United States Patent 10,266,881 (METHODS AND COMPOSITIONS FOR MULTIPLEX PCR) - sequence listing, part 3

SEQ ID NO: 63778 - DNA, 21 bp, Artificial Sequence
  Synthetic
ggucaaccaggcttuggaaac

SEQ ID NO: 63779 - DNA, 28 bp, Artificial Sequence
  Synthetic
taacgttaacacuaggtttgagtttuct

SEQ ID NO: 63780 - DNA, 24 bp, Artificial Sequence
  Synthetic
gtcctccauaaatgaagucagcgt

SEQ ID NO: 63781 - DNA, 26 bp, Artificial Sequence
  Synthetic
tctactaagctguctgtgtcctttug

SEQ ID NO: 63782 - DNA, 24 bp, Artificial Sequence
  Synthetic
tggcttcugtgatatcagugagga

SEQ ID NO: 63783 - DNA, 24 bp, Artificial Sequence
  Synthetic
cccaactgguctgtcaacguaaaa

SEQ ID NO: 63784 - DNA, 29 bp, Artificial Sequence
  Synthetic
tgctaatcgctacutctgttcatacatut

SEQ ID NO: 63785 - DNA, 28 bp, Artificial Sequence
  Synthetic
caatctcatcucccatctaggaaagtuc

SEQ ID NO: 63786 - DNA, 22 bp, Artificial Sequence
  Synthetic
aagaggaacugctttgggacug

SEQ ID NO: 63787 - DNA, 25 bp, Artificial Sequence
  Synthetic
tccttcttucaccaatgtgtccaut

SEQ ID NO: 63788 - DNA, 27 bp, Artificial Sequence
  Synthetic
gaagaatctcatuggttgtccagttug

SEQ ID NO: 63789 - DNA, 33 bp, Artificial Sequence
  Synthetic
aggtaagcaaattauaaagcaacataaaacugt

SEQ ID NO: 63790 - DNA, 24 bp, Artificial Sequence
  Synthetic
gacagacugggagttaggagguaa

SEQ ID NO: 63791 - DNA, 20 bp, Artificial Sequence
  Synthetic
tgatccugagcaacgugcag

SEQ ID NO: 63792 - DNA, 21 bp, Artificial Sequence
  Synthetic
caggugagagaagcacauggt

SEQ ID NO: 63793 - DNA, 25 bp, Artificial Sequence
  Synthetic
agtatttctctccautccctcccut

SEQ ID NO: 63794 - DNA, 21 bp, Artificial Sequence
  Synthetic
gctcccuggacctgtcctaut

SEQ ID NO: 63795 - DNA, 27 bp, Artificial Sequence
  Synthetic
gaaguggtaaaugaagaagaggacgat

SEQ ID NO: 63796 - DNA, 18 bp, Artificial Sequence
  Synthetic
cgtcgucatgggctuggt

SEQ ID NO: 63797 - DNA, 18 bp, Artificial Sequence
  Synthetic
ctcguacagcaccuccct

SEQ ID NO: 63798 - DNA, 18 bp, Artificial Sequence
  Synthetic
ggtgggugggtccuagca

SEQ ID NO: 63799 - DNA, 18 bp, Artificial Sequence
  Synthetic
cgagucgcccggagtuag

SEQ ID NO: 63800 - DNA, 17 bp, Artificial Sequence
  Synthetic
accutgctgcugcacca

SEQ ID NO: 63801 - DNA, 21 bp, Artificial Sequence
  Synthetic
ggcactucacaaggacctgua

SEQ ID NO: 63802 - DNA, 21 bp, Artificial Sequence
  Synthetic
ggutcctgcctugacacagat

SEQ ID NO: 63803 - DNA, 20 bp, Artificial Sequence
  Synthetic
cctccagcggcuacatgtug

SEQ ID NO: 63804 - DNA, 27 bp, Artificial Sequence
  Synthetic
gggtagtcctaauactgcctatcauca

SEQ ID NO: 63805 - DNA, 20 bp, Artificial Sequence
  Synthetic
ggagcccacauggcactuag

SEQ ID NO: 63806 - DNA, 23 bp, Artificial Sequence
  Synthetic
ggctgcucactgacattuacaga

SEQ ID NO: 63807 - DNA, 20 bp, Artificial Sequence
  Synthetic
ggagcugacccttgaggaug

SEQ ID NO: 63808 - DNA, 23 bp, Artificial Sequence
  Synthetic
ggagtacctagugctctgaggug

SEQ ID NO: 63809 - DNA, 25 bp, Artificial Sequence
  Synthetic
tctgagcttctutcctttgcttcut

SEQ ID NO: 63810 - DNA, 27 bp, Artificial Sequence
  Synthetic
ttccauaaagcttctuacacaggaaca

SEQ ID NO: 63811 - DNA, 24 bp, Artificial Sequence
  Synthetic
gatcctaaatugcagcaaggcuac

SEQ ID NO: 63812 - DNA, 23 bp, Artificial Sequence
  Synthetic
ccacaggaautcgtgatgaucgt

SEQ ID NO: 63813 - DNA, 22 bp, Artificial Sequence
  Synthetic
gagtcgggautgggaguaaagg

SEQ ID NO: 63814 - DNA, 25 bp, Artificial Sequence
  Synthetic
ctattggacacuctactggtggtut

SEQ ID NO: 63815 - DNA, 17 bp, Artificial Sequence
  Synthetic
ctcgccucaggccucag

SEQ ID NO: 63816 - DNA, 22 bp, Artificial Sequence
  Synthetic
gggctctcuctaaagacaugga

SEQ ID NO: 63817 - DNA, 21 bp, Artificial Sequence
  Synthetic
gcctatcugcaggacatggut

SEQ ID NO: 63818 - DNA, 21 bp, Artificial Sequence
  Synthetic
gccuggagctttugcaaggat

SEQ ID NO: 63819 - DNA, 25 bp, Artificial Sequence
  Synthetic
gtggauagaagacactctgtaugcc

SEQ ID NO: 63820 - DNA, 26 bp, Artificial Sequence
  Synthetic
tcaauattgcaaaacauggcaggaac

SEQ ID NO: 63821 - DNA, 23 bp, Artificial Sequence
  Synthetic
ggttgcucaggagattcctucaa

SEQ ID NO: 63822 - DNA, 29 bp, Artificial Sequence
  Synthetic
gctatgttttucaaaggctgattactuct

SEQ ID NO: 63823 - DNA, 23 bp, Artificial Sequence
  Synthetic
gtgacaagggugaagauggagat

SEQ ID NO: 63824 - DNA, 28 bp, Artificial Sequence
  Synthetic
tcacagcaugagagtaaugaaagaagag

SEQ ID NO: 63825 - DNA, 32 bp, Artificial Sequence
  Synthetic
tcagatatctccucctattggtattcaatuca

SEQ ID NO: 63826 - DNA, 28 bp, Artificial Sequence
  Synthetic
agcaatatctuggagtacaauaaacgca

SEQ ID NO: 63827 - DNA, 21 bp, Artificial Sequence
  Synthetic
ctcctggugagcaaggtctuc

SEQ ID NO: 63828 - DNA, 23 bp, Artificial Sequence
  Synthetic
tttccagagugaacugacacagg

SEQ ID NO: 63829 - DNA, 23 bp, Artificial Sequence
  Synthetic
cgcttaatcaugctgttggcaut

SEQ ID NO: 63830 - DNA, 23 bp, Artificial Sequence
  Synthetic
ccctgaattuccaaatgctgcut

SEQ ID NO: 63831 - DNA, 21 bp, Artificial Sequence
  Synthetic
ctgatggtcuacctggtccuc

SEQ ID NO: 63832 - DNA, 24 bp, Artificial Sequence
  Synthetic
cttggctgagguttcaatgaaugg

SEQ ID NO: 63833 - DNA, 28 bp, Artificial Sequence
  Synthetic
acccagcctaaucttgtttttcttaugt

SEQ ID NO: 63834 - DNA, 22 bp, Artificial Sequence
  Synthetic
ggaatggugctctaggaaucca

SEQ ID NO: 63835 - DNA, 18 bp, Artificial Sequence
  Synthetic
aggtccuacccucgccaa

SEQ ID NO: 63836 - DNA, 22 bp, Artificial Sequence
  Synthetic
tctgataaggcccugacctuca

SEQ ID NO: 63837 - DNA, 21 bp, Artificial Sequence
  Synthetic
gggatgucccggaactcttua

SEQ ID NO: 63838 - DNA, 25 bp, Artificial Sequence
  Synthetic
agactgucatttacctugccaaagt

SEQ ID NO: 63839 - DNA, 21 bp, Artificial Sequence
  Synthetic
ctccttctgguccagtgagug

SEQ ID NO: 63840 - DNA, 26 bp, Artificial Sequence
  Synthetic
actgtatcugccaaaaccatttgcua

SEQ ID NO: 63841 - DNA, 26 bp, Artificial Sequence
  Synthetic
ctcttttgguaggttgggauacacat

SEQ ID NO: 63842 - DNA, 21 bp, Artificial Sequence
  Synthetic
cgaggagcagauctttgguga

SEQ ID NO: 63843 - DNA, 21 bp, Artificial Sequence
  Synthetic
ctcaggcugctgtcctatuct

SEQ ID NO: 63844 - DNA, 21 bp, Artificial Sequence
  Synthetic
ccccaucccacctatgctcua

SEQ ID NO: 63845 - DNA, 24 bp, Artificial Sequence
  Synthetic
ctgatgctgacuattcctctcucc

SEQ ID NO: 63846 - DNA, 27 bp, Artificial Sequence
  Synthetic
ccaagacattttaauggtgagcatcug

SEQ ID NO: 63847 - DNA, 20 bp, Artificial Sequence
  Synthetic
tccugaacggccaacugaag

SEQ ID NO: 63848 - DNA, 26 bp, Artificial Sequence
  Synthetic
ctcccacaccggaaautttataaugg

SEQ ID NO: 63849 - DNA, 28 bp, Artificial Sequence
  Synthetic
aagccaaacacagaguattggatcttua

SEQ ID NO: 63850 - DNA, 26 bp, Artificial Sequence
  Synthetic
tccuaagtcugcaaaggagagagaat

SEQ ID NO: 63851 - DNA, 27 bp, Artificial Sequence
  Synthetic
gaggtttatugacaagacttctgcuct

SEQ ID NO: 63852 - DNA, 27 bp, Artificial Sequence
  Synthetic
agttcactuaccattcggatatucagg

SEQ ID NO: 63853 - DNA, 26 bp, Artificial Sequence
  Synthetic
actttugggaccaagagtgaaaugag

SEQ ID NO: 63854 - DNA, 28 bp, Artificial Sequence
  Synthetic
agagatgtgacugtaaacttttgcgtua

SEQ ID NO: 63855 - DNA, 27 bp, Artificial Sequence
  Synthetic
gtgccagaauggattctacaatcuaca

SEQ ID NO: 63856 - DNA, 23 bp, Artificial Sequence
  Synthetic
caggccuacctcatcatgaucag

SEQ ID NO: 63857 - DNA, 21 bp, Artificial Sequence
  Synthetic
cctcugcagaaagggaugcaa

SEQ ID NO: 63858 - DNA, 23 bp, Artificial Sequence
  Synthetic
gcatcaagaggucactgtctcua

SEQ ID NO: 63859 - DNA, 22 bp, Artificial Sequence
  Synthetic
gctattaggucagtguggcaga

SEQ ID NO: 63860 - DNA, 21 bp, Artificial Sequence
  Synthetic
gctggccuctaacccttgtug

SEQ ID NO: 63861 - DNA, 22 bp, Artificial Sequence
  Synthetic
ttaucgcaaggcttgugaacag

SEQ ID NO: 63862 - DNA, 25 bp, Artificial Sequence
  Synthetic
tcagagggcugaattttucaaggaa

SEQ ID NO: 63863 - DNA, 21 bp, Artificial Sequence
  Synthetic
agccauaggcctgtgtcuaca

SEQ ID NO: 63864 - DNA, 21 bp, Artificial Sequence
  Synthetic
ggagcaggaggaccuttcuga

SEQ ID NO: 63865 - DNA, 23 bp, Artificial Sequence
  Synthetic
aggctuacggactctauaggcaa

SEQ ID NO: 63866 - DNA, 27 bp, Artificial Sequence
  Synthetic
gggaaaatguggcttctgataaaauac

SEQ ID NO: 63867 - DNA, 25 bp, Artificial Sequence
  Synthetic
acagcttcauaacaaggagcauacc

SEQ ID NO: 63868 - DNA, 26 bp, Artificial Sequence
  Synthetic
ctcctacugttgtgttgauagaaggg

SEQ ID NO: 63869 - DNA, 23 bp, Artificial Sequence
  Synthetic
tcagtgtgaacaucatggtgugt

SEQ ID NO: 63870 - DNA, 25 bp, Artificial Sequence
  Synthetic
gtagtgttagucctttgtgccuaca

SEQ ID NO: 63871 - DNA, 22 bp, Artificial Sequence
  Synthetic
ccacccagacautagcaggtuc

SEQ ID NO: 63872 - DNA, 22 bp, Artificial Sequence
  Synthetic
aaautcagcaucaaacgcagca

SEQ ID NO: 63873 - DNA, 28 bp, Artificial Sequence
  Synthetic
ctccctagaagacugatatcatcacuga

SEQ ID NO: 63874 - DNA, 23 bp, Artificial Sequence
  Synthetic
ggcatcttucacaacgaggacut

SEQ ID NO: 63875 - DNA, 22 bp, Artificial Sequence
  Synthetic
tgcaattuaactggctcuggca

SEQ ID NO: 63876 - DNA, 33 bp, Artificial Sequence
  Synthetic
aataaagtaacuaagtggttaatcttuggacaa

SEQ ID NO: 63877 - DNA, 23 bp, Artificial Sequence
  Synthetic
gctgcatcauagaaggtcucagt

SEQ ID NO: 63878 - DNA, 28 bp, Artificial Sequence
  Synthetic
tggaaaaacagucatcaatggattcuga

SEQ ID NO: 63879 - DNA, 28 bp, Artificial Sequence
  Synthetic
gggcatgtatuagagaaagttcacttua

SEQ ID NO: 63880 - DNA, 27 bp, Artificial Sequence
  Synthetic
caactaatguggaagatgtttguccaa

SEQ ID NO: 63881 - DNA, 22 bp, Artificial Sequence
  Synthetic
ccaccaacgagacaugtagcug

SEQ ID NO: 63882 - DNA, 23 bp, Artificial Sequence
  Synthetic
aacaaaagtugaggcagctucac

SEQ ID NO: 63883 - DNA, 28 bp, Artificial Sequence
  Synthetic
tgagcctaaautattacggtatugcact

SEQ ID NO: 63884 - DNA, 27 bp, Artificial Sequence
  Synthetic
gcagagtaactuggataaagacgguat

SEQ ID NO: 63885 - DNA, 30 bp, Artificial Sequence
  Synthetic
ttacagcattcuttaaaacgacaaugacaa

SEQ ID NO: 63886 - DNA, 26 bp, Artificial Sequence
  Synthetic
ttgctgaataagugtaaaaccccuca

SEQ ID NO: 63887 - DNA, 28 bp, Artificial Sequence
  Synthetic
gtataatcatgtggguaactgcaggtua

SEQ ID NO: 63888 - DNA, 26 bp, Artificial Sequence
  Synthetic
ggtgatagtacucatggcccaaatug

SEQ ID NO: 63889 - DNA, 26 bp, Artificial Sequence
  Synthetic
ccttcucacaggacagagacauacat

SEQ ID NO: 63890 - DNA, 26 bp, Artificial Sequence
  Synthetic
catgttugcaacccattttcaugaac

SEQ ID NO: 63891 - DNA, 28 bp, Artificial Sequence
  Synthetic
ggtagtaagttucccattaccaagtuct

SEQ ID NO: 63892 - DNA, 20 bp, Artificial Sequence
  Synthetic
ccccagcucctgcaacttut

SEQ ID NO: 63893 - DNA, 19 bp, Artificial Sequence
  Synthetic
cugggacccaagggucaag

SEQ ID NO: 63894 - DNA, 23 bp, Artificial Sequence
  Synthetic
agaaaggtccaggugaggtaguc

SEQ ID NO: 63895 - DNA, 29 bp, Artificial Sequence
  Synthetic
attctttattacuccttctccctcuccaa

SEQ ID NO: 63896 - DNA, 22 bp, Artificial Sequence
  Synthetic
agacaaugacaggcttctuggg

SEQ ID NO: 63897 - DNA, 21 bp, Artificial Sequence
  Synthetic
catccagguaggacccacuct

SEQ ID NO: 63898 - DNA, 21 bp, Artificial Sequence
  Synthetic
cgggacaaagugcaagacaut

SEQ ID NO: 63899 - DNA, 25 bp, Artificial Sequence
  Synthetic
gaggtgattcugcaccatgagtaut

SEQ ID NO: 63900 - DNA, 22 bp, Artificial Sequence
  Synthetic
gcccgtctucttgtcgtactug

SEQ ID NO: 63901 - DNA, 23 bp, Artificial Sequence
  Synthetic
gctaagaaccaugagctgtguct

SEQ ID NO: 63902 - DNA, 28 bp, Artificial Sequence
  Synthetic
ttggtgaatcaaacautcgaaagaaugg

SEQ ID NO: 63903 - DNA, 26 bp, Artificial Sequence
  Synthetic
agcctcattugtctaactgtugaact

SEQ ID NO: 63904 - DNA, 27 bp, Artificial Sequence
  Synthetic
ggaaacuccacaccatattcuacaaga

SEQ ID NO: 63905 - DNA, 28 bp, Artificial Sequence
  Synthetic
ccaacatgatatugatggcacttcttut

SEQ ID NO: 63906 - DNA, 22 bp, Artificial Sequence
  Synthetic
catccaucaaggccugggaaat

SEQ ID NO: 63907 - DNA, 27 bp, Artificial Sequence
  Synthetic
cctgtgacucaagtattagcuaagcag

SEQ ID NO: 63908 - DNA, 21 bp, Artificial Sequence
  Synthetic
gctttguggaaaggctugcat

SEQ ID NO: 63909 - DNA, 23 bp, Artificial Sequence
  Synthetic
cagaguauggaagggagacagag

SEQ ID NO: 63910 - DNA, 25 bp, Artificial Sequence
  Synthetic
gtagtagtguctgagggagaucagt

SEQ ID NO: 63911 - DNA, 28 bp, Artificial Sequence
  Synthetic
ctttgcagaacaaaauccaaggatguat

SEQ ID NO: 63912 - DNA, 28 bp, Artificial Sequence
  Synthetic
tggttgaaautatctatgaugacaccaa

SEQ ID NO: 63913 - DNA, 27 bp, Artificial Sequence
  Synthetic
cctaggauagcactgtttgaatuacct

SEQ ID NO: 63914 - DNA, 28 bp, Artificial Sequence
  Synthetic
ggcaaccttaguttatgtttaccaguct

SEQ ID NO: 63915 - DNA, 28 bp, Artificial Sequence
  Synthetic
ggaatctttgcagcugaaatggtatuaa

SEQ ID NO: 63916 - DNA, 21 bp, Artificial Sequence
  Synthetic
acccatgcaguttgctcacut

SEQ ID NO: 63917 - DNA, 28 bp, Artificial Sequence
  Synthetic
catcagggctcutgataaccttagatut

SEQ ID NO: 63918 - DNA, 22 bp, Artificial Sequence
  Synthetic
agtgctcttguctcaccacaut

SEQ ID NO: 63919 - DNA, 21 bp, Artificial Sequence
  Synthetic
agtgttggugtcatctgcugt

SEQ ID NO: 63920 - DNA, 32 bp, Artificial Sequence
  Synthetic
atctgtattacatugagtttttacctacctut

SEQ ID NO: 63921 - DNA, 24 bp, Artificial Sequence
  Synthetic
gttgttaaggcacuggcaaaacut

SEQ ID NO: 63922 - DNA, 26 bp, Artificial Sequence
  Synthetic
tgttgctauctaggttagugaaggct

SEQ ID NO: 63923 - DNA, 28 bp, Artificial Sequence
  Synthetic
tcatttgtcttgccuttcttctgtcuaa

SEQ ID NO: 63924 - DNA, 28 bp, Artificial Sequence
  Synthetic
agcatgacacaaugggaagatuaaagaa

SEQ ID NO: 63925 - DNA, 27 bp, Artificial Sequence
  Synthetic
gtggacctgtaauatctttctgtgcua

SEQ ID NO: 63926 - DNA, 24 bp, Artificial Sequence
  Synthetic
gggaauggagcaaaacagtcttug

SEQ ID NO: 63927 - DNA, 28 bp, Artificial Sequence
  Synthetic
cuggttgacaagatuagaacaagaggaa

SEQ ID NO: 63928 - DNA, 22 bp, Artificial Sequence
  Synthetic
ttacaggtugcccatcttcucc

SEQ ID NO: 63929 - DNA, 22 bp, Artificial Sequence
  Synthetic
tgccctccutggtgtttcttuc

SEQ ID NO: 63930 - DNA, 25 bp, Artificial Sequence
  Synthetic
caagacaaaugcattcucacaccat

SEQ ID NO: 63931 - DNA, 24 bp, Artificial Sequence
  Synthetic
caautttgtgcuagggagaacgag

SEQ ID NO: 63932 - DNA, 23 bp, Artificial Sequence
  Synthetic
atctttuccaggagctcccuagt

SEQ ID NO: 63933 - DNA, 28 bp, Artificial Sequence
  Synthetic
tggaggaggtaugtttttgacaaatuga

SEQ ID NO: 63934 - DNA, 28 bp, Artificial Sequence
  Synthetic
cagaattcagugcactaucaaacacaat

SEQ ID NO: 63935 - DNA, 28 bp, Artificial Sequence
  Synthetic
cagtctaagattgaucgagacaagtcut

SEQ ID NO: 63936 - DNA, 22 bp, Artificial Sequence
  Synthetic
tgccatgtcutgacactcagut

SEQ ID NO: 63937 - DNA, 29 bp, Artificial Sequence
  Synthetic
cacattactgutctcattgtttuccacat

SEQ ID NO: 63938 - DNA, 21 bp, Artificial Sequence
  Synthetic
cttcgtcagauccatcgggut

SEQ ID NO: 63939 - DNA, 21 bp, Artificial Sequence
  Synthetic
gagtcacccccauctctctuc

SEQ ID NO: 63940 - DNA, 19 bp, Artificial Sequence
  Synthetic
cccagcutgcttccuccat

SEQ ID NO: 63941 - DNA, 29 bp, Artificial Sequence
  Synthetic
cagtaagaagccuctaatctgtttuagca

SEQ ID NO: 63942 - DNA, 20 bp, Artificial Sequence
  Synthetic
cctcatuccacagccctgua

SEQ ID NO: 63943 - DNA, 21 bp, Artificial Sequence
  Synthetic
gggaguggagtgagugaggag

SEQ ID NO: 63944 - DNA, 21 bp, Artificial Sequence
  Synthetic
cctgaauccgcactctguacc

SEQ ID NO: 63945 - DNA, 23 bp, Artificial Sequence
  Synthetic
gcaggacacugatgttuccaaat

SEQ ID NO: 63946 - DNA, 25 bp, Artificial Sequence
  Synthetic
gtgagatccaucagtagtacaggua

SEQ ID NO: 63947 - DNA, 25 bp, Artificial Sequence
  Synthetic
cagtctcctguaattctcaggctug

SEQ ID NO: 63948 - DNA, 24 bp, Artificial Sequence
  Synthetic
gtttgcacauaaatcuccaaggca

SEQ ID NO: 63949 - DNA, 25 bp, Artificial Sequence
  Synthetic
ttgaaaccagagucctuaacaagca

SEQ ID NO: 63950 - DNA, 21 bp, Artificial Sequence
  Synthetic
gtggcaccucatcaccttuct

SEQ ID NO: 63951 - DNA, 20 bp, Artificial Sequence
  Synthetic
cguguccgagcaacaaggat

SEQ ID NO: 63952 - DNA, 21 bp, Artificial Sequence
  Synthetic
cctggtgcuttggtcaaugaa

SEQ ID NO: 63953 - DNA, 23 bp, Artificial Sequence
  Synthetic
gtagcuctgcttgtucacacact

SEQ ID NO: 63954 - DNA, 23 bp, Artificial Sequence
  Synthetic
cgctgtgcugttttcatcatcug

SEQ ID NO: 63955 - DNA, 21 bp, Artificial Sequence
  Synthetic
agagcacatgucatggtcgug

SEQ ID NO: 63956 - DNA, 22 bp, Artificial Sequence
  Synthetic
cagaagactgugaggaccauca

SEQ ID NO: 63957 - DNA, 22 bp, Artificial Sequence
  Synthetic
cccttattcugtccccaccuct

SEQ ID NO: 63958 - DNA, 22 bp, Artificial Sequence
  Synthetic
caaguggaagcaaccgttctuc

SEQ ID NO: 63959 - DNA, 25 bp, Artificial Sequence
  Synthetic
gtttcattuccagcaggtaagctut

SEQ ID NO: 63960 - DNA, 21 bp, Artificial Sequence
  Synthetic
tctagaacccugacugggcat

SEQ ID NO: 63961 - DNA, 22 bp, Artificial Sequence
  Synthetic
gcucctcucccaagaacaacag

SEQ ID NO: 63962 - DNA, 23 bp, Artificial Sequence
  Synthetic
ggaggttcaugttttgtgcctug

SEQ ID NO: 63963 - DNA, 28 bp, Artificial Sequence
  Synthetic
ctgaggatacutaaaggtacugaaaggt

SEQ ID NO: 63964 - DNA, 27 bp, Artificial Sequence
  Synthetic
ccgataatctaucacactaggtgctut

SEQ ID NO: 63965 - DNA, 20 bp, Artificial Sequence
  Synthetic
agtacaccugcaaggctguc

SEQ ID NO: 63966 - DNA, 20 bp, Artificial Sequence
  Synthetic
cctgaggcccacguatctug

SEQ ID NO: 63967 - DNA, 21 bp, Artificial Sequence
  Synthetic
agguggagaacagcgagaaug

SEQ ID NO: 63968 - DNA, 21 bp, Artificial Sequence
  Synthetic
tccactgcuggagcugaaaat

SEQ ID NO: 63969 - DNA, 26 bp, Artificial Sequence
  Synthetic
gcttctgacctuaacttagtgcctut

SEQ ID NO: 63970 - DNA, 20 bp, Artificial Sequence
  Synthetic
gggcgaaccucactaacgug

SEQ ID NO: 63971 - DNA, 23 bp, Artificial Sequence
  Synthetic
ctatagucggccacagagtccua

SEQ ID NO: 63972 - DNA, 28 bp, Artificial Sequence
  Synthetic
ggtgctgtatuacctgttgaaagtaugt

SEQ ID NO: 63973 - DNA, 29 bp, Artificial Sequence
  Synthetic
acacaaaagaugaaacaauggaagaacaa

SEQ ID NO: 63974 - DNA, 28 bp, Artificial Sequence
  Synthetic
tcttgtgctgcuttatccaattcuaact

SEQ ID NO: 63975 - DNA, 23 bp, Artificial Sequence
  Synthetic
catcataggcacugactcugcaa

SEQ ID NO: 63976 - DNA, 19 bp, Artificial Sequence
  Synthetic
cctgctucctgacgcugac

SEQ ID NO: 63977 - DNA, 20 bp, Artificial Sequence
  Synthetic
gccagcccugaatggacauc

SEQ ID NO: 63978 - DNA, 21 bp, Artificial Sequence
  Synthetic
tgtgggaaggccauccctaua

SEQ ID NO: 63979 - DNA, 23 bp, Artificial Sequence
  Synthetic
cggtgctucttgctgatauggat

SEQ ID NO: 63980 - DNA, 27 bp, Artificial Sequence
  Synthetic
gcaaaacagaaauacacatcugacact

SEQ ID NO: 63981 - DNA, 25 bp, Artificial Sequence
  Synthetic
ggattttgcugcttgtggaauagac

SEQ ID NO: 63982 - DNA, 26 bp, Artificial Sequence
  Synthetic
caggacagctuatctctgaaacauga

SEQ ID NO: 63983 - DNA, 27 bp, Artificial Sequence
  Synthetic
accctacttacuaaatgaagacuggga

SEQ ID NO: 63984 - DNA, 24 bp, Artificial Sequence
  Synthetic
ccggaataatuccttgctcgtgua

SEQ ID NO: 63985 - DNA, 28 bp, Artificial Sequence
  Synthetic
ccccagggcuattttatagagtauaggt

SEQ ID NO: 63986 - DNA, 28 bp, Artificial Sequence
  Synthetic
gattatccuaacccatcactcaugaaca

SEQ ID NO: 63987 - DNA, 26 bp, Artificial Sequence
  Synthetic
tttccagtguggtgtaaaggaatuca

SEQ ID NO: 63988 - DNA, 20 bp, Artificial Sequence
  Synthetic
gctcatuggctcacaucgca

SEQ ID NO: 63989 - DNA, 24 bp, Artificial Sequence
  Synthetic
gctgaagctagucagtcactcaua

SEQ ID NO: 63990 - DNA, 26 bp, Artificial Sequence
  Synthetic
agaatctagaguctggagtttugcct

SEQ ID NO: 63991 - DNA, 28 bp, Artificial Sequence
  Synthetic
ggtaacatatcauagtgggcttttcugt

SEQ ID NO: 63992 - DNA, 23 bp, Artificial Sequence
  Synthetic
gcaaatcaaaugtgggugaagca

SEQ ID NO: 63993 - DNA, 28 bp, Artificial Sequence
  Synthetic
actctaccugaattgcactauagcagat

SEQ ID NO: 63994 - DNA, 23 bp, Artificial Sequence
  Synthetic
cctcgutgaatgtcucaccaaga

SEQ ID NO: 63995 - DNA, 23 bp, Artificial Sequence
  Synthetic
ccagugcctcaatuaaccacaca

SEQ ID NO: 63996 - DNA, 27 bp, Artificial Sequence
  Synthetic
tcctcacattauaagcacttgggagua

SEQ ID NO: 63997 - DNA, 28 bp, Artificial Sequence
  Synthetic
ggaagtttgtaaucaaccctgtuaggat

SEQ ID NO: 63998 - DNA, 28 bp, Artificial Sequence
  Synthetic
cctggtgcuggaaaatcaacatttauag

SEQ ID NO: 63999 - DNA, 24 bp, Artificial Sequence
  Synthetic
cgagaccaaacutagctagcagut

SEQ ID NO: 64000 - DNA, 18 bp, Artificial Sequence
  Synthetic
cccccaucgagaggguca

SEQ ID NO: 64001 - DNA, 18 bp, Artificial Sequence
  Synthetic
ggccuggcgcagatttuc

SEQ ID NO: 64002 - DNA, 27 bp, Artificial Sequence
  Synthetic
cctgtgtugataatgtcauccaaacga

SEQ ID NO: 64003 - DNA, 24 bp, Artificial Sequence
  Synthetic
gggacaagaggaacaugaaacuca

SEQ ID NO: 64004 - DNA, 23 bp, Artificial Sequence
  Synthetic
cccaaggcaaugatggaatcugt

SEQ ID NO: 64005 - DNA, 18 bp, Artificial Sequence
  Synthetic
caggcccgcaaguacauc

SEQ ID NO: 64006 - DNA, 26 bp, Artificial Sequence
  Synthetic
agagtgagaaacucttcatgctugac

SEQ ID NO: 64007 - DNA, 28 bp, Artificial Sequence
  Synthetic
ggcagtgggauaagcctgatttaaauat

SEQ ID NO: 64008 - DNA, 24 bp, Artificial Sequence
  Synthetic
gcagaaaaatuggcacacacacua

SEQ ID NO: 64009 - DNA, 20 bp, Artificial Sequence
  Synthetic
gtgatcggautcccauggct

SEQ ID NO: 64010 - DNA, 27 bp, Artificial Sequence
  Synthetic
caatcccaauttccatucaggaaaaca

SEQ ID NO: 64011 - DNA, 25 bp, Artificial Sequence
  Synthetic
gcagcccagcaaauttccattatuc

SEQ ID NO: 64012 - DNA, 21 bp, Artificial Sequence
  Synthetic
ccctctgccaugacaggttua

SEQ ID NO: 64013 - DNA, 26 bp, Artificial Sequence
  Synthetic
actttcttugggaaggacaagucaat

SEQ ID NO: 64014 - DNA, 22 bp, Artificial Sequence
  Synthetic
tcccattcccugggaattccua

SEQ ID NO: 64015 - DNA, 23 bp, Artificial Sequence
  Synthetic
agcccagttucaagaaagagcut

SEQ ID NO: 64016 - DNA, 26 bp, Artificial Sequence
  Synthetic
caatacctgguatttagtggccaugt

SEQ ID NO: 64017 - DNA, 23 bp, Artificial Sequence
  Synthetic
cagcuctgcttucacaagacaaa

SEQ ID NO: 64018 - DNA, 28 bp, Artificial Sequence
  Synthetic
agcgtctatattutgctctttgaaauga

SEQ ID NO: 64019 - DNA, 27 bp, Artificial Sequence
  Synthetic
ttgttgauaattggaagaugcaggact

SEQ ID NO: 64020 - DNA, 29 bp, Artificial Sequence
  Synthetic
agaagaacutaaacagaaugagagcagaa

SEQ ID NO: 64021 - DNA, 22 bp, Artificial Sequence
  Synthetic
aggatgcccaucactctttugt

SEQ ID NO: 64022 - DNA, 23 bp, Artificial Sequence
  Synthetic
agttgtcagucctgcattucagt

SEQ ID NO: 64023 - DNA, 29 bp, Artificial Sequence
  Synthetic
attacaagtagacaugtgaagcugaagaa

SEQ ID NO: 64024 - DNA, 28 bp, Artificial Sequence
  Synthetic
aggagaaaguggagtttgtgaaauagac

SEQ ID NO: 64025 - DNA, 25 bp, Artificial Sequence
  Synthetic
ggtctgtaaucttcttcacctugct

SEQ ID NO: 64026 - DNA, 27 bp, Artificial Sequence
  Synthetic
ggttcatcagutcagtaacaagucaac

SEQ ID NO: 64027 - DNA, 28 bp, Artificial Sequence
  Synthetic
gcaaaactaaugtaaggacaugcaaaga

SEQ ID NO: 64028 - DNA, 23 bp, Artificial Sequence
  Synthetic
ggauagaggaggaggcactucag

SEQ ID NO: 64029 - DNA, 33 bp, Artificial Sequence
  Synthetic
tacattacttggugtacatttaatagacugaca

SEQ ID NO: 64030 - DNA, 29 bp, Artificial Sequence
  Synthetic
acaaggaagtatugaagatgaagctaugg

SEQ ID NO: 64031 - DNA, 23 bp, Artificial Sequence
  Synthetic
acatccugagggtaaggcuaaca

SEQ ID NO: 64032 - DNA, 27 bp, Artificial Sequence
  Synthetic
agcactttagguagagaagttugcaat

SEQ ID NO: 64033 - DNA, 28 bp, Artificial Sequence
  Synthetic
agcgtaataccaguctttttcctttuct

SEQ ID NO: 64034 - DNA, 26 bp, Artificial Sequence
  Synthetic
tagcagatguacttctgtcagtucac

SEQ ID NO: 64035 - DNA, 23 bp, Artificial Sequence
  Synthetic
tgttttactuctgcttgguggca

SEQ ID NO: 64036 - DNA, 28 bp, Artificial Sequence
  Synthetic
cagugacatugaccaagaaaacaacaat

SEQ ID NO: 64037 - DNA, 27 bp, Artificial Sequence
  Synthetic
caacaggtcaucttcagagtcaauact

SEQ ID NO: 64038 - DNA, 20 bp, Artificial Sequence
  Synthetic
gtacgtggugtcctgtguct

SEQ ID NO: 64039 - DNA, 17 bp, Artificial Sequence
  Synthetic
gctgcuctgcgagucct

SEQ ID NO: 64040 - DNA, 21 bp, Artificial Sequence
  Synthetic
ggctcugaaccgcatucaagt

SEQ ID NO: 64041 - DNA, 22 bp, Artificial Sequence
  Synthetic
cctacggutataacgccuaccc

SEQ ID NO: 64042 - DNA, 27 bp, Artificial Sequence
  Synthetic
ggtgaccattttuctgatgtgcattuc

SEQ ID NO: 64043 - DNA, 21 bp, Artificial Sequence
  Synthetic
tgttcatgcgcutacgaggut

SEQ ID NO: 64044 - DNA, 26 bp, Artificial Sequence
  Synthetic
atgacttgcagucttgtgatcugaat

SEQ ID NO: 64045 - DNA, 27 bp, Artificial Sequence
  Synthetic
tttccttcagggauatcaatgtucagg

SEQ ID NO: 64046 - DNA, 22 bp, Artificial Sequence
  Synthetic
acuctgaatgcaucaaccgcat

SEQ ID NO: 64047 - DNA, 25 bp, Artificial Sequence
  Synthetic
aagcaacugcaaagaggagaaagua

SEQ ID NO: 64048 - DNA, 22 bp, Artificial Sequence
  Synthetic
tcatccacaccutcggactgua

SEQ ID NO: 64049 - DNA, 26 bp, Artificial Sequence
  Synthetic
atccagttuggaaatgaaaagcaucc

SEQ ID NO: 64050 - DNA, 22 bp, Artificial Sequence
  Synthetic
aggcctagcaccutgataccua

SEQ ID NO: 64051 - DNA, 21 bp, Artificial Sequence
  Synthetic
cgaatcttcugcagctccauc

SEQ ID NO: 64052 - DNA, 24 bp, Artificial Sequence
  Synthetic
agtcauctttgtctucagcccaaa

SEQ ID NO: 64053 - DNA, 20 bp, Artificial Sequence
  Synthetic
gtcaccguagaggaccugga

SEQ ID NO: 64054 - DNA, 20 bp, Artificial Sequence
  Synthetic
gaaaagguggaggcuggact

SEQ ID NO: 64055 - DNA, 20 bp, Artificial Sequence
  Synthetic
ggcgaatucgactcctucgt

SEQ ID NO: 64056 - DNA, 18 bp, Artificial Sequence
  Synthetic
caccucgcctcacucaca

SEQ ID NO: 64057 - DNA, 19 bp, Artificial Sequence
  Synthetic
ccgctucgactcctucact

SEQ ID NO: 64058 - DNA, 19 bp, Artificial Sequence
  Synthetic
gccccucactcacctguca

SEQ ID NO: 64059 - DNA, 20 bp, Artificial Sequence
  Synthetic
gcagctucgactcttucacc

SEQ ID NO: 64060 - DNA, 24 bp, Artificial Sequence
  Synthetic
cutgttcgcaatuccaaacagagt

SEQ ID NO: 64061 - DNA, 22 bp, Artificial Sequence
  Synthetic
ccagttugacaccttcatgguc

SEQ ID NO: 64062 - DNA, 22 bp, Artificial Sequence
  Synthetic
ccacccucttctgtgaucacct

SEQ ID NO: 64063 - DNA, 22 bp, Artificial Sequence
  Synthetic
cagtcctugcttcagagguaca

SEQ ID NO: 64064 - DNA, 22 bp, Artificial Sequence
  Synthetic
gcccuggguaagagaagagagt

SEQ ID NO: 64065 - DNA, 28 bp, Artificial Sequence
  Synthetic
ttctctaatatctugtctgccttcucct

SEQ ID NO: 64066 - DNA, 21 bp, Artificial Sequence
  Synthetic
gggaactcagcutccttccug

SEQ ID NO: 64067 - DNA, 23 bp, Artificial Sequence
  Synthetic
cttcccacuccttgactctgtut

SEQ ID NO: 64068 - DNA, 22 bp, Artificial Sequence
  Synthetic
ggaagccuggagaactagguca

SEQ ID NO: 64069 - DNA, 23 bp, Artificial Sequence
  Synthetic
gcttgttcugacacttccctugt

SEQ ID NO: 64070 - DNA, 21 bp, Artificial Sequence
  Synthetic
agcacaaccaucccctcatuc

SEQ ID NO: 64071 - DNA, 24 bp, Artificial Sequence
  Synthetic
cacctgaccccuactcttttgtuc

SEQ ID NO: 64072 - DNA, 22 bp, Artificial Sequence
  Synthetic
ggcagaugaaggtaaucacgga

SEQ ID NO: 64073 - DNA, 28 bp, Artificial Sequence
  Synthetic
caagcttctactuaacgccttaacagua

SEQ ID NO: 64074 - DNA, 19 bp, Artificial Sequence
  Synthetic
aggguacaucagccccaga

SEQ ID NO: 64075 - DNA, 20 bp, Artificial Sequence
  Synthetic
tccccagagccucctaacut

SEQ ID NO: 64076 - DNA, 28 bp, Artificial Sequence
  Synthetic
agaaggtgaaugaaggtgaaaaagtcut

SEQ ID NO: 64077 - DNA, 28 bp, Artificial Sequence
  Synthetic
tgccataatttctautaggctgggttut

SEQ ID NO: 64078 - DNA, 30 bp, Artificial Sequence
  Synthetic
gcatgttguaaaaattcctacatucaagga

SEQ ID NO: 64079 - DNA, 26 bp, Artificial Sequence
  Synthetic
aagcttactgguaccatccaaaauga

SEQ ID NO: 64080 - DNA, 28 bp, Artificial Sequence
  Synthetic
tctttcgaguattactattucccagcct

SEQ ID NO: 64081 - DNA, 24 bp, Artificial Sequence
  Synthetic
actctggttcagucagcttcctua

SEQ ID NO: 64082 - DNA, 28 bp, Artificial Sequence
  Synthetic
aactggatauaacttctgaatugcccaa

SEQ ID NO: 64083 - DNA, 28 bp, Artificial Sequence
  Synthetic
gatggcaagagugatggattacaaauaa

SEQ ID NO: 64084 - DNA, 24 bp, Artificial Sequence
  Synthetic
cataatcagatcuggctgggtuca

SEQ ID NO: 64085 - DNA, 24 bp, Artificial Sequence
  Synthetic
ctgaaacauggcaaggtgtugaag

SEQ ID NO: 64086 - DNA, 28 bp, Artificial Sequence
  Synthetic
tccctcaaaucccacatatcatctauca

SEQ ID NO: 64087 - DNA, 24 bp, Artificial Sequence
  Synthetic
ccttccauaagcatctgagcucac

SEQ ID NO: 64088 - DNA, 23 bp, Artificial Sequence
  Synthetic
gcagcttcuccctctcattagug

SEQ ID NO: 64089 - DNA, 28 bp, Artificial Sequence
  Synthetic
agatttggagtgaugtcctcagttcuat

SEQ ID NO: 64090 - DNA, 21 bp, Artificial Sequence
  Synthetic
aaggtccacacgugttcguag

SEQ ID NO: 64091 - DNA, 28 bp, Artificial Sequence
  Synthetic
tgaggatgaaacuctgtaaggtggatua

SEQ ID NO: 64092 - DNA, 21 bp, Artificial Sequence
  Synthetic
gctccaugggacuggaaagag

SEQ ID NO: 64093 - DNA, 21 bp, Artificial Sequence
  Synthetic
tggagccaugtactaccugga

SEQ ID NO: 64094 - DNA, 21 bp, Artificial Sequence
  Synthetic
ccagctcaugagggaccauaa

SEQ ID NO: 64095 - DNA, 29 bp, Artificial Sequence
  Synthetic
tgtatatggcuggattatcacuggaagat

SEQ ID NO: 64096 - DNA, 25 bp, Artificial Sequence
  Synthetic
tgataacttgucggatacagcctug

SEQ ID NO: 64097 - DNA, 27 bp, Artificial Sequence
  Synthetic
atgtaacagaaaaggccuccacuaaaa

SEQ ID NO: 64098 - DNA, 26 bp, Artificial Sequence
  Synthetic
ttccttcuccaggacaaactucaaaa

SEQ ID NO: 64099 - DNA, 32 bp, Artificial Sequence
  Synthetic
actagtgttaccutttcaaatgaatgcuaact

SEQ ID NO: 64100 - DNA, 21 bp, Artificial Sequence
  Synthetic
agagacaucctggtggugagt

SEQ ID NO: 64101 - DNA, 22 bp, Artificial Sequence
  Synthetic
tcagctccuatggacttcugct

SEQ ID NO: 64102 - DNA, 28 bp, Artificial Sequence
  Synthetic
gtgaagttugaacagtgtatgagaucct

SEQ ID NO: 64103 - DNA, 28 bp, Artificial Sequence
  Synthetic
ccttcacaaacuatctcttcagactuga

SEQ ID NO: 64104 - DNA, 25 bp, Artificial Sequence
  Synthetic
agctgccutagttacataaugagca

SEQ ID NO: 64105 - DNA, 28 bp, Artificial Sequence
  Synthetic
ctctgaaccutgcaaaaataauggaaca

SEQ ID NO: 64106 - DNA, 28 bp, Artificial Sequence
  Synthetic
agttttctguacctgaaattgtugacca

SEQ ID NO: 64107 - DNA, 28 bp, Artificial Sequence
  Synthetic
gattgctcatccauactcatctcauact

SEQ ID NO: 64108 - DNA, 28 bp, Artificial Sequence
  Synthetic
acattgttaccaugaaacagttcgauga

SEQ ID NO: 64109 - DNA, 26 bp, Artificial Sequence
  Synthetic
gctggcaacaugtatctggaaaauac

SEQ ID NO: 64110 - DNA, 29 bp, Artificial Sequence
  Synthetic
gcttgctcaucccaattttctcttttaut

SEQ ID NO: 64111 - DNA, 23 bp, Artificial Sequence
  Synthetic
agttcugccaggaatctcugagt

SEQ ID NO: 64112 - DNA, 27 bp, Artificial Sequence
  Synthetic
gccttcatggtuttattaacccccaua

SEQ ID NO: 64113 - DNA, 26 bp, Artificial Sequence
  Synthetic
ccacccaauaaggttcacttgaaaut

SEQ ID NO: 64114 - DNA, 28 bp, Artificial Sequence
  Synthetic
agtattaagguactgaagauaggcaggt

SEQ ID NO: 64115 - DNA, 22 bp, Artificial Sequence
  Synthetic
cattgcagguggcttacaagut

SEQ ID NO: 64116 - DNA, 21 bp, Artificial Sequence
  Synthetic
acaggaccacgagugtgatuc

SEQ ID NO: 64117 - DNA, 25 bp, Artificial Sequence
  Synthetic
agtcttccucctgaaaaacgucaaa

SEQ ID NO: 64118 - DNA, 24 bp, Artificial Sequence
  Synthetic
gagacggtuacagggaaaaacugt

SEQ ID NO: 64119 - DNA, 27 bp, Artificial Sequence
  Synthetic
cttcccataaaguagcttgccaattut

SEQ ID NO: 64120 - DNA, 27 bp, Artificial Sequence
  Synthetic
gcgtattaatgutgccagtttcaugat

SEQ ID NO: 64121 - DNA, 23 bp, Artificial Sequence
  Synthetic
tctctctgaaguccggaatcugt

SEQ ID NO: 64122 - DNA, 22 bp, Artificial Sequence
  Synthetic
agacactaugcccctctuggat

SEQ ID NO: 64123 - DNA, 28 bp, Artificial Sequence
  Synthetic
caaaacaaagacaaaaugtggcagtaut

SEQ ID NO: 64124 - DNA, 25 bp, Artificial Sequence
  Synthetic
ggtttgcattugtcaatgtgcatuc

SEQ ID NO: 64125 - DNA, 21 bp, Artificial Sequence
  Synthetic
gcaccagaugcuaagccacaa

SEQ ID NO: 64126 - DNA, 19 bp, Artificial Sequence
  Synthetic
gccataaugggcgctucct

SEQ ID NO: 64127 - DNA, 21 bp, Artificial Sequence
  Synthetic
ggtcagaagaacugcctgucc

SEQ ID NO: 64128 - DNA, 27 bp, Artificial Sequence
  Synthetic
atgctttattguaatctcccaaaucct

SEQ ID NO: 64129 - DNA, 26 bp, Artificial Sequence
  Synthetic
tgtgccaugaaaaggctaatagaguc

SEQ ID NO: 64130 - DNA, 24 bp, Artificial Sequence
  Synthetic
gttacttctaucgtgtgcctgugt

SEQ ID NO: 64131 - DNA, 28 bp, Artificial Sequence
  Synthetic
gctttcttcgaaugctttaactaagucc

SEQ ID NO: 64132 - DNA, 23 bp, Artificial Sequence
  Synthetic
aagctaaattgutggcgggttuc

SEQ ID NO: 64133 - DNA, 20 bp, Artificial Sequence
  Synthetic
ccctcuaccaacugcggaat

SEQ ID NO: 64134 - DNA, 21 bp, Artificial Sequence
  Synthetic
cccccgcacacacuaaagtua

SEQ ID NO: 64135 - DNA, 28 bp, Artificial Sequence
  Synthetic
gtttcctaaactuccaccacaaacauag

SEQ ID NO: 64136 - DNA, 22 bp, Artificial Sequence
  Synthetic
cttttuccaggcagaagcugac

SEQ ID NO: 64137 - DNA, 28 bp, Artificial Sequence
  Synthetic
tgttcttaacugcaaactggaatcugat

SEQ ID NO: 64138 - DNA, 27 bp, Artificial Sequence
  Synthetic
agaataaagtgcautgtatgcccucat

SEQ ID NO: 64139 - DNA, 27 bp, Artificial Sequence
  Synthetic
gcttgtgctuctttttccgataauact

SEQ ID NO: 64140 - DNA, 24 bp, Artificial Sequence
  Synthetic
ggtattgagugttcttcccaugga

SEQ ID NO: 64141 - DNA, 20 bp, Artificial Sequence
  Synthetic
cttgccugcagcguagagat

SEQ ID NO: 64142 - DNA, 23 bp, Artificial Sequence
  Synthetic
ggacagcagacagauggtaugaa

SEQ ID NO: 64143 - DNA, 29 bp, Artificial Sequence
  Synthetic
ggtcactacgutagctcacatttuaaagt

SEQ ID NO: 64144 - DNA, 22 bp, Artificial Sequence
  Synthetic
ttguttagaaccgugaggccat

SEQ ID NO: 64145 - DNA, 27 bp, Artificial Sequence
  Synthetic
ccccagatattcuagacagttcagtut

SEQ ID NO: 64146 - DNA, 26 bp, Artificial Sequence
  Synthetic
gtgtgtgatcauctctttgagguact

SEQ ID NO: 64147 - DNA, 28 bp, Artificial Sequence
  Synthetic
cattgagctgcuctatttcttcttcuct

SEQ ID NO: 64148 - DNA, 27 bp, Artificial Sequence
  Synthetic
tttttaccttccuttgttacagggugt

SEQ ID NO: 64149 - DNA, 27 bp, Artificial Sequence
  Synthetic
ctgtttgtguaaccatatgagcttguc

SEQ ID NO: 64150 - DNA, 23 bp, Artificial Sequence
  Synthetic
tctgagaaaauggtggttgcuga

SEQ ID NO: 64151 - DNA, 26 bp, Artificial Sequence
  Synthetic
actcccactccutgttacatgtttut

SEQ ID NO: 64152 - DNA, 27 bp, Artificial Sequence
  Synthetic
ttgattttctcguaccaggatcugaag

SEQ ID NO: 64153 - DNA, 28 bp, Artificial Sequence
  Synthetic
ccgaattcgaacuttctcagatucaaga

SEQ ID NO: 64154 - DNA, 26 bp, Artificial Sequence
  Synthetic
ggttactttaggugcagaaaagacug

SEQ ID NO: 64155 - DNA, 26 bp, Artificial Sequence
  Synthetic
acaattccaggcaggutttctcauat

SEQ ID NO: 64156 - DNA, 22 bp, Artificial Sequence
  Synthetic
tgtgaactcuggtgggtcugat

SEQ ID NO: 64157 - DNA, 29 bp, Artificial Sequence
  Synthetic
gcacaaaagaaccautgattuacaaaagg

SEQ ID NO: 64158 - DNA, 27 bp, Artificial Sequence
  Synthetic
gtgcacattcatutctactttggacuc

SEQ ID NO: 64159 - DNA, 27 bp, Artificial Sequence
  Synthetic
agtgaattgatcutttcgtctgtuggt

SEQ ID NO: 64160 - DNA, 26 bp, Artificial Sequence
  Synthetic
cttagtgaaatgaugggtctcccaut

SEQ ID NO: 64161 - DNA, 24 bp, Artificial Sequence
  Synthetic
ctgtcaggcauattcagctttugg

SEQ ID NO: 64162 - DNA, 22 bp, Artificial Sequence
  Synthetic
tccaaccagagugcagugaaag

SEQ ID NO: 64163 - DNA, 27 bp, Artificial Sequence
  Synthetic
ggcgggaaattutagatattgctgtug

SEQ ID NO: 64164 - DNA, 28 bp, Artificial Sequence
  Synthetic
gaacaatacagcugaagaggattcugaa

SEQ ID NO: 64165 - DNA, 24 bp, Artificial Sequence
  Synthetic
acctcatccuggacatcaagtuct

SEQ ID NO: 64166 - DNA, 27 bp, Artificial Sequence
  Synthetic
aaggttgttcaugtcaatggataugga

SEQ ID NO: 64167 - DNA, 25 bp, Artificial Sequence
  Synthetic
cgtgatuccaggaaaaggaguaact

SEQ ID NO: 64168 - DNA, 20 bp, Artificial Sequence
  Synthetic
catuggccgacgacccttua

SEQ ID NO: 64169 - DNA, 28 bp, Artificial Sequence
  Synthetic
ccccaaagccaauacatatttuaagcat

SEQ ID NO: 64170 - DNA, 24 bp, Artificial Sequence
  Synthetic
gaacagaacugaaactgacucgga

SEQ ID NO: 64171 - DNA, 27 bp, Artificial Sequence
  Synthetic
aatgcagaatgagauggtggtgaauat

SEQ ID NO: 64172 - DNA, 28 bp, Artificial Sequence
  Synthetic
cactagaugaccaggaaauagagaggaa

SEQ ID NO: 64173 - DNA, 25 bp, Artificial Sequence
  Synthetic
caatctatgaugggacagtctguct

SEQ ID NO: 64174 - DNA, 26 bp, Artificial Sequence
  Synthetic
ttcatugaaaagcccgacaaauaacc

SEQ ID NO: 64175 - DNA, 24 bp, Artificial Sequence
  Synthetic
cttctgtuggcatgtcaaugaact

SEQ ID NO: 64176 - DNA, 21 bp, Artificial Sequence
  Synthetic
acaaagugcggcagtacgaut

SEQ ID NO: 64177 - DNA, 23 bp, Artificial Sequence
  Synthetic
tgagcaaaugtcccatgucaaca

SEQ ID NO: 64178 - DNA, 22 bp, Artificial Sequence
  Synthetic
ccccaccucattctcattcugg

SEQ ID NO: 64179 - DNA, 22 bp, Artificial Sequence
  Synthetic
cgtggtcugtctttgcugaaca

SEQ ID NO: 64180 - DNA, 23 bp, Artificial Sequence
  Synthetic
tgcagaaaggaggauagugggaa

SEQ ID NO: 64181 - DNA, 25 bp, Artificial Sequence
  Synthetic
tcctagatugcaactctcagucaga

SEQ ID NO: 64182 - DNA, 19 bp, Artificial Sequence
  Synthetic
aagagauggcgcggaagut

SEQ ID NO: 64183 - DNA, 20 bp, Artificial Sequence
  Synthetic
ccagacgacgcutttcccut

SEQ ID NO: 64184 - DNA, 27 bp, Artificial Sequence
  Synthetic
cagagagaaaaggauctgcaaaaugaa

SEQ ID NO: 64185 - DNA, 30 bp, Artificial Sequence
  Synthetic
gcagguacagatttatgaatuagaggaaca

SEQ ID NO: 64186 - DNA, 21 bp, Artificial Sequence
  Synthetic
gcgacaaacacucacctcugt

SEQ ID NO: 64187 - DNA, 28 bp, Artificial Sequence
  Synthetic
ggctctctgatuccatttctaactgtuc

SEQ ID NO: 64188 - DNA, 31 bp, Artificial Sequence
  Synthetic
catctttctgagaauggagtatcatgatuca

SEQ ID NO: 64189 - DNA, 30 bp, Artificial Sequence
  Synthetic
tggtacttgattauaacaatgctcttuggt

SEQ ID NO: 64190 - DNA, 19 bp, Artificial Sequence
  Synthetic
ccccugaggagcacguaga

SEQ ID NO: 64191 - DNA, 22 bp, Artificial Sequence
  Synthetic
cttgaccuccaaccagguaagg

SEQ ID NO: 64192 - DNA, 20 bp, Artificial Sequence
  Synthetic
cagggacguctccuggagat

SEQ ID NO: 64193 - DNA, 20 bp, Artificial Sequence
  Synthetic
cccaguaacugcaccaacga

SEQ ID NO: 64194 - DNA, 22 bp, Artificial Sequence
  Synthetic
ccactcctugcttctcagauga

SEQ ID NO: 64195 - DNA, 25 bp, Artificial Sequence
  Synthetic
ggtgacagaggacaaugtgaugaag

SEQ ID NO: 64196 - DNA, 18 bp, Artificial Sequence
  Synthetic
caggtacucccgcaggut

SEQ ID NO: 64197 - DNA, 25 bp, Artificial Sequence
  Synthetic
gggtaguagaatggattucccaggt

SEQ ID NO: 64198 - DNA, 27 bp, Artificial Sequence
  Synthetic
catgcctgaaautttcttttgtugcag

SEQ ID NO: 64199 - DNA, 25 bp, Artificial Sequence
  Synthetic
cccaggccaugatgacuaaagaaat

SEQ ID NO: 64200 - DNA, 28 bp, Artificial Sequence
  Synthetic
ccataatuaaaagtagcacugggcagat

SEQ ID NO: 64201 - DNA, 23 bp, Artificial Sequence
  Synthetic
tcatcttugaacggtgttcuggt

SEQ ID NO: 64202 - DNA, 28 bp, Artificial Sequence
  Synthetic
aaaggaaaugagaaugaagacgagaaca

SEQ ID NO: 64203 - DNA, 26 bp, Artificial Sequence
  Synthetic
gtagaaacauggatggguagaagagg

SEQ ID NO: 64204 - DNA, 27 bp, Artificial Sequence
  Synthetic
ctataaaagggagauggtcactucaca

SEQ ID NO: 64205 - DNA, 28 bp, Artificial Sequence
  Synthetic
gttgaaaaatccuccaattaaggtgcut

SEQ ID NO: 64206 - DNA, 26 bp, Artificial Sequence
  Synthetic
tguaaggaggaagagagtttucacca

SEQ ID NO: 64207 - DNA, 24 bp, Artificial Sequence
  Synthetic
gcccagtaacautgtgtctctuca

SEQ ID NO: 64208 - DNA, 26 bp, Artificial Sequence
  Synthetic
tgtctcctcutacagatgagtucagg

SEQ ID NO: 64209 - DNA, 27 bp, Artificial Sequence
  Synthetic
aaaauggagacagugaagacacaagaa

SEQ ID NO: 64210 - DNA, 27 bp, Artificial Sequence
  Synthetic
tctugttcttgaatttuccgcaaagat

SEQ ID NO: 64211 - DNA, 24 bp, Artificial Sequence
  Synthetic
tgtattcaccuagtggtcctguga

SEQ ID NO: 64212 - DNA, 23 bp, Artificial Sequence
  Synthetic
ctctccccacugtctctcttcut

SEQ ID NO: 64213 - DNA, 20 bp, Artificial Sequence
  Synthetic
gacgccagacugttcugagt

SEQ ID NO: 64214 - DNA, 28 bp, Artificial Sequence
  Synthetic
agaactgttcatuactggcatctaagug

SEQ ID NO: 64215 - DNA, 27 bp, Artificial Sequence
  Synthetic
ggcttattagttgucttgccaattgut

SEQ ID NO: 64216 - DNA, 21 bp, Artificial Sequence
  Synthetic
ctgagtgtugcagcctgtcua

SEQ ID NO: 64217 - DNA, 24 bp, Artificial Sequence
  Synthetic
ggagaaagauggcctccugaaaaa

SEQ ID NO: 64218 - DNA, 22 bp, Artificial Sequence
  Synthetic
gcacaccatcutcctctgtgut

SEQ ID NO: 64219 - DNA, 22 bp, Artificial Sequence
  Synthetic
atgccagacutcttuggagacc

SEQ ID NO: 64220 - DNA, 23 bp, Artificial Sequence
  Synthetic
ggcugagatttggugagacacag

SEQ ID NO: 64221 - DNA, 24 bp, Artificial Sequence
  Synthetic
cgcttgttctutgctatcagagut

SEQ ID NO: 64222 - DNA, 27 bp, Artificial Sequence
  Synthetic
aacaagcagtutcaatttacctugacc

SEQ ID NO: 64223 - DNA, 22 bp, Artificial Sequence
  Synthetic
gctcttcucaacgggttcctut

SEQ ID NO: 64224 - DNA, 19 bp, Artificial Sequence
  Synthetic
ctctgguggaacgcucaac

SEQ ID NO: 64225 - DNA, 21 bp, Artificial Sequence
  Synthetic
caacaugaccccagggaugac

SEQ ID NO: 64226 - DNA, 21 bp, Artificial Sequence
  Synthetic
tggugcaaggaacgacacaut

SEQ ID NO: 64227 - DNA, 24 bp, Artificial Sequence
  Synthetic
tttcgaaggucattgaccauggat

SEQ ID NO: 64228 - DNA, 25 bp, Artificial Sequence
  Synthetic
tgtcgaugagacttttccaaugcaa

SEQ ID NO: 64229 - DNA, 22 bp, Artificial Sequence
  Synthetic
caaagauctuggcagggaggaa

SEQ ID NO: 64230 - DNA, 26 bp, Artificial Sequence
  Synthetic
tgtttgaggaugcgaaataagtguca

SEQ ID NO: 64231 - DNA, 28 bp, Artificial Sequence
  Synthetic
gggaaagcatgaaaugcagtatgtatua

SEQ ID NO: 64232 - DNA, 21 bp, Artificial Sequence
  Synthetic
cctccccaacccuctcctuag

SEQ ID NO: 64233 - DNA, 23 bp, Artificial Sequence
  Synthetic
ggtgtcaccauaggcaaccttut

SEQ ID NO: 64234 - DNA, 27 bp, Artificial Sequence
  Synthetic
tgcaccaucaatatttuacaacgcaaa

SEQ ID NO: 64235 - DNA, 28 bp, Artificial Sequence
  Synthetic
accagcatuaaaaagagaggagaaaguc

SEQ ID NO: 64236 - DNA, 21 bp, Artificial Sequence
  Synthetic
agggtgtacugctccatcugt

SEQ ID NO: 64237 - DNA, 26 bp, Artificial Sequence
  Synthetic
gcccgtcaaaacutacgtgaatttut

SEQ ID NO: 64238 - DNA, 23 bp, Artificial Sequence
  Synthetic
ctgtggaaacccuccatccauat

SEQ ID NO: 64239 - DNA, 23 bp, Artificial Sequence
  Synthetic
ccatgagggutggtgctgtttua

SEQ ID NO: 64240 - DNA, 20 bp, Artificial Sequence
  Synthetic
tggagcgauggtgauaagcc

SEQ ID NO: 64241 - DNA, 28 bp, Artificial Sequence
  Synthetic
gagacccaagaggauttatgttgtgaut

SEQ ID NO: 64242 - DNA, 22 bp, Artificial Sequence
  Synthetic
tcacaggattuctggaccccua

SEQ ID NO: 64243 - DNA, 21 bp, Artificial Sequence
  Synthetic
ggagcagcagguctctgauac

SEQ ID NO: 64244 - DNA, 20 bp, Artificial Sequence
  Synthetic
tgatgcgcaaaaucgtcguc

SEQ ID NO: 64245 - DNA, 25 bp, Artificial Sequence
  Synthetic
gcgtgggtautactctactctuggt

SEQ ID NO: 64246 - DNA, 21 bp, Artificial Sequence
  Synthetic
ctgtaggtcuctgaccacgut

SEQ ID NO: 64247 - DNA, 21 bp, Artificial Sequence
  Synthetic
gtggatccuggctgttucact

SEQ ID NO: 64248 - DNA, 23 bp, Artificial Sequence
  Synthetic
ctttcttctccutgccctttcug

SEQ ID NO: 64249 - DNA, 21 bp, Artificial Sequence
  Synthetic
atccagcagcaccucatagug

SEQ ID NO: 64250 - DNA, 22 bp, Artificial Sequence
  Synthetic
accaggatcagaugtccgtgua

SEQ ID NO: 64251 - DNA, 20 bp, Artificial Sequence
  Synthetic
tttttgcaccauccgctgug

SEQ ID NO: 64252 - DNA, 28 bp, Artificial Sequence
  Synthetic
attgtcaaactugtagtgtttgtttugt

SEQ ID NO: 64253 - DNA, 26 bp, Artificial Sequence
  Synthetic
ttttaaagctucctctatgcctuggt

SEQ ID NO: 64254 - DNA, 22 bp, Artificial Sequence
  Synthetic
aggtatgugagcgaaucccaac

SEQ ID NO: 64255 - DNA, 26 bp, Artificial Sequence
  Synthetic
tuaaattacugcaaaacggcacagaa

SEQ ID NO: 64256 - DNA, 23 bp, Artificial Sequence
  Synthetic
cccaautcaagtgauccgcaaag

SEQ ID NO: 64257 - DNA, 23 bp, Artificial Sequence
  Synthetic
tggttttggaggugtagcttcug

SEQ ID NO: 64258 - DNA, 23 bp, Artificial Sequence
  Synthetic
tgtcaggaaggutcagaccauct

SEQ ID NO: 64259 - DNA, 21 bp, Artificial Sequence
  Synthetic
cggcacccauctccatgatug

SEQ ID NO: 64260 - DNA, 21 bp, Artificial Sequence
  Synthetic
actgactctcucgtctgccut

SEQ ID NO: 64261 - DNA, 19 bp, Artificial Sequence
  Synthetic
gtaggugggcagggtgtug

SEQ ID NO: 64262 - DNA, 20 bp, Artificial Sequence
  Synthetic
ctggaccagcgccuaaagut

SEQ ID NO: 64263 - DNA, 21 bp, Artificial Sequence
  Synthetic
tctcgguaccaagtcctguca

SEQ ID NO: 64264 - DNA, 24 bp, Artificial Sequence
  Synthetic
gccttgtccuccatgttctcaaug

SEQ ID NO: 64265 - DNA, 22 bp, Artificial Sequence
  Synthetic
ccttggagugatccaggtucag

SEQ ID NO: 64266 - DNA, 20 bp, Artificial Sequence
  Synthetic
gcatccaccgguagctctuc

SEQ ID NO: 64267 - DNA, 21 bp, Artificial Sequence
  Synthetic
agaggacucctgcacaguaca

SEQ ID NO: 64268 - DNA, 22 bp, Artificial Sequence
  Synthetic
catctggatcucctggccatuc

SEQ ID NO: 64269 - DNA, 19 bp, Artificial Sequence
  Synthetic
gccacagccacaguagcut

SEQ ID NO: 64270 - DNA, 22 bp, Artificial Sequence
  Synthetic
caccguggacagtgagatugaa

SEQ ID NO: 64271 - DNA, 17 bp, Artificial Sequence
  Synthetic
gggugcggagccttguc

SEQ ID NO: 64272 - DNA, 21 bp, Artificial Sequence
  Synthetic
gcttccaugggctgattugga

SEQ ID NO: 64273 - DNA, 22 bp, Artificial Sequence
  Synthetic
aacaactauggcaaaggcugga

SEQ ID NO: 64274 - DNA, 21 bp, Artificial Sequence
  Synthetic
gugctggaacugacagagact

SEQ ID NO: 64275 - DNA, 18 bp, Artificial Sequence
  Synthetic
ggtagcgcucgcccuaac

SEQ ID NO: 64276 - DNA, 20 bp, Artificial Sequence
  Synthetic
cctgggcugagttccagtug

SEQ ID NO: 64277 - DNA, 19 bp, Artificial Sequence
  Synthetic
ccacccucggaactcuggt

SEQ ID NO: 64278 - DNA, 20 bp, Artificial Sequence
  Synthetic
ggttucacacggcacttugt

SEQ ID NO: 64279 - DNA, 25 bp, Artificial Sequence
  Synthetic
tgtaaattgcugcgttgatcttguc

SEQ ID NO: 64280 - DNA, 21 bp, Artificial Sequence
  Synthetic
gagaggctguccattccctug

SEQ ID NO: 64281 - DNA, 22 bp, Artificial Sequence
  Synthetic
ccagcccacaucatgggaatut

SEQ ID NO: 64282 - DNA, 20 bp, Artificial Sequence
  Synthetic
caaccuggagaagcugcact

SEQ ID NO: 64283 - DNA, 20 bp, Artificial Sequence
  Synthetic
gtugacagaggcaccacuca

SEQ ID NO: 64284 - DNA, 19 bp, Artificial Sequence
  Synthetic
gcttccugcagucccgaaa

SEQ ID NO: 64285 - DNA, 21 bp, Artificial Sequence
  Synthetic
gtctagcuggcagttgaggua

SEQ ID NO: 64286 - DNA, 22 bp, Artificial Sequence
  Synthetic
ctccucaagtccucagagggat

SEQ ID NO: 64287 - DNA, 22 bp, Artificial Sequence
  Synthetic
gctgcagggauggaagaagaug

SEQ ID NO: 64288 - DNA, 26 bp, Artificial Sequence
  Synthetic
ctgttttactgacgutgatagctgug

SEQ ID NO: 64289 - DNA, 28 bp, Artificial Sequence
  Synthetic
aagtgccacucagaaaatctagcttuaa

SEQ ID NO: 64290 - DNA, 28 bp, Artificial Sequence
  Synthetic
ggttttgatuccacatctggtgatuaga

SEQ ID NO: 64291 - DNA, 29 bp, Artificial Sequence
  Synthetic
gtaccctcauaggcaaaauaaggaagaat

SEQ ID NO: 64292 - DNA, 27 bp, Artificial Sequence
  Synthetic
gaaaattcttcutgccatatgugagca

SEQ ID NO: 64293 - DNA, 28 bp, Artificial Sequence
  Synthetic
gctcctccuaagccactttttatatcut

SEQ ID NO: 64294 - DNA, 26 bp, Artificial Sequence
  Synthetic
ctatatgtagaggcugttggaagcug

SEQ ID NO: 64295 - DNA, 24 bp, Artificial Sequence
  Synthetic
tactcaccaaucttctaccagugt

SEQ ID NO: 64296 - DNA, 27 bp, Artificial Sequence
  Synthetic
tttctgttaagcagucactaccatugt

SEQ ID NO: 64297 - DNA, 23 bp, Artificial Sequence
  Synthetic
gcugtaaagugagcagcacaaga

SEQ ID NO: 64298 - DNA, 25 bp, Artificial Sequence
  Synthetic
agaaggtccugttgtcagttttuca

SEQ ID NO: 64299 - DNA, 22 bp, Artificial Sequence
  Synthetic
gcctgctguatgagcaaatuca

SEQ ID NO: 64300 - DNA, 20 bp, Artificial Sequence
  Synthetic
gguagagcaggtcguggagt

SEQ ID NO: 64301 - DNA, 27 bp, Artificial Sequence
  Synthetic
cgcttccaccguaaaaattaugagaaa

SEQ ID NO: 64302 - DNA, 28 bp, Artificial Sequence
  Synthetic
accaagggtcautttctttaagaaugga

SEQ ID NO: 64303 - DNA, 23 bp, Artificial Sequence
  Synthetic
cagtgggaagacautccacaaug

SEQ ID NO: 64304 - DNA, 24 bp, Artificial Sequence
  Synthetic
gaggatucagaacccaaucaggaa

SEQ ID NO: 64305 - DNA, 24 bp, Artificial Sequence
  Synthetic
ggagaautttagcgtuggacagag

SEQ ID NO: 64306 - DNA, 27 bp, Artificial Sequence
  Synthetic
gagtcaaaggcuaaatcctaaggcaua

SEQ ID NO: 64307 - DNA, 29 bp, Artificial Sequence
  Synthetic
ctatgtgtgtguaacttctgtttctccut

SEQ ID NO: 64308 - DNA, 25 bp, Artificial Sequence
  Synthetic
gttccttctcutaggacactuccat

SEQ ID NO: 64309 - DNA, 26 bp, Artificial Sequence
  Synthetic
actcacaaautacagtatcugacgca

SEQ ID NO: 64310 - DNA, 21 bp, Artificial Sequence
  Synthetic
ctcgugccacacagattcuct

SEQ ID NO: 64311 - DNA, 21 bp, Artificial Sequence
  Synthetic
actgttggccaguagacagut

SEQ ID NO: 64312 - DNA, 26 bp, Artificial Sequence
  Synthetic
ctgttggaaataugctagcacactut

SEQ ID NO: 64313 - DNA, 28 bp, Artificial Sequence
  Synthetic
atgaacattgttugctatacttgcagug

SEQ ID NO: 64314 - DNA, 29 bp, Artificial Sequence
  Synthetic
gcctattugaacaactcataaaacugcat

SEQ ID NO: 64315 - DNA, 25 bp, Artificial Sequence
  Synthetic
gctggaccuctttgtatttcuggaa

SEQ ID NO: 64316 - DNA, 33 bp, Artificial Sequence
  Synthetic
tatttaaggagatuacacttgatgtatcucaca

SEQ ID NO: 64317 - DNA, 24 bp, Artificial Sequence
  Synthetic
gcacatgaagcacaauttcctcut

SEQ ID NO: 64318 - DNA, 28 bp, Artificial Sequence
  Synthetic
tggacttagagutggtcaaactgtuaag

SEQ ID NO: 64319 - DNA, 27 bp, Artificial Sequence
  Synthetic
ttctttctaugccacgttaatgcttug

SEQ ID NO: 64320 - DNA, 26 bp, Artificial Sequence
  Synthetic
ctcttcctgagcaugagaaagaauga

SEQ ID NO: 64321 - DNA, 23 bp, Artificial Sequence
  Synthetic
ggaagaaagcugcagcatuacac

SEQ ID NO: 64322 - DNA, 21 bp, Artificial Sequence
  Synthetic
cttgtgtccaccuccactgut

SEQ ID NO: 64323 - DNA, 25 bp, Artificial Sequence
  Synthetic
caaaagaggagutgaaggtgccuat

SEQ ID NO: 64324 - DNA, 22 bp, Artificial Sequence
  Synthetic
acaggacaagacautgcaugct

SEQ ID NO: 64325 - DNA, 23 bp, Artificial Sequence
  Synthetic
agaatcccucttcttccuccgat

SEQ ID NO: 64326 - DNA, 25 bp, Artificial Sequence
  Synthetic
ctcagaaagaccccutaaactguca

SEQ ID NO: 64327 - DNA, 26 bp, Artificial Sequence
  Synthetic
agtctttgaugcgaagaaaacgttuc

SEQ ID NO: 64328 - DNA, 21 bp, Artificial Sequence
  Synthetic
gatcctccaagcucccactut

SEQ ID NO: 64329 - DNA, 25 bp, Artificial Sequence
  Synthetic
accattctgttugcttctctctcuc

SEQ ID NO: 64330 - DNA, 20 bp, Artificial Sequence
  Synthetic
cagccctcutaccgtctcuc

SEQ ID NO: 64331 - DNA, 19 bp, Artificial Sequence
  Synthetic
gcagaacacugcccggtut

SEQ ID NO: 64332 - DNA, 21 bp, Artificial Sequence
  Synthetic
tcctgctccucatggatguga

SEQ ID NO: 64333 - DNA, 21 bp, Artificial Sequence
  Synthetic
agtcctuggcccaatctctug

SEQ ID NO: 64334 - DNA, 17 bp, Artificial Sequence
  Synthetic
gggcagcugcacaguct

SEQ ID NO: 64335 - DNA, 17 bp, Artificial Sequence
  Synthetic
cctcaccuccgcgaugt

SEQ ID NO: 64336 - DNA, 25 bp, Artificial Sequence
  Synthetic
aagaagtaatgcugatccaggctut

SEQ ID NO: 64337 - DNA, 28 bp, Artificial Sequence
  Synthetic
caagagtgactautactgagcggaauat

SEQ ID NO: 64338 - DNA, 25 bp, Artificial Sequence
  Synthetic
cctgaattugaaaccaagugcaaca

SEQ ID NO: 64339 - DNA, 28 bp, Artificial Sequence
  Synthetic
ggccaatctgacaugtctgatacttuaa

SEQ ID NO: 64340 - DNA, 21 bp, Artificial Sequence
  Synthetic
gtgctggaacautccctcucc

SEQ ID NO: 64341 - DNA, 21 bp, Artificial Sequence
  Synthetic
agaggacaucagcugcaacac

SEQ ID NO: 64342 - DNA, 21 bp, Artificial Sequence
  Synthetic
ctgctggcutacctggguaat

SEQ ID NO: 64343 - DNA, 25 bp, Artificial Sequence
  Synthetic
cagcttgttcuctcttcctcttucc

SEQ ID NO: 64344 - DNA, 21 bp, Artificial Sequence
  Synthetic
ctccttaccugctgggugaag

SEQ ID NO: 64345 - DNA, 22 bp, Artificial Sequence
  Synthetic
ttgtccucagagcagaacctug

SEQ ID NO: 64346 - DNA, 33 bp, Artificial Sequence
  Synthetic
tutttaaattatctgttucaggaagaagaacga

SEQ ID NO: 64347 - DNA, 26 bp, Artificial Sequence
  Synthetic
cgcacgccaauaaagacataugaaaa

SEQ ID NO: 64348 - DNA, 25 bp, Artificial Sequence
  Synthetic
caagatgtauctgggtguacaacct

SEQ ID NO: 64349 - DNA, 28 bp, Artificial Sequence
  Synthetic
gaaagagagguagatttcaatggctuct

SEQ ID NO: 64350 - DNA, 28 bp, Artificial Sequence
  Synthetic
tgagctcagtauggaaagaaataacuct

SEQ ID NO: 64351 - DNA, 25 bp, Artificial Sequence
  Synthetic
tcactttgcauatgccatacaugga

SEQ ID NO: 64352 - DNA, 24 bp, Artificial Sequence
  Synthetic
ccccagacacutaccaucacaaaa

SEQ ID NO: 64353 - DNA, 24 bp, Artificial Sequence
  Synthetic
gaggatgtugagtgtagguaacgg

SEQ ID NO: 64354 - DNA, 22 bp, Artificial Sequence
  Synthetic
cgtctgtgaugggaactcctug

SEQ ID NO: 64355 - DNA, 27 bp, Artificial Sequence
  Synthetic
ccaaacttatggaugttctggtgttut

SEQ ID NO: 64356 - DNA, 28 bp, Artificial Sequence
  Synthetic
cattggttcucacaaatagtaggtgugt

SEQ ID NO: 64357 - DNA, 23 bp, Artificial Sequence
  Synthetic
gggaaaggugattgcatttgcuc

SEQ ID NO: 64358 - DNA, 20 bp, Artificial Sequence
  Synthetic
gccccutcctctcugagagt

SEQ ID NO: 64359 - DNA, 18 bp, Artificial Sequence
  Synthetic
gcatgacugcgaccugct

SEQ ID NO: 64360 - DNA, 20 bp, Artificial Sequence
  Synthetic
gcttctgcagcugcttctug

SEQ ID NO: 64361 - DNA, 22 bp, Artificial Sequence
  Synthetic
tgugaggactugaccagaccat

SEQ ID NO: 64362 - DNA, 20 bp, Artificial Sequence
  Synthetic
cccttuctgcgguacaggac

SEQ ID NO: 64363 - DNA, 25 bp, Artificial Sequence
  Synthetic
gctggtcuccagtagtattgtucac

SEQ ID NO: 64364 - DNA, 22 bp, Artificial Sequence
  Synthetic
ggacauggauggagcaagaaca

SEQ ID NO: 64365 - DNA, 20 bp, Artificial Sequence
  Synthetic
ggctctugcagacagugacc

SEQ ID NO: 64366 - DNA, 28 bp, Artificial Sequence
  Synthetic
cattcctttgagutagatgaaacugcat

SEQ ID NO: 64367 - DNA, 25 bp, Artificial Sequence
  Synthetic
acaugaagugacagaagcacagaag

SEQ ID NO: 64368 - DNA, 27 bp, Artificial Sequence
  Synthetic
acagtgataucagatgagtcugcagat

SEQ ID NO: 64369 - DNA, 23 bp, Artificial Sequence
  Synthetic
ttttagtcucagctguccccaac

SEQ ID NO: 64370 - DNA, 27 bp, Artificial Sequence
  Synthetic
gaaaggattagucttcagcttuacaga

SEQ ID NO: 64371 - DNA, 26 bp, Artificial Sequence
  Synthetic
ggaaagacaaaccucctccaaatgut

SEQ ID NO: 64372 - DNA, 28 bp, Artificial Sequence
  Synthetic
gctaacagguaaagtttguaggagacaa

SEQ ID NO: 64373 - DNA, 24 bp, Artificial Sequence
  Synthetic
gtcttatcuggaggcaccactaug

SEQ ID NO: 64374 - DNA, 21 bp, Artificial Sequence
  Synthetic
gccatttccuagatcgcugga

SEQ ID NO: 64375 - DNA, 19 bp, Artificial Sequence
  Synthetic
ccugcagaacccccugaag

SEQ ID NO: 64376 - DNA, 22 bp, Artificial Sequence
  Synthetic
tggaggcugaggtuaggaaagt

SEQ ID NO: 64377 - DNA, 28 bp, Artificial Sequence
  Synthetic
tgactcttctugtttttggtcctucaat

SEQ ID NO: 64378 - DNA, 25 bp, Artificial Sequence
  Synthetic
ttcatgaagacaaacucttggguag

SEQ ID NO: 64379 - DNA, 27 bp, Artificial Sequence
  Synthetic
accagattctgutctccttcaaatuca

SEQ ID NO: 64380 - DNA, 21 bp, Artificial Sequence
  Synthetic
cccaugcccttctgtuacaca

SEQ ID NO: 64381 - DNA, 24 bp, Artificial Sequence
  Synthetic
gtcatgctgtutagtcactgcuct

SEQ ID NO: 64382 - DNA, 20 bp, Artificial Sequence
  Synthetic
ccgagagtugaggcgaagut

SEQ ID NO: 64383 - DNA, 17 bp, Artificial Sequence
  Synthetic
aggcgcutcacgaucgg

SEQ ID NO: 64384 - DNA, 28 bp, Artificial Sequence
  Synthetic
ggctgtattguccttatcatcagaaucc

SEQ ID NO: 64385 - DNA, 20 bp, Artificial Sequence
  Synthetic
acagauctcuggccagcaac

SEQ ID NO: 64386 - DNA, 24 bp, Artificial Sequence
  Synthetic
gagggctgacuataagcctctgua

SEQ ID NO: 64387 - DNA, 25 bp, Artificial Sequence
  Synthetic
atttgcctaugaacgtttgucacac

SEQ ID NO: 64388 - DNA, 20 bp, Artificial Sequence
  Synthetic
ggccugactcggtauggaaa

SEQ ID NO: 64389 - DNA, 24 bp, Artificial Sequence
  Synthetic
gcattaggcuttcaggatgtugaa

SEQ ID NO: 64390 - DNA, 23 bp, Artificial Sequence
  Synthetic
tggatguggaaggaggaugaaga

SEQ ID NO: 64391 - DNA, 18 bp, Artificial Sequence
  Synthetic
cgcugccaccacttcugt

SEQ ID NO: 64392 - DNA, 21 bp, Artificial Sequence
  Synthetic
ggaaggagaucaggugcagac

SEQ ID NO: 64393 - DNA, 21 bp, Artificial Sequence
  Synthetic
gctgagcguggacaactucaa

SEQ ID NO: 64394 - DNA, 24 bp, Artificial Sequence
  Synthetic
tgagaaaagcagcucaggaacaut

SEQ ID NO: 64395 - DNA, 21 bp, Artificial Sequence
  Synthetic
gagtugaaagccatggugcag

SEQ ID NO: 64396 - DNA, 22 bp, Artificial Sequence
  Synthetic
ctcaggtgugtcactcugaagg

SEQ ID NO: 64397 - DNA, 21 bp, Artificial Sequence
  Synthetic
cagggccugatataggtgugt

SEQ ID NO: 64398 - DNA, 19 bp, Artificial Sequence
  Synthetic
cctgggtgucctctccugt

SEQ ID NO: 64399 - DNA, 24 bp, Artificial Sequence
  Synthetic
aacctuccagagcagttucagaaa

SEQ ID NO: 64400 - DNA, 20 bp, Artificial Sequence
  Synthetic
gccccugataaacgtguggt

SEQ ID NO: 64401 - DNA, 24 bp, Artificial Sequence
  Synthetic
gatggacaggacgauctcauagga

SEQ ID NO: 64402 - DNA, 22 bp, Artificial Sequence
  Synthetic
tctggcttucaccatcctctuc

SEQ ID NO: 64403 - DNA, 22 bp, Artificial Sequence
  Synthetic
acatcccucagacaugcaaaca

SEQ ID NO: 64404 - DNA, 21 bp, Artificial Sequence
  Synthetic
ctttggcccutggtgauaggt

SEQ ID NO: 64405 - DNA, 23 bp, Artificial Sequence
  Synthetic
ccatcatguccagacaggttucc

SEQ ID NO: 64406 - DNA, 20 bp, Artificial Sequence
  Synthetic
aaaaccuggctggtugggaa

SEQ ID NO: 64407 - DNA, 20 bp, Artificial Sequence
  Synthetic
acttaguccccaggctggua

SEQ ID NO: 64408 - DNA, 22 bp, Artificial Sequence
  Synthetic
tcgaccagaucccatcauacga

SEQ ID NO: 64409 - DNA, 20 bp, Artificial Sequence
  Synthetic
cccagacuccctacccacug

SEQ ID NO: 64410 - DNA, 21 bp, Artificial Sequence
  Synthetic
ccagagccccuggagtaauca

SEQ ID NO: 64411 - DNA, 22 bp, Artificial Sequence
  Synthetic
ctcaccggagucattguagaca

SEQ ID NO: 64412 - DNA, 23 bp, Artificial Sequence
  Synthetic
gaacaacuccaccatctcguagt

SEQ ID NO: 64413 - DNA, 20 bp, Artificial Sequence
  Synthetic
gctctcuaccctgtgtccug

SEQ ID NO: 64414 - DNA, 28 bp, Artificial Sequence
  Synthetic
gtacttgtgtuacccttagagtttuggt

SEQ ID NO: 64415 - DNA, 26 bp, Artificial Sequence
  Synthetic
tccgattttgaucttctgcctcaaut

SEQ ID NO: 64416 - DNA, 18 bp, Artificial Sequence
  Synthetic
gcctgucgcggagagtug

SEQ ID NO: 64417 - DNA, 22 bp, Artificial Sequence
  Synthetic
accacctgtuttccttgctgut

SEQ ID NO: 64418 - DNA, 21 bp, Artificial Sequence
  Synthetic
cccaaccccaaagucatuggt

SEQ ID NO: 64419 - DNA, 23 bp, Artificial Sequence
  Synthetic
cattgaccttugtgtctgctcug

SEQ ID NO: 64420 - DNA, 21 bp, Artificial Sequence
  Synthetic
gcuctgataatguggccccaa

SEQ ID NO: 64421 - DNA, 18 bp, Artificial Sequence
  Synthetic
ccgaggcugccagtucag

SEQ ID NO: 64422 - DNA, 21 bp, Artificial Sequence
  Synthetic
cccgggaaggucttctctuca

SEQ ID NO: 64423 - DNA, 22 bp, Artificial Sequence
  Synthetic
tgtccctuaccttccccatuca

SEQ ID NO: 64424 - DNA, 18 bp, Artificial Sequence
  Synthetic
gcctgggcutcagcacuc

SEQ ID NO: 64425 - DNA, 25 bp, Artificial Sequence
  Synthetic
tggtctcaccuaggacttacaugat

SEQ ID NO: 64426 - DNA, 20 bp, Artificial Sequence
  Synthetic
actctgcuggcttgcgtuat

SEQ ID NO: 64427 - DNA, 22 bp, Artificial Sequence
  Synthetic
ttgtcttttggutgcaggtugg

SEQ ID NO: 64428 - DNA, 22 bp, Artificial Sequence
  Synthetic
ccagagttcguggaggtcatug

SEQ ID NO: 64429 - DNA, 23 bp, Artificial Sequence
  Synthetic
agacctcgcuttccttctcuact

SEQ ID NO: 64430 - DNA, 21 bp, Artificial Sequence
  Synthetic
gcttgagcccgacugtcttuc

SEQ ID NO: 64431 - DNA, 22 bp, Artificial Sequence
  Synthetic
gtaccactgaaucctggtguca

SEQ ID NO: 64432 - DNA, 20 bp, Artificial Sequence
  Synthetic
gctgcgatugttccttgguc

SEQ ID NO: 64433 - DNA, 27 bp, Artificial Sequence
  Synthetic
ggauccttgtaatauaacccacaccat

SEQ ID NO: 64434 - DNA, 21 bp, Artificial Sequence
  Synthetic
gccgggagacautccactuat

SEQ ID NO: 64435 - DNA, 28 bp, Artificial Sequence
  Synthetic
gcttccttaacaagucttaatctcucca

SEQ ID NO: 64436 - DNA, 25 bp, Artificial Sequence
  Synthetic
ggatcatgtcugtacggtagttgut

SEQ ID NO: 64437 - DNA, 28 bp, Artificial Sequence
  Synthetic
tgtcagaacugactttaagcagtaucag

SEQ ID NO: 64438 - DNA, 23 bp, Artificial Sequence
  Synthetic
gaatcaaugaactcgctcuccca

SEQ ID NO: 64439 - DNA, 21 bp, Artificial Sequence
  Synthetic
accctattgcucaggcccuaa

SEQ ID NO: 64440 - DNA, 19 bp, Artificial Sequence
  Synthetic
gcgcttgucggcttcauac

SEQ ID NO: 64441 - DNA, 22 bp, Artificial Sequence
  Synthetic
cagttgguggattggtgugaac

SEQ ID NO: 64442 - DNA, 21 bp, Artificial Sequence
  Synthetic
cttgatccccucaggcaucat

SEQ ID NO: 64443 - DNA, 24 bp, Artificial Sequence
  Synthetic
gtaatcccctugggacactcuact

SEQ ID NO: 64444 - DNA, 19 bp, Artificial Sequence
  Synthetic
cagccgauactgcacguga

SEQ ID NO: 64445 - DNA, 23 bp, Artificial Sequence
  Synthetic
atcagttggguccattgctcaut

SEQ ID NO: 64446 - DNA, 20 bp, Artificial Sequence
  Synthetic
tccctccaccugagcgttua

SEQ ID NO: 64447 - DNA, 25 bp, Artificial Sequence
  Synthetic
aactttggcugactcttccttucat

SEQ ID NO: 64448 - DNA, 28 bp, Artificial Sequence
  Synthetic
ctgcagataugaccattaaactauggga

SEQ ID NO: 64449 - DNA, 28 bp, Artificial Sequence
  Synthetic
tgctcttccaccaauactgacaatuaag

SEQ ID NO: 64450 - DNA, 21 bp, Artificial Sequence
  Synthetic
ctctgtgugggtccacatcuc

SEQ ID NO: 64451 - DNA, 25 bp, Artificial Sequence
  Synthetic
ggtacctguggaaaatactugacca

SEQ ID NO: 64452 - DNA, 21 bp, Artificial Sequence
  Synthetic
guagctctucccaccggaaaa

SEQ ID NO: 64453 - DNA, 22 bp, Artificial Sequence
  Synthetic
cctgtgcaaaaagcucggttuc

SEQ ID NO: 64454 - DNA, 20 bp, Artificial Sequence
  Synthetic
gcaccagggcugcacttaut

SEQ ID NO: 64455 - DNA, 21 bp, Artificial Sequence
  Synthetic
cctcaccaggcugatgagtug

SEQ ID NO: 64456 - DNA, 21 bp, Artificial Sequence
  Synthetic
acgtggtcugtctgattuggg

SEQ ID NO: 64457 - DNA, 24 bp, Artificial Sequence
  Synthetic
acacttgtctcutctctcctguga

SEQ ID NO: 64458 - DNA, 29 bp, Artificial Sequence
  Synthetic
catttaaatattucagctggttgcuacct

SEQ ID NO: 64459 - DNA, 24 bp, Artificial Sequence
  Synthetic
agctgcttatagucagggacatug

SEQ ID NO: 64460 - DNA, 24 bp, Artificial Sequence
  Synthetic
ttcaacgtcaccuttccaaacuct

SEQ ID NO: 64461 - DNA, 28 bp, Artificial Sequence
  Synthetic
gatgctgaucatatttgaaugaaggcat

SEQ ID NO: 64462 - DNA, 25 bp, Artificial Sequence
  Synthetic
gcatcctgguctatgtgttcaacug

SEQ ID NO: 64463 - DNA, 21 bp, Artificial Sequence
  Synthetic
ctccagggutcaaacguccaa

SEQ ID NO: 64464 - DNA, 24 bp, Artificial Sequence
  Synthetic
ctgctccugggtcatcaatatugt

SEQ ID NO: 64465 - DNA, 20 bp, Artificial Sequence
  Synthetic
gtatuggaggcggacuagca

SEQ ID NO: 64466 - DNA, 24 bp, Artificial Sequence
  Synthetic
ggagagaucatgtauggaggccat

SEQ ID NO: 64467 - DNA, 22 bp, Artificial Sequence
  Synthetic
cucacgacaucagaagcacaga

SEQ ID NO: 64468 - DNA, 21 bp, Artificial Sequence
  Synthetic
ctccaccuactcctcctcugt

SEQ ID NO: 64469 - DNA, 17 bp, Artificial Sequence
  Synthetic
gcccgacugguaggcat

SEQ ID NO: 64470 - DNA, 20 bp, Artificial Sequence
  Synthetic
agctgctacugctgtgaugg

SEQ ID NO: 64471 - DNA, 19 bp, Artificial Sequence
  Synthetic
ccugcagcccaaagagcut

SEQ ID NO: 64472 - DNA, 21 bp, Artificial Sequence
  Synthetic
catgccagagautgcucagga

SEQ ID NO: 64473 - DNA, 24 bp, Artificial Sequence
  Synthetic
ccugttacucacagaaaccacaca

SEQ ID NO: 64474 - DNA, 20 bp, Artificial Sequence
  Synthetic
cctgtgggugcacttacuct

SEQ ID NO: 64475 - DNA, 23 bp, Artificial Sequence
  Synthetic
caatgctagcutgccctagaugt

SEQ ID NO: 64476 - DNA, 23 bp, Artificial Sequence
  Synthetic
ccaatgaaguctacacgtugcac

SEQ ID NO: 64477 - DNA, 20 bp, Artificial Sequence
  Synthetic
gaaggaggtuccgctggtut

SEQ ID NO: 64478 - DNA, 22 bp, Artificial Sequence
  Synthetic
tggttggttuctggagccttut

SEQ ID NO: 64479 - DNA, 27 bp, Artificial Sequence
  Synthetic
gttaaggtgaacuggttctcatcuact

SEQ ID NO: 64480 - DNA, 27 bp, Artificial Sequence
  Synthetic
caugtggtatgtcuagagagagaacag

SEQ ID NO: 64481 - DNA, 20 bp, Artificial Sequence
  Synthetic
ccuaacacgcaugggaaggt

SEQ ID NO: 64482 - DNA, 21 bp, Artificial Sequence
  Synthetic
cttccggtaguctgggttcut

SEQ ID NO: 64483 - DNA, 20 bp, Artificial Sequence
  Synthetic
actcauggagttgcugcact

SEQ ID NO: 64484 - DNA, 19 bp, Artificial Sequence
  Synthetic
cucatgcagugagcagggt

SEQ ID NO: 64485 - DNA, 18 bp, Artificial Sequence
  Synthetic
cgctgucgtgcguaccat

SEQ ID NO: 64486 - DNA, 24 bp, Artificial Sequence
  Synthetic
cctggtagutgatgagaugcacaa

SEQ ID NO: 64487 - DNA, 19 bp, Artificial Sequence
  Synthetic
actcaguccctguccccat

SEQ ID NO: 64488 - DNA, 22 bp, Artificial Sequence
  Synthetic
caccaguctccatgtugcagaa

SEQ ID NO: 64489 - DNA, 22 bp, Artificial Sequence
  Synthetic
gcccatatgugcccctaccaua

SEQ ID NO: 64490 - DNA, 21 bp, Artificial Sequence
  Synthetic
gaaaccaguagcacccuggaa

SEQ ID NO: 64491 - DNA, 21 bp, Artificial Sequence
  Synthetic
gcttgatgccuctgtgctcuc

SEQ ID NO: 64492 - DNA, 25 bp, Artificial Sequence
  Synthetic
agaagggagggaagguttagaauct

SEQ ID NO: 64493 - DNA, 23 bp, Artificial Sequence
  Synthetic
ccgtgactguagtgttctctcug

SEQ ID NO: 64494 - DNA, 25 bp, Artificial Sequence
  Synthetic
gtgaagaaagauggccactgtaaug

SEQ ID NO: 64495 - DNA, 22 bp, Artificial Sequence
  Synthetic
caagcttugccctctttggaug

SEQ ID NO: 64496 - DNA, 24 bp, Artificial Sequence
  Synthetic
aggaagacgacagugaaaauggag

SEQ ID NO: 64497 - DNA, 24 bp, Artificial Sequence
  Synthetic
tccagagaaggaaucagtcaguca

SEQ ID NO: 64498 - DNA, 21 bp, Artificial Sequence
  Synthetic
tgaatctccuggacccctuca

SEQ ID NO: 64499 - DNA, 21 bp, Artificial Sequence
  Synthetic
gaacttgtccucctcgctcuc

SEQ ID NO: 64500 - DNA, 22 bp, Artificial Sequence
  Synthetic
ctctgcagacugagauggagaa

SEQ ID NO: 64501 - DNA, 28 bp, Artificial Sequence
  Synthetic
ggtgatcattaaacaugtgtcgagttug

SEQ ID NO: 64502 - DNA, 21 bp, Artificial Sequence
  Synthetic
gtgactggcuacttcccctug

SEQ ID NO: 64503 - DNA, 21 bp, Artificial Sequence
  Synthetic
ccgggacucaacacatacgut

SEQ ID NO: 64504 - DNA, 21 bp, Artificial Sequence
  Synthetic
gttcugggacgauggagagag

SEQ ID NO: 64505 - DNA, 23 bp, Artificial Sequence
  Synthetic
ctagagtgtccuagtggcaggua

SEQ ID NO: 64506 - DNA, 21 bp, Artificial Sequence
  Synthetic
gttacactgugcactgctgut

SEQ ID NO: 64507 - DNA, 26 bp, Artificial Sequence
  Synthetic
aaatcgtgaaagugacagtgatguct

SEQ ID NO: 64508 - DNA, 25 bp, Artificial Sequence
  Synthetic
gatauaccatgacatucagccccaa

SEQ ID NO: 64509 - DNA, 20 bp, Artificial Sequence
  Synthetic
ggccccuctcacugacaaac

SEQ ID NO: 64510 - DNA, 21 bp, Artificial Sequence
  Synthetic
ccagccagutccttggcttua

SEQ ID NO: 64511 - DNA, 25 bp, Artificial Sequence
  Synthetic
ccaccaacuggattgaatacatgut

SEQ ID NO: 64512 - DNA, 22 bp, Artificial Sequence
  Synthetic
gtgtatcugcagttguccacct

SEQ ID NO: 64513 - DNA, 21 bp, Artificial Sequence
  Synthetic
tggctucacaacccaaacugt

SEQ ID NO: 64514 - DNA, 27 bp, Artificial Sequence
  Synthetic
actacacaaagaacuccttcattggut

SEQ ID NO: 64515 - DNA, 27 bp, Artificial Sequence
  Synthetic
acgagttactgtugaggataaggacut

SEQ ID NO: 64516 - DNA, 20 bp, Artificial Sequence
  Synthetic
gcaccugcccaatgauggag

SEQ ID NO: 64517 - DNA, 27 bp, Artificial Sequence
  Synthetic
tgaggtgggugaaaaggaatgaaauaa

SEQ ID NO: 64518 - DNA, 22 bp, Artificial Sequence
  Synthetic
gcagctugaagggatggtugaa

SEQ ID NO: 64519 - DNA, 26 bp, Artificial Sequence
  Synthetic
cccacgccagutttgaatacttagua

SEQ ID NO: 64520 - DNA, 26 bp, Artificial Sequence
  Synthetic
tgtggaatttaaugttgcctcaucct

SEQ ID NO: 64521 - DNA, 22 bp, Artificial Sequence
  Synthetic
ctgtgagtguaaggacctgcut

SEQ ID NO: 64522 - DNA, 28 bp, Artificial Sequence
  Synthetic
actctgtgagcaaacuatggttaatuca

SEQ ID NO: 64523 - DNA, 28 bp, Artificial Sequence
  Synthetic
aggaagtttctgutgctatcacattuct

SEQ ID NO: 64524 - DNA, 29 bp, Artificial Sequence
  Synthetic
caattttgttaactuctcacgtgtctuct

SEQ ID NO: 64525 - DNA, 25 bp, Artificial Sequence
  Synthetic
gcaaacgggaagauaaaaccaaguc

SEQ ID NO: 64526 - DNA, 25 bp, Artificial Sequence
  Synthetic
cccccaauctgataactgugaagaa

SEQ ID NO: 64527 - DNA, 28 bp, Artificial Sequence
  Synthetic
tcttctagagaaucaggaaggaggtuac

SEQ ID NO: 64528 - DNA, 20 bp, Artificial Sequence
  Synthetic
cagacgagagggacaucugg

SEQ ID NO: 64529 - DNA, 21 bp, Artificial Sequence
  Synthetic
ctctcgcugtcgctggauaag

SEQ ID NO: 64530 - DNA, 20 bp, Artificial Sequence
  Synthetic
cgcgcaggaacuttgguagt

SEQ ID NO: 64531 - DNA, 23 bp, Artificial Sequence
  Synthetic
tgaactgcaggaucatgtcctug

SEQ ID NO: 64532 - DNA, 21 bp, Artificial Sequence
  Synthetic
cactgtcccugggtgtcttuc

SEQ ID NO: 64533 - DNA, 25 bp, Artificial Sequence
  Synthetic
gacaaaugcggagaugagaacaaaa

SEQ ID NO: 64534 - DNA, 23 bp, Artificial Sequence
  Synthetic
gaggtcagutattggugggacaa

SEQ ID NO: 64535 - DNA, 20 bp, Artificial Sequence
  Synthetic
atggccacguatgaguccac

SEQ ID NO: 64536 - DNA, 22 bp, Artificial Sequence
  Synthetic
gcctgcaggaccucatcatcua

SEQ ID NO: 64537 - DNA, 19 bp, Artificial Sequence
  Synthetic
acttccccaggucccucag

SEQ ID NO: 64538 - DNA, 20 bp, Artificial Sequence
  Synthetic
ctgatgccagugtccuggag

SEQ ID NO: 64539 - DNA, 18 bp, Artificial Sequence
  Synthetic
ctgcccaccccugcauag

SEQ ID NO: 64540 - DNA, 20 bp, Artificial Sequence
  Synthetic
agatttaccgcuggcccauc

SEQ ID NO: 64541 - DNA, 21 bp, Artificial Sequence
  Synthetic
gccaugccccttgttcuagac

SEQ ID NO: 64542 - DNA, 25 bp, Artificial Sequence
  Synthetic
gaacaacuggcagaaaatuaccaca

SEQ ID NO: 64543 - DNA, 22 bp, Artificial Sequence
  Synthetic
tgctggtgcucatctcatuacc

SEQ ID NO: 64544 - DNA, 24 bp, Artificial Sequence
  Synthetic
cttctctgtcccugtctcctcuaa

SEQ ID NO: 64545 - DNA, 22 bp, Artificial Sequence
  Synthetic
ctgggagcuatttctucagggt

SEQ ID NO: 64546 - DNA, 22 bp, Artificial Sequence
  Synthetic
gtttcacatguacgtgggtguc

SEQ ID NO: 64547 - DNA, 21 bp, Artificial Sequence
  Synthetic
gauggccaacaggaugacgat

SEQ ID NO: 64548 - DNA, 21 bp, Artificial Sequence
  Synthetic
ggutggctccaugaccaagat

SEQ ID NO: 64549 - DNA, 23 bp, Artificial Sequence
  Synthetic
tcaaggcuactccatcaaugcag

SEQ ID NO: 64550 - DNA, 18 bp, Artificial Sequence
  Synthetic
ggtggcugctgugcagaa

SEQ ID NO: 64551 - DNA, 18 bp, Artificial Sequence
  Synthetic
ccatcgugacgggtgugg

SEQ ID NO: 64552 - DNA, 22 bp, Artificial Sequence
  Synthetic
ctcctattucagcggccuagac

SEQ ID NO: 64553 - DNA, 25 bp, Artificial Sequence
  Synthetic
ggtccttgaautccaagctauccac

SEQ ID NO: 64554 - DNA, 21 bp, Artificial Sequence
  Synthetic
tgaagugggatcccuccaaca

SEQ ID NO: 64555 - DNA, 26 bp, Artificial Sequence
  Synthetic
gcttcacaaguccttcagttctttut

SEQ ID NO: 64556 - DNA, 22 bp, Artificial Sequence
  Synthetic
gcaagagguggcagaaatgcua

SEQ ID NO: 64557 - DNA, 28 bp, Artificial Sequence
  Synthetic
gaccctgtttcugaattgctaaattgut

SEQ ID NO: 64558 - DNA, 20 bp, Artificial Sequence
  Synthetic
ctggcaccgucatcugaaga

SEQ ID NO: 64559 - DNA, 21 bp, Artificial Sequence
  Synthetic
ccagctgugcctgtacctaug

SEQ ID NO: 64560 - DNA, 21 bp, Artificial Sequence
  Synthetic
caactgcugcaattucagggt

SEQ ID NO: 64561 - DNA, 25 bp, Artificial Sequence
  Synthetic
ctctgtagggcuacctcagaatcut

SEQ ID NO: 64562 - DNA, 20 bp, Artificial Sequence
  Synthetic
ggugaagcgaugaccacaga

SEQ ID NO: 64563 - DNA, 20 bp, Artificial Sequence
  Synthetic
cactguggcgcuagacacat

SEQ ID NO: 64564 - DNA, 22 bp, Artificial Sequence
  Synthetic
cctcaagccuctctttggctut

SEQ ID NO: 64565 - DNA, 28 bp, Artificial Sequence
  Synthetic
gtggattattctgutgttgttggcttut

SEQ ID NO: 64566 - DNA, 25 bp, Artificial Sequence
  Synthetic
cagagcattagugtgtagacgugaa

SEQ ID NO: 64567 - DNA, 22 bp, Artificial Sequence
  Synthetic
accatcttugtcagcagucaca

SEQ ID NO: 64568 - DNA, 27 bp, Artificial Sequence
  Synthetic
cagaaaugagaaaccaccaaucacaaa

SEQ ID NO: 64569 - DNA, 27 bp, Artificial Sequence
  Synthetic
atcagtgaucgcctcttgtgaauaaat

SEQ ID NO: 64570 - DNA, 20 bp, Artificial Sequence
  Synthetic
ccagugaggagccaucacat

SEQ ID NO: 64571 - DNA, 22 bp, Artificial Sequence
  Synthetic
tgaaacagcutcagctgcucaa

SEQ ID NO: 64572 - DNA, 22 bp, Artificial Sequence
  Synthetic
gtacccagagagcutcccuagt

SEQ ID NO: 64573 - DNA, 29 bp, Artificial Sequence
  Synthetic
gcttttgagaagaaugactttggtttucc

SEQ ID NO: 64574 - DNA, 24 bp, Artificial Sequence
  Synthetic
ctgagtgagaautttccgcuacct

SEQ ID NO: 64575 - DNA, 28 bp, Artificial Sequence
  Synthetic
gccttatggagcutcattttgttgatut

SEQ ID NO: 64576 - DNA, 24 bp, Artificial Sequence
  Synthetic
gggagtttcaugaagccactugat

SEQ ID NO: 64577 - DNA, 28 bp, Artificial Sequence
  Synthetic
ttaggtgatgtucacagaagaagatguc

SEQ ID NO: 64578 - DNA, 21 bp, Artificial Sequence
  Synthetic
ggacaggccuttatgttcgug

SEQ ID NO: 64579 - DNA, 21 bp, Artificial Sequence
  Synthetic
ttcttcgguggcagtcagaug

SEQ ID NO: 64580 - DNA, 23 bp, Artificial Sequence
  Synthetic
acgttgaccaaautgttgtgcuc

SEQ ID NO: 64581 - DNA, 26 bp, Artificial Sequence
  Synthetic
ggacacugaaaggaaggttttacuct

SEQ ID NO: 64582 - DNA, 22 bp, Artificial Sequence
  Synthetic
cutaacatgugcaaggcacgag

SEQ ID NO: 64583 - DNA, 22 bp, Artificial Sequence
  Synthetic
acatggtacgcugctgttctut

SEQ ID NO: 64584 - DNA, 27 bp, Artificial Sequence
  Synthetic
acauttaacacatgugacggaagagat

SEQ ID NO: 64585 - DNA, 28 bp, Artificial Sequence
  Synthetic
cattttaaacgtugttgcatttgtcugt

SEQ ID NO: 64586 - DNA, 21 bp, Artificial Sequence
  Synthetic
gttagtgccuttcacccugct

SEQ ID NO: 64587 - DNA, 28 bp, Artificial Sequence
  Synthetic
aaacagaugccagtattcuacaggaaaa

SEQ ID NO: 64588 - DNA, 27 bp, Artificial Sequence
  Synthetic
gagtttctgaugactaagtcugaagca

SEQ ID NO: 64589 - DNA, 28 bp, Artificial Sequence
  Synthetic
gcgagaggaaauaaagauaaaacagcag

SEQ ID NO: 64590 - DNA, 28 bp, Artificial Sequence
  Synthetic
ctcttgatagcutttctgtaatccugct

SEQ ID NO: 64591 - DNA, 28 bp, Artificial Sequence
  Synthetic
gatccctgaucctatagttttgttugct

SEQ ID NO: 64592 - DNA, 21 bp, Artificial Sequence
  Synthetic
ccgagtctcugctccatgaut

SEQ ID NO: 64593 - DNA, 29 bp, Artificial Sequence
  Synthetic
ggcaaagtgugaaacaattaagtgatuct

SEQ ID NO: 64594 - DNA, 28 bp, Artificial Sequence
  Synthetic
agatgctcucaccttttcctaattucag

SEQ ID NO: 64595 - DNA, 28 bp, Artificial Sequence
  Synthetic
gcaatgtctgaccuctgtttcaatacut

SEQ ID NO: 64596 - DNA, 24 bp, Artificial Sequence
  Synthetic
ccagtccaagucctaatttuccgt

SEQ ID NO: 64597 - DNA, 23 bp, Artificial Sequence
  Synthetic
accacagagaccauagagagugt

SEQ ID NO: 64598 - DNA, 26 bp, Artificial Sequence
  Synthetic
tucaacatgttuaaaacacagcagca

SEQ ID NO: 64599 - DNA, 28 bp, Artificial Sequence
  Synthetic
ctgaaaataaucccggtaaattctggut

SEQ ID NO: 64600 - DNA, 21 bp, Artificial Sequence
  Synthetic
ctgttccctugctgctcatug

SEQ ID NO: 64601 - DNA, 23 bp, Artificial Sequence
  Synthetic
caagcatttucgtccaagcauct

SEQ ID NO: 64602 - DNA, 24 bp, Artificial Sequence
  Synthetic
actucagcagcattatugcagaga

SEQ ID NO: 64603 - DNA, 22 bp, Artificial Sequence
  Synthetic
gccugaaggacaggaaacagua

SEQ ID NO: 64604 - DNA, 22 bp, Artificial Sequence
  Synthetic
ggctcuggccttttataugcct

SEQ ID NO: 64605 - DNA, 27 bp, Artificial Sequence
  Synthetic
actatccccaucctttcctcaaacaua

SEQ ID NO: 64606 - DNA, 23 bp, Artificial Sequence
  Synthetic
ccccaccccuagtcaactagtua

SEQ ID NO: 64607 - DNA, 20 bp, Artificial Sequence
  Synthetic
aggccagaaugugggaaagg

SEQ ID NO: 64608 - DNA, 20 bp, Artificial Sequence
  Synthetic
cagagcacccacccutcuac

SEQ ID NO: 64609 - DNA, 26 bp, Artificial Sequence
  Synthetic
atctcttcctagcucaccactactut

SEQ ID NO: 64610 - DNA, 29 bp, Artificial Sequence
  Synthetic
gtaaagtgctauggtcatattgtguagga

SEQ ID NO: 64611 - DNA, 22 bp, Artificial Sequence
  Synthetic
aatuggccaggauggagagaac

SEQ ID NO: 64612 - DNA, 22 bp, Artificial Sequence
  Synthetic
gagctggtuccagaactcagut

SEQ ID NO: 64613 - DNA, 27 bp, Artificial Sequence
  Synthetic
ccutacaaaacaaucaacaccagacac

SEQ ID NO: 64614 - DNA, 28 bp, Artificial Sequence
  Synthetic
tgtaggtagcuaggtaggatatgucact

SEQ ID NO: 64615 - DNA, 26 bp, Artificial Sequence
  Synthetic
agaggctuggaaagcaaatcgtatua

SEQ ID NO: 64616 - DNA, 28 bp, Artificial Sequence
  Synthetic
gagatgagutttgagttucagagacaga

SEQ ID NO: 64617 - DNA, 26 bp, Artificial Sequence
  Synthetic
cctacagacagcutctttttcgtugt

SEQ ID NO: 64618 - DNA, 23 bp, Artificial Sequence
  Synthetic
ggaaguactuggagggagagcat

SEQ ID NO: 64619 - DNA, 23 bp, Artificial Sequence
  Synthetic
gaggaaagcaacutaccatggug

SEQ ID NO: 64620 - DNA, 21 bp, Artificial Sequence
  Synthetic
ttccaaugaagcaggauggct

SEQ ID NO: 64621 - DNA, 27 bp, Artificial Sequence
  Synthetic
tgatgacaaaugcaaggaagagtguaa

SEQ ID NO: 64622 - DNA, 17 bp, Artificial Sequence
  Synthetic
cgcggagcugttccuca

SEQ ID NO: 64623 - DNA, 19 bp, Artificial Sequence
  Synthetic
gcctccccuctcccttcuc

SEQ ID NO: 64624 - DNA, 27 bp, Artificial Sequence
  Synthetic
tcttttggttguagtgagtggtttuct

SEQ ID NO: 64625 - DNA, 29 bp, Artificial Sequence
  Synthetic
caggagacuacaggaaaagatgguaaaat

SEQ ID NO: 64626 - DNA, 22 bp, Artificial Sequence
  Synthetic
ctttctccuggagctccttucc

SEQ ID NO: 64627 - DNA, 22 bp, Artificial Sequence
  Synthetic
acacauccccaggtcaguagaa

SEQ ID NO: 64628 - DNA, 25 bp, Artificial Sequence
  Synthetic
cttcacagaacaugcagtauaccca

SEQ ID NO: 64629 - DNA, 28 bp, Artificial Sequence
  Synthetic
gggtgttgaaagacucatcatgtttuaa

SEQ ID NO: 64630 - DNA, 21 bp, Artificial Sequence
  Synthetic
caacagugccatccgtuacct

SEQ ID NO: 64631 - DNA, 20 bp, Artificial Sequence
  Synthetic
ggagtggcutggtcaggtug

SEQ ID NO: 64632 - DNA, 19 bp, Artificial Sequence
  Synthetic
gcgatgugagcgtguggat

SEQ ID NO: 64633 - DNA, 21 bp, Artificial Sequence
  Synthetic
ccttccttugcatgtccucca

SEQ ID NO: 64634 - DNA, 23 bp, Artificial Sequence
  Synthetic
gggacagaaggacaugaattgug

SEQ ID NO: 64635 - DNA, 23 bp, Artificial Sequence
  Synthetic
ctttcgccacaguatgtcagcua

SEQ ID NO: 64636 - DNA, 21 bp, Artificial Sequence
  Synthetic
cctcaccaucctgtcgcttua

SEQ ID NO: 64637 - DNA, 23 bp, Artificial Sequence
  Synthetic
ctctatccaagucactggtggut

SEQ ID NO: 64638 - DNA, 19 bp, Artificial Sequence
  Synthetic
tggtctgagcuccctgcua

SEQ ID NO: 64639 - DNA, 19 bp, Artificial Sequence
  Synthetic
cacccacccacuttcucct

SEQ ID NO: 64640 - DNA, 24 bp, Artificial Sequence
  Synthetic
cttacaggtccugaaaaaggctug

SEQ ID NO: 64641 - DNA, 25 bp, Artificial Sequence
  Synthetic
ttagtttctccuccagcttcaagug

SEQ ID NO: 64642 - DNA, 28 bp, Artificial Sequence
  Synthetic
gggttatatgaucacgtgtgtttgagua

SEQ ID NO: 64643 - DNA, 21 bp, Artificial Sequence
  Synthetic
cagagtuccaagccuccaaca

SEQ ID NO: 64644 - DNA, 29 bp, Artificial Sequence
  Synthetic
gaggttacgtttugttttcttggaatuca

SEQ ID NO: 64645 - DNA, 21 bp, Artificial Sequence
  Synthetic
gggagucuggccaaggaaaag

SEQ ID NO: 64646 - DNA, 25 bp, Artificial Sequence
  Synthetic
gatgtctattggutccccatctuca

SEQ ID NO: 64647 - DNA, 20 bp, Artificial Sequence
  Synthetic
ccagcaccccuatgucaaga

SEQ ID NO: 64648 - DNA, 21 bp, Artificial Sequence
  Synthetic
gggaccgcaucttctttgugt

SEQ ID NO: 64649 - DNA, 22 bp, Artificial Sequence
  Synthetic
tccucagcacgagacaaaaugt

SEQ ID NO: 64650 - DNA, 21 bp, Artificial Sequence
  Synthetic
tgguagagccctgtcuccaag

SEQ ID NO: 64651 - DNA, 23 bp, Artificial Sequence
  Synthetic
acacagctugtcacagttuaggt

SEQ ID NO: 64652 - DNA, 20 bp, Artificial Sequence
  Synthetic
cagccuctcagcauccacat

SEQ ID NO: 64653 - DNA, 18 bp, Artificial Sequence
  Synthetic
ccagggccgugttuccag

SEQ ID NO: 64654 - DNA, 18 bp, Artificial Sequence
  Synthetic
gccugcagaactggguct

SEQ ID NO: 64655 - DNA, 20 bp, Artificial Sequence
  Synthetic
gggaucagaaaccgggctua

SEQ ID NO: 64656 - DNA, 21 bp, Artificial Sequence
  Synthetic
tcttgttugagcacgugcaac

SEQ ID NO: 64657 - DNA, 25 bp, Artificial Sequence
  Synthetic
agagaggaugaagacagagaaugga

SEQ ID NO: 64658 - DNA, 20 bp, Artificial Sequence
  Synthetic
tguggaccacgaggacauct

SEQ ID NO: 64659 - DNA, 20 bp, Artificial Sequence
  Synthetic
cccacucaggcagctcaaua

SEQ ID NO: 64660 - DNA, 25 bp, Artificial Sequence
  Synthetic
gactctuccaagtgtcaauggagaa

SEQ ID NO: 64661 - DNA, 21 bp, Artificial Sequence
  Synthetic
ggaatccuctcctgcucacct

SEQ ID NO: 64662 - DNA, 28 bp, Artificial Sequence
  Synthetic
ccuagttaatatcttcuacagggagcca

SEQ ID NO: 64663 - DNA, 26 bp, Artificial Sequence
  Synthetic
aaggtaattaacgugggtgtctcaut

SEQ ID NO: 64664 - DNA, 23 bp, Artificial Sequence
  Synthetic
tgtggcagguagagggtgaaaua

SEQ ID NO: 64665 - DNA, 21 bp, Artificial Sequence
  Synthetic
gttactgacgcauggcctcut

SEQ ID NO: 64666 - DNA, 26 bp, Artificial Sequence
  Synthetic
ccagttcaguaaggtcaatctcauca

SEQ ID NO: 64667 - DNA, 28 bp, Artificial Sequence
  Synthetic
agaggaagggtutaactgagagaguaaa

SEQ ID NO: 64668 - DNA, 27 bp, Artificial Sequence
  Synthetic
acttatuaccccacaaaattgacuggt

SEQ ID NO: 64669 - DNA, 27 bp, Artificial Sequence
  Synthetic
ggctcttctggcutcactttaaaaaut

SEQ ID NO: 64670 - DNA, 28 bp, Artificial Sequence
  Synthetic
gcattgcgtaguatgtagtaatcacuca

SEQ ID NO: 64671 - DNA, 21 bp, Artificial Sequence
  Synthetic
gagcagatggugtcagagguc

SEQ ID NO: 64672 - DNA, 28 bp, Artificial Sequence
  Synthetic
gaccaaatuaaggcattttctctuggaa

SEQ ID NO: 64673 - DNA, 26 bp, Artificial Sequence
  Synthetic
tgctaaatauagggtcatccugggaa

SEQ ID NO: 64674 - DNA, 24 bp, Artificial Sequence
  Synthetic
acaugaatgaaatcuccccacact

SEQ ID NO: 64675 - DNA, 21 bp, Artificial Sequence
  Synthetic
gtcttcctgguccacaagguc

SEQ ID NO: 64676 - DNA, 20 bp, Artificial Sequence
  Synthetic
accugaggacctggaucacc

SEQ ID NO: 64677 - DNA, 28 bp, Artificial Sequence
  Synthetic
gcaattggcaggauaaaagtagtuagga

SEQ ID NO: 64678 - DNA, 25 bp, Artificial Sequence
  Synthetic
aggtgtcctaguggtaataggcaut

SEQ ID NO: 64679 - DNA, 26 bp, Artificial Sequence
  Synthetic
cctaatgaagaauttggtccaggugt

SEQ ID NO: 64680 - DNA, 21 bp, Artificial Sequence
  Synthetic
tcccagucaccacagtccuaa

SEQ ID NO: 64681 - DNA, 19 bp, Artificial Sequence
  Synthetic
gcauccggcccagactcua

SEQ ID NO: 64682 - DNA, 21 bp, Artificial Sequence
  Synthetic
gctcacaccuctctcctcugt

SEQ ID NO: 64683 - DNA, 18 bp, Artificial Sequence
  Synthetic
tcaagcccccucccauga

SEQ ID NO: 64684 - DNA, 22 bp, Artificial Sequence
  Synthetic
tccaccccaucagttctctcut

SEQ ID NO: 64685 - DNA, 23 bp, Artificial Sequence
  Synthetic
aattagcaaggucaccaggacuc

SEQ ID NO: 64686 - DNA, 25 bp, Artificial Sequence
  Synthetic
gttttccauacagagtccugaggaa

SEQ ID NO: 64687 - DNA, 22 bp, Artificial Sequence
  Synthetic
gccctcaaauatggtcccaucc

SEQ ID NO: 64688 - DNA, 21 bp, Artificial Sequence
  Synthetic
catgcacgguagggctgtuaa

SEQ ID NO: 64689 - DNA, 21 bp, Artificial Sequence
  Synthetic
gcctgtaacuccaagggtuca

SEQ ID NO: 64690 - DNA, 24 bp, Artificial Sequence
  Synthetic
gcatcacugtgcaattagugacat

SEQ ID NO: 64691 - DNA, 26 bp, Artificial Sequence
  Synthetic
ggacattuccaagaggtctgacttuc

SEQ ID NO: 64692 - DNA, 26 bp, Artificial Sequence
  Synthetic
agaaaaatcucccatcctgctugaaa

SEQ ID NO: 64693 - DNA, 26 bp, Artificial Sequence
  Synthetic
ggatttgctccutggagtttacatuc

SEQ ID NO: 64694 - DNA, 24 bp, Artificial Sequence
  Synthetic
ggattccttucatcatcgtgguca

SEQ ID NO: 64695 - DNA, 28 bp, Artificial Sequence
  Synthetic
gtgtgtcuagagacagaaaccaaatuct

SEQ ID NO: 64696 - DNA, 24 bp, Artificial Sequence
  Synthetic
acatgaagtccutcagtgaagcuc

SEQ ID NO: 64697 - DNA, 23 bp, Artificial Sequence
  Synthetic
ggtgttcctuaggagtgtgugat

SEQ ID NO: 64698 - DNA, 28 bp, Artificial Sequence
  Synthetic
gtacaccttatcguttctcattaccuga

SEQ ID NO: 64699 - DNA, 26 bp, Artificial Sequence
  Synthetic
gcaggagacacagcugataauagagt

SEQ ID NO: 64700 - DNA, 22 bp, Artificial Sequence
  Synthetic
ctgttctcccuggtttctcucc

SEQ ID NO: 64701 - DNA, 28 bp, Artificial Sequence
  Synthetic
acuaaaaccaacagagaguaacacaaca

SEQ ID NO: 64702 - DNA, 27 bp, Artificial Sequence
  Synthetic
agagacttagaacugatctttccccut

SEQ ID NO: 64703 - DNA, 28 bp, Artificial Sequence
  Synthetic
cccagtatugcccttcaaataaguagag

SEQ ID NO: 64704 - DNA, 24 bp, Artificial Sequence
  Synthetic
tcctctctttuccttatgccccua

SEQ ID NO: 64705 - DNA, 30 bp, Artificial Sequence
  Synthetic
accatacagaaaacauacaaaguaccacat

SEQ ID NO: 64706 - DNA, 28 bp, Artificial Sequence
  Synthetic
gttgggaatcautggcaaagaaaauaga

SEQ ID NO: 64707 - DNA, 27 bp, Artificial Sequence
  Synthetic
tcagcagatacaugatcctacttucca

SEQ ID NO: 64708 - DNA, 27 bp, Artificial Sequence
  Synthetic
tcttgatccaauattttagggcugcat

SEQ ID NO: 64709 - DNA, 28 bp, Artificial Sequence
  Synthetic
tgagcacagtttutacgatttcctcuaa

SEQ ID NO: 64710 - DNA, 21 bp, Artificial Sequence
  Synthetic
ctggcatcccutggtcagaut

SEQ ID NO: 64711 - DNA, 27 bp, Artificial Sequence
  Synthetic
aacattuacgagacaaagggttguagt

SEQ ID NO: 64712 - DNA, 22 bp, Artificial Sequence
  Synthetic
cgttaaacaagutgcctcguga

SEQ ID NO: 64713 - DNA, 23 bp, Artificial Sequence
  Synthetic
tctctaggccautgagcactgua

SEQ ID NO: 64714 - DNA, 27 bp, Artificial Sequence
  Synthetic
cgttaacattugcttcatctuccaaga

SEQ ID NO: 64715 - DNA, 28 bp, Artificial Sequence
  Synthetic
ggagacaggugatccttttaatguaagt

SEQ ID NO: 64716 - DNA, 27 bp, Artificial Sequence
  Synthetic
gcagttgcacaggcugtatatattcut

SEQ ID NO: 64717 - DNA, 24 bp, Artificial Sequence
  Synthetic
gactggugaaaacgtttgtggtut

SEQ ID NO: 64718 - DNA, 22 bp, Artificial Sequence
  Synthetic
agaagcagccuggguaaaacat

SEQ ID NO: 64719 - DNA, 27 bp, Artificial Sequence
  Synthetic
ggttttcatgaucgtttccttagucag

SEQ ID NO: 64720 - DNA, 19 bp, Artificial Sequence
  Synthetic
cacagugcgcctttucgac

SEQ ID NO: 64721 - DNA, 19 bp, Artificial Sequence
  Synthetic
tcucugaggcgggaaagga

SEQ ID NO: 64722 - DNA, 25 bp, Artificial Sequence
  Synthetic
tgctgccgtauctgaagaagaaaut

SEQ ID NO: 64723 - DNA, 27 bp, Artificial Sequence
  Synthetic
tcctccagattuggaagctctaaatug

SEQ ID NO: 64724 - DNA, 22 bp, Artificial Sequence
  Synthetic
cattgcttgccugttcggttut

SEQ ID NO: 64725 - DNA, 20 bp, Artificial Sequence
  Synthetic
cautcagtcguccccaccag

SEQ ID NO: 64726 - DNA, 23 bp, Artificial Sequence
  Synthetic
agagtgataccuttccccaggut

SEQ ID NO: 64727 - DNA, 23 bp, Artificial Sequence
  Synthetic
tgtttgttctucccttcccugag

SEQ ID NO: 64728 - DNA, 23 bp, Artificial Sequence
  Synthetic
cuatcacugaggcaagggaagaa

SEQ ID NO: 64729 - DNA, 22 bp, Artificial Sequence
  Synthetic
gctttgatucgacagaggucac

SEQ ID NO: 64730 - DNA, 25 bp, Artificial Sequence
  Synthetic
aataccaagcacucatgaaauggga

SEQ ID NO: 64731 - DNA, 26 bp, Artificial Sequence
  Synthetic
tttgctggcaagutctatgagtguat

SEQ ID NO: 64732 - DNA, 26 bp, Artificial Sequence
  Synthetic
gcacttttagagcucagtttggaugt

SEQ ID NO: 64733 - DNA, 22 bp, Artificial Sequence
  Synthetic
atgtcctgucctagggttucct

SEQ ID NO: 64734 - DNA, 28 bp, Artificial Sequence
  Synthetic
acctcctaauacaggctcttaacauaca

SEQ ID NO: 64735 - DNA, 27 bp, Artificial Sequence
  Synthetic
ccttgtttaggcuaatgacccaagaut

SEQ ID NO: 64736 - DNA, 24 bp, Artificial Sequence
  Synthetic
ccaaattcacacugtagcagctut

SEQ ID NO: 64737 - DNA, 29 bp, Artificial Sequence
  Synthetic
agcataatgaauaccctagagagugaaga

SEQ ID NO: 64738 - DNA, 24 bp, Artificial Sequence
  Synthetic
tgtgttgaugacgatgacagugat

SEQ ID NO: 64739 - DNA, 25 bp, Artificial Sequence
  Synthetic
ccagatggguagttgtgggatttut

SEQ ID NO: 64740 - DNA, 27 bp, Artificial Sequence
  Synthetic
ctaagagacaaagaaccugcctttuct

SEQ ID NO: 64741 - DNA, 28 bp, Artificial Sequence
  Synthetic
atgttttaaaattgcuttggcaggauct

SEQ ID NO: 64742 - DNA, 19 bp, Artificial Sequence
  Synthetic
gcucagcaccacgucacaa

SEQ ID NO: 64743 - DNA, 18 bp, Artificial Sequence
  Synthetic
gcaggaaccgggugagug

SEQ ID NO: 64744 - DNA, 25 bp, Artificial Sequence
  Synthetic
cagtatgccaacaugacaaatgugt

SEQ ID NO: 64745 - DNA, 26 bp, Artificial Sequence
  Synthetic
tctataaccugctgaagaagguagag

SEQ ID NO: 64746 - DNA, 27 bp, Artificial Sequence
  Synthetic
aatgactttcagguacaatgcagauca

SEQ ID NO: 64747 - DNA, 28 bp, Artificial Sequence
  Synthetic
acatacatgaaugctctttctgaagugt

SEQ ID NO: 64748 - DNA, 27 bp, Artificial Sequence
  Synthetic
tctgatgttacaagaaaugtccagcut

SEQ ID NO: 64749 - DNA, 28 bp, Artificial Sequence
  Synthetic
actttgtacaaugccactctcgtattut

SEQ ID NO: 64750 - DNA, 17 bp, Artificial Sequence
  Synthetic
gcccuccccucggacaa

SEQ ID NO: 64751 - DNA, 22 bp, Artificial Sequence
  Synthetic
tcacctcuagcctctctgtucc

SEQ ID NO: 64752 - DNA, 17 bp, Artificial Sequence
  Synthetic
cgccgcauccactcucc

SEQ ID NO: 64753 - DNA, 19 bp, Artificial Sequence
  Synthetic
agcuggaggagccctuaga

SEQ ID NO: 64754 - DNA, 28 bp, Artificial Sequence
  Synthetic
aggaagaaaatcaaucactctccttugt

SEQ ID NO: 64755 - DNA, 23 bp, Artificial Sequence
  Synthetic
cctaaaaagcugcgtgtgttucc

SEQ ID NO: 64756 - DNA, 26 bp, Artificial Sequence
  Synthetic
ctcttctacaucatcaacatccuggt

SEQ ID NO: 64757 - DNA, 19 bp, Artificial Sequence
  Synthetic
gcagggagcuccaggaaug

SEQ ID NO: 64758 - DNA, 27 bp, Artificial Sequence
  Synthetic
aaaaattaccuaacaggcatccuggaa

SEQ ID NO: 64759 - DNA, 28 bp, Artificial Sequence
  Synthetic
gtctctgtaagautactgcaagccuaaa

SEQ ID NO: 64760 - DNA, 24 bp, Artificial Sequence
  Synthetic
agaaatctcugttatgccuggcaa

SEQ ID NO: 64761 - DNA, 26 bp, Artificial Sequence
  Synthetic
aaagcacgctuagattggaatacuga

SEQ ID NO: 64762 - DNA, 20 bp, Artificial Sequence
  Synthetic
tggtcaccccucagctcuaa

SEQ ID NO: 64763 - DNA, 21 bp, Artificial Sequence
  Synthetic
gttccuccaccgtacgaguag

SEQ ID NO: 64764 - DNA, 22 bp, Artificial Sequence
  Synthetic
cactgggagutgccatatcugt

SEQ ID NO: 64765 - DNA, 22 bp, Artificial Sequence
  Synthetic
gcagctcugtgttgtggtugat

SEQ ID NO: 64766 - DNA, 31 bp, Artificial Sequence
  Synthetic
tcctggattaaaucaagaaaatgggaatuca

SEQ ID NO: 64767 - DNA, 28 bp, Artificial Sequence
  Synthetic
ccataggtagaaauactggctaaaucct

SEQ ID NO: 64768 - DNA, 23 bp, Artificial Sequence
  Synthetic
tctcttacccucatgcccucaaa

SEQ ID NO: 64769 - DNA, 22 bp, Artificial Sequence
  Synthetic
cctccccauttctacttugcct

SEQ ID NO: 64770 - DNA, 22 bp, Artificial Sequence
  Synthetic
cagctggaggutgttcatcuct

SEQ ID NO: 64771 - DNA, 20 bp, Artificial Sequence
  Synthetic
cttggtgagccugacccaut

SEQ ID NO: 64772 - DNA, 23 bp, Artificial Sequence
  Synthetic
ggaagatgaugaggaaggcauga

SEQ ID NO: 64773 - DNA, 20 bp, Artificial Sequence
  Synthetic
ggaaccugacactggtgcua

SEQ ID NO: 64774 - DNA, 19 bp, Artificial Sequence
  Synthetic
ggtaccugcagcggaagug

SEQ ID NO: 64775 - DNA, 21 bp, Artificial Sequence
  Synthetic
ggctgacgcaaauctccugat

SEQ ID NO: 64776 - DNA, 29 bp, Artificial Sequence
  Synthetic
ggtcagggcauaaatagaaaatacaguca

SEQ ID NO: 64777 - DNA, 21 bp, Artificial Sequence
  Synthetic
atgcaaggcggaaacuttugg

SEQ ID NO: 64778 - DNA, 23 bp, Artificial Sequence
  Synthetic
agagauggcagaaccaaagctuc

SEQ ID NO: 64779 - DNA, 24 bp, Artificial Sequence
  Synthetic
ggtggaggcugattctaattguct

SEQ ID NO: 64780 - DNA, 28 bp, Artificial Sequence
  Synthetic
ctctagguccagaatgaaaauaacagga

SEQ ID NO: 64781 - DNA, 25 bp, Artificial Sequence
  Synthetic
tcggctgttucctctaaatgtgaug

SEQ ID NO: 64782 - DNA, 21 bp, Artificial Sequence
  Synthetic
tccaugaggcacgaguacaga

SEQ ID NO: 64783 - DNA, 28 bp, Artificial Sequence
  Synthetic
tcatgctgttgutaactgatcttctuca

SEQ ID NO: 64784 - DNA, 21 bp, Artificial Sequence
  Synthetic
gaggtaaugggagccagcauc

SEQ ID NO: 64785 - DNA, 24 bp, Artificial Sequence
  Synthetic
gcatagggagcucacgttcttuac

SEQ ID NO: 64786 - DNA, 21 bp, Artificial Sequence
  Synthetic
ggttgccutcctagcuaccct

SEQ ID NO: 64787 - DNA, 20 bp, Artificial Sequence
  Synthetic
ccgaagcggaagutgcucat

SEQ ID NO: 64788 - DNA, 20 bp, Artificial Sequence
  Synthetic
tctcacgcucccttgcttug

SEQ ID NO: 64789 - DNA, 31 bp, Artificial Sequence
  Synthetic
acaccaactatatugtaatcacagtctaaug

SEQ ID NO: 64790 - DNA, 17 bp, Artificial Sequence
  Synthetic
agggcggacgugaccua

SEQ ID NO: 64791 - DNA, 20 bp, Artificial Sequence
  Synthetic
gttggccaguagcaggtuct

SEQ ID NO: 64792 - DNA, 20 bp, Artificial Sequence
  Synthetic
ctcccaccuttgaggacugt

SEQ ID NO: 64793 - DNA, 19 bp, Artificial Sequence
  Synthetic
gcccugaggcccaagaaug

SEQ ID NO: 64794 - DNA, 23 bp, Artificial Sequence
  Synthetic
attcaatgcuggtggaagucaga

SEQ ID NO: 64795 - DNA, 19 bp, Artificial Sequence
  Synthetic
tgaggacagccutgcgaug

SEQ ID NO: 64796 - DNA, 18 bp, Artificial Sequence
  Synthetic
agguggctgugcgaagag

SEQ ID NO: 64797 - DNA, 17 bp, Artificial Sequence
  Synthetic
cggagucgtccccugag

SEQ ID NO: 64798 - DNA, 28 bp, Artificial Sequence
  Synthetic
aacaaccaaagaugatggattcattgug

SEQ ID NO: 64799 - DNA, 26 bp, Artificial Sequence
  Synthetic
tctcattcctutgggtttttguggat

SEQ ID NO: 64800 - DNA, 21 bp, Artificial Sequence
  Synthetic
aagagtuggaacgcugggaat

SEQ ID NO: 64801 - DNA, 28 bp, Artificial Sequence
  Synthetic
ccacutcctcacttatuagaaacacaca

SEQ ID NO: 64802 - DNA, 21 bp, Artificial Sequence
  Synthetic
ctctgcauattgccgcuagga

SEQ ID NO: 64803 - DNA, 27 bp, Artificial Sequence
  Synthetic
caaagagttcctutccacaaatgtgut

SEQ ID NO: 64804 - DNA, 20 bp, Artificial Sequence
  Synthetic
catccagagcggugggtuaa

SEQ ID NO: 64805 - DNA, 23 bp, Artificial Sequence
  Synthetic
gctgcgauagaagagaaccucag

SEQ ID NO: 64806 - DNA, 23 bp, Artificial Sequence
  Synthetic
aggtgtttcugcatgactgauga

SEQ ID NO: 64807 - DNA, 27 bp, Artificial Sequence
  Synthetic
caaaatgcgaacutgtctttcacttut

SEQ ID NO: 64808 - DNA, 26 bp, Artificial Sequence
  Synthetic
caagagaaagguaaagttcggguaga

SEQ ID NO: 64809 - DNA, 24 bp, Artificial Sequence
  Synthetic
aggttcagguattttgtggcugag

SEQ ID NO: 64810 - DNA, 25 bp, Artificial Sequence
  Synthetic
ggtgctttagauggcagttcugaaa

SEQ ID NO: 64811 - DNA, 24 bp, Artificial Sequence
  Synthetic
gtcttggtgcuttcctttgttucc

SEQ ID NO: 64812 - DNA, 21 bp, Artificial Sequence
  Synthetic
cattcaagugcgcaaccauct

SEQ ID NO: 64813 - DNA, 25 bp, Artificial Sequence
  Synthetic
caagttactuccatccacttuccca

SEQ ID NO: 64814 - DNA, 25 bp, Artificial Sequence
  Synthetic
caggtttatgucctttgtcaauccc

SEQ ID NO: 64815 - DNA, 27 bp, Artificial Sequence
  Synthetic
agtggcttugccagtagttaaaauagt

SEQ ID NO: 64816 - DNA, 28 bp, Artificial Sequence
  Synthetic
cctagtgataaaucagaaagctgcucaa

SEQ ID NO: 64817 - DNA, 26 bp, Artificial Sequence
  Synthetic
ttttaaaggaggugcctcatuagacc

SEQ ID NO: 64818 - DNA, 25 bp, Artificial Sequence
  Synthetic
tgttctgcacautgtcatccauagg

SEQ ID NO: 64819 - DNA, 25 bp, Artificial Sequence
  Synthetic
ccaatagcaaccutgtgatcctgut

SEQ ID NO: 64820 - DNA, 24 bp, Artificial Sequence
  Synthetic
cattggaccaccuccttcttgaut

SEQ ID NO: 64821 - DNA, 28 bp, Artificial Sequence
  Synthetic
gctacaaaaauggtttgcattccuaaga

SEQ ID NO: 64822 - DNA, 25 bp, Artificial Sequence
  Synthetic
acttccatcugtgagtctuaccagt

SEQ ID NO: 64823 - DNA, 28 bp, Artificial Sequence
  Synthetic
tcagattcatauggcttctgcaagtaut

SEQ ID NO: 64824 - DNA, 24 bp, Artificial Sequence
  Synthetic
cccatacccutaaaaatccgucca

SEQ ID NO: 64825 - DNA, 25 bp, Artificial Sequence
  Synthetic
gggctggttcuagtgatgtttcuac

SEQ ID NO: 64826 - DNA, 23 bp, Artificial Sequence
  Synthetic
agctctcgaugatgtctgtugag

SEQ ID NO: 64827 - DNA, 28 bp, Artificial Sequence
  Synthetic
gcatcacttuaaaagccagcaacauaat

SEQ ID NO: 64828 - DNA, 21 bp, Artificial Sequence
  Synthetic
aggtuggagagcttcauccac

SEQ ID NO: 64829 - DNA, 23 bp, Artificial Sequence
  Synthetic
agagcccuacagtttgacccuaa

SEQ ID NO: 64830 - DNA, 28 bp, Artificial Sequence
  Synthetic
cacctgaaatugatgtttggtttcucaa

SEQ ID NO: 64831 - DNA, 28 bp, Artificial Sequence
  Synthetic
ctgtgtgtttuacaaaagcatcatcuga

SEQ ID NO: 64832 - DNA, 25 bp, Artificial Sequence
  Synthetic
caaugattgtcuccaccagaggaat

SEQ ID NO: 64833 - DNA, 23 bp, Artificial Sequence
  Synthetic
gggtatgugtgttcttcaucagg

SEQ ID NO: 64834 - DNA, 28 bp, Artificial Sequence
  Synthetic
caaaaggacagaggguaacaagaguaaa

SEQ ID NO: 64835 - DNA, 24 bp, Artificial Sequence
  Synthetic
tttcggctcucctttcattuccat

SEQ ID NO: 64836 - DNA, 27 bp, Artificial Sequence
  Synthetic
ttgtggaaaaugtcagtgaacuacagt

SEQ ID NO: 64837 - DNA, 29 bp, Artificial Sequence
  Synthetic
tgaatgtacugaaaaccaggtatctucat

SEQ ID NO: 64838 - DNA, 21 bp, Artificial Sequence
  Synthetic
gtgaggtgaaagugccctgua

SEQ ID NO: 64839 - DNA, 28 bp, Artificial Sequence
  Synthetic
ggaaaacaggcuagattgtctgctauat

SEQ ID NO: 64840 - DNA, 28 bp, Artificial Sequence
  Synthetic
ggcttcaagtugtctttttaatgaucct

SEQ ID NO: 64841 - DNA, 26 bp, Artificial Sequence
  Synthetic
gtacctgctguaagtcttcacttuca

SEQ ID NO: 64842 - DNA, 21 bp, Artificial Sequence
  Synthetic
gggaagtcucccaggaaguca

SEQ ID NO: 64843 - DNA, 22 bp, Artificial Sequence
  Synthetic
ggctgtccuggagacaaactut

SEQ ID NO: 64844 - DNA, 23 bp, Artificial Sequence
  Synthetic
agucagagagtagugaggaggga

SEQ ID NO: 64845 - DNA, 25 bp, Artificial Sequence
  Synthetic
ttgctcttcaacutcacaccauagt

SEQ ID NO: 64846 - DNA, 23 bp, Artificial Sequence
  Synthetic
ggctctctccuctcatcctgtut

SEQ ID NO: 64847 - DNA, 21 bp, Artificial Sequence
  Synthetic
gcctccccaucactgtcugat

SEQ ID NO: 64848 - DNA, 21 bp, Artificial Sequence
  Synthetic
agcaaggaguccagtcggaua

SEQ ID NO: 64849 - DNA, 25 bp, Artificial Sequence
  Synthetic
catgtggguaagtatggaaguaggg

SEQ ID NO: 64850 - DNA, 22 bp, Artificial Sequence
  Synthetic
ggaagugcagcagaaaggcaua

SEQ ID NO: 64851 - DNA, 26 bp, Artificial Sequence
  Synthetic
gggcatctaaautcactggatuggaa

SEQ ID NO: 64852 - DNA, 26 bp, Artificial Sequence
  Synthetic
ctgaacautctgcagaugagaaggaa

SEQ ID NO: 64853 - DNA, 27 bp, Artificial Sequence
  Synthetic
ggctatttgcuatcctggaaagtucat

SEQ ID NO: 64854 - DNA, 26 bp, Artificial Sequence
  Synthetic
acttgtgcccaguttctaaatcauct

SEQ ID NO: 64855 - DNA, 19 bp, Artificial Sequence
  Synthetic
gccaaggucccccttctug

SEQ ID NO: 64856 - DNA, 24 bp, Artificial Sequence
  Synthetic
ccccagccuttagataaggucaga

SEQ ID NO: 64857 - DNA, 23 bp, Artificial Sequence
  Synthetic
ggatttauccagccttgggucag

SEQ ID NO: 64858 - DNA, 28 bp, Artificial Sequence
  Synthetic
gcatgagucaactggaagtuaaagaaaa

SEQ ID NO: 64859 - DNA, 27 bp, Artificial Sequence
  Synthetic
tggcacggcuttaagtcatauaagaat

SEQ ID NO: 64860 - DNA, 23 bp, Artificial Sequence
  Synthetic
ctctguggaaccagctctacauc

SEQ ID NO: 64861 - DNA, 24 bp, Artificial Sequence
  Synthetic
aagaaggutgaactgtuggacaca

SEQ ID NO: 64862 - DNA, 22 bp, Artificial Sequence
  Synthetic
cagggtggucctggtagauaga

SEQ ID NO: 64863 - DNA, 22 bp, Artificial Sequence
  Synthetic
tcatgucgggagctgcuaaaaa

SEQ ID NO: 64864 - DNA, 22 bp, Artificial Sequence
  Synthetic
aggtuccactgtatugggagga

SEQ ID NO: 64865 - DNA, 21 bp, Artificial Sequence
  Synthetic
cctcgguggagcttggttuac

SEQ ID NO: 64866 - DNA, 21 bp, Artificial Sequence
  Synthetic
gaggcttaaucctgagcuggt

SEQ ID NO: 64867 - DNA, 19 bp, Artificial Sequence
  Synthetic
ccaaccucaacgggctcua

SEQ ID NO: 64868 - DNA, 18 bp, Artificial Sequence
  Synthetic
ctgcccguccctgtctut

SEQ ID NO: 64869 - DNA, 19 bp, Artificial Sequence
  Synthetic
aacagcucagccgttucct

SEQ ID NO: 64870 - DNA, 21 bp, Artificial Sequence
  Synthetic
ggagaaccaggcuggaggtua

SEQ ID NO: 64871 - DNA, 21 bp, Artificial Sequence
  Synthetic
cgtggguatgtgcuggagaag

SEQ ID NO: 64872 - DNA, 22 bp, Artificial Sequence
  Synthetic
gcagacagacuaatgcuagggt

SEQ ID NO: 64873 - DNA, 23 bp, Artificial Sequence
  Synthetic
tcactgcatuctcctctctucct

SEQ ID NO: 64874 - DNA, 21 bp, Artificial Sequence
  Synthetic
ccctgcaugtgtggatgugaa

SEQ ID NO: 64875 - DNA, 22 bp, Artificial Sequence
  Synthetic
ccaguagacaccttcttugcct

SEQ ID NO: 64876 - DNA, 28 bp, Artificial Sequence
  Synthetic
ccaagcacaaaggaacuatctcattuga

SEQ ID NO: 64877 - DNA, 28 bp, Artificial Sequence
  Synthetic
ccgaaatatacaaautcagcctgacgua

SEQ ID NO: 64878 - DNA, 21 bp, Artificial Sequence
  Synthetic
gccacgagggutagacaaugt

SEQ ID NO: 64879 - DNA, 28 bp, Artificial Sequence
  Synthetic
aggaatgtatuggattcagaaugagcaa

SEQ ID NO: 64880 - DNA, 22 bp, Artificial Sequence
  Synthetic
ccagactgugaagagggaugga

SEQ ID NO: 64881 - DNA, 21 bp, Artificial Sequence
  Synthetic
caugtaugaagcggcagcaac

SEQ ID NO: 64882 - DNA, 26 bp, Artificial Sequence
  Synthetic
ataatcctttatguggcaagtgagut

SEQ ID NO: 64883 - DNA, 21 bp, Artificial Sequence
  Synthetic
ccttccagagcugcggataut

SEQ ID NO: 64884 - DNA, 21 bp, Artificial Sequence
  Synthetic
caggaggugacactguagacc

SEQ ID NO: 64885 - DNA, 28 bp, Artificial Sequence
  Synthetic
aggaatctatgcuttaggtgtgtacuga

SEQ ID NO: 64886 - DNA, 22 bp, Artificial Sequence
  Synthetic
caaaatcccaccuggtcucaac

SEQ ID NO: 64887 - DNA, 29 bp, Artificial Sequence
  Synthetic
agaacaaacatcacaautacaggagacut

SEQ ID NO: 64888 - DNA, 29 bp, Artificial Sequence
  Synthetic
agaaagtaagcaagaugagagagauaggt

SEQ ID NO: 64889 - DNA, 28 bp, Artificial Sequence
  Synthetic
tcctgagttaaugtgtgtttctttgugt

SEQ ID NO: 64890 - DNA, 28 bp, Artificial Sequence
  Synthetic
ttcattttgagcuattcccatccauaca

SEQ ID NO: 64891 - DNA, 28 bp, Artificial Sequence
  Synthetic
tcattttcttacagutgcctgtgtacut

SEQ ID NO: 64892 - DNA, 21 bp, Artificial Sequence
  Synthetic
ggaggcugcatcuaggcaaag

SEQ ID NO: 64893 - DNA, 27 bp, Artificial Sequence
  Synthetic
agacatcagcutccattatgaatucca

SEQ ID NO: 64894 - DNA, 23 bp, Artificial Sequence
  Synthetic
aagaggaaacaucugcggaagaa

SEQ ID NO: 64895 - DNA, 25 bp, Artificial Sequence
  Synthetic
ccaaagtggutcgtttctgatucat

SEQ ID NO: 64896 - DNA, 20 bp, Artificial Sequence
  Synthetic
cagtgtauccacgugggcaa

SEQ ID NO: 64897 - DNA, 26 bp, Artificial Sequence
  Synthetic
acagaggaaggaaaugucaaacaagt

SEQ ID NO: 64898 - DNA, 22 bp, Artificial Sequence
  Synthetic
agtaagccuttcaagggucagg

SEQ ID NO: 64899 - DNA, 24 bp, Artificial Sequence
  Synthetic
tcacatgtgcaaucttctgtgugt

SEQ ID NO: 64900 - DNA, 24 bp, Artificial Sequence
  Synthetic
acccattttccutaccttgtgucc

SEQ ID NO: 64901 - DNA, 26 bp, Artificial Sequence
  Synthetic
gccttctgaucactttctguaccaaa

SEQ ID NO: 64902 - DNA, 24 bp, Artificial Sequence
  Synthetic
cccacaaaacacacacutacucgt

SEQ ID NO: 64903 - DNA, 25 bp, Artificial Sequence
  Synthetic
ggtctcaacttugcacctttttcuc

SEQ ID NO: 64904 - DNA, 22 bp, Artificial Sequence
  Synthetic
ggctcuggacttcgauaggact

SEQ ID NO: 64905 - DNA, 27 bp, Artificial Sequence
  Synthetic
ttctcactttcuccccatcttttctuc

SEQ ID NO: 64906 - DNA, 26 bp, Artificial Sequence
  Synthetic
aaaaatcagaugactgacctgucgaa

SEQ ID NO: 64907 - DNA, 21 bp, Artificial Sequence
  Synthetic
gggagccucgtgactgatuag

SEQ ID NO: 64908 - DNA, 25 bp, Artificial Sequence
  Synthetic
tccttttcttugggccaatctuaca

SEQ ID NO: 64909 - DNA, 24 bp, Artificial Sequence
  Synthetic
agcctccctutcctgtatttcuct

SEQ ID NO: 64910 - DNA, 27 bp, Artificial Sequence
  Synthetic
aaaataaggtggaauctctcctgtugg

SEQ ID NO: 64911 - DNA, 22 bp, Artificial Sequence
  Synthetic
aagacgagcugtctctgttgug

SEQ ID NO: 64912 - DNA, 20 bp, Artificial Sequence
  Synthetic
agacacaucccgggtctcut

SEQ ID NO: 64913 - DNA, 27 bp, Artificial Sequence
  Synthetic
caggaccatagutatgaccagctttut

SEQ ID NO: 64914 - DNA, 21 bp, Artificial Sequence
  Synthetic
gtgaacaaggccagugacgua

SEQ ID NO: 64915 - DNA, 26 bp, Artificial Sequence
  Synthetic
ctccgcactcuaaatgttggaatuag

SEQ ID NO: 64916 - DNA, 20 bp, Artificial Sequence
  Synthetic
gctacaatugccgccuggaa

SEQ ID NO: 64917 - DNA, 25 bp, Artificial Sequence
  Synthetic
agaaagccaguctcttcaaactuca

SEQ ID NO: 64918 - DNA, 27 bp, Artificial Sequence
  Synthetic
ccaagaguacaaacttcacacuaacct

SEQ ID NO: 64919 - DNA, 28 bp, Artificial Sequence
  Synthetic
gtctgcaaaccagugataaaagcttaut

SEQ ID NO: 64920 - DNA, 27 bp, Artificial Sequence
  Synthetic
tgttcctaacucctgagcaaauagaga

SEQ ID NO: 64921 - DNA, 28 bp, Artificial Sequence
  Synthetic
ccatgaatgtuagcagaatgtctttuca

SEQ ID NO: 64922 - DNA, 24 bp, Artificial Sequence
  Synthetic
ccttcctacacucactgctttguc

SEQ ID NO: 64923 - DNA, 21 bp, Artificial Sequence
  Synthetic
ggaucccaccccattucacac

SEQ ID NO: 64924 - DNA, 24 bp, Artificial Sequence
  Synthetic
gaaattucaaccacagcagaugac

SEQ ID NO: 64925 - DNA, 28 bp, Artificial Sequence
  Synthetic
gtgacaagaaaucaagtagcaacaauca

SEQ ID NO: 64926 - DNA, 22 bp, Artificial Sequence
  Synthetic
ctcataguagcacagcugcaga

SEQ ID NO: 64927 - DNA, 27 bp, Artificial Sequence
  Synthetic
gcttctacaagtuagctgacttcctua

SEQ ID NO: 64928 - DNA, 24 bp, Artificial Sequence
  Synthetic
tggctgaaucacaagaagcugaat

SEQ ID NO: 64929 - DNA, 27 bp, Artificial Sequence
  Synthetic
tcaaattgtccutttcaaactgcaugg

SEQ ID NO: 64930 - DNA, 27 bp, Artificial Sequence
  Synthetic
gtcattgauggctatgcagaugaaaaa

SEQ ID NO: 64931 - DNA, 25 bp, Artificial Sequence
  Synthetic
cctctgcttucatagcttcctttug

SEQ ID NO: 64932 - DNA, 29 bp, Artificial Sequence
  Synthetic
aagattttaactgaaugccctactgtuct

SEQ ID NO: 64933 - DNA, 25 bp, Artificial Sequence
  Synthetic
ggatgcaatgcucttactcagttut

SEQ ID NO: 64934 - DNA, 23 bp, Artificial Sequence
  Synthetic
cagctttcacggauctagaggug

SEQ ID NO: 64935 - DNA, 28 bp, Artificial Sequence
  Synthetic
ccagcagagaauagagggagaatuaaaa

SEQ ID NO: 64936 - DNA, 24 bp, Artificial Sequence
  Synthetic
tgatgctacaugctgaaggucaac

SEQ ID NO: 64937 - DNA, 28 bp, Artificial Sequence
  Synthetic
ggctgttggtacauttctcaacttacut

SEQ ID NO: 64938 - DNA, 22 bp, Artificial Sequence
  Synthetic
ttctaagggugctcgtggttuc

SEQ ID NO: 64939 - DNA, 22 bp, Artificial Sequence
  Synthetic
cctttggcaaacuccagggaut

SEQ ID NO: 64940 - DNA, 21 bp, Artificial Sequence
  Synthetic
gcuttcgugggaacccacaat

SEQ ID NO: 64941 - DNA, 25 bp, Artificial Sequence
  Synthetic
gaagagcacaagagugggagaaaua

SEQ ID NO: 64942 - DNA, 21 bp, Artificial Sequence
  Synthetic
tggccaacuatgcctcucaga

SEQ ID NO: 64943 - DNA, 26 bp, Artificial Sequence
  Synthetic
ccacttcccaaagcuattcccataut

SEQ ID NO: 64944 - DNA, 22 bp, Artificial Sequence
  Synthetic
acugcaguacccacaaaaagac

SEQ ID NO: 64945 - DNA, 24 bp, Artificial Sequence
  Synthetic
gccagttccuaaatccaggaucaa

SEQ ID NO: 64946 - DNA, 25 bp, Artificial Sequence
  Synthetic
tgccattaauaagctttaggugcca

SEQ ID NO: 64947 - DNA, 28 bp, Artificial Sequence
  Synthetic
ctgctctcaucagggaaaggaaataaut

SEQ ID NO: 64948 - DNA, 27 bp, Artificial Sequence
  Synthetic
tgcttttatcguagttgatgctgaugt

SEQ ID NO: 64949 - DNA, 25 bp, Artificial Sequence
  Synthetic
tttaccatguttttgccugcaaagt

SEQ ID NO: 64950 - DNA, 26 bp, Artificial Sequence
  Synthetic
acattcatcucccttttcacctucac

SEQ ID NO: 64951 - DNA, 20 bp, Artificial Sequence
  Synthetic
ccagctcuggcttcagucat

SEQ ID NO: 64952 - DNA, 20 bp, Artificial Sequence
  Synthetic
aggagctgugctttcgagut

SEQ ID NO: 64953 - DNA, 18 bp, Artificial Sequence
  Synthetic
acacgacgccuctcccua

SEQ ID NO: 64954 - DNA, 18 bp, Artificial Sequence
  Synthetic
cagccugggagggaauga

SEQ ID NO: 64955 - DNA, 18 bp, Artificial Sequence
  Synthetic
cgcatcuccagcctcgug

SEQ ID NO: 64956 - DNA, 23 bp, Artificial Sequence
  Synthetic
ccacaaagtugagggtgattugg

SEQ ID NO: 64957 - DNA, 23 bp, Artificial Sequence
  Synthetic
cctggtcuccactctcgatcuat

SEQ ID NO: 64958 - DNA, 25 bp, Artificial Sequence
  Synthetic
ctcttactatuctgtccacgauggt

SEQ ID NO: 64959 - DNA, 29 bp, Artificial Sequence
  Synthetic
gctctcttaagcucactaattttggucat

SEQ ID NO: 64960 - DNA, 17 bp, Artificial Sequence
  Synthetic
ggaagcugcggccuaca

SEQ ID NO: 64961 - DNA, 18 bp, Artificial Sequence
  Synthetic
cccacgucggccatguaa

SEQ ID NO: 64962 - DNA, 21 bp, Artificial Sequence
  Synthetic
ctcttggaacagccuggtcut

SEQ ID NO: 64963 - DNA, 21 bp, Artificial Sequence
  Synthetic
ccgcttccccuaaccagatug

SEQ ID NO: 64964 - DNA, 19 bp, Artificial Sequence
  Synthetic
cucauggcccaagcagagt

SEQ ID NO: 64965 - DNA, 19 bp, Artificial Sequence
  Synthetic
ccccaccaucttccuccct

SEQ ID NO: 64966 - DNA, 20 bp, Artificial Sequence
  Synthetic
cccatggugcagtccatcuc

SEQ ID NO: 64967 - DNA, 21 bp, Artificial Sequence
  Synthetic
gctguaaggtgctugggacat

SEQ ID NO: 64968 - DNA, 25 bp, Artificial Sequence
  Synthetic
aactgttttcuccctctatgtggug

SEQ ID NO: 64969 - DNA, 25 bp, Artificial Sequence
  Synthetic
caggttatttgccutttcccttgut

SEQ ID NO: 64970 - DNA, 22 bp, Artificial Sequence
  Synthetic
cttctgaagcagutggcacaut

SEQ ID NO: 64971 - DNA, 23 bp, Artificial Sequence
  Synthetic
ccaaagucccaggatgtatccuc

SEQ ID NO: 64972 - DNA, 19 bp, Artificial Sequence
  Synthetic
ctcagcgucttgccgauca

SEQ ID NO: 64973 - DNA, 22 bp, Artificial Sequence
  Synthetic
gtcaaacaggcagacuccuaca

SEQ ID NO: 64974 - DNA, 22 bp, Artificial Sequence
  Synthetic
caggacaucgagaggagaagut

SEQ ID NO: 64975 - DNA, 23 bp, Artificial Sequence
  Synthetic
tccattttgcutccgttgtcuct

SEQ ID NO: 64976 - DNA, 21 bp, Artificial Sequence
  Synthetic
cctggcucttcccacuaaact

SEQ ID NO: 64977 - DNA, 25 bp, Artificial Sequence
  Synthetic
cctcaatgtauccctttggcattuc

SEQ ID NO: 64978 - DNA, 22 bp, Artificial Sequence
  Synthetic
gattgtccugagctgcggaaua

SEQ ID NO: 64979 - DNA, 24 bp, Artificial Sequence
  Synthetic
tcagtgcaaucaccaatatgguca

SEQ ID NO: 64980 - DNA, 21 bp, Artificial Sequence
  Synthetic
ggcaagcuagtgctgatugac

SEQ ID NO: 64981 - DNA, 26 bp, Artificial Sequence
  Synthetic
gaccccugggaaggtaattttagaut

SEQ ID NO: 64982 - DNA, 22 bp, Artificial Sequence
  Synthetic
gttgaaaggcaaauggccagua

SEQ ID NO: 64983 - DNA, 25 bp, Artificial Sequence
  Synthetic
tttaagcugcagaaacaagccatuc

SEQ ID NO: 64984 - DNA, 19 bp, Artificial Sequence
  Synthetic
gcccaagagccaagugguc

SEQ ID NO: 64985 - DNA, 28 bp, Artificial Sequence
  Synthetic
gggttattttgaucaagtgcatctctut

SEQ ID NO: 64986 - DNA, 27 bp, Artificial Sequence
  Synthetic
aatgattccuaccattgtuccacaagt

SEQ ID NO: 64987 - DNA, 26 bp, Artificial Sequence
  Synthetic
gagaaaaucgccgaaagtuaccaaaa

SEQ ID NO: 64988 - DNA, 20 bp, Artificial Sequence
  Synthetic
gtatcgugggcctagcugag

SEQ ID NO: 64989 - DNA, 23 bp, Artificial Sequence
  Synthetic
attgcgtttccugctttccttut

SEQ ID NO: 64990 - DNA, 20 bp, Artificial Sequence
  Synthetic
ctgggtgggucataaggugt

SEQ ID NO: 64991 - DNA, 25 bp, Artificial Sequence
  Synthetic
gctacaggaautcgaggattucagt

SEQ ID NO: 64992 - DNA, 20 bp, Artificial Sequence
  Synthetic
cgccugggaggttactguaa

SEQ ID NO: 64993 - DNA, 25 bp, Artificial Sequence
  Synthetic
cccgggactuaccactgaataaauc

SEQ ID NO: 64994 - DNA, 20 bp, Artificial Sequence
  Synthetic
ctgcuggcactcaugacaac

SEQ ID NO: 64995 - DNA, 25 bp, Artificial Sequence
  Synthetic
gcatactgatuggagtcacgtttut

SEQ ID NO: 64996 - DNA, 26 bp, Artificial Sequence
  Synthetic
cattttgacuccagctctttuaggga

SEQ ID NO: 64997 - DNA, 21 bp, Artificial Sequence
  Synthetic
tcagggcugtagctucaggat

SEQ ID NO: 64998 - DNA, 21 bp, Artificial Sequence
  Synthetic
gtttgccauaaagcggcaguc

SEQ ID NO: 64999 - DNA, 20 bp, Artificial Sequence
  Synthetic
tgggatguagagggcacuca

SEQ ID NO: 65000 - DNA, 21 bp, Artificial Sequence
  Synthetic
gcttatuccggcacaugcaaa

SEQ ID NO: 65001 - DNA, 29 bp, Artificial Sequence
  Synthetic
ggttgguagagaacttagaguagaaaagg

SEQ ID NO: 65002 - DNA, 23 bp, Artificial Sequence
  Synthetic
tgtttcugccacctctguacaaa

SEQ ID NO: 65003 - DNA, 23 bp, Artificial Sequence
  Synthetic
caatggtccugattgcagcaaua

SEQ ID NO: 65004 - DNA, 23 bp, Artificial Sequence
  Synthetic
cattcaccaucgagtgccaaaug

SEQ ID NO: 65005 - DNA, 28 bp, Artificial Sequence
  Synthetic
ctatctcacattcuagcaagttggctua

SEQ ID NO: 65006 - DNA, 22 bp, Artificial Sequence
  Synthetic
gcatgggugaaagctagcuaga

SEQ ID NO: 65007 - DNA, 28 bp, Artificial Sequence
  Synthetic
ggtgguagaactatgtgauagaaaaggt

SEQ ID NO: 65008 - DNA, 26 bp, Artificial Sequence
  Synthetic
ggctactgauttgaaaactuccacaa

SEQ ID NO: 65009 - DNA, 21 bp, Artificial Sequence
  Synthetic
gcattgutggtgtucaggact

SEQ ID NO: 65010 - DNA, 17 bp, Artificial Sequence
  Synthetic
gccgagguccccaugac

SEQ ID NO: 65011 - DNA, 17 bp, Artificial Sequence
  Synthetic
gcgcttuccagcgggua

SEQ ID NO: 65012 - DNA, 21 bp, Artificial Sequence
  Synthetic
cgacttctggugctctcagut

SEQ ID NO: 65013 - DNA, 21 bp, Artificial Sequence
  Synthetic
ctggatgcugaaggguaggag

SEQ ID NO: 65014 - DNA, 21 bp, Artificial Sequence
  Synthetic
cgggtcctcutgcctagacua

SEQ ID NO: 65015 - DNA, 26 bp, Artificial Sequence
  Synthetic
gagtttacctccautctgagaagcug

SEQ ID NO: 65016 - DNA, 21 bp, Artificial Sequence
  Synthetic
cgcagtcugagagccttugaa

SEQ ID NO: 65017 - DNA, 20 bp, Artificial Sequence
  Synthetic
tcccccaauccaaggcagua

SEQ ID NO: 65018 - DNA, 20 bp, Artificial Sequence
  Synthetic
tggaggtcgugaaagctgug

SEQ ID NO: 65019 - DNA, 22 bp, Artificial Sequence
  Synthetic
cccaaaacaugagccgctagua

SEQ ID NO: 65020 - DNA, 21 bp, Artificial Sequence
  Synthetic
ggttggcuctgaggactugac

SEQ ID NO: 65021 - DNA, 22 bp, Artificial Sequence
  Synthetic
cccctgaggugtgtctggaaua

SEQ ID NO: 65022 - DNA, 20 bp, Artificial Sequence
  Synthetic
agcagaaaugcagcccugat

SEQ ID NO: 65023 - DNA, 23 bp, Artificial Sequence
  Synthetic
ttgtaacccagutcagtctgcuc

SEQ ID NO: 65024 - DNA, 26 bp, Artificial Sequence
  Synthetic
tgtattcaguatagtcgcuggaggat

SEQ ID NO: 65025 - DNA, 27 bp, Artificial Sequence
  Synthetic
agagccagaatautccccatgatttut

SEQ ID NO: 65026 - DNA, 25 bp, Artificial Sequence
  Synthetic
tcctcctcatautcttcctcagcut

SEQ ID NO: 65027 - DNA, 28 bp, Artificial Sequence
  Synthetic
catggtagattcuacagaaatcacauga

SEQ ID NO: 65028 - DNA, 21 bp, Artificial Sequence
  Synthetic
tgttgctgugattagcugcct

SEQ ID NO: 65029 - DNA, 22 bp, Artificial Sequence
  Synthetic
ggaugaagaguggaagggcaaa

SEQ ID NO: 65030 - DNA, 21 bp, Artificial Sequence
  Synthetic
tgaggcctuggctaagcttut

SEQ ID NO: 65031 - DNA, 22 bp, Artificial Sequence
  Synthetic
tccatgaugctgtacuccacct

SEQ ID NO: 65032 - DNA, 23 bp, Artificial Sequence
  Synthetic
ggagtttgtgauctctcctgugg

SEQ ID NO: 65033 - DNA, 26 bp, Artificial Sequence
  Synthetic
tgtttacaagaauctctguggcaagt

SEQ ID NO: 65034 - DNA, 20 bp, Artificial Sequence
  Synthetic
ggccccaugtgatgacaucc

SEQ ID NO: 65035 - DNA, 22 bp, Artificial Sequence
  Synthetic
gtaatcagggcacuagctcugt

SEQ ID NO: 65036 - DNA, 22 bp, Artificial Sequence
  Synthetic
gcuagaggacaucaacgaccag

SEQ ID NO: 65037 - DNA, 22 bp, Artificial Sequence
  Synthetic
ctgttgtugccaatgtcugcat

SEQ ID NO: 65038 - DNA, 22 bp, Artificial Sequence
  Synthetic
gcauctacatccugagggacga

SEQ ID NO: 65039 - DNA, 21 bp, Artificial Sequence
  Synthetic
cacaatgcccugtctctccut

SEQ ID NO: 65040 - DNA, 24 bp, Artificial Sequence
  Synthetic
ggtgatccagaugatcgaugagaa

SEQ ID NO: 65041 - DNA, 22 bp, Artificial Sequence
  Synthetic
ggaggauagccaggacgaugat

SEQ ID NO: 65042 - DNA, 27 bp, Artificial Sequence
  Synthetic
gtagaaaggagugtgtgagtagaucac

SEQ ID NO: 65043 - DNA, 25 bp, Artificial Sequence
  Synthetic
gaagucagagcagatattuccccaa

SEQ ID NO: 65044 - DNA, 21 bp, Artificial Sequence
  Synthetic
gtggagaautccgaggauccc

SEQ ID NO: 65045 - DNA, 23 bp, Artificial Sequence
  Synthetic
ggtgagacauagtgccatgcaut

SEQ ID NO: 65046 - DNA, 25 bp, Artificial Sequence
  Synthetic
ccagcatttcugactagttccctua

SEQ ID NO: 65047 - DNA, 21 bp, Artificial Sequence
  Synthetic
gactccaguaacaggcauggg

SEQ ID NO: 65048 - DNA, 23 bp, Artificial Sequence
  Synthetic
tggaggatcutgttggacuccat

SEQ ID NO: 65049 - DNA, 21 bp, Artificial Sequence
  Synthetic
ctgagaagaccaccugcauct

SEQ ID NO: 65050 - DNA, 27 bp, Artificial Sequence
  Synthetic
ctcagcuaaacctttcatugagacagt

SEQ ID NO: 65051 - DNA, 27 bp, Artificial Sequence
  Synthetic
ctcatgattggtutgaggttcatctuc

SEQ ID NO: 65052 - DNA, 19 bp, Artificial Sequence
  Synthetic
ccaggccguacttgtugct

SEQ ID NO: 65053 - DNA, 17 bp, Artificial Sequence
  Synthetic
ggugcacgcuccaacca

SEQ ID NO: 65054 - DNA, 23 bp, Artificial Sequence
  Synthetic
gccgtautcactaagugagcaga

SEQ ID NO: 65055 - DNA, 22 bp, Artificial Sequence
  Synthetic
aggtgttgaugagctccaagut

SEQ ID NO: 65056 - DNA, 20 bp, Artificial Sequence
  Synthetic
cttgcgcaaccugcttaucc

SEQ ID NO: 65057 - DNA, 20 bp, Artificial Sequence
  Synthetic
gcacagcggacaaagucuca

SEQ ID NO: 65058 - DNA, 22 bp, Artificial Sequence
  Synthetic
gatgttccaacucagcctguct

SEQ ID NO: 65059 - DNA, 21 bp, Artificial Sequence
  Synthetic
catgacguacacactgucggt

SEQ ID NO: 65060 - DNA, 21 bp, Artificial Sequence
  Synthetic
ctgtccccauagtccatcguc

SEQ ID NO: 65061 - DNA, 21 bp, Artificial Sequence
  Synthetic
tggctcttucccacagtccua

SEQ ID NO: 65062 - DNA, 24 bp, Artificial Sequence
  Synthetic
tccucaggagaagtcuaacaacga

SEQ ID NO: 65063 - DNA, 21 bp, Artificial Sequence
  Synthetic
cctccaaucggcuacagacaa

SEQ ID NO: 65064 - DNA, 28 bp, Artificial Sequence
  Synthetic
gtccctugcaaaaggaagaaaauagaac

SEQ ID NO: 65065 - DNA, 27 bp, Artificial Sequence
  Synthetic
ggttgagaugaaaggattccacugaaa

SEQ ID NO: 65066 - DNA, 28 bp, Artificial Sequence
  Synthetic
gtggagaaguagaatcaatggaagauga

SEQ ID NO: 65067 - DNA, 28 bp, Artificial Sequence
  Synthetic
gaggcctcttauactgccaaatcaauat

SEQ ID NO: 65068 - DNA, 29 bp, Artificial Sequence
  Synthetic
ctgagaagtttaaaugttgggtagtucct

SEQ ID NO: 65069 - DNA, 28 bp, Artificial Sequence
  Synthetic
cactgagtggcauctaagtttgctaaua

SEQ ID NO: 65070 - DNA, 22 bp, Artificial Sequence
  Synthetic
agacagugaccuaagggaccaa

SEQ ID NO: 65071 - DNA, 22 bp, Artificial Sequence
  Synthetic
gattcccttuccctgtgtccuc

SEQ ID NO: 65072 - DNA, 20 bp, Artificial Sequence
  Synthetic
ggtguagaggccagagucgt

SEQ ID NO: 65073 - DNA, 24 bp, Artificial Sequence
  Synthetic
cctaccctctuctgctcctctauc

SEQ ID NO: 65074 - DNA, 22 bp, Artificial Sequence
  Synthetic
ggtgatgcutggttcagugagt

SEQ ID NO: 65075 - DNA, 22 bp, Artificial Sequence
  Synthetic
gccgatgauggcgtagatgaug

SEQ ID NO: 65076 - DNA, 20 bp, Artificial Sequence
  Synthetic
ctgaactcugtgcgcuccat

SEQ ID NO: 65077 - DNA, 22 bp, Artificial Sequence
  Synthetic
cgaaucccagcagagaagaguc

SEQ ID NO: 65078 - DNA, 26 bp, Artificial Sequence
  Synthetic
tcactcttttcuccttgtcctcucat

SEQ ID NO: 65079 - DNA, 21 bp, Artificial Sequence
  Synthetic
gggagccacuctcctactcug

SEQ ID NO: 65080 - DNA, 21 bp, Artificial Sequence
  Synthetic
gggagggugatggcagacuaa

SEQ ID NO: 65081 - DNA, 25 bp, Artificial Sequence
  Synthetic
caagautcttgcctuccaaaaccag

SEQ ID NO: 65082 - DNA, 22 bp, Artificial Sequence
  Synthetic
gggtggtcaugatggatcucct

SEQ ID NO: 65083 - DNA, 27 bp, Artificial Sequence
  Synthetic
aaagaaggaagutctggaaccugaaaa

SEQ ID NO: 65084 - DNA, 21 bp, Artificial Sequence
  Synthetic
ctcacatgugccagtgucagt

SEQ ID NO: 65085 - DNA, 21 bp, Artificial Sequence
  Synthetic
ctucagcaggtgucaccagat

SEQ ID NO: 65086 - DNA, 23 bp, Artificial Sequence
  Synthetic
ctgcttcctuccattgttgtuca

SEQ ID NO: 65087 - DNA, 24 bp, Artificial Sequence
  Synthetic
cuaacatagacaaugccaaacgca

SEQ ID NO: 65088 - DNA, 28 bp, Artificial Sequence
  Synthetic
ctgtcttgtcttugctgatgtttcaaua

SEQ ID NO: 65089 - DNA, 28 bp, Artificial Sequence
  Synthetic
gaagatgtaccuatggtcctaguaggaa

SEQ ID NO: 65090 - DNA, 18 bp, Artificial Sequence
  Synthetic
gaaagcccuccccagucc

SEQ ID NO: 65091 - DNA, 27 bp, Artificial Sequence
  Synthetic
tgcactgtaataauccagactgtgtut

SEQ ID NO: 65092 - DNA, 21 bp, Artificial Sequence
  Synthetic
tgaggttcugcagagctccua

SEQ ID NO: 65093 - DNA, 28 bp, Artificial Sequence
  Synthetic
gcattaattctggautccttttgtgugt

SEQ ID NO: 65094 - DNA, 28 bp, Artificial Sequence
  Synthetic
acagttcataaugccagtgtaaactugt

SEQ ID NO: 65095 - DNA, 28 bp, Artificial Sequence
  Synthetic
caagctacccuaatcctgatctucaaaa

SEQ ID NO: 65096 - DNA, 26 bp, Artificial Sequence
  Synthetic
tgcagtcattaugctgccatctatut

SEQ ID NO: 65097 - DNA, 24 bp, Artificial Sequence
  Synthetic
tgcuttcatagctuccaccacaat

SEQ ID NO: 65098 - DNA, 26 bp, Artificial Sequence
  Synthetic
ggaacaaaaggaucaacagguacagt

SEQ ID NO: 65099 - DNA, 27 bp, Artificial Sequence
  Synthetic
aagtaatcatccauagctactttugca

SEQ ID NO: 65100 - DNA, 23 bp, Artificial Sequence
  Synthetic
aggcagcgauggaaatttttcug

SEQ ID NO: 65101 - DNA, 26 bp, Artificial Sequence
  Synthetic
cttgggtccuattgttcaatgucagt

SEQ ID NO: 65102 - DNA, 27 bp, Artificial Sequence
  Synthetic
gaggacucatatcaguaacaacccaat

SEQ ID NO: 65103 - DNA, 29 bp, Artificial Sequence
  Synthetic
acaataagctucaggagaccaattuaagt

SEQ ID NO: 65104 - DNA, 28 bp, Artificial Sequence
  Synthetic
agaaactctgtugaagaaatgggcatua

SEQ ID NO: 65105 - DNA, 31 bp, Artificial Sequence
  Synthetic
gaaggatcactuaaaagcatttgtaagtugt

SEQ ID NO: 65106 - DNA, 23 bp, Artificial Sequence
  Synthetic
gcctggauaacccuagggaacaa

SEQ ID NO: 65107 - DNA, 23 bp, Artificial Sequence
  Synthetic
ctctgaacaccuccacttuggat

SEQ ID NO: 65108 - DNA, 26 bp, Artificial Sequence
  Synthetic
atcaatgttgcuagtacacaaugggt

SEQ ID NO: 65109 - DNA, 28 bp, Artificial Sequence
  Synthetic
actcgtgttggaaaugtatattgtguga

SEQ ID NO: 65110 - DNA, 24 bp, Artificial Sequence
  Synthetic
aacctcugcaatcttucagacact

SEQ ID NO: 65111 - DNA, 28 bp, Artificial Sequence
  Synthetic
catggagacaucactttgaaaggauaca

SEQ ID NO: 65112 - DNA, 22 bp, Artificial Sequence
  Synthetic
agaatgugccaggctaatugct

SEQ ID NO: 65113 - DNA, 23 bp, Artificial Sequence
  Synthetic
ccagcctcaugatgtggaaaaug

SEQ ID NO: 65114 - DNA, 28 bp, Artificial Sequence
  Synthetic
tccatcttguaaaggatttaaggctgut

SEQ ID NO: 65115 - DNA, 23 bp, Artificial Sequence
  Synthetic
gtggcccatuttgatggtgttut

SEQ ID NO: 65116 - DNA, 18 bp, Artificial Sequence
  Synthetic
acgatucacggcaggugt

SEQ ID NO: 65117 - DNA, 18 bp, Artificial Sequence
  Synthetic
gggtcaggucccgucaag

SEQ ID NO: 65118 - DNA, 21 bp, Artificial Sequence
  Synthetic
gcaugacacacagggttucct

SEQ ID NO: 65119 - DNA, 23 bp, Artificial Sequence
  Synthetic
agcacaacagacugtcttuacga

SEQ ID NO: 65120 - DNA, 23 bp, Artificial Sequence
  Synthetic
agaaagaaggutggtucagcaca

SEQ ID NO: 65121 - DNA, 28 bp, Artificial Sequence
  Synthetic
gtccatgtagattucactggcctttaua

SEQ ID NO: 65122 - DNA, 28 bp, Artificial Sequence
  Synthetic
ggatacaaattcuaggccactggataug

SEQ ID NO: 65123 - DNA, 26 bp, Artificial Sequence
  Synthetic
accaaggaaaaacugtagagtgagug

SEQ ID NO: 65124 - DNA, 18 bp, Artificial Sequence
  Synthetic
ggaauccaggccacggua

SEQ ID NO: 65125 - DNA, 20 bp, Artificial Sequence
  Synthetic
tgagccaggccuctaguaca

SEQ ID NO: 65126 - DNA, 28 bp, Artificial Sequence
  Synthetic
tgagacaacagaagcautatactgctut

SEQ ID NO: 65127 - DNA, 25 bp, Artificial Sequence
  Synthetic
ctggagtgtguggaggaattacaut

SEQ ID NO: 65128 - DNA, 24 bp, Artificial Sequence
  Synthetic
gaagttaccuctgatccccugaag

SEQ ID NO: 65129 - DNA, 27 bp, Artificial Sequence
  Synthetic
actttgcaaaucaatttgcttctcugt

SEQ ID NO: 65130 - DNA, 23 bp, Artificial Sequence
  Synthetic
tcccaaaggucctgtgcctauaa

SEQ ID NO: 65131 - DNA, 23 bp, Artificial Sequence
  Synthetic
cggcctgucccatatgtttuaga

SEQ ID NO: 65132 - DNA, 24 bp, Artificial Sequence
  Synthetic
gggtcagtuttaggacactugaac

SEQ ID NO: 65133 - DNA, 27 bp, Artificial Sequence
  Synthetic
tttcctctcuctcctcctaauacacac

SEQ ID NO: 65134 - DNA, 24 bp, Artificial Sequence
  Synthetic
gtcagcctuagggtaaagtggaug

SEQ ID NO: 65135 - DNA, 22 bp, Artificial Sequence
  Synthetic
cctaacuccccaccttcatcug

SEQ ID NO: 65136 - DNA, 22 bp, Artificial Sequence
  Synthetic
tgtctcctgucaggaaggtcut

SEQ ID NO: 65137 - DNA, 22 bp, Artificial Sequence
  Synthetic
cagtacttugccagcatugcag

SEQ ID NO: 65138 - DNA, 19 bp, Artificial Sequence
  Synthetic
caggcucacctgucagcat

SEQ ID NO: 65139 - DNA, 19 bp, Artificial Sequence
  Synthetic
cctcaugcccagccttguc

SEQ ID NO: 65140 - DNA, 22 bp, Artificial Sequence
  Synthetic
ctcccccugttctatgagcuct

SEQ ID NO: 65141 - DNA, 25 bp, Artificial Sequence
  Synthetic
acagactccucctacttccttctug

SEQ ID NO: 65142 - DNA, 22 bp, Artificial Sequence
  Synthetic
ctacagauaccagggugcaaca

SEQ ID NO: 65143 - DNA, 25 bp, Artificial Sequence
  Synthetic
gtgccatgccutgaatttctttuct

SEQ ID NO: 65144 - DNA, 23 bp, Artificial Sequence
  Synthetic
cagaggtgcuttgcgtacctuat

SEQ ID NO: 65145 - DNA, 23 bp, Artificial Sequence
  Synthetic
cactaatgaaaggcugcctcugt

SEQ ID NO: 65146 - DNA, 25 bp, Artificial Sequence
  Synthetic
ctcattgccaauagtgatgactugg

SEQ ID NO: 65147 - DNA, 28 bp, Artificial Sequence
  Synthetic
ctccctataatugacttcttgctucaga

SEQ ID NO: 65148 - DNA, 21 bp, Artificial Sequence
  Synthetic
ggagtcggaaguagggaggut

SEQ ID NO: 65149 - DNA, 25 bp, Artificial Sequence
  Synthetic
catgttgatguaggttttgctccug

SEQ ID NO: 65150 - DNA, 28 bp, Artificial Sequence
  Synthetic
agccatcagaaauagacacttaccuaca

SEQ ID NO: 65151 - DNA, 27 bp, Artificial Sequence
  Synthetic
gtgacccccuacatattaatgttguca

SEQ ID NO: 65152 - DNA, 22 bp, Artificial Sequence
  Synthetic
gaggttguggcaagtuccaaag

SEQ ID NO: 65153 - DNA, 28 bp, Artificial Sequence
  Synthetic
ccagattggtgtuagatactctgcatut

SEQ ID NO: 65154 - DNA, 20 bp, Artificial Sequence
  Synthetic
ctugcacagacagcgguaag

SEQ ID NO: 65155 - DNA, 27 bp, Artificial Sequence
  Synthetic
ggttgcttaucaaggactgcatagaut

SEQ ID NO: 65156 - DNA, 23 bp, Artificial Sequence
  Synthetic
gtggctccautgatgttgatcuc

SEQ ID NO: 65157 - DNA, 27 bp, Artificial Sequence
  Synthetic
atgtcagctttucctgcaaaagaatut

SEQ ID NO: 65158 - DNA, 28 bp, Artificial Sequence
  Synthetic
acatgatcuagggttttauagcacgaac

SEQ ID NO: 65159 - DNA, 27 bp, Artificial Sequence
  Synthetic
ttttcatccagatuggtttccttcgua

SEQ ID NO: 65160 - DNA, 18 bp, Artificial Sequence
  Synthetic
ccaccauggacgccauca

SEQ ID NO: 65161 - DNA, 17 bp, Artificial Sequence
  Synthetic
gtgccaggcucgagucc

SEQ ID NO: 65162 - DNA, 21 bp, Artificial Sequence
  Synthetic
ccctcaguccagggttttcut

SEQ ID NO: 65163 - DNA, 23 bp, Artificial Sequence
  Synthetic
ccagttgtgugcacaaggagaua

SEQ ID NO: 65164 - DNA, 24 bp, Artificial Sequence
  Synthetic
aagttgttcggguaaaggacguag

SEQ ID NO: 65165 - DNA, 21 bp, Artificial Sequence
  Synthetic
tcacgtgautcgccgauaagt

SEQ ID NO: 65166 - DNA, 20 bp, Artificial Sequence
  Synthetic
cagcagtcgucagggaaguc

SEQ ID NO: 65167 - DNA, 23 bp, Artificial Sequence
  Synthetic
actcacctaucccagccaattuc

SEQ ID NO: 65168 - DNA, 20 bp, Artificial Sequence
  Synthetic
gcccuccgaggatagcacut

SEQ ID NO: 65169 - DNA, 17 bp, Artificial Sequence
  Synthetic
catgagccgccugcuct

SEQ ID NO: 65170 - DNA, 19 bp, Artificial Sequence
  Synthetic
cattgccaccccucacugt

SEQ ID NO: 65171 - DNA, 18 bp, Artificial Sequence
  Synthetic
gactuggaggcaccguca

SEQ ID NO: 65172 - DNA, 19 bp, Artificial Sequence
  Synthetic
ccccgaggutacaccauct

SEQ ID NO: 65173 - DNA, 19 bp, Artificial Sequence
  Synthetic
caagugaggcaccaggtuc

SEQ ID NO: 65174 - DNA, 19 bp, Artificial Sequence
  Synthetic
ccacaccuggctaugaggt

SEQ ID NO: 65175 - DNA, 26 bp, Artificial Sequence
  Synthetic
tcaataaaagagcugtctgacugcaa

SEQ ID NO: 65176 - DNA, 20 bp, Artificial Sequence
  Synthetic
ccugcggacgagaaatcugt

SEQ ID NO: 65177 - DNA, 19 bp, Artificial Sequence
  Synthetic
ccaguggacccgtttcgug

SEQ ID NO: 65178 - DNA, 18 bp, Artificial Sequence
  Synthetic
gggaugagccctcugcaa

SEQ ID NO: 65179 - DNA, 17 bp, Artificial Sequence
  Synthetic
ccgcuagtgtgcuccca

SEQ ID NO: 65180 - DNA, 20 bp, Artificial Sequence
  Synthetic
cacattggccuggatgcuct

SEQ ID NO: 65181 - DNA, 20 bp, Artificial Sequence
  Synthetic
agtaccgcugggaggtguat

SEQ ID NO: 65182 - DNA, 17 bp, Artificial Sequence
  Synthetic
gcucugcagggccacat

SEQ ID NO: 65183 - DNA, 18 bp, Artificial Sequence
  Synthetic
ctcgcugcagaaggucca

SEQ ID NO: 65184 - DNA, 18 bp, Artificial Sequence
  Synthetic
ggcatugagccggaugga

SEQ ID NO: 65185 - DNA, 20 bp, Artificial Sequence
  Synthetic
gtggaaguggatgugcaggt

SEQ ID NO: 65186 - DNA, 23 bp, Artificial Sequence
  Synthetic
gcggaaggugtaagagatgguag

SEQ ID NO: 65187 - DNA, 21 bp, Artificial Sequence
  Synthetic
tggctcaaugtgacggugaag

SEQ ID NO: 65188 - DNA, 19 bp, Artificial Sequence
  Synthetic
ctgggacaagagccuggug

SEQ ID NO: 65189 - DNA, 22 bp, Artificial Sequence
  Synthetic
cgtcaccgugaactacaacgua

SEQ ID NO: 65190 - DNA, 20 bp, Artificial Sequence
  Synthetic
cagcaaucgtggcugaagac

SEQ ID NO: 65191 - DNA, 25 bp, Artificial Sequence
  Synthetic
gtgacgccuctttgtuaaaagcaaa

SEQ ID NO: 65192 - DNA, 21 bp, Artificial Sequence
  Synthetic
catctgaggcuctccuagcaa

SEQ ID NO: 65193 - DNA, 24 bp, Artificial Sequence
  Synthetic
ggagtaaggacauctgagcttguc

SEQ ID NO: 65194 - DNA, 21 bp, Artificial Sequence
  Synthetic
ctcctggagguctgagatgug

SEQ ID NO: 65195 - DNA, 23 bp, Artificial Sequence
  Synthetic
gggacatggauagaaggtgttug

SEQ ID NO: 65196 - DNA, 27 bp, Artificial Sequence
  Synthetic
aaatctcttgguagctggtttacctuc

SEQ ID NO: 65197 - DNA, 28 bp, Artificial Sequence
  Synthetic
ggagaggautagtgactuaacgacaaat

SEQ ID NO: 65198 - DNA, 21 bp, Artificial Sequence
  Synthetic
gccattuggccagtgaugaca

SEQ ID NO: 65199 - DNA, 22 bp, Artificial Sequence
  Synthetic
ggaggaatggaugctggaggua

SEQ ID NO: 65200 - DNA, 27 bp, Artificial Sequence
  Synthetic
gcaatgatgtuctgtttgtatcucggt

SEQ ID NO: 65201 - DNA, 23 bp, Artificial Sequence
  Synthetic
gcatagatgaugttcccgtguct

SEQ ID NO: 65202 - DNA, 18 bp, Artificial Sequence
  Synthetic
ctttgggugcgtgtgcug

SEQ ID NO: 65203 - DNA, 20 bp, Artificial Sequence
  Synthetic
tccaccccacccacuagaut

SEQ ID NO: 65204 - DNA, 24 bp, Artificial Sequence
  Synthetic
catatactcaacuccctgcctcuc

SEQ ID NO: 65205 - DNA, 19 bp, Artificial Sequence
  Synthetic
agggcacuctgctgaucac

SEQ ID NO: 65206 - DNA, 22 bp, Artificial Sequence
  Synthetic
caccuccccaggacauagagat

SEQ ID NO: 65207 - DNA, 22 bp, Artificial Sequence
  Synthetic
caagtcctguttctccctcugg

SEQ ID NO: 65208 - DNA, 25 bp, Artificial Sequence
  Synthetic
tgacuctgtugaagcaaagagaaca

SEQ ID NO: 65209 - DNA, 27 bp, Artificial Sequence
  Synthetic
tgagttatgacagugggaactaugact

SEQ ID NO: 65210 - DNA, 24 bp, Artificial Sequence
  Synthetic
tggctttttcaguatcagctccuc

SEQ ID NO: 65211 - DNA, 23 bp, Artificial Sequence
  Synthetic
ttcgtactaaccucgtccccuaa

SEQ ID NO: 65212 - DNA, 18 bp, Artificial Sequence
  Synthetic
ccaguacgcccgttuggt

SEQ ID NO: 65213 - DNA, 23 bp, Artificial Sequence
  Synthetic
ctaagtgccaacuggcctaauct

SEQ ID NO: 65214 - DNA, 22 bp, Artificial Sequence
  Synthetic
aaccagtgguaggaggacucaa

SEQ ID NO: 65215 - DNA, 22 bp, Artificial Sequence
  Synthetic
caggaagaugactaggguccca

SEQ ID NO: 65216 - DNA, 22 bp, Artificial Sequence
  Synthetic
cacagtgaccugcaaaaggtug

SEQ ID NO: 65217 - DNA, 20 bp, Artificial Sequence
  Synthetic
ccgcctgacaucctcacaua

SEQ ID NO: 65218 - DNA, 23 bp, Artificial Sequence
  Synthetic
tctatgccatugagtctgcagug

SEQ ID NO: 65219 - DNA, 28 bp, Artificial Sequence
  Synthetic
agctctagcuttagtctctguaagacat

SEQ ID NO: 65220 - DNA, 24 bp, Artificial Sequence
  Synthetic
tttcctcttttucctccacctucc

SEQ ID NO: 65221 - DNA, 27 bp, Artificial Sequence
  Synthetic
agtaacagaatguccccatcaaaaucc

SEQ ID NO: 65222 - DNA, 22 bp, Artificial Sequence
  Synthetic
tgtgtgggcutcttgagttcug

SEQ ID NO: 65223 - DNA, 26 bp, Artificial Sequence
  Synthetic
cttgggaaggaaacutgactgtttug

SEQ ID NO: 65224 - DNA, 21 bp, Artificial Sequence
  Synthetic
tgagcagtugcctccaatcut

SEQ ID NO: 65225 - DNA, 26 bp, Artificial Sequence
  Synthetic
gtagaguctgatgaacuccagaaagg

SEQ ID NO: 65226 - DNA, 21 bp, Artificial Sequence
  Synthetic
ccuagttgaccucgacaagca

SEQ ID NO: 65227 - DNA, 21 bp, Artificial Sequence
  Synthetic
gtctgucacccgctccaauat

SEQ ID NO: 65228 - DNA, 21 bp, Artificial Sequence
  Synthetic
cccgctuccacatggacttua

SEQ ID NO: 65229 - DNA, 25 bp, Artificial Sequence
  Synthetic
ctctccuaaccaagtgtctcttucc

SEQ ID NO: 65230 - DNA, 19 bp, Artificial Sequence
  Synthetic
aggaggccgacuaccugag

SEQ ID NO: 65231 - DNA, 24 bp, Artificial Sequence
  Synthetic
ctctggaaggagucgtcagattug

SEQ ID NO: 65232 - DNA, 23 bp, Artificial Sequence
  Synthetic
ggaagaaggccuggtaaatgugg

SEQ ID NO: 65233 - DNA, 22 bp, Artificial Sequence
  Synthetic
cctttccggcucctcttctuag

SEQ ID NO: 65234 - DNA, 22 bp, Artificial Sequence
  Synthetic
gcagctggautttactgccaut

SEQ ID NO: 65235 - DNA, 25 bp, Artificial Sequence
  Synthetic
gcaagaaacaaggcagucaatcaut

SEQ ID NO: 65236 - DNA, 23 bp, Artificial Sequence
  Synthetic
agccacaccucacgttagaatut

SEQ ID NO: 65237 - DNA, 31 bp, Artificial Sequence
  Synthetic
agtaaaaatgtaagugaaagtcttcacugga

SEQ ID NO: 65238 - DNA, 22 bp, Artificial Sequence
  Synthetic
gcacugcaagcaaatggaucat

SEQ ID NO: 65239 - DNA, 30 bp, Artificial Sequence
  Synthetic
gcctagtttgcauttaaagtaagacauaag

SEQ ID NO: 65240 - DNA, 23 bp, Artificial Sequence
  Synthetic
cutcaaagtccuaccccaggaag

SEQ ID NO: 65241 - DNA, 22 bp, Artificial Sequence
  Synthetic
cgaggacagutacacccuagca

SEQ ID NO: 65242 - DNA, 20 bp, Artificial Sequence
  Synthetic
gcagacaaggcugtggucat

SEQ ID NO: 65243 - DNA, 25 bp, Artificial Sequence
  Synthetic
gctgactctcacutctctctctcuc

SEQ ID NO: 65244 - DNA, 21 bp, Artificial Sequence
  Synthetic
agattggagagaugcgcugac

SEQ ID NO: 65245 - DNA, 19 bp, Artificial Sequence
  Synthetic
gagcctcutgtccctugct

SEQ ID NO: 65246 - DNA, 18 bp, Artificial Sequence
  Synthetic
actugccagagcccctuc

SEQ ID NO: 65247 - DNA, 20 bp, Artificial Sequence
  Synthetic
gcgtcgtacutggccctauc

SEQ ID NO: 65248 - DNA, 21 bp, Artificial Sequence
  Synthetic
gatgatccgugccatggagut

SEQ ID NO: 65249 - DNA, 21 bp, Artificial Sequence
  Synthetic
gccttccuggagtgttcctug

SEQ ID NO: 65250 - DNA, 21 bp, Artificial Sequence
  Synthetic
catggtggcugagttccauga

SEQ ID NO: 65251 - DNA, 22 bp, Artificial Sequence
  Synthetic
gtgggttcuccagctcattgut

SEQ ID NO: 65252 - DNA, 18 bp, Artificial Sequence
  Synthetic
ggcuccaaccagcuggac

SEQ ID NO: 65253 - DNA, 19 bp, Artificial Sequence
  Synthetic
gcugcccgtguaccagaac

SEQ ID NO: 65254 - DNA, 26 bp, Artificial Sequence
  Synthetic
agcgtcatcucaatttatgtuagcga

SEQ ID NO: 65255 - DNA, 27 bp, Artificial Sequence
  Synthetic
tggatttgaaggaaugaagtgtucaga

SEQ ID NO: 65256 - DNA, 24 bp, Artificial Sequence
  Synthetic
ggcactcagcaucttcaagatgua

SEQ ID NO: 65257 - DNA, 20 bp, Artificial Sequence
  Synthetic
gtggtgtucctagccgucat

SEQ ID NO: 65258 - DNA, 21 bp, Artificial Sequence
  Synthetic
actctcacucccttgcaggua

SEQ ID NO: 65259 - DNA, 25 bp, Artificial Sequence
  Synthetic
tttagaacacaggagucacatgcuc

SEQ ID NO: 65260 - DNA, 20 bp, Artificial Sequence
  Synthetic
gggtcuggcattgctuaggg

SEQ ID NO: 65261 - DNA, 26 bp, Artificial Sequence
  Synthetic
tgcaggagaugcaaagaatttugaag

SEQ ID NO: 65262 - DNA, 21 bp, Artificial Sequence
  Synthetic
ccaaagaccugcaggatcugt

SEQ ID NO: 65263 - DNA, 19 bp, Artificial Sequence
  Synthetic
tccctccauctggctcucc

SEQ ID NO: 65264 - DNA, 20 bp, Artificial Sequence
  Synthetic
gcgtgtacucctcgcagtuc

SEQ ID NO: 65265 - DNA, 21 bp, Artificial Sequence
  Synthetic
caggccccuaacccagagaua

SEQ ID NO: 65266 - DNA, 23 bp, Artificial Sequence
  Synthetic
ggtcttcugacccctcactuaca

SEQ ID NO: 65267 - DNA, 18 bp, Artificial Sequence
  Synthetic
ccaccgugcccuaaacga

SEQ ID NO: 65268 - DNA, 21 bp, Artificial Sequence
  Synthetic
agcctcccautgaccaactuc

SEQ ID NO: 65269 - DNA, 27 bp, Artificial Sequence
  Synthetic
ggaatctggtcccuaatcctactcaua

SEQ ID NO: 65270 - DNA, 25 bp, Artificial Sequence
  Synthetic
agtgtucagggactatauccaaggt

SEQ ID NO: 65271 - DNA, 24 bp, Artificial Sequence
  Synthetic
gatagttgggaugaagtgggacug

SEQ ID NO: 65272 - DNA, 21 bp, Artificial Sequence
  Synthetic
catggccagaugacccuagaa

SEQ ID NO: 65273 - DNA, 26 bp, Artificial Sequence
  Synthetic
gacttggaccaguagatgaagatcuc

SEQ ID NO: 65274 - DNA, 18 bp, Artificial Sequence
  Synthetic
acgcgacaucggctucaa

SEQ ID NO: 65275 - DNA, 22 bp, Artificial Sequence
  Synthetic
ggttggtcuctgagatcucgaa

SEQ ID NO: 65276 - DNA, 20 bp, Artificial Sequence
  Synthetic
ggtctucagcaaccgcatut

SEQ ID NO: 65277 - DNA, 20 bp, Artificial Sequence
  Synthetic
gcugaggccaaggttcugac

SEQ ID NO: 65278 - DNA, 20 bp, Artificial Sequence
  Synthetic
acccccauctccgctctuat

SEQ ID NO: 65279 - DNA, 21 bp, Artificial Sequence
  Synthetic
agagggtcuggacacacauct

SEQ ID NO: 65280 - DNA, 20 bp, Artificial Sequence
  Synthetic
gtcaucgtggaugccaacaa

SEQ ID NO: 65281 - DNA, 21 bp, Artificial Sequence
  Synthetic
ctcgatcugagcttgggctua

SEQ ID NO: 65282 - DNA, 21 bp, Artificial Sequence
  Synthetic
caagagaggutctcgagccut

SEQ ID NO: 65283 - DNA, 22 bp, Artificial Sequence
  Synthetic
cagcctaauccccaatcccaut

SEQ ID NO: 65284 - DNA, 18 bp, Artificial Sequence
  Synthetic
gctccugcaggctgacuc

SEQ ID NO: 65285 - DNA, 25 bp, Artificial Sequence
  Synthetic
gtccatgaggutaaccccttactuc

SEQ ID NO: 65286 - DNA, 20 bp, Artificial Sequence
  Synthetic
ctcacccuaccccgaaggua

SEQ ID NO: 65287 - DNA, 20 bp, Artificial Sequence
  Synthetic
caacacacaccacgutccuc

SEQ ID NO: 65288 - DNA, 27 bp, Artificial Sequence
  Synthetic
ctatcatcacacaaacuagtcccacut

SEQ ID NO: 65289 - DNA, 28 bp, Artificial Sequence
  Synthetic
tctgactctcaaguctgacaattgttut

SEQ ID NO: 65290 - DNA, 21 bp, Artificial Sequence
  Synthetic
gtcagggatucccagcagtuc

SEQ ID NO: 65291 - DNA, 27 bp, Artificial Sequence
  Synthetic
gctatcaaaaggaucgcctatgagtut

SEQ ID NO: 65292 - DNA, 21 bp, Artificial Sequence
  Synthetic
ggtcctccuccgagttgaugt

SEQ ID NO: 65293 - DNA, 21 bp, Artificial Sequence
  Synthetic
caatcagcugtcagggcucat

SEQ ID NO: 65294 - DNA, 17 bp, Artificial Sequence
  Synthetic
cutaggucggcgggaga

SEQ ID NO: 65295 - DNA, 19 bp, Artificial Sequence
  Synthetic
aggtccugggctcctugaa

SEQ ID NO: 65296 - DNA, 19 bp, Artificial Sequence
  Synthetic
ggtggugcacctggactuc

SEQ ID NO: 65297 - DNA, 22 bp, Artificial Sequence
  Synthetic
gaaagcgaggugtaaagcucct

SEQ ID NO: 65298 - DNA, 25 bp, Artificial Sequence
  Synthetic
accacagcacauacacatttuagca

SEQ ID NO: 65299 - DNA, 23 bp, Artificial Sequence
  Synthetic
ggtatccaccuttctcugagcat

SEQ ID NO: 65300 - DNA, 20 bp, Artificial Sequence
  Synthetic
gcagggtcugcagtggtauc

SEQ ID NO: 65301 - DNA, 23 bp, Artificial Sequence
  Synthetic
ggactggaaaguacaaggcucac

SEQ ID NO: 65302 - DNA, 23 bp, Artificial Sequence
  Synthetic
gcgaaatauagccctgtccauct

SEQ ID NO: 65303 - DNA, 19 bp, Artificial Sequence
  Synthetic
ccacggutcagaaccugct

SEQ ID NO: 65304 - DNA, 28 bp, Artificial Sequence
  Synthetic
gtactatgcatguacattacagcctuct

SEQ ID NO: 65305 - DNA, 27 bp, Artificial Sequence
  Synthetic
gtgatgctgtuggatttctctttcaut

SEQ ID NO: 65306 - DNA, 25 bp, Artificial Sequence
  Synthetic
ctatcagctuacaccatgguaccaa

SEQ ID NO: 65307 - DNA, 25 bp, Artificial Sequence
  Synthetic
gtgtacgtgugactatccattguca

SEQ ID NO: 65308 - DNA, 27 bp, Artificial Sequence
  Synthetic
actaatacugcaagcaaactctcucac

SEQ ID NO: 65309 - DNA, 25 bp, Artificial Sequence
  Synthetic
gtggatgaauctggtaauccggaat

SEQ ID NO: 65310 - DNA, 21 bp, Artificial Sequence
  Synthetic
ctgcaaguggagaggtgacua

SEQ ID NO: 65311 - DNA, 28 bp, Artificial Sequence
  Synthetic
gatatctctgccucttcctctctctaut

SEQ ID NO: 65312 - DNA, 25 bp, Artificial Sequence
  Synthetic
gtatttatcgucttgaacccuccca

SEQ ID NO: 65313 - DNA, 26 bp, Artificial Sequence
  Synthetic
tctccgggatuattctgcagatgaua

SEQ ID NO: 65314 - DNA, 26 bp, Artificial Sequence
  Synthetic
tgggaaatgguctaggagaguaaagt

SEQ ID NO: 65315 - DNA, 21 bp, Artificial Sequence
  Synthetic
ctgctcuggcagattucaacc

SEQ ID NO: 65316 - DNA, 26 bp, Artificial Sequence
  Synthetic
ccagtaacaacucacaatttgugcaa

SEQ ID NO: 65317 - DNA, 21 bp, Artificial Sequence
  Synthetic
gggcccugtattggtttugct

SEQ ID NO: 65318 - DNA, 28 bp, Artificial Sequence
  Synthetic
tttccactcctagutcattcacacttut

SEQ ID NO: 65319 - DNA, 29 bp, Artificial Sequence
  Synthetic
gaaggaattggagcaguttaactcagaua

SEQ ID NO: 65320 - DNA, 28 bp, Artificial Sequence
  Synthetic
tctctcaagatacucttcttcagctugt

SEQ ID NO: 65321 - DNA, 24 bp, Artificial Sequence
  Synthetic
ttttguggaaggtctaugccagaa

SEQ ID NO: 65322 - DNA, 23 bp, Artificial Sequence
  Synthetic
gttctguctcaagtcucgaagca

SEQ ID NO: 65323 - DNA, 27 bp, Artificial Sequence
  Synthetic
gccatcagucccaattttacatttuct

SEQ ID NO: 65324 - DNA, 28 bp, Artificial Sequence
  Synthetic
ctctctgtatttgutggtgggatatuct

SEQ ID NO: 65325 - DNA, 28 bp, Artificial Sequence
  Synthetic
tgttcaaaagagucccctcaataaauca

SEQ ID NO: 65326 - DNA, 28 bp, Artificial Sequence
  Synthetic
ggtgttgtttcacugttttctaggatut

SEQ ID NO: 65327 - DNA, 27 bp, Artificial Sequence
  Synthetic
agcatcaggtcutgtctttttcctaut

SEQ ID NO: 65328 - DNA, 24 bp, Artificial Sequence
  Synthetic
cttatgggagcaccuatactgcut

SEQ ID NO: 65329 - DNA, 20 bp, Artificial Sequence
  Synthetic
ctggttcccucctcgagaug

SEQ ID NO: 65330 - DNA, 21 bp, Artificial Sequence
  Synthetic
tttgtccccaccccuacctua

SEQ ID NO: 65331 - DNA, 27 bp, Artificial Sequence
  Synthetic
ttggccaatctugttctcttatctcug

SEQ ID NO: 65332 - DNA, 26 bp, Artificial Sequence
  Synthetic
cttagtactgcugttctgtgaacuga

SEQ ID NO: 65333 - DNA, 23 bp, Artificial Sequence
  Synthetic
acgauctagugcaaggaaaagcc

SEQ ID NO: 65334 - DNA, 27 bp, Artificial Sequence
  Synthetic
ctgctccttcugaagtatcttttgugt

SEQ ID NO: 65335 - DNA, 17 bp, Artificial Sequence
  Synthetic
ccaaccugggcagcugt

SEQ ID NO: 65336 - DNA, 24 bp, Artificial Sequence
  Synthetic
tgggaattauctgagggagugagg

SEQ ID NO: 65337 - DNA, 25 bp, Artificial Sequence
  Synthetic
tggaatgtucaagccaauacaccaa

SEQ ID NO: 65338 - DNA, 20 bp, Artificial Sequence
  Synthetic
ccatcaaacuccggcagtuc

SEQ ID NO: 65339 - DNA, 27 bp, Artificial Sequence
  Synthetic
accagaattcaatuataccttggccut

SEQ ID NO: 65340 - DNA, 27 bp, Artificial Sequence
  Synthetic
gcttatctcugatatgtgttucagcct

SEQ ID NO: 65341 - DNA, 25 bp, Artificial Sequence
  Synthetic
gaaggtggcgcauttgtttgauaat

SEQ ID NO: 65342 - DNA, 25 bp, Artificial Sequence
  Synthetic
tttttggtcugaggaagcattcuga

SEQ ID NO: 65343 - DNA, 28 bp, Artificial Sequence
  Synthetic
gccttgacauccctactatagataucca

SEQ ID NO: 65344 - DNA, 27 bp, Artificial Sequence
  Synthetic
catacgtaaggugagtgagtgattuga

SEQ ID NO: 65345 - DNA, 29 bp, Artificial Sequence
  Synthetic
agatggacggautcatggaaagaaaauaa

SEQ ID NO: 65346 - DNA, 28 bp, Artificial Sequence
  Synthetic
tccctttcctagauagaagctaagtugt

SEQ ID NO: 65347 - DNA, 28 bp, Artificial Sequence
  Synthetic
cacttgcaggcacaauaacaatcttaua

SEQ ID NO: 65348 - DNA, 20 bp, Artificial Sequence
  Synthetic
cgagcgtacuaagccagguc

SEQ ID NO: 65349 - DNA, 21 bp, Artificial Sequence
  Synthetic
gaaccaccuaggcuggagaac

SEQ ID NO: 65350 - DNA, 28 bp, Artificial Sequence
  Synthetic
attgagttgtcucactcttcttgaaugt

SEQ ID NO: 65351 - DNA, 26 bp, Artificial Sequence
  Synthetic
catgtcatcaauagcttcctguaggg

SEQ ID NO: 65352 - DNA, 25 bp, Artificial Sequence
  Synthetic
agaagggacaagaaaaucaauggca

SEQ ID NO: 65353 - DNA, 26 bp, Artificial Sequence
  Synthetic
tcaaaaatuaacccccaaccuccaat

SEQ ID NO: 65354 - DNA, 27 bp, Artificial Sequence
  Synthetic
cacatcatgactutggcttcttcaaug

SEQ ID NO: 65355 - DNA, 28 bp, Artificial Sequence
  Synthetic
ccccaaagaaucacaccaagactttaut

SEQ ID NO: 65356 - DNA, 24 bp, Artificial Sequence
  Synthetic
cccatauggagaaaccacttucca

SEQ ID NO: 65357 - DNA, 28 bp, Artificial Sequence
  Synthetic
ctggacatctttuaaccaggagagaaut

SEQ ID NO: 65358 - DNA, 21 bp, Artificial Sequence
  Synthetic
aatctcaaccaugcctgugct

SEQ ID NO: 65359 - DNA, 24 bp, Artificial Sequence
  Synthetic
gcattactggutggcaacatgaua

SEQ ID NO: 65360 - DNA, 24 bp, Artificial Sequence
  Synthetic
ctttttctggcutgtcaggcttuc

SEQ ID NO: 65361 - DNA, 26 bp, Artificial Sequence
  Synthetic
tttggagatcaaaccuttcactccut

SEQ ID NO: 65362 - DNA, 28 bp, Artificial Sequence
  Synthetic
tgtagctctuaaagcaatgcagttttuc

SEQ ID NO: 65363 - DNA, 25 bp, Artificial Sequence
  Synthetic
gctgaacaugatttgacttucccaa

SEQ ID NO: 65364 - DNA, 21 bp, Artificial Sequence
  Synthetic
ggaaccucctctgtugcacat

SEQ ID NO: 65365 - DNA, 26 bp, Artificial Sequence
  Synthetic
agaacccaacaggauttcugaaacaa

SEQ ID NO: 65366 - DNA, 26 bp, Artificial Sequence
  Synthetic
cccagagttucagcattaagtcaguc

SEQ ID NO: 65367 - DNA, 24 bp, Artificial Sequence
  Synthetic
aatgccacutgcctttaugcaaaa

SEQ ID NO: 65368 - DNA, 28 bp, Artificial Sequence
  Synthetic
ctggtgcaautaatggagauagaagaca

SEQ ID NO: 65369 - DNA, 21 bp, Artificial Sequence
  Synthetic
acccttugctggaauggacaa

SEQ ID NO: 65370 - DNA, 21 bp, Artificial Sequence
  Synthetic
gcagaaucaccaggcctcauc

SEQ ID NO: 65371 - DNA, 29 bp, Artificial Sequence
  Synthetic
gctgttagactcutcaatattgctgucaa

SEQ ID NO: 65372 - DNA, 33 bp, Artificial Sequence
  Synthetic
agataggaaatcaauaccaaaacactttagaua

SEQ ID NO: 65373 - DNA, 28 bp, Artificial Sequence
  Synthetic
actgatctttcugagtcctttugacaaa

SEQ ID NO: 65374 - DNA, 26 bp, Artificial Sequence
  Synthetic
acactaattcauctgcaaagcucaca

SEQ ID NO: 65375 - DNA, 23 bp, Artificial Sequence
  Synthetic
cctccacagaaugcatcaactut

SEQ ID NO: 65376 - DNA, 22 bp, Artificial Sequence
  Synthetic
acaaccaugacattgccctuct

SEQ ID NO: 65377 - DNA, 24 bp, Artificial Sequence
  Synthetic
cggtcaacaaguggaactcuaagg

SEQ ID NO: 65378 - DNA, 28 bp, Artificial Sequence
  Synthetic
tgccatttgttgugtatcttggtatcua

SEQ ID NO: 65379 - DNA, 29 bp, Artificial Sequence
  Synthetic
acgataatttgugatgtaaactctuccct

SEQ ID NO: 65380 - DNA, 23 bp, Artificial Sequence
  Synthetic
gtgctgucatggattcauccaga

SEQ ID NO: 65381 - DNA, 26 bp, Artificial Sequence
  Synthetic
gctaagtguccagcacatcatuaagt

SEQ ID NO: 65382 - DNA, 20 bp, Artificial Sequence
  Synthetic
ggauccgaggcagcaagtuc

SEQ ID NO: 65383 - DNA, 20 bp, Artificial Sequence
  Synthetic
tggutcgttcatuggccagt

SEQ ID NO: 65384 - DNA, 21 bp, Artificial Sequence
  Synthetic
gcttaccucccaaggcttuga

SEQ ID NO: 65385 - DNA, 20 bp, Artificial Sequence
  Synthetic
ggagggccutagacttccug

SEQ ID NO: 65386 - DNA, 24 bp, Artificial Sequence
  Synthetic
cttacaggtcutcagtccttuccc

SEQ ID NO: 65387 - DNA, 22 bp, Artificial Sequence
  Synthetic
gaaagccgugaaggagtctuct

SEQ ID NO: 65388 - DNA, 18 bp, Artificial Sequence
  Synthetic
cgugacgcgacaacgaut

SEQ ID NO: 65389 - DNA, 18 bp, Artificial Sequence
  Synthetic
caagguggtcagcucggt

SEQ ID NO: 65390 - DNA, 27 bp, Artificial Sequence
  Synthetic
gtttaaaaggcauacatttccauggca

SEQ ID NO: 65391 - DNA, 24 bp, Artificial Sequence
  Synthetic
acgtaaaagcaggcautcatcuga

SEQ ID NO: 65392 - DNA, 29 bp, Artificial Sequence
  Synthetic
tctcaaccagugatgtatttacaguaggt

SEQ ID NO: 65393 - DNA, 25 bp, Artificial Sequence
  Synthetic
ctctaaaactuctagccccguaaca

SEQ ID NO: 65394 - DNA, 22 bp, Artificial Sequence
  Synthetic
gcttccagcautgacaccatuc

SEQ ID NO: 65395 - DNA, 20 bp, Artificial Sequence
  Synthetic
agcaagtgugccgtctcuac

SEQ ID NO: 65396 - DNA, 24 bp, Artificial Sequence
  Synthetic
tatttccugacacaagcaaccaut

SEQ ID NO: 65397 - DNA, 23 bp, Artificial Sequence
  Synthetic
ggatgagcacacuttttctggug

SEQ ID NO: 65398 - DNA, 24 bp, Artificial Sequence
  Synthetic
aaaaacgtatugggagtcgucgat

SEQ ID NO: 65399 - DNA, 23 bp, Artificial Sequence
  Synthetic
ttgtcggattucaggtctctgug

SEQ ID NO: 65400 - DNA, 20 bp, Artificial Sequence
  Synthetic
gacaccctugcagcctctua

SEQ ID NO: 65401 - DNA, 20 bp, Artificial Sequence
  Synthetic
ctgctccuagggcttctucc

SEQ ID NO: 65402 - DNA, 21 bp, Artificial Sequence
  Synthetic
ggccctcugatggttccctua

SEQ ID NO: 65403 - DNA, 21 bp, Artificial Sequence
  Synthetic
gcttcttgguatggccagcuc

SEQ ID NO: 65404 - DNA, 21 bp, Artificial Sequence
  Synthetic
ggaagugaacaggcctagcut

SEQ ID NO: 65405 - DNA, 24 bp, Artificial Sequence
  Synthetic
gtcagctcttguaggtacacaguc

SEQ ID NO: 65406 - DNA, 20 bp, Artificial Sequence
  Synthetic
gcaggcacaagagcugaugt

SEQ ID NO: 65407 - DNA, 24 bp, Artificial Sequence
  Synthetic
tctcagtccgguttcttcgtauct

SEQ ID NO: 65408 - DNA, 21 bp, Artificial Sequence
  Synthetic
gggctcacuccactgauaaac

SEQ ID NO: 65409 - DNA, 25 bp, Artificial Sequence
  Synthetic
tcccaaagccugactttgtatctuc

SEQ ID NO: 65410 - DNA, 28 bp, Artificial Sequence
  Synthetic
gcatatgctctgugcttgaagttctuat

SEQ ID NO: 65411 - DNA, 23 bp, Artificial Sequence
  Synthetic
acagagcuggcatcagtctttut

SEQ ID NO: 65412 - DNA, 23 bp, Artificial Sequence
  Synthetic
tggttttcuccaccacgtctaug

SEQ ID NO: 65413 - DNA, 25 bp, Artificial Sequence
  Synthetic
cacactctcucaactttgtgacuct

SEQ ID NO: 65414 - DNA, 26 bp, Artificial Sequence
  Synthetic
gctcctgtcugcttttccaaatagut

SEQ ID NO: 65415 - DNA, 31 bp, Artificial Sequence
  Synthetic
tgtcagttgatcaaautccattttgaaacut

SEQ ID NO: 65416 - DNA, 28 bp, Artificial Sequence
  Synthetic
accttttaaagcutccgtttctatguct

SEQ ID NO: 65417 - DNA, 26 bp, Artificial Sequence
  Synthetic
gtgtctcagttugatagcatctguga

SEQ ID NO: 65418 - DNA, 22 bp, Artificial Sequence
  Synthetic
atctagacauccaccucagcca

SEQ ID NO: 65419 - DNA, 25 bp, Artificial Sequence
  Synthetic
tgatccctacucaaggaagctctut

SEQ ID NO: 65420 - DNA, 24 bp, Artificial Sequence
  Synthetic
gaagcctcutccactgtcuacaat

SEQ ID NO: 65421 - DNA, 22 bp, Artificial Sequence
  Synthetic
tgtccacccaguaggagaucac

SEQ ID NO: 65422 - DNA, 21 bp, Artificial Sequence
  Synthetic
ccagtcucccaaggaaugcag

SEQ ID NO: 65423 - DNA, 23 bp, Artificial Sequence
  Synthetic
ttttgtgcugctgtcatccuagt

SEQ ID NO: 65424 - DNA, 26 bp, Artificial Sequence
  Synthetic
cutctgagagagaucacaagagagga

SEQ ID NO: 65425 - DNA, 23 bp, Artificial Sequence
  Synthetic
tgaaaccacucaaaaggctcgut

SEQ ID NO: 65426 - DNA, 22 bp, Artificial Sequence
  Synthetic
caccaaacutgccaugggaaaa

SEQ ID NO: 65427 - DNA, 22 bp, Artificial Sequence
  Synthetic
gautctggcugagaggaggaag

SEQ ID NO: 65428 - DNA, 22 bp, Artificial Sequence
  Synthetic
tgtgaatgtggugcgttcctua

SEQ ID NO: 65429 - DNA, 22 bp, Artificial Sequence
  Synthetic
gguctgtttuagaccccaccat

SEQ ID NO: 65430 - DNA, 25 bp, Artificial Sequence
  Synthetic
caaccagtccuggatttttagcuct

SEQ ID NO: 65431 - DNA, 24 bp, Artificial Sequence
  Synthetic
ccacgttccaugtgatctcttcua

SEQ ID NO: 65432 - DNA, 27 bp, Artificial Sequence
  Synthetic
cacggaugaagagggtataattgauga

SEQ ID NO: 65433 - DNA, 22 bp, Artificial Sequence
  Synthetic
cccaggtguggagtatagcuac

SEQ ID NO: 65434 - DNA, 28 bp, Artificial Sequence
  Synthetic
ctggtggtauccaagctacaaatauaga

SEQ ID NO: 65435 - DNA, 22 bp, Artificial Sequence
  Synthetic
aagtctcttgugcatggcctua

SEQ ID NO: 65436 - DNA, 28 bp, Artificial Sequence
  Synthetic
gttatgaaggaguttacagatuccacct

SEQ ID NO: 65437 - DNA, 26 bp, Artificial Sequence
  Synthetic
gtgcactttattucttgcttgcttut

SEQ ID NO: 65438 - DNA, 29 bp, Artificial Sequence
  Synthetic
tgtgatactaggutcatatgaggucaagt

SEQ ID NO: 65439 - DNA, 23 bp, Artificial Sequence
  Synthetic
ctggatuggcagagttcugaaga

SEQ ID NO: 65440 - DNA, 28 bp, Artificial Sequence
  Synthetic
gaaaataaagacgucccttcttcaacug

SEQ ID NO: 65441 - DNA, 24 bp, Artificial Sequence
  Synthetic
atcacacttgucttaccaggcaut

SEQ ID NO: 65442 - DNA, 25 bp, Artificial Sequence
  Synthetic
gtgatggtugtcattgttugaggag

SEQ ID NO: 65443 - DNA, 27 bp, Artificial Sequence
  Synthetic
ctaaagtaaccccuttgtctgaugagt

SEQ ID NO: 65444 - DNA, 25 bp, Artificial Sequence
  Synthetic
gcctccaaaccaacucaggaattua

SEQ ID NO: 65445 - DNA, 21 bp, Artificial Sequence
  Synthetic
gccatuccaaaagctgccaut

SEQ ID NO: 65446 - DNA, 22 bp, Artificial Sequence
  Synthetic
gaagutggtggugaagggaagt

SEQ ID NO: 65447 - DNA, 28 bp, Artificial Sequence
  Synthetic
caatggagattuggaaaaacctgatuct

SEQ ID NO: 65448 - DNA, 21 bp, Artificial Sequence
  Synthetic
ctggaggacutccgggatuac

SEQ ID NO: 65449 - DNA, 21 bp, Artificial Sequence
  Synthetic
gacccaggucaaacgccttua

SEQ ID NO: 65450 - DNA, 22 bp, Artificial Sequence
  Synthetic
autgatgguggaccacacagag

SEQ ID NO: 65451 - DNA, 25 bp, Artificial Sequence
  Synthetic
aaaagatcttcuggaacacggugaa

SEQ ID NO: 65452 - DNA, 24 bp, Artificial Sequence
  Synthetic
agaacagaagaaaucctcgcctug

SEQ ID NO: 65453 - DNA, 27 bp, Artificial Sequence
  Synthetic
cuactacatcatctugcaaccgaagaa

SEQ ID NO: 65454 - DNA, 26 bp, Artificial Sequence
  Synthetic
ctaggaattgagcuggatgaagaugg

SEQ ID NO: 65455 - DNA, 21 bp, Artificial Sequence
  Synthetic
tgccagugcactctcatacug

SEQ ID NO: 65456 - DNA, 27 bp, Artificial Sequence
  Synthetic
acaccctttttcugaaattgtgctuac

SEQ ID NO: 65457 - DNA, 26 bp, Artificial Sequence
  Synthetic
aagcctagacccuctttcatctuaga

SEQ ID NO: 65458 - DNA, 27 bp, Artificial Sequence
  Synthetic
gttgctaggutgcttacctttuaaact

SEQ ID NO: 65459 - DNA, 28 bp, Artificial Sequence
  Synthetic
ggctgaaccttuccatgataaaatgtug

SEQ ID NO: 65460 - DNA, 23 bp, Artificial Sequence
  Synthetic
agcaatggaaugaaggtccacut

SEQ ID NO: 65461 - DNA, 24 bp, Artificial Sequence
  Synthetic
gacacctgaugttttctcaagcuc

SEQ ID NO: 65462 - DNA, 24 bp, Artificial Sequence
  Synthetic
acccaugcaggaaagaaaaucagt

SEQ ID NO: 65463 - DNA, 23 bp, Artificial Sequence
  Synthetic
ggctgccuagtgctgatgttuat

SEQ ID NO: 65464 - DNA, 23 bp, Artificial Sequence
  Synthetic
acctcagucttcgtttugcaaga

SEQ ID NO: 65465 - DNA, 25 bp, Artificial Sequence
  Synthetic
ctggttcagauttgtcatttuggct

SEQ ID NO: 65466 - DNA, 27 bp, Artificial Sequence
  Synthetic
tttgaagtggucatgcaaattucacaa

SEQ ID NO: 65467 - DNA, 27 bp, Artificial Sequence
  Synthetic
tccaccucaggagaacaaacttacuat

SEQ ID NO: 65468 - DNA, 33 bp, Artificial Sequence
  Synthetic
tacattgaaaaatgguagtaggtatttauggaa

SEQ ID NO: 65469 - DNA, 23 bp, Artificial Sequence
  Synthetic
cgactugcaaacctgttgguaaa

SEQ ID NO: 65470 - DNA, 21 bp, Artificial Sequence
  Synthetic
tcagcttugctcacgtgucaa

SEQ ID NO: 65471 - DNA, 28 bp, Artificial Sequence
  Synthetic
tgcaatttcaucttgaactucaacacaa

SEQ ID NO: 65472 - DNA, 29 bp, Artificial Sequence
  Synthetic
gatggaaatgaaacaauttgtcactguct

SEQ ID NO: 65473 - DNA, 23 bp, Artificial Sequence
  Synthetic
tgtttcacctuggacaggaacuc

SEQ ID NO: 65474 - DNA, 22 bp, Artificial Sequence
  Synthetic
ggacatugaaagcaacctgcuc

SEQ ID NO: 65475 - DNA, 22 bp, Artificial Sequence
  Synthetic
gttttccuagacgcctctccut

SEQ ID NO: 65476 - DNA, 21 bp, Artificial Sequence
  Synthetic
catccugccagtaucccagac

SEQ ID NO: 65477 - DNA, 25 bp, Artificial Sequence
  Synthetic
gccctaaagacuccaagacucagaa

SEQ ID NO: 65478 - DNA, 21 bp, Artificial Sequence
  Synthetic
cctggguaagggatgctgaut

SEQ ID NO: 65479 - DNA, 24 bp, Artificial Sequence
  Synthetic
cctcctggauctggatauagacca

SEQ ID NO: 65480 - DNA, 22 bp, Artificial Sequence
  Synthetic
ctccctgttugtccacttcugt

SEQ ID NO: 65481 - DNA, 23 bp, Artificial Sequence
  Synthetic
ggcutgatgttcugaggaaccat

SEQ ID NO: 65482 - DNA, 21 bp, Artificial Sequence
  Synthetic
ccgtccucagacccaaacaut

SEQ ID NO: 65483 - DNA, 25 bp, Artificial Sequence
  Synthetic
gcaaagggaacautatcaucagcac

SEQ ID NO: 65484 - DNA, 26 bp, Artificial Sequence
  Synthetic
ggaacaggaagacuacauaggcaaac

SEQ ID NO: 65485 - DNA, 20 bp, Artificial Sequence
  Synthetic
accaacagcuttgcctccut

SEQ ID NO: 65486 - DNA, 23 bp, Artificial Sequence
  Synthetic
cuaggagaacugagcaggaaacc

SEQ ID NO: 65487 - DNA, 22 bp, Artificial Sequence
  Synthetic
cccttgaccutttcctcctugt

SEQ ID NO: 65488 - DNA, 22 bp, Artificial Sequence
  Synthetic
aaugcccaagtcugaaacccat

SEQ ID NO: 65489 - DNA, 27 bp, Artificial Sequence
  Synthetic
tgccctcttttuctaatccttcatugt

SEQ ID NO: 65490 - DNA, 21 bp, Artificial Sequence
  Synthetic
ggaagctgauccgctgaguaa

SEQ ID NO: 65491 - DNA, 25 bp, Artificial Sequence
  Synthetic
gcaauatacattcugaaccccagga

SEQ ID NO: 65492 - DNA, 26 bp, Artificial Sequence
  Synthetic
tcatactgtugccaaaggtcucaaaa

SEQ ID NO: 65493 - DNA, 23 bp, Artificial Sequence
  Synthetic
cguctagucaaaggagcaaaggg

SEQ ID NO: 65494 - DNA, 27 bp, Artificial Sequence
  Synthetic
aatgcatgaacauctggttacauacca

SEQ ID NO: 65495 - DNA, 27 bp, Artificial Sequence
  Synthetic
agaatgtgtcugcaagatcaatgauga

SEQ ID NO: 65496 - DNA, 29 bp, Artificial Sequence
  Synthetic
ggcttcttcatcaucatctttcttttcut

SEQ ID NO: 65497 - DNA, 22 bp, Artificial Sequence
  Synthetic
tttgtttccauccaggcctcut

SEQ ID NO: 65498 - DNA, 23 bp, Artificial Sequence
  Synthetic
actggttgacaauaagcggugaa

SEQ ID NO: 65499 - DNA, 27 bp, Artificial Sequence
  Synthetic
gttcatccaaggaauaatactggugga

SEQ ID NO: 65500 - DNA, 26 bp, Artificial Sequence
  Synthetic
ccaacagttaautggatacccuggaa

SEQ ID NO: 65501 - DNA, 28 bp, Artificial Sequence
  Synthetic
gtgagggaaaauaaccaatcacttucat

SEQ ID NO: 65502 - DNA, 26 bp, Artificial Sequence
  Synthetic
acacatcaguccaacacttuagcaaa

SEQ ID NO: 65503 - DNA, 28 bp, Artificial Sequence
  Synthetic
gcaatacattggagugtacagagatugt

SEQ ID NO: 65504 - DNA, 23 bp, Artificial Sequence
  Synthetic
tttattagccuactcgcccucct

SEQ ID NO: 65505 - DNA, 28 bp, Artificial Sequence
  Synthetic
gtctgttgttuggtgccattatucaaat

SEQ ID NO: 65506 - DNA, 20 bp, Artificial Sequence
  Synthetic
gccctcagguacgtagctut

SEQ ID NO: 65507 - DNA, 29 bp, Artificial Sequence
  Synthetic
cctccaccctautttcatctccaatttua

SEQ ID NO: 65508 - DNA, 28 bp, Artificial Sequence
  Synthetic
tgtatcataaagagugtcagcugagaga

SEQ ID NO: 65509 - DNA, 23 bp, Artificial Sequence
  Synthetic
ggaactuacagcagguccagaac

SEQ ID NO: 65510 - DNA, 28 bp, Artificial Sequence
  Synthetic
tcattcctttgtauacagggtgaaagug

SEQ ID NO: 65511 - DNA, 27 bp, Artificial Sequence
  Synthetic
ttctaccuggctggttgaauaaaaact

SEQ ID NO: 65512 - DNA, 29 bp, Artificial Sequence
  Synthetic
caagcttgaggaauttcatattttucagt

SEQ ID NO: 65513 - DNA, 18 bp, Artificial Sequence
  Synthetic
acctggucgagcugggaa

SEQ ID NO: 65514 - DNA, 27 bp, Artificial Sequence
  Synthetic
tgtttccaugacaccagauaacaagag

SEQ ID NO: 65515 - DNA, 28 bp, Artificial Sequence
  Synthetic
cgttcttcaattucttcacaagtgttug

SEQ ID NO: 65516 - DNA, 26 bp, Artificial Sequence
  Synthetic
cagggtgagaagauctcccttaatug

SEQ ID NO: 65517 - DNA, 28 bp, Artificial Sequence
  Synthetic
cgagtcataaagucatcaatcaccucat

SEQ ID NO: 65518 - DNA, 23 bp, Artificial Sequence
  Synthetic
tgcaggaggagautcagtugaag

SEQ ID NO: 65519 - DNA, 23 bp, Artificial Sequence
  Synthetic
cgatctccucgttgagagatuca

SEQ ID NO: 65520 - DNA, 24 bp, Artificial Sequence
  Synthetic
gcaaagucaacuagaagacaggca

SEQ ID NO: 65521 - DNA, 24 bp, Artificial Sequence
  Synthetic
agggtacaucctgtgtcttugaga

SEQ ID NO: 65522 - DNA, 27 bp, Artificial Sequence
  Synthetic
aatcacagcugcaaacgttaaattcut

SEQ ID NO: 65523 - DNA, 22 bp, Artificial Sequence
  Synthetic
tcauacacggcagccacauaat

SEQ ID NO: 65524 - DNA, 19 bp, Artificial Sequence
  Synthetic
ggagccucaccgctucaat

SEQ ID NO: 65525 - DNA, 28 bp, Artificial Sequence
  Synthetic
gggatgttaagguctcctatcaatctua

SEQ ID NO: 65526 - DNA, 22 bp, Artificial Sequence
  Synthetic
agactauaggacagccugcgaa

SEQ ID NO: 65527 - DNA, 22 bp, Artificial Sequence
  Synthetic
gggtcauggcaaactgtctcua

SEQ ID NO: 65528 - DNA, 23 bp, Artificial Sequence
  Synthetic
ggaaacaauactggctgaucacc

SEQ ID NO: 65529 - DNA, 23 bp, Artificial Sequence
  Synthetic
gttaggucgttctucacgaggat

SEQ ID NO: 65530 - DNA, 23 bp, Artificial Sequence
  Synthetic
tctgaggtaaauccagtggccua

SEQ ID NO: 65531 - DNA, 19 bp, Artificial Sequence
  Synthetic
cccccaacacgutgcauga

SEQ ID NO: 65532 - DNA, 27 bp, Artificial Sequence
  Synthetic
tctcttttccccutgggattagtauct

SEQ ID NO: 65533 - DNA, 28 bp, Artificial Sequence
  Synthetic
aagcttcaacaatutactctcccatgua

SEQ ID NO: 65534 - DNA, 26 bp, Artificial Sequence
  Synthetic
agtttgctgguggagataaggttaug

SEQ ID NO: 65535 - DNA, 22 bp, Artificial Sequence
  Synthetic
agcauttccaaagauggagcga

SEQ ID NO: 65536 - DNA, 23 bp, Artificial Sequence
  Synthetic
acagaggaagauggucccaaaga

SEQ ID NO: 65537 - DNA, 28 bp, Artificial Sequence
  Synthetic
acaacagaagtauaagaatggctgucac

SEQ ID NO: 65538 - DNA, 23 bp, Artificial Sequence
  Synthetic
gtaggagatcutggatgggtugg

SEQ ID NO: 65539 - DNA, 20 bp, Artificial Sequence
  Synthetic
ctgtcugagccactccguat

SEQ ID NO: 65540 - DNA, 21 bp, Artificial Sequence
  Synthetic
tctccguccagctgacttgua

SEQ ID NO: 65541 - DNA, 23 bp, Artificial Sequence
  Synthetic
gtggagacagaugaccaaagucc

SEQ ID NO: 65542 - DNA, 22 bp, Artificial Sequence
  Synthetic
agctctgggcccugtatatgua

SEQ ID NO: 65543 - DNA, 23 bp, Artificial Sequence
  Synthetic
cgagucagacacagaugaccaag

SEQ ID NO: 65544 - DNA, 21 bp, Artificial Sequence
  Synthetic
cagctccaugaggcuaaggat

SEQ ID NO: 65545 - DNA, 22 bp, Artificial Sequence
  Synthetic
tccaucccaaacaattccugct

SEQ ID NO: 65546 - DNA, 22 bp, Artificial Sequence
  Synthetic
atugacaagggagtugcacaga

SEQ ID NO: 65547 - DNA, 20 bp, Artificial Sequence
  Synthetic
cucaaccacctugcaggaga

SEQ ID NO: 65548 - DNA, 21 bp, Artificial Sequence
  Synthetic
ggtcgaacagcaugaaggcut

SEQ ID NO: 65549 - DNA, 25 bp, Artificial Sequence
  Synthetic
gggtctcttutcagattgagtucac

SEQ ID NO: 65550 - DNA, 22 bp, Artificial Sequence
  Synthetic
gtctgcagugctttccatctug

SEQ ID NO: 65551 - DNA, 25 bp, Artificial Sequence
  Synthetic
agaaagagaauauccggcaggagat

SEQ ID NO: 65552 - DNA, 18 bp, Artificial Sequence
  Synthetic
acctcuccagcgctgtuc

SEQ ID NO: 65553 - DNA, 20 bp, Artificial Sequence
  Synthetic
gggaggaccucccuaaccaa

SEQ ID NO: 65554 - DNA, 21 bp, Artificial Sequence
  Synthetic
cttggtuccggctgaactcut

SEQ ID NO: 65555 - DNA, 20 bp, Artificial Sequence
  Synthetic
cgaagcuggacagtcuggag

SEQ ID NO: 65556 - DNA, 21 bp, Artificial Sequence
  Synthetic
tgtgagugggccaggtgtaua

SEQ ID NO: 65557 - DNA, 23 bp, Artificial Sequence
  Synthetic
atgtcagcugaactttccaucca

SEQ ID NO: 65558 - DNA, 26 bp, Artificial Sequence
  Synthetic
ggaaagaacttcutctgccttacugt

SEQ ID NO: 65559 - DNA, 28 bp, Artificial Sequence
  Synthetic
aggcctagcuaatatcttagtcaauggt

SEQ ID NO: 65560 - DNA, 27 bp, Artificial Sequence
  Synthetic
ctgatctaacaugatgtctcacctuca

SEQ ID NO: 65561 - DNA, 28 bp, Artificial Sequence
  Synthetic
tctgaaacatcucaaccatcagtuacaa

SEQ ID NO: 65562 - DNA, 25 bp, Artificial Sequence
  Synthetic
cagcttgtautcctcttcttuccct

SEQ ID NO: 65563 - DNA, 27 bp, Artificial Sequence
  Synthetic
gattcatcagacguccattttgcuaaa

SEQ ID NO: 65564 - DNA, 17 bp, Artificial Sequence
  Synthetic
cugccacgacgguacca

SEQ ID NO: 65565 - DNA, 20 bp, Artificial Sequence
  Synthetic
tcctgcuccaggauggagat

SEQ ID NO: 65566 - DNA, 17 bp, Artificial Sequence
  Synthetic
cgcctccucggagucct

SEQ ID NO: 65567 - DNA, 19 bp, Artificial Sequence
  Synthetic
gcggaauccgggctcuaac

SEQ ID NO: 65568 - DNA, 23 bp, Artificial Sequence
  Synthetic
agctgtccutgtaattgccucaa

SEQ ID NO: 65569 - DNA, 28 bp, Artificial Sequence
  Synthetic
cctctcttgttcutgacaaatccagaua

SEQ ID NO: 65570 - DNA, 20 bp, Artificial Sequence
  Synthetic
gtagccgtuccccacaguaa

SEQ ID NO: 65571 - DNA, 22 bp, Artificial Sequence
  Synthetic
agccacuggctttgucaaaaag

SEQ ID NO: 65572 - DNA, 28 bp, Artificial Sequence
  Synthetic
ctttttctttgtccutgttcatggcuaa

SEQ ID NO: 65573 - DNA, 22 bp, Artificial Sequence
  Synthetic
ggcttccauacttggctgcuac

SEQ ID NO: 65574 - DNA, 21 bp, Artificial Sequence
  Synthetic
cacctgcgucatcatcgagua

SEQ ID NO: 65575 - DNA, 21 bp, Artificial Sequence
  Synthetic
ggugaaacaggcaagcgttut

SEQ ID NO: 65576 - DNA, 22 bp, Artificial Sequence
  Synthetic
gcctgtgaugaaggtcaacgua

SEQ ID NO: 65577 - DNA, 22 bp, Artificial Sequence
  Synthetic
gggagtgcaagutctaacccut

SEQ ID NO: 65578 - DNA, 25 bp, Artificial Sequence
  Synthetic
aauctaatttugagggccaggacat

SEQ ID NO: 65579 - DNA, 20 bp, Artificial Sequence
  Synthetic
agccucaaaggcttcaucgt

SEQ ID NO: 65580 - DNA, 28 bp, Artificial Sequence
  Synthetic
tgttgtgguaataaccaaaatugaacac

SEQ ID NO: 65581 - DNA, 24 bp, Artificial Sequence
  Synthetic
aggcagaaacaaaaaucccaguca

SEQ ID NO: 65582 - DNA, 20 bp, Artificial Sequence
  Synthetic
gggtacttgucaggcgguaa

SEQ ID NO: 65583 - DNA, 28 bp, Artificial Sequence
  Synthetic
gccatgtaggtuaacgtcttaaggaaua

SEQ ID NO: 65584 - DNA, 28 bp, Artificial Sequence
  Synthetic
tctttcttcagugtcacttacattuggt

SEQ ID NO: 65585 - DNA, 20 bp, Artificial Sequence
  Synthetic
ctcugacacgccgactaugg

SEQ ID NO: 65586 - DNA, 28 bp, Artificial Sequence
  Synthetic
tcttaatgtttucctccaaagcguagaa

SEQ ID NO: 65587 - DNA, 26 bp, Artificial Sequence
  Synthetic
gttcacttcccauctgagatgtcuaa

SEQ ID NO: 65588 - DNA, 25 bp, Artificial Sequence
  Synthetic
caggacaaatcuagcaagtcttuga

SEQ ID NO: 65589 - DNA, 27 bp, Artificial Sequence
  Synthetic
tggaaatatgccagaaaucccttacug

SEQ ID NO: 65590 - DNA, 27 bp, Artificial Sequence
  Synthetic
agagtagaaauccttaacucacgggat

SEQ ID NO: 65591 - DNA, 28 bp, Artificial Sequence
  Synthetic
gtggttgtgtuggaagttcctctatuaa

SEQ ID NO: 65592 - DNA, 26 bp, Artificial Sequence
  Synthetic
ccaccacaacugttacttctaucgaa

SEQ ID NO: 65593 - DNA, 24 bp, Artificial Sequence
  Synthetic
gctttctcacuctgctcttttuca

SEQ ID NO: 65594 - DNA, 28 bp, Artificial Sequence
  Synthetic
tgacatggcuaattccaaaaucacagaa

SEQ ID NO: 65595 - DNA, 31 bp, Artificial Sequence
  Synthetic
ttcatgaagcutatattcaatgugaaggaga

SEQ ID NO: 65596 - DNA, 22 bp, Artificial Sequence
  Synthetic
ctcatgcaccaugactgacgua

SEQ ID NO: 65597 - DNA, 27 bp, Artificial Sequence
  Synthetic
ctgatttgccutgcttcatatuccaat

SEQ ID NO: 65598 - DNA, 21 bp, Artificial Sequence
  Synthetic
gctccauccaagttcugcaca

SEQ ID NO: 65599 - DNA, 22 bp, Artificial Sequence
  Synthetic
ctgcttcctgugtcgtctgaut

SEQ ID NO: 65600 - DNA, 29 bp, Artificial Sequence
  Synthetic
agctcccaaauaatgaagatagagucaga

SEQ ID NO: 65601 - DNA, 27 bp, Artificial Sequence
  Synthetic
tttgcctttctuaattcagcctttucc

SEQ ID NO: 65602 - DNA, 28 bp, Artificial Sequence
  Synthetic
gcctccaaaggacuaaatcagatgaaua

SEQ ID NO: 65603 - DNA, 29 bp, Artificial Sequence
  Synthetic
tggtctagatgauggagaaagagatucaa

SEQ ID NO: 65604 - DNA, 22 bp, Artificial Sequence
  Synthetic
gggttuggaaaatcgccugaac

SEQ ID NO: 65605 - DNA, 22 bp, Artificial Sequence
  Synthetic
tgtgtttgcutgagctgcuaga

SEQ ID NO: 65606 - DNA, 17 bp, Artificial Sequence
  Synthetic
cgcgcgaggucuaaggg

SEQ ID NO: 65607 - DNA, 18 bp, Artificial Sequence
  Synthetic
ccgcagcagauggtggua

SEQ ID NO: 65608 - DNA, 23 bp, Artificial Sequence
  Synthetic
agtggacccuttgccttguaaaa

SEQ ID NO: 65609 - DNA, 25 bp, Artificial Sequence
  Synthetic
ggactacgautagggucgacaaaaa

SEQ ID NO: 65610 - DNA, 21 bp, Artificial Sequence
  Synthetic
ccaatucccaggccucaaaag

SEQ ID NO: 65611 - DNA, 21 bp, Artificial Sequence
  Synthetic
tgtccctcugtgtcctgcuat

SEQ ID NO: 65612 - DNA, 20 bp, Artificial Sequence
  Synthetic
ggccctaucggcagtacuac

SEQ ID NO: 65613 - DNA, 28 bp, Artificial Sequence
  Synthetic
tctttttcttactugcttctgtcacuca

SEQ ID NO: 65614 - DNA, 24 bp, Artificial Sequence
  Synthetic
ctcttctgauaccaaaggctcucc

SEQ ID NO: 65615 - DNA, 28 bp, Artificial Sequence
  Synthetic
agtaatggttttgauggctttgatgtuc

SEQ ID NO: 65616 - DNA, 22 bp, Artificial Sequence
  Synthetic
tgaaaaattgggugagctgcug

SEQ ID NO: 65617 - DNA, 25 bp, Artificial Sequence
  Synthetic
ttggaggaagaccgutcgatatcua

SEQ ID NO: 65618 - DNA, 24 bp, Artificial Sequence
  Synthetic
gagtgggcaaucttttaggtcuct

SEQ ID NO: 65619 - DNA, 20 bp, Artificial Sequence
  Synthetic
tgtgccaaugtctgtgugct

SEQ ID NO: 65620 - DNA, 22 bp, Artificial Sequence
  Synthetic
agcatcgguattgttgggtugt

SEQ ID NO: 65621 - DNA, 21 bp, Artificial Sequence
  Synthetic
ctcaucccccttaugcacgat

SEQ ID NO: 65622 - DNA, 20 bp, Artificial Sequence
  Synthetic
gagcugaagaaaacgcccut

SEQ ID NO: 65623 - DNA, 23 bp, Artificial Sequence
  Synthetic
ctcctccugaaactcagcttuga

SEQ ID NO: 65624 - DNA, 22 bp, Artificial Sequence
  Synthetic
aguacgatgaccugaggagagg

SEQ ID NO: 65625 - DNA, 27 bp, Artificial Sequence
  Synthetic
acagtgaagcugtgatcaagtattugt

SEQ ID NO: 65626 - DNA, 19 bp, Artificial Sequence
  Synthetic
tgtcguccaagggctuacc

SEQ ID NO: 65627 - DNA, 23 bp, Artificial Sequence
  Synthetic
tcaaggtauagcaaccacuccca

SEQ ID NO: 65628 - DNA, 27 bp, Artificial Sequence
  Synthetic
tcctccaaccuatagaaggaagugaaa

SEQ ID NO: 65629 - DNA, 21 bp, Artificial Sequence
  Synthetic
gcatccatuggctgcttaucc

SEQ ID NO: 65630 - DNA, 22 bp, Artificial Sequence
  Synthetic
cttgacucccacctggagttuc

SEQ ID NO: 65631 - DNA, 19 bp, Artificial Sequence
  Synthetic
ggcggacagcutcaaaguc

SEQ ID NO: 65632 - DNA, 22 bp, Artificial Sequence
  Synthetic
gcccatcuccattcctgtacug

SEQ ID NO: 65633 - DNA, 23 bp, Artificial Sequence
  Synthetic
ccacctcagucctctcttuccat

SEQ ID NO: 65634 - DNA, 19 bp, Artificial Sequence
  Synthetic
cctcaggcucagctgtgua

SEQ ID NO: 65635 - DNA, 23 bp, Artificial Sequence
  Synthetic
ggtgaatucgactcctttguggt

SEQ ID NO: 65636 - DNA, 27 bp, Artificial Sequence
  Synthetic
tcttatattttcuctcaggcuccaggt

SEQ ID NO: 65637 - DNA, 21 bp, Artificial Sequence
  Synthetic
agatgugacccccaactcugt

SEQ ID NO: 65638 - DNA, 17 bp, Artificial Sequence
  Synthetic
cccctugcgtcgucgag

SEQ ID NO: 65639 - DNA, 22 bp, Artificial Sequence
  Synthetic
ccaggugagggaaccagaagua

SEQ ID NO: 65640 - DNA, 19 bp, Artificial Sequence
  Synthetic
tguagcccgtgucgcaaat

SEQ ID NO: 65641 - DNA, 17 bp, Artificial Sequence
  Synthetic
cuggcgaggactguggt

SEQ ID NO: 65642 - DNA, 21 bp, Artificial Sequence
  Synthetic
agccccuggtggtaucagaat

SEQ ID NO: 65643 - DNA, 24 bp, Artificial Sequence
  Synthetic
ctcatctuccccaaatgtctggut

SEQ ID NO: 65644 - DNA, 22 bp, Artificial Sequence
  Synthetic
caacaagggccugaaaccctua

SEQ ID NO: 65645 - DNA, 27 bp, Artificial Sequence
  Synthetic
atgtgttctatcuccatctccttcuga

SEQ ID NO: 65646 - DNA, 21 bp, Artificial Sequence
  Synthetic
accggtaguctagggugaagg

SEQ ID NO: 65647 - DNA, 25 bp, Artificial Sequence
  Synthetic
tgagatagaagaagggaugggtgut

SEQ ID NO: 65648 - DNA, 21 bp, Artificial Sequence
  Synthetic
gtgctcagggagutggctaut

SEQ ID NO: 65649 - DNA, 22 bp, Artificial Sequence
  Synthetic
cctcacaggcauctgtttccut

SEQ ID NO: 65650 - DNA, 21 bp, Artificial Sequence
  Synthetic
tcttcatgcccacugagggua

SEQ ID NO: 65651 - DNA, 22 bp, Artificial Sequence
  Synthetic
gcucctagaccugcagagaaag

SEQ ID NO: 65652 - DNA, 25 bp, Artificial Sequence
  Synthetic
gaactcgagggutgtctgaatcaua

SEQ ID NO: 65653 - DNA, 28 bp, Artificial Sequence
  Synthetic
ccttgattccagacucttgaatctuaca

SEQ ID NO: 65654 - DNA, 21 bp, Artificial Sequence
  Synthetic
caatguggcggctaacttucc

SEQ ID NO: 65655 - DNA, 29 bp, Artificial Sequence
  Synthetic
gtcagaaatgcuaagtatgcaaaatgugt

SEQ ID NO: 65656 - DNA, 25 bp, Artificial Sequence
  Synthetic
tgctatgaatucctaatggcugcaa

SEQ ID NO: 65657 - DNA, 25 bp, Artificial Sequence
  Synthetic
actttttcttccuccctcctccuat

SEQ ID NO: 65658 - DNA, 24 bp, Artificial Sequence
  Synthetic
atcagcccucatttggatgugaat

SEQ ID NO: 65659 - DNA, 23 bp, Artificial Sequence
  Synthetic
gaaautggtgatucgccaacagt

SEQ ID NO: 65660 - DNA, 22 bp, Artificial Sequence
  Synthetic
agcaagcacuagaccacaaugt

SEQ ID NO: 65661 - DNA, 24 bp, Artificial Sequence
  Synthetic
ggtattctguggcctgtatucacc

SEQ ID NO: 65662 - DNA, 28 bp, Artificial Sequence
  Synthetic
ctgattgagaaagaacuttatgcccuct

SEQ ID NO: 65663 - DNA, 24 bp, Artificial Sequence
  Synthetic
tggatccccuggatttgtugaaac

SEQ ID NO: 65664 - DNA, 25 bp, Artificial Sequence
  Synthetic
aggaaatagugccatgctctaacug

SEQ ID NO: 65665 - DNA, 24 bp, Artificial Sequence
  Synthetic
cctactcaacucccttcttuccct

SEQ ID NO: 65666 - DNA, 23 bp, Artificial Sequence
  Synthetic
gtggcatcuttactcaccaucca

SEQ ID NO: 65667 - DNA, 27 bp, Artificial Sequence
  Synthetic
gtaaagaagggagauttgcctgtauga

SEQ ID NO: 65668 - DNA, 28 bp, Artificial Sequence
  Synthetic
gctggtttgggaaauagaagtatacuct

SEQ ID NO: 65669 - DNA, 21 bp, Artificial Sequence
  Synthetic
ccautaucgccccaggaagac

SEQ ID NO: 65670 - DNA, 22 bp, Artificial Sequence
  Synthetic
tccacatgguatcaacccctug

SEQ ID NO: 65671 - DNA, 28 bp, Artificial Sequence
  Synthetic
cctcagttaaaccutgatcagtatuggt

SEQ ID NO: 65672 - DNA, 22 bp, Artificial Sequence
  Synthetic
ggccccacuagccagaaaauat

SEQ ID NO: 65673 - DNA, 28 bp, Artificial Sequence
  Synthetic
gggaggaauacacaaatatgcgaatcua

SEQ ID NO: 65674 - DNA, 25 bp, Artificial Sequence
  Synthetic
cagaagaaaaugaaugcccagaagt

SEQ ID NO: 65675 - DNA, 24 bp, Artificial Sequence
  Synthetic
catcaaaucacaggctgctgatuc

SEQ ID NO: 65676 - DNA, 25 bp, Artificial Sequence
  Synthetic
gacatacaaatugtccagggauggt

SEQ ID NO: 65677 - DNA, 27 bp, Artificial Sequence
  Synthetic
caccacauactattagtucaagggagt

SEQ ID NO: 65678 - DNA, 25 bp, Artificial Sequence
  Synthetic
gtgcatggaaaaautgatagccgut

SEQ ID NO: 65679 - DNA, 25 bp, Artificial Sequence
  Synthetic
aaccactgugtcgcaatttucaaat

SEQ ID NO: 65680 - DNA, 27 bp, Artificial Sequence
  Synthetic
tttaataccccautgtgugaacaagga

SEQ ID NO: 65681 - DNA, 27 bp, Artificial Sequence
  Synthetic
gggtagcggcaauacttgaatattuca

SEQ ID NO: 65682 - DNA, 23 bp, Artificial Sequence
  Synthetic
ccaagatgugaagatggcacaut

SEQ ID NO: 65683 - DNA, 22 bp, Artificial Sequence
  Synthetic
ccacagccautcgtcccaaaua

SEQ ID NO: 65684 - DNA, 28 bp, Artificial Sequence
  Synthetic
tggaccagaaautacagaaatggaugat

SEQ ID NO: 65685 - DNA, 25 bp, Artificial Sequence
  Synthetic
ggtgtgtgtguatcagtgtcacaua

SEQ ID NO: 65686 - DNA, 22 bp, Artificial Sequence
  Synthetic
ggtucacggaggagaaauggag

SEQ ID NO: 65687 - DNA, 22 bp, Artificial Sequence
  Synthetic
ctgtctccccugggtagtttug

SEQ ID NO: 65688 - DNA, 29 bp, Artificial Sequence
  Synthetic
gtcaaacgaaaggauaatacttcaugcaa

SEQ ID NO: 65689 - DNA, 25 bp, Artificial Sequence
  Synthetic
ttgaggagacaagugaagaccatuc

SEQ ID NO: 65690 - DNA, 25 bp, Artificial Sequence
  Synthetic
agccauctucaagaaaaggaacact

SEQ ID NO: 65691 - DNA, 23 bp, Artificial Sequence
  Synthetic
gcacaagaaggucaagattucca

SEQ ID NO: 65692 - DNA, 21 bp, Artificial Sequence
  Synthetic
gcctuagagccaguaggagga

SEQ ID NO: 65693 - DNA, 27 bp, Artificial Sequence
  Synthetic
aatcaaaaatccacagutccctaggut

SEQ ID NO: 65694 - DNA, 26 bp, Artificial Sequence
  Synthetic
aatttgcaatagcgugcaagagatut

SEQ ID NO: 65695 - DNA, 23 bp, Artificial Sequence
  Synthetic
gacgaagtugagacagccatgua

SEQ ID NO: 65696 - DNA, 19 bp, Artificial Sequence
  Synthetic
tuacacacugcccgcaaga

SEQ ID NO: 65697 - DNA, 27 bp, Artificial Sequence
  Synthetic
gtccatcatgcutaagatttgcttgut

SEQ ID NO: 65698 - DNA, 26 bp, Artificial Sequence
  Synthetic
gactctatgtgutcttttggagugct

SEQ ID NO: 65699 - DNA, 28 bp, Artificial Sequence
  Synthetic
aaaactggaaacuggtcctgtaaacuat

SEQ ID NO: 65700 - DNA, 20 bp, Artificial Sequence
  Synthetic
gcugccacacaatugcaacc

SEQ ID NO: 65701 - DNA, 22 bp, Artificial Sequence
  Synthetic
tcagcctgaagguccagatgua

SEQ ID NO: 65702 - DNA, 22 bp, Artificial Sequence
  Synthetic
actggagcugctcctatctuca

SEQ ID NO: 65703 - DNA, 28 bp, Artificial Sequence
  Synthetic
ggtggagaagaaugagaaaacagguaaa

SEQ ID NO: 65704 - DNA, 25 bp, Artificial Sequence
  Synthetic
ccatgtacutacttcctttugcaca

SEQ ID NO: 65705 - DNA, 25 bp, Artificial Sequence
  Synthetic
ttcccttucagcggtttctaaugaa

SEQ ID NO: 65706 - DNA, 20 bp, Artificial Sequence
  Synthetic
gcctccccacugttcctuac

SEQ ID NO: 65707 - DNA, 21 bp, Artificial Sequence
  Synthetic
gcaacttugacccagggagut

SEQ ID NO: 65708 - DNA, 22 bp, Artificial Sequence
  Synthetic
gagggtccutgggaaacuacat

SEQ ID NO: 65709 - DNA, 20 bp, Artificial Sequence
  Synthetic
tguggccatcucaaggacac

SEQ ID NO: 65710 - DNA, 28 bp, Artificial Sequence
  Synthetic
aaggaaaaacucaaggaagaacuaggac

SEQ ID NO: 65711 - DNA, 26 bp, Artificial Sequence
  Synthetic
tgtctgtctagcuctctgaatctgut

SEQ ID NO: 65712 - DNA, 28 bp, Artificial Sequence
  Synthetic
atcagctaacacaggaautattcagcut

SEQ ID NO: 65713 - DNA, 28 bp, Artificial Sequence
  Synthetic
aggactacttcuagttcaggtttgtcut

SEQ ID NO: 65714 - DNA, 25 bp, Artificial Sequence
  Synthetic
gacagcaaauggaaaaagauaggca

SEQ ID NO: 65715 - DNA, 23 bp, Artificial Sequence
  Synthetic
tcttgcttcuggaattccugcat

SEQ ID NO: 65716 - DNA, 24 bp, Artificial Sequence
  Synthetic
ggtgacatcucacctccttuaaca

SEQ ID NO: 65717 - DNA, 27 bp, Artificial Sequence
  Synthetic
gctgaaatuaacagacaagttggucaa

SEQ ID NO: 65718 - DNA, 29 bp, Artificial Sequence
  Synthetic
tttttacttctcuagaactttgctgcuca

SEQ ID NO: 65719 - DNA, 28 bp, Artificial Sequence
  Synthetic
ggcgtggtaaaaugtgacataaaaugaa

SEQ ID NO: 65720 - DNA, 21 bp, Artificial Sequence
  Synthetic
ccatgtagggugaacctggug

SEQ ID NO: 65721 - DNA, 27 bp, Artificial Sequence
  Synthetic
aatgctgaaggauacagtgatuagcaa

SEQ ID NO: 65722 - DNA, 20 bp, Artificial Sequence
  Synthetic
gggaguagagtgggucggaa

SEQ ID NO: 65723 - DNA, 23 bp, Artificial Sequence
  Synthetic
gatctaatggguagctgctgugt

SEQ ID NO: 65724 - DNA, 21 bp, Artificial Sequence
  Synthetic
gtgggatucaccagcucacat

SEQ ID NO: 65725 - DNA, 27 bp, Artificial Sequence
  Synthetic
cattccttagguccgtgatcttcttua

SEQ ID NO: 65726 - DNA, 23 bp, Artificial Sequence
  Synthetic
tutagtgtgcucagaaccacgaa

SEQ ID NO: 65727 - DNA, 21 bp, Artificial Sequence
  Synthetic
caacucccagatuagccccat

SEQ ID NO: 65728 - DNA, 24 bp, Artificial Sequence
  Synthetic
aaactctgtuccacaaagctcuga

SEQ ID NO: 65729 - DNA, 28 bp, Artificial Sequence
  Synthetic
acctgttgttaaaauggaaatgaaggua

SEQ ID NO: 65730 - DNA, 21 bp, Artificial Sequence
  Synthetic
gccactcuacaggttgctguc

SEQ ID NO: 65731 - DNA, 28 bp, Artificial Sequence
  Synthetic
gttgggtatagucaaaatcacctctuca

SEQ ID NO: 65732 - DNA, 27 bp, Artificial Sequence
  Synthetic
ggaggaggaguttaatcatauggaagg

SEQ ID NO: 65733 - DNA, 22 bp, Artificial Sequence
  Synthetic
aatccaccccagguttccatut

SEQ ID NO: 65734 - DNA, 23 bp, Artificial Sequence
  Synthetic
ccccagaagcugaaaatgtugga

SEQ ID NO: 65735 - DNA, 18 bp, Artificial Sequence
  Synthetic
cctgauggaggacugcga

SEQ ID NO: 65736 - DNA, 17 bp, Artificial Sequence
  Synthetic
ggcccgcucctaccauc

SEQ ID NO: 65737 - DNA, 18 bp, Artificial Sequence
  Synthetic
aacgcucggguggagaac

SEQ ID NO: 65738 - DNA, 19 bp, Artificial Sequence
  Synthetic
cgauacccaaccggugaca

SEQ ID NO: 65739 - DNA, 22 bp, Artificial Sequence
  Synthetic
gtctacacucaccaccaaccuc

SEQ ID NO: 65740 - DNA, 24 bp, Artificial Sequence
  Synthetic
catccttgtuccctatcgatgugt

SEQ ID NO: 65741 - DNA, 17 bp, Artificial Sequence
  Synthetic
cggcacucggagcagut

SEQ ID NO: 65742 - DNA, 27 bp, Artificial Sequence
  Synthetic
gttatttgatgugaactttgtgccugt

SEQ ID NO: 65743 - DNA, 28 bp, Artificial Sequence
  Synthetic
cgtaactatacacaauggatccagugaa

SEQ ID NO: 65744 - DNA, 22 bp, Artificial Sequence
  Synthetic
cctcutaaacccaaugcccaga

SEQ ID NO: 65745 - DNA, 21 bp, Artificial Sequence
  Synthetic
gtcccuaggaggaaccucagt

SEQ ID NO: 65746 - DNA, 21 bp, Artificial Sequence
  Synthetic
gttgatgctcugcacatcguc

SEQ ID NO: 65747 - DNA, 19 bp, Artificial Sequence
  Synthetic
gtguggccagcgtaatucc

SEQ ID NO: 65748 - DNA, 21 bp, Artificial Sequence
  Synthetic
ggccactgucttgggttttug

SEQ ID NO: 65749 - DNA, 26 bp, Artificial Sequence
  Synthetic
catccataaaucccacagatctggua

SEQ ID NO: 65750 - DNA, 29 bp, Artificial Sequence
  Synthetic
atcttaatgagucatcctgttttgtugga

SEQ ID NO: 65751 - DNA, 23 bp, Artificial Sequence
  Synthetic
tcttgcctcauctgttgccttut

SEQ ID NO: 65752 - DNA, 25 bp, Artificial Sequence
  Synthetic
tccctgatacugtggttgtgaguaa

SEQ ID NO: 65753 - DNA, 26 bp, Artificial Sequence
  Synthetic
gtagaatccatcucgggtttcatcuc

SEQ ID NO: 65754 - DNA, 20 bp, Artificial Sequence
  Synthetic
gagtggaucagcggcatgua

SEQ ID NO: 65755 - DNA, 21 bp, Artificial Sequence
  Synthetic
ctgcttgcucatttgccugac

SEQ ID NO: 65756 - DNA, 19 bp, Artificial Sequence
  Synthetic
tggctccucgatgcccuaa

SEQ ID NO: 65757 - DNA, 27 bp, Artificial Sequence
  Synthetic
ggaaacttgggugattcttgtgttuat

SEQ ID NO: 65758 - DNA, 28 bp, Artificial Sequence
  Synthetic
atgtaagtattgacugtacaccctcuct

SEQ ID NO: 65759 - DNA, 28 bp, Artificial Sequence
  Synthetic
gacactgtagccuttacgaatgtacuaa

SEQ ID NO: 65760 - DNA, 23 bp, Artificial Sequence
  Synthetic
gcagtatcuaacagcagcuggaa

SEQ ID NO: 65761 - DNA, 26 bp, Artificial Sequence
  Synthetic
ggtaacactuttcctgtttcuagcct

SEQ ID NO: 65762 - DNA, 25 bp, Artificial Sequence
  Synthetic
cttcaaucacagaatcacaguccca

SEQ ID NO: 65763 - DNA, 28 bp, Artificial Sequence
  Synthetic
ggagggttgautgatggactauagaaaa

SEQ ID NO: 65764 - DNA, 28 bp, Artificial Sequence
  Synthetic
actgtcactgucaatggtaatuacaact

SEQ ID NO: 65765 - DNA, 24 bp, Artificial Sequence
  Synthetic
gugatacctttucagacagccgat

SEQ ID NO: 65766 - DNA, 21 bp, Artificial Sequence
  Synthetic
tcatcccauggtgcctgacua

SEQ ID NO: 65767 - DNA, 26 bp, Artificial Sequence
  Synthetic
atttatcagtttugcccgatctccut

SEQ ID NO: 65768 - DNA, 22 bp, Artificial Sequence
  Synthetic
acactgtgtccuggaacccaua

SEQ ID NO: 65769 - DNA, 24 bp, Artificial Sequence
  Synthetic
ggctgagtucaggtcatagaugaa

SEQ ID NO: 65770 - DNA, 22 bp, Artificial Sequence
  Synthetic
gctagagagcuctgaggacuga

SEQ ID NO: 65771 - DNA, 22 bp, Artificial Sequence
  Synthetic
ctacaggctuacctctccgtug

SEQ ID NO: 65772 - DNA, 22 bp, Artificial Sequence
  Synthetic
gcutgttggtgucccaggaagt

SEQ ID NO: 65773 - DNA, 23 bp, Artificial Sequence
  Synthetic
tgcagcagaagcugtaaaacuga

SEQ ID NO: 65774 - DNA, 28 bp, Artificial Sequence
  Synthetic
ggaaagtgtugagataaaacaugaagca

SEQ ID NO: 65775 - DNA, 24 bp, Artificial Sequence
  Synthetic
gatctccacccaguttgacagtua

SEQ ID NO: 65776 - DNA, 18 bp, Artificial Sequence
  Synthetic
tcgccgugcgaacaguag

SEQ ID NO: 65777 - DNA, 22 bp, Artificial Sequence
  Synthetic
tctacaaaggucacctgtucgg

SEQ ID NO: 65778 - DNA, 20 bp, Artificial Sequence
  Synthetic
gtgcttgccgutcctctgua

SEQ ID NO: 65779 - DNA, 27 bp, Artificial Sequence
  Synthetic
tggaaattctaguttgggcatgtguag

SEQ ID NO: 65780 - DNA, 25 bp, Artificial Sequence
  Synthetic
tccgugaggcagagatttaucaaac

SEQ ID NO: 65781 - DNA, 29 bp, Artificial Sequence
  Synthetic
tcgacttaatggguctaatctacaugaga

SEQ ID NO: 65782 - DNA, 23 bp, Artificial Sequence
  Synthetic
cagaccaauggaaaatggugcat

SEQ ID NO: 65783 - DNA, 21 bp, Artificial Sequence
  Synthetic
aggagagtucaggcaaagcug

SEQ ID NO: 65784 - DNA, 32 bp, Artificial Sequence
  Synthetic
ttuatgcttgatttcctuaacaagaagagaga

SEQ ID NO: 65785 - DNA, 26 bp, Artificial Sequence
  Synthetic
ggtaggtgtutcttggaaatguggaa

SEQ ID NO: 65786 - DNA, 18 bp, Artificial Sequence
  Synthetic
ggatgugcgcctcctugt

SEQ ID NO: 65787 - DNA, 21 bp, Artificial Sequence
  Synthetic
ccactatcuttggctgugggt

SEQ ID NO: 65788 - DNA, 21 bp, Artificial Sequence
  Synthetic
gccaggugagattccagtucc

SEQ ID NO: 65789 - DNA, 26 bp, Artificial Sequence
  Synthetic
gccttctcaguccttcttacattguc

SEQ ID NO: 65790 - DNA, 20 bp, Artificial Sequence
  Synthetic
actacacgcccucaccguat

SEQ ID NO: 65791 - DNA, 21 bp, Artificial Sequence
  Synthetic
agaagggagcucagcattgug

SEQ ID NO: 65792 - DNA, 21 bp, Artificial Sequence
  Synthetic
gagctgguaaacctggcguat

SEQ ID NO: 65793 - DNA, 22 bp, Artificial Sequence
  Synthetic
acaaagcctutctccacacuga

SEQ ID NO: 65794 - DNA, 21 bp, Artificial Sequence
  Synthetic
gccuacguagagccaaaggaa

SEQ ID NO: 65795 - DNA, 24 bp, Artificial Sequence
  Synthetic
tccttttcacaguagcgatcctug

SEQ ID NO: 65796 - DNA, 20 bp, Artificial Sequence
  Synthetic
gagggtttgugacaggccua

SEQ ID NO: 65797 - DNA, 22 bp, Artificial Sequence
  Synthetic
tgagagagggcuccaaaaguca

SEQ ID NO: 65798 - DNA, 22 bp, Artificial Sequence
  Synthetic
caacaagagguttgcccgacua

SEQ ID NO: 65799 - DNA, 27 bp, Artificial Sequence
  Synthetic
cgcacaaaugtttcagaactucaaact

SEQ ID NO: 65800 - DNA, 25 bp, Artificial Sequence
  Synthetic
actcttggcutgtattttgggugaa

SEQ ID NO: 65801 - DNA, 25 bp, Artificial Sequence
  Synthetic
catguagacggatcactuaagagca

SEQ ID NO: 65802 - DNA, 25 bp, Artificial Sequence
  Synthetic
gctcatttctaucgatggctctgut

SEQ ID NO: 65803 - DNA, 29 bp, Artificial Sequence
  Synthetic
ggactgtcatgtutgtactttgtttgaut

SEQ ID NO: 65804 - DNA, 26 bp, Artificial Sequence
  Synthetic
cctctaccagaaaagugatactugct

SEQ ID NO: 65805 - DNA, 28 bp, Artificial Sequence
  Synthetic
cctgcatttctutattttggtaacguca

SEQ ID NO: 65806 - DNA, 28 bp, Artificial Sequence
  Synthetic
aggtatttacauaccggatcatcuggat

SEQ ID NO: 65807 - DNA, 24 bp, Artificial Sequence
  Synthetic
ctgtaacatttcuggtgtgcagut

SEQ ID NO: 65808 - DNA, 23 bp, Artificial Sequence
  Synthetic
gccagatcauggtagcttgcuaa

SEQ ID NO: 65809 - DNA, 27 bp, Artificial Sequence
  Synthetic
gatgaggatgtautcagacttggtcuc

SEQ ID NO: 65810 - DNA, 20 bp, Artificial Sequence
  Synthetic
ggaaggacgcacccuacuac

SEQ ID NO: 65811 - DNA, 22 bp, Artificial Sequence
  Synthetic
ctatugcaagagccagcucaga

SEQ ID NO: 65812 - DNA, 17 bp, Artificial Sequence
  Synthetic
gagcgcaucgcggagua

SEQ ID NO: 65813 - DNA, 22 bp, Artificial Sequence
  Synthetic
cctcatuaacaagggagccugt

SEQ ID NO: 65814 - DNA, 23 bp, Artificial Sequence
  Synthetic
tcaggaccuaggagctgagatuc

SEQ ID NO: 65815 - DNA, 18 bp, Artificial Sequence
  Synthetic
gccgcugattgggucgat

SEQ ID NO: 65816 - DNA, 21 bp, Artificial Sequence
  Synthetic
ccaaaccaccuctgccugaag

SEQ ID NO: 65817 - DNA, 25 bp, Artificial Sequence
  Synthetic
catccttuccgagaagacatcctut

SEQ ID NO: 65818 - DNA, 21 bp, Artificial Sequence
  Synthetic
caagttcugggagctgcctua

SEQ ID NO: 65819 - DNA, 25 bp, Artificial Sequence
  Synthetic
cacagtaaacgutgttctgctctuc

SEQ ID NO: 65820 - DNA, 23 bp, Artificial Sequence
  Synthetic
ttttcgaagcacugtctgtucct

SEQ ID NO: 65821 - DNA, 21 bp, Artificial Sequence
  Synthetic
catactgcucgatgguggaca

SEQ ID NO: 65822 - DNA, 22 bp, Artificial Sequence
  Synthetic
ggagagaagaugctcacagucc

SEQ ID NO: 65823 - DNA, 21 bp, Artificial Sequence
  Synthetic
ggagaaacucactggctugct

SEQ ID NO: 65824 - DNA, 21 bp, Artificial Sequence
  Synthetic
cctgagccacucctcactuct

SEQ ID NO: 65825 - DNA, 27 bp, Artificial Sequence
  Synthetic
gactctcactcugactactgtcattuc

SEQ ID NO: 65826 - DNA, 21 bp, Artificial Sequence
  Synthetic
atgacatuccccaagcaugga

SEQ ID NO: 65827 - DNA, 25 bp, Artificial Sequence
  Synthetic
cgcagacggcaugtatgataaacua

SEQ ID NO: 65828 - DNA, 20 bp, Artificial Sequence
  Synthetic
gacaccaccgagcugatuca

SEQ ID NO: 65829 - DNA, 22 bp, Artificial Sequence
  Synthetic
gggatgaggaugcattgtggut

SEQ ID NO: 65830 - DNA, 17 bp, Artificial Sequence
  Synthetic
caaguccgccggcucat

SEQ ID NO: 65831 - DNA, 22 bp, Artificial Sequence
  Synthetic
ctcagctgtcutcggttctcuc

SEQ ID NO: 65832 - DNA, 21 bp, Artificial Sequence
  Synthetic
ctcggcucctgtttgaugaag

SEQ ID NO: 65833 - DNA, 17 bp, Artificial Sequence
  Synthetic
gacgugcgggaccugaa

SEQ ID NO: 65834 - DNA, 21 bp, Artificial Sequence
  Synthetic
cttcctcagcugcagtcagua

SEQ ID NO: 65835 - DNA, 22 bp, Artificial Sequence
  Synthetic
agacagcccaucaataaugcca

SEQ ID NO: 65836 - DNA, 25 bp, Artificial Sequence
  Synthetic
gcagtccgtutttcattcacaauca

SEQ ID NO: 65837 - DNA, 21 bp, Artificial Sequence
  Synthetic
gcctcccagcucaagcatuaa

SEQ ID NO: 65838 - DNA, 20 bp, Artificial Sequence
  Synthetic
aggtucccacatccucaggt

SEQ ID NO: 65839 - DNA, 24 bp, Artificial Sequence
  Synthetic
acccagguacatctttgaguccat

SEQ ID NO: 65840 - DNA, 20 bp, Artificial Sequence
  Synthetic
cccactacugggtccttcug

SEQ ID NO: 65841 - DNA, 23 bp, Artificial Sequence
  Synthetic
tctccaccutcttcattgcugag

SEQ ID NO: 65842 - DNA, 21 bp, Artificial Sequence
  Synthetic
cctggaagcutaggtcugact

SEQ ID NO: 65843 - DNA, 25 bp, Artificial Sequence
  Synthetic
catgtctucaagacgatgttucagg

SEQ ID NO: 65844 - DNA, 18 bp, Artificial Sequence
  Synthetic
cucatccgcuacgccaac

SEQ ID NO: 65845 - DNA, 20 bp, Artificial Sequence
  Synthetic
gactttggcuccacccauct

SEQ ID NO: 65846 - DNA, 21 bp, Artificial Sequence
  Synthetic
aggatcguctcaaccttugcc

SEQ ID NO: 65847 - DNA, 24 bp, Artificial Sequence
  Synthetic
gttcttcagtguggacagctguat

SEQ ID NO: 65848 - DNA, 29 bp, Artificial Sequence
  Synthetic
cacagtuacagcaaatagaaacaugacaa

SEQ ID NO: 65849 - DNA, 23 bp, Artificial Sequence
  Synthetic
cctgttgcuatggagacuaccaa

SEQ ID NO: 65850 - DNA, 25 bp, Artificial Sequence
  Synthetic
gcagcagcugattttuagagcaaac

SEQ ID NO: 65851 - DNA, 24 bp, Artificial Sequence
  Synthetic
gggtaccugagaatttgtaggcut

SEQ ID NO: 65852 - DNA, 28 bp, Artificial Sequence
  Synthetic
gcctgattcgagaucctgaaacaatuaa

SEQ ID NO: 65853 - DNA, 30 bp, Artificial Sequence
  Synthetic
gcaaggcauaatgatatauaggaagcaaag

SEQ ID NO: 65854 - DNA, 22 bp, Artificial Sequence
  Synthetic
ccacacacagccuacttuccaa

SEQ ID NO: 65855 - DNA, 23 bp, Artificial Sequence
  Synthetic
aatagacgacugaggauggcaac

SEQ ID NO: 65856 - DNA, 28 bp, Artificial Sequence
  Synthetic
aataatgagcaccugattgattgacuct

SEQ ID NO: 65857 - DNA, 23 bp, Artificial Sequence
  Synthetic
aaagagccugagtgaatccctuc

SEQ ID NO: 65858 - DNA, 21 bp, Artificial Sequence
  Synthetic
cggagguacauccccaagaac

SEQ ID NO: 65859 - DNA, 22 bp, Artificial Sequence
  Synthetic
gctccgtuacactttccauccc

SEQ ID NO: 65860 - DNA, 21 bp, Artificial Sequence
  Synthetic
ccatctguggcttcctaccut

SEQ ID NO: 65861 - DNA, 24 bp, Artificial Sequence
  Synthetic
ccgcttccagaucttcttgaugat

SEQ ID NO: 65862 - DNA, 24 bp, Artificial Sequence
  Synthetic
ggccagccaauagtctatagcuac

SEQ ID NO: 65863 - DNA, 26 bp, Artificial Sequence
  Synthetic
gcccatcugaagcttaaacaaaagut

SEQ ID NO: 65864 - DNA, 28 bp, Artificial Sequence
  Synthetic
ccacggaaauagagaaggauagaaacaa

SEQ ID NO: 65865 - DNA, 28 bp, Artificial Sequence
  Synthetic
gttacctttcacguttctgtttgctuat

SEQ ID NO: 65866 - DNA, 23 bp, Artificial Sequence
  Synthetic
ggcttgcttutgtttctggguaa

SEQ ID NO: 65867 - DNA, 28 bp, Artificial Sequence
  Synthetic
gcattgtaccuggacagacttctatuaa

SEQ ID NO: 65868 - DNA, 23 bp, Artificial Sequence
  Synthetic
gugagaaagagagcagucccaaa

SEQ ID NO: 65869 - DNA, 28 bp, Artificial Sequence
  Synthetic
tcctatacaaaaucctccaaggcaaaug

SEQ ID NO: 65870 - DNA, 32 bp, Artificial Sequence
  Synthetic
accattaaccctautaaaatttcatggtucct

SEQ ID NO: 65871 - DNA, 28 bp, Artificial Sequence
  Synthetic
acactgcattcugcccaaaatatctaut

SEQ ID NO: 65872 - DNA, 22 bp, Artificial Sequence
  Synthetic
gtggttcaacutcaggctcuca

SEQ ID NO: 65873 - DNA, 23 bp, Artificial Sequence
  Synthetic
cgggacctgguaggtactgaaua

SEQ ID NO: 65874 - DNA, 24 bp, Artificial Sequence
  Synthetic
ctgatggaatcugtgagccttuct

SEQ ID NO: 65875 - DNA, 27 bp, Artificial Sequence
  Synthetic
tccaaaggaagaucccatattttgcut

SEQ ID NO: 65876 - DNA, 28 bp, Artificial Sequence
  Synthetic
gttttgttctguggatactcaattugct

SEQ ID NO: 65877 - DNA, 25 bp, Artificial Sequence
  Synthetic
gagaaaatctttgugccacatccuc

SEQ ID NO: 65878 - DNA, 23 bp, Artificial Sequence
  Synthetic
gtttcttctccutgctcttgcug

SEQ ID NO: 65879 - DNA, 22 bp, Artificial Sequence
  Synthetic
cctgggtcuctcaagctttugt

SEQ ID NO: 65880 - DNA, 21 bp, Artificial Sequence
  Synthetic
ggaggtccuttgggtccuaca

SEQ ID NO: 65881 - DNA, 26 bp, Artificial Sequence
  Synthetic
tcggcttaaucctgtgaatgttucat

SEQ ID NO: 65882 - DNA, 28 bp, Artificial Sequence
  Synthetic
tctggcctgatauttgactacagtagua

SEQ ID NO: 65883 - DNA, 23 bp, Artificial Sequence
  Synthetic
tcatgttugggaaggatgtcugg

SEQ ID NO: 65884 - DNA, 20 bp, Artificial Sequence
  Synthetic
ggatgctgagucccgtgaug

SEQ ID NO: 65885 - DNA, 28 bp, Artificial Sequence
  Synthetic
agggacattacautacaggcaaattcut

SEQ ID NO: 65886 - DNA, 21 bp, Artificial Sequence
  Synthetic
ccaggccucagaagacgauag

SEQ ID NO: 65887 - DNA, 21 bp, Artificial Sequence
  Synthetic
cacaacugacaccaacaccug

SEQ ID NO: 65888 - DNA, 27 bp, Artificial Sequence
  Synthetic
cctctccattggauttaggaaagctua

SEQ ID NO: 65889 - DNA, 21 bp, Artificial Sequence
  Synthetic
catccatgaugctctccugct

SEQ ID NO: 65890 - DNA, 21 bp, Artificial Sequence
  Synthetic
gctataauggcagcggtgcua

SEQ ID NO: 65891 - DNA, 23 bp, Artificial Sequence
  Synthetic
agcaattcccaaccucctcttug

SEQ ID NO: 65892 - DNA, 24 bp, Artificial Sequence
  Synthetic
ctttctctccutttgcaccttugt

SEQ ID NO: 65893 - DNA, 28 bp, Artificial Sequence
  Synthetic
gctaagcccaaaucaagtttcaattgut

SEQ ID NO: 65894 - DNA, 21 bp, Artificial Sequence
  Synthetic
gcatgtccaguccagggaauc

SEQ ID NO: 65895 - DNA, 21 bp, Artificial Sequence
  Synthetic
ccugaugaccccaaacaccaa

SEQ ID NO: 65896 - DNA, 26 bp, Artificial Sequence
  Synthetic
cacaaaggatucagagacctactgua

SEQ ID NO: 65897 - DNA, 20 bp, Artificial Sequence
  Synthetic
acaaggucaacagcctgucc

SEQ ID NO: 65898 - DNA, 19 bp, Artificial Sequence
  Synthetic
gtgagcuccgcgttcauct

SEQ ID NO: 65899 - DNA, 23 bp, Artificial Sequence
  Synthetic
gtctaggagugccagctctttut

SEQ ID NO: 65900 - DNA, 21 bp, Artificial Sequence
  Synthetic
agggaggacutctgguacagg

SEQ ID NO: 65901 - DNA, 22 bp, Artificial Sequence
  Synthetic
acctgggcaaguccaacaatut

SEQ ID NO: 65902 - DNA, 22 bp, Artificial Sequence
  Synthetic
gtaggagcaagcgagugatugt

SEQ ID NO: 65903 - DNA, 21 bp, Artificial Sequence
  Synthetic
gcagcaggugtactacuccat

SEQ ID NO: 65904 - DNA, 23 bp, Artificial Sequence
  Synthetic
ggugacuagcaaagcccaaaaga

SEQ ID NO: 65905 - DNA, 21 bp, Artificial Sequence
  Synthetic
caagccaggagucugagaacc

SEQ ID NO: 65906 - DNA, 18 bp, Artificial Sequence
  Synthetic
gcgtguctctgcguccag

SEQ ID NO: 65907 - DNA, 19 bp, Artificial Sequence
  Synthetic
cctgacugtctgccugcat

SEQ ID NO: 65908 - DNA, 21 bp, Artificial Sequence
  Synthetic
tttgttcucccgctugaaggt

SEQ ID NO: 65909 - DNA, 20 bp, Artificial Sequence
  Synthetic
ccugagacagacccuggaca

SEQ ID NO: 65910 - DNA, 23 bp, Artificial Sequence
  Synthetic
cagagtccucctgtgttgucaaa

SEQ ID NO: 65911 - DNA, 20 bp, Artificial Sequence
  Synthetic
gtccttuccaaggccaacuc

SEQ ID NO: 65912 - DNA, 21 bp, Artificial Sequence
  Synthetic
gcctgggucaaggtcagtaug

SEQ ID NO: 65913 - DNA, 24 bp, Artificial Sequence
  Synthetic
tggaggaugaggaggagatgaaug

SEQ ID NO: 65914 - DNA, 24 bp, Artificial Sequence
  Synthetic
cacaaacaugtggtggtugaagaa

SEQ ID NO: 65915 - DNA, 18 bp, Artificial Sequence
  Synthetic
ggcucaggcacaguggac

SEQ ID NO: 65916 - DNA, 23 bp, Artificial Sequence
  Synthetic
guggagcaagaugaggaagaaga

SEQ ID NO: 65917 - DNA, 29 bp, Artificial Sequence
  Synthetic
ccacactggcuttgagaataauaaaacaa

SEQ ID NO: 65918 - DNA, 25 bp, Artificial Sequence
  Synthetic
gtcttguctttttggauagggcagt

SEQ ID NO: 65919 - DNA, 28 bp, Artificial Sequence
  Synthetic
gctgttgctugggattatttctgaatut

SEQ ID NO: 65920 - DNA, 26 bp, Artificial Sequence
  Synthetic
atcagtgcctugtttatctcatgaut

SEQ ID NO: 65921 - DNA, 27 bp, Artificial Sequence
  Synthetic
agtacagagagtucacatttgcacaut

SEQ ID NO: 65922 - DNA, 25 bp, Artificial Sequence
  Synthetic
cctttaccttuagaagggcaugact

SEQ ID NO: 65923 - DNA, 26 bp, Artificial Sequence
  Synthetic
caccaaaauagattggagcaugcaat

SEQ ID NO: 65924 - DNA, 26 bp, Artificial Sequence
  Synthetic
ccugaaaaattccaugaaggagaacc

SEQ ID NO: 65925 - DNA, 25 bp, Artificial Sequence
  Synthetic
acagaagctuaccaccaagaugaac

SEQ ID NO: 65926 - DNA, 23 bp, Artificial Sequence
  Synthetic
gcctgaatcgugttttctgtuga

SEQ ID NO: 65927 - DNA, 20 bp, Artificial Sequence
  Synthetic
aagctgcaaaucaccuccga

SEQ ID NO: 65928 - DNA, 20 bp, Artificial Sequence
  Synthetic
gacacccgacacucctcaut

SEQ ID NO: 65929 - DNA, 28 bp, Artificial Sequence
  Synthetic
ggaacctcttccutatttttccctttuc

SEQ ID NO: 65930 - DNA, 21 bp, Artificial Sequence
  Synthetic
atgaccagcaccaacugugaa

SEQ ID NO: 65931 - DNA, 21 bp, Artificial Sequence
  Synthetic
cctgtgaacagugtcccaucc

SEQ ID NO: 65932 - DNA, 22 bp, Artificial Sequence
  Synthetic
cactggaaacucccaaaggugt

SEQ ID NO: 65933 - DNA, 26 bp, Artificial Sequence
  Synthetic
ccgaccaaaucctatcaccgttauat

SEQ ID NO: 65934 - DNA, 23 bp, Artificial Sequence
  Synthetic
ggaggatguccacttacatgugt

SEQ ID NO: 65935 - DNA, 28 bp, Artificial Sequence
  Synthetic
cctgatgctttugtgtttgtatatggua

SEQ ID NO: 65936 - DNA, 23 bp, Artificial Sequence
  Synthetic
caaaaagtccaugctgggaugat

SEQ ID NO: 65937 - DNA, 21 bp, Artificial Sequence
  Synthetic
gguactgaggaaugcgaggag

SEQ ID NO: 65938 - DNA, 25 bp, Artificial Sequence
  Synthetic
tgtuaacacacaggccattttuaca

SEQ ID NO: 65939 - DNA, 28 bp, Artificial Sequence
  Synthetic
gcaccctagaaautctacacaaacuact

SEQ ID NO: 65940 - DNA, 20 bp, Artificial Sequence
  Synthetic
gtctctuccggcatgggtua

SEQ ID NO: 65941 - DNA, 22 bp, Artificial Sequence
  Synthetic
atgugagaaaaacccctgugct

SEQ ID NO: 65942 - DNA, 24 bp, Artificial Sequence
  Synthetic
catctguaaaggtcacuggacact

SEQ ID NO: 65943 - DNA, 25 bp, Artificial Sequence
  Synthetic
ccagaaaggauacatagggacucac

SEQ ID NO: 65944 - DNA, 21 bp, Artificial Sequence
  Synthetic
gactggcuctggtttcctuca

SEQ ID NO: 65945 - DNA, 17 bp, Artificial Sequence
  Synthetic
cggcaucatgcgucgag

SEQ ID NO: 65946 - DNA, 17 bp, Artificial Sequence
  Synthetic
gggaguagctcgcugga

SEQ ID NO: 65947 - DNA, 21 bp, Artificial Sequence
  Synthetic
gggtgatgggugtatccctua

SEQ ID NO: 65948 - DNA, 20 bp, Artificial Sequence
  Synthetic
ggcacccugtccagtcuaac

SEQ ID NO: 65949 - DNA, 19 bp, Artificial Sequence
  Synthetic
acucggagagggaccucaa

SEQ ID NO: 65950 - DNA, 24 bp, Artificial Sequence
  Synthetic
gcttcacuctgagcauaacaagca

SEQ ID NO: 65951 - DNA, 22 bp, Artificial Sequence
  Synthetic
aagtgtgaaccugaagggtguc

SEQ ID NO: 65952 - DNA, 17 bp, Artificial Sequence
  Synthetic
gugctcagugggccagt

SEQ ID NO: 65953 - DNA, 17 bp, Artificial Sequence
  Synthetic
ggcugcccagccatcuc

SEQ ID NO: 65954 - DNA, 26 bp, Artificial Sequence
  Synthetic
atgaagtacaucttcttgccaauggt

SEQ ID NO: 65955 - DNA, 20 bp, Artificial Sequence
  Synthetic
ctccttcccgugtcccaauc

SEQ ID NO: 65956 - DNA, 23 bp, Artificial Sequence
  Synthetic
aggaccaagucgaugaggaagaa

SEQ ID NO: 65957 - DNA, 26 bp, Artificial Sequence
  Synthetic
tgtaacttgtccuctctctcttccug

SEQ ID NO: 65958 - DNA, 23 bp, Artificial Sequence
  Synthetic
gcatcatuggccagatccaucaa

SEQ ID NO: 65959 - DNA, 23 bp, Artificial Sequence
  Synthetic
gtcttgccucctgtggtcattua

SEQ ID NO: 65960 - DNA, 22 bp, Artificial Sequence
  Synthetic
gtctgacuggaaggtgcugaag

SEQ ID NO: 65961 - DNA, 20 bp, Artificial Sequence
  Synthetic
agaggcucgcagtctttugg

SEQ ID NO: 65962 - DNA, 19 bp, Artificial Sequence
  Synthetic
ccutgtccatcugcagcgt

SEQ ID NO: 65963 - DNA, 20 bp, Artificial Sequence
  Synthetic
ttccccaaggaguccugaga

SEQ ID NO: 65964 - DNA, 19 bp, Artificial Sequence
  Synthetic
caggcuccacgaaguccat

SEQ ID NO: 65965 - DNA, 17 bp, Artificial Sequence
  Synthetic
gctgcaggccguggtua

SEQ ID NO: 65966 - DNA, 23 bp, Artificial Sequence
  Synthetic
cgaagucccacgtguaaagaaca

SEQ ID NO: 65967 - DNA, 19 bp, Artificial Sequence
  Synthetic
tccccacaggugaguacct

SEQ ID NO: 65968 - DNA, 27 bp, Artificial Sequence
  Synthetic
gattttgcaagaauctcgtggaaaugt

SEQ ID NO: 65969 - DNA, 25 bp, Artificial Sequence
  Synthetic
gctccttcttguttgctgatgguaa

SEQ ID NO: 65970 - DNA, 23 bp, Artificial Sequence
  Synthetic
tggtacctucccagcataaugga

SEQ ID NO: 65971 - DNA, 25 bp, Artificial Sequence
  Synthetic
tctctgatucaagccctacttguct

SEQ ID NO: 65972 - DNA, 26 bp, Artificial Sequence
  Synthetic
ccttaactagacagccucctacccua

SEQ ID NO: 65973 - DNA, 26 bp, Artificial Sequence
  Synthetic
ggatcctggauatagctggattugag

SEQ ID NO: 65974 - DNA, 22 bp, Artificial Sequence
  Synthetic
gtucccagacaggugagcaaat

SEQ ID NO: 65975 - DNA, 24 bp, Artificial Sequence
  Synthetic
aatagaggcaggagguagacucag

SEQ ID NO: 65976 - DNA, 28 bp, Artificial Sequence
  Synthetic
aagaaagtcaguaaagtcaaggtcucac

SEQ ID NO: 65977 - DNA, 20 bp, Artificial Sequence
  Synthetic
ggcagtugacgggcatguat

SEQ ID NO: 65978 - DNA, 23 bp, Artificial Sequence
  Synthetic
ggagatgggugggaaatugaagt

SEQ ID NO: 65979 - DNA, 22 bp, Artificial Sequence
  Synthetic
agctgcctcuttactgactgug

SEQ ID NO: 65980 - DNA, 19 bp, Artificial Sequence
  Synthetic
tcccauacccgtccgguaa

SEQ ID NO: 65981 - DNA, 22 bp, Artificial Sequence
  Synthetic
acatcuccaaacaccucaccag

SEQ ID NO: 65982 - DNA, 19 bp, Artificial Sequence
  Synthetic
gacttguccacccggagut

SEQ ID NO: 65983 - DNA, 20 bp, Artificial Sequence
  Synthetic
gcggaatggugtagagcuca

SEQ ID NO: 65984 - DNA, 25 bp, Artificial Sequence
  Synthetic
catgaaggcaggaugagaauggaat

SEQ ID NO: 65985 - DNA, 23 bp, Artificial Sequence
  Synthetic
cttacttcuccccctcctctgut

SEQ ID NO: 65986 - DNA, 23 bp, Artificial Sequence
  Synthetic
gggactguagatgggugaaaaga

SEQ ID NO: 65987 - DNA, 22 bp, Artificial Sequence
  Synthetic
gggactgacuttctgctctugt

SEQ ID NO: 65988 - DNA, 18 bp, Artificial Sequence
  Synthetic
ggaccuacgtggccauga

SEQ ID NO: 65989 - DNA, 18 bp, Artificial Sequence
  Synthetic
ccgacucaggucccacct

SEQ ID NO: 65990 - DNA, 23 bp, Artificial Sequence
  Synthetic
cttatgagguggctgttgtcuct

SEQ ID NO: 65991 - DNA, 26 bp, Artificial Sequence
  Synthetic
tucaaagaaactctucaggaacccaa

SEQ ID NO: 65992 - DNA, 27 bp, Artificial Sequence
  Synthetic
ctgtctttcauagcaactagcccttua

SEQ ID NO: 65993 - DNA, 29 bp, Artificial Sequence
  Synthetic
tttgtcttaaatatuggagtcacccaugt

SEQ ID NO: 65994 - DNA, 21 bp, Artificial Sequence
  Synthetic
gcacctucagccagtatucgt

SEQ ID NO: 65995 - DNA, 26 bp, Artificial Sequence
  Synthetic
cacacctcttcauagagcgtttcaua

SEQ ID NO: 65996 - DNA, 26 bp, Artificial Sequence
  Synthetic
autctccataaucccaaccaaaccaa

SEQ ID NO: 65997 - DNA, 23 bp, Artificial Sequence
  Synthetic
ggctgatcucaaagaggagctuc

SEQ ID NO: 65998 - DNA, 22 bp, Artificial Sequence
  Synthetic
cgggacauagagggatctgcua

SEQ ID NO: 65999 - DNA, 20 bp, Artificial Sequence
  Synthetic
gttgtccugaggttgcccut

SEQ ID NO: 66000 - DNA, 23 bp, Artificial Sequence
  Synthetic
cagtgtctatucctgtcctgugt

SEQ ID NO: 66001 - DNA, 20 bp, Artificial Sequence
  Synthetic
gtgtctguggtgaccctuca

SEQ ID NO: 66002 - DNA, 21 bp, Artificial Sequence
  Synthetic
gactucaagcaggaggaggug

SEQ ID NO: 66003 - DNA, 20 bp, Artificial Sequence
  Synthetic
ctgcccaggagcucacauag

SEQ ID NO: 66004 - DNA, 18 bp, Artificial Sequence
  Synthetic
gccutcaagucgggcaag

SEQ ID NO: 66005 - DNA, 22 bp, Artificial Sequence
  Synthetic
tggaagatcucctgggtttugg

SEQ ID NO: 66006 - DNA, 20 bp, Artificial Sequence
  Synthetic
gaaaagagccccugcaguct

SEQ ID NO: 66007 - DNA, 21 bp, Artificial Sequence
  Synthetic
gcccuacaaaacactgtgguc

SEQ ID NO: 66008 - DNA, 25 bp, Artificial Sequence
  Synthetic
aggcatttuggaactggguagaaaa

SEQ ID NO: 66009 - DNA, 28 bp, Artificial Sequence
  Synthetic
tgacaccagtugacaatagaagatguaa

SEQ ID NO: 66010 - DNA, 23 bp, Artificial Sequence
  Synthetic
ctgaagaaggagauggtguggaa

SEQ ID NO: 66011 - DNA, 27 bp, Artificial Sequence
  Synthetic
tcctgtcaugggtattatttcttugct

SEQ ID NO: 66012 - DNA, 24 bp, Artificial Sequence
  Synthetic
ttctcaggaugaactagcucgagt

SEQ ID NO: 66013 - DNA, 25 bp, Artificial Sequence
  Synthetic
cucagcacacacauacacacaaaat

SEQ ID NO: 66014 - DNA, 28 bp, Artificial Sequence
  Synthetic
gacctttgaacuctttgttttcatguct

SEQ ID NO: 66015 - DNA, 22 bp, Artificial Sequence
  Synthetic
caagccccuttcgattcuaggt

SEQ ID NO: 66016 - DNA, 28 bp, Artificial Sequence
  Synthetic
ttttccatuacagcaaacacaaatucca

SEQ ID NO: 66017 - DNA, 23 bp, Artificial Sequence
  Synthetic
ggagucaggagggattctucact

SEQ ID NO: 66018 - DNA, 20 bp, Artificial Sequence
  Synthetic
actcgagucctggctucact

SEQ ID NO: 66019 - DNA, 18 bp, Artificial Sequence
  Synthetic
cggcuctuggcggaagac

SEQ ID NO: 66020 - DNA, 21 bp, Artificial Sequence
  Synthetic
gcatcaucagcccggtaguag

SEQ ID NO: 66021 - DNA, 20 bp, Artificial Sequence
  Synthetic
aaagcactuggatgccggua

SEQ ID NO: 66022 - DNA, 25 bp, Artificial Sequence
  Synthetic
accaaaccaagagaagucagaugag

SEQ ID NO: 66023 - DNA, 25 bp, Artificial Sequence
  Synthetic
ccagagucccaccatgaatgaatut

SEQ ID NO: 66024 - DNA, 18 bp, Artificial Sequence
  Synthetic
tccaggcuguccagggat

SEQ ID NO: 66025 - DNA, 22 bp, Artificial Sequence
  Synthetic
acctggccucttgtttcttcuc

SEQ ID NO: 66026 - DNA, 18 bp, Artificial Sequence
  Synthetic
gacctgcugagccccauc

SEQ ID NO: 66027 - DNA, 19 bp, Artificial Sequence
  Synthetic
gggccccggacuttaucac

SEQ ID NO: 66028 - DNA, 21 bp, Artificial Sequence
  Synthetic
tctucggaaaagccactuggt

SEQ ID NO: 66029 - DNA, 28 bp, Artificial Sequence
  Synthetic
gttgtcaatgucctgtttactcaaauca

SEQ ID NO: 66030 - DNA, 17 bp, Artificial Sequence
  Synthetic
gcugaccacgcugagca

SEQ ID NO: 66031 - DNA, 20 bp, Artificial Sequence
  Synthetic
gagttctgguggtcggtgua

SEQ ID NO: 66032 - DNA, 22 bp, Artificial Sequence
  Synthetic
ctggtgacccugtttctctcut

SEQ ID NO: 66033 - DNA, 20 bp, Artificial Sequence
  Synthetic
gcgcaggucttggtguagag

SEQ ID NO: 66034 - DNA, 21 bp, Artificial Sequence
  Synthetic
ctctggtgtucttgggcttug

SEQ ID NO: 66035 - DNA, 18 bp, Artificial Sequence
  Synthetic
acatccucgctgcctgug

SEQ ID NO: 66036 - DNA, 27 bp, Artificial Sequence
  Synthetic
ccagccctaautttgctttttgaugaa

SEQ ID NO: 66037 - DNA, 20 bp, Artificial Sequence
  Synthetic
gagctccutcttggaugcgt

SEQ ID NO: 66038 - DNA, 22 bp, Artificial Sequence
  Synthetic
caacgaccugaagaagcucaac

SEQ ID NO: 66039 - DNA, 24 bp, Artificial Sequence
  Synthetic
ggaaattacaucctggugcagaac

SEQ ID NO: 66040 - DNA, 29 bp, Artificial Sequence
  Synthetic
caatgcagtaggutattcatgaacaaugt

SEQ ID NO: 66041 - DNA, 26 bp, Artificial Sequence
  Synthetic
cctgagucagaaggcagaaataaucc

SEQ ID NO: 66042 - DNA, 26 bp, Artificial Sequence
  Synthetic
actgtggtacgugataaactggacua

SEQ ID NO: 66043 - DNA, 27 bp, Artificial Sequence
  Synthetic
tgaacttgagcutgttttacaggttug

SEQ ID NO: 66044 - DNA, 26 bp, Artificial Sequence
  Synthetic
gactcactccaguactgttcttgtut

SEQ ID NO: 66045 - DNA, 29 bp, Artificial Sequence
  Synthetic
aacaacacattttauggaggtacaaguct

SEQ ID NO: 66046 - DNA, 22 bp, Artificial Sequence
  Synthetic
ccttttcucccgactgttgcua

SEQ ID NO: 66047 - DNA, 20 bp, Artificial Sequence
  Synthetic
actgtucacacggcctctuc

SEQ ID NO: 66048 - DNA, 22 bp, Artificial Sequence
  Synthetic
gccctacguagcaaacuacaga

SEQ ID NO: 66049 - DNA, 20 bp, Artificial Sequence
  Synthetic
gtggacgagugatgaguggt

SEQ ID NO: 66050 - DNA, 26 bp, Artificial Sequence
  Synthetic
gatgtaggaagagutaatcacgugct

SEQ ID NO: 66051 - DNA, 27 bp, Artificial Sequence
  Synthetic
cctgagcutcatgtattuccaaaggaa

SEQ ID NO: 66052 - DNA, 27 bp, Artificial Sequence
  Synthetic
acgatacctucagatgtgtagagaugt

SEQ ID NO: 66053 - DNA, 23 bp, Artificial Sequence
  Synthetic
cagaaucgaaggatugggaacag

SEQ ID NO: 66054 - DNA, 21 bp, Artificial Sequence
  Synthetic
aggtctcugatggtggcucat

SEQ ID NO: 66055 - DNA, 18 bp, Artificial Sequence
  Synthetic
cctcggagaugcggaugg

SEQ ID NO: 66056 - DNA, 21 bp, Artificial Sequence
  Synthetic
cttccuggaccgtgtgtaugg

SEQ ID NO: 66057 - DNA, 28 bp, Artificial Sequence
  Synthetic
tgauatgtccacaaucccaagaaaaaca

SEQ ID NO: 66058 - DNA, 25 bp, Artificial Sequence
  Synthetic
tgagcatacaatugggactgacaut

SEQ ID NO: 66059 - DNA, 20 bp, Artificial Sequence
  Synthetic
ggtacagcuccgggtcguat

SEQ ID NO: 66060 - DNA, 23 bp, Artificial Sequence
  Synthetic
ggcctaugctgatatcauggcaa

SEQ ID NO: 66061 - DNA, 22 bp, Artificial Sequence
  Synthetic
accucaaaggagaccucaacct

SEQ ID NO: 66062 - DNA, 21 bp, Artificial Sequence
  Synthetic
gcttcctccucccatcctgut

SEQ ID NO: 66063 - DNA, 20 bp, Artificial Sequence
  Synthetic
cagatccucagccccuaggt

SEQ ID NO: 66064 - DNA, 20 bp, Artificial Sequence
  Synthetic
ctgguggcctttctcugcat

SEQ ID NO: 66065 - DNA, 21 bp, Artificial Sequence
  Synthetic
cctgtcauccttgcuggagac

SEQ ID NO: 66066 - DNA, 21 bp, Artificial Sequence
  Synthetic
cagtcuggcagcgtcttctua

SEQ ID NO: 66067 - DNA, 23 bp, Artificial Sequence
  Synthetic
ccctccucaccatagttggucat

SEQ ID NO: 66068 - DNA, 29 bp, Artificial Sequence
  Synthetic
aaaagaggcauagtcacaataaagucagt

SEQ ID NO: 66069 - DNA, 21 bp, Artificial Sequence
  Synthetic
tgacacgcccutctctgttut

SEQ ID NO: 66070 - DNA, 17 bp, Artificial Sequence
  Synthetic
ggagcaguagcgccuct

SEQ ID NO: 66071 - DNA, 17 bp, Artificial Sequence
  Synthetic
cgggtgcugctgaguct

SEQ ID NO: 66072 - DNA, 23 bp, Artificial Sequence
  Synthetic
catatcuaaaagacgcggcaugg

SEQ ID NO: 66073 - DNA, 21 bp, Artificial Sequence
  Synthetic
cacacaccugctctuccagat

SEQ ID NO: 66074 - DNA, 24 bp, Artificial Sequence
  Synthetic
ccattctcccugtgacagtcctua

SEQ ID NO: 66075 - DNA, 21 bp, Artificial Sequence
  Synthetic
tgcggagtucttcagcatcuc

SEQ ID NO: 66076 - DNA, 24 bp, Artificial Sequence
  Synthetic
gaacagctgaagutcatgggacua

SEQ ID NO: 66077 - DNA, 23 bp, Artificial Sequence
  Synthetic
ggucatgagagaaugggaagagg

SEQ ID NO: 66078 - DNA, 17 bp, Artificial Sequence
  Synthetic
gcuacgccggcttcuga

SEQ ID NO: 66079 - DNA, 20 bp, Artificial Sequence
  Synthetic
gggactauccctggcucaca

SEQ ID NO: 66080 - DNA, 21 bp, Artificial Sequence
  Synthetic
ccacccuaccccuggagaaaa

SEQ ID NO: 66081 - DNA, 20 bp, Artificial Sequence
  Synthetic
ctgaggccutcctcttggug

SEQ ID NO: 66082 - DNA, 23 bp, Artificial Sequence
  Synthetic
tgtttcaacautgagagcugggt

SEQ ID NO: 66083 - DNA, 27 bp, Artificial Sequence
  Synthetic
tgtataaguagagctgggttuggaact

SEQ ID NO: 66084 - DNA, 20 bp, Artificial Sequence
  Synthetic
ccgagguggtcagtgatucc

SEQ ID NO: 66085 - DNA, 23 bp, Artificial Sequence
  Synthetic
gccatgtgtcuttctgtcctcuc

SEQ ID NO: 66086 - DNA, 22 bp, Artificial Sequence
  Synthetic
ggttgtttccaguctggtccut

SEQ ID NO: 66087 - DNA, 22 bp, Artificial Sequence
  Synthetic
ctcggtgacucggtatgttcuc

SEQ ID NO: 66088 - DNA, 28 bp, Artificial Sequence
  Synthetic
ttcagcttctgutagccactgatuaaat

SEQ ID NO: 66089 - DNA, 28 bp, Artificial Sequence
  Synthetic
ctaaactctgcaaaugcaggaaactauc

SEQ ID NO: 66090 - DNA, 21 bp, Artificial Sequence
  Synthetic
cttuccccaggcaactucaga

SEQ ID NO: 66091 - DNA, 28 bp, Artificial Sequence
  Synthetic
cutttcagguaacagaaagaaagcaaca

SEQ ID NO: 66092 - DNA, 25 bp, Artificial Sequence
  Synthetic
agcacgcaacauaagatacaccuac

SEQ ID NO: 66093 - DNA, 28 bp, Artificial Sequence
  Synthetic
gctttcaaagaggucataataggctuct

SEQ ID NO: 66094 - DNA, 28 bp, Artificial Sequence
  Synthetic
tcgccacagauaagcaagtatcattuat

SEQ ID NO: 66095 - DNA, 28 bp, Artificial Sequence
  Synthetic
ccaatgttgatgaguttttctgtggaut

SEQ ID NO: 66096 - DNA, 25 bp, Artificial Sequence
  Synthetic
ccatgaagttauttaaccagcgugt

SEQ ID NO: 66097 - DNA, 28 bp, Artificial Sequence
  Synthetic
gaattaatgaaccutcagagaggcauca

SEQ ID NO: 66098 - DNA, 23 bp, Artificial Sequence
  Synthetic
agccaatgaaggugagtcctcua

SEQ ID NO: 66099 - DNA, 20 bp, Artificial Sequence
  Synthetic
gaagaaucagcacgcaccuc

SEQ ID NO: 66100 - DNA, 18 bp, Artificial Sequence
  Synthetic
gggagcgcutttggauca

SEQ ID NO: 66101 - DNA, 19 bp, Artificial Sequence
  Synthetic
tcctcagucctggccucag

SEQ ID NO: 66102 - DNA, 25 bp, Artificial Sequence
  Synthetic
cctttctctcagutgttctccccua

SEQ ID NO: 66103 - DNA, 26 bp, Artificial Sequence
  Synthetic
gggtucaaaacagatcaucacaaggt

SEQ ID NO: 66104 - DNA, 22 bp, Artificial Sequence
  Synthetic
ccgtttactcugctagctgcug

SEQ ID NO: 66105 - DNA, 24 bp, Artificial Sequence
  Synthetic
cgccagagcuttgtttcagttaut

SEQ ID NO: 66106 - DNA, 22 bp, Artificial Sequence
  Synthetic
gctttccugaaactctggccut

SEQ ID NO: 66107 - DNA, 24 bp, Artificial Sequence
  Synthetic
gggagcttctugggtatgaaacug

SEQ ID NO: 66108 - DNA, 25 bp, Artificial Sequence
  Synthetic
gcactgatcutctggctgaugaaaa

SEQ ID NO: 66109 - DNA, 26 bp, Artificial Sequence
  Synthetic
gattaagggcaguatctgcuagacac

SEQ ID NO: 66110 - DNA, 27 bp, Artificial Sequence
  Synthetic
aaatatcagggccuttggaatucagaa

SEQ ID NO: 66111 - DNA, 26 bp, Artificial Sequence
  Synthetic
cataagtggtguctaagaggaaggug

SEQ ID NO: 66112 - DNA, 22 bp, Artificial Sequence
  Synthetic
agcauccggaaacaaucacaga

SEQ ID NO: 66113 - DNA, 28 bp, Artificial Sequence
  Synthetic
aaggaagtgguaaatcaaactcacauga

SEQ ID NO: 66114 - DNA, 22 bp, Artificial Sequence
  Synthetic
gctgttgacccuaggcagtuat

SEQ ID NO: 66115 - DNA, 23 bp, Artificial Sequence
  Synthetic
gtcttatuccaccagaucccaca

SEQ ID NO: 66116 - DNA, 24 bp, Artificial Sequence
  Synthetic
caccagutaaatccucagaagggt

SEQ ID NO: 66117 - DNA, 25 bp, Artificial Sequence
  Synthetic
ggagtgacugagcttgcattauact

SEQ ID NO: 66118 - DNA, 22 bp, Artificial Sequence
  Synthetic
ttggttcuagcttccatuggca

SEQ ID NO: 66119 - DNA, 28 bp, Artificial Sequence
  Synthetic
aatttgcctccuggaactactttaauga

SEQ ID NO: 66120 - DNA, 24 bp, Artificial Sequence
  Synthetic
ccatttcagutcaggtugcagaaa

SEQ ID NO: 66121 - DNA, 27 bp, Artificial Sequence
  Synthetic
tgcacaucttcuaaaacagcaagagaa

SEQ ID NO: 66122 - DNA, 25 bp, Artificial Sequence
  Synthetic
cctattcagaaaugacgcuacagca

SEQ ID NO: 66123 - DNA, 27 bp, Artificial Sequence
  Synthetic
tcaaaacatttgutccccagaaugaga

SEQ ID NO: 66124 - DNA, 25 bp, Artificial Sequence
  Synthetic
actcagagttugcggagcttttuaa

SEQ ID NO: 66125 - DNA, 22 bp, Artificial Sequence
  Synthetic
gcctttctguccaggtaaucct

SEQ ID NO: 66126 - DNA, 20 bp, Artificial Sequence
  Synthetic
gcctggtgugaccgaatuct

SEQ ID NO: 66127 - DNA, 29 bp, Artificial Sequence
  Synthetic
gctgaattactgauctgttctgagtcuaa

SEQ ID NO: 66128 - DNA, 26 bp, Artificial Sequence
  Synthetic
aagcagatctauattggcgttgtuga

SEQ ID NO: 66129 - DNA, 28 bp, Artificial Sequence
  Synthetic
ggaagaaattgaagugcctttcagaaut

SEQ ID NO: 66130 - DNA, 28 bp, Artificial Sequence
  Synthetic
tgttggatagctuctataggagcatuga

SEQ ID NO: 66131 - DNA, 26 bp, Artificial Sequence
  Synthetic
tcatgcatttucaaacgcgtaaagut

SEQ ID NO: 66132 - DNA, 20 bp, Artificial Sequence
  Synthetic
gcagaugccatugagcggat

SEQ ID NO: 66133 - DNA, 21 bp, Artificial Sequence
  Synthetic
cttgaagugacagcgcugaac

SEQ ID NO: 66134 - DNA, 21 bp, Artificial Sequence
  Synthetic
cctgatuacccaggccaacug

SEQ ID NO: 66135 - DNA, 22 bp, Artificial Sequence
  Synthetic
agtccugcagaagaccacaaug

SEQ ID NO: 66136 - DNA, 22 bp, Artificial Sequence
  Synthetic
gaagtcacuctgttgtccucca

SEQ ID NO: 66137 - DNA, 21 bp, Artificial Sequence
  Synthetic
cgcttcutcccctaugccaat

SEQ ID NO: 66138 - DNA, 17 bp, Artificial Sequence
  Synthetic
ggctgugggcactccua

SEQ ID NO: 66139 - DNA, 18 bp, Artificial Sequence
  Synthetic
ggagggugacgggaugga

SEQ ID NO: 66140 - DNA, 26 bp, Artificial Sequence
  Synthetic
ctctcagaaugccttttacaatguct

SEQ ID NO: 66141 - DNA, 23 bp, Artificial Sequence
  Synthetic
ggccatcaguggactctctttut

SEQ ID NO: 66142 - DNA, 28 bp, Artificial Sequence
  Synthetic
cacttcttcccaucaagactatacauga

SEQ ID NO: 66143 - DNA, 28 bp, Artificial Sequence
  Synthetic
cacctgtagcaaugtagattcttccuaa

SEQ ID NO: 66144 - DNA, 27 bp, Artificial Sequence
  Synthetic
ttgatctgacugaagagtaguacgagt

SEQ ID NO: 66145 - DNA, 20 bp, Artificial Sequence
  Synthetic
ttgtcccugaacgcttguga

SEQ ID NO: 66146 - DNA, 17 bp, Artificial Sequence
  Synthetic
gccccgucgcgaagtut

SEQ ID NO: 66147 - DNA, 17 bp, Artificial Sequence
  Synthetic
ggcctucgctcccucac

SEQ ID NO: 66148 - DNA, 21 bp, Artificial Sequence
  Synthetic
gcagacaaggaggauctgguc

SEQ ID NO: 66149 - DNA, 25 bp, Artificial Sequence
  Synthetic
ttatctttucaccaagccugggaat

SEQ ID NO: 66150 - DNA, 20 bp, Artificial Sequence
  Synthetic
cttctctgugaccccacguc

SEQ ID NO: 66151 - DNA, 21 bp, Artificial Sequence
  Synthetic
aatcacccauctcgccatcuc

SEQ ID NO: 66152 - DNA, 23 bp, Artificial Sequence
  Synthetic
tcutgaacacaaugagccaggag

SEQ ID NO: 66153 - DNA, 27 bp, Artificial Sequence
  Synthetic
ccactaacugaaaatccaucaccaaca

SEQ ID NO: 66154 - DNA, 21 bp, Artificial Sequence
  Synthetic
gcuagcacuacccacaaggga

SEQ ID NO: 66155 - DNA, 21 bp, Artificial Sequence
  Synthetic
atggauggcgacggauaaagg

SEQ ID NO: 66156 - DNA, 27 bp, Artificial Sequence
  Synthetic
gaatgaatgaauagcacgcttcagtut

SEQ ID NO: 66157 - DNA, 21 bp, Artificial Sequence
  Synthetic
gcucacaggacgagaacauct

SEQ ID NO: 66158 - DNA, 23 bp, Artificial Sequence
  Synthetic
cutgctagattucagcaggagga

SEQ ID NO: 66159 - DNA, 27 bp, Artificial Sequence
  Synthetic
ccgtcttgtttguttgtttacatggut

SEQ ID NO: 66160 - DNA, 18 bp, Artificial Sequence
  Synthetic
ctgggcacuctggctcug

SEQ ID NO: 66161 - DNA, 28 bp, Artificial Sequence
  Synthetic
cattagagauccagaccttataggcaut

SEQ ID NO: 66162 - DNA, 26 bp, Artificial Sequence
  Synthetic
acttcaaaugctggttcugacaaaga

SEQ ID NO: 66163 - DNA, 21 bp, Artificial Sequence
  Synthetic
gctgtccaugcagatgaugct

SEQ ID NO: 66164 - DNA, 25 bp, Artificial Sequence
  Synthetic
aacutaaccaacaugagaggccaat

SEQ ID NO: 66165 - DNA, 24 bp, Artificial Sequence
  Synthetic
agagaccttuacaaagctgauggg

SEQ ID NO: 66166 - DNA, 24 bp, Artificial Sequence
  Synthetic
tctctccauaggtgagggaaauga

SEQ ID NO: 66167 - DNA, 24 bp, Artificial Sequence
  Synthetic
aatgaggcttugtccttacagcut

SEQ ID NO: 66168 - DNA, 24 bp, Artificial Sequence
  Synthetic
tccccattutcaccttttucacca

SEQ ID NO: 66169 - DNA, 28 bp, Artificial Sequence
  Synthetic
gtgtaagatttuatcacatgtggucaac

SEQ ID NO: 66170 - DNA, 24 bp, Artificial Sequence
  Synthetic
caaaggaacauacctgtgguccaa

SEQ ID NO: 66171 - DNA, 30 bp, Artificial Sequence
  Synthetic
gtcaataggugactttcttttaatgugact

SEQ ID NO: 66172 - DNA, 28 bp, Artificial Sequence
  Synthetic
ttgattgcttttucttcgctaccttuac

SEQ ID NO: 66173 - DNA, 28 bp, Artificial Sequence
  Synthetic
gttttccattccauctttcaccacatut

SEQ ID NO: 66174 - DNA, 27 bp, Artificial Sequence
  Synthetic
cagaatatggguaaagatgauccgaca

SEQ ID NO: 66175 - DNA, 22 bp, Artificial Sequence
  Synthetic
tggttuccaacaggttctugct

SEQ ID NO: 66176 - DNA, 28 bp, Artificial Sequence
  Synthetic
gttaccatggcuatgacacatttttcuc

SEQ ID NO: 66177 - DNA, 22 bp, Artificial Sequence
  Synthetic
tggccatttutctgtcccugat

SEQ ID NO: 66178 - DNA, 21 bp, Artificial Sequence
  Synthetic
ccagccccgugtactttgtut

SEQ ID NO: 66179 - DNA, 23 bp, Artificial Sequence
  Synthetic
acccgtctugactctacgtaucc

SEQ ID NO: 66180 - DNA, 21 bp, Artificial Sequence
  Synthetic
cccaggccaagugtcugaaag

SEQ ID NO: 66181 - DNA, 28 bp, Artificial Sequence
  Synthetic
ctctctctctcuttaaagggatccucat

SEQ ID NO: 66182 - DNA, 23 bp, Artificial Sequence
  Synthetic
cgtgacacaugaacacgctacut

SEQ ID NO: 66183 - DNA, 27 bp, Artificial Sequence
  Synthetic
aagagggaautcaaccattucaggaat

SEQ ID NO: 66184 - DNA, 22 bp, Artificial Sequence
  Synthetic
cactcctugaggcacatctuct

SEQ ID NO: 66185 - DNA, 22 bp, Artificial Sequence
  Synthetic
ttccagaugtgaaccucaagcc

SEQ ID NO: 66186 - DNA, 22 bp, Artificial Sequence
  Synthetic
cgccuccgagagcttttctauc

SEQ ID NO: 66187 - DNA, 27 bp, Artificial Sequence
  Synthetic
aatgctgugagactgaacttatuccaa

SEQ ID NO: 66188 - DNA, 24 bp, Artificial Sequence
  Synthetic
ggattgcattuacctgtgaggtug

SEQ ID NO: 66189 - DNA, 28 bp, Artificial Sequence
  Synthetic
ctgttgtcagaggugtaattgagaagua

SEQ ID NO: 66190 - DNA, 24 bp, Artificial Sequence
  Synthetic
actaaacucaccaggatcctucct

SEQ ID NO: 66191 - DNA, 26 bp, Artificial Sequence
  Synthetic
tggtgaaggugtatttctcatcucct

SEQ ID NO: 66192 - DNA, 26 bp, Artificial Sequence
  Synthetic
caagaattcuccccagtgtcatuact

SEQ ID NO: 66193 - DNA, 24 bp, Artificial Sequence
  Synthetic
cttttctctctuttccggttgcut

SEQ ID NO: 66194 - DNA, 21 bp, Artificial Sequence
  Synthetic
atgatcagcgucatcgtggut

SEQ ID NO: 66195 - DNA, 24 bp, Artificial Sequence
  Synthetic
tttttcuaaaggcggctgttucac

SEQ ID NO: 66196 - DNA, 21 bp, Artificial Sequence
  Synthetic
ccgcctgagaugtgaacctut

SEQ ID NO: 66197 - DNA, 22 bp, Artificial Sequence
  Synthetic
aggctgttagcuccccaagaua

SEQ ID NO: 66198 - DNA, 18 bp, Artificial Sequence
  Synthetic
cctccgugggtccgttug

SEQ ID NO: 66199 - DNA, 22 bp, Artificial Sequence
  Synthetic
ctcatcctcgucgtacacguag

SEQ ID NO: 66200 - DNA, 26 bp, Artificial Sequence
  Synthetic
ggagtttatagutacagcacgaucca

SEQ ID NO: 66201 - DNA, 28 bp, Artificial Sequence
  Synthetic
aaaagcauaatucagacaaacacacagg

SEQ ID NO: 66202 - DNA, 26 bp, Artificial Sequence
  Synthetic
cccacatagcugctgacaaatcatua

SEQ ID NO: 66203 - DNA, 28 bp, Artificial Sequence
  Synthetic
ccccagaacaacuttcttgataaaugaa

SEQ ID NO: 66204 - DNA, 25 bp, Artificial Sequence
  Synthetic
cccctgaaagautccactacguaga

SEQ ID NO: 66205 - DNA, 29 bp, Artificial Sequence
  Synthetic
ctgcatauacacctaagtcauacaacagt

SEQ ID NO: 66206 - DNA, 27 bp, Artificial Sequence
  Synthetic
gaagatgtccaggugtcttgttauaga

SEQ ID NO: 66207 - DNA, 27 bp, Artificial Sequence
  Synthetic
ggaatttcaaaggucaatccggttuag

SEQ ID NO: 66208 - DNA, 22 bp, Artificial Sequence
  Synthetic
ggaggcagaacucctcatccua

SEQ ID NO: 66209 - DNA, 28 bp, Artificial Sequence
  Synthetic
acgttatgaccgaautggagaaatuact

SEQ ID NO: 66210 - DNA, 21 bp, Artificial Sequence
  Synthetic
agatctcggagucggactuga

SEQ ID NO: 66211 - DNA, 25 bp, Artificial Sequence
  Synthetic
ccatgtcctucacggtcatctttut

SEQ ID NO: 66212 - DNA, 28 bp, Artificial Sequence
  Synthetic
ttcattgtaagttuacgtggcaggauat

SEQ ID NO: 66213 - DNA, 30 bp, Artificial Sequence
  Synthetic
tgtgctttaagaaaaaugtagaggatucca

SEQ ID NO: 66214 - DNA, 19 bp, Artificial Sequence
  Synthetic
gtcggtccugctgttcgut

SEQ ID NO: 66215 - DNA, 24 bp, Artificial Sequence
  Synthetic
caagtcaucatcaaccguaaccca

SEQ ID NO: 66216 - DNA, 23 bp, Artificial Sequence
  Synthetic
ggaagctguctgtctttgcugaa

SEQ ID NO: 66217 - DNA, 21 bp, Artificial Sequence
  Synthetic
gtagcttgaucttgcccguga

SEQ ID NO: 66218 - DNA, 20 bp, Artificial Sequence
  Synthetic
gccugcggaacaugaagagt

SEQ ID NO: 66219 - DNA, 23 bp, Artificial Sequence
  Synthetic
augtagaacttcuagccccagga

SEQ ID NO: 66220 - DNA, 21 bp, Artificial Sequence
  Synthetic
ctctaauccccatgtguggca

SEQ ID NO: 66221 - DNA, 22 bp, Artificial Sequence
  Synthetic
gcuccaacaccacagtctuagg

SEQ ID NO: 66222 - DNA, 21 bp, Artificial Sequence
  Synthetic
gggtagttucgagctcttguc

SEQ ID NO: 66223 - DNA, 28 bp, Artificial Sequence
  Synthetic
ggaggtcatagucatagagagtgatcut

SEQ ID NO: 66224 - DNA, 21 bp, Artificial Sequence
  Synthetic
actcctgagccuggaatccut

SEQ ID NO: 66225 - DNA, 22 bp, Artificial Sequence
  Synthetic
cgtttctttuccttccccagug

SEQ ID NO: 66226 - DNA, 25 bp, Artificial Sequence
  Synthetic
caaacccatgacuggtctattggua

SEQ ID NO: 66227 - DNA, 24 bp, Artificial Sequence
  Synthetic
ccagtgggcaaacauttttagcug

SEQ ID NO: 66228 - DNA, 26 bp, Artificial Sequence
  Synthetic
tcatgtgccuatttaaggtugaccag

SEQ ID NO: 66229 - DNA, 25 bp, Artificial Sequence
  Synthetic
tttagggcacgaccaaucaaauaca

SEQ ID NO: 66230 - DNA, 21 bp, Artificial Sequence
  Synthetic
gtatcaaagguccagcuggga

SEQ ID NO: 66231 - DNA, 28 bp, Artificial Sequence
  Synthetic
tgtccagtaaaatuggttaggcaaguaa

SEQ ID NO: 66232 - DNA, 22 bp, Artificial Sequence
  Synthetic
actggtcctautggtcctccug

SEQ ID NO: 66233 - DNA, 22 bp, Artificial Sequence
  Synthetic
accaccutcacccuggaaaaag

SEQ ID NO: 66234 - DNA, 25 bp, Artificial Sequence
  Synthetic
actggatggguttgctgaaauacat

SEQ ID NO: 66235 - DNA, 28 bp, Artificial Sequence
  Synthetic
aaaccctcugttaattctttuggagact

SEQ ID NO: 66236 - DNA, 21 bp, Artificial Sequence
  Synthetic
caggagcacutctccccttug

SEQ ID NO: 66237 - DNA, 22 bp, Artificial Sequence
  Synthetic
tcttcatgcauctgcttugcct

SEQ ID NO: 66238 - DNA, 20 bp, Artificial Sequence
  Synthetic
tccccagagccugttcacua

SEQ ID NO: 66239 - DNA, 28 bp, Artificial Sequence
  Synthetic
tgctggaaaacugtgtactagctattut

SEQ ID NO: 66240 - DNA, 20 bp, Artificial Sequence
  Synthetic
ggcugtacgtuccccacaag

SEQ ID NO: 66241 - DNA, 28 bp, Artificial Sequence
  Synthetic
tcttcaactgaacugaattaagtguggt

SEQ ID NO: 66242 - DNA, 22 bp, Artificial Sequence
  Synthetic
aagctttcttugggctgcuagt

SEQ ID NO: 66243 - DNA, 19 bp, Artificial Sequence
  Synthetic
cctggtacucgcgcagaug

SEQ ID NO: 66244 - DNA, 28 bp, Artificial Sequence
  Synthetic
ctgaaataagtaucaacctcaccccaut

SEQ ID NO: 66245 - DNA, 20 bp, Artificial Sequence
  Synthetic
agaggucgacauccacacct

SEQ ID NO: 66246 - DNA, 27 bp, Artificial Sequence
  Synthetic
gcctgtcttuaagttgaacatgaucct

SEQ ID NO: 66247 - DNA, 24 bp, Artificial Sequence
  Synthetic
cagctgcauctctcctacaauagt

SEQ ID NO: 66248 - DNA, 22 bp, Artificial Sequence
  Synthetic
cagctguaataggacugcccat

SEQ ID NO: 66249 - DNA, 23 bp, Artificial Sequence
  Synthetic
gtacactgccaucgcctcttuaa

SEQ ID NO: 66250 - DNA, 21 bp, Artificial Sequence
  Synthetic
ctgcacaugccattctcagug

SEQ ID NO: 66251 - DNA, 27 bp, Artificial Sequence
  Synthetic
acttggttgaaucttactgaccttugt

SEQ ID NO: 66252 - DNA, 21 bp, Artificial Sequence
  Synthetic
caccacctcuggcatccauac

SEQ ID NO: 66253 - DNA, 22 bp, Artificial Sequence
  Synthetic
gcagaagauccuggcaaaagca

SEQ ID NO: 66254 - DNA, 22 bp, Artificial Sequence
  Synthetic
ctggtttgugactgactgcaut

SEQ ID NO: 66255 - DNA, 22 bp, Artificial Sequence
  Synthetic
acttcctucccaccctcctaug

SEQ ID NO: 66256 - DNA, 25 bp, Artificial Sequence
  Synthetic
catagcacagcauagcaaaugagat

SEQ ID NO: 66257 - DNA, 21 bp, Artificial Sequence
  Synthetic
gctcaggccucccuaagaaac

SEQ ID NO: 66258 - DNA, 25 bp, Artificial Sequence
  Synthetic
gcttcaccuctgggttttucagaat

SEQ ID NO: 66259 - DNA, 21 bp, Artificial Sequence
  Synthetic
ggcuacacaggagaggauggt

SEQ ID NO: 66260 - DNA, 21 bp, Artificial Sequence
  Synthetic
ggcctgcucttgagtctcaua

SEQ ID NO: 66261 - DNA, 22 bp, Artificial Sequence
  Synthetic
caatacttcugagggccaccug

SEQ ID NO: 66262 - DNA, 27 bp, Artificial Sequence
  Synthetic
aaaatacauggaggagagtttgucagg

SEQ ID NO: 66263 - DNA, 24 bp, Artificial Sequence
  Synthetic
ccagucacccatgtttaucaggat

SEQ ID NO: 66264 - DNA, 28 bp, Artificial Sequence
  Synthetic
tatgctatcactautacagggcaattug

SEQ ID NO: 66265 - DNA, 28 bp, Artificial Sequence
  Synthetic
catgcaatguactaccaagaaucaaagg

SEQ ID NO: 66266 - DNA, 23 bp, Artificial Sequence
  Synthetic
ggagcuaggaattuggagggaag

SEQ ID NO: 66267 - DNA, 21 bp, Artificial Sequence
  Synthetic
actggcucagagauggcaaag

SEQ ID NO: 66268 - DNA, 18 bp, Artificial Sequence
  Synthetic
gcucaagccggaggucaa

SEQ ID NO: 66269 - DNA, 19 bp, Artificial Sequence
  Synthetic
cagaccauggctccuccag

SEQ ID NO: 66270 - DNA, 21 bp, Artificial Sequence
  Synthetic
tggcagucaccctauccaaag

SEQ ID NO: 66271 - DNA, 23 bp, Artificial Sequence
  Synthetic
caugtggcctttuggaaacacag

SEQ ID NO: 66272 - DNA, 18 bp, Artificial Sequence
  Synthetic
cccagcuccccuggagaa

SEQ ID NO: 66273 - DNA, 17 bp, Artificial Sequence
  Synthetic
gggacugccactugcct

SEQ ID NO: 66274 - DNA, 21 bp, Artificial Sequence
  Synthetic
ctactcctucgacaccugcaa

SEQ ID NO: 66275 - DNA, 20 bp, Artificial Sequence
  Synthetic
gctgaagccuctccaccuct

SEQ ID NO: 66276 - DNA, 25 bp, Artificial Sequence
  Synthetic
cacatttcuagcattctttgtgugg

SEQ ID NO: 66277 - DNA, 25 bp, Artificial Sequence
  Synthetic
aaggtatgtgaucttgctgctucat

SEQ ID NO: 66278 - DNA, 18 bp, Artificial Sequence
  Synthetic
tgaccgcgauggugaact

SEQ ID NO: 66279 - DNA, 17 bp, Artificial Sequence
  Synthetic
ccggaugcgctgcauct

SEQ ID NO: 66280 - DNA, 25 bp, Artificial Sequence
  Synthetic
attttctgttautcggcagcuacct

SEQ ID NO: 66281 - DNA, 25 bp, Artificial Sequence
  Synthetic
cccaaaacucgattagcttccucaa

SEQ ID NO: 66282 - DNA, 27 bp, Artificial Sequence
  Synthetic
tttacctatcutccctatgucgaaggt

SEQ ID NO: 66283 - DNA, 21 bp, Artificial Sequence
  Synthetic
caaggcuttagggcugacagt

SEQ ID NO: 66284 - DNA, 20 bp, Artificial Sequence
  Synthetic
gccatcaugccctgtcauac

SEQ ID NO: 66285 - DNA, 28 bp, Artificial Sequence
  Synthetic
tgccttctaugaggcttgaaagaaauaa

SEQ ID NO: 66286 - DNA, 21 bp, Artificial Sequence
  Synthetic
cagagcuctcggtcugagaga

SEQ ID NO: 66287 - DNA, 28 bp, Artificial Sequence
  Synthetic
acacaggtatucagatcatcaguaaggt

SEQ ID NO: 66288 - DNA, 28 bp, Artificial Sequence
  Synthetic
gttatgctaauagtttgctguggaaaca

SEQ ID NO: 66289 - DNA, 22 bp, Artificial Sequence
  Synthetic
gttttccaugctggtcctucac

SEQ ID NO: 66290 - DNA, 23 bp, Artificial Sequence
  Synthetic
tggaccacugaaggaaattccuc

SEQ ID NO: 66291 - DNA, 22 bp, Artificial Sequence
  Synthetic
gtattgcaugccaacagtguca

SEQ ID NO: 66292 - DNA, 26 bp, Artificial Sequence
  Synthetic
tgtguacaaacaacctuaaaggacca

SEQ ID NO: 66293 - DNA, 28 bp, Artificial Sequence
  Synthetic
tgattgttcttgutctctgtgguaaagt

SEQ ID NO: 66294 - DNA, 24 bp, Artificial Sequence
  Synthetic
agatggcagauctggtagctguaa

SEQ ID NO: 66295 - DNA, 27 bp, Artificial Sequence
  Synthetic
gagtgaaagauacagaaugcaagcaag

SEQ ID NO: 66296 - DNA, 21 bp, Artificial Sequence
  Synthetic
acctgacccacuatggcauct

SEQ ID NO: 66297 - DNA, 21 bp, Artificial Sequence
  Synthetic
ggactcguccaggtgatugac

SEQ ID NO: 66298 - DNA, 26 bp, Artificial Sequence
  Synthetic
tcuacgaaaaggactcauacaccagt

SEQ ID NO: 66299 - DNA, 25 bp, Artificial Sequence
  Synthetic
cctcctggcaggaauccttaaaaut

SEQ ID NO: 66300 - DNA, 23 bp, Artificial Sequence
  Synthetic
cttctgccucttctaaagcuggt

SEQ ID NO: 66301 - DNA, 25 bp, Artificial Sequence
  Synthetic
ctgtttggtgaaguattgcttgcut

SEQ ID NO: 66302 - DNA, 26 bp, Artificial Sequence
  Synthetic
cccaatagcacutattcacaccacua

SEQ ID NO: 66303 - DNA, 23 bp, Artificial Sequence
  Synthetic
ggttttgtaucgaacagctgguc

SEQ ID NO: 66304 - DNA, 25 bp, Artificial Sequence
  Synthetic
acaaaattgggcutactgagccaua

SEQ ID NO: 66305 - DNA, 26 bp, Artificial Sequence
  Synthetic
caattccctcuattttaggctgugct

SEQ ID NO: 66306 - DNA, 21 bp, Artificial Sequence
  Synthetic
ccacagacaagcucugggaac

SEQ ID NO: 66307 - DNA, 27 bp, Artificial Sequence
  Synthetic
gacatucccagtgaagtuacaaacaac

SEQ ID NO: 66308 - DNA, 24 bp, Artificial Sequence
  Synthetic
tggcaaacacaguatcgugaaact

SEQ ID NO: 66309 - DNA, 28 bp, Artificial Sequence
  Synthetic
gaatcttcttcugcattagagtcctuct

SEQ ID NO: 66310 - DNA, 25 bp, Artificial Sequence
  Synthetic
ctttagcttgauatgcaacgaggug

SEQ ID NO: 66311 - DNA, 28 bp, Artificial Sequence
  Synthetic
caaaacatgatgcutgaaaggcaaaaut

SEQ ID NO: 66312 - DNA, 33 bp, Artificial Sequence
  Synthetic
agtatgttacttauggacacttttaatgtgtut

SEQ ID NO: 66313 - DNA, 28 bp, Artificial Sequence
  Synthetic
caacaagttgaguacaagctttctucac

SEQ ID NO: 66314 - DNA, 25 bp, Artificial Sequence
  Synthetic
accaagaggacccaaauaacactuc

SEQ ID NO: 66315 - DNA, 28 bp, Artificial Sequence
  Synthetic
gatcacagtgccauatagctctatgtut

SEQ ID NO: 66316 - DNA, 28 bp, Artificial Sequence
  Synthetic
tgggtagacacuattaaagagucagaca

SEQ ID NO: 66317 - DNA, 25 bp, Artificial Sequence
  Synthetic
cctgtaaattuggctgcatguacaa

SEQ ID NO: 66318 - DNA, 27 bp, Artificial Sequence
  Synthetic
aggaaaaaccucatctgtaaccauacc

SEQ ID NO: 66319 - DNA, 28 bp, Artificial Sequence
  Synthetic
ggtgaagtuggtttctttttctuaccat

SEQ ID NO: 66320 - DNA, 27 bp, Artificial Sequence
  Synthetic
ctattcaggaaggugcaaattccauag

SEQ ID NO: 66321 - DNA, 28 bp, Artificial Sequence
  Synthetic
ccaatgtactttuctcccctggtttuag

SEQ ID NO: 66322 - DNA, 20 bp, Artificial Sequence
  Synthetic
gcgaggagucagacagugac

SEQ ID NO: 66323 - DNA, 23 bp, Artificial Sequence
  Synthetic
gggaguccagaaggagaatguga

SEQ ID NO: 66324 - DNA, 21 bp, Artificial Sequence
  Synthetic
agtggtgaaggucctgacuga

SEQ ID NO: 66325 - DNA, 19 bp, Artificial Sequence
  Synthetic
tcccctuggaagtcgugga

SEQ ID NO: 66326 - DNA, 20 bp, Artificial Sequence
  Synthetic
tgtgcaccucccaacatuga

SEQ ID NO: 66327 - DNA, 22 bp, Artificial Sequence
  Synthetic
ggtctgttutctggccugagac

SEQ ID NO: 66328 - DNA, 24 bp, Artificial Sequence
  Synthetic
tggaacttggcuaaagccattuca

SEQ ID NO: 66329 - DNA, 26 bp, Artificial Sequence
  Synthetic
ctaggcactgtuaagttctcccttut

SEQ ID NO: 66330 - DNA, 22 bp, Artificial Sequence
  Synthetic
cttttcuccaaggctgcagaug

SEQ ID NO: 66331 - DNA, 27 bp, Artificial Sequence
  Synthetic
ccaggatgtguccaaatccatgttaua

SEQ ID NO: 66332 - DNA, 23 bp, Artificial Sequence
  Synthetic
aggcaaucccattttctcuggaa

SEQ ID NO: 66333 - DNA, 22 bp, Artificial Sequence
  Synthetic
ctcgcttacccucaagaaccug

SEQ ID NO: 66334 - DNA, 18 bp, Artificial Sequence
  Synthetic
gcaacugtgugggaccgt

SEQ ID NO: 66335 - DNA, 18 bp, Artificial Sequence
  Synthetic
caccacgggugagaugga

SEQ ID NO: 66336 - DNA, 22 bp, Artificial Sequence
  Synthetic
tgtcaccccaaugacagagaug

SEQ ID NO: 66337 - DNA, 19 bp, Artificial Sequence
  Synthetic
ccctcagccugtccuggat

SEQ ID NO: 66338 - DNA, 21 bp, Artificial Sequence
  Synthetic
ccgtcccugtctttgtacugg

SEQ ID NO: 66339 - DNA, 24 bp, Artificial Sequence
  Synthetic
actatgcttugcttttgcctcuca

SEQ ID NO: 66340 - DNA, 20 bp, Artificial Sequence
  Synthetic
gtcatcccuaggcgucacac

SEQ ID NO: 66341 - DNA, 24 bp, Artificial Sequence
  Synthetic
ggaccaggagacuaagagcaugat

SEQ ID NO: 66342 - DNA, 21 bp, Artificial Sequence
  Synthetic
gactcttgcugcagaggagut

SEQ ID NO: 66343 - DNA, 28 bp, Artificial Sequence
  Synthetic
gaaggagaggagguttttgactctaauc

SEQ ID NO: 66344 - DNA, 21 bp, Artificial Sequence
  Synthetic
gaggagacggcaugaauggat

SEQ ID NO: 66345 - DNA, 20 bp, Artificial Sequence
  Synthetic
cagcagcuttaccgtgucct

SEQ ID NO: 66346 - DNA, 25 bp, Artificial Sequence
  Synthetic
caaaagaagccccuttccagaacua

SEQ ID NO: 66347 - DNA, 23 bp, Artificial Sequence
  Synthetic
gaagggtgaauttggagagugct

SEQ ID NO: 66348 - DNA, 22 bp, Artificial Sequence
  Synthetic
gtcaatccugcctctgatugct

SEQ ID NO: 66349 - DNA, 24 bp, Artificial Sequence
  Synthetic
ttcacttgaaccucttccaccaut

SEQ ID NO: 66350 - DNA, 21 bp, Artificial Sequence
  Synthetic
aggacagagaugacgggcuat

SEQ ID NO: 66351 - DNA, 22 bp, Artificial Sequence
  Synthetic
cctctcaccugtctccccttut

SEQ ID NO: 66352 - DNA, 25 bp, Artificial Sequence
  Synthetic
gttttgggcuaaccatcatttucct

SEQ ID NO: 66353 - DNA, 20 bp, Artificial Sequence
  Synthetic
tggccuccaggtaauggact

SEQ ID NO: 66354 - DNA, 27 bp, Artificial Sequence
  Synthetic
cattcagatatagcutacctgcgtuga

SEQ ID NO: 66355 - DNA, 28 bp, Artificial Sequence
  Synthetic
ctgcttatcaugaaatgaaagagtugct

SEQ ID NO: 66356 - DNA, 22 bp, Artificial Sequence
  Synthetic
acaaaagacuccctcugaggct

SEQ ID NO: 66357 - DNA, 28 bp, Artificial Sequence
  Synthetic
gaccattgacucctccatatagtcuact

SEQ ID NO: 66358 - DNA, 22 bp, Artificial Sequence
  Synthetic
ccataacacacagcugtcccut

SEQ ID NO: 66359 - DNA, 21 bp, Artificial Sequence
  Synthetic
tccaucaccaggucagaacca

SEQ ID NO: 66360 - DNA, 25 bp, Artificial Sequence
  Synthetic
gcuttaaaattgugacagcacagca

SEQ ID NO: 66361 - DNA, 23 bp, Artificial Sequence
  Synthetic
gataatgtcacuggcaccacuct

SEQ ID NO: 66362 - DNA, 24 bp, Artificial Sequence
  Synthetic
tttcagaggacautgattgcccut

SEQ ID NO: 66363 - DNA, 28 bp, Artificial Sequence
  Synthetic
ccagagcatttacauatgtctcttccut

SEQ ID NO: 66364 - DNA, 25 bp, Artificial Sequence
  Synthetic
gagtcatguaacgtaggtugggaat

SEQ ID NO: 66365 - DNA, 23 bp, Artificial Sequence
  Synthetic
agaaagcaggucctgtttauggg

SEQ ID NO: 66366 - DNA, 23 bp, Artificial Sequence
  Synthetic
aagaggaaugccgagaaaagugt

SEQ ID NO: 66367 - DNA, 21 bp, Artificial Sequence
  Synthetic
gcatggagaaugaaccuggct

SEQ ID NO: 66368 - DNA, 24 bp, Artificial Sequence
  Synthetic
cuaacacacaggcaaaaacucact

SEQ ID NO: 66369 - DNA, 25 bp, Artificial Sequence
  Synthetic
caatccaggcuatgttgggauaaga

SEQ ID NO: 66370 - DNA, 27 bp, Artificial Sequence
  Synthetic
caggaccttuatcttggcaaauaccat

SEQ ID NO: 66371 - DNA, 28 bp, Artificial Sequence
  Synthetic
tttcctttttgcaguatgtatgcatucc

SEQ ID NO: 66372 - DNA, 21 bp, Artificial Sequence
  Synthetic
cggctgcauagcctgagaauc

SEQ ID NO: 66373 - DNA, 24 bp, Artificial Sequence
  Synthetic
gcuggaaagtaaaaugagccacct

SEQ ID NO: 66374 - DNA, 29 bp, Artificial Sequence
  Synthetic
agattatgactagaaaugttggtggctut

SEQ ID NO: 66375 - DNA, 23 bp, Artificial Sequence
  Synthetic
atgttgcaggucctgttcaguag

SEQ ID NO: 66376 - DNA, 23 bp, Artificial Sequence
  Synthetic
tggaaagacuggaatttgguggt

SEQ ID NO: 66377 - DNA, 25 bp, Artificial Sequence
  Synthetic
ggatcccaugcaatgaaaaugcaaa

SEQ ID NO: 66378 - DNA, 26 bp, Artificial Sequence
  Synthetic
ctcatagtgcutaatgttgcctucac

SEQ ID NO: 66379 - DNA, 26 bp, Artificial Sequence
  Synthetic
gtaaatgtguccaaccttauccacca

SEQ ID NO: 66380 - DNA, 28 bp, Artificial Sequence
  Synthetic
caatcctgaucacgctttagtttaucaa

SEQ ID NO: 66381 - DNA, 26 bp, Artificial Sequence
  Synthetic
tgggucaaaatugacacagagaagac

SEQ ID NO: 66382 - DNA, 24 bp, Artificial Sequence
  Synthetic
gcagacttggucatcttcactugg

SEQ ID NO: 66383 - DNA, 27 bp, Artificial Sequence
  Synthetic
ctagaatagcauacagcctgtcttuga

SEQ ID NO: 66384 - DNA, 28 bp, Artificial Sequence
  Synthetic
aaaaactttcagcucttacctcuggaat

SEQ ID NO: 66385 - DNA, 27 bp, Artificial Sequence
  Synthetic
gccagctacucactcaacaaaatcaua

SEQ ID NO: 66386 - DNA, 26 bp, Artificial Sequence
  Synthetic
gtguaaggaaagaagaatugggcaaa

SEQ ID NO: 66387 - DNA, 27 bp, Artificial Sequence
  Synthetic
gacaacaaatgtuctttccatagcugt

SEQ ID NO: 66388 - DNA, 22 bp, Artificial Sequence
  Synthetic
caggcaccagutgtcacattut

SEQ ID NO: 66389 - DNA, 21 bp, Artificial Sequence
  Synthetic
aaagccaucugggacaggaag

SEQ ID NO: 66390 - DNA, 25 bp, Artificial Sequence
  Synthetic
caagtttttctucctccctcccaua

SEQ ID NO: 66391 - DNA, 21 bp, Artificial Sequence
  Synthetic
gcttctggtuaggctgtgguc

SEQ ID NO: 66392 - DNA, 19 bp, Artificial Sequence
  Synthetic
cctgaacugccaccuccat

SEQ ID NO: 66393 - DNA, 21 bp, Artificial Sequence
  Synthetic
ccggatcagcuccaaactguc

SEQ ID NO: 66394 - DNA, 20 bp, Artificial Sequence
  Synthetic
gggccaccccautcactauc

SEQ ID NO: 66395 - DNA, 25 bp, Artificial Sequence
  Synthetic
ctgttcctagtutccttgtcccaut

SEQ ID NO: 66396 - DNA, 24 bp, Artificial Sequence
  Synthetic
agttacaagaggaguatgctugcc

SEQ ID NO: 66397 - DNA, 23 bp, Artificial Sequence
  Synthetic
ttcaacaaccucacccattucca

SEQ ID NO: 66398 - DNA, 28 bp, Artificial Sequence
  Synthetic
gatccccaugatataccagaaucaaagg

SEQ ID NO: 66399 - DNA, 28 bp, Artificial Sequence
  Synthetic
ccaaacatuaagcagcactattgcuaat

SEQ ID NO: 66400 - DNA, 28 bp, Artificial Sequence
  Synthetic
gtcattaaacttuaggagcaagccatug

SEQ ID NO: 66401 - DNA, 26 bp, Artificial Sequence
  Synthetic
tgtaagtugggcaatatcagugaagt

SEQ ID NO: 66402 - DNA, 27 bp, Artificial Sequence
  Synthetic
ggagaaacaaaagaaucaaacuacgct

SEQ ID NO: 66403 - DNA, 21 bp, Artificial Sequence
  Synthetic
gggtcuacccagccuaagaat

SEQ ID NO: 66404 - DNA, 27 bp, Artificial Sequence
  Synthetic
tgacttctguacttctgacatttuggg

SEQ ID NO: 66405 - DNA, 27 bp, Artificial Sequence
  Synthetic
agtgaagatgacuggaagaatttugct

SEQ ID NO: 66406 - DNA, 25 bp, Artificial Sequence
  Synthetic
acatttatctagucgaccaggccua

SEQ ID NO: 66407 - DNA, 24 bp, Artificial Sequence
  Synthetic
gttaaccagtugctgactcagtug

SEQ ID NO: 66408 - DNA, 28 bp, Artificial Sequence
  Synthetic
tcaaaatatgccaucatcttagcuggaa

SEQ ID NO: 66409 - DNA, 22 bp, Artificial Sequence
  Synthetic
caguacttgtggaucgagccat

SEQ ID NO: 66410 - DNA, 29 bp, Artificial Sequence
  Synthetic
tcctcactgttutcttcttttaccauagg

SEQ ID NO: 66411 - DNA, 27 bp, Artificial Sequence
  Synthetic
cctggatggguacattgttattgucaa

SEQ ID NO: 66412 - DNA, 28 bp, Artificial Sequence
  Synthetic
ttgttcacuggaaattacttctuaggca

SEQ ID NO: 66413 - DNA, 28 bp, Artificial Sequence
  Synthetic
ggacgaagcccuttatagttcaaaaaut

SEQ ID NO: 66414 - DNA, 21 bp, Artificial Sequence
  Synthetic
agtgtcaugccactguaagca

SEQ ID NO: 66415 - DNA, 28 bp, Artificial Sequence
  Synthetic
acagttccaatcuttcacatcacaguaa

SEQ ID NO: 66416 - DNA, 19 bp, Artificial Sequence
  Synthetic
cgctggugaagtuggcaaa

SEQ ID NO: 66417 - DNA, 27 bp, Artificial Sequence
  Synthetic
agtaatttggcucattctctccaucag

SEQ ID NO: 66418 - DNA, 26 bp, Artificial Sequence
  Synthetic
ctctctctgctauattctccctccut

SEQ ID NO: 66419 - DNA, 21 bp, Artificial Sequence
  Synthetic
cacuaggaccagauggaccag

SEQ ID NO: 66420 - DNA, 22 bp, Artificial Sequence
  Synthetic
cttccaggcccutggtgatuaa

SEQ ID NO: 66421 - DNA, 22 bp, Artificial Sequence
  Synthetic
ccaacugcacctacttcuccag

SEQ ID NO: 66422 - DNA, 23 bp, Artificial Sequence
  Synthetic
gggaaggtuagcattccaucgaa

SEQ ID NO: 66423 - DNA, 28 bp, Artificial Sequence
  Synthetic
cacacaatgaaaucctgctcagtttuat

SEQ ID NO: 66424 - DNA, 27 bp, Artificial Sequence
  Synthetic
gcagcagattuagcatgatactuacac

SEQ ID NO: 66425 - DNA, 28 bp, Artificial Sequence
  Synthetic
gctggtggtauggaaataatgtgttcut

SEQ ID NO: 66426 - DNA, 20 bp, Artificial Sequence
  Synthetic
ccgaggugccctaguagact

SEQ ID NO: 66427 - DNA, 28 bp, Artificial Sequence
  Synthetic
aggtgaacgattutgtgagggataaaut

SEQ ID NO: 66428 - DNA, 21 bp, Artificial Sequence
  Synthetic
acaccacaauactugcaggct

SEQ ID NO: 66429 - DNA, 25 bp, Artificial Sequence
  Synthetic
aatttatttgaggcugctggaggua

SEQ ID NO: 66430 - DNA, 28 bp, Artificial Sequence
  Synthetic
aatgtttctccugagcaagtaacugaat

SEQ ID NO: 66431 - DNA, 27 bp, Artificial Sequence
  Synthetic
acgggaaagtcutacaggtagataugt

SEQ ID NO: 66432 - DNA, 27 bp, Artificial Sequence
  Synthetic
gatggttgccuaaattttcttcugacc

SEQ ID NO: 66433 - DNA, 28 bp, Artificial Sequence
  Synthetic
gaatatcctgtucaggaatgtgactuct

SEQ ID NO: 66434 - DNA, 28 bp, Artificial Sequence
  Synthetic
gtttatggcauggtacctatatgucaca

SEQ ID NO: 66435 - DNA, 27 bp, Artificial Sequence
  Synthetic
ctccactgtugcaaagttattgaaucc

SEQ ID NO: 66436 - DNA, 24 bp, Artificial Sequence
  Synthetic
gtatatgcccuttgaacacugcac

SEQ ID NO: 66437 - DNA, 26 bp, Artificial Sequence
  Synthetic
aaatgtaacacugctccctctttuca

SEQ ID NO: 66438 - DNA, 22 bp, Artificial Sequence
  Synthetic
gtgtggutttgagcaugggaat

SEQ ID NO: 66439 - DNA, 22 bp, Artificial Sequence
  Synthetic
cagcaaaguaggtggaggugac

SEQ ID NO: 66440 - DNA, 20 bp, Artificial Sequence
  Synthetic
gggtggucacagcactguag

SEQ ID NO: 66441 - DNA, 21 bp, Artificial Sequence
  Synthetic
tgtccccacutctcugagcat

SEQ ID NO: 66442 - DNA, 19 bp, Artificial Sequence
  Synthetic
ccagcaugcaccagtgugt

SEQ ID NO: 66443 - DNA, 18 bp, Artificial Sequence
  Synthetic
ggucccaagggagggugt

SEQ ID NO: 66444 - DNA, 26 bp, Artificial Sequence
  Synthetic
ggtgccactuaccataggtgattuat

SEQ ID NO: 66445 - DNA, 29 bp, Artificial Sequence
  Synthetic
aagctcttctagcauatattctaggcuca

SEQ ID NO: 66446 - DNA, 22 bp, Artificial Sequence
  Synthetic
ctgatttgggugtgctgacuct

SEQ ID NO: 66447 - DNA, 20 bp, Artificial Sequence
  Synthetic
ctgtgcccguagtgagauga

SEQ ID NO: 66448 - DNA, 19 bp, Artificial Sequence
  Synthetic
ccagctgguacccaaggut

SEQ ID NO: 66449 - DNA, 18 bp, Artificial Sequence
  Synthetic
gaacgcccutcacugcac

SEQ ID NO: 66450 - DNA, 29 bp, Artificial Sequence
  Synthetic
cutggaaataaaguggaacgaaaagaaga

SEQ ID NO: 66451 - DNA, 28 bp, Artificial Sequence
  Synthetic
gtgcttcctcuttatttagtaccucagt

SEQ ID NO: 66452 - DNA, 21 bp, Artificial Sequence
  Synthetic
agagcauagcugagagcagga

SEQ ID NO: 66453 - DNA, 27 bp, Artificial Sequence
  Synthetic
gtggattgcutgtttacttcaucaagt

SEQ ID NO: 66454 - DNA, 27 bp, Artificial Sequence
  Synthetic
ccaatgaatcaguccgtaccaagauac

SEQ ID NO: 66455 - DNA, 22 bp, Artificial Sequence
  Synthetic
gagtgccugctggattacucat

SEQ ID NO: 66456 - DNA, 23 bp, Artificial Sequence
  Synthetic
gacugataccuggccaacaacat

SEQ ID NO: 66457 - DNA, 21 bp, Artificial Sequence
  Synthetic
caatgcagagguaggctcugt

SEQ ID NO: 66458 - DNA, 21 bp, Artificial Sequence
  Synthetic
gctcuacagtgcagugaagga

SEQ ID NO: 66459 - DNA, 28 bp, Artificial Sequence
  Synthetic
ccagttgggaautctaactactgtuaca

SEQ ID NO: 66460 - DNA, 22 bp, Artificial Sequence
  Synthetic
gctactgacucatgcccttuct

SEQ ID NO: 66461 - DNA, 21 bp, Artificial Sequence
  Synthetic
ggaaaggutcagggauccaca

SEQ ID NO: 66462 - DNA, 24 bp, Artificial Sequence
  Synthetic
agactcaaauggaactgcuccaag

SEQ ID NO: 66463 - DNA, 20 bp, Artificial Sequence
  Synthetic
cagctgucaacacgugcaat

SEQ ID NO: 66464 - DNA, 24 bp, Artificial Sequence
  Synthetic
tttctattcacutgggtgtuggct

SEQ ID NO: 66465 - DNA, 28 bp, Artificial Sequence
  Synthetic
accatggtgauggaaataaaagaugaaa

SEQ ID NO: 66466 - DNA, 28 bp, Artificial Sequence
  Synthetic
catatactgaugaagaaacaaggugcaa

SEQ ID NO: 66467 - DNA, 27 bp, Artificial Sequence
  Synthetic
tgtcaaatggaaggcutcttgtcttua

SEQ ID NO: 66468 - DNA, 23 bp, Artificial Sequence
  Synthetic
gctccugaaagtactcugaaggt

SEQ ID NO: 66469 - DNA, 29 bp, Artificial Sequence
  Synthetic
ggcaggaagaaguatctcgtatcauaaat

SEQ ID NO: 66470 - DNA, 27 bp, Artificial Sequence
  Synthetic
catctaaatcctguagctctggctuag

SEQ ID NO: 66471 - DNA, 24 bp, Artificial Sequence
  Synthetic
tgctctgctutaagtttgggaugt

SEQ ID NO: 66472 - DNA, 21 bp, Artificial Sequence
  Synthetic
ccatgucagaaaagcgcauct

SEQ ID NO: 66473 - DNA, 24 bp, Artificial Sequence
  Synthetic
gctaatggcuctttttcccttugt

SEQ ID NO: 66474 - DNA, 21 bp, Artificial Sequence
  Synthetic
gcctcucccatctgcuaagga

SEQ ID NO: 66475 - DNA, 28 bp, Artificial Sequence
  Synthetic
ctgatgatgatuttgctctttcttugct

SEQ ID NO: 66476 - DNA, 24 bp, Artificial Sequence
  Synthetic
gggataagcuacttttgcuaccac

SEQ ID NO: 66477 - DNA, 28 bp, Artificial Sequence
  Synthetic
tgtggagttuagagttgatgtttuccat

SEQ ID NO: 66478 - DNA, 27 bp, Artificial Sequence
  Synthetic
tgcccaaatgutttagacagatuacca

SEQ ID NO: 66479 - DNA, 24 bp, Artificial Sequence
  Synthetic
ctcccactaautgtcctccaucac

SEQ ID NO: 66480 - DNA, 21 bp, Artificial Sequence
  Synthetic
gaactcgtuccagcacucgat

SEQ ID NO: 66481 - DNA, 23 bp, Artificial Sequence
  Synthetic
ccatcatguacggcaagttcucc

SEQ ID NO: 66482 - DNA, 24 bp, Artificial Sequence
  Synthetic
aagccaaggauggtgttaugaact

SEQ ID NO: 66483 - DNA, 26 bp, Artificial Sequence
  Synthetic
gcctgtcttugtgtgaatcttttucc

SEQ ID NO: 66484 - DNA, 25 bp, Artificial Sequence
  Synthetic
gagaaacacuagacctauggcaaca

SEQ ID NO: 66485 - DNA, 25 bp, Artificial Sequence
  Synthetic
ccctcaaaagaguaatgacctugct

SEQ ID NO: 66486 - DNA, 18 bp, Artificial Sequence
  Synthetic
cggagagcaggcuccaut

SEQ ID NO: 66487 - DNA, 18 bp, Artificial Sequence
  Synthetic
cuccucggagagcagcag

SEQ ID NO: 66488 - DNA, 21 bp, Artificial Sequence
  Synthetic
gagaggcugtccatgtugagg

SEQ ID NO: 66489 - DNA, 20 bp, Artificial Sequence
  Synthetic
caacuccacagggccaugat

SEQ ID NO: 66490 - DNA, 21 bp, Artificial Sequence
  Synthetic
cgutgggaacuccaggaagag

SEQ ID NO: 66491 - DNA, 27 bp, Artificial Sequence
  Synthetic
ggagtcattgucatcaccttattcuca

SEQ ID NO: 66492 - DNA, 20 bp, Artificial Sequence
  Synthetic
gctccucctcgtcugaaggt

SEQ ID NO: 66493 - DNA, 24 bp, Artificial Sequence
  Synthetic
cacaattctcuagctccacacuga

SEQ ID NO: 66494 - DNA, 22 bp, Artificial Sequence
  Synthetic
ccgtctcugaaatccaggugaa

SEQ ID NO: 66495 - DNA, 27 bp, Artificial Sequence
  Synthetic
ctgcatauacaagaaatgctugaagcc

SEQ ID NO: 66496 - DNA, 24 bp, Artificial Sequence
  Synthetic
caacctcatautgccactcttucc

SEQ ID NO: 66497 - DNA, 24 bp, Artificial Sequence
  Synthetic
atccacaaaacccaguatgcugaa

SEQ ID NO: 66498 - DNA, 22 bp, Artificial Sequence
  Synthetic
gggtcutgttgtgaucccagaa

SEQ ID NO: 66499 - DNA, 21 bp, Artificial Sequence
  Synthetic
aggcauacaaggcagaugcag

SEQ ID NO: 66500 - DNA, 22 bp, Artificial Sequence
  Synthetic
ccgcaaacacugacagcuaaga

SEQ ID NO: 66501 - DNA, 20 bp, Artificial Sequence
  Synthetic
aggaggcuaagtggcctuga

SEQ ID NO: 66502 - DNA, 24 bp, Artificial Sequence
  Synthetic
ggtttgcatucttgcttctgucat

SEQ ID NO: 66503 - DNA, 23 bp, Artificial Sequence
  Synthetic
ccctguggaagaaaguacagacc

SEQ ID NO: 66504 - DNA, 22 bp, Artificial Sequence
  Synthetic
ccagacgtugaaacggaaagug

SEQ ID NO: 66505 - DNA, 22 bp, Artificial Sequence
  Synthetic
ccaaacatcuctccttcugcct

SEQ ID NO: 66506 - DNA, 20 bp, Artificial Sequence
  Synthetic
gggacatgugggagctuacc

SEQ ID NO: 66507 - DNA, 20 bp, Artificial Sequence
  Synthetic
ggactgucagcacagagguc

SEQ ID NO: 66508 - DNA, 22 bp, Artificial Sequence
  Synthetic
aggacgccuttgctgtgaauat

SEQ ID NO: 66509 - DNA, 23 bp, Artificial Sequence
  Synthetic
gaaaagagaaggacggutcuggt

SEQ ID NO: 66510 - DNA, 21 bp, Artificial Sequence
  Synthetic
ggaucccttctgucggaacct

SEQ ID NO: 66511 - DNA, 22 bp, Artificial Sequence
  Synthetic
cacccctuaaagaacccagcut

SEQ ID NO: 66512 - DNA, 18 bp, Artificial Sequence
  Synthetic
ggcacagcagaucuccca

SEQ ID NO: 66513 - DNA, 17 bp, Artificial Sequence
  Synthetic
cucacccggacgaggut

SEQ ID NO: 66514 - DNA, 20 bp, Artificial Sequence
  Synthetic
gtggttcugccggtgtgtua

SEQ ID NO: 66515 - DNA, 28 bp, Artificial Sequence
  Synthetic
tcaagagtaggcuttttgtctcagatug

SEQ ID NO: 66516 - DNA, 20 bp, Artificial Sequence
  Synthetic
ggaaggcgacagugccuaag

SEQ ID NO: 66517 - DNA, 27 bp, Artificial Sequence
  Synthetic
tcaggagcugatcaacaaaugaaaaga

SEQ ID NO: 66518 - DNA, 18 bp, Artificial Sequence
  Synthetic
gacgcgugtggcctcuaa

SEQ ID NO: 66519 - DNA, 19 bp, Artificial Sequence
  Synthetic
cucggcgagugaggagaag

SEQ ID NO: 66520 - DNA, 21 bp, Artificial Sequence
  Synthetic
cccacaautgcatgucaccaa

SEQ ID NO: 66521 - DNA, 26 bp, Artificial Sequence
  Synthetic
ggaaggacctcuatgctaacaatguc

SEQ ID NO: 66522 - DNA, 22 bp, Artificial Sequence
  Synthetic
ggtacatcuccattccggugat

SEQ ID NO: 66523 - DNA, 21 bp, Artificial Sequence
  Synthetic
gtcatcccccuggatcttgug

SEQ ID NO: 66524 - DNA, 20 bp, Artificial Sequence
  Synthetic
agcccgacacugtgtgttut

SEQ ID NO: 66525 - DNA, 20 bp, Artificial Sequence
  Synthetic
ccatgccuggaagttuccga

SEQ ID NO: 66526 - DNA, 21 bp, Artificial Sequence
  Synthetic
ccacatccagauccaccaugt

SEQ ID NO: 66527 - DNA, 21 bp, Artificial Sequence
  Synthetic
cctaaccccugtgcctttcuc

SEQ ID NO: 66528 - DNA, 24 bp, Artificial Sequence
  Synthetic
gtactctguacaagcacctctguc

SEQ ID NO: 66529 - DNA, 28 bp, Artificial Sequence
  Synthetic
gttctggcacaauatggaaaatcaacut

SEQ ID NO: 66530 - DNA, 26 bp, Artificial Sequence
  Synthetic
acactagtctttuccaatccctcuca

SEQ ID NO: 66531 - DNA, 22 bp, Artificial Sequence
  Synthetic
cgaggcuagaccttctctgucc

SEQ ID NO: 66532 - DNA, 22 bp, Artificial Sequence
  Synthetic
cctcggcugtacaccacatuaa

SEQ ID NO: 66533 - DNA, 24 bp, Artificial Sequence
  Synthetic
agcttggaguctgaaaagcaucaa

SEQ ID NO: 66534 - DNA, 20 bp, Artificial Sequence
  Synthetic
caggcccugccatattgugt

SEQ ID NO: 66535 - DNA, 26 bp, Artificial Sequence
  Synthetic
aatccuggagattcctaucagaggag

SEQ ID NO: 66536 - DNA, 21 bp, Artificial Sequence
  Synthetic
gtccaagcccuaaagccucat

SEQ ID NO: 66537 - DNA, 22 bp, Artificial Sequence
  Synthetic
cgggaggagaccutcaaauacc

SEQ ID NO: 66538 - DNA, 21 bp, Artificial Sequence
  Synthetic
gtgatgagggugctgtgcuat

SEQ ID NO: 66539 - DNA, 25 bp, Artificial Sequence
  Synthetic
gcggaaaauagggaggaaguaaagg

SEQ ID NO: 66540 - DNA, 19 bp, Artificial Sequence
  Synthetic
gagccggcuaacctacugg

SEQ ID NO: 66541 - DNA, 19 bp, Artificial Sequence
  Synthetic
aggtacgacuccgccauga

SEQ ID NO: 66542 - DNA, 17 bp, Artificial Sequence
  Synthetic
ccagccugacccucgaa

SEQ ID NO: 66543 - DNA, 21 bp, Artificial Sequence
  Synthetic
acagagaaggcautgcaggug

SEQ ID NO: 66544 - DNA, 21 bp, Artificial Sequence
  Synthetic
gcccuggtaccuggagaagag

SEQ ID NO: 66545 - DNA, 24 bp, Artificial Sequence
  Synthetic
ttctagccucagttucccaaaagg

SEQ ID NO: 66546 - DNA, 22 bp, Artificial Sequence
  Synthetic
ggagaaguaaggccaggtgtug

SEQ ID NO: 66547 - DNA, 25 bp, Artificial Sequence
  Synthetic
cacagtagttuggtccttgagttug

SEQ ID NO: 66548 - DNA, 27 bp, Artificial Sequence
  Synthetic
tttctatcctgugacaagtctuaggga

SEQ ID NO: 66549 - DNA, 20 bp, Artificial Sequence
  Synthetic
tgatcaggcugcttgtgugt

SEQ ID NO: 66550 - DNA, 22 bp, Artificial Sequence
  Synthetic
gatgaggaggaccuctcugagt

SEQ ID NO: 66551 - DNA, 21 bp, Artificial Sequence
  Synthetic
ccagcagugacctagugacag

SEQ ID NO: 66552 - DNA, 20 bp, Artificial Sequence
  Synthetic
ccaatcatgutgcccgugac

SEQ ID NO: 66553 - DNA, 21 bp, Artificial Sequence
  Synthetic
gcggccauaccttgucaaaca

SEQ ID NO: 66554 - DNA, 25 bp, Artificial Sequence
  Synthetic
atggtgatcguaacaatggtgguaa

SEQ ID NO: 66555 - DNA, 17 bp, Artificial Sequence
  Synthetic
ggacggccccuaccauc

SEQ ID NO: 66556 - DNA, 29 bp, Artificial Sequence
  Synthetic
ggtaatatatgccutttgagctgtctuga

SEQ ID NO: 66557 - DNA, 24 bp, Artificial Sequence
  Synthetic
gcactagaattugctggctcaugt

SEQ ID NO: 66558 - DNA, 20 bp, Artificial Sequence
  Synthetic
agatgtguaagcgcagccut

SEQ ID NO: 66559 - DNA, 27 bp, Artificial Sequence
  Synthetic
acagaaaagcugcactttaggauaaca

SEQ ID NO: 66560 - DNA, 28 bp, Artificial Sequence
  Synthetic
ccatatgtcatuttcatttcagcuccct

SEQ ID NO: 66561 - DNA, 24 bp, Artificial Sequence
  Synthetic
tgagaatacucagggcaagacuct

SEQ ID NO: 66562 - DNA, 20 bp, Artificial Sequence
  Synthetic
gttccccuctcucagcgaag

SEQ ID NO: 66563 - DNA, 27 bp, Artificial Sequence
  Synthetic
acagctgtcagcuttaataagccatua

SEQ ID NO: 66564 - DNA, 23 bp, Artificial Sequence
  Synthetic
gcataggcucagcatacuacaca

SEQ ID NO: 66565 - DNA, 29 bp, Artificial Sequence
  Synthetic
tgagatacacaguctacctgguaagaaaa

SEQ ID NO: 66566 - DNA, 22 bp, Artificial Sequence
  Synthetic
ggctgtacugttcttccuccaa

SEQ ID NO: 66567 - DNA, 21 bp, Artificial Sequence
  Synthetic
gctcctuacacaggcctctuc

SEQ ID NO: 66568 - DNA, 28 bp, Artificial Sequence
  Synthetic
agactcttgtttcuccttatctccauct

SEQ ID NO: 66569 - DNA, 23 bp, Artificial Sequence
  Synthetic
tgatccaauccaggtagccttug

SEQ ID NO: 66570 - DNA, 22 bp, Artificial Sequence
  Synthetic
gcctggacgaugattctgaugg

SEQ ID NO: 66571 - DNA, 22 bp, Artificial Sequence
  Synthetic
aggaggaggaaugaggaggtut

SEQ ID NO: 66572 - DNA, 22 bp, Artificial Sequence
  Synthetic
ggtcttcucacagcacctcaut

SEQ ID NO: 66573 - DNA, 23 bp, Artificial Sequence
  Synthetic
agctatacccuctctcagctugg

SEQ ID NO: 66574 - DNA, 22 bp, Artificial Sequence
  Synthetic
ggcaugaagaaggtccucaggt

SEQ ID NO: 66575 - DNA, 20 bp, Artificial Sequence
  Synthetic
ggccgucgctttggtaguag

SEQ ID NO: 66576 - DNA, 22 bp, Artificial Sequence
  Synthetic
gcagcaggcgucttctctatut

SEQ ID NO: 66577 - DNA, 28 bp, Artificial Sequence
  Synthetic
gtgtggttaacaucgtgtttttgtttuc

SEQ ID NO: 66578 - DNA, 26 bp, Artificial Sequence
  Synthetic
tgcaacauggaaaatacacattugct

SEQ ID NO: 66579 - DNA, 26 bp, Artificial Sequence
  Synthetic
cgccaattcaguactttattgcuaca

SEQ ID NO: 66580 - DNA, 28 bp, Artificial Sequence
  Synthetic
acgttgtagaauatgtcaaaaucgagca

SEQ ID NO: 66581 - DNA, 26 bp, Artificial Sequence
  Synthetic
ctgttttcatgguaactctgtgctut

SEQ ID NO: 66582 - DNA, 18 bp, Artificial Sequence
  Synthetic
gcagcggacgutcaugct

SEQ ID NO: 66583 - DNA, 28 bp, Artificial Sequence
  Synthetic
ttctatctgtttuccttcctggacatug

SEQ ID NO: 66584 - DNA, 26 bp, Artificial Sequence
  Synthetic
cagtggtccccaaaauactaacagut

SEQ ID NO: 66585 - DNA, 28 bp, Artificial Sequence
  Synthetic
acatttagucgacagaaactagtcttut

SEQ ID NO: 66586 - DNA, 26 bp, Artificial Sequence
  Synthetic
cagatttugacagtgaaaguggaagg

SEQ ID NO: 66587 - DNA, 28 bp, Artificial Sequence
  Synthetic
cttggaaccagcaaauattcttctccua

SEQ ID NO: 66588 - DNA, 26 bp, Artificial Sequence
  Synthetic
gcttggacagcutaatttaagtgcut

SEQ ID NO: 66589 - DNA, 28 bp, Artificial Sequence
  Synthetic
gtcttaacagccugagtgatgtatgtut

SEQ ID NO: 66590 - DNA, 23 bp, Artificial Sequence
  Synthetic
cctaagtguatgcctcctuggat

SEQ ID NO: 66591 - DNA, 28 bp, Artificial Sequence
  Synthetic
cttcaaacccuctactattctaccucca

SEQ ID NO: 66592 - DNA, 21 bp, Artificial Sequence
  Synthetic
cacaggcagcucttctctcug

SEQ ID NO: 66593 - DNA, 21 bp, Artificial Sequence
  Synthetic
aggcucccagaacatcaccua

SEQ ID NO: 66594 - DNA, 21 bp, Artificial Sequence
  Synthetic
ggactcagugcaggacactug

SEQ ID NO: 66595 - DNA, 21 bp, Artificial Sequence
  Synthetic
ccgcaguctctggacuaagga

SEQ ID NO: 66596 - DNA, 20 bp, Artificial Sequence
  Synthetic
ctgtctccucgagcacctut

SEQ ID NO: 66597 - DNA, 22 bp, Artificial Sequence
  Synthetic
cctggaugaggaagggugagat

SEQ ID NO: 66598 - DNA, 18 bp, Artificial Sequence
  Synthetic
catgagggccugcacuga

SEQ ID NO: 66599 - DNA, 21 bp, Artificial Sequence
  Synthetic
caccttctuaccccagctcut

SEQ ID NO: 66600 - DNA, 21 bp, Artificial Sequence
  Synthetic
cagctttggugagaggctgua

SEQ ID NO: 66601 - DNA, 21 bp, Artificial Sequence
  Synthetic
gttacccaggcuccaugaaca

SEQ ID NO: 66602 - DNA, 20 bp, Artificial Sequence
  Synthetic
ccugagggtcugaagccaag

SEQ ID NO: 66603 - DNA, 22 bp, Artificial Sequence
  Synthetic
catcgctgaggucacatgguat

SEQ ID NO: 66604 - DNA, 21 bp, Artificial Sequence
  Synthetic
gcccacaacugucagagcaaa

SEQ ID NO: 66605 - DNA, 25 bp, Artificial Sequence
  Synthetic
tcttcatttcaucctccctgtcuct

SEQ ID NO: 66606 - DNA, 22 bp, Artificial Sequence
  Synthetic
ctgaggcaguctttcacgtcut

SEQ ID NO: 66607 - DNA, 23 bp, Artificial Sequence
  Synthetic
caggaugggcagaggtataauga

SEQ ID NO: 66608 - DNA, 26 bp, Artificial Sequence
  Synthetic
ccaaggacaaggccautaagaaatuc

SEQ ID NO: 66609 - DNA, 24 bp, Artificial Sequence
  Synthetic
gatactgggaucctcacacagtuc

SEQ ID NO: 66610 - DNA, 26 bp, Artificial Sequence
  Synthetic
aagatuccaaagcaagctatgaauga

SEQ ID NO: 66611 - DNA, 27 bp, Artificial Sequence
  Synthetic
ccaccaacucaggaatcctactaugat

SEQ ID NO: 66612 - DNA, 28 bp, Artificial Sequence
  Synthetic
aaataagagaaggcaaacugcataucct

SEQ ID NO: 66613 - DNA, 28 bp, Artificial Sequence
  Synthetic
catctctgcaaaugttagatacgguaca

SEQ ID NO: 66614 - DNA, 27 bp, Artificial Sequence
  Synthetic
tgttactattgucactcgaggattguc

SEQ ID NO: 66615 - DNA, 28 bp, Artificial Sequence
  Synthetic
gggtattucacatcttcataugccaagt

SEQ ID NO: 66616 - DNA, 22 bp, Artificial Sequence
  Synthetic
cacagaaggcaggacuctucat

SEQ ID NO: 66617 - DNA, 26 bp, Artificial Sequence
  Synthetic
gccttgaaaaaucaggtgtctcttut

SEQ ID NO: 66618 - DNA, 21 bp, Artificial Sequence
  Synthetic
ggctgattugggaactgcuga

SEQ ID NO: 66619 - DNA, 28 bp, Artificial Sequence
  Synthetic
cacatgtattatgcugtggagatacugt

SEQ ID NO: 66620 - DNA, 23 bp, Artificial Sequence
  Synthetic
tggtacagtugctgctgctatut

SEQ ID NO: 66621 - DNA, 28 bp, Artificial Sequence
  Synthetic
cttgtgctcauggcaaaaatgtatuact

SEQ ID NO: 66622 - DNA, 17 bp, Artificial Sequence
  Synthetic
ccgggcutgcggacaut

SEQ ID NO: 66623 - DNA, 17 bp, Artificial Sequence
  Synthetic
tgcgagccggugtaugg

SEQ ID NO: 66624 - DNA, 21 bp, Artificial Sequence
  Synthetic
ggagctgucacccacaucaag

SEQ ID NO: 66625 - DNA, 27 bp, Artificial Sequence
  Synthetic
gcagcagacttugtggtcactaaaaug

SEQ ID NO: 66626 - DNA, 25 bp, Artificial Sequence
  Synthetic
atgtaagctuaaacagcgtggtcua

SEQ ID NO: 66627 - DNA, 29 bp, Artificial Sequence
  Synthetic
accaatagagcacutgcatttaaauacct

SEQ ID NO: 66628 - DNA, 27 bp, Artificial Sequence
  Synthetic
gtcaagggaacuttttgttttagcugt

SEQ ID NO: 66629 - DNA, 26 bp, Artificial Sequence
  Synthetic
aggagcauagccaaatttaccatugt

SEQ ID NO: 66630 - DNA, 33 bp, Artificial Sequence
  Synthetic
aatacagttttaacauagtatccagtgtgugaa

SEQ ID NO: 66631 - DNA, 28 bp, Artificial Sequence
  Synthetic
caactgctgcaauaaagatacagatucc

SEQ ID NO: 66632 - DNA, 28 bp, Artificial Sequence
  Synthetic
agaaggcaactugacaagagaaatgaua

SEQ ID NO: 66633 - DNA, 28 bp, Artificial Sequence
  Synthetic
aggtagatgtuaagaaacacctcucact

SEQ ID NO: 66634 - DNA, 28 bp, Artificial Sequence
  Synthetic
tgctcatctcugcaaaattgtatauggt

SEQ ID NO: 66635 - DNA, 29 bp, Artificial Sequence
  Synthetic
aggtgtttgaauaactgcatttggaaaut

SEQ ID NO: 66636 - DNA, 26 bp, Artificial Sequence
  Synthetic
cttgtaagaguccagacattgaucca

SEQ ID NO: 66637 - DNA, 28 bp, Artificial Sequence
  Synthetic
aggtttguagaatgacttugaacgaagt

SEQ ID NO: 66638 - DNA, 24 bp, Artificial Sequence
  Synthetic
gtggaagugcaacatattggucaa

SEQ ID NO: 66639 - DNA, 28 bp, Artificial Sequence
  Synthetic
cggagatgttccuttcaggactatuaaa

SEQ ID NO: 66640 - DNA, 22 bp, Artificial Sequence
  Synthetic
gcctcagtuacctcagggcuat

SEQ ID NO: 66641 - DNA, 22 bp, Artificial Sequence
  Synthetic
gaaggaaggcuacctgtcacuc

SEQ ID NO: 66642 - DNA, 22 bp, Artificial Sequence
  Synthetic
cttcutctcttgcuccagggat

SEQ ID NO: 66643 - DNA, 26 bp, Artificial Sequence
  Synthetic
cccctatauctaggcaatcucacagt

SEQ ID NO: 66644 - DNA, 22 bp, Artificial Sequence
  Synthetic
gcagaatcccugctcctctgua

SEQ ID NO: 66645 - DNA, 22 bp, Artificial Sequence
  Synthetic
cttctcccugatccactaugcc

SEQ ID NO: 66646 - DNA, 21 bp, Artificial Sequence
  Synthetic
gagaugactgcugagcagaca

SEQ ID NO: 66647 - DNA, 23 bp, Artificial Sequence
  Synthetic
gccatcaugcacttuggaaacat

SEQ ID NO: 66648 - DNA, 29 bp, Artificial Sequence
  Synthetic
ccacactgttugtagtcatctttaucaca

SEQ ID NO: 66649 - DNA, 22 bp, Artificial Sequence
  Synthetic
gcagccaccuggtctatuacag

SEQ ID NO: 66650 - DNA, 21 bp, Artificial Sequence
  Synthetic
ccagcccautccagttaggua

SEQ ID NO: 66651 - DNA, 21 bp, Artificial Sequence
  Synthetic
gcagctacautcctgctccug

SEQ ID NO: 66652 - DNA, 21 bp, Artificial Sequence
  Synthetic
ggcugcaagaggacuaagcat

SEQ ID NO: 66653 - DNA, 20 bp, Artificial Sequence
  Synthetic
caagcaggcuctccctctuc

SEQ ID NO: 66654 - DNA, 18 bp, Artificial Sequence
  Synthetic
gtcagccugggtcagcuc

SEQ ID NO: 66655 - DNA, 21 bp, Artificial Sequence
  Synthetic
tgccttguggttctcctugac

SEQ ID NO: 66656 - DNA, 23 bp, Artificial Sequence
  Synthetic
actaacttcugacccaccucgat

SEQ ID NO: 66657 - DNA, 26 bp, Artificial Sequence
  Synthetic
tgaaaaacatctaugctccccttcug

SEQ ID NO: 66658 - DNA, 21 bp, Artificial Sequence
  Synthetic
gcgcacgaauggctaactcut

SEQ ID NO: 66659 - DNA, 23 bp, Artificial Sequence
  Synthetic
gtgccctugagtttctttugcag

SEQ ID NO: 66660 - DNA, 21 bp, Artificial Sequence
  Synthetic
ctcaggugggaagatggaugt

SEQ ID NO: 66661 - DNA, 24 bp, Artificial Sequence
  Synthetic
gagtctugggagaagugaagcaaa

SEQ ID NO: 66662 - DNA, 22 bp, Artificial Sequence
  Synthetic
gaggutcatggacugaggcaaa

SEQ ID NO: 66663 - DNA, 21 bp, Artificial Sequence
  Synthetic
gagaagccauacctgugggat

SEQ ID NO: 66664 - DNA, 22 bp, Artificial Sequence
  Synthetic
gctgatgucaggagagcatuct

SEQ ID NO: 66665 - DNA, 20 bp, Artificial Sequence
  Synthetic
gaggcagagaccacuggaug

SEQ ID NO: 66666 - DNA, 20 bp, Artificial Sequence
  Synthetic
gccgagcaucagcagttuag

SEQ ID NO: 66667 - DNA, 21 bp, Artificial Sequence
  Synthetic
gcaccaagcutaccctgtcut

SEQ ID NO: 66668 - DNA, 18 bp, Artificial Sequence
  Synthetic
gccatggacuccccugag

SEQ ID NO: 66669 - DNA, 17 bp, Artificial Sequence
  Synthetic
cctgccaccugcaucca

SEQ ID NO: 66670 - DNA, 25 bp, Artificial Sequence
  Synthetic
gactctugaacccaaactcttucca

SEQ ID NO: 66671 - DNA, 21 bp, Artificial Sequence
  Synthetic
gcttcccuctgcactacucag

SEQ ID NO: 66672 - DNA, 20 bp, Artificial Sequence
  Synthetic
cagugccacttcuccaggac

SEQ ID NO: 66673 - DNA, 21 bp, Artificial Sequence
  Synthetic
gugggtgacuggcagaaagat

SEQ ID NO: 66674 - DNA, 17 bp, Artificial Sequence
  Synthetic
gagggugcctgcugaca

SEQ ID NO: 66675 - DNA, 20 bp, Artificial Sequence
  Synthetic
agaggagcuggacttgcuca

SEQ ID NO: 66676 - DNA, 17 bp, Artificial Sequence
  Synthetic
ccuggcgugaccaccaa

SEQ ID NO: 66677 - DNA, 21 bp, Artificial Sequence
  Synthetic
tgagctcacuatcagguggca

SEQ ID NO: 66678 - DNA, 20 bp, Artificial Sequence
  Synthetic
ggctctcuaccagggtguca

SEQ ID NO: 66679 - DNA, 18 bp, Artificial Sequence
  Synthetic
cgtgagugttgcguggct

SEQ ID NO: 66680 - DNA, 18 bp, Artificial Sequence
  Synthetic
cggagtuggcggagtugg

SEQ ID NO: 66681 - DNA, 21 bp, Artificial Sequence
  Synthetic
ctggtggacuccaatccctut

SEQ ID NO: 66682 - DNA, 20 bp, Artificial Sequence
  Synthetic
gctgcacaaacugcctcuct

SEQ ID NO: 66683 - DNA, 23 bp, Artificial Sequence
  Synthetic
actacctctucgactggacctuc

SEQ ID NO: 66684 - DNA, 22 bp, Artificial Sequence
  Synthetic
caggtacacaugctccactgut

SEQ ID NO: 66685 - DNA, 20 bp, Artificial Sequence
  Synthetic
ggactcagcguggacaugag

SEQ ID NO: 66686 - DNA, 27 bp, Artificial Sequence
  Synthetic
gagatttgttcuggaagaaaccuaaga

SEQ ID NO: 66687 - DNA, 23 bp, Artificial Sequence
  Synthetic
gcaaagccugaactgtgtttucc

SEQ ID NO: 66688 - DNA, 22 bp, Artificial Sequence
  Synthetic
cutacacagugggaacacccat

SEQ ID NO: 66689 - DNA, 23 bp, Artificial Sequence
  Synthetic
ggttcagauggtcaccaatguca

SEQ ID NO: 66690 - DNA, 25 bp, Artificial Sequence
  Synthetic
tgtctgttgcucatgtgtttgttuc

SEQ ID NO: 66691 - DNA, 19 bp, Artificial Sequence
  Synthetic
gccagcauctcguggacaa

SEQ ID NO: 66692 - DNA, 20 bp, Artificial Sequence
  Synthetic
acaggaaucgcaccagctut

SEQ ID NO: 66693 - DNA, 22 bp, Artificial Sequence
  Synthetic
gagttttggtucctgaccccut

SEQ ID NO: 66694 - DNA, 20 bp, Artificial Sequence
  Synthetic
ccaaugaccagactgugcgt

SEQ ID NO: 66695 - DNA, 28 bp, Artificial Sequence
  Synthetic
cctgaaacagggaautagcaaagttauc

SEQ ID NO: 66696 - DNA, 27 bp, Artificial Sequence
  Synthetic
tccaggcttacgugtgagttttaaaua

SEQ ID NO: 66697 - DNA, 22 bp, Artificial Sequence
  Synthetic
agugcauccagaggaaaagagg

SEQ ID NO: 66698 - DNA, 21 bp, Artificial Sequence
  Synthetic
gtggcagucctttaugagcca

SEQ ID NO: 66699 - DNA, 28 bp, Artificial Sequence
  Synthetic
ctctttacaaagutgacgtgtcattuct

SEQ ID NO: 66700 - DNA, 23 bp, Artificial Sequence
  Synthetic
cugggcaaugaggaacaagaaga

SEQ ID NO: 66701 - DNA, 20 bp, Artificial Sequence
  Synthetic
aacatcatcgugccctgugt

SEQ ID NO: 66702 - DNA, 23 bp, Artificial Sequence
  Synthetic
gttgagucggtaatccugccaat

SEQ ID NO: 66703 - DNA, 24 bp, Artificial Sequence
  Synthetic
cttcaatcauccccatctcccauc

SEQ ID NO: 66704 - DNA, 21 bp, Artificial Sequence
  Synthetic
ccacgcccugaatatcccaut

SEQ ID NO: 66705 - DNA, 22 bp, Artificial Sequence
  Synthetic
ctaagcucccccaacccaaaut

SEQ ID NO: 66706 - DNA, 24 bp, Artificial Sequence
  Synthetic
ccagcaugagaaaatgctctguga

SEQ ID NO: 66707 - DNA, 22 bp, Artificial Sequence
  Synthetic
aggcctuggagatgctttugaa

SEQ ID NO: 66708 - DNA, 20 bp, Artificial Sequence
  Synthetic
ggcataacugcaccctuggt

SEQ ID NO: 66709 - DNA, 25 bp, Artificial Sequence
  Synthetic
cctcttgctuctcttttcctaucct

SEQ ID NO: 66710 - DNA, 23 bp, Artificial Sequence
  Synthetic
tttccctacaguctagcagccua

SEQ ID NO: 66711 - DNA, 25 bp, Artificial Sequence
  Synthetic
cagacuccagagacggauagaaaac

SEQ ID NO: 66712 - DNA, 22 bp, Artificial Sequence
  Synthetic
caaagcccgaaccugtattguc

SEQ ID NO: 66713 - DNA, 23 bp, Artificial Sequence
  Synthetic
cugtcatugggaagaggaagcaa

SEQ ID NO: 66714 - DNA, 27 bp, Artificial Sequence
  Synthetic
ggaaaggacgtuatgtggagacattut

SEQ ID NO: 66715 - DNA, 22 bp, Artificial Sequence
  Synthetic
ggacaccagaggaugcgaatua

SEQ ID NO: 66716 - DNA, 24 bp, Artificial Sequence
  Synthetic
caccaacuacagcagctatuccaa

SEQ ID NO: 66717 - DNA, 23 bp, Artificial Sequence
  Synthetic
gaggaaaugtactugaggcggat

SEQ ID NO: 66718 - DNA, 28 bp, Artificial Sequence
  Synthetic
tgtcattttccutaggttcaaaacuggt

SEQ ID NO: 66719 - DNA, 20 bp, Artificial Sequence
  Synthetic
tgcggagacgutgtcguaag

SEQ ID NO: 66720 - DNA, 21 bp, Artificial Sequence
  Synthetic
gagttugacaggactcugcct

SEQ ID NO: 66721 - DNA, 19 bp, Artificial Sequence
  Synthetic
gatggcccutcgcttcuca

SEQ ID NO: 66722 - DNA, 23 bp, Artificial Sequence
  Synthetic
gggtagtcuccatccatguccat

SEQ ID NO: 66723 - DNA, 21 bp, Artificial Sequence
  Synthetic
gtagctugcagacccuaggac

SEQ ID NO: 66724 - DNA, 20 bp, Artificial Sequence
  Synthetic
ccgtgatgucgtccttguca

SEQ ID NO: 66725 - DNA, 23 bp, Artificial Sequence
  Synthetic
cctggagagugtgctgaagatuc

SEQ ID NO: 66726 - DNA, 23 bp, Artificial Sequence
  Synthetic
cacacgtucctctgcuaaaacct

SEQ ID NO: 66727 - DNA, 25 bp, Artificial Sequence
  Synthetic
cctggttctttucaaaggtggttuc

SEQ ID NO: 66728 - DNA, 22 bp, Artificial Sequence
  Synthetic
gagtgauggagagagggcacua

SEQ ID NO: 66729 - DNA, 19 bp, Artificial Sequence
  Synthetic
cguggcctacauggaccag

SEQ ID NO: 66730 - DNA, 20 bp, Artificial Sequence
  Synthetic
gtcttcctgcuccccagaug

SEQ ID NO: 66731 - DNA, 20 bp, Artificial Sequence
  Synthetic
tttcccuctgctccuaggct

SEQ ID NO: 66732 - DNA, 23 bp, Artificial Sequence
  Synthetic
aacccaggacaaaggugttagug

SEQ ID NO: 66733 - DNA, 25 bp, Artificial Sequence
  Synthetic
ttctcgctgacauctccatttcaut

SEQ ID NO: 66734 - DNA, 21 bp, Artificial Sequence
  Synthetic
cccagaucgggagaaugaact

SEQ ID NO: 66735 - DNA, 22 bp, Artificial Sequence
  Synthetic
cccttccttugtgggaggaauc

SEQ ID NO: 66736 - DNA, 21 bp, Artificial Sequence
  Synthetic
gaccauccgttuccggaagaa

SEQ ID NO: 66737 - DNA, 20 bp, Artificial Sequence
  Synthetic
catucacacgagccucacag

SEQ ID NO: 66738 - DNA, 20 bp, Artificial Sequence
  Synthetic
gggaaauacagggccucgaa

SEQ ID NO: 66739 - DNA, 20 bp, Artificial Sequence
  Synthetic
ctgccctgucaatgcaaguc

SEQ ID NO: 66740 - DNA, 21 bp, Artificial Sequence
  Synthetic
tgccattgaugccccagaaua

SEQ ID NO: 66741 - DNA, 21 bp, Artificial Sequence
  Synthetic
cgtcttcugcttcctcgucac

SEQ ID NO: 66742 - DNA, 23 bp, Artificial Sequence
  Synthetic
ctgcagagccagutcaataccua

SEQ ID NO: 66743 - DNA, 21 bp, Artificial Sequence
  Synthetic
ctgcaactccuccgtgaguat

SEQ ID NO: 66744 - DNA, 27 bp, Artificial Sequence
  Synthetic
tcctaatttctuacactgcctctccua

SEQ ID NO: 66745 - DNA, 19 bp, Artificial Sequence
  Synthetic
caggucuccagagcccaag

SEQ ID NO: 66746 - DNA, 23 bp, Artificial Sequence
  Synthetic
gggaacatcaauaaacccccauc

SEQ ID NO: 66747 - DNA, 17 bp, Artificial Sequence
  Synthetic
gcccuccccatcaugct

SEQ ID NO: 66748 - DNA, 17 bp, Artificial Sequence
  Synthetic
ctucgccacagccgtut

SEQ ID NO: 66749 - DNA, 18 bp, Artificial Sequence
  Synthetic
gguagcggctgucacagg

SEQ ID NO: 66750 - DNA, 21 bp, Artificial Sequence
  Synthetic
cttctgucccactcctuggaa

SEQ ID NO: 66751 - DNA, 24 bp, Artificial Sequence
  Synthetic
cccattcttctucatgcacacgua

SEQ ID NO: 66752 - DNA, 25 bp, Artificial Sequence
  Synthetic
gcaaattaaagutgcagtggaugct

SEQ ID NO: 66753 - DNA, 22 bp, Artificial Sequence
  Synthetic
tctaacagtccuccctgcaugt

SEQ ID NO: 66754 - DNA, 25 bp, Artificial Sequence
  Synthetic
cttctgaaguacaagacaagguggt

SEQ ID NO: 66755 - DNA, 28 bp, Artificial Sequence
  Synthetic
ggactcctacauggtggattattucaaa

SEQ ID NO: 66756 - DNA, 25 bp, Artificial Sequence
  Synthetic
cacutgatgctaaugacaaaaccga

SEQ ID NO: 66757 - DNA, 28 bp, Artificial Sequence
  Synthetic
cttctaacugggaggtgttttcuaaact

SEQ ID NO: 66758 - DNA, 21 bp, Artificial Sequence
  Synthetic
accccacugaggaaacgaaug

SEQ ID NO: 66759 - DNA, 29 bp, Artificial Sequence
  Synthetic
ctgtgatgaaguccactaatgctattuct

SEQ ID NO: 66760 - DNA, 25 bp, Artificial Sequence
  Synthetic
ccttatgccacugctacttcttgut

SEQ ID NO: 66761 - DNA, 23 bp, Artificial Sequence
  Synthetic
ccatttuccagagaggctagucc

SEQ ID NO: 66762 - DNA, 26 bp, Artificial Sequence
  Synthetic
ccaaggagutttctagcaucgaacaa

SEQ ID NO: 66763 - DNA, 24 bp, Artificial Sequence
  Synthetic
cctccugagaggagaaagatgugt

SEQ ID NO: 66764 - DNA, 23 bp, Artificial Sequence
  Synthetic
caacuccattttcuagccaccca

SEQ ID NO: 66765 - DNA, 17 bp, Artificial Sequence
  Synthetic
ccccgagcccucuccat

SEQ ID NO: 66766 - DNA, 24 bp, Artificial Sequence
  Synthetic
caccctctgugttgtttctgagua

SEQ ID NO: 66767 - DNA, 21 bp, Artificial Sequence
  Synthetic
gccctcaauatccttcuggct

SEQ ID NO: 66768 - DNA, 22 bp, Artificial Sequence
  Synthetic
ggagtacuggtttgtgcugact

SEQ ID NO: 66769 - DNA, 20 bp, Artificial Sequence
  Synthetic
cccggcgagutacagtccua

SEQ ID NO: 66770 - DNA, 26 bp, Artificial Sequence
  Synthetic
ggaaataacaccggutagaggtgaua

SEQ ID NO: 66771 - DNA, 25 bp, Artificial Sequence
  Synthetic
gcuaccgtctattuccaagaggaat

SEQ ID NO: 66772 - DNA, 19 bp, Artificial Sequence
  Synthetic
gacugcacacccgacauct

SEQ ID NO: 66773 - DNA, 18 bp, Artificial Sequence
  Synthetic
ggtcctcccuctcacguc

SEQ ID NO: 66774 - DNA, 23 bp, Artificial Sequence
  Synthetic
cctgtaggtgaugggcatcttug

SEQ ID NO: 66775 - DNA, 23 bp, Artificial Sequence
  Synthetic
ttcttctttcuccccttctgcug

SEQ ID NO: 66776 - DNA, 22 bp, Artificial Sequence
  Synthetic
atgacattucccgccttctuga

SEQ ID NO: 66777 - DNA, 25 bp, Artificial Sequence
  Synthetic
ggtttctctuccttcttctucacca

SEQ ID NO: 66778 - DNA, 24 bp, Artificial Sequence
  Synthetic
cttcctcugctatttcugccgaat

SEQ ID NO: 66779 - DNA, 20 bp, Artificial Sequence
  Synthetic
agtgagcuggtggaaagugg

SEQ ID NO: 66780 - DNA, 22 bp, Artificial Sequence
  Synthetic
ggctgatccutctctccacauc

SEQ ID NO: 66781 - DNA, 21 bp, Artificial Sequence
  Synthetic
ggtgtccuaggtgagtcuggt

SEQ ID NO: 66782 - DNA, 21 bp, Artificial Sequence
  Synthetic
cctggaaaugcccagcuagag

SEQ ID NO: 66783 - DNA, 19 bp, Artificial Sequence
  Synthetic
caugcggaaggucccagat

SEQ ID NO: 66784 - DNA, 26 bp, Artificial Sequence
  Synthetic
ttgattgcagguaaatgatgggauga

SEQ ID NO: 66785 - DNA, 21 bp, Artificial Sequence
  Synthetic
caucccacagcauggaaaagg

SEQ ID NO: 66786 - DNA, 20 bp, Artificial Sequence
  Synthetic
acgtcaccccauggtgagua

SEQ ID NO: 66787 - DNA, 21 bp, Artificial Sequence
  Synthetic
ggugccaagagaaacgacugt

SEQ ID NO: 66788 - DNA, 17 bp, Artificial Sequence
  Synthetic
cctccccaggugggcua

SEQ ID NO: 66789 - DNA, 19 bp, Artificial Sequence
  Synthetic
ggcttcucccctccaugac

SEQ ID NO: 66790 - DNA, 20 bp, Artificial Sequence
  Synthetic
ggcagggautaggcucacaa

SEQ ID NO: 66791 - DNA, 25 bp, Artificial Sequence
  Synthetic
agaaaccgaaggaacugtcagatuc

SEQ ID NO: 66792 - DNA, 21 bp, Artificial Sequence
  Synthetic
cagggacagagcuctccuagt

SEQ ID NO: 66793 - DNA, 28 bp, Artificial Sequence
  Synthetic
gcttttcaatuaagcccaatttcacugt

SEQ ID NO: 66794 - DNA, 21 bp, Artificial Sequence
  Synthetic
gcatctccuggcaagttcugg

SEQ ID NO: 66795 - DNA, 24 bp, Artificial Sequence
  Synthetic
ccatcctcacugctgttttgtuct

SEQ ID NO: 66796 - DNA, 21 bp, Artificial Sequence
  Synthetic
catccttctugggctgtguca

SEQ ID NO: 66797 - DNA, 23 bp, Artificial Sequence
  Synthetic
gaattcatcugcactgtgtuggg

SEQ ID NO: 66798 - DNA, 24 bp, Artificial Sequence
  Synthetic
aggctccttuttgatgacctugag

SEQ ID NO: 66799 - DNA, 23 bp, Artificial Sequence
  Synthetic
augggagaccaggagtaucagag

SEQ ID NO: 66800 - DNA, 21 bp, Artificial Sequence
  Synthetic
gcaggatgccutccttgguat

SEQ ID NO: 66801 - DNA, 27 bp, Artificial Sequence
  Synthetic
tgccttggagcuatggatactauaact

SEQ ID NO: 66802 - DNA, 19 bp, Artificial Sequence
  Synthetic
gutgcagtccucggaacca

SEQ ID NO: 66803 - DNA, 19 bp, Artificial Sequence
  Synthetic
gacccgcuccuagcaaagg

SEQ ID NO: 66804 - DNA, 22 bp, Artificial Sequence
  Synthetic
gttgggcugacctcttctctut

SEQ ID NO: 66805 - DNA, 21 bp, Artificial Sequence
  Synthetic
ctgagttuccacggcucaaga

SEQ ID NO: 66806 - DNA, 25 bp, Artificial Sequence
  Synthetic
catccttttuacgctcccactttut

SEQ ID NO: 66807 - DNA, 24 bp, Artificial Sequence
  Synthetic
tctactgcaugaatctgaggguca

SEQ ID NO: 66808 - DNA, 22 bp, Artificial Sequence
  Synthetic
cagagggcacagguttctaucc

SEQ ID NO: 66809 - DNA, 24 bp, Artificial Sequence
  Synthetic
gatgtctgtgutttgcttgcagua

SEQ ID NO: 66810 - DNA, 24 bp, Artificial Sequence
  Synthetic
cttacccctugtgcgtgaagauat

SEQ ID NO: 66811 - DNA, 27 bp, Artificial Sequence
  Synthetic
cttcgtttugggcacatatagttucaa

SEQ ID NO: 66812 - DNA, 20 bp, Artificial Sequence
  Synthetic
tccaagtttugaccgccuca

SEQ ID NO: 66813 - DNA, 21 bp, Artificial Sequence
  Synthetic
aagctcacucctccactcgua

SEQ ID NO: 66814 - DNA, 25 bp, Artificial Sequence
  Synthetic
caccttggaguagatcttccuacct

SEQ ID NO: 66815 - DNA, 25 bp, Artificial Sequence
  Synthetic
caagtcctauctcttgctcauggaa

SEQ ID NO: 66816 - DNA, 28 bp, Artificial Sequence
  Synthetic
gagccagcauatacgtagaatugagaaa

SEQ ID NO: 66817 - DNA, 28 bp, Artificial Sequence
  Synthetic
ggtggaagauaaactcagtcttcugaat

SEQ ID NO: 66818 - DNA, 28 bp, Artificial Sequence
  Synthetic
cctattgatuatgctccaaauggaagga

SEQ ID NO: 66819 - DNA, 29 bp, Artificial Sequence
  Synthetic
atcatcgcttuctataatcagcuacaaca

SEQ ID NO: 66820 - DNA, 28 bp, Artificial Sequence
  Synthetic
cttgaataguagctgtccttuacacact

SEQ ID NO: 66821 - DNA, 24 bp, Artificial Sequence
  Synthetic
tcactctuccaagttttgccucaa

SEQ ID NO: 66822 - DNA, 28 bp, Artificial Sequence
  Synthetic
ccatatcttctgcugcttactcctuaaa

SEQ ID NO: 66823 - DNA, 27 bp, Artificial Sequence
  Synthetic
aacattcacaaaaugggtaaaugcaca

SEQ ID NO: 66824 - DNA, 26 bp, Artificial Sequence
  Synthetic
ggttctttctgcuccttctgtttuac

SEQ ID NO: 66825 - DNA, 27 bp, Artificial Sequence
  Synthetic
gacagcaataucaaatccctcgtttut

SEQ ID NO: 66826 - DNA, 31 bp, Artificial Sequence
  Synthetic
ttttaatgacttttcautggaattcaggcuc

SEQ ID NO: 66827 - DNA, 28 bp, Artificial Sequence
  Synthetic
gtatggcaatugagagcggattctatua

SEQ ID NO: 66828 - DNA, 22 bp, Artificial Sequence
  Synthetic
cagggaacagaacaguggacuc

SEQ ID NO: 66829 - DNA, 25 bp, Artificial Sequence
  Synthetic
tggagaaccugagaatgggaagtua

SEQ ID NO: 66830 - DNA, 29 bp, Artificial Sequence
  Synthetic
gtgtcttacttgutacaaaagctgaaugg

SEQ ID NO: 66831 - DNA, 26 bp, Artificial Sequence
  Synthetic
cctggctaccutttaaaacctttuct

SEQ ID NO: 66832 - DNA, 26 bp, Artificial Sequence
  Synthetic
guatttgcctttatugcaagggaagt

SEQ ID NO: 66833 - DNA, 25 bp, Artificial Sequence
  Synthetic
caatccctcucttcaacacaagugt

SEQ ID NO: 66834 - DNA, 24 bp, Artificial Sequence
  Synthetic
caaaccctctugggtaatctcuca

SEQ ID NO: 66835 - DNA, 25 bp, Artificial Sequence
  Synthetic
gagaatccttucctgtttgcatugg

SEQ ID NO: 66836 - DNA, 28 bp, Artificial Sequence
  Synthetic
cttaagagaguagtctggagaaugaggt

SEQ ID NO: 66837 - DNA, 24 bp, Artificial Sequence
  Synthetic
atcctgcccuttcagacatgtuag

SEQ ID NO: 66838 - DNA, 23 bp, Artificial Sequence
  Synthetic
agggagcucagtaagtcactuct

SEQ ID NO: 66839 - DNA, 25 bp, Artificial Sequence
  Synthetic
ccautgatgtugccgaaaaggaaac

SEQ ID NO: 66840 - DNA, 22 bp, Artificial Sequence
  Synthetic
ccuctttggccucagagaaagt

SEQ ID NO: 66841 - DNA, 24 bp, Artificial Sequence
  Synthetic
gcaatcugagcattcuccacagaa

SEQ ID NO: 66842 - DNA, 28 bp, Artificial Sequence
  Synthetic
aaggaattcagguttttaggagtcucac

SEQ ID NO: 66843 - DNA, 28 bp, Artificial Sequence
  Synthetic
attccaactctauacaaagcccctagua

SEQ ID NO: 66844 - DNA, 22 bp, Artificial Sequence
  Synthetic
tgtgcctccugcgtacauaaaa

SEQ ID NO: 66845 - DNA, 28 bp, Artificial Sequence
  Synthetic
gggagtgcugattaaatagguaagaaca

SEQ ID NO: 66846 - DNA, 25 bp, Artificial Sequence
  Synthetic
cacaccataaaaucttggccatugt

SEQ ID NO: 66847 - DNA, 24 bp, Artificial Sequence
  Synthetic
gggaattccuacaggagatgacua

SEQ ID NO: 66848 - DNA, 22 bp, Artificial Sequence
  Synthetic
acacctucggaagctgagtcua

SEQ ID NO: 66849 - DNA, 28 bp, Artificial Sequence
  Synthetic
tcctcttgactguctctcttgataaguc

SEQ ID NO: 66850 - DNA, 23 bp, Artificial Sequence
  Synthetic
tccaaggttugtgctttcctuga

SEQ ID NO: 66851 - DNA, 27 bp, Artificial Sequence
  Synthetic
gcacacacautttaaaccgattuccaa

SEQ ID NO: 66852 - DNA, 28 bp, Artificial Sequence
  Synthetic
gcattcgctttuctaccatagtaagtug

SEQ ID NO: 66853 - DNA, 24 bp, Artificial Sequence
  Synthetic
cctggctagaguggaaacgauaat

SEQ ID NO: 66854 - DNA, 23 bp, Artificial Sequence
  Synthetic
cuggtattccttuagccaggaca

SEQ ID NO: 66855 - DNA, 28 bp, Artificial Sequence
  Synthetic
agggttaaagauggtttgttgaugaaga

SEQ ID NO: 66856 - DNA, 28 bp, Artificial Sequence
  Synthetic
tgttgcaaatttcutcaaatctgctgut

SEQ ID NO: 66857 - DNA, 25 bp, Artificial Sequence
  Synthetic
tcatctggttgcutaatccctctua

SEQ ID NO: 66858 - DNA, 21 bp, Artificial Sequence
  Synthetic
gggagccauccaacagtcauc

SEQ ID NO: 66859 - DNA, 26 bp, Artificial Sequence
  Synthetic
aatgggagguacctaagtgttcatut

SEQ ID NO: 66860 - DNA, 27 bp, Artificial Sequence
  Synthetic
atttctgtatgagcuttgtcaggagut

SEQ ID NO: 66861 - DNA, 23 bp, Artificial Sequence
  Synthetic
tgtccttttucccctttctgucc

SEQ ID NO: 66862 - DNA, 22 bp, Artificial Sequence
  Synthetic
gacctccuggacttgatgtucc

SEQ ID NO: 66863 - DNA, 27 bp, Artificial Sequence
  Synthetic
acatgggaattauctaccagagtcgua

SEQ ID NO: 66864 - DNA, 23 bp, Artificial Sequence
  Synthetic
cctgaactuaggtcacttuggct

SEQ ID NO: 66865 - DNA, 25 bp, Artificial Sequence
  Synthetic
gatgatctgcautggtacctgguaa

SEQ ID NO: 66866 - DNA, 27 bp, Artificial Sequence
  Synthetic
accagaaaatguggatctgattgtcut

SEQ ID NO: 66867 - DNA, 27 bp, Artificial Sequence
  Synthetic
caatgagacacugcatcctaggaatut

SEQ ID NO: 66868 - DNA, 26 bp, Artificial Sequence
  Synthetic
aaagactgauctcaaaatgcugggat

SEQ ID NO: 66869 - DNA, 23 bp, Artificial Sequence
  Synthetic
caagcaccaucatgctggataug

SEQ ID NO: 66870 - DNA, 29 bp, Artificial Sequence
  Synthetic
cacgtattgattagugttacagagtcuga

SEQ ID NO: 66871 - DNA, 28 bp, Artificial Sequence
  Synthetic
tctttgactucgagacattcttttguga

SEQ ID NO: 66872 - DNA, 22 bp, Artificial Sequence
  Synthetic
ggcugaaggtaggauacgcaat

SEQ ID NO: 66873 - DNA, 28 bp, Artificial Sequence
  Synthetic
gctggaaccuattcagttaataauggca

SEQ ID NO: 66874 - DNA, 26 bp, Artificial Sequence
  Synthetic
aggaatgtugaaagaatggctttugg

SEQ ID NO: 66875 - DNA, 24 bp, Artificial Sequence
  Synthetic
tgcaaugaccauagcaacaaggaa

SEQ ID NO: 66876 - DNA, 23 bp, Artificial Sequence
  Synthetic
gtgtcugtctgttatuccccagt

SEQ ID NO: 66877 - DNA, 25 bp, Artificial Sequence
  Synthetic
agcagagacaaugguaaagggaaaa

SEQ ID NO: 66878 - DNA, 28 bp, Artificial Sequence
  Synthetic
ttctgtctgucaatgactttctttucct

SEQ ID NO: 66879 - DNA, 27 bp, Artificial Sequence
  Synthetic
accacagutaagtgttaaucaagcaca

SEQ ID NO: 66880 - DNA, 28 bp, Artificial Sequence
  Synthetic
tttccttgaagagutgatgagattgugt

SEQ ID NO: 66881 - DNA, 21 bp, Artificial Sequence
  Synthetic
tgaagaaucagctccgctucc

SEQ ID NO: 66882 - DNA, 23 bp, Artificial Sequence
  Synthetic
catcacattugccatccatggut

SEQ ID NO: 66883 - DNA, 25 bp, Artificial Sequence
  Synthetic
gctattccauacgcaccatagacua

SEQ ID NO: 66884 - DNA, 25 bp, Artificial Sequence
  Synthetic
tccccaaacuatgtccttgauacct

SEQ ID NO: 66885 - DNA, 25 bp, Artificial Sequence
  Synthetic
caactttguggctttgtgttttucc

SEQ ID NO: 66886 - DNA, 21 bp, Artificial Sequence
  Synthetic
ccaggaagccuctctgtguct

SEQ ID NO: 66887 - DNA, 21 bp, Artificial Sequence
  Synthetic
acctgacuctgaguagccagt

SEQ ID NO: 66888 - DNA, 21 bp, Artificial Sequence
  Synthetic
cagacuccccagaaugcagag

SEQ ID NO: 66889 - DNA, 20 bp, Artificial Sequence
  Synthetic
aagggcugaggcttgcauat

SEQ ID NO: 66890 - DNA, 18 bp, Artificial Sequence
  Synthetic
ccccuccacctccctucc

SEQ ID NO: 66891 - DNA, 17 bp, Artificial Sequence
  Synthetic
accugggcgaggaccua

SEQ ID NO: 66892 - DNA, 21 bp, Artificial Sequence
  Synthetic
tccacaggcucctctctgtut

SEQ ID NO: 66893 - DNA, 23 bp, Artificial Sequence
  Synthetic
gcgtcugcaaagaggagaagaug

SEQ ID NO: 66894 - DNA, 24 bp, Artificial Sequence
  Synthetic
ccaggatcaacucgtaggcttuac

SEQ ID NO: 66895 - DNA, 21 bp, Artificial Sequence
  Synthetic
ccagactuccctccccttuct

SEQ ID NO: 66896 - DNA, 22 bp, Artificial Sequence
  Synthetic
gggcaggacuaattgcatcugt

SEQ ID NO: 66897 - DNA, 21 bp, Artificial Sequence
  Synthetic
cccccauaggtcccuccaaaa

SEQ ID NO: 66898 - DNA, 28 bp, Artificial Sequence
  Synthetic
tgtgaactttuggaagcaattcaactut

SEQ ID NO: 66899 - DNA, 23 bp, Artificial Sequence
  Synthetic
ggguccaagaaagcagtcattuc

SEQ ID NO: 66900 - DNA, 28 bp, Artificial Sequence
  Synthetic
gccagactgauggactattctcaatuaa

SEQ ID NO: 66901 - DNA, 25 bp, Artificial Sequence
  Synthetic
tcgtcaacagagaguggtaggtuat

SEQ ID NO: 66902 - DNA, 28 bp, Artificial Sequence
  Synthetic
gccaaattgtcugatggaattgtugaaa

SEQ ID NO: 66903 - DNA, 26 bp, Artificial Sequence
  Synthetic
ggagcaauagacagtaauaacagcct

SEQ ID NO: 66904 - DNA, 25 bp, Artificial Sequence
  Synthetic
gtcctgaagcuagatctctcuccat

SEQ ID NO: 66905 - DNA, 29 bp, Artificial Sequence
  Synthetic
tggcttgttgtacuctaattgagctatut

SEQ ID NO: 66906 - DNA, 23 bp, Artificial Sequence
  Synthetic
gtgtgtcuccaacttccccauaa

SEQ ID NO: 66907 - DNA, 27 bp, Artificial Sequence
  Synthetic
cctaccuagaatttttctucccaacct

SEQ ID NO: 66908 - DNA, 20 bp, Artificial Sequence
  Synthetic
aagaucccctccuggcagat

SEQ ID NO: 66909 - DNA, 18 bp, Artificial Sequence
  Synthetic
gcccutgacguccaccac

SEQ ID NO: 66910 - DNA, 27 bp, Artificial Sequence
  Synthetic
gaatatcacaaggaacuactgcuggaa

SEQ ID NO: 66911 - DNA, 24 bp, Artificial Sequence
  Synthetic
gagctctcacauctgtgactucat

SEQ ID NO: 66912 - DNA, 20 bp, Artificial Sequence
  Synthetic
cggtaacccucccagcttug

SEQ ID NO: 66913 - DNA, 24 bp, Artificial Sequence
  Synthetic
cgtttccaacagucctacttcuct

SEQ ID NO: 66914 - DNA, 19 bp, Artificial Sequence
  Synthetic
gccauctugaacccaccgt

SEQ ID NO: 66915 - DNA, 22 bp, Artificial Sequence
  Synthetic
tcccagtcacaugtctcacuct

SEQ ID NO: 66916 - DNA, 20 bp, Artificial Sequence
  Synthetic
caggaaugcggtgatcuggt

SEQ ID NO: 66917 - DNA, 27 bp, Artificial Sequence
  Synthetic
gggccatgtaautaggcattatgttua

SEQ ID NO: 66918 - DNA, 27 bp, Artificial Sequence
  Synthetic
ggttactctucattgtgtttaguccct

SEQ ID NO: 66919 - DNA, 24 bp, Artificial Sequence
  Synthetic
cacttggcauttgttcccugaaaa

SEQ ID NO: 66920 - DNA, 21 bp, Artificial Sequence
  Synthetic
acaagcacauttgccccauct

SEQ ID NO: 66921 - DNA, 28 bp, Artificial Sequence
  Synthetic
ccttgggattacuacagtttcctaucct

SEQ ID NO: 66922 - DNA, 24 bp, Artificial Sequence
  Synthetic
gtcttgttucagggaatugaggga

SEQ ID NO: 66923 - DNA, 28 bp, Artificial Sequence
  Synthetic
ccactttaugaaacaattgcacucacat

SEQ ID NO: 66924 - DNA, 21 bp, Artificial Sequence
  Synthetic
aggaccaggaucuccaggaaa

SEQ ID NO: 66925 - DNA, 27 bp, Artificial Sequence
  Synthetic
ttgtcatgacttuaacctcttcaccuc

SEQ ID NO: 66926 - DNA, 18 bp, Artificial Sequence
  Synthetic
ccctgggutccctgctuc

SEQ ID NO: 66927 - DNA, 28 bp, Artificial Sequence
  Synthetic
aagcactggagucactgatagaaaaaut

SEQ ID NO: 66928 - DNA, 28 bp, Artificial Sequence
  Synthetic
gcttttucacaggatctacuaacacgaa

SEQ ID NO: 66929 - DNA, 28 bp, Artificial Sequence
  Synthetic
cttgtagcugcacttcaaaactguaaaa

SEQ ID NO: 66930 - DNA, 28 bp, Artificial Sequence
  Synthetic
gatagacaugcacatgtatuagcagaca

SEQ ID NO: 66931 - DNA, 28 bp, Artificial Sequence
  Synthetic
gcagatgcuatgagaaagaatucaaact

SEQ ID NO: 66932 - DNA, 23 bp, Artificial Sequence
  Synthetic
aaacatcagcugcaagaguacca

SEQ ID NO: 66933 - DNA, 23 bp, Artificial Sequence
  Synthetic
gttgttatuctgtgccucaggga

SEQ ID NO: 66934 - DNA, 27 bp, Artificial Sequence
  Synthetic
caucaccactatacucacagaggaaga

SEQ ID NO: 66935 - DNA, 26 bp, Artificial Sequence
  Synthetic
gttgataccaauggaatcacggttut

SEQ ID NO: 66936 - DNA, 25 bp, Artificial Sequence
  Synthetic
acagaaaaacaggugatcucccaac

SEQ ID NO: 66937 - DNA, 28 bp, Artificial Sequence
  Synthetic
tttctaactcttuggccttttcttcuca

SEQ ID NO: 66938 - DNA, 26 bp, Artificial Sequence
  Synthetic
tcattcatuaaattccagugccagga

SEQ ID NO: 66939 - DNA, 25 bp, Artificial Sequence
  Synthetic
gggctaaccuagtgcctatagcuaa

SEQ ID NO: 66940 - DNA, 22 bp, Artificial Sequence
  Synthetic
ctcagugactgtggtugaggac

SEQ ID NO: 66941 - DNA, 22 bp, Artificial Sequence
  Synthetic
gccagcgaguaaagtuccaaaa

SEQ ID NO: 66942 - DNA, 22 bp, Artificial Sequence
  Synthetic
agcatgtcacuaaccaccaugt

SEQ ID NO: 66943 - DNA, 22 bp, Artificial Sequence
  Synthetic
ctacccacuctacccctacucc

SEQ ID NO: 66944 - DNA, 21 bp, Artificial Sequence
  Synthetic
taggcttcucaggaggtguct

SEQ ID NO: 66945 - DNA, 23 bp, Artificial Sequence
  Synthetic
aggaagaacaguagcagaagcug

SEQ ID NO: 66946 - DNA, 28 bp, Artificial Sequence
  Synthetic
tggtcactaatutcatggttgaatuggt

SEQ ID NO: 66947 - DNA, 26 bp, Artificial Sequence
  Synthetic
gctgtcgguaaattgttctugaggaa

SEQ ID NO: 66948 - DNA, 23 bp, Artificial Sequence
  Synthetic
tcaataggagagucaggugcaca

SEQ ID NO: 66949 - DNA, 25 bp, Artificial Sequence
  Synthetic
ttcttcactctguctgcttcactuc

SEQ ID NO: 66950 - DNA, 21 bp, Artificial Sequence
  Synthetic
ggctcccaggauttccacaut

SEQ ID NO: 66951 - DNA, 24 bp, Artificial Sequence
  Synthetic
ctactgacagugtttcctgtugct

SEQ ID NO: 66952 - DNA, 26 bp, Artificial Sequence
  Synthetic
tgtcagggcucatctatttatcugga

SEQ ID NO: 66953 - DNA, 27 bp, Artificial Sequence
  Synthetic
tgcaaaccaugcaggagaaatttuaag

SEQ ID NO: 66954 - DNA, 20 bp, Artificial Sequence
  Synthetic
cacaagctccucccctgaut

SEQ ID NO: 66955 - DNA, 22 bp, Artificial Sequence
  Synthetic
gctguacaaacagttccugggt

SEQ ID NO: 66956 - DNA, 23 bp, Artificial Sequence
  Synthetic
cgatgcaugcttcatcaguccat

SEQ ID NO: 66957 - DNA, 28 bp, Artificial Sequence
  Synthetic
ccttctgcagccuttttatataccuact

SEQ ID NO: 66958 - DNA, 25 bp, Artificial Sequence
  Synthetic
gttattgcuttgcaacugccaaaaa

SEQ ID NO: 66959 - DNA, 22 bp, Artificial Sequence
  Synthetic
ccatgctcaugccatacaacug

SEQ ID NO: 66960 - DNA, 28 bp, Artificial Sequence
  Synthetic
accatttaaacuctgtcctattugcaca

SEQ ID NO: 66961 - DNA, 27 bp, Artificial Sequence
  Synthetic
gtgcatcagacaaaaaucagcttctut

SEQ ID NO: 66962 - DNA, 22 bp, Artificial Sequence
  Synthetic
cttctgggccagaguttctcut

SEQ ID NO: 66963 - DNA, 17 bp, Artificial Sequence
  Synthetic
gcagcuggacgcauccc

SEQ ID NO: 66964 - DNA, 23 bp, Artificial Sequence
  Synthetic
cctgggagguctgttucaaaagt

SEQ ID NO: 66965 - DNA, 26 bp, Artificial Sequence
  Synthetic
gautccactgagaauacaaggaccag

SEQ ID NO: 66966 - DNA, 23 bp, Artificial Sequence
  Synthetic
tcagctccuctatgccatugaga

SEQ ID NO: 66967 - DNA, 20 bp, Artificial Sequence
  Synthetic
gggtgatgcucttcgtcucc

SEQ ID NO: 66968 - DNA, 28 bp, Artificial Sequence
  Synthetic
cttttcagatgatuttgtggctaagcuc

SEQ ID NO: 66969 - DNA, 23 bp, Artificial Sequence
  Synthetic
gcaaggcagagaucctgaaugac

SEQ ID NO: 66970 - DNA, 22 bp, Artificial Sequence
  Synthetic
tcacaaggcagccauggtttua

SEQ ID NO: 66971 - DNA, 20 bp, Artificial Sequence
  Synthetic
agaggaggaaguccaucgct

SEQ ID NO: 66972 - DNA, 28 bp, Artificial Sequence
  Synthetic
tgtgagaataagtaugatgttcctgcug

SEQ ID NO: 66973 - DNA, 28 bp, Artificial Sequence
  Synthetic
ccataagcccaugctgatcctttaaaua

SEQ ID NO: 66974 - DNA, 25 bp, Artificial Sequence
  Synthetic
gtgagaactaaacuagacagccgut

SEQ ID NO: 66975 - DNA, 28 bp, Artificial Sequence
  Synthetic
ccacaggatcugcttctgtatcatcuat

SEQ ID NO: 66976 - DNA, 24 bp, Artificial Sequence
  Synthetic
gtgggaggugaactctgaaatgua

SEQ ID NO: 66977 - DNA, 28 bp, Artificial Sequence
  Synthetic
gtcatccgtgugactttaaaccatttut

SEQ ID NO: 66978 - DNA, 25 bp, Artificial Sequence
  Synthetic
agagagcaaatuctttccctgtuca

SEQ ID NO: 66979 - DNA, 24 bp, Artificial Sequence
  Synthetic
gcaagttcatccuactctcgaguc

SEQ ID NO: 66980 - DNA, 25 bp, Artificial Sequence
  Synthetic
tcactgtcugcggtaatcaagttut

SEQ ID NO: 66981 - DNA, 24 bp, Artificial Sequence
  Synthetic
acctgaaaaaggutaagggctcug

SEQ ID NO: 66982 - DNA, 27 bp, Artificial Sequence
  Synthetic
cagtagaatttgucatagcaccaggua

SEQ ID NO: 66983 - DNA, 21 bp, Artificial Sequence
  Synthetic
actgctactucctgtctgcug

SEQ ID NO: 66984 - DNA, 21 bp, Artificial Sequence
  Synthetic
cttuggcggcaagagttugat

SEQ ID NO: 66985 - DNA, 23 bp, Artificial Sequence
  Synthetic
ccuccagaaccaaaaugcaagga

SEQ ID NO: 66986 - DNA, 18 bp, Artificial Sequence
  Synthetic
tggctggguggagcatug

SEQ ID NO: 66987 - DNA, 19 bp, Artificial Sequence
  Synthetic
atctggcaucctgccctug

SEQ ID NO: 66988 - DNA, 17 bp, Artificial Sequence
  Synthetic
gacccutgccugcccat

SEQ ID NO: 66989 - DNA, 18 bp, Artificial Sequence
  Synthetic
acugctcacugccacaca

SEQ ID NO: 66990 - DNA, 23 bp, Artificial Sequence
  Synthetic
ggagutgtcauggaagacaggaa

SEQ ID NO: 66991 - DNA, 20 bp, Artificial Sequence
  Synthetic
gtcttgcgguactcgaggug

SEQ ID NO: 66992 - DNA, 24 bp, Artificial Sequence
  Synthetic
tcctaatucaggctcaactcucct

SEQ ID NO: 66993 - DNA, 24 bp, Artificial Sequence
  Synthetic
tcatcttgattuctgcctgctcut

SEQ ID NO: 66994 - DNA, 23 bp, Artificial Sequence
  Synthetic
cagcagaaccagcugatttucac

SEQ ID NO: 66995 - DNA, 28 bp, Artificial Sequence
  Synthetic
aggcagatgaaguattggagatttugaa

SEQ ID NO: 66996 - DNA, 19 bp, Artificial Sequence
  Synthetic
acacucacctgguccccaa

SEQ ID NO: 66997 - DNA, 27 bp, Artificial Sequence
  Synthetic
gaaaggttcugccattcaataucacat

SEQ ID NO: 66998 - DNA, 28 bp, Artificial Sequence
  Synthetic
acaaagaagtugaagaagtttccaucct

SEQ ID NO: 66999 - DNA, 21 bp, Artificial Sequence
  Synthetic
ttctctggcaaugggactcug

SEQ ID NO: 67000 - DNA, 28 bp, Artificial Sequence
  Synthetic
attatcaagugaaagaaaacacgcugac

SEQ ID NO: 67001 - DNA, 28 bp, Artificial Sequence
  Synthetic
aaactgctacctucttatcccacattut

SEQ ID NO: 67002 - DNA, 26 bp, Artificial Sequence
  Synthetic
cttttcuggtcacaguaacaaggact

SEQ ID NO: 67003 - DNA, 24 bp, Artificial Sequence
  Synthetic
cacataagcccugagaagtgtuca

SEQ ID NO: 67004 - DNA, 21 bp, Artificial Sequence
  Synthetic
ggacttgaacaucgacccuga

SEQ ID NO: 67005 - DNA, 21 bp, Artificial Sequence
  Synthetic
ctcccccgguaaaacactgut

SEQ ID NO: 67006 - DNA, 28 bp, Artificial Sequence
  Synthetic
cctcattccutcaaatctagauaaggct

SEQ ID NO: 67007 - DNA, 26 bp, Artificial Sequence
  Synthetic
tgttcctgtugagttgcttttaguga

SEQ ID NO: 67008 - DNA, 27 bp, Artificial Sequence
  Synthetic
agctcaaguaaaattttgtcatuggca

SEQ ID NO: 67009 - DNA, 26 bp, Artificial Sequence
  Synthetic
ctgctacaagautgttgaacacagut

SEQ ID NO: 67010 - DNA, 28 bp, Artificial Sequence
  Synthetic
ctcatttcagcaagugtatggtuagaaa

SEQ ID NO: 67011 - DNA, 24 bp, Artificial Sequence
  Synthetic
cagcaatugaagaagaccctgaug

SEQ ID NO: 67012 - DNA, 27 bp, Artificial Sequence
  Synthetic
tcctatatctctucctctgccttugaa

SEQ ID NO: 67013 - DNA, 21 bp, Artificial Sequence
  Synthetic
caguaggtgctucagcaacca

SEQ ID NO: 67014 - DNA, 25 bp, Artificial Sequence
  Synthetic
gaattucaagccacgaagctuacat

SEQ ID NO: 67015 - DNA, 28 bp, Artificial Sequence
  Synthetic
cacaaugaaaagaccauccagagaaaag

SEQ ID NO: 67016 - DNA, 27 bp, Artificial Sequence
  Synthetic
catgtataucaaggaaactgggcugat

SEQ ID NO: 67017 - DNA, 28 bp, Artificial Sequence
  Synthetic
gtatcacacucttcatctgctugaaaaa

SEQ ID NO: 67018 - DNA, 20 bp, Artificial Sequence
  Synthetic
cgtggugaacgcgtaagtut

SEQ ID NO: 67019 - DNA, 23 bp, Artificial Sequence
  Synthetic
gttctccaggugatccatcctug

SEQ ID NO: 67020 - DNA, 23 bp, Artificial Sequence
  Synthetic
gatctcctcuttgtcctgcauct

SEQ ID NO: 67021 - DNA, 33 bp, Artificial Sequence
  Synthetic
aaaataatatcatggutattcttgttaggguga

SEQ ID NO: 67022 - DNA, 22 bp, Artificial Sequence
  Synthetic
acccttgagcautttgagcugt

SEQ ID NO: 67023 - DNA, 28 bp, Artificial Sequence
  Synthetic
gactagctaaaugtcctggttctuacaa

SEQ ID NO: 67024 - DNA, 21 bp, Artificial Sequence
  Synthetic
catccgggcucagtaugagac

SEQ ID NO: 67025 - DNA, 21 bp, Artificial Sequence
  Synthetic
gctctccucccatggatggua

SEQ ID NO: 67026 - DNA, 20 bp, Artificial Sequence
  Synthetic
gacttggucaggctgagugt

SEQ ID NO: 67027 - DNA, 20 bp, Artificial Sequence
  Synthetic
acuagccagggaccuagacc

SEQ ID NO: 67028 - DNA, 20 bp, Artificial Sequence
  Synthetic
cctactccugcaacgtgcut

SEQ ID NO: 67029 - DNA, 22 bp, Artificial Sequence
  Synthetic
gtgcttcagucaccttcttugg

SEQ ID NO: 67030 - DNA, 18 bp, Artificial Sequence
  Synthetic
ggcaggcgucgaagagua

SEQ ID NO: 67031 - DNA, 21 bp, Artificial Sequence
  Synthetic
gcgatugcagaagatgaccug

SEQ ID NO: 67032 - DNA, 17 bp, Artificial Sequence
  Synthetic
gguccaggcggcuacat

SEQ ID NO: 67033 - DNA, 17 bp, Artificial Sequence
  Synthetic
gggagaggcgcutccug

SEQ ID NO: 67034 - DNA, 28 bp, Artificial Sequence
  Synthetic
gagaactgauagaaattggatgugagga

SEQ ID NO: 67035 - DNA, 27 bp, Artificial Sequence
  Synthetic
gtggatttcccaugtggttcttttuaa

SEQ ID NO: 67036 - DNA, 22 bp, Artificial Sequence
  Synthetic
cctacagtcaggugagggctua

SEQ ID NO: 67037 - DNA, 26 bp, Artificial Sequence
  Synthetic
tcttcttcatgcutgtcatcttccug

SEQ ID NO: 67038 - DNA, 22 bp, Artificial Sequence
  Synthetic
ccaaggaguggaccactguaaa

SEQ ID NO: 67039 - DNA, 21 bp, Artificial Sequence
  Synthetic
gacaccgcuctatgactucca

SEQ ID NO: 67040 - DNA, 21 bp, Artificial Sequence
  Synthetic
cataggcagcuctgggugaag

SEQ ID NO: 67041 - DNA, 22 bp, Artificial Sequence
  Synthetic
acaucgaggagctcaugaagga

SEQ ID NO: 67042 - DNA, 21 bp, Artificial Sequence
  Synthetic
gctacuaaccccgcactcuca

SEQ ID NO: 67043 - DNA, 22 bp, Artificial Sequence
  Synthetic
gggcagggcuatttaagucaag

SEQ ID NO: 67044 - DNA, 22 bp, Artificial Sequence
  Synthetic
tgtgcaguatgcaauccagaca

SEQ ID NO: 67045 - DNA, 24 bp, Artificial Sequence
  Synthetic
actgctacuggcattttgacagut

SEQ ID NO: 67046 - DNA, 27 bp, Artificial Sequence
  Synthetic
cccattatgutcaaaagccucagaaaa

SEQ ID NO: 67047 - DNA, 28 bp, Artificial Sequence
  Synthetic
tcctcaactgutgtgaattcctuaagag

SEQ ID NO: 67048 - DNA, 29 bp, Artificial Sequence
  Synthetic
aatttuattcttgcaattuacacgacagt

SEQ ID NO: 67049 - DNA, 21 bp, Artificial Sequence
  Synthetic
gcttgguggagaaggctauct

SEQ ID NO: 67050 - DNA, 26 bp, Artificial Sequence
  Synthetic
aaaccaagacaccaguaatggctaut

SEQ ID NO: 67051 - DNA, 28 bp, Artificial Sequence
  Synthetic
agctgggaaatuttaagattccttcugt

SEQ ID NO: 67052 - DNA, 27 bp, Artificial Sequence
  Synthetic
tgatgtaaaauacgcaactgtcaguga

SEQ ID NO: 67053 - DNA, 27 bp, Artificial Sequence
  Synthetic
agtatgtggttcgugaaggtgataaug

SEQ ID NO: 67054 - DNA, 28 bp, Artificial Sequence
  Synthetic
caccttcatttuctccaatgttctucaa

SEQ ID NO: 67055 - DNA, 21 bp, Artificial Sequence
  Synthetic
tcctaccagguagcctcuact

SEQ ID NO: 67056 - DNA, 25 bp, Artificial Sequence
  Synthetic
cagtattgattgucactgtccggua

SEQ ID NO: 67057 - DNA, 24 bp, Artificial Sequence
  Synthetic
actaatcaccugtgtcctctcugt

SEQ ID NO: 67058 - DNA, 22 bp, Artificial Sequence
  Synthetic
tgagaaaugggacccctgtgua

SEQ ID NO: 67059 - DNA, 24 bp, Artificial Sequence
  Synthetic
acctggttcacuccacaattctuc

SEQ ID NO: 67060 - DNA, 18 bp, Artificial Sequence
  Synthetic
gcattggtugcggccauc

SEQ ID NO: 67061 - DNA, 19 bp, Artificial Sequence
  Synthetic
gaccccagggaggutgtuc

SEQ ID NO: 67062 - DNA, 19 bp, Artificial Sequence
  Synthetic
gccaagccugtcaccguag

SEQ ID NO: 67063 - DNA, 22 bp, Artificial Sequence
  Synthetic
cccagcaggutgatgatgttut

SEQ ID NO: 67064 - DNA, 20 bp, Artificial Sequence
  Synthetic
gcccacucctttaccuccaa

SEQ ID NO: 67065 - DNA, 18 bp, Artificial Sequence
  Synthetic
gtgggcauggtgcucaga

SEQ ID NO: 67066 - DNA, 23 bp, Artificial Sequence
  Synthetic
ttttgcctguacagatctgcugt

SEQ ID NO: 67067 - DNA, 28 bp, Artificial Sequence
  Synthetic
gggatgtagttgcugagctttcataaua

SEQ ID NO: 67068 - DNA, 26 bp, Artificial Sequence
  Synthetic
aggagacacucaccagtatgaaucat

SEQ ID NO: 67069 - DNA, 28 bp, Artificial Sequence
  Synthetic
ccatgtttgcaaaugcataacaaaggua

SEQ ID NO: 67070 - DNA, 22 bp, Artificial Sequence
  Synthetic
gggctaacugttctccaaguca

SEQ ID NO: 67071 - DNA, 22 bp, Artificial Sequence
  Synthetic
cttggtgcauccatcaagugaa

SEQ ID NO: 67072 - DNA, 24 bp, Artificial Sequence
  Synthetic
ggcaataaggcuagggaatcauct

SEQ ID NO: 67073 - DNA, 25 bp, Artificial Sequence
  Synthetic
gggaggttucacagaatgttcttut

SEQ ID NO: 67074 - DNA, 24 bp, Artificial Sequence
  Synthetic
ggatctttcugtgttccagugacc

SEQ ID NO: 67075 - DNA, 27 bp, Artificial Sequence
  Synthetic
gcattgaaatgaugaagccaaaugaac

SEQ ID NO: 67076 - DNA, 25 bp, Artificial Sequence
  Synthetic
gcagcctgugagattatcttttgut

SEQ ID NO: 67077 - DNA, 26 bp, Artificial Sequence
  Synthetic
gggaatatcaagauccacaatgcuga

SEQ ID NO: 67078 - DNA, 26 bp, Artificial Sequence
  Synthetic
aatactttccccaacuttgagcauct

SEQ ID NO: 67079 - DNA, 23 bp, Artificial Sequence
  Synthetic
gctttggcuggtcacttgaatut

SEQ ID NO: 67080 - DNA, 24 bp, Artificial Sequence
  Synthetic
gaagtgaaauctgactuggcacag

SEQ ID NO: 67081 - DNA, 27 bp, Artificial Sequence
  Synthetic
ctgggtgaaacaaugctcattttaugt

SEQ ID NO: 67082 - DNA, 20 bp, Artificial Sequence
  Synthetic
cagggagaccacguggaaug

SEQ ID NO: 67083 - DNA, 22 bp, Artificial Sequence
  Synthetic
agutaatgtggacugggccaag

SEQ ID NO: 67084 - DNA, 20 bp, Artificial Sequence
  Synthetic
ctcctgcucggctcatcaut

SEQ ID NO: 67085 - DNA, 25 bp, Artificial Sequence
  Synthetic
gcaaagacaugaaggcaaaatguca

SEQ ID NO: 67086 - DNA, 25 bp, Artificial Sequence
  Synthetic
aacaagcatttuaccaccatgcaut

SEQ ID NO: 67087 - DNA, 24 bp, Artificial Sequence
  Synthetic
tggaataatgatucggagcccaut

SEQ ID NO: 67088 - DNA, 21 bp, Artificial Sequence
  Synthetic
ccctgaggccutgtggatcua

SEQ ID NO: 67089 - DNA, 26 bp, Artificial Sequence
  Synthetic
caggaacttcatuaaccaggtgacut

SEQ ID NO: 67090 - DNA, 24 bp, Artificial Sequence
  Synthetic
cagggaagagacuctctcugaaga

SEQ ID NO: 67091 - DNA, 21 bp, Artificial Sequence
  Synthetic
gtggaggcugaaatccccaut

SEQ ID NO: 67092 - DNA, 24 bp, Artificial Sequence
  Synthetic
cgtcucagaggaagacatttcugt

SEQ ID NO: 67093 - DNA, 28 bp, Artificial Sequence
  Synthetic
ggtattacattugacaggctttcttugg

SEQ ID NO: 67094 - DNA, 27 bp, Artificial Sequence
  Synthetic
agagggcataucaatgtaagtctucct

SEQ ID NO: 67095 - DNA, 26 bp, Artificial Sequence
  Synthetic
actgactcaccaacaauatcaagcug

SEQ ID NO: 67096 - DNA, 27 bp, Artificial Sequence
  Synthetic
cttggtaaaaacugaaatctgguccaa

SEQ ID NO: 67097 - DNA, 27 bp, Artificial Sequence
  Synthetic
agggaaataataaugcaacggtaguca

SEQ ID NO: 67098 - DNA, 21 bp, Artificial Sequence
  Synthetic
gcatttcccugaggaguacga

SEQ ID NO: 67099 - DNA, 29 bp, Artificial Sequence
  Synthetic
tctgatctugagacacctatatctuccaa

SEQ ID NO: 67100 - DNA, 21 bp, Artificial Sequence
  Synthetic
ggatggaucatggcugccaaa

SEQ ID NO: 67101 - DNA, 23 bp, Artificial Sequence
  Synthetic
ggaaacacucaaggagtuaggct

SEQ ID NO: 67102 - DNA, 26 bp, Artificial Sequence
  Synthetic
acgtggaccutgatattttgucaact

SEQ ID NO: 67103 - DNA, 27 bp, Artificial Sequence
  Synthetic
gctttgcagaguaatgaagacagugat

SEQ ID NO: 67104 - DNA, 25 bp, Artificial Sequence
  Synthetic
gcttagatucaacccatctgcctua

SEQ ID NO: 67105 - DNA, 25 bp, Artificial Sequence
  Synthetic
agaagccaaaccuataatucgcagt

SEQ ID NO: 67106 - DNA, 24 bp, Artificial Sequence
  Synthetic
ctgtttctgctucctccacatcut

SEQ ID NO: 67107 - DNA, 29 bp, Artificial Sequence
  Synthetic
ggatacattagaugcagtcctgttugaat

SEQ ID NO: 67108 - DNA, 27 bp, Artificial Sequence
  Synthetic
cttcaaaaacacccautacuccacaag

SEQ ID NO: 67109 - DNA, 28 bp, Artificial Sequence
  Synthetic
cctgttgtgatauctgttgttgattcug

SEQ ID NO: 67110 - DNA, 29 bp, Artificial Sequence
  Synthetic
tacttgaggtttauatatagaggcgtcut

SEQ ID NO: 67111 - DNA, 25 bp, Artificial Sequence
  Synthetic
tcactgccaagutcattaagcugat

SEQ ID NO: 67112 - DNA, 27 bp, Artificial Sequence
  Synthetic
atggactatacacutaacacctguact

SEQ ID NO: 67113 - DNA, 24 bp, Artificial Sequence
  Synthetic
gcatttucaccaagaactcguagg

SEQ ID NO: 67114 - DNA, 24 bp, Artificial Sequence
  Synthetic
gggaaagaaguacctgctctaaug

SEQ ID NO: 67115 - DNA, 25 bp, Artificial Sequence
  Synthetic
agacttggaugctgaauaaaggcaa

SEQ ID NO: 67116 - DNA, 23 bp, Artificial Sequence
  Synthetic
aggaaaaugagucaagcgacagt

SEQ ID NO: 67117 - DNA, 29 bp, Artificial Sequence
  Synthetic
gagaagtaauaaaatacccugggacacat

SEQ ID NO: 67118 - DNA, 25 bp, Artificial Sequence
  Synthetic
cacagttccaugcctttatcaguct

SEQ ID NO: 67119 - DNA, 23 bp, Artificial Sequence
  Synthetic
agttgccaugttgatttcuccca

SEQ ID NO: 67120 - DNA, 28 bp, Artificial Sequence
  Synthetic
ttgaattgaacatucacttgctgttuct

SEQ ID NO: 67121 - DNA, 22 bp, Artificial Sequence
  Synthetic
ggatccaugaggcagtcuaggt

SEQ ID NO: 67122 - DNA, 22 bp, Artificial Sequence
  Synthetic
cgacaacaccaggcauctuaca

SEQ ID NO: 67123 - DNA, 22 bp, Artificial Sequence
  Synthetic
ccttctauccacgtgccuacag

SEQ ID NO: 67124 - DNA, 20 bp, Artificial Sequence
  Synthetic
tcctcgagcugttcctucca

SEQ ID NO: 67125 - DNA, 23 bp, Artificial Sequence
  Synthetic
gtctgugtttgccugagaaacaa

SEQ ID NO: 67126 - DNA, 22 bp, Artificial Sequence
  Synthetic
gctgctttggugatggatcuca

SEQ ID NO: 67127 - DNA, 22 bp, Artificial Sequence
  Synthetic
ggatcugacacacagccttuct

SEQ ID NO: 67128 - DNA, 22 bp, Artificial Sequence
  Synthetic
tctggttuctctgtgttugcct

SEQ ID NO: 67129 - DNA, 18 bp, Artificial Sequence
  Synthetic
gggtguggccaaggctut

SEQ ID NO: 67130 - DNA, 21 bp, Artificial Sequence
  Synthetic
gctgggaugagtucaccaaac

SEQ ID NO: 67131 - DNA, 26 bp, Artificial Sequence
  Synthetic
ggtcuagaagactctttgucacacaa

SEQ ID NO: 67132 - DNA, 27 bp, Artificial Sequence
  Synthetic
ccgactgactuatgagattgaagauga

SEQ ID NO: 67133 - DNA, 23 bp, Artificial Sequence
  Synthetic
ctgcaguagaaccctcaacctut

SEQ ID NO: 67134 - DNA, 22 bp, Artificial Sequence
  Synthetic
tcucaggaggguggaagaagac

SEQ ID NO: 67135 - DNA, 22 bp, Artificial Sequence
  Synthetic
gatggtttuggcagcatcauca

SEQ ID NO: 67136 - DNA, 20 bp, Artificial Sequence
  Synthetic
ctcagguagccgaugacagg

SEQ ID NO: 67137 - DNA, 20 bp, Artificial Sequence
  Synthetic
tcccctuctacccucaacga

SEQ ID NO: 67138 - DNA, 21 bp, Artificial Sequence
  Synthetic
gctgctcucagctttctuggt

SEQ ID NO: 67139 - DNA, 20 bp, Artificial Sequence
  Synthetic
cccagcagaaccaguacguc

SEQ ID NO: 67140 - DNA, 21 bp, Artificial Sequence
  Synthetic
gtccctguccttgtacugcac

SEQ ID NO: 67141 - DNA, 22 bp, Artificial Sequence
  Synthetic
ggcacctggcaucctctctaua

SEQ ID NO: 67142 - DNA, 21 bp, Artificial Sequence
  Synthetic
cacacctgucctgagccttua

SEQ ID NO: 67143 - DNA, 18 bp, Artificial Sequence
  Synthetic
ctguacggccuccacgag

SEQ ID NO: 67144 - DNA, 21 bp, Artificial Sequence
  Synthetic
ggaacttccuccaggagguga

SEQ ID NO: 67145 - DNA, 24 bp, Artificial Sequence
  Synthetic
agctttcccuaacccattctctug

SEQ ID NO: 67146 - DNA, 21 bp, Artificial Sequence
  Synthetic
ctcucaacccccacaactucc

SEQ ID NO: 67147 - DNA, 25 bp, Artificial Sequence
  Synthetic
gactcctctutgcattctctugact

SEQ ID NO: 67148 - DNA, 22 bp, Artificial Sequence
  Synthetic
aagtgagauggctgagcaugaa

SEQ ID NO: 67149 - DNA, 24 bp, Artificial Sequence
  Synthetic
ctgggcccaugttttgtatactug

SEQ ID NO: 67150 - DNA, 25 bp, Artificial Sequence
  Synthetic
cccataatcuaaacacactgugcct

SEQ ID NO: 67151 - DNA, 18 bp, Artificial Sequence
  Synthetic
ccaaucccagcccacuga

SEQ ID NO: 67152 - DNA, 22 bp, Artificial Sequence
  Synthetic
cgcagcattugaactcgatcug

SEQ ID NO: 67153 - DNA, 24 bp, Artificial Sequence
  Synthetic
cgtacctggcuatctgtgttcuct

SEQ ID NO: 67154 - DNA, 28 bp, Artificial Sequence
  Synthetic
ccagctctcauctttgctatttccauat

SEQ ID NO: 67155 - DNA, 29 bp, Artificial Sequence
  Synthetic
agttacataaatguacgtgcactgatcut

SEQ ID NO: 67156 - DNA, 24 bp, Artificial Sequence
  Synthetic
ctctcutcttagttgucccagcag

SEQ ID NO: 67157 - DNA, 22 bp, Artificial Sequence
  Synthetic
tgagtaagcaaaguggcagcut

SEQ ID NO: 67158 - DNA, 23 bp, Artificial Sequence
  Synthetic
gcutctttuaagccaacagcaca

SEQ ID NO: 67159 - DNA, 19 bp, Artificial Sequence
  Synthetic
cccgccacaggagucaaut

SEQ ID NO: 67160 - DNA, 20 bp, Artificial Sequence
  Synthetic
gacgttgucgccatcttgug

SEQ ID NO: 67161 - DNA, 27 bp, Artificial Sequence
  Synthetic
cttatactaucccgcccaaaaacaaug

SEQ ID NO: 67162 - DNA, 27 bp, Artificial Sequence
  Synthetic
gtcatcgctcugagaaatagagaucaa

SEQ ID NO: 67163 - DNA, 21 bp, Artificial Sequence
  Synthetic
gacagaacaccacgucaguct

SEQ ID NO: 67164 - DNA, 21 bp, Artificial Sequence
  Synthetic
cccatcucagagccaagugac

SEQ ID NO: 67165 - DNA, 28 bp, Artificial Sequence
  Synthetic
gcttgggagcacutcacatatacttuat

SEQ ID NO: 67166 - DNA, 22 bp, Artificial Sequence
  Synthetic
ctcagccacucagtguccaaat

SEQ ID NO: 67167 - DNA, 20 bp, Artificial Sequence
  Synthetic
aacatcctuctccggctugg

SEQ ID NO: 67168 - DNA, 25 bp, Artificial Sequence
  Synthetic
aagcaaataccutaacacctgcuct

SEQ ID NO: 67169 - DNA, 27 bp, Artificial Sequence
  Synthetic
gctgatctcuctgatgagtatugaagt

SEQ ID NO: 67170 - DNA, 31 bp, Artificial Sequence
  Synthetic
aacttatgtaaccucattttgttcatcucca

SEQ ID NO: 67171 - DNA, 27 bp, Artificial Sequence
  Synthetic
tggctctaaacuatgatggcatttgut

SEQ ID NO: 67172 - DNA, 33 bp, Artificial Sequence
  Synthetic
ttacttgtgtatatggutgtatacatatgcaut

SEQ ID NO: 67173 - DNA, 24 bp, Artificial Sequence
  Synthetic
cagtgtcaaccacaugtctgttuc

SEQ ID NO: 67174 - DNA, 28 bp, Artificial Sequence
  Synthetic
acagcttgatugcctgaagtatctatut

SEQ ID NO: 67175 - DNA, 25 bp, Artificial Sequence
  Synthetic
ggaaaaacatguagacggcaatugg

SEQ ID NO: 67176 - DNA, 21 bp, Artificial Sequence
  Synthetic
ctttucaccagcaacacccut

SEQ ID NO: 67177 - DNA, 27 bp, Artificial Sequence
  Synthetic
cagaatttgggaacuaggaagcatcut

SEQ ID NO: 67178 - DNA, 28 bp, Artificial Sequence
  Synthetic
cactgagtagaccgutagtaggagaaua

SEQ ID NO: 67179 - DNA, 32 bp, Artificial Sequence
  Synthetic
actaagtataaaccucaagctataaccattut

SEQ ID NO: 67180 - DNA, 20 bp, Artificial Sequence
  Synthetic
gcccttctuagcagcgagut

SEQ ID NO: 67181 - DNA, 22 bp, Artificial Sequence
  Synthetic
aaatctttaccugctgcccugt

SEQ ID NO: 67182 - DNA, 22 bp, Artificial Sequence
  Synthetic
tcccutttggactuggagcaaa

SEQ ID NO: 67183 - DNA, 25 bp, Artificial Sequence
  Synthetic
ggttatgaatuaagcacctgcacug

SEQ ID NO: 67184 - DNA, 23 bp, Artificial Sequence
  Synthetic
ggtctgaatcutgctcagctugt

SEQ ID NO: 67185 - DNA, 19 bp, Artificial Sequence
  Synthetic
caagaagtcugcgggcugt

SEQ ID NO: 67186 - DNA, 22 bp, Artificial Sequence
  Synthetic
ccatgctgugtcttccgaugaa

SEQ ID NO: 67187 - DNA, 28 bp, Artificial Sequence
  Synthetic
acactctaaagucctcaaatttgcucat

SEQ ID NO: 67188 - DNA, 27 bp, Artificial Sequence
  Synthetic
aattgaagtaauttcgcatttgugcct

SEQ ID NO: 67189 - DNA, 28 bp, Artificial Sequence
  Synthetic
ttttccttataagagugacttccgcaut

SEQ ID NO: 67190 - DNA, 29 bp, Artificial Sequence
  Synthetic
gactgtgatgttugtgttttctattgcut

SEQ ID NO: 67191 - DNA, 26 bp, Artificial Sequence
  Synthetic
actttgtaguccatttgctcugaaca

SEQ ID NO: 67192 - DNA, 22 bp, Artificial Sequence
  Synthetic
cttccgctaaucctgtctgugt

SEQ ID NO: 67193 - DNA, 22 bp, Artificial Sequence
  Synthetic
aggautttcatctugccaggct

SEQ ID NO: 67194 - DNA, 26 bp, Artificial Sequence
  Synthetic
gtaaagcatccaucctatctgggaut

SEQ ID NO: 67195 - DNA, 28 bp, Artificial Sequence
  Synthetic
tcttgggaaccutttcaatgtcatagut

SEQ ID NO: 67196 - DNA, 27 bp, Artificial Sequence
  Synthetic
gaagcgtugccatgtattttacuacag

SEQ ID NO: 67197 - DNA, 28 bp, Artificial Sequence
  Synthetic
tgutcagtgattucaaagacaacaacaa

SEQ ID NO: 67198 - DNA, 21 bp, Artificial Sequence
  Synthetic
ggcattcttugtcacccgtuc

SEQ ID NO: 67199 - DNA, 27 bp, Artificial Sequence
  Synthetic
gggaagcaatuagtttacctctgttuc

SEQ ID NO: 67200 - DNA, 25 bp, Artificial Sequence
  Synthetic
tgccagauccttcattauccagact

SEQ ID NO: 67201 - DNA, 27 bp, Artificial Sequence
  Synthetic
ttgtcttugaactgacgatuaagaggt

SEQ ID NO: 67202 - DNA, 19 bp, Artificial Sequence
  Synthetic
gtcgtcaguccggtctugt

SEQ ID NO: 67203 - DNA, 22 bp, Artificial Sequence
  Synthetic
ctctctccuttggaggcuagga

SEQ ID NO: 67204 - DNA, 18 bp, Artificial Sequence
  Synthetic
ctgctgaugcctgcucac

SEQ ID NO: 67205 - DNA, 27 bp, Artificial Sequence
  Synthetic
gtaaacagaauggtgctaatgcucaaa

SEQ ID NO: 67206 - DNA, 19 bp, Artificial Sequence
  Synthetic
ctgcagggutccagtguca

SEQ ID NO: 67207 - DNA, 20 bp, Artificial Sequence
  Synthetic
ggtccucccctcuagcacag

SEQ ID NO: 67208 - DNA, 21 bp, Artificial Sequence
  Synthetic
ctggtcaccaugaatcccugt

SEQ ID NO: 67209 - DNA, 24 bp, Artificial Sequence
  Synthetic
cccataggcaaugaatgaaggtut

SEQ ID NO: 67210 - DNA, 21 bp, Artificial Sequence
  Synthetic
cttuaaacacggcucggagga

SEQ ID NO: 67211 - DNA, 21 bp, Artificial Sequence
  Synthetic
cttgguccaggccattucagt

SEQ ID NO: 67212 - DNA, 28 bp, Artificial Sequence
  Synthetic
gagaaaaacgucaagcagtaaacaugat

SEQ ID NO: 67213 - DNA, 27 bp, Artificial Sequence
  Synthetic
gggagaauacttactuccacagagaag

SEQ ID NO: 67214 - DNA, 26 bp, Artificial Sequence
  Synthetic
gtaggttgccauaccataatctucca

SEQ ID NO: 67215 - DNA, 27 bp, Artificial Sequence
  Synthetic
ccaactcactutccatcatctcuagat

SEQ ID NO: 67216 - DNA, 29 bp, Artificial Sequence
  Synthetic
gaacagcuacaagaagagatuaagagact

SEQ ID NO: 67217 - DNA, 26 bp, Artificial Sequence
  Synthetic
agtatagagtgugttcctgatgcuaa

SEQ ID NO: 67218 - DNA, 24 bp, Artificial Sequence
  Synthetic
tgctcttgucagtcaaauccaact

SEQ ID NO: 67219 - DNA, 29 bp, Artificial Sequence
  Synthetic
ttcaacaacctggcuttctaattctgaua

SEQ ID NO: 67220 - DNA, 27 bp, Artificial Sequence
  Synthetic
agttacugaaagaggaatgtgguacct

SEQ ID NO: 67221 - DNA, 25 bp, Artificial Sequence
  Synthetic
tgagttgcatuttggtttgtcauct

SEQ ID NO: 67222 - DNA, 25 bp, Artificial Sequence
  Synthetic
gcacattctgaugcttaccagacua

SEQ ID NO: 67223 - DNA, 25 bp, Artificial Sequence
  Synthetic
ctgatgctaugtcaaatcccugact

SEQ ID NO: 67224 - DNA, 23 bp, Artificial Sequence
  Synthetic
aggtgctttcuctcactgaguct

SEQ ID NO: 67225 - DNA, 27 bp, Artificial Sequence
  Synthetic
catagtattcttuggttacctcggcut

SEQ ID NO: 67226 - DNA, 28 bp, Artificial Sequence
  Synthetic
gaatgcttuccatatgtcgtauaaaccc

SEQ ID NO: 67227 - DNA, 24 bp, Artificial Sequence
  Synthetic
gtctcttgtugcaggactuaggaa

SEQ ID NO: 67228 - DNA, 19 bp, Artificial Sequence
  Synthetic
gaccccaggcugaagauca

SEQ ID NO: 67229 - DNA, 17 bp, Artificial Sequence
  Synthetic
cgcuagggugggcgaac

SEQ ID NO: 67230 - DNA, 22 bp, Artificial Sequence
  Synthetic
gcatttaatgugtgctgccuct

SEQ ID NO: 67231 - DNA, 27 bp, Artificial Sequence
  Synthetic
guatttcaggatgaugagaaccacagt

SEQ ID NO: 67232 - DNA, 24 bp, Artificial Sequence
  Synthetic
ccaguggugaagaaggaaagagag

SEQ ID NO: 67233 - DNA, 28 bp, Artificial Sequence
  Synthetic
actgatttaauaaggcagauggaaagca

SEQ ID NO: 67234 - DNA, 22 bp, Artificial Sequence
  Synthetic
gcaagggucagggaaguaagag

SEQ ID NO: 67235 - DNA, 27 bp, Artificial Sequence
  Synthetic
catgtggttttucttcctttgcaaaug

SEQ ID NO: 67236 - DNA, 24 bp, Artificial Sequence
  Synthetic
gaaaatgcucacacaaguccacac

SEQ ID NO: 67237 - DNA, 27 bp, Artificial Sequence
  Synthetic
tccacaagctacugacttttgcttuat

SEQ ID NO: 67238 - DNA, 27 bp, Artificial Sequence
  Synthetic
gtgttgtttgaugctgatatcatggut

SEQ ID NO: 67239 - DNA, 23 bp, Artificial Sequence
  Synthetic
catacagacgacaauggugagca

SEQ ID NO: 67240 - DNA, 25 bp, Artificial Sequence
  Synthetic
cctaggttatcugggtgtttacgug

SEQ ID NO: 67241 - DNA, 28 bp, Artificial Sequence
  Synthetic
ctcagagtgugttgttctgtttauagga

SEQ ID NO: 67242 - DNA, 26 bp, Artificial Sequence
  Synthetic
tctgtgatacaaugatgttggcctut

SEQ ID NO: 67243 - DNA, 29 bp, Artificial Sequence
  Synthetic
tcttctgctccaucatcttgtctaaatuc

SEQ ID NO: 67244 - DNA, 22 bp, Artificial Sequence
  Synthetic
acagctgugatttgctucgaat

SEQ ID NO: 67245 - DNA, 26 bp, Artificial Sequence
  Synthetic
cagatctgaacuaattccgtctagug

SEQ ID NO: 67246 - DNA, 18 bp, Artificial Sequence
  Synthetic
gacaucgccagtgggugt

SEQ ID NO: 67247 - DNA, 20 bp, Artificial Sequence
  Synthetic
accctcugaccctgttcuct

SEQ ID NO: 67248 - DNA, 21 bp, Artificial Sequence
  Synthetic
gccagtcacauggatgctcug

SEQ ID NO: 67249 - DNA, 19 bp, Artificial Sequence
  Synthetic
cccctgaugcctgagcaua

SEQ ID NO: 67250 - DNA, 24 bp, Artificial Sequence
  Synthetic
gttgaattccaugtttgggtgcut

SEQ ID NO: 67251 - DNA, 24 bp, Artificial Sequence
  Synthetic
gcaaaccttugcacagtatcaucc

SEQ ID NO: 67252 - DNA, 28 bp, Artificial Sequence
  Synthetic
aagaaatccuacttagcgacaugaacaa

SEQ ID NO: 67253 - DNA, 29 bp, Artificial Sequence
  Synthetic
agcaaatttctaugagtcagccttaauga

SEQ ID NO: 67254 - DNA, 23 bp, Artificial Sequence
  Synthetic
gcaagcaaggaaugcctucaaaa

SEQ ID NO: 67255 - DNA, 20 bp, Artificial Sequence
  Synthetic
gctctagggugaccccacuc

SEQ ID NO: 67256 - DNA, 22 bp, Artificial Sequence
  Synthetic
atttttctuccaggcucaggct

SEQ ID NO: 67257 - DNA, 28 bp, Artificial Sequence
  Synthetic
ggtagcattttcucttccactcauagac

SEQ ID NO: 67258 - DNA, 23 bp, Artificial Sequence
  Synthetic
accaggaacutttgugacacact

SEQ ID NO: 67259 - DNA, 24 bp, Artificial Sequence
  Synthetic
tttcaccttcuttcccttcctucc

SEQ ID NO: 67260 - DNA, 22 bp, Artificial Sequence
  Synthetic
ggtcagucggacggattaucac

SEQ ID NO: 67261 - DNA, 27 bp, Artificial Sequence
  Synthetic
tgttccagtacccuctcatcttgaaua

SEQ ID NO: 67262 - DNA, 21 bp, Artificial Sequence
  Synthetic
accaggcggaaautgcuaagt

SEQ ID NO: 67263 - DNA, 23 bp, Artificial Sequence
  Synthetic
cctcacatgtaugtgtgcctcug

SEQ ID NO: 67264 - DNA, 23 bp, Artificial Sequence
  Synthetic
aagauatcuagggccaagaccca

SEQ ID NO: 67265 - DNA, 23 bp, Artificial Sequence
  Synthetic
atccuaccccagccatctaauga

SEQ ID NO: 67266 - DNA, 22 bp, Artificial Sequence
  Synthetic
cctcagutgagagtucgggagt

SEQ ID NO: 67267 - DNA, 24 bp, Artificial Sequence
  Synthetic
ggacagattcugtgatgccaugat

SEQ ID NO: 67268 - DNA, 25 bp, Artificial Sequence
  Synthetic
agtagtctattuagggccactccut

SEQ ID NO: 67269 - DNA, 22 bp, Artificial Sequence
  Synthetic
tgacttttgcutttggccctug

SEQ ID NO: 67270 - DNA, 21 bp, Artificial Sequence
  Synthetic
ccaccattcutccaggcauca

SEQ ID NO: 67271 - DNA, 26 bp, Artificial Sequence
  Synthetic
caaccttgttccutttctctcactuc

SEQ ID NO: 67272 - DNA, 22 bp, Artificial Sequence
  Synthetic
ccctgttucagattcaccucca

SEQ ID NO: 67273 - DNA, 26 bp, Artificial Sequence
  Synthetic
tcacgttggaaugtgctttttcttut

SEQ ID NO: 67274 - DNA, 21 bp, Artificial Sequence
  Synthetic
caggagccuccctgaaauact

SEQ ID NO: 67275 - DNA, 23 bp, Artificial Sequence
  Synthetic
catcttgcugagagaccatggua

SEQ ID NO: 67276 - DNA, 22 bp, Artificial Sequence
  Synthetic
ctctgtgucccaaacctccauc

SEQ ID NO: 67277 - DNA, 22 bp, Artificial Sequence
  Synthetic
gaggtggguggtaagaggttuc

SEQ ID NO: 67278 - DNA, 21 bp, Artificial Sequence
  Synthetic
gctgctcuacagccugaagaa

SEQ ID NO: 67279 - DNA, 21 bp, Artificial Sequence
  Synthetic
tctgagtgcutgccagactug

SEQ ID NO: 67280 - DNA, 20 bp, Artificial Sequence
  Synthetic
tgctggcgaaugacgtctut

SEQ ID NO: 67281 - DNA, 27 bp, Artificial Sequence
  Synthetic
tgattttggctuctctcagaaacucat

SEQ ID NO: 67282 - DNA, 27 bp, Artificial Sequence
  Synthetic
ttatggaatgctuaatgtcagtgguca

SEQ ID NO: 67283 - DNA, 24 bp, Artificial Sequence
  Synthetic
gatgcccugttcacaattugacaa

SEQ ID NO: 67284 - DNA, 24 bp, Artificial Sequence
  Synthetic
tgaatcctucaaacgtgcugacat

SEQ ID NO: 67285 - DNA, 27 bp, Artificial Sequence
  Synthetic
tgaacaacttcugctcatgacaaacua

SEQ ID NO: 67286 - DNA, 22 bp, Artificial Sequence
  Synthetic
tcacctacugaactctgccugt

SEQ ID NO: 67287 - DNA, 24 bp, Artificial Sequence
  Synthetic
gaucatccaagaaucgccgaaaag

SEQ ID NO: 67288 - DNA, 26 bp, Artificial Sequence
  Synthetic
gtgtgtcuaacaagaaagctacugct

SEQ ID NO: 67289 - DNA, 22 bp, Artificial Sequence
  Synthetic
cccggtctgucattcaccatut

SEQ ID NO: 67290 - DNA, 22 bp, Artificial Sequence
  Synthetic
cggttttggguatgggtacugt

SEQ ID NO: 67291 - DNA, 21 bp, Artificial Sequence
  Synthetic
ctacccaugcaggtcagagug

SEQ ID NO: 67292 - DNA, 20 bp, Artificial Sequence
  Synthetic
ggcaggacccuggtgaauaa

SEQ ID NO: 67293 - DNA, 24 bp, Artificial Sequence
  Synthetic
gcttctggucctcagtguaaacag

SEQ ID NO: 67294 - DNA, 27 bp, Artificial Sequence
  Synthetic
atttcagagagaaaagcautcagctua

SEQ ID NO: 67295 - DNA, 24 bp, Artificial Sequence
  Synthetic
cactatgguaaccaagcuccacag

SEQ ID NO: 67296 - DNA, 23 bp, Artificial Sequence
  Synthetic
tgctgcctcutaaaacgctcaua

SEQ ID NO: 67297 - DNA, 24 bp, Artificial Sequence
  Synthetic
catctguaaaaggcatttcugcca

SEQ ID NO: 67298 - DNA, 22 bp, Artificial Sequence
  Synthetic
ccttctucctgtgtcucgagga

SEQ ID NO: 67299 - DNA, 22 bp, Artificial Sequence
  Synthetic
gccaaacacgaugatgccatug

SEQ ID NO: 67300 - DNA, 20 bp, Artificial Sequence
  Synthetic
cagatcuggaggtugcggaa

SEQ ID NO: 67301 - DNA, 22 bp, Artificial Sequence
  Synthetic
gggacctcugtggtttcttugg

SEQ ID NO: 67302 - DNA, 20 bp, Artificial Sequence
  Synthetic
tggccagutggaactuggac

SEQ ID NO: 67303 - DNA, 24 bp, Artificial Sequence
  Synthetic
gatcucaggaaacacagucaacct

SEQ ID NO: 67304 - DNA, 20 bp, Artificial Sequence
  Synthetic
ggcuggccgaggagtaaaua

SEQ ID NO: 67305 - DNA, 22 bp, Artificial Sequence
  Synthetic
caugcagggattugacagcaag

SEQ ID NO: 67306 - DNA, 26 bp, Artificial Sequence
  Synthetic
gcacctaaatugtgcatgcttatuct

SEQ ID NO: 67307 - DNA, 25 bp, Artificial Sequence
  Synthetic
gttttccactggucttgttcatcug

SEQ ID NO: 67308 - DNA, 24 bp, Artificial Sequence
  Synthetic
tttacagcggaagutcagagugaa

SEQ ID NO: 67309 - DNA, 27 bp, Artificial Sequence
  Synthetic
gattatagagcaaacaguagcagucct

SEQ ID NO: 67310 - DNA, 28 bp, Artificial Sequence
  Synthetic
tgataacaatgugagtgcaaatctguct

SEQ ID NO: 67311 - DNA, 21 bp, Artificial Sequence
  Synthetic
ccccuggaacaacctccauat

SEQ ID NO: 67312 - DNA, 22 bp, Artificial Sequence
  Synthetic
cacucagcaggagaactgauga

SEQ ID NO: 67313 - DNA, 25 bp, Artificial Sequence
  Synthetic
ggcaaggugaaacactgatgauaga

SEQ ID NO: 67314 - DNA, 25 bp, Artificial Sequence
  Synthetic
cctgtugaagaaaagagcaacacut

SEQ ID NO: 67315 - DNA, 20 bp, Artificial Sequence
  Synthetic
cuggacagggaaagcacuga

SEQ ID NO: 67316 - DNA, 22 bp, Artificial Sequence
  Synthetic
actgccuacagtagcgtcuaca

SEQ ID NO: 67317 - DNA, 24 bp, Artificial Sequence
  Synthetic
gcatccuaggacagcagaactuag

SEQ ID NO: 67318 - DNA, 23 bp, Artificial Sequence
  Synthetic
caaagacagacaagcaaugcuca

SEQ ID NO: 67319 - DNA, 28 bp, Artificial Sequence
  Synthetic
tcttccatttttcugatctgcttccaut

SEQ ID NO: 67320 - DNA, 17 bp, Artificial Sequence
  Synthetic
caccccacccugaccut

SEQ ID NO: 67321 - DNA, 17 bp, Artificial Sequence
  Synthetic
gggauccccggctucct

SEQ ID NO: 67322 - DNA, 19 bp, Artificial Sequence
  Synthetic
ctacgccguggtgaccuac

SEQ ID NO: 67323 - DNA, 22 bp, Artificial Sequence
  Synthetic
gggactcugggctgugaaaaat

SEQ ID NO: 67324 - DNA, 21 bp, Artificial Sequence
  Synthetic
gactgacctuggcctactcuc

SEQ ID NO: 67325 - DNA, 23 bp, Artificial Sequence
  Synthetic
gtccttcccacutccaaatucca

SEQ ID NO: 67326 - DNA, 22 bp, Artificial Sequence
  Synthetic
cactgctuggctgttagctauc

SEQ ID NO: 67327 - DNA, 24 bp, Artificial Sequence
  Synthetic
tcaccaacttutccagcttcauct

SEQ ID NO: 67328 - DNA, 28 bp, Artificial Sequence
  Synthetic
gatatgcttugaggatgtatcuggacat

SEQ ID NO: 67329 - DNA, 26 bp, Artificial Sequence
  Synthetic
ctgacagaaaaauggaagaccucaga

SEQ ID NO: 67330 - DNA, 20 bp, Artificial Sequence
  Synthetic
gccguaggcagcctaaauca

SEQ ID NO: 67331 - DNA, 19 bp, Artificial Sequence
  Synthetic
ccacggauggctcggauac

SEQ ID NO: 67332 - DNA, 21 bp, Artificial Sequence
  Synthetic
tgattcccggcuctgagtuct

SEQ ID NO: 67333 - DNA, 22 bp, Artificial Sequence
  Synthetic
cacacacaugctgtccttugat

SEQ ID NO: 67334 - DNA, 23 bp, Artificial Sequence
  Synthetic
gtgaacacatuccctaaccccut

SEQ ID NO: 67335 - DNA, 19 bp, Artificial Sequence
  Synthetic
ggtgccagutgcgcaatut

SEQ ID NO: 67336 - DNA, 21 bp, Artificial Sequence
  Synthetic
ccaacuataacccugcaccct

SEQ ID NO: 67337 - DNA, 20 bp, Artificial Sequence
  Synthetic
tgatggagguggtgctctug

SEQ ID NO: 67338 - DNA, 22 bp, Artificial Sequence
  Synthetic
ggtgcacccuttccatgtcuat

SEQ ID NO: 67339 - DNA, 21 bp, Artificial Sequence
  Synthetic
ctctcctuacctcagguccgt

SEQ ID NO: 67340 - DNA, 22 bp, Artificial Sequence
  Synthetic
catcctatugtgagaccuggct

SEQ ID NO: 67341 - DNA, 20 bp, Artificial Sequence
  Synthetic
agttggccaaucagccucat

SEQ ID NO: 67342 - DNA, 27 bp, Artificial Sequence
  Synthetic
ggatagtagaacaugtccaaagggaug

SEQ ID NO: 67343 - DNA, 28 bp, Artificial Sequence
  Synthetic
ctctaagcagagugacaatuacagaact

SEQ ID NO: 67344 - DNA, 20 bp, Artificial Sequence
  Synthetic
gccagccggutgatcttuag

SEQ ID NO: 67345 - DNA, 28 bp, Artificial Sequence
  Synthetic
ctgtcgacacuatttctaacctttguca

SEQ ID NO: 67346 - DNA, 20 bp, Artificial Sequence
  Synthetic
gcaggtgugacgtcgucaat

SEQ ID NO: 67347 - DNA, 24 bp, Artificial Sequence
  Synthetic
gcctacctcugaaggcacatuaaa

SEQ ID NO: 67348 - DNA, 23 bp, Artificial Sequence
  Synthetic
actgctccagaaggutgctagua

SEQ ID NO: 67349 - DNA, 20 bp, Artificial Sequence
  Synthetic
caggtccauccacacauggt

SEQ ID NO: 67350 - DNA, 21 bp, Artificial Sequence
  Synthetic
agtggcagccuagtcctctua

SEQ ID NO: 67351 - DNA, 22 bp, Artificial Sequence
  Synthetic
cagagggacagaagucauggag

SEQ ID NO: 67352 - DNA, 20 bp, Artificial Sequence
  Synthetic
aggcagggucagtcuggaat

SEQ ID NO: 67353 - DNA, 19 bp, Artificial Sequence
  Synthetic
gcctugcgcaccagauagg

SEQ ID NO: 67354 - DNA, 30 bp, Artificial Sequence
  Synthetic
atgatctgctagugaatgagataagtcaua

SEQ ID NO: 67355 - DNA, 24 bp, Artificial Sequence
  Synthetic
acctacttacugtacctggugaca

SEQ ID NO: 67356 - DNA, 28 bp, Artificial Sequence
  Synthetic
tgtgagagaaugtggtauagaaaagcac

SEQ ID NO: 67357 - DNA, 28 bp, Artificial Sequence
  Synthetic
tccttcctaacaguttaccaaagtugaa

SEQ ID NO: 67358 - DNA, 28 bp, Artificial Sequence
  Synthetic
ggtgtaatagcugaagaggaagcataua

SEQ ID NO: 67359 - DNA, 31 bp, Artificial Sequence
  Synthetic
ggttaacctgcauaaaatttaatgtctucca

SEQ ID NO: 67360 - DNA, 27 bp, Artificial Sequence
  Synthetic
ttgaagcagcauatatattggcccuaa

SEQ ID NO: 67361 - DNA, 28 bp, Artificial Sequence
  Synthetic
ctgcaatgtcautcattagctttgaugt

SEQ ID NO: 67362 - DNA, 28 bp, Artificial Sequence
  Synthetic
tgttctggaataugctttggaaaguagg

SEQ ID NO: 67363 - DNA, 27 bp, Artificial Sequence
  Synthetic
tcattccttccugagctttcaagtaug

SEQ ID NO: 67364 - DNA, 25 bp, Artificial Sequence
  Synthetic
agaggugttcttgugacaaacagaa

SEQ ID NO: 67365 - DNA, 28 bp, Artificial Sequence
  Synthetic
catggcatcugtacagtgtctauaacaa

SEQ ID NO: 67366 - DNA, 21 bp, Artificial Sequence
  Synthetic
actcctguttaggcctugcag

SEQ ID NO: 67367 - DNA, 27 bp, Artificial Sequence
  Synthetic
tugtttagaaugaggagagaggcaaaa

SEQ ID NO: 67368 - DNA, 28 bp, Artificial Sequence
  Synthetic
agttctgttaaagutcatggcttttgug

SEQ ID NO: 67369 - DNA, 24 bp, Artificial Sequence
  Synthetic
agcgtttacgaucctctttcagug

SEQ ID NO: 67370 - DNA, 21 bp, Artificial Sequence
  Synthetic
acaggagtgugctccagauca

SEQ ID NO: 67371 - DNA, 21 bp, Artificial Sequence
  Synthetic
gccttcccuttcctcccuact

SEQ ID NO: 67372 - DNA, 25 bp, Artificial Sequence
  Synthetic
aaaaagaggccagacucacactuag

SEQ ID NO: 67373 - DNA, 24 bp, Artificial Sequence
  Synthetic
caaagggaaggcauatgucaccat

SEQ ID NO: 67374 - DNA, 21 bp, Artificial Sequence
  Synthetic
gtgcaucccaggtttcuaggt

SEQ ID NO: 67375 - DNA, 28 bp, Artificial Sequence
  Synthetic
gtgggatttggugagaacaagagatuat

SEQ ID NO: 67376 - DNA, 21 bp, Artificial Sequence
  Synthetic
cacggcaucaccaacttugac

SEQ ID NO: 67377 - DNA, 21 bp, Artificial Sequence
  Synthetic
cguatgugaccccaagaccat

SEQ ID NO: 67378 - DNA, 22 bp, Artificial Sequence
  Synthetic
aatttcccugggactgtugacc

SEQ ID NO: 67379 - DNA, 22 bp, Artificial Sequence
  Synthetic
gcccttacacuactggcaacut

SEQ ID NO: 67380 - DNA, 21 bp, Artificial Sequence
  Synthetic
ccugagaccccugaagagacc

SEQ ID NO: 67381 - DNA, 25 bp, Artificial Sequence
  Synthetic
gtgtgtatctgugcacctatgtcut

SEQ ID NO: 67382 - DNA, 21 bp, Artificial Sequence
  Synthetic
ccctgtttucctgccctgaug

SEQ ID NO: 67383 - DNA, 20 bp, Artificial Sequence
  Synthetic
caggatutgtccgucaccct

SEQ ID NO: 67384 - DNA, 21 bp, Artificial Sequence
  Synthetic
attgacccugatgtgcagugt

SEQ ID NO: 67385 - DNA, 24 bp, Artificial Sequence
  Synthetic
agtcatgtcccauttccattccuc

SEQ ID NO: 67386 - DNA, 27 bp, Artificial Sequence
  Synthetic
tcacatctttuccggtgtacataauca

SEQ ID NO: 67387 - DNA, 25 bp, Artificial Sequence
  Synthetic
gtgaacagtutcctgactauggagt

SEQ ID NO: 67388 - DNA, 26 bp, Artificial Sequence
  Synthetic
acccacacatucttgctcataaauca

SEQ ID NO: 67389 - DNA, 28 bp, Artificial Sequence
  Synthetic
cttcctgtcutcaaagaaagtuaaagca

SEQ ID NO: 67390 - DNA, 17 bp, Artificial Sequence
  Synthetic
ccagcutcccucagcgt

SEQ ID NO: 67391 - DNA, 21 bp, Artificial Sequence
  Synthetic
caugggcaacctctuggagaa

SEQ ID NO: 67392 - DNA, 20 bp, Artificial Sequence
  Synthetic
aatcgctgugcgtgtaguga

SEQ ID NO: 67393 - DNA, 25 bp, Artificial Sequence
  Synthetic
actttattuctctcatgugcaggct

SEQ ID NO: 67394 - DNA, 28 bp, Artificial Sequence
  Synthetic
gctgggcacuaaataatctccttatgua

SEQ ID NO: 67395 - DNA, 28 bp, Artificial Sequence
  Synthetic
gcagcaacatcuaaaactaaatgccuat

SEQ ID NO: 67396 - DNA, 28 bp, Artificial Sequence
  Synthetic
aaagaagaatgugttcataggaacugga

SEQ ID NO: 67397 - DNA, 25 bp, Artificial Sequence
  Synthetic
tccaaaagtgaaautcgcacaagut

SEQ ID NO: 67398 - DNA, 28 bp, Artificial Sequence
  Synthetic
ccttgagacugaaggaactgaagattut

SEQ ID NO: 67399 - DNA, 22 bp, Artificial Sequence
  Synthetic
aactuagagggcctgguaagga

SEQ ID NO: 67400 - DNA, 20 bp, Artificial Sequence
  Synthetic
ggattcguccccggatgtug

SEQ ID NO: 67401 - DNA, 27 bp, Artificial Sequence
  Synthetic
cacacttgucatgcactgaauagaaaa

SEQ ID NO: 67402 - DNA, 27 bp, Artificial Sequence
  Synthetic
tgtaggttttcutatgcagcttucagt

SEQ ID NO: 67403 - DNA, 28 bp, Artificial Sequence
  Synthetic
gtgacacatgaagugcaaagataatuct

SEQ ID NO: 67404 - DNA, 20 bp, Artificial Sequence
  Synthetic
gggactugtccttgcugacc

SEQ ID NO: 67405 - DNA, 23 bp, Artificial Sequence
  Synthetic
gcactcatcauccttgtctcugt

SEQ ID NO: 67406 - DNA, 20 bp, Artificial Sequence
  Synthetic
cagguaagugcaagcagcaa

SEQ ID NO: 67407 - DNA, 28 bp, Artificial Sequence
  Synthetic
cttcccattgaugcctttttctcttuat

SEQ ID NO: 67408 - DNA, 23 bp, Artificial Sequence
  Synthetic
ggatgcagaguagtgttcuccct

SEQ ID NO: 67409 - DNA, 26 bp, Artificial Sequence
  Synthetic
gcctgtctucagtctttaagaacuca

SEQ ID NO: 67410 - DNA, 20 bp, Artificial Sequence
  Synthetic
gcaacuggtagcuggaggac

SEQ ID NO: 67411 - DNA, 28 bp, Artificial Sequence
  Synthetic
gtgatgagcttugagttttctttctuct

SEQ ID NO: 67412 - DNA, 21 bp, Artificial Sequence
  Synthetic
gcaccaaugtcatgccucaag

SEQ ID NO: 67413 - DNA, 22 bp, Artificial Sequence
  Synthetic
ctgcgttagutccagtgacugt

SEQ ID NO: 67414 - DNA, 24 bp, Artificial Sequence
  Synthetic
ctgcaagugaactgttagcatucc

SEQ ID NO: 67415 - DNA, 29 bp, Artificial Sequence
  Synthetic
agttttctgtttcaaugttcgcttttcut

SEQ ID NO: 67416 - DNA, 27 bp, Artificial Sequence
  Synthetic
ctutcaataatttgacuggcacaagga

SEQ ID NO: 67417 - DNA, 28 bp, Artificial Sequence
  Synthetic
aaatgcacaccucaaaaggctaattuac

SEQ ID NO: 67418 - DNA, 27 bp, Artificial Sequence
  Synthetic
tcttgaaaggaacugaaatacgacgut

SEQ ID NO: 67419 - DNA, 22 bp, Artificial Sequence
  Synthetic
agcttgagcuttccaatcugct

SEQ ID NO: 67420 - DNA, 17 bp, Artificial Sequence
  Synthetic
cgucaugccgcccaaaa

SEQ ID NO: 67421 - DNA, 17 bp, Artificial Sequence
  Synthetic
cggctcugctcgcucac

SEQ ID NO: 67422 - DNA, 19 bp, Artificial Sequence
  Synthetic
cccggaggacccaugaauc

SEQ ID NO: 67423 - DNA, 21 bp, Artificial Sequence
  Synthetic
gtccacgcuggagattacugt

SEQ ID NO: 67424 - DNA, 22 bp, Artificial Sequence
  Synthetic
ctgccgaaaaucaggccttcua

SEQ ID NO: 67425 - DNA, 26 bp, Artificial Sequence
  Synthetic
cacgtaagcaccuttgtgttttctut

SEQ ID NO: 67426 - DNA, 21 bp, Artificial Sequence
  Synthetic
cacttggtccuggcagagaug

SEQ ID NO: 67427 - DNA, 22 bp, Artificial Sequence
  Synthetic
ctgatgugagcttctgtcuggt

SEQ ID NO: 67428 - DNA, 22 bp, Artificial Sequence
  Synthetic
ggtgagguggcacatgttcaua

SEQ ID NO: 67429 - DNA, 28 bp, Artificial Sequence
  Synthetic
ccaactatcaaagagutttcagcttcut

SEQ ID NO: 67430 - DNA, 17 bp, Artificial Sequence
  Synthetic
ggaacggccuggaguct

SEQ ID NO: 67431 - DNA, 17 bp, Artificial Sequence
  Synthetic
tcccucaccgggtccuc

SEQ ID NO: 67432 - DNA, 26 bp, Artificial Sequence
  Synthetic
aatgacaattcutttcaggttugcgt

SEQ ID NO: 67433 - DNA, 26 bp, Artificial Sequence
  Synthetic
acaactagaacagcaauggacauagg

SEQ ID NO: 67434 - DNA, 20 bp, Artificial Sequence
  Synthetic
ctccacgauggcgatgtuct

SEQ ID NO: 67435 - DNA, 20 bp, Artificial Sequence
  Synthetic
tggagaagcaguggtgtcug

SEQ ID NO: 67436 - DNA, 22 bp, Artificial Sequence
  Synthetic
tgggccatutcacaagtcaugt

SEQ ID NO: 67437 - DNA, 22 bp, Artificial Sequence
  Synthetic
cacactcacccutcctgtctug

SEQ ID NO: 67438 - DNA, 18 bp, Artificial Sequence
  Synthetic
ggugugcagcagggacag

SEQ ID NO: 67439 - DNA, 26 bp, Artificial Sequence
  Synthetic
cacctttttcuggctctactctctut

SEQ ID NO: 67440 - DNA, 20 bp, Artificial Sequence
  Synthetic
cggacttcuctagcgccuct

SEQ ID NO: 67441 - DNA, 22 bp, Artificial Sequence
  Synthetic
aggctcagcacucctttcaaug

SEQ ID NO: 67442 - DNA, 21 bp, Artificial Sequence
  Synthetic
tctgtggcautcatggcaugt

SEQ ID NO: 67443 - DNA, 25 bp, Artificial Sequence
  Synthetic
actgtggctgaauctctcaaagtug

SEQ ID NO: 67444 - DNA, 21 bp, Artificial Sequence
  Synthetic
gtcucagggaaccagcaugaa

SEQ ID NO: 67445 - DNA, 29 bp, Artificial Sequence
  Synthetic
agccataagcccaauagataaaaugacat

SEQ ID NO: 67446 - DNA, 28 bp, Artificial Sequence
  Synthetic
ggaagtgttuaaaacctataacgtugct

SEQ ID NO: 67447 - DNA, 21 bp, Artificial Sequence
  Synthetic
gatatgccugctggagucgaa

SEQ ID NO: 67448 - DNA, 27 bp, Artificial Sequence
  Synthetic
tctagatttaguggctgttttgtgucc

SEQ ID NO: 67449 - DNA, 27 bp, Artificial Sequence
  Synthetic
gtgcttcagtuccgataaattcuacac

SEQ ID NO: 67450 - DNA, 26 bp, Artificial Sequence
  Synthetic
atgcagttgaugactgtcataucgaa

SEQ ID NO: 67451 - DNA, 21 bp, Artificial Sequence
  Synthetic
aggctgcauaatccacacugg

SEQ ID NO: 67452 - DNA, 24 bp, Artificial Sequence
  Synthetic
cctgaaaguagacttaggcugcac

SEQ ID NO: 67453 - DNA, 26 bp, Artificial Sequence
  Synthetic
ggtgaagggaauatctcgttctcauc

SEQ ID NO: 67454 - DNA, 25 bp, Artificial Sequence
  Synthetic
agaaaactgaagaauccacgcugaa

SEQ ID NO: 67455 - DNA, 28 bp, Artificial Sequence
  Synthetic
acagtttttgcuctggtgaattacauct

SEQ ID NO: 67456 - DNA, 22 bp, Artificial Sequence
  Synthetic
gaaattcaggcccuccaggaut

SEQ ID NO: 67457 - DNA, 25 bp, Artificial Sequence
  Synthetic
agatacaucccaccatgaucaggat

SEQ ID NO: 67458 - DNA, 22 bp, Artificial Sequence
  Synthetic
gggaacaggcuctgaaacctuc

SEQ ID NO: 67459 - DNA, 26 bp, Artificial Sequence
  Synthetic
gagtaaatgagcugtggtttctcuct

SEQ ID NO: 67460 - DNA, 26 bp, Artificial Sequence
  Synthetic
catgaaatcugagcctacatgaggut

SEQ ID NO: 67461 - DNA, 23 bp, Artificial Sequence
  Synthetic
ctgccatttcauttccccttgut

SEQ ID NO: 67462 - DNA, 22 bp, Artificial Sequence
  Synthetic
acgaugctcauggaaacccaat

SEQ ID NO: 67463 - DNA, 20 bp, Artificial Sequence
  Synthetic
cggactcgcugaacttgugg

SEQ ID NO: 67464 - DNA, 23 bp, Artificial Sequence
  Synthetic
aaggaaacaguaagccactgcut

SEQ ID NO: 67465 - DNA, 21 bp, Artificial Sequence
  Synthetic
atcctgcauggctttggauga

SEQ ID NO: 67466 - DNA, 22 bp, Artificial Sequence
  Synthetic
gccactggcutcttctttguga

SEQ ID NO: 67467 - DNA, 24 bp, Artificial Sequence
  Synthetic
ctccttccagcucttacaactcug

SEQ ID NO: 67468 - DNA, 26 bp, Artificial Sequence
  Synthetic
gatatcactgcugcatatctgtcugt

SEQ ID NO: 67469 - DNA, 22 bp, Artificial Sequence
  Synthetic
gccttugccacactggtttuaa

SEQ ID NO: 67470 - DNA, 27 bp, Artificial Sequence
  Synthetic
acatttataggucccacgaaggtttuc

SEQ ID NO: 67471 - DNA, 27 bp, Artificial Sequence
  Synthetic
gacagagtgtuctctttccagugaaat

SEQ ID NO: 67472 - DNA, 20 bp, Artificial Sequence
  Synthetic
agttggaaugcagcguccat

SEQ ID NO: 67473 - DNA, 23 bp, Artificial Sequence
  Synthetic
gaccttugcccaaagagtaucct

SEQ ID NO: 67474 - DNA, 21 bp, Artificial Sequence
  Synthetic
gggctgggaugggatattcug

SEQ ID NO: 67475 - DNA, 21 bp, Artificial Sequence
  Synthetic
gatgtucgcccaggatacugt

SEQ ID NO: 67476 - DNA, 28 bp, Artificial Sequence
  Synthetic
ttgtcattaaaccuacctatgcatcugg

SEQ ID NO: 67477 - DNA, 25 bp, Artificial Sequence
  Synthetic
tgagtccttcuactgacgaatggut

SEQ ID NO: 67478 - DNA, 27 bp, Artificial Sequence
  Synthetic
gacatgttagacutactggatcuggag

SEQ ID NO: 67479 - DNA, 27 bp, Artificial Sequence
  Synthetic
catgtgcuaacagacctctggtttaut

SEQ ID NO: 67480 - DNA, 17 bp, Artificial Sequence
  Synthetic
ggccccacacccauguc

SEQ ID NO: 67481 - DNA, 20 bp, Artificial Sequence
  Synthetic
ggagguggcagggagtacut

SEQ ID NO: 67482 - DNA, 25 bp, Artificial Sequence
  Synthetic
cactcacatcucctcttccattuct

SEQ ID NO: 67483 - DNA, 27 bp, Artificial Sequence
  Synthetic
tgagtctttactcugcctctctacauc

SEQ ID NO: 67484 - DNA, 21 bp, Artificial Sequence
  Synthetic
gaccccuccctccatcctuaa

SEQ ID NO: 67485 - DNA, 24 bp, Artificial Sequence
  Synthetic
cgtggaatgauggtgataacacug

SEQ ID NO: 67486 - DNA, 20 bp, Artificial Sequence
  Synthetic
ctcccacauccccgaggaua

SEQ ID NO: 67487 - DNA, 19 bp, Artificial Sequence
  Synthetic
ccauccggtcacucgaaga

SEQ ID NO: 67488 - DNA, 20 bp, Artificial Sequence
  Synthetic
gctggtagacgucctctgug

SEQ ID NO: 67489 - DNA, 20 bp, Artificial Sequence
  Synthetic
ccaaggtauccccggatgug

SEQ ID NO: 67490 - DNA, 19 bp, Artificial Sequence
  Synthetic
gcgagugaaacggcuacga

SEQ ID NO: 67491 - DNA, 17 bp, Artificial Sequence
  Synthetic
gccutcuaggcgacgca

SEQ ID NO: 67492 - DNA, 17 bp, Artificial Sequence
  Synthetic
acgtgcucccccucact

SEQ ID NO: 67493 - DNA, 19 bp, Artificial Sequence
  Synthetic
ggtggacuctggugccaac

SEQ ID NO: 67494 - DNA, 21 bp, Artificial Sequence
  Synthetic
gccggguttcttctugaagca

SEQ ID NO: 67495 - DNA, 24 bp, Artificial Sequence
  Synthetic
ccctuagaatgaagtugagagcgt

SEQ ID NO: 67496 - DNA, 21 bp, Artificial Sequence
  Synthetic
ccacugggctgttgaugaagt

SEQ ID NO: 67497 - DNA, 28 bp, Artificial Sequence
  Synthetic
gtctgattcugaccctgttaccttatuc

SEQ ID NO: 67498 - DNA, 26 bp, Artificial Sequence
  Synthetic
acgaaagaaaagutacataccuggct

SEQ ID NO: 67499 - DNA, 19 bp, Artificial Sequence
  Synthetic
gugaccgaaacggcaguct

SEQ ID NO: 67500 - DNA, 22 bp, Artificial Sequence
  Synthetic
tguggcagaaaccacatcucat

SEQ ID NO: 67501 - DNA, 27 bp, Artificial Sequence
  Synthetic
gtcatttcaccaucatcattcccttuc

SEQ ID NO: 67502 - DNA, 20 bp, Artificial Sequence
  Synthetic
ccuccccgcagtcttucaat

SEQ ID NO: 67503 - DNA, 21 bp, Artificial Sequence
  Synthetic
ccccttccacauctgtgtcut

SEQ ID NO: 67504 - DNA, 21 bp, Artificial Sequence
  Synthetic
ccatccugccccttgttctua

SEQ ID NO: 67505 - DNA, 22 bp, Artificial Sequence
  Synthetic
tgaagggcguagagaaggugat

SEQ ID NO: 67506 - DNA, 24 bp, Artificial Sequence
  Synthetic
ccagggaucccaacagaaauaaga

SEQ ID NO: 67507 - DNA, 17 bp, Artificial Sequence
  Synthetic
gcacuggacccgctcug

SEQ ID NO: 67508 - DNA, 19 bp, Artificial Sequence
  Synthetic
tcacgugacaccgtcugag

SEQ ID NO: 67509 - DNA, 28 bp, Artificial Sequence
  Synthetic
cttaugggaaaagtatucagcaaacaca

SEQ ID NO: 67510 - DNA, 21 bp, Artificial Sequence
  Synthetic
cggccccaagagutgatttut

SEQ ID NO: 67511 - DNA, 25 bp, Artificial Sequence
  Synthetic
cgactggcucaagactatttcauct

SEQ ID NO: 67512 - DNA, 21 bp, Artificial Sequence
  Synthetic
gggccctuagcttatgtccut

SEQ ID NO: 67513 - DNA, 21 bp, Artificial Sequence
  Synthetic
ctcagcagugtacctggtcug

SEQ ID NO: 67514 - DNA, 23 bp, Artificial Sequence
  Synthetic
gacatgaaatuagcctcccgcua

SEQ ID NO: 67515 - DNA, 22 bp, Artificial Sequence
  Synthetic
ccactguggacaagactgttug

SEQ ID NO: 67516 - DNA, 20 bp, Artificial Sequence
  Synthetic
gggaaaacgcaucctctuga

SEQ ID NO: 67517 - DNA, 23 bp, Artificial Sequence
  Synthetic
gtcaatgagautccctgggucat

SEQ ID NO: 67518 - DNA, 22 bp, Artificial Sequence
  Synthetic
ccggcccagagaugttttuagt

SEQ ID NO: 67519 - DNA, 28 bp, Artificial Sequence
  Synthetic
aagaacaaatgtuacctgcagatuagga

SEQ ID NO: 67520 - DNA, 21 bp, Artificial Sequence
  Synthetic
cttcagccucctgcagatgut

SEQ ID NO: 67521 - DNA, 22 bp, Artificial Sequence
  Synthetic
aaaaccacaaagccuccagcua

SEQ ID NO: 67522 - DNA, 24 bp, Artificial Sequence
  Synthetic
gctaaacccagutgtggaagucat

SEQ ID NO: 67523 - DNA, 21 bp, Artificial Sequence
  Synthetic
aatgccgaagagguggagtuc

SEQ ID NO: 67524 - DNA, 21 bp, Artificial Sequence
  Synthetic
ggacagcuctcacatctgugt

SEQ ID NO: 67525 - DNA, 22 bp, Artificial Sequence
  Synthetic
ggccagaagagugatgaggaug

SEQ ID NO: 67526 - DNA, 25 bp, Artificial Sequence
  Synthetic
tttttgtgaautgtccccauagggt

SEQ ID NO: 67527 - DNA, 24 bp, Artificial Sequence
  Synthetic
atcctgagagaagccugtacauct

SEQ ID NO: 67528 - DNA, 24 bp, Artificial Sequence
  Synthetic
tcctctucaacactgtactuggga

SEQ ID NO: 67529 - DNA, 23 bp, Artificial Sequence
  Synthetic
ggttguacagcctcccuagagat

SEQ ID NO: 67530 - DNA, 18 bp, Artificial Sequence
  Synthetic
cccuacccaggccgcuat

SEQ ID NO: 67531 - DNA, 22 bp, Artificial Sequence
  Synthetic
ggcactgcugtctttttcauca

SEQ ID NO: 67532 - DNA, 21 bp, Artificial Sequence
  Synthetic
cutcctacagtuccacaccgt

SEQ ID NO: 67533 - DNA, 21 bp, Artificial Sequence
  Synthetic
caggttcucagggagcttguc

SEQ ID NO: 67534 - DNA, 21 bp, Artificial Sequence
  Synthetic
cctccaugcgcucaaaaggaa

SEQ ID NO: 67535 - DNA, 23 bp, Artificial Sequence
  Synthetic
tggctttctugggagaagacauc

SEQ ID NO: 67536 - DNA, 20 bp, Artificial Sequence
  Synthetic
ctctccuccacgatgcacut

SEQ ID NO: 67537 - DNA, 25 bp, Artificial Sequence
  Synthetic
ccttgagtttuggcttcttttuggg

SEQ ID NO: 67538 - DNA, 28 bp, Artificial Sequence
  Synthetic
ctgtttgtucagaagacaatgttgaugt

SEQ ID NO: 67539 - DNA, 28 bp, Artificial Sequence
  Synthetic
agtttggtgttcuagttcagcacaatua

SEQ ID NO: 67540 - DNA, 26 bp, Artificial Sequence
  Synthetic
gagtcucaaacaggaagacaacucaa

SEQ ID NO: 67541 - DNA, 27 bp, Artificial Sequence
  Synthetic
catgatccauggacatttgactgguat

SEQ ID NO: 67542 - DNA, 28 bp, Artificial Sequence
  Synthetic
tggtccaugcaattcaaauaaaaacgaa

SEQ ID NO: 67543 - DNA, 24 bp, Artificial Sequence
  Synthetic
cctccuttctaccaauaaccgcat

SEQ ID NO: 67544 - DNA, 28 bp, Artificial Sequence
  Synthetic
acttcagagtatugccaatcatgttcuc

SEQ ID NO: 67545 - DNA, 24 bp, Artificial Sequence
  Synthetic
agcaacugagtaaguggcaagaaa

SEQ ID NO: 67546 - DNA, 24 bp, Artificial Sequence
  Synthetic
acttgcauggactgtgttatuggt

SEQ ID NO: 67547 - DNA, 22 bp, Artificial Sequence
  Synthetic
gagctagttcugtccactgguc

SEQ ID NO: 67548 - DNA, 27 bp, Artificial Sequence
  Synthetic
ttctgttttccuaaaaggcactugaga

SEQ ID NO: 67549 - DNA, 26 bp, Artificial Sequence
  Synthetic
acactgauacccaaaatgaaugcact

SEQ ID NO: 67550 - DNA, 21 bp, Artificial Sequence
  Synthetic
caagagggaagggutggtcug

SEQ ID NO: 67551 - DNA, 21 bp, Artificial Sequence
  Synthetic
cccccauctgtgcctuaagag

SEQ ID NO: 67552 - DNA, 17 bp, Artificial Sequence
  Synthetic
ccgcccucaaggccauc

SEQ ID NO: 67553 - DNA, 23 bp, Artificial Sequence
  Synthetic
tgtcatatuccccgtccatcuca

SEQ ID NO: 67554 - DNA, 23 bp, Artificial Sequence
  Synthetic
ggttagaagacaaguccctguca

SEQ ID NO: 67555 - DNA, 22 bp, Artificial Sequence
  Synthetic
ctacagagggaucaccaugacc

SEQ ID NO: 67556 - DNA, 19 bp, Artificial Sequence
  Synthetic
gggcagutcttggtcucgt

SEQ ID NO: 67557 - DNA, 21 bp, Artificial Sequence
  Synthetic
ctacugacaacgcccctctuc

SEQ ID NO: 67558 - DNA, 24 bp, Artificial Sequence
  Synthetic
ccatagctctucctccctactcut

SEQ ID NO: 67559 - DNA, 18 bp, Artificial Sequence
  Synthetic
gauacggugcacgcacag

SEQ ID NO: 67560 - DNA, 23 bp, Artificial Sequence
  Synthetic
gcaaatcagugctgcagauacga

SEQ ID NO: 67561 - DNA, 20 bp, Artificial Sequence
  Synthetic
cctaagacuccgtgggaugg

SEQ ID NO: 67562 - DNA, 20 bp, Artificial Sequence
  Synthetic
accaggaucaccctguggaa

SEQ ID NO: 67563 - DNA, 23 bp, Artificial Sequence
  Synthetic
gcautgctgttuagcaggaacac

SEQ ID NO: 67564 - DNA, 19 bp, Artificial Sequence
  Synthetic
tgacagggutcccgaguga

SEQ ID NO: 67565 - DNA, 17 bp, Artificial Sequence
  Synthetic
gcagccccucctgguag

SEQ ID NO: 67566 - DNA, 18 bp, Artificial Sequence
  Synthetic
gcacucagagggcgcauc

SEQ ID NO: 67567 - DNA, 17 bp, Artificial Sequence
  Synthetic
ggugccgaggcatugac

SEQ ID NO: 67568 - DNA, 28 bp, Artificial Sequence
  Synthetic
ccuatgtaactgaguaagacagggagaa

SEQ ID NO: 67569 - DNA, 27 bp, Artificial Sequence
  Synthetic
gttggtaaaaguggtttcuaacacagt

SEQ ID NO: 67570 - DNA, 19 bp, Artificial Sequence
  Synthetic
gaaauaucgcgcccaggga

SEQ ID NO: 67571 - DNA, 22 bp, Artificial Sequence
  Synthetic
gcagtggugacaggaugaacac

SEQ ID NO: 67572 - DNA, 21 bp, Artificial Sequence
  Synthetic
ccaccgaucctcttcctucat

SEQ ID NO: 67573 - DNA, 25 bp, Artificial Sequence
  Synthetic
ggaatccatuagaggacacactcug

SEQ ID NO: 67574 - DNA, 26 bp, Artificial Sequence
  Synthetic
ctgctgggcuaaatcatcaggaatua

SEQ ID NO: 67575 - DNA, 25 bp, Artificial Sequence
  Synthetic
caatccaggaaagcugtcttcttut

SEQ ID NO: 67576 - DNA, 23 bp, Artificial Sequence
  Synthetic
agagacaaaauggccaagcauca

SEQ ID NO: 67577 - DNA, 20 bp, Artificial Sequence
  Synthetic
tucaatcugacacggcccaa

SEQ ID NO: 67578 - DNA, 25 bp, Artificial Sequence
  Synthetic
atgatttcagcuaacaggtuacgct

SEQ ID NO: 67579 - DNA, 23 bp, Artificial Sequence
  Synthetic
cccaacaaagacaucctgtguga

SEQ ID NO: 67580 - DNA, 29 bp, Artificial Sequence
  Synthetic
aacaacaacgacaucatccaggataauaa

SEQ ID NO: 67581 - DNA, 24 bp, Artificial Sequence
  Synthetic
accaaataaucacaaccgcctuca

SEQ ID NO: 67582 - DNA, 21 bp, Artificial Sequence
  Synthetic
cgguaccgagaggaacuacag

SEQ ID NO: 67583 - DNA, 18 bp, Artificial Sequence
  Synthetic
cacccuccacuccagcag

SEQ ID NO: 67584 - DNA, 21 bp, Artificial Sequence
  Synthetic
acccgacaaacutcccgauag

SEQ ID NO: 67585 - DNA, 22 bp, Artificial Sequence
  Synthetic
aactcuaaggagtgccugcaag

SEQ ID NO: 67586 - DNA, 21 bp, Artificial Sequence
  Synthetic
gctggacagcugttggtucat

SEQ ID NO: 67587 - DNA, 19 bp, Artificial Sequence
  Synthetic
gcttccccgugttggaguc

SEQ ID NO: 67588 - DNA, 21 bp, Artificial Sequence
  Synthetic
gttugccacaagcatcucaca

SEQ ID NO: 67589 - DNA, 19 bp, Artificial Sequence
  Synthetic
ggtcggucaggcttcaguc

SEQ ID NO: 67590 - DNA, 28 bp, Artificial Sequence
  Synthetic
tcaatactacuacaaaccttggauccga

SEQ ID NO: 67591 - DNA, 23 bp, Artificial Sequence
  Synthetic
aggtctttccugcagacatugac

SEQ ID NO: 67592 - DNA, 21 bp, Artificial Sequence
  Synthetic
ggcaagugcagaactcaaguc

SEQ ID NO: 67593 - DNA, 23 bp, Artificial Sequence
  Synthetic
tgctcactugatgaactggtugt

SEQ ID NO: 67594 - DNA, 23 bp, Artificial Sequence
  Synthetic
ccagauccccagtcctatuggat

SEQ ID NO: 67595 - DNA, 21 bp, Artificial Sequence
  Synthetic
gtgcccagaaugagaggugaa

SEQ ID NO: 67596 - DNA, 24 bp, Artificial Sequence
  Synthetic
ctttggatgtcugtctctctcugg

SEQ ID NO: 67597 - DNA, 22 bp, Artificial Sequence
  Synthetic
cgtccaccaucacctcaaagua

SEQ ID NO: 67598 - DNA, 22 bp, Artificial Sequence
  Synthetic
cgaccctgacuacgaaaaccug

SEQ ID NO: 67599 - DNA, 25 bp, Artificial Sequence
  Synthetic
actcaccctcucttcttgttctuct

SEQ ID NO: 67600 - DNA, 21 bp, Artificial Sequence
  Synthetic
gtccttctaugccgcctugat

SEQ ID NO: 67601 - DNA, 18 bp, Artificial Sequence
  Synthetic
ctcacuccgtgucaccga

SEQ ID NO: 67602 - DNA, 20 bp, Artificial Sequence
  Synthetic
tgggattccugcacgtgtuc

SEQ ID NO: 67603 - DNA, 23 bp, Artificial Sequence
  Synthetic
gaaagaggauggattuggccact

SEQ ID NO: 67604 - DNA, 17 bp, Artificial Sequence
  Synthetic
ggtggccgugaccgaug

SEQ ID NO: 67605 - DNA, 23 bp, Artificial Sequence
  Synthetic
tccaaucccccatcttuccaaaa

SEQ ID NO: 67606 - DNA, 22 bp, Artificial Sequence
  Synthetic
tctacacagccugatgctcuct

SEQ ID NO: 67607 - DNA, 21 bp, Artificial Sequence
  Synthetic
agtgtcagacuccagucacct

SEQ ID NO: 67608 - DNA, 19 bp, Artificial Sequence
  Synthetic
gctgucgccggttctugaa

SEQ ID NO: 67609 - DNA, 20 bp, Artificial Sequence
  Synthetic
cgcaguggacaagtaucgac

SEQ ID NO: 67610 - DNA, 20 bp, Artificial Sequence
  Synthetic
gctctcgaguagccgguaga

SEQ ID NO: 67611 - DNA, 17 bp, Artificial Sequence
  Synthetic
gcutcucgcccgagcag

SEQ ID NO: 67612 - DNA, 25 bp, Artificial Sequence
  Synthetic
gctacttaaagggaauggtggctut

SEQ ID NO: 67613 - DNA, 23 bp, Artificial Sequence
  Synthetic
gtaaccaagguggtctttgctut

SEQ ID NO: 67614 - DNA, 22 bp, Artificial Sequence
  Synthetic
ggguagcagaggacaagtctuc

SEQ ID NO: 67615 - DNA, 26 bp, Artificial Sequence
  Synthetic
agtgttggagtauctgcctaagtcut

SEQ ID NO: 67616 - DNA, 23 bp, Artificial Sequence
  Synthetic
cagagcgggccutaatctcatua

SEQ ID NO: 67617 - DNA, 20 bp, Artificial Sequence
  Synthetic
gatctggcugggaggtgtuc

SEQ ID NO: 67618 - DNA, 20 bp, Artificial Sequence
  Synthetic
cccaagaauggaagggcauc

SEQ ID NO: 67619 - DNA, 21 bp, Artificial Sequence
  Synthetic
tgtctgccautctggccttuc

SEQ ID NO: 67620 - DNA, 22 bp, Artificial Sequence
  Synthetic
gcctgcttcuggcatagaguat

SEQ ID NO: 67621 - DNA, 20 bp, Artificial Sequence
  Synthetic
cacagcguctacctgacuca

SEQ ID NO: 67622 - DNA, 21 bp, Artificial Sequence
  Synthetic
cagtcacucagttcgccauca

SEQ ID NO: 67623 - DNA, 21 bp, Artificial Sequence
  Synthetic
cctgagaccaugcgtatgucc

SEQ ID NO: 67624 - DNA, 17 bp, Artificial Sequence
  Synthetic
ggcugcgggagcaucaa

SEQ ID NO: 67625 - DNA, 17 bp, Artificial Sequence
  Synthetic
ccguggccgaagtccug

SEQ ID NO: 67626 - DNA, 25 bp, Artificial Sequence
  Synthetic
ggtacugacatgcaugaacaagaac

SEQ ID NO: 67627 - DNA, 29 bp, Artificial Sequence
  Synthetic
ggcattatgggacucttcaccaatttaua

SEQ ID NO: 67628 - DNA, 28 bp, Artificial Sequence
  Synthetic
aacaaatatcuactccccgcuaaaaaca

SEQ ID NO: 67629 - DNA, 20 bp, Artificial Sequence
  Synthetic
gccaaacutggaaugccaca

SEQ ID NO: 67630 - DNA, 28 bp, Artificial Sequence
  Synthetic
cctccccugagaaaatccaaaauaagat

SEQ ID NO: 67631 - DNA, 30 bp, Artificial Sequence
  Synthetic
ccacatggaaacuaagataaatcagtggut

SEQ ID NO: 67632 - DNA, 24 bp, Artificial Sequence
  Synthetic
gtgtggcctucttcaatacctuca

SEQ ID NO: 67633 - DNA, 33 bp, Artificial Sequence
  Synthetic
gcagggtcttattutaacaaggatatagttuat

SEQ ID NO: 67634 - DNA, 21 bp, Artificial Sequence
  Synthetic
caaagtcccugtgggctucat

SEQ ID NO: 67635 - DNA, 28 bp, Artificial Sequence
  Synthetic
tgaaatgttgctutagtgttctcaguct

SEQ ID NO: 67636 - DNA, 27 bp, Artificial Sequence
  Synthetic
accttggtttcugtgattttctttugg

SEQ ID NO: 67637 - DNA, 23 bp, Artificial Sequence
  Synthetic
acaatggcuggaagcuaaggaag

SEQ ID NO: 67638 - DNA, 22 bp, Artificial Sequence
  Synthetic
acugttggaaucccaagcacat

SEQ ID NO: 67639 - DNA, 21 bp, Artificial Sequence
  Synthetic
gcutctttctgcugaggacac

SEQ ID NO: 67640 - DNA, 23 bp, Artificial Sequence
  Synthetic
actttcttggccutagctgcuac

SEQ ID NO: 67641 - DNA, 25 bp, Artificial Sequence
  Synthetic
gggaatgaccacauatgcacacaua

SEQ ID NO: 67642 - DNA, 22 bp, Artificial Sequence
  Synthetic
tcatctccccucaaccgactua

SEQ ID NO: 67643 - DNA, 25 bp, Artificial Sequence
  Synthetic
cagtgtttugtgttcaatgucgagt

SEQ ID NO: 67644 - DNA, 26 bp, Artificial Sequence
  Synthetic
gggagtcuaagaagaattugaggaag

SEQ ID NO: 67645 - DNA, 26 bp, Artificial Sequence
  Synthetic
tgcttgttgacugagcagatauaaca

SEQ ID NO: 67646 - DNA, 24 bp, Artificial Sequence
  Synthetic
gcacacacauaaacccacauacag

SEQ ID NO: 67647 - DNA, 25 bp, Artificial Sequence
  Synthetic
ctttctactgutggctggtucagat

SEQ ID NO: 67648 - DNA, 22 bp, Artificial Sequence
  Synthetic
tgaaaggtucaggcttcacugt

SEQ ID NO: 67649 - DNA, 23 bp, Artificial Sequence
  Synthetic
cauttaggaggtgugggaggaag

SEQ ID NO: 67650 - DNA, 23 bp, Artificial Sequence
  Synthetic
cctgcuagagccugagaaaaagg

SEQ ID NO: 67651 - DNA, 20 bp, Artificial Sequence
  Synthetic
aaaccggagcgucaugaagt

SEQ ID NO: 67652 - DNA, 26 bp, Artificial Sequence
  Synthetic
ggacaagacagggutactatatucgg

SEQ ID NO: 67653 - DNA, 21 bp, Artificial Sequence
  Synthetic
acaacccaaucccctcccuat

SEQ ID NO: 67654 - DNA, 29 bp, Artificial Sequence
  Synthetic
tccttatactggaugaaatggtcacaaug

SEQ ID NO: 67655 - DNA, 26 bp, Artificial Sequence
  Synthetic
cagccccautacaggaauacagaaaa

SEQ ID NO: 67656 - DNA, 23 bp, Artificial Sequence
  Synthetic
gagctcuggcacatggagaauaa

SEQ ID NO: 67657 - DNA, 27 bp, Artificial Sequence
  Synthetic
ggttgttacugtgacagttuggaaaat

SEQ ID NO: 67658 - DNA, 28 bp, Artificial Sequence
  Synthetic
ctagctctcuccatataaacccucaaga

SEQ ID NO: 67659 - DNA, 19 bp, Artificial Sequence
  Synthetic
gtgaaagagcggugauggg

SEQ ID NO: 67660 - DNA, 22 bp, Artificial Sequence
  Synthetic
cttctcttcutagggcccucct

SEQ ID NO: 67661 - DNA, 25 bp, Artificial Sequence
  Synthetic
ggctgaauaaccagctctctttcut

SEQ ID NO: 67662 - DNA, 28 bp, Artificial Sequence
  Synthetic
gatatcctcacutttccaggaaugaagg

SEQ ID NO: 67663 - DNA, 26 bp, Artificial Sequence
  Synthetic
agcatcagucccatcctttgaatuaa

SEQ ID NO: 67664 - DNA, 28 bp, Artificial Sequence
  Synthetic
acactatactgaaaugtcgtcattugct

SEQ ID NO: 67665 - DNA, 28 bp, Artificial Sequence
  Synthetic
acacccacattcutctctcatcagauat

SEQ ID NO: 67666 - DNA, 26 bp, Artificial Sequence
  Synthetic
tctaatcctucagggtaauccacagt

SEQ ID NO: 67667 - DNA, 28 bp, Artificial Sequence
  Synthetic
cgtatctgttatcugtagacagttguga

SEQ ID NO: 67668 - DNA, 17 bp, Artificial Sequence
  Synthetic
ctagcgcgcucagggua

SEQ ID NO: 67669 - DNA, 21 bp, Artificial Sequence
  Synthetic
ccgcuccttctuccagagact

SEQ ID NO: 67670 - DNA, 21 bp, Artificial Sequence
  Synthetic
ctgtguaacccccaaagccua

SEQ ID NO: 67671 - DNA, 23 bp, Artificial Sequence
  Synthetic
gctacccatgutcccctgataut

SEQ ID NO: 67672 - DNA, 21 bp, Artificial Sequence
  Synthetic
gtagtccaggcugtggaugac

SEQ ID NO: 67673 - DNA, 21 bp, Artificial Sequence
  Synthetic
gcagagugggaaaagcuggaa

SEQ ID NO: 67674 - DNA, 21 bp, Artificial Sequence
  Synthetic
ggcccatauagatggctcugg

SEQ ID NO: 67675 - DNA, 22 bp, Artificial Sequence
  Synthetic
actatgtcaccguggaggguat

SEQ ID NO: 67676 - DNA, 22 bp, Artificial Sequence
  Synthetic
ccctucccaaggctacaaugac

SEQ ID NO: 67677 - DNA, 24 bp, Artificial Sequence
  Synthetic
gatcccctaggutgtacccaagua

SEQ ID NO: 67678 - DNA, 21 bp, Artificial Sequence
  Synthetic
cactccctugttgtcctccut

SEQ ID NO: 67679 - DNA, 21 bp, Artificial Sequence
  Synthetic
catccccucttacccaugcag

SEQ ID NO: 67680 - DNA, 21 bp, Artificial Sequence
  Synthetic
ccaggcatuactcctccctug

SEQ ID NO: 67681 - DNA, 27 bp, Artificial Sequence
  Synthetic
agcatgtccttgugataaccttcttut

SEQ ID NO: 67682 - DNA, 25 bp, Artificial Sequence
  Synthetic
caaaaagtggucagcacaauagaca

SEQ ID NO: 67683 - DNA, 28 bp, Artificial Sequence
  Synthetic
cgtccctattccutctattctagcctua

SEQ ID NO: 67684 - DNA, 25 bp, Artificial Sequence
  Synthetic
ggagccaucagtaaattccuggaaa

SEQ ID NO: 67685 - DNA, 23 bp, Artificial Sequence
  Synthetic
gaggcatttcuacccacttggua

SEQ ID NO: 67686 - DNA, 28 bp, Artificial Sequence
  Synthetic
gctgaaatatctucataactgtccucgt

SEQ ID NO: 67687 - DNA, 24 bp, Artificial Sequence
  Synthetic
tuatctgggaaugggagagaacct

SEQ ID NO: 67688 - DNA, 21 bp, Artificial Sequence
  Synthetic
ctccaggagcutctcacacug

SEQ ID NO: 67689 - DNA, 23 bp, Artificial Sequence
  Synthetic
tcccccggacuaatactgttuct

SEQ ID NO: 67690 - DNA, 27 bp, Artificial Sequence
  Synthetic
aaaaccagugagagatgugagaaagag

SEQ ID NO: 67691 - DNA, 28 bp, Artificial Sequence
  Synthetic
cgcgtggcatuttaattactagaaagug

SEQ ID NO: 67692 - DNA, 22 bp, Artificial Sequence
  Synthetic
tgcagcuatggacacugacaaa

SEQ ID NO: 67693 - DNA, 26 bp, Artificial Sequence
  Synthetic
caatcaaggtuaagcaggagttugag

SEQ ID NO: 67694 - DNA, 21 bp, Artificial Sequence
  Synthetic
ggaacgtcugtgcctgugaat

SEQ ID NO: 67695 - DNA, 21 bp, Artificial Sequence
  Synthetic
acaagagugaagggcacaugg

SEQ ID NO: 67696 - DNA, 21 bp, Artificial Sequence
  Synthetic
ggaagcuaagggtccgtctug

SEQ ID NO: 67697 - DNA, 17 bp, Artificial Sequence
  Synthetic
cugttcccgugcagcct

SEQ ID NO: 67698 - DNA, 20 bp, Artificial Sequence
  Synthetic
gatgugagcagccaccagua

SEQ ID NO: 67699 - DNA, 18 bp, Artificial Sequence
  Synthetic
ggccagucctgagcagug

SEQ ID NO: 67700 - DNA, 19 bp, Artificial Sequence
  Synthetic
ggaacgaggucaccuccat

SEQ ID NO: 67701 - DNA, 20 bp, Artificial Sequence
  Synthetic
cccctgucacggaaggaauc

SEQ ID NO: 67702 - DNA, 21 bp, Artificial Sequence
  Synthetic
gaggcatauctgagcctugga

SEQ ID NO: 67703 - DNA, 27 bp, Artificial Sequence
  Synthetic
tctacctaatcucgctcttctctuacc

SEQ ID NO: 67704 - DNA, 22 bp, Artificial Sequence
  Synthetic
gcaccaaggutaaguacaagcc

SEQ ID NO: 67705 - DNA, 24 bp, Artificial Sequence
  Synthetic
tgctguacacccttuaccaacaat

SEQ ID NO: 67706 - DNA, 21 bp, Artificial Sequence
  Synthetic
ggagccauggatttgccauct

SEQ ID NO: 67707 - DNA, 22 bp, Artificial Sequence
  Synthetic
gcttttctcgutgtcccaucct

SEQ ID NO: 67708 - DNA, 21 bp, Artificial Sequence
  Synthetic
ccaaagtcagugaccccacut

SEQ ID NO: 67709 - DNA, 25 bp, Artificial Sequence
  Synthetic
guacttcttugacaacagcacacag

SEQ ID NO: 67710 - DNA, 21 bp, Artificial Sequence
  Synthetic
ccccacacutccaacctgtut

SEQ ID NO: 67711 - DNA, 22 bp, Artificial Sequence
  Synthetic
caatctggtcutcgtgtgguca

SEQ ID NO: 67712 - DNA, 19 bp, Artificial Sequence
  Synthetic
caccccaucccctttugct

SEQ ID NO: 67713 - DNA, 23 bp, Artificial Sequence
  Synthetic
tctctgccttucaaagggacauc

SEQ ID NO: 67714 - DNA, 19 bp, Artificial Sequence
  Synthetic
gccagggucaccttugaga

SEQ ID NO: 67715 - DNA, 30 bp, Artificial Sequence
  Synthetic
tccgtattttcaaaacuaaactaggtcugt

SEQ ID NO: 67716 - DNA, 24 bp, Artificial Sequence
  Synthetic
gagtgaataggugacccttgagut

SEQ ID NO: 67717 - DNA, 19 bp, Artificial Sequence
  Synthetic
ccaagaggcccucaagguc

SEQ ID NO: 67718 - DNA, 22 bp, Artificial Sequence
  Synthetic
atcatacccgugcacctttcuc

SEQ ID NO: 67719 - DNA, 25 bp, Artificial Sequence
  Synthetic
gctgtgtgaaaaucactctgtucca

SEQ ID NO: 67720 - DNA, 32 bp, Artificial Sequence
  Synthetic
ttaaaaagtgggacugtgatttaatactguct

SEQ ID NO: 67721 - DNA, 28 bp, Artificial Sequence
  Synthetic
gaatttaccatuaggcaaacatcgtuga

SEQ ID NO: 67722 - DNA, 26 bp, Artificial Sequence
  Synthetic
ccgcttaugcaagaataatugcaact

SEQ ID NO: 67723 - DNA, 27 bp, Artificial Sequence
  Synthetic
ccttagcacacucatctttccattugt

SEQ ID NO: 67724 - DNA, 20 bp, Artificial Sequence
  Synthetic
ccatacucagctccauccgt

SEQ ID NO: 67725 - DNA, 25 bp, Artificial Sequence
  Synthetic
agatgtgtccautctccatgtctuc

SEQ ID NO: 67726 - DNA, 23 bp, Artificial Sequence
  Synthetic
tgtgaccccutttcctcatcuct

SEQ ID NO: 67727 - DNA, 21 bp, Artificial Sequence
  Synthetic
ccagcccaaguctgtcaucac

SEQ ID NO: 67728 - DNA, 21 bp, Artificial Sequence
  Synthetic
gccttgacuagacccccacut

SEQ ID NO: 67729 - DNA, 21 bp, Artificial Sequence
  Synthetic
ctccagttugcgcttttuggt

SEQ ID NO: 67730 - DNA, 22 bp, Artificial Sequence
  Synthetic
gaaaagcugcugcagaagaagt

SEQ ID NO: 67731 - DNA, 19 bp, Artificial Sequence
  Synthetic
gcctcacuggcgtcaaguc

SEQ ID NO: 67732 - DNA, 21 bp, Artificial Sequence
  Synthetic
gtagcuccatctcgaugacca

SEQ ID NO: 67733 - DNA, 19 bp, Artificial Sequence
  Synthetic
gtcgcucggtgactgaugt

SEQ ID NO: 67734 - DNA, 21 bp, Artificial Sequence
  Synthetic
cgutgaaacccaugcagacac

SEQ ID NO: 67735 - DNA, 28 bp, Artificial Sequence
  Synthetic
gaatagaaaagcagguggtgtgaaaaut

SEQ ID NO: 67736 - DNA, 20 bp, Artificial Sequence
  Synthetic
ctccattcgugcaggcuaca

SEQ ID NO: 67737 - DNA, 21 bp, Artificial Sequence
  Synthetic
ggctgcuccatcagaagucag

SEQ ID NO: 67738 - DNA, 24 bp, Artificial Sequence
  Synthetic
aatgtccucaccacatuccaagag

SEQ ID NO: 67739 - DNA, 23 bp, Artificial Sequence
  Synthetic
cgctatgaagugattcgcagaug

SEQ ID NO: 67740 - DNA, 22 bp, Artificial Sequence
  Synthetic
ccagcacagcaaauctggttuc

SEQ ID NO: 67741 - DNA, 27 bp, Artificial Sequence
  Synthetic
ttgggatcugcaagatgattgtgauaa

SEQ ID NO: 67742 - DNA, 24 bp, Artificial Sequence
  Synthetic
cccagcugatagaauggacaaagt

SEQ ID NO: 67743 - DNA, 28 bp, Artificial Sequence
  Synthetic
agttttctctgcuctaattcatctgugt

SEQ ID NO: 67744 - DNA, 21 bp, Artificial Sequence
  Synthetic
gaugagcacccaaaggttugt

SEQ ID NO: 67745 - DNA, 28 bp, Artificial Sequence
  Synthetic
catgtaatgccucttagagtgguaaagt

SEQ ID NO: 67746 - DNA, 26 bp, Artificial Sequence
  Synthetic
actcactgtaugggtattgatccuct

SEQ ID NO: 67747 - DNA, 28 bp, Artificial Sequence
  Synthetic
tgcttttctgtutattgattgcttugct

SEQ ID NO: 67748 - DNA, 28 bp, Artificial Sequence
  Synthetic
gcagtgttgaaaautgtcaatggucaaa

SEQ ID NO: 67749 - DNA, 25 bp, Artificial Sequence
  Synthetic
gggagacagugcaataaatgttugg

SEQ ID NO: 67750 - DNA, 22 bp, Artificial Sequence
  Synthetic
ctgggaguccacatactgctug

SEQ ID NO: 67751 - DNA, 26 bp, Artificial Sequence
  Synthetic
aaatgctttaucaggaggagaaugct

SEQ ID NO: 67752 - DNA, 28 bp, Artificial Sequence
  Synthetic
tgtttgagcaaguaaatattcgcaggua

SEQ ID NO: 67753 - DNA, 24 bp, Artificial Sequence
  Synthetic
ggacctaattcugatggcttcucc

SEQ ID NO: 67754 - DNA, 27 bp, Artificial Sequence
  Synthetic
agcagaactucgttgtacagaaugaaa

SEQ ID NO: 67755 - DNA, 28 bp, Artificial Sequence
  Synthetic
accaaatctgucagattccagtuacaaa

SEQ ID NO: 67756 - DNA, 24 bp, Artificial Sequence
  Synthetic
gaatgccccaaauttgtagcaugt

SEQ ID NO: 67757 - DNA, 28 bp, Artificial Sequence
  Synthetic
tggcttacctugccttgtaaatgaauat

SEQ ID NO: 67758 - DNA, 29 bp, Artificial Sequence
  Synthetic
gctcttctatguctaatgttctttugcac

SEQ ID NO: 67759 - DNA, 26 bp, Artificial Sequence
  Synthetic
aaaactctucacttcctctucaccat

SEQ ID NO: 67760 - DNA, 22 bp, Artificial Sequence
  Synthetic
ccataagcacuacacgcaguca

SEQ ID NO: 67761 - DNA, 25 bp, Artificial Sequence
  Synthetic
cgcuctctgctaatuccagaaaagt

SEQ ID NO: 67762 - DNA, 23 bp, Artificial Sequence
  Synthetic
ccgaggatcugaccgactuaaag

SEQ ID NO: 67763 - DNA, 24 bp, Artificial Sequence
  Synthetic
cagagagaatgcugctgtgactua

SEQ ID NO: 67764 - DNA, 25 bp, Artificial Sequence
  Synthetic
gcgttctgtttuctgacatgttcut

SEQ ID NO: 67765 - DNA, 28 bp, Artificial Sequence
  Synthetic
ctgaggacaagauggttcttaatgtcut

SEQ ID NO: 67766 - DNA, 23 bp, Artificial Sequence
  Synthetic
tgtcccuccaagaagtgauacca

SEQ ID NO: 67767 - DNA, 24 bp, Artificial Sequence
  Synthetic
tcatcagctucagtgaggaggaua

SEQ ID NO: 67768 - DNA, 28 bp, Artificial Sequence
  Synthetic
tttccataccgtucatttctgatcagut

SEQ ID NO: 67769 - DNA, 28 bp, Artificial Sequence
  Synthetic
actgtttaaugcacacattttgttcuga

SEQ ID NO: 67770 - DNA, 29 bp, Artificial Sequence
  Synthetic
tggattaauagacctgagtttugccaaat

SEQ ID NO: 67771 - DNA, 21 bp, Artificial Sequence
  Synthetic
gggcgttuctgttagccuagt

SEQ ID NO: 67772 - DNA, 23 bp, Artificial Sequence
  Synthetic
cttaggcttcucctggcaatcuc

SEQ ID NO: 67773 - DNA, 24 bp, Artificial Sequence
  Synthetic
tcagggaatucacacagtccuagt

SEQ ID NO: 67774 - DNA, 24 bp, Artificial Sequence
  Synthetic
ggatgctaccutttcagctgtcua

SEQ ID NO: 67775 - DNA, 22 bp, Artificial Sequence
  Synthetic
gccacagtuccttcactctcug

SEQ ID NO: 67776 - DNA, 21 bp, Artificial Sequence
  Synthetic
tcagatcaggguccaggugat

SEQ ID NO: 67777 - DNA, 24 bp, Artificial Sequence
  Synthetic
acactcutgaatgaatugccaggt

SEQ ID NO: 67778 - DNA, 22 bp, Artificial Sequence
  Synthetic
cgatgtgagccuactcagucct

SEQ ID NO: 67779 - DNA, 27 bp, Artificial Sequence
  Synthetic
ggatgtgtauagaggctgtgtgauaat

SEQ ID NO: 67780 - DNA, 21 bp, Artificial Sequence
  Synthetic
ccctaaccaagugctctcugt

SEQ ID NO: 67781 - DNA, 21 bp, Artificial Sequence
  Synthetic
tcctggacugtggcctauacc

SEQ ID NO: 67782 - DNA, 27 bp, Artificial Sequence
  Synthetic
aaggaaatgugagagaagcuaaaacca

SEQ ID NO: 67783 - DNA, 23 bp, Artificial Sequence
  Synthetic
catgaucgccgcctactatuaca

SEQ ID NO: 67784 - DNA, 24 bp, Artificial Sequence
  Synthetic
atttcaggcaaggauactgauccc

SEQ ID NO: 67785 - DNA, 28 bp, Artificial Sequence
  Synthetic
gcatctgttctccucattaccttgttut

SEQ ID NO: 67786 - DNA, 22 bp, Artificial Sequence
  Synthetic
gtttctctgcugctggtcucat

SEQ ID NO: 67787 - DNA, 20 bp, Artificial Sequence
  Synthetic
agcucccagaacatgcaugg

SEQ ID NO: 67788 - DNA, 25 bp, Artificial Sequence
  Synthetic
ccagatgaatcutcaggaagctgut

SEQ ID NO: 67789 - DNA, 24 bp, Artificial Sequence
  Synthetic
gaggaactuagcagtgatucggat

SEQ ID NO: 67790 - DNA, 28 bp, Artificial Sequence
  Synthetic
gacataaccagaaacutgactcuacaca

SEQ ID NO: 67791 - DNA, 20 bp, Artificial Sequence
  Synthetic
ggcuauggaacaccacccaa

SEQ ID NO: 67792 - DNA, 27 bp, Artificial Sequence
  Synthetic
caaatagttggagutatgagtggccua

SEQ ID NO: 67793 - DNA, 28 bp, Artificial Sequence
  Synthetic
cttgactaaaggcucaggtaagtaucat

SEQ ID NO: 67794 - DNA, 23 bp, Artificial Sequence
  Synthetic
accagaguctttcaaggugcaaa

SEQ ID NO: 67795 - DNA, 26 bp, Artificial Sequence
  Synthetic
gtttcaaugccacacctgctttauat

SEQ ID NO: 67796 - DNA, 25 bp, Artificial Sequence
  Synthetic
catcaaatcccuggagttcacatuc

SEQ ID NO: 67797 - DNA, 28 bp, Artificial Sequence
  Synthetic
gccagaacaagutaaaaagtgtgaucat

SEQ ID NO: 67798 - DNA, 24 bp, Artificial Sequence
  Synthetic
acataccacauctttuggcacaca

SEQ ID NO: 67799 - DNA, 29 bp, Artificial Sequence
  Synthetic
ctactccagacutgacatcatatgaauca

SEQ ID NO: 67800 - DNA, 25 bp, Artificial Sequence
  Synthetic
ccttcuaccaagaaagctgatcuca

SEQ ID NO: 67801 - DNA, 21 bp, Artificial Sequence
  Synthetic
tgcugaagactcacuggaggt

SEQ ID NO: 67802 - DNA, 18 bp, Artificial Sequence
  Synthetic
gccctccuggtcctccug

SEQ ID NO: 67803 - DNA, 28 bp, Artificial Sequence
  Synthetic
ctagggacaacaccucttttagaaucaa

SEQ ID NO: 67804 - DNA, 24 bp, Artificial Sequence
  Synthetic
actggctucttttgcatttugcat

SEQ ID NO: 67805 - DNA, 21 bp, Artificial Sequence
  Synthetic
caaggcaacutacugcaccac

SEQ ID NO: 67806 - DNA, 27 bp, Artificial Sequence
  Synthetic
ggaatgtatatgutggcctatcctuga

SEQ ID NO: 67807 - DNA, 20 bp, Artificial Sequence
  Synthetic
ggtcgaccacuttctcctug

SEQ ID NO: 67808 - DNA, 22 bp, Artificial Sequence
  Synthetic
tctggaccaaaaggugatgcug

SEQ ID NO: 67809 - DNA, 26 bp, Artificial Sequence
  Synthetic
cctggagcuccctaatacagataaug

SEQ ID NO: 67810 - DNA, 19 bp, Artificial Sequence
  Synthetic
aatcccucgcgtgcagtua

SEQ ID NO: 67811 - DNA, 26 bp, Artificial Sequence
  Synthetic
cctgatccatguatgcaatgctatut

SEQ ID NO: 67812 - DNA, 23 bp, Artificial Sequence
  Synthetic
caaggtaaaatugcccccagtuc

SEQ ID NO: 67813 - DNA, 26 bp, Artificial Sequence
  Synthetic
ggacgaucaagctaagaaccucaaaa

SEQ ID NO: 67814 - DNA, 25 bp, Artificial Sequence
  Synthetic
ttttacaugaccaggaagcacuagg

SEQ ID NO: 67815 - DNA, 26 bp, Artificial Sequence
  Synthetic
acattcagccucttttgcttcacuat

SEQ ID NO: 67816 - DNA, 24 bp, Artificial Sequence
  Synthetic
cttaccccacccautgtaatucca

SEQ ID NO: 67817 - DNA, 28 bp, Artificial Sequence
  Synthetic
gtcgtctttggugtttcttgctaaaaut

SEQ ID NO: 67818 - DNA, 20 bp, Artificial Sequence
  Synthetic
aatgaccgcutcgccaacua

SEQ ID NO: 67819 - DNA, 21 bp, Artificial Sequence
  Synthetic
ctggttagugagcaccuccac

SEQ ID NO: 67820 - DNA, 20 bp, Artificial Sequence
  Synthetic
aggacgtauggagccaguct

SEQ ID NO: 67821 - DNA, 20 bp, Artificial Sequence
  Synthetic
cagcucggcggtgttttuat

SEQ ID NO: 67822 - DNA, 21 bp, Artificial Sequence
  Synthetic
ccttcucaccccactctcuct

SEQ ID NO: 67823 - DNA, 22 bp, Artificial Sequence
  Synthetic
cctagaugaagcgcttgtccug

SEQ ID NO: 67824 - DNA, 20 bp, Artificial Sequence
  Synthetic
ccaagctuaccgtgccatut

SEQ ID NO: 67825 - DNA, 26 bp, Artificial Sequence
  Synthetic
ttgatcctttgaugccctcattauca

SEQ ID NO: 67826 - DNA, 26 bp, Artificial Sequence
  Synthetic
tcttcagtatuccagtaccaguaccc

SEQ ID NO: 67827 - DNA, 21 bp, Artificial Sequence
  Synthetic
gacuctcactcugcacaggaa

SEQ ID NO: 67828 - DNA, 25 bp, Artificial Sequence
  Synthetic
cagagactacaaggugaagcatgut

SEQ ID NO: 67829 - DNA, 25 bp, Artificial Sequence
  Synthetic
ggtgactttugggattttccatguc

SEQ ID NO: 67830 - DNA, 24 bp, Artificial Sequence
  Synthetic
accttauccaaagagctgtaugcc

SEQ ID NO: 67831 - DNA, 24 bp, Artificial Sequence
  Synthetic
gtcatcccugaggucagaaacaaa

SEQ ID NO: 67832 - DNA, 21 bp, Artificial Sequence
  Synthetic
caggccautgucacagaggat

SEQ ID NO: 67833 - DNA, 25 bp, Artificial Sequence
  Synthetic
ggtaggcugtactttucccaaaagg

SEQ ID NO: 67834 - DNA, 26 bp, Artificial Sequence
  Synthetic
ggtattgaatttcuttggaccaggug

SEQ ID NO: 67835 - DNA, 27 bp, Artificial Sequence
  Synthetic
aaagattgtaugaggtcctgtccuagt

SEQ ID NO: 67836 - DNA, 21 bp, Artificial Sequence
  Synthetic
gggaggaaggaaguccctuct

SEQ ID NO: 67837 - DNA, 22 bp, Artificial Sequence
  Synthetic
tgccttugaactacaccaucgt

SEQ ID NO: 67838 - DNA, 23 bp, Artificial Sequence
  Synthetic
gggttgagaguttgtgagctgut

SEQ ID NO: 67839 - DNA, 26 bp, Artificial Sequence
  Synthetic
ctggttcgagacautcatcatctuca

SEQ ID NO: 67840 - DNA, 21 bp, Artificial Sequence
  Synthetic
ccaaaacccucacggagugat

SEQ ID NO: 67841 - DNA, 24 bp, Artificial Sequence
  Synthetic
auctctgaaggugggagaaagagt

SEQ ID NO: 67842 - DNA, 25 bp, Artificial Sequence
  Synthetic
tgccttcatgtutttcactcacgua

SEQ ID NO: 67843 - DNA, 29 bp, Artificial Sequence
  Synthetic
gttaggtacagcaaaautgtaacatgtuc

SEQ ID NO: 67844 - DNA, 28 bp, Artificial Sequence
  Synthetic
ggcacatgtugaatattgcataugaagg

SEQ ID NO: 67845 - DNA, 28 bp, Artificial Sequence
  Synthetic
aaccatctagutaagcaacatucacaga

SEQ ID NO: 67846 - DNA, 22 bp, Artificial Sequence
  Synthetic
gccctgtgcutccttctcauac

SEQ ID NO: 67847 - DNA, 20 bp, Artificial Sequence
  Synthetic
cctgaaggacugcgctgtua

SEQ ID NO: 67848 - DNA, 20 bp, Artificial Sequence
  Synthetic
cctucgcagcattctugggt

SEQ ID NO: 67849 - DNA, 23 bp, Artificial Sequence
  Synthetic
gcacgaucagcagaaacatguag

SEQ ID NO: 67850 - DNA, 26 bp, Artificial Sequence
  Synthetic
ttgguggaagagcaagagaauagaag

SEQ ID NO: 67851 - DNA, 29 bp, Artificial Sequence
  Synthetic
tctacatttcaggugatgagtatgagcua

SEQ ID NO: 67852 - DNA, 20 bp, Artificial Sequence
  Synthetic
gtggagccuggtcauggaaa

SEQ ID NO: 67853 - DNA, 18 bp, Artificial Sequence
  Synthetic
gggcagaugacgcucagg

SEQ ID NO: 67854 - DNA, 19 bp, Artificial Sequence
  Synthetic
gacagccugacctcaccut

SEQ ID NO: 67855 - DNA, 18 bp, Artificial Sequence
  Synthetic
ccugaggacccaguggag

SEQ ID NO: 67856 - DNA, 21 bp, Artificial Sequence
  Synthetic
gccacgugcctttgtccttua

SEQ ID NO: 67857 - DNA, 20 bp, Artificial Sequence
  Synthetic
cctcctacugtgcacccuac

SEQ ID NO: 67858 - DNA, 24 bp, Artificial Sequence
  Synthetic
ccctgcgagcuattttgaaaguga

SEQ ID NO: 67859 - DNA, 21 bp, Artificial Sequence
  Synthetic
ccagccaccuactctuccact

SEQ ID NO: 67860 - DNA, 22 bp, Artificial Sequence
  Synthetic
tgcaatgatgucctcgtctugg

SEQ ID NO: 67861 - DNA, 22 bp, Artificial Sequence
  Synthetic
tgaccccacacauccgtactua

SEQ ID NO: 67862 - DNA, 23 bp, Artificial Sequence
  Synthetic
atgctttcugcttctgugcaaag

SEQ ID NO: 67863 - DNA, 22 bp, Artificial Sequence
  Synthetic
ctcccataaagcuggacccaut

SEQ ID NO: 67864 - DNA, 20 bp, Artificial Sequence
  Synthetic
ctcactcagugacccctugt

SEQ ID NO: 67865 - DNA, 28 bp, Artificial Sequence
  Synthetic
caacgcaaattcugccaattcctttaua

SEQ ID NO: 67866 - DNA, 29 bp, Artificial Sequence
  Synthetic
gcttttctgactucagtgtaaacattcut

SEQ ID NO: 67867 - DNA, 20 bp, Artificial Sequence
  Synthetic
cacagagcuagctgccaugt

SEQ ID NO: 67868 - DNA, 26 bp, Artificial Sequence
  Synthetic
tctttgaggagautagtgaugaggct

SEQ ID NO: 67869 - DNA, 28 bp, Artificial Sequence
  Synthetic
caggtggcagautttcaattactgauac

SEQ ID NO: 67870 - DNA, 24 bp, Artificial Sequence
  Synthetic
ctggaacaaaaggutctcatuggg

SEQ ID NO: 67871 - DNA, 23 bp, Artificial Sequence
  Synthetic
caagtttucaagcatgggucaca

SEQ ID NO: 67872 - DNA, 24 bp, Artificial Sequence
  Synthetic
tcttcttggguttagccaccttuc

SEQ ID NO: 67873 - DNA, 23 bp, Artificial Sequence
  Synthetic
acagactauagacgccaauccca

SEQ ID NO: 67874 - DNA, 23 bp, Artificial Sequence
  Synthetic
acacacatacgcaugtcctgtut

SEQ ID NO: 67875 - DNA, 20 bp, Artificial Sequence
  Synthetic
gcaucugaacgcccaacaac

SEQ ID NO: 67876 - DNA, 27 bp, Artificial Sequence
  Synthetic
gttctactggguaaatgcagatagugt

SEQ ID NO: 67877 - DNA, 26 bp, Artificial Sequence
  Synthetic
catgcagaaaacuaatcaggcttucc

SEQ ID NO: 67878 - DNA, 27 bp, Artificial Sequence
  Synthetic
aataaatcccaugagaccttgcaauct

SEQ ID NO: 67879 - DNA, 22 bp, Artificial Sequence
  Synthetic
gatgattucagcgagtgtugcc

SEQ ID NO: 67880 - DNA, 28 bp, Artificial Sequence
  Synthetic
gatgatgtcaaggugtcaaaatttccut

SEQ ID NO: 67881 - DNA, 28 bp, Artificial Sequence
  Synthetic
tcctactttttgaugtcctcacttccua

SEQ ID NO: 67882 - DNA, 26 bp, Artificial Sequence
  Synthetic
gatttgctagaaucagcctcugacat

SEQ ID NO: 67883 - DNA, 26 bp, Artificial Sequence
  Synthetic
acctctgagaagaucacatctctgut

SEQ ID NO: 67884 - DNA, 23 bp, Artificial Sequence
  Synthetic
gtctgttttgugtgttgcagugt

SEQ ID NO: 67885 - DNA, 20 bp, Artificial Sequence
  Synthetic
gcaauccccgcaagaguagt

SEQ ID NO: 67886 - DNA, 28 bp, Artificial Sequence
  Synthetic
tctgtttgtttutccagactcugacaat

SEQ ID NO: 67887 - DNA, 27 bp, Artificial Sequence
  Synthetic
gtatggttgcauagtcattgcatgtut

SEQ ID NO: 67888 - DNA, 29 bp, Artificial Sequence
  Synthetic
tgcaaaacaggaagacutaaaagaaaugg

SEQ ID NO: 67889 - DNA, 26 bp, Artificial Sequence
  Synthetic
tcttttagtaagugctgctgccauaa

SEQ ID NO: 67890 - DNA, 27 bp, Artificial Sequence
  Synthetic
cctttcttuaaaaacaagcagccacua

SEQ ID NO: 67891 - DNA, 24 bp, Artificial Sequence
  Synthetic
cagtgccucaacttgcttuaacaa

SEQ ID NO: 67892 - DNA, 28 bp, Artificial Sequence
  Synthetic
atcacttaattgguttttggctttugga

SEQ ID NO: 67893 - DNA, 25 bp, Artificial Sequence
  Synthetic
guaaaagctggaugaggagaggaag

SEQ ID NO: 67894 - DNA, 20 bp, Artificial Sequence
  Synthetic
tgccagcucctgtugaacat

SEQ ID NO: 67895 - DNA, 28 bp, Artificial Sequence
  Synthetic
gttggtggccutatatcctaattcauca

SEQ ID NO: 67896 - DNA, 28 bp, Artificial Sequence
  Synthetic
gcccatacacautcaaacacttacaaut

SEQ ID NO: 67897 - DNA, 29 bp, Artificial Sequence
  Synthetic
ggtattgaccauaactgcaaaacttacut

SEQ ID NO: 67898 - DNA, 21 bp, Artificial Sequence
  Synthetic
ccttaagacuccagccuccaa

SEQ ID NO: 67899 - DNA, 21 bp, Artificial Sequence
  Synthetic
tcggccaggagacugtauagg

SEQ ID NO: 67900 - DNA, 22 bp, Artificial Sequence
  Synthetic
ctcacacugggactctgtcuac

SEQ ID NO: 67901 - DNA, 20 bp, Artificial Sequence
  Synthetic
ctgctcuccgagttguccat

SEQ ID NO: 67902 - DNA, 21 bp, Artificial Sequence
  Synthetic
gacttcuccagcaggctcauc

SEQ ID NO: 67903 - DNA, 21 bp, Artificial Sequence
  Synthetic
aggaguccaaaggaccacgua

SEQ ID NO: 67904 - DNA, 27 bp, Artificial Sequence
  Synthetic
ttttctcttctcucagcggtttaaugt

SEQ ID NO: 67905 - DNA, 29 bp, Artificial Sequence
  Synthetic
aguattaaaatcaugaggagcaggacaaa

SEQ ID NO: 67906 - DNA, 25 bp, Artificial Sequence
  Synthetic
ggatgauccagattccaguaccagt

SEQ ID NO: 67907 - DNA, 28 bp, Artificial Sequence
  Synthetic
caagtttcccttuaagtggcctgtauat

SEQ ID NO: 67908 - DNA, 21 bp, Artificial Sequence
  Synthetic
ggagatggcacucagaacucc

SEQ ID NO: 67909 - DNA, 25 bp, Artificial Sequence
  Synthetic
tgtgttcttuaccatttgggcugaa

SEQ ID NO: 67910 - DNA, 23 bp, Artificial Sequence
  Synthetic
acagtgggttutcctgaagctut

SEQ ID NO: 67911 - DNA, 25 bp, Artificial Sequence
  Synthetic
ggaccagugaaagtttgctgaaaut

SEQ ID NO: 67912 - DNA, 23 bp, Artificial Sequence
  Synthetic
gacaugtgtgttaguagccagca

SEQ ID NO: 67913 - DNA, 27 bp, Artificial Sequence
  Synthetic
ggcgtgaaaaguagcttctcttuagaa

SEQ ID NO: 67914 - DNA, 24 bp, Artificial Sequence
  Synthetic
ctcttgggagutggtatccttugt

SEQ ID NO: 67915 - DNA, 23 bp, Artificial Sequence
  Synthetic
ccaaagcagaagucuagaagggt

SEQ ID NO: 67916 - DNA, 18 bp, Artificial Sequence
  Synthetic
tggagccauccccgttuc

SEQ ID NO: 67917 - DNA, 26 bp, Artificial Sequence
  Synthetic
gcgcaaagaaaaagcuagtttcgaut

SEQ ID NO: 67918 - DNA, 24 bp, Artificial Sequence
  Synthetic
ggacctattccuttggttgcagut

SEQ ID NO: 67919 - DNA, 22 bp, Artificial Sequence
  Synthetic
ctctccaauccagtgtgucagg

SEQ ID NO: 67920 - DNA, 23 bp, Artificial Sequence
  Synthetic
cgtttcccautctggaguccaaa

SEQ ID NO: 67921 - DNA, 19 bp, Artificial Sequence
  Synthetic
cgtgaccucggactcagug

SEQ ID NO: 67922 - DNA, 19 bp, Artificial Sequence
  Synthetic
gucaccccaauggcagaca

SEQ ID NO: 67923 - DNA, 21 bp, Artificial Sequence
  Synthetic
ccacttccuggtccaguacag

SEQ ID NO: 67924 - DNA, 21 bp, Artificial Sequence
  Synthetic
gaagcccguagaggttcauct

SEQ ID NO: 67925 - DNA, 21 bp, Artificial Sequence
  Synthetic
gcccctucgactcattcaugg

SEQ ID NO: 67926 - DNA, 22 bp, Artificial Sequence
  Synthetic
tggcagccauctctgaattcut

SEQ ID NO: 67927 - DNA, 23 bp, Artificial Sequence
  Synthetic
ccctctctcuccttccagttcuc

SEQ ID NO: 67928 - DNA, 19 bp, Artificial Sequence
  Synthetic
gaggagcauccccacacug

SEQ ID NO: 67929 - DNA, 22 bp, Artificial Sequence
  Synthetic
cctctgccautcaggacacaut

SEQ ID NO: 67930 - DNA, 21 bp, Artificial Sequence
  Synthetic
ggaacacagcacuggaacugt

SEQ ID NO: 67931 - DNA, 23 bp, Artificial Sequence
  Synthetic
ggtgccctcucacctctatctut

SEQ ID NO: 67932 - DNA, 21 bp, Artificial Sequence
  Synthetic
cattgctgtcugggtagggut

SEQ ID NO: 67933 - DNA, 27 bp, Artificial Sequence
  Synthetic
cactggtcacautttctatccctuact

SEQ ID NO: 67934 - DNA, 27 bp, Artificial Sequence
  Synthetic
gaacagaaaaugacaagtcacagaugg

SEQ ID NO: 67935 - DNA, 25 bp, Artificial Sequence
  Synthetic
ccctacgatuacacctatggctaug

SEQ ID NO: 67936 - DNA, 19 bp, Artificial Sequence
  Synthetic
gccuaccccaccatgucac

SEQ ID NO: 67937 - DNA, 25 bp, Artificial Sequence
  Synthetic
gcatgtcccutctcctgataaucat

SEQ ID NO: 67938 - DNA, 21 bp, Artificial Sequence
  Synthetic
cgcccccautagacccaaaug

SEQ ID NO: 67939 - DNA, 22 bp, Artificial Sequence
  Synthetic
aucaccaacaacucagcacact

SEQ ID NO: 67940 - DNA, 17 bp, Artificial Sequence
  Synthetic
gcaacucgacgggcgut

SEQ ID NO: 67941 - DNA, 21 bp, Artificial Sequence
  Synthetic
gccctgcgcgaugtagtaauc

SEQ ID NO: 67942 - DNA, 27 bp, Artificial Sequence
  Synthetic
gggccttatttaucatctgttctguct

SEQ ID NO: 67943 - DNA, 26 bp, Artificial Sequence
  Synthetic
tgatggtgtcuaacacaacctttgut

SEQ ID NO: 67944 - DNA, 26 bp, Artificial Sequence
  Synthetic
catgttcaggaucacagguagaaact

SEQ ID NO: 67945 - DNA, 29 bp, Artificial Sequence
  Synthetic
tgtatccatcuctaaacaagtgcucaaac

SEQ ID NO: 67946 - DNA, 24 bp, Artificial Sequence
  Synthetic
catgacaggcuctttcttctcugt

SEQ ID NO: 67947 - DNA, 25 bp, Artificial Sequence
  Synthetic
cttcttcagaauggtccaaauggga

SEQ ID NO: 67948 - DNA, 23 bp, Artificial Sequence
  Synthetic
ctagagacaacuggagtugcact

SEQ ID NO: 67949 - DNA, 23 bp, Artificial Sequence
  Synthetic
gctaccccaacgacutcaguaat

SEQ ID NO: 67950 - DNA, 33 bp, Artificial Sequence
  Synthetic
gtcatcttaaatgtacutagctcttgttttaug

SEQ ID NO: 67951 - DNA, 24 bp, Artificial Sequence
  Synthetic
actgugaaacaaacgccaatgaut

SEQ ID NO: 67952 - DNA, 29 bp, Artificial Sequence
  Synthetic
gccaaataagaaaugagacaacaauacca

SEQ ID NO: 67953 - DNA, 21 bp, Artificial Sequence
  Synthetic
gcaaatcugcgtccugcaaaa

SEQ ID NO: 67954 - DNA, 22 bp, Artificial Sequence
  Synthetic
gccutcatgugggaaccaacat

SEQ ID NO: 67955 - DNA, 21 bp, Artificial Sequence
  Synthetic
cugaaggcgaaaagugccaag

SEQ ID NO: 67956 - DNA, 28 bp, Artificial Sequence
  Synthetic
acctgcaaggauaatctttctcacatut

SEQ ID NO: 67957 - DNA, 28 bp, Artificial Sequence
  Synthetic
cttctccagguaagaacccattcatuac

SEQ ID NO: 67958 - DNA, 25 bp, Artificial Sequence
  Synthetic
tcaaacaucagacagcattcaugga

SEQ ID NO: 67959 - DNA, 28 bp, Artificial Sequence
  Synthetic
cctgaagttcuaacctgttgtaaucagt

SEQ ID NO: 67960 - DNA, 28 bp, Artificial Sequence
  Synthetic
tgcaagtcaatgaucactgaaaaatgug

SEQ ID NO: 67961 - DNA, 28 bp, Artificial Sequence
  Synthetic
catctgctgatuatgctgatctcttuga

SEQ ID NO: 67962 - DNA, 28 bp, Artificial Sequence
  Synthetic
ggaaagatcttggguctggaaatgaaut

SEQ ID NO: 67963 - DNA, 25 bp, Artificial Sequence
  Synthetic
tgttggcaccugttctactttctuc

SEQ ID NO: 67964 - DNA, 22 bp, Artificial Sequence
  Synthetic
gaaggugggcgaaatagcttug

SEQ ID NO: 67965 - DNA, 28 bp, Artificial Sequence
  Synthetic
ggcctttatttugtatgtctttgugcat

SEQ ID NO: 67966 - DNA, 22 bp, Artificial Sequence
  Synthetic
ttgttgccucctgagattgugt

SEQ ID NO: 67967 - DNA, 28 bp, Artificial Sequence
  Synthetic
actcagccacaauttgtttttgaaucat

SEQ ID NO: 67968 - DNA, 20 bp, Artificial Sequence
  Synthetic
aacagucacaccaacccgut

SEQ ID NO: 67969 - DNA, 25 bp, Artificial Sequence
  Synthetic
acatctccacagagugtcttctcut

SEQ ID NO: 67970 - DNA, 22 bp, Artificial Sequence
  Synthetic
agggaagcuttctggaugacac

SEQ ID NO: 67971 - DNA, 27 bp, Artificial Sequence
  Synthetic
atgtctcatucgaacagagcatuagaa

SEQ ID NO: 67972 - DNA, 24 bp, Artificial Sequence
  Synthetic
tggttctcugagttttcagugcaa

SEQ ID NO: 67973 - DNA, 22 bp, Artificial Sequence
  Synthetic
gtgcagacucagcactcaugaa

SEQ ID NO: 67974 - DNA, 19 bp, Artificial Sequence
  Synthetic
ggcuggagccgaagctauc

SEQ ID NO: 67975 - DNA, 25 bp, Artificial Sequence
  Synthetic
gcttugtaaactcctuggaagaggt

SEQ ID NO: 67976 - DNA, 20 bp, Artificial Sequence
  Synthetic
gaatgccguggttccucagt

SEQ ID NO: 67977 - DNA, 28 bp, Artificial Sequence
  Synthetic
gccatggtagauaccaacattacttcuc

SEQ ID NO: 67978 - DNA, 22 bp, Artificial Sequence
  Synthetic
ctccccacautgtcaaaaugct

SEQ ID NO: 67979 - DNA, 24 bp, Artificial Sequence
  Synthetic
ggacgttcatucatgtgccacuaa

SEQ ID NO: 67980 - DNA, 21 bp, Artificial Sequence
  Synthetic
gtccctcuagagtccccacut

SEQ ID NO: 67981 - DNA, 29 bp, Artificial Sequence
  Synthetic
cagaatttcgtctucgttcagttcattut

SEQ ID NO: 67982 - DNA, 21 bp, Artificial Sequence
  Synthetic
gcagaucagggcauggagaaa

SEQ ID NO: 67983 - DNA, 20 bp, Artificial Sequence
  Synthetic
ggcucacttccuaggaggca

SEQ ID NO: 67984 - DNA, 22 bp, Artificial Sequence
  Synthetic
catgactuggcttctctuggct

SEQ ID NO: 67985 - DNA, 22 bp, Artificial Sequence
  Synthetic
caacgttgaugaggtcgugagt

SEQ ID NO: 67986 - DNA, 28 bp, Artificial Sequence
  Synthetic
agaaaagggtacacutgaacaagaagut

SEQ ID NO: 67987 - DNA, 27 bp, Artificial Sequence
  Synthetic
ctttcttcttggcuaacaggagtaugt

SEQ ID NO: 67988 - DNA, 25 bp, Artificial Sequence
  Synthetic
ctgtcacagagacugtctgatctut

SEQ ID NO: 67989 - DNA, 28 bp, Artificial Sequence
  Synthetic
cttgtcatggucacaactccatctaaua

SEQ ID NO: 67990 - DNA, 22 bp, Artificial Sequence
  Synthetic
tggagaaacaggautgctgcut

SEQ ID NO: 67991 - DNA, 28 bp, Artificial Sequence
  Synthetic
tctagggacaatuctggtttagcttcua

SEQ ID NO: 67992 - DNA, 26 bp, Artificial Sequence
  Synthetic
ggaaagagcautgatttgtuccaact

SEQ ID NO: 67993 - DNA, 28 bp, Artificial Sequence
  Synthetic
gctctaagagccucgagttcatuaaaaa

SEQ ID NO: 67994 - DNA, 26 bp, Artificial Sequence
  Synthetic
cttccaaaguagagccggtacataut

SEQ ID NO: 67995 - DNA, 28 bp, Artificial Sequence
  Synthetic
catctttaaacuggttgtccttttgugt

SEQ ID NO: 67996 - DNA, 21 bp, Artificial Sequence
  Synthetic
ctcgtgcaautaccccagcua

SEQ ID NO: 67997 - DNA, 29 bp, Artificial Sequence
  Synthetic
agctgctactuagtcatttctgttuagac

SEQ ID NO: 67998 - DNA, 27 bp, Artificial Sequence
  Synthetic
aaaugctgacugacaaaagaacaagac

SEQ ID NO: 67999 - DNA, 21 bp, Artificial Sequence
  Synthetic
ccatctgtugtcctgcuggat

SEQ ID NO: 68000 - DNA, 21 bp, Artificial Sequence
  Synthetic
gcattctcgugggcttcacut

SEQ ID NO: 68001 - DNA, 27 bp, Artificial Sequence
  Synthetic
gtgttgcaaagaaaucttcagcatgua

SEQ ID NO: 68002 - DNA, 26 bp, Artificial Sequence
  Synthetic
gctgtatttccautttaacgcaguct

SEQ ID NO: 68003 - DNA, 23 bp, Artificial Sequence
  Synthetic
ccaacgatcaacuggctctttug

SEQ ID NO: 68004 - DNA, 22 bp, Artificial Sequence
  Synthetic
ggctgacacuttgggactttut

SEQ ID NO: 68005 - DNA, 22 bp, Artificial Sequence
  Synthetic
gguggcttuaaccaagagagca

SEQ ID NO: 68006 - DNA, 28 bp, Artificial Sequence
  Synthetic
ctttctgcatacugtaactttggttugt

SEQ ID NO: 68007 - DNA, 27 bp, Artificial Sequence
  Synthetic
ccaactgagauatgtcttgatgtucca

SEQ ID NO: 68008 - DNA, 22 bp, Artificial Sequence
  Synthetic
gctagagtccugattgccagug

SEQ ID NO: 68009 - DNA, 28 bp, Artificial Sequence
  Synthetic
cttgcttactatttuagcacctgaccua

SEQ ID NO: 68010 - DNA, 24 bp, Artificial Sequence
  Synthetic
cutcctgaaatacucagcgaaggt

SEQ ID NO: 68011 - DNA, 28 bp, Artificial Sequence
  Synthetic
ctgagatggataucataaggctgttgut

SEQ ID NO: 68012 - DNA, 25 bp, Artificial Sequence
  Synthetic
gcagagcatugaattctgccaaaua

SEQ ID NO: 68013 - DNA, 23 bp, Artificial Sequence
  Synthetic
tgaagccagcuctctatcccaut

SEQ ID NO: 68014 - DNA, 23 bp, Artificial Sequence
  Synthetic
gcttcctaugacccggauaacaa

SEQ ID NO: 68015 - DNA, 28 bp, Artificial Sequence
  Synthetic
gtacgatacagaauatatgtgccauggg

SEQ ID NO: 68016 - DNA, 28 bp, Artificial Sequence
  Synthetic
acttaacgacuacagaagtagtgaugga

SEQ ID NO: 68017 - DNA, 28 bp, Artificial Sequence
  Synthetic
cctccttccagutctaccagttatauca

SEQ ID NO: 68018 - DNA, 25 bp, Artificial Sequence
  Synthetic
ctgctuaggatgataatuggaggca

SEQ ID NO: 68019 - DNA, 28 bp, Artificial Sequence
  Synthetic
tccaggaaaacugagaacagaaugaaat

SEQ ID NO: 68020 - DNA, 22 bp, Artificial Sequence
  Synthetic
agctatagcagutgtcgcagut

SEQ ID NO: 68021 - DNA, 25 bp, Artificial Sequence
  Synthetic
aagatgagtaucgcacattcacugt

SEQ ID NO: 68022 - DNA, 22 bp, Artificial Sequence
  Synthetic
augtgagaaauggcaggcagat

SEQ ID NO: 68023 - DNA, 29 bp, Artificial Sequence
  Synthetic
ggtctgtgaaggacuattactgattgtut

SEQ ID NO: 68024 - DNA, 22 bp, Artificial Sequence
  Synthetic
ttccttucccactgctctucag

SEQ ID NO: 68025 - DNA, 22 bp, Artificial Sequence
  Synthetic
caatcacaucccctgtuccagt

SEQ ID NO: 68026 - DNA, 23 bp, Artificial Sequence
  Synthetic
acattcutaaccactugcagcca

SEQ ID NO: 68027 - DNA, 28 bp, Artificial Sequence
  Synthetic
ctgttaccaugagctttgaaacttucat

SEQ ID NO: 68028 - DNA, 17 bp, Artificial Sequence
  Synthetic
ggcgcacucacctucgt

SEQ ID NO: 68029 - DNA, 17 bp, Artificial Sequence
  Synthetic
gcgucgcagctcaugct

SEQ ID NO: 68030 - DNA, 21 bp, Artificial Sequence
  Synthetic
gcacctcaagugagctgugag

SEQ ID NO: 68031 - DNA, 22 bp, Artificial Sequence
  Synthetic
tgacacccacguagagtuccat

SEQ ID NO: 68032 - DNA, 21 bp, Artificial Sequence
  Synthetic
gacgggucactatctgugcaa

SEQ ID NO: 68033 - DNA, 20 bp, Artificial Sequence
  Synthetic
gggctcucacccacgtaauc

SEQ ID NO: 68034 - DNA, 17 bp, Artificial Sequence
  Synthetic
tgccugcggccttgaut

SEQ ID NO: 68035 - DNA, 18 bp, Artificial Sequence
  Synthetic
ggcagcugctaccuggat

SEQ ID NO: 68036 - DNA, 20 bp, Artificial Sequence
  Synthetic
cagaggcgaucuggagagag

SEQ ID NO: 68037 - DNA, 21 bp, Artificial Sequence
  Synthetic
cgggacutcaggacauaccat

SEQ ID NO: 68038 - DNA, 29 bp, Artificial Sequence
  Synthetic
tgtttaaaugcagtctaactuggagaagt

SEQ ID NO: 68039 - DNA, 28 bp, Artificial Sequence
  Synthetic
cccaacatcugacagttctttctcttua

SEQ ID NO: 68040 - DNA, 21 bp, Artificial Sequence
  Synthetic
gggagaaaggaugggtgtgua

SEQ ID NO: 68041 - DNA, 28 bp, Artificial Sequence
  Synthetic
ccattaatttctugctggtatcactucc

SEQ ID NO: 68042 - DNA, 23 bp, Artificial Sequence
  Synthetic
gtggtuacccggaaaatccagua

SEQ ID NO: 68043 - DNA, 18 bp, Artificial Sequence
  Synthetic
ggagacgcgaguccgtuc

SEQ ID NO: 68044 - DNA, 20 bp, Artificial Sequence
  Synthetic
ccucagcacaugcagcagat

SEQ ID NO: 68045 - DNA, 20 bp, Artificial Sequence
  Synthetic
cgagugacgcaaggaaggug

SEQ ID NO: 68046 - DNA, 28 bp, Artificial Sequence
  Synthetic
gtgacccaaaauattattgcttggugaa

SEQ ID NO: 68047 - DNA, 25 bp, Artificial Sequence
  Synthetic
gttgcctgaaucaccactttguaat

SEQ ID NO: 68048 - DNA, 28 bp, Artificial Sequence
  Synthetic
ttttaactugcaagcaaatcaugacact

SEQ ID NO: 68049 - DNA, 26 bp, Artificial Sequence
  Synthetic
tcttctcaaggauggctcggtaauat

SEQ ID NO: 68050 - DNA, 26 bp, Artificial Sequence
  Synthetic
ggaagtgttttaucctgccttctuct

SEQ ID NO: 68051 - DNA, 22 bp, Artificial Sequence
  Synthetic
aggattttctuccagccaccug

SEQ ID NO: 68052 - DNA, 26 bp, Artificial Sequence
  Synthetic
ctcggatgugattagacttacucgaa

SEQ ID NO: 68053 - DNA, 28 bp, Artificial Sequence
  Synthetic
tggacgccagutggatttattaaucaat

SEQ ID NO: 68054 - DNA, 19 bp, Artificial Sequence
  Synthetic
ccaugcgauaacgccacca

SEQ ID NO: 68055 - DNA, 26 bp, Artificial Sequence
  Synthetic
gcatgggcttuctattttctgtcaut

SEQ ID NO: 68056 - DNA, 22 bp, Artificial Sequence
  Synthetic
gtgacaagaagucccacguagt

SEQ ID NO: 68057 - DNA, 21 bp, Artificial Sequence
  Synthetic
tggtgtugcaacttgtuccct

SEQ ID NO: 68058 - DNA, 21 bp, Artificial Sequence
  Synthetic
tgaacccaggutcctctggua

SEQ ID NO: 68059 - DNA, 24 bp, Artificial Sequence
  Synthetic
ctagcagacautgaagcccacuat

SEQ ID NO: 68060 - DNA, 23 bp, Artificial Sequence
  Synthetic
gcgcttcacaagcuctttcctua

SEQ ID NO: 68061 - DNA, 24 bp, Artificial Sequence
  Synthetic
gccatctttccuctggatttcgut

SEQ ID NO: 68062 - DNA, 25 bp, Artificial Sequence
  Synthetic
tcctgggcugaattaatgaaugagg

SEQ ID NO: 68063 - DNA, 28 bp, Artificial Sequence
  Synthetic
cctaggaacatcutcttaccgtttctut

SEQ ID NO: 68064 - DNA, 24 bp, Artificial Sequence
  Synthetic
gtcctgcauagaaatctucaagcc

SEQ ID NO: 68065 - DNA, 26 bp, Artificial Sequence
  Synthetic
gagtgaagcagagucaagtgaatcut

SEQ ID NO: 68066 - DNA, 29 bp, Artificial Sequence
  Synthetic
gcctcttccucaaactctacaatataugg

SEQ ID NO: 68067 - DNA, 28 bp, Artificial Sequence
  Synthetic
ctatcttactguaggtgctgttgctaut

SEQ ID NO: 68068 - DNA, 21 bp, Artificial Sequence
  Synthetic
ccagtuaccttgctgucgaga

SEQ ID NO: 68069 - DNA, 26 bp, Artificial Sequence
  Synthetic
ctcgtgctaguggatctgtttttcua

SEQ ID NO: 68070 - DNA, 20 bp, Artificial Sequence
  Synthetic
gagggtggcuagacctctug

SEQ ID NO: 68071 - DNA, 25 bp, Artificial Sequence
  Synthetic
ctgagtcuccaactctggttugaaa

SEQ ID NO: 68072 - DNA, 23 bp, Artificial Sequence
  Synthetic
gtaaaggaccugcctgttctuct

SEQ ID NO: 68073 - DNA, 26 bp, Artificial Sequence
  Synthetic
gataagaaagtuagggactcctuggg

SEQ ID NO: 68074 - DNA, 28 bp, Artificial Sequence
  Synthetic
actcacgtatguataaagcctagucagt

SEQ ID NO: 68075 - DNA, 23 bp, Artificial Sequence
  Synthetic
acacgtcccauttgaccagttua

SEQ ID NO: 68076 - DNA, 23 bp, Artificial Sequence
  Synthetic
cgaatagugctaagcugggaagt

SEQ ID NO: 68077 - DNA, 17 bp, Artificial Sequence
  Synthetic
cugggugacgccaggag

SEQ ID NO: 68078 - DNA, 23 bp, Artificial Sequence
  Synthetic
ctttggcuttcagagtucgaacc

SEQ ID NO: 68079 - DNA, 28 bp, Artificial Sequence
  Synthetic
gatacctatgacguggaaggtgtttuat

SEQ ID NO: 68080 - DNA, 21 bp, Artificial Sequence
  Synthetic
ggtggcugggaaccttcauat

SEQ ID NO: 68081 - DNA, 23 bp, Artificial Sequence
  Synthetic
ggaucatcauccggaagacagaa

SEQ ID NO: 68082 - DNA, 26 bp, Artificial Sequence
  Synthetic
ttctgttgcugataagatgccaugat

SEQ ID NO: 68083 - DNA, 22 bp, Artificial Sequence
  Synthetic
ggcctttgguattggcagtcut

SEQ ID NO: 68084 - DNA, 22 bp, Artificial Sequence
  Synthetic
gggcaaacacuatctcuggact

SEQ ID NO: 68085 - DNA, 26 bp, Artificial Sequence
  Synthetic
ttgtagtcaacugctgcttattguct

SEQ ID NO: 68086 - DNA, 28 bp, Artificial Sequence
  Synthetic
tctgtatcatcugtatccatgtguacca

SEQ ID NO: 68087 - DNA, 24 bp, Artificial Sequence
  Synthetic
tgtatgtgtguttgactccacucc

SEQ ID NO: 68088 - DNA, 22 bp, Artificial Sequence
  Synthetic
ctggaggcaugaagugagacaa

SEQ ID NO: 68089 - DNA, 20 bp, Artificial Sequence
  Synthetic
gtggcacagacugtguccat

SEQ ID NO: 68090 - DNA, 22 bp, Artificial Sequence
  Synthetic
ccaagtcttugcccagttcugt

SEQ ID NO: 68091 - DNA, 19 bp, Artificial Sequence
  Synthetic
cattcagcagucgguggga

SEQ ID NO: 68092 - DNA, 21 bp, Artificial Sequence
  Synthetic
cagagcgagggucaggtttua

SEQ ID NO: 68093 - DNA, 28 bp, Artificial Sequence
  Synthetic
gcagttttacacutacagggatuacact

SEQ ID NO: 68094 - DNA, 19 bp, Artificial Sequence
  Synthetic
cccaccaagcagcuguacc

SEQ ID NO: 68095 - DNA, 22 bp, Artificial Sequence
  Synthetic
actgttgcaacugcctttucac

SEQ ID NO: 68096 - DNA, 22 bp, Artificial Sequence
  Synthetic
acctcctttuccagagtcucct

SEQ ID NO: 68097 - DNA, 23 bp, Artificial Sequence
  Synthetic
ccagctcucagatttgccaauga

SEQ ID NO: 68098 - DNA, 22 bp, Artificial Sequence
  Synthetic
tcagtgcctutgctcttgtcuc

SEQ ID NO: 68099 - DNA, 24 bp, Artificial Sequence
  Synthetic
aggtcctagtcuccctccagauaa

SEQ ID NO: 68100 - DNA, 22 bp, Artificial Sequence
  Synthetic
ggugcacacaggcaatattuga

SEQ ID NO: 68101 - DNA, 20 bp, Artificial Sequence
  Synthetic
gcutacccgtucaccaggag

SEQ ID NO: 68102 - DNA, 22 bp, Artificial Sequence
  Synthetic
acaggauttccuggaccaaagg

SEQ ID NO: 68103 - DNA, 21 bp, Artificial Sequence
  Synthetic
ccucatcugaccagccagaat

SEQ ID NO: 68104 - DNA, 24 bp, Artificial Sequence
  Synthetic
gaccagggcugtccttagattuag

SEQ ID NO: 68105 - DNA, 22 bp, Artificial Sequence
  Synthetic
cugacacagaaggcuccagaaa

SEQ ID NO: 68106 - DNA, 24 bp, Artificial Sequence
  Synthetic
ctaggaggcagaagcuaagtgaut

SEQ ID NO: 68107 - DNA, 25 bp, Artificial Sequence
  Synthetic
ccagctgcaautctacagcaauaga

SEQ ID NO: 68108 - DNA, 22 bp, Artificial Sequence
  Synthetic
gctgtcaggaugggactgttug

SEQ ID NO: 68109 - DNA, 21 bp, Artificial Sequence
  Synthetic
gggtccccaggutatgagcua

SEQ ID NO: 68110 - DNA, 26 bp, Artificial Sequence
  Synthetic
aatactatgggcucttctcctccuac

SEQ ID NO: 68111 - DNA, 20 bp, Artificial Sequence
  Synthetic
gcccccucggagaagguaat

SEQ ID NO: 68112 - DNA, 21 bp, Artificial Sequence
  Synthetic
gcccacttcucatctcctgut

SEQ ID NO: 68113 - DNA, 25 bp, Artificial Sequence
  Synthetic
tgactacactacucttgggcgauag

SEQ ID NO: 68114 - DNA, 26 bp, Artificial Sequence
  Synthetic
aaaatggccccuttgataatgtgtuc

SEQ ID NO: 68115 - DNA, 22 bp, Artificial Sequence
  Synthetic
gtcagagaaaccguctucacca

SEQ ID NO: 68116 - DNA, 27 bp, Artificial Sequence
  Synthetic
ccactacaaatccutcttttccctcut

SEQ ID NO: 68117 - DNA, 28 bp, Artificial Sequence
  Synthetic
gccatttcauaagggttatcttttccug

SEQ ID NO: 68118 - DNA, 28 bp, Artificial Sequence
  Synthetic
catttcgugtatttcaaaaucggacaga

SEQ ID NO: 68119 - DNA, 26 bp, Artificial Sequence
  Synthetic
ttgtgctgtuacgctgttcttactua

SEQ ID NO: 68120 - DNA, 31 bp, Artificial Sequence
  Synthetic
actcacttacagugacttaattctctctuct

SEQ ID NO: 68121 - DNA, 26 bp, Artificial Sequence
  Synthetic
agaauagtagctcuggacaaggacat

SEQ ID NO: 68122 - DNA, 29 bp, Artificial Sequence
  Synthetic
aagaaactgtugttgctatacucaggaaa

SEQ ID NO: 68123 - DNA, 24 bp, Artificial Sequence
  Synthetic
ggtgttgauggatcctgtuaagca

SEQ ID NO: 68124 - DNA, 17 bp, Artificial Sequence
  Synthetic
cagcccucaccctgugt

SEQ ID NO: 68125 - DNA, 17 bp, Artificial Sequence
  Synthetic
gcaccccaggccaucug

SEQ ID NO: 68126 - DNA, 23 bp, Artificial Sequence
  Synthetic
ctcaaccuaaggctgtgtgtuct

SEQ ID NO: 68127 - DNA, 23 bp, Artificial Sequence
  Synthetic
gaagggacutcugagaaggaagg

SEQ ID NO: 68128 - DNA, 22 bp, Artificial Sequence
  Synthetic
gcctgtttuaaaccacggtgut

SEQ ID NO: 68129 - DNA, 20 bp, Artificial Sequence
  Synthetic
gcacgttgucgttgacaucc

SEQ ID NO: 68130 - DNA, 28 bp, Artificial Sequence
  Synthetic
ggaaggaaaggaacuctaaaaacctcut

SEQ ID NO: 68131 - DNA, 21 bp, Artificial Sequence
  Synthetic
agaccttuggcagccuagaga

SEQ ID NO: 68132 - DNA, 21 bp, Artificial Sequence
  Synthetic
gcaagggugctctggtgttua

SEQ ID NO: 68133 - DNA, 28 bp, Artificial Sequence
  Synthetic
gctccaatttcucagaactcattctuca

SEQ ID NO: 68134 - DNA, 21 bp, Artificial Sequence
  Synthetic
tgctgctgaucttccctggua

SEQ ID NO: 68135 - DNA, 24 bp, Artificial Sequence
  Synthetic
ctttctcttgccutcgagttctuc

SEQ ID NO: 68136 - DNA, 20 bp, Artificial Sequence
  Synthetic
ggcagcggaaacgutcatut

SEQ ID NO: 68137 - DNA, 26 bp, Artificial Sequence
  Synthetic
gtttgccacaaugtttgtatctggut

SEQ ID NO: 68138 - DNA, 20 bp, Artificial Sequence
  Synthetic
acuctgtcccugcaggagat

SEQ ID NO: 68139 - DNA, 21 bp, Artificial Sequence
  Synthetic
ggtcctucctggtcuggaaac

SEQ ID NO: 68140 - DNA, 23 bp, Artificial Sequence
  Synthetic
gccaaagggaguttgagatucct

SEQ ID NO: 68141 - DNA, 21 bp, Artificial Sequence
  Synthetic
tgtatccaccugggctgttuc

SEQ ID NO: 68142 - DNA, 22 bp, Artificial Sequence
  Synthetic
gcagttcuccccactcttccua

SEQ ID NO: 68143 - DNA, 20 bp, Artificial Sequence
  Synthetic
caggcaauccaguggaggac

SEQ ID NO: 68144 - DNA, 28 bp, Artificial Sequence
  Synthetic
acttgttttcattgutctcaggtaccuc

SEQ ID NO: 68145 - DNA, 25 bp, Artificial Sequence
  Synthetic
gtttccccucaaaggaatccttcut

SEQ ID NO: 68146 - DNA, 21 bp, Artificial Sequence
  Synthetic
ggagtgtguagagctctugct

SEQ ID NO: 68147 - DNA, 23 bp, Artificial Sequence
  Synthetic
gattacatgcugccctacttgug

SEQ ID NO: 68148 - DNA, 23 bp, Artificial Sequence
  Synthetic
ccatttcccaugttgctuccaaa

SEQ ID NO: 68149 - DNA, 22 bp, Artificial Sequence
  Synthetic
agtctugccaggaggaatcuct

SEQ ID NO: 68150 - DNA, 22 bp, Artificial Sequence
  Synthetic
agtgagggacuggaaagggaut

SEQ ID NO: 68151 - DNA, 24 bp, Artificial Sequence
  Synthetic
gcaggtgaggauactgagtcuaac

SEQ ID NO: 68152 - DNA, 22 bp, Artificial Sequence
  Synthetic
tggccaaggutaagtgttugct

SEQ ID NO: 68153 - DNA, 21 bp, Artificial Sequence
  Synthetic
ggaggagacggagcuctacug

SEQ ID NO: 68154 - DNA, 21 bp, Artificial Sequence
  Synthetic
gagcatggcgucatcattgut

SEQ ID NO: 68155 - DNA, 20 bp, Artificial Sequence
  Synthetic
acgagaagcugtgcgagtut

SEQ ID NO: 68156 - DNA, 23 bp, Artificial Sequence
  Synthetic
gcaggatggccaugtagatgaug

SEQ ID NO: 68157 - DNA, 20 bp, Artificial Sequence
  Synthetic
aagcccaaggucatcgagug

SEQ ID NO: 68158 - DNA, 21 bp, Artificial Sequence
  Synthetic
cccacactuagcagccagtuc

SEQ ID NO: 68159 - DNA, 26 bp, Artificial Sequence
  Synthetic
accctaccttatucttgacctagcuc

SEQ ID NO: 68160 - DNA, 21 bp, Artificial Sequence
  Synthetic
ggcugccctcaaaauccacat

SEQ ID NO: 68161 - DNA, 24 bp, Artificial Sequence
  Synthetic
cccatugacaaaggtccttcucag

SEQ ID NO: 68162 - DNA, 25 bp, Artificial Sequence
  Synthetic
ttcatgggautcaactguggaaact

SEQ ID NO: 68163 - DNA, 24 bp, Artificial Sequence
  Synthetic
tcgttaaacaugggtgttgaucca

SEQ ID NO: 68164 - DNA, 28 bp, Artificial Sequence
  Synthetic
tgccattccaagugtcttatttttgtuc

SEQ ID NO: 68165 - DNA, 28 bp, Artificial Sequence
  Synthetic
tgttgctgagatauttcacaccagtaut

SEQ ID NO: 68166 - DNA, 28 bp, Artificial Sequence
  Synthetic
ccctcctaccaucttagtatctaaugct

SEQ ID NO: 68167 - DNA, 27 bp, Artificial Sequence
  Synthetic
aaagaacacacautgctgtgguaaaaa

SEQ ID NO: 68168 - DNA, 23 bp, Artificial Sequence
  Synthetic
cggattcaccugtcaggacatuc

SEQ ID NO: 68169 - DNA, 20 bp, Artificial Sequence
  Synthetic
gctggagacucccuacccaa

SEQ ID NO: 68170 - DNA, 22 bp, Artificial Sequence
  Synthetic
tcacggacacaaugtguagcat

SEQ ID NO: 68171 - DNA, 24 bp, Artificial Sequence
  Synthetic
gtctttgtacgugatgtagtugcc

SEQ ID NO: 68172 - DNA, 19 bp, Artificial Sequence
  Synthetic
cacaugtcugcgcgaacaa

SEQ ID NO: 68173 - DNA, 27 bp, Artificial Sequence
  Synthetic
gtgccctgaaaugtgtaacaaauacat

SEQ ID NO: 68174 - DNA, 24 bp, Artificial Sequence
  Synthetic
tgggacactutcacagaactucac

SEQ ID NO: 68175 - DNA, 26 bp, Artificial Sequence
  Synthetic
gcctcaacttgugttcttttccatut

SEQ ID NO: 68176 - DNA, 21 bp, Artificial Sequence
  Synthetic
ggaacggccuccaacaaaauc

SEQ ID NO: 68177 - DNA, 28 bp, Artificial Sequence
  Synthetic
cgtttaatacttgutcttggccttcaut

SEQ ID NO: 68178 - DNA, 28 bp, Artificial Sequence
  Synthetic
caccttatugcagcaattaaugaaaacc

SEQ ID NO: 68179 - DNA, 25 bp, Artificial Sequence
  Synthetic
gctcagttttugaatccctgtucca

SEQ ID NO: 68180 - DNA, 23 bp, Artificial Sequence
  Synthetic
tcaagugaatgucacggaaagca

SEQ ID NO: 68181 - DNA, 26 bp, Artificial Sequence
  Synthetic
gcttattcaggagutccttggtgaut

SEQ ID NO: 68182 - DNA, 23 bp, Artificial Sequence
  Synthetic
ggtgatctagutgggttccagut

SEQ ID NO: 68183 - DNA, 28 bp, Artificial Sequence
  Synthetic
caaccatgcatucaacaattacgtttut

SEQ ID NO: 68184 - DNA, 25 bp, Artificial Sequence
  Synthetic
gaggccatatuttactcctggauct

SEQ ID NO: 68185 - DNA, 27 bp, Artificial Sequence
  Synthetic
tgacactggaaagutcagagaaaaugt

SEQ ID NO: 68186 - DNA, 24 bp, Artificial Sequence
  Synthetic
cttgcaactccuatctctcacuca

SEQ ID NO: 68187 - DNA, 23 bp, Artificial Sequence
  Synthetic
tcgtaccaacguttctcatgugg

SEQ ID NO: 68188 - DNA, 24 bp, Artificial Sequence
  Synthetic
aggccaaaauacaatagcagcugt

SEQ ID NO: 68189 - DNA, 27 bp, Artificial Sequence
  Synthetic
aaaaacccttcuaccaatgtctcagut

SEQ ID NO: 68190 - DNA, 25 bp, Artificial Sequence
  Synthetic
cacagcugagattatggauccagaa

SEQ ID NO: 68191 - DNA, 26 bp, Artificial Sequence
  Synthetic
gtattattccaacugaagctgtugcc

SEQ ID NO: 68192 - DNA, 26 bp, Artificial Sequence
  Synthetic
aaaacccaccuctttttgcataacug

SEQ ID NO: 68193 - DNA, 21 bp, Artificial Sequence
  Synthetic
cttgaugccgcacaugagaaa

SEQ ID NO: 68194 - DNA, 22 bp, Artificial Sequence
  Synthetic
tucgaagaugacccggaagaag

SEQ ID NO: 68195 - DNA, 20 bp, Artificial Sequence
  Synthetic
cctgcagcugatcttcgugt

SEQ ID NO: 68196 - DNA, 29 bp, Artificial Sequence
  Synthetic
tctactgaaataaautctgcattggugct

SEQ ID NO: 68197 - DNA, 24 bp, Artificial Sequence
  Synthetic
gcagagaaugagggaggaguacat

SEQ ID NO: 68198 - DNA, 26 bp, Artificial Sequence
  Synthetic
cttcctcagacautcaaacgtgttut

SEQ ID NO: 68199 - DNA, 24 bp, Artificial Sequence
  Synthetic
atgttttgguggacccattacaut

SEQ ID NO: 68200 - DNA, 21 bp, Artificial Sequence
  Synthetic
cgcagtgtutcactcgcuact

SEQ ID NO: 68201 - DNA, 24 bp, Artificial Sequence
  Synthetic
gtgtccttcugggaccaaaatuct

SEQ ID NO: 68202 - DNA, 21 bp, Artificial Sequence
  Synthetic
tcggtcucctgtggugagaaa

SEQ ID NO: 68203 - DNA, 24 bp, Artificial Sequence
  Synthetic
tccttcatcguttgtctttgcuct

SEQ ID NO: 68204 - DNA, 24 bp, Artificial Sequence
  Synthetic
cggatctgccuctacatctcuagt

SEQ ID NO: 68205 - DNA, 21 bp, Artificial Sequence
  Synthetic
gcctgttgcauctacccctug

SEQ ID NO: 68206 - DNA, 22 bp, Artificial Sequence
  Synthetic
cugcatcttcttucccagacct

SEQ ID NO: 68207 - DNA, 22 bp, Artificial Sequence
  Synthetic
cccgaugacaaggaagagttug

SEQ ID NO: 68208 - DNA, 17 bp, Artificial Sequence
  Synthetic
gctgcacccgcucacua

SEQ ID NO: 68209 - DNA, 20 bp, Artificial Sequence
  Synthetic
ctcatgcccacuctccugat

SEQ ID NO: 68210 - DNA, 20 bp, Artificial Sequence
  Synthetic
gagacugtggugggaaccat

SEQ ID NO: 68211 - DNA, 28 bp, Artificial Sequence
  Synthetic
acatccatcatauaactctccttcccut

SEQ ID NO: 68212 - DNA, 21 bp, Artificial Sequence
  Synthetic
ccaggtugccatggagauagt

SEQ ID NO: 68213 - DNA, 29 bp, Artificial Sequence
  Synthetic
ccctaacttttctutctctccttcttcuc

SEQ ID NO: 68214 - DNA, 21 bp, Artificial Sequence
  Synthetic
agaaggaccgagutctgguct

SEQ ID NO: 68215 - DNA, 22 bp, Artificial Sequence
  Synthetic
cctccctccauctcacacttut

SEQ ID NO: 68216 - DNA, 23 bp, Artificial Sequence
  Synthetic
agaaagggagucacaagacacug

SEQ ID NO: 68217 - DNA, 27 bp, Artificial Sequence
  Synthetic
aggaatccaugactttgcaacauagag

SEQ ID NO: 68218 - DNA, 25 bp, Artificial Sequence
  Synthetic
tccctgctgugcctttttacauaat

SEQ ID NO: 68219 - DNA, 25 bp, Artificial Sequence
  Synthetic
ctgattcucaccacacatccttuct

SEQ ID NO: 68220 - DNA, 20 bp, Artificial Sequence
  Synthetic
ccctaggcgcugtgtcttua

SEQ ID NO: 68221 - DNA, 28 bp, Artificial Sequence
  Synthetic
ggattaattggcaaauttgtgcttugat

SEQ ID NO: 68222 - DNA, 22 bp, Artificial Sequence
  Synthetic
gggagcaggugtgaaagtuacc

SEQ ID NO: 68223 - DNA, 25 bp, Artificial Sequence
  Synthetic
gaacagtaaggucgttgtttcgtuc

SEQ ID NO: 68224 - DNA, 21 bp, Artificial Sequence
  Synthetic
tcttcacgcugctggttugaa

SEQ ID NO: 68225 - DNA, 22 bp, Artificial Sequence
  Synthetic
gggagcgaagauacctgcuaag

SEQ ID NO: 68226 - DNA, 23 bp, Artificial Sequence
  Synthetic
gggttgattuggagattcagugt

SEQ ID NO: 68227 - DNA, 21 bp, Artificial Sequence
  Synthetic
gtagcctagucccctcccaut

SEQ ID NO: 68228 - DNA, 25 bp, Artificial Sequence
  Synthetic
catctccccucacagataaagctuc

SEQ ID NO: 68229 - DNA, 28 bp, Artificial Sequence
  Synthetic
gctgtccatgaucccttatttactuact

SEQ ID NO: 68230 - DNA, 27 bp, Artificial Sequence
  Synthetic
aactttggcaaugatgtcatucaaaca

SEQ ID NO: 68231 - DNA, 27 bp, Artificial Sequence
  Synthetic
ccacctttaacauggtcatttccatut

SEQ ID NO: 68232 - DNA, 28 bp, Artificial Sequence
  Synthetic
ggcauaactgtctaaaauacaggagact

SEQ ID NO: 68233 - DNA, 28 bp, Artificial Sequence
  Synthetic
tcctttgtgacaauggacaatguagaaa

SEQ ID NO: 68234 - DNA, 19 bp, Artificial Sequence
  Synthetic
ctgguctggcaucgacact

SEQ ID NO: 68235 - DNA, 23 bp, Artificial Sequence
  Synthetic
gcctaccuggaatattgctcugg

SEQ ID NO: 68236 - DNA, 22 bp, Artificial Sequence
  Synthetic
cgggaagcacuatggcatcuat

SEQ ID NO: 68237 - DNA, 22 bp, Artificial Sequence
  Synthetic
gccatgggcutggacattttug

SEQ ID NO: 68238 - DNA, 19 bp, Artificial Sequence
  Synthetic
cgcctcccuccacttugat

SEQ ID NO: 68239 - DNA, 19 bp, Artificial Sequence
  Synthetic
acggacaccugcatgacuc

SEQ ID NO: 68240 - DNA, 22 bp, Artificial Sequence
  Synthetic
cagcaccauacctggaagtuct

SEQ ID NO: 68241 - DNA, 21 bp, Artificial Sequence
  Synthetic
gctgatcugccatgtccctug

SEQ ID NO: 68242 - DNA, 26 bp, Artificial Sequence
  Synthetic
aaacaagtcacucttcatctguccaa

SEQ ID NO: 68243 - DNA, 18 bp, Artificial Sequence
  Synthetic
ccacgcugaggugaggac

SEQ ID NO: 68244 - DNA, 23 bp, Artificial Sequence
  Synthetic
gcttggagauccctttcgaacug

SEQ ID NO: 68245 - DNA, 26 bp, Artificial Sequence
  Synthetic
ttcatgaagtugagcctcatagaaug

SEQ ID NO: 68246 - DNA, 20 bp, Artificial Sequence
  Synthetic
ccggccccuactcactttug

SEQ ID NO: 68247 - DNA, 24 bp, Artificial Sequence
  Synthetic
ccagaucaccacgagagtaaauct

SEQ ID NO: 68248 - DNA, 21 bp, Artificial Sequence
  Synthetic
agcucaccttctugcacacat

SEQ ID NO: 68249 - DNA, 22 bp, Artificial Sequence
  Synthetic
tcgttagcaaagucgcactcut

SEQ ID NO: 68250 - DNA, 22 bp, Artificial Sequence
  Synthetic
caaggtcttcgucctgtgaguc

SEQ ID NO: 68251 - DNA, 23 bp, Artificial Sequence
  Synthetic
gggcucaagtcacucaaaaaggt

SEQ ID NO: 68252 - DNA, 19 bp, Artificial Sequence
  Synthetic
ccaacucauaccccggcat

SEQ ID NO: 68253 - DNA, 19 bp, Artificial Sequence
  Synthetic
gacuccccacccaccttug

SEQ ID NO: 68254 - DNA, 20 bp, Artificial Sequence
  Synthetic
gtcctcacugtccagctuca

SEQ ID NO: 68255 - DNA, 19 bp, Artificial Sequence
  Synthetic
ccaggugccaucccaaact

SEQ ID NO: 68256 - DNA, 23 bp, Artificial Sequence
  Synthetic
ctggccugaaaatacatggucct

SEQ ID NO: 68257 - DNA, 21 bp, Artificial Sequence
  Synthetic
ggccaagutcctggacuacac

SEQ ID NO: 68258 - DNA, 21 bp, Artificial Sequence
  Synthetic
gcctccaggaauggccataut

SEQ ID NO: 68259 - DNA, 23 bp, Artificial Sequence
  Synthetic
cttgaggugggcctttcatttut

SEQ ID NO: 68260 - DNA, 23 bp, Artificial Sequence
  Synthetic
tcaggaugttcctuaccccaagt

SEQ ID NO: 68261 - DNA, 22 bp, Artificial Sequence
  Synthetic
ggcctttaaacugaggtgccut

SEQ ID NO: 68262 - DNA, 23 bp, Artificial Sequence
  Synthetic
cccaaaggagggacauaccacua

SEQ ID NO: 68263 - DNA, 28 bp, Artificial Sequence
  Synthetic
gaagagaccucccaaagctgtatttuaa

SEQ ID NO: 68264 - DNA, 25 bp, Artificial Sequence
  Synthetic
aatgagcuaaccggagtatttcugg

SEQ ID NO: 68265 - DNA, 27 bp, Artificial Sequence
  Synthetic
acctaccactuttcacacaacauacat

SEQ ID NO: 68266 - DNA, 21 bp, Artificial Sequence
  Synthetic
gccacugacaaccaccctuaa

SEQ ID NO: 68267 - DNA, 23 bp, Artificial Sequence
  Synthetic
cctctgatucctcactgatugct

SEQ ID NO: 68268 - DNA, 23 bp, Artificial Sequence
  Synthetic
gggtgaagaggaaucccaaagut

SEQ ID NO: 68269 - DNA, 22 bp, Artificial Sequence
  Synthetic
ccctucccagaaaaccuaccag

SEQ ID NO: 68270 - DNA, 20 bp, Artificial Sequence
  Synthetic
catccuaccgcacctugaca

SEQ ID NO: 68271 - DNA, 21 bp, Artificial Sequence
  Synthetic
ggatuaggacccaggucccat

SEQ ID NO: 68272 - DNA, 24 bp, Artificial Sequence
  Synthetic
ctgttuagcaagacaagcccuaga

SEQ ID NO: 68273 - DNA, 28 bp, Artificial Sequence
  Synthetic
ccatcttatcccgauaaactcgattuga

SEQ ID NO: 68274 - DNA, 23 bp, Artificial Sequence
  Synthetic
ggtgtggagacugacaaagugag

SEQ ID NO: 68275 - DNA, 21 bp, Artificial Sequence
  Synthetic
cctgagggaugagcaggtaug

SEQ ID NO: 68276 - DNA, 23 bp, Artificial Sequence
  Synthetic
cagtctcatacucccggacucat

SEQ ID NO: 68277 - DNA, 23 bp, Artificial Sequence
  Synthetic
tgattcuaaccagggccaugaac

SEQ ID NO: 68278 - DNA, 20 bp, Artificial Sequence
  Synthetic
gcggguggccaacctaauag

SEQ ID NO: 68279 - DNA, 27 bp, Artificial Sequence
  Synthetic
tgtctgggcacuaaaaataacctgtut

SEQ ID NO: 68280 - DNA, 27 bp, Artificial Sequence
  Synthetic
acacaagaaataauaatgacgccucca

SEQ ID NO: 68281 - DNA, 26 bp, Artificial Sequence
  Synthetic
atgaggcaaguatgggtcaagauaac

SEQ ID NO: 68282 - DNA, 18 bp, Artificial Sequence
  Synthetic
ggatuccaccaccucgga

SEQ ID NO: 68283 - DNA, 20 bp, Artificial Sequence
  Synthetic
gugcaggatucagggagcaa

SEQ ID NO: 68284 - DNA, 30 bp, Artificial Sequence
  Synthetic
agtatgagtttuagaggctgttaattugct

SEQ ID NO: 68285 - DNA, 21 bp, Artificial Sequence
  Synthetic
tcagctgccuacttccuccat

SEQ ID NO: 68286 - DNA, 28 bp, Artificial Sequence
  Synthetic
tttctatttgctgutctttttggctuca

SEQ ID NO: 68287 - DNA, 28 bp, Artificial Sequence
  Synthetic
ccttttggactuacattggtgatgatuc

SEQ ID NO: 68288 - DNA, 24 bp, Artificial Sequence
  Synthetic
caaactagaaguggccctguacat

SEQ ID NO: 68289 - DNA, 25 bp, Artificial Sequence
  Synthetic
tcatattgcugacagaggcaaacuc

SEQ ID NO: 68290 - DNA, 27 bp, Artificial Sequence
  Synthetic
actcatcuccctttaatttuggcacat

SEQ ID NO: 68291 - DNA, 27 bp, Artificial Sequence
  Synthetic
gcacaattccauggattggattuaaca

SEQ ID NO: 68292 - DNA, 22 bp, Artificial Sequence
  Synthetic
gaagcctcuctctcctctcuga

SEQ ID NO: 68293 - DNA, 21 bp, Artificial Sequence
  Synthetic
ggtgctgauggtcctgctgua

SEQ ID NO: 68294 - DNA, 23 bp, Artificial Sequence
  Synthetic
gggaagucacaggaacagtuagg

SEQ ID NO: 68295 - DNA, 19 bp, Artificial Sequence
  Synthetic
gtgtgucgcggagtucact

SEQ ID NO: 68296 - DNA, 20 bp, Artificial Sequence
  Synthetic
actgaccccuctccctctut

SEQ ID NO: 68297 - DNA, 19 bp, Artificial Sequence
  Synthetic
gggagatgugcgtctgcuc

SEQ ID NO: 68298 - DNA, 17 bp, Artificial Sequence
  Synthetic
caucggcgagcugagca

SEQ ID NO: 68299 - DNA, 18 bp, Artificial Sequence
  Synthetic
gcctgcugcttggacauc

SEQ ID NO: 68300 - DNA, 21 bp, Artificial Sequence
  Synthetic
cctctgtcccuccaaccauga

SEQ ID NO: 68301 - DNA, 20 bp, Artificial Sequence
  Synthetic
tgaggaccuggaugcacaag

SEQ ID NO: 68302 - DNA, 21 bp, Artificial Sequence
  Synthetic
cugtccccuaccaacaccaac

SEQ ID NO: 68303 - DNA, 22 bp, Artificial Sequence
  Synthetic
ggcaauaccaagaggugggaaa

SEQ ID NO: 68304 - DNA, 22 bp, Artificial Sequence
  Synthetic
ggttccaacaaguaggtcccut

SEQ ID NO: 68305 - DNA, 21 bp, Artificial Sequence
  Synthetic
gggcaatgucaccgttgatut

SEQ ID NO: 68306 - DNA, 23 bp, Artificial Sequence
  Synthetic
cagcaggtguctttcttctggut

SEQ ID NO: 68307 - DNA, 20 bp, Artificial Sequence
  Synthetic
gatgagagccagucgctugt

SEQ ID NO: 68308 - DNA, 24 bp, Artificial Sequence
  Synthetic
ctactccatgauttcctgctggut

SEQ ID NO: 68309 - DNA, 19 bp, Artificial Sequence
  Synthetic
cctgggtgauggccttguc

SEQ ID NO: 68310 - DNA, 24 bp, Artificial Sequence
  Synthetic
tgggatccuggatgtctacatcut

SEQ ID NO: 68311 - DNA, 20 bp, Artificial Sequence
  Synthetic
cggcaugaacgggtatccug

SEQ ID NO: 68312 - DNA, 20 bp, Artificial Sequence
  Synthetic
ggaaccuccgagctcuccat

SEQ ID NO: 68313 - DNA, 18 bp, Artificial Sequence
  Synthetic
cttggccucctcctgcug

SEQ ID NO: 68314 - DNA, 28 bp, Artificial Sequence
  Synthetic
gcaagtggtcauttacatcatcaatgut

SEQ ID NO: 68315 - DNA, 28 bp, Artificial Sequence
  Synthetic
tggtgcttucccccaataattaaatuct

SEQ ID NO: 68316 - DNA, 19 bp, Artificial Sequence
  Synthetic
cagaccggutgcgattgug

SEQ ID NO: 68317 - DNA, 25 bp, Artificial Sequence
  Synthetic
caaauttagcgtucaggagaagcag

SEQ ID NO: 68318 - DNA, 18 bp, Artificial Sequence
  Synthetic
cgagucuccccggagagg

SEQ ID NO: 68319 - DNA, 20 bp, Artificial Sequence
  Synthetic
cagctcgcugttctgugact

SEQ ID NO: 68320 - DNA, 21 bp, Artificial Sequence
  Synthetic
cgacagcccaguatgtcugag

SEQ ID NO: 68321 - DNA, 24 bp, Artificial Sequence
  Synthetic
caactacacaagugcaggactcua

SEQ ID NO: 68322 - DNA, 18 bp, Artificial Sequence
  Synthetic
gagcucggtgcuggagaa

SEQ ID NO: 68323 - DNA, 17 bp, Artificial Sequence
  Synthetic
cagggagucctcugccc

SEQ ID NO: 68324 - DNA, 20 bp, Artificial Sequence
  Synthetic
cggcatcutgtccacgugaa

SEQ ID NO: 68325 - DNA, 23 bp, Artificial Sequence
  Synthetic
cttagctgtcacutagcgtccuc

SEQ ID NO: 68326 - DNA, 21 bp, Artificial Sequence
  Synthetic
ccccuccccacctgtcttuat

SEQ ID NO: 68327 - DNA, 20 bp, Artificial Sequence
  Synthetic
ccagaccacugaagctccug

SEQ ID NO: 68328 - DNA, 17 bp, Artificial Sequence
  Synthetic
gucttcuccggcggagt

SEQ ID NO: 68329 - DNA, 22 bp, Artificial Sequence
  Synthetic
tgttgtcggucttgtggtcauc

SEQ ID NO: 68330 - DNA, 33 bp, Artificial Sequence
  Synthetic
actgatttgtatttcautagtatattggaguga

SEQ ID NO: 68331 - DNA, 27 bp, Artificial Sequence
  Synthetic
ccttccttcatgauttcctcagtctut

SEQ ID NO: 68332 - DNA, 23 bp, Artificial Sequence
  Synthetic
cgactccaucttgaacccaucaa

SEQ ID NO: 68333 - DNA, 21 bp, Artificial Sequence
  Synthetic
cucgccagaaaaccttugcag

SEQ ID NO: 68334 - DNA, 21 bp, Artificial Sequence
  Synthetic
ggactuggccactggctuaat

SEQ ID NO: 68335 - DNA, 25 bp, Artificial Sequence
  Synthetic
catctataagagcugtcctgggaug

SEQ ID NO: 68336 - DNA, 20 bp, Artificial Sequence
  Synthetic
catcacgcucttccctccug

SEQ ID NO: 68337 - DNA, 20 bp, Artificial Sequence
  Synthetic
cagcatccucagtgcctugt

SEQ ID NO: 68338 - DNA, 18 bp, Artificial Sequence
  Synthetic
cgugggccagaaccucac

SEQ ID NO: 68339 - DNA, 26 bp, Artificial Sequence
  Synthetic
gcttacagcaagaaauccacacatuc

SEQ ID NO: 68340 - DNA, 20 bp, Artificial Sequence
  Synthetic
gggtgauggcttgacatucc

SEQ ID NO: 68341 - DNA, 21 bp, Artificial Sequence
  Synthetic
gcagcgugatctcgaugacat

SEQ ID NO: 68342 - DNA, 18 bp, Artificial Sequence
  Synthetic
ggaguccaagcgccagut

SEQ ID NO: 68343 - DNA, 17 bp, Artificial Sequence
  Synthetic
cccucgggcuccgagat

SEQ ID NO: 68344 - DNA, 21 bp, Artificial Sequence
  Synthetic
ggtggtctccuctgctctcut

SEQ ID NO: 68345 - DNA, 22 bp, Artificial Sequence
  Synthetic
ggattccagagaugacgtuggg

SEQ ID NO: 68346 - DNA, 20 bp, Artificial Sequence
  Synthetic
catgtcaauccgcgtggaug

SEQ ID NO: 68347 - DNA, 27 bp, Artificial Sequence
  Synthetic
acagtgatcgataugaggaagatgcua

SEQ ID NO: 68348 - DNA, 18 bp, Artificial Sequence
  Synthetic
cagggucaccacctguga

SEQ ID NO: 68349 - DNA, 19 bp, Artificial Sequence
  Synthetic
ggctgccaccuttcctcug

SEQ ID NO: 68350 - DNA, 22 bp, Artificial Sequence
  Synthetic
ccacctctcugctttcttcuga

SEQ ID NO: 68351 - DNA, 21 bp, Artificial Sequence
  Synthetic
gtggtagatguagccggtgug

SEQ ID NO: 68352 - DNA, 17 bp, Artificial Sequence
  Synthetic
ggccuggtcgcugaact

SEQ ID NO: 68353 - DNA, 18 bp, Artificial Sequence
  Synthetic
gggtcuggcccataccug

SEQ ID NO: 68354 - DNA, 22 bp, Artificial Sequence
  Synthetic
cggttguacagcacgttgauct

SEQ ID NO: 68355 - DNA, 21 bp, Artificial Sequence
  Synthetic
accagcuggagtcugagaagt

SEQ ID NO: 68356 - DNA, 21 bp, Artificial Sequence
  Synthetic
gaagggtggucttggaggtug

SEQ ID NO: 68357 - DNA, 22 bp, Artificial Sequence
  Synthetic
ctctcacguctcttccctcuct

SEQ ID NO: 68358 - DNA, 22 bp, Artificial Sequence
  Synthetic
cctgccuaagccctgggtaaua

SEQ ID NO: 68359 - DNA, 23 bp, Artificial Sequence
  Synthetic
ctaacctctgacucatcgccauc

SEQ ID NO: 68360 - DNA, 22 bp, Artificial Sequence
  Synthetic
ctttctgcuggtgtttguccat

SEQ ID NO: 68361 - DNA, 23 bp, Artificial Sequence
  Synthetic
cagcugaaccagaucaaaaaccc

SEQ ID NO: 68362 - DNA, 20 bp, Artificial Sequence
  Synthetic
tctccccagcguggtatcut

SEQ ID NO: 68363 - DNA, 21 bp, Artificial Sequence
  Synthetic
catccctcuctgactgccauc

SEQ ID NO: 68364 - DNA, 22 bp, Artificial Sequence
  Synthetic
actccacgaccaugtcctcaua

SEQ ID NO: 68365 - DNA, 21 bp, Artificial Sequence
  Synthetic
gcccacgaaucatgcagucat

SEQ ID NO: 68366 - DNA, 26 bp, Artificial Sequence
  Synthetic
gagaagcagaauagagccaagtaugg

SEQ ID NO: 68367 - DNA, 23 bp, Artificial Sequence
  Synthetic
tcaatcuccacagcatggucaag

SEQ ID NO: 68368 - DNA, 23 bp, Artificial Sequence
  Synthetic
ctctctctctugcacacacgtua

SEQ ID NO: 68369 - DNA, 22 bp, Artificial Sequence
  Synthetic
tgctctcaugccatcttugacc

SEQ ID NO: 68370 - DNA, 22 bp, Artificial Sequence
  Synthetic
tcctauagggtcagugcacaga

SEQ ID NO: 68371 - DNA, 22 bp, Artificial Sequence
  Synthetic
ccatccccacuttgtgatuccc

SEQ ID NO: 68372 - DNA, 26 bp, Artificial Sequence
  Synthetic
cgttttcctaaccutgttcgcctaut

SEQ ID NO: 68373 - DNA, 27 bp, Artificial Sequence
  Synthetic
ccatgagguacaggatgacataguaga

SEQ ID NO: 68374 - DNA, 27 bp, Artificial Sequence
  Synthetic
ctttagaaaggaacaaguggcaactut

SEQ ID NO: 68375 - DNA, 21 bp, Artificial Sequence
  Synthetic
cagutccaaugggaggacgac

SEQ ID NO: 68376 - DNA, 26 bp, Artificial Sequence
  Synthetic
cccagagtcuggaaaagattttcuga

SEQ ID NO: 68377 - DNA, 27 bp, Artificial Sequence
  Synthetic
ccccuccagaaactgtauagaagagaa

SEQ ID NO: 68378 - DNA, 25 bp, Artificial Sequence
  Synthetic
cugtagagagguagaaggagaggac

SEQ ID NO: 68379 - DNA, 28 bp, Artificial Sequence
  Synthetic
ggcttctaaaguaggaagggtcaaaaut

SEQ ID NO: 68380 - DNA, 25 bp, Artificial Sequence
  Synthetic
ctgtgctaucctacctctaaauccc

SEQ ID NO: 68381 - DNA, 28 bp, Artificial Sequence
  Synthetic
ttttcaggaatgutcgattaggtctuga

SEQ ID NO: 68382 - DNA, 26 bp, Artificial Sequence
  Synthetic
catgtagttcccuccaacgagaatua

SEQ ID NO: 68383 - DNA, 26 bp, Artificial Sequence
  Synthetic
ctgagcattugctgataatccaaugt

SEQ ID NO: 68384 - DNA, 29 bp, Artificial Sequence
  Synthetic
catttatgcttctutgcaaactactguga

SEQ ID NO: 68385 - DNA, 28 bp, Artificial Sequence
  Synthetic
cctacuggagcaataaagttugaagaac

SEQ ID NO: 68386 - DNA, 25 bp, Artificial Sequence
  Synthetic
tttgtaaacccuctccatcagtguc

SEQ ID NO: 68387 - DNA, 20 bp, Artificial Sequence
  Synthetic
gggaacugacgcaggauaca

SEQ ID NO: 68388 - DNA, 21 bp, Artificial Sequence
  Synthetic
gctcccucactgcaacugaac

SEQ ID NO: 68389 - DNA, 23 bp, Artificial Sequence
  Synthetic
caaacccaaguctctgaccauca

SEQ ID NO: 68390 - DNA, 21 bp, Artificial Sequence
  Synthetic
gcaggugggttgaaugaagga

SEQ ID NO: 68391 - DNA, 21 bp, Artificial Sequence
  Synthetic
agccagacuacagugaacgac

SEQ ID NO: 68392 - DNA, 24 bp, Artificial Sequence
  Synthetic
ccutatcgauaccaagggcaacaa

SEQ ID NO: 68393 - DNA, 21 bp, Artificial Sequence
  Synthetic
agctgaugcaggcaaagtuct

SEQ ID NO: 68394 - DNA, 26 bp, Artificial Sequence
  Synthetic
gtctguaggaaaggtgaatctucagg

SEQ ID NO: 68395 - DNA, 24 bp, Artificial Sequence
  Synthetic
tcttcuaaacaccaagccccttut

SEQ ID NO: 68396 - DNA, 28 bp, Artificial Sequence
  Synthetic
tctaggagcaauacaatgtagtgacugt

SEQ ID NO: 68397 - DNA, 25 bp, Artificial Sequence
  Synthetic
catttctaatcauccactcccggut

SEQ ID NO: 68398 - DNA, 22 bp, Artificial Sequence
  Synthetic
tttctgcatguagcgagcauct

SEQ ID NO: 68399 - DNA, 28 bp, Artificial Sequence
  Synthetic
ctataatuaacaatccgguccagcaaac

SEQ ID NO: 68400 - DNA, 29 bp, Artificial Sequence
  Synthetic
actgaatttaccugttgatctgaatcugt

SEQ ID NO: 68401 - DNA, 24 bp, Artificial Sequence
  Synthetic
aaacgtgcctuctggtggttauat

SEQ ID NO: 68402 - DNA, 25 bp, Artificial Sequence
  Synthetic
gcaaaaccagcauattaacgugact

SEQ ID NO: 68403 - DNA, 22 bp, Artificial Sequence
  Synthetic
gaagccautgctctuagcagga

SEQ ID NO: 68404 - DNA, 22 bp, Artificial Sequence
  Synthetic
gccagcaacugtacatgauggt

SEQ ID NO: 68405 - DNA, 28 bp, Artificial Sequence
  Synthetic
gctatccaaaaagacugcaaaccaatut

SEQ ID NO: 68406 - DNA, 21 bp, Artificial Sequence
  Synthetic
gugtgaugaagcaggcaggat

SEQ ID NO: 68407 - DNA, 23 bp, Artificial Sequence
  Synthetic
ctaagcaaccacacuttctuggt

SEQ ID NO: 68408 - DNA, 25 bp, Artificial Sequence
  Synthetic
cttcttatagggucctcctggacut

SEQ ID NO: 68409 - DNA, 24 bp, Artificial Sequence
  Synthetic
aatggatggauctcaccttggtuc

SEQ ID NO: 68410 - DNA, 22 bp, Artificial Sequence
  Synthetic
caautgcatugaacagggccaa

SEQ ID NO: 68411 - DNA, 24 bp, Artificial Sequence
  Synthetic
ggaguatgcgatuaaggcacaaaa

SEQ ID NO: 68412 - DNA, 27 bp, Artificial Sequence
  Synthetic
tcatgggagttuttgttgtgttttguc

SEQ ID NO: 68413 - DNA, 21 bp, Artificial Sequence
  Synthetic
gttgagaugcagugacagcct

SEQ ID NO: 68414 - DNA, 25 bp, Artificial Sequence
  Synthetic
gtgccatttuggacaaaagcttgua

SEQ ID NO: 68415 - DNA, 27 bp, Artificial Sequence
  Synthetic
cctaccttctuggaaatagccattgut

SEQ ID NO: 68416 - DNA, 20 bp, Artificial Sequence
  Synthetic
caccaugcggaagctcttug

SEQ ID NO: 68417 - DNA, 27 bp, Artificial Sequence
  Synthetic
atgtcttaaataucaacaggccacugt

SEQ ID NO: 68418 - DNA, 25 bp, Artificial Sequence
  Synthetic
attaaccutttgtaacuccccggaa

SEQ ID NO: 68419 - DNA, 28 bp, Artificial Sequence
  Synthetic
caagcaactgaacuttacatgaacauga

SEQ ID NO: 68420 - DNA, 23 bp, Artificial Sequence
  Synthetic
ctgcctaagucggtaacauggaa

SEQ ID NO: 68421 - DNA, 28 bp, Artificial Sequence
  Synthetic
cagactacuatgctttgtauggcaaaga

SEQ ID NO: 68422 - DNA, 29 bp, Artificial Sequence
  Synthetic
gatgtgattgaaauggattctttgtugct

SEQ ID NO: 68423 - DNA, 25 bp, Artificial Sequence
  Synthetic
gacttgtgtggaauaccatgcttuc

SEQ ID NO: 68424 - DNA, 22 bp, Artificial Sequence
  Synthetic
gaccaagcaguacgttcuccat

SEQ ID NO: 68425 - DNA, 20 bp, Artificial Sequence
  Synthetic
caguaaggactguggccgaa

SEQ ID NO: 68426 - DNA, 24 bp, Artificial Sequence
  Synthetic
caaactcaaaagcutgtggaguca

SEQ ID NO: 68427 - DNA, 22 bp, Artificial Sequence
  Synthetic
gggaccutaaucaccacagcaa

SEQ ID NO: 68428 - DNA, 21 bp, Artificial Sequence
  Synthetic
gcagaugcgagcagttttgua

SEQ ID NO: 68429 - DNA, 28 bp, Artificial Sequence
  Synthetic
tcaaaaggaagcagautcaaguaggaat

SEQ ID NO: 68430 - DNA, 27 bp, Artificial Sequence
  Synthetic
gcatctaagacagagguctcaggacua

SEQ ID NO: 68431 - DNA, 26 bp, Artificial Sequence
  Synthetic
ccatcattgcauttacctcggaucat

SEQ ID NO: 68432 - DNA, 28 bp, Artificial Sequence
  Synthetic
ggcctagtauggaaatagaacctguaaa

SEQ ID NO: 68433 - DNA, 28 bp, Artificial Sequence
  Synthetic
gactcattcuccaaggagtgtgaatuat

SEQ ID NO: 68434 - DNA, 21 bp, Artificial Sequence
  Synthetic
cgtcaucaccctgtggucaaa

SEQ ID NO: 68435 - DNA, 21 bp, Artificial Sequence
  Synthetic
atcugaggcacgauacggaac

SEQ ID NO: 68436 - DNA, 23 bp, Artificial Sequence
  Synthetic
actgtattgcuacaggcugcaaa

SEQ ID NO: 68437 - DNA, 23 bp, Artificial Sequence
  Synthetic
ccagagtuccaagtgacgcauac

SEQ ID NO: 68438 - DNA, 20 bp, Artificial Sequence
  Synthetic
gcccacaaaguctaccccut

SEQ ID NO: 68439 - DNA, 19 bp, Artificial Sequence
  Synthetic
ggagccgcugcaggaauac

SEQ ID NO: 68440 - DNA, 22 bp, Artificial Sequence
  Synthetic
cttacctcuccagggaccugaa

SEQ ID NO: 68441 - DNA, 22 bp, Artificial Sequence
  Synthetic
agaagaagcugtccctctcugt

SEQ ID NO: 68442 - DNA, 21 bp, Artificial Sequence
  Synthetic
agacaucagccccttccttug

SEQ ID NO: 68443 - DNA, 25 bp, Artificial Sequence
  Synthetic
aggctgcagcautgatgtgttaaua

SEQ ID NO: 68444 - DNA, 19 bp, Artificial Sequence
  Synthetic
tcaugaccccguccaggaa

SEQ ID NO: 68445 - DNA, 18 bp, Artificial Sequence
  Synthetic
gtgucagcccgtctgucc

SEQ ID NO: 68446 - DNA, 19 bp, Artificial Sequence
  Synthetic
cccccaguaugagcgggat

SEQ ID NO: 68447 - DNA, 21 bp, Artificial Sequence
  Synthetic
gcuacaaacacgcccatcuac

SEQ ID NO: 68448 - DNA, 26 bp, Artificial Sequence
  Synthetic
attaatctugacaagccctcuaaccc

SEQ ID NO: 68449 - DNA, 23 bp, Artificial Sequence
  Synthetic
gcttttcactcuagccagtccut

SEQ ID NO: 68450 - DNA, 28 bp, Artificial Sequence
  Synthetic
cacatgtccacugaaatgaatagaaugg

SEQ ID NO: 68451 - DNA, 28 bp, Artificial Sequence
  Synthetic
tggtggaguggagagaaagaaacttaua

SEQ ID NO: 68452 - DNA, 26 bp, Artificial Sequence
  Synthetic
agaaataggtutctgctgctuggaaa

SEQ ID NO: 68453 - DNA, 21 bp, Artificial Sequence
  Synthetic
gccagaaucagcaagguggat

SEQ ID NO: 68454 - DNA, 18 bp, Artificial Sequence
  Synthetic
gccugtccuccccaggat

SEQ ID NO: 68455 - DNA, 18 bp, Artificial Sequence
  Synthetic
tgcucccagcccctaugt

SEQ ID NO: 68456 - DNA, 21 bp, Artificial Sequence
  Synthetic
ggaagagcaccgugatcaaug

SEQ ID NO: 68457 - DNA, 21 bp, Artificial Sequence
  Synthetic
cgtgucacaacggaggactug

SEQ ID NO: 68458 - DNA, 21 bp, Artificial Sequence
  Synthetic
ccctcttgcucctctgctuag

SEQ ID NO: 68459 - DNA, 22 bp, Artificial Sequence
  Synthetic
ccagaatgccucctcctcatut

SEQ ID NO: 68460 - DNA, 24 bp, Artificial Sequence
  Synthetic
ggtgggaucaaaggagacatugaa

SEQ ID NO: 68461 - DNA, 24 bp, Artificial Sequence
  Synthetic
atagacguagaggaggccauagag

SEQ ID NO: 68462 - DNA, 22 bp, Artificial Sequence
  Synthetic
gctcacggugcattcttttcuc

SEQ ID NO: 68463 - DNA, 22 bp, Artificial Sequence
  Synthetic
ctctttgucacctccaggtuct

SEQ ID NO: 68464 - DNA, 22 bp, Artificial Sequence
  Synthetic
gttcctugggacagagtucaga

SEQ ID NO: 68465 - DNA, 22 bp, Artificial Sequence
  Synthetic
ccguagaagggatugacaagcc

SEQ ID NO: 68466 - DNA, 20 bp, Artificial Sequence
  Synthetic
gcugggaaagtguccacacc

SEQ ID NO: 68467 - DNA, 24 bp, Artificial Sequence
  Synthetic
ggctttctcgucactctcatacuc

SEQ ID NO: 68468 - DNA, 19 bp, Artificial Sequence
  Synthetic
ccagcaugaccccugaaca

SEQ ID NO: 68469 - DNA, 20 bp, Artificial Sequence
  Synthetic
cctatucccaagcccauccc

SEQ ID NO: 68470 - DNA, 26 bp, Artificial Sequence
  Synthetic
gatgacaaggaaugttattgcugcat

SEQ ID NO: 68471 - DNA, 22 bp, Artificial Sequence
  Synthetic
agattccccuctccucacagac

SEQ ID NO: 68472 - DNA, 28 bp, Artificial Sequence
  Synthetic
gatggttttucctctaattctcucaggt

SEQ ID NO: 68473 - DNA, 22 bp, Artificial Sequence
  Synthetic
tggtgttgcagucaaagtccut

SEQ ID NO: 68474 - DNA, 24 bp, Artificial Sequence
  Synthetic
cuaggaagagagagaaucgccaaa

SEQ ID NO: 68475 - DNA, 18 bp, Artificial Sequence
  Synthetic
cgcggucatgugacacag

SEQ ID NO: 68476 - DNA, 24 bp, Artificial Sequence
  Synthetic
gaugggaggagcugagaaagaaaa

SEQ ID NO: 68477 - DNA, 21 bp, Artificial Sequence
  Synthetic
cttcucagccagguagaccag

SEQ ID NO: 68478 - DNA, 20 bp, Artificial Sequence
  Synthetic
gccttccuggtacucagcac

SEQ ID NO: 68479 - DNA, 22 bp, Artificial Sequence
  Synthetic
gccctagguctagatccugcat

SEQ ID NO: 68480 - DNA, 28 bp, Artificial Sequence
  Synthetic
aacagttacttcuctaatcccttcucca

SEQ ID NO: 68481 - DNA, 28 bp, Artificial Sequence
  Synthetic
cctctgccugagaacattctctaattut

SEQ ID NO: 68482 - DNA, 26 bp, Artificial Sequence
  Synthetic
gagaaaguaaaacaccactccuggat

SEQ ID NO: 68483 - DNA, 22 bp, Artificial Sequence
  Synthetic
cgaggagaguctctccagttug

SEQ ID NO: 68484 - DNA, 20 bp, Artificial Sequence
  Synthetic
accgacugaaacggugacat

SEQ ID NO: 68485 - DNA, 26 bp, Artificial Sequence
  Synthetic
gcaaaatttcaccuaccactgtcauc

SEQ ID NO: 68486 - DNA, 27 bp, Artificial Sequence
  Synthetic
cttacagtagagccuttgttaccctut

SEQ ID NO: 68487 - DNA, 23 bp, Artificial Sequence
  Synthetic
tctctagggaautcctggtccug

SEQ ID NO: 68488 - DNA, 18 bp, Artificial Sequence
  Synthetic
ggaugccccgaagaccut

SEQ ID NO: 68489 - DNA, 28 bp, Artificial Sequence
  Synthetic
gtattttctcaucactaatgtgcuccca

SEQ ID NO: 68490 - DNA, 25 bp, Artificial Sequence
  Synthetic
cctcaaacagutttccctcaugaga

SEQ ID NO: 68491 - DNA, 22 bp, Artificial Sequence
  Synthetic
cagggtauggcaggtgtagaug

SEQ ID NO: 68492 - DNA, 26 bp, Artificial Sequence
  Synthetic
cgcatggcaatuatctggttagctua

SEQ ID NO: 68493 - DNA, 24 bp, Artificial Sequence
  Synthetic
agaaatuggaccaagaggtctucc

SEQ ID NO: 68494 - DNA, 23 bp, Artificial Sequence
  Synthetic
tcautccatcaucaccaggagga

SEQ ID NO: 68495 - DNA, 21 bp, Artificial Sequence
  Synthetic
tccctgccaaaugtcctgtut

SEQ ID NO: 68496 - DNA, 28 bp, Artificial Sequence
  Synthetic
tgagatatcaugtccattcactuaccct

SEQ ID NO: 68497 - DNA, 24 bp, Artificial Sequence
  Synthetic
agggcaacugtttagaactcuagt

SEQ ID NO: 68498 - DNA, 22 bp, Artificial Sequence
  Synthetic
cttctgaaaaggcugggcuact

SEQ ID NO: 68499 - DNA, 28 bp, Artificial Sequence
  Synthetic
cctctgcctgcugtctaatcttatttut

SEQ ID NO: 68500 - DNA, 18 bp, Artificial Sequence
  Synthetic
cgccacagguaggtguga

SEQ ID NO: 68501 - DNA, 19 bp, Artificial Sequence
  Synthetic
ctctgctgutgtggtcgug

SEQ ID NO: 68502 - DNA, 21 bp, Artificial Sequence
  Synthetic
tgagtgaccccutcccatuca

SEQ ID NO: 68503 - DNA, 21 bp, Artificial Sequence
  Synthetic
ggtggaggcuaatggcugaac

SEQ ID NO: 68504 - DNA, 21 bp, Artificial Sequence
  Synthetic
aucaagcgccagaauggagat

SEQ ID NO: 68505 - DNA, 20 bp, Artificial Sequence
  Synthetic
cttccacaccaggucgguag

SEQ ID NO: 68506 - DNA, 28 bp, Artificial Sequence
  Synthetic
gaaaaagcagaaauggaagtucacaaac

SEQ ID NO: 68507 - DNA, 26 bp, Artificial Sequence
  Synthetic
gtatacctgcucacctcttacttguc

SEQ ID NO: 68508 - DNA, 21 bp, Artificial Sequence
  Synthetic
ggaagccagutcactgucgaa

SEQ ID NO: 68509 - DNA, 22 bp, Artificial Sequence
  Synthetic
ctgcctguggcttctaucagag

SEQ ID NO: 68510 - DNA, 21 bp, Artificial Sequence
  Synthetic
gaacgaccccguacctagtug

SEQ ID NO: 68511 - DNA, 20 bp, Artificial Sequence
  Synthetic
cccggccuaaggaccttuat

SEQ ID NO: 68512 - DNA, 23 bp, Artificial Sequence
  Synthetic
gggaaaatuacaggctggtccua

SEQ ID NO: 68513 - DNA, 29 bp, Artificial Sequence
  Synthetic
cagttccaagcautcataaattctcacut

SEQ ID NO: 68514 - DNA, 26 bp, Artificial Sequence
  Synthetic
acttggagucttgagugagaaaaaca

SEQ ID NO: 68515 - DNA, 26 bp, Artificial Sequence
  Synthetic
gtatccaugcgctaaaacucaaaagt

SEQ ID NO: 68516 - DNA, 26 bp, Artificial Sequence
  Synthetic
aaaattttgtaccutgaagtgaugcc

SEQ ID NO: 68517 - DNA, 27 bp, Artificial Sequence
  Synthetic
gaaggtgggautcagactattgtuagt

SEQ ID NO: 68518 - DNA, 26 bp, Artificial Sequence
  Synthetic
aggctatcacucgatacaggtatuct

SEQ ID NO: 68519 - DNA, 22 bp, Artificial Sequence
  Synthetic
gggaaatgacuccatcctggut

SEQ ID NO: 68520 - DNA, 22 bp, Artificial Sequence
  Synthetic
cgtaggaaacacauggcugacc

SEQ ID NO: 68521 - DNA, 24 bp, Artificial Sequence
  Synthetic
gttcaacaaggagugtagctguca

SEQ ID NO: 68522 - DNA, 23 bp, Artificial Sequence
  Synthetic
ctggttccaaaaauccgtgcaut

SEQ ID NO: 68523 - DNA, 22 bp, Artificial Sequence
  Synthetic
caggcacaaacagcaugaucac

SEQ ID NO: 68524 - DNA, 22 bp, Artificial Sequence
  Synthetic
aaagagcagaucttgcugcaga

SEQ ID NO: 68525 - DNA, 23 bp, Artificial Sequence
  Synthetic
tttctcucccctctctguggaat

SEQ ID NO: 68526 - DNA, 28 bp, Artificial Sequence
  Synthetic
ggagaaattgcuagaaaccattgaucag

SEQ ID NO: 68527 - DNA, 27 bp, Artificial Sequence
  Synthetic
ttctaatgcauagggcatacagagtug

SEQ ID NO: 68528 - DNA, 21 bp, Artificial Sequence
  Synthetic
accgtcaccutccaatcctuc

SEQ ID NO: 68529 - DNA, 24 bp, Artificial Sequence
  Synthetic
aggatgtaguggactcctgcuaaa

SEQ ID NO: 68530 - DNA, 28 bp, Artificial Sequence
  Synthetic
cacgtctcactuatttttccctctctut

SEQ ID NO: 68531 - DNA, 27 bp, Artificial Sequence
  Synthetic
cttcaatgccacuagtaaaactugcat

SEQ ID NO: 68532 - DNA, 23 bp, Artificial Sequence
  Synthetic
gtttacucacaggccatttgcut

SEQ ID NO: 68533 - DNA, 25 bp, Artificial Sequence
  Synthetic
gtgcattaggcugtgtttagaagut

SEQ ID NO: 68534 - DNA, 26 bp, Artificial Sequence
  Synthetic
gtgttgccucctcatcuagaaagaat

SEQ ID NO: 68535 - DNA, 20 bp, Artificial Sequence
  Synthetic
gucaccccauagcgggaaaa

SEQ ID NO: 68536 - DNA, 21 bp, Artificial Sequence
  Synthetic
ggctcaagugggtaggaugaa

SEQ ID NO: 68537 - DNA, 25 bp, Artificial Sequence
  Synthetic
tcctgcttttuagaaatggccugat

SEQ ID NO: 68538 - DNA, 29 bp, Artificial Sequence
  Synthetic
gacttggaagatuatgatgctgattcuga

SEQ ID NO: 68539 - DNA, 27 bp, Artificial Sequence
  Synthetic
ggactgtaaccutcctcacataacuac

SEQ ID NO: 68540 - DNA, 28 bp, Artificial Sequence
  Synthetic
tgctagcaatuaggattacatttuggct

SEQ ID NO: 68541 - DNA, 20 bp, Artificial Sequence
  Synthetic
aggccuccgaatgagcaauc

SEQ ID NO: 68542 - DNA, 23 bp, Artificial Sequence
  Synthetic
acacgcactuaaacacctgcaua

SEQ ID NO: 68543 - DNA, 28 bp, Artificial Sequence
  Synthetic
agcttatatggcutcattaatggcugaa

SEQ ID NO: 68544 - DNA, 25 bp, Artificial Sequence
  Synthetic
cacaaggttttuaatgaggcacugt

SEQ ID NO: 68545 - DNA, 28 bp, Artificial Sequence
  Synthetic
gccaaatataugcaggaaagcatuacat

SEQ ID NO: 68546 - DNA, 25 bp, Artificial Sequence
  Synthetic
ttggaagatacgagucctccctuat

SEQ ID NO: 68547 - DNA, 29 bp, Artificial Sequence
  Synthetic
ccactgtggtguaattgataatctgagua

SEQ ID NO: 68548 - DNA, 25 bp, Artificial Sequence
  Synthetic
cagtctcccuatgccatuaaacaga

SEQ ID NO: 68549 - DNA, 25 bp, Artificial Sequence
  Synthetic
gcaattccaaguttcagagtagcug

SEQ ID NO: 68550 - DNA, 24 bp, Artificial Sequence
  Synthetic
gtccaagacuggttagtcaauggt

SEQ ID NO: 68551 - DNA, 25 bp, Artificial Sequence
  Synthetic
ggatagcttuggagaaattccgtug

SEQ ID NO: 68552 - DNA, 21 bp, Artificial Sequence
  Synthetic
gatgcctcauggtacctgguc

SEQ ID NO: 68553 - DNA, 28 bp, Artificial Sequence
  Synthetic
attagctgaatttuaccaggcacataua

SEQ ID NO: 68554 - DNA, 28 bp, Artificial Sequence
  Synthetic
tctgattctacucgtaaacaguaaggct

SEQ ID NO: 68555 - DNA, 21 bp, Artificial Sequence
  Synthetic
ggcaacccugaggtccuaaaa

SEQ ID NO: 68556 - DNA, 28 bp, Artificial Sequence
  Synthetic
ggtctagtctguaaacaggtgatgaaut

SEQ ID NO: 68557 - DNA, 24 bp, Artificial Sequence
  Synthetic
gaagaaagaguagctgtggugagt

SEQ ID NO: 68558 - DNA, 21 bp, Artificial Sequence
  Synthetic
cattgcuagcaccaggaaguc

SEQ ID NO: 68559 - DNA, 27 bp, Artificial Sequence
  Synthetic
agcaatcaagaagaugaacgagatuca

SEQ ID NO: 68560 - DNA, 26 bp, Artificial Sequence
  Synthetic
agaaaagctcaguttcctaccttguc

SEQ ID NO: 68561 - DNA, 27 bp, Artificial Sequence
  Synthetic
ttttaattttgcaggaggucctaggut

SEQ ID NO: 68562 - DNA, 27 bp, Artificial Sequence
  Synthetic
gtaccttttggaucaaatgatgctugt

SEQ ID NO: 68563 - DNA, 26 bp, Artificial Sequence
  Synthetic
cgaagatcaguaagaggagucacaaa

SEQ ID NO: 68564 - DNA, 21 bp, Artificial Sequence
  Synthetic
agagggauccaggcctcatua

SEQ ID NO: 68565 - DNA, 25 bp, Artificial Sequence
  Synthetic
ctgacagcagcuttctagatguagg

SEQ ID NO: 68566 - DNA, 21 bp, Artificial Sequence
  Synthetic
ctgagucagaggtcagcucac

SEQ ID NO: 68567 - DNA, 23 bp, Artificial Sequence
  Synthetic
ttcccacaatucttgccacagua

SEQ ID NO: 68568 - DNA, 22 bp, Artificial Sequence
  Synthetic
cctttcuagggacagacuccac

SEQ ID NO: 68569 - DNA, 21 bp, Artificial Sequence
  Synthetic
agatcucagcccacagtcuct

SEQ ID NO: 68570 - DNA, 21 bp, Artificial Sequence
  Synthetic
gtgggcucagagcacactaut

SEQ ID NO: 68571 - DNA, 25 bp, Artificial Sequence
  Synthetic
gacatcauggagatggaggaugaag

SEQ ID NO: 68572 - DNA, 26 bp, Artificial Sequence
  Synthetic
tctggtatgcugtagagaaaacacug

SEQ ID NO: 68573 - DNA, 22 bp, Artificial Sequence
  Synthetic
tccgtaccuggagaagcuaagt

SEQ ID NO: 68574 - DNA, 29 bp, Artificial Sequence
  Synthetic
tgctgattacatucacaatcctgattuct

SEQ ID NO: 68575 - DNA, 18 bp, Artificial Sequence
  Synthetic
gaccagctugcccaggut

SEQ ID NO: 68576 - DNA, 27 bp, Artificial Sequence
  Synthetic
gtatctagggugaaaatggtctuccag

SEQ ID NO: 68577 - DNA, 21 bp, Artificial Sequence
  Synthetic
ccctctuggacccuacagagt

SEQ ID NO: 68578 - DNA, 21 bp, Artificial Sequence
  Synthetic
ccagcuggaaagagtggugac

SEQ ID NO: 68579 - DNA, 26 bp, Artificial Sequence
  Synthetic
ttttggttggcagauctgacattcua

SEQ ID NO: 68580 - DNA, 23 bp, Artificial Sequence
  Synthetic
ggtttugccccgtattauggaga

SEQ ID NO: 68581 - DNA, 26 bp, Artificial Sequence
  Synthetic
ttgccatgaagaugaaagacuaccaa

SEQ ID NO: 68582 - DNA, 23 bp, Artificial Sequence
  Synthetic
aagcucaacuagcacaaacaagt

SEQ ID NO: 68583 - DNA, 17 bp, Artificial Sequence
  Synthetic
tgggccaacuggagcug

SEQ ID NO: 68584 - DNA, 25 bp, Artificial Sequence
  Synthetic
gtagcttacatcutccccaggttua

SEQ ID NO: 68585 - DNA, 32 bp, Artificial Sequence
  Synthetic
atgttttgaattguattactggcaaguaaagg

SEQ ID NO: 68586 - DNA, 26 bp, Artificial Sequence
  Synthetic
ggcttttaacuggcatacaguagagt

SEQ ID NO: 68587 - DNA, 26 bp, Artificial Sequence
  Synthetic
atgaaaaatcuggacttgggagucaa

SEQ ID NO: 68588 - DNA, 28 bp, Artificial Sequence
  Synthetic
cctgctcccuttataatgaucaggaaag

SEQ ID NO: 68589 - DNA, 28 bp, Artificial Sequence
  Synthetic
tgagattcgttctuctggatatccctua

SEQ ID NO: 68590 - DNA, 22 bp, Artificial Sequence
  Synthetic
attcatgcugcccaatctucct

SEQ ID NO: 68591 - DNA, 21 bp, Artificial Sequence
  Synthetic
tgcatcuccagctctgcaauc

SEQ ID NO: 68592 - DNA, 23 bp, Artificial Sequence
  Synthetic
tcattacacuactgccucaggga

SEQ ID NO: 68593 - DNA, 22 bp, Artificial Sequence
  Synthetic
ccaggcauggattttccagcua

SEQ ID NO: 68594 - DNA, 21 bp, Artificial Sequence
  Synthetic
ctgccgggcaaugtcaatuag

SEQ ID NO: 68595 - DNA, 22 bp, Artificial Sequence
  Synthetic
agtagaccuccctgagcactut

SEQ ID NO: 68596 - DNA, 21 bp, Artificial Sequence
  Synthetic
gctttcugggctgacgugaat

SEQ ID NO: 68597 - DNA, 24 bp, Artificial Sequence
  Synthetic
cttuaccccaacagagtttucacc

SEQ ID NO: 68598 - DNA, 22 bp, Artificial Sequence
  Synthetic
cccatctcugacagcttccuct

SEQ ID NO: 68599 - DNA, 22 bp, Artificial Sequence
  Synthetic
gcagactgaucctgtgccttua

SEQ ID NO: 68600 - DNA, 19 bp, Artificial Sequence
  Synthetic
cccgagagccautgctgut

SEQ ID NO: 68601 - DNA, 22 bp, Artificial Sequence
  Synthetic
catctttggcauggccaactuc

SEQ ID NO: 68602 - DNA, 22 bp, Artificial Sequence
  Synthetic
ggcatgtuacatcccuggacac

SEQ ID NO: 68603 - DNA, 27 bp, Artificial Sequence
  Synthetic
tcautgacaactucaaccaacagaaga

SEQ ID NO: 68604 - DNA, 19 bp, Artificial Sequence
  Synthetic
cctgtacagcucggctuga

SEQ ID NO: 68605 - DNA, 21 bp, Artificial Sequence
  Synthetic
acctacccuggcctctguaac

SEQ ID NO: 68606 - DNA, 23 bp, Artificial Sequence
  Synthetic
gaaccagaugagtgagtgaugct

SEQ ID NO: 68607 - DNA, 29 bp, Artificial Sequence
  Synthetic
ccatcactgtuccttagtttaatctugct

SEQ ID NO: 68608 - DNA, 26 bp, Artificial Sequence
  Synthetic
aatagagtgcagugtacaaacgctua

SEQ ID NO: 68609 - DNA, 20 bp, Artificial Sequence
  Synthetic
ccggcagguttctaccctug

SEQ ID NO: 68610 - DNA, 21 bp, Artificial Sequence
  Synthetic
acttttcaagguagcgccugt

SEQ ID NO: 68611 - DNA, 27 bp, Artificial Sequence
  Synthetic
gctatatggguggactaatatgtgcut

SEQ ID NO: 68612 - DNA, 25 bp, Artificial Sequence
  Synthetic
tgtaaaagtgtcucagttgctgugt

SEQ ID NO: 68613 - DNA, 27 bp, Artificial Sequence
  Synthetic
gcttataugccaccatgtttgaucact

SEQ ID NO: 68614 - DNA, 19 bp, Artificial Sequence
  Synthetic
cacccacugguccaccaag

SEQ ID NO: 68615 - DNA, 22 bp, Artificial Sequence
  Synthetic
ccgtgatgugctggcaattuat

SEQ ID NO: 68616 - DNA, 22 bp, Artificial Sequence
  Synthetic
gctagcggauttcaggttcuca

SEQ ID NO: 68617 - DNA, 24 bp, Artificial Sequence
  Synthetic
agaaatuaccagcagagaauggca

SEQ ID NO: 68618 - DNA, 20 bp, Artificial Sequence
  Synthetic
gcacggaaauccatctgcuc

SEQ ID NO: 68619 - DNA, 20 bp, Artificial Sequence
  Synthetic
agggutggcuagaggaggaa

SEQ ID NO: 68620 - DNA, 25 bp, Artificial Sequence
  Synthetic
tgatgctgacuagtgagatgtcuga

SEQ ID NO: 68621 - DNA, 22 bp, Artificial Sequence
  Synthetic
ccuacagcuagcacaaaaggca

SEQ ID NO: 68622 - DNA, 25 bp, Artificial Sequence
  Synthetic
ggagggaaagutgcaatattgtugt

SEQ ID NO: 68623 - DNA, 22 bp, Artificial Sequence
  Synthetic
cgcgagcggcuaagtaaaatug

SEQ ID NO: 68624 - DNA, 24 bp, Artificial Sequence
  Synthetic
gcaugagaagagguccaaaaccag

SEQ ID NO: 68625 - DNA, 28 bp, Artificial Sequence
  Synthetic
accatgtctguagaagagaaagctacua

SEQ ID NO: 68626 - DNA, 22 bp, Artificial Sequence
  Synthetic
tgucgtgaacauacaagccagt

SEQ ID NO: 68627 - DNA, 28 bp, Artificial Sequence
  Synthetic
tgagattgggaauaacacagagttugag

SEQ ID NO: 68628 - DNA, 17 bp, Artificial Sequence
  Synthetic
cctgagccggguctcut

SEQ ID NO: 68629 - DNA, 20 bp, Artificial Sequence
  Synthetic
ttggagcuggagctcttgug

SEQ ID NO: 68630 - DNA, 20 bp, Artificial Sequence
  Synthetic
agactcacuggcgttacuga

SEQ ID NO: 68631 - DNA, 21 bp, Artificial Sequence
  Synthetic
aggatgccugcatacacacug

SEQ ID NO: 68632 - DNA, 21 bp, Artificial Sequence
  Synthetic
gtgtgagcaucaagggaccuc

SEQ ID NO: 68633 - DNA, 21 bp, Artificial Sequence
  Synthetic
gcaguggaugcggagaaagac

SEQ ID NO: 68634 - DNA, 18 bp, Artificial Sequence
  Synthetic
cacuggcagccactccuc

SEQ ID NO: 68635 - DNA, 20 bp, Artificial Sequence
  Synthetic
gctgcguggtgtgtcauagt

SEQ ID NO: 68636 - DNA, 22 bp, Artificial Sequence
  Synthetic
gctttctttucggcatguccag

SEQ ID NO: 68637 - DNA, 20 bp, Artificial Sequence
  Synthetic
cacagagcaccagucugcaa

SEQ ID NO: 68638 - DNA, 17 bp, Artificial Sequence
  Synthetic
ggcggagaggcuggtuc

SEQ ID NO: 68639 - DNA, 19 bp, Artificial Sequence
  Synthetic
gcgctggguaccggaaaua

SEQ ID NO: 68640 - DNA, 26 bp, Artificial Sequence
  Synthetic
aactgatactcuacccagtccttcuc

SEQ ID NO: 68641 - DNA, 28 bp, Artificial Sequence
  Synthetic
gcttcagaagaaagutgaccatttucac

SEQ ID NO: 68642 - DNA, 23 bp, Artificial Sequence
  Synthetic
actttgcaguggtgtctcgtauc

SEQ ID NO: 68643 - DNA, 29 bp, Artificial Sequence
  Synthetic
aggtaacagtccutgacaaagctaattut

SEQ ID NO: 68644 - DNA, 28 bp, Artificial Sequence
  Synthetic
ctagtgcagagaaagcugaactuaaaaa

SEQ ID NO: 68645 - DNA, 24 bp, Artificial Sequence
  Synthetic
cttgcttcgaccuttctgttcauc

SEQ ID NO: 68646 - DNA, 22 bp, Artificial Sequence
  Synthetic
gccccagugaaagcttttcauc

SEQ ID NO: 68647 - DNA, 26 bp, Artificial Sequence
  Synthetic
acgggaacauccatggaaaatctauc

SEQ ID NO: 68648 - DNA, 28 bp, Artificial Sequence
  Synthetic
gaaggagcgggauatgacataattctua

SEQ ID NO: 68649 - DNA, 30 bp, Artificial Sequence
  Synthetic
ctgctgaaugaacaaaaataagttgucact

SEQ ID NO: 68650 - DNA, 23 bp, Artificial Sequence
  Synthetic
aaaaacccgucauccaaaagcag

SEQ ID NO: 68651 - DNA, 26 bp, Artificial Sequence
  Synthetic
aacatagctgguttacactgcaguat

SEQ ID NO: 68652 - DNA, 21 bp, Artificial Sequence
  Synthetic
gcaaccccagcugacatttug

SEQ ID NO: 68653 - DNA, 23 bp, Artificial Sequence
  Synthetic
cugacatcaccuaccagagcaag

SEQ ID NO: 68654 - DNA, 22 bp, Artificial Sequence
  Synthetic
ccaaatggaautttccgggcut

SEQ ID NO: 68655 - DNA, 28 bp, Artificial Sequence
  Synthetic
caatcacacggaugaacgtaaagtatut

SEQ ID NO: 68656 - DNA, 26 bp, Artificial Sequence
  Synthetic
ccacttcaataguttacctgcagcut

SEQ ID NO: 68657 - DNA, 29 bp, Artificial Sequence
  Synthetic
acctggtttgauaaggctttagtaagtut

SEQ ID NO: 68658 - DNA, 28 bp, Artificial Sequence
  Synthetic
cagtttctaugacactgttguacagagt

SEQ ID NO: 68659 - DNA, 27 bp, Artificial Sequence
  Synthetic
tcattttgatgcgutttcacttgtgut

SEQ ID NO: 68660 - DNA, 28 bp, Artificial Sequence
  Synthetic
acctcaataggucctacttgaaagucaa

SEQ ID NO: 68661 - DNA, 24 bp, Artificial Sequence
  Synthetic
catuggacgccactguaacaaaaa

SEQ ID NO: 68662 - DNA, 23 bp, Artificial Sequence
  Synthetic
ggctcagcautaatttcctgcuc

SEQ ID NO: 68663 - DNA, 28 bp, Artificial Sequence
  Synthetic
tgcctttcagautcttccttctuaacat

SEQ ID NO: 68664 - DNA, 22 bp, Artificial Sequence
  Synthetic
cccctuagggacactgatgaug

SEQ ID NO: 68665 - DNA, 28 bp, Artificial Sequence
  Synthetic
gtgaattcttccutgttttgggtuaact

SEQ ID NO: 68666 - DNA, 24 bp, Artificial Sequence
  Synthetic
cacagagcacugcaaguagagaaa

SEQ ID NO: 68667 - DNA, 22 bp, Artificial Sequence
  Synthetic
gagttccgcautgatgccatuc

SEQ ID NO: 68668 - DNA, 23 bp, Artificial Sequence
  Synthetic
ctgcctctuccatctccttuacc

SEQ ID NO: 68669 - DNA, 29 bp, Artificial Sequence
  Synthetic
ttctcttaguaaggccaaaactttucact

SEQ ID NO: 68670 - DNA, 26 bp, Artificial Sequence
  Synthetic
tgactcaccucggttaaaaucagaac

SEQ ID NO: 68671 - DNA, 29 bp, Artificial Sequence
  Synthetic
gccatgttcattuctactagaggatcuca

SEQ ID NO: 68672 - DNA, 22 bp, Artificial Sequence
  Synthetic
ccctgaacucctggcagaaaut

SEQ ID NO: 68673 - DNA, 28 bp, Artificial Sequence
  Synthetic
aatgagaaaaacacaucaacctgcttut

SEQ ID NO: 68674 - DNA, 26 bp, Artificial Sequence
  Synthetic
acacacaucataacactttuccacca

SEQ ID NO: 68675 - DNA, 28 bp, Artificial Sequence
  Synthetic
ccgctgattttguaactctctccauaat

SEQ ID NO: 68676 - DNA, 26 bp, Artificial Sequence
  Synthetic
cacatcaugcaaaggaaatugagaca

SEQ ID NO: 68677 - DNA, 28 bp, Artificial Sequence
  Synthetic
gagttcatccugcaacaaaaagtcatua

SEQ ID NO: 68678 - DNA, 28 bp, Artificial Sequence
  Synthetic
aaacaatgaagcuagcctcagaatguaa

SEQ ID NO: 68679 - DNA, 26 bp, Artificial Sequence
  Synthetic
cctgttgtaccuggtaagacatctuc

SEQ ID NO: 68680 - DNA, 20 bp, Artificial Sequence
  Synthetic
cagugagggacgggcaauag

SEQ ID NO: 68681 - DNA, 25 bp, Artificial Sequence
  Synthetic
attccataaggcacucaatacgcut

SEQ ID NO: 68682 - DNA, 28 bp, Artificial Sequence
  Synthetic
tttgttgttacugcatacacattgugac

SEQ ID NO: 68683 - DNA, 28 bp, Artificial Sequence
  Synthetic
tctttaggatttcutgctgagagatucc

SEQ ID NO: 68684 - DNA, 26 bp, Artificial Sequence
  Synthetic
tgataaacaccucaagtuccaaccac

SEQ ID NO: 68685 - DNA, 28 bp, Artificial Sequence
  Synthetic
tctcttcttcttcaugctgttcttctuc

SEQ ID NO: 68686 - DNA, 23 bp, Artificial Sequence
  Synthetic
cctgagagcucagatgacaguga

SEQ ID NO: 68687 - DNA, 25 bp, Artificial Sequence
  Synthetic
acaggtgcagaaugagtctgagaua

SEQ ID NO: 68688 - DNA, 21 bp, Artificial Sequence
  Synthetic
ccttgagtccuggtggtccua

SEQ ID NO: 68689 - DNA, 28 bp, Artificial Sequence
  Synthetic
tctgagtttccucaaagatctcctcuat

SEQ ID NO: 68690 - DNA, 26 bp, Artificial Sequence
  Synthetic
gaaattgctcautgagttgctgtuca

SEQ ID NO: 68691 - DNA, 21 bp, Artificial Sequence
  Synthetic
gctgaggutctgggtcugaga

SEQ ID NO: 68692 - DNA, 27 bp, Artificial Sequence
  Synthetic
actaugaagacagaacuacagaaagcc

SEQ ID NO: 68693 - DNA, 28 bp, Artificial Sequence
  Synthetic
tcaagtgacautatcttgugaacaacca

SEQ ID NO: 68694 - DNA, 20 bp, Artificial Sequence
  Synthetic
gaggagcugaatcggcugaa

SEQ ID NO: 68695 - DNA, 23 bp, Artificial Sequence
  Synthetic
gaggtcatccucactcctctuct

SEQ ID NO: 68696 - DNA, 27 bp, Artificial Sequence
  Synthetic
tgagaaacagcaaautcagaaugacct

SEQ ID NO: 68697 - DNA, 21 bp, Artificial Sequence
  Synthetic
tgtgactgtguctccctggua

SEQ ID NO: 68698 - DNA, 22 bp, Artificial Sequence
  Synthetic
gaaccacauactggtctgcuct

SEQ ID NO: 68699 - DNA, 22 bp, Artificial Sequence
  Synthetic
tgaacccuggaggaagtcctua

SEQ ID NO: 68700 - DNA, 22 bp, Artificial Sequence
  Synthetic
cagggugtgatugaccaagaca

SEQ ID NO: 68701 - DNA, 21 bp, Artificial Sequence
  Synthetic
cttcggugcttatccucccat

SEQ ID NO: 68702 - DNA, 21 bp, Artificial Sequence
  Synthetic
gtgctggagucgatctucagg

SEQ ID NO: 68703 - DNA, 23 bp, Artificial Sequence
  Synthetic
ctgccuccctacttcaugaaagg

SEQ ID NO: 68704 - DNA, 21 bp, Artificial Sequence
  Synthetic
tgcacggugaaggagucaaag

SEQ ID NO: 68705 - DNA, 23 bp, Artificial Sequence
  Synthetic
agcaagttgcccutaaaccctua

SEQ ID NO: 68706 - DNA, 22 bp, Artificial Sequence
  Synthetic
gggucaaccacacaaaaaggua

SEQ ID NO: 68707 - DNA, 21 bp, Artificial Sequence
  Synthetic
gatgaaccugtacggctucca

SEQ ID NO: 68708 - DNA, 23 bp, Artificial Sequence
  Synthetic
gcaataccaaaguctcggaguga

SEQ ID NO: 68709 - DNA, 21 bp, Artificial Sequence
  Synthetic
gatgaaccugtacggctucca

SEQ ID NO: 68710 - DNA, 22 bp, Artificial Sequence
  Synthetic
gggaggaucctgtcactgtuag

SEQ ID NO: 68711 - DNA, 20 bp, Artificial Sequence
  Synthetic
tctcccucctttuccccagt

SEQ ID NO: 68712 - DNA, 18 bp, Artificial Sequence
  Synthetic
gcagtccucaccgccaua

SEQ ID NO: 68713 - DNA, 21 bp, Artificial Sequence
  Synthetic
atctgtugggaaggctacgug

SEQ ID NO: 68714 - DNA, 21 bp, Artificial Sequence
  Synthetic
ggcaagagacaaggutggugt

SEQ ID NO: 68715 - DNA, 25 bp, Artificial Sequence
  Synthetic
ccctccatgaccugatttattccut

SEQ ID NO: 68716 - DNA, 23 bp, Artificial Sequence
  Synthetic
ggugggaaugaagcagagagaac

SEQ ID NO: 68717 - DNA, 27 bp, Artificial Sequence
  Synthetic
tcctgaacccuacctttcataactuct

SEQ ID NO: 68718 - DNA, 26 bp, Artificial Sequence
  Synthetic
acccatacuatatgacauccccacaa

SEQ ID NO: 68719 - DNA, 26 bp, Artificial Sequence
  Synthetic
cagtgagttgucttcccttgttcuat

SEQ ID NO: 68720 - DNA, 27 bp, Artificial Sequence
  Synthetic
tcaaaaccaagaucagcaaatcctgua

SEQ ID NO: 68721 - DNA, 27 bp, Artificial Sequence
  Synthetic
agggttcataaautcatggaacgugaa

SEQ ID NO: 68722 - DNA, 24 bp, Artificial Sequence
  Synthetic
ctgtgtgcauccatgtatgugaaa

SEQ ID NO: 68723 - DNA, 20 bp, Artificial Sequence
  Synthetic
tgaagaaugtgcugcccgaa

SEQ ID NO: 68724 - DNA, 21 bp, Artificial Sequence
  Synthetic
ggccccuccaagagagttgua

SEQ ID NO: 68725 - DNA, 21 bp, Artificial Sequence
  Synthetic
cgaggaaagutcccaaugcct

SEQ ID NO: 68726 - DNA, 25 bp, Artificial Sequence
  Synthetic
gacctcacuggcaaattaauccaga

SEQ ID NO: 68727 - DNA, 28 bp, Artificial Sequence
  Synthetic
tggcttactcttucttatctctctcugt

SEQ ID NO: 68728 - DNA, 21 bp, Artificial Sequence
  Synthetic
gaatccucccagctgacugaa

SEQ ID NO: 68729 - DNA, 27 bp, Artificial Sequence
  Synthetic
gcttcttgcacuaatagaacugaagga

SEQ ID NO: 68730 - DNA, 26 bp, Artificial Sequence
  Synthetic
tcaauaacacaagcacaccctuagac

SEQ ID NO: 68731 - DNA, 28 bp, Artificial Sequence
  Synthetic
gctttgggaatucatggtttttgatuca

SEQ ID NO: 68732 - DNA, 29 bp, Artificial Sequence
  Synthetic
ctattcaccatacutacagatcccttugg

SEQ ID NO: 68733 - DNA, 25 bp, Artificial Sequence
  Synthetic
ccggagttaauctgttcatggttut

SEQ ID NO: 68734 - DNA, 27 bp, Artificial Sequence
  Synthetic
tcatcaccatctuactttttcccctut

SEQ ID NO: 68735 - DNA, 28 bp, Artificial Sequence
  Synthetic
cattgtctagaucagcttttgtgaugag

SEQ ID NO: 68736 - DNA, 23 bp, Artificial Sequence
  Synthetic
ccaaattccauctgggacaugct

SEQ ID NO: 68737 - DNA, 28 bp, Artificial Sequence
  Synthetic
actgcaacaggautgaatctttaccuat

SEQ ID NO: 68738 - DNA, 27 bp, Artificial Sequence
  Synthetic
gaaagcatgcautttcaataggguaca

SEQ ID NO: 68739 - DNA, 28 bp, Artificial Sequence
  Synthetic
agagtggatgaaguagaatgacatgcua

SEQ ID NO: 68740 - DNA, 26 bp, Artificial Sequence
  Synthetic
cacagggcaaacucagaaaatgaauc

SEQ ID NO: 68741 - DNA, 27 bp, Artificial Sequence
  Synthetic
ttctggaatuaacacagcuaccacaat

SEQ ID NO: 68742 - DNA, 27 bp, Artificial Sequence
  Synthetic
ccagatguccaacagcagtatttauca

SEQ ID NO: 68743 - DNA, 29 bp, Artificial Sequence
  Synthetic
gtgatcaattcugtcaggcctatuaaaga

SEQ ID NO: 68744 - DNA, 26 bp, Artificial Sequence
  Synthetic
acagttttgtugccaattttguacga

SEQ ID NO: 68745 - DNA, 28 bp, Artificial Sequence
  Synthetic
agttcttctagacautttgccccuaaaa

SEQ ID NO: 68746 - DNA, 24 bp, Artificial Sequence
  Synthetic
tttaacttagcutcaggcaccugt

SEQ ID NO: 68747 - DNA, 23 bp, Artificial Sequence
  Synthetic
gatattgaugccaggcugaggaa

SEQ ID NO: 68748 - DNA, 25 bp, Artificial Sequence
  Synthetic
cgaactcacuaaacgtgtcctugaa

SEQ ID NO: 68749 - DNA, 22 bp, Artificial Sequence
  Synthetic
ctguctatccaacuggccacat

SEQ ID NO: 68750 - DNA, 26 bp, Artificial Sequence
  Synthetic
tcaggtcttugcaattttctgguaca

SEQ ID NO: 68751 - DNA, 24 bp, Artificial Sequence
  Synthetic
aatgcttgcugttggaaauggaag

SEQ ID NO: 68752 - DNA, 24 bp, Artificial Sequence
  Synthetic
gcaggagaaaucccagatctgtuc

SEQ ID NO: 68753 - DNA, 28 bp, Artificial Sequence
  Synthetic
gcaatagcaggutttaactaacaugcaa

SEQ ID NO: 68754 - DNA, 26 bp, Artificial Sequence
  Synthetic
tcttgaattggauttcctgctucgat

SEQ ID NO: 68755 - DNA, 28 bp, Artificial Sequence
  Synthetic
gtttacatttcaacacuggagagagcua

SEQ ID NO: 68756 - DNA, 23 bp, Artificial Sequence
  Synthetic
cttcttgucagggtcttcucgaa

SEQ ID NO: 68757 - DNA, 25 bp, Artificial Sequence
  Synthetic
aggaagcatcucctctatgtacugg

SEQ ID NO: 68758 - DNA, 28 bp, Artificial Sequence
  Synthetic
tgttttattctttugaaggtggtcugga

SEQ ID NO: 68759 - DNA, 22 bp, Artificial Sequence
  Synthetic
cctaaucgaccaacacccugaa

SEQ ID NO: 68760 - DNA, 21 bp, Artificial Sequence
  Synthetic
ggauaaaacgaggugcggaga

SEQ ID NO: 68761 - DNA, 21 bp, Artificial Sequence
  Synthetic
guctagtcaccuggcccaaag

SEQ ID NO: 68762 - DNA, 21 bp, Artificial Sequence
  Synthetic
agggagacccaucgtucagaa

SEQ ID NO: 68763 - DNA, 24 bp, Artificial Sequence
  Synthetic
ggcactctguactggttagatucc

SEQ ID NO: 68764 - DNA, 28 bp, Artificial Sequence
  Synthetic
acaagaattugaagctgccatuaaacaa

SEQ ID NO: 68765 - DNA, 31 bp, Artificial Sequence
  Synthetic
ctctgttctgucaactctaaaaattctcuca

SEQ ID NO: 68766 - DNA, 33 bp, Artificial Sequence
  Synthetic
ttctcatgaattttuaaactcttgtagtcagua

SEQ ID NO: 68767 - DNA, 20 bp, Artificial Sequence
  Synthetic
caaatgcgutgggctuccat

SEQ ID NO: 68768 - DNA, 25 bp, Artificial Sequence
  Synthetic
gtgtggtguagattttgcaugaaca

SEQ ID NO: 68769 - DNA, 32 bp, Artificial Sequence
  Synthetic
gtaccatcaatatuctttttcacacaactucc

SEQ ID NO: 68770 - DNA, 25 bp, Artificial Sequence
  Synthetic
gccatgtcctugggattctagauag

SEQ ID NO: 68771 - DNA, 28 bp, Artificial Sequence
  Synthetic
tugaaatgattgttuccacaacacagaa

SEQ ID NO: 68772 - DNA, 27 bp, Artificial Sequence
  Synthetic
caatgtcaagcugaaaaagtacgugat

SEQ ID NO: 68773 - DNA, 28 bp, Artificial Sequence
  Synthetic
gcttggttttgcugtcttaaatccatua

SEQ ID NO: 68774 - DNA, 30 bp, Artificial Sequence
  Synthetic
ttgtacgttataggcuctgatttctttugt

SEQ ID NO: 68775 - DNA, 25 bp, Artificial Sequence
  Synthetic
gcatcagattccuttatggcaaguc

SEQ ID NO: 68776 - DNA, 22 bp, Artificial Sequence
  Synthetic
aattctgtugttctcggugcct

SEQ ID NO: 68777 - DNA, 27 bp, Artificial Sequence
  Synthetic
tcagcattttguctcagtagtcttuca

SEQ ID NO: 68778 - DNA, 24 bp, Artificial Sequence
  Synthetic
gttttcatugaatggtggugccaa

SEQ ID NO: 68779 - DNA, 26 bp, Artificial Sequence
  Synthetic
ctgtgatgttuagatgggagatguct

SEQ ID NO: 68780 - DNA, 26 bp, Artificial Sequence
  Synthetic
ccatgactgagutaatgtgttcuggt

SEQ ID NO: 68781 - DNA, 27 bp, Artificial Sequence
  Synthetic
tugccaagaactuacacaagaacaaag

SEQ ID NO: 68782 - DNA, 21 bp, Artificial Sequence
  Synthetic
gggagggaaggaacugtcuaa

SEQ ID NO: 68783 - DNA, 26 bp, Artificial Sequence
  Synthetic
ctttgatagcauccatagtgcaucct

SEQ ID NO: 68784 - DNA, 28 bp, Artificial Sequence
  Synthetic
ttggugcaaaacagaaaaatggtuaagt

SEQ ID NO: 68785 - DNA, 21 bp, Artificial Sequence
  Synthetic
ttgaacggautgctcctcugg

SEQ ID NO: 68786 - DNA, 21 bp, Artificial Sequence
  Synthetic
gctaacaggugatcccgtuct

SEQ ID NO: 68787 - DNA, 19 bp, Artificial Sequence
  Synthetic
tgcugttgcuggaaagcga

SEQ ID NO: 68788 - DNA, 18 bp, Artificial Sequence
  Synthetic
ctcccgggugatgacgua

SEQ ID NO: 68789 - DNA, 22 bp, Artificial Sequence
  Synthetic
ctcaacacgaccucacctacuc

SEQ ID NO: 68790 - DNA, 26 bp, Artificial Sequence
  Synthetic
ggtcaatttuaaacctcggagctuct

SEQ ID NO: 68791 - DNA, 28 bp, Artificial Sequence
  Synthetic
caactccaccuacatgacctaaaaatuc

SEQ ID NO: 68792 - DNA, 24 bp, Artificial Sequence
  Synthetic
ccagtcttcuggtctttccttucc

SEQ ID NO: 68793 - DNA, 22 bp, Artificial Sequence
  Synthetic
gccatctgugtcagcatttguc

SEQ ID NO: 68794 - DNA, 25 bp, Artificial Sequence
  Synthetic
gaacuccaaaatcuacagccagact

SEQ ID NO: 68795 - DNA, 26 bp, Artificial Sequence
  Synthetic
acaggagcauctccttctaaugagaa

SEQ ID NO: 68796 - DNA, 26 bp, Artificial Sequence
  Synthetic
ttatttgggttcugaatgcgtcuact

SEQ ID NO: 68797 - DNA, 28 bp, Artificial Sequence
  Synthetic
cctggatgaagucaaatatgguaagagg

SEQ ID NO: 68798 - DNA, 25 bp, Artificial Sequence
  Synthetic
aaacttggauccctatgaacagugg

SEQ ID NO: 68799 - DNA, 23 bp, Artificial Sequence
  Synthetic
tccagtcaaaaguacctgtugct

SEQ ID NO: 68800 - DNA, 23 bp, Artificial Sequence
  Synthetic
aagctgattguggctaacgcuat

SEQ ID NO: 68801 - DNA, 25 bp, Artificial Sequence
  Synthetic
acagagaatuactgtgcaaucagca

SEQ ID NO: 68802 - DNA, 23 bp, Artificial Sequence
  Synthetic
accatacttccugtgagggtgua

SEQ ID NO: 68803 - DNA, 25 bp, Artificial Sequence
  Synthetic
gtgtgaccuggactgtctttctauc

SEQ ID NO: 68804 - DNA, 22 bp, Artificial Sequence
  Synthetic
gggacagguggugagaagaaaa

SEQ ID NO: 68805 - DNA, 21 bp, Artificial Sequence
  Synthetic
gtgggcaaagguccaggtuaa

SEQ ID NO: 68806 - DNA, 22 bp, Artificial Sequence
  Synthetic
caggacuccctttgcttuggat

SEQ ID NO: 68807 - DNA, 23 bp, Artificial Sequence
  Synthetic
gttcccacatuctccttccctuc

SEQ ID NO: 68808 - DNA, 21 bp, Artificial Sequence
  Synthetic
cagccucagtttccuccaact

SEQ ID NO: 68809 - DNA, 23 bp, Artificial Sequence
  Synthetic
cccctccaucaaggacaagtaug

SEQ ID NO: 68810 - DNA, 17 bp, Artificial Sequence
  Synthetic
gcuggcgcagctttcuc

SEQ ID NO: 68811 - DNA, 18 bp, Artificial Sequence
  Synthetic
ggcccuggacgaagugac

SEQ ID NO: 68812 - DNA, 28 bp, Artificial Sequence
  Synthetic
tcagagagtaguaagttgagaaacugaa

SEQ ID NO: 68813 - DNA, 25 bp, Artificial Sequence
  Synthetic
acccacaaaagaaucctcaagtucc

SEQ ID NO: 68814 - DNA, 18 bp, Artificial Sequence
  Synthetic
ctgccuccagtgctccug

SEQ ID NO: 68815 - DNA, 21 bp, Artificial Sequence
  Synthetic
accaacatccuggacagcaut

SEQ ID NO: 68816 - DNA, 25 bp, Artificial Sequence
  Synthetic
cttggcaaagutgcactaatucagt

SEQ ID NO: 68817 - DNA, 27 bp, Artificial Sequence
  Synthetic
agaacggccagcuaataaaagaactua

SEQ ID NO: 68818 - DNA, 27 bp, Artificial Sequence
  Synthetic
ttcaaggatauggaaagagtttgugct

SEQ ID NO: 68819 - DNA, 28 bp, Artificial Sequence
  Synthetic
aaagagggtgauattgtggcaatgauaa

SEQ ID NO: 68820 - DNA, 22 bp, Artificial Sequence
  Synthetic
tcaggttccaaucgttgcacut

SEQ ID NO: 68821 - DNA, 24 bp, Artificial Sequence
  Synthetic
gttttgacaagaaauggcugcaga

SEQ ID NO: 68822 - DNA, 28 bp, Artificial Sequence
  Synthetic
tctgtagacagaccucttttcaaguaca

SEQ ID NO: 68823 - DNA, 28 bp, Artificial Sequence
  Synthetic
ccaaaggcatcutcttttcttggaauaa

SEQ ID NO: 68824 - DNA, 25 bp, Artificial Sequence
  Synthetic
tttggtaaagaugacttccctggug

SEQ ID NO: 68825 - DNA, 23 bp, Artificial Sequence
  Synthetic
cgtggcaguttttgctttcttut

SEQ ID NO: 68826 - DNA, 25 bp, Artificial Sequence
  Synthetic
acagguacaacagcttuccaagaaa

SEQ ID NO: 68827 - DNA, 26 bp, Artificial Sequence
  Synthetic
ctatggaaaaccuggcctcttuagat

SEQ ID NO: 68828 - DNA, 20 bp, Artificial Sequence
  Synthetic
gctgaagcugcaccctacut

SEQ ID NO: 68829 - DNA, 23 bp, Artificial Sequence
  Synthetic
agaccugggaaatgttugagacc

SEQ ID NO: 68830 - DNA, 23 bp, Artificial Sequence
  Synthetic
cagggtttugttcctgagucgat

SEQ ID NO: 68831 - DNA, 25 bp, Artificial Sequence
  Synthetic
cgactggagautctggagattcuga

SEQ ID NO: 68832 - DNA, 17 bp, Artificial Sequence
  Synthetic
ccacgccggguggtuag

SEQ ID NO: 68833 - DNA, 18 bp, Artificial Sequence
  Synthetic
ctccttccugctgcggut

SEQ ID NO: 68834 - DNA, 28 bp, Artificial Sequence
  Synthetic
agctcacctatuttagttgcactguaaa

SEQ ID NO: 68835 - DNA, 20 bp, Artificial Sequence
  Synthetic
gcaatgcucgtgcttgtuca

SEQ ID NO: 68836 - DNA, 28 bp, Artificial Sequence
  Synthetic
actactaaaagccutaggaaagctcuca

SEQ ID NO: 68837 - DNA, 28 bp, Artificial Sequence
  Synthetic
ggtagcagtuttacaacatcaucaggaa

SEQ ID NO: 68838 - DNA, 21 bp, Artificial Sequence
  Synthetic
ccaacutcacaccuggaccaa

SEQ ID NO: 68839 - DNA, 24 bp, Artificial Sequence
  Synthetic
accaggaaugccttatatcacguc

SEQ ID NO: 68840 - DNA, 25 bp, Artificial Sequence
  Synthetic
aatcauaaagcacagaagcctguct

SEQ ID NO: 68841 - DNA, 28 bp, Artificial Sequence
  Synthetic
cctgttgagucctaacatctcttuaagg

SEQ ID NO: 68842 - DNA, 28 bp, Artificial Sequence
  Synthetic
gagggaagugaaatcagtctgtuaaact

SEQ ID NO: 68843 - DNA, 23 bp, Artificial Sequence
  Synthetic
gtaagcugcttcgaaguacaggt

SEQ ID NO: 68844 - DNA, 28 bp, Artificial Sequence
  Synthetic
ccaagcatauaggacacttagaaucagg

SEQ ID NO: 68845 - DNA, 24 bp, Artificial Sequence
  Synthetic
agataatggcaucagctgcuaagg

SEQ ID NO: 68846 - DNA, 21 bp, Artificial Sequence
  Synthetic
tgcaataugtgcccucagcaa

SEQ ID NO: 68847 - DNA, 26 bp, Artificial Sequence
  Synthetic
accttgaacuccttaagcataugcac

SEQ ID NO: 68848 - DNA, 22 bp, Artificial Sequence
  Synthetic
ctgacuattgcaacucggaggt

SEQ ID NO: 68849 - DNA, 28 bp, Artificial Sequence
  Synthetic
ctgttccaaggautttgaagtttcucaa

SEQ ID NO: 68850 - DNA, 24 bp, Artificial Sequence
  Synthetic
catgatatcaggcutcaggcgaut

SEQ ID NO: 68851 - DNA, 26 bp, Artificial Sequence
  Synthetic
tgttacggcuctgtgttuaagaacat

SEQ ID NO: 68852 - DNA, 20 bp, Artificial Sequence
  Synthetic
gggcgttcugtgtgtcauca

SEQ ID NO: 68853 - DNA, 21 bp, Artificial Sequence
  Synthetic
ctaccugcccaacttcuaccc

SEQ ID NO: 68854 - DNA, 20 bp, Artificial Sequence
  Synthetic
gaaggaugggauggcgaact

SEQ ID NO: 68855 - DNA, 22 bp, Artificial Sequence
  Synthetic
gggacuggatgaatgucaaggg

SEQ ID NO: 68856 - DNA, 18 bp, Artificial Sequence
  Synthetic
gcuaccgtcugcgcacaa

SEQ ID NO: 68857 - DNA, 20 bp, Artificial Sequence
  Synthetic
agcggacgcaucguagaaag

SEQ ID NO: 68858 - DNA, 23 bp, Artificial Sequence
  Synthetic
caatctagacaaugtgtggcgut

SEQ ID NO: 68859 - DNA, 28 bp, Artificial Sequence
  Synthetic
cctcatgctcaaacuattttccattcug

SEQ ID NO: 68860 - DNA, 28 bp, Artificial Sequence
  Synthetic
ggcataaaaguaagaactccacauacct

SEQ ID NO: 68861 - DNA, 27 bp, Artificial Sequence
  Synthetic
ccccaaatgatugtgttctgttttgut

SEQ ID NO: 68862 - DNA, 29 bp, Artificial Sequence
  Synthetic
tgtcttcacacauaaatcacaagcuaact

SEQ ID NO: 68863 - DNA, 28 bp, Artificial Sequence
  Synthetic
gttaggtaaaatggugtatcctggcuat

SEQ ID NO: 68864 - DNA, 20 bp, Artificial Sequence
  Synthetic
gtaccagagugcagcaguga

SEQ ID NO: 68865 - DNA, 21 bp, Artificial Sequence
  Synthetic
ttcagagaagucgagggucca

SEQ ID NO: 68866 - DNA, 27 bp, Artificial Sequence
  Synthetic
tccttacaaacaucctacctugagaca

SEQ ID NO: 68867 - DNA, 25 bp, Artificial Sequence
  Synthetic
aggactgcccutgttcttttacaut

SEQ ID NO: 68868 - DNA, 20 bp, Artificial Sequence
  Synthetic
cggcgaaccaggauaccauc

SEQ ID NO: 68869 - DNA, 26 bp, Artificial Sequence
  Synthetic
aggcaccgagguctctttaaaaauaa

SEQ ID NO: 68870 - DNA, 20 bp, Artificial Sequence
  Synthetic
ggaccctucccatccuccat

SEQ ID NO: 68871 - DNA, 23 bp, Artificial Sequence
  Synthetic
ccagctucagagagtugagagag

SEQ ID NO: 68872 - DNA, 21 bp, Artificial Sequence
  Synthetic
tuctctgctuccgaaaagcca

SEQ ID NO: 68873 - DNA, 22 bp, Artificial Sequence
  Synthetic
ggagagucggcatcguagaaag

SEQ ID NO: 68874 - DNA, 26 bp, Artificial Sequence
  Synthetic
ccagacatcuctttcagttccauaca

SEQ ID NO: 68875 - DNA, 23 bp, Artificial Sequence
  Synthetic
caaaagacccagagcutcaccut

SEQ ID NO: 68876 - DNA, 24 bp, Artificial Sequence
  Synthetic
tcaagtctgcutacagagggauct

SEQ ID NO: 68877 - DNA, 23 bp, Artificial Sequence
  Synthetic
actcaccaucccttacacuagca

SEQ ID NO: 68878 - DNA, 18 bp, Artificial Sequence
  Synthetic
gccgggagcuctgttucc

SEQ ID NO: 68879 - DNA, 21 bp, Artificial Sequence
  Synthetic
ctctgcccagaucactgtgut

SEQ ID NO: 68880 - DNA, 21 bp, Artificial Sequence
  Synthetic
gctttagcccugactccagut

SEQ ID NO: 68881 - DNA, 22 bp, Artificial Sequence
  Synthetic
cccccgtaugtccagctataug

SEQ ID NO: 68882 - DNA, 23 bp, Artificial Sequence
  Synthetic
gaaagcagggaaaaggucuccat

SEQ ID NO: 68883 - DNA, 20 bp, Artificial Sequence
  Synthetic
tctctctccaugcgcctcua

SEQ ID NO: 68884 - DNA, 22 bp, Artificial Sequence
  Synthetic
tgacaauacgccccagtucaag

SEQ ID NO: 68885 - DNA, 21 bp, Artificial Sequence
  Synthetic
ccagcccucctctgacagaut

SEQ ID NO: 68886 - DNA, 19 bp, Artificial Sequence
  Synthetic
caagcacagcgguggatug

SEQ ID NO: 68887 - DNA, 25 bp, Artificial Sequence
  Synthetic
ttacaggaccccuatcaacaactug

SEQ ID NO: 68888 - DNA, 24 bp, Artificial Sequence
  Synthetic
tcttctctgtgcutctccttccut

SEQ ID NO: 68889 - DNA, 21 bp, Artificial Sequence
  Synthetic
gtcacctcauctgaggcctug

SEQ ID NO: 68890 - DNA, 24 bp, Artificial Sequence
  Synthetic
ttagcgauaagcagcttttuacca

SEQ ID NO: 68891 - DNA, 25 bp, Artificial Sequence
  Synthetic
gtgcttacaatcucagtacctgcua

SEQ ID NO: 68892 - DNA, 17 bp, Artificial Sequence
  Synthetic
cgucacccccgccttua

SEQ ID NO: 68893 - DNA, 17 bp, Artificial Sequence
  Synthetic
caaagggucgcggucac

SEQ ID NO: 68894 - DNA, 22 bp, Artificial Sequence
  Synthetic
gggagctguagcttccauaagg

SEQ ID NO: 68895 - DNA, 22 bp, Artificial Sequence
  Synthetic
ccacagacutcttgggttuggg

SEQ ID NO: 68896 - DNA, 21 bp, Artificial Sequence
  Synthetic
ggcccagaaugcaccactauc

SEQ ID NO: 68897 - DNA, 21 bp, Artificial Sequence
  Synthetic
cctctgcugtgttgcccuaaa

SEQ ID NO: 68898 - DNA, 21 bp, Artificial Sequence
  Synthetic
gctcaacugttgtguccccat

SEQ ID NO: 68899 - DNA, 28 bp, Artificial Sequence
  Synthetic
tccatgtctgttuctcaaagggaatauc

SEQ ID NO: 68900 - DNA, 21 bp, Artificial Sequence
  Synthetic
agacccccucggacagtaauc

SEQ ID NO: 68901 - DNA, 23 bp, Artificial Sequence
  Synthetic
tggttttctguccacttccccua

SEQ ID NO: 68902 - DNA, 19 bp, Artificial Sequence
  Synthetic
gggtaagagcugcggucaa

SEQ ID NO: 68903 - DNA, 19 bp, Artificial Sequence
  Synthetic
gcccgcuattcgcaaucag

SEQ ID NO: 68904 - DNA, 22 bp, Artificial Sequence
  Synthetic
ccaaggtttuccggatcgaugt

SEQ ID NO: 68905 - DNA, 23 bp, Artificial Sequence
  Synthetic
gctgaagacucttcctctugagt

SEQ ID NO: 68906 - DNA, 22 bp, Artificial Sequence
  Synthetic
ttggcatcuccacccctacuat

SEQ ID NO: 68907 - DNA, 20 bp, Artificial Sequence
  Synthetic
gguacacagugcagaaagcc

SEQ ID NO: 68908 - DNA, 20 bp, Artificial Sequence
  Synthetic
gggttcutcactgugaccgt

SEQ ID NO: 68909 - DNA, 22 bp, Artificial Sequence
  Synthetic
acttggatcucaccccaacuct

SEQ ID NO: 68910 - DNA, 18 bp, Artificial Sequence
  Synthetic
cctucccaccccaaugct

SEQ ID NO: 68911 - DNA, 20 bp, Artificial Sequence
  Synthetic
aaagccuttgcucacagggt

SEQ ID NO: 68912 - DNA, 27 bp, Artificial Sequence
  Synthetic
cctgctttgaguattttagaggacugt

SEQ ID NO: 68913 - DNA, 19 bp, Artificial Sequence
  Synthetic
ggttgucggcaagcuggaa

SEQ ID NO: 68914 - DNA, 18 bp, Artificial Sequence
  Synthetic
cgctgcguccacacaaut

SEQ ID NO: 68915 - DNA, 19 bp, Artificial Sequence
  Synthetic
gcagctccucgtgatccuc

SEQ ID NO: 68916 - DNA, 23 bp, Artificial Sequence
  Synthetic
ttcacagtgucacaggcauagac

SEQ ID NO: 68917 - DNA, 26 bp, Artificial Sequence
  Synthetic
tgttccaaaggutctttgaggtgaut

SEQ ID NO: 68918 - DNA, 21 bp, Artificial Sequence
  Synthetic
gcugtactggucacaagccat

SEQ ID NO: 68919 - DNA, 21 bp, Artificial Sequence
  Synthetic
gagcaacagutcucccacaca

SEQ ID NO: 68920 - DNA, 21 bp, Artificial Sequence
  Synthetic
acatttucaggccctggauga

SEQ ID NO: 68921 - DNA, 23 bp, Artificial Sequence
  Synthetic
gtagccagcuccctacaatccua

SEQ ID NO: 68922 - DNA, 20 bp, Artificial Sequence
  Synthetic
caggaugccctggacaugat

SEQ ID NO: 68923 - DNA, 23 bp, Artificial Sequence
  Synthetic
cctatacttgaautggccccuga

SEQ ID NO: 68924 - DNA, 22 bp, Artificial Sequence
  Synthetic
gtgucttctgtgucaccccaat

SEQ ID NO: 68925 - DNA, 24 bp, Artificial Sequence
  Synthetic
ccaaacatctugtccaccatguct

SEQ ID NO: 68926 - DNA, 20 bp, Artificial Sequence
  Synthetic
gggacacccugtaagctuca

SEQ ID NO: 68927 - DNA, 23 bp, Artificial Sequence
  Synthetic
cctctgtgagcutggacttctut

SEQ ID NO: 68928 - DNA, 22 bp, Artificial Sequence
  Synthetic
catgactgacucaactggccut

SEQ ID NO: 68929 - DNA, 21 bp, Artificial Sequence
  Synthetic
gtattcgucccccttgauggt

SEQ ID NO: 68930 - DNA, 20 bp, Artificial Sequence
  Synthetic
gcuccctctatucggcacaa

SEQ ID NO: 68931 - DNA, 21 bp, Artificial Sequence
  Synthetic
cctgatguggttgtcggucag

SEQ ID NO: 68932 - DNA, 19 bp, Artificial Sequence
  Synthetic
cctgtgaccugctctguct

SEQ ID NO: 68933 - DNA, 19 bp, Artificial Sequence
  Synthetic
cacccgcutccagtcauca

SEQ ID NO: 68934 - DNA, 19 bp, Artificial Sequence
  Synthetic
ccaccgtgugctcgctuat

SEQ ID NO: 68935 - DNA, 20 bp, Artificial Sequence
  Synthetic
ggtagcugatgggccugaac

SEQ ID NO: 68936 - DNA, 28 bp, Artificial Sequence
  Synthetic
acaagatgttcauagagttttaguggct

SEQ ID NO: 68937 - DNA, 27 bp, Artificial Sequence
  Synthetic
gagattagatuacctcgcacacugaat

SEQ ID NO: 68938 - DNA, 28 bp, Artificial Sequence
  Synthetic
tcttagcagcucttactatcttccucaa

SEQ ID NO: 68939 - DNA, 23 bp, Artificial Sequence
  Synthetic
ctttttctugggttttggcucct

SEQ ID NO: 68940 - DNA, 26 bp, Artificial Sequence
  Synthetic
gaagutgcattgtgucaagacaagag

SEQ ID NO: 68941 - DNA, 27 bp, Artificial Sequence
  Synthetic
ctaccctgaatuatggctccaaguaag

SEQ ID NO: 68942 - DNA, 29 bp, Artificial Sequence
  Synthetic
agttuagcacagaaagacatatuggaagt

SEQ ID NO: 68943 - DNA, 27 bp, Artificial Sequence
  Synthetic
acctcaagcaaagutttaaggcaatut

SEQ ID NO: 68944 - DNA, 28 bp, Artificial Sequence
  Synthetic
catcttaaaagguaaacattgccuccag

SEQ ID NO: 68945 - DNA, 27 bp, Artificial Sequence
  Synthetic
cacagatttataucatccaggcctuca

SEQ ID NO: 68946 - DNA, 29 bp, Artificial Sequence
  Synthetic
gtcagactgtacutccatacttgatucat

SEQ ID NO: 68947 - DNA, 20 bp, Artificial Sequence
  Synthetic
ggttgtggaucggctcgtut

SEQ ID NO: 68948 - DNA, 21 bp, Artificial Sequence
  Synthetic
aagatgaugggaggccuagga

SEQ ID NO: 68949 - DNA, 30 bp, Artificial Sequence
  Synthetic
tgaggaatuagagagagaaaatgaguaact

SEQ ID NO: 68950 - DNA, 27 bp, Artificial Sequence
  Synthetic
gaagatgttgtugtccctactauggaa

SEQ ID NO: 68951 - DNA, 29 bp, Artificial Sequence
  Synthetic
gcttgggcaaaggaaauataatacugaga

SEQ ID NO: 68952 - DNA, 22 bp, Artificial Sequence
  Synthetic
gaggtgcacagaugctcagaut

SEQ ID NO: 68953 - DNA, 22 bp, Artificial Sequence
  Synthetic
gacagcatcutgtctcagguca

SEQ ID NO: 68954 - DNA, 23 bp, Artificial Sequence
  Synthetic
actgguggcagaaaacucaagaa

SEQ ID NO: 68955 - DNA, 20 bp, Artificial Sequence
  Synthetic
atcccaccaagcugcctauc

SEQ ID NO: 68956 - DNA, 24 bp, Artificial Sequence
  Synthetic
tcttttgccacaggutccaacuat

SEQ ID NO: 68957 - DNA, 19 bp, Artificial Sequence
  Synthetic
ccatattgcugccgctucc

SEQ ID NO: 68958 - DNA, 21 bp, Artificial Sequence
  Synthetic
tccccacccugttccttttug

SEQ ID NO: 68959 - DNA, 21 bp, Artificial Sequence
  Synthetic
aaggagcaugtgtgtuagcga

SEQ ID NO: 68960 - DNA, 19 bp, Artificial Sequence
  Synthetic
gctguaccgctccaucgac

SEQ ID NO: 68961 - DNA, 22 bp, Artificial Sequence
  Synthetic
tcctaggaagcuacctggtuct

SEQ ID NO: 68962 - DNA, 23 bp, Artificial Sequence
  Synthetic
cactgccacugaggtctgtatut

SEQ ID NO: 68963 - DNA, 22 bp, Artificial Sequence
  Synthetic
gacutgatgaagguccacagca

SEQ ID NO: 68964 - DNA, 21 bp, Artificial Sequence
  Synthetic
gttcuacgccacgttccugat

SEQ ID NO: 68965 - DNA, 21 bp, Artificial Sequence
  Synthetic
gucagaggcaaugaccaggac

SEQ ID NO: 68966 - DNA, 22 bp, Artificial Sequence
  Synthetic
accugagaugcagaaggagaca

SEQ ID NO: 68967 - DNA, 28 bp, Artificial Sequence
  Synthetic
accagtcaguctcattataatccugagt

SEQ ID NO: 68968 - DNA, 25 bp, Artificial Sequence
  Synthetic
tcaacattaucccaaatcucagcca

SEQ ID NO: 68969 - DNA, 27 bp, Artificial Sequence
  Synthetic
atgagccttucattttgtgguaacaac

SEQ ID NO: 68970 - DNA, 26 bp, Artificial Sequence
  Synthetic
gatgaatggaagaucttaggcucagt

SEQ ID NO: 68971 - DNA, 24 bp, Artificial Sequence
  Synthetic
tcagaggaaccautgcagatuacc

SEQ ID NO: 68972 - DNA, 20 bp, Artificial Sequence
  Synthetic
cagccgagguaccccattua

SEQ ID NO: 68973 - DNA, 22 bp, Artificial Sequence
  Synthetic
cattgaaugccttgaugccaca

SEQ ID NO: 68974 - DNA, 29 bp, Artificial Sequence
  Synthetic
attatgtgtgcucttgtatatgcttucct

SEQ ID NO: 68975 - DNA, 26 bp, Artificial Sequence
  Synthetic
gccacttcaggagaaugtatatgcut

SEQ ID NO: 68976 - DNA, 28 bp, Artificial Sequence
  Synthetic
gctagacttaagutcctcagatggtuca

SEQ ID NO: 68977 - DNA, 28 bp, Artificial Sequence
  Synthetic
tggacatttcacugtaggatcuaaaacc

SEQ ID NO: 68978 - DNA, 27 bp, Artificial Sequence
  Synthetic
tgtctgccaautaactcatttatugct

SEQ ID NO: 68979 - DNA, 22 bp, Artificial Sequence
  Synthetic
caggaagaugcaccaaggcuaa

SEQ ID NO: 68980 - DNA, 21 bp, Artificial Sequence
  Synthetic
cttgccucctaggcaucagaa

SEQ ID NO: 68981 - DNA, 22 bp, Artificial Sequence
  Synthetic
actcctttgcuaacgcttguca

SEQ ID NO: 68982 - DNA, 23 bp, Artificial Sequence
  Synthetic
agtctccuccaggcataatcuga

SEQ ID NO: 68983 - DNA, 21 bp, Artificial Sequence
  Synthetic
tgtgaggaccugcctctctut

SEQ ID NO: 68984 - DNA, 22 bp, Artificial Sequence
  Synthetic
caaatggtggugtttggcttug

SEQ ID NO: 68985 - DNA, 23 bp, Artificial Sequence
  Synthetic
cgtaaagccaacucatgctuagg

SEQ ID NO: 68986 - DNA, 22 bp, Artificial Sequence
  Synthetic
cgtcucacacagaccttgagut

SEQ ID NO: 68987 - DNA, 28 bp, Artificial Sequence
  Synthetic
ggaagaaaaauacacagcagtucagaga

SEQ ID NO: 68988 - DNA, 28 bp, Artificial Sequence
  Synthetic
cgaaccttctgcuttttaatgtcctcua

SEQ ID NO: 68989 - DNA, 21 bp, Artificial Sequence
  Synthetic
gcaaccgggaugcaaaaaugt

SEQ ID NO: 68990 - DNA, 29 bp, Artificial Sequence
  Synthetic
ccagtaccaaagutgataatgctatguca

SEQ ID NO: 68991 - DNA, 28 bp, Artificial Sequence
  Synthetic
gctaacatuaaaagggacaagtcuaaga

SEQ ID NO: 68992 - DNA, 20 bp, Artificial Sequence
  Synthetic
ggtcatcugcccatgucgaa

SEQ ID NO: 68993 - DNA, 25 bp, Artificial Sequence
  Synthetic
gcaattacuacgcaaacgctuacag

SEQ ID NO: 68994 - DNA, 19 bp, Artificial Sequence
  Synthetic
gcutggccaugagaagcct

SEQ ID NO: 68995 - DNA, 22 bp, Artificial Sequence
  Synthetic
gctcaccagugccttctcttuc

SEQ ID NO: 68996 - DNA, 25 bp, Artificial Sequence
  Synthetic
catttctcaaugctttgcagaucca

SEQ ID NO: 68997 - DNA, 23 bp, Artificial Sequence
  Synthetic
gttttatttcgacutgcggcuca

SEQ ID NO: 68998 - DNA, 25 bp, Artificial Sequence
  Synthetic
aagacaagcaacuttccaattgugg

SEQ ID NO: 68999 - DNA, 26 bp, Artificial Sequence
  Synthetic
tgcctgggtuacattttcactttcut

SEQ ID NO: 69000 - DNA, 21 bp, Artificial Sequence
  Synthetic
cagaacugcagagttggctug

SEQ ID NO: 69001 - DNA, 22 bp, Artificial Sequence
  Synthetic
ccagccucaucaaccagaagaa

SEQ ID NO: 69002 - DNA, 17 bp, Artificial Sequence
  Synthetic
ggtcugcagcgagucca

SEQ ID NO: 69003 - DNA, 26 bp, Artificial Sequence
  Synthetic
tgtatcttctcaucctccctcucaac

SEQ ID NO: 69004 - DNA, 19 bp, Artificial Sequence
  Synthetic
gcucccgagacaggtcuga

SEQ ID NO: 69005 - DNA, 21 bp, Artificial Sequence
  Synthetic
acctctccacuggaagagcua

SEQ ID NO: 69006 - DNA, 27 bp, Artificial Sequence
  Synthetic
aaagccaagaautaaaacttugcaggt

SEQ ID NO: 69007 - DNA, 28 bp, Artificial Sequence
  Synthetic
ctggttacagucttcaggaaaatcuagt

SEQ ID NO: 69008 - DNA, 20 bp, Artificial Sequence
  Synthetic
gcggcaguggaaatttucgg

SEQ ID NO: 69009 - DNA, 23 bp, Artificial Sequence
  Synthetic
acaagaacgagagcguacucaag

SEQ ID NO: 69010 - DNA, 23 bp, Artificial Sequence
  Synthetic
augagacaaccacugagaaccag

SEQ ID NO: 69011 - DNA, 22 bp, Artificial Sequence
  Synthetic
ccactgagcugggacatuacat

SEQ ID NO: 69012 - DNA, 24 bp, Artificial Sequence
  Synthetic
ttaacacatcacccucccaatcug

SEQ ID NO: 69013 - DNA, 27 bp, Artificial Sequence
  Synthetic
ttgagttacuggccatttgaggtatut

SEQ ID NO: 69014 - DNA, 21 bp, Artificial Sequence
  Synthetic
tcccctgugttgttcccuaca

SEQ ID NO: 69015 - DNA, 24 bp, Artificial Sequence
  Synthetic
tggtcagutctgataaucggaggt

SEQ ID NO: 69016 - DNA, 22 bp, Artificial Sequence
  Synthetic
ccctttttggcuccatgtgaut

SEQ ID NO: 69017 - DNA, 22 bp, Artificial Sequence
  Synthetic
ctucatgctctcuacccacaca

SEQ ID NO: 69018 - DNA, 22 bp, Artificial Sequence
  Synthetic
ttuacaaacacagccaggugga

SEQ ID NO: 69019 - DNA, 22 bp, Artificial Sequence
  Synthetic
tgaggagcugcttugagacaac

SEQ ID NO: 69020 - DNA, 22 bp, Artificial Sequence
  Synthetic
gctucagaaagcaagcagtgut

SEQ ID NO: 69021 - DNA, 22 bp, Artificial Sequence
  Synthetic
atcatggtggcuctgcttctut

SEQ ID NO: 69022 - DNA, 29 bp, Artificial Sequence
  Synthetic
aatcccttaaaagaaucgctacaauccat

SEQ ID NO: 69023 - DNA, 23 bp, Artificial Sequence
  Synthetic
gcttgactcaaaugcctctctug

SEQ ID NO: 69024 - DNA, 25 bp, Artificial Sequence
  Synthetic
catgtagtcuggaggacagauacag

SEQ ID NO: 69025 - DNA, 24 bp, Artificial Sequence
  Synthetic
tcaggccautccaaaatgugaagt

SEQ ID NO: 69026 - DNA, 21 bp, Artificial Sequence
  Synthetic
acaggucccactuaggcagat

SEQ ID NO: 69027 - DNA, 28 bp, Artificial Sequence
  Synthetic
gaagagcaaatguaaattggcctcuaaa

SEQ ID NO: 69028 - DNA, 27 bp, Artificial Sequence
  Synthetic
ggaacctacugagagattcaacaugag

SEQ ID NO: 69029 - DNA, 28 bp, Artificial Sequence
  Synthetic
acattgatgaaugcagcataatgaaugg

SEQ ID NO: 69030 - DNA, 24 bp, Artificial Sequence
  Synthetic
aaaaagagaacugaccctgtuggt

SEQ ID NO: 69031 - DNA, 23 bp, Artificial Sequence
  Synthetic
caacactgauggctccuacagat

SEQ ID NO: 69032 - DNA, 26 bp, Artificial Sequence
  Synthetic
cagaggtuccattacctccuaagaga

SEQ ID NO: 69033 - DNA, 23 bp, Artificial Sequence
  Synthetic
ttggcttcauccacaactcucat

SEQ ID NO: 69034 - DNA, 22 bp, Artificial Sequence
  Synthetic
ccacttcauggccagccttaua

SEQ ID NO: 69035 - DNA, 22 bp, Artificial Sequence
  Synthetic
agaggucagggacagatgagug

SEQ ID NO: 69036 - DNA, 21 bp, Artificial Sequence
  Synthetic
ctctugggagggaccaatgug

SEQ ID NO: 69037 - DNA, 18 bp, Artificial Sequence
  Synthetic
catguccgacgtcuggct

SEQ ID NO: 69038 - DNA, 21 bp, Artificial Sequence
  Synthetic
agaaggcuggagcaatcctut

SEQ ID NO: 69039 - DNA, 26 bp, Artificial Sequence
  Synthetic
ggaccugcaagaattuaagcagaaga

SEQ ID NO: 69040 - DNA, 22 bp, Artificial Sequence
  Synthetic
gagtaccucccctaaccacuga

SEQ ID NO: 69041 - DNA, 21 bp, Artificial Sequence
  Synthetic
agagacuggcaggagcagtua

SEQ ID NO: 69042 - DNA, 19 bp, Artificial Sequence
  Synthetic
cagaccuccacgucgaaca

SEQ ID NO: 69043 - DNA, 20 bp, Artificial Sequence
  Synthetic
acaaccuggaccagcactuc

SEQ ID NO: 69044 - DNA, 21 bp, Artificial Sequence
  Synthetic
cctggacaagutcctggctuc

SEQ ID NO: 69045 - DNA, 22 bp, Artificial Sequence
  Synthetic
acacctccautgttggcacaut

SEQ ID NO: 69046 - DNA, 22 bp, Artificial Sequence
  Synthetic
gatgtccccautcctgttucgt

SEQ ID NO: 69047 - DNA, 23 bp, Artificial Sequence
  Synthetic
ctagcaaagacacagguagcuca

SEQ ID NO: 69048 - DNA, 21 bp, Artificial Sequence
  Synthetic
tctgctgaucctgtggcttut

SEQ ID NO: 69049 - DNA, 22 bp, Artificial Sequence
  Synthetic
tgaucgucaaggccagagaaac

SEQ ID NO: 69050 - DNA, 19 bp, Artificial Sequence
  Synthetic
agcaaaccagccucucgac

SEQ ID NO: 69051 - DNA, 18 bp, Artificial Sequence
  Synthetic
gugccaggcaaggcuaca

SEQ ID NO: 69052 - DNA, 21 bp, Artificial Sequence
  Synthetic
tctctgcucgacctgtgtgua

SEQ ID NO: 69053 - DNA, 21 bp, Artificial Sequence
  Synthetic
cagcacctaugaggcagagug

SEQ ID NO: 69054 - DNA, 17 bp, Artificial Sequence
  Synthetic
gctguggaagccgccua

SEQ ID NO: 69055 - DNA, 20 bp, Artificial Sequence
  Synthetic
ctcctgugccgtgtaugaca

SEQ ID NO: 69056 - DNA, 18 bp, Artificial Sequence
  Synthetic
gcccctccuctggcaauc

SEQ ID NO: 69057 - DNA, 20 bp, Artificial Sequence
  Synthetic
cccaccctaugcctcctgua

SEQ ID NO: 69058 - DNA, 20 bp, Artificial Sequence
  Synthetic
cacagggucacucacaggaa

SEQ ID NO: 69059 - DNA, 21 bp, Artificial Sequence
  Synthetic
aguactucagcgaggaggaca

SEQ ID NO: 69060 - DNA, 18 bp, Artificial Sequence
  Synthetic
gtcagcacccuggaguga

SEQ ID NO: 69061 - DNA, 17 bp, Artificial Sequence
  Synthetic
tcugccccaggccacua

SEQ ID NO: 69062 - DNA, 18 bp, Artificial Sequence
  Synthetic
tgcugaggagccgguaca

SEQ ID NO: 69063 - DNA, 21 bp, Artificial Sequence
  Synthetic
tcttccugggaagttcgggua

SEQ ID NO: 69064 - DNA, 26 bp, Artificial Sequence
  Synthetic
ttgttgcutatatcccuggaagagac

SEQ ID NO: 69065 - DNA, 20 bp, Artificial Sequence
  Synthetic
ggccacucactccucagaga

SEQ ID NO: 69066 - DNA, 21 bp, Artificial Sequence
  Synthetic
accctctugtccctcaaucca

SEQ ID NO: 69067 - DNA, 19 bp, Artificial Sequence
  Synthetic
gcaacauggaggccaugag

SEQ ID NO: 69068 - DNA, 19 bp, Artificial Sequence
  Synthetic
gagccacgcgucatacuct

SEQ ID NO: 69069 - DNA, 26 bp, Artificial Sequence
  Synthetic
ccgcutatgataaacuggaaaagacc

SEQ ID NO: 69070 - DNA, 18 bp, Artificial Sequence
  Synthetic
tgcgccuccagcttctuc

SEQ ID NO: 69071 - DNA, 21 bp, Artificial Sequence
  Synthetic
gttatcccucccctctgctuc

SEQ ID NO: 69072 - DNA, 18 bp, Artificial Sequence
  Synthetic
augcagcgcacgaagtug

SEQ ID NO: 69073 - DNA, 17 bp, Artificial Sequence
  Synthetic
gugggccagaggcugat

SEQ ID NO: 69074 - DNA, 26 bp, Artificial Sequence
  Synthetic
ggagaatagagtucactagcagctut

SEQ ID NO: 69075 - DNA, 28 bp, Artificial Sequence
  Synthetic
gctgtatgacaggaauctacttttucgt

SEQ ID NO: 69076 - DNA, 22 bp, Artificial Sequence
  Synthetic
cgatggccucaccttatcccua

SEQ ID NO: 69077 - DNA, 19 bp, Artificial Sequence
  Synthetic
cccccaguggctacgaaug

SEQ ID NO: 69078 - DNA, 24 bp, Artificial Sequence
  Synthetic
cccaagaauaagaggcaacauggt

SEQ ID NO: 69079 - DNA, 23 bp, Artificial Sequence
  Synthetic
ttgtguaggccatgcuaacgaat

SEQ ID NO: 69080 - DNA, 23 bp, Artificial Sequence
  Synthetic
acatggagaguaagagucagcct

SEQ ID NO: 69081 - DNA, 23 bp, Artificial Sequence
  Synthetic
ccaaactctggugggcttattut

SEQ ID NO: 69082 - DNA, 30 bp, Artificial Sequence; identical to SEQ ID NO: 30822
  Synthetic

SEQ ID NO: 69083 - DNA, 26 bp, Artificial Sequence
  Synthetic
ggtccaccugacgtaaattcttctut

SEQ ID NO: 69084 - DNA, 18 bp, Artificial Sequence
  Synthetic
ccctgcccugtcttgucc

SEQ ID NO: 69085 - DNA, 20 bp, Artificial Sequence
  Synthetic
gccatgugggcagagatgua

SEQ ID NO: 69086 - DNA, 21 bp, Artificial Sequence
  Synthetic
tccuagggagacugcagaacc

SEQ ID NO: 69087 - DNA, 21 bp, Artificial Sequence
  Synthetic
tcugacccgacugggaagaaa

SEQ ID NO: 69088 - DNA, 22 bp, Artificial Sequence
  Synthetic
caaggctuggttgagatcaugg

SEQ ID NO: 69089 - DNA, 27 bp, Artificial Sequence
  Synthetic
ccactttaccccautctgaaatccuaa

SEQ ID NO: 69090 - DNA, 22 bp, Artificial Sequence
  Synthetic
gcagtagcugagctgcagaauc

SEQ ID NO: 69091 - DNA, 26 bp, Artificial Sequence
  Synthetic
agctccttuaaggttttctccauacc

SEQ ID NO: 69092 - DNA, 23 bp, Artificial Sequence
  Synthetic
ggagtgguggttaattgctucca

SEQ ID NO: 69093 - DNA, 28 bp, Artificial Sequence
  Synthetic
gggaaaaggaaaugatgccttcttatua

SEQ ID NO: 69094 - DNA, 21 bp, Artificial Sequence
  Synthetic
ctggtcccuctggctgaatut

SEQ ID NO: 69095 - DNA, 24 bp, Artificial Sequence
  Synthetic
ctcatcattugtgactgcttuggg

SEQ ID NO: 69096 - DNA, 22 bp, Artificial Sequence
  Synthetic
cacctgacugtctcttgctuga

SEQ ID NO: 69097 - DNA, 20 bp, Artificial Sequence
  Synthetic
ccutcccagacuagccagag

SEQ ID NO: 69098 - DNA, 20 bp, Artificial Sequence
  Synthetic
gactccutgcagcuggacaa

SEQ ID NO: 69099 - DNA, 20 bp, Artificial Sequence
  Synthetic
ggutgtguccgggaaacagt

SEQ ID NO: 69100 - DNA, 17 bp, Artificial Sequence
  Synthetic
cacaggccgguggaaug

SEQ ID NO: 69101 - DNA, 20 bp, Artificial Sequence
  Synthetic
ctcctaccucccctcaccua

SEQ ID NO: 69102 - DNA, 28 bp, Artificial Sequence
  Synthetic
agtctttcacttutcagatgtgtgtuga

SEQ ID NO: 69103 - DNA, 29 bp, Artificial Sequence
  Synthetic
acaaagcctgccuacttaagatcaattua

SEQ ID NO: 69104 - DNA, 27 bp, Artificial Sequence
  Synthetic
aaaacctagagaacuggcatguaagag

SEQ ID NO: 69105 - DNA, 25 bp, Artificial Sequence
  Synthetic
tcaaaccgaucagccaatactgtut

SEQ ID NO: 69106 - DNA, 27 bp, Artificial Sequence
  Synthetic
gaggcctcagguaaaatagaatttuca

SEQ ID NO: 69107 - DNA, 24 bp, Artificial Sequence
  Synthetic
gtatctgccaucacctcagcttut

SEQ ID NO: 69108 - DNA, 22 bp, Artificial Sequence
  Synthetic
ggaaatccaugagccuggacat

SEQ ID NO: 69109 - DNA, 27 bp, Artificial Sequence
  Synthetic
caaaaactttgcuacactgacauggaa

SEQ ID NO: 69110 - DNA, 20 bp, Artificial Sequence
  Synthetic
gggcaguagcttcctgugac

SEQ ID NO: 69111 - DNA, 21 bp, Artificial Sequence
  Synthetic
gggaagugagtcctccuccat

SEQ ID NO: 69112 - DNA, 22 bp, Artificial Sequence
  Synthetic
ggcctcacuctgttccaaaguc

SEQ ID NO: 69113 - DNA, 21 bp, Artificial Sequence
  Synthetic
agtcaugcagcaaccaaguca

SEQ ID NO: 69114 - DNA, 24 bp, Artificial Sequence
  Synthetic
ctcttcttuccccaggtgaactut

SEQ ID NO: 69115 - DNA, 20 bp, Artificial Sequence
  Synthetic
cttggctugcagtgatcugg

SEQ ID NO: 69116 - DNA, 27 bp, Artificial Sequence
  Synthetic
ccttggtattctugggatgtgacttuc

SEQ ID NO: 69117 - DNA, 21 bp, Artificial Sequence
  Synthetic
catggcaggcaautccagtuc

SEQ ID NO: 69118 - DNA, 22 bp, Artificial Sequence
  Synthetic
aaaagaggcugacctuccagag

SEQ ID NO: 69119 - DNA, 22 bp, Artificial Sequence
  Synthetic
cgatttaguggcgtccuaggaa

SEQ ID NO: 69120 - DNA, 20 bp, Artificial Sequence
  Synthetic
cccucctaucccacagcaca

SEQ ID NO: 69121 - DNA, 24 bp, Artificial Sequence
  Synthetic
ctgacagtttguccctttctcuct

SEQ ID NO: 69122 - DNA, 21 bp, Artificial Sequence
  Synthetic
ctggctctucatggatccuca

SEQ ID NO: 69123 - DNA, 24 bp, Artificial Sequence
  Synthetic
ctgtaagtaucactcccccugaac

SEQ ID NO: 69124 - DNA, 22 bp, Artificial Sequence
  Synthetic
tctgatccucctgtgtgtguga

SEQ ID NO: 69125 - DNA, 19 bp, Artificial Sequence
  Synthetic
tctccatutcggctugcgt

SEQ ID NO: 69126 - DNA, 22 bp, Artificial Sequence
  Synthetic
gacaatgucccatctgggugaa

SEQ ID NO: 69127 - DNA, 23 bp, Artificial Sequence
  Synthetic
cutatatggcaagucggaccagt

SEQ ID NO: 69128 - DNA, 21 bp, Artificial Sequence
  Synthetic
cugccccaaccagatugagaa

SEQ ID NO: 69129 - DNA, 20 bp, Artificial Sequence
  Synthetic
tcagggtugggcatgatguc

SEQ ID NO: 69130 - DNA, 23 bp, Artificial Sequence
  Synthetic
ctttgatcuggaggagagucacc

SEQ ID NO: 69131 - DNA, 22 bp, Artificial Sequence
  Synthetic
agcccagaacagacaugugaac

SEQ ID NO: 69132 - DNA, 27 bp, Artificial Sequence
  Synthetic
acatgccaagtcuatctctcactgtua

SEQ ID NO: 69133 - DNA, 28 bp, Artificial Sequence
  Synthetic
tcccatcaggaauatctgtttcuaggaa

SEQ ID NO: 69134 - DNA, 26 bp, Artificial Sequence
  Synthetic
actgttggctuaaacactgaagaugt

SEQ ID NO: 69135 - DNA, 27 bp, Artificial Sequence
  Synthetic
tcaatcaaagtuttcagaagccuggat

SEQ ID NO: 69136 - DNA, 26 bp, Artificial Sequence
  Synthetic
acagagagtucaacctgaaacatucc

SEQ ID NO: 69137 - DNA, 26 bp, Artificial Sequence
  Synthetic
tcttctcgaucaagaatgctgguaac

SEQ ID NO: 69138 - DNA, 26 bp, Artificial Sequence
  Synthetic
ggttagtacctuctccactccaaaut

SEQ ID NO: 69139 - DNA, 26 bp, Artificial Sequence
  Synthetic
cagttgtcgtugatgtcttcaacaut

SEQ ID NO: 69140 - DNA, 26 bp, Artificial Sequence
  Synthetic
ccaaaacaaccguactttaactgugt

SEQ ID NO: 69141 - DNA, 23 bp, Artificial Sequence
  Synthetic
tggtttagcugctggacttgaut

SEQ ID NO: 69142 - DNA, 19 bp, Artificial Sequence
  Synthetic
gggcuaccccctuaaccct

SEQ ID NO: 69143 - DNA, 21 bp, Artificial Sequence
  Synthetic
ggcagcgaucttcttguagca

SEQ ID NO: 69144 - DNA, 21 bp, Artificial Sequence
  Synthetic
gagcattcugggaagccauca

SEQ ID NO: 69145 - DNA, 20 bp, Artificial Sequence
  Synthetic
cgcaatggcucaccagguag

SEQ ID NO: 69146 - DNA, 24 bp, Artificial Sequence
  Synthetic
gcctccaatauctgtccctttuct

SEQ ID NO: 69147 - DNA, 21 bp, Artificial Sequence
  Synthetic
ggacucaaagacacccugcac

SEQ ID NO: 69148 - DNA, 17 bp, Artificial Sequence
  Synthetic
gtgaccugtcgccucca

SEQ ID NO: 69149 - DNA, 19 bp, Artificial Sequence
  Synthetic
cucagccuccccacaagac

SEQ ID NO: 69150 - DNA, 20 bp, Artificial Sequence
  Synthetic
aggaaggcutcgagccatut

SEQ ID NO: 69151 - DNA, 22 bp, Artificial Sequence
  Synthetic
cactguggaaggaaggagctut

SEQ ID NO: 69152 - DNA, 21 bp, Artificial Sequence
  Synthetic
gtacaccatcucaccgtccuc

SEQ ID NO: 69153 - DNA, 28 bp, Artificial Sequence
  Synthetic
agggaatgttatugtatcctgaggguat

SEQ ID NO: 69154 - DNA, 23 bp, Artificial Sequence
  Synthetic
caccccagaaaaaccuctucagt

SEQ ID NO: 69155 - DNA, 23 bp, Artificial Sequence
  Synthetic
tcutttgctugcagaggaaggag

SEQ ID NO: 69156 - DNA, 24 bp, Artificial Sequence
  Synthetic
gcacactctuaaatccccttcuct

SEQ ID NO: 69157 - DNA, 23 bp, Artificial Sequence
  Synthetic
tgccttcttcugaagtcccttug

SEQ ID NO: 69158 - DNA, 19 bp, Artificial Sequence
  Synthetic
gccaggccgutgatgauga

SEQ ID NO: 69159 - DNA, 19 bp, Artificial Sequence
  Synthetic
acgacugaggacgagucca

SEQ ID NO: 69160 - DNA, 23 bp, Artificial Sequence
  Synthetic
gaggagacacagcuggatcttuc

SEQ ID NO: 69161 - DNA, 23 bp, Artificial Sequence
  Synthetic
gagaagacagucagaauccagca

SEQ ID NO: 69162 - DNA, 22 bp, Artificial Sequence
  Synthetic
gccttcucctcaccuaacccat

SEQ ID NO: 69163 - DNA, 21 bp, Artificial Sequence
  Synthetic
ggacctcugtgtccctucagt

SEQ ID NO: 69164 - DNA, 22 bp, Artificial Sequence
  Synthetic
acccuccctgagtauccagaaa

SEQ ID NO: 69165 - DNA, 21 bp, Artificial Sequence
  Synthetic
ggtggcaccugctatgaugag

SEQ ID NO: 69166 - DNA, 20 bp, Artificial Sequence
  Synthetic
tcacgutctgcauggacagg

SEQ ID NO: 69167 - DNA, 24 bp, Artificial Sequence
  Synthetic
agtcctugaacgtagttucgcaaa

SEQ ID NO: 69168 - DNA, 21 bp, Artificial Sequence
  Synthetic
gtctutccattggucccacca

SEQ ID NO: 69169 - DNA, 21 bp, Artificial Sequence
  Synthetic
cgaggccaaacacaugtccut

SEQ ID NO: 69170 - DNA, 23 bp, Artificial Sequence
  Synthetic
gcttugaaagcccctccatucat

SEQ ID NO: 69171 - DNA, 19 bp, Artificial Sequence
  Synthetic
ccaucacaccccacgagua

SEQ ID NO: 69172 - DNA, 23 bp, Artificial Sequence
  Synthetic
gccaggauttcctugggaaagat

SEQ ID NO: 69173 - DNA, 26 bp, Artificial Sequence
  Synthetic
ttgccagtgagcutcaaatctctaut

SEQ ID NO: 69174 - DNA, 21 bp, Artificial Sequence
  Synthetic
ggtcttctucctggctaugct

SEQ ID NO: 69175 - DNA, 22 bp, Artificial Sequence
  Synthetic
gaagaaaaugcccagcaggaug

SEQ ID NO: 69176 - DNA, 18 bp, Artificial Sequence
  Synthetic
cuggcugccaaccagaca

SEQ ID NO: 69177 - DNA, 17 bp, Artificial Sequence
  Synthetic
acgttgcucccgcucac

SEQ ID NO: 69178 - DNA, 20 bp, Artificial Sequence
  Synthetic
atgaagcacucgtugaggct

SEQ ID NO: 69179 - DNA, 18 bp, Artificial Sequence
  Synthetic
tcgtacguggcgctcauc

SEQ ID NO: 69180 - DNA, 18 bp, Artificial Sequence
  Synthetic
gctcugcacgcgtgtgua

SEQ ID NO: 69181 - DNA, 19 bp, Artificial Sequence
  Synthetic
ccccaaguacctgcaguct

SEQ ID NO: 69182 - DNA, 24 bp, Artificial Sequence
  Synthetic
ctggaagauggttatgaggtugga

SEQ ID NO: 69183 - DNA, 28 bp, Artificial Sequence
  Synthetic
gcctctgattacugactctgtcctauat

SEQ ID NO: 69184 - DNA, 24 bp, Artificial Sequence
  Synthetic
ggcagtcaggauctaactcacuca

SEQ ID NO: 69185 - DNA, 21 bp, Artificial Sequence
  Synthetic
ccagggcugactctcatgtut

SEQ ID NO: 69186 - DNA, 21 bp, Artificial Sequence
  Synthetic
gcctctgtucacctctcgaug

SEQ ID NO: 69187 - DNA, 21 bp, Artificial Sequence
  Synthetic
ctgtgucaggcatcctucact

SEQ ID NO: 69188 - DNA, 19 bp, Artificial Sequence
  Synthetic
cucctucagcggcaagaga

SEQ ID NO: 69189 - DNA, 17 bp, Artificial Sequence
  Synthetic
cgcggccucttcgauga

SEQ ID NO: 69190 - DNA, 18 bp, Artificial Sequence
  Synthetic
ttccagcucctgccgtut

SEQ ID NO: 69191 - DNA, 17 bp, Artificial Sequence
  Synthetic
gcgggagcuggcugaac

SEQ ID NO: 69192 - DNA, 18 bp, Artificial Sequence
  Synthetic
cagcgcucaagcaacugg

SEQ ID NO: 69193 - DNA, 19 bp, Artificial Sequence
  Synthetic
ccucctguccccaacagaa

SEQ ID NO: 69194 - DNA, 21 bp, Artificial Sequence
  Synthetic
ccttcagccguaggttguact

SEQ ID NO: 69195 - DNA, 19 bp, Artificial Sequence
  Synthetic
agcagatguaccgcaggug

SEQ ID NO: 69196 - DNA, 20 bp, Artificial Sequence
  Synthetic
gctggtagcuccatctccut

SEQ ID NO: 69197 - DNA, 18 bp, Artificial Sequence
  Synthetic
gaguaccgggagctggug

SEQ ID NO: 69198 - DNA, 21 bp, Artificial Sequence
  Synthetic
gaggtaguccagggcaatcug

SEQ ID NO: 69199 - DNA, 20 bp, Artificial Sequence
  Synthetic
ggagggugaacctgggauga

SEQ ID NO: 69200 - DNA, 17 bp, Artificial Sequence
  Synthetic
gauctcuggcggcaggt

SEQ ID NO: 69201 - DNA, 17 bp, Artificial Sequence
  Synthetic
gctugcacccccatgug

SEQ ID NO: 69202 - DNA, 22 bp, Artificial Sequence
  Synthetic
catagccgacgucatgcaagua

SEQ ID NO: 69203 - DNA, 23 bp, Artificial Sequence
  Synthetic
acttcttgactutgggagtgguc

SEQ ID NO: 69204 - DNA, 27 bp, Artificial Sequence
  Synthetic
aagtgctcttguccaaaatactcucaa

SEQ ID NO: 69205 - DNA, 24 bp, Artificial Sequence
  Synthetic
acgtgttcugatctgacttugcat

SEQ ID NO: 69206 - DNA, 23 bp, Artificial Sequence
  Synthetic
gaaagugggaggagagagtcuga

SEQ ID NO: 69207 - DNA, 17 bp, Artificial Sequence
  Synthetic
gcagcggcugtaucggt

SEQ ID NO: 69208 - DNA, 22 bp, Artificial Sequence
  Synthetic
ccttcctccugccatcccuaat

SEQ ID NO: 69209 - DNA, 26 bp, Artificial Sequence
  Synthetic
acgaggagatcuacaaggagttctut

SEQ ID NO: 69210 - DNA, 18 bp, Artificial Sequence
  Synthetic
cugcagaagcuccagcga

SEQ ID NO: 69211 - DNA, 23 bp, Artificial Sequence
  Synthetic
ggtgggccaucatgagacauaat

SEQ ID NO: 69212 - DNA, 27 bp, Artificial Sequence
  Synthetic
tccagtaatuttcaagccaugagagaa

SEQ ID NO: 69213 - DNA, 29 bp, Artificial Sequence
  Synthetic
tcctgtctatacucttccctatgttucaa

SEQ ID NO: 69214 - DNA, 22 bp, Artificial Sequence
  Synthetic
agattcccctuaccagctccut

SEQ ID NO: 69215 - DNA, 21 bp, Artificial Sequence
  Synthetic
agctccacacautccccatug

SEQ ID NO: 69216 - DNA, 20 bp, Artificial Sequence
  Synthetic
cagcgauggagagtggcaut

SEQ ID NO: 69217 - DNA, 29 bp, Artificial Sequence
  Synthetic
aggagttcugaaaagcacatattgatuga

SEQ ID NO: 69218 - DNA, 24 bp, Artificial Sequence
  Synthetic
ggcctggatcucattcatcttcug

SEQ ID NO: 69219 - DNA, 24 bp, Artificial Sequence
  Synthetic
cctacagtcaaaugcgtgttguct

SEQ ID NO: 69220 - DNA, 19 bp, Artificial Sequence
  Synthetic
cacucgacccagacccuac

SEQ ID NO: 69221 - DNA, 26 bp, Artificial Sequence
  Synthetic
gcccttcttugttgattactccugat

SEQ ID NO: 69222 - DNA, 23 bp, Artificial Sequence
  Synthetic
tgctttcugcaaactgcaatcuc

SEQ ID NO: 69223 - DNA, 27 bp, Artificial Sequence
  Synthetic
gccccaggtuatttttgttttccaaut

SEQ ID NO: 69224 - DNA, 27 bp, Artificial Sequence
  Synthetic
acttttcatttcuggcttatcacugct

SEQ ID NO: 69225 - DNA, 27 bp, Artificial Sequence
  Synthetic
ccttttcttttcaauggctgtagcuat

SEQ ID NO: 69226 - DNA, 31 bp, Artificial Sequence
  Synthetic
acaaatcttcuctaaaagcaatcuaccacat

SEQ ID NO: 69227 - DNA, 27 bp, Artificial Sequence
  Synthetic
agctccaacaacuacaatgagaaauct

SEQ ID NO: 69228 - DNA, 25 bp, Artificial Sequence
  Synthetic
cttacccaagccguttgtttgaaut

SEQ ID NO: 69229 - DNA, 27 bp, Artificial Sequence
  Synthetic
cgautttctguaaaacaggagcaaaga

SEQ ID NO: 69230 - DNA, 28 bp, Artificial Sequence
  Synthetic
ttggcaaauttcattacguaaaaaccga

SEQ ID NO: 69231 - DNA, 25 bp, Artificial Sequence
  Synthetic
gcttgttgutgactcattugaacct

SEQ ID NO: 69232 - DNA, 20 bp, Artificial Sequence
  Synthetic
cctggaaguccgtgcaguat

SEQ ID NO: 69233 - DNA, 23 bp, Artificial Sequence
  Synthetic
cctttctctcagutcccgcttuc

SEQ ID NO: 69234 - DNA, 24 bp, Artificial Sequence
  Synthetic
aaacacaaccaccauauagcccaa

SEQ ID NO: 69235 - DNA, 25 bp, Artificial Sequence
  Synthetic
ggttgtaattucccatggtctuggt

SEQ ID NO: 69236 - DNA, 27 bp, Artificial Sequence
  Synthetic
tgctacaactuatgtacacgttucaga

SEQ ID NO: 69237 - DNA, 21 bp, Artificial Sequence
  Synthetic
tgtccatccucaggcguagaa

SEQ ID NO: 69238 - DNA, 22 bp, Artificial Sequence
  Synthetic
ccagacaguggattggagaugt

SEQ ID NO: 69239 - DNA, 27 bp, Artificial Sequence
  Synthetic
ctcgtatgcaaugattactccagtgua

SEQ ID NO: 69240 - DNA, 28 bp, Artificial Sequence
  Synthetic
tttttaacgtatcutagtgtgagcucgt

SEQ ID NO: 69241 - DNA, 22 bp, Artificial Sequence
  Synthetic
gcatggcccuttggagacuaaa

SEQ ID NO: 69242 - DNA, 22 bp, Artificial Sequence
  Synthetic
gggactccutgctaaccauagg

SEQ ID NO: 69243 - DNA, 28 bp, Artificial Sequence
  Synthetic
ctaaagaaaagauagtgggtgtaccuca

SEQ ID NO: 69244 - DNA, 20 bp, Artificial Sequence
  Synthetic
gagaagacgcgacuguggaa

SEQ ID NO: 69245 - DNA, 19 bp, Artificial Sequence
  Synthetic
gatgtgggucctccugcac

SEQ ID NO: 69246 - DNA, 22 bp, Artificial Sequence
  Synthetic
guggtguagcacaacagacact

SEQ ID NO: 69247 - DNA, 24 bp, Artificial Sequence
  Synthetic
attgtuttcctgtgauccagagca

SEQ ID NO: 69248 - DNA, 22 bp, Artificial Sequence
  Synthetic
gcgaagcaccagaaaucaugga

SEQ ID NO: 69249 - DNA, 19 bp, Artificial Sequence
  Synthetic
cuccttugggagcacacga

SEQ ID NO: 69250 - DNA, 21 bp, Artificial Sequence
  Synthetic
cuggtctcttcugacggaact

SEQ ID NO: 69251 - DNA, 23 bp, Artificial Sequence
  Synthetic
ggaaagaagacaacuggctccug

SEQ ID NO: 69252 - DNA, 22 bp, Artificial Sequence
  Synthetic
tgggcagaaaaugcaagucaac

SEQ ID NO: 69253 - DNA, 21 bp, Artificial Sequence
  Synthetic
gagggaggacutgaacaucca

SEQ ID NO: 69254 - DNA, 20 bp, Artificial Sequence
  Synthetic
gagcucaccaacctguaccc

SEQ ID NO: 69255 - DNA, 23 bp, Artificial Sequence
  Synthetic
ggaatacaggaagagugctguca

SEQ ID NO: 69256 - DNA, 20 bp, Artificial Sequence
  Synthetic
ccucacacgggacuacaact

SEQ ID NO: 69257 - DNA, 23 bp, Artificial Sequence
  Synthetic
gaagagaggaagggutaguggga

SEQ ID NO: 69258 - DNA, 20 bp, Artificial Sequence
  Synthetic
cactgtgacucccacugaga

SEQ ID NO: 69259 - DNA, 17 bp, Artificial Sequence
  Synthetic
gccucaccgccgtucag

SEQ ID NO: 69260 - DNA, 26 bp, Artificial Sequence
  Synthetic
agatctcucaggattaacacugcaga

SEQ ID NO: 69261 - DNA, 17 bp, Artificial Sequence
  Synthetic
gccugccgcucacacaa

SEQ ID NO: 69262 - DNA, 23 bp, Artificial Sequence
  Synthetic
aaaaactgtgutgtggagugcaa

SEQ ID NO: 69263 - DNA, 25 bp, Artificial Sequence
  Synthetic
gtccacgtauccatcaacaguaaca

SEQ ID NO: 69264 - DNA, 21 bp, Artificial Sequence
  Synthetic
ggccaguaggcagtgaaguaa

SEQ ID NO: 69265 - DNA, 28 bp, Artificial Sequence
  Synthetic
acagtgacaucatcagtuaaaacaaggt

SEQ ID NO: 69266 - DNA, 23 bp, Artificial Sequence
  Synthetic
gctccctcugtctccatctttuc

SEQ ID NO: 69267 - DNA, 21 bp, Artificial Sequence
  Synthetic
ccctgacauccgacttgtuct

SEQ ID NO: 69268 - DNA, 20 bp, Artificial Sequence
  Synthetic
cccacctgutctccacgtuc

SEQ ID NO: 69269 - DNA, 21 bp, Artificial Sequence
  Synthetic
gagccuggaaagcctggtaut

SEQ ID NO: 69270 - DNA, 21 bp, Artificial Sequence
  Synthetic
cuaaaacctgtgugccaggga

SEQ ID NO: 69271 - DNA, 26 bp, Artificial Sequence
  Synthetic
atgaccatgaugaactgacttugagt

SEQ ID NO: 69272 - DNA, 20 bp, Artificial Sequence
  Synthetic
gguccccgaaaccctucaat

SEQ ID NO: 69273 - DNA, 25 bp, Artificial Sequence
  Synthetic
ctgttccucagcaagcttatctcug

SEQ ID NO: 69274 - DNA, 21 bp, Artificial Sequence
  Synthetic
agaacagcaggucagggaaug

SEQ ID NO: 69275 - DNA, 23 bp, Artificial Sequence
  Synthetic
ctggtatcttugggagtgaggug

SEQ ID NO: 69276 - DNA, 20 bp, Artificial Sequence
  Synthetic
caccaagcucccagtggaua

SEQ ID NO: 69277 - DNA, 22 bp, Artificial Sequence
  Synthetic
cctcaggcuctgtgtttcctuc

SEQ ID NO: 69278 - DNA, 22 bp, Artificial Sequence
  Synthetic
gccttgcagacucaggactcua

SEQ ID NO: 69279 - DNA, 20 bp, Artificial Sequence
  Synthetic
catgaauccctggugggact

SEQ ID NO: 69280 - DNA, 22 bp, Artificial Sequence
  Synthetic
acttcccguctgtgaucaggat

SEQ ID NO: 69281 - DNA, 21 bp, Artificial Sequence
  Synthetic
ccgugagcttagcuacaaggg

SEQ ID NO: 69282 - DNA, 21 bp, Artificial Sequence
  Synthetic
ggcgctuacttgtaggugagg

SEQ ID NO: 69283 - DNA, 17 bp, Artificial Sequence
  Synthetic
ccgcgcgggugtttaug

SEQ ID NO: 69284 - DNA, 19 bp, Artificial Sequence
  Synthetic
gagagcaugucggcgaact

SEQ ID NO: 69285 - DNA, 22 bp, Artificial Sequence
  Synthetic
tcaaguccatgatcaucgaccg

SEQ ID NO: 69286 - DNA, 17 bp, Artificial Sequence
  Synthetic
gacagcugggcguccaa

SEQ ID NO: 69287 - DNA, 25 bp, Artificial Sequence
  Synthetic
cgagtttcaugagaagctgctauca

SEQ ID NO: 69288 - DNA, 21 bp, Artificial Sequence
  Synthetic
ggtcaaagaagcccutggugt

SEQ ID NO: 69289 - DNA, 22 bp, Artificial Sequence
  Synthetic
ccagcagauctctctctuccaa

SEQ ID NO: 69290 - DNA, 17 bp, Artificial Sequence
  Synthetic
gccctccucggccucat

SEQ ID NO: 69291 - DNA, 20 bp, Artificial Sequence
  Synthetic
ctgcagcaaagcutcctcuc

SEQ ID NO: 69292 - DNA, 19 bp, Artificial Sequence
  Synthetic
gctcggcaucatggucact

SEQ ID NO: 69293 - DNA, 18 bp, Artificial Sequence
  Synthetic
gctggagaugagcgcuga

SEQ ID NO: 69294 - DNA, 17 bp, Artificial Sequence
  Synthetic
gcaacggucccggacut

SEQ ID NO: 69295 - DNA, 18 bp, Artificial Sequence
  Synthetic
ccacggcucugaccacac

SEQ ID NO: 69296 - DNA, 19 bp, Artificial Sequence
  Synthetic
agacaggagggcuccugat

SEQ ID NO: 69297 - DNA, 17 bp, Artificial Sequence
  Synthetic
gtcccgcagucctucca

SEQ ID NO: 69298 - DNA, 20 bp, Artificial Sequence
  Synthetic
atctgcagcutggucacgat

SEQ ID NO: 69299 - DNA, 19 bp, Artificial Sequence
  Synthetic
caagctcccacucgcctua

SEQ ID NO: 69300 - DNA, 24 bp, Artificial Sequence
  Synthetic
gacgtaggtgaugatggacttcuc

SEQ ID NO: 69301 - DNA, 19 bp, Artificial Sequence
  Synthetic
gguguaccggcagaccaac

SEQ ID NO: 69302 - DNA, 24 bp, Artificial Sequence
  Synthetic
cataatgcutgtggttuccccaat

SEQ ID NO: 69303 - DNA, 23 bp, Artificial Sequence
  Synthetic
tctatagcccuctccaagcucac

SEQ ID NO: 69304 - DNA, 24 bp, Artificial Sequence
  Synthetic
gaaagagutctcucacagcaccat

SEQ ID NO: 69305 - DNA, 25 bp, Artificial Sequence
  Synthetic
gcatgttggugacctctgaatttut

SEQ ID NO: 69306 - DNA, 24 bp, Artificial Sequence
  Synthetic
ggaaaaacucuaggagaaggcgaa

SEQ ID NO: 69307 - DNA, 20 bp, Artificial Sequence
  Synthetic
ccgctcuagaacagcatugg

SEQ ID NO: 69308 - DNA, 27 bp, Artificial Sequence
  Synthetic
tgaaaattgucacgaaacaatgagcut

SEQ ID NO: 69309 - DNA, 25 bp, Artificial Sequence
  Synthetic
tttctggtcggaguctgatttcauc

SEQ ID NO: 69310 - DNA, 21 bp, Artificial Sequence
  Synthetic
gcuggacgaaagccugaacaa

SEQ ID NO: 69311 - DNA, 24 bp, Artificial Sequence
  Synthetic
cagaaacuactcaaacucccacct

SEQ ID NO: 69312 - DNA, 24 bp, Artificial Sequence
  Synthetic
gagggtttugaagaagtgggucat

SEQ ID NO: 69313 - DNA, 22 bp, Artificial Sequence
  Synthetic
gtcccuctatccucgagaaggg

SEQ ID NO: 69314 - DNA, 28 bp, Artificial Sequence
  Synthetic
cttgactagcauatactcaaagcacugt

SEQ ID NO: 69315 - DNA, 28 bp, Artificial Sequence
  Synthetic
agagttttccuaagcatgtgctctatut

SEQ ID NO: 69316 - DNA, 29 bp, Artificial Sequence
  Synthetic
gtataattttcgtcutccatcccttcugt

SEQ ID NO: 69317 - DNA, 24 bp, Artificial Sequence
  Synthetic
ggtgtctccauagctctcaucaag

SEQ ID NO: 69318 - DNA, 20 bp, Artificial Sequence
  Synthetic
cccaataguccatgccccua

SEQ ID NO: 69319 - DNA, 28 bp, Artificial Sequence
  Synthetic
tgacaatgacacugagactattcuacct

SEQ ID NO: 69320 - DNA, 22 bp, Artificial Sequence
  Synthetic
caatctcctcauactgggccut

SEQ ID NO: 69321 - DNA, 22 bp, Artificial Sequence
  Synthetic
ccagaugaccgactccaaauct

SEQ ID NO: 69322 - DNA, 26 bp, Artificial Sequence
  Synthetic
acaaaagacccaaagcutaucaggaa

SEQ ID NO: 69323 - DNA, 23 bp, Artificial Sequence
  Synthetic
agcuaacaaggaccaaaguggag

SEQ ID NO: 69324 - DNA, 28 bp, Artificial Sequence
  Synthetic
tggctttttcuagaagacgttgatacut

SEQ ID NO: 69325 - DNA, 25 bp, Artificial Sequence
  Synthetic
cauagctgagcuaggcagaaaagag

SEQ ID NO: 69326 - DNA, 23 bp, Artificial Sequence
  Synthetic
gaacttutcctgttgugccaagg

SEQ ID NO: 69327 - DNA, 22 bp, Artificial Sequence
  Synthetic
agtgaggcuactgctcttggua

SEQ ID NO: 69328 - DNA, 27 bp, Artificial Sequence
  Synthetic
agaaaagtactauctgcatgcttuggt

SEQ ID NO: 69329 - DNA, 26 bp, Artificial Sequence
  Synthetic
gaattgactuacctgatgggauagca

SEQ ID NO: 69330 - DNA, 27 bp, Artificial Sequence
  Synthetic
cttttaacctctucagagcctcaacua

SEQ ID NO: 69331 - DNA, 28 bp, Artificial Sequence
  Synthetic
ttgggatcacugatttgaaggaauaagt

SEQ ID NO: 69332 - DNA, 22 bp, Artificial Sequence
  Synthetic
ggccagtgcuagccacttttua

SEQ ID NO: 69333 - DNA, 28 bp, Artificial Sequence
  Synthetic
aggttctacaaaggcugtaattgttuct

SEQ ID NO: 69334 - DNA, 28 bp, Artificial Sequence
  Synthetic
ttttatgagcuttacacagttugcaaca

SEQ ID NO: 69335 - DNA, 22 bp, Artificial Sequence
  Synthetic
aacttgtguagctgctgaugct

SEQ ID NO: 69336 - DNA, 21 bp, Artificial Sequence
  Synthetic
catgtgaccugacagctgcua

SEQ ID NO: 69337 - DNA, 24 bp, Artificial Sequence
  Synthetic
ccatgtgagugataagtggcgtut

SEQ ID NO: 69338 - DNA, 24 bp, Artificial Sequence
  Synthetic
aatacagtgtgugctgctaaccut

SEQ ID NO: 69339 - DNA, 26 bp, Artificial Sequence
  Synthetic
tctcagaattgauagcagtgttugct

SEQ ID NO: 69340 - DNA, 18 bp, Artificial Sequence
  Synthetic
cgggcacgcacguaguag

SEQ ID NO: 69341 - DNA, 22 bp, Artificial Sequence
  Synthetic
ggagaggaggagguactgcuat

SEQ ID NO: 69342 - DNA, 19 bp, Artificial Sequence
  Synthetic
gtcttccugccctucgaca

SEQ ID NO: 69343 - DNA, 17 bp, Artificial Sequence
  Synthetic
cucccgggaccgtcuac

SEQ ID NO: 69344 - DNA, 19 bp, Artificial Sequence
  Synthetic
ccccacucttuggcaccat

SEQ ID NO: 69345 - DNA, 18 bp, Artificial Sequence
  Synthetic
ggcaaaaagccggucucc

SEQ ID NO: 69346 - DNA, 17 bp, Artificial Sequence
  Synthetic
accaugccgcggtacug

SEQ ID NO: 69347 - DNA, 21 bp, Artificial Sequence
  Synthetic
agaauccccacagtgcucaag

SEQ ID NO: 69348 - DNA, 20 bp, Artificial Sequence
  Synthetic
ccccacagagcacugaucaa

SEQ ID NO: 69349 - DNA, 17 bp, Artificial Sequence
  Synthetic
ggcgcugtgcctauccc

SEQ ID NO: 69350 - DNA, 24 bp, Artificial Sequence
  Synthetic
cattgactuaccttcacaccugga

SEQ ID NO: 69351 - DNA, 22 bp, Artificial Sequence
  Synthetic
accctcucaaatgctgttugct

SEQ ID NO: 69352 - DNA, 23 bp, Artificial Sequence
  Synthetic
ccagaacauctgctgucagaagt

SEQ ID NO: 69353 - DNA, 24 bp, Artificial Sequence
  Synthetic
gaggaggaaacucactagcatucc

SEQ ID NO: 69354 - DNA, 21 bp, Artificial Sequence
  Synthetic
gctcccctutggatccaguct

SEQ ID NO: 69355 - DNA, 21 bp, Artificial Sequence
  Synthetic
cccctttgugttctgccguat

SEQ ID NO: 69356 - DNA, 21 bp, Artificial Sequence
  Synthetic
caggactuagtcaggguccca

SEQ ID NO: 69357 - DNA, 27 bp, Artificial Sequence
  Synthetic
tgtcttccugacttcttatcctuccat

SEQ ID NO: 69358 - DNA, 21 bp, Artificial Sequence
  Synthetic
gggtcugaaagagcaauggag

SEQ ID NO: 69359 - DNA, 21 bp, Artificial Sequence
  Synthetic
catgccagcauttccctcuga

SEQ ID NO: 69360 - DNA, 20 bp, Artificial Sequence
  Synthetic
cctactcaccgugggtcauc

SEQ ID NO: 69361 - DNA, 21 bp, Artificial Sequence
  Synthetic
gaagaggcccugatctcucct

SEQ ID NO: 69362 - DNA, 18 bp, Artificial Sequence
  Synthetic
tcacctcucgggctcgua

SEQ ID NO: 69363 - DNA, 18 bp, Artificial Sequence
  Synthetic
ggccacucacuccaccac

SEQ ID NO: 69364 - DNA, 19 bp, Artificial Sequence
  Synthetic
cguagcccgaggaggagua

SEQ ID NO: 69365 - DNA, 21 bp, Artificial Sequence
  Synthetic
gtccaccaagggcuacuacag

SEQ ID NO: 69366 - DNA, 20 bp, Artificial Sequence
  Synthetic
aggtacugcaccuccaggaa

SEQ ID NO: 69367 - DNA, 21 bp, Artificial Sequence
  Synthetic
ggtggacaagaucatggugga

SEQ ID NO: 69368 - DNA, 18 bp, Artificial Sequence
  Synthetic
gctcugacagctggucgt

SEQ ID NO: 69369 - DNA, 19 bp, Artificial Sequence
  Synthetic
ggctaccgugaccccuaca

SEQ ID NO: 69370 - DNA, 18 bp, Artificial Sequence
  Synthetic
ggcuacgtcucgcacaga

SEQ ID NO: 69371 - DNA, 22 bp, Artificial Sequence
  Synthetic
cggatcacaguggagaagauca

SEQ ID NO: 69372 - DNA, 17 bp, Artificial Sequence
  Synthetic
ctcgcugtccgaugcct

SEQ ID NO: 69373 - DNA, 17 bp, Artificial Sequence
  Synthetic
cgggugctugcggagaa

SEQ ID NO: 69374 - DNA, 18 bp, Artificial Sequence
  Synthetic
ccctccugcaaggucaca

SEQ ID NO: 69375 - DNA, 18 bp, Artificial Sequence
  Synthetic
ggcaagcuggagcagguc

SEQ ID NO: 69376 - DNA, 22 bp, Artificial Sequence
  Synthetic
ctttttcaaggcugggaaggug

SEQ ID NO: 69377 - DNA, 25 bp, Artificial Sequence
  Synthetic
aattattagccacugctgugaccat

SEQ ID NO: 69378 - DNA, 28 bp, Artificial Sequence
  Synthetic
actcagcaagauaatgtaacagugaagg

SEQ ID NO: 69379 - DNA, 27 bp, Artificial Sequence
  Synthetic
tggacaaucaaaacttaactccuggat

SEQ ID NO: 69380 - DNA, 28 bp, Artificial Sequence
  Synthetic
tgatttctaaaacaugtctcctugcaca

SEQ ID NO: 69381 - DNA, 24 bp, Artificial Sequence
  Synthetic
gcaacctgaucttgtgaacaucct

SEQ ID NO: 69382 - DNA, 24 bp, Artificial Sequence
  Synthetic
tttgactuccacaaagcccctuat

SEQ ID NO: 69383 - DNA, 22 bp, Artificial Sequence
  Synthetic
aguaaggaccatcugcagcaac

SEQ ID NO: 69384 - DNA, 24 bp, Artificial Sequence
  Synthetic
cgctacttactuctcagccttgut

SEQ ID NO: 69385 - DNA, 21 bp, Artificial Sequence
  Synthetic
ggcctctgutcttcccgttut

SEQ ID NO: 69386 - DNA, 20 bp, Artificial Sequence
  Synthetic
gtgggcugtccttcugagac

SEQ ID NO: 69387 - DNA, 22 bp, Artificial Sequence
  Synthetic
gccacttucagcttgugggaat

SEQ ID NO: 69388 - DNA, 20 bp, Artificial Sequence
  Synthetic
gacaccagagcccugctuaa

SEQ ID NO: 69389 - DNA, 20 bp, Artificial Sequence
  Synthetic
ggcaaagaaccacucaccug

SEQ ID NO: 69390 - DNA, 24 bp, Artificial Sequence
  Synthetic
ttgaacaguccatgaaaggugaca

SEQ ID NO: 69391 - DNA, 28 bp, Artificial Sequence
  Synthetic
tgacattcaatctauagcttgggcttut

SEQ ID NO: 69392 - DNA, 22 bp, Artificial Sequence
  Synthetic
gtcagtgaaugatggcacaugg

SEQ ID NO: 69393 - DNA, 21 bp, Artificial Sequence
  Synthetic
caccctugcaggccctttaua

SEQ ID NO: 69394 - DNA, 21 bp, Artificial Sequence
  Synthetic
gagagacaaggacacugugct

SEQ ID NO: 69395 - DNA, 28 bp, Artificial Sequence
  Synthetic
gacagtctctggaugacagtttctatut

SEQ ID NO: 69396 - DNA, 19 bp, Artificial Sequence
  Synthetic
tgcutgcacugaagccaga

SEQ ID NO: 69397 - DNA, 21 bp, Artificial Sequence
  Synthetic
ctcactgagucctccctccut

SEQ ID NO: 69398 - DNA, 28 bp, Artificial Sequence
  Synthetic
ccagutctagtucagacaaagaaacact

SEQ ID NO: 69399 - DNA, 23 bp, Artificial Sequence
  Synthetic
tggcuagtgctugaccagaaaaa

SEQ ID NO: 69400 - DNA, 25 bp, Artificial Sequence
  Synthetic
acccacattcgagutggaagtacua

SEQ ID NO: 69401 - DNA, 23 bp, Artificial Sequence
  Synthetic
gcagggtguggacaaagaaacut

SEQ ID NO: 69402 - DNA, 21 bp, Artificial Sequence
  Synthetic
cccagguagaggaagggacut

SEQ ID NO: 69403 - DNA, 24 bp, Artificial Sequence
  Synthetic
ccaagtaccutcctccttttuccc

SEQ ID NO: 69404 - DNA, 23 bp, Artificial Sequence
  Synthetic
tttcutccaggcauacgaaacct

SEQ ID NO: 69405 - DNA, 28 bp, Artificial Sequence
  Synthetic
tctggtgttaugttacttggagaugaac

SEQ ID NO: 69406 - DNA, 23 bp, Artificial Sequence
  Synthetic
tggautattttuccccagcccaa

SEQ ID NO: 69407 - DNA, 28 bp, Artificial Sequence
  Synthetic
tgcagaguggactagtttgttuaaagag

SEQ ID NO: 69408 - DNA, 21 bp, Artificial Sequence
  Synthetic
tgtgucccccatagtcugcat

SEQ ID NO: 69409 - DNA, 23 bp, Artificial Sequence
  Synthetic
tggacatgtacutgaagctgguc

SEQ ID NO: 69410 - DNA, 23 bp, Artificial Sequence
  Synthetic
catcagagcagaguctgcacaua

SEQ ID NO: 69411 - DNA, 26 bp, Artificial Sequence
  Synthetic
ttctttttccttucctccctgtaugg

SEQ ID NO: 69412 - DNA, 21 bp, Artificial Sequence
  Synthetic
gcggaacaggauactgcagug

SEQ ID NO: 69413 - DNA, 24 bp, Artificial Sequence
  Synthetic
agggaggtguctgccaaatuaaag

SEQ ID NO: 69414 - DNA, 27 bp, Artificial Sequence
  Synthetic
acaaacatcccauagaatttgcgacua

SEQ ID NO: 69415 - DNA, 25 bp, Artificial Sequence
  Synthetic
gcaaagtgatugactgtgacagtuc

SEQ ID NO: 69416 - DNA, 21 bp, Artificial Sequence
  Synthetic
gggcacaccuggaatgtugaa

SEQ ID NO: 69417 - DNA, 22 bp, Artificial Sequence
  Synthetic
ggtgagattauctccgcctgug

SEQ ID NO: 69418 - DNA, 17 bp, Artificial Sequence
  Synthetic
ctgctucgcgcatucgg

SEQ ID NO: 69419 - DNA, 18 bp, Artificial Sequence
  Synthetic
cagguccaagggcuccat

SEQ ID NO: 69420 - DNA, 22 bp, Artificial Sequence
  Synthetic
cggatgcuggagcagtactcua

SEQ ID NO: 69421 - DNA, 20 bp, Artificial Sequence
  Synthetic
cucagccacagaccuaggga

SEQ ID NO: 69422 - DNA, 21 bp, Artificial Sequence
  Synthetic
gcaacctggutctgcacuaac

SEQ ID NO: 69423 - DNA, 19 bp, Artificial Sequence
  Synthetic
ccacggcacugaggatguc

SEQ ID NO: 69424 - DNA, 25 bp, Artificial Sequence
  Synthetic
cctccctgcauttcttttaagcuga

SEQ ID NO: 69425 - DNA, 20 bp, Artificial Sequence
  Synthetic
gtggaagccgacaucaaugg

SEQ ID NO: 69426 - DNA, 21 bp, Artificial Sequence
  Synthetic
gtggaggccucatgtgucaat

SEQ ID NO: 69427 - DNA, 23 bp, Artificial Sequence
  Synthetic
tgtttaggugagacaccgugaga

SEQ ID NO: 69428 - DNA, 21 bp, Artificial Sequence
  Synthetic
caagaagaagggugagcuggt

SEQ ID NO: 69429 - DNA, 17 bp, Artificial Sequence
  Synthetic
ccctgggugctcaccut

SEQ ID NO: 69430 - DNA, 23 bp, Artificial Sequence
  Synthetic
tgaagctuacagagaagcaggug

SEQ ID NO: 69431 - DNA, 20 bp, Artificial Sequence
  Synthetic
ccctccuggaacuccaccat

SEQ ID NO: 69432 - DNA, 22 bp, Artificial Sequence
  Synthetic
gcuctcucaagaggaagcaacc

SEQ ID NO: 69433 - DNA, 21 bp, Artificial Sequence
  Synthetic
ttctgcccguctctagcuaca

SEQ ID NO: 69434 - DNA, 21 bp, Artificial Sequence
  Synthetic
cgtgaggccauctgttgugat

SEQ ID NO: 69435 - DNA, 26 bp, Artificial Sequence
  Synthetic
ccaaatuaacgcccaggaaaaauaca

SEQ ID NO: 69436 - DNA, 27 bp, Artificial Sequence
  Synthetic
actgggtcactauaaggtcaaaagcua

SEQ ID NO: 69437 - DNA, 20 bp, Artificial Sequence
  Synthetic
gcauctgaguggccacacat

SEQ ID NO: 69438 - DNA, 21 bp, Artificial Sequence
  Synthetic
ggctgagggutagagcctgua

SEQ ID NO: 69439 - DNA, 24 bp, Artificial Sequence
  Synthetic
ctcagctcugacctcttctttucc

SEQ ID NO: 69440 - DNA, 21 bp, Artificial Sequence
  Synthetic
agagccuggtagatgcucagt

SEQ ID NO: 69441 - DNA, 21 bp, Artificial Sequence
  Synthetic
ctgttcgaggcucggatcauc

SEQ ID NO: 69442 - DNA, 24 bp, Artificial Sequence
  Synthetic
tgtgtctctucaaatgcccttcut

SEQ ID NO: 69443 - DNA, 19 bp, Artificial Sequence
  Synthetic
ggagaugaaccgcgtccug

SEQ ID NO: 69444 - DNA, 17 bp, Artificial Sequence
  Synthetic
cttcacggccucgugga

SEQ ID NO: 69445 - DNA, 17 bp, Artificial Sequence
  Synthetic
cucgccggcatcuacct

SEQ ID NO: 69446 - DNA, 17 bp, Artificial Sequence
  Synthetic
ctccgccugtgccttug

SEQ ID NO: 69447 - DNA, 17 bp, Artificial Sequence
  Synthetic
ctccgcgcugtcugagt

SEQ ID NO: 69448 - DNA, 19 bp, Artificial Sequence
  Synthetic
ccgacccccaucuccaaga

SEQ ID NO: 69449 - DNA, 20 bp, Artificial Sequence
  Synthetic
aggacaaccugtaccuggct

SEQ ID NO: 69450 - DNA, 21 bp, Artificial Sequence
  Synthetic
gtatgtgctuggtctggcuct

SEQ ID NO: 69451 - DNA, 28 bp, Artificial Sequence
  Synthetic
gtataaggaagtauggctcccaaagaut

SEQ ID NO: 69452 - DNA, 21 bp, Artificial Sequence
  Synthetic
ggacctggcuctgcatttugt

SEQ ID NO: 69453 - DNA, 22 bp, Artificial Sequence
  Synthetic
gctccutaaagagcugcgaact

SEQ ID NO: 69454 - DNA, 19 bp, Artificial Sequence
  Synthetic
ccacgucctgcagcucaat

SEQ ID NO: 69455 - DNA, 18 bp, Artificial Sequence
  Synthetic
ggctacugccagcccauc

SEQ ID NO: 69456 - DNA, 20 bp, Artificial Sequence
  Synthetic
gcagacguggtacctgcauc

SEQ ID NO: 69457 - DNA, 22 bp, Artificial Sequence
  Synthetic
tgaagagcgagcaccucattuc

SEQ ID NO: 69458 - DNA, 20 bp, Artificial Sequence
  Synthetic
gcaggauctgccuaggaggt

SEQ ID NO: 69459 - DNA, 23 bp, Artificial Sequence
  Synthetic
cctgttcccaugccctgatuaaa

SEQ ID NO: 69460 - DNA, 19 bp, Artificial Sequence
  Synthetic
gctcctcuggcttggacuc

SEQ ID NO: 69461 - DNA, 20 bp, Artificial Sequence
  Synthetic
ggcaacctugctctcaccut

SEQ ID NO: 69462 - DNA, 18 bp, Artificial Sequence
  Synthetic
caccacgucgtcgaugga

SEQ ID NO: 69463 - DNA, 18 bp, Artificial Sequence
  Synthetic
gggcggguggaacctuag

SEQ ID NO: 69464 - DNA, 25 bp, Artificial Sequence
  Synthetic
ctgtgaaacuaccattggttccugt

SEQ ID NO: 69465 - DNA, 24 bp, Artificial Sequence
  Synthetic
ccutgatatccugggacacagaag

SEQ ID NO: 69466 - DNA, 25 bp, Artificial Sequence
  Synthetic
cgtggaaaaucgaaaagggagaugt

SEQ ID NO: 69467 - DNA, 23 bp, Artificial Sequence
  Synthetic
cattacctugcagctgttgtcuc

SEQ ID NO: 69468 - DNA, 25 bp, Artificial Sequence
  Synthetic
gatttctttuctgctcaguccaacc

SEQ ID NO: 69469 - DNA, 26 bp, Artificial Sequence
  Synthetic
tggtgagatgguaggtttgaactcua

SEQ ID NO: 69470 - DNA, 21 bp, Artificial Sequence
  Synthetic
gcctaccacugcacatgugag

SEQ ID NO: 69471 - DNA, 27 bp, Artificial Sequence
  Synthetic
caagaacagtgaugcagagtatagcut

SEQ ID NO: 69472 - DNA, 23 bp, Artificial Sequence
  Synthetic
aggtgtccccaguagacaaguat

SEQ ID NO: 69473 - DNA, 23 bp, Artificial Sequence
  Synthetic
tttgctgtgucctaggaaagguc

SEQ ID NO: 69474 - DNA, 22 bp, Artificial Sequence
  Synthetic
aggagactcuggttgacaguga

SEQ ID NO: 69475 - DNA, 20 bp, Artificial Sequence
  Synthetic
catcagcacuagtgguggca

SEQ ID NO: 69476 - DNA, 28 bp, Artificial Sequence
  Synthetic
cttgttctgtugcacaatttcttctuca

SEQ ID NO: 69477 - DNA, 29 bp, Artificial Sequence
  Synthetic
actggcataugaaaatagaagaactucgt

SEQ ID NO: 69478 - DNA, 27 bp, Artificial Sequence
  Synthetic
ctgaaatttggcuatcactgtccuact

SEQ ID NO: 69479 - DNA, 26 bp, Artificial Sequence
  Synthetic
gctgctatgtcutcatagctcgttut

SEQ ID NO: 69480 - DNA, 30 bp, Artificial Sequence
  Synthetic
gaataactgagtauacctgaagttgcacut

SEQ ID NO: 69481 - DNA, 27 bp, Artificial Sequence
  Synthetic
agtacagagcugaaaaccagattctut

SEQ ID NO: 69482 - DNA, 31 bp, Artificial Sequence
  Synthetic
ggtgatgtagauattaccaggtatttucaca

SEQ ID NO: 69483 - DNA, 28 bp, Artificial Sequence
  Synthetic
agttgcttttcugtttacttagguggaa

SEQ ID NO: 69484 - DNA, 17 bp, Artificial Sequence
  Synthetic
gaggtgcugggccacut

SEQ ID NO: 69485 - DNA, 18 bp, Artificial Sequence
  Synthetic
cggucagccatctuccct

SEQ ID NO: 69486 - DNA, 27 bp, Artificial Sequence
  Synthetic
tcatcttgugaccagttctctactuct

SEQ ID NO: 69487 - DNA, 24 bp, Artificial Sequence
  Synthetic
ccagacugcaatgcaaauaaggga

SEQ ID NO: 69488 - DNA, 21 bp, Artificial Sequence
  Synthetic
acatagcugacctggucccat

SEQ ID NO: 69489 - DNA, 24 bp, Artificial Sequence
  Synthetic
gccttgttuctagaatggcucaga

SEQ ID NO: 69490 - DNA, 26 bp, Artificial Sequence
  Synthetic
ccagtcttgucaaacatcacagtcut

SEQ ID NO: 69491 - DNA, 21 bp, Artificial Sequence
  Synthetic
gtttcctgtcugaggcaggut

SEQ ID NO: 69492 - DNA, 22 bp, Artificial Sequence
  Synthetic
ccctttaacggauaggcagcut

SEQ ID NO: 69493 - DNA, 21 bp, Artificial Sequence
  Synthetic
gggtatcuccagcctgagcua

SEQ ID NO: 69494 - DNA, 25 bp, Artificial Sequence
  Synthetic
gaaggaaguagataaggtgcugaca

SEQ ID NO: 69495 - DNA, 24 bp, Artificial Sequence
  Synthetic
gttgcactugaatagatccgtugg

SEQ ID NO: 69496 - DNA, 21 bp, Artificial Sequence
  Synthetic
ggagggcucgttctuaaccat

SEQ ID NO: 69497 - DNA, 21 bp, Artificial Sequence
  Synthetic
gccattcucagggttggtcuc

SEQ ID NO: 69498 - DNA, 29 bp, Artificial Sequence
  Synthetic
agacacgtaaauacatttcaacactugga

SEQ ID NO: 69499 - DNA, 22 bp, Artificial Sequence
  Synthetic
agttgctuggagaccatgaugt

SEQ ID NO: 69500 - DNA, 19 bp, Artificial Sequence
  Synthetic
cctccggagugaccctcua

SEQ ID NO: 69501 - DNA, 21 bp, Artificial Sequence
  Synthetic
cggacauggagtuggagaagt

SEQ ID NO: 69502 - DNA, 21 bp, Artificial Sequence
  Synthetic
ccctgaggauctctggguaca

SEQ ID NO: 69503 - DNA, 20 bp, Artificial Sequence
  Synthetic
gacucaccggaacttgguct

SEQ ID NO: 69504 - DNA, 19 bp, Artificial Sequence
  Synthetic
cctaccgcuacacggugaa

SEQ ID NO: 69505 - DNA, 19 bp, Artificial Sequence
  Synthetic
ggcguccacgatagggaug

SEQ ID NO: 69506 - DNA, 20 bp, Artificial Sequence
  Synthetic
accacgcgguctttguacag

SEQ ID NO: 69507 - DNA, 28 bp, Artificial Sequence
  Synthetic
cacccagauttcaattctttugacaaca

SEQ ID NO: 69508 - DNA, 27 bp, Artificial Sequence
  Synthetic
gcagagaagutatatgcugaggagaat

SEQ ID NO: 69509 - DNA, 24 bp, Artificial Sequence
  Synthetic
agccttucacaaaactcatccuga

SEQ ID NO: 69510 - DNA, 18 bp, Artificial Sequence
  Synthetic
caggugctucagccacca

SEQ ID NO: 69511 - DNA, 22 bp, Artificial Sequence
  Synthetic
gtctgggtccugactctgtcua

SEQ ID NO: 69512 - DNA, 24 bp, Artificial Sequence
  Synthetic
ggatgagaugtcaagtcaguccct

SEQ ID NO: 69513 - DNA, 21 bp, Artificial Sequence
  Synthetic
atctctccccugtgacctugt

SEQ ID NO: 69514 - DNA, 21 bp, Artificial Sequence
  Synthetic
caggcuggaacttcagtgugt

SEQ ID NO: 69515 - DNA, 21 bp, Artificial Sequence
  Synthetic
ctgcctctaugctgtgctcuc

SEQ ID NO: 69516 - DNA, 20 bp, Artificial Sequence
  Synthetic
tgcuatgagguagggcacga

SEQ ID NO: 69517 - DNA, 24 bp, Artificial Sequence
  Synthetic
gtatcccguttttgccctuaagag

SEQ ID NO: 69518 - DNA, 19 bp, Artificial Sequence
  Synthetic
cactcgcucacctccugac

SEQ ID NO: 69519 - DNA, 22 bp, Artificial Sequence
  Synthetic
ggcatcccaucctcacattgut

SEQ ID NO: 69520 - DNA, 21 bp, Artificial Sequence
  Synthetic
gccaccugcttcatcttcuca

SEQ ID NO: 69521 - DNA, 19 bp, Artificial Sequence
  Synthetic
aggaggagcucttcucggt

SEQ ID NO: 69522 - DNA, 18 bp, Artificial Sequence
  Synthetic
ccacagccacgugtucct

SEQ ID NO: 69523 - DNA, 18 bp, Artificial Sequence
  Synthetic
ggtacagguggcccugga

SEQ ID NO: 69524 - DNA, 18 bp, Artificial Sequence
  Synthetic
cccugcacaacgcctcuc

SEQ ID NO: 69525 - DNA, 19 bp, Artificial Sequence
  Synthetic
gctggugacgctgactgua

SEQ ID NO: 69526 - DNA, 19 bp, Artificial Sequence
  Synthetic
gctcaccuccacctgctua

SEQ ID NO: 69527 - DNA, 19 bp, Artificial Sequence
  Synthetic
catggcccucgtctggaug

SEQ ID NO: 69528 - DNA, 20 bp, Artificial Sequence
  Synthetic
acagcagcagcutctcctug

SEQ ID NO: 69529 - DNA, 18 bp, Artificial Sequence
  Synthetic
cccctgggugctgagcua

SEQ ID NO: 69530 - DNA, 22 bp, Artificial Sequence
  Synthetic
cttttcuggcatctucccacag

SEQ ID NO: 69531 - DNA, 23 bp, Artificial Sequence
  Synthetic
tcatgccttucaagacactgcut

SEQ ID NO: 69532 - DNA, 22 bp, Artificial Sequence
  Synthetic
ccatagtctgugctctctgcug

SEQ ID NO: 69533 - DNA, 26 bp, Artificial Sequence
  Synthetic
agaatttaggtugtcaactgccaugt

SEQ ID NO: 69534 - DNA, 27 bp, Artificial Sequence
  Synthetic
acaaccataacugaacatccattucct

SEQ ID NO: 69535 - DNA, 28 bp, Artificial Sequence
  Synthetic
gtgagttaaccugcaactgattttgtut

SEQ ID NO: 69536 - DNA, 22 bp, Artificial Sequence
  Synthetic
cggagacuaggaaaccagcuct

SEQ ID NO: 69537 - DNA, 27 bp, Artificial Sequence
  Synthetic
tcctaaggaagaugtatgaagcctuga

SEQ ID NO: 69538 - DNA, 21 bp, Artificial Sequence
  Synthetic
ccccacagaccugacttcuct

SEQ ID NO: 69539 - DNA, 23 bp, Artificial Sequence
  Synthetic
gcuggaaaggaggtgtugaagaa

SEQ ID NO: 69540 - DNA, 22 bp, Artificial Sequence
  Synthetic
ggccccuttcactcacugaaat

SEQ ID NO: 69541 - DNA, 28 bp, Artificial Sequence
  Synthetic
ggttacataaatuggtccgacaacatuc

SEQ ID NO: 69542 - DNA, 27 bp, Artificial Sequence
  Synthetic
gttcggagaacugcttatttccaagua

SEQ ID NO: 69543 - DNA, 25 bp, Artificial Sequence
  Synthetic
gggagttgaatuaactagccctgut

SEQ ID NO: 69544 - DNA, 33 bp, Artificial Sequence
  Synthetic
ataaagctatataauttccaggtcacuaaagga

SEQ ID NO: 69545 - DNA, 28 bp, Artificial Sequence
  Synthetic
gccaaaauagaaggaatucgaaacaagt

SEQ ID NO: 69546 - DNA, 33 bp, Artificial Sequence
  Synthetic
tttgcctatttttacaauacatttcgaagacut

SEQ ID NO: 69547 - DNA, 27 bp, Artificial Sequence
  Synthetic
tctctttcctcacucttggtcaaacua

SEQ ID NO: 69548 - DNA, 25 bp, Artificial Sequence
  Synthetic
ttcatcattctaugcattgcccuca

SEQ ID NO: 69549 - DNA, 23 bp, Artificial Sequence
  Synthetic
agtttgccccutccaaaucaact

SEQ ID NO: 69550 - DNA, 21 bp, Artificial Sequence
  Synthetic
ctccatcugcctgtccatguc

SEQ ID NO: 69551 - DNA, 23 bp, Artificial Sequence
  Synthetic
atctggaagaugagcugacacac

SEQ ID NO: 69552 - DNA, 21 bp, Artificial Sequence
  Synthetic
ggcaccucagggacaguaaat

SEQ ID NO: 69553 - DNA, 26 bp, Artificial Sequence
  Synthetic
cacccttacatutctgcaaaatggut

SEQ ID NO: 69554 - DNA, 19 bp, Artificial Sequence
  Synthetic
cctguaaccccguaacgca

SEQ ID NO: 69555 - DNA, 22 bp, Artificial Sequence
  Synthetic
gttacagccaugacctgauggt

SEQ ID NO: 69556 - DNA, 22 bp, Artificial Sequence
  Synthetic
gccacttccugcacagatguag

SEQ ID NO: 69557 - DNA, 27 bp, Artificial Sequence
  Synthetic
cctgaaaccucttgttcugaaaaacat

SEQ ID NO: 69558 - DNA, 26 bp, Artificial Sequence
  Synthetic
ggctccaucaggaagagaaacttuaa

SEQ ID NO: 69559 - DNA, 25 bp, Artificial Sequence
  Synthetic
gtcacccuccaactgagaatagaug

SEQ ID NO: 69560 - DNA, 24 bp, Artificial Sequence
  Synthetic
ctctcactacuccttgcagttucc

SEQ ID NO: 69561 - DNA, 24 bp, Artificial Sequence
  Synthetic
tgaaatatgugccatcggttgugt

SEQ ID NO: 69562 - DNA, 23 bp, Artificial Sequence
  Synthetic
catctgtatuccccctgcttuca

SEQ ID NO: 69563 - DNA, 19 bp, Artificial Sequence
  Synthetic
cugagatgccucggcacat

SEQ ID NO: 69564 - DNA, 17 bp, Artificial Sequence
  Synthetic
cucuggcgggaagggat

SEQ ID NO: 69565 - DNA, 18 bp, Artificial Sequence
  Synthetic
acucgtgggucccgaact

SEQ ID NO: 69566 - DNA, 22 bp, Artificial Sequence
  Synthetic
gctgaagucacggaactgcaua

SEQ ID NO: 69567 - DNA, 23 bp, Artificial Sequence
  Synthetic
gggagaagcccutgaaataaugg

SEQ ID NO: 69568 - DNA, 22 bp, Artificial Sequence
  Synthetic
cctcccacaucttggtctucaa

SEQ ID NO: 69569 - DNA, 20 bp, Artificial Sequence
  Synthetic
cccagcacugcttcaucagg

SEQ ID NO: 69570 - DNA, 22 bp, Artificial Sequence
  Synthetic
cagaggaggaggguctuaccat

SEQ ID NO: 69571 - DNA, 19 bp, Artificial Sequence
  Synthetic
gcaggagaucgccaccuac

SEQ ID NO: 69572 - DNA, 19 bp, Artificial Sequence
  Synthetic
accaccctucctggcacua

SEQ ID NO: 69573 - DNA, 25 bp, Artificial Sequence
  Synthetic
ctggtgtgaauggcattctctttut

SEQ ID NO: 69574 - DNA, 22 bp, Artificial Sequence
  Synthetic
ctgatcagucttagggcaucca

SEQ ID NO: 69575 - DNA, 25 bp, Artificial Sequence
  Synthetic
actacaguccctactucaagaccat

SEQ ID NO: 69576 - DNA, 20 bp, Artificial Sequence
  Synthetic
gagagcgugagggtgtcauc

SEQ ID NO: 69577 - DNA, 20 bp, Artificial Sequence
  Synthetic
gcacugggagtgcucaaagt

SEQ ID NO: 69578 - DNA, 23 bp, Artificial Sequence
  Synthetic
ggtgagutacacttttugcccat

SEQ ID NO: 69579 - DNA, 20 bp, Artificial Sequence
  Synthetic
ctgaggcccugatgctauct

SEQ ID NO: 69580 - DNA, 20 bp, Artificial Sequence
  Synthetic
cgacguggctcuagaggaat

SEQ ID NO: 69581 - DNA, 23 bp, Artificial Sequence
  Synthetic
caaggagcucagagaggttucaa

SEQ ID NO: 69582 - DNA, 21 bp, Artificial Sequence
  Synthetic
ccaccttugaggtgaguccaa

SEQ ID NO: 69583 - DNA, 24 bp, Artificial Sequence
  Synthetic
tggctctcutgatatctgguccat

SEQ ID NO: 69584 - DNA, 19 bp, Artificial Sequence
  Synthetic
aaggacuccucccccagaa

SEQ ID NO: 69585 - DNA, 23 bp, Artificial Sequence
  Synthetic
cttttgtctauggtggctgugga

SEQ ID NO: 69586 - DNA, 21 bp, Artificial Sequence
  Synthetic
cugtggaaucacagcccagat

SEQ ID NO: 69587 - DNA, 22 bp, Artificial Sequence
  Synthetic
gcagatgggacacugggattut

SEQ ID NO: 69588 - DNA, 22 bp, Artificial Sequence
  Synthetic
ggatggagcaguggttgaugat

SEQ ID NO: 69589 - DNA, 20 bp, Artificial Sequence
  Synthetic
tcttcccacccgugtgttuc

SEQ ID NO: 69590 - DNA, 19 bp, Artificial Sequence
  Synthetic
cctcacgcgguactgtguc

SEQ ID NO: 69591 - DNA, 24 bp, Artificial Sequence
  Synthetic
ggtcagtgaggaugaggaagauca

SEQ ID NO: 69592 - DNA, 22 bp, Artificial Sequence
  Synthetic
tggagaacccguagtgcaaauc

SEQ ID NO: 69593 - DNA, 21 bp, Artificial Sequence
  Synthetic
gtccacacacccacucttgut

SEQ ID NO: 69594 - DNA, 20 bp, Artificial Sequence
  Synthetic
tcctccaccutggcttucag

SEQ ID NO: 69595 - DNA, 17 bp, Artificial Sequence
  Synthetic
cuggagcugggacgcat

SEQ ID NO: 69596 - DNA, 18 bp, Artificial Sequence
  Synthetic
tgccggcuctttguccag

SEQ ID NO: 69597 - DNA, 18 bp, Artificial Sequence
  Synthetic
cgguggagugacccacat

SEQ ID NO: 69598 - DNA, 19 bp, Artificial Sequence
  Synthetic
ctccccutcccuaggcact

SEQ ID NO: 69599 - DNA, 20 bp, Artificial Sequence
  Synthetic
ccgacgagcaggacutcauc

SEQ ID NO: 69600 - DNA, 21 bp, Artificial Sequence
  Synthetic
cccgcttucagggatctugag

SEQ ID NO: 69601 - DNA, 21 bp, Artificial Sequence
  Synthetic
ccttcctaaguccgcttcugg

SEQ ID NO: 69602 - DNA, 28 bp, Artificial Sequence
  Synthetic
tctaacgcuctcataatcaugacaaagg

SEQ ID NO: 69603 - DNA, 28 bp, Artificial Sequence
  Synthetic
acgtgaaguatgtcatgtuggaagaaaa

SEQ ID NO: 69604 - DNA, 25 bp, Artificial Sequence
  Synthetic
gaaaggaagaagacuacagggcaua

SEQ ID NO: 69605 - DNA, 27 bp, Artificial Sequence
  Synthetic
gtgacctgccuactaattcccataaut

SEQ ID NO: 69606 - DNA, 23 bp, Artificial Sequence
  Synthetic
tctacagcacucctctggtuact

SEQ ID NO: 69607 - DNA, 21 bp, Artificial Sequence
  Synthetic
tguaaccuccaccccaagaga

SEQ ID NO: 69608 - DNA, 23 bp, Artificial Sequence
  Synthetic
tttttgauggcagcattcgaugg

SEQ ID NO: 69609 - DNA, 27 bp, Artificial Sequence
  Synthetic
acagcggtugacatctaatattugaca

SEQ ID NO: 69610 - DNA, 24 bp, Artificial Sequence
  Synthetic
tgggtacaccaugctttttgauga

SEQ ID NO: 69611 - DNA, 24 bp, Artificial Sequence
  Synthetic
ttctccataucggccttuaccaac

SEQ ID NO: 69612 - DNA, 22 bp, Artificial Sequence
  Synthetic
tgttggucccagccttgttuaa

SEQ ID NO: 69613 - DNA, 23 bp, Artificial Sequence
  Synthetic
ggagttcuaagccaaucacccaa

SEQ ID NO: 69614 - DNA, 20 bp, Artificial Sequence
  Synthetic
ccacugcgaagaagacguca

SEQ ID NO: 69615 - DNA, 28 bp, Artificial Sequence
  Synthetic
agtgagggaugcatgttccattattuag

SEQ ID NO: 69616 - DNA, 23 bp, Artificial Sequence
  Synthetic
cccaaaggaaggcauggtaguag

SEQ ID NO: 69617 - DNA, 20 bp, Artificial Sequence
  Synthetic
gagccgttgutcgagcagua

SEQ ID NO: 69618 - DNA, 28 bp, Artificial Sequence
  Synthetic
caaggaacatctugcgatattatgcaut

SEQ ID NO: 69619 - DNA, 27 bp, Artificial Sequence
  Synthetic
caaagcattacugaccttaaacagcut

SEQ ID NO: 69620 - DNA, 28 bp, Artificial Sequence
  Synthetic
cttttggccagautaagaaagaagtuga

SEQ ID NO: 69621 - DNA, 20 bp, Artificial Sequence
  Synthetic
gutgttcauagggcccacca

SEQ ID NO: 69622 - DNA, 28 bp, Artificial Sequence
  Synthetic
ttcataggtttuaggtctacttccucca

SEQ ID NO: 69623 - DNA, 27 bp, Artificial Sequence
  Synthetic
gtcagtgatagcutcagaaagttgcua

SEQ ID NO: 69624 - DNA, 28 bp, Artificial Sequence
  Synthetic
ggttaaguacaggattattcatcugcct

SEQ ID NO: 69625 - DNA, 28 bp, Artificial Sequence
  Synthetic
ccaaggaaaaacutcacactatugaaca

SEQ ID NO: 69626 - DNA, 24 bp, Artificial Sequence
  Synthetic
catccgaauccatcugaagagcat

SEQ ID NO: 69627 - DNA, 29 bp, Artificial Sequence
  Synthetic
ggagaccuggaaaacagaatcuaaaacaa

SEQ ID NO: 69628 - DNA, 27 bp, Artificial Sequence
  Synthetic
tctaagtgccucattttcaucaaggaa

SEQ ID NO: 69629 - DNA, 33 bp, Artificial Sequence
  Synthetic
attaaattggatattuttcagggagtatauggt

SEQ ID NO: 69630 - DNA, 28 bp, Artificial Sequence
  Synthetic
ggacagttcuagagcttttcuaaccaat

SEQ ID NO: 69631 - DNA, 29 bp, Artificial Sequence
  Synthetic
gaagaagatgauccaattatggtagcugt

SEQ ID NO: 69632 - DNA, 26 bp, Artificial Sequence
  Synthetic
aggaaagaaatgcugaaaatgccauc

SEQ ID NO: 69633 - DNA, 28 bp, Artificial Sequence
  Synthetic
gcctugagaaaaggactacatucagaaa

SEQ ID NO: 69634 - DNA, 24 bp, Artificial Sequence
  Synthetic
aagaggttgttugcctttgtccua

SEQ ID NO: 69635 - DNA, 26 bp, Artificial Sequence
  Synthetic
agatcctttaaaugaggaggagggut

SEQ ID NO: 69636 - DNA, 23 bp, Artificial Sequence
  Synthetic
acaggcaaagggugtgtaugaaa

SEQ ID NO: 69637 - DNA, 29 bp, Artificial Sequence
  Synthetic
acaataaaccaggutcaaatactcacuga

SEQ ID NO: 69638 - DNA, 19 bp, Artificial Sequence
  Synthetic
cagaugcaccgacugcaag

SEQ ID NO: 69639 - DNA, 22 bp, Artificial Sequence
  Synthetic
ttcccagtgucttagccctgua

SEQ ID NO: 69640 - DNA, 22 bp, Artificial Sequence
  Synthetic
tctcagacacuggagatgguga

SEQ ID NO: 69641 - DNA, 21 bp, Artificial Sequence
  Synthetic
ctctgggacccaaaugtggua

SEQ ID NO: 69642 - DNA, 21 bp, Artificial Sequence
  Synthetic
gggctcacacugcaacaguat

SEQ ID NO: 69643 - DNA, 26 bp, Artificial Sequence
  Synthetic
caucagcacaaaaccaaacucaaact

SEQ ID NO: 69644 - DNA, 27 bp, Artificial Sequence
  Synthetic
ccaagtatcaaagugttcaactgagug

SEQ ID NO: 69645 - DNA, 28 bp, Artificial Sequence
  Synthetic
ctttttactatggtuccctcagagacut

SEQ ID NO: 69646 - DNA, 23 bp, Artificial Sequence
  Synthetic
cagggtgttuaggagatgaccut

SEQ ID NO: 69647 - DNA, 20 bp, Artificial Sequence
  Synthetic
catctgtgugctggtgcuct

SEQ ID NO: 69648 - DNA, 19 bp, Artificial Sequence
  Synthetic
cggtcaguacacgcaugga

SEQ ID NO: 69649 - DNA, 21 bp, Artificial Sequence
  Synthetic
ccaccaauacagccccttcut

SEQ ID NO: 69650 - DNA, 19 bp, Artificial Sequence
  Synthetic
cggagacgagcucaugagt

SEQ ID NO: 69651 - DNA, 21 bp, Artificial Sequence
  Synthetic
caccacgcucatgagaacugt

SEQ ID NO: 69652 - DNA, 19 bp, Artificial Sequence
  Synthetic
gctcguccaggtcctcgua

SEQ ID NO: 69653 - DNA, 22 bp, Artificial Sequence
  Synthetic
gctctgaguggaggcctttuat

SEQ ID NO: 69654 - DNA, 19 bp, Artificial Sequence
  Synthetic
ccccatuccccttcccuga

SEQ ID NO: 69655 - DNA, 17 bp, Artificial Sequence
  Synthetic
ggcttgggugggacgut

SEQ ID NO: 69656 - DNA, 21 bp, Artificial Sequence
  Synthetic
ggaaugaagcaggactccugt

SEQ ID NO: 69657 - DNA, 21 bp, Artificial Sequence
  Synthetic
cacacgaaguctccgtugaag

SEQ ID NO: 69658 - DNA, 19 bp, Artificial Sequence
  Synthetic
gcccagcacacucugacaa

SEQ ID NO: 69659 - DNA, 17 bp, Artificial Sequence
  Synthetic
gcacccucgaccctgug

SEQ ID NO: 69660 - DNA, 18 bp, Artificial Sequence
  Synthetic
tctagguggctggucgga

SEQ ID NO: 69661 - DNA, 26 bp, Artificial Sequence
  Synthetic
agtgatatggatucacacagacacua

SEQ ID NO: 69662 - DNA, 24 bp, Artificial Sequence
  Synthetic
tctcaccaucactaucccaaggag

SEQ ID NO: 69663 - DNA, 22 bp, Artificial Sequence
  Synthetic
tgtgcacacaguggaaaucagt

SEQ ID NO: 69664 - DNA, 23 bp, Artificial Sequence
  Synthetic
cagcacatgugtccttctgtgua

SEQ ID NO: 69665 - DNA, 24 bp, Artificial Sequence
  Synthetic
ctttatggtcccugtggtcttcug

SEQ ID NO: 69666 - DNA, 19 bp, Artificial Sequence
  Synthetic
cccugtacctugggaccga

SEQ ID NO: 69667 - DNA, 19 bp, Artificial Sequence
  Synthetic
ctcaccccacugcctgaug

SEQ ID NO: 69668 - DNA, 23 bp, Artificial Sequence
  Synthetic
ctgggagttugagctctcagaug

SEQ ID NO: 69669 - DNA, 21 bp, Artificial Sequence
  Synthetic
tcccgacucctctgattccug

SEQ ID NO: 69670 - DNA, 21 bp, Artificial Sequence
  Synthetic
cuagggaggauggcagagagt

SEQ ID NO: 69671 - DNA, 26 bp, Artificial Sequence
  Synthetic
ctgagtcaaugaacctaatgucacca

SEQ ID NO: 69672 - DNA, 21 bp, Artificial Sequence
  Synthetic
agagctctcaucccaggtcuc

SEQ ID NO: 69673 - DNA, 20 bp, Artificial Sequence
  Synthetic
gccctucacccagacttugt

SEQ ID NO: 69674 - DNA, 22 bp, Artificial Sequence
  Synthetic
cctgcaagauaacagggucaga

SEQ ID NO: 69675 - DNA, 20 bp, Artificial Sequence
  Synthetic
ggccacugacatcccatgug

SEQ ID NO: 69676 - DNA, 21 bp, Artificial Sequence
  Synthetic
cagctgctuctgggaatccut

SEQ ID NO: 69677 - DNA, 22 bp, Artificial Sequence
  Synthetic
cagtggaatcuctggagtgguc

SEQ ID NO: 69678 - DNA, 19 bp, Artificial Sequence
  Synthetic
ctccaccgucagctucagt

SEQ ID NO: 69679 - DNA, 23 bp, Artificial Sequence
  Synthetic
ggucaccaagaactugcagaagt

SEQ ID NO: 69680 - DNA, 22 bp, Artificial Sequence
  Synthetic
acctccuccacgatggtaauga

SEQ ID NO: 69681 - DNA, 22 bp, Artificial Sequence
  Synthetic
cttugaaaagaccccggtugag

SEQ ID NO: 69682 - DNA, 23 bp, Artificial Sequence
  Synthetic
ggcgtaaacacucagcttcucat

SEQ ID NO: 69683 - DNA, 20 bp, Artificial Sequence
  Synthetic
ggaaggugtcagcucagagg

SEQ ID NO: 69684 - DNA, 21 bp, Artificial Sequence
  Synthetic
ccccactgguctctgaccaua

SEQ ID NO: 69685 - DNA, 21 bp, Artificial Sequence
  Synthetic
ccgccacuaaggagctaaugt

SEQ ID NO: 69686 - DNA, 20 bp, Artificial Sequence
  Synthetic
cacagctgcuggtagaggua

SEQ ID NO: 69687 - DNA, 17 bp, Artificial Sequence
  Synthetic
cgugggcuggaagcaga

SEQ ID NO: 69688 - DNA, 21 bp, Artificial Sequence
  Synthetic
ggccaggauttcacaaggcut

SEQ ID NO: 69689 - DNA, 19 bp, Artificial Sequence
  Synthetic
ccacaagcugctgcugaca

SEQ ID NO: 69690 - DNA, 23 bp, Artificial Sequence
  Synthetic
gtctctaguaacaaggccagguc

SEQ ID NO: 69691 - DNA, 27 bp, Artificial Sequence
  Synthetic
tgtgtgtctatgugtgtgtgtatacuc

SEQ ID NO: 69692 - DNA, 22 bp, Artificial Sequence
  Synthetic
gcaggaagtugaggagaaggug

SEQ ID NO: 69693 - DNA, 22 bp, Artificial Sequence
  Synthetic
ttcctaaccuctcccctgugaa

SEQ ID NO: 69694 - DNA, 20 bp, Artificial Sequence
  Synthetic
cacuaccacggugggaagac

SEQ ID NO: 69695 - DNA, 20 bp, Artificial Sequence
  Synthetic
gggtctgatucctccgacuc

SEQ ID NO: 69696 - DNA, 28 bp, Artificial Sequence
  Synthetic
aaagtagaagcaauctgatgaacuccaa

SEQ ID NO: 69697 - DNA, 19 bp, Artificial Sequence
  Synthetic
tccacaagggaccugcuct

SEQ ID NO: 69698 - DNA, 22 bp, Artificial Sequence
  Synthetic
cauttgucaacggacagcagat

SEQ ID NO: 69699 - DNA, 20 bp, Artificial Sequence
  Synthetic
ttctgugcccccattgtuct

SEQ ID NO: 69700 - DNA, 29 bp, Artificial Sequence
  Synthetic
tgaaauggaacaaacaatgauaagcaaca

SEQ ID NO: 69701 - DNA, 22 bp, Artificial Sequence
  Synthetic
ttaacctaacgcauggcctcut

SEQ ID NO: 69702 - DNA, 20 bp, Artificial Sequence
  Synthetic
caggtgttguaggagcgcut

SEQ ID NO: 69703 - DNA, 28 bp, Artificial Sequence
  Synthetic
catgagtttgcagugattttgctatuct

SEQ ID NO: 69704 - DNA, 17 bp, Artificial Sequence
  Synthetic
gccccugtctgctuggt

SEQ ID NO: 69705 - DNA, 18 bp, Artificial Sequence
  Synthetic
gggcaccaucaccaccuc

SEQ ID NO: 69706 - DNA, 17 bp, Artificial Sequence
  Synthetic
gctaccugggcagugga

SEQ ID NO: 69707 - DNA, 18 bp, Artificial Sequence
  Synthetic
gctgggugcagagccaua

SEQ ID NO: 69708 - DNA, 21 bp, Artificial Sequence
  Synthetic
gggagtttugccaaggcctua

SEQ ID NO: 69709 - DNA, 21 bp, Artificial Sequence
  Synthetic
gttagtgccaucagctcucgt

SEQ ID NO: 69710 - DNA, 22 bp, Artificial Sequence
  Synthetic
gtagccagccagguacatguag

SEQ ID NO: 69711 - DNA, 21 bp, Artificial Sequence
  Synthetic
gagaggacuccctgggatcut

SEQ ID NO: 69712 - DNA, 22 bp, Artificial Sequence
  Synthetic
gattgagugcagcagctctgua

SEQ ID NO: 69713 - DNA, 26 bp, Artificial Sequence
  Synthetic
ggtttggcutcatattgcugacaaaa

SEQ ID NO: 69714 - DNA, 27 bp, Artificial Sequence
  Synthetic
gtgatcaggatuggtatcaaagguagg

SEQ ID NO: 69715 - DNA, 27 bp, Artificial Sequence
  Synthetic
ctcttccaaagccutttaaaaccacut

SEQ ID NO: 69716 - DNA, 23 bp, Artificial Sequence
  Synthetic
tctcugagacagacagggaucag

SEQ ID NO: 69717 - DNA, 23 bp, Artificial Sequence
  Synthetic
aaccaggaaaaaugcccaaagug

SEQ ID NO: 69718 - DNA, 28 bp, Artificial Sequence
  Synthetic
cttggtcttttuacagtactgagtggua

SEQ ID NO: 69719 - DNA, 22 bp, Artificial Sequence
  Synthetic
gaggaucaguaacaaggcgaca

SEQ ID NO: 69720 - DNA, 17 bp, Artificial Sequence
  Synthetic
ccaccccacgucaugct

SEQ ID NO: 69721 - DNA, 18 bp, Artificial Sequence
  Synthetic
cggtggcugctgttguct

SEQ ID NO: 69722 - DNA, 24 bp, Artificial Sequence
  Synthetic
ccaaccacgutgacaaaaacauga

SEQ ID NO: 69723 - DNA, 23 bp, Artificial Sequence
  Synthetic
tcttctucagcgcttctcttucc

SEQ ID NO: 69724 - DNA, 26 bp, Artificial Sequence
  Synthetic
ttgttgaaaaaugcatgtgtgtguct

SEQ ID NO: 69725 - DNA, 28 bp, Artificial Sequence
  Synthetic
aatcgttgatcgacauactagagagcua

SEQ ID NO: 69726 - DNA, 22 bp, Artificial Sequence
  Synthetic
ctagcagutgcattcugaggga

SEQ ID NO: 69727 - DNA, 28 bp, Artificial Sequence
  Synthetic
agaagagatagaugctgaaaacgaaugg

SEQ ID NO: 69728 - DNA, 29 bp, Artificial Sequence
  Synthetic
gctcacactaucagctaattcatctctua

SEQ ID NO: 69729 - DNA, 27 bp, Artificial Sequence
  Synthetic
tgaactaaggccaaguaaagaggatug

SEQ ID NO: 69730 - DNA, 28 bp, Artificial Sequence
  Synthetic
tgtctgatgcacaauagctttcattcua

SEQ ID NO: 69731 - DNA, 23 bp, Artificial Sequence
  Synthetic
aggacacttauggctgcgttuaa

SEQ ID NO: 69732 - DNA, 20 bp, Artificial Sequence
  Synthetic
gcatctucgggcaggaugag

SEQ ID NO: 69733 - DNA, 22 bp, Artificial Sequence
  Synthetic
tgtgtagccugagtcacctgua

SEQ ID NO: 69734 - DNA, 20 bp, Artificial Sequence
  Synthetic
ctgcaaugggtaucccaacc

SEQ ID NO: 69735 - DNA, 19 bp, Artificial Sequence
  Synthetic
gccgacgucgtccttauca

SEQ ID NO: 69736 - DNA, 23 bp, Artificial Sequence
  Synthetic
accaccaggaugaccagagaaua

SEQ ID NO: 69737 - DNA, 22 bp, Artificial Sequence
  Synthetic
tgaactctccuccctactugct

SEQ ID NO: 69738 - DNA, 21 bp, Artificial Sequence
  Synthetic
gaaaatccucctggugggagt

SEQ ID NO: 69739 - DNA, 20 bp, Artificial Sequence
  Synthetic
cgaccaggugacctttugct

SEQ ID NO: 69740 - DNA, 21 bp, Artificial Sequence
  Synthetic
gaagcuggccagtatcgauct

SEQ ID NO: 69741 - DNA, 27 bp, Artificial Sequence
  Synthetic
cccacaatttagugcttcagagtttut

SEQ ID NO: 69742 - DNA, 24 bp, Artificial Sequence
  Synthetic
ccctgatctaautgtgccctctut

SEQ ID NO: 69743 - DNA, 22 bp, Artificial Sequence
  Synthetic
acctgaaguacttgccacucag

SEQ ID NO: 69744 - DNA, 22 bp, Artificial Sequence
  Synthetic
tcctcttucaacacctcucgga

SEQ ID NO: 69745 - DNA, 24 bp, Artificial Sequence
  Synthetic
gtgaaacutgcgcaaugaagaaac

SEQ ID NO: 69746 - DNA, 21 bp, Artificial Sequence
  Synthetic
cccuacacacactctugacca

SEQ ID NO: 69747 - DNA, 23 bp, Artificial Sequence
  Synthetic
ttgaagggagcggaugctttuat

SEQ ID NO: 69748 - DNA, 21 bp, Artificial Sequence
  Synthetic
tgccttguacgtgaagaugcc

SEQ ID NO: 69749 - DNA, 28 bp, Artificial Sequence
  Synthetic
ggctctaagtttutgcttgaggttaaut

SEQ ID NO: 69750 - DNA, 20 bp, Artificial Sequence
  Synthetic
gggagaaggucagccaugac

SEQ ID NO: 69751 - DNA, 22 bp, Artificial Sequence
  Synthetic
gagagggaaaucggctctucaa

SEQ ID NO: 69752 - DNA, 20 bp, Artificial Sequence
  Synthetic
cutctcacugcccaccagaa

SEQ ID NO: 69753 - DNA, 17 bp, Artificial Sequence
  Synthetic
gcggccugtctgtcuca

SEQ ID NO: 69754 - DNA, 19 bp, Artificial Sequence
  Synthetic
tgcuggtcttcuccaccga

SEQ ID NO: 69755 - DNA, 26 bp, Artificial Sequence
  Synthetic
ctataggaguagttggugacagcaaa

SEQ ID NO: 69756 - DNA, 19 bp, Artificial Sequence
  Synthetic
cccaacacagugcctguct

SEQ ID NO: 69757 - DNA, 19 bp, Artificial Sequence
  Synthetic
gcucucagcaaccccaacc

SEQ ID NO: 69758 - DNA, 21 bp, Artificial Sequence
  Synthetic
gcuggaaggucaccaacaaca

SEQ ID NO: 69759 - DNA, 22 bp, Artificial Sequence
  Synthetic
gttcauagcaccaucagcacag

SEQ ID NO: 69760 - DNA, 20 bp, Artificial Sequence
  Synthetic
gcagacgcugaaggcatcut

SEQ ID NO: 69761 - DNA, 21 bp, Artificial Sequence
  Synthetic
gggugaaggaaaggacaggug

SEQ ID NO: 69762 - DNA, 21 bp, Artificial Sequence
  Synthetic
ctuagcacccacauggaccaa

SEQ ID NO: 69763 - DNA, 21 bp, Artificial Sequence
  Synthetic
ggtgcaaggauggagtagcug

SEQ ID NO: 69764 - DNA, 21 bp, Artificial Sequence
  Synthetic
ggactggaaguaggacugcac

SEQ ID NO: 69765 - DNA, 25 bp, Artificial Sequence
  Synthetic
gccctuacaacaaaaacaagagcut

SEQ ID NO: 69766 - DNA, 20 bp, Artificial Sequence
  Synthetic
gccucaaaccctagaucgca

SEQ ID NO: 69767 - DNA, 24 bp, Artificial Sequence
  Synthetic
ttcagttucaaggcctcgattuct

SEQ ID NO: 69768 - DNA, 21 bp, Artificial Sequence
  Synthetic
ccccaucctaagtccucacga

SEQ ID NO: 69769 - DNA, 21 bp, Artificial Sequence
  Synthetic
agggtucccaagtcactcuct

SEQ ID NO: 69770 - DNA, 21 bp, Artificial Sequence
  Synthetic
gctccuggagctcatccucat

SEQ ID NO: 69771 - DNA, 22 bp, Artificial Sequence
  Synthetic
tgttaatcccugagccctgtuc

SEQ ID NO: 69772 - DNA, 22 bp, Artificial Sequence
  Synthetic
gtcagaggutgcagaaaacucc

SEQ ID NO: 69773 - DNA, 23 bp, Artificial Sequence
  Synthetic
tgaatgttugggctgatgugagt

SEQ ID NO: 69774 - DNA, 21 bp, Artificial Sequence
  Synthetic
ctccagaccccutgtgugaag

SEQ ID NO: 69775 - DNA, 21 bp, Artificial Sequence
  Synthetic
caaactgcugcctacctugag

SEQ ID NO: 69776 - DNA, 21 bp, Artificial Sequence
  Synthetic
cuggaagaagccccuagacat

SEQ ID NO: 69777 - DNA, 20 bp, Artificial Sequence
  Synthetic
cacgttgacautcgccugag

SEQ ID NO: 69778 - DNA, 21 bp, Artificial Sequence
  Synthetic
gaggagugccucagagaaacc

SEQ ID NO: 69779 - DNA, 20 bp, Artificial Sequence
  Synthetic
agggccugagaggacaagut

SEQ ID NO: 69780 - DNA, 23 bp, Artificial Sequence
  Synthetic
cttcugcaggagacagaactuga

SEQ ID NO: 69781 - DNA, 21 bp, Artificial Sequence
  Synthetic
acctcgtgutccaagcatuga

SEQ ID NO: 69782 - DNA, 22 bp, Artificial Sequence
  Synthetic
ggtgggcauacagcaatggtua

SEQ ID NO: 69783 - DNA, 20 bp, Artificial Sequence
  Synthetic
ccccttaccutgcctctguc

SEQ ID NO: 69784 - DNA, 21 bp, Artificial Sequence
  Synthetic
ggtcaggagcacauaggaugg

SEQ ID NO: 69785 - DNA, 27 bp, Artificial Sequence
  Synthetic
tgacttcttcttcutcgtcaatgacut

SEQ ID NO: 69786 - DNA, 24 bp, Artificial Sequence
  Synthetic
tctcagcaagaaagucgatgtcuc

SEQ ID NO: 69787 - DNA, 22 bp, Artificial Sequence
  Synthetic
ggctttctuccagcctttucct

SEQ ID NO: 69788 - DNA, 19 bp, Artificial Sequence
  Synthetic
agcccaccauggtcagtuc

SEQ ID NO: 69789 - DNA, 25 bp, Artificial Sequence
  Synthetic
gtgataaactcuttacgtgggcugt

SEQ ID NO: 69790 - DNA, 23 bp, Artificial Sequence
  Synthetic
cgtctgcucggcgaatttctuat

SEQ ID NO: 69791 - DNA, 19 bp, Artificial Sequence
  Synthetic
gcugaagcagucggcagag

SEQ ID NO: 69792 - DNA, 21 bp, Artificial Sequence
  Synthetic
gcaacagaugagacggugagg

SEQ ID NO: 69793 - DNA, 20 bp, Artificial Sequence
  Synthetic
ctgcaccaguccaucgaaga

SEQ ID NO: 69794 - DNA, 27 bp, Artificial Sequence
  Synthetic
acaaaaggaacggaaaguguaaaaacc

SEQ ID NO: 69795 - DNA, 26 bp, Artificial Sequence
  Synthetic
tcgagtttacuttgctttcctugagt

SEQ ID NO: 69796 - DNA, 20 bp, Artificial Sequence
  Synthetic
gctgccuggctaaggtgtuc

SEQ ID NO: 69797 - DNA, 22 bp, Artificial Sequence
  Synthetic
augtagtgaagtucggcacact

SEQ ID NO: 69798 - DNA, 21 bp, Artificial Sequence
  Synthetic
gccttctgcauccactgcuac

SEQ ID NO: 69799 - DNA, 21 bp, Artificial Sequence
  Synthetic
gacccucaccaggatctugaa

SEQ ID NO: 69800 - DNA, 18 bp, Artificial Sequence
  Synthetic
cacaagcgguccgaaguc

SEQ ID NO: 69801 - DNA, 20 bp, Artificial Sequence
  Synthetic
agatcaacucgagcgccauc

SEQ ID NO: 69802 - DNA, 22 bp, Artificial Sequence
  Synthetic
tuccccaccaaaatucaagggt

SEQ ID NO: 69803 - DNA, 26 bp, Artificial Sequence
  Synthetic
gaacttccttcutcattctgcagtug

SEQ ID NO: 69804 - DNA, 23 bp, Artificial Sequence
  Synthetic
gaccagaaaauccaaggcccaua

SEQ ID NO: 69805 - DNA, 21 bp, Artificial Sequence
  Synthetic
ccutcggcttauccaggacag

SEQ ID NO: 69806 - DNA, 22 bp, Artificial Sequence
  Synthetic
ggatctatccugtctgccucct

SEQ ID NO: 69807 - DNA, 20 bp, Artificial Sequence
  Synthetic
atgccctggugagctatguc

SEQ ID NO: 69808 - DNA, 20 bp, Artificial Sequence
  Synthetic
cccugagctgguccaaaagg

SEQ ID NO: 69809 - DNA, 21 bp, Artificial Sequence
  Synthetic
tgctgauccttcaggugagga

SEQ ID NO: 69810 - DNA, 20 bp, Artificial Sequence
  Synthetic
actggaaccccuggagcaua

SEQ ID NO: 69811 - DNA, 25 bp, Artificial Sequence
  Synthetic
ccggatccuagatgcaaagaguaag

SEQ ID NO: 69812 - DNA, 18 bp, Artificial Sequence
  Synthetic
cgucccccaggcttugag

SEQ ID NO: 69813 - DNA, 23 bp, Artificial Sequence
  Synthetic
aatctaggacacagucccugaca

SEQ ID NO: 69814 - DNA, 19 bp, Artificial Sequence
  Synthetic
aagtggcgauctccacguc

SEQ ID NO: 69815 - DNA, 22 bp, Artificial Sequence
  Synthetic
aaccccactcucctcctttcua

SEQ ID NO: 69816 - DNA, 25 bp, Artificial Sequence
  Synthetic
catttcttccgguaagctgaucaac

SEQ ID NO: 69817 - DNA, 28 bp, Artificial Sequence
  Synthetic
gcttggcaaugaaaataggaaaatgcut

SEQ ID NO: 69818 - DNA, 27 bp, Artificial Sequence
  Synthetic
tcautctgaagguaaccaaacacaaca

SEQ ID NO: 69819 - DNA, 29 bp, Artificial Sequence
  Synthetic
tcatttctaattaccgutttcctgtccut

SEQ ID NO: 69820 - DNA, 24 bp, Artificial Sequence
  Synthetic
agaagtcattugggctctcttugt

SEQ ID NO: 69821 - DNA, 22 bp, Artificial Sequence
  Synthetic
gctgatcaauggttccttuggg

SEQ ID NO: 69822 - DNA, 21 bp, Artificial Sequence
  Synthetic
ccagggctuctccgagaaaut

SEQ ID NO: 69823 - DNA, 22 bp, Artificial Sequence
  Synthetic
cgggttgucctctttacacugt

SEQ ID NO: 69824 - DNA, 25 bp, Artificial Sequence
  Synthetic
tttcagcagugtcataagtauggct

SEQ ID NO: 69825 - DNA, 21 bp, Artificial Sequence
  Synthetic
cgttttgguttgaggcaugga

SEQ ID NO: 69826 - DNA, 23 bp, Artificial Sequence
  Synthetic
cuccttctagtugaaacgagcca

SEQ ID NO: 69827 - DNA, 26 bp, Artificial Sequence
  Synthetic
ttattccggaacucatccacatctuc

SEQ ID NO: 69828 - DNA, 19 bp, Artificial Sequence
  Synthetic
cgcuacgagggtcagtuct

SEQ ID NO: 69829 - DNA, 20 bp, Artificial Sequence
  Synthetic
ggtccugacgggaaagucat

SEQ ID NO: 69830 - DNA, 21 bp, Artificial Sequence
  Synthetic
gggtgttgaagugggtctcug

SEQ ID NO: 69831 - DNA, 24 bp, Artificial Sequence
  Synthetic
cagccagtugaaatggatctucct

SEQ ID NO: 69832 - DNA, 20 bp, Artificial Sequence
  Synthetic
caggaaaugcagcgcaucaa

SEQ ID NO: 69833 - DNA, 22 bp, Artificial Sequence
  Synthetic
cagctugaggacaactgctgua

SEQ ID NO: 69834 - DNA, 22 bp, Artificial Sequence
  Synthetic
cagttccaacccaaaugcctut

SEQ ID NO: 69835 - DNA, 21 bp, Artificial Sequence
  Synthetic
gtgctaguccactggcttcug

SEQ ID NO: 69836 - DNA, 22 bp, Artificial Sequence
  Synthetic
gacgtagguagtgctugagacc

SEQ ID NO: 69837 - DNA, 25 bp, Artificial Sequence
  Synthetic
agagucaaggaacacggauaaagac

SEQ ID NO: 69838 - DNA, 24 bp, Artificial Sequence
  Synthetic
catcagagagucctcctggagaut

SEQ ID NO: 69839 - DNA, 20 bp, Artificial Sequence
  Synthetic
gggaugcagctcgtuaccac

SEQ ID NO: 69840 - DNA, 24 bp, Artificial Sequence
  Synthetic
cuaatgatggugaagcagaaagcc

SEQ ID NO: 69841 - DNA, 23 bp, Artificial Sequence
  Synthetic
tcaccctuaggcatcatcctuct

SEQ ID NO: 69842 - DNA, 23 bp, Artificial Sequence
  Synthetic
ccccagacuggacagacagaaua

SEQ ID NO: 69843 - DNA, 23 bp, Artificial Sequence
  Synthetic
ggtgaggcutatgggctttuact

SEQ ID NO: 69844 - DNA, 23 bp, Artificial Sequence
  Synthetic
gcatgagtcuggaggaccactua

SEQ ID NO: 69845 - DNA, 24 bp, Artificial Sequence
  Synthetic
ggagcttctggutgtccttcttuc

SEQ ID NO: 69846 - DNA, 21 bp, Artificial Sequence
  Synthetic
gcagatauggcagcugagcaa

SEQ ID NO: 69847 - DNA, 21 bp, Artificial Sequence
  Synthetic
cttggctuccatgacaccuga

SEQ ID NO: 69848 - DNA, 27 bp, Artificial Sequence
  Synthetic
ccaggagtuaagttttgattguccaga

SEQ ID NO: 69849 - DNA, 27 bp, Artificial Sequence
  Synthetic
cagggatactugttctgtgaactuagt

SEQ ID NO: 69850 - DNA, 20 bp, Artificial Sequence
  Synthetic
ctgtgcccgcguatactuct

SEQ ID NO: 69851 - DNA, 19 bp, Artificial Sequence
  Synthetic
ccacaaggucggcacucac

SEQ ID NO: 69852 - DNA, 20 bp, Artificial Sequence
  Synthetic
agaaccagguctccguggat

SEQ ID NO: 69853 - DNA, 19 bp, Artificial Sequence
  Synthetic
gcagaacacaggccucguc

SEQ ID NO: 69854 - DNA, 23 bp, Artificial Sequence
  Synthetic
atctgtgagcauctgtgctugaa

SEQ ID NO: 69855 - DNA, 20 bp, Artificial Sequence
  Synthetic
cctagggucacgatcuccca

SEQ ID NO: 69856 - DNA, 19 bp, Artificial Sequence
  Synthetic
ccagcuacgccggacaaua

SEQ ID NO: 69857 - DNA, 25 bp, Artificial Sequence
  Synthetic
aagatattugagaagcatgcuccga

SEQ ID NO: 69858 - DNA, 23 bp, Artificial Sequence
  Synthetic
gggatgacaucattggctactuc

SEQ ID NO: 69859 - DNA, 19 bp, Artificial Sequence
  Synthetic
gcagugaggaccccaccua

SEQ ID NO: 69860 - DNA, 23 bp, Artificial Sequence
  Synthetic
ccccaacacacaaagutctctuc

SEQ ID NO: 69861 - DNA, 23 bp, Artificial Sequence
  Synthetic
gtggcagccugaattatgaucct

SEQ ID NO: 69862 - DNA, 22 bp, Artificial Sequence
  Synthetic
cccttcctugccctcttucaat

SEQ ID NO: 69863 - DNA, 24 bp, Artificial Sequence
  Synthetic
cagaatcttucctctttccuggct

SEQ ID NO: 69864 - DNA, 20 bp, Artificial Sequence
  Synthetic
gcaccaaaccggutccugaa

SEQ ID NO: 69865 - DNA, 19 bp, Artificial Sequence
  Synthetic
ccagctucacctccgtguc

SEQ ID NO: 69866 - DNA, 25 bp, Artificial Sequence
  Synthetic
acagctgtttucacaaaacgauact

SEQ ID NO: 69867 - DNA, 28 bp, Artificial Sequence
  Synthetic
tcaacagaugctgatcaacuaaaggaaa

SEQ ID NO: 69868 - DNA, 26 bp, Artificial Sequence
  Synthetic
ctaattggctcuttagccgttcuact

SEQ ID NO: 69869 - DNA, 25 bp, Artificial Sequence
  Synthetic
acatcaggctucaagaaaaccauga

SEQ ID NO: 69870 - DNA, 28 bp, Artificial Sequence
  Synthetic
tgcagtttagaugtaattgacuccaact

SEQ ID NO: 69871 - DNA, 28 bp, Artificial Sequence
  Synthetic
gccactgtgtuaaaactttgcttaguaa

SEQ ID NO: 69872 - DNA, 26 bp, Artificial Sequence
  Synthetic
acatcaggatcuttctgcatttccut

SEQ ID NO: 69873 - DNA, 28 bp, Artificial Sequence
  Synthetic
atctgatcatccaaugagaaaactgugt

SEQ ID NO: 69874 - DNA, 29 bp, Artificial Sequence
  Synthetic
tccttgagaaatgutttcagttaggtuca

SEQ ID NO: 69875 - DNA, 28 bp, Artificial Sequence
  Synthetic
gctatgtagaatuttggagggatttugg

SEQ ID NO: 69876 - DNA, 20 bp, Artificial Sequence
  Synthetic
gggcgggaggaaucaauagt

SEQ ID NO: 69877 - DNA, 25 bp, Artificial Sequence
  Synthetic
cttgaacuaggaacagccattccut

SEQ ID NO: 69878 - DNA, 21 bp, Artificial Sequence
  Synthetic
gctgacccaaccautgcttuc

SEQ ID NO: 69879 - DNA, 23 bp, Artificial Sequence
  Synthetic
tgaggtagcggaugaactgttuc

SEQ ID NO: 69880 - DNA, 25 bp, Artificial Sequence
  Synthetic
aagacgcaagacutacaatgcatuc

SEQ ID NO: 69881 - DNA, 21 bp, Artificial Sequence
  Synthetic
agcugccaucaagagcaaagt

SEQ ID NO: 69882 - DNA, 28 bp, Artificial Sequence
  Synthetic
ctagagagtaccguaatgggttaatugg

SEQ ID NO: 69883 - DNA, 22 bp, Artificial Sequence
  Synthetic
catcacttcugcctctggguag

SEQ ID NO: 69884 - DNA, 18 bp, Artificial Sequence
  Synthetic
cgguccgaaagctgcgua

SEQ ID NO: 69885 - DNA, 27 bp, Artificial Sequence
  Synthetic
gttttcttcccagucacgagatactut

SEQ ID NO: 69886 - DNA, 21 bp, Artificial Sequence
  Synthetic
agacaugagacugggaaggct

SEQ ID NO: 69887 - DNA, 28 bp, Artificial Sequence
  Synthetic
actgctttgtttucttgttctcattcug

SEQ ID NO: 69888 - DNA, 20 bp, Artificial Sequence
  Synthetic
ttcttgcugcagccatggua

SEQ ID NO: 69889 - DNA, 19 bp, Artificial Sequence
  Synthetic
ctgccuaggtgggctucac

SEQ ID NO: 69890 - DNA, 17 bp, Artificial Sequence
  Synthetic
gtccccgcutcgaggua

SEQ ID NO: 69891 - DNA, 17 bp, Artificial Sequence
  Synthetic
gcutctucggcgagcag

SEQ ID NO: 69892 - DNA, 22 bp, Artificial Sequence
  Synthetic
ccaaaacucagcctgaccucaa

SEQ ID NO: 69893 - DNA, 21 bp, Artificial Sequence
  Synthetic
tcttcccccacugtctctcug

SEQ ID NO: 69894 - DNA, 21 bp, Artificial Sequence
  Synthetic
ccctgctccuctcactctugt

SEQ ID NO: 69895 - DNA, 24 bp, Artificial Sequence
  Synthetic
cagccaggatuatagagtctcgug

SEQ ID NO: 69896 - DNA, 21 bp, Artificial Sequence
  Synthetic
ggttcctucaagctgcccuat

SEQ ID NO: 69897 - DNA, 29 bp, Artificial Sequence
  Synthetic
acatgggaaaacauaaccttgaauaaaag

SEQ ID NO: 69898 - DNA, 23 bp, Artificial Sequence
  Synthetic
aggtctttgauttgcgtcagugt

SEQ ID NO: 69899 - DNA, 24 bp, Artificial Sequence
  Synthetic
ggagctatuccacctactgaucct

SEQ ID NO: 69900 - DNA, 22 bp, Artificial Sequence
  Synthetic
gagcugggagggaatgagatug

SEQ ID NO: 69901 - DNA, 26 bp, Artificial Sequence
  Synthetic
ctgcuatgtcttccugaaaagggaat

SEQ ID NO: 69902 - DNA, 21 bp, Artificial Sequence
  Synthetic
gggtggtgucttttcctgcua

SEQ ID NO: 69903 - DNA, 22 bp, Artificial Sequence
  Synthetic
gaacaucaccaggacuaaggca

SEQ ID NO: 69904 - DNA, 21 bp, Artificial Sequence
  Synthetic
ggctguacccatcagcaaugt

SEQ ID NO: 69905 - DNA, 22 bp, Artificial Sequence
  Synthetic
acagtctgaaaccugagggcua

SEQ ID NO: 69906 - DNA, 24 bp, Artificial Sequence
  Synthetic
agctcctacuccacttgaaaguga

SEQ ID NO: 69907 - DNA, 27 bp, Artificial Sequence
  Synthetic
acatttaatgaugagccagacgagaug

SEQ ID NO: 69908 - DNA, 22 bp, Artificial Sequence
  Synthetic
ggtgguccaggctgtacttuag

SEQ ID NO: 69909 - DNA, 21 bp, Artificial Sequence
  Synthetic
gaccugacaggacuggagaag

SEQ ID NO: 69910 - DNA, 21 bp, Artificial Sequence
  Synthetic
ggacccccaggauatgtgugt

SEQ ID NO: 69911 - DNA, 21 bp, Artificial Sequence
  Synthetic
tgactgaauccctctccuggt

SEQ ID NO: 69912 - DNA, 21 bp, Artificial Sequence
  Synthetic
gacccugacggagaacaaguc

SEQ ID NO: 69913 - DNA, 22 bp, Artificial Sequence
  Synthetic
gcactgcccugaactttctcut

SEQ ID NO: 69914 - DNA, 21 bp, Artificial Sequence
  Synthetic
ggagggutgcccatugaaaca

SEQ ID NO: 69915 - DNA, 24 bp, Artificial Sequence
  Synthetic
tgactccacucttttctgagguct

SEQ ID NO: 69916 - DNA, 20 bp, Artificial Sequence
  Synthetic
ggcctcutccaaaccugagt

SEQ ID NO: 69917 - DNA, 22 bp, Artificial Sequence
  Synthetic
tgaaaaggcuatcaugcagcca

SEQ ID NO: 69918 - DNA, 21 bp, Artificial Sequence
  Synthetic
cccaatgguccctaactucct

SEQ ID NO: 69919 - DNA, 22 bp, Artificial Sequence
  Synthetic
ctccctgatucctgagcttuct

SEQ ID NO: 69920 - DNA, 21 bp, Artificial Sequence
  Synthetic
caggtctgutacagggcucac

SEQ ID NO: 69921 - DNA, 19 bp, Artificial Sequence
  Synthetic
gacccgcuaccagtuggat

SEQ ID NO: 69922 - DNA, 21 bp, Artificial Sequence
  Synthetic
gcaggguctgcucaacagaag

SEQ ID NO: 69923 - DNA, 20 bp, Artificial Sequence
  Synthetic
tggcacggacuatgagguga

SEQ ID NO: 69924 - DNA, 20 bp, Artificial Sequence
  Synthetic
ggtcagaggcuggcagaaut

SEQ ID NO: 69925 - DNA, 24 bp, Artificial Sequence
  Synthetic
ctgggcaagauaaagtgacctcut

SEQ ID NO: 69926 - DNA, 21 bp, Artificial Sequence
  Synthetic
ctcagtctggutgctgggaua

SEQ ID NO: 69927 - DNA, 21 bp, Artificial Sequence
  Synthetic
ccaaccugcaggcaaatgtuc

SEQ ID NO: 69928 - DNA, 21 bp, Artificial Sequence
  Synthetic
cuccacugagaggaaggacac

SEQ ID NO: 69929 - DNA, 24 bp, Artificial Sequence
  Synthetic
tgaccacactucccttctacauca

SEQ ID NO: 69930 - DNA, 17 bp, Artificial Sequence
  Synthetic
gcctcctugcgcagcut

SEQ ID NO: 69931 - DNA, 17 bp, Artificial Sequence
  Synthetic
agcagagcgugcuggac

SEQ ID NO: 69932 - DNA, 21 bp, Artificial Sequence
  Synthetic
cctgcgugccttctagactug

SEQ ID NO: 69933 - DNA, 28 bp, Artificial Sequence
  Synthetic
tttaatttgcctuctcttctgtccugat

SEQ ID NO: 69934 - DNA, 19 bp, Artificial Sequence
  Synthetic
cagaagccgucacaguggt

SEQ ID NO: 69935 - DNA, 22 bp, Artificial Sequence
  Synthetic
gcgcagagacgcutttgaaaut

SEQ ID NO: 69936 - DNA, 21 bp, Artificial Sequence
  Synthetic
gccutaggtcuccagagagca

SEQ ID NO: 69937 - DNA, 28 bp, Artificial Sequence
  Synthetic
atgccaaacaautacaagaatggaucag

SEQ ID NO: 69938 - DNA, 23 bp, Artificial Sequence
  Synthetic
gccacatttugggaagctgttug

SEQ ID NO: 69939 - DNA, 21 bp, Artificial Sequence
  Synthetic
cggacautgtaccucgggaaa

SEQ ID NO: 69940 - DNA, 20 bp, Artificial Sequence
  Synthetic
agaagaggccaugcgtuagg

SEQ ID NO: 69941 - DNA, 28 bp, Artificial Sequence
  Synthetic
ctgcttttcatuttattaggcaguggaa

SEQ ID NO: 69942 - DNA, 23 bp, Artificial Sequence
  Synthetic
gcatggcacugtatgtgugaaag

SEQ ID NO: 69943 - DNA, 18 bp, Artificial Sequence
  Synthetic
catggugcggttcuccga

SEQ ID NO: 69944 - DNA, 21 bp, Artificial Sequence
  Synthetic
cagautcagatgguccggcaa

SEQ ID NO: 69945 - DNA, 28 bp, Artificial Sequence
  Synthetic
acctcacuagccttgtcaaaaaugaaat

SEQ ID NO: 69946 - DNA, 23 bp, Artificial Sequence
  Synthetic
ctgggccutgctgttaaatucaa

SEQ ID NO: 69947 - DNA, 31 bp, Artificial Sequence
  Synthetic
aacaagcataugcacatttttagaatuccat

SEQ ID NO: 69948 - DNA, 22 bp, Artificial Sequence
  Synthetic
cagcaaccauttttgugcccat

SEQ ID NO: 69949 - DNA, 25 bp, Artificial Sequence
  Synthetic
ggtggcattuacgaatcacttctuc

SEQ ID NO: 69950 - DNA, 18 bp, Artificial Sequence
  Synthetic
tgccgtgagutgcagcut

SEQ ID NO: 69951 - DNA, 18 bp, Artificial Sequence
  Synthetic
gccagggugcagtgucag

SEQ ID NO: 69952 - DNA, 22 bp, Artificial Sequence
  Synthetic
cugggccagaaaagtcugacaa

SEQ ID NO: 69953 - DNA, 20 bp, Artificial Sequence
  Synthetic
cccaccugctgcgattcuac

SEQ ID NO: 69954 - DNA, 27 bp, Artificial Sequence
  Synthetic
ctttacagacacuctcatcaaggauct

SEQ ID NO: 69955 - DNA, 27 bp, Artificial Sequence
  Synthetic
gaaaaactuaaagctcatctugggcat

SEQ ID NO: 69956 - DNA, 24 bp, Artificial Sequence
  Synthetic
gcatcttgtuggacttgatccuca

SEQ ID NO: 69957 - DNA, 29 bp, Artificial Sequence
  Synthetic
gctatgauacctcttgtgtugagaaaact

SEQ ID NO: 69958 - DNA, 22 bp, Artificial Sequence
  Synthetic
actgacuaccacacttgccuct

SEQ ID NO: 69959 - DNA, 28 bp, Artificial Sequence
  Synthetic
accagttgcttgauggtatatgacatut

SEQ ID NO: 69960 - DNA, 27 bp, Artificial Sequence
  Synthetic
gaagaaauaaaacaccacaagcaugga

SEQ ID NO: 69961 - DNA, 24 bp, Artificial Sequence
  Synthetic
ctcagattgugaaactgguggaag

SEQ ID NO: 69962 - DNA, 28 bp, Artificial Sequence
  Synthetic
ggtattcttacuagggcatagucaagga

SEQ ID NO: 69963 - DNA, 23 bp, Artificial Sequence
  Synthetic
ccaagaaagcacagcugatgaug

SEQ ID NO: 69964 - DNA, 22 bp, Artificial Sequence
  Synthetic
ctcttcuccccctttgucaaga

SEQ ID NO: 69965 - DNA, 20 bp, Artificial Sequence
  Synthetic
gcccaacccaaaccuggaut

SEQ ID NO: 69966 - DNA, 19 bp, Artificial Sequence
  Synthetic
cctgcccagguggtaguag

SEQ ID NO: 69967 - DNA, 21 bp, Artificial Sequence
  Synthetic
tgtgccagcauactgctctut

SEQ ID NO: 69968 - DNA, 22 bp, Artificial Sequence
  Synthetic
acagaacautgccuggaacact

SEQ ID NO: 69969 - DNA, 29 bp, Artificial Sequence
  Synthetic
ggttgggaaaauaggacatagctttagua

SEQ ID NO: 69970 - DNA, 21 bp, Artificial Sequence
  Synthetic
ggcctccuggtactuggaaga

SEQ ID NO: 69971 - DNA, 22 bp, Artificial Sequence
  Synthetic
tgtttttcggguctctgauggg

SEQ ID NO: 69972 - DNA, 21 bp, Artificial Sequence
  Synthetic
ctgccctcugacctcaatcug

SEQ ID NO: 69973 - DNA, 23 bp, Artificial Sequence
  Synthetic
ccucgtacacuaagagaccccaa

SEQ ID NO: 69974 - DNA, 24 bp, Artificial Sequence
  Synthetic
gctcagagagaaauaaagcuggac

SEQ ID NO: 69975 - DNA, 22 bp, Artificial Sequence
  Synthetic
tcccttggaaugggtaggguaa

SEQ ID NO: 69976 - DNA, 22 bp, Artificial Sequence
  Synthetic
gtggacctguacatcctcaugg

SEQ ID NO: 69977 - DNA, 25 bp, Artificial Sequence
  Synthetic
ctcaaatgtccagugtttccttcug

SEQ ID NO: 69978 - DNA, 22 bp, Artificial Sequence
  Synthetic
caagcacaacaucatccccauc

SEQ ID NO: 69979 - DNA, 22 bp, Artificial Sequence
  Synthetic
agaggtguctgagaagcuccat

SEQ ID NO: 69980 - DNA, 20 bp, Artificial Sequence
  Synthetic
gtgaggcagaucgcagagua

SEQ ID NO: 69981 - DNA, 21 bp, Artificial Sequence
  Synthetic
ggtgtagcugtaggtgcaguc

SEQ ID NO: 69982 - DNA, 22 bp, Artificial Sequence
  Synthetic
acaggctgaugctcttcctcua

SEQ ID NO: 69983 - DNA, 20 bp, Artificial Sequence
  Synthetic
ctcctugggccatcucacag

SEQ ID NO: 69984 - DNA, 29 bp, Artificial Sequence
  Synthetic
acaagacctgaucaaaagatgaaaatuct

SEQ ID NO: 69985 - DNA, 24 bp, Artificial Sequence
  Synthetic
ccagatgccutggaagaagaugat

SEQ ID NO: 69986 - DNA, 32 bp, Artificial Sequence
  Synthetic
ggttgaaaggagaagutctgtatttattatug

SEQ ID NO: 69987 - DNA, 26 bp, Artificial Sequence
  Synthetic
agccaactacauggattgtttugagt

SEQ ID NO: 69988 - DNA, 21 bp, Artificial Sequence
  Synthetic
cctcacuggccgtacatcaut

SEQ ID NO: 69989 - DNA, 21 bp, Artificial Sequence
  Synthetic
ctggugacaagcaugaccaag

SEQ ID NO: 69990 - DNA, 23 bp, Artificial Sequence
  Synthetic
cgagaagcaugaggaauggagat

SEQ ID NO: 69991 - DNA, 29 bp, Artificial Sequence
  Synthetic
gcttcaatggtcuccttactatgtaucag

SEQ ID NO: 69992 - DNA, 22 bp, Artificial Sequence
  Synthetic
ccctguggagagaggauaggag

SEQ ID NO: 69993 - DNA, 22 bp, Artificial Sequence
  Synthetic
tcctgggcucacactttctcua

SEQ ID NO: 69994 - DNA, 20 bp, Artificial Sequence
  Synthetic
tggcacccauaccctcatug

SEQ ID NO: 69995 - DNA, 27 bp, Artificial Sequence
  Synthetic
tctgacttcugacttctgtctguaact

SEQ ID NO: 69996 - DNA, 17 bp, Artificial Sequence
  Synthetic
ccctuggtgtcgucgct

SEQ ID NO: 69997 - DNA, 20 bp, Artificial Sequence
  Synthetic
gcagcaccauctccctctuc

SEQ ID NO: 69998 - DNA, 19 bp, Artificial Sequence
  Synthetic
cgaugaggcccttcugcat

SEQ ID NO: 69999 - DNA, 18 bp, Artificial Sequence
  Synthetic
cugaccgucaacgaggct

SEQ ID NO: 70000 - DNA, 18 bp, Artificial Sequence
  Synthetic
cctcagcgcucatcucca

SEQ ID NO: 70001 - DNA, 24 bp, Artificial Sequence
  Synthetic
gcagagaagaugcucaaggagaag

SEQ ID NO: 70002 - DNA, 20 bp, Artificial Sequence
  Synthetic
tctgccgguacaccttgtuc

SEQ ID NO: 70003 - DNA, 25 bp, Artificial Sequence
  Synthetic
acagtgtattttucagggtgagugt

SEQ ID NO: 70004 - DNA, 21 bp, Artificial Sequence
  Synthetic
ccuagccagaaagcggaucaa

SEQ ID NO: 70005 - DNA, 22 bp, Artificial Sequence
  Synthetic
gtgaagcuggtgaacaucagga

SEQ ID NO: 70006 - DNA, 23 bp, Artificial Sequence
  Synthetic
ctacttgccacccaucatgacut

SEQ ID NO: 70007 - DNA, 19 bp, Artificial Sequence
  Synthetic
gguctaccgucggaaggag

SEQ ID NO: 70008 - DNA, 23 bp, Artificial Sequence
  Synthetic
ccaaaaccccaaaucctcctcua

SEQ ID NO: 70009 - DNA, 21 bp, Artificial Sequence
  Synthetic
cacccctgutctgtgtccuac

SEQ ID NO: 70010 - DNA, 25 bp, Artificial Sequence
  Synthetic
ctaatutccccatgauacagccaga

SEQ ID NO: 70011 - DNA, 28 bp, Artificial Sequence
  Synthetic
caagtttctgagaaagugcttgtgauat

SEQ ID NO: 70012 - DNA, 26 bp, Artificial Sequence
  Synthetic
ttctggtccacuacttaccatctcut

SEQ ID NO: 70013 - DNA, 23 bp, Artificial Sequence
  Synthetic
gggacatcaccutttcgctttut

SEQ ID NO: 70014 - DNA, 21 bp, Artificial Sequence
  Synthetic
cacagggagaaugcaaggtuc

SEQ ID NO: 70015 - DNA, 21 bp, Artificial Sequence
  Synthetic
ggtcatccugatcgcttcugt

SEQ ID NO: 70016 - DNA, 19 bp, Artificial Sequence
  Synthetic
gaggcuggagucggagaac

SEQ ID NO: 70017 - DNA, 21 bp, Artificial Sequence
  Synthetic
cuttgcccaugaaacgcagat

SEQ ID NO: 70018 - DNA, 24 bp, Artificial Sequence
  Synthetic
ggatagtatgcutcatggcacugg

SEQ ID NO: 70019 - DNA, 28 bp, Artificial Sequence
  Synthetic
cctaactctuaagaagggctgcauaaaa

SEQ ID NO: 70020 - DNA, 21 bp, Artificial Sequence
  Synthetic
ctgcctccugaggttgtugat

SEQ ID NO: 70021 - DNA, 21 bp, Artificial Sequence
  Synthetic
gggaggcaccutagtgagtug

SEQ ID NO: 70022 - DNA, 32 bp, Artificial Sequence
  Synthetic
tggcaatatcagttuccaattcttttaactug

SEQ ID NO: 70023 - DNA, 26 bp, Artificial Sequence
  Synthetic
ataccttatctcutgccaccacttut

SEQ ID NO: 70024 - DNA, 24 bp, Artificial Sequence
  Synthetic
tgtgtggugagattttggtuccat

SEQ ID NO: 70025 - DNA, 29 bp, Artificial Sequence
  Synthetic
tgcagaaacuaaaagagaaagaatcugct

SEQ ID NO: 70026 - DNA, 29 bp, Artificial Sequence
  Synthetic
agaattgtataccugtaattgggtttcut

SEQ ID NO: 70027 - DNA, 24 bp, Artificial Sequence
  Synthetic
gatgctgauaggcaacggattcua

SEQ ID NO: 70028 - DNA, 28 bp, Artificial Sequence
  Synthetic
gauatttcagagauccagacaaaccact

SEQ ID NO: 70029 - DNA, 20 bp, Artificial Sequence
  Synthetic
agcgggcugaacattgucaa

SEQ ID NO: 70030 - DNA, 26 bp, Artificial Sequence
  Synthetic
tttttcacaaactucagcctccatug

SEQ ID NO: 70031 - DNA, 28 bp, Artificial Sequence
  Synthetic
ctcttcagatggautcggatgaaaugaa

SEQ ID NO: 70032 - DNA, 28 bp, Artificial Sequence
  Synthetic
tctatttcccugagacaaagtcauacca

SEQ ID NO: 70033 - DNA, 26 bp, Artificial Sequence
  Synthetic
ttttagttggcucttcgaaaugagga

SEQ ID NO: 70034 - DNA, 28 bp, Artificial Sequence
  Synthetic
aaaacgaagtgcuaaaatgtctctcuct

SEQ ID NO: 70035 - DNA, 23 bp, Artificial Sequence
  Synthetic
aucttaccaucagcacaccaaca

SEQ ID NO: 70036 - DNA, 18 bp, Artificial Sequence
  Synthetic
gaggcgugacacgtctuc

SEQ ID NO: 70037 - DNA, 20 bp, Artificial Sequence
  Synthetic
aggaaaucccatcggugcat

SEQ ID NO: 70038 - DNA, 22 bp, Artificial Sequence
  Synthetic
gggaaaugagaggcaagtucca

SEQ ID NO: 70039 - DNA, 23 bp, Artificial Sequence
  Synthetic
gtgtgagugcgagttctttctuc

SEQ ID NO: 70040 - DNA, 23 bp, Artificial Sequence
  Synthetic
ggaaagcugcaataaagugccat

SEQ ID NO: 70041 - DNA, 28 bp, Artificial Sequence
  Synthetic
caggactgtccautctaaatctcatcut

SEQ ID NO: 70042 - DNA, 21 bp, Artificial Sequence
  Synthetic
caagcucaggacatgccucaa

SEQ ID NO: 70043 - DNA, 22 bp, Artificial Sequence
  Synthetic
ccatugaaggcatgatcuccca

SEQ ID NO: 70044 - DNA, 26 bp, Artificial Sequence
  Synthetic
tgttgttcttatuctgaagcagguga

SEQ ID NO: 70045 - DNA, 27 bp, Artificial Sequence
  Synthetic
tcagtgctgaaugggataatgtcatut

SEQ ID NO: 70046 - DNA, 25 bp, Artificial Sequence
  Synthetic
caucaaaattggtucacacccagaa

SEQ ID NO: 70047 - DNA, 22 bp, Artificial Sequence
  Synthetic
aagggaatcutgccaatguggt

SEQ ID NO: 70048 - DNA, 21 bp, Artificial Sequence
  Synthetic
ggccaggguagctctttucaa

SEQ ID NO: 70049 - DNA, 27 bp, Artificial Sequence
  Synthetic
ggattgtgtgtuctgtcctcattguat

SEQ ID NO: 70050 - DNA, 21 bp, Artificial Sequence
  Synthetic
ggucaggaggctgucaaagag

SEQ ID NO: 70051 - DNA, 22 bp, Artificial Sequence
  Synthetic
cgtctucagtgcccuggaaaat

SEQ ID NO: 70052 - DNA, 21 bp, Artificial Sequence
  Synthetic
tgaagacccccugctttgtuc

SEQ ID NO: 70053 - DNA, 28 bp, Artificial Sequence
  Synthetic
ggttcttgtcauccctaactagtttcut

SEQ ID NO: 70054 - DNA, 21 bp, Artificial Sequence
  Synthetic
gctgctgaagcuctggaagug

SEQ ID NO: 70055 - DNA, 24 bp, Artificial Sequence
  Synthetic
tgctgacauctgttttctgtucct

SEQ ID NO: 70056 - DNA, 20 bp, Artificial Sequence
  Synthetic
ccattcgugctgcuagacac

SEQ ID NO: 70057 - DNA, 20 bp, Artificial Sequence
  Synthetic
ggtccauggcgattgtcuca

SEQ ID NO: 70058 - DNA, 20 bp, Artificial Sequence
  Synthetic
ggtgagggugggagtcttuc

SEQ ID NO: 70059 - DNA, 23 bp, Artificial Sequence
  Synthetic
cggcacacuacttcttgcaugat

SEQ ID NO: 70060 - DNA, 21 bp, Artificial Sequence
  Synthetic
caggcaccugtcgagtgtauc

SEQ ID NO: 70061 - DNA, 21 bp, Artificial Sequence
  Synthetic
gctgtcucaggttgcugacaa

SEQ ID NO: 70062 - DNA, 19 bp, Artificial Sequence
  Synthetic
gagggccaagacucacugg

SEQ ID NO: 70063 - DNA, 20 bp, Artificial Sequence
  Synthetic
accaaaggucgctacugcat

SEQ ID NO: 70064 - DNA, 21 bp, Artificial Sequence
  Synthetic
accttgttccucaggtccuca

SEQ ID NO: 70065 - DNA, 20 bp, Artificial Sequence
  Synthetic
ggcagugagaaggugaccat

SEQ ID NO: 70066 - DNA, 20 bp, Artificial Sequence
  Synthetic
ctgccacugacagcactcut

SEQ ID NO: 70067 - DNA, 22 bp, Artificial Sequence
  Synthetic
ggcaggaaagaaggauctggut

SEQ ID NO: 70068 - DNA, 27 bp, Artificial Sequence
  Synthetic
tgggtugatagacagtugaagaaacag

SEQ ID NO: 70069 - DNA, 23 bp, Artificial Sequence
  Synthetic
ccagcagugacaagtgtaatugt

SEQ ID NO: 70070 - DNA, 23 bp, Artificial Sequence
  Synthetic
atcctgacucacagccaagttut

SEQ ID NO: 70071 - DNA, 20 bp, Artificial Sequence
  Synthetic
aagaactgugagcggtguca

SEQ ID NO: 70072 - DNA, 22 bp, Artificial Sequence
  Synthetic
agggactauggtgagacugcat

SEQ ID NO: 70073 - DNA, 20 bp, Artificial Sequence
  Synthetic
tccctgaggucagaggucac

SEQ ID NO: 70074 - DNA, 21 bp, Artificial Sequence
  Synthetic
cccaggaucacagctgaguct

SEQ ID NO: 70075 - DNA, 20 bp, Artificial Sequence
  Synthetic
ggcgggacucacactcttut

SEQ ID NO: 70076 - DNA, 22 bp, Artificial Sequence
  Synthetic
cttcacccuggatggtgacaut

SEQ ID NO: 70077 - DNA, 21 bp, Artificial Sequence
  Synthetic
ccactgatucccctcacugat

SEQ ID NO: 70078 - DNA, 20 bp, Artificial Sequence
  Synthetic
gctccuggatgtugggacat

SEQ ID NO: 70079 - DNA, 21 bp, Artificial Sequence
  Synthetic
gagaaggcucaguccagacac

SEQ ID NO: 70080 - DNA, 22 bp, Artificial Sequence
  Synthetic
ggcattuggaaacaggcttgug

SEQ ID NO: 70081 - DNA, 22 bp, Artificial Sequence
  Synthetic
agctgugggcctgaaataugag

SEQ ID NO: 70082 - DNA, 22 bp, Artificial Sequence
  Synthetic
gggtctagggucctcatgugaa

SEQ ID NO: 70083 - DNA, 22 bp, Artificial Sequence
  Synthetic
tggtggccucttaccactcuat

SEQ ID NO: 70084 - DNA, 23 bp, Artificial Sequence
  Synthetic
gccctguggatggaaggauaaga

SEQ ID NO: 70085 - DNA, 22 bp, Artificial Sequence
  Synthetic
agcactgauggtctttgucacc

SEQ ID NO: 70086 - DNA, 23 bp, Artificial Sequence
  Synthetic
gcagtagtgucctcaagatgcug

SEQ ID NO: 70087 - DNA, 24 bp, Artificial Sequence
  Synthetic
caagctattugctgtggguaagga

SEQ ID NO: 70088 - DNA, 22 bp, Artificial Sequence
  Synthetic
ccaggagccauaccatcaccua

SEQ ID NO: 70089 - DNA, 21 bp, Artificial Sequence
  Synthetic
ccaagctcutccgtccttuct

SEQ ID NO: 70090 - DNA, 18 bp, Artificial Sequence
  Synthetic
catccagcuccacugcgt

SEQ ID NO: 70091 - DNA, 24 bp, Artificial Sequence
  Synthetic
tggagcugaaggagaagaagauca

SEQ ID NO: 70092 - DNA, 22 bp, Artificial Sequence
  Synthetic
tctcaccauccctcactcacut

SEQ ID NO: 70093 - DNA, 23 bp, Artificial Sequence
  Synthetic
cagatccagutgttctcaugcag

SEQ ID NO: 70094 - DNA, 25 bp, Artificial Sequence
  Synthetic
acattaccagguatggtgcttucag

SEQ ID NO: 70095 - DNA, 27 bp, Artificial Sequence
  Synthetic
ttcgataaaggcuagcttgttctgaut

SEQ ID NO: 70096 - DNA, 24 bp, Artificial Sequence
  Synthetic
ttgttctacutgttcggugagcat

SEQ ID NO: 70097 - DNA, 26 bp, Artificial Sequence
  Synthetic
ggtaaaaggcauacttguacccacaa

SEQ ID NO: 70098 - DNA, 30 bp, Artificial Sequence
  Synthetic
accttcaagcaaaauataagaacactucca

SEQ ID NO: 70099 - DNA, 27 bp, Artificial Sequence
  Synthetic
ccgtcaagaagaacuggcagataatut

SEQ ID NO: 70100 - DNA, 22 bp, Artificial Sequence
  Synthetic
gggaacagcuttccaaagucat

SEQ ID NO: 70101 - DNA, 21 bp, Artificial Sequence
  Synthetic
ccattcugcgagtuccaagag

SEQ ID NO: 70102 - DNA, 24 bp, Artificial Sequence
  Synthetic
catcaugaataaaccuccccggaa

SEQ ID NO: 70103 - DNA, 27 bp, Artificial Sequence
  Synthetic
gcatctctgtcutttgctaccctauac

SEQ ID NO: 70104 - DNA, 28 bp, Artificial Sequence
  Synthetic
agatactacttucatctctcaggauggg

SEQ ID NO: 70105 - DNA, 22 bp, Artificial Sequence
  Synthetic
aggtgatcauccggtttgctut

SEQ ID NO: 70106 - DNA, 24 bp, Artificial Sequence
  Synthetic
aacacagttgcugggtattcugaa

SEQ ID NO: 70107 - DNA, 27 bp, Artificial Sequence
  Synthetic
catcctgugtgtctaacauagaaagga

SEQ ID NO: 70108 - DNA, 23 bp, Artificial Sequence
  Synthetic
cccaatttgauggcaaacctgut

SEQ ID NO: 70109 - DNA, 22 bp, Artificial Sequence
  Synthetic
ggctatgaagguggtctggaug

SEQ ID NO: 70110 - DNA, 25 bp, Artificial Sequence
  Synthetic
tctcuggacaagatgtgaugagaca

SEQ ID NO: 70111 - DNA, 26 bp, Artificial Sequence
  Synthetic
gtaccttttgauctcatcctgtugct

SEQ ID NO: 70112 - DNA, 23 bp, Artificial Sequence
  Synthetic
ggtatccatcugagagcttgcut

SEQ ID NO: 70113 - DNA, 25 bp, Artificial Sequence
  Synthetic
cacattugagagagctctucaaggt

SEQ ID NO: 70114 - DNA, 23 bp, Artificial Sequence
  Synthetic
ctccctttuaccaatgcgttucc

SEQ ID NO: 70115 - DNA, 23 bp, Artificial Sequence
  Synthetic
ccccttccugtaccatcttucct

SEQ ID NO: 70116 - DNA, 21 bp, Artificial Sequence
  Synthetic
agtgcaacaagagcuccaugt

SEQ ID NO: 70117 - DNA, 20 bp, Artificial Sequence
  Synthetic
ctgaggaccugctcctcuct

SEQ ID NO: 70118 - DNA, 21 bp, Artificial Sequence
  Synthetic
gctgtggaguctcccacucat

SEQ ID NO: 70119 - DNA, 24 bp, Artificial Sequence
  Synthetic
cactctactagutgtgggtccuca

SEQ ID NO: 70120 - DNA, 26 bp, Artificial Sequence
  Synthetic
acagaagatccacaautcttcgcaut

SEQ ID NO: 70121 - DNA, 24 bp, Artificial Sequence
  Synthetic
ttgtgaccagutgtguagaaagca

SEQ ID NO: 70122 - DNA, 22 bp, Artificial Sequence
  Synthetic
caagaacgucatcagccugaca

SEQ ID NO: 70123 - DNA, 18 bp, Artificial Sequence
  Synthetic
tgcccagaagugcucacc

SEQ ID NO: 70124 - DNA, 20 bp, Artificial Sequence
  Synthetic
ccggcuactacacccucact

SEQ ID NO: 70125 - DNA, 20 bp, Artificial Sequence
  Synthetic
cgtcatccucaggccggaua

SEQ ID NO: 70126 - DNA, 22 bp, Artificial Sequence
  Synthetic
cccuacttugaggaggaggagt

SEQ ID NO: 70127 - DNA, 23 bp, Artificial Sequence
  Synthetic
gcaatgttcugtctcccctucat

SEQ ID NO: 70128 - DNA, 25 bp, Artificial Sequence
  Synthetic
caggatggaautgatggttacucct

SEQ ID NO: 70129 - DNA, 26 bp, Artificial Sequence
  Synthetic
gaaagagctaacuacaccatctguga

SEQ ID NO: 70130 - DNA, 21 bp, Artificial Sequence
  Synthetic
aatguaacccaaggctgugct

SEQ ID NO: 70131 - DNA, 27 bp, Artificial Sequence
  Synthetic
ggctcaatguaaatttcacagtctugt

SEQ ID NO: 70132 - DNA, 23 bp, Artificial Sequence
  Synthetic
ttcaccactautggctcagugac

SEQ ID NO: 70133 - DNA, 21 bp, Artificial Sequence
  Synthetic
tgtgtggauccccatcucgaa

SEQ ID NO: 70134 - DNA, 19 bp, Artificial Sequence
  Synthetic
ccuagaagggcagcaugga

SEQ ID NO: 70135 - DNA, 19 bp, Artificial Sequence
  Synthetic
cctttgtcugcccaacgug

SEQ ID NO: 70136 - DNA, 20 bp, Artificial Sequence
  Synthetic
ggattcaccaugccccuaca

SEQ ID NO: 70137 - DNA, 22 bp, Artificial Sequence
  Synthetic
gcattgaccautccctccctut

SEQ ID NO: 70138 - DNA, 28 bp, Artificial Sequence
  Synthetic
actatgtttctggaugcatctgtatguc

SEQ ID NO: 70139 - DNA, 23 bp, Artificial Sequence
  Synthetic
acatccaaccagugatctgtucc

SEQ ID NO: 70140 - DNA, 22 bp, Artificial Sequence
  Synthetic
tucgccctgauggaaaagaaga

SEQ ID NO: 70141 - DNA, 20 bp, Artificial Sequence
  Synthetic
gttggagttugggaccccut

SEQ ID NO: 70142 - DNA, 22 bp, Artificial Sequence
  Synthetic
tggtcagccacauggagaatug

SEQ ID NO: 70143 - DNA, 22 bp, Artificial Sequence
  Synthetic
tcaagagagccugatacccgua

SEQ ID NO: 70144 - DNA, 27 bp, Artificial Sequence
  Synthetic
aaggactatatccuatccacccatucc

SEQ ID NO: 70145 - DNA, 21 bp, Artificial Sequence
  Synthetic
gcaccccuccccactaauaac

SEQ ID NO: 70146 - DNA, 22 bp, Artificial Sequence
  Synthetic
tcggtcaggauctcgttcauct

SEQ ID NO: 70147 - DNA, 23 bp, Artificial Sequence
  Synthetic
cctactcugggaagctcatcucc

SEQ ID NO: 70148 - DNA, 22 bp, Artificial Sequence
  Synthetic
agatggacaccutctcctuggt

SEQ ID NO: 70149 - DNA, 20 bp, Artificial Sequence
  Synthetic
cccagttugagcagcucaag

SEQ ID NO: 70150 - DNA, 23 bp, Artificial Sequence
  Synthetic
caccaccgugatgatgatctuga

SEQ ID NO: 70151 - DNA, 21 bp, Artificial Sequence
  Synthetic
gctggtcuacactgacuccga

SEQ ID NO: 70152 - DNA, 17 bp, Artificial Sequence
  Synthetic
ctgcgccugtcgcttut

SEQ ID NO: 70153 - DNA, 17 bp, Artificial Sequence
  Synthetic
gaggagauccgcguggt

SEQ ID NO: 70154 - DNA, 17 bp, Artificial Sequence
  Synthetic
gaacgugggctgctgug

SEQ ID NO: 70155 - DNA, 18 bp, Artificial Sequence
  Synthetic
ccaccaaggccuctcuga

SEQ ID NO: 70156 - DNA, 20 bp, Artificial Sequence
  Synthetic
tgcagccggaugtcttugag

SEQ ID NO: 70157 - DNA, 18 bp, Artificial Sequence
  Synthetic
gatggcugagcgcgagua

SEQ ID NO: 70158 - DNA, 19 bp, Artificial Sequence
  Synthetic
cucgatctuggcccggaat

SEQ ID NO: 70159 - DNA, 20 bp, Artificial Sequence
  Synthetic
gagcuggaggactccacuct

SEQ ID NO: 70160 - DNA, 20 bp, Artificial Sequence
  Synthetic
gcgggaacucagtcaaccuc

SEQ ID NO: 70161 - DNA, 26 bp, Artificial Sequence
  Synthetic
agtctctgaagaugtctccaauggaa

SEQ ID NO: 70162 - DNA, 23 bp, Artificial Sequence
  Synthetic
actagtcaagucaccccaucaca

SEQ ID NO: 70163 - DNA, 24 bp, Artificial Sequence
  Synthetic
cuttagggaaauccacagagagca

SEQ ID NO: 70164 - DNA, 21 bp, Artificial Sequence
  Synthetic
ccacagccutcaucaccagaa

SEQ ID NO: 70165 - DNA, 20 bp, Artificial Sequence
  Synthetic
atgtccagugcagctcucag

SEQ ID NO: 70166 - DNA, 26 bp, Artificial Sequence
  Synthetic
gacuaaaacaaccaaaccaaacucca

SEQ ID NO: 70167 - DNA, 22 bp, Artificial Sequence
  Synthetic
ggcatttcgcautctgttguga

SEQ ID NO: 70168 - DNA, 19 bp, Artificial Sequence
  Synthetic
cgcucttacctuccaccca

SEQ ID NO: 70169 - DNA, 27 bp, Artificial Sequence
  Synthetic
gagagcgaagtutcagagactcttaut

SEQ ID NO: 70170 - DNA, 20 bp, Artificial Sequence
  Synthetic
gggagaaguacgagctggug

SEQ ID NO: 70171 - DNA, 21 bp, Artificial Sequence
  Synthetic
cggagacagacacuggguaga

SEQ ID NO: 70172 - DNA, 25 bp, Artificial Sequence
  Synthetic
gatccugtttgtgaaugacaccaag

SEQ ID NO: 70173 - DNA, 23 bp, Artificial Sequence
  Synthetic
tgcagctguactgcttttcucaa

SEQ ID NO: 70174 - DNA, 21 bp, Artificial Sequence
  Synthetic
ggtguggcccaagaaaaugga

SEQ ID NO: 70175 - DNA, 21 bp, Artificial Sequence
  Synthetic
tcatgccugggtagtgttugg

SEQ ID NO: 70176 - DNA, 28 bp, Artificial Sequence
  Synthetic
ctccttaattttccutagagcgatcuca

SEQ ID NO: 70177 - DNA, 24 bp, Artificial Sequence
  Synthetic
ctctcaatgcugcaactgctttut

SEQ ID NO: 70178 - DNA, 25 bp, Artificial Sequence
  Synthetic
ttcaacgacagcaucttcuaaacca

SEQ ID NO: 70179 - DNA, 32 bp, Artificial Sequence
  Synthetic
ataggcatatgtacautttcctttagactuag

SEQ ID NO: 70180 - DNA, 27 bp, Artificial Sequence
  Synthetic
tttaggaaccautgctctgaatugact

SEQ ID NO: 70181 - DNA, 28 bp, Artificial Sequence
  Synthetic
ccttcagaaugaacaactttgucaggat

SEQ ID NO: 70182 - DNA, 27 bp, Artificial Sequence
  Synthetic
tgcagaaaccugtctcaatgttuaact

SEQ ID NO: 70183 - DNA, 20 bp, Artificial Sequence
  Synthetic
atcatgaugacccggaugcc

SEQ ID NO: 70184 - DNA, 22 bp, Artificial Sequence
  Synthetic
agggcaggaugactggacauat

SEQ ID NO: 70185 - DNA, 22 bp, Artificial Sequence
  Synthetic
aagtggtctcugctcctgaaug

SEQ ID NO: 70186 - DNA, 22 bp, Artificial Sequence
  Synthetic
ccagccctucatgttccagtut

SEQ ID NO: 70187 - DNA, 28 bp, Artificial Sequence
  Synthetic
gcaggaauaacaacatgggataaaugag

SEQ ID NO: 70188 - DNA, 24 bp, Artificial Sequence
  Synthetic
cttccagagaaaugctagggugaa

SEQ ID NO: 70189 - DNA, 21 bp, Artificial Sequence
  Synthetic
ctgcacucaggattcccugat

SEQ ID NO: 70190 - DNA, 26 bp, Artificial Sequence
  Synthetic
ttttcctcaauccatgaccaacauct

SEQ ID NO: 70191 - DNA, 22 bp, Artificial Sequence
  Synthetic
ggaatcgagccuggtctcuaaa

SEQ ID NO: 70192 - DNA, 21 bp, Artificial Sequence
  Synthetic
gtctggaaacccugactugga

SEQ ID NO: 70193 - DNA, 29 bp, Artificial Sequence
  Synthetic
gccttatttagaaugacagcacagguaat

SEQ ID NO: 70194 - DNA, 23 bp, Artificial Sequence
  Synthetic
caggcagcaugacaagtacuagg

SEQ ID NO: 70195 - DNA, 28 bp, Artificial Sequence
  Synthetic
tgatctctgacutgaagtttttgtcugt

SEQ ID NO: 70196 - DNA, 28 bp, Artificial Sequence
  Synthetic
tgaactagaatgautagcataggccuca

SEQ ID NO: 70197 - DNA, 22 bp, Artificial Sequence
  Synthetic
ctggccuggagcttgaatttut

SEQ ID NO: 70198 - DNA, 24 bp, Artificial Sequence
  Synthetic
gaataagttugcaggactggctut

SEQ ID NO: 70199 - DNA, 21 bp, Artificial Sequence
  Synthetic
atgttcaagcucgaggtcugg

SEQ ID NO: 70200 - DNA, 18 bp, Artificial Sequence
  Synthetic
gtcgccuccgtgactucc

SEQ ID NO: 70201 - DNA, 19 bp, Artificial Sequence
  Synthetic
gaucactgcugcggacaga

SEQ ID NO: 70202 - DNA, 21 bp, Artificial Sequence
  Synthetic
actgucacccctctugaccat

SEQ ID NO: 70203 - DNA, 22 bp, Artificial Sequence
  Synthetic
cagcucagagaaagagcaguca

SEQ ID NO: 70204 - DNA, 21 bp, Artificial Sequence
  Synthetic
atcccctgaucctagcauggt

SEQ ID NO: 70205 - DNA, 22 bp, Artificial Sequence
  Synthetic
tccttacgttcucctccaccuc

SEQ ID NO: 70206 - DNA, 22 bp, Artificial Sequence
  Synthetic
gugtaagtacuccacccagcaa

SEQ ID NO: 70207 - DNA, 22 bp, Artificial Sequence
  Synthetic
agtcaactucttgcagcuccag

SEQ ID NO: 70208 - DNA, 21 bp, Artificial Sequence
  Synthetic
gggctacagugtggaguacca

SEQ ID NO: 70209 - DNA, 21 bp, Artificial Sequence
  Synthetic
gctttagcgcucaagggacut

SEQ ID NO: 70210 - DNA, 28 bp, Artificial Sequence
  Synthetic
gtcagtatgcguttgacttaaaatguga

SEQ ID NO: 70211 - DNA, 28 bp, Artificial Sequence
  Synthetic
tcgcgggctaucttccaaatttataaut

SEQ ID NO: 70212 - DNA, 20 bp, Artificial Sequence
  Synthetic
tcagcuggcgcttacaguag

SEQ ID NO: 70213 - DNA, 22 bp, Artificial Sequence
  Synthetic
gacccauctgcaguacacacat

SEQ ID NO: 70214 - DNA, 23 bp, Artificial Sequence
  Synthetic
gagcagcucaatgaacucaagac

SEQ ID NO: 70215 - DNA, 27 bp, Artificial Sequence
  Synthetic
aucagcaaaauacaagaaagagaccct

SEQ ID NO: 70216 - DNA, 29 bp, Artificial Sequence
  Synthetic
acacttatttucagaagaggacagatugg

SEQ ID NO: 70217 - DNA, 25 bp, Artificial Sequence
  Synthetic
ctctcaacuggaggacattcactut

SEQ ID NO: 70218 - DNA, 26 bp, Artificial Sequence
  Synthetic
cagcacaaaggucacaaagaaagaut

SEQ ID NO: 70219 - DNA, 27 bp, Artificial Sequence
  Synthetic
catgttgtcacaguctttgtccaaaut

SEQ ID NO: 70220 - DNA, 25 bp, Artificial Sequence
  Synthetic
gagatgaacaagaugaacagctgug

SEQ ID NO: 70221 - DNA, 25 bp, Artificial Sequence
  Synthetic
tctcttccagaaggcuctaatguga

SEQ ID NO: 70222 - DNA, 25 bp, Artificial Sequence
  Synthetic
cttagatttagugcccttcctgcut

SEQ ID NO: 70223 - DNA, 22 bp, Artificial Sequence
  Synthetic
ctactatgctgugtcccagcuc

SEQ ID NO: 70224 - DNA, 24 bp, Artificial Sequence
  Synthetic
caatacatgugagagccacctuct

SEQ ID NO: 70225 - DNA, 23 bp, Artificial Sequence
  Synthetic
ccatagaguccccctcctttcug

SEQ ID NO: 70226 - DNA, 19 bp, Artificial Sequence
  Synthetic
cttccugcctcucccacac

SEQ ID NO: 70227 - DNA, 21 bp, Artificial Sequence
  Synthetic
gtacagccaccagcautcuct

SEQ ID NO: 70228 - DNA, 20 bp, Artificial Sequence
  Synthetic
gugggcuacaagaaccccaa

SEQ ID NO: 70229 - DNA, 26 bp, Artificial Sequence
  Synthetic
ggttcctagcaguttgtcttcatcuc

SEQ ID NO: 70230 - DNA, 21 bp, Artificial Sequence
  Synthetic
ggccucagggagagguagaat

SEQ ID NO: 70231 - DNA, 23 bp, Artificial Sequence
  Synthetic
cgcttcaguaacttgttccccut

SEQ ID NO: 70232 - DNA, 20 bp, Artificial Sequence
  Synthetic
gctaatgcggugtggcuagt

SEQ ID NO: 70233 - DNA, 19 bp, Artificial Sequence
  Synthetic
tttgctagcccuggagcug

SEQ ID NO: 70234 - DNA, 17 bp, Artificial Sequence
  Synthetic
gagccgcugacgctgua

SEQ ID NO: 70235 - DNA, 22 bp, Artificial Sequence
  Synthetic
gcctacuccaagtaccucacct

SEQ ID NO: 70236 - DNA, 18 bp, Artificial Sequence
  Synthetic
ctccuccgcacucaggat

SEQ ID NO: 70237 - DNA, 17 bp, Artificial Sequence
  Synthetic
gcuggcgcacucagagg

SEQ ID NO: 70238 - DNA, 19 bp, Artificial Sequence
  Synthetic
aagatgagugcgcggtuct

SEQ ID NO: 70239 - DNA, 20 bp, Artificial Sequence
  Synthetic
agcaggagcugacaacacug

SEQ ID NO: 70240 - DNA, 21 bp, Artificial Sequence
  Synthetic
ggacacaacagguggugagat

SEQ ID NO: 70241 - DNA, 18 bp, Artificial Sequence
  Synthetic
agctcucgcagggcuaac

SEQ ID NO: 70242 - DNA, 23 bp, Artificial Sequence
  Synthetic
ctcctcctccuccttctcatuca

SEQ ID NO: 70243 - DNA, 18 bp, Artificial Sequence
  Synthetic
ggaccugcaguacgccaa

SEQ ID NO: 70244 - DNA, 20 bp, Artificial Sequence
  Synthetic
gtttcctucccaggcaguga

SEQ ID NO: 70245 - DNA, 20 bp, Artificial Sequence
  Synthetic
cctatagggccugagtgugg

SEQ ID NO: 70246 - DNA, 20 bp, Artificial Sequence
  Synthetic
tggtgucgcatccacugaag

SEQ ID NO: 70247 - DNA, 20 bp, Artificial Sequence
  Synthetic
acctacgtcucgtcgctgua

SEQ ID NO: 70248 - DNA, 20 bp, Artificial Sequence
  Synthetic
ggcaacacugctttcacuga

SEQ ID NO: 70249 - DNA, 19 bp, Artificial Sequence
  Synthetic
cctgtttcccuccctggug

SEQ ID NO: 70250 - DNA, 18 bp, Artificial Sequence
  Synthetic
ccauggcacgcaugacct

SEQ ID NO: 70251 - DNA, 17 bp, Artificial Sequence
  Synthetic
cgggccutctcgtggua

SEQ ID NO: 70252 - DNA, 22 bp, Artificial Sequence
  Synthetic
tggagagagucctgtaccacuc

SEQ ID NO: 70253 - DNA, 25 bp, Artificial Sequence
  Synthetic
gtttcttccccutgtgagtccatua

SEQ ID NO: 70254 - DNA, 26 bp, Artificial Sequence
  Synthetic
ggauaggattctttcugagggaagga

SEQ ID NO: 70255 - DNA, 26 bp, Artificial Sequence
  Synthetic
ctgttccaaaucacgattguaacgac

SEQ ID NO: 70256 - DNA, 27 bp, Artificial Sequence
  Synthetic
gggtcaaccaguttttcattacaaugg

SEQ ID NO: 70257 - DNA, 25 bp, Artificial Sequence
  Synthetic
atgactgtugatcaggtttugggaa

SEQ ID NO: 70258 - DNA, 23 bp, Artificial Sequence
  Synthetic
gttccatcucagccagacgaaua

SEQ ID NO: 70259 - DNA, 33 bp, Artificial Sequence
  Synthetic
accaaattaaaaatauggaataagtatggcaut

SEQ ID NO: 70260 - DNA, 28 bp, Artificial Sequence
  Synthetic
accttccattcutctacttttgcatuga

SEQ ID NO: 70261 - DNA, 28 bp, Artificial Sequence
  Synthetic
gttacatcagttugcaacaactctugaa

SEQ ID NO: 70262 - DNA, 21 bp, Artificial Sequence
  Synthetic
gctcattucagccgcctttut

SEQ ID NO: 70263 - DNA, 27 bp, Artificial Sequence
  Synthetic
cgaaggtctucagaaattcaatgacut

SEQ ID NO: 70264 - DNA, 22 bp, Artificial Sequence
  Synthetic
agutcagaaatugccacccagt

SEQ ID NO: 70265 - DNA, 27 bp, Artificial Sequence
  Synthetic
agaacatctcaatugcaatctgccaua

SEQ ID NO: 70266 - DNA, 24 bp, Artificial Sequence
  Synthetic
cugtatttcugagagagcggaagg

SEQ ID NO: 70267 - DNA, 27 bp, Artificial Sequence
  Synthetic
accatttagaaauaaccacagcctcut

SEQ ID NO: 70268 - DNA, 28 bp, Artificial Sequence
  Synthetic
ccatgggaaaagutgaagaattttggut

SEQ ID NO: 70269 - DNA, 24 bp, Artificial Sequence
  Synthetic
agcaaagcccutgttaagttugac

SEQ ID NO: 70270 - DNA, 26 bp, Artificial Sequence
  Synthetic
cagcaagaagacugaacagtacuact

SEQ ID NO: 70271 - DNA, 22 bp, Artificial Sequence
  Synthetic
cagactcccccutcagtacauc

SEQ ID NO: 70272 - DNA, 25 bp, Artificial Sequence
  Synthetic
ggaaagaaaaguccaggaaggcuat

SEQ ID NO: 70273 - DNA, 28 bp, Artificial Sequence
  Synthetic
gaagctggagaagaugatcaatactcug

SEQ ID NO: 70274 - DNA, 22 bp, Artificial Sequence
  Synthetic
agagatcgccaacaugtcacug

SEQ ID NO: 70275 - DNA, 24 bp, Artificial Sequence
  Synthetic
agttgcctccuctacaggaaauct

SEQ ID NO: 70276 - DNA, 20 bp, Artificial Sequence
  Synthetic
gcttaccgcauccacgugaa

SEQ ID NO: 70277 - DNA, 20 bp, Artificial Sequence
  Synthetic
atctcgaguctgcguggaac

SEQ ID NO: 70278 - DNA, 22 bp, Artificial Sequence
  Synthetic
gaaugccatucacaccagaagg

SEQ ID NO: 70279 - DNA, 19 bp, Artificial Sequence
  Synthetic
tgagccgcautcugaacga

SEQ ID NO: 70280 - DNA, 21 bp, Artificial Sequence
  Synthetic
gtgggaaagugcttgccttug

SEQ ID NO: 70281 - DNA, 26 bp, Artificial Sequence
  Synthetic
accctagattcauttccaccagcuat

SEQ ID NO: 70282 - DNA, 20 bp, Artificial Sequence
  Synthetic
gcagtccccaucatcccuga

SEQ ID NO: 70283 - DNA, 22 bp, Artificial Sequence
  Synthetic
tggacucactctguacccaaga

SEQ ID NO: 70284 - DNA, 25 bp, Artificial Sequence
  Synthetic
aattttcctugcaacgttagctgut

SEQ ID NO: 70285 - DNA, 27 bp, Artificial Sequence
  Synthetic
tgctctttttgcaaaugtttcactcuc

SEQ ID NO: 70286 - DNA, 27 bp, Artificial Sequence
  Synthetic
atgatggugaaggatgaatatgugcat

SEQ ID NO: 70287 - DNA, 23 bp, Artificial Sequence
  Synthetic
gcagtgctgguagcattagacuc

SEQ ID NO: 70288 - DNA, 24 bp, Artificial Sequence
  Synthetic
agaaacatttgutcactcccgugt

SEQ ID NO: 70289 - DNA, 27 bp, Artificial Sequence
  Synthetic
ctcactgagguttctgttatcttcuct

SEQ ID NO: 70290 - DNA, 22 bp, Artificial Sequence
  Synthetic
gcaataguaacccctgccaguc

SEQ ID NO: 70291 - DNA, 28 bp, Artificial Sequence
  Synthetic
agaaagtcaagtcauatcccatctccut

SEQ ID NO: 70292 - DNA, 28 bp, Artificial Sequence
  Synthetic
tgactccacuggttatgtcatcttuact

SEQ ID NO: 70293 - DNA, 23 bp, Artificial Sequence
  Synthetic
gggagagttuggagtcagcatug

SEQ ID NO: 70294 - DNA, 23 bp, Artificial Sequence
  Synthetic
atttcuccccaggcctactttuc

SEQ ID NO: 70295 - DNA, 20 bp, Artificial Sequence
  Synthetic
gatugagcgctccucagact

SEQ ID NO: 70296 - DNA, 22 bp, Artificial Sequence
  Synthetic
gctctcccugtggcagagauaa

SEQ ID NO: 70297 - DNA, 24 bp, Artificial Sequence
  Synthetic
gccattcttcucactggtcatucc

SEQ ID NO: 70298 - DNA, 20 bp, Artificial Sequence
  Synthetic
gtcagcccuggtuccaagaa

SEQ ID NO: 70299 - DNA, 18 bp, Artificial Sequence
  Synthetic
acugcttgctucgagcgt

SEQ ID NO: 70300 - DNA, 19 bp, Artificial Sequence
  Synthetic
ggtguccaccacacguagt

SEQ ID NO: 70301 - DNA, 26 bp, Artificial Sequence
  Synthetic
cccaugatgcttcaauaagacaaacc

SEQ ID NO: 70302 - DNA, 19 bp, Artificial Sequence
  Synthetic
ccttcugggccaggtugat

SEQ ID NO: 70303 - DNA, 18 bp, Artificial Sequence
  Synthetic
ggcuggcatccuggacac

SEQ ID NO: 70304 - DNA, 22 bp, Artificial Sequence
  Synthetic
gcaggtugtaggtcucgagaga

SEQ ID NO: 70305 - DNA, 24 bp, Artificial Sequence
  Synthetic
ccaaggaacgcaugatcatcauca

SEQ ID NO: 70306 - DNA, 18 bp, Artificial Sequence
  Synthetic
gtccugccctugaagcca

SEQ ID NO: 70307 - DNA, 18 bp, Artificial Sequence
  Synthetic
cgccaaggccuacaguga

SEQ ID NO: 70308 - DNA, 22 bp, Artificial Sequence
  Synthetic
ctgtagcaggcugtcctttuca

SEQ ID NO: 70309 - DNA, 21 bp, Artificial Sequence
  Synthetic
caaactgcugcagctcaaguc

SEQ ID NO: 70310 - DNA, 18 bp, Artificial Sequence
  Synthetic
ccagcutcuccgcaagca

SEQ ID NO: 70311 - DNA, 19 bp, Artificial Sequence
  Synthetic
cgagggcugaggaggaguc

SEQ ID NO: 70312 - DNA, 19 bp, Artificial Sequence
  Synthetic
gggtgauggtgtggucaga

SEQ ID NO: 70313 - DNA, 18 bp, Artificial Sequence
  Synthetic
cuaccgcgagagugcaga

SEQ ID NO: 70314 - DNA, 21 bp, Artificial Sequence
  Synthetic
tctccagguagauggcagaca

SEQ ID NO: 70315 - DNA, 19 bp, Artificial Sequence
  Synthetic
cggtgaugagtgcgtuccc

SEQ ID NO: 70316 - DNA, 17 bp, Artificial Sequence
  Synthetic
ccgugcagcccagacuc

SEQ ID NO: 70317 - DNA, 18 bp, Artificial Sequence
  Synthetic
ggaggcacugcguaggaa

SEQ ID NO: 70318 - DNA, 18 bp, Artificial Sequence
  Synthetic
ggccggugcagatagucc

SEQ ID NO: 70319 - DNA, 18 bp, Artificial Sequence
  Synthetic
atggccucggctgguaac

SEQ ID NO: 70320 - DNA, 18 bp, Artificial Sequence
  Synthetic
ggctgagugggctacguc

SEQ ID NO: 70321 - DNA, 22 bp, Artificial Sequence
  Synthetic
gatgtgctgutgagacctcugt

SEQ ID NO: 70322 - DNA, 19 bp, Artificial Sequence
  Synthetic
gcctgacgacucgtgcuat

SEQ ID NO: 70323 - DNA, 23 bp, Artificial Sequence
  Synthetic
tcauaaacatcucgggacaagcc

SEQ ID NO: 70324 - DNA, 24 bp, Artificial Sequence
  Synthetic
ccaccacccacaacutactaagug

SEQ ID NO: 70325 - DNA, 27 bp, Artificial Sequence
  Synthetic
ttgggagctgutaacccttaatucaat

SEQ ID NO: 70326 - DNA, 28 bp, Artificial Sequence
  Synthetic
tgtcagttccautcaaatctttcacuca

SEQ ID NO: 70327 - DNA, 22 bp, Artificial Sequence
  Synthetic
cagtgccaaucatccctgttuc

SEQ ID NO: 70328 - DNA, 28 bp, Artificial Sequence
  Synthetic
aacaactaaggaaggagutttaggcaut

SEQ ID NO: 70329 - DNA, 28 bp, Artificial Sequence
  Synthetic
gagtcagaugatcattgucagagagaac

SEQ ID NO: 70330 - DNA, 23 bp, Artificial Sequence
  Synthetic
aagacttcccccuctttctctut

SEQ ID NO: 70331 - DNA, 25 bp, Artificial Sequence
  Synthetic
ctggtaatttucctacctcctucgt

SEQ ID NO: 70332 - DNA, 28 bp, Artificial Sequence
  Synthetic
aagactgctgautgtacgttcatatuca

SEQ ID NO: 70333 - DNA, 33 bp, Artificial Sequence
  Synthetic
taaattgtaaatcttagguaatcaactggcaua

SEQ ID NO: 70334 - DNA, 20 bp, Artificial Sequence
  Synthetic
tttcctgtucccaggctugt

SEQ ID NO: 70335 - DNA, 28 bp, Artificial Sequence
  Synthetic
caatgtcattttguggtattggtcugaa

SEQ ID NO: 70336 - DNA, 27 bp, Artificial Sequence
  Synthetic
gacatacctccagutcattttccagut

SEQ ID NO: 70337 - DNA, 29 bp, Artificial Sequence
  Synthetic
tctagactccuattttatggatcugccat

SEQ ID NO: 70338 - DNA, 26 bp, Artificial Sequence
  Synthetic
tggattttctugcagagtcattucct

SEQ ID NO: 70339 - DNA, 22 bp, Artificial Sequence
  Synthetic
accgtgacuacacacaatuccc

SEQ ID NO: 70340 - DNA, 20 bp, Artificial Sequence
  Synthetic
cugcagaagggccctcuaag

SEQ ID NO: 70341 - DNA, 22 bp, Artificial Sequence
  Synthetic
cgtggcagucaccaaatacugt

SEQ ID NO: 70342 - DNA, 24 bp, Artificial Sequence
  Synthetic
ctttttgaacugcacauccaccag

SEQ ID NO: 70343 - DNA, 24 bp, Artificial Sequence
  Synthetic
ctgaagcctcutgaaggtagtgua

SEQ ID NO: 70344 - DNA, 21 bp, Artificial Sequence
  Synthetic
tcacugacccugcagagaaac

SEQ ID NO: 70345 - DNA, 22 bp, Artificial Sequence
  Synthetic
gattggcagagauctgcuacct

SEQ ID NO: 70346 - DNA, 20 bp, Artificial Sequence
  Synthetic
tugtauccccagccacgaag

SEQ ID NO: 70347 - DNA, 23 bp, Artificial Sequence
  Synthetic
ctttccagcaguctgtagccaut

SEQ ID NO: 70348 - DNA, 24 bp, Artificial Sequence
  Synthetic
ggatccagacauctccuaggaact

SEQ ID NO: 70349 - DNA, 21 bp, Artificial Sequence
  Synthetic
ccgucggagaaggaaggttuc

SEQ ID NO: 70350 - DNA, 20 bp, Artificial Sequence
  Synthetic
gcaaaaagaggugcggucag

SEQ ID NO: 70351 - DNA, 22 bp, Artificial Sequence
  Synthetic
cgccctuagccgtttcttugat

SEQ ID NO: 70352 - DNA, 22 bp, Artificial Sequence
  Synthetic
caggcacagaugtagctcucat

SEQ ID NO: 70353 - DNA, 23 bp, Artificial Sequence
  Synthetic
ccatagggutctctcuggagagg

SEQ ID NO: 70354 - DNA, 23 bp, Artificial Sequence
  Synthetic
gcagccatagugaaggactgtug

SEQ ID NO: 70355 - DNA, 22 bp, Artificial Sequence
  Synthetic
cagtccuacttccaguccaggt

SEQ ID NO: 70356 - DNA, 23 bp, Artificial Sequence
  Synthetic
tgaccttcgucgcttatgcauac

SEQ ID NO: 70357 - DNA, 21 bp, Artificial Sequence
  Synthetic
gtuaagggccccaacgguaaa

SEQ ID NO: 70358 - DNA, 21 bp, Artificial Sequence
  Synthetic
ctcacagtguccttccccaut

SEQ ID NO: 70359 - DNA, 23 bp, Artificial Sequence
  Synthetic
cccaccagtutcatcgagttcua

SEQ ID NO: 70360 - DNA, 21 bp, Artificial Sequence
  Synthetic
ccatggugccaaggagaagug

SEQ ID NO: 70361 - DNA, 21 bp, Artificial Sequence
  Synthetic
cgcucccagauggaggaagat

SEQ ID NO: 70362 - DNA, 20 bp, Artificial Sequence
  Synthetic
caggctgugccattgtctug

SEQ ID NO: 70363 - DNA, 22 bp, Artificial Sequence
  Synthetic
agatgtctggcugtttctggug

SEQ ID NO: 70364 - DNA, 22 bp, Artificial Sequence
  Synthetic
ccaaagggtuatagggcaccut

SEQ ID NO: 70365 - DNA, 22 bp, Artificial Sequence
  Synthetic
agtgtctgcuatctccctcucc

SEQ ID NO: 70366 - DNA, 26 bp, Artificial Sequence
  Synthetic
gaagattgggaggguttagcatuaca

SEQ ID NO: 70367 - DNA, 25 bp, Artificial Sequence
  Synthetic
caaaatatugggagggtctgtcuca

SEQ ID NO: 70368 - DNA, 21 bp, Artificial Sequence
  Synthetic
ggucacaagggccagaguaac

SEQ ID NO: 70369 - DNA, 25 bp, Artificial Sequence
  Synthetic
ggttgcaccutatactttgtcucct

SEQ ID NO: 70370 - DNA, 19 bp, Artificial Sequence
  Synthetic
gtggagtuggctgggtugt

SEQ ID NO: 70371 - DNA, 22 bp, Artificial Sequence
  Synthetic
tcctagcugacggcttttacug

SEQ ID NO: 70372 - DNA, 20 bp, Artificial Sequence
  Synthetic
gaagggttgugggctgauct

SEQ ID NO: 70373 - DNA, 21 bp, Artificial Sequence
  Synthetic
gctggaggcacuaatccctug

SEQ ID NO: 70374 - DNA, 17 bp, Artificial Sequence
  Synthetic
ctcgtgucccgggtgut

SEQ ID NO: 70375 - DNA, 17 bp, Artificial Sequence
  Synthetic
cctccucgggacucgac

SEQ ID NO: 70376 - DNA, 22 bp, Artificial Sequence
  Synthetic
tggcatcaucgatgtcgtacug

SEQ ID NO: 70377 - DNA, 22 bp, Artificial Sequence
  Synthetic
agatgtcagtguacgaggccua

SEQ ID NO: 70378 - DNA, 18 bp, Artificial Sequence
  Synthetic
cagggcuacagucagcgt

SEQ ID NO: 70379 - DNA, 17 bp, Artificial Sequence
  Synthetic
gcacagccgucccacug

SEQ ID NO: 70380 - DNA, 18 bp, Artificial Sequence
  Synthetic
gcaggcagaggucuccag

SEQ ID NO: 70381 - DNA, 19 bp, Artificial Sequence
  Synthetic
ccacucagggcctatuggt

SEQ ID NO: 70382 - DNA, 21 bp, Artificial Sequence
  Synthetic
ggagcccugctacctttctug

SEQ ID NO: 70383 - DNA, 17 bp, Artificial Sequence
  Synthetic
agagcaccgugccugag

SEQ ID NO: 70384 - DNA, 28 bp, Artificial Sequence
  Synthetic
gcaataactuaaacccagactgaagaug

SEQ ID NO: 70385 - DNA, 25 bp, Artificial Sequence
  Synthetic
agcagtctguaagaccaacattgut

SEQ ID NO: 70386 - DNA, 21 bp, Artificial Sequence
  Synthetic
gtcccagaccaguaatgccut

SEQ ID NO: 70387 - DNA, 22 bp, Artificial Sequence
  Synthetic
ttgccctcugacgtatctcuct

SEQ ID NO: 70388 - DNA, 23 bp, Artificial Sequence
  Synthetic
ctgctgtcguacagtcttuccaa

SEQ ID NO: 70389 - DNA, 23 bp, Artificial Sequence
  Synthetic
gccagagttcuttgaggctguaa

SEQ ID NO: 70390 - DNA, 22 bp, Artificial Sequence
  Synthetic
tcugcccaagguaagaagagat

SEQ ID NO: 70391 - DNA, 28 bp, Artificial Sequence
  Synthetic
gcactcagattugataaagaagttgcuc

SEQ ID NO: 70392 - DNA, 24 bp, Artificial Sequence
  Synthetic
actgtcgtcugggaactatacucc

SEQ ID NO: 70393 - DNA, 28 bp, Artificial Sequence
  Synthetic
gcaggtaaauggacaagaacactttuaa

SEQ ID NO: 70394 - DNA, 19 bp, Artificial Sequence
  Synthetic
acagccccaggcucgtaua

SEQ ID NO: 70395 - DNA, 21 bp, Artificial Sequence
  Synthetic
tcctaaccugtgcccttcuct

SEQ ID NO: 70396 - DNA, 22 bp, Artificial Sequence
  Synthetic
gtgttttgcuctccaccctuct

SEQ ID NO: 70397 - DNA, 25 bp, Artificial Sequence
  Synthetic
gaaatgctgaauaaggctgaggtug

SEQ ID NO: 70398 - DNA, 20 bp, Artificial Sequence
  Synthetic
caggagcgaucgttugcaac

SEQ ID NO: 70399 - DNA, 21 bp, Artificial Sequence
  Synthetic
gggagaacagggcugtaugga

SEQ ID NO: 70400 - DNA, 22 bp, Artificial Sequence
  Synthetic
ttggagaggucaggagatuggt

SEQ ID NO: 70401 - DNA, 21 bp, Artificial Sequence
  Synthetic
tctgagaggccgucgtcauaa

SEQ ID NO: 70402 - DNA, 22 bp, Artificial Sequence
  Synthetic
gagaccttcutcaccagcucac

SEQ ID NO: 70403 - DNA, 18 bp, Artificial Sequence
  Synthetic
ggctgucaaccgcgucat

SEQ ID NO: 70404 - DNA, 33 bp, Artificial Sequence
  Synthetic
atgctactcuagaactataaacacaauagaagt

SEQ ID NO: 70405 - DNA, 28 bp, Artificial Sequence
  Synthetic
aggcaaatuaaaagactaaccaguggat

SEQ ID NO: 70406 - DNA, 21 bp, Artificial Sequence
  Synthetic
acacgtgtugatgttcaccut

SEQ ID NO: 70407 - DNA, 18 bp, Artificial Sequence
  Synthetic
ggcacutagucgggcact

SEQ ID NO: 70408 - DNA, 28 bp, Artificial Sequence
  Synthetic
ggtcttcctcaugtttcttcacaattuc

SEQ ID NO: 70409 - DNA, 29 bp, Artificial Sequence
  Synthetic
gacatgcauaccagtctagatacauacat

SEQ ID NO: 70410 - DNA, 29 bp, Artificial Sequence
  Synthetic
gagaattaatgauactggcactagauggt

SEQ ID NO: 70411 - DNA, 27 bp, Artificial Sequence
  Synthetic
gagttgtgattcucattgctggattut

SEQ ID NO: 70412 - DNA, 22 bp, Artificial Sequence
  Synthetic
tggcttgguttgaagaagguga

SEQ ID NO: 70413 - DNA, 28 bp, Artificial Sequence
  Synthetic
cccgcaaacauatttttacucaacacat

SEQ ID NO: 70414 - DNA, 21 bp, Artificial Sequence
  Synthetic
tcugauggagaggagcacaca

SEQ ID NO: 70415 - DNA, 25 bp, Artificial Sequence
  Synthetic
agaauaaagggaagaaagucgccat

SEQ ID NO: 70416 - DNA, 25 bp, Artificial Sequence
  Synthetic
caatgtcaauacaacatgggcauct

SEQ ID NO: 70417 - DNA, 28 bp, Artificial Sequence
  Synthetic
cgatagctctcauttcacattctggtua

SEQ ID NO: 70418 - DNA, 28 bp, Artificial Sequence
  Synthetic
aagcattaagaguatcaacagtgcugaa

SEQ ID NO: 70419 - DNA, 23 bp, Artificial Sequence
  Synthetic
tgactcacugtctagctctugct

SEQ ID NO: 70420 - DNA, 25 bp, Artificial Sequence
  Synthetic
gagcagaaggcautatcacagauca

SEQ ID NO: 70421 - DNA, 24 bp, Artificial Sequence
  Synthetic
gggatttagtugagccttacguct

SEQ ID NO: 70422 - DNA, 20 bp, Artificial Sequence
  Synthetic
gaagacagaccggcugctua

SEQ ID NO: 70423 - DNA, 26 bp, Artificial Sequence
  Synthetic
gtcactaaaguacagtgtcactugct

SEQ ID NO: 70424 - DNA, 22 bp, Artificial Sequence
  Synthetic
gggatctuccagtgggatcugt

SEQ ID NO: 70425 - DNA, 21 bp, Artificial Sequence
  Synthetic
cctctgguaacgtcctctucc

SEQ ID NO: 70426 - DNA, 20 bp, Artificial Sequence
  Synthetic
tgcatcuccaggtcagcuct

SEQ ID NO: 70427 - DNA, 24 bp, Artificial Sequence
  Synthetic
tgtgatcaggaugggtgtctcaua

SEQ ID NO: 70428 - DNA, 22 bp, Artificial Sequence
  Synthetic
gatctccggugtacacaagcuc

SEQ ID NO: 70429 - DNA, 23 bp, Artificial Sequence
  Synthetic
acccacgagucttctactcacut

SEQ ID NO: 70430 - DNA, 20 bp, Artificial Sequence
  Synthetic
gcagaaccccaaugcuaagg

SEQ ID NO: 70431 - DNA, 20 bp, Artificial Sequence
  Synthetic
ccctcugaccacctgtgcua

SEQ ID NO: 70432 - DNA, 20 bp, Artificial Sequence
  Synthetic
ccaccctcugactggccuat

SEQ ID NO: 70433 - DNA, 18 bp, Artificial Sequence
  Synthetic
gagagccgggauccccua

SEQ ID NO: 70434 - DNA, 31 bp, Artificial Sequence
  Synthetic
gcataagcttgutttaaacaattccuaacct

SEQ ID NO: 70435 - DNA, 20 bp, Artificial Sequence
  Synthetic
aggctggaaugcaagcucat

SEQ ID NO: 70436 - DNA, 21 bp, Artificial Sequence
  Synthetic
gtctcgagcccugtgatucaa

SEQ ID NO: 70437 - DNA, 21 bp, Artificial Sequence
  Synthetic
gccaaggaaguccccaaguag

SEQ ID NO: 70438 - DNA, 28 bp, Artificial Sequence
  Synthetic
ccttctctcatuaggtattgcaaaugct

SEQ ID NO: 70439 - DNA, 28 bp, Artificial Sequence
  Synthetic
caggctcttttuctgcatgcaatatuat

SEQ ID NO: 70440 - DNA, 24 bp, Artificial Sequence
  Synthetic
tgugggagacagagctatugacaa

SEQ ID NO: 70441 - DNA, 23 bp, Artificial Sequence
  Synthetic
tcacagtutcctccaugcaaaca

SEQ ID NO: 70442 - DNA, 22 bp, Artificial Sequence
  Synthetic
cataatgccucaccucagcaac

SEQ ID NO: 70443 - DNA, 25 bp, Artificial Sequence
  Synthetic
gaaccacacautgattcactgtuca

SEQ ID NO: 70444 - DNA, 22 bp, Artificial Sequence
  Synthetic
gaactgcucggatctgcucaat

SEQ ID NO: 70445 - DNA, 22 bp, Artificial Sequence
  Synthetic
gaggctacugtaatcgcuaccc

SEQ ID NO: 70446 - DNA, 20 bp, Artificial Sequence
  Synthetic
ccaaaacggutggcatuccc

SEQ ID NO: 70447 - DNA, 24 bp, Artificial Sequence
  Synthetic
gacctttcaacccuctctgatucc

SEQ ID NO: 70448 - DNA, 21 bp, Artificial Sequence
  Synthetic
tgcattcauggacacccaugt

SEQ ID NO: 70449 - DNA, 20 bp, Artificial Sequence
  Synthetic
gctgcccauggtgactucag

SEQ ID NO: 70450 - DNA, 27 bp, Artificial Sequence
  Synthetic
gggagatauaggacagagtcagtaauc

SEQ ID NO: 70451 - DNA, 25 bp, Artificial Sequence
  Synthetic
gaaggtctctcaugcttcttctgut

SEQ ID NO: 70452 - DNA, 23 bp, Artificial Sequence
  Synthetic
acactcaccauctctcctttgug

SEQ ID NO: 70453 - DNA, 26 bp, Artificial Sequence
  Synthetic
tgggaatcactucttcatctgcttut

SEQ ID NO: 70454 - DNA, 21 bp, Artificial Sequence
  Synthetic
gggaacagggcucagggatua

SEQ ID NO: 70455 - DNA, 24 bp, Artificial Sequence
  Synthetic
ctccccctcaucagactcttttuc

SEQ ID NO: 70456 - DNA, 24 bp, Artificial Sequence
  Synthetic
caggaucacagagggttauagggt

SEQ ID NO: 70457 - DNA, 23 bp, Artificial Sequence
  Synthetic
ctgccaccccautttcttgttuc

SEQ ID NO: 70458 - DNA, 21 bp, Artificial Sequence
  Synthetic
cctcagagucacccugaagga

SEQ ID NO: 70459 - DNA, 28 bp, Artificial Sequence
  Synthetic
ggcttcatagtucttggctcatatttut

SEQ ID NO: 70460 - DNA, 22 bp, Artificial Sequence
  Synthetic
gaagaacccugggaagacacut

SEQ ID NO: 70461 - DNA, 22 bp, Artificial Sequence
  Synthetic
ctaaaggugagcaagccttguc

SEQ ID NO: 70462 - DNA, 20 bp, Artificial Sequence
  Synthetic
ggtctccacacucacccuct

SEQ ID NO: 70463 - DNA, 23 bp, Artificial Sequence
  Synthetic
cagcacagguctcactgatuacc

SEQ ID NO: 70464 - DNA, 22 bp, Artificial Sequence
  Synthetic
aacctcagcutgaccucagaac

SEQ ID NO: 70465 - DNA, 22 bp, Artificial Sequence
  Synthetic
cctgatctgcuccacctaccut

SEQ ID NO: 70466 - DNA, 21 bp, Artificial Sequence
  Synthetic
cttcggagagaccutgaggug

SEQ ID NO: 70467 - DNA, 21 bp, Artificial Sequence
  Synthetic
ctgtccgacugacttggctua

SEQ ID NO: 70468 - DNA, 18 bp, Artificial Sequence
  Synthetic
guggcguccacgaagaca

SEQ ID NO: 70469 - DNA, 18 bp, Artificial Sequence
  Synthetic
cgcaagcugacctuccgt

SEQ ID NO: 70470 - DNA, 21 bp, Artificial Sequence
  Synthetic
ctggaagagcgagauggtcug

SEQ ID NO: 70471 - DNA, 21 bp, Artificial Sequence
  Synthetic
ctcaagaaagggcugcugagt

SEQ ID NO: 70472 - DNA, 21 bp, Artificial Sequence
  Synthetic
ctgtacccugtcacagcctuc

SEQ ID NO: 70473 - DNA, 24 bp, Artificial Sequence
  Synthetic
gggcagaagcugagtatcuacaat

SEQ ID NO: 70474 - DNA, 17 bp, Artificial Sequence
  Synthetic
gccgccaggcucttcug

SEQ ID NO: 70475 - DNA, 17 bp, Artificial Sequence
  Synthetic
gcgcugaaggcgagcut

SEQ ID NO: 70476 - DNA, 21 bp, Artificial Sequence
  Synthetic
gcctcctccutctgcttcuca

SEQ ID NO: 70477 - DNA, 19 bp, Artificial Sequence
  Synthetic
cucccugcaggaggaacac

SEQ ID NO: 70478 - DNA, 18 bp, Artificial Sequence
  Synthetic
ccgtgtguacctgggcut

SEQ ID NO: 70479 - DNA, 19 bp, Artificial Sequence
  Synthetic
cuccgagtcauggcaacga

SEQ ID NO: 70480 - DNA, 25 bp, Artificial Sequence
  Synthetic
ggacacacgaaggcauatattuggt

SEQ ID NO: 70481 - DNA, 24 bp, Artificial Sequence
  Synthetic
gaagtacctggucttagcatcugg

SEQ ID NO: 70482 - DNA, 22 bp, Artificial Sequence
  Synthetic
gcagcaaagacutccgaatucc

SEQ ID NO: 70483 - DNA, 21 bp, Artificial Sequence
  Synthetic
cgcttgccucagaacaactuc

SEQ ID NO: 70484 - DNA, 20 bp, Artificial Sequence
  Synthetic
ggaaagagutgcugcaccag

SEQ ID NO: 70485 - DNA, 19 bp, Artificial Sequence
  Synthetic
cacatccaucggcgcttug

SEQ ID NO: 70486 - DNA, 23 bp, Artificial Sequence
  Synthetic
ccauctcagtgtucaaggcagat

SEQ ID NO: 70487 - DNA, 18 bp, Artificial Sequence
  Synthetic
tctccucctccgugcgaa

SEQ ID NO: 70488 - DNA, 20 bp, Artificial Sequence
  Synthetic
gatgtggucacggatcugct

SEQ ID NO: 70489 - DNA, 24 bp, Artificial Sequence
  Synthetic
cctctacacaugctacctccagut

SEQ ID NO: 70490 - DNA, 23 bp, Artificial Sequence
  Synthetic
ctcaccttgucaccctttagucc

SEQ ID NO: 70491 - DNA, 21 bp, Artificial Sequence
  Synthetic
gtagctcacggucaccttcuc

SEQ ID NO: 70492 - DNA, 20 bp, Artificial Sequence
  Synthetic
gagagaatgcuggtggcugt

SEQ ID NO: 70493 - DNA, 19 bp, Artificial Sequence
  Synthetic
ccgctccuctgacctctug

SEQ ID NO: 70494 - DNA, 22 bp, Artificial Sequence
  Synthetic
ctgauaacccaggctcatgucc

SEQ ID NO: 70495 - DNA, 24 bp, Artificial Sequence
  Synthetic
gctctgatttcutcctcccctauc

SEQ ID NO: 70496 - DNA, 22 bp, Artificial Sequence
  Synthetic
gggaagacccuaggaagaagug

SEQ ID NO: 70497 - DNA, 22 bp, Artificial Sequence
  Synthetic
gttcattcccugacctgctgut

SEQ ID NO: 70498 - DNA, 22 bp, Artificial Sequence
  Synthetic
ggtacaggaggagucacucaga

SEQ ID NO: 70499 - DNA, 20 bp, Artificial Sequence
  Synthetic
cgagcucagcagctaucacc

SEQ ID NO: 70500 - DNA, 22 bp, Artificial Sequence
  Synthetic
tcaggaucaggcccttctucat

SEQ ID NO: 70501 - DNA, 22 bp, Artificial Sequence
  Synthetic
gttacgtcaucgaccccaucaa

SEQ ID NO: 70502 - DNA, 19 bp, Artificial Sequence
  Synthetic
cagccccucacccagtuag

SEQ ID NO: 70503 - DNA, 21 bp, Artificial Sequence
  Synthetic
aagcccaugtgagggttuagg

SEQ ID NO: 70504 - DNA, 18 bp, Artificial Sequence
  Synthetic
ggagctgcugagcaccut

SEQ ID NO: 70505 - DNA, 17 bp, Artificial Sequence
  Synthetic
ctggccgugtgcgacua

SEQ ID NO: 70506 - DNA, 20 bp, Artificial Sequence
  Synthetic
cccagcautttggagcucct

SEQ ID NO: 70507 - DNA, 19 bp, Artificial Sequence
  Synthetic
gccgucccctatggucaga

SEQ ID NO: 70508 - DNA, 20 bp, Artificial Sequence
  Synthetic
gccgucagcgatgtcaucat

SEQ ID NO: 70509 - DNA, 23 bp, Artificial Sequence
  Synthetic
gtttccacaagcugcagaatguc

SEQ ID NO: 70510 - DNA, 23 bp, Artificial Sequence
  Synthetic
ccaaggacucuaggacaccaact

SEQ ID NO: 70511 - DNA, 28 bp, Artificial Sequence
  Synthetic
tgtcaagttcuaagactctgtactcugg

SEQ ID NO: 70512 - DNA, 27 bp, Artificial Sequence
  Synthetic
ggagaaaggtucataatgtaagccuct

SEQ ID NO: 70513 - DNA, 28 bp, Artificial Sequence
  Synthetic
ttgcataatgccuttactgaccaaaaut

SEQ ID NO: 70514 - DNA, 21 bp, Artificial Sequence
  Synthetic
gccagaaugcccttcaguaga

SEQ ID NO: 70515 - DNA, 20 bp, Artificial Sequence
  Synthetic
acccttcuaacccacccuca

SEQ ID NO: 70516 - DNA, 19 bp, Artificial Sequence
  Synthetic
gggtagcgucaacggauga

SEQ ID NO: 70517 - DNA, 21 bp, Artificial Sequence
  Synthetic
caaagccgacuacatgccuga

SEQ ID NO: 70518 - DNA, 18 bp, Artificial Sequence
  Synthetic
cugcacgccgatucgaag

SEQ ID NO: 70519 - DNA, 24 bp, Artificial Sequence
  Synthetic
tgcttccugggaatactgatgaug

SEQ ID NO: 70520 - DNA, 20 bp, Artificial Sequence
  Synthetic
gcagutcttgugccccaaca

SEQ ID NO: 70521 - DNA, 24 bp, Artificial Sequence
  Synthetic
aatgaactgauggcatgaagguga

SEQ ID NO: 70522 - DNA, 17 bp, Artificial Sequence
  Synthetic
gcugugccagcgacagt

SEQ ID NO: 70523 - DNA, 19 bp, Artificial Sequence
  Synthetic
cgcauagugagccgagagg

SEQ ID NO: 70524 - DNA, 27 bp, Artificial Sequence
  Synthetic
cttccttctttcuctctctttggcaut

SEQ ID NO: 70525 - DNA, 21 bp, Artificial Sequence
  Synthetic
ccctccuggaggtauccaaga

SEQ ID NO: 70526 - DNA, 27 bp, Artificial Sequence
  Synthetic
ccaaacaaacugttcaucaggaagaaa

SEQ ID NO: 70527 - DNA, 28 bp, Artificial Sequence
  Synthetic
tgacagttcaacuagaagagactgguaa

SEQ ID NO: 70528 - DNA, 28 bp, Artificial Sequence
  Synthetic
tttcaactgtucattttctctcuggact

SEQ ID NO: 70529 - DNA, 28 bp, Artificial Sequence
  Synthetic
gcctgttgtattgutggtacttcgtaut

SEQ ID NO: 70530 - DNA, 27 bp, Artificial Sequence
  Synthetic
attctttttctgacuccaaagctcgua

SEQ ID NO: 70531 - DNA, 26 bp, Artificial Sequence
  Synthetic
aattgaaaagccaaacacugaauggt

SEQ ID NO: 70532 - DNA, 22 bp, Artificial Sequence
  Synthetic
tctgcccggagutctaaaagug

SEQ ID NO: 70533 - DNA, 33 bp, Artificial Sequence
  Synthetic
agttgagttgttaauttgtgaaatatgtuccat

SEQ ID NO: 70534 - DNA, 33 bp, Artificial Sequence
  Synthetic
ttatcatttgccuatttttacaatacattucga

SEQ ID NO: 70535 - DNA, 28 bp, Artificial Sequence
  Synthetic
ctctttcctcacucttggtcaaacuaaa

SEQ ID NO: 70536 - DNA, 28 bp, Artificial Sequence
  Synthetic
caaactttgtugatgacgaatuacagca

SEQ ID NO: 70537 - DNA, 28 bp, Artificial Sequence
  Synthetic
gtgttgcttacagauttggtgactttua

SEQ ID NO: 70538 - DNA, 29 bp, Artificial Sequence
  Synthetic
tctgtgaatctatutgtttctggtaguca

SEQ ID NO: 70539 - DNA, 23 bp, Artificial Sequence
  Synthetic
accgttttccugtccttttcugt

SEQ ID NO: 70540 - DNA, 21 bp, Artificial Sequence
  Synthetic
gtagcagccautccugaaggt

SEQ ID NO: 70541 - DNA, 29 bp, Artificial Sequence
  Synthetic
aaccacgacacggaauattctaaatuact

SEQ ID NO: 70542 - DNA, 21 bp, Artificial Sequence
  Synthetic
ccagccaguaacaaccccuac

SEQ ID NO: 70543 - DNA, 25 bp, Artificial Sequence
  Synthetic
ggcgtgaagaugtaataaccucgaa

SEQ ID NO: 70544 - DNA, 23 bp, Artificial Sequence
  Synthetic
attgaaattgtcuccctggccut

SEQ ID NO: 70545 - DNA, 21 bp, Artificial Sequence
  Synthetic
gacttccucaccccaguaacc

SEQ ID NO: 70546 - DNA, 22 bp, Artificial Sequence
  Synthetic
ccaggacuctgcacagugaaac

SEQ ID NO: 70547 - DNA, 29 bp, Artificial Sequence
  Synthetic
tgcaggtaucacacaaattacagaagaut

SEQ ID NO: 70548 - DNA, 21 bp, Artificial Sequence
  Synthetic
cgggcagguttcctcatctut

SEQ ID NO: 70549 - DNA, 28 bp, Artificial Sequence
  Synthetic
gtctcatgtgtuaagagaaagctauggt

SEQ ID NO: 70550 - DNA, 21 bp, Artificial Sequence
  Synthetic
acaagggaaacugggugacag

SEQ ID NO: 70551 - DNA, 22 bp, Artificial Sequence
  Synthetic
cggccccaccaugtatctaaug

SEQ ID NO: 70552 - DNA, 23 bp, Artificial Sequence
  Synthetic
ctgccaatcauctcctggatcug

SEQ ID NO: 70553 - DNA, 23 bp, Artificial Sequence
  Synthetic
catgguaggaatagugccaggaa

SEQ ID NO: 70554 - DNA, 20 bp, Artificial Sequence
  Synthetic
caggcggucattgaggtuct

SEQ ID NO: 70555 - DNA, 20 bp, Artificial Sequence
  Synthetic
gtctcatccucccgcttcuc

SEQ ID NO: 70556 - DNA, 21 bp, Artificial Sequence
  Synthetic
ccagaagggcaacauccauct

SEQ ID NO: 70557 - DNA, 22 bp, Artificial Sequence
  Synthetic
aggagtccugcttcattccuca

SEQ ID NO: 70558 - DNA, 21 bp, Artificial Sequence
  Synthetic
tggaaagagcugcaggugaag

SEQ ID NO: 70559 - DNA, 22 bp, Artificial Sequence
  Synthetic
gtcttccctcucctcctgctua

SEQ ID NO: 70560 - DNA, 21 bp, Artificial Sequence
  Synthetic
tgaccctcugaagcactcuct

SEQ ID NO: 70561 - DNA, 20 bp, Artificial Sequence
  Synthetic
ggtggccaggutgatgaugg

SEQ ID NO: 70562 - DNA, 19 bp, Artificial Sequence
  Synthetic
cguggcaggaaacauccct

SEQ ID NO: 70563 - DNA, 26 bp, Artificial Sequence
  Synthetic
actgctcaaagaaacuaatcaacuga

SEQ ID NO: 70564 - DNA, 23 bp, Artificial Sequence
  Synthetic
aaccaagggcucagtttguaaca

SEQ ID NO: 70565 - DNA, 24 bp, Artificial Sequence
  Synthetic
cctctgcaaauattaccuccacga

SEQ ID NO: 70566 - DNA, 24 bp, Artificial Sequence
  Synthetic
ggagttgguaatggcagtagucat

SEQ ID NO: 70567 - DNA, 22 bp, Artificial Sequence
  Synthetic
caaacaccuccattgugacagg

SEQ ID NO: 70568 - DNA, 24 bp, Artificial Sequence
  Synthetic
gttaaatguctgcaacuccaaccc

SEQ ID NO: 70569 - DNA, 24 bp, Artificial Sequence
  Synthetic
ttcacagtucacaccagtgtaucc

SEQ ID NO: 70570 - DNA, 20 bp, Artificial Sequence
  Synthetic
tccaggaagugggacuccat

SEQ ID NO: 70571 - DNA, 18 bp, Artificial Sequence
  Synthetic
gcaggtcuccgacagcuc

SEQ ID NO: 70572 - DNA, 19 bp, Artificial Sequence
  Synthetic
acucgccaggtctuaccga

SEQ ID NO: 70573 - DNA, 21 bp, Artificial Sequence
  Synthetic
tgtggtaugccaggaggttug

SEQ ID NO: 70574 - DNA, 21 bp, Artificial Sequence
  Synthetic
ggtcaagucagcagggttugt

SEQ ID NO: 70575 - DNA, 21 bp, Artificial Sequence
  Synthetic
aggaguaccaggacccugaag

SEQ ID NO: 70576 - DNA, 20 bp, Artificial Sequence
  Synthetic
tgctgccccacucctcauat

SEQ ID NO: 70577 - DNA, 20 bp, Artificial Sequence
  Synthetic
cagcccugacagagctctuc

SEQ ID NO: 70578 - DNA, 21 bp, Artificial Sequence
  Synthetic
ggaagucccacagctccagua

SEQ ID NO: 70579 - DNA, 22 bp, Artificial Sequence
  Synthetic
ctcatgcaguctctgggttgut

SEQ ID NO: 70580 - DNA, 22 bp, Artificial Sequence
  Synthetic
acatctcccuggaggugacaaa

SEQ ID NO: 70581 - DNA, 21 bp, Artificial Sequence
  Synthetic
gccaagcugtatctgtccugt

SEQ ID NO: 70582 - DNA, 21 bp, Artificial Sequence
  Synthetic
cccacuacacatcactugcct

SEQ ID NO: 70583 - DNA, 26 bp, Artificial Sequence
  Synthetic
cgaataggaauagctggacatgtcua

SEQ ID NO: 70584 - DNA, 21 bp, Artificial Sequence
  Synthetic
acctttcugcccttcccacua

SEQ ID NO: 70585 - DNA, 28 bp, Artificial Sequence
  Synthetic
tggagacagcuttttaatcaagttcugt

SEQ ID NO: 70586 - DNA, 20 bp, Artificial Sequence
  Synthetic
cccaauccccagcacatuct

SEQ ID NO: 70587 - DNA, 23 bp, Artificial Sequence
  Synthetic
tgttgactctuctctgccttgug

SEQ ID NO: 70588 - DNA, 21 bp, Artificial Sequence
  Synthetic
aggtgaaccugggtcctcaua

SEQ ID NO: 70589 - DNA, 23 bp, Artificial Sequence
  Synthetic
agaagaaccgagacuaccctcug

SEQ ID NO: 70590 - DNA, 26 bp, Artificial Sequence
  Synthetic
gtgaatgaaaccaauacctcccauca

SEQ ID NO: 70591 - DNA, 22 bp, Artificial Sequence
  Synthetic
cattgccauggctgtgagtuac

SEQ ID NO: 70592 - DNA, 17 bp, Artificial Sequence
  Synthetic
gcgggccuccttcctuc

SEQ ID NO: 70593 - DNA, 17 bp, Artificial Sequence
  Synthetic
gcuacgugcccgaggat

SEQ ID NO: 70594 - DNA, 18 bp, Artificial Sequence
  Synthetic
tccagcaggaagccugug

SEQ ID NO: 70595 - DNA, 18 bp, Artificial Sequence
  Synthetic
ctccgtggcuggtgtcua

SEQ ID NO: 70596 - DNA, 19 bp, Artificial Sequence
  Synthetic
ccaccacacccucctucac

SEQ ID NO: 70597 - DNA, 18 bp, Artificial Sequence
  Synthetic
tgutgcugaaggccacca

SEQ ID NO: 70598 - DNA, 20 bp, Artificial Sequence
  Synthetic
agugggaacgcactcaucac

SEQ ID NO: 70599 - DNA, 18 bp, Artificial Sequence
  Synthetic
gcuggaggcctgugagac

SEQ ID NO: 70600 - DNA, 18 bp, Artificial Sequence
  Synthetic
cagcaggucctgcaggua

SEQ ID NO: 70601 - DNA, 19 bp, Artificial Sequence
  Synthetic
ggtguaccgtcugcacgag

SEQ ID NO: 70602 - DNA, 24 bp, Artificial Sequence
  Synthetic
ggtcccaaucagaaaatcauccct

SEQ ID NO: 70603 - DNA, 24 bp, Artificial Sequence
  Synthetic
cacatcauctctgcuacccaagat

SEQ ID NO: 70604 - DNA, 20 bp, Artificial Sequence
  Synthetic
cagacccucggacagguaac

SEQ ID NO: 70605 - DNA, 20 bp, Artificial Sequence
  Synthetic
gctccugcacaacagcugat

SEQ ID NO: 70606 - DNA, 21 bp, Artificial Sequence
  Synthetic
gggcctgaugaggaggtcaua

SEQ ID NO: 70607 - DNA, 28 bp, Artificial Sequence
  Synthetic
ccgtttcaatctuaatgttcatgctcut

SEQ ID NO: 70608 - DNA, 27 bp, Artificial Sequence
  Synthetic
agaaatgatuccaagcatctcctucaa

SEQ ID NO: 70609 - DNA, 21 bp, Artificial Sequence
  Synthetic
tgtcagctguagtctgccuct

SEQ ID NO: 70610 - DNA, 21 bp, Artificial Sequence
  Synthetic
tcucaaccggaacctcuccat

SEQ ID NO: 70611 - DNA, 21 bp, Artificial Sequence
  Synthetic
tccccagacaggcaauaggua

SEQ ID NO: 70612 - DNA, 18 bp, Artificial Sequence
  Synthetic
cccuggctccuggaagac

SEQ ID NO: 70613 - DNA, 17 bp, Artificial Sequence
  Synthetic
gtgagggcccgcucauc

SEQ ID NO: 70614 - DNA, 27 bp, Artificial Sequence
  Synthetic
tgtacctgtucacattcagacucaaat

SEQ ID NO: 70615 - DNA, 23 bp, Artificial Sequence
  Synthetic
cttctttguctcatgggucccaa

SEQ ID NO: 70616 - DNA, 25 bp, Artificial Sequence
  Synthetic
cctgaagaagugattcgtaaaugcc

SEQ ID NO: 70617 - DNA, 25 bp, Artificial Sequence
  Synthetic
tctagagtttcucctccgatggtut

SEQ ID NO: 70618 - DNA, 21 bp, Artificial Sequence
  Synthetic
cgaggguggttggaaacugat

SEQ ID NO: 70619 - DNA, 24 bp, Artificial Sequence
  Synthetic
ctatcgggaugaacacatcuaccc

SEQ ID NO: 70620 - DNA, 21 bp, Artificial Sequence
  Synthetic
gggaaacagggaugatuggca

SEQ ID NO: 70621 - DNA, 24 bp, Artificial Sequence
  Synthetic
tgctcatccuctgacaaacactuc

SEQ ID NO: 70622 - DNA, 26 bp, Artificial Sequence
  Synthetic
aggctttttgtutcttttgcagtuca

SEQ ID NO: 70623 - DNA, 32 bp, Artificial Sequence
  Synthetic
atcattgatacttcutgaagagtcatgaauaa

SEQ ID NO: 70624 - DNA, 29 bp, Artificial Sequence
  Synthetic
ctgctaacctuaaagcagattctttcuct

SEQ ID NO: 70625 - DNA, 28 bp, Artificial Sequence
  Synthetic
gcatgcaaauaactgctgtcaatuagaa

SEQ ID NO: 70626 - DNA, 28 bp, Artificial Sequence
  Synthetic
tggctaattucacaaggttcaagaauca

SEQ ID NO: 70627 - DNA, 28 bp, Artificial Sequence
  Synthetic
tgcagctcuccaaaaagttgtagauaat

SEQ ID NO: 70628 - DNA, 26 bp, Artificial Sequence
  Synthetic
aaatcaactggauagtgacagacuga

SEQ ID NO: 70629 - DNA, 29 bp, Artificial Sequence
  Synthetic
aagagatttagaaaggaguaggacaguga

SEQ ID NO: 70630 - DNA, 23 bp, Artificial Sequence
  Synthetic
gggaccagguggtagaagaaaut

SEQ ID NO: 70631 - DNA, 27 bp, Artificial Sequence
  Synthetic
cctaagggagaaacutaagaatgcuca

SEQ ID NO: 70632 - DNA, 23 bp, Artificial Sequence
  Synthetic
tgttggtgugctgatgguaagat

SEQ ID NO: 70633 - DNA, 28 bp, Artificial Sequence
  Synthetic
cccaatggacaucatttgttttctgaut

SEQ ID NO: 70634 - DNA, 21 bp, Artificial Sequence
  Synthetic
catgcuggatccuccgagaat

SEQ ID NO: 70635 - DNA, 23 bp, Artificial Sequence
  Synthetic
cctgtgaaagcutttgacgucac

SEQ ID NO: 70636 - DNA, 21 bp, Artificial Sequence
  Synthetic
gcgggcaaucuacaacaacat

SEQ ID NO: 70637 - DNA, 27 bp, Artificial Sequence
  Synthetic
atgacccattuagataaaggcguacag

SEQ ID NO: 70638 - DNA, 22 bp, Artificial Sequence
  Synthetic
acagccttuctaaaacgccuct

SEQ ID NO: 70639 - DNA, 24 bp, Artificial Sequence
  Synthetic
ggtccuggcactgatttauaacct

SEQ ID NO: 70640 - DNA, 20 bp, Artificial Sequence
  Synthetic
gggagtcautgaccccaucc

SEQ ID NO: 70641 - DNA, 22 bp, Artificial Sequence
  Synthetic
gggcaaggguaacttgaggtut

SEQ ID NO: 70642 - DNA, 28 bp, Artificial Sequence
  Synthetic
gataatatcccguggaccgataattucc

SEQ ID NO: 70643 - DNA, 22 bp, Artificial Sequence
  Synthetic
ggcttucacaggctttcctuga

SEQ ID NO: 70644 - DNA, 25 bp, Artificial Sequence
  Synthetic
gattttccucgacatguaccaaggt

SEQ ID NO: 70645 - DNA, 22 bp, Artificial Sequence
  Synthetic
gcatgcauagaccaatgggtut

SEQ ID NO: 70646 - DNA, 24 bp, Artificial Sequence
  Synthetic
tgatggagacagautcgctttuct

SEQ ID NO: 70647 - DNA, 24 bp, Artificial Sequence
  Synthetic
gaaattctgcautggtgctuagga

SEQ ID NO: 70648 - DNA, 28 bp, Artificial Sequence
  Synthetic
ggagucaggaagagatattcuagagcaa

SEQ ID NO: 70649 - DNA, 29 bp, Artificial Sequence
  Synthetic
tcaatccactttgugtcttatcaactuca

SEQ ID NO: 70650 - DNA, 22 bp, Artificial Sequence
  Synthetic
ccgagtcuatattgccugcaga

SEQ ID NO: 70651 - DNA, 24 bp, Artificial Sequence
  Synthetic
cctgcttttcuacctacccaucag

SEQ ID NO: 70652 - DNA, 22 bp, Artificial Sequence
  Synthetic
tggaatttuccagggcacugaa

SEQ ID NO: 70653 - DNA, 21 bp, Artificial Sequence
  Synthetic
actgatggttucacggctguc

SEQ ID NO: 70654 - DNA, 22 bp, Artificial Sequence
  Synthetic
ggccttcugggaagatcaggua

SEQ ID NO: 70655 - DNA, 25 bp, Artificial Sequence
  Synthetic
ttgctgtgacuatgtcatggttcut

SEQ ID NO: 70656 - DNA, 21 bp, Artificial Sequence
  Synthetic
gcacuggcagtagtugaggat

SEQ ID NO: 70657 - DNA, 22 bp, Artificial Sequence
  Synthetic
cuaaggaaccugcagaccaagg

SEQ ID NO: 70658 - DNA, 22 bp, Artificial Sequence
  Synthetic
gcatggagguaagcaggatcuc

SEQ ID NO: 70659 - DNA, 24 bp, Artificial Sequence
  Synthetic
tgaacagugtgtcuagagcagagt

SEQ ID NO: 70660 - DNA, 21 bp, Artificial Sequence
  Synthetic
gacgtcttuagcttggccauc

SEQ ID NO: 70661 - DNA, 23 bp, Artificial Sequence
  Synthetic
agagtgaggcuggctcttttcua

SEQ ID NO: 70662 - DNA, 22 bp, Artificial Sequence
  Synthetic
tcttcagcagcuttaccagcut

SEQ ID NO: 70663 - DNA, 22 bp, Artificial Sequence
  Synthetic
cggatcagaucctccaggtuac

SEQ ID NO: 70664 - DNA, 21 bp, Artificial Sequence
  Synthetic
gctcagctaucccctctcugt

SEQ ID NO: 70665 - DNA, 23 bp, Artificial Sequence
  Synthetic
aagttgtgggugaaagaggagug

SEQ ID NO: 70666 - DNA, 22 bp, Artificial Sequence
  Synthetic
tgcatctttcaugagggcacut

SEQ ID NO: 70667 - DNA, 21 bp, Artificial Sequence
  Synthetic
gcctcataguggaaggcugac

SEQ ID NO: 70668 - DNA, 24 bp, Artificial Sequence
  Synthetic
tcttttcttuagggcctgtucaca

SEQ ID NO: 70669 - DNA, 27 bp, Artificial Sequence
  Synthetic
gtgcgtttcaaucaccactaaaucaat

SEQ ID NO: 70670 - DNA, 21 bp, Artificial Sequence
  Synthetic
tgcttgcucaactcagtgcut

SEQ ID NO: 70671 - DNA, 24 bp, Artificial Sequence
  Synthetic
ggctgaaguggagattaacauccc

SEQ ID NO: 70672 - DNA, 28 bp, Artificial Sequence
  Synthetic
aattcctgagagagaugaaacattcugg

SEQ ID NO: 70673 - DNA, 22 bp, Artificial Sequence
  Synthetic
tgcctgtgcucatgtttgacut

SEQ ID NO: 70674 - DNA, 20 bp, Artificial Sequence
  Synthetic
gggaguctgcacugagagac

SEQ ID NO: 70675 - DNA, 25 bp, Artificial Sequence
  Synthetic
ggcttctuccttattctuccaccat

SEQ ID NO: 70676 - DNA, 18 bp, Artificial Sequence
  Synthetic
cuagagcgcggcagacua

SEQ ID NO: 70677 - DNA, 23 bp, Artificial Sequence
  Synthetic
cagguaggccaccaatgtagaug

SEQ ID NO: 70678 - DNA, 21 bp, Artificial Sequence
  Synthetic
catccgtguccagaagucacc

SEQ ID NO: 70679 - DNA, 22 bp, Artificial Sequence
  Synthetic
tgagaggugggcaattgtgtut

SEQ ID NO: 70680 - DNA, 22 bp, Artificial Sequence
  Synthetic
gcutaatccugggcagagagaa

SEQ ID NO: 70681 - DNA, 23 bp, Artificial Sequence
  Synthetic
ccacagacucagctactgttcug

SEQ ID NO: 70682 - DNA, 20 bp, Artificial Sequence
  Synthetic
cggtuccggaaatagugcag

SEQ ID NO: 70683 - DNA, 20 bp, Artificial Sequence
  Synthetic
tcagcccugggactctctut

SEQ ID NO: 70684 - DNA, 18 bp, Artificial Sequence
  Synthetic
tcaccaugggcagccauc

SEQ ID NO: 70685 - DNA, 18 bp, Artificial Sequence
  Synthetic
tgccagggccagutcauc

SEQ ID NO: 70686 - DNA, 20 bp, Artificial Sequence
  Synthetic
ccutcccccuaaaccccaga

SEQ ID NO: 70687 - DNA, 23 bp, Artificial Sequence
  Synthetic
ccgugacttctuacccaaaccaa

SEQ ID NO: 70688 - DNA, 21 bp, Artificial Sequence
  Synthetic
aaaaccacgaccuctgaccug

SEQ ID NO: 70689 - DNA, 21 bp, Artificial Sequence
  Synthetic
caaccacugctccatccucat

SEQ ID NO: 70690 - DNA, 20 bp, Artificial Sequence
  Synthetic
cagcgtgagggucctctcua

SEQ ID NO: 70691 - DNA, 20 bp, Artificial Sequence
  Synthetic
ggcauccccatcacugagac

SEQ ID NO: 70692 - DNA, 28 bp, Artificial Sequence
  Synthetic
ccttataggagaucttgagcttggtcut

SEQ ID NO: 70693 - DNA, 22 bp, Artificial Sequence
  Synthetic
gaagaagggcuggctctacuac

SEQ ID NO: 70694 - DNA, 17 bp, Artificial Sequence
  Synthetic
gccagcucggctuccag

SEQ ID NO: 70695 - DNA, 18 bp, Artificial Sequence
  Synthetic
cgggagcuggcugaacaa

SEQ ID NO: 70696 - DNA, 20 bp, Artificial Sequence
  Synthetic
gugacaacgugacccacaac

SEQ ID NO: 70697 - DNA, 17 bp, Artificial Sequence
  Synthetic
gggctguctagccugga

SEQ ID NO: 70698 - DNA, 20 bp, Artificial Sequence
  Synthetic
ggacaguggactgcatggua

SEQ ID NO: 70699 - DNA, 28 bp, Artificial Sequence
  Synthetic
gtttcagcataacautgcaacatgttuc

SEQ ID NO: 70700 - DNA, 19 bp, Artificial Sequence
  Synthetic
ccctgugaccctgcttguc

SEQ ID NO: 70701 - DNA, 18 bp, Artificial Sequence
  Synthetic
ctccctugggcgttucca

SEQ ID NO: 70702 - DNA, 20 bp, Artificial Sequence
  Synthetic
cagagcauacgcagcctgua

SEQ ID NO: 70703 - DNA, 20 bp, Artificial Sequence
  Synthetic
ggcttgugggcaaacttgug

SEQ ID NO: 70704 - DNA, 22 bp, Artificial Sequence
  Synthetic
gctcctctagauctgccaggut

SEQ ID NO: 70705 - DNA, 23 bp, Artificial Sequence
  Synthetic
cgtggctcauaactctctcctuc

SEQ ID NO: 70706 - DNA, 23 bp, Artificial Sequence
  Synthetic
tgccuagaagaggcaatcuccat

SEQ ID NO: 70707 - DNA, 19 bp, Artificial Sequence
  Synthetic
cctagguggtgggcucagt

SEQ ID NO: 70708 - DNA, 28 bp, Artificial Sequence
  Synthetic
gacattttgagcugtgtctctagatcut

SEQ ID NO: 70709 - DNA, 25 bp, Artificial Sequence
  Synthetic
ggaggcagcautaagtgtttacauc

SEQ ID NO: 70710 - DNA, 22 bp, Artificial Sequence
  Synthetic
ggugagcuacaggaggaagaat

SEQ ID NO: 70711 - DNA, 28 bp, Artificial Sequence
  Synthetic
tcacagattagaacuacaggctgauagt

SEQ ID NO: 70712 - DNA, 28 bp, Artificial Sequence
  Synthetic
tctgtgagtuaacactctagactaugct

SEQ ID NO: 70713 - DNA, 25 bp, Artificial Sequence
  Synthetic
cctgatgtctucgtgtatgtgtcug

SEQ ID NO: 70714 - DNA, 24 bp, Artificial Sequence
  Synthetic
aaagccagguaacttgaacaguga

SEQ ID NO: 70715 - DNA, 21 bp, Artificial Sequence
  Synthetic
gtctgcagguggacgagauac

SEQ ID NO: 70716 - DNA, 29 bp, Artificial Sequence
  Synthetic
tggcagatccauaaaataggagtcuagaa

SEQ ID NO: 70717 - DNA, 25 bp, Artificial Sequence
  Synthetic
agctggctutggaagaaguagaaaa

SEQ ID NO: 70718 - DNA, 28 bp, Artificial Sequence
  Synthetic
ccaattaagcaccutggataaggaaauc

SEQ ID NO: 70719 - DNA, 23 bp, Artificial Sequence
  Synthetic
tgttttgtuacagagguggagca

SEQ ID NO: 70720 - DNA, 24 bp, Artificial Sequence
  Synthetic
ccttgtgtcugttgccttagaugt

SEQ ID NO: 70721 - DNA, 25 bp, Artificial Sequence
  Synthetic
caggctcatatuccttaagggctuc

SEQ ID NO: 70722 - DNA, 21 bp, Artificial Sequence
  Synthetic
gggucacctgttucagaggag

SEQ ID NO: 70723 - DNA, 24 bp, Artificial Sequence
  Synthetic
cagtctctguagcttctccaacut

SEQ ID NO: 70724 - DNA, 25 bp, Artificial Sequence
  Synthetic
agtcatcagaugtactgctccucat

SEQ ID NO: 70725 - DNA, 22 bp, Artificial Sequence
  Synthetic
acataggcauggatgacaggug

SEQ ID NO: 70726 - DNA, 22 bp, Artificial Sequence
  Synthetic
gcaacagcaauccccaaaaugg

SEQ ID NO: 70727 - DNA, 22 bp, Artificial Sequence
  Synthetic
cctttccugacccctctttcug

SEQ ID NO: 70728 - DNA, 20 bp, Artificial Sequence
  Synthetic
cagaaacagggcacugucca

SEQ ID NO: 70729 - DNA, 20 bp, Artificial Sequence
  Synthetic
gccaacaugttcgccuacca

SEQ ID NO: 70730 - DNA, 21 bp, Artificial Sequence
  Synthetic
caguggagcccgagtacttug

SEQ ID NO: 70731 - DNA, 23 bp, Artificial Sequence
  Synthetic
gctggugaagctgaatugaaggt

SEQ ID NO: 70732 - DNA, 23 bp, Artificial Sequence
  Synthetic
tcatggagaugcttagccugaga

SEQ ID NO: 70733 - DNA, 20 bp, Artificial Sequence
  Synthetic
ccaccgugauccaagacacc

SEQ ID NO: 70734 - DNA, 20 bp, Artificial Sequence
  Synthetic
gaacctgcugaagccugaca

SEQ ID NO: 70735 - DNA, 22 bp, Artificial Sequence
  Synthetic
gagaccccuctcccctagtuaa

SEQ ID NO: 70736 - DNA, 18 bp, Artificial Sequence
  Synthetic
gccugaacctuccaccct

SEQ ID NO: 70737 - DNA, 19 bp, Artificial Sequence
  Synthetic
cgtggaaggcccuctgtuc

SEQ ID NO: 70738 - DNA, 17 bp, Artificial Sequence
  Synthetic
gtacgggugcccctcut

SEQ ID NO: 70739 - DNA, 18 bp, Artificial Sequence
  Synthetic
cacucuccccacccagac

SEQ ID NO: 70740 - DNA, 21 bp, Artificial Sequence
  Synthetic
gagtcgggcucagaugaaagg

SEQ ID NO: 70741 - DNA, 22 bp, Artificial Sequence
  Synthetic
ctatgguggctggaugacagat

SEQ ID NO: 70742 - DNA, 24 bp, Artificial Sequence
  Synthetic
cacaggaggaagugccaatauagt

SEQ ID NO: 70743 - DNA, 21 bp, Artificial Sequence
  Synthetic
tcctgggcaagutctcucaga

SEQ ID NO: 70744 - DNA, 24 bp, Artificial Sequence
  Synthetic
tgutcttgtucagacacagccaat

SEQ ID NO: 70745 - DNA, 22 bp, Artificial Sequence
  Synthetic
tccatgtuggcaggagttctug

SEQ ID NO: 70746 - DNA, 25 bp, Artificial Sequence
  Synthetic
ggtaacagaacauttgacaagugct

SEQ ID NO: 70747 - DNA, 22 bp, Artificial Sequence
  Synthetic
gcatccugacaagtugcaccat

SEQ ID NO: 70748 - DNA, 24 bp, Artificial Sequence
  Synthetic
tttttcaaacugctccctctucct

SEQ ID NO: 70749 - DNA, 28 bp, Artificial Sequence
  Synthetic
ggcaaaactcccucctatattttagugt

SEQ ID NO: 70750 - DNA, 22 bp, Artificial Sequence
  Synthetic
tcauaggtcuggaagcaagggt

SEQ ID NO: 70751 - DNA, 21 bp, Artificial Sequence
  Synthetic
acccctguctctgactgucat

SEQ ID NO: 70752 - DNA, 21 bp, Artificial Sequence
  Synthetic
cccatccugactccctgucat

SEQ ID NO: 70753 - DNA, 23 bp, Artificial Sequence
  Synthetic
gacacaaaggagagauggugagt

SEQ ID NO: 70754 - DNA, 22 bp, Artificial Sequence
  Synthetic
aagagagagucagcagcactug

SEQ ID NO: 70755 - DNA, 22 bp, Artificial Sequence
  Synthetic
tcctcgugaggacttaggaugg

SEQ ID NO: 70756 - DNA, 21 bp, Artificial Sequence
  Synthetic
cacccugttguggcgaaaaag

SEQ ID NO: 70757 - DNA, 21 bp, Artificial Sequence
  Synthetic
ccaagugaggcccagatugag

SEQ ID NO: 70758 - DNA, 22 bp, Artificial Sequence
  Synthetic
gggaagugggagttaguggaag

SEQ ID NO: 70759 - DNA, 28 bp, Artificial Sequence
  Synthetic
cctgagggcucctattgactataaucat

SEQ ID NO: 70760 - DNA, 27 bp, Artificial Sequence
  Synthetic
ccattacuccaaaatccacaucagagg

SEQ ID NO: 70761 - DNA, 27 bp, Artificial Sequence
  Synthetic
cctgtgcagtaugacttttctctcuat

SEQ ID NO: 70762 - DNA, 20 bp, Artificial Sequence
  Synthetic
ggagagcccugcaaauggag

SEQ ID NO: 70763 - DNA, 21 bp, Artificial Sequence
  Synthetic
cccttcctgucctgacctcut

SEQ ID NO: 70764 - DNA, 24 bp, Artificial Sequence
  Synthetic
cactgacacucaacccattctcua

SEQ ID NO: 70765 - DNA, 26 bp, Artificial Sequence
  Synthetic
gttcaaccucaaagagaccctatguc

SEQ ID NO: 70766 - DNA, 20 bp, Artificial Sequence
  Synthetic
ccctatucccagacccctuc

SEQ ID NO: 70767 - DNA, 22 bp, Artificial Sequence
  Synthetic
agggttcugacatgtcctucct

SEQ ID NO: 70768 - DNA, 22 bp, Artificial Sequence
  Synthetic
ccaccaccuatcactccugaca

SEQ ID NO: 70769 - DNA, 19 bp, Artificial Sequence
  Synthetic
tcctgccugatccccugat

SEQ ID NO: 70770 - DNA, 21 bp, Artificial Sequence
  Synthetic
gcgauccatcuggacaccaac

SEQ ID NO: 70771 - DNA, 24 bp, Artificial Sequence
  Synthetic
ggagagggaacaggucguaaaaac

SEQ ID NO: 70772 - DNA, 19 bp, Artificial Sequence
  Synthetic
gacacctuctccagcguct

SEQ ID NO: 70773 - DNA, 18 bp, Artificial Sequence
  Synthetic
cggcacgcuctccaucac

SEQ ID NO: 70774 - DNA, 27 bp, Artificial Sequence
  Synthetic
tctctgtcttcucaatgatctcgauga

SEQ ID NO: 70775 - DNA, 22 bp, Artificial Sequence
  Synthetic
aggugtacacugaggaggagac

SEQ ID NO: 70776 - DNA, 20 bp, Artificial Sequence
  Synthetic
gaaaggtccutgaccgucgt

SEQ ID NO: 70777 - DNA, 24 bp, Artificial Sequence
  Synthetic
ccgtggagaaggucatcaagatuc

SEQ ID NO: 70778 - DNA, 19 bp, Artificial Sequence
  Synthetic
augaagcccaagccucgaa

SEQ ID NO: 70779 - DNA, 20 bp, Artificial Sequence
  Synthetic
ctattgcucgagccccaugt

SEQ ID NO: 70780 - DNA, 18 bp, Artificial Sequence
  Synthetic
agcccccucctggcttua

SEQ ID NO: 70781 - DNA, 19 bp, Artificial Sequence
  Synthetic
gcaggcuggagtgtctuca

SEQ ID NO: 70782 - DNA, 20 bp, Artificial Sequence
  Synthetic
gctgcgttutcccaaggtuc

SEQ ID NO: 70783 - DNA, 23 bp, Artificial Sequence
  Synthetic
gggagagtucagtgtctaggtua

SEQ ID NO: 70784 - DNA, 24 bp, Artificial Sequence
  Synthetic
cattcaucccccaagucacaagaa

SEQ ID NO: 70785 - DNA, 20 bp, Artificial Sequence
  Synthetic
accccttcautgtggcacuc

SEQ ID NO: 70786 - DNA, 21 bp, Artificial Sequence
  Synthetic
ggcugcaaccaaguacaacag

SEQ ID NO: 70787 - DNA, 25 bp, Artificial Sequence
  Synthetic
gtaaagacagucctagggtggatug

SEQ ID NO: 70788 - DNA, 22 bp, Artificial Sequence
  Synthetic
actcccugccccgagtaatuat

SEQ ID NO: 70789 - DNA, 20 bp, Artificial Sequence
  Synthetic
tgacaaccccuccctcaugt

SEQ ID NO: 70790 - DNA, 21 bp, Artificial Sequence
  Synthetic
ggacgugcagcattcuaaggt

SEQ ID NO: 70791 - DNA, 19 bp, Artificial Sequence
  Synthetic
cttgtguaccgccucacca

SEQ ID NO: 70792 - DNA, 21 bp, Artificial Sequence
  Synthetic
gctcagaugacagccggtuct

SEQ ID NO: 70793 - DNA, 23 bp, Artificial Sequence
  Synthetic
gttgcctugaccactttuccaaa

SEQ ID NO: 70794 - DNA, 28 bp, Artificial Sequence
  Synthetic
agcaagaccaautattaaaggugacagt

SEQ ID NO: 70795 - DNA, 26 bp, Artificial Sequence
  Synthetic
ggaugagtugaaagaacagaagcaag

SEQ ID NO: 70796 - DNA, 21 bp, Artificial Sequence
  Synthetic
cauagccacccacuccacaag

SEQ ID NO: 70797 - DNA, 21 bp, Artificial Sequence
  Synthetic
cucttgcuccaccaggaacaa

SEQ ID NO: 70798 - DNA, 25 bp, Artificial Sequence
  Synthetic
ttcaagttttccutctgaagcucct

SEQ ID NO: 70799 - DNA, 24 bp, Artificial Sequence
  Synthetic
gctttcaccagaacacuccgatut

SEQ ID NO: 70800 - DNA, 28 bp, Artificial Sequence
  Synthetic
gtgtaatccaaucacatgcaaguaacaa

SEQ ID NO: 70801 - DNA, 28 bp, Artificial Sequence
  Synthetic
acaugcaagcaaggttaaaucaaaaaga

SEQ ID NO: 70802 - DNA, 29 bp, Artificial Sequence
  Synthetic
gtcgctccaatuctactaaggttgtauat

SEQ ID NO: 70803 - DNA, 28 bp, Artificial Sequence
  Synthetic
agtaatatggaugtgtctttgugcagaa

SEQ ID NO: 70804 - DNA, 23 bp, Artificial Sequence
  Synthetic
agattcaggacugaacccacuga

SEQ ID NO: 70805 - DNA, 28 bp, Artificial Sequence
  Synthetic
gucaaatggcucaagaaagaggaaaaag

SEQ ID NO: 70806 - DNA, 21 bp, Artificial Sequence
  Synthetic
cccaaguccacgtacctctut

SEQ ID NO: 70807 - DNA, 25 bp, Artificial Sequence
  Synthetic
gagttgtggtugtttttggcagaua

SEQ ID NO: 70808 - DNA, 26 bp, Artificial Sequence
  Synthetic
cttcattaccuttgacatcugagcct

SEQ ID NO: 70809 - DNA, 24 bp, Artificial Sequence
  Synthetic
tgagcaagugacagttgtctctut

SEQ ID NO: 70810 - DNA, 21 bp, Artificial Sequence
  Synthetic
gatatttgcugcacccctucc

SEQ ID NO: 70811 - DNA, 20 bp, Artificial Sequence
  Synthetic
ggcactuccacctgggaaut

SEQ ID NO: 70812 - DNA, 22 bp, Artificial Sequence
  Synthetic
cagactacutggcaagcuaggg

SEQ ID NO: 70813 - DNA, 28 bp, Artificial Sequence
  Synthetic
caattctcatuaagtaccttcuggagca

SEQ ID NO: 70814 - DNA, 24 bp, Artificial Sequence
  Synthetic
gagguactttcctttugacccaga

SEQ ID NO: 70815 - DNA, 28 bp, Artificial Sequence
  Synthetic
catccctgaagtugaaatgtagatggua

SEQ ID NO: 70816 - DNA, 26 bp, Artificial Sequence
  Synthetic
ctgagtcaauaagctagagtccucct

SEQ ID NO: 70817 - DNA, 26 bp, Artificial Sequence
  Synthetic
gtgacttcaagcutcagatcctcaut

SEQ ID NO: 70818 - DNA, 24 bp, Artificial Sequence
  Synthetic
tcucagctccaugaggagagaaat

SEQ ID NO: 70819 - DNA, 22 bp, Artificial Sequence
  Synthetic
ccccaugaggaggttttctcut

SEQ ID NO: 70820 - DNA, 22 bp, Artificial Sequence
  Synthetic
agcaacagcagcuacagaagut

SEQ ID NO: 70821 - DNA, 28 bp, Artificial Sequence
  Synthetic
ctttgtaaacgautgtttgagttgcuga

SEQ ID NO: 70822 - DNA, 21 bp, Artificial Sequence
  Synthetic
cctggagauaagcagcugcac

SEQ ID NO: 70823 - DNA, 25 bp, Artificial Sequence
  Synthetic
tccagttcggaaugcactaaatuca

SEQ ID NO: 70824 - DNA, 24 bp, Artificial Sequence
  Synthetic
tgagagacugacaaggaaagucct

SEQ ID NO: 70825 - DNA, 22 bp, Artificial Sequence
  Synthetic
gatgcactguctgcttctcugt

SEQ ID NO: 70826 - DNA, 22 bp, Artificial Sequence
  Synthetic
gccagaaaucaaacccgtcuga

SEQ ID NO: 70827 - DNA, 21 bp, Artificial Sequence
  Synthetic
ctttgttgcutgaagcggugt

SEQ ID NO: 70828 - DNA, 20 bp, Artificial Sequence
  Synthetic
tggcaugcctcccuagagaa

SEQ ID NO: 70829 - DNA, 26 bp, Artificial Sequence
  Synthetic
gctcacttccuacttacctcatucca

SEQ ID NO: 70830 - DNA, 21 bp, Artificial Sequence
  Synthetic
ggatgttcuggcccaccatut

SEQ ID NO: 70831 - DNA, 25 bp, Artificial Sequence
  Synthetic
tccatttgacaaautacctgugcct

SEQ ID NO: 70832 - DNA, 18 bp, Artificial Sequence
  Synthetic
accaagggacccugcuct

SEQ ID NO: 70833 - DNA, 19 bp, Artificial Sequence
  Synthetic
gtgttcugagcgggucagt

SEQ ID NO: 70834 - DNA, 21 bp, Artificial Sequence
  Synthetic
gatatcgucggctacctggug

SEQ ID NO: 70835 - DNA, 22 bp, Artificial Sequence
  Synthetic
ccttgaacttguagggcacgut

SEQ ID NO: 70836 - DNA, 21 bp, Artificial Sequence
  Synthetic
ccccaagccaggucatcuaat

SEQ ID NO: 70837 - DNA, 22 bp, Artificial Sequence
  Synthetic
tgcggucaagttuggaagaact

SEQ ID NO: 70838 - DNA, 27 bp, Artificial Sequence
  Synthetic
aataatgctacatgugaggacagtgut

SEQ ID NO: 70839 - DNA, 26 bp, Artificial Sequence
  Synthetic
gcagtaaataugtgtgagcacugaag

SEQ ID NO: 70840 - DNA, 26 bp, Artificial Sequence
  Synthetic
gtttcagaacaagggaugcaaatgua

SEQ ID NO: 70841 - DNA, 22 bp, Artificial Sequence
  Synthetic
gtcauggaaagggtcactucgt

SEQ ID NO: 70842 - DNA, 23 bp, Artificial Sequence
  Synthetic
gtattcaacagggaccugggtut

SEQ ID NO: 70843 - DNA, 29 bp, Artificial Sequence
  Synthetic
tgccagaauaagagagagacauaaaagga

SEQ ID NO: 70844 - DNA, 21 bp, Artificial Sequence
  Synthetic
cacgggaccaagucacugaaa

SEQ ID NO: 70845 - DNA, 19 bp, Artificial Sequence
  Synthetic
cugacgaccgttuccaacc

SEQ ID NO: 70846 - DNA, 22 bp, Artificial Sequence
  Synthetic
gcataugcacaccacctcuagt

SEQ ID NO: 70847 - DNA, 23 bp, Artificial Sequence
  Synthetic
ggactgacutgacatctcauccc

SEQ ID NO: 70848 - DNA, 22 bp, Artificial Sequence
  Synthetic
gcccuggagagaugaagacaaa

SEQ ID NO: 70849 - DNA, 22 bp, Artificial Sequence
  Synthetic
tttccccaccuggtcattctug

SEQ ID NO: 70850 - DNA, 21 bp, Artificial Sequence
  Synthetic
caaggauaccaggagcuccac

SEQ ID NO: 70851 - DNA, 22 bp, Artificial Sequence
  Synthetic
tgcctgaagcauccttgtctuc

SEQ ID NO: 70852 - DNA, 21 bp, Artificial Sequence
  Synthetic
gcuttccctgugggaacagat

SEQ ID NO: 70853 - DNA, 21 bp, Artificial Sequence
  Synthetic
tgtgccccaagggauatcuca

SEQ ID NO: 70854 - DNA, 19 bp, Artificial Sequence
  Synthetic
tgaugcaggacgcucgaag

SEQ ID NO: 70855 - DNA, 22 bp, Artificial Sequence
  Synthetic
cgggtgaaucaatgtgggaaug

SEQ ID NO: 70856 - DNA, 21 bp, Artificial Sequence
  Synthetic
ggtggccccugaatguagaga

SEQ ID NO: 70857 - DNA, 23 bp, Artificial Sequence
  Synthetic
tctagcccugtctgtccataucc

SEQ ID NO: 70858 - DNA, 20 bp, Artificial Sequence
  Synthetic
agagtgugaggcggtacuca

SEQ ID NO: 70859 - DNA, 21 bp, Artificial Sequence
  Synthetic
tctgctgguctgaccctgtua

SEQ ID NO: 70860 - DNA, 25 bp, Artificial Sequence
  Synthetic
gagtacaucatggaccuaggaggaa

SEQ ID NO: 70861 - DNA, 25 bp, Artificial Sequence
  Synthetic
caggacaaaggauccatucagaagt

SEQ ID NO: 70862 - DNA, 22 bp, Artificial Sequence
  Synthetic
gtacgtcuggtggtcaaucagg

SEQ ID NO: 70863 - DNA, 23 bp, Artificial Sequence
  Synthetic
ctgatggagcgutgtatcacuga

SEQ ID NO: 70864 - DNA, 21 bp, Artificial Sequence
  Synthetic
ctcctccauggtgatctgcut

SEQ ID NO: 70865 - DNA, 21 bp, Artificial Sequence
  Synthetic
tggcuaccucaacaaggacac

SEQ ID NO: 70866 - DNA, 17 bp, Artificial Sequence
  Synthetic
caccugcgaggcaguga

SEQ ID NO: 70867 - DNA, 17 bp, Artificial Sequence
  Synthetic
ctgguggccagcaugga

SEQ ID NO: 70868 - DNA, 19 bp, Artificial Sequence
  Synthetic
gtaguggtggcugcaggag

SEQ ID NO: 70869 - DNA, 17 bp, Artificial Sequence
  Synthetic
ctcagccccacgugcut

SEQ ID NO: 70870 - DNA, 18 bp, Artificial Sequence
  Synthetic
caccagcucccggtacuc

SEQ ID NO: 70871 - DNA, 18 bp, Artificial Sequence
  Synthetic
gtggaugtcccucagccc

SEQ ID NO: 70872 - DNA, 21 bp, Artificial Sequence
  Synthetic
ccaacgugtctgaagtugcct

SEQ ID NO: 70873 - DNA, 19 bp, Artificial Sequence
  Synthetic
ggcagucggaggacaugac

SEQ ID NO: 70874 - DNA, 19 bp, Artificial Sequence
  Synthetic
ccagccccacuaggugaga

SEQ ID NO: 70875 - DNA, 19 bp, Artificial Sequence
  Synthetic
cgagggaggucttgcugga

SEQ ID NO: 70876 - DNA, 21 bp, Artificial Sequence
  Synthetic
tctcaggugacacctccucaa

SEQ ID NO: 70877 - DNA, 17 bp, Artificial Sequence
  Synthetic
ccaccuccgccaguacc

SEQ ID NO: 70878 - DNA, 18 bp, Artificial Sequence
  Synthetic
cagcgacccacaguguca

SEQ ID NO: 70879 - DNA, 18 bp, Artificial Sequence
  Synthetic
tggactcugcctgguggt

SEQ ID NO: 70880 - DNA, 25 bp, Artificial Sequence
  Synthetic
gcatacccaagaccutgagugaaaa

SEQ ID NO: 70881 - DNA, 26 bp, Artificial Sequence
  Synthetic
gcattgtacauaaaaggcactugcat

SEQ ID NO: 70882 - DNA, 21 bp, Artificial Sequence
  Synthetic
gtgaacuccactcctaugcca

SEQ ID NO: 70883 - DNA, 23 bp, Artificial Sequence
  Synthetic
gatcugaaccgaggacacctuag

SEQ ID NO: 70884 - DNA, 27 bp, Artificial Sequence
  Synthetic
gtgcagcaauaaagtcatattctcugg

SEQ ID NO: 70885 - DNA, 21 bp, Artificial Sequence
  Synthetic
ctgaccttgugcctcttcugt

SEQ ID NO: 70886 - DNA, 20 bp, Artificial Sequence
  Synthetic
cctccgtcutctcccaguct

SEQ ID NO: 70887 - DNA, 25 bp, Artificial Sequence
  Synthetic
gaaacaggctugtaattgtgagucc

SEQ ID NO: 70888 - DNA, 22 bp, Artificial Sequence
  Synthetic
ccactccauctgactcccugat

SEQ ID NO: 70889 - DNA, 23 bp, Artificial Sequence
  Synthetic
gagaggaaggauagugcaaaggg

SEQ ID NO: 70890 - DNA, 29 bp, Artificial Sequence
  Synthetic
tgcttatatgcacutactttgacactuca

SEQ ID NO: 70891 - DNA, 22 bp, Artificial Sequence
  Synthetic
gcacagaagguggaacagaugt

SEQ ID NO: 70892 - DNA, 24 bp, Artificial Sequence
  Synthetic
gacttguaaatcaggtugcgcaaa

SEQ ID NO: 70893 - DNA, 28 bp, Artificial Sequence
  Synthetic
tggtttagaagaugctgtcgttgaaaua

SEQ ID NO: 70894 - DNA, 31 bp, Artificial Sequence
  Synthetic
gacagacaaaaautcacatccuagaaaaagt

SEQ ID NO: 70895 - DNA, 27 bp, Artificial Sequence
  Synthetic
caggaaauggagaagatgactgaugaa

SEQ ID NO: 70896 - DNA, 25 bp, Artificial Sequence
  Synthetic
caccaaauaaaccaagcaggacauc

SEQ ID NO: 70897 - DNA, 23 bp, Artificial Sequence
  Synthetic
gacuccagaggtcauaggaacct

SEQ ID NO: 70898 - DNA, 21 bp, Artificial Sequence
  Synthetic
gccacatuaacagccgcctua

SEQ ID NO: 70899 - DNA, 25 bp, Artificial Sequence
  Synthetic
gacatagaggaucaggaaguggagt

SEQ ID NO: 70900 - DNA, 19 bp, Artificial Sequence
  Synthetic
ggagaagccacgugctcua

SEQ ID NO: 70901 - DNA, 18 bp, Artificial Sequence
  Synthetic
cgacgcaguggaaaugcc

SEQ ID NO: 70902 - DNA, 25 bp, Artificial Sequence
  Synthetic
ggccacugagatagaaaagtucaga

SEQ ID NO: 70903 - DNA, 26 bp, Artificial Sequence
  Synthetic
cgaagugaggagaacaaaggacuaag

SEQ ID NO: 70904 - DNA, 21 bp, Artificial Sequence
  Synthetic
gttaatgtgucctcgguggct

SEQ ID NO: 70905 - DNA, 25 bp, Artificial Sequence
  Synthetic
caagttgctguggacctctaattug

SEQ ID NO: 70906 - DNA, 21 bp, Artificial Sequence
  Synthetic
gcacagacaacccutcccauc

SEQ ID NO: 70907 - DNA, 21 bp, Artificial Sequence
  Synthetic
gagttgccugagccacttcut

SEQ ID NO: 70908 - DNA, 17 bp, Artificial Sequence
  Synthetic
gaggaggucggctgguc

SEQ ID NO: 70909 - DNA, 19 bp, Artificial Sequence
  Synthetic
gggacaaggcguaguggat

SEQ ID NO: 70910 - DNA, 20 bp, Artificial Sequence
  Synthetic
ggctgguggagataaugggt

SEQ ID NO: 70911 - DNA, 18 bp, Artificial Sequence
  Synthetic
cgtcttguccccgucaca

SEQ ID NO: 70912 - DNA, 26 bp, Artificial Sequence
  Synthetic
tgctacttcugaattgaaatggtuca

SEQ ID NO: 70913 - DNA, 27 bp, Artificial Sequence
  Synthetic
gattacctaccautactctgcagtgut

SEQ ID NO: 70914 - DNA, 23 bp, Artificial Sequence
  Synthetic
cactcatcacgauttcaggccua

SEQ ID NO: 70915 - DNA, 24 bp, Artificial Sequence
  Synthetic
auagagagtaccugggaacaacct

SEQ ID NO: 70916 - DNA, 26 bp, Artificial Sequence
  Synthetic
tccattacagtccuaaacctgagcua

SEQ ID NO: 70917 - DNA, 24 bp, Artificial Sequence
  Synthetic
ggcaaggguttgaagaacatucat

SEQ ID NO: 70918 - DNA, 26 bp, Artificial Sequence
  Synthetic
gattggaaucacattacccuggagaa

SEQ ID NO: 70919 - DNA, 20 bp, Artificial Sequence
  Synthetic
ggcacucctagccauagcac

SEQ ID NO: 70920 - DNA, 21 bp, Artificial Sequence
  Synthetic
tctgacccaagccutggaauc

SEQ ID NO: 70921 - DNA, 23 bp, Artificial Sequence
  Synthetic
acctcauaaccatctuccagcct

SEQ ID NO: 70922 - DNA, 22 bp, Artificial Sequence
  Synthetic
cctctgacccagugccctaaua

SEQ ID NO: 70923 - DNA, 21 bp, Artificial Sequence
  Synthetic
cctcctcugacctcacaugga

SEQ ID NO: 70924 - DNA, 22 bp, Artificial Sequence
  Synthetic
gcaaagggagggaauggucaat

SEQ ID NO: 70925 - DNA, 23 bp, Artificial Sequence
  Synthetic
cttgatccgaugcctctttucct

SEQ ID NO: 70926 - DNA, 19 bp, Artificial Sequence
  Synthetic
acccauccgaagctcucca

SEQ ID NO: 70927 - DNA, 21 bp, Artificial Sequence
  Synthetic
gactgcucacccctaaccaut

SEQ ID NO: 70928 - DNA, 18 bp, Artificial Sequence
  Synthetic
caggcagcugtccuccac

SEQ ID NO: 70929 - DNA, 19 bp, Artificial Sequence
  Synthetic
tgcccaccuaccctgacut

SEQ ID NO: 70930 - DNA, 19 bp, Artificial Sequence
  Synthetic
acacugcggccaaauaggg

SEQ ID NO: 70931 - DNA, 23 bp, Artificial Sequence
  Synthetic
cctcagtggugagtgagagaugt

SEQ ID NO: 70932 - DNA, 24 bp, Artificial Sequence
  Synthetic
gggaatcctuacctctgtcuccaa

SEQ ID NO: 70933 - DNA, 21 bp, Artificial Sequence
  Synthetic
ctttgccacagugcaguacag

SEQ ID NO: 70934 - DNA, 21 bp, Artificial Sequence
  Synthetic
ggatggcagcagguctttcut

SEQ ID NO: 70935 - DNA, 19 bp, Artificial Sequence
  Synthetic
caucgaccgcgagctcuac

SEQ ID NO: 70936 - DNA, 18 bp, Artificial Sequence
  Synthetic
ccgccucagccttgaguc

SEQ ID NO: 70937 - DNA, 19 bp, Artificial Sequence
  Synthetic
acaauacgcagcgctucct

SEQ ID NO: 70938 - DNA, 20 bp, Artificial Sequence
  Synthetic
cttctcgaagcucgcctuca

SEQ ID NO: 70939 - DNA, 20 bp, Artificial Sequence
  Synthetic
acaaggcugacaucgaggag

SEQ ID NO: 70940 - DNA, 17 bp, Artificial Sequence
  Synthetic
ccguagcgcctcgtugg

SEQ ID NO: 70941 - DNA, 17 bp, Artificial Sequence
  Synthetic
agcaaacgcgccuccut

SEQ ID NO: 70942 - DNA, 20 bp, Artificial Sequence
  Synthetic
ggcuccggaagaaccttuca

SEQ ID NO: 70943 - DNA, 23 bp, Artificial Sequence
  Synthetic
ctgtggtcucagttcctgaagut

SEQ ID NO: 70944 - DNA, 23 bp, Artificial Sequence
  Synthetic
cagagaugaaaggugagcacaca

SEQ ID NO: 70945 - DNA, 22 bp, Artificial Sequence
  Synthetic
ccaggtaagcuggtcttgtcuc

SEQ ID NO: 70946 - DNA, 23 bp, Artificial Sequence
  Synthetic
agtcccagagagaauccaggtut

SEQ ID NO: 70947 - DNA, 20 bp, Artificial Sequence
  Synthetic
gttgagtgcugaccgtctug

SEQ ID NO: 70948 - DNA, 23 bp, Artificial Sequence
  Synthetic
ggagaacctugtcctcctcttug

SEQ ID NO: 70949 - DNA, 21 bp, Artificial Sequence
  Synthetic
aggagggautcgaagguggaa

SEQ ID NO: 70950 - DNA, 21 bp, Artificial Sequence
  Synthetic
tgtaggcaaggacuccaucgt

SEQ ID NO: 70951 - DNA, 28 bp, Artificial Sequence
  Synthetic
gctgcgagtuataatgtgttacaaucat

SEQ ID NO: 70952 - DNA, 22 bp, Artificial Sequence
  Synthetic
ccaagaactugccgcagtttut

SEQ ID NO: 70953 - DNA, 20 bp, Artificial Sequence
  Synthetic
actcctcccutctgctucgt

SEQ ID NO: 70954 - DNA, 22 bp, Artificial Sequence
  Synthetic
gcagatggucttttggtgucct

SEQ ID NO: 70955 - DNA, 22 bp, Artificial Sequence
  Synthetic
ggagggaaugcacacagatguc

SEQ ID NO: 70956 - DNA, 20 bp, Artificial Sequence
  Synthetic
tcctcccauttgcagaugcc

SEQ ID NO: 70957 - DNA, 24 bp, Artificial Sequence
  Synthetic
ttcccaaccuatgcttacctttuc

SEQ ID NO: 70958 - DNA, 23 bp, Artificial Sequence
  Synthetic
accttttgggcucctttggtauc

SEQ ID NO: 70959 - DNA, 25 bp, Artificial Sequence
  Synthetic
cgacgacagtutagtggagcttuac

SEQ ID NO: 70960 - DNA, 28 bp, Artificial Sequence
  Synthetic
ctcaccttuaaattagctttugccaact

SEQ ID NO: 70961 - DNA, 22 bp, Artificial Sequence
  Synthetic
gaguctgcattugaaagcccaa

SEQ ID NO: 70962 - DNA, 20 bp, Artificial Sequence
  Synthetic
gtgggucgcagagatctgut

SEQ ID NO: 70963 - DNA, 28 bp, Artificial Sequence
  Synthetic
ggttggcagugaaaaacataacattuga

SEQ ID NO: 70964 - DNA, 22 bp, Artificial Sequence
  Synthetic
gtggttugacccacctctacut

SEQ ID NO: 70965 - DNA, 22 bp, Artificial Sequence
  Synthetic
aactuggaacagagacctuggg

SEQ ID NO: 70966 - DNA, 26 bp, Artificial Sequence
  Synthetic
tcuatagaaacctucagggaagacac

SEQ ID NO: 70967 - DNA, 21 bp, Artificial Sequence
  Synthetic
tgctgcgcuctgctatctauc

SEQ ID NO: 70968 - DNA, 21 bp, Artificial Sequence
  Synthetic
gcuggacucaaaaaccccgaa

SEQ ID NO: 70969 - DNA, 23 bp, Artificial Sequence
  Synthetic
tgtgtgaatugtgctgtgauggt

SEQ ID NO: 70970 - DNA, 23 bp, Artificial Sequence
  Synthetic
ggagggatccugggaacaacuaa

SEQ ID NO: 70971 - DNA, 21 bp, Artificial Sequence
  Synthetic
agcaagaagaccgcgucauag

SEQ ID NO: 70972 - DNA, 20 bp, Artificial Sequence
  Synthetic
tccctccugctggacctuat

SEQ ID NO: 70973 - DNA, 23 bp, Artificial Sequence
  Synthetic
ttgagtacgaauctgccauccac

SEQ ID NO: 70974 - DNA, 18 bp, Artificial Sequence
  Synthetic
gctgugcgggtcuaggga

SEQ ID NO: 70975 - DNA, 18 bp, Artificial Sequence
  Synthetic
gcggcaugaguggcaaag

SEQ ID NO: 70976 - DNA, 25 bp, Artificial Sequence
  Synthetic
ctcatctgugcaaagaggacaguaa

SEQ ID NO: 70977 - DNA, 26 bp, Artificial Sequence
  Synthetic
acaccttcatcucatagtcgcaauac

SEQ ID NO: 70978 - DNA, 22 bp, Artificial Sequence
  Synthetic
gatgtgccauagacaaggugga

SEQ ID NO: 70979 - DNA, 27 bp, Artificial Sequence
  Synthetic
tgccaccauagagggtauagaaaaact

SEQ ID NO: 70980 - DNA, 20 bp, Artificial Sequence
  Synthetic
cagctctgutagccccauct

SEQ ID NO: 70981 - DNA, 28 bp, Artificial Sequence
  Synthetic
caatgattaggaaaacucaacttgcuga

SEQ ID NO: 70982 - DNA, 21 bp, Artificial Sequence
  Synthetic
gctaaagggcucagagugcag

SEQ ID NO: 70983 - DNA, 20 bp, Artificial Sequence
  Synthetic
tcctcacggugaacgtctug

SEQ ID NO: 70984 - DNA, 21 bp, Artificial Sequence
  Synthetic
tgacccaagcucctaauccga

SEQ ID NO: 70985 - DNA, 24 bp, Artificial Sequence
  Synthetic
cccaatcacucagtctagtucaca

SEQ ID NO: 70986 - DNA, 25 bp, Artificial Sequence
  Synthetic
tctaagactuacccccatggttuca

SEQ ID NO: 70987 - DNA, 24 bp, Artificial Sequence
  Synthetic
cctttcatucacaagcccattugt

SEQ ID NO: 70988 - DNA, 27 bp, Artificial Sequence
  Synthetic
ctaaattccugaacatcaccuagcact

SEQ ID NO: 70989 - DNA, 28 bp, Artificial Sequence
  Synthetic
catggcttgaaaautactggacugaaaa

SEQ ID NO: 70990 - DNA, 19 bp, Artificial Sequence
  Synthetic
gatuaggagccgtgugcgt

SEQ ID NO: 70991 - DNA, 24 bp, Artificial Sequence
  Synthetic
cttcctagguaggtcttggcauag

SEQ ID NO: 70992 - DNA, 21 bp, Artificial Sequence
  Synthetic
gagcacacuggtcacattugg

SEQ ID NO: 70993 - DNA, 20 bp, Artificial Sequence
  Synthetic
ttttcauggagcgtcugcct

SEQ ID NO: 70994 - DNA, 19 bp, Artificial Sequence
  Synthetic
agcauggccgugacagaag

SEQ ID NO: 70995 - DNA, 27 bp, Artificial Sequence
  Synthetic
agactctatgugcctctaacttcctut

SEQ ID NO: 70996 - DNA, 23 bp, Artificial Sequence
  Synthetic
cccugcaggaaacaagaaaaugg

SEQ ID NO: 70997 - DNA, 20 bp, Artificial Sequence
  Synthetic
cccucacccgctattugcat

SEQ ID NO: 70998 - DNA, 20 bp, Artificial Sequence
  Synthetic
ccuggacccccaauaaaccc

SEQ ID NO: 70999 - DNA, 20 bp, Artificial Sequence
  Synthetic
gttccagcagacuccccaut

SEQ ID NO: 71000 - DNA, 24 bp, Artificial Sequence
  Synthetic
aggaagacaccuttaagcgtugaa

SEQ ID NO: 71001 - DNA, 25 bp, Artificial Sequence
  Synthetic
tctccatgaccutctcttcatccuc

SEQ ID NO: 71002 - DNA, 20 bp, Artificial Sequence
  Synthetic
cacgguggccttcucaaaga

SEQ ID NO: 71003 - DNA, 19 bp, Artificial Sequence
  Synthetic
ggagaugaaccgcgtccug

SEQ ID NO: 71004 - DNA, 20 bp, Artificial Sequence
  Synthetic
cagcaggutcttctgguggt

SEQ ID NO: 71005 - DNA, 19 bp, Artificial Sequence
  Synthetic
cugacgcggagauggagaa

SEQ ID NO: 71006 - DNA, 17 bp, Artificial Sequence
  Synthetic
guccagcacgctcugct

SEQ ID NO: 71007 - DNA, 17 bp, Artificial Sequence
  Synthetic
cggcgcuggaggaaguc

SEQ ID NO: 71008 - DNA, 19 bp, Artificial Sequence
  Synthetic
tcctgaaugctgcgctuct

SEQ ID NO: 71009 - DNA, 17 bp, Artificial Sequence
  Synthetic
cagaggcuggcugagca

SEQ ID NO: 71010 - DNA, 18 bp, Artificial Sequence
  Synthetic
cggcauggcctggatcug

SEQ ID NO: 71011 - DNA, 17 bp, Artificial Sequence
  Synthetic
cgggacguggaggugga

SEQ ID NO: 71012 - DNA, 22 bp, Artificial Sequence
  Synthetic
cctgcaggutgccatgacauat

SEQ ID NO: 71013 - DNA, 21 bp, Artificial Sequence
  Synthetic
gctctuggccttctacuacgg

SEQ ID NO: 71014 - DNA, 21 bp, Artificial Sequence
  Synthetic
gggaggcaccuaagtaucgaa

SEQ ID NO: 71015 - DNA, 23 bp, Artificial Sequence
  Synthetic
gtgttcccguttcctcttgauct

SEQ ID NO: 71016 - DNA, 26 bp, Artificial Sequence
  Synthetic
gggtcagacugaggaaaatuaaagga

SEQ ID NO: 71017 - DNA, 23 bp, Artificial Sequence
  Synthetic
atgtctaaugccaccatcctcug

SEQ ID NO: 71018 - DNA, 25 bp, Artificial Sequence
  Synthetic
gcggaagaugaagatttcggattuc

SEQ ID NO: 71019 - DNA, 23 bp, Artificial Sequence
  Synthetic
ggtatcttucctaggctucccaa

SEQ ID NO: 71020 - DNA, 24 bp, Artificial Sequence
  Synthetic
cccctgttgucataggtaggtuag

SEQ ID NO: 71021 - DNA, 25 bp, Artificial Sequence
  Synthetic
cagccauagaaaugagcaaaaccag

SEQ ID NO: 71022 - DNA, 25 bp, Artificial Sequence
  Synthetic
tccagaaugagcattacttcuccct

SEQ ID NO: 71023 - DNA, 22 bp, Artificial Sequence
  Synthetic
acaggcagcugaauaagccaat

SEQ ID NO: 71024 - DNA, 27 bp, Artificial Sequence
  Synthetic
attttattttuggccctcaactuggac

SEQ ID NO: 71025 - DNA, 22 bp, Artificial Sequence
  Synthetic
gatgtagggcuggaagtggtut

SEQ ID NO: 71026 - DNA, 20 bp, Artificial Sequence
  Synthetic
gtgaccucagctgtctgcuc

SEQ ID NO: 71027 - DNA, 24 bp, Artificial Sequence
  Synthetic
acagaggacccuctttcatuacct

SEQ ID NO: 71028 - DNA, 19 bp, Artificial Sequence
  Synthetic
gagcucgggaacgttggua

SEQ ID NO: 71029 - DNA, 18 bp, Artificial Sequence
  Synthetic
gcccagaagacgcugtuc

SEQ ID NO: 71030 - DNA, 24 bp, Artificial Sequence
  Synthetic
ggccatgagucagactgaaauagt

SEQ ID NO: 71031 - DNA, 21 bp, Artificial Sequence
  Synthetic
gagctcaugaacaccaagcug

SEQ ID NO: 71032 - DNA, 29 bp, Artificial Sequence
  Synthetic
acagaattaauacagccaggtcaucaaat

SEQ ID NO: 71033 - DNA, 27 bp, Artificial Sequence
  Synthetic
acuagagaaccaatuagagggaaaggt

SEQ ID NO: 71034 - DNA, 27 bp, Artificial Sequence
  Synthetic
acgaagtccguaagtgttcatacatut

SEQ ID NO: 71035 - DNA, 27 bp, Artificial Sequence
  Synthetic
tgcatgtagguaatgaatctagcaugg

SEQ ID NO: 71036 - DNA, 26 bp, Artificial Sequence
  Synthetic
acagaataguctgtgaauggcaagaa

SEQ ID NO: 71037 - DNA, 28 bp, Artificial Sequence
  Synthetic
gctgatgcuagggaaaaggauaaagaat

SEQ ID NO: 71038 - DNA, 23 bp, Artificial Sequence
  Synthetic
cccatgtcuttgatcttcgucct

SEQ ID NO: 71039 - DNA, 28 bp, Artificial Sequence
  Synthetic
catgtaagguacagaaagaaaggugact

SEQ ID NO: 71040 - DNA, 20 bp, Artificial Sequence
  Synthetic
ccaccaaaucctgctcgtuc

SEQ ID NO: 71041 - DNA, 28 bp, Artificial Sequence
  Synthetic
gaaaattcagcagaaauagacagtugct

SEQ ID NO: 71042 - DNA, 20 bp, Artificial Sequence
  Synthetic
caaugcacagcaccgtgaug

SEQ ID NO: 71043 - DNA, 23 bp, Artificial Sequence
  Synthetic
agagcagtguggaataccatcug

SEQ ID NO: 71044 - DNA, 23 bp, Artificial Sequence
  Synthetic
catggtgtucagaggaagugaga

SEQ ID NO: 71045 - DNA, 22 bp, Artificial Sequence
  Synthetic
ggccacaagcautgcttatgut

SEQ ID NO: 71046 - DNA, 21 bp, Artificial Sequence
  Synthetic
atgcccaagaucctgactgug

SEQ ID NO: 71047 - DNA, 23 bp, Artificial Sequence
  Synthetic
ccagagaagcugggatgttguag

SEQ ID NO: 71048 - DNA, 26 bp, Artificial Sequence
  Synthetic
gagtggaagutctcagagacuaacag

SEQ ID NO: 71049 - DNA, 27 bp, Artificial Sequence
  Synthetic
accatttacaggaugtagaggttccut

SEQ ID NO: 71050 - DNA, 21 bp, Artificial Sequence
  Synthetic
actgtcttuctctgcccucca

SEQ ID NO: 71051 - DNA, 21 bp, Artificial Sequence
  Synthetic
ggcatggatugggcctgauaa

SEQ ID NO: 71052 - DNA, 27 bp, Artificial Sequence
  Synthetic
gattgaaaccaagcutgcgagaaaaua

SEQ ID NO: 71053 - DNA, 20 bp, Artificial Sequence
  Synthetic
tgcaaugaccccgttctcuc

SEQ ID NO: 71054 - DNA, 27 bp, Artificial Sequence
  Synthetic
cgcctggcaauaaatatcttaauagca

SEQ ID NO: 71055 - DNA, 28 bp, Artificial Sequence
  Synthetic
ggcgatacugaggaggattttattguat

SEQ ID NO: 71056 - DNA, 17 bp, Artificial Sequence
  Synthetic
tcgtggguccggugaac

SEQ ID NO: 71057 - DNA, 17 bp, Artificial Sequence
  Synthetic
gccuccacccacagguc

SEQ ID NO: 71058 - DNA, 18 bp, Artificial Sequence
  Synthetic
accccaguccgccuaagt

SEQ ID NO: 71059 - DNA, 17 bp, Artificial Sequence
  Synthetic
ccacgucatcgcugcct

SEQ ID NO: 71060 - DNA, 19 bp, Artificial Sequence
  Synthetic
ccagugaccccctgtccut

SEQ ID NO: 71061 - DNA, 22 bp, Artificial Sequence
  Synthetic
ccccataaauagccaggcugag

SEQ ID NO: 71062 - DNA, 22 bp, Artificial Sequence
  Synthetic
ccctcuccagagagaacccuat

SEQ ID NO: 71063 - DNA, 21 bp, Artificial Sequence
  Synthetic
cccacaccucgtaggtctuag

SEQ ID NO: 71064 - DNA, 22 bp, Artificial Sequence
  Synthetic
gtgggaguaacactgcacuact

SEQ ID NO: 71065 - DNA, 20 bp, Artificial Sequence
  Synthetic
gtgcaccugggattcaaugg

SEQ ID NO: 71066 - DNA, 22 bp, Artificial Sequence
  Synthetic
ggatttactggucagccagcua

SEQ ID NO: 71067 - DNA, 25 bp, Artificial Sequence
  Synthetic
tggtgaggcaaautaggtgtgtaug

SEQ ID NO: 71068 - DNA, 24 bp, Artificial Sequence
  Synthetic
ttcctaaggutgcacauaggcaaa

SEQ ID NO: 71069 - DNA, 27 bp, Artificial Sequence
  Synthetic
cccagcttcuctgtctaagtaguaact

SEQ ID NO: 71070 - DNA, 29 bp, Artificial Sequence
  Synthetic
tggcaaacaauaccaaatttacttcaugt

SEQ ID NO: 71071 - DNA, 28 bp, Artificial Sequence
  Synthetic
gcccataaaggaaugtaaaccaacaaug

SEQ ID NO: 71072 - DNA, 20 bp, Artificial Sequence
  Synthetic
aggctgucggactgaaacug

SEQ ID NO: 71073 - DNA, 28 bp, Artificial Sequence
  Synthetic
cttcacaagatgucactctgatatccut

SEQ ID NO: 71074 - DNA, 28 bp, Artificial Sequence
  Synthetic
ttcagacacaacaautgctttcatuacc

SEQ ID NO: 71075 - DNA, 28 bp, Artificial Sequence
  Synthetic
gaacagtgcttugagtatatgctaguca

SEQ ID NO: 71076 - DNA, 21 bp, Artificial Sequence
  Synthetic
tcctccagucctgggaaguag

SEQ ID NO: 71077 - DNA, 21 bp, Artificial Sequence
  Synthetic
ctggacugctccaucacacat

SEQ ID NO: 71078 - DNA, 22 bp, Artificial Sequence
  Synthetic
tgagccttcuctgctcaguagt

SEQ ID NO: 71079 - DNA, 22 bp, Artificial Sequence
  Synthetic
tctgtgactgaugcctgtgtug

SEQ ID NO: 71080 - DNA, 21 bp, Artificial Sequence
  Synthetic
cgacccaucaggactcaguca

SEQ ID NO: 71081 - DNA, 20 bp, Artificial Sequence
  Synthetic
gtgattugaccccugcacct

SEQ ID NO: 71082 - DNA, 19 bp, Artificial Sequence
  Synthetic
ggagaaccaggcccutcug

SEQ ID NO: 71083 - DNA, 18 bp, Artificial Sequence
  Synthetic
cggaaccagcgccuguat

SEQ ID NO: 71084 - DNA, 17 bp, Artificial Sequence
  Synthetic
tggagcucgccguaggt

SEQ ID NO: 71085 - DNA, 18 bp, Artificial Sequence
  Synthetic
cucatuccccgggagcag

SEQ ID NO: 71086 - DNA, 17 bp, Artificial Sequence
  Synthetic
gcccgucgcacguagag

SEQ ID NO: 71087 - DNA, 20 bp, Artificial Sequence
  Synthetic
ctggugcagacacuggagat

SEQ ID NO: 71088 - DNA, 21 bp, Artificial Sequence
  Synthetic
gcggagcgaucacaactguat

SEQ ID NO: 71089 - DNA, 21 bp, Artificial Sequence
  Synthetic
tttgccacuccttcctcagug

SEQ ID NO: 71090 - DNA, 20 bp, Artificial Sequence
  Synthetic
ggcctuggaggagttctgug

SEQ ID NO: 71091 - DNA, 21 bp, Artificial Sequence
  Synthetic
agacctcaccguctcatcugt

SEQ ID NO: 71092 - DNA, 22 bp, Artificial Sequence
  Synthetic
acttacagcaaaauggccucgt

SEQ ID NO: 71093 - DNA, 26 bp, Artificial Sequence
  Synthetic
tgcatggctcutagatttgagtgaut

SEQ ID NO: 71094 - DNA, 20 bp, Artificial Sequence
  Synthetic
gcggtccaugtaaccaugac

SEQ ID NO: 71095 - DNA, 28 bp, Artificial Sequence
  Synthetic
tcttttcatggtcucgtctcctaattuc

SEQ ID NO: 71096 - DNA, 26 bp, Artificial Sequence
  Synthetic
gaactaatacuccaggtgcattucca

SEQ ID NO: 71097 - DNA, 22 bp, Artificial Sequence
  Synthetic
ggtgcuaatgtccugaccacag

SEQ ID NO: 71098 - DNA, 20 bp, Artificial Sequence
  Synthetic
cagcatctcuacggcacgua

SEQ ID NO: 71099 - DNA, 21 bp, Artificial Sequence
  Synthetic
ccatgccaagcutcagtguca

SEQ ID NO: 71100 - DNA, 21 bp, Artificial Sequence
  Synthetic
gcaagagcaucucaagcagac

SEQ ID NO: 71101 - DNA, 28 bp, Artificial Sequence
  Synthetic
aggacacattcuaaatcaacacaccaut

SEQ ID NO: 71102 - DNA, 25 bp, Artificial Sequence
  Synthetic
agccattccuataaagcaucccaat

SEQ ID NO: 71103 - DNA, 22 bp, Artificial Sequence
  Synthetic
ggatagcatcaucgctgagguc

SEQ ID NO: 71104 - DNA, 27 bp, Artificial Sequence
  Synthetic
agtcgaaaaatgcutgtctctagtugt

SEQ ID NO: 71105 - DNA, 28 bp, Artificial Sequence
  Synthetic
tccatggcaaaccutatcttctaactut

SEQ ID NO: 71106 - DNA, 26 bp, Artificial Sequence
  Synthetic
catatcccacucccaacatctaaugt

SEQ ID NO: 71107 - DNA, 27 bp, Artificial Sequence
  Synthetic
caacaatcuagggacaaggaaguagag

SEQ ID NO: 71108 - DNA, 27 bp, Artificial Sequence
  Synthetic
acctggacaaagguacacaagauaaag

SEQ ID NO: 71109 - DNA, 28 bp, Artificial Sequence
  Synthetic
catctgatatatcugtgttgctgcatut

SEQ ID NO: 71110 - DNA, 25 bp, Artificial Sequence
  Synthetic
ctcttaccagcutctttcugcagat

SEQ ID NO: 71111 - DNA, 24 bp, Artificial Sequence
  Synthetic
tggtgcaaacuacagatgguacac

SEQ ID NO: 71112 - DNA, 27 bp, Artificial Sequence
  Synthetic
ctcaatatcaatuggtcccaggctuaa

SEQ ID NO: 71113 - DNA, 21 bp, Artificial Sequence
  Synthetic
agctccatugaaggcaagguc

SEQ ID NO: 71114 - DNA, 26 bp, Artificial Sequence
  Synthetic
gcagaaatagucgagttgtatugcca

SEQ ID NO: 71115 - DNA, 23 bp, Artificial Sequence
  Synthetic
cctgtgagttugcctgttttcuc

SEQ ID NO: 71116 - DNA, 20 bp, Artificial Sequence
  Synthetic
gguttgugaggacccacaac

SEQ ID NO: 71117 - DNA, 26 bp, Artificial Sequence
  Synthetic
gcttttcttaccugccttgaactcut

SEQ ID NO: 71118 - DNA, 20 bp, Artificial Sequence
  Synthetic
gggaaggaacggucaccuac

SEQ ID NO: 71119 - DNA, 22 bp, Artificial Sequence
  Synthetic
tcuctcuggacacacagaacct

SEQ ID NO: 71120 - DNA, 22 bp, Artificial Sequence
  Synthetic
gcacacaugagacacagcauga

SEQ ID NO: 71121 - DNA, 26 bp, Artificial Sequence
  Synthetic
gtgtctttccauctggtttcttccut

SEQ ID NO: 71122 - DNA, 18 bp, Artificial Sequence
  Synthetic
cacccuggctcagcaugt

SEQ ID NO: 71123 - DNA, 19 bp, Artificial Sequence
  Synthetic
ccccacaggcaucgugaag

SEQ ID NO: 71124 - DNA, 23 bp, Artificial Sequence
  Synthetic
gacagugagccaatggaaaugag

SEQ ID NO: 71125 - DNA, 20 bp, Artificial Sequence
  Synthetic
gagaaaccgauggccaccua

SEQ ID NO: 71126 - DNA, 24 bp, Artificial Sequence
  Synthetic
atcttctcatacuggtcacgcauc

SEQ ID NO: 71127 - DNA, 24 bp, Artificial Sequence
  Synthetic
gcagtautcaggccuaaggaacac

SEQ ID NO: 71128 - DNA, 21 bp, Artificial Sequence
  Synthetic
gctttcctccugggctgttuc

SEQ ID NO: 71129 - DNA, 24 bp, Artificial Sequence
  Synthetic
gggacacuggaagttgtcatacuc

SEQ ID NO: 71130 - DNA, 19 bp, Artificial Sequence
  Synthetic
cctuccgggacgaggauga

SEQ ID NO: 71131 - DNA, 17 bp, Artificial Sequence
  Synthetic
ccuccccaccgagcuct

SEQ ID NO: 71132 - DNA, 27 bp, Artificial Sequence
  Synthetic
actacgaagagcuaataagaggtcugt

SEQ ID NO: 71133 - DNA, 24 bp, Artificial Sequence
  Synthetic
caacgttugcactatgacctucag

SEQ ID NO: 71134 - DNA, 20 bp, Artificial Sequence
  Synthetic
ctcttgccuccactggtugt

SEQ ID NO: 71135 - DNA, 21 bp, Artificial Sequence
  Synthetic
ggatcgctuttccgagctuct

SEQ ID NO: 71136 - DNA, 20 bp, Artificial Sequence
  Synthetic
gccaccgcuatcacctucag

SEQ ID NO: 71137 - DNA, 25 bp, Artificial Sequence
  Synthetic
cutcaatggctauagagagaaccca

SEQ ID NO: 71138 - DNA, 25 bp, Artificial Sequence
  Synthetic
gacagcaaauggaaaaagauaggca

SEQ ID NO: 71139 - DNA, 28 bp, Artificial Sequence
  Synthetic
cgctgtcctucaaggtctaacttauaaa

SEQ ID NO: 71140 - DNA, 21 bp, Artificial Sequence
  Synthetic
gaaauctuccacgagcagggt

SEQ ID NO: 71141 - DNA, 21 bp, Artificial Sequence
  Synthetic
cccgcgggaagaugaauaagg

SEQ ID NO: 71142 - DNA, 26 bp, Artificial Sequence
  Synthetic
tagagaaataugctccagtgguaagt

SEQ ID NO: 71143 - DNA, 26 bp, Artificial Sequence
  Synthetic
tgtaagauaaattcccugaccccagt

SEQ ID NO: 71144 - DNA, 30 bp, Artificial Sequence; identical to SEQ ID NO: 53008
  Synthetic

SEQ ID NO: 71145 - DNA, 24 bp, Artificial Sequence
  Synthetic
catccatgcutgacactgaaauct

SEQ ID NO: 71146 - DNA, 26 bp, Artificial Sequence
  Synthetic
tcatgatgagauttcagtgucaagca

SEQ ID NO: 71147 - DNA, 22 bp, Artificial Sequence
  Synthetic
tgtctctccauttgccgcauat

SEQ ID NO: 71148 - DNA, 18 bp, Artificial Sequence
  Synthetic
gtcgcuctccagcuccag

SEQ ID NO: 71149 - DNA, 17 bp, Artificial Sequence
  Synthetic
ctgggcccgutgtcugt

SEQ ID NO: 71150 - DNA, 18 bp, Artificial Sequence
  Synthetic
gaaccagggccugtuggt

SEQ ID NO: 71151 - DNA, 22 bp, Artificial Sequence
  Synthetic
gcttccagcucctcuaaaagca

SEQ ID NO: 71152 - DNA, 28 bp, Artificial Sequence
  Synthetic
acaaagtatuaaaggccatctgtaccug

SEQ ID NO: 71153 - DNA, 27 bp, Artificial Sequence
  Synthetic
ttctccctggucatcttcttctaugat

SEQ ID NO: 71154 - DNA, 28 bp, Artificial Sequence
  Synthetic
agttctgttaaagutcatggcttttgug

SEQ ID NO: 71155 - DNA, 24 bp, Artificial Sequence
  Synthetic
agcgtttacgaucctctttcagug

SEQ ID NO: 71156 - DNA, 23 bp, Artificial Sequence
  Synthetic
accuggttucagagagagagagg

SEQ ID NO: 71157 - DNA, 28 bp, Artificial Sequence
  Synthetic
caaatcctactgaautggtgatccatug

SEQ ID NO: 71158 - DNA, 26 bp, Artificial Sequence
  Synthetic
gggtcagggaauttatctuacacaca

SEQ ID NO: 71159 - DNA, 27 bp, Artificial Sequence
  Synthetic
aacatagaaacaacacuggctgagtua

SEQ ID NO: 71160 - DNA, 17 bp, Artificial Sequence
  Synthetic
gcuggaccccgcgaaug

SEQ ID NO: 71161 - DNA, 17 bp, Artificial Sequence
  Synthetic
agcagcugcaccaugct

SEQ ID NO: 71162 - DNA, 22 bp, Artificial Sequence
  Synthetic
ggaaacgtgugccagtgatuct

SEQ ID NO: 71163 - DNA, 24 bp, Artificial Sequence
  Synthetic
gactttggaaacgcucatgttuca

SEQ ID NO: 71164 - DNA, 23 bp, Artificial Sequence
  Synthetic
gaaaacaacagccutagcauggt

SEQ ID NO: 71165 - DNA, 20 bp, Artificial Sequence
  Synthetic
aaaggaucagagcuggacgc

SEQ ID NO: 71166 - DNA, 28 bp, Artificial Sequence
  Synthetic
ggaggtttcugaaatgtgtatagctugt

SEQ ID NO: 71167 - DNA, 25 bp, Artificial Sequence
  Synthetic
tcatccaaaguttcagggttcucag

SEQ ID NO: 71168 - DNA, 22 bp, Artificial Sequence
  Synthetic
gctccaguccaaaguggaagat

SEQ ID NO: 71169 - DNA, 25 bp, Artificial Sequence
  Synthetic
ctcgttctagutcttgcttcuggaa

SEQ ID NO: 71170 - DNA, 21 bp, Artificial Sequence
  Synthetic
gtcccauagtgcugagaaccc

SEQ ID NO: 71171 - DNA, 27 bp, Artificial Sequence
  Synthetic
acaaggtgaggutctaatccattcuct

SEQ ID NO: 71172 - DNA, 23 bp, Artificial Sequence
  Synthetic
cgacuacaaggaatcaugcagga

SEQ ID NO: 71173 - DNA, 21 bp, Artificial Sequence
  Synthetic
gggctgcagugctttcctuaa

SEQ ID NO: 71174 - DNA, 24 bp, Artificial Sequence
  Synthetic
cgggcaugaaagtggacauaaaag

SEQ ID NO: 71175 - DNA, 25 bp, Artificial Sequence
  Synthetic
acugaagaaacagguggagaacaag

SEQ ID NO: 71176 - DNA, 19 bp, Artificial Sequence
  Synthetic
cagcgccccaaucctuact

SEQ ID NO: 71177 - DNA, 26 bp, Artificial Sequence
  Synthetic
aattattattggagugcaagcgaaug

SEQ ID NO: 71178 - DNA, 28 bp, Artificial Sequence
  Synthetic
aactgcttagtaacuagcagaagtgtuc

SEQ ID NO: 71179 - DNA, 24 bp, Artificial Sequence
  Synthetic
ggauatatgccauaccccagcaaa

SEQ ID NO: 71180 - DNA, 25 bp, Artificial Sequence
  Synthetic
cgagagcuggagttggatgaatuag

SEQ ID NO: 71181 - DNA, 24 bp, Artificial Sequence
  Synthetic
acuccagaatttucaagccagagg

SEQ ID NO: 71182 - DNA, 23 bp, Artificial Sequence
  Synthetic
agtatggatgcucccttctcugt

SEQ ID NO: 71183 - DNA, 19 bp, Artificial Sequence
  Synthetic
atgaggagggcgagucauc

SEQ ID NO: 71184 - DNA, 24 bp, Artificial Sequence
  Synthetic
aactaguaccggagaacactucct

SEQ ID NO: 71185 - DNA, 22 bp, Artificial Sequence
  Synthetic
tgtcttgucaactggccttuga

SEQ ID NO: 71186 - DNA, 28 bp, Artificial Sequence
  Synthetic
ttttagaactaauggacattgcttugcc

SEQ ID NO: 71187 - DNA, 22 bp, Artificial Sequence
  Synthetic
tcatatggccccucccttctut

SEQ ID NO: 71188 - DNA, 28 bp, Artificial Sequence
  Synthetic
gtcagcacaaaauttagcauccagaaat

SEQ ID NO: 71189 - DNA, 26 bp, Artificial Sequence
  Synthetic
gataaaacagtcutcaccaagcagug

SEQ ID NO: 71190 - DNA, 23 bp, Artificial Sequence
  Synthetic
aacggaautgtuaaggcaagcac

SEQ ID NO: 71191 - DNA, 24 bp, Artificial Sequence
  Synthetic
tctggttcaagutggtgttuggaa

SEQ ID NO: 71192 - DNA, 24 bp, Artificial Sequence
  Synthetic
aacatggtgtugaagtcctgcaua

SEQ ID NO: 71193 - DNA, 28 bp, Artificial Sequence
  Synthetic
aatcttctggtaaugcctctgaaaauct

SEQ ID NO: 71194 - DNA, 24 bp, Artificial Sequence
  Synthetic
gggtgggcutctgttctctttuaa

SEQ ID NO: 71195 - DNA, 21 bp, Artificial Sequence
  Synthetic
tctgagccgcauggguaaaaa

SEQ ID NO: 71196 - DNA, 25 bp, Artificial Sequence
  Synthetic
tgtttgcccugtgtaaatctgugaa

SEQ ID NO: 71197 - DNA, 27 bp, Artificial Sequence
  Synthetic
tgccacucagaaaatctagcttuaact

SEQ ID NO: 71198 - DNA, 21 bp, Artificial Sequence
  Synthetic
caagatgggcugccctacaut

SEQ ID NO: 71199 - DNA, 19 bp, Artificial Sequence
  Synthetic
gccacacguacaccauggg

SEQ ID NO: 71200 - DNA, 33 bp, Artificial Sequence
  Synthetic
tttatgauaacaccttatatuacaaaccaccat

SEQ ID NO: 71201 - DNA, 27 bp, Artificial Sequence
  Synthetic
accaaguagcattatcuccagaaagga

SEQ ID NO: 71202 - DNA, 27 bp, Artificial Sequence
  Synthetic
ctcctttcuggagataatgctactugg

SEQ ID NO: 71203 - DNA, 28 bp, Artificial Sequence
  Synthetic
acctctttaaaguacagtacctcaccut

SEQ ID NO: 71204 - DNA, 24 bp, Artificial Sequence
  Synthetic
gcagcagugcactaaauaacgagt

SEQ ID NO: 71205 - DNA, 27 bp, Artificial Sequence
  Synthetic
gggttttaaauaccaggagacaugcaa

SEQ ID NO: 71206 - DNA, 19 bp, Artificial Sequence
  Synthetic
acattcaccugggcgctua

SEQ ID NO: 71207 - DNA, 19 bp, Artificial Sequence
  Synthetic
tgctgatguccggctgaug

SEQ ID NO: 71208 - DNA, 21 bp, Artificial Sequence
  Synthetic
ctccagaacutcctggtugct

SEQ ID NO: 71209 - DNA, 26 bp, Artificial Sequence
  Synthetic
ggtgtgtctatauccatctccatguc

SEQ ID NO: 71210 - DNA, 26 bp, Artificial Sequence
  Synthetic
gaactaatcagcuagaggcgaucaat

SEQ ID NO: 71211 - DNA, 26 bp, Artificial Sequence
  Synthetic
gctttcattuaacatctgccaaugga

SEQ ID NO: 71212 - DNA, 20 bp, Artificial Sequence
  Synthetic
gcaccccaaaaagccutcug

SEQ ID NO: 71213 - DNA, 18 bp, Artificial Sequence
  Synthetic
cggaggcucccttuggat

SEQ ID NO: 71214 - DNA, 27 bp, Artificial Sequence
  Synthetic
atgatatgtggguattccgactttgut

SEQ ID NO: 71215 - DNA, 25 bp, Artificial Sequence
  Synthetic
tguctaagttttucaagcacagggt

SEQ ID NO: 71216 - DNA, 24 bp, Artificial Sequence
  Synthetic
gtctgtuacctgacaacugacact

SEQ ID NO: 71217 - DNA, 20 bp, Artificial Sequence
  Synthetic
tcctcccacccucactcauc

SEQ ID NO: 71218 - DNA, 27 bp, Artificial Sequence
  Synthetic
gggattgtauttgtagcaatucgagaa

SEQ ID NO: 71219 - DNA, 21 bp, Artificial Sequence
  Synthetic
gtgtggcagagagucctgaug

SEQ ID NO: 71220 - DNA, 20 bp, Artificial Sequence
  Synthetic
gcacgcagaggugaagugat

SEQ ID NO: 71221 - DNA, 24 bp, Artificial Sequence
  Synthetic
cccgacugaccagtcttttctaut

SEQ ID NO: 71222 - DNA, 27 bp, Artificial Sequence
  Synthetic
gatagatgactugctgcttccaguaaa

SEQ ID NO: 71223 - DNA, 28 bp, Artificial Sequence
  Synthetic
ggctgaatttuccaaaaagcaucaaaaa

SEQ ID NO: 71224 - DNA, 23 bp, Artificial Sequence
  Synthetic
gctttcauggactctgugaggaa

SEQ ID NO: 71225 - DNA, 26 bp, Artificial Sequence
  Synthetic
ctaggaatggacutggctctguaaag

SEQ ID NO: 71226 - DNA, 23 bp, Artificial Sequence
  Synthetic
tcttgtgccccutcaatgttcuc

SEQ ID NO: 71227 - DNA, 25 bp, Artificial Sequence
  Synthetic
ttttattggtccccutgtcttccuc

SEQ ID NO: 71228 - DNA, 24 bp, Artificial Sequence
  Synthetic
aattcagaaacucttgtccggugt

SEQ ID NO: 71229 - DNA, 27 bp, Artificial Sequence
  Synthetic
cctaccttggcuttctggaataatuct

SEQ ID NO: 71230 - DNA, 27 bp, Artificial Sequence
  Synthetic
gatagagaaaacacugtcugccaagaa

SEQ ID NO: 71231 - DNA, 28 bp, Artificial Sequence
  Synthetic
ctgcaatgtcautcattagctttgaugt

SEQ ID NO: 71232 - DNA, 28 bp, Artificial Sequence
  Synthetic
ggtgtaatagcugaagaggaagcataua

SEQ ID NO: 71233 - DNA, 31 bp, Artificial Sequence; identical to SEQ ID NO: 67359
  Synthetic

SEQ ID NO: 71234 - DNA, 21 bp, Artificial Sequence
  Synthetic
cacgaagugaggttccccauc

SEQ ID NO: 71235 - DNA, 25 bp, Artificial Sequence
  Synthetic
gggtgggaaagaugattatcctgut

SEQ ID NO: 71236 - DNA, 29 bp, Artificial Sequence
  Synthetic
cattgtcctgtatautggttctgtcctut

SEQ ID NO: 71237 - DNA, 22 bp, Artificial Sequence
  Synthetic
cuaaatggguacggcagcagat

SEQ ID NO: 71238 - DNA, 21 bp, Artificial Sequence
  Synthetic
ccuaggagguaggcagagaca

SEQ ID NO: 71239 - DNA, 20 bp, Artificial Sequence
  Synthetic
ggaggcgutccactttguca

SEQ ID NO: 71240 - DNA, 22 bp, Artificial Sequence
  Synthetic
aggtgtguaagcaagaaugcct

SEQ ID NO: 71241 - DNA, 27 bp, Artificial Sequence
  Synthetic
tcctaaacguaagaagcaacactcaut

SEQ ID NO: 71242 - DNA, 21 bp, Artificial Sequence
  Synthetic
cggcctgugataggcacauag

SEQ ID NO: 71243 - DNA, 21 bp, Artificial Sequence
  Synthetic
tttttgggcccugactctgut

SEQ ID NO: 71244 - DNA, 22 bp, Artificial Sequence
  Synthetic
gggataacagaugccgaguacc

SEQ ID NO: 71245 - DNA, 21 bp, Artificial Sequence
  Synthetic
ttcagaucccaagcacugcaa

SEQ ID NO: 71246 - DNA, 25 bp, Artificial Sequence
  Synthetic
cacaagtgucagtggataucaggaa

SEQ ID NO: 71247 - DNA, 21 bp, Artificial Sequence
  Synthetic
gtgactuccaccaggactgug

SEQ ID NO: 71248 - DNA, 21 bp, Artificial Sequence
  Synthetic
cataggcaagacuccaggcut

SEQ ID NO: 71249 - DNA, 19 bp, Artificial Sequence
  Synthetic
agugcaacaacgccuacca

SEQ ID NO: 71250 - DNA, 20 bp, Artificial Sequence
  Synthetic
ccacgcucaggttggagtuc

SEQ ID NO: 71251 - DNA, 21 bp, Artificial Sequence
  Synthetic
tgagtgacugcctctcctcut

SEQ ID NO: 71252 - DNA, 22 bp, Artificial Sequence
  Synthetic
atctggcuctcatcttcuccct

SEQ ID NO: 71253 - DNA, 23 bp, Artificial Sequence
  Synthetic
gcaaacttaccauggttgtgugt

SEQ ID NO: 71254 - DNA, 21 bp, Artificial Sequence
  Synthetic
actcctguttaggcctugcag

SEQ ID NO: 71255 - DNA, 23 bp, Artificial Sequence
  Synthetic
tccatgcugcttggtaaugaagt

SEQ ID NO: 71256 - DNA, 21 bp, Artificial Sequence
  Synthetic
gggagcutccagtugaaacat

SEQ ID NO: 71257 - DNA, 28 bp, Artificial Sequence
  Synthetic
aaataagaacatucttcagacacugcct

SEQ ID NO: 71258 - DNA, 25 bp, Artificial Sequence
  Synthetic
aagactggugtcctgaacuagaaga

SEQ ID NO: 71259 - DNA, 27 bp, Artificial Sequence
  Synthetic
tugtttagaaugaggagagaggcaaaa

SEQ ID NO: 71260 - DNA, 24 bp, Artificial Sequence
  Synthetic
aaaatgatacuccccctacuccca

SEQ ID NO: 71261 - DNA, 25 bp, Artificial Sequence
  Synthetic
ccttattttcutccccguagagcaa

SEQ ID NO: 71262 - DNA, 21 bp, Artificial Sequence
  Synthetic
gcattgccaaucgcataucct

SEQ ID NO: 71263 - DNA, 23 bp, Artificial Sequence
  Synthetic
tgttccttccgautcctggaaug

SEQ ID NO: 71264 - DNA, 28 bp, Artificial Sequence
  Synthetic
tcaactcagguaaaatgtcagtuccaaa

SEQ ID NO: 71265 - DNA, 22 bp, Artificial Sequence
  Synthetic
tgcatguggaagtgtuggagaa

SEQ ID NO: 71266 - DNA, 26 bp, Artificial Sequence
  Synthetic
caaagttgugtgttgtaaguggaaca

SEQ ID NO: 71267 - DNA, 27 bp, Artificial Sequence
  Synthetic
ccaagaaaggcutgtgtctacatttut

SEQ ID NO: 71268 - DNA, 33 bp, Artificial Sequence; identical to SEQ ID NO: 68766
  Synthetic

SEQ ID NO: 71269 - DNA, 20 bp, Artificial Sequence
  Synthetic
caaatgcgutgggctuccat

SEQ ID NO: 71270 - DNA, 28 bp, Artificial Sequence
  Synthetic
agaatgattuaaggctacagauggaagc

SEQ ID NO: 71271 - DNA, 26 bp, Artificial Sequence
  Synthetic
tccttgatcutttcctctugagcaaa

SEQ ID NO: 71272 - DNA, 28 bp, Artificial Sequence
  Synthetic
cagcctgctcutctaatttgtttactut

SEQ ID NO: 71273 - DNA, 27 bp, Artificial Sequence
  Synthetic
gactcaaaaactucctcctcttctuct

SEQ ID NO: 71274 - DNA, 29 bp, Artificial Sequence
  Synthetic
tggatcaggutcgtgaatatauggaaaat

SEQ ID NO: 71275 - DNA, 28 bp, Artificial Sequence
  Synthetic
acctgtttcttgugttttcatagtcugt

SEQ ID NO: 71276 - DNA, 28 bp, Artificial Sequence
  Synthetic
tcaaggaactucagaaaatacaccagut

SEQ ID NO: 71277 - DNA, 22 bp, Artificial Sequence
  Synthetic
caaatcaccutcctctgugggt

SEQ ID NO: 71278 - DNA, 21 bp, Artificial Sequence
  Synthetic
ggagaatugagccctggugac

SEQ ID NO: 71279 - DNA, 23 bp, Artificial Sequence
  Synthetic
tcaaggugaaggacgacaacuac

SEQ ID NO: 71280 - DNA, 23 bp, Artificial Sequence
  Synthetic
caaactctgutggcactugagaa

SEQ ID NO: 71281 - DNA, 19 bp, Artificial Sequence
  Synthetic
agagcaccuccuacacgga

SEQ ID NO: 71282 - DNA, 19 bp, Artificial Sequence
  Synthetic
ttgtguggagcgcuggaat

SEQ ID NO: 71283 - DNA, 22 bp, Artificial Sequence
  Synthetic
acataagcagcagcagugacuc

SEQ ID NO: 71284 - DNA, 23 bp, Artificial Sequence
  Synthetic
aaagacagcaagagcuccaauca

SEQ ID NO: 71285 - DNA, 28 bp, Artificial Sequence
  Synthetic
gcaaactagaagugtccacaggtataut

SEQ ID NO: 71286 - DNA, 20 bp, Artificial Sequence
  Synthetic
gcgtagcgcauggctaagut

SEQ ID NO: 71287 - DNA, 22 bp, Artificial Sequence
  Synthetic
agaagaagcagaugacgcugac

SEQ ID NO: 71288 - DNA, 23 bp, Artificial Sequence
  Synthetic
agtaagtgtugcacagcctguaa

SEQ ID NO: 71289 - DNA, 22 bp, Artificial Sequence
  Synthetic
gtacctuggaggtgcagaugag

SEQ ID NO: 71290 - DNA, 21 bp, Artificial Sequence
  Synthetic
gaagaagaagcugucggagca

SEQ ID NO: 71291 - DNA, 23 bp, Artificial Sequence
  Synthetic
aagtgaaaacgcacugccatuag

SEQ ID NO: 71292 - DNA, 22 bp, Artificial Sequence
  Synthetic
gaaugccuagaccccagagaag

SEQ ID NO: 71293 - DNA, 22 bp, Artificial Sequence
  Synthetic
tgatcctucagctcctucccat

SEQ ID NO: 71294 - DNA, 21 bp, Artificial Sequence
  Synthetic
gtaccgcucctggaaggtuag

SEQ ID NO: 71295 - DNA, 20 bp, Artificial Sequence
  Synthetic
gcctcacgcacutcctgaug

SEQ ID NO: 71296 - DNA, 28 bp, Artificial Sequence
  Synthetic
ggcttcaagtugtctttttaatgaucct

SEQ ID NO: 71297 - DNA, 26 bp, Artificial Sequence
  Synthetic
gtacctgctguaagtcttcacttuca

SEQ ID NO: 71298 - DNA, 24 bp, Artificial Sequence
  Synthetic
cagagatgtcuccaaaggttccut

SEQ ID NO: 71299 - DNA, 28 bp, Artificial Sequence
  Synthetic
tgatttgatttccutctccagtctgaut

SEQ ID NO: 71300 - DNA, 20 bp, Artificial Sequence
  Synthetic
ctgcagcutgatgaccucgt

SEQ ID NO: 71301 - DNA, 21 bp, Artificial Sequence
  Synthetic
tgcgtcuggaacctcctttut

SEQ ID NO: 71302 - DNA, 29 bp, Artificial Sequence
  Synthetic
ctgagaagtttaaaugttgggtagtucct

SEQ ID NO: 71303 - DNA, 23 bp, Artificial Sequence
  Synthetic
gcctcaacacutctgaccatcug

SEQ ID NO: 71304 - DNA, 28 bp, Artificial Sequence
  Synthetic
aagcagaaagagacugtgauaacaagaa

SEQ ID NO: 71305 - DNA, 24 bp, Artificial Sequence
  Synthetic
caccgtagatuaggtggttgcuaa

SEQ ID NO: 71306 - DNA, 27 bp, Artificial Sequence
  Synthetic
tcgaacagaggcugcaaatagaauaat

SEQ ID NO: 71307 - DNA, 24 bp, Artificial Sequence
  Synthetic
tccactgaguggcatctaagttug

SEQ ID NO: 71308 - DNA, 27 bp, Artificial Sequence
  Synthetic
gttgaggcactutgtgatgcttataut

SEQ ID NO: 71309 - DNA, 26 bp, Artificial Sequence
  Synthetic
tcuctacagagaguaacacagcaaga

SEQ ID NO: 71310 - DNA, 17 bp, Artificial Sequence
  Synthetic
ccucctgggugcaccaa

SEQ ID NO: 71311 - DNA, 17 bp, Artificial Sequence
  Synthetic
atgacagccugcugcgt

SEQ ID NO: 71312 - DNA, 29 bp, Artificial Sequence
  Synthetic
agaattagagatgcugaacaaaaggacut

SEQ ID NO: 71313 - DNA, 26 bp, Artificial Sequence
  Synthetic
caacaaagggagaagcuacgtaauga

SEQ ID NO: 71314 - DNA, 28 bp, Artificial Sequence
  Synthetic
tgtataaccctcauccattcttttgugg

SEQ ID NO: 71315 - DNA, 27 bp, Artificial Sequence
  Synthetic
tgcaccaaaagagagutcatatcacut

SEQ ID NO: 71316 - DNA, 27 bp, Artificial Sequence
  Synthetic
attaggccttctugtatcatggatgug

SEQ ID NO: 71317 - DNA, 28 bp, Artificial Sequence
  Synthetic
agtgtaccaacaauaacatgaagauggt

SEQ ID NO: 71318 - DNA, 22 bp, Artificial Sequence
  Synthetic
ggttgtagcguatgcagucaac

SEQ ID NO: 71319 - DNA, 20 bp, Artificial Sequence
  Synthetic
aguacagacacggcctcuga

SEQ ID NO: 71320 - DNA, 20 bp, Artificial Sequence
  Synthetic
ccagacagccgugactuact

SEQ ID NO: 71321 - DNA, 31 bp, Artificial Sequence
  Synthetic
accattttgaagaugagtcagaaaatuacct

SEQ ID NO: 71322 - DNA, 20 bp, Artificial Sequence
  Synthetic
gagtugaaagcacugccgat

SEQ ID NO: 71323 - DNA, 23 bp, Artificial Sequence
  Synthetic
tcttggcugagaagcucaaagag

SEQ ID NO: 71324 - DNA, 22 bp, Artificial Sequence
  Synthetic
gtttcttgtguttccgctguca

SEQ ID NO: 71325 - DNA, 28 bp, Artificial Sequence
  Synthetic
ctcttcttgaaguttttcagcctttuct

SEQ ID NO: 71326 - DNA, 23 bp, Artificial Sequence
  Synthetic
ccctcctctuagagtccagaugt

SEQ ID NO: 71327 - DNA, 29 bp, Artificial Sequence
  Synthetic
gagcctagaattutattacccagaacugt

SEQ ID NO: 71328 - DNA, 22 bp, Artificial Sequence
  Synthetic
gtggcuaccaaagcagaactug

SEQ ID NO: 71329 - DNA, 31 bp, Artificial Sequence
  Synthetic
tctagcttttaagtuatggagctcatttgut

SEQ ID NO: 71330 - DNA, 18 bp, Artificial Sequence
  Synthetic
ccggcucacagacccuct

SEQ ID NO: 71331 - DNA, 19 bp, Artificial Sequence
  Synthetic
ttccaccucggaggaguca

SEQ ID NO: 71332 - DNA, 28 bp, Artificial Sequence
  Synthetic
tgaagaagttgtcauaattctggctcut

SEQ ID NO: 71333 - DNA, 26 bp, Artificial Sequence
  Synthetic
tgaatagaatggucctctccaucact

SEQ ID NO: 71334 - DNA, 24 bp, Artificial Sequence
  Synthetic
caggaagtacutgctgtctucagg

SEQ ID NO: 71335 - DNA, 20 bp, Artificial Sequence
  Synthetic
ccaccacuaacgccagctut

SEQ ID NO: 71336 - DNA, 28 bp, Artificial Sequence
  Synthetic
ttaaattggtugtgttttctugaaggca

SEQ ID NO: 71337 - DNA, 25 bp, Artificial Sequence
  Synthetic
gagtatcugaaaaccgggctaauga

SEQ ID NO: 71338 - DNA, 23 bp, Artificial Sequence
  Synthetic
ggaattgagagguccttcuggga

SEQ ID NO: 71339 - DNA, 23 bp, Artificial Sequence
  Synthetic
cgttccctugcttcacatctuct

SEQ ID NO: 71340 - DNA, 22 bp, Artificial Sequence
  Synthetic
catgtcaagcaagauggctuca

SEQ ID NO: 71341 - DNA, 24 bp, Artificial Sequence
  Synthetic
gaatttgcuggattaccuccgaga

SEQ ID NO: 71342 - DNA, 18 bp, Artificial Sequence
  Synthetic
acagggugctuggcagac

SEQ ID NO: 71343 - DNA, 19 bp, Artificial Sequence
  Synthetic
gtgctuggcccctgaatut

SEQ ID NO: 71344 - DNA, 23 bp, Artificial Sequence
  Synthetic
ctctttcccagucaccagttugt

SEQ ID NO: 71345 - DNA, 24 bp, Artificial Sequence
  Synthetic
cagagtgatcuggtctttccccua

SEQ ID NO: 71346 - DNA, 25 bp, Artificial Sequence
  Synthetic
gctttctctcacugagtctcccuat

SEQ ID NO: 71347 - DNA, 27 bp, Artificial Sequence
  Synthetic
catagtattcttuggttacctcggcut

SEQ ID NO: 71348 - DNA, 28 bp, Artificial Sequence
  Synthetic
gagctaagaaauggaaaaaugaaggcat

SEQ ID NO: 71349 - DNA, 24 bp, Artificial Sequence
  Synthetic
agacctacttccuctttggctcut

SEQ ID NO: 71350 - DNA, 24 bp, Artificial Sequence
  Synthetic
tgaaaacaagcaagcuctccugaa

SEQ ID NO: 71351 - DNA, 28 bp, Artificial Sequence
  Synthetic
tctttctaugcaaaaacactcacucagt

SEQ ID NO: 71352 - DNA, 28 bp, Artificial Sequence
  Synthetic
tgagtctagccuatagtatgattggcut

SEQ ID NO: 71353 - DNA, 28 bp, Artificial Sequence
  Synthetic
tgcatactcatuttctcaggtttugaca

SEQ ID NO: 71354 - DNA, 27 bp, Artificial Sequence
  Synthetic
ctgacagaaaagaggaugttctuagca

SEQ ID NO: 71355 - DNA, 28 bp, Artificial Sequence
  Synthetic
gtctaaaatatugcttgtaccgucacag

SEQ ID NO: 71356 - DNA, 21 bp, Artificial Sequence
  Synthetic
gtcacctcutctcggtugcat

SEQ ID NO: 71357 - DNA, 26 bp, Artificial Sequence
  Synthetic
caaagtggttuggagtgtttgaaugt

SEQ ID NO: 71358 - DNA, 25 bp, Artificial Sequence
  Synthetic
gcaccaatcttucttctgcctttug

SEQ ID NO: 71359 - DNA, 27 bp, Artificial Sequence
  Synthetic
ccaaaucaagaaacctgttugagagaa

SEQ ID NO: 71360 - DNA, 22 bp, Artificial Sequence
  Synthetic
gcugaauccagaaaccagcaca

SEQ ID NO: 71361 - DNA, 27 bp, Artificial Sequence
  Synthetic
ccattttataacauacagccacaggut

SEQ ID NO: 71362 - DNA, 17 bp, Artificial Sequence
  Synthetic
aggccgcgaaguccauc

SEQ ID NO: 71363 - DNA, 20 bp, Artificial Sequence
  Synthetic
agttccagcuccccttccut

SEQ ID NO: 71364 - DNA, 22 bp, Artificial Sequence
  Synthetic
tgtaccctgugtcactgagcua

SEQ ID NO: 71365 - DNA, 28 bp, Artificial Sequence
  Synthetic
acaaattgttacatutctgaagcctgug

SEQ ID NO: 71366 - DNA, 28 bp, Artificial Sequence
  Synthetic
tctataccattgcuaccagttctttucc

SEQ ID NO: 71367 - DNA, 19 bp, Artificial Sequence
  Synthetic
gtgctguctctgacguggt

SEQ ID NO: 71368 - DNA, 26 bp, Artificial Sequence
  Synthetic
gccatcacagcutttgtttttctugt

SEQ ID NO: 71369 - DNA, 26 bp, Artificial Sequence
  Synthetic
cctttcagaaggugcagaaatacuca

SEQ ID NO: 71370 - DNA, 22 bp, Artificial Sequence
  Synthetic
ggtttcagcuccttgttugggt

SEQ ID NO: 71371 - DNA, 24 bp, Artificial Sequence
  Synthetic
cctgaaaucaaccctcaccuaact

SEQ ID NO: 71372 - DNA, 28 bp, Artificial Sequence
  Synthetic
gtugattatggaagatucccacaagagt

SEQ ID NO: 71373 - DNA, 22 bp, Artificial Sequence
  Synthetic
ctcagtattutggccaguccct

SEQ ID NO: 71374 - DNA, 22 bp, Artificial Sequence
  Synthetic
ccttgagcgaggaugccatuat

SEQ ID NO: 71375 - DNA, 26 bp, Artificial Sequence
  Synthetic
agaagggagauccttcaaggacatua

SEQ ID NO: 71376 - DNA, 28 bp, Artificial Sequence
  Synthetic
ttttagctgatggugctttttgtgatut

SEQ ID NO: 71377 - DNA, 28 bp, Artificial Sequence
  Synthetic
cagagacccugacattcatcaatactua

SEQ ID NO: 71378 - DNA, 26 bp, Artificial Sequence
  Synthetic
tggauaggattctttcugagggaagg

SEQ ID NO: 71379 - DNA, 26 bp, Artificial Sequence
  Synthetic
cttcatcctgtuccaaatcacgatug

SEQ ID NO: 71380 - DNA, 22 bp, Artificial Sequence
  Synthetic
gctgcagatucgttcagaguct

SEQ ID NO: 71381 - DNA, 23 bp, Artificial Sequence
  Synthetic
agccacggaaauatccactgtut

SEQ ID NO: 71382 - DNA, 22 bp, Artificial Sequence
  Synthetic
gcatcucaagcagacgtcgtua

SEQ ID NO: 71383 - DNA, 27 bp, Artificial Sequence
  Synthetic
acaccattcatguctataggaacgtut

SEQ ID NO: 71384 - DNA, 18 bp, Artificial Sequence
  Synthetic
gggccuaggttucaccga

SEQ ID NO: 71385 - DNA, 18 bp, Artificial Sequence
  Synthetic
gctcccucccagctccua

SEQ ID NO: 71386 - DNA, 20 bp, Artificial Sequence
  Synthetic
cagugagggacgggcaauag

SEQ ID NO: 71387 - DNA, 25 bp, Artificial Sequence
  Synthetic
attccataaggcacucaatacgcut

SEQ ID NO: 71388 - DNA, 28 bp, Artificial Sequence
  Synthetic
cgttttgtauccactccttttcaugaga

SEQ ID NO: 71389 - DNA, 24 bp, Artificial Sequence
  Synthetic
gtagatagugccacaagctgtcug

SEQ ID NO: 71390 - DNA, 28 bp, Artificial Sequence
  Synthetic
ctgtttcttacuaggaatcaacccucaa

SEQ ID NO: 71391 - DNA, 22 bp, Artificial Sequence
  Synthetic
ccgguaagtaagagugccaacc

SEQ ID NO: 71392 - DNA, 26 bp, Artificial Sequence
  Synthetic
agttattaccutgttgcctcuaccct

SEQ ID NO: 71393 - DNA, 22 bp, Artificial Sequence
  Synthetic
ccagactgugagccaaggaaut

SEQ ID NO: 71394 - DNA, 24 bp, Artificial Sequence
  Synthetic
acactcatuacttccggguacaga

SEQ ID NO: 71395 - DNA, 28 bp, Artificial Sequence
  Synthetic
ccatgtcugaaaagtaagtaatcuggca

SEQ ID NO: 71396 - DNA, 25 bp, Artificial Sequence
  Synthetic
agatguaaagacctcugaggaccag

SEQ ID NO: 71397 - DNA, 28 bp, Artificial Sequence
  Synthetic
aagcacaugcagaataagagaguaaaca

SEQ ID NO: 71398 - DNA, 25 bp, Artificial Sequence
  Synthetic
ctgtagatggugcacttgcatttut

SEQ ID NO: 71399 - DNA, 24 bp, Artificial Sequence
  Synthetic
cctgtggtccucatttgtagcuat

SEQ ID NO: 71400 - DNA, 26 bp, Artificial Sequence
  Synthetic
accutgtaagauggcaagaaacacaa

SEQ ID NO: 71401 - DNA, 27 bp, Artificial Sequence
  Synthetic
gaatctctgtgcuaccttccagaauac

SEQ ID NO: 71402 - DNA, 21 bp, Artificial Sequence
  Synthetic
ccagcgugggagaaagaauct

SEQ ID NO: 71403 - DNA, 19 bp, Artificial Sequence
  Synthetic
gctgucccgagctagguga

SEQ ID NO: 71404 - DNA, 26 bp, Artificial Sequence
  Synthetic
ctcccactucatcttggaacucaaat

SEQ ID NO: 71405 - DNA, 27 bp, Artificial Sequence
  Synthetic
ctaatttccatgccuttttcaggcaua

SEQ ID NO: 71406 - DNA, 17 bp, Artificial Sequence
  Synthetic
cuggcgcgggaaaaugt

SEQ ID NO: 71407 - DNA, 18 bp, Artificial Sequence
  Synthetic
cggcuacucagcccaacc

SEQ ID NO: 71408 - DNA, 22 bp, Artificial Sequence
  Synthetic
cgaagtcaacugccagactcut

SEQ ID NO: 71409 - DNA, 17 bp, Artificial Sequence
  Synthetic
gccaucgggctcctgug

SEQ ID NO: 71410 - DNA, 26 bp, Artificial Sequence
  Synthetic
ctggaataugctttggaaaguagggt

SEQ ID NO: 71411 - DNA, 25 bp, Artificial Sequence
  Synthetic
gcattttcaaaagcugtttgcugaa

SEQ ID NO: 71412 - DNA, 18 bp, Artificial Sequence
  Synthetic
cacagcugccguggaaag

SEQ ID NO: 71413 - DNA, 22 bp, Artificial Sequence
  Synthetic
tggguaccaaggactgtucaga

SEQ ID NO: 71414 - DNA, 24 bp, Artificial Sequence
  Synthetic
ccaggttacugaaagcacttccut

SEQ ID NO: 71415 - DNA, 28 bp, Artificial Sequence
  Synthetic
accaaacttggugaagtaatttauggga

SEQ ID NO: 71416 - DNA, 23 bp, Artificial Sequence
  Synthetic
agagcagaacaggagugaaguct

SEQ ID NO: 71417 - DNA, 21 bp, Artificial Sequence
  Synthetic
ccagatggacutgctggaugg

SEQ ID NO: 71418 - DNA, 20 bp, Artificial Sequence
  Synthetic
gggcauctcctuagaacgct

SEQ ID NO: 71419 - DNA, 22 bp, Artificial Sequence
  Synthetic
tctggagugcagctttgactuc

SEQ ID NO: 71420 - DNA, 18 bp, Artificial Sequence
  Synthetic
gtggguggtgggcaugaa

SEQ ID NO: 71421 - DNA, 17 bp, Artificial Sequence
  Synthetic
gacgccagcccuagcuc

SEQ ID NO: 71422 - DNA, 22 bp, Artificial Sequence
  Synthetic
tccgtaggttutggtctcggua

SEQ ID NO: 71423 - DNA, 27 bp, Artificial Sequence
  Synthetic
acaatactttucacatcgtcagucaca

SEQ ID NO: 71424 - DNA, 21 bp, Artificial Sequence
  Synthetic
gggaatacuccagcucacagg

SEQ ID NO: 71425 - DNA, 21 bp, Artificial Sequence
  Synthetic
ctuggacagggcaaaggaugt

SEQ ID NO: 71426 - DNA, 27 bp, Artificial Sequence
  Synthetic
ctaccacugtgcaatgaauaacgaaaa

SEQ ID NO: 71427 - DNA, 21 bp, Artificial Sequence
  Synthetic
ccttcggtucccaattgcuca

SEQ ID NO: 71428 - DNA, 26 bp, Artificial Sequence
  Synthetic
aaaacaagagaugtgactgacgaugt

SEQ ID NO: 71429 - DNA, 27 bp, Artificial Sequence
  Synthetic
caagaaaatgucgaccagcatatucat

SEQ ID NO: 71430 - DNA, 28 bp, Artificial Sequence
  Synthetic
agatgtgacugacgatgtgaaaagtaut

SEQ ID NO: 71431 - DNA, 30 bp, Artificial Sequence
  Synthetic
tcaattgaaguaactcaaacatucaaaaca

SEQ ID NO: 71432 - DNA, 28 bp, Artificial Sequence
  Synthetic
atttaaatagtugccattccaagtguct

SEQ ID NO: 71433 - DNA, 28 bp, Artificial Sequence
  Synthetic
gctccgtaaauagcaccattagaugaat

SEQ ID NO: 71434 - DNA, 17 bp, Artificial Sequence
  Synthetic
ggcgtccgugccttcut

SEQ ID NO: 71435 - DNA, 20 bp, Artificial Sequence
  Synthetic
ccatgaggcuctgactuccc

SEQ ID NO: 71436 - DNA, 28 bp, Artificial Sequence
  Synthetic
ttgcctctuatatttcaggtugaacagt

SEQ ID NO: 71437 - DNA, 28 bp, Artificial Sequence
  Synthetic
ttctcttactcugaactccagtttcuct

SEQ ID NO: 71438 - DNA, 27 bp, Artificial Sequence
  Synthetic
gcacctaggcuaaaatgtcaagaacuc

SEQ ID NO: 71439 - DNA, 28 bp, Artificial Sequence
  Synthetic
tgttgctgagatauttcacaccagtaut

SEQ ID NO: 71440 - DNA, 30 bp, Artificial Sequence
  Synthetic
tctgggttacucactagatttaatcuggat

SEQ ID NO: 71441 - DNA, 28 bp, Artificial Sequence
  Synthetic
ggagtggaaaugaaatgctcttaactut

SEQ ID NO: 71442 - DNA, 22 bp, Artificial Sequence
  Synthetic
agggtgtctcuctgtggcttua

SEQ ID NO: 71443 - DNA, 22 bp, Artificial Sequence
  Synthetic
gactctguaggctgcagttcuc

SEQ ID NO: 71444 - DNA, 28 bp, Artificial Sequence
  Synthetic
cagcutcaaagggatauacaagaaagga

SEQ ID NO: 71445 - DNA, 32 bp, Artificial Sequence
  Synthetic
aacacttattaagtuagcccaaataaaaugcc

SEQ ID NO: 71446 - DNA, 28 bp, Artificial Sequence
  Synthetic
gagctgattguagcaacatactacucaa

SEQ ID NO: 71447 - DNA, 26 bp, Artificial Sequence
  Synthetic
agacagauacagacagagtgcttuct

SEQ ID NO: 71448 - DNA, 24 bp, Artificial Sequence
  Synthetic
gcagtggtgauacccattttgugt

SEQ ID NO: 71449 - DNA, 26 bp, Artificial Sequence
  Synthetic
gtgtgtgtaaggaugatactggtuga

SEQ ID NO: 71450 - DNA, 19 bp, Artificial Sequence
  Synthetic
gaggucctgcugacacaca

SEQ ID NO: 71451 - DNA, 19 bp, Artificial Sequence
  Synthetic
gcaggagcuggucaacagg

SEQ ID NO: 71452 - DNA, 21 bp, Artificial Sequence
  Synthetic
gctttgccugtgguggaaaat

SEQ ID NO: 71453 - DNA, 26 bp, Artificial Sequence
  Synthetic
tgcatgctcagautagaaactgtgua

SEQ ID NO: 71454 - DNA, 22 bp, Artificial Sequence
  Synthetic
cctcctccugcaggttguagat

SEQ ID NO: 71455 - DNA, 21 bp, Artificial Sequence
  Synthetic
ctgaccctcugaaacctccuc

SEQ ID NO: 71456 - DNA, 25 bp, Artificial Sequence
  Synthetic
tgcttcgucaacatagctttaugga

SEQ ID NO: 71457 - DNA, 21 bp, Artificial Sequence
  Synthetic
cgtcccaacutggctttcuct

SEQ ID NO: 71458 - DNA, 28 bp, Artificial Sequence
  Synthetic
agaaaatcagcutcaagacactucaaga

SEQ ID NO: 71459 - DNA, 25 bp, Artificial Sequence
  Synthetic
acccacataauaaaaacccgcacut

SEQ ID NO: 71460 - DNA, 20 bp, Artificial Sequence
  Synthetic
ctccagugggcttuggagaa

SEQ ID NO: 71461 - DNA, 28 bp, Artificial Sequence
  Synthetic
ttgacattttagauggaggaaagcctua

SEQ ID NO: 71462 - DNA, 21 bp, Artificial Sequence
  Synthetic
tcggtgcaugtgaacgttcut

SEQ ID NO: 71463 - DNA, 20 bp, Artificial Sequence
  Synthetic
caaagcguccagctccucat

SEQ ID NO: 71464 - DNA, 28 bp, Artificial Sequence
  Synthetic
tgctcaacagaugattatttcaccctut

SEQ ID NO: 71465 - DNA, 26 bp, Artificial Sequence
  Synthetic
cccctctttacugtctactctggtut

SEQ ID NO: 71466 - DNA, 26 bp, Artificial Sequence
  Synthetic
tgtgtgatgtauttgctcttggtugt

SEQ ID NO: 71467 - DNA, 22 bp, Artificial Sequence
  Synthetic
aggactcagagcuccttctguc

SEQ ID NO: 71468 - DNA, 28 bp, Artificial Sequence
  Synthetic
ccaagugaacccagaaaatattcuccat

SEQ ID NO: 71469 - DNA, 27 bp, Artificial Sequence
  Synthetic
ctttccttauaaagcttacccgucaca

SEQ ID NO: 71470 - DNA, 26 bp, Artificial Sequence
  Synthetic
cagaattcatcauagcaagctgugac

SEQ ID NO: 71471 - DNA, 28 bp, Artificial Sequence
  Synthetic
gtaaggcgtguctcaatatttgacatut

SEQ ID NO: 71472 - DNA, 22 bp, Artificial Sequence
  Synthetic
gcttccagauggtggaugaact

SEQ ID NO: 71473 - DNA, 21 bp, Artificial Sequence
  Synthetic
ccacucugaccacaccaaacc

SEQ ID NO: 71474 - DNA, 24 bp, Artificial Sequence
  Synthetic
tggttcaauagatgaccuccccat

SEQ ID NO: 71475 - DNA, 22 bp, Artificial Sequence
  Synthetic
gggagguaugaggagagaaagg

SEQ ID NO: 71476 - DNA, 29 bp, Artificial Sequence
  Synthetic
atgtgggtaagaaacugaatctgctaaut

SEQ ID NO: 71477 - DNA, 21 bp, Artificial Sequence
  Synthetic
caacaccugagtccaccauca

SEQ ID NO: 71478 - DNA, 28 bp, Artificial Sequence
  Synthetic
ggtaacagtgaugatgtcaaatgcttut

SEQ ID NO: 71479 - DNA, 29 bp, Artificial Sequence
  Synthetic
aggtgaacacauataagcaatctcaugat

SEQ ID NO: 71480 - DNA, 23 bp, Artificial Sequence
  Synthetic
agcagagtaauccagctcaguct

SEQ ID NO: 71481 - DNA, 20 bp, Artificial Sequence
  Synthetic
cccuaaagcccagcactuga

SEQ ID NO: 71482 - DNA, 28 bp, Artificial Sequence
  Synthetic
atgtagttttcuggtgaatttggaguga

SEQ ID NO: 71483 - DNA, 28 bp, Artificial Sequence
  Synthetic
aaggcucaaagggaatauaaaccaagat

SEQ ID NO: 71484 - DNA, 25 bp, Artificial Sequence
  Synthetic
ctctaatttgtgcugaccagctgua

SEQ ID NO: 71485 - DNA, 21 bp, Artificial Sequence
  Synthetic
ccccctguttaccctgatugg

SEQ ID NO: 71486 - DNA, 22 bp, Artificial Sequence
  Synthetic
tcagaggacccutcagccauaa

SEQ ID NO: 71487 - DNA, 28 bp, Artificial Sequence
  Synthetic
gatcttcgtctugttgtaacactttuca

SEQ ID NO: 71488 - DNA, 23 bp, Artificial Sequence
  Synthetic
cagacccugaggatactgtgcua

SEQ ID NO: 71489 - DNA, 22 bp, Artificial Sequence
  Synthetic
atgaaaaaggacgccaugcauc

SEQ ID NO: 71490 - DNA, 22 bp, Artificial Sequence
  Synthetic
ccccagcuggattccaaatuct

SEQ ID NO: 71491 - DNA, 22 bp, Artificial Sequence
  Synthetic
ccattuccagccccattctuca

SEQ ID NO: 71492 - DNA, 18 bp, Artificial Sequence
  Synthetic
cgcacacccugccacuaa

SEQ ID NO: 71493 - DNA, 20 bp, Artificial Sequence
  Synthetic
agctgttcutccacctgucc

SEQ ID NO: 71494 - DNA, 28 bp, Artificial Sequence
  Synthetic
tcatttgaugaagagcatagacaugcaa

SEQ ID NO: 71495 - DNA, 28 bp, Artificial Sequence
  Synthetic
gaagttggtggccutatatcctaatuca

SEQ ID NO: 71496 - DNA, 23 bp, Artificial Sequence
  Synthetic
tggtgcgatuttcctgttacuct

SEQ ID NO: 71497 - DNA, 22 bp, Artificial Sequence
  Synthetic
cgtactucccagtttggtgugg

SEQ ID NO: 71498 - DNA, 22 bp, Artificial Sequence
  Synthetic
ccataccccuaaagcacuccct

SEQ ID NO: 71499 - DNA, 21 bp, Artificial Sequence
  Synthetic
ggagtcccaggauctctcuga

SEQ ID NO: 71500 - DNA, 20 bp, Artificial Sequence
  Synthetic
cucctctgugaagacacgct

SEQ ID NO: 71501 - DNA, 21 bp, Artificial Sequence
  Synthetic
agctgtcacutgctggtucat

SEQ ID NO: 71502 - DNA, 21 bp, Artificial Sequence
  Synthetic
aagacaggacaucgtccccua

SEQ ID NO: 71503 - DNA, 19 bp, Artificial Sequence
  Synthetic
cacccagcccugcttuaca

SEQ ID NO: 71504 - DNA, 22 bp, Artificial Sequence
  Synthetic
gggaaacagcucagatggcuaa

SEQ ID NO: 71505 - DNA, 26 bp, Artificial Sequence
  Synthetic
ggaagttgaattautaccccctgcuc

SEQ ID NO: 71506 - DNA, 22 bp, Artificial Sequence
  Synthetic
gtattuccgccgactccttuga

SEQ ID NO: 71507 - DNA, 21 bp, Artificial Sequence
  Synthetic
ctgtcgaatgucagaggccut

SEQ ID NO: 71508 - DNA, 20 bp, Artificial Sequence
  Synthetic
ccaccucgtcctguaaagca

SEQ ID NO: 71509 - DNA, 22 bp, Artificial Sequence
  Synthetic
cgctacuacgccatgaagaucc

SEQ ID NO: 71510 - DNA, 27 bp, Artificial Sequence
  Synthetic
tttgtgatcuattccatctguccaaac

SEQ ID NO: 71511 - DNA, 28 bp, Artificial Sequence
  Synthetic
tcgtgaauaagcagatcctttuccaaat

SEQ ID NO: 71512 - DNA, 20 bp, Artificial Sequence
  Synthetic
cttccgaccuttgcccttug

SEQ ID NO: 71513 - DNA, 22 bp, Artificial Sequence
  Synthetic
cctggacuctctgtgtctucag

SEQ ID NO: 71514 - DNA, 24 bp, Artificial Sequence
  Synthetic
tcttgtcctcucttgccacagaua

SEQ ID NO: 71515 - DNA, 23 bp, Artificial Sequence
  Synthetic
gagcuctgcggauaaagagagac

SEQ ID NO: 71516 - DNA, 28 bp, Artificial Sequence
  Synthetic
gtaagagtgcaaaaauccagtcagguat

SEQ ID NO: 71517 - DNA, 23 bp, Artificial Sequence
  Synthetic
gggctttatutccgagcaucaca

SEQ ID NO: 71518 - DNA, 20 bp, Artificial Sequence
  Synthetic
tctucgcacaacggcttcut

SEQ ID NO: 71519 - DNA, 20 bp, Artificial Sequence
  Synthetic
gtgtggcagutttcggaugg

SEQ ID NO: 71520 - DNA, 20 bp, Artificial Sequence
  Synthetic
aatgaccaggcgaucgctua

SEQ ID NO: 71521 - DNA, 29 bp, Artificial Sequence
  Synthetic
gcttggacaaagacacuatactucacaat

SEQ ID NO: 71522 - DNA, 22 bp, Artificial Sequence
  Synthetic
ggaggatggaguctgaaagcug

SEQ ID NO: 71523 - DNA, 27 bp, Artificial Sequence
  Synthetic
agtgattgacagugttgactctcauag

SEQ ID NO: 71524 - DNA, 22 bp, Artificial Sequence
  Synthetic
acuaaacaacgaagccgctuga

SEQ ID NO: 71525 - DNA, 21 bp, Artificial Sequence
  Synthetic
acctcttaagugcaggctugg

SEQ ID NO: 71526 - DNA, 28 bp, Artificial Sequence
  Synthetic
tgaaagaugcagacttttactgugaagt

SEQ ID NO: 71527 - DNA, 25 bp, Artificial Sequence
  Synthetic
tttccatcucacagaccttgctuag

SEQ ID NO: 71528 - DNA, 31 bp, Artificial Sequence; identical to SEQ ID NO: 60670
  Synthetic

SEQ ID NO: 71529 - DNA, 26 bp, Artificial Sequence
  Synthetic
cagauagagcctgaaguacacagaga

SEQ ID NO: 71530 - DNA, 26 bp, Artificial Sequence
  Synthetic
acaaacucttggtactucaaacacga

SEQ ID NO: 71531 - DNA, 28 bp, Artificial Sequence
  Synthetic
ttcccaatctccuttttcatgttctcut

SEQ ID NO: 71532 - DNA, 24 bp, Artificial Sequence
  Synthetic
tgttctctgtguacttcaggcuct

SEQ ID NO: 71533 - DNA, 24 bp, Artificial Sequence
  Synthetic
gcacacugaatagcctuggaaaaa

SEQ ID NO: 71534 - DNA, 26 bp, Artificial Sequence
  Synthetic
ggctctauctgaaacctucacaagat

SEQ ID NO: 71535 - DNA, 27 bp, Artificial Sequence
  Synthetic
aaagagattagatuacctcgcacacug

SEQ ID NO: 71536 - DNA, 21 bp, Artificial Sequence
  Synthetic
ccaaggcuattcagtgugcga

SEQ ID NO: 71537 - DNA, 28 bp, Artificial Sequence
  Synthetic
aggaatccacuagttctgttatgaugga

SEQ ID NO: 71538 - DNA, 18 bp, Artificial Sequence
  Synthetic
aaccgugaggccatgcut

SEQ ID NO: 71539 - DNA, 27 bp, Artificial Sequence
  Synthetic
ccccagatattcuagacagttcagtut

SEQ ID NO: 71540 - DNA, 25 bp, Artificial Sequence
  Synthetic
gtcaatatgcuaggactgtctggut

SEQ ID NO: 71541 - DNA, 28 bp, Artificial Sequence
  Synthetic
gctttgaaacaaucctttttctctccut

SEQ ID NO: 71542 - DNA, 28 bp, Artificial Sequence
  Synthetic
gtgtcaatgaguatagcatttgcucaac

SEQ ID NO: 71543 - DNA, 28 bp, Artificial Sequence
  Synthetic
agtctgaaaaccaauttgatcctgugat

SEQ ID NO: 71544 - DNA, 26 bp, Artificial Sequence
  Synthetic
cagcaaagaaguagaaggaaccagut

SEQ ID NO: 71545 - DNA, 28 bp, Artificial Sequence
  Synthetic
caagtttucagaaaagaagccaugacat

SEQ ID NO: 71546 - DNA, 22 bp, Artificial Sequence
  Synthetic
gaacttaagggcuctcgagcut

SEQ ID NO: 71547 - DNA, 23 bp, Artificial Sequence
  Synthetic
gccaagucacacctgtactttut

SEQ ID NO: 71548 - DNA, 23 bp, Artificial Sequence
  Synthetic
gtgatguggaaaagacctgugac

SEQ ID NO: 71549 - DNA, 21 bp, Artificial Sequence
  Synthetic
gggccctugtggaatcagtuc

SEQ ID NO: 71550 - DNA, 28 bp, Artificial Sequence
  Synthetic
ctgtgtgucagcaagaacaacattatut

SEQ ID NO: 71551 - DNA, 29 bp, Artificial Sequence
  Synthetic
tcctttccatgtuctcctaactcttuact

SEQ ID NO: 71552 - DNA, 22 bp, Artificial Sequence
  Synthetic
gcccccuccatctaacuaccag

SEQ ID NO: 71553 - DNA, 23 bp, Artificial Sequence
  Synthetic
attttcaucccagagugcaggaa

SEQ ID NO: 71554 - DNA, 28 bp, Artificial Sequence
  Synthetic
agacttttgagacaguggatgtgaaaut

SEQ ID NO: 71555 - DNA, 27 bp, Artificial Sequence
  Synthetic
tutcttctgaaatagucagcacacagt

SEQ ID NO: 71556 - DNA, 24 bp, Artificial Sequence
  Synthetic
gaattcccaggcutagccatgaua

SEQ ID NO: 71557 - DNA, 25 bp, Artificial Sequence
  Synthetic
gcaatgctugattggttcauggaag

SEQ ID NO: 71558 - DNA, 23 bp, Artificial Sequence
  Synthetic
agaatcaaaggacugtgtgcuga

SEQ ID NO: 71559 - DNA, 28 bp, Artificial Sequence
  Synthetic
ccaaacatuaagcagcactattgcuaat

SEQ ID NO: 71560 - DNA, 23 bp, Artificial Sequence
  Synthetic
tgcatauagggagcugagggaat

SEQ ID NO: 71561 - DNA, 23 bp, Artificial Sequence
  Synthetic
agactcctuccctttcctgtcuc

SEQ ID NO: 71562 - DNA, 18 bp, Artificial Sequence
  Synthetic
gaccgaggutggcucgat

SEQ ID NO: 71563 - DNA, 20 bp, Artificial Sequence
  Synthetic
cccgagaacugagggtggua

SEQ ID NO: 71564 - DNA, 21 bp, Artificial Sequence
  Synthetic
acctctccuagcaagtcucca

SEQ ID NO: 71565 - DNA, 21 bp, Artificial Sequence
  Synthetic
ggtgataucccgccgaaucat

SEQ ID NO: 71566 - DNA, 25 bp, Artificial Sequence
  Synthetic
acagtccucaaagaaggaaatgcuc

SEQ ID NO: 71567 - DNA, 23 bp, Artificial Sequence
  Synthetic
atggaagaguctttgtggtugct

SEQ ID NO: 71568 - DNA, 23 bp, Artificial Sequence
  Synthetic
ccttccaggcugacttctgtcua

SEQ ID NO: 71569 - DNA, 22 bp, Artificial Sequence
  Synthetic
cagctcccuaaatcctccucac

SEQ ID NO: 71570 - DNA, 17 bp, Artificial Sequence
  Synthetic
ccccttugcccgctuct

SEQ ID NO: 71571 - DNA, 19 bp, Artificial Sequence
  Synthetic
gggaggagacgucaaugcc

SEQ ID NO: 71572 - DNA, 21 bp, Artificial Sequence
  Synthetic
agtcggacagcaucatgcauc

SEQ ID NO: 71573 - DNA, 24 bp, Artificial Sequence
  Synthetic
ggtcaaacagcuctccaaaagcua

SEQ ID NO: 71574 - DNA, 20 bp, Artificial Sequence
  Synthetic
atcctccutgtccucggact

SEQ ID NO: 71575 - DNA, 20 bp, Artificial Sequence
  Synthetic
ccgaggaggaccucacugaa

SEQ ID NO: 71576 - DNA, 21 bp, Artificial Sequence
  Synthetic
cagtaccugcctcgcacauag

SEQ ID NO: 71577 - DNA, 22 bp, Artificial Sequence
  Synthetic
ggcagatuaggcaaccgaauga

SEQ ID NO: 71578 - DNA, 23 bp, Artificial Sequence
  Synthetic
gcgttacucacgtccttctucac

SEQ ID NO: 71579 - DNA, 23 bp, Artificial Sequence
  Synthetic
tcctctcctucttccccatuacc

SEQ ID NO: 71580 - DNA, 27 bp, Artificial Sequence
  Synthetic
aagctgatatgtcugatttggttccut

SEQ ID NO: 71581 - DNA, 22 bp, Artificial Sequence
  Synthetic
tggtaccaggagugtttcucca

SEQ ID NO: 71582 - DNA, 22 bp, Artificial Sequence
  Synthetic
caaaagugccagcaguaccaag

SEQ ID NO: 71583 - DNA, 25 bp, Artificial Sequence
  Synthetic
caatgcatcccaucttacagaguga

SEQ ID NO: 71584 - DNA, 26 bp, Artificial Sequence
  Synthetic
catatactuaccatatcggcugcgat

SEQ ID NO: 71585 - DNA, 27 bp, Artificial Sequence
  Synthetic
caagcacatggaucagtgttttcttua

SEQ ID NO: 71586 - DNA, 23 bp, Artificial Sequence
  Synthetic
ggcaggtggucattgagaaugat

SEQ ID NO: 71587 - DNA, 23 bp, Artificial Sequence
  Synthetic
gtgtttcagcutcttgtggtgut

SEQ ID NO: 71588 - DNA, 20 bp, Artificial Sequence
  Synthetic
acgctcuacccactgcagua

SEQ ID NO: 71589 - DNA, 28 bp, Artificial Sequence
  Synthetic
ggccagtataauaaacaaagtgtgaugg

SEQ ID NO: 71590 - DNA, 24 bp, Artificial Sequence
  Synthetic
aatttcaatggaucacccccauca

SEQ ID NO: 71591 - DNA, 28 bp, Artificial Sequence
  Synthetic
gagagctttgtutaggcacattttuagt

SEQ ID NO: 71592 - DNA, 23 bp, Artificial Sequence
  Synthetic
gcuggtacugagcaagaagacaa

SEQ ID NO: 71593 - DNA, 27 bp, Artificial Sequence
  Synthetic
cagacaaaaaugggttgttggttcuac

SEQ ID NO: 71594 - DNA, 28 bp, Artificial Sequence
  Synthetic
atcacccccaucacactttgtttatuat

SEQ ID NO: 71595 - DNA, 23 bp, Artificial Sequence
  Synthetic
gctgagagcuttgttuaggcaca

SEQ ID NO: 71596 - DNA, 28 bp, Artificial Sequence
  Synthetic
ctaaaaatgtgccuaaacaaagctcuca

SEQ ID NO: 71597 - DNA, 28 bp, Artificial Sequence
  Synthetic
ccttgaaccgatuttagatggcatctua

SEQ ID NO: 71598 - DNA, 29 bp, Artificial Sequence
  Synthetic
cagttttctgtcgugaacgtttcttatut

SEQ ID NO: 71599 - DNA, 28 bp, Artificial Sequence
  Synthetic
ccacttaatuagcactttctttgcauct

SEQ ID NO: 71600 - DNA, 19 bp, Artificial Sequence
  Synthetic
cactcucaggcacctucca

SEQ ID NO: 71601 - DNA, 21 bp, Artificial Sequence
  Synthetic
ccacagagaccggcutcaaua

SEQ ID NO: 71602 - DNA, 21 bp, Artificial Sequence
  Synthetic
acatcacgccagucaacaguc

SEQ ID NO: 71603 - DNA, 22 bp, Artificial Sequence
  Synthetic
tggtacacccucccttcgtauc

SEQ ID NO: 71604 - DNA, 21 bp, Artificial Sequence
  Synthetic
gggaggacugaccuaagcaag

SEQ ID NO: 71605 - DNA, 22 bp, Artificial Sequence
  Synthetic
ctctgctcuggtttgctacuca

SEQ ID NO: 71606 - DNA, 21 bp, Artificial Sequence
  Synthetic
cttgacaccugcgaugaggaa

SEQ ID NO: 71607 - DNA, 20 bp, Artificial Sequence
  Synthetic
ccatcacccccucctctugt

SEQ ID NO: 71608 - DNA, 29 bp, Artificial Sequence
  Synthetic
tctgttaagcagucactaccattgtatuc

SEQ ID NO: 71609 - DNA, 24 bp, Artificial Sequence
  Synthetic
gagctacctuggcaacttcuagat

SEQ ID NO: 71610 - DNA, 23 bp, Artificial Sequence
  Synthetic
ctagaagtugccaaggtagcuca

SEQ ID NO: 71611 - DNA, 28 bp, Artificial Sequence
  Synthetic
acccttattgagacaaugccaacatuaa

SEQ ID NO: 71612 - DNA, 24 bp, Artificial Sequence
  Synthetic
gaagtacacaugctcctaggctut

SEQ ID NO: 71613 - DNA, 20 bp, Artificial Sequence
  Synthetic
caguagttcaccucgccagt

SEQ ID NO: 71614 - DNA, 20 bp, Artificial Sequence
  Synthetic
ccagagguccatctcgcuga

SEQ ID NO: 71615 - DNA, 25 bp, Artificial Sequence
  Synthetic
cttcttggtugagctttctugcaat

SEQ ID NO: 71616 - DNA, 19 bp, Artificial Sequence
  Synthetic
cutctcagacuggcgaggt

SEQ ID NO: 71617 - DNA, 28 bp, Artificial Sequence
  Synthetic
cctgttctugtattctctgtuccaaaca

SEQ ID NO: 71618 - DNA, 28 bp, Artificial Sequence
  Synthetic
ggtactacagaugcagttggtttacuaa

SEQ ID NO: 71619 - DNA, 33 bp, Artificial Sequence
  Synthetic
atattcatagtggcucctattaaaatctuaacc

SEQ ID NO: 71620 - DNA, 21 bp, Artificial Sequence
  Synthetic
gggtgaggcaguctttacuca

SEQ ID NO: 71621 - DNA, 26 bp, Artificial Sequence
  Synthetic
cgttgtacacucatcttccuagggat

SEQ ID NO: 71622 - DNA, 23 bp, Artificial Sequence
  Synthetic
gggaucccaaggaagagaaguga

SEQ ID NO: 71623 - DNA, 23 bp, Artificial Sequence
  Synthetic
cacttccctugtgggaatgucaa

SEQ ID NO: 71624 - DNA, 27 bp, Artificial Sequence
  Synthetic
catacagacacutcatttggaguacct

SEQ ID NO: 71625 - DNA, 27 bp, Artificial Sequence
  Synthetic
agtgtgtgcuactagaacucaaaacac

SEQ ID NO: 71626 - DNA, 28 bp, Artificial Sequence
  Synthetic
aaaggcagcacaaauacactaauagaca

SEQ ID NO: 71627 - DNA, 26 bp, Artificial Sequence
  Synthetic
ggaatcagcaagutacagtguaacag

SEQ ID NO: 71628 - DNA, 21 bp, Artificial Sequence
  Synthetic
gagcaaaccgaagcugaacut

SEQ ID NO: 71629 - DNA, 27 bp, Artificial Sequence
  Synthetic
cctgctgtugttaaatctatttugcca

SEQ ID NO: 71630 - DNA, 22 bp, Artificial Sequence
  Synthetic
cgaauggaccaugaaacagcca

SEQ ID NO: 71631 - DNA, 28 bp, Artificial Sequence
  Synthetic
cttagcaaagtagucatggcattaguga

SEQ ID NO: 71632 - DNA, 28 bp, Artificial Sequence
  Synthetic
catttcacattcautcttctctgtgucc

SEQ ID NO: 71633 - DNA, 25 bp, Artificial Sequence
  Synthetic
gttagaacaagcagcucagatcugt

SEQ ID NO: 71634 - DNA, 20 bp, Artificial Sequence
  Synthetic
cctgttgcuggtagccguaa

SEQ ID NO: 71635 - DNA, 21 bp, Artificial Sequence
  Synthetic
ctggagggaagcugtactguc

SEQ ID NO: 71636 - DNA, 25 bp, Artificial Sequence
  Synthetic
gctactctccugaactctctcacuc

SEQ ID NO: 71637 - DNA, 23 bp, Artificial Sequence
  Synthetic
tgcatcagaacccuccttgaauc

SEQ ID NO: 71638 - DNA, 21 bp, Artificial Sequence
  Synthetic
ctcccagutgcaacgtuaggt

SEQ ID NO: 71639 - DNA, 22 bp, Artificial Sequence
  Synthetic
gguccacggauccagaaacaag

SEQ ID NO: 71640 - DNA, 20 bp, Artificial Sequence
  Synthetic
cctgccuggatgggtgttut

SEQ ID NO: 71641 - DNA, 25 bp, Artificial Sequence
  Synthetic
gtagattctcgccuctattgagcug

SEQ ID NO: 71642 - DNA, 18 bp, Artificial Sequence
  Synthetic
cgggccagcagcucaaua

SEQ ID NO: 71643 - DNA, 29 bp, Artificial Sequence
  Synthetic
ggacucttaaagatttauaccacccagat

SEQ ID NO: 71644 - DNA, 18 bp, Artificial Sequence
  Synthetic
gcaagcgagacccugcuc

SEQ ID NO: 71645 - DNA, 18 bp, Artificial Sequence
  Synthetic
ggagcugcacgacuacca

SEQ ID NO: 71646 - DNA, 19 bp, Artificial Sequence
  Synthetic
acccacagcucctcuccat

SEQ ID NO: 71647 - DNA, 18 bp, Artificial Sequence
  Synthetic
accctgcugccttcaucc

SEQ ID NO: 71648 - DNA, 21 bp, Artificial Sequence
  Synthetic
ccatcgggugcttgatgaugt

SEQ ID NO: 71649 - DNA, 19 bp, Artificial Sequence
  Synthetic
gcaagaagggcaagcuguc

SEQ ID NO: 71650 - DNA, 20 bp, Artificial Sequence
  Synthetic
ctgaggatgcugtcgcagua

SEQ ID NO: 71651 - DNA, 17 bp, Artificial Sequence
  Synthetic
cccgccgutgucagacc

SEQ ID NO: 71652 - DNA, 20 bp, Artificial Sequence
  Synthetic
cgtacgutgggtuccacaag

SEQ ID NO: 71653 - DNA, 24 bp, Artificial Sequence
  Synthetic
gagatctctgutcgagtcccuaga

SEQ ID NO: 71654 - DNA, 26 bp, Artificial Sequence
  Synthetic
cacagactcuggaaatgtguaaccaa

SEQ ID NO: 71655 - DNA, 21 bp, Artificial Sequence
  Synthetic
ccctcuggaaggtacatugcc

SEQ ID NO: 71656 - DNA, 19 bp, Artificial Sequence
  Synthetic
ccaccactutggcctgcut

SEQ ID NO: 71657 - DNA, 17 bp, Artificial Sequence
  Synthetic
gcgacaugcgtctucgg

SEQ ID NO: 71658 - DNA, 28 bp, Artificial Sequence
  Synthetic
ggtaaaaatgtgaugatctctgcaggua

SEQ ID NO: 71659 - DNA, 27 bp, Artificial Sequence
  Synthetic
gggcagtctgautgcttttaatctcut

SEQ ID NO: 71660 - DNA, 27 bp, Artificial Sequence
  Synthetic
acatacttcacautggtgttgguacag

SEQ ID NO: 71661 - DNA, 27 bp, Artificial Sequence
  Synthetic
tcagguagtgaaatuaaaaggccaagt

SEQ ID NO: 71662 - DNA, 25 bp, Artificial Sequence
  Synthetic
ctgtcacagagacugtctgatctut

SEQ ID NO: 71663 - DNA, 28 bp, Artificial Sequence
  Synthetic
tgccctgttguggttaataatgattuct

SEQ ID NO: 71664 - DNA, 24 bp, Artificial Sequence
  Synthetic
ccaggcttgucaacttaccagtut

SEQ ID NO: 71665 - DNA, 20 bp, Artificial Sequence
  Synthetic
catcgccacauttccuagcc

SEQ ID NO: 71666 - DNA, 18 bp, Artificial Sequence
  Synthetic
tcacgtguccccctucca

SEQ ID NO: 71667 - DNA, 21 bp, Artificial Sequence
  Synthetic
ggttcctccuctcctggtcuc

SEQ ID NO: 71668 - DNA, 27 bp, Artificial Sequence
  Synthetic
attttattttuggccctcaactuggac

SEQ ID NO: 71669 - DNA, 22 bp, Artificial Sequence
  Synthetic
gatgtagggcuggaagtggtut

SEQ ID NO: 71670 - DNA, 28 bp, Artificial Sequence
  Synthetic
gcaagagaaagaacaaguttcatugaga

SEQ ID NO: 71671 - DNA, 28 bp, Artificial Sequence
  Synthetic
cttgtcatggucacaactccatctaaua

SEQ ID NO: 71672 - DNA, 28 bp, Artificial Sequence
  Synthetic
cagtcatgtgauactcaagtaagctcut

SEQ ID NO: 71673 - DNA, 29 bp, Artificial Sequence
  Synthetic
ttgcttactttctuctccaacagtcauat

SEQ ID NO: 71674 - DNA, 23 bp, Artificial Sequence
  Synthetic
ctgggagaaaugagcttgtcuga

SEQ ID NO: 71675 - DNA, 19 bp, Artificial Sequence
  Synthetic
gccuggccacgaauagcag

SEQ ID NO: 71676 - DNA, 20 bp, Artificial Sequence
  Synthetic
ttggccucacacgttccuac

SEQ ID NO: 71677 - DNA, 22 bp, Artificial Sequence
  Synthetic
tggaaaaccucatgcuggacaa

SEQ ID NO: 71678 - DNA, 28 bp, Artificial Sequence
  Synthetic
ggtgctgaaggaucagtttctaaaguaa

SEQ ID NO: 71679 - DNA, 27 bp, Artificial Sequence
  Synthetic
agttgctctaagugatgattccttugt

SEQ ID NO: 71680 - DNA, 28 bp, Artificial Sequence
  Synthetic
aacaaaggaaucatcactuagagcaact

SEQ ID NO: 71681 - DNA, 27 bp, Artificial Sequence
  Synthetic
tgaaggtgaaaccutagtgtgaaaugt

SEQ ID NO: 71682 - DNA, 21 bp, Artificial Sequence
  Synthetic
gatctctctugcagcctcgut

SEQ ID NO: 71683 - DNA, 23 bp, Artificial Sequence
  Synthetic
cttctcaacaccucagctgacuc

SEQ ID NO: 71684 - DNA, 21 bp, Artificial Sequence
  Synthetic
gutctuagaccggaaccggaa

SEQ ID NO: 71685 - DNA, 21 bp, Artificial Sequence
  Synthetic
tggtgccucaaggacaaugac

SEQ ID NO: 71686 - DNA, 19 bp, Artificial Sequence
  Synthetic
gctgtgccutcagggtuct

SEQ ID NO: 71687 - DNA, 18 bp, Artificial Sequence
  Synthetic
tcacctguggctggctuc

SEQ ID NO: 71688 - DNA, 17 bp, Artificial Sequence
  Synthetic
ccgctccugagaggcut

SEQ ID NO: 71689 - DNA, 26 bp, Artificial Sequence
  Synthetic
ggccacccaagaaguaaaaauaaact

SEQ ID NO: 71690 - DNA, 19 bp, Artificial Sequence
  Synthetic
ggtgaccccuacagtcgug

SEQ ID NO: 71691 - DNA, 23 bp, Artificial Sequence
  Synthetic
agaggcagatugagcccactaua

SEQ ID NO: 71692 - DNA, 23 bp, Artificial Sequence
  Synthetic
cagtgatctugatgtggccauct

SEQ ID NO: 71693 - DNA, 20 bp, Artificial Sequence
  Synthetic
gcatgggagggutgatgucc

SEQ ID NO: 71694 - DNA, 28 bp, Artificial Sequence
  Synthetic
agaccttacaauttccatgattuccagt

SEQ ID NO: 71695 - DNA, 28 bp, Artificial Sequence
  Synthetic
ccacatgttaatgucatttcttggcaua

SEQ ID NO: 71696 - DNA, 28 bp, Artificial Sequence
  Synthetic
gaatccattcccucttattctggaagug

SEQ ID NO: 71697 - DNA, 27 bp, Artificial Sequence
  Synthetic
agcataagttctucattttcaggguct

SEQ ID NO: 71698 - DNA, 21 bp, Artificial Sequence
  Synthetic
ccccuttctctuccagaagcc

SEQ ID NO: 71699 - DNA, 27 bp, Artificial Sequence
  Synthetic
gttatctccacuggccacaaaatcaua

SEQ ID NO: 71700 - DNA, 21 bp, Artificial Sequence
  Synthetic
cctcauccacggacucaggat

SEQ ID NO: 71701 - DNA, 28 bp, Artificial Sequence
  Synthetic
cagtatctctgautttgatgccattugt

SEQ ID NO: 71702 - DNA, 21 bp, Artificial Sequence
  Synthetic
gcuggacgaaagccugaacaa

SEQ ID NO: 71703 - DNA, 24 bp, Artificial Sequence
  Synthetic
cagaaacuactcaaacucccacct

SEQ ID NO: 71704 - DNA, 18 bp, Artificial Sequence
  Synthetic
ggcaaaagcccaguccuc

SEQ ID NO: 71705 - DNA, 23 bp, Artificial Sequence
  Synthetic
gtaacgtgtgugtgtctgtguct

SEQ ID NO: 71706 - DNA, 28 bp, Artificial Sequence
  Synthetic
acatttggcugtgacttcuaagaagaaa

SEQ ID NO: 71707 - DNA, 27 bp, Artificial Sequence
  Synthetic
gctcactaacuaacgtgaaagcctuac

SEQ ID NO: 71708 - DNA, 24 bp, Artificial Sequence
  Synthetic
gagtggtttugctggaacugaaat

SEQ ID NO: 71709 - DNA, 24 bp, Artificial Sequence
  Synthetic
ggttaccugactgctagttucact

SEQ ID NO: 71710 - DNA, 30 bp, Artificial Sequence; identical to SEQ ID NO: 6760
  Synthetic

SEQ ID NO: 71711 - DNA, 23 bp, Artificial Sequence
  Synthetic
aagtcctugaccctttgctgaut

SEQ ID NO: 71712 - DNA, 22 bp, Artificial Sequence
  Synthetic
ctccaggcaugatgatguccat

SEQ ID NO: 71713 - DNA, 21 bp, Artificial Sequence
  Synthetic
cggcacaucccatctuagcag

SEQ ID NO: 71714 - DNA, 28 bp, Artificial Sequence
  Synthetic
gatacattatgugtgtacaagugaccca

SEQ ID NO: 71715 - DNA, 25 bp, Artificial Sequence
  Synthetic
aagcugagaacatgcuaaagaacca

SEQ ID NO: 71716 - DNA, 21 bp, Artificial Sequence
  Synthetic
gctgaggucctggagattuct

SEQ ID NO: 71717 - DNA, 28 bp, Artificial Sequence
  Synthetic
cccctgataaautaacatacttgcucct

SEQ ID NO: 71718 - DNA, 23 bp, Artificial Sequence
  Synthetic
tgattcgggugtctcttcucagt

SEQ ID NO: 71719 - DNA, 19 bp, Artificial Sequence
  Synthetic
tctcucgcgagcaagctuc

SEQ ID NO: 71720 - DNA, 21 bp, Artificial Sequence
  Synthetic
gaaccucuacccaacaccaca

SEQ ID NO: 71721 - DNA, 25 bp, Artificial Sequence
  Synthetic
tgtgtttugggtagtgcauacaact

SEQ ID NO: 71722 - DNA, 25 bp, Artificial Sequence
  Synthetic
ctcatcatcagugcatagcttcuca

SEQ ID NO: 71723 - DNA, 21 bp, Artificial Sequence
  Synthetic
ggtgaggacuttgctggtugt

SEQ ID NO: 71724 - DNA, 21 bp, Artificial Sequence
  Synthetic
ggagagccutaccugaaggag

SEQ ID NO: 71725 - DNA, 26 bp, Artificial Sequence
  Synthetic
cagggccugactgattgataaatuca

SEQ ID NO: 71726 - DNA, 27 bp, Artificial Sequence
  Synthetic
gcagttgaaaaacucctagaagccaua

SEQ ID NO: 71727 - DNA, 28 bp, Artificial Sequence
  Synthetic
tgccaaacagcuatccatgaaaatauca

SEQ ID NO: 71728 - DNA, 17 bp, Artificial Sequence
  Synthetic
acagcacccgcugctut

SEQ ID NO: 71729 - DNA, 22 bp, Artificial Sequence
  Synthetic
ccagctgucagtcatggtgaua

SEQ ID NO: 71730 - DNA, 21 bp, Artificial Sequence
  Synthetic
cccaaccttutcgttgcacug

SEQ ID NO: 71731 - DNA, 26 bp, Artificial Sequence
  Synthetic
tcaaaccgcaautcccagatttcuat

SEQ ID NO: 71732 - DNA, 23 bp, Artificial Sequence
  Synthetic
gatttcutgcagacuccgaagga

SEQ ID NO: 71733 - DNA, 28 bp, Artificial Sequence
  Synthetic
ccatatcatcccaaucattgatgguact

SEQ ID NO: 71734 - DNA, 18 bp, Artificial Sequence
  Synthetic
accucgccacggtcttug

SEQ ID NO: 71735 - DNA, 19 bp, Artificial Sequence
  Synthetic
ccacctcugtcaggucagg

SEQ ID NO: 71736 - DNA, 22 bp, Artificial Sequence
  Synthetic
gcactccagcugatttcaaucc

SEQ ID NO: 71737 - DNA, 24 bp, Artificial Sequence
  Synthetic
tgccaagaugtggttaaacucaga

SEQ ID NO: 71738 - DNA, 26 bp, Artificial Sequence
  Synthetic
ccgggatacugctctcaagaaatuag

SEQ ID NO: 71739 - DNA, 27 bp, Artificial Sequence
  Synthetic
atttctgagcagugcttactctuacaa

SEQ ID NO: 71740 - DNA, 22 bp, Artificial Sequence
  Synthetic
gtuacaccaccccaaagucact

SEQ ID NO: 71741 - DNA, 26 bp, Artificial Sequence
  Synthetic
gtcatccttcugttcctcagucaaat

SEQ ID NO: 71742 - DNA, 22 bp, Artificial Sequence
  Synthetic
caacagggccagacuccataut

SEQ ID NO: 71743 - DNA, 21 bp, Artificial Sequence
  Synthetic
ctgggaguatggaggcugaga

SEQ ID NO: 71744 - DNA, 21 bp, Artificial Sequence
  Synthetic
gggacagucgaagaactucag

SEQ ID NO: 71745 - DNA, 21 bp, Artificial Sequence
  Synthetic
gctgcccauacatctcaucca

SEQ ID NO: 71746 - DNA, 24 bp, Artificial Sequence
  Synthetic
ggaaggaagttugtgagcagagut

SEQ ID NO: 71747 - DNA, 28 bp, Artificial Sequence
  Synthetic
tccaggatuggaattacacaagucaaat

SEQ ID NO: 71748 - DNA, 22 bp, Artificial Sequence
  Synthetic
gtgagaggugaacaaccccuaa

SEQ ID NO: 71749 - DNA, 17 bp, Artificial Sequence
  Synthetic
gagccucacctgccgua

SEQ ID NO: 71750 - DNA, 28 bp, Artificial Sequence
  Synthetic
cggaagaatagaauggcacttttucaac

SEQ ID NO: 71751 - DNA, 24 bp, Artificial Sequence
  Synthetic
ttgcttguaaagacgtctgtguct

SEQ ID NO: 71752 - DNA, 19 bp, Artificial Sequence
  Synthetic
ggtctcuggctcgttguga

SEQ ID NO: 71753 - DNA, 19 bp, Artificial Sequence
  Synthetic
catgggagagcugggcuac

SEQ ID NO: 71754 - DNA, 18 bp, Artificial Sequence
  Synthetic
ccaccacagcuccagucc

SEQ ID NO: 71755 - DNA, 19 bp, Artificial Sequence
  Synthetic
gaggttgcugctgctggua

SEQ ID NO: 71756 - DNA, 21 bp, Artificial Sequence
  Synthetic
gutagaacaacuccgggcaga

SEQ ID NO: 71757 - DNA, 24 bp, Artificial Sequence
  Synthetic
catttctcccutatgccgtgttut

SEQ ID NO: 71758 - DNA, 20 bp, Artificial Sequence
  Synthetic
caggacgaguatgcgcugaa

SEQ ID NO: 71759 - DNA, 26 bp, Artificial Sequence
  Synthetic
agggtgtttgauctctttcatgacug

SEQ ID NO: 71760 - DNA, 29 bp, Artificial Sequence
  Synthetic
gccggaattatuaatgaacaagaacauga

SEQ ID NO: 71761 - DNA, 25 bp, Artificial Sequence
  Synthetic
tgctcatauaacacagcttcagcut

SEQ ID NO: 71762 - DNA, 24 bp, Artificial Sequence
  Synthetic
gggaccgacauaaaagaacucaca

SEQ ID NO: 71763 - DNA, 27 bp, Artificial Sequence
  Synthetic
aaaaagcatttcacutacgatgacgut

SEQ ID NO: 71764 - DNA, 22 bp, Artificial Sequence
  Synthetic
cacauggcacagauggaggaaa

SEQ ID NO: 71765 - DNA, 28 bp, Artificial Sequence
  Synthetic
ttccttttgagagutagtatctugcaat

SEQ ID NO: 71766 - DNA, 19 bp, Artificial Sequence
  Synthetic
cagccacaggcucagtcuc

SEQ ID NO: 71767 - DNA, 20 bp, Artificial Sequence
  Synthetic
gcaggaggcagggauatcut

SEQ ID NO: 71768 - DNA, 20 bp, Artificial Sequence
  Synthetic
cgctccuaccttcctgugac

SEQ ID NO: 71769 - DNA, 20 bp, Artificial Sequence
  Synthetic
ggagtacauttgcgcgtuca

SEQ ID NO: 71770 - DNA, 27 bp, Artificial Sequence
  Synthetic
aaaaactcacucaaattcucagcaagg

SEQ ID NO: 71771 - DNA, 24 bp, Artificial Sequence
  Synthetic
ttccctttagaaugcagcagtcut

SEQ ID NO: 71772 - DNA, 25 bp, Artificial Sequence
  Synthetic
caggtaagugctagtcattcucact

SEQ ID NO: 71773 - DNA, 25 bp, Artificial Sequence
  Synthetic
ccatctgccutgttgttcatttugg

SEQ ID NO: 71774 - DNA, 19 bp, Artificial Sequence
  Synthetic
caacgugaacgcgcaaaug

SEQ ID NO: 71775 - DNA, 18 bp, Artificial Sequence
  Synthetic
cgtgtcgutgtggcagut

SEQ ID NO: 71776 - DNA, 18 bp, Artificial Sequence
  Synthetic
gcugacagcagccucaag

SEQ ID NO: 71777 - DNA, 17 bp, Artificial Sequence
  Synthetic
acacucgccugcaacca

SEQ ID NO: 71778 - DNA, 23 bp, Artificial Sequence
  Synthetic
gacctacctuctggaacctugaa

SEQ ID NO: 71779 - DNA, 21 bp, Artificial Sequence
  Synthetic
gtgtatagugcaccaggucca

SEQ ID NO: 71780 - DNA, 27 bp, Artificial Sequence
  Synthetic
gaaaattcttcutgccatatgugagca

SEQ ID NO: 71781 - DNA, 28 bp, Artificial Sequence
  Synthetic
gctcctccuaagccactttttatatcut

SEQ ID NO: 71782 - DNA, 23 bp, Artificial Sequence
  Synthetic
catatgugagcaagcagcugaaa

SEQ ID NO: 71783 - DNA, 19 bp, Artificial Sequence
  Synthetic
acaaaggcccaagcuccuc

SEQ ID NO: 71784 - DNA, 28 bp, Artificial Sequence
  Synthetic
gatataaaaagtggcutaggaggagcut

SEQ ID NO: 71785 - DNA, 28 bp, Artificial Sequence
  Synthetic
ggaagaacaggauagaaagactgctuat

SEQ ID NO: 71786 - DNA, 25 bp, Artificial Sequence
  Synthetic
gtggaagagtucttgaaagaagcug

SEQ ID NO: 71787 - DNA, 21 bp, Artificial Sequence
  Synthetic
caacgaggutttgtgcaguga

SEQ ID NO: 71788 - DNA, 21 bp, Artificial Sequence
  Synthetic
cagcacaaaugtgtgcaccut

SEQ ID NO: 71789 - DNA, 28 bp, Artificial Sequence
  Synthetic
aaaatagtucccaaggcattgaaucaac

SEQ ID NO: 71790 - DNA, 24 bp, Artificial Sequence
  Synthetic
gggatguaaagttaacuccagcca

SEQ ID NO: 71791 - DNA, 28 bp, Artificial Sequence
  Synthetic
ttgtcactctcutttctttttcctucct

SEQ ID NO: 71792 - DNA, 28 bp, Artificial Sequence
  Synthetic
gcagattctgcuaataccctgcaaauag

SEQ ID NO: 71793 - DNA, 21 bp, Artificial Sequence
  Synthetic
tttgtgccuggctgattcuga

SEQ ID NO: 71794 - DNA, 24 bp, Artificial Sequence
  Synthetic
catctagaccagcutctcccacua

SEQ ID NO: 71795 - DNA, 22 bp, Artificial Sequence
  Synthetic
gctttgctggucttccatcaut

SEQ ID NO: 71796 - DNA, 28 bp, Artificial Sequence
  Synthetic
gcctaccaattauagtgaacgttacuct

SEQ ID NO: 71797 - DNA, 28 bp, Artificial Sequence
  Synthetic
tgtttctgtgaugaaggaatatctgugg

SEQ ID NO: 71798 - DNA, 21 bp, Artificial Sequence
  Synthetic
ccgggaagcaacaacucugat

SEQ ID NO: 71799 - DNA, 21 bp, Artificial Sequence
  Synthetic
ggauccaggauaacggaggct

SEQ ID NO: 71800 - DNA, 25 bp, Artificial Sequence
  Synthetic
cagactgcagggutctagtttauct

SEQ ID NO: 71801 - DNA, 26 bp, Artificial Sequence
  Synthetic
gtgaactgacagaaguacatctgcua

SEQ ID NO: 71802 - DNA, 28 bp, Artificial Sequence
  Synthetic
cgtcatgtggaucagcctattgattaua

SEQ ID NO: 71803 - DNA, 23 bp, Artificial Sequence
  Synthetic
tgtggacgtautctcactgctug

SEQ ID NO: 71804 - DNA, 22 bp, Artificial Sequence
  Synthetic
ggccctguaaagcagcacauat

SEQ ID NO: 71805 - DNA, 22 bp, Artificial Sequence
  Synthetic
cccaacuccttttgguccacag

SEQ ID NO: 71806 - DNA, 21 bp, Artificial Sequence
  Synthetic
ggtggugaccagggagtctua

SEQ ID NO: 71807 - DNA, 20 bp, Artificial Sequence
  Synthetic
acgcagugcagctgagtauc

SEQ ID NO: 71808 - DNA, 28 bp, Artificial Sequence
  Synthetic
caaagcaguaaaaccgaacatatgtcut

SEQ ID NO: 71809 - DNA, 21 bp, Artificial Sequence
  Synthetic
ccttttgaggcugaccactuc

SEQ ID NO: 71810 - DNA, 21 bp, Artificial Sequence
  Synthetic
acatcaccaagugcaccuacc

SEQ ID NO: 71811 - DNA, 23 bp, Artificial Sequence
  Synthetic
ggattgtggccutctttgagtuc

SEQ ID NO: 71812 - DNA, 23 bp, Artificial Sequence
  Synthetic
ccatccaagtuctgcacagagua

SEQ ID NO: 71813 - DNA, 28 bp, Artificial Sequence
  Synthetic
acatcctatttcaucttcagctgaugac

SEQ ID NO: 71814 - DNA, 20 bp, Artificial Sequence
  Synthetic
gacgctcuccacacacauga

SEQ ID NO: 71815 - DNA, 19 bp, Artificial Sequence
  Synthetic
cgactucgccgagatgucc

SEQ ID NO: 71816 - DNA, 20 bp, Artificial Sequence
  Synthetic
tccctgtccugccccaauaa

SEQ ID NO: 71817 - DNA, 20 bp, Artificial Sequence
  Synthetic
cugcagacccacagugacaa

SEQ ID NO: 71818 - DNA, 18 bp, Artificial Sequence
  Synthetic
gttcaccccgucccugaa

SEQ ID NO: 71819 - DNA, 17 bp, Artificial Sequence
  Synthetic
cggtgccaccugtgguc

SEQ ID NO: 71820 - DNA, 17 bp, Artificial Sequence
  Synthetic
gcggagggucaggugga

SEQ ID NO: 71821 - DNA, 17 bp, Artificial Sequence
  Synthetic
cgcaccgggcauctuct

SEQ ID NO: 71822 - DNA, 28 bp, Artificial Sequence
  Synthetic
tcagagatactutagggacaaaauccga

SEQ ID NO: 71823 - DNA, 24 bp, Artificial Sequence
  Synthetic
catctctgcccuttctttctucca

SEQ ID NO: 71824 - DNA, 27 bp, Artificial Sequence
  Synthetic
acataccagttccuatggttccagtua

SEQ ID NO: 71825 - DNA, 22 bp, Artificial Sequence
  Synthetic
agcauacagggcctuaaaccag

SEQ ID NO: 71826 - DNA, 27 bp, Artificial Sequence
  Synthetic
aaatttcacuccacttaccuaccaagg

SEQ ID NO: 71827 - DNA, 28 bp, Artificial Sequence
  Synthetic
actaaaacgacaauacaaugaccaccat

SEQ ID NO: 71828 - DNA, 27 bp, Artificial Sequence
  Synthetic
agtgtcagtaguagtgatggttauggt

SEQ ID NO: 71829 - DNA, 28 bp, Artificial Sequence
  Synthetic
ttgcactatgtatuttatgggctagguc

SEQ ID NO: 71830 - DNA, 25 bp, Artificial Sequence
  Synthetic
caaggtctucaatgataagcuccca

SEQ ID NO: 71831 - DNA, 28 bp, Artificial Sequence
  Synthetic
ggaaaggucaacatcatcatcaucaaaa

SEQ ID NO: 71832 - DNA, 29 bp, Artificial Sequence
  Synthetic
cacctaatctcagucccactatagaguat

SEQ ID NO: 71833 - DNA, 25 bp, Artificial Sequence
  Synthetic
tcgaggaagggaugatgaatgttug

SEQ ID NO: 71834 - DNA, 26 bp, Artificial Sequence
  Synthetic
agttttgcagutatggtcaauaccca

SEQ ID NO: 71835 - DNA, 25 bp, Artificial Sequence
  Synthetic
cttgcccauctttcattctgugaag

SEQ ID NO: 71836 - DNA, 20 bp, Artificial Sequence
  Synthetic
gcagcggucacacttguagg

SEQ ID NO: 71837 - DNA, 21 bp, Artificial Sequence
  Synthetic
ccttcctcgugctgacttugg

SEQ ID NO: 71838 - DNA, 28 bp, Artificial Sequence
  Synthetic
ctttacatggctuttggtcttctaagug

SEQ ID NO: 71839 - DNA, 23 bp, Artificial Sequence
  Synthetic
cattcuggcacgcttuggaaaaa

SEQ ID NO: 71840 - DNA, 21 bp, Artificial Sequence
  Synthetic
tcaggagaccccacucatgut

SEQ ID NO: 71841 - DNA, 22 bp, Artificial Sequence
  Synthetic
gcatggtttguccagggctauc

SEQ ID NO: 71842 - DNA, 28 bp, Artificial Sequence
  Synthetic
ctcactaugaaaaactgtaaagcugcaa

SEQ ID NO: 71843 - DNA, 22 bp, Artificial Sequence
  Synthetic
agatgcagcuactacccagcua

SEQ ID NO: 71844 - DNA, 20 bp, Artificial Sequence
  Synthetic
accuggaaacgugagcacag

SEQ ID NO: 71845 - DNA, 28 bp, Artificial Sequence
  Synthetic
tggttcctgaaauagagttcacatgtut

SEQ ID NO: 71846 - DNA, 23 bp, Artificial Sequence
  Synthetic
ctgccattgautagactgcugag

SEQ ID NO: 71847 - DNA, 25 bp, Artificial Sequence
  Synthetic
cttggtuacaaccagaatggugagt

SEQ ID NO: 71848 - DNA, 25 bp, Artificial Sequence
  Synthetic
cgggctattuaagagggatgguact

SEQ ID NO: 71849 - DNA, 26 bp, Artificial Sequence
  Synthetic
caaagaaggcacuggaaaaggattug

SEQ ID NO: 71850 - DNA, 22 bp, Artificial Sequence
  Synthetic
gcacaggaaccuggtggaaauc

SEQ ID NO: 71851 - DNA, 28 bp, Artificial Sequence
  Synthetic
acaatgtgauagaagaagaaatccgugt

SEQ ID NO: 71852 - DNA, 24 bp, Artificial Sequence
  Synthetic
agttgaactcuggaaggcaaaguc

SEQ ID NO: 71853 - DNA, 23 bp, Artificial Sequence
  Synthetic
tgtggttggaacutgaggtgtut

SEQ ID NO: 71854 - DNA, 28 bp, Artificial Sequence
  Synthetic
gaactccttacugtttttcacgaaauga

SEQ ID NO: 71855 - DNA, 24 bp, Artificial Sequence
  Synthetic
gctgattgtuggttggaggtuagt

SEQ ID NO: 71856 - DNA, 23 bp, Artificial Sequence
  Synthetic
gaagggttctuccggagatacug

SEQ ID NO: 71857 - DNA, 28 bp, Artificial Sequence
  Synthetic
agagcaagaagaaaucatctgaagtcut

SEQ ID NO: 71858 - DNA, 28 bp, Artificial Sequence
  Synthetic
gatcctggtautcttagcaggtuaaagg

SEQ ID NO: 71859 - DNA, 21 bp, Artificial Sequence
  Synthetic
acgcacagaacacucauggat

SEQ ID NO: 71860 - DNA, 25 bp, Artificial Sequence
  Synthetic
ccattctuagagcgaacttcacucc

SEQ ID NO: 71861 - DNA, 28 bp, Artificial Sequence
  Synthetic
tgacagtacacugcttcagttgaaauaa

SEQ ID NO: 71862 - DNA, 25 bp, Artificial Sequence
  Synthetic
tcagatgaacagacuagccacttug

SEQ ID NO: 71863 - DNA, 28 bp, Artificial Sequence
  Synthetic
agttgcaaaatugaaaaagaccaaacut

SEQ ID NO: 71864 - DNA, 23 bp, Artificial Sequence
  Synthetic
gcuaaagtuaccagccacacaga

SEQ ID NO: 71865 - DNA, 28 bp, Artificial Sequence
  Synthetic
gggaaaagtggautgtttctgaagtaug

SEQ ID NO: 71866 - DNA, 21 bp, Artificial Sequence
  Synthetic
cactcaugcacgcttctgtuc

SEQ ID NO: 71867 - DNA, 22 bp, Artificial Sequence
  Synthetic
agaacuctggttuggccacaaa

SEQ ID NO: 71868 - DNA, 28 bp, Artificial Sequence
  Synthetic
cagtgaaaaagcaaaaagugaggaugaa

SEQ ID NO: 71869 - DNA, 22 bp, Artificial Sequence
  Synthetic
agcaccattugtagcaccugag

SEQ ID NO: 71870 - DNA, 28 bp, Artificial Sequence
  Synthetic
tcctgtttatacugagagcactgaugat

SEQ ID NO: 71871 - DNA, 28 bp, Artificial Sequence
  Synthetic
gacacaaagacuggcttacattttgaut

SEQ ID NO: 71872 - DNA, 26 bp, Artificial Sequence
  Synthetic
ccaataaaucgaggtcagccuaaacc

SEQ ID NO: 71873 - DNA, 28 bp, Artificial Sequence
  Synthetic
gcaaaccggaguattttcaauagcaaaa

SEQ ID NO: 71874 - DNA, 28 bp, Artificial Sequence
  Synthetic
ccacaaatagtacutctcagaccgttuc

SEQ ID NO: 71875 - DNA, 24 bp, Artificial Sequence
  Synthetic
ggattgttaaugggacagtccuca

SEQ ID NO: 71876 - DNA, 28 bp, Artificial Sequence
  Synthetic
ccgtgttcgctutctaagtagattctua

SEQ ID NO: 71877 - DNA, 27 bp, Artificial Sequence
  Synthetic
cctcagtgatuaaacattgatgtuggt

SEQ ID NO: 71878 - DNA, 28 bp, Artificial Sequence
  Synthetic
aaatcgagtgggutctaatcatggaaut

SEQ ID NO: 71879 - DNA, 28 bp, Artificial Sequence
  Synthetic
tctcttcttcttcaugctgttcttctuc

SEQ ID NO: 71880 - DNA, 26 bp, Artificial Sequence
  Synthetic
gcagcaacugatgaaaagtuacagaa

SEQ ID NO: 71881 - DNA, 23 bp, Artificial Sequence
  Synthetic
ggtttacttggutctccctguga

SEQ ID NO: 71882 - DNA, 25 bp, Artificial Sequence
  Synthetic
ttgtaccagaagautagggctcuct

SEQ ID NO: 71883 - DNA, 18 bp, Artificial Sequence
  Synthetic
ctcacccgcaguctguct

SEQ ID NO: 71884 - DNA, 24 bp, Artificial Sequence
  Synthetic
tggactgtagutccagacacguaa

SEQ ID NO: 71885 - DNA, 20 bp, Artificial Sequence
  Synthetic
agcacttgacugggacccua

SEQ ID NO: 71886 - DNA, 24 bp, Artificial Sequence
  Synthetic
caattgagcagautgtgugcagat

SEQ ID NO: 71887 - DNA, 28 bp, Artificial Sequence
  Synthetic
gtgtctcaaaatcuatttcttccccuct

SEQ ID NO: 71888 - DNA, 28 bp, Artificial Sequence
  Synthetic
caatgtctuacaggtatcttcucaacct

SEQ ID NO: 71889 - DNA, 28 bp, Artificial Sequence
  Synthetic
gaagcagtutatatattggugccaaaca

SEQ ID NO: 71890 - DNA, 28 bp, Artificial Sequence
  Synthetic
catcacttaatuggtttttggctttugg

SEQ ID NO: 71891 - DNA, 24 bp, Artificial Sequence
  Synthetic
caaagttcgcgacauatcatccut

SEQ ID NO: 71892 - DNA, 21 bp, Artificial Sequence
  Synthetic
tttccccaaugccttctccug

SEQ ID NO: 71893 - DNA, 23 bp, Artificial Sequence
  Synthetic
aaggucaaaggcgguaagaacat

SEQ ID NO: 71894 - DNA, 27 bp, Artificial Sequence
  Synthetic
agctgttatcaauatcaagatggcugt

SEQ ID NO: 71895 - DNA, 27 bp, Artificial Sequence
  Synthetic
gctaaauggagcacaaatctctcuact

SEQ ID NO: 71896 - DNA, 24 bp, Artificial Sequence
  Synthetic
caccuactgcugaaaagagagaga

SEQ ID NO: 71897 - DNA, 20 bp, Artificial Sequence
  Synthetic
aatggctcaucgaggcucag

SEQ ID NO: 71898 - DNA, 24 bp, Artificial Sequence
  Synthetic
ggcaagcatutttggaggaaauct

SEQ ID NO: 71899 - DNA, 28 bp, Artificial Sequence
  Synthetic
cctctcgttttcutctttcttaccttuc

SEQ ID NO: 71900 - DNA, 26 bp, Artificial Sequence
  Synthetic
tgttgtcaatgcutggtactcaugat

SEQ ID NO: 71901 - DNA, 27 bp, Artificial Sequence
  Synthetic
gggaatttcccaacaauacagagtcut

SEQ ID NO: 71902 - DNA, 19 bp, Artificial Sequence
  Synthetic
ccctctgugacccgtccua

SEQ ID NO: 71903 - DNA, 21 bp, Artificial Sequence
  Synthetic
cactcacaugcatgcttuccc

SEQ ID NO: 71904 - DNA, 24 bp, Artificial Sequence
  Synthetic
cttcctatgucaccatcacauccc

SEQ ID NO: 71905 - DNA, 25 bp, Artificial Sequence
  Synthetic
aatccaaacaccccaguaatuacca

SEQ ID NO: 71906 - DNA, 21 bp, Artificial Sequence
  Synthetic
tcugcagacctugaccagagt

SEQ ID NO: 71907 - DNA, 24 bp, Artificial Sequence
  Synthetic
gcaaaccacugcaacatgaacauc

SEQ ID NO: 71908 - DNA, 21 bp, Artificial Sequence
  Synthetic
gccaggccccuttatctctua

SEQ ID NO: 71909 - DNA, 24 bp, Artificial Sequence
  Synthetic
ccactgagagugaccctaatcuct

SEQ ID NO: 71910 - DNA, 26 bp, Artificial Sequence
  Synthetic
aaaucataggtcaaaugaagcgcaac

SEQ ID NO: 71911 - DNA, 22 bp, Artificial Sequence
  Synthetic
tguctactucaggcaggaggaa

SEQ ID NO: 71912 - DNA, 26 bp, Artificial Sequence
  Synthetic
ctttcaagagautcacccagatucca

SEQ ID NO: 71913 - DNA, 23 bp, Artificial Sequence
  Synthetic
cucgaaaaccagacaagcuaacc

SEQ ID NO: 71914 - DNA, 23 bp, Artificial Sequence
  Synthetic
cccaggauaaggauggagagcat

SEQ ID NO: 71915 - DNA, 22 bp, Artificial Sequence
  Synthetic
gtgtguatctgtccuccggaag

SEQ ID NO: 71916 - DNA, 23 bp, Artificial Sequence
  Synthetic
ccttaccaucacactuccagcag

SEQ ID NO: 71917 - DNA, 20 bp, Artificial Sequence
  Synthetic
catccguccccaccuagaag

SEQ ID NO: 71918 - DNA, 22 bp, Artificial Sequence
  Synthetic
gactcctgcgugtcctttgtua

SEQ ID NO: 71919 - DNA, 22 bp, Artificial Sequence
  Synthetic
tgatacccaggguttggaguca

SEQ ID NO: 71920 - DNA, 21 bp, Artificial Sequence
  Synthetic
gagggaaugcacgtacctgut

SEQ ID NO: 71921 - DNA, 28 bp, Artificial Sequence
  Synthetic
agtgctgatugactttagtttatuccca

SEQ ID NO: 71922 - DNA, 19 bp, Artificial Sequence
  Synthetic
cagccttauctccgcguca

SEQ ID NO: 71923 - DNA, 24 bp, Artificial Sequence
  Synthetic
actgttttctccuctcacccguat

SEQ ID NO: 71924 - DNA, 23 bp, Artificial Sequence
  Synthetic
ccagctttuacatggcaaugaca

SEQ ID NO: 71925 - DNA, 23 bp, Artificial Sequence
  Synthetic
agcgcguatctgtuccaaaagat

SEQ ID NO: 71926 - DNA, 28 bp, Artificial Sequence
  Synthetic
cttgctacaaaaucataaagugcaacga

SEQ ID NO: 71927 - DNA, 28 bp, Artificial Sequence
  Synthetic
aattcccttcccutcttatgtcttucag

SEQ ID NO: 71928 - DNA, 21 bp, Artificial Sequence
  Synthetic
gcuctgagguccacaagaggt

SEQ ID NO: 71929 - DNA, 22 bp, Artificial Sequence
  Synthetic
cagagcugatucagacccacaa

SEQ ID NO: 71930 - DNA, 25 bp, Artificial Sequence
  Synthetic
ctctttgttuagcttgaacaugcga

SEQ ID NO: 71931 - DNA, 20 bp, Artificial Sequence
  Synthetic
ctcaugaaggcgctcucgaa

SEQ ID NO: 71932 - DNA, 23 bp, Artificial Sequence
  Synthetic
tcctgtatgacauggatgccuct

SEQ ID NO: 71933 - DNA, 23 bp, Artificial Sequence
  Synthetic
gttagagucttccugcccaacaa

SEQ ID NO: 71934 - DNA, 23 bp, Artificial Sequence
  Synthetic
tgagaaacugccatgcguaagat

SEQ ID NO: 71935 - DNA, 23 bp, Artificial Sequence
  Synthetic
ggcttctcuttctttccaugcag

SEQ ID NO: 71936 - DNA, 22 bp, Artificial Sequence
  Synthetic
aaagtcggagcaugcttcucaa

SEQ ID NO: 71937 - DNA, 25 bp, Artificial Sequence
  Synthetic
cagccauagaaaugagcaaaaccag

SEQ ID NO: 71938 - DNA, 20 bp, Artificial Sequence
  Synthetic
gcgtgaaauccgagtcctuc

SEQ ID NO: 71939 - DNA, 28 bp, Artificial Sequence
  Synthetic
ttgaaacatgcacuacgatgtacacuat

SEQ ID NO: 71940 - DNA, 21 bp, Artificial Sequence
  Synthetic
ggcagcugtgactctugagac

SEQ ID NO: 71941 - DNA, 25 bp, Artificial Sequence
  Synthetic
aggtccucagcccttagctattuaa

SEQ ID NO: 71942 - DNA, 21 bp, Artificial Sequence
  Synthetic
tgactcaccacugtcctcugt

SEQ ID NO: 71943 - DNA, 27 bp, Artificial Sequence
  Synthetic
catcttcttccucttctagccttucag

SEQ ID NO: 71944 - DNA, 22 bp, Artificial Sequence
  Synthetic
tcccutaagugccaagaggaac

SEQ ID NO: 71945 - DNA, 23 bp, Artificial Sequence
  Synthetic
aaacctggcugtgcaucaaaaat

SEQ ID NO: 71946 - DNA, 22 bp, Artificial Sequence
  Synthetic
acatuccagaagcggaatucca

SEQ ID NO: 71947 - DNA, 27 bp, Artificial Sequence
  Synthetic
gagcacaagutcaaatagcaaucagat

SEQ ID NO: 71948 - DNA, 23 bp, Artificial Sequence
  Synthetic
tttttgauggcagcattcgaugg

SEQ ID NO: 71949 - DNA, 27 bp, Artificial Sequence
  Synthetic
acagcggtugacatctaatattugaca

SEQ ID NO: 71950 - DNA, 21 bp, Artificial Sequence
  Synthetic
gcggagauaactgggtgtgut

SEQ ID NO: 71951 - DNA, 22 bp, Artificial Sequence
  Synthetic
ccctcucaggacagaggauact

SEQ ID NO: 71952 - DNA, 17 bp, Artificial Sequence
  Synthetic
gggtgugcgctcaccuc

SEQ ID NO: 71953 - DNA, 17 bp, Artificial Sequence
  Synthetic
aucccacagcgcaucca

SEQ ID NO: 71954 - DNA, 28 bp, Artificial Sequence
  Synthetic
tgaaaaacugaaagagatgaagguagca

SEQ ID NO: 71955 - DNA, 25 bp, Artificial Sequence
  Synthetic
gaugcacuccaacaaagagaacaac

SEQ ID NO: 71956 - DNA, 19 bp, Artificial Sequence
  Synthetic
tggtgatgcugacgtggut

SEQ ID NO: 71957 - DNA, 20 bp, Artificial Sequence
  Synthetic
catgtcucccaacccctcuc

SEQ ID NO: 71958 - DNA, 18 bp, Artificial Sequence
  Synthetic
ggagaggcugcccugaga

SEQ ID NO: 71959 - DNA, 18 bp, Artificial Sequence
  Synthetic
gccacugcgctttgctut

SEQ ID NO: 71960 - DNA, 20 bp, Artificial Sequence
  Synthetic
gctctatggucacgcccauc

SEQ ID NO: 71961 - DNA, 21 bp, Artificial Sequence
  Synthetic
ggaggtugggaacggtttcuc

SEQ ID NO: 71962 - DNA, 22 bp, Artificial Sequence
  Synthetic
gagatgagcuccaaaggcagut

SEQ ID NO: 71963 - DNA, 29 bp, Artificial Sequence
  Synthetic
tgctgagtagttuggatttcttttagcut

SEQ ID NO: 71964 - DNA, 24 bp, Artificial Sequence
  Synthetic
cgttccccagagautccaauaact

SEQ ID NO: 71965 - DNA, 25 bp, Artificial Sequence
  Synthetic
ttaatgtcaggacaaaguccggaut

SEQ ID NO: 71966 - DNA, 27 bp, Artificial Sequence
  Synthetic
gcagaaacagautgaagagauggagaa

SEQ ID NO: 71967 - DNA, 21 bp, Artificial Sequence
  Synthetic
gggtugggaggacttuaacct

SEQ ID NO: 71968 - DNA, 22 bp, Artificial Sequence
  Synthetic
ccagaucaggcaacuggagaaa

SEQ ID NO: 71969 - DNA, 20 bp, Artificial Sequence
  Synthetic
ccccgaucagaggtgcaaug

SEQ ID NO: 71970 - DNA, 28 bp, Artificial Sequence
  Synthetic
gagtataactacgauctgccaaactuga

SEQ ID NO: 71971 - DNA, 25 bp, Artificial Sequence
  Synthetic
tcaccatggacuatttctgcttugt

SEQ ID NO: 71972 - DNA, 29 bp, Artificial Sequence
  Synthetic
gagcttttaaguggtagccatagtaugat

SEQ ID NO: 71973 - DNA, 21 bp, Artificial Sequence
  Synthetic
gcttctgtugcttgggacugt

SEQ ID NO: 71974 - DNA, 27 bp, Artificial Sequence
  Synthetic
accttttgacaauagtggagatgcuac

SEQ ID NO: 71975 - DNA, 28 bp, Artificial Sequence
  Synthetic
tgttttaagagacagcuggcagaatuat

SEQ ID NO: 71976 - DNA, 19 bp, Artificial Sequence
  Synthetic
gcaagcgcagcaucccaua

SEQ ID NO: 71977 - DNA, 20 bp, Artificial Sequence
  Synthetic
gagcucaggaaagtguccga

SEQ ID NO: 71978 - DNA, 21 bp, Artificial Sequence
  Synthetic
ccgcaaagaggucctaaggut

SEQ ID NO: 71979 - DNA, 20 bp, Artificial Sequence
  Synthetic
tgtaaccggcacaugcucag

SEQ ID NO: 71980 - DNA, 26 bp, Artificial Sequence
  Synthetic
tugtgatggaattugaagaccacaga

SEQ ID NO: 71981 - DNA, 25 bp, Artificial Sequence
  Synthetic
gcttcatcaauaacaaaacgugcca

SEQ ID NO: 71982 - DNA, 19 bp, Artificial Sequence
  Synthetic
ctggccugctctgcattut

SEQ ID NO: 71983 - DNA, 24 bp, Artificial Sequence
  Synthetic
cctugttgaatctatucggcgaga

SEQ ID NO: 71984 - DNA, 28 bp, Artificial Sequence
  Synthetic
tttcagcacttcauctgtaatcttcugt

SEQ ID NO: 71985 - DNA, 27 bp, Artificial Sequence
  Synthetic
caagtagaaaaagggcuggaaaatugt

SEQ ID NO: 71986 - DNA, 20 bp, Artificial Sequence
  Synthetic
ggtgactuggatcccgauct

SEQ ID NO: 71987 - DNA, 25 bp, Artificial Sequence
  Synthetic
gggacaucctggtttttauagagca

SEQ ID NO: 71988 - DNA, 28 bp, Artificial Sequence
  Synthetic
ccttttgggtttucctgtaagtagtcua

SEQ ID NO: 71989 - DNA, 26 bp, Artificial Sequence
  Synthetic
acctgtgugagaaaatcatagcugag

SEQ ID NO: 71990 - DNA, 27 bp, Artificial Sequence
  Synthetic
ttgcacgtagaugatcaaaatgtcuct

SEQ ID NO: 71991 - DNA, 28 bp, Artificial Sequence
  Synthetic
tgccaactaatagucacgtatgtgatut

SEQ ID NO: 71992 - DNA, 26 bp, Artificial Sequence
  Synthetic
ggagaatctctaugagaggaagcuct

SEQ ID NO: 71993 - DNA, 22 bp, Artificial Sequence
  Synthetic
tcgttcacucagtgtgggttut

SEQ ID NO: 71994 - DNA, 20 bp, Artificial Sequence
  Synthetic
cgccacacugcttcctttug

SEQ ID NO: 71995 - DNA, 21 bp, Artificial Sequence
  Synthetic
cgaagaagacgagggucugga

SEQ ID NO: 71996 - DNA, 28 bp, Artificial Sequence
  Synthetic
acaggagaatauggaaatctggtgacua

SEQ ID NO: 71997 - DNA, 25 bp, Artificial Sequence
  Synthetic
cactaaaacuctaagggcuaagcca

SEQ ID NO: 71998 - DNA, 21 bp, Artificial Sequence
  Synthetic
catttugaccgccttgcauct

SEQ ID NO: 71999 - DNA, 28 bp, Artificial Sequence
  Synthetic
tctctttgtctuctgcatttactucaca

SEQ ID NO: 72000 - DNA, 23 bp, Artificial Sequence
  Synthetic
tgagctuggcagggttgatauag

SEQ ID NO: 72001 - DNA, 28 bp, Artificial Sequence
  Synthetic
ccagtgagacugctttattaagcttgut

SEQ ID NO: 72002 - DNA, 20 bp, Artificial Sequence
  Synthetic
aggccactuggctcctcuat

SEQ ID NO: 72003 - DNA, 21 bp, Artificial Sequence
  Synthetic
ccgccuaagcccatctctauc

SEQ ID NO: 72004 - DNA, 22 bp, Artificial Sequence
  Synthetic
gctcugaagacagaaccugaca

SEQ ID NO: 72005 - DNA, 26 bp, Artificial Sequence
  Synthetic
acttacauccaaggaagtcagcttut

SEQ ID NO: 72006 - DNA, 28 bp, Artificial Sequence
  Synthetic
cttatcgtagaucaagtccaaaagcuga

SEQ ID NO: 72007 - DNA, 28 bp, Artificial Sequence
  Synthetic
actgcaaatttaacugctgtgctttaut

SEQ ID NO: 72008 - DNA, 18 bp, Artificial Sequence
  Synthetic
cacucaccctugcaccga

SEQ ID NO: 72009 - DNA, 20 bp, Artificial Sequence
  Synthetic
ggcgctgugacttacaugga

SEQ ID NO: 72010 - DNA, 24 bp, Artificial Sequence
  Synthetic
cagtttgtuccccctgttauaccc

SEQ ID NO: 72011 - DNA, 28 bp, Artificial Sequence
  Synthetic
gcaaagtgggaagaauttcatctccuaa

SEQ ID NO: 72012 - DNA, 32 bp, Artificial Sequence
  Synthetic
ataatgcctatacautttgttggttttacaut

SEQ ID NO: 72013 - DNA, 24 bp, Artificial Sequence
  Synthetic
cttctgaatggucttctccaggut

SEQ ID NO: 72014 - DNA, 24 bp, Artificial Sequence
  Synthetic
ccautttgaaccuggagaagacca

SEQ ID NO: 72015 - DNA, 28 bp, Artificial Sequence
  Synthetic
gctaggatttttcuctgaactgtctgut

SEQ ID NO: 72016 - DNA, 25 bp, Artificial Sequence
  Synthetic
gactttggctgucaactttcgaaut

SEQ ID NO: 72017 - DNA, 19 bp, Artificial Sequence
  Synthetic
gggtttuggctccttucgg

SEQ ID NO: 72018 - DNA, 29 bp, Artificial Sequence
  Synthetic
ctgcaaattuatatccatcauccgaaagg

SEQ ID NO: 72019 - DNA, 28 bp, Artificial Sequence
  Synthetic
accagagaaauccagaggaaagtcauat

SEQ ID NO: 72020 - DNA, 29 bp, Artificial Sequence
  Synthetic
ttcttgtgtaagaauccgttttagtucca

SEQ ID NO: 72021 - DNA, 27 bp, Artificial Sequence
  Synthetic
ggatcactcgguaccatgttgtaauat

SEQ ID NO: 72022 - DNA, 24 bp, Artificial Sequence
  Synthetic
ccgtggaaaugggctttaguagaa

SEQ ID NO: 72023 - DNA, 27 bp, Artificial Sequence
  Synthetic
acttgattcttttucctcagttgcuct

SEQ ID NO: 72024 - DNA, 25 bp, Artificial Sequence
  Synthetic
cagttctttcugtgggtatugagca

SEQ ID NO: 72025 - DNA, 26 bp, Artificial Sequence
  Synthetic
ttctcaaggcugtcaaatacaacuca

SEQ ID NO: 72026 - DNA, 24 bp, Artificial Sequence
  Synthetic
gatcguggaagaataccaatugcc

SEQ ID NO: 72027 - DNA, 25 bp, Artificial Sequence
  Synthetic
gtggcattuacgaatcacttctuca

SEQ ID NO: 72028 - DNA, 28 bp, Artificial Sequence
  Synthetic
ctaccatgtgacuggcttatttgtauga

SEQ ID NO: 72029 - DNA, 27 bp, Artificial Sequence
  Synthetic
cctctgctguaaatacaaagcttucaa

SEQ ID NO: 72030 - DNA, 22 bp, Artificial Sequence
  Synthetic
gccctcctugagaagtgagtua

SEQ ID NO: 72031 - DNA, 24 bp, Artificial Sequence
  Synthetic
gtcgacacaagguacttcgaugat

SEQ ID NO: 72032 - DNA, 24 bp, Artificial Sequence
  Synthetic
ctctttgacuggaccatgaaucct

SEQ ID NO: 72033 - DNA, 27 bp, Artificial Sequence
  Synthetic
acaggacctucttaaaatactgcucac

SEQ ID NO: 72034 - DNA, 22 bp, Artificial Sequence
  Synthetic
tgatggacugggcggtaaatuc

SEQ ID NO: 72035 - DNA, 20 bp, Artificial Sequence
  Synthetic
cactcgtggugaccttggut

SEQ ID NO: 72036 - DNA, 19 bp, Artificial Sequence
  Synthetic
gcuccacgcaggcaactua

SEQ ID NO: 72037 - DNA, 28 bp, Artificial Sequence
  Synthetic
ccgacgagauagaaattgacttugagac

SEQ ID NO: 72038 - DNA, 19 bp, Artificial Sequence
  Synthetic
cggactugaccgtcauggg

SEQ ID NO: 72039 - DNA, 19 bp, Artificial Sequence
  Synthetic
tcugcggcaagacgtucaa

SEQ ID NO: 72040 - DNA, 22 bp, Artificial Sequence
  Synthetic
cggtggaacagugatgaaguga

SEQ ID NO: 72041 - DNA, 27 bp, Artificial Sequence
  Synthetic
ccagcattcugacattagctucaaaac

SEQ ID NO: 72042 - DNA, 21 bp, Artificial Sequence
  Synthetic
accaccaggutgctcugaaat

SEQ ID NO: 72043 - DNA, 23 bp, Artificial Sequence
  Synthetic
gccctaugcaaaggttacugcaa

SEQ ID NO: 72044 - DNA, 21 bp, Artificial Sequence
  Synthetic
gcctgccacagugttcagtua

SEQ ID NO: 72045 - DNA, 27 bp, Artificial Sequence
  Synthetic
tgtagaattcugtcatccugaagacca

SEQ ID NO: 72046 - DNA, 21 bp, Artificial Sequence
  Synthetic
cgcaaaguggtgggttucaga

SEQ ID NO: 72047 - DNA, 23 bp, Artificial Sequence
  Synthetic
tgcccaugagctacgaugaaaag

SEQ ID NO: 72048 - DNA, 20 bp, Artificial Sequence
  Synthetic
gcttgcuacctggcuggaat

SEQ ID NO: 72049 - DNA, 20 bp, Artificial Sequence
  Synthetic
cctcccgccauggatttcuc

SEQ ID NO: 72050 - DNA, 30 bp, Artificial Sequence; identical to SEQ ID NO: 6362
  Synthetic

SEQ ID NO: 72051 - DNA, 27 bp, Artificial Sequence
  Synthetic
ccctgaacatgugtagaaagcagatut

SEQ ID NO: 72052 - DNA, 21 bp, Artificial Sequence
  Synthetic
ccggttgaugtccaggcuaag

SEQ ID NO: 72053 - DNA, 22 bp, Artificial Sequence
  Synthetic
gcagguagacggagacucaaca

SEQ ID NO: 72054 - DNA, 29 bp, Artificial Sequence
  Synthetic
gtcagactgtacutccatacttgatucat

SEQ ID NO: 72055 - DNA, 20 bp, Artificial Sequence
  Synthetic
ggttgtggaucggctcgtut

SEQ ID NO: 72056 - DNA, 22 bp, Artificial Sequence
  Synthetic
ccagctgtcutcgacacttcuc

SEQ ID NO: 72057 - DNA, 27 bp, Artificial Sequence
  Synthetic
atcctgtaaagugcttttagtgggaut

SEQ ID NO: 72058 - DNA, 19 bp, Artificial Sequence
  Synthetic
cttuagaggcgccccaguc

SEQ ID NO: 72059 - DNA, 20 bp, Artificial Sequence
  Synthetic
gggaguggcctttctttucc

SEQ ID NO: 72060 - DNA, 23 bp, Artificial Sequence
  Synthetic
ctgccagctcuctaagtctccua

SEQ ID NO: 72061 - DNA, 21 bp, Artificial Sequence
  Synthetic
ccaccaccgagacaucactug

SEQ ID NO: 72062 - DNA, 22 bp, Artificial Sequence
  Synthetic
ccttttgtggcuagaggaguct

SEQ ID NO: 72063 - DNA, 22 bp, Artificial Sequence
  Synthetic
catcagtgaccugaaggaggug

SEQ ID NO: 72064 - DNA, 25 bp, Artificial Sequence
  Synthetic
gtgtggtguagattttgcaugaaca

SEQ ID NO: 72065 - DNA, 32 bp, Artificial Sequence; identical to SEQ ID NO: 68769
  Synthetic

SEQ ID NO: 72066 - DNA, 27 bp, Artificial Sequence
  Synthetic
aactcatcaacuggacaggtttcauag

SEQ ID NO: 72067 - DNA, 22 bp, Artificial Sequence
  Synthetic
agaccacaggcagcugaauaag

SEQ ID NO: 72068 - DNA, 18 bp, Artificial Sequence
  Synthetic
gcgagggutctccgggua

SEQ ID NO: 72069 - DNA, 18 bp, Artificial Sequence
  Synthetic
cggatccgcucgaagtug

SEQ ID NO: 72070 - DNA, 17 bp, Artificial Sequence
  Synthetic
cccccaggcgcuctaug

SEQ ID NO: 72071 - DNA, 25 bp, Artificial Sequence
  Synthetic
cctctccaugggattcatatugcag

SEQ ID NO: 72072 - DNA, 19 bp, Artificial Sequence
  Synthetic
gagggtuctccggguaagg

SEQ ID NO: 72073 - DNA, 17 bp, Artificial Sequence
  Synthetic
ccauggccctugcggat

SEQ ID NO: 72074 - DNA, 20 bp, Artificial Sequence
  Synthetic
cgctcagguccaactucgag

SEQ ID NO: 72075 - DNA, 23 bp, Artificial Sequence
  Synthetic
cacctctttgucgttgacctuca

SEQ ID NO: 72076 - DNA, 23 bp, Artificial Sequence
  Synthetic
ccttctacgugaacgtcgagtut

SEQ ID NO: 72077 - DNA, 17 bp, Artificial Sequence
  Synthetic
gaugcaucccccacgct

SEQ ID NO: 72078 - DNA, 22 bp, Artificial Sequence
  Synthetic
gtcacgtgcaguttcacttcug

SEQ ID NO: 72079 - DNA, 21 bp, Artificial Sequence
  Synthetic
cutgcaatgcauggagaaggt

SEQ ID NO: 72080 - DNA, 23 bp, Artificial Sequence
  Synthetic
ccgaatgagggugatgttttucc

SEQ ID NO: 72081 - DNA, 21 bp, Artificial Sequence
  Synthetic
agagcccugagtacaagcuga

SEQ ID NO: 72082 - DNA, 24 bp, Artificial Sequence
  Synthetic
aattctggtuctggctcuaggaga

SEQ ID NO: 72083 - DNA, 20 bp, Artificial Sequence
  Synthetic
ggagcaggucaacctcaugt

SEQ ID NO: 72084 - DNA, 21 bp, Artificial Sequence
  Synthetic
augcagauggagcgcaaaaag

SEQ ID NO: 72085 - DNA, 18 bp, Artificial Sequence
  Synthetic
ccatuggcgtcgaucagg

SEQ ID NO: 72086 - DNA, 19 bp, Artificial Sequence
  Synthetic
ttcagctgccugtggtcug

SEQ ID NO: 72087 - DNA, 28 bp, Artificial Sequence
  Synthetic
caaagaaccacucacctgttgaattuaa

SEQ ID NO: 72088 - DNA, 20 bp, Artificial Sequence
  Synthetic
tgcatgugaacggtgcugat

SEQ ID NO: 72089 - DNA, 24 bp, Artificial Sequence
  Synthetic
cctgatgaguctcctaagcugaag

SEQ ID NO: 72090 - DNA, 22 bp, Artificial Sequence
  Synthetic
ggttgtagucggtcatgauggt

SEQ ID NO: 72091 - DNA, 20 bp, Artificial Sequence
  Synthetic
tggcctgugtagtgctucaa

SEQ ID NO: 72092 - DNA, 25 bp, Artificial Sequence
  Synthetic
acagaaauttauggcacccaaggaa

SEQ ID NO: 72093 - DNA, 20 bp, Artificial Sequence
  Synthetic
ggcaaagaaccacucaccug

SEQ ID NO: 72094 - DNA, 19 bp, Artificial Sequence
  Synthetic
cccgcutccugaaggacaa

SEQ ID NO: 72095 - DNA, 19 bp, Artificial Sequence
  Synthetic
aggtaaggcgcutctccug

SEQ ID NO: 72096 - DNA, 25 bp, Artificial Sequence
  Synthetic
acacttcgagagutcttccaaaguc

SEQ ID NO: 72097 - DNA, 28 bp, Artificial Sequence
  Synthetic
aggcaaagugacatatgtaagcauacaa

SEQ ID NO: 72098 - DNA, 23 bp, Artificial Sequence
  Synthetic
ctgggccutgctgttaaatucaa

SEQ ID NO: 72099 - DNA, 31 bp, Artificial Sequence; identical to SEQ ID NO: 69947
  Synthetic

SEQ ID NO: 72100 - DNA, 24 bp, Artificial Sequence
  Synthetic
accttuccagagagaacttccuga

SEQ ID NO: 72101 - DNA, 19 bp, Artificial Sequence
  Synthetic
gccaccccuggtactgaug

SEQ ID NO: 72102 - DNA, 31 bp, Artificial Sequence
  Synthetic
ttttattttctttcuaggactctcagcaugt

SEQ ID NO: 72103 - DNA, 24 bp, Artificial Sequence
  Synthetic
tcaacauaggaaggcctcatcuct

SEQ ID NO: 72104 - DNA, 19 bp, Artificial Sequence
  Synthetic
cgcuggttuccgaagacga

SEQ ID NO: 72105 - DNA, 21 bp, Artificial Sequence
  Synthetic
gcggacacugtgtucagaact

SEQ ID NO: 72106 - DNA, 24 bp, Artificial Sequence
  Synthetic
aaggcaaagcautaggtactuggt

SEQ ID NO: 72107 - DNA, 28 bp, Artificial Sequence
  Synthetic
tccatcttgucaaaagttgtcugaagaa

SEQ ID NO: 72108 - DNA, 26 bp, Artificial Sequence
  Synthetic
aaatgttcctucaagtctgtgcctua

SEQ ID NO: 72109 - DNA, 24 bp, Artificial Sequence
  Synthetic
tgccagatucttggtaguaaccct

SEQ ID NO: 72110 - DNA, 28 bp, Artificial Sequence
  Synthetic
tcttgaagugaacaccaccaaaaagaua

SEQ ID NO: 72111 - DNA, 24 bp, Artificial Sequence
  Synthetic
ccttgagautctgguggacagaga

SEQ ID NO: 72112 - DNA, 20 bp, Artificial Sequence
  Synthetic
gcaccaguccagtatuggct

SEQ ID NO: 72113 - DNA, 28 bp, Artificial Sequence
  Synthetic
tccttcctaacaguttaccaaagtugaa

SEQ ID NO: 72114 - DNA, 27 bp, Artificial Sequence
  Synthetic
cctgttctttcugtctcattagtggut

SEQ ID NO: 72115 - DNA, 26 bp, Artificial Sequence
  Synthetic
gagaagguggaacaaaatccgtauca

SEQ ID NO: 72116 - DNA, 28 bp, Artificial Sequence
  Synthetic
gcttcttcttccucttcaaaatgcctua

SEQ ID NO: 72117 - DNA, 30 bp, Artificial Sequence
  Synthetic
tgaggctttcacutgaatgtaaaataatug

SEQ ID NO: 72118 - DNA, 22 bp, Artificial Sequence
  Synthetic
ggcattcucagacacagacuga

SEQ ID NO: 72119 - DNA, 23 bp, Artificial Sequence
  Synthetic
cccagcaguactcagatgaugag

SEQ ID NO: 72120 - DNA, 24 bp, Artificial Sequence
  Synthetic
gttttgaagcuagggauggaggaa

SEQ ID NO: 72121 - DNA, 21 bp, Artificial Sequence
  Synthetic
gctctcucaggaccttgctug

SEQ ID NO: 72122 - DNA, 25 bp, Artificial Sequence
  Synthetic
catgcatctcuccctaaatctgugg

SEQ ID NO: 72123 - DNA, 23 bp, Artificial Sequence
  Synthetic
tctctacaauggagcccagctua

SEQ ID NO: 72124 - DNA, 28 bp, Artificial Sequence
  Synthetic
cagagtcaacaaaccaauttaacagcua

SEQ ID NO: 72125 - DNA, 22 bp, Artificial Sequence
  Synthetic
tcuatgatcaggugcacccaga

SEQ ID NO: 72126 - DNA, 21 bp, Artificial Sequence
  Synthetic
agttggtgutctgcacgucat

SEQ ID NO: 72127 - DNA, 20 bp, Artificial Sequence
  Synthetic
ccgagcagcacutgtttgua

SEQ ID NO: 72128 - DNA, 26 bp, Artificial Sequence
  Synthetic
tcccaaauctattcctaaucccacct

SEQ ID NO: 72129 - DNA, 23 bp, Artificial Sequence
  Synthetic
aggccctautggacaaattuggt

SEQ ID NO: 72130 - DNA, 26 bp, Artificial Sequence
  Synthetic
caguagcaaagcctatgaugagaact

SEQ ID NO: 72131 - DNA, 24 bp, Artificial Sequence
  Synthetic
gggatagagcgaauacacagacuc

SEQ ID NO: 72132 - DNA, 23 bp, Artificial Sequence
  Synthetic
tggattatgcuccccaccaaaut

SEQ ID NO: 72133 - DNA, 29 bp, Artificial Sequence
  Synthetic
gcagttactgtgaugtagttgtctatgut

SEQ ID NO: 72134 - DNA, 21 bp, Artificial Sequence
  Synthetic
gctgtcugccaacaccatcuc

SEQ ID NO: 72135 - DNA, 28 bp, Artificial Sequence
  Synthetic
acaaatctgcuaaaacccagagaacuat

SEQ ID NO: 72136 - DNA, 26 bp, Artificial Sequence
  Synthetic
caacattggugtgtaacaaaauccgt

SEQ ID NO: 72137 - DNA, 28 bp, Artificial Sequence
  Synthetic
gatgagatacacaguctacctgguaaga

SEQ ID NO: 72138 - DNA, 20 bp, Artificial Sequence
  Synthetic
agatgtguaagcgcagccut

SEQ ID NO: 72139 - DNA, 27 bp, Artificial Sequence
  Synthetic
acagaaaagcugcactttaggauaaca

SEQ ID NO: 72140 - DNA, 26 bp, Artificial Sequence
  Synthetic
gcctuaggaagaacttucccaaagag

SEQ ID NO: 72141 - DNA, 21 bp, Artificial Sequence
  Synthetic
cctccttcugccatggaacug

SEQ ID NO: 72142 - DNA, 21 bp, Artificial Sequence
  Synthetic
aggttcctcugtgcaaagcuc

SEQ ID NO: 72143 - DNA, 24 bp, Artificial Sequence
  Synthetic
gagaaatggagaaucagccccaua

SEQ ID NO: 72144 - DNA, 24 bp, Artificial Sequence
  Synthetic
tgctcacgaaguttatccacauca

SEQ ID NO: 72145 - DNA, 23 bp, Artificial Sequence
  Synthetic
auttgatctuggaggcagcagat

SEQ ID NO: 72146 - DNA, 27 bp, Artificial Sequence
  Synthetic
aattgtcacgaaacaaugagctttuca

SEQ ID NO: 72147 - DNA, 28 bp, Artificial Sequence
  Synthetic
tgctaaggttacuccattttctgactut

SEQ ID NO: 72148 - DNA, 24 bp, Artificial Sequence
  Synthetic
gaugaaatcagacuccgaccagaa

SEQ ID NO: 72149 - DNA, 28 bp, Artificial Sequence
  Synthetic
cctaactctuaagaagggctgcauaaaa

SEQ ID NO: 72150 - DNA, 26 bp, Artificial Sequence
  Synthetic
gaagttacccgugagttcgtattuct

SEQ ID NO: 72151 - DNA, 21 bp, Artificial Sequence
  Synthetic
cagcctcutggaagaugccaa

SEQ ID NO: 72152 - DNA, 23 bp, Artificial Sequence
  Synthetic
acaccagtgccuctatccctuaa

SEQ ID NO: 72153 - DNA, 19 bp, Artificial Sequence
  Synthetic
ctuggcgccacccagaaua

SEQ ID NO: 72154 - DNA, 17 bp, Artificial Sequence
  Synthetic
autctggguggcgccaa

SEQ ID NO: 72155 - DNA, 28 bp, Artificial Sequence
  Synthetic
aaagattugatggtaacaugaggacagt

SEQ ID NO: 72156 - DNA, 27 bp, Artificial Sequence
  Synthetic
cucacatgagacaauaaacagaaagcc

SEQ ID NO: 72157 - DNA, 22 bp, Artificial Sequence
  Synthetic
gcatgtggccugaagtgtctua

SEQ ID NO: 72158 - DNA, 21 bp, Artificial Sequence
  Synthetic
gagcccccugaactgtgtuat

SEQ ID NO: 72159 - DNA, 20 bp, Artificial Sequence
  Synthetic
agtgactccuccacgacuga

SEQ ID NO: 72160 - DNA, 20 bp, Artificial Sequence
  Synthetic
cagacuccccagucaaccag

SEQ ID NO: 72161 - DNA, 25 bp, Artificial Sequence
  Synthetic
caaggagttcccaugcacttatcut

SEQ ID NO: 72162 - DNA, 23 bp, Artificial Sequence
  Synthetic
ctatccctggugaagcatgtcuc

SEQ ID NO: 72163 - DNA, 28 bp, Artificial Sequence
  Synthetic
ttttaagttactgaucggccatttcuca

SEQ ID NO: 72164 - DNA, 21 bp, Artificial Sequence
  Synthetic
gactaccccuttgccagtcut

SEQ ID NO: 72165 - DNA, 21 bp, Artificial Sequence
  Synthetic
acttttucgccacgccattug

SEQ ID NO: 72166 - DNA, 18 bp, Artificial Sequence
  Synthetic
gcugaccgccactuccat

SEQ ID NO: 72167 - DNA, 18 bp, Artificial Sequence
  Synthetic
ggacucacgtgtguccct

SEQ ID NO: 72168 - DNA, 23 bp, Artificial Sequence
  Synthetic
ccaccccuagaatctgcctauct

SEQ ID NO: 72169 - DNA, 28 bp, Artificial Sequence
  Synthetic
gatgatacgtccgugattgatgatgaua

SEQ ID NO: 72170 - DNA, 21 bp, Artificial Sequence
  Synthetic
aggaggagggugttgagtgut

SEQ ID NO: 72171 - DNA, 25 bp, Artificial Sequence
  Synthetic
catcttcaaccuggagaaggaugac

SEQ ID NO: 72172 - DNA, 27 bp, Artificial Sequence
  Synthetic
ttcatggtacaucactgacaatgcaua

SEQ ID NO: 72173 - DNA, 23 bp, Artificial Sequence
  Synthetic
gatttctccuggctgtctcugaa

SEQ ID NO: 72174 - DNA, 21 bp, Artificial Sequence
  Synthetic
acagcaggcacuagggacuaa

SEQ ID NO: 72175 - DNA, 24 bp, Artificial Sequence
  Synthetic
ggctaggctcuacctcttcctuac

SEQ ID NO: 72176 - DNA, 21 bp, Artificial Sequence
  Synthetic
cccaaccaggauguacagcat

SEQ ID NO: 72177 - DNA, 22 bp, Artificial Sequence
  Synthetic
aacgttctutgtcccatugcag

SEQ ID NO: 72178 - DNA, 20 bp, Artificial Sequence
  Synthetic
gggccaaacugagcagaguc

SEQ ID NO: 72179 - DNA, 27 bp, Artificial Sequence
  Synthetic
ggcattctcugctctctctctaauact

SEQ ID NO: 72180 - DNA, 23 bp, Artificial Sequence
  Synthetic
gguaaaggccgatauggagaagt

SEQ ID NO: 72181 - DNA, 26 bp, Artificial Sequence
  Synthetic
aaattgactgaaucagtgtguaccca

SEQ ID NO: 72182 - DNA, 22 bp, Artificial Sequence
  Synthetic
tgcaguaaaaggcccacatgut

SEQ ID NO: 72183 - DNA, 25 bp, Artificial Sequence
  Synthetic
gtcgagacaucttgactgatgtugt

SEQ ID NO: 72184 - DNA, 27 bp, Artificial Sequence
  Synthetic
ggtaaaauaaacaccaagacgtgguaa

SEQ ID NO: 72185 - DNA, 27 bp, Artificial Sequence
  Synthetic
caccagaagtcaucagaatgcaagaua

SEQ ID NO: 72186 - DNA, 26 bp, Artificial Sequence
  Synthetic
gtgggcaaagaacaugttatucacaa

SEQ ID NO: 72187 - DNA, 22 bp, Artificial Sequence
  Synthetic
cttctccccuttggctgatcug

SEQ ID NO: 72188 - DNA, 28 bp, Artificial Sequence
  Synthetic
acatctgacugaaagctgtatggattut

SEQ ID NO: 72189 - DNA, 29 bp, Artificial Sequence
  Synthetic
gcattgctcuaggaattatagtaggtugt

SEQ ID NO: 72190 - DNA, 22 bp, Artificial Sequence
  Synthetic
tcccgtactuggtgagggttua

SEQ ID NO: 72191 - DNA, 25 bp, Artificial Sequence
  Synthetic
ggtgtgugagaagaacaucaagagg

SEQ ID NO: 72192 - DNA, 22 bp, Artificial Sequence
  Synthetic
gtggatagacgacauggaggut

SEQ ID NO: 72193 - DNA, 27 bp, Artificial Sequence
  Synthetic
atcatacagcaggaugttgatggtauc

SEQ ID NO: 72194 - DNA, 19 bp, Artificial Sequence
  Synthetic
tctgggagcccuaccugaa

SEQ ID NO: 72195 - DNA, 18 bp, Artificial Sequence
  Synthetic
cugaccaaagccgctgug

SEQ ID NO: 72196 - DNA, 20 bp, Artificial Sequence
  Synthetic
gggaagucgtcctggtucat

SEQ ID NO: 72197 - DNA, 18 bp, Artificial Sequence
  Synthetic
ccgugctctucacaccca

SEQ ID NO: 72198 - DNA, 23 bp, Artificial Sequence
  Synthetic
gcaccatgacugacgtattugct

SEQ ID NO: 72199 - DNA, 24 bp, Artificial Sequence
  Synthetic
gccttgctucatattccaatugcc

SEQ ID NO: 72200 - DNA, 18 bp, Artificial Sequence
  Synthetic
ctcugcaccagcgtctug

SEQ ID NO: 72201 - DNA, 17 bp, Artificial Sequence
  Synthetic
tcugaccgccacccuct

SEQ ID NO: 72202 - DNA, 24 bp, Artificial Sequence
  Synthetic
ccutcctgcttucaaacaacacaa

SEQ ID NO: 72203 - DNA, 29 bp, Artificial Sequence
  Synthetic
aactcatcaaaaauggagaaagguacact

SEQ ID NO: 72204 - DNA, 26 bp, Artificial Sequence
  Synthetic
tcaccgaccaugaaataattuccagt

SEQ ID NO: 72205 - DNA, 25 bp, Artificial Sequence
  Synthetic
ggtgaagacagucattguagaacca

SEQ ID NO: 72206 - DNA, 27 bp, Artificial Sequence
  Synthetic
cutacaaacagataugaccagaaggca

SEQ ID NO: 72207 - DNA, 28 bp, Artificial Sequence
  Synthetic
gctcttcgcugttttatcactuagaaac

SEQ ID NO: 72208 - DNA, 21 bp, Artificial Sequence
  Synthetic
gcagagagcacaugggcatua

SEQ ID NO: 72209 - DNA, 25 bp, Artificial Sequence
  Synthetic
agaagaucccaaaccctctcaauct

SEQ ID NO: 72210 - DNA, 28 bp, Artificial Sequence
  Synthetic
ttgtatttgatugcgtcataguacacct

SEQ ID NO: 72211 - DNA, 22 bp, Artificial Sequence
  Synthetic
gaacgttggcuctctactggut

SEQ ID NO: 72212 - DNA, 20 bp, Artificial Sequence
  Synthetic
gctcacggcucacaacaaug

SEQ ID NO: 72213 - DNA, 26 bp, Artificial Sequence
  Synthetic
ggactaacaggautttggcctcttut

SEQ ID NO: 72214 - DNA, 22 bp, Artificial Sequence
  Synthetic
cugggcugaacagacagaagat

SEQ ID NO: 72215 - DNA, 29 bp, Artificial Sequence
  Synthetic
ggcacgtttaatuctagttactctctcut

SEQ ID NO: 72216 - DNA, 22 bp, Artificial Sequence
  Synthetic
ctguagatctgguggcaaagga

SEQ ID NO: 72217 - DNA, 23 bp, Artificial Sequence
  Synthetic
cauccagaaggagaauccagcac

SEQ ID NO: 72218 - DNA, 21 bp, Artificial Sequence
  Synthetic
agcgcatgcuttttcctgaug

SEQ ID NO: 72219 - DNA, 23 bp, Artificial Sequence
  Synthetic
cttacctaggcuttgggatuggg

SEQ ID NO: 72220 - DNA, 23 bp, Artificial Sequence
  Synthetic
agaaacaggautgctgcttcuca

SEQ ID NO: 72221 - DNA, 26 bp, Artificial Sequence
  Synthetic
ctagggacaatuctggtttagctuct

SEQ ID NO: 72222 - DNA, 23 bp, Artificial Sequence
  Synthetic
accgaaaacacuttggagctgua

SEQ ID NO: 72223 - DNA, 27 bp, Artificial Sequence
  Synthetic
tcaaaccacgcugtgtcattuaaaaat

SEQ ID NO: 72224 - DNA, 20 bp, Artificial Sequence
  Synthetic
gggccaauacaggccaugat

SEQ ID NO: 72225 - DNA, 19 bp, Artificial Sequence
  Synthetic
ggtggucgggtcctauggt

SEQ ID NO: 72226 - DNA, 26 bp, Artificial Sequence
  Synthetic
ttcuagaacaggcaaatucagagaag

SEQ ID NO: 72227 - DNA, 21 bp, Artificial Sequence
  Synthetic
tuttccagauggagccacgaa

SEQ ID NO: 72228 - DNA, 27 bp, Artificial Sequence
  Synthetic
tcatctgaatttgauctggagaggtug

SEQ ID NO: 72229 - DNA, 27 bp, Artificial Sequence
  Synthetic
tttaacaagucacaagatggacaguga

SEQ ID NO: 72230 - DNA, 28 bp, Artificial Sequence
  Synthetic
ctgttcctcaguttgtcactaaaatcuc

SEQ ID NO: 72231 - DNA, 31 bp, Artificial Sequence; identical to SEQ ID NO: 59127
  Synthetic

SEQ ID NO: 72232 - DNA, 28 bp, Artificial Sequence
  Synthetic
tgtttagcucagacttttctucagagac

SEQ ID NO: 72233 - DNA, 22 bp, Artificial Sequence
  Synthetic
agcctcugccctttucaaagat

SEQ ID NO: 72234 - DNA, 23 bp, Artificial Sequence
  Synthetic
catctaccttguagggctcacug

SEQ ID NO: 72235 - DNA, 24 bp, Artificial Sequence
  Synthetic
tttgtgtgtguggttgttctcuct

SEQ ID NO: 72236 - DNA, 32 bp, Artificial Sequence; identical to SEQ ID NO: 58964
  Synthetic

SEQ ID NO: 72237 - DNA, 27 bp, Artificial Sequence
  Synthetic
gcccaccagaagaaugataaaaugagt

SEQ ID NO: 72238 - DNA, 26 bp, Artificial Sequence
  Synthetic
ggttactttaggugcagaaaagacug

SEQ ID NO: 72239 - DNA, 27 bp, Artificial Sequence
  Synthetic
attccaggcaggutttctcatattcut

SEQ ID NO: 72240 - DNA, 33 bp, Artificial Sequence
  Synthetic
tttcctttgatagguttgatatgtgactaauaa

SEQ ID NO: 72241 - DNA, 25 bp, Artificial Sequence
  Synthetic
tctgagtcagucttatcacctguca

SEQ ID NO: 72242 - DNA, 23 bp, Artificial Sequence
  Synthetic
agtgaugaagctgcaguacacac

SEQ ID NO: 72243 - DNA, 27 bp, Artificial Sequence
  Synthetic
gttgcactuaagccataatgacgttua

SEQ ID NO: 72244 - DNA, 24 bp, Artificial Sequence
  Synthetic
ccaccttctaugaactcccaguct

SEQ ID NO: 72245 - DNA, 21 bp, Artificial Sequence
  Synthetic
accaucatgtccuggagggaa

SEQ ID NO: 72246 - DNA, 22 bp, Artificial Sequence
  Synthetic
ggctcctaaaugtcaccacuga

SEQ ID NO: 72247 - DNA, 19 bp, Artificial Sequence
  Synthetic
cttcgugcactcggucaag

SEQ ID NO: 72248 - DNA, 17 bp, Artificial Sequence
  Synthetic
cggcuttcucggccaga

SEQ ID NO: 72249 - DNA, 18 bp, Artificial Sequence
  Synthetic
gccttcggucacctcugt

SEQ ID NO: 72250 - DNA, 18 bp, Artificial Sequence
  Synthetic
gctgucgccatucagcgt

SEQ ID NO: 72251 - DNA, 21 bp, Artificial Sequence
  Synthetic
tgtgtcccaguagggctttuc

SEQ ID NO: 72252 - DNA, 28 bp, Artificial Sequence
  Synthetic
ggaacagagaaaaautgactcuccagaa

SEQ ID NO: 72253 - DNA, 26 bp, Artificial Sequence
  Synthetic
ctgtgatgttuagatgggagatguct

SEQ ID NO: 72254 - DNA, 19 bp, Artificial Sequence
  Synthetic
gtcucccacgaugcaccaa

SEQ ID NO: 72255 - DNA, 20 bp, Artificial Sequence
  Synthetic
gagguggacaggugaagcag

SEQ ID NO: 72256 - DNA, 21 bp, Artificial Sequence
  Synthetic
aacaaguggttguccagcagt

SEQ ID NO: 72257 - DNA, 24 bp, Artificial Sequence
  Synthetic
ggcagagaatguggcatgttgaua

SEQ ID NO: 72258 - DNA, 22 bp, Artificial Sequence
  Synthetic
accccttatccucaccccaaua

SEQ ID NO: 72259 - DNA, 28 bp, Artificial Sequence
  Synthetic
gtgtgtgacccaaacutaatcttttuct

SEQ ID NO: 72260 - DNA, 24 bp, Artificial Sequence
  Synthetic
cctcauatcctcttugcagcaaca

SEQ ID NO: 72261 - DNA, 22 bp, Artificial Sequence
  Synthetic
gcagaugaatacctuggcggaa

SEQ ID NO: 72262 - DNA, 22 bp, Artificial Sequence
  Synthetic
ctgctgcugcttccattaaguc

SEQ ID NO: 72263 - DNA, 23 bp, Artificial Sequence
  Synthetic
ggtgcuttatggttuggagggat

SEQ ID NO: 72264 - DNA, 23 bp, Artificial Sequence
  Synthetic
gggtacagagccautttctgaug

SEQ ID NO: 72265 - DNA, 21 bp, Artificial Sequence
  Synthetic
ttcggcccutccattucagag

SEQ ID NO: 72266 - DNA, 23 bp, Artificial Sequence
  Synthetic
gcttcaagcugttagtgagucca

SEQ ID NO: 72267 - DNA, 25 bp, Artificial Sequence
  Synthetic
gctacaucctatctcttuccagcaa

SEQ ID NO: 72268 - DNA, 22 bp, Artificial Sequence
  Synthetic
ccttgggcuaagaaagccuaca

SEQ ID NO: 72269 - DNA, 23 bp, Artificial Sequence
  Synthetic
ctgaccatuaccagaagtugcca

SEQ ID NO: 72270 - DNA, 21 bp, Artificial Sequence
  Synthetic
ggaagacugcaggaugaggaa

SEQ ID NO: 72271 - DNA, 19 bp, Artificial Sequence
  Synthetic
caccagcugucaccaggag

SEQ ID NO: 72272 - DNA, 27 bp, Artificial Sequence
  Synthetic
ggcactgtccugatagataaagtctut

SEQ ID NO: 72273 - DNA, 26 bp, Artificial Sequence
  Synthetic
tgctctattcccauttttaccgtucc

SEQ ID NO: 72274 - DNA, 20 bp, Artificial Sequence
  Synthetic
gctcgatgcucaaaccccua

SEQ ID NO: 72275 - DNA, 24 bp, Artificial Sequence
  Synthetic
gcuagcucaggaaaagaagaagga

SEQ ID NO: 72276 - DNA, 21 bp, Artificial Sequence
  Synthetic
tgtggtcaugggccaaatcuc

SEQ ID NO: 72277 - DNA, 22 bp, Artificial Sequence
  Synthetic
ctgcagucactgtgagguagac

SEQ ID NO: 72278 - DNA, 23 bp, Artificial Sequence
  Synthetic
gtgatcaccacautaccgtcugt

SEQ ID NO: 72279 - DNA, 18 bp, Artificial Sequence
  Synthetic
gcctccagguccaacgug

SEQ ID NO: 72280 - DNA, 17 bp, Artificial Sequence
  Synthetic
tccggcucctggugaca

SEQ ID NO: 72281 - DNA, 20 bp, Artificial Sequence
  Synthetic
gtcataatugcgggccucca

SEQ ID NO: 72282 - DNA, 17 bp, Artificial Sequence
  Synthetic
cgggcacgutggaccug

SEQ ID NO: 72283 - DNA, 19 bp, Artificial Sequence
  Synthetic
agaggagggcucggugaaa

SEQ ID NO: 72284 - DNA, 20 bp, Artificial Sequence
  Synthetic
ggagacucactcgggaucct

SEQ ID NO: 72285 - DNA, 22 bp, Artificial Sequence
  Synthetic
gggtagaacucgtcagugaaga

SEQ ID NO: 72286 - DNA, 21 bp, Artificial Sequence
  Synthetic
tgacatccugcagacgcttut

SEQ ID NO: 72287 - DNA, 19 bp, Artificial Sequence
  Synthetic
catcgguctgctcugcagt

SEQ ID NO: 72288 - DNA, 24 bp, Artificial Sequence
  Synthetic
gtcaaggagugggagaaaucaaca

SEQ ID NO: 72289 - DNA, 29 bp, Artificial Sequence
  Synthetic
cttctggaaataugcattcaggacuaaga

SEQ ID NO: 72290 - DNA, 27 bp, Artificial Sequence
  Synthetic
agagagtaugttcacgaaucagagaca

SEQ ID NO: 72291 - DNA, 21 bp, Artificial Sequence
  Synthetic
gaucaagtaugaggccaggct

SEQ ID NO: 72292 - DNA, 21 bp, Artificial Sequence
  Synthetic
aaccaggcgggagauauacct

SEQ ID NO: 72293 - DNA, 26 bp, Artificial Sequence
  Synthetic
cattcaaaggcauagagacacuggat

SEQ ID NO: 72294 - DNA, 22 bp, Artificial Sequence
  Synthetic
cagatacttgugcccagcaauc

SEQ ID NO: 72295 - DNA, 27 bp, Artificial Sequence
  Synthetic
tgtagttcggauctgatatgttugcat

SEQ ID NO: 72296 - DNA, 23 bp, Artificial Sequence
  Synthetic
cactgaccaccaguatagtucca

SEQ ID NO: 72297 - DNA, 22 bp, Artificial Sequence
  Synthetic
ccugtgaagaatuggaggcact

SEQ ID NO: 72298 - DNA, 20 bp, Artificial Sequence
  Synthetic
tgacggutcacctucagcac

SEQ ID NO: 72299 - DNA, 21 bp, Artificial Sequence
  Synthetic
tgccaggauatctgccucaac

SEQ ID NO: 72300 - DNA, 23 bp, Artificial Sequence
  Synthetic
ctttcaggguccatgtgacatuc

SEQ ID NO: 72301 - DNA, 24 bp, Artificial Sequence
  Synthetic
cagtgaccaccuggagacatagua

SEQ ID NO: 72302 - DNA, 21 bp, Artificial Sequence
  Synthetic
aaacctccccutcagagucct

SEQ ID NO: 72303 - DNA, 22 bp, Artificial Sequence
  Synthetic
caggtctagcaguctccagcua

SEQ ID NO: 72304 - DNA, 25 bp, Artificial Sequence
  Synthetic
gactagcauaacgaagtgacaccut

SEQ ID NO: 72305 - DNA, 22 bp, Artificial Sequence
  Synthetic
gatcctctcugtggtgaccuct

SEQ ID NO: 72306 - DNA, 26 bp, Artificial Sequence
  Synthetic
gagggugacttagaaaauagcacaga

SEQ ID NO: 72307 - DNA, 26 bp, Artificial Sequence
  Synthetic
catctggcaucaaataaguggagaga

SEQ ID NO: 72308 - DNA, 27 bp, Artificial Sequence
  Synthetic
tggutttaatugggaaaggaagagcat

SEQ ID NO: 72309 - DNA, 24 bp, Artificial Sequence
  Synthetic
cacaaauacaccagcgaggactua

SEQ ID NO: 72310 - DNA, 25 bp, Artificial Sequence
  Synthetic
acaagtgcacauatacccactccua

SEQ ID NO: 72311 - DNA, 28 bp, Artificial Sequence
  Synthetic
cagacttctgtaagutctccaagacaut

SEQ ID NO: 72312 - DNA, 23 bp, Artificial Sequence
  Synthetic
accaaucatgaugccggagaaag

SEQ ID NO: 72313 - DNA, 22 bp, Artificial Sequence
  Synthetic
tgactugggaccaacucaaagg

SEQ ID NO: 72314 - DNA, 17 bp, Artificial Sequence
  Synthetic
ccagcaaucccgccuca

SEQ ID NO: 72315 - DNA, 18 bp, Artificial Sequence
  Synthetic
cugagagcagccguagca

SEQ ID NO: 72316 - DNA, 27 bp, Artificial Sequence
  Synthetic
aggaacaattcugctcattcacuagac

SEQ ID NO: 72317 - DNA, 23 bp, Artificial Sequence
  Synthetic
cttctgggccugtttctctttuc

SEQ ID NO: 72318 - DNA, 23 bp, Artificial Sequence
  Synthetic
accatcuagctgcaucaggagat

SEQ ID NO: 72319 - DNA, 26 bp, Artificial Sequence
  Synthetic
gtcatctgucttagttgtcugagagg

SEQ ID NO: 72320 - DNA, 24 bp, Artificial Sequence
  Synthetic
tgatgacatcucctgtgactcuca

SEQ ID NO: 72321 - DNA, 28 bp, Artificial Sequence
  Synthetic
tgtatacagttccagutaacatctggut

SEQ ID NO: 72322 - DNA, 20 bp, Artificial Sequence
  Synthetic
tgaguccgaagagctcucct

SEQ ID NO: 72323 - DNA, 20 bp, Artificial Sequence
  Synthetic
cgcaggacgugtttgagaug

SEQ ID NO: 72324 - DNA, 22 bp, Artificial Sequence
  Synthetic
tgtcucagagggaagagauggt

SEQ ID NO: 72325 - DNA, 23 bp, Artificial Sequence
  Synthetic
ggcctattaauctgtgccacgua

SEQ ID NO: 72326 - DNA, 24 bp, Artificial Sequence
  Synthetic
cccgaaugcacttacuagaagagg

SEQ ID NO: 72327 - DNA, 22 bp, Artificial Sequence
  Synthetic
ccaggactcauagctccaacug

SEQ ID NO: 72328 - DNA, 21 bp, Artificial Sequence
  Synthetic
catcuggcatctuggcaaacc

SEQ ID NO: 72329 - DNA, 20 bp, Artificial Sequence
  Synthetic
tccuagccccaccttcguaa

SEQ ID NO: 72330 - DNA, 24 bp, Artificial Sequence
  Synthetic
gccagctccutgaaaaagcaguat

SEQ ID NO: 72331 - DNA, 19 bp, Artificial Sequence
  Synthetic
ccgcugaccccatcctuac

SEQ ID NO: 72332 - DNA, 28 bp, Artificial Sequence
  Synthetic
acagctttctaautgctggattatguat

SEQ ID NO: 72333 - DNA, 27 bp, Artificial Sequence
  Synthetic
gtcttccaaatuggtcatctgagaaug

SEQ ID NO: 72334 - DNA, 22 bp, Artificial Sequence
  Synthetic
cattaggucggcuggaagaagt

SEQ ID NO: 72335 - DNA, 28 bp, Artificial Sequence
  Synthetic
ctgactctgtaacautccattaccguaa

SEQ ID NO: 72336 - DNA, 27 bp, Artificial Sequence
  Synthetic
ccattctcagaugaccaattuggaaga

SEQ ID NO: 72337 - DNA, 29 bp, Artificial Sequence
  Synthetic
ggtcactacgutagctcacatttuaaagt

SEQ ID NO: 72338 - DNA, 27 bp, Artificial Sequence
  Synthetic
caagaccaugaataatcaccttucgga

SEQ ID NO: 72339 - DNA, 28 bp, Artificial Sequence
  Synthetic
ccttgccttaaaggutgtacattttcut

SEQ ID NO: 72340 - DNA, 33 bp, Artificial Sequence
  Synthetic
tttctatgatatgcuctatttttcccctauaag

SEQ ID NO: 72341 - DNA, 28 bp, Artificial Sequence
  Synthetic
tcctgcattccgutatattttcacagua

SEQ ID NO: 72342 - DNA, 28 bp, Artificial Sequence
  Synthetic
ggaaaccatcauacaagagaaacucact

SEQ ID NO: 72343 - DNA, 27 bp, Artificial Sequence
  Synthetic
agcaattaucacaagaaacatcugggt

SEQ ID NO: 72344 - DNA, 24 bp, Artificial Sequence
  Synthetic
cgtgcttugagagtgatctgaaut

SEQ ID NO: 72345 - DNA, 23 bp, Artificial Sequence
  Synthetic
gtccagaagaagccauagctuca

SEQ ID NO: 72346 - DNA, 29 bp, Artificial Sequence
  Synthetic
acaaggaagtatugaagatgaagctaugg

SEQ ID NO: 72347 - DNA, 24 bp, Artificial Sequence
  Synthetic
tcgagagaagcugtacttggauct

SEQ ID NO: 72348 - DNA, 22 bp, Artificial Sequence
  Synthetic
ggagugacacctugaacacgaa

SEQ ID NO: 72349 - DNA, 22 bp, Artificial Sequence
  Synthetic
cggaaaaucttugcaggagggt

SEQ ID NO: 72350 - DNA, 28 bp, Artificial Sequence
  Synthetic
tccugatttttguaagaaacacccagat

SEQ ID NO: 72351 - DNA, 28 bp, Artificial Sequence
  Synthetic
gagaccaccttutgcaatctaatttgua

SEQ ID NO: 72352 - DNA, 24 bp, Artificial Sequence
  Synthetic
agggagatgaaugggaactgagua

SEQ ID NO: 72353 - DNA, 24 bp, Artificial Sequence
  Synthetic
ttgagacucagccattcuacacac

SEQ ID NO: 72354 - DNA, 24 bp, Artificial Sequence
  Synthetic
cctggcctugctagttcataauca

SEQ ID NO: 72355 - DNA, 28 bp, Artificial Sequence
  Synthetic
atgguataaggtgtacuagagggaagac

SEQ ID NO: 72356 - DNA, 20 bp, Artificial Sequence
  Synthetic
tgtcccguttgtgacugcaa

SEQ ID NO: 72357 - DNA, 21 bp, Artificial Sequence
  Synthetic
tcatggtgugcctatggcauc

SEQ ID NO: 72358 - DNA, 20 bp, Artificial Sequence
  Synthetic
ccacccccacutcttcaugg

SEQ ID NO: 72359 - DNA, 20 bp, Artificial Sequence
  Synthetic
ctcacgcaggutccctauct

SEQ ID NO: 72360 - DNA, 24 bp, Artificial Sequence
  Synthetic
cctgagtcucccatctgtctaugt

SEQ ID NO: 72361 - DNA, 20 bp, Artificial Sequence
  Synthetic
cacacucctcaauggcaggt

SEQ ID NO: 72362 - DNA, 23 bp, Artificial Sequence
  Synthetic
cagggaaaatcuctccagctgua

SEQ ID NO: 72363 - DNA, 21 bp, Artificial Sequence
  Synthetic
gtcaucgagaggacctuccac

SEQ ID NO: 72364 - DNA, 23 bp, Artificial Sequence
  Synthetic
actgacctcucgtctggagaauc

SEQ ID NO: 72365 - DNA, 19 bp, Artificial Sequence
  Synthetic
gcaggcuagcagggctauc

SEQ ID NO: 72366 - DNA, 23 bp, Artificial Sequence
  Synthetic
tgcctctgugaatatcccuggaa

SEQ ID NO: 72367 - DNA, 24 bp, Artificial Sequence
  Synthetic
gccacagtcutgatagcatcaugg

SEQ ID NO: 72368 - DNA, 20 bp, Artificial Sequence
  Synthetic
gggcatccuttagggtccug

SEQ ID NO: 72369 - DNA, 25 bp, Artificial Sequence
  Synthetic
ttttgccttuagtggtccugaaaat

SEQ ID NO: 72370 - DNA, 18 bp, Artificial Sequence
  Synthetic
ccuggcagcgggtacuaa

SEQ ID NO: 72371 - DNA, 22 bp, Artificial Sequence
  Synthetic
cttccuttgcttcucccagagg

SEQ ID NO: 72372 - DNA, 23 bp, Artificial Sequence
  Synthetic
ccaccaguaccatcactctugac

SEQ ID NO: 72373 - DNA, 25 bp, Artificial Sequence
  Synthetic
gtaaatggatguacgcctaccuact

SEQ ID NO: 72374 - DNA, 20 bp, Artificial Sequence
  Synthetic
cccagtuccaccccgttaua

SEQ ID NO: 72375 - DNA, 26 bp, Artificial Sequence
  Synthetic
cacaacctgccuttctgatttctuac

SEQ ID NO: 72376 - DNA, 26 bp, Artificial Sequence
  Synthetic
acagtgctgacugtgtaatcttgaut

SEQ ID NO: 72377 - DNA, 23 bp, Artificial Sequence
  Synthetic
gtctgcgauactgugaacaccat

SEQ ID NO: 72378 - DNA, 22 bp, Artificial Sequence
  Synthetic
ggcagaaaacccuactcaguca

SEQ ID NO: 72379 - DNA, 24 bp, Artificial Sequence
  Synthetic
ccagaggacaugagttcaatggua

SEQ ID NO: 72380 - DNA, 17 bp, Artificial Sequence
  Synthetic
caggcgguccccatgua

SEQ ID NO: 72381 - DNA, 20 bp, Artificial Sequence
  Synthetic
ccctcccucttctccuccag

SEQ ID NO: 72382 - DNA, 22 bp, Artificial Sequence
  Synthetic
gagaagaguacccctugccaat

SEQ ID NO: 72383 - DNA, 27 bp, Artificial Sequence
  Synthetic
aaagaacacacautgctgtgguaaaaa

SEQ ID NO: 72384 - DNA, 28 bp, Artificial Sequence
  Synthetic
ctcttgatccutcctataccaaaucaca

SEQ ID NO: 72385 - DNA, 24 bp, Artificial Sequence
  Synthetic
actgctctucacatcttcctucag

SEQ ID NO: 72386 - DNA, 22 bp, Artificial Sequence
  Synthetic
cagauatcaacugacccaggca

SEQ ID NO: 72387 - DNA, 25 bp, Artificial Sequence
  Synthetic
ttgtgcatgccautcaaaggattut

SEQ ID NO: 72388 - DNA, 21 bp, Artificial Sequence
  Synthetic
gcacctgucccactctctcut

SEQ ID NO: 72389 - DNA, 22 bp, Artificial Sequence
  Synthetic
ctgaacggcaucaaggcatuac

SEQ ID NO: 72390 - DNA, 26 bp, Artificial Sequence
  Synthetic
gttccttggtucatgtcattgttugt

SEQ ID NO: 72391 - DNA, 29 bp, Artificial Sequence
  Synthetic
tgggctgtagagaaugattgatgtttaut

SEQ ID NO: 72392 - DNA, 31 bp, Artificial Sequence
  Synthetic
aaagtgtaagaattaugccaatgtgtttuga

SEQ ID NO: 72393 - DNA, 26 bp, Artificial Sequence
  Synthetic
gctgggttataaugccatctcttugt

SEQ ID NO: 72394 - DNA, 28 bp, Artificial Sequence
  Synthetic
acaagaattugaagctgccatuaaacaa

SEQ ID NO: 72395 - DNA, 31 bp, Artificial Sequence; identical to SEQ ID NO: 68765
  Synthetic

SEQ ID NO: 72396 - DNA, 25 bp, Artificial Sequence
  Synthetic
ccagcucactgctaattuacaacaa

SEQ ID NO: 72397 - DNA, 33 bp, Artificial Sequence; identical to SEQ ID NO: 53865
  Synthetic

SEQ ID NO: 72398 - DNA, 21 bp, Artificial Sequence
  Synthetic
cagttagggcagutggctcut

SEQ ID NO: 72399 - DNA, 25 bp, Artificial Sequence
  Synthetic
caagctcttatcugagcatcagguc

SEQ ID NO: 72400 - DNA, 23 bp, Artificial Sequence
  Synthetic
ggagcagcacuttcctctgatut

SEQ ID NO: 72401 - DNA, 21 bp, Artificial Sequence
  Synthetic
cttccatgucctcagggctuc

SEQ ID NO: 72402 - DNA, 28 bp, Artificial Sequence
  Synthetic
agcaagaccaautattaaaggugacagt

SEQ ID NO: 72403 - DNA, 27 bp, Artificial Sequence
  Synthetic
acacugatttacctugaacacgagaaa

SEQ ID NO: 72404 - DNA, 22 bp, Artificial Sequence
  Synthetic
ggtccttguctccagaggaugt

SEQ ID NO: 72405 - DNA, 22 bp, Artificial Sequence
  Synthetic
aaccacaaagugccagtcctua

SEQ ID NO: 72406 - DNA, 29 bp, Artificial Sequence
  Synthetic
cagattattgggagccuatttgttcauca

SEQ ID NO: 72407 - DNA, 26 bp, Artificial Sequence
  Synthetic
acagggaugagtugaaagaacagaag

SEQ ID NO: 72408 - DNA, 28 bp, Artificial Sequence
  Synthetic
tgaatctctcuccctaaggaatatugct

SEQ ID NO: 72409 - DNA, 27 bp, Artificial Sequence
  Synthetic
ccaactcactutccatcatctcuagat

SEQ ID NO: 72410 - DNA, 20 bp, Artificial Sequence
  Synthetic
agcacaagacaguccgacuc

SEQ ID NO: 72411 - DNA, 28 bp, Artificial Sequence
  Synthetic
gaguagcaaaucaaaagccacagaaaat

SEQ ID NO: 72412 - DNA, 30 bp, Artificial Sequence
  Synthetic
caacagagttuaacataagcatgaugacat

SEQ ID NO: 72413 - DNA, 27 bp, Artificial Sequence
  Synthetic
tggataaaugaactggaacugggaaaa

SEQ ID NO: 72414 - DNA, 27 bp, Artificial Sequence
  Synthetic
gcctttattttuggaaggagatggtut

SEQ ID NO: 72415 - DNA, 28 bp, Artificial Sequence
  Synthetic
gctgaggatugcatagatacaaagtuga

SEQ ID NO: 72416 - DNA, 29 bp, Artificial Sequence
  Synthetic
tcatcttctgctuctgtttcaaaatcuct

SEQ ID NO: 72417 - DNA, 24 bp, Artificial Sequence
  Synthetic
aatcattctgaacauccgctcugt

SEQ ID NO: 72418 - DNA, 28 bp, Artificial Sequence
  Synthetic
attgctaagugaggtatgtcttttucca

SEQ ID NO: 72419 - DNA, 27 bp, Artificial Sequence
  Synthetic
ttacacaaacatcuggagacacatcut

SEQ ID NO: 72420 - DNA, 21 bp, Artificial Sequence
  Synthetic
tggauccagggcttctucaga

SEQ ID NO: 72421 - DNA, 28 bp, Artificial Sequence
  Synthetic
cccttcactgauaaatgtgaatccucaa

SEQ ID NO: 72422 - DNA, 21 bp, Artificial Sequence
  Synthetic
ggactcuccagctgggacuat

SEQ ID NO: 72423 - DNA, 18 bp, Artificial Sequence
  Synthetic
gaaacgctcucgccccua

SEQ ID NO: 72424 - DNA, 29 bp, Artificial Sequence
  Synthetic
cagttccagttcauttatccaagttgtut

SEQ ID NO: 72425 - DNA, 26 bp, Artificial Sequence
  Synthetic
agaagtagatucagccagagaaguga

SEQ ID NO: 72426 - DNA, 28 bp, Artificial Sequence
  Synthetic
aactttgtatctaugcaatcctcagcut

SEQ ID NO: 72427 - DNA, 28 bp, Artificial Sequence
  Synthetic
tgacctagcugaaactgauagaggaaat

SEQ ID NO: 72428 - DNA, 24 bp, Artificial Sequence
  Synthetic
aatcctcagcuttcacttctcugg

SEQ ID NO: 72429 - DNA, 26 bp, Artificial Sequence
  Synthetic
tgacctagcugaaactgauagaggaa

SEQ ID NO: 72430 - DNA, 28 bp, Artificial Sequence
  Synthetic
cctctatcagttucagctaggtcattut

SEQ ID NO: 72431 - DNA, 25 bp, Artificial Sequence
  Synthetic
tggatccagacautgaattgtcuct

SEQ ID NO: 72432 - DNA, 22 bp, Artificial Sequence
  Synthetic
gtgtgttucagagtgggugaga

SEQ ID NO: 72433 - DNA, 25 bp, Artificial Sequence
  Synthetic
cccaaggguaaagagaagaatggug

SEQ ID NO: 72434 - DNA, 24 bp, Artificial Sequence
  Synthetic
ctctaagcccagcugagatctuac

SEQ ID NO: 72435 - DNA, 26 bp, Artificial Sequence
  Synthetic
tgtcccacuggaaaactggatttaut

SEQ ID NO: 72436 - DNA, 18 bp, Artificial Sequence
  Synthetic
cagtccucactggcgcut

SEQ ID NO: 72437 - DNA, 21 bp, Artificial Sequence
  Synthetic
cacctgcucaagggtctcuac

SEQ ID NO: 72438 - DNA, 24 bp, Artificial Sequence
  Synthetic
cctcagaaagcaucacctcaaaug

SEQ ID NO: 72439 - DNA, 27 bp, Artificial Sequence
  Synthetic
gtgcttaatucaagtcagtggttucaa

SEQ ID NO: 72440 - DNA, 24 bp, Artificial Sequence
  Synthetic
accaccccagaguaagaagcttua

SEQ ID NO: 72441 - DNA, 26 bp, Artificial Sequence
  Synthetic
aacttggtgaucttctcattggtugt

SEQ ID NO: 72442 - DNA, 22 bp, Artificial Sequence
  Synthetic
cattgccaucctatcctgcuct

SEQ ID NO: 72443 - DNA, 24 bp, Artificial Sequence
  Synthetic
gcttcttuacaccacgcttaauca

SEQ ID NO: 72444 - DNA, 20 bp, Artificial Sequence
  Synthetic
aactccagccaucccaaguc

SEQ ID NO: 72445 - DNA, 23 bp, Artificial Sequence
  Synthetic
cacagcucttcctcucagaacac

SEQ ID NO: 72446 - DNA, 26 bp, Artificial Sequence
  Synthetic
atccaaacgaugtgtttactgucaga

SEQ ID NO: 72447 - DNA, 20 bp, Artificial Sequence
  Synthetic
cctgagcucgggtcaucaga

SEQ ID NO: 72448 - DNA, 23 bp, Artificial Sequence
  Synthetic
gaggccaucaaagctcaggtuaa

SEQ ID NO: 72449 - DNA, 20 bp, Artificial Sequence
  Synthetic
gggtacccaugtccttgcug

SEQ ID NO: 72450 - DNA, 22 bp, Artificial Sequence
  Synthetic
gggaggacuagaggcactatuc

SEQ ID NO: 72451 - DNA, 23 bp, Artificial Sequence
  Synthetic
gauccacaagcccaacttucaac

SEQ ID NO: 72452 - DNA, 24 bp, Artificial Sequence
  Synthetic
ctctgtaauggctagauccccaga

SEQ ID NO: 72453 - DNA, 22 bp, Artificial Sequence
  Synthetic
ggccaaugacatgctuccaaaa

SEQ ID NO: 72454 - DNA, 28 bp, Artificial Sequence
  Synthetic
ccttcaatgacuttctagtaacucagca

SEQ ID NO: 72455 - DNA, 21 bp, Artificial Sequence
  Synthetic
gagtgggucccatcagttuga

SEQ ID NO: 72456 - DNA, 27 bp, Artificial Sequence
  Synthetic
tgaccagctaacuctctttgtttgtut

SEQ ID NO: 72457 - DNA, 28 bp, Artificial Sequence
  Synthetic
gcaautatgttagcuaggagcagaaagt

SEQ ID NO: 72458 - DNA, 26 bp, Artificial Sequence
  Synthetic
ttacatgaactcuatgtcgtggcaut

SEQ ID NO: 72459 - DNA, 28 bp, Artificial Sequence
  Synthetic
ccatgataggcucctgaaaactaaaauc

SEQ ID NO: 72460 - DNA, 22 bp, Artificial Sequence
  Synthetic
gcagggauacctggaggaugat

SEQ ID NO: 72461 - DNA, 25 bp, Artificial Sequence
  Synthetic
ctagtttggtuttcctctcctuccc

SEQ ID NO: 72462 - DNA, 25 bp, Artificial Sequence
  Synthetic
ccacaaaatggauccagacaacugt

SEQ ID NO: 72463 - DNA, 28 bp, Artificial Sequence
  Synthetic
gcttgctctgauaggaaaatgagatcua

SEQ ID NO: 72464 - DNA, 19 bp, Artificial Sequence
  Synthetic
caacagggaccuccgucag

SEQ ID NO: 72465 - DNA, 26 bp, Artificial Sequence
  Synthetic
aacaagggucaaggtaatcacaauca

SEQ ID NO: 72466 - DNA, 27 bp, Artificial Sequence
  Synthetic
agatgggctgugaaattttatctugga

SEQ ID NO: 72467 - DNA, 28 bp, Artificial Sequence
  Synthetic
tgctattttgacutcaccttgatucagt

SEQ ID NO: 72468 - DNA, 27 bp, Artificial Sequence
  Synthetic
accttccagaaauccagttcttcuact

SEQ ID NO: 72469 - DNA, 22 bp, Artificial Sequence
  Synthetic
agagguccagaggtttccuacc

SEQ ID NO: 72470 - DNA, 21 bp, Artificial Sequence
  Synthetic
tcccagcutcucaaggacagt

SEQ ID NO: 72471 - DNA, 27 bp, Artificial Sequence
  Synthetic
ttctggccaguatagagagttcuacaa

SEQ ID NO: 72472 - DNA, 25 bp, Artificial Sequence
  Synthetic
atcatctcttugaggtactgcccua

SEQ ID NO: 72473 - DNA, 27 bp, Artificial Sequence
  Synthetic
ttgggtttcaagaucccttatcagtuc

SEQ ID NO: 72474 - DNA, 22 bp, Artificial Sequence
  Synthetic
gcutgagaugggagcaaacagt

SEQ ID NO: 72475 - DNA, 20 bp, Artificial Sequence
  Synthetic
tgaagagccaccugcgaauc

SEQ ID NO: 72476 - DNA, 26 bp, Artificial Sequence
  Synthetic
gaactgauaagggatctugaaaccca

SEQ ID NO: 72477 - DNA, 27 bp, Artificial Sequence
  Synthetic
agcattcatugatgtcttctguccaat

SEQ ID NO: 72478 - DNA, 28 bp, Artificial Sequence
  Synthetic
tgaaaaactucaacaggaatuggcaaat

SEQ ID NO: 72479 - DNA, 26 bp, Artificial Sequence
  Synthetic
ttcttcatuagcggtttctactugct

SEQ ID NO: 72480 - DNA, 28 bp, Artificial Sequence
  Synthetic
tguattaaggacattcucaccaaacacc

SEQ ID NO: 72481 - DNA, 24 bp, Artificial Sequence
  Synthetic
tctttttcccucaggctttctgut

SEQ ID NO: 72482 - DNA, 21 bp, Artificial Sequence
  Synthetic
tcctggcacugtcttcccuaa

SEQ ID NO: 72483 - DNA, 24 bp, Artificial Sequence
  Synthetic
ccctactgctutcctttcctcauc

SEQ ID NO: 72484 - DNA, 22 bp, Artificial Sequence
  Synthetic
actctgcctcucccaactgaua

SEQ ID NO: 72485 - DNA, 25 bp, Artificial Sequence
  Synthetic
caatcaggcaucgtcggaaatatuc

SEQ ID NO: 72486 - DNA, 24 bp, Artificial Sequence
  Synthetic
catggtaagguttctctcctgugt

SEQ ID NO: 72487 - DNA, 21 bp, Artificial Sequence
  Synthetic
ccagaagaccuctcatgccut

SEQ ID NO: 72488 - DNA, 21 bp, Artificial Sequence
  Synthetic
ctgaaaagcuggcctuggaac

SEQ ID NO: 72489 - DNA, 25 bp, Artificial Sequence
  Synthetic
ttccacacttucacgttctctctut

SEQ ID NO: 72490 - DNA, 25 bp, Artificial Sequence
  Synthetic
catcugagcaaagacaaaccugaac

SEQ ID NO: 72491 - DNA, 27 bp, Artificial Sequence
  Synthetic
aagttgtagcaaccutgtttccaaaut

SEQ ID NO: 72492 - DNA, 29 bp, Artificial Sequence
  Synthetic
ttcttgaacttcugaaaccactatcguaa

SEQ ID NO: 72493 - DNA, 24 bp, Artificial Sequence
  Synthetic
caaacatcttggucacgacgauac

SEQ ID NO: 72494 - DNA, 26 bp, Artificial Sequence
  Synthetic
tttaccacagcaaugtgtgttcttug

SEQ ID NO: 72495 - DNA, 21 bp, Artificial Sequence
  Synthetic
ctgtcctugagcatccctugt

SEQ ID NO: 72496 - DNA, 22 bp, Artificial Sequence
  Synthetic
catgacaaatcugcctgctgug

SEQ ID NO: 72497 - DNA, 26 bp, Artificial Sequence
  Synthetic
catgaagccagugagtaccuagaaag

SEQ ID NO: 72498 - DNA, 27 bp, Artificial Sequence
  Synthetic
ttttgaagaaaauggcaaaggtuccat

SEQ ID NO: 72499 - DNA, 28 bp, Artificial Sequence
  Synthetic
gccttgttctugcatgtcttttattugt

SEQ ID NO: 72500 - DNA, 28 bp, Artificial Sequence
  Synthetic
atcagctaacacaggaautattcagcut

SEQ ID NO: 72501 - DNA, 27 bp, Artificial Sequence
  Synthetic
gagcatcctctguaaggactacttcua

SEQ ID NO: 72502 - DNA, 28 bp, Artificial Sequence
  Synthetic
caaaggacttagaacutacccagtgtua

SEQ ID NO: 72503 - DNA, 26 bp, Artificial Sequence
  Synthetic
ctcaagtuggatttgacugacaagag

SEQ ID NO: 72504 - DNA, 28 bp, Artificial Sequence
  Synthetic
gaaaatagtugaagaaaaagtggcugct

SEQ ID NO: 72505 - DNA, 25 bp, Artificial Sequence
  Synthetic
tgaccccaacucatcttctctuagt

SEQ ID NO: 72506 - DNA, 27 bp, Artificial Sequence
  Synthetic
ggtcaaagcaauatggactcugagaac

SEQ ID NO: 72507 - DNA, 28 bp, Artificial Sequence
  Synthetic
gcattcguatccacagauagcaaaagaa

SEQ ID NO: 72508 - DNA, 22 bp, Artificial Sequence
  Synthetic
agggttgcuagagctccttgua

SEQ ID NO: 72509 - DNA, 21 bp, Artificial Sequence
  Synthetic
ggagctggacuagacacctug

SEQ ID NO: 72510 - DNA, 21 bp, Artificial Sequence
  Synthetic
cacugagcatauccagaccca

SEQ ID NO: 72511 - DNA, 21 bp, Artificial Sequence
  Synthetic
tggtctgttguccctggtgua

SEQ ID NO: 72512 - DNA, 27 bp, Artificial Sequence
  Synthetic
ctgttcttttggauagcatgaagctut

SEQ ID NO: 72513 - DNA, 28 bp, Artificial Sequence
  Synthetic
cagauaatttttatggugggacgaggat

SEQ ID NO: 72514 - DNA, 27 bp, Artificial Sequence
  Synthetic
tgttcatagaacguaggtaacatgugg

SEQ ID NO: 72515 - DNA, 25 bp, Artificial Sequence
  Synthetic
aactgtctcaggaguaggaaggaut

SEQ ID NO: 72516 - DNA, 20 bp, Artificial Sequence
  Synthetic
tcccaggugccagtgacuaa

SEQ ID NO: 72517 - DNA, 25 bp, Artificial Sequence
  Synthetic
ggagaataacucctcggttcuaggg

SEQ ID NO: 72518 - DNA, 28 bp, Artificial Sequence
  Synthetic
cagttcaggaauatgcaaaattctguca

SEQ ID NO: 72519 - DNA, 28 bp, Artificial Sequence
  Synthetic
gcatttcaacaaccuggctttctaatuc

SEQ ID NO: 72520 - DNA, 28 bp, Artificial Sequence
  Synthetic
gggtcagatataucagcattaacctuga

SEQ ID NO: 72521 - DNA, 29 bp, Artificial Sequence
  Synthetic
tctgtagttcuagcagcttcttttcttut

SEQ ID NO: 72522 - DNA, 24 bp, Artificial Sequence
  Synthetic
ttttaggcuacagatugcaaccca

SEQ ID NO: 72523 - DNA, 26 bp, Artificial Sequence
  Synthetic
cttccgtaaggcaucgtaacacauat

SEQ ID NO: 72524 - DNA, 22 bp, Artificial Sequence
  Synthetic
ggaagcaugugacaacagcaga

SEQ ID NO: 72525 - DNA, 22 bp, Artificial Sequence
  Synthetic
tctccttgauggcctcugaact

SEQ ID NO: 72526 - DNA, 28 bp, Artificial Sequence
  Synthetic
caggttgttgaaaugcatactagttuga

SEQ ID NO: 72527 - DNA, 24 bp, Artificial Sequence
  Synthetic
aacttcaacaucttgagggctuct

SEQ ID NO: 72528 - DNA, 20 bp, Artificial Sequence
  Synthetic
gctccggaautgccgttuag

SEQ ID NO: 72529 - DNA, 21 bp, Artificial Sequence
  Synthetic
tgtctgaaugtctccccuggt

SEQ ID NO: 72530 - DNA, 22 bp, Artificial Sequence
  Synthetic
ctactggaucctgggaggtuca

SEQ ID NO: 72531 - DNA, 24 bp, Artificial Sequence
  Synthetic
cactattctcugaagctggctugt

SEQ ID NO: 72532 - DNA, 24 bp, Artificial Sequence
  Synthetic
actauctcagcttcuaccccaaca

SEQ ID NO: 72533 - DNA, 28 bp, Artificial Sequence
  Synthetic
aatctgacttttgugagctttctaggut

SEQ ID NO: 72534 - DNA, 22 bp, Artificial Sequence
  Synthetic
gugttgctttugaacagggcaa

SEQ ID NO: 72535 - DNA, 22 bp, Artificial Sequence
  Synthetic
cccagcccaugtaatttugaca

SEQ ID NO: 72536 - DNA, 23 bp, Artificial Sequence
  Synthetic
aggagauagcctttucaggcaag

SEQ ID NO: 72537 - DNA, 25 bp, Artificial Sequence
  Synthetic
cutatctgagcaguccaccacaaat

SEQ ID NO: 72538 - DNA, 22 bp, Artificial Sequence
  Synthetic
tgtcccttcuctgtcctccaut

SEQ ID NO: 72539 - DNA, 21 bp, Artificial Sequence
  Synthetic
cauggcgatgucagcagaaag

SEQ ID NO: 72540 - DNA, 24 bp, Artificial Sequence
  Synthetic
gcattgtgucaagacaagagguca

SEQ ID NO: 72541 - DNA, 27 bp, Artificial Sequence
  Synthetic
ctaaactacccugaattatggcuccaa

SEQ ID NO: 72542 - DNA, 21 bp, Artificial Sequence
  Synthetic
cttgaccgaggauggagcuaa

SEQ ID NO: 72543 - DNA, 21 bp, Artificial Sequence
  Synthetic
gtccagaaggguacacagugg

SEQ ID NO: 72544 - DNA, 18 bp, Artificial Sequence
  Synthetic
gccccagcagaacucuca

SEQ ID NO: 72545 - DNA, 17 bp, Artificial Sequence
  Synthetic
ccggagugccacctcuc

SEQ ID NO: 72546 - DNA, 17 bp, Artificial Sequence
  Synthetic
cgcctccucgtcgtcut

SEQ ID NO: 72547 - DNA, 17 bp, Artificial Sequence
  Synthetic
ggguagccctgguagcc

SEQ ID NO: 72548 - DNA, 26 bp, Artificial Sequence
  Synthetic
agaagaaugacatgctgttuccaagt

SEQ ID NO: 72549 - DNA, 29 bp, Artificial Sequence
  Synthetic
acatcttcaggttutctgtctaattccut

SEQ ID NO: 72550 - DNA, 20 bp, Artificial Sequence
  Synthetic
ctcaaccaacugctcacguc

SEQ ID NO: 72551 - DNA, 18 bp, Artificial Sequence
  Synthetic
aacacugcgaggccaugt

SEQ ID NO: 72552 - DNA, 17 bp, Artificial Sequence
  Synthetic
gggcuaccagggcuacc

SEQ ID NO: 72553 - DNA, 19 bp, Artificial Sequence
  Synthetic
gcgtgguggctcctttgut

SEQ ID NO: 72554 - DNA, 18 bp, Artificial Sequence
  Synthetic
acatggccucgcagtgut

SEQ ID NO: 72555 - DNA, 18 bp, Artificial Sequence
  Synthetic
ccctccccacucagcugt

SEQ ID NO: 72556 - DNA, 28 bp, Artificial Sequence
  Synthetic
gcttccaguaaagatcguacagaagaat

SEQ ID NO: 72557 - DNA, 21 bp, Artificial Sequence
  Synthetic
agctctgucttgctcucgaag

SEQ ID NO: 72558 - DNA, 28 bp, Artificial Sequence
  Synthetic
ccaaggagaagutgaagaacaaacatut

SEQ ID NO: 72559 - DNA, 30 bp, Artificial Sequence; identical to SEQ ID NO: 55317
  Synthetic

SEQ ID NO: 72560 - DNA, 20 bp, Artificial Sequence
  Synthetic
catgatgugccccauggaac

SEQ ID NO: 72561 - DNA, 21 bp, Artificial Sequence
  Synthetic
gtgttauggacggctggtcut

SEQ ID NO: 72562 - DNA, 27 bp, Artificial Sequence
  Synthetic
agcactttagguagagaagttugcaat

SEQ ID NO: 72563 - DNA, 28 bp, Artificial Sequence
  Synthetic
agcgtaataccaguctttttcctttuct

SEQ ID NO: 72564 - DNA, 28 bp, Artificial Sequence
  Synthetic
ccatatgtcatuttcatttcagcuccct

SEQ ID NO: 72565 - DNA, 24 bp, Artificial Sequence
  Synthetic
tgagaatacucagggcaagacuct

SEQ ID NO: 72566 - DNA, 28 bp, Artificial Sequence
  Synthetic
caaatacaagcugaaaactttggctuac

SEQ ID NO: 72567 - DNA, 27 bp, Artificial Sequence
  Synthetic
gtcagacataaugcatgctgaactuac

SEQ ID NO: 72568 - DNA, 26 bp, Artificial Sequence
  Synthetic
attgcttctugctgatctugacaaag

SEQ ID NO: 72569 - DNA, 29 bp, Artificial Sequence
  Synthetic
tgtactgccaagutacttacatttucagt

SEQ ID NO: 72570 - DNA, 17 bp, Artificial Sequence
  Synthetic
cucgcgagcgcaatucc

SEQ ID NO: 72571 - DNA, 26 bp, Artificial Sequence
  Synthetic
cagaccatgaaugacttcgactauct

SEQ ID NO: 72572 - DNA, 22 bp, Artificial Sequence
  Synthetic
tgtaauttggctcugggcagaa

SEQ ID NO: 72573 - DNA, 29 bp, Artificial Sequence
  Synthetic
gcaggttcauacaatggtgtttatucaaa

SEQ ID NO: 72574 - DNA, 24 bp, Artificial Sequence
  Synthetic
gaagcacaaguattcugggcaaaa

SEQ ID NO: 72575 - DNA, 33 bp, Artificial Sequence; identical to SEQ ID NO: 54021
  Synthetic

SEQ ID NO: 72576 - DNA, 23 bp, Artificial Sequence
  Synthetic
cgaaccccacaguaaggaugaga

SEQ ID NO: 72577 - DNA, 22 bp, Artificial Sequence
  Synthetic
aagtcattgccuggcacaaaug

SEQ ID NO: 72578 - DNA, 20 bp, Artificial Sequence
  Synthetic
gcccacccuaatcctgtgut

SEQ ID NO: 72579 - DNA, 20 bp, Artificial Sequence
  Synthetic
ccagtccautcccagcuacc

SEQ ID NO: 72580 - DNA, 21 bp, Artificial Sequence
  Synthetic
gttccctugccaaggagttug

SEQ ID NO: 72581 - DNA, 28 bp, Artificial Sequence
  Synthetic
acagtgtctttuggttttcctctttcut

SEQ ID NO: 72582 - DNA, 21 bp, Artificial Sequence
  Synthetic
ccagcacccugaagctauagt

SEQ ID NO: 72583 - DNA, 23 bp, Artificial Sequence
  Synthetic
aggagaatacauccccgagtcug

SEQ ID NO: 72584 - DNA, 23 bp, Artificial Sequence
  Synthetic
gtccaataccautcgaagccugt

SEQ ID NO: 72585 - DNA, 20 bp, Artificial Sequence
  Synthetic
ctcaccccutggtcctgtuc

SEQ ID NO: 72586 - DNA, 22 bp, Artificial Sequence
  Synthetic
agcagtgguggatttgugaagt

SEQ ID NO: 72587 - DNA, 20 bp, Artificial Sequence
  Synthetic
gcatgggcugtgtaggtguc

SEQ ID NO: 72588 - DNA, 25 bp, Artificial Sequence
  Synthetic
cctttcagugagttttctgagugct

SEQ ID NO: 72589 - DNA, 27 bp, Artificial Sequence
  Synthetic
acctcaagcaaagutttaaggcaatut

SEQ ID NO: 72590 - DNA, 28 bp, Artificial Sequence
  Synthetic
tgatttattctgttutgtttgccaccut

SEQ ID NO: 72591 - DNA, 28 bp, Artificial Sequence
  Synthetic
gctagaaatagtugtattctggctucct

SEQ ID NO: 72592 - DNA, 24 bp, Artificial Sequence
  Synthetic
tcutgcattugaagaaggaagcca

SEQ ID NO: 72593 - DNA, 27 bp, Artificial Sequence
  Synthetic
acatggcatcugtacagtgtctauaac

SEQ ID NO: 72594 - DNA, 27 bp, Artificial Sequence
  Synthetic
aggcaaguataaaggaaauaagcagca

SEQ ID NO: 72595 - DNA, 28 bp, Artificial Sequence
  Synthetic
ctactctctgautatatgcttgctugga

SEQ ID NO: 72596 - DNA, 24 bp, Artificial Sequence
  Synthetic
gctgttgucactattgcataugct

SEQ ID NO: 72597 - DNA, 27 bp, Artificial Sequence
  Synthetic
aaacatggccauaaggacttatctgut

SEQ ID NO: 72598 - DNA, 28 bp, Artificial Sequence
  Synthetic
aacgtggtttgutaaatggtagtttucc

SEQ ID NO: 72599 - DNA, 23 bp, Artificial Sequence
  Synthetic
aggcgatgagugtgagactuagt

SEQ ID NO: 72600 - DNA, 21 bp, Artificial Sequence
  Synthetic
cgaatcucatgcctuccaacc

SEQ ID NO: 72601 - DNA, 20 bp, Artificial Sequence
  Synthetic
gtggcgaagccugatccaua

SEQ ID NO: 72602 - DNA, 19 bp, Artificial Sequence
  Synthetic
aaatctggcuccgcaggut

SEQ ID NO: 72603 - DNA, 27 bp, Artificial Sequence
  Synthetic
tggtaataggugagaaaccctatcgut

SEQ ID NO: 72604 - DNA, 21 bp, Artificial Sequence
  Synthetic
gtgtagccugtagctgggaug

SEQ ID NO: 72605 - DNA, 24 bp, Artificial Sequence
  Synthetic
ttcuacaaccaggaccaugagaag

SEQ ID NO: 72606 - DNA, 23 bp, Artificial Sequence
  Synthetic
aattcgagugtgggtttucaggt

SEQ ID NO: 72607 - DNA, 22 bp, Artificial Sequence
  Synthetic
gaggagcaggcugctuagaaat

SEQ ID NO: 72608 - DNA, 26 bp, Artificial Sequence
  Synthetic
caggcaccacuaacttaugaaaagga

SEQ ID NO: 72609 - DNA, 23 bp, Artificial Sequence
  Synthetic
agatgtuggcgagtguaaccaag

SEQ ID NO: 72610 - DNA, 23 bp, Artificial Sequence
  Synthetic
gcaacaagaguggaaatgugggt

SEQ ID NO: 72611 - DNA, 22 bp, Artificial Sequence
  Synthetic
tggacactugccggaagttuat

SEQ ID NO: 72612 - DNA, 28 bp, Artificial Sequence
  Synthetic
gattaatttgcaggutattgcgagtgut

SEQ ID NO: 72613 - DNA, 28 bp, Artificial Sequence
  Synthetic
aggtaccuttttaacttcuaaagcacat

SEQ ID NO: 72614 - DNA, 23 bp, Artificial Sequence
  Synthetic
cctccaugaggatgagcucaaaa

SEQ ID NO: 72615 - DNA, 19 bp, Artificial Sequence
  Synthetic
cccttgaugccgagtccug

SEQ ID NO: 72616 - DNA, 25 bp, Artificial Sequence
  Synthetic
ggaagtgugaaagcattgauggaat

SEQ ID NO: 72617 - DNA, 32 bp, Artificial Sequence; identical to SEQ ID NO: 59649
  Synthetic

SEQ ID NO: 72618 - DNA, 21 bp, Artificial Sequence
  Synthetic
gccugagcaggttgaugacag

SEQ ID NO: 72619 - DNA, 23 bp, Artificial Sequence
  Synthetic
cctgtagucaggaaggaccacut

SEQ ID NO: 72620 - DNA, 25 bp, Artificial Sequence
  Synthetic
cgaagaagugaaggagttcctuagt

SEQ ID NO: 72621 - DNA, 21 bp, Artificial Sequence
  Synthetic
gcaggagugtgaatggacugg

SEQ ID NO: 72622 - DNA, 26 bp, Artificial Sequence
  Synthetic
tgaccacggaaaautacugaagaaca

SEQ ID NO: 72623 - DNA, 29 bp, Artificial Sequence
  Synthetic
ttttattttgatuttccaggacugcaact

SEQ ID NO: 72624 - DNA, 21 bp, Artificial Sequence
  Synthetic
gtagcaacucacctggcctua

SEQ ID NO: 72625 - DNA, 23 bp, Artificial Sequence
  Synthetic
gagatcaacccugagggattcug

SEQ ID NO: 72626 - DNA, 27 bp, Artificial Sequence
  Synthetic
tttctccagtuggttacatactuggac

SEQ ID NO: 72627 - DNA, 27 bp, Artificial Sequence
  Synthetic
gcaaacaacautccatgaugaccaaat

SEQ ID NO: 72628 - DNA, 28 bp, Artificial Sequence
  Synthetic
cctgtaaacatcugcattttccattugt

SEQ ID NO: 72629 - DNA, 28 bp, Artificial Sequence
  Synthetic
gcatctttttccucttcctttcattuct

SEQ ID NO: 72630 - DNA, 21 bp, Artificial Sequence
  Synthetic
cagtactgauggctgcuggat

SEQ ID NO: 72631 - DNA, 21 bp, Artificial Sequence
  Synthetic
cagtggtguctctgtgctcug

SEQ ID NO: 72632 - DNA, 24 bp, Artificial Sequence
  Synthetic
accctttctcucccagcttcuaat

SEQ ID NO: 72633 - DNA, 27 bp, Artificial Sequence
  Synthetic
cctcatcatcgutcaagttctagugag

SEQ ID NO: 72634 - DNA, 27 bp, Artificial Sequence
  Synthetic
gcattaatacauactttctguggcgaa

SEQ ID NO: 72635 - DNA, 28 bp, Artificial Sequence
  Synthetic
caccttaaactucattttggttctgugt

SEQ ID NO: 72636 - DNA, 19 bp, Artificial Sequence
  Synthetic
aggaccuccaggagagcug

SEQ ID NO: 72637 - DNA, 19 bp, Artificial Sequence
  Synthetic
agcttcccgutggcctaug

SEQ ID NO: 72638 - DNA, 19 bp, Artificial Sequence
  Synthetic
cugaaucccgagaggccaa

SEQ ID NO: 72639 - DNA, 25 bp, Artificial Sequence
  Synthetic
cgctacttccucctcaagaatgaug

SEQ ID NO: 72640 - DNA, 24 bp, Artificial Sequence
  Synthetic
gtgtacatgaaguccaggaggaug

SEQ ID NO: 72641 - DNA, 28 bp, Artificial Sequence
  Synthetic
aagggatcacagautcgatatgtcuact

SEQ ID NO: 72642 - DNA, 21 bp, Artificial Sequence
  Synthetic
tggcggtugttgaacatgtug

SEQ ID NO: 72643 - DNA, 28 bp, Artificial Sequence
  Synthetic
tggagttgtttatucttccttgctguat

SEQ ID NO: 72644 - DNA, 26 bp, Artificial Sequence
  Synthetic
cttcccacuactttgcaaguaaaacc

SEQ ID NO: 72645 - DNA, 28 bp, Artificial Sequence
  Synthetic
tcctttcttcccutgttccctatatuga

SEQ ID NO: 72646 - DNA, 18 bp, Artificial Sequence
  Synthetic
ccttgtcgucccccugga

SEQ ID NO: 72647 - DNA, 21 bp, Artificial Sequence
  Synthetic
tggtgacccuatgctctgugt

SEQ ID NO: 72648 - DNA, 22 bp, Artificial Sequence
  Synthetic
gctcctugtagccaaugaaggt

SEQ ID NO: 72649 - DNA, 20 bp, Artificial Sequence
  Synthetic
gggtcugacgggtagagugt

SEQ ID NO: 72650 - DNA, 21 bp, Artificial Sequence
  Synthetic
catccagcuccttccacacua

SEQ ID NO: 72651 - DNA, 22 bp, Artificial Sequence
  Synthetic
cagcttttggcauggagactug

SEQ ID NO: 72652 - DNA, 20 bp, Artificial Sequence
  Synthetic
acctccgggugtgcagauat

SEQ ID NO: 72653 - DNA, 18 bp, Artificial Sequence
  Synthetic
agaugcccacctccucca

SEQ ID NO: 72654 - DNA, 18 bp, Artificial Sequence
  Synthetic
cgcacuccgcagacacut

SEQ ID NO: 72655 - DNA, 19 bp, Artificial Sequence
  Synthetic
cccatcagugcagctcucc

SEQ ID NO: 72656 - DNA, 26 bp, Artificial Sequence
  Synthetic
tgtgcttaagugaccttacaccatut

SEQ ID NO: 72657 - DNA, 25 bp, Artificial Sequence
  Synthetic
ttccagcttcauaaccatgttccut

SEQ ID NO: 72658 - DNA, 21 bp, Artificial Sequence
  Synthetic
ggctgttgugcccttctctua

SEQ ID NO: 72659 - DNA, 23 bp, Artificial Sequence
  Synthetic
tgcccuaaaggacacagtatugg

SEQ ID NO: 72660 - DNA, 22 bp, Artificial Sequence
  Synthetic
gcagccaagaacugaaccaaug

SEQ ID NO: 72661 - DNA, 21 bp, Artificial Sequence
  Synthetic
gtcagctctucggtcacctut

SEQ ID NO: 72662 - DNA, 18 bp, Artificial Sequence
  Synthetic
gcagcaacgcguaugcac

SEQ ID NO: 72663 - DNA, 21 bp, Artificial Sequence
  Synthetic
gaaccucatgcuggacaagga

SEQ ID NO: 72664 - DNA, 22 bp, Artificial Sequence
  Synthetic
cagcccgaaguctgtgatctua

SEQ ID NO: 72665 - DNA, 20 bp, Artificial Sequence
  Synthetic
actcggagaagaacguggug

SEQ ID NO: 72666 - DNA, 23 bp, Artificial Sequence
  Synthetic
ggttcggcuctagtcaucacaag

SEQ ID NO: 72667 - DNA, 25 bp, Artificial Sequence
  Synthetic
ggaagagtttgcuggttggaatgua

SEQ ID NO: 72668 - DNA, 21 bp, Artificial Sequence
  Synthetic
ccccuagagagcagggugaat

SEQ ID NO: 72669 - DNA, 24 bp, Artificial Sequence
  Synthetic
ccaguaacagcagcaggtattuct

SEQ ID NO: 72670 - DNA, 26 bp, Artificial Sequence
  Synthetic
gtgtttgtgugtaactactgcucaga

SEQ ID NO: 72671 - DNA, 28 bp, Artificial Sequence
  Synthetic
agcaacatcagauaaaatccaagagcut

SEQ ID NO: 72672 - DNA, 28 bp, Artificial Sequence
  Synthetic
gcatagtaagtugtatttgtgtcugcct

SEQ ID NO: 72673 - DNA, 28 bp, Artificial Sequence
  Synthetic
gacaaaggaaaauacgcaccauaaaaca

SEQ ID NO: 72674 - DNA, 28 bp, Artificial Sequence
  Synthetic
gtcaactgacugaagagaagaatgacut

SEQ ID NO: 72675 - DNA, 28 bp, Artificial Sequence
  Synthetic
cagcagaaatgauaagcatgcactaaut

SEQ ID NO: 72676 - DNA, 26 bp, Artificial Sequence
  Synthetic
ttttcgaaaggcuctcattuaccaga

SEQ ID NO: 72677 - DNA, 20 bp, Artificial Sequence
  Synthetic
ccgaccgaaaccuggugaag

SEQ ID NO: 72678 - DNA, 26 bp, Artificial Sequence
  Synthetic
gccaacacaagagaaaauatttgcug

SEQ ID NO: 72679 - DNA, 28 bp, Artificial Sequence
  Synthetic
cttttgaccaaaguactgacttgcttut

SEQ ID NO: 72680 - DNA, 30 bp, Artificial Sequence
  Synthetic
ctagcagttaattugattttccgaagtuga

SEQ ID NO: 72681 - DNA, 27 bp, Artificial Sequence
  Synthetic
caacagaaaugagaagtgcatggaaut

SEQ ID NO: 72682 - DNA, 26 bp, Artificial Sequence
  Synthetic
tttactcacguttttcccatcuagca

SEQ ID NO: 72683 - DNA, 20 bp, Artificial Sequence
  Synthetic
cggaggacggcauatucagg

SEQ ID NO: 72684 - DNA, 22 bp, Artificial Sequence
  Synthetic
gtacaugaagggcagttgggua

SEQ ID NO: 72685 - DNA, 21 bp, Artificial Sequence
  Synthetic
gcuaaccagtugccacaaacc

SEQ ID NO: 72686 - DNA, 21 bp, Artificial Sequence
  Synthetic
gugatcaccaaucgcccaaag

SEQ ID NO: 72687 - DNA, 25 bp, Artificial Sequence
  Synthetic
accagcagagaauagagggagaaut

SEQ ID NO: 72688 - DNA, 28 bp, Artificial Sequence
  Synthetic
ccagcctaaaacutacatacacagaaug

SEQ ID NO: 72689 - DNA, 25 bp, Artificial Sequence
  Synthetic
aagggttgcuccaaaaatctuacct

SEQ ID NO: 72690 - DNA, 26 bp, Artificial Sequence
  Synthetic
tgctggaaagaauagtcatuggaacc

SEQ ID NO: 72691 - DNA, 28 bp, Artificial Sequence
  Synthetic
aaacagtcaagagucatcgaataccaut

SEQ ID NO: 72692 - DNA, 27 bp, Artificial Sequence
  Synthetic
cttggatttcccugtatgatccttcut

SEQ ID NO: 72693 - DNA, 28 bp, Artificial Sequence
  Synthetic
gattccatgtgagguttgataacgttut

SEQ ID NO: 72694 - DNA, 28 bp, Artificial Sequence
  Synthetic
cggccttaaggutaattcttgaaguaca

SEQ ID NO: 72695 - DNA, 24 bp, Artificial Sequence
  Synthetic
tctauaggacccacttcucccaag

SEQ ID NO: 72696 - DNA, 26 bp, Artificial Sequence
  Synthetic
ctatatgtagaggcugttggaagcug

SEQ ID NO: 72697 - DNA, 25 bp, Artificial Sequence
  Synthetic
agcattatgaagguccactgaagut

SEQ ID NO: 72698 - DNA, 27 bp, Artificial Sequence
  Synthetic
gaactgctagcutatgccttcaaaaut

SEQ ID NO: 72699 - DNA, 24 bp, Artificial Sequence
  Synthetic
cctgtctcagguctatgaccuact

SEQ ID NO: 72700 - DNA, 27 bp, Artificial Sequence
  Synthetic
ctgttgtaguggaaatactgtcctuga

SEQ ID NO: 72701 - DNA, 25 bp, Artificial Sequence
  Synthetic
aggaaatggattutggagtcctcug

SEQ ID NO: 72702 - DNA, 26 bp, Artificial Sequence
  Synthetic
ggctgttccautcgatatccttttuc

SEQ ID NO: 72703 - DNA, 26 bp, Artificial Sequence
  Synthetic
atcggagaagaaacacuaagtgctut

SEQ ID NO: 72704 - DNA, 21 bp, Artificial Sequence
  Synthetic
atgatctgcutatctgcugcc

SEQ ID NO: 72705 - DNA, 28 bp, Artificial Sequence
  Synthetic
gcgcttaaattuctcaacttctttcuga

SEQ ID NO: 72706 - DNA, 24 bp, Artificial Sequence
  Synthetic
gauccaaaagaaagcggtucaagt

SEQ ID NO: 72707 - DNA, 21 bp, Artificial Sequence
  Synthetic
gaagaggcgucctuagcagag

SEQ ID NO: 72708 - DNA, 28 bp, Artificial Sequence
  Synthetic
actagaacaugatagagcuacagaacga

SEQ ID NO: 72709 - DNA, 28 bp, Artificial Sequence
  Synthetic
gccgatctagaugtttaattgttucagg

SEQ ID NO: 72710 - DNA, 22 bp, Artificial Sequence
  Synthetic
gccttacccuctgccaggatua

SEQ ID NO: 72711 - DNA, 20 bp, Artificial Sequence
  Synthetic
ccaguggagaaggaggucgt

SEQ ID NO: 72712 - DNA, 20 bp, Artificial Sequence
  Synthetic
cucctagcuccaagccagaa

SEQ ID NO: 72713 - DNA, 23 bp, Artificial Sequence
  Synthetic
gtaggctuagacaactctgcugt

SEQ ID NO: 72714 - DNA, 27 bp, Artificial Sequence
  Synthetic
aactggtgtacutgataggcattugaa

SEQ ID NO: 72715 - DNA, 28 bp, Artificial Sequence
  Synthetic
ccagcattggauctgttgtcatcttaua

SEQ ID NO: 72716 - DNA, 20 bp, Artificial Sequence
  Synthetic
caccatccccgucttctcuc

SEQ ID NO: 72717 - DNA, 24 bp, Artificial Sequence
  Synthetic
aaagtgtccugcactctgatgaut

SEQ ID NO: 72718 - DNA, 23 bp, Artificial Sequence
  Synthetic
gatgauccagatgtuagggcagt

SEQ ID NO: 72719 - DNA, 27 bp, Artificial Sequence
  Synthetic
ggttttgcacaagutaggtttgtttug

SEQ ID NO: 72720 - DNA, 26 bp, Artificial Sequence
  Synthetic
agactggacauagtttctgggagaut

SEQ ID NO: 72721 - DNA, 25 bp, Artificial Sequence
  Synthetic
ccacagcaaacagaacugtttuaga

SEQ ID NO: 72722 - DNA, 22 bp, Artificial Sequence
  Synthetic
agcagagtuagcttgtcaccug

SEQ ID NO: 72723 - DNA, 23 bp, Artificial Sequence
  Synthetic
cctccuccccaaaccagtactua

SEQ ID NO: 72724 - DNA, 25 bp, Artificial Sequence
  Synthetic
tgatgaaaatgcugatgaggctuct

SEQ ID NO: 72725 - DNA, 27 bp, Artificial Sequence
  Synthetic
caaagcactggauctaagagtcctuac

SEQ ID NO: 72726 - DNA, 18 bp, Artificial Sequence
  Synthetic
cacaagagcucccuccct

SEQ ID NO: 72727 - DNA, 17 bp, Artificial Sequence
  Synthetic
ggcggcagccacuaguc

SEQ ID NO: 72728 - DNA, 24 bp, Artificial Sequence
  Synthetic
gcacttcacaacuccttactgcut

SEQ ID NO: 72729 - DNA, 25 bp, Artificial Sequence
  Synthetic
tcaacgtcauctagaggaattugcc

SEQ ID NO: 72730 - DNA, 28 bp, Artificial Sequence
  Synthetic
aagacaaaaugcagaagaaaaagucagg

SEQ ID NO: 72731 - DNA, 25 bp, Artificial Sequence
  Synthetic
agtcctttagcccuactcaggtuaa

SEQ ID NO: 72732 - DNA, 22 bp, Artificial Sequence
  Synthetic
actttgctcutgttccccugac

SEQ ID NO: 72733 - DNA, 21 bp, Artificial Sequence
  Synthetic
agcagctuggtgtctcucaaa

SEQ ID NO: 72734 - DNA, 17 bp, Artificial Sequence
  Synthetic
accccagccutcccugt

SEQ ID NO: 72735 - DNA, 18 bp, Artificial Sequence
  Synthetic
gggccacaucgtcacuca

SEQ ID NO: 72736 - DNA, 21 bp, Artificial Sequence
  Synthetic
ccgcaaagacagacucccaut

SEQ ID NO: 72737 - DNA, 26 bp, Artificial Sequence
  Synthetic
gctgtttatctuctgctttcctcugg

SEQ ID NO: 72738 - DNA, 21 bp, Artificial Sequence
  Synthetic
gcgagtgugtgggaaatcugg

SEQ ID NO: 72739 - DNA, 22 bp, Artificial Sequence
  Synthetic
agatcatgcagcaucgcttcut

SEQ ID NO: 72740 - DNA, 21 bp, Artificial Sequence
  Synthetic
ccttcugaggtctgcugcaaa

SEQ ID NO: 72741 - DNA, 22 bp, Artificial Sequence
  Synthetic
gggacaugccatagguagcaat

SEQ ID NO: 72742 - DNA, 18 bp, Artificial Sequence
  Synthetic
cgtgcugccacacgauac

SEQ ID NO: 72743 - DNA, 21 bp, Artificial Sequence
  Synthetic
ggcccuacaucacaggaggaa

SEQ ID NO: 72744 - DNA, 17 bp, Artificial Sequence
  Synthetic
cgagcgugcgtcctcug

SEQ ID NO: 72745 - DNA, 18 bp, Artificial Sequence
  Synthetic
ccaggcccuctccugact

SEQ ID NO: 72746 - DNA, 23 bp, Artificial Sequence
  Synthetic
cctagaccugctctctcggauac

SEQ ID NO: 72747 - DNA, 21 bp, Artificial Sequence
  Synthetic
agtctccccacacucacctut

SEQ ID NO: 72748 - DNA, 23 bp, Artificial Sequence
  Synthetic
acctgctatgugttcctgttugg

SEQ ID NO: 72749 - DNA, 22 bp, Artificial Sequence
  Synthetic
aatggcagccuctgctuagaaa

SEQ ID NO: 72750 - DNA, 23 bp, Artificial Sequence
  Synthetic
cucaagcaagtuggccaaaaaga

SEQ ID NO: 72751 - DNA, 21 bp, Artificial Sequence
  Synthetic
aggcuacagcgaaucaaagca

SEQ ID NO: 72752 - DNA, 28 bp, Artificial Sequence
  Synthetic
gttctagcaatgcuggatacttacauca

SEQ ID NO: 72753 - DNA, 27 bp, Artificial Sequence
  Synthetic
ccttcaaaauccattccaatuccacag

SEQ ID NO: 72754 - DNA, 18 bp, Artificial Sequence
  Synthetic
gcccggacutgctaucct

SEQ ID NO: 72755 - DNA, 18 bp, Artificial Sequence
  Synthetic
cagctccuccagcgacuc

SEQ ID NO: 72756 - DNA, 26 bp, Artificial Sequence
  Synthetic
gcccaaattgauttcgatgatctuca

SEQ ID NO: 72757 - DNA, 33 bp, Artificial Sequence
  Synthetic
acctttatatcgtuactctgaatcttatctucc

SEQ ID NO: 72758 - DNA, 23 bp, Artificial Sequence
  Synthetic
gtgggtttgugttgtgatgcuat

SEQ ID NO: 72759 - DNA, 20 bp, Artificial Sequence
  Synthetic
gggctguagcatttgauggg

SEQ ID NO: 72760 - DNA, 22 bp, Artificial Sequence
  Synthetic
ttttgccaguaagcaagtggut

SEQ ID NO: 72761 - DNA, 22 bp, Artificial Sequence
  Synthetic
gcattttcatcucctgggcugt

SEQ ID NO: 72762 - DNA, 22 bp, Artificial Sequence
  Synthetic
cctctccauccctccaagcuat

SEQ ID NO: 72763 - DNA, 21 bp, Artificial Sequence
  Synthetic
cugagctgtcuacacccacag

SEQ ID NO: 72764 - DNA, 19 bp, Artificial Sequence
  Synthetic
agatccggagcugctcuct

SEQ ID NO: 72765 - DNA, 23 bp, Artificial Sequence
  Synthetic
gtttgctcacutggctttcctuc

SEQ ID NO: 72766 - DNA, 19 bp, Artificial Sequence
  Synthetic
cgacacacugcgacccuac

SEQ ID NO: 72767 - DNA, 21 bp, Artificial Sequence
  Synthetic
gcttgcugggctgctuaagaa

SEQ ID NO: 72768 - DNA, 22 bp, Artificial Sequence
  Synthetic
gaaggtggcutatccacagcut

SEQ ID NO: 72769 - DNA, 22 bp, Artificial Sequence
  Synthetic
ggatcatgaccucctcaccugt

SEQ ID NO: 72770 - DNA, 21 bp, Artificial Sequence
  Synthetic
cugtggaucaggaacccaagg

SEQ ID NO: 72771 - DNA, 24 bp, Artificial Sequence
  Synthetic
cggtgtgaacacuttcaattgugt

SEQ ID NO: 72772 - DNA, 18 bp, Artificial Sequence
  Synthetic
cagcccucacctctgcut

SEQ ID NO: 72773 - DNA, 17 bp, Artificial Sequence
  Synthetic
gaccacgagcgccucut

SEQ ID NO: 72774 - DNA, 22 bp, Artificial Sequence
  Synthetic
cggatctctuccatgaggauga

SEQ ID NO: 72775 - DNA, 23 bp, Artificial Sequence
  Synthetic
cctcatttcucctccatccucag

SEQ ID NO: 72776 - DNA, 24 bp, Artificial Sequence
  Synthetic
gcatttggaguattgcttugggaa

SEQ ID NO: 72777 - DNA, 21 bp, Artificial Sequence
  Synthetic
aacaggcugaggaaggctuac

SEQ ID NO: 72778 - DNA, 20 bp, Artificial Sequence
  Synthetic
gcacacaccacacucgauga

SEQ ID NO: 72779 - DNA, 23 bp, Artificial Sequence
  Synthetic
agcaagacacagccaucaactua

SEQ ID NO: 72780 - DNA, 26 bp, Artificial Sequence
  Synthetic
tggaggatcagucatccatgaatcua

SEQ ID NO: 72781 - DNA, 25 bp, Artificial Sequence
  Synthetic
caatgaggccucttatacugccaaa

SEQ ID NO: 72782 - DNA, 25 bp, Artificial Sequence
  Synthetic
cttgaagatcgucagtcctttcgua

SEQ ID NO: 72783 - DNA, 21 bp, Artificial Sequence
  Synthetic
acccucaaagaaaaccuggct

SEQ ID NO: 72784 - DNA, 21 bp, Artificial Sequence
  Synthetic
tgggaagtucatctggcacug

SEQ ID NO: 72785 - DNA, 23 bp, Artificial Sequence
  Synthetic
tttctgtcctcuctggcactcua

SEQ ID NO: 72786 - DNA, 21 bp, Artificial Sequence
  Synthetic
gcccagggaaguggtattgua

SEQ ID NO: 72787 - DNA, 21 bp, Artificial Sequence
  Synthetic
gtgaggcugaactggauccaa

SEQ ID NO: 72788 - DNA, 25 bp, Artificial Sequence
  Synthetic
ccttaaaactutgcttgaggugagt

SEQ ID NO: 72789 - DNA, 28 bp, Artificial Sequence
  Synthetic
cccattacatuaagaatggcccatttug

SEQ ID NO: 72790 - DNA, 29 bp, Artificial Sequence
  Synthetic
ggtaatatatgccutttgagctgtctuga

SEQ ID NO: 72791 - DNA, 24 bp, Artificial Sequence
  Synthetic
gcactagaattugctggctcaugt

SEQ ID NO: 72792 - DNA, 26 bp, Artificial Sequence
  Synthetic
atgttccatgaucatcagtccttugt

SEQ ID NO: 72793 - DNA, 28 bp, Artificial Sequence
  Synthetic
tggaatacatctcuctcatgttctcugt

SEQ ID NO: 72794 - DNA, 25 bp, Artificial Sequence
  Synthetic
cttttcccguaggctgatccttaut

SEQ ID NO: 72795 - DNA, 20 bp, Artificial Sequence
  Synthetic
gcagccaacaugcgaactug

SEQ ID NO: 72796 - DNA, 28 bp, Artificial Sequence
  Synthetic
gtcattaaacttuaggagcaagccatug

SEQ ID NO: 72797 - DNA, 26 bp, Artificial Sequence
  Synthetic
agttgggcaataucagtgaagttcut

SEQ ID NO: 72798 - DNA, 25 bp, Artificial Sequence
  Synthetic
ttgtggtggagutattgatgacgut

SEQ ID NO: 72799 - DNA, 28 bp, Artificial Sequence
  Synthetic
agacattgaaggugtcaaccaauaaact

SEQ ID NO: 72800 - DNA, 27 bp, Artificial Sequence
  Synthetic
acacaatttctugctgacaatcaucac

SEQ ID NO: 72801 - DNA, 28 bp, Artificial Sequence
  Synthetic
gcaactgtgagcugttactatguaagac

SEQ ID NO: 72802 - DNA, 26 bp, Artificial Sequence
  Synthetic
agccatggtcuatatatgctgtcuga

SEQ ID NO: 72803 - DNA, 25 bp, Artificial Sequence
  Synthetic
ccacatauggagtgaaacugggaag

SEQ ID NO: 72804 - DNA, 21 bp, Artificial Sequence
  Synthetic
gggcatatuctgcactcaucc

SEQ ID NO: 72805 - DNA, 28 bp, Artificial Sequence
  Synthetic
gttgtttgtagcugtagtgcttgattut

SEQ ID NO: 72806 - DNA, 23 bp, Artificial Sequence
  Synthetic
caaaacgaaaucctccagcauca

SEQ ID NO: 72807 - DNA, 26 bp, Artificial Sequence
  Synthetic
gggtctatgtacautgagattcggut

SEQ ID NO: 72808 - DNA, 28 bp, Artificial Sequence
  Synthetic
ctgaacatcguaagagaagctcuaaaga

SEQ ID NO: 72809 - DNA, 24 bp, Artificial Sequence
  Synthetic
tcatgcuggagccaaatttccuat

SEQ ID NO: 72810 - DNA, 27 bp, Artificial Sequence
  Synthetic
cttaatacatugagcagtgttggctut

SEQ ID NO: 72811 - DNA, 26 bp, Artificial Sequence
  Synthetic
cttctggcgaagcauattcattctut

SEQ ID NO: 72812 - DNA, 20 bp, Artificial Sequence
  Synthetic
gggagugaggatggcuacag

SEQ ID NO: 72813 - DNA, 20 bp, Artificial Sequence
  Synthetic
actgtcaucgaacgcaccut

SEQ ID NO: 72814 - DNA, 17 bp, Artificial Sequence
  Synthetic
cccacguaccgctccuc

SEQ ID NO: 72815 - DNA, 20 bp, Artificial Sequence
  Synthetic
gcagagugccagctgaugaa

SEQ ID NO: 72816 - DNA, 21 bp, Artificial Sequence
  Synthetic
ctgatagctguacccgctgug

SEQ ID NO: 72817 - DNA, 24 bp, Artificial Sequence
  Synthetic
ctgccttugggaagtagaauaggt

SEQ ID NO: 72818 - DNA, 18 bp, Artificial Sequence
  Synthetic
cgguggagggaggtcuca

SEQ ID NO: 72819 - DNA, 19 bp, Artificial Sequence
  Synthetic
cgctgtcuctgctcuccag

SEQ ID NO: 72820 - DNA, 21 bp, Artificial Sequence
  Synthetic
cagcggaugatgaaggtgtug

SEQ ID NO: 72821 - DNA, 20 bp, Artificial Sequence
  Synthetic
cctggugggtggtaugcaag

SEQ ID NO: 72822 - DNA, 21 bp, Artificial Sequence
  Synthetic
gctcaagagugagccactuct

SEQ ID NO: 72823 - DNA, 25 bp, Artificial Sequence
  Synthetic
tgactctgtcucctcttgtcttcuc

SEQ ID NO: 72824 - DNA, 25 bp, Artificial Sequence
  Synthetic
ggtaguaaacacccccaatugagaa

SEQ ID NO: 72825 - DNA, 18 bp, Artificial Sequence
  Synthetic
ttcaccutgcuggccagt

SEQ ID NO: 72826 - DNA, 24 bp, Artificial Sequence
  Synthetic
tgaagtctucatggatgttugcca

SEQ ID NO: 72827 - DNA, 24 bp, Artificial Sequence
  Synthetic
aagtagctacacugcgcgtauaag

SEQ ID NO: 72828 - DNA, 26 bp, Artificial Sequence
  Synthetic
gggacatgatuttcgtcaagatuaca

SEQ ID NO: 72829 - DNA, 25 bp, Artificial Sequence
  Synthetic
aaatacgtgacgugcaacaactuac

SEQ ID NO: 72830 - DNA, 22 bp, Artificial Sequence
  Synthetic
actctctggugctgtccactua

SEQ ID NO: 72831 - DNA, 26 bp, Artificial Sequence
  Synthetic
gaatcacatuagggttctcttuccca

SEQ ID NO: 72832 - DNA, 28 bp, Artificial Sequence
  Synthetic
caagagaatcaaguagagaatccugcaa

SEQ ID NO: 72833 - DNA, 23 bp, Artificial Sequence
  Synthetic
acaaacccaagcuagtggugaag

SEQ ID NO: 72834 - DNA, 25 bp, Artificial Sequence
  Synthetic
gctatttggttugagaagcgatugg

SEQ ID NO: 72835 - DNA, 27 bp, Artificial Sequence
  Synthetic
cctgcaacucagaatgtagaaaaagug

SEQ ID NO: 72836 - DNA, 19 bp, Artificial Sequence
  Synthetic
gaaccccautgaggcugct

SEQ ID NO: 72837 - DNA, 25 bp, Artificial Sequence
  Synthetic
gtgagcttttcutggagatccuact

SEQ ID NO: 72838 - DNA, 28 bp, Artificial Sequence
  Synthetic
ttaggttuagcatgagcttuaacagaca

SEQ ID NO: 72839 - DNA, 24 bp, Artificial Sequence
  Synthetic
agctaatcacauggctgtacucac

SEQ ID NO: 72840 - DNA, 22 bp, Artificial Sequence
  Synthetic
cccactagaaaugcctgcauga

SEQ ID NO: 72841 - DNA, 28 bp, Artificial Sequence
  Synthetic
caatattgtttgttuttatcccgtccut

SEQ ID NO: 72842 - DNA, 27 bp, Artificial Sequence
  Synthetic
tgcaaagtaccuaactccactgattuc

SEQ ID NO: 72843 - DNA, 25 bp, Artificial Sequence
  Synthetic
acagcaaaccagucaaaacactuac

SEQ ID NO: 72844 - DNA, 28 bp, Artificial Sequence
  Synthetic
ttctttctattccutcctctccctuaca

SEQ ID NO: 72845 - DNA, 25 bp, Artificial Sequence
  Synthetic
tctggatguggaaagagacgauagt

SEQ ID NO: 72846 - DNA, 27 bp, Artificial Sequence
  Synthetic
tcaccaacaguaaatccaacagatuct

SEQ ID NO: 72847 - DNA, 28 bp, Artificial Sequence
  Synthetic
actggatattgaauttctgcaaggagut

SEQ ID NO: 72848 - DNA, 24 bp, Artificial Sequence
  Synthetic
tctttaaaucacagccgtcaucac

SEQ ID NO: 72849 - DNA, 24 bp, Artificial Sequence
  Synthetic
aagcaggtttcugtcgtcattgua

SEQ ID NO: 72850 - DNA, 18 bp, Artificial Sequence
  Synthetic
caccttgaggucccggua

SEQ ID NO: 72851 - DNA, 17 bp, Artificial Sequence
  Synthetic
cggctgugcctcaggut

SEQ ID NO: 72852 - DNA, 22 bp, Artificial Sequence
  Synthetic
tgtttugaagggccaggtugaa

SEQ ID NO: 72853 - DNA, 28 bp, Artificial Sequence
  Synthetic
tgcagtcacugtagaatcatuaaaccat

SEQ ID NO: 72854 - DNA, 24 bp, Artificial Sequence
  Synthetic
cgactctgtcucaatgaactccut

SEQ ID NO: 72855 - DNA, 19 bp, Artificial Sequence
  Synthetic
accaaaaccaggcccugug

SEQ ID NO: 72856 - DNA, 17 bp, Artificial Sequence
  Synthetic
cccggcugaggtccuct

SEQ ID NO: 72857 - DNA, 22 bp, Artificial Sequence
  Synthetic
aguaaaggcgugaagcagaagt

SEQ ID NO: 72858 - DNA, 17 bp, Artificial Sequence
  Synthetic
gcctggugggcttctug

SEQ ID NO: 72859 - DNA, 18 bp, Artificial Sequence
  Synthetic
acaaggccccugggagua

SEQ ID NO: 72860 - DNA, 20 bp, Artificial Sequence
  Synthetic
ggacttctgcutcacgccut

SEQ ID NO: 72861 - DNA, 19 bp, Artificial Sequence
  Synthetic
ggaaaguccccgacgttug

SEQ ID NO: 72862 - DNA, 27 bp, Artificial Sequence
  Synthetic
cctttcttuaaaaacaagcagccacua

SEQ ID NO: 72863 - DNA, 27 bp, Artificial Sequence
  Synthetic
tctagctcttgucgaagatttgagtuc

SEQ ID NO: 72864 - DNA, 23 bp, Artificial Sequence
  Synthetic
caagtugaggcactgaagaugga

SEQ ID NO: 72865 - DNA, 28 bp, Artificial Sequence
  Synthetic
cctcaagttuacaagagggaatacugaa

SEQ ID NO: 72866 - DNA, 25 bp, Artificial Sequence
  Synthetic
gctcttgatcuccttctctcucagg

SEQ ID NO: 72867 - DNA, 24 bp, Artificial Sequence
  Synthetic
agttaauccccacaagcctccuat

SEQ ID NO: 72868 - DNA, 26 bp, Artificial Sequence
  Synthetic
tcttttgtggcauctgaaacagttug

SEQ ID NO: 72869 - DNA, 29 bp, Artificial Sequence
  Synthetic
caggacttcaaugtctagtgttcaguaaa

SEQ ID NO: 72870 - DNA, 19 bp, Artificial Sequence
  Synthetic
tgcgcgcuctcgtgatuat

SEQ ID NO: 72871 - DNA, 17 bp, Artificial Sequence
  Synthetic
gugaaccgagccgucgt

SEQ ID NO: 72872 - DNA, 19 bp, Artificial Sequence
  Synthetic
gcagcagaacguggctcut

SEQ ID NO: 72873 - DNA, 21 bp, Artificial Sequence
  Synthetic
caagaccaaccagcugcagua

SEQ ID NO: 72874 - DNA, 22 bp, Artificial Sequence
  Synthetic
tctucaccaccacattcugcat

SEQ ID NO: 72875 - DNA, 23 bp, Artificial Sequence
  Synthetic
tgtgacagaaagugagtgagcug

SEQ ID NO: 72876 - DNA, 19 bp, Artificial Sequence
  Synthetic
gaggccucaaccaagguca

SEQ ID NO: 72877 - DNA, 19 bp, Artificial Sequence
  Synthetic
gcgaugccaaggaggucat

SEQ ID NO: 72878 - DNA, 21 bp, Artificial Sequence
  Synthetic
gctgaggaagaaccugtgcuc

SEQ ID NO: 72879 - DNA, 24 bp, Artificial Sequence
  Synthetic
tggtttgtggucaagacagaauca

SEQ ID NO: 72880 - DNA, 23 bp, Artificial Sequence
  Synthetic
caggtatgcacuccagaaagcua

SEQ ID NO: 72881 - DNA, 25 bp, Artificial Sequence
  Synthetic
ggcagatgacuggcttttacuagat

SEQ ID NO: 72882 - DNA, 19 bp, Artificial Sequence
  Synthetic
ccctggcaggutcatcgut

SEQ ID NO: 72883 - DNA, 22 bp, Artificial Sequence
  Synthetic
actggagcgggagaaugaaaug

SEQ ID NO: 72884 - DNA, 25 bp, Artificial Sequence
  Synthetic
gccatgtcctugggattctagauag

SEQ ID NO: 72885 - DNA, 28 bp, Artificial Sequence
  Synthetic
tugaaatgattgttuccacaacacagaa

SEQ ID NO: 72886 - DNA, 24 bp, Artificial Sequence
  Synthetic
actgauaaaagcaaagccaugcac

SEQ ID NO: 72887 - DNA, 26 bp, Artificial Sequence
  Synthetic
ggtacagttcacaugacaagtcguat

SEQ ID NO: 72888 - DNA, 23 bp, Artificial Sequence
  Synthetic
agctcctgguttttggtctucag

SEQ ID NO: 72889 - DNA, 24 bp, Artificial Sequence
  Synthetic
cggutgaataagauggaggaggaa

SEQ ID NO: 72890 - DNA, 26 bp, Artificial Sequence
  Synthetic
agagactgattuctctccagctuaca

SEQ ID NO: 72891 - DNA, 24 bp, Artificial Sequence
  Synthetic
cgttgcctttuctgagtgtttcut

SEQ ID NO: 72892 - DNA, 25 bp, Artificial Sequence
  Synthetic
gttgatttcagggugagagatgaut

SEQ ID NO: 72893 - DNA, 24 bp, Artificial Sequence
  Synthetic
gacaatatcuccatcagccuggac

SEQ ID NO: 72894 - DNA, 21 bp, Artificial Sequence
  Synthetic
caggtcagcautctctcggut

SEQ ID NO: 72895 - DNA, 21 bp, Artificial Sequence
  Synthetic
cuacagcacccuggagaaaca

SEQ ID NO: 72896 - DNA, 21 bp, Artificial Sequence
  Synthetic
cgccaacacguttgaacugaa

SEQ ID NO: 72897 - DNA, 25 bp, Artificial Sequence
  Synthetic
catttgaccutgtcatucacaccag

SEQ ID NO: 72898 - DNA, 25 bp, Artificial Sequence
  Synthetic
tttaaagaccagcuatgcagctuct

SEQ ID NO: 72899 - DNA, 25 bp, Artificial Sequence
  Synthetic
accctaaggucaacactguaggaaa

SEQ ID NO: 72900 - DNA, 27 bp, Artificial Sequence
  Synthetic
ggcaactaauaggcattcaatacguga

SEQ ID NO: 72901 - DNA, 28 bp, Artificial Sequence
  Synthetic
gcttcatattctuctgcccatgagauat

SEQ ID NO: 72902 - DNA, 19 bp, Artificial Sequence
  Synthetic
ctcgccgugccacttttuc

SEQ ID NO: 72903 - DNA, 19 bp, Artificial Sequence
  Synthetic
agtgcgagcugtgcaacua

SEQ ID NO: 72904 - DNA, 22 bp, Artificial Sequence
  Synthetic
tgaactcacuggtgagguagca

SEQ ID NO: 72905 - DNA, 24 bp, Artificial Sequence
  Synthetic
cctcacacacautcctcttgaugt

SEQ ID NO: 72906 - DNA, 26 bp, Artificial Sequence
  Synthetic
aaacttaaggtuttgatggccuacct

SEQ ID NO: 72907 - DNA, 24 bp, Artificial Sequence
  Synthetic
agtttgtcguggtaaagtgaguga

SEQ ID NO: 72908 - DNA, 22 bp, Artificial Sequence
  Synthetic
ggacugaggagcagagucagaa

SEQ ID NO: 72909 - DNA, 24 bp, Artificial Sequence
  Synthetic
cgtaggtcaugaactcagtgauga

SEQ ID NO: 72910 - DNA, 19 bp, Artificial Sequence
  Synthetic
ccagccacugcgaguacac

SEQ ID NO: 72911 - DNA, 17 bp, Artificial Sequence
  Synthetic
cctuccccgggctctuc

SEQ ID NO: 72912 - DNA, 17 bp, Artificial Sequence
  Synthetic
gccuaggcccacgtuct

SEQ ID NO: 72913 - DNA, 17 bp, Artificial Sequence
  Synthetic
ggcccgagucgagctuc

SEQ ID NO: 72914 - DNA, 18 bp, Artificial Sequence
  Synthetic
cagcuccgagtccaugct

SEQ ID NO: 72915 - DNA, 17 bp, Artificial Sequence
  Synthetic
cggccgacggugactuc

SEQ ID NO: 72916 - DNA, 23 bp, Artificial Sequence
  Synthetic
tggtgtttcacutgctcagtuct

SEQ ID NO: 72917 - DNA, 29 bp, Artificial Sequence
  Synthetic
agagttaagacaagcuccaaagaaagtut

SEQ ID NO: 72918 - DNA, 28 bp, Artificial Sequence
  Synthetic
cctgtagauctttcacattuggaaaagg

SEQ ID NO: 72919 - DNA, 25 bp, Artificial Sequence
  Synthetic
tgttgtttaagauggagctctccug

SEQ ID NO: 72920 - DNA, 28 bp, Artificial Sequence
  Synthetic
cggtatttgccauctttaagactgttuc

SEQ ID NO: 72921 - DNA, 25 bp, Artificial Sequence
  Synthetic
agataccggauaatgactcagugct

SEQ ID NO: 72922 - DNA, 28 bp, Artificial Sequence
  Synthetic
aacaatcaagcuttgaagataguggact

SEQ ID NO: 72923 - DNA, 28 bp, Artificial Sequence
  Synthetic
catatttgctcaggcutgttttacacut

SEQ ID NO: 72924 - DNA, 21 bp, Artificial Sequence
  Synthetic
tgtctucaggctgatgtugcc

SEQ ID NO: 72925 - DNA, 22 bp, Artificial Sequence
  Synthetic
agttcgcacccucaacgtatuc

SEQ ID NO: 72926 - DNA, 27 bp, Artificial Sequence
  Synthetic
ttacauctccatgaguaggaagaaggt

SEQ ID NO: 72927 - DNA, 26 bp, Artificial Sequence
  Synthetic
ccatatuacacagcccgagaacuaat

SEQ ID NO: 72928 - DNA, 25 bp, Artificial Sequence
  Synthetic
ggcaaacaaccagauttgaaaugga

SEQ ID NO: 72929 - DNA, 22 bp, Artificial Sequence
  Synthetic
aactggcutgaactugacggat

SEQ ID NO: 72930 - DNA, 19 bp, Artificial Sequence
  Synthetic
cgggagcccccgutctaua

SEQ ID NO: 72931 - DNA, 23 bp, Artificial Sequence
  Synthetic
cccctaccugtggatgaagttut

SEQ ID NO: 72932 - DNA, 24 bp, Artificial Sequence
  Synthetic
ttgctcgtgcuggtttctatuaca

SEQ ID NO: 72933 - DNA, 27 bp, Artificial Sequence
  Synthetic
gtagcttccaagutgttaacggaatut

SEQ ID NO: 72934 - DNA, 26 bp, Artificial Sequence
  Synthetic
gaatuaaaggacaggagttcauccgt

SEQ ID NO: 72935 - DNA, 28 bp, Artificial Sequence
  Synthetic
ttgtcttttcacucaaatagcactcuct

SEQ ID NO: 72936 - DNA, 28 bp, Artificial Sequence
  Synthetic
gtagggacaaaauatgatgtcagcauct

SEQ ID NO: 72937 - DNA, 26 bp, Artificial Sequence
  Synthetic
gtgatcagcacacautacagacttuc

SEQ ID NO: 72938 - DNA, 25 bp, Artificial Sequence
  Synthetic
cgtauggaagaaaaacccucacaga

SEQ ID NO: 72939 - DNA, 28 bp, Artificial Sequence
  Synthetic
tggttataaattucaccagcgttguagt

SEQ ID NO: 72940 - DNA, 26 bp, Artificial Sequence
  Synthetic
gaagauctgctctaatugaacgggaa

SEQ ID NO: 72941 - DNA, 23 bp, Artificial Sequence
  Synthetic
ggaggtccccgutaaacctttua

SEQ ID NO: 72942 - DNA, 25 bp, Artificial Sequence
  Synthetic
tcccttggaaaguctgtaatgtgug

SEQ ID NO: 72943 - DNA, 27 bp, Artificial Sequence
  Synthetic
cttgtggcttuaatgatgttccucaaa

SEQ ID NO: 72944 - DNA, 22 bp, Artificial Sequence
  Synthetic
gccauggagtaccuggagaaga

SEQ ID NO: 72945 - DNA, 22 bp, Artificial Sequence
  Synthetic
ccagcacugaggttagaagcug

SEQ ID NO: 72946 - DNA, 27 bp, Artificial Sequence
  Synthetic
attaacacacaucagtggaacttcugt

SEQ ID NO: 72947 - DNA, 26 bp, Artificial Sequence
  Synthetic
aaacgttttucaccttagcatttugt

SEQ ID NO: 72948 - DNA, 25 bp, Artificial Sequence
  Synthetic
gcaauccaaaagaauagcagccaaa

SEQ ID NO: 72949 - DNA, 28 bp, Artificial Sequence
  Synthetic
caccatcuccatatcatugagaccaaat

SEQ ID NO: 72950 - DNA, 25 bp, Artificial Sequence
  Synthetic
cagcccacuctagacttttctucat

SEQ ID NO: 72951 - DNA, 22 bp, Artificial Sequence
  Synthetic
cagtggacutctttgcccugaa

SEQ ID NO: 72952 - DNA, 29 bp, Artificial Sequence
  Synthetic
gcagtctgtcgugcaatatctataagtut

SEQ ID NO: 72953 - DNA, 26 bp, Artificial Sequence
  Synthetic
caggaaaacacgacaugtgaataucc

SEQ ID NO: 72954 - DNA, 26 bp, Artificial Sequence
  Synthetic
ctttgtggaauagcccatgaagagua

SEQ ID NO: 72955 - DNA, 27 bp, Artificial Sequence
  Synthetic
cgacagactacuttggttctctttugt

SEQ ID NO: 72956 - DNA, 21 bp, Artificial Sequence
  Synthetic
ccagtgcucctctgtgtcuaa

SEQ ID NO: 72957 - DNA, 23 bp, Artificial Sequence
  Synthetic
tgatctccucattgatgcuggac

SEQ ID NO: 72958 - DNA, 22 bp, Artificial Sequence
  Synthetic
ggccccuttcactcacugaaat

SEQ ID NO: 72959 - DNA, 28 bp, Artificial Sequence
  Synthetic
ggttacataaatuggtccgacaacatuc

SEQ ID NO: 72960 - DNA, 19 bp, Artificial Sequence
  Synthetic
ccagcuacgccggacaaua

SEQ ID NO: 72961 - DNA, 25 bp, Artificial Sequence
  Synthetic
aagatattugagaagcatgcuccga

SEQ ID NO: 72962 - DNA, 24 bp, Artificial Sequence
  Synthetic
ctgtatgccaugacccttaagcua

SEQ ID NO: 72963 - DNA, 21 bp, Artificial Sequence
  Synthetic
agtgggcugaccttuaaccac

SEQ ID NO: 72964 - DNA, 22 bp, Artificial Sequence
  Synthetic
tcacctgagutgtaccttgcug

SEQ ID NO: 72965 - DNA, 25 bp, Artificial Sequence
  Synthetic
tcacccatccautaaagggtcctua

SEQ ID NO: 72966 - DNA, 21 bp, Artificial Sequence
  Synthetic
cctccgcauctcacagaacut

SEQ ID NO: 72967 - DNA, 19 bp, Artificial Sequence
  Synthetic
ctcagcaggauggguggac

SEQ ID NO: 72968 - DNA, 25 bp, Artificial Sequence
  Synthetic
tcactcttggucttatcttgcccua

SEQ ID NO: 72969 - DNA, 28 bp, Artificial Sequence
  Synthetic
tctaccaaagagauaaagggccaauact

SEQ ID NO: 72970 - DNA, 26 bp, Artificial Sequence
  Synthetic
agattcagataccutcactgcagtuc

SEQ ID NO: 72971 - DNA, 26 bp, Artificial Sequence
  Synthetic
ttttctcctcugttttccaaugcaac

SEQ ID NO: 72972 - DNA, 27 bp, Artificial Sequence
  Synthetic
cagattcaacuttcacgtaucaaacca

SEQ ID NO: 72973 - DNA, 17 bp, Artificial Sequence
  Synthetic
ccccucggaccugcaga

SEQ ID NO: 72974 - DNA, 22 bp, Artificial Sequence
  Synthetic
aggacccucgcagacatuaaag

SEQ ID NO: 72975 - DNA, 19 bp, Artificial Sequence
  Synthetic
accaccaucaccactgcug

SEQ ID NO: 72976 - DNA, 19 bp, Artificial Sequence
  Synthetic
cgaugagggagguggcaga

SEQ ID NO: 72977 - DNA, 19 bp, Artificial Sequence
  Synthetic
cctgggtaugctccccaut

SEQ ID NO: 72978 - DNA, 28 bp, Artificial Sequence
  Synthetic
ggcatattuaagaacaggcatctcugat

SEQ ID NO: 72979 - DNA, 30 bp, Artificial Sequence
  Synthetic
tcttaaagactguaagactcatatgucggt

SEQ ID NO: 72980 - DNA, 30 bp, Artificial Sequence
  Synthetic
tttatgaaggagutatgtgtgtguaaaacc

SEQ ID NO: 72981 - DNA, 27 bp, Artificial Sequence
  Synthetic
attgctgttucgaggtcatatgtuact

SEQ ID NO: 72982 - DNA, 23 bp, Artificial Sequence
  Synthetic
aactactgccgccutatcctcua

SEQ ID NO: 72983 - DNA, 21 bp, Artificial Sequence
  Synthetic
tcctagcccauctgtgagucc

SEQ ID NO: 72984 - DNA, 21 bp, Artificial Sequence
  Synthetic
gagccgcagguttcctttcua

SEQ ID NO: 72985 - DNA, 28 bp, Artificial Sequence
  Synthetic
ggtcatcaatctautccatcaggctuaa

SEQ ID NO: 72986 - DNA, 22 bp, Artificial Sequence
  Synthetic
actgcagcaaagacuggttcuc

SEQ ID NO: 72987 - DNA, 22 bp, Artificial Sequence
  Synthetic
gctcugcagcaaatucaaccac

SEQ ID NO: 72988 - DNA, 21 bp, Artificial Sequence
  Synthetic
ctcagcagggcautccagtua

SEQ ID NO: 72989 - DNA, 26 bp, Artificial Sequence
  Synthetic
gctctcagtcutcttctctccuacag

SEQ ID NO: 72990 - DNA, 20 bp, Artificial Sequence
  Synthetic
atccugagcagctugcaagt

SEQ ID NO: 72991 - DNA, 28 bp, Artificial Sequence
  Synthetic
agcatttgacaucatcactgttaccuaa

SEQ ID NO: 72992 - DNA, 23 bp, Artificial Sequence
  Synthetic
ccaaugcagcgaacaatgttcug

SEQ ID NO: 72993 - DNA, 28 bp, Artificial Sequence
  Synthetic
agctgctgaaaaugtaactttgtaucct

SEQ ID NO: 72994 - DNA, 27 bp, Artificial Sequence
  Synthetic
tggattacaggugcttatgaaucaaca

SEQ ID NO: 72995 - DNA, 28 bp, Artificial Sequence
  Synthetic
acggcaatautacgaaatccugaagaat

SEQ ID NO: 72996 - DNA, 28 bp, Artificial Sequence
  Synthetic
ggatttcguaatattgccgucaaagaaa

SEQ ID NO: 72997 - DNA, 26 bp, Artificial Sequence
  Synthetic
ggctttttgugagaacacaggtttua

SEQ ID NO: 72998 - DNA, 25 bp, Artificial Sequence
  Synthetic
gaattacattccucccacaccctut

SEQ ID NO: 72999 - DNA, 23 bp, Artificial Sequence
  Synthetic
caatttctcutttgcctcugcga

SEQ ID NO: 73000 - DNA, 23 bp, Artificial Sequence
  Synthetic
ggatactcuctgtcccucccaaa

SEQ ID NO: 73001 - DNA, 23 bp, Artificial Sequence
  Synthetic
gattccttgucttggtcuccact

SEQ ID NO: 73002 - DNA, 17 bp, Artificial Sequence
  Synthetic
gtcccaccuccguccaa

SEQ ID NO: 73003 - DNA, 17 bp, Artificial Sequence
  Synthetic
gttgccucgggctcucc

SEQ ID NO: 73004 - DNA, 26 bp, Artificial Sequence
  Synthetic
gattgtcttttucctcttgcccttut

SEQ ID NO: 73005 - DNA, 28 bp, Artificial Sequence
  Synthetic
ccattccagcauatcgtcttagtguaat

SEQ ID NO: 73006 - DNA, 26 bp, Artificial Sequence
  Synthetic
cccaattatugaagacagtcgugaag

SEQ ID NO: 73007 - DNA, 28 bp, Artificial Sequence
  Synthetic
ttcactaggcauggatatagtggtaugt

SEQ ID NO: 73008 - DNA, 20 bp, Artificial Sequence
  Synthetic
gccttccutctcccugacaa

SEQ ID NO: 73009 - DNA, 18 bp, Artificial Sequence
  Synthetic
gtcctgcggcuctcaguc

SEQ ID NO: 73010 - DNA, 25 bp, Artificial Sequence
  Synthetic
gacttaagccaagutagggaucacc

SEQ ID NO: 73011 - DNA, 27 bp, Artificial Sequence
  Synthetic
gggatgcaatgcucttactcagtttua

SEQ ID NO: 73012 - DNA, 24 bp, Artificial Sequence
  Synthetic
ttttcacugaagaagcaaacugcc

SEQ ID NO: 73013 - DNA, 28 bp, Artificial Sequence
  Synthetic
acacttctttguccatacacacttuaca

SEQ ID NO: 73014 - DNA, 28 bp, Artificial Sequence
  Synthetic
cagaattatugcaagtggactgugaaat

SEQ ID NO: 73015 - DNA, 25 bp, Artificial Sequence
  Synthetic
aacataccttgutggctacatcucc

SEQ ID NO: 73016 - DNA, 20 bp, Artificial Sequence
  Synthetic
gtggaggcacauctcugcat

SEQ ID NO: 73017 - DNA, 22 bp, Artificial Sequence
  Synthetic
ccaggtgcugaggctgttttua

SEQ ID NO: 73018 - DNA, 27 bp, Artificial Sequence
  Synthetic
aautgcggagacuacaagaagaaagaa

SEQ ID NO: 73019 - DNA, 28 bp, Artificial Sequence
  Synthetic
ctgtaccctugattgtactccuacaaat

SEQ ID NO: 73020 - DNA, 27 bp, Artificial Sequence
  Synthetic
gtagtatgcaaagautgtgctcctuct

SEQ ID NO: 73021 - DNA, 33 bp, Artificial Sequence
  Synthetic
aattaattctaaagttuagacgatgttttggut

SEQ ID NO: 73022 - DNA, 22 bp, Artificial Sequence
  Synthetic
tgcatgttugagccacttccua

SEQ ID NO: 73023 - DNA, 28 bp, Artificial Sequence
  Synthetic
cttcttctgaggaacautcactctguaa

SEQ ID NO: 73024 - DNA, 24 bp, Artificial Sequence
  Synthetic
tgaattcagugggttttctauggg

SEQ ID NO: 73025 - DNA, 27 bp, Artificial Sequence
  Synthetic
tttccagttugtcttcaguaacaccat

SEQ ID NO: 73026 - DNA, 26 bp, Artificial Sequence
  Synthetic
attttgctgugtagtgaatuaaggct

SEQ ID NO: 73027 - DNA, 19 bp, Artificial Sequence
  Synthetic
tcggccaccgutgaaugat

SEQ ID NO: 73028 - DNA, 26 bp, Artificial Sequence
  Synthetic
tgatcctgaggutttgcttcaaatug

SEQ ID NO: 73029 - DNA, 22 bp, Artificial Sequence
  Synthetic
cgcgucgcttcacatuaaacag

SEQ ID NO: 73030 - DNA, 28 bp, Artificial Sequence
  Synthetic
gcaatcagacuccacaaattcttgtuaa

SEQ ID NO: 73031 - DNA, 28 bp, Artificial Sequence
  Synthetic
ctgaaatatgtcuggattccatguccaa

SEQ ID NO: 73032 - DNA, 25 bp, Artificial Sequence
  Synthetic
gcaagaactacaugctgctgaaaut

SEQ ID NO: 73033 - DNA, 23 bp, Artificial Sequence
  Synthetic
cagacactguatcactgcctuca

SEQ ID NO: 73034 - DNA, 21 bp, Artificial Sequence
  Synthetic
cacctgtgcuacctcactugt

SEQ ID NO: 73035 - DNA, 26 bp, Artificial Sequence
  Synthetic
ccatcatagaacuccttgtggatcuc

SEQ ID NO: 73036 - DNA, 20 bp, Artificial Sequence
  Synthetic
cctggccgagutggttcauc

SEQ ID NO: 73037 - DNA, 20 bp, Artificial Sequence
  Synthetic
tgatgtccgugcgttccauc

SEQ ID NO: 73038 - DNA, 27 bp, Artificial Sequence
  Synthetic
agttacugaaagaggaatgtgguacct

SEQ ID NO: 73039 - DNA, 25 bp, Artificial Sequence
  Synthetic
tgagttgcatuttggtttgtcauct

SEQ ID NO: 73040 - DNA, 24 bp, Artificial Sequence
  Synthetic
cttcttcaaagugcctgagctcua

SEQ ID NO: 73041 - DNA, 18 bp, Artificial Sequence
  Synthetic
cggcccugggttacucac

SEQ ID NO: 73042 - DNA, 25 bp, Artificial Sequence
  Synthetic
gggagaaagaagaaauccacctugt

SEQ ID NO: 73043 - DNA, 24 bp, Artificial Sequence
  Synthetic
tctgagtcugaggaactgtcugag

SEQ ID NO: 73044 - DNA, 22 bp, Artificial Sequence
  Synthetic
cucccctcauccagcaagaaaa

SEQ ID NO: 73045 - DNA, 23 bp, Artificial Sequence
  Synthetic
ggcttugaactatgcugaagcag

SEQ ID NO: 73046 - DNA, 22 bp, Artificial Sequence
  Synthetic
agagacucccaaagctgcttut

SEQ ID NO: 73047 - DNA, 19 bp, Artificial Sequence
  Synthetic
ctctgcccauccgacugag

SEQ ID NO: 73048 - DNA, 21 bp, Artificial Sequence
  Synthetic
gtgucccccaacuacgacaag

SEQ ID NO: 73049 - DNA, 22 bp, Artificial Sequence
  Synthetic
cagcctaccutcaaggtctuca

SEQ ID NO: 73050 - DNA, 22 bp, Artificial Sequence
  Synthetic
cutgcccagttucgacaaagaa

SEQ ID NO: 73051 - DNA, 28 bp, Artificial Sequence
  Synthetic
ttgatcaatatucaaatcatggtgugct

SEQ ID NO: 73052 - DNA, 25 bp, Artificial Sequence
  Synthetic
acgtcaagcaguaaacatgatgugt

SEQ ID NO: 73053 - DNA, 28 bp, Artificial Sequence
  Synthetic
ctcatgactggutatttctccactaugt

SEQ ID NO: 73054 - DNA, 22 bp, Artificial Sequence
  Synthetic
ggaagaaauacagccugacggt

SEQ ID NO: 73055 - DNA, 22 bp, Artificial Sequence
  Synthetic
ggagguagactuccaggcagat

SEQ ID NO: 73056 - DNA, 27 bp, Artificial Sequence
  Synthetic
catttccacacucgataaacgacaaug

SEQ ID NO: 73057 - DNA, 28 bp, Artificial Sequence
  Synthetic
cagagttgggttuctcaaataaggtgua

SEQ ID NO: 73058 - DNA, 28 bp, Artificial Sequence
  Synthetic
agttctcagagaguagaatcaactguga

SEQ ID NO: 73059 - DNA, 27 bp, Artificial Sequence
  Synthetic
gttatgacuactttccaucgagaacca

SEQ ID NO: 73060 - DNA, 18 bp, Artificial Sequence
  Synthetic
ggcuccgccaaatgguga

SEQ ID NO: 73061 - DNA, 23 bp, Artificial Sequence
  Synthetic
acgaacgcguttgaaaagttuct

SEQ ID NO: 73062 - DNA, 22 bp, Artificial Sequence
  Synthetic
cagagucagaaagcaccaguga

SEQ ID NO: 73063 - DNA, 20 bp, Artificial Sequence
  Synthetic
ctgccauctaagguggccat

SEQ ID NO: 73064 - DNA, 28 bp, Artificial Sequence
  Synthetic
gatcatcaaatgcuctttaatggcctut

SEQ ID NO: 73065 - DNA, 28 bp, Artificial Sequence
  Synthetic
cctgtatcttttaugagcaccatctuca

SEQ ID NO: 73066 - DNA, 19 bp, Artificial Sequence
  Synthetic
cagcccuccacaguccaag

SEQ ID NO: 73067 - DNA, 19 bp, Artificial Sequence
  Synthetic
cugacggccucaagaagca

SEQ ID NO: 73068 - DNA, 22 bp, Artificial Sequence
  Synthetic
ggaagtccauctcctcctccuc

SEQ ID NO: 73069 - DNA, 21 bp, Artificial Sequence
  Synthetic
ggtggagcucctgatctggua

SEQ ID NO: 73070 - DNA, 27 bp, Artificial Sequence
  Synthetic
tgtccccatuggtgaatttcttgtuaa

SEQ ID NO: 73071 - DNA, 23 bp, Artificial Sequence
  Synthetic
acagctgucagctttaauaagcc

SEQ ID NO: 73072 - DNA, 27 bp, Artificial Sequence
  Synthetic
tggaaaaacacuggaagattacugact

SEQ ID NO: 73073 - DNA, 28 bp, Artificial Sequence
  Synthetic
ccaggatagagauccaagatttucagaa

SEQ ID NO: 73074 - DNA, 26 bp, Artificial Sequence
  Synthetic
agugttccaaagtuaaagaagggcat

SEQ ID NO: 73075 - DNA, 20 bp, Artificial Sequence
  Synthetic
gcggtcaguatggagaggut

SEQ ID NO: 73076 - DNA, 28 bp, Artificial Sequence
  Synthetic
tcattttggaagutcactggtctaugaa

SEQ ID NO: 73077 - DNA, 24 bp, Artificial Sequence
  Synthetic
gttgctttaaucacatgcgaugga

SEQ ID NO: 73078 - DNA, 23 bp, Artificial Sequence
  Synthetic
cctgctccuaatccacctcatut

SEQ ID NO: 73079 - DNA, 28 bp, Artificial Sequence
  Synthetic
tcatcatgtatacutacagggctttugg

SEQ ID NO: 73080 - DNA, 28 bp, Artificial Sequence
  Synthetic
tgtattataggcgucattgatggctaug

SEQ ID NO: 73081 - DNA, 26 bp, Artificial Sequence
  Synthetic
ctccaattctugcaacctgttactug

SEQ ID NO: 73082 - DNA, 26 bp, Artificial Sequence
  Synthetic
catacccgcautgatgttgtgauaga

SEQ ID NO: 73083 - DNA, 20 bp, Artificial Sequence
  Synthetic
tggtucagcctgugacaacc

SEQ ID NO: 73084 - DNA, 22 bp, Artificial Sequence
  Synthetic
cgccgccuctttccaaaauaaa

SEQ ID NO: 73085 - DNA, 18 bp, Artificial Sequence
  Synthetic
ccaggcuctgtucaacgg

SEQ ID NO: 73086 - DNA, 20 bp, Artificial Sequence
  Synthetic
cactcaccucctccggaaug

SEQ ID NO: 73087 - DNA, 19 bp, Artificial Sequence
  Synthetic
gccccggcuctcggttaua

SEQ ID NO: 73088 - DNA, 21 bp, Artificial Sequence
  Synthetic
cttgctgtgutctggtccugt

SEQ ID NO: 73089 - DNA, 27 bp, Artificial Sequence
  Synthetic
agtgttctccgguactagttagaaugt

SEQ ID NO: 73090 - DNA, 24 bp, Artificial Sequence
  Synthetic
gtcttgagcaggagutgttatgug

SEQ ID NO: 73091 - DNA, 27 bp, Artificial Sequence
  Synthetic
cagaggactguttcatacaaattcuga

SEQ ID NO: 73092 - DNA, 23 bp, Artificial Sequence
  Synthetic
ggtccuccatagacucagggaaa

SEQ ID NO: 73093 - DNA, 20 bp, Artificial Sequence
  Synthetic
gtgacgatgutgtgcacguc

SEQ ID NO: 73094 - DNA, 27 bp, Artificial Sequence
  Synthetic
tgcagaacataatuattgatggcccut

SEQ ID NO: 73095 - DNA, 28 bp, Artificial Sequence
  Synthetic
gtgcttaggatguggtttatactaggut

SEQ ID NO: 73096 - DNA, 29 bp, Artificial Sequence
  Synthetic
agtaattttgcttcuttaggacaccaugt

SEQ ID NO: 73097 - DNA, 20 bp, Artificial Sequence
  Synthetic
cttctccucagacgctugct

SEQ ID NO: 73098 - DNA, 27 bp, Artificial Sequence
  Synthetic
gaaattgcacacugaaattaggacgut

SEQ ID NO: 73099 - DNA, 28 bp, Artificial Sequence
  Synthetic
ctatgaaacccucatgtuaagcaacaag

SEQ ID NO: 73100 - DNA, 25 bp, Artificial Sequence
  Synthetic
ggagatccuctacaaagggtucaga

SEQ ID NO: 73101 - DNA, 26 bp, Artificial Sequence
  Synthetic
agcccgaattucttcaaaggagaaut

SEQ ID NO: 73102 - DNA, 21 bp, Artificial Sequence
  Synthetic
ctgtcctgguacatggtguca

SEQ ID NO: 73103 - DNA, 20 bp, Artificial Sequence
  Synthetic
gaggacggccugatcacauc

SEQ ID NO: 73104 - DNA, 25 bp, Artificial Sequence
  Synthetic
ggagaagattuatgcaggaguaggg

SEQ ID NO: 73105 - DNA, 22 bp, Artificial Sequence
  Synthetic
tcagcucaacctucacacaact

SEQ ID NO: 73106 - DNA, 24 bp, Artificial Sequence
  Synthetic
gtatttctuccagacgccaacgua

SEQ ID NO: 73107 - DNA, 20 bp, Artificial Sequence
  Synthetic
tgaugggctggugacaacat

SEQ ID NO: 73108 - DNA, 20 bp, Artificial Sequence
  Synthetic
gccggatguagaacgagucc

SEQ ID NO: 73109 - DNA, 21 bp, Artificial Sequence
  Synthetic
gtggugaggaaagctgctgua

SEQ ID NO: 73110 - DNA, 21 bp, Artificial Sequence
  Synthetic
acttgggtgcugggtagtgua

SEQ ID NO: 73111 - DNA, 26 bp, Artificial Sequence
  Synthetic
agcttttctccutttcttaccaggug

SEQ ID NO: 73112 - DNA, 22 bp, Artificial Sequence
  Synthetic
gctgaagaaaccugtagcucct

SEQ ID NO: 73113 - DNA, 21 bp, Artificial Sequence
  Synthetic
gacaccagcugcttgacuact

SEQ ID NO: 73114 - DNA, 21 bp, Artificial Sequence
  Synthetic
gatgcaguccacatagccuga

SEQ ID NO: 73115 - DNA, 25 bp, Artificial Sequence
  Synthetic
cucagcagacaaaaucagcaaagag

SEQ ID NO: 73116 - DNA, 27 bp, Artificial Sequence
  Synthetic
ttgattttctcguaccaggatcugaag

SEQ ID NO: 73117 - DNA, 25 bp, Artificial Sequence
  Synthetic
ctgggcatcauatagcattctcugt

SEQ ID NO: 73118 - DNA, 22 bp, Artificial Sequence
  Synthetic
gacagtaggucagcacatucca

SEQ ID NO: 73119 - DNA, 21 bp, Artificial Sequence
  Synthetic
cagtgaugcctccaccucaag

SEQ ID NO: 73120 - DNA, 25 bp, Artificial Sequence
  Synthetic
acuactgaacgaaucccagcaaaaa

SEQ ID NO: 73121 - DNA, 21 bp, Artificial Sequence
  Synthetic
ccgctcccuatctaggguact

SEQ ID NO: 73122 - DNA, 22 bp, Artificial Sequence
  Synthetic
ctccccucagaaatgtgugcat

SEQ ID NO: 73123 - DNA, 21 bp, Artificial Sequence
  Synthetic
gagcaaacuggaacucagcct

SEQ ID NO: 73124 - DNA, 22 bp, Artificial Sequence
  Synthetic
gagauggaagatgugggcagag

SEQ ID NO: 73125 - DNA, 22 bp, Artificial Sequence
  Synthetic
tccatctgcucagacccuacag

SEQ ID NO: 73126 - DNA, 22 bp, Artificial Sequence
  Synthetic
gctcguaagcccagtgtcttut

SEQ ID NO: 73127 - DNA, 20 bp, Artificial Sequence
  Synthetic
gaauctggugccacccaagt

SEQ ID NO: 73128 - DNA, 26 bp, Artificial Sequence
  Synthetic
agaaagttcgaautcgggaaaugagt

SEQ ID NO: 73129 - DNA, 24 bp, Artificial Sequence
  Synthetic
cgactgtgttuttcctctagcugt

SEQ ID NO: 73130 - DNA, 23 bp, Artificial Sequence
  Synthetic
gacctacugaaagagcugcagaa

SEQ ID NO: 73131 - DNA, 22 bp, Artificial Sequence
  Synthetic
ctgcagugttttcctgugaacc

SEQ ID NO: 73132 - DNA, 21 bp, Artificial Sequence
  Synthetic
cgatgaagcagagcugaggut

SEQ ID NO: 73133 - DNA, 17 bp, Artificial Sequence
  Synthetic
gcaatucgcgccuccca

SEQ ID NO: 73134 - DNA, 22 bp, Artificial Sequence
  Synthetic
ccagucccgaagatcuggaaga

SEQ ID NO: 73135 - DNA, 21 bp, Artificial Sequence
  Synthetic
agttcaatcucagcgagcugt

SEQ ID NO: 73136 - DNA, 20 bp, Artificial Sequence
  Synthetic
ttggcgaauccaccaacuga

SEQ ID NO: 73137 - DNA, 19 bp, Artificial Sequence
  Synthetic
gctguccagggtgcugaag

SEQ ID NO: 73138 - DNA, 19 bp, Artificial Sequence
  Synthetic
gcuccagcaccaactgcut

SEQ ID NO: 73139 - DNA, 18 bp, Artificial Sequence
  Synthetic
ggctcgcuagctcuggac

SEQ ID NO: 73140 - DNA, 18 bp, Artificial Sequence
  Synthetic
cctucagcacccuggaca

SEQ ID NO: 73141 - DNA, 19 bp, Artificial Sequence
  Synthetic
ctactgcugccaccaucct

SEQ ID NO: 73142 - DNA, 18 bp, Artificial Sequence
  Synthetic
gcaguccagagcuagcga

SEQ ID NO: 73143 - DNA, 19 bp, Artificial Sequence
  Synthetic
cgggagccacucagcuact

SEQ ID NO: 73144 - DNA, 26 bp, Artificial Sequence
  Synthetic
gauttgattgatuacagcacgggaaa

SEQ ID NO: 73145 - DNA, 28 bp, Artificial Sequence
  Synthetic
cttaccactggagcauatttctctaguc

SEQ ID NO: 73146 - DNA, 28 bp, Artificial Sequence
  Synthetic
cattctgatgcutaccagacuagagaaa

SEQ ID NO: 73147 - DNA, 28 bp, Artificial Sequence
  Synthetic
accccagtctgauccagaatctaaaaua

SEQ ID NO: 73148 - DNA, 23 bp, Artificial Sequence
  Synthetic
catccatctgucctgttctgucc

SEQ ID NO: 73149 - DNA, 19 bp, Artificial Sequence
  Synthetic
gcatctcccugcccatguc

SEQ ID NO: 73150 - DNA, 27 bp, Artificial Sequence
  Synthetic
caccacattuaaaagcgtctgaactua

SEQ ID NO: 73151 - DNA, 28 bp, Artificial Sequence
  Synthetic
tgtgtgtugtttgttgttuagaaagcag

SEQ ID NO: 73152 - DNA, 23 bp, Artificial Sequence
  Synthetic
ctgagccacucttctcttcccua

SEQ ID NO: 73153 - DNA, 23 bp, Artificial Sequence
  Synthetic
agatggacugggaccttuagact

SEQ ID NO: 73154 - DNA, 22 bp, Artificial Sequence
  Synthetic
gcaagagacagagcaucctgut

SEQ ID NO: 73155 - DNA, 21 bp, Artificial Sequence
  Synthetic
caaggacaccucaggaaggut

SEQ ID NO: 73156 - DNA, 26 bp, Artificial Sequence
  Synthetic
gggaatgtttucagaattgttgugag

SEQ ID NO: 73157 - DNA, 27 bp, Artificial Sequence
  Synthetic
acaaagaugttctguagagccaaagat

SEQ ID NO: 73158 - DNA, 32 bp, Artificial Sequence; identical to SEQ ID NO: 61476
  Synthetic

SEQ ID NO: 73159 - DNA, 26 bp, Artificial Sequence
  Synthetic
gcaatggactucacctcatcaaaaug

SEQ ID NO: 73160 - DNA, 21 bp, Artificial Sequence
  Synthetic
gagactgucaagaggugcaca

SEQ ID NO: 73161 - DNA, 22 bp, Artificial Sequence
  Synthetic
tctggaagaccugttgcaugac

SEQ ID NO: 73162 - DNA, 28 bp, Artificial Sequence
  Synthetic
ggttttgatuccacatctggtgatuaga

SEQ ID NO: 73163 - DNA, 29 bp, Artificial Sequence
  Synthetic
gtaccctcauaggcaaaauaaggaagaat

SEQ ID NO: 73164 - DNA, 28 bp, Artificial Sequence
  Synthetic
acagactgcttuccaaagattcttguaa

SEQ ID NO: 73165 - DNA, 24 bp, Artificial Sequence
  Synthetic
attgaagccauacctgtttuccca

SEQ ID NO: 73166 - DNA, 19 bp, Artificial Sequence
  Synthetic
gccgaggaguccagaguga

SEQ ID NO: 73167 - DNA, 18 bp, Artificial Sequence
  Synthetic
gggctttccuccagccut

SEQ ID NO: 73168 - DNA, 17 bp, Artificial Sequence
  Synthetic
cctccugcgtuccccat

SEQ ID NO: 73169 - DNA, 20 bp, Artificial Sequence
  Synthetic
gccggctuctcacttttgug

SEQ ID NO: 73170 - DNA, 23 bp, Artificial Sequence
  Synthetic
gtgatgaccugagacaagaugct

SEQ ID NO: 73171 - DNA, 28 bp, Artificial Sequence
  Synthetic
cccaaccaaauggcatcttttatatgut

SEQ ID NO: 73172 - DNA, 22 bp, Artificial Sequence
  Synthetic
gggaaattguccaggcucaaac

SEQ ID NO: 73173 - DNA, 19 bp, Artificial Sequence
  Synthetic
cttggcagcgucactgtuc

SEQ ID NO: 73174 - DNA, 26 bp, Artificial Sequence
  Synthetic
gttatcaagccuccctgaaactauca

SEQ ID NO: 73175 - DNA, 21 bp, Artificial Sequence
  Synthetic
cutttgtgcttcugggcagag

SEQ ID NO: 73176 - DNA, 20 bp, Artificial Sequence
  Synthetic
tgccucgccatctcuaggaa

SEQ ID NO: 73177 - DNA, 22 bp, Artificial Sequence
  Synthetic
tccagtttgtugatggcctcuc

SEQ ID NO: 73178 - DNA, 21 bp, Artificial Sequence
  Synthetic
gagttgtcagcucttccccut

SEQ ID NO: 73179 - DNA, 20 bp, Artificial Sequence
  Synthetic
gcgcugaacaagttggtcut

SEQ ID NO: 73180 - DNA, 22 bp, Artificial Sequence
  Synthetic
aaaagccacgaguctggtugat

SEQ ID NO: 73181 - DNA, 19 bp, Artificial Sequence
  Synthetic
ggatgctgauggcaacgug

SEQ ID NO: 73182 - DNA, 24 bp, Artificial Sequence
  Synthetic
agacagtttgacucgtccacatut

SEQ ID NO: 73183 - DNA, 21 bp, Artificial Sequence
  Synthetic
aagacctcaucagcagctucc

SEQ ID NO: 73184 - DNA, 23 bp, Artificial Sequence
  Synthetic
cccaggcuggtgaaaaagaauga

SEQ ID NO: 73185 - DNA, 22 bp, Artificial Sequence
  Synthetic
ctttccagcutcttccttgugg

SEQ ID NO: 73186 - DNA, 20 bp, Artificial Sequence
  Synthetic
ccacuccaaagccacagucc

SEQ ID NO: 73187 - DNA, 24 bp, Artificial Sequence
  Synthetic
agagacacucgggttgataugaga

SEQ ID NO: 73188 - DNA, 18 bp, Artificial Sequence
  Synthetic
cgtctuccaccgcctuca

SEQ ID NO: 73189 - DNA, 17 bp, Artificial Sequence
  Synthetic
ctggccauctgcucgga

SEQ ID NO: 73190 - DNA, 20 bp, Artificial Sequence
  Synthetic
cgcccaaccugacuccaaaa

SEQ ID NO: 73191 - DNA, 18 bp, Artificial Sequence
  Synthetic
tgagccugctttgcuggt

SEQ ID NO: 73192 - DNA, 20 bp, Artificial Sequence
  Synthetic
tggaaagggcagugcctuag

SEQ ID NO: 73193 - DNA, 21 bp, Artificial Sequence
  Synthetic
cgactcagaggagugcttgug

SEQ ID NO: 73194 - DNA, 23 bp, Artificial Sequence
  Synthetic
agttgactugggctctctttugt

SEQ ID NO: 73195 - DNA, 26 bp, Artificial Sequence
  Synthetic
agcatcacaaccaugagttuacacat

SEQ ID NO: 73196 - DNA, 21 bp, Artificial Sequence
  Synthetic
cgccutcuccccaaagacaaa

SEQ ID NO: 73197 - DNA, 20 bp, Artificial Sequence
  Synthetic
ctgatgtcucggccctctuc

SEQ ID NO: 73198 - DNA, 19 bp, Artificial Sequence
  Synthetic
caaacgcagcagcucctuc

SEQ ID NO: 73199 - DNA, 18 bp, Artificial Sequence
  Synthetic
gccccatugctgggctut

SEQ ID NO: 73200 - DNA, 25 bp, Artificial Sequence
  Synthetic
caaatgaggaacaaguttgcctucc

SEQ ID NO: 73201 - DNA, 22 bp, Artificial Sequence
  Synthetic
gctgctaccuctgcactatguc

SEQ ID NO: 73202 - DNA, 20 bp, Artificial Sequence
  Synthetic
cttucaccccctuggacaca

SEQ ID NO: 73203 - DNA, 17 bp, Artificial Sequence
  Synthetic
ctggucagcgtgcugga

SEQ ID NO: 73204 - DNA, 20 bp, Artificial Sequence
  Synthetic
tcuccccacctguggaagaa

SEQ ID NO: 73205 - DNA, 19 bp, Artificial Sequence
  Synthetic
tgactgaccuccacuccgt

SEQ ID NO: 73206 - DNA, 22 bp, Artificial Sequence
  Synthetic
ccaccatucagcttggtuaaca

SEQ ID NO: 73207 - DNA, 28 bp, Artificial Sequence
  Synthetic
tctttgtacctcuttgttccttcttuca

SEQ ID NO: 73208 - DNA, 24 bp, Artificial Sequence
  Synthetic
ctcagttcggugaaggaaaucagt

SEQ ID NO: 73209 - DNA, 21 bp, Artificial Sequence
  Synthetic
tcactagucccttgucagcca

SEQ ID NO: 73210 - DNA, 22 bp, Artificial Sequence
  Synthetic
gccacgaugacttccttctuga

SEQ ID NO: 73211 - DNA, 21 bp, Artificial Sequence
  Synthetic
gcccauagaccaugaacgagt

SEQ ID NO: 73212 - DNA, 28 bp, Artificial Sequence
  Synthetic
aacaaaattucacgtcacauacaaacca

SEQ ID NO: 73213 - DNA, 22 bp, Artificial Sequence
  Synthetic
cctgcaaggugtggagtuacag

SEQ ID NO: 73214 - DNA, 21 bp, Artificial Sequence
  Synthetic
catggcugaaccagtcuggat

SEQ ID NO: 73215 - DNA, 24 bp, Artificial Sequence
  Synthetic
aacattgttugttggagaguccca

SEQ ID NO: 73216 - DNA, 21 bp, Artificial Sequence
  Synthetic
ccagcagcutcaggtacucaa

SEQ ID NO: 73217 - DNA, 19 bp, Artificial Sequence
  Synthetic
gtgaaguggacgcctcucc

SEQ ID NO: 73218 - DNA, 24 bp, Artificial Sequence
  Synthetic
gtgctttctutagactgtcucgga

SEQ ID NO: 73219 - DNA, 28 bp, Artificial Sequence
  Synthetic
gttgtatctgaccuagtaacccattuga

SEQ ID NO: 73220 - DNA, 20 bp, Artificial Sequence
  Synthetic
cctcccgutttgcctgtuga

SEQ ID NO: 73221 - DNA, 27 bp, Artificial Sequence
  Synthetic
gttttaauaatttccccuacggcagga

SEQ ID NO: 73222 - DNA, 27 bp, Artificial Sequence
  Synthetic
tgtctgttcccuaatacagtcactuca

SEQ ID NO: 73223 - DNA, 24 bp, Artificial Sequence
  Synthetic
cttgttctucaagctgctgtugat

SEQ ID NO: 73224 - DNA, 23 bp, Artificial Sequence
  Synthetic
agccaaacaacagaucctcacuc

SEQ ID NO: 73225 - DNA, 27 bp, Artificial Sequence
  Synthetic
gcttctacaagtuagctgacttcctua

SEQ ID NO: 73226 - DNA, 23 bp, Artificial Sequence
  Synthetic
ggctaagcttuttccacttccug

SEQ ID NO: 73227 - DNA, 28 bp, Artificial Sequence
  Synthetic
caatctcactttuccttgctgttctaut

SEQ ID NO: 73228 - DNA, 29 bp, Artificial Sequence
  Synthetic
ccaagaucaaagtacactguaaaaagcaa

SEQ ID NO: 73229 - DNA, 27 bp, Artificial Sequence
  Synthetic
cugcatcatatttcucaaggaaccaat

SEQ ID NO: 73230 - DNA, 22 bp, Artificial Sequence
  Synthetic
agcagaagcaguctcaaaugct

SEQ ID NO: 73231 - DNA, 23 bp, Artificial Sequence
  Synthetic
agtttgtgcaagcucactctuca

SEQ ID NO: 73232 - DNA, 27 bp, Artificial Sequence
  Synthetic
gtgcaggagaaaguatcactctgttua

SEQ ID NO: 73233 - DNA, 28 bp, Artificial Sequence
  Synthetic
aagaaaatcttaccutggtacagtugct

SEQ ID NO: 73234 - DNA, 24 bp, Artificial Sequence
  Synthetic
gaaagcugaaattgtugccaaagg

SEQ ID NO: 73235 - DNA, 21 bp, Artificial Sequence
  Synthetic
gagaccucagcaugcagaact

SEQ ID NO: 73236 - DNA, 30 bp, Artificial Sequence; identical to SEQ ID NO: 68774
  Synthetic

SEQ ID NO: 73237 - DNA, 25 bp, Artificial Sequence
  Synthetic
gcatcagattccuttatggcaaguc

SEQ ID NO: 73238 - DNA, 26 bp, Artificial Sequence
  Synthetic
tgttccuaggatgacauggagaaact

SEQ ID NO: 73239 - DNA, 28 bp, Artificial Sequence
  Synthetic
ttggtcaatttcuacctctttttccugt

SEQ ID NO: 73240 - DNA, 28 bp, Artificial Sequence
  Synthetic
ggaggcacaaaaugtgaaattctucaat

SEQ ID NO: 73241 - DNA, 28 bp, Artificial Sequence
  Synthetic
ggtgatattatgugaagatgatgugcag

SEQ ID NO: 73242 - DNA, 24 bp, Artificial Sequence
  Synthetic
gccaugtctacucaagaccaacat

SEQ ID NO: 73243 - DNA, 27 bp, Artificial Sequence
  Synthetic
tgttgtaatttuaagttgctgcuggag

SEQ ID NO: 73244 - DNA, 22 bp, Artificial Sequence
  Synthetic
gtgggtcugatacagguagcaa

SEQ ID NO: 73245 - DNA, 29 bp, Artificial Sequence
  Synthetic
gcacaaaagaaccautgattuacaaaagg

SEQ ID NO: 73246 - DNA, 21 bp, Artificial Sequence
  Synthetic
cctgcuccccagatgaaacuc

SEQ ID NO: 73247 - DNA, 29 bp, Artificial Sequence
  Synthetic
ggttctgaaugaccagttttaaacaugat

SEQ ID NO: 73248 - DNA, 24 bp, Artificial Sequence
  Synthetic
ctgagaaaauggtggttgcugaac

SEQ ID NO: 73249 - DNA, 26 bp, Artificial Sequence
  Synthetic
gtttttaauaaggaagccuggcacac

SEQ ID NO: 73250 - DNA, 18 bp, Artificial Sequence
  Synthetic
cccacccauccggacuca

SEQ ID NO: 73251 - DNA, 20 bp, Artificial Sequence
  Synthetic
cacccctguaccaaccauca

SEQ ID NO: 73252 - DNA, 18 bp, Artificial Sequence
  Synthetic
ccgacgugacgttugcag

SEQ ID NO: 73253 - DNA, 25 bp, Artificial Sequence
  Synthetic
tgttgaacatcccutccttgtctug

SEQ ID NO: 73254 - DNA, 25 bp, Artificial Sequence
  Synthetic
acagataagttuacagcagcagcut

SEQ ID NO: 73255 - DNA, 23 bp, Artificial Sequence
  Synthetic
gataccttatgutccgctgcuga

SEQ ID NO: 73256 - DNA, 21 bp, Artificial Sequence
  Synthetic
ggattgugggaacgaacugct

SEQ ID NO: 73257 - DNA, 22 bp, Artificial Sequence
  Synthetic
ggccagaaagccugaacattut

SEQ ID NO: 73258 - DNA, 20 bp, Artificial Sequence
  Synthetic
caatcccagcacugctgcua

SEQ ID NO: 73259 - DNA, 19 bp, Artificial Sequence
  Synthetic
cagaagaaggcuccugcca

SEQ ID NO: 73260 - DNA, 20 bp, Artificial Sequence
  Synthetic
cttggcaggagccutctuct

SEQ ID NO: 73261 - DNA, 22 bp, Artificial Sequence
  Synthetic
tcucaggccccaguaaacaaac

SEQ ID NO: 73262 - DNA, 20 bp, Artificial Sequence
  Synthetic
tcttctgcugagcctgctug

SEQ ID NO: 73263 - DNA, 20 bp, Artificial Sequence
  Synthetic
ctgtcucaggccccaguaaa

SEQ ID NO: 73264 - DNA, 28 bp, Artificial Sequence
  Synthetic
ccctaggaauaaaagacatacacgugaa

SEQ ID NO: 73265 - DNA, 27 bp, Artificial Sequence
  Synthetic
aatttgtaggctutcctgttctcauca

SEQ ID NO: 73266 - DNA, 25 bp, Artificial Sequence
  Synthetic
acaggtaaatggutgcagttttgug

SEQ ID NO: 73267 - DNA, 28 bp, Artificial Sequence
  Synthetic
cagaaagaagtacaugcaggaaaaagut

SEQ ID NO: 73268 - DNA, 24 bp, Artificial Sequence
  Synthetic
gttcacctcacugaaacctttgug

SEQ ID NO: 73269 - DNA, 22 bp, Artificial Sequence
  Synthetic
ctatggccugctgtaugagcaa

SEQ ID NO: 73270 - DNA, 28 bp, Artificial Sequence
  Synthetic
ggagaaatggagaaugctttaaggucat

SEQ ID NO: 73271 - DNA, 27 bp, Artificial Sequence
  Synthetic
gtcctagttcutccttgagttttucct

SEQ ID NO: 73272 - DNA, 28 bp, Artificial Sequence
  Synthetic
actcucaaaaggaaaaacucaaggaaga

SEQ ID NO: 73273 - DNA, 25 bp, Artificial Sequence
  Synthetic
tctagctctcugaatctgttcccut

SEQ ID NO: 73274 - DNA, 28 bp, Artificial Sequence
  Synthetic
agctttccaaacugaaggaagattuaga

SEQ ID NO: 73275 - DNA, 27 bp, Artificial Sequence
  Synthetic
tcaaattgtccutttcaaactgcaugg

SEQ ID NO: 73276 - DNA, 28 bp, Artificial Sequence
  Synthetic
agctaaaagattuacagcagtctctugt

SEQ ID NO: 73277 - DNA, 28 bp, Artificial Sequence
  Synthetic
gaacttcttgtucaagtgtaccctttuc

SEQ ID NO: 73278 - DNA, 27 bp, Artificial Sequence
  Synthetic
agaaaaggguacactugaacaagaagt

SEQ ID NO: 73279 - DNA, 28 bp, Artificial Sequence
  Synthetic
caacatgtctucaagggttttctttuca

SEQ ID NO: 73280 - DNA, 25 bp, Artificial Sequence
  Synthetic
gcacaactugaagcagagaauagca

SEQ ID NO: 73281 - DNA, 28 bp, Artificial Sequence
  Synthetic
gtctttggattuggacttaatggaguct

SEQ ID NO: 73282 - DNA, 28 bp, Artificial Sequence
  Synthetic
gaagaccttgtugaagaattgagcttut

SEQ ID NO: 73283 - DNA, 28 bp, Artificial Sequence
  Synthetic
gcagaaacaatcucagctttcaaatcut

SEQ ID NO: 73284 - DNA, 27 bp, Artificial Sequence
  Synthetic
tgaagcacauaagtcccttaguacagt

SEQ ID NO: 73285 - DNA, 28 bp, Artificial Sequence
  Synthetic
cattctgtcuaacacagcattctttuct

SEQ ID NO: 73286 - DNA, 28 bp, Artificial Sequence
  Synthetic
ctcctgtuagccaagaagaaagatugat

SEQ ID NO: 73287 - DNA, 29 bp, Artificial Sequence
  Synthetic
gtgttcctttgcutttcaatctcttcaut

SEQ ID NO: 73288 - DNA, 23 bp, Artificial Sequence
  Synthetic
tcagtgttgguggacaagugaat

SEQ ID NO: 73289 - DNA, 28 bp, Artificial Sequence
  Synthetic
gtatgtuggcaggttaaaaauaaaggct

SEQ ID NO: 73290 - DNA, 28 bp, Artificial Sequence
  Synthetic
ggacctcaaacaacaaugtattcagcua

SEQ ID NO: 73291 - DNA, 27 bp, Artificial Sequence
  Synthetic
tcaucttttacttugagaaggcaagca

SEQ ID NO: 73292 - DNA, 28 bp, Artificial Sequence
  Synthetic
ctatgcacattggaugcacaatagttut

SEQ ID NO: 73293 - DNA, 19 bp, Artificial Sequence
  Synthetic
tgagggutggcaucggaac

SEQ ID NO: 73294 - DNA, 21 bp, Artificial Sequence
  Synthetic
ccutcggtgttuacagaccca

SEQ ID NO: 73295 - DNA, 21 bp, Artificial Sequence
  Synthetic
gctgttuacggcctggaacut

SEQ ID NO: 73296 - DNA, 24 bp, Artificial Sequence
  Synthetic
agaaacatuggaaatgggugaggt

SEQ ID NO: 73297 - DNA, 28 bp, Artificial Sequence
  Synthetic
tcaccatgttuctgtttcaattgtucag

SEQ ID NO: 73298 - DNA, 28 bp, Artificial Sequence
  Synthetic
gcatctgaauccagaaaggaacuagaat

SEQ ID NO: 73299 - DNA, 28 bp, Artificial Sequence
  Synthetic
ttcttcgtgacuaaatagaagctgtgut

SEQ ID NO: 73300 - DNA, 25 bp, Artificial Sequence
  Synthetic
gctgaatuagagaggcugagaacac

SEQ ID NO: 73301 - DNA, 30 bp, Artificial Sequence
  Synthetic
tttcattctgtaaaccauctatctgctgut

SEQ ID NO: 73302 - DNA, 25 bp, Artificial Sequence
  Synthetic
agaatccucgaatttcagguccaaa

SEQ ID NO: 73303 - DNA, 20 bp, Artificial Sequence
  Synthetic
catugggaccccaugaggag

SEQ ID NO: 73304 - DNA, 28 bp, Artificial Sequence
  Synthetic
gcctttcaugaacgtaaaattuggacat

SEQ ID NO: 73305 - DNA, 27 bp, Artificial Sequence
  Synthetic
atcacgtactttutcagcttgacatug

SEQ ID NO: 73306 - DNA, 26 bp, Artificial Sequence
  Synthetic
caatgtcaagcugaaaaagtacguga

SEQ ID NO: 73307 - DNA, 26 bp, Artificial Sequence
  Synthetic
atgcttggtttugctgtcttaaaucc

SEQ ID NO: 73308 - DNA, 18 bp, Artificial Sequence
  Synthetic
gccgugggacccaacaua

SEQ ID NO: 73309 - DNA, 20 bp, Artificial Sequence
  Synthetic
gagggaauggaacctgcugt

SEQ ID NO: 73310 - DNA, 29 bp, Artificial Sequence
  Synthetic
cagtagguttatagagcuggaacaagaaa

SEQ ID NO: 73311 - DNA, 28 bp, Artificial Sequence
  Synthetic
agtatacuagcaaagaacattccacuga

SEQ ID NO: 73312 - DNA, 21 bp, Artificial Sequence
  Synthetic
cagccagacgcugcaatatut

SEQ ID NO: 73313 - DNA, 20 bp, Artificial Sequence
  Synthetic
gatgtccggagutcccacug

SEQ ID NO: 73314 - DNA, 26 bp, Artificial Sequence
  Synthetic
acagggaacacacagaugataagtut

SEQ ID NO: 73315 - DNA, 22 bp, Artificial Sequence
  Synthetic
ccctccugtaaccattguccag

SEQ ID NO: 73316 - DNA, 21 bp, Artificial Sequence
  Synthetic
ggcttcccuccagtacaguct

SEQ ID NO: 73317 - DNA, 20 bp, Artificial Sequence
  Synthetic
gcttgcaaagugctgcauct

SEQ ID NO: 73318 - DNA, 23 bp, Artificial Sequence
  Synthetic
acaggaagagcacagucacttug

SEQ ID NO: 73319 - DNA, 20 bp, Artificial Sequence
  Synthetic
ctcacugacaagctccucgt

SEQ ID NO: 73320 - DNA, 22 bp, Artificial Sequence
  Synthetic
atctgtccugcagaagctgaug

SEQ ID NO: 73321 - DNA, 22 bp, Artificial Sequence
  Synthetic
ttaaccugcaggaagucaaggg

SEQ ID NO: 73322 - DNA, 22 bp, Artificial Sequence
  Synthetic
ggactagcautacctggcaugg

SEQ ID NO: 73323 - DNA, 21 bp, Artificial Sequence
  Synthetic
aggtcccaucatgccttgtug

SEQ ID NO: 73324 - DNA, 20 bp, Artificial Sequence
  Synthetic
gcaaccugccccaaagtuca

SEQ ID NO: 73325 - DNA, 20 bp, Artificial Sequence
  Synthetic
tcggaugacctccugcagat

SEQ ID NO: 73326 - DNA, 24 bp, Artificial Sequence
  Synthetic
cctcctcugaaagcgagcaaauag

SEQ ID NO: 73327 - DNA, 28 bp, Artificial Sequence
  Synthetic
gagtcactttccugagcatcttcattua

SEQ ID NO: 73328 - DNA, 21 bp, Artificial Sequence
  Synthetic
caugagaccaccagccttuct

SEQ ID NO: 73329 - DNA, 21 bp, Artificial Sequence
  Synthetic
ccgatcctugccaggaaucat

SEQ ID NO: 73330 - DNA, 19 bp, Artificial Sequence
  Synthetic
gcccacccugaugagcaat

SEQ ID NO: 73331 - DNA, 22 bp, Artificial Sequence
  Synthetic
gggatcaugatgttctgtuggg

SEQ ID NO: 73332 - DNA, 21 bp, Artificial Sequence
  Synthetic
gccccatugctgaagtgcaua

SEQ ID NO: 73333 - DNA, 26 bp, Artificial Sequence
  Synthetic
catgactattcccaauggctagctut

SEQ ID NO: 73334 - DNA, 17 bp, Artificial Sequence
  Synthetic
cgggaugcggctggaug

SEQ ID NO: 73335 - DNA, 26 bp, Artificial Sequence
  Synthetic
cgataaccgggagauagtgaugaagt

SEQ ID NO: 73336 - DNA, 28 bp, Artificial Sequence
  Synthetic
ttgttactgcauacacattgtgacctua

SEQ ID NO: 73337 - DNA, 27 bp, Artificial Sequence
  Synthetic
gatttcttgcugagagatuccacaaag

SEQ ID NO: 73338 - DNA, 25 bp, Artificial Sequence
  Synthetic
ctctgcgacagcutataatggaugt

SEQ ID NO: 73339 - DNA, 29 bp, Artificial Sequence
  Synthetic
agctggattataacucctcttctttcuct

SEQ ID NO: 73340 - DNA, 28 bp, Artificial Sequence
  Synthetic
ttgacaatagucagtaatgcatguggaa

SEQ ID NO: 73341 - DNA, 27 bp, Artificial Sequence
  Synthetic
cccatagcaaucattttgtgcttugaa

SEQ ID NO: 73342 - DNA, 26 bp, Artificial Sequence
  Synthetic
gcaacatgacugtcctttcaccauat

SEQ ID NO: 73343 - DNA, 23 bp, Artificial Sequence
  Synthetic
ctggattttcugttgctggaugg

SEQ ID NO: 73344 - DNA, 25 bp, Artificial Sequence
  Synthetic
aagcttcguctgattcagatuccat

SEQ ID NO: 73345 - DNA, 26 bp, Artificial Sequence
  Synthetic
ccaatgtactttuctcccctggttut

SEQ ID NO: 73346 - DNA, 26 bp, Artificial Sequence
  Synthetic
acaagtaauaaaggcccacgaatuct

SEQ ID NO: 73347 - DNA, 20 bp, Artificial Sequence
  Synthetic
ggctgttucatttggccuga

SEQ ID NO: 73348 - DNA, 24 bp, Artificial Sequence
  Synthetic
gtgggtcaaguaaagcaccttcua

SEQ ID NO: 73349 - DNA, 29 bp, Artificial Sequence
  Synthetic
tgatgtcctuggaagttgagataattugt

SEQ ID NO: 73350 - DNA, 20 bp, Artificial Sequence
  Synthetic
gccaaaugaaacagccccut

SEQ ID NO: 73351 - DNA, 22 bp, Artificial Sequence
  Synthetic
ggtggctgtutgaccttcacua

SEQ ID NO: 73352 - DNA, 19 bp, Artificial Sequence
  Synthetic
aagagacugagcccccuga

SEQ ID NO: 73353 - DNA, 27 bp, Artificial Sequence
  Synthetic
caacaggtcaucttcagagtcaauact

SEQ ID NO: 73354 - DNA, 20 bp, Artificial Sequence
  Synthetic
ggccauctcagaucccaact

SEQ ID NO: 73355 - DNA, 28 bp, Artificial Sequence
  Synthetic
tcctctcttutaaacagatgucacaagg

SEQ ID NO: 73356 - DNA, 23 bp, Artificial Sequence
  Synthetic
agcatgcucaagaacctcatuca

SEQ ID NO: 73357 - DNA, 28 bp, Artificial Sequence
  Synthetic
gcttctagggcuttttgtttccuaacat

SEQ ID NO: 73358 - DNA, 20 bp, Artificial Sequence
  Synthetic
cgccatuctgggtctuacct

SEQ ID NO: 73359 - DNA, 28 bp, Artificial Sequence
  Synthetic
ccagaacaaaaacccuctaacaagaauc

SEQ ID NO: 73360 - DNA, 28 bp, Artificial Sequence
  Synthetic
gacacctataaacutttccacagcuaca

SEQ ID NO: 73361 - DNA, 24 bp, Artificial Sequence
  Synthetic
ctccttgagccucatctgtactuc

SEQ ID NO: 73362 - DNA, 22 bp, Artificial Sequence
  Synthetic
gcggaattgguctaggcaacua

SEQ ID NO: 73363 - DNA, 23 bp, Artificial Sequence
  Synthetic
cccagaactuctgtcttccugag

SEQ ID NO: 73364 - DNA, 28 bp, Artificial Sequence
  Synthetic
ctcaagaaacagtuctctcagttctcut

SEQ ID NO: 73365 - DNA, 25 bp, Artificial Sequence
  Synthetic
ccacccatattuctgggactatgut

SEQ ID NO: 73366 - DNA, 26 bp, Artificial Sequence
  Synthetic
aaaacagaggaugtttgggugagaat

SEQ ID NO: 73367 - DNA, 28 bp, Artificial Sequence
  Synthetic
cccacattttgtuttgcctgattatcut

SEQ ID NO: 73368 - DNA, 24 bp, Artificial Sequence
  Synthetic
ttttcttgtucatccagccugagt

SEQ ID NO: 73369 - DNA, 25 bp, Artificial Sequence
  Synthetic
ttctgcctctutctcttggtttuca

SEQ ID NO: 73370 - DNA, 28 bp, Artificial Sequence
  Synthetic
cctggtagaaauggaataagtcctccua

SEQ ID NO: 73371 - DNA, 27 bp, Artificial Sequence
  Synthetic
tggataaaccugtttgtttgguaaggt

SEQ ID NO: 73372 - DNA, 28 bp, Artificial Sequence
  Synthetic
ccttcaagacucaagggtgataaugaaa

SEQ ID NO: 73373 - DNA, 28 bp, Artificial Sequence
  Synthetic
accttcctgaauagctttccaaucaaaa

SEQ ID NO: 73374 - DNA, 24 bp, Artificial Sequence
  Synthetic
ccttaagacuccagccuccaaaag

SEQ ID NO: 73375 - DNA, 23 bp, Artificial Sequence
  Synthetic
gggtcgaauctctagatccugat

SEQ ID NO: 73376 - DNA, 26 bp, Artificial Sequence
  Synthetic
catggtctaucccctgatucagaaaa

SEQ ID NO: 73377 - DNA, 26 bp, Artificial Sequence
  Synthetic
gagagautcctgattucagggaaagg

SEQ ID NO: 73378 - DNA, 21 bp, Artificial Sequence
  Synthetic
gctcaagctugccatctctuc

SEQ ID NO: 73379 - DNA, 24 bp, Artificial Sequence
  Synthetic
gcttgtgtcuctgcttacuacgat

SEQ ID NO: 73380 - DNA, 24 bp, Artificial Sequence
  Synthetic
gagauaccattccuacagaaggca

SEQ ID NO: 73381 - DNA, 22 bp, Artificial Sequence
  Synthetic
acacggaaaggcutgtgactut

SEQ ID NO: 73382 - DNA, 26 bp, Artificial Sequence
  Synthetic
cagtgttucagaaaaggcaaauccaa

SEQ ID NO: 73383 - DNA, 28 bp, Artificial Sequence
  Synthetic
gttttatctcagutcctttttggucagg

SEQ ID NO: 73384 - DNA, 23 bp, Artificial Sequence
  Synthetic
agguagacagaugagccaacaga

SEQ ID NO: 73385 - DNA, 28 bp, Artificial Sequence
  Synthetic
ttctaccttttuattggctccatuacca

SEQ ID NO: 73386 - DNA, 25 bp, Artificial Sequence
  Synthetic
gaagaagtgucagccattcauacct

SEQ ID NO: 73387 - DNA, 29 bp, Artificial Sequence
  Synthetic
gaacatgtcctatutgaattttccgacut

SEQ ID NO: 73388 - DNA, 27 bp, Artificial Sequence
  Synthetic
agaatcagagcagccuaaagaaucaaa

SEQ ID NO: 73389 - DNA, 26 bp, Artificial Sequence
  Synthetic
tttgctttacgugatgactttgtugg

SEQ ID NO: 73390 - DNA, 28 bp, Artificial Sequence
  Synthetic
agaagaatgtautatttctgccaugcca

SEQ ID NO: 73391 - DNA, 27 bp, Artificial Sequence
  Synthetic
acctgttttgugatggtagaagttugt

SEQ ID NO: 73392 - DNA, 26 bp, Artificial Sequence
  Synthetic
agacaatttaagucccaaggcatcuc

SEQ ID NO: 73393 - DNA, 26 bp, Artificial Sequence
  Synthetic
gagctggguaacactgtagtatucaa

SEQ ID NO: 73394 - DNA, 25 bp, Artificial Sequence
  Synthetic
autaattctgctaugcccaaaggga

SEQ ID NO: 73395 - DNA, 28 bp, Artificial Sequence
  Synthetic
tgtggtataggtuttactggtgaagtug

SEQ ID NO: 73396 - DNA, 26 bp, Artificial Sequence
  Synthetic
agaaaccaacutcaccaguaaaacct

SEQ ID NO: 73397 - DNA, 25 bp, Artificial Sequence
  Synthetic
ggagcttatcautgaagacctugga

SEQ ID NO: 73398 - DNA, 28 bp, Artificial Sequence
  Synthetic
gcccatacacautcaaacacttacaaut

SEQ ID NO: 73399 - DNA, 25 bp, Artificial Sequence
  Synthetic
aatcgagggttucatttgacctcut

SEQ ID NO: 73400 - DNA, 24 bp, Artificial Sequence
  Synthetic
aactcctttautcaggtggaugcc

SEQ ID NO: 73401 - DNA, 22 bp, Artificial Sequence
  Synthetic
gtcccacuaggtgaactgtgut

SEQ ID NO: 73402 - DNA, 29 bp, Artificial Sequence
  Synthetic
gcctccaaaggacuaaatcagatgaauaa

SEQ ID NO: 73403 - DNA, 23 bp, Artificial Sequence
  Synthetic
ggcttggagcutctttgaugaaa

SEQ ID NO: 73404 - DNA, 25 bp, Artificial Sequence
  Synthetic
gacctgtatuagtacgccagucaac

SEQ ID NO: 73405 - DNA, 25 bp, Artificial Sequence
  Synthetic
ggacttaaaacuggagtttgugcct

SEQ ID NO: 73406 - DNA, 27 bp, Artificial Sequence
  Synthetic
ctctttactuttcagtgtcuacgagca

SEQ ID NO: 73407 - DNA, 27 bp, Artificial Sequence
  Synthetic
tctagagtttcucctccgatggttuaa

SEQ ID NO: 73408 - DNA, 21 bp, Artificial Sequence
  Synthetic
ctactcugggcacaggcauag

SEQ ID NO: 73409 - DNA, 24 bp, Artificial Sequence
  Synthetic
gacacttgugagtactgugggaaa

SEQ ID NO: 73410 - DNA, 21 bp, Artificial Sequence
  Synthetic
ggccatuaacagtgccaucgt

SEQ ID NO: 73411 - DNA, 17 bp, Artificial Sequence
  Synthetic
ggcatggugctcagcuc

SEQ ID NO: 73412 - DNA, 27 bp, Artificial Sequence
  Synthetic
agtgagatugctacagttctugaagac

SEQ ID NO: 73413 - DNA, 18 bp, Artificial Sequence
  Synthetic
agcuggacggagggauct

SEQ ID NO: 73414 - DNA, 19 bp, Artificial Sequence
  Synthetic
ggaaggccucgctgaagug

SEQ ID NO: 73415 - DNA, 17 bp, Artificial Sequence
  Synthetic
ctacggcutcgggcuga

SEQ ID NO: 73416 - DNA, 17 bp, Artificial Sequence
  Synthetic
ccccgcgagcugttcuc

SEQ ID NO: 73417 - DNA, 19 bp, Artificial Sequence
  Synthetic
aacgaccccaaccugaucc

SEQ ID NO: 73418 - DNA, 18 bp, Artificial Sequence
  Synthetic
ctcgctcuccgtcagcuc

SEQ ID NO: 73419 - DNA, 17 bp, Artificial Sequence
  Synthetic
guccgtgguggccaagt

SEQ ID NO: 73420 - DNA, 20 bp, Artificial Sequence
  Synthetic
aaaccaagucagctgccugt

SEQ ID NO: 73421 - DNA, 28 bp, Artificial Sequence
  Synthetic
gggattcgatugttagatcactuagaga

SEQ ID NO: 73422 - DNA, 20 bp, Artificial Sequence
  Synthetic
ggcccggaccacuaataugg

SEQ ID NO: 73423 - DNA, 22 bp, Artificial Sequence
  Synthetic
cccutccttagctucggagact

SEQ ID NO: 73424 - DNA, 19 bp, Artificial Sequence
  Synthetic
gggtcgtuctcgctctuga

SEQ ID NO: 73425 - DNA, 20 bp, Artificial Sequence
  Synthetic
gacgcacaugcacaaaucgt

SEQ ID NO: 73426 - DNA, 21 bp, Artificial Sequence
  Synthetic
gaggcaaaaggcgautgtcug

SEQ ID NO: 73427 - DNA, 22 bp, Artificial Sequence
  Synthetic
ccccttcuctaagcgcaucaag

SEQ ID NO: 73428 - DNA, 20 bp, Artificial Sequence
  Synthetic
ggcaggucgaactccttcuc

SEQ ID NO: 73429 - DNA, 17 bp, Artificial Sequence
  Synthetic
gcgagucggaccgcaua

SEQ ID NO: 73430 - DNA, 23 bp, Artificial Sequence
  Synthetic
cgagagagacagagugacagaug

SEQ ID NO: 73431 - DNA, 29 bp, Artificial Sequence
  Synthetic
tttgatttgtgtcutgtgtcttgtttcut

SEQ ID NO: 73432 - DNA, 23 bp, Artificial Sequence
  Synthetic
attcagttcuagcagcucaagca

SEQ ID NO: 73433 - DNA, 26 bp, Artificial Sequence
  Synthetic
cgcttctttgugttgttattcacugg

SEQ ID NO: 73434 - DNA, 25 bp, Artificial Sequence
  Synthetic
agacttctgutgccttgaaaugagt

SEQ ID NO: 73435 - DNA, 28 bp, Artificial Sequence
  Synthetic
ctattaccugaaacatcttctgugggaa

SEQ ID NO: 73436 - DNA, 29 bp, Artificial Sequence
  Synthetic
ctcccttagugcaacaggacataaaauat

SEQ ID NO: 73437 - DNA, 28 bp, Artificial Sequence
  Synthetic
tccacuggtagatcuagaaagaggaaag

SEQ ID NO: 73438 - DNA, 23 bp, Artificial Sequence
  Synthetic
tcttttcccaccugcattgtuca

SEQ ID NO: 73439 - DNA, 25 bp, Artificial Sequence
  Synthetic
gggcttcauacaagagagtacucac

SEQ ID NO: 73440 - DNA, 22 bp, Artificial Sequence
  Synthetic
ccctctguctctcttcctucct

SEQ ID NO: 73441 - DNA, 18 bp, Artificial Sequence
  Synthetic
ggaaggcggguggagaug

SEQ ID NO: 73442 - DNA, 24 bp, Artificial Sequence
  Synthetic
ctcctcccaauttcttccttccut

SEQ ID NO: 73443 - DNA, 22 bp, Artificial Sequence
  Synthetic
cccctccucatgaguccaagat

SEQ ID NO: 73444 - DNA, 33 bp, Artificial Sequence; identical to SEQ ID NO: 58954
  Synthetic

SEQ ID NO: 73445 - DNA, 24 bp, Artificial Sequence
  Synthetic
cagtcatctgcugtggttgaaaut

SEQ ID NO: 73446 - DNA, 24 bp, Artificial Sequence
  Synthetic
gaaattucaaccacagcagaugac

SEQ ID NO: 73447 - DNA, 28 bp, Artificial Sequence
  Synthetic
gtgacaagaaaucaagtagcaacaauca

SEQ ID NO: 73448 - DNA, 24 bp, Artificial Sequence
  Synthetic
gtgctaauagaggagcactgtcut

SEQ ID NO: 73449 - DNA, 21 bp, Artificial Sequence
  Synthetic
guccccattcuagcagccaat

SEQ ID NO: 73450 - DNA, 19 bp, Artificial Sequence
  Synthetic
gggtgucaggtgggaguga

SEQ ID NO: 73451 - DNA, 24 bp, Artificial Sequence
  Synthetic
gggaaggacguttacaaatgugaa

SEQ ID NO: 73452 - DNA, 17 bp, Artificial Sequence
  Synthetic
cguggaaggcgcagtuc

SEQ ID NO: 73453 - DNA, 17 bp, Artificial Sequence
  Synthetic
cggaagcgcucctggut

SEQ ID NO: 73454 - DNA, 21 bp, Artificial Sequence
  Synthetic
ccttggtcgcutctgtagcuc

SEQ ID NO: 73455 - DNA, 21 bp, Artificial Sequence
  Synthetic
agcagctttcucccgtaccua

SEQ ID NO: 73456 - DNA, 18 bp, Artificial Sequence
  Synthetic
cagccagagcaccucuga

SEQ ID NO: 73457 - DNA, 18 bp, Artificial Sequence
  Synthetic
ctcgcuggaggtgaggut

SEQ ID NO: 73458 - DNA, 19 bp, Artificial Sequence
  Synthetic
caucgagcaggagcuggag

SEQ ID NO: 73459 - DNA, 17 bp, Artificial Sequence
  Synthetic
ccatcgcugccggucat

SEQ ID NO: 73460 - DNA, 17 bp, Artificial Sequence
  Synthetic
gcuaugaccggcagcga

SEQ ID NO: 73461 - DNA, 18 bp, Artificial Sequence
  Synthetic
cuggcctuacccggagaa

SEQ ID NO: 73462 - DNA, 20 bp, Artificial Sequence
  Synthetic
cggacugcagctccaaugag

SEQ ID NO: 73463 - DNA, 19 bp, Artificial Sequence
  Synthetic
tgctgctgucgaaggacug

SEQ ID NO: 73464 - DNA, 18 bp, Artificial Sequence
  Synthetic
cccucgcagaacucgcaa

SEQ ID NO: 73465 - DNA, 19 bp, Artificial Sequence
  Synthetic
cacctgcguctccauggaa

SEQ ID NO: 73466 - DNA, 27 bp, Artificial Sequence
  Synthetic
gtacacgcuaaaaggcatctuacaaat

SEQ ID NO: 73467 - DNA, 23 bp, Artificial Sequence
  Synthetic
ccttataaaugcgagctgugcaa

SEQ ID NO: 73468 - DNA, 20 bp, Artificial Sequence
  Synthetic
gcagatcuggcccaacgaug

SEQ ID NO: 73469 - DNA, 23 bp, Artificial Sequence
  Synthetic
acaagtgcaccugatacacucaa

SEQ ID NO: 73470 - DNA, 27 bp, Artificial Sequence
  Synthetic
tgtattgcctutacattgctctucact

SEQ ID NO: 73471 - DNA, 28 bp, Artificial Sequence
  Synthetic
tgcctgaattucagataacaaactccut

SEQ ID NO: 73472 - DNA, 25 bp, Artificial Sequence
  Synthetic
tgctagtgagugactaaccaaguct

SEQ ID NO: 73473 - DNA, 21 bp, Artificial Sequence
  Synthetic
gctgtccaugcatttgaccuc

SEQ ID NO: 73474 - DNA, 25 bp, Artificial Sequence
  Synthetic
tgctagcauccaaattaggctatut

SEQ ID NO: 73475 - DNA, 27 bp, Artificial Sequence
  Synthetic
ccaauttatgguaaagaggaggcaaga

SEQ ID NO: 73476 - DNA, 29 bp, Artificial Sequence
  Synthetic
tgagttgatgcacuaataacaggtactuc

SEQ ID NO: 73477 - DNA, 23 bp, Artificial Sequence
  Synthetic
aattcccucccaacccctctaua

SEQ ID NO: 73478 - DNA, 24 bp, Artificial Sequence
  Synthetic
ggaatgccuccagaaagcagauag

SEQ ID NO: 73479 - DNA, 28 bp, Artificial Sequence
  Synthetic
tgtaaccataugagcttgtcauacaaca

SEQ ID NO: 73480 - DNA, 22 bp, Artificial Sequence
  Synthetic
caattggugcacctctttucca

SEQ ID NO: 73481 - DNA, 19 bp, Artificial Sequence
  Synthetic
gcccuguacacggaaacgg

SEQ ID NO: 73482 - DNA, 20 bp, Artificial Sequence
  Synthetic
catggcuggaggcauaaacc

SEQ ID NO: 73483 - DNA, 20 bp, Artificial Sequence
  Synthetic
ggacacaucccugacccaac

SEQ ID NO: 73484 - DNA, 31 bp, Artificial Sequence
  Synthetic
gagttgggagtuacatattggtaatgauaca

SEQ ID NO: 73485 - DNA, 27 bp, Artificial Sequence
  Synthetic
ggctcccctauacttctgtagattuct

SEQ ID NO: 73486 - DNA, 24 bp, Artificial Sequence
  Synthetic
ccagatagttugtatggctguggt

SEQ ID NO: 73487 - DNA, 27 bp, Artificial Sequence
  Synthetic
ttgggtttuacacacacataactccut

SEQ ID NO: 73488 - DNA, 20 bp, Artificial Sequence
  Synthetic
atggccaauatgccaccuca

SEQ ID NO: 73489 - DNA, 20 bp, Artificial Sequence
  Synthetic
ctctgctucccaggcctuac

SEQ ID NO: 73490 - DNA, 22 bp, Artificial Sequence
  Synthetic
cttgccugccctgcattttauc

SEQ ID NO: 73491 - DNA, 28 bp, Artificial Sequence
  Synthetic
gaggaaaaccaugagcagaaatttugaa

SEQ ID NO: 73492 - DNA, 24 bp, Artificial Sequence
  Synthetic
tcacaggctuaaccaatacgtgut

SEQ ID NO: 73493 - DNA, 28 bp, Artificial Sequence
  Synthetic
cttcgaagatccuttagtccttcaaguc

SEQ ID NO: 73494 - DNA, 27 bp, Artificial Sequence
  Synthetic
gtgtttatgaugcacttccatugacaa

SEQ ID NO: 73495 - DNA, 27 bp, Artificial Sequence
  Synthetic
gaaacaggtagaaauagcccatgucat

SEQ ID NO: 73496 - DNA, 23 bp, Artificial Sequence
  Synthetic
agacgaaagcaucaacacuccat

SEQ ID NO: 73497 - DNA, 23 bp, Artificial Sequence
  Synthetic
tgcagtgugagaagtgtaaccug

SEQ ID NO: 73498 - DNA, 26 bp, Artificial Sequence
  Synthetic
gatacttgacuaccatgttcagcugt

SEQ ID NO: 73499 - DNA, 24 bp, Artificial Sequence
  Synthetic
ctctggcugcaaagttatctgcua

SEQ ID NO: 73500 - DNA, 30 bp, Artificial Sequence
  Synthetic
cttacattgcattutaaaagacatgcauca

SEQ ID NO: 73501 - DNA, 27 bp, Artificial Sequence
  Synthetic
ttcccttaagaucacgtactgttucac

SEQ ID NO: 73502 - DNA, 27 bp, Artificial Sequence
  Synthetic
gcaataaagugtcattgtcgugaaaca

SEQ ID NO: 73503 - DNA, 24 bp, Artificial Sequence
  Synthetic
tcutcaactacactucccagacct

SEQ ID NO: 73504 - DNA, 27 bp, Artificial Sequence
  Synthetic
catctctgtatauggatgcctgttuct

SEQ ID NO: 73505 - DNA, 27 bp, Artificial Sequence
  Synthetic
ccttacatccuggttccagttttctuc

SEQ ID NO: 73506 - DNA, 24 bp, Artificial Sequence
  Synthetic
ggagacggagaaaautctggagut

SEQ ID NO: 73507 - DNA, 28 bp, Artificial Sequence
  Synthetic
ctacagaaaagucaggttttgtgtgtut

SEQ ID NO: 73508 - DNA, 25 bp, Artificial Sequence
  Synthetic
gctcttttaatugcccttctgtuca

SEQ ID NO: 73509 - DNA, 21 bp, Artificial Sequence
  Synthetic
gagttggcugcagtctgguat

SEQ ID NO: 73510 - DNA, 22 bp, Artificial Sequence
  Synthetic
gctggctttugtgacggaaaug

SEQ ID NO: 73511 - DNA, 24 bp, Artificial Sequence
  Synthetic
ctcgtagggagaaucttcctcuct

SEQ ID NO: 73512 - DNA, 18 bp, Artificial Sequence
  Synthetic
ccctggucgggaactuga

SEQ ID NO: 73513 - DNA, 19 bp, Artificial Sequence
  Synthetic
agcaggcagcaugtcugag

SEQ ID NO: 73514 - DNA, 22 bp, Artificial Sequence
  Synthetic
caggaccagaautctucccaga

SEQ ID NO: 73515 - DNA, 20 bp, Artificial Sequence
  Synthetic
ggagcuggcaggacttccua

SEQ ID NO: 73516 - DNA, 27 bp, Artificial Sequence
  Synthetic
gggtagaaaacaaacugattccttcug

SEQ ID NO: 73517 - DNA, 24 bp, Artificial Sequence
  Synthetic
ttgggatctgcugaagagctatug

SEQ ID NO: 73518 - DNA, 23 bp, Artificial Sequence
  Synthetic
cctggattugcaggcatgauaaa

SEQ ID NO: 73519 - DNA, 24 bp, Artificial Sequence
  Synthetic
ccaggaggaaaauttcgaccauct

SEQ ID NO: 73520 - DNA, 22 bp, Artificial Sequence
  Synthetic
caacucccaacaauagggcagt

SEQ ID NO: 73521 - DNA, 21 bp, Artificial Sequence
  Synthetic
ctccagcugctcctgagauag

SEQ ID NO: 73522 - DNA, 23 bp, Artificial Sequence
  Synthetic
ccagatgaugtgccaaaaauccc

SEQ ID NO: 73523 - DNA, 22 bp, Artificial Sequence
  Synthetic
gctgctgcugaaacatctctuc

SEQ ID NO: 73524 - DNA, 21 bp, Artificial Sequence
  Synthetic
gggcttttugccactccttug

SEQ ID NO: 73525 - DNA, 26 bp, Artificial Sequence
  Synthetic
agtactgccugaatttgtcatggtua

SEQ ID NO: 73526 - DNA, 20 bp, Artificial Sequence
  Synthetic
ccccacacugggagagaauc

SEQ ID NO: 73527 - DNA, 26 bp, Artificial Sequence
  Synthetic
actttgtgcucctgtgaattcttuct

SEQ ID NO: 73528 - DNA, 21 bp, Artificial Sequence
  Synthetic
ccaaacccccaaggautguct

SEQ ID NO: 73529 - DNA, 21 bp, Artificial Sequence
  Synthetic
ggttatucccaggctccaugt

SEQ ID NO: 73530 - DNA, 20 bp, Artificial Sequence
  Synthetic
tgcugaaatuacgcccaggt

SEQ ID NO: 73531 - DNA, 20 bp, Artificial Sequence
  Synthetic
gatuccgcaagccactgtug

SEQ ID NO: 73532 - DNA, 23 bp, Artificial Sequence
  Synthetic
gctgaccgtuctggaagatctug

SEQ ID NO: 73533 - DNA, 23 bp, Artificial Sequence
  Synthetic
gattccttctuccctgctcctut

SEQ ID NO: 73534 - DNA, 18 bp, Artificial Sequence
  Synthetic
cattcauggccgccucct

SEQ ID NO: 73535 - DNA, 24 bp, Artificial Sequence
  Synthetic
gcaatgcctuacgcttttcacuaa

SEQ ID NO: 73536 - DNA, 23 bp, Artificial Sequence
  Synthetic
gatgaacaggaugatuccaggct

SEQ ID NO: 73537 - DNA, 22 bp, Artificial Sequence
  Synthetic
cccacuaggaaccaucccaaac

SEQ ID NO: 73538 - DNA, 23 bp, Artificial Sequence
  Synthetic
tggaguacagggactucagacat

SEQ ID NO: 73539 - DNA, 27 bp, Artificial Sequence
  Synthetic
acagtgtuaggagactttctguagaca

SEQ ID NO: 73540 - DNA, 23 bp, Artificial Sequence
  Synthetic
gaccattccutcccatgtcucag

SEQ ID NO: 73541 - DNA, 21 bp, Artificial Sequence
  Synthetic
ctgaacuggaggagctgtgut

SEQ ID NO: 73542 - DNA, 24 bp, Artificial Sequence
  Synthetic
actacctcucaacccttccaguaa

SEQ ID NO: 73543 - DNA, 20 bp, Artificial Sequence
  Synthetic
cccagcautggtgacuggac

SEQ ID NO: 73544 - DNA, 27 bp, Artificial Sequence
  Synthetic
ttgtactgtuagtggatgtcuagggaa

SEQ ID NO: 73545 - DNA, 28 bp, Artificial Sequence
  Synthetic
gcaatttgcagtutagttgtctccttug

SEQ ID NO: 73546 - DNA, 22 bp, Artificial Sequence
  Synthetic
cagcaagaagagacgaugccua

SEQ ID NO: 73547 - DNA, 26 bp, Artificial Sequence
  Synthetic
tgtcccttccaccuatgtagtctuac

SEQ ID NO: 73548 - DNA, 25 bp, Artificial Sequence
  Synthetic
tggtgcataaaugtaccactgagut

SEQ ID NO: 73549 - DNA, 26 bp, Artificial Sequence
  Synthetic
gcattcagaauccgcacaaagaatut

SEQ ID NO: 73550 - DNA, 27 bp, Artificial Sequence
  Synthetic
aggctaaaagauggtgaattguggaat

SEQ ID NO: 73551 - DNA, 24 bp, Artificial Sequence
  Synthetic
ttccataaggcuttgttcagguga

SEQ ID NO: 73552 - DNA, 20 bp, Artificial Sequence
  Synthetic
gtgccautgcagugcagaag

SEQ ID NO: 73553 - DNA, 18 bp, Artificial Sequence
  Synthetic
cgccgcaucatguccaca

SEQ ID NO: 73554 - DNA, 25 bp, Artificial Sequence
  Synthetic
gggttttugacactacatuccaaag

SEQ ID NO: 73555 - DNA, 21 bp, Artificial Sequence
  Synthetic
ctgaggcagcaauctgugaga

SEQ ID NO: 73556 - DNA, 21 bp, Artificial Sequence
  Synthetic
cutggagatgcuccgggaaaa

SEQ ID NO: 73557 - DNA, 22 bp, Artificial Sequence
  Synthetic
caaactgcccagugtaggaguc

SEQ ID NO: 73558 - DNA, 20 bp, Artificial Sequence
  Synthetic
cccaccctutgagccaacua

SEQ ID NO: 73559 - DNA, 27 bp, Artificial Sequence
  Synthetic
tgacttgugaaaccaatgagttcauca

SEQ ID NO: 73560 - DNA, 21 bp, Artificial Sequence
  Synthetic
tccauaccccgagagcattug

SEQ ID NO: 73561 - DNA, 23 bp, Artificial Sequence
  Synthetic
acattgttgucctggatgcugag

SEQ ID NO: 73562 - DNA, 21 bp, Artificial Sequence
  Synthetic
tggacauctcggtaucaccgt

SEQ ID NO: 73563 - DNA, 26 bp, Artificial Sequence
  Synthetic
cagtcagtutctaagttcuccacaca

SEQ ID NO: 73564 - DNA, 22 bp, Artificial Sequence
  Synthetic
ggtctuggaaacccucagcaaa

SEQ ID NO: 73565 - DNA, 20 bp, Artificial Sequence
  Synthetic
cgggttctutcggtcacuga

SEQ ID NO: 73566 - DNA, 23 bp, Artificial Sequence
  Synthetic
ttgtatagcacuatggtgcgcut

SEQ ID NO: 73567 - DNA, 20 bp, Artificial Sequence
  Synthetic
ccaggaggutgccgatacug

SEQ ID NO: 73568 - DNA, 17 bp, Artificial Sequence
  Synthetic
cgcccucggagcugaag

SEQ ID NO: 73569 - DNA, 18 bp, Artificial Sequence
  Synthetic
ccgtccugcagctcctut

SEQ ID NO: 73570 - DNA, 20 bp, Artificial Sequence
  Synthetic
gagccggaccugaagaacuc

SEQ ID NO: 73571 - DNA, 17 bp, Artificial Sequence
  Synthetic
ggtugcccgaagccgua

SEQ ID NO: 73572 - DNA, 19 bp, Artificial Sequence
  Synthetic
ggcccgcccugaacaauaa

SEQ ID NO: 73573 - DNA, 17 bp, Artificial Sequence
  Synthetic
ctccggccguagggtug

SEQ ID NO: 73574 - DNA, 17 bp, Artificial Sequence
  Synthetic
ggctucgggcaacccua

SEQ ID NO: 73575 - DNA, 20 bp, Artificial Sequence
  Synthetic
ccgtggtcgugagagttcug

SEQ ID NO: 73576 - DNA, 21 bp, Artificial Sequence
  Synthetic
gccguctuccaccaacaacat

SEQ ID NO: 73577 - DNA, 25 bp, Artificial Sequence
  Synthetic
gtagtaggagtugtactggtggtug

SEQ ID NO: 73578 - DNA, 23 bp, Artificial Sequence
  Synthetic
gcctcuctgagtguggagagaaa

SEQ ID NO: 73579 - DNA, 21 bp, Artificial Sequence
  Synthetic
tcggagacugacaccagguat

SEQ ID NO: 73580 - DNA, 21 bp, Artificial Sequence
  Synthetic
cagttcccccuttgtcaccua

SEQ ID NO: 73581 - DNA, 25 bp, Artificial Sequence
  Synthetic
gggtctcttuatcatggacttucac

SEQ ID NO: 73582 - DNA, 21 bp, Artificial Sequence
  Synthetic
ggccgugaactcctcaucaaa

SEQ ID NO: 73583 - DNA, 21 bp, Artificial Sequence
  Synthetic
cttgagcacacutgagggugt

SEQ ID NO: 73584 - DNA, 21 bp, Artificial Sequence
  Synthetic
gcttutgtggccuaccagagt

SEQ ID NO: 73585 - DNA, 20 bp, Artificial Sequence
  Synthetic
ccctccauagggccaucaag

SEQ ID NO: 73586 - DNA, 26 bp, Artificial Sequence
  Synthetic
gatgaugatgatgacugggaagacat

SEQ ID NO: 73587 - DNA, 25 bp, Artificial Sequence
  Synthetic
tttgagcaguagatgacacuggaag

SEQ ID NO: 73588 - DNA, 22 bp, Artificial Sequence
  Synthetic
caaatcucccaaggaccuagca

SEQ ID NO: 73589 - DNA, 20 bp, Artificial Sequence
  Synthetic
atccaugggccggacauaag

SEQ ID NO: 73590 - DNA, 23 bp, Artificial Sequence
  Synthetic
ctggaguaaaactgcggucaaaa

SEQ ID NO: 73591 - DNA, 26 bp, Artificial Sequence
  Synthetic
tccattuacaaaccctcttctuggaa

SEQ ID NO: 73592 - DNA, 24 bp, Artificial Sequence
  Synthetic
acagactgtcutccagtgtcauct

SEQ ID NO: 73593 - DNA, 28 bp, Artificial Sequence
  Synthetic
ggcaatgatgauttgctatggttttuct

SEQ ID NO: 73594 - DNA, 23 bp, Artificial Sequence
  Synthetic
tgtggagauacaggcctgatuca

SEQ ID NO: 73595 - DNA, 21 bp, Artificial Sequence
  Synthetic
cttcctgguggcagagaaucc

SEQ ID NO: 73596 - DNA, 23 bp, Artificial Sequence
  Synthetic
cagtcctgtucctatgggtucat

SEQ ID NO: 73597 - DNA, 26 bp, Artificial Sequence
  Synthetic
aactggaguacacaaggcaatgttua

SEQ ID NO: 73598 - DNA, 25 bp, Artificial Sequence
  Synthetic
gatctcatggaugatctgactuggg

SEQ ID NO: 73599 - DNA, 20 bp, Artificial Sequence
  Synthetic
ctttcaccccacugcaggua

SEQ ID NO: 73600 - DNA, 21 bp, Artificial Sequence
  Synthetic
catgcatugtctggctuacgg

SEQ ID NO: 73601 - DNA, 22 bp, Artificial Sequence
  Synthetic
tggcactcacugtcagtgttut

SEQ ID NO: 73602 - DNA, 25 bp, Artificial Sequence
  Synthetic
agctgauagaggagaagggtatugg

SEQ ID NO: 73603 - DNA, 20 bp, Artificial Sequence
  Synthetic
cgtgtcctuggtgctagugg

SEQ ID NO: 73604 - DNA, 24 bp, Artificial Sequence
  Synthetic
agcagatutgtgcaaaucaagcaa

SEQ ID NO: 73605 - DNA, 21 bp, Artificial Sequence
  Synthetic
agccctcguctatctguagca

SEQ ID NO: 73606 - DNA, 22 bp, Artificial Sequence
  Synthetic
aagugttgcaaugcagcagaag

SEQ ID NO: 73607 - DNA, 23 bp, Artificial Sequence
  Synthetic
catcttcagtutggtgagctugg

SEQ ID NO: 73608 - DNA, 24 bp, Artificial Sequence
  Synthetic
ctgacuaccacccuaggaaagaca

SEQ ID NO: 73609 - DNA, 27 bp, Artificial Sequence
  Synthetic
agaacatttccugggaaataagagcut

SEQ ID NO: 73610 - DNA, 21 bp, Artificial Sequence
  Synthetic
tgacccacucaucccaagaca

SEQ ID NO: 73611 - DNA, 22 bp, Artificial Sequence
  Synthetic
ctcccttccugcctcattucag

SEQ ID NO: 73612 - DNA, 21 bp, Artificial Sequence
  Synthetic
gctcctucccggttttgtuct

SEQ ID NO: 73613 - DNA, 25 bp, Artificial Sequence
  Synthetic
ttcagcaatcauaccttgtcctcug

SEQ ID NO: 73614 - DNA, 21 bp, Artificial Sequence
  Synthetic
gctgctggugtggaagttgua

SEQ ID NO: 73615 - DNA, 22 bp, Artificial Sequence
  Synthetic
gagtcatcucgttggagtuccc

SEQ ID NO: 73616 - DNA, 26 bp, Artificial Sequence
  Synthetic
ggcugaaacaccaagacuaggaaaaa

SEQ ID NO: 73617 - DNA, 28 bp, Artificial Sequence
  Synthetic
gaaggttggguttctctttctaagucat

SEQ ID NO: 73618 - DNA, 28 bp, Artificial Sequence
  Synthetic
cactgctgugaaagatcagaauaaacat

SEQ ID NO: 73619 - DNA, 26 bp, Artificial Sequence
  Synthetic
atttgctggcugctaaattatgcaut

SEQ ID NO: 73620 - DNA, 22 bp, Artificial Sequence
  Synthetic
gactugaaagtgccugccaaag

SEQ ID NO: 73621 - DNA, 24 bp, Artificial Sequence
  Synthetic
cggacattutcatctcaaauccgt

SEQ ID NO: 73622 - DNA, 21 bp, Artificial Sequence
  Synthetic
agtcugaggaaccccaggtut

SEQ ID NO: 73623 - DNA, 28 bp, Artificial Sequence
  Synthetic
caatagcgtggaugtgtttttctttcuc

SEQ ID NO: 73624 - DNA, 29 bp, Artificial Sequence
  Synthetic
tcttgtttctcaguactcttggtttctug

SEQ ID NO: 73625 - DNA, 22 bp, Artificial Sequence
  Synthetic
atccacttcugctgcactucat

SEQ ID NO: 73626 - DNA, 17 bp, Artificial Sequence
  Synthetic
ctgcagguggtgccugt

SEQ ID NO: 73627 - DNA, 26 bp, Artificial Sequence
  Synthetic
gcatattgattuctctgtgtggtuca

SEQ ID NO: 73628 - DNA, 28 bp, Artificial Sequence
  Synthetic
taggatgaagtacuctccttagaccuaa

SEQ ID NO: 73629 - DNA, 25 bp, Artificial Sequence
  Synthetic
ctcaggctggautttgatgatgaug

SEQ ID NO: 73630 - DNA, 28 bp, Artificial Sequence
  Synthetic
acctcaaaaattuactgttcccttcucc

SEQ ID NO: 73631 - DNA, 24 bp, Artificial Sequence
  Synthetic
ttccgguagcttgtgtugagaaat

SEQ ID NO: 73632 - DNA, 21 bp, Artificial Sequence
  Synthetic
gcctcagugattcugccagag

SEQ ID NO: 73633 - DNA, 24 bp, Artificial Sequence
  Synthetic
tgcattctacaugtgcatgttugg

SEQ ID NO: 73634 - DNA, 27 bp, Artificial Sequence
  Synthetic
gttttggctgucttaggaactacauga

SEQ ID NO: 73635 - DNA, 22 bp, Artificial Sequence
  Synthetic
gagutcatcucccgacacaaca

SEQ ID NO: 73636 - DNA, 25 bp, Artificial Sequence
  Synthetic
ctggcactucaggtatcttcuaact

SEQ ID NO: 73637 - DNA, 26 bp, Artificial Sequence
  Synthetic
tcaccaatgaaauccttttcgucaga

SEQ ID NO: 73638 - DNA, 28 bp, Artificial Sequence
  Synthetic
tgaagataccagauccttggagattuct

SEQ ID NO: 73639 - DNA, 28 bp, Artificial Sequence
  Synthetic
attctgtgacttcugaaggtgatcttut

SEQ ID NO: 73640 - DNA, 21 bp, Artificial Sequence
  Synthetic
catgtccacuctggccugaaa

SEQ ID NO: 73641 - DNA, 22 bp, Artificial Sequence
  Synthetic
acugattctccugggacacaca

SEQ ID NO: 73642 - DNA, 25 bp, Artificial Sequence
  Synthetic
gaggugggaggagaaatuagagaac

SEQ ID NO: 73643 - DNA, 26 bp, Artificial Sequence
  Synthetic
gcttgtgattctuttcctctctccua

SEQ ID NO: 73644 - DNA, 29 bp, Artificial Sequence
  Synthetic
gaagaaaatagaacuaggctgggaaguaa

SEQ ID NO: 73645 - DNA, 26 bp, Artificial Sequence
  Synthetic
gttctggtugagatgaaaggatucca

SEQ ID NO: 73646 - DNA, 23 bp, Artificial Sequence
  Synthetic
agttgctcttugtgatggcauga

SEQ ID NO: 73647 - DNA, 24 bp, Artificial Sequence
  Synthetic
ggcttgtgtugaggctgatacaut

SEQ ID NO: 73648 - DNA, 27 bp, Artificial Sequence
  Synthetic
gatccacaaaagugaagatacccucaa

SEQ ID NO: 73649 - DNA, 28 bp, Artificial Sequence
  Synthetic
accatgaggagauaggaaatacatcugt

SEQ ID NO: 73650 - DNA, 27 bp, Artificial Sequence
  Synthetic
acagaaugtctgagaauagcaaaacca

SEQ ID NO: 73651 - DNA, 28 bp, Artificial Sequence
  Synthetic
gcgacagtaatcugttaagccatttaut

SEQ ID NO: 73652 - DNA, 22 bp, Artificial Sequence
  Synthetic
gaggcugaaatcaaaaguggct

SEQ ID NO: 73653 - DNA, 24 bp, Artificial Sequence
  Synthetic
cctgcttgttcugactcctgttut

SEQ ID NO: 73654 - DNA, 20 bp, Artificial Sequence
  Synthetic
ggcgugaaccgaacagauga

SEQ ID NO: 73655 - DNA, 23 bp, Artificial Sequence
  Synthetic
aatgtgattcugcatgcttggug

SEQ ID NO: 73656 - DNA, 20 bp, Artificial Sequence
  Synthetic
cctcugcaggacagtgtugt

SEQ ID NO: 73657 - DNA, 21 bp, Artificial Sequence
  Synthetic
ctgactttggucagccagtug

SEQ ID NO: 73658 - DNA, 24 bp, Artificial Sequence
  Synthetic
gggtatgtcautgaggaccucaaa

SEQ ID NO: 73659 - DNA, 23 bp, Artificial Sequence
  Synthetic
ccttcccaccutgaggatagtuc

SEQ ID NO: 73660 - DNA, 23 bp, Artificial Sequence
  Synthetic
agguatatcagcuggacagagca

SEQ ID NO: 73661 - DNA, 26 bp, Artificial Sequence
  Synthetic
tcagatggcacutgagaaagactuac

SEQ ID NO: 73662 - DNA, 25 bp, Artificial Sequence
  Synthetic
ctttatgtcccugagtgcagaguat

SEQ ID NO: 73663 - DNA, 18 bp, Artificial Sequence
  Synthetic
caactgcugctgcugagg

SEQ ID NO: 73664 - DNA, 21 bp, Artificial Sequence
  Synthetic
gcacctgguttgccaatgaug

SEQ ID NO: 73665 - DNA, 22 bp, Artificial Sequence
  Synthetic
cctccuccccgctttttcuaag

SEQ ID NO: 73666 - DNA, 22 bp, Artificial Sequence
  Synthetic
ccgaggaggguctctcttctuc

SEQ ID NO: 73667 - DNA, 29 bp, Artificial Sequence
  Synthetic
gcaatatctatucacccaaggaaacaauc

SEQ ID NO: 73668 - DNA, 32 bp, Artificial Sequence
  Synthetic
caataattgtgttcccutaagatagactguga

SEQ ID NO: 73669 - DNA, 28 bp, Artificial Sequence
  Synthetic
gcgtagtttgatucttttgtttctccut

SEQ ID NO: 73670 - DNA, 22 bp, Artificial Sequence
  Synthetic
caacaaacaaauggcagcugga

SEQ ID NO: 73671 - DNA, 24 bp, Artificial Sequence
  Synthetic
gggaggatcuttggattcagaaug

SEQ ID NO: 73672 - DNA, 20 bp, Artificial Sequence
  Synthetic
cagacccagacaguctcuga

SEQ ID NO: 73673 - DNA, 20 bp, Artificial Sequence
  Synthetic
cttuccccacgagccuacac

SEQ ID NO: 73674 - DNA, 24 bp, Artificial Sequence
  Synthetic
cagagccagaaggaauctguacaa

SEQ ID NO: 73675 - DNA, 20 bp, Artificial Sequence
  Synthetic
ccctgcugggtcagtctuag

SEQ ID NO: 73676 - DNA, 19 bp, Artificial Sequence
  Synthetic
cgacagugccacgagucag

SEQ ID NO: 73677 - DNA, 21 bp, Artificial Sequence
  Synthetic
ttccaacgguttgcctttgug

SEQ ID NO: 73678 - DNA, 21 bp, Artificial Sequence
  Synthetic
ggagatguacagcgtgccaua

SEQ ID NO: 73679 - DNA, 23 bp, Artificial Sequence
  Synthetic
gataggcatugccatactggtug

SEQ ID NO: 73680 - DNA, 22 bp, Artificial Sequence
  Synthetic
agcctaugggtgctctauccaa

SEQ ID NO: 73681 - DNA, 19 bp, Artificial Sequence
  Synthetic
cacaccucggacacaccug

SEQ ID NO: 73682 - DNA, 28 bp, Artificial Sequence
  Synthetic
tggagctuaaccagtgatagaacuagaa

SEQ ID NO: 73683 - DNA, 26 bp, Artificial Sequence
  Synthetic
agctacacatugaagcttttgtcuga

SEQ ID NO: 73684 - DNA, 23 bp, Artificial Sequence
  Synthetic
gcatatcactucgtgcctctuct

SEQ ID NO: 73685 - DNA, 21 bp, Artificial Sequence
  Synthetic
cactcccaugtgatagugcca

SEQ ID NO: 73686 - DNA, 23 bp, Artificial Sequence
  Synthetic
gatgttccccuctacaaggaugg

SEQ ID NO: 73687 - DNA, 20 bp, Artificial Sequence
  Synthetic
ctcagccuggauccgagaag

SEQ ID NO: 73688 - DNA, 21 bp, Artificial Sequence
  Synthetic
gtcaaggtuctcaggcuccat

SEQ ID NO: 73689 - DNA, 25 bp, Artificial Sequence
  Synthetic
caaagccugcaactggaagaaauac

SEQ ID NO: 73690 - DNA, 23 bp, Artificial Sequence
  Synthetic
ccttccccucagcaagatgtaua

SEQ ID NO: 73691 - DNA, 21 bp, Artificial Sequence
  Synthetic
atgttttgcugggcattggug

SEQ ID NO: 73692 - DNA, 18 bp, Artificial Sequence
  Synthetic
aagucuccggcacagcag

SEQ ID NO: 73693 - DNA, 22 bp, Artificial Sequence
  Synthetic
ccttgggcutgtcttuggaagt

SEQ ID NO: 73694 - DNA, 28 bp, Artificial Sequence
  Synthetic
accggctgtaaucatgaattagaaauga

SEQ ID NO: 73695 - DNA, 25 bp, Artificial Sequence
  Synthetic
ctacuttcccaaagaucaggcagaa

SEQ ID NO: 73696 - DNA, 19 bp, Artificial Sequence
  Synthetic
cuatggcucccgagaccag

SEQ ID NO: 73697 - DNA, 20 bp, Artificial Sequence
  Synthetic
tgggccugagagagcctuag

SEQ ID NO: 73698 - DNA, 22 bp, Artificial Sequence
  Synthetic
acagcactatutggctccagut

SEQ ID NO: 73699 - DNA, 28 bp, Artificial Sequence
  Synthetic
cagccatactatuaatcccttgtccaua

SEQ ID NO: 73700 - DNA, 23 bp, Artificial Sequence
  Synthetic
cgaattcccagutgagtctgugg

SEQ ID NO: 73701 - DNA, 26 bp, Artificial Sequence
  Synthetic
ctgctcaaaggauttcctcttcugat

SEQ ID NO: 73702 - DNA, 21 bp, Artificial Sequence
  Synthetic
gctgtugagcacgatgaacut

SEQ ID NO: 73703 - DNA, 21 bp, Artificial Sequence
  Synthetic
gagcccccagaaauctgacug

SEQ ID NO: 73704 - DNA, 20 bp, Artificial Sequence
  Synthetic
ggcugtacucaccagggact

SEQ ID NO: 73705 - DNA, 20 bp, Artificial Sequence
  Synthetic
acaccgccagccucttatuc

SEQ ID NO: 73706 - DNA, 25 bp, Artificial Sequence
  Synthetic
cttggatttuggcaaagcctttuct

SEQ ID NO: 73707 - DNA, 22 bp, Artificial Sequence
  Synthetic
gagatcagguctctctggguca

SEQ ID NO: 73708 - DNA, 20 bp, Artificial Sequence
  Synthetic
ccautccagttuggccgaga

SEQ ID NO: 73709 - DNA, 28 bp, Artificial Sequence
  Synthetic
cctgttggcauaattataggtcatguca

SEQ ID NO: 73710 - DNA, 22 bp, Artificial Sequence
  Synthetic
catacaggcaucagctgaggut

SEQ ID NO: 73711 - DNA, 22 bp, Artificial Sequence
  Synthetic
cctctgatcugtgtgcagcaut

SEQ ID NO: 73712 - DNA, 21 bp, Artificial Sequence
  Synthetic
cttactgcugcaggactcugt

SEQ ID NO: 73713 - DNA, 20 bp, Artificial Sequence
  Synthetic
cutgugacaaggccagcaaa

SEQ ID NO: 73714 - DNA, 21 bp, Artificial Sequence
  Synthetic
acaggagggucaggtcgatut

SEQ ID NO: 73715 - DNA, 20 bp, Artificial Sequence
  Synthetic
ccaggaccaccagugacauc

SEQ ID NO: 73716 - DNA, 20 bp, Artificial Sequence
  Synthetic
acagggagguggctguacat

SEQ ID NO: 73717 - DNA, 22 bp, Artificial Sequence
  Synthetic
ccccaagacaucatggcctauc

SEQ ID NO: 73718 - DNA, 27 bp, Artificial Sequence
  Synthetic
caagttgaagugagatggtcaggaaua

SEQ ID NO: 73719 - DNA, 23 bp, Artificial Sequence
  Synthetic
gaattcaagguggaggagccaut

SEQ ID NO: 73720 - DNA, 23 bp, Artificial Sequence
  Synthetic
cgtggctutcattttggaucaga

SEQ ID NO: 73721 - DNA, 26 bp, Artificial Sequence
  Synthetic
aagatgttttgttugtcaccggttut

SEQ ID NO: 73722 - DNA, 20 bp, Artificial Sequence
  Synthetic
tgatgggaacuggaccucct

SEQ ID NO: 73723 - DNA, 28 bp, Artificial Sequence
  Synthetic
tgactctugaagaaatccctagugagaa

SEQ ID NO: 73724 - DNA, 21 bp, Artificial Sequence
  Synthetic
gtagaactgcucctccagcuc

SEQ ID NO: 73725 - DNA, 21 bp, Artificial Sequence
  Synthetic
gaguaccctctguccaaagca

SEQ ID NO: 73726 - DNA, 20 bp, Artificial Sequence
  Synthetic
tgaggaucaucacggagggt

SEQ ID NO: 73727 - DNA, 24 bp, Artificial Sequence
  Synthetic
gaugagttccucagaaggcagaag

SEQ ID NO: 73728 - DNA, 21 bp, Artificial Sequence
  Synthetic
ccgcttaauagccctcuggac

SEQ ID NO: 73729 - DNA, 28 bp, Artificial Sequence
  Synthetic
gatactgatgauaagcaaggactgtcut

SEQ ID NO: 73730 - DNA, 20 bp, Artificial Sequence
  Synthetic
gttcuccaccaccucacgac

SEQ ID NO: 73731 - DNA, 22 bp, Artificial Sequence
  Synthetic
ggccggtguctttcctctttut

SEQ ID NO: 73732 - DNA, 22 bp, Artificial Sequence
  Synthetic
cacacttcuccctggccauaat

SEQ ID NO: 73733 - DNA, 22 bp, Artificial Sequence
  Synthetic
caagacggcutccaggtactua

SEQ ID NO: 73734 - DNA, 22 bp, Artificial Sequence
  Synthetic
gggagtagaugatggtcuccgt

SEQ ID NO: 73735 - DNA, 24 bp, Artificial Sequence
  Synthetic
gatcggacaucgagttctguagag

SEQ ID NO: 73736 - DNA, 21 bp, Artificial Sequence
  Synthetic
cuctgatcatucccggaggag

SEQ ID NO: 73737 - DNA, 22 bp, Artificial Sequence
  Synthetic
ctaagcaggaucguccccaaat

SEQ ID NO: 73738 - DNA, 18 bp, Artificial Sequence
  Synthetic
ctggctucaggtgugggt

SEQ ID NO: 73739 - DNA, 21 bp, Artificial Sequence
  Synthetic
caucgtcaaccuggagagcaa

SEQ ID NO: 73740 - DNA, 20 bp, Artificial Sequence
  Synthetic
tggtccaggutgttgctguc

SEQ ID NO: 73741 - DNA, 21 bp, Artificial Sequence
  Synthetic
gacacagtacucgcagtgcut

SEQ ID NO: 73742 - DNA, 26 bp, Artificial Sequence
  Synthetic
gcttcctgtacutgtccttttcgaut

SEQ ID NO: 73743 - DNA, 20 bp, Artificial Sequence
  Synthetic
gggttgggaugatgcctguc

SEQ ID NO: 73744 - DNA, 17 bp, Artificial Sequence
  Synthetic
gggtcgcuctcgtggug

SEQ ID NO: 73745 - DNA, 19 bp, Artificial Sequence
  Synthetic
agcucaagcgccacaugaa

SEQ ID NO: 73746 - DNA, 17 bp, Artificial Sequence
  Synthetic
ccggccutgtgcatgug

SEQ ID NO: 73747 - DNA, 19 bp, Artificial Sequence
  Synthetic
gcaagtcgugcgagttcug

SEQ ID NO: 73748 - DNA, 18 bp, Artificial Sequence
  Synthetic
cgagtcgauggccauggg

SEQ ID NO: 73749 - DNA, 17 bp, Artificial Sequence
  Synthetic
acgccgccuctctucag

SEQ ID NO: 73750 - DNA, 18 bp, Artificial Sequence
  Synthetic
ccatctccucggcacuga

SEQ ID NO: 73751 - DNA, 18 bp, Artificial Sequence
  Synthetic
tutccugggcgacagcaa

SEQ ID NO: 73752 - DNA, 18 bp, Artificial Sequence
  Synthetic
tcaugcgcagcaggtuga

SEQ ID NO: 73753 - DNA, 19 bp, Artificial Sequence
  Synthetic
gcttccgcauctaccugga

SEQ ID NO: 73754 - DNA, 24 bp, Artificial Sequence
  Synthetic
attgctctggaacutgaaggtcut

SEQ ID NO: 73755 - DNA, 17 bp, Artificial Sequence
  Synthetic
gcggcaacccuaugcac

SEQ ID NO: 73756 - DNA, 18 bp, Artificial Sequence
  Synthetic
gcccgugcgtcttcaugt

SEQ ID NO: 73757 - DNA, 18 bp, Artificial Sequence
  Synthetic
cagcgacacgugcgagua

SEQ ID NO: 73758 - DNA, 21 bp, Artificial Sequence
  Synthetic
gctgucgcccaggaaatucat

SEQ ID NO: 73759 - DNA, 19 bp, Artificial Sequence
  Synthetic
cttcaacagcgcguggtuc

SEQ ID NO: 73760 - DNA, 18 bp, Artificial Sequence
  Synthetic
gtucaggagccggugcat

SEQ ID NO: 73761 - DNA, 18 bp, Artificial Sequence
  Synthetic
gtgcctucgaccgaguca

SEQ ID NO: 73762 - DNA, 19 bp, Artificial Sequence
  Synthetic
cagggtgccugcctcauag

SEQ ID NO: 73763 - DNA, 20 bp, Artificial Sequence
  Synthetic
cggtggaaccugacatgugg

SEQ ID NO: 73764 - DNA, 19 bp, Artificial Sequence
  Synthetic
tgaacacctugccgcagua

SEQ ID NO: 73765 - DNA, 17 bp, Artificial Sequence
  Synthetic
cagccugcgcttcucca

SEQ ID NO: 73766 - DNA, 17 bp, Artificial Sequence
  Synthetic
acgagugcucggacgac

SEQ ID NO: 73767 - DNA, 19 bp, Artificial Sequence
  Synthetic
gcucatcccguccgagaac

SEQ ID NO: 73768 - DNA, 18 bp, Artificial Sequence
  Synthetic
gaagccgugcgtgttcug

SEQ ID NO: 73769 - DNA, 18 bp, Artificial Sequence
  Synthetic
ccgcttcucacgctguct

SEQ ID NO: 73770 - DNA, 17 bp, Artificial Sequence
  Synthetic
gcggagcagcucctcua

SEQ ID NO: 73771 - DNA, 17 bp, Artificial Sequence
  Synthetic
ctgcgugtctccuccca

SEQ ID NO: 73772 - DNA, 21 bp, Artificial Sequence
  Synthetic
ggacagggutggaaaggctut

SEQ ID NO: 73773 - DNA, 21 bp, Artificial Sequence
  Synthetic
gcacaatgacucggcactuac

SEQ ID NO: 73774 - DNA, 20 bp, Artificial Sequence
  Synthetic
gatgaaggcacugcagccua

SEQ ID NO: 73775 - DNA, 27 bp, Artificial Sequence
  Synthetic
tgtgtatgggugactattcttggttuc

SEQ ID NO: 73776 - DNA, 27 bp, Artificial Sequence
  Synthetic
ctggaaaagaguaattcacacaagcuc

SEQ ID NO: 73777 - DNA, 28 bp, Artificial Sequence
  Synthetic
tgacacttggaguaacaattgcctttua

SEQ ID NO: 73778 - DNA, 29 bp, Artificial Sequence
  Synthetic
gagggaaagugatacuagacaagaaaact

SEQ ID NO: 73779 - DNA, 22 bp, Artificial Sequence
  Synthetic
gctttcucccactcctcuccaa

SEQ ID NO: 73780 - DNA, 23 bp, Artificial Sequence
  Synthetic
gcctacuacagagggctacagut

SEQ ID NO: 73781 - DNA, 22 bp, Artificial Sequence
  Synthetic
ggctgcuccactaatctcucag

SEQ ID NO: 73782 - DNA, 26 bp, Artificial Sequence
  Synthetic
ccatccagugacaaatcccatuacat

SEQ ID NO: 73783 - DNA, 26 bp, Artificial Sequence
  Synthetic
tgttctcgagguagtaagatctccug

SEQ ID NO: 73784 - DNA, 21 bp, Artificial Sequence
  Synthetic
tccgccaaaagaucccagaut

SEQ ID NO: 73785 - DNA, 23 bp, Artificial Sequence
  Synthetic
tggtggaagaaccutctcuaggg

SEQ ID NO: 73786 - DNA, 23 bp, Artificial Sequence
  Synthetic
ccutctggaaatuaccccgagag

SEQ ID NO: 73787 - DNA, 23 bp, Artificial Sequence
  Synthetic
aaaggugggagagcuagaggaat

SEQ ID NO: 73788 - DNA, 26 bp, Artificial Sequence
  Synthetic
gaatccagagaacacauaccatcugt

SEQ ID NO: 73789 - DNA, 20 bp, Artificial Sequence
  Synthetic
ctcctcgagauggcacaguc

SEQ ID NO: 73790 - DNA, 22 bp, Artificial Sequence
  Synthetic
ctgtccucccaaacctcaguag

SEQ ID NO: 73791 - DNA, 20 bp, Artificial Sequence
  Synthetic
ccautgtcugcaggaacggt

SEQ ID NO: 73792 - DNA, 20 bp, Artificial Sequence
  Synthetic
agttgcugcagggtagctug

SEQ ID NO: 73793 - DNA, 23 bp, Artificial Sequence
  Synthetic
ccatcaaccaugccactgtttut

SEQ ID NO: 73794 - DNA, 25 bp, Artificial Sequence
  Synthetic
agtaattcaaaugctgcuccaggaa

SEQ ID NO: 73795 - DNA, 23 bp, Artificial Sequence
  Synthetic
gagccaaaaagcutcttccctug

SEQ ID NO: 73796 - DNA, 24 bp, Artificial Sequence
  Synthetic
ctcttgacagccutacttcacuct

SEQ ID NO: 73797 - DNA, 23 bp, Artificial Sequence
  Synthetic
gaggtgaccutcaaagucagagg

SEQ ID NO: 73798 - DNA, 24 bp, Artificial Sequence
  Synthetic
gaaagugatgaugaggagcaagga

SEQ ID NO: 73799 - DNA, 22 bp, Artificial Sequence
  Synthetic
gtgaggautcaggtguggaact

SEQ ID NO: 73800 - DNA, 26 bp, Artificial Sequence
  Synthetic
ccaactgagtuccaccagctttaaut

SEQ ID NO: 73801 - DNA, 23 bp, Artificial Sequence
  Synthetic
tgctgtcagugaacattugcaag

SEQ ID NO: 73802 - DNA, 23 bp, Artificial Sequence
  Synthetic
cgctacgcaugggatcttuacat

SEQ ID NO: 73803 - DNA, 21 bp, Artificial Sequence
  Synthetic
tcaatccuggcaagaccagug

SEQ ID NO: 73804 - DNA, 22 bp, Artificial Sequence
  Synthetic
ggaaatgtucaccgcagtcuga

SEQ ID NO: 73805 - DNA, 20 bp, Artificial Sequence
  Synthetic
gguccagtacucccaacagg

SEQ ID NO: 73806 - DNA, 24 bp, Artificial Sequence
  Synthetic
ctgggtgaucagagcaatgtuaca

SEQ ID NO: 73807 - DNA, 22 bp, Artificial Sequence
  Synthetic
gtttgtgctuggtcccaactuc

SEQ ID NO: 73808 - DNA, 21 bp, Artificial Sequence
  Synthetic
gagccacagugcatcacttuc

SEQ ID NO: 73809 - DNA, 23 bp, Artificial Sequence
  Synthetic
acaaggcacaauacacagagcut

SEQ ID NO: 73810 - DNA, 27 bp, Artificial Sequence
  Synthetic
tcccactaugaaggatcctgtaaaugt

SEQ ID NO: 73811 - DNA, 23 bp, Artificial Sequence
  Synthetic
agaaacgagagccutggtttuca

SEQ ID NO: 73812 - DNA, 21 bp, Artificial Sequence
  Synthetic
cagggugaggtccctaugaca

SEQ ID NO: 73813 - DNA, 24 bp, Artificial Sequence
  Synthetic
gcatgtguggcattctuaacaact

SEQ ID NO: 73814 - DNA, 22 bp, Artificial Sequence
  Synthetic
gatcccuccagttttucccagt

SEQ ID NO: 73815 - DNA, 23 bp, Artificial Sequence
  Synthetic
tgttctcggcauttgcctuaaga

SEQ ID NO: 73816 - DNA, 23 bp, Artificial Sequence
  Synthetic
acgatgactguattggacccuca

SEQ ID NO: 73817 - DNA, 25 bp, Artificial Sequence
  Synthetic
agagtgctccugcctaaagagtaut

SEQ ID NO: 73818 - DNA, 20 bp, Artificial Sequence
  Synthetic
cggtgaguccacggauacag

SEQ ID NO: 73819 - DNA, 22 bp, Artificial Sequence
  Synthetic
gtcaccautcacctuggacagt

SEQ ID NO: 73820 - DNA, 23 bp, Artificial Sequence
  Synthetic
ttctgccagauagctgugaaaca

SEQ ID NO: 73821 - DNA, 28 bp, Artificial Sequence
  Synthetic
ggaatccatttcutccagtttccuagag

SEQ ID NO: 73822 - DNA, 26 bp, Artificial Sequence
  Synthetic
agcgtcaagaaugagaagactttugt

SEQ ID NO: 73823 - DNA, 18 bp, Artificial Sequence
  Synthetic
tcacugagcccctuccct

SEQ ID NO: 73824 - DNA, 25 bp, Artificial Sequence
  Synthetic
ggaugagaaacccaatuggaaccaa

SEQ ID NO: 73825 - DNA, 21 bp, Artificial Sequence
  Synthetic
ctcagtacuggccagcaguag

SEQ ID NO: 73826 - DNA, 27 bp, Artificial Sequence
  Synthetic
caaaaccaugaggagaatactuacgga

SEQ ID NO: 73827 - DNA, 24 bp, Artificial Sequence
  Synthetic
gtattccatcgaucgtcacacuga

SEQ ID NO: 73828 - DNA, 22 bp, Artificial Sequence
  Synthetic
ctgtccuaagcactagcagcut

SEQ ID NO: 73829 - DNA, 23 bp, Artificial Sequence
  Synthetic
tcttcttcaauccttggcacucc

SEQ ID NO: 73830 - DNA, 25 bp, Artificial Sequence
  Synthetic
aaaccaacgugttatgaaaccauca

SEQ ID NO: 73831 - DNA, 23 bp, Artificial Sequence
  Synthetic
tgactgtcuggtcatttgcaugt

SEQ ID NO: 73832 - DNA, 27 bp, Artificial Sequence
  Synthetic
aagtttagtgauacgacacaagaucgg

SEQ ID NO: 73833 - DNA, 27 bp, Artificial Sequence
  Synthetic
taattattttctgccuacccgagacua

SEQ ID NO: 73834 - DNA, 26 bp, Artificial Sequence
  Synthetic
agtctgtcccaacuacatagatucca

SEQ ID NO: 73835 - DNA, 25 bp, Artificial Sequence
  Synthetic
ggaaaacctgguagcctatgcuaag

SEQ ID NO: 73836 - DNA, 21 bp, Artificial Sequence
  Synthetic
cccgugaaaggaaacaugcaa

SEQ ID NO: 73837 - DNA, 26 bp, Artificial Sequence
  Synthetic
tgatgtggtauctatcttgguggact

SEQ ID NO: 73838 - DNA, 28 bp, Artificial Sequence
  Synthetic
cttgcatagaagacutgaaagcattugt

SEQ ID NO: 73839 - DNA, 28 bp, Artificial Sequence
  Synthetic
tcagtcttaccuagaagcactgttuact

SEQ ID NO: 73840 - DNA, 21 bp, Artificial Sequence
  Synthetic
tcatcccagucttcccuccaa

SEQ ID NO: 73841 - DNA, 22 bp, Artificial Sequence
  Synthetic
ctacagagggaucaccaugacc

SEQ ID NO: 73842 - DNA, 20 bp, Artificial Sequence
  Synthetic
atgaacgugccttgcccuaa

SEQ ID NO: 73843 - DNA, 23 bp, Artificial Sequence
  Synthetic
ttgcaguatgagtttuccccaca

SEQ ID NO: 73844 - DNA, 28 bp, Artificial Sequence
  Synthetic
tttgaatgacutatcttctgaugcacca

SEQ ID NO: 73845 - DNA, 27 bp, Artificial Sequence
  Synthetic
actcactatactguccactgctagtut

SEQ ID NO: 73846 - DNA, 28 bp, Artificial Sequence
  Synthetic
aaggccttttagauaatcccataaguga

SEQ ID NO: 73847 - DNA, 28 bp, Artificial Sequence
  Synthetic
aagaagtgttttgauccacggaaaaaut

SEQ ID NO: 73848 - DNA, 22 bp, Artificial Sequence
  Synthetic
cgtacatguccccttccactut

SEQ ID NO: 73849 - DNA, 23 bp, Artificial Sequence
  Synthetic
ctggacgaaaccccaugtcttua

SEQ ID NO: 73850 - DNA, 28 bp, Artificial Sequence
  Synthetic
tcctctctauccagaggttttgtagtut

SEQ ID NO: 73851 - DNA, 23 bp, Artificial Sequence
  Synthetic
gctgctctgaaugtcttggtcua

SEQ ID NO: 73852 - DNA, 27 bp, Artificial Sequence
  Synthetic
gtcccatacugttttcattgacuacca

SEQ ID NO: 73853 - DNA, 25 bp, Artificial Sequence
  Synthetic
cctggaaagaaaacacuctccucag

SEQ ID NO: 73854 - DNA, 22 bp, Artificial Sequence
  Synthetic
cacaccgaggacucaagaauga

SEQ ID NO: 73855 - DNA, 25 bp, Artificial Sequence
  Synthetic
gcacaucaggaaaagcactacatut

SEQ ID NO: 73856 - DNA, 21 bp, Artificial Sequence
  Synthetic
cggtgccaacuccaattuacc

SEQ ID NO: 73857 - DNA, 26 bp, Artificial Sequence
  Synthetic
ggcacttguattggtttctcugaaga

SEQ ID NO: 73858 - DNA, 28 bp, Artificial Sequence
  Synthetic
cgtggaucaaaacacttctucagaaaat

SEQ ID NO: 73859 - DNA, 29 bp, Artificial Sequence
  Synthetic
tcggttcctuggaataaataggtatcuca

SEQ ID NO: 73860 - DNA, 25 bp, Artificial Sequence
  Synthetic
tgcttttccugatgtgcctgauaaa

SEQ ID NO: 73861 - DNA, 28 bp, Artificial Sequence
  Synthetic
ggtgaaattcaucccatcatcttttuct

SEQ ID NO: 73862 - DNA, 27 bp, Artificial Sequence
  Synthetic
gaacaccaacagugatatgtactccua

SEQ ID NO: 73863 - DNA, 25 bp, Artificial Sequence
  Synthetic
cctcuacagggcccctattatuaga

SEQ ID NO: 73864 - DNA, 22 bp, Artificial Sequence
  Synthetic
gtcccaaagugcagcttgtcua

SEQ ID NO: 73865 - DNA, 26 bp, Artificial Sequence
  Synthetic
catatttttgucagggagcucaggat

SEQ ID NO: 73866 - DNA, 28 bp, Artificial Sequence
  Synthetic
gcctcttctacacaucaaatgcatguat

SEQ ID NO: 73867 - DNA, 23 bp, Artificial Sequence
  Synthetic
cctttagatucccgtgagtuggt

SEQ ID NO: 73868 - DNA, 21 bp, Artificial Sequence
  Synthetic
ctaaccccuctggaggaaugg

SEQ ID NO: 73869 - DNA, 28 bp, Artificial Sequence
  Synthetic
ctctgactttugcttgatagaggtucat

SEQ ID NO: 73870 - DNA, 28 bp, Artificial Sequence
  Synthetic
aaagatgtacaaagucctggatttcuga

SEQ ID NO: 73871 - DNA, 24 bp, Artificial Sequence
  Synthetic
ctccagggcacuttcgttatcuat

SEQ ID NO: 73872 - DNA, 22 bp, Artificial Sequence
  Synthetic
gctuacaccatccucagccaag

SEQ ID NO: 73873 - DNA, 26 bp, Artificial Sequence
  Synthetic
cacgggatugagctaatacacattug

SEQ ID NO: 73874 - DNA, 27 bp, Artificial Sequence
  Synthetic
gatattacccagagutgtatgguggaa

SEQ ID NO: 73875 - DNA, 25 bp, Artificial Sequence
  Synthetic
tcctagtgatcuccatgtcatccug

SEQ ID NO: 73876 - DNA, 27 bp, Artificial Sequence
  Synthetic
ctggaggauaaagaggacttccattug

SEQ ID NO: 73877 - DNA, 23 bp, Artificial Sequence
  Synthetic
cggttttgtccaugggcctaaua

SEQ ID NO: 73878 - DNA, 28 bp, Artificial Sequence
  Synthetic
cacacaactgccutagaatgtaaaacuc

SEQ ID NO: 73879 - DNA, 24 bp, Artificial Sequence
  Synthetic
gtggctugacagtcaaugaaaaca

SEQ ID NO: 73880 - DNA, 23 bp, Artificial Sequence
  Synthetic
tctggaagucaccgattcccaua

SEQ ID NO: 73881 - DNA, 21 bp, Artificial Sequence
  Synthetic
tttccuacagccagtgctugt

SEQ ID NO: 73882 - DNA, 25 bp, Artificial Sequence
  Synthetic
aagatgcttttgucccttcttctut

SEQ ID NO: 73883 - DNA, 23 bp, Artificial Sequence
  Synthetic
tggtctttguctgactcugagga

SEQ ID NO: 73884 - DNA, 26 bp, Artificial Sequence
  Synthetic
cgattgttaattutagggcccatugt

SEQ ID NO: 73885 - DNA, 20 bp, Artificial Sequence
  Synthetic
accaacaacgcuacctucca

SEQ ID NO: 73886 - DNA, 25 bp, Artificial Sequence
  Synthetic
gctgtgtucaagaaatcgcugaaaa

SEQ ID NO: 73887 - DNA, 23 bp, Artificial Sequence
  Synthetic
gcctggtcuacaactttcccuat

SEQ ID NO: 73888 - DNA, 21 bp, Artificial Sequence
  Synthetic
gctagtcugagctcccugaac

SEQ ID NO: 73889 - DNA, 23 bp, Artificial Sequence
  Synthetic
gauttctgcattucccagcacat

SEQ ID NO: 73890 - DNA, 19 bp, Artificial Sequence
  Synthetic
gcgatagguccccgtgtut

SEQ ID NO: 73891 - DNA, 19 bp, Artificial Sequence
  Synthetic
cggtgaccutgcgatgugt

SEQ ID NO: 73892 - DNA, 24 bp, Artificial Sequence
  Synthetic
agtgctgctauggatgaaaagguc

SEQ ID NO: 73893 - DNA, 26 bp, Artificial Sequence
  Synthetic
agcagttgcaugactacttguaaagt

SEQ ID NO: 73894 - DNA, 19 bp, Artificial Sequence
  Synthetic
gcggcugguaagggaagag

SEQ ID NO: 73895 - DNA, 17 bp, Artificial Sequence
  Synthetic
aggcuggagcccctgua

SEQ ID NO: 73896 - DNA, 17 bp, Artificial Sequence
  Synthetic
cggccgggucgatguag

SEQ ID NO: 73897 - DNA, 18 bp, Artificial Sequence
  Synthetic
ccgaugagcagccaccug

SEQ ID NO: 73898 - DNA, 28 bp, Artificial Sequence
  Synthetic
cgcaagttgaaagcugtcagttaaauaa

SEQ ID NO: 73899 - DNA, 29 bp, Artificial Sequence
  Synthetic
actacccuccaaattatcaguacaggaaa

SEQ ID NO: 73900 - DNA, 24 bp, Artificial Sequence
  Synthetic
aaggaagggccautagaacacauc

SEQ ID NO: 73901 - DNA, 24 bp, Artificial Sequence
  Synthetic
tgatggtctttuctctccctcuca

SEQ ID NO: 73902 - DNA, 19 bp, Artificial Sequence
  Synthetic
ccattccacgcugccatug

SEQ ID NO: 73903 - DNA, 22 bp, Artificial Sequence
  Synthetic
cgcatccuagacctcacttcug

SEQ ID NO: 73904 - DNA, 24 bp, Artificial Sequence
  Synthetic
tgaaatgtgtgugatgcctctugt

SEQ ID NO: 73905 - DNA, 21 bp, Artificial Sequence
  Synthetic
gaggatgcugtcctgaaggug

SEQ ID NO: 73906 - DNA, 24 bp, Artificial Sequence
  Synthetic
ctcactcacacutcagcatctuca

SEQ ID NO: 73907 - DNA, 21 bp, Artificial Sequence
  Synthetic
ccagggacutaagggaccugt

SEQ ID NO: 73908 - DNA, 27 bp, Artificial Sequence
  Synthetic
ttccaaagatcautatggcacttucct

SEQ ID NO: 73909 - DNA, 22 bp, Artificial Sequence
  Synthetic
acttaccaaaggugctgctcuc

SEQ ID NO: 73910 - DNA, 19 bp, Artificial Sequence
  Synthetic
cccaggcgccauctaucac

SEQ ID NO: 73911 - DNA, 27 bp, Artificial Sequence
  Synthetic
gcttagaucaagctatctcaatugcca

SEQ ID NO: 73912 - DNA, 29 bp, Artificial Sequence
  Synthetic
aggatggaaaaauaaaaacgcauaaaact

SEQ ID NO: 73913 - DNA, 26 bp, Artificial Sequence
  Synthetic
agccgtttaccaugagatccttatug

SEQ ID NO: 73914 - DNA, 29 bp, Artificial Sequence
  Synthetic
ccaaactcacccuaatttcttcacauact

SEQ ID NO: 73915 - DNA, 24 bp, Artificial Sequence
  Synthetic
cctgagttaaacaugtgcctccut

SEQ ID NO: 73916 - DNA, 23 bp, Artificial Sequence
  Synthetic
ctgttggtacugtttgggtggua

SEQ ID NO: 73917 - DNA, 24 bp, Artificial Sequence
  Synthetic
agcttgatcaucactccacucaac

SEQ ID NO: 73918 - DNA, 21 bp, Artificial Sequence
  Synthetic
caggcuaagggatggcaguag

SEQ ID NO: 73919 - DNA, 22 bp, Artificial Sequence
  Synthetic
aaacggaggucgcgtttacaua

SEQ ID NO: 73920 - DNA, 21 bp, Artificial Sequence
  Synthetic
gggagaacagccaacucaucc

SEQ ID NO: 73921 - DNA, 21 bp, Artificial Sequence
  Synthetic
tgatgcctcugtgctctccua

SEQ ID NO: 73922 - DNA, 21 bp, Artificial Sequence
  Synthetic
ggttccccaagaugccttgut

SEQ ID NO: 73923 - DNA, 28 bp, Artificial Sequence
  Synthetic
cacagatcatucagttgcttttuacagt

SEQ ID NO: 73924 - DNA, 21 bp, Artificial Sequence
  Synthetic
agcttgtcugagtgggatguc

SEQ ID NO: 73925 - DNA, 27 bp, Artificial Sequence
  Synthetic
agtgagtguagccattcatttttcugt

SEQ ID NO: 73926 - DNA, 23 bp, Artificial Sequence
  Synthetic
ggtctcaagtutgtggctcttug

SEQ ID NO: 73927 - DNA, 19 bp, Artificial Sequence
  Synthetic
ttcacuggcctcctcucct

SEQ ID NO: 73928 - DNA, 22 bp, Artificial Sequence
  Synthetic
gtgggtuggaaagctcaggaut

SEQ ID NO: 73929 - DNA, 20 bp, Artificial Sequence
  Synthetic
ccttccaugggcaccaugag

SEQ ID NO: 73930 - DNA, 27 bp, Artificial Sequence
  Synthetic
aaaatccattggcutttagttgccaut

SEQ ID NO: 73931 - DNA, 24 bp, Artificial Sequence
  Synthetic
tcagtggtcugtgcatactguaga

SEQ ID NO: 73932 - DNA, 17 bp, Artificial Sequence
  Synthetic
ggagcgcuguagcacct

SEQ ID NO: 73933 - DNA, 21 bp, Artificial Sequence
  Synthetic
tgtgccuaccacguaaccaaa

SEQ ID NO: 73934 - DNA, 25 bp, Artificial Sequence
  Synthetic
cctgcaaacautaaccaugaccaat

SEQ ID NO: 73935 - DNA, 25 bp, Artificial Sequence
  Synthetic
accacacctgugaattctgaatucc

SEQ ID NO: 73936 - DNA, 22 bp, Artificial Sequence
  Synthetic
gacaccacgutgcugaaaacat

SEQ ID NO: 73937 - DNA, 26 bp, Artificial Sequence
  Synthetic
agtagggtgaagugactttttctugg

SEQ ID NO: 73938 - DNA, 28 bp, Artificial Sequence
  Synthetic
cacagagtuacttttggcaatuaccaat

SEQ ID NO: 73939 - DNA, 24 bp, Artificial Sequence
  Synthetic
cccagatcucagctgtacttucac

SEQ ID NO: 73940 - DNA, 21 bp, Artificial Sequence
  Synthetic
acagggagacaugaaccccut

SEQ ID NO: 73941 - DNA, 25 bp, Artificial Sequence
  Synthetic
cgctgacauctccatttcatucaca

SEQ ID NO: 73942 - DNA, 21 bp, Artificial Sequence
  Synthetic
caaatagacgugggctgucct

SEQ ID NO: 73943 - DNA, 26 bp, Artificial Sequence
  Synthetic
caacuccaaagaatatuccggagact

SEQ ID NO: 73944 - DNA, 25 bp, Artificial Sequence
  Synthetic
tcacaatgagutcaggcttauggag

SEQ ID NO: 73945 - DNA, 27 bp, Artificial Sequence
  Synthetic
cggtacttuaaggagcttttgtgttug

SEQ ID NO: 73946 - DNA, 21 bp, Artificial Sequence
  Synthetic
aggaccccugtuagcagagag

SEQ ID NO: 73947 - DNA, 27 bp, Artificial Sequence
  Synthetic
tgcatacaaauacacagacacacauga

SEQ ID NO: 73948 - DNA, 24 bp, Artificial Sequence
  Synthetic
caagaaugcagcgtuacagacaaa

SEQ ID NO: 73949 - DNA, 28 bp, Artificial Sequence
  Synthetic
actgcatgaggutgctctagaattttua

SEQ ID NO: 73950 - DNA, 27 bp, Artificial Sequence
  Synthetic
gaaatcacatugaatggtcaugcaaac

SEQ ID NO: 73951 - DNA, 26 bp, Artificial Sequence
  Synthetic
acattttgccaagaaacugcactuac

SEQ ID NO: 73952 - DNA, 28 bp, Artificial Sequence
  Synthetic
gcaaaaggcaagaaaaaucagatuggat

SEQ ID NO: 73953 - DNA, 25 bp, Artificial Sequence
  Synthetic
ttttaaacaggcugaacctctccuc

SEQ ID NO: 73954 - DNA, 22 bp, Artificial Sequence
  Synthetic
ggaugagaaaggcaagccuaca

SEQ ID NO: 73955 - DNA, 22 bp, Artificial Sequence
  Synthetic
tttctcccccucttctuagcct

SEQ ID NO: 73956 - DNA, 20 bp, Artificial Sequence
  Synthetic
cagttguggccctguaggac

SEQ ID NO: 73957 - DNA, 26 bp, Artificial Sequence
  Synthetic
aggtttcuaacgcctgttttcttuct

SEQ ID NO: 73958 - DNA, 27 bp, Artificial Sequence
  Synthetic
acgtgttaataaaaggugatcagccut

SEQ ID NO: 73959 - DNA, 19 bp, Artificial Sequence
  Synthetic
tggtgccugtggagaggua

SEQ ID NO: 73960 - DNA, 22 bp, Artificial Sequence
  Synthetic
gactctguggacaagugagcat

SEQ ID NO: 73961 - DNA, 20 bp, Artificial Sequence
  Synthetic
ccgaaacucaggcaacucag

SEQ ID NO: 73962 - DNA, 22 bp, Artificial Sequence
  Synthetic
ctcacccatguggcttaaccut

SEQ ID NO: 73963 - DNA, 27 bp, Artificial Sequence
  Synthetic
aaaaatacctuagaaagccggaaguca

SEQ ID NO: 73964 - DNA, 28 bp, Artificial Sequence
  Synthetic
gataaaatattggtugacttccggctut

SEQ ID NO: 73965 - DNA, 28 bp, Artificial Sequence
  Synthetic
gcaagtaaccuatttacaaaugccacat

SEQ ID NO: 73966 - DNA, 20 bp, Artificial Sequence
  Synthetic
tggactucgaagagcgctut

SEQ ID NO: 73967 - DNA, 18 bp, Artificial Sequence
  Synthetic
tgcccaaugctcgccuac

SEQ ID NO: 73968 - DNA, 17 bp, Artificial Sequence
  Synthetic
ccacgcaucccgcctut

SEQ ID NO: 73969 - DNA, 23 bp, Artificial Sequence
  Synthetic
gggcucattuaccagagagacag

SEQ ID NO: 73970 - DNA, 20 bp, Artificial Sequence
  Synthetic
ttucagcccagcggattuct

SEQ ID NO: 73971 - DNA, 18 bp, Artificial Sequence
  Synthetic
ggagcucagggaucccca

SEQ ID NO: 73972 - DNA, 27 bp, Artificial Sequence
  Synthetic
agaaataggtctucagcgatctacuca

SEQ ID NO: 73973 - DNA, 27 bp, Artificial Sequence
  Synthetic
ggtttctttgcutctgctaaaactuca

SEQ ID NO: 73974 - DNA, 25 bp, Artificial Sequence
  Synthetic
guccaagaacaugaaagggaaaagg

SEQ ID NO: 73975 - DNA, 20 bp, Artificial Sequence
  Synthetic
cccgaacagagugcaaugct

SEQ ID NO: 73976 - DNA, 27 bp, Artificial Sequence
  Synthetic
ttcttttatagucaaacgagcugcaga

SEQ ID NO: 73977 - DNA, 27 bp, Artificial Sequence
  Synthetic
ggttactgcaaucaaagaatccttgut

SEQ ID NO: 73978 - DNA, 18 bp, Artificial Sequence
  Synthetic
gggacagutcgcuggaca

SEQ ID NO: 73979 - DNA, 19 bp, Artificial Sequence
  Synthetic
gtcucaccccagactggut

SEQ ID NO: 73980 - DNA, 19 bp, Artificial Sequence
  Synthetic
ccatggugactgcgagucc

SEQ ID NO: 73981 - DNA, 21 bp, Artificial Sequence
  Synthetic
atcgccacgucccttaguaac

SEQ ID NO: 73982 - DNA, 23 bp, Artificial Sequence
  Synthetic
cacttgggtcuttttgtgcctut

SEQ ID NO: 73983 - DNA, 18 bp, Artificial Sequence
  Synthetic
gutcacgtugggcaggga

SEQ ID NO: 73984 - DNA, 20 bp, Artificial Sequence
  Synthetic
cagccgaggccaguactaug

SEQ ID NO: 73985 - DNA, 22 bp, Artificial Sequence
  Synthetic
gataaccccagcugtccucaat

SEQ ID NO: 73986 - DNA, 17 bp, Artificial Sequence
  Synthetic
gcuggagaccgcaccug

SEQ ID NO: 73987 - DNA, 18 bp, Artificial Sequence
  Synthetic
cagcggautcugcagcaa

SEQ ID NO: 73988 - DNA, 19 bp, Artificial Sequence
  Synthetic
gggacccaauctgctgcut

SEQ ID NO: 73989 - DNA, 18 bp, Artificial Sequence
  Synthetic
agatggcggcucagaugg

SEQ ID NO: 73990 - DNA, 18 bp, Artificial Sequence
  Synthetic
cccatcuggccaagcugt

SEQ ID NO: 73991 - DNA, 19 bp, Artificial Sequence
  Synthetic
ccagtuccagcagccucaa

SEQ ID NO: 73992 - DNA, 17 bp, Artificial Sequence
  Synthetic
ggtagccuccgggucct

SEQ ID NO: 73993 - DNA, 28 bp, Artificial Sequence
  Synthetic
gtatgaatccacaguaccgagaaatgut

SEQ ID NO: 73994 - DNA, 23 bp, Artificial Sequence
  Synthetic
gggtctuctgttgacucacaacc

SEQ ID NO: 73995 - DNA, 27 bp, Artificial Sequence
  Synthetic
agcggtcuacttattctgttuccaaaa

SEQ ID NO: 73996 - DNA, 17 bp, Artificial Sequence
  Synthetic
catgccggcacucccut

SEQ ID NO: 73997 - DNA, 22 bp, Artificial Sequence
  Synthetic
ccaggccutgaacatcaugaac

SEQ ID NO: 73998 - DNA, 24 bp, Artificial Sequence
  Synthetic
agagccaggacaagauctagacut

SEQ ID NO: 73999 - DNA, 21 bp, Artificial Sequence
  Synthetic
cagaagtguccctgtuccagt

SEQ ID NO: 74000 - DNA, 23 bp, Artificial Sequence
  Synthetic
ctgtggattcauactcgccaugt

SEQ ID NO: 74001 - DNA, 18 bp, Artificial Sequence
  Synthetic
ccagccugcagaaccuga

SEQ ID NO: 74002 - DNA, 21 bp, Artificial Sequence
  Synthetic
ctggctctucatggatccuca

SEQ ID NO: 74003 - DNA, 22 bp, Artificial Sequence
  Synthetic
ctttcgtgccucccatcctuag

SEQ ID NO: 74004 - DNA, 28 bp, Artificial Sequence
  Synthetic
gtattttctctuaggttctccagtugct

SEQ ID NO: 74005 - DNA, 27 bp, Artificial Sequence
  Synthetic
tctgcatcaaugatgtttatgaccuga

SEQ ID NO: 74006 - DNA, 21 bp, Artificial Sequence
  Synthetic
ccuacagggcttucccagaac

SEQ ID NO: 74007 - DNA, 20 bp, Artificial Sequence
  Synthetic
gccccaagutacauccacga

SEQ ID NO: 74008 - DNA, 23 bp, Artificial Sequence
  Synthetic
ttctgugagaggaauccaaagcc

SEQ ID NO: 74009 - DNA, 28 bp, Artificial Sequence
  Synthetic
gcaaagttgccaaaauaaaactcaggua

SEQ ID NO: 74010 - DNA, 21 bp, Artificial Sequence
  Synthetic
gcagcugcattttctuggact

SEQ ID NO: 74011 - DNA, 25 bp, Artificial Sequence
  Synthetic
gaagtttatcagcaauggcccttuc

SEQ ID NO: 74012 - DNA, 21 bp, Artificial Sequence
  Synthetic
cttgacggucacagtgtccut

SEQ ID NO: 74013 - DNA, 26 bp, Artificial Sequence
  Synthetic
tgtcaatctuctcttcattctugcca

SEQ ID NO: 74014 - DNA, 28 bp, Artificial Sequence
  Synthetic
cttagatauggatatgtgtgugccacaa

SEQ ID NO: 74015 - DNA, 28 bp, Artificial Sequence
  Synthetic
actttgacatgugaatatgctctucagt

SEQ ID NO: 74016 - DNA, 20 bp, Artificial Sequence
  Synthetic
ctcccuctcaccugcagaga

SEQ ID NO: 74017 - DNA, 19 bp, Artificial Sequence
  Synthetic
acaaggugacggugcagag

SEQ ID NO: 74018 - DNA, 24 bp, Artificial Sequence
  Synthetic
ctctaagguctcaacagucagcag

SEQ ID NO: 74019 - DNA, 21 bp, Artificial Sequence
  Synthetic
cctgaagcuctgagccacaut

SEQ ID NO: 74020 - DNA, 21 bp, Artificial Sequence
  Synthetic
accaaacagcuttguccacca

SEQ ID NO: 74021 - DNA, 22 bp, Artificial Sequence
  Synthetic
cccagagagcauctttgacugt

SEQ ID NO: 74022 - DNA, 21 bp, Artificial Sequence
  Synthetic
gtcgctcugaaccgtguagac

SEQ ID NO: 74023 - DNA, 22 bp, Artificial Sequence
  Synthetic
tgtcaagggcaaugtaagugct

SEQ ID NO: 74024 - DNA, 24 bp, Artificial Sequence
  Synthetic
gaaccgtguagacacagucaaaga

SEQ ID NO: 74025 - DNA, 25 bp, Artificial Sequence
  Synthetic
atgactccaacuacattgucaaggg

SEQ ID NO: 74026 - DNA, 23 bp, Artificial Sequence
  Synthetic
ccatctccuaacactggctcuga

SEQ ID NO: 74027 - DNA, 22 bp, Artificial Sequence
  Synthetic
gcaacauggagactggugagac

SEQ ID NO: 74028 - DNA, 21 bp, Artificial Sequence
  Synthetic
cccctucagatcttcucagca

SEQ ID NO: 74029 - DNA, 22 bp, Artificial Sequence
  Synthetic
gcutcgattcuccggaaaaagg

SEQ ID NO: 74030 - DNA, 25 bp, Artificial Sequence
  Synthetic
tcttgctgatguaccagttcttcug

SEQ ID NO: 74031 - DNA, 22 bp, Artificial Sequence
  Synthetic
tccctttcccugactccatcut

SEQ ID NO: 74032 - DNA, 22 bp, Artificial Sequence
  Synthetic
ccutctgaaaacuccccaggaa

SEQ ID NO: 74033 - DNA, 21 bp, Artificial Sequence
  Synthetic
caccgaauagttacggucgga

SEQ ID NO: 74034 - DNA, 20 bp, Artificial Sequence
  Synthetic
agctugcggaagtcagtuca

SEQ ID NO: 74035 - DNA, 18 bp, Artificial Sequence
  Synthetic
gcgtcccucgcaagucag

SEQ ID NO: 74036 - DNA, 18 bp, Artificial Sequence
  Synthetic
ccgcugcagaccctcuac

SEQ ID NO: 74037 - DNA, 18 bp, Artificial Sequence
  Synthetic
ggagcagcauggagccut

SEQ ID NO: 74038 - DNA, 20 bp, Artificial Sequence
  Synthetic
cacagcaggccuctcttcug

SEQ ID NO: 74039 - DNA, 19 bp, Artificial Sequence
  Synthetic
ggucccagcaagcatcugt

SEQ ID NO: 74040 - DNA, 24 bp, Artificial Sequence
  Synthetic
gcatccaggaggguctgaaagaua

SEQ ID NO: 74041 - DNA, 20 bp, Artificial Sequence
  Synthetic
catccccacccutcacucac

SEQ ID NO: 74042 - DNA, 25 bp, Artificial Sequence
  Synthetic
actgtaagcaugagaacttgtgugt

SEQ ID NO: 74043 - DNA, 23 bp, Artificial Sequence
  Synthetic
ctggctgagaacuggagtactuc

SEQ ID NO: 74044 - DNA, 23 bp, Artificial Sequence
  Synthetic
cagagagaaggagagaugcugag

SEQ ID NO: 74045 - DNA, 21 bp, Artificial Sequence
  Synthetic
cttcagggaaugcctggugaa

SEQ ID NO: 74046 - DNA, 27 bp, Artificial Sequence
  Synthetic
ctttctgtctuaatgcctcagugaaga

SEQ ID NO: 74047 - DNA, 26 bp, Artificial Sequence
  Synthetic
caaaagcatatgaucaggacatgugg

SEQ ID NO: 74048 - DNA, 28 bp, Artificial Sequence
  Synthetic
gcccctcauacattgataaattgguaca

SEQ ID NO: 74049 - DNA, 28 bp, Artificial Sequence
  Synthetic
aaaaattaaatuccctcacctgugagga

SEQ ID NO: 74050 - DNA, 26 bp, Artificial Sequence
  Synthetic
ggttgaacttacuctgtcaccctuag

SEQ ID NO: 74051 - DNA, 21 bp, Artificial Sequence
  Synthetic
aggcctcacuccagtcttcut

SEQ ID NO: 74052 - DNA, 20 bp, Artificial Sequence
  Synthetic
atctagcccccuccccauac

SEQ ID NO: 74053 - DNA, 18 bp, Artificial Sequence
  Synthetic
gaugggacagcaccguga

SEQ ID NO: 74054 - DNA, 23 bp, Artificial Sequence
  Synthetic
ggtctatccuaacacggcucact

SEQ ID NO: 74055 - DNA, 24 bp, Artificial Sequence
  Synthetic
cccataucgaaccaaagctctgut

SEQ ID NO: 74056 - DNA, 22 bp, Artificial Sequence
  Synthetic
gccgucaatttccucaaaagca

SEQ ID NO: 74057 - DNA, 25 bp, Artificial Sequence
  Synthetic
gtcagcaacagccuttgtaaatguc

SEQ ID NO: 74058 - DNA, 17 bp, Artificial Sequence
  Synthetic
aggguccccgaggugag

SEQ ID NO: 74059 - DNA, 20 bp, Artificial Sequence
  Synthetic
tgggccugaactgcctttut

SEQ ID NO: 74060 - DNA, 21 bp, Artificial Sequence
  Synthetic
gctctctguccccactctuca

SEQ ID NO: 74061 - DNA, 20 bp, Artificial Sequence
  Synthetic
ccauccacagggccaagtuc

SEQ ID NO: 74062 - DNA, 26 bp, Artificial Sequence
  Synthetic
gttgcaatguttctgtctuacaccat

SEQ ID NO: 74063 - DNA, 23 bp, Artificial Sequence
  Synthetic
ggaggaugccataacaacuccag

SEQ ID NO: 74064 - DNA, 24 bp, Artificial Sequence
  Synthetic
gcattgatagucctggctcugaat

SEQ ID NO: 74065 - DNA, 20 bp, Artificial Sequence
  Synthetic
ctactgcccugtctgcucac

SEQ ID NO: 74066 - DNA, 17 bp, Artificial Sequence
  Synthetic
ctuccagcaccggguct

SEQ ID NO: 74067 - DNA, 21 bp, Artificial Sequence
  Synthetic
gtaaccctgugccctcctcua

SEQ ID NO: 74068 - DNA, 21 bp, Artificial Sequence
  Synthetic
gcacccacuagcactatugcc

SEQ ID NO: 74069 - DNA, 23 bp, Artificial Sequence
  Synthetic
atccagcagaaugugaagacaca

SEQ ID NO: 74070 - DNA, 27 bp, Artificial Sequence
  Synthetic
ctctgtagcataugcacttgaaggaut

SEQ ID NO: 74071 - DNA, 22 bp, Artificial Sequence
  Synthetic
gcgaaaccagutcggtcttuca

SEQ ID NO: 74072 - DNA, 22 bp, Artificial Sequence
  Synthetic
cccctggtutcgcaaattcuca

SEQ ID NO: 74073 - DNA, 24 bp, Artificial Sequence
  Synthetic
ggaaucgtttgaaaucacaacgga

SEQ ID NO: 74074 - DNA, 25 bp, Artificial Sequence
  Synthetic
ctacttagaggugctaatcccgaut

SEQ ID NO: 74075 - DNA, 20 bp, Artificial Sequence
  Synthetic
ccttcttuggcagccaagug

SEQ ID NO: 74076 - DNA, 25 bp, Artificial Sequence
  Synthetic
aacaagaaccacaggautcucaagt

SEQ ID NO: 74077 - DNA, 21 bp, Artificial Sequence
  Synthetic
agatgaacagcaugggcucag

SEQ ID NO: 74078 - DNA, 22 bp, Artificial Sequence
  Synthetic
cacccccucctgtgtttcauag

SEQ ID NO: 74079 - DNA, 22 bp, Artificial Sequence
  Synthetic
ccagaugtctgtgucagaagca

SEQ ID NO: 74080 - DNA, 21 bp, Artificial Sequence
  Synthetic
agagaacacutaccccuggca

SEQ ID NO: 74081 - DNA, 25 bp, Artificial Sequence
  Synthetic
tgaaccgttgugggtacattuacag

SEQ ID NO: 74082 - DNA, 28 bp, Artificial Sequence
  Synthetic
tctttagcttucactcttcctactucct

SEQ ID NO: 74083 - DNA, 29 bp, Artificial Sequence
  Synthetic
caatgaaatctauagtcttacagcugcca

SEQ ID NO: 74084 - DNA, 21 bp, Artificial Sequence
  Synthetic
gccuggtuaggagcaaaggaa

SEQ ID NO: 74085 - DNA, 28 bp, Artificial Sequence
  Synthetic
gcattgacguttacattatttugcaaca

SEQ ID NO: 74086 - DNA, 25 bp, Artificial Sequence
  Synthetic
acaucgaggataaugaagggaacct

SEQ ID NO: 74087 - DNA, 22 bp, Artificial Sequence
  Synthetic
gctaacaaccucattccuccca

SEQ ID NO: 74088 - DNA, 21 bp, Artificial Sequence
  Synthetic
acaggaacugacgcaggtcua

SEQ ID NO: 74089 - DNA, 23 bp, Artificial Sequence
  Synthetic
catactggguagaaggcttuggg

SEQ ID NO: 74090 - DNA, 24 bp, Artificial Sequence
  Synthetic
gggaccuagagcaacttactagut

SEQ ID NO: 74091 - DNA, 28 bp, Artificial Sequence
  Synthetic
cgtaggcaacautattgacttgtttucc

SEQ ID NO: 74092 - DNA, 21 bp, Artificial Sequence
  Synthetic
ctgtgattuggccaggctcua

SEQ ID NO: 74093 - DNA, 28 bp, Artificial Sequence
  Synthetic
agtcaggagagcuactcagttaatugat

SEQ ID NO: 74094 - DNA, 19 bp, Artificial Sequence
  Synthetic
ggccctgcaucgtactcug

SEQ ID NO: 74095 - DNA, 23 bp, Artificial Sequence
  Synthetic
tcatcactcgucatgtccucact

SEQ ID NO: 74096 - DNA, 20 bp, Artificial Sequence
  Synthetic
gagctuctcgttcucagcgt

SEQ ID NO: 74097 - DNA, 19 bp, Artificial Sequence
  Synthetic
ctgggtccugggcaagaut

SEQ ID NO: 74098 - DNA, 27 bp, Artificial Sequence
  Synthetic
tttatcttcccautttcatcacgugga

SEQ ID NO: 74099 - DNA, 28 bp, Artificial Sequence
  Synthetic
gttgcatctggucttttcttctttguat

SEQ ID NO: 74100 - DNA, 27 bp, Artificial Sequence
  Synthetic
aaggttgucaacgagaaaatgaaacuc

SEQ ID NO: 74101 - DNA, 28 bp, Artificial Sequence
  Synthetic
agactatcttaccagucttgaggcauaa

SEQ ID NO: 74102 - DNA, 28 bp, Artificial Sequence
  Synthetic
cttatagagtaguagaccagcccctuaa

SEQ ID NO: 74103 - DNA, 20 bp, Artificial Sequence
  Synthetic
gcaacgucaucaacggcaat

SEQ ID NO: 74104 - DNA, 21 bp, Artificial Sequence
  Synthetic
gcccucccagcacttacatug

SEQ ID NO: 74105 - DNA, 22 bp, Artificial Sequence
  Synthetic
aagactaacccugcagtgctut

SEQ ID NO: 74106 - DNA, 21 bp, Artificial Sequence
  Synthetic
ggcagaagggagaguttggua

SEQ ID NO: 74107 - DNA, 20 bp, Artificial Sequence
  Synthetic
tttcccuctgctccuaggct

SEQ ID NO: 74108 - DNA, 21 bp, Artificial Sequence
  Synthetic
ctgatgttcgcugcctcatut

SEQ ID NO: 74109 - DNA, 23 bp, Artificial Sequence
  Synthetic
tggacatcucctatgtugaggct

SEQ ID NO: 74110 - DNA, 24 bp, Artificial Sequence
  Synthetic
ctgctccatguatgaggacatcuc

SEQ ID NO: 74111 - DNA, 21 bp, Artificial Sequence
  Synthetic
agggaagugagcugagacact

SEQ ID NO: 74112 - DNA, 23 bp, Artificial Sequence
  Synthetic
gggtagagcugtggattcattut

SEQ ID NO: 74113 - DNA, 24 bp, Artificial Sequence
  Synthetic
gacggacatttutcctccctctut

SEQ ID NO: 74114 - DNA, 18 bp, Artificial Sequence
  Synthetic
tccaggcuguccagggat

SEQ ID NO: 74115 - DNA, 20 bp, Artificial Sequence
  Synthetic
aaggguaagcgttgcacuct

SEQ ID NO: 74116 - DNA, 18 bp, Artificial Sequence
  Synthetic
gcccagagugcaacgcut

SEQ ID NO: 74117 - DNA, 24 bp, Artificial Sequence
  Synthetic
gtaatctccugccctcgaatttug

SEQ ID NO: 74118 - DNA, 22 bp, Artificial Sequence
  Synthetic
tgtgaaggcugctctggagaua

SEQ ID NO: 74119 - DNA, 23 bp, Artificial Sequence
  Synthetic
tttgctcactguctgttcctcuc

SEQ ID NO: 74120 - DNA, 19 bp, Artificial Sequence
  Synthetic
agacccuacacgggauggt

SEQ ID NO: 74121 - DNA, 19 bp, Artificial Sequence
  Synthetic
cgctggugaacgtggtuct

SEQ ID NO: 74122 - DNA, 22 bp, Artificial Sequence
  Synthetic
agctucaccaggagatccttug

SEQ ID NO: 74123 - DNA, 23 bp, Artificial Sequence
  Synthetic
cctgggcaucttcttcctcttut

SEQ ID NO: 74124 - DNA, 17 bp, Artificial Sequence
  Synthetic
gcaggcgaggcuacuga

SEQ ID NO: 74125 - DNA, 21 bp, Artificial Sequence
  Synthetic
gggaacauagagggcaugcag

SEQ ID NO: 74126 - DNA, 19 bp, Artificial Sequence
  Synthetic
cgcaccaaacagccuaucc

SEQ ID NO: 74127 - DNA, 23 bp, Artificial Sequence
  Synthetic
ctgccuctcaagtucaacacaac

SEQ ID NO: 74128 - DNA, 26 bp, Artificial Sequence
  Synthetic
gtgctaagagaaagugatgaccagut

SEQ ID NO: 74129 - DNA, 26 bp, Artificial Sequence
  Synthetic
tttcttactgaagaaugccgtctuct

SEQ ID NO: 74130 - DNA, 22 bp, Artificial Sequence
  Synthetic
gagaccugtuagaagacggcat

SEQ ID NO: 74131 - DNA, 23 bp, Artificial Sequence
  Synthetic
ccagtaaggguaggatggugaag

SEQ ID NO: 74132 - DNA, 21 bp, Artificial Sequence
  Synthetic
caggccugggagttcttcuat

SEQ ID NO: 74133 - DNA, 28 bp, Artificial Sequence
  Synthetic
acttgtcttcuaacccatctttttccut

SEQ ID NO: 74134 - DNA, 24 bp, Artificial Sequence
  Synthetic
ctgttcucaaatactgcugggaca

SEQ ID NO: 74135 - DNA, 24 bp, Artificial Sequence
  Synthetic
gggaacgccaacuttctcatttut

SEQ ID NO: 74136 - DNA, 28 bp, Artificial Sequence
  Synthetic
gcaggtcaaaagguacaagattgtuact

SEQ ID NO: 74137 - DNA, 28 bp, Artificial Sequence
  Synthetic
tcccacagacuttcacataaaauaccac

SEQ ID NO: 74138 - DNA, 23 bp, Artificial Sequence
  Synthetic
tgtgataggaagcugtggaguga

SEQ ID NO: 74139 - DNA, 25 bp, Artificial Sequence
  Synthetic
ctggaagatcaucgagagctaugag

SEQ ID NO: 74140 - DNA, 28 bp, Artificial Sequence
  Synthetic
tcagaatgtcuacccaataccagtacut

SEQ ID NO: 74141 - DNA, 25 bp, Artificial Sequence
  Synthetic
gtacaauagcagacaccatcugagg

SEQ ID NO: 74142 - DNA, 25 bp, Artificial Sequence
  Synthetic
ggtcgaugaaagtataactgtugcc

SEQ ID NO: 74143 - DNA, 23 bp, Artificial Sequence
  Synthetic
gucagaaacaagguccaggaact

SEQ ID NO: 74144 - DNA, 21 bp, Artificial Sequence
  Synthetic
agacacgcuatcatgcgtuct

SEQ ID NO: 74145 - DNA, 23 bp, Artificial Sequence
  Synthetic
gcaggaaugcctccagactuaaa

SEQ ID NO: 74146 - DNA, 21 bp, Artificial Sequence
  Synthetic
cggagccutaugaaccagaga

SEQ ID NO: 74147 - DNA, 23 bp, Artificial Sequence
  Synthetic
cgcattgucgaaccaugaaaaac

SEQ ID NO: 74148 - DNA, 27 bp, Artificial Sequence
  Synthetic
acaagaautttatttccuagggagcca

SEQ ID NO: 74149 - DNA, 19 bp, Artificial Sequence
  Synthetic
cccgcucagagccagttuc

SEQ ID NO: 74150 - DNA, 20 bp, Artificial Sequence
  Synthetic
gtgagggcutactggccauc

SEQ ID NO: 74151 - DNA, 23 bp, Artificial Sequence
  Synthetic
aacacagaauccactggugaact

SEQ ID NO: 74152 - DNA, 25 bp, Artificial Sequence
  Synthetic
ccttctctgaguggtaaaggcaauc

SEQ ID NO: 74153 - DNA, 27 bp, Artificial Sequence
  Synthetic
gttctcaaaacugcattctgacttuca

SEQ ID NO: 74154 - DNA, 21 bp, Artificial Sequence
  Synthetic
gatgacgggaacuggttcugt

SEQ ID NO: 74155 - DNA, 22 bp, Artificial Sequence
  Synthetic
cttccgaacuacagctctggug

SEQ ID NO: 74156 - DNA, 18 bp, Artificial Sequence
  Synthetic
ccaagccucaccccacuc

SEQ ID NO: 74157 - DNA, 22 bp, Artificial Sequence
  Synthetic
tgggcatccuctgtcctatcuc

SEQ ID NO: 74158 - DNA, 26 bp, Artificial Sequence
  Synthetic
tgacaatgcgucatgtgatucaaaac

SEQ ID NO: 74159 - DNA, 23 bp, Artificial Sequence
  Synthetic
gcagauccugaaaaacgcaaact

SEQ ID NO: 74160 - DNA, 21 bp, Artificial Sequence
  Synthetic
agaaccagcugctgctgtauc

SEQ ID NO: 74161 - DNA, 28 bp, Artificial Sequence
  Synthetic
tgaatatgactuggaactctgagaggut

SEQ ID NO: 74162 - DNA, 28 bp, Artificial Sequence
  Synthetic
aagttcuacaaaccttaaguaacaccag

SEQ ID NO: 74163 - DNA, 23 bp, Artificial Sequence
  Synthetic
cgaaauactgtugccaagccaaa

SEQ ID NO: 74164 - DNA, 22 bp, Artificial Sequence
  Synthetic
aatctcagacuttggctuggca

SEQ ID NO: 74165 - DNA, 27 bp, Artificial Sequence
  Synthetic
actggttctgcaugaaattctcttcuc

SEQ ID NO: 74166 - DNA, 28 bp, Artificial Sequence
  Synthetic
ttgaacaagaugtgtggtacttuaccat

SEQ ID NO: 74167 - DNA, 21 bp, Artificial Sequence
  Synthetic
ctcttaccuccagcgagcaut

SEQ ID NO: 74168 - DNA, 23 bp, Artificial Sequence
  Synthetic
acagugagacagagagugaccat

SEQ ID NO: 74169 - DNA, 19 bp, Artificial Sequence
  Synthetic
actggguccgacgtttucc

SEQ ID NO: 74170 - DNA, 20 bp, Artificial Sequence
  Synthetic
agagacauggccctcacugt

SEQ ID NO: 74171 - DNA, 20 bp, Artificial Sequence
  Synthetic
ctgcguccatccttcucaga

SEQ ID NO: 74172 - DNA, 20 bp, Artificial Sequence
  Synthetic
ccaaggaacgggacucauct

SEQ ID NO: 74173 - DNA, 21 bp, Artificial Sequence
  Synthetic
tctcccgcugcatuaaacaca

SEQ ID NO: 74174 - DNA, 31 bp, Artificial Sequence
  Synthetic
gttctccagactutacttattttcctctuct

SEQ ID NO: 74175 - DNA, 28 bp, Artificial Sequence
  Synthetic
gtaacacagtguccagaacagaacuaaa

SEQ ID NO: 74176 - DNA, 27 bp, Artificial Sequence
  Synthetic
tcctttttcttutgcagcttattugct

SEQ ID NO: 74177 - DNA, 26 bp, Artificial Sequence
  Synthetic
acaatttctgtccucagtagctctug

SEQ ID NO: 74178 - DNA, 28 bp, Artificial Sequence
  Synthetic
acacugtgttactuagacccaaagaaaa

SEQ ID NO: 74179 - DNA, 27 bp, Artificial Sequence
  Synthetic
cagaaaacagcaaauagaacaccaugt

SEQ ID NO: 74180 - DNA, 25 bp, Artificial Sequence
  Synthetic
cttggaaggaugacctcaaacucaa

SEQ ID NO: 74181 - DNA, 21 bp, Artificial Sequence
  Synthetic
gaggtttttguccgagtggug

SEQ ID NO: 74182 - DNA, 20 bp, Artificial Sequence
  Synthetic
cttgaccuccaccgtctugt

SEQ ID NO: 74183 - DNA, 22 bp, Artificial Sequence
  Synthetic
cctgctcctuctggacttccua

SEQ ID NO: 74184 - DNA, 25 bp, Artificial Sequence
  Synthetic
ggtcctattcuaaaagccagagcut

SEQ ID NO: 74185 - DNA, 21 bp, Artificial Sequence
  Synthetic
gattagggcugtgtacgugct

SEQ ID NO: 74186 - DNA, 22 bp, Artificial Sequence
  Synthetic
ggctcctctucctttctggaut

SEQ ID NO: 74187 - DNA, 23 bp, Artificial Sequence
  Synthetic
actctcagcucatcctcttcucc

SEQ ID NO: 74188 - DNA, 20 bp, Artificial Sequence
  Synthetic
gccatgacuccgtgtgucag

SEQ ID NO: 74189 - DNA, 23 bp, Artificial Sequence
  Synthetic
tctcttccatucctgggactgut

SEQ ID NO: 74190 - DNA, 24 bp, Artificial Sequence
  Synthetic
gaggatttugagcacgugaagaac

SEQ ID NO: 74191 - DNA, 28 bp, Artificial Sequence
  Synthetic
aaagaatgaacucttcccuccaaaagaa

SEQ ID NO: 74192 - DNA, 22 bp, Artificial Sequence
  Synthetic
gaggcuatgtgtuagggcagaa

SEQ ID NO: 74193 - DNA, 26 bp, Artificial Sequence
  Synthetic
ttatccatgtctutagggtgatgcug

SEQ ID NO: 74194 - DNA, 21 bp, Artificial Sequence
  Synthetic
ccaccuccccagtcttacugt

SEQ ID NO: 74195 - DNA, 23 bp, Artificial Sequence
  Synthetic
ccaggugatgctugagaagagaa

SEQ ID NO: 74196 - DNA, 21 bp, Artificial Sequence
  Synthetic
caucttugccaggagagccat

SEQ ID NO: 74197 - DNA, 20 bp, Artificial Sequence
  Synthetic
cagagggccucucaggaaac

SEQ ID NO: 74198 - DNA, 23 bp, Artificial Sequence
  Synthetic
aautgggaatgttugcaccacag

SEQ ID NO: 74199 - DNA, 23 bp, Artificial Sequence
  Synthetic
aatagcttcugcagcttcctugt

SEQ ID NO: 74200 - DNA, 17 bp, Artificial Sequence
  Synthetic
ccugaagccacgggugt

SEQ ID NO: 74201 - DNA, 28 bp, Artificial Sequence
  Synthetic
cctgttaattcuggcatactcttacuga

SEQ ID NO: 74202 - DNA, 22 bp, Artificial Sequence
  Synthetic
gtcctctgugaacttgcucagg

SEQ ID NO: 74203 - DNA, 24 bp, Artificial Sequence
  Synthetic
acacatctgcuaaaggctttggut

SEQ ID NO: 74204 - DNA, 24 bp, Artificial Sequence
  Synthetic
ctttuattctctagcuccgcagca

SEQ ID NO: 74205 - DNA, 23 bp, Artificial Sequence
  Synthetic
cttaccctgtuggccctttacuc

SEQ ID NO: 74206 - DNA, 23 bp, Artificial Sequence
  Synthetic
tttcccgtccucttttgcttgua

SEQ ID NO: 74207 - DNA, 29 bp, Artificial Sequence
  Synthetic
cttttagctccucaatcaatgtcttgtut

SEQ ID NO: 74208 - DNA, 23 bp, Artificial Sequence
  Synthetic
agagtggcagugcttgaaaauca

SEQ ID NO: 74209 - DNA, 25 bp, Artificial Sequence
  Synthetic
ccagtccautttccacctuaacagg

SEQ ID NO: 74210 - DNA, 21 bp, Artificial Sequence
  Synthetic
ctccgcaggaucagctuaagg

SEQ ID NO: 74211 - DNA, 25 bp, Artificial Sequence
  Synthetic
ccagccaaaagaauatctgccuaca

SEQ ID NO: 74212 - DNA, 22 bp, Artificial Sequence
  Synthetic
ctggaaguatgggugagacagg

SEQ ID NO: 74213 - DNA, 26 bp, Artificial Sequence
  Synthetic
agatgcgctuaacatatgacagugaa

SEQ ID NO: 74214 - DNA, 18 bp, Artificial Sequence
  Synthetic
cacagaccugggtggcua

SEQ ID NO: 74215 - DNA, 17 bp, Artificial Sequence
  Synthetic
tgcccugacgcctctuc

SEQ ID NO: 74216 - DNA, 19 bp, Artificial Sequence
  Synthetic
cagcugcgagtcttuccct

SEQ ID NO: 74217 - DNA, 20 bp, Artificial Sequence
  Synthetic
catgcccaacgugtccaaug

SEQ ID NO: 74218 - DNA, 21 bp, Artificial Sequence
  Synthetic
cauacagcttcugggacaggt

SEQ ID NO: 74219 - DNA, 19 bp, Artificial Sequence
  Synthetic
cacagcctugcgtgttgut

SEQ ID NO: 74220 - DNA, 22 bp, Artificial Sequence
  Synthetic
tcaaaacccutctgcucacact

SEQ ID NO: 74221 - DNA, 23 bp, Artificial Sequence
  Synthetic
tgaccctcaaccucgatcaagua

SEQ ID NO: 74222 - DNA, 20 bp, Artificial Sequence
  Synthetic
ttgccggcaugttggaaauc

SEQ ID NO: 74223 - DNA, 28 bp, Artificial Sequence
  Synthetic
accttggtataacauctccattcctuct

SEQ ID NO: 74224 - DNA, 25 bp, Artificial Sequence
  Synthetic
gtgagccacuaagcattgaaatgut

SEQ ID NO: 74225 - DNA, 29 bp, Artificial Sequence
  Synthetic
tggtccccatcuctttaaatactcaauct

SEQ ID NO: 74226 - DNA, 21 bp, Artificial Sequence
  Synthetic
cuaaggaugggaggcacgaaa

SEQ ID NO: 74227 - DNA, 22 bp, Artificial Sequence
  Synthetic
ctcatacctcuctgcctcccua

SEQ ID NO: 74228 - DNA, 21 bp, Artificial Sequence
  Synthetic
aatgtgtcaccauccccaguc

SEQ ID NO: 74229 - DNA, 21 bp, Artificial Sequence
  Synthetic
gttggcgtugttgctgctaut

SEQ ID NO: 74230 - DNA, 20 bp, Artificial Sequence
  Synthetic
gaagacgcccacutccaaug

SEQ ID NO: 74231 - DNA, 23 bp, Artificial Sequence
  Synthetic
ccatggctcutgttcacattcug

SEQ ID NO: 74232 - DNA, 21 bp, Artificial Sequence
  Synthetic
ccccaatgguacgctgaucat

SEQ ID NO: 74233 - DNA, 18 bp, Artificial Sequence
  Synthetic
gcgggacagugggaguag

SEQ ID NO: 74234 - DNA, 28 bp, Artificial Sequence
  Synthetic
ttaacttcattguttctgctctcuaggg

SEQ ID NO: 74235 - DNA, 23 bp, Artificial Sequence
  Synthetic
ttcattcacauccagcacaucca

SEQ ID NO: 74236 - DNA, 21 bp, Artificial Sequence
  Synthetic
ggactaucgcattgtcugcct

SEQ ID NO: 74237 - DNA, 19 bp, Artificial Sequence
  Synthetic
cccgagucccctgtccaua

SEQ ID NO: 74238 - DNA, 24 bp, Artificial Sequence
  Synthetic
tggtacctttugaggtctctcuca

SEQ ID NO: 74239 - DNA, 20 bp, Artificial Sequence
  Synthetic
gccaaagtccucggacacut

SEQ ID NO: 74240 - DNA, 22 bp, Artificial Sequence
  Synthetic
gtgcctccugaaaagagagugg

SEQ ID NO: 74241 - DNA, 25 bp, Artificial Sequence
  Synthetic
agttgcugcaagtcagtugaaaaat

SEQ ID NO: 74242 - DNA, 21 bp, Artificial Sequence
  Synthetic
gactgaagccuggcaggauac

SEQ ID NO: 74243 - DNA, 24 bp, Artificial Sequence
  Synthetic
ccactttctaaccucagagtccut

SEQ ID NO: 74244 - DNA, 19 bp, Artificial Sequence
  Synthetic
aggtgucggagtgtccuga

SEQ ID NO: 74245 - DNA, 21 bp, Artificial Sequence
  Synthetic
ggaaccauagccttugccaaa

SEQ ID NO: 74246 - DNA, 19 bp, Artificial Sequence
  Synthetic
cccccggaucctcctguag

SEQ ID NO: 74247 - DNA, 19 bp, Artificial Sequence
  Synthetic
tgggcctugaaggttccug

SEQ ID NO: 74248 - DNA, 18 bp, Artificial Sequence
  Synthetic
gugcugcccccaaacaag

SEQ ID NO: 74249 - DNA, 19 bp, Artificial Sequence
  Synthetic
tuagaggcgaugggcacag

SEQ ID NO: 74250 - DNA, 19 bp, Artificial Sequence
  Synthetic
cagccaccuccttcucact

SEQ ID NO: 74251 - DNA, 21 bp, Artificial Sequence
  Synthetic
gcaggauccatugggaggaac

SEQ ID NO: 74252 - DNA, 28 bp, Artificial Sequence
  Synthetic
ctctgttatttcacuttatgcctccuct

SEQ ID NO: 74253 - DNA, 28 bp, Artificial Sequence
  Synthetic
accgaaatataaucattgcaggucagat

SEQ ID NO: 74254 - DNA, 19 bp, Artificial Sequence
  Synthetic
guccagcgacacctuccaa

SEQ ID NO: 74255 - DNA, 22 bp, Artificial Sequence
  Synthetic
gtctgcaggaugtttcctccuc

SEQ ID NO: 74256 - DNA, 18 bp, Artificial Sequence
  Synthetic
ggcctgucagcagcacuc

SEQ ID NO: 74257 - DNA, 23 bp, Artificial Sequence
  Synthetic
gccgactucttgtccgaauacac

SEQ ID NO: 74258 - DNA, 20 bp, Artificial Sequence
  Synthetic
gggaaucacccagguacagt

SEQ ID NO: 74259 - DNA, 20 bp, Artificial Sequence
  Synthetic
acttugccgttgguggaagt

SEQ ID NO: 74260 - DNA, 19 bp, Artificial Sequence
  Synthetic
gagacccgaaagugugggt

SEQ ID NO: 74261 - DNA, 19 bp, Artificial Sequence
  Synthetic
gccccauaggccagtgaug

SEQ ID NO: 74262 - DNA, 19 bp, Artificial Sequence
  Synthetic
catccguttcacccuccca

SEQ ID NO: 74263 - DNA, 19 bp, Artificial Sequence
  Synthetic
ctatggccccuccccuagt

SEQ ID NO: 74264 - DNA, 24 bp, Artificial Sequence
  Synthetic
gccctgttugttaaccatgttuct

SEQ ID NO: 74265 - DNA, 28 bp, Artificial Sequence
  Synthetic
gaacacttcacutaaaacataccugcac

SEQ ID NO: 74266 - DNA, 24 bp, Artificial Sequence
  Synthetic
ccatggctcugaaatccactatug

SEQ ID NO: 74267 - DNA, 25 bp, Artificial Sequence
  Synthetic
ccgaagtagcaguaaccagttuagt

SEQ ID NO: 74268 - DNA, 18 bp, Artificial Sequence
  Synthetic
ccgctgggugtcagctua

SEQ ID NO: 74269 - DNA, 17 bp, Artificial Sequence
  Synthetic
ggugcccaccaguaggt

SEQ ID NO: 74270 - DNA, 24 bp, Artificial Sequence
  Synthetic
aggacaccaauatuaaggcagaac

SEQ ID NO: 74271 - DNA, 25 bp, Artificial Sequence
  Synthetic
aagtcttttccaaaucgaggcauct

SEQ ID NO: 74272 - DNA, 18 bp, Artificial Sequence
  Synthetic
cgccugccactgtcacua

SEQ ID NO: 74273 - DNA, 18 bp, Artificial Sequence
  Synthetic
cacucccagcacctgcuc

SEQ ID NO: 74274 - DNA, 27 bp, Artificial Sequence
  Synthetic
ctgattattcagaugcctcgattugga

SEQ ID NO: 74275 - DNA, 28 bp, Artificial Sequence
  Synthetic
tcugacaattuccacaaaaccaacaaaa

SEQ ID NO: 74276 - DNA, 21 bp, Artificial Sequence
  Synthetic
cccctgcugtccagttcatug

SEQ ID NO: 74277 - DNA, 17 bp, Artificial Sequence
  Synthetic
cagcgugggcaggaugt

SEQ ID NO: 74278 - DNA, 22 bp, Artificial Sequence
  Synthetic
tcccaaugggtagctucaggat

SEQ ID NO: 74279 - DNA, 29 bp, Artificial Sequence
  Synthetic
ctcaagctctcutcacaaatagtatcuct

SEQ ID NO: 74280 - DNA, 28 bp, Artificial Sequence
  Synthetic
cagtagtcaaauggaatcacagtttcuc

SEQ ID NO: 74281 - DNA, 30 bp, Artificial Sequence
  Synthetic
acgtgtattagaaaugagacgttuaaacct

SEQ ID NO: 74282 - DNA, 26 bp, Artificial Sequence
  Synthetic
attctttgctgugtactagtgggtut

SEQ ID NO: 74283 - DNA, 21 bp, Artificial Sequence
  Synthetic
cagaatauggccggtcuggag

SEQ ID NO: 74284 - DNA, 20 bp, Artificial Sequence
  Synthetic
ccctgggaucccttcgctua

SEQ ID NO: 74285 - DNA, 24 bp, Artificial Sequence
  Synthetic
cctcttaccugatcttggccttug

SEQ ID NO: 74286 - DNA, 24 bp, Artificial Sequence
  Synthetic
gagggagtggugagaaagggtaua

SEQ ID NO: 74287 - DNA, 22 bp, Artificial Sequence
  Synthetic
ggtgaaauaccgagtgcctcug

SEQ ID NO: 74288 - DNA, 22 bp, Artificial Sequence
  Synthetic
caccaucagguacagacaccaa

SEQ ID NO: 74289 - DNA, 22 bp, Artificial Sequence
  Synthetic
ttugtctacaccugcaacgagt

SEQ ID NO: 74290 - DNA, 18 bp, Artificial Sequence
  Synthetic
cgtctccacguggtgcut

SEQ ID NO: 74291 - DNA, 17 bp, Artificial Sequence
  Synthetic
tccucacccucgccaga

SEQ ID NO: 74292 - DNA, 22 bp, Artificial Sequence
  Synthetic
cutcgagatctuccaccaccac

SEQ ID NO: 74293 - DNA, 19 bp, Artificial Sequence
  Synthetic
agtcuccaaggcggcuaga

SEQ ID NO: 74294 - DNA, 21 bp, Artificial Sequence
  Synthetic
ggagaacucccagtgcttguc

SEQ ID NO: 74295 - DNA, 21 bp, Artificial Sequence
  Synthetic
gactaaagccccucctcucct

SEQ ID NO: 74296 - DNA, 20 bp, Artificial Sequence
  Synthetic
ggctgtacggauggaaccut

SEQ ID NO: 74297 - DNA, 20 bp, Artificial Sequence
  Synthetic
attggaaaccggcugcaaug

SEQ ID NO: 74298 - DNA, 21 bp, Artificial Sequence
  Synthetic
ggcctgacuctaggttugcat

SEQ ID NO: 74299 - DNA, 29 bp, Artificial Sequence
  Synthetic
cactgtcaccaucacctaatataacauga

SEQ ID NO: 74300 - DNA, 22 bp, Artificial Sequence
  Synthetic
ctgtcccuccagagacaaacug

SEQ ID NO: 74301 - DNA, 21 bp, Artificial Sequence
  Synthetic
aagtgagugccggttggtuaa

SEQ ID NO: 74302 - DNA, 27 bp, Artificial Sequence
  Synthetic
tgatacctcaguaaagcaggaauaggt

SEQ ID NO: 74303 - DNA, 20 bp, Artificial Sequence
  Synthetic
cggacucucagggacaacca

SEQ ID NO: 74304 - DNA, 22 bp, Artificial Sequence
  Synthetic
tgaucccuggacaggaagagaa

SEQ ID NO: 74305 - DNA, 28 bp, Artificial Sequence
  Synthetic
gcccacacatauttcttaacaggtuaga

SEQ ID NO: 74306 - DNA, 30 bp, Artificial Sequence
  Synthetic
aatatatttatgauacactccaggaaugcc

SEQ ID NO: 74307 - DNA, 28 bp, Artificial Sequence
  Synthetic
gcagttatgtcaucatctagatcaguct

SEQ ID NO: 74308 - DNA, 22 bp, Artificial Sequence
  Synthetic
gccaaugggcaacacaggaaua

SEQ ID NO: 74309 - DNA, 23 bp, Artificial Sequence
  Synthetic
cactauaccaacagcagctccuc

SEQ ID NO: 74310 - DNA, 21 bp, Artificial Sequence
  Synthetic
cggtcagtgugatcgtcacut

SEQ ID NO: 74311 - DNA, 22 bp, Artificial Sequence
  Synthetic
tgatgttgccugcttacctguc

SEQ ID NO: 74312 - DNA, 27 bp, Artificial Sequence
  Synthetic
tgcaatcaaagccaaaautatggcuaa

SEQ ID NO: 74313 - DNA, 26 bp, Artificial Sequence
  Synthetic
gtaagatagtugttcgtgtccuccat

SEQ ID NO: 74314 - DNA, 23 bp, Artificial Sequence
  Synthetic
tttcctuacaccggtgcuagaag

SEQ ID NO: 74315 - DNA, 27 bp, Artificial Sequence
  Synthetic
gtttgagtcacutcagtagatggauga

SEQ ID NO: 74316 - DNA, 26 bp, Artificial Sequence
  Synthetic
cgagauattgucagcagagagagagt

SEQ ID NO: 74317 - DNA, 28 bp, Artificial Sequence
  Synthetic
cttccaccuaaaagcaaagttuaaccaa

SEQ ID NO: 74318 - DNA, 18 bp, Artificial Sequence
  Synthetic
ggtccagguggccuagga

SEQ ID NO: 74319 - DNA, 17 bp, Artificial Sequence
  Synthetic
cgggtccugggctcuca

SEQ ID NO: 74320 - DNA, 17 bp, Artificial Sequence
  Synthetic
cccuggagccacaugcc

SEQ ID NO: 74321 - DNA, 21 bp, Artificial Sequence
  Synthetic
tcagggaacucacgcatcauc

SEQ ID NO: 74322 - DNA, 25 bp, Artificial Sequence
  Synthetic
ctttggtctuccctcagaaaguaac

SEQ ID NO: 74323 - DNA, 20 bp, Artificial Sequence
  Synthetic
agccucugaagacaccccat

SEQ ID NO: 74324 - DNA, 22 bp, Artificial Sequence
  Synthetic
gggtgtctucagaggctaauga

SEQ ID NO: 74325 - DNA, 28 bp, Artificial Sequence
  Synthetic
tggaacacaauggaaaaagatcucagaa

SEQ ID NO: 74326 - DNA, 25 bp, Artificial Sequence
  Synthetic
atcttttcagcauttggaggcuact

SEQ ID NO: 74327 - DNA, 24 bp, Artificial Sequence
  Synthetic
gaattgtaaugaccctggaugcct

SEQ ID NO: 74328 - DNA, 28 bp, Artificial Sequence
  Synthetic
gctuggagataatgatugggaagaagaa

SEQ ID NO: 74329 - DNA, 26 bp, Artificial Sequence
  Synthetic
tgcctcatggcacuatctataccuat

SEQ ID NO: 74330 - DNA, 24 bp, Artificial Sequence
  Synthetic
ctggaaaatgaaugctctgagcut

SEQ ID NO: 74331 - DNA, 18 bp, Artificial Sequence
  Synthetic
ctgaggagcugggccauc

SEQ ID NO: 74332 - DNA, 18 bp, Artificial Sequence
  Synthetic
gcagguaccgugcgacat

SEQ ID NO: 74333 - DNA, 17 bp, Artificial Sequence
  Synthetic
gaccccgccacucucac

SEQ ID NO: 74334 - DNA, 17 bp, Artificial Sequence
  Synthetic
cacgggucgggugagag

SEQ ID NO: 74335 - DNA, 22 bp, Artificial Sequence
  Synthetic
acacaagctucctttccgucat

SEQ ID NO: 74336 - DNA, 25 bp, Artificial Sequence
  Synthetic
agaagggagggaagguttagaauct

SEQ ID NO: 74337 - DNA, 23 bp, Artificial Sequence
  Synthetic
ccgtgactguagtgttctctcug

SEQ ID NO: 74338 - DNA, 18 bp, Artificial Sequence
  Synthetic
gggugctgtgugaaggga

SEQ ID NO: 74339 - DNA, 19 bp, Artificial Sequence
  Synthetic
cctgacccugagcctctug

SEQ ID NO: 74340 - DNA, 23 bp, Artificial Sequence
  Synthetic
tcaggctcucctgtcttctctut

SEQ ID NO: 74341 - DNA, 24 bp, Artificial Sequence
  Synthetic
caaccucaagagaguggacagaat

SEQ ID NO: 74342 - DNA, 20 bp, Artificial Sequence
  Synthetic
cacuggctctgugcagaact

SEQ ID NO: 74343 - DNA, 23 bp, Artificial Sequence
  Synthetic
gctttaacagugcgccttcttug

SEQ ID NO: 74344 - DNA, 22 bp, Artificial Sequence
  Synthetic
tgugcaguccaggaaacagaaa

SEQ ID NO: 74345 - DNA, 28 bp, Artificial Sequence
  Synthetic
ctgcattttgtuggtttgacaattuaca

SEQ ID NO: 74346 - DNA, 21 bp, Artificial Sequence
  Synthetic
gtcaggccugggacttctuat

SEQ ID NO: 74347 - DNA, 22 bp, Artificial Sequence
  Synthetic
cagatgcagaugaccccactua

SEQ ID NO: 74348 - DNA, 26 bp, Artificial Sequence
  Synthetic
agattaaagcuttctgcaucgaacca

SEQ ID NO: 74349 - DNA, 27 bp, Artificial Sequence
  Synthetic
tcgttcagaatgucttcactgattcuc

SEQ ID NO: 74350 - DNA, 24 bp, Artificial Sequence
  Synthetic
tacactaactuggcgctattucca

SEQ ID NO: 74351 - DNA, 27 bp, Artificial Sequence
  Synthetic
ggtgccttctucagggttaatttuaga

SEQ ID NO: 74352 - DNA, 21 bp, Artificial Sequence
  Synthetic
cugggtucagcagaaagagga

SEQ ID NO: 74353 - DNA, 28 bp, Artificial Sequence
  Synthetic
tgctaccttataucccttctcacctuag

SEQ ID NO: 74354 - DNA, 22 bp, Artificial Sequence
  Synthetic
ccgcggtuaggtaggaagtaut

SEQ ID NO: 74355 - DNA, 21 bp, Artificial Sequence
  Synthetic
gaatgccguaccctacuccag

SEQ ID NO: 74356 - DNA, 21 bp, Artificial Sequence
  Synthetic
aaacctgcgutagggtcucag

SEQ ID NO: 74357 - DNA, 26 bp, Artificial Sequence
  Synthetic
ctcaatagtaacuctggccatagcut

SEQ ID NO: 74358 - DNA, 20 bp, Artificial Sequence
  Synthetic
ctccgaagcagucacugagg

SEQ ID NO: 74359 - DNA, 23 bp, Artificial Sequence
  Synthetic
agacagccaccuatgaggacaua

SEQ ID NO: 74360 - DNA, 24 bp, Artificial Sequence
  Synthetic
tgcccttgugaagcctgattaaut

SEQ ID NO: 74361 - DNA, 20 bp, Artificial Sequence
  Synthetic
ccaagcacugaauccgcaag

SEQ ID NO: 74362 - DNA, 22 bp, Artificial Sequence
  Synthetic
ctagtgttccuggtcctgacut

SEQ ID NO: 74363 - DNA, 26 bp, Artificial Sequence
  Synthetic
ggattgaagaucggaggattatcgut

SEQ ID NO: 74364 - DNA, 26 bp, Artificial Sequence
  Synthetic
agaacaaaacuatggctcugaaacct

SEQ ID NO: 74365 - DNA, 22 bp, Artificial Sequence
  Synthetic
gugagagtgaucagaccaagcc

SEQ ID NO: 74366 - DNA, 21 bp, Artificial Sequence
  Synthetic
gtgaucacagtcacugacacc

SEQ ID NO: 74367 - DNA, 24 bp, Artificial Sequence
  Synthetic
agttttcaaagacutcgcccauga

SEQ ID NO: 74368 - DNA, 20 bp, Artificial Sequence
  Synthetic
cagccccacutgcttttgug

SEQ ID NO: 74369 - DNA, 19 bp, Artificial Sequence
  Synthetic
tcagugccaugggcaagag

SEQ ID NO: 74370 - DNA, 22 bp, Artificial Sequence
  Synthetic
tgaagaatcuccctggcucaga

SEQ ID NO: 74371 - DNA, 20 bp, Artificial Sequence
  Synthetic
aggcagcggcuctagtauca

SEQ ID NO: 74372 - DNA, 25 bp, Artificial Sequence
  Synthetic
gactctgaggutagaaaguggcaaa

SEQ ID NO: 74373 - DNA, 27 bp, Artificial Sequence
  Synthetic
gatatgtccuttcttctgatucagggt

SEQ ID NO: 74374 - DNA, 23 bp, Artificial Sequence
  Synthetic
gcaggatuacctggtuggaaagt

SEQ ID NO: 74375 - DNA, 22 bp, Artificial Sequence
  Synthetic
ctgtctgcautctgtctuccca

SEQ ID NO: 74376 - DNA, 28 bp, Artificial Sequence
  Synthetic
gctgcaacuaaacaggtaaattcugagt

SEQ ID NO: 74377 - DNA, 25 bp, Artificial Sequence
  Synthetic
ctgcacaggugaccacatttatauc

SEQ ID NO: 74378 - DNA, 24 bp, Artificial Sequence
  Synthetic
cttgttcagcutctgggtucagat

SEQ ID NO: 74379 - DNA, 22 bp, Artificial Sequence
  Synthetic
ctcagtgatgucttccctguca

SEQ ID NO: 74380 - DNA, 25 bp, Artificial Sequence
  Synthetic
tgccttccttcutgcctattttgut

SEQ ID NO: 74381 - DNA, 20 bp, Artificial Sequence
  Synthetic
gatcuggcagcccaucaact

SEQ ID NO: 74382 - DNA, 24 bp, Artificial Sequence
  Synthetic
gccuttaaagucacgaaagcacaa

SEQ ID NO: 74383 - DNA, 26 bp, Artificial Sequence
  Synthetic
gtcatttgttggutttcagcttcugt

SEQ ID NO: 74384 - DNA, 20 bp, Artificial Sequence
  Synthetic
ccaccctggugctgactauc

SEQ ID NO: 74385 - DNA, 28 bp, Artificial Sequence
  Synthetic
ggatgattuacaggtcagtaucaaacca

SEQ ID NO: 74386 - DNA, 21 bp, Artificial Sequence
  Synthetic
cactccaagucctgtgauggt

SEQ ID NO: 74387 - DNA, 21 bp, Artificial Sequence
  Synthetic
caaagggtgcucctggtacuc

SEQ ID NO: 74388 - DNA, 19 bp, Artificial Sequence
  Synthetic
tgtgcguactgtcctucgg

SEQ ID NO: 74389 - DNA, 27 bp, Artificial Sequence
  Synthetic
cttaaccacaacuggtagtccatagug

SEQ ID NO: 74390 - DNA, 21 bp, Artificial Sequence
  Synthetic
cagagtggagaugcagctgua

SEQ ID NO: 74391 - DNA, 26 bp, Artificial Sequence
  Synthetic
ctcuaggaagagacacaaacuggaat

SEQ ID NO: 74392 - DNA, 21 bp, Artificial Sequence
  Synthetic
cgctguccagcaatacctuga

SEQ ID NO: 74393 - DNA, 21 bp, Artificial Sequence
  Synthetic
ggtgctgauggtcctgctgua

SEQ ID NO: 74394 - DNA, 21 bp, Artificial Sequence
  Synthetic
cctccaggugacagcaaucag

SEQ ID NO: 74395 - DNA, 27 bp, Artificial Sequence
  Synthetic
tggcagattuacaaatagccuaaacca

SEQ ID NO: 74396 - DNA, 22 bp, Artificial Sequence
  Synthetic
gctacgggcaaucactctccua

SEQ ID NO: 74397 - DNA, 23 bp, Artificial Sequence
  Synthetic
cgagaucugaagccagagaacat

SEQ ID NO: 74398 - DNA, 20 bp, Artificial Sequence
  Synthetic
cccagaaugcagttcgccut

SEQ ID NO: 74399 - DNA, 28 bp, Artificial Sequence
  Synthetic
caacagctagagaugcttcatttucaat

SEQ ID NO: 74400 - DNA, 22 bp, Artificial Sequence
  Synthetic
gtggcatgugatgcctauagca

SEQ ID NO: 74401 - DNA, 27 bp, Artificial Sequence
  Synthetic
ccaaccaatugagaagtttguaacaga

SEQ ID NO: 74402 - DNA, 17 bp, Artificial Sequence
  Synthetic
ccucgcctgcugagcat

SEQ ID NO: 74403 - DNA, 18 bp, Artificial Sequence
  Synthetic
ccgccugggugaagaagg

SEQ ID NO: 74404 - DNA, 17 bp, Artificial Sequence
  Synthetic
cgccagccugactcgug

SEQ ID NO: 74405 - DNA, 17 bp, Artificial Sequence
  Synthetic
accccacccugggctua

SEQ ID NO: 74406 - DNA, 27 bp, Artificial Sequence
  Synthetic
agtaggtcttugcctagttcatcgaua

SEQ ID NO: 74407 - DNA, 28 bp, Artificial Sequence
  Synthetic
cttatgtccatgugtggttcttttguag

SEQ ID NO: 74408 - DNA, 21 bp, Artificial Sequence
  Synthetic
gtuccaccacttgucaccaga

SEQ ID NO: 74409 - DNA, 25 bp, Artificial Sequence
  Synthetic
catctgtaccucccctttgaaacua

SEQ ID NO: 74410 - DNA, 27 bp, Artificial Sequence
  Synthetic
tcaaggaaagcagagugaaacaaaaug

SEQ ID NO: 74411 - DNA, 20 bp, Artificial Sequence
  Synthetic
cttggauccgcttgccatug

SEQ ID NO: 74412 - DNA, 20 bp, Artificial Sequence
  Synthetic
tctccccucccctuccaaaa

SEQ ID NO: 74413 - DNA, 18 bp, Artificial Sequence
  Synthetic
tcgtcucggagcaggtug

SEQ ID NO: 74414 - DNA, 17 bp, Artificial Sequence
  Synthetic
cugctgugccacgaggt

SEQ ID NO: 74415 - DNA, 20 bp, Artificial Sequence
  Synthetic
cgcatguagggttggatguc

SEQ ID NO: 74416 - DNA, 27 bp, Artificial Sequence
  Synthetic
gatatagagtauccttgcacucccaaa

SEQ ID NO: 74417 - DNA, 28 bp, Artificial Sequence
  Synthetic
cacaaagagtcuacatgtctagggtcua

SEQ ID NO: 74418 - DNA, 22 bp, Artificial Sequence
  Synthetic
cctactucaagtgcgugcagaa

SEQ ID NO: 74419 - DNA, 22 bp, Artificial Sequence
  Synthetic
gattgcccuctcccaggttuag

SEQ ID NO: 74420 - DNA, 27 bp, Artificial Sequence
  Synthetic
atttctgacaaugaactgagagtuggt

SEQ ID NO: 74421 - DNA, 21 bp, Artificial Sequence
  Synthetic
ggctgtuccaattccugagca

SEQ ID NO: 74422 - DNA, 22 bp, Artificial Sequence
  Synthetic
ccccttctccutttcccttgut

SEQ ID NO: 74423 - DNA, 22 bp, Artificial Sequence
  Synthetic
ccccaacccuctctcctatgua

SEQ ID NO: 74424 - DNA, 23 bp, Artificial Sequence
  Synthetic
gtttctttagcccuggtcctcut

SEQ ID NO: 74425 - DNA, 29 bp, Artificial Sequence
  Synthetic
gaataaatctcttugcgtcattgaacuga

SEQ ID NO: 74426 - DNA, 24 bp, Artificial Sequence
  Synthetic
ctctctctguttccatctccucct

SEQ ID NO: 74427 - DNA, 20 bp, Artificial Sequence
  Synthetic
ggatatcugccgtccgtgut

SEQ ID NO: 74428 - DNA, 17 bp, Artificial Sequence
  Synthetic
gccccugtcaguggaca

SEQ ID NO: 74429 - DNA, 20 bp, Artificial Sequence
  Synthetic
agatggtgcugccctgatuc

SEQ ID NO: 74430 - DNA, 19 bp, Artificial Sequence
  Synthetic
gccuggcucagcaaacaat

SEQ ID NO: 74431 - DNA, 19 bp, Artificial Sequence
  Synthetic
agaggcaccugccucaaag

SEQ ID NO: 74432 - DNA, 17 bp, Artificial Sequence
  Synthetic
gccaucgccagcatucc

SEQ ID NO: 74433 - DNA, 20 bp, Artificial Sequence
  Synthetic
gccccucaagctcagacuct

SEQ ID NO: 74434 - DNA, 19 bp, Artificial Sequence
  Synthetic
ccaguccgagagccaacug

SEQ ID NO: 74435 - DNA, 19 bp, Artificial Sequence
  Synthetic
cgctcaccauggtcucagg

SEQ ID NO: 74436 - DNA, 17 bp, Artificial Sequence
  Synthetic
cccccaccugcugagga

SEQ ID NO: 74437 - DNA, 24 bp, Artificial Sequence
  Synthetic
acacaggcauggaaagaagaguag

SEQ ID NO: 74438 - DNA, 23 bp, Artificial Sequence
  Synthetic
acctggcctutttcttgtcctut

SEQ ID NO: 74439 - DNA, 20 bp, Artificial Sequence
  Synthetic
gctauggcgacctgcucaac

SEQ ID NO: 74440 - DNA, 20 bp, Artificial Sequence
  Synthetic
tcagccutcctucgcagaaa

SEQ ID NO: 74441 - DNA, 22 bp, Artificial Sequence
  Synthetic
gtctcatgcucctgttcaugga

SEQ ID NO: 74442 - DNA, 25 bp, Artificial Sequence
  Synthetic
ggttttgtcugcaagataccagtuc

SEQ ID NO: 74443 - DNA, 29 bp, Artificial Sequence
  Synthetic
acgagcctcacaaucttctctataaauct

SEQ ID NO: 74444 - DNA, 28 bp, Artificial Sequence
  Synthetic
ggacccacttccuaaaatagagaacaut

SEQ ID NO: 74445 - DNA, 26 bp, Artificial Sequence
  Synthetic
catacagcaagaaacacuttcggaut

SEQ ID NO: 74446 - DNA, 23 bp, Artificial Sequence
  Synthetic
gcttctgttugcctaagcacaut

SEQ ID NO: 74447 - DNA, 25 bp, Artificial Sequence
  Synthetic
gccatgagtugatggaagaatcuct

SEQ ID NO: 74448 - DNA, 29 bp, Artificial Sequence
  Synthetic
aagtcaatatgttuaccgacccaagauac

SEQ ID NO: 74449 - DNA, 26 bp, Artificial Sequence
  Synthetic
aactattaactgauccctccccucaa

SEQ ID NO: 74450 - DNA, 27 bp, Artificial Sequence
  Synthetic
acatgggtatucattacctacccugaa

SEQ ID NO: 74451 - DNA, 28 bp, Artificial Sequence
  Synthetic
gccctctgaugcatgcttttatatuaca

SEQ ID NO: 74452 - DNA, 20 bp, Artificial Sequence
  Synthetic
catgccugaaccagatgcuc

SEQ ID NO: 74453 - DNA, 28 bp, Artificial Sequence
  Synthetic
gcagagagaaacacacuagaatttggua

SEQ ID NO: 74454 - DNA, 22 bp, Artificial Sequence
  Synthetic
ctgtatctugccttgcctucca

SEQ ID NO: 74455 - DNA, 25 bp, Artificial Sequence
  Synthetic
atcagcaguaacatacccaauagcc

SEQ ID NO: 74456 - DNA, 28 bp, Artificial Sequence
  Synthetic
tttgctttctattcutccttgctttgug

SEQ ID NO: 74457 - DNA, 28 bp, Artificial Sequence
  Synthetic
aaccggctctuctgataaaagtttuaga

SEQ ID NO: 74458 - DNA, 21 bp, Artificial Sequence
  Synthetic
ctgtactcguctgggtcagug

SEQ ID NO: 74459 - DNA, 26 bp, Artificial Sequence
  Synthetic
actctaacagauggtatgcaguaggt

SEQ ID NO: 74460 - DNA, 23 bp, Artificial Sequence
  Synthetic
ccctccctccuacttcctctcua

SEQ ID NO: 74461 - DNA, 19 bp, Artificial Sequence
  Synthetic
ccctcgcaccugagtgaug

SEQ ID NO: 74462 - DNA, 20 bp, Artificial Sequence
  Synthetic
ctgtcauagcgccactcuct

SEQ ID NO: 74463 - DNA, 19 bp, Artificial Sequence
  Synthetic
ccgctgugggagaaagcuc

SEQ ID NO: 74464 - DNA, 17 bp, Artificial Sequence
  Synthetic
cctguccccgctgucac

SEQ ID NO: 74465 - DNA, 26 bp, Artificial Sequence
  Synthetic
aactaaaagtgtugggagcattcuca

SEQ ID NO: 74466 - DNA, 21 bp, Artificial Sequence
  Synthetic
agaacggcuacacacagtugg

SEQ ID NO: 74467 - DNA, 21 bp, Artificial Sequence
  Synthetic
cctagaccugcgtcagtucct

SEQ ID NO: 74468 - DNA, 22 bp, Artificial Sequence
  Synthetic
agaagtagacagucaggcgcua

SEQ ID NO: 74469 - DNA, 22 bp, Artificial Sequence
  Synthetic
agacaccauctgcaggauaggt

SEQ ID NO: 74470 - DNA, 21 bp, Artificial Sequence
  Synthetic
ccaccucctctggauacccat

SEQ ID NO: 74471 - DNA, 28 bp, Artificial Sequence
  Synthetic
ctcactctgactuctcttgtttgttcua

SEQ ID NO: 74472 - DNA, 17 bp, Artificial Sequence
  Synthetic
gggctgaucaggcugct

SEQ ID NO: 74473 - DNA, 18 bp, Artificial Sequence
  Synthetic
cgaggugggagactggut

SEQ ID NO: 74474 - DNA, 19 bp, Artificial Sequence
  Synthetic
ctgcagcaguaccgcacua

SEQ ID NO: 74475 - DNA, 21 bp, Artificial Sequence
  Synthetic
caugaacaagacaagcgugga

SEQ ID NO: 74476 - DNA, 28 bp, Artificial Sequence
  Synthetic
aattctgcttaucagcaaaaaggaaugg

SEQ ID NO: 74477 - DNA, 18 bp, Artificial Sequence
  Synthetic
cctgtcccugccagugaa

SEQ ID NO: 74478 - DNA, 28 bp, Artificial Sequence
  Synthetic
cagaatgaattugaggagtttcagagut

SEQ ID NO: 74479 - DNA, 21 bp, Artificial Sequence
  Synthetic
ccacctcugaggtccugaaga

SEQ ID NO: 74480 - DNA, 26 bp, Artificial Sequence
  Synthetic
ctagatatugaaacccccaaggaguc

SEQ ID NO: 74481 - DNA, 26 bp, Artificial Sequence
  Synthetic
gaaactcatgggaugcttacacatut

SEQ ID NO: 74482 - DNA, 22 bp, Artificial Sequence
  Synthetic
acctugagaaacttgcaugcga

SEQ ID NO: 74483 - DNA, 27 bp, Artificial Sequence
  Synthetic
ggacctattggcugttttccctttuaa

SEQ ID NO: 74484 - DNA, 18 bp, Artificial Sequence
  Synthetic
acugaccccgaggacuca

SEQ ID NO: 74485 - DNA, 25 bp, Artificial Sequence
  Synthetic
gacactaacacuctgatctccaucc

SEQ ID NO: 74486 - DNA, 23 bp, Artificial Sequence
  Synthetic
aaagggtcutaccaagatuggca

SEQ ID NO: 74487 - DNA, 23 bp, Artificial Sequence
  Synthetic
acagtgtccacucaggaactcua

SEQ ID NO: 74488 - DNA, 27 bp, Artificial Sequence
  Synthetic
gggtggtagguatagttgtctattucc

SEQ ID NO: 74489 - DNA, 26 bp, Artificial Sequence
  Synthetic
acccctttcauccaacagaagattut

SEQ ID NO: 74490 - DNA, 26 bp, Artificial Sequence
  Synthetic
catggtautggaataacucacaggga

SEQ ID NO: 74491 - DNA, 27 bp, Artificial Sequence
  Synthetic
agacttgatttugccttgtatggcuat

SEQ ID NO: 74492 - DNA, 22 bp, Artificial Sequence
  Synthetic
caaacugtacacugcccacaga

SEQ ID NO: 74493 - DNA, 23 bp, Artificial Sequence
  Synthetic
caggagaggagutgggaaatgug

SEQ ID NO: 74494 - DNA, 22 bp, Artificial Sequence
  Synthetic
tgcactgaguctgcttctgtut

SEQ ID NO: 74495 - DNA, 22 bp, Artificial Sequence
  Synthetic
acggtcaaaggugaagatgucc

SEQ ID NO: 74496 - DNA, 25 bp, Artificial Sequence
  Synthetic
aggttcttggucctcaggaauagaa

SEQ ID NO: 74497 - DNA, 20 bp, Artificial Sequence
  Synthetic
cagggcatauccagctccuc

SEQ ID NO: 74498 - DNA, 17 bp, Artificial Sequence
  Synthetic
cugcgccggaccatgua

SEQ ID NO: 74499 - DNA, 19 bp, Artificial Sequence
  Synthetic
ctuagcaccccgacaccut

SEQ ID NO: 74500 - DNA, 25 bp, Artificial Sequence
  Synthetic
acgaagttgagagutccttcaccua

SEQ ID NO: 74501 - DNA, 17 bp, Artificial Sequence
  Synthetic
ccagcuccaugcagcga

SEQ ID NO: 74502 - DNA, 19 bp, Artificial Sequence
  Synthetic
ccaagagugccaagugcga

SEQ ID NO: 74503 - DNA, 24 bp, Artificial Sequence
  Synthetic
ccaccctaccuctctcactctcua

SEQ ID NO: 74504 - DNA, 20 bp, Artificial Sequence
  Synthetic
gggaguccgagagcagcaua

SEQ ID NO: 74505 - DNA, 24 bp, Artificial Sequence
  Synthetic
tttgtctgtcugtctgtttgucgt

SEQ ID NO: 74506 - DNA, 23 bp, Artificial Sequence
  Synthetic
tctggaauccaagcagaatugct

SEQ ID NO: 74507 - DNA, 23 bp, Artificial Sequence
  Synthetic
aaucccucccagagaaacagaga

SEQ ID NO: 74508 - DNA, 20 bp, Artificial Sequence
  Synthetic
agtttggcaucgtgctggua

SEQ ID NO: 74509 - DNA, 24 bp, Artificial Sequence
  Synthetic
tggacacttuctttttgaggucgt

SEQ ID NO: 74510 - DNA, 23 bp, Artificial Sequence
  Synthetic
ggcatggcautgagagttaggut

SEQ ID NO: 74511 - DNA, 23 bp, Artificial Sequence
  Synthetic
gtggtcacacuctggacctacua

SEQ ID NO: 74512 - DNA, 24 bp, Artificial Sequence
  Synthetic
tccagaguatgaauagcagcccat

SEQ ID NO: 74513 - DNA, 28 bp, Artificial Sequence
  Synthetic
agctttttacaaguaacaactccacugt

SEQ ID NO: 74514 - DNA, 27 bp, Artificial Sequence
  Synthetic
ctttttctctttugctgatgctaugct

SEQ ID NO: 74515 - DNA, 20 bp, Artificial Sequence
  Synthetic
gccaagaaacgguccaggua

SEQ ID NO: 74516 - DNA, 19 bp, Artificial Sequence
  Synthetic
cccacagccauctccagua

SEQ ID NO: 74517 - DNA, 18 bp, Artificial Sequence
  Synthetic
tcccccacagccugatug

SEQ ID NO: 74518 - DNA, 22 bp, Artificial Sequence
  Synthetic
ccccaagagcagauacugagac

SEQ ID NO: 74519 - DNA, 22 bp, Artificial Sequence
  Synthetic
gccagtgcucagtggactuaac

SEQ ID NO: 74520 - DNA, 23 bp, Artificial Sequence
  Synthetic
gatacatcucgaggccagtcauc

SEQ ID NO: 74521 - DNA, 27 bp, Artificial Sequence
  Synthetic
ctattctgagucctctttctgcugaac

SEQ ID NO: 74522 - DNA, 21 bp, Artificial Sequence
  Synthetic
gtcttcccuctggccaugaat

SEQ ID NO: 74523 - DNA, 22 bp, Artificial Sequence
  Synthetic
ggtgtaaaugcacagcttcucc

SEQ ID NO: 74524 - DNA, 22 bp, Artificial Sequence
  Synthetic
gccuccaaacucaaagagacca

SEQ ID NO: 74525 - DNA, 21 bp, Artificial Sequence
  Synthetic
gctctggcaguggtgauagaa

SEQ ID NO: 74526 - DNA, 20 bp, Artificial Sequence
  Synthetic
aaatgaatggcugccccgua

SEQ ID NO: 74527 - DNA, 24 bp, Artificial Sequence
  Synthetic
ggacatcauacccatcatccucat

SEQ ID NO: 74528 - DNA, 27 bp, Artificial Sequence
  Synthetic
gcttttaatccuccacatggaatccua

SEQ ID NO: 74529 - DNA, 22 bp, Artificial Sequence
  Synthetic
gagaguagcaguaacggcacag

SEQ ID NO: 74530 - DNA, 23 bp, Artificial Sequence
  Synthetic
cgaaggagaugttgacugagagg

SEQ ID NO: 74531 - DNA, 27 bp, Artificial Sequence
  Synthetic
agcutcccaagtuaaagaagaaacaga

SEQ ID NO: 74532 - DNA, 20 bp, Artificial Sequence
  Synthetic
ctctggaacugggcacacuc

SEQ ID NO: 74533 - DNA, 23 bp, Artificial Sequence
  Synthetic
tgaacatcatggucctccacauc

SEQ ID NO: 74534 - DNA, 20 bp, Artificial Sequence
  Synthetic
tggucccgaggagucagaaa

SEQ ID NO: 74535 - DNA, 23 bp, Artificial Sequence
  Synthetic
cccaaagtaguctggagacucac

SEQ ID NO: 74536 - DNA, 21 bp, Artificial Sequence
  Synthetic
gucttctccaucacaccccaa

SEQ ID NO: 74537 - DNA, 22 bp, Artificial Sequence
  Synthetic
agctagtagcugagagctcugt

SEQ ID NO: 74538 - DNA, 26 bp, Artificial Sequence
  Synthetic
tttccaagtugggattcttagtguga

SEQ ID NO: 74539 - DNA, 19 bp, Artificial Sequence
  Synthetic
gtcacugggttggucccat

SEQ ID NO: 74540 - DNA, 28 bp, Artificial Sequence
  Synthetic
actgggacttgcuttgtttttagaatug

SEQ ID NO: 74541 - DNA, 28 bp, Artificial Sequence
  Synthetic
ccaagaaatcgguactctttcacucaag

SEQ ID NO: 74542 - DNA, 23 bp, Artificial Sequence
  Synthetic
caggtuagagaagggaggacugt

SEQ ID NO: 74543 - DNA, 21 bp, Artificial Sequence
  Synthetic
cagcatuagcaaacctuggct

SEQ ID NO: 74544 - DNA, 28 bp, Artificial Sequence
  Synthetic
agctaatgacuagggccttatatcctut

SEQ ID NO: 74545 - DNA, 27 bp, Artificial Sequence
  Synthetic
catggcaccaguttactcagaattuac

SEQ ID NO: 74546 - DNA, 25 bp, Artificial Sequence
  Synthetic
tggttctgattuctgctctgctaug

SEQ ID NO: 74547 - DNA, 24 bp, Artificial Sequence
  Synthetic
aggttgcgguaacataaaggtgut

SEQ ID NO: 74548 - DNA, 26 bp, Artificial Sequence
  Synthetic
agggacagacugtcattcaaaauagg

SEQ ID NO: 74549 - DNA, 25 bp, Artificial Sequence
  Synthetic
tcgcgatcuaaaaccacagaacaut

SEQ ID NO: 74550 - DNA, 25 bp, Artificial Sequence
  Synthetic
tgctagcagucttggtactttguaa

SEQ ID NO: 74551 - DNA, 20 bp, Artificial Sequence
  Synthetic
tguatacagccucccacgct

SEQ ID NO: 74552 - DNA, 22 bp, Artificial Sequence
  Synthetic
gttttatttguccgctgcuggt

SEQ ID NO: 74553 - DNA, 25 bp, Artificial Sequence
  Synthetic
catagcaaatgcucaacttccgtut

SEQ ID NO: 74554 - DNA, 28 bp, Artificial Sequence
  Synthetic
gatgcatctgtuactatcttttgctuct

SEQ ID NO: 74555 - DNA, 20 bp, Artificial Sequence
  Synthetic
gctgccacuccctcuaggat

SEQ ID NO: 74556 - DNA, 26 bp, Artificial Sequence
  Synthetic
tcagaaaugagaaaccaccaaucaca

SEQ ID NO: 74557 - DNA, 29 bp, Artificial Sequence
  Synthetic
gatgatcagtcaguttatcctaaggcaut

SEQ ID NO: 74558 - DNA, 28 bp, Artificial Sequence
  Synthetic
accttccaagaguttttgacatgatgua

SEQ ID NO: 74559 - DNA, 27 bp, Artificial Sequence
  Synthetic
attttagaatcagugatcgcctctugt

SEQ ID NO: 74560 - DNA, 21 bp, Artificial Sequence
  Synthetic
tgatgctgaugcccccaauac

SEQ ID NO: 74561 - DNA, 21 bp, Artificial Sequence
  Synthetic
gctgtgaggaugccagttuct

SEQ ID NO: 74562 - DNA, 22 bp, Artificial Sequence
  Synthetic
cccatcgtgguagatccgttug

SEQ ID NO: 74563 - DNA, 24 bp, Artificial Sequence
  Synthetic
ccagtctccuaaactgccatctua

SEQ ID NO: 74564 - DNA, 28 bp, Artificial Sequence
  Synthetic
gtaattcaacuaaaagaaaggcagcugt

SEQ ID NO: 74565 - DNA, 22 bp, Artificial Sequence
  Synthetic
ttgcctugcctttgtgttucag

SEQ ID NO: 74566 - DNA, 27 bp, Artificial Sequence
  Synthetic
aggaguatatggcauagcaaagaggaa

SEQ ID NO: 74567 - DNA, 28 bp, Artificial Sequence
  Synthetic
cactattttcataugagactccgtcugg

SEQ ID NO: 74568 - DNA, 30 bp, Artificial Sequence
  Synthetic
tccaagaacatttutgcaattcttcaauct

SEQ ID NO: 74569 - DNA, 28 bp, Artificial Sequence
  Synthetic
atgtcttcaacgutactacactgcaaua

SEQ ID NO: 74570 - DNA, 20 bp, Artificial Sequence
  Synthetic
cctatgggugcccttcucca

SEQ ID NO: 74571 - DNA, 23 bp, Artificial Sequence
  Synthetic
agtatgggcucagctgcaatuac

SEQ ID NO: 74572 - DNA, 21 bp, Artificial Sequence
  Synthetic
gaacuggagcccagctactua

SEQ ID NO: 74573 - DNA, 21 bp, Artificial Sequence
  Synthetic
ctgacccatautcccctgcuc

SEQ ID NO: 74574 - DNA, 22 bp, Artificial Sequence
  Synthetic
gccccttcucccatgttttcut

SEQ ID NO: 74575 - DNA, 24 bp, Artificial Sequence
  Synthetic
tcggttaccgugatcaaaatcucc

SEQ ID NO: 74576 - DNA, 23 bp, Artificial Sequence
  Synthetic
gggaatgcagutgaggauccaat

SEQ ID NO: 74577 - DNA, 23 bp, Artificial Sequence
  Synthetic
gggtccaaagaaccuaagaguct

SEQ ID NO: 74578 - DNA, 17 bp, Artificial Sequence
  Synthetic
guggcggcgagaagaug

SEQ ID NO: 74579 - DNA, 18 bp, Artificial Sequence
  Synthetic
cgtcaggcucaggtccut

SEQ ID NO: 74580 - DNA, 28 bp, Artificial Sequence
  Synthetic
aaaagataaccucacaccagaaatucca

SEQ ID NO: 74581 - DNA, 28 bp, Artificial Sequence
  Synthetic
gaagaaaaaugatacctuagaccccgaa

SEQ ID NO: 74582 - DNA, 25 bp, Artificial Sequence
  Synthetic
ctagccttccuagaccatttaccuc

SEQ ID NO: 74583 - DNA, 22 bp, Artificial Sequence
  Synthetic
gcttgccauacagagccactut

SEQ ID NO: 74584 - DNA, 18 bp, Artificial Sequence
  Synthetic
cctggtgugcctccctuc

SEQ ID NO: 74585 - DNA, 18 bp, Artificial Sequence
  Synthetic
ggctggcguatcccagut

SEQ ID NO: 74586 - DNA, 21 bp, Artificial Sequence
  Synthetic
gggctccacacucaactacuc

SEQ ID NO: 74587 - DNA, 19 bp, Artificial Sequence
  Synthetic
tggccucacctgugaggat

SEQ ID NO: 74588 - DNA, 20 bp, Artificial Sequence
  Synthetic
acagtggcauccccaacauc

SEQ ID NO: 74589 - DNA, 21 bp, Artificial Sequence
  Synthetic
ccatcaagcutgggucacaac

SEQ ID NO: 74590 - DNA, 26 bp, Artificial Sequence
  Synthetic
tgactaaagucttcacucaccaagga

SEQ ID NO: 74591 - DNA, 28 bp, Artificial Sequence
  Synthetic
gcccaagtcttautcacatgtcttcuaa

SEQ ID NO: 74592 - DNA, 20 bp, Artificial Sequence
  Synthetic
cagacaggcutgcaggctua

SEQ ID NO: 74593 - DNA, 18 bp, Artificial Sequence
  Synthetic
cgacgtugcaggguacct

SEQ ID NO: 74594 - DNA, 17 bp, Artificial Sequence
  Synthetic
gggaaccuggcgucagt

SEQ ID NO: 74595 - DNA, 18 bp, Artificial Sequence
  Synthetic
cttccuggacacgcuggt

SEQ ID NO: 74596 - DNA, 17 bp, Artificial Sequence
  Synthetic
cgctccucggccaaguc

SEQ ID NO: 74597 - DNA, 18 bp, Artificial Sequence
  Synthetic
cagacccugccactcuca

SEQ ID NO: 74598 - DNA, 20 bp, Artificial Sequence
  Synthetic
ggcagctaguggctgtcuaa

SEQ ID NO: 74599 - DNA, 21 bp, Artificial Sequence
  Synthetic
cuctccuccgaagaaacagca

SEQ ID NO: 74600 - DNA, 21 bp, Artificial Sequence
  Synthetic
ccutcagcuaagacagccagt

SEQ ID NO: 74601 - DNA, 28 bp, Artificial Sequence
  Synthetic
atgttaacttugatgtcttccuccaaca

SEQ ID NO: 74602 - DNA, 17 bp, Artificial Sequence
  Synthetic
cgggcagcaucaugcac

SEQ ID NO: 74603 - DNA, 18 bp, Artificial Sequence
  Synthetic
gccggcauctcccauacc

SEQ ID NO: 74604 - DNA, 23 bp, Artificial Sequence
  Synthetic
ggagguagggauggaaaggagat

SEQ ID NO: 74605 - DNA, 21 bp, Artificial Sequence
  Synthetic
aguaaaugagaggccccagga

SEQ ID NO: 74606 - DNA, 21 bp, Artificial Sequence
  Synthetic
ggactgaccutggtgttgtug

SEQ ID NO: 74607 - DNA, 18 bp, Artificial Sequence
  Synthetic
tctcucccccggtcucag

SEQ ID NO: 74608 - DNA, 22 bp, Artificial Sequence
  Synthetic
ccagttctgautctgctgcuct

SEQ ID NO: 74609 - DNA, 25 bp, Artificial Sequence
  Synthetic
ccactgagcuaccaaggtttucaaa

SEQ ID NO: 74610 - DNA, 18 bp, Artificial Sequence
  Synthetic
cgtgccuccgtaggtcug

SEQ ID NO: 74611 - DNA, 24 bp, Artificial Sequence
  Synthetic
cutcatctuagaggccacgaacat

SEQ ID NO: 74612 - DNA, 20 bp, Artificial Sequence
  Synthetic
cuggagcccgugaaaaagag

SEQ ID NO: 74613 - DNA, 18 bp, Artificial Sequence
  Synthetic
ccggauggagttgucggt

SEQ ID NO: 74614 - DNA, 21 bp, Artificial Sequence
  Synthetic
gccgagaagcugtgcatcuac

SEQ ID NO: 74615 - DNA, 22 bp, Artificial Sequence
  Synthetic
tcggaggagcagauatgucaga

SEQ ID NO: 74616 - DNA, 24 bp, Artificial Sequence
  Synthetic
gtgtggtugtctcccauaagaact

SEQ ID NO: 74617 - DNA, 25 bp, Artificial Sequence
  Synthetic
tcctgtgaaucttcactttcugcaa

SEQ ID NO: 74618 - DNA, 25 bp, Artificial Sequence
  Synthetic
ttgcagaaagugaagatucacagga

SEQ ID NO: 74619 - DNA, 28 bp, Artificial Sequence
  Synthetic
tctgacatctcuttatctgcaacuacct

SEQ ID NO: 74620 - DNA, 26 bp, Artificial Sequence
  Synthetic
tgttctgucaccagattatggttugt

SEQ ID NO: 74621 - DNA, 19 bp, Artificial Sequence
  Synthetic
cctttgucgaccggugcaa

SEQ ID NO: 74622 - DNA, 18 bp, Artificial Sequence
  Synthetic
cctgccuctggcctttuc

SEQ ID NO: 74623 - DNA, 17 bp, Artificial Sequence
  Synthetic
gggaaggugggctccuc

SEQ ID NO: 74624 - DNA, 22 bp, Artificial Sequence
  Synthetic
cgaccugaccaacatccactuc

SEQ ID NO: 74625 - DNA, 18 bp, Artificial Sequence
  Synthetic
cggagtguccctgcctua

SEQ ID NO: 74626 - DNA, 26 bp, Artificial Sequence
  Synthetic
tggccagaaagaauattugaagaggt

SEQ ID NO: 74627 - DNA, 25 bp, Artificial Sequence
  Synthetic
gaagaugagggacagtttggtuagg

SEQ ID NO: 74628 - DNA, 25 bp, Artificial Sequence
  Synthetic
gcattcugatcatttguaggcgaaa

SEQ ID NO: 74629 - DNA, 23 bp, Artificial Sequence
  Synthetic
ctuttctccaaaatuccgcagca

SEQ ID NO: 74630 - DNA, 23 bp, Artificial Sequence
  Synthetic
tgcugcggaatttuggagaaaag

SEQ ID NO: 74631 - DNA, 26 bp, Artificial Sequence
  Synthetic
accaaagccaggaaauacauacacat

SEQ ID NO: 74632 - DNA, 22 bp, Artificial Sequence
  Synthetic
gcccugcagtgaatttugaaga

SEQ ID NO: 74633 - DNA, 23 bp, Artificial Sequence
  Synthetic
ggatcugtgggttaugaaaccgt

SEQ ID NO: 74634 - DNA, 25 bp, Artificial Sequence
  Synthetic
gtgtgattacagucaaaaggccuct

SEQ ID NO: 74635 - DNA, 28 bp, Artificial Sequence
  Synthetic
cgaacttcucagaaaaatgccaacauac

SEQ ID NO: 74636 - DNA, 27 bp, Artificial Sequence
  Synthetic
tgttgttaaaugaggattuccccagat

SEQ ID NO: 74637 - DNA, 21 bp, Artificial Sequence
  Synthetic
aggaccacuaccttgcugaca

SEQ ID NO: 74638 - DNA, 24 bp, Artificial Sequence
  Synthetic
gaatcaactcugaacggaaagcug

SEQ ID NO: 74639 - DNA, 22 bp, Artificial Sequence
  Synthetic
ctcgatgttgutctgggcaaug

SEQ ID NO: 74640 - DNA, 22 bp, Artificial Sequence
  Synthetic
aggacauccagaaagcttuggt

SEQ ID NO: 74641 - DNA, 21 bp, Artificial Sequence
  Synthetic
cuaaaccugcagcagggagat

SEQ ID NO: 74642 - DNA, 20 bp, Artificial Sequence
  Synthetic
ctgagggccaaggguaacut

SEQ ID NO: 74643 - DNA, 21 bp, Artificial Sequence
  Synthetic
ctggagugaacccccagtuag

SEQ ID NO: 74644 - DNA, 22 bp, Artificial Sequence
  Synthetic
cccttccccutctcacattuca

SEQ ID NO: 74645 - DNA, 27 bp, Artificial Sequence
  Synthetic
ttatccattaagugaagggaagcucac

SEQ ID NO: 74646 - DNA, 22 bp, Artificial Sequence
  Synthetic
ggaagccctuctgttctgagut

SEQ ID NO: 74647 - DNA, 24 bp, Artificial Sequence
  Synthetic
tgacctttgaagcucctcttctuc

SEQ ID NO: 74648 - DNA, 26 bp, Artificial Sequence
  Synthetic
ccaaagaatuggaacagcugaaaact

SEQ ID NO: 74649 - DNA, 22 bp, Artificial Sequence
  Synthetic
tccccaaaucctgtcagtcuct

SEQ ID NO: 74650 - DNA, 22 bp, Artificial Sequence
  Synthetic
gttgaccaugctctgtttgcug

SEQ ID NO: 74651 - DNA, 23 bp, Artificial Sequence
  Synthetic
caccacagcugatgttacctcut

SEQ ID NO: 74652 - DNA, 20 bp, Artificial Sequence
  Synthetic
ggtaacgcugttgcctctug

SEQ ID NO: 74653 - DNA, 21 bp, Artificial Sequence
  Synthetic
ctgagcuggacttcttucggt

SEQ ID NO: 74654 - DNA, 22 bp, Artificial Sequence
  Synthetic
cagatuggaagtggugcaacaa

SEQ ID NO: 74655 - DNA, 17 bp, Artificial Sequence
  Synthetic
gcagcagugcccgtcuc

SEQ ID NO: 74656 - DNA, 17 bp, Artificial Sequence
  Synthetic
cgggagcggagcauguc

SEQ ID NO: 74657 - DNA, 22 bp, Artificial Sequence
  Synthetic
agggucgccaaatuaaagcgat

SEQ ID NO: 74658 - DNA, 30 bp, Artificial Sequence
  Synthetic
ctgttagtgtttgucgtaagtatacagugt

SEQ ID NO: 74659 - DNA, 22 bp, Artificial Sequence
  Synthetic
agagagctgcugcaactagaug

SEQ ID NO: 74660 - DNA, 29 bp, Artificial Sequence
  Synthetic
cagatttttgaucaccatacugaagagga

SEQ ID NO: 74661 - DNA, 20 bp, Artificial Sequence
  Synthetic
agaggtcccaucagcctuga

SEQ ID NO: 74662 - DNA, 21 bp, Artificial Sequence
  Synthetic
gcagcagcuctctggatucaa

SEQ ID NO: 74663 - DNA, 28 bp, Artificial Sequence
  Synthetic
ccccaaaaaggcauatacaacatucaaa

SEQ ID NO: 74664 - DNA, 18 bp, Artificial Sequence
  Synthetic
agggaacccuccgaguca

SEQ ID NO: 74665 - DNA, 17 bp, Artificial Sequence
  Synthetic
gcggccuctcuccaggt

SEQ ID NO: 74666 - DNA, 22 bp, Artificial Sequence
  Synthetic
ggcactguctgcatctguagag

SEQ ID NO: 74667 - DNA, 22 bp, Artificial Sequence
  Synthetic
gccaagagcucatgctttccut

SEQ ID NO: 74668 - DNA, 20 bp, Artificial Sequence
  Synthetic
gagagcuacacgtucacggt

SEQ ID NO: 74669 - DNA, 21 bp, Artificial Sequence
  Synthetic
aatttcucggccccttuccaa

SEQ ID NO: 74670 - DNA, 31 bp, Artificial Sequence
  Synthetic
ggaaacaagtcutcactttttctgtuaacat

SEQ ID NO: 74671 - DNA, 21 bp, Artificial Sequence
  Synthetic
ttggaatguggagcccatcuc

SEQ ID NO: 74672 - DNA, 26 bp, Artificial Sequence
  Synthetic
gaattatactgugagatgggcuccac

SEQ ID NO: 74673 - DNA, 20 bp, Artificial Sequence
  Synthetic
agauccgtaccugccaggat

SEQ ID NO: 74674 - DNA, 20 bp, Artificial Sequence
  Synthetic
cctaccaguctgugcagcaa

SEQ ID NO: 74675 - DNA, 22 bp, Artificial Sequence
  Synthetic
ccttatguggaacccccaccua

SEQ ID NO: 74676 - DNA, 23 bp, Artificial Sequence
  Synthetic
gtaaagatugagccctguggaca

SEQ ID NO: 74677 - DNA, 21 bp, Artificial Sequence
  Synthetic
aggccaccccutgtatcagua

SEQ ID NO: 74678 - DNA, 21 bp, Artificial Sequence
  Synthetic
aagaactucaggcgccaagua

SEQ ID NO: 74679 - DNA, 27 bp, Artificial Sequence
  Synthetic
ggcaagttcaacautattccctttugt

SEQ ID NO: 74680 - DNA, 18 bp, Artificial Sequence
  Synthetic
gccgcucaccctgtgtuc

SEQ ID NO: 74681 - DNA, 19 bp, Artificial Sequence
  Synthetic
cctccgccuctggcattut

SEQ ID NO: 74682 - DNA, 27 bp, Artificial Sequence
  Synthetic
gaatccagccugaagagttgaatuaga

SEQ ID NO: 74683 - DNA, 19 bp, Artificial Sequence
  Synthetic
cttacagcugcacgucgga

SEQ ID NO: 74684 - DNA, 25 bp, Artificial Sequence
  Synthetic
cacgatttcatugaacacttccuct

SEQ ID NO: 74685 - DNA, 17 bp, Artificial Sequence
  Synthetic
ccggccagggucaccua

SEQ ID NO: 74686 - DNA, 18 bp, Artificial Sequence
  Synthetic
ccaggcaaugagggugga

SEQ ID NO: 74687 - DNA, 20 bp, Artificial Sequence
  Synthetic
gccctgutggtgtucaagga

SEQ ID NO: 74688 - DNA, 18 bp, Artificial Sequence
  Synthetic
cctcgagcucctcgctut

SEQ ID NO: 74689 - DNA, 19 bp, Artificial Sequence
  Synthetic
aggaaccccugacacugga

SEQ ID NO: 74690 - DNA, 27 bp, Artificial Sequence
  Synthetic
gaacaagaauctacaggaauagccaca

SEQ ID NO: 74691 - DNA, 22 bp, Artificial Sequence
  Synthetic
gtcatgccugcctttctgtgua

SEQ ID NO: 74692 - DNA, 28 bp, Artificial Sequence
  Synthetic
ggtaattaacaaguatgcgaaugcaaga

SEQ ID NO: 74693 - DNA, 22 bp, Artificial Sequence
  Synthetic
caaaacgacugcaggagtggua

SEQ ID NO: 74694 - DNA, 28 bp, Artificial Sequence
  Synthetic
gtggcattattatutccggtttcttcut

SEQ ID NO: 74695 - DNA, 28 bp, Artificial Sequence
  Synthetic
cattcacaauccaaatttcacagucaga

SEQ ID NO: 74696 - DNA, 21 bp, Artificial Sequence
  Synthetic
acgccttguccagcatcttut

SEQ ID NO: 74697 - DNA, 21 bp, Artificial Sequence
  Synthetic
gcacgttcauctgacgtgugt

SEQ ID NO: 74698 - DNA, 24 bp, Artificial Sequence
  Synthetic
ccacttcctuggtttctccttugt

SEQ ID NO: 74699 - DNA, 25 bp, Artificial Sequence
  Synthetic
gcgactgctucttcagttactcuat

SEQ ID NO: 74700 - DNA, 27 bp, Artificial Sequence
  Synthetic
tcctttttagagutcaacttgctguga

SEQ ID NO: 74701 - DNA, 28 bp, Artificial Sequence
  Synthetic
ccttctctcctgugaccatagaatttua

SEQ ID NO: 74702 - DNA, 20 bp, Artificial Sequence
  Synthetic
cggacgcuctctttcaggug

SEQ ID NO: 74703 - DNA, 21 bp, Artificial Sequence
  Synthetic
agcaggugaaaatggcugaga

SEQ ID NO: 74704 - DNA, 25 bp, Artificial Sequence
  Synthetic
aaccttaguacaaacctcggttguc

SEQ ID NO: 74705 - DNA, 26 bp, Artificial Sequence
  Synthetic
agcatgatttattuatgggccaccut

SEQ ID NO: 74706 - DNA, 28 bp, Artificial Sequence
  Synthetic
gccgtagacugtccagaaaatatuaaga

SEQ ID NO: 74707 - DNA, 26 bp, Artificial Sequence
  Synthetic
ctattctgucaaaaagctctccucca

SEQ ID NO: 74708 - DNA, 24 bp, Artificial Sequence
  Synthetic
ttctggaguactgtaguggaggag

SEQ ID NO: 74709 - DNA, 26 bp, Artificial Sequence
  Synthetic
caugagcaatttugaaaggacaacga

SEQ ID NO: 74710 - DNA, 25 bp, Artificial Sequence
  Synthetic
gggagctguccttaaaattcuccaa

SEQ ID NO: 74711 - DNA, 28 bp, Artificial Sequence
  Synthetic
tctggtagcagguctaagatataaggug

SEQ ID NO: 74712 - DNA, 21 bp, Artificial Sequence
  Synthetic
agctggcgcuaaagaauagcc

SEQ ID NO: 74713 - DNA, 28 bp, Artificial Sequence
  Synthetic
ggcttatggttugcttagttttctucat

SEQ ID NO: 74714 - DNA, 22 bp, Artificial Sequence
  Synthetic
gcttacctcacucctccccaut

SEQ ID NO: 74715 - DNA, 20 bp, Artificial Sequence
  Synthetic
cagcgaggugaagccuagag

SEQ ID NO: 74716 - DNA, 18 bp, Artificial Sequence
  Synthetic
ggcccacgagcuctguag

SEQ ID NO: 74717 - DNA, 19 bp, Artificial Sequence
  Synthetic
caagtuagggcccggacug

SEQ ID NO: 74718 - DNA, 29 bp, Artificial Sequence
  Synthetic
gatggagacactuggagaaaatgagtaut

SEQ ID NO: 74719 - DNA, 27 bp, Artificial Sequence
  Synthetic
cagtcacagaccugcataattattugt

SEQ ID NO: 74720 - DNA, 24 bp, Artificial Sequence
  Synthetic
ggctcttcucagacatgtgaucaa

SEQ ID NO: 74721 - DNA, 22 bp, Artificial Sequence
  Synthetic
cagatagcaccutcagcacuct

SEQ ID NO: 74722 - DNA, 24 bp, Artificial Sequence
  Synthetic
gcacatatgcacucccagtauaca

SEQ ID NO: 74723 - DNA, 20 bp, Artificial Sequence
  Synthetic
ttgacccugtcatgcagucc

SEQ ID NO: 74724 - DNA, 24 bp, Artificial Sequence
  Synthetic
cgaaaaacuactguggaccacaag

SEQ ID NO: 74725 - DNA, 28 bp, Artificial Sequence
  Synthetic
ctaattagaacugcagatgctauacaca

SEQ ID NO: 74726 - DNA, 26 bp, Artificial Sequence
  Synthetic
aacatgcttacugtttcagagagugt

SEQ ID NO: 74727 - DNA, 27 bp, Artificial Sequence
  Synthetic
ggcaagtuaggcattatgcaaatuact

SEQ ID NO: 74728 - DNA, 21 bp, Artificial Sequence
  Synthetic
tgcguccacagcaatauccaa

SEQ ID NO: 74729 - DNA, 19 bp, Artificial Sequence
  Synthetic
agtacguggacgacgtcug

SEQ ID NO: 74730 - DNA, 21 bp, Artificial Sequence
  Synthetic
tgagggtguctcccctttuct

SEQ ID NO: 74731 - DNA, 22 bp, Artificial Sequence
  Synthetic
cctaacccugagttccccttug

SEQ ID NO: 74732 - DNA, 22 bp, Artificial Sequence
  Synthetic
gccaggcautgttgaacaugag

SEQ ID NO: 74733 - DNA, 23 bp, Artificial Sequence
  Synthetic
gggatuccctatacugagaccat

SEQ ID NO: 74734 - DNA, 20 bp, Artificial Sequence
  Synthetic
gccccgutaagtccacugag

SEQ ID NO: 74735 - DNA, 24 bp, Artificial Sequence
  Synthetic
tgacttctctuggtttggttguca

SEQ ID NO: 74736 - DNA, 22 bp, Artificial Sequence
  Synthetic
cctctctgacucccctgugaaa

SEQ ID NO: 74737 - DNA, 22 bp, Artificial Sequence
  Synthetic
cauactctagcuccccaagcac

SEQ ID NO: 74738 - DNA, 19 bp, Artificial Sequence
  Synthetic
gcccugcacagguacagaa

SEQ ID NO: 74739 - DNA, 19 bp, Artificial Sequence
  Synthetic
cgagugaccccaagacucc

SEQ ID NO: 74740 - DNA, 28 bp, Artificial Sequence
  Synthetic
aagaaccuaagaaaaggaaaaucaggct

SEQ ID NO: 74741 - DNA, 23 bp, Artificial Sequence
  Synthetic
tccttctgtugcatctgggtaug

SEQ ID NO: 74742 - DNA, 22 bp, Artificial Sequence
  Synthetic
cacattgcttuctgctcccaut

SEQ ID NO: 74743 - DNA, 28 bp, Artificial Sequence
  Synthetic
gcctttccagtutatgctgattcattut

SEQ ID NO: 74744 - DNA, 23 bp, Artificial Sequence
  Synthetic
caatttaaggucaccctcccuca

SEQ ID NO: 74745 - DNA, 22 bp, Artificial Sequence
  Synthetic
aagtatggccutcttgcugaca

SEQ ID NO: 74746 - DNA, 28 bp, Artificial Sequence
  Synthetic
cgtgaatcuttttatgtctucagcaaca

SEQ ID NO: 74747 - DNA, 27 bp, Artificial Sequence
  Synthetic
tggaatgggcutctgaaagttcaauat

SEQ ID NO: 74748 - DNA, 28 bp, Artificial Sequence
  Synthetic
tttctcctagaucctgaggaattctuga

SEQ ID NO: 74749 - DNA, 27 bp, Artificial Sequence
  Synthetic
ggaaatcatguctgttgaataauggca

SEQ ID NO: 74750 - DNA, 22 bp, Artificial Sequence
  Synthetic
gtcctgttuggctcccttguaa

SEQ ID NO: 74751 - DNA, 19 bp, Artificial Sequence
  Synthetic
cccgcacugacatgcuagg

SEQ ID NO: 74752 - DNA, 20 bp, Artificial Sequence
  Synthetic
gggaaggucctagtgccuct

SEQ ID NO: 74753 - DNA, 23 bp, Artificial Sequence
  Synthetic
caacauccagcagguagagagaa

SEQ ID NO: 74754 - DNA, 23 bp, Artificial Sequence
  Synthetic
ggtcatggagugttgccatctua

SEQ ID NO: 74755 - DNA, 20 bp, Artificial Sequence
  Synthetic
gtacccucagcatggccaut

SEQ ID NO: 74756 - DNA, 25 bp, Artificial Sequence
  Synthetic
aatgcttggguaagaaaacatguca

SEQ ID NO: 74757 - DNA, 25 bp, Artificial Sequence
  Synthetic
ggttgtggagagutgtaatggcaua

SEQ ID NO: 74758 - DNA, 22 bp, Artificial Sequence
  Synthetic
cttgctgaagcauaccccauct

SEQ ID NO: 74759 - DNA, 22 bp, Artificial Sequence
  Synthetic
gcctgcaaggutttaacuggac

SEQ ID NO: 74760 - DNA, 23 bp, Artificial Sequence
  Synthetic
gctctgagccauactacctccut

SEQ ID NO: 74761 - DNA, 19 bp, Artificial Sequence
  Synthetic
ggctgacucagagguccga

SEQ ID NO: 74762 - DNA, 27 bp, Artificial Sequence
  Synthetic
tctgccacacauttagaaagaaucagt

SEQ ID NO: 74763 - DNA, 22 bp, Artificial Sequence
  Synthetic
agcccccaaacutgattucaga

SEQ ID NO: 74764 - DNA, 24 bp, Artificial Sequence
  Synthetic
tcaccagtggautctgtgttgtut

SEQ ID NO: 74765 - DNA, 29 bp, Artificial Sequence
  Synthetic
agtctgtcgtaauagccaagaattuaaca

SEQ ID NO: 74766 - DNA, 21 bp, Artificial Sequence
  Synthetic
agggaagucggaagagcugat

SEQ ID NO: 74767 - DNA, 27 bp, Artificial Sequence
  Synthetic
gcatgttggutatctgtcaucaaaact

SEQ ID NO: 74768 - DNA, 33 bp, Artificial Sequence
  Synthetic
atactgtctacttuagaaactaagaattuggag

SEQ ID NO: 74769 - DNA, 28 bp, Artificial Sequence
  Synthetic
cccacacccauttatctccttaacuaat

SEQ ID NO: 74770 - DNA, 25 bp, Artificial Sequence
  Synthetic
accacagcacauacacatttuagca

SEQ ID NO: 74771 - DNA, 23 bp, Artificial Sequence
  Synthetic
ggtatccaccuttctcugagcat

SEQ ID NO: 74772 - DNA, 24 bp, Artificial Sequence
  Synthetic
ggutgccttgcucaacaaaacaaa

SEQ ID NO: 74773 - DNA, 28 bp, Artificial Sequence
  Synthetic
caatgctccaugaaaaccacauaaagaa

SEQ ID NO: 74774 - DNA, 22 bp, Artificial Sequence
  Synthetic
gtcagaaaagggucccagguag

SEQ ID NO: 74775 - DNA, 23 bp, Artificial Sequence
  Synthetic
cagatgcttgugtgttctgctut

SEQ ID NO: 74776 - DNA, 31 bp, Artificial Sequence
  Synthetic
agaatatggtttttaugacacagagttguga

SEQ ID NO: 74777 - DNA, 27 bp, Artificial Sequence
  Synthetic
ggcctggtttugcaatcatttacttut

SEQ ID NO: 74778 - DNA, 25 bp, Artificial Sequence
  Synthetic
gttgtatgccagutcttccttcugt

SEQ ID NO: 74779 - DNA, 21 bp, Artificial Sequence
  Synthetic
gaugugcacgaacaagcaact

SEQ ID NO: 74780 - DNA, 22 bp, Artificial Sequence
  Synthetic
gcagaagacccugcaaaatcuc

SEQ ID NO: 74781 - DNA, 28 bp, Artificial Sequence
  Synthetic
actgaatgguaaagagtggaatctgtuc

SEQ ID NO: 74782 - DNA, 22 bp, Artificial Sequence
  Synthetic
ggtgccatuccacgactagtuc

SEQ ID NO: 74783 - DNA, 28 bp, Artificial Sequence
  Synthetic
gcattcctttuagatagccaggtaucac

SEQ ID NO: 74784 - DNA, 25 bp, Artificial Sequence
  Synthetic
gcagaaatcucttagaacuggaggt

SEQ ID NO: 74785 - DNA, 24 bp, Artificial Sequence
  Synthetic
acacaaacaaaugatgcctgcaut

SEQ ID NO: 74786 - DNA, 20 bp, Artificial Sequence
  Synthetic
gugaactcacugaccaccga

SEQ ID NO: 74787 - DNA, 25 bp, Artificial Sequence
  Synthetic
gtgcagtgttuagctcttccatuac

SEQ ID NO: 74788 - DNA, 24 bp, Artificial Sequence
  Synthetic
ggccugacacacaatttttauggg

SEQ ID NO: 74789 - DNA, 20 bp, Artificial Sequence
  Synthetic
agccucaaaccccagtucag

SEQ ID NO: 74790 - DNA, 20 bp, Artificial Sequence
  Synthetic
gctgttgcugcgatgacuga

SEQ ID NO: 74791 - DNA, 21 bp, Artificial Sequence
  Synthetic
cagugcuacccaaacccagag

SEQ ID NO: 74792 - DNA, 18 bp, Artificial Sequence
  Synthetic
gctgctgccuggactgua

SEQ ID NO: 74793 - DNA, 19 bp, Artificial Sequence
  Synthetic
tgccauctcuccagcacac

SEQ ID NO: 74794 - DNA, 20 bp, Artificial Sequence
  Synthetic
gagtcaucccaggtggtguc

SEQ ID NO: 74795 - DNA, 24 bp, Artificial Sequence
  Synthetic
tgctcttccuaaccctcucaacat

SEQ ID NO: 74796 - DNA, 19 bp, Artificial Sequence
  Synthetic
ggtgcaguggtgactgugt

SEQ ID NO: 74797 - DNA, 24 bp, Artificial Sequence
  Synthetic
accatactctguccatttctggua

SEQ ID NO: 74798 - DNA, 27 bp, Artificial Sequence
  Synthetic
gaaaatgtguttcttaccucaagccat

SEQ ID NO: 74799 - DNA, 28 bp, Artificial Sequence
  Synthetic
ggtaattcttgcugatggattcucaact

SEQ ID NO: 74800 - DNA, 28 bp, Artificial Sequence
  Synthetic
gtaatgtttgttuttagctctgcugcat

SEQ ID NO: 74801 - DNA, 27 bp, Artificial Sequence
  Synthetic
ctttgcaatuaccttttctuccacaga

SEQ ID NO: 74802 - DNA, 24 bp, Artificial Sequence
  Synthetic
cagcctgtatutgagaagcatgug

SEQ ID NO: 74803 - DNA, 18 bp, Artificial Sequence
  Synthetic
tcuccugcaacgcagagg

SEQ ID NO: 74804 - DNA, 19 bp, Artificial Sequence
  Synthetic
ccagccagcutgcgauaac

SEQ ID NO: 74805 - DNA, 27 bp, Artificial Sequence
  Synthetic
gagcacatgaauaaatgagcatccaut

SEQ ID NO: 74806 - DNA, 19 bp, Artificial Sequence
  Synthetic
gccggcgutcagaatguag

SEQ ID NO: 74807 - DNA, 22 bp, Artificial Sequence
  Synthetic
gcagaagcaggacutgtaccut

SEQ ID NO: 74808 - DNA, 23 bp, Artificial Sequence
  Synthetic
gaacgtucattcaaguaggccat

SEQ ID NO: 74809 - DNA, 25 bp, Artificial Sequence
  Synthetic
ctccaaatcuaggacctaggacuca

SEQ ID NO: 74810 - DNA, 22 bp, Artificial Sequence
  Synthetic
actttctctgucagcccaguct

SEQ ID NO: 74811 - DNA, 23 bp, Artificial Sequence
  Synthetic
gggttcuccttaactucagccaa

SEQ ID NO: 74812 - DNA, 19 bp, Artificial Sequence
  Synthetic
cctggcauggcaggaguag

SEQ ID NO: 74813 - DNA, 19 bp, Artificial Sequence
  Synthetic
accacccucaagagccuga

SEQ ID NO: 74814 - DNA, 20 bp, Artificial Sequence
  Synthetic
ccgccaucgctgatcacuat

SEQ ID NO: 74815 - DNA, 22 bp, Artificial Sequence
  Synthetic
cgctgtgatuccaatggtctug

SEQ ID NO: 74816 - DNA, 21 bp, Artificial Sequence
  Synthetic
ctcaggguccccacttctcua

SEQ ID NO: 74817 - DNA, 21 bp, Artificial Sequence
  Synthetic
catcagcacagutcgugaggt

SEQ ID NO: 74818 - DNA, 21 bp, Artificial Sequence
  Synthetic
gctccggaugttctcgatcug

SEQ ID NO: 74819 - DNA, 21 bp, Artificial Sequence
  Synthetic
caagagaaggcucacgauggt

SEQ ID NO: 74820 - DNA, 21 bp, Artificial Sequence
  Synthetic
ttcctccccuggtctcaucat

SEQ ID NO: 74821 - DNA, 21 bp, Artificial Sequence
  Synthetic
gtcacacacgcugacctcuaa

SEQ ID NO: 74822 - DNA, 21 bp, Artificial Sequence
  Synthetic
gcatcaucagcccggtaguag

SEQ ID NO: 74823 - DNA, 21 bp, Artificial Sequence
  Synthetic
gccggtaauccccactctcut

SEQ ID NO: 74824 - DNA, 21 bp, Artificial Sequence
  Synthetic
ctgacgccuttgtcctcatuc

SEQ ID NO: 74825 - DNA, 29 bp, Artificial Sequence
  Synthetic
atctctccaatcugactccttttcttcua

SEQ ID NO: 74826 - DNA, 23 bp, Artificial Sequence
  Synthetic
gaacccctuttcctatggaucgt

SEQ ID NO: 74827 - DNA, 24 bp, Artificial Sequence
  Synthetic
agttctagcutgtccaaugcaaca

SEQ ID NO: 74828 - DNA, 22 bp, Artificial Sequence
  Synthetic
acatggtcuagaagtgggcuca

SEQ ID NO: 74829 - DNA, 25 bp, Artificial Sequence
  Synthetic
cugcacaaaaccucacagagaaaaa

SEQ ID NO: 74830 - DNA, 17 bp, Artificial Sequence
  Synthetic
cugggccactugccaga

SEQ ID NO: 74831 - DNA, 20 bp, Artificial Sequence
  Synthetic
tgccctguccttcccttcua

SEQ ID NO: 74832 - DNA, 17 bp, Artificial Sequence
  Synthetic
gccccagcuaccuggat

SEQ ID NO: 74833 - DNA, 18 bp, Artificial Sequence
  Synthetic
ggcagcgaugagggtcug

SEQ ID NO: 74834 - DNA, 21 bp, Artificial Sequence
  Synthetic
gtcgcaccutctccactaguc

SEQ ID NO: 74835 - DNA, 22 bp, Artificial Sequence
  Synthetic
tttacggccaacgguggatuat

SEQ ID NO: 74836 - DNA, 22 bp, Artificial Sequence
  Synthetic
gtgatgaagautgtggcgtgut

SEQ ID NO: 74837 - DNA, 25 bp, Artificial Sequence
  Synthetic
tctccaacctucaaagaaactcugg

SEQ ID NO: 74838 - DNA, 21 bp, Artificial Sequence
  Synthetic
cctccagucgcctcaguaaag

SEQ ID NO: 74839 - DNA, 20 bp, Artificial Sequence
  Synthetic
tggctgaaautggtgucggt

SEQ ID NO: 74840 - DNA, 28 bp, Artificial Sequence
  Synthetic
gataaccagaauaaagaccaagugacca

SEQ ID NO: 74841 - DNA, 21 bp, Artificial Sequence
  Synthetic
tcacttgccagcuggactuac

SEQ ID NO: 74842 - DNA, 22 bp, Artificial Sequence
  Synthetic
ggagcucagagaagggtctgua

SEQ ID NO: 74843 - DNA, 22 bp, Artificial Sequence
  Synthetic
gtgatttcuggcccaatgtgut

SEQ ID NO: 74844 - DNA, 18 bp, Artificial Sequence
  Synthetic
ctgctgcugttggtucgt

SEQ ID NO: 74845 - DNA, 21 bp, Artificial Sequence
  Synthetic
ggatgutgtactgucgcagga

SEQ ID NO: 74846 - DNA, 19 bp, Artificial Sequence
  Synthetic
aagauggcggacgtgctua

SEQ ID NO: 74847 - DNA, 19 bp, Artificial Sequence
  Synthetic
acagccaugccggactuac

SEQ ID NO: 74848 - DNA, 27 bp, Artificial Sequence
  Synthetic
tcgaacttccucctttggaaauaaact

SEQ ID NO: 74849 - DNA, 27 bp, Artificial Sequence
  Synthetic
ccaaaatttucttaccatguccacacc

SEQ ID NO: 74850 - DNA, 19 bp, Artificial Sequence
  Synthetic
agaggcaucaagccuggac

SEQ ID NO: 74851 - DNA, 21 bp, Artificial Sequence
  Synthetic
gcuaaaggcgaacctggugat

SEQ ID NO: 74852 - DNA, 19 bp, Artificial Sequence
  Synthetic
ccagcaucgccttuagcac

SEQ ID NO: 74853 - DNA, 21 bp, Artificial Sequence
  Synthetic
ggautgttucccacccaagca

SEQ ID NO: 74854 - DNA, 22 bp, Artificial Sequence
  Synthetic
ggccttguacactgtcccauag

SEQ ID NO: 74855 - DNA, 22 bp, Artificial Sequence
  Synthetic
ctgcaggcucataccatccuaa

SEQ ID NO: 74856 - DNA, 29 bp, Artificial Sequence
  Synthetic
cttgttctagtuccttaatgctctctuct

SEQ ID NO: 74857 - DNA, 23 bp, Artificial Sequence
  Synthetic
cctcatctcacugttgtgcttug

SEQ ID NO: 74858 - DNA, 24 bp, Artificial Sequence
  Synthetic
ggatcuaacaaagagccacacugt

SEQ ID NO: 74859 - DNA, 28 bp, Artificial Sequence
  Synthetic
ttacagctatcugtctgttcattgtugt

SEQ ID NO: 74860 - DNA, 24 bp, Artificial Sequence
  Synthetic
acattgatucccacatccagugag

SEQ ID NO: 74861 - DNA, 28 bp, Artificial Sequence
  Synthetic
tccatggcattcugagtttgattttcua

SEQ ID NO: 74862 - DNA, 28 bp, Artificial Sequence
  Synthetic
catggaaaugaccaaatgtctcucaaat

SEQ ID NO: 74863 - DNA, 28 bp, Artificial Sequence
  Synthetic
cctctccggaauaaatagttttctcugt

SEQ ID NO: 74864 - DNA, 22 bp, Artificial Sequence
  Synthetic
ctcagccucatttcucaaccga

SEQ ID NO: 74865 - DNA, 28 bp, Artificial Sequence
  Synthetic
cctcactattgaguattttgggcttgut

SEQ ID NO: 74866 - DNA, 25 bp, Artificial Sequence
  Synthetic
gcaatccagaugctatgtcttcuct

SEQ ID NO: 74867 - DNA, 29 bp, Artificial Sequence
  Synthetic
tgctatttgcacauttgattgatcttgut

SEQ ID NO: 74868 - DNA, 25 bp, Artificial Sequence
  Synthetic
tcgtaatgaaccauttcagcgauca

SEQ ID NO: 74869 - DNA, 25 bp, Artificial Sequence
  Synthetic
ggcttgttgcuatctcctgatuaca

SEQ ID NO: 74870 - DNA, 21 bp, Artificial Sequence
  Synthetic
gaacacactacuggccagcua

SEQ ID NO: 74871 - DNA, 27 bp, Artificial Sequence
  Synthetic
tttaggtttctguacactttcgtccuc

SEQ ID NO: 74872 - DNA, 27 bp, Artificial Sequence
  Synthetic
tttaaccacacuttgcagatctuacct

SEQ ID NO: 74873 - DNA, 28 bp, Artificial Sequence
  Synthetic
ggaaaggtctugaaaagcagtatttugt

SEQ ID NO: 74874 - DNA, 25 bp, Artificial Sequence
  Synthetic
aaattcctcugcacccatatgugaa

SEQ ID NO: 74875 - DNA, 29 bp, Artificial Sequence
  Synthetic
tgagttactguggaaatctagagctguat

SEQ ID NO: 74876 - DNA, 28 bp, Artificial Sequence
  Synthetic
atggacatuaccaagagtcatacagtug

SEQ ID NO: 74877 - DNA, 28 bp, Artificial Sequence
  Synthetic
attttcccatctuctgatgtggtcauaa

SEQ ID NO: 74878 - DNA, 28 bp, Artificial Sequence
  Synthetic
tgataaagattcucctcagtcagcugat

SEQ ID NO: 74879 - DNA, 28 bp, Artificial Sequence
  Synthetic
cctgatgaaaataauggctttgtgguag

SEQ ID NO: 74880 - DNA, 24 bp, Artificial Sequence
  Synthetic
cccgaaaaagaaaugatgcuccaa

SEQ ID NO: 74881 - DNA, 22 bp, Artificial Sequence
  Synthetic
aaaggattugacaggctcugct

SEQ ID NO: 74882 - DNA, 26 bp, Artificial Sequence
  Synthetic
tgctgtttgtggauccagtgataaut

SEQ ID NO: 74883 - DNA, 26 bp, Artificial Sequence
  Synthetic
tggcaaaaucatttgcauaagcaaga

SEQ ID NO: 74884 - DNA, 28 bp, Artificial Sequence
  Synthetic
actgtgguggagttcttgauaaacaaat

SEQ ID NO: 74885 - DNA, 27 bp, Artificial Sequence
  Synthetic
ctggcctaguacagatttcactgtaug

SEQ ID NO: 74886 - DNA, 28 bp, Artificial Sequence
  Synthetic
aggttauggaactaaagctucaggaaat

SEQ ID NO: 74887 - DNA, 24 bp, Artificial Sequence
  Synthetic
ctggcatccugattacaagtcugt

SEQ ID NO: 74888 - DNA, 25 bp, Artificial Sequence
  Synthetic
cuaaggaaagaauacagcagagcct

SEQ ID NO: 74889 - DNA, 22 bp, Artificial Sequence
  Synthetic
tggtactcuccggtgctagaut

SEQ ID NO: 74890 - DNA, 22 bp, Artificial Sequence
  Synthetic
gggaaggaaaagugttggugga

SEQ ID NO: 74891 - DNA, 19 bp, Artificial Sequence
  Synthetic
tccugccaauggcaccaaa

SEQ ID NO: 74892 - DNA, 22 bp, Artificial Sequence
  Synthetic
ggtttgcugcagcctguaaaaa

SEQ ID NO: 74893 - DNA, 26 bp, Artificial Sequence
  Synthetic
cagcattgacaugagtttgaaugact

SEQ ID NO: 74894 - DNA, 22 bp, Artificial Sequence
  Synthetic
gggcagaaacucacatagtcuc

SEQ ID NO: 74895 - DNA, 28 bp, Artificial Sequence
  Synthetic
ggtcatttccauggcatcattacaacua

SEQ ID NO: 74896 - DNA, 28 bp, Artificial Sequence
  Synthetic
gccattattttcaucaggacagttcuct

SEQ ID NO: 74897 - DNA, 25 bp, Artificial Sequence
  Synthetic
tcatcttgtcauggcaatagucagg

SEQ ID NO: 74898 - DNA, 22 bp, Artificial Sequence
  Synthetic
cgtgattgucatttggugccat

SEQ ID NO: 74899 - DNA, 28 bp, Artificial Sequence
  Synthetic
ggcctagtagutatttcatctggugaga

SEQ ID NO: 74900 - DNA, 26 bp, Artificial Sequence
  Synthetic
cacagtaacucagacgtaacuaagca

SEQ ID NO: 74901 - DNA, 28 bp, Artificial Sequence
  Synthetic
tggtagatgaacaguttgaaaggcuaaa

SEQ ID NO: 74902 - DNA, 25 bp, Artificial Sequence
  Synthetic
ccaattatugcccagtgcaaaauga

SEQ ID NO: 74903 - DNA, 28 bp, Artificial Sequence
  Synthetic
tgtcctttggtacuggtttgaataacut

SEQ ID NO: 74904 - DNA, 28 bp, Artificial Sequence
  Synthetic
agaatattagccaugaccccagaatcua

SEQ ID NO: 74905 - DNA, 28 bp, Artificial Sequence
  Synthetic
tgctttagcaaauttttctcctctcuca

SEQ ID NO: 74906 - DNA, 24 bp, Artificial Sequence
  Synthetic
ggagaagcaccagaucctgtaaut

SEQ ID NO: 74907 - DNA, 29 bp, Artificial Sequence
  Synthetic
cattgtgtgccutatttcctaatucaagt

SEQ ID NO: 74908 - DNA, 23 bp, Artificial Sequence
  Synthetic
gtcaggttccucttgcagctuat

SEQ ID NO: 74909 - DNA, 28 bp, Artificial Sequence
  Synthetic
cggttaagctguttttggctattatguc

SEQ ID NO: 74910 - DNA, 24 bp, Artificial Sequence
  Synthetic
ctctgctccutgtcctttgtuaga

SEQ ID NO: 74911 - DNA, 28 bp, Artificial Sequence
  Synthetic
catctcccccagaucttgactatauact

SEQ ID NO: 74912 - DNA, 20 bp, Artificial Sequence
  Synthetic
ccacccctuccagagcaaut

SEQ ID NO: 74913 - DNA, 28 bp, Artificial Sequence
  Synthetic
tggtttcagcuccattatgagactttut

SEQ ID NO: 74914 - DNA, 26 bp, Artificial Sequence
  Synthetic
tgaggaaaaguttaagcaaucccaca

SEQ ID NO: 74915 - DNA, 26 bp, Artificial Sequence
  Synthetic
agttcagaaggaccaaauccaaugac

SEQ ID NO: 74916 - DNA, 29 bp, Artificial Sequence
  Synthetic
ccacgaaatctatuggctaatcaaactut

SEQ ID NO: 74917 - DNA, 21 bp, Artificial Sequence
  Synthetic
aatggaggutggtcggtugag

SEQ ID NO: 74918 - DNA, 28 bp, Artificial Sequence
  Synthetic
tctccagcaaugctaaagataguagaga

SEQ ID NO: 74919 - DNA, 24 bp, Artificial Sequence
  Synthetic
tgutgggcaatcuaggcaaaaaga

SEQ ID NO: 74920 - DNA, 24 bp, Artificial Sequence
  Synthetic
ctctcuaccgccaaagacagttut

SEQ ID NO: 74921 - DNA, 24 bp, Artificial Sequence
  Synthetic
agttgtgtcugctggaatctgtuc

SEQ ID NO: 74922 - DNA, 28 bp, Artificial Sequence
  Synthetic
cacacaactgccutagaatgtaaaacug

SEQ ID NO: 74923 - DNA, 28 bp, Artificial Sequence
  Synthetic
gttaggtctgtcugttctttcctttuct

SEQ ID NO: 74924 - DNA, 26 bp, Artificial Sequence
  Synthetic
tgtagtgtcacuggtattgaugacct

SEQ ID NO: 74925 - DNA, 25 bp, Artificial Sequence
  Synthetic
ttcagtttaccugcaacagauccaa

SEQ ID NO: 74926 - DNA, 23 bp, Artificial Sequence
  Synthetic
ggtctcuagcaaagatucaggca

SEQ ID NO: 74927 - DNA, 28 bp, Artificial Sequence
  Synthetic
aaggccttttccucagtttctatgtuaa

SEQ ID NO: 74928 - DNA, 28 bp, Artificial Sequence
  Synthetic
tcctgatgagaucaattcttcagacuct

SEQ ID NO: 74929 - DNA, 26 bp, Artificial Sequence
  Synthetic
ttcttcttcttguacccacgttctut

SEQ ID NO: 74930 - DNA, 19 bp, Artificial Sequence
  Synthetic
cggactttucgagggccut

SEQ ID NO: 74931 - DNA, 17 bp, Artificial Sequence
  Synthetic
gccgcgagugagggtut

SEQ ID NO: 74932 - DNA, 26 bp, Artificial Sequence
  Synthetic
aatgggaaaaacutgcaauagccaaa

SEQ ID NO: 74933 - DNA, 21 bp, Artificial Sequence
  Synthetic
ggtucaagacagagcucacct

SEQ ID NO: 74934 - DNA, 18 bp, Artificial Sequence
  Synthetic
gcgggaugugaaccacga

SEQ ID NO: 74935 - DNA, 19 bp, Artificial Sequence
  Synthetic
gctcaccuctggugccaaa

SEQ ID NO: 74936 - DNA, 23 bp, Artificial Sequence
  Synthetic
cccagggtuggttactcttuaca

SEQ ID NO: 74937 - DNA, 29 bp, Artificial Sequence
  Synthetic
ctaaagcttgtguccagtgatatggtuat

SEQ ID NO: 74938 - DNA, 19 bp, Artificial Sequence
  Synthetic
caccuggctccttuccaca

SEQ ID NO: 74939 - DNA, 21 bp, Artificial Sequence
  Synthetic
ctcaccttugctctggtugga

SEQ ID NO: 74940 - DNA, 22 bp, Artificial Sequence
  Synthetic
cgaggacaccugggtaaagtug

SEQ ID NO: 74941 - DNA, 20 bp, Artificial Sequence
  Synthetic
ctgacguacctgtgcuggaa

SEQ ID NO: 74942 - DNA, 21 bp, Artificial Sequence
  Synthetic
gttccctuggcactcctuagt

SEQ ID NO: 74943 - DNA, 17 bp, Artificial Sequence
  Synthetic
cuggaccccacacccut

SEQ ID NO: 74944 - DNA, 20 bp, Artificial Sequence
  Synthetic
gcttggguctccgtctucat

SEQ ID NO: 74945 - DNA, 24 bp, Artificial Sequence
  Synthetic
ctgaagtcagugctttcggtttut

SEQ ID NO: 74946 - DNA, 21 bp, Artificial Sequence
  Synthetic
ccaggtcagccugtggaatut

SEQ ID NO: 74947 - DNA, 21 bp, Artificial Sequence
  Synthetic
ttgcgcaagaugtgctcaaug

SEQ ID NO: 74948 - DNA, 22 bp, Artificial Sequence
  Synthetic
cagctgtcacucctcatgacut

SEQ ID NO: 74949 - DNA, 21 bp, Artificial Sequence
  Synthetic
ccggcucaagcctcatctuac

SEQ ID NO: 74950 - DNA, 22 bp, Artificial Sequence
  Synthetic
cctccttcccuctctccttcug

SEQ ID NO: 74951 - DNA, 24 bp, Artificial Sequence
  Synthetic
acacutgatcactcuggagaggaa

SEQ ID NO: 74952 - DNA, 24 bp, Artificial Sequence
  Synthetic
cccaacaactucctgtcctacuac

SEQ ID NO: 74953 - DNA, 20 bp, Artificial Sequence
  Synthetic
tttccguggcactaggtguc

SEQ ID NO: 74954 - DNA, 23 bp, Artificial Sequence
  Synthetic
ccatccauggaggagttgaagut

SEQ ID NO: 74955 - DNA, 21 bp, Artificial Sequence
  Synthetic
ctctagugagcacctgaccug

SEQ ID NO: 74956 - DNA, 18 bp, Artificial Sequence
  Synthetic
gttgcccauggcctugac

SEQ ID NO: 74957 - DNA, 19 bp, Artificial Sequence
  Synthetic
agaaggugctggagcugac

SEQ ID NO: 74958 - DNA, 18 bp, Artificial Sequence
  Synthetic
cgcaggcggucattguca

SEQ ID NO: 74959 - DNA, 18 bp, Artificial Sequence
  Synthetic
ggccaagaagucggugga

SEQ ID NO: 74960 - DNA, 17 bp, Artificial Sequence
  Synthetic
ggcugcaggtgcauggt

SEQ ID NO: 74961 - DNA, 19 bp, Artificial Sequence
  Synthetic
cggccucttccctuaccag

SEQ ID NO: 74962 - DNA, 19 bp, Artificial Sequence
  Synthetic
agtgcgcgauctggaacug

SEQ ID NO: 74963 - DNA, 20 bp, Artificial Sequence
  Synthetic
cgcuggtgaucaagcaggag

SEQ ID NO: 74964 - DNA, 19 bp, Artificial Sequence
  Synthetic
gctgggcgauatcccctug

SEQ ID NO: 74965 - DNA, 23 bp, Artificial Sequence
  Synthetic
ctgatggatcuggactgacagut

SEQ ID NO: 74966 - DNA, 23 bp, Artificial Sequence
  Synthetic
ctgtttctgaguctctgcaguct

SEQ ID NO: 74967 - DNA, 20 bp, Artificial Sequence
  Synthetic
cccacacutccagtugcgat

SEQ ID NO: 74968 - DNA, 20 bp, Artificial Sequence
  Synthetic
gcattaccacgugggaguga

SEQ ID NO: 74969 - DNA, 21 bp, Artificial Sequence
  Synthetic
gctccaacgagaucgagaucc

SEQ ID NO: 74970 - DNA, 20 bp, Artificial Sequence
  Synthetic
ggaggcaccggaauctccua

SEQ ID NO: 74971 - DNA, 18 bp, Artificial Sequence
  Synthetic
gcugccagagagctccut

SEQ ID NO: 74972 - DNA, 21 bp, Artificial Sequence
  Synthetic
acagtgacgcugtaggugaag

SEQ ID NO: 74973 - DNA, 22 bp, Artificial Sequence
  Synthetic
cctcccagaacaucaccuacca

SEQ ID NO: 74974 - DNA, 19 bp, Artificial Sequence
  Synthetic
ccatguacccaccgucgat

SEQ ID NO: 74975 - DNA, 24 bp, Artificial Sequence
  Synthetic
gacauctggactuagccaagaagg

SEQ ID NO: 74976 - DNA, 18 bp, Artificial Sequence
  Synthetic
gccacgcugttctugcag

SEQ ID NO: 74977 - DNA, 19 bp, Artificial Sequence
  Synthetic
cgcatagcggcucactcut

SEQ ID NO: 74978 - DNA, 17 bp, Artificial Sequence
  Synthetic
gccagccugcauggcat

SEQ ID NO: 74979 - DNA, 23 bp, Artificial Sequence
  Synthetic
caaaucaaacccgcagctaaugg

SEQ ID NO: 74980 - DNA, 17 bp, Artificial Sequence
  Synthetic
ccgcucacctggtuggg

SEQ ID NO: 74981 - DNA, 17 bp, Artificial Sequence
  Synthetic
ctccugcagcgguggaa

SEQ ID NO: 74982 - DNA, 18 bp, Artificial Sequence
  Synthetic
ggccucacgctcgatcug

SEQ ID NO: 74983 - DNA, 17 bp, Artificial Sequence
  Synthetic
cccucacccgugagcat

SEQ ID NO: 74984 - DNA, 17 bp, Artificial Sequence
  Synthetic
gggaagccagcugguga

SEQ ID NO: 74985 - DNA, 19 bp, Artificial Sequence
  Synthetic
cggauggccaccaugaaca

SEQ ID NO: 74986 - DNA, 24 bp, Artificial Sequence
  Synthetic
gcatttgttttcutggcagtgcut

SEQ ID NO: 74987 - DNA, 17 bp, Artificial Sequence
  Synthetic
cgcaacgccaacugcuc

SEQ ID NO: 74988 - DNA, 21 bp, Artificial Sequence
  Synthetic
gctgtgcgcugtttgaugaaa

SEQ ID NO: 74989 - DNA, 18 bp, Artificial Sequence
  Synthetic
agcgctcugcaagaccug

SEQ ID NO: 74990 - DNA, 19 bp, Artificial Sequence
  Synthetic
gactctgcugaggcacgut

SEQ ID NO: 74991 - DNA, 18 bp, Artificial Sequence
  Synthetic
gccctcugctgcuaccac

SEQ ID NO: 74992 - DNA, 19 bp, Artificial Sequence
  Synthetic
gcaccacccgcutcatcut

SEQ ID NO: 74993 - DNA, 18 bp, Artificial Sequence
  Synthetic
ctgggccuggaugacgag

SEQ ID NO: 74994 - DNA, 17 bp, Artificial Sequence
  Synthetic
cugggcgactucagggt

SEQ ID NO: 74995 - DNA, 17 bp, Artificial Sequence
  Synthetic
ctugcccaggcctguga

SEQ ID NO: 74996 - DNA, 18 bp, Artificial Sequence
  Synthetic
cctgggccugcatggaua

SEQ ID NO: 74997 - DNA, 19 bp, Artificial Sequence
  Synthetic
ccccgugagcctgaatgug

SEQ ID NO: 74998 - DNA, 19 bp, Artificial Sequence
  Synthetic
gggctcuttgactguggct

SEQ ID NO: 74999 - DNA, 20 bp, Artificial Sequence
  Synthetic
cctgtccccuttccttgcut

SEQ ID NO: 75000 - DNA, 25 bp, Artificial Sequence
  Synthetic
tcactggcaaaaggguttagaacut

SEQ ID NO: 75001 - DNA, 21 bp, Artificial Sequence
  Synthetic
gccttggatuctcctggaguc

SEQ ID NO: 75002 - DNA, 22 bp, Artificial Sequence
  Synthetic
tctggaagaccugcattcctug

SEQ ID NO: 75003 - DNA, 22 bp, Artificial Sequence
  Synthetic
cgttaggacuctgccttcagut

SEQ ID NO: 75004 - DNA, 29 bp, Artificial Sequence
  Synthetic
aaggctttgtauattattgaaccaucaca

SEQ ID NO: 75005 - DNA, 28 bp, Artificial Sequence
  Synthetic
ggtaggttcccauagtgtcaatttugaa

SEQ ID NO: 75006 - DNA, 23 bp, Artificial Sequence
  Synthetic
tttcguagaaacggaaggctuca

SEQ ID NO: 75007 - DNA, 28 bp, Artificial Sequence
  Synthetic
actcacauaaaatcccuggaacaaaaga

SEQ ID NO: 75008 - DNA, 22 bp, Artificial Sequence
  Synthetic
ccagaagggaaauggcagctut

SEQ ID NO: 75009 - DNA, 22 bp, Artificial Sequence
  Synthetic
gttttctgaccuttgcctcucc

SEQ ID NO: 75010 - DNA, 20 bp, Artificial Sequence
  Synthetic
tggagacccugcataugcct

SEQ ID NO: 75011 - DNA, 24 bp, Artificial Sequence
  Synthetic
cacgctgaaggauggtatcaucat

SEQ ID NO: 75012 - DNA, 21 bp, Artificial Sequence
  Synthetic
gatgaucagcagcgtcuggat

SEQ ID NO: 75013 - DNA, 21 bp, Artificial Sequence
  Synthetic
gctgcccutgtaggccuaaaa

SEQ ID NO: 75014 - DNA, 28 bp, Artificial Sequence
  Synthetic
cttaggtaaatgcugaactgtggauagt

SEQ ID NO: 75015 - DNA, 23 bp, Artificial Sequence
  Synthetic
gccctcauctaatgtcucaggga

SEQ ID NO: 75016 - DNA, 25 bp, Artificial Sequence
  Synthetic
catgttttctccguaggatgctcua

SEQ ID NO: 75017 - DNA, 20 bp, Artificial Sequence
  Synthetic
ctccgacutggatccgucac

SEQ ID NO: 75018 - DNA, 21 bp, Artificial Sequence
  Synthetic
agaggguacgagctgctaugt

SEQ ID NO: 75019 - DNA, 26 bp, Artificial Sequence
  Synthetic
caagtttacaacugcatgttucagca

SEQ ID NO: 75020 - DNA, 33 bp, Artificial Sequence
  Synthetic
aatgtcaacttgttuttacatgcattattcuaa

SEQ ID NO: 75021 - DNA, 28 bp, Artificial Sequence
  Synthetic
ggagccaaataautcagaatctcaagug

SEQ ID NO: 75022 - DNA, 26 bp, Artificial Sequence
  Synthetic
caggtacauggtaaagcataaaucgc

SEQ ID NO: 75023 - DNA, 28 bp, Artificial Sequence
  Synthetic
gaagcacaaagcaucaaataaggtctua

SEQ ID NO: 75024 - DNA, 20 bp, Artificial Sequence
  Synthetic
gcaguaccgucaggaccaac

SEQ ID NO: 75025 - DNA, 24 bp, Artificial Sequence
  Synthetic
attatggacgcguctctctcttuc

SEQ ID NO: 75026 - DNA, 22 bp, Artificial Sequence
  Synthetic
cgtttggcugaaccaucacaga

SEQ ID NO: 75027 - DNA, 28 bp, Artificial Sequence
  Synthetic
gcagactaaaaagcuagctatgtcatug

SEQ ID NO: 75028 - DNA, 27 bp, Artificial Sequence
  Synthetic
tggtaaggaaaagutacatgtagcgut

SEQ ID NO: 75029 - DNA, 27 bp, Artificial Sequence
  Synthetic
tgttcagtctguacaatcccttcttug

SEQ ID NO: 75030 - DNA, 24 bp, Artificial Sequence
  Synthetic
cgccttgauaaagagagatuggct

SEQ ID NO: 75031 - DNA, 28 bp, Artificial Sequence
  Synthetic
aagagguaaatgtaaatguggagagcat

SEQ ID NO: 75032 - DNA, 24 bp, Artificial Sequence
  Synthetic
cuagattctugagaacgccagaca

SEQ ID NO: 75033 - DNA, 27 bp, Artificial Sequence
  Synthetic
ccacagattcagacutggactatgaut

SEQ ID NO: 75034 - DNA, 21 bp, Artificial Sequence
  Synthetic
ccctgccutcataaccguaga

SEQ ID NO: 75035 - DNA, 22 bp, Artificial Sequence
  Synthetic
cccgcaaagacaucaaaccuga

SEQ ID NO: 75036 - DNA, 22 bp, Artificial Sequence
  Synthetic
cgagguccccagttctguagat

SEQ ID NO: 75037 - DNA, 25 bp, Artificial Sequence
  Synthetic
gctcctccutatgactccatucaaa

SEQ ID NO: 75038 - DNA, 24 bp, Artificial Sequence
  Synthetic
ctcttataaaggcutccgggucat

SEQ ID NO: 75039 - DNA, 19 bp, Artificial Sequence
  Synthetic
gcaggcutgacuccagcag

SEQ ID NO: 75040 - DNA, 24 bp, Artificial Sequence
  Synthetic
ccaggtcuaggcatgtactgauac

SEQ ID NO: 75041 - DNA, 24 bp, Artificial Sequence
  Synthetic
ggaagaagaugtccgugagaacat

SEQ ID NO: 75042 - DNA, 19 bp, Artificial Sequence
  Synthetic
cugccaggagcagaucgaa

SEQ ID NO: 75043 - DNA, 19 bp, Artificial Sequence
  Synthetic
gccctcagaugtccacguc

SEQ ID NO: 75044 - DNA, 18 bp, Artificial Sequence
  Synthetic
tggaccuggctugcacac

SEQ ID NO: 75045 - DNA, 26 bp, Artificial Sequence
  Synthetic
gaatgaagcttucccttctggtauca

SEQ ID NO: 75046 - DNA, 27 bp, Artificial Sequence
  Synthetic
ccaccccctucatcatcataagtaaug

SEQ ID NO: 75047 - DNA, 26 bp, Artificial Sequence
  Synthetic
ctggacttaacgaaugcttacctuct

SEQ ID NO: 75048 - DNA, 28 bp, Artificial Sequence
  Synthetic
atattgaacaugagtacugccaaagagt

SEQ ID NO: 75049 - DNA, 22 bp, Artificial Sequence
  Synthetic
ccatugggcagctgtacuagag

SEQ ID NO: 75050 - DNA, 21 bp, Artificial Sequence
  Synthetic
gggatuaccggcatccaagug

SEQ ID NO: 75051 - DNA, 22 bp, Artificial Sequence
  Synthetic
ctccuggcaaagatggacucaa

SEQ ID NO: 75052 - DNA, 23 bp, Artificial Sequence
  Synthetic
acauacaacaggaccagcaucac

SEQ ID NO: 75053 - DNA, 22 bp, Artificial Sequence
  Synthetic
cttcuggcagcctttcucaaac

SEQ ID NO: 75054 - DNA, 21 bp, Artificial Sequence
  Synthetic
catcatctgcucccaccguaa

SEQ ID NO: 75055 - DNA, 26 bp, Artificial Sequence
  Synthetic
acacataccugaactgtttggactug

SEQ ID NO: 75056 - DNA, 20 bp, Artificial Sequence
  Synthetic
ccctgacacutggagcagua

SEQ ID NO: 75057 - DNA, 22 bp, Artificial Sequence
  Synthetic
gaacatcgucaaccttcuggga

SEQ ID NO: 75058 - DNA, 25 bp, Artificial Sequence
  Synthetic
aaacaatggacacucagaagucaca

SEQ ID NO: 75059 - DNA, 24 bp, Artificial Sequence
  Synthetic
ctagaagcacugtaucgacaggac

SEQ ID NO: 75060 - DNA, 21 bp, Artificial Sequence
  Synthetic
ccaacggagacucctguacaa

SEQ ID NO: 75061 - DNA, 20 bp, Artificial Sequence
  Synthetic
ccaacggagucaaccgttuc

SEQ ID NO: 75062 - DNA, 21 bp, Artificial Sequence
  Synthetic
gcccttaccuccatggguaca

SEQ ID NO: 75063 - DNA, 23 bp, Artificial Sequence
  Synthetic
tgtctttgggacugtggttctuc

SEQ ID NO: 75064 - DNA, 23 bp, Artificial Sequence
  Synthetic
ctcaccuacagaccacttcacut

SEQ ID NO: 75065 - DNA, 22 bp, Artificial Sequence
  Synthetic
ccactatctgcuggtgtggtug

SEQ ID NO: 75066 - DNA, 22 bp, Artificial Sequence
  Synthetic
gccggaaagguaatgactcugg

SEQ ID NO: 75067 - DNA, 25 bp, Artificial Sequence
  Synthetic
agggatcugagcacctttuacaaag

SEQ ID NO: 75068 - DNA, 26 bp, Artificial Sequence
  Synthetic
gttataatacggcutcagttggugga

SEQ ID NO: 75069 - DNA, 25 bp, Artificial Sequence
  Synthetic
ttctgaacauttggauccagacgaa

SEQ ID NO: 75070 - DNA, 29 bp, Artificial Sequence
  Synthetic
ggacttgatctcugtctatagtactcugg

SEQ ID NO: 75071 - DNA, 22 bp, Artificial Sequence
  Synthetic
aaagctgacucgacgagagtut

SEQ ID NO: 75072 - DNA, 28 bp, Artificial Sequence
  Synthetic
cccttaggaauccaatgcttugagaaat

SEQ ID NO: 75073 - DNA, 29 bp, Artificial Sequence
  Synthetic
ttggtttgauacacaaaataccaguacct

SEQ ID NO: 75074 - DNA, 25 bp, Artificial Sequence
  Synthetic
ggcctaaugacattcttttcauggt

SEQ ID NO: 75075 - DNA, 24 bp, Artificial Sequence
  Synthetic
tgcagagaacagcaaauaacucca

SEQ ID NO: 75076 - DNA, 20 bp, Artificial Sequence
  Synthetic
cctttcugggcctgaggaut

SEQ ID NO: 75077 - DNA, 18 bp, Artificial Sequence
  Synthetic
caugccgctcuccaccat

SEQ ID NO: 75078 - DNA, 18 bp, Artificial Sequence
  Synthetic
ggtcuccaggtgccucag

SEQ ID NO: 75079 - DNA, 18 bp, Artificial Sequence
  Synthetic
cgaaugcguggcggagat

SEQ ID NO: 75080 - DNA, 18 bp, Artificial Sequence
  Synthetic
ccatctcccugcccauct

SEQ ID NO: 75081 - DNA, 17 bp, Artificial Sequence
  Synthetic
ccacugctgctcucgct

SEQ ID NO: 75082 - DNA, 21 bp, Artificial Sequence
  Synthetic
ggcctugaacaccttcccaua

SEQ ID NO: 75083 - DNA, 17 bp, Artificial Sequence
  Synthetic
ggccgccagcuagtuga

SEQ ID NO: 75084 - DNA, 23 bp, Artificial Sequence
  Synthetic
gggagcutaaatgacucaaaggt

SEQ ID NO: 75085 - DNA, 23 bp, Artificial Sequence
  Synthetic
tgttctaauggcccttccttguc

SEQ ID NO: 75086 - DNA, 22 bp, Artificial Sequence
  Synthetic
ggaaaagacccagugtugggat

SEQ ID NO: 75087 - DNA, 28 bp, Artificial Sequence
  Synthetic
ttcagccatccugtttctctttcaauaa

SEQ ID NO: 75088 - DNA, 21 bp, Artificial Sequence
  Synthetic
ccgctcugggctgtgttuaat

SEQ ID NO: 75089 - DNA, 19 bp, Artificial Sequence
  Synthetic
ccaggaucttgcugacggt

SEQ ID NO: 75090 - DNA, 17 bp, Artificial Sequence
  Synthetic
cagctguagccccuggt

SEQ ID NO: 75091 - DNA, 19 bp, Artificial Sequence
  Synthetic
cagcccaugctcacttguc

SEQ ID NO: 75092 - DNA, 23 bp, Artificial Sequence
  Synthetic
gctcacatutcctattccugggt

SEQ ID NO: 75093 - DNA, 27 bp, Artificial Sequence
  Synthetic
ccaatggaggagaautaggcctttuaa

SEQ ID NO: 75094 - DNA, 24 bp, Artificial Sequence
  Synthetic
cctgaagaagaccuttgactcugt

SEQ ID NO: 75095 - DNA, 20 bp, Artificial Sequence
  Synthetic
acttcugacaggacccugct

SEQ ID NO: 75096 - DNA, 21 bp, Artificial Sequence
  Synthetic
cgucaucccaaccaggacaac

SEQ ID NO: 75097 - DNA, 19 bp, Artificial Sequence
  Synthetic
gcagggcaacccutcacuc

SEQ ID NO: 75098 - DNA, 27 bp, Artificial Sequence
  Synthetic
aagccttccauctgaagtatgaugaag

SEQ ID NO: 75099 - DNA, 28 bp, Artificial Sequence
  Synthetic
cacacacaagcauattttagaaucggaa

SEQ ID NO: 75100 - DNA, 21 bp, Artificial Sequence
  Synthetic
cacccccugttggtgtcttua

SEQ ID NO: 75101 - DNA, 21 bp, Artificial Sequence
  Synthetic
tgtuaccccggtgucaacaag

SEQ ID NO: 75102 - DNA, 21 bp, Artificial Sequence
  Synthetic
gctgcatcccutgccagaaua

SEQ ID NO: 75103 - DNA, 23 bp, Artificial Sequence
  Synthetic
atgcagaagaaaggcguttucag

SEQ ID NO: 75104 - DNA, 21 bp, Artificial Sequence
  Synthetic
ctggaacaaggutcccacugt

SEQ ID NO: 75105 - DNA, 28 bp, Artificial Sequence
  Synthetic
gctgtaaaggtugcttagtttctcatut

SEQ ID NO: 75106 - DNA, 19 bp, Artificial Sequence
  Synthetic
ccaggugagggaggugagt

SEQ ID NO: 75107 - DNA, 21 bp, Artificial Sequence
  Synthetic
gcctccucctttcttccucag

SEQ ID NO: 75108 - DNA, 21 bp, Artificial Sequence
  Synthetic
gccaugaccaucaccacaaga

SEQ ID NO: 75109 - DNA, 24 bp, Artificial Sequence
  Synthetic
caatggcauctacttctgucagca

SEQ ID NO: 75110 - DNA, 21 bp, Artificial Sequence
  Synthetic
gtagaccuccgaggtgttgut

SEQ ID NO: 75111 - DNA, 21 bp, Artificial Sequence
  Synthetic
caggagauggacgagaauccc

SEQ ID NO: 75112 - DNA, 23 bp, Artificial Sequence
  Synthetic
gattcgttcugggactctuccat

SEQ ID NO: 75113 - DNA, 22 bp, Artificial Sequence
  Synthetic
cccacguttcauagccaggaaa

SEQ ID NO: 75114 - DNA, 27 bp, Artificial Sequence
  Synthetic
agaccgaaaagaaaauggtagcuagac

SEQ ID NO: 75115 - DNA, 24 bp, Artificial Sequence
  Synthetic
tcaggaagtguctcttgaacucca

SEQ ID NO: 75116 - DNA, 23 bp, Artificial Sequence
  Synthetic
gggtgauggattggagtucaaga

SEQ ID NO: 75117 - DNA, 26 bp, Artificial Sequence
  Synthetic
actatatucaccaggatuccccagag

SEQ ID NO: 75118 - DNA, 26 bp, Artificial Sequence
  Synthetic
aggtgacatguattttgctctgtuca

SEQ ID NO: 75119 - DNA, 22 bp, Artificial Sequence
  Synthetic
cctcttcacccucacattgcuc

SEQ ID NO: 75120 - DNA, 22 bp, Artificial Sequence
  Synthetic
tgtagcagugcatttucaccgt

SEQ ID NO: 75121 - DNA, 20 bp, Artificial Sequence
  Synthetic
ggaagaugccaagcggaaug

SEQ ID NO: 75122 - DNA, 24 bp, Artificial Sequence
  Synthetic
tgatggctguctgattagcuagga

SEQ ID NO: 75123 - DNA, 20 bp, Artificial Sequence
  Synthetic
tcccccauttcccaccuaca

SEQ ID NO: 75124 - DNA, 22 bp, Artificial Sequence
  Synthetic
acctcttccugtgccaaaacug

SEQ ID NO: 75125 - DNA, 25 bp, Artificial Sequence
  Synthetic
agggtgtcaautacccacauaaagg

SEQ ID NO: 75126 - DNA, 22 bp, Artificial Sequence
  Synthetic
ggaatucaaggtaguccagggt

SEQ ID NO: 75127 - DNA, 27 bp, Artificial Sequence
  Synthetic
cccatccattcutcctattcccttuag

SEQ ID NO: 75128 - DNA, 27 bp, Artificial Sequence
  Synthetic
catacaacugttttgaaaauccagcgt

SEQ ID NO: 75129 - DNA, 23 bp, Artificial Sequence
  Synthetic
ccugacaaguaagcagggagaga

SEQ ID NO: 75130 - DNA, 28 bp, Artificial Sequence
  Synthetic
agtggctggguattcattttcttatgut

SEQ ID NO: 75131 - DNA, 24 bp, Artificial Sequence
  Synthetic
cauaggcatcattuccagcagaga

SEQ ID NO: 75132 - DNA, 28 bp, Artificial Sequence
  Synthetic
tttcagctgatgaguaaagaatctccug

SEQ ID NO: 75133 - DNA, 28 bp, Artificial Sequence
  Synthetic
acatctgatgctuatccttttcaaccut

SEQ ID NO: 75134 - DNA, 28 bp, Artificial Sequence
  Synthetic
gtaaagtgactcaugaatacagccuact

SEQ ID NO: 75135 - DNA, 23 bp, Artificial Sequence
  Synthetic
ccagaccgugagatctacgauga

SEQ ID NO: 75136 - DNA, 20 bp, Artificial Sequence
  Synthetic
ggtccuggtgtctcugagga

SEQ ID NO: 75137 - DNA, 18 bp, Artificial Sequence
  Synthetic
guggaagaggcggccaut

SEQ ID NO: 75138 - DNA, 19 bp, Artificial Sequence
  Synthetic
gcaacugctcgtctuccga

SEQ ID NO: 75139 - DNA, 23 bp, Artificial Sequence
  Synthetic
gggaattcagucccttactggut

SEQ ID NO: 75140 - DNA, 28 bp, Artificial Sequence
  Synthetic
gaaatcttaccugacatcatcagagcut

SEQ ID NO: 75141 - DNA, 28 bp, Artificial Sequence
  Synthetic
aatcaatgccauactgacaggaaauagt

SEQ ID NO: 75142 - DNA, 17 bp, Artificial Sequence
  Synthetic
gccacccccgucatcut

SEQ ID NO: 75143 - DNA, 20 bp, Artificial Sequence
  Synthetic
acccaacaucctgtgucagt

SEQ ID NO: 75144 - DNA, 31 bp, Artificial Sequence
  Synthetic
tgcattcatttccautttaaagtgctacuac

SEQ ID NO: 75145 - DNA, 27 bp, Artificial Sequence
  Synthetic
ttttaatagcaugcctggtucaagaga

SEQ ID NO: 75146 - DNA, 21 bp, Artificial Sequence
  Synthetic
ccttccugcagtccttgcuaa

SEQ ID NO: 75147 - DNA, 23 bp, Artificial Sequence
  Synthetic
gccauccatgttcuggaaaaagg

SEQ ID NO: 75148 - DNA, 24 bp, Artificial Sequence
  Synthetic
cccacagagccuacaagattguaa

SEQ ID NO: 75149 - DNA, 27 bp, Artificial Sequence
  Synthetic
gctttcagagcugttaaggtacuacac

SEQ ID NO: 75150 - DNA, 27 bp, Artificial Sequence
  Synthetic
gttctgtcacaccuccaatctuaaagt

SEQ ID NO: 75151 - DNA, 29 bp, Artificial Sequence
  Synthetic
ctgggtttctttucaacttgtaatagugt

SEQ ID NO: 75152 - DNA, 24 bp, Artificial Sequence
  Synthetic
ggcaggagutgagtatguaaaccc

SEQ ID NO: 75153 - DNA, 27 bp, Artificial Sequence
  Synthetic
aaattgttgaagucagaattggugcaa

SEQ ID NO: 75154 - DNA, 25 bp, Artificial Sequence
  Synthetic
tgttgattagutcaagctctugcct

SEQ ID NO: 75155 - DNA, 21 bp, Artificial Sequence
  Synthetic
ggttggguggcggttactuac

SEQ ID NO: 75156 - DNA, 22 bp, Artificial Sequence
  Synthetic
cauctcaucaccagaggcagat

SEQ ID NO: 75157 - DNA, 28 bp, Artificial Sequence
  Synthetic
cattagttttccaautggcctcttuagt

SEQ ID NO: 75158 - DNA, 23 bp, Artificial Sequence
  Synthetic
cagctugatggagaucgacacat

SEQ ID NO: 75159 - DNA, 20 bp, Artificial Sequence
  Synthetic
ggtactugggcggcactuac

SEQ ID NO: 75160 - DNA, 24 bp, Artificial Sequence
  Synthetic
ttaaaacgugaagctaacccucca

SEQ ID NO: 75161 - DNA, 27 bp, Artificial Sequence
  Synthetic
aaatcatcuggtttgtacucgcaaaac

SEQ ID NO: 75162 - DNA, 21 bp, Artificial Sequence
  Synthetic
gcaccttgucctgtctgtguc

SEQ ID NO: 75163 - DNA, 20 bp, Artificial Sequence
  Synthetic
gggtgaccucttgccaucac

SEQ ID NO: 75164 - DNA, 18 bp, Artificial Sequence
  Synthetic
ggcgccugggttctcauc

SEQ ID NO: 75165 - DNA, 17 bp, Artificial Sequence
  Synthetic
agctgcugccuccagac

SEQ ID NO: 75166 - DNA, 17 bp, Artificial Sequence
  Synthetic
tgcgcgggutccatgua

SEQ ID NO: 75167 - DNA, 18 bp, Artificial Sequence
  Synthetic
tcugcacccagacccuga

SEQ ID NO: 75168 - DNA, 22 bp, Artificial Sequence
  Synthetic
ggtgcaaggaguttggtttgug

SEQ ID NO: 75169 - DNA, 21 bp, Artificial Sequence
  Synthetic
ctgcagcuggctcagttuaga

SEQ ID NO: 75170 - DNA, 17 bp, Artificial Sequence
  Synthetic
gcagccgagccauggut

SEQ ID NO: 75171 - DNA, 18 bp, Artificial Sequence
  Synthetic
gcaggacucccccttguc

SEQ ID NO: 75172 - DNA, 20 bp, Artificial Sequence
  Synthetic
ctaccucctggcuggagaag

SEQ ID NO: 75173 - DNA, 20 bp, Artificial Sequence
  Synthetic
cgtgaagucttccccaucgt

SEQ ID NO: 75174 - DNA, 17 bp, Artificial Sequence
  Synthetic
ggctgagcugcccaaug

SEQ ID NO: 75175 - DNA, 19 bp, Artificial Sequence
  Synthetic
tctccaccacggcuttcug

SEQ ID NO: 75176 - DNA, 22 bp, Artificial Sequence
  Synthetic
tccucaaagagcuggagaacct

SEQ ID NO: 75177 - DNA, 18 bp, Artificial Sequence
  Synthetic
gggctcgutaggagcuga

SEQ ID NO: 75178 - DNA, 23 bp, Artificial Sequence
  Synthetic
gcttgacaaugcctgttttcuct

SEQ ID NO: 75179 - DNA, 21 bp, Artificial Sequence
  Synthetic
catattggcugtccagccgua

SEQ ID NO: 75180 - DNA, 26 bp, Artificial Sequence
  Synthetic
caatagacttgugtcttcacctugct

SEQ ID NO: 75181 - DNA, 18 bp, Artificial Sequence
  Synthetic
ccgcagcgucuccacaat

SEQ ID NO: 75182 - DNA, 21 bp, Artificial Sequence
  Synthetic
ctggagaucaacccugaccac

SEQ ID NO: 75183 - DNA, 20 bp, Artificial Sequence
  Synthetic
atgcgauagatgcggtugga

SEQ ID NO: 75184 - DNA, 21 bp, Artificial Sequence
  Synthetic
aaccgggucaatgtguggaat

SEQ ID NO: 75185 - DNA, 19 bp, Artificial Sequence
  Synthetic
ggagagaggccacguctuc

SEQ ID NO: 75186 - DNA, 21 bp, Artificial Sequence
  Synthetic
cgcctugagagcgagtactut

SEQ ID NO: 75187 - DNA, 20 bp, Artificial Sequence
  Synthetic
guagggaggcgggauaaagg

SEQ ID NO: 75188 - DNA, 22 bp, Artificial Sequence
  Synthetic
gggaagaugttcagcguagagt

SEQ ID NO: 75189 - DNA, 17 bp, Artificial Sequence
  Synthetic
ggagggucccgguaggt

SEQ ID NO: 75190 - DNA, 27 bp, Artificial Sequence
  Synthetic
cagagatcauggtttcttgacatucac

SEQ ID NO: 75191 - DNA, 22 bp, Artificial Sequence
  Synthetic
gutcttuacgaacagccaagcc

SEQ ID NO: 75192 - DNA, 25 bp, Artificial Sequence
  Synthetic
ccaauggaaaagaaatgcugcagaa

SEQ ID NO: 75193 - DNA, 21 bp, Artificial Sequence
  Synthetic
gccagcuacagatgguacagg

SEQ ID NO: 75194 - DNA, 23 bp, Artificial Sequence
  Synthetic
cttctggcutttccctugaggat

SEQ ID NO: 75195 - DNA, 25 bp, Artificial Sequence
  Synthetic
aattaagccaugtgagactugacca

SEQ ID NO: 75196 - DNA, 27 bp, Artificial Sequence
  Synthetic
tttgtaagagtgcutagctggattuga

SEQ ID NO: 75197 - DNA, 24 bp, Artificial Sequence
  Synthetic
tccgaacctucttggttaagctut

SEQ ID NO: 75198 - DNA, 22 bp, Artificial Sequence
  Synthetic
tcattatcugaggagccgguca

SEQ ID NO: 75199 - DNA, 26 bp, Artificial Sequence
  Synthetic
accctgctaauttgtcacaaguacaa

SEQ ID NO: 75200 - DNA, 28 bp, Artificial Sequence
  Synthetic
ttcgtcttcagcaugagaataagatgut

SEQ ID NO: 75201 - DNA, 25 bp, Artificial Sequence
  Synthetic
gatgcggccaccuataatactcuac

SEQ ID NO: 75202 - DNA, 21 bp, Artificial Sequence
  Synthetic
gtgaugggtcagtugaaagcc

SEQ ID NO: 75203 - DNA, 28 bp, Artificial Sequence
  Synthetic
aacaaaccagtgucttctcttcatuaca

SEQ ID NO: 75204 - DNA, 25 bp, Artificial Sequence
  Synthetic
ccaacaugacttacttgauccccat

SEQ ID NO: 75205 - DNA, 28 bp, Artificial Sequence
  Synthetic
aagttgaaacaaaugtggaaaucaccaa

SEQ ID NO: 75206 - DNA, 22 bp, Artificial Sequence
  Synthetic
cgugccacccagaatattucgt

SEQ ID NO: 75207 - DNA, 21 bp, Artificial Sequence
  Synthetic
acgaccaagucaccaaggaug

SEQ ID NO: 75208 - DNA, 19 bp, Artificial Sequence
  Synthetic
cgggugtcuaggaggcaca

SEQ ID NO: 75209 - DNA, 27 bp, Artificial Sequence
  Synthetic
cctgaacccagacagugacaaaatuat

SEQ ID NO: 75210 - DNA, 17 bp, Artificial Sequence
  Synthetic
ccagccccuggguacac

SEQ ID NO: 75211 - DNA, 17 bp, Artificial Sequence
  Synthetic
gtttgcccuggcuggac

SEQ ID NO: 75212 - DNA, 18 bp, Artificial Sequence
  Synthetic
gcagagagggcugcttug

SEQ ID NO: 75213 - DNA, 19 bp, Artificial Sequence
  Synthetic
ccctagcuctgccuaccct

SEQ ID NO: 75214 - DNA, 27 bp, Artificial Sequence
  Synthetic
cagcaccagaaauacaagctctuaaaa

SEQ ID NO: 75215 - DNA, 31 bp, Artificial Sequence
  Synthetic
gaacacaattguaaaatataacaaggcuccc

SEQ ID NO: 75216 - DNA, 20 bp, Artificial Sequence
  Synthetic
cgcacgugaagtgggaguag

SEQ ID NO: 75217 - DNA, 23 bp, Artificial Sequence
  Synthetic
aaagtgtcccucttgtctctugg

SEQ ID NO: 75218 - DNA, 28 bp, Artificial Sequence
  Synthetic
gccaacattaugcttctttatagctuct

SEQ ID NO: 75219 - DNA, 24 bp, Artificial Sequence
  Synthetic
gctctatatgccaucactgcagut

SEQ ID NO: 75220 - DNA, 17 bp, Artificial Sequence
  Synthetic
tggagguggccgagtug

SEQ ID NO: 75221 - DNA, 19 bp, Artificial Sequence
  Synthetic
ttctcccccucttggcuct

SEQ ID NO: 75222 - DNA, 27 bp, Artificial Sequence
  Synthetic
cttgcagtggugtttgttctacattua

SEQ ID NO: 75223 - DNA, 23 bp, Artificial Sequence
  Synthetic
catggagutcctgtctuccagaa

SEQ ID NO: 75224 - DNA, 25 bp, Artificial Sequence
  Synthetic
aaacaguaaacagcaagacugacct

SEQ ID NO: 75225 - DNA, 25 bp, Artificial Sequence
  Synthetic
acagttacggutctaatgcttucca

SEQ ID NO: 75226 - DNA, 21 bp, Artificial Sequence
  Synthetic
cgaacccacaacucccugaag

SEQ ID NO: 75227 - DNA, 25 bp, Artificial Sequence
  Synthetic
caatcgcctcuttcaggttgtttut

SEQ ID NO: 75228 - DNA, 23 bp, Artificial Sequence
  Synthetic
ccccaagaagutcacacugaaac

SEQ ID NO: 75229 - DNA, 20 bp, Artificial Sequence
  Synthetic
ggttgagacgutcgccttuc

SEQ ID NO: 75230 - DNA, 22 bp, Artificial Sequence
  Synthetic
gcaggaagucaagtcccugaga

SEQ ID NO: 75231 - DNA, 22 bp, Artificial Sequence
  Synthetic
ctgcactgugctgatgatgtug

SEQ ID NO: 75232 - DNA, 19 bp, Artificial Sequence
  Synthetic
tcugcagggaccugaggaa

SEQ ID NO: 75233 - DNA, 17 bp, Artificial Sequence
  Synthetic
gugggcauggagcagga

SEQ ID NO: 75234 - DNA, 21 bp, Artificial Sequence
  Synthetic
gcaaccaaagugcaggacauc

SEQ ID NO: 75235 - DNA, 28 bp, Artificial Sequence
  Synthetic
ccacaatgguctgaaaatgattuagcaa

SEQ ID NO: 75236 - DNA, 21 bp, Artificial Sequence
  Synthetic
tcaacugggcaatttcugcct

SEQ ID NO: 75237 - DNA, 22 bp, Artificial Sequence
  Synthetic
tgtagacgucctgcaaggttut

SEQ ID NO: 75238 - DNA, 18 bp, Artificial Sequence
  Synthetic
gaccgcuccccctgaauc

SEQ ID NO: 75239 - DNA, 17 bp, Artificial Sequence
  Synthetic
ggagcgucgtccctucc

SEQ ID NO: 75240 - DNA, 18 bp, Artificial Sequence
  Synthetic
tgctcacgcucttggcut

SEQ ID NO: 75241 - DNA, 18 bp, Artificial Sequence
  Synthetic
ggcggucacuccacaaac

SEQ ID NO: 75242 - DNA, 25 bp, Artificial Sequence
  Synthetic
tttgatctgucttgcctttuaccca

SEQ ID NO: 75243 - DNA, 28 bp, Artificial Sequence
  Synthetic
ccgatagtaacacutctaagcagaauga

SEQ ID NO: 75244 - DNA, 25 bp, Artificial Sequence
  Synthetic
gaagtatgagccutgattccctuga

SEQ ID NO: 75245 - DNA, 27 bp, Artificial Sequence
  Synthetic
actataagcaugaagctccaacauacc

SEQ ID NO: 75246 - DNA, 27 bp, Artificial Sequence
  Synthetic
cttatttgcagugaaagtatgcugaga

SEQ ID NO: 75247 - DNA, 27 bp, Artificial Sequence
  Synthetic
tccccgaaatuatacacatgacugaag

SEQ ID NO: 75248 - DNA, 20 bp, Artificial Sequence
  Synthetic
gggaaugacgagctccctuc

SEQ ID NO: 75249 - DNA, 25 bp, Artificial Sequence
  Synthetic
tgtctagatgcutgcatgtcaauca

SEQ ID NO: 75250 - DNA, 25 bp, Artificial Sequence
  Synthetic
gctgttcucaaacactgatccacut

SEQ ID NO: 75251 - DNA, 28 bp, Artificial Sequence
  Synthetic
gctgatgaatgaguctctaatgttggug

SEQ ID NO: 75252 - DNA, 28 bp, Artificial Sequence
  Synthetic
acttacctataugaggattgagagcugt

SEQ ID NO: 75253 - DNA, 25 bp, Artificial Sequence
  Synthetic
gggatgctucagtttccttuacaga

SEQ ID NO: 75254 - DNA, 19 bp, Artificial Sequence
  Synthetic
ctcagcccagugggcttua

SEQ ID NO: 75255 - DNA, 22 bp, Artificial Sequence
  Synthetic
ccctgaugggaagacgatugag

SEQ ID NO: 75256 - DNA, 20 bp, Artificial Sequence
  Synthetic
cttctggugctcccgauagt

SEQ ID NO: 75257 - DNA, 22 bp, Artificial Sequence
  Synthetic
gcccugagagaaaggctttcua

SEQ ID NO: 75258 - DNA, 22 bp, Artificial Sequence
  Synthetic
gagaugagtgacauggccaact

SEQ ID NO: 75259 - DNA, 20 bp, Artificial Sequence
  Synthetic
gccacccagaaguacagugt

SEQ ID NO: 75260 - DNA, 20 bp, Artificial Sequence
  Synthetic
ggatucccaccacgcagtut

SEQ ID NO: 75261 - DNA, 28 bp, Artificial Sequence
  Synthetic
aacatgttgcctuagtaatgtctctcuc

SEQ ID NO: 75262 - DNA, 21 bp, Artificial Sequence
  Synthetic
tgatgguggcacactugacag

SEQ ID NO: 75263 - DNA, 27 bp, Artificial Sequence
  Synthetic
cgtggacauccagctaaagtatttuga

SEQ ID NO: 75264 - DNA, 21 bp, Artificial Sequence
  Synthetic
atcagtctggucacggttugg

SEQ ID NO: 75265 - DNA, 22 bp, Artificial Sequence
  Synthetic
ccatggccugcagacttctuat

SEQ ID NO: 75266 - DNA, 28 bp, Artificial Sequence
  Synthetic
caagtttggauaactgaaagtucaccat

SEQ ID NO: 75267 - DNA, 21 bp, Artificial Sequence
  Synthetic
tgaaactgcgcucctgtctuc

SEQ ID NO: 75268 - DNA, 21 bp, Artificial Sequence
  Synthetic
ggatcutccagacugaagcca

SEQ ID NO: 75269 - DNA, 22 bp, Artificial Sequence
  Synthetic
acaaugggttacauggcagcaa

SEQ ID NO: 75270 - DNA, 19 bp, Artificial Sequence
  Synthetic
ggaauctcucccgccaagt

SEQ ID NO: 75271 - DNA, 17 bp, Artificial Sequence
  Synthetic
ccgtgcccucgtttugg

SEQ ID NO: 75272 - DNA, 17 bp, Artificial Sequence
  Synthetic
accatucgagccgcgut

SEQ ID NO: 75273 - DNA, 21 bp, Artificial Sequence
  Synthetic
acagccgcccagaaautcuac

SEQ ID NO: 75274 - DNA, 24 bp, Artificial Sequence
  Synthetic
cagggtttatcuccaggtgttuct

SEQ ID NO: 75275 - DNA, 27 bp, Artificial Sequence
  Synthetic
actttttgatuacaggtggttgtguca

SEQ ID NO: 75276 - DNA, 26 bp, Artificial Sequence
  Synthetic
tcttagggctugagctttcatgatuc

SEQ ID NO: 75277 - DNA, 28 bp, Artificial Sequence
  Synthetic
agtcatcacttttugattacaggtggut

SEQ ID NO: 75278 - DNA, 25 bp, Artificial Sequence
  Synthetic
tgtggtacaaucattccttgtgcut

SEQ ID NO: 75279 - DNA, 23 bp, Artificial Sequence
  Synthetic
cctgcaagatucaggcacctaug

SEQ ID NO: 75280 - DNA, 23 bp, Artificial Sequence
  Synthetic
ggagatgucaccaatcggttuga

SEQ ID NO: 75281 - DNA, 32 bp, Artificial Sequence
  Synthetic
aagttgtatttgacaguagatagtatttugga

SEQ ID NO: 75282 - DNA, 28 bp, Artificial Sequence
  Synthetic
gtgtattccaagcugaaacaaagtaugt

SEQ ID NO: 75283 - DNA, 25 bp, Artificial Sequence
  Synthetic
gaacuggcggaagauaaagagaact

SEQ ID NO: 75284 - DNA, 25 bp, Artificial Sequence
  Synthetic
gtagutctctttatctuccgccagt

SEQ ID NO: 75285 - DNA, 25 bp, Artificial Sequence
  Synthetic
ctcggaggatcuccctctaaacaua

SEQ ID NO: 75286 - DNA, 28 bp, Artificial Sequence
  Synthetic
gccagttcaguaaagagttctaagcaut

SEQ ID NO: 75287 - DNA, 23 bp, Artificial Sequence
  Synthetic
tggaatgacucagtgcattuggt

SEQ ID NO: 75288 - DNA, 24 bp, Artificial Sequence
  Synthetic
cctgtgtatacautcctggctcug

SEQ ID NO: 75289 - DNA, 27 bp, Artificial Sequence
  Synthetic
ttacttggatttuactgcggacagtua

SEQ ID NO: 75290 - DNA, 28 bp, Artificial Sequence
  Synthetic
tgctaatactgtagugcattgttctgut

SEQ ID NO: 75291 - DNA, 26 bp, Artificial Sequence
  Synthetic
ccaaatggguttcatgttaactugga

SEQ ID NO: 75292 - DNA, 23 bp, Artificial Sequence
  Synthetic
agcacaauccaagctaggcuaag

SEQ ID NO: 75293 - DNA, 24 bp, Artificial Sequence
  Synthetic
tcacaagtgtuttgtgcgaguaga

SEQ ID NO: 75294 - DNA, 21 bp, Artificial Sequence
  Synthetic
tctccttccgucggcatttut

SEQ ID NO: 75295 - DNA, 28 bp, Artificial Sequence
  Synthetic
gtgcacgaacaautcttaagatcttuga

SEQ ID NO: 75296 - DNA, 21 bp, Artificial Sequence
  Synthetic
ccggcaccucatctctgaaut

SEQ ID NO: 75297 - DNA, 24 bp, Artificial Sequence
  Synthetic
ctggtacagcaucatcaccaucat

SEQ ID NO: 75298 - DNA, 23 bp, Artificial Sequence
  Synthetic
tccatacugcccctttaacgtut

SEQ ID NO: 75299 - DNA, 28 bp, Artificial Sequence
  Synthetic
ctgaatttactgcugtttttggagtcut

SEQ ID NO: 75300 - DNA, 21 bp, Artificial Sequence
  Synthetic
acaagctugaagcacccauca

SEQ ID NO: 75301 - DNA, 28 bp, Artificial Sequence
  Synthetic
gaaaagtacatcgaucaagaagagcuca

SEQ ID NO: 75302 - DNA, 23 bp, Artificial Sequence
  Synthetic
ttgatgagguagatccgguccat

SEQ ID NO: 75303 - DNA, 20 bp, Artificial Sequence
  Synthetic
tcutcggagaugagcagcac

SEQ ID NO: 75304 - DNA, 22 bp, Artificial Sequence
  Synthetic
gaaggugtggcugaacacaaag

SEQ ID NO: 75305 - DNA, 21 bp, Artificial Sequence
  Synthetic
tttgtgccagcugactcugaa

SEQ ID NO: 75306 - DNA, 22 bp, Artificial Sequence
  Synthetic
gggctttgutttgttgagcuct

SEQ ID NO: 75307 - DNA, 26 bp, Artificial Sequence
  Synthetic
aaagagucggaagacaaaccugaaat

SEQ ID NO: 75308 - DNA, 28 bp, Artificial Sequence
  Synthetic
ttgagctcttctugatcgatgtacttut

SEQ ID NO: 75309 - DNA, 24 bp, Artificial Sequence
  Synthetic
agaaagagucggaagacaaaccug

SEQ ID NO: 75310 - DNA, 21 bp, Artificial Sequence
  Synthetic
cctggctcutgtaggcactua

SEQ ID NO: 75311 - DNA, 26 bp, Artificial Sequence
  Synthetic
gagatctctcugatcctatctugcac

SEQ ID NO: 75312 - DNA, 28 bp, Artificial Sequence
  Synthetic
ctcatcagaaccaacaucttcaattuca

SEQ ID NO: 75313 - DNA, 28 bp, Artificial Sequence
  Synthetic
gcagtgatgtgauttcgtgttttcttut

SEQ ID NO: 75314 - DNA, 22 bp, Artificial Sequence
  Synthetic
acagugaaauggcagaagacct

SEQ ID NO: 75315 - DNA, 28 bp, Artificial Sequence
  Synthetic
acttgcatcuaaaacacccacatagtut

SEQ ID NO: 75316 - DNA, 26 bp, Artificial Sequence
  Synthetic
tcaaccaaatuacagtctgactugaa

SEQ ID NO: 75317 - DNA, 26 bp, Artificial Sequence
  Synthetic
gctgcaattguctaatgttttccuca

SEQ ID NO: 75318 - DNA, 20 bp, Artificial Sequence
  Synthetic
tgtgugagcagcctgcatua

SEQ ID NO: 75319 - DNA, 28 bp, Artificial Sequence
  Synthetic
ggcaactacttugagatgagtacctaut

SEQ ID NO: 75320 - DNA, 33 bp, Artificial Sequence
  Synthetic
tgtagattcagatuatatttttaggcagucaca

SEQ ID NO: 75321 - DNA, 23 bp, Artificial Sequence
  Synthetic
cggaacccaaaaggugacauacc

SEQ ID NO: 75322 - DNA, 28 bp, Artificial Sequence
  Synthetic
gcttatgctacagucatacatacctuca

SEQ ID NO: 75323 - DNA, 25 bp, Artificial Sequence
  Synthetic
cctttttccccuctacacaguacag

SEQ ID NO: 75324 - DNA, 24 bp, Artificial Sequence
  Synthetic
ccaggaacaacaaaaucagtugct

SEQ ID NO: 75325 - DNA, 27 bp, Artificial Sequence
  Synthetic
ccctatttgtcuaggtgtcttcuaggt

SEQ ID NO: 75326 - DNA, 26 bp, Artificial Sequence
  Synthetic
ccacugatgauacaaaagcaaacaga

SEQ ID NO: 75327 - DNA, 29 bp, Artificial Sequence
  Synthetic
caagtttguattctgaaaaugcaggaaca

SEQ ID NO: 75328 - DNA, 29 bp, Artificial Sequence
  Synthetic
gttttgggagccutgttatatttuacaat

SEQ ID NO: 75329 - DNA, 28 bp, Artificial Sequence
  Synthetic
tttctcttccatcuctctctgactctut

SEQ ID NO: 75330 - DNA, 28 bp, Artificial Sequence
  Synthetic
gagaaaacaaagagucagagagagaugg

SEQ ID NO: 75331 - DNA, 30 bp, Artificial Sequence
  Synthetic
ctttcagattcattuggtagagtgactuct

SEQ ID NO: 75332 - DNA, 20 bp, Artificial Sequence
  Synthetic
ggacccccaauccctcatuc

SEQ ID NO: 75333 - DNA, 24 bp, Artificial Sequence
  Synthetic
aaggcatctggugttaggtaggua

SEQ ID NO: 75334 - DNA, 21 bp, Artificial Sequence
  Synthetic
cctgtgccuctgctgcataut

SEQ ID NO: 75335 - DNA, 28 bp, Artificial Sequence
  Synthetic
agtcgactgtguttaactttgagtttut

SEQ ID NO: 75336 - DNA, 20 bp, Artificial Sequence
  Synthetic
cctgcgggauttcactugct

SEQ ID NO: 75337 - DNA, 25 bp, Artificial Sequence
  Synthetic
ggccatactcutgtcctcaattgua

SEQ ID NO: 75338 - DNA, 21 bp, Artificial Sequence
  Synthetic
gcaatgagucctgctccacua

SEQ ID NO: 75339 - DNA, 21 bp, Artificial Sequence
  Synthetic
tgtgggccugcaagaactaug

SEQ ID NO: 75340 - DNA, 26 bp, Artificial Sequence
  Synthetic
ggagaaaaggcagacuttaagggaua

SEQ ID NO: 75341 - DNA, 28 bp, Artificial Sequence
  Synthetic
catatcaagtugccaaaggaatggaaut

SEQ ID NO: 75342 - DNA, 25 bp, Artificial Sequence
  Synthetic
ggagcauaccgacttaaatuccaga

SEQ ID NO: 75343 - DNA, 25 bp, Artificial Sequence
  Synthetic
gcaaaagtgaagacuggctctatut

SEQ ID NO: 75344 - DNA, 22 bp, Artificial Sequence
  Synthetic
gtgtucaagggagtgguagcag

SEQ ID NO: 75345 - DNA, 28 bp, Artificial Sequence
  Synthetic
ccgaagtgctcugtatttttatctgugt

SEQ ID NO: 75346 - DNA, 20 bp, Artificial Sequence
  Synthetic
gtctgacugcacatcuccgt

SEQ ID NO: 75347 - DNA, 27 bp, Artificial Sequence
  Synthetic
ctctccccauaacagacctttttacuc

SEQ ID NO: 75348 - DNA, 22 bp, Artificial Sequence
  Synthetic
aaaggcagtuttggacccauct

SEQ ID NO: 75349 - DNA, 23 bp, Artificial Sequence
  Synthetic
gcaacaaucacagcagttuggat

SEQ ID NO: 75350 - DNA, 21 bp, Artificial Sequence
  Synthetic
gtttcggtuggctttggugag

SEQ ID NO: 75351 - DNA, 28 bp, Artificial Sequence
  Synthetic
tgaatgtcaagaaaccaugatctctgut

SEQ ID NO: 75352 - DNA, 23 bp, Artificial Sequence
  Synthetic
accaatggaguttgaagtgcuga

SEQ ID NO: 75353 - DNA, 23 bp, Artificial Sequence
  Synthetic
gggtguagacactgtcacuaagg

SEQ ID NO: 75354 - DNA, 27 bp, Artificial Sequence
  Synthetic
tttttaagtccagcuttcccttctuct

SEQ ID NO: 75355 - DNA, 23 bp, Artificial Sequence
  Synthetic
guatctccgtcauagggaagggt

SEQ ID NO: 75356 - DNA, 18 bp, Artificial Sequence
  Synthetic
gugggcucccacagagac

SEQ ID NO: 75357 - DNA, 20 bp, Artificial Sequence
  Synthetic
agggcacccgggauatauca

SEQ ID NO: 75358 - DNA, 21 bp, Artificial Sequence
  Synthetic
tgcagaaguacccucaagcag

SEQ ID NO: 75359 - DNA, 23 bp, Artificial Sequence
  Synthetic
aatctcccugccaaggaaagaug

SEQ ID NO: 75360 - DNA, 21 bp, Artificial Sequence
  Synthetic
gggccuaccttaugggacaaa

SEQ ID NO: 75361 - DNA, 21 bp, Artificial Sequence
  Synthetic
gctgtggucatgctgagaugg

SEQ ID NO: 75362 - DNA, 28 bp, Artificial Sequence
  Synthetic
gctgacgtatttaauggaggtctcttua

SEQ ID NO: 75363 - DNA, 25 bp, Artificial Sequence
  Synthetic
aaatagcttgagutttccgagcuca

SEQ ID NO: 75364 - DNA, 27 bp, Artificial Sequence
  Synthetic
aggagtttttgucagaaaatggcatuc

SEQ ID NO: 75365 - DNA, 22 bp, Artificial Sequence
  Synthetic
gctcugcatacagtucggagat

SEQ ID NO: 75366 - DNA, 21 bp, Artificial Sequence
  Synthetic
ggagacacaugtcgtggucag

SEQ ID NO: 75367 - DNA, 28 bp, Artificial Sequence
  Synthetic
tttgaagaggacggaautagctgtuaat

SEQ ID NO: 75368 - DNA, 19 bp, Artificial Sequence
  Synthetic
ccctcggucatggaccuca

SEQ ID NO: 75369 - DNA, 22 bp, Artificial Sequence
  Synthetic
ctctacctugcctgtcccatuc

SEQ ID NO: 75370 - DNA, 20 bp, Artificial Sequence
  Synthetic
tgucaagggagagggucagt

SEQ ID NO: 75371 - DNA, 19 bp, Artificial Sequence
  Synthetic
gaagcuacggcatccccua

SEQ ID NO: 75372 - DNA, 19 bp, Artificial Sequence
  Synthetic
tctuggccgaggtcucgat

SEQ ID NO: 75373 - DNA, 20 bp, Artificial Sequence
  Synthetic
ctctcgctutccacctcuca

SEQ ID NO: 75374 - DNA, 25 bp, Artificial Sequence
  Synthetic
cuacctttttactcugccagggaat

SEQ ID NO: 75375 - DNA, 27 bp, Artificial Sequence
  Synthetic
aagatccugaactgagttuaaaaggca

SEQ ID NO: 75376 - DNA, 26 bp, Artificial Sequence
  Synthetic
tgccttttaaacucagttcaggauct

SEQ ID NO: 75377 - DNA, 30 bp, Artificial Sequence
  Synthetic
tgaaaaactcaccutcatggaaagauaact

SEQ ID NO: 75378 - DNA, 17 bp, Artificial Sequence
  Synthetic
cctcacgccuggtguct

SEQ ID NO: 75379 - DNA, 20 bp, Artificial Sequence
  Synthetic
ggttgtgguaccagcggaug

SEQ ID NO: 75380 - DNA, 25 bp, Artificial Sequence
  Synthetic
cctatcgctcugctctctctttgua

SEQ ID NO: 75381 - DNA, 22 bp, Artificial Sequence
  Synthetic
acgcagagugaugagaaaaccc

SEQ ID NO: 75382 - DNA, 27 bp, Artificial Sequence
  Synthetic
tgaactcactguctaaggtccuaacaa

SEQ ID NO: 75383 - DNA, 21 bp, Artificial Sequence
  Synthetic
gggcaauttctgccugaaagg

SEQ ID NO: 75384 - DNA, 20 bp, Artificial Sequence
  Synthetic
gccuggcgggcaattctaut

SEQ ID NO: 75385 - DNA, 21 bp, Artificial Sequence
  Synthetic
cggccguaagtcacaggatuc

SEQ ID NO: 75386 - DNA, 19 bp, Artificial Sequence
  Synthetic
gcuaccugggcaacgacac

SEQ ID NO: 75387 - DNA, 18 bp, Artificial Sequence
  Synthetic
gtccccuaaccccaugct

SEQ ID NO: 75388 - DNA, 23 bp, Artificial Sequence
  Synthetic
gagaagcccauttagccatggua

SEQ ID NO: 75389 - DNA, 28 bp, Artificial Sequence
  Synthetic
gcctgtgaucaagtgtgttttaaucaat

SEQ ID NO: 75390 - DNA, 22 bp, Artificial Sequence
  Synthetic
gaggaggagguggagactttug

SEQ ID NO: 75391 - DNA, 23 bp, Artificial Sequence
  Synthetic
aaatguggaaaccagagcaccua

SEQ ID NO: 75392 - DNA, 26 bp, Artificial Sequence
  Synthetic
ttgtaaaaatatcucagcgcguagga

SEQ ID NO: 75393 - DNA, 22 bp, Artificial Sequence
  Synthetic
agacuagatagcgucaccagca

SEQ ID NO: 75394 - DNA, 28 bp, Artificial Sequence
  Synthetic
ttccccactgaugaatcattgttctuat

SEQ ID NO: 75395 - DNA, 28 bp, Artificial Sequence
  Synthetic
gcatgttttcttuttaaggtgtgcaugt

SEQ ID NO: 75396 - DNA, 22 bp, Artificial Sequence
  Synthetic
ccgcacaccuaaggaaaagaug

SEQ ID NO: 75397 - DNA, 23 bp, Artificial Sequence
  Synthetic
tgaaagcacugcactctcttgut

SEQ ID NO: 75398 - DNA, 29 bp, Artificial Sequence
  Synthetic
ctcaacatcacucagacttttatctucct

SEQ ID NO: 75399 - DNA, 22 bp, Artificial Sequence
  Synthetic
gggtccttutcggtctctucaa

SEQ ID NO: 75400 - DNA, 28 bp, Artificial Sequence
  Synthetic
agagagtgacautgttttagctttcugt

SEQ ID NO: 75401 - DNA, 21 bp, Artificial Sequence
  Synthetic
agggcaacaccucuacaagga

SEQ ID NO: 75402 - DNA, 24 bp, Artificial Sequence
  Synthetic
caccgaaagcaaaucatucaacga

SEQ ID NO: 75403 - DNA, 17 bp, Artificial Sequence
  Synthetic
gguggtggcucacccag

SEQ ID NO: 75404 - DNA, 18 bp, Artificial Sequence
  Synthetic
gggccucagccactccua

SEQ ID NO: 75405 - DNA, 18 bp, Artificial Sequence
  Synthetic
aggguacctcugcaccgt

SEQ ID NO: 75406 - DNA, 26 bp, Artificial Sequence
  Synthetic
gcctaagcaauataaatggcugcaga

SEQ ID NO: 75407 - DNA, 23 bp, Artificial Sequence
  Synthetic
gtgtttctcuggcatctgauggt

SEQ ID NO: 75408 - DNA, 25 bp, Artificial Sequence
  Synthetic
aaugagaaagaaucaagggcaaggt

SEQ ID NO: 75409 - DNA, 21 bp, Artificial Sequence
  Synthetic
ccccttctuggttggtagcuc

SEQ ID NO: 75410 - DNA, 24 bp, Artificial Sequence
  Synthetic
gtcattcaaaacaauggctggugt

SEQ ID NO: 75411 - DNA, 21 bp, Artificial Sequence
  Synthetic
tccccgugcttcaugagaaag

SEQ ID NO: 75412 - DNA, 25 bp, Artificial Sequence
  Synthetic
cctagaatugggagctgagagtgua

SEQ ID NO: 75413 - DNA, 24 bp, Artificial Sequence
  Synthetic
gggaaacagaautgagagcaucac

SEQ ID NO: 75414 - DNA, 23 bp, Artificial Sequence
  Synthetic
gactacaaaacucccctucccaa

SEQ ID NO: 75415 - DNA, 21 bp, Artificial Sequence
  Synthetic
catgguggcccaagctaugaa

SEQ ID NO: 75416 - DNA, 28 bp, Artificial Sequence
  Synthetic
tttcatactcacuaggaaagcaacctut

SEQ ID NO: 75417 - DNA, 28 bp, Artificial Sequence
  Synthetic
gctgcaaatatcuagctgtacctactuc

SEQ ID NO: 75418 - DNA, 22 bp, Artificial Sequence
  Synthetic
gatugaagagcccacaggugat

SEQ ID NO: 75419 - DNA, 23 bp, Artificial Sequence
  Synthetic
ccgttgtaccuattgcactccuc

SEQ ID NO: 75420 - DNA, 24 bp, Artificial Sequence
  Synthetic
ccttctattatugccatgcgcuga

SEQ ID NO: 75421 - DNA, 27 bp, Artificial Sequence
  Synthetic
ctgtaaagccacautgtgacaacttut

SEQ ID NO: 75422 - DNA, 26 bp, Artificial Sequence
  Synthetic
agcagtagtaggugatgtttaccugt

SEQ ID NO: 75423 - DNA, 26 bp, Artificial Sequence
  Synthetic
gcagtauacagcaagcccactuaaaa

SEQ ID NO: 75424 - DNA, 29 bp, Artificial Sequence
  Synthetic
agattgcagattcugtttccttcttctut

SEQ ID NO: 75425 - DNA, 24 bp, Artificial Sequence
  Synthetic
ccugtggaagaaauggcaaacaat

SEQ ID NO: 75426 - DNA, 19 bp, Artificial Sequence
  Synthetic
ccatgagcugtcgcugcat

SEQ ID NO: 75427 - DNA, 22 bp, Artificial Sequence
  Synthetic
tttcccatccutcaaggcucag

SEQ ID NO: 75428 - DNA, 23 bp, Artificial Sequence
  Synthetic
agagtagaguggtggauccagac

SEQ ID NO: 75429 - DNA, 26 bp, Artificial Sequence
  Synthetic
tgtttggttuggaagtccagaagaut

SEQ ID NO: 75430 - DNA, 19 bp, Artificial Sequence
  Synthetic
ggagcgagagacgcuagug

SEQ ID NO: 75431 - DNA, 24 bp, Artificial Sequence
  Synthetic
acagcctttuacaggaccuagagt

SEQ ID NO: 75432 - DNA, 26 bp, Artificial Sequence
  Synthetic
tgtgttcaaggutaaagtacugcaga

SEQ ID NO: 75433 - DNA, 25 bp, Artificial Sequence
  Synthetic
ggcccagccauaaatatgttttgut

SEQ ID NO: 75434 - DNA, 22 bp, Artificial Sequence
  Synthetic
ccagatgaagccuccctcugat

SEQ ID NO: 75435 - DNA, 28 bp, Artificial Sequence
  Synthetic
ggacaagcagaugatatcccuaacaaaa

SEQ ID NO: 75436 - DNA, 21 bp, Artificial Sequence
  Synthetic
ctcgttcugggctgatucaga

SEQ ID NO: 75437 - DNA, 23 bp, Artificial Sequence
  Synthetic
ggatacctuggtccagauggaga

SEQ ID NO: 75438 - DNA, 20 bp, Artificial Sequence
  Synthetic
aggagagcagacagcuggua

SEQ ID NO: 75439 - DNA, 20 bp, Artificial Sequence
  Synthetic
gtgttcuccaggctccugaa

SEQ ID NO: 75440 - DNA, 21 bp, Artificial Sequence
  Synthetic
accctccacugtacgtctcut

SEQ ID NO: 75441 - DNA, 20 bp, Artificial Sequence
  Synthetic
cctggcucagctctgtgaug

SEQ ID NO: 75442 - DNA, 21 bp, Artificial Sequence
  Synthetic
ccctgugggacagaacaaucc

SEQ ID NO: 75443 - DNA, 22 bp, Artificial Sequence
  Synthetic
acaaaaggaucaagguggcgaa

SEQ ID NO: 75444 - DNA, 22 bp, Artificial Sequence
  Synthetic
ccacccaugtgttccucacaag

SEQ ID NO: 75445 - DNA, 22 bp, Artificial Sequence
  Synthetic
ccacttcucaccccatcactua

SEQ ID NO: 75446 - DNA, 23 bp, Artificial Sequence
  Synthetic
ggtcatctcaucaccatccauct

SEQ ID NO: 75447 - DNA, 21 bp, Artificial Sequence
  Synthetic
gctttctgccacugtctccug

SEQ ID NO: 75448 - DNA, 17 bp, Artificial Sequence
  Synthetic
gccccugagcgtcauct

SEQ ID NO: 75449 - DNA, 21 bp, Artificial Sequence
  Synthetic
tgtgcgtcacugtacacctug

SEQ ID NO: 75450 - DNA, 19 bp, Artificial Sequence
  Synthetic
gcgacguggagttccacug

SEQ ID NO: 75451 - DNA, 21 bp, Artificial Sequence
  Synthetic
cacctugagcacggtaacgua

SEQ ID NO: 75452 - DNA, 20 bp, Artificial Sequence
  Synthetic
tggaggugaauggcagcaag

SEQ ID NO: 75453 - DNA, 21 bp, Artificial Sequence
  Synthetic
cuccaaccccuagacccaaat

SEQ ID NO: 75454 - DNA, 18 bp, Artificial Sequence
  Synthetic
ccacgtcugcccctcuct

SEQ ID NO: 75455 - DNA, 19 bp, Artificial Sequence
  Synthetic
cagcaggccuggacctuac

SEQ ID NO: 75456 - DNA, 26 bp, Artificial Sequence
  Synthetic
aagcctatctugttttgaagccuaca

SEQ ID NO: 75457 - DNA, 28 bp, Artificial Sequence
  Synthetic
gatcatcgaauacccctttgactuacaa

SEQ ID NO: 75458 - DNA, 19 bp, Artificial Sequence
  Synthetic
agccctaucctggctgugt

SEQ ID NO: 75459 - DNA, 21 bp, Artificial Sequence
  Synthetic
tgaccauccagctgauccaga

SEQ ID NO: 75460 - DNA, 24 bp, Artificial Sequence
  Synthetic
ggtcgtatucgtccacaaaauggt

SEQ ID NO: 75461 - DNA, 20 bp, Artificial Sequence
  Synthetic
ggcaggagacccuguaggag

SEQ ID NO: 75462 - DNA, 23 bp, Artificial Sequence
  Synthetic
ccctucagagaatgtcugcacaa

SEQ ID NO: 75463 - DNA, 22 bp, Artificial Sequence
  Synthetic
gccagaacccaucuacagcaag

SEQ ID NO: 75464 - DNA, 28 bp, Artificial Sequence
  Synthetic
gactcagtuactacctgaaaaugacact

SEQ ID NO: 75465 - DNA, 26 bp, Artificial Sequence
  Synthetic
attctcattgtgucttccctcctcua

SEQ ID NO: 75466 - DNA, 22 bp, Artificial Sequence
  Synthetic
tggagguggaggaaggacaaut

SEQ ID NO: 75467 - DNA, 20 bp, Artificial Sequence
  Synthetic
ttcccgtgucagtggctaug

SEQ ID NO: 75468 - DNA, 22 bp, Artificial Sequence
  Synthetic
caaagcguctgcattugaagga

SEQ ID NO: 75469 - DNA, 21 bp, Artificial Sequence
  Synthetic
actacctgugcaatgcctgug

SEQ ID NO: 75470 - DNA, 22 bp, Artificial Sequence
  Synthetic
tctgccttuggatttccgtcut

SEQ ID NO: 75471 - DNA, 21 bp, Artificial Sequence
  Synthetic
cctgaggutgccuacaaaggg

SEQ ID NO: 75472 - DNA, 23 bp, Artificial Sequence
  Synthetic
tgcccatucatcttgtgguagag

SEQ ID NO: 75473 - DNA, 20 bp, Artificial Sequence
  Synthetic
cccgagaacutgccggtuaa

SEQ ID NO: 75474 - DNA, 24 bp, Artificial Sequence
  Synthetic
gggagtgauaacttgaggtgucat

SEQ ID NO: 75475 - DNA, 21 bp, Artificial Sequence
  Synthetic
tttaagcaggcugauggcagt

SEQ ID NO: 75476 - DNA, 24 bp, Artificial Sequence
  Synthetic
tgtattgcaugcattcccctuaca

SEQ ID NO: 75477 - DNA, 22 bp, Artificial Sequence
  Synthetic
tgcttuccaagtagttguggca

SEQ ID NO: 75478 - DNA, 27 bp, Artificial Sequence
  Synthetic
tggtaattcacaagugattgagcugat

SEQ ID NO: 75479 - DNA, 28 bp, Artificial Sequence
  Synthetic
ccattaataccugattctcugccaacaa

SEQ ID NO: 75480 - DNA, 19 bp, Artificial Sequence
  Synthetic
cauccaggacaugcgcaga

SEQ ID NO: 75481 - DNA, 23 bp, Artificial Sequence
  Synthetic
gccaucaacaacaccaagtctut

SEQ ID NO: 75482 - DNA, 22 bp, Artificial Sequence
  Synthetic
cctgtactgguggatgtccuca

SEQ ID NO: 75483 - DNA, 21 bp, Artificial Sequence
  Synthetic
cggaagcagguggtcatugat

SEQ ID NO: 75484 - DNA, 27 bp, Artificial Sequence
  Synthetic
aaggtcctctttugaaatgtaccacut

SEQ ID NO: 75485 - DNA, 27 bp, Artificial Sequence
  Synthetic
gcggacatagaguttgatgttgttcut

SEQ ID NO: 75486 - DNA, 20 bp, Artificial Sequence
  Synthetic
ccagccucgatctgtaccut

SEQ ID NO: 75487 - DNA, 18 bp, Artificial Sequence
  Synthetic
tcccgcuccgacacatug

SEQ ID NO: 75488 - DNA, 23 bp, Artificial Sequence
  Synthetic
cagcgaagcucttuagaggaaca

SEQ ID NO: 75489 - DNA, 20 bp, Artificial Sequence
  Synthetic
ctctgcucctaaggcugcat

SEQ ID NO: 75490 - DNA, 21 bp, Artificial Sequence
  Synthetic
cggtauccaggatguccaaca

SEQ ID NO: 75491 - DNA, 22 bp, Artificial Sequence
  Synthetic
gcaugagagguaccagggagag

SEQ ID NO: 75492 - DNA, 22 bp, Artificial Sequence
  Synthetic
agtcctggaucagtgagagugt

SEQ ID NO: 75493 - DNA, 20 bp, Artificial Sequence
  Synthetic
ggcaugggacagagtcgtua

SEQ ID NO: 75494 - DNA, 25 bp, Artificial Sequence
  Synthetic
agcatugcaggaagagaaaaguagt

SEQ ID NO: 75495 - DNA, 29 bp, Artificial Sequence
  Synthetic
tgtcttttaccugaatgtttcttctugga

SEQ ID NO: 75496 - DNA, 28 bp, Artificial Sequence
  Synthetic
ccuttgaccttttugagaacaagaagaa

SEQ ID NO: 75497 - DNA, 23 bp, Artificial Sequence
  Synthetic
gcctaaaaccucccaagactuca

SEQ ID NO: 75498 - DNA, 28 bp, Artificial Sequence
  Synthetic
tttctacagagguaaccacagaatcuct

SEQ ID NO: 75499 - DNA, 21 bp, Artificial Sequence
  Synthetic
gaagaaccugggccaucacaa

SEQ ID NO: 75500 - DNA, 19 bp, Artificial Sequence
  Synthetic
cagctgatuccctccccut

SEQ ID NO: 75501 - DNA, 19 bp, Artificial Sequence
  Synthetic
tctgcacagguggcaugag

SEQ ID NO: 75502 - DNA, 24 bp, Artificial Sequence
  Synthetic
accgtggaagauttaacgaauggg

SEQ ID NO: 75503 - DNA, 23 bp, Artificial Sequence
  Synthetic
tgccgccuacaactcttactcua

SEQ ID NO: 75504 - DNA, 18 bp, Artificial Sequence
  Synthetic
caccccuccuaccagcag

SEQ ID NO: 75505 - DNA, 18 bp, Artificial Sequence
  Synthetic
caccccuttccccugcat

SEQ ID NO: 75506 - DNA, 26 bp, Artificial Sequence
  Synthetic
ccuaacagataugccaaaagcagaga

SEQ ID NO: 75507 - DNA, 22 bp, Artificial Sequence
  Synthetic
cgtgcucagaggaugaacacag

SEQ ID NO: 75508 - DNA, 23 bp, Artificial Sequence
  Synthetic
ggcaacccagaaaaacugcaaug

SEQ ID NO: 75509 - DNA, 23 bp, Artificial Sequence
  Synthetic
tttaggatgucagctggcagaug

SEQ ID NO: 75510 - DNA, 21 bp, Artificial Sequence
  Synthetic
tggtguaggaatggcgugaag

SEQ ID NO: 75511 - DNA, 21 bp, Artificial Sequence
  Synthetic
ggagttggcugtgaacgagua

SEQ ID NO: 75512 - DNA, 18 bp, Artificial Sequence
  Synthetic
cccaggguctgccuacca

SEQ ID NO: 75513 - DNA, 21 bp, Artificial Sequence
  Synthetic
cattctgccccauccccauag

SEQ ID NO: 75514 - DNA, 23 bp, Artificial Sequence
  Synthetic
gctgctacauaccgcttcttcug

SEQ ID NO: 75515 - DNA, 29 bp, Artificial Sequence
  Synthetic
tcttcatcttgtuccttgttctattgcut

SEQ ID NO: 75516 - DNA, 19 bp, Artificial Sequence
  Synthetic
cacggccucccttcttgua

SEQ ID NO: 75517 - DNA, 22 bp, Artificial Sequence
  Synthetic
caagaguggaagccauacacac

SEQ ID NO: 75518 - DNA, 22 bp, Artificial Sequence
  Synthetic
cctcatcacugcttctgtguct

SEQ ID NO: 75519 - DNA, 18 bp, Artificial Sequence
  Synthetic
gggutctgugccagagga

SEQ ID NO: 75520 - DNA, 17 bp, Artificial Sequence
  Synthetic
cgccgggcuacgctuac

SEQ ID NO: 75521 - DNA, 21 bp, Artificial Sequence
  Synthetic
gcucccaguagcaagaaggga

SEQ ID NO: 75522 - DNA, 18 bp, Artificial Sequence
  Synthetic
gcccccucctgagugact

SEQ ID NO: 75523 - DNA, 19 bp, Artificial Sequence
  Synthetic
gcccacauggccaaguaca

SEQ ID NO: 75524 - DNA, 18 bp, Artificial Sequence
  Synthetic
gctggugaccacgcacut

SEQ ID NO: 75525 - DNA, 18 bp, Artificial Sequence
  Synthetic
cgaggcuctcacguccct

SEQ ID NO: 75526 - DNA, 22 bp, Artificial Sequence
  Synthetic
cttcgtctucactcaccacugt

SEQ ID NO: 75527 - DNA, 17 bp, Artificial Sequence
  Synthetic
gggaaccgucctcugcg

SEQ ID NO: 75528 - DNA, 17 bp, Artificial Sequence
  Synthetic
gccgccgcgugtacuac

SEQ ID NO: 75529 - DNA, 21 bp, Artificial Sequence
  Synthetic
gaaggctugcacgagaaagut

SEQ ID NO: 75530 - DNA, 19 bp, Artificial Sequence
  Synthetic
ccccagcgcaacutacucc

SEQ ID NO: 75531 - DNA, 20 bp, Artificial Sequence
  Synthetic
gcttcttugcgcatctguct

SEQ ID NO: 75532 - DNA, 20 bp, Artificial Sequence
  Synthetic
cctcccugcccaaagtgtua

SEQ ID NO: 75533 - DNA, 23 bp, Artificial Sequence
  Synthetic
ccctgcacagauttgacactuac

SEQ ID NO: 75534 - DNA, 18 bp, Artificial Sequence
  Synthetic
guaccccuggcggagaag

SEQ ID NO: 75535 - DNA, 17 bp, Artificial Sequence
  Synthetic
gcagaguccgccgcaut

SEQ ID NO: 75536 - DNA, 22 bp, Artificial Sequence
  Synthetic
tttcagggacuacagcugagga

SEQ ID NO: 75537 - DNA, 26 bp, Artificial Sequence
  Synthetic
aacgtggugaagatttgtgatttugg

SEQ ID NO: 75538 - DNA, 26 bp, Artificial Sequence
  Synthetic
ggutcttataaataucccgggcaagg

SEQ ID NO: 75539 - DNA, 28 bp, Artificial Sequence
  Synthetic
agttggttaggutaaggaaatgcatuga

SEQ ID NO: 75540 - DNA, 20 bp, Artificial Sequence
  Synthetic
cacggcugactgatauggca

SEQ ID NO: 75541 - DNA, 23 bp, Artificial Sequence
  Synthetic
tggtggtauacgggaagcuagag

SEQ ID NO: 75542 - DNA, 20 bp, Artificial Sequence
  Synthetic
ccauctuacggagccccaaa

SEQ ID NO: 75543 - DNA, 20 bp, Artificial Sequence
  Synthetic
gggctgtuccccgattucag

SEQ ID NO: 75544 - DNA, 23 bp, Artificial Sequence
  Synthetic
aatgaugggctgacugaaaacct

SEQ ID NO: 75545 - DNA, 17 bp, Artificial Sequence
  Synthetic
gtccgaacaccgugcug

SEQ ID NO: 75546 - DNA, 28 bp, Artificial Sequence
  Synthetic
gcaataatatgucaggacaacgcgauat

SEQ ID NO: 75547 - DNA, 20 bp, Artificial Sequence
  Synthetic
gcctcgccaucattcucgac

SEQ ID NO: 75548 - DNA, 20 bp, Artificial Sequence
  Synthetic
ctgagcagaucccgtcctug

SEQ ID NO: 75549 - DNA, 21 bp, Artificial Sequence
  Synthetic
cttcatgggagugcccttgut

SEQ ID NO: 75550 - DNA, 20 bp, Artificial Sequence
  Synthetic
tcgataccacuggccucaac

SEQ ID NO: 75551 - DNA, 22 bp, Artificial Sequence
  Synthetic
gggtagggucattactuacgct

SEQ ID NO: 75552 - DNA, 18 bp, Artificial Sequence
  Synthetic
caccuggtacguccgcaa

SEQ ID NO: 75553 - DNA, 23 bp, Artificial Sequence
  Synthetic
cccactgacutcctttccatcua

SEQ ID NO: 75554 - DNA, 21 bp, Artificial Sequence
  Synthetic
ctcactuagccacagcgaugt

SEQ ID NO: 75555 - DNA, 23 bp, Artificial Sequence
  Synthetic
tggagcaagutctgatugaccaa

SEQ ID NO: 75556 - DNA, 20 bp, Artificial Sequence
  Synthetic
cccaccaagcagguaagguc

SEQ ID NO: 75557 - DNA, 17 bp, Artificial Sequence
  Synthetic
agaugccggcgtgugaa

SEQ ID NO: 75558 - DNA, 19 bp, Artificial Sequence
  Synthetic
actgaggccuccagugagt

SEQ ID NO: 75559 - DNA, 17 bp, Artificial Sequence
  Synthetic
ggagccagggccucuca

SEQ ID NO: 75560 - DNA, 22 bp, Artificial Sequence
  Synthetic
cctgtggaaaagcugggaacut

SEQ ID NO: 75561 - DNA, 21 bp, Artificial Sequence
  Synthetic
ctgggaucccctccauacagt

SEQ ID NO: 75562 - DNA, 20 bp, Artificial Sequence
  Synthetic
ccagccuaaccagggaagut

SEQ ID NO: 75563 - DNA, 20 bp, Artificial Sequence
  Synthetic
gactggcugacaggagacug

SEQ ID NO: 75564 - DNA, 23 bp, Artificial Sequence
  Synthetic
ctttcaggtguacccattgcuca

SEQ ID NO: 75565 - DNA, 20 bp, Artificial Sequence
  Synthetic
gaagctggugctgcctttuc

SEQ ID NO: 75566 - DNA, 20 bp, Artificial Sequence
  Synthetic
ggccguggaagatctggaug

SEQ ID NO: 75567 - DNA, 22 bp, Artificial Sequence
  Synthetic
cggugggagaaaagaagguact

SEQ ID NO: 75568 - DNA, 22 bp, Artificial Sequence
  Synthetic
aactcatggaugctgatgggut

SEQ ID NO: 75569 - DNA, 18 bp, Artificial Sequence
  Synthetic
cggcacugacctgcttug

SEQ ID NO: 75570 - DNA, 17 bp, Artificial Sequence
  Synthetic
cagcuaccugggcagca

SEQ ID NO: 75571 - DNA, 17 bp, Artificial Sequence
  Synthetic
gccgcccutgagacugt

SEQ ID NO: 75572 - DNA, 17 bp, Artificial Sequence
  Synthetic
cagccgcgacagucuca

SEQ ID NO: 75573 - DNA, 19 bp, Artificial Sequence
  Synthetic
tcagggugacgtcgtcgua

SEQ ID NO: 75574 - DNA, 23 bp, Artificial Sequence
  Synthetic
ccctgtccccaauagtgcttaug

SEQ ID NO: 75575 - DNA, 24 bp, Artificial Sequence
  Synthetic
cacctcaactuccctgtcctttut

SEQ ID NO: 75576 - DNA, 18 bp, Artificial Sequence
  Synthetic
cgctcguacccgcucaac

SEQ ID NO: 75577 - DNA, 21 bp, Artificial Sequence
  Synthetic
gacggtaguttcgctctucca

SEQ ID NO: 75578 - DNA, 20 bp, Artificial Sequence
  Synthetic
gctgcaugaagaccggacuc

SEQ ID NO: 75579 - DNA, 21 bp, Artificial Sequence
  Synthetic
tgctgacuacggagacaccut

SEQ ID NO: 75580 - DNA, 23 bp, Artificial Sequence
  Synthetic
actctagacaucagatcgggcut

SEQ ID NO: 75581 - DNA, 26 bp, Artificial Sequence
  Synthetic
gacaagtctaauctggagctgaucac

SEQ ID NO: 75582 - DNA, 21 bp, Artificial Sequence
  Synthetic
gccacacaggugcatgtuaga

SEQ ID NO: 75583 - DNA, 24 bp, Artificial Sequence
  Synthetic
ccatttagggaaacugagcctcut

SEQ ID NO: 75584 - DNA, 17 bp, Artificial Sequence
  Synthetic
gccccggacgguacuca

SEQ ID NO: 75585 - DNA, 19 bp, Artificial Sequence
  Synthetic
gagtccaucatggcgugct

SEQ ID NO: 75586 - DNA, 19 bp, Artificial Sequence
  Synthetic
gacgguacucaccgagcag

SEQ ID NO: 75587 - DNA, 21 bp, Artificial Sequence
  Synthetic
cggaggcacuttggaagaaug

SEQ ID NO: 75588 - DNA, 18 bp, Artificial Sequence
  Synthetic
ggcaggutgggcatuggt

SEQ ID NO: 75589 - DNA, 18 bp, Artificial Sequence
  Synthetic
gccugaacccuggaccct

SEQ ID NO: 75590 - DNA, 28 bp, Artificial Sequence
  Synthetic
tcatgaaagagucaataggucagagagt

SEQ ID NO: 75591 - DNA, 24 bp, Artificial Sequence
  Synthetic
tctcggauggatacccatuaccat

SEQ ID NO: 75592 - DNA, 19 bp, Artificial Sequence
  Synthetic
gacagccugacctcaccut

SEQ ID NO: 75593 - DNA, 18 bp, Artificial Sequence
  Synthetic
ggtcgtgugtgcagtugg

SEQ ID NO: 75594 - DNA, 21 bp, Artificial Sequence
  Synthetic
ggagctctucaagctgcugaa

SEQ ID NO: 75595 - DNA, 19 bp, Artificial Sequence
  Synthetic
cccgccutatucgggaaca

SEQ ID NO: 75596 - DNA, 23 bp, Artificial Sequence
  Synthetic
tgaacactucttccagguccaag

SEQ ID NO: 75597 - DNA, 23 bp, Artificial Sequence
  Synthetic
ccagtgagcutatttcacacgut

SEQ ID NO: 75598 - DNA, 22 bp, Artificial Sequence
  Synthetic
ttctcagaacccucccctucat

SEQ ID NO: 75599 - DNA, 21 bp, Artificial Sequence
  Synthetic
caaaccagutguagacacgca

SEQ ID NO: 75600 - DNA, 21 bp, Artificial Sequence
  Synthetic
gcuatttcugcagggcggaat

SEQ ID NO: 75601 - DNA, 17 bp, Artificial Sequence
  Synthetic
ggcccgcugtacgtguc

SEQ ID NO: 75602 - DNA, 18 bp, Artificial Sequence
  Synthetic
gcacaagcuggccaugga

SEQ ID NO: 75603 - DNA, 23 bp, Artificial Sequence
  Synthetic
ccttgtccccacauaccactuac

SEQ ID NO: 75604 - DNA, 24 bp, Artificial Sequence
  Synthetic
ggctgtctcuggttataggatgug

SEQ ID NO: 75605 - DNA, 28 bp, Artificial Sequence
  Synthetic
ctgttgctagcuaaagtttccttttcut

SEQ ID NO: 75606 - DNA, 27 bp, Artificial Sequence
  Synthetic
aacccttatggutttcttatggtuggt

SEQ ID NO: 75607 - DNA, 21 bp, Artificial Sequence
  Synthetic
ttgcaggccaagguaaacuca

SEQ ID NO: 75608 - DNA, 24 bp, Artificial Sequence
  Synthetic
cgcttcaaucttattcaggauggt

SEQ ID NO: 75609 - DNA, 23 bp, Artificial Sequence
  Synthetic
aagtacgaguttgtggugaccag

SEQ ID NO: 75610 - DNA, 18 bp, Artificial Sequence
  Synthetic
cctcgguctgcagcuaca

SEQ ID NO: 75611 - DNA, 20 bp, Artificial Sequence
  Synthetic
ccacgggccutgtgttgtua

SEQ ID NO: 75612 - DNA, 20 bp, Artificial Sequence
  Synthetic
gacgugcacaacctcgacua

SEQ ID NO: 75613 - DNA, 20 bp, Artificial Sequence
  Synthetic
ctcggucaaacaaggccuca

SEQ ID NO: 75614 - DNA, 18 bp, Artificial Sequence
  Synthetic
cctucccacacccuccca

SEQ ID NO: 75615 - DNA, 17 bp, Artificial Sequence
  Synthetic
cgccuccaccccugaag

SEQ ID NO: 75616 - DNA, 24 bp, Artificial Sequence
  Synthetic
cagcugcgggataacttuaaacaa

SEQ ID NO: 75617 - DNA, 19 bp, Artificial Sequence
  Synthetic
gttctggucctcggucagg

SEQ ID NO: 75618 - DNA, 21 bp, Artificial Sequence
  Synthetic
caccctuccctctucaggaaa

SEQ ID NO: 75619 - DNA, 26 bp, Artificial Sequence
  Synthetic
gctgacaaagcutcatttagttccuc

SEQ ID NO: 75620 - DNA, 28 bp, Artificial Sequence
  Synthetic
tgtttctaaccagcugaagaaaacuaca

SEQ ID NO: 75621 - DNA, 22 bp, Artificial Sequence
  Synthetic
gaggtggugcacagaacaaauc

SEQ ID NO: 75622 - DNA, 17 bp, Artificial Sequence
  Synthetic
tccacugcagccauggg

SEQ ID NO: 75623 - DNA, 22 bp, Artificial Sequence
  Synthetic
tgatgtgaguggtgctctcuct

SEQ ID NO: 75624 - DNA, 18 bp, Artificial Sequence
  Synthetic
cutgccuggcagcacaaa

SEQ ID NO: 75625 - DNA, 23 bp, Artificial Sequence
  Synthetic
cacctgtugtgcaaattgucaga

SEQ ID NO: 75626 - DNA, 20 bp, Artificial Sequence
  Synthetic
cgccataagguggtggtugt

SEQ ID NO: 75627 - DNA, 20 bp, Artificial Sequence
  Synthetic
cctccttgacugagctggug

SEQ ID NO: 75628 - DNA, 20 bp, Artificial Sequence
  Synthetic
attcucccagaccugaccga

SEQ ID NO: 75629 - DNA, 24 bp, Artificial Sequence
  Synthetic
tctttaggcutgccttttgucact

SEQ ID NO: 75630 - DNA, 25 bp, Artificial Sequence
  Synthetic
gagcagccagagcutcaaatttaut

SEQ ID NO: 75631 - DNA, 29 bp, Artificial Sequence
  Synthetic
cgtatattggaacuttctgtttcactugc

SEQ ID NO: 75632 - DNA, 17 bp, Artificial Sequence
  Synthetic
ggccucaacgcccaugt

SEQ ID NO: 75633 - DNA, 19 bp, Artificial Sequence
  Synthetic
ggagcccaggccuttctug

SEQ ID NO: 75634 - DNA, 23 bp, Artificial Sequence
  Synthetic
gcttcttccugttcatcctggug

SEQ ID NO: 75635 - DNA, 24 bp, Artificial Sequence
  Synthetic
cagctcagaaccuggtatctacut

SEQ ID NO: 75636 - DNA, 26 bp, Artificial Sequence
  Synthetic
agcacccaaaaautatcttacccuga

SEQ ID NO: 75637 - DNA, 23 bp, Artificial Sequence
  Synthetic
cttgcggttucgagtctgaauac

SEQ ID NO: 75638 - DNA, 25 bp, Artificial Sequence
  Synthetic
aagttgaatgaucacctacgcagut

SEQ ID NO: 75639 - DNA, 28 bp, Artificial Sequence
  Synthetic
tcatgaattattugggacggacauaagg

SEQ ID NO: 75640 - DNA, 20 bp, Artificial Sequence
  Synthetic
cacugaccaugcggaaggat

SEQ ID NO: 75641 - DNA, 19 bp, Artificial Sequence
  Synthetic
tccccacaautcccgcuac

SEQ ID NO: 75642 - DNA, 20 bp, Artificial Sequence
  Synthetic
ctggtggcuttatggtggug

SEQ ID NO: 75643 - DNA, 21 bp, Artificial Sequence
  Synthetic
aaggcaugaggtggcuaacag

SEQ ID NO: 75644 - DNA, 21 bp, Artificial Sequence
  Synthetic
cagagtauggcatgggtcuga

SEQ ID NO: 75645 - DNA, 25 bp, Artificial Sequence
  Synthetic
accccagtuattaaagctttuggca

SEQ ID NO: 75646 - DNA, 17 bp, Artificial Sequence
  Synthetic
gccctguggtgctguca

SEQ ID NO: 75647 - DNA, 18 bp, Artificial Sequence
  Synthetic
tcctcuggaggccaugct

SEQ ID NO: 75648 - DNA, 17 bp, Artificial Sequence
  Synthetic
ggccgcucgctucaaga

SEQ ID NO: 75649 - DNA, 28 bp, Artificial Sequence
  Synthetic
gttttatgtauagcttttgcatcugcca

SEQ ID NO: 75650 - DNA, 21 bp, Artificial Sequence
  Synthetic
cagutcatttcuggcacagca

SEQ ID NO: 75651 - DNA, 28 bp, Artificial Sequence
  Synthetic
tgttctcctctugagcattcatttguaa

SEQ ID NO: 75652 - DNA, 20 bp, Artificial Sequence
  Synthetic
cctcggagcugagccaaaug

SEQ ID NO: 75653 - DNA, 24 bp, Artificial Sequence
  Synthetic
ccaagaacaccauacugaaagcct

SEQ ID NO: 75654 - DNA, 19 bp, Artificial Sequence
  Synthetic
tcctugaaacgcccaucgt

SEQ ID NO: 75655 - DNA, 17 bp, Artificial Sequence
  Synthetic
cggcaaucgccaggcua

SEQ ID NO: 75656 - DNA, 22 bp, Artificial Sequence
  Synthetic
tcaccgutctaaagucgggaga

SEQ ID NO: 75657 - DNA, 22 bp, Artificial Sequence
  Synthetic
gcactgaggugaagggatacug

SEQ ID NO: 75658 - DNA, 20 bp, Artificial Sequence
  Synthetic
ggcatcacagccuaccaguc

SEQ ID NO: 75659 - DNA, 19 bp, Artificial Sequence
  Synthetic
gcacccuggtgatgtcgut

SEQ ID NO: 75660 - DNA, 20 bp, Artificial Sequence
  Synthetic
ctgugtctcatcugcagcct

SEQ ID NO: 75661 - DNA, 28 bp, Artificial Sequence
  Synthetic
ggtagagtgagaugcctacaaaatucat

SEQ ID NO: 75662 - DNA, 23 bp, Artificial Sequence
  Synthetic
actactcccacugtctcuacacc

SEQ ID NO: 75663 - DNA, 20 bp, Artificial Sequence
  Synthetic
gcccgtuaggttggcttcuc

SEQ ID NO: 75664 - DNA, 18 bp, Artificial Sequence
  Synthetic
ggctccutgactgugcga

SEQ ID NO: 75665 - DNA, 18 bp, Artificial Sequence
  Synthetic
gtgcgccccaacucttug

SEQ ID NO: 75666 - DNA, 20 bp, Artificial Sequence
  Synthetic
acactgaguggcctcctgua

SEQ ID NO: 75667 - DNA, 22 bp, Artificial Sequence
  Synthetic
ccgaggcaucaagcattcguaa

SEQ ID NO: 75668 - DNA, 20 bp, Artificial Sequence
  Synthetic
gggaagaaugugcggaggat

SEQ ID NO: 75669 - DNA, 28 bp, Artificial Sequence
  Synthetic
ccacagataucacactttagtttuccgt

SEQ ID NO: 75670 - DNA, 23 bp, Artificial Sequence
  Synthetic
ctgcagttuacctgtttcuccca

SEQ ID NO: 75671 - DNA, 28 bp, Artificial Sequence
  Synthetic
gaaaagugccaatgtuaagaaagcagat

SEQ ID NO: 75672 - DNA, 28 bp, Artificial Sequence
  Synthetic
tctgttacttacguggacatttctugac

SEQ ID NO: 75673 - DNA, 23 bp, Artificial Sequence
  Synthetic
tgacagtggagcaugtgttacuc

SEQ ID NO: 75674 - DNA, 28 bp, Artificial Sequence
  Synthetic
aatcagcaaacaaaucaaagctcaugat

SEQ ID NO: 75675 - DNA, 28 bp, Artificial Sequence
  Synthetic
ccatccttaccuctatttctcttucagg

SEQ ID NO: 75676 - DNA, 28 bp, Artificial Sequence
  Synthetic
tgaactagaatgautagcataggccuca

SEQ ID NO: 75677 - DNA, 22 bp, Artificial Sequence
  Synthetic
ctggccuggagcttgaatttut

SEQ ID NO: 75678 - DNA, 22 bp, Artificial Sequence
  Synthetic
agatggacacccugaggucaat

SEQ ID NO: 75679 - DNA, 21 bp, Artificial Sequence
  Synthetic
aggatacagccugtgcacauc

SEQ ID NO: 75680 - DNA, 21 bp, Artificial Sequence
  Synthetic
attcttctuggtggtgcugct

SEQ ID NO: 75681 - DNA, 25 bp, Artificial Sequence
  Synthetic
gggatgggauagcattgaatcucat

SEQ ID NO: 75682 - DNA, 21 bp, Artificial Sequence
  Synthetic
aggacutgtggtuggacgaaa

SEQ ID NO: 75683 - DNA, 28 bp, Artificial Sequence
  Synthetic
ttcgaaagtugctcaacttctaugagaa

SEQ ID NO: 75684 - DNA, 28 bp, Artificial Sequence
  Synthetic
gaugttattaacuggaggagggaaagac

SEQ ID NO: 75685 - DNA, 28 bp, Artificial Sequence
  Synthetic
gtgggacaaaauacctgagtttagagua

SEQ ID NO: 75686 - DNA, 27 bp, Artificial Sequence
  Synthetic
gcaactcttaggutgtgtactaacugt

SEQ ID NO: 75687 - DNA, 25 bp, Artificial Sequence
  Synthetic
ctggtctagagagugaagcaaacuc

SEQ ID NO: 75688 - DNA, 21 bp, Artificial Sequence
  Synthetic
gcccacccagaaaguactuct

SEQ ID NO: 75689 - DNA, 23 bp, Artificial Sequence
  Synthetic
gacgtgctccutttgatctgtut

SEQ ID NO: 75690 - DNA, 20 bp, Artificial Sequence
  Synthetic
catcucaccacccacacgua

SEQ ID NO: 75691 - DNA, 20 bp, Artificial Sequence
  Synthetic
atctgtgtgcuggtgctcuc

SEQ ID NO: 75692 - DNA, 26 bp, Artificial Sequence
  Synthetic
acctcagggugaatacacaagtttut

SEQ ID NO: 75693 - DNA, 20 bp, Artificial Sequence
  Synthetic
gugcctccaaugagcacaag

SEQ ID NO: 75694 - DNA, 22 bp, Artificial Sequence
  Synthetic
gcaatgagcucacagaagucag

SEQ ID NO: 75695 - DNA, 28 bp, Artificial Sequence
  Synthetic
aatgaacaatttcucctttcctctccut

SEQ ID NO: 75696 - DNA, 25 bp, Artificial Sequence
  Synthetic
gttggattguagacaaaggttuggg

SEQ ID NO: 75697 - DNA, 21 bp, Artificial Sequence
  Synthetic
cctgtttuggcagcgttucat

SEQ ID NO: 75698 - DNA, 22 bp, Artificial Sequence
  Synthetic
cagugagugaagcaagggaaga

SEQ ID NO: 75699 - DNA, 25 bp, Artificial Sequence
  Synthetic
ggacattctcaugaacttcctggug

SEQ ID NO: 75700 - DNA, 18 bp, Artificial Sequence
  Synthetic
cauccccagggcacugat

SEQ ID NO: 75701 - DNA, 17 bp, Artificial Sequence
  Synthetic
gggcgucacctggtgua

SEQ ID NO: 75702 - DNA, 27 bp, Artificial Sequence
  Synthetic
tgutttcaaacagaucaaaaggagcac

SEQ ID NO: 75703 - DNA, 25 bp, Artificial Sequence
  Synthetic
atctttcuccaccaccccaaatauc

SEQ ID NO: 75704 - DNA, 19 bp, Artificial Sequence
  Synthetic
ccattctgucgctggcuca

SEQ ID NO: 75705 - DNA, 26 bp, Artificial Sequence
  Synthetic
gttccctcctugccaaaataaatgut

SEQ ID NO: 75706 - DNA, 22 bp, Artificial Sequence
  Synthetic
gttggaggcautcgacttccua

SEQ ID NO: 75707 - DNA, 22 bp, Artificial Sequence
  Synthetic
gaaaaacugagccaggcctuac

SEQ ID NO: 75708 - DNA, 28 bp, Artificial Sequence
  Synthetic
gcagaaatattuaactctccccauggaa

SEQ ID NO: 75709 - DNA, 28 bp, Artificial Sequence
  Synthetic
caaatgtccugaaattctgtcagaugaa

SEQ ID NO: 75710 - DNA, 27 bp, Artificial Sequence
  Synthetic
cttcatcatcugaagactcttcctugt

SEQ ID NO: 75711 - DNA, 23 bp, Artificial Sequence
  Synthetic
gcagccatugccgaaatcuaaaa

SEQ ID NO: 75712 - DNA, 22 bp, Artificial Sequence
  Synthetic
ttccttgccautccagaacugt

SEQ ID NO: 75713 - DNA, 32 bp, Artificial Sequence
  Synthetic
aagaaattgagutgataagtttucaagaagag

SEQ ID NO: 75714 - DNA, 22 bp, Artificial Sequence
  Synthetic
ccauggaatctgucagcaacct

SEQ ID NO: 75715 - DNA, 18 bp, Artificial Sequence
  Synthetic
gtgcgctuccgaacgaug

SEQ ID NO: 75716 - DNA, 24 bp, Artificial Sequence
  Synthetic
tgatcgtugggcaaacacaaatuc

SEQ ID NO: 75717 - DNA, 20 bp, Artificial Sequence
  Synthetic
agtacgctugggagtccuca

SEQ ID NO: 75718 - DNA, 22 bp, Artificial Sequence
  Synthetic
gaggcaautttgucacagcaga

SEQ ID NO: 75719 - DNA, 22 bp, Artificial Sequence
  Synthetic
tgataauggccccctgugaaac

SEQ ID NO: 75720 - DNA, 26 bp, Artificial Sequence
  Synthetic
catttacaaugcaagggtagctgaut

SEQ ID NO: 75721 - DNA, 24 bp, Artificial Sequence
  Synthetic
ccctcctucagtttagtugaggat

SEQ ID NO: 75722 - DNA, 19 bp, Artificial Sequence
  Synthetic
gatcggccucttcaugcga

SEQ ID NO: 75723 - DNA, 20 bp, Artificial Sequence
  Synthetic
aactgctaauggcccgtuct

SEQ ID NO: 75724 - DNA, 23 bp, Artificial Sequence
  Synthetic
acttcaggagcuacagagaugct

SEQ ID NO: 75725 - DNA, 24 bp, Artificial Sequence
  Synthetic
gaaacuaaagacaggctcgacuca

SEQ ID NO: 75726 - DNA, 24 bp, Artificial Sequence
  Synthetic
cttaccttcuggctctaatguggt

SEQ ID NO: 75727 - DNA, 26 bp, Artificial Sequence
  Synthetic
gggattaacguccacatggagataug

SEQ ID NO: 75728 - DNA, 20 bp, Artificial Sequence
  Synthetic
gtgcctaccugtgtctgucc

SEQ ID NO: 75729 - DNA, 21 bp, Artificial Sequence
  Synthetic
tttgcaggcuggtgcagauat

SEQ ID NO: 75730 - DNA, 26 bp, Artificial Sequence
  Synthetic
cggatccgcccautctgtttauaaaa

SEQ ID NO: 75731 - DNA, 26 bp, Artificial Sequence
  Synthetic
aaaagcugagtaccugaagaacaaca

SEQ ID NO: 75732 - DNA, 22 bp, Artificial Sequence
  Synthetic
cctcccatcuccctgcaauaac

SEQ ID NO: 75733 - DNA, 22 bp, Artificial Sequence
  Synthetic
ctgactgucacctgcaactuca

SEQ ID NO: 75734 - DNA, 18 bp, Artificial Sequence
  Synthetic
gaggagcuggcaguggaa

SEQ ID NO: 75735 - DNA, 17 bp, Artificial Sequence
  Synthetic
tggcuaccacgccugag

SEQ ID NO: 75736 - DNA, 27 bp, Artificial Sequence
  Synthetic
acactguaaaactgaatggugagaagt

SEQ ID NO: 75737 - DNA, 24 bp, Artificial Sequence
  Synthetic
gcatcaggcuctttctctgtctuc

SEQ ID NO: 75738 - DNA, 23 bp, Artificial Sequence
  Synthetic
tccaggcuggaatactaguagca

SEQ ID NO: 75739 - DNA, 28 bp, Artificial Sequence
  Synthetic
ggagttgttuccatggtcatttugaaaa

SEQ ID NO: 75740 - DNA, 20 bp, Artificial Sequence
  Synthetic
catcauaagggagccgcuca

SEQ ID NO: 75741 - DNA, 28 bp, Artificial Sequence
  Synthetic
acagtggatgutaacggaatatcuagga

SEQ ID NO: 75742 - DNA, 22 bp, Artificial Sequence
  Synthetic
gccaagcagaggaacugagaut

SEQ ID NO: 75743 - DNA, 25 bp, Artificial Sequence
  Synthetic
aggagctugatttgcatgaugaaga

SEQ ID NO: 75744 - DNA, 24 bp, Artificial Sequence
  Synthetic
aagctgagucaatcagaagugcat

SEQ ID NO: 75745 - DNA, 23 bp, Artificial Sequence
  Synthetic
tcgcatttugggactaactgcut

SEQ ID NO: 75746 - DNA, 20 bp, Artificial Sequence
  Synthetic
gcattcttguccccagcauc

SEQ ID NO: 75747 - DNA, 21 bp, Artificial Sequence
  Synthetic
agccaaggucatugcaggaat

SEQ ID NO: 75748 - DNA, 20 bp, Artificial Sequence
  Synthetic
ccctcaccacugtccctuct

SEQ ID NO: 75749 - DNA, 18 bp, Artificial Sequence
  Synthetic
cccuccacccagctcuga

SEQ ID NO: 75750 - DNA, 21 bp, Artificial Sequence
  Synthetic
ctccagctugggtttctguca

SEQ ID NO: 75751 - DNA, 28 bp, Artificial Sequence
  Synthetic
accaaactgccuttttagtcactaugaa

SEQ ID NO: 75752 - DNA, 28 bp, Artificial Sequence
  Synthetic
gtgcaaggtutacacattttaaucccat

SEQ ID NO: 75753 - DNA, 26 bp, Artificial Sequence
  Synthetic
tgttttgagctugtttgctgaatgut

SEQ ID NO: 75754 - DNA, 23 bp, Artificial Sequence
  Synthetic
cctggttttcutccacagcatuc

SEQ ID NO: 75755 - DNA, 22 bp, Artificial Sequence
  Synthetic
aaacatgguccccttgagtguc

SEQ ID NO: 75756 - DNA, 22 bp, Artificial Sequence
  Synthetic
gggatgagucaaccaugcaaag

SEQ ID NO: 75757 - DNA, 28 bp, Artificial Sequence
  Synthetic
cttttggacagtugatgatgaagagtut

SEQ ID NO: 75758 - DNA, 21 bp, Artificial Sequence
  Synthetic
ccaagctugccctcaggauaa

SEQ ID NO: 75759 - DNA, 28 bp, Artificial Sequence
  Synthetic
ggattttattuggaggatcttccauggg

SEQ ID NO: 75760 - DNA, 29 bp, Artificial Sequence
  Synthetic
aattcctctggaucacatttcccattuaa

SEQ ID NO: 75761 - DNA, 28 bp, Artificial Sequence
  Synthetic
tgttttaatatggcgaugtctctctugt

SEQ ID NO: 75762 - DNA, 22 bp, Artificial Sequence
  Synthetic
tgactgguttcccaugaaagca

SEQ ID NO: 75763 - DNA, 26 bp, Artificial Sequence
  Synthetic
cctcttccacauttgacttcagauga

SEQ ID NO: 75764 - DNA, 27 bp, Artificial Sequence
  Synthetic
cgtgaagucatctccatgugaaaaact

SEQ ID NO: 75765 - DNA, 23 bp, Artificial Sequence
  Synthetic
gattttcactcuccagctccuct

SEQ ID NO: 75766 - DNA, 21 bp, Artificial Sequence
  Synthetic
ctggcagggcutgtgttctua

SEQ ID NO: 75767 - DNA, 22 bp, Artificial Sequence
  Synthetic
ccagggucttttugagcagagg

SEQ ID NO: 75768 - DNA, 28 bp, Artificial Sequence
  Synthetic
tggagagtttugtaaggctttaucaaca

SEQ ID NO: 75769 - DNA, 31 bp, Artificial Sequence
  Synthetic
agaaaggtaattctcuttctctctctctcut

SEQ ID NO: 75770 - DNA, 22 bp, Artificial Sequence
  Synthetic
tcttccuggaacactggtcuct

SEQ ID NO: 75771 - DNA, 29 bp, Artificial Sequence
  Synthetic
gcaaaatctggautgtgttaattctcuct

SEQ ID NO: 75772 - DNA, 22 bp, Artificial Sequence
  Synthetic
gccttctcuggcattgacagua

SEQ ID NO: 75773 - DNA, 22 bp, Artificial Sequence
  Synthetic
cacaatgcauccaatgguccac

SEQ ID NO: 75774 - DNA, 25 bp, Artificial Sequence
  Synthetic
ggttattgaucaagtcagcctuggt

SEQ ID NO: 75775 - DNA, 26 bp, Artificial Sequence
  Synthetic
ttgttaacaggcautggacaaaaucc

SEQ ID NO: 75776 - DNA, 21 bp, Artificial Sequence
  Synthetic
aggactucctcccaucaccaa

SEQ ID NO: 75777 - DNA, 24 bp, Artificial Sequence
  Synthetic
gtagaaggcagggucttcgtaauc

SEQ ID NO: 75778 - DNA, 21 bp, Artificial Sequence
  Synthetic
acgagacucacccaacatgug

SEQ ID NO: 75779 - DNA, 23 bp, Artificial Sequence
  Synthetic
tcactagcaggauccaaggctua

SEQ ID NO: 75780 - DNA, 20 bp, Artificial Sequence
  Synthetic
tgaatauggcggccacgtut

SEQ ID NO: 75781 - DNA, 21 bp, Artificial Sequence
  Synthetic
cctttgcugctgctcctaucc

SEQ ID NO: 75782 - DNA, 21 bp, Artificial Sequence
  Synthetic
cctgcugggaagtagcucaga

SEQ ID NO: 75783 - DNA, 26 bp, Artificial Sequence
  Synthetic
acacactttuacatcttcgtcaucgt

SEQ ID NO: 75784 - DNA, 21 bp, Artificial Sequence
  Synthetic
aaagaccugttggguggacaa

SEQ ID NO: 75785 - DNA, 23 bp, Artificial Sequence
  Synthetic
ctatacacuaccgcttccauggg

SEQ ID NO: 75786 - DNA, 24 bp, Artificial Sequence
  Synthetic
tgggatctgucaagctttcauacc

SEQ ID NO: 75787 - DNA, 28 bp, Artificial Sequence
  Synthetic
gtaagtcactuattaacccagaaucgga

SEQ ID NO: 75788 - DNA, 29 bp, Artificial Sequence
  Synthetic
gtctcattgctgugtaagtaattgttucc

SEQ ID NO: 75789 - DNA, 25 bp, Artificial Sequence
  Synthetic
ggtgagttgcaaugtccgtaattut

SEQ ID NO: 75790 - DNA, 24 bp, Artificial Sequence
  Synthetic
tgctuacagctataaaugcaggct

SEQ ID NO: 75791 - DNA, 24 bp, Artificial Sequence
  Synthetic
ttccttctgcuacagctctgatug

SEQ ID NO: 75792 - DNA, 24 bp, Artificial Sequence
  Synthetic
tctaggttccugatcagtauggca

SEQ ID NO: 75793 - DNA, 28 bp, Artificial Sequence
  Synthetic
tcagttaacggtuaatatcacacagcut

SEQ ID NO: 75794 - DNA, 21 bp, Artificial Sequence
  Synthetic
ggtgcctugcagattagguga

SEQ ID NO: 75795 - DNA, 28 bp, Artificial Sequence
  Synthetic
ctcagtttcccaguatgatcttcatgut

SEQ ID NO: 75796 - DNA, 22 bp, Artificial Sequence
  Synthetic
cacatactcaucctcggcctug

SEQ ID NO: 75797 - DNA, 22 bp, Artificial Sequence
  Synthetic
accugaatccaguggaggagaa

SEQ ID NO: 75798 - DNA, 28 bp, Artificial Sequence
  Synthetic
cctaatcctcaugacaccaaagugaaaa

SEQ ID NO: 75799 - DNA, 22 bp, Artificial Sequence
  Synthetic
aucaggttucccccacagaaag

SEQ ID NO: 75800 - DNA, 24 bp, Artificial Sequence
  Synthetic
ctctgcatguctagtgatgtcugg

SEQ ID NO: 75801 - DNA, 28 bp, Artificial Sequence
  Synthetic
cccctgagtaugaaacttttgcagaaua

SEQ ID NO: 75802 - DNA, 19 bp, Artificial Sequence
  Synthetic
ccgtgguggatgacucgaa

SEQ ID NO: 75803 - DNA, 31 bp, Artificial Sequence
  Synthetic
ccaagtttctcutccataagtttuaaaccaa

SEQ ID NO: 75804 - DNA, 24 bp, Artificial Sequence
  Synthetic
ccctgacguacattcaaaggcaut

SEQ ID NO: 75805 - DNA, 20 bp, Artificial Sequence
  Synthetic
gutgctgtttuccccaccag

SEQ ID NO: 75806 - DNA, 23 bp, Artificial Sequence
  Synthetic
ctaagtugcccagagtgggatut

SEQ ID NO: 75807 - DNA, 26 bp, Artificial Sequence
  Synthetic
ccttgtcttacauaccctgtgtctuc

SEQ ID NO: 75808 - DNA, 25 bp, Artificial Sequence
  Synthetic
acagtataatatcucctggcgcuca

SEQ ID NO: 75809 - DNA, 20 bp, Artificial Sequence
  Synthetic
gctgcacugatccccacaut

SEQ ID NO: 75810 - DNA, 27 bp, Artificial Sequence
  Synthetic
catgcatccutcatgggaattuaaagg

SEQ ID NO: 75811 - DNA, 22 bp, Artificial Sequence
  Synthetic
ttgctgagaaagucactgcuga

SEQ ID NO: 75812 - DNA, 28 bp, Artificial Sequence
  Synthetic
tggttaggtcaaggutgtactttgttut

SEQ ID NO: 75813 - DNA, 26 bp, Artificial Sequence
  Synthetic
agatatcgcaautttgatcagccuca

SEQ ID NO: 75814 - DNA, 24 bp, Artificial Sequence
  Synthetic
cacaugccacaaaaggaacttuct

SEQ ID NO: 75815 - DNA, 21 bp, Artificial Sequence
  Synthetic
gaaggttgcuttgggcaagug

SEQ ID NO: 75816 - DNA, 26 bp, Artificial Sequence
  Synthetic
tctttcagccautaagagagctctug

SEQ ID NO: 75817 - DNA, 28 bp, Artificial Sequence
  Synthetic
cggtattcctttuccatctctcacttua

SEQ ID NO: 75818 - DNA, 24 bp, Artificial Sequence
  Synthetic
actaattgcuggtctcaacugcat

SEQ ID NO: 75819 - DNA, 29 bp, Artificial Sequence
  Synthetic
ctcttctaggtacuctgtctgatcttcut

SEQ ID NO: 75820 - DNA, 27 bp, Artificial Sequence
  Synthetic
gaaaggcagaaaacugatacaatugct

SEQ ID NO: 75821 - DNA, 29 bp, Artificial Sequence
  Synthetic
tgcaggtaucacacaaattacagaagaut

SEQ ID NO: 75822 - DNA, 24 bp, Artificial Sequence
  Synthetic
tgtctttgtcaautcccactgcut

SEQ ID NO: 75823 - DNA, 25 bp, Artificial Sequence
  Synthetic
gttctggaauttccctcacuacacc

SEQ ID NO: 75824 - DNA, 20 bp, Artificial Sequence
  Synthetic
catccaguggcgggacauag

SEQ ID NO: 75825 - DNA, 21 bp, Artificial Sequence
  Synthetic
ctgtagagcugtcccccauag

SEQ ID NO: 75826 - DNA, 26 bp, Artificial Sequence
  Synthetic
gggtaccaaagugatcctccatctua

SEQ ID NO: 75827 - DNA, 26 bp, Artificial Sequence
  Synthetic
acatccugcacgttaagtguaaaaga

SEQ ID NO: 75828 - DNA, 22 bp, Artificial Sequence
  Synthetic
ccgagaacagugaugaaggact

SEQ ID NO: 75829 - DNA, 22 bp, Artificial Sequence
  Synthetic
ccccacgugaacaagtgacaut

SEQ ID NO: 75830 - DNA, 24 bp, Artificial Sequence
  Synthetic
cctgaccaacutttcccagttuct

SEQ ID NO: 75831 - DNA, 28 bp, Artificial Sequence
  Synthetic
actttcttcttcugccaaaattgttgut

SEQ ID NO: 75832 - DNA, 23 bp, Artificial Sequence
  Synthetic
cctcaaaacucaaagcuccacca

SEQ ID NO: 75833 - DNA, 20 bp, Artificial Sequence
  Synthetic
gatgacccaccugcatguga

SEQ ID NO: 75834 - DNA, 21 bp, Artificial Sequence
  Synthetic
cggcttugggttctguagact

SEQ ID NO: 75835 - DNA, 28 bp, Artificial Sequence
  Synthetic
agagccaugcatctttatucagagaaat

SEQ ID NO: 75836 - DNA, 21 bp, Artificial Sequence
  Synthetic
ctcgtagcaucgtcctcaugt

SEQ ID NO: 75837 - DNA, 21 bp, Artificial Sequence
  Synthetic
tggcattugaagggcttcucc

SEQ ID NO: 75838 - DNA, 26 bp, Artificial Sequence
  Synthetic
gtagcttccutatagcacaacugcat

SEQ ID NO: 75839 - DNA, 22 bp, Artificial Sequence
  Synthetic
ctggtucacacgaatgttugct

SEQ ID NO: 75840 - DNA, 23 bp, Artificial Sequence
  Synthetic
acgtcttccutctctctctguca

SEQ ID NO: 75841 - DNA, 21 bp, Artificial Sequence
  Synthetic
ctgaggtucagagccauggac

SEQ ID NO: 75842 - DNA, 25 bp, Artificial Sequence
  Synthetic
aaggaaagaagaaccutggcatcut

SEQ ID NO: 75843 - DNA, 24 bp, Artificial Sequence
  Synthetic
ggatgagagcucctgagtactcua

SEQ ID NO: 75844 - DNA, 20 bp, Artificial Sequence
  Synthetic
cggcacaucaagctgcatuc

SEQ ID NO: 75845 - DNA, 19 bp, Artificial Sequence
  Synthetic
cgggcagaguggaggaauc

SEQ ID NO: 75846 - DNA, 22 bp, Artificial Sequence
  Synthetic
aaggaacaggguctaccuccat

SEQ ID NO: 75847 - DNA, 23 bp, Artificial Sequence
  Synthetic
cgagtgttgcugtcatcaactut

SEQ ID NO: 75848 - DNA, 22 bp, Artificial Sequence
  Synthetic
gcagctgucaattctcatgucc

SEQ ID NO: 75849 - DNA, 24 bp, Artificial Sequence
  Synthetic
tgtgagttugcctgttttctcuct

SEQ ID NO: 75850 - DNA, 18 bp, Artificial Sequence
  Synthetic
cgcgttgcgucggaagua

SEQ ID NO: 75851 - DNA, 27 bp, Artificial Sequence
  Synthetic
acgactctgcugatttggtcataaaut

SEQ ID NO: 75852 - DNA, 22 bp, Artificial Sequence
  Synthetic
ccaagggcucacattucaggag

SEQ ID NO: 75853 - DNA, 27 bp, Artificial Sequence
  Synthetic
ttggtcttttguacccttaagccauaa

SEQ ID NO: 75854 - DNA, 18 bp, Artificial Sequence
  Synthetic
ggtgccugcctcatggut

SEQ ID NO: 75855 - DNA, 17 bp, Artificial Sequence
  Synthetic
accagcccugtgccauc

SEQ ID NO: 75856 - DNA, 18 bp, Artificial Sequence
  Synthetic
gcccacugtctgggucaa

SEQ ID NO: 75857 - DNA, 21 bp, Artificial Sequence
  Synthetic
gcacactgaaguggcacagua

SEQ ID NO: 75858 - DNA, 18 bp, Artificial Sequence
  Synthetic
gcugaatgccucccacga

SEQ ID NO: 75859 - DNA, 21 bp, Artificial Sequence
  Synthetic
gcactcggcucctttctguag

SEQ ID NO: 75860 - DNA, 28 bp, Artificial Sequence
  Synthetic
acttcttgtcaaaaagugaatgcttgut

SEQ ID NO: 75861 - DNA, 26 bp, Artificial Sequence
  Synthetic
tgtgcatcccaacgaucatgttaaua

SEQ ID NO: 75862 - DNA, 22 bp, Artificial Sequence
  Synthetic
gctcacatacugacctggctut

SEQ ID NO: 75863 - DNA, 20 bp, Artificial Sequence
  Synthetic
cctcucgtggtauggcagac

SEQ ID NO: 75864 - DNA, 22 bp, Artificial Sequence
  Synthetic
cctggtcacagauccaatgcut

SEQ ID NO: 75865 - DNA, 28 bp, Artificial Sequence
  Synthetic
ttcttatatcaugaccattctgcaccuc

SEQ ID NO: 75866 - DNA, 20 bp, Artificial Sequence
  Synthetic
gagaagacgcgacuguggaa

SEQ ID NO: 75867 - DNA, 18 bp, Artificial Sequence
  Synthetic
gtgcaccugggtgagucc

SEQ ID NO: 75868 - DNA, 27 bp, Artificial Sequence
  Synthetic
gcatgttcuttttctaaatugcccaca

SEQ ID NO: 75869 - DNA, 25 bp, Artificial Sequence
  Synthetic
ggacatctccutcctgttgttucag

SEQ ID NO: 75870 - DNA, 28 bp, Artificial Sequence
  Synthetic
gagaaggaaaacuatggtaggaaacugg

SEQ ID NO: 75871 - DNA, 22 bp, Artificial Sequence
  Synthetic
agagutatgcuggcacaagcaa

SEQ ID NO: 75872 - DNA, 29 bp, Artificial Sequence
  Synthetic
cattcatatttguctgagttcctgaucca

SEQ ID NO: 75873 - DNA, 26 bp, Artificial Sequence
  Synthetic
tcaaactctguggcataatcagcaut

SEQ ID NO: 75874 - DNA, 19 bp, Artificial Sequence
  Synthetic
cccacauccacctcuggga

SEQ ID NO: 75875 - DNA, 19 bp, Artificial Sequence
  Synthetic
cgtctucagtgcccuggaa

SEQ ID NO: 75876 - DNA, 26 bp, Artificial Sequence
  Synthetic
agagactgtcugtttttcaggtctuc

SEQ ID NO: 75877 - DNA, 22 bp, Artificial Sequence
  Synthetic
aagagaacuccaggtgcttguc

SEQ ID NO: 75878 - DNA, 27 bp, Artificial Sequence
  Synthetic
ggtactcatcucaaagtagttgcccua

SEQ ID NO: 75879 - DNA, 23 bp, Artificial Sequence
  Synthetic
gggctcaccugggaatuagaaaa

SEQ ID NO: 75880 - DNA, 19 bp, Artificial Sequence
  Synthetic
gggcgaguttgcacacuca

SEQ ID NO: 75881 - DNA, 21 bp, Artificial Sequence
  Synthetic
ccctccucacctttcagcauc

SEQ ID NO: 75882 - DNA, 24 bp, Artificial Sequence
  Synthetic
cctattacctccucgagtgcttug

SEQ ID NO: 75883 - DNA, 26 bp, Artificial Sequence
  Synthetic
ctcacttgggaugttttcatctccua

SEQ ID NO: 75884 - DNA, 23 bp, Artificial Sequence
  Synthetic
ccaacuaagggcctgatccuact

SEQ ID NO: 75885 - DNA, 23 bp, Artificial Sequence
  Synthetic
gtaggagaggucaggttucacac

SEQ ID NO: 75886 - DNA, 19 bp, Artificial Sequence
  Synthetic
ctgtcaccguagccgugaa

SEQ ID NO: 75887 - DNA, 21 bp, Artificial Sequence
  Synthetic
ccttgtcaguggcatcgtcug

SEQ ID NO: 75888 - DNA, 19 bp, Artificial Sequence
  Synthetic
tgtcaccguagccgugaag

SEQ ID NO: 75889 - DNA, 20 bp, Artificial Sequence
  Synthetic
atcucagacaccagguccga

SEQ ID NO: 75890 - DNA, 23 bp, Artificial Sequence
  Synthetic
ccactauaaggaccctccctuct

SEQ ID NO: 75891 - DNA, 22 bp, Artificial Sequence
  Synthetic
tgcagaaaagaccgutggacuc

SEQ ID NO: 75892 - DNA, 18 bp, Artificial Sequence
  Synthetic
gccgucccgggagactua

SEQ ID NO: 75893 - DNA, 20 bp, Artificial Sequence
  Synthetic
cactgacccuctccctugac

SEQ ID NO: 75894 - DNA, 18 bp, Artificial Sequence
  Synthetic
ccaagccagccucaccuc

SEQ ID NO: 75895 - DNA, 22 bp, Artificial Sequence
  Synthetic
gcaguacaaggccacagactut

SEQ ID NO: 75896 - DNA, 21 bp, Artificial Sequence
  Synthetic
gatctgauggatggucgggat

SEQ ID NO: 75897 - DNA, 21 bp, Artificial Sequence
  Synthetic
tctccacauggtgcttgcaut

SEQ ID NO: 75898 - DNA, 23 bp, Artificial Sequence
  Synthetic
gttgtacactucccactcctuga

SEQ ID NO: 75899 - DNA, 22 bp, Artificial Sequence
  Synthetic
gcctagccaucctcttgtcuct

SEQ ID NO: 75900 - DNA, 21 bp, Artificial Sequence
  Synthetic
caggcccautgagagagaugt

SEQ ID NO: 75901 - DNA, 18 bp, Artificial Sequence
  Synthetic
cctcccuccctcctcugg

SEQ ID NO: 75902 - DNA, 18 bp, Artificial Sequence
  Synthetic
cctgaccugcacagccut

SEQ ID NO: 75903 - DNA, 20 bp, Artificial Sequence
  Synthetic
cccaccutgatguggaagga

SEQ ID NO: 75904 - DNA, 21 bp, Artificial Sequence
  Synthetic
ggaggcccaaugtttctcugt

SEQ ID NO: 75905 - DNA, 21 bp, Artificial Sequence
  Synthetic
cccccuagagcactgatguct

SEQ ID NO: 75906 - DNA, 22 bp, Artificial Sequence
  Synthetic
cgctttgtcuacacctgcaaug

SEQ ID NO: 75907 - DNA, 25 bp, Artificial Sequence
  Synthetic
ctctataaaauacgtggctgcaugg

SEQ ID NO: 75908 - DNA, 22 bp, Artificial Sequence
  Synthetic
tagatgcatuctgctccucgaa

SEQ ID NO: 75909 - DNA, 28 bp, Artificial Sequence
  Synthetic
tccaagtccttuaggaaaatgtcauagg

SEQ ID NO: 75910 - DNA, 20 bp, Artificial Sequence
  Synthetic
ccaagagccaaguggtcuca

SEQ ID NO: 75911 - DNA, 26 bp, Artificial Sequence
  Synthetic
tcctatgtgtucaccttgtgtuacag

SEQ ID NO: 75912 - DNA, 23 bp, Artificial Sequence
  Synthetic
ttgcaugagaaagggtgtucaga

SEQ ID NO: 75913 - DNA, 24 bp, Artificial Sequence
  Synthetic
ggctggtctucctcctcttttaut

SEQ ID NO: 75914 - DNA, 23 bp, Artificial Sequence
  Synthetic
tcattcaatgcuggtggaaguca

SEQ ID NO: 75915 - DNA, 21 bp, Artificial Sequence
  Synthetic
ggtgtgtuggagctcauggac

SEQ ID NO: 75916 - DNA, 28 bp, Artificial Sequence
  Synthetic
aagagagaagcacugagttaaaaacuga

SEQ ID NO: 75917 - DNA, 22 bp, Artificial Sequence
  Synthetic
ccagaacgaauggctucagaga

SEQ ID NO: 75918 - DNA, 19 bp, Artificial Sequence
  Synthetic
ggtguccctggaguccaac

SEQ ID NO: 75919 - DNA, 17 bp, Artificial Sequence
  Synthetic
gcccucagcaccacuga

SEQ ID NO: 75920 - DNA, 24 bp, Artificial Sequence
  Synthetic
gccaattgttcuttgttccctgut

SEQ ID NO: 75921 - DNA, 23 bp, Artificial Sequence
  Synthetic
aagcctttgagutggtactguga

SEQ ID NO: 75922 - DNA, 22 bp, Artificial Sequence
  Synthetic
aaugggaggucagggagagaaa

SEQ ID NO: 75923 - DNA, 20 bp, Artificial Sequence
  Synthetic
tccuccagcgactauggaca

SEQ ID NO: 75924 - DNA, 27 bp, Artificial Sequence
  Synthetic
ttttgcctttaggaguctgatgactut

SEQ ID NO: 75925 - DNA, 25 bp, Artificial Sequence
  Synthetic
gatgtgtccugaatgttgctgatuc

SEQ ID NO: 75926 - DNA, 28 bp, Artificial Sequence
  Synthetic
tgaaccagcauatagaacatguccaaaa

SEQ ID NO: 75927 - DNA, 23 bp, Artificial Sequence
  Synthetic
tcttcagagaccacuctcctuga

SEQ ID NO: 75928 - DNA, 22 bp, Artificial Sequence
  Synthetic
gggctttcugaaggagguagag

SEQ ID NO: 75929 - DNA, 28 bp, Artificial Sequence
  Synthetic
gggtgctagttuatagaattcagaguca

SEQ ID NO: 75930 - DNA, 23 bp, Artificial Sequence
  Synthetic
aggcatacguaactcaccactug

SEQ ID NO: 75931 - DNA, 28 bp, Artificial Sequence
  Synthetic
ctgatggaccaucgttggtacatatuaa

SEQ ID NO: 75932 - DNA, 24 bp, Artificial Sequence
  Synthetic
aggtgctggauggaaataguaacc

SEQ ID NO: 75933 - DNA, 21 bp, Artificial Sequence
  Synthetic
gcttcctgggcuagtgaccua

SEQ ID NO: 75934 - DNA, 25 bp, Artificial Sequence
  Synthetic
gcgtcttattcuctgggatgaauga

SEQ ID NO: 75935 - DNA, 27 bp, Artificial Sequence
  Synthetic
gttctgatcugactttgcattgtucag

SEQ ID NO: 75936 - DNA, 21 bp, Artificial Sequence
  Synthetic
acacctacugcagggaucaca

SEQ ID NO: 75937 - DNA, 23 bp, Artificial Sequence
  Synthetic
aagaagaggaagguggcatucag

SEQ ID NO: 75938 - DNA, 20 bp, Artificial Sequence
  Synthetic
gcacgcauccgactgtucat

SEQ ID NO: 75939 - DNA, 19 bp, Artificial Sequence
  Synthetic
ctctcugccacttcugcga

SEQ ID NO: 75940 - DNA, 21 bp, Artificial Sequence
  Synthetic
cgtgggcucatcttggaaguc

SEQ ID NO: 75941 - DNA, 29 bp, Artificial Sequence
  Synthetic
gttggagtgtctugaattatgtgtttcut

SEQ ID NO: 75942 - DNA, 24 bp, Artificial Sequence
  Synthetic
ctaacctctucaggctcaaucagt

SEQ ID NO: 75943 - DNA, 21 bp, Artificial Sequence
  Synthetic
gaaugtaucgggaaggaccca

SEQ ID NO: 75944 - DNA, 20 bp, Artificial Sequence
  Synthetic
tgatccucgccgttggtaug

SEQ ID NO: 75945 - DNA, 27 bp, Artificial Sequence
  Synthetic
cccataaagtggutgattgtggttuaa

SEQ ID NO: 75946 - DNA, 20 bp, Artificial Sequence
  Synthetic
accuccgugcagaagagagt

SEQ ID NO: 75947 - DNA, 24 bp, Artificial Sequence
  Synthetic
gggaggttucatggagtcaauagg

SEQ ID NO: 75948 - DNA, 21 bp, Artificial Sequence
  Synthetic
cccacuccttgcttcucagat

SEQ ID NO: 75949 - DNA, 23 bp, Artificial Sequence
  Synthetic
tggtgacagaggacaaugtgaug

SEQ ID NO: 75950 - DNA, 17 bp, Artificial Sequence
  Synthetic
cgucgcugcaagccaaa

SEQ ID NO: 75951 - DNA, 21 bp, Artificial Sequence
  Synthetic
gtttagcggugggcaacuaac

SEQ ID NO: 75952 - DNA, 20 bp, Artificial Sequence
  Synthetic
ccctcuggtgatgucagggt

SEQ ID NO: 75953 - DNA, 19 bp, Artificial Sequence
  Synthetic
ctccgaggagcucaucaca

SEQ ID NO: 75954 - DNA, 25 bp, Artificial Sequence
  Synthetic
gttgaacagaacaaccuctgucact

SEQ ID NO: 75955 - DNA, 26 bp, Artificial Sequence
  Synthetic
catactcaggaugctgttccactuac

SEQ ID NO: 75956 - DNA, 24 bp, Artificial Sequence
  Synthetic
tgcctgcagugtctatctatgtug

SEQ ID NO: 75957 - DNA, 21 bp, Artificial Sequence
  Synthetic
gctctgtgacugtgcctctug

SEQ ID NO: 75958 - DNA, 21 bp, Artificial Sequence
  Synthetic
ttcccugaccgctttgcuaaa

SEQ ID NO: 75959 - DNA, 22 bp, Artificial Sequence
  Synthetic
caaagucaggcacgttcaucac

SEQ ID NO: 75960 - DNA, 22 bp, Artificial Sequence
  Synthetic
cgaggccaaaguctgctatcut

SEQ ID NO: 75961 - DNA, 21 bp, Artificial Sequence
  Synthetic
acaagtcggcuagttgcaugg

SEQ ID NO: 75962 - DNA, 23 bp, Artificial Sequence
  Synthetic
actcctcccutgatccuaacact

SEQ ID NO: 75963 - DNA, 20 bp, Artificial Sequence
  Synthetic
ccaccagccacacutguaac

SEQ ID NO: 75964 - DNA, 25 bp, Artificial Sequence
  Synthetic
actgctggaucatatgcattugagt

SEQ ID NO: 75965 - DNA, 27 bp, Artificial Sequence
  Synthetic
atctgctttcttugattcttcggauaa

SEQ ID NO: 75966 - DNA, 27 bp, Artificial Sequence
  Synthetic
atccgaagaaucaaagaaagcagauaa

SEQ ID NO: 75967 - DNA, 28 bp, Artificial Sequence
  Synthetic
cagtgcucaaaaccaaaatgcctaauat

SEQ ID NO: 75968 - DNA, 18 bp, Artificial Sequence
  Synthetic
cagcggacuggtgtggut

SEQ ID NO: 75969 - DNA, 19 bp, Artificial Sequence
  Synthetic
agcutgagtccugggcaag

SEQ ID NO: 75970 - DNA, 24 bp, Artificial Sequence
  Synthetic
ttcagaguggactacatccugagt

SEQ ID NO: 75971 - DNA, 21 bp, Artificial Sequence
  Synthetic
tgcctgaagugtggttuggat

SEQ ID NO: 75972 - DNA, 20 bp, Artificial Sequence
  Synthetic
cccaatagcaugccacccua

SEQ ID NO: 75973 - DNA, 21 bp, Artificial Sequence
  Synthetic
tctccgcugctctctgaauct

SEQ ID NO: 75974 - DNA, 23 bp, Artificial Sequence
  Synthetic
aggaggtucaccttcctcugaaa

SEQ ID NO: 75975 - DNA, 22 bp, Artificial Sequence
  Synthetic
gcctctaugcttgcguaaccag

SEQ ID NO: 75976 - DNA, 17 bp, Artificial Sequence
  Synthetic
gctgccuccgctcacuc

SEQ ID NO: 75977 - DNA, 18 bp, Artificial Sequence
  Synthetic
gccggaugcugccaaact

SEQ ID NO: 75978 - DNA, 18 bp, Artificial Sequence
  Synthetic
ccggacacagcutggcut

SEQ ID NO: 75979 - DNA, 17 bp, Artificial Sequence
  Synthetic
ccaggcccgauggucat

SEQ ID NO: 75980 - DNA, 18 bp, Artificial Sequence
  Synthetic
ccugcgtcguggagaaca

SEQ ID NO: 75981 - DNA, 18 bp, Artificial Sequence
  Synthetic
gggcagaugacgcucagg

SEQ ID NO: 75982 - DNA, 22 bp, Artificial Sequence
  Synthetic
cggagaaguaggtggtgucact

SEQ ID NO: 75983 - DNA, 21 bp, Artificial Sequence
  Synthetic
acgatgugcagagcaucaact

SEQ ID NO: 75984 - DNA, 24 bp, Artificial Sequence
  Synthetic
tcaaacucctataccugcccaaga

SEQ ID NO: 75985 - DNA, 27 bp, Artificial Sequence
  Synthetic
agtactgtuaccaggactacagaagut

SEQ ID NO: 75986 - DNA, 20 bp, Artificial Sequence
  Synthetic
gcagcaguggaaauggcaat

SEQ ID NO: 75987 - DNA, 19 bp, Artificial Sequence
  Synthetic
aaatgcccacugggaccuc

SEQ ID NO: 75988 - DNA, 19 bp, Artificial Sequence
  Synthetic
ccacctccucccctgugat

SEQ ID NO: 75989 - DNA, 17 bp, Artificial Sequence
  Synthetic
gggagccccuguggaag

SEQ ID NO: 75990 - DNA, 22 bp, Artificial Sequence
  Synthetic
gaacctcatcauggcctcacut

SEQ ID NO: 75991 - DNA, 20 bp, Artificial Sequence
  Synthetic
gctcctggautctgcggtug

SEQ ID NO: 75992 - DNA, 27 bp, Artificial Sequence
  Synthetic
tgttcactaauttgttgccuaccagaa

SEQ ID NO: 75993 - DNA, 28 bp, Artificial Sequence
  Synthetic
tgaagaggaugcagggaattatacaauc

SEQ ID NO: 75994 - DNA, 22 bp, Artificial Sequence
  Synthetic
ccagcucaaagcaagagtguca

SEQ ID NO: 75995 - DNA, 21 bp, Artificial Sequence
  Synthetic
gctccguacgctgagucaaag

SEQ ID NO: 75996 - DNA, 24 bp, Artificial Sequence
  Synthetic
tccaggttttautggcttgcacua

SEQ ID NO: 75997 - DNA, 22 bp, Artificial Sequence
  Synthetic
cctcucggaaccagtugagagt

SEQ ID NO: 75998 - DNA, 21 bp, Artificial Sequence
  Synthetic
ggaccaggaaggacuccacut

SEQ ID NO: 75999 - DNA, 19 bp, Artificial Sequence
  Synthetic
gtguggccagcgtaatucc

SEQ ID NO: 76000 - DNA, 18 bp, Artificial Sequence
  Synthetic
gagaagcucagccuggga

SEQ ID NO: 76001 - DNA, 21 bp, Artificial Sequence
  Synthetic
cacagaugccaaccucaacct

SEQ ID NO: 76002 - DNA, 23 bp, Artificial Sequence
  Synthetic
ggagacugggaggtggaaagtua

SEQ ID NO: 76003 - DNA, 24 bp, Artificial Sequence
  Synthetic
agtcacagaagaggaugaaggugt

SEQ ID NO: 76004 - DNA, 21 bp, Artificial Sequence
  Synthetic
caggaagtacutggccaccug

SEQ ID NO: 76005 - DNA, 20 bp, Artificial Sequence
  Synthetic
ctccccgaaugaccttcugt

SEQ ID NO: 76006 - DNA, 25 bp, Artificial Sequence
  Synthetic
ggattttgcaucaagagcatcaugt

SEQ ID NO: 76007 - DNA, 28 bp, Artificial Sequence
  Synthetic
agaagtttgttttugttgcctctgatut

SEQ ID NO: 76008 - DNA, 18 bp, Artificial Sequence
  Synthetic
gugagcgacgaccagucc

SEQ ID NO: 76009 - DNA, 20 bp, Artificial Sequence
  Synthetic
gcttgacgutgacccucact

SEQ ID NO: 76010 - DNA, 20 bp, Artificial Sequence
  Synthetic
ggagagguggagaggctuca

SEQ ID NO: 76011 - DNA, 23 bp, Artificial Sequence
  Synthetic
ctcacgttggucgtcttcttgua

SEQ ID NO: 76012 - DNA, 22 bp, Artificial Sequence
  Synthetic
gtatgaacccaccucccaugac

SEQ ID NO: 76013 - DNA, 19 bp, Artificial Sequence
  Synthetic
ggccacugacatcauggct

SEQ ID NO: 76014 - DNA, 28 bp, Artificial Sequence
  Synthetic
catatttcttacuctcaactggtuccga

SEQ ID NO: 76015 - DNA, 25 bp, Artificial Sequence
  Synthetic
ggttagtgctuggtgaagacttcua

SEQ ID NO: 76016 - DNA, 22 bp, Artificial Sequence
  Synthetic
acagcaggaguggatcaaucag

SEQ ID NO: 76017 - DNA, 22 bp, Artificial Sequence
  Synthetic
cccatctgcugcaaaaacctua

SEQ ID NO: 76018 - DNA, 22 bp, Artificial Sequence
  Synthetic
cctcutaaacccaaugcccaga

SEQ ID NO: 76019 - DNA, 22 bp, Artificial Sequence
  Synthetic
gtgcccctucttcttcccauag

SEQ ID NO: 76020 - DNA, 27 bp, Artificial Sequence
  Synthetic
cacatttgacugttttatgcucagcaa

SEQ ID NO: 76021 - DNA, 27 bp, Artificial Sequence
  Synthetic
ccgtgtgaaaugacttactgatcaugt

SEQ ID NO: 76022 - DNA, 21 bp, Artificial Sequence
  Synthetic
gcctcagcagcgugtttctua

SEQ ID NO: 76023 - DNA, 21 bp, Artificial Sequence
  Synthetic
ttggtctccugcggttuacag

SEQ ID NO: 76024 - DNA, 26 bp, Artificial Sequence
  Synthetic
aaggcctttagutctgtatgacauct

SEQ ID NO: 76025 - DNA, 24 bp, Artificial Sequence
  Synthetic
acatccuggaggattgttcguact

SEQ ID NO: 76026 - DNA, 26 bp, Artificial Sequence
  Synthetic
gaatggcaatuacctacctgttcugt

SEQ ID NO: 76027 - DNA, 24 bp, Artificial Sequence
  Synthetic
acguttgtttttcuggcgaaagag

SEQ ID NO: 76028 - DNA, 22 bp, Artificial Sequence
  Synthetic
gggcaucaaattccugggacaa

SEQ ID NO: 76029 - DNA, 21 bp, Artificial Sequence
  Synthetic
gcaguaccagcaugacaccag

SEQ ID NO: 76030 - DNA, 28 bp, Artificial Sequence
  Synthetic
agtgaatgcacguaagtatttagctuca

SEQ ID NO: 76031 - DNA, 19 bp, Artificial Sequence
  Synthetic
ctggccagugctaactugg

SEQ ID NO: 76032 - DNA, 28 bp, Artificial Sequence
  Synthetic
tgcaaatctgttucattgtgacttctuc

SEQ ID NO: 76033 - DNA, 28 bp, Artificial Sequence
  Synthetic
aagtgagtcugaggatagttcagaugat

SEQ ID NO: 76034 - DNA, 27 bp, Artificial Sequence
  Synthetic
tctcccagauaagatgaatactguggt

SEQ ID NO: 76035 - DNA, 28 bp, Artificial Sequence
  Synthetic
tcatcctcactgugtgctatgttttaut

SEQ ID NO: 76036 - DNA, 27 bp, Artificial Sequence
  Synthetic
acctagccagaauttttctcatcttut

SEQ ID NO: 76037 - DNA, 20 bp, Artificial Sequence
  Synthetic
gagcugacaggcgatctuga

SEQ ID NO: 76038 - DNA, 25 bp, Artificial Sequence
  Synthetic
tttctgctgcaaguacttctgaugt

SEQ ID NO: 76039 - DNA, 23 bp, Artificial Sequence
  Synthetic
ttcacugaggccacatgatctuc

SEQ ID NO: 76040 - DNA, 22 bp, Artificial Sequence
  Synthetic
tttgaggcgucttgcaatcuct

SEQ ID NO: 76041 - DNA, 32 bp, Artificial Sequence
  Synthetic
aactagttttatattuccagcttcaacttuca

SEQ ID NO: 76042 - DNA, 24 bp, Artificial Sequence
  Synthetic
gtaacctcauagaatcggcagugg

SEQ ID NO: 76043 - DNA, 21 bp, Artificial Sequence
  Synthetic
accctgtcugggtgcuaagat

SEQ ID NO: 76044 - DNA, 27 bp, Artificial Sequence
  Synthetic
cgagtcttgucaagaagcattcatcut

SEQ ID NO: 76045 - DNA, 28 bp, Artificial Sequence
  Synthetic
agatttctcaucactctttccacaugac

SEQ ID NO: 76046 - DNA, 25 bp, Artificial Sequence
  Synthetic
ttggtcaagtcucacatggctuaat

SEQ ID NO: 76047 - DNA, 28 bp, Artificial Sequence
  Synthetic
gcacaagtttuccaactatgaactccua

SEQ ID NO: 76048 - DNA, 25 bp, Artificial Sequence
  Synthetic
gctgttgcctutgatactggtttut

SEQ ID NO: 76049 - DNA, 28 bp, Artificial Sequence
  Synthetic
gtgcaactaagutacagtagatcucaca

SEQ ID NO: 76050 - DNA, 22 bp, Artificial Sequence
  Synthetic
gttggtggcuttgcagtgauag

SEQ ID NO: 76051 - DNA, 25 bp, Artificial Sequence
  Synthetic
catccaggcccacuaatcuaaacat

SEQ ID NO: 76052 - DNA, 23 bp, Artificial Sequence
  Synthetic
gtttttcctcutcccaccctuca

SEQ ID NO: 76053 - DNA, 27 bp, Artificial Sequence
  Synthetic
cgagaaacatacuctgacagagatguc

SEQ ID NO: 76054 - DNA, 23 bp, Artificial Sequence
  Synthetic
tgctgtttgtauttccaggccut

SEQ ID NO: 76055 - DNA, 21 bp, Artificial Sequence
  Synthetic
ccaaagucagggtacgtucct

SEQ ID NO: 76056 - DNA, 22 bp, Artificial Sequence
  Synthetic
caactacaguctgggaugccaa

SEQ ID NO: 76057 - DNA, 20 bp, Artificial Sequence
  Synthetic
accugagaguccgcaaaagg

SEQ ID NO: 76058 - DNA, 21 bp, Artificial Sequence
  Synthetic
gtgtggcgcugagtgtactua

SEQ ID NO: 76059 - DNA, 21 bp, Artificial Sequence
  Synthetic
cacatccauctggtacguggt

SEQ ID NO: 76060 - DNA, 22 bp, Artificial Sequence
  Synthetic
accccagttgugggtaccttua

SEQ ID NO: 76061 - DNA, 21 bp, Artificial Sequence
  Synthetic
ggtcggaggagacguagagut

SEQ ID NO: 76062 - DNA, 21 bp, Artificial Sequence
  Synthetic
cccacucatgctcuacaaccc

SEQ ID NO: 76063 - DNA, 22 bp, Artificial Sequence
  Synthetic
gacaaggaugcctgaccagtua

SEQ ID NO: 76064 - DNA, 18 bp, Artificial Sequence
  Synthetic
cucccagcagggacacuc

SEQ ID NO: 76065 - DNA, 21 bp, Artificial Sequence
  Synthetic
agugtaagccucggcaaacaa

SEQ ID NO: 76066 - DNA, 22 bp, Artificial Sequence
  Synthetic
cctcccaguctggagaugagat

SEQ ID NO: 76067 - DNA, 23 bp, Artificial Sequence
  Synthetic
ccactccuccaaaaaggctucaa

SEQ ID NO: 76068 - DNA, 24 bp, Artificial Sequence
  Synthetic
aaaautgacatcauccccaaccct

SEQ ID NO: 76069 - DNA, 28 bp, Artificial Sequence
  Synthetic
ataagtatgaaugcctacagaacugcaa

SEQ ID NO: 76070 - DNA, 26 bp, Artificial Sequence
  Synthetic
actgtgtcucaacaagcctuacaaaa

SEQ ID NO: 76071 - DNA, 24 bp, Artificial Sequence
  Synthetic
ggattagagutggcatactuggca

SEQ ID NO: 76072 - DNA, 19 bp, Artificial Sequence
  Synthetic
cacaagcuggctgggucat

SEQ ID NO: 76073 - DNA, 22 bp, Artificial Sequence
  Synthetic
catcctgugccgaaugaagaac

SEQ ID NO: 76074 - DNA, 24 bp, Artificial Sequence
  Synthetic
gcatcacugtaaacctugcagaca

SEQ ID NO: 76075 - DNA, 22 bp, Artificial Sequence
  Synthetic
ctttctuccctctcuccaccag

SEQ ID NO: 76076 - DNA, 21 bp, Artificial Sequence
  Synthetic
gaagtcuggcttcttggucgt

SEQ ID NO: 76077 - DNA, 24 bp, Artificial Sequence
  Synthetic
cctcctcctgugatctgcaatcua

SEQ ID NO: 76078 - DNA, 21 bp, Artificial Sequence
  Synthetic
gttggcugcattcaucaagca

SEQ ID NO: 76079 - DNA, 22 bp, Artificial Sequence
  Synthetic
cgcctgcautggattcatgtuc

SEQ ID NO: 76080 - DNA, 24 bp, Artificial Sequence
  Synthetic
agagattaaccgugccgaaugaaa

SEQ ID NO: 76081 - DNA, 20 bp, Artificial Sequence
  Synthetic
ccagaggcaguctgagucac

SEQ ID NO: 76082 - DNA, 25 bp, Artificial Sequence
  Synthetic
ctaaggcaatccugacatttgcauc

SEQ ID NO: 76083 - DNA, 20 bp, Artificial Sequence
  Synthetic
agtgtgacccugacctcugt

SEQ ID NO: 76084 - DNA, 20 bp, Artificial Sequence
  Synthetic
gtccacuccaauccagccat

SEQ ID NO: 76085 - DNA, 23 bp, Artificial Sequence
  Synthetic
aattgtgaaggcauggtgttgug

SEQ ID NO: 76086 - DNA, 29 bp, Artificial Sequence
  Synthetic
agctgtgttaautttatagcagucaacca

SEQ ID NO: 76087 - DNA, 23 bp, Artificial Sequence
  Synthetic
cgtgctuggcgggtaattctaut

SEQ ID NO: 76088 - DNA, 20 bp, Artificial Sequence
  Synthetic
cctcguacccctccaucaac

SEQ ID NO: 76089 - DNA, 26 bp, Artificial Sequence
  Synthetic
gtataacctttcuccttctcccccua

SEQ ID NO: 76090 - DNA, 28 bp, Artificial Sequence
  Synthetic
tgaucaggaagaacuaaacaagaccaag

SEQ ID NO: 76091 - DNA, 22 bp, Artificial Sequence
  Synthetic
caacaugcaaaggcttcucaca

SEQ ID NO: 76092 - DNA, 22 bp, Artificial Sequence
  Synthetic
caggcucagcagatgaacauga

SEQ ID NO: 76093 - DNA, 22 bp, Artificial Sequence
  Synthetic
tgctggaacuggttatggtugg

SEQ ID NO: 76094 - DNA, 21 bp, Artificial Sequence
  Synthetic
tggcagguccuagcagaagat

SEQ ID NO: 76095 - DNA, 23 bp, Artificial Sequence
  Synthetic
cccutgaggactugaggcaaaaa

SEQ ID NO: 76096 - DNA, 24 bp, Artificial Sequence
  Synthetic
ccatgcagagugaaaggatauccc

SEQ ID NO: 76097 - DNA, 24 bp, Artificial Sequence
  Synthetic
gccttttctttugcttcccttgut

SEQ ID NO: 76098 - DNA, 20 bp, Artificial Sequence
  Synthetic
tcagcggcuccacaaguaag

SEQ ID NO: 76099 - DNA, 24 bp, Artificial Sequence
  Synthetic
agaaccuccaaacctctctcugaa

SEQ ID NO: 76100 - DNA, 24 bp, Artificial Sequence
  Synthetic
cctttggtuagaacagcagucaga

SEQ ID NO: 76101 - DNA, 25 bp, Artificial Sequence
  Synthetic
ccaaagcguactgactatucaaggg

SEQ ID NO: 76102 - DNA, 19 bp, Artificial Sequence
  Synthetic
tctggcuctcctgcuccat

SEQ ID NO: 76103 - DNA, 17 bp, Artificial Sequence
  Synthetic
gcctccucgtgctcgug

SEQ ID NO: 76104 - DNA, 20 bp, Artificial Sequence
  Synthetic
cccccgaaucggaatcugac

SEQ ID NO: 76105 - DNA, 19 bp, Artificial Sequence
  Synthetic
tctcaggcucggtcucgaa

SEQ ID NO: 76106 - DNA, 26 bp, Artificial Sequence
  Synthetic
atcagcaagugaatagctcuacaaaa

SEQ ID NO: 76107 - DNA, 25 bp, Artificial Sequence
  Synthetic
ttgtagctcucatttgctgugagaa

SEQ ID NO: 76108 - DNA, 27 bp, Artificial Sequence
  Synthetic
caaacatccutaccaattttgugcagt

SEQ ID NO: 76109 - DNA, 28 bp, Artificial Sequence
  Synthetic
agcgatgtgcauatataatggaaaggut

SEQ ID NO: 76110 - DNA, 27 bp, Artificial Sequence
  Synthetic
tcagaagtcaugggaaatatugcaagt

SEQ ID NO: 76111 - DNA, 24 bp, Artificial Sequence
  Synthetic
acaacgutaagactuacccagcag

SEQ ID NO: 76112 - DNA, 20 bp, Artificial Sequence
  Synthetic
ccgaaaucgaguccgagacc

SEQ ID NO: 76113 - DNA, 18 bp, Artificial Sequence
  Synthetic
gggctucgcaactugaga

SEQ ID NO: 76114 - DNA, 17 bp, Artificial Sequence
  Synthetic
cuccacctucggccagt

SEQ ID NO: 76115 - DNA, 21 bp, Artificial Sequence
  Synthetic
gatctttgucctcgggctuga

SEQ ID NO: 76116 - DNA, 17 bp, Artificial Sequence
  Synthetic
cgacgccuccccaaguc

SEQ ID NO: 76117 - DNA, 17 bp, Artificial Sequence
  Synthetic
ggcgggugggcttctut

SEQ ID NO: 76118 - DNA, 21 bp, Artificial Sequence
  Synthetic
ggtgtccacautcctcacguc

SEQ ID NO: 76119 - DNA, 24 bp, Artificial Sequence
  Synthetic
gttgaggatguaggtgatgauggt

SEQ ID NO: 76120 - DNA, 18 bp, Artificial Sequence
  Synthetic
gctgctgcuctgcctcut

SEQ ID NO: 76121 - DNA, 20 bp, Artificial Sequence
  Synthetic
agcauaggacgggaagugga

SEQ ID NO: 76122 - DNA, 29 bp, Artificial Sequence
  Synthetic
acgggtatttccugcttgtagtaattuag

SEQ ID NO: 76123 - DNA, 22 bp, Artificial Sequence
  Synthetic
tggtaagcuccacgttgaagut

SEQ ID NO: 76124 - DNA, 30 bp, Artificial Sequence
  Synthetic
acaaagactgugaggaaagtttcatuacaa

SEQ ID NO: 76125 - DNA, 25 bp, Artificial Sequence
  Synthetic
acagtgtcacgaacuccagtaguat

SEQ ID NO: 76126 - DNA, 20 bp, Artificial Sequence
  Synthetic
ggaggagagutggugaacgg

SEQ ID NO: 76127 - DNA, 24 bp, Artificial Sequence
  Synthetic
agaacatgcuggtgaacaagauga

SEQ ID NO: 76128 - DNA, 24 bp, Artificial Sequence
  Synthetic
aacaagctgcuctcttgtgatuct

SEQ ID NO: 76129 - DNA, 25 bp, Artificial Sequence
  Synthetic
ccaaactcaccuctgacttctcuct

SEQ ID NO: 76130 - DNA, 28 bp, Artificial Sequence
  Synthetic
tcaatgatcaggaaaugctgtatucaca

SEQ ID NO: 76131 - DNA, 24 bp, Artificial Sequence
  Synthetic
gggaagacuttagtgtcagucacc

SEQ ID NO: 76132 - DNA, 23 bp, Artificial Sequence
  Synthetic
caacacugcaaaccacttucagg

SEQ ID NO: 76133 - DNA, 22 bp, Artificial Sequence
  Synthetic
tgaaatgctuggcgactcctut

SEQ ID NO: 76134 - DNA, 20 bp, Artificial Sequence
  Synthetic
ccttctgtccucgcaggtua

SEQ ID NO: 76135 - DNA, 19 bp, Artificial Sequence
  Synthetic
gctgcauccaagcccucag

SEQ ID NO: 76136 - DNA, 19 bp, Artificial Sequence
  Synthetic
ccagcagcugcccaactua

SEQ ID NO: 76137 - DNA, 25 bp, Artificial Sequence
  Synthetic
tcttatctccuctgggtttuccaca

SEQ ID NO: 76138 - DNA, 21 bp, Artificial Sequence
  Synthetic
gtgtccuccacaccagaauca

SEQ ID NO: 76139 - DNA, 24 bp, Artificial Sequence
  Synthetic
aagacagccacucaatggagtuac

SEQ ID NO: 76140 - DNA, 20 bp, Artificial Sequence
  Synthetic
ccaggccutctttggugact

SEQ ID NO: 76141 - DNA, 21 bp, Artificial Sequence
  Synthetic
cagcctttguggaacgtctuc

SEQ ID NO: 76142 - DNA, 17 bp, Artificial Sequence
  Synthetic
ggcccaagggugacuca

SEQ ID NO: 76143 - DNA, 18 bp, Artificial Sequence
  Synthetic
ggcagaggucuccagcac

SEQ ID NO: 76144 - DNA, 27 bp, Artificial Sequence
  Synthetic
accattaattgcugtaagatctgcuga

SEQ ID NO: 76145 - DNA, 22 bp, Artificial Sequence
  Synthetic
tgctgcacaucaaggtgcuaat

SEQ ID NO: 76146 - DNA, 21 bp, Artificial Sequence
  Synthetic
gtcactctccuggtccatcuc

SEQ ID NO: 76147 - DNA, 22 bp, Artificial Sequence
  Synthetic
accuggaggccaaaatgatucc

SEQ ID NO: 76148 - DNA, 21 bp, Artificial Sequence
  Synthetic
cagcaagaagguggagaucgt

SEQ ID NO: 76149 - DNA, 21 bp, Artificial Sequence
  Synthetic
gaaactcuggccacctgugat

SEQ ID NO: 76150 - DNA, 21 bp, Artificial Sequence
  Synthetic
caggaauaggccctggaaugg

SEQ ID NO: 76151 - DNA, 25 bp, Artificial Sequence
  Synthetic
tgtcccatattuccttgttgcauct

SEQ ID NO: 76152 - DNA, 28 bp, Artificial Sequence
  Synthetic
ggtcatgattttcuagagaggaggtuct

SEQ ID NO: 76153 - DNA, 26 bp, Artificial Sequence
  Synthetic
cctaactuagacttcggguggaaaaa

SEQ ID NO: 76154 - DNA, 24 bp, Artificial Sequence
  Synthetic
cagaauatgcaguacccaaaccca

SEQ ID NO: 76155 - DNA, 20 bp, Artificial Sequence
  Synthetic
ctcacatgcaugccgatugt

SEQ ID NO: 76156 - DNA, 24 bp, Artificial Sequence
  Synthetic
ccatctgtagcuggctttcauacc

SEQ ID NO: 76157 - DNA, 28 bp, Artificial Sequence
  Synthetic
tgtttgtctccucttcattgtcgtttua

SEQ ID NO: 76158 - DNA, 29 bp, Artificial Sequence
  Synthetic
cagtactcatcaaugggctcaatcataua

SEQ ID NO: 76159 - DNA, 27 bp, Artificial Sequence
  Synthetic
gcaagaaaagucagagctagaugaaac

SEQ ID NO: 76160 - DNA, 28 bp, Artificial Sequence
  Synthetic
gctgaagaggagutagaaattgagauga

SEQ ID NO: 76161 - DNA, 22 bp, Artificial Sequence
  Synthetic
aattgctgtugctctcagccua

SEQ ID NO: 76162 - DNA, 20 bp, Artificial Sequence
  Synthetic
ggatgcagcaucacaugcaa

SEQ ID NO: 76163 - DNA, 20 bp, Artificial Sequence
  Synthetic
ctgttgcugaaggagucgct

SEQ ID NO: 76164 - DNA, 26 bp, Artificial Sequence
  Synthetic
agatatgtggugatggcatgcttuaa

SEQ ID NO: 76165 - DNA, 22 bp, Artificial Sequence
  Synthetic
gcaggauggattcugagcagag

SEQ ID NO: 76166 - DNA, 31 bp, Artificial Sequence
  Synthetic
aggattttgggttaucttactatttgcagut

SEQ ID NO: 76167 - DNA, 23 bp, Artificial Sequence
  Synthetic
gcatatgcucattggagtcauca

SEQ ID NO: 76168 - DNA, 24 bp, Artificial Sequence
  Synthetic
gcatatgcttacugtatgggacug

SEQ ID NO: 76169 - DNA, 26 bp, Artificial Sequence
  Synthetic
tctgctttugcgacttacgaauagat

SEQ ID NO: 76170 - DNA, 22 bp, Artificial Sequence
  Synthetic
actctgtccutggcaatgagut

SEQ ID NO: 76171 - DNA, 23 bp, Artificial Sequence
  Synthetic
tgctccccaauaaggttcacauc

SEQ ID NO: 76172 - DNA, 21 bp, Artificial Sequence
  Synthetic
tgccagtcuacaggcctauca

SEQ ID NO: 76173 - DNA, 20 bp, Artificial Sequence
  Synthetic
gagagcgcacutgatuggag

SEQ ID NO: 76174 - DNA, 19 bp, Artificial Sequence
  Synthetic
cggtcccutcctccucact

SEQ ID NO: 76175 - DNA, 19 bp, Artificial Sequence
  Synthetic
tctccuccgcccctcauac

SEQ ID NO: 76176 - DNA, 24 bp, Artificial Sequence
  Synthetic
gttttcttccaacugtccttgcug

SEQ ID NO: 76177 - DNA, 25 bp, Artificial Sequence
  Synthetic
caagccagguagaugaagaacagat

SEQ ID NO: 76178 - DNA, 26 bp, Artificial Sequence
  Synthetic
tgcttgactuccaactgctacttaug

SEQ ID NO: 76179 - DNA, 25 bp, Artificial Sequence
  Synthetic
gcagcaauggacattttgagtugaa

SEQ ID NO: 76180 - DNA, 26 bp, Artificial Sequence
  Synthetic
tucaaggaaaugaggaaagggaacat

SEQ ID NO: 76181 - DNA, 25 bp, Artificial Sequence
  Synthetic
caagaggtccugtcttcagaugaaa

SEQ ID NO: 76182 - DNA, 22 bp, Artificial Sequence
  Synthetic
gccagcagauccctaattcuct

SEQ ID NO: 76183 - DNA, 21 bp, Artificial Sequence
  Synthetic
cagctaccaguccaggatgug

SEQ ID NO: 76184 - DNA, 28 bp, Artificial Sequence
  Synthetic
acagcaaattaaugactttaccctucct

SEQ ID NO: 76185 - DNA, 28 bp, Artificial Sequence
  Synthetic
gaaacaaattaccutgcttctgtucaca

SEQ ID NO: 76186 - DNA, 26 bp, Artificial Sequence
  Synthetic
ttgtacutgtgacaaatuagcagggt

SEQ ID NO: 76187 - DNA, 24 bp, Artificial Sequence
  Synthetic
attctgtttcaucgctgagugaca

SEQ ID NO: 76188 - DNA, 27 bp, Artificial Sequence
  Synthetic
cccaccaacaaautaauaagccaaacc

SEQ ID NO: 76189 - DNA, 29 bp, Artificial Sequence
  Synthetic
gttctcagagcuaagtatcaaggattuca

SEQ ID NO: 76190 - DNA, 23 bp, Artificial Sequence
  Synthetic
ctcatctuaggctgtgctgugaa

SEQ ID NO: 76191 - DNA, 25 bp, Artificial Sequence
  Synthetic
gggtgacctuaaacagatgttacug

SEQ ID NO: 76192 - DNA, 26 bp, Artificial Sequence
  Synthetic
tcttgagatgcutttagagctucagg

SEQ ID NO: 76193 - DNA, 22 bp, Artificial Sequence
  Synthetic
cggtaaagugcctccaaagtug

SEQ ID NO: 76194 - DNA, 22 bp, Artificial Sequence
  Synthetic
agaagaacuacgacaggcacug

SEQ ID NO: 76195 - DNA, 27 bp, Artificial Sequence
  Synthetic
accaccaaatacutacagggattccua

SEQ ID NO: 76196 - DNA, 26 bp, Artificial Sequence
  Synthetic
gagtcctugaggagtacccaauagaa

SEQ ID NO: 76197 - DNA, 28 bp, Artificial Sequence
  Synthetic
agcgatgaatguactctcctgagtaaua

SEQ ID NO: 76198 - DNA, 21 bp, Artificial Sequence
  Synthetic
gttuccccacagacaagtucc

SEQ ID NO: 76199 - DNA, 20 bp, Artificial Sequence
  Synthetic
ttgccatgccuggattgcua

SEQ ID NO: 76200 - DNA, 23 bp, Artificial Sequence
  Synthetic
aggugaaacatagguacccccat

SEQ ID NO: 76201 - DNA, 22 bp, Artificial Sequence
  Synthetic
agagatggcagcugagtcatug

SEQ ID NO: 76202 - DNA, 25 bp, Artificial Sequence
  Synthetic
gcttaccaucattggctugaaaaca

SEQ ID NO: 76203 - DNA, 28 bp, Artificial Sequence
  Synthetic
tctttactctgtcautggtggttttcut

SEQ ID NO: 76204 - DNA, 21 bp, Artificial Sequence
  Synthetic
cagugucccgaaggagaaagg

SEQ ID NO: 76205 - DNA, 25 bp, Artificial Sequence
  Synthetic
aacttgtggcauagactgtttgcua

SEQ ID NO: 76206 - DNA, 28 bp, Artificial Sequence
  Synthetic
ggtagatttgutagcatttccaucaagg

SEQ ID NO: 76207 - DNA, 25 bp, Artificial Sequence
  Synthetic
cagagactttugccaaggaaaucag

SEQ ID NO: 76208 - DNA, 23 bp, Artificial Sequence
  Synthetic
gttcctcctcuaccacacgatuc

SEQ ID NO: 76209 - DNA, 23 bp, Artificial Sequence
  Synthetic
caagaaguagcaagctggcttut

SEQ ID NO: 76210 - DNA, 21 bp, Artificial Sequence
  Synthetic
ctgcctgguactgccctatug

SEQ ID NO: 76211 - DNA, 21 bp, Artificial Sequence
  Synthetic
ggcatggacucaaacgtguct

SEQ ID NO: 76212 - DNA, 28 bp, Artificial Sequence
  Synthetic
gagatgcttaagutcaatagcagttucc

SEQ ID NO: 76213 - DNA, 22 bp, Artificial Sequence
  Synthetic
tcucacagcagagcagttugac

SEQ ID NO: 76214 - DNA, 21 bp, Artificial Sequence
  Synthetic
cgagagccugtgcattucaga

SEQ ID NO: 76215 - DNA, 23 bp, Artificial Sequence
  Synthetic
cctccagtgagucatgcacttut

SEQ ID NO: 76216 - DNA, 22 bp, Artificial Sequence
  Synthetic
accctctgaagcucaggtcaua

SEQ ID NO: 76217 - DNA, 23 bp, Artificial Sequence
  Synthetic
aggaacugtgcaagaugaccaag

SEQ ID NO: 76218 - DNA, 26 bp, Artificial Sequence
  Synthetic
agcatgtcctuaggttttacccatuc

SEQ ID NO: 76219 - DNA, 28 bp, Artificial Sequence
  Synthetic
actgctaacccauatgtcgtcttttuat

SEQ ID NO: 76220 - DNA, 28 bp, Artificial Sequence
  Synthetic
aaatgtctagcaaauccaaaaagugcaa

SEQ ID NO: 76221 - DNA, 19 bp, Artificial Sequence
  Synthetic
ggcugaagggcgagatgug

SEQ ID NO: 76222 - DNA, 20 bp, Artificial Sequence
  Synthetic
gcccuggtcaccuacaacac

SEQ ID NO: 76223 - DNA, 24 bp, Artificial Sequence
  Synthetic
ccuccccaccaaaaugagaaaact

SEQ ID NO: 76224 - DNA, 26 bp, Artificial Sequence
  Synthetic
tcagatttctcuctccttttccucct

SEQ ID NO: 76225 - DNA, 20 bp, Artificial Sequence
  Synthetic
ccattgguggcactctcgut

SEQ ID NO: 76226 - DNA, 21 bp, Artificial Sequence
  Synthetic
ccagacacaugtcctcccuga

SEQ ID NO: 76227 - DNA, 20 bp, Artificial Sequence
  Synthetic
gcaucgagcagggctcuaac

SEQ ID NO: 76228 - DNA, 20 bp, Artificial Sequence
  Synthetic
ccugtccttuggaccacacc

SEQ ID NO: 76229 - DNA, 24 bp, Artificial Sequence
  Synthetic
atcgcgttuaggcttcatgauact

SEQ ID NO: 76230 - DNA, 26 bp, Artificial Sequence
  Synthetic
actggtataaagutgagtgggcuaga

SEQ ID NO: 76231 - DNA, 28 bp, Artificial Sequence
  Synthetic
cctgaaactgtcutcatcctcaatguaa

SEQ ID NO: 76232 - DNA, 24 bp, Artificial Sequence
  Synthetic
agaatttgttaguggcctggaguc

SEQ ID NO: 76233 - DNA, 27 bp, Artificial Sequence
  Synthetic
atgaagtuggcaaaacagactgaatut

SEQ ID NO: 76234 - DNA, 20 bp, Artificial Sequence
  Synthetic
gtgagcctcuggaagtcguc

SEQ ID NO: 76235 - DNA, 21 bp, Artificial Sequence
  Synthetic
aatgtgtucccaccccttuca

SEQ ID NO: 76236 - DNA, 19 bp, Artificial Sequence
  Synthetic
tgtggcccggcuatgacua

SEQ ID NO: 76237 - DNA, 24 bp, Artificial Sequence
  Synthetic
gcctccutaaagaagtuccaccac

SEQ ID NO: 76238 - DNA, 20 bp, Artificial Sequence
  Synthetic
ctgttcccacccuggcatua

SEQ ID NO: 76239 - DNA, 22 bp, Artificial Sequence
  Synthetic
ggctggaauactgcuacaaccc

SEQ ID NO: 76240 - DNA, 17 bp, Artificial Sequence
  Synthetic
gggcgaugggttgaugg

SEQ ID NO: 76241 - DNA, 19 bp, Artificial Sequence
  Synthetic
tgcagcugcggatggauag

SEQ ID NO: 76242 - DNA, 18 bp, Artificial Sequence
  Synthetic
gggcgaugggttgauggg

SEQ ID NO: 76243 - DNA, 17 bp, Artificial Sequence
  Synthetic
cacutgcagcugcggat

SEQ ID NO: 76244 - DNA, 19 bp, Artificial Sequence
  Synthetic
gctgctccuctgggttgug

SEQ ID NO: 76245 - DNA, 19 bp, Artificial Sequence
  Synthetic
cccatggccucttctccug

SEQ ID NO: 76246 - DNA, 19 bp, Artificial Sequence
  Synthetic
cccgctcaguacggagtug

SEQ ID NO: 76247 - DNA, 20 bp, Artificial Sequence
  Synthetic
gcctauccccgggacuaaga

SEQ ID NO: 76248 - DNA, 20 bp, Artificial Sequence
  Synthetic
actcactgucgcctgcttuc

SEQ ID NO: 76249 - DNA, 20 bp, Artificial Sequence
  Synthetic
gatggcgtugttgatggcut

SEQ ID NO: 76250 - DNA, 23 bp, Artificial Sequence
  Synthetic
cgaaatgaugaagtcccacguga

SEQ ID NO: 76251 - DNA, 20 bp, Artificial Sequence
  Synthetic
ggcttgugcagctgguacat

SEQ ID NO: 76252 - DNA, 18 bp, Artificial Sequence
  Synthetic
aggtggucccggtcauca

SEQ ID NO: 76253 - DNA, 19 bp, Artificial Sequence
  Synthetic
agtctuggcagctgtugct

SEQ ID NO: 76254 - DNA, 23 bp, Artificial Sequence
  Synthetic
cctcccctgutcccattactcua

SEQ ID NO: 76255 - DNA, 23 bp, Artificial Sequence
  Synthetic
gaagttcaaaugcccttccagug

SEQ ID NO: 76256 - DNA, 24 bp, Artificial Sequence
  Synthetic
gaggaaaagcugctgtttcatugt

SEQ ID NO: 76257 - DNA, 28 bp, Artificial Sequence
  Synthetic
gatcgaatcttatutcttagcacccugt

SEQ ID NO: 76258 - DNA, 20 bp, Artificial Sequence
  Synthetic
ctcuccaaggccaagtuggt

SEQ ID NO: 76259 - DNA, 17 bp, Artificial Sequence
  Synthetic
tugagcgacagcccgut

SEQ ID NO: 76260 - DNA, 22 bp, Artificial Sequence
  Synthetic
ggtgtttgaccuggtgatgcut

SEQ ID NO: 76261 - DNA, 22 bp, Artificial Sequence
  Synthetic
gaatgtactcuggagcagcugt

SEQ ID NO: 76262 - DNA, 27 bp, Artificial Sequence
  Synthetic
ttccttttccuaagcaagacgttttug

SEQ ID NO: 76263 - DNA, 24 bp, Artificial Sequence
  Synthetic
caacttuagaaggcggaagctcua

SEQ ID NO: 76264 - DNA, 24 bp, Artificial Sequence
  Synthetic
ctcatctaccugaccaaccacauc

SEQ ID NO: 76265 - DNA, 24 bp, Artificial Sequence
  Synthetic
gcacttgtacaccutcatctgcuc

SEQ ID NO: 76266 - DNA, 22 bp, Artificial Sequence
  Synthetic
cattttucaaccagcgcagugt

SEQ ID NO: 76267 - DNA, 21 bp, Artificial Sequence
  Synthetic
tgcctgtcuctcttggcttuc

SEQ ID NO: 76268 - DNA, 24 bp, Artificial Sequence
  Synthetic
catctugtggtatctucaggagga

SEQ ID NO: 76269 - DNA, 28 bp, Artificial Sequence
  Synthetic
tgacgcttaatttucctttccaactcua

SEQ ID NO: 76270 - DNA, 21 bp, Artificial Sequence
  Synthetic
gcugatgtgtugaaggccaca

SEQ ID NO: 76271 - DNA, 23 bp, Artificial Sequence
  Synthetic
tcacattcacgaaguccccttut

SEQ ID NO: 76272 - DNA, 20 bp, Artificial Sequence
  Synthetic
tggtctcccugctcagtgua

SEQ ID NO: 76273 - DNA, 29 bp, Artificial Sequence
  Synthetic
tcttgttctucaggagatgattctgttut

SEQ ID NO: 76274 - DNA, 21 bp, Artificial Sequence
  Synthetic
ttgggcgaaugcagttttucc

SEQ ID NO: 76275 - DNA, 28 bp, Artificial Sequence
  Synthetic
actgatttgtgaauatgcctactgtuca

SEQ ID NO: 76276 - DNA, 22 bp, Artificial Sequence
  Synthetic
gtgaaaugcagcagccacuaaa

SEQ ID NO: 76277 - DNA, 21 bp, Artificial Sequence
  Synthetic
cagtcaaguggatggcuccag

SEQ ID NO: 76278 - DNA, 28 bp, Artificial Sequence
  Synthetic
tgagtgtatactcuatcaaacagggcut

SEQ ID NO: 76279 - DNA, 24 bp, Artificial Sequence
  Synthetic
agccctatugagcctgctaagaua

SEQ ID NO: 76280 - DNA, 19 bp, Artificial Sequence
  Synthetic
cgcccgagacucacactuc

SEQ ID NO: 76281 - DNA, 19 bp, Artificial Sequence
  Synthetic
ccgctggugacccactuac

SEQ ID NO: 76282 - DNA, 20 bp, Artificial Sequence
  Synthetic
catggtucgtaaggcauggg

SEQ ID NO: 76283 - DNA, 27 bp, Artificial Sequence
  Synthetic
tgacccaagaugaaataaaacgtcuct

SEQ ID NO: 76284 - DNA, 26 bp, Artificial Sequence
  Synthetic
ccattcttacugttctagcttgucct

SEQ ID NO: 76285 - DNA, 19 bp, Artificial Sequence
  Synthetic
cacaccuggccaagctuac

SEQ ID NO: 76286 - DNA, 24 bp, Artificial Sequence
  Synthetic
ccctaagtggcutatctgtgctut

SEQ ID NO: 76287 - DNA, 21 bp, Artificial Sequence
  Synthetic
cttcgctugggcttaaugagg

SEQ ID NO: 76288 - DNA, 21 bp, Artificial Sequence
  Synthetic
gccttggtgugcattcttcuc

SEQ ID NO: 76289 - DNA, 24 bp, Artificial Sequence
  Synthetic
cagagagggucatcagtgauacac

SEQ ID NO: 76290 - DNA, 24 bp, Artificial Sequence
  Synthetic
ttaccatagcuccaaacgtcacuc

SEQ ID NO: 76291 - DNA, 23 bp, Artificial Sequence
  Synthetic
gccagcccaaagacucacattua

SEQ ID NO: 76292 - DNA, 20 bp, Artificial Sequence
  Synthetic
agtttctgcugggacaggug

SEQ ID NO: 76293 - DNA, 21 bp, Artificial Sequence
  Synthetic
ctgcgcuctgctatctaucct

SEQ ID NO: 76294 - DNA, 20 bp, Artificial Sequence
  Synthetic
acagacgaugccacugacaa

SEQ ID NO: 76295 - DNA, 17 bp, Artificial Sequence
  Synthetic
gccgcuaccgcaccuac

SEQ ID NO: 76296 - DNA, 26 bp, Artificial Sequence
  Synthetic
cuatcacaaaaugaacggacagaacc

SEQ ID NO: 76297 - DNA, 21 bp, Artificial Sequence
  Synthetic
gctgacacgautggaggcuat

SEQ ID NO: 76298 - DNA, 24 bp, Artificial Sequence
  Synthetic
gcattgucagaagaaaccuggaag

SEQ ID NO: 76299 - DNA, 24 bp, Artificial Sequence
  Synthetic
tgtgaccagutgtguagaaagcaa

SEQ ID NO: 76300 - DNA, 17 bp, Artificial Sequence
  Synthetic
ggcugcccgctauccat

SEQ ID NO: 76301 - DNA, 21 bp, Artificial Sequence
  Synthetic
gggtacucacaggguaacggt

SEQ ID NO: 76302 - DNA, 22 bp, Artificial Sequence
  Synthetic
gaagcagggautcaaccuacct

SEQ ID NO: 76303 - DNA, 25 bp, Artificial Sequence
  Synthetic
tcagagacatuctcctcctacucac

SEQ ID NO: 76304 - DNA, 18 bp, Artificial Sequence
  Synthetic
cggccutctgccuaacgg

SEQ ID NO: 76305 - DNA, 22 bp, Artificial Sequence
  Synthetic
aggcctguccagaaatctcuga

SEQ ID NO: 76306 - DNA, 27 bp, Artificial Sequence
  Synthetic
cccaaacatcauccatctattagcugt

SEQ ID NO: 76307 - DNA, 24 bp, Artificial Sequence
  Synthetic
gagaaggaagaccuggcttgttua

SEQ ID NO: 76308 - DNA, 25 bp, Artificial Sequence
  Synthetic
attgattccuttccccacuaaagca

SEQ ID NO: 76309 - DNA, 18 bp, Artificial Sequence
  Synthetic
cctgacgcugacctgucc

SEQ ID NO: 76310 - DNA, 23 bp, Artificial Sequence
  Synthetic
ccatatggccuctggtagagtug

SEQ ID NO: 76311 - DNA, 22 bp, Artificial Sequence
  Synthetic
cuccagaaggcaggaaugaaga

SEQ ID NO: 76312 - DNA, 26 bp, Artificial Sequence
  Synthetic
agaagtgtugacaatgttttcuccca

SEQ ID NO: 76313 - DNA, 21 bp, Artificial Sequence
  Synthetic
aatggaggugccugacaaagt

SEQ ID NO: 76314 - DNA, 23 bp, Artificial Sequence
  Synthetic
gcttctccucctgcttgtcauag

SEQ ID NO: 76315 - DNA, 26 bp, Artificial Sequence
  Synthetic
tgttttccaacccugcatgtatcaua

SEQ ID NO: 76316 - DNA, 22 bp, Artificial Sequence
  Synthetic
ggtgtgtaggaugtgacacuca

SEQ ID NO: 76317 - DNA, 19 bp, Artificial Sequence
  Synthetic
ggatccaccuctggccuca

SEQ ID NO: 76318 - DNA, 20 bp, Artificial Sequence
  Synthetic
gtgcccaccuttctcccaua

SEQ ID NO: 76319 - DNA, 20 bp, Artificial Sequence
  Synthetic
gggtuccgaaagagctgguc

SEQ ID NO: 76320 - DNA, 25 bp, Artificial Sequence
  Synthetic
acagtaagggaaguatttggctgug

SEQ ID NO: 76321 - DNA, 25 bp, Artificial Sequence
  Synthetic
tctgcagttatutggtgagatgugt

SEQ ID NO: 76322 - DNA, 28 bp, Artificial Sequence
  Synthetic
tgtttggacaacgaguacagttttauct

SEQ ID NO: 76323 - DNA, 29 bp, Artificial Sequence
  Synthetic
gtttagagtcctcautggcacttactaug

SEQ ID NO: 76324 - DNA, 21 bp, Artificial Sequence
  Synthetic
ccataacacccaccuctgcut

SEQ ID NO: 76325 - DNA, 20 bp, Artificial Sequence
  Synthetic
cactgggcuccctgtctuac

SEQ ID NO: 76326 - DNA, 24 bp, Artificial Sequence
  Synthetic
gaaacucttcagctuccagaggaa

SEQ ID NO: 76327 - DNA, 28 bp, Artificial Sequence
  Synthetic
aactgtaccaagaucaatgggaattuga

SEQ ID NO: 76328 - DNA, 26 bp, Artificial Sequence
  Synthetic
ccgaccuagtgcatctttuaaaacaa

SEQ ID NO: 76329 - DNA, 29 bp, Artificial Sequence
  Synthetic
cataggcatucccagtacaaagtauacaa

SEQ ID NO: 76330 - DNA, 27 bp, Artificial Sequence
  Synthetic
acccatgaauaccagtgacuagaaaga

SEQ ID NO: 76331 - DNA, 27 bp, Artificial Sequence
  Synthetic
ccctaactcugagtcttgtttcuacag

SEQ ID NO: 76332 - DNA, 28 bp, Artificial Sequence
  Synthetic
aatgataacggcaucttggtaatctuct

SEQ ID NO: 76333 - DNA, 28 bp, Artificial Sequence
  Synthetic
actccagcactutggatattgacttuaa

SEQ ID NO: 76334 - DNA, 28 bp, Artificial Sequence
  Synthetic
gcttcagacttcucaatatcttccauga

SEQ ID NO: 76335 - DNA, 32 bp, Artificial Sequence
  Synthetic
actctagacacatauacaaacatacagcttug

SEQ ID NO: 76336 - DNA, 24 bp, Artificial Sequence
  Synthetic
acctagcaauggcacagaaatugt

SEQ ID NO: 76337 - DNA, 27 bp, Artificial Sequence
  Synthetic
gaccagtgctuacatttggttttguag

SEQ ID NO: 76338 - DNA, 28 bp, Artificial Sequence
  Synthetic
tcttcctttgtautgcctgtaaacucaa

SEQ ID NO: 76339 - DNA, 21 bp, Artificial Sequence
  Synthetic
ctcactcucatctgctgugct

SEQ ID NO: 76340 - DNA, 29 bp, Artificial Sequence
  Synthetic
caatacaggtttcucttgctttatgtugt

SEQ ID NO: 76341 - DNA, 28 bp, Artificial Sequence
  Synthetic
ctgatggtgautgttgaatacugcaaat

SEQ ID NO: 76342 - DNA, 19 bp, Artificial Sequence
  Synthetic
gcctctcccuccatgcuca

SEQ ID NO: 76343 - DNA, 20 bp, Artificial Sequence
  Synthetic
ggctctugatctcccugcaa

SEQ ID NO: 76344 - DNA, 21 bp, Artificial Sequence
  Synthetic
agtgatguccaccctgtucct

SEQ ID NO: 76345 - DNA, 23 bp, Artificial Sequence
  Synthetic
acctgtgatcucttccagaguct

SEQ ID NO: 76346 - DNA, 21 bp, Artificial Sequence
  Synthetic
tgagtuggcaacgctgaacua

SEQ ID NO: 76347 - DNA, 28 bp, Artificial Sequence
  Synthetic
ccatgccaacauattctacagtgttcut

SEQ ID NO: 76348 - DNA, 21 bp, Artificial Sequence
  Synthetic
cagagcagcuccaagtgttug

SEQ ID NO: 76349 - DNA, 26 bp, Artificial Sequence
  Synthetic
ccatgctgagaugtataggtaaccug

SEQ ID NO: 76350 - DNA, 27 bp, Artificial Sequence
  Synthetic
tcttgaggtagutggagagattuccat

SEQ ID NO: 76351 - DNA, 21 bp, Artificial Sequence
  Synthetic
ggtttcucaggcaggcugaag

SEQ ID NO: 76352 - DNA, 21 bp, Artificial Sequence
  Synthetic
cacagagcautcacacccuca

SEQ ID NO: 76353 - DNA, 20 bp, Artificial Sequence
  Synthetic
gggtaatcucacccctccut

SEQ ID NO: 76354 - DNA, 26 bp, Artificial Sequence
  Synthetic
acttcttaacagguggtttgttcugg

SEQ ID NO: 76355 - DNA, 24 bp, Artificial Sequence
  Synthetic
aattgcagtgaagugctgtgaaug

SEQ ID NO: 76356 - DNA, 26 bp, Artificial Sequence
  Synthetic
agattaagucccaaaatucccaggag

SEQ ID NO: 76357 - DNA, 28 bp, Artificial Sequence
  Synthetic
tgctccaccaacutagaacaatuaacaa

SEQ ID NO: 76358 - DNA, 29 bp, Artificial Sequence
  Synthetic
cctttgtctttgutctgcattttgucaat

SEQ ID NO: 76359 - DNA, 26 bp, Artificial Sequence
  Synthetic
actttaagcaugaacactcactccut

SEQ ID NO: 76360 - DNA, 21 bp, Artificial Sequence
  Synthetic
ccaccccauaugccacacaaa

SEQ ID NO: 76361 - DNA, 28 bp, Artificial Sequence
  Synthetic
tggtctaacacagcutcattcttctcua

SEQ ID NO: 76362 - DNA, 24 bp, Artificial Sequence
  Synthetic
gctaaccccucttaccttgactuc

SEQ ID NO: 76363 - DNA, 28 bp, Artificial Sequence
  Synthetic
gggacaacaatcutggctatgtagtuat

SEQ ID NO: 76364 - DNA, 24 bp, Artificial Sequence
  Synthetic
gtagaagagaugagtcaggtugct

SEQ ID NO: 76365 - DNA, 21 bp, Artificial Sequence
  Synthetic
tggagccuctaaggatcugct

SEQ ID NO: 76366 - DNA, 28 bp, Artificial Sequence
  Synthetic
tccaatatccccauttatagctgaguct

SEQ ID NO: 76367 - DNA, 21 bp, Artificial Sequence
  Synthetic
cgctggugaggauaacaacac

SEQ ID NO: 76368 - DNA, 26 bp, Artificial Sequence
  Synthetic
gcatgcttgcauactaaacggtttut

SEQ ID NO: 76369 - DNA, 28 bp, Artificial Sequence
  Synthetic
gcagaaccaagaautttauaagaacgca

SEQ ID NO: 76370 - DNA, 25 bp, Artificial Sequence
  Synthetic
gtaaatgguggtctaacttcugcgt

SEQ ID NO: 76371 - DNA, 25 bp, Artificial Sequence
  Synthetic
ttgcctcacguagagttgtaatcug

SEQ ID NO: 76372 - DNA, 22 bp, Artificial Sequence
  Synthetic
gaggcaucagaagugggaagag

SEQ ID NO: 76373 - DNA, 25 bp, Artificial Sequence
  Synthetic
ccgcagttuctcattgagguagaat

SEQ ID NO: 76374 - DNA, 25 bp, Artificial Sequence
  Synthetic
gggactccaagutttcagaaguaac

SEQ ID NO: 76375 - DNA, 26 bp, Artificial Sequence
  Synthetic
tctagccaggauagatggagauagga

SEQ ID NO: 76376 - DNA, 21 bp, Artificial Sequence
  Synthetic
acggacaccagcutcctctua

SEQ ID NO: 76377 - DNA, 21 bp, Artificial Sequence
  Synthetic
cgaaccgacutctctccguag

SEQ ID NO: 76378 - DNA, 28 bp, Artificial Sequence
  Synthetic
ttgagatcatctccuaactccctatguc

SEQ ID NO: 76379 - DNA, 28 bp, Artificial Sequence
  Synthetic
gtacatcaggguactttgaacatuccat

SEQ ID NO: 76380 - DNA, 22 bp, Artificial Sequence
  Synthetic
gtctttaggcaggugtgtguga

SEQ ID NO: 76381 - DNA, 22 bp, Artificial Sequence
  Synthetic
guccgaggaggacaatgucaag

SEQ ID NO: 76382 - DNA, 20 bp, Artificial Sequence
  Synthetic
tguctgccgtugaagagagg

SEQ ID NO: 76383 - DNA, 24 bp, Artificial Sequence
  Synthetic
ccttctcagauggagccaggatua

SEQ ID NO: 76384 - DNA, 21 bp, Artificial Sequence
  Synthetic
ggtcaggtgguggcagtagua

SEQ ID NO: 76385 - DNA, 28 bp, Artificial Sequence
  Synthetic
aggaagtatggcucccaaagattauaga

SEQ ID NO: 76386 - DNA, 27 bp, Artificial Sequence
  Synthetic
tcttgttttggtaauctacagcctgut

SEQ ID NO: 76387 - DNA, 21 bp, Artificial Sequence
  Synthetic
cgtgttucggaatgtccucac

SEQ ID NO: 76388 - DNA, 20 bp, Artificial Sequence
  Synthetic
caccaccutgtcccuagacc

SEQ ID NO: 76389 - DNA, 26 bp, Artificial Sequence
  Synthetic
gtagcatctcuaccccaaaactgtut

SEQ ID NO: 76390 - DNA, 23 bp, Artificial Sequence
  Synthetic
ccagtcauccagaactucagcag

SEQ ID NO: 76391 - DNA, 28 bp, Artificial Sequence
  Synthetic
tgtctgagtgttutgttttggttttcut

SEQ ID NO: 76392 - DNA, 24 bp, Artificial Sequence
  Synthetic
ccagccagautatcctttcugagt

SEQ ID NO: 76393 - DNA, 18 bp, Artificial Sequence
  Synthetic
tcaguggcggttctgugg

SEQ ID NO: 76394 - DNA, 23 bp, Artificial Sequence
  Synthetic
tctccutgcatctcuaccacaga

SEQ ID NO: 76395 - DNA, 31 bp, Artificial Sequence
  Synthetic
tgaattgttctttuagtagtcactacgtugt

SEQ ID NO: 76396 - DNA, 20 bp, Artificial Sequence
  Synthetic
ggtcgccugttttgguaggt

SEQ ID NO: 76397 - DNA, 28 bp, Artificial Sequence
  Synthetic
aatttgtaataugggcgcataacatgug

SEQ ID NO: 76398 - DNA, 25 bp, Artificial Sequence
  Synthetic
ttctagaaaacuggtatcugcaggt

SEQ ID NO: 76399 - DNA, 25 bp, Artificial Sequence
  Synthetic
atcatgcatcuccaaactcaacuca

SEQ ID NO: 76400 - DNA, 18 bp, Artificial Sequence
  Synthetic
cgguccgaaagctgcgua

SEQ ID NO: 76401 - DNA, 28 bp, Artificial Sequence
  Synthetic
agcaatttcttacuctctctgcaagtut

SEQ ID NO: 76402 - DNA, 19 bp, Artificial Sequence
  Synthetic
ccggtcagguttcggtgua

SEQ ID NO: 76403 - DNA, 23 bp, Artificial Sequence
  Synthetic
ctcttcttttgucccctggguag

SEQ ID NO: 76404 - DNA, 25 bp, Artificial Sequence
  Synthetic
acaaagtauctcgtgacugggaaga

SEQ ID NO: 76405 - DNA, 28 bp, Artificial Sequence
  Synthetic
cagttcggaaugcactaaattcagttut

SEQ ID NO: 76406 - DNA, 26 bp, Artificial Sequence
  Synthetic
cctgauggtggaataucacaagaaca

SEQ ID NO: 76407 - DNA, 26 bp, Artificial Sequence
  Synthetic
gtgtcgagcaguactctaaacaugag

SEQ ID NO: 76408 - DNA, 22 bp, Artificial Sequence
  Synthetic
caaactagcccucaatcccuga

SEQ ID NO: 76409 - DNA, 18 bp, Artificial Sequence
  Synthetic
cagcaguctccgcaucgt

SEQ ID NO: 76410 - DNA, 25 bp, Artificial Sequence
  Synthetic
aatgagugagaaagcacatctguca

SEQ ID NO: 76411 - DNA, 24 bp, Artificial Sequence
  Synthetic
agagautacatatccugggcaggt

SEQ ID NO: 76412 - DNA, 21 bp, Artificial Sequence
  Synthetic
gcagcagaagauccggaagua

SEQ ID NO: 76413 - DNA, 18 bp, Artificial Sequence
  Synthetic
catcgcuccgctaggugt

SEQ ID NO: 76414 - DNA, 23 bp, Artificial Sequence
  Synthetic
tttgttgctgugacttccccaua

SEQ ID NO: 76415 - DNA, 27 bp, Artificial Sequence
  Synthetic
tcgtcacaaguccacaatgtagaauag

SEQ ID NO: 76416 - DNA, 23 bp, Artificial Sequence
  Synthetic
ccaggaacccutttatggctuca

SEQ ID NO: 76417 - DNA, 27 bp, Artificial Sequence
  Synthetic
atgacagctcaccugtctaaattctut

SEQ ID NO: 76418 - DNA, 27 bp, Artificial Sequence
  Synthetic
acgtggagtaauacacctatgaagugt

SEQ ID NO: 76419 - DNA, 26 bp, Artificial Sequence
  Synthetic
gacttcaucccatacctaguagacca

SEQ ID NO: 76420 - DNA, 23 bp, Artificial Sequence
  Synthetic
agagctggacautgaggtctuct

SEQ ID NO: 76421 - DNA, 25 bp, Artificial Sequence
  Synthetic
tcagtgtcacagugttctttgugaa

SEQ ID NO: 76422 - DNA, 18 bp, Artificial Sequence
  Synthetic
tcccccauccugggacaa

SEQ ID NO: 76423 - DNA, 22 bp, Artificial Sequence
  Synthetic
acctgttgugctcactgctuag

SEQ ID NO: 76424 - DNA, 26 bp, Artificial Sequence
  Synthetic
ccgtatttccggutactgagacttug

SEQ ID NO: 76425 - DNA, 24 bp, Artificial Sequence
  Synthetic
tcctccccacauacaccatgtaut

SEQ ID NO: 76426 - DNA, 25 bp, Artificial Sequence
  Synthetic
ctattacatcacuggtgcgtugact

SEQ ID NO: 76427 - DNA, 21 bp, Artificial Sequence
  Synthetic
gctccacaaaagcugagtugg

SEQ ID NO: 76428 - DNA, 22 bp, Artificial Sequence
  Synthetic
gcgaagcaccagaaaucaugga

SEQ ID NO: 76429 - DNA, 18 bp, Artificial Sequence
  Synthetic
tcuccacacaggccucct

SEQ ID NO: 76430 - DNA, 22 bp, Artificial Sequence
  Synthetic
cctctctuaacccccttcccua

SEQ ID NO: 76431 - DNA, 26 bp, Artificial Sequence
  Synthetic
tgatgaagatgaucgggaagcauaag

SEQ ID NO: 76432 - DNA, 21 bp, Artificial Sequence
  Synthetic
cccacaugcagattcccauct

SEQ ID NO: 76433 - DNA, 24 bp, Artificial Sequence
  Synthetic
cgcatatggtauccctcaaccuac

SEQ ID NO: 76434 - DNA, 28 bp, Artificial Sequence
  Synthetic
catttaatuaccctacaggugagagcaa

SEQ ID NO: 76435 - DNA, 21 bp, Artificial Sequence
  Synthetic
ccctccutggtaacugagacc

SEQ ID NO: 76436 - DNA, 18 bp, Artificial Sequence
  Synthetic
gtcugaggagcccgtguc

SEQ ID NO: 76437 - DNA, 21 bp, Artificial Sequence
  Synthetic
tgcaggtgucgaaggaguagt

SEQ ID NO: 76438 - DNA, 19 bp, Artificial Sequence
  Synthetic
gggtaaccugcgggagtut

SEQ ID NO: 76439 - DNA, 21 bp, Artificial Sequence
  Synthetic
cttcugggaggccaagtacuc

SEQ ID NO: 76440 - DNA, 22 bp, Artificial Sequence
  Synthetic
cccccagcaggutgatgataut

SEQ ID NO: 76441 - DNA, 28 bp, Artificial Sequence
  Synthetic
caagtaaatgaguctcaacgtgttctut

SEQ ID NO: 76442 - DNA, 17 bp, Artificial Sequence
  Synthetic
cctgggagucccccuca

SEQ ID NO: 76443 - DNA, 21 bp, Artificial Sequence
  Synthetic
ctgatcccauccctccttucc

SEQ ID NO: 76444 - DNA, 19 bp, Artificial Sequence
  Synthetic
tggtgtccugtgccuacca

SEQ ID NO: 76445 - DNA, 18 bp, Artificial Sequence
  Synthetic
gcagggcugaagcctcuc

SEQ ID NO: 76446 - DNA, 24 bp, Artificial Sequence
  Synthetic
caaggaauttgaugggaagagcct

SEQ ID NO: 76447 - DNA, 25 bp, Artificial Sequence
  Synthetic
cagaatggctuaccttctcaaccut

SEQ ID NO: 76448 - DNA, 21 bp, Artificial Sequence
  Synthetic
gggugccagaaccacttgaut

SEQ ID NO: 76449 - DNA, 23 bp, Artificial Sequence
  Synthetic
cccgttctucatctccttuccag

SEQ ID NO: 76450 - DNA, 28 bp, Artificial Sequence
  Synthetic
tctgcaagcucatgaaagaaatctuaga

SEQ ID NO: 76451 - DNA, 23 bp, Artificial Sequence
  Synthetic
aggcaagaaggcaugaaacagua

SEQ ID NO: 76452 - DNA, 27 bp, Artificial Sequence
  Synthetic
agcatuaaaacaaggaaagcaaagugg

SEQ ID NO: 76453 - DNA, 27 bp, Artificial Sequence
  Synthetic
acctctuccatcaaatgtucacagaaa

SEQ ID NO: 76454 - DNA, 29 bp, Artificial Sequence
  Synthetic
gagaaaagaaagagacaugcatgaacaut

SEQ ID NO: 76455 - DNA, 21 bp, Artificial Sequence
  Synthetic
gtactuccagaccagggtgut

SEQ ID NO: 76456 - DNA, 17 bp, Artificial Sequence
  Synthetic
ccugcccttugcccaac

SEQ ID NO: 76457 - DNA, 22 bp, Artificial Sequence
  Synthetic
gguagagcacatugggcacaaa

SEQ ID NO: 76458 - DNA, 22 bp, Artificial Sequence
  Synthetic
ggcaggagucaugggagaaaac

SEQ ID NO: 76459 - DNA, 27 bp, Artificial Sequence
  Synthetic
aaatgttctgtuctccttcacttucca

SEQ ID NO: 76460 - DNA, 20 bp, Artificial Sequence
  Synthetic
ccacccgugtccttcttcua

SEQ ID NO: 76461 - DNA, 23 bp, Artificial Sequence
  Synthetic
cctttgtucttccctcuccacag

SEQ ID NO: 76462 - DNA, 22 bp, Artificial Sequence
  Synthetic
acagtcaccccaaucaccuaca

SEQ ID NO: 76463 - DNA, 27 bp, Artificial Sequence
  Synthetic
tgaaagaagaccaaacugagtactugg

SEQ ID NO: 76464 - DNA, 22 bp, Artificial Sequence
  Synthetic
gcacagcagauactgccaatut

SEQ ID NO: 76465 - DNA, 24 bp, Artificial Sequence
  Synthetic
aatcccttggagutgatgtcaguc

SEQ ID NO: 76466 - DNA, 19 bp, Artificial Sequence
  Synthetic
ggagccgggcagutactua

SEQ ID NO: 76467 - DNA, 28 bp, Artificial Sequence
  Synthetic
cacatccauggaatatgttctttugcat

SEQ ID NO: 76468 - DNA, 29 bp, Artificial Sequence
  Synthetic
cttcacaatcucctttattcttcgtucct

SEQ ID NO: 76469 - DNA, 28 bp, Artificial Sequence
  Synthetic
ggcgttgagcacuaaattgaatgtatua

SEQ ID NO: 76470 - DNA, 23 bp, Artificial Sequence
  Synthetic
ggagaggagaagugtagggctua

SEQ ID NO: 76471 - DNA, 26 bp, Artificial Sequence
  Synthetic
ctccaattccacuatttaccccucag

SEQ ID NO: 76472 - DNA, 24 bp, Artificial Sequence
  Synthetic
cgtagtgaaaaucctccagacugt

SEQ ID NO: 76473 - DNA, 27 bp, Artificial Sequence
  Synthetic
gaccatgacagagautacgaagaugaa

SEQ ID NO: 76474 - DNA, 27 bp, Artificial Sequence
  Synthetic
tcugccttgauaaaggaaaccaaagaa

SEQ ID NO: 76475 - DNA, 28 bp, Artificial Sequence
  Synthetic
catcaaaacuactttctggucagagaga

SEQ ID NO: 76476 - DNA, 29 bp, Artificial Sequence
  Synthetic
tccagcattttcauctttcttcatcauct

SEQ ID NO: 76477 - DNA, 25 bp, Artificial Sequence
  Synthetic
acagaagtcagaauctccacgtgua

SEQ ID NO: 76478 - DNA, 24 bp, Artificial Sequence
  Synthetic
gtccaaaagugttaaugcccaagt

SEQ ID NO: 76479 - DNA, 28 bp, Artificial Sequence
  Synthetic
ttcactgtaatcuctggatgttttgugt

SEQ ID NO: 76480 - DNA, 23 bp, Artificial Sequence
  Synthetic
cactccatgucctcgtttacugg

SEQ ID NO: 76481 - DNA, 26 bp, Artificial Sequence
  Synthetic
ccctcactgaaccuctgcatatttut

SEQ ID NO: 76482 - DNA, 21 bp, Artificial Sequence
  Synthetic
cgtgatccugctgaacaugga

SEQ ID NO: 76483 - DNA, 24 bp, Artificial Sequence
  Synthetic
cacatgcgucactttctttttgug

SEQ ID NO: 76484 - DNA, 21 bp, Artificial Sequence
  Synthetic
ccaagacuccaaagcccagua

SEQ ID NO: 76485 - DNA, 21 bp, Artificial Sequence
  Synthetic
gttcagccauccagaaugggt

SEQ ID NO: 76486 - DNA, 24 bp, Artificial Sequence
  Synthetic
cttttggaaacagcuccaggttut

SEQ ID NO: 76487 - DNA, 24 bp, Artificial Sequence
  Synthetic
ctgaataagatugaagcggctcug

SEQ ID NO: 76488 - DNA, 26 bp, Artificial Sequence
  Synthetic
tgatgtgtaatuacgaaacccugacc

SEQ ID NO: 76489 - DNA, 28 bp, Artificial Sequence
  Synthetic
gaatactgttgcuatggtgatcttcuca

SEQ ID NO: 76490 - DNA, 20 bp, Artificial Sequence
  Synthetic
cctacccutcaccaggucca

SEQ ID NO: 76491 - DNA, 19 bp, Artificial Sequence
  Synthetic
cccccacaguagcttucca

SEQ ID NO: 76492 - DNA, 19 bp, Artificial Sequence
  Synthetic
ccaccugaaccgagctcut

SEQ ID NO: 76493 - DNA, 21 bp, Artificial Sequence
  Synthetic
gcgcaggucccaaatttucac

SEQ ID NO: 76494 - DNA, 19 bp, Artificial Sequence
  Synthetic
ggagggaggucagggacua

SEQ ID NO: 76495 - DNA, 21 bp, Artificial Sequence
  Synthetic
actgcccucatctctcuccag

SEQ ID NO: 76496 - DNA, 21 bp, Artificial Sequence
  Synthetic
gccgcacuctagtaagtggut

SEQ ID NO: 76497 - DNA, 25 bp, Artificial Sequence
  Synthetic
aacaactgcttuaacagctgcttut

SEQ ID NO: 76498 - DNA, 22 bp, Artificial Sequence
  Synthetic
ctccttcttgaucctggtggug

SEQ ID NO: 76499 - DNA, 19 bp, Artificial Sequence
  Synthetic
acccagcuggtccucaaag

SEQ ID NO: 76500 - DNA, 21 bp, Artificial Sequence
  Synthetic
cccgugtcctgtucaaacact

SEQ ID NO: 76501 - DNA, 28 bp, Artificial Sequence
  Synthetic
tcatcacacaatcuacatcttctgcaut

SEQ ID NO: 76502 - DNA, 20 bp, Artificial Sequence
  Synthetic
ggctgacggguttcctctuc

SEQ ID NO: 76503 - DNA, 21 bp, Artificial Sequence
  Synthetic
aatggacguggauagcagcaa

SEQ ID NO: 76504 - DNA, 28 bp, Artificial Sequence
  Synthetic
gtccaagtccugtgaaatttttctctut

SEQ ID NO: 76505 - DNA, 28 bp, Artificial Sequence
  Synthetic
tgaaataacagtutgctttgtgtaugcc

SEQ ID NO: 76506 - DNA, 28 bp, Artificial Sequence
  Synthetic
ttgcagttaagugattatatgggaugag

SEQ ID NO: 76507 - DNA, 28 bp, Artificial Sequence
  Synthetic
acctttagccuccaattatctcctacut

SEQ ID NO: 76508 - DNA, 28 bp, Artificial Sequence
  Synthetic
gcagagatccugcatattttgaugaaaa

SEQ ID NO: 76509 - DNA, 24 bp, Artificial Sequence
  Synthetic
cttctaaagcucactggacacauc

SEQ ID NO: 76510 - DNA, 21 bp, Artificial Sequence
  Synthetic
cacagacaggutctggtuggt

SEQ ID NO: 76511 - DNA, 26 bp, Artificial Sequence
  Synthetic
cagagtgtccuttttgtgagaagaug

SEQ ID NO: 76512 - DNA, 27 bp, Artificial Sequence
  Synthetic
gttctaatcuaaaggctgtcuaaccaa

SEQ ID NO: 76513 - DNA, 22 bp, Artificial Sequence
  Synthetic
gacgtgtggucttacggaguat

SEQ ID NO: 76514 - DNA, 24 bp, Artificial Sequence
  Synthetic
cagacaaagcccauttttctucca

SEQ ID NO: 76515 - DNA, 21 bp, Artificial Sequence
  Synthetic
accacaguaggccccaattuc

SEQ ID NO: 76516 - DNA, 18 bp, Artificial Sequence
  Synthetic
ccugcuggagagccaagt

SEQ ID NO: 76517 - DNA, 18 bp, Artificial Sequence
  Synthetic
agctgagacccugccuga

SEQ ID NO: 76518 - DNA, 22 bp, Artificial Sequence
  Synthetic
cacagccuccgtagaucaaaca

SEQ ID NO: 76519 - DNA, 24 bp, Artificial Sequence
  Synthetic
ggagagatgagguctgggatauca

SEQ ID NO: 76520 - DNA, 22 bp, Artificial Sequence
  Synthetic
attttccacugctctugaggct

SEQ ID NO: 76521 - DNA, 20 bp, Artificial Sequence
  Synthetic
ggcgccucagagctatuacc

SEQ ID NO: 76522 - DNA, 21 bp, Artificial Sequence
  Synthetic
ggagucaccaggaaccgttua

SEQ ID NO: 76523 - DNA, 23 bp, Artificial Sequence
  Synthetic
cctctccctutcctctgttcuct

SEQ ID NO: 76524 - DNA, 21 bp, Artificial Sequence
  Synthetic
cgcttcuccaagtccccatug

SEQ ID NO: 76525 - DNA, 28 bp, Artificial Sequence
  Synthetic
accctcctctugtgtatctttctuacat

SEQ ID NO: 76526 - DNA, 22 bp, Artificial Sequence
  Synthetic
accaccugcatucaggaaaagt

SEQ ID NO: 76527 - DNA, 28 bp, Artificial Sequence
  Synthetic
gctgtaaattcuggcttataaggtgtuc

SEQ ID NO: 76528 - DNA, 24 bp, Artificial Sequence
  Synthetic
cuaaggagaagattucccacagca

SEQ ID NO: 76529 - DNA, 23 bp, Artificial Sequence
  Synthetic
gttttcaugcccttctgcucaag

SEQ ID NO: 76530 - DNA, 32 bp, Artificial Sequence; identical to SEQ ID NO: 4488
  Synthetic

SEQ ID NO: 76531 - DNA, 26 bp, Artificial Sequence
  Synthetic
tgacaccucgacatttgaaucagaag

SEQ ID NO: 76532 - DNA, 25 bp, Artificial Sequence
  Synthetic
gttttgattucaccctctcctcuct

SEQ ID NO: 76533 - DNA, 22 bp, Artificial Sequence
  Synthetic
gtaguagagcccacaggcatug

SEQ ID NO: 76534 - DNA, 22 bp, Artificial Sequence
  Synthetic
cactgctuaaaggaagcgctut

SEQ ID NO: 76535 - DNA, 23 bp, Artificial Sequence
  Synthetic
gcccaagaggcugtagtugaaat

SEQ ID NO: 76536 - DNA, 20 bp, Artificial Sequence
  Synthetic
ctgactgcugtgacccacuc

SEQ ID NO: 76537 - DNA, 20 bp, Artificial Sequence
  Synthetic
ttgcacttguccacgcatuc

SEQ ID NO: 76538 - DNA, 23 bp, Artificial Sequence
  Synthetic
atgatccuctctctucccccaat

SEQ ID NO: 76539 - DNA, 25 bp, Artificial Sequence
  Synthetic
ctgagccacauagactacatccauc

SEQ ID NO: 76540 - DNA, 21 bp, Artificial Sequence
  Synthetic
cgtctctugccggaatgucag

SEQ ID NO: 76541 - DNA, 28 bp, Artificial Sequence
  Synthetic
acagaatgccugtaaagctauaacaaca

SEQ ID NO: 76542 - DNA, 22 bp, Artificial Sequence
  Synthetic
ctctggaggaggaaugccaaug

SEQ ID NO: 76543 - DNA, 21 bp, Artificial Sequence
  Synthetic
tttgctggucaccaucaggaa

SEQ ID NO: 76544 - DNA, 21 bp, Artificial Sequence
  Synthetic
ggccgcuagctttucagacat

SEQ ID NO: 76545 - DNA, 21 bp, Artificial Sequence
  Synthetic
gaggctugagcaaaugaggga

SEQ ID NO: 76546 - DNA, 24 bp, Artificial Sequence
  Synthetic
tccatttcugaaacaggcatguca

SEQ ID NO: 76547 - DNA, 24 bp, Artificial Sequence
  Synthetic
tgatgcucatgtctttuccaccag

SEQ ID NO: 76548 - DNA, 26 bp, Artificial Sequence
  Synthetic
cgaaagttgugtaactgtgtttucca

SEQ ID NO: 76549 - DNA, 25 bp, Artificial Sequence
  Synthetic
agtgtaagtgugaacaccacaauct

SEQ ID NO: 76550 - DNA, 21 bp, Artificial Sequence
  Synthetic
cagaaagcaccgaugctcuga

SEQ ID NO: 76551 - DNA, 28 bp, Artificial Sequence
  Synthetic
caaatgcttuggaagaagtctctatuga

SEQ ID NO: 76552 - DNA, 29 bp, Artificial Sequence
  Synthetic
aaggttccaatugctcttttgtttacauc

SEQ ID NO: 76553 - DNA, 28 bp, Artificial Sequence
  Synthetic
aattgtctgagaaggaucgaatgcttua

SEQ ID NO: 76554 - DNA, 24 bp, Artificial Sequence
  Synthetic
tutagaattctcugcagcacccaa

SEQ ID NO: 76555 - DNA, 22 bp, Artificial Sequence
  Synthetic
acagggcccaguaaatctcuca

SEQ ID NO: 76556 - DNA, 28 bp, Artificial Sequence
  Synthetic
caggtaagctgugtgatattaaccgtua

SEQ ID NO: 76557 - DNA, 25 bp, Artificial Sequence
  Synthetic
tgagcacatgucaagagcaaatcut

SEQ ID NO: 76558 - DNA, 27 bp, Artificial Sequence
  Synthetic
gggttctttatcuctctctctttcuca

SEQ ID NO: 76559 - DNA, 26 bp, Artificial Sequence
  Synthetic
ccacacagctauctcataaggtcuca

SEQ ID NO: 76560 - DNA, 27 bp, Artificial Sequence
  Synthetic
tttggagacaaaaccuattcacagcua

SEQ ID NO: 76561 - DNA, 24 bp, Artificial Sequence
  Synthetic
gttccagaacucctcggttatuct

SEQ ID NO: 76562 - DNA, 22 bp, Artificial Sequence
  Synthetic
catgaagccagccucaattguc

SEQ ID NO: 76563 - DNA, 28 bp, Artificial Sequence
  Synthetic
actaggatgatuggagtgttgtgtttut

SEQ ID NO: 76564 - DNA, 19 bp, Artificial Sequence
  Synthetic
tccacacccccucuaggac

SEQ ID NO: 76565 - DNA, 22 bp, Artificial Sequence
  Synthetic
gctgugggaagaugccagaaaa

SEQ ID NO: 76566 - DNA, 24 bp, Artificial Sequence
  Synthetic
gccaccugaatacaggttaucagt

SEQ ID NO: 76567 - DNA, 23 bp, Artificial Sequence
  Synthetic
catctattgcuggcaccatcuga

SEQ ID NO: 76568 - DNA, 27 bp, Artificial Sequence
  Synthetic
cagtacguaccagcgatgaatctttua

SEQ ID NO: 76569 - DNA, 25 bp, Artificial Sequence
  Synthetic
aggaagaagatutctctccccaugt

SEQ ID NO: 76570 - DNA, 27 bp, Artificial Sequence
  Synthetic
ctcacaatgacagucacctgataucaa

SEQ ID NO: 76571 - DNA, 25 bp, Artificial Sequence
  Synthetic
cggtgtgggaguattagattggaug

SEQ ID NO: 76572 - DNA, 21 bp, Artificial Sequence
  Synthetic
gtcttgccacacauccctuca

SEQ ID NO: 76573 - DNA, 28 bp, Artificial Sequence
  Synthetic
gttaataatcacaucctgcttcacucac

SEQ ID NO: 76574 - DNA, 25 bp, Artificial Sequence
  Synthetic
agtcgactagaugggaatacaugat

SEQ ID NO: 76575 - DNA, 24 bp, Artificial Sequence
  Synthetic
ttttuccagaaccgaauggaggaa

SEQ ID NO: 76576 - DNA, 21 bp, Artificial Sequence
  Synthetic
ccagaggcagacuacagcuga

SEQ ID NO: 76577 - DNA, 27 bp, Artificial Sequence
  Synthetic
gtgaccatgaugagaagtcucacaaat

SEQ ID NO: 76578 - DNA, 30 bp, Artificial Sequence
  Synthetic
acatgaacagaaacutgaaacaaaatucca

SEQ ID NO: 76579 - DNA, 24 bp, Artificial Sequence
  Synthetic
gtcttuaagcacagctcccugaat

SEQ ID NO: 76580 - DNA, 28 bp, Artificial Sequence
  Synthetic
gagacacaaatagutggcaaattgaugt

SEQ ID NO: 76581 - DNA, 22 bp, Artificial Sequence
  Synthetic
tttggaaagagggcucagaguc

SEQ ID NO: 76582 - DNA, 28 bp, Artificial Sequence
  Synthetic
ggtattcctccacutacctgttttguaa

SEQ ID NO: 76583 - DNA, 21 bp, Artificial Sequence
  Synthetic
cagggacagugtacgaagcug

SEQ ID NO: 76584 - DNA, 28 bp, Artificial Sequence
  Synthetic
tgaattcatttttcugcacaggatctut

SEQ ID NO: 76585 - DNA, 25 bp, Artificial Sequence
  Synthetic
ttctgtaguctactttguccccagt

SEQ ID NO: 76586 - DNA, 22 bp, Artificial Sequence
  Synthetic
gcagtatggcagutccttggut

SEQ ID NO: 76587 - DNA, 21 bp, Artificial Sequence
  Synthetic
cctgaggugttttuggaggca

SEQ ID NO: 76588 - DNA, 28 bp, Artificial Sequence
  Synthetic
ataatccautgcctgtcuaaagaacact

SEQ ID NO: 76589 - DNA, 22 bp, Artificial Sequence
  Synthetic
ttgcagaauggtcgatguaggg

SEQ ID NO: 76590 - DNA, 20 bp, Artificial Sequence
  Synthetic
ggtggcccaaaguaaagcug

SEQ ID NO: 76591 - DNA, 26 bp, Artificial Sequence
  Synthetic
ttctgcccautcatcttgtgauagag

SEQ ID NO: 76592 - DNA, 24 bp, Artificial Sequence
  Synthetic
aagcagauacatccactuccacag

SEQ ID NO: 76593 - DNA, 26 bp, Artificial Sequence
  Synthetic
ccttagaccugcagttttcatgaaut

SEQ ID NO: 76594 - DNA, 23 bp, Artificial Sequence
  Synthetic
caggtatugcagttctguaggca

SEQ ID NO: 76595 - DNA, 21 bp, Artificial Sequence
  Synthetic
ccacuttctcugccaccaagt

SEQ ID NO: 76596 - DNA, 21 bp, Artificial Sequence
  Synthetic
acaggccacuacctaugcaac

SEQ ID NO: 76597 - DNA, 28 bp, Artificial Sequence
  Synthetic
tcctatataaugggaagatgtggctuct

SEQ ID NO: 76598 - DNA, 20 bp, Artificial Sequence
  Synthetic
ggcccuccccttctccatua

SEQ ID NO: 76599 - DNA, 23 bp, Artificial Sequence
  Synthetic
actcttccutgcttcucacacag

SEQ ID NO: 76600 - DNA, 22 bp, Artificial Sequence
  Synthetic
ccgtctctuccactgaaagugt

SEQ ID NO: 76601 - DNA, 22 bp, Artificial Sequence
  Synthetic
agtttgtuccaggctgttcucc

SEQ ID NO: 76602 - DNA, 20 bp, Artificial Sequence
  Synthetic
cctgccuggatcagtgcuac

SEQ ID NO: 76603 - DNA, 21 bp, Artificial Sequence
  Synthetic
ggtggcucatgccttucaaga

SEQ ID NO: 76604 - DNA, 28 bp, Artificial Sequence
  Synthetic
ttcatatttgttttugatgtccccctug

SEQ ID NO: 76605 - DNA, 25 bp, Artificial Sequence
  Synthetic
acgtcgatcgucctcaattcauaag

SEQ ID NO: 76606 - DNA, 28 bp, Artificial Sequence
  Synthetic
gtgctggagucattaactuagaagagaa

SEQ ID NO: 76607 - DNA, 23 bp, Artificial Sequence
  Synthetic
agacgctgatucagcatactgug

SEQ ID NO: 76608 - DNA, 28 bp, Artificial Sequence
  Synthetic
cattaagagguagaacacagtatgcuga

SEQ ID NO: 76609 - DNA, 28 bp, Artificial Sequence
  Synthetic
aagtctggttucatgttgtctcuacaaa

SEQ ID NO: 76610 - DNA, 21 bp, Artificial Sequence
  Synthetic
gctactguccccauagggaga

SEQ ID NO: 76611 - DNA, 28 bp, Artificial Sequence
  Synthetic
caccacttcagautactcagttcactua

SEQ ID NO: 76612 - DNA, 22 bp, Artificial Sequence
  Synthetic
cttttagcaggguggagagugt

SEQ ID NO: 76613 - DNA, 23 bp, Artificial Sequence
  Synthetic
ctttcccuttgtagagucagcgt

SEQ ID NO: 76614 - DNA, 23 bp, Artificial Sequence
  Synthetic
tggtgtuggcttttattcugcct

SEQ ID NO: 76615 - DNA, 28 bp, Artificial Sequence
  Synthetic
ccaactacctugtaacagaaaagcuaac

SEQ ID NO: 76616 - DNA, 27 bp, Artificial Sequence
  Synthetic
ggtgaagtcutgtaatcaacucaagca

SEQ ID NO: 76617 - DNA, 27 bp, Artificial Sequence
  Synthetic
ccttttgctaagautccacacttucct

SEQ ID NO: 76618 - DNA, 20 bp, Artificial Sequence
  Synthetic
gagaguaccccugcaggaga

SEQ ID NO: 76619 - DNA, 20 bp, Artificial Sequence
  Synthetic
tcccacugggaagcagagua

SEQ ID NO: 76620 - DNA, 20 bp, Artificial Sequence
  Synthetic
acctcuccagagcgtgtgua

SEQ ID NO: 76621 - DNA, 25 bp, Artificial Sequence
  Synthetic
agatcgaggugcctcttctattuct

SEQ ID NO: 76622 - DNA, 25 bp, Artificial Sequence
  Synthetic
gaataagcagtuctcccacactuct

SEQ ID NO: 76623 - DNA, 23 bp, Artificial Sequence
  Synthetic
ttatctcgtugcatggctctuca

SEQ ID NO: 76624 - DNA, 20 bp, Artificial Sequence
  Synthetic
gagcgcuctaggttgcugat

SEQ ID NO: 76625 - DNA, 29 bp, Artificial Sequence
  Synthetic
ctcagttgaaccuccgtatauaagaaagt

SEQ ID NO: 76626 - DNA, 21 bp, Artificial Sequence
  Synthetic
cagaagagcgagauccgagut

SEQ ID NO: 76627 - DNA, 22 bp, Artificial Sequence
  Synthetic
cctcatgaucacagcctcctuc

SEQ ID NO: 76628 - DNA, 23 bp, Artificial Sequence
  Synthetic
agccccgacuccttactttuact

SEQ ID NO: 76629 - DNA, 28 bp, Artificial Sequence
  Synthetic
caaatgacccacucagaaagagtagaut

SEQ ID NO: 76630 - DNA, 23 bp, Artificial Sequence
  Synthetic
gacttugcacacaaaacacugag

SEQ ID NO: 76631 - DNA, 22 bp, Artificial Sequence
  Synthetic
cuaccgcatguaccagaaagga

SEQ ID NO: 76632 - DNA, 28 bp, Artificial Sequence
  Synthetic
ccagatcctaauttcaaaagttguaccc

SEQ ID NO: 76633 - DNA, 23 bp, Artificial Sequence
  Synthetic
tccctgctucctcccatcatuat

SEQ ID NO: 76634 - DNA, 24 bp, Artificial Sequence
  Synthetic
gctttcaugtttcttgucagccat

SEQ ID NO: 76635 - DNA, 21 bp, Artificial Sequence
  Synthetic
ggccagaaaucacccucgaaa

SEQ ID NO: 76636 - DNA, 22 bp, Artificial Sequence
  Synthetic
gagaccttggugagcctcttua

SEQ ID NO: 76637 - DNA, 24 bp, Artificial Sequence
  Synthetic
catgcagcugaaggaaaagagtug

SEQ ID NO: 76638 - DNA, 25 bp, Artificial Sequence
  Synthetic
agttctgtctuaacatgcagggtut

SEQ ID NO: 76639 - DNA, 24 bp, Artificial Sequence
  Synthetic
ccagaggttuccaatgtagtuggg

SEQ ID NO: 76640 - DNA, 28 bp, Artificial Sequence
  Synthetic
gattaacaagugcaaaggaattgcctua

SEQ ID NO: 76641 - DNA, 25 bp, Artificial Sequence
  Synthetic
tcaaaggaaacucaatgccctuaca

SEQ ID NO: 76642 - DNA, 24 bp, Artificial Sequence
  Synthetic
cggccattaautcgagactgttuc

SEQ ID NO: 76643 - DNA, 20 bp, Artificial Sequence
  Synthetic
gagccccutctcctgctuac

SEQ ID NO: 76644 - DNA, 20 bp, Artificial Sequence
  Synthetic
ggattgguggacgtctccug

SEQ ID NO: 76645 - DNA, 24 bp, Artificial Sequence
  Synthetic
caacgcttcaugctccactactua

SEQ ID NO: 76646 - DNA, 19 bp, Artificial Sequence
  Synthetic
catgaccggcugctttguc

SEQ ID NO: 76647 - DNA, 21 bp, Artificial Sequence
  Synthetic
gaaaatgtcgucggccaugaa

SEQ ID NO: 76648 - DNA, 23 bp, Artificial Sequence
  Synthetic
tggctcccauggaaagauaaagg

SEQ ID NO: 76649 - DNA, 21 bp, Artificial Sequence
  Synthetic
acaactcgguggtcctguact

SEQ ID NO: 76650 - DNA, 24 bp, Artificial Sequence
  Synthetic
aggcttcgtgucaaactctagaug

SEQ ID NO: 76651 - DNA, 17 bp, Artificial Sequence
  Synthetic
agctgugggcacgucag

SEQ ID NO: 76652 - DNA, 19 bp, Artificial Sequence
  Synthetic
cagcgtggucgtaggugaa

SEQ ID NO: 76653 - DNA, 29 bp, Artificial Sequence
  Synthetic
tcctttctttctutagcttgagaguaacc

SEQ ID NO: 76654 - DNA, 26 bp, Artificial Sequence
  Synthetic
ttctctttcacutcctacagaugcac

SEQ ID NO: 76655 - DNA, 25 bp, Artificial Sequence
  Synthetic
tcagaaaugcaggaaagcatctuca

SEQ ID NO: 76656 - DNA, 23 bp, Artificial Sequence
  Synthetic
ctacaccugccacatggatguat

SEQ ID NO: 76657 - DNA, 20 bp, Artificial Sequence
  Synthetic
attgagugccacccuaagcc

SEQ ID NO: 76658 - DNA, 23 bp, Artificial Sequence
  Synthetic
caagcccagagaaauagcacuga

SEQ ID NO: 76659 - DNA, 25 bp, Artificial Sequence
  Synthetic
acaagucagggaagaaaacaucagg

SEQ ID NO: 76660 - DNA, 20 bp, Artificial Sequence
  Synthetic
ggtctcugcagtgucgagag

SEQ ID NO: 76661 - DNA, 27 bp, Artificial Sequence
  Synthetic
ctactaucacaaacatgcctucaacaa

SEQ ID NO: 76662 - DNA, 27 bp, Artificial Sequence
  Synthetic
aacagugaagggtatgttugaaaaagt

SEQ ID NO: 76663 - DNA, 27 bp, Artificial Sequence
  Synthetic
tggacaaucaaaacttaactccuggat

SEQ ID NO: 76664 - DNA, 27 bp, Artificial Sequence
  Synthetic
ccttcaaaaagtugggagtcaaaguat

SEQ ID NO: 76665 - DNA, 22 bp, Artificial Sequence
  Synthetic
tccagtgcauccatgaactcug

SEQ ID NO: 76666 - DNA, 19 bp, Artificial Sequence
  Synthetic
gccccacagcauggacaua

SEQ ID NO: 76667 - DNA, 20 bp, Artificial Sequence
  Synthetic
tcctggtgcugaaggactug

SEQ ID NO: 76668 - DNA, 22 bp, Artificial Sequence
  Synthetic
caatgtagcgguccaccugaat

SEQ ID NO: 76669 - DNA, 24 bp, Artificial Sequence
  Synthetic
gggaaaagauaggacttgggccua

SEQ ID NO: 76670 - DNA, 22 bp, Artificial Sequence
  Synthetic
agtccagctuctttagctgcut

SEQ ID NO: 76671 - DNA, 20 bp, Artificial Sequence
  Synthetic
ggttguaaggccctgcaaug

SEQ ID NO: 76672 - DNA, 17 bp, Artificial Sequence
  Synthetic
ggcugctctugcgaggt

SEQ ID NO: 76673 - DNA, 19 bp, Artificial Sequence
  Synthetic
ctcgttcgcuctccagcut

SEQ ID NO: 76674 - DNA, 19 bp, Artificial Sequence
  Synthetic
cgugauggccgaaccagaa

SEQ ID NO: 76675 - DNA, 24 bp, Artificial Sequence
  Synthetic
catcagauacacagacatgugcct

SEQ ID NO: 76676 - DNA, 25 bp, Artificial Sequence
  Synthetic
ggccttgguagaatcgactatggua

SEQ ID NO: 76677 - DNA, 22 bp, Artificial Sequence
  Synthetic
gggaaggcaagugugaagagaa

SEQ ID NO: 76678 - DNA, 25 bp, Artificial Sequence
  Synthetic
aaatacagagcacutcggcttaugt

SEQ ID NO: 76679 - DNA, 25 bp, Artificial Sequence
  Synthetic
aaagaaatagggcutctgacctgug

SEQ ID NO: 76680 - DNA, 22 bp, Artificial Sequence
  Synthetic
gggtgcacuaggtacctuaact

SEQ ID NO: 76681 - DNA, 29 bp, Artificial Sequence
  Synthetic
gccttttcctgucttgataattctttcug

SEQ ID NO: 76682 - DNA, 21 bp, Artificial Sequence
  Synthetic
aacattcagcugactgcucca

SEQ ID NO: 76683 - DNA, 25 bp, Artificial Sequence
  Synthetic
atgggtcaggauactctgaugaaga

SEQ ID NO: 76684 - DNA, 25 bp, Artificial Sequence
  Synthetic
catttttgtgcauctttgttgcugt

SEQ ID NO: 76685 - DNA, 24 bp, Artificial Sequence
  Synthetic
gcacgtacucaccatttgtcttug

SEQ ID NO: 76686 - DNA, 18 bp, Artificial Sequence
  Synthetic
tgtccuacgcggaccuga

SEQ ID NO: 76687 - DNA, 18 bp, Artificial Sequence
  Synthetic
gtggguacgcacctucca

SEQ ID NO: 76688 - DNA, 22 bp, Artificial Sequence
  Synthetic
gcgtgcccuacttcaaggauaa

SEQ ID NO: 76689 - DNA, 18 bp, Artificial Sequence
  Synthetic
agcgcacuccgacgaauc

SEQ ID NO: 76690 - DNA, 23 bp, Artificial Sequence
  Synthetic
gccactagauagtcctcugggat

SEQ ID NO: 76691 - DNA, 26 bp, Artificial Sequence
  Synthetic
cttaccgtccuctctttcctttguag

SEQ ID NO: 76692 - DNA, 22 bp, Artificial Sequence
  Synthetic
ccagagagcutcagccattcut

SEQ ID NO: 76693 - DNA, 22 bp, Artificial Sequence
  Synthetic
cacagaauggauaagccagcca

SEQ ID NO: 76694 - DNA, 22 bp, Artificial Sequence
  Synthetic
ggtguagcacaacagacacuca

SEQ ID NO: 76695 - DNA, 24 bp, Artificial Sequence
  Synthetic
attgtuttcctgtgauccagagca

SEQ ID NO: 76696 - DNA, 26 bp, Artificial Sequence
  Synthetic
gatcttcatcautgtggaacucagga

SEQ ID NO: 76697 - DNA, 21 bp, Artificial Sequence
  Synthetic
gcagctcugactctgacucat

SEQ ID NO: 76698 - DNA, 23 bp, Artificial Sequence
  Synthetic
caaatgcccautgactgttgcut

SEQ ID NO: 76699 - DNA, 26 bp, Artificial Sequence
  Synthetic
gttaatgcaugcctcttcctttucag

SEQ ID NO: 76700 - DNA, 22 bp, Artificial Sequence
  Synthetic
ccttacagutcgttggugcagt

SEQ ID NO: 76701 - DNA, 22 bp, Artificial Sequence
  Synthetic
gccgtgctutctccttttgtug

SEQ ID NO: 76702 - DNA, 21 bp, Artificial Sequence
  Synthetic
agcttggugaagcccctttua

SEQ ID NO: 76703 - DNA, 25 bp, Artificial Sequence
  Synthetic
ggtctgaugagctgctattgtucat

SEQ ID NO: 76704 - DNA, 27 bp, Artificial Sequence
  Synthetic
ggaccttccautcaataatgaguacac

SEQ ID NO: 76705 - DNA, 26 bp, Artificial Sequence
  Synthetic
gaagtacagcccaaugtagaguacaa

SEQ ID NO: 76706 - DNA, 24 bp, Artificial Sequence
  Synthetic
gctcagggaggutttgagugaaag

SEQ ID NO: 76707 - DNA, 24 bp, Artificial Sequence
  Synthetic
accctacttautcacccccugaag

SEQ ID NO: 76708 - DNA, 28 bp, Artificial Sequence
  Synthetic
agtaatgatgacuaaagcaagggatugt

SEQ ID NO: 76709 - DNA, 22 bp, Artificial Sequence
  Synthetic
gggattccgucatatggctugg

SEQ ID NO: 76710 - DNA, 24 bp, Artificial Sequence
  Synthetic
ctctaactgcugtacaaccugcat

SEQ ID NO: 76711 - DNA, 28 bp, Artificial Sequence
  Synthetic
gcctagtttatgcutaaacatcctggua

SEQ ID NO: 76712 - DNA, 20 bp, Artificial Sequence
  Synthetic
gggaaggaacggucaccuac

SEQ ID NO: 76713 - DNA, 22 bp, Artificial Sequence
  Synthetic
tcuctcuggacacacagaacct

SEQ ID NO: 76714 - DNA, 22 bp, Artificial Sequence
  Synthetic
gaagcctccuggacagacuaaa

SEQ ID NO: 76715 - DNA, 22 bp, Artificial Sequence
  Synthetic
caaagccacugtcaaacgtguc

SEQ ID NO: 76716 - DNA, 22 bp, Artificial Sequence
  Synthetic
accttacccucatcctgtgcua

SEQ ID NO: 76717 - DNA, 19 bp, Artificial Sequence
  Synthetic
ggtggcagcugtacaccuc

SEQ ID NO: 76718 - DNA, 24 bp, Artificial Sequence
  Synthetic
tttgggagtugatgaccttuggat

SEQ ID NO: 76719 - DNA, 20 bp, Artificial Sequence
  Synthetic
gacagacccaccagucacuc

SEQ ID NO: 76720 - DNA, 17 bp, Artificial Sequence
  Synthetic
ctggccggccuggauat

SEQ ID NO: 76721 - DNA, 19 bp, Artificial Sequence
  Synthetic
ggtccagggcucgaaagug

SEQ ID NO: 76722 - DNA, 17 bp, Artificial Sequence
  Synthetic
gagcugggacccuggag

SEQ ID NO: 76723 - DNA, 18 bp, Artificial Sequence
  Synthetic
ctugggcacaccgucaga

SEQ ID NO: 76724 - DNA, 21 bp, Artificial Sequence
  Synthetic
cucacggagcuacaagaacca

SEQ ID NO: 76725 - DNA, 22 bp, Artificial Sequence
  Synthetic
gcatcuagcacagtcactgugt

SEQ ID NO: 76726 - DNA, 20 bp, Artificial Sequence
  Synthetic
catacggccuggtgtccaut

SEQ ID NO: 76727 - DNA, 22 bp, Artificial Sequence
  Synthetic
gcatccaagagugggtcctcua

SEQ ID NO: 76728 - DNA, 18 bp, Artificial Sequence
  Synthetic
ccctggaccuggatgcug

SEQ ID NO: 76729 - DNA, 19 bp, Artificial Sequence
  Synthetic
cagtccuccccatcugcaa

SEQ ID NO: 76730 - DNA, 23 bp, Artificial Sequence
  Synthetic
ctcaaccucctcttcctcuggat

SEQ ID NO: 76731 - DNA, 24 bp, Artificial Sequence
  Synthetic
gttaugaaggaacctgcuccaaga

SEQ ID NO: 76732 - DNA, 20 bp, Artificial Sequence
  Synthetic
ccagtggguggtcattccuc

SEQ ID NO: 76733 - DNA, 21 bp, Artificial Sequence
  Synthetic
gctgcaggugtcttcacauca

SEQ ID NO: 76734 - DNA, 18 bp, Artificial Sequence
  Synthetic
agguggctgugcgaagag

SEQ ID NO: 76735 - DNA, 17 bp, Artificial Sequence
  Synthetic
cggagucgtccccugag

SEQ ID NO: 76736 - DNA, 20 bp, Artificial Sequence
  Synthetic
cgccttucgagcagtacucc

SEQ ID NO: 76737 - DNA, 21 bp, Artificial Sequence
  Synthetic
gctagggaccccucacatugt

SEQ ID NO: 76738 - DNA, 22 bp, Artificial Sequence
  Synthetic
tcctcttucaacacctcucgga

SEQ ID NO: 76739 - DNA, 27 bp, Artificial Sequence
  Synthetic
tgtttcagttucagttcctcatgtuca

SEQ ID NO: 76740 - DNA, 26 bp, Artificial Sequence
  Synthetic
acauccttaatccucacaacacgaac

SEQ ID NO: 76741 - DNA, 28 bp, Artificial Sequence
  Synthetic
gggagagaacaaugauaaagaagaagaa

SEQ ID NO: 76742 - DNA, 26 bp, Artificial Sequence
  Synthetic
gaggagctcgaaguttcatctttcut

SEQ ID NO: 76743 - DNA, 23 bp, Artificial Sequence
  Synthetic
cggctucccaataacaguagcag

SEQ ID NO: 76744 - DNA, 20 bp, Artificial Sequence
  Synthetic
tcgggccuctgagaacaauc

SEQ ID NO: 76745 - DNA, 22 bp, Artificial Sequence
  Synthetic
gctgttgauggtctgttuccac

SEQ ID NO: 76746 - DNA, 22 bp, Artificial Sequence
  Synthetic
acacccuaagaccccatcucag

SEQ ID NO: 76747 - DNA, 21 bp, Artificial Sequence
  Synthetic
tgggtccutgagcuaggaaga

SEQ ID NO: 76748 - DNA, 25 bp, Artificial Sequence
  Synthetic
tttgcagcaatuaagtgaggcatut

SEQ ID NO: 76749 - DNA, 20 bp, Artificial Sequence
  Synthetic
ggaccucagagcagccaaug

SEQ ID NO: 76750 - DNA, 26 bp, Artificial Sequence
  Synthetic
tcctttgatuccagcacattaauggt

SEQ ID NO: 76751 - DNA, 27 bp, Artificial Sequence
  Synthetic
ccctgatgtugacatttttcattucgt

SEQ ID NO: 76752 - DNA, 27 bp, Artificial Sequence
  Synthetic
tcacctgaaacauttttagccatucct

SEQ ID NO: 76753 - DNA, 21 bp, Artificial Sequence
  Synthetic
gtaccacugggcttguaccat

SEQ ID NO: 76754 - DNA, 24 bp, Artificial Sequence
  Synthetic
caaaagttgtuggtgttgcugaac

SEQ ID NO: 76755 - DNA, 31 bp, Artificial Sequence
  Synthetic
tgaaatatgccagaucatcattctttguact

SEQ ID NO: 76756 - DNA, 20 bp, Artificial Sequence
  Synthetic
gtggcuagcagccttgttug

SEQ ID NO: 76757 - DNA, 21 bp, Artificial Sequence
  Synthetic
cguggttacugggaggaagag

SEQ ID NO: 76758 - DNA, 22 bp, Artificial Sequence
  Synthetic
agaccutcatcuccacccagat

SEQ ID NO: 76759 - DNA, 19 bp, Artificial Sequence
  Synthetic
ggcacagcuguccaggaag

SEQ ID NO: 76760 - DNA, 19 bp, Artificial Sequence
  Synthetic
gggaggguccagtcguagt

SEQ ID NO: 76761 - DNA, 21 bp, Artificial Sequence
  Synthetic
ccctccaggugagctcctuat

SEQ ID NO: 76762 - DNA, 22 bp, Artificial Sequence
  Synthetic
ctgcactacucctccctaucca

SEQ ID NO: 76763 - DNA, 21 bp, Artificial Sequence
  Synthetic
agtcccuccccaatugcaaag

SEQ ID NO: 76764 - DNA, 19 bp, Artificial Sequence
  Synthetic
cgggtcauggcctucacac

SEQ ID NO: 76765 - DNA, 20 bp, Artificial Sequence
  Synthetic
gaactcccugccgttctuca

SEQ ID NO: 76766 - DNA, 19 bp, Artificial Sequence
  Synthetic
aaccccacuccctccauct

SEQ ID NO: 76767 - DNA, 17 bp, Artificial Sequence
  Synthetic
gugagugagcggaggca

SEQ ID NO: 76768 - DNA, 22 bp, Artificial Sequence
  Synthetic
gcaugaaagcagugggaaccat

SEQ ID NO: 76769 - DNA, 24 bp, Artificial Sequence
  Synthetic
gagactaattucaagccctuggga

SEQ ID NO: 76770 - DNA, 20 bp, Artificial Sequence
  Synthetic
cggaacagtucaccccagua

SEQ ID NO: 76771 - DNA, 29 bp, Artificial Sequence
  Synthetic
ctggacaacaaacuaattagcactttuca

SEQ ID NO: 76772 - DNA, 23 bp, Artificial Sequence
  Synthetic
gggaaggagagaugagtccagua

SEQ ID NO: 76773 - DNA, 20 bp, Artificial Sequence
  Synthetic
cccatgucatcgtccuccag

SEQ ID NO: 76774 - DNA, 17 bp, Artificial Sequence
  Synthetic
tcuccgggcuacagcct

SEQ ID NO: 76775 - DNA, 17 bp, Artificial Sequence
  Synthetic
gcgctgcucagctguct

SEQ ID NO: 76776 - DNA, 17 bp, Artificial Sequence
  Synthetic
accccggugtcccagua

SEQ ID NO: 76777 - DNA, 20 bp, Artificial Sequence
  Synthetic
gaagtggutgtctccuggct

SEQ ID NO: 76778 - DNA, 19 bp, Artificial Sequence
  Synthetic
gcacctuctaccgcucact

SEQ ID NO: 76779 - DNA, 17 bp, Artificial Sequence
  Synthetic
gugugaccgagggcact

SEQ ID NO: 76780 - DNA, 28 bp, Artificial Sequence
  Synthetic
aatagcaaaggucaattucagcaaacat

SEQ ID NO: 76781 - DNA, 25 bp, Artificial Sequence
  Synthetic
tcttcttuccaccttgtucacaaca

SEQ ID NO: 76782 - DNA, 27 bp, Artificial Sequence
  Synthetic
agcattagauacacacctaacgttcug

SEQ ID NO: 76783 - DNA, 25 bp, Artificial Sequence
  Synthetic
agagcagcgcauatcattattuggt

SEQ ID NO: 76784 - DNA, 21 bp, Artificial Sequence
  Synthetic
tcutcagcucacagggaacct

SEQ ID NO: 76785 - DNA, 20 bp, Artificial Sequence
  Synthetic
catctuaccaggcagucgct

SEQ ID NO: 76786 - DNA, 19 bp, Artificial Sequence
  Synthetic
ccagugactgcugccacaa

SEQ ID NO: 76787 - DNA, 21 bp, Artificial Sequence
  Synthetic
cuaattgacagcucccccaca

SEQ ID NO: 76788 - DNA, 20 bp, Artificial Sequence
  Synthetic
ggaccugcaggactuccaac

SEQ ID NO: 76789 - DNA, 21 bp, Artificial Sequence
  Synthetic
gcgatcucgcgatcagtgtut

SEQ ID NO: 76790 - DNA, 19 bp, Artificial Sequence
  Synthetic
guggacacagucagccaga

SEQ ID NO: 76791 - DNA, 19 bp, Artificial Sequence
  Synthetic
catccccuccctctgctut

SEQ ID NO: 76792 - DNA, 20 bp, Artificial Sequence
  Synthetic
tgtaguccccgccttgttuc

SEQ ID NO: 76793 - DNA, 20 bp, Artificial Sequence
  Synthetic
gggactccugctcctctugt

SEQ ID NO: 76794 - DNA, 20 bp, Artificial Sequence
  Synthetic
cggctcctuccgctaaacuc

SEQ ID NO: 76795 - DNA, 28 bp, Artificial Sequence
  Synthetic
gcttggagaccaugatgtccataaauaa

SEQ ID NO: 76796 - DNA, 19 bp, Artificial Sequence
  Synthetic
cucccctctuccacgaagt

SEQ ID NO: 76797 - DNA, 21 bp, Artificial Sequence
  Synthetic
cccaccuacccctcctatgug

SEQ ID NO: 76798 - DNA, 22 bp, Artificial Sequence
  Synthetic
gagautgtatuacgccccagga

SEQ ID NO: 76799 - DNA, 25 bp, Artificial Sequence
  Synthetic
ccuaaaaggcggaaatatucaagca

SEQ ID NO: 76800 - DNA, 20 bp, Artificial Sequence
  Synthetic
tccutcucaagggcgacaag

SEQ ID NO: 76801 - DNA, 23 bp, Artificial Sequence
  Synthetic
ctgtcagguttaaagccuaccca

SEQ ID NO: 76802 - DNA, 21 bp, Artificial Sequence
  Synthetic
gaagagtccgcugctgtaguc

SEQ ID NO: 76803 - DNA, 20 bp, Artificial Sequence
  Synthetic
gugtcacugacggagagcat

SEQ ID NO: 76804 - DNA, 22 bp, Artificial Sequence
  Synthetic
gggactgccacuttccatctuc

SEQ ID NO: 76805 - DNA, 21 bp, Artificial Sequence
  Synthetic
gccacccaaagaagugtcucc

SEQ ID NO: 76806 - DNA, 20 bp, Artificial Sequence
  Synthetic
ggaacucaggagcucggaaa

SEQ ID NO: 76807 - DNA, 19 bp, Artificial Sequence
  Synthetic
ctcguccaccagcaucagg

SEQ ID NO: 76808 - DNA, 19 bp, Artificial Sequence
  Synthetic
cctcccugacaccctgugt

SEQ ID NO: 76809 - DNA, 18 bp, Artificial Sequence
  Synthetic
caggtucggctcccucag

SEQ ID NO: 76810 - DNA, 17 bp, Artificial Sequence
  Synthetic
gtttcgcugcggcacug

SEQ ID NO: 76811 - DNA, 18 bp, Artificial Sequence
  Synthetic
caugagcacggccacaut

SEQ ID NO: 76812 - DNA, 17 bp, Artificial Sequence
  Synthetic
ccgtggugctaggguca

SEQ ID NO: 76813 - DNA, 18 bp, Artificial Sequence
  Synthetic
ccuggaggcccactcuct

SEQ ID NO: 76814 - DNA, 18 bp, Artificial Sequence
  Synthetic
cuccagccagcccaaugt

SEQ ID NO: 76815 - DNA, 26 bp, Artificial Sequence
  Synthetic
ctttctgtatutctccatggucccaa

SEQ ID NO: 76816 - DNA, 18 bp, Artificial Sequence
  Synthetic
gguggacauggccagcaa

SEQ ID NO: 76817 - DNA, 20 bp, Artificial Sequence
  Synthetic
cctctgcugacccccatuac

SEQ ID NO: 76818 - DNA, 22 bp, Artificial Sequence
  Synthetic
cccctcctuccaaatggactua

SEQ ID NO: 76819 - DNA, 25 bp, Artificial Sequence
  Synthetic
ttccattggtuatacaggacauggg

SEQ ID NO: 76820 - DNA, 22 bp, Artificial Sequence
  Synthetic
ggtgttctgtuctctcccgtut

SEQ ID NO: 76821 - DNA, 22 bp, Artificial Sequence
  Synthetic
cattttgaacuccccgttgguc

SEQ ID NO: 76822 - DNA, 21 bp, Artificial Sequence
  Synthetic
ccaagcccucgagcagttaut

SEQ ID NO: 76823 - DNA, 28 bp, Artificial Sequence
  Synthetic
tgcaatgttagttuttccccctttcaua

SEQ ID NO: 76824 - DNA, 20 bp, Artificial Sequence
  Synthetic
caacgccagcugtaucacct

SEQ ID NO: 76825 - DNA, 24 bp, Artificial Sequence
  Synthetic
ccgtgcactutggtcataatgtut

SEQ ID NO: 76826 - DNA, 26 bp, Artificial Sequence
  Synthetic
cgggcccuccgttattactatgauaa

SEQ ID NO: 76827 - DNA, 26 bp, Artificial Sequence
  Synthetic
tgtaggagatgucagaagggtactug

SEQ ID NO: 76828 - DNA, 18 bp, Artificial Sequence
  Synthetic
cctgcuccgcacctucag

SEQ ID NO: 76829 - DNA, 19 bp, Artificial Sequence
  Synthetic
gcgugccctactucaagga

SEQ ID NO: 76830 - DNA, 21 bp, Artificial Sequence
  Synthetic
gagctgttgcugtcaccctua

SEQ ID NO: 76831 - DNA, 17 bp, Artificial Sequence
  Synthetic
cgcaagagcagcucguc

SEQ ID NO: 76832 - DNA, 17 bp, Artificial Sequence
  Synthetic
cuggaaguccccgcaca

SEQ ID NO: 76833 - DNA, 19 bp, Artificial Sequence
  Synthetic
tcagcgccgacutcaugag

SEQ ID NO: 76834 - DNA, 19 bp, Artificial Sequence
  Synthetic
cctccagcaagcucaggut

SEQ ID NO: 76835 - DNA, 19 bp, Artificial Sequence
  Synthetic
ggccggaguttagccaguc

SEQ ID NO: 76836 - DNA, 21 bp, Artificial Sequence
  Synthetic
tctcactgccugtctctggut

SEQ ID NO: 76837 - DNA, 23 bp, Artificial Sequence
  Synthetic
cctgtaugacacctgcatuccac

SEQ ID NO: 76838 - DNA, 21 bp, Artificial Sequence
  Synthetic
gccctgggaucaagaacctuc

SEQ ID NO: 76839 - DNA, 22 bp, Artificial Sequence
  Synthetic
gcattgtgucttggtggaugac

SEQ ID NO: 76840 - DNA, 19 bp, Artificial Sequence
  Synthetic
cgaccgagucgtccatgua

SEQ ID NO: 76841 - DNA, 20 bp, Artificial Sequence
  Synthetic
agtattgtgaugcggcucca

SEQ ID NO: 76842 - DNA, 17 bp, Artificial Sequence
  Synthetic
ccagcgggugcctucag

SEQ ID NO: 76843 - DNA, 17 bp, Artificial Sequence
  Synthetic
ggcctcgugaccacugt

SEQ ID NO: 76844 - DNA, 22 bp, Artificial Sequence
  Synthetic
gccccaggcagautcctttaua

SEQ ID NO: 76845 - DNA, 25 bp, Artificial Sequence
  Synthetic
cagatcagggagutcatttggugat

SEQ ID NO: 76846 - DNA, 22 bp, Artificial Sequence
  Synthetic
ctgtcacttccuccagcttcut

SEQ ID NO: 76847 - DNA, 23 bp, Artificial Sequence
  Synthetic
agctagaaggccacugatgagua

SEQ ID NO: 76848 - DNA, 24 bp, Artificial Sequence
  Synthetic
tcgcttcagcaaugcaatgataug

SEQ ID NO: 76849 - DNA, 28 bp, Artificial Sequence
  Synthetic
aaaaacaggccagcuatgaactatgaua

SEQ ID NO: 76850 - DNA, 22 bp, Artificial Sequence
  Synthetic
agagagaacuggtcagctgcua

SEQ ID NO: 76851 - DNA, 26 bp, Artificial Sequence
  Synthetic
gccttcucagcaaagagacuagagat

SEQ ID NO: 76852 - DNA, 20 bp, Artificial Sequence
  Synthetic
gcggagugaacggctaagut

SEQ ID NO: 76853 - DNA, 28 bp, Artificial Sequence
  Synthetic
ggacatttttgugggtttggaagtaaut

SEQ ID NO: 76854 - DNA, 21 bp, Artificial Sequence
  Synthetic
ccaagaacccgcaucttguca

SEQ ID NO: 76855 - DNA, 21 bp, Artificial Sequence
  Synthetic
cttacgtcugcctctgtgugt

SEQ ID NO: 76856 - DNA, 20 bp, Artificial Sequence
  Synthetic
aguagacuggcccacgaaga

SEQ ID NO: 76857 - DNA, 22 bp, Artificial Sequence
  Synthetic
gtagcaacguggagttcatgug

SEQ ID NO: 76858 - DNA, 21 bp, Artificial Sequence
  Synthetic
actctgcgugtgtctcaccua

SEQ ID NO: 76859 - DNA, 24 bp, Artificial Sequence
  Synthetic
cattttggccuccatcttcactuc

SEQ ID NO: 76860 - DNA, 20 bp, Artificial Sequence
  Synthetic
gcgggtcacugtacacctua

SEQ ID NO: 76861 - DNA, 22 bp, Artificial Sequence
  Synthetic
cctctttagccauggcaagguc

SEQ ID NO: 76862 - DNA, 21 bp, Artificial Sequence
  Synthetic
ttcctttctcucggctgcaut

SEQ ID NO: 76863 - DNA, 24 bp, Artificial Sequence
  Synthetic
ctcttcgaacutgggtaagacugg

SEQ ID NO: 76864 - DNA, 21 bp, Artificial Sequence
  Synthetic
ccattgcugagaagcagccut

SEQ ID NO: 76865 - DNA, 25 bp, Artificial Sequence
  Synthetic
tgggttcctauactgaggtccuaac

SEQ ID NO: 76866 - DNA, 27 bp, Artificial Sequence
  Synthetic
gtgtacttuccagagatgaagcacuac

SEQ ID NO: 76867 - DNA, 29 bp, Artificial Sequence
  Synthetic
ggtttaaatgtguctgaatgtagcaauga

SEQ ID NO: 76868 - DNA, 28 bp, Artificial Sequence
  Synthetic
agtgtcagctugaattaaatgaggtcut

SEQ ID NO: 76869 - DNA, 24 bp, Artificial Sequence
  Synthetic
tttccgaatuccagtagtggaugg

SEQ ID NO: 76870 - DNA, 21 bp, Artificial Sequence
  Synthetic
cctaugccaacagcagcucaa

SEQ ID NO: 76871 - DNA, 27 bp, Artificial Sequence
  Synthetic
atgagacgtguccacaatcttactuac

SEQ ID NO: 76872 - DNA, 27 bp, Artificial Sequence
  Synthetic
aaaaggcattttaugagcaaagcauga

SEQ ID NO: 76873 - DNA, 22 bp, Artificial Sequence
  Synthetic
cccccauagccatcctctcuat

SEQ ID NO: 76874 - DNA, 22 bp, Artificial Sequence
  Synthetic
acutttcugagaagcaggcgat

SEQ ID NO: 76875 - DNA, 27 bp, Artificial Sequence
  Synthetic
agaaacatgcttucctccaaagaacua

SEQ ID NO: 76876 - DNA, 26 bp, Artificial Sequence
  Synthetic
gggagatatuctgtgctatucccaaa

SEQ ID NO: 76877 - DNA, 28 bp, Artificial Sequence
  Synthetic
gctgctcttattuttgctggttttctua

SEQ ID NO: 76878 - DNA, 20 bp, Artificial Sequence
  Synthetic
cggagacugcugcaggaaac

SEQ ID NO: 76879 - DNA, 22 bp, Artificial Sequence
  Synthetic
gtctcttucaggatccgcauct

SEQ ID NO: 76880 - DNA, 18 bp, Artificial Sequence
  Synthetic
tggagccgcugacaccua

SEQ ID NO: 76881 - DNA, 17 bp, Artificial Sequence
  Synthetic
caggaccuggcccugac

SEQ ID NO: 76882 - DNA, 21 bp, Artificial Sequence
  Synthetic
gccacttgcauacaccatguc

SEQ ID NO: 76883 - DNA, 20 bp, Artificial Sequence
  Synthetic
cctcgtcuggtggaatggut

SEQ ID NO: 76884 - DNA, 25 bp, Artificial Sequence
  Synthetic
agtaattccugttcctcuccacagt

SEQ ID NO: 76885 - DNA, 20 bp, Artificial Sequence
  Synthetic
gctgacaucgtagcctugcc

SEQ ID NO: 76886 - DNA, 28 bp, Artificial Sequence
  Synthetic
ggagacagcaaaaaugcuaaaaagaaga

SEQ ID NO: 76887 - DNA, 20 bp, Artificial Sequence
  Synthetic
ctctggguggctgcatctua

SEQ ID NO: 76888 - DNA, 21 bp, Artificial Sequence
  Synthetic
cccgtguccctacuccagaat

SEQ ID NO: 76889 - DNA, 20 bp, Artificial Sequence
  Synthetic
ctcagcccacucactauggg

SEQ ID NO: 76890 - DNA, 24 bp, Artificial Sequence
  Synthetic
aatagcagcuaccatggatgtguc

SEQ ID NO: 76891 - DNA, 27 bp, Artificial Sequence
  Synthetic
tgatgctttagauaccctgcttuacac

SEQ ID NO: 76892 - DNA, 23 bp, Artificial Sequence
  Synthetic
cggcttttcuacgtggactuacc

SEQ ID NO: 76893 - DNA, 22 bp, Artificial Sequence
  Synthetic
gcccaccacacuaaacctcauc

SEQ ID NO: 76894 - DNA, 21 bp, Artificial Sequence
  Synthetic
ttgacaggucaaggcuggaag

SEQ ID NO: 76895 - DNA, 20 bp, Artificial Sequence
  Synthetic
cctgttgaugagcccagtug

SEQ ID NO: 76896 - DNA, 20 bp, Artificial Sequence
  Synthetic
actgtucccaggacgttugt

SEQ ID NO: 76897 - DNA, 25 bp, Artificial Sequence
  Synthetic
gacatcttatggugcactgaaaugg

SEQ ID NO: 76898 - DNA, 21 bp, Artificial Sequence
  Synthetic
gcctcccagcuctgaaacaua

SEQ ID NO: 76899 - DNA, 28 bp, Artificial Sequence
  Synthetic
aggcttgaucacctttauccaaaagaat

SEQ ID NO: 76900 - DNA, 19 bp, Artificial Sequence
  Synthetic
gcacaacccggguacctut

SEQ ID NO: 76901 - DNA, 28 bp, Artificial Sequence
  Synthetic
gcttattcctctuttctcctcttcauct

SEQ ID NO: 76902 - DNA, 20 bp, Artificial Sequence
  Synthetic
ggugacgggactgtuaaggg

SEQ ID NO: 76903 - DNA, 24 bp, Artificial Sequence
  Synthetic
catcagcagutccaccacttuaga

SEQ ID NO: 76904 - DNA, 17 bp, Artificial Sequence
  Synthetic
cucuggcgggaagggat

SEQ ID NO: 76905 - DNA, 18 bp, Artificial Sequence
  Synthetic
acucgtgggucccgaact

SEQ ID NO: 76906 - DNA, 25 bp, Artificial Sequence
  Synthetic
ctaaaagaggccaagguactucact

SEQ ID NO: 76907 - DNA, 25 bp, Artificial Sequence
  Synthetic
cctctaccacaucaaactgtgauga

SEQ ID NO: 76908 - DNA, 21 bp, Artificial Sequence
  Synthetic
gggacaccautagcaugacag

SEQ ID NO: 76909 - DNA, 25 bp, Artificial Sequence
  Synthetic
cgagtaatcacagcuccctttctut

SEQ ID NO: 76910 - DNA, 28 bp, Artificial Sequence
  Synthetic
tgggcaatgaugctaatgctaaatauct

SEQ ID NO: 76911 - DNA, 28 bp, Artificial Sequence
  Synthetic
gagtattcgucaaccaagaggagtttua

SEQ ID NO: 76912 - DNA, 28 bp, Artificial Sequence
  Synthetic
ccagaatcauagggatagggagauacat

SEQ ID NO: 76913 - DNA, 25 bp, Artificial Sequence
  Synthetic
ccuttgtatcugagcaccaaaaaca

SEQ ID NO: 76914 - DNA, 20 bp, Artificial Sequence
  Synthetic
ccgcccuactacggaaacuc

SEQ ID NO: 76915 - DNA, 20 bp, Artificial Sequence
  Synthetic
gggctttcgcutgacctcuc

SEQ ID NO: 76916 - DNA, 28 bp, Artificial Sequence
  Synthetic
acgcccatcatauttcttcagaatagug

SEQ ID NO: 76917 - DNA, 23 bp, Artificial Sequence
  Synthetic
tctcactggcutctcctcuacag

SEQ ID NO: 76918 - DNA, 23 bp, Artificial Sequence
  Synthetic
ggtgtaagggutcaggaggcuat

SEQ ID NO: 76919 - DNA, 23 bp, Artificial Sequence
  Synthetic
gcatttcucgggagatgtucagg

SEQ ID NO: 76920 - DNA, 19 bp, Artificial Sequence
  Synthetic
ccccgacggagucaagtut

SEQ ID NO: 76921 - DNA, 23 bp, Artificial Sequence
  Synthetic
actgagcugagattugcgaagag

SEQ ID NO: 76922 - DNA, 24 bp, Artificial Sequence
  Synthetic
gcagattttauccgtggtgtggut

SEQ ID NO: 76923 - DNA, 26 bp, Artificial Sequence
  Synthetic
cttgtaattcuccttgtcttcugcca

SEQ ID NO: 76924 - DNA, 23 bp, Artificial Sequence
  Synthetic
ccttcaggcugttcccgaauaag

SEQ ID NO: 76925 - DNA, 19 bp, Artificial Sequence
  Synthetic
cggtggacgucacgguaag

SEQ ID NO: 76926 - DNA, 21 bp, Artificial Sequence
  Synthetic
tctcctccugagctcctgaug

SEQ ID NO: 76927 - DNA, 23 bp, Artificial Sequence
  Synthetic
tgtgtugccagagaguacagaag

SEQ ID NO: 76928 - DNA, 21 bp, Artificial Sequence
  Synthetic
ccugagagagaggaggacuct

SEQ ID NO: 76929 - DNA, 28 bp, Artificial Sequence
  Synthetic
gagactgtttgtauctgtaactgtccut

SEQ ID NO: 76930 - DNA, 24 bp, Artificial Sequence
  Synthetic
ccaaagtctucacagagctaugcc

SEQ ID NO: 76931 - DNA, 23 bp, Artificial Sequence
  Synthetic
ggctttucagcagcagctttuac

SEQ ID NO: 76932 - DNA, 23 bp, Artificial Sequence
  Synthetic
agattcttucacatggcggucaa

SEQ ID NO: 76933 - DNA, 20 bp, Artificial Sequence
  Synthetic
aaucgcugagggagggaaac

SEQ ID NO: 76934 - DNA, 21 bp, Artificial Sequence
  Synthetic
gctgctguaactgctgcauct

SEQ ID NO: 76935 - DNA, 28 bp, Artificial Sequence
  Synthetic
ccatacttttaaccutccttgggaagug

SEQ ID NO: 76936 - DNA, 24 bp, Artificial Sequence
  Synthetic
gtaagugctgggtuaaagacacct

SEQ ID NO: 76937 - DNA, 20 bp, Artificial Sequence
  Synthetic
gaccccgugatccgagaaug

SEQ ID NO: 76938 - DNA, 26 bp, Artificial Sequence
  Synthetic
gccatttccutgtaattgttguaccc

SEQ ID NO: 76939 - DNA, 22 bp, Artificial Sequence
  Synthetic
tgacgatcuctcctgtctucca

SEQ ID NO: 76940 - DNA, 24 bp, Artificial Sequence
  Synthetic
tccatcaucacaggacugaaaagg

SEQ ID NO: 76941 - DNA, 22 bp, Artificial Sequence
  Synthetic
ttcactgggcugtgcttactut

SEQ ID NO: 76942 - DNA, 22 bp, Artificial Sequence
  Synthetic
tgaaggaacucacaggaagcug

SEQ ID NO: 76943 - DNA, 28 bp, Artificial Sequence
  Synthetic
cttttcttaccugccttgaactctttug

SEQ ID NO: 76944 - DNA, 27 bp, Artificial Sequence
  Synthetic
tcacaagaatucaagacaggaacacuc

SEQ ID NO: 76945 - DNA, 27 bp, Artificial Sequence
  Synthetic
actgctgttgguacaggtttaaauact

SEQ ID NO: 76946 - DNA, 22 bp, Artificial Sequence
  Synthetic
accacagtgagugcagttgtut

SEQ ID NO: 76947 - DNA, 27 bp, Artificial Sequence
  Synthetic
gctcgagataucatgagtgatuccaac

SEQ ID NO: 76948 - DNA, 23 bp, Artificial Sequence
  Synthetic
ccactttugcagcaacctttuct

SEQ ID NO: 76949 - DNA, 30 bp, Artificial Sequence; identical to SEQ ID NO: 11721
  Synthetic

SEQ ID NO: 76950 - DNA, 28 bp, Artificial Sequence
  Synthetic
ggcagcttttatucttgtcattgcauat

SEQ ID NO: 76951 - DNA, 31 bp, Artificial Sequence
  Synthetic
tgcagttagaguaacttgtaagctatuagga

SEQ ID NO: 76952 - DNA, 21 bp, Artificial Sequence
  Synthetic
ggctcatgautcagaggcuga

SEQ ID NO: 76953 - DNA, 27 bp, Artificial Sequence
  Synthetic
ctcgtccatauagctgttgtagtucat

SEQ ID NO: 76954 - DNA, 23 bp, Artificial Sequence
  Synthetic
gcctccccutcagagtttctuaa

SEQ ID NO: 76955 - DNA, 28 bp, Artificial Sequence
  Synthetic
ccatctaattgaaugagcagtggaauct

SEQ ID NO: 76956 - DNA, 21 bp, Artificial Sequence
  Synthetic
tggttcugcgcaatatcugct

SEQ ID NO: 76957 - DNA, 21 bp, Artificial Sequence
  Synthetic
gcaggcgguacucagacaaat

SEQ ID NO: 76958 - DNA, 21 bp, Artificial Sequence
  Synthetic
cagcgutagcaaaugcagcaa

SEQ ID NO: 76959 - DNA, 21 bp, Artificial Sequence
  Synthetic
ggcagccuggttctcgaatua

SEQ ID NO: 76960 - DNA, 18 bp, Artificial Sequence
  Synthetic
gcctctcuccccacugac

SEQ ID NO: 76961 - DNA, 19 bp, Artificial Sequence
  Synthetic
gtgaggcccggcuactuac

SEQ ID NO: 76962 - DNA, 19 bp, Artificial Sequence
  Synthetic
gacgaaaugggcacgtugt

SEQ ID NO: 76963 - DNA, 20 bp, Artificial Sequence
  Synthetic
caucggaggcttcuccacag

SEQ ID NO: 76964 - DNA, 27 bp, Artificial Sequence
  Synthetic
ggtgttcatgaautaaaactcctgugt

SEQ ID NO: 76965 - DNA, 21 bp, Artificial Sequence
  Synthetic
gcgagggucaaacatttccug

SEQ ID NO: 76966 - DNA, 27 bp, Artificial Sequence
  Synthetic
aatgaagcagttuggtgatttgtgtut

SEQ ID NO: 76967 - DNA, 25 bp, Artificial Sequence
  Synthetic
gttacattcautccctgtgauggga

SEQ ID NO: 76968 - DNA, 24 bp, Artificial Sequence
  Synthetic
cgaagctcccaauacaacaacugt

SEQ ID NO: 76969 - DNA, 24 bp, Artificial Sequence
  Synthetic
ctggagaugactgcctttaugacc

SEQ ID NO: 76970 - DNA, 25 bp, Artificial Sequence
  Synthetic
gaacacctaugctgtaccacatuct

SEQ ID NO: 76971 - DNA, 20 bp, Artificial Sequence
  Synthetic
cgcccagagugctgaauacc

SEQ ID NO: 76972 - DNA, 23 bp, Artificial Sequence
  Synthetic
ccagttccutcctcagacucagt

SEQ ID NO: 76973 - DNA, 28 bp, Artificial Sequence
  Synthetic
gccactctctccuataaaaacctacauc

SEQ ID NO: 76974 - DNA, 23 bp, Artificial Sequence
  Synthetic
gggtcgtuggagtatgagguaag

SEQ ID NO: 76975 - DNA, 22 bp, Artificial Sequence
  Synthetic
cgcatcctcugtgttactccug

SEQ ID NO: 76976 - DNA, 24 bp, Artificial Sequence
  Synthetic
agtccctuggtaccttcucagaaa

SEQ ID NO: 76977 - DNA, 17 bp, Artificial Sequence
  Synthetic
cggaugcccccgtgtuc

SEQ ID NO: 76978 - DNA, 20 bp, Artificial Sequence
  Synthetic
cctgaccuggtgcatcctut

SEQ ID NO: 76979 - DNA, 20 bp, Artificial Sequence
  Synthetic
gcaccugcagctcatagcuc

SEQ ID NO: 76980 - DNA, 19 bp, Artificial Sequence
  Synthetic
ccucacaacgagcccaucc

SEQ ID NO: 76981 - DNA, 19 bp, Artificial Sequence
  Synthetic
ttcagccucgaagggcaut

SEQ ID NO: 76982 - DNA, 28 bp, Artificial Sequence
  Synthetic
atcacatagcauaggaagaaaacagcut

SEQ ID NO: 76983 - DNA, 28 bp, Artificial Sequence
  Synthetic
ctgtgacataccuacctgaaaaaggtut

SEQ ID NO: 76984 - DNA, 23 bp, Artificial Sequence
  Synthetic
ctttctgugaagggctgtgtgua

SEQ ID NO: 76985 - DNA, 21 bp, Artificial Sequence
  Synthetic
catgtcaccuccccaagacut

SEQ ID NO: 76986 - DNA, 19 bp, Artificial Sequence
  Synthetic
ctggcuccagaggaggcua

SEQ ID NO: 76987 - DNA, 17 bp, Artificial Sequence
  Synthetic
ctgctgccgucgactug

SEQ ID NO: 76988 - DNA, 22 bp, Artificial Sequence
  Synthetic
caggaaaugcccagcaagagua

SEQ ID NO: 76989 - DNA, 25 bp, Artificial Sequence
  Synthetic
gcactgacatcuagggcaaaatcut

SEQ ID NO: 76990 - DNA, 19 bp, Artificial Sequence
  Synthetic
gcuacagcccacctccuga

SEQ ID NO: 76991 - DNA, 19 bp, Artificial Sequence
  Synthetic
ctggtcuggcaccacugaa

SEQ ID NO: 76992 - DNA, 22 bp, Artificial Sequence
  Synthetic
agatcttgcccuttccagcauc

SEQ ID NO: 76993 - DNA, 24 bp, Artificial Sequence
  Synthetic
ttgcccaaagacugattaccagut

SEQ ID NO: 76994 - DNA, 21 bp, Artificial Sequence
  Synthetic
tctcagagcutcgaccaugga

SEQ ID NO: 76995 - DNA, 25 bp, Artificial Sequence
  Synthetic
ctggatttgaggaugattcagguga

SEQ ID NO: 76996 - DNA, 22 bp, Artificial Sequence
  Synthetic
ccccttcctutgtctgccttua

SEQ ID NO: 76997 - DNA, 22 bp, Artificial Sequence
  Synthetic
ggttctgagacccugtgtgtug

SEQ ID NO: 76998 - DNA, 20 bp, Artificial Sequence
  Synthetic
ggcttucccgagttaucgca

SEQ ID NO: 76999 - DNA, 20 bp, Artificial Sequence
  Synthetic
ctgcugcccgtgaagtuaga

SEQ ID NO: 77000 - DNA, 24 bp, Artificial Sequence
  Synthetic
ctgcttggcaguctctgacaauat

SEQ ID NO: 77001 - DNA, 24 bp, Artificial Sequence
  Synthetic
cggtttgatacugagctgcattug

SEQ ID NO: 77002 - DNA, 20 bp, Artificial Sequence
  Synthetic
caucccaagaggctgucaga

SEQ ID NO: 77003 - DNA, 17 bp, Artificial Sequence
  Synthetic
ccgucaagcgcgatugg

SEQ ID NO: 77004 - DNA, 20 bp, Artificial Sequence
  Synthetic
cccuggagtuccgcaaagac

SEQ ID NO: 77005 - DNA, 21 bp, Artificial Sequence
  Synthetic
tccatcccagcutcacaccua

SEQ ID NO: 77006 - DNA, 20 bp, Artificial Sequence
  Synthetic
cactcccgucaacauggaca

SEQ ID NO: 77007 - DNA, 20 bp, Artificial Sequence
  Synthetic
ccccggagaggguactttuc

SEQ ID NO: 77008 - DNA, 18 bp, Artificial Sequence
  Synthetic
ctucggcccagcacucat

SEQ ID NO: 77009 - DNA, 21 bp, Artificial Sequence
  Synthetic
agcaaggtcugggacctguaa

SEQ ID NO: 77010 - DNA, 18 bp, Artificial Sequence
  Synthetic
tggaaggagccgcugaug

SEQ ID NO: 77011 - DNA, 18 bp, Artificial Sequence
  Synthetic
tcccggagucgggatcut

SEQ ID NO: 77012 - DNA, 18 bp, Artificial Sequence
  Synthetic
ggcagccucagcggauac

SEQ ID NO: 77013 - DNA, 17 bp, Artificial Sequence
  Synthetic
cgggaucggcugcgaat

SEQ ID NO: 77014 - DNA, 19 bp, Artificial Sequence
  Synthetic
gccagacgcaagauccauc

SEQ ID NO: 77015 - DNA, 17 bp, Artificial Sequence
  Synthetic
gcuggccacccctucat

SEQ ID NO: 77016 - DNA, 27 bp, Artificial Sequence
  Synthetic
tggagggaauggaaaaatucaaagaca

SEQ ID NO: 77017 - DNA, 28 bp, Artificial Sequence
  Synthetic
aggagtattccuggtcctaaagaugaaa

SEQ ID NO: 77018 - DNA, 21 bp, Artificial Sequence
  Synthetic
agaggcugcagtcaacttcuc

SEQ ID NO: 77019 - DNA, 23 bp, Artificial Sequence
  Synthetic
gctcaaatggcauagtctccuca

SEQ ID NO: 77020 - DNA, 20 bp, Artificial Sequence
  Synthetic
agacaaucccugcggacaag

SEQ ID NO: 77021 - DNA, 24 bp, Artificial Sequence
  Synthetic
ccagttaggtcutatcctggccua

SEQ ID NO: 77022 - DNA, 24 bp, Artificial Sequence
  Synthetic
ggcaacaaaacuccacaguaaagg

SEQ ID NO: 77023 - DNA, 28 bp, Artificial Sequence
  Synthetic
ccaataatcttcuccgttctctctcaut

SEQ ID NO: 77024 - DNA, 22 bp, Artificial Sequence
  Synthetic
tcagctctgcauttcacacgua

SEQ ID NO: 77025 - DNA, 23 bp, Artificial Sequence
  Synthetic
caggttctcuggagcaatacuga

SEQ ID NO: 77026 - DNA, 23 bp, Artificial Sequence
  Synthetic
ggtcacuctgaggagucaaaagt

SEQ ID NO: 77027 - DNA, 21 bp, Artificial Sequence
  Synthetic
ccaaaugtauccacggcccaa

SEQ ID NO: 77028 - DNA, 22 bp, Artificial Sequence
  Synthetic
cccatcatcacucactggctut

SEQ ID NO: 77029 - DNA, 22 bp, Artificial Sequence
  Synthetic
agcctagttgutccctccatug

SEQ ID NO: 77030 - DNA, 22 bp, Artificial Sequence
  Synthetic
gggatgguagcccaggttcaua

SEQ ID NO: 77031 - DNA, 23 bp, Artificial Sequence
  Synthetic
ccttgccagaugatgaugacgag

SEQ ID NO: 77032 - DNA, 21 bp, Artificial Sequence
  Synthetic
ccaccaagaucatgcagcuga

SEQ ID NO: 77033 - DNA, 28 bp, Artificial Sequence
  Synthetic
acttagatgaugacagagggtttaucca

SEQ ID NO: 77034 - DNA, 28 bp, Artificial Sequence
  Synthetic
gcagtttcccacagauattctaagucat

SEQ ID NO: 77035 - DNA, 20 bp, Artificial Sequence
  Synthetic
gttcctgccuggtgaccuac

SEQ ID NO: 77036 - DNA, 21 bp, Artificial Sequence
  Synthetic
ccaaccagutttacgccucct

SEQ ID NO: 77037 - DNA, 20 bp, Artificial Sequence
  Synthetic
tgctctugccggaacuacac

SEQ ID NO: 77038 - DNA, 28 bp, Artificial Sequence
  Synthetic
tctgttgttutaaaagccttuggaagac

SEQ ID NO: 77039 - DNA, 28 bp, Artificial Sequence
  Synthetic
tcactctccttautttctgcctcaatut

SEQ ID NO: 77040 - DNA, 27 bp, Artificial Sequence
  Synthetic
gggaggcacugactgaagtatuaaaag

SEQ ID NO: 77041 - DNA, 28 bp, Artificial Sequence
  Synthetic
aggactcauttgatagatttuggaagca

SEQ ID NO: 77042 - DNA, 20 bp, Artificial Sequence
  Synthetic
ggacccagaggugcugagat

SEQ ID NO: 77043 - DNA, 20 bp, Artificial Sequence
  Synthetic
gccactucttggtgtugcag

SEQ ID NO: 77044 - DNA, 24 bp, Artificial Sequence
  Synthetic
cactcttacacutacgcccaagua

SEQ ID NO: 77045 - DNA, 21 bp, Artificial Sequence
  Synthetic
gtcgtggacuggaatggguag

SEQ ID NO: 77046 - DNA, 20 bp, Artificial Sequence
  Synthetic
ggtgcucggtttuggaccat

SEQ ID NO: 77047 - DNA, 18 bp, Artificial Sequence
  Synthetic
gggctttuccgctctucc

SEQ ID NO: 77048 - DNA, 21 bp, Artificial Sequence
  Synthetic
tcaccctccutctctctccug

SEQ ID NO: 77049 - DNA, 20 bp, Artificial Sequence
  Synthetic
cgtggtggauggacgtctug

SEQ ID NO: 77050 - DNA, 21 bp, Artificial Sequence
  Synthetic
ctggaatcucagccccttcuc

SEQ ID NO: 77051 - DNA, 17 bp, Artificial Sequence
  Synthetic
gguggacagcgaugggt

SEQ ID NO: 77052 - DNA, 24 bp, Artificial Sequence
  Synthetic
gtcctgtaaggcuttggtatccug

SEQ ID NO: 77053 - DNA, 21 bp, Artificial Sequence
  Synthetic
aggcugggaagacacttctug

SEQ ID NO: 77054 - DNA, 17 bp, Artificial Sequence
  Synthetic
ccgccgaaggacgucuc

SEQ ID NO: 77055 - DNA, 19 bp, Artificial Sequence
  Synthetic
tgggacgacuccagctuca

SEQ ID NO: 77056 - DNA, 23 bp, Artificial Sequence
  Synthetic
gagaaagagugcctcaaguacca

SEQ ID NO: 77057 - DNA, 19 bp, Artificial Sequence
  Synthetic
ctgtacucgggcacguagg

SEQ ID NO: 77058 - DNA, 19 bp, Artificial Sequence
  Synthetic
ccaccccaucaccaccuac

SEQ ID NO: 77059 - DNA, 19 bp, Artificial Sequence
  Synthetic
agggaagagcuggctccua

SEQ ID NO: 77060 - DNA, 20 bp, Artificial Sequence
  Synthetic
cccaucauggcaagcacaga

SEQ ID NO: 77061 - DNA, 25 bp, Artificial Sequence
  Synthetic
cagtcagcccaucattcagatucat

SEQ ID NO: 77062 - DNA, 27 bp, Artificial Sequence
  Synthetic
caatgctgtuaacaagatttggcctua

SEQ ID NO: 77063 - DNA, 22 bp, Artificial Sequence
  Synthetic
acaucaaaguggacgaacgact

SEQ ID NO: 77064 - DNA, 22 bp, Artificial Sequence
  Synthetic
catgacacaugaggtggctcut

SEQ ID NO: 77065 - DNA, 28 bp, Artificial Sequence
  Synthetic
atctaagtcaautacaggaaacauggct

SEQ ID NO: 77066 - DNA, 21 bp, Artificial Sequence
  Synthetic
ctcctgucaacaccauggagt

SEQ ID NO: 77067 - DNA, 22 bp, Artificial Sequence
  Synthetic
tgcttgttuggcttgtgttcug

SEQ ID NO: 77068 - DNA, 28 bp, Artificial Sequence
  Synthetic
ccccgtctttguaatattctctctcuct

SEQ ID NO: 77069 - DNA, 21 bp, Artificial Sequence
  Synthetic
cttggaaugagggacggtuct

SEQ ID NO: 77070 - DNA, 17 bp, Artificial Sequence
  Synthetic
gacggtuccccggtgut

SEQ ID NO: 77071 - DNA, 17 bp, Artificial Sequence
  Synthetic
gctccggcuctcctucc

SEQ ID NO: 77072 - DNA, 18 bp, Artificial Sequence
  Synthetic
ccagagucaggtgugcga

SEQ ID NO: 77073 - DNA, 17 bp, Artificial Sequence
  Synthetic
ctuggcccggctctugt

SEQ ID NO: 77074 - DNA, 28 bp, Artificial Sequence
  Synthetic
tttgtcttctcuagcaattttgacugga

SEQ ID NO: 77075 - DNA, 26 bp, Artificial Sequence
  Synthetic
ctttctatggagcugggatcaatcug

SEQ ID NO: 77076 - DNA, 28 bp, Artificial Sequence
  Synthetic
accugtagacctagtuaccaaaagacaa

SEQ ID NO: 77077 - DNA, 27 bp, Artificial Sequence
  Synthetic
tgcaacgttcugactacttgaauacat

SEQ ID NO: 77078 - DNA, 28 bp, Artificial Sequence
  Synthetic
cctgagctagtutgatcttcaagtttuc

SEQ ID NO: 77079 - DNA, 28 bp, Artificial Sequence
  Synthetic
atttctaggacttuaccactacctgcua

SEQ ID NO: 77080 - DNA, 22 bp, Artificial Sequence
  Synthetic
agctgcuggagaagagauacga

SEQ ID NO: 77081 - DNA, 22 bp, Artificial Sequence
  Synthetic
ggtcttguagggaggaccugag

SEQ ID NO: 77082 - DNA, 22 bp, Artificial Sequence
  Synthetic
ccccaaccuaagcactgtuagt

SEQ ID NO: 77083 - DNA, 24 bp, Artificial Sequence
  Synthetic
ctgattctgcuggttctttgctug

SEQ ID NO: 77084 - DNA, 21 bp, Artificial Sequence
  Synthetic
tgaacttcgaauggcgaucgt

SEQ ID NO: 77085 - DNA, 22 bp, Artificial Sequence
  Synthetic
catguccaagaggacaguagca

SEQ ID NO: 77086 - DNA, 25 bp, Artificial Sequence
  Synthetic
tcaaguaaatcagaugccgacacaa

SEQ ID NO: 77087 - DNA, 28 bp, Artificial Sequence
  Synthetic
tcatttacugacacaaccaataccaugt

SEQ ID NO: 77088 - DNA, 20 bp, Artificial Sequence
  Synthetic
ggtcagcacugtacctcugg

SEQ ID NO: 77089 - DNA, 20 bp, Artificial Sequence
  Synthetic
aggagtguctgtgcccuaca

SEQ ID NO: 77090 - DNA, 26 bp, Artificial Sequence
  Synthetic
tcttcagcuaatttttctgcauccct

SEQ ID NO: 77091 - DNA, 22 bp, Artificial Sequence
  Synthetic
tcggcaacagcuatcaccttuc

SEQ ID NO: 77092 - DNA, 25 bp, Artificial Sequence
  Synthetic
agttccucaaaagagaaaucacgca

SEQ ID NO: 77093 - DNA, 28 bp, Artificial Sequence
  Synthetic
gctaaggcauaggaattttcgtaguaca

SEQ ID NO: 77094 - DNA, 21 bp, Artificial Sequence
  Synthetic
cactggtgcgaucccacaaua

SEQ ID NO: 77095 - DNA, 29 bp, Artificial Sequence
  Synthetic
tggacagaaggccutataacattagttuc

SEQ ID NO: 77096 - DNA, 23 bp, Artificial Sequence
  Synthetic
cttctggaautgtgctagtuggg

SEQ ID NO: 77097 - DNA, 23 bp, Artificial Sequence
  Synthetic
ctaacaacgccutctcuccacat

SEQ ID NO: 77098 - DNA, 27 bp, Artificial Sequence
  Synthetic
caaccutatgattcaucaggagagcat

SEQ ID NO: 77099 - DNA, 27 bp, Artificial Sequence
  Synthetic
agggttgttaguggagcatatgattut

SEQ ID NO: 77100 - DNA, 21 bp, Artificial Sequence
  Synthetic
gggccttucagtgagauacct

SEQ ID NO: 77101 - DNA, 28 bp, Artificial Sequence
  Synthetic
catatctttgttcuctgctcttagcuct

SEQ ID NO: 77102 - DNA, 22 bp, Artificial Sequence
  Synthetic
cttgcattautggttgguggca

SEQ ID NO: 77103 - DNA, 28 bp, Artificial Sequence
  Synthetic
gctggtcttcuagcatatagctgaguaa

SEQ ID NO: 77104 - DNA, 28 bp, Artificial Sequence
  Synthetic
gaaaacctgcagaucatcagaggaaaua

SEQ ID NO: 77105 - DNA, 23 bp, Artificial Sequence
  Synthetic
ctgctguctgcatttaugaaccc

SEQ ID NO: 77106 - DNA, 23 bp, Artificial Sequence
  Synthetic
tctggaucccacaccttuaccat

SEQ ID NO: 77107 - DNA, 21 bp, Artificial Sequence
  Synthetic
tctgcagagutgttagcggut

SEQ ID NO: 77108 - DNA, 20 bp, Artificial Sequence
  Synthetic
catctccuccgagccugaaa

SEQ ID NO: 77109 - DNA, 29 bp, Artificial Sequence
  Synthetic
gctgttttctcucggatctccaaattuaa

SEQ ID NO: 77110 - DNA, 21 bp, Artificial Sequence
  Synthetic
tggtttccccaauccacccua

SEQ ID NO: 77111 - DNA, 21 bp, Artificial Sequence
  Synthetic
ggtcuccaggagctgaucaca

SEQ ID NO: 77112 - DNA, 20 bp, Artificial Sequence
  Synthetic
cagggacguctccuggagat

SEQ ID NO: 77113 - DNA, 23 bp, Artificial Sequence
  Synthetic
gaactttucaagctgcugaagga

SEQ ID NO: 77114 - DNA, 21 bp, Artificial Sequence
  Synthetic
gcagttacugggcttguccat

SEQ ID NO: 77115 - DNA, 20 bp, Artificial Sequence
  Synthetic
gaggcggagaagcucuaaca

SEQ ID NO: 77116 - DNA, 17 bp, Artificial Sequence
  Synthetic
gagctcuggctcuggca

SEQ ID NO: 77117 - DNA, 21 bp, Artificial Sequence
  Synthetic
agacguccctgacctuacagt

SEQ ID NO: 77118 - DNA, 20 bp, Artificial Sequence
  Synthetic
gcttagugccttgtcugggt

SEQ ID NO: 77119 - DNA, 22 bp, Artificial Sequence
  Synthetic
ccagactcaugccctctctcut

SEQ ID NO: 77120 - DNA, 20 bp, Artificial Sequence
  Synthetic
cagcaugagctcccauccat

SEQ ID NO: 77121 - DNA, 26 bp, Artificial Sequence
  Synthetic
atctggtttcutccttcttcucacag

SEQ ID NO: 77122 - DNA, 27 bp, Artificial Sequence
  Synthetic
agcacactgucactatttcagtaacuc

SEQ ID NO: 77123 - DNA, 28 bp, Artificial Sequence
  Synthetic
agagactggagaaugtatacacacctua

SEQ ID NO: 77124 - DNA, 27 bp, Artificial Sequence
  Synthetic
gcttaattcuaccttgtagccuccaat

SEQ ID NO: 77125 - DNA, 21 bp, Artificial Sequence
  Synthetic
cggccaacacugtcaagttuc

SEQ ID NO: 77126 - DNA, 20 bp, Artificial Sequence
  Synthetic
gcatggtuggcattgggtuc

SEQ ID NO: 77127 - DNA, 23 bp, Artificial Sequence
  Synthetic
gggaagctguccatcagtauaca

SEQ ID NO: 77128 - DNA, 22 bp, Artificial Sequence
  Synthetic
gcacagtggaaguatgcccaua

SEQ ID NO: 77129 - DNA, 28 bp, Artificial Sequence
  Synthetic
cttaagtgtttutccagtgtcugagaac

SEQ ID NO: 77130 - DNA, 24 bp, Artificial Sequence
  Synthetic
actccacctguatgtcccacuaat

SEQ ID NO: 77131 - DNA, 29 bp, Artificial Sequence
  Synthetic
ggaugtaatattttcugaagagccaaaca

SEQ ID NO: 77132 - DNA, 22 bp, Artificial Sequence
  Synthetic
gagtgtgcaaaucccccatcua

SEQ ID NO: 77133 - DNA, 21 bp, Artificial Sequence
  Synthetic
gggtcggucatcgtcuacaag

SEQ ID NO: 77134 - DNA, 23 bp, Artificial Sequence
  Synthetic
cgtcaauggaacaaacccaucac

SEQ ID NO: 77135 - DNA, 17 bp, Artificial Sequence
  Synthetic
tcagccuggaccgguca

SEQ ID NO: 77136 - DNA, 22 bp, Artificial Sequence
  Synthetic
agcatgggugcagacaacatua

SEQ ID NO: 77137 - DNA, 24 bp, Artificial Sequence
  Synthetic
gctcuagacaacaaaccttgugga

SEQ ID NO: 77138 - DNA, 22 bp, Artificial Sequence
  Synthetic
ctatttcagccccacuctgcut

SEQ ID NO: 77139 - DNA, 21 bp, Artificial Sequence
  Synthetic
cgggtcuccattgtcuagcac

SEQ ID NO: 77140 - DNA, 26 bp, Artificial Sequence
  Synthetic
tcactcttctuggtaccactctucat

SEQ ID NO: 77141 - DNA, 21 bp, Artificial Sequence
  Synthetic
ctaacacccugttcgcacuga

SEQ ID NO: 77142 - DNA, 23 bp, Artificial Sequence
  Synthetic
ccctatgcuctgacaaggguact

SEQ ID NO: 77143 - DNA, 28 bp, Artificial Sequence
  Synthetic
gtgcaactgaaagcugtgattctttaua

SEQ ID NO: 77144 - DNA, 22 bp, Artificial Sequence
  Synthetic
ccaaatgcuggtaacactgugg

SEQ ID NO: 77145 - DNA, 28 bp, Artificial Sequence
  Synthetic
agtggaacuggaagagtgaaaaaguaag

SEQ ID NO: 77146 - DNA, 23 bp, Artificial Sequence
  Synthetic
agctcttugaggacaactaugcc

SEQ ID NO: 77147 - DNA, 25 bp, Artificial Sequence
  Synthetic
tggtcagcuctgaauaaccaagaga

SEQ ID NO: 77148 - DNA, 18 bp, Artificial Sequence
  Synthetic
gtcccugcatccucgcat

SEQ ID NO: 77149 - DNA, 17 bp, Artificial Sequence
  Synthetic
gcctgcagutcgctugt

SEQ ID NO: 77150 - DNA, 20 bp, Artificial Sequence
  Synthetic
ggtcgcgguttgtctctcut

SEQ ID NO: 77151 - DNA, 19 bp, Artificial Sequence
  Synthetic
agacuaagcgccucagggt

SEQ ID NO: 77152 - DNA, 28 bp, Artificial Sequence
  Synthetic
ggaaaatctuaggagatacagggaaugg

SEQ ID NO: 77153 - DNA, 20 bp, Artificial Sequence
  Synthetic
tcgutctgtuccagccgaaa

SEQ ID NO: 77154 - DNA, 23 bp, Artificial Sequence
  Synthetic
gcatgcatattutgtcagcggua

SEQ ID NO: 77155 - DNA, 25 bp, Artificial Sequence
  Synthetic
acccttcaucctgaactuaggagaa

SEQ ID NO: 77156 - DNA, 18 bp, Artificial Sequence
  Synthetic
gctcugcacgcgtgtgua

SEQ ID NO: 77157 - DNA, 19 bp, Artificial Sequence
  Synthetic
tccctcacccaugcccuat

SEQ ID NO: 77158 - DNA, 17 bp, Artificial Sequence
  Synthetic
ctugccgggcuggaagt

SEQ ID NO: 77159 - DNA, 19 bp, Artificial Sequence
  Synthetic
cgcaagggcaacuacugga

SEQ ID NO: 77160 - DNA, 18 bp, Artificial Sequence
  Synthetic
gcggccacgagutgtuga

SEQ ID NO: 77161 - DNA, 19 bp, Artificial Sequence
  Synthetic
cgcaugaagaggccctucc

SEQ ID NO: 77162 - DNA, 28 bp, Artificial Sequence
  Synthetic
acagagactccuagttagaccactttut

SEQ ID NO: 77163 - DNA, 25 bp, Artificial Sequence
  Synthetic
gctgtaaaguacgacuaccacaagt

SEQ ID NO: 77164 - DNA, 24 bp, Artificial Sequence
  Synthetic
aaaagaaactccuacgtggtgugt

SEQ ID NO: 77165 - DNA, 22 bp, Artificial Sequence
  Synthetic
ggctttggcugtggtcaactua

SEQ ID NO: 77166 - DNA, 22 bp, Artificial Sequence
  Synthetic
gctatcctgacuctgccccuaa

SEQ ID NO: 77167 - DNA, 22 bp, Artificial Sequence
  Synthetic
cagcaucaaccacacauaccag

SEQ ID NO: 77168 - DNA, 22 bp, Artificial Sequence
  Synthetic
ccttcucgaacatgtctucgca

SEQ ID NO: 77169 - DNA, 20 bp, Artificial Sequence
  Synthetic
tcgcgaagutcccgttcuac

SEQ ID NO: 77170 - DNA, 24 bp, Artificial Sequence
  Synthetic
ttgccagcccutcttattcttcuc

SEQ ID NO: 77171 - DNA, 18 bp, Artificial Sequence
  Synthetic
gcagaagcccccguacuc

SEQ ID NO: 77172 - DNA, 20 bp, Artificial Sequence
  Synthetic
caggtcaguggatccccuct

SEQ ID NO: 77173 - DNA, 24 bp, Artificial Sequence
  Synthetic
caatggaacuatccggaacaucct

SEQ ID NO: 77174 - DNA, 26 bp, Artificial Sequence
  Synthetic
ttgggatguctgattattcugaacgg

SEQ ID NO: 77175 - DNA, 28 bp, Artificial Sequence
  Synthetic
ctccagactctutttgaccaatattgut

SEQ ID NO: 77176 - DNA, 17 bp, Artificial Sequence
  Synthetic
gcgaugagcgccacgua

SEQ ID NO: 77177 - DNA, 17 bp, Artificial Sequence
  Synthetic
cugcuggccccagagac

SEQ ID NO: 77178 - DNA, 28 bp, Artificial Sequence
  Synthetic
ttaaatgcctuagagtgttcctcaaugt

SEQ ID NO: 77179 - DNA, 28 bp, Artificial Sequence
  Synthetic
cagaaaagauggaaactttggactucaa

SEQ ID NO: 77180 - DNA, 21 bp, Artificial Sequence
  Synthetic
gtgggtgggutggatgtauga

SEQ ID NO: 77181 - DNA, 22 bp, Artificial Sequence
  Synthetic
gguggtgaucaaacaggaacag

SEQ ID NO: 77182 - DNA, 29 bp, Artificial Sequence
  Synthetic
ccttacctgucaagttctttaauccaagt

SEQ ID NO: 77183 - DNA, 22 bp, Artificial Sequence
  Synthetic
tcgttaccugcctcuggagaat

SEQ ID NO: 77184 - DNA, 28 bp, Artificial Sequence
  Synthetic
gttttgtagtagcccutctaagccatua

SEQ ID NO: 77185 - DNA, 24 bp, Artificial Sequence
  Synthetic
catgcagaaaaugatgaugcccaa

SEQ ID NO: 77186 - DNA, 26 bp, Artificial Sequence
  Synthetic
tcagcgtgaacautttggtaaatugg

SEQ ID NO: 77187 - DNA, 28 bp, Artificial Sequence
  Synthetic
tgtagcaattgggcuaaatctgtcttua

SEQ ID NO: 77188 - DNA, 24 bp, Artificial Sequence
  Synthetic
cgtgggatguttttgcagatgaug

SEQ ID NO: 77189 - DNA, 23 bp, Artificial Sequence
  Synthetic
ctgcagugggaccactattauct

SEQ ID NO: 77190 - DNA, 23 bp, Artificial Sequence
  Synthetic
cucaggagagacagcttugaagt

SEQ ID NO: 77191 - DNA, 25 bp, Artificial Sequence
  Synthetic
gcgatttuggactacctcauaacca

SEQ ID NO: 77192 - DNA, 25 bp, Artificial Sequence
  Synthetic
gttttgtcccacgaauaatgcguaa

SEQ ID NO: 77193 - DNA, 27 bp, Artificial Sequence
  Synthetic
tcgttttauaacacaggcaactgttug

SEQ ID NO: 77194 - DNA, 21 bp, Artificial Sequence
  Synthetic
cctctuacccacgacauccag

SEQ ID NO: 77195 - DNA, 24 bp, Artificial Sequence
  Synthetic
ccctcaatgtauccctttggcaut

SEQ ID NO: 77196 - DNA, 18 bp, Artificial Sequence
  Synthetic
gtcguaggcgaaguccgt

SEQ ID NO: 77197 - DNA, 17 bp, Artificial Sequence
  Synthetic
gcccugcccaccctauc

SEQ ID NO: 77198 - DNA, 19 bp, Artificial Sequence
  Synthetic
aagccuatgugcggaagca

SEQ ID NO: 77199 - DNA, 23 bp, Artificial Sequence
  Synthetic
cccatcacgutgcctttatccuc

SEQ ID NO: 77200 - DNA, 19 bp, Artificial Sequence
  Synthetic
ctctgctcugctccgugac

SEQ ID NO: 77201 - DNA, 21 bp, Artificial Sequence
  Synthetic
gtaagcacagagcgugtgtuc

SEQ ID NO: 77202 - DNA, 17 bp, Artificial Sequence
  Synthetic
gcccagaaucgcuccct

SEQ ID NO: 77203 - DNA, 19 bp, Artificial Sequence
  Synthetic
agggtcccugggagatgug

SEQ ID NO: 77204 - DNA, 22 bp, Artificial Sequence
  Synthetic
ggtgatggguttgggttgatug

SEQ ID NO: 77205 - DNA, 23 bp, Artificial Sequence
  Synthetic
cagcttcatucccactgcagaua

SEQ ID NO: 77206 - DNA, 25 bp, Artificial Sequence
  Synthetic
ggtattcttgcutaaagctctgcug

SEQ ID NO: 77207 - DNA, 23 bp, Artificial Sequence
  Synthetic
cutccttctccauccaaccacat

SEQ ID NO: 77208 - DNA, 21 bp, Artificial Sequence
  Synthetic
gcgggtcutcataaaggugct

SEQ ID NO: 77209 - DNA, 25 bp, Artificial Sequence
  Synthetic
tgtaaatgcttcugcacaagctuac

SEQ ID NO: 77210 - DNA, 20 bp, Artificial Sequence
  Synthetic
gggtgtgacacugcttccuc

SEQ ID NO: 77211 - DNA, 19 bp, Artificial Sequence
  Synthetic
gggaccagucaaggtgugt

SEQ ID NO: 77212 - DNA, 19 bp, Artificial Sequence
  Synthetic
accutgactgguccccaga

SEQ ID NO: 77213 - DNA, 21 bp, Artificial Sequence
  Synthetic
gccccugacagacacatctua

SEQ ID NO: 77214 - DNA, 23 bp, Artificial Sequence
  Synthetic
cagagatcuggttccacttuggg

SEQ ID NO: 77215 - DNA, 20 bp, Artificial Sequence
  Synthetic
ccauacagcagccaguacga

SEQ ID NO: 77216 - DNA, 29 bp, Artificial Sequence
  Synthetic
ggttgtctaaaguaataactccatuggct

SEQ ID NO: 77217 - DNA, 24 bp, Artificial Sequence
  Synthetic
gagctgaagaggguaaaagtccut

SEQ ID NO: 77218 - DNA, 21 bp, Artificial Sequence
  Synthetic
aggagtccuctgtccctctuc

SEQ ID NO: 77219 - DNA, 24 bp, Artificial Sequence
  Synthetic
gaggutgtattauaggccagcagt

SEQ ID NO: 77220 - DNA, 20 bp, Artificial Sequence
  Synthetic
accgtuccaaaagcaccuga

SEQ ID NO: 77221 - DNA, 24 bp, Artificial Sequence
  Synthetic
agaggacugactatcggacugaaa

SEQ ID NO: 77222 - DNA, 21 bp, Artificial Sequence
  Synthetic
ccaggaagutgcaccgauagg

SEQ ID NO: 77223 - DNA, 22 bp, Artificial Sequence
  Synthetic
ggtttggguagtagagcaugga

SEQ ID NO: 77224 - DNA, 27 bp, Artificial Sequence
  Synthetic
cactgaaacaacuttacaagtguggat

SEQ ID NO: 77225 - DNA, 24 bp, Artificial Sequence
  Synthetic
ctaagagtttaaccugccgcctua

SEQ ID NO: 77226 - DNA, 28 bp, Artificial Sequence
  Synthetic
aaaaagaagcuagaagaccttggtgaut

SEQ ID NO: 77227 - DNA, 28 bp, Artificial Sequence
  Synthetic
tgtctcttgtagguttcaagttgactuc

SEQ ID NO: 77228 - DNA, 28 bp, Artificial Sequence
  Synthetic
gcagaauactgtcagtcuagaggaagag

SEQ ID NO: 77229 - DNA, 30 bp, Artificial Sequence
  Synthetic
ttttggtaagcuacatgtcataacugagag

SEQ ID NO: 77230 - DNA, 22 bp, Artificial Sequence
  Synthetic
gaaggucaaagagguggaagga

SEQ ID NO: 77231 - DNA, 21 bp, Artificial Sequence
  Synthetic
gcaaacatguacacccgcuct

SEQ ID NO: 77232 - DNA, 26 bp, Artificial Sequence
  Synthetic
ctgtttatgtttugcctctcaggtuc

SEQ ID NO: 77233 - DNA, 21 bp, Artificial Sequence
  Synthetic
gcctgtgucatgtctgguaca

SEQ ID NO: 77234 - DNA, 22 bp, Artificial Sequence
  Synthetic
agagtucccaggcaacaaacut

SEQ ID NO: 77235 - DNA, 21 bp, Artificial Sequence
  Synthetic
aagaggtagtuggcctgctuc

SEQ ID NO: 77236 - DNA, 22 bp, Artificial Sequence
  Synthetic
gagaccctaugggcactttguc

SEQ ID NO: 77237 - DNA, 23 bp, Artificial Sequence
  Synthetic
gaagaaucagccucgcaacaaac

SEQ ID NO: 77238 - DNA, 28 bp, Artificial Sequence
  Synthetic
agaggaattgtagaguactgaacaggua

SEQ ID NO: 77239 - DNA, 27 bp, Artificial Sequence
  Synthetic
tggaaacagguattgatgaagaugacc

SEQ ID NO: 77240 - DNA, 21 bp, Artificial Sequence
  Synthetic
gcagcacuggtatcaucagca

SEQ ID NO: 77241 - DNA, 28 bp, Artificial Sequence
  Synthetic
gtcctguaatactgtctugaaagcagat

SEQ ID NO: 77242 - DNA, 27 bp, Artificial Sequence
  Synthetic
cctgttttctgaautctgcttccauct

SEQ ID NO: 77243 - DNA, 28 bp, Artificial Sequence
  Synthetic
cagcaacgttuaacttccaaatgtguat

SEQ ID NO: 77244 - DNA, 23 bp, Artificial Sequence
  Synthetic
gcatcatttccuaaagcgctuga

SEQ ID NO: 77245 - DNA, 21 bp, Artificial Sequence
  Synthetic
ggagactaacaugggctggut

SEQ ID NO: 77246 - DNA, 21 bp, Artificial Sequence
  Synthetic
ggccaggguagctctttucaa

SEQ ID NO: 77247 - DNA, 27 bp, Artificial Sequence
  Synthetic
ggattgtgtgtuctgtcctcattguat

SEQ ID NO: 77248 - DNA, 28 bp, Artificial Sequence
  Synthetic
aatgctgacaugatattacagtgguagg

SEQ ID NO: 77249 - DNA, 24 bp, Artificial Sequence
  Synthetic
tttccgagcauatgcaactaggut

SEQ ID NO: 77250 - DNA, 21 bp, Artificial Sequence
  Synthetic
gggccaccuggaaagatacuc

SEQ ID NO: 77251 - DNA, 27 bp, Artificial Sequence
  Synthetic
tgcacaattagtucgagaagttgaugt

SEQ ID NO: 77252 - DNA, 25 bp, Artificial Sequence
  Synthetic
ggattcucaaaagcagacacctuct

SEQ ID NO: 77253 - DNA, 28 bp, Artificial Sequence
  Synthetic
ccagtataugaaggaaggtgttaccuga

SEQ ID NO: 77254 - DNA, 25 bp, Artificial Sequence
  Synthetic
tgcttuaaaagacagacggauggaa

SEQ ID NO: 77255 - DNA, 28 bp, Artificial Sequence
  Synthetic
ccacaacaggtucaatcttggctatuaa

SEQ ID NO: 77256 - DNA, 26 bp, Artificial Sequence
  Synthetic
tgttttcutctctttaguggcacact

SEQ ID NO: 77257 - DNA, 27 bp, Artificial Sequence
  Synthetic
ttcatcactuacgctgttgatttcuct

SEQ ID NO: 77258 - DNA, 19 bp, Artificial Sequence
  Synthetic
gtcctcgacguccatcugt

SEQ ID NO: 77259 - DNA, 19 bp, Artificial Sequence
  Synthetic
ctggacacauggcaccugt

SEQ ID NO: 77260 - DNA, 19 bp, Artificial Sequence
  Synthetic
caggatgugtccggagugg

SEQ ID NO: 77261 - DNA, 25 bp, Artificial Sequence
  Synthetic
agaugtccaacaaguccaagaagag

SEQ ID NO: 77262 - DNA, 25 bp, Artificial Sequence
  Synthetic
gatcaaaguccacaaatucgagcat

SEQ ID NO: 77263 - DNA, 27 bp, Artificial Sequence
  Synthetic
tcattacaaccatuccctagctctgua

SEQ ID NO: 77264 - DNA, 23 bp, Artificial Sequence
  Synthetic
ccccctcaaaaaugctggtgaua

SEQ ID NO: 77265 - DNA, 26 bp, Artificial Sequence
  Synthetic
acaggtcccucacataatcaaguagt

SEQ ID NO: 77266 - DNA, 21 bp, Artificial Sequence
  Synthetic
gcacttugacagctccucgaa

SEQ ID NO: 77267 - DNA, 22 bp, Artificial Sequence
  Synthetic
ggaaugttgcuggaggaaggaa

SEQ ID NO: 77268 - DNA, 21 bp, Artificial Sequence
  Synthetic
tctggcacugatggttgcaut

SEQ ID NO: 77269 - DNA, 28 bp, Artificial Sequence
  Synthetic
tgggucccaaaaattatauaagcacaga

SEQ ID NO: 77270 - DNA, 28 bp, Artificial Sequence
  Synthetic
aactagtttgtaauctcttgcctcttug

SEQ ID NO: 77271 - DNA, 29 bp, Artificial Sequence
  Synthetic
agtcaagaactucagagaaaggcaaaaua

SEQ ID NO: 77272 - DNA, 22 bp, Artificial Sequence
  Synthetic
cggttgtcatugcagactccua

SEQ ID NO: 77273 - DNA, 29 bp, Artificial Sequence
  Synthetic
ggtatacattacaaugacctgaggagaut

SEQ ID NO: 77274 - DNA, 22 bp, Artificial Sequence
  Synthetic
cctggacctugagggattgtut

SEQ ID NO: 77275 - DNA, 26 bp, Artificial Sequence
  Synthetic
ccacctcacagutattgaacatccuc

SEQ ID NO: 77276 - DNA, 20 bp, Artificial Sequence
  Synthetic
tccttccuttcctccugcga

SEQ ID NO: 77277 - DNA, 17 bp, Artificial Sequence
  Synthetic
tcgucccacggcttcug

SEQ ID NO: 77278 - DNA, 17 bp, Artificial Sequence
  Synthetic
ggatgtccugcgccuca

SEQ ID NO: 77279 - DNA, 17 bp, Artificial Sequence
  Synthetic
cccccggccauctagut

SEQ ID NO: 77280 - DNA, 22 bp, Artificial Sequence
  Synthetic
gatacaccucccctctuggaac

SEQ ID NO: 77281 - DNA, 22 bp, Artificial Sequence
  Synthetic
gcttatcgugacctctgtugct

SEQ ID NO: 77282 - DNA, 26 bp, Artificial Sequence
  Synthetic
tttgaagatcautttctcagccucca

SEQ ID NO: 77283 - DNA, 28 bp, Artificial Sequence
  Synthetic
gcctttcuccacttagattttcuccaat

SEQ ID NO: 77284 - DNA, 22 bp, Artificial Sequence
  Synthetic
gccagaaaucaaacccgtcuga

SEQ ID NO: 77285 - DNA, 21 bp, Artificial Sequence
  Synthetic
ctttgttgcutgaagcggugt

SEQ ID NO: 77286 - DNA, 24 bp, Artificial Sequence
  Synthetic
cacaatgcctugtacgtgaagaug

SEQ ID NO: 77287 - DNA, 28 bp, Artificial Sequence
  Synthetic
tttcaatacggcauggttaagaaccuaa

SEQ ID NO: 77288 - DNA, 25 bp, Artificial Sequence
  Synthetic
ttctaaggagaaugaggaggcagua

SEQ ID NO: 77289 - DNA, 27 bp, Artificial Sequence
  Synthetic
caaagtggtcagutcatcattctgtug

SEQ ID NO: 77290 - DNA, 21 bp, Artificial Sequence
  Synthetic
ccacggcaagacagutatuca

SEQ ID NO: 77291 - DNA, 23 bp, Artificial Sequence
  Synthetic
agacacauccaggcuacaaaacc

SEQ ID NO: 77292 - DNA, 22 bp, Artificial Sequence
  Synthetic
tgtcugaggaacgtctctuggt

SEQ ID NO: 77293 - DNA, 21 bp, Artificial Sequence
  Synthetic
cggtctuaccggctctctaug

SEQ ID NO: 77294 - DNA, 28 bp, Artificial Sequence
  Synthetic
tctgttctgaatugctgtcttgttaugt

SEQ ID NO: 77295 - DNA, 20 bp, Artificial Sequence
  Synthetic
gguacaggcgagggtgaaut

SEQ ID NO: 77296 - DNA, 25 bp, Artificial Sequence
  Synthetic
agccaatggagugactgaattucaa

SEQ ID NO: 77297 - DNA, 27 bp, Artificial Sequence
  Synthetic
tgctgaaauagcagtaacagtaugagg

SEQ ID NO: 77298 - DNA, 28 bp, Artificial Sequence
  Synthetic
gttagaaaaggagauctctgaactucgg

SEQ ID NO: 77299 - DNA, 24 bp, Artificial Sequence
  Synthetic
tttcuaacaccagagccaaacugt

SEQ ID NO: 77300 - DNA, 23 bp, Artificial Sequence
  Synthetic
ttcctcaaccagcucttcaucag

SEQ ID NO: 77301 - DNA, 21 bp, Artificial Sequence
  Synthetic
ggatgtagagccugggacugt

SEQ ID NO: 77302 - DNA, 21 bp, Artificial Sequence
  Synthetic
gtctgtcucctggcaucacat

SEQ ID NO: 77303 - DNA, 22 bp, Artificial Sequence
  Synthetic
aaagucatcagcucccacacag

SEQ ID NO: 77304 - DNA, 17 bp, Artificial Sequence
  Synthetic
cagtcguggcugagcgt

SEQ ID NO: 77305 - DNA, 19 bp, Artificial Sequence
  Synthetic
ccggatugagccggaaguc

SEQ ID NO: 77306 - DNA, 21 bp, Artificial Sequence
  Synthetic
tgttccuacacctccugccat

SEQ ID NO: 77307 - DNA, 20 bp, Artificial Sequence
  Synthetic
aggugcagcaggaagugaag

SEQ ID NO: 77308 - DNA, 22 bp, Artificial Sequence
  Synthetic
gcgagggaaaugccttcactut

SEQ ID NO: 77309 - DNA, 25 bp, Artificial Sequence
  Synthetic
gaggcccuaaggttttgtttaugga

SEQ ID NO: 77310 - DNA, 23 bp, Artificial Sequence
  Synthetic
caacacaactuccccaacaagug

SEQ ID NO: 77311 - DNA, 23 bp, Artificial Sequence
  Synthetic
tctactuactggagtugcaggct

SEQ ID NO: 77312 - DNA, 21 bp, Artificial Sequence
  Synthetic
cagtctcuccctccagcauct

SEQ ID NO: 77313 - DNA, 19 bp, Artificial Sequence
  Synthetic
gagaacgcaccucttugcc

SEQ ID NO: 77314 - DNA, 20 bp, Artificial Sequence
  Synthetic
tgutccuaccccaacagcac

SEQ ID NO: 77315 - DNA, 24 bp, Artificial Sequence
  Synthetic
aaagagaauggaaauggcccagaa

SEQ ID NO: 77316 - DNA, 22 bp, Artificial Sequence
  Synthetic
cctgtctcugccttaggtguga

SEQ ID NO: 77317 - DNA, 20 bp, Artificial Sequence
  Synthetic
ccacgcacauttgaccauga

SEQ ID NO: 77318 - DNA, 22 bp, Artificial Sequence
  Synthetic
gctccacaaugcagaugagaca

SEQ ID NO: 77319 - DNA, 21 bp, Artificial Sequence
  Synthetic
gatgaucgccccttcttcugg

SEQ ID NO: 77320 - DNA, 26 bp, Artificial Sequence
  Synthetic
catctgcaccautgatgtctacauga

SEQ ID NO: 77321 - DNA, 24 bp, Artificial Sequence
  Synthetic
tctacatacatccuggtcccctut

SEQ ID NO: 77322 - DNA, 27 bp, Artificial Sequence
  Synthetic
catttactcuttttgctgauggcacat

SEQ ID NO: 77323 - DNA, 28 bp, Artificial Sequence
  Synthetic
gcactcagattugataaagaagttgcuc

SEQ ID NO: 77324 - DNA, 25 bp, Artificial Sequence
  Synthetic
gcatacccaagaccutgagugaaaa

SEQ ID NO: 77325 - DNA, 26 bp, Artificial Sequence
  Synthetic
gcattgtacauaaaaggcactugcat

SEQ ID NO: 77326 - DNA, 26 bp, Artificial Sequence
  Synthetic
gctcttctcacucatatcctcctcut

SEQ ID NO: 77327 - DNA, 21 bp, Artificial Sequence
  Synthetic
tccttccugtcctccuagcag

SEQ ID NO: 77328 - DNA, 23 bp, Artificial Sequence
  Synthetic
caggaugacagccagttacguat

SEQ ID NO: 77329 - DNA, 26 bp, Artificial Sequence
  Synthetic
atctggaagatgauaaacccttgcuc

SEQ ID NO: 77330 - DNA, 17 bp, Artificial Sequence
  Synthetic
ccggctuctcggtgugt

SEQ ID NO: 77331 - DNA, 18 bp, Artificial Sequence
  Synthetic
cgutggagguggcaaggg

SEQ ID NO: 77332 - DNA, 26 bp, Artificial Sequence
  Synthetic
ccagcaccucgatgtttataaaugct

SEQ ID NO: 77333 - DNA, 28 bp, Artificial Sequence
  Synthetic
acacauttaaagactuaaccccacaaga

SEQ ID NO: 77334 - DNA, 22 bp, Artificial Sequence
  Synthetic
tggccaccacautcucaaagag

SEQ ID NO: 77335 - DNA, 21 bp, Artificial Sequence
  Synthetic
ccacaccacugtcctaugcag

SEQ ID NO: 77336 - DNA, 19 bp, Artificial Sequence
  Synthetic
ctcggcuctcttcggtuga

SEQ ID NO: 77337 - DNA, 18 bp, Artificial Sequence
  Synthetic
ccatggcaauccgucgag

SEQ ID NO: 77338 - DNA, 21 bp, Artificial Sequence
  Synthetic
cggaagagcutccatggaguc

SEQ ID NO: 77339 - DNA, 20 bp, Artificial Sequence
  Synthetic
gcagugcagcuggagaaagt

SEQ ID NO: 77340 - DNA, 17 bp, Artificial Sequence
  Synthetic
cggaccggcucctcuac

SEQ ID NO: 77341 - DNA, 18 bp, Artificial Sequence
  Synthetic
tgtcagaggccucgcauc

SEQ ID NO: 77342 - DNA, 24 bp, Artificial Sequence
  Synthetic
ctgccttcaautcattccacucac

SEQ ID NO: 77343 - DNA, 23 bp, Artificial Sequence
  Synthetic
tccgaagccucaaagctaaucaa

SEQ ID NO: 77344 - DNA, 23 bp, Artificial Sequence
  Synthetic
ggtttcagcuattgggaaccuga

SEQ ID NO: 77345 - DNA, 25 bp, Artificial Sequence
  Synthetic
agagtcacugtggaagtaguaggaa

SEQ ID NO: 77346 - DNA, 21 bp, Artificial Sequence
  Synthetic
gcccagcuctgtucaaaccat

SEQ ID NO: 77347 - DNA, 28 bp, Artificial Sequence
  Synthetic
tgtttctggaaagcugagtcttttcuac

SEQ ID NO: 77348 - DNA, 24 bp, Artificial Sequence
  Synthetic
tccctttctcutaagtctccuggt

SEQ ID NO: 77349 - DNA, 23 bp, Artificial Sequence
  Synthetic
ccctgttcugtgtcctactucag

SEQ ID NO: 77350 - DNA, 26 bp, Artificial Sequence
  Synthetic
tgattatcagcauaggctggaaacug

SEQ ID NO: 77351 - DNA, 22 bp, Artificial Sequence
  Synthetic
ccttgtguccaactggaaggut

SEQ ID NO: 77352 - DNA, 20 bp, Artificial Sequence
  Synthetic
tgtcctcugacccatcugct

SEQ ID NO: 77353 - DNA, 18 bp, Artificial Sequence
  Synthetic
ggacaggcuggcatuggt

SEQ ID NO: 77354 - DNA, 23 bp, Artificial Sequence
  Synthetic
gaaacctggaacucacctaccug

SEQ ID NO: 77355 - DNA, 20 bp, Artificial Sequence
  Synthetic
tcttcugccacccacctgua

SEQ ID NO: 77356 - DNA, 28 bp, Artificial Sequence
  Synthetic
ctgtaactucgaccaacacctttaaaut

SEQ ID NO: 77357 - DNA, 22 bp, Artificial Sequence
  Synthetic
gcctgagagugcacactaaaug

SEQ ID NO: 77358 - DNA, 22 bp, Artificial Sequence
  Synthetic
tccaatttccccugcacaacut

SEQ ID NO: 77359 - DNA, 28 bp, Artificial Sequence
  Synthetic
cagtactactcacuaaagagctgtccua

SEQ ID NO: 77360 - DNA, 25 bp, Artificial Sequence
  Synthetic
aggaagatgtuctgagcttacugga

SEQ ID NO: 77361 - DNA, 23 bp, Artificial Sequence
  Synthetic
gcaacugcagatuaagccaacag

SEQ ID NO: 77362 - DNA, 31 bp, Artificial Sequence
  Synthetic
gtggataggautcattcattaatugccaaat

SEQ ID NO: 77363 - DNA, 21 bp, Artificial Sequence
  Synthetic
ccuacagccaggaagguacca

SEQ ID NO: 77364 - DNA, 26 bp, Artificial Sequence
  Synthetic
cacaaattuaggcacttucaccacaa

SEQ ID NO: 77365 - DNA, 25 bp, Artificial Sequence
  Synthetic
ttctagaaaagaguctcatcgugga

SEQ ID NO: 77366 - DNA, 22 bp, Artificial Sequence
  Synthetic
gctgaagtcucccctgatcuga

SEQ ID NO: 77367 - DNA, 24 bp, Artificial Sequence
  Synthetic
accatgtttcuaggttgaacugct

SEQ ID NO: 77368 - DNA, 26 bp, Artificial Sequence
  Synthetic
ggtattatgauccagagctgctucaa

SEQ ID NO: 77369 - DNA, 32 bp, Artificial Sequence
  Synthetic
ggaggacgatttuagagaatagtgaaattucc

SEQ ID NO: 77370 - DNA, 23 bp, Artificial Sequence
  Synthetic
tttcttttcccucttgcctucca

SEQ ID NO: 77371 - DNA, 28 bp, Artificial Sequence
  Synthetic
tccaaaaccatgcucagaagaagaauaa

SEQ ID NO: 77372 - DNA, 19 bp, Artificial Sequence
  Synthetic
cuccgagaacucgcaggac

SEQ ID NO: 77373 - DNA, 18 bp, Artificial Sequence
  Synthetic
gcugtgguagccgcacat

SEQ ID NO: 77374 - DNA, 22 bp, Artificial Sequence
  Synthetic
ccgtgauccttttgagugcaac

SEQ ID NO: 77375 - DNA, 21 bp, Artificial Sequence
  Synthetic
ggcagtccutgtgctttucct

SEQ ID NO: 77376 - DNA, 22 bp, Artificial Sequence
  Synthetic
aaatgtgatugcctgggtguct

SEQ ID NO: 77377 - DNA, 23 bp, Artificial Sequence
  Synthetic
agggtattugggtaccugaagga

SEQ ID NO: 77378 - DNA, 25 bp, Artificial Sequence
  Synthetic
aaacagaaatugagagaaggcucca

SEQ ID NO: 77379 - DNA, 24 bp, Artificial Sequence
  Synthetic
gacagcagcgutgagataucaaag

SEQ ID NO: 77380 - DNA, 23 bp, Artificial Sequence
  Synthetic
cagccagagacuaccacaacaut

SEQ ID NO: 77381 - DNA, 28 bp, Artificial Sequence
  Synthetic
acattctcatggucttctcctttuacag

SEQ ID NO: 77382 - DNA, 28 bp, Artificial Sequence
  Synthetic
tcatttctuccagtgttctaatugcact

SEQ ID NO: 77383 - DNA, 24 bp, Artificial Sequence
  Synthetic
tggaagcacagacugcaatttgua

SEQ ID NO: 77384 - DNA, 22 bp, Artificial Sequence
  Synthetic
ggcagaaagaggacuccucagt

SEQ ID NO: 77385 - DNA, 21 bp, Artificial Sequence
  Synthetic
cgactgccugtgaagtggaug

SEQ ID NO: 77386 - DNA, 21 bp, Artificial Sequence
  Synthetic
cgtgttgaugctgagcugaat

SEQ ID NO: 77387 - DNA, 24 bp, Artificial Sequence
  Synthetic
ccctaacuagtttcttcctucgca

SEQ ID NO: 77388 - DNA, 22 bp, Artificial Sequence
  Synthetic
ccaggagtutgctttgcauacc

SEQ ID NO: 77389 - DNA, 26 bp, Artificial Sequence
  Synthetic
acatgttgaacaacaggugattcgua

SEQ ID NO: 77390 - DNA, 25 bp, Artificial Sequence
  Synthetic
tgggtgtagauccggtcaaataaug

SEQ ID NO: 77391 - DNA, 24 bp, Artificial Sequence
  Synthetic
tttcatcugagaagcaaggagugg

SEQ ID NO: 77392 - DNA, 24 bp, Artificial Sequence
  Synthetic
aatttctugacaggtgggaucgag

SEQ ID NO: 77393 - DNA, 22 bp, Artificial Sequence
  Synthetic
ccaucauaaggacagccccaaa

SEQ ID NO: 77394 - DNA, 21 bp, Artificial Sequence
  Synthetic
ctcctcaggcaugggttctua

SEQ ID NO: 77395 - DNA, 23 bp, Artificial Sequence
  Synthetic
ctgcctacutctacttccuccca

SEQ ID NO: 77396 - DNA, 22 bp, Artificial Sequence
  Synthetic
actcacttggcugtgtttccut

SEQ ID NO: 77397 - DNA, 29 bp, Artificial Sequence
  Synthetic
agtggccaattucccattctaataaagut

SEQ ID NO: 77398 - DNA, 21 bp, Artificial Sequence
  Synthetic
gcccagguggtagtaggtgut

SEQ ID NO: 77399 - DNA, 21 bp, Artificial Sequence
  Synthetic
ccaggagcacutcctcttuga

SEQ ID NO: 77400 - DNA, 23 bp, Artificial Sequence
  Synthetic
catgtttggguttgctgacgaua

SEQ ID NO: 77401 - DNA, 20 bp, Artificial Sequence
  Synthetic
actcggucgtaggugaggac

SEQ ID NO: 77402 - DNA, 27 bp, Artificial Sequence
  Synthetic
tctgttcagtugaaggaatttcucacc

SEQ ID NO: 77403 - DNA, 28 bp, Artificial Sequence
  Synthetic
gatccutatcagattctuggaccaacaa

SEQ ID NO: 77404 - DNA, 19 bp, Artificial Sequence
  Synthetic
ggattugcaaggcggcuac

SEQ ID NO: 77405 - DNA, 24 bp, Artificial Sequence
  Synthetic
ggaggacautttcggctcugaaat

SEQ ID NO: 77406 - DNA, 19 bp, Artificial Sequence
  Synthetic
gagccgtcugcggaaaauc

SEQ ID NO: 77407 - DNA, 22 bp, Artificial Sequence
  Synthetic
tgtgccagcauactgctcttut

SEQ ID NO: 77408 - DNA, 21 bp, Artificial Sequence
  Synthetic
tgcttgccugtgaaccaguaa

SEQ ID NO: 77409 - DNA, 24 bp, Artificial Sequence
  Synthetic
gcagaaacuccttcaggtcaucag

SEQ ID NO: 77410 - DNA, 24 bp, Artificial Sequence
  Synthetic
tggtaaaccaaaaaugcacttucc

SEQ ID NO: 77411 - DNA, 26 bp, Artificial Sequence
  Synthetic
aaatcucccaagaggaaugacaaaca

SEQ ID NO: 77412 - DNA, 25 bp, Artificial Sequence
  Synthetic
gagagagcaaacaucctctttguca

SEQ ID NO: 77413 - DNA, 24 bp, Artificial Sequence
  Synthetic
aaagagaggcacucatgucagaac

SEQ ID NO: 77414 - DNA, 20 bp, Artificial Sequence
  Synthetic
ctcaagggtucaccgccaua

SEQ ID NO: 77415 - DNA, 24 bp, Artificial Sequence
  Synthetic
gagagaggcacuaaggcttctuac

SEQ ID NO: 77416 - DNA, 24 bp, Artificial Sequence
  Synthetic
ctttctcctugctcttctctucca

SEQ ID NO: 77417 - DNA, 24 bp, Artificial Sequence
  Synthetic
ggaaagaugcgatcgtaagucgag

SEQ ID NO: 77418 - DNA, 27 bp, Artificial Sequence
  Synthetic
acaatgtttaaagguggtagctgtuga

SEQ ID NO: 77419 - DNA, 27 bp, Artificial Sequence
  Synthetic
acucattgatagttgugaaccaacaca

SEQ ID NO: 77420 - DNA, 21 bp, Artificial Sequence
  Synthetic
ccagctgggucatcatctuga

SEQ ID NO: 77421 - DNA, 28 bp, Artificial Sequence
  Synthetic
gcagattgactcugagctgagaaaaaut

SEQ ID NO: 77422 - DNA, 28 bp, Artificial Sequence
  Synthetic
gggttctatcacutgcatcatatgttut

SEQ ID NO: 77423 - DNA, 29 bp, Artificial Sequence
  Synthetic
cctttataagccugtaatttgggacauct

SEQ ID NO: 77424 - DNA, 21 bp, Artificial Sequence
  Synthetic
gcccugagattccaguggaac

SEQ ID NO: 77425 - DNA, 22 bp, Artificial Sequence
  Synthetic
gtgccaucccgactgtaatuga

SEQ ID NO: 77426 - DNA, 26 bp, Artificial Sequence
  Synthetic
aaagaattgtuacctgaagagcuggt

SEQ ID NO: 77427 - DNA, 28 bp, Artificial Sequence
  Synthetic
ctgtgtaguaacgcaaaggattttctug

SEQ ID NO: 77428 - DNA, 25 bp, Artificial Sequence
  Synthetic
ctcactcacaugacagagaaucagg

SEQ ID NO: 77429 - DNA, 21 bp, Artificial Sequence
  Synthetic
ccctctgcgutcctgtcauat

SEQ ID NO: 77430 - DNA, 22 bp, Artificial Sequence
  Synthetic
gagttugcccccatguacaaga

SEQ ID NO: 77431 - DNA, 27 bp, Artificial Sequence
  Synthetic
ccttcttcucctagcctaagucaaaat

SEQ ID NO: 77432 - DNA, 24 bp, Artificial Sequence
  Synthetic
atgugacaagggaggugaaaaagt

SEQ ID NO: 77433 - DNA, 19 bp, Artificial Sequence
  Synthetic
gaguaccacgacccagugt

SEQ ID NO: 77434 - DNA, 24 bp, Artificial Sequence
  Synthetic
aggtcactuaccttgaaccaguct

SEQ ID NO: 77435 - DNA, 27 bp, Artificial Sequence
  Synthetic
tgctgtgactaugtcatggttctuaac

SEQ ID NO: 77436 - DNA, 28 bp, Artificial Sequence
  Synthetic
ttcctttgaaacugtctttgtgaactug

SEQ ID NO: 77437 - DNA, 25 bp, Artificial Sequence
  Synthetic
gctgtccaggautctgagtataugg

SEQ ID NO: 77438 - DNA, 22 bp, Artificial Sequence
  Synthetic
cacctagugaacaaggguccaa

SEQ ID NO: 77439 - DNA, 22 bp, Artificial Sequence
  Synthetic
ttgctgagguttctccctugac

SEQ ID NO: 77440 - DNA, 24 bp, Artificial Sequence
  Synthetic
aacaaccccaauccttatggtuca

SEQ ID NO: 77441 - DNA, 23 bp, Artificial Sequence
  Synthetic
agtactcaccaugttgggcatuc

SEQ ID NO: 77442 - DNA, 24 bp, Artificial Sequence
  Synthetic
cagcatgaccuaccatcatuggaa

SEQ ID NO: 77443 - DNA, 23 bp, Artificial Sequence
  Synthetic
cccaaggaugttatgtucaggct

SEQ ID NO: 77444 - DNA, 24 bp, Artificial Sequence
  Synthetic
caccctgtugtttgtttcagugac

SEQ ID NO: 77445 - DNA, 28 bp, Artificial Sequence
  Synthetic
ggaacaggaaataugtcgaaaagttcuc

SEQ ID NO: 77446 - DNA, 21 bp, Artificial Sequence
  Synthetic
aaaaaggcagutcctggugga

SEQ ID NO: 77447 - DNA, 26 bp, Artificial Sequence
  Synthetic
tcaatttaggcucctagtggguacaa

SEQ ID NO: 77448 - DNA, 22 bp, Artificial Sequence
  Synthetic
gtcactgacaaguccccttgut

SEQ ID NO: 77449 - DNA, 19 bp, Artificial Sequence
  Synthetic
atgtcacggcagucgtuga

SEQ ID NO: 77450 - DNA, 22 bp, Artificial Sequence
  Synthetic
ccaaccauggtgttgtgtucat

SEQ ID NO: 77451 - DNA, 24 bp, Artificial Sequence
  Synthetic
ctgaaccctguaactcctttccuc

SEQ ID NO: 77452 - DNA, 26 bp, Artificial Sequence
  Synthetic
gtgagutacataccauacagggcaag

SEQ ID NO: 77453 - DNA, 18 bp, Artificial Sequence
  Synthetic
ccgcccaccucggaaaut

SEQ ID NO: 77454 - DNA, 23 bp, Artificial Sequence
  Synthetic
ggtcagtttuctcttgcagucgt

SEQ ID NO: 77455 - DNA, 22 bp, Artificial Sequence
  Synthetic
ccggaggucccaaacagtttut

SEQ ID NO: 77456 - DNA, 19 bp, Artificial Sequence
  Synthetic
tgagaacauccgccgtgug

SEQ ID NO: 77457 - DNA, 25 bp, Artificial Sequence
  Synthetic
ctatggtgggugattaactgctugt

SEQ ID NO: 77458 - DNA, 19 bp, Artificial Sequence
  Synthetic
cutggcatcgucggcaaag

SEQ ID NO: 77459 - DNA, 28 bp, Artificial Sequence
  Synthetic
cactaagaaauggaaaaccgtatccgua

SEQ ID NO: 77460 - DNA, 22 bp, Artificial Sequence
  Synthetic
atagcactcuccaagctgctut

SEQ ID NO: 77461 - DNA, 26 bp, Artificial Sequence
  Synthetic
gcttacactccuttcatacgctttuc

SEQ ID NO: 77462 - DNA, 20 bp, Artificial Sequence
  Synthetic
ccatcccagauccgtgagug

SEQ ID NO: 77463 - DNA, 21 bp, Artificial Sequence
  Synthetic
ccattcccaggucaccaucaa

SEQ ID NO: 77464 - DNA, 22 bp, Artificial Sequence
  Synthetic
cacaggaaaccugtcaccauca

SEQ ID NO: 77465 - DNA, 19 bp, Artificial Sequence
  Synthetic
atggcatcguggccttcut

SEQ ID NO: 77466 - DNA, 28 bp, Artificial Sequence
  Synthetic
tcaggaaacaaaaauttgtgctaugcaa

SEQ ID NO: 77467 - DNA, 23 bp, Artificial Sequence
  Synthetic
ggacccatuagaaccaacuccat

SEQ ID NO: 77468 - DNA, 18 bp, Artificial Sequence
  Synthetic
gggctggcuccgatguat

SEQ ID NO: 77469 - DNA, 22 bp, Artificial Sequence
  Synthetic
caacguagccatcagtcucaga

SEQ ID NO: 77470 - DNA, 23 bp, Artificial Sequence
  Synthetic
gcctggagcagaaaugagtacua

SEQ ID NO: 77471 - DNA, 20 bp, Artificial Sequence
  Synthetic
acacagaccucagagcucct

SEQ ID NO: 77472 - DNA, 28 bp, Artificial Sequence
  Synthetic
agcagtcatattuaaaacatcgccuaca

SEQ ID NO: 77473 - DNA, 29 bp, Artificial Sequence
  Synthetic
atgtcagauataaagaacucaccgaacag

SEQ ID NO: 77474 - DNA, 17 bp, Artificial Sequence
  Synthetic
gcctgggagcugctgut

SEQ ID NO: 77475 - DNA, 28 bp, Artificial Sequence
  Synthetic
agccatucctttatgtttuaggcaagat

SEQ ID NO: 77476 - DNA, 22 bp, Artificial Sequence
  Synthetic
tctccatguactggtagcuggt

SEQ ID NO: 77477 - DNA, 28 bp, Artificial Sequence
  Synthetic
ccagaaacucctagttcuaagacagaga

SEQ ID NO: 77478 - DNA, 20 bp, Artificial Sequence
  Synthetic
gtgcctgaucagctgttgug

SEQ ID NO: 77479 - DNA, 22 bp, Artificial Sequence
  Synthetic
ttcctaaccuctcccctgugaa

SEQ ID NO: 77480 - DNA, 21 bp, Artificial Sequence
  Synthetic
tctacagcgguacagugagga

SEQ ID NO: 77481 - DNA, 22 bp, Artificial Sequence
  Synthetic
tgcccatcaguctctctgctua

SEQ ID NO: 77482 - DNA, 19 bp, Artificial Sequence
  Synthetic
ctggcaccuctgcacaauc

SEQ ID NO: 77483 - DNA, 22 bp, Artificial Sequence
  Synthetic
ttggctgccaugttgttcttuc

SEQ ID NO: 77484 - DNA, 21 bp, Artificial Sequence
  Synthetic
catagcgcaacagutgcagut

SEQ ID NO: 77485 - DNA, 27 bp, Artificial Sequence
  Synthetic
tctcttcttgattutctagggacccut

SEQ ID NO: 77486 - DNA, 28 bp, Artificial Sequence
  Synthetic
ctgtaactaaugagcaggatgacaagua

SEQ ID NO: 77487 - DNA, 21 bp, Artificial Sequence
  Synthetic
cttcctcaagucagccaccuc

SEQ ID NO: 77488 - DNA, 24 bp, Artificial Sequence
  Synthetic
ggtctatggcutcaattgcatugt

SEQ ID NO: 77489 - DNA, 27 bp, Artificial Sequence
  Synthetic
gcattgataacaccccuactgctaaut

SEQ ID NO: 77490 - DNA, 22 bp, Artificial Sequence
  Synthetic
tcgutccuggagaaggagaact

SEQ ID NO: 77491 - DNA, 27 bp, Artificial Sequence
  Synthetic
acaggaaacaaacugtccatctatucc

SEQ ID NO: 77492 - DNA, 19 bp, Artificial Sequence
  Synthetic
cccaacauggagggctugg

SEQ ID NO: 77493 - DNA, 22 bp, Artificial Sequence
  Synthetic
cacttctcacaucacccctuct

SEQ ID NO: 77494 - DNA, 27 bp, Artificial Sequence
  Synthetic
ccagttgcuacttgcaatgatauacac

SEQ ID NO: 77495 - DNA, 28 bp, Artificial Sequence
  Synthetic
tgatcacatgctuacagttttgtgguaa

SEQ ID NO: 77496 - DNA, 27 bp, Artificial Sequence
  Synthetic
ttgtcaucagaaccactaactatucgg

SEQ ID NO: 77497 - DNA, 28 bp, Artificial Sequence
  Synthetic
tgccttcattttuctcttcaccagtaut

SEQ ID NO: 77498 - DNA, 21 bp, Artificial Sequence
  Synthetic
gggtgaacutacctgcucact

SEQ ID NO: 77499 - DNA, 25 bp, Artificial Sequence
  Synthetic
gacctcatggauggagatacatugg

SEQ ID NO: 77500 - DNA, 24 bp, Artificial Sequence
  Synthetic
cccttctccaagaucatcctgtuc

SEQ ID NO: 77501 - DNA, 24 bp, Artificial Sequence
  Synthetic
ggctctcacagcaaugatgactut

SEQ ID NO: 77502 - DNA, 23 bp, Artificial Sequence
  Synthetic
gccauaggttgacaugaccgaat

SEQ ID NO: 77503 - DNA, 21 bp, Artificial Sequence
  Synthetic
agtataacugtgcgccuggac

SEQ ID NO: 77504 - DNA, 24 bp, Artificial Sequence
  Synthetic
agggcgaaaugtactccagttauc

SEQ ID NO: 77505 - DNA, 24 bp, Artificial Sequence
  Synthetic
guaaatttgcuaagagccgaagcc

SEQ ID NO: 77506 - DNA, 27 bp, Artificial Sequence
  Synthetic
tgggcaacacautgtcaaagtuaaaat

SEQ ID NO: 77507 - DNA, 21 bp, Artificial Sequence
  Synthetic
aggagaagcucccaagugact

SEQ ID NO: 77508 - DNA, 24 bp, Artificial Sequence
  Synthetic
cagaagucagcaactcctucaaga

SEQ ID NO: 77509 - DNA, 23 bp, Artificial Sequence
  Synthetic
tgaatucacccagcccaaacuac

SEQ ID NO: 77510 - DNA, 24 bp, Artificial Sequence
  Synthetic
actggagagaugctttcttctugg

SEQ ID NO: 77511 - DNA, 22 bp, Artificial Sequence
  Synthetic
tcgugtgcagaaugaaggaact

SEQ ID NO: 77512 - DNA, 21 bp, Artificial Sequence
  Synthetic
gctcaaugaacatgccaucca

SEQ ID NO: 77513 - DNA, 20 bp, Artificial Sequence
  Synthetic
gtaugaaccgccugacccaa

SEQ ID NO: 77514 - DNA, 18 bp, Artificial Sequence
  Synthetic
cuctgcccaucccaccag

SEQ ID NO: 77515 - DNA, 18 bp, Artificial Sequence
  Synthetic
ctgaccccuggcactcut

SEQ ID NO: 77516 - DNA, 24 bp, Artificial Sequence
  Synthetic
gagcauccaccaagaacttttucc

SEQ ID NO: 77517 - DNA, 27 bp, Artificial Sequence
  Synthetic
gaagtttugcaagcagagaagtatugt

SEQ ID NO: 77518 - DNA, 29 bp, Artificial Sequence
  Synthetic
tcatgctggatuggccatatgtatattut

SEQ ID NO: 77519 - DNA, 25 bp, Artificial Sequence
  Synthetic
tcaaccttctcucatcaccaacauc

SEQ ID NO: 77520 - DNA, 22 bp, Artificial Sequence
  Synthetic
ggcacttguacaggtgtctuca

SEQ ID NO: 77521 - DNA, 28 bp, Artificial Sequence
  Synthetic
ccaggcatcucataacaaaatgaugaat

SEQ ID NO: 77522 - DNA, 21 bp, Artificial Sequence
  Synthetic
cuttcctttggugggaggact

SEQ ID NO: 77523 - DNA, 26 bp, Artificial Sequence
  Synthetic
gcagcctttugtaatatccgguaaga

SEQ ID NO: 77524 - DNA, 19 bp, Artificial Sequence
  Synthetic
gaaagcugggtgcccucat

SEQ ID NO: 77525 - DNA, 18 bp, Artificial Sequence
  Synthetic
gaagctgtucccggtgug

SEQ ID NO: 77526 - DNA, 21 bp, Artificial Sequence
  Synthetic
gcccgtuaactgcagatguct

SEQ ID NO: 77527 - DNA, 20 bp, Artificial Sequence
  Synthetic
gaacgtcaugatgggcccua

SEQ ID NO: 77528 - DNA, 21 bp, Artificial Sequence
  Synthetic
ccttggcagugtcactcucat

SEQ ID NO: 77529 - DNA, 22 bp, Artificial Sequence
  Synthetic
accctcacuactcagagtcugg

SEQ ID NO: 77530 - DNA, 24 bp, Artificial Sequence
  Synthetic
gaggactgggucgaaacagtuaat

SEQ ID NO: 77531 - DNA, 24 bp, Artificial Sequence
  Synthetic
cgcaaagauggcctctacttuacc

SEQ ID NO: 77532 - DNA, 23 bp, Artificial Sequence
  Synthetic
agtccttttugcacactcuggat

SEQ ID NO: 77533 - DNA, 23 bp, Artificial Sequence
  Synthetic
gcatgatatcucccccttuggaa

SEQ ID NO: 77534 - DNA, 22 bp, Artificial Sequence
  Synthetic
cactggccautacagcagatuc

SEQ ID NO: 77535 - DNA, 22 bp, Artificial Sequence
  Synthetic
gtcttgugacagggctgcuaat

SEQ ID NO: 77536 - DNA, 25 bp, Artificial Sequence
  Synthetic
aagcaucaagttgtcauggcaaaaa

SEQ ID NO: 77537 - DNA, 25 bp, Artificial Sequence
  Synthetic
catataagcaugactccaccugagt

SEQ ID NO: 77538 - DNA, 21 bp, Artificial Sequence
  Synthetic
tgacaggagggcuacatccut

SEQ ID NO: 77539 - DNA, 24 bp, Artificial Sequence
  Synthetic
ccaacaaacacutcttuagcacga

SEQ ID NO: 77540 - DNA, 21 bp, Artificial Sequence
  Synthetic
gaacauggcagagcagcuagt

SEQ ID NO: 77541 - DNA, 21 bp, Artificial Sequence
  Synthetic
gggtaaccutcccggtaugaa

SEQ ID NO: 77542 - DNA, 28 bp, Artificial Sequence
  Synthetic
ggtattctgttguttcatgtttcctgug

SEQ ID NO: 77543 - DNA, 26 bp, Artificial Sequence
  Synthetic
tctctagguacagaaggcauaacact

SEQ ID NO: 77544 - DNA, 24 bp, Artificial Sequence
  Synthetic
gggautgcttatcucagacagact

SEQ ID NO: 77545 - DNA, 23 bp, Artificial Sequence
  Synthetic
ggagactcucacccattaugacc

SEQ ID NO: 77546 - DNA, 25 bp, Artificial Sequence
  Synthetic
gggaatggagaugttcttacuggag

SEQ ID NO: 77547 - DNA, 28 bp, Artificial Sequence
  Synthetic
tgggacugaaagagtactatgugagaat

SEQ ID NO: 77548 - DNA, 21 bp, Artificial Sequence
  Synthetic
ccaggagcuttcaccaaccug

SEQ ID NO: 77549 - DNA, 24 bp, Artificial Sequence
  Synthetic
ctcatctucaaaccgtctcctgut

SEQ ID NO: 77550 - DNA, 21 bp, Artificial Sequence
  Synthetic
caggtacuctgttgccuccat

SEQ ID NO: 77551 - DNA, 28 bp, Artificial Sequence
  Synthetic
cttccctgttagaguttgctcagtatut

SEQ ID NO: 77552 - DNA, 21 bp, Artificial Sequence
  Synthetic
caccacgutaagaacaucgca

SEQ ID NO: 77553 - DNA, 25 bp, Artificial Sequence
  Synthetic
gggauaagaaaacagccatcacugt

SEQ ID NO: 77554 - DNA, 23 bp, Artificial Sequence
  Synthetic
gggagaacauactgtgugccaat

SEQ ID NO: 77555 - DNA, 29 bp, Artificial Sequence
  Synthetic
ggttgggaaaauaggacatagctttagua

SEQ ID NO: 77556 - DNA, 30 bp, Artificial Sequence; identical to SEQ ID NO: 12464
  Synthetic

SEQ ID NO: 77557 - DNA, 23 bp, Artificial Sequence
  Synthetic
tgtgctugccagtctatctucag

SEQ ID NO: 77558 - DNA, 23 bp, Artificial Sequence
  Synthetic
gaatgacccugcauaaaaaggca

SEQ ID NO: 77559 - DNA, 21 bp, Artificial Sequence
  Synthetic
gtgatugagcggcacaactuc

SEQ ID NO: 77560 - DNA, 24 bp, Artificial Sequence
  Synthetic
atgttagctgcuagcctcattgut

SEQ ID NO: 77561 - DNA, 22 bp, Artificial Sequence
  Synthetic
gctgctggcutcattctgttug

SEQ ID NO: 77562 - DNA, 21 bp, Artificial Sequence
  Synthetic
cccaagcuaagggcatgctua

SEQ ID NO: 77563 - DNA, 20 bp, Artificial Sequence
  Synthetic
gggaagcagguggatgaguc

SEQ ID NO: 77564 - DNA, 21 bp, Artificial Sequence
  Synthetic
ccaccgtcaucaccttcctut

SEQ ID NO: 77565 - DNA, 22 bp, Artificial Sequence
  Synthetic
cccttcgcacutcttacactug

SEQ ID NO: 77566 - DNA, 19 bp, Artificial Sequence
  Synthetic
acagcugacggtggaguct

SEQ ID NO: 77567 - DNA, 17 bp, Artificial Sequence
  Synthetic
ccggagcuctacgugct

SEQ ID NO: 77568 - DNA, 22 bp, Artificial Sequence
  Synthetic
ggcucaugagagaagacggaat

SEQ ID NO: 77569 - DNA, 20 bp, Artificial Sequence
  Synthetic
cttcctcucgcccaucacag

SEQ ID NO: 77570 - DNA, 24 bp, Artificial Sequence
  Synthetic
ccatattcauccactttggugcct

SEQ ID NO: 77571 - DNA, 26 bp, Artificial Sequence
  Synthetic
gggcttacttcugtgttggtatctug

SEQ ID NO: 77572 - DNA, 24 bp, Artificial Sequence
  Synthetic
gacagcuatgagauggaggaagac

SEQ ID NO: 77573 - DNA, 21 bp, Artificial Sequence
  Synthetic
gttccttuggaggtggcauga

SEQ ID NO: 77574 - DNA, 20 bp, Artificial Sequence
  Synthetic
cggagacgagcucatgaguc

SEQ ID NO: 77575 - DNA, 20 bp, Artificial Sequence
  Synthetic
acctcctgcugacgtcttuc

SEQ ID NO: 77576 - DNA, 20 bp, Artificial Sequence
  Synthetic
gcagccaucaggttcugaca

SEQ ID NO: 77577 - DNA, 24 bp, Artificial Sequence
  Synthetic
ggaggucttttugcaaagcagaat

SEQ ID NO: 77578 - DNA, 22 bp, Artificial Sequence
  Synthetic
caaggcucctgctcaugaaagt

SEQ ID NO: 77579 - DNA, 28 bp, Artificial Sequence
  Synthetic
actctttatcugccaattaactcaccuc

SEQ ID NO: 77580 - DNA, 22 bp, Artificial Sequence
  Synthetic
tgaggugaaggcaacccuagaa

SEQ ID NO: 77581 - DNA, 22 bp, Artificial Sequence
  Synthetic
aaggaatggugtgcaaccauct

SEQ ID NO: 77582 - DNA, 24 bp, Artificial Sequence
  Synthetic
aacttacaacaauggaggcucgaa

SEQ ID NO: 77583 - DNA, 28 bp, Artificial Sequence
  Synthetic
tcagcctcagaauttctttttctucaca

SEQ ID NO: 77584 - DNA, 21 bp, Artificial Sequence
  Synthetic
caacagccaucacuggaacac

SEQ ID NO: 77585 - DNA, 27 bp, Artificial Sequence
  Synthetic
gccaccaaagucatttgccatatauct

SEQ ID NO: 77586 - DNA, 21 bp, Artificial Sequence
  Synthetic
ggtgtcuagcccaugggagaa

SEQ ID NO: 77587 - DNA, 23 bp, Artificial Sequence
  Synthetic
cccaucacacaccataacuccac

SEQ ID NO: 77588 - DNA, 27 bp, Artificial Sequence
  Synthetic
cttaccctatucgagtcaattctugct

SEQ ID NO: 77589 - DNA, 28 bp, Artificial Sequence
  Synthetic
gcaagttcttucagaatctcttggauga

SEQ ID NO: 77590 - DNA, 21 bp, Artificial Sequence
  Synthetic
gtucacccaccagagtgaugt

SEQ ID NO: 77591 - DNA, 20 bp, Artificial Sequence
  Synthetic
tccctcccutcacatgcuga

SEQ ID NO: 77592 - DNA, 28 bp, Artificial Sequence
  Synthetic
gaggtugaaccttaagacuaacaacagt

SEQ ID NO: 77593 - DNA, 27 bp, Artificial Sequence
  Synthetic
cctcagaaagtcautcacacgattcuc

SEQ ID NO: 77594 - DNA, 25 bp, Artificial Sequence
  Synthetic
cctgtttggauaactcagcacugaa

SEQ ID NO: 77595 - DNA, 23 bp, Artificial Sequence
  Synthetic
cgtccacucagactcatactucc

SEQ ID NO: 77596 - DNA, 27 bp, Artificial Sequence
  Synthetic
gcatccatcataucttccaaatccuct

SEQ ID NO: 77597 - DNA, 28 bp, Artificial Sequence
  Synthetic
catatttgtgtcugatgggcaatcttuc

SEQ ID NO: 77598 - DNA, 24 bp, Artificial Sequence
  Synthetic
tctaccagactuggcacctttcua

SEQ ID NO: 77599 - DNA, 29 bp, Artificial Sequence
  Synthetic
cgaggagaagaaaagugaaatgacuagat

SEQ ID NO: 77600 - DNA, 26 bp, Artificial Sequence
  Synthetic
tctctgggaccaugagatgaauaagt

SEQ ID NO: 77601 - DNA, 23 bp, Artificial Sequence
  Synthetic
tctctcagtuttgtcacctugcc

SEQ ID NO: 77602 - DNA, 23 bp, Artificial Sequence
  Synthetic
ccagaggcaugaaauggaccaat

SEQ ID NO: 77603 - DNA, 25 bp, Artificial Sequence
  Synthetic
gtcctttttcccutttcgtgttcug

SEQ ID NO: 77604 - DNA, 17 bp, Artificial Sequence
  Synthetic
gcucacccugcagcact

SEQ ID NO: 77605 - DNA, 18 bp, Artificial Sequence
  Synthetic
cagccccagcucatcuct

SEQ ID NO: 77606 - DNA, 21 bp, Artificial Sequence
  Synthetic
cagggaucttgaggcugcaaa

SEQ ID NO: 77607 - DNA, 21 bp, Artificial Sequence
  Synthetic
ctaagtccgcutctggtcucc

SEQ ID NO: 77608 - DNA, 24 bp, Artificial Sequence
  Synthetic
acugtttucagaagaagcgaaggt

SEQ ID NO: 77609 - DNA, 26 bp, Artificial Sequence
  Synthetic
atguattcctttttcauccacaggct

SEQ ID NO: 77610 - DNA, 21 bp, Artificial Sequence
  Synthetic
actgtgcaacautcccaggut

SEQ ID NO: 77611 - DNA, 23 bp, Artificial Sequence
  Synthetic
atgatgaugacgtttucccacca

SEQ ID NO: 77612 - DNA, 23 bp, Artificial Sequence
  Synthetic
acgcggctuaaatgaagtgaaug

SEQ ID NO: 77613 - DNA, 27 bp, Artificial Sequence
  Synthetic
ggcgatacugaggaggattttattgua

SEQ ID NO: 77614 - DNA, 20 bp, Artificial Sequence
  Synthetic
cutaacucaggcccgggaaa

SEQ ID NO: 77615 - DNA, 24 bp, Artificial Sequence
  Synthetic
gtctgaggcugttcactgactuac

SEQ ID NO: 77616 - DNA, 22 bp, Artificial Sequence
  Synthetic
catcgtcaggccucaacacaua

SEQ ID NO: 77617 - DNA, 28 bp, Artificial Sequence
  Synthetic
gcagagaggaugtgttttcatcauaagt

SEQ ID NO: 77618 - DNA, 20 bp, Artificial Sequence
  Synthetic
acctuagcagggccaaccua

SEQ ID NO: 77619 - DNA, 21 bp, Artificial Sequence
  Synthetic
tugacgtcauccaggacaagg

SEQ ID NO: 77620 - DNA, 25 bp, Artificial Sequence
  Synthetic
tgggaagauggagtaagagaaguga

SEQ ID NO: 77621 - DNA, 29 bp, Artificial Sequence
  Synthetic
cctccaatctaauagacgacaacttaucc

SEQ ID NO: 77622 - DNA, 22 bp, Artificial Sequence
  Synthetic
tttaggtucgccagttggugat

SEQ ID NO: 77623 - DNA, 29 bp, Artificial Sequence
  Synthetic
tctaggtgtgaugggatataagagcauac

SEQ ID NO: 77624 - DNA, 22 bp, Artificial Sequence
  Synthetic
cagaaggtcuacatgggtgcut

SEQ ID NO: 77625 - DNA, 26 bp, Artificial Sequence
  Synthetic
agtctgtaatuttgacatggtuggga

SEQ ID NO: 77626 - DNA, 23 bp, Artificial Sequence
  Synthetic
gaacctaaugccatttcctuccc

SEQ ID NO: 77627 - DNA, 26 bp, Artificial Sequence
  Synthetic
tgaacatcauccaggtatcugcaaaa

SEQ ID NO: 77628 - DNA, 21 bp, Artificial Sequence
  Synthetic
ggcaatagaccccugctccua

SEQ ID NO: 77629 - DNA, 23 bp, Artificial Sequence
  Synthetic
cgtcgtccaugtcttcttcaucc

SEQ ID NO: 77630 - DNA, 24 bp, Artificial Sequence
  Synthetic
aatacagtgtgugctgctaaccut

SEQ ID NO: 77631 - DNA, 22 bp, Artificial Sequence
  Synthetic
ctgttcuaggcaggactuccac

SEQ ID NO: 77632 - DNA, 23 bp, Artificial Sequence
  Synthetic
ctggcccgaaugtgattuaacat

SEQ ID NO: 77633 - DNA, 27 bp, Artificial Sequence
  Synthetic
cctcatuaaagaagaatgtgggucagt

SEQ ID NO: 77634 - DNA, 24 bp, Artificial Sequence
  Synthetic
tcaaauggaaagccactgaacuga

SEQ ID NO: 77635 - DNA, 29 bp, Artificial Sequence
  Synthetic
aagatgttgacuttgaattggcttugaat

SEQ ID NO: 77636 - DNA, 20 bp, Artificial Sequence
  Synthetic
cggaacgugctggucaagag

SEQ ID NO: 77637 - DNA, 22 bp, Artificial Sequence
  Synthetic
tgctccttgguccttcaccuaa

SEQ ID NO: 77638 - DNA, 23 bp, Artificial Sequence
  Synthetic
agtgccaucaagtgtcaauacca

SEQ ID NO: 77639 - DNA, 23 bp, Artificial Sequence
  Synthetic
cattcctccutcatcacctugct

SEQ ID NO: 77640 - DNA, 22 bp, Artificial Sequence
  Synthetic
cagggagaaagugctcauggat

SEQ ID NO: 77641 - DNA, 21 bp, Artificial Sequence
  Synthetic
cagtcucaacccagctcucac

SEQ ID NO: 77642 - DNA, 21 bp, Artificial Sequence
  Synthetic
caacttcuaccgtgcccugat

SEQ ID NO: 77643 - DNA, 25 bp, Artificial Sequence
  Synthetic
aguagacacagctugagagagagag

SEQ ID NO: 77644 - DNA, 22 bp, Artificial Sequence
  Synthetic
ggacuccttccttucacacaga

SEQ ID NO: 77645 - DNA, 25 bp, Artificial Sequence
  Synthetic
gagcaaauggacaaggaugaagaag

SEQ ID NO: 77646 - DNA, 28 bp, Artificial Sequence
  Synthetic
caagcaagatugctctcaaaaagauacc

SEQ ID NO: 77647 - DNA, 28 bp, Artificial Sequence
  Synthetic
tcttagtgaaatcuccaaaccatgugaa

SEQ ID NO: 77648 - DNA, 23 bp, Artificial Sequence
  Synthetic
tggctagcccaaaauctgtgaut

SEQ ID NO: 77649 - DNA, 27 bp, Artificial Sequence
  Synthetic
ggaaaaccugggcattaactgaatauc

SEQ ID NO: 77650 - DNA, 27 bp, Artificial Sequence
  Synthetic
caaggcuacagatcatctuacaaacca

SEQ ID NO: 77651 - DNA, 25 bp, Artificial Sequence
  Synthetic
aactcattcagauctcaaggtuggg

SEQ ID NO: 77652 - DNA, 25 bp, Artificial Sequence
  Synthetic
tggatgatacuccatctcccguaaa

SEQ ID NO: 77653 - DNA, 20 bp, Artificial Sequence
  Synthetic
gccagggcucctgatacugt

SEQ ID NO: 77654 - DNA, 28 bp, Artificial Sequence
  Synthetic
tccaagatgcauttacttctaggttuga

SEQ ID NO: 77655 - DNA, 28 bp, Artificial Sequence
  Synthetic
tgutaatcattagtaguccagagagcca

SEQ ID NO: 77656 - DNA, 25 bp, Artificial Sequence
  Synthetic
gacactgtctgugtctcttcttcut

SEQ ID NO: 77657 - DNA, 22 bp, Artificial Sequence
  Synthetic
ttcagcaccuacctctcucaca

SEQ ID NO: 77658 - DNA, 28 bp, Artificial Sequence
  Synthetic
ctaccatuaagaggaagttagacacugg

SEQ ID NO: 77659 - DNA, 26 bp, Artificial Sequence
  Synthetic
catcactgggucaatttcttgtucaa

SEQ ID NO: 77660 - DNA, 27 bp, Artificial Sequence
  Synthetic
aggaaatgttaautgctgcttttgugt

SEQ ID NO: 77661 - DNA, 28 bp, Artificial Sequence
  Synthetic
ggctatcatcugaattttcccaagaaut

SEQ ID NO: 77662 - DNA, 27 bp, Artificial Sequence
  Synthetic
acagtttgccaagugaaataguacact

SEQ ID NO: 77663 - DNA, 27 bp, Artificial Sequence
  Synthetic
gcatacaucagacagcacagaatugat

SEQ ID NO: 77664 - DNA, 24 bp, Artificial Sequence
  Synthetic
ccatcaccagcugaaaagucacat

SEQ ID NO: 77665 - DNA, 28 bp, Artificial Sequence
  Synthetic
acttacttgtcugcagttttggtaacut

SEQ ID NO: 77666 - DNA, 27 bp, Artificial Sequence
  Synthetic
gtcgaaaataccutcaacacccaaaut

SEQ ID NO: 77667 - DNA, 28 bp, Artificial Sequence
  Synthetic
caaaccagacauacataactgtacaugc

SEQ ID NO: 77668 - DNA, 21 bp, Artificial Sequence
  Synthetic
gctccaagcuctctgagguct

SEQ ID NO: 77669 - DNA, 28 bp, Artificial Sequence
  Synthetic
aaagccagaagcaggauattctcttauc

SEQ ID NO: 77670 - DNA, 21 bp, Artificial Sequence
  Synthetic
ttctccucgcctccagtuagt

SEQ ID NO: 77671 - DNA, 28 bp, Artificial Sequence
  Synthetic
ggtgaaggcaatutactcttgaactgua

SEQ ID NO: 77672 - DNA, 21 bp, Artificial Sequence
  Synthetic
ggaccaauagggccuagggaa

SEQ ID NO: 77673 - DNA, 22 bp, Artificial Sequence
  Synthetic
gggactgaguccgcttgttauc

SEQ ID NO: 77674 - DNA, 21 bp, Artificial Sequence
  Synthetic
gagugacctccugcaacagaa

SEQ ID NO: 77675 - DNA, 24 bp, Artificial Sequence
  Synthetic
gtaggtaggugacacttcgttuga

SEQ ID NO: 77676 - DNA, 20 bp, Artificial Sequence
  Synthetic
ggacauttgctuccggcaga

SEQ ID NO: 77677 - DNA, 28 bp, Artificial Sequence
  Synthetic
ccctggtauaaagaggagaaaagaguga

SEQ ID NO: 77678 - DNA, 23 bp, Artificial Sequence
  Synthetic
ggtttgtgtgugcagtgagttut

SEQ ID NO: 77679 - DNA, 25 bp, Artificial Sequence
  Synthetic
cagattguggagttatucgaggcat

SEQ ID NO: 77680 - DNA, 21 bp, Artificial Sequence
  Synthetic
cgtcactgugtaccccucact

SEQ ID NO: 77681 - DNA, 25 bp, Artificial Sequence
  Synthetic
ccaaacagccagauatcactgucat

SEQ ID NO: 77682 - DNA, 26 bp, Artificial Sequence
  Synthetic
tgaaagaaagcugtaatggcuacaca

SEQ ID NO: 77683 - DNA, 28 bp, Artificial Sequence
  Synthetic
ggtgaatgcccutggtcaatataaugat

SEQ ID NO: 77684 - DNA, 21 bp, Artificial Sequence
  Synthetic
agactuccggaaccatcacug

SEQ ID NO: 77685 - DNA, 28 bp, Artificial Sequence
  Synthetic
cccaattgattgugaaagtccacataut

SEQ ID NO: 77686 - DNA, 28 bp, Artificial Sequence
  Synthetic
tcaagtgtcattugccatcctaaauact

SEQ ID NO: 77687 - DNA, 26 bp, Artificial Sequence
  Synthetic
gggtgatataguagattcggtgctug

SEQ ID NO: 77688 - DNA, 25 bp, Artificial Sequence
  Synthetic
cgcggcatguctatagaaactttut

SEQ ID NO: 77689 - DNA, 27 bp, Artificial Sequence
  Synthetic
atgcatcaaacuagttcctuggaaaga

SEQ ID NO: 77690 - DNA, 20 bp, Artificial Sequence
  Synthetic
gcagtgugccaaaccagaug

SEQ ID NO: 77691 - DNA, 22 bp, Artificial Sequence
  Synthetic
gcataaagcgggugttcaggua

SEQ ID NO: 77692 - DNA, 25 bp, Artificial Sequence
  Synthetic
tcttggcuctttaattuggcagaca

SEQ ID NO: 77693 - DNA, 24 bp, Artificial Sequence
  Synthetic
tgctgacauctgttttctgtucct

SEQ ID NO: 77694 - DNA, 26 bp, Artificial Sequence
  Synthetic
ctttcttcaggaucgtctccatcauc

SEQ ID NO: 77695 - DNA, 28 bp, Artificial Sequence
  Synthetic
acttttgacattautgcttctcctgugt

SEQ ID NO: 77696 - DNA, 23 bp, Artificial Sequence
  Synthetic
gccctcaucccaagaaugaagac

SEQ ID NO: 77697 - DNA, 19 bp, Artificial Sequence
  Synthetic
gccuaacaaccggcacauc

SEQ ID NO: 77698 - DNA, 27 bp, Artificial Sequence
  Synthetic
gttctttugcaaacaggatctcaugat

SEQ ID NO: 77699 - DNA, 23 bp, Artificial Sequence
  Synthetic
actttatcgccutcactgcctut

SEQ ID NO: 77700 - DNA, 22 bp, Artificial Sequence
  Synthetic
gaaugcacgctgaugggaaaag

SEQ ID NO: 77701 - DNA, 23 bp, Artificial Sequence
  Synthetic
ccccgtgacaucttccagtttut

SEQ ID NO: 77702 - DNA, 22 bp, Artificial Sequence
  Synthetic
cggatgttuctctggctaugga

SEQ ID NO: 77703 - DNA, 20 bp, Artificial Sequence
  Synthetic
tgacaaccccuccctcaugt

SEQ ID NO: 77704 - DNA, 22 bp, Artificial Sequence
  Synthetic
ggaauguagagaagcgcagcat

SEQ ID NO: 77705 - DNA, 26 bp, Artificial Sequence
  Synthetic
acaccttgatttugttctttgggtug

SEQ ID NO: 77706 - DNA, 25 bp, Artificial Sequence
  Synthetic
agttggtgaatuccagtatgggtut

SEQ ID NO: 77707 - DNA, 23 bp, Artificial Sequence
  Synthetic
tgtacaaguacccctcagaccuc

SEQ ID NO: 77708 - DNA, 21 bp, Artificial Sequence
  Synthetic
ctcttagcucctctgcaguca

SEQ ID NO: 77709 - DNA, 27 bp, Artificial Sequence
  Synthetic
ctgtccatttutccccttactugaaga

SEQ ID NO: 77710 - DNA, 23 bp, Artificial Sequence
  Synthetic
tttgatgtctaucgctgtggcut

SEQ ID NO: 77711 - DNA, 26 bp, Artificial Sequence
  Synthetic
ggttgatgtcaucagtgtagtaguca

SEQ ID NO: 77712 - DNA, 26 bp, Artificial Sequence
  Synthetic
tggctagtttgaaucaagatgcacut

SEQ ID NO: 77713 - DNA, 24 bp, Artificial Sequence
  Synthetic
ccttacaauccgatcgattccuga

SEQ ID NO: 77714 - DNA, 18 bp, Artificial Sequence
  Synthetic
ggacgucacagugaccga

SEQ ID NO: 77715 - DNA, 19 bp, Artificial Sequence
  Synthetic
ctaccugcgccacauccat

SEQ ID NO: 77716 - DNA, 25 bp, Artificial Sequence
  Synthetic
gacattccaaauggctgcaaacuaa

SEQ ID NO: 77717 - DNA, 28 bp, Artificial Sequence
  Synthetic
cacttctttacaucaggtgtcattucct

SEQ ID NO: 77718 - DNA, 18 bp, Artificial Sequence
  Synthetic
cuccagagccgugcgaat

SEQ ID NO: 77719 - DNA, 21 bp, Artificial Sequence
  Synthetic
gatcgctttuccgagcttcug

SEQ ID NO: 77720 - DNA, 28 bp, Artificial Sequence
  Synthetic
aatcacagcaatguttctagtggtcuaa

SEQ ID NO: 77721 - DNA, 23 bp, Artificial Sequence
  Synthetic
gaagcttctcugtcgttttccug

SEQ ID NO: 77722 - DNA, 21 bp, Artificial Sequence
  Synthetic
gctcauggccatcucagacag

SEQ ID NO: 77723 - DNA, 23 bp, Artificial Sequence
  Synthetic
ctgggctgtaugagtgtgagaua

SEQ ID NO: 77724 - DNA, 21 bp, Artificial Sequence
  Synthetic
ggacttagcguccagtgacuc

SEQ ID NO: 77725 - DNA, 25 bp, Artificial Sequence
  Synthetic
aagagaaucgcaggaaaucaagaca

SEQ ID NO: 77726 - DNA, 22 bp, Artificial Sequence
  Synthetic
gacgtagguagtgctugagacc

SEQ ID NO: 77727 - DNA, 23 bp, Artificial Sequence
  Synthetic
aatagcatugcagagaggcguat

SEQ ID NO: 77728 - DNA, 26 bp, Artificial Sequence
  Synthetic
ttttgacttaaugcacacacaaugct

SEQ ID NO: 77729 - DNA, 24 bp, Artificial Sequence
  Synthetic
accaaacatgacugacttcagugt

SEQ ID NO: 77730 - DNA, 21 bp, Artificial Sequence
  Synthetic
gctgugccggaacattcttug

SEQ ID NO: 77731 - DNA, 21 bp, Artificial Sequence
  Synthetic
cttgaagcuggtccagctcut

SEQ ID NO: 77732 - DNA, 25 bp, Artificial Sequence
  Synthetic
accaatggucaccaggtuagaaaaa

SEQ ID NO: 77733 - DNA, 28 bp, Artificial Sequence
  Synthetic
cccaacttucaacacattttcaccauat

SEQ ID NO: 77734 - DNA, 20 bp, Artificial Sequence
  Synthetic
ggagtcgaugcagacgtugt

SEQ ID NO: 77735 - DNA, 20 bp, Artificial Sequence
  Synthetic
cctggtguccaaggaacugg

SEQ ID NO: 77736 - DNA, 18 bp, Artificial Sequence
  Synthetic
gtgggccucgucgaagac

SEQ ID NO: 77737 - DNA, 18 bp, Artificial Sequence
  Synthetic
gccctgguaaccctgcuc

SEQ ID NO: 77738 - DNA, 23 bp, Artificial Sequence
  Synthetic
aggtgaaacugtgcttgtauccc

SEQ ID NO: 77739 - DNA, 23 bp, Artificial Sequence
  Synthetic
tttccagcaguctgtagccatut

SEQ ID NO: 77740 - DNA, 21 bp, Artificial Sequence
  Synthetic
cccuacacacactctugacca

SEQ ID NO: 77741 - DNA, 22 bp, Artificial Sequence
  Synthetic
ttggutggccattugcaagaag

SEQ ID NO: 77742 - DNA, 21 bp, Artificial Sequence
  Synthetic
gaaccucctgcgttuccagaa

SEQ ID NO: 77743 - DNA, 23 bp, Artificial Sequence
  Synthetic
gtcatctgucgcacattggttug

SEQ ID NO: 77744 - DNA, 25 bp, Artificial Sequence
  Synthetic
gccaggctttugaatttctcctgua

SEQ ID NO: 77745 - DNA, 28 bp, Artificial Sequence
  Synthetic
gtgattggtttutcttcacatcttucca

SEQ ID NO: 77746 - DNA, 23 bp, Artificial Sequence
  Synthetic
gcagaugaggatcuagggaaacc

SEQ ID NO: 77747 - DNA, 22 bp, Artificial Sequence
  Synthetic
gccctcugacgtatctctcucc

SEQ ID NO: 77748 - DNA, 25 bp, Artificial Sequence
  Synthetic
agctcttgatgautgcaggatcaut

SEQ ID NO: 77749 - DNA, 21 bp, Artificial Sequence
  Synthetic
cagttcctcutcgccttgtuc

SEQ ID NO: 77750 - DNA, 23 bp, Artificial Sequence
  Synthetic
ctgaaactuccaaacctcccuca

SEQ ID NO: 77751 - DNA, 22 bp, Artificial Sequence
  Synthetic
tgccattcauggagcgaatcut

SEQ ID NO: 77752 - DNA, 21 bp, Artificial Sequence
  Synthetic
gctgcugagcctgaatctuct

SEQ ID NO: 77753 - DNA, 28 bp, Artificial Sequence
  Synthetic
tgaccaaatcugttatagctaatugcct

SEQ ID NO: 77754 - DNA, 25 bp, Artificial Sequence
  Synthetic
accatgtccuctcttttctcttugg

SEQ ID NO: 77755 - DNA, 25 bp, Artificial Sequence
  Synthetic
acatgggcuttcttgatguaaccat

SEQ ID NO: 77756 - DNA, 23 bp, Artificial Sequence
  Synthetic
gccacaggaagcugagaaagaug

SEQ ID NO: 77757 - DNA, 27 bp, Artificial Sequence
  Synthetic
ctcatccaccaacuccttaaaacucaa

SEQ ID NO: 77758 - DNA, 29 bp, Artificial Sequence
  Synthetic
cccaaatuaagaagagcagtguagagaac

SEQ ID NO: 77759 - DNA, 25 bp, Artificial Sequence
  Synthetic
ggcagaauaacatggcttugagact

SEQ ID NO: 77760 - DNA, 22 bp, Artificial Sequence
  Synthetic
ctttcuccaggccaggaaauga

SEQ ID NO: 77761 - DNA, 21 bp, Artificial Sequence
  Synthetic
gcugaaactcugacggcagaa

SEQ ID NO: 77762 - DNA, 24 bp, Artificial Sequence
  Synthetic
agtcatgctuaggatggatcccut

SEQ ID NO: 77763 - DNA, 21 bp, Artificial Sequence
  Synthetic
acagacacgugaaggcaugag

SEQ ID NO: 77764 - DNA, 24 bp, Artificial Sequence
  Synthetic
tgaaggtcauagtgcaaacgtuga

SEQ ID NO: 77765 - DNA, 20 bp, Artificial Sequence
  Synthetic
caagtgcuagtccacuggct

SEQ ID NO: 77766 - DNA, 23 bp, Artificial Sequence
  Synthetic
caaagacutccgaatuccccaga

SEQ ID NO: 77767 - DNA, 18 bp, Artificial Sequence
  Synthetic
ggagcgcutgccucagaa

SEQ ID NO: 77768 - DNA, 26 bp, Artificial Sequence
  Synthetic
ggacacatcagutttcctctcaugat

SEQ ID NO: 77769 - DNA, 28 bp, Artificial Sequence
  Synthetic
gctgtcatttucttcaacttcatuagca

SEQ ID NO: 77770 - DNA, 28 bp, Artificial Sequence
  Synthetic
gctaatgaagutgaagaaaaugacagca

SEQ ID NO: 77771 - DNA, 27 bp, Artificial Sequence
  Synthetic
gaaaacccatgautcagtcctgaacua

SEQ ID NO: 77772 - DNA, 22 bp, Artificial Sequence
  Synthetic
atcaggtccutcccatauccct

SEQ ID NO: 77773 - DNA, 27 bp, Artificial Sequence
  Synthetic
gcacatttaccugttggatgttatcug

SEQ ID NO: 77774 - DNA, 22 bp, Artificial Sequence
  Synthetic
ccgctatcaccutcaggaagut

SEQ ID NO: 77775 - DNA, 26 bp, Artificial Sequence
  Synthetic
gctauagagagaacccaaatcuccag

SEQ ID NO: 77776 - DNA, 23 bp, Artificial Sequence
  Synthetic
ctgggtctucatcagagagucct

SEQ ID NO: 77777 - DNA, 20 bp, Artificial Sequence
  Synthetic
acctggugcagcaactctut

SEQ ID NO: 77778 - DNA, 26 bp, Artificial Sequence
  Synthetic
gtgtctctcaatuctttagcccctut

SEQ ID NO: 77779 - DNA, 27 bp, Artificial Sequence
  Synthetic
gggagatgaagutttagatcaggaugg

SEQ ID NO: 77780 - DNA, 27 bp, Artificial Sequence
  Synthetic
catcctgatcuaaaacttcatcuccca

SEQ ID NO: 77781 - DNA, 26 bp, Artificial Sequence
  Synthetic
gagaactggguaaagacatguacaca

SEQ ID NO: 77782 - DNA, 23 bp, Artificial Sequence
  Synthetic
gctctctuggagtgtctccucat

SEQ ID NO: 77783 - DNA, 21 bp, Artificial Sequence
  Synthetic
ccgggatuagcgaactuccag

SEQ ID NO: 77784 - DNA, 22 bp, Artificial Sequence
  Synthetic
gctcagtgugcaagtcguaaga

SEQ ID NO: 77785 - DNA, 22 bp, Artificial Sequence
  Synthetic
gctcttgggaugcaatgtgcua

SEQ ID NO: 77786 - DNA, 21 bp, Artificial Sequence
  Synthetic
caccgaugaccccatctucaa

SEQ ID NO: 77787 - DNA, 19 bp, Artificial Sequence
  Synthetic
ccggccuctcgctgaauat

SEQ ID NO: 77788 - DNA, 23 bp, Artificial Sequence
  Synthetic
caacagctutgctaggauccaga

SEQ ID NO: 77789 - DNA, 27 bp, Artificial Sequence
  Synthetic
ctctctttctccuttttcaaccacuga

SEQ ID NO: 77790 - DNA, 25 bp, Artificial Sequence
  Synthetic
gggcatttuccattcataugcagaa

SEQ ID NO: 77791 - DNA, 22 bp, Artificial Sequence
  Synthetic
tccgaaggaagaggcugacuat

SEQ ID NO: 77792 - DNA, 22 bp, Artificial Sequence
  Synthetic
gcctaagggugaaagatuggca

SEQ ID NO: 77793 - DNA, 20 bp, Artificial Sequence
  Synthetic
gcuggaggcccaaacuaagg

SEQ ID NO: 77794 - DNA, 28 bp, Artificial Sequence
  Synthetic
cctgatcatacuccaggaaatcatctuc

SEQ ID NO: 77795 - DNA, 21 bp, Artificial Sequence
  Synthetic
gctatgttucccctcctuccc

SEQ ID NO: 77796 - DNA, 22 bp, Artificial Sequence
  Synthetic
ccucaccacagagcatctucat

SEQ ID NO: 77797 - DNA, 28 bp, Artificial Sequence
  Synthetic
tgtcaagttcuaagactctgtactcugg

SEQ ID NO: 77798 - DNA, 18 bp, Artificial Sequence
  Synthetic
gggtccucgggtgacuca

SEQ ID NO: 77799 - DNA, 20 bp, Artificial Sequence
  Synthetic
ccggauactuggaccagcaa

SEQ ID NO: 77800 - DNA, 26 bp, Artificial Sequence
  Synthetic
ctatgtcctatttucccaaccagcut

SEQ ID NO: 77801 - DNA, 21 bp, Artificial Sequence
  Synthetic
ggtattctcucagccgggaug

SEQ ID NO: 77802 - DNA, 20 bp, Artificial Sequence
  Synthetic
ctcacgcugctgaaggtgua

SEQ ID NO: 77803 - DNA, 17 bp, Artificial Sequence
  Synthetic
ccuggacggtgugcgaa

SEQ ID NO: 77804 - DNA, 20 bp, Artificial Sequence
  Synthetic
cagatctgucccacgcuaga

SEQ ID NO: 77805 - DNA, 26 bp, Artificial Sequence
  Synthetic
aggcatttuaaacagcaagtcttugg

SEQ ID NO: 77806 - DNA, 28 bp, Artificial Sequence
  Synthetic
tcaacggtttauctaagttgtguaagca

SEQ ID NO: 77807 - DNA, 27 bp, Artificial Sequence
  Synthetic
tctaggctucagataagtttugccaaa

SEQ ID NO: 77808 - DNA, 21 bp, Artificial Sequence
  Synthetic
cacggatcucagcaggacauc

SEQ ID NO: 77809 - DNA, 28 bp, Artificial Sequence
  Synthetic
cttcacatgttugtctttccttttguct

SEQ ID NO: 77810 - DNA, 21 bp, Artificial Sequence
  Synthetic
agaggacaccutggctgguaa

SEQ ID NO: 77811 - DNA, 29 bp, Artificial Sequence
  Synthetic
gccttatttagaaugacagcacagguaat

SEQ ID NO: 77812 - DNA, 21 bp, Artificial Sequence
  Synthetic
tgcctgtggauccctagcuat

SEQ ID NO: 77813 - DNA, 29 bp, Artificial Sequence
  Synthetic
cgtagcatttauggagagtgagtcttuaa

SEQ ID NO: 77814 - DNA, 21 bp, Artificial Sequence
  Synthetic
ctggaaagguggtucccaaga

SEQ ID NO: 77815 - DNA, 23 bp, Artificial Sequence
  Synthetic
gtgaagggcaaugaaggguacat

SEQ ID NO: 77816 - DNA, 28 bp, Artificial Sequence
  Synthetic
gtgtgtaacggaauaggtattggugaat

SEQ ID NO: 77817 - DNA, 22 bp, Artificial Sequence
  Synthetic
aagcaacugaacctgtgacuca

SEQ ID NO: 77818 - DNA, 20 bp, Artificial Sequence
  Synthetic
acctccaucagtggcgauct

SEQ ID NO: 77819 - DNA, 24 bp, Artificial Sequence
  Synthetic
cagaggaggaguatgtgugaagga

SEQ ID NO: 77820 - DNA, 19 bp, Artificial Sequence
  Synthetic
cuctgcauaaccgggacct

SEQ ID NO: 77821 - DNA, 21 bp, Artificial Sequence
  Synthetic
gctgctggaguacgtgaagug

SEQ ID NO: 77822 - DNA, 19 bp, Artificial Sequence
  Synthetic
ctctccugcaccacaugct

SEQ ID NO: 77823 - DNA, 17 bp, Artificial Sequence
  Synthetic
cgccgcugatagcguct

SEQ ID NO: 77824 - DNA, 19 bp, Artificial Sequence
  Synthetic
ctcccugaggctcagccua

SEQ ID NO: 77825 - DNA, 20 bp, Artificial Sequence
  Synthetic
ccagacaccgutgggaugaa

SEQ ID NO: 77826 - DNA, 20 bp, Artificial Sequence
  Synthetic
cuagagaacgagcgggucag

SEQ ID NO: 77827 - DNA, 23 bp, Artificial Sequence
  Synthetic
aaagtucctaccctucgcagaag

SEQ ID NO: 77828 - DNA, 24 bp, Artificial Sequence
  Synthetic
acgaatacugacagcaatgctgut

SEQ ID NO: 77829 - DNA, 28 bp, Artificial Sequence
  Synthetic
tggagagaucaggtgtaaatagugaact

SEQ ID NO: 77830 - DNA, 20 bp, Artificial Sequence
  Synthetic
cctccatguagctgccguag

SEQ ID NO: 77831 - DNA, 24 bp, Artificial Sequence
  Synthetic
cgatggagacaugctctttgatug

SEQ ID NO: 77832 - DNA, 20 bp, Artificial Sequence
  Synthetic
cacgagcucagaagcaggua

SEQ ID NO: 77833 - DNA, 28 bp, Artificial Sequence
  Synthetic
ctgacttgaaguttttgtctgtttcucc

SEQ ID NO: 77834 - DNA, 29 bp, Artificial Sequence
  Synthetic
ggctttggaugcattaagaaatucaagat

SEQ ID NO: 77835 - DNA, 26 bp, Artificial Sequence
  Synthetic
acaccttggtutcttccattttcugt

SEQ ID NO: 77836 - DNA, 24 bp, Artificial Sequence
  Synthetic
ccttgacuaacataccagcugcaa

SEQ ID NO: 77837 - DNA, 23 bp, Artificial Sequence
  Synthetic
acactgacuctccatgttugacc

SEQ ID NO: 77838 - DNA, 21 bp, Artificial Sequence
  Synthetic
ccaatcugccggcacatgtua

SEQ ID NO: 77839 - DNA, 28 bp, Artificial Sequence
  Synthetic
cccacagaataucgatcctatgtucaat

SEQ ID NO: 77840 - DNA, 22 bp, Artificial Sequence
  Synthetic
ccagggtatguggctacatgut

SEQ ID NO: 77841 - DNA, 21 bp, Artificial Sequence
  Synthetic
acttcucacaccgctgtgtuc

SEQ ID NO: 77842 - DNA, 22 bp, Artificial Sequence
  Synthetic
ggtgccctugctcttccttuag

SEQ ID NO: 77843 - DNA, 28 bp, Artificial Sequence
  Synthetic
acctgcttatugcaacaagtattguaga

SEQ ID NO: 77844 - DNA, 22 bp, Artificial Sequence
  Synthetic
caagaggugacagcagaggaug

SEQ ID NO: 77845 - DNA, 23 bp, Artificial Sequence
  Synthetic
aagagggtcugaggaaggauagg

SEQ ID NO: 77846 - DNA, 28 bp, Artificial Sequence
  Synthetic
tctaggcauaaagatgtcatcaucaacc

SEQ ID NO: 77847 - DNA, 28 bp, Artificial Sequence
  Synthetic
tgaactgataaagugcactggaugaaaa

SEQ ID NO: 77848 - DNA, 26 bp, Artificial Sequence
  Synthetic
ggcattttcucaaaatcttgcccuat

SEQ ID NO: 77849 - DNA, 25 bp, Artificial Sequence
  Synthetic
tggtatttgcauctgttgggugaaa

SEQ ID NO: 77850 - DNA, 27 bp, Artificial Sequence
  Synthetic
ttgcattttgguatatcaacacccuct

SEQ ID NO: 77851 - DNA, 27 bp, Artificial Sequence
  Synthetic
ttcttagaagugcttttcttgguggat

SEQ ID NO: 77852 - DNA, 25 bp, Artificial Sequence
  Synthetic
aaatgaagttgutttggctguggag

SEQ ID NO: 77853 - DNA, 27 bp, Artificial Sequence
  Synthetic
tgattcttaccccaaaaautccctgut

SEQ ID NO: 77854 - DNA, 23 bp, Artificial Sequence
  Synthetic
gagcggcaautcacuaacaagaa

SEQ ID NO: 77855 - DNA, 28 bp, Artificial Sequence
  Synthetic
tgccatgacaacutgatgcttatuaaac

SEQ ID NO: 77856 - DNA, 20 bp, Artificial Sequence
  Synthetic
ggcaggaacuccgatctugt

SEQ ID NO: 77857 - DNA, 28 bp, Artificial Sequence
  Synthetic
aggcttctgaaauggttttctcatauct

SEQ ID NO: 77858 - DNA, 20 bp, Artificial Sequence
  Synthetic
gaggaccuagaagcccucca

SEQ ID NO: 77859 - DNA, 25 bp, Artificial Sequence
  Synthetic
tttgcgagagguaatgaaugacact

SEQ ID NO: 77860 - DNA, 28 bp, Artificial Sequence
  Synthetic
tcagctaaagggaacugctattttugaa

SEQ ID NO: 77861 - DNA, 20 bp, Artificial Sequence
  Synthetic
tuggccaccaggaagtucat

SEQ ID NO: 77862 - DNA, 28 bp, Artificial Sequence
  Synthetic
ggtcagagctguattattctcctcttug

SEQ ID NO: 77863 - DNA, 26 bp, Artificial Sequence
  Synthetic
acatctgtcacuaattgccactcaut

SEQ ID NO: 77864 - DNA, 20 bp, Artificial Sequence
  Synthetic
ccccaugaaggagagccuca

SEQ ID NO: 77865 - DNA, 26 bp, Artificial Sequence
  Synthetic
tgaatggctaguactgatggttucac

SEQ ID NO: 77866 - DNA, 22 bp, Artificial Sequence
  Synthetic
caggtcugcctgtatgcaucat

SEQ ID NO: 77867 - DNA, 27 bp, Artificial Sequence
  Synthetic
gcaagtactaugaaaactgtgaggtug

SEQ ID NO: 77868 - DNA, 23 bp, Artificial Sequence
  Synthetic
tctgttaccuggtggtagtucct

SEQ ID NO: 77869 - DNA, 28 bp, Artificial Sequence
  Synthetic
tggtccttcgtutttcttctagttctut

SEQ ID NO: 77870 - DNA, 27 bp, Artificial Sequence
  Synthetic
actaccacctuctagctgagaaaauct

SEQ ID NO: 77871 - DNA, 17 bp, Artificial Sequence
  Synthetic
ttcctggutgcggcugt

SEQ ID NO: 77872 - DNA, 22 bp, Artificial Sequence
  Synthetic
gttatctccaggutgcccauga

SEQ ID NO: 77873 - DNA, 25 bp, Artificial Sequence
  Synthetic
cacgtgtaucttcttgtcttugcag

SEQ ID NO: 77874 - DNA, 21 bp, Artificial Sequence
  Synthetic
ccagcuaaggagaccacugga

SEQ ID NO: 77875 - DNA, 21 bp, Artificial Sequence
  Synthetic
ctttctggagugtgcguacca

SEQ ID NO: 77876 - DNA, 22 bp, Artificial Sequence
  Synthetic
ctgggagagugagagggtgtua

SEQ ID NO: 77877 - DNA, 22 bp, Artificial Sequence
  Synthetic
actgcagucctcaagcattuag

SEQ ID NO: 77878 - DNA, 18 bp, Artificial Sequence
  Synthetic
gtagccgucgtcgtcgua

SEQ ID NO: 77879 - DNA, 22 bp, Artificial Sequence
  Synthetic
gggtcatgucttcagggctuag

SEQ ID NO: 77880 - DNA, 25 bp, Artificial Sequence
  Synthetic
cctcgatagugttcatttctuccgt

SEQ ID NO: 77881 - DNA, 25 bp, Artificial Sequence
  Synthetic
ctatatcucaccagaatgccaugct

SEQ ID NO: 77882 - DNA, 28 bp, Artificial Sequence
  Synthetic
aggcattcagauctaacattttgcucat

SEQ ID NO: 77883 - DNA, 23 bp, Artificial Sequence
  Synthetic
cgtcaaacuaaccgggtugagag

SEQ ID NO: 77884 - DNA, 21 bp, Artificial Sequence
  Synthetic
catggacagutggcucaacct

SEQ ID NO: 77885 - DNA, 28 bp, Artificial Sequence
  Synthetic
cagaagaactaggagutatggtctgtut

SEQ ID NO: 77886 - DNA, 23 bp, Artificial Sequence
  Synthetic
aggagggcagagcauttttctua

SEQ ID NO: 77887 - DNA, 22 bp, Artificial Sequence
  Synthetic
cucaggaccuaaggacacagac

SEQ ID NO: 77888 - DNA, 24 bp, Artificial Sequence
  Synthetic
ttgacaaugctctucccaggaaat

SEQ ID NO: 77889 - DNA, 22 bp, Artificial Sequence
  Synthetic
ttggatttuccatcctguggca

SEQ ID NO: 77890 - DNA, 24 bp, Artificial Sequence
  Synthetic
acttctgttucccgattttgcuct

SEQ ID NO: 77891 - DNA, 27 bp, Artificial Sequence
  Synthetic
gcctcacacautgctacaggaaauaaa

SEQ ID NO: 77892 - DNA, 22 bp, Artificial Sequence
  Synthetic
gcaccutaccttgtucaggcaa

SEQ ID NO: 77893 - DNA, 20 bp, Artificial Sequence
  Synthetic
aggaggaucgagctcacugt

SEQ ID NO: 77894 - DNA, 22 bp, Artificial Sequence
  Synthetic
gagcatguccaaattgcctgut

SEQ ID NO: 77895 - DNA, 21 bp, Artificial Sequence
  Synthetic
ttccugaggagcagaugacct

SEQ ID NO: 77896 - DNA, 21 bp, Artificial Sequence
  Synthetic
tgaggtgacccutgtctcugt

SEQ ID NO: 77897 - DNA, 28 bp, Artificial Sequence
  Synthetic
ccagcacttugatctttttgaatucagt

SEQ ID NO: 77898 - DNA, 25 bp, Artificial Sequence
  Synthetic
agctctctugaggatctugaaggaa

SEQ ID NO: 77899 - DNA, 26 bp, Artificial Sequence
  Synthetic
ggaaatatacagcutgcaaggacuct

SEQ ID NO: 77900 - DNA, 22 bp, Artificial Sequence
  Synthetic
gggtaucaagaaggccttgguc

SEQ ID NO: 77901 - DNA, 23 bp, Artificial Sequence
  Synthetic
aggacacacaggaaauggctuac

SEQ ID NO: 77902 - DNA, 21 bp, Artificial Sequence
  Synthetic
gacccagcucaagctctucaa

SEQ ID NO: 77903 - DNA, 24 bp, Artificial Sequence
  Synthetic
ggcatcauccttctttctcuccag

SEQ ID NO: 77904 - DNA, 22 bp, Artificial Sequence
  Synthetic
agtgggttuccctgtctcctua

SEQ ID NO: 77905 - DNA, 19 bp, Artificial Sequence
  Synthetic
cttggacagucgccccuac

SEQ ID NO: 77906 - DNA, 21 bp, Artificial Sequence
  Synthetic
tgcaugacaccaagtcctuga

SEQ ID NO: 77907 - DNA, 24 bp, Artificial Sequence
  Synthetic
ggagcttcucttcttccucaacag

SEQ ID NO: 77908 - DNA, 23 bp, Artificial Sequence
  Synthetic
ggatcucaggaaattccgtugct

SEQ ID NO: 77909 - DNA, 23 bp, Artificial Sequence
  Synthetic
ggttcaaagaugctttccagcut

SEQ ID NO: 77910 - DNA, 20 bp, Artificial Sequence
  Synthetic
aatctcugccgcttggtuga

SEQ ID NO: 77911 - DNA, 29 bp, Artificial Sequence
  Synthetic
ttgtcttctttatugccgtttctcattut

SEQ ID NO: 77912 - DNA, 33 bp, Artificial Sequence
  Synthetic
catattttcaataugaaaactgttccaggtuag

SEQ ID NO: 77913 - DNA, 25 bp, Artificial Sequence
  Synthetic
acattggaucacaactgctgctuaa

SEQ ID NO: 77914 - DNA, 25 bp, Artificial Sequence
  Synthetic
cacttaccutagctatcuggacaca

SEQ ID NO: 77915 - DNA, 19 bp, Artificial Sequence
  Synthetic
cacaccuagtccggtugct

SEQ ID NO: 77916 - DNA, 20 bp, Artificial Sequence
  Synthetic
ggatggutgggcucagacac

SEQ ID NO: 77917 - DNA, 28 bp, Artificial Sequence
  Synthetic
aaatcatcagcaccautagtacaaucca

SEQ ID NO: 77918 - DNA, 24 bp, Artificial Sequence
  Synthetic
cctttacttcaucagctcgtcuga

SEQ ID NO: 77919 - DNA, 27 bp, Artificial Sequence
  Synthetic
gcutttagaataatcaugggccagact

SEQ ID NO: 77920 - DNA, 23 bp, Artificial Sequence
  Synthetic
ggtccctuctcagatttctuccc

SEQ ID NO: 77921 - DNA, 26 bp, Artificial Sequence
  Synthetic
gttagtttgcugcggatuaaaacaca

SEQ ID NO: 77922 - DNA, 18 bp, Artificial Sequence
  Synthetic
agaacgcacguccaccut

SEQ ID NO: 77923 - DNA, 26 bp, Artificial Sequence
  Synthetic
tgaaaacutgtaatctuccccaggag

SEQ ID NO: 77924 - DNA, 29 bp, Artificial Sequence
  Synthetic
tttctacttgtttucagaatcactcugct

SEQ ID NO: 77925 - DNA, 25 bp, Artificial Sequence
  Synthetic
ggagaautttggcugaagacaacct

SEQ ID NO: 77926 - DNA, 27 bp, Artificial Sequence
  Synthetic
cttaccctctuctttgcatttctcuct

SEQ ID NO: 77927 - DNA, 26 bp, Artificial Sequence
  Synthetic
ttttcttagtuggcactctatgugct

SEQ ID NO: 77928 - DNA, 24 bp, Artificial Sequence
  Synthetic
ggttccaggaaugaaagcacauag

SEQ ID NO: 77929 - DNA, 33 bp, Artificial Sequence
  Synthetic
tatcaagtatctcaucctgtggagaataatuaa

SEQ ID NO: 77930 - DNA, 21 bp, Artificial Sequence
  Synthetic
ggaaacagccuggttctugga

SEQ ID NO: 77931 - DNA, 26 bp, Artificial Sequence
  Synthetic
aatgactttcutaccttcgaugccat

SEQ ID NO: 77932 - DNA, 25 bp, Artificial Sequence
  Synthetic
agtaagttcuaagggttagccugaa

SEQ ID NO: 77933 - DNA, 22 bp, Artificial Sequence
  Synthetic
ggaccccuactacaucagcaag

SEQ ID NO: 77934 - DNA, 20 bp, Artificial Sequence
  Synthetic
ctctgtcaacutcccgcuca

SEQ ID NO: 77935 - DNA, 28 bp, Artificial Sequence
  Synthetic
gcttcattaggcuctactctccttttua

SEQ ID NO: 77936 - DNA, 19 bp, Artificial Sequence
  Synthetic
gaggccguagtccgtctug

SEQ ID NO: 77937 - DNA, 21 bp, Artificial Sequence
  Synthetic
cccagcttcucatcctccgua

SEQ ID NO: 77938 - DNA, 28 bp, Artificial Sequence
  Synthetic
gaatgaggtcaagutcccatatguaaga

SEQ ID NO: 77939 - DNA, 24 bp, Artificial Sequence
  Synthetic
ggcucatuggaagaaaccaaacat

SEQ ID NO: 77940 - DNA, 17 bp, Artificial Sequence
  Synthetic
gccactcgucccgctug

SEQ ID NO: 77941 - DNA, 20 bp, Artificial Sequence
  Synthetic
cgtcagugcccaccctaaug

SEQ ID NO: 77942 - DNA, 20 bp, Artificial Sequence
  Synthetic
gtggttcugggaagcguact

SEQ ID NO: 77943 - DNA, 24 bp, Artificial Sequence
  Synthetic
tggctagcacuggaattcactuac

SEQ ID NO: 77944 - DNA, 24 bp, Artificial Sequence
  Synthetic
tgagagacugacaaggaaagucct

SEQ ID NO: 77945 - DNA, 22 bp, Artificial Sequence
  Synthetic
gatgcactguctgcttctcugt

SEQ ID NO: 77946 - DNA, 28 bp, Artificial Sequence
  Synthetic
aggaaattgaagutgtgaggaugaagag

SEQ ID NO: 77947 - DNA, 25 bp, Artificial Sequence
  Synthetic
gccgatgaaacaaagugagaagaug

SEQ ID NO: 77948 - DNA, 22 bp, Artificial Sequence
  Synthetic
ggcaacagcaauccccaaaaug

SEQ ID NO: 77949 - DNA, 21 bp, Artificial Sequence
  Synthetic
acacacgcutggcagtguaat

SEQ ID NO: 77950 - DNA, 26 bp, Artificial Sequence
  Synthetic
gccatgggaacucaatagaaaaucct

SEQ ID NO: 77951 - DNA, 30 bp, Artificial Sequence
  Synthetic
aaaactatacgacacutaccaaagtctgut

SEQ ID NO: 77952 - DNA, 23 bp, Artificial Sequence
  Synthetic
ggtgacacagguttgactugact

SEQ ID NO: 77953 - DNA, 22 bp, Artificial Sequence
  Synthetic
gggcagatcuctgttggagaug

SEQ ID NO: 77954 - DNA, 23 bp, Artificial Sequence
  Synthetic
acctctucagaggatctguggaa

SEQ ID NO: 77955 - DNA, 21 bp, Artificial Sequence
  Synthetic
cacagtttgugctgggatugg

SEQ ID NO: 77956 - DNA, 18 bp, Artificial Sequence
  Synthetic
gccaggcuccuagaccca

SEQ ID NO: 77957 - DNA, 26 bp, Artificial Sequence
  Synthetic
ctccagatgutcttcgctaauaacca

SEQ ID NO: 77958 - DNA, 26 bp, Artificial Sequence
  Synthetic
tctttcuaaagggagccaacaauacc

SEQ ID NO: 77959 - DNA, 25 bp, Artificial Sequence
  Synthetic
aggauattgaagtuccaaaggccat

SEQ ID NO: 77960 - DNA, 22 bp, Artificial Sequence
  Synthetic
cagcacucacaaattcctgguc

SEQ ID NO: 77961 - DNA, 21 bp, Artificial Sequence
  Synthetic
agaccccuggaactgcuacat

SEQ ID NO: 77962 - DNA, 24 bp, Artificial Sequence
  Synthetic
ggaagccggaauattggattcuca

SEQ ID NO: 77963 - DNA, 24 bp, Artificial Sequence
  Synthetic
agcagcttcuaagtctaggctuct

SEQ ID NO: 77964 - DNA, 19 bp, Artificial Sequence
  Synthetic
agcccguaggtaccctugt

SEQ ID NO: 77965 - DNA, 22 bp, Artificial Sequence
  Synthetic
ctgagagtcucctctgcucact

SEQ ID NO: 77966 - DNA, 27 bp, Artificial Sequence
  Synthetic
gatcttgctttucatagacatctcuca

SEQ ID NO: 77967 - DNA, 22 bp, Artificial Sequence
  Synthetic
tttaaccgagugagcacctucc

SEQ ID NO: 77968 - DNA, 20 bp, Artificial Sequence
  Synthetic
tgccutcugccaggaaacat

SEQ ID NO: 77969 - DNA, 24 bp, Artificial Sequence
  Synthetic
agtgctttatugcctcactacugg

SEQ ID NO: 77970 - DNA, 24 bp, Artificial Sequence
  Synthetic
ccagcaagcgacucaaaaataucc

SEQ ID NO: 77971 - DNA, 23 bp, Artificial Sequence
  Synthetic
gaaactacauctgtggacugcct

SEQ ID NO: 77972 - DNA, 28 bp, Artificial Sequence
  Synthetic
agttctatgttguccttgtaggtttucc

SEQ ID NO: 77973 - DNA, 27 bp, Artificial Sequence
  Synthetic
gctctcattuccaaggagaactcuagt

SEQ ID NO: 77974 - DNA, 21 bp, Artificial Sequence
  Synthetic
tccagagagcucugggaagac

SEQ ID NO: 77975 - DNA, 21 bp, Artificial Sequence
  Synthetic
gtggctcugaggagtgaccua

SEQ ID NO: 77976 - DNA, 23 bp, Artificial Sequence
  Synthetic
aagaaggtuggtgtggcatuaca

SEQ ID NO: 77977 - DNA, 20 bp, Artificial Sequence
  Synthetic
ggctcugaaagaaggccuga

SEQ ID NO: 77978 - DNA, 28 bp, Artificial Sequence
  Synthetic
tgttatctcucaacctcttgaacauact

SEQ ID NO: 77979 - DNA, 22 bp, Artificial Sequence
  Synthetic
gucccgaagacugaagcaaact

SEQ ID NO: 77980 - DNA, 23 bp, Artificial Sequence
  Synthetic
cccccacuccagaagaatuaagg

SEQ ID NO: 77981 - DNA, 28 bp, Artificial Sequence
  Synthetic
ctgcaagtaguggaacaaatgtagttut

SEQ ID NO: 77982 - DNA, 24 bp, Artificial Sequence
  Synthetic
aaccagattucaggccttcttuca

SEQ ID NO: 77983 - DNA, 26 bp, Artificial Sequence
  Synthetic
ggcccaaaugacatcaagaaaatgut

SEQ ID NO: 77984 - DNA, 27 bp, Artificial Sequence
  Synthetic
gggactttggauttcggaggaataaua

SEQ ID NO: 77985 - DNA, 26 bp, Artificial Sequence
  Synthetic
aacaaaaccuatttuccaagcacacc

SEQ ID NO: 77986 - DNA, 21 bp, Artificial Sequence
  Synthetic
ctcattucccagggcctctua

SEQ ID NO: 77987 - DNA, 22 bp, Artificial Sequence
  Synthetic
ctccctcaucctctccccauag

SEQ ID NO: 77988 - DNA, 23 bp, Artificial Sequence
  Synthetic
ccccctgugcctcatgttataut

SEQ ID NO: 77989 - DNA, 25 bp, Artificial Sequence
  Synthetic
tccgaggtuggagatagagatgtut

SEQ ID NO: 77990 - DNA, 27 bp, Artificial Sequence
  Synthetic
aacggttccaaauatgttatctucggt

SEQ ID NO: 77991 - DNA, 22 bp, Artificial Sequence
  Synthetic
caaactgccccutgatccauct

SEQ ID NO: 77992 - DNA, 27 bp, Artificial Sequence
  Synthetic
tgutccactactugcagaaacagaaat

SEQ ID NO: 77993 - DNA, 28 bp, Artificial Sequence
  Synthetic
tgtaggctcagacauaacattttgtugt

SEQ ID NO: 77994 - DNA, 25 bp, Artificial Sequence
  Synthetic
tttgtatggccaaucagtgctgaua

SEQ ID NO: 77995 - DNA, 28 bp, Artificial Sequence
  Synthetic
ctttctagggauacctgattcucagact

SEQ ID NO: 77996 - DNA, 21 bp, Artificial Sequence
  Synthetic
ccugccaacaaccctcuagac

SEQ ID NO: 77997 - DNA, 20 bp, Artificial Sequence
  Synthetic
agatcaccgaccutgcugac

SEQ ID NO: 77998 - DNA, 22 bp, Artificial Sequence
  Synthetic
gcttctuggatggaggugacaa

SEQ ID NO: 77999 - DNA, 28 bp, Artificial Sequence
  Synthetic
aggcatttaaugaaatcagtgtttugct

SEQ ID NO: 78000 - DNA, 22 bp, Artificial Sequence
  Synthetic
cacaggucagagtgcaucaaca

SEQ ID NO: 78001 - DNA, 21 bp, Artificial Sequence
  Synthetic
gacctccaccaaugacacgut

SEQ ID NO: 78002 - DNA, 21 bp, Artificial Sequence
  Synthetic
ggguggcaaagtuagcaagga

SEQ ID NO: 78003 - DNA, 20 bp, Artificial Sequence
  Synthetic
cctgctcaugcttccgtcug

SEQ ID NO: 78004 - DNA, 22 bp, Artificial Sequence
  Synthetic
ctcttccugtttcaguccccat

SEQ ID NO: 78005 - DNA, 22 bp, Artificial Sequence
  Synthetic
gggacatgtcugtcagaggaua

SEQ ID NO: 78006 - DNA, 21 bp, Artificial Sequence
  Synthetic
ggctgugaagaacatcuccct

SEQ ID NO: 78007 - DNA, 26 bp, Artificial Sequence
  Synthetic
ccagatggaacaacugctcttttuac

SEQ ID NO: 78008 - DNA, 25 bp, Artificial Sequence
  Synthetic
gtcagtccataugtccagttgcaua

SEQ ID NO: 78009 - DNA, 21 bp, Artificial Sequence
  Synthetic
tgcaucccagcaagtctucat

SEQ ID NO: 78010 - DNA, 28 bp, Artificial Sequence
  Synthetic
gaagtcatcauaaagaccactcagauag

SEQ ID NO: 78011 - DNA, 25 bp, Artificial Sequence
  Synthetic
tcctcctccucccagaactuaaaaa

SEQ ID NO: 78012 - DNA, 29 bp, Artificial Sequence
  Synthetic
aaggcatgtttcuaatactgtgtctctut

SEQ ID NO: 78013 - DNA, 25 bp, Artificial Sequence
  Synthetic
gcacaggauaactctttgcaucagt

SEQ ID NO: 78014 - DNA, 20 bp, Artificial Sequence
  Synthetic
gttcaugccgacaagugcag

SEQ ID NO: 78015 - DNA, 22 bp, Artificial Sequence
  Synthetic
cctggaccagcuctggattuag

SEQ ID NO: 78016 - DNA, 21 bp, Artificial Sequence
  Synthetic
gtccacatugacctcagugct

SEQ ID NO: 78017 - DNA, 28 bp, Artificial Sequence
  Synthetic
ggccaaagauaaaatgcttacuggaaaa

SEQ ID NO: 78018 - DNA, 20 bp, Artificial Sequence
  Synthetic
ccacccuagcaguagaccga

SEQ ID NO: 78019 - DNA, 21 bp, Artificial Sequence
  Synthetic
tctctgacucctccccatucc

SEQ ID NO: 78020 - DNA, 24 bp, Artificial Sequence
  Synthetic
gatatgtttgcugcagggcctaua

SEQ ID NO: 78021 - DNA, 29 bp, Artificial Sequence
  Synthetic
ctcttgattcagcutacctctttcauagt

SEQ ID NO: 78022 - DNA, 26 bp, Artificial Sequence
  Synthetic
ctgttggugcacaaaaagacactuat

SEQ ID NO: 78023 - DNA, 21 bp, Artificial Sequence
  Synthetic
tggccaatutctccacauggt

SEQ ID NO: 78024 - DNA, 24 bp, Artificial Sequence
  Synthetic
cccttgtctugcaggtatgacaua

SEQ ID NO: 78025 - DNA, 21 bp, Artificial Sequence
  Synthetic
cacaccuggaacugggagaag

SEQ ID NO: 78026 - DNA, 26 bp, Artificial Sequence
  Synthetic
acctggaggucagactattttaguaa

SEQ ID NO: 78027 - DNA, 26 bp, Artificial Sequence
  Synthetic
ggagatctucagttttcctgaugact

SEQ ID NO: 78028 - DNA, 24 bp, Artificial Sequence
  Synthetic
agagacugagaacacacagcatug

SEQ ID NO: 78029 - DNA, 25 bp, Artificial Sequence
  Synthetic
cttggtttguggaccattttgtuga

SEQ ID NO: 78030 - DNA, 22 bp, Artificial Sequence
  Synthetic
ggacgaggagcutatggttcug

SEQ ID NO: 78031 - DNA, 27 bp, Artificial Sequence
  Synthetic
acagtggtattacugcaccatgaaaut

SEQ ID NO: 78032 - DNA, 22 bp, Artificial Sequence
  Synthetic
ggaactggauacagtgccguaa

SEQ ID NO: 78033 - DNA, 28 bp, Artificial Sequence
  Synthetic
cattgttagctuccaccaaagtttuagt

SEQ ID NO: 78034 - DNA, 22 bp, Artificial Sequence
  Synthetic
tctctctcctuccttcccccua

SEQ ID NO: 78035 - DNA, 27 bp, Artificial Sequence
  Synthetic
cacctctaagggutgccaaaatcauat

SEQ ID NO: 78036 - DNA, 27 bp, Artificial Sequence
  Synthetic
agagcaugagaattttcuggaaaccat

SEQ ID NO: 78037 - DNA, 26 bp, Artificial Sequence
  Synthetic
ccagauttcuacaaaagcacagacac

SEQ ID NO: 78038 - DNA, 27 bp, Artificial Sequence
  Synthetic
gtattcatgaagaccugggactttuct

SEQ ID NO: 78039 - DNA, 26 bp, Artificial Sequence
  Synthetic
ccagattttcuttgttccagugggat

SEQ ID NO: 78040 - DNA, 24 bp, Artificial Sequence
  Synthetic
ggaacuaacagaccaggagaacut

SEQ ID NO: 78041 - DNA, 23 bp, Artificial Sequence
  Synthetic
ccggcatacucaatcaccatcuc

SEQ ID NO: 78042 - DNA, 23 bp, Artificial Sequence
  Synthetic
cagcttcaggucactttcccuat

SEQ ID NO: 78043 - DNA, 20 bp, Artificial Sequence
  Synthetic
tgtgggacuctgtcctucgt

SEQ ID NO: 78044 - DNA, 20 bp, Artificial Sequence
  Synthetic
gttgtugcagccagcagaug

SEQ ID NO: 78045 - DNA, 28 bp, Artificial Sequence
  Synthetic
cttactctcaaugattcctggaaugagg

SEQ ID NO: 78046 - DNA, 19 bp, Artificial Sequence
  Synthetic
accaggccucctcatucca

SEQ ID NO: 78047 - DNA, 32 bp, Artificial Sequence
  Synthetic
tgagatgcatauaaaagtaatgtgtccttuca

SEQ ID NO: 78048 - DNA, 20 bp, Artificial Sequence
  Synthetic
ggaacgguggtttggcugat

SEQ ID NO: 78049 - DNA, 27 bp, Artificial Sequence
  Synthetic
aagtgagugaaagagacacaggaaaut

SEQ ID NO: 78050 - DNA, 24 bp, Artificial Sequence
  Synthetic
gcatctctguatcttccacuggga

SEQ ID NO: 78051 - DNA, 24 bp, Artificial Sequence
  Synthetic
cacctuacagacaccggaatacug

SEQ ID NO: 78052 - DNA, 20 bp, Artificial Sequence
  Synthetic
cggucagcacucaaccagag

SEQ ID NO: 78053 - DNA, 22 bp, Artificial Sequence
  Synthetic
acuctacagtgcuggagacaca

SEQ ID NO: 78054 - DNA, 18 bp, Artificial Sequence
  Synthetic
ccugagcccctgtuccaa

SEQ ID NO: 78055 - DNA, 21 bp, Artificial Sequence
  Synthetic
agaggaaagccagagugtgug

SEQ ID NO: 78056 - DNA, 25 bp, Artificial Sequence
  Synthetic
ccacagacucagtuccaaaagaaca

SEQ ID NO: 78057 - DNA, 20 bp, Artificial Sequence
  Synthetic
cccaggugcgtcactatguc

SEQ ID NO: 78058 - DNA, 23 bp, Artificial Sequence
  Synthetic
aaaccacaacugagctuacacca

SEQ ID NO: 78059 - DNA, 25 bp, Artificial Sequence
  Synthetic
cctgcaggaguacagcacaaaauat

SEQ ID NO: 78060 - DNA, 28 bp, Artificial Sequence
  Synthetic
ggctgagaccugagttgataaaattuct

SEQ ID NO: 78061 - DNA, 30 bp, Artificial Sequence; identical to SEQ ID NO: 14605
  Synthetic

SEQ ID NO: 78062 - DNA, 27 bp, Artificial Sequence
  Synthetic
ttctguaagagaaacattgaugcaggt

SEQ ID NO: 78063 - DNA, 24 bp, Artificial Sequence
  Synthetic
aaaagaactgtgugagtgcaagug

SEQ ID NO: 78064 - DNA, 22 bp, Artificial Sequence
  Synthetic
cctctggagagugcagtggtua

SEQ ID NO: 78065 - DNA, 23 bp, Artificial Sequence
  Synthetic
caaagttcgutctgctgcucaag

SEQ ID NO: 78066 - DNA, 23 bp, Artificial Sequence
  Synthetic
gggattgguaaggatgacagugt

SEQ ID NO: 78067 - DNA, 27 bp, Artificial Sequence
  Synthetic
cgtgtgagagcaaaucctttgactaua

SEQ ID NO: 78068 - DNA, 26 bp, Artificial Sequence
  Synthetic
gagcatttgttacugcaaccactauc

SEQ ID NO: 78069 - DNA, 24 bp, Artificial Sequence
  Synthetic
gtaatgcttuccttccgctttugt

SEQ ID NO: 78070 - DNA, 22 bp, Artificial Sequence
  Synthetic
agccatttugagaggacacgut

SEQ ID NO: 78071 - DNA, 28 bp, Artificial Sequence
  Synthetic
ttgcataatgccuttactgaccaaaaut

SEQ ID NO: 78072 - DNA, 22 bp, Artificial Sequence
  Synthetic
tgatgcuttggctucagcaaga

SEQ ID NO: 78073 - DNA, 26 bp, Artificial Sequence
  Synthetic
gggtcaaccugatttaatccacucac

SEQ ID NO: 78074 - DNA, 23 bp, Artificial Sequence
  Synthetic
gtttgtctgutcagcaaguggac

SEQ ID NO: 78075 - DNA, 23 bp, Artificial Sequence
  Synthetic
gttgccatuagcacctacuccat

SEQ ID NO: 78076 - DNA, 27 bp, Artificial Sequence
  Synthetic
tcaaagaatgaaacacaugctgaagug

SEQ ID NO: 78077 - DNA, 21 bp, Artificial Sequence
  Synthetic
aaacugacagggccaaugact

SEQ ID NO: 78078 - DNA, 27 bp, Artificial Sequence
  Synthetic
ggtggctgttguatttatttctgtcuc

SEQ ID NO: 78079 - DNA, 27 bp, Artificial Sequence
  Synthetic
acccaggguataaatcacgtuaagact

SEQ ID NO: 78080 - DNA, 21 bp, Artificial Sequence
  Synthetic
ccctgaugccccttgtcttua

SEQ ID NO: 78081 - DNA, 20 bp, Artificial Sequence
  Synthetic
caagguggagagggacucac

SEQ ID NO: 78082 - DNA, 28 bp, Artificial Sequence
  Synthetic
caaaatgtaaaccgaautctgcttcuga

SEQ ID NO: 78083 - DNA, 21 bp, Artificial Sequence
  Synthetic
tcagtggtcugctgttctugg

SEQ ID NO: 78084 - DNA, 22 bp, Artificial Sequence
  Synthetic
cctcctcucagagttcctucct

SEQ ID NO: 78085 - DNA, 22 bp, Artificial Sequence
  Synthetic
ctgtcacuccttggaggtucac

SEQ ID NO: 78086 - DNA, 20 bp, Artificial Sequence
  Synthetic
aggaccttutggtggtgugg

SEQ ID NO: 78087 - DNA, 23 bp, Artificial Sequence
  Synthetic
agtggaaagcccagutcaagaug

SEQ ID NO: 78088 - DNA, 24 bp, Artificial Sequence
  Synthetic
gaaatggtttucagagcacacugt

SEQ ID NO: 78089 - DNA, 23 bp, Artificial Sequence
  Synthetic
tcacccgaaugaagaaggactug

SEQ ID NO: 78090 - DNA, 24 bp, Artificial Sequence
  Synthetic
agcatggtcaaguccttcttcaut

SEQ ID NO: 78091 - DNA, 29 bp, Artificial Sequence
  Synthetic
caaagaugttttauacacaccacaaagca

SEQ ID NO: 78092 - DNA, 21 bp, Artificial Sequence
  Synthetic
gatctggcugtcgtcaauggt

SEQ ID NO: 78093 - DNA, 22 bp, Artificial Sequence
  Synthetic
gggtgggatugcactcttgtut

SEQ ID NO: 78094 - DNA, 22 bp, Artificial Sequence
  Synthetic
ccactaugcagaggctgacaua

SEQ ID NO: 78095 - DNA, 23 bp, Artificial Sequence
  Synthetic
tccttcucccagcttctcttuga

SEQ ID NO: 78096 - DNA, 22 bp, Artificial Sequence
  Synthetic
ttcccctaaugggtcacctuct

SEQ ID NO: 78097 - DNA, 21 bp, Artificial Sequence
  Synthetic
acgtcttugacgaccccatuc

SEQ ID NO: 78098 - DNA, 25 bp, Artificial Sequence
  Synthetic
aggaattagccuaacctggagtuga

SEQ ID NO: 78099 - DNA, 23 bp, Artificial Sequence
  Synthetic
ggcaatggcuttaattgacugga

SEQ ID NO: 78100 - DNA, 24 bp, Artificial Sequence
  Synthetic
agttccccaggaaacucctaacut

SEQ ID NO: 78101 - DNA, 28 bp, Artificial Sequence
  Synthetic
gaagggactcttugttctactgatcaut

SEQ ID NO: 78102 - DNA, 21 bp, Artificial Sequence
  Synthetic
caagacuctcuccccagggaa

SEQ ID NO: 78103 - DNA, 19 bp, Artificial Sequence
  Synthetic
gtgggtccuggtcccagua

SEQ ID NO: 78104 - DNA, 21 bp, Artificial Sequence
  Synthetic
ccagcctucgacaacctcuat

SEQ ID NO: 78105 - DNA, 21 bp, Artificial Sequence
  Synthetic
gaggacacaucagggcttcug

SEQ ID NO: 78106 - DNA, 21 bp, Artificial Sequence
  Synthetic
ccctgcguatgtgggatugag

SEQ ID NO: 78107 - DNA, 23 bp, Artificial Sequence
  Synthetic
gctctgatugaccgaatggugaa

SEQ ID NO: 78108 - DNA, 19 bp, Artificial Sequence
  Synthetic
ccagggagcuctgacugga

SEQ ID NO: 78109 - DNA, 28 bp, Artificial Sequence
  Synthetic
ctatgttccctutcctcatttcctugaa

SEQ ID NO: 78110 - DNA, 22 bp, Artificial Sequence
  Synthetic
caaggagccaggcauttttcut

SEQ ID NO: 78111 - DNA, 25 bp, Artificial Sequence
  Synthetic
guatacgctuccagagaacaaggag

SEQ ID NO: 78112 - DNA, 24 bp, Artificial Sequence
  Synthetic
gatgtgcuaaatgcatacauggca

SEQ ID NO: 78113 - DNA, 25 bp, Artificial Sequence
  Synthetic
tgatgcagatuaacacgcgattgua

SEQ ID NO: 78114 - DNA, 23 bp, Artificial Sequence
  Synthetic
caattgttcaugcttggugcaga

SEQ ID NO: 78115 - DNA, 20 bp, Artificial Sequence
  Synthetic
cuggaaagcagcgcaugaag

SEQ ID NO: 78116 - DNA, 33 bp, Artificial Sequence
  Synthetic
tttgagttaagataggutacttagtataccuga

SEQ ID NO: 78117 - DNA, 25 bp, Artificial Sequence
  Synthetic
tgctttctcutccttgttcaucaca

SEQ ID NO: 78118 - DNA, 23 bp, Artificial Sequence
  Synthetic
accccaagacutgctacattugt

SEQ ID NO: 78119 - DNA, 26 bp, Artificial Sequence
  Synthetic
tctgtgcaacaauggaaacatcctua

SEQ ID NO: 78120 - DNA, 20 bp, Artificial Sequence
  Synthetic
ttccgacaacuccugggaag

SEQ ID NO: 78121 - DNA, 23 bp, Artificial Sequence
  Synthetic
cgctcugggaaatctgcuacaat

SEQ ID NO: 78122 - DNA, 31 bp, Artificial Sequence; identical to SEQ ID NO: 64766
  Synthetic

SEQ ID NO: 78123 - DNA, 28 bp, Artificial Sequence
  Synthetic
ccataggtagaaauactggctaaaucct

SEQ ID NO: 78124 - DNA, 28 bp, Artificial Sequence
  Synthetic
ttcactactaguaaactgcagtccttug

SEQ ID NO: 78125 - DNA, 26 bp, Artificial Sequence
  Synthetic
acagacaatgtcaucacaggaggaua

SEQ ID NO: 78126 - DNA, 20 bp, Artificial Sequence
  Synthetic
ccagggaccucggacttcua

SEQ ID NO: 78127 - DNA, 21 bp, Artificial Sequence
  Synthetic
acatcuaccccgagcagtuct

SEQ ID NO: 78128 - DNA, 28 bp, Artificial Sequence
  Synthetic
actttcctttcautctcctgttcttuct

SEQ ID NO: 78129 - DNA, 21 bp, Artificial Sequence
  Synthetic
cagagcccucactcuccagat

SEQ ID NO: 78130 - DNA, 26 bp, Artificial Sequence
  Synthetic
agccacggguaataatttttgtccut

SEQ ID NO: 78131 - DNA, 22 bp, Artificial Sequence
  Synthetic
tccaaagccauccacttcacug

SEQ ID NO: 78132 - DNA, 24 bp, Artificial Sequence
  Synthetic
accccatgauctcattctctucca

SEQ ID NO: 78133 - DNA, 20 bp, Artificial Sequence
  Synthetic
gacctucagagacacugcca

SEQ ID NO: 78134 - DNA, 20 bp, Artificial Sequence
  Synthetic
cgtttgagcucccgcatgua

SEQ ID NO: 78135 - DNA, 19 bp, Artificial Sequence
  Synthetic
cttcuctgggcucgacgac

SEQ ID NO: 78136 - DNA, 27 bp, Artificial Sequence
  Synthetic
gactatatcttucatcccttccuccct

SEQ ID NO: 78137 - DNA, 21 bp, Artificial Sequence
  Synthetic
caccauagaagcccacgaugt

SEQ ID NO: 78138 - DNA, 27 bp, Artificial Sequence
  Synthetic
gttcagtcttcutcattgtacctucct

SEQ ID NO: 78139 - DNA, 22 bp, Artificial Sequence
  Synthetic
ccggucggaagaagguaaacat

SEQ ID NO: 78140 - DNA, 31 bp, Artificial Sequence
  Synthetic
ttatactgtcttgautcaccttgacaauaaa

SEQ ID NO: 78141 - DNA, 24 bp, Artificial Sequence
  Synthetic
atgcagttgcutcagtacccauaa

SEQ ID NO: 78142 - DNA, 25 bp, Artificial Sequence
  Synthetic
gggagaccaagaauacattaugggt

SEQ ID NO: 78143 - DNA, 24 bp, Artificial Sequence
  Synthetic
tgatggcuacagcttaaggttguc

SEQ ID NO: 78144 - DNA, 22 bp, Artificial Sequence
  Synthetic
tcagcgucttgtcttucaaggg

SEQ ID NO: 78145 - DNA, 23 bp, Artificial Sequence
  Synthetic
ctccatcagugtgtctgttguct

SEQ ID NO: 78146 - DNA, 21 bp, Artificial Sequence
  Synthetic
ctgcccaugaggaatcgauct

SEQ ID NO: 78147 - DNA, 25 bp, Artificial Sequence
  Synthetic
aattttctgatugggcctaagcuct

SEQ ID NO: 78148 - DNA, 26 bp, Artificial Sequence
  Synthetic
ttatcgaggaaaggacugtagagcua

SEQ ID NO: 78149 - DNA, 27 bp, Artificial Sequence
  Synthetic
aatgataccaaccauttcacacaguct

SEQ ID NO: 78150 - DNA, 27 bp, Artificial Sequence
  Synthetic
tttctcagagcaugaatgatuggaagt

SEQ ID NO: 78151 - DNA, 24 bp, Artificial Sequence
  Synthetic
agccacaguattggacattaucgg

SEQ ID NO: 78152 - DNA, 23 bp, Artificial Sequence
  Synthetic
aaagaatggucctgcaccaguaa

SEQ ID NO: 78153 - DNA, 27 bp, Artificial Sequence
  Synthetic
aggcctgcugaaaatgactgaatauaa

SEQ ID NO: 78154 - DNA, 21 bp, Artificial Sequence
  Synthetic
ccagcuccaacuaccacaagt

SEQ ID NO: 78155 - DNA, 27 bp, Artificial Sequence
  Synthetic
aggtactgguggagtatttgatagugt

SEQ ID NO: 78156 - DNA, 25 bp, Artificial Sequence
  Synthetic
gtguacacaacaaaacaggugcaaa

SEQ ID NO: 78157 - DNA, 29 bp, Artificial Sequence
  Synthetic
agaggagaaacucagagataaccaauaca

SEQ ID NO: 78158 - DNA, 25 bp, Artificial Sequence
  Synthetic
ggtaatggugccgataatguccaat

SEQ ID NO: 78159 - DNA, 28 bp, Artificial Sequence
  Synthetic
ccaaaaacucaaggaaaaaggaactgut

SEQ ID NO: 78160 - DNA, 20 bp, Artificial Sequence
  Synthetic
cgacactaccugggccauac

SEQ ID NO: 78161 - DNA, 28 bp, Artificial Sequence
  Synthetic
gagcttuccacaagaaatcacttucaat

SEQ ID NO: 78162 - DNA, 22 bp, Artificial Sequence
  Synthetic
cagcaccaucaccacttaccut

SEQ ID NO: 78163 - DNA, 26 bp, Artificial Sequence
  Synthetic
gcatgcaguaccatacaggaactuac

SEQ ID NO: 78164 - DNA, 20 bp, Artificial Sequence
  Synthetic
ctccauccagttggctucgt

SEQ ID NO: 78165 - DNA, 24 bp, Artificial Sequence
  Synthetic
tgaatgcucccattgtttccucag

SEQ ID NO: 78166 - DNA, 28 bp, Artificial Sequence
  Synthetic
gaggcaaacgtuctcctttctctaauaa

SEQ ID NO: 78167 - DNA, 28 bp, Artificial Sequence
  Synthetic
tggtatagtgcuggtttgttcaacauat

SEQ ID NO: 78168 - DNA, 20 bp, Artificial Sequence
  Synthetic
gcatgagugcaactcuccgt

SEQ ID NO: 78169 - DNA, 22 bp, Artificial Sequence
  Synthetic
cccaactcutaaggccatugct

SEQ ID NO: 78170 - DNA, 23 bp, Artificial Sequence
  Synthetic
ggtgctugacaaaaacctgtuct

SEQ ID NO: 78171 - DNA, 25 bp, Artificial Sequence
  Synthetic
gcctcttugagccatttcttctuca

SEQ ID NO: 78172 - DNA, 22 bp, Artificial Sequence
  Synthetic
gggutgggauaacagagcaaca

SEQ ID NO: 78173 - DNA, 26 bp, Artificial Sequence
  Synthetic
ttcagcacaaucaaccagagaauagt

SEQ ID NO: 78174 - DNA, 21 bp, Artificial Sequence
  Synthetic
ccccagcuccagcttctauct

SEQ ID NO: 78175 - DNA, 24 bp, Artificial Sequence
  Synthetic
ccucttttcatccuagaccccaac

SEQ ID NO: 78176 - DNA, 22 bp, Artificial Sequence
  Synthetic
agcttttctgutgtcccggaut

SEQ ID NO: 78177 - DNA, 22 bp, Artificial Sequence
  Synthetic
gaaaucagcgcaggaaacauct

SEQ ID NO: 78178 - DNA, 26 bp, Artificial Sequence
  Synthetic
gtcctttctgacautttgacctcuca

SEQ ID NO: 78179 - DNA, 22 bp, Artificial Sequence
  Synthetic
gacacgtcucctccatguaagt

SEQ ID NO: 78180 - DNA, 28 bp, Artificial Sequence
  Synthetic
tgcatttgtttgtutttcttgtctccut

SEQ ID NO: 78181 - DNA, 27 bp, Artificial Sequence
  Synthetic
gcagaagctgtugatttctccaaaaua

SEQ ID NO: 78182 - DNA, 24 bp, Artificial Sequence
  Synthetic
aaccauggagggtttugaagaagt

SEQ ID NO: 78183 - DNA, 21 bp, Artificial Sequence
  Synthetic
ctggugaagaaggtcuccgat

SEQ ID NO: 78184 - DNA, 27 bp, Artificial Sequence
  Synthetic
attgcataaggguttgtgttagacuga

SEQ ID NO: 78185 - DNA, 25 bp, Artificial Sequence
  Synthetic
ccttttgatcacucccacctucaag

SEQ ID NO: 78186 - DNA, 23 bp, Artificial Sequence
  Synthetic
aggactacaugggtcactauggt

SEQ ID NO: 78187 - DNA, 24 bp, Artificial Sequence
  Synthetic
cccctacctautcttgctctccuc

SEQ ID NO: 78188 - DNA, 25 bp, Artificial Sequence
  Synthetic
tcaggtacauctgtgagugagaaca

SEQ ID NO: 78189 - DNA, 31 bp, Artificial Sequence
  Synthetic
aaccagtaagcuaacttgttgtaaauaacct

SEQ ID NO: 78190 - DNA, 28 bp, Artificial Sequence
  Synthetic
tgtgctctttauctcatcagactttuga

SEQ ID NO: 78191 - DNA, 21 bp, Artificial Sequence
  Synthetic
aaaaugtccugggaagcccaa

SEQ ID NO: 78192 - DNA, 28 bp, Artificial Sequence
  Synthetic
attctgtaagtgaugctgctgatgtuat

SEQ ID NO: 78193 - DNA, 31 bp, Artificial Sequence
  Synthetic
tgataatgcatuttaaagttctacucaccca

SEQ ID NO: 78194 - DNA, 21 bp, Artificial Sequence
  Synthetic
gcaaacaacugaccagcctut

SEQ ID NO: 78195 - DNA, 29 bp, Artificial Sequence
  Synthetic
catttggtcccaaugttattcacattuct

SEQ ID NO: 78196 - DNA, 27 bp, Artificial Sequence
  Synthetic
gtgtcacaagcaugattttattgucct

SEQ ID NO: 78197 - DNA, 24 bp, Artificial Sequence
  Synthetic
acttttggtuggaggctcactuac

SEQ ID NO: 78198 - DNA, 22 bp, Artificial Sequence
  Synthetic
caugggtcaggucacagagaag

SEQ ID NO: 78199 - DNA, 25 bp, Artificial Sequence
  Synthetic
aaaatagttuccaccagcuccaagt

SEQ ID NO: 78200 - DNA, 26 bp, Artificial Sequence
  Synthetic
tgtagaagtctggutagatccagcut

SEQ ID NO: 78201 - DNA, 28 bp, Artificial Sequence
  Synthetic
tccatgatgcucaaaattaactuaccct

SEQ ID NO: 78202 - DNA, 22 bp, Artificial Sequence
  Synthetic
ggctgaggcugttccataugac

SEQ ID NO: 78203 - DNA, 21 bp, Artificial Sequence
  Synthetic
gtggccgaccugtctatcauc

SEQ ID NO: 78204 - DNA, 26 bp, Artificial Sequence
  Synthetic
acacaggttgcugttgtcagtaauat

SEQ ID NO: 78205 - DNA, 24 bp, Artificial Sequence
  Synthetic
gttttctcactuccccctcctuag

SEQ ID NO: 78206 - DNA, 23 bp, Artificial Sequence
  Synthetic
gaggacatucacagggtucagaa

SEQ ID NO: 78207 - DNA, 25 bp, Artificial Sequence
  Synthetic
gttcagaggcugattgtgauagaca

SEQ ID NO: 78208 - DNA, 19 bp, Artificial Sequence
  Synthetic
cggugaagcgggcauagag

SEQ ID NO: 78209 - DNA, 21 bp, Artificial Sequence
  Synthetic
ggcttcguggagcattttcug

SEQ ID NO: 78210 - DNA, 22 bp, Artificial Sequence
  Synthetic
tgtcctguccccactccttuaa

SEQ ID NO: 78211 - DNA, 20 bp, Artificial Sequence
  Synthetic
cccctcttuctcagtgcuca

SEQ ID NO: 78212 - DNA, 29 bp, Artificial Sequence
  Synthetic
agacctttaggacutagctatattcugaa

SEQ ID NO: 78213 - DNA, 24 bp, Artificial Sequence
  Synthetic
gacttagugtcatgacuccagcaa

SEQ ID NO: 78214 - DNA, 23 bp, Artificial Sequence
  Synthetic
ccactattgcuggagtcaugaca

SEQ ID NO: 78215 - DNA, 25 bp, Artificial Sequence
  Synthetic
acgaagcagtugaactttctgtuct

SEQ ID NO: 78216 - DNA, 18 bp, Artificial Sequence
  Synthetic
agggaugacgcggtugac

SEQ ID NO: 78217 - DNA, 19 bp, Artificial Sequence
  Synthetic
gcccagaagacgcugtucc

SEQ ID NO: 78218 - DNA, 18 bp, Artificial Sequence
  Synthetic
caccacgucgtcgaugga

SEQ ID NO: 78219 - DNA, 18 bp, Artificial Sequence
  Synthetic
gggcggguggaacctuag

SEQ ID NO: 78220 - DNA, 20 bp, Artificial Sequence
  Synthetic
gctggctcugtgcagaaucc

SEQ ID NO: 78221 - DNA, 22 bp, Artificial Sequence
  Synthetic
tgtcgaaugtgctgtugacaca

SEQ ID NO: 78222 - DNA, 26 bp, Artificial Sequence
  Synthetic
tcaagaaugacaatguccaagacaca

SEQ ID NO: 78223 - DNA, 26 bp, Artificial Sequence
  Synthetic
ctgcaagaguacaaagattggcttut

SEQ ID NO: 78224 - DNA, 28 bp, Artificial Sequence
  Synthetic
gaaagaaagaagcguatgacacatugat

SEQ ID NO: 78225 - DNA, 28 bp, Artificial Sequence
  Synthetic
ccaagctttggauttcatttctgaagut

SEQ ID NO: 78226 - DNA, 28 bp, Artificial Sequence
  Synthetic
ctcaaggacautactagtgacucagaaa

SEQ ID NO: 78227 - DNA, 24 bp, Artificial Sequence
  Synthetic
ccaagcagtatutacagccagcua

SEQ ID NO: 78228 - DNA, 29 bp, Artificial Sequence
  Synthetic
ccagtgacttcuacacatttgttctauct

SEQ ID NO: 78229 - DNA, 25 bp, Artificial Sequence
  Synthetic
gggtgauaaggaagaggtactguga

SEQ ID NO: 78230 - DNA, 22 bp, Artificial Sequence
  Synthetic
accccgaguatctcaacacugt

SEQ ID NO: 78231 - DNA, 21 bp, Artificial Sequence
  Synthetic
ccatttggcutggcttcctug

SEQ ID NO: 78232 - DNA, 33 bp, Artificial Sequence
  Synthetic
ggttggatatagauatagatatacacacguaca

SEQ ID NO: 78233 - DNA, 28 bp, Artificial Sequence
  Synthetic
ccttcgguataatcactuccaagcaaat

SEQ ID NO: 78234 - DNA, 21 bp, Artificial Sequence
  Synthetic
ccugcccacacacacagauag

SEQ ID NO: 78235 - DNA, 21 bp, Artificial Sequence
  Synthetic
actttgctccugtcctgggua

SEQ ID NO: 78236 - DNA, 27 bp, Artificial Sequence
  Synthetic
ctctttaggatuggaccggaataagut

SEQ ID NO: 78237 - DNA, 22 bp, Artificial Sequence
  Synthetic
catgcccagggaautcatugag

SEQ ID NO: 78238 - DNA, 27 bp, Artificial Sequence
  Synthetic
acaatacagtacautctcctatguggt

SEQ ID NO: 78239 - DNA, 23 bp, Artificial Sequence
  Synthetic
caccagccauaggaccgtattuc

SEQ ID NO: 78240 - DNA, 23 bp, Artificial Sequence
  Synthetic
gttgtguaaccgccatggaaaut

SEQ ID NO: 78241 - DNA, 26 bp, Artificial Sequence
  Synthetic
tcacatgtuacagcatgacagtucat

SEQ ID NO: 78242 - DNA, 27 bp, Artificial Sequence
  Synthetic
gttttgttttuatctccccuccaggat

SEQ ID NO: 78243 - DNA, 28 bp, Artificial Sequence
  Synthetic
ccaccaattgaaaugtgtctagaatucc

SEQ ID NO: 78244 - DNA, 26 bp, Artificial Sequence
  Synthetic
cctaaacagugggaattcuagacaca

SEQ ID NO: 78245 - DNA, 28 bp, Artificial Sequence
  Synthetic
acacacacacaaaacaauctgcttaaut

SEQ ID NO: 78246 - DNA, 21 bp, Artificial Sequence
  Synthetic
acttcgaagcautggcuccag

SEQ ID NO: 78247 - DNA, 27 bp, Artificial Sequence
  Synthetic
actactttggcacutgattcaagauca

SEQ ID NO: 78248 - DNA, 28 bp, Artificial Sequence
  Synthetic
gaagaaaacagcaagaguaaaugcagaa

SEQ ID NO: 78249 - DNA, 28 bp, Artificial Sequence
  Synthetic
gtgggattaattautgccattctcaucc

SEQ ID NO: 78250 - DNA, 26 bp, Artificial Sequence
  Synthetic
gatacttgucaccactccaacaauga

SEQ ID NO: 78251 - DNA, 28 bp, Artificial Sequence
  Synthetic
tctgtacttcacacuaaaaatggcgaut

SEQ ID NO: 78252 - DNA, 25 bp, Artificial Sequence
  Synthetic
gtctcguaacggtttttctcuacca

SEQ ID NO: 78253 - DNA, 28 bp, Artificial Sequence
  Synthetic
ccgcattacuacatccaaatccauaaga

SEQ ID NO: 78254 - DNA, 23 bp, Artificial Sequence
  Synthetic
gacuaccagcaggacttcttucc

SEQ ID NO: 78255 - DNA, 25 bp, Artificial Sequence
  Synthetic
ttttagggcucatactatccuccgt

SEQ ID NO: 78256 - DNA, 27 bp, Artificial Sequence
  Synthetic
agaggcuagtttttgttcuacgaaagg

SEQ ID NO: 78257 - DNA, 27 bp, Artificial Sequence
  Synthetic
tttctccattttguggtcatggtttut

SEQ ID NO: 78258 - DNA, 28 bp, Artificial Sequence
  Synthetic
ggucaacagtggaugaaaaagaacaaaa

SEQ ID NO: 78259 - DNA, 26 bp, Artificial Sequence
  Synthetic
tgccatcttcauttgtcccaatuaga

SEQ ID NO: 78260 - DNA, 22 bp, Artificial Sequence
  Synthetic
gcucctctcttcucccacagaa

SEQ ID NO: 78261 - DNA, 24 bp, Artificial Sequence
  Synthetic
gatgtggucggcttcataguagat

SEQ ID NO: 78262 - DNA, 28 bp, Artificial Sequence
  Synthetic
tgaccttctatuatgaaaaatgccucca

SEQ ID NO: 78263 - DNA, 27 bp, Artificial Sequence
  Synthetic
cgttttcttccuctgttaggcattgua

SEQ ID NO: 78264 - DNA, 26 bp, Artificial Sequence
  Synthetic
aataatgttucctcagtcuccaccac

SEQ ID NO: 78265 - DNA, 27 bp, Artificial Sequence
  Synthetic
gtaaccactgucctttgcaaattugaa

SEQ ID NO: 78266 - DNA, 21 bp, Artificial Sequence
  Synthetic
ccacatctucacctggcagut

SEQ ID NO: 78267 - DNA, 23 bp, Artificial Sequence
  Synthetic
ggaaauccacagagagcactgut

SEQ ID NO: 78268 - DNA, 27 bp, Artificial Sequence
  Synthetic
gacttgtgtaucacctgctauaacact

SEQ ID NO: 78269 - DNA, 21 bp, Artificial Sequence
  Synthetic
agcauggaccagagacuggat

SEQ ID NO: 78270 - DNA, 21 bp, Artificial Sequence
  Synthetic
gttccggtucccatcctucaa

SEQ ID NO: 78271 - DNA, 28 bp, Artificial Sequence
  Synthetic
agaacaagaugaagggcagcatttauat

SEQ ID NO: 78272 - DNA, 25 bp, Artificial Sequence
  Synthetic
ccagaattcaaugctttctcagcut

SEQ ID NO: 78273 - DNA, 25 bp, Artificial Sequence
  Synthetic
tgctcccaaaauactacaaggtguc

SEQ ID NO: 78274 - DNA, 21 bp, Artificial Sequence
  Synthetic
tgtgcucatcgcuggaagaac

SEQ ID NO: 78275 - DNA, 26 bp, Artificial Sequence
  Synthetic
gggatgaggaaaaaucaatccaugct

SEQ ID NO: 78276 - DNA, 27 bp, Artificial Sequence
  Synthetic
cutccctatagatuacacaaccagcat

SEQ ID NO: 78277 - DNA, 22 bp, Artificial Sequence
  Synthetic
ccagagacugagtttguaggca

SEQ ID NO: 78278 - DNA, 20 bp, Artificial Sequence
  Synthetic
gattcucgccgcctgaguat

SEQ ID NO: 78279 - DNA, 22 bp, Artificial Sequence
  Synthetic
cattggtuttccgttugcaacc

SEQ ID NO: 78280 - DNA, 23 bp, Artificial Sequence
  Synthetic
ttuagggcaaaacactuccacct

SEQ ID NO: 78281 - DNA, 23 bp, Artificial Sequence
  Synthetic
gcactttggucttctctccctut

SEQ ID NO: 78282 - DNA, 28 bp, Artificial Sequence
  Synthetic
tggttttgtcauactttgacctttguct

SEQ ID NO: 78283 - DNA, 26 bp, Artificial Sequence
  Synthetic
gccaagacttguctgaagctgatuaa

SEQ ID NO: 78284 - DNA, 20 bp, Artificial Sequence
  Synthetic
gccaacagcugactcaucac

SEQ ID NO: 78285 - DNA, 25 bp, Artificial Sequence
  Synthetic
gutcttgatgtgcuacagggaacat

SEQ ID NO: 78286 - DNA, 18 bp, Artificial Sequence
  Synthetic
agcgggtugtgcagcaua

SEQ ID NO: 78287 - DNA, 18 bp, Artificial Sequence
  Synthetic
tgccggagcutctgctug

SEQ ID NO: 78288 - DNA, 21 bp, Artificial Sequence
  Synthetic
ggtgtccaagagcucctctut

SEQ ID NO: 78289 - DNA, 28 bp, Artificial Sequence
  Synthetic
aaaggagccgautttactaacatucagt

SEQ ID NO: 78290 - DNA, 21 bp, Artificial Sequence
  Synthetic
ggaaacgcacagucaaaguga

SEQ ID NO: 78291 - DNA, 22 bp, Artificial Sequence
  Synthetic
cactggaccauctcctggatut

SEQ ID NO: 78292 - DNA, 19 bp, Artificial Sequence
  Synthetic
cccugaccggagtaaccut

SEQ ID NO: 78293 - DNA, 22 bp, Artificial Sequence
  Synthetic
tgttuccagacaagccacucac

SEQ ID NO: 78294 - DNA, 24 bp, Artificial Sequence
  Synthetic
tgggactaaccaauggtggtgaua

SEQ ID NO: 78295 - DNA, 21 bp, Artificial Sequence
  Synthetic
gggccaccaacucccatatug

SEQ ID NO: 78296 - DNA, 22 bp, Artificial Sequence
  Synthetic
ctttggccaauggaccctttuc

SEQ ID NO: 78297 - DNA, 21 bp, Artificial Sequence
  Synthetic
gtagagugagtgcgttucgct

SEQ ID NO: 78298 - DNA, 21 bp, Artificial Sequence
  Synthetic
ggtgccgutctgccuaaacat

SEQ ID NO: 78299 - DNA, 20 bp, Artificial Sequence
  Synthetic
ccagtuggtgtcgtuggagt

SEQ ID NO: 78300 - DNA, 25 bp, Artificial Sequence
  Synthetic
gggatgacagauttcatgcttucct

SEQ ID NO: 78301 - DNA, 20 bp, Artificial Sequence
  Synthetic
gaggtcuccaggagtgggua

SEQ ID NO: 78302 - DNA, 23 bp, Artificial Sequence
  Synthetic
cgatctgguagttccccuaacct

SEQ ID NO: 78303 - DNA, 22 bp, Artificial Sequence
  Synthetic
catgtugggagaagucaagcct

SEQ ID NO: 78304 - DNA, 23 bp, Artificial Sequence
  Synthetic
acagaaccaauttcagcctcuga

SEQ ID NO: 78305 - DNA, 22 bp, Artificial Sequence
  Synthetic
ggccatcuggaagcattaggut

SEQ ID NO: 78306 - DNA, 24 bp, Artificial Sequence
  Synthetic
tggaagtaauggaaacgtgcctua

SEQ ID NO: 78307 - DNA, 29 bp, Artificial Sequence
  Synthetic
aaaacauttatgugaaaagccaacaagga

SEQ ID NO: 78308 - DNA, 21 bp, Artificial Sequence
  Synthetic
gtcccgucagaagagaugagg

SEQ ID NO: 78309 - DNA, 20 bp, Artificial Sequence
  Synthetic
ctgtggtcugaggcctagug

SEQ ID NO: 78310 - DNA, 26 bp, Artificial Sequence
  Synthetic
atcagaaucttccaguacaggacaga

SEQ ID NO: 78311 - DNA, 27 bp, Artificial Sequence
  Synthetic
accataggatcutactccatagagugg

SEQ ID NO: 78312 - DNA, 21 bp, Artificial Sequence
  Synthetic
aaggcugacucccaaagacac

SEQ ID NO: 78313 - DNA, 23 bp, Artificial Sequence
  Synthetic
gatcagacaccaggaaugcctua

SEQ ID NO: 78314 - DNA, 22 bp, Artificial Sequence
  Synthetic
tggucaaaagcccaaugacaca

SEQ ID NO: 78315 - DNA, 19 bp, Artificial Sequence
  Synthetic
ccaggautcaugcccgcat

SEQ ID NO: 78316 - DNA, 26 bp, Artificial Sequence
  Synthetic
cactttggauctcaaattgugcacat

SEQ ID NO: 78317 - DNA, 26 bp, Artificial Sequence
  Synthetic
agaaaaucgccgaaagtuaccaaaac

SEQ ID NO: 78318 - DNA, 24 bp, Artificial Sequence
  Synthetic
ccgtgcacgutctaacatgtttut

SEQ ID NO: 78319 - DNA, 21 bp, Artificial Sequence
  Synthetic
cttaagtcaucggccccaucc

SEQ ID NO: 78320 - DNA, 26 bp, Artificial Sequence
  Synthetic
ccacaggtattugtagcagagttuca

SEQ ID NO: 78321 - DNA, 27 bp, Artificial Sequence
  Synthetic
ccaatatggtaugaccaacatggctua

SEQ ID NO: 78322 - DNA, 22 bp, Artificial Sequence
  Synthetic
cctccccgutatggacgtgaua

SEQ ID NO: 78323 - DNA, 23 bp, Artificial Sequence
  Synthetic
cuaaggatcaucccaggacagga

SEQ ID NO: 78324 - DNA, 24 bp, Artificial Sequence
  Synthetic
gtgtcgtaucagcaggaaatctuc

SEQ ID NO: 78325 - DNA, 29 bp, Artificial Sequence
  Synthetic
ggctgtcttugcatgtttcatatttugat

SEQ ID NO: 78326 - DNA, 27 bp, Artificial Sequence
  Synthetic
gcagtatcuaaccagaactctctctuc

SEQ ID NO: 78327 - DNA, 19 bp, Artificial Sequence
  Synthetic
gcagggcugucaaccagac

SEQ ID NO: 78328 - DNA, 19 bp, Artificial Sequence
  Synthetic
cctcgauggccgcuagaat

SEQ ID NO: 78329 - DNA, 24 bp, Artificial Sequence
  Synthetic
cagcatcuacaaaggcaagaagug

SEQ ID NO: 78330 - DNA, 23 bp, Artificial Sequence
  Synthetic
tgaactucaaaaaccccctcucc

SEQ ID NO: 78331 - DNA, 20 bp, Artificial Sequence
  Synthetic
ggcactuggcctgacuacac

SEQ ID NO: 78332 - DNA, 23 bp, Artificial Sequence
  Synthetic
catgggaaugaacacagggauga

SEQ ID NO: 78333 - DNA, 22 bp, Artificial Sequence
  Synthetic
tcagtaagtugccagcactucc

SEQ ID NO: 78334 - DNA, 25 bp, Artificial Sequence
  Synthetic
aggtgtgtttutgatgagtcaucca

SEQ ID NO: 78335 - DNA, 28 bp, Artificial Sequence
  Synthetic
ctggctgaatucaaaggtgaaattgtua

SEQ ID NO: 78336 - DNA, 30 bp, Artificial Sequence
  Synthetic
gtatgaaatgtaaauttcatggtgctguga

SEQ ID NO: 78337 - DNA, 21 bp, Artificial Sequence
  Synthetic
tctgcgctuggtgaactctut

SEQ ID NO: 78338 - DNA, 24 bp, Artificial Sequence
  Synthetic
gcaggcttttaugtctgtcgagut

SEQ ID NO: 78339 - DNA, 22 bp, Artificial Sequence
  Synthetic
gggaatccccaucccaacatuc

SEQ ID NO: 78340 - DNA, 26 bp, Artificial Sequence
  Synthetic
agatattgaguctgaggactucagca

SEQ ID NO: 78341 - DNA, 24 bp, Artificial Sequence
  Synthetic
gttgcatattucacctctggcaut

SEQ ID NO: 78342 - DNA, 20 bp, Artificial Sequence
  Synthetic
atgucaaaccccacgtccuc

SEQ ID NO: 78343 - DNA, 22 bp, Artificial Sequence
  Synthetic
agagaccagutgtcaccucagt

SEQ ID NO: 78344 - DNA, 23 bp, Artificial Sequence
  Synthetic
gtgaaaucgaagcaggacuccat

SEQ ID NO: 78345 - DNA, 23 bp, Artificial Sequence
  Synthetic
cccttcgtuccttgggatcaaut

SEQ ID NO: 78346 - DNA, 28 bp, Artificial Sequence
  Synthetic
ggtaccagggauaaagatacatguggat

SEQ ID NO: 78347 - DNA, 25 bp, Artificial Sequence
  Synthetic
gaaaaatguccagatggctuacagg

SEQ ID NO: 78348 - DNA, 27 bp, Artificial Sequence
  Synthetic
gataacuaggaaaggattugagcgaca

SEQ ID NO: 78349 - DNA, 26 bp, Artificial Sequence
  Synthetic
tcactgtggauggagaatgatgttut

SEQ ID NO: 78350 - DNA, 26 bp, Artificial Sequence
  Synthetic
ccccctattctautcctttcctccut

SEQ ID NO: 78351 - DNA, 24 bp, Artificial Sequence
  Synthetic
ttgcctaguacatgtccauccaac

SEQ ID NO: 78352 - DNA, 24 bp, Artificial Sequence
  Synthetic
tgaugctaatttcuccaaccaaca

SEQ ID NO: 78353 - DNA, 28 bp, Artificial Sequence
  Synthetic
cugaaaacttuggaagacagaaccaaat

SEQ ID NO: 78354 - DNA, 21 bp, Artificial Sequence
  Synthetic
cacgctggaaucctcgtttuc

SEQ ID NO: 78355 - DNA, 23 bp, Artificial Sequence
  Synthetic
gttttattucggaggctugcagt

SEQ ID NO: 78356 - DNA, 19 bp, Artificial Sequence
  Synthetic
gggacaccaacccgucuac

SEQ ID NO: 78357 - DNA, 23 bp, Artificial Sequence
  Synthetic
ggcttatgggcutttactccuca

SEQ ID NO: 78358 - DNA, 27 bp, Artificial Sequence
  Synthetic
gcatacttgaaaaugaaactgttugcc

SEQ ID NO: 78359 - DNA, 25 bp, Artificial Sequence
  Synthetic
attccagaggaaaugacaccactut

SEQ ID NO: 78360 - DNA, 27 bp, Artificial Sequence
  Synthetic
ctgagtctuacccaaaagatggagaua

SEQ ID NO: 78361 - DNA, 28 bp, Artificial Sequence
  Synthetic
ctgtgccatcucattgtctctuaaaaag

SEQ ID NO: 78362 - DNA, 21 bp, Artificial Sequence
  Synthetic
gcaccgacutgcttgtagcut

SEQ ID NO: 78363 - DNA, 24 bp, Artificial Sequence
  Synthetic
gttacagcaccaucagtagguaca

SEQ ID NO: 78364 - DNA, 19 bp, Artificial Sequence
  Synthetic
tggctccucgatgcccuaa

SEQ ID NO: 78365 - DNA, 27 bp, Artificial Sequence
  Synthetic
ggaaacttgggugattcttgtgttuat

SEQ ID NO: 78366 - DNA, 24 bp, Artificial Sequence
  Synthetic
gcaaatgtgcaauaccaacatguc

SEQ ID NO: 78367 - DNA, 28 bp, Artificial Sequence
  Synthetic
gccatgcuacaattgaggtauacgaaat

SEQ ID NO: 78368 - DNA, 23 bp, Artificial Sequence
  Synthetic
cauagagagcaaaggucagccaa

SEQ ID NO: 78369 - DNA, 24 bp, Artificial Sequence
  Synthetic
ccatctcacacuatgccatgauga

SEQ ID NO: 78370 - DNA, 22 bp, Artificial Sequence
  Synthetic
ggaguctggauggaaggacaaa

SEQ ID NO: 78371 - DNA, 26 bp, Artificial Sequence
  Synthetic
tgaatccttgtcutctacccctguag

SEQ ID NO: 78372 - DNA, 18 bp, Artificial Sequence
  Synthetic
tggcggugaaggctugag

SEQ ID NO: 78373 - DNA, 18 bp, Artificial Sequence
  Synthetic
cgctcucccggaugagga

SEQ ID NO: 78374 - DNA, 18 bp, Artificial Sequence
  Synthetic
ggaacacucacggcucct

SEQ ID NO: 78375 - DNA, 17 bp, Artificial Sequence
  Synthetic
cgacucaccccgtguct

SEQ ID NO: 78376 - DNA, 22 bp, Artificial Sequence
  Synthetic
cccatctgutggtgcttttuct

SEQ ID NO: 78377 - DNA, 20 bp, Artificial Sequence
  Synthetic
ggtcccguctgtgtccctua

SEQ ID NO: 78378 - DNA, 24 bp, Artificial Sequence
  Synthetic
cctcgcutgtatcuccgaaagaat

SEQ ID NO: 78379 - DNA, 27 bp, Artificial Sequence
  Synthetic
cgagtagaaaagautaaagggaacgug

SEQ ID NO: 78380 - DNA, 27 bp, Artificial Sequence
  Synthetic
aagcttctgtaugtttgggaaaugaga

SEQ ID NO: 78381 - DNA, 22 bp, Artificial Sequence
  Synthetic
gctcttgctucagactctgugg

SEQ ID NO: 78382 - DNA, 23 bp, Artificial Sequence
  Synthetic
cactgcuccagaaaccttctuct

SEQ ID NO: 78383 - DNA, 21 bp, Artificial Sequence
  Synthetic
cccagagcutgttgtcuccac

SEQ ID NO: 78384 - DNA, 22 bp, Artificial Sequence
  Synthetic
acgtgcacagcgugtattttuc

SEQ ID NO: 78385 - DNA, 28 bp, Artificial Sequence
  Synthetic
aactctcctcuacagaatttcuggaaac

SEQ ID NO: 78386 - DNA, 22 bp, Artificial Sequence
  Synthetic
agttctggcaacugcatctuct

SEQ ID NO: 78387 - DNA, 21 bp, Artificial Sequence
  Synthetic
ggtttctcccccutgctccua

SEQ ID NO: 78388 - DNA, 26 bp, Artificial Sequence
  Synthetic
gatcaaggtugagcttgttgattugg

SEQ ID NO: 78389 - DNA, 26 bp, Artificial Sequence
  Synthetic
agctctgtttaguctctggctctuaa

SEQ ID NO: 78390 - DNA, 23 bp, Artificial Sequence
  Synthetic
ccaggtgtucatctctcctcuct

SEQ ID NO: 78391 - DNA, 21 bp, Artificial Sequence
  Synthetic
accacttcutccttcgtucgg

SEQ ID NO: 78392 - DNA, 28 bp, Artificial Sequence
  Synthetic
caacaggagaaagaagaugctaaacgua

SEQ ID NO: 78393 - DNA, 27 bp, Artificial Sequence
  Synthetic
ctgggttttuccttttgccttaucaag

SEQ ID NO: 78394 - DNA, 20 bp, Artificial Sequence
  Synthetic
gtgaccgccagauctgtgut

SEQ ID NO: 78395 - DNA, 27 bp, Artificial Sequence
  Synthetic
cgacaaattcatuacaaatggctguca

SEQ ID NO: 78396 - DNA, 21 bp, Artificial Sequence
  Synthetic
ctgagatgguaacacccguga

SEQ ID NO: 78397 - DNA, 22 bp, Artificial Sequence
  Synthetic
tcgacttcauactggccaagug

SEQ ID NO: 78398 - DNA, 25 bp, Artificial Sequence
  Synthetic
gtagtgugacgacattgagtttugg

SEQ ID NO: 78399 - DNA, 29 bp, Artificial Sequence
  Synthetic
ctaactgctcugatactgactcatucaaa

SEQ ID NO: 78400 - DNA, 24 bp, Artificial Sequence
  Synthetic
ccaccgtgguccagatatauagca

SEQ ID NO: 78401 - DNA, 22 bp, Artificial Sequence
  Synthetic
ctgugcaaccttttucacccat

SEQ ID NO: 78402 - DNA, 28 bp, Artificial Sequence
  Synthetic
agcacaccacagugtaaatattttucag

SEQ ID NO: 78403 - DNA, 23 bp, Artificial Sequence
  Synthetic
tgtgcgagaautgcttgaaaugg

SEQ ID NO: 78404 - DNA, 21 bp, Artificial Sequence
  Synthetic
tgagtgguccctgggagatut

SEQ ID NO: 78405 - DNA, 23 bp, Artificial Sequence
  Synthetic
ctaagcctucattgctcuagcct

SEQ ID NO: 78406 - DNA, 25 bp, Artificial Sequence
  Synthetic
tgccatggagaaagaauttgagcua

SEQ ID NO: 78407 - DNA, 23 bp, Artificial Sequence
  Synthetic
agatgattcugagaggcagguct

SEQ ID NO: 78408 - DNA, 27 bp, Artificial Sequence
  Synthetic
cttacctaaattuggcagtttctggut

SEQ ID NO: 78409 - DNA, 26 bp, Artificial Sequence
  Synthetic
ggtattgtuggctcccttuagaaaga

SEQ ID NO: 78410 - DNA, 25 bp, Artificial Sequence
  Synthetic
accagagcagaggucaaaatuaagg

SEQ ID NO: 78411 - DNA, 25 bp, Artificial Sequence
  Synthetic
tctactagtugtgggtccucacaaa

SEQ ID NO: 78412 - DNA, 24 bp, Artificial Sequence
  Synthetic
gttccattucaagcaattcucgca

SEQ ID NO: 78413 - DNA, 21 bp, Artificial Sequence
  Synthetic
cccatgaugcggccactaaua

SEQ ID NO: 78414 - DNA, 22 bp, Artificial Sequence
  Synthetic
gcccttctacaugtcccactug

SEQ ID NO: 78415 - DNA, 26 bp, Artificial Sequence
  Synthetic
tcttggttgcutgataggtagguact

SEQ ID NO: 78416 - DNA, 21 bp, Artificial Sequence
  Synthetic
cccctgacuccgtccagtaut

SEQ ID NO: 78417 - DNA, 19 bp, Artificial Sequence
  Synthetic
cgagacacgcccutaccut

SEQ ID NO: 78418 - DNA, 24 bp, Artificial Sequence
  Synthetic
gaatacaugcggtggattttuggg

SEQ ID NO: 78419 - DNA, 23 bp, Artificial Sequence
  Synthetic
ttccttcacugagttcugcgaat

SEQ ID NO: 78420 - DNA, 25 bp, Artificial Sequence
  Synthetic
gcaattgcaucaaagcaacaaauac

SEQ ID NO: 78421 - DNA, 27 bp, Artificial Sequence
  Synthetic
ggctcctcuaaccatgtttacaacuat

SEQ ID NO: 78422 - DNA, 29 bp, Artificial Sequence
  Synthetic
gtttcagatacuacagatgacttgtggut

SEQ ID NO: 78423 - DNA, 28 bp, Artificial Sequence
  Synthetic
gcacacaaacagaaucaacatggaatut

SEQ ID NO: 78424 - DNA, 27 bp, Artificial Sequence
  Synthetic
tgtctctcttcucttacccttttucct

SEQ ID NO: 78425 - DNA, 27 bp, Artificial Sequence
  Synthetic
ccctggaaacaccucaagattttcuac

SEQ ID NO: 78426 - DNA, 22 bp, Artificial Sequence
  Synthetic
gagccaaaaaccagugctucag

SEQ ID NO: 78427 - DNA, 27 bp, Artificial Sequence
  Synthetic
cgtcttagttuccttcttttctuccca

SEQ ID NO: 78428 - DNA, 22 bp, Artificial Sequence
  Synthetic
cagcctgtguctgctgaagtua

SEQ ID NO: 78429 - DNA, 28 bp, Artificial Sequence
  Synthetic
ccatgaactccuggagaataatccuaag

SEQ ID NO: 78430 - DNA, 21 bp, Artificial Sequence
  Synthetic
ccgtggatgaucacagggtug

SEQ ID NO: 78431 - DNA, 26 bp, Artificial Sequence
  Synthetic
ccacaggtaguagggaagaatguact

SEQ ID NO: 78432 - DNA, 29 bp, Artificial Sequence
  Synthetic
acactttccttgugctatcaatttacuca

SEQ ID NO: 78433 - DNA, 28 bp, Artificial Sequence
  Synthetic
gttgaggatactuctgcagattcgauat

SEQ ID NO: 78434 - DNA, 25 bp, Artificial Sequence
  Synthetic
acccacuatgaaugagcagaaaacc

SEQ ID NO: 78435 - DNA, 24 bp, Artificial Sequence
  Synthetic
cctgtgtgaggaugagctcttuac

SEQ ID NO: 78436 - DNA, 27 bp, Artificial Sequence
  Synthetic
ccacaggaatgucttcccattttacua

SEQ ID NO: 78437 - DNA, 28 bp, Artificial Sequence
  Synthetic
ctgtattcauacactccccttuagcaat

SEQ ID NO: 78438 - DNA, 26 bp, Artificial Sequence
  Synthetic
ctacagttaccutcccttttctcugg

SEQ ID NO: 78439 - DNA, 23 bp, Artificial Sequence
  Synthetic
acacgtcctguttccttgttcug

SEQ ID NO: 78440 - DNA, 22 bp, Artificial Sequence
  Synthetic
tggacttgugcaaatgccuagt

SEQ ID NO: 78441 - DNA, 28 bp, Artificial Sequence
  Synthetic
ggacatttauccaacaaaatgctacugt

SEQ ID NO: 78442 - DNA, 28 bp, Artificial Sequence
  Synthetic
tttccaggaatcuaggtaaaaatggcut

SEQ ID NO: 78443 - DNA, 28 bp, Artificial Sequence
  Synthetic
acgtaaatactaggugtaggtggatuca

SEQ ID NO: 78444 - DNA, 23 bp, Artificial Sequence
  Synthetic
ggtgcaauttaggauacccccaa

SEQ ID NO: 78445 - DNA, 22 bp, Artificial Sequence
  Synthetic
cgtagcaagaugcgtgatguca

SEQ ID NO: 78446 - DNA, 21 bp, Artificial Sequence
  Synthetic
cuccctugccaaaggacaagt

SEQ ID NO: 78447 - DNA, 27 bp, Artificial Sequence
  Synthetic
aatgtttccuaaagggcatccatguaa

SEQ ID NO: 78448 - DNA, 27 bp, Artificial Sequence
  Synthetic
gatggaacaacugatgtcttacttgug

SEQ ID NO: 78449 - DNA, 24 bp, Artificial Sequence
  Synthetic
aaatatgtgcaccutccctcctut

SEQ ID NO: 78450 - DNA, 26 bp, Artificial Sequence
  Synthetic
gggtcagctuaaggtaagaaactgua

SEQ ID NO: 78451 - DNA, 23 bp, Artificial Sequence
  Synthetic
ctggaggcagautttccaaacug

SEQ ID NO: 78452 - DNA, 26 bp, Artificial Sequence
  Synthetic
tcatagcucagctgtaagaaaugcaa

SEQ ID NO: 78453 - DNA, 20 bp, Artificial Sequence
  Synthetic
ctaccaguacggcaccacuc

SEQ ID NO: 78454 - DNA, 22 bp, Artificial Sequence
  Synthetic
cctccgauaagctcctccagua

SEQ ID NO: 78455 - DNA, 23 bp, Artificial Sequence
  Synthetic
tttatggcuggtgtctgacucac

SEQ ID NO: 78456 - DNA, 28 bp, Artificial Sequence
  Synthetic
gtctggatucacattaactctaugacca

SEQ ID NO: 78457 - DNA, 23 bp, Artificial Sequence
  Synthetic
acttcgcugaattgacccaugaa

SEQ ID NO: 78458 - DNA, 22 bp, Artificial Sequence
  Synthetic
gcuatgaucaaccaggcaacag

SEQ ID NO: 78459 - DNA, 28 bp, Artificial Sequence
  Synthetic
tgcccatctgucttgattcacatauaag

SEQ ID NO: 78460 - DNA, 22 bp, Artificial Sequence
  Synthetic
ccagttcaugcaacagagagug

SEQ ID NO: 78461 - DNA, 27 bp, Artificial Sequence
  Synthetic
acaaaacaccuagcaaatggaaaaugg

SEQ ID NO: 78462 - DNA, 24 bp, Artificial Sequence
  Synthetic
catagaccguacatgtcagcgtut

SEQ ID NO: 78463 - DNA, 28 bp, Artificial Sequence
  Synthetic
agctgactgacaautcaaaagttgttut

SEQ ID NO: 78464 - DNA, 20 bp, Artificial Sequence
  Synthetic
ctttgcagcgcgutgactua

SEQ ID NO: 78465 - DNA, 25 bp, Artificial Sequence
  Synthetic
acagctactcucagaaagcactuac

SEQ ID NO: 78466 - DNA, 32 bp, Artificial Sequence
  Synthetic
atgactgaaactttutaagattagagggtuga

SEQ ID NO: 78467 - DNA, 28 bp, Artificial Sequence
  Synthetic
ggaccaacccaaguattaagagtgtuat

SEQ ID NO: 78468 - DNA, 28 bp, Artificial Sequence
  Synthetic
aggcatctttggucctatattgaatgut

SEQ ID NO: 78469 - DNA, 19 bp, Artificial Sequence
  Synthetic
aagcccaauccgccacaua

SEQ ID NO: 78470 - DNA, 21 bp, Artificial Sequence
  Synthetic
gctgtaugcctggcauccaat

SEQ ID NO: 78471 - DNA, 24 bp, Artificial Sequence
  Synthetic
cttgtactgccaguaggactguag

SEQ ID NO: 78472 - DNA, 25 bp, Artificial Sequence
  Synthetic
accatgaaguaccaagtttcacugt

SEQ ID NO: 78473 - DNA, 19 bp, Artificial Sequence
  Synthetic
tgaaagaugccgccgugat

SEQ ID NO: 78474 - DNA, 25 bp, Artificial Sequence
  Synthetic
atgctccagtautagtgttcgcaut

SEQ ID NO: 78475 - DNA, 20 bp, Artificial Sequence
  Synthetic
catgaccccugcttccucac

SEQ ID NO: 78476 - DNA, 27 bp, Artificial Sequence
  Synthetic
actggtggttugtcttgaaaagauaca

SEQ ID NO: 78477 - DNA, 24 bp, Artificial Sequence
  Synthetic
aggtggacaaaacugagagctuag

SEQ ID NO: 78478 - DNA, 23 bp, Artificial Sequence
  Synthetic
gcaguccaaagaaaggacccaut

SEQ ID NO: 78479 - DNA, 27 bp, Artificial Sequence
  Synthetic
ttttcccttttguagtaagctgtgcua

SEQ ID NO: 78480 - DNA, 26 bp, Artificial Sequence
  Synthetic
aagtgcttcutctaattccaucagca

SEQ ID NO: 78481 - DNA, 28 bp, Artificial Sequence
  Synthetic
actgcagtattgauaccttttgtttcut

SEQ ID NO: 78482 - DNA, 25 bp, Artificial Sequence
  Synthetic
tggatacaagcugattctcccauct

SEQ ID NO: 78483 - DNA, 27 bp, Artificial Sequence
  Synthetic
ggttacttaactugttttcagcagucc

SEQ ID NO: 78484 - DNA, 28 bp, Artificial Sequence
  Synthetic
ggaacacctccacutacaaaagaagaua

SEQ ID NO: 78485 - DNA, 23 bp, Artificial Sequence
  Synthetic
ttttgcccuctgtaagagtugct

SEQ ID NO: 78486 - DNA, 25 bp, Artificial Sequence
  Synthetic
ggacctcatcauggtaggttttugt

SEQ ID NO: 78487 - DNA, 25 bp, Artificial Sequence
  Synthetic
gctgucagaacttgctucagagaaa

SEQ ID NO: 78488 - DNA, 21 bp, Artificial Sequence
  Synthetic
gaattgctgguctcagctguc

SEQ ID NO: 78489 - DNA, 23 bp, Artificial Sequence
  Synthetic
acccatgugcatgaguacaaact

SEQ ID NO: 78490 - DNA, 22 bp, Artificial Sequence
  Synthetic
caccccatccutagtccaacug

SEQ ID NO: 78491 - DNA, 23 bp, Artificial Sequence
  Synthetic
ccatctgtcuccgtcttctcuct

SEQ ID NO: 78492 - DNA, 22 bp, Artificial Sequence
  Synthetic
gccctugaaaaagagcugcaga

SEQ ID NO: 78493 - DNA, 27 bp, Artificial Sequence
  Synthetic
aagactaccuaagaacaagctcucaga

SEQ ID NO: 78494 - DNA, 24 bp, Artificial Sequence
  Synthetic
tccgggtuccattaaaagttguga

SEQ ID NO: 78495 - DNA, 25 bp, Artificial Sequence
  Synthetic
acacactgtguaaaacctcctuacc

SEQ ID NO: 78496 - DNA, 27 bp, Artificial Sequence
  Synthetic
ccaacagagggaaacuaatagttguct

SEQ ID NO: 78497 - DNA, 26 bp, Artificial Sequence
  Synthetic
gcctcaguacaaactcattagcauca

SEQ ID NO: 78498 - DNA, 26 bp, Artificial Sequence
  Synthetic
tttcaggucagaagcctagactuaga

SEQ ID NO: 78499 - DNA, 25 bp, Artificial Sequence
  Synthetic
ctttcactccuggtccatcaacuac

SEQ ID NO: 78500 - DNA, 23 bp, Artificial Sequence
  Synthetic
aaggacagaugcaaccattgcua

SEQ ID NO: 78501 - DNA, 26 bp, Artificial Sequence
  Synthetic
aacaggcatgaugaactgtcgaauat

SEQ ID NO: 78502 - DNA, 17 bp, Artificial Sequence
  Synthetic
gcccgcugctcacctut

SEQ ID NO: 78503 - DNA, 23 bp, Artificial Sequence
  Synthetic
acgauaattcctuccccaaagcc

SEQ ID NO: 78504 - DNA, 24 bp, Artificial Sequence
  Synthetic
tgacgagcugcaatttggttauga

SEQ ID NO: 78505 - DNA, 29 bp, Artificial Sequence
  Synthetic
actctactggaagautttagaaactcuga

SEQ ID NO: 78506 - DNA, 22 bp, Artificial Sequence
  Synthetic
tttagcugctgagaaucacggt

SEQ ID NO: 78507 - DNA, 25 bp, Artificial Sequence
  Synthetic
tctctccacacutcccacatactua

SEQ ID NO: 78508 - DNA, 25 bp, Artificial Sequence
  Synthetic
agaaaggugaagacacaggucaaaa

SEQ ID NO: 78509 - DNA, 28 bp, Artificial Sequence
  Synthetic
gggcaattttaatuggagggtcataauc

SEQ ID NO: 78510 - DNA, 22 bp, Artificial Sequence
  Synthetic
ggctctgacauctagtgtgugt

SEQ ID NO: 78511 - DNA, 25 bp, Artificial Sequence
  Synthetic
ccatcccccauaaaccaagaactua

SEQ ID NO: 78512 - DNA, 23 bp, Artificial Sequence
  Synthetic
ctgcatacaaggaguaggcagut

SEQ ID NO: 78513 - DNA, 28 bp, Artificial Sequence
  Synthetic
gtctgttttguccatttggtatctcuca

SEQ ID NO: 78514 - DNA, 26 bp, Artificial Sequence
  Synthetic
gctttcttgaggutatcttcacugga

SEQ ID NO: 78515 - DNA, 24 bp, Artificial Sequence
  Synthetic
gcugaccacaaagcacaattuaca

SEQ ID NO: 78516 - DNA, 25 bp, Artificial Sequence
  Synthetic
gtggcttttuaacccatagctgtut

SEQ ID NO: 78517 - DNA, 28 bp, Artificial Sequence
  Synthetic
cagttgccataucactctcacactaaut

SEQ ID NO: 78518 - DNA, 31 bp, Artificial Sequence
  Synthetic
ttagacttctaaaaaugcattagaggtgugt

SEQ ID NO: 78519 - DNA, 26 bp, Artificial Sequence
  Synthetic
gctgaaacugctgttgatgaauaagt

SEQ ID NO: 78520 - DNA, 23 bp, Artificial Sequence
  Synthetic
ctcggcgguttatagaggaugag

SEQ ID NO: 78521 - DNA, 26 bp, Artificial Sequence
  Synthetic
gctactagaucgagaggagtcugaag

SEQ ID NO: 78522 - DNA, 23 bp, Artificial Sequence
  Synthetic
acuttcugaccagcaacgacaaa

SEQ ID NO: 78523 - DNA, 25 bp, Artificial Sequence
  Synthetic
cacaaaggagaaauctguacccaca

SEQ ID NO: 78524 - DNA, 21 bp, Artificial Sequence
  Synthetic
tggccaaaaugaguggacaca

SEQ ID NO: 78525 - DNA, 28 bp, Artificial Sequence
  Synthetic
ggaaactgagagggaauctctttcauaa

SEQ ID NO: 78526 - DNA, 25 bp, Artificial Sequence
  Synthetic
gctgaagttguagcaggaactacua

SEQ ID NO: 78527 - DNA, 28 bp, Artificial Sequence
  Synthetic
caagtagaaagauttgaaacagtuggca

SEQ ID NO: 78528 - DNA, 23 bp, Artificial Sequence
  Synthetic
ctacatacauacacctgguggct

SEQ ID NO: 78529 - DNA, 22 bp, Artificial Sequence
  Synthetic
aaagaaccccacaguccatgut

SEQ ID NO: 78530 - DNA, 28 bp, Artificial Sequence
  Synthetic
tttgttaatgtccutgttgtgcattuat

SEQ ID NO: 78531 - DNA, 24 bp, Artificial Sequence
  Synthetic
tcuggaatauacagggcacaaacc

SEQ ID NO: 78532 - DNA, 20 bp, Artificial Sequence
  Synthetic
tgcaggcagagcugattuct

SEQ ID NO: 78533 - DNA, 31 bp, Artificial Sequence
  Synthetic
aacacattaatcuccataattccuacagcat

SEQ ID NO: 78534 - DNA, 18 bp, Artificial Sequence
  Synthetic
gggcccaugtggtttgug

SEQ ID NO: 78535 - DNA, 27 bp, Artificial Sequence
  Synthetic
acaaaaactucctttctactucccagt

SEQ ID NO: 78536 - DNA, 20 bp, Artificial Sequence
  Synthetic
ggagcgauacccctgaagut

SEQ ID NO: 78537 - DNA, 19 bp, Artificial Sequence
  Synthetic
gagacgaggagguctgcug

SEQ ID NO: 78538 - DNA, 28 bp, Artificial Sequence
  Synthetic
cagtctgtgguaagtaactttuaggcat

SEQ ID NO: 78539 - DNA, 25 bp, Artificial Sequence
  Synthetic
gtggatcugggcaaatgaaaatgut

SEQ ID NO: 78540 - DNA, 24 bp, Artificial Sequence
  Synthetic
cttctcagcacucctctcaaaugt

SEQ ID NO: 78541 - DNA, 21 bp, Artificial Sequence
  Synthetic
ggaaatgggcaguggaggaug

SEQ ID NO: 78542 - DNA, 27 bp, Artificial Sequence
  Synthetic
tggatttggaauatcaggguagaaggt

SEQ ID NO: 78543 - DNA, 31 bp, Artificial Sequence
  Synthetic
attttaatctcagaugtgcattaaaggatuc

SEQ ID NO: 78544 - DNA, 26 bp, Artificial Sequence
  Synthetic
aaggcctgauatgttttaagugggaa

SEQ ID NO: 78545 - DNA, 27 bp, Artificial Sequence
  Synthetic
ggatctgaaacaacautcatgtgugaa

SEQ ID NO: 78546 - DNA, 23 bp, Artificial Sequence
  Synthetic
ccaaaagcauctgcugcagaaac

SEQ ID NO: 78547 - DNA, 28 bp, Artificial Sequence
  Synthetic
gcatgaatccaguccagatattucacat

SEQ ID NO: 78548 - DNA, 26 bp, Artificial Sequence
  Synthetic
cctcagtattcuctctcttcctcuca

SEQ ID NO: 78549 - DNA, 17 bp, Artificial Sequence
  Synthetic
gagcugggaccccucac

SEQ ID NO: 78550 - DNA, 24 bp, Artificial Sequence
  Synthetic
aatggttgctguctcatcagcaua

SEQ ID NO: 78551 - DNA, 27 bp, Artificial Sequence
  Synthetic
caggcctauaagacttcaatugggaat

SEQ ID NO: 78552 - DNA, 28 bp, Artificial Sequence
  Synthetic
aaaagaauaaacaagaccacagacucca

SEQ ID NO: 78553 - DNA, 26 bp, Artificial Sequence
  Synthetic
gaagacttggaucgaattctcacuct

SEQ ID NO: 78554 - DNA, 28 bp, Artificial Sequence
  Synthetic
caugatactaaauaagccaacacaccac

SEQ ID NO: 78555 - DNA, 23 bp, Artificial Sequence
  Synthetic
tcctcatguggctgatgtttuca

SEQ ID NO: 78556 - DNA, 28 bp, Artificial Sequence
  Synthetic
agaagutttggatcuagaacgacgaaaa

SEQ ID NO: 78557 - DNA, 21 bp, Artificial Sequence
  Synthetic
gutggaggcauaagccaaggt

SEQ ID NO: 78558 - DNA, 26 bp, Artificial Sequence
  Synthetic
aggaagttctuacctcattggttgug

SEQ ID NO: 78559 - DNA, 27 bp, Artificial Sequence
  Synthetic
ccacgtacccagugcatatgaaatuaa

SEQ ID NO: 78560 - DNA, 27 bp, Artificial Sequence
  Synthetic
ctcattgactgaugaaacttgcttuga

SEQ ID NO: 78561 - DNA, 22 bp, Artificial Sequence
  Synthetic
catgtagauggcggtgatggua

SEQ ID NO: 78562 - DNA, 19 bp, Artificial Sequence
  Synthetic
ctgttgaccugtcccggua

SEQ ID NO: 78563 - DNA, 22 bp, Artificial Sequence
  Synthetic
agaucttctugcagccagcaaa

SEQ ID NO: 78564 - DNA, 22 bp, Artificial Sequence
  Synthetic
cctccaguatctcugaccacac

SEQ ID NO: 78565 - DNA, 23 bp, Artificial Sequence
  Synthetic
gtggctcugacctagaatgctut

SEQ ID NO: 78566 - DNA, 20 bp, Artificial Sequence
  Synthetic
agtacugttgccugggcaaa

SEQ ID NO: 78567 - DNA, 24 bp, Artificial Sequence
  Synthetic
tccagtattcuaccgtgguacaca

SEQ ID NO: 78568 - DNA, 24 bp, Artificial Sequence
  Synthetic
gacactgtcaucttcccacauacc

SEQ ID NO: 78569 - DNA, 27 bp, Artificial Sequence
  Synthetic
ggaagttaaacaugtcaaatgcugact

SEQ ID NO: 78570 - DNA, 22 bp, Artificial Sequence
  Synthetic
ctgactgcaugtgtggctagua

SEQ ID NO: 78571 - DNA, 26 bp, Artificial Sequence
  Synthetic
tttggaatugacaagacagcaactug

SEQ ID NO: 78572 - DNA, 24 bp, Artificial Sequence
  Synthetic
gttaccagugccaatauccaggag

SEQ ID NO: 78573 - DNA, 23 bp, Artificial Sequence
  Synthetic
catctggatccucaggactcugt

SEQ ID NO: 78574 - DNA, 24 bp, Artificial Sequence
  Synthetic
tgutttaatctttuggccccagga

SEQ ID NO: 78575 - DNA, 22 bp, Artificial Sequence
  Synthetic
ctgctccccacucaagactuac

SEQ ID NO: 78576 - DNA, 25 bp, Artificial Sequence
  Synthetic
aaccgacattuaggtggacttctut

SEQ ID NO: 78577 - DNA, 20 bp, Artificial Sequence
  Synthetic
ccaacgtccucgggagtuag

SEQ ID NO: 78578 - DNA, 25 bp, Artificial Sequence
  Synthetic
caacattttgacugctactgtccug

SEQ ID NO: 78579 - DNA, 24 bp, Artificial Sequence
  Synthetic
cttgttgctgutgttgttgacuct

SEQ ID NO: 78580 - DNA, 21 bp, Artificial Sequence
  Synthetic
acttggacugacggaactugg

SEQ ID NO: 78581 - DNA, 22 bp, Artificial Sequence
  Synthetic
aaggacacagcaguggtatugg

SEQ ID NO: 78582 - DNA, 27 bp, Artificial Sequence
  Synthetic
ttttgtgcagtautaatgcttgctgut

SEQ ID NO: 78583 - DNA, 23 bp, Artificial Sequence
  Synthetic
aaagtccauaagcctacctugcc

SEQ ID NO: 78584 - DNA, 22 bp, Artificial Sequence
  Synthetic
tgataattuccgacccccucca

SEQ ID NO: 78585 - DNA, 26 bp, Artificial Sequence
  Synthetic
tgtgcataucaaaccttgtuccagaa

SEQ ID NO: 78586 - DNA, 23 bp, Artificial Sequence
  Synthetic
aatggctugacagagttguggat

SEQ ID NO: 78587 - DNA, 28 bp, Artificial Sequence
  Synthetic
ggaaaaagcuaatggatggauggaaaag

SEQ ID NO: 78588 - DNA, 22 bp, Artificial Sequence
  Synthetic
ggcttcaugccctattugcaag

SEQ ID NO: 78589 - DNA, 28 bp, Artificial Sequence
  Synthetic
ctaagaacattcuctgacaggtuggaaa

SEQ ID NO: 78590 - DNA, 27 bp, Artificial Sequence
  Synthetic
gttaaacagucaaccgtactaguaaca

SEQ ID NO: 78591 - DNA, 22 bp, Artificial Sequence
  Synthetic
gaggtccgcuctttttcttugg

SEQ ID NO: 78592 - DNA, 25 bp, Artificial Sequence
  Synthetic
ctgagacttugcatggtttcttucc

SEQ ID NO: 78593 - DNA, 28 bp, Artificial Sequence
  Synthetic
aaccatgctgacucaagatttgatagut

SEQ ID NO: 78594 - DNA, 24 bp, Artificial Sequence
  Synthetic
ggaggagtucagaggaagacacut

SEQ ID NO: 78595 - DNA, 24 bp, Artificial Sequence
  Synthetic
ggaccctgauggattacaaggaug

SEQ ID NO: 78596 - DNA, 26 bp, Artificial Sequence
  Synthetic
cttcttctctucagaagttcctucgt

SEQ ID NO: 78597 - DNA, 21 bp, Artificial Sequence
  Synthetic
ccagacgguccatcactucag

SEQ ID NO: 78598 - DNA, 25 bp, Artificial Sequence
  Synthetic
cccagagcaguaacctaaaatgcut

SEQ ID NO: 78599 - DNA, 20 bp, Artificial Sequence
  Synthetic
atgaucacaggcuggcagag

SEQ ID NO: 78600 - DNA, 21 bp, Artificial Sequence
  Synthetic
ctgttugcttggaaugggaca

SEQ ID NO: 78601 - DNA, 20 bp, Artificial Sequence
  Synthetic
gtggtgtuggcagaggcuat

SEQ ID NO: 78602 - DNA, 23 bp, Artificial Sequence
  Synthetic
ctagaacacuacgcaugcaggat

SEQ ID NO: 78603 - DNA, 29 bp, Artificial Sequence
  Synthetic
gagaattgcugatcttcaagguaaaacaa

SEQ ID NO: 78604 - DNA, 21 bp, Artificial Sequence
  Synthetic
gggaaagggucctctgaucat

SEQ ID NO: 78605 - DNA, 24 bp, Artificial Sequence
  Synthetic
ggttgttctugtggaagatgucct

SEQ ID NO: 78606 - DNA, 21 bp, Artificial Sequence
  Synthetic
ggttggguttgtccttgucca

SEQ ID NO: 78607 - DNA, 22 bp, Artificial Sequence
  Synthetic
ggtgccuctcaaggttugaact

SEQ ID NO: 78608 - DNA, 20 bp, Artificial Sequence
  Synthetic
tcgcaagaccaggugguaac

SEQ ID NO: 78609 - DNA, 27 bp, Artificial Sequence
  Synthetic
atttgaaacgggutagagattagugct

SEQ ID NO: 78610 - DNA, 23 bp, Artificial Sequence
  Synthetic
ctaccaggacacgautttgugga

SEQ ID NO: 78611 - DNA, 22 bp, Artificial Sequence
  Synthetic
ggtcaggcugtcugagagaaga

SEQ ID NO: 78612 - DNA, 20 bp, Artificial Sequence
  Synthetic
gggauagcgggactgatguc

SEQ ID NO: 78613 - DNA, 20 bp, Artificial Sequence
  Synthetic
gcuctatgccugccaagacc

SEQ ID NO: 78614 - DNA, 20 bp, Artificial Sequence
  Synthetic
tgcgtatucctgagcugcaa

SEQ ID NO: 78615 - DNA, 21 bp, Artificial Sequence
  Synthetic
cggcaggagguttauggcaat

SEQ ID NO: 78616 - DNA, 23 bp, Artificial Sequence
  Synthetic
ttgaggtguctctccucgaagat

SEQ ID NO: 78617 - DNA, 20 bp, Artificial Sequence
  Synthetic
ggaugagaggcgctgctuac

SEQ ID NO: 78618 - DNA, 27 bp, Artificial Sequence
  Synthetic
tcaactcaagagucaaaagaaacugga

SEQ ID NO: 78619 - DNA, 25 bp, Artificial Sequence
  Synthetic
gttctcattcugtgtcttcccugaa

SEQ ID NO: 78620 - DNA, 18 bp, Artificial Sequence
  Synthetic
gcccuagcctcucccact

SEQ ID NO: 78621 - DNA, 18 bp, Artificial Sequence
  Synthetic
tgcccagucctgcugaga

SEQ ID NO: 78622 - DNA, 18 bp, Artificial Sequence
  Synthetic
ggcccggagaguggaaug

SEQ ID NO: 78623 - DNA, 19 bp, Artificial Sequence
  Synthetic
ccaaaagugaccgcucgct

SEQ ID NO: 78624 - DNA, 23 bp, Artificial Sequence
  Synthetic
gcaccacugagaacaagggatut

SEQ ID NO: 78625 - DNA, 21 bp, Artificial Sequence
  Synthetic
gctggtgcuggactttgaugt

SEQ ID NO: 78626 - DNA, 25 bp, Artificial Sequence
  Synthetic
actggaagaauacgacacucaggat

SEQ ID NO: 78627 - DNA, 25 bp, Artificial Sequence
  Synthetic
gtggaatuccccatgaacatucaaa

SEQ ID NO: 78628 - DNA, 27 bp, Artificial Sequence
  Synthetic
catcttttctgcucttcacttcatguc

SEQ ID NO: 78629 - DNA, 24 bp, Artificial Sequence
  Synthetic
cgaaaccuagtcacatuggagagt

SEQ ID NO: 78630 - DNA, 22 bp, Artificial Sequence
  Synthetic
ctggcaggaggguaagaatgug

SEQ ID NO: 78631 - DNA, 20 bp, Artificial Sequence
  Synthetic
gggacttucagcgggagaut

SEQ ID NO: 78632 - DNA, 28 bp, Artificial Sequence
  Synthetic
aatgtctaaattgaaugtgtcctccugt

SEQ ID NO: 78633 - DNA, 26 bp, Artificial Sequence
  Synthetic
ccatccaagacaaugacaacauccat

SEQ ID NO: 78634 - DNA, 28 bp, Artificial Sequence
  Synthetic
tgttcagtgtgucaaacagtattctuga

SEQ ID NO: 78635 - DNA, 26 bp, Artificial Sequence
  Synthetic
catagacaatgggaucttcacgguaa

SEQ ID NO: 78636 - DNA, 20 bp, Artificial Sequence
  Synthetic
gtgtuggccagcgttcatuc

SEQ ID NO: 78637 - DNA, 20 bp, Artificial Sequence
  Synthetic
actccugtgttguggcaacc

SEQ ID NO: 78638 - DNA, 23 bp, Artificial Sequence
  Synthetic
aaccgagagacaagcauctucag

SEQ ID NO: 78639 - DNA, 28 bp, Artificial Sequence
  Synthetic
ccagagataaaacugcaattcctctuga

SEQ ID NO: 78640 - DNA, 27 bp, Artificial Sequence
  Synthetic
tttcttccagtcutactaggagctuct

SEQ ID NO: 78641 - DNA, 23 bp, Artificial Sequence
  Synthetic
ccaaatctccaggucgctgaaua

SEQ ID NO: 78642 - DNA, 27 bp, Artificial Sequence
  Synthetic
tgaagcaaatgtuccagtgtataggut

SEQ ID NO: 78643 - DNA, 25 bp, Artificial Sequence
  Synthetic
cctgtaaguggaccaacatuccaag

SEQ ID NO: 78644 - DNA, 23 bp, Artificial Sequence
  Synthetic
ctattggctggugcaacaacaut

SEQ ID NO: 78645 - DNA, 28 bp, Artificial Sequence
  Synthetic
attctatgcaaggagucattcttctuac

SEQ ID NO: 78646 - DNA, 20 bp, Artificial Sequence
  Synthetic
cuctgauccgccacacaact

SEQ ID NO: 78647 - DNA, 26 bp, Artificial Sequence
  Synthetic
tgtgaccugtttacagtucaacaaga

SEQ ID NO: 78648 - DNA, 21 bp, Artificial Sequence
  Synthetic
tgtgcagugctttgaggauct

SEQ ID NO: 78649 - DNA, 20 bp, Artificial Sequence
  Synthetic
gacatcagucccgctauccc

SEQ ID NO: 78650 - DNA, 28 bp, Artificial Sequence
  Synthetic
ccatcatcugagctggtaatuacaaagt

SEQ ID NO: 78651 - DNA, 33 bp, Artificial Sequence
  Synthetic
aactaactcatagccautatttctaaccaguaa

SEQ ID NO: 78652 - DNA, 22 bp, Artificial Sequence
  Synthetic
ccttctaggcugcccaacauac

SEQ ID NO: 78653 - DNA, 25 bp, Artificial Sequence
  Synthetic
cccagctcauattgccttctctuac

SEQ ID NO: 78654 - DNA, 29 bp, Artificial Sequence
  Synthetic
ctcacgattatttuggtcaacttgaaugt

SEQ ID NO: 78655 - DNA, 22 bp, Artificial Sequence
  Synthetic
gguctucaaaggcaccagaaaa

SEQ ID NO: 78656 - DNA, 31 bp, Artificial Sequence
  Synthetic
aaggtcacaaatuttgcttatattctuaggt

SEQ ID NO: 78657 - DNA, 23 bp, Artificial Sequence
  Synthetic
catatgagauggtgcctgacuga

SEQ ID NO: 78658 - DNA, 22 bp, Artificial Sequence
  Synthetic
tcutctctcagucaggcaccat

SEQ ID NO: 78659 - DNA, 29 bp, Artificial Sequence
  Synthetic
gtaggtgagaguagggttttagagtuagt

SEQ ID NO: 78660 - DNA, 24 bp, Artificial Sequence
  Synthetic
ttgccagttgugctttttgcuaaa

SEQ ID NO: 78661 - DNA, 20 bp, Artificial Sequence
  Synthetic
cagctuggacacggcttuac

SEQ ID NO: 78662 - DNA, 21 bp, Artificial Sequence
  Synthetic
cacagccagugccagaacuaa

SEQ ID NO: 78663 - DNA, 25 bp, Artificial Sequence
  Synthetic
tggtcccgggautatttccagaaua

SEQ ID NO: 78664 - DNA, 26 bp, Artificial Sequence
  Synthetic
aggtcagtcaguactaaagtagucgt

SEQ ID NO: 78665 - DNA, 27 bp, Artificial Sequence
  Synthetic
cctgagaaauggcagagaaacaaauct

SEQ ID NO: 78666 - DNA, 21 bp, Artificial Sequence
  Synthetic
tgccatcccuaatcccguaca

SEQ ID NO: 78667 - DNA, 20 bp, Artificial Sequence
  Synthetic
tcauccccaacctgcugaag

SEQ ID NO: 78668 - DNA, 24 bp, Artificial Sequence
  Synthetic
gcccaccattutcatagtctgcut

SEQ ID NO: 78669 - DNA, 19 bp, Artificial Sequence
  Synthetic
ggtgcaagggucacagugt

SEQ ID NO: 78670 - DNA, 19 bp, Artificial Sequence
  Synthetic
cctttcaccuggcttugct

SEQ ID NO: 78671 - DNA, 20 bp, Artificial Sequence
  Synthetic
acccuacagagaccccacug

SEQ ID NO: 78672 - DNA, 22 bp, Artificial Sequence
  Synthetic
tgctccaguacttgtggacuga

SEQ ID NO: 78673 - DNA, 28 bp, Artificial Sequence
  Synthetic
ctaatgccaggaucactaagtttgauga

SEQ ID NO: 78674 - DNA, 28 bp, Artificial Sequence
  Synthetic
ctgtgacctatuaaaaactgccctguat

SEQ ID NO: 78675 - DNA, 28 bp, Artificial Sequence
  Synthetic
actgttgcttgugatttcatttgtuaca

SEQ ID NO: 78676 - DNA, 26 bp, Artificial Sequence
  Synthetic
cagctgaagauagaaggagtugaaca

SEQ ID NO: 78677 - DNA, 28 bp, Artificial Sequence
  Synthetic
ttctatcagucaagaagucaaccacaag

SEQ ID NO: 78678 - DNA, 24 bp, Artificial Sequence
  Synthetic
acaggaagacaggaaaucctccut

SEQ ID NO: 78679 - DNA, 28 bp, Artificial Sequence
  Synthetic
actgcccaaguaaagcttagtaacatua

SEQ ID NO: 78680 - DNA, 27 bp, Artificial Sequence
  Synthetic
gtaggatacttguggttgacttctuga

SEQ ID NO: 78681 - DNA, 28 bp, Artificial Sequence
  Synthetic
actgaagacagacuattctcuggagaaa

SEQ ID NO: 78682 - DNA, 25 bp, Artificial Sequence
  Synthetic
ctagatcactggugtggaatagcut

SEQ ID NO: 78683 - DNA, 28 bp, Artificial Sequence
  Synthetic
cagtacctcttgcutggagagttaaaut

SEQ ID NO: 78684 - DNA, 21 bp, Artificial Sequence
  Synthetic
cucactgtuggcaaaggcaaa

SEQ ID NO: 78685 - DNA, 21 bp, Artificial Sequence
  Synthetic
aaatuggacacagccctccuc

SEQ ID NO: 78686 - DNA, 28 bp, Artificial Sequence
  Synthetic
attgtgaaatacutactcctgacauggg

SEQ ID NO: 78687 - DNA, 26 bp, Artificial Sequence
  Synthetic
ccatgtggcutttctttttcgttuct

SEQ ID NO: 78688 - DNA, 22 bp, Artificial Sequence
  Synthetic
tggcagugtactgaaugcaaga

SEQ ID NO: 78689 - DNA, 29 bp, Artificial Sequence
  Synthetic
ggacatcatttccutcattttcctttuca

SEQ ID NO: 78690 - DNA, 23 bp, Artificial Sequence
  Synthetic
tggaacctccucacccattuact

SEQ ID NO: 78691 - DNA, 19 bp, Artificial Sequence
  Synthetic
tcacgaaacucgcuggcat

SEQ ID NO: 78692 - DNA, 28 bp, Artificial Sequence
  Synthetic
ggatgcatguagaaaactactcttcugt

SEQ ID NO: 78693 - DNA, 22 bp, Artificial Sequence
  Synthetic
ctccccacuaaagcagtgctua

SEQ ID NO: 78694 - DNA, 21 bp, Artificial Sequence
  Synthetic
tcgaaaacgccaaguctucct

SEQ ID NO: 78695 - DNA, 20 bp, Artificial Sequence
  Synthetic
ggaagugaccaaagcaggug

SEQ ID NO: 78696 - DNA, 23 bp, Artificial Sequence
  Synthetic
tctcccacutcttcctatuccca

SEQ ID NO: 78697 - DNA, 20 bp, Artificial Sequence
  Synthetic
augccctccuagaccagact

SEQ ID NO: 78698 - DNA, 19 bp, Artificial Sequence
  Synthetic
cccgttgcuggactggaut

SEQ ID NO: 78699 - DNA, 24 bp, Artificial Sequence
  Synthetic
caguaaccccaagatccugaaaca

SEQ ID NO: 78700 - DNA, 28 bp, Artificial Sequence
  Synthetic
ctgctctcacautttcagtagtttugac

SEQ ID NO: 78701 - DNA, 23 bp, Artificial Sequence
  Synthetic
gaaatcuctgcactuacccccat

SEQ ID NO: 78702 - DNA, 24 bp, Artificial Sequence
  Synthetic
cacgtctgauatcactgccauacc

SEQ ID NO: 78703 - DNA, 24 bp, Artificial Sequence
  Synthetic
ctgtgagccaaauccaagaatucc

SEQ ID NO: 78704 - DNA, 22 bp, Artificial Sequence
  Synthetic
gaagccuccagaacuggaagag

SEQ ID NO: 78705 - DNA, 21 bp, Artificial Sequence
  Synthetic
ctagctcguccctcacaccua

SEQ ID NO: 78706 - DNA, 20 bp, Artificial Sequence
  Synthetic
ccaggtucagggtcatgcuc

SEQ ID NO: 78707 - DNA, 21 bp, Artificial Sequence
  Synthetic
acgtgaagugacggactgtuc

SEQ ID NO: 78708 - DNA, 21 bp, Artificial Sequence
  Synthetic
gaggutauagcaagggcccat

SEQ ID NO: 78709 - DNA, 23 bp, Artificial Sequence
  Synthetic
ccttccagccaguctccatauag

SEQ ID NO: 78710 - DNA, 24 bp, Artificial Sequence
  Synthetic
gcatcaggcagguactttgatcut

SEQ ID NO: 78711 - DNA, 21 bp, Artificial Sequence
  Synthetic
gggtaucagggacctcucaga

SEQ ID NO: 78712 - DNA, 26 bp, Artificial Sequence
  Synthetic
gtgagagtcacuttatcagctcugaa

SEQ ID NO: 78713 - DNA, 28 bp, Artificial Sequence
  Synthetic
tcctttgcctauactttgcagtguaaat

SEQ ID NO: 78714 - DNA, 24 bp, Artificial Sequence
  Synthetic
gtcataggagguatgcaacaggut

SEQ ID NO: 78715 - DNA, 24 bp, Artificial Sequence
  Synthetic
cagtcccctutccctctatacuga

SEQ ID NO: 78716 - DNA, 26 bp, Artificial Sequence
  Synthetic
tcttgttcctacutcgttctccauct

SEQ ID NO: 78717 - DNA, 23 bp, Artificial Sequence
  Synthetic
gcagttgaccguagtctccuact

SEQ ID NO: 78718 - DNA, 20 bp, Artificial Sequence
  Synthetic
ggtaatuccccggugggaaa

SEQ ID NO: 78719 - DNA, 21 bp, Artificial Sequence
  Synthetic
cccgagaggutcgttguagag

SEQ ID NO: 78720 - DNA, 21 bp, Artificial Sequence
  Synthetic
cccaagcaggccaaucauagg

SEQ ID NO: 78721 - DNA, 22 bp, Artificial Sequence
  Synthetic
ctacctcgaguctgatgagcug

SEQ ID NO: 78722 - DNA, 28 bp, Artificial Sequence
  Synthetic
caaagattuttaaaggcguacgaagaga

SEQ ID NO: 78723 - DNA, 28 bp, Artificial Sequence
  Synthetic
cataugagagcacatcttuaaacagcat

SEQ ID NO: 78724 - DNA, 24 bp, Artificial Sequence
  Synthetic
actttttgauccctgcaacucagt

SEQ ID NO: 78725 - DNA, 27 bp, Artificial Sequence
  Synthetic
tttctcacauaagctacatggctucaa

SEQ ID NO: 78726 - DNA, 27 bp, Artificial Sequence
  Synthetic
gggtaccuaggaaaggatcataatuca

SEQ ID NO: 78727 - DNA, 22 bp, Artificial Sequence
  Synthetic
ggctcataacuctctcctucgg

SEQ ID NO: 78728 - DNA, 21 bp, Artificial Sequence
  Synthetic
gggtctcucggacttgaguct

SEQ ID NO: 78729 - DNA, 23 bp, Artificial Sequence
  Synthetic
gcctatacucgagaggcttaugg

SEQ ID NO: 78730 - DNA, 22 bp, Artificial Sequence
  Synthetic
cttggaagguctccucaaagca

SEQ ID NO: 78731 - DNA, 20 bp, Artificial Sequence
  Synthetic
ttagcagtauccgccgucac

SEQ ID NO: 78732 - DNA, 24 bp, Artificial Sequence
  Synthetic
cgtcctccucatctgaatctucct

SEQ ID NO: 78733 - DNA, 21 bp, Artificial Sequence
  Synthetic
cuatggcccucaacaggagaa

SEQ ID NO: 78734 - DNA, 18 bp, Artificial Sequence
  Synthetic
cctggcauaggctuccct

SEQ ID NO: 78735 - DNA, 21 bp, Artificial Sequence
  Synthetic
acggcuagtgaccauccagaa

SEQ ID NO: 78736 - DNA, 20 bp, Artificial Sequence
  Synthetic
cccagugaccttgctctucc

SEQ ID NO: 78737 - DNA, 24 bp, Artificial Sequence
  Synthetic
agacaggcuccagatguaagacat

SEQ ID NO: 78738 - DNA, 21 bp, Artificial Sequence
  Synthetic
ccccuccaaagaaacuaggca

SEQ ID NO: 78739 - DNA, 22 bp, Artificial Sequence
  Synthetic
gggaguacccgugaacaaacag

SEQ ID NO: 78740 - DNA, 21 bp, Artificial Sequence
  Synthetic
catcatcuggcaaggccauct

SEQ ID NO: 78741 - DNA, 25 bp, Artificial Sequence
  Synthetic
gctttgattcautgacaggttgugg

SEQ ID NO: 78742 - DNA, 23 bp, Artificial Sequence
  Synthetic
aaacttcucagccacagcttuct

SEQ ID NO: 78743 - DNA, 21 bp, Artificial Sequence
  Synthetic
catggcccugaagatgttguc

SEQ ID NO: 78744 - DNA, 24 bp, Artificial Sequence
  Synthetic
ggcttctttgcutacttggtguct

SEQ ID NO: 78745 - DNA, 22 bp, Artificial Sequence
  Synthetic
cacgaaggaguggttaugcaac

SEQ ID NO: 78746 - DNA, 26 bp, Artificial Sequence
  Synthetic
ccatgtcctgutctgctattatguca

SEQ ID NO: 78747 - DNA, 20 bp, Artificial Sequence
  Synthetic
ccuagaggagccccauagcc

SEQ ID NO: 78748 - DNA, 23 bp, Artificial Sequence
  Synthetic
ccttgttctuggctccttttuct

SEQ ID NO: 78749 - DNA, 21 bp, Artificial Sequence
  Synthetic
gctggacguacctcagttguc

SEQ ID NO: 78750 - DNA, 23 bp, Artificial Sequence
  Synthetic
acatggaggautgccagaatcuc

SEQ ID NO: 78751 - DNA, 25 bp, Artificial Sequence
  Synthetic
accagctgaauctctttctugcaaa

SEQ ID NO: 78752 - DNA, 22 bp, Artificial Sequence
  Synthetic
tgcagaacggaacucagcaaut

SEQ ID NO: 78753 - DNA, 24 bp, Artificial Sequence
  Synthetic
tccgggaagaguggaacaatttut

SEQ ID NO: 78754 - DNA, 28 bp, Artificial Sequence
  Synthetic
tctttggagcaautcatactttcagugt

SEQ ID NO: 78755 - DNA, 28 bp, Artificial Sequence
  Synthetic
ttctgattttgugaaacaccatttggut

SEQ ID NO: 78756 - DNA, 26 bp, Artificial Sequence
  Synthetic
cagaggccuactcataugaaccaaat

SEQ ID NO: 78757 - DNA, 32 bp, Artificial Sequence
  Synthetic
tgtcacatgaatguaaatcaagaaaacagaug

SEQ ID NO: 78758 - DNA, 21 bp, Artificial Sequence
  Synthetic
ggagaagccagutcctucact

SEQ ID NO: 78759 - DNA, 24 bp, Artificial Sequence
  Synthetic
gtggcaagaaggguatctgtacuc

SEQ ID NO: 78760 - DNA, 27 bp, Artificial Sequence
  Synthetic
tccctucattttataacauggccagag

SEQ ID NO: 78761 - DNA, 24 bp, Artificial Sequence
  Synthetic
aaacccatuttccttccuggacat

SEQ ID NO: 78762 - DNA, 22 bp, Artificial Sequence
  Synthetic
gutttgcagttcuccgggagat

SEQ ID NO: 78763 - DNA, 26 bp, Artificial Sequence
  Synthetic
cttgttcacacacucagctgattuac

SEQ ID NO: 78764 - DNA, 24 bp, Artificial Sequence
  Synthetic
ctactaccttcucccctgtttcug

SEQ ID NO: 78765 - DNA, 22 bp, Artificial Sequence
  Synthetic
agaaccttcuccaccagcuact

SEQ ID NO: 78766 - DNA, 27 bp, Artificial Sequence
  Synthetic
caactcaagcugcgaaaacataauaga

SEQ ID NO: 78767 - DNA, 25 bp, Artificial Sequence
  Synthetic
ttgttccugaaaatgauaggcccaa

SEQ ID NO: 78768 - DNA, 28 bp, Artificial Sequence
  Synthetic
acaatgtgagtgauttcagggaaguaag

SEQ ID NO: 78769 - DNA, 28 bp, Artificial Sequence
  Synthetic
gcaacttaacccugtcccttttatguat

SEQ ID NO: 78770 - DNA, 18 bp, Artificial Sequence
  Synthetic
gccatgggutgggccuat

SEQ ID NO: 78771 - DNA, 29 bp, Artificial Sequence
  Synthetic
ggagaaaagccuttttattgctactuaaa

SEQ ID NO: 78772 - DNA, 21 bp, Artificial Sequence
  Synthetic
ctctccugcactccttuagca

SEQ ID NO: 78773 - DNA, 22 bp, Artificial Sequence
  Synthetic
ggtccaaacgucatgggacaut

SEQ ID NO: 78774 - DNA, 27 bp, Artificial Sequence
  Synthetic
tttctggatcttuacaggccatttuct

SEQ ID NO: 78775 - DNA, 17 bp, Artificial Sequence
  Synthetic
gctcagccccucaggug

SEQ ID NO: 78776 - DNA, 19 bp, Artificial Sequence
  Synthetic
cacccggaaaucccguacc

SEQ ID NO: 78777 - DNA, 28 bp, Artificial Sequence
  Synthetic
ggccacattagcaautagctcttctaut

SEQ ID NO: 78778 - DNA, 22 bp, Artificial Sequence
  Synthetic
cctccttcaacucctggtcuct

SEQ ID NO: 78779 - DNA, 28 bp, Artificial Sequence
  Synthetic
gctcgtattguaagcattttcctttcug

SEQ ID NO: 78780 - DNA, 22 bp, Artificial Sequence
  Synthetic
caccugagcaggtgataauggt

SEQ ID NO: 78781 - DNA, 26 bp, Artificial Sequence
  Synthetic
acactttgcaatutgttccattcgua

SEQ ID NO: 78782 - DNA, 24 bp, Artificial Sequence
  Synthetic
cagtataaautggcaguggaacgg

SEQ ID NO: 78783 - DNA, 27 bp, Artificial Sequence
  Synthetic
agagggacuacagcagtttuagaaaag

SEQ ID NO: 78784 - DNA, 25 bp, Artificial Sequence
  Synthetic
tgctggtauctacaactcuggagaa

SEQ ID NO: 78785 - DNA, 21 bp, Artificial Sequence
  Synthetic
ctgaggccaauaccccaauct

SEQ ID NO: 78786 - DNA, 28 bp, Artificial Sequence
  Synthetic
acattttgaaaccugagaagaaggaugt

SEQ ID NO: 78787 - DNA, 28 bp, Artificial Sequence
  Synthetic
tgagttaaccugcaactgattttgttut

SEQ ID NO: 78788 - DNA, 24 bp, Artificial Sequence
  Synthetic
ttgtctttccucatccttugcagt

SEQ ID NO: 78789 - DNA, 28 bp, Artificial Sequence
  Synthetic
cgcccagaacuccattaaattatctgua

SEQ ID NO: 78790 - DNA, 28 bp, Artificial Sequence
  Synthetic
gatggtactcaagutatcactccacaut

SEQ ID NO: 78791 - DNA, 23 bp, Artificial Sequence
  Synthetic
catccactucacaggtagucgag

SEQ ID NO: 78792 - DNA, 27 bp, Artificial Sequence
  Synthetic
ttgactctgtugtgcttctatuacagg

SEQ ID NO: 78793 - DNA, 25 bp, Artificial Sequence
  Synthetic
tgaagttgtcuttggcaaggaucat

SEQ ID NO: 78794 - DNA, 28 bp, Artificial Sequence
  Synthetic
cttactggctuctgttgttaaatgtugt

SEQ ID NO: 78795 - DNA, 26 bp, Artificial Sequence
  Synthetic
cttgttgctcuggacaagttaaaucc

SEQ ID NO: 78796 - DNA, 20 bp, Artificial Sequence
  Synthetic
cutccuccagaaaggcccat

SEQ ID NO: 78797 - DNA, 22 bp, Artificial Sequence
  Synthetic
gccagugtatcaagugcaagac

SEQ ID NO: 78798 - DNA, 28 bp, Artificial Sequence
  Synthetic
cagaaagtttcaguagaacaacgaaucc

SEQ ID NO: 78799 - DNA, 26 bp, Artificial Sequence
  Synthetic
tttgttttccaauagcggaatgucac

SEQ ID NO: 78800 - DNA, 22 bp, Artificial Sequence
  Synthetic
ctgctgtcguacagtcttucca

SEQ ID NO: 78801 - DNA, 21 bp, Artificial Sequence
  Synthetic
ggaggctcucctcatctguca

SEQ ID NO: 78802 - DNA, 21 bp, Artificial Sequence
  Synthetic
ctcaccccucaggacagttut

SEQ ID NO: 78803 - DNA, 25 bp, Artificial Sequence
  Synthetic
gttgaggagtutggtgctacatuac

SEQ ID NO: 78804 - DNA, 20 bp, Artificial Sequence
  Synthetic
gggcugacaggaaacacgua

SEQ ID NO: 78805 - DNA, 28 bp, Artificial Sequence
  Synthetic
ggattttgctaccuggttctggttauat

SEQ ID NO: 78806 - DNA, 21 bp, Artificial Sequence
  Synthetic
agatgtctucccttcggguga

SEQ ID NO: 78807 - DNA, 23 bp, Artificial Sequence
  Synthetic
gcctccgcuccaagagtgataua

SEQ ID NO: 78808 - DNA, 22 bp, Artificial Sequence
  Synthetic
gatttccugaggttcacgucca

SEQ ID NO: 78809 - DNA, 26 bp, Artificial Sequence
  Synthetic
tgcatggctcutagatttgagtgaut

SEQ ID NO: 78810 - DNA, 22 bp, Artificial Sequence
  Synthetic
aacatgtucccagcugagagac

SEQ ID NO: 78811 - DNA, 25 bp, Artificial Sequence
  Synthetic
gggtctttaggucttttgtgagaut

SEQ ID NO: 78812 - DNA, 20 bp, Artificial Sequence
  Synthetic
gctgtgtugactgaccccua

SEQ ID NO: 78813 - DNA, 23 bp, Artificial Sequence
  Synthetic
gtagatgggcuggcttacugaag

SEQ ID NO: 78814 - DNA, 22 bp, Artificial Sequence
  Synthetic
gcaacccaguccaacttggaua

SEQ ID NO: 78815 - DNA, 21 bp, Artificial Sequence
  Synthetic
gcuaacgcagcagtugcaaac

SEQ ID NO: 78816 - DNA, 21 bp, Artificial Sequence
  Synthetic
gctgtccctugggactgtcua

SEQ ID NO: 78817 - DNA, 21 bp, Artificial Sequence
  Synthetic
caugcgggagaatucagacac

SEQ ID NO: 78818 - DNA, 23 bp, Artificial Sequence
  Synthetic
acccaaaccuccagagaagagua

SEQ ID NO: 78819 - DNA, 24 bp, Artificial Sequence
  Synthetic
gttgtttatggccugggatttgut

SEQ ID NO: 78820 - DNA, 29 bp, Artificial Sequence
  Synthetic
gaaggaagacagutcaaagagaatuagga

SEQ ID NO: 78821 - DNA, 25 bp, Artificial Sequence
  Synthetic
cttcctcttccagutcttcaggtut

SEQ ID NO: 78822 - DNA, 24 bp, Artificial Sequence
  Synthetic
ttgcaacaaugaaacgtgatguga

SEQ ID NO: 78823 - DNA, 21 bp, Artificial Sequence
  Synthetic
acccccaauttccuccacaag

SEQ ID NO: 78824 - DNA, 20 bp, Artificial Sequence
  Synthetic
ggccaagatuccgggagtug

SEQ ID NO: 78825 - DNA, 24 bp, Artificial Sequence
  Synthetic
ggcatactggacucatctctccut

SEQ ID NO: 78826 - DNA, 28 bp, Artificial Sequence
  Synthetic
gaagttgaccutaactcaaatgguagga

SEQ ID NO: 78827 - DNA, 28 bp, Artificial Sequence
  Synthetic
cagcatccgaugacaaatttacaucaaa

SEQ ID NO: 78828 - DNA, 22 bp, Artificial Sequence
  Synthetic
cccgacgguctctctucaaaat

SEQ ID NO: 78829 - DNA, 23 bp, Artificial Sequence
  Synthetic
gcuggaggaaaaagugaaaacct

SEQ ID NO: 78830 - DNA, 21 bp, Artificial Sequence
  Synthetic
gctccgagutctgagcttuca

SEQ ID NO: 78831 - DNA, 19 bp, Artificial Sequence
  Synthetic
agucccaggagcggaucaa

SEQ ID NO: 78832 - DNA, 21 bp, Artificial Sequence
  Synthetic
cgaaggacaaggutgccctut

SEQ ID NO: 78833 - DNA, 25 bp, Artificial Sequence
  Synthetic
ccaacagugaaaccactttgaaguc

SEQ ID NO: 78834 - DNA, 25 bp, Artificial Sequence
  Synthetic
cccggaagaaautaagcaugaagaa

SEQ ID NO: 78835 - DNA, 23 bp, Artificial Sequence
  Synthetic
cgtatcttggcuccacttcaugt

SEQ ID NO: 78836 - DNA, 18 bp, Artificial Sequence
  Synthetic
ccuccugcgagggacaag

SEQ ID NO: 78837 - DNA, 22 bp, Artificial Sequence
  Synthetic
tggucactgtuaccaggacaga

SEQ ID NO: 78838 - DNA, 23 bp, Artificial Sequence
  Synthetic
aaagctccttuggtggatgtgua

SEQ ID NO: 78839 - DNA, 26 bp, Artificial Sequence
  Synthetic
aaggaguaaaaactcauccacagcat

SEQ ID NO: 78840 - DNA, 22 bp, Artificial Sequence
  Synthetic
agatgcgtaaugctgtggauga

SEQ ID NO: 78841 - DNA, 28 bp, Artificial Sequence
  Synthetic
actcttccatucaacaacatgttuacct

SEQ ID NO: 78842 - DNA, 33 bp, Artificial Sequence
  Synthetic
atcctagagtaggauataggttttatcugaaaa

SEQ ID NO: 78843 - DNA, 25 bp, Artificial Sequence
  Synthetic
ggcagaccutggtttccauaaagat

SEQ ID NO: 78844 - DNA, 23 bp, Artificial Sequence
  Synthetic
ctgcacccacuaaaatctggtug

SEQ ID NO: 78845 - DNA, 20 bp, Artificial Sequence
  Synthetic
cttcggtacuccccctccut

SEQ ID NO: 78846 - DNA, 22 bp, Artificial Sequence
  Synthetic
cctgtcucgggaaacttgatug

SEQ ID NO: 78847 - DNA, 26 bp, Artificial Sequence
  Synthetic
agaaatctgcaguaagaggcacatut

SEQ ID NO: 78848 - DNA, 25 bp, Artificial Sequence
  Synthetic
gtgtttgaccagauagtggttcuga

SEQ ID NO: 78849 - DNA, 28 bp, Artificial Sequence
  Synthetic
gcatcagtttcugtgctggatttaaaut

SEQ ID NO: 78850 - DNA, 19 bp, Artificial Sequence
  Synthetic
ggttccucatgcgctucct

SEQ ID NO: 78851 - DNA, 17 bp, Artificial Sequence
  Synthetic
accugccccagcagaug

SEQ ID NO: 78852 - DNA, 17 bp, Artificial Sequence
  Synthetic
gcugggcagcgtgtuct

SEQ ID NO: 78853 - DNA, 17 bp, Artificial Sequence
  Synthetic
gagcuggagcgccugat

SEQ ID NO: 78854 - DNA, 27 bp, Artificial Sequence
  Synthetic
atgaggttgacuctttttgtgatgcua

SEQ ID NO: 78855 - DNA, 27 bp, Artificial Sequence
  Synthetic
ctctgggaaugcagattctacagtuaa

SEQ ID NO: 78856 - DNA, 28 bp, Artificial Sequence
  Synthetic
gaggttctctugttccatagttucagaa

SEQ ID NO: 78857 - DNA, 28 bp, Artificial Sequence
  Synthetic
tttgatggctuacctctttaacagugaa

SEQ ID NO: 78858 - DNA, 26 bp, Artificial Sequence
  Synthetic
tcttcttctagcauttggaacagcuc

SEQ ID NO: 78859 - DNA, 28 bp, Artificial Sequence
  Synthetic
agggaaaaataugctatacacactuggt

SEQ ID NO: 78860 - DNA, 27 bp, Artificial Sequence
  Synthetic
ggaaagtcaguttgtcttaaugcaaca

SEQ ID NO: 78861 - DNA, 33 bp, Artificial Sequence
  Synthetic
tctgtcaaataccaguagaaagtaaaaaugaac

SEQ ID NO: 78862 - DNA, 29 bp, Artificial Sequence
  Synthetic
acccactuagagtcaaatuacaaaccaat

SEQ ID NO: 78863 - DNA, 26 bp, Artificial Sequence
  Synthetic
cttcgggaagccutaaggaatatcut

SEQ ID NO: 78864 - DNA, 21 bp, Artificial Sequence
  Synthetic
cgagggcacutacuccacaaa

SEQ ID NO: 78865 - DNA, 22 bp, Artificial Sequence
  Synthetic
gaucagaaaaacuggcccgaga

SEQ ID NO: 78866 - DNA, 21 bp, Artificial Sequence
  Synthetic
gagaaacuggccuggaggaag

SEQ ID NO: 78867 - DNA, 27 bp, Artificial Sequence
  Synthetic
tgtacaccaugaaccccaacaaattua

SEQ ID NO: 78868 - DNA, 27 bp, Artificial Sequence
  Synthetic
cactgtcctgtuttgatatcccagaut

SEQ ID NO: 78869 - DNA, 25 bp, Artificial Sequence
  Synthetic
cttgatacaucaatccgtgttuggg

SEQ ID NO: 78870 - DNA, 27 bp, Artificial Sequence
  Synthetic
agagaatcttaccugctcttgtacuga

SEQ ID NO: 78871 - DNA, 28 bp, Artificial Sequence
  Synthetic
cagtttatccccauactcctacttcaut

SEQ ID NO: 78872 - DNA, 22 bp, Artificial Sequence
  Synthetic
gctccacaguggttccacauat

SEQ ID NO: 78873 - DNA, 23 bp, Artificial Sequence
  Synthetic
ctaatgagccccaucccttucag

SEQ ID NO: 78874 - DNA, 22 bp, Artificial Sequence
  Synthetic
ggttctaccacucctgcctcua

SEQ ID NO: 78875 - DNA, 22 bp, Artificial Sequence
  Synthetic
gatgcagggagutgggttttuc

SEQ ID NO: 78876 - DNA, 28 bp, Artificial Sequence
  Synthetic
acagctgttgaautaatatccttcacut

SEQ ID NO: 78877 - DNA, 22 bp, Artificial Sequence
  Synthetic
tcagcactaaugatgcctcgut

SEQ ID NO: 78878 - DNA, 26 bp, Artificial Sequence
  Synthetic
gaaccttacctguagattcagtggug

SEQ ID NO: 78879 - DNA, 27 bp, Artificial Sequence
  Synthetic
acagcatggaaacaagautgtgtctua

SEQ ID NO: 78880 - DNA, 29 bp, Artificial Sequence
  Synthetic
gctgctgttugaggtttattttgttctua

SEQ ID NO: 78881 - DNA, 21 bp, Artificial Sequence
  Synthetic
ctctcccauggttccctcaut

SEQ ID NO: 78882 - DNA, 23 bp, Artificial Sequence
  Synthetic
aatgcaatuccctgtcuccacat

SEQ ID NO: 78883 - DNA, 28 bp, Artificial Sequence
  Synthetic
ccctttcctacuaggattaaggtcagua

SEQ ID NO: 78884 - DNA, 20 bp, Artificial Sequence
  Synthetic
tcaatgtuccggcacttcug

SEQ ID NO: 78885 - DNA, 27 bp, Artificial Sequence
  Synthetic
cccaaggucaaggagattattgaugag

SEQ ID NO: 78886 - DNA, 23 bp, Artificial Sequence
  Synthetic
ttgagtucgcagctcttuaagga

SEQ ID NO: 78887 - DNA, 28 bp, Artificial Sequence
  Synthetic
ttttaatttgcctuctcttctgtccuga

SEQ ID NO: 78888 - DNA, 27 bp, Artificial Sequence
  Synthetic
tcttttcacauttcaggtcaucaggaa

SEQ ID NO: 78889 - DNA, 28 bp, Artificial Sequence
  Synthetic
ttggaaacctacutttcacagaagucat

SEQ ID NO: 78890 - DNA, 23 bp, Artificial Sequence
  Synthetic
gagaagggaaacugctcttucca

SEQ ID NO: 78891 - DNA, 26 bp, Artificial Sequence
  Synthetic
accccaaccacuaaacaaatcctuac

SEQ ID NO: 78892 - DNA, 23 bp, Artificial Sequence
  Synthetic
cttgatcagaaacuggcaagcuc

SEQ ID NO: 78893 - DNA, 28 bp, Artificial Sequence
  Synthetic
aaacttgtaaaaugacccctggttctua

SEQ ID NO: 78894 - DNA, 20 bp, Artificial Sequence
  Synthetic
gcaggccaacuacctctugt

SEQ ID NO: 78895 - DNA, 23 bp, Artificial Sequence
  Synthetic
ctccuccagaagagaagaauccc

SEQ ID NO: 78896 - DNA, 25 bp, Artificial Sequence
  Synthetic
gtttgttgttccugaaggttacugg

SEQ ID NO: 78897 - DNA, 24 bp, Artificial Sequence
  Synthetic
ttcttcgcugaatggtaagugaat

SEQ ID NO: 78898 - DNA, 24 bp, Artificial Sequence
  Synthetic
ggagtagtaaaugatgcctggugt

SEQ ID NO: 78899 - DNA, 22 bp, Artificial Sequence
  Synthetic
gaautactcagcugcggaggat

SEQ ID NO: 78900 - DNA, 27 bp, Artificial Sequence
  Synthetic
ggttgttattgtutttggattgccuca

SEQ ID NO: 78901 - DNA, 21 bp, Artificial Sequence
  Synthetic
gtgggcaugtcaucaggaaac

SEQ ID NO: 78902 - DNA, 26 bp, Artificial Sequence
  Synthetic
cacatgtccgugtacacttctttgua

SEQ ID NO: 78903 - DNA, 21 bp, Artificial Sequence
  Synthetic
gaggugggaacaagtuggaga

SEQ ID NO: 78904 - DNA, 23 bp, Artificial Sequence
  Synthetic
ggcctttctucctggaacatuct

SEQ ID NO: 78905 - DNA, 28 bp, Artificial Sequence
  Synthetic
cagccagaaaugttttgguaacagaaaa

SEQ ID NO: 78906 - DNA, 21 bp, Artificial Sequence
  Synthetic
ccccaucaggagggtcttuca

SEQ ID NO: 78907 - DNA, 23 bp, Artificial Sequence
  Synthetic
ggacaccccuttgtgactcauac

SEQ ID NO: 78908 - DNA, 28 bp, Artificial Sequence
  Synthetic
aaaaugactctcuaaaaggagaccaacc

SEQ ID NO: 78909 - DNA, 21 bp, Artificial Sequence
  Synthetic
ggcccatucatcaagcucagt

SEQ ID NO: 78910 - DNA, 25 bp, Artificial Sequence
  Synthetic
aggtcagttccugtttttacgtugt

SEQ ID NO: 78911 - DNA, 21 bp, Artificial Sequence
  Synthetic
cgaaggguaaggcgttgucat

SEQ ID NO: 78912 - DNA, 23 bp, Artificial Sequence
  Synthetic
tgaattcggaugcagagcttcut

SEQ ID NO: 78913 - DNA, 26 bp, Artificial Sequence
  Synthetic
ccaaaatctgtgaucttgacatgcug

SEQ ID NO: 78914 - DNA, 22 bp, Artificial Sequence
  Synthetic
ggctctgacucacccttgttut

SEQ ID NO: 78915 - DNA, 25 bp, Artificial Sequence
  Synthetic
tcccccaguaagtcccttcaaatua

SEQ ID NO: 78916 - DNA, 19 bp, Artificial Sequence
  Synthetic
ctuggccgaaaacgagcug

SEQ ID NO: 78917 - DNA, 25 bp, Artificial Sequence
  Synthetic
aatcaaaagtcugttccgacuccaa

SEQ ID NO: 78918 - DNA, 29 bp, Artificial Sequence
  Synthetic
gtccaaagtctgcuattttcatcacatug

SEQ ID NO: 78919 - DNA, 24 bp, Artificial Sequence
  Synthetic
tttgttcuggcggtgtttugaaat

SEQ ID NO: 78920 - DNA, 19 bp, Artificial Sequence
  Synthetic
gacccgcagaugtccauga

SEQ ID NO: 78921 - DNA, 23 bp, Artificial Sequence
  Synthetic
catagcaaauggcaagttcugct

SEQ ID NO: 78922 - DNA, 27 bp, Artificial Sequence
  Synthetic
acgtattttggcuttgaaatggaacug

SEQ ID NO: 78923 - DNA, 22 bp, Artificial Sequence
  Synthetic
ctcuccacccaaacccttguag

SEQ ID NO: 78924 - DNA, 21 bp, Artificial Sequence
  Synthetic
ccuagacagcaccgtaauggg

SEQ ID NO: 78925 - DNA, 22 bp, Artificial Sequence
  Synthetic
aaggagcagcutggctaaacut

SEQ ID NO: 78926 - DNA, 22 bp, Artificial Sequence
  Synthetic
agtggttttgauacgggctuca

SEQ ID NO: 78927 - DNA, 24 bp, Artificial Sequence
  Synthetic
agctgtttccuatatgagggcuct

SEQ ID NO: 78928 - DNA, 26 bp, Artificial Sequence
  Synthetic
tcaacuaacacaagtcgugaaaggag

SEQ ID NO: 78929 - DNA, 27 bp, Artificial Sequence
  Synthetic
cgtgttcgaccautcataaatcaggua

SEQ ID NO: 78930 - DNA, 20 bp, Artificial Sequence
  Synthetic
tgccaggcaacagcuctuac

SEQ ID NO: 78931 - DNA, 29 bp, Artificial Sequence
  Synthetic
agatgacugacagagaagaacaaaugaat

SEQ ID NO: 78932 - DNA, 19 bp, Artificial Sequence
  Synthetic
ccactccucagcctucacc

SEQ ID NO: 78933 - DNA, 17 bp, Artificial Sequence
  Synthetic
tgctugcgcgactucct

SEQ ID NO: 78934 - DNA, 24 bp, Artificial Sequence
  Synthetic
agatcugcgaggaauagagaagga

SEQ ID NO: 78935 - DNA, 21 bp, Artificial Sequence
  Synthetic
tgacagaucctgccttcucca

SEQ ID NO: 78936 - DNA, 22 bp, Artificial Sequence
  Synthetic
cactgggcccaauatgacauca

SEQ ID NO: 78937 - DNA, 19 bp, Artificial Sequence
  Synthetic
gcctaugagccgguccaga

SEQ ID NO: 78938 - DNA, 23 bp, Artificial Sequence
  Synthetic
acaccaaaggcaacugauaaggt

SEQ ID NO: 78939 - DNA, 22 bp, Artificial Sequence
  Synthetic
tccctgguagatggctactucc

SEQ ID NO: 78940 - DNA, 23 bp, Artificial Sequence
  Synthetic
caggaacguactggugaaaacac

SEQ ID NO: 78941 - DNA, 22 bp, Artificial Sequence
  Synthetic
caggaaaatgcuggctgaccua

SEQ ID NO: 78942 - DNA, 19 bp, Artificial Sequence
  Synthetic
gaaugacggcucggaagga

SEQ ID NO: 78943 - DNA, 22 bp, Artificial Sequence
  Synthetic
ggattaccgacugctcctcuca

SEQ ID NO: 78944 - DNA, 19 bp, Artificial Sequence
  Synthetic
cgcgcugccagatttgtuc

SEQ ID NO: 78945 - DNA, 17 bp, Artificial Sequence
  Synthetic
tguagcgggucccccaa

SEQ ID NO: 78946 - DNA, 17 bp, Artificial Sequence
  Synthetic
gagggccaugtcgcugt

SEQ ID NO: 78947 - DNA, 19 bp, Artificial Sequence
  Synthetic
tgatccaggagcucgcuga

SEQ ID NO: 78948 - DNA, 17 bp, Artificial Sequence
  Synthetic
agggccaugtcgctgut

SEQ ID NO: 78949 - DNA, 17 bp, Artificial Sequence
  Synthetic
ggcgccugauccaggag

SEQ ID NO: 78950 - DNA, 28 bp, Artificial Sequence
  Synthetic
agaatccaacatcugaatacaccacaut

SEQ ID NO: 78951 - DNA, 25 bp, Artificial Sequence
  Synthetic
gaacattgugaacgactgccttaug

SEQ ID NO: 78952 - DNA, 21 bp, Artificial Sequence
  Synthetic
cagaucccuggaccaacacaa

SEQ ID NO: 78953 - DNA, 28 bp, Artificial Sequence
  Synthetic
gctactttcugacttgcattatcuccat

SEQ ID NO: 78954 - DNA, 28 bp, Artificial Sequence
  Synthetic
cacaaagutagtttaugggaaggaacct

SEQ ID NO: 78955 - DNA, 28 bp, Artificial Sequence
  Synthetic
accattcatttugaaggctagggtttua

SEQ ID NO: 78956 - DNA, 28 bp, Artificial Sequence
  Synthetic
gagaactgauagaaattggatgugagga

SEQ ID NO: 78957 - DNA, 28 bp, Artificial Sequence
  Synthetic
tggatttcccaugtggttcttttuaact

SEQ ID NO: 78958 - DNA, 22 bp, Artificial Sequence
  Synthetic
accaacccauttctcaccaucc

SEQ ID NO: 78959 - DNA, 27 bp, Artificial Sequence
  Synthetic
ggctggaaaaugatcatctccgatuaa

SEQ ID NO: 78960 - DNA, 27 bp, Artificial Sequence
  Synthetic
gaacacttaccagaauactgagcagut

SEQ ID NO: 78961 - DNA, 28 bp, Artificial Sequence
  Synthetic
gggaatgaugcaacataatatgcttuca

SEQ ID NO: 78962 - DNA, 21 bp, Artificial Sequence
  Synthetic
ggaatucccatttgcuggcat

SEQ ID NO: 78963 - DNA, 28 bp, Artificial Sequence
  Synthetic
gtttatgacuggaaggattgatgcttuc

SEQ ID NO: 78964 - DNA, 28 bp, Artificial Sequence
  Synthetic
tagatctagaaugaatccttaccugcaa

SEQ ID NO: 78965 - DNA, 24 bp, Artificial Sequence
  Synthetic
ggtctaacucagtggcaacuacat

SEQ ID NO: 78966 - DNA, 23 bp, Artificial Sequence
  Synthetic
gtaatgatgggcauctgctguga

SEQ ID NO: 78967 - DNA, 20 bp, Artificial Sequence
  Synthetic
tctcactgugcacctcccua

SEQ ID NO: 78968 - DNA, 27 bp, Artificial Sequence
  Synthetic
tgcagttcaauagtcatgacaaaguct

SEQ ID NO: 78969 - DNA, 21 bp, Artificial Sequence
  Synthetic
agaacagcauccagtgucacc

SEQ ID NO: 78970 - DNA, 27 bp, Artificial Sequence
  Synthetic
ctgtgtgctautggtgtttattugcat

SEQ ID NO: 78971 - DNA, 29 bp, Artificial Sequence
  Synthetic
caataatctgcagugtggatagaguaaca

SEQ ID NO: 78972 - DNA, 24 bp, Artificial Sequence
  Synthetic
accugatgaaaauccccaaacaca

SEQ ID NO: 78973 - DNA, 22 bp, Artificial Sequence
  Synthetic
ctggtcatugtgggtcugacat

SEQ ID NO: 78974 - DNA, 26 bp, Artificial Sequence
  Synthetic
gcctcttatcaucagaaaaccuacca

SEQ ID NO: 78975 - DNA, 29 bp, Artificial Sequence
  Synthetic
ctccggtggttugtaaactatacttguat

SEQ ID NO: 78976 - DNA, 21 bp, Artificial Sequence
  Synthetic
ctcucaaggcccagccatuat

SEQ ID NO: 78977 - DNA, 22 bp, Artificial Sequence
  Synthetic
caugagctattuccaccaccct

SEQ ID NO: 78978 - DNA, 24 bp, Artificial Sequence
  Synthetic
tcctttgccautgttagcatucct

SEQ ID NO: 78979 - DNA, 28 bp, Artificial Sequence
  Synthetic
cataaaacggctucagaatgtaagtgua

SEQ ID NO: 78980 - DNA, 25 bp, Artificial Sequence
  Synthetic
cagctgagtuttccaatgtcaugat

SEQ ID NO: 78981 - DNA, 33 bp, Artificial Sequence
  Synthetic
tcactgtattttaaauaaaagaagagacucaca

SEQ ID NO: 78982 - DNA, 20 bp, Artificial Sequence
  Synthetic
gcaaaaacgcccugctugac

SEQ ID NO: 78983 - DNA, 23 bp, Artificial Sequence
  Synthetic
tgaagacagacauggaacgucac

SEQ ID NO: 78984 - DNA, 21 bp, Artificial Sequence
  Synthetic
ccacgtcagagugtgggatuc

SEQ ID NO: 78985 - DNA, 27 bp, Artificial Sequence
  Synthetic
actgagcttaacutctttcctgcttut

SEQ ID NO: 78986 - DNA, 27 bp, Artificial Sequence
  Synthetic
tgctctuccttctaacauaaacagcaa

SEQ ID NO: 78987 - DNA, 28 bp, Artificial Sequence
  Synthetic
cttcctctgtcutctctctcttcauact

SEQ ID NO: 78988 - DNA, 20 bp, Artificial Sequence
  Synthetic
tgaaggtggaucctgcccua

SEQ ID NO: 78989 - DNA, 24 bp, Artificial Sequence
  Synthetic
gactgtctugaccctcaaatucca

SEQ ID NO: 78990 - DNA, 28 bp, Artificial Sequence
  Synthetic
ctgaagcagtuaaaggtgaagtgtuaaa

SEQ ID NO: 78991 - DNA, 25 bp, Artificial Sequence
  Synthetic
acatcatgagaggaaugcaggaauc

SEQ ID NO: 78992 - DNA, 22 bp, Artificial Sequence
  Synthetic
ggtaccaggucagtactuccca

SEQ ID NO: 78993 - DNA, 23 bp, Artificial Sequence
  Synthetic
ctcttugccctgtaugacgagaa

SEQ ID NO: 78994 - DNA, 24 bp, Artificial Sequence
  Synthetic
agcauaactcattcaucgccacat

SEQ ID NO: 78995 - DNA, 23 bp, Artificial Sequence
  Synthetic
tggcaagauattgtucggaaccc

SEQ ID NO: 78996 - DNA, 28 bp, Artificial Sequence
  Synthetic
gtagtttacttgaauagtgacaggugga

SEQ ID NO: 78997 - DNA, 24 bp, Artificial Sequence
  Synthetic
ggtccagtggguacttgaacaaug

SEQ ID NO: 78998 - DNA, 27 bp, Artificial Sequence
  Synthetic
tccaacttguggtttaaaatguagcct

SEQ ID NO: 78999 - DNA, 28 bp, Artificial Sequence
  Synthetic
caggaggatggcaauggaagatataauc

SEQ ID NO: 79000 - DNA, 22 bp, Artificial Sequence
  Synthetic
aagagucaagtuggaaggccat

SEQ ID NO: 79001 - DNA, 27 bp, Artificial Sequence
  Synthetic
ccttttcaucaacaagcagttugacaa

SEQ ID NO: 79002 - DNA, 28 bp, Artificial Sequence
  Synthetic
catttcattttucaacagcttgctaugg

SEQ ID NO: 79003 - DNA, 24 bp, Artificial Sequence
  Synthetic
acaacaggagugcagttcctaaut

SEQ ID NO: 79004 - DNA, 21 bp, Artificial Sequence
  Synthetic
cactgtgucctcctcgtugat

SEQ ID NO: 79005 - DNA, 27 bp, Artificial Sequence
  Synthetic
gaggatgggttuttctcttccatgtua

SEQ ID NO: 79006 - DNA, 21 bp, Artificial Sequence
  Synthetic
ggagcauaccagagcttggug

SEQ ID NO: 79007 - DNA, 28 bp, Artificial Sequence
  Synthetic
tctttgtggaugagagagttccttauct

SEQ ID NO: 79008 - DNA, 21 bp, Artificial Sequence
  Synthetic
tguccaccaagugagggagat

SEQ ID NO: 79009 - DNA, 20 bp, Artificial Sequence
  Synthetic
gcccctaugtcccaacugac

SEQ ID NO: 79010 - DNA, 27 bp, Artificial Sequence
  Synthetic
autcatttatatguacacagggcagca

SEQ ID NO: 79011 - DNA, 21 bp, Artificial Sequence
  Synthetic
tgucagugaggaggacacagt

SEQ ID NO: 79012 - DNA, 21 bp, Artificial Sequence
  Synthetic
gtgcaguccgtcguagaagaa

SEQ ID NO: 79013 - DNA, 20 bp, Artificial Sequence
  Synthetic
caacgcggcgutaaggauac

SEQ ID NO: 79014 - DNA, 21 bp, Artificial Sequence
  Synthetic
tcauccaagugggacaaaggg

SEQ ID NO: 79015 - DNA, 22 bp, Artificial Sequence
  Synthetic
ccagaccttcuctctccccaua

SEQ ID NO: 79016 - DNA, 27 bp, Artificial Sequence
  Synthetic
ctttcggtgaugaggaaaagaaaaugg

SEQ ID NO: 79017 - DNA, 17 bp, Artificial Sequence
  Synthetic
cgggagagcggcuacug

SEQ ID NO: 79018 - DNA, 24 bp, Artificial Sequence
  Synthetic
ctagataccccuctggaagctcut

SEQ ID NO: 79019 - DNA, 21 bp, Artificial Sequence
  Synthetic
cgatcgcacacauttgtcgug

SEQ ID NO: 79020 - DNA, 28 bp, Artificial Sequence
  Synthetic
aaagtaagcugtacacattugaggagaa

SEQ ID NO: 79021 - DNA, 24 bp, Artificial Sequence
  Synthetic
agauagcttgcttuggacacagac

SEQ ID NO: 79022 - DNA, 21 bp, Artificial Sequence
  Synthetic
cctttgtucagtgtggcuggt

SEQ ID NO: 79023 - DNA, 26 bp, Artificial Sequence
  Synthetic
aaaacatgtaugccagctgtuagaga

SEQ ID NO: 79024 - DNA, 21 bp, Artificial Sequence
  Synthetic
cttcaaagcugtgcctgtugt

SEQ ID NO: 79025 - DNA, 26 bp, Artificial Sequence
  Synthetic
atgagaagaaugaagcgattcacuca

SEQ ID NO: 79026 - DNA, 23 bp, Artificial Sequence
  Synthetic
gtgtatgggcutcagcaagttuc

SEQ ID NO: 79027 - DNA, 22 bp, Artificial Sequence
  Synthetic
ctcacccugaacagcacaatuc

SEQ ID NO: 79028 - DNA, 21 bp, Artificial Sequence
  Synthetic
cccaggcuctgagagatuggt

SEQ ID NO: 79029 - DNA, 21 bp, Artificial Sequence
  Synthetic
ggcccacaccutctttagugt

SEQ ID NO: 79030 - DNA, 20 bp, Artificial Sequence
  Synthetic
gctgctcguctgtctcttug

SEQ ID NO: 79031 - DNA, 19 bp, Artificial Sequence
  Synthetic
accuggagacccugcagaa

SEQ ID NO: 79032 - DNA, 17 bp, Artificial Sequence
  Synthetic
ccaccugagcaccguct

SEQ ID NO: 79033 - DNA, 18 bp, Artificial Sequence
  Synthetic
gccagccccuctgaguga

SEQ ID NO: 79034 - DNA, 25 bp, Artificial Sequence
  Synthetic
tcctggaacuaatcctttccuccat

SEQ ID NO: 79035 - DNA, 25 bp, Artificial Sequence
  Synthetic
gtcctatgctuctgcctacacuaac

SEQ ID NO: 79036 - DNA, 21 bp, Artificial Sequence
  Synthetic
caagccuggaaatgcatgcuc

SEQ ID NO: 79037 - DNA, 25 bp, Artificial Sequence
  Synthetic
gtaactctaucggactctcccauca

SEQ ID NO: 79038 - DNA, 18 bp, Artificial Sequence
  Synthetic
gctcctccucgccctcut

SEQ ID NO: 79039 - DNA, 20 bp, Artificial Sequence
  Synthetic
tcgggauaggagagctcguc

SEQ ID NO: 79040 - DNA, 21 bp, Artificial Sequence
  Synthetic
cctggaaggugaggacacuga

SEQ ID NO: 79041 - DNA, 21 bp, Artificial Sequence
  Synthetic
gcacutcttcugcaaggaggt

SEQ ID NO: 79042 - DNA, 23 bp, Artificial Sequence
  Synthetic
tguttattgttucagcggagggt

SEQ ID NO: 79043 - DNA, 27 bp, Artificial Sequence
  Synthetic
cctgattctttugggcaatcttttguc

SEQ ID NO: 79044 - DNA, 23 bp, Artificial Sequence
  Synthetic
accattctucctctttgcuccag

SEQ ID NO: 79045 - DNA, 23 bp, Artificial Sequence
  Synthetic
caattggcttuaccagggcttut

SEQ ID NO: 79046 - DNA, 18 bp, Artificial Sequence
  Synthetic
ggccacutccuccagcag

SEQ ID NO: 79047 - DNA, 18 bp, Artificial Sequence
  Synthetic
ctgggcuctgacgctugt

SEQ ID NO: 79048 - DNA, 21 bp, Artificial Sequence
  Synthetic
agaacggucaaccaugcagag

SEQ ID NO: 79049 - DNA, 26 bp, Artificial Sequence
  Synthetic
ccattttgctuccgttgtctcttcua

SEQ ID NO: 79050 - DNA, 25 bp, Artificial Sequence
  Synthetic
caacctgauccaacatgaaaagcug

SEQ ID NO: 79051 - DNA, 28 bp, Artificial Sequence
  Synthetic
ctattttcacacugcaacagaaagacut

SEQ ID NO: 79052 - DNA, 23 bp, Artificial Sequence
  Synthetic
gcagatauggcagctgagcaaua

SEQ ID NO: 79053 - DNA, 20 bp, Artificial Sequence
  Synthetic
gtgatcuccagccttguggt

SEQ ID NO: 79054 - DNA, 25 bp, Artificial Sequence
  Synthetic
gtccagagtucacaatccaguagaa

SEQ ID NO: 79055 - DNA, 22 bp, Artificial Sequence
  Synthetic
acaccagugtgtctcttugcag

SEQ ID NO: 79056 - DNA, 22 bp, Artificial Sequence
  Synthetic
ccaaccccauggaaagatguga

SEQ ID NO: 79057 - DNA, 25 bp, Artificial Sequence
  Synthetic
guggaatuggcaaaagaagaagaca

SEQ ID NO: 79058 - DNA, 23 bp, Artificial Sequence
  Synthetic
gtcttcgtttugcaggagaaugg

SEQ ID NO: 79059 - DNA, 21 bp, Artificial Sequence
  Synthetic
cttggctuccatgacaccuga

SEQ ID NO: 79060 - DNA, 21 bp, Artificial Sequence
  Synthetic
cagutctccgcuggaaaaagg

SEQ ID NO: 79061 - DNA, 27 bp, Artificial Sequence
  Synthetic
tctctcaactttugggccattattuct

SEQ ID NO: 79062 - DNA, 25 bp, Artificial Sequence
  Synthetic
ctacaggauccagatctaactuggg

SEQ ID NO: 79063 - DNA, 28 bp, Artificial Sequence
  Synthetic
agaatgaggcaaauctttgtgaacuact

SEQ ID NO: 79064 - DNA, 24 bp, Artificial Sequence
  Synthetic
aatutttggttttaguggcggcat

SEQ ID NO: 79065 - DNA, 28 bp, Artificial Sequence
  Synthetic
gtttgatcgtttuctttggctattcuca

SEQ ID NO: 79066 - DNA, 25 bp, Artificial Sequence
  Synthetic
cttgggauggcagtgttagatauga

SEQ ID NO: 79067 - DNA, 25 bp, Artificial Sequence
  Synthetic
tcaaaaggcauggguaaacacagaa

SEQ ID NO: 79068 - DNA, 21 bp, Artificial Sequence
  Synthetic
gagcacttaucagggtggcua

SEQ ID NO: 79069 - DNA, 27 bp, Artificial Sequence
  Synthetic
gtacaaggagaaauacgagaagtuggt

SEQ ID NO: 79070 - DNA, 18 bp, Artificial Sequence
  Synthetic
cugcagaagcuccagcga

SEQ ID NO: 79071 - DNA, 23 bp, Artificial Sequence
  Synthetic
ggtgggccaucatgagacauaat

SEQ ID NO: 79072 - DNA, 20 bp, Artificial Sequence
  Synthetic
ctcgagccgutttcucggaa

SEQ ID NO: 79073 - DNA, 21 bp, Artificial Sequence
  Synthetic
gucctggagucggagaagaac

SEQ ID NO: 79074 - DNA, 24 bp, Artificial Sequence
  Synthetic
tcttcaggagagaauaccaugggt

SEQ ID NO: 79075 - DNA, 25 bp, Artificial Sequence
  Synthetic
gagaatccagagcacutagaggtut

SEQ ID NO: 79076 - DNA, 20 bp, Artificial Sequence
  Synthetic
tgcttgagguggtcgactug

SEQ ID NO: 79077 - DNA, 20 bp, Artificial Sequence
  Synthetic
gtgauccggcugaagcagaa

SEQ ID NO: 79078 - DNA, 22 bp, Artificial Sequence
  Synthetic
ggaaauctgcaguggaggagat

SEQ ID NO: 79079 - DNA, 28 bp, Artificial Sequence
  Synthetic
atgccacaccaaccutctttttaaaaut

SEQ ID NO: 79080 - DNA, 23 bp, Artificial Sequence
  Synthetic
gatctttctcutggtggccugaa

SEQ ID NO: 79081 - DNA, 26 bp, Artificial Sequence
  Synthetic
gacttttugacactgaaccauggaaa

SEQ ID NO: 79082 - DNA, 18 bp, Artificial Sequence
  Synthetic
ggcauagccgcggtttut

SEQ ID NO: 79083 - DNA, 17 bp, Artificial Sequence
  Synthetic
gccugcactucgacgac

SEQ ID NO: 79084 - DNA, 21 bp, Artificial Sequence
  Synthetic
ccgaccucatccucacaggaa

SEQ ID NO: 79085 - DNA, 28 bp, Artificial Sequence
  Synthetic
tgtctgccaaatuaaagagccaagauat

SEQ ID NO: 79086 - DNA, 27 bp, Artificial Sequence
  Synthetic
ctgaaacttaugggagaaacaggacut

SEQ ID NO: 79087 - DNA, 23 bp, Artificial Sequence
  Synthetic
ccatcaaucacacgtaccaccug

SEQ ID NO: 79088 - DNA, 28 bp, Artificial Sequence
  Synthetic
tgttttcttttagcaaauggaacgtgut

SEQ ID NO: 79089 - DNA, 24 bp, Artificial Sequence
  Synthetic
tcagatttcuagccgaugaggaga

SEQ ID NO: 79090 - DNA, 26 bp, Artificial Sequence
  Synthetic
agguaaaatgatcctugccaaagaca

SEQ ID NO: 79091 - DNA, 27 bp, Artificial Sequence
  Synthetic
gccttccttgaucatcttgtagaacut

SEQ ID NO: 79092 - DNA, 22 bp, Artificial Sequence
  Synthetic
tccccgaacutccaccagaaua

SEQ ID NO: 79093 - DNA, 22 bp, Artificial Sequence
  Synthetic
cttatcugcaagatggcugcct

SEQ ID NO: 79094 - DNA, 22 bp, Artificial Sequence
  Synthetic
tgagagttcutccccagugaca

SEQ ID NO: 79095 - DNA, 23 bp, Artificial Sequence
  Synthetic
cgatggaucagagatggaagcuc

SEQ ID NO: 79096 - DNA, 25 bp, Artificial Sequence
  Synthetic
gagttgtacagutctgtagcctuga

SEQ ID NO: 79097 - DNA, 28 bp, Artificial Sequence
  Synthetic
ggagggcaagaguattaagaacaaagua

SEQ ID NO: 79098 - DNA, 21 bp, Artificial Sequence
  Synthetic
ggcaaacucacccacaacauc

SEQ ID NO: 79099 - DNA, 23 bp, Artificial Sequence
  Synthetic
ccgccttugctttgatctttuca

SEQ ID NO: 79100 - DNA, 22 bp, Artificial Sequence
  Synthetic
tuaaccaagcagagggauggac

SEQ ID NO: 79101 - DNA, 23 bp, Artificial Sequence
  Synthetic
ggtctttuggagtcactcugcat

SEQ ID NO: 79102 - DNA, 24 bp, Artificial Sequence
  Synthetic
tcattttgcagugagtttgccaut

SEQ ID NO: 79103 - DNA, 27 bp, Artificial Sequence
  Synthetic
actgtgtaaattuccaggttggaugat

SEQ ID NO: 79104 - DNA, 23 bp, Artificial Sequence
  Synthetic
ctccctgutctcatgugaaagga

SEQ ID NO: 79105 - DNA, 27 bp, Artificial Sequence
  Synthetic
tctgaggaugatgatgaggaugaagaa

SEQ ID NO: 79106 - DNA, 29 bp, Artificial Sequence
  Synthetic
ccttaaatttagguctactgtcagcauca

SEQ ID NO: 79107 - DNA, 28 bp, Artificial Sequence
  Synthetic
gcttgctttcuttctcagatcatuacga

SEQ ID NO: 79108 - DNA, 27 bp, Artificial Sequence
  Synthetic
agttcutcttattaatguggcacccat

SEQ ID NO: 79109 - DNA, 25 bp, Artificial Sequence
  Synthetic
cagtagtatctuccaagcgctucaa

SEQ ID NO: 79110 - DNA, 23 bp, Artificial Sequence
  Synthetic
caggttcagguctagcttctcug

SEQ ID NO: 79111 - DNA, 20 bp, Artificial Sequence
  Synthetic
ttggccacacucaacctuga

SEQ ID NO: 79112 - DNA, 23 bp, Artificial Sequence
  Synthetic
gggtgactgutggatctgtaugg

SEQ ID NO: 79113 - DNA, 26 bp, Artificial Sequence
  Synthetic
agaccaggtacutactgctaaaguga

SEQ ID NO: 79114 - DNA, 20 bp, Artificial Sequence
  Synthetic
ctggaaugccggtcgatuct

SEQ ID NO: 79115 - DNA, 28 bp, Artificial Sequence
  Synthetic
tcaacatctggguttctgtctcuaaaaa

SEQ ID NO: 79116 - DNA, 23 bp, Artificial Sequence
  Synthetic
gggaaugcttatugaagggacaa

SEQ ID NO: 79117 - DNA, 21 bp, Artificial Sequence
  Synthetic
gccuaagaccttccuggagag

SEQ ID NO: 79118 - DNA, 28 bp, Artificial Sequence
  Synthetic
gaactcatgtcuacctcgtttgauaagt

SEQ ID NO: 79119 - DNA, 23 bp, Artificial Sequence
  Synthetic
gcattcaaaacuccagcagcauc

SEQ ID NO: 79120 - DNA, 24 bp, Artificial Sequence
  Synthetic
tgaatcacaguaagtcagcagcuc

SEQ ID NO: 79121 - DNA, 27 bp, Artificial Sequence
  Synthetic
gaagttttgtgutctgcttccttucaa

SEQ ID NO: 79122 - DNA, 25 bp, Artificial Sequence
  Synthetic
tgtggataugcgtgaattucgaagt

SEQ ID NO: 79123 - DNA, 25 bp, Artificial Sequence
  Synthetic
cggccgttatutaaagagccgatua

SEQ ID NO: 79124 - DNA, 28 bp, Artificial Sequence
  Synthetic
cactagcaacaacuctatatctggauca

SEQ ID NO: 79125 - DNA, 24 bp, Artificial Sequence
  Synthetic
agctgtgagcugaagatttctucc

SEQ ID NO: 79126 - DNA, 27 bp, Artificial Sequence
  Synthetic
tgtctctggcutctctttttctucaat

SEQ ID NO: 79127 - DNA, 27 bp, Artificial Sequence
  Synthetic
caaactgctcgaaaucttacgcaaaua

SEQ ID NO: 79128 - DNA, 24 bp, Artificial Sequence
  Synthetic
aactgctgucgctcatatggttua

SEQ ID NO: 79129 - DNA, 26 bp, Artificial Sequence
  Synthetic
ggagcugcacaggaaatttttatugt

SEQ ID NO: 79130 - DNA, 21 bp, Artificial Sequence
  Synthetic
ctgtgacucagctcctcctug

SEQ ID NO: 79131 - DNA, 26 bp, Artificial Sequence
  Synthetic
ccctaagtgtccuagacctgtgttua

SEQ ID NO: 79132 - DNA, 23 bp, Artificial Sequence
  Synthetic
ggagcgcaagaguatcagtgaut

SEQ ID NO: 79133 - DNA, 21 bp, Artificial Sequence
  Synthetic
gagaaaggcutgctaggguca

SEQ ID NO: 79134 - DNA, 24 bp, Artificial Sequence
  Synthetic
gttcttctcccutcttctgcaugt

SEQ ID NO: 79135 - DNA, 25 bp, Artificial Sequence
  Synthetic
acaatgtgctuctgcccatcaauat

SEQ ID NO: 79136 - DNA, 21 bp, Artificial Sequence
  Synthetic
cuagagggucagagggcaaag

SEQ ID NO: 79137 - DNA, 28 bp, Artificial Sequence
  Synthetic
aacaucactaatacctugaggaaaaggg

SEQ ID NO: 79138 - DNA, 22 bp, Artificial Sequence
  Synthetic
ggaacaactgugtcagcagcua

SEQ ID NO: 79139 - DNA, 33 bp, Artificial Sequence
  Synthetic
acatccautagttataagtucaaaaacaaacca

SEQ ID NO: 79140 - DNA, 18 bp, Artificial Sequence
  Synthetic
cccgggaugggugaagag

SEQ ID NO: 79141 - DNA, 19 bp, Artificial Sequence
  Synthetic
ctgggugagccttctcgug

SEQ ID NO: 79142 - DNA, 20 bp, Artificial Sequence
  Synthetic
ccaccugactgagaaucgct

SEQ ID NO: 79143 - DNA, 23 bp, Artificial Sequence
  Synthetic
gggatatgccauttggacatgua

SEQ ID NO: 79144 - DNA, 28 bp, Artificial Sequence
  Synthetic
gctcttcacauagtgcatgtatttucct

SEQ ID NO: 79145 - DNA, 20 bp, Artificial Sequence
  Synthetic
agactgtcgugccgtatugg

SEQ ID NO: 79146 - DNA, 22 bp, Artificial Sequence
  Synthetic
gtcccgtgcutctgattgagut

SEQ ID NO: 79147 - DNA, 20 bp, Artificial Sequence
  Synthetic
gggcaccagagaauccguag

SEQ ID NO: 79148 - DNA, 28 bp, Artificial Sequence
  Synthetic
aatgacgctcauaatcttctctaaucgg

SEQ ID NO: 79149 - DNA, 28 bp, Artificial Sequence
  Synthetic
ctgctctcttcuctttatagtgctacut

SEQ ID NO: 79150 - DNA, 20 bp, Artificial Sequence
  Synthetic
acaccagggucccagaacua

SEQ ID NO: 79151 - DNA, 26 bp, Artificial Sequence
  Synthetic
gagccattugagaacaactgaaaucc

SEQ ID NO: 79152 - DNA, 21 bp, Artificial Sequence
  Synthetic
gactttcccacuccttcccut

SEQ ID NO: 79153 - DNA, 19 bp, Artificial Sequence
  Synthetic
gggugaccacagcguagag

SEQ ID NO: 79154 - DNA, 27 bp, Artificial Sequence
  Synthetic
taggaatccgcaaaguattctaagcua

SEQ ID NO: 79155 - DNA, 23 bp, Artificial Sequence
  Synthetic
gtcaccatcucaatgtggucaac

SEQ ID NO: 79156 - DNA, 21 bp, Artificial Sequence
  Synthetic
gtggtcucccataccctcuca

SEQ ID NO: 79157 - DNA, 21 bp, Artificial Sequence
  Synthetic
gtcuaagaggcagccauaggg

SEQ ID NO: 79158 - DNA, 24 bp, Artificial Sequence
  Synthetic
ctaactgctatuctcgggtcauca

SEQ ID NO: 79159 - DNA, 20 bp, Artificial Sequence
  Synthetic
gttgctggcaucctcaaugg

SEQ ID NO: 79160 - DNA, 20 bp, Artificial Sequence
  Synthetic
gaggccaaccucaugaagca

SEQ ID NO: 79161 - DNA, 21 bp, Artificial Sequence
  Synthetic
ggagagcaguatcccctggua

SEQ ID NO: 79162 - DNA, 27 bp, Artificial Sequence
  Synthetic
attctgtcttggugaaatctgguagag

SEQ ID NO: 79163 - DNA, 21 bp, Artificial Sequence
  Synthetic
tgggatcaggcutccacttug

SEQ ID NO: 79164 - DNA, 25 bp, Artificial Sequence
  Synthetic
tcttctuacacttcactuccccaga

SEQ ID NO: 79165 - DNA, 21 bp, Artificial Sequence
  Synthetic
tctctgacucgggaagggtut

SEQ ID NO: 79166 - DNA, 23 bp, Artificial Sequence
  Synthetic
ccctguccataccuaaccaccat

SEQ ID NO: 79167 - DNA, 26 bp, Artificial Sequence
  Synthetic
caaatgatcgcuatctagcaacccua

SEQ ID NO: 79168 - DNA, 21 bp, Artificial Sequence
  Synthetic
cagctggugacacagcttaug

SEQ ID NO: 79169 - DNA, 21 bp, Artificial Sequence
  Synthetic
cctagccccutgtggacauag

SEQ ID NO: 79170 - DNA, 22 bp, Artificial Sequence
  Synthetic
gcttgguacaggcaccuagaag

SEQ ID NO: 79171 - DNA, 29 bp, Artificial Sequence
  Synthetic
tgtccatacctaugatttccctctttgua

SEQ ID NO: 79172 - DNA, 28 bp, Artificial Sequence
  Synthetic
ctaccttctgucttcttgtctattucct

SEQ ID NO: 79173 - DNA, 27 bp, Artificial Sequence
  Synthetic
ttccaaagtcagcuatcttgattgugt

SEQ ID NO: 79174 - DNA, 28 bp, Artificial Sequence
  Synthetic
aggagaggaacucacttacgactauaag

SEQ ID NO: 79175 - DNA, 20 bp, Artificial Sequence
  Synthetic
ccttcagcgutgcttuggat

SEQ ID NO: 79176 - DNA, 24 bp, Artificial Sequence
  Synthetic
ttguacaagagctucaggaagaga

SEQ ID NO: 79177 - DNA, 27 bp, Artificial Sequence
  Synthetic
aaagctgtgugaatgcgtcaaauaaat

SEQ ID NO: 79178 - DNA, 28 bp, Artificial Sequence
  Synthetic
ctgatttgccaacaagauttcttacugt

SEQ ID NO: 79179 - DNA, 22 bp, Artificial Sequence
  Synthetic
gacatugcctcctttugaagcc

SEQ ID NO: 79180 - DNA, 21 bp, Artificial Sequence
  Synthetic
acaggtgtcutgctgggttuc

SEQ ID NO: 79181 - DNA, 25 bp, Artificial Sequence
  Synthetic
gacatcaccutttcgcttttuccaa

SEQ ID NO: 79182 - DNA, 18 bp, Artificial Sequence
  Synthetic
tctcaggucgacggcuga

SEQ ID NO: 79183 - DNA, 18 bp, Artificial Sequence
  Synthetic
cgacggguccccactuac

SEQ ID NO: 79184 - DNA, 27 bp, Artificial Sequence
  Synthetic
aaautatctcacttgucaaggcacaga

SEQ ID NO: 79185 - DNA, 25 bp, Artificial Sequence
  Synthetic
actatagatggugtaacccggagug

SEQ ID NO: 79186 - DNA, 22 bp, Artificial Sequence
  Synthetic
cctcttcugggtctccacucaa

SEQ ID NO: 79187 - DNA, 22 bp, Artificial Sequence
  Synthetic
cctagcccugctgtggauaaag

SEQ ID NO: 79188 - DNA, 26 bp, Artificial Sequence
  Synthetic
acgaaactguttagtggguaagaact

SEQ ID NO: 79189 - DNA, 27 bp, Artificial Sequence
  Synthetic
acagggctttaaaaugctgagaactua

SEQ ID NO: 79190 - DNA, 27 bp, Artificial Sequence
  Synthetic
gcaacaaaatugcttcgtcaucaaaat

SEQ ID NO: 79191 - DNA, 27 bp, Artificial Sequence
  Synthetic
tggacaataaaagaaugaggactgcut

SEQ ID NO: 79192 - DNA, 22 bp, Artificial Sequence
  Synthetic
gcacaggugtacaatcctuggt

SEQ ID NO: 79193 - DNA, 27 bp, Artificial Sequence
  Synthetic
gctttggaagtucagtcaactctttut

SEQ ID NO: 79194 - DNA, 22 bp, Artificial Sequence
  Synthetic
gttcagcaauggtcagcagtuc

SEQ ID NO: 79195 - DNA, 21 bp, Artificial Sequence
  Synthetic
ggaugaggugaaacgcacact

SEQ ID NO: 79196 - DNA, 18 bp, Artificial Sequence
  Synthetic
cgcaugacagccaaggug

SEQ ID NO: 79197 - DNA, 19 bp, Artificial Sequence
  Synthetic
cctccaguccagggcuact

SEQ ID NO: 79198 - DNA, 23 bp, Artificial Sequence
  Synthetic
acctcgaaaugcaaggagaugat

SEQ ID NO: 79199 - DNA, 22 bp, Artificial Sequence
  Synthetic
gtaccactcccuctttgctcug

SEQ ID NO: 79200 - DNA, 19 bp, Artificial Sequence
  Synthetic
ccccucuccaacagggact

SEQ ID NO: 79201 - DNA, 19 bp, Artificial Sequence
  Synthetic
gcccagcugaggagttugt

SEQ ID NO: 79202 - DNA, 28 bp, Artificial Sequence
  Synthetic
aatgttgauaacagccactggaaattug

SEQ ID NO: 79203 - DNA, 24 bp, Artificial Sequence
  Synthetic
cctaacctaggacugactgcatug

SEQ ID NO: 79204 - DNA, 21 bp, Artificial Sequence
  Synthetic
catccuccacggagaagaugt

SEQ ID NO: 79205 - DNA, 20 bp, Artificial Sequence
  Synthetic
tgatgcuggcactccugaag

SEQ ID NO: 79206 - DNA, 23 bp, Artificial Sequence
  Synthetic
tcctagaguaagccagggcttut

SEQ ID NO: 79207 - DNA, 28 bp, Artificial Sequence
  Synthetic
ccattgtgcttgaaugcactagaatcua

SEQ ID NO: 79208 - DNA, 25 bp, Artificial Sequence
  Synthetic
tgttttctttuccctccatggcuat

SEQ ID NO: 79209 - DNA, 21 bp, Artificial Sequence
  Synthetic
gtttggacauggcaagcucag

SEQ ID NO: 79210 - DNA, 21 bp, Artificial Sequence
  Synthetic
cugccctcaauaaggccagat

SEQ ID NO: 79211 - DNA, 22 bp, Artificial Sequence
  Synthetic
gtgtgauggctgtgaugacaac

SEQ ID NO: 79212 - DNA, 20 bp, Artificial Sequence
  Synthetic
ctcaucagcacuccaagcgt

SEQ ID NO: 79213 - DNA, 24 bp, Artificial Sequence
  Synthetic
gagtttggaccugaaaccucacat

SEQ ID NO: 79214 - DNA, 25 bp, Artificial Sequence
  Synthetic
agcaaataaacaugccaaccaaguc

SEQ ID NO: 79215 - DNA, 26 bp, Artificial Sequence
  Synthetic
agaggagaggagacaugaattaccuc

SEQ ID NO: 79216 - DNA, 26 bp, Artificial Sequence
  Synthetic
tggaaagctaguggttcagagttcua

SEQ ID NO: 79217 - DNA, 27 bp, Artificial Sequence
  Synthetic
agcctaaacauccccttaaattggaut

SEQ ID NO: 79218 - DNA, 27 bp, Artificial Sequence
  Synthetic
cttacgctuaactccaactgugaaaaa

SEQ ID NO: 79219 - DNA, 27 bp, Artificial Sequence
  Synthetic
ggacaaactagaguccacagttaagug

SEQ ID NO: 79220 - DNA, 21 bp, Artificial Sequence
  Synthetic
cagcaggcagaagaugtggua

SEQ ID NO: 79221 - DNA, 27 bp, Artificial Sequence
  Synthetic
gatttccaauggagaacttttgctcut

SEQ ID NO: 79222 - DNA, 25 bp, Artificial Sequence
  Synthetic
catagtcattuggcctcctcuaacc

SEQ ID NO: 79223 - DNA, 24 bp, Artificial Sequence
  Synthetic
gtgtcaaacaccaugaatgagcut

SEQ ID NO: 79224 - DNA, 21 bp, Artificial Sequence
  Synthetic
gtcgagccucatctgagagug

SEQ ID NO: 79225 - DNA, 24 bp, Artificial Sequence
  Synthetic
ctcacctugcacttctctcaucat

SEQ ID NO: 79226 - DNA, 24 bp, Artificial Sequence
  Synthetic
cgttgttacuttggatcugaagga

SEQ ID NO: 79227 - DNA, 27 bp, Artificial Sequence
  Synthetic
actcaccagaagcuctttatacttugg

SEQ ID NO: 79228 - DNA, 25 bp, Artificial Sequence
  Synthetic
cctuacgaaggatgaauccaaaagg

SEQ ID NO: 79229 - DNA, 22 bp, Artificial Sequence
  Synthetic
ccactgcutgcttagugaacca

SEQ ID NO: 79230 - DNA, 21 bp, Artificial Sequence
  Synthetic
cctataagcugcctgcaguct

SEQ ID NO: 79231 - DNA, 24 bp, Artificial Sequence
  Synthetic
tccaautatauagggcaggccaac

SEQ ID NO: 79232 - DNA, 29 bp, Artificial Sequence
  Synthetic
ggctatgtattucttttgtgtgttugaga

SEQ ID NO: 79233 - DNA, 27 bp, Artificial Sequence
  Synthetic
aacctttgtgauaaacgaaccacuaga

SEQ ID NO: 79234 - DNA, 27 bp, Artificial Sequence
  Synthetic
ccacagctgtauagaaaattctgggut

SEQ ID NO: 79235 - DNA, 25 bp, Artificial Sequence
  Synthetic
ctaacctttuacccacccacauacc

SEQ ID NO: 79236 - DNA, 26 bp, Artificial Sequence
  Synthetic
gccatctgacaucttttcccagtuat

SEQ ID NO: 79237 - DNA, 27 bp, Artificial Sequence
  Synthetic
tttctgttagauccaccagatacucct

SEQ ID NO: 79238 - DNA, 21 bp, Artificial Sequence
  Synthetic
ctgtttuggcaggacagugag

SEQ ID NO: 79239 - DNA, 27 bp, Artificial Sequence
  Synthetic
ccgttatattgtuctcctgtgtctgut

SEQ ID NO: 79240 - DNA, 20 bp, Artificial Sequence
  Synthetic
cttgacccccaucccttcut

SEQ ID NO: 79241 - DNA, 19 bp, Artificial Sequence
  Synthetic
ttggctacaugccgcugat

SEQ ID NO: 79242 - DNA, 19 bp, Artificial Sequence
  Synthetic
ccccaaacacaugcagugg

SEQ ID NO: 79243 - DNA, 19 bp, Artificial Sequence
  Synthetic
tcggaggaugggcugagat

SEQ ID NO: 79244 - DNA, 20 bp, Artificial Sequence
  Synthetic
gggtuccccaccagaaaaug

SEQ ID NO: 79245 - DNA, 19 bp, Artificial Sequence
  Synthetic
acaucctcguggagagcga

SEQ ID NO: 79246 - DNA, 20 bp, Artificial Sequence
  Synthetic
gccgaagucagcgatctuga

SEQ ID NO: 79247 - DNA, 21 bp, Artificial Sequence
  Synthetic
gggtaccugccggattaucct

SEQ ID NO: 79248 - DNA, 17 bp, Artificial Sequence
  Synthetic
tcucugggaccgggcat

SEQ ID NO: 79249 - DNA, 20 bp, Artificial Sequence
  Synthetic
cgagacguccggctttctuc

SEQ ID NO: 79250 - DNA, 21 bp, Artificial Sequence
  Synthetic
cctcagccacugttaggguct

SEQ ID NO: 79251 - DNA, 26 bp, Artificial Sequence
  Synthetic
gcagcctgaatuatgatcctttccua

SEQ ID NO: 79252 - DNA, 28 bp, Artificial Sequence
  Synthetic
tcttaagatgctuttgtgtgactcuaaa

SEQ ID NO: 79253 - DNA, 28 bp, Artificial Sequence
  Synthetic
ccatgaagtgaucggaatacatguagaa

SEQ ID NO: 79254 - DNA, 17 bp, Artificial Sequence
  Synthetic
agggcugcggagaucct

SEQ ID NO: 79255 - DNA, 21 bp, Artificial Sequence
  Synthetic
gcagctacutccagagctuca

SEQ ID NO: 79256 - DNA, 21 bp, Artificial Sequence
  Synthetic
gggctccugttcctctguagt

SEQ ID NO: 79257 - DNA, 26 bp, Artificial Sequence
  Synthetic
tctggaagaaagutcccttcattcuc

SEQ ID NO: 79258 - DNA, 23 bp, Artificial Sequence
  Synthetic
cgacatcaguaattgctcugcca

SEQ ID NO: 79259 - DNA, 27 bp, Artificial Sequence
  Synthetic
acccaaaggaagaagaauttaggtugt

SEQ ID NO: 79260 - DNA, 21 bp, Artificial Sequence
  Synthetic
gtctgguccacattgctcuca

SEQ ID NO: 79261 - DNA, 20 bp, Artificial Sequence
  Synthetic
gctgtccccucaccatucag

SEQ ID NO: 79262 - DNA, 22 bp, Artificial Sequence
  Synthetic
gggtagguggttctccaugact

SEQ ID NO: 79263 - DNA, 21 bp, Artificial Sequence
  Synthetic
catttuggaagccccagcauc

SEQ ID NO: 79264 - DNA, 28 bp, Artificial Sequence
  Synthetic
tcattttgugaacacactggtaaguaca

SEQ ID NO: 79265 - DNA, 20 bp, Artificial Sequence
  Synthetic
cccttuacgctgcgttugat

SEQ ID NO: 79266 - DNA, 21 bp, Artificial Sequence
  Synthetic
agaggccagaggacutcucat

SEQ ID NO: 79267 - DNA, 24 bp, Artificial Sequence
  Synthetic
guatcttccauccccaccagaaac

SEQ ID NO: 79268 - DNA, 21 bp, Artificial Sequence
  Synthetic
gttaccggcacugcguaaaat

SEQ ID NO: 79269 - DNA, 28 bp, Artificial Sequence
  Synthetic
cgttccttttuggcagtcaagttttuaa

SEQ ID NO: 79270 - DNA, 18 bp, Artificial Sequence
  Synthetic
ccgggucugaaccccaaa

SEQ ID NO: 79271 - DNA, 18 bp, Artificial Sequence
  Synthetic
ggacgtgcuccccatgug

SEQ ID NO: 79272 - DNA, 22 bp, Artificial Sequence
  Synthetic
gatctggagcucctggaagaug

SEQ ID NO: 79273 - DNA, 21 bp, Artificial Sequence
  Synthetic
cgagccuggagtttgcaugaa

SEQ ID NO: 79274 - DNA, 21 bp, Artificial Sequence
  Synthetic
gtgauaggagcccatguacgg

SEQ ID NO: 79275 - DNA, 23 bp, Artificial Sequence
  Synthetic
cgcccuccgttactactaugaca

SEQ ID NO: 79276 - DNA, 27 bp, Artificial Sequence
  Synthetic
ttacuaggaaatcatcucagcagagaa

SEQ ID NO: 79277 - DNA, 21 bp, Artificial Sequence
  Synthetic
gauccacagctctuacagcga

SEQ ID NO: 79278 - DNA, 28 bp, Artificial Sequence
  Synthetic
agtugaaaaccgaagatuagaggaacaa

SEQ ID NO: 79279 - DNA, 23 bp, Artificial Sequence
  Synthetic
cacacttaccaguctgtgcugaa

SEQ ID NO: 79280 - DNA, 29 bp, Artificial Sequence
  Synthetic
cttcttttctagauctgtaccaagtgugt

SEQ ID NO: 79281 - DNA, 21 bp, Artificial Sequence
  Synthetic
ctccgaaagcuggcaaaacug

SEQ ID NO: 79282 - DNA, 28 bp, Artificial Sequence
  Synthetic
ctagtccgtcucatcaaatacacacaut

SEQ ID NO: 79283 - DNA, 31 bp, Artificial Sequence
  Synthetic
aaacaacctatagtuccttttctacatctuc

SEQ ID NO: 79284 - DNA, 24 bp, Artificial Sequence
  Synthetic
catggacctuggtcatgatgtuct

SEQ ID NO: 79285 - DNA, 20 bp, Artificial Sequence
  Synthetic
tccaacuccagctgcaucac

SEQ ID NO: 79286 - DNA, 22 bp, Artificial Sequence
  Synthetic
caggagcugaggtcugaacaat

SEQ ID NO: 79287 - DNA, 21 bp, Artificial Sequence
  Synthetic
tgaccaucaagcctgcttcut

SEQ ID NO: 79288 - DNA, 27 bp, Artificial Sequence
  Synthetic
gggtgtgtaugtgtgaatatttucaga

SEQ ID NO: 79289 - DNA, 23 bp, Artificial Sequence
  Synthetic
cccaacatucacttcctgctugt

SEQ ID NO: 79290 - DNA, 27 bp, Artificial Sequence
  Synthetic
actcaggatuggaagatactguagagg

SEQ ID NO: 79291 - DNA, 28 bp, Artificial Sequence
  Synthetic
tctgguaaggaccattagacauaagaca

SEQ ID NO: 79292 - DNA, 17 bp, Artificial Sequence
  Synthetic
cggcgacgcutggugat

SEQ ID NO: 79293 - DNA, 18 bp, Artificial Sequence
  Synthetic
cagccgcugcaaagctuc

SEQ ID NO: 79294 - DNA, 22 bp, Artificial Sequence
  Synthetic
gcaggcutgatggucagaaaga

SEQ ID NO: 79295 - DNA, 21 bp, Artificial Sequence
  Synthetic
ccctttcuccactctgacucc

SEQ ID NO: 79296 - DNA, 20 bp, Artificial Sequence
  Synthetic
ccactgucacaactgtugct

SEQ ID NO: 79297 - DNA, 18 bp, Artificial Sequence
  Synthetic
cacccauccccaccacug

SEQ ID NO: 79298 - DNA, 17 bp, Artificial Sequence
  Synthetic
ccgcgaaagcugucgaa

SEQ ID NO: 79299 - DNA, 22 bp, Artificial Sequence
  Synthetic
ctcgaggauctgtactggaugg

SEQ ID NO: 79300 - DNA, 21 bp, Artificial Sequence
  Synthetic
cggttccaagccautctggut

SEQ ID NO: 79301 - DNA, 22 bp, Artificial Sequence
  Synthetic
ggagcuagagccaaagagggua

SEQ ID NO: 79302 - DNA, 22 bp, Artificial Sequence
  Synthetic
ggttcatcugctggtagtugct

SEQ ID NO: 79303 - DNA, 17 bp, Artificial Sequence
  Synthetic
ggctcggugtccuccac

SEQ ID NO: 79304 - DNA, 17 bp, Artificial Sequence
  Synthetic
tggcccugagctccgua

SEQ ID NO: 79305 - DNA, 25 bp, Artificial Sequence
  Synthetic
tgtctttcugcctgtctgtaaucac

SEQ ID NO: 79306 - DNA, 28 bp, Artificial Sequence
  Synthetic
ccagaatucacgagaggatagtaucagt

SEQ ID NO: 79307 - DNA, 24 bp, Artificial Sequence
  Synthetic
gataccaaguagctgccagttuct

SEQ ID NO: 79308 - DNA, 26 bp, Artificial Sequence
  Synthetic
atttcacttttcutctcctcguggat

SEQ ID NO: 79309 - DNA, 22 bp, Artificial Sequence
  Synthetic
ggctttggutcggtauggaaag

SEQ ID NO: 79310 - DNA, 20 bp, Artificial Sequence
  Synthetic
gagcuacacggagtgcugag

SEQ ID NO: 79311 - DNA, 17 bp, Artificial Sequence
  Synthetic
ccgcuggccatggagua

SEQ ID NO: 79312 - DNA, 24 bp, Artificial Sequence
  Synthetic
tgcaaauaaaggcacaccugaaga

SEQ ID NO: 79313 - DNA, 29 bp, Artificial Sequence
  Synthetic
gtctatgccaaaauaagtttccagttuca

SEQ ID NO: 79314 - DNA, 22 bp, Artificial Sequence
  Synthetic
ccatagcaugcaggaagcacua

SEQ ID NO: 79315 - DNA, 22 bp, Artificial Sequence
  Synthetic
aatcccugtggatcugaaacgg

SEQ ID NO: 79316 - DNA, 23 bp, Artificial Sequence
  Synthetic
caggtcgaagucgttgacauact

SEQ ID NO: 79317 - DNA, 19 bp, Artificial Sequence
  Synthetic
gctcttcuccgctctuccc

SEQ ID NO: 79318 - DNA, 24 bp, Artificial Sequence
  Synthetic
gtcgaagucgttgacatacuccat

SEQ ID NO: 79319 - DNA, 18 bp, Artificial Sequence
  Synthetic
ccagctcutctccgcuct

SEQ ID NO: 79320 - DNA, 21 bp, Artificial Sequence
  Synthetic
tcatcttgaacuccccgtugg

SEQ ID NO: 79321 - DNA, 22 bp, Artificial Sequence
  Synthetic
aacctgtgcucactggagttut

SEQ ID NO: 79322 - DNA, 21 bp, Artificial Sequence
  Synthetic
cgagacgcaagutaggucact

SEQ ID NO: 79323 - DNA, 23 bp, Artificial Sequence
  Synthetic
agaacauccagaggaacaagcug

SEQ ID NO: 79324 - DNA, 25 bp, Artificial Sequence
  Synthetic
cacgagtacuataacgttgcaucct

SEQ ID NO: 79325 - DNA, 26 bp, Artificial Sequence
  Synthetic
ggaggaaagttuccagagatagaugg

SEQ ID NO: 79326 - DNA, 25 bp, Artificial Sequence
  Synthetic
gggaaggaagacutgcttucaaact

SEQ ID NO: 79327 - DNA, 25 bp, Artificial Sequence
  Synthetic
gacagctatcugctggtgtaacaut

SEQ ID NO: 79328 - DNA, 26 bp, Artificial Sequence
  Synthetic
ttgttgcagacaaaaugaacactugt

SEQ ID NO: 79329 - DNA, 27 bp, Artificial Sequence
  Synthetic
gggaagaccuttttaacaacacuacct

SEQ ID NO: 79330 - DNA, 23 bp, Artificial Sequence
  Synthetic
tggcucaccgaaaagtaaauccc

SEQ ID NO: 79331 - DNA, 27 bp, Artificial Sequence
  Synthetic
gcttcctccuggttatgtagtaaauca

SEQ ID NO: 79332 - DNA, 25 bp, Artificial Sequence
  Synthetic
caccatccugggtctcaauaaagag

SEQ ID NO: 79333 - DNA, 24 bp, Artificial Sequence
  Synthetic
cccagaagagutggatguaaccag

SEQ ID NO: 79334 - DNA, 23 bp, Artificial Sequence
  Synthetic
ctctagatgatuccagtgcccut

SEQ ID NO: 79335 - DNA, 27 bp, Artificial Sequence
  Synthetic
tccctaggauggcttataaacaugact

SEQ ID NO: 79336 - DNA, 22 bp, Artificial Sequence
  Synthetic
cctaccugcagaagcaagcuaa

SEQ ID NO: 79337 - DNA, 28 bp, Artificial Sequence
  Synthetic
aatctactcccugagaaagagttguact

SEQ ID NO: 79338 - DNA, 25 bp, Artificial Sequence
  Synthetic
actgtgatguccattgtgactaucc

SEQ ID NO: 79339 - DNA, 25 bp, Artificial Sequence
  Synthetic
agactgctgaagutcttctttgucc

SEQ ID NO: 79340 - DNA, 27 bp, Artificial Sequence
  Synthetic
tcccatttatcugtgttgcttttguct

SEQ ID NO: 79341 - DNA, 27 bp, Artificial Sequence
  Synthetic
actgtaatcugtatcgcctuggaaaaa

SEQ ID NO: 79342 - DNA, 24 bp, Artificial Sequence
  Synthetic
gggaucaaatatugacaccaccat

SEQ ID NO: 79343 - DNA, 24 bp, Artificial Sequence
  Synthetic
gccttgaatgaautccagcaguga

SEQ ID NO: 79344 - DNA, 25 bp, Artificial Sequence
  Synthetic
ccattcacaucctggtaauccaagt

SEQ ID NO: 79345 - DNA, 29 bp, Artificial Sequence
  Synthetic
tgtctctacuggcacattacttctacuaa

SEQ ID NO: 79346 - DNA, 24 bp, Artificial Sequence
  Synthetic
ggacaaagaagaacutcagcaguc

SEQ ID NO: 79347 - DNA, 28 bp, Artificial Sequence
  Synthetic
gccacataaacaauccatgaccaguaat

SEQ ID NO: 79348 - DNA, 22 bp, Artificial Sequence
  Synthetic
gctcaccaugcttcatgtcaut

SEQ ID NO: 79349 - DNA, 26 bp, Artificial Sequence
  Synthetic
gtgcagtactatutcacaggcatcua

SEQ ID NO: 79350 - DNA, 23 bp, Artificial Sequence
  Synthetic
gacagtggagagauggcagaauc

SEQ ID NO: 79351 - DNA, 24 bp, Artificial Sequence
  Synthetic
gctagccacugtgagctagtcaua

SEQ ID NO: 79352 - DNA, 20 bp, Artificial Sequence
  Synthetic
gcttcggucctcagcccuat

SEQ ID NO: 79353 - DNA, 28 bp, Artificial Sequence
  Synthetic
atttgctgtttacucctcttctcttuct

SEQ ID NO: 79354 - DNA, 26 bp, Artificial Sequence
  Synthetic
aagcaccacaauactaacaagugaca

SEQ ID NO: 79355 - DNA, 24 bp, Artificial Sequence
  Synthetic
aattccagcuctttcacatgguga

SEQ ID NO: 79356 - DNA, 28 bp, Artificial Sequence
  Synthetic
ggatttatcctgutggtctagttctugt

SEQ ID NO: 79357 - DNA, 20 bp, Artificial Sequence
  Synthetic
ctgtccgucgtgacacugag

SEQ ID NO: 79358 - DNA, 26 bp, Artificial Sequence
  Synthetic
cctgatctgtcuctctctgtctctuc

SEQ ID NO: 79359 - DNA, 27 bp, Artificial Sequence
  Synthetic
gggagtacuagaaaaggaaaggctuac

SEQ ID NO: 79360 - DNA, 28 bp, Artificial Sequence
  Synthetic
cctctggttcugttttatactgtuagct

SEQ ID NO: 79361 - DNA, 24 bp, Artificial Sequence
  Synthetic
tctatggcctucagaatgctcuct

SEQ ID NO: 79362 - DNA, 22 bp, Artificial Sequence
  Synthetic
gcaguatctaccuggagcacac

SEQ ID NO: 79363 - DNA, 25 bp, Artificial Sequence
  Synthetic
agggaaaaacuggaggaaagaacuc

SEQ ID NO: 79364 - DNA, 20 bp, Artificial Sequence
  Synthetic
gggctucacaaaggucagag

SEQ ID NO: 79365 - DNA, 23 bp, Artificial Sequence
  Synthetic
ccccctgtgutactgaattgcua

SEQ ID NO: 79366 - DNA, 28 bp, Artificial Sequence
  Synthetic
tggacaacagucaaacaacaattcttug

SEQ ID NO: 79367 - DNA, 28 bp, Artificial Sequence
  Synthetic
aggcattagaaagccugtagttttacut

SEQ ID NO: 79368 - DNA, 22 bp, Artificial Sequence
  Synthetic
ggtgucaaggagcagaagctut

SEQ ID NO: 79369 - DNA, 28 bp, Artificial Sequence
  Synthetic
tgctctccttttuctgagtacttttcuc

SEQ ID NO: 79370 - DNA, 20 bp, Artificial Sequence
  Synthetic
gcagctgcuagaggccttut

SEQ ID NO: 79371 - DNA, 22 bp, Artificial Sequence
  Synthetic
ttcctttccuccctgtauggga

SEQ ID NO: 79372 - DNA, 22 bp, Artificial Sequence
  Synthetic
cgcatgctttucccgtcttcua

SEQ ID NO: 79373 - DNA, 28 bp, Artificial Sequence
  Synthetic
gtaatccaaaguccacttcttgaaguga

SEQ ID NO: 79374 - DNA, 21 bp, Artificial Sequence
  Synthetic
cgggcuccatcaacaucacag

SEQ ID NO: 79375 - DNA, 20 bp, Artificial Sequence
  Synthetic
ccactagcccacuccagcua

SEQ ID NO: 79376 - DNA, 22 bp, Artificial Sequence
  Synthetic
cagaaucagaacggacauccca

SEQ ID NO: 79377 - DNA, 24 bp, Artificial Sequence
  Synthetic
gcaccgucaatatgtttccugaag

SEQ ID NO: 79378 - DNA, 27 bp, Artificial Sequence
  Synthetic
tctccuagaggacagtaatcttugcat

SEQ ID NO: 79379 - DNA, 22 bp, Artificial Sequence
  Synthetic
cutgcucaagacaggaagacca

SEQ ID NO: 79380 - DNA, 24 bp, Artificial Sequence
  Synthetic
tcaaaggauttgctcucacacgaa

SEQ ID NO: 79381 - DNA, 28 bp, Artificial Sequence
  Synthetic
agaaaaacctuttgttgctttuggaagt

SEQ ID NO: 79382 - DNA, 22 bp, Artificial Sequence
  Synthetic
ctgaccacgcaaugtctttuct

SEQ ID NO: 79383 - DNA, 27 bp, Artificial Sequence
  Synthetic
gaaattgaaugccaccatgttctcuaa

SEQ ID NO: 79384 - DNA, 21 bp, Artificial Sequence
  Synthetic
ttccaccagagautccaugcc

SEQ ID NO: 79385 - DNA, 21 bp, Artificial Sequence
  Synthetic
tgcagctacucagacccucaa

SEQ ID NO: 79386 - DNA, 18 bp, Artificial Sequence
  Synthetic
catgcagagguccucggt

SEQ ID NO: 79387 - DNA, 25 bp, Artificial Sequence
  Synthetic
ggatcaguactccagugagaagaca

SEQ ID NO: 79388 - DNA, 26 bp, Artificial Sequence
  Synthetic
tgtttgttgtttugcttttcgtgtug

SEQ ID NO: 79389 - DNA, 28 bp, Artificial Sequence
  Synthetic
caggtttgtgcugttctaaaaatgagut

SEQ ID NO: 79390 - DNA, 26 bp, Artificial Sequence
  Synthetic
ggcautacctuaaccaaagagagcaa

SEQ ID NO: 79391 - DNA, 25 bp, Artificial Sequence
  Synthetic
acttagaatcuccatggcuaggact

SEQ ID NO: 79392 - DNA, 24 bp, Artificial Sequence
  Synthetic
tccaggcugtaaacttuggaaagg

SEQ ID NO: 79393 - DNA, 21 bp, Artificial Sequence
  Synthetic
cagctguggcaatttctggug

SEQ ID NO: 79394 - DNA, 22 bp, Artificial Sequence
  Synthetic
cccagtctuacgtgttgcctut

SEQ ID NO: 79395 - DNA, 22 bp, Artificial Sequence
  Synthetic
accatgccutatggacuggaga

SEQ ID NO: 79396 - DNA, 23 bp, Artificial Sequence
  Synthetic
tcagtgctgtutgagggaactut

SEQ ID NO: 79397 - DNA, 28 bp, Artificial Sequence
  Synthetic
ctcaaaatagaacaagutgttgggaugg

SEQ ID NO: 79398 - DNA, 23 bp, Artificial Sequence
  Synthetic
catttgutgggtcauccagcaag

SEQ ID NO: 79399 - DNA, 23 bp, Artificial Sequence
  Synthetic
cacaaaccccacaccucctatut

SEQ ID NO: 79400 - DNA, 28 bp, Artificial Sequence
  Synthetic
ctccatgatcaaaaugtcatttgtgcua

SEQ ID NO: 79401 - DNA, 25 bp, Artificial Sequence
  Synthetic
gcagacagauctacgttugagaacc

SEQ ID NO: 79402 - DNA, 27 bp, Artificial Sequence
  Synthetic
tgtctctttaggutccatgtagcagua

SEQ ID NO: 79403 - DNA, 28 bp, Artificial Sequence
  Synthetic
ggcattttagtucctttagacatgcaut

SEQ ID NO: 79404 - DNA, 27 bp, Artificial Sequence
  Synthetic
atgcttgctauacagactgctatacug

SEQ ID NO: 79405 - DNA, 28 bp, Artificial Sequence
  Synthetic
ccttgtcaaaaggutttccaatagcaut

SEQ ID NO: 79406 - DNA, 27 bp, Artificial Sequence
  Synthetic
ttcaaagaagugagtttggactuacga

SEQ ID NO: 79407 - DNA, 24 bp, Artificial Sequence
  Synthetic
agggaactuagcagagagcaaaug

SEQ ID NO: 79408 - DNA, 27 bp, Artificial Sequence
  Synthetic
acgagcttgttuaaggtatgccttuat

SEQ ID NO: 79409 - DNA, 28 bp, Artificial Sequence
  Synthetic
tgcttaatctgcuattcttgcttuaggg

SEQ ID NO: 79410 - DNA, 29 bp, Artificial Sequence
  Synthetic
tcactgtccacaauttcattcaaguagaa

SEQ ID NO: 79411 - DNA, 28 bp, Artificial Sequence
  Synthetic
gcaatgtactaugtaggtctttcgugaa

SEQ ID NO: 79412 - DNA, 21 bp, Artificial Sequence
  Synthetic
ggccaagcutgtaccatguga

SEQ ID NO: 79413 - DNA, 28 bp, Artificial Sequence
  Synthetic
accattcaataacuatggcctcttcaut

SEQ ID NO: 79414 - DNA, 21 bp, Artificial Sequence
  Synthetic
gatgacggcagaugctgttug

SEQ ID NO: 79415 - DNA, 22 bp, Artificial Sequence
  Synthetic
acaggttccaguacccacatug

SEQ ID NO: 79416 - DNA, 28 bp, Artificial Sequence
  Synthetic
tgatctgctutttgtcactaaugagagt

SEQ ID NO: 79417 - DNA, 25 bp, Artificial Sequence
  Synthetic
caggtcctccautttgtactgtuct

SEQ ID NO: 79418 - DNA, 25 bp, Artificial Sequence
  Synthetic
gaaacttggaaaacuttgtggugct

SEQ ID NO: 79419 - DNA, 23 bp, Artificial Sequence
  Synthetic
gcaaacacugctgcttcauaacc

SEQ ID NO: 79420 - DNA, 21 bp, Artificial Sequence
  Synthetic
aagcagcacgggugtaactua

SEQ ID NO: 79421 - DNA, 29 bp, Artificial Sequence
  Synthetic
cctttcactctgutttcttttctcttcug

SEQ ID NO: 79422 - DNA, 24 bp, Artificial Sequence
  Synthetic
tgggtcaacagguttgttcaguag

SEQ ID NO: 79423 - DNA, 26 bp, Artificial Sequence
  Synthetic
cagcaatcacugttgaatcagcaaut

SEQ ID NO: 79424 - DNA, 20 bp, Artificial Sequence
  Synthetic
tgtcgcuacctcagttugcc

SEQ ID NO: 79425 - DNA, 24 bp, Artificial Sequence
  Synthetic
ggtatttggttucccagtccacua

SEQ ID NO: 79426 - DNA, 26 bp, Artificial Sequence
  Synthetic
ccagaaggauaaacagcatacgcuat

SEQ ID NO: 79427 - DNA, 25 bp, Artificial Sequence
  Synthetic
ggtggaaacgutctctacuacgaag

SEQ ID NO: 79428 - DNA, 22 bp, Artificial Sequence
  Synthetic
agaggttggguctgccagatua

SEQ ID NO: 79429 - DNA, 23 bp, Artificial Sequence
  Synthetic
cacaucagcaaaaccatctuggt

SEQ ID NO: 79430 - DNA, 23 bp, Artificial Sequence
  Synthetic
gcaactggacauccttttgtuca

SEQ ID NO: 79431 - DNA, 28 bp, Artificial Sequence
  Synthetic
acctagcaatguctatcagactctttua

SEQ ID NO: 79432 - DNA, 22 bp, Artificial Sequence
  Synthetic
gctcatgtuggagacgtcagua

SEQ ID NO: 79433 - DNA, 21 bp, Artificial Sequence
  Synthetic
ggtcctgcugtgtggtuagac

SEQ ID NO: 79434 - DNA, 21 bp, Artificial Sequence
  Synthetic
tggtgagccagaauggaacug

SEQ ID NO: 79435 - DNA, 28 bp, Artificial Sequence
  Synthetic
aatgtatgcattuatgctctgagguagg

SEQ ID NO: 79436 - DNA, 25 bp, Artificial Sequence
  Synthetic
ggacacacgaaggcauatattuggt

SEQ ID NO: 79437 - DNA, 24 bp, Artificial Sequence
  Synthetic
gctcttcguagtggtgcattuagg

SEQ ID NO: 79438 - DNA, 20 bp, Artificial Sequence
  Synthetic
acugacagaucggacggaca

SEQ ID NO: 79439 - DNA, 22 bp, Artificial Sequence
  Synthetic
ccaauacagccccttcttucca

SEQ ID NO: 79440 - DNA, 25 bp, Artificial Sequence
  Synthetic
ctgtagagtcugcttctttcccauc

SEQ ID NO: 79441 - DNA, 24 bp, Artificial Sequence
  Synthetic
gcttttcctuccccctttctctuc

SEQ ID NO: 79442 - DNA, 25 bp, Artificial Sequence
  Synthetic
ccttgttgaugggaaaagccaauaa

SEQ ID NO: 79443 - DNA, 21 bp, Artificial Sequence
  Synthetic
gtggttguctgctcaguggat

SEQ ID NO: 79444 - DNA, 23 bp, Artificial Sequence
  Synthetic
cagaagacgauatccccacacug

SEQ ID NO: 79445 - DNA, 28 bp, Artificial Sequence
  Synthetic
agaaattgtgacauatccctctccuact

SEQ ID NO: 79446 - DNA, 23 bp, Artificial Sequence
  Synthetic
attgcaugacaggaaauggaggt

SEQ ID NO: 79447 - DNA, 25 bp, Artificial Sequence
  Synthetic
ccagaugagagtcgatuagggaaag

SEQ ID NO: 79448 - DNA, 20 bp, Artificial Sequence
  Synthetic
ccccagcagaggutcuagac

SEQ ID NO: 79449 - DNA, 25 bp, Artificial Sequence
  Synthetic
gttacagtctcucttctgcctccua

SEQ ID NO: 79450 - DNA, 22 bp, Artificial Sequence
  Synthetic
atgggagcucttcctgatcuga

SEQ ID NO: 79451 - DNA, 25 bp, Artificial Sequence
  Synthetic
cctgctttattugggtactccugac

SEQ ID NO: 79452 - DNA, 22 bp, Artificial Sequence
  Synthetic
ccaagatucccagtcaccauca

SEQ ID NO: 79453 - DNA, 24 bp, Artificial Sequence
  Synthetic
ggtgaaatacutggctacctugga

SEQ ID NO: 79454 - DNA, 24 bp, Artificial Sequence
  Synthetic
gctgagacccaaaacutgtcttut

SEQ ID NO: 79455 - DNA, 22 bp, Artificial Sequence
  Synthetic
gcccctccaccuctgaaagaua

SEQ ID NO: 79456 - DNA, 24 bp, Artificial Sequence
  Synthetic
gggaattcaggcutcatttggaug

SEQ ID NO: 79457 - DNA, 27 bp, Artificial Sequence
  Synthetic
actcaacaatgtautcagcaagtccut

SEQ ID NO: 79458 - DNA, 20 bp, Artificial Sequence
  Synthetic
ggtcgcugggatcaccaaut

SEQ ID NO: 79459 - DNA, 21 bp, Artificial Sequence
  Synthetic
ccagcaguccattcauccagt

SEQ ID NO: 79460 - DNA, 26 bp, Artificial Sequence
  Synthetic
cagcaccgtaaugttttgtcaaagut

SEQ ID NO: 79461 - DNA, 23 bp, Artificial Sequence
  Synthetic
gtccaucagacagaggaacctuc

SEQ ID NO: 79462 - DNA, 21 bp, Artificial Sequence
  Synthetic
cagggtcauctgtcagcauct

SEQ ID NO: 79463 - DNA, 24 bp, Artificial Sequence
  Synthetic
tggctcaaagcugaaagcaauagt

SEQ ID NO: 79464 - DNA, 26 bp, Artificial Sequence
  Synthetic
aacattatttauccgcatcctgguga

SEQ ID NO: 79465 - DNA, 28 bp, Artificial Sequence
  Synthetic
acatgtggattcauggacttagattugt

SEQ ID NO: 79466 - DNA, 29 bp, Artificial Sequence
  Synthetic
gctaataaugagaggaatggaaagaugct

SEQ ID NO: 79467 - DNA, 23 bp, Artificial Sequence
  Synthetic
ggauttgtagctucccgcagaaa

SEQ ID NO: 79468 - DNA, 28 bp, Artificial Sequence
  Synthetic
agctgcagautatgaaattuaacagggt

SEQ ID NO: 79469 - DNA, 25 bp, Artificial Sequence
  Synthetic
gggaauagggctgttctugacaaaa

SEQ ID NO: 79470 - DNA, 22 bp, Artificial Sequence
  Synthetic
gtctccagggcagutagaacut

SEQ ID NO: 79471 - DNA, 24 bp, Artificial Sequence
  Synthetic
tctatcugggtctgcuaacagact

SEQ ID NO: 79472 - DNA, 23 bp, Artificial Sequence
  Synthetic
gacagaggaagauggucccaaag

SEQ ID NO: 79473 - DNA, 28 bp, Artificial Sequence
  Synthetic
caacagaagtauaagaatggctgucaca

SEQ ID NO: 79474 - DNA, 21 bp, Artificial Sequence
  Synthetic
agacatgaggutcaccgcauc

SEQ ID NO: 79475 - DNA, 22 bp, Artificial Sequence
  Synthetic
gcagttacugccctctcctuac

SEQ ID NO: 79476 - DNA, 23 bp, Artificial Sequence
  Synthetic
tggatttcctcugcctggaatug

SEQ ID NO: 79477 - DNA, 27 bp, Artificial Sequence
  Synthetic
ctgttaggcaagaaautcctggtttut

SEQ ID NO: 79478 - DNA, 22 bp, Artificial Sequence
  Synthetic
cataatcaguaccacggccugt

SEQ ID NO: 79479 - DNA, 28 bp, Artificial Sequence
  Synthetic
tgcagttgactuattcagcatattcugt

SEQ ID NO: 79480 - DNA, 25 bp, Artificial Sequence
  Synthetic
ggttactttgugggagacttucacc

SEQ ID NO: 79481 - DNA, 26 bp, Artificial Sequence
  Synthetic
atccattcauccccaacagttctuac

SEQ ID NO: 79482 - DNA, 26 bp, Artificial Sequence
  Synthetic
ttctgacttttcutctcaggactgug

SEQ ID NO: 79483 - DNA, 22 bp, Artificial Sequence
  Synthetic
aagtgcggtucattagggctua

SEQ ID NO: 79484 - DNA, 26 bp, Artificial Sequence
  Synthetic
tgcauagatcactttuacaaggccaa

SEQ ID NO: 79485 - DNA, 25 bp, Artificial Sequence
  Synthetic
cttaccttcuccaggctttuacaca

SEQ ID NO: 79486 - DNA, 27 bp, Artificial Sequence
  Synthetic
cttccuaaggagaaagagcttatuggt

SEQ ID NO: 79487 - DNA, 24 bp, Artificial Sequence
  Synthetic
agtgaattcugctgtgcuaagagg

SEQ ID NO: 79488 - DNA, 23 bp, Artificial Sequence
  Synthetic
gagutggaaactcuggagagcaa

SEQ ID NO: 79489 - DNA, 25 bp, Artificial Sequence
  Synthetic
tctgaagaaggugguaaaggaaacc

SEQ ID NO: 79490 - DNA, 19 bp, Artificial Sequence
  Synthetic
ccacacugacgtgcctcuc

SEQ ID NO: 79491 - DNA, 23 bp, Artificial Sequence
  Synthetic
gtctttgtgtucccggacauagt

SEQ ID NO: 79492 - DNA, 24 bp, Artificial Sequence
  Synthetic
agatagcugatttccccucaacct

SEQ ID NO: 79493 - DNA, 25 bp, Artificial Sequence
  Synthetic
ggaaatactgauctccatcctccug

SEQ ID NO: 79494 - DNA, 23 bp, Artificial Sequence
  Synthetic
gaacaucactccucaacccaagt

SEQ ID NO: 79495 - DNA, 21 bp, Artificial Sequence
  Synthetic
actuaccaacacacggccauc

SEQ ID NO: 79496 - DNA, 26 bp, Artificial Sequence
  Synthetic
tgatagtautgtagtgguaggaggca

SEQ ID NO: 79497 - DNA, 28 bp, Artificial Sequence
  Synthetic
tgtttgaagatuccaccaagatgtaugt

SEQ ID NO: 79498 - DNA, 19 bp, Artificial Sequence
  Synthetic
agctcaucacgcagcucat

SEQ ID NO: 79499 - DNA, 22 bp, Artificial Sequence
  Synthetic
atgtgaggaucctggctcctua

SEQ ID NO: 79500 - DNA, 22 bp, Artificial Sequence
  Synthetic
caacagccugaccaccttctua

SEQ ID NO: 79501 - DNA, 24 bp, Artificial Sequence
  Synthetic
cggaatgatuctgtcaacccugat

SEQ ID NO: 79502 - DNA, 20 bp, Artificial Sequence
  Synthetic
ccgcgaugatgagtggaugg

SEQ ID NO: 79503 - DNA, 27 bp, Artificial Sequence
  Synthetic
cagccttccuaacagatcattcatuct

SEQ ID NO: 79504 - DNA, 22 bp, Artificial Sequence
  Synthetic
gagcccucaacattatgccuct

SEQ ID NO: 79505 - DNA, 20 bp, Artificial Sequence
  Synthetic
ccaccgucagggactugaac

SEQ ID NO: 79506 - DNA, 28 bp, Artificial Sequence
  Synthetic
agtgttttatcugcatctggatgaucaa

SEQ ID NO: 79507 - DNA, 24 bp, Artificial Sequence
  Synthetic
ccctacucgggagaattucaacag

SEQ ID NO: 79508 - DNA, 21 bp, Artificial Sequence
  Synthetic
actgcagccaaacucccaaua

SEQ ID NO: 79509 - DNA, 25 bp, Artificial Sequence
  Synthetic
ttgatgagtgucatcttgcaaucct

SEQ ID NO: 79510 - DNA, 24 bp, Artificial Sequence
  Synthetic
tgtgggcttuaggtcaatgtugat

SEQ ID NO: 79511 - DNA, 28 bp, Artificial Sequence
  Synthetic
gcacagtaacaagautttaaaaccccut

SEQ ID NO: 79512 - DNA, 21 bp, Artificial Sequence
  Synthetic
gggtgguctaggatugcaaga

SEQ ID NO: 79513 - DNA, 28 bp, Artificial Sequence
  Synthetic
gcagtgaatgcuatgtttgtttacugat

SEQ ID NO: 79514 - DNA, 24 bp, Artificial Sequence
  Synthetic
ctatccacutgttccauaggccaa

SEQ ID NO: 79515 - DNA, 28 bp, Artificial Sequence
  Synthetic
cccatcatcatuattttcacagctcuca

SEQ ID NO: 79516 - DNA, 28 bp, Artificial Sequence
  Synthetic
tttgcaggtaaaaucaagagtccacaua

SEQ ID NO: 79517 - DNA, 21 bp, Artificial Sequence
  Synthetic
cuccaaacatcugaggccaca

SEQ ID NO: 79518 - DNA, 24 bp, Artificial Sequence
  Synthetic
gtatgcuccagaatcacugacaga

SEQ ID NO: 79519 - DNA, 17 bp, Artificial Sequence
  Synthetic
cacugaccgctggugga

SEQ ID NO: 79520 - DNA, 32 bp, Artificial Sequence
  Synthetic
agcaataccaaautttattcttgtttuagaca

SEQ ID NO: 79521 - DNA, 28 bp, Artificial Sequence
  Synthetic
ctgcagcaaagutcgtaatatctucaaa

SEQ ID NO: 79522 - DNA, 25 bp, Artificial Sequence
  Synthetic
cagctcacugaaaggttcttttgut

SEQ ID NO: 79523 - DNA, 23 bp, Artificial Sequence
  Synthetic
tcagcttttccuctgttcacugg

SEQ ID NO: 79524 - DNA, 27 bp, Artificial Sequence
  Synthetic
cttggagccaagacuaaatccttagut

SEQ ID NO: 79525 - DNA, 24 bp, Artificial Sequence
  Synthetic
tcccaccugaattcugaccaaaag

SEQ ID NO: 79526 - DNA, 25 bp, Artificial Sequence
  Synthetic
ggaauctcugagagcaacggaaaaa

SEQ ID NO: 79527 - DNA, 22 bp, Artificial Sequence
  Synthetic
gcactttucacacctgatuccc

SEQ ID NO: 79528 - DNA, 26 bp, Artificial Sequence
  Synthetic
gtaagagcttautgagatggcugact

SEQ ID NO: 79529 - DNA, 24 bp, Artificial Sequence
  Synthetic
tcatttggaaguccatgctccaut

SEQ ID NO: 79530 - DNA, 25 bp, Artificial Sequence
  Synthetic
aggtgcuggtacaatguaagacaag

SEQ ID NO: 79531 - DNA, 24 bp, Artificial Sequence
  Synthetic
acctgacaaugatgagcagttugt

SEQ ID NO: 79532 - DNA, 20 bp, Artificial Sequence
  Synthetic
cactaccucagccctccauc

SEQ ID NO: 79533 - DNA, 24 bp, Artificial Sequence
  Synthetic
tgacatgttcucctttgggttuca

SEQ ID NO: 79534 - DNA, 20 bp, Artificial Sequence
  Synthetic
tcuctcagggucaacagcca

SEQ ID NO: 79535 - DNA, 24 bp, Artificial Sequence
  Synthetic
gugagcaugcaaaaggagaacaag

SEQ ID NO: 79536 - DNA, 24 bp, Artificial Sequence
  Synthetic
tttaatuaccgggagcacctucag

SEQ ID NO: 79537 - DNA, 20 bp, Artificial Sequence
  Synthetic
acacgggaaagcaguccaut

SEQ ID NO: 79538 - DNA, 24 bp, Artificial Sequence
  Synthetic
caactttcagccugatagtcuggt

SEQ ID NO: 79539 - DNA, 23 bp, Artificial Sequence
  Synthetic
agguttgatcucagcccaagaag

SEQ ID NO: 79540 - DNA, 33 bp, Artificial Sequence
  Synthetic
aatgagactaaaactutgaagtagtcattttug

SEQ ID NO: 79541 - DNA, 21 bp, Artificial Sequence
  Synthetic
ccgaccgcgcauaaacattut

SEQ ID NO: 79542 - DNA, 25 bp, Artificial Sequence
  Synthetic
tcttctaccuctaggcagttuccaa

SEQ ID NO: 79543 - DNA, 24 bp, Artificial Sequence
  Synthetic
ctgaaagtgtgucagaggaggaug

SEQ ID NO: 79544 - DNA, 27 bp, Artificial Sequence
  Synthetic
tgucttgtgttucaacagaaggagaat

SEQ ID NO: 79545 - DNA, 26 bp, Artificial Sequence
  Synthetic
tgaatttgcugtcatgguagagaagg

SEQ ID NO: 79546 - DNA, 20 bp, Artificial Sequence
  Synthetic
cagagaagcgcaagcucauc

SEQ ID NO: 79547 - DNA, 26 bp, Artificial Sequence
  Synthetic
agtgtgtcatguggtttaggacatuc

SEQ ID NO: 79548 - DNA, 28 bp, Artificial Sequence
  Synthetic
gcatttaggaagauttagtggactugct

SEQ ID NO: 79549 - DNA, 19 bp, Artificial Sequence
  Synthetic
cgggaatuggtaggcucca

SEQ ID NO: 79550 - DNA, 26 bp, Artificial Sequence
  Synthetic
ggaggaatcaaaaautgtcgggaaut

SEQ ID NO: 79551 - DNA, 28 bp, Artificial Sequence
  Synthetic
aagatatagcugcagaagaggactuaga

SEQ ID NO: 79552 - DNA, 21 bp, Artificial Sequence
  Synthetic
cagauggcagcaagacaucct

SEQ ID NO: 79553 - DNA, 25 bp, Artificial Sequence
  Synthetic
agctgggtttcugttaatctcacug

SEQ ID NO: 79554 - DNA, 22 bp, Artificial Sequence
  Synthetic
cctagtatugaggaggcgugga

SEQ ID NO: 79555 - DNA, 28 bp, Artificial Sequence
  Synthetic
gcttgaccacuagagaatugaaaagaac

SEQ ID NO: 79556 - DNA, 29 bp, Artificial Sequence
  Synthetic
acgactacagugtcaaataaactcucaaa

SEQ ID NO: 79557 - DNA, 19 bp, Artificial Sequence
  Synthetic
cccaccucatgcactgtug

SEQ ID NO: 79558 - DNA, 26 bp, Artificial Sequence
  Synthetic
tctctgggaacuctgtatttggagua

SEQ ID NO: 79559 - DNA, 20 bp, Artificial Sequence
  Synthetic
tgcccaauctcuaccaagcc

SEQ ID NO: 79560 - DNA, 28 bp, Artificial Sequence
  Synthetic
cagtagaataaucaacagtgcaugaggt

SEQ ID NO: 79561 - DNA, 28 bp, Artificial Sequence
  Synthetic
ctaggtctcaucaaactctttgcaagua

SEQ ID NO: 79562 - DNA, 20 bp, Artificial Sequence
  Synthetic
ccccacugtcgcacaaugaa

SEQ ID NO: 79563 - DNA, 26 bp, Artificial Sequence
  Synthetic
cttcttctcccuggctgtaaaaatug

SEQ ID NO: 79564 - DNA, 20 bp, Artificial Sequence
  Synthetic
gcaagucgagggccguaaaa

SEQ ID NO: 79565 - DNA, 29 bp, Artificial Sequence
  Synthetic
cacattgcatcaucttactctcataguca

SEQ ID NO: 79566 - DNA, 23 bp, Artificial Sequence
  Synthetic
gaggtctguaacccgcagtttua

SEQ ID NO: 79567 - DNA, 23 bp, Artificial Sequence
  Synthetic
guatcagccucaagcaaaaccag

SEQ ID NO: 79568 - DNA, 21 bp, Artificial Sequence
  Synthetic
cgtgtttuggtcgatcugggt

SEQ ID NO: 79569 - DNA, 19 bp, Artificial Sequence
  Synthetic
ccagctugggagaccucat

SEQ ID NO: 79570 - DNA, 21 bp, Artificial Sequence
  Synthetic
gggtggtuggaaactgaugga

SEQ ID NO: 79571 - DNA, 24 bp, Artificial Sequence
  Synthetic
gggatgaacacauctaccccuaca

SEQ ID NO: 79572 - DNA, 19 bp, Artificial Sequence
  Synthetic
tgguagccagccagguaca

SEQ ID NO: 79573 - DNA, 20 bp, Artificial Sequence
  Synthetic
gatcttcctguggcccctuc

SEQ ID NO: 79574 - DNA, 28 bp, Artificial Sequence
  Synthetic
ccctctctgugacaaatgttatgaugat

SEQ ID NO: 79575 - DNA, 29 bp, Artificial Sequence
  Synthetic
actgaaataaaaagacuccaaccttcugt

SEQ ID NO: 79576 - DNA, 21 bp, Artificial Sequence
  Synthetic
gatctgcutcttgagguggct

SEQ ID NO: 79577 - DNA, 28 bp, Artificial Sequence
  Synthetic
acatgtaattuctggtcattucccgaat

SEQ ID NO: 79578 - DNA, 23 bp, Artificial Sequence
  Synthetic
tgttacgcagugctaaccaagut

SEQ ID NO: 79579 - DNA, 27 bp, Artificial Sequence
  Synthetic
gcaaaccacaaaaguatactccauggt

SEQ ID NO: 79580 - DNA, 26 bp, Artificial Sequence
  Synthetic
ttacttgggaaguctcatttgctuct

SEQ ID NO: 79581 - DNA, 27 bp, Artificial Sequence
  Synthetic
agctgtgtttugactctcttttgauga

SEQ ID NO: 79582 - DNA, 22 bp, Artificial Sequence
  Synthetic
ttgctgtugggtgtagtguagg

SEQ ID NO: 79583 - DNA, 23 bp, Artificial Sequence
  Synthetic
cctcaggatcucagtcgaagtut

SEQ ID NO: 79584 - DNA, 28 bp, Artificial Sequence
  Synthetic
agaguttttatttccugccacagaaagt

SEQ ID NO: 79585 - DNA, 26 bp, Artificial Sequence
  Synthetic
catgataauaacaggagccagaggut

SEQ ID NO: 79586 - DNA, 26 bp, Artificial Sequence
  Synthetic
tttccattttcucctccatcctgtut

SEQ ID NO: 79587 - DNA, 23 bp, Artificial Sequence
  Synthetic
ccatcattguccagatcguccag

SEQ ID NO: 79588 - DNA, 23 bp, Artificial Sequence
  Synthetic
aacagagugaaaggcagtcgaut

SEQ ID NO: 79589 - DNA, 20 bp, Artificial Sequence
  Synthetic
ccgcugcatgaactaugacc

SEQ ID NO: 79590 - DNA, 20 bp, Artificial Sequence
  Synthetic
agggaggguacgtgugagat

SEQ ID NO: 79591 - DNA, 24 bp, Artificial Sequence
  Synthetic
gtgaatgucccgtagttaauggct

SEQ ID NO: 79592 - DNA, 21 bp, Artificial Sequence
  Synthetic
gcgcacttuggagagagcaut

SEQ ID NO: 79593 - DNA, 21 bp, Artificial Sequence
  Synthetic
caggagcaugccacuagagat

SEQ ID NO: 79594 - DNA, 21 bp, Artificial Sequence
  Synthetic
agaccgaccucctcatucaca

SEQ ID NO: 79595 - DNA, 26 bp, Artificial Sequence
  Synthetic
ggctgatctucttaggtcaaguaggt

SEQ ID NO: 79596 - DNA, 23 bp, Artificial Sequence
  Synthetic
gggucagaguacagaagaaaggg

SEQ ID NO: 79597 - DNA, 21 bp, Artificial Sequence
  Synthetic
cttcctgccaugctgcauaag

SEQ ID NO: 79598 - DNA, 21 bp, Artificial Sequence
  Synthetic
catttcccutgtcaccuggct

SEQ ID NO: 79599 - DNA, 22 bp, Artificial Sequence
  Synthetic
cgggaaaatugagctcctcugt

SEQ ID NO: 79600 - DNA, 20 bp, Artificial Sequence
  Synthetic
ccaggugaccccatgcuaaa

SEQ ID NO: 79601 - DNA, 21 bp, Artificial Sequence
  Synthetic
cgtcctguacgagctctucac

SEQ ID NO: 79602 - DNA, 21 bp, Artificial Sequence
  Synthetic
cautaaguggacagcgccaga

SEQ ID NO: 79603 - DNA, 22 bp, Artificial Sequence
  Synthetic
ccttcccaucaccctttcagut

SEQ ID NO: 79604 - DNA, 22 bp, Artificial Sequence
  Synthetic
acagacugggaaactgaggcua

SEQ ID NO: 79605 - DNA, 18 bp, Artificial Sequence
  Synthetic
ccacatgcgcucctccut

SEQ ID NO: 79606 - DNA, 22 bp, Artificial Sequence
  Synthetic
ctcagtuccggagaagauggag

SEQ ID NO: 79607 - DNA, 23 bp, Artificial Sequence
  Synthetic
caacagccugaactcagatguca

SEQ ID NO: 79608 - DNA, 21 bp, Artificial Sequence
  Synthetic
ctgcagctuttgtcgcaguag

SEQ ID NO: 79609 - DNA, 22 bp, Artificial Sequence
  Synthetic
tctacacccucgcatcucaaga

SEQ ID NO: 79610 - DNA, 20 bp, Artificial Sequence
  Synthetic
gacucagcccgaacctucag

SEQ ID NO: 79611 - DNA, 20 bp, Artificial Sequence
  Synthetic
catgggccuttcuggaggaa

SEQ ID NO: 79612 - DNA, 22 bp, Artificial Sequence
  Synthetic
cggaagaaaggccuctgatugg

SEQ ID NO: 79613 - DNA, 22 bp, Artificial Sequence
  Synthetic
gtttcttccaugtgcccctcut

SEQ ID NO: 79614 - DNA, 28 bp, Artificial Sequence
  Synthetic
aagtctcttggcautatttctagtuggt

SEQ ID NO: 79615 - DNA, 24 bp, Artificial Sequence
  Synthetic
caatgagagcutccctcaatguct

SEQ ID NO: 79616 - DNA, 28 bp, Artificial Sequence
  Synthetic
tgtcttctaagaacuctgaagcaatguc

SEQ ID NO: 79617 - DNA, 27 bp, Artificial Sequence
  Synthetic
agggaagaggcuttataaaacaacugt

SEQ ID NO: 79618 - DNA, 21 bp, Artificial Sequence
  Synthetic
cutctaggucagcagcaacaa

SEQ ID NO: 79619 - DNA, 25 bp, Artificial Sequence
  Synthetic
caccttccaaaauagcgagtaugga

SEQ ID NO: 79620 - DNA, 23 bp, Artificial Sequence
  Synthetic
gcactcgtucagtttggcatuaa

SEQ ID NO: 79621 - DNA, 21 bp, Artificial Sequence
  Synthetic
ggcattggcagauccatgcua

SEQ ID NO: 79622 - DNA, 20 bp, Artificial Sequence
  Synthetic
gagctgucagaggatucgct

SEQ ID NO: 79623 - DNA, 21 bp, Artificial Sequence
  Synthetic
ccaggaagauctguggaccaa

SEQ ID NO: 79624 - DNA, 27 bp, Artificial Sequence
  Synthetic
guatgtcttatctctuaggagggcaac

SEQ ID NO: 79625 - DNA, 26 bp, Artificial Sequence
  Synthetic
agcatttgguctgctttgatttugaa

SEQ ID NO: 79626 - DNA, 27 bp, Artificial Sequence
  Synthetic
cacattaatauagccagaaagggccua

SEQ ID NO: 79627 - DNA, 26 bp, Artificial Sequence
  Synthetic
gacttcggttuaaccaaagcaatuga

SEQ ID NO: 79628 - DNA, 26 bp, Artificial Sequence
  Synthetic
tgacggtgtaauactccttatcggut

SEQ ID NO: 79629 - DNA, 27 bp, Artificial Sequence
  Synthetic
gtgcttgacttutacttctctctcuca

SEQ ID NO: 79630 - DNA, 25 bp, Artificial Sequence
  Synthetic
tctcaagcacucaccatttggaaut

SEQ ID NO: 79631 - DNA, 23 bp, Artificial Sequence
  Synthetic
gaggaaacacaguccctttcuga

SEQ ID NO: 79632 - DNA, 24 bp, Artificial Sequence
  Synthetic
tttttcucccgagccagaatgaut

SEQ ID NO: 79633 - DNA, 23 bp, Artificial Sequence
  Synthetic
cgtgccttcuctggttcatttug

SEQ ID NO: 79634 - DNA, 22 bp, Artificial Sequence
  Synthetic
ggaccatgcugtttcctgtuga

SEQ ID NO: 79635 - DNA, 23 bp, Artificial Sequence
  Synthetic
ggcttguggaaacggaatttgua

SEQ ID NO: 79636 - DNA, 21 bp, Artificial Sequence
  Synthetic
gaagcacuaatcggctugcat

SEQ ID NO: 79637 - DNA, 25 bp, Artificial Sequence
  Synthetic
cagcctccaaucatctccttcauac

SEQ ID NO: 79638 - DNA, 23 bp, Artificial Sequence
  Synthetic
ctttgtgcugaggatcagggaut

SEQ ID NO: 79639 - DNA, 28 bp, Artificial Sequence
  Synthetic
tcacgtttugcagggttttataacaaut

SEQ ID NO: 79640 - DNA, 24 bp, Artificial Sequence
  Synthetic
gatgaaacatcuaggctggaccut

SEQ ID NO: 79641 - DNA, 28 bp, Artificial Sequence
  Synthetic
tgtctgtaaatcagutgagccattacut

SEQ ID NO: 79642 - DNA, 27 bp, Artificial Sequence
  Synthetic
cttggtggtutttaggaaactugagaa

SEQ ID NO: 79643 - DNA, 26 bp, Artificial Sequence
  Synthetic
gtgtggtcaagaguaaccaagaaugt

SEQ ID NO: 79644 - DNA, 18 bp, Artificial Sequence
  Synthetic
gccccacauccccuacca

SEQ ID NO: 79645 - DNA, 17 bp, Artificial Sequence
  Synthetic
cccutgguggccacgac

SEQ ID NO: 79646 - DNA, 19 bp, Artificial Sequence
  Synthetic
cctcctgutctcccugggt

SEQ ID NO: 79647 - DNA, 17 bp, Artificial Sequence
  Synthetic
gaccggcacucgcucat

SEQ ID NO: 79648 - DNA, 21 bp, Artificial Sequence
  Synthetic
gctccagguccatgatguact

SEQ ID NO: 79649 - DNA, 20 bp, Artificial Sequence
  Synthetic
cagcuacaaggcctgccuac

SEQ ID NO: 79650 - DNA, 18 bp, Artificial Sequence
  Synthetic
gaatacgccuccgcguca

SEQ ID NO: 79651 - DNA, 21 bp, Artificial Sequence
  Synthetic
ggctaaagccugggtttgugt

SEQ ID NO: 79652 - DNA, 20 bp, Artificial Sequence
  Synthetic
ggaggacgagguctcccaua

SEQ ID NO: 79653 - DNA, 19 bp, Artificial Sequence
  Synthetic
ggcggtugggtgttuacct

SEQ ID NO: 79654 - DNA, 20 bp, Artificial Sequence
  Synthetic
gugccaagcactgucgaaat

SEQ ID NO: 79655 - DNA, 24 bp, Artificial Sequence
  Synthetic
aacugcugacagaaaagaagggaa

SEQ ID NO: 79656 - DNA, 29 bp, Artificial Sequence
  Synthetic
ctcactatagacagaugatgttgttgugt

SEQ ID NO: 79657 - DNA, 22 bp, Artificial Sequence
  Synthetic
gcaggatccuctcttgctgaug

SEQ ID NO: 79658 - DNA, 26 bp, Artificial Sequence
  Synthetic
tgtttccaaagaacagutacccauga

SEQ ID NO: 79659 - DNA, 26 bp, Artificial Sequence
  Synthetic
accacuggcaaagcaaaauagaaaac

SEQ ID NO: 79660 - DNA, 25 bp, Artificial Sequence
  Synthetic
actggatcucaaggtattgauggga

SEQ ID NO: 79661 - DNA, 23 bp, Artificial Sequence
  Synthetic
ggccctgtgutgcaaagtactua

SEQ ID NO: 79662 - DNA, 26 bp, Artificial Sequence
  Synthetic
agtttgctgguggagataaggttaug

SEQ ID NO: 79663 - DNA, 22 bp, Artificial Sequence
  Synthetic
agcauttccaaagauggagcga

SEQ ID NO: 79664 - DNA, 25 bp, Artificial Sequence
  Synthetic
gtggtggactcuagtcagaaaccua

SEQ ID NO: 79665 - DNA, 21 bp, Artificial Sequence
  Synthetic
tggtggccugtttggatucag

SEQ ID NO: 79666 - DNA, 23 bp, Artificial Sequence
  Synthetic
aatgccucaaccgtggacaauat

SEQ ID NO: 79667 - DNA, 30 bp, Artificial Sequence; identical to SEQ ID NO: 52837
  Synthetic

SEQ ID NO: 79668 - DNA, 26 bp, Artificial Sequence
  Synthetic
ggaaaagagugaagaagggaatguct

SEQ ID NO: 79669 - DNA, 27 bp, Artificial Sequence
  Synthetic
gagtggtttugggaacttcttttctug

SEQ ID NO: 79670 - DNA, 25 bp, Artificial Sequence
  Synthetic
tggaaagaaccuctcaacattguca

SEQ ID NO: 79671 - DNA, 27 bp, Artificial Sequence
  Synthetic
gagtagaaccatugctcaaaggactua

SEQ ID NO: 79672 - DNA, 21 bp, Artificial Sequence
  Synthetic
ctcagccaccuacuacaggac

SEQ ID NO: 79673 - DNA, 23 bp, Artificial Sequence
  Synthetic
tgctgttugagacatcagtgcut

SEQ ID NO: 79674 - DNA, 28 bp, Artificial Sequence
  Synthetic
accauccttccatuaaagagagagagat

SEQ ID NO: 79675 - DNA, 23 bp, Artificial Sequence
  Synthetic
gctgtctcagugacaaacccaua

SEQ ID NO: 79676 - DNA, 24 bp, Artificial Sequence
  Synthetic
acactuctccattctucacaaggg

SEQ ID NO: 79677 - DNA, 25 bp, Artificial Sequence
  Synthetic
aggctgcgtuggaagttatttcuaa

SEQ ID NO: 79678 - DNA, 24 bp, Artificial Sequence
  Synthetic
accccttugaaagagaacacacut

SEQ ID NO: 79679 - DNA, 22 bp, Artificial Sequence
  Synthetic
gctggccugagacattcctaug

SEQ ID NO: 79680 - DNA, 26 bp, Artificial Sequence
  Synthetic
cacagaagauggaactcagtatugga

SEQ ID NO: 79681 - DNA, 22 bp, Artificial Sequence
  Synthetic
ccacgcggacuattaagtcuga

SEQ ID NO: 79682 - DNA, 22 bp, Artificial Sequence
  Synthetic
acaaaagccaguctgggaagut

SEQ ID NO: 79683 - DNA, 20 bp, Artificial Sequence
  Synthetic
gggccugatactuggagaga

SEQ ID NO: 79684 - DNA, 23 bp, Artificial Sequence
  Synthetic
tccatcagaacuccactctcucc

SEQ ID NO: 79685 - DNA, 28 bp, Artificial Sequence
  Synthetic
aactgcttcacgutttattgagaatucc

SEQ ID NO: 79686 - DNA, 23 bp, Artificial Sequence
  Synthetic
caccauccatccauccaggaaaa

SEQ ID NO: 79687 - DNA, 29 bp, Artificial Sequence
  Synthetic
cgtgatccatucattctgcttattcucat

SEQ ID NO: 79688 - DNA, 32 bp, Artificial Sequence
  Synthetic
actgagaatataaccugataatgtaggauagt

SEQ ID NO: 79689 - DNA, 27 bp, Artificial Sequence
  Synthetic
ctacttcgaatcuctagagcctgttug

SEQ ID NO: 79690 - DNA, 23 bp, Artificial Sequence
  Synthetic
aagugtcacctuaccaaaggcaa

SEQ ID NO: 79691 - DNA, 25 bp, Artificial Sequence
  Synthetic
tgtagatuccgcacaagagatucag

SEQ ID NO: 79692 - DNA, 28 bp, Artificial Sequence
  Synthetic
acaggctctagagautcgaagtagttua

SEQ ID NO: 79693 - DNA, 24 bp, Artificial Sequence
  Synthetic
aaaatgggctutaccgtaccauga

SEQ ID NO: 79694 - DNA, 27 bp, Artificial Sequence
  Synthetic
tctttttccctucctttacagaaugct

SEQ ID NO: 79695 - DNA, 28 bp, Artificial Sequence
  Synthetic
acaagcaaacaagccauttacugaaaat

SEQ ID NO: 79696 - DNA, 28 bp, Artificial Sequence
  Synthetic
tgaggcactatugtttgtatttggagut

SEQ ID NO: 79697 - DNA, 29 bp, Artificial Sequence
  Synthetic
cctccctcttuaacaatcacttgaauact

SEQ ID NO: 79698 - DNA, 26 bp, Artificial Sequence
  Synthetic
gacttttgagaucctggaugaaacga

SEQ ID NO: 79699 - DNA, 22 bp, Artificial Sequence
  Synthetic
cacugcagaaagccaagcatut

SEQ ID NO: 79700 - DNA, 23 bp, Artificial Sequence
  Synthetic
aaagttcugcaacccaagaguga

SEQ ID NO: 79701 - DNA, 25 bp, Artificial Sequence
  Synthetic
tggagaaucagacgacaagtatugg

SEQ ID NO: 79702 - DNA, 24 bp, Artificial Sequence
  Synthetic
gccagttuagatgcaaaauccaca

SEQ ID NO: 79703 - DNA, 28 bp, Artificial Sequence
  Synthetic
aacatcctgctacuttgaggttttacut

SEQ ID NO: 79704 - DNA, 27 bp, Artificial Sequence
  Synthetic
aatccautctgaacaucaacaggaagt

SEQ ID NO: 79705 - DNA, 28 bp, Artificial Sequence
  Synthetic
tcagttagcaaaugtgttcactctgtua

SEQ ID NO: 79706 - DNA, 26 bp, Artificial Sequence
  Synthetic
tggagugtattcucacagaaaagaga

SEQ ID NO: 79707 - DNA, 23 bp, Artificial Sequence
  Synthetic
acaccccgaaaagaaugtcauca

SEQ ID NO: 79708 - DNA, 22 bp, Artificial Sequence
  Synthetic
gcatgagacutcgatgcttucc

SEQ ID NO: 79709 - DNA, 27 bp, Artificial Sequence
  Synthetic
gctgataccagaaccauttcaaaagut

SEQ ID NO: 79710 - DNA, 22 bp, Artificial Sequence
  Synthetic
gacaaauaggagccagccugaa

SEQ ID NO: 79711 - DNA, 26 bp, Artificial Sequence
  Synthetic
gctggagacauctcacattgttttug

SEQ ID NO: 79712 - DNA, 20 bp, Artificial Sequence
  Synthetic
ggcccatgauagccgtctut

SEQ ID NO: 79713 - DNA, 22 bp, Artificial Sequence
  Synthetic
cttcgggcacutacaagccuat

SEQ ID NO: 79714 - DNA, 25 bp, Artificial Sequence
  Synthetic
acgacttctucaacaagatcgucaa

SEQ ID NO: 79715 - DNA, 28 bp, Artificial Sequence
  Synthetic
gccctggatatuctttttgagactgaua

SEQ ID NO: 79716 - DNA, 25 bp, Artificial Sequence
  Synthetic
gcaagaguacacactcctcattugg

SEQ ID NO: 79717 - DNA, 28 bp, Artificial Sequence
  Synthetic
tcacaacccacugaggtatatgtauagg

SEQ ID NO: 79718 - DNA, 29 bp, Artificial Sequence
  Synthetic
ccttcttcacuctatgttgttatcuccaa

SEQ ID NO: 79719 - DNA, 22 bp, Artificial Sequence
  Synthetic
ctatgctggcauggtcttcugt

SEQ ID NO: 79720 - DNA, 20 bp, Artificial Sequence
  Synthetic
tcctccaccuccaggaacut

SEQ ID NO: 79721 - DNA, 19 bp, Artificial Sequence
  Synthetic
ctgtgtcuggccccctuag

SEQ ID NO: 79722 - DNA, 28 bp, Artificial Sequence
  Synthetic
gagttaggaaacagauacagaggucaag

SEQ ID NO: 79723 - DNA, 28 bp, Artificial Sequence
  Synthetic
cttctgagucgagagattcaactucaaa

SEQ ID NO: 79724 - DNA, 28 bp, Artificial Sequence
  Synthetic
tcctcttaccuacaacgacaactatgua

SEQ ID NO: 79725 - DNA, 27 bp, Artificial Sequence
  Synthetic
acccagaaaagagauttgttcctgaug

SEQ ID NO: 79726 - DNA, 24 bp, Artificial Sequence
  Synthetic
tgctgucccaggaaattctgtuac

SEQ ID NO: 79727 - DNA, 28 bp, Artificial Sequence
  Synthetic
agtgatcattguacatggctctcattut

SEQ ID NO: 79728 - DNA, 26 bp, Artificial Sequence
  Synthetic
attggttggaucaggattcagttuca

SEQ ID NO: 79729 - DNA, 29 bp, Artificial Sequence
  Synthetic
actacctcatcaucttcatctgagagtuc

SEQ ID NO: 79730 - DNA, 28 bp, Artificial Sequence
  Synthetic
tccccttgggautagtatctatctcuct

SEQ ID NO: 79731 - DNA, 28 bp, Artificial Sequence
  Synthetic
aagcttcaacaatutactctcccatgua

SEQ ID NO: 79732 - DNA, 23 bp, Artificial Sequence
  Synthetic
gtctgtgutatggctgugaccat

SEQ ID NO: 79733 - DNA, 23 bp, Artificial Sequence
  Synthetic
ccacautctcctcaugccaagac

SEQ ID NO: 79734 - DNA, 22 bp, Artificial Sequence
  Synthetic
agaccagugacgtgaagacauc

SEQ ID NO: 79735 - DNA, 20 bp, Artificial Sequence
  Synthetic
gcaatcutgcagcucagggt

SEQ ID NO: 79736 - DNA, 25 bp, Artificial Sequence
  Synthetic
acgtaaccaugaatcatccacucac

SEQ ID NO: 79737 - DNA, 28 bp, Artificial Sequence
  Synthetic
ggtaaatagcautgaggaagatgugact

SEQ ID NO: 79738 - DNA, 24 bp, Artificial Sequence
  Synthetic
gcaaacuctacccucacaaaaggt

SEQ ID NO: 79739 - DNA, 20 bp, Artificial Sequence
  Synthetic
gcaccugctgaacaguagca

SEQ ID NO: 79740 - DNA, 28 bp, Artificial Sequence
  Synthetic
catggagttgacuttctaaaaggtgcua

SEQ ID NO: 79741 - DNA, 28 bp, Artificial Sequence
  Synthetic
ggtaatgatgugcatctgcagttaauct

SEQ ID NO: 79742 - DNA, 25 bp, Artificial Sequence
  Synthetic
aatggatgucagctccatacucaac

SEQ ID NO: 79743 - DNA, 24 bp, Artificial Sequence
  Synthetic
gccatagtcauctgctacctguct

SEQ ID NO: 79744 - DNA, 29 bp, Artificial Sequence
  Synthetic
ctttgtctttcgugtcattaattgaugga

SEQ ID NO: 79745 - DNA, 22 bp, Artificial Sequence
  Synthetic
cgaaattgggccaugacagtug

SEQ ID NO: 79746 - DNA, 24 bp, Artificial Sequence
  Synthetic
cctccagccgugcttgaaaataua

SEQ ID NO: 79747 - DNA, 31 bp, Artificial Sequence
  Synthetic
tacatgtatcacuctgttaaatcttcttugt

SEQ ID NO: 79748 - DNA, 21 bp, Artificial Sequence
  Synthetic
gctgccaacautctggtguct

SEQ ID NO: 79749 - DNA, 22 bp, Artificial Sequence
  Synthetic
gcccagaccacccutaaatcuc

SEQ ID NO: 79750 - DNA, 21 bp, Artificial Sequence
  Synthetic
ttggtgtgtutgccagcttuc

SEQ ID NO: 79751 - DNA, 23 bp, Artificial Sequence
  Synthetic
acctgagctgugaaggacgauat

SEQ ID NO: 79752 - DNA, 22 bp, Artificial Sequence
  Synthetic
gctgcaaggugctttctcttuc

SEQ ID NO: 79753 - DNA, 19 bp, Artificial Sequence
  Synthetic
gcucagucaccccgagagt

SEQ ID NO: 79754 - DNA, 19 bp, Artificial Sequence
  Synthetic
gcgcuccacgatagcacug

SEQ ID NO: 79755 - DNA, 21 bp, Artificial Sequence
  Synthetic
caucccagaggcagcaaucat

SEQ ID NO: 79756 - DNA, 21 bp, Artificial Sequence
  Synthetic
ctgccataugctgtggttcuc

SEQ ID NO: 79757 - DNA, 21 bp, Artificial Sequence
  Synthetic
gcttgttccugcaacctccua

SEQ ID NO: 79758 - DNA, 21 bp, Artificial Sequence
  Synthetic
tcaaaucttcuggccaccaca

SEQ ID NO: 79759 - DNA, 22 bp, Artificial Sequence
  Synthetic
tcgtgcaggaagugaactucat

SEQ ID NO: 79760 - DNA, 28 bp, Artificial Sequence
  Synthetic
aaaattaaaggcaauagcaccaauagcc

SEQ ID NO: 79761 - DNA, 24 bp, Artificial Sequence
  Synthetic
ggagaacacuggacagctgaauaa

SEQ ID NO: 79762 - DNA, 23 bp, Artificial Sequence
  Synthetic
gaugttaatgugcaccccacaaa

SEQ ID NO: 79763 - DNA, 21 bp, Artificial Sequence
  Synthetic
gccccagagaaguagcuggat

SEQ ID NO: 79764 - DNA, 25 bp, Artificial Sequence
  Synthetic
gtgtgtctgcauacatctgatcuca

SEQ ID NO: 79765 - DNA, 23 bp, Artificial Sequence
  Synthetic
ccatcaugggactctccaucagt

SEQ ID NO: 79766 - DNA, 20 bp, Artificial Sequence
  Synthetic
ccaggctacuggtggttguc

SEQ ID NO: 79767 - DNA, 24 bp, Artificial Sequence
  Synthetic
actcttccagauccagggtgaaut

SEQ ID NO: 79768 - DNA, 22 bp, Artificial Sequence
  Synthetic
gactcccaggagagugctgaua

SEQ ID NO: 79769 - DNA, 26 bp, Artificial Sequence
  Synthetic
ctcaccttttuacctgatgctugaaa

SEQ ID NO: 79770 - DNA, 24 bp, Artificial Sequence
  Synthetic
gaccgaagaucaggcaccttaaut

SEQ ID NO: 79771 - DNA, 23 bp, Artificial Sequence
  Synthetic
gacagcacugccatauaaacaca

SEQ ID NO: 79772 - DNA, 22 bp, Artificial Sequence
  Synthetic
cagggtcugacccaatcttcug

SEQ ID NO: 79773 - DNA, 20 bp, Artificial Sequence
  Synthetic
cttgtcttucaggcccugct

SEQ ID NO: 79774 - DNA, 27 bp, Artificial Sequence
  Synthetic
ctagcttcttucttagtactgcuccat

SEQ ID NO: 79775 - DNA, 24 bp, Artificial Sequence
  Synthetic
gtggauttaaccatcuccccagag

SEQ ID NO: 79776 - DNA, 28 bp, Artificial Sequence
  Synthetic
ttaatacagacttugctaccaggactug

SEQ ID NO: 79777 - DNA, 21 bp, Artificial Sequence
  Synthetic
ccgggaauctguacgaaccat

SEQ ID NO: 79778 - DNA, 23 bp, Artificial Sequence
  Synthetic
gugataaggtctaugcccaccag

SEQ ID NO: 79779 - DNA, 25 bp, Artificial Sequence
  Synthetic
ccctgccacuagaaatatctgtcut

SEQ ID NO: 79780 - DNA, 19 bp, Artificial Sequence
  Synthetic
cgutgctcacucccaagca

SEQ ID NO: 79781 - DNA, 19 bp, Artificial Sequence
  Synthetic
cgtgggccucagtcucaag

SEQ ID NO: 79782 - DNA, 32 bp, Artificial Sequence
  Synthetic
tgaaagttaatauggagaagttaattgcugct

SEQ ID NO: 79783 - DNA, 27 bp, Artificial Sequence
  Synthetic
caccgtgaugccagctattatattuct

SEQ ID NO: 79784 - DNA, 21 bp, Artificial Sequence
  Synthetic
tcaatacgaggccugcccuat

SEQ ID NO: 79785 - DNA, 18 bp, Artificial Sequence
  Synthetic
cuccaccagctucagcgt

SEQ ID NO: 79786 - DNA, 27 bp, Artificial Sequence
  Synthetic
ccttttcugaaaccagcagacuaaact

SEQ ID NO: 79787 - DNA, 28 bp, Artificial Sequence
  Synthetic
gttgtgacattugctgatccaaaaguat

SEQ ID NO: 79788 - DNA, 20 bp, Artificial Sequence
  Synthetic
ctgagacacucaccctgcuc

SEQ ID NO: 79789 - DNA, 24 bp, Artificial Sequence
  Synthetic
aggttaacaacagggcutgaagut

SEQ ID NO: 79790 - DNA, 22 bp, Artificial Sequence
  Synthetic
gggtgtggugggaatcttgtua

SEQ ID NO: 79791 - DNA, 27 bp, Artificial Sequence
  Synthetic
catgaaatcagcaugcaaatguacact

SEQ ID NO: 79792 - DNA, 26 bp, Artificial Sequence
  Synthetic
tggagtgttcaugtgttatgccaaua

SEQ ID NO: 79793 - DNA, 32 bp, Artificial Sequence
  Synthetic
actgtctaataattucttctttcactacugcc

SEQ ID NO: 79794 - DNA, 19 bp, Artificial Sequence
  Synthetic
gaggacgagugggaggtuc

SEQ ID NO: 79795 - DNA, 20 bp, Artificial Sequence
  Synthetic
agctgtccugggactcucat

SEQ ID NO: 79796 - DNA, 21 bp, Artificial Sequence
  Synthetic
caggccautgucacagaggat

SEQ ID NO: 79797 - DNA, 21 bp, Artificial Sequence
  Synthetic
gttgtatcccccuccaagcuc

SEQ ID NO: 79798 - DNA, 22 bp, Artificial Sequence
  Synthetic
ctgaagtggcugccaaaaauca

SEQ ID NO: 79799 - DNA, 25 bp, Artificial Sequence
  Synthetic
gaggtaggcugtactttucccaaaa

SEQ ID NO: 79800 - DNA, 20 bp, Artificial Sequence
  Synthetic
cctctccccuctgacccuac

SEQ ID NO: 79801 - DNA, 24 bp, Artificial Sequence
  Synthetic
gggtatgaguctgaggucagaact

SEQ ID NO: 79802 - DNA, 26 bp, Artificial Sequence
  Synthetic
ctttcctaagugacctttctctcucc

SEQ ID NO: 79803 - DNA, 24 bp, Artificial Sequence
  Synthetic
gtacaaagaagcaggaugcctuac

SEQ ID NO: 79804 - DNA, 27 bp, Artificial Sequence
  Synthetic
tggtgagttugggattcttgtaatuct

SEQ ID NO: 79805 - DNA, 23 bp, Artificial Sequence
  Synthetic
acacagcuacaactggagcatut

SEQ ID NO: 79806 - DNA, 27 bp, Artificial Sequence
  Synthetic
catctgtaaauccagcagtaaatgcuc

SEQ ID NO: 79807 - DNA, 23 bp, Artificial Sequence
  Synthetic
gccacaaugtacaggaugcaact

SEQ ID NO: 79808 - DNA, 23 bp, Artificial Sequence
  Synthetic
gacutagtgcaaugcaagacagg

SEQ ID NO: 79809 - DNA, 28 bp, Artificial Sequence
  Synthetic
ttgacacccccauaatattttuccagaa

SEQ ID NO: 79810 - DNA, 21 bp, Artificial Sequence
  Synthetic
gggaaactgucttccccugat

SEQ ID NO: 79811 - DNA, 28 bp, Artificial Sequence
  Synthetic
gagtcagagaaugggagaagtaaugaag

SEQ ID NO: 79812 - DNA, 30 bp, Artificial Sequence; identical to SEQ ID NO: 13230
  Synthetic

SEQ ID NO: 79813 - DNA, 26 bp, Artificial Sequence
  Synthetic
acacagattugcaacttggatucaga

SEQ ID NO: 79814 - DNA, 24 bp, Artificial Sequence
  Synthetic
tttaaggaagugttgatggcguct

SEQ ID NO: 79815 - DNA, 23 bp, Artificial Sequence
  Synthetic
ggtagtgaggaauagggctucca

SEQ ID NO: 79816 - DNA, 25 bp, Artificial Sequence
  Synthetic
cattggtttuacagtgtgttgcugt

SEQ ID NO: 79817 - DNA, 27 bp, Artificial Sequence
  Synthetic
ccaaaagaccccaaaaucaacttccua

SEQ ID NO: 79818 - DNA, 28 bp, Artificial Sequence
  Synthetic
cttacagguctcgcttatuaaagcagaa

SEQ ID NO: 79819 - DNA, 26 bp, Artificial Sequence
  Synthetic
tgtcaacautatttcccaucacacct

SEQ ID NO: 79820 - DNA, 28 bp, Artificial Sequence
  Synthetic
ttgttcttatatuctgtgaatggcucct

SEQ ID NO: 79821 - DNA, 20 bp, Artificial Sequence
  Synthetic
tggaagcacugcgtttggua

SEQ ID NO: 79822 - DNA, 28 bp, Artificial Sequence
  Synthetic
gaatcaattatttucagcagtgggaugt

SEQ ID NO: 79823 - DNA, 25 bp, Artificial Sequence
  Synthetic
tgggagcuggaatgattttctucat

SEQ ID NO: 79824 - DNA, 27 bp, Artificial Sequence
  Synthetic
gacttttcgtuctcttcattcttuccc

SEQ ID NO: 79825 - DNA, 23 bp, Artificial Sequence
  Synthetic
gctcaaccagutcctcaaaguca

SEQ ID NO: 79826 - DNA, 21 bp, Artificial Sequence
  Synthetic
cacacugagcagcctccttua

SEQ ID NO: 79827 - DNA, 23 bp, Artificial Sequence
  Synthetic
cgactctccutttggtggctuac

SEQ ID NO: 79828 - DNA, 27 bp, Artificial Sequence
  Synthetic
ccatagggtauggagtatcttgguaca

SEQ ID NO: 79829 - DNA, 26 bp, Artificial Sequence
  Synthetic
gggacttucaccaggttcttttacut

SEQ ID NO: 79830 - DNA, 24 bp, Artificial Sequence
  Synthetic
ctgttttccuccattttcaucgca

SEQ ID NO: 79831 - DNA, 28 bp, Artificial Sequence
  Synthetic
gtttcttctgucggttttcaagttctut

SEQ ID NO: 79832 - DNA, 28 bp, Artificial Sequence
  Synthetic
cgagaaauatattgguggagaacgagaa

SEQ ID NO: 79833 - DNA, 25 bp, Artificial Sequence
  Synthetic
ctcaccagaauatgggacttucacc

SEQ ID NO: 79834 - DNA, 21 bp, Artificial Sequence
  Synthetic
gugcgcttugaacaagagcaa

SEQ ID NO: 79835 - DNA, 25 bp, Artificial Sequence
  Synthetic
gttaggugacccaaatucaggagag

SEQ ID NO: 79836 - DNA, 26 bp, Artificial Sequence
  Synthetic
cuatatccgaaagtugcaacgagaac

SEQ ID NO: 79837 - DNA, 26 bp, Artificial Sequence
  Synthetic
tgtcttgaagucggtaaaaagcagua

SEQ ID NO: 79838 - DNA, 22 bp, Artificial Sequence
  Synthetic
atggtctcttucttgtgggcut

SEQ ID NO: 79839 - DNA, 25 bp, Artificial Sequence
  Synthetic
gccactatgguaggagtgtaacuga

SEQ ID NO: 79840 - DNA, 22 bp, Artificial Sequence
  Synthetic
gcaagttcucttgcctttuggt

SEQ ID NO: 79841 - DNA, 28 bp, Artificial Sequence
  Synthetic
cttgctgtagatutgaaaggtggattug

SEQ ID NO: 79842 - DNA, 22 bp, Artificial Sequence
  Synthetic
cccaaagtgcuacaacctgugt

SEQ ID NO: 79843 - DNA, 29 bp, Artificial Sequence
  Synthetic
cctgtgaaattcugatctggttgaacuat

SEQ ID NO: 79844 - DNA, 25 bp, Artificial Sequence
  Synthetic
cgcaaagcacugaagttgaatttug

SEQ ID NO: 79845 - DNA, 27 bp, Artificial Sequence
  Synthetic
tctttgcttgagutgagcctttgatua

SEQ ID NO: 79846 - DNA, 26 bp, Artificial Sequence
  Synthetic
tttcttcaaccguccttggaaaagua

SEQ ID NO: 79847 - DNA, 24 bp, Artificial Sequence
  Synthetic
cuttctcttttucagccacaggaa

SEQ ID NO: 79848 - DNA, 28 bp, Artificial Sequence
  Synthetic
aacagcactgttautactacttgggtut

SEQ ID NO: 79849 - DNA, 28 bp, Artificial Sequence
  Synthetic
cacaagaaucgacgacaatcttaaacug

SEQ ID NO: 79850 - DNA, 23 bp, Artificial Sequence
  Synthetic
cgttaagagacgcugtaggucaa

SEQ ID NO: 79851 - DNA, 22 bp, Artificial Sequence
  Synthetic
ggaggagcugagacagcuagag

SEQ ID NO: 79852 - DNA, 23 bp, Artificial Sequence
  Synthetic
ggttgccttugtgtgaatgcuaa

SEQ ID NO: 79853 - DNA, 20 bp, Artificial Sequence
  Synthetic
caggagagauccugcaagca

SEQ ID NO: 79854 - DNA, 21 bp, Artificial Sequence
  Synthetic
gtgcgctgucagtacctguag

SEQ ID NO: 79855 - DNA, 21 bp, Artificial Sequence
  Synthetic
tggcaagtugaactgagcugt

SEQ ID NO: 79856 - DNA, 23 bp, Artificial Sequence
  Synthetic
tgtttgcccugtgcttactuaca

SEQ ID NO: 79857 - DNA, 22 bp, Artificial Sequence
  Synthetic
agaagggucaggcatcttcuca

SEQ ID NO: 79858 - DNA, 21 bp, Artificial Sequence
  Synthetic
gggccagggaaccuaggauaa

SEQ ID NO: 79859 - DNA, 25 bp, Artificial Sequence
  Synthetic
ggcactccacuatcttgcatgtaua

SEQ ID NO: 79860 - DNA, 24 bp, Artificial Sequence
  Synthetic
gccttcuaatgaggcuccaaaact

SEQ ID NO: 79861 - DNA, 28 bp, Artificial Sequence
  Synthetic
gcctgtgagugtaaaaacattugaagat

SEQ ID NO: 79862 - DNA, 28 bp, Artificial Sequence
  Synthetic
cttttacttcuggttcttcuaacgggat

SEQ ID NO: 79863 - DNA, 26 bp, Artificial Sequence
  Synthetic
ggtagccgauctgcagtcaaatauac

SEQ ID NO: 79864 - DNA, 28 bp, Artificial Sequence
  Synthetic
aatggttttctttuctcctccaaccuaa

SEQ ID NO: 79865 - DNA, 28 bp, Artificial Sequence
  Synthetic
ggtactcacgtutcctttaaccacauaa

SEQ ID NO: 79866 - DNA, 18 bp, Artificial Sequence
  Synthetic
gctcgcaagcgcugtgua

SEQ ID NO: 79867 - DNA, 28 bp, Artificial Sequence
  Synthetic
tcaagtcccaucttgattcaagacuaac

SEQ ID NO: 79868 - DNA, 25 bp, Artificial Sequence
  Synthetic
agtgctagagaugggagaagaaugt

SEQ ID NO: 79869 - DNA, 25 bp, Artificial Sequence
  Synthetic
acttagagtccuccaggtcatcaut

SEQ ID NO: 79870 - DNA, 24 bp, Artificial Sequence
  Synthetic
ttcacaggugattgaagugggaaa

SEQ ID NO: 79871 - DNA, 24 bp, Artificial Sequence
  Synthetic
cagcactcutcaacacaagugaac

SEQ ID NO: 79872 - DNA, 24 bp, Artificial Sequence
  Synthetic
gttcctgaaguagaggacccucat

SEQ ID NO: 79873 - DNA, 21 bp, Artificial Sequence
  Synthetic
actcatgccutcactgcucac

SEQ ID NO: 79874 - DNA, 24 bp, Artificial Sequence
  Synthetic
tgtatggtcacauctctcaccuca

SEQ ID NO: 79875 - DNA, 27 bp, Artificial Sequence
  Synthetic
tctccctugcaacaagtaaacagtuat

SEQ ID NO: 79876 - DNA, 27 bp, Artificial Sequence
  Synthetic
ccttatccugacgtaaacaccttugat

SEQ ID NO: 79877 - DNA, 28 bp, Artificial Sequence
  Synthetic
ggcaggcauttctgtaaaaguaaagaac

SEQ ID NO: 79878 - DNA, 20 bp, Artificial Sequence
  Synthetic
ccgggctcugttctcactut

SEQ ID NO: 79879 - DNA, 19 bp, Artificial Sequence
  Synthetic
cccagcugtcaccacucac

SEQ ID NO: 79880 - DNA, 28 bp, Artificial Sequence
  Synthetic
aagaaccccagucagttttcattaauca

SEQ ID NO: 79881 - DNA, 26 bp, Artificial Sequence
  Synthetic
caggaaaagacgaacutggaaaucat

SEQ ID NO: 79882 - DNA, 21 bp, Artificial Sequence
  Synthetic
accgccgugcctactagaaua

SEQ ID NO: 79883 - DNA, 25 bp, Artificial Sequence
  Synthetic
gcttgggattutgctttagtgcuaa

SEQ ID NO: 79884 - DNA, 17 bp, Artificial Sequence
  Synthetic
cgtccgcuggtgtgcut

SEQ ID NO: 79885 - DNA, 17 bp, Artificial Sequence
  Synthetic
ccucgccagggaaggug

SEQ ID NO: 79886 - DNA, 21 bp, Artificial Sequence
  Synthetic
cctttcacccaucaacccgua

SEQ ID NO: 79887 - DNA, 20 bp, Artificial Sequence
  Synthetic
ctgcgcagguagucaaaggt

SEQ ID NO: 79888 - DNA, 21 bp, Artificial Sequence
  Synthetic
gcagaacaugggctcagagut

SEQ ID NO: 79889 - DNA, 22 bp, Artificial Sequence
  Synthetic
gaaagtguccacccctagugac

SEQ ID NO: 79890 - DNA, 20 bp, Artificial Sequence
  Synthetic
tccugggcccaaacttccua

SEQ ID NO: 79891 - DNA, 26 bp, Artificial Sequence
  Synthetic
gttctattucaccaattggcauggaa

SEQ ID NO: 79892 - DNA, 23 bp, Artificial Sequence
  Synthetic
cgctugaggaaagacagagtgua

SEQ ID NO: 79893 - DNA, 21 bp, Artificial Sequence
  Synthetic
ccagugctcacttuccagagt

SEQ ID NO: 79894 - DNA, 20 bp, Artificial Sequence
  Synthetic
ccaactcaugaggctgugct

SEQ ID NO: 79895 - DNA, 22 bp, Artificial Sequence
  Synthetic
caagucaggcuggagagaaagg

SEQ ID NO: 79896 - DNA, 22 bp, Artificial Sequence
  Synthetic
acactgacugctcattgtcgut

SEQ ID NO: 79897 - DNA, 21 bp, Artificial Sequence
  Synthetic
ggttgtcugcctgcttcucag

SEQ ID NO: 79898 - DNA, 28 bp, Artificial Sequence
  Synthetic
ggagaaggactugataatctgtggaaut

SEQ ID NO: 79899 - DNA, 29 bp, Artificial Sequence
  Synthetic
acaggtttatcaacutatgaggaaaugct

SEQ ID NO: 79900 - DNA, 32 bp, Artificial Sequence
  Synthetic
aaaatcatcatgaauccaaagatgtactttut

SEQ ID NO: 79901 - DNA, 22 bp, Artificial Sequence
  Synthetic
cacagaugaaggugggaaggat

SEQ ID NO: 79902 - DNA, 27 bp, Artificial Sequence
  Synthetic
gggtaguaaaagtgaattcuggaccat

SEQ ID NO: 79903 - DNA, 27 bp, Artificial Sequence
  Synthetic
gcautgaatagttgaaugaagcacagt

SEQ ID NO: 79904 - DNA, 28 bp, Artificial Sequence
  Synthetic
aactgtgctgutggtaaatataatugga

SEQ ID NO: 79905 - DNA, 26 bp, Artificial Sequence
  Synthetic
tttctcctcguggctatgttguaaaa

SEQ ID NO: 79906 - DNA, 21 bp, Artificial Sequence
  Synthetic
tctgttcagguggaggaccut

SEQ ID NO: 79907 - DNA, 23 bp, Artificial Sequence
  Synthetic
ccactcccagautttggactgua

SEQ ID NO: 79908 - DNA, 24 bp, Artificial Sequence
  Synthetic
ctgttgctuccatttgcctatucc

SEQ ID NO: 79909 - DNA, 27 bp, Artificial Sequence
  Synthetic
ggcaaggttgaaucagcataaacauac

SEQ ID NO: 79910 - DNA, 21 bp, Artificial Sequence
  Synthetic
agtggtugccaccttgtuacc

SEQ ID NO: 79911 - DNA, 28 bp, Artificial Sequence
  Synthetic
gggagauccgacaatacagatugaaaaa

SEQ ID NO: 79912 - DNA, 19 bp, Artificial Sequence
  Synthetic
cggagtuggaagcgcgtua

SEQ ID NO: 79913 - DNA, 18 bp, Artificial Sequence
  Synthetic
cgcccgccccauactuac

SEQ ID NO: 79914 - DNA, 27 bp, Artificial Sequence
  Synthetic
ccaggagtcttutcttctttgctgaut

SEQ ID NO: 79915 - DNA, 28 bp, Artificial Sequence
  Synthetic
ccaatgcaacagacuttaaagaagtugt

SEQ ID NO: 79916 - DNA, 19 bp, Artificial Sequence
  Synthetic
gcugaagggcagctctuct

SEQ ID NO: 79917 - DNA, 17 bp, Artificial Sequence
  Synthetic
gccacuggcggagctuc

SEQ ID NO: 79918 - DNA, 18 bp, Artificial Sequence
  Synthetic
gcggagagutcggcauga

SEQ ID NO: 79919 - DNA, 22 bp, Artificial Sequence
  Synthetic
ggaagatgcucttctcctcgut

SEQ ID NO: 79920 - DNA, 20 bp, Artificial Sequence
  Synthetic
caguggctgaucgaccagat

SEQ ID NO: 79921 - DNA, 17 bp, Artificial Sequence
  Synthetic
cgtcctccucgcggtug

SEQ ID NO: 79922 - DNA, 23 bp, Artificial Sequence
  Synthetic
gtctgtgtggaaugctgatccut

SEQ ID NO: 79923 - DNA, 24 bp, Artificial Sequence
  Synthetic
ccaaagucacagagcttgatcucc

SEQ ID NO: 79924 - DNA, 21 bp, Artificial Sequence
  Synthetic
agactcacugcgttcttucgt

SEQ ID NO: 79925 - DNA, 20 bp, Artificial Sequence
  Synthetic
gccgggaaaagugatucgag

SEQ ID NO: 79926 - DNA, 21 bp, Artificial Sequence
  Synthetic
cccacaagcccugctaatcug

SEQ ID NO: 79927 - DNA, 25 bp, Artificial Sequence
  Synthetic
agtccaggagaaaautcacaugagg

SEQ ID NO: 79928 - DNA, 21 bp, Artificial Sequence
  Synthetic
aacggtggcutctacatcucc

SEQ ID NO: 79929 - DNA, 23 bp, Artificial Sequence
  Synthetic
gggaatggaguagggcatugaaa

SEQ ID NO: 79930 - DNA, 23 bp, Artificial Sequence
  Synthetic
tttctcgaucaggaccaucaacc

SEQ ID NO: 79931 - DNA, 26 bp, Artificial Sequence
  Synthetic
tgggaaaaaccacguctatggaaaut

SEQ ID NO: 79932 - DNA, 23 bp, Artificial Sequence
  Synthetic
cctccaacaucctagtcaacucc

SEQ ID NO: 79933 - DNA, 21 bp, Artificial Sequence
  Synthetic
accguacaagaagcucaagca

SEQ ID NO: 79934 - DNA, 33 bp, Artificial Sequence
  Synthetic
gccaatttaatttcuttacctataatggucaca

SEQ ID NO: 79935 - DNA, 28 bp, Artificial Sequence
  Synthetic
ccaaatttuacaaactccugaaccagaa

SEQ ID NO: 79936 - DNA, 28 bp, Artificial Sequence
  Synthetic
tctggttcaggaguttgtaaaattugga

SEQ ID NO: 79937 - DNA, 25 bp, Artificial Sequence
  Synthetic
acttacuagaaaatgcauggcccat

SEQ ID NO: 79938 - DNA, 25 bp, Artificial Sequence
  Synthetic
cttgaagtugctaaacagtuggcat

SEQ ID NO: 79939 - DNA, 28 bp, Artificial Sequence
  Synthetic
cagactatttuacatgaattggcaucca

SEQ ID NO: 79940 - DNA, 21 bp, Artificial Sequence
  Synthetic
gatccacuagggatgcacuca

SEQ ID NO: 79941 - DNA, 19 bp, Artificial Sequence
  Synthetic
tcccucagcgttcaugcag

SEQ ID NO: 79942 - DNA, 23 bp, Artificial Sequence
  Synthetic
gggtccaagutaggttaggugat

SEQ ID NO: 79943 - DNA, 22 bp, Artificial Sequence
  Synthetic
atctggaggagggaugggauac

SEQ ID NO: 79944 - DNA, 22 bp, Artificial Sequence
  Synthetic
aaatgttctucacagggcucca

SEQ ID NO: 79945 - DNA, 27 bp, Artificial Sequence
  Synthetic
acaactctgaauggcaaagatacacut

SEQ ID NO: 79946 - DNA, 19 bp, Artificial Sequence
  Synthetic
cagccuccguggacaagag

SEQ ID NO: 79947 - DNA, 21 bp, Artificial Sequence
  Synthetic
ctcccugctcagaaguccaat

SEQ ID NO: 79948 - DNA, 20 bp, Artificial Sequence
  Synthetic
ggcauatcugaggcccaact

SEQ ID NO: 79949 - DNA, 27 bp, Artificial Sequence
  Synthetic
ggaaagcaaaacauattgctactugga

SEQ ID NO: 79950 - DNA, 22 bp, Artificial Sequence
  Synthetic
gcatgggacugtctctgguaga

SEQ ID NO: 79951 - DNA, 20 bp, Artificial Sequence
  Synthetic
ggacacaccaggcuacucac

SEQ ID NO: 79952 - DNA, 25 bp, Artificial Sequence
  Synthetic
tgttaacatguctgtgttgctucca

SEQ ID NO: 79953 - DNA, 22 bp, Artificial Sequence
  Synthetic
agatgattgugggctgcacuaa

SEQ ID NO: 79954 - DNA, 20 bp, Artificial Sequence
  Synthetic
gccaggacaccagugtaugt

SEQ ID NO: 79955 - DNA, 27 bp, Artificial Sequence
  Synthetic
gcaaggctttauagacaatgtgtucca

SEQ ID NO: 79956 - DNA, 22 bp, Artificial Sequence
  Synthetic
ccaaactccuggaagtggacug

SEQ ID NO: 79957 - DNA, 28 bp, Artificial Sequence
  Synthetic
acatcccacagugcataaataaccauat

SEQ ID NO: 79958 - DNA, 27 bp, Artificial Sequence
  Synthetic
cataattgtgugctgtacttactugcc

SEQ ID NO: 79959 - DNA, 23 bp, Artificial Sequence
  Synthetic
gcactcagggugatagctgttuc

SEQ ID NO: 79960 - DNA, 21 bp, Artificial Sequence
  Synthetic
cagccucaggaaggttguagg

SEQ ID NO: 79961 - DNA, 25 bp, Artificial Sequence
  Synthetic
ctgtcgtaagucaggatttctggut

SEQ ID NO: 79962 - DNA, 18 bp, Artificial Sequence
  Synthetic
gacaggutgugggccagt

SEQ ID NO: 79963 - DNA, 19 bp, Artificial Sequence
  Synthetic
gctcgaggugacccuggat

SEQ ID NO: 79964 - DNA, 24 bp, Artificial Sequence
  Synthetic
gcagctgcuggagtgtaataagug

SEQ ID NO: 79965 - DNA, 26 bp, Artificial Sequence
  Synthetic
cataagtccaauagtcacatgguggt

SEQ ID NO: 79966 - DNA, 24 bp, Artificial Sequence
  Synthetic
acggcaaaccacugatatctucat

SEQ ID NO: 79967 - DNA, 27 bp, Artificial Sequence
  Synthetic
tcaaagctgugatacagacugaagaaa

SEQ ID NO: 79968 - DNA, 24 bp, Artificial Sequence
  Synthetic
ggaugagtctauagaggagacggt

SEQ ID NO: 79969 - DNA, 20 bp, Artificial Sequence
  Synthetic
ggcucgggaacacaugaagt

SEQ ID NO: 79970 - DNA, 28 bp, Artificial Sequence
  Synthetic
aaaacttaagagacgautggaggagaug

SEQ ID NO: 79971 - DNA, 27 bp, Artificial Sequence
  Synthetic
ggagtcgugtacattacugagaacaaa

SEQ ID NO: 79972 - DNA, 21 bp, Artificial Sequence
  Synthetic
acatccugcaccagcaacuat

SEQ ID NO: 79973 - DNA, 23 bp, Artificial Sequence
  Synthetic
ctaaagctctcucacttcgccut

SEQ ID NO: 79974 - DNA, 24 bp, Artificial Sequence
  Synthetic
gccatttcugttttcctguagcaa

SEQ ID NO: 79975 - DNA, 28 bp, Artificial Sequence
  Synthetic
ctctgcattauaagcagtgccaaaaaua

SEQ ID NO: 79976 - DNA, 25 bp, Artificial Sequence
  Synthetic
gacatggaaucaccacagttttgut

SEQ ID NO: 79977 - DNA, 28 bp, Artificial Sequence
  Synthetic
agtttaggaaccugaaaaaugaccaact

SEQ ID NO: 79978 - DNA, 25 bp, Artificial Sequence
  Synthetic
tcttaggtgaucgaatggaggcuat

SEQ ID NO: 79979 - DNA, 28 bp, Artificial Sequence
  Synthetic
aaagaaatcagacuccacttttcctuca

SEQ ID NO: 79980 - DNA, 29 bp, Artificial Sequence
  Synthetic
gtggagtctgauttcttttgtcaatuagg

SEQ ID NO: 79981 - DNA, 28 bp, Artificial Sequence
  Synthetic
tttgctcatgcacutacaatttctuagg

SEQ ID NO: 79982 - DNA, 20 bp, Artificial Sequence
  Synthetic
cttgacggcugcccttctua

SEQ ID NO: 79983 - DNA, 24 bp, Artificial Sequence
  Synthetic
gcatgcaggagauttggttucaaa

SEQ ID NO: 79984 - DNA, 22 bp, Artificial Sequence
  Synthetic
atgcagaggacuacacgggaua

SEQ ID NO: 79985 - DNA, 28 bp, Artificial Sequence
  Synthetic
acccacctctgugaataattttcaagut

SEQ ID NO: 79986 - DNA, 28 bp, Artificial Sequence
  Synthetic
agactgtgaaagcacuaaaccactuaaa

SEQ ID NO: 79987 - DNA, 29 bp, Artificial Sequence
  Synthetic
acagtgacacugtaattttcaauaaccgt

SEQ ID NO: 79988 - DNA, 23 bp, Artificial Sequence
  Synthetic
gtgactgtggucttttcctguga

SEQ ID NO: 79989 - DNA, 28 bp, Artificial Sequence
  Synthetic
ctcatgtgcctutaaagaaaaacagcut

SEQ ID NO: 79990 - DNA, 28 bp, Artificial Sequence
  Synthetic
gggagagtgauacagattcattugaaga

SEQ ID NO: 79991 - DNA, 32 bp, Artificial Sequence
  Synthetic
ataaaaatcagttcauttcagaaagaagcuag

SEQ ID NO: 79992 - DNA, 28 bp, Artificial Sequence
  Synthetic
tggcagagtaaaacautatttccaccut

SEQ ID NO: 79993 - DNA, 28 bp, Artificial Sequence
  Synthetic
gttaccttgcauatctgagatgtguact

SEQ ID NO: 79994 - DNA, 28 bp, Artificial Sequence
  Synthetic
acataaaacttcugcagtacacatcuca

SEQ ID NO: 79995 - DNA, 33 bp, Artificial Sequence
  Synthetic
tggtcttaacccuatatattccctttattauct

SEQ ID NO: 79996 - DNA, 29 bp, Artificial Sequence
  Synthetic
ttttggtttgtttuctgcttcgtattcut

SEQ ID NO: 79997 - DNA, 24 bp, Artificial Sequence
  Synthetic
agctttcctuggtggctttatcuc

SEQ ID NO: 79998 - DNA, 27 bp, Artificial Sequence
  Synthetic
tcatttactguaggttggatgcaucac

SEQ ID NO: 79999 - DNA, 22 bp, Artificial Sequence
  Synthetic
caggacuggccagaatuaggat

SEQ ID NO: 80000 - DNA, 28 bp, Artificial Sequence
  Synthetic
ggaaagctaugctattcagtatcuccaa

SEQ ID NO: 80001 - DNA, 31 bp, Artificial Sequence
  Synthetic
atctcttagcuggaatagacaaaaucaaaca

SEQ ID NO: 80002 - DNA, 23 bp, Artificial Sequence
  Synthetic
tgtcatugccactgtctttucct

SEQ ID NO: 80003 - DNA, 23 bp, Artificial Sequence
  Synthetic
acctgguaagaaaagcucagcaa

SEQ ID NO: 80004 - DNA, 24 bp, Artificial Sequence
  Synthetic
gagttggcccuagactuagaagac

SEQ ID NO: 80005 - DNA, 27 bp, Artificial Sequence
  Synthetic
ggctctaaaaugctctgttcucaaaaa

SEQ ID NO: 80006 - DNA, 23 bp, Artificial Sequence
  Synthetic
gctgaggucctttttgtguggaa

SEQ ID NO: 80007 - DNA, 23 bp, Artificial Sequence
  Synthetic
caacaaaagaagucaccgtgugg

SEQ ID NO: 80008 - DNA, 21 bp, Artificial Sequence
  Synthetic
tgaatuccgtgctugggaact

SEQ ID NO: 80009 - DNA, 26 bp, Artificial Sequence
  Synthetic
cctgcaagaaggutgtttatggguat

SEQ ID NO: 80010 - DNA, 26 bp, Artificial Sequence
  Synthetic
attcttcagcacutctaactcagcut

SEQ ID NO: 80011 - DNA, 22 bp, Artificial Sequence
  Synthetic
atcaggtcaugtgactggtgug

SEQ ID NO: 80012 - DNA, 26 bp, Artificial Sequence
  Synthetic
cagaagcatttuctcttaccctugga

SEQ ID NO: 80013 - DNA, 28 bp, Artificial Sequence
  Synthetic
gtgtggttttacauaggccatttttcut

SEQ ID NO: 80014 - DNA, 32 bp, Artificial Sequence
  Synthetic
cagatctgtattuatttcagtgttactuacct

SEQ ID NO: 80015 - DNA, 27 bp, Artificial Sequence
  Synthetic
gactctgaagatguacctatggtccua

SEQ ID NO: 80016 - DNA, 25 bp, Artificial Sequence
  Synthetic
agctcagacacuctatcaucaccaa

SEQ ID NO: 80017 - DNA, 19 bp, Artificial Sequence
  Synthetic
cagccgguggauggagaag

SEQ ID NO: 80018 - DNA, 28 bp, Artificial Sequence
  Synthetic
gtctactgttcuagaaggcaaaucacat

SEQ ID NO: 80019 - DNA, 28 bp, Artificial Sequence
  Synthetic
gtggacaggtuttgaaagatatttgugt

SEQ ID NO: 80020 - DNA, 23 bp, Artificial Sequence
  Synthetic
tcagatttguacaaccccagcuc

SEQ ID NO: 80021 - DNA, 22 bp, Artificial Sequence
  Synthetic
gatguaagggaagcccagucat

SEQ ID NO: 80022 - DNA, 22 bp, Artificial Sequence
  Synthetic
gccaguggactacuaaaaccca

SEQ ID NO: 80023 - DNA, 24 bp, Artificial Sequence
  Synthetic
gcgctcgutctcctcuaaacaaaa

SEQ ID NO: 80024 - DNA, 23 bp, Artificial Sequence
  Synthetic
ggaggcctugaatagaaagcuca

SEQ ID NO: 80025 - DNA, 21 bp, Artificial Sequence
  Synthetic
gutgcaggtctugcagaggat

SEQ ID NO: 80026 - DNA, 21 bp, Artificial Sequence
  Synthetic
tgttgugagccctuccacaag

SEQ ID NO: 80027 - DNA, 28 bp, Artificial Sequence
  Synthetic
ccagctgtagtuctattaccaagtttug

SEQ ID NO: 80028 - DNA, 22 bp, Artificial Sequence
  Synthetic
gagauaaccaaggctgcuaccc

SEQ ID NO: 80029 - DNA, 28 bp, Artificial Sequence
  Synthetic
tctttttcttgugttcgttcttcucagt

SEQ ID NO: 80030 - DNA, 23 bp, Artificial Sequence
  Synthetic
caaaauggaagcagcagtucaga

SEQ ID NO: 80031 - DNA, 27 bp, Artificial Sequence
  Synthetic
tccatcagcugttttcgttgtaauagt

SEQ ID NO: 80032 - DNA, 21 bp, Artificial Sequence
  Synthetic
tggatgtcaguctgccctuct

SEQ ID NO: 80033 - DNA, 24 bp, Artificial Sequence
  Synthetic
acttagctuggaagctgacaagug

SEQ ID NO: 80034 - DNA, 22 bp, Artificial Sequence
  Synthetic
cataagccaugtggctcatgut

SEQ ID NO: 80035 - DNA, 25 bp, Artificial Sequence
  Synthetic
tggtgtugagacaggattactcuga

SEQ ID NO: 80036 - DNA, 22 bp, Artificial Sequence
  Synthetic
tggtgacgccacuaaacactuc

SEQ ID NO: 80037 - DNA, 21 bp, Artificial Sequence
  Synthetic
agtggatcccugatcccacut

SEQ ID NO: 80038 - DNA, 25 bp, Artificial Sequence
  Synthetic
ggagtacttcuttgggttgactuct

SEQ ID NO: 80039 - DNA, 21 bp, Artificial Sequence
  Synthetic
tcagttcucccaccttcugct

SEQ ID NO: 80040 - DNA, 27 bp, Artificial Sequence
  Synthetic
gagttattucccctaactucacaagca

SEQ ID NO: 80041 - DNA, 28 bp, Artificial Sequence
  Synthetic
ttcctgaauagcagaaaaggtctcatut

SEQ ID NO: 80042 - DNA, 20 bp, Artificial Sequence
  Synthetic
gctgctgucaccacctguag

SEQ ID NO: 80043 - DNA, 20 bp, Artificial Sequence
  Synthetic
cacctgcugcgattcuacga

SEQ ID NO: 80044 - DNA, 20 bp, Artificial Sequence
  Synthetic
tcctcccauttgcagaugcc

SEQ ID NO: 80045 - DNA, 23 bp, Artificial Sequence
  Synthetic
gggtgaguaagagactgatcugt

SEQ ID NO: 80046 - DNA, 22 bp, Artificial Sequence
  Synthetic
cttgaggccuttctuacccaga

SEQ ID NO: 80047 - DNA, 28 bp, Artificial Sequence
  Synthetic
caattacctgtuaatcaaggcaaacuca

SEQ ID NO: 80048 - DNA, 21 bp, Artificial Sequence
  Synthetic
cctgtttugcactggccttua

SEQ ID NO: 80049 - DNA, 27 bp, Artificial Sequence
  Synthetic
gaggtaaccacauagctgatcugaaaa

SEQ ID NO: 80050 - DNA, 24 bp, Artificial Sequence
  Synthetic
gttcactgauaccacctuaaggct

SEQ ID NO: 80051 - DNA, 28 bp, Artificial Sequence
  Synthetic
accgctcaaatgutatctgggaaatuaa

SEQ ID NO: 80052 - DNA, 21 bp, Artificial Sequence
  Synthetic
agggcaaggccccautatauc

SEQ ID NO: 80053 - DNA, 25 bp, Artificial Sequence
  Synthetic
gataatggcagutctcacacacauc

SEQ ID NO: 80054 - DNA, 27 bp, Artificial Sequence
  Synthetic
agctccatacuctctttacguagaact

SEQ ID NO: 80055 - DNA, 28 bp, Artificial Sequence
  Synthetic
aatttgtctgctgauttctcaacctcua

SEQ ID NO: 80056 - DNA, 25 bp, Artificial Sequence
  Synthetic
gataacattugagcggtguggaaaa

SEQ ID NO: 80057 - DNA, 31 bp, Artificial Sequence
  Synthetic
gtttcctctttutaaagccttaatuccagat

SEQ ID NO: 80058 - DNA, 27 bp, Artificial Sequence
  Synthetic
agaggttcctuaagatctcgattucct

SEQ ID NO: 80059 - DNA, 21 bp, Artificial Sequence
  Synthetic
acagcacaugcatcttuccct

SEQ ID NO: 80060 - DNA, 25 bp, Artificial Sequence
  Synthetic
ggaagatgacuggatggaaaacauc

SEQ ID NO: 80061 - DNA, 23 bp, Artificial Sequence
  Synthetic
gcattctcuacccaactcccuca

SEQ ID NO: 80062 - DNA, 22 bp, Artificial Sequence
  Synthetic
ccactgtgutgtaaggccuact

SEQ ID NO: 80063 - DNA, 28 bp, Artificial Sequence
  Synthetic
gatagtcttggauctttgctcgaauaca

SEQ ID NO: 80064 - DNA, 28 bp, Artificial Sequence
  Synthetic
ccaaagtttgtgautccacatttctcut

SEQ ID NO: 80065 - DNA, 28 bp, Artificial Sequence
  Synthetic
cactcuggagagagaacaaataaauggt

SEQ ID NO: 80066 - DNA, 28 bp, Artificial Sequence
  Synthetic
ccctagcuacaagacattctuaccaaaa

SEQ ID NO: 80067 - DNA, 26 bp, Artificial Sequence
  Synthetic
cttaagtttcaaguttctggcagugg

SEQ ID NO: 80068 - DNA, 27 bp, Artificial Sequence
  Synthetic
gacttgaccacutatgttgtcuaaggt

SEQ ID NO: 80069 - DNA, 28 bp, Artificial Sequence
  Synthetic
aagtcacagagcutaatatttccactuc

SEQ ID NO: 80070 - DNA, 23 bp, Artificial Sequence
  Synthetic
aaaggaatuggccactgtguact

SEQ ID NO: 80071 - DNA, 24 bp, Artificial Sequence
  Synthetic
gctcugaaggaaacaccgacauac

SEQ ID NO: 80072 - DNA, 27 bp, Artificial Sequence
  Synthetic
tgtcttgcagauatcaaacctuccaat

SEQ ID NO: 80073 - DNA, 22 bp, Artificial Sequence
  Synthetic
ctaucaagcaagaaggccugga

SEQ ID NO: 80074 - DNA, 28 bp, Artificial Sequence
  Synthetic
gcagatttatucagcaattcagccaaug

SEQ ID NO: 80075 - DNA, 26 bp, Artificial Sequence
  Synthetic
accacttccaggutcttttactucaa

SEQ ID NO: 80076 - DNA, 25 bp, Artificial Sequence
  Synthetic
caguctgccttcuacacagagaaat

SEQ ID NO: 80077 - DNA, 28 bp, Artificial Sequence
  Synthetic
ctgttctgtcagugtctcactttcttua

SEQ ID NO: 80078 - DNA, 25 bp, Artificial Sequence
  Synthetic
gaautcagtggucaagagggaaaca

SEQ ID NO: 80079 - DNA, 25 bp, Artificial Sequence
  Synthetic
tcaaaugggagaagtgcaauaccat

SEQ ID NO: 80080 - DNA, 22 bp, Artificial Sequence
  Synthetic
cttgcacttcucagagggctua

SEQ ID NO: 80081 - DNA, 22 bp, Artificial Sequence
  Synthetic
cagtcagacagacugcctctug

SEQ ID NO: 80082 - DNA, 21 bp, Artificial Sequence
  Synthetic
cactgacutgattcccuggct

SEQ ID NO: 80083 - DNA, 24 bp, Artificial Sequence
  Synthetic
cagtctgtacugtgccacaucaat

SEQ ID NO: 80084 - DNA, 22 bp, Artificial Sequence
  Synthetic
acacaggtccugaagctctcua

SEQ ID NO: 80085 - DNA, 23 bp, Artificial Sequence
  Synthetic
ctcttaucggagaagaacguggt

SEQ ID NO: 80086 - DNA, 22 bp, Artificial Sequence
  Synthetic
gtgtggtucagagggactguag

SEQ ID NO: 80087 - DNA, 22 bp, Artificial Sequence
  Synthetic
gtctagugaggaaggcaugcaa

SEQ ID NO: 80088 - DNA, 22 bp, Artificial Sequence
  Synthetic
ggcaccttcaugccagagauat

SEQ ID NO: 80089 - DNA, 25 bp, Artificial Sequence
  Synthetic
tctcagttccutagcataacccuca

SEQ ID NO: 80090 - DNA, 24 bp, Artificial Sequence
  Synthetic
gccaagccaaagucacagatttua

SEQ ID NO: 80091 - DNA, 27 bp, Artificial Sequence
  Synthetic
ggtcacaacagaugtgaaagagaucag

SEQ ID NO: 80092 - DNA, 21 bp, Artificial Sequence
  Synthetic
agatttguttggcgugccaag

SEQ ID NO: 80093 - DNA, 27 bp, Artificial Sequence
  Synthetic
tctctgacaaaagugaatgaggguaga

SEQ ID NO: 80094 - DNA, 28 bp, Artificial Sequence
  Synthetic
ggaggaaggcaaauttgtgatgatgaua

SEQ ID NO: 80095 - DNA, 26 bp, Artificial Sequence
  Synthetic
gatcttgtgctuctccctcagataug

SEQ ID NO: 80096 - DNA, 27 bp, Artificial Sequence
  Synthetic
ctttcctctagguaataaaaggccuga

SEQ ID NO: 80097 - DNA, 28 bp, Artificial Sequence
  Synthetic
ggaagcaacagccuttggattatatcua

SEQ ID NO: 80098 - DNA, 22 bp, Artificial Sequence
  Synthetic
ggcaggcagacugagatuaaga

SEQ ID NO: 80099 - DNA, 22 bp, Artificial Sequence
  Synthetic
gaataggcgugggtgatgtuca

SEQ ID NO: 80100 - DNA, 24 bp, Artificial Sequence
  Synthetic
ctggtaaagagacgugggaaauga

SEQ ID NO: 80101 - DNA, 25 bp, Artificial Sequence
  Synthetic
gcctcttcugtaagacacucacaat

SEQ ID NO: 80102 - DNA, 25 bp, Artificial Sequence
  Synthetic
ggtttgaatucagtactccctugga

SEQ ID NO: 80103 - DNA, 19 bp, Artificial Sequence
  Synthetic
gcctcgaucgacgtcctut

SEQ ID NO: 80104 - DNA, 20 bp, Artificial Sequence
  Synthetic
tgctcccccuttaaccugga

SEQ ID NO: 80105 - DNA, 23 bp, Artificial Sequence
  Synthetic
cctccccttugttagcactacug

SEQ ID NO: 80106 - DNA, 23 bp, Artificial Sequence
  Synthetic
ggagtaactauttcccccauccc

SEQ ID NO: 80107 - DNA, 22 bp, Artificial Sequence
  Synthetic
gaaccaaguactcagcctucct

SEQ ID NO: 80108 - DNA, 25 bp, Artificial Sequence
  Synthetic
agtgtcattuccgatcactttugga

SEQ ID NO: 80109 - DNA, 28 bp, Artificial Sequence
  Synthetic
ggcacttcatautaatacctcccugaaa

SEQ ID NO: 80110 - DNA, 21 bp, Artificial Sequence
  Synthetic
ccccaggaaccuccaguaaag

SEQ ID NO: 80111 - DNA, 25 bp, Artificial Sequence
  Synthetic
catctcagagugaaacacccactua

SEQ ID NO: 80112 - DNA, 25 bp, Artificial Sequence
  Synthetic
tgattcttccuctcactcucaggat

SEQ ID NO: 80113 - DNA, 32 bp, Artificial Sequence
  Synthetic
ccaaaatgtttctauatttcaatgtctccaut

SEQ ID NO: 80114 - DNA, 24 bp, Artificial Sequence
  Synthetic
gttcccugagcgttaacgaguaaa

SEQ ID NO: 80115 - DNA, 19 bp, Artificial Sequence
  Synthetic
cgacucgcagctgcctuac

SEQ ID NO: 80116 - DNA, 29 bp, Artificial Sequence
  Synthetic
aggaagtgatttutgacagaagtattugt

SEQ ID NO: 80117 - DNA, 22 bp, Artificial Sequence
  Synthetic
tctggctgcutcttgtgttuct

SEQ ID NO: 80118 - DNA, 20 bp, Artificial Sequence
  Synthetic
gccagaaccaucaccugcat

SEQ ID NO: 80119 - DNA, 25 bp, Artificial Sequence
  Synthetic
ggttgaaaagcugggaaaagtuagg

SEQ ID NO: 80120 - DNA, 28 bp, Artificial Sequence
  Synthetic
gttggcagtaatutttgctttctttcut

SEQ ID NO: 80121 - DNA, 25 bp, Artificial Sequence
  Synthetic
aggctgtggtutcaatgtagactuc

SEQ ID NO: 80122 - DNA, 20 bp, Artificial Sequence
  Synthetic
cccccucuaacagcaaccaa

SEQ ID NO: 80123 - DNA, 24 bp, Artificial Sequence
  Synthetic
ctgactucacctgcacatuaaagg

SEQ ID NO: 80124 - DNA, 23 bp, Artificial Sequence
  Synthetic
ccaaccagggacgcuattaugaa

SEQ ID NO: 80125 - DNA, 22 bp, Artificial Sequence
  Synthetic
ggatacaucccaggagggtuct

SEQ ID NO: 80126 - DNA, 20 bp, Artificial Sequence
  Synthetic
accaggguacactcctccug

SEQ ID NO: 80127 - DNA, 24 bp, Artificial Sequence
  Synthetic
acccctgtatuctcctccttaugt

SEQ ID NO: 80128 - DNA, 28 bp, Artificial Sequence
  Synthetic
ttttctctttatuccccactgtcttcuc

SEQ ID NO: 80129 - DNA, 20 bp, Artificial Sequence
  Synthetic
cgtctuccagtgccatucgt

SEQ ID NO: 80130 - DNA, 21 bp, Artificial Sequence
  Synthetic
cctccactucttcaaggccua

SEQ ID NO: 80131 - DNA, 21 bp, Artificial Sequence
  Synthetic
gtgtugaaggagguggacact

SEQ ID NO: 80132 - DNA, 21 bp, Artificial Sequence
  Synthetic
ctgugaccagccatuccaact

SEQ ID NO: 80133 - DNA, 23 bp, Artificial Sequence
  Synthetic
cacccctugagggaataatuggt

SEQ ID NO: 80134 - DNA, 22 bp, Artificial Sequence
  Synthetic
tctgtgcuatggctugaaggag

SEQ ID NO: 80135 - DNA, 21 bp, Artificial Sequence
  Synthetic
cgcccccacuagggatgtaut

SEQ ID NO: 80136 - DNA, 24 bp, Artificial Sequence
  Synthetic
ctataacacucagccagttccugt

SEQ ID NO: 80137 - DNA, 20 bp, Artificial Sequence
  Synthetic
ctggcccugctgcataguag

SEQ ID NO: 80138 - DNA, 21 bp, Artificial Sequence
  Synthetic
cctcucacagacccagaagug

SEQ ID NO: 80139 - DNA, 22 bp, Artificial Sequence
  Synthetic
cctcctgguccacagaacaaug

SEQ ID NO: 80140 - DNA, 20 bp, Artificial Sequence
  Synthetic
gcctaccaucggctctguct

SEQ ID NO: 80141 - DNA, 26 bp, Artificial Sequence
  Synthetic
acuaaggtggaucaacgagaagagaa

SEQ ID NO: 80142 - DNA, 22 bp, Artificial Sequence
  Synthetic
agattuccccaaacacagccut

SEQ ID NO: 80143 - DNA, 21 bp, Artificial Sequence
  Synthetic
gctgagttucgatcggaucct

SEQ ID NO: 80144 - DNA, 19 bp, Artificial Sequence
  Synthetic
accagagcucggaucccat

SEQ ID NO: 80145 - DNA, 19 bp, Artificial Sequence
  Synthetic
caggctucgccgagtaguc

SEQ ID NO: 80146 - DNA, 21 bp, Artificial Sequence
  Synthetic
cacctgcaccagauccttcut

SEQ ID NO: 80147 - DNA, 21 bp, Artificial Sequence
  Synthetic
gtctgagagcucggatctugg

SEQ ID NO: 80148 - DNA, 28 bp, Artificial Sequence
  Synthetic
tgatatataguccatccttucagccgat

SEQ ID NO: 80149 - DNA, 24 bp, Artificial Sequence
  Synthetic
aggcatccugaactttcccaauac

SEQ ID NO: 80150 - DNA, 23 bp, Artificial Sequence
  Synthetic
ccttcccttcucaggtgctatuc

SEQ ID NO: 80151 - DNA, 25 bp, Artificial Sequence
  Synthetic
acaaaggcutaccctatugaacacc

SEQ ID NO: 80152 - DNA, 28 bp, Artificial Sequence
  Synthetic
aggcaguctattgataaaucagaagcaa

SEQ ID NO: 80153 - DNA, 31 bp, Artificial Sequence
  Synthetic
ctatgaagtactataugtgatgcaaccauct

SEQ ID NO: 80154 - DNA, 26 bp, Artificial Sequence
  Synthetic
tgtgtctgugacaaatttgactgcua

SEQ ID NO: 80155 - DNA, 22 bp, Artificial Sequence
  Synthetic
ggtaagugagagcuggagacag

SEQ ID NO: 80156 - DNA, 24 bp, Artificial Sequence
  Synthetic
ttctcttugccagtccatctucaa

SEQ ID NO: 80157 - DNA, 30 bp, Artificial Sequence
  Synthetic
tgagtcagaataaauctcacctgataguga

SEQ ID NO: 80158 - DNA, 25 bp, Artificial Sequence
  Synthetic
gtgccaccuaaaacattgttaugct

SEQ ID NO: 80159 - DNA, 33 bp, Artificial Sequence
  Synthetic
aaacagtatgtctautacaataacaaaaagugg

SEQ ID NO: 80160 - DNA, 23 bp, Artificial Sequence
  Synthetic
atctggcucgggatctagtacuc

SEQ ID NO: 80161 - DNA, 26 bp, Artificial Sequence
  Synthetic
acccacctatuacctgtcacatgaua

SEQ ID NO: 80162 - DNA, 21 bp, Artificial Sequence
  Synthetic
ctggcccuctccaagugaaat

SEQ ID NO: 80163 - DNA, 28 bp, Artificial Sequence
  Synthetic
cacacctcttcuatttttgcttttccut

SEQ ID NO: 80164 - DNA, 27 bp, Artificial Sequence
  Synthetic
gcttttctaacuctctttgacugcaga

SEQ ID NO: 80165 - DNA, 26 bp, Artificial Sequence
  Synthetic
ggattguggcacagagattctgauac

SEQ ID NO: 80166 - DNA, 27 bp, Artificial Sequence
  Synthetic
acaaccuaaccagaaaattcctuggat

SEQ ID NO: 80167 - DNA, 28 bp, Artificial Sequence
  Synthetic
cttccttaccacauaggagaatgtacug

SEQ ID NO: 80168 - DNA, 21 bp, Artificial Sequence
  Synthetic
gtggctugggctactacagua

SEQ ID NO: 80169 - DNA, 21 bp, Artificial Sequence
  Synthetic
tcatgccugggtagtgttugg

SEQ ID NO: 80170 - DNA, 19 bp, Artificial Sequence
  Synthetic
agctgtcugctccccatug

SEQ ID NO: 80171 - DNA, 24 bp, Artificial Sequence
  Synthetic
acagaggacccuctttcatuacct

SEQ ID NO: 80172 - DNA, 17 bp, Artificial Sequence
  Synthetic
ctcagcagccuccucgt

SEQ ID NO: 80173 - DNA, 17 bp, Artificial Sequence
  Synthetic
gccgcucuccccaaaca

SEQ ID NO: 80174 - DNA, 21 bp, Artificial Sequence
  Synthetic
tcatcgtccucagcctctuca

SEQ ID NO: 80175 - DNA, 18 bp, Artificial Sequence
  Synthetic
gggttccucgccccctua

SEQ ID NO: 80176 - DNA, 26 bp, Artificial Sequence
  Synthetic
tgtgaggaattuctcctttgttguga

SEQ ID NO: 80177 - DNA, 23 bp, Artificial Sequence
  Synthetic
gttcagcacuttgatggtuccag

SEQ ID NO: 80178 - DNA, 21 bp, Artificial Sequence
  Synthetic
agccacagccgaaagutauca

SEQ ID NO: 80179 - DNA, 26 bp, Artificial Sequence
  Synthetic
gttcaggaattcutccagctttctuc

SEQ ID NO: 80180 - DNA, 20 bp, Artificial Sequence
  Synthetic
caagccagugtcctgacuga

SEQ ID NO: 80181 - DNA, 23 bp, Artificial Sequence
  Synthetic
ccctttgccuacttctccctcua

SEQ ID NO: 80182 - DNA, 23 bp, Artificial Sequence
  Synthetic
ggaggttcuctggatcaagucct

SEQ ID NO: 80183 - DNA, 28 bp, Artificial Sequence
  Synthetic
catcttcctcucttgtccatttctuacc

SEQ ID NO: 80184 - DNA, 19 bp, Artificial Sequence
  Synthetic
cccagccugttaggcctua

SEQ ID NO: 80185 - DNA, 28 bp, Artificial Sequence
  Synthetic
tcttgattcattuccttctttcctucca

SEQ ID NO: 80186 - DNA, 23 bp, Artificial Sequence
  Synthetic
tgctccagggucattttatuggg

SEQ ID NO: 80187 - DNA, 25 bp, Artificial Sequence
  Synthetic
tttcttacctgutctctcccugagt

SEQ ID NO: 80188 - DNA, 32 bp, Artificial Sequence
  Synthetic
tctttctttagcaaacuaacttaccttaccuc

SEQ ID NO: 80189 - DNA, 27 bp, Artificial Sequence
  Synthetic
gttgcttcaccautatgtactgaccua

SEQ ID NO: 80190 - DNA, 33 bp, Artificial Sequence
  Synthetic
ttctcattatttauacccttttaagaatgcuct

SEQ ID NO: 80191 - DNA, 26 bp, Artificial Sequence
  Synthetic
ggtgacttttagugcatccaagatug

SEQ ID NO: 80192 - DNA, 30 bp, Artificial Sequence
  Synthetic
agcatttttcatuaaagcatttcaccacut

SEQ ID NO: 80193 - DNA, 19 bp, Artificial Sequence
  Synthetic
cacaauccgctgggucgat

SEQ ID NO: 80194 - DNA, 28 bp, Artificial Sequence
  Synthetic
actaaaattgutgattgtgaucgaccca

SEQ ID NO: 80195 - DNA, 28 bp, Artificial Sequence
  Synthetic
gttagacttaaaagagcugaagcaccua

SEQ ID NO: 80196 - DNA, 23 bp, Artificial Sequence
  Synthetic
ttccatgcaggucatgcactaut

SEQ ID NO: 80197 - DNA, 22 bp, Artificial Sequence
  Synthetic
cgcaagcccucactgttttuac

SEQ ID NO: 80198 - DNA, 28 bp, Artificial Sequence
  Synthetic
ggtgcttcagcucttttaagtcuaacat

SEQ ID NO: 80199 - DNA, 33 bp, Artificial Sequence
  Synthetic
ttatacaaattaagtatuacgaatttgcccgut

SEQ ID NO: 80200 - DNA, 23 bp, Artificial Sequence
  Synthetic
aaattggaagucgttucaacgga

SEQ ID NO: 80201 - DNA, 24 bp, Artificial Sequence
  Synthetic
cctguatcacagacuggcaacaag

SEQ ID NO: 80202 - DNA, 20 bp, Artificial Sequence
  Synthetic
gcgatgcacgguaccatcut

SEQ ID NO: 80203 - DNA, 27 bp, Artificial Sequence
  Synthetic
accctgtaauggatcttaaagcatucc

SEQ ID NO: 80204 - DNA, 25 bp, Artificial Sequence
  Synthetic
cattccacccaaagcaugttatcut

SEQ ID NO: 80205 - DNA, 32 bp, Artificial Sequence
  Synthetic
cacatgttttggaaaugactgtaaaataugga

SEQ ID NO: 80206 - DNA, 20 bp, Artificial Sequence
  Synthetic
aactugggccagcaactcut

SEQ ID NO: 80207 - DNA, 21 bp, Artificial Sequence
  Synthetic
ttcacgtcacuggtctgtucc

SEQ ID NO: 80208 - DNA, 21 bp, Artificial Sequence
  Synthetic
ccaccaccagcucctagtcut

SEQ ID NO: 80209 - DNA, 22 bp, Artificial Sequence
  Synthetic
tttcccctcuctaccctcucag

SEQ ID NO: 80210 - DNA, 26 bp, Artificial Sequence
  Synthetic
cccattgacuggaggaaatugagaaa

SEQ ID NO: 80211 - DNA, 25 bp, Artificial Sequence
  Synthetic
gaacacgatcauctgtccttgttug

SEQ ID NO: 80212 - DNA, 27 bp, Artificial Sequence
  Synthetic
ggaatttatgcguatgattggcaauga

SEQ ID NO: 80213 - DNA, 28 bp, Artificial Sequence
  Synthetic
agaaaatgcatgacuaccctggatuaaa

SEQ ID NO: 80214 - DNA, 27 bp, Artificial Sequence
  Synthetic
gactctgtttuccttcaggatacauca

SEQ ID NO: 80215 - DNA, 19 bp, Artificial Sequence
  Synthetic
gcagugtugggagcaaggg

SEQ ID NO: 80216 - DNA, 23 bp, Artificial Sequence
  Synthetic
gaaaguctuccaggcaaggagaa

SEQ ID NO: 80217 - DNA, 29 bp, Artificial Sequence
  Synthetic
gattgatgaagaautttgtaggcgatuga

SEQ ID NO: 80218 - DNA, 28 bp, Artificial Sequence
  Synthetic
atcacaaacuaagaagcaatgaggcuat

SEQ ID NO: 80219 - DNA, 25 bp, Artificial Sequence
  Synthetic
aggaagatgguaagggatacuggag

SEQ ID NO: 80220 - DNA, 21 bp, Artificial Sequence
  Synthetic
ccaccaucccaccacattcua

SEQ ID NO: 80221 - DNA, 23 bp, Artificial Sequence
  Synthetic
ccatggccutttgtgttctucag

SEQ ID NO: 80222 - DNA, 23 bp, Artificial Sequence
  Synthetic
gggccctcautctagttcctuct

SEQ ID NO: 80223 - DNA, 26 bp, Artificial Sequence
  Synthetic
gatacataggugatgaggatgugcaa

SEQ ID NO: 80224 - DNA, 22 bp, Artificial Sequence
  Synthetic
ctggtttctggugggaccatua

SEQ ID NO: 80225 - DNA, 20 bp, Artificial Sequence
  Synthetic
caugcaccggaaaagcgaug

SEQ ID NO: 80226 - DNA, 23 bp, Artificial Sequence
  Synthetic
cacttgcttcutcactccaguca

SEQ ID NO: 80227 - DNA, 25 bp, Artificial Sequence
  Synthetic
aggttttctgtugtttggtttgcut

SEQ ID NO: 80228 - DNA, 20 bp, Artificial Sequence
  Synthetic
tgcgtcggacuctctgtcua

SEQ ID NO: 80229 - DNA, 20 bp, Artificial Sequence
  Synthetic
caaacccugcactcaccuga

SEQ ID NO: 80230 - DNA, 21 bp, Artificial Sequence
  Synthetic
cataaggtcugccgaagccut

SEQ ID NO: 80231 - DNA, 24 bp, Artificial Sequence
  Synthetic
gggagcaaagcaagugtcuaaagt

SEQ ID NO: 80232 - DNA, 26 bp, Artificial Sequence
  Synthetic
tttgaatttccauggtgtgguaagga

SEQ ID NO: 80233 - DNA, 27 bp, Artificial Sequence
  Synthetic
caggttccagacauggctatttttaug

SEQ ID NO: 80234 - DNA, 25 bp, Artificial Sequence
  Synthetic
ttgtaaagatgccugtcatgcagua

SEQ ID NO: 80235 - DNA, 21 bp, Artificial Sequence
  Synthetic
tcacgcaggugaaacagugag

SEQ ID NO: 80236 - DNA, 20 bp, Artificial Sequence
  Synthetic
caccgggaaggccuatcauc

SEQ ID NO: 80237 - DNA, 21 bp, Artificial Sequence
  Synthetic
gtgacgagagaguaggtugcc

SEQ ID NO: 80238 - DNA, 22 bp, Artificial Sequence
  Synthetic
cctactcuggaccccatctuct

SEQ ID NO: 80239 - DNA, 23 bp, Artificial Sequence
  Synthetic
acagccccauctttcttaagcug

SEQ ID NO: 80240 - DNA, 22 bp, Artificial Sequence
  Synthetic
tcgaggaaaagucatcgcctuc

SEQ ID NO: 80241 - DNA, 22 bp, Artificial Sequence
  Synthetic
ggcctctcucttacccactuca

SEQ ID NO: 80242 - DNA, 20 bp, Artificial Sequence
  Synthetic
cctccagagugggctcctua

SEQ ID NO: 80243 - DNA, 20 bp, Artificial Sequence
  Synthetic
tcccgagtuctgggcattuc

SEQ ID NO: 80244 - DNA, 21 bp, Artificial Sequence
  Synthetic
gaatgccugctgaugccaaat

SEQ ID NO: 80245 - DNA, 28 bp, Artificial Sequence
  Synthetic
ctggtcccauaaatctctcatcttugaa

SEQ ID NO: 80246 - DNA, 27 bp, Artificial Sequence
  Synthetic
gatcttctgaacuagtgtgttggugaa

SEQ ID NO: 80247 - DNA, 24 bp, Artificial Sequence
  Synthetic
gaucttctatctgucggacaggga

SEQ ID NO: 80248 - DNA, 22 bp, Artificial Sequence
  Synthetic
cctctgcugtgtactcuccact

SEQ ID NO: 80249 - DNA, 24 bp, Artificial Sequence
  Synthetic
gccatggctutctgtgctaaaaug

SEQ ID NO: 80250 - DNA, 22 bp, Artificial Sequence
  Synthetic
cctcagtcutcttggagcucct

SEQ ID NO: 80251 - DNA, 28 bp, Artificial Sequence
  Synthetic
acactccctttugccataagaactttua

SEQ ID NO: 80252 - DNA, 28 bp, Artificial Sequence
  Synthetic
ccaagttatagacugtttttgcttgugt

SEQ ID NO: 80253 - DNA, 22 bp, Artificial Sequence
  Synthetic
caggctgccaagucattcagua

SEQ ID NO: 80254 - DNA, 28 bp, Artificial Sequence
  Synthetic
tgttttctctuacaggcaaatgttcuga

SEQ ID NO: 80255 - DNA, 28 bp, Artificial Sequence
  Synthetic
gtaaagatacaccugaagaactggauct

SEQ ID NO: 80256 - DNA, 26 bp, Artificial Sequence
  Synthetic
tccaggagagcaaauaaagtaaugcc

SEQ ID NO: 80257 - DNA, 23 bp, Artificial Sequence
  Synthetic
ggccacagaacugaaacatctuc

SEQ ID NO: 80258 - DNA, 28 bp, Artificial Sequence
  Synthetic
agaggtttgagutcttcttcuagacact

SEQ ID NO: 80259 - DNA, 27 bp, Artificial Sequence
  Synthetic
agtgacatugagaacagagagaauggt

SEQ ID NO: 80260 - DNA, 28 bp, Artificial Sequence
  Synthetic
ctggaaaugccaattctaugaagcaaat

SEQ ID NO: 80261 - DNA, 25 bp, Artificial Sequence
  Synthetic
ccacaagcttuagaagcagcaauac

SEQ ID NO: 80262 - DNA, 24 bp, Artificial Sequence
  Synthetic
gggagtatgutgcagaagaaauct

SEQ ID NO: 80263 - DNA, 22 bp, Artificial Sequence
  Synthetic
acgccagccauacaagcatuaa

SEQ ID NO: 80264 - DNA, 17 bp, Artificial Sequence
  Synthetic
cgcgcguagccaucgaa

SEQ ID NO: 80265 - DNA, 21 bp, Artificial Sequence
  Synthetic
gcgcaccuggaagactacuac

SEQ ID NO: 80266 - DNA, 17 bp, Artificial Sequence
  Synthetic
ggguagccggtcaucca

SEQ ID NO: 80267 - DNA, 18 bp, Artificial Sequence
  Synthetic
cuccacccccaugagcac

SEQ ID NO: 80268 - DNA, 17 bp, Artificial Sequence
  Synthetic
tccaggugcgccttcug

SEQ ID NO: 80269 - DNA, 22 bp, Artificial Sequence
  Synthetic
agugaaaaaggaaccgguggag

SEQ ID NO: 80270 - DNA, 18 bp, Artificial Sequence
  Synthetic
gctgaugatgcggucggt

SEQ ID NO: 80271 - DNA, 22 bp, Artificial Sequence
  Synthetic
tcagaacuggcaaugagcaact

SEQ ID NO: 80272 - DNA, 28 bp, Artificial Sequence
  Synthetic
ggttccttttucacttcaaacttcauca

SEQ ID NO: 80273 - DNA, 18 bp, Artificial Sequence
  Synthetic
ctctccugcagcccauct

SEQ ID NO: 80274 - DNA, 25 bp, Artificial Sequence
  Synthetic
aactttgggcuttacgttactguct

SEQ ID NO: 80275 - DNA, 27 bp, Artificial Sequence
  Synthetic
aatgtccacugttttgtugagcaaaat

SEQ ID NO: 80276 - DNA, 26 bp, Artificial Sequence
  Synthetic
acctctgcuagccagacaactataut

SEQ ID NO: 80277 - DNA, 27 bp, Artificial Sequence
  Synthetic
attcttgaauagaggaatggcggauag

SEQ ID NO: 80278 - DNA, 28 bp, Artificial Sequence
  Synthetic
ccaagccautaaaauagaagaggaagca

SEQ ID NO: 80279 - DNA, 28 bp, Artificial Sequence
  Synthetic
cttgctatcttgacugtctcgatcatua

SEQ ID NO: 80280 - DNA, 27 bp, Artificial Sequence
  Synthetic
ccaaggaaccuactggtgtcatgtaua

SEQ ID NO: 80281 - DNA, 28 bp, Artificial Sequence
  Synthetic
tcctttgcttaatuaaacgttgcagtut

SEQ ID NO: 80282 - DNA, 22 bp, Artificial Sequence
  Synthetic
gcaagagaucagcugaaggaca

SEQ ID NO: 80283 - DNA, 27 bp, Artificial Sequence
  Synthetic
gaaataaattatgggaugccagtcgut

SEQ ID NO: 80284 - DNA, 23 bp, Artificial Sequence
  Synthetic
caaguacccccuccgacaaaaat

SEQ ID NO: 80285 - DNA, 28 bp, Artificial Sequence
  Synthetic
ctgcatggauggagtattctttaguaca

SEQ ID NO: 80286 - DNA, 24 bp, Artificial Sequence
  Synthetic
cagtgatutcttcagguggagagg

SEQ ID NO: 80287 - DNA, 27 bp, Artificial Sequence
  Synthetic
ctagtatcactcuctgtcccatcauca

SEQ ID NO: 80288 - DNA, 28 bp, Artificial Sequence
  Synthetic
cacaggttcauaacacaacatcuagaga

SEQ ID NO: 80289 - DNA, 23 bp, Artificial Sequence
  Synthetic
tgtgtgttgguctcgatcatucc

SEQ ID NO: 80290 - DNA, 25 bp, Artificial Sequence
  Synthetic
caaaaatctcacagutggatggugt

SEQ ID NO: 80291 - DNA, 28 bp, Artificial Sequence
  Synthetic
ccagcatctucaggtctatcaatcttua

SEQ ID NO: 80292 - DNA, 24 bp, Artificial Sequence
  Synthetic
cctgcctucagacattatggacut

SEQ ID NO: 80293 - DNA, 26 bp, Artificial Sequence
  Synthetic
cccatgtctttutcacgattactguc

SEQ ID NO: 80294 - DNA, 22 bp, Artificial Sequence
  Synthetic
caccuccattugagagggcaaa

SEQ ID NO: 80295 - DNA, 28 bp, Artificial Sequence
  Synthetic
tctcctatctcuggaactagatcccaua

SEQ ID NO: 80296 - DNA, 28 bp, Artificial Sequence
  Synthetic
gccagatuccaaaaagaaatgguaaaga

SEQ ID NO: 80297 - DNA, 24 bp, Artificial Sequence
  Synthetic
ttgtccctgugttttaactcugct

SEQ ID NO: 80298 - DNA, 27 bp, Artificial Sequence
  Synthetic
ccaaagatggauaactgccattctgua

SEQ ID NO: 80299 - DNA, 28 bp, Artificial Sequence
  Synthetic
ggagctcagtatuataggtgtccaguaa

SEQ ID NO: 80300 - DNA, 25 bp, Artificial Sequence
  Synthetic
gaatcttggugaaggattgggtcut

SEQ ID NO: 80301 - DNA, 24 bp, Artificial Sequence
  Synthetic
gatcagauggtagctcuagaggca

SEQ ID NO: 80302 - DNA, 27 bp, Artificial Sequence
  Synthetic
caacagaucatccattaucaacgaaca

SEQ ID NO: 80303 - DNA, 24 bp, Artificial Sequence
  Synthetic
gcttcaaguttccttccucaccag

SEQ ID NO: 80304 - DNA, 23 bp, Artificial Sequence
  Synthetic
catggaugcagaccacatctcua

SEQ ID NO: 80305 - DNA, 22 bp, Artificial Sequence
  Synthetic
cgggccaggacuatcaguagaa

SEQ ID NO: 80306 - DNA, 20 bp, Artificial Sequence
  Synthetic
ggaaccuggtcaggugacaa

SEQ ID NO: 80307 - DNA, 28 bp, Artificial Sequence
  Synthetic
ggcctttaucaccaatcttaucagaaga

SEQ ID NO: 80308 - DNA, 23 bp, Artificial Sequence
  Synthetic
cucagcagaggaacagttugagt

SEQ ID NO: 80309 - DNA, 24 bp, Artificial Sequence
  Synthetic
tcacttucagaggaggcuacagat

SEQ ID NO: 80310 - DNA, 23 bp, Artificial Sequence
  Synthetic
gccaacgaccaugtaacaatgut

SEQ ID NO: 80311 - DNA, 28 bp, Artificial Sequence
  Synthetic
ctcattttccauttttagaggtgucagt

SEQ ID NO: 80312 - DNA, 23 bp, Artificial Sequence
  Synthetic
cagaaccagaaguatgugcccaa

SEQ ID NO: 80313 - DNA, 22 bp, Artificial Sequence
  Synthetic
gggtcacuccattuggaagagt

SEQ ID NO: 80314 - DNA, 27 bp, Artificial Sequence
  Synthetic
ggagaagagaguaaccaucacagaaaa

SEQ ID NO: 80315 - DNA, 23 bp, Artificial Sequence
  Synthetic
tugctctacugaaccacaaggag

SEQ ID NO: 80316 - DNA, 23 bp, Artificial Sequence
  Synthetic
gcacaucaacaauaagccaggat

SEQ ID NO: 80317 - DNA, 20 bp, Artificial Sequence
  Synthetic
gtcctggaacugacgcacua

SEQ ID NO: 80318 - DNA, 23 bp, Artificial Sequence
  Synthetic
atgcagccacuttatgttcucca

SEQ ID NO: 80319 - DNA, 23 bp, Artificial Sequence
  Synthetic
gagaagtuggcaagcttggatut

SEQ ID NO: 80320 - DNA, 22 bp, Artificial Sequence
  Synthetic
ggccccagguatccaacttuac

SEQ ID NO: 80321 - DNA, 24 bp, Artificial Sequence
  Synthetic
agaagauggagaggauggagaacc

SEQ ID NO: 80322 - DNA, 24 bp, Artificial Sequence
  Synthetic
gcaaacuaccacaaccccuacaag

SEQ ID NO: 80323 - DNA, 28 bp, Artificial Sequence
  Synthetic
ctgctggctagcuttgattaaaagatug

SEQ ID NO: 80324 - DNA, 21 bp, Artificial Sequence
  Synthetic
ccttcccugcagctacucaaa

SEQ ID NO: 80325 - DNA, 23 bp, Artificial Sequence
  Synthetic
ttcttgaguccagaggauggagt

SEQ ID NO: 80326 - DNA, 22 bp, Artificial Sequence
  Synthetic
ggctttaucctcagctgugcaa

SEQ ID NO: 80327 - DNA, 23 bp, Artificial Sequence
  Synthetic
aactttgtgcutcttgccatucc

SEQ ID NO: 80328 - DNA, 26 bp, Artificial Sequence
  Synthetic
ggtaccccagauattggctcaauaag

SEQ ID NO: 80329 - DNA, 21 bp, Artificial Sequence
  Synthetic
tctgtgatguccccagttgug

SEQ ID NO: 80330 - DNA, 21 bp, Artificial Sequence
  Synthetic
tcucaccctuaccacaggact

SEQ ID NO: 80331 - DNA, 23 bp, Artificial Sequence
  Synthetic
gctgatgttuggtgggaaacuac

SEQ ID NO: 80332 - DNA, 22 bp, Artificial Sequence
  Synthetic
agacctcaguaccacaguagcc

SEQ ID NO: 80333 - DNA, 27 bp, Artificial Sequence
  Synthetic
ggagggtgugaagttaatcaatgucat

SEQ ID NO: 80334 - DNA, 22 bp, Artificial Sequence
  Synthetic
gggcuaggagacaagaatcuga

SEQ ID NO: 80335 - DNA, 20 bp, Artificial Sequence
  Synthetic
acggcuacaggctgaaccua

SEQ ID NO: 80336 - DNA, 22 bp, Artificial Sequence
  Synthetic
ccgccaagutcaggaatgttuc

SEQ ID NO: 80337 - DNA, 22 bp, Artificial Sequence
  Synthetic
tgatagtgtucgtctgctuccc

SEQ ID NO: 80338 - DNA, 24 bp, Artificial Sequence
  Synthetic
ggtttcagcugcctcuagacaaag

SEQ ID NO: 80339 - DNA, 26 bp, Artificial Sequence
  Synthetic
agcctagctaguatttggatctcuca

SEQ ID NO: 80340 - DNA, 22 bp, Artificial Sequence
  Synthetic
gtagtuaggaggctccucaggt

SEQ ID NO: 80341 - DNA, 20 bp, Artificial Sequence
  Synthetic
cucacagagagggccaucag

SEQ ID NO: 80342 - DNA, 25 bp, Artificial Sequence
  Synthetic
ccaaaagagcagucacatctucaga

SEQ ID NO: 80343 - DNA, 20 bp, Artificial Sequence
  Synthetic
catcctggcacugctgguag

SEQ ID NO: 80344 - DNA, 17 bp, Artificial Sequence
  Synthetic
ccgcacaggcagucuct

SEQ ID NO: 80345 - DNA, 18 bp, Artificial Sequence
  Synthetic
gcctccucagctcuccga

SEQ ID NO: 80346 - DNA, 24 bp, Artificial Sequence
  Synthetic
gccccttcugatgtggtttcuaat

SEQ ID NO: 80347 - DNA, 28 bp, Artificial Sequence
  Synthetic
ccggttcaaaauacatgatgctagatut

SEQ ID NO: 80348 - DNA, 19 bp, Artificial Sequence
  Synthetic
gggatgaggugggatuggg

SEQ ID NO: 80349 - DNA, 18 bp, Artificial Sequence
  Synthetic
agcacggccucctcuaca

SEQ ID NO: 80350 - DNA, 21 bp, Artificial Sequence
  Synthetic
gcataacagccgcutcaccut

SEQ ID NO: 80351 - DNA, 23 bp, Artificial Sequence
  Synthetic
ctattaggagcguctaccgtcug

SEQ ID NO: 80352 - DNA, 28 bp, Artificial Sequence
  Synthetic
cgaactguccccaacatcauaaaaagat

SEQ ID NO: 80353 - DNA, 21 bp, Artificial Sequence
  Synthetic
ccctgatgugaggtggcuagt

SEQ ID NO: 80354 - DNA, 19 bp, Artificial Sequence
  Synthetic
aaatgcaggcucgagcuca

SEQ ID NO: 80355 - DNA, 22 bp, Artificial Sequence
  Synthetic
ccgtgagaucgagagttgtugt

SEQ ID NO: 80356 - DNA, 22 bp, Artificial Sequence
  Synthetic
gcatcaugcagacctaaccugt

SEQ ID NO: 80357 - DNA, 22 bp, Artificial Sequence
  Synthetic
gagaaagggugtcgtccaucag

SEQ ID NO: 80358 - DNA, 25 bp, Artificial Sequence
  Synthetic
cttagacaaggucttccttccacut

SEQ ID NO: 80359 - DNA, 24 bp, Artificial Sequence
  Synthetic
ctacctcaccugtttcctgtaugg

SEQ ID NO: 80360 - DNA, 24 bp, Artificial Sequence
  Synthetic
atgggatccaaacuggaagacauc

SEQ ID NO: 80361 - DNA, 20 bp, Artificial Sequence
  Synthetic
aatgcagugcagggaggaut

SEQ ID NO: 80362 - DNA, 25 bp, Artificial Sequence
  Synthetic
tgttgcaaatgugaaggcaaauagg

SEQ ID NO: 80363 - DNA, 26 bp, Artificial Sequence
  Synthetic
tgcttagaacuattgccatuggagag

SEQ ID NO: 80364 - DNA, 23 bp, Artificial Sequence
  Synthetic
gcacttugaacatccucagcact

SEQ ID NO: 80365 - DNA, 28 bp, Artificial Sequence
  Synthetic
caacacctttgguagtagcattttctut

SEQ ID NO: 80366 - DNA, 22 bp, Artificial Sequence
  Synthetic
gggtcacauacttcctccucct

SEQ ID NO: 80367 - DNA, 26 bp, Artificial Sequence
  Synthetic
aactgaagccauaacaacagtctuct

SEQ ID NO: 80368 - DNA, 25 bp, Artificial Sequence
  Synthetic
gcagtctgtaugttcagagtgcaut

SEQ ID NO: 80369 - DNA, 27 bp, Artificial Sequence
  Synthetic
tcagacctatauggatttggagcauca

SEQ ID NO: 80370 - DNA, 26 bp, Artificial Sequence
  Synthetic
cgttgatgcuccaaatccatauaggt

SEQ ID NO: 80371 - DNA, 28 bp, Artificial Sequence
  Synthetic
tgtcatggucgatatttaacuccaacaa

SEQ ID NO: 80372 - DNA, 28 bp, Artificial Sequence
  Synthetic
gattgttgaauatgaagcatuccccaaa

SEQ ID NO: 80373 - DNA, 23 bp, Artificial Sequence
  Synthetic
ccagggcaagguccatttctuac

SEQ ID NO: 80374 - DNA, 28 bp, Artificial Sequence
  Synthetic
tttccatcagtuagttgtgatctugaca

SEQ ID NO: 80375 - DNA, 25 bp, Artificial Sequence
  Synthetic
gctgcagttugctaagttggaguaa

SEQ ID NO: 80376 - DNA, 25 bp, Artificial Sequence
  Synthetic
gactatgggcutgttttcuccagat

SEQ ID NO: 80377 - DNA, 22 bp, Artificial Sequence
  Synthetic
ggtgacccaaacacugattcug

SEQ ID NO: 80378 - DNA, 20 bp, Artificial Sequence
  Synthetic
gcattgtccucaggcacgua

SEQ ID NO: 80379 - DNA, 20 bp, Artificial Sequence
  Synthetic
tgcttgtccugtgctctcuc

SEQ ID NO: 80380 - DNA, 21 bp, Artificial Sequence
  Synthetic
cccaaccccutgcctcataut

SEQ ID NO: 80381 - DNA, 27 bp, Artificial Sequence
  Synthetic
aguaaattccaaggugaaggaaaccag

SEQ ID NO: 80382 - DNA, 23 bp, Artificial Sequence
  Synthetic
tcagtacaaaauggccagtgcua

SEQ ID NO: 80383 - DNA, 22 bp, Artificial Sequence
  Synthetic
tcagagccacutctaggtcucc

SEQ ID NO: 80384 - DNA, 28 bp, Artificial Sequence
  Synthetic
cacagtuaaaactagtccucgaaaacct

SEQ ID NO: 80385 - DNA, 28 bp, Artificial Sequence
  Synthetic
tgatcttatcuccagatttggtctcuga

SEQ ID NO: 80386 - DNA, 21 bp, Artificial Sequence
  Synthetic
ccaaggaagcagacuagugct

SEQ ID NO: 80387 - DNA, 21 bp, Artificial Sequence
  Synthetic
cgctcttgucagcatcucgat

SEQ ID NO: 80388 - DNA, 28 bp, Artificial Sequence
  Synthetic
gatccatctgtgutttcccctctaaaua

SEQ ID NO: 80389 - DNA, 26 bp, Artificial Sequence
  Synthetic
actctgaaatgucctttccatgtgut

SEQ ID NO: 80390 - DNA, 20 bp, Artificial Sequence
  Synthetic
cgattgttutcgccacucca

SEQ ID NO: 80391 - DNA, 25 bp, Artificial Sequence
  Synthetic
ccugaagaagatgtuccagcagaag

SEQ ID NO: 80392 - DNA, 28 bp, Artificial Sequence
  Synthetic
ccaccttcccuggagtaaaaaucaaaat

SEQ ID NO: 80393 - DNA, 24 bp, Artificial Sequence
  Synthetic
ttgagaggagagaguttaccugct

SEQ ID NO: 80394 - DNA, 17 bp, Artificial Sequence
  Synthetic
tuggaccucggcccaac

SEQ ID NO: 80395 - DNA, 19 bp, Artificial Sequence
  Synthetic
gctggcaacccucttguca

SEQ ID NO: 80396 - DNA, 23 bp, Artificial Sequence
  Synthetic
cgttucagcaagccacaaagaut

SEQ ID NO: 80397 - DNA, 27 bp, Artificial Sequence
  Synthetic
gggtctttaucctttctgttgauggag

SEQ ID NO: 80398 - DNA, 24 bp, Artificial Sequence
  Synthetic
acaaautguacgacggagaggaag

SEQ ID NO: 80399 - DNA, 20 bp, Artificial Sequence
  Synthetic
ccttcgagggcuttgtcuga

SEQ ID NO: 80400 - DNA, 26 bp, Artificial Sequence
  Synthetic
gtctgtaaccutgcctagtaaucgaa

SEQ ID NO: 80401 - DNA, 23 bp, Artificial Sequence
  Synthetic
ccttccactucttgtcctcaugg

SEQ ID NO: 80402 - DNA, 19 bp, Artificial Sequence
  Synthetic
cccgaggagcuguccaaag

SEQ ID NO: 80403 - DNA, 28 bp, Artificial Sequence
  Synthetic
caggauacaaagcagaactactcugaat

SEQ ID NO: 80404 - DNA, 20 bp, Artificial Sequence
  Synthetic
cgagaugcugacaagagcgt

SEQ ID NO: 80405 - DNA, 24 bp, Artificial Sequence
  Synthetic
ttcaccaacaaccutctcttugga

SEQ ID NO: 80406 - DNA, 25 bp, Artificial Sequence
  Synthetic
tctgaaccaagauctccttcucact

SEQ ID NO: 80407 - DNA, 21 bp, Artificial Sequence
  Synthetic
gcactaguggcaagaggacua

SEQ ID NO: 80408 - DNA, 21 bp, Artificial Sequence
  Synthetic
aggcagacaagcutccaauga

SEQ ID NO: 80409 - DNA, 29 bp, Artificial Sequence
  Synthetic
actgttagtttuaataggcaagguggaaa

SEQ ID NO: 80410 - DNA, 23 bp, Artificial Sequence
  Synthetic
ctttgtatccugtgggtagggut

SEQ ID NO: 80411 - DNA, 28 bp, Artificial Sequence
  Synthetic
tgtatccccaagagucacagaagtaaua

SEQ ID NO: 80412 - DNA, 26 bp, Artificial Sequence
  Synthetic
gtctcttccucgttaagcatttcugt

SEQ ID NO: 80413 - DNA, 26 bp, Artificial Sequence
  Synthetic
aggactacttgaugaaaatggctcug

SEQ ID NO: 80414 - DNA, 25 bp, Artificial Sequence
  Synthetic
cttcatcacaugattctgggacuga

SEQ ID NO: 80415 - DNA, 23 bp, Artificial Sequence
  Synthetic
ggttttctccutctccagggaug

SEQ ID NO: 80416 - DNA, 23 bp, Artificial Sequence
  Synthetic
ggcctagaagaugacatgcauga

SEQ ID NO: 80417 - DNA, 27 bp, Artificial Sequence
  Synthetic
atggcaatttcacugatgtaagtgtug

SEQ ID NO: 80418 - DNA, 28 bp, Artificial Sequence
  Synthetic
ggctttttgtcauttgcttctattucca

SEQ ID NO: 80419 - DNA, 26 bp, Artificial Sequence
  Synthetic
ctctgtggcuttaactaatactugcc

SEQ ID NO: 80420 - DNA, 23 bp, Artificial Sequence
  Synthetic
ttttaacaccacgucctctcgut

SEQ ID NO: 80421 - DNA, 23 bp, Artificial Sequence
  Synthetic
gcuctttgttgctucccaaacac

SEQ ID NO: 80422 - DNA, 21 bp, Artificial Sequence
  Synthetic
cccgtggtugggtgaatacut

SEQ ID NO: 80423 - DNA, 21 bp, Artificial Sequence
  Synthetic
cccaggagacutcacugaagg

SEQ ID NO: 80424 - DNA, 25 bp, Artificial Sequence
  Synthetic
caccaaaggcagautccaaauacag

SEQ ID NO: 80425 - DNA, 27 bp, Artificial Sequence
  Synthetic
aagaagagcaagguataaggguacaga

SEQ ID NO: 80426 - DNA, 23 bp, Artificial Sequence
  Synthetic
actttggctutagcaggacugaa

SEQ ID NO: 80427 - DNA, 26 bp, Artificial Sequence
  Synthetic
cagatgaugcaggtaaaacaauccac

SEQ ID NO: 80428 - DNA, 21 bp, Artificial Sequence
  Synthetic
gccatggaucaggtctuccac

SEQ ID NO: 80429 - DNA, 26 bp, Artificial Sequence
  Synthetic
gcttgaggaacaaauctggaactuac

SEQ ID NO: 80430 - DNA, 22 bp, Artificial Sequence
  Synthetic
gctggctaucctactgctucat

SEQ ID NO: 80431 - DNA, 20 bp, Artificial Sequence
  Synthetic
gagtuccgagaccctctugg

SEQ ID NO: 80432 - DNA, 21 bp, Artificial Sequence
  Synthetic
gggcctgautttcgcgatgua

SEQ ID NO: 80433 - DNA, 19 bp, Artificial Sequence
  Synthetic
agtcctuaagggcggucca

SEQ ID NO: 80434 - DNA, 20 bp, Artificial Sequence
  Synthetic
cttggctcugtggagtcgut

SEQ ID NO: 80435 - DNA, 21 bp, Artificial Sequence
  Synthetic
gctcctucacgaggattuccc

SEQ ID NO: 80436 - DNA, 21 bp, Artificial Sequence
  Synthetic
gctgcacauctgcctgtacua

SEQ ID NO: 80437 - DNA, 25 bp, Artificial Sequence
  Synthetic
cagcttctcaaugtttttcctcugg

SEQ ID NO: 80438 - DNA, 21 bp, Artificial Sequence
  Synthetic
tuccccuacccagaggacaat

SEQ ID NO: 80439 - DNA, 21 bp, Artificial Sequence
  Synthetic
agtagaucctgctcuggcaca

SEQ ID NO: 80440 - DNA, 27 bp, Artificial Sequence
  Synthetic
gaagttaatgtcuccaccactggatut

SEQ ID NO: 80441 - DNA, 21 bp, Artificial Sequence
  Synthetic
cttcactucgcaggcagatuc

SEQ ID NO: 80442 - DNA, 21 bp, Artificial Sequence
  Synthetic
acgggcuctaugcgaaaagac

SEQ ID NO: 80443 - DNA, 27 bp, Artificial Sequence
  Synthetic
attctaacagauaacgaggtgcctuac

SEQ ID NO: 80444 - DNA, 20 bp, Artificial Sequence
  Synthetic
ccaatgtccuctcgctccug

SEQ ID NO: 80445 - DNA, 22 bp, Artificial Sequence
  Synthetic
atggctggcutacagctagtut

SEQ ID NO: 80446 - DNA, 23 bp, Artificial Sequence
  Synthetic
tgtctcctcugggcatttcttug

SEQ ID NO: 80447 - DNA, 22 bp, Artificial Sequence
  Synthetic
accatgcacutaattggccgua

SEQ ID NO: 80448 - DNA, 22 bp, Artificial Sequence
  Synthetic
gcaccttaugtgtgcccuaact

SEQ ID NO: 80449 - DNA, 25 bp, Artificial Sequence
  Synthetic
gaggtttcctaauagtgagctgcug

SEQ ID NO: 80450 - DNA, 20 bp, Artificial Sequence
  Synthetic
ttgcatgccagucctcaugt

SEQ ID NO: 80451 - DNA, 22 bp, Artificial Sequence
  Synthetic
aattgguttgggcuggagaagt

SEQ ID NO: 80452 - DNA, 24 bp, Artificial Sequence
  Synthetic
actcaggcagutctttagttgcug

SEQ ID NO: 80453 - DNA, 28 bp, Artificial Sequence
  Synthetic
ctctattcaatacugcctactcttugct

SEQ ID NO: 80454 - DNA, 20 bp, Artificial Sequence
  Synthetic
aaauccttgcguagcccgaa

SEQ ID NO: 80455 - DNA, 20 bp, Artificial Sequence
  Synthetic
gcccccaccauaatgucact

SEQ ID NO: 80456 - DNA, 22 bp, Artificial Sequence
  Synthetic
ggaagaacagccuagactuggg

SEQ ID NO: 80457 - DNA, 22 bp, Artificial Sequence
  Synthetic
atcttctctcccutcccaccut

SEQ ID NO: 80458 - DNA, 27 bp, Artificial Sequence
  Synthetic
tcattaagagcaagugtggaaatcugt

SEQ ID NO: 80459 - DNA, 24 bp, Artificial Sequence
  Synthetic
ccucaactauccaccaggcaaaaa

SEQ ID NO: 80460 - DNA, 21 bp, Artificial Sequence
  Synthetic
gagcguagcaaggagccaaua

SEQ ID NO: 80461 - DNA, 28 bp, Artificial Sequence
  Synthetic
cacatccatgtcutttcctacttgttut

SEQ ID NO: 80462 - DNA, 22 bp, Artificial Sequence
  Synthetic
gctacgcagutctggagcatut

SEQ ID NO: 80463 - DNA, 21 bp, Artificial Sequence
  Synthetic
gacatttaaaucgcccccucg

SEQ ID NO: 80464 - DNA, 25 bp, Artificial Sequence
  Synthetic
cacctcaaagcuctaagtucgaaga

SEQ ID NO: 80465 - DNA, 28 bp, Artificial Sequence
  Synthetic
gtgtaacacacguccatttgataaugag

SEQ ID NO: 80466 - DNA, 23 bp, Artificial Sequence
  Synthetic
gggagccuggagttctatgtuct

SEQ ID NO: 80467 - DNA, 26 bp, Artificial Sequence
  Synthetic
caggatttuacaaacatagcaugcga

SEQ ID NO: 80468 - DNA, 19 bp, Artificial Sequence
  Synthetic
gaagaacgugccgtugagg

SEQ ID NO: 80469 - DNA, 28 bp, Artificial Sequence
  Synthetic
acactgtgauacgggatgaaaattctut

SEQ ID NO: 80470 - DNA, 24 bp, Artificial Sequence
  Synthetic
gggtttgtatuccttgtccttcuc

SEQ ID NO: 80471 - DNA, 26 bp, Artificial Sequence
  Synthetic
gagggtagagggaagutattgcttut

SEQ ID NO: 80472 - DNA, 17 bp, Artificial Sequence
  Synthetic
ggtgucggcgtuggagt

SEQ ID NO: 80473 - DNA, 17 bp, Artificial Sequence
  Synthetic
ctcgccgcucgctttuc

SEQ ID NO: 80474 - DNA, 24 bp, Artificial Sequence
  Synthetic
gaattcagaccuattccgcuccat

SEQ ID NO: 80475 - DNA, 28 bp, Artificial Sequence
  Synthetic
cctgtaaacugaggtactttggttauca

SEQ ID NO: 80476 - DNA, 21 bp, Artificial Sequence
  Synthetic
agaagttgcutgctccuccaa

SEQ ID NO: 80477 - DNA, 23 bp, Artificial Sequence
  Synthetic
ggtacaagcugcagtcattucct

SEQ ID NO: 80478 - DNA, 23 bp, Artificial Sequence
  Synthetic
ccctucccttcttttucaaccgt

SEQ ID NO: 80479 - DNA, 25 bp, Artificial Sequence
  Synthetic
cccagctatuccacagatgtttcuc

SEQ ID NO: 80480 - DNA, 24 bp, Artificial Sequence
  Synthetic
aaatgguggaagatgatucccgaa

SEQ ID NO: 80481 - DNA, 20 bp, Artificial Sequence
  Synthetic
cttggcagutgaggcccuat

SEQ ID NO: 80482 - DNA, 28 bp, Artificial Sequence
  Synthetic
cagtgtttcttuttcattgcagatucca

SEQ ID NO: 80483 - DNA, 23 bp, Artificial Sequence
  Synthetic
ctttttggguggctgttgtguag

SEQ ID NO: 80484 - DNA, 21 bp, Artificial Sequence
  Synthetic
ggaaccccagcauttcagugt

SEQ ID NO: 80485 - DNA, 25 bp, Artificial Sequence
  Synthetic
ccaaguaaccaactctgaaauccca

SEQ ID NO: 80486 - DNA, 25 bp, Artificial Sequence
  Synthetic
actctttaccucagatgagctgcua

SEQ ID NO: 80487 - DNA, 28 bp, Artificial Sequence
  Synthetic
agaattacaagaaucccaaacucaccag

SEQ ID NO: 80488 - DNA, 28 bp, Artificial Sequence
  Synthetic
tgtaaaacttaaaugtgagcatccuggt

SEQ ID NO: 80489 - DNA, 28 bp, Artificial Sequence
  Synthetic
gctggattuacagatgattttgaaugga

SEQ ID NO: 80490 - DNA, 24 bp, Artificial Sequence
  Synthetic
agataagtcugagagctacuggca

SEQ ID NO: 80491 - DNA, 27 bp, Artificial Sequence
  Synthetic
gggaggactttcuagacccttattcua

SEQ ID NO: 80492 - DNA, 26 bp, Artificial Sequence
  Synthetic
aggcatagattuccaggtagaaacug

SEQ ID NO: 80493 - DNA, 25 bp, Artificial Sequence
  Synthetic
attgacgtcagaautggacacuagg

SEQ ID NO: 80494 - DNA, 22 bp, Artificial Sequence
  Synthetic
ccgaaggaggcacutacacaut

SEQ ID NO: 80495 - DNA, 23 bp, Artificial Sequence
  Synthetic
cutgcagctgtuacaaacacgag

SEQ ID NO: 80496 - DNA, 28 bp, Artificial Sequence
  Synthetic
actatttctgtcucatccatgttucagg

SEQ ID NO: 80497 - DNA, 27 bp, Artificial Sequence
  Synthetic
tgagaacaccaaaautggcaaaaucat

SEQ ID NO: 80498 - DNA, 28 bp, Artificial Sequence
  Synthetic
agtgaagaactgutctaccagatacuca

SEQ ID NO: 80499 - DNA, 27 bp, Artificial Sequence
  Synthetic
gtggagagcuactatttucagaaacga

SEQ ID NO: 80500 - DNA, 18 bp, Artificial Sequence
  Synthetic
gaaagcccuccccagucc

SEQ ID NO: 80501 - DNA, 27 bp, Artificial Sequence
  Synthetic
tgcactgtaataauccagactgtgtut

SEQ ID NO: 80502 - DNA, 25 bp, Artificial Sequence
  Synthetic
aagtgaagtttguctccaagtgugt

SEQ ID NO: 80503 - DNA, 28 bp, Artificial Sequence
  Synthetic
ctaattaatcccutttagtgccuccaga

SEQ ID NO: 80504 - DNA, 22 bp, Artificial Sequence
  Synthetic
caccagcccauccatctatcug

SEQ ID NO: 80505 - DNA, 28 bp, Artificial Sequence
  Synthetic
cttgactttugtattctgacuccaaggt

SEQ ID NO: 80506 - DNA, 27 bp, Artificial Sequence
  Synthetic
agtgaaacagaaggaugctttugagat

SEQ ID NO: 80507 - DNA, 28 bp, Artificial Sequence
  Synthetic
gaaaactucaaatccattcucaggaacc

SEQ ID NO: 80508 - DNA, 28 bp, Artificial Sequence
  Synthetic
cgttcacaaugcaactcaaattttuagg

SEQ ID NO: 80509 - DNA, 24 bp, Artificial Sequence
  Synthetic
tttagatcgcaaaugccttgggua

SEQ ID NO: 80510 - DNA, 21 bp, Artificial Sequence
  Synthetic
gccaaagaggccccuatcuct

SEQ ID NO: 80511 - DNA, 28 bp, Artificial Sequence
  Synthetic
gcutgtcttaaattguacagcaagaact

SEQ ID NO: 80512 - DNA, 27 bp, Artificial Sequence
  Synthetic
gttgaagtcaauccccacatttagtuc

SEQ ID NO: 80513 - DNA, 28 bp, Artificial Sequence
  Synthetic
gcttatttgctcuctcatgttctgttut

SEQ ID NO: 80514 - DNA, 28 bp, Artificial Sequence
  Synthetic
aacagctaccaugggttttattuaaggt

SEQ ID NO: 80515 - DNA, 24 bp, Artificial Sequence
  Synthetic
cccaataaccaaggcuaggtcaua

SEQ ID NO: 80516 - DNA, 23 bp, Artificial Sequence
  Synthetic
gccacgacucacagaaagaacuc

SEQ ID NO: 80517 - DNA, 21 bp, Artificial Sequence
  Synthetic
gcagctuaagcaggaggtguc

SEQ ID NO: 80518 - DNA, 22 bp, Artificial Sequence
  Synthetic
cttgaccttguaggcgtctcuc

SEQ ID NO: 80519 - DNA, 22 bp, Artificial Sequence
  Synthetic
gguataaacgcguccagcagaa

SEQ ID NO: 80520 - DNA, 22 bp, Artificial Sequence
  Synthetic
gtcttctcautctccagguggt

SEQ ID NO: 80521 - DNA, 19 bp, Artificial Sequence
  Synthetic
accagctcgugtccatguc

SEQ ID NO: 80522 - DNA, 18 bp, Artificial Sequence
  Synthetic
gcggaucacctcgtccut

SEQ ID NO: 80523 - DNA, 17 bp, Artificial Sequence
  Synthetic
cagcugcccacuagcca

SEQ ID NO: 80524 - DNA, 18 bp, Artificial Sequence
  Synthetic
gagcuggtcgucggagaa

SEQ ID NO: 80525 - DNA, 18 bp, Artificial Sequence
  Synthetic
acccgcaccaucaccauc

SEQ ID NO: 80526 - DNA, 22 bp, Artificial Sequence
  Synthetic
tcgctcaagucaaacaggucaa

SEQ ID NO: 80527 - DNA, 17 bp, Artificial Sequence
  Synthetic
ccccucctcucccgagt

SEQ ID NO: 80528 - DNA, 25 bp, Artificial Sequence
  Synthetic
agacagtctgcuaattccagcuact

SEQ ID NO: 80529 - DNA, 19 bp, Artificial Sequence
  Synthetic
agagggucauaccggcaca

SEQ ID NO: 80530 - DNA, 23 bp, Artificial Sequence
  Synthetic
gggtaatttugggagtguggaga

SEQ ID NO: 80531 - DNA, 27 bp, Artificial Sequence
  Synthetic
tgctgtagggauttcaggatttcaaut

SEQ ID NO: 80532 - DNA, 24 bp, Artificial Sequence
  Synthetic
gcaccuaagagacttugaaaggga

SEQ ID NO: 80533 - DNA, 23 bp, Artificial Sequence
  Synthetic
acaggaugccaaacacataccut

SEQ ID NO: 80534 - DNA, 28 bp, Artificial Sequence
  Synthetic
accacattttatcucagtcacagttuca

SEQ ID NO: 80535 - DNA, 28 bp, Artificial Sequence
  Synthetic
agcaggataggcaauttctagatgttuc

SEQ ID NO: 80536 - DNA, 28 bp, Artificial Sequence
  Synthetic
tgtatttgaacuatttggaagcugacca

SEQ ID NO: 80537 - DNA, 27 bp, Artificial Sequence
  Synthetic
gcaaagagguaagacatgacaaaguca

SEQ ID NO: 80538 - DNA, 22 bp, Artificial Sequence
  Synthetic
gtgctgaagcucctcttctuga

SEQ ID NO: 80539 - DNA, 28 bp, Artificial Sequence
  Synthetic
agacagaactgcaautttcccatatgua

SEQ ID NO: 80540 - DNA, 30 bp, Artificial Sequence
  Synthetic
gacttttgattgutttagatgacactuggt

SEQ ID NO: 80541 - DNA, 25 bp, Artificial Sequence
  Synthetic
ccagtctgatuacctgctttctuca

SEQ ID NO: 80542 - DNA, 28 bp, Artificial Sequence
  Synthetic
tctttaccttuaggatggatttugccat

SEQ ID NO: 80543 - DNA, 24 bp, Artificial Sequence
  Synthetic
gtgacauactaaccucgacagcaa

SEQ ID NO: 80544 - DNA, 22 bp, Artificial Sequence
  Synthetic
accaccaucacaaaggacauca

SEQ ID NO: 80545 - DNA, 24 bp, Artificial Sequence
  Synthetic
gatgaagaagcugacaccugaact

SEQ ID NO: 80546 - DNA, 27 bp, Artificial Sequence
  Synthetic
acagaagtutcaatgtacuaccaagca

SEQ ID NO: 80547 - DNA, 25 bp, Artificial Sequence
  Synthetic
aaaagcugggatcaacauaaagcac

SEQ ID NO: 80548 - DNA, 24 bp, Artificial Sequence
  Synthetic
acactgaatgcuttgttgcaacuc

SEQ ID NO: 80549 - DNA, 27 bp, Artificial Sequence
  Synthetic
atttcctctgtugatgtagacagugac

SEQ ID NO: 80550 - DNA, 25 bp, Artificial Sequence
  Synthetic
cagggcaautaaagcattucaggag

SEQ ID NO: 80551 - DNA, 28 bp, Artificial Sequence
  Synthetic
ccaacaaccuacctttaaactagacuca

SEQ ID NO: 80552 - DNA, 28 bp, Artificial Sequence
  Synthetic
catttacgactugggcttatgtucaaag

SEQ ID NO: 80553 - DNA, 33 bp, Artificial Sequence
  Synthetic
ttcttttaaagtgccaauataaattccaacaut

SEQ ID NO: 80554 - DNA, 23 bp, Artificial Sequence
  Synthetic
tcaacagcaacaccutcuccaaa

SEQ ID NO: 80555 - DNA, 25 bp, Artificial Sequence
  Synthetic
gatctgtggacuaggtttgtggtua

SEQ ID NO: 80556 - DNA, 23 bp, Artificial Sequence
  Synthetic
acccagcacaucccagtgtauat

SEQ ID NO: 80557 - DNA, 21 bp, Artificial Sequence
  Synthetic
gcggaaaacauccctgtucac

SEQ ID NO: 80558 - DNA, 22 bp, Artificial Sequence
  Synthetic
tgagaucagggaugagggacag

SEQ ID NO: 80559 - DNA, 28 bp, Artificial Sequence
  Synthetic
atattttcatctccuctgggtaacatug

SEQ ID NO: 80560 - DNA, 21 bp, Artificial Sequence
  Synthetic
agactucagccacagcatgut

SEQ ID NO: 80561 - DNA, 29 bp, Artificial Sequence
  Synthetic
tctggatcacuggcaatagttctaattuc

SEQ ID NO: 80562 - DNA, 22 bp, Artificial Sequence
  Synthetic
gaggtcaggcuggctaucaaat

SEQ ID NO: 80563 - DNA, 21 bp, Artificial Sequence
  Synthetic
gtcccttutccacttgugcag

SEQ ID NO: 80564 - DNA, 21 bp, Artificial Sequence
  Synthetic
ccttgagagccuggatgtugg

SEQ ID NO: 80565 - DNA, 22 bp, Artificial Sequence
  Synthetic
ccacatcagacugagcgttcut

SEQ ID NO: 80566 - DNA, 28 bp, Artificial Sequence
  Synthetic
gggtggtaaautataaagttgctaugga

SEQ ID NO: 80567 - DNA, 22 bp, Artificial Sequence
  Synthetic
cagggaaggagugguacaacag

SEQ ID NO: 80568 - DNA, 25 bp, Artificial Sequence
  Synthetic
ccatgaaaacagauctgcttcuggt

SEQ ID NO: 80569 - DNA, 25 bp, Artificial Sequence
  Synthetic
tcactutgatgaacttucccacact

SEQ ID NO: 80570 - DNA, 28 bp, Artificial Sequence
  Synthetic
catgtcaacaucgctctaatucagagat

SEQ ID NO: 80571 - DNA, 28 bp, Artificial Sequence
  Synthetic
gcttttcaaaaggcutaaacacaggaut

SEQ ID NO: 80572 - DNA, 28 bp, Artificial Sequence
  Synthetic
ttttcatgttagaugggatccttuccaa

SEQ ID NO: 80573 - DNA, 28 bp, Artificial Sequence
  Synthetic
agtttgagctgaugatttaagacagugt

SEQ ID NO: 80574 - DNA, 22 bp, Artificial Sequence
  Synthetic
agatcccagcuctttccugaga

SEQ ID NO: 80575 - DNA, 26 bp, Artificial Sequence
  Synthetic
gtccatttcuccagagtaatccucac

SEQ ID NO: 80576 - DNA, 17 bp, Artificial Sequence
  Synthetic
gccgcucggctctucac

SEQ ID NO: 80577 - DNA, 17 bp, Artificial Sequence
  Synthetic
ggccgcgutcctuaccc

SEQ ID NO: 80578 - DNA, 22 bp, Artificial Sequence
  Synthetic
gactgcctuggttgatggtcua

SEQ ID NO: 80579 - DNA, 25 bp, Artificial Sequence
  Synthetic
caggtggatuttccatgtcauacag

SEQ ID NO: 80580 - DNA, 24 bp, Artificial Sequence
  Synthetic
cttgagcaccugaccaaaaagaug

SEQ ID NO: 80581 - DNA, 25 bp, Artificial Sequence
  Synthetic
ccagtggagcugataatagtuccaa

SEQ ID NO: 80582 - DNA, 29 bp, Artificial Sequence
  Synthetic
tgtacaaatagguactcaaaacagcucaa

SEQ ID NO: 80583 - DNA, 22 bp, Artificial Sequence
  Synthetic
acagagccaggcuttcaucaaa

SEQ ID NO: 80584 - DNA, 28 bp, Artificial Sequence
  Synthetic
agaugaattatctggugaacgacaaaga

SEQ ID NO: 80585 - DNA, 24 bp, Artificial Sequence
  Synthetic
tgagaacatuaccggattcgaugg

SEQ ID NO: 80586 - DNA, 28 bp, Artificial Sequence
  Synthetic
cctacagggtcautttcttgttcttcut

SEQ ID NO: 80587 - DNA, 22 bp, Artificial Sequence
  Synthetic
cctgaaaaccaugtggttgugt

SEQ ID NO: 80588 - DNA, 24 bp, Artificial Sequence
  Synthetic
gcaguagcagtgaatcuacaggga

SEQ ID NO: 80589 - DNA, 28 bp, Artificial Sequence
  Synthetic
gcactgtgtttuctatcaatctcguaag

SEQ ID NO: 80590 - DNA, 24 bp, Artificial Sequence
  Synthetic
cctcaatgaugggtggacaauagg

SEQ ID NO: 80591 - DNA, 29 bp, Artificial Sequence
  Synthetic
tggaaatgaatccutgtaccccaaauaat

SEQ ID NO: 80592 - DNA, 24 bp, Artificial Sequence
  Synthetic
tgatcgagtutccagaaccucaac

SEQ ID NO: 80593 - DNA, 27 bp, Artificial Sequence
  Synthetic
attgcaatggcauttagtgctatttut

SEQ ID NO: 80594 - DNA, 21 bp, Artificial Sequence
  Synthetic
cccgtccucgactgatucaac

SEQ ID NO: 80595 - DNA, 23 bp, Artificial Sequence
  Synthetic
tgcaaaugagacccaugaaccaa

SEQ ID NO: 80596 - DNA, 27 bp, Artificial Sequence
  Synthetic
gttatcttcaugtagtccaccugaaca

SEQ ID NO: 80597 - DNA, 27 bp, Artificial Sequence
  Synthetic
ctggtaatgaugactggaugaaagaca

SEQ ID NO: 80598 - DNA, 27 bp, Artificial Sequence
  Synthetic
tgttccccaagauttcatcaagatuga

SEQ ID NO: 80599 - DNA, 22 bp, Artificial Sequence
  Synthetic
accacagcagugacttagctut

SEQ ID NO: 80600 - DNA, 23 bp, Artificial Sequence
  Synthetic
tgcccattuagtgtttggcucat

SEQ ID NO: 80601 - DNA, 21 bp, Artificial Sequence
  Synthetic
gtacaccugcagcctauaccc

SEQ ID NO: 80602 - DNA, 26 bp, Artificial Sequence
  Synthetic
ttgctaacaatugctttgggtttcuc

SEQ ID NO: 80603 - DNA, 22 bp, Artificial Sequence
  Synthetic
ccaattccagccucctgtcuac

SEQ ID NO: 80604 - DNA, 24 bp, Artificial Sequence
  Synthetic
tcattttgtuggctgaggaaguca

SEQ ID NO: 80605 - DNA, 27 bp, Artificial Sequence
  Synthetic
gccuaatttgaatcagucaggaacagg

SEQ ID NO: 80606 - DNA, 22 bp, Artificial Sequence
  Synthetic
gcctgttgcagugactgattug

SEQ ID NO: 80607 - DNA, 26 bp, Artificial Sequence
  Synthetic
caccacagagaacaucaaacgtaaug

SEQ ID NO: 80608 - DNA, 21 bp, Artificial Sequence
  Synthetic
ggcattcutgtcccgugagaa

SEQ ID NO: 80609 - DNA, 28 bp, Artificial Sequence
  Synthetic
ggagataacatgcugctacgaactaaua

SEQ ID NO: 80610 - DNA, 22 bp, Artificial Sequence
  Synthetic
gtgcagttgugttggatgugat

SEQ ID NO: 80611 - DNA, 28 bp, Artificial Sequence
  Synthetic
gggccaaguaataataacaatguagcca

SEQ ID NO: 80612 - DNA, 23 bp, Artificial Sequence
  Synthetic
accaacagauccagcuccaaaag

SEQ ID NO: 80613 - DNA, 26 bp, Artificial Sequence
  Synthetic
tcaggaaugaatcaatugacccaaca

SEQ ID NO: 80614 - DNA, 20 bp, Artificial Sequence
  Synthetic
cctggctcugagggacugaa

SEQ ID NO: 80615 - DNA, 27 bp, Artificial Sequence
  Synthetic
cctccttacccauggagaaaataguga

SEQ ID NO: 80616 - DNA, 27 bp, Artificial Sequence
  Synthetic
tttacatggacaccutggttttagugt

SEQ ID NO: 80617 - DNA, 24 bp, Artificial Sequence
  Synthetic
catcctgttugctgacctcaguaa

SEQ ID NO: 80618 - DNA, 21 bp, Artificial Sequence
  Synthetic
gctgggugcgggttgttaaua

SEQ ID NO: 80619 - DNA, 21 bp, Artificial Sequence
  Synthetic
ggccagucgaaagtaauggct

SEQ ID NO: 80620 - DNA, 24 bp, Artificial Sequence
  Synthetic
gagagattcuccccaacacgaaut

SEQ ID NO: 80621 - DNA, 25 bp, Artificial Sequence
  Synthetic
ctccagggutcctugaaaagaaaac

SEQ ID NO: 80622 - DNA, 25 bp, Artificial Sequence
  Synthetic
ctgttggcaggagauaggttaacua

SEQ ID NO: 80623 - DNA, 30 bp, Artificial Sequence
  Synthetic
cacatcactttttaugagaagcatcatugg

SEQ ID NO: 80624 - DNA, 22 bp, Artificial Sequence
  Synthetic
gaaggaccugatccaccagtuc

SEQ ID NO: 80625 - DNA, 28 bp, Artificial Sequence
  Synthetic
attctgatggcucactgtagaaacauac

SEQ ID NO: 80626 - DNA, 23 bp, Artificial Sequence
  Synthetic
gcccggugagtattcactttuga

SEQ ID NO: 80627 - DNA, 22 bp, Artificial Sequence
  Synthetic
ccaacatauctgtgccucccat

SEQ ID NO: 80628 - DNA, 21 bp, Artificial Sequence
  Synthetic
gccggccutgtacatgtagut

SEQ ID NO: 80629 - DNA, 21 bp, Artificial Sequence
  Synthetic
cctcttcugctggaccaucac

SEQ ID NO: 80630 - DNA, 24 bp, Artificial Sequence
  Synthetic
aaccaagcagutcttctgagtuga

SEQ ID NO: 80631 - DNA, 26 bp, Artificial Sequence
  Synthetic
catggtccaatugtacagcacaaaua

SEQ ID NO: 80632 - DNA, 23 bp, Artificial Sequence
  Synthetic
gattttctccugcccaaauggac

SEQ ID NO: 80633 - DNA, 21 bp, Artificial Sequence
  Synthetic
gcccagcagcucaaacagaua

SEQ ID NO: 80634 - DNA, 22 bp, Artificial Sequence
  Synthetic
ccatggatgcuttacaggccua

SEQ ID NO: 80635 - DNA, 26 bp, Artificial Sequence
  Synthetic
gcaagugcagaggtattacuacaact

SEQ ID NO: 80636 - DNA, 20 bp, Artificial Sequence
  Synthetic
gggcatgcugctgacgatua

SEQ ID NO: 80637 - DNA, 22 bp, Artificial Sequence
  Synthetic
ctctccactucgtctccaaucc

SEQ ID NO: 80638 - DNA, 23 bp, Artificial Sequence
  Synthetic
caautcctctuccacccagagaa

SEQ ID NO: 80639 - DNA, 26 bp, Artificial Sequence
  Synthetic
catagacatgtauctgcgaaaacgug

SEQ ID NO: 80640 - DNA, 28 bp, Artificial Sequence
  Synthetic
cctcaggatgccautaaatgctactuaa

SEQ ID NO: 80641 - DNA, 21 bp, Artificial Sequence
  Synthetic
cctccttcugcctgagtgtuc

SEQ ID NO: 80642 - DNA, 24 bp, Artificial Sequence
  Synthetic
catgttcuccagttcaaggucact

SEQ ID NO: 80643 - DNA, 23 bp, Artificial Sequence
  Synthetic
tctgtctugcagtaagcacaugg

SEQ ID NO: 80644 - DNA, 20 bp, Artificial Sequence
  Synthetic
tgtttgaccaccugcagcut

SEQ ID NO: 80645 - DNA, 21 bp, Artificial Sequence
  Synthetic
tgtuggcagaacctccucaac

SEQ ID NO: 80646 - DNA, 28 bp, Artificial Sequence
  Synthetic
gattatatcatguctgctgcttauggga

SEQ ID NO: 80647 - DNA, 24 bp, Artificial Sequence
  Synthetic
tgcactgaacutccagaagaugac

SEQ ID NO: 80648 - DNA, 22 bp, Artificial Sequence
  Synthetic
caggaacuccaggcagtguaaa

SEQ ID NO: 80649 - DNA, 27 bp, Artificial Sequence
  Synthetic
tcctttatgtacauctttggttgcuga

SEQ ID NO: 80650 - DNA, 23 bp, Artificial Sequence
  Synthetic
attctctugggtcattuggccat

SEQ ID NO: 80651 - DNA, 21 bp, Artificial Sequence
  Synthetic
gcaccccugcgaaagacuaac

SEQ ID NO: 80652 - DNA, 24 bp, Artificial Sequence
  Synthetic
gcttcaccaacaucatctguagca

SEQ ID NO: 80653 - DNA, 28 bp, Artificial Sequence
  Synthetic
gtggtgggagugaaggagaaaaataaua

SEQ ID NO: 80654 - DNA, 22 bp, Artificial Sequence
  Synthetic
cctugaacctgtttuggcagat

SEQ ID NO: 80655 - DNA, 28 bp, Artificial Sequence
  Synthetic
agttgggaagcugatacttcatatucac

SEQ ID NO: 80656 - DNA, 23 bp, Artificial Sequence
  Synthetic
gaatgugtatgggauggcagagt

SEQ ID NO: 80657 - DNA, 28 bp, Artificial Sequence
  Synthetic
gctttgtggacaacucatttcttgauat

SEQ ID NO: 80658 - DNA, 24 bp, Artificial Sequence
  Synthetic
agttactctcacucccaacaguca

SEQ ID NO: 80659 - DNA, 28 bp, Artificial Sequence
  Synthetic
ctccaggtgaautttcaaagctttuagg

SEQ ID NO: 80660 - DNA, 23 bp, Artificial Sequence
  Synthetic
cgacatgtcuttccccacaauca

SEQ ID NO: 80661 - DNA, 25 bp, Artificial Sequence
  Synthetic
gttgaugaaccggtccttuacagat

SEQ ID NO: 80662 - DNA, 28 bp, Artificial Sequence
  Synthetic
agtagtctttctguacctcttacgtuct

SEQ ID NO: 80663 - DNA, 22 bp, Artificial Sequence
  Synthetic
tgatauccgggacaccagtuca

SEQ ID NO: 80664 - DNA, 25 bp, Artificial Sequence
  Synthetic
cttcaaccucagctgttactucaca

SEQ ID NO: 80665 - DNA, 25 bp, Artificial Sequence
  Synthetic
caggcccaugcttactttgtttaut

SEQ ID NO: 80666 - DNA, 24 bp, Artificial Sequence
  Synthetic
gcactagcaaaguccgagaugaat

SEQ ID NO: 80667 - DNA, 26 bp, Artificial Sequence
  Synthetic
caaccttctgaaggucttcctcatut

SEQ ID NO: 80668 - DNA, 21 bp, Artificial Sequence
  Synthetic
cctgggagccaaaguccttuc

SEQ ID NO: 80669 - DNA, 25 bp, Artificial Sequence
  Synthetic
cgtttccttuagccttctcacugat

SEQ ID NO: 80670 - DNA, 21 bp, Artificial Sequence
  Synthetic
cgaaaugcgcccatcctttuc

SEQ ID NO: 80671 - DNA, 24 bp, Artificial Sequence
  Synthetic
aggauacggagcgacacatttuac

SEQ ID NO: 80672 - DNA, 29 bp, Artificial Sequence
  Synthetic
cttggtgccacuaactacatttatgttut

SEQ ID NO: 80673 - DNA, 28 bp, Artificial Sequence
  Synthetic
gagccatgtugatgttatcttuccaaac

SEQ ID NO: 80674 - DNA, 28 bp, Artificial Sequence
  Synthetic
ctggcauagaagaagaaactguaaagga

SEQ ID NO: 80675 - DNA, 22 bp, Artificial Sequence
  Synthetic
ttgttatgctucctgcagcuga

SEQ ID NO: 80676 - DNA, 24 bp, Artificial Sequence
  Synthetic
cccagatcauccattgcatucgat

SEQ ID NO: 80677 - DNA, 25 bp, Artificial Sequence
  Synthetic
tgctttcaaaggcauggacatacut

SEQ ID NO: 80678 - DNA, 24 bp, Artificial Sequence
  Synthetic
agcaaagccaauttaucaggaggt

SEQ ID NO: 80679 - DNA, 23 bp, Artificial Sequence
  Synthetic
cctccgactguatgtcagcagua

SEQ ID NO: 80680 - DNA, 25 bp, Artificial Sequence
  Synthetic
ccatgtgaacgcuacttatgugaac

SEQ ID NO: 80681 - DNA, 27 bp, Artificial Sequence
  Synthetic
gactgttgctutgacatagtacuagca

SEQ ID NO: 80682 - DNA, 26 bp, Artificial Sequence
  Synthetic
ctgagttcagagautcttaccccaut

SEQ ID NO: 80683 - DNA, 28 bp, Artificial Sequence
  Synthetic
ggaacagaaccugattattcttgtguga

SEQ ID NO: 80684 - DNA, 26 bp, Artificial Sequence
  Synthetic
agggaaactcuagatgctcagactut

SEQ ID NO: 80685 - DNA, 28 bp, Artificial Sequence
  Synthetic
acacttccttctutgtggatctctttut

SEQ ID NO: 80686 - DNA, 27 bp, Artificial Sequence
  Synthetic
tgcacatcattgguattaagaagggut

SEQ ID NO: 80687 - DNA, 24 bp, Artificial Sequence
  Synthetic
tggaataacaccuccagccatuac

SEQ ID NO: 80688 - DNA, 29 bp, Artificial Sequence
  Synthetic
tcctttctctgcutcttttctaggtauca

SEQ ID NO: 80689 - DNA, 27 bp, Artificial Sequence
  Synthetic
gcctggtugactcatctatauggaaga

SEQ ID NO: 80690 - DNA, 24 bp, Artificial Sequence
  Synthetic
agaaaggauctggtauccacccaa

SEQ ID NO: 80691 - DNA, 28 bp, Artificial Sequence
  Synthetic
ccattttgccutttagcattaagugagt

SEQ ID NO: 80692 - DNA, 27 bp, Artificial Sequence
  Synthetic
tgacagcattatutcttgttccctugt

SEQ ID NO: 80693 - DNA, 28 bp, Artificial Sequence
  Synthetic
aaatgcttagtauctgcttgatcacuga

SEQ ID NO: 80694 - DNA, 22 bp, Artificial Sequence
  Synthetic
gaaaaggacagggaguggtgut

SEQ ID NO: 80695 - DNA, 21 bp, Artificial Sequence
  Synthetic
ttcacgagcucatgaagcugt

SEQ ID NO: 80696 - DNA, 19 bp, Artificial Sequence
  Synthetic
gaatgauggccggtccugt

SEQ ID NO: 80697 - DNA, 24 bp, Artificial Sequence
  Synthetic
caaatacgcugaatgggagttgug

SEQ ID NO: 80698 - DNA, 26 bp, Artificial Sequence
  Synthetic
ggacttaatguccagtggacttagut

SEQ ID NO: 80699 - DNA, 21 bp, Artificial Sequence
  Synthetic
gccattgaccugctgaacucc

SEQ ID NO: 80700 - DNA, 24 bp, Artificial Sequence
  Synthetic
ccccacagaaacccaugtaugaag

SEQ ID NO: 80701 - DNA, 23 bp, Artificial Sequence
  Synthetic
tggaaagccccugtttcatacug

SEQ ID NO: 80702 - DNA, 21 bp, Artificial Sequence
  Synthetic
caacaaggcucaggagugagt

SEQ ID NO: 80703 - DNA, 25 bp, Artificial Sequence
  Synthetic
caatgccattaautgccagttggut

SEQ ID NO: 80704 - DNA, 29 bp, Artificial Sequence
  Synthetic
agaggaaauatcattcugcaaaagaagct

SEQ ID NO: 80705 - DNA, 21 bp, Artificial Sequence
  Synthetic
tgccacacucgacauggaaaa

SEQ ID NO: 80706 - DNA, 28 bp, Artificial Sequence
  Synthetic
aacactataacaugattcactggcucaa

SEQ ID NO: 80707 - DNA, 26 bp, Artificial Sequence
  Synthetic
gtttgtattacucaccaggaugacca

SEQ ID NO: 80708 - DNA, 24 bp, Artificial Sequence
  Synthetic
ggaataautggagcttugccaggt

SEQ ID NO: 80709 - DNA, 21 bp, Artificial Sequence
  Synthetic
ctggcatuggatgtgtugcat

SEQ ID NO: 80710 - DNA, 24 bp, Artificial Sequence
  Synthetic
ctccttcaugcccttcatcttcuc

SEQ ID NO: 80711 - DNA, 17 bp, Artificial Sequence
  Synthetic
ggccagggugcagtguc

SEQ ID NO: 80712 - DNA, 17 bp, Artificial Sequence
  Synthetic
cccaggcccutguccag

SEQ ID NO: 80713 - DNA, 18 bp, Artificial Sequence
  Synthetic
cggcagaaggugcgcaua

SEQ ID NO: 80714 - DNA, 17 bp, Artificial Sequence
  Synthetic
cctucccgggcttccuc

SEQ ID NO: 80715 - DNA, 19 bp, Artificial Sequence
  Synthetic
gagcagggucctggagtuc

SEQ ID NO: 80716 - DNA, 20 bp, Artificial Sequence
  Synthetic
ccacacaaccguaccaccua

SEQ ID NO: 80717 - DNA, 24 bp, Artificial Sequence
  Synthetic
ccccaauctaaggcauagacaaca

SEQ ID NO: 80718 - DNA, 27 bp, Artificial Sequence
  Synthetic
tgcaccccaucataatatcttcagtut

SEQ ID NO: 80719 - DNA, 23 bp, Artificial Sequence
  Synthetic
aaccatgcuggagtttgguacat

SEQ ID NO: 80720 - DNA, 27 bp, Artificial Sequence
  Synthetic
ctctgtttucctgagatcuaaccacat

SEQ ID NO: 80721 - DNA, 23 bp, Artificial Sequence
  Synthetic
cagcaaggccacguattactgua

SEQ ID NO: 80722 - DNA, 24 bp, Artificial Sequence
  Synthetic
catctagacgtutccttggctcut

SEQ ID NO: 80723 - DNA, 18 bp, Artificial Sequence
  Synthetic
ggctcgacuccctccgua

SEQ ID NO: 80724 - DNA, 23 bp, Artificial Sequence
  Synthetic
tgtacaaauccgaacaacccugt

SEQ ID NO: 80725 - DNA, 23 bp, Artificial Sequence
  Synthetic
tctgccagugctggaaaagtuaa

SEQ ID NO: 80726 - DNA, 30 bp, Artificial Sequence
  Synthetic
gccaatttataattuctcatgttgcctuga

SEQ ID NO: 80727 - DNA, 28 bp, Artificial Sequence
  Synthetic
atcctatagatgaguttcgaccagguat

SEQ ID NO: 80728 - DNA, 26 bp, Artificial Sequence
  Synthetic
ccttgattuctgcatccauacaggaa

SEQ ID NO: 80729 - DNA, 33 bp, Artificial Sequence
  Synthetic
ttagctttggaaautttagagtatgttaugaac

SEQ ID NO: 80730 - DNA, 26 bp, Artificial Sequence
  Synthetic
aatggctctguaaattctacccgtut

SEQ ID NO: 80731 - DNA, 26 bp, Artificial Sequence
  Synthetic
gcttatggatagutacaactcggcut

SEQ ID NO: 80732 - DNA, 23 bp, Artificial Sequence
  Synthetic
ctctcatgtgaugtccaggagut

SEQ ID NO: 80733 - DNA, 20 bp, Artificial Sequence
  Synthetic
gacaccaccgugtacuccag

SEQ ID NO: 80734 - DNA, 21 bp, Artificial Sequence
  Synthetic
gtcccagaucagccactcaut

SEQ ID NO: 80735 - DNA, 20 bp, Artificial Sequence
  Synthetic
cccacagcaguctucgagag

SEQ ID NO: 80736 - DNA, 18 bp, Artificial Sequence
  Synthetic
caucccagcaggtugcca

SEQ ID NO: 80737 - DNA, 19 bp, Artificial Sequence
  Synthetic
tgtcgcucagtcccacuca

SEQ ID NO: 80738 - DNA, 27 bp, Artificial Sequence
  Synthetic
tggctttatgccauttatctcagtugt

SEQ ID NO: 80739 - DNA, 28 bp, Artificial Sequence
  Synthetic
caggatagacugaagactagtactuggt

SEQ ID NO: 80740 - DNA, 26 bp, Artificial Sequence
  Synthetic
tcagctttaaaagutctgcttccuca

SEQ ID NO: 80741 - DNA, 26 bp, Artificial Sequence
  Synthetic
ccaactccttugtttgccatttctuc

SEQ ID NO: 80742 - DNA, 21 bp, Artificial Sequence
  Synthetic
gttttcacugttgcgtugcct

SEQ ID NO: 80743 - DNA, 21 bp, Artificial Sequence
  Synthetic
gacctgcaaucaccagacuca

SEQ ID NO: 80744 - DNA, 17 bp, Artificial Sequence
  Synthetic
ggcccacccuggtcaut

SEQ ID NO: 80745 - DNA, 28 bp, Artificial Sequence
  Synthetic
tgcagaagattcutataaagtgcagcut

SEQ ID NO: 80746 - DNA, 24 bp, Artificial Sequence
  Synthetic
gtucaaagcaggaagatcaugcag

SEQ ID NO: 80747 - DNA, 24 bp, Artificial Sequence
  Synthetic
tcagccttgautgcaaaccctuat

SEQ ID NO: 80748 - DNA, 26 bp, Artificial Sequence
  Synthetic
acagtttuaacgcctaaagtaucaca

SEQ ID NO: 80749 - DNA, 28 bp, Artificial Sequence
  Synthetic
ctttactgaggcuttcaaaacattccut

SEQ ID NO: 80750 - DNA, 22 bp, Artificial Sequence
  Synthetic
ccaggugaatugggacgaagaa

SEQ ID NO: 80751 - DNA, 21 bp, Artificial Sequence
  Synthetic
ccagtgtgcaucaccactgua

SEQ ID NO: 80752 - DNA, 30 bp, Artificial Sequence; identical to SEQ ID NO: 63500
  Synthetic

SEQ ID NO: 80753 - DNA, 26 bp, Artificial Sequence
  Synthetic
cctgtacacaugaagccatcgtauat

SEQ ID NO: 80754 - DNA, 24 bp, Artificial Sequence
  Synthetic
tccaccaatuaaaagatggcccut

SEQ ID NO: 80755 - DNA, 27 bp, Artificial Sequence
  Synthetic
catccagccaugttatcccttattuga

SEQ ID NO: 80756 - DNA, 22 bp, Artificial Sequence
  Synthetic
gggatctagcucttcgagugga

SEQ ID NO: 80757 - DNA, 27 bp, Artificial Sequence
  Synthetic
tctttgctggcuagcatcatgattuat

SEQ ID NO: 80758 - DNA, 21 bp, Artificial Sequence
  Synthetic
aggaataagcccugcccagua

SEQ ID NO: 80759 - DNA, 28 bp, Artificial Sequence
  Synthetic
gtgaattgaggcautttctcacttugat

SEQ ID NO: 80760 - DNA, 24 bp, Artificial Sequence
  Synthetic
gggttacagaaacugactgtgugt

SEQ ID NO: 80761 - DNA, 23 bp, Artificial Sequence
  Synthetic
ggctttcucagagatttccccut

SEQ ID NO: 80762 - DNA, 25 bp, Artificial Sequence
  Synthetic
ggcutcctgaagauaaagggaaaga

SEQ ID NO: 80763 - DNA, 28 bp, Artificial Sequence
  Synthetic
cacatgactctcuggaatcattcacuat

SEQ ID NO: 80764 - DNA, 27 bp, Artificial Sequence
  Synthetic
gggctttgaugttcctgattguaaaaa

SEQ ID NO: 80765 - DNA, 27 bp, Artificial Sequence
  Synthetic
ctctttcacatcutcttggctgctaua

SEQ ID NO: 80766 - DNA, 29 bp, Artificial Sequence
  Synthetic
ctcagccatcaacutctagtagcattaut

SEQ ID NO: 80767 - DNA, 23 bp, Artificial Sequence
  Synthetic
ggtcgaccutgacaaaucacaca

SEQ ID NO: 80768 - DNA, 22 bp, Artificial Sequence
  Synthetic
gcccctuaatgccatugaacct

SEQ ID NO: 80769 - DNA, 28 bp, Artificial Sequence
  Synthetic
gcacaatcattugaattggttgtcuaca

SEQ ID NO: 80770 - DNA, 22 bp, Artificial Sequence
  Synthetic
tctcagccuggaagcctttuag

SEQ ID NO: 80771 - DNA, 22 bp, Artificial Sequence
  Synthetic
ctgtgcttcugatttgccctug

SEQ ID NO: 80772 - DNA, 21 bp, Artificial Sequence
  Synthetic
atttguctgcccugaccacat

SEQ ID NO: 80773 - DNA, 24 bp, Artificial Sequence
  Synthetic
tttacaccaaaagcucccactuga

SEQ ID NO: 80774 - DNA, 23 bp, Artificial Sequence
  Synthetic
aggtggccuacttaactacacut

SEQ ID NO: 80775 - DNA, 20 bp, Artificial Sequence
  Synthetic
gcaagcuccatcaugccgat

SEQ ID NO: 80776 - DNA, 22 bp, Artificial Sequence
  Synthetic
atggugtcagtacugcagaagg

SEQ ID NO: 80777 - DNA, 24 bp, Artificial Sequence
  Synthetic
tcttaccagcccacauctatucca

SEQ ID NO: 80778 - DNA, 28 bp, Artificial Sequence
  Synthetic
gggtcaagtgaguggataaaaatatugt

SEQ ID NO: 80779 - DNA, 25 bp, Artificial Sequence
  Synthetic
ttcagctcugaaacatcacacauct

SEQ ID NO: 80780 - DNA, 22 bp, Artificial Sequence
  Synthetic
aacttccagcugctttgaugga

SEQ ID NO: 80781 - DNA, 19 bp, Artificial Sequence
  Synthetic
cgctcgagugcccattuga

SEQ ID NO: 80782 - DNA, 18 bp, Artificial Sequence
  Synthetic
cacaccutccgccugaca

SEQ ID NO: 80783 - DNA, 19 bp, Artificial Sequence
  Synthetic
cccugacccctuccaacac

SEQ ID NO: 80784 - DNA, 20 bp, Artificial Sequence
  Synthetic
ggagcuctagcugggagacc

SEQ ID NO: 80785 - DNA, 20 bp, Artificial Sequence
  Synthetic
gccaauaaggcggagagugt

SEQ ID NO: 80786 - DNA, 25 bp, Artificial Sequence
  Synthetic
cacaagtucatgtgtcugacaaggt

SEQ ID NO: 80787 - DNA, 28 bp, Artificial Sequence
  Synthetic
gctccacaaaaucttcatcatgagugat

SEQ ID NO: 80788 - DNA, 25 bp, Artificial Sequence
  Synthetic
gttacacaggtutttcaagggacug

SEQ ID NO: 80789 - DNA, 26 bp, Artificial Sequence
  Synthetic
cctgttcaacaagcagutctgattut

SEQ ID NO: 80790 - DNA, 28 bp, Artificial Sequence
  Synthetic
ctgaaataagtaucaacctcaccccaut

SEQ ID NO: 80791 - DNA, 20 bp, Artificial Sequence
  Synthetic
agaggucgacauccacacct

SEQ ID NO: 80792 - DNA, 21 bp, Artificial Sequence
  Synthetic
cgacagccuccgatcttucag

SEQ ID NO: 80793 - DNA, 28 bp, Artificial Sequence
  Synthetic
agttaaaagacugggaaggatgcaatua

SEQ ID NO: 80794 - DNA, 27 bp, Artificial Sequence
  Synthetic
ggaagtagtcgcutactcatttctcut

SEQ ID NO: 80795 - DNA, 28 bp, Artificial Sequence
  Synthetic
ggtttgagagagcutgaagaaatgttut

SEQ ID NO: 80796 - DNA, 21 bp, Artificial Sequence
  Synthetic
tgtgacaucctcugcaaccac

SEQ ID NO: 80797 - DNA, 25 bp, Artificial Sequence
  Synthetic
tgaaaaactagtcutgccagcacut

SEQ ID NO: 80798 - DNA, 22 bp, Artificial Sequence
  Synthetic
tggagcugaagctacacugact

SEQ ID NO: 80799 - DNA, 22 bp, Artificial Sequence
  Synthetic
tggtaacuggcaccatctcuct

SEQ ID NO: 80800 - DNA, 21 bp, Artificial Sequence
  Synthetic
ggtctggugagtcgagaggut

SEQ ID NO: 80801 - DNA, 19 bp, Artificial Sequence
  Synthetic
ggtcggcutgttggaucgt

SEQ ID NO: 80802 - DNA, 25 bp, Artificial Sequence
  Synthetic
aaucaccagagaacaguaagggaga

SEQ ID NO: 80803 - DNA, 22 bp, Artificial Sequence
  Synthetic
gtccuaccctgtucaacaagca

SEQ ID NO: 80804 - DNA, 23 bp, Artificial Sequence
  Synthetic
cttgactctucctcggtacctug

SEQ ID NO: 80805 - DNA, 18 bp, Artificial Sequence
  Synthetic
caaccgccgugcaagaug

SEQ ID NO: 80806 - DNA, 20 bp, Artificial Sequence
  Synthetic
ggcataggccuctggguagt

SEQ ID NO: 80807 - DNA, 22 bp, Artificial Sequence
  Synthetic
gggtaccaggugatcaggauag

SEQ ID NO: 80808 - DNA, 19 bp, Artificial Sequence
  Synthetic
cccagcutgcttccuccat

SEQ ID NO: 80809 - DNA, 29 bp, Artificial Sequence
  Synthetic
cagtaagaagccuctaatctgtttuagca

SEQ ID NO: 80810 - DNA, 22 bp, Artificial Sequence
  Synthetic
gcgtaactuccagcttctggua

SEQ ID NO: 80811 - DNA, 26 bp, Artificial Sequence
  Synthetic
gctaacactgcauttcacaatctcug

SEQ ID NO: 80812 - DNA, 24 bp, Artificial Sequence
  Synthetic
catcagttttggugggacatcuct

SEQ ID NO: 80813 - DNA, 23 bp, Artificial Sequence
  Synthetic
aactcaggaggcuaccaaaugac

SEQ ID NO: 80814 - DNA, 28 bp, Artificial Sequence
  Synthetic
agtattggctuacgcttcagtatttgut

SEQ ID NO: 80815 - DNA, 28 bp, Artificial Sequence
  Synthetic
ccaaaatacatguttgtctccttucact

SEQ ID NO: 80816 - DNA, 28 bp, Artificial Sequence
  Synthetic
aggattaaaaagaacaucgatcagugct

SEQ ID NO: 80817 - DNA, 28 bp, Artificial Sequence
  Synthetic
cactttctgaggaccuacatttctaugg

SEQ ID NO: 80818 - DNA, 24 bp, Artificial Sequence
  Synthetic
tgctctgtgagucaatgcttaguc

SEQ ID NO: 80819 - DNA, 21 bp, Artificial Sequence
  Synthetic
gtgagucagcttggagucagt

SEQ ID NO: 80820 - DNA, 21 bp, Artificial Sequence
  Synthetic
ggtgctgaccaugtggacaut

SEQ ID NO: 80821 - DNA, 29 bp, Artificial Sequence
  Synthetic
ccaatcatggaatuttctttctcctccua

SEQ ID NO: 80822 - DNA, 24 bp, Artificial Sequence
  Synthetic
ccttccaacaucattccccacaut

SEQ ID NO: 80823 - DNA, 21 bp, Artificial Sequence
  Synthetic
ctcactgucacctggcttcuc

SEQ ID NO: 80824 - DNA, 19 bp, Artificial Sequence
  Synthetic
cccacacccugtgctctua

SEQ ID NO: 80825 - DNA, 23 bp, Artificial Sequence
  Synthetic
ctgtaacaccugcttctctuccc

SEQ ID NO: 80826 - DNA, 22 bp, Artificial Sequence
  Synthetic
agaggccacutcatcagcttug

SEQ ID NO: 80827 - DNA, 22 bp, Artificial Sequence
  Synthetic
ctgggcaagaacaggutcttut

SEQ ID NO: 80828 - DNA, 21 bp, Artificial Sequence
  Synthetic
cggaccaauccatgggtcaua

SEQ ID NO: 80829 - DNA, 21 bp, Artificial Sequence
  Synthetic
agaaacccccucagguacaga

SEQ ID NO: 80830 - DNA, 24 bp, Artificial Sequence
  Synthetic
tccgcaaactuctgactctgtuaa

SEQ ID NO: 80831 - DNA, 20 bp, Artificial Sequence
  Synthetic
aggaggaagcaggugguact

SEQ ID NO: 80832 - DNA, 27 bp, Artificial Sequence
  Synthetic
gctatgcugaaaggaatttgactucca

SEQ ID NO: 80833 - DNA, 21 bp, Artificial Sequence
  Synthetic
cttcugggagcagtacaucgg

SEQ ID NO: 80834 - DNA, 21 bp, Artificial Sequence
  Synthetic
accaagcagagcutctugcat

SEQ ID NO: 80835 - DNA, 26 bp, Artificial Sequence
  Synthetic
actgctttagugcaaagtactgacut

SEQ ID NO: 80836 - DNA, 27 bp, Artificial Sequence
  Synthetic
cactcacaugacttaccttcucaaagt

SEQ ID NO: 80837 - DNA, 21 bp, Artificial Sequence
  Synthetic
actaaagaucgaggcccucca

SEQ ID NO: 80838 - DNA, 29 bp, Artificial Sequence
  Synthetic
cagactataaaugcactacatgacactug

SEQ ID NO: 80839 - DNA, 21 bp, Artificial Sequence
  Synthetic
aggatgcugcaggaccttcua

SEQ ID NO: 80840 - DNA, 24 bp, Artificial Sequence
  Synthetic
agtcatccacgutttccctgttut

SEQ ID NO: 80841 - DNA, 19 bp, Artificial Sequence
  Synthetic
ccuccacggagcgaaacug

SEQ ID NO: 80842 - DNA, 23 bp, Artificial Sequence
  Synthetic
cttctccagauctgtgacugcac

SEQ ID NO: 80843 - DNA, 25 bp, Artificial Sequence
  Synthetic
ggaatgtgccagutagaatgaucct

SEQ ID NO: 80844 - DNA, 20 bp, Artificial Sequence
  Synthetic
ccaacaccacgcugaugaac

SEQ ID NO: 80845 - DNA, 23 bp, Artificial Sequence
  Synthetic
tcagactttguggaggcaatuga

SEQ ID NO: 80846 - DNA, 20 bp, Artificial Sequence
  Synthetic
tggccauccgcatcttucag

SEQ ID NO: 80847 - DNA, 21 bp, Artificial Sequence
  Synthetic
caaggaggccagcautgtgua

SEQ ID NO: 80848 - DNA, 23 bp, Artificial Sequence
  Synthetic
tgctgcagauggtccttacttut

SEQ ID NO: 80849 - DNA, 22 bp, Artificial Sequence
  Synthetic
ctaacctgugcccttctctguc

SEQ ID NO: 80850 - DNA, 27 bp, Artificial Sequence
  Synthetic
catgttccagcacutgtttattucgat

SEQ ID NO: 80851 - DNA, 22 bp, Artificial Sequence
  Synthetic
cctccagaagcutacagtgucc

SEQ ID NO: 80852 - DNA, 27 bp, Artificial Sequence
  Synthetic
ctcaaatatggaguccacgagatcaut

SEQ ID NO: 80853 - DNA, 24 bp, Artificial Sequence
  Synthetic
caaacttgggcuccataaagucac

SEQ ID NO: 80854 - DNA, 20 bp, Artificial Sequence
  Synthetic
gagccugcgaaagcctttug

SEQ ID NO: 80855 - DNA, 26 bp, Artificial Sequence
  Synthetic
tcatcccacccuctttcauagaagat

SEQ ID NO: 80856 - DNA, 27 bp, Artificial Sequence
  Synthetic
ctcttttgccttugaatttctgaggut

SEQ ID NO: 80857 - DNA, 23 bp, Artificial Sequence
  Synthetic
cagggaagtuccctacctttguc

SEQ ID NO: 80858 - DNA, 20 bp, Artificial Sequence
  Synthetic
ccaaugcccaggaacaucct

SEQ ID NO: 80859 - DNA, 20 bp, Artificial Sequence
  Synthetic
augtcaagcugggaagccat

SEQ ID NO: 80860 - DNA, 22 bp, Artificial Sequence
  Synthetic
cccagtggcucaacaactttut

SEQ ID NO: 80861 - DNA, 22 bp, Artificial Sequence
  Synthetic
cagaggcacutggactugagag

SEQ ID NO: 80862 - DNA, 27 bp, Artificial Sequence
  Synthetic
gaaacccgcuataatcacuagagcaat

SEQ ID NO: 80863 - DNA, 21 bp, Artificial Sequence
  Synthetic
gcatccgugtaagtugcacca

SEQ ID NO: 80864 - DNA, 21 bp, Artificial Sequence
  Synthetic
ggactctgucagaggcuccat

SEQ ID NO: 80865 - DNA, 22 bp, Artificial Sequence
  Synthetic
tgttggcugcaaggtuacaaga

SEQ ID NO: 80866 - DNA, 25 bp, Artificial Sequence
  Synthetic
aggttguggctttatgctuagaaca

SEQ ID NO: 80867 - DNA, 25 bp, Artificial Sequence
  Synthetic
accatattcacuggacatcaugcac

SEQ ID NO: 80868 - DNA, 21 bp, Artificial Sequence
  Synthetic
gcctctgagagugctacccut

SEQ ID NO: 80869 - DNA, 28 bp, Artificial Sequence
  Synthetic
gcatagccattcautcgttgattcatuc

SEQ ID NO: 80870 - DNA, 24 bp, Artificial Sequence
  Synthetic
agctgtgauaacctcacactcuct

SEQ ID NO: 80871 - DNA, 25 bp, Artificial Sequence
  Synthetic
caaggaaatcugcttagggttcuca

SEQ ID NO: 80872 - DNA, 23 bp, Artificial Sequence
  Synthetic
tcgttttccutgtccaagcugat

SEQ ID NO: 80873 - DNA, 27 bp, Artificial Sequence
  Synthetic
tgttgtaactugagctgtgtaatucct

SEQ ID NO: 80874 - DNA, 33 bp, Artificial Sequence
  Synthetic
tgtacagttaaataauagtaagttctgagtguc

SEQ ID NO: 80875 - DNA, 23 bp, Artificial Sequence
  Synthetic
aggatggucactctucaggaagt

SEQ ID NO: 80876 - DNA, 25 bp, Artificial Sequence
  Synthetic
aaattcaccuggacttccugaagag

SEQ ID NO: 80877 - DNA, 18 bp, Artificial Sequence
  Synthetic
ccactgucagcgcucagt

SEQ ID NO: 80878 - DNA, 19 bp, Artificial Sequence
  Synthetic
ggtgguctggaugagcaga

SEQ ID NO: 80879 - DNA, 21 bp, Artificial Sequence
  Synthetic
gtcctctccutcagggccuat

SEQ ID NO: 80880 - DNA, 31 bp, Artificial Sequence
  Synthetic
ctgttaagtttguatgcaacatttcuaaagt

SEQ ID NO: 80881 - DNA, 28 bp, Artificial Sequence
  Synthetic
tgggttatggucttcaaaaggatatugt

SEQ ID NO: 80882 - DNA, 27 bp, Artificial Sequence
  Synthetic
gaggttatctutttaccacagtugcac

SEQ ID NO: 80883 - DNA, 25 bp, Artificial Sequence
  Synthetic
gtgaattgcugcaacatgattguca

SEQ ID NO: 80884 - DNA, 28 bp, Artificial Sequence
  Synthetic
agctagaacttaucaaacccttttguga

SEQ ID NO: 80885 - DNA, 26 bp, Artificial Sequence
  Synthetic
tgccccgaugtaataaataugcacat

SEQ ID NO: 80886 - DNA, 25 bp, Artificial Sequence
  Synthetic
gaaagggacgaacuggtgtaaugat

SEQ ID NO: 80887 - DNA, 29 bp, Artificial Sequence
  Synthetic
caauaaattctcagauccaggaagaggaa

SEQ ID NO: 80888 - DNA, 28 bp, Artificial Sequence
  Synthetic
acacacaagacccautaaaacctatucc

SEQ ID NO: 80889 - DNA, 25 bp, Artificial Sequence
  Synthetic
gtttttccautggattcctucgcaa

SEQ ID NO: 80890 - DNA, 19 bp, Artificial Sequence
  Synthetic
cccacaucggcctgtguat

SEQ ID NO: 80891 - DNA, 28 bp, Artificial Sequence
  Synthetic
gggagattgauaactggtgtgtttaugt

SEQ ID NO: 80892 - DNA, 24 bp, Artificial Sequence
  Synthetic
acaaagatcacuccttgccucaac

SEQ ID NO: 80893 - DNA, 19 bp, Artificial Sequence
  Synthetic
gcagtuggtggacuggcat

SEQ ID NO: 80894 - DNA, 33 bp, Artificial Sequence
  Synthetic
aaaattccatcattuaattgtaaacgtgtuact

SEQ ID NO: 80895 - DNA, 21 bp, Artificial Sequence
  Synthetic
gccgccttugcactgaattug

SEQ ID NO: 80896 - DNA, 26 bp, Artificial Sequence
  Synthetic
ccagggaauatagctgaaatuagggt

SEQ ID NO: 80897 - DNA, 25 bp, Artificial Sequence
  Synthetic
aatgggucagagaagccatattucc

SEQ ID NO: 80898 - DNA, 22 bp, Artificial Sequence
  Synthetic
ggatgaaggaguctgctuggag

SEQ ID NO: 80899 - DNA, 26 bp, Artificial Sequence
  Synthetic
tgtttgacgaaguccataaaccctua

SEQ ID NO: 80900 - DNA, 26 bp, Artificial Sequence
  Synthetic
ttctctgacccautaaccttcagtuc

SEQ ID NO: 80901 - DNA, 28 bp, Artificial Sequence
  Synthetic
ggatcttgtcuaaacatcgtaacuggat

SEQ ID NO: 80902 - DNA, 27 bp, Artificial Sequence
  Synthetic
gtggtgcgaaautctcacactattaug

SEQ ID NO: 80903 - DNA, 27 bp, Artificial Sequence
  Synthetic
actcacatttcucctttgttcttguct

SEQ ID NO: 80904 - DNA, 23 bp, Artificial Sequence
  Synthetic
cacacactacaucagtggcucaa

SEQ ID NO: 80905 - DNA, 28 bp, Artificial Sequence
  Synthetic
ttctaacucagaggaauacacaaacacc

SEQ ID NO: 80906 - DNA, 26 bp, Artificial Sequence
  Synthetic
cctatttctgttugtttgcctctgut

SEQ ID NO: 80907 - DNA, 20 bp, Artificial Sequence
  Synthetic
cctcuccgaacacttugcct

SEQ ID NO: 80908 - DNA, 20 bp, Artificial Sequence
  Synthetic
ccagccttuacaagcccuct

SEQ ID NO: 80909 - DNA, 27 bp, Artificial Sequence
  Synthetic
ggucaaatttctttucagagcaagagt

SEQ ID NO: 80910 - DNA, 20 bp, Artificial Sequence
  Synthetic
tgtcccggaguttgcacauc

SEQ ID NO: 80911 - DNA, 24 bp, Artificial Sequence
  Synthetic
tttccctgtccautccatcaaguc

SEQ ID NO: 80912 - DNA, 23 bp, Artificial Sequence
  Synthetic
accagaggcugctttctctctua

SEQ ID NO: 80913 - DNA, 22 bp, Artificial Sequence
  Synthetic
caaggtgguggagaagatuggg

SEQ ID NO: 80914 - DNA, 27 bp, Artificial Sequence
  Synthetic
tcttgaaaggaacugaaatacgacgut

SEQ ID NO: 80915 - DNA, 22 bp, Artificial Sequence
  Synthetic
gcttgagctutccaatctgcuc

SEQ ID NO: 80916 - DNA, 20 bp, Artificial Sequence
  Synthetic
ctcccgcaaaaugtgccuac

SEQ ID NO: 80917 - DNA, 25 bp, Artificial Sequence
  Synthetic
gagcataacauccgcaaugacaaat

SEQ ID NO: 80918 - DNA, 27 bp, Artificial Sequence
  Synthetic
ttcatcctgtcautcctcttcctcuat

SEQ ID NO: 80919 - DNA, 25 bp, Artificial Sequence
  Synthetic
cgggaaggacuttatgtatgaguca

SEQ ID NO: 80920 - DNA, 21 bp, Artificial Sequence
  Synthetic
ggcccuggcaaaacatttgua

SEQ ID NO: 80921 - DNA, 19 bp, Artificial Sequence
  Synthetic
cgccucccccaaugaagac

SEQ ID NO: 80922 - DNA, 21 bp, Artificial Sequence
  Synthetic
agggttcuggcgtttgtaguc

SEQ ID NO: 80923 - DNA, 29 bp, Artificial Sequence
  Synthetic
gcttattgggtaautctttgggattcuct

SEQ ID NO: 80924 - DNA, 24 bp, Artificial Sequence
  Synthetic
ctatcautccctctucaccagcat

SEQ ID NO: 80925 - DNA, 21 bp, Artificial Sequence
  Synthetic
gutcttgaagcucgagagcca

SEQ ID NO: 80926 - DNA, 22 bp, Artificial Sequence
  Synthetic
ctcauggagcactcaagugaca

SEQ ID NO: 80927 - DNA, 22 bp, Artificial Sequence
  Synthetic
gagggttcuggctgtgtgauag

SEQ ID NO: 80928 - DNA, 28 bp, Artificial Sequence
  Synthetic
gaaatattaatgcauggagcctgggaua

SEQ ID NO: 80929 - DNA, 24 bp, Artificial Sequence
  Synthetic
aggagcuaaaggctcaaatugagg

SEQ ID NO: 80930 - DNA, 28 bp, Artificial Sequence
  Synthetic
cataaataggucacaaagtcttcugcct

SEQ ID NO: 80931 - DNA, 22 bp, Artificial Sequence
  Synthetic
cccttttcuacctcccccucaa

SEQ ID NO: 80932 - DNA, 23 bp, Artificial Sequence
  Synthetic
ggugaaagcagacatcucgaagt

SEQ ID NO: 80933 - DNA, 25 bp, Artificial Sequence
  Synthetic
cttcagaauacctctgacagugaca

SEQ ID NO: 80934 - DNA, 23 bp, Artificial Sequence
  Synthetic
ccagagaggcaucagaccatcua

SEQ ID NO: 80935 - DNA, 20 bp, Artificial Sequence
  Synthetic
ccuggcaattgugacccagt

SEQ ID NO: 80936 - DNA, 22 bp, Artificial Sequence
  Synthetic
gacactgaggagaaucctgcut

SEQ ID NO: 80937 - DNA, 22 bp, Artificial Sequence
  Synthetic
gggacaguaacaggtgtctuca

SEQ ID NO: 80938 - DNA, 22 bp, Artificial Sequence
  Synthetic
catgcaggugtttguagaggct

SEQ ID NO: 80939 - DNA, 21 bp, Artificial Sequence
  Synthetic
agtagaccuccctgagcacut

SEQ ID NO: 80940 - DNA, 21 bp, Artificial Sequence
  Synthetic
cctccacggcuactttccuct

SEQ ID NO: 80941 - DNA, 27 bp, Artificial Sequence
  Synthetic
caggaaagugagattctaagucaacct

SEQ ID NO: 80942 - DNA, 22 bp, Artificial Sequence
  Synthetic
cctcagguggagcatttctucc

SEQ ID NO: 80943 - DNA, 28 bp, Artificial Sequence
  Synthetic
gcctaacttctucaaaccatgatttuct

SEQ ID NO: 80944 - DNA, 23 bp, Artificial Sequence
  Synthetic
gttgcttccaggcuaagactcut

SEQ ID NO: 80945 - DNA, 28 bp, Artificial Sequence
  Synthetic
acttaccagcaaaugaaaaccaaaacut

SEQ ID NO: 80946 - DNA, 28 bp, Artificial Sequence
  Synthetic
caagagtgtcacugggagatttuaaaga

SEQ ID NO: 80947 - DNA, 28 bp, Artificial Sequence
  Synthetic
gcccacaagutctaattuagaggcaaat

SEQ ID NO: 80948 - DNA, 28 bp, Artificial Sequence
  Synthetic
gctggtaagttautgtaggtgagtucat

SEQ ID NO: 80949 - DNA, 28 bp, Artificial Sequence
  Synthetic
gactgtctctacagauaacctccttgua

SEQ ID NO: 80950 - DNA, 27 bp, Artificial Sequence
  Synthetic
cagttggccacutttacttatagctut

SEQ ID NO: 80951 - DNA, 25 bp, Artificial Sequence
  Synthetic
gtagcagugaacttactacucacga

SEQ ID NO: 80952 - DNA, 28 bp, Artificial Sequence
  Synthetic
cctccaaactuacaggtgaagtaaauct

SEQ ID NO: 80953 - DNA, 23 bp, Artificial Sequence
  Synthetic
cctaattucaccagggcgacuac

SEQ ID NO: 80954 - DNA, 23 bp, Artificial Sequence
  Synthetic
ctccactucaaccttcagcucaa

SEQ ID NO: 80955 - DNA, 20 bp, Artificial Sequence
  Synthetic
tgagaggcuguggaccaagg

SEQ ID NO: 80956 - DNA, 28 bp, Artificial Sequence
  Synthetic
ccgctatcugatagagtctguaaaggaa

SEQ ID NO: 80957 - DNA, 28 bp, Artificial Sequence
  Synthetic
cagattcuccagaaccagtuacagaaat

SEQ ID NO: 80958 - DNA, 19 bp, Artificial Sequence
  Synthetic
tcccgagcuccacguaaac

SEQ ID NO: 80959 - DNA, 24 bp, Artificial Sequence
  Synthetic
tuggaaggagtucaacagacagac

SEQ ID NO: 80960 - DNA, 28 bp, Artificial Sequence
  Synthetic
gattcgttcccucattcactttaactug

SEQ ID NO: 80961 - DNA, 28 bp, Artificial Sequence
  Synthetic
ctaacttaccgggagauaattggcaaua

SEQ ID NO: 80962 - DNA, 20 bp, Artificial Sequence
  Synthetic
ccagcgagggagacuaugag

SEQ ID NO: 80963 - DNA, 25 bp, Artificial Sequence
  Synthetic
cgtggtggaugacatagactatcug

SEQ ID NO: 80964 - DNA, 24 bp, Artificial Sequence
  Synthetic
aaatgcaugagactccacucacat

SEQ ID NO: 80965 - DNA, 21 bp, Artificial Sequence
  Synthetic
ctcttguctctgcuccccaac

SEQ ID NO: 80966 - DNA, 19 bp, Artificial Sequence
  Synthetic
ccagagccacgcgucauac

SEQ ID NO: 80967 - DNA, 23 bp, Artificial Sequence
  Synthetic
gacctggutgttgattuggacaa

SEQ ID NO: 80968 - DNA, 21 bp, Artificial Sequence
  Synthetic
ccagtggugagtgtgagtugg

SEQ ID NO: 80969 - DNA, 22 bp, Artificial Sequence
  Synthetic
cctgtggcuactgaggtagtug

SEQ ID NO: 80970 - DNA, 28 bp, Artificial Sequence
  Synthetic
ataggaaactcagutgtagaaaacucct

SEQ ID NO: 80971 - DNA, 21 bp, Artificial Sequence
  Synthetic
gagaacaggcucacggagaug

SEQ ID NO: 80972 - DNA, 24 bp, Artificial Sequence
  Synthetic
ggacttgggugttcaattcuccag

SEQ ID NO: 80973 - DNA, 23 bp, Artificial Sequence
  Synthetic
caagaatauggacccgctgaaug

SEQ ID NO: 80974 - DNA, 26 bp, Artificial Sequence
  Synthetic
agacagacctuggtctcagtaauaca

SEQ ID NO: 80975 - DNA, 24 bp, Artificial Sequence
  Synthetic
gattctcaccutctttagcgcuct

SEQ ID NO: 80976 - DNA, 24 bp, Artificial Sequence
  Synthetic
acuggtugaaagcggaaaaagaga

SEQ ID NO: 80977 - DNA, 21 bp, Artificial Sequence
  Synthetic
tgatggccutgttagcauggg

SEQ ID NO: 80978 - DNA, 26 bp, Artificial Sequence
  Synthetic
cagaauggaacagatgacuggaaagt

SEQ ID NO: 80979 - DNA, 26 bp, Artificial Sequence
  Synthetic
ggtagggcattuctcccacttctuaa

SEQ ID NO: 80980 - DNA, 21 bp, Artificial Sequence
  Synthetic
agcacccuccaatccttccua

SEQ ID NO: 80981 - DNA, 24 bp, Artificial Sequence
  Synthetic
gtaugcaacaggacatugagcaag

SEQ ID NO: 80982 - DNA, 21 bp, Artificial Sequence
  Synthetic
gggcagaccagugtcatugag

SEQ ID NO: 80983 - DNA, 20 bp, Artificial Sequence
  Synthetic
gagacccacutgcctuccaa

SEQ ID NO: 80984 - DNA, 28 bp, Artificial Sequence
  Synthetic
ctcgttttgattcutcacaacaggatut

SEQ ID NO: 80985 - DNA, 24 bp, Artificial Sequence
  Synthetic
accagaccauatttgtuggacaca

SEQ ID NO: 80986 - DNA, 19 bp, Artificial Sequence
  Synthetic
cagggugaagtggcugcat

SEQ ID NO: 80987 - DNA, 25 bp, Artificial Sequence
  Synthetic
gggttggttgutattacttagcuca

SEQ ID NO: 80988 - DNA, 21 bp, Artificial Sequence
  Synthetic
cagcccucccaacacattuct

SEQ ID NO: 80989 - DNA, 20 bp, Artificial Sequence
  Synthetic
gaagccuccgtgcuacacaa

SEQ ID NO: 80990 - DNA, 20 bp, Artificial Sequence
  Synthetic
acugacacccaccugagact

SEQ ID NO: 80991 - DNA, 25 bp, Artificial Sequence
  Synthetic
gcatgtctcuacctctatctccuct

SEQ ID NO: 80992 - DNA, 23 bp, Artificial Sequence
  Synthetic
ccgccggutgauaaagaaaaact

SEQ ID NO: 80993 - DNA, 26 bp, Artificial Sequence
  Synthetic
tctaatcccttucactctggaaucct

SEQ ID NO: 80994 - DNA, 26 bp, Artificial Sequence
  Synthetic
tcaccgguacaagttcttttcttugt

SEQ ID NO: 80995 - DNA, 20 bp, Artificial Sequence
  Synthetic
actcttgugcgtgccttcuc

SEQ ID NO: 80996 - DNA, 18 bp, Artificial Sequence
  Synthetic
cactgaguccccgtgcut

SEQ ID NO: 80997 - DNA, 18 bp, Artificial Sequence
  Synthetic
gutgucggagacgcggat

SEQ ID NO: 80998 - DNA, 21 bp, Artificial Sequence
  Synthetic
ggaaggaaaggccgauacuca

SEQ ID NO: 80999 - DNA, 22 bp, Artificial Sequence
  Synthetic
cacttcuccccagttgtcuact

SEQ ID NO: 81000 - DNA, 26 bp, Artificial Sequence
  Synthetic
aggaatggauaatagctccucccaaa

SEQ ID NO: 81001 - DNA, 26 bp, Artificial Sequence
  Synthetic
cccagtctucattgctactaaucagg

SEQ ID NO: 81002 - DNA, 20 bp, Artificial Sequence
  Synthetic
cttcggcucggtctacucag

SEQ ID NO: 81003 - DNA, 19 bp, Artificial Sequence
  Synthetic
ccagggtcuccgtcaggut

SEQ ID NO: 81004 - DNA, 20 bp, Artificial Sequence
  Synthetic
tccaggtuggacacgagtug

SEQ ID NO: 81005 - DNA, 23 bp, Artificial Sequence
  Synthetic
aggtuccagaaggagaucgagaa

SEQ ID NO: 81006 - DNA, 21 bp, Artificial Sequence
  Synthetic
ccaaaggcutcgtaugcaggt

SEQ ID NO: 81007 - DNA, 21 bp, Artificial Sequence
  Synthetic
ccccttacagugcagccauag

SEQ ID NO: 81008 - DNA, 19 bp, Artificial Sequence
  Synthetic
ggaacgcucgagtctgcut

SEQ ID NO: 81009 - DNA, 27 bp, Artificial Sequence
  Synthetic
tcctctctcuactttgcaacauaaacc

SEQ ID NO: 81010 - DNA, 28 bp, Artificial Sequence
  Synthetic
tgggtgtatcuggtgttgaaaattcuaa

SEQ ID NO: 81011 - DNA, 25 bp, Artificial Sequence
  Synthetic
cccaattttcucctgattgtuccag

SEQ ID NO: 81012 - DNA, 25 bp, Artificial Sequence
  Synthetic
gtgctatatgucaaagtgcuaggct

SEQ ID NO: 81013 - DNA, 24 bp, Artificial Sequence
  Synthetic
gggaactcauggtgtacccctaut

SEQ ID NO: 81014 - DNA, 20 bp, Artificial Sequence
  Synthetic
gagcagggaagucacgtugt

SEQ ID NO: 81015 - DNA, 27 bp, Artificial Sequence
  Synthetic
gccttggtttcuaagtttctagttucc

SEQ ID NO: 81016 - DNA, 25 bp, Artificial Sequence
  Synthetic
atgtgcttgcuttacatcgtcuact

SEQ ID NO: 81017 - DNA, 28 bp, Artificial Sequence
  Synthetic
ccaagaagaugcaaagtaaaaagcacua

SEQ ID NO: 81018 - DNA, 29 bp, Artificial Sequence
  Synthetic
tggcaaacaauaccaaatttacttcaugt

SEQ ID NO: 81019 - DNA, 18 bp, Artificial Sequence
  Synthetic
cggtgcuctgcguaccaa

SEQ ID NO: 81020 - DNA, 28 bp, Artificial Sequence
  Synthetic
cctcaaaagcautaagaaaatguggact

SEQ ID NO: 81021 - DNA, 26 bp, Artificial Sequence
  Synthetic
tgaaaatgacaagcuggttgagacua

SEQ ID NO: 81022 - DNA, 30 bp, Artificial Sequence; identical to SEQ ID NO: 68284
  Synthetic

SEQ ID NO: 81023 - DNA, 21 bp, Artificial Sequence
  Synthetic
tcagctgccuacttccuccat

SEQ ID NO: 81024 - DNA, 21 bp, Artificial Sequence
  Synthetic
ggcutctggactuggaaccat

SEQ ID NO: 81025 - DNA, 27 bp, Artificial Sequence
  Synthetic
agagataagccugaagataatgugggt

SEQ ID NO: 81026 - DNA, 26 bp, Artificial Sequence
  Synthetic
ggaaatgugggaggagagaattacug

SEQ ID NO: 81027 - DNA, 24 bp, Artificial Sequence
  Synthetic
caagcatgtccuagttttgcagut

SEQ ID NO: 81028 - DNA, 24 bp, Artificial Sequence
  Synthetic
tggacagtcuacgaaaagctctug

SEQ ID NO: 81029 - DNA, 27 bp, Artificial Sequence
  Synthetic
ggactgaacaaguaggaaaaugacaga

SEQ ID NO: 81030 - DNA, 28 bp, Artificial Sequence
  Synthetic
ctattacgttacgauttccccctugaat

SEQ ID NO: 81031 - DNA, 23 bp, Artificial Sequence
  Synthetic
cgaagttccugatggagctguaa

SEQ ID NO: 81032 - DNA, 22 bp, Artificial Sequence
  Synthetic
ggtagtttguttgtggguggct

SEQ ID NO: 81033 - DNA, 28 bp, Artificial Sequence
  Synthetic
ccttttggatgtugtgctcttgtttaut

SEQ ID NO: 81034 - DNA, 20 bp, Artificial Sequence
  Synthetic
tgagaaguaccgctcccuca

SEQ ID NO: 81035 - DNA, 21 bp, Artificial Sequence
  Synthetic
gttguggagctgguggagaat

SEQ ID NO: 81036 - DNA, 22 bp, Artificial Sequence
  Synthetic
gctgacagaaagugctgcaaut

SEQ ID NO: 81037 - DNA, 26 bp, Artificial Sequence
  Synthetic
gcatgutaccttaagaucaaccacca

SEQ ID NO: 81038 - DNA, 27 bp, Artificial Sequence
  Synthetic
tgtcattttccuacttgttcaguccat

SEQ ID NO: 81039 - DNA, 28 bp, Artificial Sequence
  Synthetic
caagtccuatgaacttaucaacgaagag

SEQ ID NO: 81040 - DNA, 19 bp, Artificial Sequence
  Synthetic
tcctcgtacugctggguga

SEQ ID NO: 81041 - DNA, 20 bp, Artificial Sequence
  Synthetic
cctggacgcugtccttguag

SEQ ID NO: 81042 - DNA, 22 bp, Artificial Sequence
  Synthetic
aaaaggtcguctacagcugcaa

SEQ ID NO: 81043 - DNA, 21 bp, Artificial Sequence
  Synthetic
tttcacugaatgguccacgct

SEQ ID NO: 81044 - DNA, 26 bp, Artificial Sequence
  Synthetic
gcattatcggcaguttgatctugaga

SEQ ID NO: 81045 - DNA, 28 bp, Artificial Sequence
  Synthetic
gccaaagaaaaugctaaaatgtuggaat

SEQ ID NO: 81046 - DNA, 27 bp, Artificial Sequence
  Synthetic
cttttgatgacatugctcatgctagug

SEQ ID NO: 81047 - DNA, 23 bp, Artificial Sequence
  Synthetic
ctcugggagctacuaacaggagt

SEQ ID NO: 81048 - DNA, 27 bp, Artificial Sequence
  Synthetic
cttagaggutagtttctttuccaccct

SEQ ID NO: 81049 - DNA, 23 bp, Artificial Sequence
  Synthetic
tgaaagauccagaccctgaucca

SEQ ID NO: 81050 - DNA, 22 bp, Artificial Sequence
  Synthetic
ctttcccaaccgugaccttcut

SEQ ID NO: 81051 - DNA, 24 bp, Artificial Sequence
  Synthetic
aaaaacttcaucaacagcccagug

SEQ ID NO: 81052 - DNA, 24 bp, Artificial Sequence
  Synthetic
caacagaagtutcaggtgacugag

SEQ ID NO: 81053 - DNA, 26 bp, Artificial Sequence
  Synthetic
cctgttgguggaagactcataaauca

SEQ ID NO: 81054 - DNA, 25 bp, Artificial Sequence
  Synthetic
ggacattattgaucacacctgggut

SEQ ID NO: 81055 - DNA, 28 bp, Artificial Sequence
  Synthetic
gagatggtctctugggtgaattttacut

SEQ ID NO: 81056 - DNA, 23 bp, Artificial Sequence
  Synthetic
ggcaacacagcuagaattggaug

SEQ ID NO: 81057 - DNA, 24 bp, Artificial Sequence
  Synthetic
ccatcagttggutggcagttttug

SEQ ID NO: 81058 - DNA, 27 bp, Artificial Sequence
  Synthetic
cacaaacutgugagagagagacaagaa

SEQ ID NO: 81059 - DNA, 21 bp, Artificial Sequence
  Synthetic
tgccaaaauggaguccaacca

SEQ ID NO: 81060 - DNA, 17 bp, Artificial Sequence
  Synthetic
gtggcccccuctuggat

SEQ ID NO: 81061 - DNA, 17 bp, Artificial Sequence
  Synthetic
gcacucccagccucgaa

SEQ ID NO: 81062 - DNA, 23 bp, Artificial Sequence
  Synthetic
catagcagcugacttcucaccat

SEQ ID NO: 81063 - DNA, 26 bp, Artificial Sequence
  Synthetic
aaggtacccuggttattgtggtatug

SEQ ID NO: 81064 - DNA, 17 bp, Artificial Sequence
  Synthetic
gctucgaggcugggagt

SEQ ID NO: 81065 - DNA, 20 bp, Artificial Sequence
  Synthetic
caggaacuacgcctccauca

SEQ ID NO: 81066 - DNA, 22 bp, Artificial Sequence
  Synthetic
gtttactgcugcagctaccuct

SEQ ID NO: 81067 - DNA, 21 bp, Artificial Sequence
  Synthetic
tgagggcaagacugaggacut

SEQ ID NO: 81068 - DNA, 18 bp, Artificial Sequence
  Synthetic
gttccugccccagcctut

SEQ ID NO: 81069 - DNA, 21 bp, Artificial Sequence
  Synthetic
gaaattcgagcuggtgccauc

SEQ ID NO: 81070 - DNA, 18 bp, Artificial Sequence
  Synthetic
cgggatuccgcttcguct

SEQ ID NO: 81071 - DNA, 19 bp, Artificial Sequence
  Synthetic
ccagcgaggacaucuggaa

SEQ ID NO: 81072 - DNA, 20 bp, Artificial Sequence
  Synthetic
gggacccagacgaguctcut

SEQ ID NO: 81073 - DNA, 22 bp, Artificial Sequence
  Synthetic
gtggtctgatuctgaccctgut

SEQ ID NO: 81074 - DNA, 32 bp, Artificial Sequence
  Synthetic
gaaagacattgagaautatattcaagauggga

SEQ ID NO: 81075 - DNA, 28 bp, Artificial Sequence
  Synthetic
tcgcattcactuagttgagctattacut

SEQ ID NO: 81076 - DNA, 29 bp, Artificial Sequence
  Synthetic
agatgggaaagacgacuataagaagguaa

SEQ ID NO: 81077 - DNA, 27 bp, Artificial Sequence
  Synthetic
tcttttctttgugtttctcgcatucac

SEQ ID NO: 81078 - DNA, 20 bp, Artificial Sequence
  Synthetic
cgatggcaccagcucgaaut

SEQ ID NO: 81079 - DNA, 19 bp, Artificial Sequence
  Synthetic
agggagcggacauggacua

SEQ ID NO: 81080 - DNA, 20 bp, Artificial Sequence
  Synthetic
ccccaugacgccctugaaaa

SEQ ID NO: 81081 - DNA, 24 bp, Artificial Sequence
  Synthetic
ctctctgttuctggttccucacag

SEQ ID NO: 81082 - DNA, 28 bp, Artificial Sequence
  Synthetic
agtcatagtcguagaaatagtgctggua

SEQ ID NO: 81083 - DNA, 17 bp, Artificial Sequence
  Synthetic
cgacugugccgagggac

SEQ ID NO: 81084 - DNA, 30 bp, Artificial Sequence
  Synthetic
agaaaaagauacaaccgtattcagaauact

SEQ ID NO: 81085 - DNA, 28 bp, Artificial Sequence
  Synthetic
ttagctgagtaaugaactgggaguaaac

SEQ ID NO: 81086 - DNA, 21 bp, Artificial Sequence
  Synthetic
aaaatagccaugctggcugga

SEQ ID NO: 81087 - DNA, 25 bp, Artificial Sequence
  Synthetic
acttcttgtaacucagcctctguct

SEQ ID NO: 81088 - DNA, 21 bp, Artificial Sequence
  Synthetic
ccacctagtuccgtgccatug

SEQ ID NO: 81089 - DNA, 28 bp, Artificial Sequence
  Synthetic
tgtccaactatgtuagctacgactctua

SEQ ID NO: 81090 - DNA, 20 bp, Artificial Sequence
  Synthetic
agcagtugttcagguggcat

SEQ ID NO: 81091 - DNA, 25 bp, Artificial Sequence
  Synthetic
tgacaaatactgugcagaccactuc

SEQ ID NO: 81092 - DNA, 27 bp, Artificial Sequence
  Synthetic
tgtgaaagaacaacaugaacccauagt

SEQ ID NO: 81093 - DNA, 21 bp, Artificial Sequence
  Synthetic
caaaatcuccagggtggcuct

SEQ ID NO: 81094 - DNA, 23 bp, Artificial Sequence
  Synthetic
ggatttggcugaaacaaagcugt

SEQ ID NO: 81095 - DNA, 23 bp, Artificial Sequence
  Synthetic
cagaatggctuttcccgaactut

SEQ ID NO: 81096 - DNA, 25 bp, Artificial Sequence
  Synthetic
aggcacaatcaugaagtaagccaua

SEQ ID NO: 81097 - DNA, 23 bp, Artificial Sequence
  Synthetic
acgtgaacucaaggaagacucac

SEQ ID NO: 81098 - DNA, 26 bp, Artificial Sequence
  Synthetic
ctgggagautcctttactugaaccat

SEQ ID NO: 81099 - DNA, 23 bp, Artificial Sequence
  Synthetic
cctcttccuctgttggttgauga

SEQ ID NO: 81100 - DNA, 25 bp, Artificial Sequence
  Synthetic
caaaagtaataccaucccccgacut

SEQ ID NO: 81101 - DNA, 28 bp, Artificial Sequence
  Synthetic
tcaaacagaugaaatccctgtatugaca

SEQ ID NO: 81102 - DNA, 26 bp, Artificial Sequence
  Synthetic
tgtatacattuggataccagtgucct

SEQ ID NO: 81103 - DNA, 25 bp, Artificial Sequence
  Synthetic
attcgagctcugcattcttctucat

SEQ ID NO: 81104 - DNA, 19 bp, Artificial Sequence
  Synthetic
gcctcucaggacugaccca

SEQ ID NO: 81105 - DNA, 20 bp, Artificial Sequence
  Synthetic
cuccagaagccacgtuacga

SEQ ID NO: 81106 - DNA, 28 bp, Artificial Sequence
  Synthetic
aacatgguagttttcttguacgagagag

SEQ ID NO: 81107 - DNA, 24 bp, Artificial Sequence
  Synthetic
acatctugccagacccattttuca

SEQ ID NO: 81108 - DNA, 22 bp, Artificial Sequence
  Synthetic
agaaccccagguacatggtcua

SEQ ID NO: 81109 - DNA, 21 bp, Artificial Sequence
  Synthetic
cgacacugtggtcatuggcat

SEQ ID NO: 81110 - DNA, 24 bp, Artificial Sequence
  Synthetic
cgggaaaagccautctgcatttut

SEQ ID NO: 81111 - DNA, 27 bp, Artificial Sequence
  Synthetic
tctgagaagtgaaugtactgagtggua

SEQ ID NO: 81112 - DNA, 22 bp, Artificial Sequence
  Synthetic
cgctcuccacccatctcactua

SEQ ID NO: 81113 - DNA, 23 bp, Artificial Sequence
  Synthetic
agcucagagaggttucaacacac

SEQ ID NO: 81114 - DNA, 23 bp, Artificial Sequence
  Synthetic
agctcacagacucaatcacctuc

SEQ ID NO: 81115 - DNA, 20 bp, Artificial Sequence
  Synthetic
tguccuagacggacgaacct

SEQ ID NO: 81116 - DNA, 23 bp, Artificial Sequence
  Synthetic
gccccgttugtcagagagtttut

SEQ ID NO: 81117 - DNA, 22 bp, Artificial Sequence
  Synthetic
catcacgccgcutttcctttut

SEQ ID NO: 81118 - DNA, 21 bp, Artificial Sequence
  Synthetic
cccuagccaacaaucgggaaa

SEQ ID NO: 81119 - DNA, 25 bp, Artificial Sequence
  Synthetic
tttattgagugcaagtcctcuccac

SEQ ID NO: 81120 - DNA, 23 bp, Artificial Sequence
  Synthetic
cattgtgccuctctctcttguca

SEQ ID NO: 81121 - DNA, 25 bp, Artificial Sequence
  Synthetic
gcttgttcucattggctucaaagat

SEQ ID NO: 81122 - DNA, 28 bp, Artificial Sequence
  Synthetic
gtgaatgagtatgugggtgagcttauag

SEQ ID NO: 81123 - DNA, 27 bp, Artificial Sequence
  Synthetic
cagtgaaaacagcauttcccattacut

SEQ ID NO: 81124 - DNA, 22 bp, Artificial Sequence
  Synthetic
gttctcaaugacagggaugcga

SEQ ID NO: 81125 - DNA, 20 bp, Artificial Sequence
  Synthetic
caggtccugcgtctctctug

SEQ ID NO: 81126 - DNA, 22 bp, Artificial Sequence
  Synthetic
cctggtcacaguggttgtctut

SEQ ID NO: 81127 - DNA, 28 bp, Artificial Sequence
  Synthetic
ggtaggaaaauccacagtagtuccaaat

SEQ ID NO: 81128 - DNA, 23 bp, Artificial Sequence
  Synthetic
cactcatcacgauttcaggccua

SEQ ID NO: 81129 - DNA, 25 bp, Artificial Sequence
  Synthetic
gtaccugggaacaacctacttugag

SEQ ID NO: 81130 - DNA, 23 bp, Artificial Sequence
  Synthetic
gccagcuaggaagagccuagaat

SEQ ID NO: 81131 - DNA, 19 bp, Artificial Sequence
  Synthetic
cctcaagcugcgcatcuac

SEQ ID NO: 81132 - DNA, 24 bp, Artificial Sequence
  Synthetic
gtgcaactcuctggcttaaucact

SEQ ID NO: 81133 - DNA, 29 bp, Artificial Sequence
  Synthetic
tcacaggtattautctcactaaggtuggt

SEQ ID NO: 81134 - DNA, 25 bp, Artificial Sequence
  Synthetic
gccagtgggauagtttttctggaut

SEQ ID NO: 81135 - DNA, 27 bp, Artificial Sequence
  Synthetic
cgacaaggtauaatggcagaatcauca

SEQ ID NO: 81136 - DNA, 29 bp, Artificial Sequence
  Synthetic
aaactcaagucaacagaatcagagcuaaa

SEQ ID NO: 81137 - DNA, 24 bp, Artificial Sequence
  Synthetic
aggcatgagaugggtacctttuac

SEQ ID NO: 81138 - DNA, 28 bp, Artificial Sequence
  Synthetic
ttttccatuacagcaaacacaaatucca

SEQ ID NO: 81139 - DNA, 22 bp, Artificial Sequence
  Synthetic
gatactaagcuggctcugcagt

SEQ ID NO: 81140 - DNA, 20 bp, Artificial Sequence
  Synthetic
gcagagagacauggcacuca

SEQ ID NO: 81141 - DNA, 23 bp, Artificial Sequence
  Synthetic
agtaucgagaaccgagugagagg

SEQ ID NO: 81142 - DNA, 18 bp, Artificial Sequence
  Synthetic
catgcgcuccuccaggaa

SEQ ID NO: 81143 - DNA, 17 bp, Artificial Sequence
  Synthetic
aatcgggcacgcuccuc

SEQ ID NO: 81144 - DNA, 21 bp, Artificial Sequence
  Synthetic
cctggttcugcagagtcacut

SEQ ID NO: 81145 - DNA, 22 bp, Artificial Sequence
  Synthetic
ccgacucggagtatagtuccca

SEQ ID NO: 81146 - DNA, 26 bp, Artificial Sequence
  Synthetic
acggattatutagtcatcguggagga

SEQ ID NO: 81147 - DNA, 19 bp, Artificial Sequence
  Synthetic
agggcccuacagugaaggt

SEQ ID NO: 81148 - DNA, 25 bp, Artificial Sequence
  Synthetic
catgtgtggcutaatcttgcctcua

SEQ ID NO: 81149 - DNA, 23 bp, Artificial Sequence
  Synthetic
gctacagtauggaccctgucaca

SEQ ID NO: 81150 - DNA, 27 bp, Artificial Sequence
  Synthetic
tcattacctgttcutttgtctgagcut

SEQ ID NO: 81151 - DNA, 26 bp, Artificial Sequence
  Synthetic
tcacgatgttucttttctccauccag

SEQ ID NO: 81152 - DNA, 18 bp, Artificial Sequence
  Synthetic
gaggccugacactgucgt

SEQ ID NO: 81153 - DNA, 26 bp, Artificial Sequence
  Synthetic
catggaatccccutaaataggtguct

SEQ ID NO: 81154 - DNA, 19 bp, Artificial Sequence
  Synthetic
ggcgacauggcccctatug

SEQ ID NO: 81155 - DNA, 22 bp, Artificial Sequence
  Synthetic
cgggtuacaccacttgtgtcug

SEQ ID NO: 81156 - DNA, 23 bp, Artificial Sequence
  Synthetic
gcaggaacaaautctccaggtug

SEQ ID NO: 81157 - DNA, 21 bp, Artificial Sequence
  Synthetic
cagaccccugtgatgctgtua

SEQ ID NO: 81158 - DNA, 25 bp, Artificial Sequence
  Synthetic
gcatttcacaucacagtaggagcut

SEQ ID NO: 81159 - DNA, 25 bp, Artificial Sequence
  Synthetic
caaacaagagauggcaatgtttucc

SEQ ID NO: 81160 - DNA, 17 bp, Artificial Sequence
  Synthetic
aggcggtucaagccgut

SEQ ID NO: 81161 - DNA, 23 bp, Artificial Sequence
  Synthetic
ggaacagaggccccugaaaaaua

SEQ ID NO: 81162 - DNA, 26 bp, Artificial Sequence
  Synthetic
gccctaggatuaactttttcccguaa

SEQ ID NO: 81163 - DNA, 25 bp, Artificial Sequence
  Synthetic
acgaggaucagacaggtaagtugat

SEQ ID NO: 81164 - DNA, 22 bp, Artificial Sequence
  Synthetic
acagcagacagggcuttaaugg

SEQ ID NO: 81165 - DNA, 23 bp, Artificial Sequence
  Synthetic
cgcaccttaugattttgcctgut

SEQ ID NO: 81166 - DNA, 21 bp, Artificial Sequence
  Synthetic
ccacatctccutaccctccug

SEQ ID NO: 81167 - DNA, 26 bp, Artificial Sequence
  Synthetic
caagggaattccuaatgttggtguct

SEQ ID NO: 81168 - DNA, 21 bp, Artificial Sequence
  Synthetic
agggcaauattgtgcctuggt

SEQ ID NO: 81169 - DNA, 28 bp, Artificial Sequence
  Synthetic
agtaatgctacucaacacagagtctgua

SEQ ID NO: 81170 - DNA, 25 bp, Artificial Sequence
  Synthetic
tctggcutcttactttugggaacaa

SEQ ID NO: 81171 - DNA, 27 bp, Artificial Sequence
  Synthetic
tgacaaaagccutcacctacugaaaaa

SEQ ID NO: 81172 - DNA, 25 bp, Artificial Sequence
  Synthetic
ctttgtccauactgcccatatuggt

SEQ ID NO: 81173 - DNA, 20 bp, Artificial Sequence
  Synthetic
gaaccuaccaccacggtguc

SEQ ID NO: 81174 - DNA, 19 bp, Artificial Sequence
  Synthetic
ggtgggcacacacuacguc

SEQ ID NO: 81175 - DNA, 23 bp, Artificial Sequence
  Synthetic
agaaccugcccatctactcugaa

SEQ ID NO: 81176 - DNA, 24 bp, Artificial Sequence
  Synthetic
agcagaugaccaaagatacagugg

SEQ ID NO: 81177 - DNA, 27 bp, Artificial Sequence
  Synthetic
tgaaacccaaaugtaactctuggaaca

SEQ ID NO: 81178 - DNA, 26 bp, Artificial Sequence
  Synthetic
cttcgagatauaaggtgctgagtugt

SEQ ID NO: 81179 - DNA, 28 bp, Artificial Sequence
  Synthetic
ctcagaatugcagaaaaagaaaacugga

SEQ ID NO: 81180 - DNA, 20 bp, Artificial Sequence
  Synthetic
aaucagccugcaagccagat

SEQ ID NO: 81181 - DNA, 22 bp, Artificial Sequence
  Synthetic
gtgcattgugatcgggaaugag

SEQ ID NO: 81182 - DNA, 21 bp, Artificial Sequence
  Synthetic
ctccctgtcucctttcgctut

SEQ ID NO: 81183 - DNA, 21 bp, Artificial Sequence
  Synthetic
gctccgtgcuttctaggtcut

SEQ ID NO: 81184 - DNA, 28 bp, Artificial Sequence
  Synthetic
tgaaggcttttgucattttctcctttut

SEQ ID NO: 81185 - DNA, 28 bp, Artificial Sequence
  Synthetic
cttgcattaatucgggatatacguagga

SEQ ID NO: 81186 - DNA, 26 bp, Artificial Sequence
  Synthetic
ctgaaggugaggcttaauagacaaga

SEQ ID NO: 81187 - DNA, 25 bp, Artificial Sequence
  Synthetic
tgaccagcttuccttttctgttuca

SEQ ID NO: 81188 - DNA, 28 bp, Artificial Sequence
  Synthetic
gctcttcatatgguctagtctctgacug

SEQ ID NO: 81189 - DNA, 23 bp, Artificial Sequence
  Synthetic
cctcttcccaauctggctgttut

SEQ ID NO: 81190 - DNA, 24 bp, Artificial Sequence
  Synthetic
tgagcagccacuttattctuaccc

SEQ ID NO: 81191 - DNA, 28 bp, Artificial Sequence
  Synthetic
tctccataucccattccctguagaaaaa

SEQ ID NO: 81192 - DNA, 21 bp, Artificial Sequence
  Synthetic
tgtccacucgaagtugaccac

SEQ ID NO: 81193 - DNA, 25 bp, Artificial Sequence
  Synthetic
gacctaagccaauctctctcuacca

SEQ ID NO: 81194 - DNA, 21 bp, Artificial Sequence
  Synthetic
tgatggcgugatccccaaaut

SEQ ID NO: 81195 - DNA, 24 bp, Artificial Sequence
  Synthetic
acaggttgccutactggttaccua

SEQ ID NO: 81196 - DNA, 22 bp, Artificial Sequence
  Synthetic
ctccactcautgccatgacuct

SEQ ID NO: 81197 - DNA, 21 bp, Artificial Sequence
  Synthetic
cctccacgguactcctgtcuc

SEQ ID NO: 81198 - DNA, 23 bp, Artificial Sequence
  Synthetic
tgggatctttuctctgagaggut

SEQ ID NO: 81199 - DNA, 24 bp, Artificial Sequence
  Synthetic
tgaaccgagcauagtttccttugg

SEQ ID NO: 81200 - DNA, 24 bp, Artificial Sequence
  Synthetic
gcccttgtacauttccacaatcuc

SEQ ID NO: 81201 - DNA, 28 bp, Artificial Sequence
  Synthetic
gagaatcaaactucctaacctgttccua

SEQ ID NO: 81202 - DNA, 21 bp, Artificial Sequence
  Synthetic
cccugggaaaagcctcaucac

SEQ ID NO: 81203 - DNA, 25 bp, Artificial Sequence
  Synthetic
ctggaagtgtautttgctctggtut

SEQ ID NO: 81204 - DNA, 23 bp, Artificial Sequence
  Synthetic
ccggttgaucttcgguagagagt

SEQ ID NO: 81205 - DNA, 22 bp, Artificial Sequence
  Synthetic
gacccaggucctctacaagaug

SEQ ID NO: 81206 - DNA, 22 bp, Artificial Sequence
  Synthetic
tgtctggccaugaggaaatguc

SEQ ID NO: 81207 - DNA, 20 bp, Artificial Sequence
  Synthetic
gccuaaccccgtatgugacc

SEQ ID NO: 81208 - DNA, 24 bp, Artificial Sequence
  Synthetic
tcaaacatcaucacggagauccac

SEQ ID NO: 81209 - DNA, 23 bp, Artificial Sequence
  Synthetic
tgtcctgacugttgaggaacuca

SEQ ID NO: 81210 - DNA, 21 bp, Artificial Sequence
  Synthetic
accgaatcautgatgctgguc

SEQ ID NO: 81211 - DNA, 23 bp, Artificial Sequence
  Synthetic
tgtcagcugcagaatccugaaat

SEQ ID NO: 81212 - DNA, 22 bp, Artificial Sequence
  Synthetic
guctctuggaagagggcaagac

SEQ ID NO: 81213 - DNA, 22 bp, Artificial Sequence
  Synthetic
ggcagctugtttgttcatguga

SEQ ID NO: 81214 - DNA, 23 bp, Artificial Sequence
  Synthetic
gccccucccagatctctuaaagt

SEQ ID NO: 81215 - DNA, 24 bp, Artificial Sequence
  Synthetic
gctttatgagaugctgagugacca

SEQ ID NO: 81216 - DNA, 21 bp, Artificial Sequence
  Synthetic
gtgatcacagutgacgagcut

SEQ ID NO: 81217 - DNA, 21 bp, Artificial Sequence
  Synthetic
gagaagaaccuggucccagag

SEQ ID NO: 81218 - DNA, 26 bp, Artificial Sequence
  Synthetic
ttgaagucaacaacagggaggtuaat

SEQ ID NO: 81219 - DNA, 25 bp, Artificial Sequence
  Synthetic
cacaccagagaaagaautgcctgua

SEQ ID NO: 81220 - DNA, 22 bp, Artificial Sequence
  Synthetic
atcaucaaaggagcggaucgag

SEQ ID NO: 81221 - DNA, 23 bp, Artificial Sequence
  Synthetic
cutggagcttuccacaggagaaa

SEQ ID NO: 81222 - DNA, 21 bp, Artificial Sequence
  Synthetic
cccatcugagacccggatcut

SEQ ID NO: 81223 - DNA, 25 bp, Artificial Sequence
  Synthetic
ctctctgtugaaagtccctaaugct

SEQ ID NO: 81224 - DNA, 22 bp, Artificial Sequence
  Synthetic
gggagaggutaatgggccuagt

SEQ ID NO: 81225 - DNA, 21 bp, Artificial Sequence
  Synthetic
tgcccgccugttctctuaaag

SEQ ID NO: 81226 - DNA, 22 bp, Artificial Sequence
  Synthetic
ggaaaagtgaggugtggagcut

SEQ ID NO: 81227 - DNA, 20 bp, Artificial Sequence
  Synthetic
ggguacagctcucaccaagg

SEQ ID NO: 81228 - DNA, 24 bp, Artificial Sequence
  Synthetic
ccaacguacatgtgattgugaaag

SEQ ID NO: 81229 - DNA, 21 bp, Artificial Sequence
  Synthetic
aacccatcugggccatuacag

SEQ ID NO: 81230 - DNA, 25 bp, Artificial Sequence
  Synthetic
ctctatccttcaauttccccgtcut

SEQ ID NO: 81231 - DNA, 28 bp, Artificial Sequence
  Synthetic
cctgtagtatcutgcttggtcauaaagg

SEQ ID NO: 81232 - DNA, 25 bp, Artificial Sequence
  Synthetic
cctcattcacaggcuggcttatuag

SEQ ID NO: 81233 - DNA, 29 bp, Artificial Sequence
  Synthetic
actgaaugagaacttaagugggaaacaaa

SEQ ID NO: 81234 - DNA, 25 bp, Artificial Sequence
  Synthetic
cctccagcuattacgggtguagaat

SEQ ID NO: 81235 - DNA, 29 bp, Artificial Sequence
  Synthetic
gcaaagccuaaatctcauagaacagaaag

SEQ ID NO: 81236 - DNA, 22 bp, Artificial Sequence
  Synthetic
caaacuccacattccuggcaag

SEQ ID NO: 81237 - DNA, 24 bp, Artificial Sequence
  Synthetic
cgacauguacaagggcaagaagag

SEQ ID NO: 81238 - DNA, 20 bp, Artificial Sequence
  Synthetic
gcggctgugtctcctctcua

SEQ ID NO: 81239 - DNA, 23 bp, Artificial Sequence
  Synthetic
cctcacaggcaucactgaaguat

SEQ ID NO: 81240 - DNA, 21 bp, Artificial Sequence
  Synthetic
ggaggucccaaatcccaugag

SEQ ID NO: 81241 - DNA, 20 bp, Artificial Sequence
  Synthetic
agcagcugguacacgacaag

SEQ ID NO: 81242 - DNA, 23 bp, Artificial Sequence
  Synthetic
gtctacatgugttgcagctcuct

SEQ ID NO: 81243 - DNA, 17 bp, Artificial Sequence
  Synthetic
tgggugggaagccucct

SEQ ID NO: 81244 - DNA, 20 bp, Artificial Sequence
  Synthetic
ctcuggagaggaggguagca

SEQ ID NO: 81245 - DNA, 17 bp, Artificial Sequence
  Synthetic
gucucgcccccgaaaca

SEQ ID NO: 81246 - DNA, 19 bp, Artificial Sequence
  Synthetic
cggcgtucaaccacctuct

SEQ ID NO: 81247 - DNA, 18 bp, Artificial Sequence
  Synthetic
ggcaccacugagauggca

SEQ ID NO: 81248 - DNA, 21 bp, Artificial Sequence
  Synthetic
ccacaucaucgagaacccaca

SEQ ID NO: 81249 - DNA, 22 bp, Artificial Sequence
  Synthetic
gagaaagggagggaucgtucag

SEQ ID NO: 81250 - DNA, 22 bp, Artificial Sequence
  Synthetic
ggtcagggaccaaaucccaauc

SEQ ID NO: 81251 - DNA, 20 bp, Artificial Sequence
  Synthetic
tgactgagggugaggagcut

SEQ ID NO: 81252 - DNA, 21 bp, Artificial Sequence
  Synthetic
gacaaacccuctccagugacc

SEQ ID NO: 81253 - DNA, 23 bp, Artificial Sequence
  Synthetic
ggaactgaggutttctccaguga

SEQ ID NO: 81254 - DNA, 28 bp, Artificial Sequence
  Synthetic
aaaaacgagatccuagttacccaactut

SEQ ID NO: 81255 - DNA, 25 bp, Artificial Sequence
  Synthetic
acaaagaggaggcuagttaguagca

SEQ ID NO: 81256 - DNA, 20 bp, Artificial Sequence
  Synthetic
cgtagatgugaggcggcauc

SEQ ID NO: 81257 - DNA, 22 bp, Artificial Sequence
  Synthetic
gtctggaaguaagctgggtuct

SEQ ID NO: 81258 - DNA, 24 bp, Artificial Sequence
  Synthetic
gaagcccaugagatctttgcagua

SEQ ID NO: 81259 - DNA, 28 bp, Artificial Sequence
  Synthetic
ccagtttgaaugccagtcataaguaaag

SEQ ID NO: 81260 - DNA, 20 bp, Artificial Sequence
  Synthetic
caagaaagggcacuggcauc

SEQ ID NO: 81261 - DNA, 22 bp, Artificial Sequence
  Synthetic
gtgcuaggcagcaaaggtatuc

SEQ ID NO: 81262 - DNA, 21 bp, Artificial Sequence
  Synthetic
acucatuggagagccccagat

SEQ ID NO: 81263 - DNA, 22 bp, Artificial Sequence
  Synthetic
caagatccugtgcagguaccag

SEQ ID NO: 81264 - DNA, 23 bp, Artificial Sequence
  Synthetic
ggataaatccauaggtgcugcca

SEQ ID NO: 81265 - DNA, 21 bp, Artificial Sequence
  Synthetic
tgggaguctcugggacaaaga

SEQ ID NO: 81266 - DNA, 20 bp, Artificial Sequence
  Synthetic
aggacgtauggagccaguct

SEQ ID NO: 81267 - DNA, 21 bp, Artificial Sequence
  Synthetic
cggcggugtttttaucaacgg

SEQ ID NO: 81268 - DNA, 21 bp, Artificial Sequence
  Synthetic
ccatcccuccaaauccccaac

SEQ ID NO: 81269 - DNA, 26 bp, Artificial Sequence
  Synthetic
gaatauaaacgccaaaaucccaccat

SEQ ID NO: 81270 - DNA, 21 bp, Artificial Sequence
  Synthetic
gccuaggagcaguaagggagt

SEQ ID NO: 81271 - DNA, 22 bp, Artificial Sequence
  Synthetic
aggacutgcagauggacaaagg

SEQ ID NO: 81272 - DNA, 18 bp, Artificial Sequence
  Synthetic
tgctgcuccgaagcucat

SEQ ID NO: 81273 - DNA, 25 bp, Artificial Sequence
  Synthetic
ttcuatgcctcacucacaaaggaag

SEQ ID NO: 81274 - DNA, 23 bp, Artificial Sequence
  Synthetic
cttgttgaucagaaaggguccca

SEQ ID NO: 81275 - DNA, 23 bp, Artificial Sequence
  Synthetic
gttactccucacatcaccccaut

SEQ ID NO: 81276 - DNA, 20 bp, Artificial Sequence
  Synthetic
atcttguggcggatgtggut

SEQ ID NO: 81277 - DNA, 22 bp, Artificial Sequence
  Synthetic
gcgaaattacgugctgctgtuc

SEQ ID NO: 81278 - DNA, 21 bp, Artificial Sequence
  Synthetic
cctacugacaaaccccaugcc

SEQ ID NO: 81279 - DNA, 25 bp, Artificial Sequence
  Synthetic
gatccaucaccaaagcagctctaut

SEQ ID NO: 81280 - DNA, 20 bp, Artificial Sequence
  Synthetic
tcccugatcucccaggcaaa

SEQ ID NO: 81281 - DNA, 22 bp, Artificial Sequence
  Synthetic
ggttcctcauggctaagctuct

SEQ ID NO: 81282 - DNA, 28 bp, Artificial Sequence
  Synthetic
gcagagatatgugcttgtttaaagucaa

SEQ ID NO: 81283 - DNA, 32 bp, Artificial Sequence
  Synthetic
tttccatgtgtatautagctacagaagucaag

SEQ ID NO: 81284 - DNA, 22 bp, Artificial Sequence
  Synthetic
gggcgaagguaatgaaugaaga

SEQ ID NO: 81285 - DNA, 17 bp, Artificial Sequence
  Synthetic
cggcgcgcucgatcuac

SEQ ID NO: 81286 - DNA, 22 bp, Artificial Sequence
  Synthetic
ccacttgctuaggacctctcut

SEQ ID NO: 81287 - DNA, 22 bp, Artificial Sequence
  Synthetic
tcagagtagcuggagaagcugt

SEQ ID NO: 81288 - DNA, 18 bp, Artificial Sequence
  Synthetic
accagcuctgccuacgga

SEQ ID NO: 81289 - DNA, 19 bp, Artificial Sequence
  Synthetic
gctgggcugagaccaccua

SEQ ID NO: 81290 - DNA, 28 bp, Artificial Sequence
  Synthetic
agcacctgagcutataaaacaaatcuct

SEQ ID NO: 81291 - DNA, 28 bp, Artificial Sequence
  Synthetic
ggaaatgatacguttgtaacactcgaug

SEQ ID NO: 81292 - DNA, 23 bp, Artificial Sequence
  Synthetic
ggaagacaagacguggagaggua

SEQ ID NO: 81293 - DNA, 23 bp, Artificial Sequence
  Synthetic
atttggaggauctggugcaagag

SEQ ID NO: 81294 - DNA, 26 bp, Artificial Sequence
  Synthetic
acaaaccacacucacttcatttucct

SEQ ID NO: 81295 - DNA, 32 bp, Artificial Sequence
  Synthetic
aaaatattagtugcaacagatattcatctugg

SEQ ID NO: 81296 - DNA, 24 bp, Artificial Sequence
  Synthetic
tgaagctctgccuaaaagtcccua

SEQ ID NO: 81297 - DNA, 23 bp, Artificial Sequence
  Synthetic
ctggaggaauccatctgcaucaa

SEQ ID NO: 81298 - DNA, 28 bp, Artificial Sequence
  Synthetic
aaagtagaagcaauctgatgaacuccaa

SEQ ID NO: 81299 - DNA, 22 bp, Artificial Sequence
  Synthetic
cctgtacgaaguggacactcuc

SEQ ID NO: 81300 - DNA, 22 bp, Artificial Sequence
  Synthetic
cacacattctcuccctgctcuc

SEQ ID NO: 81301 - DNA, 23 bp, Artificial Sequence
  Synthetic
acaatgggcagugtgtggauaaa

SEQ ID NO: 81302 - DNA, 21 bp, Artificial Sequence
  Synthetic
cctuccacgagcaguagaggt

SEQ ID NO: 81303 - DNA, 22 bp, Artificial Sequence
  Synthetic
ctctcttcatgucctggtggut

SEQ ID NO: 81304 - DNA, 23 bp, Artificial Sequence
  Synthetic
gctgagtgaaugggaaggaaguc

SEQ ID NO: 81305 - DNA, 25 bp, Artificial Sequence
  Synthetic
agatcaatgaaugcagctctcaucc

SEQ ID NO: 81306 - DNA, 24 bp, Artificial Sequence
  Synthetic
agcauagtgcttcucagcaaaaga

SEQ ID NO: 81307 - DNA, 20 bp, Artificial Sequence
  Synthetic
gugacacaggacacccucag

SEQ ID NO: 81308 - DNA, 26 bp, Artificial Sequence
  Synthetic
ctgtggaccagaauactcagucaaaa

SEQ ID NO: 81309 - DNA, 22 bp, Artificial Sequence
  Synthetic
acttgacuccaacactggcauc

SEQ ID NO: 81310 - DNA, 18 bp, Artificial Sequence
  Synthetic
gtgctctcugggctcugg

SEQ ID NO: 81311 - DNA, 19 bp, Artificial Sequence
  Synthetic
ccacagcuttgcccaugaa

SEQ ID NO: 81312 - DNA, 24 bp, Artificial Sequence
  Synthetic
gtgaacgttgutggactctacugt

SEQ ID NO: 81313 - DNA, 22 bp, Artificial Sequence
  Synthetic
acccuccagcgaatttcauacc

SEQ ID NO: 81314 - DNA, 23 bp, Artificial Sequence
  Synthetic
gggaagugagaggaaaacgagug

SEQ ID NO: 81315 - DNA, 21 bp, Artificial Sequence
  Synthetic
attgaccuggactcgctgaug

SEQ ID NO: 81316 - DNA, 21 bp, Artificial Sequence
  Synthetic
caggcacuggaaacgatugac

SEQ ID NO: 81317 - DNA, 26 bp, Artificial Sequence
  Synthetic
cacctttctctcuctttaagccacut

SEQ ID NO: 81318 - DNA, 21 bp, Artificial Sequence
  Synthetic
cacaccacaggcugaugagaa

SEQ ID NO: 81319 - DNA, 23 bp, Artificial Sequence
  Synthetic
gcttucccagatgtcugaagagg

SEQ ID NO: 81320 - DNA, 21 bp, Artificial Sequence
  Synthetic
cacgtuccctcatucaggcat

SEQ ID NO: 81321 - DNA, 26 bp, Artificial Sequence
  Synthetic
ctgatgttgcuctgtttgcttctuag

SEQ ID NO: 81322 - DNA, 21 bp, Artificial Sequence
  Synthetic
ggactgcauggtaatcugcgt

SEQ ID NO: 81323 - DNA, 23 bp, Artificial Sequence
  Synthetic
caacatgttucccctccttucag

SEQ ID NO: 81324 - DNA, 19 bp, Artificial Sequence
  Synthetic
ccttgucagcgggcatgua

SEQ ID NO: 81325 - DNA, 20 bp, Artificial Sequence
  Synthetic
ggtggcaagaagggugagug

SEQ ID NO: 81326 - DNA, 26 bp, Artificial Sequence
  Synthetic
tcaatugtagttctctugccagcaat

SEQ ID NO: 81327 - DNA, 25 bp, Artificial Sequence
  Synthetic
gcaaagccucattccttttgtucag

SEQ ID NO: 81328 - DNA, 22 bp, Artificial Sequence
  Synthetic
cttcacacacggagucacuagg

SEQ ID NO: 81329 - DNA, 27 bp, Artificial Sequence
  Synthetic
tttttgcgcttguaatgtcaatagcut

SEQ ID NO: 81330 - DNA, 18 bp, Artificial Sequence
  Synthetic
gctcgcugtcgccatuct

SEQ ID NO: 81331 - DNA, 20 bp, Artificial Sequence
  Synthetic
gagauccacccccuggagat

SEQ ID NO: 81332 - DNA, 28 bp, Artificial Sequence
  Synthetic
tggagaagttagacaugtcaacctttug

SEQ ID NO: 81333 - DNA, 28 bp, Artificial Sequence
  Synthetic
atttacctgggcuacttcatctcuagaa

SEQ ID NO: 81334 - DNA, 21 bp, Artificial Sequence
  Synthetic
gtttgcacagugccttucaga

SEQ ID NO: 81335 - DNA, 26 bp, Artificial Sequence
  Synthetic
tgtttcagcucattgtgatuaaccct

SEQ ID NO: 81336 - DNA, 26 bp, Artificial Sequence
  Synthetic
ctgtccuggtcatttauagaaaccga

SEQ ID NO: 81337 - DNA, 23 bp, Artificial Sequence
  Synthetic
ggaggtuaccccatggaactuac

SEQ ID NO: 81338 - DNA, 28 bp, Artificial Sequence
  Synthetic
ccaaattgctuctgtctgttaaauggaa

SEQ ID NO: 81339 - DNA, 31 bp, Artificial Sequence
  Synthetic
tggactttcugagagaaaacaatttaaguga

SEQ ID NO: 81340 - DNA, 18 bp, Artificial Sequence
  Synthetic
gctggauctgcgccugaa

SEQ ID NO: 81341 - DNA, 25 bp, Artificial Sequence
  Synthetic
gcatcatgtcuaactctaccucgac

SEQ ID NO: 81342 - DNA, 17 bp, Artificial Sequence
  Synthetic
ccgccguagctgucagg

SEQ ID NO: 81343 - DNA, 19 bp, Artificial Sequence
  Synthetic
caacccccaggcacuagut

SEQ ID NO: 81344 - DNA, 28 bp, Artificial Sequence
  Synthetic
acagcaccaaauaatacagagcagtuat

SEQ ID NO: 81345 - DNA, 23 bp, Artificial Sequence
  Synthetic
accacaatctuctgcccatctuc

SEQ ID NO: 81346 - DNA, 21 bp, Artificial Sequence
  Synthetic
cuacacccaccccaaaguaga

SEQ ID NO: 81347 - DNA, 20 bp, Artificial Sequence
  Synthetic
gtcctcaugccaacccctut

SEQ ID NO: 81348 - DNA, 21 bp, Artificial Sequence
  Synthetic
gcattggaaccagugcagtut

SEQ ID NO: 81349 - DNA, 27 bp, Artificial Sequence
  Synthetic
tttccctctuagagcgtacaactttut

SEQ ID NO: 81350 - DNA, 20 bp, Artificial Sequence
  Synthetic
ctacccuacgccaagcauga

SEQ ID NO: 81351 - DNA, 22 bp, Artificial Sequence
  Synthetic
ccagagaguatcccagcuggag

SEQ ID NO: 81352 - DNA, 19 bp, Artificial Sequence
  Synthetic
ccacgcugagagtcgtcut

SEQ ID NO: 81353 - DNA, 28 bp, Artificial Sequence
  Synthetic
cctgacatactcutgacagtctattugg

SEQ ID NO: 81354 - DNA, 28 bp, Artificial Sequence
  Synthetic
gacctttgaacuctttgttttcatguct

SEQ ID NO: 81355 - DNA, 27 bp, Artificial Sequence
  Synthetic
tgataaatcugaggaacatggcactuc

SEQ ID NO: 81356 - DNA, 23 bp, Artificial Sequence
  Synthetic
agccagctuctcttctaguccat

SEQ ID NO: 81357 - DNA, 22 bp, Artificial Sequence
  Synthetic
gggtctucacctcatagtgucc

SEQ ID NO: 81358 - DNA, 21 bp, Artificial Sequence
  Synthetic
cagaacagcaucggtgcagua

SEQ ID NO: 81359 - DNA, 25 bp, Artificial Sequence
  Synthetic
ctttgacattaacutcaagccccut

SEQ ID NO: 81360 - DNA, 24 bp, Artificial Sequence
  Synthetic
aaaaagccaccaccuagaaucgaa

SEQ ID NO: 81361 - DNA, 28 bp, Artificial Sequence
  Synthetic
caaaagcacauaactgaaaaccauaggg

SEQ ID NO: 81362 - DNA, 23 bp, Artificial Sequence
  Synthetic
ctgaagcccuggagaguagaaag

SEQ ID NO: 81363 - DNA, 27 bp, Artificial Sequence
  Synthetic
ccctctcagutacaagtgattatucgt

SEQ ID NO: 81364 - DNA, 22 bp, Artificial Sequence
  Synthetic
cctcagcacutggctcaaacut

SEQ ID NO: 81365 - DNA, 27 bp, Artificial Sequence
  Synthetic
tgtaatgtccatutcaggatccatucc

SEQ ID NO: 81366 - DNA, 22 bp, Artificial Sequence
  Synthetic
catccaggtugatctcgcagut

SEQ ID NO: 81367 - DNA, 19 bp, Artificial Sequence
  Synthetic
gcgacaacgccuacctcug

SEQ ID NO: 81368 - DNA, 19 bp, Artificial Sequence
  Synthetic
tggucccctucaggcagaa

SEQ ID NO: 81369 - DNA, 18 bp, Artificial Sequence
  Synthetic
ccacctucacctgccuct

SEQ ID NO: 81370 - DNA, 17 bp, Artificial Sequence
  Synthetic
cagtgguggcccgtgua

SEQ ID NO: 81371 - DNA, 20 bp, Artificial Sequence
  Synthetic
ccgccagucctaagtctucc

SEQ ID NO: 81372 - DNA, 23 bp, Artificial Sequence
  Synthetic
gtctgaagcugagguagagaagg

SEQ ID NO: 81373 - DNA, 24 bp, Artificial Sequence
  Synthetic
acctttgcuggaaaagaagaucca

SEQ ID NO: 81374 - DNA, 22 bp, Artificial Sequence
  Synthetic
cctctuggccacgttcatguag

SEQ ID NO: 81375 - DNA, 22 bp, Artificial Sequence
  Synthetic
cgcaatucgagtatcccaucca

SEQ ID NO: 81376 - DNA, 29 bp, Artificial Sequence
  Synthetic
catactcaguagacaacataaagccucat

SEQ ID NO: 81377 - DNA, 26 bp, Artificial Sequence
  Synthetic
gaagtcccagcutggtagaaaauact

SEQ ID NO: 81378 - DNA, 28 bp, Artificial Sequence
  Synthetic
aggcaucaggtacaugaaaaagaagaat

SEQ ID NO: 81379 - DNA, 27 bp, Artificial Sequence
  Synthetic
catagtatttcutacctccgugcaaca

SEQ ID NO: 81380 - DNA, 18 bp, Artificial Sequence
  Synthetic
gtgcatgcuccggttcuc

SEQ ID NO: 81381 - DNA, 18 bp, Artificial Sequence
  Synthetic
ccacccgggcutctaguc

SEQ ID NO: 81382 - DNA, 20 bp, Artificial Sequence
  Synthetic
ctctcagctuccagggtcut

SEQ ID NO: 81383 - DNA, 29 bp, Artificial Sequence
  Synthetic
cgggtatatggaaagucagaaaacatcut

SEQ ID NO: 81384 - DNA, 22 bp, Artificial Sequence
  Synthetic
gacttccaaagcugggaaucct

SEQ ID NO: 81385 - DNA, 28 bp, Artificial Sequence
  Synthetic
ggaaaaaccaaacutgccatctctcuat

SEQ ID NO: 81386 - DNA, 19 bp, Artificial Sequence
  Synthetic
ggcgggcacgaautttguc

SEQ ID NO: 81387 - DNA, 18 bp, Artificial Sequence
  Synthetic
gggtcuggagcccucagt

SEQ ID NO: 81388 - DNA, 24 bp, Artificial Sequence
  Synthetic
cttgcccaaaguaccaggtaatug

SEQ ID NO: 81389 - DNA, 24 bp, Artificial Sequence
  Synthetic
ccaagaagtutctcagttgugcct

SEQ ID NO: 81390 - DNA, 19 bp, Artificial Sequence
  Synthetic
gcatuaacgggtgccugga

SEQ ID NO: 81391 - DNA, 21 bp, Artificial Sequence
  Synthetic
catggugggcttguccaaaat

SEQ ID NO: 81392 - DNA, 19 bp, Artificial Sequence
  Synthetic
tttcuggccccacugaacc

SEQ ID NO: 81393 - DNA, 17 bp, Artificial Sequence
  Synthetic
ggcatggugggcttguc

SEQ ID NO: 81394 - DNA, 19 bp, Artificial Sequence
  Synthetic
ccuggccccagaggacaua

SEQ ID NO: 81395 - DNA, 25 bp, Artificial Sequence
  Synthetic
gtgtcccatcucttgggtatcaaug

SEQ ID NO: 81396 - DNA, 25 bp, Artificial Sequence
  Synthetic
ctcggcaaauttagcttcuagcaac

SEQ ID NO: 81397 - DNA, 23 bp, Artificial Sequence
  Synthetic
gaacactgctutccggcttatuc

SEQ ID NO: 81398 - DNA, 18 bp, Artificial Sequence
  Synthetic
ggctgggcgugcatttug

SEQ ID NO: 81399 - DNA, 17 bp, Artificial Sequence
  Synthetic
tcgcccuctgacuccga

SEQ ID NO: 81400 - DNA, 23 bp, Artificial Sequence
  Synthetic
gattcctcuggtgaaatcgguca

SEQ ID NO: 81401 - DNA, 21 bp, Artificial Sequence
  Synthetic
cctctcugctcccaagucaag

SEQ ID NO: 81402 - DNA, 20 bp, Artificial Sequence
  Synthetic
aggcatgaguggtcgaggua

SEQ ID NO: 81403 - DNA, 23 bp, Artificial Sequence
  Synthetic
catctucaacagcctcuacacca

SEQ ID NO: 81404 - DNA, 26 bp, Artificial Sequence
  Synthetic
acttgtgcccaguttctaaatcauct

SEQ ID NO: 81405 - DNA, 17 bp, Artificial Sequence
  Synthetic
gccaagguccccctuct

SEQ ID NO: 81406 - DNA, 27 bp, Artificial Sequence
  Synthetic
ccttcagatcttugatgtcctttcgua

SEQ ID NO: 81407 - DNA, 18 bp, Artificial Sequence
  Synthetic
cugtgctcugagcaggga

SEQ ID NO: 81408 - DNA, 23 bp, Artificial Sequence
  Synthetic
cccuggatttaugcccaagaagg

SEQ ID NO: 81409 - DNA, 25 bp, Artificial Sequence
  Synthetic
actgcugacacacacactaattuct

SEQ ID NO: 81410 - DNA, 22 bp, Artificial Sequence
  Synthetic
ctcacgctuccccaaatttcut

SEQ ID NO: 81411 - DNA, 28 bp, Artificial Sequence
  Synthetic
gcgattctccaauatactgaaactccuc

SEQ ID NO: 81412 - DNA, 21 bp, Artificial Sequence
  Synthetic
gccaaacugtcccccaugaaa

SEQ ID NO: 81413 - DNA, 22 bp, Artificial Sequence
  Synthetic
ccccaccacacccuatcacuat

SEQ ID NO: 81414 - DNA, 22 bp, Artificial Sequence
  Synthetic
cuccaggacactcuggaacaac

SEQ ID NO: 81415 - DNA, 27 bp, Artificial Sequence
  Synthetic
gaaaaggaagcuctgagtgaggaatua

SEQ ID NO: 81416 - DNA, 22 bp, Artificial Sequence
  Synthetic
tgaagaucucccagagcaggat

SEQ ID NO: 81417 - DNA, 21 bp, Artificial Sequence
  Synthetic
ctgaggtccutccttgcacuc

SEQ ID NO: 81418 - DNA, 24 bp, Artificial Sequence
  Synthetic
gctaaacagaaagcccuggaacut

SEQ ID NO: 81419 - DNA, 29 bp, Artificial Sequence
  Synthetic
actatgaaaacaaacugacaaacctcuct

SEQ ID NO: 81420 - DNA, 29 bp, Artificial Sequence
  Synthetic
acttctactacctuatcgacacagctaut

SEQ ID NO: 81421 - DNA, 28 bp, Artificial Sequence
  Synthetic
ggagggctcauttgtttatctctuacag

SEQ ID NO: 81422 - DNA, 22 bp, Artificial Sequence
  Synthetic
cagaggacugacttctcuccct

SEQ ID NO: 81423 - DNA, 18 bp, Artificial Sequence
  Synthetic
tcagccgggaugcgatug

SEQ ID NO: 81424 - DNA, 28 bp, Artificial Sequence
  Synthetic
ccatacacaaguaatcactcacucaagt

SEQ ID NO: 81425 - DNA, 28 bp, Artificial Sequence
  Synthetic
aaaacattacataccugcctcgagtuat

SEQ ID NO: 81426 - DNA, 28 bp, Artificial Sequence
  Synthetic
ggccgatcacccauacaatattttctua

SEQ ID NO: 81427 - DNA, 24 bp, Artificial Sequence
  Synthetic
cacctttttcugttgatcaggugg

SEQ ID NO: 81428 - DNA, 28 bp, Artificial Sequence
  Synthetic
agtactagcauccttacagtcttcuaaa

SEQ ID NO: 81429 - DNA, 24 bp, Artificial Sequence
  Synthetic
gaaagaccagutcttccctcauca

SEQ ID NO: 81430 - DNA, 27 bp, Artificial Sequence
  Synthetic
tgaatatcugcaacaagcaagtcauct

SEQ ID NO: 81431 - DNA, 28 bp, Artificial Sequence
  Synthetic
agtgaagaaacgucttttcatgaugagt

SEQ ID NO: 81432 - DNA, 21 bp, Artificial Sequence
  Synthetic
ccccaaccutaagugcaccag

SEQ ID NO: 81433 - DNA, 22 bp, Artificial Sequence
  Synthetic
ttccctcucaccccagttttug

SEQ ID NO: 81434 - DNA, 20 bp, Artificial Sequence
  Synthetic
gtgccccagguagcttcaut

SEQ ID NO: 81435 - DNA, 22 bp, Artificial Sequence
  Synthetic
gtgagaggcutgacucaggaac

SEQ ID NO: 81436 - DNA, 26 bp, Artificial Sequence
  Synthetic
agatcctggcgaguagtaaaacttuc

SEQ ID NO: 81437 - DNA, 27 bp, Artificial Sequence
  Synthetic
gctgtcataaauacacttgggtttgut

SEQ ID NO: 81438 - DNA, 28 bp, Artificial Sequence
  Synthetic
tgggtuagaagaagaaaagugaaaagca

SEQ ID NO: 81439 - DNA, 24 bp, Artificial Sequence
  Synthetic
cctgcctuccaaagcagatactuc

SEQ ID NO: 81440 - DNA, 27 bp, Artificial Sequence
  Synthetic
ctatttcttctcggucatcctgaagug

SEQ ID NO: 81441 - DNA, 25 bp, Artificial Sequence
  Synthetic
cctattccucaaaccccagaaagug

SEQ ID NO: 81442 - DNA, 21 bp, Artificial Sequence
  Synthetic
ggaagccuggtcaggtaugag

SEQ ID NO: 81443 - DNA, 18 bp, Artificial Sequence
  Synthetic
ccctgugtggaggugcag

SEQ ID NO: 81444 - DNA, 25 bp, Artificial Sequence
  Synthetic
gagtcugggagaacagatttctuga

SEQ ID NO: 81445 - DNA, 27 bp, Artificial Sequence
  Synthetic
cttttgattcugggaagcacattcaut

SEQ ID NO: 81446 - DNA, 18 bp, Artificial Sequence
  Synthetic
ctgcacgutgcggttgut

SEQ ID NO: 81447 - DNA, 21 bp, Artificial Sequence
  Synthetic
ggttcccugaccattgcugag

SEQ ID NO: 81448 - DNA, 19 bp, Artificial Sequence
  Synthetic
tcttgcacucggcgaucat

SEQ ID NO: 81449 - DNA, 20 bp, Artificial Sequence
  Synthetic
gggtugaagggcgugagaaa

SEQ ID NO: 81450 - DNA, 21 bp, Artificial Sequence
  Synthetic
gctcctggugaaactgctcua

SEQ ID NO: 81451 - DNA, 23 bp, Artificial Sequence
  Synthetic
gcaacaugagatggagcucaagg

SEQ ID NO: 81452 - DNA, 19 bp, Artificial Sequence
  Synthetic
cacaaguccctggcaguca

SEQ ID NO: 81453 - DNA, 20 bp, Artificial Sequence
  Synthetic
tcccctccucagactccauc

SEQ ID NO: 81454 - DNA, 25 bp, Artificial Sequence
  Synthetic
gttgctgtugctgtgtttattucca

SEQ ID NO: 81455 - DNA, 27 bp, Artificial Sequence
  Synthetic
tcctttgcagauttagtttccuaagca

SEQ ID NO: 81456 - DNA, 21 bp, Artificial Sequence
  Synthetic
gcttgagccugtgtcagtcua

SEQ ID NO: 81457 - DNA, 22 bp, Artificial Sequence
  Synthetic
gcucaaggaggcacatcaugag

SEQ ID NO: 81458 - DNA, 28 bp, Artificial Sequence
  Synthetic
actggaacagtguttctgtctttttgua

SEQ ID NO: 81459 - DNA, 27 bp, Artificial Sequence
  Synthetic
gttcattacugaccctgauggagaaaa

SEQ ID NO: 81460 - DNA, 19 bp, Artificial Sequence
  Synthetic
gccccaggaaggucaucaa

SEQ ID NO: 81461 - DNA, 20 bp, Artificial Sequence
  Synthetic
ctgtugggcaggaagaccuc

SEQ ID NO: 81462 - DNA, 22 bp, Artificial Sequence
  Synthetic
gcagtucagcaagcctttcuca

SEQ ID NO: 81463 - DNA, 28 bp, Artificial Sequence
  Synthetic
ggtaagaactcugggttcatacacatut

SEQ ID NO: 81464 - DNA, 25 bp, Artificial Sequence
  Synthetic
tcaagcttcacutgcagttgtttut

SEQ ID NO: 81465 - DNA, 24 bp, Artificial Sequence
  Synthetic
agaacaugaagcaaaggcaugaga

SEQ ID NO: 81466 - DNA, 20 bp, Artificial Sequence
  Synthetic
ggagccccgucauaggaagt

SEQ ID NO: 81467 - DNA, 20 bp, Artificial Sequence
  Synthetic
tggcttugggctttcuggat

SEQ ID NO: 81468 - DNA, 25 bp, Artificial Sequence
  Synthetic
cgctttctaaaaugtcagttgucca

SEQ ID NO: 81469 - DNA, 24 bp, Artificial Sequence
  Synthetic
ccgcacctcuacaacaaaatgtut

SEQ ID NO: 81470 - DNA, 20 bp, Artificial Sequence
  Synthetic
ctactcucccaccuccacct

SEQ ID NO: 81471 - DNA, 18 bp, Artificial Sequence
  Synthetic
ggctcagcugccttcuca

SEQ ID NO: 81472 - DNA, 18 bp, Artificial Sequence
  Synthetic
gctgccugctguggagac

SEQ ID NO: 81473 - DNA, 22 bp, Artificial Sequence
  Synthetic
gctcacccugtgatttgtugct

SEQ ID NO: 81474 - DNA, 24 bp, Artificial Sequence
  Synthetic
gtttttctaaggugtgcgttucgt

SEQ ID NO: 81475 - DNA, 22 bp, Artificial Sequence
  Synthetic
atcttgtgguggtgtcactcug

SEQ ID NO: 81476 - DNA, 28 bp, Artificial Sequence
  Synthetic
cctttgctggaautaatatggtgttcuc

SEQ ID NO: 81477 - DNA, 25 bp, Artificial Sequence
  Synthetic
tgaaacacacugcagtcagaacaua

SEQ ID NO: 81478 - DNA, 23 bp, Artificial Sequence
  Synthetic
tutatgacuggacagggcaaaca

SEQ ID NO: 81479 - DNA, 19 bp, Artificial Sequence
  Synthetic
tccguaggacaccaucgct

SEQ ID NO: 81480 - DNA, 17 bp, Artificial Sequence
  Synthetic
cctgcgugcaacuccga

SEQ ID NO: 81481 - DNA, 24 bp, Artificial Sequence
  Synthetic
tgagcaugaacacccacttuaagg

SEQ ID NO: 81482 - DNA, 21 bp, Artificial Sequence
  Synthetic
gctgtcaaccugcatgaaguc

SEQ ID NO: 81483 - DNA, 27 bp, Artificial Sequence
  Synthetic
gcatactugggcagagagtttcttuac

SEQ ID NO: 81484 - DNA, 21 bp, Artificial Sequence
  Synthetic
cgctcauagcaggauccacag

SEQ ID NO: 81485 - DNA, 23 bp, Artificial Sequence
  Synthetic
aagtatguttgggcuggaccaat

SEQ ID NO: 81486 - DNA, 33 bp, Artificial Sequence
  Synthetic
gaatgccttctcttutgtctatatctgataaut

SEQ ID NO: 81487 - DNA, 27 bp, Artificial Sequence
  Synthetic
ctctccttgccaucattacttcaacua

SEQ ID NO: 81488 - DNA, 19 bp, Artificial Sequence
  Synthetic
ggcuctgcccucgacaaag

SEQ ID NO: 81489 - DNA, 23 bp, Artificial Sequence
  Synthetic
tgagactgaccuctcttctccug

SEQ ID NO: 81490 - DNA, 19 bp, Artificial Sequence
  Synthetic
cugcaagggugaccacact

SEQ ID NO: 81491 - DNA, 21 bp, Artificial Sequence
  Synthetic
gcugaaaaagcuggaggagga

SEQ ID NO: 81492 - DNA, 23 bp, Artificial Sequence
  Synthetic
tccggtcucgttaaagttccuct

SEQ ID NO: 81493 - DNA, 19 bp, Artificial Sequence
  Synthetic
tcctgggcuggaacgagua

SEQ ID NO: 81494 - DNA, 26 bp, Artificial Sequence
  Synthetic
agutgaagtaatgauggcaaggagag

SEQ ID NO: 81495 - DNA, 28 bp, Artificial Sequence
  Synthetic
ctcctttctaccaauaaccgcatatcua

SEQ ID NO: 81496 - DNA, 22 bp, Artificial Sequence
  Synthetic
ttctggtccuccaggatgauct

SEQ ID NO: 81497 - DNA, 21 bp, Artificial Sequence
  Synthetic
tgctgtccutaccgtgtcuct

SEQ ID NO: 81498 - DNA, 22 bp, Artificial Sequence
  Synthetic
tctaacacauccacctccugct

SEQ ID NO: 81499 - DNA, 24 bp, Artificial Sequence
  Synthetic
agggagcatugttttcaccttuca

SEQ ID NO: 81500 - DNA, 22 bp, Artificial Sequence
  Synthetic
atttcacuccatcccacugaga

SEQ ID NO: 81501 - DNA, 20 bp, Artificial Sequence
  Synthetic
gguggaggaagcugacaaca

SEQ ID NO: 81502 - DNA, 24 bp, Artificial Sequence
  Synthetic
gagaacaccuagaagacagugcat

SEQ ID NO: 81503 - DNA, 20 bp, Artificial Sequence
  Synthetic
caccggcacucagctauacc

SEQ ID NO: 81504 - DNA, 26 bp, Artificial Sequence
  Synthetic
gcaaatgtttugtggtatagcugagt

SEQ ID NO: 81505 - DNA, 28 bp, Artificial Sequence
  Synthetic
cagcttgtatgucaatggatactctuga

SEQ ID NO: 81506 - DNA, 26 bp, Artificial Sequence
  Synthetic
cttcagaguttgtgcttttucaccat

SEQ ID NO: 81507 - DNA, 26 bp, Artificial Sequence
  Synthetic
ggtgaattagcaucctgcagtuaaag

SEQ ID NO: 81508 - DNA, 24 bp, Artificial Sequence
  Synthetic
agccctactuccttagcactguat

SEQ ID NO: 81509 - DNA, 24 bp, Artificial Sequence
  Synthetic
catccagatugatacctggcuaca

SEQ ID NO: 81510 - DNA, 24 bp, Artificial Sequence
  Synthetic
caagctggcuaaagctccttctua

SEQ ID NO: 81511 - DNA, 19 bp, Artificial Sequence
  Synthetic
ccagcacgucacgttctuc

SEQ ID NO: 81512 - DNA, 22 bp, Artificial Sequence
  Synthetic
agtgcaaagaugccctugagag

SEQ ID NO: 81513 - DNA, 20 bp, Artificial Sequence
  Synthetic
cctggacucgggtcguaaga

SEQ ID NO: 81514 - DNA, 28 bp, Artificial Sequence
  Synthetic
aaatccttcctcaugtcctgaaaguaac

SEQ ID NO: 81515 - DNA, 19 bp, Artificial Sequence
  Synthetic
tuggaacaccauccgccaa

SEQ ID NO: 81516 - DNA, 29 bp, Artificial Sequence
  Synthetic
agtaaatctttugctcatgtgcatuaacc

SEQ ID NO: 81517 - DNA, 21 bp, Artificial Sequence
  Synthetic
gcgugcagcagttatttucca

SEQ ID NO: 81518 - DNA, 23 bp, Artificial Sequence
  Synthetic
gcaacacgacgaaauagccauac

SEQ ID NO: 81519 - DNA, 23 bp, Artificial Sequence
  Synthetic
gattttggcugtgacacagugaa

SEQ ID NO: 81520 - DNA, 22 bp, Artificial Sequence
  Synthetic
tgatgttgaugatctgcguggt

SEQ ID NO: 81521 - DNA, 23 bp, Artificial Sequence
  Synthetic
ccaagguagaatcccuggagagt

SEQ ID NO: 81522 - DNA, 23 bp, Artificial Sequence
  Synthetic
cacaatgcuactatgccctugga

SEQ ID NO: 81523 - DNA, 19 bp, Artificial Sequence
  Synthetic
gcatgcugtccactuagcc

SEQ ID NO: 81524 - DNA, 22 bp, Artificial Sequence
  Synthetic
atgtcaccagugaccucaacag

SEQ ID NO: 81525 - DNA, 24 bp, Artificial Sequence
  Synthetic
tgagggaagaagagaugaguaggg

SEQ ID NO: 81526 - DNA, 21 bp, Artificial Sequence
  Synthetic
ccttauggcgcacaggtagug

SEQ ID NO: 81527 - DNA, 21 bp, Artificial Sequence
  Synthetic
cgaaggtuggaactcgacuga

SEQ ID NO: 81528 - DNA, 22 bp, Artificial Sequence
  Synthetic
gcaactagcuggcagtctcuat

SEQ ID NO: 81529 - DNA, 23 bp, Artificial Sequence
  Synthetic
tccagcaaaaucatgucccagag

SEQ ID NO: 81530 - DNA, 24 bp, Artificial Sequence
  Synthetic
cagcgttaugaagtaatgcagugt

SEQ ID NO: 81531 - DNA, 28 bp, Artificial Sequence
  Synthetic
cctctctuttccttaaagucacagaaga

SEQ ID NO: 81532 - DNA, 27 bp, Artificial Sequence
  Synthetic
tcaaaatcaaccccuttcgatactuga

SEQ ID NO: 81533 - DNA, 27 bp, Artificial Sequence
  Synthetic
cagaaaggcacacutgatgaattaugt

SEQ ID NO: 81534 - DNA, 23 bp, Artificial Sequence
  Synthetic
ctgcaaaacacggugaatgacut

SEQ ID NO: 81535 - DNA, 27 bp, Artificial Sequence
  Synthetic
ggccaatctgacaugtctgatacttua

SEQ ID NO: 81536 - DNA, 26 bp, Artificial Sequence
  Synthetic
gagcccagtuttcattgaaatcaugt

SEQ ID NO: 81537 - DNA, 25 bp, Artificial Sequence
  Synthetic
agcagcuacaagaagaatugcagaa

SEQ ID NO: 81538 - DNA, 22 bp, Artificial Sequence
  Synthetic
cagggaugggagtgaaguagag

SEQ ID NO: 81539 - DNA, 24 bp, Artificial Sequence
  Synthetic
cctcagcagguttcctttccauag

SEQ ID NO: 81540 - DNA, 24 bp, Artificial Sequence
  Synthetic
cacctguaaccaagtatccucacc

SEQ ID NO: 81541 - DNA, 23 bp, Artificial Sequence
  Synthetic
gcaggcaaaaacugggaaacuaa

SEQ ID NO: 81542 - DNA, 26 bp, Artificial Sequence
  Synthetic
cacccttaccucctgaagatttucat

SEQ ID NO: 81543 - DNA, 25 bp, Artificial Sequence
  Synthetic
ctcactttgcutctcttttgacugg

SEQ ID NO: 81544 - DNA, 21 bp, Artificial Sequence
  Synthetic
gtcactctccuccccatcuga

SEQ ID NO: 81545 - DNA, 23 bp, Artificial Sequence
  Synthetic
aatttgucaaaaacctgcugcca

SEQ ID NO: 81546 - DNA, 22 bp, Artificial Sequence
  Synthetic
cctcaataggugccatcagugt

SEQ ID NO: 81547 - DNA, 20 bp, Artificial Sequence
  Synthetic
ggatctgaccucggtgcuct

SEQ ID NO: 81548 - DNA, 28 bp, Artificial Sequence
  Synthetic
ggttttctggauaattttcccattguga

SEQ ID NO: 81549 - DNA, 19 bp, Artificial Sequence
  Synthetic
agugcccaacatcaugggt

SEQ ID NO: 81550 - DNA, 21 bp, Artificial Sequence
  Synthetic
ccgaaagaccuatcccacugt

SEQ ID NO: 81551 - DNA, 20 bp, Artificial Sequence
  Synthetic
ccagguccacctcgatctug

SEQ ID NO: 81552 - DNA, 28 bp, Artificial Sequence
  Synthetic
gagggtucactaaatgtttuaacagcaa

SEQ ID NO: 81553 - DNA, 24 bp, Artificial Sequence
  Synthetic
tgctacuccatagaaugggagaca

SEQ ID NO: 81554 - DNA, 27 bp, Artificial Sequence
  Synthetic
acccagcagacauttacctatagacut

SEQ ID NO: 81555 - DNA, 22 bp, Artificial Sequence
  Synthetic
tguagtgaaccuggaaggcaac

SEQ ID NO: 81556 - DNA, 21 bp, Artificial Sequence
  Synthetic
gcacgaagcugttggctctua

SEQ ID NO: 81557 - DNA, 29 bp, Artificial Sequence
  Synthetic
gcctctgtauctaataaccatgugacaat

SEQ ID NO: 81558 - DNA, 28 bp, Artificial Sequence
  Synthetic
ggcaaagcauaattgattugaaggagaa

SEQ ID NO: 81559 - DNA, 25 bp, Artificial Sequence
  Synthetic
caggcattatugtacccaagagugt

SEQ ID NO: 81560 - DNA, 22 bp, Artificial Sequence
  Synthetic
acaggtctutctgtgcatucct

SEQ ID NO: 81561 - DNA, 25 bp, Artificial Sequence
  Synthetic
tgttcacatggguctcatttacucc

SEQ ID NO: 81562 - DNA, 22 bp, Artificial Sequence
  Synthetic
ggcattgcucctgttctttuga

SEQ ID NO: 81563 - DNA, 28 bp, Artificial Sequence
  Synthetic
tggcagaauatgagaatcugacaaacaa

SEQ ID NO: 81564 - DNA, 28 bp, Artificial Sequence
  Synthetic
atgtggatugtgcaaaatuaaaacgact

SEQ ID NO: 81565 - DNA, 28 bp, Artificial Sequence
  Synthetic
agtttggtgttcuagttcagcacaatua

SEQ ID NO: 81566 - DNA, 25 bp, Artificial Sequence
  Synthetic
ttcatggcguagtaaggtttucact

SEQ ID NO: 81567 - DNA, 25 bp, Artificial Sequence
  Synthetic
ccactggtuaacaagtctttgucct

SEQ ID NO: 81568 - DNA, 29 bp, Artificial Sequence
  Synthetic
gccuaaagaacgacauagaagaacaagaa

SEQ ID NO: 81569 - DNA, 25 bp, Artificial Sequence
  Synthetic
caagccaccauggaacaagtttuat

SEQ ID NO: 81570 - DNA, 26 bp, Artificial Sequence
  Synthetic
ttgctgaataagugtaaaaccccuca

SEQ ID NO: 81571 - DNA, 28 bp, Artificial Sequence
  Synthetic
gtataatcatgtggguaactgcaggtua

SEQ ID NO: 81572 - DNA, 28 bp, Artificial Sequence
  Synthetic
caggtttaccttutctgctaacacatut

SEQ ID NO: 81573 - DNA, 29 bp, Artificial Sequence
  Synthetic
accacatttaattuccccatacttgtuca

SEQ ID NO: 81574 - DNA, 26 bp, Artificial Sequence
  Synthetic
acatttgagcaaagaccugaagguat

SEQ ID NO: 81575 - DNA, 29 bp, Artificial Sequence
  Synthetic
agagccaagcaucattgagaaaagattua

SEQ ID NO: 81576 - DNA, 21 bp, Artificial Sequence
  Synthetic
ccttcctggugtcaaccacut

SEQ ID NO: 81577 - DNA, 22 bp, Artificial Sequence
  Synthetic
ctgctccuccatcttuccacag

SEQ ID NO: 81578 - DNA, 26 bp, Artificial Sequence
  Synthetic
gucacattctcugacacaaacacaac

SEQ ID NO: 81579 - DNA, 27 bp, Artificial Sequence
  Synthetic
ggatcattcccutcttaacaatugcat

SEQ ID NO: 81580 - DNA, 21 bp, Artificial Sequence
  Synthetic
catggctcaguctgcttcuct

SEQ ID NO: 81581 - DNA, 19 bp, Artificial Sequence
  Synthetic
tccaguaccaggcagggut

SEQ ID NO: 81582 - DNA, 25 bp, Artificial Sequence
  Synthetic
cactgagucctagagaagucacaga

SEQ ID NO: 81583 - DNA, 27 bp, Artificial Sequence
  Synthetic
catggcctcutctttttaacttugaca

SEQ ID NO: 81584 - DNA, 22 bp, Artificial Sequence
  Synthetic
tgtcttcauccgaagggugact

SEQ ID NO: 81585 - DNA, 25 bp, Artificial Sequence
  Synthetic
cattacaaugacatgtggcugaagg

SEQ ID NO: 81586 - DNA, 20 bp, Artificial Sequence
  Synthetic
agggcuccaaggactacuca

SEQ ID NO: 81587 - DNA, 24 bp, Artificial Sequence
  Synthetic
gctaatggaucatctcugcaccag

SEQ ID NO: 81588 - DNA, 22 bp, Artificial Sequence
  Synthetic
agcagtccuggcaaatggttua

SEQ ID NO: 81589 - DNA, 28 bp, Artificial Sequence
  Synthetic
gtgctgaauaaatctcttgcugaacaaa

SEQ ID NO: 81590 - DNA, 22 bp, Artificial Sequence
  Synthetic
cgacagcaugccaatctctuca

SEQ ID NO: 81591 - DNA, 25 bp, Artificial Sequence
  Synthetic
tgaaatacuccaaagcctcttgcuc

SEQ ID NO: 81592 - DNA, 21 bp, Artificial Sequence
  Synthetic
cagtaccugggaacctgcauc

SEQ ID NO: 81593 - DNA, 27 bp, Artificial Sequence
  Synthetic
gtcaactugaagtgttcugaaaaccat

SEQ ID NO: 81594 - DNA, 21 bp, Artificial Sequence
  Synthetic
gggaagggaugatgcactaug

SEQ ID NO: 81595 - DNA, 26 bp, Artificial Sequence
  Synthetic
aactcaaagcutccaatgtagucagt

SEQ ID NO: 81596 - DNA, 22 bp, Artificial Sequence
  Synthetic
gcgaucccaaagagtuagagga

SEQ ID NO: 81597 - DNA, 18 bp, Artificial Sequence
  Synthetic
gccggaccgggacuauct

SEQ ID NO: 81598 - DNA, 22 bp, Artificial Sequence
  Synthetic
cctcgtctccuctaggtccuat

SEQ ID NO: 81599 - DNA, 21 bp, Artificial Sequence
  Synthetic
ccagtgaccacacuctctgug

SEQ ID NO: 81600 - DNA, 25 bp, Artificial Sequence
  Synthetic
agtctgaaaugcaccttggaaauct

SEQ ID NO: 81601 - DNA, 17 bp, Artificial Sequence
  Synthetic
gcagcggcugtaucggt

SEQ ID NO: 81602 - DNA, 18 bp, Artificial Sequence
  Synthetic
ggccggugcagatagucc

SEQ ID NO: 81603 - DNA, 18 bp, Artificial Sequence
  Synthetic
atggccucggctgguaac

SEQ ID NO: 81604 - DNA, 21 bp, Artificial Sequence
  Synthetic
ccactctuccgtttagccuca

SEQ ID NO: 81605 - DNA, 22 bp, Artificial Sequence
  Synthetic
cttccaaagggutgcgtgttua

SEQ ID NO: 81606 - DNA, 22 bp, Artificial Sequence
  Synthetic
ttgaugaagacacagucgccaa

SEQ ID NO: 81607 - DNA, 28 bp, Artificial Sequence
  Synthetic
tttcttcagccagutttcttuacaacag

SEQ ID NO: 81608 - DNA, 21 bp, Artificial Sequence
  Synthetic
acaguccttgtacuccccact

SEQ ID NO: 81609 - DNA, 25 bp, Artificial Sequence
  Synthetic
ttgcactgacugccaactaatttug

SEQ ID NO: 81610 - DNA, 19 bp, Artificial Sequence
  Synthetic
ctgccccugtgacacctua

SEQ ID NO: 81611 - DNA, 22 bp, Artificial Sequence
  Synthetic
gtatgcagaggcugaggagaug

SEQ ID NO: 81612 - DNA, 23 bp, Artificial Sequence
  Synthetic
ccaactggcutaacacaggucaa

SEQ ID NO: 81613 - DNA, 20 bp, Artificial Sequence
  Synthetic
gcugtataugccccgaggga

SEQ ID NO: 81614 - DNA, 21 bp, Artificial Sequence
  Synthetic
ctgcagacccaggutagctua

SEQ ID NO: 81615 - DNA, 28 bp, Artificial Sequence
  Synthetic
aagagatttaccugatcactttgucgag

SEQ ID NO: 81616 - DNA, 22 bp, Artificial Sequence
  Synthetic
agtcctaacccuctagctgcut

SEQ ID NO: 81617 - DNA, 28 bp, Artificial Sequence
  Synthetic
tgtctactcctauggcatcgtattguat

SEQ ID NO: 81618 - DNA, 24 bp, Artificial Sequence
  Synthetic
ctccatctcaugcagtatctccuc

SEQ ID NO: 81619 - DNA, 23 bp, Artificial Sequence
  Synthetic
aggagaagaaccugcuacaggaa

SEQ ID NO: 81620 - DNA, 23 bp, Artificial Sequence
  Synthetic
cctctgcauacagctctgtcuct

SEQ ID NO: 81621 - DNA, 21 bp, Artificial Sequence
  Synthetic
gaacagaagcacucgcaggua

SEQ ID NO: 81622 - DNA, 28 bp, Artificial Sequence
  Synthetic
acataaacccaaacugaaccactctauc

SEQ ID NO: 81623 - DNA, 28 bp, Artificial Sequence
  Synthetic
gcaccagtguattactgctaugaaagaa

SEQ ID NO: 81624 - DNA, 24 bp, Artificial Sequence
  Synthetic
agaagcacucatgtggcttuaaca

SEQ ID NO: 81625 - DNA, 24 bp, Artificial Sequence
  Synthetic
ggatgggagaaaauacctcugacc

SEQ ID NO: 81626 - DNA, 28 bp, Artificial Sequence
  Synthetic
tcgaaagacccuagccttagauaaaact

SEQ ID NO: 81627 - DNA, 28 bp, Artificial Sequence
  Synthetic
ccagagtgagcuttcattttctcagtua

SEQ ID NO: 81628 - DNA, 25 bp, Artificial Sequence
  Synthetic
gttttattcgctucctcatgctguc

SEQ ID NO: 81629 - DNA, 24 bp, Artificial Sequence
  Synthetic
tgttttctcagauacggcgatuca

SEQ ID NO: 81630 - DNA, 22 bp, Artificial Sequence
  Synthetic
ctttcttguctctgcccuggag

SEQ ID NO: 81631 - DNA, 25 bp, Artificial Sequence
  Synthetic
cagacacttcaucatcagctctcut

SEQ ID NO: 81632 - DNA, 27 bp, Artificial Sequence
  Synthetic
actgacctctagugacttgctttcaua

SEQ ID NO: 81633 - DNA, 28 bp, Artificial Sequence
  Synthetic
agagagtaggaaugtaaaactuggacct

SEQ ID NO: 81634 - DNA, 26 bp, Artificial Sequence
  Synthetic
aatgagtctagaauccagacctguca

SEQ ID NO: 81635 - DNA, 22 bp, Artificial Sequence
  Synthetic
gcactguagcaccaaaguacct

SEQ ID NO: 81636 - DNA, 21 bp, Artificial Sequence
  Synthetic
ggcattcgutcacctgugagt

SEQ ID NO: 81637 - DNA, 22 bp, Artificial Sequence
  Synthetic
tgactaacacugtccccctuct

SEQ ID NO: 81638 - DNA, 22 bp, Artificial Sequence
  Synthetic
ggcttacuacaggaggctcuga

SEQ ID NO: 81639 - DNA, 21 bp, Artificial Sequence
  Synthetic
tccguccacatttgtugagca

SEQ ID NO: 81640 - DNA, 19 bp, Artificial Sequence
  Synthetic
gctcccccgucatcagtuc

SEQ ID NO: 81641 - DNA, 28 bp, Artificial Sequence
  Synthetic
ggtgataaaugcacttttgtcatauggt

SEQ ID NO: 81642 - DNA, 28 bp, Artificial Sequence
  Synthetic
cttcttgatcauctccttcttctucaga

SEQ ID NO: 81643 - DNA, 26 bp, Artificial Sequence
  Synthetic
acctaaaaagcagccuaagaaggaug

SEQ ID NO: 81644 - DNA, 22 bp, Artificial Sequence
  Synthetic
ggaggttgaaguaacccctgut

SEQ ID NO: 81645 - DNA, 28 bp, Artificial Sequence
  Synthetic
ggaaaaacaaccuaaaaagcagccuaag

SEQ ID NO: 81646 - DNA, 21 bp, Artificial Sequence
  Synthetic
tcctttcuacgctgctcctug

SEQ ID NO: 81647 - DNA, 23 bp, Artificial Sequence
  Synthetic
agucaggaagagccaguaggaaa

SEQ ID NO: 81648 - DNA, 19 bp, Artificial Sequence
  Synthetic
gagggccaucctatugcga

SEQ ID NO: 81649 - DNA, 23 bp, Artificial Sequence
  Synthetic
accactugactctgaugcagaag

SEQ ID NO: 81650 - DNA, 27 bp, Artificial Sequence
  Synthetic
gutgaaagaaaaatugcacaacaagca

SEQ ID NO: 81651 - DNA, 27 bp, Artificial Sequence
  Synthetic
guctctatgaguacagaaggacacaga

SEQ ID NO: 81652 - DNA, 25 bp, Artificial Sequence
  Synthetic
catggaggtaaguaagggtctgtut

SEQ ID NO: 81653 - DNA, 22 bp, Artificial Sequence
  Synthetic
cttuggccaacagaaucagcag

SEQ ID NO: 81654 - DNA, 25 bp, Artificial Sequence
  Synthetic
tgttactccaguccacacacauagt

SEQ ID NO: 81655 - DNA, 28 bp, Artificial Sequence
  Synthetic
gcataatttacaccugtgttcttgtugt

SEQ ID NO: 81656 - DNA, 21 bp, Artificial Sequence
  Synthetic
caggagcucagtagggtcuca

SEQ ID NO: 81657 - DNA, 20 bp, Artificial Sequence
  Synthetic
agtcuccaagccaggaguca

SEQ ID NO: 81658 - DNA, 22 bp, Artificial Sequence
  Synthetic
gctccacacucatgauccagat

SEQ ID NO: 81659 - DNA, 22 bp, Artificial Sequence
  Synthetic
gagtttccugaagtgacgguga

SEQ ID NO: 81660 - DNA, 20 bp, Artificial Sequence
  Synthetic
cccaggugccaucgaagaac

SEQ ID NO: 81661 - DNA, 24 bp, Artificial Sequence
  Synthetic
gcaagauccaaacttucacaccat

SEQ ID NO: 81662 - DNA, 28 bp, Artificial Sequence
  Synthetic
augtagaacatguaggaaacacaaggaa

SEQ ID NO: 81663 - DNA, 19 bp, Artificial Sequence
  Synthetic
gugaccaccguaccaccag

SEQ ID NO: 81664 - DNA, 22 bp, Artificial Sequence
  Synthetic
gtttgcugaagaggctgguagt

SEQ ID NO: 81665 - DNA, 27 bp, Artificial Sequence
  Synthetic
caacaactggauaatggaaggtttugt

SEQ ID NO: 81666 - DNA, 20 bp, Artificial Sequence
  Synthetic
gcatgcucaaacaccuccac

SEQ ID NO: 81667 - DNA, 25 bp, Artificial Sequence
  Synthetic
gtttcttccuggacccaaacuacat

SEQ ID NO: 81668 - DNA, 26 bp, Artificial Sequence
  Synthetic
cagcagcagaagcauacttaaucaga

SEQ ID NO: 81669 - DNA, 18 bp, Artificial Sequence
  Synthetic
gcutcucagcagcagcag

SEQ ID NO: 81670 - DNA, 23 bp, Artificial Sequence
  Synthetic
ggaccccaguatcattuaagcca

SEQ ID NO: 81671 - DNA, 22 bp, Artificial Sequence
  Synthetic
gagcucttcatuagggcaccaa

SEQ ID NO: 81672 - DNA, 21 bp, Artificial Sequence
  Synthetic
cccacccccauttagatcuga

SEQ ID NO: 81673 - DNA, 23 bp, Artificial Sequence
  Synthetic
catgactcacugggttguagcaa

SEQ ID NO: 81674 - DNA, 19 bp, Artificial Sequence
  Synthetic
gctctcugggtgcuaggct

SEQ ID NO: 81675 - DNA, 24 bp, Artificial Sequence
  Synthetic
agaaatctctgccucactcctcua

SEQ ID NO: 81676 - DNA, 27 bp, Artificial Sequence
  Synthetic
ctgaaagtagtutctgatggagtuggt

SEQ ID NO: 81677 - DNA, 28 bp, Artificial Sequence
  Synthetic
ggagtccugcaaaacaagctctaauaat

SEQ ID NO: 81678 - DNA, 22 bp, Artificial Sequence
  Synthetic
ccuagcccagagacauggagag

SEQ ID NO: 81679 - DNA, 23 bp, Artificial Sequence
  Synthetic
atctgcgagcauacaggtguaag

SEQ ID NO: 81680 - DNA, 20 bp, Artificial Sequence
  Synthetic
cagctgcggugtgaaatucc

SEQ ID NO: 81681 - DNA, 22 bp, Artificial Sequence
  Synthetic
atccacaggccuattugaaccc

SEQ ID NO: 81682 - DNA, 22 bp, Artificial Sequence
  Synthetic
cctgacatugtgagtagguggt

SEQ ID NO: 81683 - DNA, 23 bp, Artificial Sequence
  Synthetic
cctcaggugacctatgccuacat

SEQ ID NO: 81684 - DNA, 22 bp, Artificial Sequence
  Synthetic
ccactgaccucagtctgttuct

SEQ ID NO: 81685 - DNA, 22 bp, Artificial Sequence
  Synthetic
ggucccaaaaccagaagtcugt

SEQ ID NO: 81686 - DNA, 22 bp, Artificial Sequence
  Synthetic
gcttcttcauccagtggcucaa

SEQ ID NO: 81687 - DNA, 24 bp, Artificial Sequence
  Synthetic
cctcaactctugtctcctctcuca

SEQ ID NO: 81688 - DNA, 28 bp, Artificial Sequence
  Synthetic
gtttgggattcucatcttagccaaagua

SEQ ID NO: 81689 - DNA, 25 bp, Artificial Sequence
  Synthetic
ggccaaaagaaaucaaagtcuccaa

SEQ ID NO: 81690 - DNA, 27 bp, Artificial Sequence
  Synthetic
gtgcatcttgugaaagcattctgaaut

SEQ ID NO: 81691 - DNA, 31 bp, Artificial Sequence
  Synthetic
acgatctttgtttcuctattaaagttgcugt

SEQ ID NO: 81692 - DNA, 20 bp, Artificial Sequence
  Synthetic
gcttcgaacucacctucgct

SEQ ID NO: 81693 - DNA, 26 bp, Artificial Sequence
  Synthetic
tctacactggcuttctgttcacttut

SEQ ID NO: 81694 - DNA, 21 bp, Artificial Sequence
  Synthetic
cactttcggaucactguccca

SEQ ID NO: 81695 - DNA, 22 bp, Artificial Sequence
  Synthetic
aagagggacccautttgctugt

SEQ ID NO: 81696 - DNA, 20 bp, Artificial Sequence
  Synthetic
gcataacuaggccgctgucc

SEQ ID NO: 81697 - DNA, 25 bp, Artificial Sequence
  Synthetic
agcagtagauccagaacagttcuca

SEQ ID NO: 81698 - DNA, 20 bp, Artificial Sequence
  Synthetic
caggccuaaaacccugggaa

SEQ ID NO: 81699 - DNA, 21 bp, Artificial Sequence
  Synthetic
cggctgcucttttcgttcugt

SEQ ID NO: 81700 - DNA, 22 bp, Artificial Sequence
  Synthetic
agaaaggccccugtttgtgaut

SEQ ID NO: 81701 - DNA, 23 bp, Artificial Sequence
  Synthetic
ggaggagcgagauttgaagauca

SEQ ID NO: 81702 - DNA, 25 bp, Artificial Sequence
  Synthetic
gaagtctgacccuttttgtctccua

SEQ ID NO: 81703 - DNA, 18 bp, Artificial Sequence
  Synthetic
cttcggcuccacctgguc

SEQ ID NO: 81704 - DNA, 23 bp, Artificial Sequence
  Synthetic
aaggaaccugttgaagcugaaca

SEQ ID NO: 81705 - DNA, 28 bp, Artificial Sequence
  Synthetic
cttactttacgaccuacacaggagttuc

SEQ ID NO: 81706 - DNA, 30 bp, Artificial Sequence
  Synthetic
aagaaatctatgacutttccacttcaggut

SEQ ID NO: 81707 - DNA, 22 bp, Artificial Sequence
  Synthetic
tctgtcgcccuaatgccaaaut

SEQ ID NO: 81708 - DNA, 20 bp, Artificial Sequence
  Synthetic
caaccctauaggaggcguga

SEQ ID NO: 81709 - DNA, 24 bp, Artificial Sequence
  Synthetic
gtggaaacucactagagcatucct

SEQ ID NO: 81710 - DNA, 28 bp, Artificial Sequence
  Synthetic
catcagaagtuggaagagaacauagaca

SEQ ID NO: 81711 - DNA, 27 bp, Artificial Sequence
  Synthetic
cgaaattgtggtuctcgaagttcttuc

SEQ ID NO: 81712 - DNA, 27 bp, Artificial Sequence
  Synthetic
ggcgacagaaaggutaugaagaagaaa

SEQ ID NO: 81713 - DNA, 28 bp, Artificial Sequence
  Synthetic
cacaagttctgtugtcctcataacaauc

SEQ ID NO: 81714 - DNA, 28 bp, Artificial Sequence
  Synthetic
gggatgcugaggaaaagtauagagaaat

SEQ ID NO: 81715 - DNA, 29 bp, Artificial Sequence
  Synthetic
attaactgcaauaagaaaatccccaguct

SEQ ID NO: 81716 - DNA, 24 bp, Artificial Sequence
  Synthetic
cagcatgaugttggaatccugact

SEQ ID NO: 81717 - DNA, 28 bp, Artificial Sequence
  Synthetic
gagaaaacagccutatattgactcugct

SEQ ID NO: 81718 - DNA, 27 bp, Artificial Sequence
  Synthetic
tcactttacttuggttttgagtcugct

SEQ ID NO: 81719 - DNA, 28 bp, Artificial Sequence
  Synthetic
agaagaagauagtgaggtcatugaacct

SEQ ID NO: 81720 - DNA, 21 bp, Artificial Sequence
  Synthetic
ccaggccacauccaagtucag

SEQ ID NO: 81721 - DNA, 20 bp, Artificial Sequence
  Synthetic
gtctcugcagtgcuggaagt

SEQ ID NO: 81722 - DNA, 23 bp, Artificial Sequence
  Synthetic
gggcactctuccacatgttttuc

SEQ ID NO: 81723 - DNA, 27 bp, Artificial Sequence
  Synthetic
gtccagttctguctataacccagttuc

SEQ ID NO: 81724 - DNA, 19 bp, Artificial Sequence
  Synthetic
ttgcacuggctgucacagt

SEQ ID NO: 81725 - DNA, 17 bp, Artificial Sequence
  Synthetic
gcgggcaacaaggucug

SEQ ID NO: 81726 - DNA, 23 bp, Artificial Sequence
  Synthetic
ttttgagtcugaaacccccauga

SEQ ID NO: 81727 - DNA, 20 bp, Artificial Sequence
  Synthetic
ttctugcccaccagaugacc

SEQ ID NO: 81728 - DNA, 22 bp, Artificial Sequence
  Synthetic
cccagttguggtttcaguagga

SEQ ID NO: 81729 - DNA, 29 bp, Artificial Sequence
  Synthetic
cgggagttaatcugatgtcttctttgtut

SEQ ID NO: 81730 - DNA, 18 bp, Artificial Sequence
  Synthetic
ctggcggcugggtcttua

SEQ ID NO: 81731 - DNA, 17 bp, Artificial Sequence
  Synthetic
ccagcugugccagccaa

SEQ ID NO: 81732 - DNA, 17 bp, Artificial Sequence
  Synthetic
cctgcuggcttggcuga

SEQ ID NO: 81733 - DNA, 22 bp, Artificial Sequence
  Synthetic
tcacagcucagtcaggttcuct

SEQ ID NO: 81734 - DNA, 18 bp, Artificial Sequence
  Synthetic
cgcgtggutgttgcacug

SEQ ID NO: 81735 - DNA, 22 bp, Artificial Sequence
  Synthetic
ccaaatucaacgggctcttgug

SEQ ID NO: 81736 - DNA, 19 bp, Artificial Sequence
  Synthetic
tggauagccuccaccacct

SEQ ID NO: 81737 - DNA, 19 bp, Artificial Sequence
  Synthetic
gucctgccugaccagcaaa

SEQ ID NO: 81738 - DNA, 21 bp, Artificial Sequence
  Synthetic
cgaagctguagtccaggaugt

SEQ ID NO: 81739 - DNA, 18 bp, Artificial Sequence
  Synthetic
ccccgaaugccagtuccc

SEQ ID NO: 81740 - DNA, 21 bp, Artificial Sequence
  Synthetic
ggaaggccaugatgacaucgg

SEQ ID NO: 81741 - DNA, 23 bp, Artificial Sequence
  Synthetic
aggagctctucctttccttccut

SEQ ID NO: 81742 - DNA, 19 bp, Artificial Sequence
  Synthetic
aggtccccuggttguagca

SEQ ID NO: 81743 - DNA, 21 bp, Artificial Sequence
  Synthetic
gtgagaaugacgctcguacct

SEQ ID NO: 81744 - DNA, 19 bp, Artificial Sequence
  Synthetic
gggacugatcctccugcac

SEQ ID NO: 81745 - DNA, 20 bp, Artificial Sequence
  Synthetic
gcccatuagcagcccaaguc

SEQ ID NO: 81746 - DNA, 27 bp, Artificial Sequence
  Synthetic
ttccaacatgacauacttcacgtuact

SEQ ID NO: 81747 - DNA, 21 bp, Artificial Sequence
  Synthetic
cggacautgtaccucgggaaa

SEQ ID NO: 81748 - DNA, 32 bp, Artificial Sequence; identical to SEQ ID NO: 61856
  Synthetic

SEQ ID NO: 81749 - DNA, 27 bp, Artificial Sequence
  Synthetic
ctgtgatcagaautcctcctcttugaa

SEQ ID NO: 81750 - DNA, 28 bp, Artificial Sequence
  Synthetic
attcaaagaggaggaautctgaucacag

SEQ ID NO: 81751 - DNA, 25 bp, Artificial Sequence
  Synthetic
tccatttcuggcaatacagcacuat

SEQ ID NO: 81752 - DNA, 26 bp, Artificial Sequence
  Synthetic
caaagaggaggaautctgaucacaga

SEQ ID NO: 81753 - DNA, 24 bp, Artificial Sequence
  Synthetic
gtacctgatuctccatttcuggca

SEQ ID NO: 81754 - DNA, 23 bp, Artificial Sequence
  Synthetic
agtgctgtautgccagaaaugga

SEQ ID NO: 81755 - DNA, 32 bp, Artificial Sequence; identical to SEQ ID NO: 51197
  Synthetic

SEQ ID NO: 81756 - DNA, 20 bp, Artificial Sequence
  Synthetic
acaccgacccuctgtgauga

SEQ ID NO: 81757 - DNA, 18 bp, Artificial Sequence
  Synthetic
gcuggagcggcucaacaa

SEQ ID NO: 81758 - DNA, 22 bp, Artificial Sequence
  Synthetic
tcataaggucctccatcuccgt

SEQ ID NO: 81759 - DNA, 25 bp, Artificial Sequence
  Synthetic
gagaagaccauctctgccaagtaug

SEQ ID NO: 81760 - DNA, 21 bp, Artificial Sequence
  Synthetic
acagagccutggtctcctuct

SEQ ID NO: 81761 - DNA, 21 bp, Artificial Sequence
  Synthetic
gtagctcugagcctcatggug

SEQ ID NO: 81762 - DNA, 19 bp, Artificial Sequence
  Synthetic
gggcacggacaggucttua

SEQ ID NO: 81763 - DNA, 20 bp, Artificial Sequence
  Synthetic
tcgcucatttgtuggcgact

SEQ ID NO: 81764 - DNA, 27 bp, Artificial Sequence
  Synthetic
gtgcagcaauaaagtcatattctcugg

SEQ ID NO: 81765 - DNA, 22 bp, Artificial Sequence
  Synthetic
ctgaccttgugcctcttctgut

SEQ ID NO: 81766 - DNA, 20 bp, Artificial Sequence
  Synthetic
accacccucttgtcccucaa

SEQ ID NO: 81767 - DNA, 19 bp, Artificial Sequence
  Synthetic
ggcaacauggaggccauga

SEQ ID NO: 81768 - DNA, 18 bp, Artificial Sequence
  Synthetic
cctccaugttgcccugct

SEQ ID NO: 81769 - DNA, 19 bp, Artificial Sequence
  Synthetic
cccugaggcatgacuccaa

SEQ ID NO: 81770 - DNA, 33 bp, Artificial Sequence
  Synthetic
aataaagattccutcacaaatcctauaagaaca

SEQ ID NO: 81771 - DNA, 27 bp, Artificial Sequence
  Synthetic
gatcgggtagcuaatccaaaagacaut

SEQ ID NO: 81772 - DNA, 27 bp, Artificial Sequence
  Synthetic
tttccttttgtuctctatgccugaaaa

SEQ ID NO: 81773 - DNA, 25 bp, Artificial Sequence
  Synthetic
gcaaattgttguttcctagcgtuca

SEQ ID NO: 81774 - DNA, 27 bp, Artificial Sequence
  Synthetic
aaatctcttgguagctggtttacctuc

SEQ ID NO: 81775 - DNA, 28 bp, Artificial Sequence
  Synthetic
ggagaggautagtgactuaacgacaaat

SEQ ID NO: 81776 - DNA, 22 bp, Artificial Sequence
  Synthetic
cgcgattacuttaggcccucaa

SEQ ID NO: 81777 - DNA, 25 bp, Artificial Sequence
  Synthetic
cgccttagugaagagcagtatgtuc

SEQ ID NO: 81778 - DNA, 27 bp, Artificial Sequence
  Synthetic
tggtttacctuccagttctgaaaucat

SEQ ID NO: 81779 - DNA, 24 bp, Artificial Sequence
  Synthetic
tuctcttuccccaaaaaggaacga

SEQ ID NO: 81780 - DNA, 27 bp, Artificial Sequence
  Synthetic
cgttaagtcacuaatcctctccucaag

SEQ ID NO: 81781 - DNA, 31 bp, Artificial Sequence; identical to SEQ ID NO: 60789
  Synthetic

SEQ ID NO: 81782 - DNA, 19 bp, Artificial Sequence
  Synthetic
gccgcaggautccagauca

SEQ ID NO: 81783 - DNA, 17 bp, Artificial Sequence
  Synthetic
ggccccaucaccuccat

SEQ ID NO: 81784 - DNA, 23 bp, Artificial Sequence
  Synthetic
ggaaagaaugctcacagcucact

SEQ ID NO: 81785 - DNA, 17 bp, Artificial Sequence
  Synthetic
ccagaucgcggagcuca

SEQ ID NO: 81786 - DNA, 27 bp, Artificial Sequence
  Synthetic
tcctctgtaaauggtgttgtttucact

SEQ ID NO: 81787 - DNA, 28 bp, Artificial Sequence
  Synthetic
caaagcacttcaaacutactactgcaut

SEQ ID NO: 81788 - DNA, 19 bp, Artificial Sequence
  Synthetic
ttctuggccagctgcauct

SEQ ID NO: 81789 - DNA, 17 bp, Artificial Sequence
  Synthetic
gggcuccccctgcatug

SEQ ID NO: 81790 - DNA, 25 bp, Artificial Sequence
  Synthetic
atcccctgaacacuaagaatggaut

SEQ ID NO: 81791 - DNA, 22 bp, Artificial Sequence
  Synthetic
aggcacctguattgaccttgug

SEQ ID NO: 81792 - DNA, 27 bp, Artificial Sequence
  Synthetic
tttgggtgaccacuaattaaagtguga

SEQ ID NO: 81793 - DNA, 28 bp, Artificial Sequence
  Synthetic
catgauaaccaggaagctcaucagaaat

SEQ ID NO: 81794 - DNA, 22 bp, Artificial Sequence
  Synthetic
aatgccaaaggcuttcgttugt

SEQ ID NO: 81795 - DNA, 23 bp, Artificial Sequence
  Synthetic
caatggtctcgucctctctctug

SEQ ID NO: 81796 - DNA, 22 bp, Artificial Sequence
  Synthetic
ccaggagcuttgcatacucacc

SEQ ID NO: 81797 - DNA, 22 bp, Artificial Sequence
  Synthetic
gccctatctuctgcagagacut

SEQ ID NO: 81798 - DNA, 28 bp, Artificial Sequence
  Synthetic
ttcgttgtcagugattgttttcattgut

SEQ ID NO: 81799 - DNA, 23 bp, Artificial Sequence
  Synthetic
cagcacaugaacgtguaaacagg

SEQ ID NO: 81800 - DNA, 25 bp, Artificial Sequence
  Synthetic
tcccctgaacuccaggtaaaaguaa

SEQ ID NO: 81801 - DNA, 27 bp, Artificial Sequence
  Synthetic
tctgagtttccucaaagatctcctcua

SEQ ID NO: 81802 - DNA, 22 bp, Artificial Sequence
  Synthetic
ggcaagagcacutgaaatggut

SEQ ID NO: 81803 - DNA, 27 bp, Artificial Sequence
  Synthetic
ggtctgtttccaguaatggtccaauat

SEQ ID NO: 81804 - DNA, 21 bp, Artificial Sequence
  Synthetic
ttgccaatguccgcttcaaug

SEQ ID NO: 81805 - DNA, 24 bp, Artificial Sequence
  Synthetic
ggtcaaagautaaggugcccacaa

SEQ ID NO: 81806 - DNA, 22 bp, Artificial Sequence
  Synthetic
gcgaagcacugcatagttucat

SEQ ID NO: 81807 - DNA, 24 bp, Artificial Sequence
  Synthetic
ctggattactuttgccttgcucag

SEQ ID NO: 81808 - DNA, 21 bp, Artificial Sequence
  Synthetic
ggcaaacagugccaauccaaa

SEQ ID NO: 81809 - DNA, 22 bp, Artificial Sequence
  Synthetic
ggactatgccauggacgaacug

SEQ ID NO: 81810 - DNA, 28 bp, Artificial Sequence
  Synthetic
ttctttgtagataugatgcagccatuga

SEQ ID NO: 81811 - DNA, 26 bp, Artificial Sequence
  Synthetic
agagaaaaccautacttgtccaucgt

SEQ ID NO: 81812 - DNA, 25 bp, Artificial Sequence
  Synthetic
aaaacaacuaauaggcccaagggaa

SEQ ID NO: 81813 - DNA, 22 bp, Artificial Sequence
  Synthetic
gacctuccgacgcattguagaa

SEQ ID NO: 81814 - DNA, 22 bp, Artificial Sequence
  Synthetic
gttccagcagutccacctucat

SEQ ID NO: 81815 - DNA, 20 bp, Artificial Sequence
  Synthetic
ggaaggaaccccucgaaucc

SEQ ID NO: 81816 - DNA, 25 bp, Artificial Sequence
  Synthetic
ccacctaaagcutatcagaguggat

SEQ ID NO: 81817 - DNA, 17 bp, Artificial Sequence
  Synthetic
ggtggcacagguggcut

SEQ ID NO: 81818 - DNA, 28 bp, Artificial Sequence
  Synthetic
agtaaagtgcacaaauatgagtguaccc

SEQ ID NO: 81819 - DNA, 22 bp, Artificial Sequence
  Synthetic
aagugacugaacagcgacagaa

SEQ ID NO: 81820 - DNA, 21 bp, Artificial Sequence
  Synthetic
ccagcctcucggtttgtgtua

SEQ ID NO: 81821 - DNA, 27 bp, Artificial Sequence
  Synthetic
gaacatatgagccuttcttcccuacag

SEQ ID NO: 81822 - DNA, 22 bp, Artificial Sequence
  Synthetic
gtgcttcuggatgtacugacca

SEQ ID NO: 81823 - DNA, 26 bp, Artificial Sequence
  Synthetic
actgtccttacutttcctttgctuca

SEQ ID NO: 81824 - DNA, 28 bp, Artificial Sequence
  Synthetic
ctgataatgctaucaagaaccacuggaa

SEQ ID NO: 81825 - DNA, 20 bp, Artificial Sequence
  Synthetic
ggcagggagutgagctguag

SEQ ID NO: 81826 - DNA, 17 bp, Artificial Sequence
  Synthetic
ccugugccacccccaaa

SEQ ID NO: 81827 - DNA, 28 bp, Artificial Sequence
  Synthetic
cgaataggccuaagtttgtggaatgaua

SEQ ID NO: 81828 - DNA, 22 bp, Artificial Sequence
  Synthetic
gcagauaggactggguaaggct

SEQ ID NO: 81829 - DNA, 21 bp, Artificial Sequence
  Synthetic
tggtgctgaguctgcatcauc

SEQ ID NO: 81830 - DNA, 23 bp, Artificial Sequence
  Synthetic
gccagucacagaggatgagagua

SEQ ID NO: 81831 - DNA, 22 bp, Artificial Sequence
  Synthetic
gctaatggcaagaauggcgaut

SEQ ID NO: 81832 - DNA, 26 bp, Artificial Sequence
  Synthetic
tttgtaacacacuctcacaguaccac

SEQ ID NO: 81833 - DNA, 27 bp, Artificial Sequence
  Synthetic
tggtaaatcttacauccgtctctccut

SEQ ID NO: 81834 - DNA, 24 bp, Artificial Sequence
  Synthetic
tgugattgaucaaggagagacgga

SEQ ID NO: 81835 - DNA, 28 bp, Artificial Sequence
  Synthetic
gggatgtaaugacccttcaaaatcacua

SEQ ID NO: 81836 - DNA, 24 bp, Artificial Sequence
  Synthetic
gtcatttgaugggttttgcucagg

SEQ ID NO: 81837 - DNA, 24 bp, Artificial Sequence
  Synthetic
cctggagcuaaactaaccgtcuct

SEQ ID NO: 81838 - DNA, 25 bp, Artificial Sequence
  Synthetic
cagagaaagaggagaugaagctuct

SEQ ID NO: 81839 - DNA, 23 bp, Artificial Sequence
  Synthetic
ccatcaucaaccagtgcatcuca

SEQ ID NO: 81840 - DNA, 27 bp, Artificial Sequence
  Synthetic
gctaggauagtgattatuccccaggat

SEQ ID NO: 81841 - DNA, 29 bp, Artificial Sequence
  Synthetic
cagaaaauaaggaaaagtauggcaaacca

SEQ ID NO: 81842 - DNA, 23 bp, Artificial Sequence
  Synthetic
tgagucggaggttctaucaggag

SEQ ID NO: 81843 - DNA, 24 bp, Artificial Sequence
  Synthetic
tgattatuacaccccacccucagt

SEQ ID NO: 81844 - DNA, 23 bp, Artificial Sequence
  Synthetic
gcaccctggguaagatttctcut

SEQ ID NO: 81845 - DNA, 28 bp, Artificial Sequence
  Synthetic
ctggatgtcggaauatttagaaaccuct

SEQ ID NO: 81846 - DNA, 26 bp, Artificial Sequence
  Synthetic
atgctaucacacacattcactugagt

SEQ ID NO: 81847 - DNA, 17 bp, Artificial Sequence
  Synthetic
acctggugcaggctguc

SEQ ID NO: 81848 - DNA, 26 bp, Artificial Sequence
  Synthetic
atctcaacugaatggaaugaacgaca

SEQ ID NO: 81849 - DNA, 28 bp, Artificial Sequence
  Synthetic
aagctgtgttacutcaaaggaggttuat

SEQ ID NO: 81850 - DNA, 26 bp, Artificial Sequence
  Synthetic
cgttgagtcutatttccagtcugacc

SEQ ID NO: 81851 - DNA, 24 bp, Artificial Sequence
  Synthetic
gcacttagaggcccuttgcttaut

SEQ ID NO: 81852 - DNA, 21 bp, Artificial Sequence
  Synthetic
tgctgttggautcggcctuag

SEQ ID NO: 81853 - DNA, 22 bp, Artificial Sequence
  Synthetic
cugggtaaacauaaggccagga

SEQ ID NO: 81854 - DNA, 27 bp, Artificial Sequence
  Synthetic
cgtgaagaugaaacaagaattguccat

SEQ ID NO: 81855 - DNA, 27 bp, Artificial Sequence
  Synthetic
cttacctcttuttcccttccugaaaca

SEQ ID NO: 81856 - DNA, 20 bp, Artificial Sequence
  Synthetic
gagtagacacggugcaguca

SEQ ID NO: 81857 - DNA, 25 bp, Artificial Sequence
  Synthetic
tgtttgtguctcctagugaaaaggg

SEQ ID NO: 81858 - DNA, 21 bp, Artificial Sequence
  Synthetic
tcctgccuggguaggaaaaga

SEQ ID NO: 81859 - DNA, 21 bp, Artificial Sequence
  Synthetic
ggcaagugggatgtgaugagg

SEQ ID NO: 81860 - DNA, 27 bp, Artificial Sequence
  Synthetic
aggaggtaattttucttctctgctgut

SEQ ID NO: 81861 - DNA, 27 bp, Artificial Sequence
  Synthetic
agtcaagatgttuctggttctgttuct

SEQ ID NO: 81862 - DNA, 22 bp, Artificial Sequence
  Synthetic
ggatccatguggacacctcauc

SEQ ID NO: 81863 - DNA, 25 bp, Artificial Sequence
  Synthetic
atggaguccattgugagaacaacat

SEQ ID NO: 81864 - DNA, 25 bp, Artificial Sequence
  Synthetic
agtatguccccatgcuagaaaggaa

SEQ ID NO: 81865 - DNA, 28 bp, Artificial Sequence
  Synthetic
cacccagagugagtatagacactttuac

SEQ ID NO: 81866 - DNA, 25 bp, Artificial Sequence
  Synthetic
ctgacttgtttuatgcggtgtacut

SEQ ID NO: 81867 - DNA, 21 bp, Artificial Sequence
  Synthetic
tgcggtugatgcatucagagt

SEQ ID NO: 81868 - DNA, 23 bp, Artificial Sequence
  Synthetic
gcaaugaaaaagcagcccttcuc

SEQ ID NO: 81869 - DNA, 28 bp, Artificial Sequence
  Synthetic
gatgaagttccagguaattctagcaugt

SEQ ID NO: 81870 - DNA, 21 bp, Artificial Sequence
  Synthetic
ggaaaaggcugcaagacccut

SEQ ID NO: 81871 - DNA, 19 bp, Artificial Sequence
  Synthetic
gactgggccugtgctcaut

SEQ ID NO: 81872 - DNA, 28 bp, Artificial Sequence
  Synthetic
agagataaagacautagtcccagagugt

SEQ ID NO: 81873 - DNA, 21 bp, Artificial Sequence
  Synthetic
acaaactcucagagcccaucc

SEQ ID NO: 81874 - DNA, 20 bp, Artificial Sequence
  Synthetic
ggttccagugctcagcctua

SEQ ID NO: 81875 - DNA, 28 bp, Artificial Sequence
  Synthetic
aatcttgggcuaaagagactttcctuac

SEQ ID NO: 81876 - DNA, 28 bp, Artificial Sequence
  Synthetic
ccagattccaguaccagtacatuaggaa

SEQ ID NO: 81877 - DNA, 28 bp, Artificial Sequence
  Synthetic
caagtttcccttuaagtggcctgtauat

SEQ ID NO: 81878 - DNA, 21 bp, Artificial Sequence
  Synthetic
gctgtaggcaauggaacugct

SEQ ID NO: 81879 - DNA, 23 bp, Artificial Sequence
  Synthetic
cagcaagaggugtgtatggaugt

SEQ ID NO: 81880 - DNA, 22 bp, Artificial Sequence
  Synthetic
tccccagauacactcccttuct

SEQ ID NO: 81881 - DNA, 21 bp, Artificial Sequence
  Synthetic
tggaagccgacucttccuact

SEQ ID NO: 81882 - DNA, 23 bp, Artificial Sequence
  Synthetic
tgatgagaaccccugtgggauag

SEQ ID NO: 81883 - DNA, 21 bp, Artificial Sequence
  Synthetic
acctctggauattggcgctug

SEQ ID NO: 81884 - DNA, 22 bp, Artificial Sequence
  Synthetic
tcacctctcagugcactcatug

SEQ ID NO: 81885 - DNA, 25 bp, Artificial Sequence
  Synthetic
ggataagugccagacagacaugaat

SEQ ID NO: 81886 - DNA, 23 bp, Artificial Sequence
  Synthetic
gcagcgutaaaggaaatuccgat

SEQ ID NO: 81887 - DNA, 20 bp, Artificial Sequence
  Synthetic
gttctgugcccccattgtuc

SEQ ID NO: 81888 - DNA, 20 bp, Artificial Sequence
  Synthetic
cagguacacggagcttcugg

SEQ ID NO: 81889 - DNA, 28 bp, Artificial Sequence
  Synthetic
ctccatgaaugaggatgggatttatuct

SEQ ID NO: 81890 - DNA, 23 bp, Artificial Sequence
  Synthetic
cgctgucaaaaccagtgctttuc

SEQ ID NO: 81891 - DNA, 28 bp, Artificial Sequence
  Synthetic
aagcaacugcaaagaggagaaagtauat

SEQ ID NO: 81892 - DNA, 19 bp, Artificial Sequence
  Synthetic
ggccagaccutgggactua

SEQ ID NO: 81893 - DNA, 21 bp, Artificial Sequence
  Synthetic
ccactgcccuctttgacctut

SEQ ID NO: 81894 - DNA, 21 bp, Artificial Sequence
  Synthetic
gttctatggugcccctuggag

SEQ ID NO: 81895 - DNA, 25 bp, Artificial Sequence
  Synthetic
ctgacaccccauttgcttcttacua

SEQ ID NO: 81896 - DNA, 24 bp, Artificial Sequence
  Synthetic
cttacagggtucactcagacacuc

SEQ ID NO: 81897 - DNA, 28 bp, Artificial Sequence
  Synthetic
tgatgctactctucagaggtctaatuct

SEQ ID NO: 81898 - DNA, 20 bp, Artificial Sequence
  Synthetic
gggacauccccgtgtcacua

SEQ ID NO: 81899 - DNA, 23 bp, Artificial Sequence
  Synthetic
tgttcccgttucctcttgatcuc

SEQ ID NO: 81900 - DNA, 27 bp, Artificial Sequence
  Synthetic
cttctaggaaagaucataggccaauct

SEQ ID NO: 81901 - DNA, 28 bp, Artificial Sequence
  Synthetic
gtttaacttatugagcatgcctggttut

SEQ ID NO: 81902 - DNA, 22 bp, Artificial Sequence
  Synthetic
gcccaucucagacaaccaagac

SEQ ID NO: 81903 - DNA, 22 bp, Artificial Sequence
  Synthetic
gcaacataugagcgcctttucc

SEQ ID NO: 81904 - DNA, 25 bp, Artificial Sequence
  Synthetic
aaagctactgugtgaacctcaucaa

SEQ ID NO: 81905 - DNA, 26 bp, Artificial Sequence
  Synthetic
ttttaaaaggugtccaaccaaugcaa

SEQ ID NO: 81906 - DNA, 21 bp, Artificial Sequence
  Synthetic
gcctccctutccaatggacua

SEQ ID NO: 81907 - DNA, 27 bp, Artificial Sequence
  Synthetic
atgttccatgtaauactggaccaacuc

SEQ ID NO: 81908 - DNA, 23 bp, Artificial Sequence
  Synthetic
ctttgcattggutggacacctut

SEQ ID NO: 81909 - DNA, 30 bp, Artificial Sequence; identical to SEQ ID NO: 65239
  Synthetic

SEQ ID NO: 81910 - DNA, 21 bp, Artificial Sequence
  Synthetic
gtcctgguagtgtctugcagt

SEQ ID NO: 81911 - DNA, 28 bp, Artificial Sequence
  Synthetic
ggtctggcacugttcttcaaatatttut

SEQ ID NO: 81912 - DNA, 27 bp, Artificial Sequence
  Synthetic
atgacttugcagaaaaagagactcuga

SEQ ID NO: 81913 - DNA, 28 bp, Artificial Sequence
  Synthetic
tccaactgcugtaattcatactucacat

SEQ ID NO: 81914 - DNA, 29 bp, Artificial Sequence
  Synthetic
ggacagctautgaagcatttaaugaaacc

SEQ ID NO: 81915 - DNA, 28 bp, Artificial Sequence
  Synthetic
gaggatttuggttatctcuagcacaaga

SEQ ID NO: 81916 - DNA, 28 bp, Artificial Sequence
  Synthetic
cctaaguaagaagcagaatgagcugaaa

SEQ ID NO: 81917 - DNA, 33 bp, Artificial Sequence
  Synthetic
tattcaaacaataucttacagcttttaugagct

SEQ ID NO: 81918 - DNA, 19 bp, Artificial Sequence
  Synthetic
ttcacgcgggugagtaucc

SEQ ID NO: 81919 - DNA, 23 bp, Artificial Sequence
  Synthetic
accagccuggcttatgugaaaat

SEQ ID NO: 81920 - DNA, 20 bp, Artificial Sequence
  Synthetic
cagctcgutcccgataucca

SEQ ID NO: 81921 - DNA, 28 bp, Artificial Sequence
  Synthetic
ctggctccagguaaagaaaataaacaut

SEQ ID NO: 81922 - DNA, 30 bp, Artificial Sequence
  Synthetic
gtgtaagcauagatacttgaucagagaagg

SEQ ID NO: 81923 - DNA, 23 bp, Artificial Sequence
  Synthetic
tggcagacaguaactcagcuagt

SEQ ID NO: 81924 - DNA, 24 bp, Artificial Sequence
  Synthetic
cuttgtguaacagcacggaaaaga

SEQ ID NO: 81925 - DNA, 27 bp, Artificial Sequence
  Synthetic
ttgcatttgtcuggttttacacucaag

SEQ ID NO: 81926 - DNA, 22 bp, Artificial Sequence
  Synthetic
tgagagggcacutctcttgcua

SEQ ID NO: 81927 - DNA, 28 bp, Artificial Sequence
  Synthetic
gcttttaggacaagcucccttaaugaat

SEQ ID NO: 81928 - DNA, 20 bp, Artificial Sequence
  Synthetic
agaagaggccaugcgtuagg

SEQ ID NO: 81929 - DNA, 28 bp, Artificial Sequence
  Synthetic
ctgcttttcatuttattaggcaguggaa

SEQ ID NO: 81930 - DNA, 24 bp, Artificial Sequence
  Synthetic
tgccaacautagtgacatugacag

SEQ ID NO: 81931 - DNA, 23 bp, Artificial Sequence
  Synthetic
cacacagccaugggttttcttut

SEQ ID NO: 81932 - DNA, 21 bp, Artificial Sequence
  Synthetic
ggccugcaaggattcccauag

SEQ ID NO: 81933 - DNA, 20 bp, Artificial Sequence
  Synthetic
ctgaacttcugggccacuca

SEQ ID NO: 81934 - DNA, 21 bp, Artificial Sequence
  Synthetic
ggccttggcuattgcatcauc

SEQ ID NO: 81935 - DNA, 20 bp, Artificial Sequence
  Synthetic
aaagtgggcuccagtcucac

SEQ ID NO: 81936 - DNA, 28 bp, Artificial Sequence
  Synthetic
gccaggagacuattacgttcctctauaa

SEQ ID NO: 81937 - DNA, 28 bp, Artificial Sequence
  Synthetic
tctcttgctttuctatgtccctttugaa

SEQ ID NO: 81938 - DNA, 25 bp, Artificial Sequence
  Synthetic
cttgctaatcucccagaggaagtua

SEQ ID NO: 81939 - DNA, 25 bp, Artificial Sequence
  Synthetic
catcatccctuccccttttactgut

SEQ ID NO: 81940 - DNA, 21 bp, Artificial Sequence
  Synthetic
aattccuggagcccaguagga

SEQ ID NO: 81941 - DNA, 23 bp, Artificial Sequence
  Synthetic
cgagaagaagcugaagagcaugg

SEQ ID NO: 81942 - DNA, 28 bp, Artificial Sequence
  Synthetic
caaatacagcaugaaggtgtactauggt

SEQ ID NO: 81943 - DNA, 26 bp, Artificial Sequence
  Synthetic
gcttattgtagagcugagtcttcuca

SEQ ID NO: 81944 - DNA, 22 bp, Artificial Sequence
  Synthetic
cctcctgcaacuggatcatcuc

SEQ ID NO: 81945 - DNA, 18 bp, Artificial Sequence
  Synthetic
gggugccaagcctctguc

SEQ ID NO: 81946 - DNA, 30 bp, Artificial Sequence
  Synthetic
tctttcacttgtguttctttctaagtguga

SEQ ID NO: 81947 - DNA, 22 bp, Artificial Sequence
  Synthetic
gccttgauaccctccccgtuat

SEQ ID NO: 81948 - DNA, 29 bp, Artificial Sequence
  Synthetic
actatggattugataaaattgaggugcga

SEQ ID NO: 81949 - DNA, 26 bp, Artificial Sequence
  Synthetic
ccacgaaaaccguaagttgtcaaaut

SEQ ID NO: 81950 - DNA, 26 bp, Artificial Sequence
  Synthetic
gcacctgtaauggcaatgaagtacua

SEQ ID NO: 81951 - DNA, 29 bp, Artificial Sequence
  Synthetic
accttacctcagcuatacaacaaatugac

SEQ ID NO: 81952 - DNA, 21 bp, Artificial Sequence
  Synthetic
ggttttcguggagaagcctug

SEQ ID NO: 81953 - DNA, 27 bp, Artificial Sequence
  Synthetic
ccatacttcaccaaauactgggtuagt

SEQ ID NO: 81954 - DNA, 23 bp, Artificial Sequence
  Synthetic
ggaagacucagaugccgaaaact

SEQ ID NO: 81955 - DNA, 19 bp, Artificial Sequence
  Synthetic
tgtccucagcacagctugg

SEQ ID NO: 81956 - DNA, 18 bp, Artificial Sequence
  Synthetic
gggtccuctgtccacuca

SEQ ID NO: 81957 - DNA, 18 bp, Artificial Sequence
  Synthetic
gacgaguggcauggaggt

SEQ ID NO: 81958 - DNA, 29 bp, Artificial Sequence
  Synthetic
aaagtcaacttgacutttgactcaattug

SEQ ID NO: 81959 - DNA, 28 bp, Artificial Sequence
  Synthetic
tccagtgtttaguattcatggcaaucat

SEQ ID NO: 81960 - DNA, 25 bp, Artificial Sequence
  Synthetic
agcctgcatcuccaccttattatuc

SEQ ID NO: 81961 - DNA, 21 bp, Artificial Sequence
  Synthetic
accutgcatcctucacaagca

SEQ ID NO: 81962 - DNA, 25 bp, Artificial Sequence
  Synthetic
atgacaaaaggcuacagagcauagg

SEQ ID NO: 81963 - DNA, 23 bp, Artificial Sequence
  Synthetic
cagcatcaccacucggtagtuat

SEQ ID NO: 81964 - DNA, 20 bp, Artificial Sequence
  Synthetic
gguaagaacggucccaccaa

SEQ ID NO: 81965 - DNA, 24 bp, Artificial Sequence
  Synthetic
gtgacttcugctctgtgttucaag

SEQ ID NO: 81966 - DNA, 24 bp, Artificial Sequence
  Synthetic
gtgtguatatgtgtgugccagagt

SEQ ID NO: 81967 - DNA, 21 bp, Artificial Sequence
  Synthetic
gactucggcatguccagagat

SEQ ID NO: 81968 - DNA, 21 bp, Artificial Sequence
  Synthetic
cccatacugagccaccaggua

SEQ ID NO: 81969 - DNA, 24 bp, Artificial Sequence
  Synthetic
gcctgttacutggagttccugaag

SEQ ID NO: 81970 - DNA, 19 bp, Artificial Sequence
  Synthetic
ggguagctgauggcccaag

SEQ ID NO: 81971 - DNA, 23 bp, Artificial Sequence
  Synthetic
tgtttctctcuccacccaccaua

SEQ ID NO: 81972 - DNA, 25 bp, Artificial Sequence
  Synthetic
caataattaccccugtgggatcguc

SEQ ID NO: 81973 - DNA, 25 bp, Artificial Sequence
  Synthetic
acagcttttgucccgtatggaaaut

SEQ ID NO: 81974 - DNA, 20 bp, Artificial Sequence
  Synthetic
gctcgcccccutaatctcut

SEQ ID NO: 81975 - DNA, 28 bp, Artificial Sequence
  Synthetic
ggaataagatggcautgtaaaacagucc

SEQ ID NO: 81976 - DNA, 25 bp, Artificial Sequence
  Synthetic
tcagcttctgauaaaaggcggaaut

SEQ ID NO: 81977 - DNA, 22 bp, Artificial Sequence
  Synthetic
gctccccaggcutttgagauac

SEQ ID NO: 81978 - DNA, 28 bp, Artificial Sequence
  Synthetic
tttctttgagtccucagtgaaagctuaa

SEQ ID NO: 81979 - DNA, 26 bp, Artificial Sequence
  Synthetic
ccttttaggagccuttgtgtctgaua

SEQ ID NO: 81980 - DNA, 22 bp, Artificial Sequence
  Synthetic
ggaactcctucagctcctccut

SEQ ID NO: 81981 - DNA, 22 bp, Artificial Sequence
  Synthetic
ctgttctcugcctgcctgauac

SEQ ID NO: 81982 - DNA, 26 bp, Artificial Sequence
  Synthetic
gaaagcctutattctcaacugccaat

SEQ ID NO: 81983 - DNA, 28 bp, Artificial Sequence
  Synthetic
attcacgtaggtugcacaaagaatttut

SEQ ID NO: 81984 - DNA, 28 bp, Artificial Sequence
  Synthetic
ggaacaaggaaaagutttgatcactuga

SEQ ID NO: 81985 - DNA, 28 bp, Artificial Sequence
  Synthetic
acccatttcataaucagtttctgcuact

SEQ ID NO: 81986 - DNA, 23 bp, Artificial Sequence
  Synthetic
atggaaucagggaucacaacacc

SEQ ID NO: 81987 - DNA, 25 bp, Artificial Sequence
  Synthetic
tgactttcatguactctcccaccut

SEQ ID NO: 81988 - DNA, 28 bp, Artificial Sequence
  Synthetic
cctttgggttauaaatagtgcacucaga

SEQ ID NO: 81989 - DNA, 28 bp, Artificial Sequence
  Synthetic
aggtcaacagautactgtatagugcaag

SEQ ID NO: 81990 - DNA, 25 bp, Artificial Sequence
  Synthetic
ccctgtaataauccgtgctguagac

SEQ ID NO: 81991 - DNA, 21 bp, Artificial Sequence
  Synthetic
gctccacautgccagucagat

SEQ ID NO: 81992 - DNA, 29 bp, Artificial Sequence
  Synthetic
acagagtaacagacuagctagagacaaug

SEQ ID NO: 81993 - DNA, 25 bp, Artificial Sequence
  Synthetic
agcacttaccugtgactccauagaa

SEQ ID NO: 81994 - DNA, 26 bp, Artificial Sequence
  Synthetic
cgagatcctcuctctgaaatcacuga

SEQ ID NO: 81995 - DNA, 27 bp, Artificial Sequence
  Synthetic
gtaaaaacaugctgagaucagccaaat

SEQ ID NO: 81996 - DNA, 20 bp, Artificial Sequence
  Synthetic
ccagcuccaccaggauacat

SEQ ID NO: 81997 - DNA, 26 bp, Artificial Sequence
  Synthetic
cagaagucctuaaaacagcaggaaag

SEQ ID NO: 81998 - DNA, 18 bp, Artificial Sequence
  Synthetic
ctggaccacgcuttccug

SEQ ID NO: 81999 - DNA, 28 bp, Artificial Sequence
  Synthetic
agaaaatggaggaagucactgaaacaut

SEQ ID NO: 82000 - DNA, 20 bp, Artificial Sequence
  Synthetic
gggaggccagguacaccaua

SEQ ID NO: 82001 - DNA, 22 bp, Artificial Sequence
  Synthetic
ctctcttcuccccatgctctug

SEQ ID NO: 82002 - DNA, 22 bp, Artificial Sequence
  Synthetic
gaggctgcugatgtcactctua

SEQ ID NO: 82003 - DNA, 21 bp, Artificial Sequence
  Synthetic
agaaggcccuggaugaagaga

SEQ ID NO: 82004 - DNA, 28 bp, Artificial Sequence
  Synthetic
agaggcccaatauatccagaaaattgug

SEQ ID NO: 82005 - DNA, 24 bp, Artificial Sequence
  Synthetic
ttttgtgaaauggtcggguacaga

SEQ ID NO: 82006 - DNA, 21 bp, Artificial Sequence
  Synthetic
tguccagccagcaaaugagag

SEQ ID NO: 82007 - DNA, 25 bp, Artificial Sequence
  Synthetic
cagcaatcutgacttcuggaacaat

SEQ ID NO: 82008 - DNA, 23 bp, Artificial Sequence
  Synthetic
cgtaactctuttccaggcugagg

SEQ ID NO: 82009 - DNA, 24 bp, Artificial Sequence
  Synthetic
cgagaaaaugactgcctucaggaa

SEQ ID NO: 82010 - DNA, 22 bp, Artificial Sequence
  Synthetic
gtttctgccucatctccuggac

SEQ ID NO: 82011 - DNA, 22 bp, Artificial Sequence
  Synthetic
aactgccautcactgtgtucct

SEQ ID NO: 82012 - DNA, 23 bp, Artificial Sequence
  Synthetic
cgagaaguaagtcccaaauggca

SEQ ID NO: 82013 - DNA, 25 bp, Artificial Sequence
  Synthetic
gttttgggaacauggttttgaccut

SEQ ID NO: 82014 - DNA, 22 bp, Artificial Sequence
  Synthetic
ctatcactgucccaggucagga

SEQ ID NO: 82015 - DNA, 23 bp, Artificial Sequence
  Synthetic
cttcagaccucaaacccatcuca

SEQ ID NO: 82016 - DNA, 25 bp, Artificial Sequence
  Synthetic
cagtgtgaatuacagcaaaccccua

SEQ ID NO: 82017 - DNA, 27 bp, Artificial Sequence
  Synthetic
aatagccgtatcuggaaggaacttuac

SEQ ID NO: 82018 - DNA, 21 bp, Artificial Sequence
  Synthetic
ggctgaugcacgatttgctut

SEQ ID NO: 82019 - DNA, 20 bp, Artificial Sequence
  Synthetic
gagcuggaggcccuaaagac

SEQ ID NO: 82020 - DNA, 23 bp, Artificial Sequence
  Synthetic
gaagaagaccucagcagatgcut

SEQ ID NO: 82021 - DNA, 28 bp, Artificial Sequence
  Synthetic
cacaatttcugtgtttgtuaaccagagt

SEQ ID NO: 82022 - DNA, 17 bp, Artificial Sequence
  Synthetic
cactccucgccagucca

SEQ ID NO: 82023 - DNA, 18 bp, Artificial Sequence
  Synthetic
cgctgugaggcucagcat

SEQ ID NO: 82024 - DNA, 18 bp, Artificial Sequence
  Synthetic
cctgcccugtggcacaua

SEQ ID NO: 82025 - DNA, 18 bp, Artificial Sequence
  Synthetic
cgaaggcggauggctcuc

SEQ ID NO: 82026 - DNA, 23 bp, Artificial Sequence
  Synthetic
ggcatcctucacctgctattgut

SEQ ID NO: 82027 - DNA, 19 bp, Artificial Sequence
  Synthetic
cugctaaguaggccacgct

SEQ ID NO: 82028 - DNA, 18 bp, Artificial Sequence
  Synthetic
cacagagcguggccuact

SEQ ID NO: 82029 - DNA, 21 bp, Artificial Sequence
  Synthetic
tgtgaactutctgctcugcca

SEQ ID NO: 82030 - DNA, 26 bp, Artificial Sequence
  Synthetic
ccaaaccaguggttagaugagaaact

SEQ ID NO: 82031 - DNA, 22 bp, Artificial Sequence
  Synthetic
caagaautgauacgcccagacc

SEQ ID NO: 82032 - DNA, 27 bp, Artificial Sequence
  Synthetic
ggagaaaggacauttgtgauaggagaa

SEQ ID NO: 82033 - DNA, 24 bp, Artificial Sequence
  Synthetic
gauttctgtaccatugagggcact

SEQ ID NO: 82034 - DNA, 21 bp, Artificial Sequence
  Synthetic
ctgtgctguccagtgtgtcut

SEQ ID NO: 82035 - DNA, 25 bp, Artificial Sequence
  Synthetic
agaagaacaaugcccugaagaagat

SEQ ID NO: 82036 - DNA, 25 bp, Artificial Sequence
  Synthetic
acttcttttucaagcaggacgauct

SEQ ID NO: 82037 - DNA, 28 bp, Artificial Sequence
  Synthetic
cacaaacatugcaagctgaattuaaaca

SEQ ID NO: 82038 - DNA, 23 bp, Artificial Sequence
  Synthetic
cgtgtctccaucattctcagcuc

SEQ ID NO: 82039 - DNA, 28 bp, Artificial Sequence
  Synthetic
ggacctacttttugatgtttctgtgcua

SEQ ID NO: 82040 - DNA, 20 bp, Artificial Sequence
  Synthetic
gtgacattcgugccttgcut

SEQ ID NO: 82041 - DNA, 17 bp, Artificial Sequence
  Synthetic
gcuggaggacgccacug

SEQ ID NO: 82042 - DNA, 25 bp, Artificial Sequence
  Synthetic
cactctatgcautcatcttcacgut

SEQ ID NO: 82043 - DNA, 29 bp, Artificial Sequence
  Synthetic
ctcataaatagaucatggttcccgauaca

SEQ ID NO: 82044 - DNA, 21 bp, Artificial Sequence
  Synthetic
tgaaugagacgucccaccaag

SEQ ID NO: 82045 - DNA, 27 bp, Artificial Sequence
  Synthetic
cagagcaucaaccgaaacaagtuaaaa

SEQ ID NO: 82046 - DNA, 23 bp, Artificial Sequence
  Synthetic
acagctttgtutgcactgttgut

SEQ ID NO: 82047 - DNA, 24 bp, Artificial Sequence
  Synthetic
cccacgtguaaatgtagccactua

SEQ ID NO: 82048 - DNA, 23 bp, Artificial Sequence
  Synthetic
aaagtcaagcugtgtcactucct

SEQ ID NO: 82049 - DNA, 28 bp, Artificial Sequence
  Synthetic
tacaatccacucattcttttgtctucct

SEQ ID NO: 82050 - DNA, 17 bp, Artificial Sequence
  Synthetic
catggcaucggccguct

SEQ ID NO: 82051 - DNA, 18 bp, Artificial Sequence
  Synthetic
gggccacacguccatcuc

SEQ ID NO: 82052 - DNA, 22 bp, Artificial Sequence
  Synthetic
agctctgutcagaaauggcagt

SEQ ID NO: 82053 - DNA, 27 bp, Artificial Sequence
  Synthetic
tgctatgtcttccugaaaagggaatut

SEQ ID NO: 82054 - DNA, 22 bp, Artificial Sequence
  Synthetic
ccucacacaggaaaaugggagt

SEQ ID NO: 82055 - DNA, 21 bp, Artificial Sequence
  Synthetic
accuccccaacaccuacaagt

SEQ ID NO: 82056 - DNA, 21 bp, Artificial Sequence
  Synthetic
ctcctggagguctgagatgug

SEQ ID NO: 82057 - DNA, 24 bp, Artificial Sequence
  Synthetic
actgtctggucccagaaaagttut

SEQ ID NO: 82058 - DNA, 18 bp, Artificial Sequence
  Synthetic
cggccctuaccctgagug

SEQ ID NO: 82059 - DNA, 17 bp, Artificial Sequence
  Synthetic
agggccccucgttcugt

SEQ ID NO: 82060 - DNA, 25 bp, Artificial Sequence
  Synthetic
gccgctcatautcatttctcatcug

SEQ ID NO: 82061 - DNA, 20 bp, Artificial Sequence
  Synthetic
tugggucaaagaagggcact

SEQ ID NO: 82062 - DNA, 27 bp, Artificial Sequence
  Synthetic
ggattctcucaagcatcttcagttuct

SEQ ID NO: 82063 - DNA, 23 bp, Artificial Sequence
  Synthetic
tcctgggagcugaagaaucagat

SEQ ID NO: 82064 - DNA, 20 bp, Artificial Sequence
  Synthetic
ccacttcccauagccacgut

SEQ ID NO: 82065 - DNA, 21 bp, Artificial Sequence
  Synthetic
ggaggaacucaccgaccttug

SEQ ID NO: 82066 - DNA, 25 bp, Artificial Sequence
  Synthetic
cattagctgtucctgaagctgacua

SEQ ID NO: 82067 - DNA, 21 bp, Artificial Sequence
  Synthetic
ggaaguacagggacgagcuct

SEQ ID NO: 82068 - DNA, 21 bp, Artificial Sequence
  Synthetic
tggccacagautctccagcua

SEQ ID NO: 82069 - DNA, 26 bp, Artificial Sequence
  Synthetic
catcagtuaaaacaaggttgtgcuca

SEQ ID NO: 82070 - DNA, 26 bp, Artificial Sequence
  Synthetic
aaataatgaagtgugaggctgcctua

SEQ ID NO: 82071 - DNA, 28 bp, Artificial Sequence
  Synthetic
aatgatgcacataucctggagaagtuac

SEQ ID NO: 82072 - DNA, 21 bp, Artificial Sequence
  Synthetic
tcctccaagcucaacatgugg

SEQ ID NO: 82073 - DNA, 22 bp, Artificial Sequence
  Synthetic
cttacacacaggugagcacugt

SEQ ID NO: 82074 - DNA, 17 bp, Artificial Sequence
  Synthetic
ccagtggcugcacguct

SEQ ID NO: 82075 - DNA, 22 bp, Artificial Sequence
  Synthetic
acutacagaugcagcagcagaa

SEQ ID NO: 82076 - DNA, 21 bp, Artificial Sequence
  Synthetic
ctttgctgcugctggatgtut

SEQ ID NO: 82077 - DNA, 19 bp, Artificial Sequence
  Synthetic
gctgcacaguagcctugct

SEQ ID NO: 82078 - DNA, 23 bp, Artificial Sequence
  Synthetic
tctgtcuagaaacacgggacuga

SEQ ID NO: 82079 - DNA, 20 bp, Artificial Sequence
  Synthetic
gcacgautcctuccaaccca

SEQ ID NO: 82080 - DNA, 21 bp, Artificial Sequence
  Synthetic
ggttcaacggcutctcacuca

SEQ ID NO: 82081 - DNA, 22 bp, Artificial Sequence
  Synthetic
gctgagggcucttaacuacacc

SEQ ID NO: 82082 - DNA, 26 bp, Artificial Sequence
  Synthetic
accutccttgauccaaacagaaagat

SEQ ID NO: 82083 - DNA, 28 bp, Artificial Sequence
  Synthetic
ccagagtcacgauttctttcattttgut

SEQ ID NO: 82084 - DNA, 22 bp, Artificial Sequence
  Synthetic
tggtagcucatcatcugggaca

SEQ ID NO: 82085 - DNA, 17 bp, Artificial Sequence
  Synthetic
gcauggugccgaaccaa

SEQ ID NO: 82086 - DNA, 17 bp, Artificial Sequence
  Synthetic
ccccgcagagggutgua

SEQ ID NO: 82087 - DNA, 18 bp, Artificial Sequence
  Synthetic
tctcucccacctgccugt

SEQ ID NO: 82088 - DNA, 27 bp, Artificial Sequence
  Synthetic
agttgcaaatataugtcttccacccut

SEQ ID NO: 82089 - DNA, 20 bp, Artificial Sequence
  Synthetic
gcttcagugtcagggtucca

SEQ ID NO: 82090 - DNA, 20 bp, Artificial Sequence
  Synthetic
cuggtgtugaggaagccaga

SEQ ID NO: 82091 - DNA, 26 bp, Artificial Sequence
  Synthetic
aggtagcaatugttacatgagctugt

SEQ ID NO: 82092 - DNA, 20 bp, Artificial Sequence
  Synthetic
ctgagcacagugctggagua

SEQ ID NO: 82093 - DNA, 22 bp, Artificial Sequence
  Synthetic
agcatgcagccaauccagauag

SEQ ID NO: 82094 - DNA, 20 bp, Artificial Sequence
  Synthetic
cagtaggcagagcugctguc

SEQ ID NO: 82095 - DNA, 25 bp, Artificial Sequence
  Synthetic
aactttctcugctggccuaaaagaa

SEQ ID NO: 82096 - DNA, 17 bp, Artificial Sequence
  Synthetic
gctgccggguggtgaug

SEQ ID NO: 82097 - DNA, 23 bp, Artificial Sequence
  Synthetic
tccatacagcuatggtccacuga

SEQ ID NO: 82098 - DNA, 22 bp, Artificial Sequence
  Synthetic
agtggcccugtacatgtttcug

SEQ ID NO: 82099 - DNA, 26 bp, Artificial Sequence
  Synthetic
agaggcaaacuccatgaatgtgtuat

SEQ ID NO: 82100 - DNA, 26 bp, Artificial Sequence
  Synthetic
tgtgtgttugcatggtctuagaaagt

SEQ ID NO: 82101 - DNA, 25 bp, Artificial Sequence
  Synthetic
cgagtgacaauacacagcatcaauc

SEQ ID NO: 82102 - DNA, 22 bp, Artificial Sequence
  Synthetic
cagtcugcctctggtuaccaat

SEQ ID NO: 82103 - DNA, 21 bp, Artificial Sequence
  Synthetic
gaugactgcccuaaccacagg

SEQ ID NO: 82104 - DNA, 25 bp, Artificial Sequence
  Synthetic
ctgagatggguaatgatgtctucca

SEQ ID NO: 82105 - DNA, 24 bp, Artificial Sequence
  Synthetic
gccaaccctutatccttcctcuct

SEQ ID NO: 82106 - DNA, 21 bp, Artificial Sequence
  Synthetic
cttcacacugcgcugagagat

SEQ ID NO: 82107 - DNA, 22 bp, Artificial Sequence
  Synthetic
cgtctccuggctgtgtatgtug

SEQ ID NO: 82108 - DNA, 26 bp, Artificial Sequence
  Synthetic
ggcagtcaaaccutctctcttatgua

SEQ ID NO: 82109 - DNA, 28 bp, Artificial Sequence
  Synthetic
ctcttcaaucactgacatatcugggaac

SEQ ID NO: 82110 - DNA, 24 bp, Artificial Sequence
  Synthetic
gaagccaaagggaaaugcacaaut

SEQ ID NO: 82111 - DNA, 22 bp, Artificial Sequence
  Synthetic
tggaggcugtattcagcuacct

SEQ ID NO: 82112 - DNA, 22 bp, Artificial Sequence
  Synthetic
gcaggcagaaaccaugtaaucc

SEQ ID NO: 82113 - DNA, 25 bp, Artificial Sequence
  Synthetic
ggtuccaagagaagaagagcuacct

SEQ ID NO: 82114 - DNA, 22 bp, Artificial Sequence
  Synthetic
actggtucagcagtgtgguaaa

SEQ ID NO: 82115 - DNA, 24 bp, Artificial Sequence
  Synthetic
actcagtgattugccttaccaguc

SEQ ID NO: 82116 - DNA, 25 bp, Artificial Sequence
  Synthetic
cccgagaagcaggauttagctatuc

SEQ ID NO: 82117 - DNA, 28 bp, Artificial Sequence
  Synthetic
ggtcctagagutcatagtatctaugcca

SEQ ID NO: 82118 - DNA, 23 bp, Artificial Sequence
  Synthetic
ctcagaaccaacacuggtgctua

SEQ ID NO: 82119 - DNA, 28 bp, Artificial Sequence
  Synthetic
tttgcttttcugagtacacaccauagat

SEQ ID NO: 82120 - DNA, 25 bp, Artificial Sequence
  Synthetic
tgaagtgtcagugcataacctctug

SEQ ID NO: 82121 - DNA, 21 bp, Artificial Sequence
  Synthetic
ccaugtgcttugaggcagact

SEQ ID NO: 82122 - DNA, 21 bp, Artificial Sequence
  Synthetic
cgcattggautggtggccuaa

SEQ ID NO: 82123 - DNA, 27 bp, Artificial Sequence
  Synthetic
aaggaggtgagautcaaaattcgugat

SEQ ID NO: 82124 - DNA, 27 bp, Artificial Sequence
  Synthetic
caatggagaacutatagctgugcaaag

SEQ ID NO: 82125 - DNA, 28 bp, Artificial Sequence
  Synthetic
ccatcaactuacagacctaaaagacuga

SEQ ID NO: 82126 - DNA, 22 bp, Artificial Sequence
  Synthetic
cacaaaccccuccattcugaca

SEQ ID NO: 82127 - DNA, 27 bp, Artificial Sequence
  Synthetic
caggtcgtttcutctgtatgagattuc

SEQ ID NO: 82128 - DNA, 21 bp, Artificial Sequence
  Synthetic
catcatcaaaguccccgcuga

SEQ ID NO: 82129 - DNA, 21 bp, Artificial Sequence
  Synthetic
gtagcaggugtccagcugaag

SEQ ID NO: 82130 - DNA, 22 bp, Artificial Sequence
  Synthetic
ctcactgauccttttgcctgug

SEQ ID NO: 82131 - DNA, 23 bp, Artificial Sequence
  Synthetic
ccagctaaaugaaccccgugaat

SEQ ID NO: 82132 - DNA, 19 bp, Artificial Sequence
  Synthetic
gaagcccaccccacucuac

SEQ ID NO: 82133 - DNA, 23 bp, Artificial Sequence
  Synthetic
tcccuagcaaauaccaaaggcaa

SEQ ID NO: 82134 - DNA, 24 bp, Artificial Sequence
  Synthetic
gttatactugcctctgcugagcat

SEQ ID NO: 82135 - DNA, 21 bp, Artificial Sequence
  Synthetic
ctgcctgucccctatgaucac

SEQ ID NO: 82136 - DNA, 25 bp, Artificial Sequence
  Synthetic
ggctcacugaaccatatccctttua

SEQ ID NO: 82137 - DNA, 23 bp, Artificial Sequence
  Synthetic
gggauctgaaaatucccaacggt

SEQ ID NO: 82138 - DNA, 23 bp, Artificial Sequence
  Synthetic
gagactcugcacatgttcugaga

SEQ ID NO: 82139 - DNA, 28 bp, Artificial Sequence
  Synthetic
ctaactgtgccautgcattctgaatuat

SEQ ID NO: 82140 - DNA, 26 bp, Artificial Sequence
  Synthetic
tcttcttcgcuccagaatttgaaugt

SEQ ID NO: 82141 - DNA, 28 bp, Artificial Sequence
  Synthetic
tgaagttgttguaagactttgtctcgua

SEQ ID NO: 82142 - DNA, 24 bp, Artificial Sequence
  Synthetic
gugcttactagtuccaaaggcagt

SEQ ID NO: 82143 - DNA, 22 bp, Artificial Sequence
  Synthetic
ggtaccacaacuggcttgttug

SEQ ID NO: 82144 - DNA, 27 bp, Artificial Sequence
  Synthetic
gcctgctgcauttcctttattttacuc

SEQ ID NO: 82145 - DNA, 27 bp, Artificial Sequence
  Synthetic
tggaaagacuagaaatggaacaugacc

SEQ ID NO: 82146 - DNA, 21 bp, Artificial Sequence
  Synthetic
ctggaaguggcuggagaagac

SEQ ID NO: 82147 - DNA, 26 bp, Artificial Sequence
  Synthetic
aatatgtttuccctccctucaggaac

SEQ ID NO: 82148 - DNA, 25 bp, Artificial Sequence
  Synthetic
tcaaagauaccagaaaagccacgut

SEQ ID NO: 82149 - DNA, 25 bp, Artificial Sequence
  Synthetic
ctcacggaaauaactgagaucacca

SEQ ID NO: 82150 - DNA, 21 bp, Artificial Sequence
  Synthetic
gtccauccaaggcauccgaat

SEQ ID NO: 82151 - DNA, 25 bp, Artificial Sequence
  Synthetic
ggcccttgaaaaugaacttttggut

SEQ ID NO: 82152 - DNA, 22 bp, Artificial Sequence
  Synthetic
ctcttgttucagcccacgtcua

SEQ ID NO: 82153 - DNA, 21 bp, Artificial Sequence
  Synthetic
aagtgacgcuttccagactug

SEQ ID NO: 82154 - DNA, 23 bp, Artificial Sequence
  Synthetic
ggacatcatutcctgccttucct

SEQ ID NO: 82155 - DNA, 25 bp, Artificial Sequence
  Synthetic
cagatacttgagcugaagagcaguc

SEQ ID NO: 82156 - DNA, 21 bp, Artificial Sequence
  Synthetic
ggtctgtuactcggcauggaa

SEQ ID NO: 82157 - DNA, 24 bp, Artificial Sequence
  Synthetic
cctgatttatucacggctccacuc

SEQ ID NO: 82158 - DNA, 22 bp, Artificial Sequence
  Synthetic
tggcttatuggcaatgcctcut

SEQ ID NO: 82159 - DNA, 21 bp, Artificial Sequence
  Synthetic
gcgtaagcauggctctctcug

SEQ ID NO: 82160 - DNA, 28 bp, Artificial Sequence
  Synthetic
agctttagaagcugtttgtacactguat

SEQ ID NO: 82161 - DNA, 27 bp, Artificial Sequence
  Synthetic
tgttggcagttutaaagacctcttuga

SEQ ID NO: 82162 - DNA, 22 bp, Artificial Sequence
  Synthetic
atgactatgaugggctgctucc

SEQ ID NO: 82163 - DNA, 28 bp, Artificial Sequence
  Synthetic
gcttgagcaccugtagtttagtugaaat

SEQ ID NO: 82164 - DNA, 21 bp, Artificial Sequence
  Synthetic
gctcccucagttccctttugt

SEQ ID NO: 82165 - DNA, 25 bp, Artificial Sequence
  Synthetic
gagagagagaugcuggagaaaacat

SEQ ID NO: 82166 - DNA, 22 bp, Artificial Sequence
  Synthetic
cctggtgaaugctgttctuggt

SEQ ID NO: 82167 - DNA, 27 bp, Artificial Sequence
  Synthetic
tgaatttacgccutgctctgatttcua

SEQ ID NO: 82168 - DNA, 27 bp, Artificial Sequence
  Synthetic
gagguttgaaatgugaaaagacaggaa

SEQ ID NO: 82169 - DNA, 23 bp, Artificial Sequence
  Synthetic
gccaccacuctgatactccuacc

SEQ ID NO: 82170 - DNA, 22 bp, Artificial Sequence
  Synthetic
cgaagagugaaacctucaggca

SEQ ID NO: 82171 - DNA, 22 bp, Artificial Sequence
  Synthetic
ccctgtcuctgtggacttucag

SEQ ID NO: 82172 - DNA, 22 bp, Artificial Sequence
  Synthetic
cctccctauccttccctgtugt

SEQ ID NO: 82173 - DNA, 25 bp, Artificial Sequence
  Synthetic
cgttgagatugaattctgtgtgugg

SEQ ID NO: 82174 - DNA, 23 bp, Artificial Sequence
  Synthetic
gtgattucaacccccttacugga

SEQ ID NO: 82175 - DNA, 25 bp, Artificial Sequence
  Synthetic
gttgaguacgttgtuggaaggaaaa

SEQ ID NO: 82176 - DNA, 26 bp, Artificial Sequence
  Synthetic
gaccatgctgutcaaatgttcttugt

SEQ ID NO: 82177 - DNA, 21 bp, Artificial Sequence
  Synthetic
gcgtgaggagaaaucccagug

SEQ ID NO: 82178 - DNA, 23 bp, Artificial Sequence
  Synthetic
ccttcaagauagccatugggcaa

SEQ ID NO: 82179 - DNA, 22 bp, Artificial Sequence
  Synthetic
gtaaaggcagccutggugaaga

SEQ ID NO: 82180 - DNA, 27 bp, Artificial Sequence
  Synthetic
gatcattutcaatcagaauggcacagt

SEQ ID NO: 82181 - DNA, 28 bp, Artificial Sequence
  Synthetic
tgttcgtgtacaugtgtatgtgtctauc

SEQ ID NO: 82182 - DNA, 23 bp, Artificial Sequence
  Synthetic
gctgaaacutgactucacaccaa

SEQ ID NO: 82183 - DNA, 21 bp, Artificial Sequence
  Synthetic
cagtgaagugatgctguccac

SEQ ID NO: 82184 - DNA, 23 bp, Artificial Sequence
  Synthetic
tgagctcguccttctcaaatucc

SEQ ID NO: 82185 - DNA, 23 bp, Artificial Sequence
  Synthetic
gcccagttucagtctgattguca

SEQ ID NO: 82186 - DNA, 25 bp, Artificial Sequence
  Synthetic
actcactttctgutcaacctcgaut

SEQ ID NO: 82187 - DNA, 22 bp, Artificial Sequence
  Synthetic
cgttacactgugtctgggtcug

SEQ ID NO: 82188 - DNA, 21 bp, Artificial Sequence
  Synthetic
gatcucacccaggaactgguc

SEQ ID NO: 82189 - DNA, 21 bp, Artificial Sequence
  Synthetic
tgtctgccuctccctcttcut

SEQ ID NO: 82190 - DNA, 27 bp, Artificial Sequence
  Synthetic
cggtaatacttgcuagtgggatttcuc

SEQ ID NO: 82191 - DNA, 29 bp, Artificial Sequence
  Synthetic
gcactctaattucagctaccaagtttcua

SEQ ID NO: 82192 - DNA, 25 bp, Artificial Sequence
  Synthetic
gagcactcucctcactactttucaa

SEQ ID NO: 82193 - DNA, 24 bp, Artificial Sequence
  Synthetic
gguaattcucaccagccagagaag

SEQ ID NO: 82194 - DNA, 25 bp, Artificial Sequence
  Synthetic
ttaaccatgcagaucctcagttugt

SEQ ID NO: 82195 - DNA, 25 bp, Artificial Sequence
  Synthetic
agcatcttgutctgtttguggaaga

SEQ ID NO: 82196 - DNA, 19 bp, Artificial Sequence
  Synthetic
agagccugacccaauccga

SEQ ID NO: 82197 - DNA, 26 bp, Artificial Sequence
  Synthetic
ggttgatccttugatgccctcatuat

SEQ ID NO: 82198 - DNA, 23 bp, Artificial Sequence
  Synthetic
cttacucgcagtcguacaagagg

SEQ ID NO: 82199 - DNA, 27 bp, Artificial Sequence
  Synthetic
tgctattcagccaagutaaactcagut

SEQ ID NO: 82200 - DNA, 28 bp, Artificial Sequence
  Synthetic
gtggtgataucaaagtagagttctucca

SEQ ID NO: 82201 - DNA, 29 bp, Artificial Sequence
  Synthetic
agcaaaacaccugcagatctaauagaaaa

SEQ ID NO: 82202 - DNA, 24 bp, Artificial Sequence
  Synthetic
aacaattttggccugtggactcua

SEQ ID NO: 82203 - DNA, 22 bp, Artificial Sequence
  Synthetic
aaagaattcucgtccaccugct

SEQ ID NO: 82204 - DNA, 25 bp, Artificial Sequence
  Synthetic
ttgagggatgautcaaaggtggtut

SEQ ID NO: 82205 - DNA, 23 bp, Artificial Sequence
  Synthetic
tgcatcacuacaccucaaaaggg

SEQ ID NO: 82206 - DNA, 24 bp, Artificial Sequence
  Synthetic
ggagtattuccagcatcccugaac

SEQ ID NO: 82207 - DNA, 28 bp, Artificial Sequence
  Synthetic
ctcccttaatcautgttccctatgtuct

SEQ ID NO: 82208 - DNA, 24 bp, Artificial Sequence
  Synthetic
ccatuacaaagaaagccggacuct

SEQ ID NO: 82209 - DNA, 29 bp, Artificial Sequence
  Synthetic
cctggtggguccatttctatauaaaacat

SEQ ID NO: 82210 - DNA, 28 bp, Artificial Sequence
  Synthetic
gacagatataaatugtggcacagactug

SEQ ID NO: 82211 - DNA, 29 bp, Artificial Sequence
  Synthetic
caaaaaggatctuttacagtagcttucga

SEQ ID NO: 82212 - DNA, 23 bp, Artificial Sequence
  Synthetic
aggtcgauctagtgcucagaaca

SEQ ID NO: 82213 - DNA, 21 bp, Artificial Sequence
  Synthetic
gcaactcagcaugtccaccuc

SEQ ID NO: 82214 - DNA, 17 bp, Artificial Sequence
  Synthetic
cucccagggccacguaa

SEQ ID NO: 82215 - DNA, 19 bp, Artificial Sequence
  Synthetic
cgcagaugccaacauccag

SEQ ID NO: 82216 - DNA, 17 bp, Artificial Sequence
  Synthetic
gtgcggcccaugttguc

SEQ ID NO: 82217 - DNA, 24 bp, Artificial Sequence
  Synthetic
cgtcatcuccgacttcatcuacca

SEQ ID NO: 82218 - DNA, 19 bp, Artificial Sequence
  Synthetic
gtgcgguctgtctggtugt

SEQ ID NO: 82219 - DNA, 18 bp, Artificial Sequence
  Synthetic
cagacugagcacccguct

SEQ ID NO: 82220 - DNA, 24 bp, Artificial Sequence
  Synthetic
gtggcagcuccagtaauagagaac

SEQ ID NO: 82221 - DNA, 24 bp, Artificial Sequence
  Synthetic
gucaagaguccagacaacagaaga

SEQ ID NO: 82222 - DNA, 25 bp, Artificial Sequence
  Synthetic
ccattcacaccaugcacatatgaut

SEQ ID NO: 82223 - DNA, 23 bp, Artificial Sequence
  Synthetic
cctgttugcgcactttcatctuc

SEQ ID NO: 82224 - DNA, 21 bp, Artificial Sequence
  Synthetic
tgttttcttucctgccgucct

SEQ ID NO: 82225 - DNA, 28 bp, Artificial Sequence
  Synthetic
tgtcagatagtcacuccgtttacaatut

SEQ ID NO: 82226 - DNA, 21 bp, Artificial Sequence
  Synthetic
cccttggcucagtcagaacut

SEQ ID NO: 82227 - DNA, 23 bp, Artificial Sequence
  Synthetic
tgcucaaatacugagaccccaac

SEQ ID NO: 82228 - DNA, 20 bp, Artificial Sequence
  Synthetic
caggtugtactcguccagca

SEQ ID NO: 82229 - DNA, 21 bp, Artificial Sequence
  Synthetic
ggaggagacaccccugttuct

SEQ ID NO: 82230 - DNA, 23 bp, Artificial Sequence
  Synthetic
cctgaagcaguccaggacttaug

SEQ ID NO: 82231 - DNA, 28 bp, Artificial Sequence
  Synthetic
agaaatgtatggucagaaaacactguga

SEQ ID NO: 82232 - DNA, 18 bp, Artificial Sequence
  Synthetic
cacctuggcggtctcgua

SEQ ID NO: 82233 - DNA, 23 bp, Artificial Sequence
  Synthetic
cttcctctggugatggaacctug

SEQ ID NO: 82234 - DNA, 24 bp, Artificial Sequence
  Synthetic
tgacucaagggtucaacacaaact

SEQ ID NO: 82235 - DNA, 22 bp, Artificial Sequence
  Synthetic
caatttguagaggcugcagcac

SEQ ID NO: 82236 - DNA, 25 bp, Artificial Sequence
  Synthetic
cagcaacacuttaaatggacuggaa

SEQ ID NO: 82237 - DNA, 24 bp, Artificial Sequence
  Synthetic
gacaacagcaacagcauctgtuaa

SEQ ID NO: 82238 - DNA, 20 bp, Artificial Sequence
  Synthetic
acctgggucccctccctaua

SEQ ID NO: 82239 - DNA, 21 bp, Artificial Sequence
  Synthetic
gaagaggcuggtagctgacug

SEQ ID NO: 82240 - DNA, 28 bp, Artificial Sequence
  Synthetic
tcgtcctctttuaggactcactttuaga

SEQ ID NO: 82241 - DNA, 28 bp, Artificial Sequence
  Synthetic
ccatcgaattaaacuttgagtgccuact

SEQ ID NO: 82242 - DNA, 28 bp, Artificial Sequence
  Synthetic
gatttgttgcaggutttggttttaaugg

SEQ ID NO: 82243 - DNA, 28 bp, Artificial Sequence
  Synthetic
tgtgtgttctuaaagcaggcatacuaat

SEQ ID NO: 82244 - DNA, 24 bp, Artificial Sequence
  Synthetic
gutcaaaaucaaaggaagcccaga

SEQ ID NO: 82245 - DNA, 25 bp, Artificial Sequence
  Synthetic
caaactgccaautcaagcctctuaa

SEQ ID NO: 82246 - DNA, 21 bp, Artificial Sequence
  Synthetic
ggcacatgugtaccccttgut

SEQ ID NO: 82247 - DNA, 22 bp, Artificial Sequence
  Synthetic
gaatgacaacaucgccacacug

SEQ ID NO: 82248 - DNA, 25 bp, Artificial Sequence
  Synthetic
ccttttgaatgacugcagtgaagut

SEQ ID NO: 82249 - DNA, 24 bp, Artificial Sequence
  Synthetic
cactgtctacgutggcattgagua

SEQ ID NO: 82250 - DNA, 21 bp, Artificial Sequence
  Synthetic
gccacaacccutacccuagga

SEQ ID NO: 82251 - DNA, 21 bp, Artificial Sequence
  Synthetic
ctacacaggcagcuactguga

SEQ ID NO: 82252 - DNA, 18 bp, Artificial Sequence
  Synthetic
gtgagcacucguccacca

SEQ ID NO: 82253 - DNA, 19 bp, Artificial Sequence
  Synthetic
ctgggccucacctgtcuac

SEQ ID NO: 82254 - DNA, 28 bp, Artificial Sequence
  Synthetic
ccttgttcatgaucagtggatgtaauct

SEQ ID NO: 82255 - DNA, 25 bp, Artificial Sequence
  Synthetic
gccatcatugggttcatgttcugaa

SEQ ID NO: 82256 - DNA, 23 bp, Artificial Sequence
  Synthetic
ctctttctgcugttcactcucgt

SEQ ID NO: 82257 - DNA, 25 bp, Artificial Sequence
  Synthetic
gctttattcugcagccaactugaaa

SEQ ID NO: 82258 - DNA, 22 bp, Artificial Sequence
  Synthetic
cagcuccgagacaaacttguca

SEQ ID NO: 82259 - DNA, 20 bp, Artificial Sequence
  Synthetic
gagacccugugagcacacat

SEQ ID NO: 82260 - DNA, 22 bp, Artificial Sequence
  Synthetic
agaccggtuggctaaatcaugg

SEQ ID NO: 82261 - DNA, 24 bp, Artificial Sequence
  Synthetic
agatgatgtucccgtgtcttucag

SEQ ID NO: 82262 - DNA, 29 bp, Artificial Sequence
  Synthetic
tgcagaugaagccttaaauaaagacaaga

SEQ ID NO: 82263 - DNA, 28 bp, Artificial Sequence
  Synthetic
ccccaucaccctaacataaauaacaact

SEQ ID NO: 82264 - DNA, 21 bp, Artificial Sequence
  Synthetic
ggatgtccutcagctgucaca

SEQ ID NO: 82265 - DNA, 22 bp, Artificial Sequence
  Synthetic
ccgaauggcacauacacagagt

SEQ ID NO: 82266 - DNA, 25 bp, Artificial Sequence
  Synthetic
actgtgaagtcugacccctaaagua

SEQ ID NO: 82267 - DNA, 26 bp, Artificial Sequence
  Synthetic
ttgctggaactuttccaatgttgtut

SEQ ID NO: 82268 - DNA, 21 bp, Artificial Sequence
  Synthetic
tgtacgguccttgcaatguca

SEQ ID NO: 82269 - DNA, 26 bp, Artificial Sequence
  Synthetic
ctcttacatgccagutctctaggtut

SEQ ID NO: 82270 - DNA, 25 bp, Artificial Sequence
  Synthetic
gagcacaaggaguacacagtatuca

SEQ ID NO: 82271 - DNA, 21 bp, Artificial Sequence
  Synthetic
cactuggcagaacuccaggaa

SEQ ID NO: 82272 - DNA, 21 bp, Artificial Sequence
  Synthetic
aagagcagguaagcccttugg

SEQ ID NO: 82273 - DNA, 28 bp, Artificial Sequence
  Synthetic
gacgtggtgcuatgaacataagttuaat

SEQ ID NO: 82274 - DNA, 19 bp, Artificial Sequence
  Synthetic
gcctcggucccaatctcut

SEQ ID NO: 82275 - DNA, 26 bp, Artificial Sequence
  Synthetic
ggaccagccuaatttcttatcgtcuc

SEQ ID NO: 82276 - DNA, 26 bp, Artificial Sequence
  Synthetic
gcctctctucctttactttctucaca

SEQ ID NO: 82277 - DNA, 25 bp, Artificial Sequence
  Synthetic
agctcagctgutttctttccctuag

SEQ ID NO: 82278 - DNA, 25 bp, Artificial Sequence
  Synthetic
ccaugctagccttuaaaaagaaccc

SEQ ID NO: 82279 - DNA, 24 bp, Artificial Sequence
  Synthetic
gactgcucacagaaggaataugct

SEQ ID NO: 82280 - DNA, 26 bp, Artificial Sequence
  Synthetic
aatttcttggcauaaccagccattuc

SEQ ID NO: 82281 - DNA, 24 bp, Artificial Sequence
  Synthetic
gtugacaagcaagccatcaucaat

SEQ ID NO: 82282 - DNA, 24 bp, Artificial Sequence
  Synthetic
tgttacccauctttgctttcucca

SEQ ID NO: 82283 - DNA, 23 bp, Artificial Sequence
  Synthetic
tgttgtacugctggatgttucgt

SEQ ID NO: 82284 - DNA, 24 bp, Artificial Sequence
  Synthetic
gcttctttctcaugttggccttuc

SEQ ID NO: 82285 - DNA, 28 bp, Artificial Sequence
  Synthetic
tgctttucccccaagattataatuccat

SEQ ID NO: 82286 - DNA, 23 bp, Artificial Sequence
  Synthetic
catggcagguggaaatacgaaug

SEQ ID NO: 82287 - DNA, 26 bp, Artificial Sequence
  Synthetic
tcagaattaacugtgatgtggtgugg

SEQ ID NO: 82288 - DNA, 28 bp, Artificial Sequence
  Synthetic
tcaaaggtacaugagaaaggtgaaucaa

SEQ ID NO: 82289 - DNA, 29 bp, Artificial Sequence
  Synthetic
caccactgagcaaaugtttgaaattaugt

SEQ ID NO: 82290 - DNA, 21 bp, Artificial Sequence
  Synthetic
ccaccctcuggagcttctgua

SEQ ID NO: 82291 - DNA, 29 bp, Artificial Sequence
  Synthetic
ctccttgtgattgugatttctactctcut

SEQ ID NO: 82292 - DNA, 22 bp, Artificial Sequence
  Synthetic
cctgagacugttgcatcauggg

SEQ ID NO: 82293 - DNA, 28 bp, Artificial Sequence
  Synthetic
acagtctctttuggatttctgtttcugt

SEQ ID NO: 82294 - DNA, 21 bp, Artificial Sequence
  Synthetic
agctgtgagutgcatgagguc

SEQ ID NO: 82295 - DNA, 27 bp, Artificial Sequence
  Synthetic
gaggagatuttggatgattugcagaat

SEQ ID NO: 82296 - DNA, 18 bp, Artificial Sequence
  Synthetic
gagccuggactccccuct

SEQ ID NO: 82297 - DNA, 23 bp, Artificial Sequence
  Synthetic
gaugagacctuggccaaagagaa

SEQ ID NO: 82298 - DNA, 21 bp, Artificial Sequence
  Synthetic
cccatgcucagacatccucaa

SEQ ID NO: 82299 - DNA, 23 bp, Artificial Sequence
  Synthetic
gtttgcaugagtgaagcauggat

SEQ ID NO: 82300 - DNA, 22 bp, Artificial Sequence
  Synthetic
caaggagauggaacagguagca

SEQ ID NO: 82301 - DNA, 28 bp, Artificial Sequence
  Synthetic
cctctgacaggaugatctgactcauaaa

SEQ ID NO: 82302 - DNA, 24 bp, Artificial Sequence
  Synthetic
tgggaaaagcugtggtaatugact

SEQ ID NO: 82303 - DNA, 24 bp, Artificial Sequence
  Synthetic
gggcttgtggugtctactctuaga

SEQ ID NO: 82304 - DNA, 24 bp, Artificial Sequence
  Synthetic
aaaaagtcatuccttgtccuccgt

SEQ ID NO: 82305 - DNA, 25 bp, Artificial Sequence
  Synthetic
ctcactgagcagguacattacauga

SEQ ID NO: 82306 - DNA, 22 bp, Artificial Sequence
  Synthetic
tggcctctguttgctggattut

SEQ ID NO: 82307 - DNA, 24 bp, Artificial Sequence
  Synthetic
tttcttcctugccgtttcttccua

SEQ ID NO: 82308 - DNA, 22 bp, Artificial Sequence
  Synthetic
gagccccacacagauttccuat

SEQ ID NO: 82309 - DNA, 20 bp, Artificial Sequence
  Synthetic
cgagacatcaugcgggacuc

SEQ ID NO: 82310 - DNA, 20 bp, Artificial Sequence
  Synthetic
catgaggacacugcugacct

SEQ ID NO: 82311 - DNA, 22 bp, Artificial Sequence
  Synthetic
ccctccacccuaactcctcauc

SEQ ID NO: 82312 - DNA, 21 bp, Artificial Sequence
  Synthetic
ccgatcaucccgattcaugcc

SEQ ID NO: 82313 - DNA, 22 bp, Artificial Sequence
  Synthetic
gatgggaugggcctgtattcut

SEQ ID NO: 82314 - DNA, 29 bp, Artificial Sequence
  Synthetic
cagcttcaggguatatcatggtaaaaugt

SEQ ID NO: 82315 - DNA, 26 bp, Artificial Sequence
  Synthetic
gcgaccaugaacacactctttaatut

SEQ ID NO: 82316 - DNA, 20 bp, Artificial Sequence
  Synthetic
ggacatcctuccggcaaguc

SEQ ID NO: 82317 - DNA, 22 bp, Artificial Sequence
  Synthetic
gcagcutgctgaugagagaagt

SEQ ID NO: 82318 - DNA, 23 bp, Artificial Sequence
  Synthetic
cgctgccttuggagatgtaatuc

SEQ ID NO: 82319 - DNA, 21 bp, Artificial Sequence
  Synthetic
tttccccacaautguccccaa

SEQ ID NO: 82320 - DNA, 17 bp, Artificial Sequence
  Synthetic
cccgucccaggcttcuc

SEQ ID NO: 82321 - DNA, 18 bp, Artificial Sequence
  Synthetic
gcuccgagccaugcagaa

SEQ ID NO: 82322 - DNA, 25 bp, Artificial Sequence
  Synthetic
agaatgaagcaccaguttggaaaug

SEQ ID NO: 82323 - DNA, 28 bp, Artificial Sequence
  Synthetic
ctcatgctgtttuatgacagaaccaaut

SEQ ID NO: 82324 - DNA, 23 bp, Artificial Sequence
  Synthetic
gacctcccgauaaaacgctacut

SEQ ID NO: 82325 - DNA, 26 bp, Artificial Sequence
  Synthetic
tcattaatcccagcgcuttctacauc

SEQ ID NO: 82326 - DNA, 26 bp, Artificial Sequence
  Synthetic
gcttttcattttugctgtgctccuat

SEQ ID NO: 82327 - DNA, 21 bp, Artificial Sequence
  Synthetic
gagagcuggttgcaguagagg

SEQ ID NO: 82328 - DNA, 21 bp, Artificial Sequence
  Synthetic
tgaautcaugaccaccagcca

SEQ ID NO: 82329 - DNA, 21 bp, Artificial Sequence
  Synthetic
ccccaaagaggugtacgaugt

SEQ ID NO: 82330 - DNA, 20 bp, Artificial Sequence
  Synthetic
gcuggtccucagaaaaccga

SEQ ID NO: 82331 - DNA, 23 bp, Artificial Sequence
  Synthetic
ggaagcugtgguagaggaaggat

SEQ ID NO: 82332 - DNA, 22 bp, Artificial Sequence
  Synthetic
ccccttgctucgaaagacagut

SEQ ID NO: 82333 - DNA, 21 bp, Artificial Sequence
  Synthetic
gugatuaaggcccaacaccca

SEQ ID NO: 82334 - DNA, 20 bp, Artificial Sequence
  Synthetic
atgaucccgcacugagacac

SEQ ID NO: 82335 - DNA, 24 bp, Artificial Sequence
  Synthetic
gtacatttgacagcuctgggctua

SEQ ID NO: 82336 - DNA, 24 bp, Artificial Sequence
  Synthetic
gcctcaaaaaugacaatgugcaga

SEQ ID NO: 82337 - DNA, 24 bp, Artificial Sequence
  Synthetic
gtcccaagggutgtttctcttcua

SEQ ID NO: 82338 - DNA, 19 bp, Artificial Sequence
  Synthetic
cagggacugcacucaccaa

SEQ ID NO: 82339 - DNA, 24 bp, Artificial Sequence
  Synthetic
ccctgaccacugcttttcctttua

SEQ ID NO: 82340 - DNA, 21 bp, Artificial Sequence
  Synthetic
cagctccagcucatccctaut

SEQ ID NO: 82341 - DNA, 22 bp, Artificial Sequence
  Synthetic
ccaatgcataugggccttcucc

SEQ ID NO: 82342 - DNA, 19 bp, Artificial Sequence
  Synthetic
tgacccaagccgucaggua

SEQ ID NO: 82343 - DNA, 21 bp, Artificial Sequence
  Synthetic
cccccaaccccautcucaaag

SEQ ID NO: 82344 - DNA, 25 bp, Artificial Sequence
  Synthetic
gattcttttgcugtgggatcugaga

SEQ ID NO: 82345 - DNA, 23 bp, Artificial Sequence
  Synthetic
ctgccauaacagggctccauaaa

SEQ ID NO: 82346 - DNA, 20 bp, Artificial Sequence
  Synthetic
gatgtucaaccgctgctgug

SEQ ID NO: 82347 - DNA, 21 bp, Artificial Sequence
  Synthetic
aaggctgagcuttgggtguaa

SEQ ID NO: 82348 - DNA, 27 bp, Artificial Sequence
  Synthetic
gaaaagcacccagagauatttgugaac

SEQ ID NO: 82349 - DNA, 20 bp, Artificial Sequence
  Synthetic
aggaaugccctguccagact

SEQ ID NO: 82350 - DNA, 21 bp, Artificial Sequence
  Synthetic
gagcuccccgaaagagtaguc

SEQ ID NO: 82351 - DNA, 25 bp, Artificial Sequence
  Synthetic
ttgatgcaccauaagacctttcugt

SEQ ID NO: 82352 - DNA, 19 bp, Artificial Sequence
  Synthetic
cggccaugcagaaacugac

SEQ ID NO: 82353 - DNA, 24 bp, Artificial Sequence
  Synthetic
augccaaaagaaaaagugcccaat

SEQ ID NO: 82354 - DNA, 19 bp, Artificial Sequence
  Synthetic
ctcacccgugagcugagaa

SEQ ID NO: 82355 - DNA, 24 bp, Artificial Sequence
  Synthetic
caagaacaagcaugaggcaaugat

SEQ ID NO: 82356 - DNA, 27 bp, Artificial Sequence
  Synthetic
agtttaaacatutgctgagcucaacag

SEQ ID NO: 82357 - DNA, 24 bp, Artificial Sequence
  Synthetic
ccaacccccuaaatgggcaataua

SEQ ID NO: 82358 - DNA, 21 bp, Artificial Sequence
  Synthetic
ccctcaccutccaagtcagug

SEQ ID NO: 82359 - DNA, 23 bp, Artificial Sequence
  Synthetic
ccaacactaaaugccagccuact

SEQ ID NO: 82360 - DNA, 20 bp, Artificial Sequence
  Synthetic
ccttgctucggcctcagtua

SEQ ID NO: 82361 - DNA, 28 bp, Artificial Sequence
  Synthetic
gggctgaagaaagugataatttgctuat

SEQ ID NO: 82362 - DNA, 22 bp, Artificial Sequence
  Synthetic
ggttcuccagagagctgtgtut

SEQ ID NO: 82363 - DNA, 24 bp, Artificial Sequence
  Synthetic
gcatttctagcuctgtgacacuca

SEQ ID NO: 82364 - DNA, 18 bp, Artificial Sequence
  Synthetic
cctcctucgggcaccuct

SEQ ID NO: 82365 - DNA, 18 bp, Artificial Sequence
  Synthetic
gctucacgggcagcuact

SEQ ID NO: 82366 - DNA, 20 bp, Artificial Sequence
  Synthetic
gcactcautgacatcgugct

SEQ ID NO: 82367 - DNA, 19 bp, Artificial Sequence
  Synthetic
caccaaugccctccacuca

SEQ ID NO: 82368 - DNA, 28 bp, Artificial Sequence
  Synthetic
tgtcatggaagaaaugttggauaaagca

SEQ ID NO: 82369 - DNA, 22 bp, Artificial Sequence
  Synthetic
atggatccucctccacucacat

SEQ ID NO: 82370 - DNA, 20 bp, Artificial Sequence
  Synthetic
gggtcccucaggtaccauca

SEQ ID NO: 82371 - DNA, 26 bp, Artificial Sequence
  Synthetic
tgttttctacgutgttgtcatugcag

SEQ ID NO: 82372 - DNA, 23 bp, Artificial Sequence
  Synthetic
gcugaaagcctucacaagaccat

SEQ ID NO: 82373 - DNA, 21 bp, Artificial Sequence
  Synthetic
ccaggccagaautgcttcuct

SEQ ID NO: 82374 - DNA, 20 bp, Artificial Sequence
  Synthetic
cagccccuttgtagcctugt

SEQ ID NO: 82375 - DNA, 27 bp, Artificial Sequence
  Synthetic
gacattttctcutagttgtccttugcc

SEQ ID NO: 82376 - DNA, 28 bp, Artificial Sequence
  Synthetic
aaaagccttctaaagugactgacactua

SEQ ID NO: 82377 - DNA, 22 bp, Artificial Sequence
  Synthetic
ctggacaggcauctttgttugg

SEQ ID NO: 82378 - DNA, 27 bp, Artificial Sequence
  Synthetic
ctgagatgcacaauaaaacagtuagcc

SEQ ID NO: 82379 - DNA, 27 bp, Artificial Sequence
  Synthetic
gtttcatcctucttctcctgttugaga

SEQ ID NO: 82380 - DNA, 22 bp, Artificial Sequence
  Synthetic
gggtcagagutgagatgggaua

SEQ ID NO: 82381 - DNA, 20 bp, Artificial Sequence
  Synthetic
gaggactucctgcctuccac

SEQ ID NO: 82382 - DNA, 25 bp, Artificial Sequence
  Synthetic
cggagutttggaauagaggacaaag

SEQ ID NO: 82383 - DNA, 21 bp, Artificial Sequence
  Synthetic
cctgtaaacugaaggcggcua

SEQ ID NO: 82384 - DNA, 26 bp, Artificial Sequence
  Synthetic
gcaaaataatgaugtgccagtctuca

SEQ ID NO: 82385 - DNA, 21 bp, Artificial Sequence
  Synthetic
tcatggccugctctcatcuct

SEQ ID NO: 82386 - DNA, 27 bp, Artificial Sequence
  Synthetic
gtgggatgtattugaagcacctgaaua

SEQ ID NO: 82387 - DNA, 27 bp, Artificial Sequence
  Synthetic
tctcaaacacaaacuagagucacacac

SEQ ID NO: 82388 - DNA, 25 bp, Artificial Sequence
  Synthetic
ccctccaatcutaggttggttgtuc

SEQ ID NO: 82389 - DNA, 23 bp, Artificial Sequence
  Synthetic
guaactgacctcuggcacaacat

SEQ ID NO: 82390 - DNA, 23 bp, Artificial Sequence
  Synthetic
ggaatggaucaacatgacuggct

SEQ ID NO: 82391 - DNA, 23 bp, Artificial Sequence
  Synthetic
gtgtatctgcguttccctcugaa

SEQ ID NO: 82392 - DNA, 28 bp, Artificial Sequence
  Synthetic
caagtaguaaagacaacagggactucag

SEQ ID NO: 82393 - DNA, 24 bp, Artificial Sequence
  Synthetic
catctctuccccctcctgtttuag

SEQ ID NO: 82394 - DNA, 22 bp, Artificial Sequence
  Synthetic
gctggctcuaaatcccaccuaa

SEQ ID NO: 82395 - DNA, 23 bp, Artificial Sequence
  Synthetic
gatcctcugggagatctucacct

SEQ ID NO: 82396 - DNA, 23 bp, Artificial Sequence
  Synthetic
cagtcagugaacgtaagggtuct

SEQ ID NO: 82397 - DNA, 28 bp, Artificial Sequence
  Synthetic
cagatccttaacautggtccgtattuga

SEQ ID NO: 82398 - DNA, 18 bp, Artificial Sequence
  Synthetic
gggaagcugcacgcugat

SEQ ID NO: 82399 - DNA, 20 bp, Artificial Sequence
  Synthetic
tgaagaccccucccaagcua

SEQ ID NO: 82400 - DNA, 20 bp, Artificial Sequence
  Synthetic
tggcccccaugctaattuga

SEQ ID NO: 82401 - DNA, 23 bp, Artificial Sequence
  Synthetic
ggtgtctgacugtgacttcucct

SEQ ID NO: 82402 - DNA, 25 bp, Artificial Sequence
  Synthetic
tgaaaagatcatgucaggactgcut

SEQ ID NO: 82403 - DNA, 20 bp, Artificial Sequence
  Synthetic
caaggcaaugaugccacagt

SEQ ID NO: 82404 - DNA, 21 bp, Artificial Sequence
  Synthetic
ctgagacucaggcacugacaa

SEQ ID NO: 82405 - DNA, 25 bp, Artificial Sequence
  Synthetic
gaacctgcttugatgacataagugg

SEQ ID NO: 82406 - DNA, 27 bp, Artificial Sequence
  Synthetic
tctaaccaaaccugcaacacuaaaact

SEQ ID NO: 82407 - DNA, 24 bp, Artificial Sequence
  Synthetic
cagttgcugcaaactggttuaaga

SEQ ID NO: 82408 - DNA, 23 bp, Artificial Sequence
  Synthetic
gcagatacaccugtcagcaaaut

SEQ ID NO: 82409 - DNA, 28 bp, Artificial Sequence
  Synthetic
gtuaaatagcattggauacagagcagga

SEQ ID NO: 82410 - DNA, 27 bp, Artificial Sequence
  Synthetic
tgttgattgguagcagaaagugaaact

SEQ ID NO: 82411 - DNA, 29 bp, Artificial Sequence
  Synthetic
aaagcctgccuacttaagatcaattuact

SEQ ID NO: 82412 - DNA, 21 bp, Artificial Sequence
  Synthetic
ccatcaguagcatcacccuct

SEQ ID NO: 82413 - DNA, 27 bp, Artificial Sequence
  Synthetic
tccttttcttgtuccctacctctttut

SEQ ID NO: 82414 - DNA, 25 bp, Artificial Sequence
  Synthetic
cugacaguaaaaggaaaagcaacca

SEQ ID NO: 82415 - DNA, 22 bp, Artificial Sequence
  Synthetic
gaggacccagguaugcaagaag

SEQ ID NO: 82416 - DNA, 28 bp, Artificial Sequence
  Synthetic
tcctgctctguatccaatgctattuaac

SEQ ID NO: 82417 - DNA, 30 bp, Artificial Sequence; identical to SEQ ID NO: 57731
  Synthetic

SEQ ID NO: 82418 - DNA, 24 bp, Artificial Sequence
  Synthetic
tgatacaccaaaaucggcaagcua

SEQ ID NO: 82419 - DNA, 27 bp, Artificial Sequence
  Synthetic
actaatgacgtcuggttttctcacaut

SEQ ID NO: 82420 - DNA, 21 bp, Artificial Sequence
  Synthetic
agcacacaguggcaagtguag

SEQ ID NO: 82421 - DNA, 27 bp, Artificial Sequence
  Synthetic
tgaggctgucagaaagttttactgtut

SEQ ID NO: 82422 - DNA, 25 bp, Artificial Sequence
  Synthetic
acgacctuttgataagauggcaaca

SEQ ID NO: 82423 - DNA, 28 bp, Artificial Sequence
  Synthetic
cttcucaaccaaaaagaaagcaaucaac

SEQ ID NO: 82424 - DNA, 21 bp, Artificial Sequence
  Synthetic
ggaaaagugaucacccgggaa

SEQ ID NO: 82425 - DNA, 27 bp, Artificial Sequence
  Synthetic
ccctgatctgucttctgtttcucaaag

SEQ ID NO: 82426 - DNA, 28 bp, Artificial Sequence
  Synthetic
acaattggaactuacttagctactgcut

SEQ ID NO: 82427 - DNA, 28 bp, Artificial Sequence
  Synthetic
ttgagctacaataguataatggccacug

SEQ ID NO: 82428 - DNA, 23 bp, Artificial Sequence
  Synthetic
caacagaacuctgtagctuccca

SEQ ID NO: 82429 - DNA, 25 bp, Artificial Sequence
  Synthetic
tccagtcagagcuacaaatcuacga

SEQ ID NO: 82430 - DNA, 20 bp, Artificial Sequence
  Synthetic
ggctgaaacgutctgccuca

SEQ ID NO: 82431 - DNA, 26 bp, Artificial Sequence
  Synthetic
ccagagcatgugcaagagatactuac

SEQ ID NO: 82432 - DNA, 22 bp, Artificial Sequence
  Synthetic
ctccugaggagauggagaagga

SEQ ID NO: 82433 - DNA, 28 bp, Artificial Sequence
  Synthetic
catctgcatttggutctagcaacaauac

SEQ ID NO: 82434 - DNA, 22 bp, Artificial Sequence
  Synthetic
ccctgagaucagcuggagaagt

SEQ ID NO: 82435 - DNA, 19 bp, Artificial Sequence
  Synthetic
ccagcgcaucgtagaccug

SEQ ID NO: 82436 - DNA, 23 bp, Artificial Sequence
  Synthetic
cugatccgtgcuaaggaagaaga

SEQ ID NO: 82437 - DNA, 28 bp, Artificial Sequence
  Synthetic
agacactcatcuacagagctagcatuat

SEQ ID NO: 82438 - DNA, 21 bp, Artificial Sequence
  Synthetic
ggaaccauggctgcttuccat

SEQ ID NO: 82439 - DNA, 25 bp, Artificial Sequence
  Synthetic
gtgcctctatcucaacccctttuag

SEQ ID NO: 82440 - DNA, 24 bp, Artificial Sequence
  Synthetic
tcttggaatugccataaagugcct

SEQ ID NO: 82441 - DNA, 19 bp, Artificial Sequence
  Synthetic
gctctggugtggctgagua

SEQ ID NO: 82442 - DNA, 22 bp, Artificial Sequence
  Synthetic
tgaattuccaaagaggccucca

SEQ ID NO: 82443 - DNA, 28 bp, Artificial Sequence
  Synthetic
gccttttcattuggtcatcttacguaga

SEQ ID NO: 82444 - DNA, 17 bp, Artificial Sequence
  Synthetic
tugggcacgcuagagga

SEQ ID NO: 82445 - DNA, 26 bp, Artificial Sequence
  Synthetic
gcattctugaaaagggaauacagcaa

SEQ ID NO: 82446 - DNA, 19 bp, Artificial Sequence
  Synthetic
gatgucgcagggcctuaca

SEQ ID NO: 82447 - DNA, 21 bp, Artificial Sequence
  Synthetic
ccacccaaacucctaccugac

SEQ ID NO: 82448 - DNA, 20 bp, Artificial Sequence
  Synthetic
acttaccugaaggcgggcua

SEQ ID NO: 82449 - DNA, 22 bp, Artificial Sequence
  Synthetic
ccttccctcugactccacctut

SEQ ID NO: 82450 - DNA, 22 bp, Artificial Sequence
  Synthetic
aaagccgugataugaagccact

SEQ ID NO: 82451 - DNA, 19 bp, Artificial Sequence
  Synthetic
augtgtccauggcgaccaa

SEQ ID NO: 82452 - DNA, 23 bp, Artificial Sequence
  Synthetic
acagtccucccaatcugaagagt

SEQ ID NO: 82453 - DNA, 22 bp, Artificial Sequence
  Synthetic
accaaattuagccgtuggcaga

SEQ ID NO: 82454 - DNA, 33 bp, Artificial Sequence
  Synthetic
attacttactaattaaucatggccaactcatut

SEQ ID NO: 82455 - DNA, 25 bp, Artificial Sequence
  Synthetic
caaaggaagauaccgaccaugaaga

SEQ ID NO: 82456 - DNA, 25 bp, Artificial Sequence
  Synthetic
agaacataccucattgctggcttut

SEQ ID NO: 82457 - DNA, 27 bp, Artificial Sequence
  Synthetic
attaatagagutgattgcucacaggca

SEQ ID NO: 82458 - DNA, 28 bp, Artificial Sequence
  Synthetic
attttctactctgcucataatgcgtcut

SEQ ID NO: 82459 - DNA, 22 bp, Artificial Sequence
  Synthetic
cagtaggutttctgccuccaca

SEQ ID NO: 82460 - DNA, 22 bp, Artificial Sequence
  Synthetic
tcatctggtucatgctgcucat

SEQ ID NO: 82461 - DNA, 25 bp, Artificial Sequence
  Synthetic
accagcaagcugtaacattcatuca

SEQ ID NO: 82462 - DNA, 22 bp, Artificial Sequence
  Synthetic
cactgttccuctcctctcccua

SEQ ID NO: 82463 - DNA, 21 bp, Artificial Sequence
  Synthetic
tgaacttgucagccaccaugt

SEQ ID NO: 82464 - DNA, 24 bp, Artificial Sequence
  Synthetic
tcatgtaagcutaaacagcguggt

SEQ ID NO: 82465 - DNA, 23 bp, Artificial Sequence
  Synthetic
tgctgaagttutggcaggtttuc

SEQ ID NO: 82466 - DNA, 26 bp, Artificial Sequence
  Synthetic
agatggttucacccaaatatcacugg

SEQ ID NO: 82467 - DNA, 27 bp, Artificial Sequence
  Synthetic
acactctcaggaucctctcttttcaut

SEQ ID NO: 82468 - DNA, 30 bp, Artificial Sequence; identical to SEQ ID NO: 52016
  Synthetic

SEQ ID NO: 82469 - DNA, 23 bp, Artificial Sequence
  Synthetic
agcttgcaugactgccttaugaa

SEQ ID NO: 82470 - DNA, 26 bp, Artificial Sequence
  Synthetic
ctgctgaatgauactctcttgtucct

SEQ ID NO: 82471 - DNA, 29 bp, Artificial Sequence
  Synthetic
gactgattattgcuctctttatggctgua

SEQ ID NO: 82472 - DNA, 22 bp, Artificial Sequence
  Synthetic
ccagggttuaggactgatgugt

SEQ ID NO: 82473 - DNA, 20 bp, Artificial Sequence
  Synthetic
ggacggcaucaatggctuca

SEQ ID NO: 82474 - DNA, 28 bp, Artificial Sequence
  Synthetic
tgctgtttgguaacttgagtatatcugg

SEQ ID NO: 82475 - DNA, 25 bp, Artificial Sequence
  Synthetic
tgttttggguacactccagttgaug

SEQ ID NO: 82476 - DNA, 22 bp, Artificial Sequence
  Synthetic
ggacagaaggutggctugagaa

SEQ ID NO: 82477 - DNA, 25 bp, Artificial Sequence
  Synthetic
aaatcagtaagutacctgctuggct

SEQ ID NO: 82478 - DNA, 27 bp, Artificial Sequence
  Synthetic
gggaagugaaagaacttgaaagatuca

SEQ ID NO: 82479 - DNA, 25 bp, Artificial Sequence
  Synthetic
ctgtgatttggcutccatcaatucc

SEQ ID NO: 82480 - DNA, 20 bp, Artificial Sequence
  Synthetic
gccgcugaagacaagtccug

SEQ ID NO: 82481 - DNA, 21 bp, Artificial Sequence
  Synthetic
ccaatggtuccatcggccuaa

SEQ ID NO: 82482 - DNA, 21 bp, Artificial Sequence
  Synthetic
cucattgaccucagacaggca

SEQ ID NO: 82483 - DNA, 18 bp, Artificial Sequence
  Synthetic
ccugccctuagggagcat

SEQ ID NO: 82484 - DNA, 17 bp, Artificial Sequence
  Synthetic
ccgccccucccacauag

SEQ ID NO: 82485 - DNA, 18 bp, Artificial Sequence
  Synthetic
caggucccaacugccaga

SEQ ID NO: 82486 - DNA, 22 bp, Artificial Sequence
  Synthetic
cagccugaagaaggagatggug

SEQ ID NO: 82487 - DNA, 25 bp, Artificial Sequence
  Synthetic
cctatcctagucctgtcatggguat

SEQ ID NO: 82488 - DNA, 26 bp, Artificial Sequence
  Synthetic
cacactcaucgatgttgatgtuacac

SEQ ID NO: 82489 - DNA, 22 bp, Artificial Sequence
  Synthetic
ggtttcugacaccuggaaggat

SEQ ID NO: 82490 - DNA, 23 bp, Artificial Sequence
  Synthetic
tgggaaaauacaacacugcccat

SEQ ID NO: 82491 - DNA, 21 bp, Artificial Sequence
  Synthetic
ggccaauggcatggagttuct

SEQ ID NO: 82492 - DNA, 24 bp, Artificial Sequence
  Synthetic
ttgggccagutcaattgtctuact

SEQ ID NO: 82493 - DNA, 29 bp, Artificial Sequence
  Synthetic
acaagcaatgagutacaaaatcgacttuc

SEQ ID NO: 82494 - DNA, 21 bp, Artificial Sequence
  Synthetic
gacgcacacucgttgatgtug

SEQ ID NO: 82495 - DNA, 22 bp, Artificial Sequence
  Synthetic
tctggcucttggagaugaggag

SEQ ID NO: 82496 - DNA, 22 bp, Artificial Sequence
  Synthetic
tggagaaguctgaacacugcac

SEQ ID NO: 82497 - DNA, 23 bp, Artificial Sequence
  Synthetic
ttatttctgugcccaccttucca

SEQ ID NO: 82498 - DNA, 28 bp, Artificial Sequence
  Synthetic
caaccaaaggacacaaugagattagaug

SEQ ID NO: 82499 - DNA, 26 bp, Artificial Sequence
  Synthetic
agcugagagaaaauaaaaccccagag

SEQ ID NO: 82500 - DNA, 28 bp, Artificial Sequence
  Synthetic
tgcgttctcttutcaaaactgttttuca

SEQ ID NO: 82501 - DNA, 28 bp, Artificial Sequence
  Synthetic
aacaaagcaagucatgcattttccuaaa

SEQ ID NO: 82502 - DNA, 21 bp, Artificial Sequence
  Synthetic
caccacacguacgttctugga

SEQ ID NO: 82503 - DNA, 22 bp, Artificial Sequence
  Synthetic
gtgaccctcugcttctcctcua

SEQ ID NO: 82504 - DNA, 22 bp, Artificial Sequence
  Synthetic
tgcagcugaacttcggaatuct

SEQ ID NO: 82505 - DNA, 28 bp, Artificial Sequence
  Synthetic
tcatattacttcaguagtcccatgugga

SEQ ID NO: 82506 - DNA, 28 bp, Artificial Sequence
  Synthetic
tcatccaaggtuttcatcttgacttugt

SEQ ID NO: 82507 - DNA, 28 bp, Artificial Sequence
  Synthetic
cctctaactgacaugcatggagatagua

SEQ ID NO: 82508 - DNA, 27 bp, Artificial Sequence
  Synthetic
tgtggtctaaugcattcaactauccaa

SEQ ID NO: 82509 - DNA, 21 bp, Artificial Sequence
  Synthetic
gccctcuagcagtctggtuac

SEQ ID NO: 82510 - DNA, 23 bp, Artificial Sequence
  Synthetic
catacccatcucctaacggctut

SEQ ID NO: 82511 - DNA, 23 bp, Artificial Sequence
  Synthetic
agctctttctutggcttctcugg

SEQ ID NO: 82512 - DNA, 27 bp, Artificial Sequence
  Synthetic
ttgctgttctttutggcttcatttgua

SEQ ID NO: 82513 - DNA, 28 bp, Artificial Sequence
  Synthetic
ccttttggactuacattggtgatgatuc

SEQ ID NO: 82514 - DNA, 26 bp, Artificial Sequence
  Synthetic
tggctcagaatucaccttctacatut

SEQ ID NO: 82515 - DNA, 26 bp, Artificial Sequence
  Synthetic
aaccttttugaaaaccaagagugcat

SEQ ID NO: 82516 - DNA, 20 bp, Artificial Sequence
  Synthetic
ccccaguctgtcuccaaacc

SEQ ID NO: 82517 - DNA, 23 bp, Artificial Sequence
  Synthetic
gggaggtuagtgaacttgcugac

SEQ ID NO: 82518 - DNA, 19 bp, Artificial Sequence
  Synthetic
tcaaugcagccagcgcuaa

SEQ ID NO: 82519 - DNA, 23 bp, Artificial Sequence
  Synthetic
gggauccactgugagaacaacac

SEQ ID NO: 82520 - DNA, 19 bp, Artificial Sequence
  Synthetic
catgccccaagcuccuagt

SEQ ID NO: 82521 - DNA, 21 bp, Artificial Sequence
  Synthetic
gcugcagcaaagaagaagcug

SEQ ID NO: 82522 - DNA, 20 bp, Artificial Sequence
  Synthetic
cacacctcuctgtgcaguca

SEQ ID NO: 82523 - DNA, 23 bp, Artificial Sequence
  Synthetic
gcactttctgugaggaggacauc

SEQ ID NO: 82524 - DNA, 28 bp, Artificial Sequence
  Synthetic
caagtcatgcugtttacattcacuaagg

SEQ ID NO: 82525 - DNA, 29 bp, Artificial Sequence
  Synthetic
cacccattgagucattcactttuaaagaa

SEQ ID NO: 82526 - DNA, 21 bp, Artificial Sequence
  Synthetic
gauagcttccugagccaccac

SEQ ID NO: 82527 - DNA, 28 bp, Artificial Sequence
  Synthetic
gccugtaagataatgauagacagcaaca

SEQ ID NO: 82528 - DNA, 19 bp, Artificial Sequence
  Synthetic
ggtcacuggcacactcgut

SEQ ID NO: 82529 - DNA, 19 bp, Artificial Sequence
  Synthetic
ctcacacucaccctuccgt

SEQ ID NO: 82530 - DNA, 23 bp, Artificial Sequence
  Synthetic
cccatuaccagcacttcaguacc

SEQ ID NO: 82531 - DNA, 28 bp, Artificial Sequence
  Synthetic
gagcattatttgugccagacttgtttua

SEQ ID NO: 82532 - DNA, 22 bp, Artificial Sequence
  Synthetic
gggaccaccuttgtcttucgag

SEQ ID NO: 82533 - DNA, 28 bp, Artificial Sequence
  Synthetic
cacacactuccaaccttatttaatgcut

SEQ ID NO: 82534 - DNA, 21 bp, Artificial Sequence
  Synthetic
gggataggugaagggccttut

SEQ ID NO: 82535 - DNA, 25 bp, Artificial Sequence
  Synthetic
acacttagagcucagactgacctut

SEQ ID NO: 82536 - DNA, 21 bp, Artificial Sequence
  Synthetic
gcctgaagcuccaggtcttuc

SEQ ID NO: 82537 - DNA, 22 bp, Artificial Sequence
  Synthetic
gggcagcacacauctctatucc

SEQ ID NO: 82538 - DNA, 28 bp, Artificial Sequence
  Synthetic
tgattttcattttcugtaggcatgguga

SEQ ID NO: 82539 - DNA, 25 bp, Artificial Sequence
  Synthetic
tgcttcaaagccuttccttcactua

SEQ ID NO: 82540 - DNA, 28 bp, Artificial Sequence
  Synthetic
cctttggagcauatccattattgacuga

SEQ ID NO: 82541 - DNA, 28 bp, Artificial Sequence
  Synthetic
ggaagcuaggttgauaacagaagagaat

SEQ ID NO: 82542 - DNA, 28 bp, Artificial Sequence
  Synthetic
tgttattcctgtaucaacaacacacgut

SEQ ID NO: 82543 - DNA, 27 bp, Artificial Sequence
  Synthetic
cataagaaattgagutccgcagttguc

SEQ ID NO: 82544 - DNA, 26 bp, Artificial Sequence
  Synthetic
ctcttctgttaucaacctagctuccc

SEQ ID NO: 82545 - DNA, 26 bp, Artificial Sequence
  Synthetic
agtagcaccaagucttcttgaatugt

SEQ ID NO: 82546 - DNA, 20 bp, Artificial Sequence
  Synthetic
aggagtgugctgttgugcaa

SEQ ID NO: 82547 - DNA, 24 bp, Artificial Sequence
  Synthetic
ctgaagatcaugagtcacctuggg

SEQ ID NO: 82548 - DNA, 20 bp, Artificial Sequence
  Synthetic
cccaacaggutgaccacgut

SEQ ID NO: 82549 - DNA, 22 bp, Artificial Sequence
  Synthetic
gagtcagaauaggctcctgugg

SEQ ID NO: 82550 - DNA, 28 bp, Artificial Sequence
  Synthetic
tgtcatcaagaagautctaattggccut

SEQ ID NO: 82551 - DNA, 25 bp, Artificial Sequence
  Synthetic
gcatccaaatugcaaacacagtuca

SEQ ID NO: 82552 - DNA, 26 bp, Artificial Sequence
  Synthetic
aacaggttcacuggtttgttgattug

SEQ ID NO: 82553 - DNA, 24 bp, Artificial Sequence
  Synthetic
ccctgaaccacacutcaacctuaa

SEQ ID NO: 82554 - DNA, 33 bp, Artificial Sequence
  Synthetic
aaatgagactauaactctctacuaagaagaact

SEQ ID NO: 82555 - DNA, 28 bp, Artificial Sequence
  Synthetic
ggaagagcatuaagaagttggtttugaa

SEQ ID NO: 82556 - DNA, 25 bp, Artificial Sequence
  Synthetic
ggcatgtgttuctacagagctgaut

SEQ ID NO: 82557 - DNA, 25 bp, Artificial Sequence
  Synthetic
actaaacaautcgacagtucaggca

SEQ ID NO: 82558 - DNA, 27 bp, Artificial Sequence
  Synthetic
acgatuaacaggagaaaagagatugct

SEQ ID NO: 82559 - DNA, 21 bp, Artificial Sequence
  Synthetic
agtugagcagaagugcaccat

SEQ ID NO: 82560 - DNA, 25 bp, Artificial Sequence
  Synthetic
ctttgaaauaacaccaccagtgguc

SEQ ID NO: 82561 - DNA, 27 bp, Artificial Sequence
  Synthetic
gcaactgcacuaaagaggacaaacuaa

SEQ ID NO: 82562 - DNA, 27 bp, Artificial Sequence
  Synthetic
acagtgttagaaaaaugtggctcucat

SEQ ID NO: 82563 - DNA, 27 bp, Artificial Sequence
  Synthetic
cagggacctguttttaggtactguaaa

SEQ ID NO: 82564 - DNA, 21 bp, Artificial Sequence
  Synthetic
tggcuacgacccagtuaccat

SEQ ID NO: 82565 - DNA, 28 bp, Artificial Sequence
  Synthetic
ccactggtctauaatccagatgattcut

SEQ ID NO: 82566 - DNA, 17 bp, Artificial Sequence
  Synthetic
cccccaacccggucauc

SEQ ID NO: 82567 - DNA, 17 bp, Artificial Sequence
  Synthetic
ggacugggcgguggaac

SEQ ID NO: 82568 - DNA, 17 bp, Artificial Sequence
  Synthetic
ggtuccaccgcccaguc

SEQ ID NO: 82569 - DNA, 18 bp, Artificial Sequence
  Synthetic
gcgcutgtucacgggaaa

SEQ ID NO: 82570 - DNA, 19 bp, Artificial Sequence
  Synthetic
gaccacaaggcccucagua

SEQ ID NO: 82571 - DNA, 24 bp, Artificial Sequence
  Synthetic
agacauacgagcacuaacaaaggg

SEQ ID NO: 82572 - DNA, 28 bp, Artificial Sequence
  Synthetic
agaagaugaagacaatgttcucaaagca

SEQ ID NO: 82573 - DNA, 28 bp, Artificial Sequence
  Synthetic
ccaaagatgacaguttttcagtgaauga

SEQ ID NO: 82574 - DNA, 28 bp, Artificial Sequence
  Synthetic
tccttagaaguacaccugagaagaaaca

SEQ ID NO: 82575 - DNA, 27 bp, Artificial Sequence
  Synthetic
ccacagagcaagaaaaautgagctuaa

SEQ ID NO: 82576 - DNA, 26 bp, Artificial Sequence
  Synthetic
cttgacatttaatugaagcgcaggut

SEQ ID NO: 82577 - DNA, 26 bp, Artificial Sequence
  Synthetic
cacattcttttcaauggctttggcua

SEQ ID NO: 82578 - DNA, 29 bp, Artificial Sequence
  Synthetic
cagtcagaggcgcuatgtgtattattaua

SEQ ID NO: 82579 - DNA, 26 bp, Artificial Sequence
  Synthetic
acatggaaggaugagaattucaagca

SEQ ID NO: 82580 - DNA, 19 bp, Artificial Sequence
  Synthetic
gagcccccagugctttuct

SEQ ID NO: 82581 - DNA, 18 bp, Artificial Sequence
  Synthetic
gagucccagcgcaucaac

SEQ ID NO: 82582 - DNA, 21 bp, Artificial Sequence
  Synthetic
agttgtgcugttgctgaugga

SEQ ID NO: 82583 - DNA, 26 bp, Artificial Sequence
  Synthetic
cttctcttgauctcttttcucggaca

SEQ ID NO: 82584 - DNA, 17 bp, Artificial Sequence
  Synthetic
gcagctucctgcggtug

SEQ ID NO: 82585 - DNA, 21 bp, Artificial Sequence
  Synthetic
cctaaccaccccuccaacuct

SEQ ID NO: 82586 - DNA, 23 bp, Artificial Sequence
  Synthetic
agattacaagacaauggccgcut

SEQ ID NO: 82587 - DNA, 28 bp, Artificial Sequence
  Synthetic
ggatcacacccutacttgaaaaatagug

SEQ ID NO: 82588 - DNA, 23 bp, Artificial Sequence
  Synthetic
tgctugaaggagaggaaaugcaa

SEQ ID NO: 82589 - DNA, 17 bp, Artificial Sequence
  Synthetic
ccgccuacgacaagcug

SEQ ID NO: 82590 - DNA, 29 bp, Artificial Sequence
  Synthetic
ggtaaacttcugtggttctcttauaacga

SEQ ID NO: 82591 - DNA, 25 bp, Artificial Sequence
  Synthetic
ccattacctugggatcgtguacaaa

SEQ ID NO: 82592 - DNA, 21 bp, Artificial Sequence
  Synthetic
ttgcaggguggtatgtggtut

SEQ ID NO: 82593 - DNA, 24 bp, Artificial Sequence
  Synthetic
gcccucaaggctcctaugaaaaag

SEQ ID NO: 82594 - DNA, 28 bp, Artificial Sequence
  Synthetic
gtgctttttgaugcttttgtttatugag

SEQ ID NO: 82595 - DNA, 17 bp, Artificial Sequence
  Synthetic
ccagcagcucucaggga

SEQ ID NO: 82596 - DNA, 28 bp, Artificial Sequence
  Synthetic
gggaagatttagugaggaagtgcattua

SEQ ID NO: 82597 - DNA, 33 bp, Artificial Sequence
  Synthetic
agataagggutaatgaaaataatugagagagaa

SEQ ID NO: 82598 - DNA, 28 bp, Artificial Sequence
  Synthetic
ccaggaaatgaaauagaaacaggaccut

SEQ ID NO: 82599 - DNA, 20 bp, Artificial Sequence
  Synthetic
agaggcucaccagcaaacuc

SEQ ID NO: 82600 - DNA, 19 bp, Artificial Sequence
  Synthetic
gccgcgucttggtcttcuc

SEQ ID NO: 82601 - DNA, 18 bp, Artificial Sequence
  Synthetic
ccagguggccgacaugaa

SEQ ID NO: 82602 - DNA, 27 bp, Artificial Sequence
  Synthetic
ctttctgaaacugatcacactctcuct

SEQ ID NO: 82603 - DNA, 26 bp, Artificial Sequence
  Synthetic
ggctgggtgautgtattagcatttut

SEQ ID NO: 82604 - DNA, 22 bp, Artificial Sequence
  Synthetic
atgtgaagagcaucagcctgut

SEQ ID NO: 82605 - DNA, 26 bp, Artificial Sequence
  Synthetic
tgaaaggagacgucaaataugcagac

SEQ ID NO: 82606 - DNA, 21 bp, Artificial Sequence
  Synthetic
gcctccuaggatgcaactcua

SEQ ID NO: 82607 - DNA, 21 bp, Artificial Sequence
  Synthetic
cgaacatcauctggtcugcct

SEQ ID NO: 82608 - DNA, 23 bp, Artificial Sequence
  Synthetic
ccacactgucctccatcttctut

SEQ ID NO: 82609 - DNA, 21 bp, Artificial Sequence
  Synthetic
ttcataacugggcagauccct

SEQ ID NO: 82610 - DNA, 22 bp, Artificial Sequence
  Synthetic
agccagaggaaaugggttgtut

SEQ ID NO: 82611 - DNA, 19 bp, Artificial Sequence
  Synthetic
gagctgtucggcatgaugg

SEQ ID NO: 82612 - DNA, 22 bp, Artificial Sequence
  Synthetic
ccatgtagutggaggacucgat

SEQ ID NO: 82613 - DNA, 22 bp, Artificial Sequence
  Synthetic
ctcctgtgaugctccttuaccc

SEQ ID NO: 82614 - DNA, 19 bp, Artificial Sequence
  Synthetic
tcttttgcaugccggguga

SEQ ID NO: 82615 - DNA, 28 bp, Artificial Sequence
  Synthetic
ccataagttagctuccactctttccaua

SEQ ID NO: 82616 - DNA, 23 bp, Artificial Sequence
  Synthetic
cagaaccaucaggacccatguaa

SEQ ID NO: 82617 - DNA, 20 bp, Artificial Sequence
  Synthetic
gctcagguttgggtuccaca

SEQ ID NO: 82618 - DNA, 22 bp, Artificial Sequence
  Synthetic
tgctcacctuttgaggtctcug

SEQ ID NO: 82619 - DNA, 23 bp, Artificial Sequence
  Synthetic
tcctaacucagtgctctcuccat

SEQ ID NO: 82620 - DNA, 24 bp, Artificial Sequence
  Synthetic
ttcgtccagcaacutctgtagaug

SEQ ID NO: 82621 - DNA, 29 bp, Artificial Sequence
  Synthetic
cgggcctttctucatccatattacttuat

SEQ ID NO: 82622 - DNA, 23 bp, Artificial Sequence
  Synthetic
gcactgagcutgattccgaugag

SEQ ID NO: 82623 - DNA, 22 bp, Artificial Sequence
  Synthetic
tgatcugaaccgaggacaccut

SEQ ID NO: 82624 - DNA, 25 bp, Artificial Sequence
  Synthetic
ccagtaactuacctgttgtctucgg

SEQ ID NO: 82625 - DNA, 25 bp, Artificial Sequence
  Synthetic
tcctgaagacauaccagctauggaa

SEQ ID NO: 82626 - DNA, 22 bp, Artificial Sequence
  Synthetic
ccaauggcttcctugaggaagt

SEQ ID NO: 82627 - DNA, 28 bp, Artificial Sequence
  Synthetic
tgtatcataguccccatcatgttctuct

SEQ ID NO: 82628 - DNA, 21 bp, Artificial Sequence
  Synthetic
gttgcttgguagagctgccua

SEQ ID NO: 82629 - DNA, 26 bp, Artificial Sequence
  Synthetic
gtagcaggttgucttgaatgtctuca

SEQ ID NO: 82630 - DNA, 21 bp, Artificial Sequence
  Synthetic
ctgtgcccacucttgagtuct

SEQ ID NO: 82631 - DNA, 22 bp, Artificial Sequence
  Synthetic
ttuccacccacagauccaaaca

SEQ ID NO: 82632 - DNA, 27 bp, Artificial Sequence
  Synthetic
caacttttucccgaagaagtaagacut

SEQ ID NO: 82633 - DNA, 23 bp, Artificial Sequence
  Synthetic
tcaagacatttgutcccgtgcua

SEQ ID NO: 82634 - DNA, 24 bp, Artificial Sequence
  Synthetic
ggctctgtauaagtggcttcugaa

SEQ ID NO: 82635 - DNA, 29 bp, Artificial Sequence
  Synthetic
cctttggtgcuttagtttgttctatuact

SEQ ID NO: 82636 - DNA, 23 bp, Artificial Sequence
  Synthetic
acaagcacaggcauttaccuact

SEQ ID NO: 82637 - DNA, 28 bp, Artificial Sequence
  Synthetic
tcattcatgactaugcagattgggtuaa

SEQ ID NO: 82638 - DNA, 20 bp, Artificial Sequence
  Synthetic
gggtgtccugcatgtgacua

SEQ ID NO: 82639 - DNA, 20 bp, Artificial Sequence
  Synthetic
cttccaugagcaccucccat

SEQ ID NO: 82640 - DNA, 22 bp, Artificial Sequence
  Synthetic
guttgctgaatgugaagcccat

SEQ ID NO: 82641 - DNA, 23 bp, Artificial Sequence
  Synthetic
gtgttccgugacaatctgtcuga

SEQ ID NO: 82642 - DNA, 22 bp, Artificial Sequence
  Synthetic
gcgcaaccguattuaaaggagt

SEQ ID NO: 82643 - DNA, 27 bp, Artificial Sequence
  Synthetic
catggatacagaaauggaggactuaga

SEQ ID NO: 82644 - DNA, 28 bp, Artificial Sequence
  Synthetic
ctgaatatguggctctgtccuagaaaag

SEQ ID NO: 82645 - DNA, 26 bp, Artificial Sequence
  Synthetic
ttccttgggacutccttctttgtaug

SEQ ID NO: 82646 - DNA, 23 bp, Artificial Sequence
  Synthetic
aagctgcuccagaaaaugacaga

SEQ ID NO: 82647 - DNA, 23 bp, Artificial Sequence
  Synthetic
ggaagaagggaaaugtuggcagt

SEQ ID NO: 82648 - DNA, 22 bp, Artificial Sequence
  Synthetic
cagguaaagccatguagggaca

SEQ ID NO: 82649 - DNA, 25 bp, Artificial Sequence
  Synthetic
gcatgtttgaauggtgtaggagtuc

SEQ ID NO: 82650 - DNA, 23 bp, Artificial Sequence
  Synthetic
ctcccaggcacutgatgatacuc

SEQ ID NO: 82651 - DNA, 24 bp, Artificial Sequence
  Synthetic
catttctaggutacaggccuggat

SEQ ID NO: 82652 - DNA, 23 bp, Artificial Sequence
  Synthetic
aggcaggaaaagcaagutgagua

SEQ ID NO: 82653 - DNA, 19 bp, Artificial Sequence
  Synthetic
caaacutguccccgagcga

SEQ ID NO: 82654 - DNA, 18 bp, Artificial Sequence
  Synthetic
gaacagccccutgucgga

SEQ ID NO: 82655 - DNA, 23 bp, Artificial Sequence
  Synthetic
cccagucagctgtgtuaaaggaa

SEQ ID NO: 82656 - DNA, 27 bp, Artificial Sequence
  Synthetic
ttgctatcagttaauggaagtgctcut

SEQ ID NO: 82657 - DNA, 20 bp, Artificial Sequence
  Synthetic
gctttgugagagccgcuaca

SEQ ID NO: 82658 - DNA, 22 bp, Artificial Sequence
  Synthetic
gtaagtcccugtagtccccuca

SEQ ID NO: 82659 - DNA, 21 bp, Artificial Sequence
  Synthetic
gagccaccucctctacucagt

SEQ ID NO: 82660 - DNA, 21 bp, Artificial Sequence
  Synthetic
cagatcuggcggatgatcuct

SEQ ID NO: 82661 - DNA, 25 bp, Artificial Sequence
  Synthetic
tgtcttttggatugttcgtgcagua

SEQ ID NO: 82662 - DNA, 28 bp, Artificial Sequence
  Synthetic
aaaaggtcaatcutagaaagctcuccaa

SEQ ID NO: 82663 - DNA, 29 bp, Artificial Sequence
  Synthetic
catcagagagaacucctaatgggacuaat

SEQ ID NO: 82664 - DNA, 25 bp, Artificial Sequence
  Synthetic
tctacgttgttucaggtgaaagugt

SEQ ID NO: 82665 - DNA, 22 bp, Artificial Sequence
  Synthetic
accatccaucctgtctgtcuca

SEQ ID NO: 82666 - DNA, 24 bp, Artificial Sequence
  Synthetic
tctggtaagtcucctgatgctuct

SEQ ID NO: 82667 - DNA, 29 bp, Artificial Sequence
  Synthetic
caaagaaagccagaugaagacatgaaaut

SEQ ID NO: 82668 - DNA, 22 bp, Artificial Sequence
  Synthetic
ttcatctgcutgtcgctcucat

SEQ ID NO: 82669 - DNA, 24 bp, Artificial Sequence
  Synthetic
ttctcttucaggaaagtgtgcugt

SEQ ID NO: 82670 - DNA, 22 bp, Artificial Sequence
  Synthetic
agutgccataaucgggagaacc

SEQ ID NO: 82671 - DNA, 24 bp, Artificial Sequence
  Synthetic
gactgtacacugcaacagatucac

SEQ ID NO: 82672 - DNA, 19 bp, Artificial Sequence
  Synthetic
gctccuctgcagguaaggg

SEQ ID NO: 82673 - DNA, 17 bp, Artificial Sequence
  Synthetic
cggcaucctgggcauca

SEQ ID NO: 82674 - DNA, 24 bp, Artificial Sequence
  Synthetic
gcctctcttaccutcgtctctcut

SEQ ID NO: 82675 - DNA, 18 bp, Artificial Sequence
  Synthetic
ccugaccgcccgtcttuc

SEQ ID NO: 82676 - DNA, 28 bp, Artificial Sequence
  Synthetic
acagaagttuaaaagccccatgaauact

SEQ ID NO: 82677 - DNA, 27 bp, Artificial Sequence
  Synthetic
ccagtgctattutgatgtttatgcuca

SEQ ID NO: 82678 - DNA, 28 bp, Artificial Sequence
  Synthetic
gcaagcuacagaagcatacatcuaaaca

SEQ ID NO: 82679 - DNA, 23 bp, Artificial Sequence
  Synthetic
tgugcatauccggaggaaagaag

SEQ ID NO: 82680 - DNA, 24 bp, Artificial Sequence
  Synthetic
gtgtggcatgugattctgtagtug

SEQ ID NO: 82681 - DNA, 25 bp, Artificial Sequence
  Synthetic
cattctcacccugatacgucaacat

SEQ ID NO: 82682 - DNA, 28 bp, Artificial Sequence
  Synthetic
caaatctttgauaatgaacccaucgcaa

SEQ ID NO: 82683 - DNA, 25 bp, Artificial Sequence
  Synthetic
cttgaccaagaugtgaaggtttcug

SEQ ID NO: 82684 - DNA, 21 bp, Artificial Sequence
  Synthetic
agcugacaggcagaccuagat

SEQ ID NO: 82685 - DNA, 21 bp, Artificial Sequence
  Synthetic
cgagggagaucccatcaggut

SEQ ID NO: 82686 - DNA, 21 bp, Artificial Sequence
  Synthetic
ggcaguggccacatacttuct

SEQ ID NO: 82687 - DNA, 28 bp, Artificial Sequence
  Synthetic
cccaaagcaauatatttgtatucaccga

SEQ ID NO: 82688 - DNA, 20 bp, Artificial Sequence
  Synthetic
gcacagtugccaggcttaug

SEQ ID NO: 82689 - DNA, 26 bp, Artificial Sequence
  Synthetic
tttaaaaugaggtgttguccccagaa

SEQ ID NO: 82690 - DNA, 27 bp, Artificial Sequence
  Synthetic
gtcccctgaagaugctagtaagttcua

SEQ ID NO: 82691 - DNA, 28 bp, Artificial Sequence
  Synthetic
cagatcttctacuagatgagagggtguc

SEQ ID NO: 82692 - DNA, 23 bp, Artificial Sequence
  Synthetic
tgagctccagaggugtctgauat

SEQ ID NO: 82693 - DNA, 28 bp, Artificial Sequence
  Synthetic
cctagcttctgucttaggttcatttuct

SEQ ID NO: 82694 - DNA, 23 bp, Artificial Sequence
  Synthetic
ggtttaactguctccctcctucc

SEQ ID NO: 82695 - DNA, 22 bp, Artificial Sequence
  Synthetic
gcccaaauaagcagcaatguca

SEQ ID NO: 82696 - DNA, 26 bp, Artificial Sequence
  Synthetic
gacuaaaacaaccaaaccaaacucca

SEQ ID NO: 82697 - DNA, 21 bp, Artificial Sequence
  Synthetic
gtcgcacagaacuccacucaa

SEQ ID NO: 82698 - DNA, 20 bp, Artificial Sequence
  Synthetic
cagccuggcaactcctacug

SEQ ID NO: 82699 - DNA, 24 bp, Artificial Sequence
  Synthetic
cttttatctccuccccatcuccct

SEQ ID NO: 82700 - DNA, 24 bp, Artificial Sequence
  Synthetic
tctcttctatucccttggcucaca

SEQ ID NO: 82701 - DNA, 24 bp, Artificial Sequence
  Synthetic
tgcucgaaaggaatatcuccacac

SEQ ID NO: 82702 - DNA, 26 bp, Artificial Sequence
  Synthetic
cctaccaaggagaugaaaagugagaa

SEQ ID NO: 82703 - DNA, 26 bp, Artificial Sequence
  Synthetic
tcatgttaccacugtcccttttugag

SEQ ID NO: 82704 - DNA, 23 bp, Artificial Sequence
  Synthetic
gggatccugctgtatgatauggt

SEQ ID NO: 82705 - DNA, 28 bp, Artificial Sequence
  Synthetic
gaagactaauagccccatuaagaccaat

SEQ ID NO: 82706 - DNA, 21 bp, Artificial Sequence
  Synthetic
ggtggugaaggaaagcaccut

SEQ ID NO: 82707 - DNA, 22 bp, Artificial Sequence
  Synthetic
gctgtgtcaccugagatctgug

SEQ ID NO: 82708 - DNA, 22 bp, Artificial Sequence
  Synthetic
atgtucacagcagucccaagaa

SEQ ID NO: 82709 - DNA, 21 bp, Artificial Sequence
  Synthetic
aggtagauggcaaagcggaug

SEQ ID NO: 82710 - DNA, 25 bp, Artificial Sequence
  Synthetic
gacccaacauacacatccauacaca

SEQ ID NO: 82711 - DNA, 20 bp, Artificial Sequence
  Synthetic
gaugacaccgaugccaacag

SEQ ID NO: 82712 - DNA, 29 bp, Artificial Sequence
  Synthetic
ctgaaattttaagcugaggatgaaugcaa

SEQ ID NO: 82713 - DNA, 24 bp, Artificial Sequence
  Synthetic
catgagagccaucttgtgatcuga

SEQ ID NO: 82714 - DNA, 22 bp, Artificial Sequence
  Synthetic
aagaggcttautcggcaggtut

SEQ ID NO: 82715 - DNA, 22 bp, Artificial Sequence
  Synthetic
tgaccctcugcttctacctcug

SEQ ID NO: 82716 - DNA, 26 bp, Artificial Sequence
  Synthetic
cagttattuggcagaaaagcagagua

SEQ ID NO: 82717 - DNA, 28 bp, Artificial Sequence
  Synthetic
tgtgaacagcutcatgagtaaaucagaa

SEQ ID NO: 82718 - DNA, 24 bp, Artificial Sequence
  Synthetic
gactcattgccacutgaaccatug

SEQ ID NO: 82719 - DNA, 20 bp, Artificial Sequence
  Synthetic
acatgaguggcccccuagaa

SEQ ID NO: 82720 - DNA, 21 bp, Artificial Sequence
  Synthetic
cccccaggacaaaaugatucc

SEQ ID NO: 82721 - DNA, 21 bp, Artificial Sequence
  Synthetic
atcttccaccucactcccuca

SEQ ID NO: 82722 - DNA, 26 bp, Artificial Sequence
  Synthetic
agcactaaaaugaagatgtgcuacct

SEQ ID NO: 82723 - DNA, 28 bp, Artificial Sequence
  Synthetic
gcactgccattuaattcacacttatgut

SEQ ID NO: 82724 - DNA, 22 bp, Artificial Sequence
  Synthetic
ctgacgctuggtttttctgugt

SEQ ID NO: 82725 - DNA, 21 bp, Artificial Sequence
  Synthetic
gaggtctgucttctgctuggg

SEQ ID NO: 82726 - DNA, 20 bp, Artificial Sequence
  Synthetic
ggacgagaaccutgcugacc

SEQ ID NO: 82727 - DNA, 24 bp, Artificial Sequence
  Synthetic
gcacttctutttgggacucagaga

SEQ ID NO: 82728 - DNA, 18 bp, Artificial Sequence
  Synthetic
cgctgaggcccuccctua

SEQ ID NO: 82729 - DNA, 25 bp, Artificial Sequence
  Synthetic
tggatataattuccgagcgaagcug

SEQ ID NO: 82730 - DNA, 21 bp, Artificial Sequence
  Synthetic
tttccuaatgcctugcagcct

SEQ ID NO: 82731 - DNA, 28 bp, Artificial Sequence
  Synthetic
cccacatcatguctcatcttatcaaugt

SEQ ID NO: 82732 - DNA, 23 bp, Artificial Sequence
  Synthetic
tgcagaaagacutgaaggcguat

SEQ ID NO: 82733 - DNA, 28 bp, Artificial Sequence
  Synthetic
catcacaaagtauctttttctgtggcut

SEQ ID NO: 82734 - DNA, 20 bp, Artificial Sequence
  Synthetic
tcctcgagcugttcctucca

SEQ ID NO: 82735 - DNA, 22 bp, Artificial Sequence
  Synthetic
tcttatcctugctgctcacguc

SEQ ID NO: 82736 - DNA, 18 bp, Artificial Sequence
  Synthetic
tctctguggccgggtgua

SEQ ID NO: 82737 - DNA, 22 bp, Artificial Sequence
  Synthetic
ctgaccgtuacctttcctccuc

SEQ ID NO: 82738 - DNA, 28 bp, Artificial Sequence
  Synthetic
ttgcagttttuaaaccttttcctuccat

SEQ ID NO: 82739 - DNA, 26 bp, Artificial Sequence
  Synthetic
ccaagtctgucagctacttucagaaa

SEQ ID NO: 82740 - DNA, 21 bp, Artificial Sequence
  Synthetic
accatggaucagccagtctug

SEQ ID NO: 82741 - DNA, 25 bp, Artificial Sequence
  Synthetic
ggccaaagucacagatctucacaat

SEQ ID NO: 82742 - DNA, 22 bp, Artificial Sequence
  Synthetic
gcccactuccaaagctgtagut

SEQ ID NO: 82743 - DNA, 22 bp, Artificial Sequence
  Synthetic
ggcaagcagcguttagaactug

SEQ ID NO: 82744 - DNA, 22 bp, Artificial Sequence
  Synthetic
agtctucccttacauggagggt

SEQ ID NO: 82745 - DNA, 25 bp, Artificial Sequence
  Synthetic
acagaucagacactcagguaacaga

SEQ ID NO: 82746 - DNA, 22 bp, Artificial Sequence
  Synthetic
ggtcccagtugaagaccctcua

SEQ ID NO: 82747 - DNA, 22 bp, Artificial Sequence
  Synthetic
cttccaccuctacctgauccca

SEQ ID NO: 82748 - DNA, 19 bp, Artificial Sequence
  Synthetic
ccctacccugggagaugct

SEQ ID NO: 82749 - DNA, 20 bp, Artificial Sequence
  Synthetic
acctgcucgaacttctgcug

SEQ ID NO: 82750 - DNA, 20 bp, Artificial Sequence
  Synthetic
gcccacagaggaccutgaug

SEQ ID NO: 82751 - DNA, 18 bp, Artificial Sequence
  Synthetic
ccagtaccgcugcgagug

SEQ ID NO: 82752 - DNA, 22 bp, Artificial Sequence
  Synthetic
cctctgaccuccctcacatcut

SEQ ID NO: 82753 - DNA, 20 bp, Artificial Sequence
  Synthetic
ccttgggaugccacactucc

SEQ ID NO: 82754 - DNA, 18 bp, Artificial Sequence
  Synthetic
ggagcgcgagucctctug

SEQ ID NO: 82755 - DNA, 22 bp, Artificial Sequence
  Synthetic
ccaguaagagcagtugaaggga

SEQ ID NO: 82756 - DNA, 18 bp, Artificial Sequence
  Synthetic
tgggcacgucgcaguaaa

SEQ ID NO: 82757 - DNA, 20 bp, Artificial Sequence
  Synthetic
ccagcugaccccaatctguc

SEQ ID NO: 82758 - DNA, 21 bp, Artificial Sequence
  Synthetic
aatgtgcagggcugattguct

SEQ ID NO: 82759 - DNA, 24 bp, Artificial Sequence
  Synthetic
cacttcaaagcuaacatgtugcca

SEQ ID NO: 82760 - DNA, 28 bp, Artificial Sequence
  Synthetic
tctgtttttgccutttcaatttcctgut

SEQ ID NO: 82761 - DNA, 27 bp, Artificial Sequence
  Synthetic
cagcttgtccauttttcttcgtuacag

SEQ ID NO: 82762 - DNA, 21 bp, Artificial Sequence
  Synthetic
gucctccuggcacaaggaaaa

SEQ ID NO: 82763 - DNA, 25 bp, Artificial Sequence
  Synthetic
gaatctcuagaagcaacaccugact

SEQ ID NO: 82764 - DNA, 20 bp, Artificial Sequence
  Synthetic
gcacttucagctcuggagga

SEQ ID NO: 82765 - DNA, 26 bp, Artificial Sequence
  Synthetic
ccctagagatguctccttccagauat

SEQ ID NO: 82766 - DNA, 26 bp, Artificial Sequence
  Synthetic
ttatcctgtgaucctaattgccctua

SEQ ID NO: 82767 - DNA, 27 bp, Artificial Sequence
  Synthetic
gctgtgtcagcauctagaaatatguct

SEQ ID NO: 82768 - DNA, 28 bp, Artificial Sequence
  Synthetic
ctcctggatccuttattacgaattguga

SEQ ID NO: 82769 - DNA, 21 bp, Artificial Sequence
  Synthetic
ggagaaggugccttgctucat

SEQ ID NO: 82770 - DNA, 21 bp, Artificial Sequence
  Synthetic
cttccgaauggagcagucact

SEQ ID NO: 82771 - DNA, 24 bp, Artificial Sequence
  Synthetic
catagttcuggaaaaccccagcut

SEQ ID NO: 82772 - DNA, 29 bp, Artificial Sequence
  Synthetic
aaatccctgtgaaucagttgtctaaugaa

SEQ ID NO: 82773 - DNA, 23 bp, Artificial Sequence
  Synthetic
gacgtagagcucacattcucgaa

SEQ ID NO: 82774 - DNA, 26 bp, Artificial Sequence
  Synthetic
tgattctggtuctcttaccctuacct

SEQ ID NO: 82775 - DNA, 24 bp, Artificial Sequence
  Synthetic
cgaattgaugtctgcctucaaaca

SEQ ID NO: 82776 - DNA, 22 bp, Artificial Sequence
  Synthetic
agaaccatggaguctggcagua

SEQ ID NO: 82777 - DNA, 20 bp, Artificial Sequence
  Synthetic
gguctctcaggucgagcagt

SEQ ID NO: 82778 - DNA, 28 bp, Artificial Sequence
  Synthetic
tcacttgcagtcuatactcaccatcuat

SEQ ID NO: 82779 - DNA, 27 bp, Artificial Sequence
  Synthetic
gaaataaacctuagctgctgauaggct

SEQ ID NO: 82780 - DNA, 24 bp, Artificial Sequence
  Synthetic
gutaagacaccuccacaaccaaca

SEQ ID NO: 82781 - DNA, 20 bp, Artificial Sequence
  Synthetic
agggcaucgagtggaactuc

SEQ ID NO: 82782 - DNA, 21 bp, Artificial Sequence
  Synthetic
tggcuggaaaagcaatcguca

SEQ ID NO: 82783 - DNA, 28 bp, Artificial Sequence
  Synthetic
tctttttcttactugcttctgtcacuca

SEQ ID NO: 82784 - DNA, 21 bp, Artificial Sequence
  Synthetic
gggttacuggaggctacagug

SEQ ID NO: 82785 - DNA, 25 bp, Artificial Sequence
  Synthetic
ctgcacaagcutctacttcctauct

SEQ ID NO: 82786 - DNA, 26 bp, Artificial Sequence
  Synthetic
gctcaaagatuctattgtgcagtugt

SEQ ID NO: 82787 - DNA, 26 bp, Artificial Sequence
  Synthetic
caactgtcacaaucacctcatcauct

SEQ ID NO: 82788 - DNA, 27 bp, Artificial Sequence
  Synthetic
gcctgtcttuaagttgaacatgaucct

SEQ ID NO: 82789 - DNA, 25 bp, Artificial Sequence
  Synthetic
gacaagcaacacuatccgtgtttuc

SEQ ID NO: 82790 - DNA, 25 bp, Artificial Sequence
  Synthetic
gatcatttucaggaggacucccaag

SEQ ID NO: 82791 - DNA, 25 bp, Artificial Sequence
  Synthetic
ctgtgcctctucaatccattcttut

SEQ ID NO: 82792 - DNA, 19 bp, Artificial Sequence
  Synthetic
caagacaguccccgcuaca

SEQ ID NO: 82793 - DNA, 19 bp, Artificial Sequence
  Synthetic
aggaggtugtggcacucag

SEQ ID NO: 82794 - DNA, 18 bp, Artificial Sequence
  Synthetic
gggucacacgctgucaag

SEQ ID NO: 82795 - DNA, 28 bp, Artificial Sequence
  Synthetic
aattacaagaauggatcagacgauggag

SEQ ID NO: 82796 - DNA, 22 bp, Artificial Sequence
  Synthetic
gcctttgggaaggucttcctug

SEQ ID NO: 82797 - DNA, 22 bp, Artificial Sequence
  Synthetic
cactctgucctgatgtgaugga

SEQ ID NO: 82798 - DNA, 27 bp, Artificial Sequence
  Synthetic
gcatttgtggatuccatagaccgauaa

SEQ ID NO: 82799 - DNA, 23 bp, Artificial Sequence
  Synthetic
atgttgaatcugttcctgcuggt

SEQ ID NO: 82800 - DNA, 19 bp, Artificial Sequence
  Synthetic
ggucgaggccaaagucgat

SEQ ID NO: 82801 - DNA, 25 bp, Artificial Sequence
  Synthetic
ctgacattgutttctctcctugcag

SEQ ID NO: 82802 - DNA, 22 bp, Artificial Sequence
  Synthetic
gctccatcuggcacttcagaua

SEQ ID NO: 82803 - DNA, 17 bp, Artificial Sequence
  Synthetic
caucgccgcugcagaag

SEQ ID NO: 82804 - DNA, 21 bp, Artificial Sequence
  Synthetic
gctttugggcttgcttugagt

SEQ ID NO: 82805 - DNA, 20 bp, Artificial Sequence
  Synthetic
tttacaggacguccgugcat

SEQ ID NO: 82806 - DNA, 22 bp, Artificial Sequence
  Synthetic
ctgttctutgcttgtucggcaa

SEQ ID NO: 82807 - DNA, 22 bp, Artificial Sequence
  Synthetic
ccagctgcauctctccuacaat

SEQ ID NO: 82808 - DNA, 20 bp, Artificial Sequence
  Synthetic
ccgccacuggttguaccaaa

SEQ ID NO: 82809 - DNA, 24 bp, Artificial Sequence
  Synthetic
ccaacccaguatacctgagguaac

SEQ ID NO: 82810 - DNA, 17 bp, Artificial Sequence
  Synthetic
gggctgutctcggugct

SEQ ID NO: 82811 - DNA, 25 bp, Artificial Sequence
  Synthetic
cgatgagaagaagaaacugcgucat

SEQ ID NO: 82812 - DNA, 21 bp, Artificial Sequence
  Synthetic
ccaggaguttguaggcaagga

SEQ ID NO: 82813 - DNA, 28 bp, Artificial Sequence
  Synthetic
gctgcgagtuataatgtgttacaaucat

SEQ ID NO: 82814 - DNA, 20 bp, Artificial Sequence
  Synthetic
cctcgctcucactgttgcug

SEQ ID NO: 82815 - DNA, 25 bp, Artificial Sequence
  Synthetic
cgaagctgugctacacuacaaacat

SEQ ID NO: 82816 - DNA, 23 bp, Artificial Sequence
  Synthetic
aggcagaaagagugaggaggtua

SEQ ID NO: 82817 - DNA, 27 bp, Artificial Sequence
  Synthetic
gattaattggctuctctgcttcttugt

SEQ ID NO: 82818 - DNA, 22 bp, Artificial Sequence
  Synthetic
agaacaaaucacctugccacca

SEQ ID NO: 82819 - DNA, 26 bp, Artificial Sequence
  Synthetic
agaattuagaagacaccgugcagaat

SEQ ID NO: 82820 - DNA, 21 bp, Artificial Sequence
  Synthetic
tgggtguaggttccaugggat

SEQ ID NO: 82821 - DNA, 21 bp, Artificial Sequence
  Synthetic
ctgctccugtgaaggtacuca

SEQ ID NO: 82822 - DNA, 21 bp, Artificial Sequence
  Synthetic
gggagctguccagtgacttug

SEQ ID NO: 82823 - DNA, 20 bp, Artificial Sequence
  Synthetic
gcgagtgcucgtgtgagaug

SEQ ID NO: 82824 - DNA, 23 bp, Artificial Sequence
  Synthetic
gctgauagccaaactgcugaact

SEQ ID NO: 82825 - DNA, 28 bp, Artificial Sequence
  Synthetic
ccaggtttaagaautgtttaagcugcat

SEQ ID NO: 82826 - DNA, 20 bp, Artificial Sequence
  Synthetic
tccaggucatugaggagggt

SEQ ID NO: 82827 - DNA, 19 bp, Artificial Sequence
  Synthetic
ccacauccaccgaggcaut

SEQ ID NO: 82828 - DNA, 23 bp, Artificial Sequence
  Synthetic
ttaaggaacacugtccatuggca

SEQ ID NO: 82829 - DNA, 27 bp, Artificial Sequence
  Synthetic
gggttcagcaaaucttctaatccauga

SEQ ID NO: 82830 - DNA, 23 bp, Artificial Sequence
  Synthetic
gctttgaatcuttggccaguacc

SEQ ID NO: 82831 - DNA, 27 bp, Artificial Sequence
  Synthetic
agagagaagguttgactgccauaaaaa

SEQ ID NO: 82832 - DNA, 21 bp, Artificial Sequence
  Synthetic
gacaaggcaguggagtcctua

SEQ ID NO: 82833 - DNA, 21 bp, Artificial Sequence
  Synthetic
ccttcacagcacuggacacuc

SEQ ID NO: 82834 - DNA, 24 bp, Artificial Sequence
  Synthetic
gcatgacgcaguttcttcttcuca

SEQ ID NO: 82835 - DNA, 21 bp, Artificial Sequence
  Synthetic
gtcacagcuccagtgtctguc

SEQ ID NO: 82836 - DNA, 18 bp, Artificial Sequence
  Synthetic
cacgcugaagguccaggt

SEQ ID NO: 82837 - DNA, 19 bp, Artificial Sequence
  Synthetic
gccagcgaaggucttcuca

SEQ ID NO: 82838 - DNA, 21 bp, Artificial Sequence
  Synthetic
ccgggacauttgcaggttuac

SEQ ID NO: 82839 - DNA, 28 bp, Artificial Sequence
  Synthetic
gtccttattcatucctgaacatgcuaga

SEQ ID NO: 82840 - DNA, 26 bp, Artificial Sequence
  Synthetic
cccaccaataaaguaacagtgcatut

SEQ ID NO: 82841 - DNA, 26 bp, Artificial Sequence
  Synthetic
aacagtagtcccuactcagtgauacc

SEQ ID NO: 82842 - DNA, 22 bp, Artificial Sequence
  Synthetic
tcccagtcuctggagagugaag

SEQ ID NO: 82843 - DNA, 23 bp, Artificial Sequence
  Synthetic
ccaggugaagaaccaugaaccag

SEQ ID NO: 82844 - DNA, 25 bp, Artificial Sequence
  Synthetic
gtgtcaattuacaggaatggtuccc

SEQ ID NO: 82845 - DNA, 18 bp, Artificial Sequence
  Synthetic
gcugccaggccttcaugt

SEQ ID NO: 82846 - DNA, 20 bp, Artificial Sequence
  Synthetic
ggcctcttcuccgtctgcua

SEQ ID NO: 82847 - DNA, 22 bp, Artificial Sequence
  Synthetic
cccagcuagaccaaaaggaguc

SEQ ID NO: 82848 - DNA, 22 bp, Artificial Sequence
  Synthetic
actttacauagccctggcucct

SEQ ID NO: 82849 - DNA, 21 bp, Artificial Sequence
  Synthetic
gtgactguctggcaucaccaa

SEQ ID NO: 82850 - DNA, 24 bp, Artificial Sequence
  Synthetic
acaggctaugtagaaccaaugcag

SEQ ID NO: 82851 - DNA, 23 bp, Artificial Sequence
  Synthetic
tttctccaaaauggctggtcgua

SEQ ID NO: 82852 - DNA, 21 bp, Artificial Sequence
  Synthetic
tcagcttugctcacgtgucaa

SEQ ID NO: 82853 - DNA, 28 bp, Artificial Sequence
  Synthetic
tgcaatttcaucttgaactucaacacaa

SEQ ID NO: 82854 - DNA, 25 bp, Artificial Sequence
  Synthetic
ctgtacagtacugaggttctcaugt

SEQ ID NO: 82855 - DNA, 22 bp, Artificial Sequence
  Synthetic
ggagacagaaagcccuguagag

SEQ ID NO: 82856 - DNA, 26 bp, Artificial Sequence
  Synthetic
cttgccaataucccttcctcttguaa

SEQ ID NO: 82857 - DNA, 23 bp, Artificial Sequence
  Synthetic
cagcagctuttggaagactugag

SEQ ID NO: 82858 - DNA, 24 bp, Artificial Sequence
  Synthetic
agaaatctcugttatgccuggcaa

SEQ ID NO: 82859 - DNA, 26 bp, Artificial Sequence
  Synthetic
aaagcacgctuagattggaatacuga

SEQ ID NO: 82860 - DNA, 20 bp, Artificial Sequence
  Synthetic
ctggagguggaacuagcaca

SEQ ID NO: 82861 - DNA, 26 bp, Artificial Sequence
  Synthetic
gttcctcccaucaaactctctgtuac

SEQ ID NO: 82862 - DNA, 24 bp, Artificial Sequence
  Synthetic
gcagcaccutttgctaaatcucac

SEQ ID NO: 82863 - DNA, 26 bp, Artificial Sequence
  Synthetic
tggtgtgacaguataagacccagtua

SEQ ID NO: 82864 - DNA, 21 bp, Artificial Sequence
  Synthetic
caagacctcutgctgcttcuc

SEQ ID NO: 82865 - DNA, 25 bp, Artificial Sequence
  Synthetic
aaatcaatccugtgttcctcucacc

SEQ ID NO: 82866 - DNA, 23 bp, Artificial Sequence
  Synthetic
gattacccaucattcctggcuga

SEQ ID NO: 82867 - DNA, 28 bp, Artificial Sequence
  Synthetic
ttattgccaaaccagaauttaccactug

SEQ ID NO: 82868 - DNA, 24 bp, Artificial Sequence
  Synthetic
tcagagutctcttcuccagcaaac

SEQ ID NO: 82869 - DNA, 28 bp, Artificial Sequence
  Synthetic
ggatttatcacaguatcaaggatgcuca

SEQ ID NO: 82870 - DNA, 20 bp, Artificial Sequence
  Synthetic
ggucagccagagggagtuct

SEQ ID NO: 82871 - DNA, 20 bp, Artificial Sequence
  Synthetic
cggctcccuttgtgcttuca

SEQ ID NO: 82872 - DNA, 22 bp, Artificial Sequence
  Synthetic
gttgggctutgcaatgtgaugt

SEQ ID NO: 82873 - DNA, 28 bp, Artificial Sequence
  Synthetic
cagacattgtcccuaaacactactgtua

SEQ ID NO: 82874 - DNA, 17 bp, Artificial Sequence
  Synthetic
gcugccaaucgcaagca

SEQ ID NO: 82875 - DNA, 18 bp, Artificial Sequence
  Synthetic
actggcccuctcctccut

SEQ ID NO: 82876 - DNA, 22 bp, Artificial Sequence
  Synthetic
agcagggugcattggatcttua

SEQ ID NO: 82877 - DNA, 20 bp, Artificial Sequence
  Synthetic
ggtaccuggagagcugcaac

SEQ ID NO: 82878 - DNA, 20 bp, Artificial Sequence
  Synthetic
gagaccacuggtgtcucaca

SEQ ID NO: 82879 - DNA, 27 bp, Artificial Sequence
  Synthetic
cctaggcttucattttcactccauacc

SEQ ID NO: 82880 - DNA, 19 bp, Artificial Sequence
  Synthetic
gaggaaggcuagccagcut

SEQ ID NO: 82881 - DNA, 21 bp, Artificial Sequence
  Synthetic
ggtgaugtctggucagggaat

SEQ ID NO: 82882 - DNA, 22 bp, Artificial Sequence
  Synthetic
gaggcacauttacgcttagugg

SEQ ID NO: 82883 - DNA, 21 bp, Artificial Sequence
  Synthetic
ctggacagcaucctcagguaa

SEQ ID NO: 82884 - DNA, 27 bp, Artificial Sequence
  Synthetic
gtgatcttccaaauctacagagtuccc

SEQ ID NO: 82885 - DNA, 28 bp, Artificial Sequence
  Synthetic
agtcctgtacutctggatcttuaaccat

SEQ ID NO: 82886 - DNA, 23 bp, Artificial Sequence
  Synthetic
gcatgccagugtgtgaattugat

SEQ ID NO: 82887 - DNA, 28 bp, Artificial Sequence
  Synthetic
agacatacattgcuctactatgagguga

SEQ ID NO: 82888 - DNA, 27 bp, Artificial Sequence
  Synthetic
tttttcagggacaagaaucctucaaga

SEQ ID NO: 82889 - DNA, 23 bp, Artificial Sequence
  Synthetic
aaaccagacacgugcaattugag

SEQ ID NO: 82890 - DNA, 25 bp, Artificial Sequence
  Synthetic
catacgaaucaggagaataacgugt

SEQ ID NO: 82891 - DNA, 20 bp, Artificial Sequence
  Synthetic
gcacaaccagugcacctuca

SEQ ID NO: 82892 - DNA, 23 bp, Artificial Sequence
  Synthetic
ctgtggatcutagggaccucaat

SEQ ID NO: 82893 - DNA, 29 bp, Artificial Sequence
  Synthetic
acaggtagaagacugcactatagtaauga

SEQ ID NO: 82894 - DNA, 27 bp, Artificial Sequence
  Synthetic
gtcactagttguactgaaatgccaaug

SEQ ID NO: 82895 - DNA, 27 bp, Artificial Sequence
  Synthetic
ggctgggaacauttgtcatttattcut

SEQ ID NO: 82896 - DNA, 23 bp, Artificial Sequence
  Synthetic
agagaagtugagaggacccauga

SEQ ID NO: 82897 - DNA, 21 bp, Artificial Sequence
  Synthetic
ctcaacgtguctacgaagcug

SEQ ID NO: 82898 - DNA, 27 bp, Artificial Sequence
  Synthetic
aggtaactgccuttaaggaaactugac

SEQ ID NO: 82899 - DNA, 21 bp, Artificial Sequence
  Synthetic
ttctcgcggaugaatgtucca

SEQ ID NO: 82900 - DNA, 19 bp, Artificial Sequence
  Synthetic
tggtctugcaggctgtucc

SEQ ID NO: 82901 - DNA, 20 bp, Artificial Sequence
  Synthetic
gtgtccugccacatcaucca

SEQ ID NO: 82902 - DNA, 18 bp, Artificial Sequence
  Synthetic
gcctgucgcggagagtug

SEQ ID NO: 82903 - DNA, 22 bp, Artificial Sequence
  Synthetic
gucgcugaagcagaaagacaag

SEQ ID NO: 82904 - DNA, 20 bp, Artificial Sequence
  Synthetic
catgggaggugctcauggaa

SEQ ID NO: 82905 - DNA, 22 bp, Artificial Sequence
  Synthetic
agccgcacuatactcagaucca

SEQ ID NO: 82906 - DNA, 23 bp, Artificial Sequence
  Synthetic
gautagtguggccagggaagaaa

SEQ ID NO: 82907 - DNA, 23 bp, Artificial Sequence
  Synthetic
cctcagcuctgcaaugagaacag

SEQ ID NO: 82908 - DNA, 23 bp, Artificial Sequence
  Synthetic
ggccaaagaacugaagaagguga

SEQ ID NO: 82909 - DNA, 21 bp, Artificial Sequence
  Synthetic
accccaggcaaucaggauact

SEQ ID NO: 82910 - DNA, 25 bp, Artificial Sequence
  Synthetic
actcaggtuagaggaagaacuggaa

SEQ ID NO: 82911 - DNA, 22 bp, Artificial Sequence
  Synthetic
ccctatgacacucaaccctgug

SEQ ID NO: 82912 - DNA, 30 bp, Artificial Sequence
  Synthetic
actttttgcaaaugtttaacataggugaca

SEQ ID NO: 82913 - DNA, 21 bp, Artificial Sequence
  Synthetic
aggtttcctcuggtcctggua

SEQ ID NO: 82914 - DNA, 25 bp, Artificial Sequence
  Synthetic
gcagtatagagcgugcagataauga

SEQ ID NO: 82915 - DNA, 23 bp, Artificial Sequence
  Synthetic
cauacaagucaacaacccccaca

SEQ ID NO: 82916 - DNA, 22 bp, Artificial Sequence
  Synthetic
gcagcaagauttccttcagcut

SEQ ID NO: 82917 - DNA, 21 bp, Artificial Sequence
  Synthetic
aggaaagcacucaagaugcca

SEQ ID NO: 82918 - DNA, 22 bp, Artificial Sequence
  Synthetic
ccagauagcaccgagtcugaac

SEQ ID NO: 82919 - DNA, 23 bp, Artificial Sequence
  Synthetic
gaccgugaagaatgacaacucct

SEQ ID NO: 82920 - DNA, 17 bp, Artificial Sequence
  Synthetic
gccgcgcuacucacgaa

SEQ ID NO: 82921 - DNA, 17 bp, Artificial Sequence
  Synthetic
gcctucactgcguccct

SEQ ID NO: 82922 - DNA, 23 bp, Artificial Sequence
  Synthetic
ctcttccuccatgctttcuccat

SEQ ID NO: 82923 - DNA, 28 bp, Artificial Sequence
  Synthetic
gactatgaagccauttgtaaggtaccuc

SEQ ID NO: 82924 - DNA, 22 bp, Artificial Sequence
  Synthetic
tcgattgucttcccugaggact

SEQ ID NO: 82925 - DNA, 28 bp, Artificial Sequence
  Synthetic
tgagagataacgaaugggaaactttuga

SEQ ID NO: 82926 - DNA, 23 bp, Artificial Sequence
  Synthetic
tgcaaacaaggutttccatccug

SEQ ID NO: 82927 - DNA, 22 bp, Artificial Sequence
  Synthetic
ttacgcagucggcuagaagaag

SEQ ID NO: 82928 - DNA, 19 bp, Artificial Sequence
  Synthetic
gcactuggcctgtgctuct

SEQ ID NO: 82929 - DNA, 20 bp, Artificial Sequence
  Synthetic
acacggagcugaucaacgac

SEQ ID NO: 82930 - DNA, 19 bp, Artificial Sequence
  Synthetic
tgcaggtuggccttctuca

SEQ ID NO: 82931 - DNA, 18 bp, Artificial Sequence
  Synthetic
aggtgtguccccagggua

SEQ ID NO: 82932 - DNA, 22 bp, Artificial Sequence
  Synthetic
tggttuacaaccaccccttuga

SEQ ID NO: 82933 - DNA, 24 bp, Artificial Sequence
  Synthetic
acacatggcaguagtgactctuac

SEQ ID NO: 82934 - DNA, 24 bp, Artificial Sequence
  Synthetic
agtcaatgaaaucagggccttuga

SEQ ID NO: 82935 - DNA, 23 bp, Artificial Sequence
  Synthetic
cgaagacguaggtaccaauccac

SEQ ID NO: 82936 - DNA, 23 bp, Artificial Sequence
  Synthetic
gccatttcacgaugacctcucat

SEQ ID NO: 82937 - DNA, 22 bp, Artificial Sequence
  Synthetic
gcatcctgacugggttttccuc

SEQ ID NO: 82938 - DNA, 21 bp, Artificial Sequence
  Synthetic
ccaccuagagccagcacctua

SEQ ID NO: 82939 - DNA, 25 bp, Artificial Sequence
  Synthetic
tgtgaaaaguggaccctggttaaug

SEQ ID NO: 82940 - DNA, 20 bp, Artificial Sequence
  Synthetic
acccgcccugacacactaua

SEQ ID NO: 82941 - DNA, 22 bp, Artificial Sequence
  Synthetic
caaagatgacuggctggaaugg

SEQ ID NO: 82942 - DNA, 27 bp, Artificial Sequence
  Synthetic
gctgcttccaugtgtcataaagactua

SEQ ID NO: 82943 - DNA, 29 bp, Artificial Sequence
  Synthetic
tctgaaaccgacaguactgacatttatut

SEQ ID NO: 82944 - DNA, 23 bp, Artificial Sequence
  Synthetic
tgtctttcagutctggatgugct

SEQ ID NO: 82945 - DNA, 28 bp, Artificial Sequence
  Synthetic
aacaatgaaatttcutccacaggcauac

SEQ ID NO: 82946 - DNA, 23 bp, Artificial Sequence
  Synthetic
ggagatacttcuggccaccttuc

SEQ ID NO: 82947 - DNA, 22 bp, Artificial Sequence
  Synthetic
gtttgagugctggguggagaat

SEQ ID NO: 82948 - DNA, 22 bp, Artificial Sequence
  Synthetic
atgatgagtccutcagcagcuc

SEQ ID NO: 82949 - DNA, 26 bp, Artificial Sequence
  Synthetic
aattggccctugaaactgattgttut

SEQ ID NO: 82950 - DNA, 24 bp, Artificial Sequence
  Synthetic
cgaaagcagaaccuggagatugag

SEQ ID NO: 82951 - DNA, 21 bp, Artificial Sequence
  Synthetic
ccattgaguggtcacccagua

SEQ ID NO: 82952 - DNA, 32 bp, Artificial Sequence
  Synthetic
aatcttttataccaauatgtgtagctcaugat

SEQ ID NO: 82953 - DNA, 23 bp, Artificial Sequence
  Synthetic
gtgctgttgcaugcatgagtaug

SEQ ID NO: 82954 - DNA, 27 bp, Artificial Sequence
  Synthetic
tgatcttaacugtcggauccacaaaaa

SEQ ID NO: 82955 - DNA, 21 bp, Artificial Sequence
  Synthetic
tccactgguctggcagctaua

SEQ ID NO: 82956 - DNA, 23 bp, Artificial Sequence
  Synthetic
cagcatacucatgcaugcaacag

SEQ ID NO: 82957 - DNA, 28 bp, Artificial Sequence
  Synthetic
tgcgtgctcuaaaaacattcatattgut

SEQ ID NO: 82958 - DNA, 27 bp, Artificial Sequence
  Synthetic
ctgacaacauaaaccacaacaucagag

SEQ ID NO: 82959 - DNA, 27 bp, Artificial Sequence
  Synthetic
ccatccagggcautgtcttaagttaua

SEQ ID NO: 82960 - DNA, 21 bp, Artificial Sequence
  Synthetic
cgcuccaagcttctuccaaga

SEQ ID NO: 82961 - DNA, 24 bp, Artificial Sequence
  Synthetic
ggctaatccacuttccttccaugt

SEQ ID NO: 82962 - DNA, 21 bp, Artificial Sequence
  Synthetic
ccatcttggcutgggtcucat

SEQ ID NO: 82963 - DNA, 29 bp, Artificial Sequence
  Synthetic
ggaagattgguagtttaaggagattugga

SEQ ID NO: 82964 - DNA, 22 bp, Artificial Sequence
  Synthetic
ccccttcccugtttatccugaa

SEQ ID NO: 82965 - DNA, 20 bp, Artificial Sequence
  Synthetic
gcaugggaatgcaucagcct

SEQ ID NO: 82966 - DNA, 22 bp, Artificial Sequence
  Synthetic
ggaggtttctucagtggcctug

SEQ ID NO: 82967 - DNA, 27 bp, Artificial Sequence
  Synthetic
aacaccctaagaaugacaatggcatua

SEQ ID NO: 82968 - DNA, 27 bp, Artificial Sequence
  Synthetic
tgctatgtcaguctgaaactttctugt

SEQ ID NO: 82969 - DNA, 23 bp, Artificial Sequence
  Synthetic
gctgtucaagaagagccttcuca

SEQ ID NO: 82970 - DNA, 26 bp, Artificial Sequence
  Synthetic
tcccattucgaagattgguaaaacca

SEQ ID NO: 82971 - DNA, 21 bp, Artificial Sequence
  Synthetic
gaatggagggacutgtgcugt

SEQ ID NO: 82972 - DNA, 20 bp, Artificial Sequence
  Synthetic
gacctccugctgttgctcut

SEQ ID NO: 82973 - DNA, 24 bp, Artificial Sequence
  Synthetic
ctcagtgaagaugaagctggtcuc

SEQ ID NO: 82974 - DNA, 21 bp, Artificial Sequence
  Synthetic
tgtgtggcucctggatcugat

SEQ ID NO: 82975 - DNA, 27 bp, Artificial Sequence
  Synthetic
gtatcggaagaauaacgatgactcugg

SEQ ID NO: 82976 - DNA, 25 bp, Artificial Sequence
  Synthetic
ccacaacaguagaagggagaaauga

SEQ ID NO: 82977 - DNA, 28 bp, Artificial Sequence
  Synthetic
gggctccaucagttaaataatgtugact

SEQ ID NO: 82978 - DNA, 21 bp, Artificial Sequence
  Synthetic
cctucaagcccccttcucaac

SEQ ID NO: 82979 - DNA, 21 bp, Artificial Sequence
  Synthetic
gcacaaccucaaggagcgtua

SEQ ID NO: 82980 - DNA, 23 bp, Artificial Sequence
  Synthetic
gtctgtctctucacccacacauc

SEQ ID NO: 82981 - DNA, 20 bp, Artificial Sequence
  Synthetic
gttctgcucactgtggugct

SEQ ID NO: 82982 - DNA, 20 bp, Artificial Sequence
  Synthetic
tcaatggcuccgtgcucaat

SEQ ID NO: 82983 - DNA, 21 bp, Artificial Sequence
  Synthetic
cgtgtagtugccgttgtugac

SEQ ID NO: 82984 - DNA, 24 bp, Artificial Sequence
  Synthetic
tgaaaccaucaggcatgttacugg

SEQ ID NO: 82985 - DNA, 23 bp, Artificial Sequence
  Synthetic
ttgcagtgacuacttctgcctut

SEQ ID NO: 82986 - DNA, 17 bp, Artificial Sequence
  Synthetic
gggtgtcugcgccucaa

SEQ ID NO: 82987 - DNA, 18 bp, Artificial Sequence
  Synthetic
gggcagggutcaggaugg

SEQ ID NO: 82988 - DNA, 25 bp, Artificial Sequence
  Synthetic
acttacgtagaugagccctgaguag

SEQ ID NO: 82989 - DNA, 22 bp, Artificial Sequence
  Synthetic
gggaagaaggugaaggugaaca

SEQ ID NO: 82990 - DNA, 21 bp, Artificial Sequence
  Synthetic
ccagcutccugaagggaggat

SEQ ID NO: 82991 - DNA, 21 bp, Artificial Sequence
  Synthetic
ctgggcauaggtgatcuccac

SEQ ID NO: 82992 - DNA, 23 bp, Artificial Sequence
  Synthetic
ggcggcugcaaagaaaaauaact

SEQ ID NO: 82993 - DNA, 21 bp, Artificial Sequence
  Synthetic
gcaggtagtgutcgaggccua

SEQ ID NO: 82994 - DNA, 21 bp, Artificial Sequence
  Synthetic
gggagugaacacgtcctcaut

SEQ ID NO: 82995 - DNA, 20 bp, Artificial Sequence
  Synthetic
gcaagguagccttcgtgtug

SEQ ID NO: 82996 - DNA, 20 bp, Artificial Sequence
  Synthetic
gggucgcgcattttctucaa

SEQ ID NO: 82997 - DNA, 18 bp, Artificial Sequence
  Synthetic
gucgaaaaggcgcacugt

SEQ ID NO: 82998 - DNA, 23 bp, Artificial Sequence
  Synthetic
tugtcttugaaccacaggacagt

SEQ ID NO: 82999 - DNA, 17 bp, Artificial Sequence
  Synthetic
cctgacggucaccccut

SEQ ID NO: 83000 - DNA, 20 bp, Artificial Sequence
  Synthetic
gcttcgugcgcttcttucag

SEQ ID NO: 83001 - DNA, 19 bp, Artificial Sequence
  Synthetic
ccggccccaugtactugat

SEQ ID NO: 83002 - DNA, 19 bp, Artificial Sequence
  Synthetic
cccgggaggugtucaagac

SEQ ID NO: 83003 - DNA, 19 bp, Artificial Sequence
  Synthetic
cacuctcugaggcgggaaa

SEQ ID NO: 83004 - DNA, 22 bp, Artificial Sequence
  Synthetic
cacttacgugcgtactttgugg

SEQ ID NO: 83005 - DNA, 20 bp, Artificial Sequence
  Synthetic
cactccccuatccgcttcug

SEQ ID NO: 83006 - DNA, 21 bp, Artificial Sequence
  Synthetic
ggacatgucaaccgtcccaut

SEQ ID NO: 83007 - DNA, 21 bp, Artificial Sequence
  Synthetic
cgacacagutatugcccggat

SEQ ID NO: 83008 - DNA, 24 bp, Artificial Sequence
  Synthetic
ggtatcugctgaagguaggaaacc

SEQ ID NO: 83009 - DNA, 21 bp, Artificial Sequence
  Synthetic
ggagaggacugccagtacuca

SEQ ID NO: 83010 - DNA, 23 bp, Artificial Sequence
  Synthetic
aaacaagagaaggcugtguggat

SEQ ID NO: 83011 - DNA, 22 bp, Artificial Sequence
  Synthetic
acaucgctgaagucacacagac

SEQ ID NO: 83012 - DNA, 24 bp, Artificial Sequence
  Synthetic
ggttcatctuctggatgtcaucct

SEQ ID NO: 83013 - DNA, 20 bp, Artificial Sequence
  Synthetic
gccaagaagcuggtaugggt

SEQ ID NO: 83014 - DNA, 21 bp, Artificial Sequence
  Synthetic
catggtgacauactccccgut

SEQ ID NO: 83015 - DNA, 22 bp, Artificial Sequence
  Synthetic
gccttggtcucctggatctcua

SEQ ID NO: 83016 - DNA, 28 bp, Artificial Sequence
  Synthetic
acattctgcacautcagtttctcttuct

SEQ ID NO: 83017 - DNA, 28 bp, Artificial Sequence
  Synthetic
ccagcagcacaucaatagtctaacauac

SEQ ID NO: 83018 - DNA, 23 bp, Artificial Sequence
  Synthetic
agaggagaguctccaaaagguga

SEQ ID NO: 83019 - DNA, 25 bp, Artificial Sequence
  Synthetic
cgagctctgugttacaaatgcatug

SEQ ID NO: 83020 - DNA, 21 bp, Artificial Sequence
  Synthetic
cgctcaauagaaagcgctuca

SEQ ID NO: 83021 - DNA, 17 bp, Artificial Sequence
  Synthetic
tuccacacggcguccaa

SEQ ID NO: 83022 - DNA, 22 bp, Artificial Sequence
  Synthetic
tcaaagccacucttgucggaag

SEQ ID NO: 83023 - DNA, 21 bp, Artificial Sequence
  Synthetic
cccgcttaggucctggctaua

SEQ ID NO: 83024 - DNA, 26 bp, Artificial Sequence
  Synthetic
ccatgaatucagccaagttuaagagg

SEQ ID NO: 83025 - DNA, 23 bp, Artificial Sequence
  Synthetic
attttccaccutctctgcctuca

SEQ ID NO: 83026 - DNA, 17 bp, Artificial Sequence
  Synthetic
gcacgggcgugcttuag

SEQ ID NO: 83027 - DNA, 18 bp, Artificial Sequence
  Synthetic
ccccacccacucatccug

SEQ ID NO: 83028 - DNA, 22 bp, Artificial Sequence
  Synthetic
gctgttcctguagcaggttcut

SEQ ID NO: 83029 - DNA, 25 bp, Artificial Sequence
  Synthetic
gaaggcagagaaugagctuaaggag

SEQ ID NO: 83030 - DNA, 20 bp, Artificial Sequence
  Synthetic
ccuttggagauggacgagca

SEQ ID NO: 83031 - DNA, 27 bp, Artificial Sequence
  Synthetic
ggtctgtgatggucataatttgctgua

SEQ ID NO: 83032 - DNA, 29 bp, Artificial Sequence
  Synthetic
gaggtgaaagutgtaaatctttguaacac

SEQ ID NO: 83033 - DNA, 25 bp, Artificial Sequence
  Synthetic
tttgcagaggacauaatucgacact

SEQ ID NO: 83034 - DNA, 26 bp, Artificial Sequence
  Synthetic
aaggcttgaagagugtcgaattaugt

SEQ ID NO: 83035 - DNA, 28 bp, Artificial Sequence
  Synthetic
gctcattaatacucttccttaccauccc

SEQ ID NO: 83036 - DNA, 20 bp, Artificial Sequence
  Synthetic
ggcgaccuctctctcccuaa

SEQ ID NO: 83037 - DNA, 25 bp, Artificial Sequence
  Synthetic
tgagacuaaggaaagagccuggaaa

SEQ ID NO: 83038 - DNA, 24 bp, Artificial Sequence
  Synthetic
ggaagcaggacautggagacatut

SEQ ID NO: 83039 - DNA, 21 bp, Artificial Sequence
  Synthetic
cattgtutcccccugcaagag

SEQ ID NO: 83040 - DNA, 21 bp, Artificial Sequence
  Synthetic
gtacctgcgagugcttctgut

SEQ ID NO: 83041 - DNA, 24 bp, Artificial Sequence
  Synthetic
gccacaaaaacaaaugatgggcua

SEQ ID NO: 83042 - DNA, 28 bp, Artificial Sequence
  Synthetic
gacatcatgucagagttactgttucaga

SEQ ID NO: 83043 - DNA, 26 bp, Artificial Sequence
  Synthetic
tggctttcaguagttttcatggtuca

SEQ ID NO: 83044 - DNA, 28 bp, Artificial Sequence
  Synthetic
accttttgtattutcctgttctcucacc

SEQ ID NO: 83045 - DNA, 20 bp, Artificial Sequence
  Synthetic
ggaaggacuaggugcaccat

SEQ ID NO: 83046 - DNA, 21 bp, Artificial Sequence
  Synthetic
gcttctctucacgcacuccaa

SEQ ID NO: 83047 - DNA, 17 bp, Artificial Sequence
  Synthetic
gcuggcggcctucagag

SEQ ID NO: 83048 - DNA, 21 bp, Artificial Sequence
  Synthetic
ctugccacgaaaaccgugaaa

SEQ ID NO: 83049 - DNA, 22 bp, Artificial Sequence
  Synthetic
cctgtgacucagacagctcaua

SEQ ID NO: 83050 - DNA, 21 bp, Artificial Sequence
  Synthetic
cctctugggacacaccactua

SEQ ID NO: 83051 - DNA, 23 bp, Artificial Sequence
  Synthetic
tcagaaggaacucaugacagcac

SEQ ID NO: 83052 - DNA, 18 bp, Artificial Sequence
  Synthetic
ggtccauggagccugcac

SEQ ID NO: 83053 - DNA, 23 bp, Artificial Sequence
  Synthetic
gcttaaccccaucatccccuaac

SEQ ID NO: 83054 - DNA, 21 bp, Artificial Sequence
  Synthetic
ggaggtaccutggcattgugg

SEQ ID NO: 83055 - DNA, 21 bp, Artificial Sequence
  Synthetic
tgtcuccccaaagagggacut

SEQ ID NO: 83056 - DNA, 27 bp, Artificial Sequence
  Synthetic
gaaaaugaagaattgcauaaccagcga

SEQ ID NO: 83057 - DNA, 23 bp, Artificial Sequence
  Synthetic
gggtacgaguatgtcucacacat

SEQ ID NO: 83058 - DNA, 21 bp, Artificial Sequence
  Synthetic
cgccttaccugctgctcatua

SEQ ID NO: 83059 - DNA, 28 bp, Artificial Sequence
  Synthetic
caactcatgauacagaccccuaaagaag

SEQ ID NO: 83060 - DNA, 21 bp, Artificial Sequence
  Synthetic
gtcgaagcutgagctcucgaa

SEQ ID NO: 83061 - DNA, 21 bp, Artificial Sequence
  Synthetic
ggccacacuctgggactaaug

SEQ ID NO: 83062 - DNA, 21 bp, Artificial Sequence
  Synthetic
gctttgtccucgttccagtug

SEQ ID NO: 83063 - DNA, 22 bp, Artificial Sequence
  Synthetic
actgatgatgugccttccctug

SEQ ID NO: 83064 - DNA, 20 bp, Artificial Sequence
  Synthetic
ggtcaagacugtggctguga

SEQ ID NO: 83065 - DNA, 21 bp, Artificial Sequence
  Synthetic
ccagtcatcugcagcagcuac

SEQ ID NO: 83066 - DNA, 22 bp, Artificial Sequence
  Synthetic
gtggtcaggacautagcaccut

SEQ ID NO: 83067 - DNA, 29 bp, Artificial Sequence
  Synthetic
catgagtttgcagugattttgctattcua

SEQ ID NO: 83068 - DNA, 28 bp, Artificial Sequence
  Synthetic
agagtctuggccaaacctataauacaga

SEQ ID NO: 83069 - DNA, 24 bp, Artificial Sequence
  Synthetic
cttcattgacugccaaagaggaug

SEQ ID NO: 83070 - DNA, 20 bp, Artificial Sequence
  Synthetic
catcctguccctgagtggug

SEQ ID NO: 83071 - DNA, 21 bp, Artificial Sequence
  Synthetic
ttacgggutctggtcaugcaa

SEQ ID NO: 83072 - DNA, 24 bp, Artificial Sequence
  Synthetic
ctaatgtggauctgggtatgcuga

SEQ ID NO: 83073 - DNA, 28 bp, Artificial Sequence
  Synthetic
gtgatcatagtucctgcatcttccuaag

SEQ ID NO: 83074 - DNA, 20 bp, Artificial Sequence
  Synthetic
tcagctcautgagggcaucc

SEQ ID NO: 83075 - DNA, 24 bp, Artificial Sequence
  Synthetic
gtttgtagagggutggcaggauaa

SEQ ID NO: 83076 - DNA, 20 bp, Artificial Sequence
  Synthetic
gccacacacguguacaaggt

SEQ ID NO: 83077 - DNA, 21 bp, Artificial Sequence
  Synthetic
caccatgutcatccuggagca

SEQ ID NO: 83078 - DNA, 22 bp, Artificial Sequence
  Synthetic
catcuagggcacagcuacacat

SEQ ID NO: 83079 - DNA, 23 bp, Artificial Sequence
  Synthetic
acactatagggcutgggtctcug

SEQ ID NO: 83080 - DNA, 23 bp, Artificial Sequence
  Synthetic
gctgaggaagcagcutcttcaua

SEQ ID NO: 83081 - DNA, 28 bp, Artificial Sequence
  Synthetic
caaagattgctgaauactctggtccuaa

SEQ ID NO: 83082 - DNA, 22 bp, Artificial Sequence
  Synthetic
gccgaaguctccttttcuccac

SEQ ID NO: 83083 - DNA, 25 bp, Artificial Sequence
  Synthetic
tggtggccagagcutatattttcut

SEQ ID NO: 83084 - DNA, 27 bp, Artificial Sequence
  Synthetic
ggtagatttctuactgttgtcctucct

SEQ ID NO: 83085 - DNA, 28 bp, Artificial Sequence
  Synthetic
tgccaaaaatagacuaagaggagtgtuc

SEQ ID NO: 83086 - DNA, 18 bp, Artificial Sequence
  Synthetic
ctcgcgcuggtactccuc

SEQ ID NO: 83087 - DNA, 23 bp, Artificial Sequence
  Synthetic
ggctccttgucttctgactucat

SEQ ID NO: 83088 - DNA, 21 bp, Artificial Sequence
  Synthetic
tgaaagcugctgacagugagt

SEQ ID NO: 83089 - DNA, 25 bp, Artificial Sequence
  Synthetic
ggaaugagctatucccaggaagaag

SEQ ID NO: 83090 - DNA, 19 bp, Artificial Sequence
  Synthetic
guccaccttcugggaacct

SEQ ID NO: 83091 - DNA, 22 bp, Artificial Sequence
  Synthetic
gtccatggucctttgtgtcucc

SEQ ID NO: 83092 - DNA, 25 bp, Artificial Sequence
  Synthetic
ctttcaacttcgguatcacggatuc

SEQ ID NO: 83093 - DNA, 26 bp, Artificial Sequence
  Synthetic
ggagcatccguctaaaactaguacaa

SEQ ID NO: 83094 - DNA, 29 bp, Artificial Sequence
  Synthetic
catggcatagaaaaaugtgtaacttugga

SEQ ID NO: 83095 - DNA, 28 bp, Artificial Sequence
  Synthetic
gtagaugaatcagatguggaagaagaca

SEQ ID NO: 83096 - DNA, 21 bp, Artificial Sequence
  Synthetic
accatgguggagctauaagcc

SEQ ID NO: 83097 - DNA, 23 bp, Artificial Sequence
  Synthetic
gacatagucagcgaguacacaca

SEQ ID NO: 83098 - DNA, 19 bp, Artificial Sequence
  Synthetic
ctccuccccacagaacugg

SEQ ID NO: 83099 - DNA, 19 bp, Artificial Sequence
  Synthetic
aggagcugcagtccaagug

SEQ ID NO: 83100 - DNA, 19 bp, Artificial Sequence
  Synthetic
caccugcagcttguggact

SEQ ID NO: 83101 - DNA, 22 bp, Artificial Sequence
  Synthetic
ccaagcaggagguggaacauaa

SEQ ID NO: 83102 - DNA, 24 bp, Artificial Sequence
  Synthetic
gcaaaggagcagucttcaactuct

SEQ ID NO: 83103 - DNA, 29 bp, Artificial Sequence
  Synthetic
caggtatugggaaagcataatgttuaagt

SEQ ID NO: 83104 - DNA, 27 bp, Artificial Sequence
  Synthetic
ttctgttttccuaaaaggcactugaga

SEQ ID NO: 83105 - DNA, 26 bp, Artificial Sequence
  Synthetic
acactgauacccaaaatgaaugcact

SEQ ID NO: 83106 - DNA, 21 bp, Artificial Sequence
  Synthetic
tcctcagcuaccaagctagut

SEQ ID NO: 83107 - DNA, 26 bp, Artificial Sequence
  Synthetic
caggaaaaccaccutctcaaagauga

SEQ ID NO: 83108 - DNA, 20 bp, Artificial Sequence
  Synthetic
gcgccuccagcttcttctuc

SEQ ID NO: 83109 - DNA, 21 bp, Artificial Sequence
  Synthetic
gttatcccucccctctgctuc

SEQ ID NO: 83110 - DNA, 28 bp, Artificial Sequence
  Synthetic
gctttctattatgugaacctccactgut

SEQ ID NO: 83111 - DNA, 21 bp, Artificial Sequence
  Synthetic
gugatgaagguggcagagagg

SEQ ID NO: 83112 - DNA, 27 bp, Artificial Sequence
  Synthetic
aaggccatgtuagtaaatttgcatcug

SEQ ID NO: 83113 - DNA, 24 bp, Artificial Sequence
  Synthetic
ctctcaaaccgaucagccaauact

SEQ ID NO: 83114 - DNA, 21 bp, Artificial Sequence
  Synthetic
tggaggcuacctgagtgacug

SEQ ID NO: 83115 - DNA, 20 bp, Artificial Sequence
  Synthetic
cagccaugccttgtcugact

SEQ ID NO: 83116 - DNA, 23 bp, Artificial Sequence
  Synthetic
ttctgactucttgctgctugagt

SEQ ID NO: 83117 - DNA, 29 bp, Artificial Sequence
  Synthetic
accgctttccagauatacttaagagttuc

SEQ ID NO: 83118 - DNA, 22 bp, Artificial Sequence
  Synthetic
cccacagaaacuggatgctuct

SEQ ID NO: 83119 - DNA, 21 bp, Artificial Sequence
  Synthetic
ccagtgaccguagcagaugac

SEQ ID NO: 83120 - DNA, 19 bp, Artificial Sequence
  Synthetic
gttctcccagcucctggut

SEQ ID NO: 83121 - DNA, 18 bp, Artificial Sequence
  Synthetic
ccuagaggccagggugga

SEQ ID NO: 83122 - DNA, 24 bp, Artificial Sequence
  Synthetic
agaagaugaagaggaggaggaugt

SEQ ID NO: 83123 - DNA, 29 bp, Artificial Sequence
  Synthetic
caagagctgtuctatcaccaaacuaaaag

SEQ ID NO: 83124 - DNA, 25 bp, Artificial Sequence
  Synthetic
tgttctgctgcaucttcttcttcuc

SEQ ID NO: 83125 - DNA, 19 bp, Artificial Sequence
  Synthetic
ggcagaaaccgagcugugt

SEQ ID NO: 83126 - DNA, 22 bp, Artificial Sequence
  Synthetic
gctctcctgutatgtgccctua

SEQ ID NO: 83127 - DNA, 27 bp, Artificial Sequence
  Synthetic
accttcttatagucgtctttcccauct

SEQ ID NO: 83128 - DNA, 28 bp, Artificial Sequence
  Synthetic
tgttctccttuggttcttcatcttugaa

SEQ ID NO: 83129 - DNA, 21 bp, Artificial Sequence
  Synthetic
gcuagggaggcttuagaaggg

SEQ ID NO: 83130 - DNA, 18 bp, Artificial Sequence
  Synthetic
agaggugctgcugggaga

SEQ ID NO: 83131 - DNA, 22 bp, Artificial Sequence
  Synthetic
tgaccttggutttacccgtugt

SEQ ID NO: 83132 - DNA, 21 bp, Artificial Sequence
  Synthetic
tgtttttctucaccccucgca

SEQ ID NO: 83133 - DNA, 20 bp, Artificial Sequence
  Synthetic
cccagccccucagaaaucac

SEQ ID NO: 83134 - DNA, 26 bp, Artificial Sequence
  Synthetic
gccttaccugtttcattttcuccagt

SEQ ID NO: 83135 - DNA, 26 bp, Artificial Sequence
  Synthetic
ccccagccuaaatatgtatgtctgut

SEQ ID NO: 83136 - DNA, 27 bp, Artificial Sequence
  Synthetic
actatcactcuttactcccatucagga

SEQ ID NO: 83137 - DNA, 27 bp, Artificial Sequence
  Synthetic
acctaattgguactggaacaagugaac

SEQ ID NO: 83138 - DNA, 28 bp, Artificial Sequence
  Synthetic
cagatctcttcuaattcctgcttctugg

SEQ ID NO: 83139 - DNA, 23 bp, Artificial Sequence
  Synthetic
aggagcttgugttttccactugt

SEQ ID NO: 83140 - DNA, 23 bp, Artificial Sequence
  Synthetic
gcccatcaaccutctcttttgut

SEQ ID NO: 83141 - DNA, 26 bp, Artificial Sequence
  Synthetic
gctatattuggagcagacacactugg

SEQ ID NO: 83142 - DNA, 26 bp, Artificial Sequence
  Synthetic
acagaattugacacactugcagaaac

SEQ ID NO: 83143 - DNA, 26 bp, Artificial Sequence
  Synthetic
cttccccgcutactctaatcactuac

SEQ ID NO: 83144 - DNA, 23 bp, Artificial Sequence
  Synthetic
atccacuaagaaggcattucgct

SEQ ID NO: 83145 - DNA, 27 bp, Artificial Sequence
  Synthetic
acatccttcccugtctaattgctttut

SEQ ID NO: 83146 - DNA, 20 bp, Artificial Sequence
  Synthetic
ccuacccuggaaagcacacc

SEQ ID NO: 83147 - DNA, 27 bp, Artificial Sequence
  Synthetic
tctacccaacucacagaagaaucaaac

SEQ ID NO: 83148 - DNA, 22 bp, Artificial Sequence
  Synthetic
cccacagaugacaggugagaga

SEQ ID NO: 83149 - DNA, 25 bp, Artificial Sequence
  Synthetic
ctgttagaccautttgccaaucgag

SEQ ID NO: 83150 - DNA, 20 bp, Artificial Sequence
  Synthetic
cccutcatcaucgacccagt

SEQ ID NO: 83151 - DNA, 24 bp, Artificial Sequence
  Synthetic
catgguggaaagtgtugaaaacca

SEQ ID NO: 83152 - DNA, 24 bp, Artificial Sequence
  Synthetic
gggtgataugagggatagcaaauc

SEQ ID NO: 83153 - DNA, 25 bp, Artificial Sequence
  Synthetic
tcacattccagcuttaactccagut

SEQ ID NO: 83154 - DNA, 24 bp, Artificial Sequence
  Synthetic
gacgatccauatggtctgtgaugt

SEQ ID NO: 83155 - DNA, 24 bp, Artificial Sequence
  Synthetic
ttctgtgaugggccttttctguag

SEQ ID NO: 83156 - DNA, 28 bp, Artificial Sequence
  Synthetic
acgagttaatggcaauaaagggatguaa

SEQ ID NO: 83157 - DNA, 27 bp, Artificial Sequence
  Synthetic
gtgaaaaggctucttcaagagaaagug

SEQ ID NO: 83158 - DNA, 27 bp, Artificial Sequence
  Synthetic
ttctccctttctuctgtcctctcttua

SEQ ID NO: 83159 - DNA, 21 bp, Artificial Sequence
  Synthetic
guggtgttcucccaaacagga

SEQ ID NO: 83160 - DNA, 30 bp, Artificial Sequence; identical to SEQ ID NO: 20508
  Synthetic

SEQ ID NO: 83161 - DNA, 26 bp, Artificial Sequence
  Synthetic
agctgccuggaatggatatgatuaag

SEQ ID NO: 83162 - DNA, 22 bp, Artificial Sequence
  Synthetic
ggcacagacacautgcagguaa

SEQ ID NO: 83163 - DNA, 21 bp, Artificial Sequence
  Synthetic
gtggugcacacuggaagaaag

SEQ ID NO: 83164 - DNA, 19 bp, Artificial Sequence
  Synthetic
ctggccaucacctcggtua

SEQ ID NO: 83165 - DNA, 22 bp, Artificial Sequence
  Synthetic
tgtttguggctctgaaugacca

SEQ ID NO: 83166 - DNA, 25 bp, Artificial Sequence
  Synthetic
ctcacagagtaucatgtctccctug

SEQ ID NO: 83167 - DNA, 27 bp, Artificial Sequence
  Synthetic
ccaaatuaacgcccaggaaaaauacat

SEQ ID NO: 83168 - DNA, 23 bp, Artificial Sequence
  Synthetic
tttcttacccgugttgtgtcucc

SEQ ID NO: 83169 - DNA, 23 bp, Artificial Sequence
  Synthetic
ttttccagugcactctuggacat

SEQ ID NO: 83170 - DNA, 24 bp, Artificial Sequence
  Synthetic
gctcacttgtuctttgagctgaut

SEQ ID NO: 83171 - DNA, 25 bp, Artificial Sequence
  Synthetic
accagtgtttucagtgtgacaugat

SEQ ID NO: 83172 - DNA, 23 bp, Artificial Sequence
  Synthetic
cccctcctcutcttgttctcuca

SEQ ID NO: 83173 - DNA, 21 bp, Artificial Sequence
  Synthetic
aaaaccaccucccaagagucc

SEQ ID NO: 83174 - DNA, 28 bp, Artificial Sequence
  Synthetic
gtggcagaatatutctacagggttaugt

SEQ ID NO: 83175 - DNA, 23 bp, Artificial Sequence
  Synthetic
aggcatcucgtttgtacttuggg

SEQ ID NO: 83176 - DNA, 21 bp, Artificial Sequence
  Synthetic
catggagacagugcacctgut

SEQ ID NO: 83177 - DNA, 28 bp, Artificial Sequence
  Synthetic
agtgtttctgcaaautctaagaggtuct

SEQ ID NO: 83178 - DNA, 27 bp, Artificial Sequence
  Synthetic
caggttttggguctagtaatactggut

SEQ ID NO: 83179 - DNA, 27 bp, Artificial Sequence
  Synthetic
cagtgaagaaaacugaatgggttugat

SEQ ID NO: 83180 - DNA, 25 bp, Artificial Sequence
  Synthetic
cagggcaccautctggataatgtua

SEQ ID NO: 83181 - DNA, 28 bp, Artificial Sequence
  Synthetic
gcttggctauagaaaatggcaatgatut

SEQ ID NO: 83182 - DNA, 20 bp, Artificial Sequence
  Synthetic
cgcagaagcucagctguaac

SEQ ID NO: 83183 - DNA, 22 bp, Artificial Sequence
  Synthetic
gcatcaaugagagcacaauccc

SEQ ID NO: 83184 - DNA, 20 bp, Artificial Sequence
  Synthetic
ccccacacucgaccauagga

SEQ ID NO: 83185 - DNA, 20 bp, Artificial Sequence
  Synthetic
tcctgtuggagccguacaac

SEQ ID NO: 83186 - DNA, 24 bp, Artificial Sequence
  Synthetic
gcatgacacaauaactgggcucaa

SEQ ID NO: 83187 - DNA, 19 bp, Artificial Sequence
  Synthetic
ctcctccagcucctccgua

SEQ ID NO: 83188 - DNA, 20 bp, Artificial Sequence
  Synthetic
gcucccggatcucaaacacc

SEQ ID NO: 83189 - DNA, 23 bp, Artificial Sequence
  Synthetic
tgttcaaaggcuccattgctcut

SEQ ID NO: 83190 - DNA, 17 bp, Artificial Sequence
  Synthetic
ggctgcuggcaccctua

SEQ ID NO: 83191 - DNA, 19 bp, Artificial Sequence
  Synthetic
cgtggttcugcctgaccug

SEQ ID NO: 83192 - DNA, 19 bp, Artificial Sequence
  Synthetic
ggtggtcugtctggtcguc

SEQ ID NO: 83193 - DNA, 22 bp, Artificial Sequence
  Synthetic
aggaccuggagaccaagaagut

SEQ ID NO: 83194 - DNA, 18 bp, Artificial Sequence
  Synthetic
cttcucccagccctucgg

SEQ ID NO: 83195 - DNA, 22 bp, Artificial Sequence
  Synthetic
tcctccacagcutctctuacct

SEQ ID NO: 83196 - DNA, 22 bp, Artificial Sequence
  Synthetic
gctgtagtacugcagcacttug

SEQ ID NO: 83197 - DNA, 23 bp, Artificial Sequence
  Synthetic
ttttgaggagggaaugtcauggg

SEQ ID NO: 83198 - DNA, 24 bp, Artificial Sequence
  Synthetic
ccutgcagaauccaagaaaacagg

SEQ ID NO: 83199 - DNA, 24 bp, Artificial Sequence
  Synthetic
cattttccccutacctccatugct

SEQ ID NO: 83200 - DNA, 24 bp, Artificial Sequence
  Synthetic
tgcacaatacugacagaggaaguc

SEQ ID NO: 83201 - DNA, 21 bp, Artificial Sequence
  Synthetic
gagtgcttcuggagcacctua

SEQ ID NO: 83202 - DNA, 18 bp, Artificial Sequence
  Synthetic
cgggaccuccctgtcgua

SEQ ID NO: 83203 - DNA, 22 bp, Artificial Sequence
  Synthetic
gctccaccccutcctctttauc

SEQ ID NO: 83204 - DNA, 24 bp, Artificial Sequence
  Synthetic
aaacatgccttucacgttccttuc

SEQ ID NO: 83205 - DNA, 24 bp, Artificial Sequence
  Synthetic
tctctccttcutctcttggctuca

SEQ ID NO: 83206 - DNA, 21 bp, Artificial Sequence
  Synthetic
catgccagagautgcucagga

SEQ ID NO: 83207 - DNA, 24 bp, Artificial Sequence
  Synthetic
ccugttacucacagaaaccacaca

SEQ ID NO: 83208 - DNA, 22 bp, Artificial Sequence
  Synthetic
ccatuggacaggaagcggtaut

SEQ ID NO: 83209 - DNA, 22 bp, Artificial Sequence
  Synthetic
tgtcccagtcuctccaacctut

SEQ ID NO: 83210 - DNA, 22 bp, Artificial Sequence
  Synthetic
cagauccaaaaaggcggagcua

SEQ ID NO: 83211 - DNA, 21 bp, Artificial Sequence
  Synthetic
acaccccuctctccttgtugt

SEQ ID NO: 83212 - DNA, 24 bp, Artificial Sequence
  Synthetic
tgtgatagaaagccucccttcugt

SEQ ID NO: 83213 - DNA, 28 bp, Artificial Sequence
  Synthetic
tctactcatgccccucaaacttatttut

SEQ ID NO: 83214 - DNA, 27 bp, Artificial Sequence
  Synthetic
acacagcaacuattacatccugaaaca

SEQ ID NO: 83215 - DNA, 23 bp, Artificial Sequence
  Synthetic
cctgaaagcagutgaguccaaga

SEQ ID NO: 83216 - DNA, 21 bp, Artificial Sequence
  Synthetic
acgacttgccugcatgagaut

SEQ ID NO: 83217 - DNA, 27 bp, Artificial Sequence
  Synthetic
gaatguggcaagaactacaauaccaag

SEQ ID NO: 83218 - DNA, 22 bp, Artificial Sequence
  Synthetic
acguccacaaatgagugcacat

SEQ ID NO: 83219 - DNA, 27 bp, Artificial Sequence
  Synthetic
tggatgtaaacagccuctttgtagtut

SEQ ID NO: 83220 - DNA, 20 bp, Artificial Sequence
  Synthetic
tggguagcaacuggcacaaa

SEQ ID NO: 83221 - DNA, 20 bp, Artificial Sequence
  Synthetic
gcagccucaacatccccuac

SEQ ID NO: 83222 - DNA, 27 bp, Artificial Sequence
  Synthetic
cctaaaacgucatgattttcaauggca

SEQ ID NO: 83223 - DNA, 26 bp, Artificial Sequence
  Synthetic
attagacattccutgttgtgcucagt

SEQ ID NO: 83224 - DNA, 27 bp, Artificial Sequence
  Synthetic
aagtgtatacuaaggccttgtgaggua

SEQ ID NO: 83225 - DNA, 24 bp, Artificial Sequence
  Synthetic
cagcctaautcaggatugggaaac

SEQ ID NO: 83226 - DNA, 18 bp, Artificial Sequence
  Synthetic
ctgcacggccucgatcut

SEQ ID NO: 83227 - DNA, 20 bp, Artificial Sequence
  Synthetic
cagccccuctctgattgucc

SEQ ID NO: 83228 - DNA, 25 bp, Artificial Sequence
  Synthetic
gcagaacacacauaccaaagucagt

SEQ ID NO: 83229 - DNA, 23 bp, Artificial Sequence
  Synthetic
tuccccaaaacacaguaacccaa

SEQ ID NO: 83230 - DNA, 24 bp, Artificial Sequence
  Synthetic
ggccaagugacgtttaaauccaag

SEQ ID NO: 83231 - DNA, 26 bp, Artificial Sequence
  Synthetic
tgugagaaaatgttucaccggaaaga

SEQ ID NO: 83232 - DNA, 22 bp, Artificial Sequence
  Synthetic
ccutagaaacactucggcaggt

SEQ ID NO: 83233 - DNA, 26 bp, Artificial Sequence
  Synthetic
ctgggcttccutacttgtaatcugat

SEQ ID NO: 83234 - DNA, 19 bp, Artificial Sequence
  Synthetic
acctcugagcacagugcag

SEQ ID NO: 83235 - DNA, 17 bp, Artificial Sequence
  Synthetic
acgugccacccctucag

SEQ ID NO: 83236 - DNA, 28 bp, Artificial Sequence
  Synthetic
gtcagacacaaggucagaaaguaaaaga

SEQ ID NO: 83237 - DNA, 25 bp, Artificial Sequence
  Synthetic
ctttgaagatgutaactgggctucc

SEQ ID NO: 83238 - DNA, 33 bp, Artificial Sequence; identical to SEQ ID NO: 62440
  Synthetic

SEQ ID NO: 83239 - DNA, 24 bp, Artificial Sequence
  Synthetic
gccgcataugttcttcttttguga

SEQ ID NO: 83240 - DNA, 28 bp, Artificial Sequence
  Synthetic
acttcagagtatugccaatcatgttcuc

SEQ ID NO: 83241 - DNA, 24 bp, Artificial Sequence
  Synthetic
agcaacugagtaaguggcaagaaa

SEQ ID NO: 83242 - DNA, 28 bp, Artificial Sequence
  Synthetic
ctctaccagagutaatcaactgaugcaa

SEQ ID NO: 83243 - DNA, 24 bp, Artificial Sequence
  Synthetic
tgccaacaaggacagutgauacaa

SEQ ID NO: 83244 - DNA, 24 bp, Artificial Sequence
  Synthetic
tgucccaaagcagaaguaaaacca

SEQ ID NO: 83245 - DNA, 25 bp, Artificial Sequence
  Synthetic
ccaagccugggacctctattaucat

SEQ ID NO: 83246 - DNA, 17 bp, Artificial Sequence
  Synthetic
ggctggccuggtgacug

SEQ ID NO: 83247 - DNA, 22 bp, Artificial Sequence
  Synthetic
agtaugaccagcagcgtacuct

SEQ ID NO: 83248 - DNA, 26 bp, Artificial Sequence
  Synthetic
gagtcucaaacaggaagacaacucaa

SEQ ID NO: 83249 - DNA, 27 bp, Artificial Sequence
  Synthetic
aggaatatcacaucctaccccguaaaa

SEQ ID NO: 83250 - DNA, 25 bp, Artificial Sequence
  Synthetic
ctgcaaagaaauatacaugcgggaa

SEQ ID NO: 83251 - DNA, 27 bp, Artificial Sequence
  Synthetic
ctttggaaccacaaauaccacctcuaa

SEQ ID NO: 83252 - DNA, 22 bp, Artificial Sequence
  Synthetic
guccagguaaacaagcccagat

SEQ ID NO: 83253 - DNA, 28 bp, Artificial Sequence
  Synthetic
gcagacattgugctcaatactttgttuc

SEQ ID NO: 83254 - DNA, 28 bp, Artificial Sequence
  Synthetic
cagaatatggguaaagatgauccgacaa

SEQ ID NO: 83255 - DNA, 25 bp, Artificial Sequence
  Synthetic
cactgacaauccagctaauccagaa

SEQ ID NO: 83256 - DNA, 21 bp, Artificial Sequence
  Synthetic
ccagaugtgcugccaaaagga

SEQ ID NO: 83257 - DNA, 27 bp, Artificial Sequence
  Synthetic
gcccaattccaaugcatcttatacaut

SEQ ID NO: 83258 - DNA, 19 bp, Artificial Sequence
  Synthetic
ccacagcccugcctgtauc

SEQ ID NO: 83259 - DNA, 17 bp, Artificial Sequence
  Synthetic
ggcutccuccccggagt

SEQ ID NO: 83260 - DNA, 17 bp, Artificial Sequence
  Synthetic
gccccaugggctgcuac

SEQ ID NO: 83261 - DNA, 17 bp, Artificial Sequence
  Synthetic
gtgccccggaguccaua

SEQ ID NO: 83262 - DNA, 28 bp, Artificial Sequence
  Synthetic
agatagaagttccugtcactttctccut

SEQ ID NO: 83263 - DNA, 27 bp, Artificial Sequence
  Synthetic
agaaaaaguacagaagaagcugaccat

SEQ ID NO: 83264 - DNA, 24 bp, Artificial Sequence
  Synthetic
cctgatcacutctcatcugaagca

SEQ ID NO: 83265 - DNA, 23 bp, Artificial Sequence
  Synthetic
gagcacaacugagcatcugaaga

SEQ ID NO: 83266 - DNA, 22 bp, Artificial Sequence
  Synthetic
caugtgtggugcagaggagaaa

SEQ ID NO: 83267 - DNA, 24 bp, Artificial Sequence
  Synthetic
catcacctucatcttcaaguccct

SEQ ID NO: 83268 - DNA, 29 bp, Artificial Sequence
  Synthetic
ctatctttggutgagtttctuagagaagt

SEQ ID NO: 83269 - DNA, 26 bp, Artificial Sequence
  Synthetic
ggacagttgaaucttcaggctuaagg

SEQ ID NO: 83270 - DNA, 20 bp, Artificial Sequence
  Synthetic
cccagacugggcagttugac

SEQ ID NO: 83271 - DNA, 26 bp, Artificial Sequence
  Synthetic
gcccagtgaagcauatgagattacuc

SEQ ID NO: 83272 - DNA, 26 bp, Artificial Sequence
  Synthetic
gacagcttugaggaagcatgtattuc

SEQ ID NO: 83273 - DNA, 21 bp, Artificial Sequence
  Synthetic
guttgtagcucccccaccaaa

SEQ ID NO: 83274 - DNA, 19 bp, Artificial Sequence
  Synthetic
gccagttcgugggcttgut

SEQ ID NO: 83275 - DNA, 28 bp, Artificial Sequence
  Synthetic
acccagcctaaucttgtttttcttaugt

SEQ ID NO: 83276 - DNA, 28 bp, Artificial Sequence
  Synthetic
agagcauaaaagtuaaaagcaaacagca

SEQ ID NO: 83277 - DNA, 21 bp, Artificial Sequence
  Synthetic
gctaccaccagugccaugaac

SEQ ID NO: 83278 - DNA, 28 bp, Artificial Sequence
  Synthetic
ggtgggatcauattcatctacaaagugg

SEQ ID NO: 83279 - DNA, 21 bp, Artificial Sequence
  Synthetic
acaggttcutgctggtgugaa

SEQ ID NO: 83280 - DNA, 23 bp, Artificial Sequence
  Synthetic
aactgttccaugctctccttcug

SEQ ID NO: 83281 - DNA, 20 bp, Artificial Sequence
  Synthetic
ctttaggccutctgccuggt

SEQ ID NO: 83282 - DNA, 22 bp, Artificial Sequence
  Synthetic
gctutgagattcgucggaacac

SEQ ID NO: 83283 - DNA, 25 bp, Artificial Sequence
  Synthetic
gataacttgaaaacgugcctgctut

SEQ ID NO: 83284 - DNA, 22 bp, Artificial Sequence
  Synthetic
ggaacugcacacatttgagucc

SEQ ID NO: 83285 - DNA, 23 bp, Artificial Sequence
  Synthetic
gaaatgcuggtcaacaugggaaa

SEQ ID NO: 83286 - DNA, 22 bp, Artificial Sequence
  Synthetic
aggtaggccuctgagugaagaa

SEQ ID NO: 83287 - DNA, 22 bp, Artificial Sequence
  Synthetic
catgtggtccugtgctcttuca

SEQ ID NO: 83288 - DNA, 23 bp, Artificial Sequence
  Synthetic
cgaatcataccuccttggacugg

SEQ ID NO: 83289 - DNA, 28 bp, Artificial Sequence
  Synthetic
cagttactgcauctctcagttttcttug

SEQ ID NO: 83290 - DNA, 19 bp, Artificial Sequence
  Synthetic
ccaucugccagggagcaaa

SEQ ID NO: 83291 - DNA, 19 bp, Artificial Sequence
  Synthetic
cuccccacccattucacca

SEQ ID NO: 83292 - DNA, 25 bp, Artificial Sequence
  Synthetic
gtaaacccttuagccttcctggtua

SEQ ID NO: 83293 - DNA, 27 bp, Artificial Sequence
  Synthetic
cutaatttacatgtagugcccaggact

SEQ ID NO: 83294 - DNA, 27 bp, Artificial Sequence
  Synthetic
gctctagacuaagttgctttcaaguga

SEQ ID NO: 83295 - DNA, 28 bp, Artificial Sequence
  Synthetic
gcagatcagtuaacagacaaaagucaac

SEQ ID NO: 83296 - DNA, 18 bp, Artificial Sequence
  Synthetic
gatgccuggcaggcctua

SEQ ID NO: 83297 - DNA, 18 bp, Artificial Sequence
  Synthetic
ggttcugctcccguccag

SEQ ID NO: 83298 - DNA, 22 bp, Artificial Sequence
  Synthetic
tgggaauggagccatctcctua

SEQ ID NO: 83299 - DNA, 22 bp, Artificial Sequence
  Synthetic
agcaagugcaacccttcttuga

SEQ ID NO: 83300 - DNA, 23 bp, Artificial Sequence
  Synthetic
gguagaactcauccagaggcaag

SEQ ID NO: 83301 - DNA, 22 bp, Artificial Sequence
  Synthetic
ctaaccaugctctgccugaagt

SEQ ID NO: 83302 - DNA, 22 bp, Artificial Sequence
  Synthetic
ccccgactutgcagtcctuaat

SEQ ID NO: 83303 - DNA, 21 bp, Artificial Sequence
  Synthetic
cttctcaggcccutcagaguc

SEQ ID NO: 83304 - DNA, 24 bp, Artificial Sequence
  Synthetic
ctcctcagguatcccaaagatuca

SEQ ID NO: 83305 - DNA, 20 bp, Artificial Sequence
  Synthetic
acggagaccuggtggacuac

SEQ ID NO: 83306 - DNA, 20 bp, Artificial Sequence
  Synthetic
ccucagggaccaaggcuagt

SEQ ID NO: 83307 - DNA, 23 bp, Artificial Sequence
  Synthetic
ccatgtgagcutgagaaggcuat

SEQ ID NO: 83308 - DNA, 21 bp, Artificial Sequence
  Synthetic
cccctacccugcctcaacaua

SEQ ID NO: 83309 - DNA, 21 bp, Artificial Sequence
  Synthetic
gccctgacccutctccctauc

SEQ ID NO: 83310 - DNA, 22 bp, Artificial Sequence
  Synthetic
gctttatcuacagcctguccga

SEQ ID NO: 83311 - DNA, 22 bp, Artificial Sequence
  Synthetic
aauatcgugcacaaggcagagt

SEQ ID NO: 83312 - DNA, 21 bp, Artificial Sequence
  Synthetic
ctggcacuaatggcctttucc

SEQ ID NO: 83313 - DNA, 21 bp, Artificial Sequence
  Synthetic
gtctcctggcutgatggaguc

SEQ ID NO: 83314 - DNA, 22 bp, Artificial Sequence
  Synthetic
ccaactcaccagcugttcctua

SEQ ID NO: 83315 - DNA, 19 bp, Artificial Sequence
  Synthetic
ggcacaguccagcaccuac

SEQ ID NO: 83316 - DNA, 22 bp, Artificial Sequence
  Synthetic
ctgcaggaaggugtgtttgtug

SEQ ID NO: 83317 - DNA, 20 bp, Artificial Sequence
  Synthetic
ccacauccagcccctgatua

SEQ ID NO: 83318 - DNA, 22 bp, Artificial Sequence
  Synthetic
cccctaccuctgatagcgacuc

SEQ ID NO: 83319 - DNA, 26 bp, Artificial Sequence
  Synthetic
agcctgtgtcuttaagtccagauact

SEQ ID NO: 83320 - DNA, 18 bp, Artificial Sequence
  Synthetic
tcggccaccuccatcuca

SEQ ID NO: 83321 - DNA, 17 bp, Artificial Sequence
  Synthetic
ggguccacgctguagcc

SEQ ID NO: 83322 - DNA, 21 bp, Artificial Sequence
  Synthetic
cacacggccacaaaaaugtug

SEQ ID NO: 83323 - DNA, 25 bp, Artificial Sequence
  Synthetic
caatgagagttcucggtttgcttut

SEQ ID NO: 83324 - DNA, 21 bp, Artificial Sequence
  Synthetic
gttggtctcaugcctcctugt

SEQ ID NO: 83325 - DNA, 25 bp, Artificial Sequence
  Synthetic
aacuttaagctgcauacaggcaaag

SEQ ID NO: 83326 - DNA, 19 bp, Artificial Sequence
  Synthetic
cctacugcccacccaccua

SEQ ID NO: 83327 - DNA, 24 bp, Artificial Sequence
  Synthetic
guagctctccauaaacaagcagga

SEQ ID NO: 83328 - DNA, 25 bp, Artificial Sequence
  Synthetic
cagattcttcauatctaggcugcga

SEQ ID NO: 83329 - DNA, 21 bp, Artificial Sequence
  Synthetic
agctgcgugtgtttcctuaca

SEQ ID NO: 83330 - DNA, 25 bp, Artificial Sequence
  Synthetic
cttcttcugacggtgagttctucaa

SEQ ID NO: 83331 - DNA, 25 bp, Artificial Sequence
  Synthetic
cagtgtuggtttttaaaucccaggt

SEQ ID NO: 83332 - DNA, 24 bp, Artificial Sequence
  Synthetic
gggccctaucctcctgattagtut

SEQ ID NO: 83333 - DNA, 22 bp, Artificial Sequence
  Synthetic
gagaacagcugaatggctcuca

SEQ ID NO: 83334 - DNA, 21 bp, Artificial Sequence
  Synthetic
cctcccugcagtttgtgauct

SEQ ID NO: 83335 - DNA, 28 bp, Artificial Sequence
  Synthetic
cagtgagccaaguatgacttcatatgua

SEQ ID NO: 83336 - DNA, 23 bp, Artificial Sequence
  Synthetic
tcatggugaaagacgauggacaa

SEQ ID NO: 83337 - DNA, 27 bp, Artificial Sequence
  Synthetic
tcttcttgtgauccaaaaagtguccaa

SEQ ID NO: 83338 - DNA, 28 bp, Artificial Sequence
  Synthetic
gattttggacacuttttggaucacaaga

SEQ ID NO: 83339 - DNA, 22 bp, Artificial Sequence
  Synthetic
gctcgagcucacctctcaaaut

SEQ ID NO: 83340 - DNA, 28 bp, Artificial Sequence
  Synthetic
gccatttgtttugacacaggatttctua

SEQ ID NO: 83341 - DNA, 28 bp, Artificial Sequence
  Synthetic
tgautgtttctaauagagcagccagaac

SEQ ID NO: 83342 - DNA, 28 bp, Artificial Sequence
  Synthetic
aaaagcacaaauacctaccgagaauaca

SEQ ID NO: 83343 - DNA, 25 bp, Artificial Sequence
  Synthetic
ccaucttcatucacccagaagaaac

SEQ ID NO: 83344 - DNA, 26 bp, Artificial Sequence
  Synthetic
gcaggtttcutccagattacucagaa

SEQ ID NO: 83345 - DNA, 27 bp, Artificial Sequence
  Synthetic
tcctccccaagaautgaaaaagtaugg

SEQ ID NO: 83346 - DNA, 25 bp, Artificial Sequence
  Synthetic
gctcuaccaagagaagtucagaaca

SEQ ID NO: 83347 - DNA, 22 bp, Artificial Sequence
  Synthetic
gacctcgutgtgagauggacat

SEQ ID NO: 83348 - DNA, 21 bp, Artificial Sequence
  Synthetic
ctgagagauctgggtgcaugt

SEQ ID NO: 83349 - DNA, 28 bp, Artificial Sequence
  Synthetic
tgctttctgtcuatgtgtgtgtgtauag

SEQ ID NO: 83350 - DNA, 28 bp, Artificial Sequence
  Synthetic
ccataaaaataugcagctccatcucgaa

SEQ ID NO: 83351 - DNA, 21 bp, Artificial Sequence
  Synthetic
cagccagugaaactcctcuga

SEQ ID NO: 83352 - DNA, 27 bp, Artificial Sequence
  Synthetic
ctgttggatttucatcaagtcaauggg

SEQ ID NO: 83353 - DNA, 24 bp, Artificial Sequence
  Synthetic
tgctctgucacttggaatgtugaa

SEQ ID NO: 83354 - DNA, 28 bp, Artificial Sequence
  Synthetic
atcggcaatcugatgattttctagtuca

SEQ ID NO: 83355 - DNA, 20 bp, Artificial Sequence
  Synthetic
aggcctaguccctcgugaaa

SEQ ID NO: 83356 - DNA, 20 bp, Artificial Sequence
  Synthetic
ctgaccacaccgcgutctua

SEQ ID NO: 83357 - DNA, 21 bp, Artificial Sequence
  Synthetic
atcgcatcucatgcccttcuc

SEQ ID NO: 83358 - DNA, 23 bp, Artificial Sequence
  Synthetic
ccctcgggagaugtccauaaaag

SEQ ID NO: 83359 - DNA, 20 bp, Artificial Sequence
  Synthetic
cggatgccaaucacctcgut

SEQ ID NO: 83360 - DNA, 20 bp, Artificial Sequence
  Synthetic
tcaggtggcuacaggccaua

SEQ ID NO: 83361 - DNA, 28 bp, Artificial Sequence
  Synthetic
aaaaccaggaaaaacugcaagaactuaa

SEQ ID NO: 83362 - DNA, 18 bp, Artificial Sequence
  Synthetic
tccctcguctccccctug

SEQ ID NO: 83363 - DNA, 17 bp, Artificial Sequence
  Synthetic
cugcacuccgccgaaag

SEQ ID NO: 83364 - DNA, 21 bp, Artificial Sequence
  Synthetic
gggtctgaauggcactcatug

SEQ ID NO: 83365 - DNA, 27 bp, Artificial Sequence
  Synthetic
tttgatcccaguaattggtacttgugt

SEQ ID NO: 83366 - DNA, 21 bp, Artificial Sequence
  Synthetic
tcatuccctggtuagccagat

SEQ ID NO: 83367 - DNA, 22 bp, Artificial Sequence
  Synthetic
gcacagcaguttccatttccuc

SEQ ID NO: 83368 - DNA, 26 bp, Artificial Sequence
  Synthetic
ggcatagcattuctgttagacgtuga

SEQ ID NO: 83369 - DNA, 28 bp, Artificial Sequence
  Synthetic
gcacaaguagggtaacaagttugaaaaa

SEQ ID NO: 83370 - DNA, 21 bp, Artificial Sequence
  Synthetic
ggttgagcaucctgcatccut

SEQ ID NO: 83371 - DNA, 21 bp, Artificial Sequence
  Synthetic
ctagatgcaaggcugttcguc

SEQ ID NO: 83372 - DNA, 21 bp, Artificial Sequence
  Synthetic
cctugccataggugacagact

SEQ ID NO: 83373 - DNA, 27 bp, Artificial Sequence
  Synthetic
cagagcagcauctttaatgaatauccc

SEQ ID NO: 83374 - DNA, 25 bp, Artificial Sequence
  Synthetic
acatcatctcuaacctggactgugt

SEQ ID NO: 83375 - DNA, 20 bp, Artificial Sequence
  Synthetic
ctcctcacucaccagctguc

SEQ ID NO: 83376 - DNA, 26 bp, Artificial Sequence
  Synthetic
gtcttuacaaaaggaacggaaagugt

SEQ ID NO: 83377 - DNA, 20 bp, Artificial Sequence
  Synthetic
ctgacaggucctgcctaugg

SEQ ID NO: 83378 - DNA, 21 bp, Artificial Sequence
  Synthetic
ggccugcagcataagagauca

SEQ ID NO: 83379 - DNA, 27 bp, Artificial Sequence
  Synthetic
cacactaatcttcucttgccttctcua

SEQ ID NO: 83380 - DNA, 20 bp, Artificial Sequence
  Synthetic
ctggatcugctgguggacag

SEQ ID NO: 83381 - DNA, 22 bp, Artificial Sequence
  Synthetic
cactcctuccacaatccucagt

SEQ ID NO: 83382 - DNA, 22 bp, Artificial Sequence
  Synthetic
cattgagtacaugcccctccug

SEQ ID NO: 83383 - DNA, 21 bp, Artificial Sequence
  Synthetic
cagttgucacagcctccacua

SEQ ID NO: 83384 - DNA, 20 bp, Artificial Sequence
  Synthetic
tccaagucacccagcaagug

SEQ ID NO: 83385 - DNA, 27 bp, Artificial Sequence
  Synthetic
agaagtaaatucgggaaaggugaagag

SEQ ID NO: 83386 - DNA, 26 bp, Artificial Sequence
  Synthetic
ggatctaaguccagtaccgtagttug

SEQ ID NO: 83387 - DNA, 25 bp, Artificial Sequence
  Synthetic
aacuttgatgaugagaggacaaggg

SEQ ID NO: 83388 - DNA, 20 bp, Artificial Sequence
  Synthetic
gatgccuctgcctucaggaa

SEQ ID NO: 83389 - DNA, 19 bp, Artificial Sequence
  Synthetic
tggaccgcgugttugagag

SEQ ID NO: 83390 - DNA, 20 bp, Artificial Sequence
  Synthetic
ctctttgccuggctcuaggt

SEQ ID NO: 83391 - DNA, 19 bp, Artificial Sequence
  Synthetic
tttccacguccggtgugag

SEQ ID NO: 83392 - DNA, 17 bp, Artificial Sequence
  Synthetic
gcggccgccugactuac

SEQ ID NO: 83393 - DNA, 22 bp, Artificial Sequence
  Synthetic
gcaaautgtgtcugcagcaaga

SEQ ID NO: 83394 - DNA, 18 bp, Artificial Sequence
  Synthetic
gccgcagaacutccuggt

SEQ ID NO: 83395 - DNA, 17 bp, Artificial Sequence
  Synthetic
gagcggugcuggcaaag

SEQ ID NO: 83396 - DNA, 22 bp, Artificial Sequence
  Synthetic
ctgatgccuccagtugacaaga

SEQ ID NO: 83397 - DNA, 21 bp, Artificial Sequence
  Synthetic
ctcacacugaccaaccucact

SEQ ID NO: 83398 - DNA, 27 bp, Artificial Sequence
  Synthetic
ccaataaagaauaaggtttgccccaut

SEQ ID NO: 83399 - DNA, 22 bp, Artificial Sequence
  Synthetic
ggaagcacaaagautgcgcuat

SEQ ID NO: 83400 - DNA, 22 bp, Artificial Sequence
  Synthetic
tgtttggccutcttctcgctut

SEQ ID NO: 83401 - DNA, 21 bp, Artificial Sequence
  Synthetic
ccctgctugtctcaaccaugt

SEQ ID NO: 83402 - DNA, 27 bp, Artificial Sequence
  Synthetic
ctgtcttaccuaaaccatauagcgcaa

SEQ ID NO: 83403 - DNA, 28 bp, Artificial Sequence
  Synthetic
ggacattttaagtugtgctggatttgua

SEQ ID NO: 83404 - DNA, 20 bp, Artificial Sequence
  Synthetic
tccacctucgaatcccucct

SEQ ID NO: 83405 - DNA, 18 bp, Artificial Sequence
  Synthetic
gcttcugcctccgugact

SEQ ID NO: 83406 - DNA, 18 bp, Artificial Sequence
  Synthetic
ggguagccugggcagagt

SEQ ID NO: 83407 - DNA, 20 bp, Artificial Sequence
  Synthetic
ttcucacaacccucggaacc

SEQ ID NO: 83408 - DNA, 22 bp, Artificial Sequence
  Synthetic
gacagaccaagaggauguggat

SEQ ID NO: 83409 - DNA, 23 bp, Artificial Sequence
  Synthetic
ccttcatucccgcttcattucag

SEQ ID NO: 83410 - DNA, 17 bp, Artificial Sequence
  Synthetic
ccauggcaguggacgct

SEQ ID NO: 83411 - DNA, 19 bp, Artificial Sequence
  Synthetic
cccccagagaaggcutgug

SEQ ID NO: 83412 - DNA, 24 bp, Artificial Sequence
  Synthetic
ggtgaagatguctgagtagtgcug

SEQ ID NO: 83413 - DNA, 23 bp, Artificial Sequence
  Synthetic
ccttcctcuctcctgctcaucaa

SEQ ID NO: 83414 - DNA, 26 bp, Artificial Sequence
  Synthetic
acagacattgaacguccaaagtgaut

SEQ ID NO: 83415 - DNA, 28 bp, Artificial Sequence
  Synthetic
aggtgatacgauattcatgcagauacct

SEQ ID NO: 83416 - DNA, 23 bp, Artificial Sequence
  Synthetic
gctgggaagutctggttaaugga

SEQ ID NO: 83417 - DNA, 19 bp, Artificial Sequence
  Synthetic
tggcagagguacgagcuct

SEQ ID NO: 83418 - DNA, 24 bp, Artificial Sequence
  Synthetic
caccatgctuggtgtcatatucaa

SEQ ID NO: 83419 - DNA, 20 bp, Artificial Sequence
  Synthetic
catgtgtugccccggattuc

SEQ ID NO: 83420 - DNA, 21 bp, Artificial Sequence
  Synthetic
cccccacccccaguaacuaaa

SEQ ID NO: 83421 - DNA, 21 bp, Artificial Sequence
  Synthetic
agauttgatgcuccgggacac

SEQ ID NO: 83422 - DNA, 28 bp, Artificial Sequence
  Synthetic
cttcagtagaaauttcaaaagcgtcuct

SEQ ID NO: 83423 - DNA, 20 bp, Artificial Sequence
  Synthetic
atcccgaauccaggcaucac

SEQ ID NO: 83424 - DNA, 24 bp, Artificial Sequence
  Synthetic
aaaagtattcucccgtgtcuagcc

SEQ ID NO: 83425 - DNA, 21 bp, Artificial Sequence
  Synthetic
aatgtcuccagcaccttcgut

SEQ ID NO: 83426 - DNA, 19 bp, Artificial Sequence
  Synthetic
ccgccggcaautgatcuca

SEQ ID NO: 83427 - DNA, 20 bp, Artificial Sequence
  Synthetic
gcgatcggagauggatguct

SEQ ID NO: 83428 - DNA, 23 bp, Artificial Sequence
  Synthetic
cgcagacaautgttccccugaat

SEQ ID NO: 83429 - DNA, 26 bp, Artificial Sequence
  Synthetic
aatgttaccagacuccttctctcuca

SEQ ID NO: 83430 - DNA, 23 bp, Artificial Sequence
  Synthetic
cagatucaagagctgugggagaa

SEQ ID NO: 83431 - DNA, 22 bp, Artificial Sequence
  Synthetic
gtccaccuatacccuggaggag

SEQ ID NO: 83432 - DNA, 24 bp, Artificial Sequence
  Synthetic
gttgtatgctuggcgaatgtugag

SEQ ID NO: 83433 - DNA, 25 bp, Artificial Sequence
  Synthetic
tccauttgucgaaagaacaggagag

SEQ ID NO: 83434 - DNA, 23 bp, Artificial Sequence
  Synthetic
cttttcagccagugagaggguag

SEQ ID NO: 83435 - DNA, 28 bp, Artificial Sequence
  Synthetic
tcagaccttagaacugagggaaatttug

SEQ ID NO: 83436 - DNA, 19 bp, Artificial Sequence
  Synthetic
cacutggcugggcaaagag

SEQ ID NO: 83437 - DNA, 18 bp, Artificial Sequence
  Synthetic
cucggcgttucaaaggca

SEQ ID NO: 83438 - DNA, 18 bp, Artificial Sequence
  Synthetic
gcugaacccgagcagguc

SEQ ID NO: 83439 - DNA, 21 bp, Artificial Sequence
  Synthetic
gaagccccugtttcctgaugt

SEQ ID NO: 83440 - DNA, 21 bp, Artificial Sequence
  Synthetic
ctcaugcaccaagactgguca

SEQ ID NO: 83441 - DNA, 24 bp, Artificial Sequence
  Synthetic
gcctcatctcacuctgtctctgut

SEQ ID NO: 83442 - DNA, 20 bp, Artificial Sequence
  Synthetic
ctcagacgugatgtgcucca

SEQ ID NO: 83443 - DNA, 22 bp, Artificial Sequence
  Synthetic
cctccttacugaatgccucact

SEQ ID NO: 83444 - DNA, 23 bp, Artificial Sequence
  Synthetic
tgtggaatccugatgctcctgua

SEQ ID NO: 83445 - DNA, 30 bp, Artificial Sequence; identical to SEQ ID NO: 54239
  Synthetic

SEQ ID NO: 83446 - DNA, 28 bp, Artificial Sequence
  Synthetic
acaggcttcaugagaatgtaaucaacat

SEQ ID NO: 83447 - DNA, 27 bp, Artificial Sequence
  Synthetic
cagauaatcctaaaguaacccaagcca

SEQ ID NO: 83448 - DNA, 22 bp, Artificial Sequence
  Synthetic
cagaagctutgtatggctuggg

SEQ ID NO: 83449 - DNA, 23 bp, Artificial Sequence
  Synthetic
cacttcagacaugttggttugct

SEQ ID NO: 83450 - DNA, 23 bp, Artificial Sequence
  Synthetic
gcagtgatgagucccttccttuc

SEQ ID NO: 83451 - DNA, 26 bp, Artificial Sequence
  Synthetic
gatgcatcttcauctctgttttccuc

SEQ ID NO: 83452 - DNA, 22 bp, Artificial Sequence
  Synthetic
tggcaggagguactgttgtcua

SEQ ID NO: 83453 - DNA, 27 bp, Artificial Sequence
  Synthetic
gtcttgtctatuaagcctcacctucag

SEQ ID NO: 83454 - DNA, 29 bp, Artificial Sequence
  Synthetic
cactgtgugaagaggaattttatgcauat

SEQ ID NO: 83455 - DNA, 25 bp, Artificial Sequence
  Synthetic
ttgcacatcacccugaggaaattua

SEQ ID NO: 83456 - DNA, 21 bp, Artificial Sequence
  Synthetic
ggtctacucaggcctcctugt

SEQ ID NO: 83457 - DNA, 23 bp, Artificial Sequence
  Synthetic
gtgattgttcuccctccatucca

SEQ ID NO: 83458 - DNA, 22 bp, Artificial Sequence
  Synthetic
gggaagaccuttgcagtguaaa

SEQ ID NO: 83459 - DNA, 25 bp, Artificial Sequence
  Synthetic
ggatggtuctggatttctucgaagg

SEQ ID NO: 83460 - DNA, 21 bp, Artificial Sequence
  Synthetic
ctgttgggcucagattgtugg

SEQ ID NO: 83461 - DNA, 22 bp, Artificial Sequence
  Synthetic
cgaagucacagcgaatcaggua

SEQ ID NO: 83462 - DNA, 28 bp, Artificial Sequence
  Synthetic
tggtcactaaaccutaagatgagcatug

SEQ ID NO: 83463 - DNA, 28 bp, Artificial Sequence
  Synthetic
cctaatttcagcuatattccctggctua

SEQ ID NO: 83464 - DNA, 24 bp, Artificial Sequence
  Synthetic
gcgaagaauccacuaagggaaagt

SEQ ID NO: 83465 - DNA, 21 bp, Artificial Sequence
  Synthetic
cccaggatgugggagtctuct

SEQ ID NO: 83466 - DNA, 23 bp, Artificial Sequence
  Synthetic
cctgagaccaucagauaggccaa

SEQ ID NO: 83467 - DNA, 20 bp, Artificial Sequence
  Synthetic
ccucgggcatcugacaagag

SEQ ID NO: 83468 - DNA, 21 bp, Artificial Sequence
  Synthetic
gagauggagcaguggaaccat

SEQ ID NO: 83469 - DNA, 22 bp, Artificial Sequence
  Synthetic
cttctcaguggctgtctcctuc

SEQ ID NO: 83470 - DNA, 22 bp, Artificial Sequence
  Synthetic
guagtgacattucgggaaggct

SEQ ID NO: 83471 - DNA, 27 bp, Artificial Sequence
  Synthetic
atcattcagtttugcagataggacuca

SEQ ID NO: 83472 - DNA, 26 bp, Artificial Sequence
  Synthetic
actttaaugccagggattttgtucct

SEQ ID NO: 83473 - DNA, 29 bp, Artificial Sequence
  Synthetic
tctggacacaagauaaggagaatgattug

SEQ ID NO: 83474 - DNA, 25 bp, Artificial Sequence
  Synthetic
ccaaagagaacaaugcctagagcut

SEQ ID NO: 83475 - DNA, 21 bp, Artificial Sequence
  Synthetic
ccggacatuccaagcctctua

SEQ ID NO: 83476 - DNA, 24 bp, Artificial Sequence
  Synthetic
caaagaaucagaacaatgccucca

SEQ ID NO: 83477 - DNA, 28 bp, Artificial Sequence
  Synthetic
gaggcattcuaaagtcactatcatucca

SEQ ID NO: 83478 - DNA, 19 bp, Artificial Sequence
  Synthetic
agcagcaguttggccacua

SEQ ID NO: 83479 - DNA, 29 bp, Artificial Sequence
  Synthetic
caccttgaguaaaataaactgctucacat

SEQ ID NO: 83480 - DNA, 23 bp, Artificial Sequence
  Synthetic
cccagcttucaggtaaccttuga

SEQ ID NO: 83481 - DNA, 24 bp, Artificial Sequence
  Synthetic
tgaatactcuggcaatgcctaugg

SEQ ID NO: 83482 - DNA, 25 bp, Artificial Sequence
  Synthetic
gatagtgacuttagaatgccuccgt

SEQ ID NO: 83483 - DNA, 27 bp, Artificial Sequence
  Synthetic
ccctttctgctucttgagtaacactua

SEQ ID NO: 83484 - DNA, 23 bp, Artificial Sequence
  Synthetic
cctgctccgaaaugtagacgaut

SEQ ID NO: 83485 - DNA, 24 bp, Artificial Sequence
  Synthetic
gagtacacactucagaaccagguc

SEQ ID NO: 83486 - DNA, 28 bp, Artificial Sequence
  Synthetic
ttgaaatttgguggatctatgtctucgt

SEQ ID NO: 83487 - DNA, 29 bp, Artificial Sequence
  Synthetic
gactacttgaugagatgtctgatttcugt

SEQ ID NO: 83488 - DNA, 21 bp, Artificial Sequence
  Synthetic
gcctcgcugtaggaggaguag

SEQ ID NO: 83489 - DNA, 21 bp, Artificial Sequence
  Synthetic
ccccaaccautcctgagctug

SEQ ID NO: 83490 - DNA, 27 bp, Artificial Sequence
  Synthetic
agagaaatcaacaacugatgacgaugt

SEQ ID NO: 83491 - DNA, 27 bp, Artificial Sequence
  Synthetic
cactttctgagucaatgaagacaccua

SEQ ID NO: 83492 - DNA, 25 bp, Artificial Sequence
  Synthetic
aaaacagcctcuctcttacctcuct

SEQ ID NO: 83493 - DNA, 26 bp, Artificial Sequence
  Synthetic
gcgtattgctucctctctcttcttua

SEQ ID NO: 83494 - DNA, 28 bp, Artificial Sequence
  Synthetic
cctccatcaacutcttcaagatgaauct

SEQ ID NO: 83495 - DNA, 25 bp, Artificial Sequence
  Synthetic
cggttgcctacuggttcaattacut

SEQ ID NO: 83496 - DNA, 26 bp, Artificial Sequence
  Synthetic
ccttcggcttuttcaacccttttuaa

SEQ ID NO: 83497 - DNA, 26 bp, Artificial Sequence
  Synthetic
aagggacaacagutaagctttauggt

SEQ ID NO: 83498 - DNA, 21 bp, Artificial Sequence
  Synthetic
ctgtgatucaggtgccucact

SEQ ID NO: 83499 - DNA, 22 bp, Artificial Sequence
  Synthetic
gacatattggcugggtcccuac

SEQ ID NO: 83500 - DNA, 21 bp, Artificial Sequence
  Synthetic
gatcagcaggugggatuccaa

SEQ ID NO: 83501 - DNA, 18 bp, Artificial Sequence
  Synthetic
gcagcgcaaucgagtgug

SEQ ID NO: 83502 - DNA, 27 bp, Artificial Sequence
  Synthetic
caaagucattggtcaucaggaaaaagt

SEQ ID NO: 83503 - DNA, 23 bp, Artificial Sequence
  Synthetic
cattgaccttugtgtctgctcug

SEQ ID NO: 83504 - DNA, 22 bp, Artificial Sequence
  Synthetic
gggatagcaggucttcagaugt

SEQ ID NO: 83505 - DNA, 22 bp, Artificial Sequence
  Synthetic
cgactccaggcucatttgtucc

SEQ ID NO: 83506 - DNA, 25 bp, Artificial Sequence
  Synthetic
ccttctcaucctccaagacauagga

SEQ ID NO: 83507 - DNA, 22 bp, Artificial Sequence
  Synthetic
ccctttucagtccagaugacct

SEQ ID NO: 83508 - DNA, 24 bp, Artificial Sequence
  Synthetic
gaagcuguaaggagaaacgggaat

SEQ ID NO: 83509 - DNA, 27 bp, Artificial Sequence
  Synthetic
caataatguggaggcaactcttttgut

SEQ ID NO: 83510 - DNA, 26 bp, Artificial Sequence
  Synthetic
tcttctgcaaugtttctgaaggauga

SEQ ID NO: 83511 - DNA, 22 bp, Artificial Sequence
  Synthetic
ttggtagcagugacagctgtut

SEQ ID NO: 83512 - DNA, 20 bp, Artificial Sequence
  Synthetic
caggcugaccagaagagucc

SEQ ID NO: 83513 - DNA, 21 bp, Artificial Sequence
  Synthetic
tcggagguggatgaucaccat

SEQ ID NO: 83514 - DNA, 28 bp, Artificial Sequence
  Synthetic
acatctucccccaaactaucagaaaaac

SEQ ID NO: 83515 - DNA, 24 bp, Artificial Sequence
  Synthetic
tcttttgtuccagatgctgauccc

SEQ ID NO: 83516 - DNA, 24 bp, Artificial Sequence
  Synthetic
aggaagccaauatttatgcugcca

SEQ ID NO: 83517 - DNA, 27 bp, Artificial Sequence
  Synthetic
cccaatguaggaacagccagtauaaaa

SEQ ID NO: 83518 - DNA, 28 bp, Artificial Sequence
  Synthetic
gaagacttctcaaautgttgccattuca

SEQ ID NO: 83519 - DNA, 25 bp, Artificial Sequence
  Synthetic
acggacatgaguttgttttcctuct

SEQ ID NO: 83520 - DNA, 21 bp, Artificial Sequence
  Synthetic
cggtuggccccattttucaac

SEQ ID NO: 83521 - DNA, 28 bp, Artificial Sequence
  Synthetic
agatttcattgugcaagtcatagtguct

SEQ ID NO: 83522 - DNA, 21 bp, Artificial Sequence
  Synthetic
cccatcuaacccatgctucct

SEQ ID NO: 83523 - DNA, 22 bp, Artificial Sequence
  Synthetic
cugactuccaagaccaccacaa

SEQ ID NO: 83524 - DNA, 19 bp, Artificial Sequence
  Synthetic
tcatuccgccgctctaugg

SEQ ID NO: 83525 - DNA, 28 bp, Artificial Sequence
  Synthetic
tgcttagaaacaguttcccattaacuca

SEQ ID NO: 83526 - DNA, 20 bp, Artificial Sequence
  Synthetic
ccacgcccaguatccaggua

SEQ ID NO: 83527 - DNA, 20 bp, Artificial Sequence
  Synthetic
ccctgggaguggtcaactuc

SEQ ID NO: 83528 - DNA, 22 bp, Artificial Sequence
  Synthetic
accgutcctgatguacccagat

SEQ ID NO: 83529 - DNA, 22 bp, Artificial Sequence
  Synthetic
gatactcagcugcctgcttcut

SEQ ID NO: 83530 - DNA, 28 bp, Artificial Sequence
  Synthetic
tgtgtgtgauagatcttattggttugct

SEQ ID NO: 83531 - DNA, 26 bp, Artificial Sequence
  Synthetic
gaactuacaggaagatacuggaccac

SEQ ID NO: 83532 - DNA, 17 bp, Artificial Sequence
  Synthetic
cttgcggcuggccttuc

SEQ ID NO: 83533 - DNA, 18 bp, Artificial Sequence
  Synthetic
ggccaaagcccacucuct

SEQ ID NO: 83534 - DNA, 29 bp, Artificial Sequence
  Synthetic
gacagtagaagaagautggaagaagacut

SEQ ID NO: 83535 - DNA, 26 bp, Artificial Sequence
  Synthetic
caagtattggtcuctcgtctttcuca

SEQ ID NO: 83536 - DNA, 22 bp, Artificial Sequence
  Synthetic
cttctccaggcuaagacaugct

SEQ ID NO: 83537 - DNA, 26 bp, Artificial Sequence
  Synthetic
gcaagatgguacaattcagaaccuca

SEQ ID NO: 83538 - DNA, 19 bp, Artificial Sequence
  Synthetic
ggcugcaggccaactacuc

SEQ ID NO: 83539 - DNA, 26 bp, Artificial Sequence
  Synthetic
ccagcttgtgutgctccttaatatut

SEQ ID NO: 83540 - DNA, 23 bp, Artificial Sequence
  Synthetic
gggcaagguaatguagacagagg

SEQ ID NO: 83541 - DNA, 25 bp, Artificial Sequence
  Synthetic
aagcaatuagagcctttaggtuggt

SEQ ID NO: 83542 - DNA, 25 bp, Artificial Sequence
  Synthetic
ttcagatgagucccttaaacccuct

SEQ ID NO: 83543 - DNA, 23 bp, Artificial Sequence
  Synthetic
gacaaagcacaccauctgtugaa

SEQ ID NO: 83544 - DNA, 26 bp, Artificial Sequence
  Synthetic
acagcatuaaaccagaccttauccag

SEQ ID NO: 83545 - DNA, 23 bp, Artificial Sequence
  Synthetic
cgaacaccuttttgagucaacca

SEQ ID NO: 83546 - DNA, 21 bp, Artificial Sequence
  Synthetic
cgcagatctucatggccttut

SEQ ID NO: 83547 - DNA, 23 bp, Artificial Sequence
  Synthetic
gggatctctugaatgcagtggug

SEQ ID NO: 83548 - DNA, 23 bp, Artificial Sequence
  Synthetic
ttccctgcutttcagagttucct

SEQ ID NO: 83549 - DNA, 29 bp, Artificial Sequence
  Synthetic
atttgaggcuaaaagacatcattgaccua

SEQ ID NO: 83550 - DNA, 25 bp, Artificial Sequence
  Synthetic
aagaagtaatgcugatccaggctut

SEQ ID NO: 83551 - DNA, 25 bp, Artificial Sequence
  Synthetic
ctcttttcggcugtagagaagttug

SEQ ID NO: 83552 - DNA, 22 bp, Artificial Sequence
  Synthetic
tctccttucccagtcaccugaa

SEQ ID NO: 83553 - DNA, 26 bp, Artificial Sequence
  Synthetic
ggaggatccttugatttaccagcauc

SEQ ID NO: 83554 - DNA, 24 bp, Artificial Sequence
  Synthetic
ccagacacuacaacaacaggagug

SEQ ID NO: 83555 - DNA, 25 bp, Artificial Sequence
  Synthetic
aggtacagaggugctaggaaucaaa

SEQ ID NO: 83556 - DNA, 22 bp, Artificial Sequence
  Synthetic
gcccagagcuctttgtttgaut

SEQ ID NO: 83557 - DNA, 20 bp, Artificial Sequence
  Synthetic
cacgttggguagaggtccug

SEQ ID NO: 83558 - DNA, 26 bp, Artificial Sequence
  Synthetic
caggcucagccacaacaaaauaaaat

SEQ ID NO: 83559 - DNA, 28 bp, Artificial Sequence
  Synthetic
aaccttttuaccatttgcctucaaagaa

SEQ ID NO: 83560 - DNA, 22 bp, Artificial Sequence
  Synthetic
acacgagcaugtgtgtgtaucc

SEQ ID NO: 83561 - DNA, 25 bp, Artificial Sequence
  Synthetic
tcatggcctutcttctcttcaucac

SEQ ID NO: 83562 - DNA, 18 bp, Artificial Sequence
  Synthetic
gccttcuggacggctcuc

SEQ ID NO: 83563 - DNA, 21 bp, Artificial Sequence
  Synthetic
guaccaggacaccaugaggaa

SEQ ID NO: 83564 - DNA, 17 bp, Artificial Sequence
  Synthetic
ggtuggcgccguaccat

SEQ ID NO: 83565 - DNA, 17 bp, Artificial Sequence
  Synthetic
cgccgccuaccacauga

SEQ ID NO: 83566 - DNA, 20 bp, Artificial Sequence
  Synthetic
ttggccacucctaagcaucc

SEQ ID NO: 83567 - DNA, 27 bp, Artificial Sequence
  Synthetic
tctgcaccucccaaaatttaaggauat

SEQ ID NO: 83568 - DNA, 17 bp, Artificial Sequence
  Synthetic
gccgccgucatgtggua

SEQ ID NO: 83569 - DNA, 21 bp, Artificial Sequence
  Synthetic
ctugagtccccuggaggaaag

SEQ ID NO: 83570 - DNA, 29 bp, Artificial Sequence
  Synthetic
gtgatatgggcautttaatttgctgguaa

SEQ ID NO: 83571 - DNA, 27 bp, Artificial Sequence
  Synthetic
tcagctttaugacacagttaggagtug

SEQ ID NO: 83572 - DNA, 20 bp, Artificial Sequence
  Synthetic
gctgcccutggttatuccga

SEQ ID NO: 83573 - DNA, 27 bp, Artificial Sequence
  Synthetic
ttctttcttcatcucattcgtccctut

SEQ ID NO: 83574 - DNA, 22 bp, Artificial Sequence
  Synthetic
cttccugctggacucagagaac

SEQ ID NO: 83575 - DNA, 24 bp, Artificial Sequence
  Synthetic
aaaactatactucccgaggcaucc

SEQ ID NO: 83576 - DNA, 23 bp, Artificial Sequence
  Synthetic
cctccaugcccactttcttguag

SEQ ID NO: 83577 - DNA, 21 bp, Artificial Sequence
  Synthetic
tcctcttccutcctccuccag

SEQ ID NO: 83578 - DNA, 23 bp, Artificial Sequence
  Synthetic
cctgctccagutctcatgtuact

SEQ ID NO: 83579 - DNA, 23 bp, Artificial Sequence
  Synthetic
cccutactgauaaagcaggcaga

SEQ ID NO: 83580 - DNA, 20 bp, Artificial Sequence
  Synthetic
ctctttgcagugctccccut

SEQ ID NO: 83581 - DNA, 26 bp, Artificial Sequence
  Synthetic
tgacgactcuttgctgtattttucca

SEQ ID NO: 83582 - DNA, 21 bp, Artificial Sequence
  Synthetic
ccccaagcaaguaggcctuaa

SEQ ID NO: 83583 - DNA, 20 bp, Artificial Sequence
  Synthetic
tctgtcggugctgttgacug

SEQ ID NO: 83584 - DNA, 25 bp, Artificial Sequence
  Synthetic
cgaggaagaaaaacaaucccactug

SEQ ID NO: 83585 - DNA, 24 bp, Artificial Sequence
  Synthetic
aatgcagccaacaagautcugaag

SEQ ID NO: 83586 - DNA, 20 bp, Artificial Sequence
  Synthetic
caacgucagcgggaactgua

SEQ ID NO: 83587 - DNA, 22 bp, Artificial Sequence
  Synthetic
ccccattugaactggtagucca

SEQ ID NO: 83588 - DNA, 18 bp, Artificial Sequence
  Synthetic
cctgcucctctccugggt

SEQ ID NO: 83589 - DNA, 21 bp, Artificial Sequence
  Synthetic
cgugaagcuggagaaggagaa

SEQ ID NO: 83590 - DNA, 18 bp, Artificial Sequence
  Synthetic
cttgcctccuccgggtut

SEQ ID NO: 83591 - DNA, 17 bp, Artificial Sequence
  Synthetic
gggcuagugccccaagg

SEQ ID NO: 83592 - DNA, 21 bp, Artificial Sequence
  Synthetic
gttgctgtgcucacacatgut

SEQ ID NO: 83593 - DNA, 27 bp, Artificial Sequence
  Synthetic
tccttaaaattcauaccagctctuccc

SEQ ID NO: 83594 - DNA, 20 bp, Artificial Sequence
  Synthetic
aggagggccutggaagctua

SEQ ID NO: 83595 - DNA, 20 bp, Artificial Sequence
  Synthetic
gcaagcccucattucaccag

SEQ ID NO: 83596 - DNA, 26 bp, Artificial Sequence
  Synthetic
ttggcatcataaugtgttttggctut

SEQ ID NO: 83597 - DNA, 22 bp, Artificial Sequence
  Synthetic
gaatgaacugcaagcccagtug

SEQ ID NO: 83598 - DNA, 22 bp, Artificial Sequence
  Synthetic
tggagcagaaacaccuccctua

SEQ ID NO: 83599 - DNA, 18 bp, Artificial Sequence
  Synthetic
gctgcguggacucgacag

SEQ ID NO: 83600 - DNA, 21 bp, Artificial Sequence
  Synthetic
gaacaaccuccctccctcauc

SEQ ID NO: 83601 - DNA, 23 bp, Artificial Sequence
  Synthetic
atgcttcaggauttgctgcuagt

SEQ ID NO: 83602 - DNA, 20 bp, Artificial Sequence
  Synthetic
cugagggagctguggaagag

SEQ ID NO: 83603 - DNA, 17 bp, Artificial Sequence
  Synthetic
cagacgccuaccgucca

SEQ ID NO: 83604 - DNA, 21 bp, Artificial Sequence
  Synthetic
cgtctggaguttttgggtgut

SEQ ID NO: 83605 - DNA, 21 bp, Artificial Sequence
  Synthetic
ccaggaaggagcacutacgut

SEQ ID NO: 83606 - DNA, 21 bp, Artificial Sequence
  Synthetic
gcttatagugctcagcugcct

SEQ ID NO: 83607 - DNA, 23 bp, Artificial Sequence
  Synthetic
tttcctgaguggcctttcttcuc

SEQ ID NO: 83608 - DNA, 28 bp, Artificial Sequence
  Synthetic
aacttcaaacaaaucaaaccagucaaca

SEQ ID NO: 83609 - DNA, 26 bp, Artificial Sequence
  Synthetic
agttgaagtagcutttatgcccucag

SEQ ID NO: 83610 - DNA, 17 bp, Artificial Sequence
  Synthetic
cctgccgcutccaucca

SEQ ID NO: 83611 - DNA, 17 bp, Artificial Sequence
  Synthetic
gtccccgugccgcauat

SEQ ID NO: 83612 - DNA, 17 bp, Artificial Sequence
  Synthetic
agcacggccutggucag

SEQ ID NO: 83613 - DNA, 23 bp, Artificial Sequence
  Synthetic
cctgaagtggutctgatgaccut

SEQ ID NO: 83614 - DNA, 24 bp, Artificial Sequence
  Synthetic
tcttcctgttuggctaaggtttug

SEQ ID NO: 83615 - DNA, 28 bp, Artificial Sequence
  Synthetic
cgagcugaagacaattttaactuggaaa

SEQ ID NO: 83616 - DNA, 21 bp, Artificial Sequence
  Synthetic
gaactaggcuccagggttgut

SEQ ID NO: 83617 - DNA, 22 bp, Artificial Sequence
  Synthetic
caaggaacucagagaggacugg

SEQ ID NO: 83618 - DNA, 21 bp, Artificial Sequence
  Synthetic
ccctgcucatggtcttugagt

SEQ ID NO: 83619 - DNA, 24 bp, Artificial Sequence
  Synthetic
gggaugtctauagggaagggaaga

SEQ ID NO: 83620 - DNA, 22 bp, Artificial Sequence
  Synthetic
gtgttttgcuctccaccctuct

SEQ ID NO: 83621 - DNA, 25 bp, Artificial Sequence
  Synthetic
gaaatgctgaauaaggctgaggtug

SEQ ID NO: 83622 - DNA, 23 bp, Artificial Sequence
  Synthetic
caagaccgcaaautttccctcut

SEQ ID NO: 83623 - DNA, 21 bp, Artificial Sequence
  Synthetic
ctggatcaccccutcctgaug

SEQ ID NO: 83624 - DNA, 25 bp, Artificial Sequence
  Synthetic
ctgtgtggcuattatctgcauacct

SEQ ID NO: 83625 - DNA, 19 bp, Artificial Sequence
  Synthetic
gttcgcguggcctctguat

SEQ ID NO: 83626 - DNA, 21 bp, Artificial Sequence
  Synthetic
cagtgtctgcuctccatccuc

SEQ ID NO: 83627 - DNA, 20 bp, Artificial Sequence
  Synthetic
ggtgggccauctccactauc

SEQ ID NO: 83628 - DNA, 20 bp, Artificial Sequence
  Synthetic
ccuaaccacauccgccacaa

SEQ ID NO: 83629 - DNA, 19 bp, Artificial Sequence
  Synthetic
ggacccgguctcctgguag

SEQ ID NO: 83630 - DNA, 27 bp, Artificial Sequence
  Synthetic
atgatttgtuggcagaatttgtctugt

SEQ ID NO: 83631 - DNA, 28 bp, Artificial Sequence
  Synthetic
gacaactgctcutcctttctttttagut

SEQ ID NO: 83632 - DNA, 20 bp, Artificial Sequence
  Synthetic
gcggtccaugtaaccaugac

SEQ ID NO: 83633 - DNA, 28 bp, Artificial Sequence
  Synthetic
tcttttcatggtcucgtctcctaattuc

SEQ ID NO: 83634 - DNA, 28 bp, Artificial Sequence
  Synthetic
ctctgagttgtcugtattcttctcauca

SEQ ID NO: 83635 - DNA, 23 bp, Artificial Sequence
  Synthetic
attaaactguggaccaugcccat

SEQ ID NO: 83636 - DNA, 28 bp, Artificial Sequence
  Synthetic
ggaactagctucatctgagcagaauaaa

SEQ ID NO: 83637 - DNA, 28 bp, Artificial Sequence
  Synthetic
gcctgtctaaaucactttcaaaatccug

SEQ ID NO: 83638 - DNA, 21 bp, Artificial Sequence
  Synthetic
ttcuaccagcccgtttucaca

SEQ ID NO: 83639 - DNA, 24 bp, Artificial Sequence
  Synthetic
gctgcatcugaggattgatuccag

SEQ ID NO: 83640 - DNA, 21 bp, Artificial Sequence
  Synthetic
cgagggacaaaccugacugag

SEQ ID NO: 83641 - DNA, 28 bp, Artificial Sequence
  Synthetic
ccaggaauactttaagttaugcccagaa

SEQ ID NO: 83642 - DNA, 21 bp, Artificial Sequence
  Synthetic
gcgtcuccaagattcttugcc

SEQ ID NO: 83643 - DNA, 20 bp, Artificial Sequence
  Synthetic
ggagcccccgacuauaggaa

SEQ ID NO: 83644 - DNA, 21 bp, Artificial Sequence
  Synthetic
gcccagugactatccagucca

SEQ ID NO: 83645 - DNA, 22 bp, Artificial Sequence
  Synthetic
tgcctgtctuttcacccactut

SEQ ID NO: 83646 - DNA, 25 bp, Artificial Sequence
  Synthetic
gcaggcauaagtgaatggtcuagat

SEQ ID NO: 83647 - DNA, 23 bp, Artificial Sequence
  Synthetic
gctgttttugtctcctcuagcgt

SEQ ID NO: 83648 - DNA, 25 bp, Artificial Sequence
  Synthetic
gacaagctgttugatgtttgtggua

SEQ ID NO: 83649 - DNA, 24 bp, Artificial Sequence
  Synthetic
cccatcctuaacagttacctguga

SEQ ID NO: 83650 - DNA, 26 bp, Artificial Sequence
  Synthetic
acaaaaacatccucatctcggaagut

SEQ ID NO: 83651 - DNA, 25 bp, Artificial Sequence
  Synthetic
cagttcagcttutgtttggttggut

SEQ ID NO: 83652 - DNA, 27 bp, Artificial Sequence
  Synthetic
atgggtguagatagagtgaauggaaga

SEQ ID NO: 83653 - DNA, 17 bp, Artificial Sequence
  Synthetic
ttcaugcgacgcugggt

SEQ ID NO: 83654 - DNA, 24 bp, Artificial Sequence
  Synthetic
gaaacauaggaggacagttuggca

SEQ ID NO: 83655 - DNA, 27 bp, Artificial Sequence
  Synthetic
agagagaccuaagcctgtatggatuac

SEQ ID NO: 83656 - DNA, 27 bp, Artificial Sequence
  Synthetic
ctgttgattatcuggccaaaaatguga

SEQ ID NO: 83657 - DNA, 21 bp, Artificial Sequence
  Synthetic
gttagggtugggctgggaaut

SEQ ID NO: 83658 - DNA, 23 bp, Artificial Sequence
  Synthetic
ctggtcttucagttccatgucgt

SEQ ID NO: 83659 - DNA, 19 bp, Artificial Sequence
  Synthetic
tccugagcgagcgagguaa

SEQ ID NO: 83660 - DNA, 21 bp, Artificial Sequence
  Synthetic
gccacagcauacatcctgucc

SEQ ID NO: 83661 - DNA, 26 bp, Artificial Sequence
  Synthetic
ttccutacttttcctuacgcacaaga

SEQ ID NO: 83662 - DNA, 20 bp, Artificial Sequence
  Synthetic
gctagtcacuggtgcggtuc

SEQ ID NO: 83663 - DNA, 28 bp, Artificial Sequence
  Synthetic
tggctttttggugtttgaattttctgut

SEQ ID NO: 83664 - DNA, 28 bp, Artificial Sequence
  Synthetic
cttgttttauaagttccgtuaagcacac

SEQ ID NO: 83665 - DNA, 25 bp, Artificial Sequence
  Synthetic
gtatatttccccugctccactcauc

SEQ ID NO: 83666 - DNA, 24 bp, Artificial Sequence
  Synthetic
ccaactgaaguctctcctgtccua

SEQ ID NO: 83667 - DNA, 24 bp, Artificial Sequence
  Synthetic
ccctctcucattttcagacugagg

SEQ ID NO: 83668 - DNA, 26 bp, Artificial Sequence
  Synthetic
caggtcttgaaaacucttcggaaaut

SEQ ID NO: 83669 - DNA, 30 bp, Artificial Sequence
  Synthetic
tcattaagattcauttgttcagggatugga

SEQ ID NO: 83670 - DNA, 28 bp, Artificial Sequence
  Synthetic
acttagcaaucgagtaaucaagaaaccc

SEQ ID NO: 83671 - DNA, 26 bp, Artificial Sequence
  Synthetic
actcaatgtctuccacagttctucaa

SEQ ID NO: 83672 - DNA, 23 bp, Artificial Sequence
  Synthetic
ggaacatgagagugccagcttua

SEQ ID NO: 83673 - DNA, 21 bp, Artificial Sequence
  Synthetic
cctttaaccacugggtugggt

SEQ ID NO: 83674 - DNA, 24 bp, Artificial Sequence
  Synthetic
cacaaactugaacagcuacggaac

SEQ ID NO: 83675 - DNA, 24 bp, Artificial Sequence
  Synthetic
ggttgtgaggutgcatttgaucat

SEQ ID NO: 83676 - DNA, 28 bp, Artificial Sequence
  Synthetic
cactgcaaagaaagaauttgagactuca

SEQ ID NO: 83677 - DNA, 25 bp, Artificial Sequence
  Synthetic
cttttcctcaucacctgctccaaua

SEQ ID NO: 83678 - DNA, 23 bp, Artificial Sequence
  Synthetic
tgccaacaguctgaaacatcugt

SEQ ID NO: 83679 - DNA, 23 bp, Artificial Sequence
  Synthetic
gatgaatgtuacagcagccctug

SEQ ID NO: 83680 - DNA, 18 bp, Artificial Sequence
  Synthetic
catggguggguggacagt

SEQ ID NO: 83681 - DNA, 22 bp, Artificial Sequence
  Synthetic
cttccatgaggaugctgagguc

SEQ ID NO: 83682 - DNA, 24 bp, Artificial Sequence
  Synthetic
cattgauctgtagcuggaaggaga

SEQ ID NO: 83683 - DNA, 20 bp, Artificial Sequence
  Synthetic
cctttcctgcuccccaggua

SEQ ID NO: 83684 - DNA, 28 bp, Artificial Sequence
  Synthetic
tcctaagacuagtttagaggaugcaaca

SEQ ID NO: 83685 - DNA, 27 bp, Artificial Sequence
  Synthetic
tggaaatagcugaacattcaagucaca

SEQ ID NO: 83686 - DNA, 21 bp, Artificial Sequence
  Synthetic
gcagaccguggagtacctgua

SEQ ID NO: 83687 - DNA, 23 bp, Artificial Sequence
  Synthetic
gtatctggccutgcggaatttug

SEQ ID NO: 83688 - DNA, 25 bp, Artificial Sequence
  Synthetic
agactcaagggaggaugagattuct

SEQ ID NO: 83689 - DNA, 21 bp, Artificial Sequence
  Synthetic
ccaagugggucccaaaagcat

SEQ ID NO: 83690 - DNA, 24 bp, Artificial Sequence
  Synthetic
tggttcaaaagugaagctctgcua

SEQ ID NO: 83691 - DNA, 23 bp, Artificial Sequence
  Synthetic
gactctgagcugtgttctauggg

SEQ ID NO: 83692 - DNA, 19 bp, Artificial Sequence
  Synthetic
caaugcagcgaccatcgut

SEQ ID NO: 83693 - DNA, 22 bp, Artificial Sequence
  Synthetic
catggtcagugtcaggatggua

SEQ ID NO: 83694 - DNA, 21 bp, Artificial Sequence
  Synthetic
gggtctgucttgctcaaucag

SEQ ID NO: 83695 - DNA, 24 bp, Artificial Sequence
  Synthetic
ctttctgccacccuctttttcaut

SEQ ID NO: 83696 - DNA, 26 bp, Artificial Sequence
  Synthetic
cataactctguatttctccagcucgt

SEQ ID NO: 83697 - DNA, 17 bp, Artificial Sequence
  Synthetic
acccugggcctcaguca

SEQ ID NO: 83698 - DNA, 21 bp, Artificial Sequence
  Synthetic
gatggaagcagugaccuggat

SEQ ID NO: 83699 - DNA, 27 bp, Artificial Sequence
  Synthetic
cttctgttttgcutttaccctagtgut

SEQ ID NO: 83700 - DNA, 23 bp, Artificial Sequence
  Synthetic
tcuatcaatctccuccaggccat

SEQ ID NO: 83701 - DNA, 25 bp, Artificial Sequence
  Synthetic
gcccaaggugacatttctgtcttua

SEQ ID NO: 83702 - DNA, 23 bp, Artificial Sequence
  Synthetic
ctagatccguccttctgcuacct

SEQ ID NO: 83703 - DNA, 22 bp, Artificial Sequence
  Synthetic
aggctatggcugtgtatgtguc

SEQ ID NO: 83704 - DNA, 21 bp, Artificial Sequence
  Synthetic
acaccaagaagccacuctucc

SEQ ID NO: 83705 - DNA, 21 bp, Artificial Sequence
  Synthetic
ggacgacaugaaggccaauct

SEQ ID NO: 83706 - DNA, 21 bp, Artificial Sequence
  Synthetic
ggtggacccuggtaggcuaaa

SEQ ID NO: 83707 - DNA, 25 bp, Artificial Sequence
  Synthetic
gagtaaaguccacagggtucagaag

SEQ ID NO: 83708 - DNA, 17 bp, Artificial Sequence
  Synthetic
actctccugccgaugcc

SEQ ID NO: 83709 - DNA, 26 bp, Artificial Sequence
  Synthetic
gctgacgagguctttctttttctugt

SEQ ID NO: 83710 - DNA, 23 bp, Artificial Sequence
  Synthetic
gcagatgcaggugtaggaaucaa

SEQ ID NO: 83711 - DNA, 23 bp, Artificial Sequence
  Synthetic
ctgccttgguctttgagaaucct

SEQ ID NO: 83712 - DNA, 24 bp, Artificial Sequence
  Synthetic
ctacaagatcugctaacggauggt

SEQ ID NO: 83713 - DNA, 22 bp, Artificial Sequence
  Synthetic
gctggtgguttctactctgugg

SEQ ID NO: 83714 - DNA, 19 bp, Artificial Sequence
  Synthetic
cacactgcucccgatguca

SEQ ID NO: 83715 - DNA, 21 bp, Artificial Sequence
  Synthetic
acgtggagutggcattugact

SEQ ID NO: 83716 - DNA, 27 bp, Artificial Sequence
  Synthetic
agggaaagaagagagaauaggagucaa

SEQ ID NO: 83717 - DNA, 22 bp, Artificial Sequence
  Synthetic
gtccaagguaaagcatugcagt

SEQ ID NO: 83718 - DNA, 19 bp, Artificial Sequence
  Synthetic
catctccacuccagccgut

SEQ ID NO: 83719 - DNA, 26 bp, Artificial Sequence
  Synthetic
gagacucaagagccctaaucaaaagt

SEQ ID NO: 83720 - DNA, 25 bp, Artificial Sequence
  Synthetic
aaagtattcuaggtttgcugccaca

SEQ ID NO: 83721 - DNA, 25 bp, Artificial Sequence
  Synthetic
gtgaacaagaguagatgcctucaga

SEQ ID NO: 83722 - DNA, 27 bp, Artificial Sequence
  Synthetic
gctgctttatttutaactgcagtgugt

SEQ ID NO: 83723 - DNA, 22 bp, Artificial Sequence
  Synthetic
tgcgguacctgctgaauacaag

SEQ ID NO: 83724 - DNA, 26 bp, Artificial Sequence
  Synthetic
ttuaaggagcaaagaatcugcagagt

SEQ ID NO: 83725 - DNA, 27 bp, Artificial Sequence
  Synthetic
gccaaataccaaucattctcctuggat

SEQ ID NO: 83726 - DNA, 26 bp, Artificial Sequence
  Synthetic
cggaagcaugttacttatuggcagaa

SEQ ID NO: 83727 - DNA, 21 bp, Artificial Sequence
  Synthetic
ggctgggaauaaaggtugggt

SEQ ID NO: 83728 - DNA, 25 bp, Artificial Sequence
  Synthetic
cttctttgactutagtggcactugg

SEQ ID NO: 83729 - DNA, 23 bp, Artificial Sequence
  Synthetic
ctcaatcagcagutcagctcuca

SEQ ID NO: 83730 - DNA, 21 bp, Artificial Sequence
  Synthetic
gctgcagcutgatgaggucaa

SEQ ID NO: 83731 - DNA, 26 bp, Artificial Sequence
  Synthetic
gtaauctaggaaccucaaggcaaagt

SEQ ID NO: 83732 - DNA, 25 bp, Artificial Sequence
  Synthetic
agacctgaucctatgcaauggagat

SEQ ID NO: 83733 - DNA, 23 bp, Artificial Sequence
  Synthetic
ccatgtuagaagagagcaugcct

SEQ ID NO: 83734 - DNA, 23 bp, Artificial Sequence
  Synthetic
gccaccuttgatcauggaagaaa

SEQ ID NO: 83735 - DNA, 21 bp, Artificial Sequence
  Synthetic
ccaugccaggugaaaaagcac

SEQ ID NO: 83736 - DNA, 18 bp, Artificial Sequence
  Synthetic
cctggaucccgccaagua

SEQ ID NO: 83737 - DNA, 18 bp, Artificial Sequence
  Synthetic
cgaccugctcacgcugac

SEQ ID NO: 83738 - DNA, 22 bp, Artificial Sequence
  Synthetic
cugaagtgcctuagcagagacc

SEQ ID NO: 83739 - DNA, 22 bp, Artificial Sequence
  Synthetic
atcagcaatgucacagcctuct

SEQ ID NO: 83740 - DNA, 18 bp, Artificial Sequence
  Synthetic
ggcagcggcacutguact

SEQ ID NO: 83741 - DNA, 18 bp, Artificial Sequence
  Synthetic
acaugccacgtgguggac

SEQ ID NO: 83742 - DNA, 20 bp, Artificial Sequence
  Synthetic
catagtcugccacgcctcug

SEQ ID NO: 83743 - DNA, 20 bp, Artificial Sequence
  Synthetic
aactaacugcccuggcacat

SEQ ID NO: 83744 - DNA, 25 bp, Artificial Sequence
  Synthetic
agacgtctcaggutaatctctcuga

SEQ ID NO: 83745 - DNA, 26 bp, Artificial Sequence
  Synthetic
gttctcacuggatatgcttgaugaca

SEQ ID NO: 83746 - DNA, 26 bp, Artificial Sequence
  Synthetic
gtacagaaacgcuttaagttugcaca

SEQ ID NO: 83747 - DNA, 22 bp, Artificial Sequence
  Synthetic
gagtggttcucagcaggtugaa

SEQ ID NO: 83748 - DNA, 19 bp, Artificial Sequence
  Synthetic
gggatuaacgcggccauga

SEQ ID NO: 83749 - DNA, 22 bp, Artificial Sequence
  Synthetic
cacgtatcugctcacacaguct

SEQ ID NO: 83750 - DNA, 27 bp, Artificial Sequence
  Synthetic
gagtgaatctcucacgtatttggauct

SEQ ID NO: 83751 - DNA, 22 bp, Artificial Sequence
  Synthetic
tggtggcagaacugatcaacug

SEQ ID NO: 83752 - DNA, 22 bp, Artificial Sequence
  Synthetic
cagacacaggutcctgatccuc

SEQ ID NO: 83753 - DNA, 25 bp, Artificial Sequence
  Synthetic
gctttcctgauctttctgctgtcua

SEQ ID NO: 83754 - DNA, 20 bp, Artificial Sequence
  Synthetic
caucaucccaccaaggccaa

SEQ ID NO: 83755 - DNA, 22 bp, Artificial Sequence
  Synthetic
gacttcctugcctctcttggua

SEQ ID NO: 83756 - DNA, 23 bp, Artificial Sequence
  Synthetic
gacgatgccugttcaaguaacac

SEQ ID NO: 83757 - DNA, 27 bp, Artificial Sequence
  Synthetic
agtatcaactgcuaaacaagagcacut

SEQ ID NO: 83758 - DNA, 21 bp, Artificial Sequence
  Synthetic
gaggacagagccaguaggtug

SEQ ID NO: 83759 - DNA, 25 bp, Artificial Sequence
  Synthetic
accagagtccutaacaagcatugag

SEQ ID NO: 83760 - DNA, 21 bp, Artificial Sequence
  Synthetic
gcctguccaggtccatcucat

SEQ ID NO: 83761 - DNA, 21 bp, Artificial Sequence
  Synthetic
tgcuaagctgguacgaccaag

SEQ ID NO: 83762 - DNA, 22 bp, Artificial Sequence
  Synthetic
ctccacataaucaggccagcut

SEQ ID NO: 83763 - DNA, 20 bp, Artificial Sequence
  Synthetic
ccatgggagccutctgugag

SEQ ID NO: 83764 - DNA, 28 bp, Artificial Sequence
  Synthetic
tgttaatggtggcuttttgtttgttugt

SEQ ID NO: 83765 - DNA, 28 bp, Artificial Sequence
  Synthetic
tctacctcacuctaacaagcagauaact

SEQ ID NO: 83766 - DNA, 21 bp, Artificial Sequence
  Synthetic
catguggaacagaggctcuct

SEQ ID NO: 83767 - DNA, 26 bp, Artificial Sequence
  Synthetic
tgttccttcttuccctcccttactua

SEQ ID NO: 83768 - DNA, 21 bp, Artificial Sequence
  Synthetic
gaagcaacccacagaugtucc

SEQ ID NO: 83769 - DNA, 19 bp, Artificial Sequence
  Synthetic
tcaacgagugcgtcucgaa

SEQ ID NO: 83770 - DNA, 21 bp, Artificial Sequence
  Synthetic
tccatgguaggtcccgttuct

SEQ ID NO: 83771 - DNA, 22 bp, Artificial Sequence
  Synthetic
gggatgattgcugagtgtccug

SEQ ID NO: 83772 - DNA, 17 bp, Artificial Sequence
  Synthetic
caggtggcgucgttcug

SEQ ID NO: 83773 - DNA, 17 bp, Artificial Sequence
  Synthetic
cagcctcucacccgugt

SEQ ID NO: 83774 - DNA, 24 bp, Artificial Sequence
  Synthetic
gtgacttcagcuacgtctcugaat

SEQ ID NO: 83775 - DNA, 21 bp, Artificial Sequence
  Synthetic
ctgtgucccaagaccctgaug

SEQ ID NO: 83776 - DNA, 20 bp, Artificial Sequence
  Synthetic
ctgcatucacatccgctugg

SEQ ID NO: 83777 - DNA, 27 bp, Artificial Sequence
  Synthetic
caggtgactcucttttctgtacttuct

SEQ ID NO: 83778 - DNA, 18 bp, Artificial Sequence
  Synthetic
gguccgagccgtgaucag

SEQ ID NO: 83779 - DNA, 23 bp, Artificial Sequence
  Synthetic
tgctcttcaucctcgatggtgua

SEQ ID NO: 83780 - DNA, 29 bp, Artificial Sequence
  Synthetic
gatggaaatgaaacaauttgtcactguct

SEQ ID NO: 83781 - DNA, 23 bp, Artificial Sequence
  Synthetic
tgtttcacctuggacaggaacuc

SEQ ID NO: 83782 - DNA, 21 bp, Artificial Sequence
  Synthetic
tcaggagutcctguccaaggt

SEQ ID NO: 83783 - DNA, 28 bp, Artificial Sequence
  Synthetic
attccattacugggatttttcacguagt

SEQ ID NO: 83784 - DNA, 27 bp, Artificial Sequence
  Synthetic
atgcccttuactgaaatgucagaagaa

SEQ ID NO: 83785 - DNA, 28 bp, Artificial Sequence
  Synthetic
ccttcattccautactgggattttucac

SEQ ID NO: 83786 - DNA, 26 bp, Artificial Sequence
  Synthetic
atgacttgcagucttgtgatcugaat

SEQ ID NO: 83787 - DNA, 27 bp, Artificial Sequence
  Synthetic
tttccttcagggauatcaatgtucagg

SEQ ID NO: 83788 - DNA, 26 bp, Artificial Sequence
  Synthetic
ttttcactcaatcuaagcccacacut

SEQ ID NO: 83789 - DNA, 28 bp, Artificial Sequence
  Synthetic
tgaaagaauaaacacagaactggtuggt

SEQ ID NO: 83790 - DNA, 20 bp, Artificial Sequence
  Synthetic
caagacccaucctggcucat

SEQ ID NO: 83791 - DNA, 24 bp, Artificial Sequence
  Synthetic
gtcttcuacttcagcugcagagag

SEQ ID NO: 83792 - DNA, 22 bp, Artificial Sequence
  Synthetic
cattccccucctcttggtgtug

SEQ ID NO: 83793 - DNA, 28 bp, Artificial Sequence
  Synthetic
ccacaatatcaucaacctccucaaagaa

SEQ ID NO: 83794 - DNA, 17 bp, Artificial Sequence
  Synthetic
ccctgtgcuggcaccua

SEQ ID NO: 83795 - DNA, 21 bp, Artificial Sequence
  Synthetic
atcagcaaccccuguaacgag

SEQ ID NO: 83796 - DNA, 19 bp, Artificial Sequence
  Synthetic
ggttggugtcgcagtugga

SEQ ID NO: 83797 - DNA, 17 bp, Artificial Sequence
  Synthetic
cgtggguggtgugccat

SEQ ID NO: 83798 - DNA, 23 bp, Artificial Sequence
  Synthetic
cctgctgctuttcatcgtgaaug

SEQ ID NO: 83799 - DNA, 27 bp, Artificial Sequence
  Synthetic
agagatgagtgcuattcttcaggctua

SEQ ID NO: 83800 - DNA, 23 bp, Artificial Sequence
  Synthetic
gccacgggcutcttaaattucat

SEQ ID NO: 83801 - DNA, 23 bp, Artificial Sequence
  Synthetic
cagaugccaaugagaggaaaggt

SEQ ID NO: 83802 - DNA, 21 bp, Artificial Sequence
  Synthetic
cgagacucaccacctuggact

SEQ ID NO: 83803 - DNA, 25 bp, Artificial Sequence
  Synthetic
ccaagaaccucgcatagtcatacug

SEQ ID NO: 83804 - DNA, 23 bp, Artificial Sequence
  Synthetic
cttaggcttcucctggcaatcuc

SEQ ID NO: 83805 - DNA, 26 bp, Artificial Sequence
  Synthetic
gaattcacacagucctagtttccuct

SEQ ID NO: 83806 - DNA, 21 bp, Artificial Sequence
  Synthetic
gttttctugccgtggugcaaa

SEQ ID NO: 83807 - DNA, 28 bp, Artificial Sequence
  Synthetic
ggacgtagagtuattgaaaatgcagaug

SEQ ID NO: 83808 - DNA, 22 bp, Artificial Sequence
  Synthetic
gtgtccguttcctccucagaac

SEQ ID NO: 83809 - DNA, 27 bp, Artificial Sequence
  Synthetic
tcccaaccaugaagatttctttgcuaa

SEQ ID NO: 83810 - DNA, 23 bp, Artificial Sequence
  Synthetic
cutccttgctacucagcacaagt

SEQ ID NO: 83811 - DNA, 23 bp, Artificial Sequence
  Synthetic
ggtgatggtugagactgtgguaa

SEQ ID NO: 83812 - DNA, 19 bp, Artificial Sequence
  Synthetic
catcctgccagugcctcua

SEQ ID NO: 83813 - DNA, 21 bp, Artificial Sequence
  Synthetic
tcaaagaaggcccuguccaag

SEQ ID NO: 83814 - DNA, 22 bp, Artificial Sequence
  Synthetic
ccttacctauggccaagaugcc

SEQ ID NO: 83815 - DNA, 28 bp, Artificial Sequence
  Synthetic
tcccaccaccacagutagagaattatua

SEQ ID NO: 83816 - DNA, 25 bp, Artificial Sequence
  Synthetic
cccagccuagacattttctuaaacc

SEQ ID NO: 83817 - DNA, 29 bp, Artificial Sequence
  Synthetic
gcattaagctguccttttatctgttccut

SEQ ID NO: 83818 - DNA, 19 bp, Artificial Sequence
  Synthetic
ggttccacugcgagtgtug

SEQ ID NO: 83819 - DNA, 18 bp, Artificial Sequence
  Synthetic
cattggguctcccgguct

SEQ ID NO: 83820 - DNA, 22 bp, Artificial Sequence
  Synthetic
gttgacutcccaatuccagcag

SEQ ID NO: 83821 - DNA, 21 bp, Artificial Sequence
  Synthetic
ccaagaucccctggucaagag

SEQ ID NO: 83822 - DNA, 22 bp, Artificial Sequence
  Synthetic
catgctucaggctcaggauaca

SEQ ID NO: 83823 - DNA, 20 bp, Artificial Sequence
  Synthetic
ccagcttcgucttgctguga

SEQ ID NO: 83824 - DNA, 24 bp, Artificial Sequence
  Synthetic
ccctaattctggugccttcactut

SEQ ID NO: 83825 - DNA, 24 bp, Artificial Sequence
  Synthetic
tcacagtcttucatcaggttcugg

SEQ ID NO: 83826 - DNA, 20 bp, Artificial Sequence
  Synthetic
ggcacagggutgagtgucat

SEQ ID NO: 83827 - DNA, 20 bp, Artificial Sequence
  Synthetic
ccacagugtguaccccacag

SEQ ID NO: 83828 - DNA, 23 bp, Artificial Sequence
  Synthetic
agttguacaatctccugggaggt

SEQ ID NO: 83829 - DNA, 22 bp, Artificial Sequence
  Synthetic
ctgggctauactgggagcuact

SEQ ID NO: 83830 - DNA, 18 bp, Artificial Sequence
  Synthetic
gcacaggcucuccacagg

SEQ ID NO: 83831 - DNA, 20 bp, Artificial Sequence
  Synthetic
tgcaaaggagcuctgctuca

SEQ ID NO: 83832 - DNA, 26 bp, Artificial Sequence
  Synthetic
tttgatgtcacutgcactttagguct

SEQ ID NO: 83833 - DNA, 23 bp, Artificial Sequence
  Synthetic
cgatgccccacaauttcacatut

SEQ ID NO: 83834 - DNA, 29 bp, Artificial Sequence
  Synthetic
acacttgccuagaattttactaacuggaa

SEQ ID NO: 83835 - DNA, 27 bp, Artificial Sequence
  Synthetic
aaatggttgtauggctgttggtttuac

SEQ ID NO: 83836 - DNA, 22 bp, Artificial Sequence
  Synthetic
gggattcucaggagtgtguacc

SEQ ID NO: 83837 - DNA, 27 bp, Artificial Sequence
  Synthetic
gcctaacaccuaagtgatgctctttut

SEQ ID NO: 83838 - DNA, 22 bp, Artificial Sequence
  Synthetic
cagccacugucaaagcaaagac

SEQ ID NO: 83839 - DNA, 32 bp, Artificial Sequence
  Synthetic
gttacgtagatgagaautctaaatcacacuct

SEQ ID NO: 83840 - DNA, 25 bp, Artificial Sequence
  Synthetic
tggagttggguatgtggattccaua

SEQ ID NO: 83841 - DNA, 22 bp, Artificial Sequence
  Synthetic
tcctccggguaaaacacatucc

SEQ ID NO: 83842 - DNA, 22 bp, Artificial Sequence
  Synthetic
ggaactgagaugtccccagcua

SEQ ID NO: 83843 - DNA, 25 bp, Artificial Sequence
  Synthetic
caactcctgagauctgctctgttut

SEQ ID NO: 83844 - DNA, 20 bp, Artificial Sequence
  Synthetic
gggccugagaucaccaagac

SEQ ID NO: 83845 - DNA, 21 bp, Artificial Sequence
  Synthetic
gatgtgcuagttccaccucca

SEQ ID NO: 83846 - DNA, 22 bp, Artificial Sequence
  Synthetic
cctcacaugtgcactctuccaa

SEQ ID NO: 83847 - DNA, 27 bp, Artificial Sequence
  Synthetic
cagguaaaaagaatttcctucagcact

SEQ ID NO: 83848 - DNA, 21 bp, Artificial Sequence
  Synthetic
ctgagccuggaaaggtggtua

SEQ ID NO: 83849 - DNA, 23 bp, Artificial Sequence
  Synthetic
cctccaggugagaaagaucgaga

SEQ ID NO: 83850 - DNA, 26 bp, Artificial Sequence
  Synthetic
tctctctaagtcaugatctcgctcuc

SEQ ID NO: 83851 - DNA, 26 bp, Artificial Sequence
  Synthetic
agagctttaggagucttcctttccut

SEQ ID NO: 83852 - DNA, 28 bp, Artificial Sequence
  Synthetic
atttttcagugacagacauacagagagg

SEQ ID NO: 83853 - DNA, 21 bp, Artificial Sequence
  Synthetic
cauccgggacuacagggagaa

SEQ ID NO: 83854 - DNA, 23 bp, Artificial Sequence
  Synthetic
ctcctcauccagatuggaccaaa

SEQ ID NO: 83855 - DNA, 22 bp, Artificial Sequence
  Synthetic
cctttccuaggcctggaatcuc

SEQ ID NO: 83856 - DNA, 21 bp, Artificial Sequence
  Synthetic
actcatcgagutgctccucac

SEQ ID NO: 83857 - DNA, 28 bp, Artificial Sequence
  Synthetic
tgttcttctaugacatttctcccucact

SEQ ID NO: 83858 - DNA, 24 bp, Artificial Sequence
  Synthetic
ctactctcacucagaccctcttug

SEQ ID NO: 83859 - DNA, 21 bp, Artificial Sequence
  Synthetic
gaacaccaugctgagccttug

SEQ ID NO: 83860 - DNA, 20 bp, Artificial Sequence
  Synthetic
gtcgtttgcccuctccagut

SEQ ID NO: 83861 - DNA, 19 bp, Artificial Sequence
  Synthetic
ccgtagauggcgtgcaguc

SEQ ID NO: 83862 - DNA, 21 bp, Artificial Sequence
  Synthetic
ccgcatctcutcccgatgtut

SEQ ID NO: 83863 - DNA, 23 bp, Artificial Sequence
  Synthetic
tcgcacauttcgagaugaagagg

SEQ ID NO: 83864 - DNA, 19 bp, Artificial Sequence
  Synthetic
cugtggtgttugggaggct

SEQ ID NO: 83865 - DNA, 18 bp, Artificial Sequence
  Synthetic
gccctggcuatgcaggua

SEQ ID NO: 83866 - DNA, 21 bp, Artificial Sequence
  Synthetic
agautggcttctuccgcacaa

SEQ ID NO: 83867 - DNA, 19 bp, Artificial Sequence
  Synthetic
cuccgggcttucgaggaaa

SEQ ID NO: 83868 - DNA, 19 bp, Artificial Sequence
  Synthetic
ccttcgcutcgctcttucc

SEQ ID NO: 83869 - DNA, 20 bp, Artificial Sequence
  Synthetic
cctcggcgcuttaaccctut

SEQ ID NO: 83870 - DNA, 23 bp, Artificial Sequence
  Synthetic
gcaggtactuctgtcagctgaut

SEQ ID NO: 83871 - DNA, 18 bp, Artificial Sequence
  Synthetic
ccccuagcacgtgccuac

SEQ ID NO: 83872 - DNA, 24 bp, Artificial Sequence
  Synthetic
gtgatgaaauggccaagaatcugg

SEQ ID NO: 83873 - DNA, 28 bp, Artificial Sequence
  Synthetic
tgctggatctcugtgatgaaaaactuaa

SEQ ID NO: 83874 - DNA, 24 bp, Artificial Sequence
  Synthetic
gatctttgccagguttccgttuat

SEQ ID NO: 83875 - DNA, 23 bp, Artificial Sequence
  Synthetic
tcaggtgguggagagttgtttut

SEQ ID NO: 83876 - DNA, 26 bp, Artificial Sequence
  Synthetic
gtgaggcattutggaaagtttctugt

SEQ ID NO: 83877 - DNA, 27 bp, Artificial Sequence
  Synthetic
gcatgacattugcttctgctaauaact

SEQ ID NO: 83878 - DNA, 19 bp, Artificial Sequence
  Synthetic
cgcucttacctuccaccca

SEQ ID NO: 83879 - DNA, 27 bp, Artificial Sequence
  Synthetic
gagagcgaagtutcagagactcttaut

SEQ ID NO: 83880 - DNA, 33 bp, Artificial Sequence
  Synthetic
acagatttcatgtuagtaacttggttattttug

SEQ ID NO: 83881 - DNA, 23 bp, Artificial Sequence
  Synthetic
acctgcattugacccatttccut

SEQ ID NO: 83882 - DNA, 27 bp, Artificial Sequence
  Synthetic
atcttttcagtagugtgattaggcgut

SEQ ID NO: 83883 - DNA, 24 bp, Artificial Sequence
  Synthetic
cagaccccgcautatttcaatcuc

SEQ ID NO: 83884 - DNA, 21 bp, Artificial Sequence
  Synthetic
attcucaagtggtugcgggaa

SEQ ID NO: 83885 - DNA, 26 bp, Artificial Sequence
  Synthetic
ggaggaaggagaagcugaaauagaac

SEQ ID NO: 83886 - DNA, 21 bp, Artificial Sequence
  Synthetic
guggacagatcucacgggaat

SEQ ID NO: 83887 - DNA, 26 bp, Artificial Sequence
  Synthetic
ggtcaggatugaatgggaaaugaaga

SEQ ID NO: 83888 - DNA, 25 bp, Artificial Sequence
  Synthetic
ccacatcagutcttcaccuccaaat

SEQ ID NO: 83889 - DNA, 20 bp, Artificial Sequence
  Synthetic
gcccactccutcccaaacut

SEQ ID NO: 83890 - DNA, 28 bp, Artificial Sequence
  Synthetic
tcaaattacagucaactgcagaaaccua

SEQ ID NO: 83891 - DNA, 22 bp, Artificial Sequence
  Synthetic
cctggaggucttttugggacag

SEQ ID NO: 83892 - DNA, 21 bp, Artificial Sequence
  Synthetic
gctctguccaggtgtccttug

SEQ ID NO: 83893 - DNA, 26 bp, Artificial Sequence
  Synthetic
tgaaggagauagacatcagccaucat

SEQ ID NO: 83894 - DNA, 21 bp, Artificial Sequence
  Synthetic
tcccagtgcuggtgtttguag

SEQ ID NO: 83895 - DNA, 28 bp, Artificial Sequence
  Synthetic
tgagattcgtuacggaaactatuacagg

SEQ ID NO: 83896 - DNA, 22 bp, Artificial Sequence
  Synthetic
ccaagaactugccgcagtttut

SEQ ID NO: 83897 - DNA, 20 bp, Artificial Sequence
  Synthetic
actcctcccutctgctucgt

SEQ ID NO: 83898 - DNA, 28 bp, Artificial Sequence
  Synthetic
caggcaatattucatgtgggagatuaga

SEQ ID NO: 83899 - DNA, 29 bp, Artificial Sequence
  Synthetic
gttggaatatttcuggttgttacaauccc

SEQ ID NO: 83900 - DNA, 24 bp, Artificial Sequence
  Synthetic
cttaccaaaggucagtgggatugt

SEQ ID NO: 83901 - DNA, 23 bp, Artificial Sequence
  Synthetic
ctctgtgtgcutaggtagagcug

SEQ ID NO: 83902 - DNA, 25 bp, Artificial Sequence
  Synthetic
atctgtatgutcctggucagagact

SEQ ID NO: 83903 - DNA, 25 bp, Artificial Sequence
  Synthetic
ggcagacatugtttcctctttucac

SEQ ID NO: 83904 - DNA, 28 bp, Artificial Sequence
  Synthetic
tcagattaattgcugtgcttttggatuc

SEQ ID NO: 83905 - DNA, 25 bp, Artificial Sequence
  Synthetic
ggctcagaaaaautggatugaccat

SEQ ID NO: 83906 - DNA, 25 bp, Artificial Sequence
  Synthetic
gctcgatgtugagaaggatcttcut

SEQ ID NO: 83907 - DNA, 25 bp, Artificial Sequence
  Synthetic
tttacggtacacuaaccctgcttut

SEQ ID NO: 83908 - DNA, 23 bp, Artificial Sequence
  Synthetic
gcaaccugaagaagctaguggaa

SEQ ID NO: 83909 - DNA, 18 bp, Artificial Sequence
  Synthetic
cuagggaugggccagcag

SEQ ID NO: 83910 - DNA, 22 bp, Artificial Sequence
  Synthetic
tctccatcuttgcctgugagat

SEQ ID NO: 83911 - DNA, 27 bp, Artificial Sequence
  Synthetic
tgaaaaagtacucatttggtgcacuct

SEQ ID NO: 83912 - DNA, 25 bp, Artificial Sequence
  Synthetic
agtgggucaggaaaacattcttgut

SEQ ID NO: 83913 - DNA, 22 bp, Artificial Sequence
  Synthetic
ggguggaagtuaaagaaggcat

SEQ ID NO: 83914 - DNA, 21 bp, Artificial Sequence
  Synthetic
gagcugaggaattugcaacga

SEQ ID NO: 83915 - DNA, 22 bp, Artificial Sequence
  Synthetic
tgggaaattccuggaaccctug

SEQ ID NO: 83916 - DNA, 21 bp, Artificial Sequence
  Synthetic
aggcagaggucttctccagut

SEQ ID NO: 83917 - DNA, 23 bp, Artificial Sequence
  Synthetic
cttagtggatucttcgcagccua

SEQ ID NO: 83918 - DNA, 25 bp, Artificial Sequence
  Synthetic
tgtctcacagcgaacauactcttuc

SEQ ID NO: 83919 - DNA, 21 bp, Artificial Sequence
  Synthetic
ctacggcgaaugctactggua

SEQ ID NO: 83920 - DNA, 22 bp, Artificial Sequence
  Synthetic
ccccctcautggtcacaaatug

SEQ ID NO: 83921 - DNA, 28 bp, Artificial Sequence
  Synthetic
agtggatcagacauctgggaactataut

SEQ ID NO: 83922 - DNA, 19 bp, Artificial Sequence
  Synthetic
cagcaaccacuagccucct

SEQ ID NO: 83923 - DNA, 19 bp, Artificial Sequence
  Synthetic
gcgagucggaggacaacug

SEQ ID NO: 83924 - DNA, 18 bp, Artificial Sequence
  Synthetic
cccaggcauagcctucgg

SEQ ID NO: 83925 - DNA, 17 bp, Artificial Sequence
  Synthetic
aggugggcaagcgagut

SEQ ID NO: 83926 - DNA, 23 bp, Artificial Sequence
  Synthetic
cttggatttcuctggtggcagua

SEQ ID NO: 83927 - DNA, 22 bp, Artificial Sequence
  Synthetic
aacagagucagcaucagagcag

SEQ ID NO: 83928 - DNA, 19 bp, Artificial Sequence
  Synthetic
ggaagucccagacccugac

SEQ ID NO: 83929 - DNA, 28 bp, Artificial Sequence
  Synthetic
ggaatcacttttcutttctggacttgut

SEQ ID NO: 83930 - DNA, 23 bp, Artificial Sequence
  Synthetic
caatgaccccgcucttaaagaug

SEQ ID NO: 83931 - DNA, 27 bp, Artificial Sequence
  Synthetic
acaatacctgttcugctgcaaatacut

SEQ ID NO: 83932 - DNA, 22 bp, Artificial Sequence
  Synthetic
tgttctuccacgccatcatcuc

SEQ ID NO: 83933 - DNA, 22 bp, Artificial Sequence
  Synthetic
gattccucccaagccuacagac

SEQ ID NO: 83934 - DNA, 20 bp, Artificial Sequence
  Synthetic
tcagcuccgcattcucaagg

SEQ ID NO: 83935 - DNA, 23 bp, Artificial Sequence
  Synthetic
agttaattgcgggcugagatgut

SEQ ID NO: 83936 - DNA, 22 bp, Artificial Sequence
  Synthetic
ggcggtguaaataagagggcut

SEQ ID NO: 83937 - DNA, 26 bp, Artificial Sequence
  Synthetic
aagcatctgtttuctctccctttcut

SEQ ID NO: 83938 - DNA, 21 bp, Artificial Sequence
  Synthetic
cacctgautggagugcaagac

SEQ ID NO: 83939 - DNA, 22 bp, Artificial Sequence
  Synthetic
ttgaccuctgatccuacccaca

SEQ ID NO: 83940 - DNA, 22 bp, Artificial Sequence
  Synthetic
gcugccagcacuaaggaaagag

SEQ ID NO: 83941 - DNA, 20 bp, Artificial Sequence
  Synthetic
cggaagcagccuctcgauat

SEQ ID NO: 83942 - DNA, 18 bp, Artificial Sequence
  Synthetic
acactggucccccugaga

SEQ ID NO: 83943 - DNA, 28 bp, Artificial Sequence
  Synthetic
agctcattgtcuaatgtcattctcctut

SEQ ID NO: 83944 - DNA, 32 bp, Artificial Sequence
  Synthetic
gtatcttagaaagugaaataactaaccucgct

SEQ ID NO: 83945 - DNA, 25 bp, Artificial Sequence
  Synthetic
catagggattgugggcatttaguca

SEQ ID NO: 83946 - DNA, 23 bp, Artificial Sequence
  Synthetic
atctctcuggaggatgacguagg

SEQ ID NO: 83947 - DNA, 26 bp, Artificial Sequence
  Synthetic
tcagagcacgaucattcttctcatug

SEQ ID NO: 83948 - DNA, 27 bp, Artificial Sequence
  Synthetic
aagcgagctaauttgtcttctttcuct

SEQ ID NO: 83949 - DNA, 27 bp, Artificial Sequence
  Synthetic
catcuggagctaattgugaaaaacagt

SEQ ID NO: 83950 - DNA, 21 bp, Artificial Sequence
  Synthetic
gacgtctgagaucgtcaggut

SEQ ID NO: 83951 - DNA, 21 bp, Artificial Sequence
  Synthetic
ctgaagugcccatttcccugt

SEQ ID NO: 83952 - DNA, 21 bp, Artificial Sequence
  Synthetic
gcagaactuggtccccucaat

SEQ ID NO: 83953 - DNA, 21 bp, Artificial Sequence
  Synthetic
gctucccaaggaaaucaggct

SEQ ID NO: 83954 - DNA, 22 bp, Artificial Sequence
  Synthetic
cacacugagaaagcggaagaug

SEQ ID NO: 83955 - DNA, 27 bp, Artificial Sequence
  Synthetic
cccaagtccauccaattctaatucagg

SEQ ID NO: 83956 - DNA, 21 bp, Artificial Sequence
  Synthetic
gcaaaggtuggactgaauggg

SEQ ID NO: 83957 - DNA, 27 bp, Artificial Sequence
  Synthetic
cctttggagggaauattatccagcaut

SEQ ID NO: 83958 - DNA, 22 bp, Artificial Sequence
  Synthetic
ccttcucaaagccctcctucac

SEQ ID NO: 83959 - DNA, 20 bp, Artificial Sequence
  Synthetic
cccagcucgtggtaaacuca

SEQ ID NO: 83960 - DNA, 20 bp, Artificial Sequence
  Synthetic
gctggttguggcccagatut

SEQ ID NO: 83961 - DNA, 21 bp, Artificial Sequence
  Synthetic
aagtacaaggccuccaucacc

SEQ ID NO: 83962 - DNA, 25 bp, Artificial Sequence
  Synthetic
cgttccttctucattttccctccug

SEQ ID NO: 83963 - DNA, 26 bp, Artificial Sequence
  Synthetic
agctgacttctutcctatgctcttug

SEQ ID NO: 83964 - DNA, 21 bp, Artificial Sequence
  Synthetic
gcacgtacutggtctcgtugt

SEQ ID NO: 83965 - DNA, 24 bp, Artificial Sequence
  Synthetic
ccagaacaaggagcutaaggucaa

SEQ ID NO: 83966 - DNA, 25 bp, Artificial Sequence
  Synthetic
gtcaatgaatgutttggcccatugt

SEQ ID NO: 83967 - DNA, 21 bp, Artificial Sequence
  Synthetic
ctcggccaauggaccuacaaa

SEQ ID NO: 83968 - DNA, 22 bp, Artificial Sequence
  Synthetic
gagggaaguggctttugaggaa

SEQ ID NO: 83969 - DNA, 28 bp, Artificial Sequence
  Synthetic
tcatggcttauccagaaagtataugcac

SEQ ID NO: 83970 - DNA, 22 bp, Artificial Sequence
  Synthetic
ttcctccaggaugggtccttua

SEQ ID NO: 83971 - DNA, 26 bp, Artificial Sequence
  Synthetic
ctgtacaugctaacataguccaaggg

SEQ ID NO: 83972 - DNA, 23 bp, Artificial Sequence
  Synthetic
tgattgtttccugatgctgcuga

SEQ ID NO: 83973 - DNA, 28 bp, Artificial Sequence
  Synthetic
autgagaacatgtugcagaacaagaaaa

SEQ ID NO: 83974 - DNA, 17 bp, Artificial Sequence
  Synthetic
gccctgcugtccgtcuc

SEQ ID NO: 83975 - DNA, 18 bp, Artificial Sequence
  Synthetic
gcuccagcggcauggaaa

SEQ ID NO: 83976 - DNA, 20 bp, Artificial Sequence
  Synthetic
gacttgacagugcccuccat

SEQ ID NO: 83977 - DNA, 20 bp, Artificial Sequence
  Synthetic
aaggtcacuggcccttctuc

SEQ ID NO: 83978 - DNA, 28 bp, Artificial Sequence
  Synthetic
tccttctcaucaggaatttccaaaauga

SEQ ID NO: 83979 - DNA, 26 bp, Artificial Sequence
  Synthetic
attgacaatgaggauctggtgtaugg

SEQ ID NO: 83980 - DNA, 21 bp, Artificial Sequence
  Synthetic
ccttcaaggucagggttuggt

SEQ ID NO: 83981 - DNA, 22 bp, Artificial Sequence
  Synthetic
cctctggctucttgaggtctuc

SEQ ID NO: 83982 - DNA, 28 bp, Artificial Sequence
  Synthetic
atgaaaaccatuacaaacttctcaagug

SEQ ID NO: 83983 - DNA, 25 bp, Artificial Sequence
  Synthetic
ttgtaccttucccccttttctucag

SEQ ID NO: 83984 - DNA, 23 bp, Artificial Sequence
  Synthetic
cccaagagcuaccacaattugct

SEQ ID NO: 83985 - DNA, 23 bp, Artificial Sequence
  Synthetic
tcatcagaaagggaccugacuca

SEQ ID NO: 83986 - DNA, 22 bp, Artificial Sequence
  Synthetic
gggctgccauaattccauagca

SEQ ID NO: 83987 - DNA, 20 bp, Artificial Sequence
  Synthetic
acaggugtcaucagggagga

SEQ ID NO: 83988 - DNA, 20 bp, Artificial Sequence
  Synthetic
gggagcgutgaaggaatugg

SEQ ID NO: 83989 - DNA, 19 bp, Artificial Sequence
  Synthetic
catccccagugccgagtua

SEQ ID NO: 83990 - DNA, 23 bp, Artificial Sequence
  Synthetic
cgtggcuacagttggugaagaat

SEQ ID NO: 83991 - DNA, 21 bp, Artificial Sequence
  Synthetic
ccagaugaagcagtgggugag

SEQ ID NO: 83992 - DNA, 25 bp, Artificial Sequence
  Synthetic
catcccaaaugatattgtccuccca

SEQ ID NO: 83993 - DNA, 23 bp, Artificial Sequence
  Synthetic
tggcutacaatgtucagcaaggt

SEQ ID NO: 83994 - DNA, 20 bp, Artificial Sequence
  Synthetic
gctccucccattcacgugac

SEQ ID NO: 83995 - DNA, 24 bp, Artificial Sequence
  Synthetic
gtcagcguatctttgaccuacaga

SEQ ID NO: 83996 - DNA, 27 bp, Artificial Sequence
  Synthetic
gaaaaagucggtaagaaugaacaaggg

SEQ ID NO: 83997 - DNA, 22 bp, Artificial Sequence
  Synthetic
catccctaccutgccttcacut

SEQ ID NO: 83998 - DNA, 22 bp, Artificial Sequence
  Synthetic
ctgagacaugttctgctguggt

SEQ ID NO: 83999 - DNA, 24 bp, Artificial Sequence
  Synthetic
ggcacttgaucccaatgaugagaa

SEQ ID NO: 84000 - DNA, 25 bp, Artificial Sequence
  Synthetic
gtagaggcatutacgcacatttuca

SEQ ID NO: 84001 - DNA, 20 bp, Artificial Sequence
  Synthetic
ggtgacgcugtcatccaucc

SEQ ID NO: 84002 - DNA, 23 bp, Artificial Sequence
  Synthetic
aaaaaccaggaagcagaugucca

SEQ ID NO: 84003 - DNA, 25 bp, Artificial Sequence
  Synthetic
gttaaactugccaaaacagcugact

SEQ ID NO: 84004 - DNA, 20 bp, Artificial Sequence
  Synthetic
gtgtagguccccgagtctuc

SEQ ID NO: 84005 - DNA, 20 bp, Artificial Sequence
  Synthetic
gcttgcaggcugatttcucc

SEQ ID NO: 84006 - DNA, 21 bp, Artificial Sequence
  Synthetic
cacaatcaacucctccugcca

SEQ ID NO: 84007 - DNA, 27 bp, Artificial Sequence
  Synthetic
gtgacctgccuactaattcccataaut

SEQ ID NO: 84008 - DNA, 19 bp, Artificial Sequence
  Synthetic
ccccucgtcccaugaagga

SEQ ID NO: 84009 - DNA, 20 bp, Artificial Sequence
  Synthetic
cctccaccutgggctacuca

SEQ ID NO: 84010 - DNA, 21 bp, Artificial Sequence
  Synthetic
gccctggcaccutcatatgua

SEQ ID NO: 84011 - DNA, 20 bp, Artificial Sequence
  Synthetic
acaucgacucggccaacaag

SEQ ID NO: 84012 - DNA, 17 bp, Artificial Sequence
  Synthetic
ggutggguggcccagac

SEQ ID NO: 84013 - DNA, 27 bp, Artificial Sequence
  Synthetic
ggataaagaacagguggcatatacuca

SEQ ID NO: 84014 - DNA, 21 bp, Artificial Sequence
  Synthetic
ggtactgcuccagaagtggut

SEQ ID NO: 84015 - DNA, 28 bp, Artificial Sequence
  Synthetic
acttaggaaauagaatccugacccacat

SEQ ID NO: 84016 - DNA, 19 bp, Artificial Sequence
  Synthetic
tgaactcccugacggguct

SEQ ID NO: 84017 - DNA, 18 bp, Artificial Sequence
  Synthetic
caggaagucgcgcuccaa

SEQ ID NO: 84018 - DNA, 18 bp, Artificial Sequence
  Synthetic
gatggctucgtcccggut

SEQ ID NO: 84019 - DNA, 24 bp, Artificial Sequence
  Synthetic
cttcccaagtugttgatgttccut

SEQ ID NO: 84020 - DNA, 22 bp, Artificial Sequence
  Synthetic
catcauccagagtgggugcaaa

SEQ ID NO: 84021 - DNA, 20 bp, Artificial Sequence
  Synthetic
cacagcugcatugggaggat

SEQ ID NO: 84022 - DNA, 21 bp, Artificial Sequence
  Synthetic
ggaagcugtgatguccccaaa

SEQ ID NO: 84023 - DNA, 24 bp, Artificial Sequence
  Synthetic
caccatcctcugtttttgctguag

SEQ ID NO: 84024 - DNA, 19 bp, Artificial Sequence
  Synthetic
gccgcagucugacaggaaa

SEQ ID NO: 84025 - DNA, 18 bp, Artificial Sequence
  Synthetic
ccaagucccccguagcct

SEQ ID NO: 84026 - DNA, 27 bp, Artificial Sequence
  Synthetic
aaagggtgtgtauttggaagatctcuc

SEQ ID NO: 84027 - DNA, 26 bp, Artificial Sequence
  Synthetic
ttggaaccacugttcattgtgacuat

SEQ ID NO: 84028 - DNA, 21 bp, Artificial Sequence
  Synthetic
catgcctcugcaacctgauga

SEQ ID NO: 84029 - DNA, 27 bp, Artificial Sequence
  Synthetic
tgataggugaagctcaacaaauccaat

SEQ ID NO: 84030 - DNA, 24 bp, Artificial Sequence
  Synthetic
cctcagttgaugacagaacctugt

SEQ ID NO: 84031 - DNA, 22 bp, Artificial Sequence
  Synthetic
gaacaggcucattcuggagagg

SEQ ID NO: 84032 - DNA, 23 bp, Artificial Sequence
  Synthetic
agccatgcuggttacatttucct

SEQ ID NO: 84033 - DNA, 23 bp, Artificial Sequence
  Synthetic
cctcaatucccaggtggaccuat

SEQ ID NO: 84034 - DNA, 25 bp, Artificial Sequence
  Synthetic
tttttgcattucccaagacagtgut

SEQ ID NO: 84035 - DNA, 28 bp, Artificial Sequence
  Synthetic
aagcttaaggacuatggagtggatctua

SEQ ID NO: 84036 - DNA, 18 bp, Artificial Sequence
  Synthetic
gggucagtgcucaccagt

SEQ ID NO: 84037 - DNA, 20 bp, Artificial Sequence
  Synthetic
agctctccacuccagcucaa

SEQ ID NO: 84038 - DNA, 17 bp, Artificial Sequence
  Synthetic
ggccuccugcaacagca

SEQ ID NO: 84039 - DNA, 19 bp, Artificial Sequence
  Synthetic
tcgcacuccccttcuccat

SEQ ID NO: 84040 - DNA, 24 bp, Artificial Sequence
  Synthetic
cttgauccacgggcaaatttacuc

SEQ ID NO: 84041 - DNA, 26 bp, Artificial Sequence
  Synthetic
ggtgtgccugaggaagagatuaaaaa

SEQ ID NO: 84042 - DNA, 25 bp, Artificial Sequence
  Synthetic
cttcttcuaccccacatccattguc

SEQ ID NO: 84043 - DNA, 23 bp, Artificial Sequence
  Synthetic
aaaaactgauagcatggguccgt

SEQ ID NO: 84044 - DNA, 24 bp, Artificial Sequence
  Synthetic
gcctggctuggtattgcaaaauat

SEQ ID NO: 84045 - DNA, 21 bp, Artificial Sequence
  Synthetic
tctcttcttuggccgtggtuc

SEQ ID NO: 84046 - DNA, 22 bp, Artificial Sequence
  Synthetic
agagaacacugggagaggguag

SEQ ID NO: 84047 - DNA, 20 bp, Artificial Sequence
  Synthetic
acaccacugccgauccaaag

SEQ ID NO: 84048 - DNA, 28 bp, Artificial Sequence
  Synthetic
ggtggatggacutatgaggtatatucaa

SEQ ID NO: 84049 - DNA, 27 bp, Artificial Sequence
  Synthetic
gtctucgggaaacagctaatugagaat

SEQ ID NO: 84050 - DNA, 19 bp, Artificial Sequence
  Synthetic
gagacauagcagggcgcut

SEQ ID NO: 84051 - DNA, 20 bp, Artificial Sequence
  Synthetic
gggtacuaaccccaggtuga

SEQ ID NO: 84052 - DNA, 27 bp, Artificial Sequence
  Synthetic
ctgatcagccutaagttauaacccaaa

SEQ ID NO: 84053 - DNA, 28 bp, Artificial Sequence
  Synthetic
gctcattatgucaccattatctctucca

SEQ ID NO: 84054 - DNA, 21 bp, Artificial Sequence
  Synthetic
actcactugggcatgaaugct

SEQ ID NO: 84055 - DNA, 29 bp, Artificial Sequence
  Synthetic
agaaggctcttacuacacctactcatuat

SEQ ID NO: 84056 - DNA, 27 bp, Artificial Sequence
  Synthetic
tccagagcaacagcuttatcatgtaut

SEQ ID NO: 84057 - DNA, 29 bp, Artificial Sequence
  Synthetic
gaaactatttttgguctcaggaattucgg

SEQ ID NO: 84058 - DNA, 22 bp, Artificial Sequence
  Synthetic
gctgcauctcgagtugaacagt

SEQ ID NO: 84059 - DNA, 25 bp, Artificial Sequence
  Synthetic
ctaactatctgtucccaaccccauc

SEQ ID NO: 84060 - DNA, 28 bp, Artificial Sequence
  Synthetic
tggttttattttagugctgttccttugg

SEQ ID NO: 84061 - DNA, 24 bp, Artificial Sequence
  Synthetic
ccactaccuctagattctcuggct

SEQ ID NO: 84062 - DNA, 17 bp, Artificial Sequence
  Synthetic
tttucaggccgcccuca

SEQ ID NO: 84063 - DNA, 24 bp, Artificial Sequence
  Synthetic
atgatccaaauggctggtgagaut

SEQ ID NO: 84064 - DNA, 22 bp, Artificial Sequence
  Synthetic
tctggagugccccataaggaua

SEQ ID NO: 84065 - DNA, 21 bp, Artificial Sequence
  Synthetic
ccctacccuctcccagtgtuc

SEQ ID NO: 84066 - DNA, 28 bp, Artificial Sequence
  Synthetic
cagatgataacucagaaggccttactut

SEQ ID NO: 84067 - DNA, 25 bp, Artificial Sequence
  Synthetic
gggtctaaaaagguctgtgttccut

SEQ ID NO: 84068 - DNA, 22 bp, Artificial Sequence
  Synthetic
cctccccaucccagatgauaga

SEQ ID NO: 84069 - DNA, 25 bp, Artificial Sequence
  Synthetic
tgagaaagacacaacaugaaccugt

SEQ ID NO: 84070 - DNA, 24 bp, Artificial Sequence
  Synthetic
gaacagauagtuagggagcaccaa

SEQ ID NO: 84071 - DNA, 18 bp, Artificial Sequence
  Synthetic
ctucccagcggttgucca

SEQ ID NO: 84072 - DNA, 23 bp, Artificial Sequence
  Synthetic
ggagggaaugcgaagaaactcut

SEQ ID NO: 84073 - DNA, 20 bp, Artificial Sequence
  Synthetic
cgtcgtaugcgagagtcugt

SEQ ID NO: 84074 - DNA, 22 bp, Artificial Sequence
  Synthetic
ccctaacacaauccagguggaa

SEQ ID NO: 84075 - DNA, 20 bp, Artificial Sequence
  Synthetic
ccaugaaggcccagtucgag

SEQ ID NO: 84076 - DNA, 22 bp, Artificial Sequence
  Synthetic
ctgaccagcugcttcttctuct

SEQ ID NO: 84077 - DNA, 21 bp, Artificial Sequence
  Synthetic
gagaugaagacgcagcuggaa

SEQ ID NO: 84078 - DNA, 22 bp, Artificial Sequence
  Synthetic
ccagagcucaaggctgtcttuc

SEQ ID NO: 84079 - DNA, 22 bp, Artificial Sequence
  Synthetic
tcctcactgucatcgtcacuca

SEQ ID NO: 84080 - DNA, 20 bp, Artificial Sequence
  Synthetic
ctttggccggacuctagugg

SEQ ID NO: 84081 - DNA, 25 bp, Artificial Sequence
  Synthetic
tgtgattttuaaggccagtgcagua

SEQ ID NO: 84082 - DNA, 28 bp, Artificial Sequence
  Synthetic
ttacccacautcctttataaguccacag

SEQ ID NO: 84083 - DNA, 25 bp, Artificial Sequence
  Synthetic
tcctgcaattcucagcatggattua

SEQ ID NO: 84084 - DNA, 27 bp, Artificial Sequence
  Synthetic
tcttttctggtutttcttggctcuact

SEQ ID NO: 84085 - DNA, 18 bp, Artificial Sequence
  Synthetic
cggcccugcatccaugat

SEQ ID NO: 84086 - DNA, 19 bp, Artificial Sequence
  Synthetic
gcagctuggcatctucggt

SEQ ID NO: 84087 - DNA, 20 bp, Artificial Sequence
  Synthetic
aggtaccugccagtccctut

SEQ ID NO: 84088 - DNA, 20 bp, Artificial Sequence
  Synthetic
aagaucaagctuggccggaa

SEQ ID NO: 84089 - DNA, 18 bp, Artificial Sequence
  Synthetic
cggccucacctcctctug

SEQ ID NO: 84090 - DNA, 27 bp, Artificial Sequence
  Synthetic
aaaaattaccuaacaggcatccuggaa

SEQ ID NO: 84091 - DNA, 28 bp, Artificial Sequence
  Synthetic
gtctctgtaagautactgcaagccuaaa

SEQ ID NO: 84092 - DNA, 20 bp, Artificial Sequence
  Synthetic
tcagcuggcgcttacaguag

SEQ ID NO: 84093 - DNA, 25 bp, Artificial Sequence
  Synthetic
actgtacgagaugtttcggattuca

SEQ ID NO: 84094 - DNA, 20 bp, Artificial Sequence
  Synthetic
gaggugcaccauaagcagga

SEQ ID NO: 84095 - DNA, 24 bp, Artificial Sequence
  Synthetic
ttaaagagcuaggagtggguaggt

SEQ ID NO: 84096 - DNA, 25 bp, Artificial Sequence
  Synthetic
aagatctgugacgttcctuccaaat

SEQ ID NO: 84097 - DNA, 25 bp, Artificial Sequence
  Synthetic
gctcatgaggagaucttggatctut

SEQ ID NO: 84098 - DNA, 28 bp, Artificial Sequence
  Synthetic
aacaggtacaacugtaactgcttuaaga

SEQ ID NO: 84099 - DNA, 25 bp, Artificial Sequence
  Synthetic
aggauaccaaagctcaugaggagat

SEQ ID NO: 84100 - DNA, 18 bp, Artificial Sequence
  Synthetic
ggcctcaccugcctcuct

SEQ ID NO: 84101 - DNA, 18 bp, Artificial Sequence
  Synthetic
gcauccugagcacagcgt

SEQ ID NO: 84102 - DNA, 23 bp, Artificial Sequence
  Synthetic
ggtctcacctuctctctgctcut

SEQ ID NO: 84103 - DNA, 20 bp, Artificial Sequence
  Synthetic
caatgtgcucacggatgcug

SEQ ID NO: 84104 - DNA, 29 bp, Artificial Sequence
  Synthetic
ctcaagtttccuaaattcctccatcatuc

SEQ ID NO: 84105 - DNA, 20 bp, Artificial Sequence
  Synthetic
gagtggcugagtggcgtuat

SEQ ID NO: 84106 - DNA, 18 bp, Artificial Sequence
  Synthetic
cgaagcugctgccttguc

SEQ ID NO: 84107 - DNA, 18 bp, Artificial Sequence
  Synthetic
ccgcugcagactcucgaa

SEQ ID NO: 84108 - DNA, 21 bp, Artificial Sequence
  Synthetic
caagatcuccttcccguggaa

SEQ ID NO: 84109 - DNA, 27 bp, Artificial Sequence
  Synthetic
gcctgggaautaaaggactctaugaat

SEQ ID NO: 84110 - DNA, 23 bp, Artificial Sequence
  Synthetic
ggatgacagggcuggaataugac

SEQ ID NO: 84111 - DNA, 20 bp, Artificial Sequence
  Synthetic
aucgatgcctuccagcacat

SEQ ID NO: 84112 - DNA, 19 bp, Artificial Sequence
  Synthetic
tcctgtccucgcgtcgaua

SEQ ID NO: 84113 - DNA, 25 bp, Artificial Sequence
  Synthetic
gcatgttggugacctctgaatttut

SEQ ID NO: 84114 - DNA, 28 bp, Artificial Sequence
  Synthetic
acacacgccuctaaattattattugcac

SEQ ID NO: 84115 - DNA, 21 bp, Artificial Sequence
  Synthetic
gccacggagaacacuacugaa

SEQ ID NO: 84116 - DNA, 20 bp, Artificial Sequence
  Synthetic
ccgcccuggataacgtctut

SEQ ID NO: 84117 - DNA, 19 bp, Artificial Sequence
  Synthetic
gtgtgccucgaagcactug

SEQ ID NO: 84118 - DNA, 19 bp, Artificial Sequence
  Synthetic
tctggugctttgagugcga

SEQ ID NO: 84119 - DNA, 24 bp, Artificial Sequence
  Synthetic
ggagcagaagaugttgttggtcut

SEQ ID NO: 84120 - DNA, 22 bp, Artificial Sequence
  Synthetic
acagcaggcacuccauaaacag

SEQ ID NO: 84121 - DNA, 21 bp, Artificial Sequence
  Synthetic
caaattccagguggcaacuga

SEQ ID NO: 84122 - DNA, 28 bp, Artificial Sequence
  Synthetic
gatcacacatctuactagaacacacuca

SEQ ID NO: 84123 - DNA, 28 bp, Artificial Sequence
  Synthetic
tgtttgaaaaugccaaacgctataaugt

SEQ ID NO: 84124 - DNA, 21 bp, Artificial Sequence
  Synthetic
gtctcuggcaaaggtgttugg

SEQ ID NO: 84125 - DNA, 23 bp, Artificial Sequence
  Synthetic
tgagtaaccugaagaccaugggt

SEQ ID NO: 84126 - DNA, 19 bp, Artificial Sequence
  Synthetic
ggtgcgugagttccuggac

SEQ ID NO: 84127 - DNA, 22 bp, Artificial Sequence
  Synthetic
gccctcuacctggtactuggat

SEQ ID NO: 84128 - DNA, 22 bp, Artificial Sequence
  Synthetic
gcatggtcuggacaaaatgcug

SEQ ID NO: 84129 - DNA, 26 bp, Artificial Sequence
  Synthetic
tcattctgtgcuctagggtattcugt

SEQ ID NO: 84130 - DNA, 22 bp, Artificial Sequence
  Synthetic
cagaugagacagcucacgagaa

SEQ ID NO: 84131 - DNA, 22 bp, Artificial Sequence
  Synthetic
gcagcaugaaggagaatctgug

SEQ ID NO: 84132 - DNA, 25 bp, Artificial Sequence
  Synthetic
ctgaattgggcacautatagcgtut

SEQ ID NO: 84133 - DNA, 28 bp, Artificial Sequence
  Synthetic
cattggacttucaggaagaatgttucat

SEQ ID NO: 84134 - DNA, 20 bp, Artificial Sequence
  Synthetic
gtggccugcctgatgaugat

SEQ ID NO: 84135 - DNA, 23 bp, Artificial Sequence
  Synthetic
gagtccatcacugtatcctccug

SEQ ID NO: 84136 - DNA, 21 bp, Artificial Sequence
  Synthetic
agagcctguctttgcggauag

SEQ ID NO: 84137 - DNA, 19 bp, Artificial Sequence
  Synthetic
gtctgcgacutcggcttug

SEQ ID NO: 84138 - DNA, 21 bp, Artificial Sequence
  Synthetic
ggcucacggctcttuaaagca

SEQ ID NO: 84139 - DNA, 23 bp, Artificial Sequence
  Synthetic
gctgcctuaggcttttctucact

SEQ ID NO: 84140 - DNA, 24 bp, Artificial Sequence
  Synthetic
gccatctctcucctcctttttcut

SEQ ID NO: 84141 - DNA, 24 bp, Artificial Sequence
  Synthetic
gugacagaaagguaaagaggagca

SEQ ID NO: 84142 - DNA, 21 bp, Artificial Sequence
  Synthetic
cgtguagcagggtgtcaugag

SEQ ID NO: 84143 - DNA, 22 bp, Artificial Sequence
  Synthetic
gccttctgtcutgcaggttgut

SEQ ID NO: 84144 - DNA, 22 bp, Artificial Sequence
  Synthetic
attttcugcgaacctcaugcac

SEQ ID NO: 84145 - DNA, 20 bp, Artificial Sequence
  Synthetic
atgugccacctucgaaacct

SEQ ID NO: 84146 - DNA, 28 bp, Artificial Sequence
  Synthetic
ttgattgctgutgttaggaaauaggaca

SEQ ID NO: 84147 - DNA, 21 bp, Artificial Sequence
  Synthetic
tggatagguggctgcaaggua

SEQ ID NO: 84148 - DNA, 20 bp, Artificial Sequence
  Synthetic
actcggcutcaggtcucgat

SEQ ID NO: 84149 - DNA, 20 bp, Artificial Sequence
  Synthetic
gcaggaccugcuaggaagac

SEQ ID NO: 84150 - DNA, 28 bp, Artificial Sequence
  Synthetic
agaagctcttuacttgatagctugcaat

SEQ ID NO: 84151 - DNA, 28 bp, Artificial Sequence
  Synthetic
ccagaatuagtgtcatctugaggagaaa

SEQ ID NO: 84152 - DNA, 18 bp, Artificial Sequence
  Synthetic
cccuagggagcacagugg

SEQ ID NO: 84153 - DNA, 26 bp, Artificial Sequence
  Synthetic
cggtttattctgguggataccatgut

SEQ ID NO: 84154 - DNA, 25 bp, Artificial Sequence
  Synthetic
aggaaauacatgtguaagccacact

SEQ ID NO: 84155 - DNA, 26 bp, Artificial Sequence
  Synthetic
agcatggctguttttgtctctttcua

SEQ ID NO: 84156 - DNA, 17 bp, Artificial Sequence
  Synthetic
ccugaugccaggacgga

SEQ ID NO: 84157 - DNA, 19 bp, Artificial Sequence
  Synthetic
gtggtgcuggaggctaugg

SEQ ID NO: 84158 - DNA, 22 bp, Artificial Sequence
  Synthetic
gggtcttuggacagacaaccut

SEQ ID NO: 84159 - DNA, 21 bp, Artificial Sequence
  Synthetic
gcaccaaagacacutccacug

SEQ ID NO: 84160 - DNA, 22 bp, Artificial Sequence
  Synthetic
cttcgccaugttaucagccaga

SEQ ID NO: 84161 - DNA, 28 bp, Artificial Sequence
  Synthetic
ccctatggcttugaaataattggtagug

SEQ ID NO: 84162 - DNA, 26 bp, Artificial Sequence
  Synthetic
tcatgatgaugcctcttagcauagga

SEQ ID NO: 84163 - DNA, 28 bp, Artificial Sequence
  Synthetic
catgtaggtataaugcctgctgttacut

SEQ ID NO: 84164 - DNA, 24 bp, Artificial Sequence
  Synthetic
cctgttggucaggaatgctuaaca

SEQ ID NO: 84165 - DNA, 28 bp, Artificial Sequence
  Synthetic
gaagtgatgauctgagaactugaaagga

SEQ ID NO: 84166 - DNA, 22 bp, Artificial Sequence
  Synthetic
ggtccucaccaaagttctcugt

SEQ ID NO: 84167 - DNA, 22 bp, Artificial Sequence
  Synthetic
ccaggtaatcutctgcctccuc

SEQ ID NO: 84168 - DNA, 22 bp, Artificial Sequence
  Synthetic
ctcucccaaaggttcugaagga

SEQ ID NO: 84169 - DNA, 26 bp, Artificial Sequence
  Synthetic
ctaaccaagcaacutcttagtgtugg

SEQ ID NO: 84170 - DNA, 21 bp, Artificial Sequence
  Synthetic
gccgucgaaacatcaaguacc

SEQ ID NO: 84171 - DNA, 21 bp, Artificial Sequence
  Synthetic
tgttgttggugagctggtuga

SEQ ID NO: 84172 - DNA, 19 bp, Artificial Sequence
  Synthetic
ggcaaccutcucaggccaa

SEQ ID NO: 84173 - DNA, 28 bp, Artificial Sequence
  Synthetic
aaaaactttgcuacactgacauggaaaa

SEQ ID NO: 84174 - DNA, 22 bp, Artificial Sequence
  Synthetic
gcccttcttuttcggcaacauc

SEQ ID NO: 84175 - DNA, 20 bp, Artificial Sequence
  Synthetic
ggtgtaguggtgtgcctucc

SEQ ID NO: 84176 - DNA, 20 bp, Artificial Sequence
  Synthetic
gcttccuccactcccacauc

SEQ ID NO: 84177 - DNA, 19 bp, Artificial Sequence
  Synthetic
cagagccuccctguccaaa

SEQ ID NO: 84178 - DNA, 24 bp, Artificial Sequence
  Synthetic
catgagtgaugggctttattugct

SEQ ID NO: 84179 - DNA, 20 bp, Artificial Sequence
  Synthetic
gcgtaggugccattcagcuc

SEQ ID NO: 84180 - DNA, 27 bp, Artificial Sequence
  Synthetic
gtcatcttttgcuaaatccaacccaut

SEQ ID NO: 84181 - DNA, 21 bp, Artificial Sequence
  Synthetic
tgtgattccugagggagguga

SEQ ID NO: 84182 - DNA, 21 bp, Artificial Sequence
  Synthetic
gcacaccacuacaccaucgag

SEQ ID NO: 84183 - DNA, 21 bp, Artificial Sequence
  Synthetic
ccggtugaagggcttctugag

SEQ ID NO: 84184 - DNA, 18 bp, Artificial Sequence
  Synthetic
cugcggcaacagtucgac

SEQ ID NO: 84185 - DNA, 25 bp, Artificial Sequence
  Synthetic
gtatttgggtuctcaaggacacuca

SEQ ID NO: 84186 - DNA, 28 bp, Artificial Sequence
  Synthetic
gaaaaagaggaagautcttctggccaua

SEQ ID NO: 84187 - DNA, 26 bp, Artificial Sequence
  Synthetic
gccactagagucctaaatcucgaaca

SEQ ID NO: 84188 - DNA, 21 bp, Artificial Sequence
  Synthetic
ctggcatcaguggcagatcut

SEQ ID NO: 84189 - DNA, 23 bp, Artificial Sequence
  Synthetic
gaaaggttcaugtggttcugcac

SEQ ID NO: 84190 - DNA, 27 bp, Artificial Sequence
  Synthetic
aggaagutcuagaaacaacaaagcact

SEQ ID NO: 84191 - DNA, 20 bp, Artificial Sequence
  Synthetic
ggctggugcacacgtactua

SEQ ID NO: 84192 - DNA, 23 bp, Artificial Sequence
  Synthetic
ggtgattaaaguccacccaucct

SEQ ID NO: 84193 - DNA, 21 bp, Artificial Sequence
  Synthetic
cacaaagucccagtucaccca

SEQ ID NO: 84194 - DNA, 22 bp, Artificial Sequence
  Synthetic
ctaccacucccaggagtcugat

SEQ ID NO: 84195 - DNA, 21 bp, Artificial Sequence
  Synthetic
gcaggttccaugtctgctuca

SEQ ID NO: 84196 - DNA, 21 bp, Artificial Sequence
  Synthetic
ctgccagtuctagctcagcut

SEQ ID NO: 84197 - DNA, 19 bp, Artificial Sequence
  Synthetic
gctggctgugctaccaguc

SEQ ID NO: 84198 - DNA, 24 bp, Artificial Sequence
  Synthetic
ggtcagtuttcagatgaucgccat

SEQ ID NO: 84199 - DNA, 20 bp, Artificial Sequence
  Synthetic
aaaacugggagccgggtauc

SEQ ID NO: 84200 - DNA, 21 bp, Artificial Sequence
  Synthetic
ctgctcutctgtcauggcaac

SEQ ID NO: 84201 - DNA, 25 bp, Artificial Sequence
  Synthetic
gaaaatgaaagagcgucctgaccua

SEQ ID NO: 84202 - DNA, 26 bp, Artificial Sequence
  Synthetic
ccttcttaugaggccattccugaaag

SEQ ID NO: 84203 - DNA, 22 bp, Artificial Sequence
  Synthetic
ccagcttacuagaggtggugga

SEQ ID NO: 84204 - DNA, 24 bp, Artificial Sequence
  Synthetic
gtcttggaguggctgttttgttut

SEQ ID NO: 84205 - DNA, 23 bp, Artificial Sequence
  Synthetic
catccgcuctcctttctcuaaca

SEQ ID NO: 84206 - DNA, 19 bp, Artificial Sequence
  Synthetic
ccctgugaccctgcttguc

SEQ ID NO: 84207 - DNA, 18 bp, Artificial Sequence
  Synthetic
ggcgttuccagggctuac

SEQ ID NO: 84208 - DNA, 21 bp, Artificial Sequence
  Synthetic
gtttgaatucccggcaggtut

SEQ ID NO: 84209 - DNA, 24 bp, Artificial Sequence
  Synthetic
gaaagccaggaaaugcactctuac

SEQ ID NO: 84210 - DNA, 20 bp, Artificial Sequence
  Synthetic
cucctgctttugggcagagt

SEQ ID NO: 84211 - DNA, 26 bp, Artificial Sequence
  Synthetic
agagggaaacaaguaaaaagctucca

SEQ ID NO: 84212 - DNA, 27 bp, Artificial Sequence
  Synthetic
tgaaggaaaaccucatcagggaataug

SEQ ID NO: 84213 - DNA, 22 bp, Artificial Sequence
  Synthetic
gttgcatguagccaggaaguct

SEQ ID NO: 84214 - DNA, 20 bp, Artificial Sequence
  Synthetic
caccgcaccaaguctgttug

SEQ ID NO: 84215 - DNA, 20 bp, Artificial Sequence
  Synthetic
cgacugcccaaagacugagg

SEQ ID NO: 84216 - DNA, 28 bp, Artificial Sequence
  Synthetic
ggcatgacaaguagtgcctgtaataaua

SEQ ID NO: 84217 - DNA, 25 bp, Artificial Sequence
  Synthetic
gctaggtgaatuctgtgagctcauc

SEQ ID NO: 84218 - DNA, 20 bp, Artificial Sequence
  Synthetic
gtaccagccccaaguggaug

SEQ ID NO: 84219 - DNA, 28 bp, Artificial Sequence
  Synthetic
aacctcattcugttttgttctctaucgt

SEQ ID NO: 84220 - DNA, 22 bp, Artificial Sequence
  Synthetic
cagggaagggucatgaucagaa

SEQ ID NO: 84221 - DNA, 27 bp, Artificial Sequence
  Synthetic
cattgacguagaagagaauaacagcag

SEQ ID NO: 84222 - DNA, 23 bp, Artificial Sequence
  Synthetic
gaaaggaagugaagtcaccgcua

SEQ ID NO: 84223 - DNA, 23 bp, Artificial Sequence
  Synthetic
tcacagtcagugtcaggtacuca

SEQ ID NO: 84224 - DNA, 21 bp, Artificial Sequence
  Synthetic
gaggcuccaggacttcgaaut

SEQ ID NO: 84225 - DNA, 20 bp, Artificial Sequence
  Synthetic
ggagacucacuaccccgaca

SEQ ID NO: 84226 - DNA, 22 bp, Artificial Sequence
  Synthetic
cacatgccccacauttcagtut

SEQ ID NO: 84227 - DNA, 23 bp, Artificial Sequence
  Synthetic
ggaggatucaagagcaacugagg

SEQ ID NO: 84228 - DNA, 22 bp, Artificial Sequence
  Synthetic
caaacacagutaccugcacgat

SEQ ID NO: 84229 - DNA, 21 bp, Artificial Sequence
  Synthetic
catctgaacuctgcccctguc

SEQ ID NO: 84230 - DNA, 25 bp, Artificial Sequence
  Synthetic
agttcattgucctgttctctucagg

SEQ ID NO: 84231 - DNA, 23 bp, Artificial Sequence
  Synthetic
cccaatgccaucacttagcttut

SEQ ID NO: 84232 - DNA, 21 bp, Artificial Sequence
  Synthetic
cacatugccaccauccaacag

SEQ ID NO: 84233 - DNA, 24 bp, Artificial Sequence
  Synthetic
cttggttuaaggcaacattggcua

SEQ ID NO: 84234 - DNA, 20 bp, Artificial Sequence
  Synthetic
cagctccucccgagtguaga

SEQ ID NO: 84235 - DNA, 27 bp, Artificial Sequence
  Synthetic
gtctcctctgucatactctagttccut

SEQ ID NO: 84236 - DNA, 22 bp, Artificial Sequence
  Synthetic
cttctctgccagutctccaguc

SEQ ID NO: 84237 - DNA, 23 bp, Artificial Sequence
  Synthetic
gaatccagagguttgccaucact

SEQ ID NO: 84238 - DNA, 21 bp, Artificial Sequence
  Synthetic
gatagcctuccccacauggaa

SEQ ID NO: 84239 - DNA, 19 bp, Artificial Sequence
  Synthetic
cttcgtgcgcugcatcauc

SEQ ID NO: 84240 - DNA, 21 bp, Artificial Sequence
  Synthetic
gcaccttcuggaactgctcut

SEQ ID NO: 84241 - DNA, 21 bp, Artificial Sequence
  Synthetic
cgcagtccugaaaaactuccc

SEQ ID NO: 84242 - DNA, 27 bp, Artificial Sequence
  Synthetic
ctttgagaacuctcctugaggaagaat

SEQ ID NO: 84243 - DNA, 25 bp, Artificial Sequence
  Synthetic
agguagaagacacaaccaccuagag

SEQ ID NO: 84244 - DNA, 23 bp, Artificial Sequence
  Synthetic
ctccttttccuggttccgctuaa

SEQ ID NO: 84245 - DNA, 25 bp, Artificial Sequence
  Synthetic
cgcatacggacuacaaaagaugaga

SEQ ID NO: 84246 - DNA, 24 bp, Artificial Sequence
  Synthetic
tguaagacacgagacacuggaaga

SEQ ID NO: 84247 - DNA, 23 bp, Artificial Sequence
  Synthetic
tgggtaaugcaggcagacatuat

SEQ ID NO: 84248 - DNA, 24 bp, Artificial Sequence
  Synthetic
cutgggcttccuaaaaacagcaat

SEQ ID NO: 84249 - DNA, 19 bp, Artificial Sequence
  Synthetic
cctgtgcacccucacctug

SEQ ID NO: 84250 - DNA, 26 bp, Artificial Sequence
  Synthetic
gccaacttgaaaugaagactttucct

SEQ ID NO: 84251 - DNA, 28 bp, Artificial Sequence
  Synthetic
gaaagagagguagatttcaatggctuct

SEQ ID NO: 84252 - DNA, 20 bp, Artificial Sequence
  Synthetic
ctcaccctcutctcgtggut

SEQ ID NO: 84253 - DNA, 20 bp, Artificial Sequence
  Synthetic
gauggccaagaugacggaga

SEQ ID NO: 84254 - DNA, 20 bp, Artificial Sequence
  Synthetic
ggagtatcucccgggacuca

SEQ ID NO: 84255 - DNA, 21 bp, Artificial Sequence
  Synthetic
ggagcucgacagcaatctgua

SEQ ID NO: 84256 - DNA, 28 bp, Artificial Sequence
  Synthetic
ggaaaagtuagcaacacaaatgaaguct

SEQ ID NO: 84257 - DNA, 25 bp, Artificial Sequence
  Synthetic
cctcctccttuttgtgtttggttut

SEQ ID NO: 84258 - DNA, 21 bp, Artificial Sequence
  Synthetic
cgtggtccgugaagagttugt

SEQ ID NO: 84259 - DNA, 20 bp, Artificial Sequence
  Synthetic
tgccgtaugacctgacctug

SEQ ID NO: 84260 - DNA, 21 bp, Artificial Sequence
  Synthetic
ggtgagauggcctacatcgug

SEQ ID NO: 84261 - DNA, 23 bp, Artificial Sequence
  Synthetic
ctgtgctgaauctgacctgtcut

SEQ ID NO: 84262 - DNA, 20 bp, Artificial Sequence
  Synthetic
gcggaacucgaatcgcuacc

SEQ ID NO: 84263 - DNA, 19 bp, Artificial Sequence
  Synthetic
tggguccccaagacaccua

SEQ ID NO: 84264 - DNA, 20 bp, Artificial Sequence
  Synthetic
tgccuccatugacacaaggt

SEQ ID NO: 84265 - DNA, 27 bp, Artificial Sequence
  Synthetic
aaatgtgagacugatgtcaatgagugt

SEQ ID NO: 84266 - DNA, 21 bp, Artificial Sequence
  Synthetic
tgcctccatugacacaaggug

SEQ ID NO: 84267 - DNA, 27 bp, Artificial Sequence
  Synthetic
cagaaatgugagactgatgtcaaugag

SEQ ID NO: 84268 - DNA, 24 bp, Artificial Sequence
  Synthetic
gagaaaagtgaautggccctcuct

SEQ ID NO: 84269 - DNA, 25 bp, Artificial Sequence
  Synthetic
tgataggctutggtgaagauagcac

SEQ ID NO: 84270 - DNA, 23 bp, Artificial Sequence
  Synthetic
ttccctgguatcccattctucca

SEQ ID NO: 84271 - DNA, 26 bp, Artificial Sequence
  Synthetic
ctacaacauacgtagcugacacagaa

SEQ ID NO: 84272 - DNA, 24 bp, Artificial Sequence
  Synthetic
tgacctttttggutacccacacut

SEQ ID NO: 84273 - DNA, 27 bp, Artificial Sequence
  Synthetic
actggtgcucattttcatcattaucca

SEQ ID NO: 84274 - DNA, 21 bp, Artificial Sequence
  Synthetic
catgcccutcttggtctugga

SEQ ID NO: 84275 - DNA, 22 bp, Artificial Sequence
  Synthetic
gctgagccuctggcctattuag

SEQ ID NO: 84276 - DNA, 21 bp, Artificial Sequence
  Synthetic
cagatagcaucagggccucag

SEQ ID NO: 84277 - DNA, 26 bp, Artificial Sequence
  Synthetic
tgcugtctaaaaatuaaggcccacat

SEQ ID NO: 84278 - DNA, 27 bp, Artificial Sequence
  Synthetic
aggccgacaaagautatcacttuaagg

SEQ ID NO: 84279 - DNA, 28 bp, Artificial Sequence
  Synthetic
aaagtcucaagccacatgaauagaaact

SEQ ID NO: 84280 - DNA, 26 bp, Artificial Sequence
  Synthetic
cacactcatugacatcagtcucacat

SEQ ID NO: 84281 - DNA, 18 bp, Artificial Sequence
  Synthetic
ggagugccaauggacgga

SEQ ID NO: 84282 - DNA, 22 bp, Artificial Sequence
  Synthetic
gaagactttgcuctggccaaug

SEQ ID NO: 84283 - DNA, 21 bp, Artificial Sequence
  Synthetic
ctcgucagccagugagaagaa

SEQ ID NO: 84284 - DNA, 23 bp, Artificial Sequence
  Synthetic
caagutctttggcuggagagact

SEQ ID NO: 84285 - DNA, 24 bp, Artificial Sequence
  Synthetic
tcttggttggcugggtactagtua

SEQ ID NO: 84286 - DNA, 21 bp, Artificial Sequence
  Synthetic
gtcacttugagagccccacuc

SEQ ID NO: 84287 - DNA, 26 bp, Artificial Sequence
  Synthetic
gaaatgtttttgtucctcctgtgcua

SEQ ID NO: 84288 - DNA, 19 bp, Artificial Sequence
  Synthetic
augagacaggcaggcaucc

SEQ ID NO: 84289 - DNA, 22 bp, Artificial Sequence
  Synthetic
aagagctcgcugatgtcaauga

SEQ ID NO: 84290 - DNA, 20 bp, Artificial Sequence
  Synthetic
gctcacccggaagucagaut

SEQ ID NO: 84291 - DNA, 23 bp, Artificial Sequence
  Synthetic
ttgccaauccagaagtaaccugt

SEQ ID NO: 84292 - DNA, 28 bp, Artificial Sequence
  Synthetic
tgaaatgattcaauctgacaacagcuct

SEQ ID NO: 84293 - DNA, 20 bp, Artificial Sequence
  Synthetic
gcatgccguaactgctgtuc

SEQ ID NO: 84294 - DNA, 26 bp, Artificial Sequence
  Synthetic
ctttaccatgtauctgcttgctcuga

SEQ ID NO: 84295 - DNA, 29 bp, Artificial Sequence
  Synthetic
cagttgtgattcuttctttctacttgugt

SEQ ID NO: 84296 - DNA, 21 bp, Artificial Sequence
  Synthetic
ctccttcugcttcaggcuact

SEQ ID NO: 84297 - DNA, 20 bp, Artificial Sequence
  Synthetic
cacactcaaugccaccaucc

SEQ ID NO: 84298 - DNA, 25 bp, Artificial Sequence
  Synthetic
caaccaauaaggcttcauccacaag

SEQ ID NO: 84299 - DNA, 20 bp, Artificial Sequence
  Synthetic
ctgctgguggtgctacugag

SEQ ID NO: 84300 - DNA, 26 bp, Artificial Sequence
  Synthetic
tgtgtgtttgtutagctttttgguga

SEQ ID NO: 84301 - DNA, 27 bp, Artificial Sequence
  Synthetic
cactgagaggugactuaaagaaaccat

SEQ ID NO: 84302 - DNA, 22 bp, Artificial Sequence
  Synthetic
gccagttcutgatcctgtugct

SEQ ID NO: 84303 - DNA, 22 bp, Artificial Sequence
  Synthetic
gtctagccugatcactgaccug

SEQ ID NO: 84304 - DNA, 21 bp, Artificial Sequence
  Synthetic
cttccaagagcccauccauca

SEQ ID NO: 84305 - DNA, 28 bp, Artificial Sequence
  Synthetic
gatttgtacctucgaacaagaaaugagt

SEQ ID NO: 84306 - DNA, 21 bp, Artificial Sequence
  Synthetic
gtcattgtugtgccccuacct

SEQ ID NO: 84307 - DNA, 22 bp, Artificial Sequence
  Synthetic
cgutgaaguggagcaagaggac

SEQ ID NO: 84308 - DNA, 21 bp, Artificial Sequence
  Synthetic
cagcctugccccttcaaacua

SEQ ID NO: 84309 - DNA, 28 bp, Artificial Sequence
  Synthetic
ccaagatctuaggcagaatgaacaatuc

SEQ ID NO: 84310 - DNA, 22 bp, Artificial Sequence
  Synthetic
gcacagutcatgtcuccaagga

SEQ ID NO: 84311 - DNA, 28 bp, Artificial Sequence
  Synthetic
ttactgggatgtutgaataagatcggut

SEQ ID NO: 84312 - DNA, 21 bp, Artificial Sequence
  Synthetic
gtggucccagccagtcatuac

SEQ ID NO: 84313 - DNA, 29 bp, Artificial Sequence
  Synthetic
gtttgttggaagaaugtgatcagcttaut

SEQ ID NO: 84314 - DNA, 23 bp, Artificial Sequence
  Synthetic
gctgagaaagcugaaggtcctua

SEQ ID NO: 84315 - DNA, 20 bp, Artificial Sequence
  Synthetic
gacutcagttccugcagcca

SEQ ID NO: 84316 - DNA, 24 bp, Artificial Sequence
  Synthetic
ctggtcaaugactcagactuccag

SEQ ID NO: 84317 - DNA, 21 bp, Artificial Sequence
  Synthetic
tccccagacaggcaauaggua

SEQ ID NO: 84318 - DNA, 21 bp, Artificial Sequence
  Synthetic
tgaggtuggagatggagcuct

SEQ ID NO: 84319 - DNA, 22 bp, Artificial Sequence
  Synthetic
ccacucttgcugcaaacaacac

SEQ ID NO: 84320 - DNA, 22 bp, Artificial Sequence
  Synthetic
ttgcatggucatagcucccaat

SEQ ID NO: 84321 - DNA, 26 bp, Artificial Sequence
  Synthetic
tgtagtttctcuttggaaagctcugg

SEQ ID NO: 84322 - DNA, 24 bp, Artificial Sequence
  Synthetic
ctagugcagctttugacaacaact

SEQ ID NO: 84323 - DNA, 25 bp, Artificial Sequence
  Synthetic
tttatgccgttcugtcaatgagcua

SEQ ID NO: 84324 - DNA, 22 bp, Artificial Sequence
  Synthetic
gcuacctgttguacagagcaca

SEQ ID NO: 84325 - DNA, 20 bp, Artificial Sequence
  Synthetic
gcatuggcaggatggtugag

SEQ ID NO: 84326 - DNA, 22 bp, Artificial Sequence
  Synthetic
gggaagccutcctttcaaaucc

SEQ ID NO: 84327 - DNA, 24 bp, Artificial Sequence
  Synthetic
ggcctaugacaagaaaauggacac

SEQ ID NO: 84328 - DNA, 27 bp, Artificial Sequence
  Synthetic
aagtgcttaauggctagacaaauagca

SEQ ID NO: 84329 - DNA, 20 bp, Artificial Sequence
  Synthetic
tcccgggaucgtgttcuaca

SEQ ID NO: 84330 - DNA, 22 bp, Artificial Sequence
  Synthetic
tcgggutatacuggaagccact

SEQ ID NO: 84331 - DNA, 21 bp, Artificial Sequence
  Synthetic
gctgagccauccagaacctut

SEQ ID NO: 84332 - DNA, 24 bp, Artificial Sequence
  Synthetic
tcaaagcatugccatggaaaaugg

SEQ ID NO: 84333 - DNA, 21 bp, Artificial Sequence
  Synthetic
aatccagugcttccuccacag

SEQ ID NO: 84334 - DNA, 19 bp, Artificial Sequence
  Synthetic
gtctccccaugtgguccaa

SEQ ID NO: 84335 - DNA, 18 bp, Artificial Sequence
  Synthetic
cgcacagccccucgtauc

SEQ ID NO: 84336 - DNA, 26 bp, Artificial Sequence
  Synthetic
gtcatctgcutctcctttcugaacaa

SEQ ID NO: 84337 - DNA, 27 bp, Artificial Sequence
  Synthetic
gaaacaggugctttaaaaguagcaact

SEQ ID NO: 84338 - DNA, 22 bp, Artificial Sequence
  Synthetic
ccaaggagacugtugaggaagg

SEQ ID NO: 84339 - DNA, 25 bp, Artificial Sequence
  Synthetic
acacaagugggcaaacatttctcua

SEQ ID NO: 84340 - DNA, 22 bp, Artificial Sequence
  Synthetic
ccagguagagggaguacagagt

SEQ ID NO: 84341 - DNA, 21 bp, Artificial Sequence
  Synthetic
cagggcttugaaggaagtgug

SEQ ID NO: 84342 - DNA, 22 bp, Artificial Sequence
  Synthetic
tcagtcuccagcatctcuaccc

SEQ ID NO: 84343 - DNA, 23 bp, Artificial Sequence
  Synthetic
ggttcctggugttcctccattuc

SEQ ID NO: 84344 - DNA, 20 bp, Artificial Sequence
  Synthetic
gctccctcuccgctactcuc

SEQ ID NO: 84345 - DNA, 24 bp, Artificial Sequence
  Synthetic
ggctggatucactcttcactcuac

SEQ ID NO: 84346 - DNA, 28 bp, Artificial Sequence
  Synthetic
tcttagaacuaggattacctgugaagca

SEQ ID NO: 84347 - DNA, 26 bp, Artificial Sequence
  Synthetic
agacaaggatuggcattcagucaaat

SEQ ID NO: 84348 - DNA, 19 bp, Artificial Sequence
  Synthetic
gcccaccccagutcacaua

SEQ ID NO: 84349 - DNA, 19 bp, Artificial Sequence
  Synthetic
gctgacaccugaggcacug

SEQ ID NO: 84350 - DNA, 22 bp, Artificial Sequence
  Synthetic
tcaccccaggaugaacaatgug

SEQ ID NO: 84351 - DNA, 28 bp, Artificial Sequence
  Synthetic
cctcaactttgtucacttctcaggaaua

SEQ ID NO: 84352 - DNA, 20 bp, Artificial Sequence
  Synthetic
gctctgggucgtccttgtug

SEQ ID NO: 84353 - DNA, 25 bp, Artificial Sequence
  Synthetic
acagcagtctutctttcccatguaa

SEQ ID NO: 84354 - DNA, 22 bp, Artificial Sequence
  Synthetic
aucaaugcaggcaaaagcaact

SEQ ID NO: 84355 - DNA, 21 bp, Artificial Sequence
  Synthetic
gcctctgaucttgctgcctuc

SEQ ID NO: 84356 - DNA, 25 bp, Artificial Sequence
  Synthetic
gccaucagacaaggaaaaacgauag

SEQ ID NO: 84357 - DNA, 27 bp, Artificial Sequence
  Synthetic
tgctggtgggaaacuattatgaaacut

SEQ ID NO: 84358 - DNA, 23 bp, Artificial Sequence
  Synthetic
ggaggttctugtccctcttcuca

SEQ ID NO: 84359 - DNA, 23 bp, Artificial Sequence
  Synthetic
tttccttguacctgtccagucac

SEQ ID NO: 84360 - DNA, 22 bp, Artificial Sequence
  Synthetic
ccgaaucugaaggcagcaagat

SEQ ID NO: 84361 - DNA, 20 bp, Artificial Sequence
  Synthetic
tgcatacacucgggcaugac

SEQ ID NO: 84362 - DNA, 17 bp, Artificial Sequence
  Synthetic
ccaccgugggcctgtua

SEQ ID NO: 84363 - DNA, 17 bp, Artificial Sequence
  Synthetic
agccgccuccgaagaug

SEQ ID NO: 84364 - DNA, 21 bp, Artificial Sequence
  Synthetic
guttttcccacugccaagcat

SEQ ID NO: 84365 - DNA, 23 bp, Artificial Sequence
  Synthetic
acagaactgtugccattgtguca

SEQ ID NO: 84366 - DNA, 19 bp, Artificial Sequence
  Synthetic
ctgcgctucttgcatggut

SEQ ID NO: 84367 - DNA, 21 bp, Artificial Sequence
  Synthetic
tttggtcaccacguagctcuc

SEQ ID NO: 84368 - DNA, 23 bp, Artificial Sequence
  Synthetic
ttggtttgtggucctcacctaug

SEQ ID NO: 84369 - DNA, 22 bp, Artificial Sequence
  Synthetic
tcccgttccuaccagtcacuat

SEQ ID NO: 84370 - DNA, 24 bp, Artificial Sequence
  Synthetic
agaaaaggaagugccaggcaaaua

SEQ ID NO: 84371 - DNA, 26 bp, Artificial Sequence
  Synthetic
ttgttaacagguccaaggaagaaguc

SEQ ID NO: 84372 - DNA, 24 bp, Artificial Sequence
  Synthetic
cttcggagugattgcaaggtauca

SEQ ID NO: 84373 - DNA, 21 bp, Artificial Sequence
  Synthetic
cgaugcaagtgcucaaacacc

SEQ ID NO: 84374 - DNA, 22 bp, Artificial Sequence
  Synthetic
ccaaacgaugaagcctcactut

SEQ ID NO: 84375 - DNA, 26 bp, Artificial Sequence
  Synthetic
cgtgatccuttaagctcuaagaaggg

SEQ ID NO: 84376 - DNA, 24 bp, Artificial Sequence
  Synthetic
ttcgtgcugatatttgtgugaggt

SEQ ID NO: 84377 - DNA, 25 bp, Artificial Sequence
  Synthetic
aatgacttgtcuaggaaggcagtug

SEQ ID NO: 84378 - DNA, 22 bp, Artificial Sequence
  Synthetic
gguactctctgtugaccaccca

SEQ ID NO: 84379 - DNA, 21 bp, Artificial Sequence
  Synthetic
gcuctcugacccagcacaaat

SEQ ID NO: 84380 - DNA, 27 bp, Artificial Sequence
  Synthetic
tttttagccaugagttcaagttccuct

SEQ ID NO: 84381 - DNA, 27 bp, Artificial Sequence
  Synthetic
gaggcagcagauaccacattatgtuaa

SEQ ID NO: 84382 - DNA, 22 bp, Artificial Sequence
  Synthetic
attctgtugccggaagauaccc

SEQ ID NO: 84383 - DNA, 22 bp, Artificial Sequence
  Synthetic
tuggtccaguaacaagcacaca

SEQ ID NO: 84384 - DNA, 28 bp, Artificial Sequence
  Synthetic
agttggtggaautaatacactgtctuca

SEQ ID NO: 84385 - DNA, 27 bp, Artificial Sequence
  Synthetic
aaggaacaggaagaaaucaguagcaaa

SEQ ID NO: 84386 - DNA, 26 bp, Artificial Sequence
  Synthetic
tcagttactggugatctagcaggaut

SEQ ID NO: 84387 - DNA, 28 bp, Artificial Sequence
  Synthetic
gaggacauttattucacaggagagagac

SEQ ID NO: 84388 - DNA, 22 bp, Artificial Sequence
  Synthetic
gcaggaaaauggcaaagccuat

SEQ ID NO: 84389 - DNA, 29 bp, Artificial Sequence
  Synthetic
actgtgtttggaaaaugatcacctaagua

SEQ ID NO: 84390 - DNA, 22 bp, Artificial Sequence
  Synthetic
tgaaaaattgggugagctgcug

SEQ ID NO: 84391 - DNA, 25 bp, Artificial Sequence
  Synthetic
ttggaggaagaccgutcgatatcua

SEQ ID NO: 84392 - DNA, 19 bp, Artificial Sequence
  Synthetic
gcctcccugggtgcttaug

SEQ ID NO: 84393 - DNA, 18 bp, Artificial Sequence
  Synthetic
gcuacagugggcgcaact

SEQ ID NO: 84394 - DNA, 17 bp, Artificial Sequence
  Synthetic
cccgacucccgcccuaa

SEQ ID NO: 84395 - DNA, 21 bp, Artificial Sequence
  Synthetic
ccaguccaggagcctaaugac

SEQ ID NO: 84396 - DNA, 24 bp, Artificial Sequence
  Synthetic
gagaacaggaagutggtagcucag

SEQ ID NO: 84397 - DNA, 27 bp, Artificial Sequence
  Synthetic
ccagcaagttuacaatgttcaaatgug

SEQ ID NO: 84398 - DNA, 18 bp, Artificial Sequence
  Synthetic
gcagtcgucgatgucggt

SEQ ID NO: 84399 - DNA, 21 bp, Artificial Sequence
  Synthetic
acatcaacgagugcgttcuga

SEQ ID NO: 84400 - DNA, 19 bp, Artificial Sequence
  Synthetic
gugggtgttcuggcaggat

SEQ ID NO: 84401 - DNA, 19 bp, Artificial Sequence
  Synthetic
ggucgggagaggcactgua

SEQ ID NO: 84402 - DNA, 23 bp, Artificial Sequence
  Synthetic
gtatcttcuaccaggtgctuggg

SEQ ID NO: 84403 - DNA, 26 bp, Artificial Sequence
  Synthetic
caatgaggaaacugaccaaagugaaa

SEQ ID NO: 84404 - DNA, 23 bp, Artificial Sequence
  Synthetic
gtcccctaccutatctcccauct

SEQ ID NO: 84405 - DNA, 20 bp, Artificial Sequence
  Synthetic
ggtggtgagauagccccugt

SEQ ID NO: 84406 - DNA, 31 bp, Artificial Sequence
  Synthetic
attttattcctagggaaugagtgagacttug

SEQ ID NO: 84407 - DNA, 25 bp, Artificial Sequence
  Synthetic
ccacctggcuacacgaaaatttcua

SEQ ID NO: 84408 - DNA, 21 bp, Artificial Sequence
  Synthetic
gucttcuggccccaagaaagt

SEQ ID NO: 84409 - DNA, 27 bp, Artificial Sequence
  Synthetic
agacatcagcaucaacttgtucaaaag

SEQ ID NO: 84410 - DNA, 21 bp, Artificial Sequence
  Synthetic
aagaaggugagctcgggttuc

SEQ ID NO: 84411 - DNA, 21 bp, Artificial Sequence
  Synthetic
ctccccuttccgtgaugaagt

SEQ ID NO: 84412 - DNA, 24 bp, Artificial Sequence
  Synthetic
ccgccctcuttcacttttatcuct

SEQ ID NO: 84413 - DNA, 21 bp, Artificial Sequence
  Synthetic
gatagcgaaagcucccctucc

SEQ ID NO: 84414 - DNA, 23 bp, Artificial Sequence
  Synthetic
agugaatcagugccaaagacaca

SEQ ID NO: 84415 - DNA, 28 bp, Artificial Sequence
  Synthetic
ccaggaggautacctauacaaagaacag

SEQ ID NO: 84416 - DNA, 20 bp, Artificial Sequence
  Synthetic
gcccaccagcugatucacag

SEQ ID NO: 84417 - DNA, 20 bp, Artificial Sequence
  Synthetic
cctccaccgcagugctaaug

SEQ ID NO: 84418 - DNA, 20 bp, Artificial Sequence
  Synthetic
gagccggugcaagatctcut

SEQ ID NO: 84419 - DNA, 25 bp, Artificial Sequence
  Synthetic
tgaggtcgauaaggatgttttcguc

SEQ ID NO: 84420 - DNA, 23 bp, Artificial Sequence
  Synthetic
cctggctcugcagtttctcttua

SEQ ID NO: 84421 - DNA, 28 bp, Artificial Sequence
  Synthetic
caatataatgcuggaccgccatauagat

SEQ ID NO: 84422 - DNA, 28 bp, Artificial Sequence
  Synthetic
gtctgaactgaagauaatgactcaccug

SEQ ID NO: 84423 - DNA, 25 bp, Artificial Sequence
  Synthetic
agagtggaggauttaagcctgatug

SEQ ID NO: 84424 - DNA, 23 bp, Artificial Sequence
  Synthetic
caauggctucaaacagccaacat

SEQ ID NO: 84425 - DNA, 24 bp, Artificial Sequence
  Synthetic
gcccuacaagtgcauacaacaaga

SEQ ID NO: 84426 - DNA, 33 bp, Artificial Sequence
  Synthetic
tctattcttagataugaagagaaggctacuaaa

SEQ ID NO: 84427 - DNA, 21 bp, Artificial Sequence
  Synthetic
catgcgcuggtgggttttauc

SEQ ID NO: 84428 - DNA, 20 bp, Artificial Sequence
  Synthetic
gcggcaccucatgaccauat

SEQ ID NO: 84429 - DNA, 27 bp, Artificial Sequence
  Synthetic
ctcggttgacautaggagcaattcuaa

SEQ ID NO: 84430 - DNA, 18 bp, Artificial Sequence
  Synthetic
cuccaccgcgacaucaag

SEQ ID NO: 84431 - DNA, 18 bp, Artificial Sequence
  Synthetic
gcctggcucaccaucgaa

SEQ ID NO: 84432 - DNA, 20 bp, Artificial Sequence
  Synthetic
gttttguggcaccgcttcuc

SEQ ID NO: 84433 - DNA, 23 bp, Artificial Sequence
  Synthetic
gaagagagaucaatgcacuccca

SEQ ID NO: 84434 - DNA, 28 bp, Artificial Sequence
  Synthetic
agtatctggactuaaagacacaggctua

SEQ ID NO: 84435 - DNA, 21 bp, Artificial Sequence
  Synthetic
gggatgccugatgcttcucac

SEQ ID NO: 84436 - DNA, 21 bp, Artificial Sequence
  Synthetic
gaaacaaaggccutggugcag

SEQ ID NO: 84437 - DNA, 24 bp, Artificial Sequence
  Synthetic
cguggugaaaccaaaccaagaaaa

SEQ ID NO: 84438 - DNA, 28 bp, Artificial Sequence
  Synthetic
cacaaatgucactaaaagauggcagaaa

SEQ ID NO: 84439 - DNA, 26 bp, Artificial Sequence
  Synthetic
tttcaatttgggacugaaggagtuca

SEQ ID NO: 84440 - DNA, 21 bp, Artificial Sequence
  Synthetic
tgcatgugccagacatccuaa

SEQ ID NO: 84441 - DNA, 21 bp, Artificial Sequence
  Synthetic
cacgaagcaugtccaatugcc

SEQ ID NO: 84442 - DNA, 27 bp, Artificial Sequence
  Synthetic
tcaaccaaaactugatgaactcctuca

SEQ ID NO: 84443 - DNA, 24 bp, Artificial Sequence
  Synthetic
aaacctgagautgtggaucaagca

SEQ ID NO: 84444 - DNA, 20 bp, Artificial Sequence
  Synthetic
ccggcaautcatggauccag

SEQ ID NO: 84445 - DNA, 20 bp, Artificial Sequence
  Synthetic
cccctcugatgtgtcuccaa

SEQ ID NO: 84446 - DNA, 23 bp, Artificial Sequence
  Synthetic
gggaaaatgutcttgggtgucat

SEQ ID NO: 84447 - DNA, 27 bp, Artificial Sequence
  Synthetic
tgacaagttacacaucaaaacccauct

SEQ ID NO: 84448 - DNA, 28 bp, Artificial Sequence
  Synthetic
agttgactuagaagagaaggaugaacct

SEQ ID NO: 84449 - DNA, 26 bp, Artificial Sequence
  Synthetic
gctctgcaggaaguttatgattcuca

SEQ ID NO: 84450 - DNA, 26 bp, Artificial Sequence
  Synthetic
agtactcttuagaggaggugaaggag

SEQ ID NO: 84451 - DNA, 21 bp, Artificial Sequence
  Synthetic
cttagcgccacugcaaagaug

SEQ ID NO: 84452 - DNA, 21 bp, Artificial Sequence
  Synthetic
ttccactcaacugccaagugt

SEQ ID NO: 84453 - DNA, 27 bp, Artificial Sequence
  Synthetic
ggctaatgactcugatgatagcatcuc

SEQ ID NO: 84454 - DNA, 22 bp, Artificial Sequence
  Synthetic
ccauccctgctucagaacagaa

SEQ ID NO: 84455 - DNA, 22 bp, Artificial Sequence
  Synthetic
cgucctcaaggucaccagaaac

SEQ ID NO: 84456 - DNA, 26 bp, Artificial Sequence
  Synthetic
gaagccctgcuatttaaaagactuct

SEQ ID NO: 84457 - DNA, 28 bp, Artificial Sequence
  Synthetic
cccaaccttcuaccttcgattttaauct

SEQ ID NO: 84458 - DNA, 24 bp, Artificial Sequence
  Synthetic
cagacagaagcacaguaccgatut

SEQ ID NO: 84459 - DNA, 25 bp, Artificial Sequence
  Synthetic
ctagcaagagaaugagaauccgcat

SEQ ID NO: 84460 - DNA, 27 bp, Artificial Sequence
  Synthetic
ccugagaaggaaaagcgaauaaaggaa

SEQ ID NO: 84461 - DNA, 23 bp, Artificial Sequence
  Synthetic
aagctgctaucccctcatucaag

SEQ ID NO: 84462 - DNA, 22 bp, Artificial Sequence
  Synthetic
cctcaaggccugtttgtctgut

SEQ ID NO: 84463 - DNA, 22 bp, Artificial Sequence
  Synthetic
cagagaaccucggaacauacgg

SEQ ID NO: 84464 - DNA, 26 bp, Artificial Sequence
  Synthetic
agaattttcaucccatagagcacugg

SEQ ID NO: 84465 - DNA, 22 bp, Artificial Sequence
  Synthetic
cttggccacacugtcctcuaag

SEQ ID NO: 84466 - DNA, 22 bp, Artificial Sequence
  Synthetic
cacacagtuggcaaggaaagut

SEQ ID NO: 84467 - DNA, 23 bp, Artificial Sequence
  Synthetic
tccaacaagaaggccuggttuag

SEQ ID NO: 84468 - DNA, 22 bp, Artificial Sequence
  Synthetic
cacttagguccagctcctucag

SEQ ID NO: 84469 - DNA, 24 bp, Artificial Sequence
  Synthetic
acacatcacatcuctcctgtccut

SEQ ID NO: 84470 - DNA, 22 bp, Artificial Sequence
  Synthetic
tcttccttugttggttgcugct

SEQ ID NO: 84471 - DNA, 26 bp, Artificial Sequence
  Synthetic
tgtactttctccutcttctccctcut

SEQ ID NO: 84472 - DNA, 27 bp, Artificial Sequence
  Synthetic
gctttactcauaggtgggaaacuacct

SEQ ID NO: 84473 - DNA, 19 bp, Artificial Sequence
  Synthetic
aaacccucgugaagacgca

SEQ ID NO: 84474 - DNA, 23 bp, Artificial Sequence
  Synthetic
caauagttgcugggacaccaaag

SEQ ID NO: 84475 - DNA, 22 bp, Artificial Sequence
  Synthetic
tcatagcccutagctgggucat

SEQ ID NO: 84476 - DNA, 28 bp, Artificial Sequence
  Synthetic
tcagcagaaacagccutaattattuggt

SEQ ID NO: 84477 - DNA, 29 bp, Artificial Sequence
  Synthetic
tgcatacttggaaugaatccttcuagaga

SEQ ID NO: 84478 - DNA, 23 bp, Artificial Sequence
  Synthetic
acataccguggacgtctcuagaa

SEQ ID NO: 84479 - DNA, 28 bp, Artificial Sequence
  Synthetic
tgtcaaagctauaaaaatctccagugct

SEQ ID NO: 84480 - DNA, 27 bp, Artificial Sequence
  Synthetic
tcatattgatuaggctgttccaaugaa

SEQ ID NO: 84481 - DNA, 23 bp, Artificial Sequence
  Synthetic
cctgttgcacuggttttgaugaa

SEQ ID NO: 84482 - DNA, 27 bp, Artificial Sequence
  Synthetic
gatctgctugatgttgtacuagacagt

SEQ ID NO: 84483 - DNA, 27 bp, Artificial Sequence
  Synthetic
cttgcttgaaaccaauttcacattucc

SEQ ID NO: 84484 - DNA, 24 bp, Artificial Sequence
  Synthetic
gatactgctguagctttggctuct

SEQ ID NO: 84485 - DNA, 26 bp, Artificial Sequence
  Synthetic
acatgggacucaaagtttuagcacaa

SEQ ID NO: 84486 - DNA, 26 bp, Artificial Sequence
  Synthetic
gatcttcatcucttgtttgcuccact

SEQ ID NO: 84487 - DNA, 25 bp, Artificial Sequence
  Synthetic
agcttgtgugaaatgcattaugcaa

SEQ ID NO: 84488 - DNA, 29 bp, Artificial Sequence
  Synthetic
ttcaagtgactcutctcatgttcttuacc

SEQ ID NO: 84489 - DNA, 18 bp, Artificial Sequence
  Synthetic
gccaagcguctccuggat

SEQ ID NO: 84490 - DNA, 20 bp, Artificial Sequence
  Synthetic
gcagucgcuaccgggaaaat

SEQ ID NO: 84491 - DNA, 18 bp, Artificial Sequence
  Synthetic
cgtatccgcgcucgtcua

SEQ ID NO: 84492 - DNA, 29 bp, Artificial Sequence
  Synthetic
ccaaattattagaugcagaactccaguga

SEQ ID NO: 84493 - DNA, 25 bp, Artificial Sequence
  Synthetic
ggtacgucaacaggaacagcaaaua

SEQ ID NO: 84494 - DNA, 27 bp, Artificial Sequence
  Synthetic
cagcactaaagaautgggatgtttuga

SEQ ID NO: 84495 - DNA, 28 bp, Artificial Sequence
  Synthetic
acaaaggagagugattgattttctucct

SEQ ID NO: 84496 - DNA, 20 bp, Artificial Sequence
  Synthetic
catgttgucctgggcatugg

SEQ ID NO: 84497 - DNA, 26 bp, Artificial Sequence
  Synthetic
agaggactctuctgctaacatcauca

SEQ ID NO: 84498 - DNA, 27 bp, Artificial Sequence
  Synthetic
acccctagcaaguatatgagtaacgua

SEQ ID NO: 84499 - DNA, 27 bp, Artificial Sequence
  Synthetic
ctattccugaagcagaaattggatugg

SEQ ID NO: 84500 - DNA, 21 bp, Artificial Sequence
  Synthetic
ccgccaauccaatttctgcut

SEQ ID NO: 84501 - DNA, 31 bp, Artificial Sequence
  Synthetic
aaagaggttgcttuatcttgacattatcuga

SEQ ID NO: 84502 - DNA, 25 bp, Artificial Sequence
  Synthetic
ccctcttccuccattcagtttccua

SEQ ID NO: 84503 - DNA, 21 bp, Artificial Sequence
  Synthetic
ccuttcccuggcagacaacag

SEQ ID NO: 84504 - DNA, 28 bp, Artificial Sequence
  Synthetic
acattgcttttucagaaggctaauagga

SEQ ID NO: 84505 - DNA, 27 bp, Artificial Sequence
  Synthetic
cccagatgagauctccaacttcauact

SEQ ID NO: 84506 - DNA, 17 bp, Artificial Sequence
  Synthetic
ggcccutcuagcacgca

SEQ ID NO: 84507 - DNA, 21 bp, Artificial Sequence
  Synthetic
gaccaugttccucaccacaca

SEQ ID NO: 84508 - DNA, 18 bp, Artificial Sequence
  Synthetic
gctugcacgagccaguct

SEQ ID NO: 84509 - DNA, 18 bp, Artificial Sequence
  Synthetic
ggcgaguaucgagcggaa

SEQ ID NO: 84510 - DNA, 28 bp, Artificial Sequence
  Synthetic
tgaagtcaaataaugaagtcccaaguga

SEQ ID NO: 84511 - DNA, 26 bp, Artificial Sequence
  Synthetic
ggctttttguacttgtttgtccucaa

SEQ ID NO: 84512 - DNA, 17 bp, Artificial Sequence
  Synthetic
ccuggcgcagcaucagt

SEQ ID NO: 84513 - DNA, 19 bp, Artificial Sequence
  Synthetic
agctgggagcuaggtccuc

SEQ ID NO: 84514 - DNA, 21 bp, Artificial Sequence
  Synthetic
gcaccctgguagaccaaguct

SEQ ID NO: 84515 - DNA, 27 bp, Artificial Sequence
  Synthetic
gggttaactaccutctccttctugagt

SEQ ID NO: 84516 - DNA, 25 bp, Artificial Sequence
  Synthetic
cctaagaaaaaguctacgccacuga

SEQ ID NO: 84517 - DNA, 28 bp, Artificial Sequence
  Synthetic
gcaactgccuttaacatgtataaucact

SEQ ID NO: 84518 - DNA, 26 bp, Artificial Sequence
  Synthetic
ccttgcattutccattgcatuagagg

SEQ ID NO: 84519 - DNA, 25 bp, Artificial Sequence
  Synthetic
cgtucaaaccaagagcuagagagat

SEQ ID NO: 84520 - DNA, 28 bp, Artificial Sequence
  Synthetic
gtcttgggtagaaucatcttgtctcaut

SEQ ID NO: 84521 - DNA, 31 bp, Artificial Sequence; identical to SEQ ID NO: 59803
  Synthetic

SEQ ID NO: 84522 - DNA, 25 bp, Artificial Sequence
  Synthetic
cccccaaatugaactgaagtcaugt

SEQ ID NO: 84523 - DNA, 20 bp, Artificial Sequence
  Synthetic
gggaggcaccutcaagtguc

SEQ ID NO: 84524 - DNA, 21 bp, Artificial Sequence
  Synthetic
ggcttgtccucttccctccua

SEQ ID NO: 84525 - DNA, 21 bp, Artificial Sequence
  Synthetic
ctcctgcucgatcttctgcug

SEQ ID NO: 84526 - DNA, 21 bp, Artificial Sequence
  Synthetic
cactucagggacttctuggca

SEQ ID NO: 84527 - DNA, 23 bp, Artificial Sequence
  Synthetic
gaaggtcttcgutggaaggguaa

SEQ ID NO: 84528 - DNA, 19 bp, Artificial Sequence
  Synthetic
ccacugcgaaugagcgaat

SEQ ID NO: 84529 - DNA, 19 bp, Artificial Sequence
  Synthetic
ccacgagcagaucgcugac

SEQ ID NO: 84530 - DNA, 22 bp, Artificial Sequence
  Synthetic
gcatcacugagaagcuggagaa

SEQ ID NO: 84531 - DNA, 23 bp, Artificial Sequence
  Synthetic
gcagcaugttuaggaacaaagca

SEQ ID NO: 84532 - DNA, 21 bp, Artificial Sequence
  Synthetic
ccttttccgucagggcaugag

SEQ ID NO: 84533 - DNA, 19 bp, Artificial Sequence
  Synthetic
ctgaccutgcccuggagaa

SEQ ID NO: 84534 - DNA, 21 bp, Artificial Sequence
  Synthetic
tgcutgcagtuccaaacaagg

SEQ ID NO: 84535 - DNA, 28 bp, Artificial Sequence
  Synthetic
tgacttagtggcuctgatgtactuaact

SEQ ID NO: 84536 - DNA, 22 bp, Artificial Sequence
  Synthetic
ccaagaaacugaccctgagcut

SEQ ID NO: 84537 - DNA, 25 bp, Artificial Sequence
  Synthetic
acttttcucccacttcattttugcc

SEQ ID NO: 84538 - DNA, 19 bp, Artificial Sequence
  Synthetic
gccagcagucagcctacut

SEQ ID NO: 84539 - DNA, 27 bp, Artificial Sequence
  Synthetic
cctccaaauactgagacttugaacaca

SEQ ID NO: 84540 - DNA, 21 bp, Artificial Sequence
  Synthetic
cgcatcucaagctctgctcug

SEQ ID NO: 84541 - DNA, 21 bp, Artificial Sequence
  Synthetic
cagatgggcaaugagcuggaa

SEQ ID NO: 84542 - DNA, 28 bp, Artificial Sequence
  Synthetic
gcttcacggguataagaatcttctgaut

SEQ ID NO: 84543 - DNA, 26 bp, Artificial Sequence
  Synthetic
caaaatggtutgtagcaguggaaagg

SEQ ID NO: 84544 - DNA, 17 bp, Artificial Sequence
  Synthetic
tgccccuggctcuccat

SEQ ID NO: 84545 - DNA, 18 bp, Artificial Sequence
  Synthetic
cccgaguggcuggaagag

SEQ ID NO: 84546 - DNA, 22 bp, Artificial Sequence
  Synthetic
tgtttgcatguctgagggaugt

SEQ ID NO: 84547 - DNA, 21 bp, Artificial Sequence
  Synthetic
ctggucttcttcucagagcct

SEQ ID NO: 84548 - DNA, 26 bp, Artificial Sequence
  Synthetic
tgtccatcgtcutgcaagtaaaaaug

SEQ ID NO: 84549 - DNA, 28 bp, Artificial Sequence
  Synthetic
aatccacccttuggtttgtattgtauct

SEQ ID NO: 84550 - DNA, 19 bp, Artificial Sequence
  Synthetic
cagaacuggcgtccctgut

SEQ ID NO: 84551 - DNA, 22 bp, Artificial Sequence
  Synthetic
cactcugcaggaaaagauggct

SEQ ID NO: 84552 - DNA, 18 bp, Artificial Sequence
  Synthetic
cutcugcagggagccaga

SEQ ID NO: 84553 - DNA, 17 bp, Artificial Sequence
  Synthetic
gccccacucacctgcut

SEQ ID NO: 84554 - DNA, 22 bp, Artificial Sequence
  Synthetic
gcatcttgagcuctgcgatcug

SEQ ID NO: 84555 - DNA, 21 bp, Artificial Sequence
  Synthetic
cccttccugaagagcacctug

SEQ ID NO: 84556 - DNA, 18 bp, Artificial Sequence
  Synthetic
cgtcctgcugcagtgcut

SEQ ID NO: 84557 - DNA, 18 bp, Artificial Sequence
  Synthetic
aggcucagctcugaggga

SEQ ID NO: 84558 - DNA, 23 bp, Artificial Sequence
  Synthetic
cgtccttccuctccaaccaaaug

SEQ ID NO: 84559 - DNA, 21 bp, Artificial Sequence
  Synthetic
ctttctguggctgtgagguct

SEQ ID NO: 84560 - DNA, 21 bp, Artificial Sequence
  Synthetic
gccccaugtctcagacucaag

SEQ ID NO: 84561 - DNA, 25 bp, Artificial Sequence
  Synthetic
ggtcttgcugacattctttccctut

SEQ ID NO: 84562 - DNA, 21 bp, Artificial Sequence
  Synthetic
tgugcaagaaccgtacucagg

SEQ ID NO: 84563 - DNA, 25 bp, Artificial Sequence
  Synthetic
tgaaggacaaagcugatttcugcat

SEQ ID NO: 84564 - DNA, 25 bp, Artificial Sequence
  Synthetic
ccctcttcuttaaggtcaucaagga

SEQ ID NO: 84565 - DNA, 22 bp, Artificial Sequence
  Synthetic
tgaucgucaaggccagagaaac

SEQ ID NO: 84566 - DNA, 17 bp, Artificial Sequence
  Synthetic
ctcctcacgguggcgut

SEQ ID NO: 84567 - DNA, 20 bp, Artificial Sequence
  Synthetic
gcguggcaggagaagttcut

SEQ ID NO: 84568 - DNA, 25 bp, Artificial Sequence
  Synthetic
gtatgtgctgutgtcacatgtugat

SEQ ID NO: 84569 - DNA, 27 bp, Artificial Sequence
  Synthetic
caagtagucccaccagttagaaguaga

SEQ ID NO: 84570 - DNA, 21 bp, Artificial Sequence
  Synthetic
gccugcgugaaagaagcagat

SEQ ID NO: 84571 - DNA, 22 bp, Artificial Sequence
  Synthetic
ggaggaccucatcaacucacac

SEQ ID NO: 84572 - DNA, 18 bp, Artificial Sequence
  Synthetic
ggccaccuctttgcuggt

SEQ ID NO: 84573 - DNA, 21 bp, Artificial Sequence
  Synthetic
ccacagcgagcuccagauaag

SEQ ID NO: 84574 - DNA, 20 bp, Artificial Sequence
  Synthetic
ggaatgccgugggtcucaaa

SEQ ID NO: 84575 - DNA, 20 bp, Artificial Sequence
  Synthetic
gagcccuggagggaacttuc

SEQ ID NO: 84576 - DNA, 20 bp, Artificial Sequence
  Synthetic
ccttgccggcauagtggaua

SEQ ID NO: 84577 - DNA, 19 bp, Artificial Sequence
  Synthetic
ggacgaggagugctggtuc

SEQ ID NO: 84578 - DNA, 20 bp, Artificial Sequence
  Synthetic
ccaggtcauctacggcgtug

SEQ ID NO: 84579 - DNA, 18 bp, Artificial Sequence
  Synthetic
cctgagccuctccctgut

SEQ ID NO: 84580 - DNA, 21 bp, Artificial Sequence
  Synthetic
cgcutggtggtuggcaaaaag

SEQ ID NO: 84581 - DNA, 26 bp, Artificial Sequence
  Synthetic
cctgttgucaggaaaagucaaacaag

SEQ ID NO: 84582 - DNA, 18 bp, Artificial Sequence
  Synthetic
ggagagggccugctctut

SEQ ID NO: 84583 - DNA, 17 bp, Artificial Sequence
  Synthetic
tcugctcugcgggagga

SEQ ID NO: 84584 - DNA, 22 bp, Artificial Sequence
  Synthetic
ctucccacctguaaagcagact

SEQ ID NO: 84585 - DNA, 28 bp, Artificial Sequence
  Synthetic
catttctcttcaugtgttttcctugaca

SEQ ID NO: 84586 - DNA, 19 bp, Artificial Sequence
  Synthetic
cgctgttuctcagccucct

SEQ ID NO: 84587 - DNA, 19 bp, Artificial Sequence
  Synthetic
gttgaagcggcuggtgaug

SEQ ID NO: 84588 - DNA, 19 bp, Artificial Sequence
  Synthetic
ccacgaagcucttgucggt

SEQ ID NO: 84589 - DNA, 19 bp, Artificial Sequence
  Synthetic
tctgatguccgggcttugg

SEQ ID NO: 84590 - DNA, 22 bp, Artificial Sequence
  Synthetic
agcttcuggctcttctcugact

SEQ ID NO: 84591 - DNA, 25 bp, Artificial Sequence
  Synthetic
gaaaaatagccucatcagcagctug

SEQ ID NO: 84592 - DNA, 28 bp, Artificial Sequence
  Synthetic
ctttaggagtcugctttaagtacucaca

SEQ ID NO: 84593 - DNA, 23 bp, Artificial Sequence
  Synthetic
tggaaagcaccagacuaaauggg

SEQ ID NO: 84594 - DNA, 24 bp, Artificial Sequence
  Synthetic
gcgaggcaaauagaccttaaacuc

SEQ ID NO: 84595 - DNA, 28 bp, Artificial Sequence
  Synthetic
gctatctactttgucttttctgtgcuca

SEQ ID NO: 84596 - DNA, 21 bp, Artificial Sequence
  Synthetic
ctcttccugcccacaucagat

SEQ ID NO: 84597 - DNA, 22 bp, Artificial Sequence
  Synthetic
tgtgtgguacgctggatucaag

SEQ ID NO: 84598 - DNA, 22 bp, Artificial Sequence
  Synthetic
ccagcaaucagctttgcctuag

SEQ ID NO: 84599 - DNA, 26 bp, Artificial Sequence
  Synthetic
actaggctgutccctttgattuacag

SEQ ID NO: 84600 - DNA, 19 bp, Artificial Sequence
  Synthetic
gggacgucugaacggaagt

SEQ ID NO: 84601 - DNA, 19 bp, Artificial Sequence
  Synthetic
tgaaacugcgccatcguca

SEQ ID NO: 84602 - DNA, 20 bp, Artificial Sequence
  Synthetic
ctggcgautcaggauggaca

SEQ ID NO: 84603 - DNA, 21 bp, Artificial Sequence
  Synthetic
ctuccgcaccaagguacaaga

SEQ ID NO: 84604 - DNA, 23 bp, Artificial Sequence
  Synthetic
acutggcatgguacagagcaaat

SEQ ID NO: 84605 - DNA, 22 bp, Artificial Sequence
  Synthetic
ggctgtcagugttggagagtua

SEQ ID NO: 84606 - DNA, 26 bp, Artificial Sequence
  Synthetic
ctgtgtctgtaguacaagggaactut

SEQ ID NO: 84607 - DNA, 24 bp, Artificial Sequence
  Synthetic
cacgtgaagcuattggtgaaugac

SEQ ID NO: 84608 - DNA, 19 bp, Artificial Sequence
  Synthetic
gccaccucacgtuccacat

SEQ ID NO: 84609 - DNA, 22 bp, Artificial Sequence
  Synthetic
gcatccccautcctttcatcug

SEQ ID NO: 84610 - DNA, 22 bp, Artificial Sequence
  Synthetic
ccacccacuactatctgcccut

SEQ ID NO: 84611 - DNA, 21 bp, Artificial Sequence
  Synthetic
cctattgugacgtgcccaaug

SEQ ID NO: 84612 - DNA, 28 bp, Artificial Sequence
  Synthetic
gctatattaatcucactgacctccucct

SEQ ID NO: 84613 - DNA, 19 bp, Artificial Sequence
  Synthetic
tggaatgcugcctgcugat

SEQ ID NO: 84614 - DNA, 22 bp, Artificial Sequence
  Synthetic
cctgaagacaggugcaaaguca

SEQ ID NO: 84615 - DNA, 22 bp, Artificial Sequence
  Synthetic
tcttccatugagctgcuccaac

SEQ ID NO: 84616 - DNA, 21 bp, Artificial Sequence
  Synthetic
catgcaugagaagggcatguc

SEQ ID NO: 84617 - DNA, 24 bp, Artificial Sequence
  Synthetic
ggacuctggagtaugacaaacaca

SEQ ID NO: 84618 - DNA, 19 bp, Artificial Sequence
  Synthetic
gcggtagaugcggtgctut

SEQ ID NO: 84619 - DNA, 17 bp, Artificial Sequence
  Synthetic
ctggccgaggccutgut

SEQ ID NO: 84620 - DNA, 28 bp, Artificial Sequence
  Synthetic
gggaatgcgtuttagatacaaatgugaa

SEQ ID NO: 84621 - DNA, 25 bp, Artificial Sequence
  Synthetic
tgagauagacacagaagaaggguct

SEQ ID NO: 84622 - DNA, 22 bp, Artificial Sequence
  Synthetic
tgtgcacaugtttttgttuggg

SEQ ID NO: 84623 - DNA, 27 bp, Artificial Sequence
  Synthetic
ctcattccaaccutgatgtgtuaaact

SEQ ID NO: 84624 - DNA, 22 bp, Artificial Sequence
  Synthetic
caccaacugaauccaccaccat

SEQ ID NO: 84625 - DNA, 28 bp, Artificial Sequence
  Synthetic
agccattaacuggccatacaattatgut

SEQ ID NO: 84626 - DNA, 18 bp, Artificial Sequence
  Synthetic
cgcugagtgaugccaaca

SEQ ID NO: 84627 - DNA, 20 bp, Artificial Sequence
  Synthetic
ccgttgaggutcttcgccut

SEQ ID NO: 84628 - DNA, 21 bp, Artificial Sequence
  Synthetic
gtctcccucctgttugcacat

SEQ ID NO: 84629 - DNA, 27 bp, Artificial Sequence
  Synthetic
agaaactactguaaacctggtgttugt

SEQ ID NO: 84630 - DNA, 26 bp, Artificial Sequence
  Synthetic
aagtgagtcatcuctgttctcctaut

SEQ ID NO: 84631 - DNA, 24 bp, Artificial Sequence
  Synthetic
ggcaattcagcucgactagaaucc

SEQ ID NO: 84632 - DNA, 20 bp, Artificial Sequence
  Synthetic
gagccucgcggtcgaauaat

SEQ ID NO: 84633 - DNA, 21 bp, Artificial Sequence
  Synthetic
tutatttgcagcucggagcct

SEQ ID NO: 84634 - DNA, 21 bp, Artificial Sequence
  Synthetic
cgagcauagcaggtactguga

SEQ ID NO: 84635 - DNA, 29 bp, Artificial Sequence
  Synthetic
aggaatcaatgtucttgtaatgtgacuga

SEQ ID NO: 84636 - DNA, 23 bp, Artificial Sequence
  Synthetic
ccagcctugccacatcaactuat

SEQ ID NO: 84637 - DNA, 22 bp, Artificial Sequence
  Synthetic
ggaaaugcagacaatgcctuca

SEQ ID NO: 84638 - DNA, 22 bp, Artificial Sequence
  Synthetic
ggccttgcaguaaaaggagcut

SEQ ID NO: 84639 - DNA, 22 bp, Artificial Sequence
  Synthetic
tccgttgggutttctctuccag

SEQ ID NO: 84640 - DNA, 28 bp, Artificial Sequence
  Synthetic
tttactatgtggtutcccatctggtuac

SEQ ID NO: 84641 - DNA, 23 bp, Artificial Sequence
  Synthetic
ggcttccuaaggcgtttcttcuc

SEQ ID NO: 84642 - DNA, 25 bp, Artificial Sequence
  Synthetic
cagcutatguagccaaagaacacaa

SEQ ID NO: 84643 - DNA, 22 bp, Artificial Sequence
  Synthetic
cttccgcuaacagcatgttguc

SEQ ID NO: 84644 - DNA, 22 bp, Artificial Sequence
  Synthetic
aaggcctgtugcttggaacaua

SEQ ID NO: 84645 - DNA, 23 bp, Artificial Sequence
  Synthetic
cagucacaaccaaggagtctugt

SEQ ID NO: 84646 - DNA, 21 bp, Artificial Sequence
  Synthetic
cccatagugagtgctcctuga

SEQ ID NO: 84647 - DNA, 23 bp, Artificial Sequence
  Synthetic
tcgugtattuggacgagaagcag

SEQ ID NO: 84648 - DNA, 22 bp, Artificial Sequence
  Synthetic
gaggcugctatgucacaagaga

SEQ ID NO: 84649 - DNA, 21 bp, Artificial Sequence
  Synthetic
gtatgtacaccccugcctcug

SEQ ID NO: 84650 - DNA, 25 bp, Artificial Sequence
  Synthetic
tgttatatauagccagacccgugga

SEQ ID NO: 84651 - DNA, 28 bp, Artificial Sequence
  Synthetic
ttctggtgtugaaagactagugaaagag

SEQ ID NO: 84652 - DNA, 22 bp, Artificial Sequence
  Synthetic
gatcgaacugctcgtucaggaa

SEQ ID NO: 84653 - DNA, 20 bp, Artificial Sequence
  Synthetic
gcccagugaccctcctaugt

SEQ ID NO: 84654 - DNA, 21 bp, Artificial Sequence
  Synthetic
cagaggcugagccatagacug

SEQ ID NO: 84655 - DNA, 22 bp, Artificial Sequence
  Synthetic
tcctcccagcugatctgaagut

SEQ ID NO: 84656 - DNA, 27 bp, Artificial Sequence
  Synthetic
gattaattgggaaucttggctacugga

SEQ ID NO: 84657 - DNA, 25 bp, Artificial Sequence
  Synthetic
gcactaacuaccaggctacactuac

SEQ ID NO: 84658 - DNA, 19 bp, Artificial Sequence
  Synthetic
cacagacccccagcugaug

SEQ ID NO: 84659 - DNA, 25 bp, Artificial Sequence
  Synthetic
ctgtgagagtutggctctgtaauct

SEQ ID NO: 84660 - DNA, 23 bp, Artificial Sequence
  Synthetic
ctggctguacctcgatggtuaag

SEQ ID NO: 84661 - DNA, 21 bp, Artificial Sequence
  Synthetic
cttgagaggcuctggctctug

SEQ ID NO: 84662 - DNA, 22 bp, Artificial Sequence
  Synthetic
ttccaaagugtgaugcagacca

SEQ ID NO: 84663 - DNA, 25 bp, Artificial Sequence
  Synthetic
ggaagcaguccttgttacaatguga

SEQ ID NO: 84664 - DNA, 23 bp, Artificial Sequence
  Synthetic
atcatctttuagctgtgcgguca

SEQ ID NO: 84665 - DNA, 25 bp, Artificial Sequence
  Synthetic
ggaccagugaaagtttgctgaaaut

SEQ ID NO: 84666 - DNA, 24 bp, Artificial Sequence
  Synthetic
gatggctccugcactcttcattua

SEQ ID NO: 84667 - DNA, 21 bp, Artificial Sequence
  Synthetic
gaaaagtgccauctcgctucc

SEQ ID NO: 84668 - DNA, 25 bp, Artificial Sequence
  Synthetic
agccattgcuccacttaacucaaat

SEQ ID NO: 84669 - DNA, 27 bp, Artificial Sequence
  Synthetic
ttggctaccagaugttctactacagua

SEQ ID NO: 84670 - DNA, 25 bp, Artificial Sequence
  Synthetic
cagcuccagactttcuaaacacaac

SEQ ID NO: 84671 - DNA, 23 bp, Artificial Sequence
  Synthetic
aagcacaaagugaacatuggcat

SEQ ID NO: 84672 - DNA, 17 bp, Artificial Sequence
  Synthetic
ccugcaggguccccaga

SEQ ID NO: 84673 - DNA, 18 bp, Artificial Sequence
  Synthetic
acctggcugtggcugaag

SEQ ID NO: 84674 - DNA, 23 bp, Artificial Sequence
  Synthetic
tcagacaacucagtggagcatuc

SEQ ID NO: 84675 - DNA, 22 bp, Artificial Sequence
  Synthetic
gcttccuccaccctttccuaaa

SEQ ID NO: 84676 - DNA, 19 bp, Artificial Sequence
  Synthetic
tgcaggtuggtgggaacug

SEQ ID NO: 84677 - DNA, 17 bp, Artificial Sequence
  Synthetic
ggcgugcactgctucct

SEQ ID NO: 84678 - DNA, 19 bp, Artificial Sequence
  Synthetic
gtcaugaccgcgttctugt

SEQ ID NO: 84679 - DNA, 20 bp, Artificial Sequence
  Synthetic
ggttgacguactcgccctuc

SEQ ID NO: 84680 - DNA, 22 bp, Artificial Sequence
  Synthetic
cagtatcaucaaggccaugggt

SEQ ID NO: 84681 - DNA, 21 bp, Artificial Sequence
  Synthetic
agcaggttuctgtggcaauca

SEQ ID NO: 84682 - DNA, 21 bp, Artificial Sequence
  Synthetic
cagaagcaggugttcctuggt

SEQ ID NO: 84683 - DNA, 25 bp, Artificial Sequence
  Synthetic
tgagcaggaagaugaagtacucaga

SEQ ID NO: 84684 - DNA, 25 bp, Artificial Sequence
  Synthetic
tcttttgcttguccctgatttucct

SEQ ID NO: 84685 - DNA, 29 bp, Artificial Sequence
  Synthetic
gggtaaagtgatuagggcagatgatacua

SEQ ID NO: 84686 - DNA, 18 bp, Artificial Sequence
  Synthetic
tgtggcugtggctgugag

SEQ ID NO: 84687 - DNA, 20 bp, Artificial Sequence
  Synthetic
cgtctgcaaggugagccaua

SEQ ID NO: 84688 - DNA, 22 bp, Artificial Sequence
  Synthetic
cggtgcaaggugtgactgauaa

SEQ ID NO: 84689 - DNA, 29 bp, Artificial Sequence
  Synthetic
gttgctctgcautagaaaccaatattuga

SEQ ID NO: 84690 - DNA, 20 bp, Artificial Sequence
  Synthetic
actggucccacggtcauaca

SEQ ID NO: 84691 - DNA, 21 bp, Artificial Sequence
  Synthetic
gggcagaagaaggucagcaua

SEQ ID NO: 84692 - DNA, 22 bp, Artificial Sequence
  Synthetic
gctgggucaaagatcctugcat

SEQ ID NO: 84693 - DNA, 28 bp, Artificial Sequence
  Synthetic
agaaatgattucttaccttcugagcaca

SEQ ID NO: 84694 - DNA, 26 bp, Artificial Sequence
  Synthetic
catgttaatgtuagctggtgcttugt

SEQ ID NO: 84695 - DNA, 31 bp, Artificial Sequence; identical to SEQ ID NO: 34327
  Synthetic

SEQ ID NO: 84696 - DNA, 21 bp, Artificial Sequence
  Synthetic
gctgcugaaaacctucaacga

SEQ ID NO: 84697 - DNA, 20 bp, Artificial Sequence
  Synthetic
ccttccttcucctcgaccug

SEQ ID NO: 84698 - DNA, 22 bp, Artificial Sequence
  Synthetic
caaagcugaaaacctgtugcga

SEQ ID NO: 84699 - DNA, 23 bp, Artificial Sequence
  Synthetic
gcccccaaaacucaatgaaugaa

SEQ ID NO: 84700 - DNA, 20 bp, Artificial Sequence
  Synthetic
catcccgggacuggtctauc

SEQ ID NO: 84701 - DNA, 27 bp, Artificial Sequence
  Synthetic
attatgtaaccugagaggagtauccgt

SEQ ID NO: 84702 - DNA, 20 bp, Artificial Sequence
  Synthetic
ggcctccugactgacugact

SEQ ID NO: 84703 - DNA, 22 bp, Artificial Sequence
  Synthetic
ccttcagaagagcuccttuccc

SEQ ID NO: 84704 - DNA, 24 bp, Artificial Sequence
  Synthetic
gutcattuacaagcaccagcagaa

SEQ ID NO: 84705 - DNA, 19 bp, Artificial Sequence
  Synthetic
gagagacgcguccaguacc

SEQ ID NO: 84706 - DNA, 26 bp, Artificial Sequence
  Synthetic
ctgaaacucaaaagcctgaaaugact

SEQ ID NO: 84707 - DNA, 23 bp, Artificial Sequence
  Synthetic
tggatgugaagacgcaatcuagg

SEQ ID NO: 84708 - DNA, 18 bp, Artificial Sequence
  Synthetic
gggcctucagctcctuct

SEQ ID NO: 84709 - DNA, 19 bp, Artificial Sequence
  Synthetic
cctgacccuaggcctgtug

SEQ ID NO: 84710 - DNA, 26 bp, Artificial Sequence
  Synthetic
ttaaaccugccataacttucccaaga

SEQ ID NO: 84711 - DNA, 28 bp, Artificial Sequence
  Synthetic
agttacaactagaugaagagacagguga

SEQ ID NO: 84712 - DNA, 23 bp, Artificial Sequence
  Synthetic
gcagtgagcugcctttttcttuc

SEQ ID NO: 84713 - DNA, 23 bp, Artificial Sequence
  Synthetic
gcttuccagaagcaagtcuccat

SEQ ID NO: 84714 - DNA, 28 bp, Artificial Sequence
  Synthetic
aatttacaaaacugtaccagaucccaca

SEQ ID NO: 84715 - DNA, 27 bp, Artificial Sequence
  Synthetic
tgacaccagtugacaatagaagatgua

SEQ ID NO: 84716 - DNA, 26 bp, Artificial Sequence
  Synthetic
catacctagcugagtcacugacaaat

SEQ ID NO: 84717 - DNA, 26 bp, Artificial Sequence
  Synthetic
ctgttacctagtutagtcatggccut

SEQ ID NO: 84718 - DNA, 25 bp, Artificial Sequence
  Synthetic
gggccttccauatgatctgauaacc

SEQ ID NO: 84719 - DNA, 21 bp, Artificial Sequence
  Synthetic
gtuccccaaacccttgugaga

SEQ ID NO: 84720 - DNA, 21 bp, Artificial Sequence
  Synthetic
tggcattgutggaggagucag

SEQ ID NO: 84721 - DNA, 28 bp, Artificial Sequence
  Synthetic
tgaaaaactgaggugcttaaggaguaaa

SEQ ID NO: 84722 - DNA, 22 bp, Artificial Sequence
  Synthetic
ggcuggctgaatugggagaaat

SEQ ID NO: 84723 - DNA, 28 bp, Artificial Sequence
  Synthetic
ggaaagaguatgagcuggaaaaacagaa

SEQ ID NO: 84724 - DNA, 22 bp, Artificial Sequence
  Synthetic
gacucttugcaaacagcagcat

SEQ ID NO: 84725 - DNA, 26 bp, Artificial Sequence
  Synthetic
tcagagaacauccttgggauaaggaa

SEQ ID NO: 84726 - DNA, 28 bp, Artificial Sequence
  Synthetic
tggagttgttcutgtctttcctttucaa

SEQ ID NO: 84727 - DNA, 29 bp, Artificial Sequence
  Synthetic
tttgattgacatacuttggaggcaagaua

SEQ ID NO: 84728 - DNA, 29 bp, Artificial Sequence
  Synthetic
gtcaaatactuctcgacttacuccaagat

SEQ ID NO: 84729 - DNA, 21 bp, Artificial Sequence
  Synthetic
cccactucccaccaucaacag

SEQ ID NO: 84730 - DNA, 21 bp, Artificial Sequence
  Synthetic
agtgctugcagctcacagaut

SEQ ID NO: 84731 - DNA, 22 bp, Artificial Sequence
  Synthetic
gatgtccuggagcagcttttug

SEQ ID NO: 84732 - DNA, 22 bp, Artificial Sequence
  Synthetic
gauttggatacugaggccacca

SEQ ID NO: 84733 - DNA, 24 bp, Artificial Sequence
  Synthetic
ctctctucagacgaaaggucaact

SEQ ID NO: 84734 - DNA, 19 bp, Artificial Sequence
  Synthetic
cccacguctgcacatcugt

SEQ ID NO: 84735 - DNA, 20 bp, Artificial Sequence
  Synthetic
tctcauccccaccccatcuc

SEQ ID NO: 84736 - DNA, 22 bp, Artificial Sequence
  Synthetic
cccugaagaacctgaguggagt

SEQ ID NO: 84737 - DNA, 23 bp, Artificial Sequence
  Synthetic
ctcaccctggauctcttttccut

SEQ ID NO: 84738 - DNA, 24 bp, Artificial Sequence
  Synthetic
ccttttagaugtcctccttugcct

SEQ ID NO: 84739 - DNA, 22 bp, Artificial Sequence
  Synthetic
cagtuccccaaccactcatuca

SEQ ID NO: 84740 - DNA, 20 bp, Artificial Sequence
  Synthetic
tgccggaaagcaugucagat

SEQ ID NO: 84741 - DNA, 21 bp, Artificial Sequence
  Synthetic
gctccguggagtttgacaugg

SEQ ID NO: 84742 - DNA, 21 bp, Artificial Sequence
  Synthetic
ggctatggguttgcacaguga

SEQ ID NO: 84743 - DNA, 23 bp, Artificial Sequence
  Synthetic
cguagcaagagaggaaaccucag

SEQ ID NO: 84744 - DNA, 20 bp, Artificial Sequence
  Synthetic
catggaguccaccagctuga

SEQ ID NO: 84745 - DNA, 21 bp, Artificial Sequence
  Synthetic
tgttggccacaugtcccttut

SEQ ID NO: 84746 - DNA, 23 bp, Artificial Sequence
  Synthetic
cttttcccugggattctggacut

SEQ ID NO: 84747 - DNA, 22 bp, Artificial Sequence
  Synthetic
cctgtgttcucgtacactgugg

SEQ ID NO: 84748 - DNA, 23 bp, Artificial Sequence
  Synthetic
aggtctttgauttgcgtcagugt

SEQ ID NO: 84749 - DNA, 24 bp, Artificial Sequence
  Synthetic
ggagctatuccacctactgaucct

SEQ ID NO: 84750 - DNA, 19 bp, Artificial Sequence
  Synthetic
cccatgggaucctcaugct

SEQ ID NO: 84751 - DNA, 21 bp, Artificial Sequence
  Synthetic
cgctgacacugtgcttctcuc

SEQ ID NO: 84752 - DNA, 22 bp, Artificial Sequence
  Synthetic
tcagcuctcucaagaggaagca

SEQ ID NO: 84753 - DNA, 21 bp, Artificial Sequence
  Synthetic
agagaaccuctcgagctucca

SEQ ID NO: 84754 - DNA, 18 bp, Artificial Sequence
  Synthetic
gggtgggcugtgagauca

SEQ ID NO: 84755 - DNA, 24 bp, Artificial Sequence
  Synthetic
tcttgagtctugcactccaaucag

SEQ ID NO: 84756 - DNA, 22 bp, Artificial Sequence
  Synthetic
gaucaaccaggagctcauccag

SEQ ID NO: 84757 - DNA, 26 bp, Artificial Sequence
  Synthetic
atctgaaaactutctccacactucca

SEQ ID NO: 84758 - DNA, 22 bp, Artificial Sequence
  Synthetic
ggacctaguggttttggcttug

SEQ ID NO: 84759 - DNA, 21 bp, Artificial Sequence
  Synthetic
caaccaggcucauggcaaaag

SEQ ID NO: 84760 - DNA, 18 bp, Artificial Sequence
  Synthetic
cgagguaggcacgtgcua

SEQ ID NO: 84761 - DNA, 18 bp, Artificial Sequence
  Synthetic
gaaggtguccaggccgut

SEQ ID NO: 84762 - DNA, 20 bp, Artificial Sequence
  Synthetic
gacacctuctccggctucaa

SEQ ID NO: 84763 - DNA, 18 bp, Artificial Sequence
  Synthetic
tguggccagagaggguct

SEQ ID NO: 84764 - DNA, 20 bp, Artificial Sequence
  Synthetic
ctctgaggcuccaggacuca

SEQ ID NO: 84765 - DNA, 18 bp, Artificial Sequence
  Synthetic
cgaugtucgacgggacac

SEQ ID NO: 84766 - DNA, 19 bp, Artificial Sequence
  Synthetic
ctucccggaggccuacaag

SEQ ID NO: 84767 - DNA, 21 bp, Artificial Sequence
  Synthetic
cagaguagcacaucagcacca

SEQ ID NO: 84768 - DNA, 18 bp, Artificial Sequence
  Synthetic
tggtgccugcatgcugat

SEQ ID NO: 84769 - DNA, 18 bp, Artificial Sequence
  Synthetic
tccgcgucgtccttgaug

SEQ ID NO: 84770 - DNA, 18 bp, Artificial Sequence
  Synthetic
cgagcucccctcguggat

SEQ ID NO: 84771 - DNA, 19 bp, Artificial Sequence
  Synthetic
tgggcctcuccagcatgua

SEQ ID NO: 84772 - DNA, 27 bp, Artificial Sequence
  Synthetic
cattctctaggaucgaagctcattuct

SEQ ID NO: 84773 - DNA, 28 bp, Artificial Sequence
  Synthetic
agtgttcagaaugaagtacaagaagcuc

SEQ ID NO: 84774 - DNA, 18 bp, Artificial Sequence
  Synthetic
caucccgcctucccaact

SEQ ID NO: 84775 - DNA, 18 bp, Artificial Sequence
  Synthetic
gacgucacccacgagugt

SEQ ID NO: 84776 - DNA, 17 bp, Artificial Sequence
  Synthetic
gcacuaccuggcaggca

SEQ ID NO: 84777 - DNA, 19 bp, Artificial Sequence
  Synthetic
acaacgaggucggctccua

SEQ ID NO: 84778 - DNA, 17 bp, Artificial Sequence
  Synthetic
gcugcagggcacguagg

SEQ ID NO: 84779 - DNA, 20 bp, Artificial Sequence
  Synthetic
tcaacgaguguggccagaag

SEQ ID NO: 84780 - DNA, 19 bp, Artificial Sequence
  Synthetic
gtaggagccgaccucgtug

SEQ ID NO: 84781 - DNA, 21 bp, Artificial Sequence
  Synthetic
cttcgaggccucctacatcug

SEQ ID NO: 84782 - DNA, 25 bp, Artificial Sequence
  Synthetic
tcagctcugttttagcaaugacagt

SEQ ID NO: 84783 - DNA, 22 bp, Artificial Sequence
  Synthetic
actgcatcgugctttccactua

SEQ ID NO: 84784 - DNA, 20 bp, Artificial Sequence
  Synthetic
tgacgccutcagaagcaucc

SEQ ID NO: 84785 - DNA, 21 bp, Artificial Sequence
  Synthetic
gtacagggcaagutgctccua

SEQ ID NO: 84786 - DNA, 20 bp, Artificial Sequence
  Synthetic
gccacacucgttgacaucct

SEQ ID NO: 84787 - DNA, 20 bp, Artificial Sequence
  Synthetic
gaccctctugtccccttguc

SEQ ID NO: 84788 - DNA, 21 bp, Artificial Sequence
  Synthetic
ggacugacccatucaccacat

SEQ ID NO: 84789 - DNA, 21 bp, Artificial Sequence
  Synthetic
gctcagagucatctggtuggg

SEQ ID NO: 84790 - DNA, 26 bp, Artificial Sequence
  Synthetic
gtgccaatatccguaataaccctgua

SEQ ID NO: 84791 - DNA, 28 bp, Artificial Sequence
  Synthetic
acagttttatggucctttactcacctug

SEQ ID NO: 84792 - DNA, 19 bp, Artificial Sequence
  Synthetic
gcgtcucgtgccuccaaga

SEQ ID NO: 84793 - DNA, 19 bp, Artificial Sequence
  Synthetic
aggctutgctgcugaggac

SEQ ID NO: 84794 - DNA, 19 bp, Artificial Sequence
  Synthetic
cgccttccuacctgctgua

SEQ ID NO: 84795 - DNA, 22 bp, Artificial Sequence
  Synthetic
ctcagctgtcutcggttctcuc

SEQ ID NO: 84796 - DNA, 22 bp, Artificial Sequence
  Synthetic
gaagcctggaguggagaatgut

SEQ ID NO: 84797 - DNA, 24 bp, Artificial Sequence
  Synthetic
ctcacctcccugtcttcttgtcua

SEQ ID NO: 84798 - DNA, 21 bp, Artificial Sequence
  Synthetic
tcttcccucccctcgaaauga

SEQ ID NO: 84799 - DNA, 21 bp, Artificial Sequence
  Synthetic
caccttucagcaggucagaga

SEQ ID NO: 84800 - DNA, 22 bp, Artificial Sequence
  Synthetic
tguttgagaacaucgggaaggg

SEQ ID NO: 84801 - DNA, 24 bp, Artificial Sequence
  Synthetic
ccaacccuacatttcugcacaaaa

SEQ ID NO: 84802 - DNA, 22 bp, Artificial Sequence
  Synthetic
acctttttcuggacctgtuggg

SEQ ID NO: 84803 - DNA, 24 bp, Artificial Sequence
  Synthetic
acacggagaaugauaggagacaca

SEQ ID NO: 84804 - DNA, 23 bp, Artificial Sequence
  Synthetic
actggctacucccaattgtccua

SEQ ID NO: 84805 - DNA, 21 bp, Artificial Sequence
  Synthetic
cctccauccacctcatcagug

SEQ ID NO: 84806 - DNA, 20 bp, Artificial Sequence
  Synthetic
gctguggcgcaggtatagug

SEQ ID NO: 84807 - DNA, 23 bp, Artificial Sequence
  Synthetic
cgguagttcttguagcccacaaa

SEQ ID NO: 84808 - DNA, 18 bp, Artificial Sequence
  Synthetic
ctgcguctgtgggucaga

SEQ ID NO: 84809 - DNA, 17 bp, Artificial Sequence
  Synthetic
ccuggcagaggguacgg

SEQ ID NO: 84810 - DNA, 24 bp, Artificial Sequence
  Synthetic
cttctcacctcutccaagctctut

SEQ ID NO: 84811 - DNA, 20 bp, Artificial Sequence
  Synthetic
gaguaccccaccuaccacac

SEQ ID NO: 84812 - DNA, 21 bp, Artificial Sequence
  Synthetic
ggactuaggctgtgugggaat

SEQ ID NO: 84813 - DNA, 21 bp, Artificial Sequence
  Synthetic
ttgtacuggacgttgaugcca

SEQ ID NO: 84814 - DNA, 20 bp, Artificial Sequence
  Synthetic
gggtgggaautgtcgccuaa

SEQ ID NO: 84815 - DNA, 20 bp, Artificial Sequence
  Synthetic
ggctacgcuaagcaccucag

SEQ ID NO: 84816 - DNA, 21 bp, Artificial Sequence
  Synthetic
cctugggccacaacctagtuc

SEQ ID NO: 84817 - DNA, 23 bp, Artificial Sequence
  Synthetic
gggtctttttguttcaggccauc

SEQ ID NO: 84818 - DNA, 26 bp, Artificial Sequence
  Synthetic
cctccatcauaaccctgtaactgcua

SEQ ID NO: 84819 - DNA, 27 bp, Artificial Sequence
  Synthetic
tgtaacaacagtuccagactgacttug

SEQ ID NO: 84820 - DNA, 19 bp, Artificial Sequence
  Synthetic
gtgagaaugaccgggugga

SEQ ID NO: 84821 - DNA, 20 bp, Artificial Sequence
  Synthetic
cctggaccutgtcucacaga

SEQ ID NO: 84822 - DNA, 22 bp, Artificial Sequence
  Synthetic
tttgcctcuttgttagguggct

SEQ ID NO: 84823 - DNA, 28 bp, Artificial Sequence
  Synthetic
tctgcctctagaugaaaccttgatauct

SEQ ID NO: 84824 - DNA, 22 bp, Artificial Sequence
  Synthetic
ggactctgugagtgggattugt

SEQ ID NO: 84825 - DNA, 25 bp, Artificial Sequence
  Synthetic
cccagtatatttugttgcccaacug

SEQ ID NO: 84826 - DNA, 20 bp, Artificial Sequence
  Synthetic
actuccccaccgagctacua

SEQ ID NO: 84827 - DNA, 24 bp, Artificial Sequence
  Synthetic
atgtgctttccuttccttgttugg

SEQ ID NO: 84828 - DNA, 21 bp, Artificial Sequence
  Synthetic
gtcccaggaacugatgcuaca

SEQ ID NO: 84829 - DNA, 21 bp, Artificial Sequence
  Synthetic
cacgcagcagcaaaguctuac

SEQ ID NO: 84830 - DNA, 22 bp, Artificial Sequence
  Synthetic
ggcccaatcucaccttctcaua

SEQ ID NO: 84831 - DNA, 19 bp, Artificial Sequence
  Synthetic
gugccgccgaaagaacuac

SEQ ID NO: 84832 - DNA, 27 bp, Artificial Sequence
  Synthetic
gaagtcagaugatgaatccucccaaaa

SEQ ID NO: 84833 - DNA, 28 bp, Artificial Sequence
  Synthetic
cagcttctcaaguatgtttacctaugga

SEQ ID NO: 84834 - DNA, 26 bp, Artificial Sequence
  Synthetic
tgtttcacgtaguacacattgctuct

SEQ ID NO: 84835 - DNA, 28 bp, Artificial Sequence
  Synthetic
tgacaatttcttuaacaatggcatccug

SEQ ID NO: 84836 - DNA, 24 bp, Artificial Sequence
  Synthetic
cggttttctuccccttttgctgua

SEQ ID NO: 84837 - DNA, 24 bp, Artificial Sequence
  Synthetic
cttcatttcttugacctcccuggt

SEQ ID NO: 84838 - DNA, 21 bp, Artificial Sequence
  Synthetic
ggaaaacugccaggcatucag

SEQ ID NO: 84839 - DNA, 23 bp, Artificial Sequence
  Synthetic
atgtagtgaagutcggcacacut

SEQ ID NO: 84840 - DNA, 17 bp, Artificial Sequence
  Synthetic
gccugctgccucaggat

SEQ ID NO: 84841 - DNA, 21 bp, Artificial Sequence
  Synthetic
actcttgacgutgtccagcuc

SEQ ID NO: 84842 - DNA, 26 bp, Artificial Sequence
  Synthetic
aacagaataugaagaagcccaggaug

SEQ ID NO: 84843 - DNA, 28 bp, Artificial Sequence
  Synthetic
cttgcgaaaauaacaaaacacactucaa

SEQ ID NO: 84844 - DNA, 23 bp, Artificial Sequence
  Synthetic
agtggaauaggagtgaggugagt

SEQ ID NO: 84845 - DNA, 21 bp, Artificial Sequence
  Synthetic
aaaacaaagagcugcgagcug

SEQ ID NO: 84846 - DNA, 29 bp, Artificial Sequence
  Synthetic
gggatgaaauagaaagtcaaugaggagaa

SEQ ID NO: 84847 - DNA, 21 bp, Artificial Sequence
  Synthetic
acctgagtcucctgctctugt

SEQ ID NO: 84848 - DNA, 25 bp, Artificial Sequence
  Synthetic
acagttccucacagcctgttattuc

SEQ ID NO: 84849 - DNA, 28 bp, Artificial Sequence
  Synthetic
tgctggcaaaauacagaatttuaagcat

SEQ ID NO: 84850 - DNA, 19 bp, Artificial Sequence
  Synthetic
gggagttugccaaggugct

SEQ ID NO: 84851 - DNA, 21 bp, Artificial Sequence
  Synthetic
ccttgctgagcuctgggatuc

SEQ ID NO: 84852 - DNA, 25 bp, Artificial Sequence
  Synthetic
tctctggagagacugaagcauaaga

SEQ ID NO: 84853 - DNA, 23 bp, Artificial Sequence
  Synthetic
ggaggagaauggagaccttucct

SEQ ID NO: 84854 - DNA, 22 bp, Artificial Sequence
  Synthetic
ccacttcagcuaagagcacugt

SEQ ID NO: 84855 - DNA, 17 bp, Artificial Sequence
  Synthetic
cctccgugcgaaucgct

SEQ ID NO: 84856 - DNA, 21 bp, Artificial Sequence
  Synthetic
gtatcccgggcuggaaagaug

SEQ ID NO: 84857 - DNA, 23 bp, Artificial Sequence
  Synthetic
gctggccatugtctatctcatug

SEQ ID NO: 84858 - DNA, 21 bp, Artificial Sequence
  Synthetic
ctgttcagccuccttggtcut

SEQ ID NO: 84859 - DNA, 26 bp, Artificial Sequence
  Synthetic
agaaagccaaaacacautatgaugcc

SEQ ID NO: 84860 - DNA, 25 bp, Artificial Sequence
  Synthetic
ggatccugtttgtgaaugacaccaa

SEQ ID NO: 84861 - DNA, 21 bp, Artificial Sequence
  Synthetic
ccccuccactgtuacaagcag

SEQ ID NO: 84862 - DNA, 22 bp, Artificial Sequence
  Synthetic
gtgccgaacutcactacauggt

SEQ ID NO: 84863 - DNA, 22 bp, Artificial Sequence
  Synthetic
tgcutttcucaaagggcaggag

SEQ ID NO: 84864 - DNA, 28 bp, Artificial Sequence
  Synthetic
aggtttcattgtauctactctcccucaa

SEQ ID NO: 84865 - DNA, 27 bp, Artificial Sequence
  Synthetic
cagttgacataacuactccaaaagcug

SEQ ID NO: 84866 - DNA, 22 bp, Artificial Sequence
  Synthetic
gtctggcuaaccacaugagcat

SEQ ID NO: 84867 - DNA, 23 bp, Artificial Sequence
  Synthetic
ctttctauccaggccactctcug

SEQ ID NO: 84868 - DNA, 21 bp, Artificial Sequence
  Synthetic
ggatgatguggcaggacacuc

SEQ ID NO: 84869 - DNA, 21 bp, Artificial Sequence
  Synthetic
accagtctcutggcaccctua

SEQ ID NO: 84870 - DNA, 20 bp, Artificial Sequence
  Synthetic
aggaaaugcagcgcaucaag

SEQ ID NO: 84871 - DNA, 18 bp, Artificial Sequence
  Synthetic
cctccucgccagtcuggt

SEQ ID NO: 84872 - DNA, 23 bp, Artificial Sequence
  Synthetic
ctttctctttcucccccttcugg

SEQ ID NO: 84873 - DNA, 27 bp, Artificial Sequence
  Synthetic
aatgctttcagtuaaacgtgcttguaa

SEQ ID NO: 84874 - DNA, 22 bp, Artificial Sequence
  Synthetic
gctcttggtuctgctgcttcut

SEQ ID NO: 84875 - DNA, 23 bp, Artificial Sequence
  Synthetic
ctgagcactauaagctgcaggua

SEQ ID NO: 84876 - DNA, 24 bp, Artificial Sequence
  Synthetic
acagtggagautacgaatgtgcug

SEQ ID NO: 84877 - DNA, 25 bp, Artificial Sequence
  Synthetic
tctctguacagggaagagttuccat

SEQ ID NO: 84878 - DNA, 23 bp, Artificial Sequence
  Synthetic
caccacctuaacacccacctuaa

SEQ ID NO: 84879 - DNA, 24 bp, Artificial Sequence
  Synthetic
catactctctuctcactgctuccc

SEQ ID NO: 84880 - DNA, 18 bp, Artificial Sequence
  Synthetic
caagggutcggugggact

SEQ ID NO: 84881 - DNA, 20 bp, Artificial Sequence
  Synthetic
gcagcaugagcacattguca

SEQ ID NO: 84882 - DNA, 21 bp, Artificial Sequence
  Synthetic
ccatgtgtgutcccaagctuc

SEQ ID NO: 84883 - DNA, 24 bp, Artificial Sequence
  Synthetic
gttctcaccccutttgcttcuaac

SEQ ID NO: 84884 - DNA, 20 bp, Artificial Sequence
  Synthetic
caguggcgaacaaatugggt

SEQ ID NO: 84885 - DNA, 28 bp, Artificial Sequence
  Synthetic
agtagcctcaaaauggaaaattcagcua

SEQ ID NO: 84886 - DNA, 20 bp, Artificial Sequence
  Synthetic
gccgcacacuccauagaact

SEQ ID NO: 84887 - DNA, 22 bp, Artificial Sequence
  Synthetic
cctgtgtccugcattgttccua

SEQ ID NO: 84888 - DNA, 28 bp, Artificial Sequence
  Synthetic
tgctctttagcugtaacttgtaaaugct

SEQ ID NO: 84889 - DNA, 26 bp, Artificial Sequence
  Synthetic
gtgtttatgtcugttggtgaaacuga

SEQ ID NO: 84890 - DNA, 24 bp, Artificial Sequence
  Synthetic
cctatccccuctccttttcttgut

SEQ ID NO: 84891 - DNA, 19 bp, Artificial Sequence
  Synthetic
ggtcccggugcacaaaaug

SEQ ID NO: 84892 - DNA, 28 bp, Artificial Sequence
  Synthetic
ctctttccatcuagagttatccuccaca

SEQ ID NO: 84893 - DNA, 20 bp, Artificial Sequence
  Synthetic
tgtgugaggcagcaacguaa

SEQ ID NO: 84894 - DNA, 20 bp, Artificial Sequence
  Synthetic
gtcgcttcauccccctucag

SEQ ID NO: 84895 - DNA, 25 bp, Artificial Sequence
  Synthetic
tgcctaactgucctcttctccauag

SEQ ID NO: 84896 - DNA, 28 bp, Artificial Sequence
  Synthetic
agtcccgatcagauttagaataggauga

SEQ ID NO: 84897 - DNA, 21 bp, Artificial Sequence
  Synthetic
gcgctatuctcggccauacac

SEQ ID NO: 84898 - DNA, 18 bp, Artificial Sequence
  Synthetic
gtgtaccuggcgggtcug

SEQ ID NO: 84899 - DNA, 24 bp, Artificial Sequence
  Synthetic
acggtaatagucggtgctguagat

SEQ ID NO: 84900 - DNA, 20 bp, Artificial Sequence
  Synthetic
ggcaguaccagcagtucacc

SEQ ID NO: 84901 - DNA, 24 bp, Artificial Sequence
  Synthetic
gggtcacugaaagtccacaaacut

SEQ ID NO: 84902 - DNA, 28 bp, Artificial Sequence
  Synthetic
tcggatgatcucagatttttaagcctuc

SEQ ID NO: 84903 - DNA, 22 bp, Artificial Sequence
  Synthetic
auctatcgaugggacccagaca

SEQ ID NO: 84904 - DNA, 21 bp, Artificial Sequence
  Synthetic
gggaggaaguttgctgucgag

SEQ ID NO: 84905 - DNA, 23 bp, Artificial Sequence
  Synthetic
cccggttaguctctgacctucat

SEQ ID NO: 84906 - DNA, 22 bp, Artificial Sequence
  Synthetic
cgagatggaugccatgatuccc

SEQ ID NO: 84907 - DNA, 20 bp, Artificial Sequence
  Synthetic
tgtgaacgcgguaaactgut

SEQ ID NO: 84908 - DNA, 28 bp, Artificial Sequence
  Synthetic
tgttactttugacaggacttuagcagaa

SEQ ID NO: 84909 - DNA, 18 bp, Artificial Sequence
  Synthetic
gtggccgaugtccgttug

SEQ ID NO: 84910 - DNA, 19 bp, Artificial Sequence
  Synthetic
ggacaucggccacaaaguc

SEQ ID NO: 84911 - DNA, 29 bp, Artificial Sequence
  Synthetic
ggagaattcttattugccattatgtgcut

SEQ ID NO: 84912 - DNA, 25 bp, Artificial Sequence
  Synthetic
agaactctcucgtgctctgttauct

SEQ ID NO: 84913 - DNA, 28 bp, Artificial Sequence
  Synthetic
cctattccaggucagaacgatctcatua

SEQ ID NO: 84914 - DNA, 26 bp, Artificial Sequence
  Synthetic
cctcaaatgguggtgatttctccaua

SEQ ID NO: 84915 - DNA, 23 bp, Artificial Sequence
  Synthetic
gaaaggaucttgcatucgccaat

SEQ ID NO: 84916 - DNA, 22 bp, Artificial Sequence
  Synthetic
tgautttggcaugagcagggat

SEQ ID NO: 84917 - DNA, 22 bp, Artificial Sequence
  Synthetic
accagagccagugaatcucaga

SEQ ID NO: 84918 - DNA, 21 bp, Artificial Sequence
  Synthetic
ggtaacgcutgcttctccugt

SEQ ID NO: 84919 - DNA, 21 bp, Artificial Sequence
  Synthetic
gctccccucaaaactccauca

SEQ ID NO: 84920 - DNA, 22 bp, Artificial Sequence
  Synthetic
tgtctccaugttcccatcucca

SEQ ID NO: 84921 - DNA, 21 bp, Artificial Sequence
  Synthetic
gggcctuctcacttguaacca

SEQ ID NO: 84922 - DNA, 24 bp, Artificial Sequence
  Synthetic
tggtagcgacgaucagagtcauaa

SEQ ID NO: 84923 - DNA, 26 bp, Artificial Sequence
  Synthetic
actcggtatgtaucttcccgatguag

SEQ ID NO: 84924 - DNA, 23 bp, Artificial Sequence
  Synthetic
catatgagguttgtcuccagcct

SEQ ID NO: 84925 - DNA, 28 bp, Artificial Sequence
  Synthetic
gtgccagcaaaauggaattatcttguat

SEQ ID NO: 84926 - DNA, 22 bp, Artificial Sequence
  Synthetic
gggaggctautctgcccattug

SEQ ID NO: 84927 - DNA, 21 bp, Artificial Sequence
  Synthetic
gcaagtggacutcggtgctua

SEQ ID NO: 84928 - DNA, 22 bp, Artificial Sequence
  Synthetic
ctgaccuggtatggtcauggaa

SEQ ID NO: 84929 - DNA, 22 bp, Artificial Sequence
  Synthetic
tgatgacatgugggtggtugac

SEQ ID NO: 84930 - DNA, 25 bp, Artificial Sequence
  Synthetic
gaaacaggaauccauagcagaacca

SEQ ID NO: 84931 - DNA, 24 bp, Artificial Sequence
  Synthetic
gtgaaagacacauctgaagcucct

SEQ ID NO: 84932 - DNA, 24 bp, Artificial Sequence
  Synthetic
caatgtgaagcugtgagcaaatuc

SEQ ID NO: 84933 - DNA, 22 bp, Artificial Sequence
  Synthetic
gccatttcugtcaccgtuccat

SEQ ID NO: 84934 - DNA, 21 bp, Artificial Sequence
  Synthetic
ctatgcugcagctgtuaccca

SEQ ID NO: 84935 - DNA, 22 bp, Artificial Sequence
  Synthetic
ctttctcucctgcccucacaag

SEQ ID NO: 84936 - DNA, 20 bp, Artificial Sequence
  Synthetic
gccgtcgcuctctttcugat

SEQ ID NO: 84937 - DNA, 28 bp, Artificial Sequence
  Synthetic
agagattttaaaaagagcucagcaccut

SEQ ID NO: 84938 - DNA, 19 bp, Artificial Sequence
  Synthetic
cctuacgcggctcauggac

SEQ ID NO: 84939 - DNA, 22 bp, Artificial Sequence
  Synthetic
gccctgaauccatgaggcatuc

SEQ ID NO: 84940 - DNA, 22 bp, Artificial Sequence
  Synthetic
cagagtucaacgtccugaagca

SEQ ID NO: 84941 - DNA, 21 bp, Artificial Sequence
  Synthetic
ggagaacagggcugtauggag

SEQ ID NO: 84942 - DNA, 26 bp, Artificial Sequence
  Synthetic
tttttcatcagaacugctaggagcut

SEQ ID NO: 84943 - DNA, 28 bp, Artificial Sequence
  Synthetic
ggacatcaugcacaatttctttatucct

SEQ ID NO: 84944 - DNA, 20 bp, Artificial Sequence
  Synthetic
caggccaucatcctgacgut

SEQ ID NO: 84945 - DNA, 28 bp, Artificial Sequence
  Synthetic
ccggaaaggauatattttctgcttcuct

SEQ ID NO: 84946 - DNA, 28 bp, Artificial Sequence
  Synthetic
gaaggtttcccuagatcctcacttttua

SEQ ID NO: 84947 - DNA, 25 bp, Artificial Sequence
  Synthetic
tgaaggcauctttcttggtucagaa

SEQ ID NO: 84948 - DNA, 22 bp, Artificial Sequence
  Synthetic
ccctggcutcctcagaaaucat

SEQ ID NO: 84949 - DNA, 19 bp, Artificial Sequence
  Synthetic
ggccagacgauaccccuga

SEQ ID NO: 84950 - DNA, 27 bp, Artificial Sequence
  Synthetic
agaagtccguacagaatcttcaucaga

SEQ ID NO: 84951 - DNA, 28 bp, Artificial Sequence
  Synthetic
gggaaggaugaagaaattccagatagut

SEQ ID NO: 84952 - DNA, 24 bp, Artificial Sequence
  Synthetic
gctgguggatgtgttauacaacga

SEQ ID NO: 84953 - DNA, 21 bp, Artificial Sequence
  Synthetic
cgtgtgccaguctcctucaag

SEQ ID NO: 84954 - DNA, 21 bp, Artificial Sequence
  Synthetic
ggcctagugacagcaacctug

SEQ ID NO: 84955 - DNA, 24 bp, Artificial Sequence
  Synthetic
cgatggaattguggcctactctua

SEQ ID NO: 84956 - DNA, 27 bp, Artificial Sequence
  Synthetic
gcaaggagaagucaaacagtcatauct

SEQ ID NO: 84957 - DNA, 28 bp, Artificial Sequence
  Synthetic
gtagcttuaaaaacagcatgtaccaugt

SEQ ID NO: 84958 - DNA, 19 bp, Artificial Sequence
  Synthetic
cgauccgcgccagaatcuc

SEQ ID NO: 84959 - DNA, 23 bp, Artificial Sequence
  Synthetic
gggagaagcaaagugctatucct

SEQ ID NO: 84960 - DNA, 27 bp, Artificial Sequence
  Synthetic
cagcaaccaautgaaaataaaauggga

SEQ ID NO: 84961 - DNA, 24 bp, Artificial Sequence
  Synthetic
gcggttatcutctcgagtuaaggt

SEQ ID NO: 84962 - DNA, 29 bp, Artificial Sequence
  Synthetic
caaccagcattucacttagtcttctcuat

SEQ ID NO: 84963 - DNA, 21 bp, Artificial Sequence
  Synthetic
catcctgcugctctcagtgut

SEQ ID NO: 84964 - DNA, 18 bp, Artificial Sequence
  Synthetic
gggtgcuggctgtccuat

SEQ ID NO: 84965 - DNA, 17 bp, Artificial Sequence
  Synthetic
cgtcgcugtctcgctug

SEQ ID NO: 84966 - DNA, 19 bp, Artificial Sequence
  Synthetic
gggacagcagcucaacuca

SEQ ID NO: 84967 - DNA, 25 bp, Artificial Sequence
  Synthetic
gggtaaaaugaccaggcttctctut

SEQ ID NO: 84968 - DNA, 25 bp, Artificial Sequence
  Synthetic
aggttccacauagacgtaatcucca

SEQ ID NO: 84969 - DNA, 25 bp, Artificial Sequence
  Synthetic
ccctttggtgaguacctttttccut

SEQ ID NO: 84970 - DNA, 23 bp, Artificial Sequence
  Synthetic
caggcagctauagaggagtcgua

SEQ ID NO: 84971 - DNA, 24 bp, Artificial Sequence
  Synthetic
gtcttctggagutctctcccguat

SEQ ID NO: 84972 - DNA, 25 bp, Artificial Sequence
  Synthetic
gtgtgcugaagtgttttaugcagaa

SEQ ID NO: 84973 - DNA, 23 bp, Artificial Sequence
  Synthetic
tcauccggacaaaaguacagcag

SEQ ID NO: 84974 - DNA, 23 bp, Artificial Sequence
  Synthetic
ggcagaagaaaucaucacggaag

SEQ ID NO: 84975 - DNA, 20 bp, Artificial Sequence
  Synthetic
tggtgaggtugggtgggtua

SEQ ID NO: 84976 - DNA, 17 bp, Artificial Sequence
  Synthetic
cgccugccgagaaacuc

SEQ ID NO: 84977 - DNA, 21 bp, Artificial Sequence
  Synthetic
gtgcagagucagagugcagat

SEQ ID NO: 84978 - DNA, 28 bp, Artificial Sequence
  Synthetic
aggtatctctcucggtgtatttctcuac

SEQ ID NO: 84979 - DNA, 26 bp, Artificial Sequence
  Synthetic
atcatguccccagaaaatccagtuac

SEQ ID NO: 84980 - DNA, 29 bp, Artificial Sequence
  Synthetic
caagaaccccaucaatcaatcaauagaat

SEQ ID NO: 84981 - DNA, 24 bp, Artificial Sequence
  Synthetic
aaggaaacagggagcucaatucaa

SEQ ID NO: 84982 - DNA, 22 bp, Artificial Sequence
  Synthetic
cctatgctgugactggaagcug

SEQ ID NO: 84983 - DNA, 26 bp, Artificial Sequence
  Synthetic
cttgggtatgagutttctggttguct

SEQ ID NO: 84984 - DNA, 28 bp, Artificial Sequence
  Synthetic
ggaaugaagtuacacaaaacaacagcaa

SEQ ID NO: 84985 - DNA, 21 bp, Artificial Sequence
  Synthetic
cttctctuaaggcaggcugct

SEQ ID NO: 84986 - DNA, 21 bp, Artificial Sequence
  Synthetic
ccagttucaggccggtatuct

SEQ ID NO: 84987 - DNA, 26 bp, Artificial Sequence
  Synthetic
gccaacagauaaaacatctcgttgut

SEQ ID NO: 84988 - DNA, 26 bp, Artificial Sequence
  Synthetic
gtttuagagaggaacctuaaccccaa

SEQ ID NO: 84989 - DNA, 21 bp, Artificial Sequence
  Synthetic
ccgtactuacctggctgaugt

SEQ ID NO: 84990 - DNA, 28 bp, Artificial Sequence
  Synthetic
ttcatgtttttcuccctatcaggttugt

SEQ ID NO: 84991 - DNA, 24 bp, Artificial Sequence
  Synthetic
cccagattugatcttggctuccat

SEQ ID NO: 84992 - DNA, 24 bp, Artificial Sequence
  Synthetic
caaggcgatcugggctctttatua

SEQ ID NO: 84993 - DNA, 29 bp, Artificial Sequence
  Synthetic
ctttctggtcttauatatgaagcgcttut

SEQ ID NO: 84994 - DNA, 19 bp, Artificial Sequence
  Synthetic
ggtgggcaugggaacucaa

SEQ ID NO: 84995 - DNA, 19 bp, Artificial Sequence
  Synthetic
acagtccccguttcccuca

SEQ ID NO: 84996 - DNA, 28 bp, Artificial Sequence
  Synthetic
gttacttacctccucatcgattttguct

SEQ ID NO: 84997 - DNA, 26 bp, Artificial Sequence
  Synthetic
caagaauttguggacaaggaggagaa

SEQ ID NO: 84998 - DNA, 23 bp, Artificial Sequence
  Synthetic
gcaataugcggaaagctgugaag

SEQ ID NO: 84999 - DNA, 21 bp, Artificial Sequence
  Synthetic
gtcgaugagggctttguggat

SEQ ID NO: 85000 - DNA, 21 bp, Artificial Sequence
  Synthetic
gaguttggcuccaaggaagga

SEQ ID NO: 85001 - DNA, 27 bp, Artificial Sequence
  Synthetic
tcttttccacugcccttatcttatgug

SEQ ID NO: 85002 - DNA, 20 bp, Artificial Sequence
  Synthetic
tcuacccgacaucccccaat

SEQ ID NO: 85003 - DNA, 20 bp, Artificial Sequence
  Synthetic
gtgtcttggcuccaccguag

SEQ ID NO: 85004 - DNA, 27 bp, Artificial Sequence
  Synthetic
tggtatttcacuaattcctcaauggca

SEQ ID NO: 85005 - DNA, 28 bp, Artificial Sequence
  Synthetic
tctgcatccagugatttgtatctuacag

SEQ ID NO: 85006 - DNA, 19 bp, Artificial Sequence
  Synthetic
gcagacucccggugaggat

SEQ ID NO: 85007 - DNA, 17 bp, Artificial Sequence
  Synthetic
gcauggccagctcuggt

SEQ ID NO: 85008 - DNA, 20 bp, Artificial Sequence
  Synthetic
cacttugaagcccucaggga

SEQ ID NO: 85009 - DNA, 18 bp, Artificial Sequence
  Synthetic
cgcagcugcacttcaugt

SEQ ID NO: 85010 - DNA, 20 bp, Artificial Sequence
  Synthetic
ctctgcccuaggacctgcua

SEQ ID NO: 85011 - DNA, 24 bp, Artificial Sequence
  Synthetic
agatgccauggaaagctctcauac

SEQ ID NO: 85012 - DNA, 33 bp, Artificial Sequence
  Synthetic
tgcttaaaaattaataugttcatctgcaaaaug

SEQ ID NO: 85013 - DNA, 24 bp, Artificial Sequence
  Synthetic
atttgacggcucctctactgttut

SEQ ID NO: 85014 - DNA, 30 bp, Artificial Sequence
  Synthetic
attttctttctctaggugaagctgtactuc

SEQ ID NO: 85015 - DNA, 28 bp, Artificial Sequence
  Synthetic
atcagagtcaguggtgtcagaatatcua

SEQ ID NO: 85016 - DNA, 21 bp, Artificial Sequence
  Synthetic
cttccaccaggguaggucaaa

SEQ ID NO: 85017 - DNA, 25 bp, Artificial Sequence
  Synthetic
ccgtaagggugaactaggaaactug

SEQ ID NO: 85018 - DNA, 23 bp, Artificial Sequence
  Synthetic
ctatcccatucctgtccccatut

SEQ ID NO: 85019 - DNA, 18 bp, Artificial Sequence
  Synthetic
gcaggcagcaggucagug

SEQ ID NO: 85020 - DNA, 21 bp, Artificial Sequence
  Synthetic
gatcgaugcaggaccaugaga

SEQ ID NO: 85021 - DNA, 21 bp, Artificial Sequence
  Synthetic
ggcucuggacaagaccaagag

SEQ ID NO: 85022 - DNA, 19 bp, Artificial Sequence
  Synthetic
gatgagcugcctggcctua

SEQ ID NO: 85023 - DNA, 19 bp, Artificial Sequence
  Synthetic
caggcucaaggacctgcuc

SEQ ID NO: 85024 - DNA, 26 bp, Artificial Sequence
  Synthetic
ctgagttguatctagttguggcacat

SEQ ID NO: 85025 - DNA, 22 bp, Artificial Sequence
  Synthetic
gggcautattacaguccaccag

SEQ ID NO: 85026 - DNA, 22 bp, Artificial Sequence
  Synthetic
ccttatgctcucacacacgtug

SEQ ID NO: 85027 - DNA, 26 bp, Artificial Sequence
  Synthetic
tcagacttgaaaugggtgagaugaag

SEQ ID NO: 85028 - DNA, 24 bp, Artificial Sequence
  Synthetic
gttttgucctcagttucgggagat

SEQ ID NO: 85029 - DNA, 23 bp, Artificial Sequence
  Synthetic
gagcuaucacccaggcaaaagaa

SEQ ID NO: 85030 - DNA, 23 bp, Artificial Sequence
  Synthetic
tgcccttccucttcctcaaagua

SEQ ID NO: 85031 - DNA, 20 bp, Artificial Sequence
  Synthetic
ccgcagugatcagctcugac

SEQ ID NO: 85032 - DNA, 20 bp, Artificial Sequence
  Synthetic
ctgcccugacctttctcgut

SEQ ID NO: 85033 - DNA, 22 bp, Artificial Sequence
  Synthetic
ggaccttcutaccaggguaggg

SEQ ID NO: 85034 - DNA, 25 bp, Artificial Sequence
  Synthetic
gatgtttttaaucgacaggcaccut

SEQ ID NO: 85035 - DNA, 28 bp, Artificial Sequence
  Synthetic
catactgtctccuacatctgctagaaug

SEQ ID NO: 85036 - DNA, 27 bp, Artificial Sequence
  Synthetic
aggcaccttcutactgagatacguaat

SEQ ID NO: 85037 - DNA, 28 bp, Artificial Sequence
  Synthetic
agccaaattgttgucttaaaagagcauc

SEQ ID NO: 85038 - DNA, 23 bp, Artificial Sequence
  Synthetic
tgcgatgaugacagaggttctug

SEQ ID NO: 85039 - DNA, 24 bp, Artificial Sequence
  Synthetic
gcagagatuaccaggttccauagg

SEQ ID NO: 85040 - DNA, 26 bp, Artificial Sequence
  Synthetic
aaaagtgaaatgcugtgcaaatcuca

SEQ ID NO: 85041 - DNA, 20 bp, Artificial Sequence
  Synthetic
guggacaccaggtcuacgaa

SEQ ID NO: 85042 - DNA, 22 bp, Artificial Sequence
  Synthetic
ctcacattccucgaagccctua

SEQ ID NO: 85043 - DNA, 28 bp, Artificial Sequence
  Synthetic
acuacttcccuaaagagaaaacacacac

SEQ ID NO: 85044 - DNA, 22 bp, Artificial Sequence
  Synthetic
gatttaugacgacggcctcuca

SEQ ID NO: 85045 - DNA, 23 bp, Artificial Sequence
  Synthetic
gagaggaaggauagugcaaaggg

SEQ ID NO: 85046 - DNA, 21 bp, Artificial Sequence
  Synthetic
gcugactgagcucaccacaaa

SEQ ID NO: 85047 - DNA, 22 bp, Artificial Sequence
  Synthetic
gagcctaacaucagacgcucaa

SEQ ID NO: 85048 - DNA, 22 bp, Artificial Sequence
  Synthetic
caatgtccaggaucccgaugaa

SEQ ID NO: 85049 - DNA, 22 bp, Artificial Sequence
  Synthetic
ccuttgtatcugacaccacgct

SEQ ID NO: 85050 - DNA, 20 bp, Artificial Sequence
  Synthetic
ccucccctgtucacggagat

SEQ ID NO: 85051 - DNA, 28 bp, Artificial Sequence
  Synthetic
gcttttacttctgauaagctccaatgug

SEQ ID NO: 85052 - DNA, 17 bp, Artificial Sequence
  Synthetic
gcggcuagctcugcact

SEQ ID NO: 85053 - DNA, 23 bp, Artificial Sequence
  Synthetic
gaagtccgaaaugatcccaucca

SEQ ID NO: 85054 - DNA, 25 bp, Artificial Sequence
  Synthetic
cagtgcgtutttcataaagguccat

SEQ ID NO: 85055 - DNA, 26 bp, Artificial Sequence
  Synthetic
gtgactttugggaagatgucaagaaa

SEQ ID NO: 85056 - DNA, 21 bp, Artificial Sequence
  Synthetic
aagcacauggtcaccauggat

SEQ ID NO: 85057 - DNA, 20 bp, Artificial Sequence
  Synthetic
cgacacugccgttgatgtug

SEQ ID NO: 85058 - DNA, 20 bp, Artificial Sequence
  Synthetic
tccatccccugtccgauacc

SEQ ID NO: 85059 - DNA, 20 bp, Artificial Sequence
  Synthetic
agccugaaggagcuagacct

SEQ ID NO: 85060 - DNA, 27 bp, Artificial Sequence
  Synthetic
actcatcuccctttaatttuggcacat

SEQ ID NO: 85061 - DNA, 25 bp, Artificial Sequence
  Synthetic
tggatctuggcacaatgauaacagg

SEQ ID NO: 85062 - DNA, 24 bp, Artificial Sequence
  Synthetic
tggactctaagaucaacacccugt

SEQ ID NO: 85063 - DNA, 28 bp, Artificial Sequence
  Synthetic
catcaaccatccutctccagatacatut

SEQ ID NO: 85064 - DNA, 21 bp, Artificial Sequence
  Synthetic
cagctcacugcgggatcttua

SEQ ID NO: 85065 - DNA, 20 bp, Artificial Sequence
  Synthetic
ctgtcuccaggcatcctugt

SEQ ID NO: 85066 - DNA, 23 bp, Artificial Sequence
  Synthetic
gaguacttucacagacagaggca

SEQ ID NO: 85067 - DNA, 23 bp, Artificial Sequence
  Synthetic
tgacacgagggauttaggacuct

SEQ ID NO: 85068 - DNA, 22 bp, Artificial Sequence
  Synthetic
caacgtcauccaggttgttcug

SEQ ID NO: 85069 - DNA, 20 bp, Artificial Sequence
  Synthetic
ccugaagagcgagccctuag

SEQ ID NO: 85070 - DNA, 19 bp, Artificial Sequence
  Synthetic
ggtggauggtggtctgugt

SEQ ID NO: 85071 - DNA, 18 bp, Artificial Sequence
  Synthetic
gccagguatccagccugt

SEQ ID NO: 85072 - DNA, 19 bp, Artificial Sequence
  Synthetic
aggugggacaggctggaua

SEQ ID NO: 85073 - DNA, 17 bp, Artificial Sequence
  Synthetic
gccauctccgugggcag

SEQ ID NO: 85074 - DNA, 26 bp, Artificial Sequence
  Synthetic
tcccatattuccagtgaaugaaagca

SEQ ID NO: 85075 - DNA, 22 bp, Artificial Sequence
  Synthetic
acgttucggaccgtatttcugt

SEQ ID NO: 85076 - DNA, 20 bp, Artificial Sequence
  Synthetic
cacgtguaccccagtucagt

SEQ ID NO: 85077 - DNA, 28 bp, Artificial Sequence
  Synthetic
cgtcttaaatacuggtaaggtcttugga

SEQ ID NO: 85078 - DNA, 22 bp, Artificial Sequence
  Synthetic
cttgcttcugagccttcctuga

SEQ ID NO: 85079 - DNA, 23 bp, Artificial Sequence
  Synthetic
gctggttgaccucttgtccatut

SEQ ID NO: 85080 - DNA, 24 bp, Artificial Sequence
  Synthetic
ccgcggcuttgtattcatuaaaca

SEQ ID NO: 85081 - DNA, 20 bp, Artificial Sequence
  Synthetic
ctgatgcacgutggcttcuc

SEQ ID NO: 85082 - DNA, 17 bp, Artificial Sequence
  Synthetic
gtgctguccgggucagt

SEQ ID NO: 85083 - DNA, 19 bp, Artificial Sequence
  Synthetic
gccaggugtggtuccagaa

SEQ ID NO: 85084 - DNA, 27 bp, Artificial Sequence
  Synthetic
acataguagagagggacucaacaaaca

SEQ ID NO: 85085 - DNA, 21 bp, Artificial Sequence
  Synthetic
ctcttgtggugccacatcgua

SEQ ID NO: 85086 - DNA, 21 bp, Artificial Sequence
  Synthetic
gatacagggcaagcucaggut

SEQ ID NO: 85087 - DNA, 24 bp, Artificial Sequence
  Synthetic
cauttctcuacaggaggcagaagg

SEQ ID NO: 85088 - DNA, 28 bp, Artificial Sequence
  Synthetic
gtgtttatctgaaggugatagagctugt

SEQ ID NO: 85089 - DNA, 27 bp, Artificial Sequence
  Synthetic
ttctgtccaggaggutttcttaactuc

SEQ ID NO: 85090 - DNA, 25 bp, Artificial Sequence
  Synthetic
tgaattgctucagcaaatccaucag

SEQ ID NO: 85091 - DNA, 28 bp, Artificial Sequence
  Synthetic
tgtggtgttttguttgttaactctgtut

SEQ ID NO: 85092 - DNA, 21 bp, Artificial Sequence
  Synthetic
cggcagatgugcaacagttuc

SEQ ID NO: 85093 - DNA, 25 bp, Artificial Sequence
  Synthetic
ggcuaggttuacaggaagaaagcaa

SEQ ID NO: 85094 - DNA, 23 bp, Artificial Sequence
  Synthetic
atgacattcaucggcttccauct

SEQ ID NO: 85095 - DNA, 25 bp, Artificial Sequence
  Synthetic
tgtgtctgggcaguttatcaaaguc

SEQ ID NO: 85096 - DNA, 20 bp, Artificial Sequence
  Synthetic
tgcactgcugtatggagcug

SEQ ID NO: 85097 - DNA, 25 bp, Artificial Sequence
  Synthetic
aatgtaggagucagtctucccagat

SEQ ID NO: 85098 - DNA, 25 bp, Artificial Sequence
  Synthetic
cattgaaagagugaccgtagagcut

SEQ ID NO: 85099 - DNA, 28 bp, Artificial Sequence
  Synthetic
gtcattgcaagaacagutgaatgtagut

SEQ ID NO: 85100 - DNA, 21 bp, Artificial Sequence
  Synthetic
cacagccaucccccacaauaa

SEQ ID NO: 85101 - DNA, 22 bp, Artificial Sequence
  Synthetic
tcaacttgacgcuggtgaaugt

SEQ ID NO: 85102 - DNA, 20 bp, Artificial Sequence
  Synthetic
ctcctgcutgcgaaactugg

SEQ ID NO: 85103 - DNA, 24 bp, Artificial Sequence
  Synthetic
agggtgtuaaaacaagccgaagua

SEQ ID NO: 85104 - DNA, 18 bp, Artificial Sequence
  Synthetic
gcuatggcuggcaagggt

SEQ ID NO: 85105 - DNA, 17 bp, Artificial Sequence
  Synthetic
gccccuccaguccacaa

SEQ ID NO: 85106 - DNA, 26 bp, Artificial Sequence
  Synthetic
gaugagaaaaaucaagacccgagaca

SEQ ID NO: 85107 - DNA, 21 bp, Artificial Sequence
  Synthetic
tcagcagaugguccagcaaaa

SEQ ID NO: 85108 - DNA, 25 bp, Artificial Sequence
  Synthetic
ctcucagggtttcaugaggaaaaca

SEQ ID NO: 85109 - DNA, 24 bp, Artificial Sequence
  Synthetic
atctctcucggtgtgattttugct

SEQ ID NO: 85110 - DNA, 23 bp, Artificial Sequence
  Synthetic
cccaattcucctcttctucacga

SEQ ID NO: 85111 - DNA, 22 bp, Artificial Sequence
  Synthetic
tgattacuggcaaggcaauggt

SEQ ID NO: 85112 - DNA, 21 bp, Artificial Sequence
  Synthetic
ccttugcagacaccccugaag

SEQ ID NO: 85113 - DNA, 22 bp, Artificial Sequence
  Synthetic
ctaactcttuggcccctctgug

SEQ ID NO: 85114 - DNA, 23 bp, Artificial Sequence
  Synthetic
acacaaugaggguacagggagaa

SEQ ID NO: 85115 - DNA, 21 bp, Artificial Sequence
  Synthetic
agaagcggaugctggaaucag

SEQ ID NO: 85116 - DNA, 22 bp, Artificial Sequence
  Synthetic
caagtgaagacugtggcaucca

SEQ ID NO: 85117 - DNA, 21 bp, Artificial Sequence
  Synthetic
gcctgaguaacctgctcucct

SEQ ID NO: 85118 - DNA, 28 bp, Artificial Sequence
  Synthetic
aggcaggcgautatctatttgttttcua

SEQ ID NO: 85119 - DNA, 28 bp, Artificial Sequence
  Synthetic
gagtcaaggagacauttgtaugaggaaa

SEQ ID NO: 85120 - DNA, 23 bp, Artificial Sequence
  Synthetic
ggtggcauaaccacttgaaucca

SEQ ID NO: 85121 - DNA, 23 bp, Artificial Sequence
  Synthetic
ctccctcautcttcccgaucaat

SEQ ID NO: 85122 - DNA, 20 bp, Artificial Sequence
  Synthetic
cagagggugcccttcaaugt

SEQ ID NO: 85123 - DNA, 24 bp, Artificial Sequence
  Synthetic
cgcatctcgauggcaaggatttua

SEQ ID NO: 85124 - DNA, 22 bp, Artificial Sequence
  Synthetic
cagtttcauccctttgctugga

SEQ ID NO: 85125 - DNA, 22 bp, Artificial Sequence
  Synthetic
gggaagguggcttcttcttgut

SEQ ID NO: 85126 - DNA, 21 bp, Artificial Sequence
  Synthetic
gggagttcugcagcgaaacut

SEQ ID NO: 85127 - DNA, 25 bp, Artificial Sequence
  Synthetic
ctctgaccaggaugggtttatuacc

SEQ ID NO: 85128 - DNA, 21 bp, Artificial Sequence
  Synthetic
caacaccggcucttctttuga

SEQ ID NO: 85129 - DNA, 20 bp, Artificial Sequence
  Synthetic
ggcuacagaggacccccuac

SEQ ID NO: 85130 - DNA, 21 bp, Artificial Sequence
  Synthetic
gcacaggaggaagugccaaua

SEQ ID NO: 85131 - DNA, 27 bp, Artificial Sequence
  Synthetic
tcucaggataaaattuggccaagaagt

SEQ ID NO: 85132 - DNA, 21 bp, Artificial Sequence
  Synthetic
aagccattgucctcactcguc

SEQ ID NO: 85133 - DNA, 26 bp, Artificial Sequence
  Synthetic
gccatccttguagaagctatctgaut

SEQ ID NO: 85134 - DNA, 26 bp, Artificial Sequence
  Synthetic
ggagaggacauaagggtcattcauct

SEQ ID NO: 85135 - DNA, 22 bp, Artificial Sequence
  Synthetic
ccctgaccuctccaagaaggua

SEQ ID NO: 85136 - DNA, 26 bp, Artificial Sequence
  Synthetic
caacaagctgagguatgtgactacut

SEQ ID NO: 85137 - DNA, 29 bp, Artificial Sequence
  Synthetic
tcatctgaggtaauatcacagcatcuagt

SEQ ID NO: 85138 - DNA, 24 bp, Artificial Sequence
  Synthetic
ttcctaaggutgcacauaggcaaa

SEQ ID NO: 85139 - DNA, 27 bp, Artificial Sequence
  Synthetic
cccagcttcuctgtctaagtaguaact

SEQ ID NO: 85140 - DNA, 22 bp, Artificial Sequence
  Synthetic
gaagggttuctgtccccaucaa

SEQ ID NO: 85141 - DNA, 20 bp, Artificial Sequence
  Synthetic
gagtcaccccagucggatuc

SEQ ID NO: 85142 - DNA, 23 bp, Artificial Sequence
  Synthetic
aaccaacacaacaucagcgttut

SEQ ID NO: 85143 - DNA, 27 bp, Artificial Sequence
  Synthetic
ttcggtttcacuttttacttcaggtug

SEQ ID NO: 85144 - DNA, 29 bp, Artificial Sequence
  Synthetic
ggacaggcttuacttgctatacttucaaa

SEQ ID NO: 85145 - DNA, 24 bp, Artificial Sequence
  Synthetic
ctttgcccauggaagaaacaaguc

SEQ ID NO: 85146 - DNA, 21 bp, Artificial Sequence
  Synthetic
agtcacctuggccactttcut

SEQ ID NO: 85147 - DNA, 26 bp, Artificial Sequence
  Synthetic
caccttatgttcugtgttgtcaccua

SEQ ID NO: 85148 - DNA, 28 bp, Artificial Sequence
  Synthetic
ggaaacatcautctttgggatuaacact

SEQ ID NO: 85149 - DNA, 24 bp, Artificial Sequence
  Synthetic
cctgttcauacagccataccucac

SEQ ID NO: 85150 - DNA, 28 bp, Artificial Sequence
  Synthetic
cactaagagacgutgattttgttgtuga

SEQ ID NO: 85151 - DNA, 27 bp, Artificial Sequence
  Synthetic
agagtgcttutgatggaactugaagaa

SEQ ID NO: 85152 - DNA, 23 bp, Artificial Sequence
  Synthetic
acgaattacguggttacccctug

SEQ ID NO: 85153 - DNA, 25 bp, Artificial Sequence
  Synthetic
atttgaggcaguacaagtugaaggt

SEQ ID NO: 85154 - DNA, 28 bp, Artificial Sequence
  Synthetic
gccttcagattgugaggatttcttctua

SEQ ID NO: 85155 - DNA, 28 bp, Artificial Sequence
  Synthetic
gaatgagcaagcagauatttccucaaaa

SEQ ID NO: 85156 - DNA, 28 bp, Artificial Sequence
  Synthetic
tggaatttcttcauccttcccaataugg

SEQ ID NO: 85157 - DNA, 26 bp, Artificial Sequence
  Synthetic
agaagcagatacuaagcaggacacua

SEQ ID NO: 85158 - DNA, 31 bp, Artificial Sequence
  Synthetic
gaagtaggacauaaatccatcatactugaca

SEQ ID NO: 85159 - DNA, 25 bp, Artificial Sequence
  Synthetic
ccttcaattccuacacctgccttut

SEQ ID NO: 85160 - DNA, 20 bp, Artificial Sequence
  Synthetic
accacgcgguctttguacag

SEQ ID NO: 85161 - DNA, 28 bp, Artificial Sequence
  Synthetic
cacccagauttcaattctttugacaaca

SEQ ID NO: 85162 - DNA, 22 bp, Artificial Sequence
  Synthetic
ggtctgggutgagguacaaagg

SEQ ID NO: 85163 - DNA, 26 bp, Artificial Sequence
  Synthetic
tggaagccacaauatgacatuacgat

SEQ ID NO: 85164 - DNA, 22 bp, Artificial Sequence
  Synthetic
agcucacaaccgacaataugct

SEQ ID NO: 85165 - DNA, 22 bp, Artificial Sequence
  Synthetic
ccgcaggucgctaaggaattua

SEQ ID NO: 85166 - DNA, 28 bp, Artificial Sequence
  Synthetic
tgaggaaatatcugcttgctcatucaat

SEQ ID NO: 85167 - DNA, 26 bp, Artificial Sequence
  Synthetic
accagtacccutaccagtagatguag

SEQ ID NO: 85168 - DNA, 26 bp, Artificial Sequence
  Synthetic
cccagggatuaaaaatgttgctugaa

SEQ ID NO: 85169 - DNA, 27 bp, Artificial Sequence
  Synthetic
caacatctgucaactccacaaaatuct

SEQ ID NO: 85170 - DNA, 21 bp, Artificial Sequence
  Synthetic
ccttccucggttagggucgat

SEQ ID NO: 85171 - DNA, 22 bp, Artificial Sequence
  Synthetic
agcatcatcagcucagacctuc

SEQ ID NO: 85172 - DNA, 28 bp, Artificial Sequence
  Synthetic
cagtggaaacttcuacgtgactttgaua

SEQ ID NO: 85173 - DNA, 33 bp, Artificial Sequence; identical to SEQ ID NO: 63355
  Synthetic

SEQ ID NO: 85174 - DNA, 21 bp, Artificial Sequence
  Synthetic
ctttcuctccaaguccagcgt

SEQ ID NO: 85175 - DNA, 19 bp, Artificial Sequence
  Synthetic
gcagccugctgtcgtcaua

SEQ ID NO: 85176 - DNA, 28 bp, Artificial Sequence
  Synthetic
ggtaacttucactgataccaugacaagg

SEQ ID NO: 85177 - DNA, 28 bp, Artificial Sequence
  Synthetic
ctcttcttgtutagatgtctcugggaaa

SEQ ID NO: 85178 - DNA, 25 bp, Artificial Sequence
  Synthetic
tcaaaggaagaaccagucaccttuc

SEQ ID NO: 85179 - DNA, 21 bp, Artificial Sequence
  Synthetic
actccugggcaagttctcuca

SEQ ID NO: 85180 - DNA, 26 bp, Artificial Sequence
  Synthetic
tggactcugcaaataggacattucaa

SEQ ID NO: 85181 - DNA, 28 bp, Artificial Sequence
  Synthetic
cacccaaaagaauagtcaaugaacaaca

SEQ ID NO: 85182 - DNA, 21 bp, Artificial Sequence
  Synthetic
cccattgauggagtaggugga

SEQ ID NO: 85183 - DNA, 23 bp, Artificial Sequence
  Synthetic
agtccccagcucaactgtaacua

SEQ ID NO: 85184 - DNA, 28 bp, Artificial Sequence
  Synthetic
attggtggttctutcagagatctaacug

SEQ ID NO: 85185 - DNA, 22 bp, Artificial Sequence
  Synthetic
ctctcaucaccagcaccaguaa

SEQ ID NO: 85186 - DNA, 25 bp, Artificial Sequence
  Synthetic
gtctacctgatcutggatcccagua

SEQ ID NO: 85187 - DNA, 26 bp, Artificial Sequence
  Synthetic
ctcagaaactuaggttgggacttcuc

SEQ ID NO: 85188 - DNA, 21 bp, Artificial Sequence
  Synthetic
agggaguaacacugagaccgt

SEQ ID NO: 85189 - DNA, 20 bp, Artificial Sequence
  Synthetic
ggtgtggcugaagcagtcut

SEQ ID NO: 85190 - DNA, 22 bp, Artificial Sequence
  Synthetic
tgacugcuccgagaagaacaag

SEQ ID NO: 85191 - DNA, 28 bp, Artificial Sequence
  Synthetic
gtgattcagaagauacagattcggauga

SEQ ID NO: 85192 - DNA, 25 bp, Artificial Sequence
  Synthetic
cuagatctgtaacuacgagggacca

SEQ ID NO: 85193 - DNA, 18 bp, Artificial Sequence
  Synthetic
aggcguagagggcaccua

SEQ ID NO: 85194 - DNA, 23 bp, Artificial Sequence
  Synthetic
ctccagcattucctgtttcacug

SEQ ID NO: 85195 - DNA, 23 bp, Artificial Sequence
  Synthetic
aaggucaccacgaacttctugaa

SEQ ID NO: 85196 - DNA, 22 bp, Artificial Sequence
  Synthetic
accccatttcuaccaccagcua

SEQ ID NO: 85197 - DNA, 29 bp, Artificial Sequence
  Synthetic
cgctgacatttgutttatactgtgttgut

SEQ ID NO: 85198 - DNA, 28 bp, Artificial Sequence
  Synthetic
tcctccaagtugcaatatagcttgatut

SEQ ID NO: 85199 - DNA, 23 bp, Artificial Sequence
  Synthetic
aattgccatcuctgcaactcuga

SEQ ID NO: 85200 - DNA, 23 bp, Artificial Sequence
  Synthetic
ggtgtgugtgtggctucaaaaac

SEQ ID NO: 85201 - DNA, 27 bp, Artificial Sequence
  Synthetic
agacattttacaucatcatctgcugct

SEQ ID NO: 85202 - DNA, 24 bp, Artificial Sequence
  Synthetic
gtcaccuggaatgtctuagaagcc

SEQ ID NO: 85203 - DNA, 24 bp, Artificial Sequence
  Synthetic
attctagccaugcagtcacctuac

SEQ ID NO: 85204 - DNA, 20 bp, Artificial Sequence
  Synthetic
ccctgaccagacuccacuga

SEQ ID NO: 85205 - DNA, 23 bp, Artificial Sequence
  Synthetic
gtaaaggcggaugaaguaggact

SEQ ID NO: 85206 - DNA, 25 bp, Artificial Sequence
  Synthetic
gagacggtttcutggaatactgcua

SEQ ID NO: 85207 - DNA, 25 bp, Artificial Sequence
  Synthetic
catggaagacagugatggtguaact

SEQ ID NO: 85208 - DNA, 25 bp, Artificial Sequence
  Synthetic
actccagagaaguttgcagattucc

SEQ ID NO: 85209 - DNA, 20 bp, Artificial Sequence
  Synthetic
actctctugcgctgauggac

SEQ ID NO: 85210 - DNA, 24 bp, Artificial Sequence
  Synthetic
ctgttatuggtgtatguggcaagg

SEQ ID NO: 85211 - DNA, 21 bp, Artificial Sequence
  Synthetic
caccuactcaugcagcaccat

SEQ ID NO: 85212 - DNA, 24 bp, Artificial Sequence
  Synthetic
cctacaggaagcuatcctctgcut

SEQ ID NO: 85213 - DNA, 22 bp, Artificial Sequence
  Synthetic
tcctcaaccauctcctgugaca

SEQ ID NO: 85214 - DNA, 21 bp, Artificial Sequence
  Synthetic
gaaagaggcauctccaggcut

SEQ ID NO: 85215 - DNA, 21 bp, Artificial Sequence
  Synthetic
cattggcaccacugagtctuc

SEQ ID NO: 85216 - DNA, 22 bp, Artificial Sequence
  Synthetic
gctgugggaaaaccaggctuat

SEQ ID NO: 85217 - DNA, 22 bp, Artificial Sequence
  Synthetic
attttcagccuccctgactcug

SEQ ID NO: 85218 - DNA, 18 bp, Artificial Sequence
  Synthetic
gctctggcuctggtucgt

SEQ ID NO: 85219 - DNA, 19 bp, Artificial Sequence
  Synthetic
tgctgcuggaatcctccug

SEQ ID NO: 85220 - DNA, 28 bp, Artificial Sequence
  Synthetic
gaccactactgucacactttaatgcaua

SEQ ID NO: 85221 - DNA, 27 bp, Artificial Sequence
  Synthetic
ccauattgccugaaagaagaggaagac

SEQ ID NO: 85222 - DNA, 20 bp, Artificial Sequence
  Synthetic
cgccaggutcttuccgaaac

SEQ ID NO: 85223 - DNA, 22 bp, Artificial Sequence
  Synthetic
gaatctucagctcgaugcagac

SEQ ID NO: 85224 - DNA, 21 bp, Artificial Sequence
  Synthetic
tcgugaaggauaacccccaga

SEQ ID NO: 85225 - DNA, 24 bp, Artificial Sequence
  Synthetic
ggtctgaggucttgaagctaugga

SEQ ID NO: 85226 - DNA, 24 bp, Artificial Sequence
  Synthetic
cgagttttatuggcgacacacuga

SEQ ID NO: 85227 - DNA, 23 bp, Artificial Sequence
  Synthetic
cgctagaucttcttcccuaaccc

SEQ ID NO: 85228 - DNA, 25 bp, Artificial Sequence
  Synthetic
gagaagcuccagagcctttuaaaga

SEQ ID NO: 85229 - DNA, 21 bp, Artificial Sequence
  Synthetic
caactcccagucccacugaag

SEQ ID NO: 85230 - DNA, 22 bp, Artificial Sequence
  Synthetic
gaauttgctugaaggccaccat

SEQ ID NO: 85231 - DNA, 25 bp, Artificial Sequence
  Synthetic
aaaactuccacacatcatuggagga

SEQ ID NO: 85232 - DNA, 26 bp, Artificial Sequence
  Synthetic
gatacgtgguagaaggcttttctuga

SEQ ID NO: 85233 - DNA, 25 bp, Artificial Sequence
  Synthetic
aataagtctuggcaacagaccacut

SEQ ID NO: 85234 - DNA, 25 bp, Artificial Sequence
  Synthetic
gttgattctgcuatcactgctggua

SEQ ID NO: 85235 - DNA, 23 bp, Artificial Sequence
  Synthetic
gcagaagaauctuccccaccaaa

SEQ ID NO: 85236 - DNA, 18 bp, Artificial Sequence
  Synthetic
cagccuggcugacaggaa

SEQ ID NO: 85237 - DNA, 19 bp, Artificial Sequence
  Synthetic
gcuggaacagtugccggat

SEQ ID NO: 85238 - DNA, 20 bp, Artificial Sequence
  Synthetic
ccactguacgatgcctucgg

SEQ ID NO: 85239 - DNA, 21 bp, Artificial Sequence
  Synthetic
caccaguggaaggcucagaat

SEQ ID NO: 85240 - DNA, 27 bp, Artificial Sequence
  Synthetic
tgtcctccttcucctctttcatcuaaa

SEQ ID NO: 85241 - DNA, 23 bp, Artificial Sequence
  Synthetic
tcaggaaagggauttgctuccag

SEQ ID NO: 85242 - DNA, 24 bp, Artificial Sequence
  Synthetic
gaaggagaacgucttcatgauggt

SEQ ID NO: 85243 - DNA, 18 bp, Artificial Sequence
  Synthetic
ccagguggacctgctuca

SEQ ID NO: 85244 - DNA, 26 bp, Artificial Sequence
  Synthetic
aaaatgggattguttgcactaaccug

SEQ ID NO: 85245 - DNA, 28 bp, Artificial Sequence
  Synthetic
catggagtcugccaattctacttcttua

SEQ ID NO: 85246 - DNA, 21 bp, Artificial Sequence
  Synthetic
aggaaugcagggagagctgua

SEQ ID NO: 85247 - DNA, 22 bp, Artificial Sequence
  Synthetic
acagauagccatgaugcagcag

SEQ ID NO: 85248 - DNA, 24 bp, Artificial Sequence
  Synthetic
ctcctatactgacugggaggacut

SEQ ID NO: 85249 - DNA, 20 bp, Artificial Sequence
  Synthetic
cucttcttgtcucggcccat

SEQ ID NO: 85250 - DNA, 27 bp, Artificial Sequence
  Synthetic
tcgagcatgaugagctattagatcuga

SEQ ID NO: 85251 - DNA, 29 bp, Artificial Sequence
  Synthetic
cacttatgcatgauttaccatctttgcut

SEQ ID NO: 85252 - DNA, 25 bp, Artificial Sequence
  Synthetic
agtctactatcuggcctgtttugga

SEQ ID NO: 85253 - DNA, 21 bp, Artificial Sequence
  Synthetic
tgggucacccaaatucagagg

SEQ ID NO: 85254 - DNA, 22 bp, Artificial Sequence
  Synthetic
cttctcatucagcagggcuagg

SEQ ID NO: 85255 - DNA, 22 bp, Artificial Sequence
  Synthetic
ccccttgugcacatagttcugt

SEQ ID NO: 85256 - DNA, 21 bp, Artificial Sequence
  Synthetic
ctgtgauggagcccctcatua

SEQ ID NO: 85257 - DNA, 25 bp, Artificial Sequence
  Synthetic
gaatgctgcucatcttcttccatug

SEQ ID NO: 85258 - DNA, 23 bp, Artificial Sequence
  Synthetic
acccattatuacgcctgttcucc

SEQ ID NO: 85259 - DNA, 27 bp, Artificial Sequence
  Synthetic
tctggatgcagugctaaagaguaaaaa

SEQ ID NO: 85260 - DNA, 22 bp, Artificial Sequence
  Synthetic
gcuccacaaccaucaacaggaa

SEQ ID NO: 85261 - DNA, 21 bp, Artificial Sequence
  Synthetic
gcacaaggucaaagcagagug

SEQ ID NO: 85262 - DNA, 25 bp, Artificial Sequence
  Synthetic
gaaggtatttuggctttcacggtut

SEQ ID NO: 85263 - DNA, 26 bp, Artificial Sequence
  Synthetic
ccggaaattucttttacacaguccag

SEQ ID NO: 85264 - DNA, 29 bp, Artificial Sequence
  Synthetic
ccatgaatagtcuagcagtttgattguct

SEQ ID NO: 85265 - DNA, 28 bp, Artificial Sequence
  Synthetic
aatcattaaactuacttgacagccuggt

SEQ ID NO: 85266 - DNA, 24 bp, Artificial Sequence
  Synthetic
ccaactgctcuggaacatgtttuc

SEQ ID NO: 85267 - DNA, 24 bp, Artificial Sequence
  Synthetic
gacataccucagcacacacauaca

SEQ ID NO: 85268 - DNA, 22 bp, Artificial Sequence
  Synthetic
cctcaagaccutgcctcttcuc

SEQ ID NO: 85269 - DNA, 23 bp, Artificial Sequence
  Synthetic
gatgtgcucactgtcugaccaat

SEQ ID NO: 85270 - DNA, 27 bp, Artificial Sequence
  Synthetic
aaaactcacautcctcttucaccagaa

SEQ ID NO: 85271 - DNA, 26 bp, Artificial Sequence
  Synthetic
catttttagtggacucttgtgggcua

SEQ ID NO: 85272 - DNA, 28 bp, Artificial Sequence
  Synthetic
ttcattcaaauggttctcacaugagagt

SEQ ID NO: 85273 - DNA, 20 bp, Artificial Sequence
  Synthetic
ttctugggacgcacagugat

SEQ ID NO: 85274 - DNA, 27 bp, Artificial Sequence
  Synthetic
cctgcatgcttuaaaaactctgaacut

SEQ ID NO: 85275 - DNA, 25 bp, Artificial Sequence
  Synthetic
tcttcagagtcutccaccaggaaua

SEQ ID NO: 85276 - DNA, 22 bp, Artificial Sequence
  Synthetic
caaggttcugccactcucagac

SEQ ID NO: 85277 - DNA, 24 bp, Artificial Sequence
  Synthetic
aggacaagacugagttctccauca

SEQ ID NO: 85278 - DNA, 25 bp, Artificial Sequence
  Synthetic
tcaagagagtuagactgtccaccut

SEQ ID NO: 85279 - DNA, 28 bp, Artificial Sequence
  Synthetic
cagatcacucaaaatttgcatgugaaga

SEQ ID NO: 85280 - DNA, 22 bp, Artificial Sequence
  Synthetic
gattcuccaacctcgtcuccaa

SEQ ID NO: 85281 - DNA, 20 bp, Artificial Sequence
  Synthetic
ccagccaucgagacttugct

SEQ ID NO: 85282 - DNA, 21 bp, Artificial Sequence
  Synthetic
accaaggcugtcaccacatuc

SEQ ID NO: 85283 - DNA, 21 bp, Artificial Sequence
  Synthetic
atagttgugctgctgguggat

SEQ ID NO: 85284 - DNA, 23 bp, Artificial Sequence
  Synthetic
tggtacctucccagcataaugga

SEQ ID NO: 85285 - DNA, 20 bp, Artificial Sequence
  Synthetic
ctggacgaggaaugctggut

SEQ ID NO: 85286 - DNA, 18 bp, Artificial Sequence
  Synthetic
tgcagcuccagguagcac

SEQ ID NO: 85287 - DNA, 21 bp, Artificial Sequence
  Synthetic
gcttaccguacaggcttugga

SEQ ID NO: 85288 - DNA, 33 bp, Artificial Sequence
  Synthetic
ttacaaagaatggutagtggtttaacauaaaca

SEQ ID NO: 85289 - DNA, 26 bp, Artificial Sequence
  Synthetic
aagctttgucaccagatgataacuga

SEQ ID NO: 85290 - DNA, 24 bp, Artificial Sequence
  Synthetic
gtgctaccgaugctctgcttauat

SEQ ID NO: 85291 - DNA, 27 bp, Artificial Sequence
  Synthetic
actctgaagcugaaaatattgagccut

SEQ ID NO: 85292 - DNA, 21 bp, Artificial Sequence
  Synthetic
ccttaagccauctgggccuac

SEQ ID NO: 85293 - DNA, 23 bp, Artificial Sequence
  Synthetic
gactccugtttcctauggcaact

SEQ ID NO: 85294 - DNA, 22 bp, Artificial Sequence
  Synthetic
tgatccucaaacgatgcctucc

SEQ ID NO: 85295 - DNA, 21 bp, Artificial Sequence
  Synthetic
gggctcaagcucttagcctut

SEQ ID NO: 85296 - DNA, 22 bp, Artificial Sequence
  Synthetic
cgccaagguggtcatttugaaa

SEQ ID NO: 85297 - DNA, 22 bp, Artificial Sequence
  Synthetic
acugtccagtttugagaagcgt

SEQ ID NO: 85298 - DNA, 24 bp, Artificial Sequence
  Synthetic
agaaatugccccacattgaugagt

SEQ ID NO: 85299 - DNA, 22 bp, Artificial Sequence
  Synthetic
gggttggaugattacggtuggg

SEQ ID NO: 85300 - DNA, 28 bp, Artificial Sequence
  Synthetic
ccaaactttauaagatcctggctaucct

SEQ ID NO: 85301 - DNA, 28 bp, Artificial Sequence
  Synthetic
gtttcccctgacutatacacggtttuaa

SEQ ID NO: 85302 - DNA, 20 bp, Artificial Sequence
  Synthetic
cgtccgcucaagagtgucat

SEQ ID NO: 85303 - DNA, 21 bp, Artificial Sequence
  Synthetic
cgugagaaagcuggaccgaag

SEQ ID NO: 85304 - DNA, 33 bp, Artificial Sequence; identical to SEQ ID NO: 54944
  Synthetic

SEQ ID NO: 85305 - DNA, 24 bp, Artificial Sequence
  Synthetic
gcagctgacutgactttgctaaug

SEQ ID NO: 85306 - DNA, 20 bp, Artificial Sequence
  Synthetic
ggctcctucctcacccgaua

SEQ ID NO: 85307 - DNA, 17 bp, Artificial Sequence
  Synthetic
cgcuaccugcggaccac

SEQ ID NO: 85308 - DNA, 23 bp, Artificial Sequence
  Synthetic
gcagcaucagtgtgtcugaacat

SEQ ID NO: 85309 - DNA, 21 bp, Artificial Sequence
  Synthetic
gcagacgaugaggtcaugcaa

SEQ ID NO: 85310 - DNA, 28 bp, Artificial Sequence
  Synthetic
gtctgacagagtuctcattacccaaaut

SEQ ID NO: 85311 - DNA, 22 bp, Artificial Sequence
  Synthetic
cuctctctcauaggagccagga

SEQ ID NO: 85312 - DNA, 20 bp, Artificial Sequence
  Synthetic
agacttguccgtggcttugg

SEQ ID NO: 85313 - DNA, 22 bp, Artificial Sequence
  Synthetic
gatgcccaugcgttgtgtauag

SEQ ID NO: 85314 - DNA, 20 bp, Artificial Sequence
  Synthetic
cacgcuaccactcctgtuga

SEQ ID NO: 85315 - DNA, 29 bp, Artificial Sequence
  Synthetic
agcttctttagccucaaacttaatctugt

SEQ ID NO: 85316 - DNA, 21 bp, Artificial Sequence
  Synthetic
cgucgcagaaaccacaacauc

SEQ ID NO: 85317 - DNA, 21 bp, Artificial Sequence
  Synthetic
gtggacatacucagtggccut

SEQ ID NO: 85318 - DNA, 25 bp, Artificial Sequence
  Synthetic
tcttcttttgcutccctctcttucc

SEQ ID NO: 85319 - DNA, 27 bp, Artificial Sequence
  Synthetic
accatcagcauctactccatauagaca

SEQ ID NO: 85320 - DNA, 24 bp, Artificial Sequence
  Synthetic
agctggatcuagaaatggaagcuc

SEQ ID NO: 85321 - DNA, 23 bp, Artificial Sequence
  Synthetic
attgcacgtttugagggtaccua

SEQ ID NO: 85322 - DNA, 23 bp, Artificial Sequence
  Synthetic
tcattgcctuccgttccagtuac

SEQ ID NO: 85323 - DNA, 27 bp, Artificial Sequence
  Synthetic
tcattttggctuctatacctccaugat

SEQ ID NO: 85324 - DNA, 21 bp, Artificial Sequence
  Synthetic
agaattcgcuagccctgggua

SEQ ID NO: 85325 - DNA, 24 bp, Artificial Sequence
  Synthetic
tcatggucgagcattttugcaaag

SEQ ID NO: 85326 - DNA, 24 bp, Artificial Sequence
  Synthetic
cccggcccacaautttattctuaa

SEQ ID NO: 85327 - DNA, 27 bp, Artificial Sequence
  Synthetic
ttgctggagaacutgtagtagttgaug

SEQ ID NO: 85328 - DNA, 23 bp, Artificial Sequence
  Synthetic
gcatggaaaggugccttttuagt

SEQ ID NO: 85329 - DNA, 28 bp, Artificial Sequence
  Synthetic
tctagatgcucgaggaagtattccauaa

SEQ ID NO: 85330 - DNA, 28 bp, Artificial Sequence
  Synthetic
ctactgcattugacattccttgtttugt

SEQ ID NO: 85331 - DNA, 22 bp, Artificial Sequence
  Synthetic
tgctgggtaugtaaggagctug

SEQ ID NO: 85332 - DNA, 24 bp, Artificial Sequence
  Synthetic
caaagcagaggaaguagctacgut

SEQ ID NO: 85333 - DNA, 28 bp, Artificial Sequence
  Synthetic
actaggatatuaacacatgggcuacagt

SEQ ID NO: 85334 - DNA, 24 bp, Artificial Sequence
  Synthetic
ctcattguaccgtcaggaucaaga

SEQ ID NO: 85335 - DNA, 28 bp, Artificial Sequence
  Synthetic
gtactgattactacuggccggaagtaua

SEQ ID NO: 85336 - DNA, 21 bp, Artificial Sequence
  Synthetic
cttgccttugcagccatugat

SEQ ID NO: 85337 - DNA, 20 bp, Artificial Sequence
  Synthetic
gcgcgucaatgactuccact

SEQ ID NO: 85338 - DNA, 28 bp, Artificial Sequence
  Synthetic
ctcagttgaattugctgggttttatugt

SEQ ID NO: 85339 - DNA, 25 bp, Artificial Sequence
  Synthetic
aacatcagctguaggaacatcgaut

SEQ ID NO: 85340 - DNA, 23 bp, Artificial Sequence
  Synthetic
agccccaacauggttttgaacua

SEQ ID NO: 85341 - DNA, 29 bp, Artificial Sequence
  Synthetic
ggttcaattcattuacttcagaggacugt

SEQ ID NO: 85342 - DNA, 17 bp, Artificial Sequence
  Synthetic
caccggugugaccagca

SEQ ID NO: 85343 - DNA, 17 bp, Artificial Sequence
  Synthetic
gtgggugagcgctguga

SEQ ID NO: 85344 - DNA, 21 bp, Artificial Sequence
  Synthetic
ggacaggcacucgttgacauc

SEQ ID NO: 85345 - DNA, 20 bp, Artificial Sequence
  Synthetic
tcaacguggacgacugcaat

SEQ ID NO: 85346 - DNA, 21 bp, Artificial Sequence
  Synthetic
caggcagcuaatgaaggucca

SEQ ID NO: 85347 - DNA, 26 bp, Artificial Sequence
  Synthetic
aaagcctucagacccaatggttauag

SEQ ID NO: 85348 - DNA, 21 bp, Artificial Sequence
  Synthetic
agcaaaccugccagtggtuat

SEQ ID NO: 85349 - DNA, 26 bp, Artificial Sequence
  Synthetic
acctactgcugtgtctactguagaaa

SEQ ID NO: 85350 - DNA, 20 bp, Artificial Sequence
  Synthetic
caggugccgttgtuaaagca

SEQ ID NO: 85351 - DNA, 18 bp, Artificial Sequence
  Synthetic
guctuccgggacggacac

SEQ ID NO: 85352 - DNA, 20 bp, Artificial Sequence
  Synthetic
aagtggtacgcuccggaaug

SEQ ID NO: 85353 - DNA, 22 bp, Artificial Sequence
  Synthetic
agaaaaugaagcaggacuggct

SEQ ID NO: 85354 - DNA, 18 bp, Artificial Sequence
  Synthetic
gcucccucacgacaggat

SEQ ID NO: 85355 - DNA, 20 bp, Artificial Sequence
  Synthetic
ctcgagggcauccgtatcug

SEQ ID NO: 85356 - DNA, 20 bp, Artificial Sequence
  Synthetic
ccuggaagaccaccctgtug

SEQ ID NO: 85357 - DNA, 24 bp, Artificial Sequence
  Synthetic
ccctgactatuctccgactgtuct

SEQ ID NO: 85358 - DNA, 26 bp, Artificial Sequence
  Synthetic
catctgagutctgagaatugggacat

SEQ ID NO: 85359 - DNA, 21 bp, Artificial Sequence
  Synthetic
aaggctucaagctcucaggac

SEQ ID NO: 85360 - DNA, 21 bp, Artificial Sequence
  Synthetic
tgtgccucccacattgttuca

SEQ ID NO: 85361 - DNA, 21 bp, Artificial Sequence
  Synthetic
gttcaccctugggctaggtuc

SEQ ID NO: 85362 - DNA, 22 bp, Artificial Sequence
  Synthetic
gccttcttccucctcctccaua

SEQ ID NO: 85363 - DNA, 22 bp, Artificial Sequence
  Synthetic
cttctcagagcuggatggacug

SEQ ID NO: 85364 - DNA, 22 bp, Artificial Sequence
  Synthetic
ttcccccaautgacactctucc

SEQ ID NO: 85365 - DNA, 22 bp, Artificial Sequence
  Synthetic
gccagtgugttcaagacucaga

SEQ ID NO: 85366 - DNA, 28 bp, Artificial Sequence
  Synthetic
tgtcattttccutaggttcaaaacuggt

SEQ ID NO: 85367 - DNA, 20 bp, Artificial Sequence
  Synthetic
cgattgcuaggcccggtaug

SEQ ID NO: 85368 - DNA, 19 bp, Artificial Sequence
  Synthetic
cctctuccatgggcuccag

SEQ ID NO: 85369 - DNA, 20 bp, Artificial Sequence
  Synthetic
ctggcaggutagcagugaga

SEQ ID NO: 85370 - DNA, 28 bp, Artificial Sequence
  Synthetic
gccatatgaaatugtagtggacctuacc

SEQ ID NO: 85371 - DNA, 21 bp, Artificial Sequence
  Synthetic
actcccugacccaggagtuac

SEQ ID NO: 85372 - DNA, 21 bp, Artificial Sequence
  Synthetic
agcagtuccacttacgugcat

SEQ ID NO: 85373 - DNA, 24 bp, Artificial Sequence
  Synthetic
agcatggagaagcuttagaauggg

SEQ ID NO: 85374 - DNA, 18 bp, Artificial Sequence
  Synthetic
cagacgagcuggaucgca

SEQ ID NO: 85375 - DNA, 27 bp, Artificial Sequence
  Synthetic
gttcatatatgtuctgcccttgtcuct

SEQ ID NO: 85376 - DNA, 26 bp, Artificial Sequence
  Synthetic
tggaaaaccaaaugaaaccatucagg

SEQ ID NO: 85377 - DNA, 23 bp, Artificial Sequence
  Synthetic
ccgttcttuagcggtcatgucaa

SEQ ID NO: 85378 - DNA, 22 bp, Artificial Sequence
  Synthetic
caatgggacuaaaccugcagga

SEQ ID NO: 85379 - DNA, 22 bp, Artificial Sequence
  Synthetic
ctacagtcuccagtggcuaagg

SEQ ID NO: 85380 - DNA, 24 bp, Artificial Sequence
  Synthetic
ccaggccuaaaatauacccaacca

SEQ ID NO: 85381 - DNA, 29 bp, Artificial Sequence
  Synthetic
tctcaaaaguacaaaccaaagacagctua

SEQ ID NO: 85382 - DNA, 21 bp, Artificial Sequence
  Synthetic
tccgtgttcutgaagcagugg

SEQ ID NO: 85383 - DNA, 24 bp, Artificial Sequence
  Synthetic
cctgaccugcactcttctgtttua

SEQ ID NO: 85384 - DNA, 21 bp, Artificial Sequence
  Synthetic
cccatcucccaagcttguaga

SEQ ID NO: 85385 - DNA, 26 bp, Artificial Sequence
  Synthetic
cactacaacaauggcaactauaccct

SEQ ID NO: 85386 - DNA, 22 bp, Artificial Sequence
  Synthetic
ttccatcctucacattgcccut

SEQ ID NO: 85387 - DNA, 28 bp, Artificial Sequence
  Synthetic
caacaatgcaaaagcacutcttatccua

SEQ ID NO: 85388 - DNA, 24 bp, Artificial Sequence
  Synthetic
ttccacuggtcatcctucgaaaaa

SEQ ID NO: 85389 - DNA, 25 bp, Artificial Sequence
  Synthetic
tgagtaacagcugtgcagaaatugt

SEQ ID NO: 85390 - DNA, 22 bp, Artificial Sequence
  Synthetic
cccaccaccauctcctctttuc

SEQ ID NO: 85391 - DNA, 22 bp, Artificial Sequence
  Synthetic
tcctgaaggccuctgtggatua

SEQ ID NO: 85392 - DNA, 28 bp, Artificial Sequence
  Synthetic
aacgtctccgcaguctatatctauaact

SEQ ID NO: 85393 - DNA, 25 bp, Artificial Sequence
  Synthetic
caggtagtttcugttgttcatgcuc

SEQ ID NO: 85394 - DNA, 21 bp, Artificial Sequence
  Synthetic
cccagtggguttttggcaaug

SEQ ID NO: 85395 - DNA, 18 bp, Artificial Sequence
  Synthetic
cactggcugcacaauggg

SEQ ID NO: 85396 - DNA, 20 bp, Artificial Sequence
  Synthetic
ccttctgcagcutgcggaua

SEQ ID NO: 85397 - DNA, 23 bp, Artificial Sequence
  Synthetic
agctccugagaaactcctcaugt

SEQ ID NO: 85398 - DNA, 26 bp, Artificial Sequence
  Synthetic
ggtcagaaaugaccatgtgtaaguct

SEQ ID NO: 85399 - DNA, 25 bp, Artificial Sequence
  Synthetic
cactgtaaugagggctgtctguaaa

SEQ ID NO: 85400 - DNA, 20 bp, Artificial Sequence
  Synthetic
gctggaggaucggttgucaa

SEQ ID NO: 85401 - DNA, 22 bp, Artificial Sequence
  Synthetic
gctgtcaccaaugaggtugaag

SEQ ID NO: 85402 - DNA, 23 bp, Artificial Sequence
  Synthetic
tgatcttttuctcccccuagggt

SEQ ID NO: 85403 - DNA, 28 bp, Artificial Sequence
  Synthetic
gaagactacutgcagagaatuaccaact

SEQ ID NO: 85404 - DNA, 21 bp, Artificial Sequence
  Synthetic
gggaaacuggctgagcacaua

SEQ ID NO: 85405 - DNA, 26 bp, Artificial Sequence
  Synthetic
tcgttuacaaaacacagacuggaact

SEQ ID NO: 85406 - DNA, 20 bp, Artificial Sequence
  Synthetic
ctgccagutagcgguaacct

SEQ ID NO: 85407 - DNA, 24 bp, Artificial Sequence
  Synthetic
gctcagtggutacttctcttuccc

SEQ ID NO: 85408 - DNA, 27 bp, Artificial Sequence
  Synthetic
gtagtattccacauggatgatctugga

SEQ ID NO: 85409 - DNA, 20 bp, Artificial Sequence
  Synthetic
gcaggcutctccctugacag

SEQ ID NO: 85410 - DNA, 26 bp, Artificial Sequence
  Synthetic
aacactcactuctttacagcttcucc

SEQ ID NO: 85411 - DNA, 24 bp, Artificial Sequence
  Synthetic
gggccaugaacatgagtguaaaat

SEQ ID NO: 85412 - DNA, 22 bp, Artificial Sequence
  Synthetic
cgttgccucctgacauaccaag

SEQ ID NO: 85413 - DNA, 24 bp, Artificial Sequence
  Synthetic
cccaatcacucagtctagtucaca

SEQ ID NO: 85414 - DNA, 18 bp, Artificial Sequence
  Synthetic
ccatgtgggugggtggut

SEQ ID NO: 85415 - DNA, 18 bp, Artificial Sequence
  Synthetic
aatgtuccagggcugcca

SEQ ID NO: 85416 - DNA, 25 bp, Artificial Sequence
  Synthetic
caccaaagcutttctggaaaaucca

SEQ ID NO: 85417 - DNA, 28 bp, Artificial Sequence
  Synthetic
ggttgctttcuccaataactagatguga

SEQ ID NO: 85418 - DNA, 27 bp, Artificial Sequence
  Synthetic
cacatgtgagucaaattgtucagaaaa

SEQ ID NO: 85419 - DNA, 23 bp, Artificial Sequence
  Synthetic
gcacatcgaucatttccaagucc

SEQ ID NO: 85420 - DNA, 23 bp, Artificial Sequence
  Synthetic
tgtttccuagatacacccuccgt

SEQ ID NO: 85421 - DNA, 27 bp, Artificial Sequence
  Synthetic
tucaatgaggtucccagaagagaaaaa

SEQ ID NO: 85422 - DNA, 18 bp, Artificial Sequence
  Synthetic
ccacgccucccagactua

SEQ ID NO: 85423 - DNA, 18 bp, Artificial Sequence
  Synthetic
gctcggcuggagtctgug

SEQ ID NO: 85424 - DNA, 26 bp, Artificial Sequence
  Synthetic
ctcccaacaaauacctcattcaugga

SEQ ID NO: 85425 - DNA, 28 bp, Artificial Sequence
  Synthetic
agtcagaugaattccctugaacaagaat

SEQ ID NO: 85426 - DNA, 19 bp, Artificial Sequence
  Synthetic
ccctccgucccauagcaaa

SEQ ID NO: 85427 - DNA, 25 bp, Artificial Sequence
  Synthetic
ttatttcacugacaggcaauaccgt

SEQ ID NO: 85428 - DNA, 22 bp, Artificial Sequence
  Synthetic
gugctggtuccaagaaggagag

SEQ ID NO: 85429 - DNA, 21 bp, Artificial Sequence
  Synthetic
ccctgggucctccagtgauag

SEQ ID NO: 85430 - DNA, 25 bp, Artificial Sequence
  Synthetic
gtatccatucccacatgguaagaca

SEQ ID NO: 85431 - DNA, 28 bp, Artificial Sequence
  Synthetic
accaagcugaaacaaaatcaaaaucact

SEQ ID NO: 85432 - DNA, 18 bp, Artificial Sequence
  Synthetic
tctgcaucacccccgtug

SEQ ID NO: 85433 - DNA, 20 bp, Artificial Sequence
  Synthetic
cgggucaagccatcuaacct

SEQ ID NO: 85434 - DNA, 27 bp, Artificial Sequence
  Synthetic
tttcttttucaggccttcatttuccaa

SEQ ID NO: 85435 - DNA, 26 bp, Artificial Sequence
  Synthetic
aagagutgagatttcugacaagcaca

SEQ ID NO: 85436 - DNA, 28 bp, Artificial Sequence
  Synthetic
cttctgcagatuctctacttgacttuca

SEQ ID NO: 85437 - DNA, 28 bp, Artificial Sequence
  Synthetic
actgtttgtugtcttaggttauggagac

SEQ ID NO: 85438 - DNA, 22 bp, Artificial Sequence
  Synthetic
aggaggcagcutcttctcuaca

SEQ ID NO: 85439 - DNA, 29 bp, Artificial Sequence
  Synthetic
ctctgatctctugctatcctttcttacut

SEQ ID NO: 85440 - DNA, 22 bp, Artificial Sequence
  Synthetic
cctgaagcauatgtagcccuga

SEQ ID NO: 85441 - DNA, 24 bp, Artificial Sequence
  Synthetic
gtggtgcttugaacagtgaaugat

SEQ ID NO: 85442 - DNA, 17 bp, Artificial Sequence
  Synthetic
gcuacgccucggaccag

SEQ ID NO: 85443 - DNA, 19 bp, Artificial Sequence
  Synthetic
ccccugggtgaugcaagag

SEQ ID NO: 85444 - DNA, 28 bp, Artificial Sequence
  Synthetic
cgtttuaagaggaaaaagucaggagagt

SEQ ID NO: 85445 - DNA, 20 bp, Artificial Sequence
  Synthetic
ctggatctcugcgctgaugt

SEQ ID NO: 85446 - DNA, 20 bp, Artificial Sequence
  Synthetic
gcttcgacgagutcaaggug

SEQ ID NO: 85447 - DNA, 28 bp, Artificial Sequence
  Synthetic
ccagttttcutttctgtcaaauggagat

SEQ ID NO: 85448 - DNA, 23 bp, Artificial Sequence
  Synthetic
ggatgggugtgtatucaggaact

SEQ ID NO: 85449 - DNA, 25 bp, Artificial Sequence
  Synthetic
aaccacacagguaatcgtctcttuc

SEQ ID NO: 85450 - DNA, 20 bp, Artificial Sequence
  Synthetic
ggctucagcgtccagucaat

SEQ ID NO: 85451 - DNA, 22 bp, Artificial Sequence
  Synthetic
gctatctcccaucacctcugct

SEQ ID NO: 85452 - DNA, 19 bp, Artificial Sequence
  Synthetic
gcagccacagugagcucaa

SEQ ID NO: 85453 - DNA, 17 bp, Artificial Sequence
  Synthetic
gtgcatcugcgcgugaa

SEQ ID NO: 85454 - DNA, 21 bp, Artificial Sequence
  Synthetic
caggagcaggauagtgcctut

SEQ ID NO: 85455 - DNA, 18 bp, Artificial Sequence
  Synthetic
guccacagccuccagcag

SEQ ID NO: 85456 - DNA, 17 bp, Artificial Sequence
  Synthetic
gcgccagguggtagcuc

SEQ ID NO: 85457 - DNA, 18 bp, Artificial Sequence
  Synthetic
gcugcagcacagcaucca

SEQ ID NO: 85458 - DNA, 19 bp, Artificial Sequence
  Synthetic
gcgcgacuacgaggagaug

SEQ ID NO: 85459 - DNA, 20 bp, Artificial Sequence
  Synthetic
aggaaaccgugcatguccag

SEQ ID NO: 85460 - DNA, 24 bp, Artificial Sequence
  Synthetic
tcctacagacutcatcugcagaga

SEQ ID NO: 85461 - DNA, 27 bp, Artificial Sequence
  Synthetic
cataattgttctgguaattgccagcut

SEQ ID NO: 85462 - DNA, 25 bp, Artificial Sequence
  Synthetic
aaaagtgtagugttgagggctucat

SEQ ID NO: 85463 - DNA, 25 bp, Artificial Sequence
  Synthetic
caccugtaccaacuacaacaacaac

SEQ ID NO: 85464 - DNA, 22 bp, Artificial Sequence
  Synthetic
cggcacccutccatctctcuaa

SEQ ID NO: 85465 - DNA, 19 bp, Artificial Sequence
  Synthetic
ccgtgaaugtgguccgact

SEQ ID NO: 85466 - DNA, 20 bp, Artificial Sequence
  Synthetic
tcggtgagucctgtcuggat

SEQ ID NO: 85467 - DNA, 26 bp, Artificial Sequence
  Synthetic
aacatgttatctgucgctcctctuag

SEQ ID NO: 85468 - DNA, 24 bp, Artificial Sequence
  Synthetic
gcttgtctaggaugctgttgtgut

SEQ ID NO: 85469 - DNA, 20 bp, Artificial Sequence
  Synthetic
cagcutcgacuccagcacat

SEQ ID NO: 85470 - DNA, 20 bp, Artificial Sequence
  Synthetic
gaacctgaccucccacugaa

SEQ ID NO: 85471 - DNA, 21 bp, Artificial Sequence
  Synthetic
ctcctcgcgggugtatatguc

SEQ ID NO: 85472 - DNA, 21 bp, Artificial Sequence
  Synthetic
ttugagaggacccacuaccca

SEQ ID NO: 85473 - DNA, 24 bp, Artificial Sequence
  Synthetic
gccatcccaaacutctgaatcuct

SEQ ID NO: 85474 - DNA, 29 bp, Artificial Sequence
  Synthetic
tgatgtttctgugcatatacttgttgtug

SEQ ID NO: 85475 - DNA, 26 bp, Artificial Sequence
  Synthetic
cagctcctggutatactcctaatgut

SEQ ID NO: 85476 - DNA, 26 bp, Artificial Sequence
  Synthetic
gtcctggtgtuttattgtttggctut

SEQ ID NO: 85477 - DNA, 21 bp, Artificial Sequence
  Synthetic
cccacagacugugaacacagg

SEQ ID NO: 85478 - DNA, 22 bp, Artificial Sequence
  Synthetic
ccggcccaaucacaatgattuc

SEQ ID NO: 85479 - DNA, 19 bp, Artificial Sequence
  Synthetic
gttugcacccgtccuggat

SEQ ID NO: 85480 - DNA, 20 bp, Artificial Sequence
  Synthetic
gaggccaugccacuagagat

SEQ ID NO: 85481 - DNA, 21 bp, Artificial Sequence
  Synthetic
cctcaugctggctauccacaa

SEQ ID NO: 85482 - DNA, 21 bp, Artificial Sequence
  Synthetic
tggaggaacutgcccaacuac

SEQ ID NO: 85483 - DNA, 29 bp, Artificial Sequence
  Synthetic
agaggaaaacauggtgattacucaacaaa

SEQ ID NO: 85484 - DNA, 21 bp, Artificial Sequence
  Synthetic
ggcgagaggaacucactctuc

SEQ ID NO: 85485 - DNA, 20 bp, Artificial Sequence
  Synthetic
gccactcugatgcctcctuc

SEQ ID NO: 85486 - DNA, 24 bp, Artificial Sequence
  Synthetic
acaatgaagucgaactcagauccc

SEQ ID NO: 85487 - DNA, 24 bp, Artificial Sequence
  Synthetic
gcaacctgaucttgtgaacaucct

SEQ ID NO: 85488 - DNA, 25 bp, Artificial Sequence
  Synthetic
ccttccaccutcctttcuacagaat

SEQ ID NO: 85489 - DNA, 23 bp, Artificial Sequence
  Synthetic
ccatgtggauaaggtacgtguca

SEQ ID NO: 85490 - DNA, 28 bp, Artificial Sequence
  Synthetic
tgttagttccugaaaacattgacacgua

SEQ ID NO: 85491 - DNA, 24 bp, Artificial Sequence
  Synthetic
agaaccgggaaaacauctccttut

SEQ ID NO: 85492 - DNA, 22 bp, Artificial Sequence
  Synthetic
cttgtgtgaccuttgcccttug

SEQ ID NO: 85493 - DNA, 21 bp, Artificial Sequence
  Synthetic
cacaaacacacccaugagcug

SEQ ID NO: 85494 - DNA, 23 bp, Artificial Sequence
  Synthetic
cctctcagcutcttctctgctut

SEQ ID NO: 85495 - DNA, 24 bp, Artificial Sequence
  Synthetic
ctctcttgauatctggtccauccc

SEQ ID NO: 85496 - DNA, 26 bp, Artificial Sequence
  Synthetic
gacttcaaccutcatgtgatgucaac

SEQ ID NO: 85497 - DNA, 28 bp, Artificial Sequence
  Synthetic
ggatatgcaaautgaacaaacugacact

SEQ ID NO: 85498 - DNA, 24 bp, Artificial Sequence
  Synthetic
agcatgcuaccaactacaaaucat

SEQ ID NO: 85499 - DNA, 28 bp, Artificial Sequence
  Synthetic
cauatgtttgaagtatuggaacgagcaa

SEQ ID NO: 85500 - DNA, 27 bp, Artificial Sequence
  Synthetic
gctttgaaaacauaccgattcatccut

SEQ ID NO: 85501 - DNA, 28 bp, Artificial Sequence
  Synthetic
accacccctuacatttgacataatuagg

SEQ ID NO: 85502 - DNA, 26 bp, Artificial Sequence
  Synthetic
tcagatagtagucaggcaacucagat

SEQ ID NO: 85503 - DNA, 22 bp, Artificial Sequence
  Synthetic
aggaagaguggcatttctccua

SEQ ID NO: 85504 - DNA, 22 bp, Artificial Sequence
  Synthetic
caccactagagugcctcagtut

SEQ ID NO: 85505 - DNA, 19 bp, Artificial Sequence
  Synthetic
caccagccucaugcacaac

SEQ ID NO: 85506 - DNA, 21 bp, Artificial Sequence
  Synthetic
gctcaagggcutaccactgua

SEQ ID NO: 85507 - DNA, 17 bp, Artificial Sequence
  Synthetic
ggcuccccctgaugcac

SEQ ID NO: 85508 - DNA, 29 bp, Artificial Sequence
  Synthetic
gctgcattggagucatgtattttgattut

SEQ ID NO: 85509 - DNA, 26 bp, Artificial Sequence
  Synthetic
caaattacttggaaucgtcccttgug

SEQ ID NO: 85510 - DNA, 28 bp, Artificial Sequence
  Synthetic
gacggtagcgautattttcaacattcut

SEQ ID NO: 85511 - DNA, 25 bp, Artificial Sequence
  Synthetic
tttgtgtcagucatgagtcaucagg

SEQ ID NO: 85512 - DNA, 21 bp, Artificial Sequence
  Synthetic
cggtgtcuccttggttgucat

SEQ ID NO: 85513 - DNA, 22 bp, Artificial Sequence
  Synthetic
cctggtgtgucaatcactguca

SEQ ID NO: 85514 - DNA, 19 bp, Artificial Sequence
  Synthetic
gctggcccagcaugtcuac

SEQ ID NO: 85515 - DNA, 18 bp, Artificial Sequence
  Synthetic
gtgtgcacucagcagcuc

SEQ ID NO: 85516 - DNA, 25 bp, Artificial Sequence
  Synthetic
tggtttucaactctgtatucagcca

SEQ ID NO: 85517 - DNA, 22 bp, Artificial Sequence
  Synthetic
ctgcttgtgucccttagcuaca

SEQ ID NO: 85518 - DNA, 18 bp, Artificial Sequence
  Synthetic
tcctcacccugccctuct

SEQ ID NO: 85519 - DNA, 22 bp, Artificial Sequence
  Synthetic
gagcucagaaagcugaggaagt

SEQ ID NO: 85520 - DNA, 22 bp, Artificial Sequence
  Synthetic
gcagactgcugtgttctttgug

SEQ ID NO: 85521 - DNA, 23 bp, Artificial Sequence
  Synthetic
cagctgucagcacttactgctua

SEQ ID NO: 85522 - DNA, 23 bp, Artificial Sequence
  Synthetic
gctgtagcaucttccctcaucat

SEQ ID NO: 85523 - DNA, 25 bp, Artificial Sequence
  Synthetic
tgctcttgttcuacacaaagtccug

SEQ ID NO: 85524 - DNA, 20 bp, Artificial Sequence
  Synthetic
gagaaaggcguccggaugaa

SEQ ID NO: 85525 - DNA, 21 bp, Artificial Sequence
  Synthetic
ggaaacctcuagggctgacuc

SEQ ID NO: 85526 - DNA, 21 bp, Artificial Sequence
  Synthetic
catctacuccaaggccgtguc

SEQ ID NO: 85527 - DNA, 24 bp, Artificial Sequence
  Synthetic
ggaatucccacagcctgttaaugt

SEQ ID NO: 85528 - DNA, 22 bp, Artificial Sequence
  Synthetic
ccctacacaacgugagctucat

SEQ ID NO: 85529 - DNA, 22 bp, Artificial Sequence
  Synthetic
ccutcaaagtaggugcccagag

SEQ ID NO: 85530 - DNA, 24 bp, Artificial Sequence
  Synthetic
gcttaagcauaaccctgtcgttua

SEQ ID NO: 85531 - DNA, 27 bp, Artificial Sequence
  Synthetic
acaatttcattgugtaggcgaaucaag

SEQ ID NO: 85532 - DNA, 19 bp, Artificial Sequence
  Synthetic
cccagccugcttucaacct

SEQ ID NO: 85533 - DNA, 20 bp, Artificial Sequence
  Synthetic
ccagagacuccaagctgguc

SEQ ID NO: 85534 - DNA, 21 bp, Artificial Sequence
  Synthetic
cctggccucccaaacttctuc

SEQ ID NO: 85535 - DNA, 21 bp, Artificial Sequence
  Synthetic
gctcatgttuctcgccaggua

SEQ ID NO: 85536 - DNA, 28 bp, Artificial Sequence
  Synthetic
gaatcttcaccuctctgggatattucac

SEQ ID NO: 85537 - DNA, 28 bp, Artificial Sequence
  Synthetic
gcttttccaagautcactggttttugat

SEQ ID NO: 85538 - DNA, 20 bp, Artificial Sequence
  Synthetic
cucaagaaccuggcccagac

SEQ ID NO: 85539 - DNA, 21 bp, Artificial Sequence
  Synthetic
aaagcacugcaggctacugaa

SEQ ID NO: 85540 - DNA, 21 bp, Artificial Sequence
  Synthetic
ccaggtcuctgcgtgttucaa

SEQ ID NO: 85541 - DNA, 27 bp, Artificial Sequence
  Synthetic
gccaacaaguaccaagatattgacuct

SEQ ID NO: 85542 - DNA, 28 bp, Artificial Sequence
  Synthetic
acaggaagaatcuagctaaaggctttut

SEQ ID NO: 85543 - DNA, 27 bp, Artificial Sequence
  Synthetic
gucaagaagcatuagaagaagcaaagg

SEQ ID NO: 85544 - DNA, 22 bp, Artificial Sequence
  Synthetic
ttcagatggcuttcatcgucca

SEQ ID NO: 85545 - DNA, 28 bp, Artificial Sequence
  Synthetic
cttgagctgttuctgcctttatttucat

SEQ ID NO: 85546 - DNA, 21 bp, Artificial Sequence
  Synthetic
ctcggtttucctgtcggacut

SEQ ID NO: 85547 - DNA, 29 bp, Artificial Sequence
  Synthetic
tctttggtacctutggatttgacagtuat

SEQ ID NO: 85548 - DNA, 19 bp, Artificial Sequence
  Synthetic
cagacgcugggctaucgaa

SEQ ID NO: 85549 - DNA, 20 bp, Artificial Sequence
  Synthetic
tccagggaccutggtaggug

SEQ ID NO: 85550 - DNA, 28 bp, Artificial Sequence
  Synthetic
gtgccttgaaauccagtcaattgtaaua

SEQ ID NO: 85551 - DNA, 28 bp, Artificial Sequence
  Synthetic
gggattacaaaugagaagtgcaguaaac

SEQ ID NO: 85552 - DNA, 20 bp, Artificial Sequence
  Synthetic
cgcgatcucgctaccgttua

SEQ ID NO: 85553 - DNA, 17 bp, Artificial Sequence
  Synthetic
gctgugcggctttggug

SEQ ID NO: 85554 - DNA, 28 bp, Artificial Sequence
  Synthetic
aacaaagaaagaugtttcacctucaacc

SEQ ID NO: 85555 - DNA, 25 bp, Artificial Sequence
  Synthetic
atcttccttccugtggtcttuacac

SEQ ID NO: 85556 - DNA, 20 bp, Artificial Sequence
  Synthetic
gctaccgcuctcgtcagcua

SEQ ID NO: 85557 - DNA, 20 bp, Artificial Sequence
  Synthetic
actgggctuagggactcugg

SEQ ID NO: 85558 - DNA, 21 bp, Artificial Sequence
  Synthetic
gtcagttucactgcccugagt

SEQ ID NO: 85559 - DNA, 20 bp, Artificial Sequence
  Synthetic
ccaguacgatguggacgagt

SEQ ID NO: 85560 - DNA, 21 bp, Artificial Sequence
  Synthetic
cactuggcaccattctugcag

SEQ ID NO: 85561 - DNA, 21 bp, Artificial Sequence
  Synthetic
ctgaagggccauagtgctgut

SEQ ID NO: 85562 - DNA, 33 bp, Artificial Sequence
  Synthetic
tatcatatatgctuacacgatttcggtatcuaa

SEQ ID NO: 85563 - DNA, 28 bp, Artificial Sequence
  Synthetic
ggacgtagguacaagactcaataugaag

SEQ ID NO: 85564 - DNA, 28 bp, Artificial Sequence
  Synthetic
tcttcaaaataccutatcctgttgugct

SEQ ID NO: 85565 - DNA, 26 bp, Artificial Sequence
  Synthetic
aggaaaccauccagaaggactuagat

SEQ ID NO: 85566 - DNA, 25 bp, Artificial Sequence
  Synthetic
acatcaugacaaagtccucaaccat

SEQ ID NO: 85567 - DNA, 25 bp, Artificial Sequence
  Synthetic
gccatatttcugaggcttccctcua

SEQ ID NO: 85568 - DNA, 28 bp, Artificial Sequence
  Synthetic
gagtcttgtaccuacgtccaattttcut

SEQ ID NO: 85569 - DNA, 28 bp, Artificial Sequence
  Synthetic
tgcatctttgacuaacaaccagaactua

SEQ ID NO: 85570 - DNA, 28 bp, Artificial Sequence
  Synthetic
tggatggtttccutttcagttcttacut

SEQ ID NO: 85571 - DNA, 30 bp, Artificial Sequence
  Synthetic
attggacttcaaacuttgaaaaatgtcuca

SEQ ID NO: 85572 - DNA, 17 bp, Artificial Sequence
  Synthetic
cctccgcguctggacuc

SEQ ID NO: 85573 - DNA, 20 bp, Artificial Sequence
  Synthetic
gaacugcgcagccagaaauc

SEQ ID NO: 85574 - DNA, 27 bp, Artificial Sequence
  Synthetic
gctgatttagtugagacttacgtgcut

SEQ ID NO: 85575 - DNA, 28 bp, Artificial Sequence
  Synthetic
gggaatcgacgaaguaaatcttcttgua

SEQ ID NO: 85576 - DNA, 20 bp, Artificial Sequence
  Synthetic
ctctcacccucctcctccuc

SEQ ID NO: 85577 - DNA, 17 bp, Artificial Sequence
  Synthetic
tgcgucacucgcgaagt

SEQ ID NO: 85578 - DNA, 24 bp, Artificial Sequence
  Synthetic
gggaactagaaaagucccctcuca

SEQ ID NO: 85579 - DNA, 26 bp, Artificial Sequence
  Synthetic
ccttattaccccuacttgcacuagag

SEQ ID NO: 85580 - DNA, 21 bp, Artificial Sequence
  Synthetic
ggctcgauacgtcttcuccaa

SEQ ID NO: 85581 - DNA, 19 bp, Artificial Sequence
  Synthetic
ccaggtuttggtccugcca

SEQ ID NO: 85582 - DNA, 21 bp, Artificial Sequence
  Synthetic
ggtgagcaagucagcattugg

SEQ ID NO: 85583 - DNA, 22 bp, Artificial Sequence
  Synthetic
agaaaatgaccugggcctgtut

SEQ ID NO: 85584 - DNA, 24 bp, Artificial Sequence
  Synthetic
aagatgcagaautgaggcagacut

SEQ ID NO: 85585 - DNA, 28 bp, Artificial Sequence
  Synthetic
agttgatttauaccctgatagagucggt

SEQ ID NO: 85586 - DNA, 28 bp, Artificial Sequence
  Synthetic
tggatgaagaagaucaactgaagttucc

SEQ ID NO: 85587 - DNA, 23 bp, Artificial Sequence
  Synthetic
gccaucacaacatgcaucagaga

SEQ ID NO: 85588 - DNA, 19 bp, Artificial Sequence
  Synthetic
tgtgggcgagutcctccua

SEQ ID NO: 85589 - DNA, 21 bp, Artificial Sequence
  Synthetic
gaggaaaggaaggugcaguca

SEQ ID NO: 85590 - DNA, 24 bp, Artificial Sequence
  Synthetic
tgatactcctcugtctgccaguag

SEQ ID NO: 85591 - DNA, 22 bp, Artificial Sequence
  Synthetic
ctgaggaacuggatgccttugt

SEQ ID NO: 85592 - DNA, 27 bp, Artificial Sequence
  Synthetic
gacaagcagcaaacutacaagattgut

SEQ ID NO: 85593 - DNA, 28 bp, Artificial Sequence
  Synthetic
ggacagcacatugccaagtatatatugt

SEQ ID NO: 85594 - DNA, 31 bp, Artificial Sequence; identical to SEQ ID NO: 70434
  Synthetic

SEQ ID NO: 85595 - DNA, 20 bp, Artificial Sequence
  Synthetic
aggctggaaugcaagcucat

SEQ ID NO: 85596 - DNA, 24 bp, Artificial Sequence
  Synthetic
tcttttcttuagggcctgtucaca

SEQ ID NO: 85597 - DNA, 27 bp, Artificial Sequence
  Synthetic
gtgcgtttcaaucaccactaaaucaat

SEQ ID NO: 85598 - DNA, 28 bp, Artificial Sequence
  Synthetic
aacagaacttacuactgagactuggaga

SEQ ID NO: 85599 - DNA, 24 bp, Artificial Sequence
  Synthetic
cctgagtgugacatgttctcucat

SEQ ID NO: 85600 - DNA, 26 bp, Artificial Sequence
  Synthetic
agtctgtctutactacactgucccaa

SEQ ID NO: 85601 - DNA, 24 bp, Artificial Sequence
  Synthetic
ggacttccagucttctcgatacug

SEQ ID NO: 85602 - DNA, 22 bp, Artificial Sequence
  Synthetic
gtuctagcactcugaccagcaa

SEQ ID NO: 85603 - DNA, 22 bp, Artificial Sequence
  Synthetic
tcactcaucctcatcucgaggt

SEQ ID NO: 85604 - DNA, 33 bp, Artificial Sequence; identical to SEQ ID NO: 59000
  Synthetic

SEQ ID NO: 85605 - DNA, 28 bp, Artificial Sequence
  Synthetic
acctgaacagtautctggagttacguat

SEQ ID NO: 85606 - DNA, 29 bp, Artificial Sequence
  Synthetic
tgtttttacagagguaaataccggatugt

SEQ ID NO: 85607 - DNA, 26 bp, Artificial Sequence
  Synthetic
ccagtgtccauccataggtttaacut

SEQ ID NO: 85608 - DNA, 22 bp, Artificial Sequence
  Synthetic
cuaaagggacagcctuggagaa

SEQ ID NO: 85609 - DNA, 22 bp, Artificial Sequence
  Synthetic
aggtgaaggcccuaaggaguag

SEQ ID NO: 85610 - DNA, 26 bp, Artificial Sequence
  Synthetic
gcatctgtaucaggcaaagtcauaga

SEQ ID NO: 85611 - DNA, 29 bp, Artificial Sequence
  Synthetic
gtagctaactaacutcagaacaccaacut

SEQ ID NO: 85612 - DNA, 22 bp, Artificial Sequence
  Synthetic
ccagctggaguttggtcatgut

SEQ ID NO: 85613 - DNA, 23 bp, Artificial Sequence
  Synthetic
ctgacuggcaattgtgucaacag

SEQ ID NO: 85614 - DNA, 21 bp, Artificial Sequence
  Synthetic
tgggaacaaugtcatcagugg

SEQ ID NO: 85615 - DNA, 21 bp, Artificial Sequence
  Synthetic
atccugaccacctugcaagag

SEQ ID NO: 85616 - DNA, 21 bp, Artificial Sequence
  Synthetic
gctcagaugacagccggtuct

SEQ ID NO: 85617 - DNA, 23 bp, Artificial Sequence
  Synthetic
gaaccaagutctuccgagggaat

SEQ ID NO: 85618 - DNA, 18 bp, Artificial Sequence
  Synthetic
agctctgugccctgtgug

SEQ ID NO: 85619 - DNA, 17 bp, Artificial Sequence
  Synthetic
agcacguccagcaccut

SEQ ID NO: 85620 - DNA, 21 bp, Artificial Sequence
  Synthetic
gcaacccutgccuaggaagaa

SEQ ID NO: 85621 - DNA, 23 bp, Artificial Sequence
  Synthetic
ctgaagcggcauctcctgaaaua

SEQ ID NO: 85622 - DNA, 25 bp, Artificial Sequence
  Synthetic
gttcagattuaagcctgaggagcut

SEQ ID NO: 85623 - DNA, 27 bp, Artificial Sequence
  Synthetic
ccactgtgtttuctcctccattttuag

SEQ ID NO: 85624 - DNA, 21 bp, Artificial Sequence
  Synthetic
tgtguggacaagauccggaac

SEQ ID NO: 85625 - DNA, 26 bp, Artificial Sequence
  Synthetic
tccctttgtuaagctcaacacuagac

SEQ ID NO: 85626 - DNA, 22 bp, Artificial Sequence
  Synthetic
ctgcugcagaaggaaagcatut

SEQ ID NO: 85627 - DNA, 27 bp, Artificial Sequence
  Synthetic
gatggagggaguagaactggtaauact

SEQ ID NO: 85628 - DNA, 28 bp, Artificial Sequence
  Synthetic
tgcataactgaacugtaagccaagauat

SEQ ID NO: 85629 - DNA, 24 bp, Artificial Sequence
  Synthetic
agcaggaaaaacccutgttagcut

SEQ ID NO: 85630 - DNA, 25 bp, Artificial Sequence
  Synthetic
cagtcucaaagtctguaaccccaat

SEQ ID NO: 85631 - DNA, 23 bp, Artificial Sequence
  Synthetic
ctggaacugcttcactagauccc

SEQ ID NO: 85632 - DNA, 28 bp, Artificial Sequence
  Synthetic
gcutaatgtttgaaatucacggaagaga

SEQ ID NO: 85633 - DNA, 25 bp, Artificial Sequence
  Synthetic
gtaacaatautgcatgcuccagagg

SEQ ID NO: 85634 - DNA, 20 bp, Artificial Sequence
  Synthetic
tctcgggauagatggccuca

SEQ ID NO: 85635 - DNA, 26 bp, Artificial Sequence
  Synthetic
aataacatgcucaaccttgtctguct

SEQ ID NO: 85636 - DNA, 23 bp, Artificial Sequence
  Synthetic
tcagccatuaccttgtcatgugg

SEQ ID NO: 85637 - DNA, 28 bp, Artificial Sequence
  Synthetic
agtatcatccatugcccttttcttgaut

SEQ ID NO: 85638 - DNA, 26 bp, Artificial Sequence
  Synthetic
gtctacatguccattcctuacagcat

SEQ ID NO: 85639 - DNA, 21 bp, Artificial Sequence
  Synthetic
gacattttuggccgtctguca

SEQ ID NO: 85640 - DNA, 22 bp, Artificial Sequence
  Synthetic
ggcagacaacuactgaauccca

SEQ ID NO: 85641 - DNA, 28 bp, Artificial Sequence
  Synthetic
ggactggataugcacattttguagagat

SEQ ID NO: 85642 - DNA, 28 bp, Artificial Sequence
  Synthetic
tctactttgugacaaagtucagaaaggt

SEQ ID NO: 85643 - DNA, 24 bp, Artificial Sequence
  Synthetic
gctucccaatcgtucaacacaaaa

SEQ ID NO: 85644 - DNA, 28 bp, Artificial Sequence
  Synthetic
catagaagtucgttttgtgtugaacgat

SEQ ID NO: 85645 - DNA, 20 bp, Artificial Sequence
  Synthetic
ggtcuccgcaactgcattut

SEQ ID NO: 85646 - DNA, 28 bp, Artificial Sequence
  Synthetic
ttttcactgcauatggtctatgtgugat

SEQ ID NO: 85647 - DNA, 23 bp, Artificial Sequence
  Synthetic
cccttgaugagctcagggttuag

SEQ ID NO: 85648 - DNA, 23 bp, Artificial Sequence
  Synthetic
acataggaggauccaaaguggga

SEQ ID NO: 85649 - DNA, 23 bp, Artificial Sequence
  Synthetic
gcaggtaccuttcagcatctuca

SEQ ID NO: 85650 - DNA, 22 bp, Artificial Sequence
  Synthetic
gctcctgaguattggtgtucca

SEQ ID NO: 85651 - DNA, 22 bp, Artificial Sequence
  Synthetic
cccaaacaaaagcgauctccuc

SEQ ID NO: 85652 - DNA, 21 bp, Artificial Sequence
  Synthetic
cagcaccgauggcagaaagua

SEQ ID NO: 85653 - DNA, 27 bp, Artificial Sequence
  Synthetic
ccattttaccugcttcctcaaauagga

SEQ ID NO: 85654 - DNA, 28 bp, Artificial Sequence
  Synthetic
gcacatcctgauctcattgattgatcug

SEQ ID NO: 85655 - DNA, 27 bp, Artificial Sequence
  Synthetic
cattcagtggtautcctagtgacacut

SEQ ID NO: 85656 - DNA, 22 bp, Artificial Sequence
  Synthetic
cutccatcugaaaggcagagca

SEQ ID NO: 85657 - DNA, 20 bp, Artificial Sequence
  Synthetic
agccgctcuagaacagcaut

SEQ ID NO: 85658 - DNA, 23 bp, Artificial Sequence
  Synthetic
gctaucacagaacccguaacagt

SEQ ID NO: 85659 - DNA, 28 bp, Artificial Sequence
  Synthetic
caagaagatgttatuagcaggaccacut

SEQ ID NO: 85660 - DNA, 22 bp, Artificial Sequence
  Synthetic
cctgagautttggcctugcaaa

SEQ ID NO: 85661 - DNA, 22 bp, Artificial Sequence
  Synthetic
gatccttucgaaccgccaaaug

SEQ ID NO: 85662 - DNA, 29 bp, Artificial Sequence
  Synthetic
caatcatattcaacutctggcttuccaat

SEQ ID NO: 85663 - DNA, 21 bp, Artificial Sequence
  Synthetic
cccaguccagggaagtagcut

SEQ ID NO: 85664 - DNA, 21 bp, Artificial Sequence
  Synthetic
tggtttctucaggcaccauga

SEQ ID NO: 85665 - DNA, 24 bp, Artificial Sequence
  Synthetic
cgtttcctguttgaccttttcucc

SEQ ID NO: 85666 - DNA, 24 bp, Artificial Sequence
  Synthetic
acttgcauggactgtgttatuggt

SEQ ID NO: 85667 - DNA, 22 bp, Artificial Sequence
  Synthetic
gagctagttcugtccactgguc

SEQ ID NO: 85668 - DNA, 22 bp, Artificial Sequence
  Synthetic
gctggaccaguggacagaacua

SEQ ID NO: 85669 - DNA, 28 bp, Artificial Sequence
  Synthetic
tccacagaactuataaaaacctttgugt

SEQ ID NO: 85670 - DNA, 24 bp, Artificial Sequence
  Synthetic
aacaccaaggaaaaugagggacut

SEQ ID NO: 85671 - DNA, 28 bp, Artificial Sequence
  Synthetic
agtuctaaaaacttgatuaccgcagaca

SEQ ID NO: 85672 - DNA, 22 bp, Artificial Sequence
  Synthetic
gtctacgagcucccatucaaca

SEQ ID NO: 85673 - DNA, 20 bp, Artificial Sequence
  Synthetic
gaaaccugcccagaggaguc

SEQ ID NO: 85674 - DNA, 28 bp, Artificial Sequence
  Synthetic
actagaacttgtutgtggcatatctuca

SEQ ID NO: 85675 - DNA, 28 bp, Artificial Sequence
  Synthetic
ttgttgatgttcautcttccttctucct

SEQ ID NO: 85676 - DNA, 22 bp, Artificial Sequence
  Synthetic
acctgccaccgutttcctttua

SEQ ID NO: 85677 - DNA, 28 bp, Artificial Sequence
  Synthetic
caccatgatgaaugggatatgtauccat

SEQ ID NO: 85678 - DNA, 26 bp, Artificial Sequence
  Synthetic
tttaggttgcaguttcatcactguct

SEQ ID NO: 85679 - DNA, 25 bp, Artificial Sequence
  Synthetic
gctctgactgcugcaatatccaaut

SEQ ID NO: 85680 - DNA, 24 bp, Artificial Sequence
  Synthetic
tcaaaatttcccugtctgccgtua

SEQ ID NO: 85681 - DNA, 28 bp, Artificial Sequence
  Synthetic
tcctttttgcgutctcattacagtauga

SEQ ID NO: 85682 - DNA, 25 bp, Artificial Sequence
  Synthetic
tcactgtcugcggtaatcaagttut

SEQ ID NO: 85683 - DNA, 24 bp, Artificial Sequence
  Synthetic
acctgaaaaaggutaagggctcug

SEQ ID NO: 85684 - DNA, 26 bp, Artificial Sequence
  Synthetic
tgaaattggauattgcagcagucaga

SEQ ID NO: 85685 - DNA, 31 bp, Artificial Sequence; identical to SEQ ID NO: 52781
  Synthetic

SEQ ID NO: 85686 - DNA, 22 bp, Artificial Sequence
  Synthetic
gcattcugagggctgtcatcut

SEQ ID NO: 85687 - DNA, 22 bp, Artificial Sequence
  Synthetic
cgaactttcuccctggucacac

SEQ ID NO: 85688 - DNA, 22 bp, Artificial Sequence
  Synthetic
gctcatugcggaagttcctcut

SEQ ID NO: 85689 - DNA, 18 bp, Artificial Sequence
  Synthetic
gtcgcuggttctcguggt

SEQ ID NO: 85690 - DNA, 21 bp, Artificial Sequence
  Synthetic
ggutttccgaugaccaggact

SEQ ID NO: 85691 - DNA, 21 bp, Artificial Sequence
  Synthetic
agatagugcccctggaagugt

SEQ ID NO: 85692 - DNA, 27 bp, Artificial Sequence
  Synthetic
attccttctcucaactgagtcuaaacc

SEQ ID NO: 85693 - DNA, 24 bp, Artificial Sequence
  Synthetic
ccacaccaggacucatacagguaa

SEQ ID NO: 85694 - DNA, 20 bp, Artificial Sequence
  Synthetic
gaggctccaucgctgaagua

SEQ ID NO: 85695 - DNA, 22 bp, Artificial Sequence
  Synthetic
cacagacaaggagcucagugac

SEQ ID NO: 85696 - DNA, 20 bp, Artificial Sequence
  Synthetic
ctcccugaggctgagugaac

SEQ ID NO: 85697 - DNA, 23 bp, Artificial Sequence
  Synthetic
gtggagcaaacaaugacgaugac

SEQ ID NO: 85698 - DNA, 18 bp, Artificial Sequence
  Synthetic
tccacccuccuccaggac

SEQ ID NO: 85699 - DNA, 23 bp, Artificial Sequence
  Synthetic
ggagaugauggagagggaaagga

SEQ ID NO: 85700 - DNA, 19 bp, Artificial Sequence
  Synthetic
tctccactucaccccguca

SEQ ID NO: 85701 - DNA, 25 bp, Artificial Sequence
  Synthetic
ggttaaggugaactggttctcauct

SEQ ID NO: 85702 - DNA, 28 bp, Artificial Sequence
  Synthetic
gcagcctaaaacauagaaagtcactuct

SEQ ID NO: 85703 - DNA, 21 bp, Artificial Sequence
  Synthetic
gctgcttgccuccattagtug

SEQ ID NO: 85704 - DNA, 23 bp, Artificial Sequence
  Synthetic
actgggtauggtggtttctcuca

SEQ ID NO: 85705 - DNA, 21 bp, Artificial Sequence
  Synthetic
gacagagcuccaagaggugac

SEQ ID NO: 85706 - DNA, 19 bp, Artificial Sequence
  Synthetic
gggcttgguaacgtccugt

SEQ ID NO: 85707 - DNA, 18 bp, Artificial Sequence
  Synthetic
ctccaugcccctcacuca

SEQ ID NO: 85708 - DNA, 27 bp, Artificial Sequence
  Synthetic
caugctgtattcauggaaaaccaagat

SEQ ID NO: 85709 - DNA, 27 bp, Artificial Sequence
  Synthetic
ggaaagctautgcagagaucaagaaaa

SEQ ID NO: 85710 - DNA, 24 bp, Artificial Sequence
  Synthetic
aacaacaggautctcagggaaugg

SEQ ID NO: 85711 - DNA, 20 bp, Artificial Sequence
  Synthetic
tctccgugcagucggaaaaa

SEQ ID NO: 85712 - DNA, 22 bp, Artificial Sequence
  Synthetic
agttcguggacatcttucagca

SEQ ID NO: 85713 - DNA, 26 bp, Artificial Sequence
  Synthetic
ctgaccctuagccagtatcuaaacat

SEQ ID NO: 85714 - DNA, 21 bp, Artificial Sequence
  Synthetic
caccaugctgaaguccaggag

SEQ ID NO: 85715 - DNA, 21 bp, Artificial Sequence
  Synthetic
aactcttcucccctccctgut

SEQ ID NO: 85716 - DNA, 28 bp, Artificial Sequence
  Synthetic
acttcttcaaaaguctccaggttttcut

SEQ ID NO: 85717 - DNA, 25 bp, Artificial Sequence
  Synthetic
ctcttctcaacgggutccttttcua

SEQ ID NO: 85718 - DNA, 22 bp, Artificial Sequence
  Synthetic
catagcctuggcccatgtgaua

SEQ ID NO: 85719 - DNA, 23 bp, Artificial Sequence
  Synthetic
gatgctgctuacaaaaggagcug

SEQ ID NO: 85720 - DNA, 27 bp, Artificial Sequence
  Synthetic
ctttcttctccutataggttgccauca

SEQ ID NO: 85721 - DNA, 24 bp, Artificial Sequence
  Synthetic
ggaaggagttucacccaagatugt

SEQ ID NO: 85722 - DNA, 28 bp, Artificial Sequence
  Synthetic
aatgtgaagaaaaguttacgcacttgut

SEQ ID NO: 85723 - DNA, 25 bp, Artificial Sequence
  Synthetic
ggctagacctuctctgtccattuag

SEQ ID NO: 85724 - DNA, 28 bp, Artificial Sequence
  Synthetic
ggtcatttagaaaguttgtcagtccugt

SEQ ID NO: 85725 - DNA, 22 bp, Artificial Sequence
  Synthetic
cggtccugaagaaatgcugaga

SEQ ID NO: 85726 - DNA, 28 bp, Artificial Sequence
  Synthetic
agatgugagaccgaaagaaattauccag

SEQ ID NO: 85727 - DNA, 20 bp, Artificial Sequence
  Synthetic
actacaaggccuccctccut

SEQ ID NO: 85728 - DNA, 27 bp, Artificial Sequence
  Synthetic
tgttggaugcaaacagtaatattugga

SEQ ID NO: 85729 - DNA, 25 bp, Artificial Sequence
  Synthetic
ctgtttttcucagccttgctuaact

SEQ ID NO: 85730 - DNA, 25 bp, Artificial Sequence
  Synthetic
tgacuaggaacgtgagtuaagcaag

SEQ ID NO: 85731 - DNA, 21 bp, Artificial Sequence
  Synthetic
actgctccauctcctggucaa

SEQ ID NO: 85732 - DNA, 19 bp, Artificial Sequence
  Synthetic
actcacccgcuttctcgut

SEQ ID NO: 85733 - DNA, 19 bp, Artificial Sequence
  Synthetic
gcccugcacgaactccauc

SEQ ID NO: 85734 - DNA, 20 bp, Artificial Sequence
  Synthetic
gtgcttcugacgcacaccua

SEQ ID NO: 85735 - DNA, 21 bp, Artificial Sequence
  Synthetic
gtucaagacagaagggccuga

SEQ ID NO: 85736 - DNA, 26 bp, Artificial Sequence
  Synthetic
tggctgttgttugatattctctccut

SEQ ID NO: 85737 - DNA, 21 bp, Artificial Sequence
  Synthetic
acutagtctcugggacgccat

SEQ ID NO: 85738 - DNA, 21 bp, Artificial Sequence
  Synthetic
cagcctccutctgtgagaugt

SEQ ID NO: 85739 - DNA, 20 bp, Artificial Sequence
  Synthetic
cccaggtuccagaggatugg

SEQ ID NO: 85740 - DNA, 23 bp, Artificial Sequence
  Synthetic
ttgagaaaggcugtgtgucagat

SEQ ID NO: 85741 - DNA, 21 bp, Artificial Sequence
  Synthetic
cctgcagaagcucttccugag

SEQ ID NO: 85742 - DNA, 17 bp, Artificial Sequence
  Synthetic
accgggugtacctggug

SEQ ID NO: 85743 - DNA, 21 bp, Artificial Sequence
  Synthetic
ttctcaccugctgctugacaa

SEQ ID NO: 85744 - DNA, 28 bp, Artificial Sequence
  Synthetic
tcaactcacuaacaagcatctatuagcc

SEQ ID NO: 85745 - DNA, 26 bp, Artificial Sequence
  Synthetic
gatcatcttcuagaggtggagcaauc

SEQ ID NO: 85746 - DNA, 23 bp, Artificial Sequence
  Synthetic
cttagacaggacccugcguaaac

SEQ ID NO: 85747 - DNA, 27 bp, Artificial Sequence
  Synthetic
gtgcaagguaggctattttaaguacca

SEQ ID NO: 85748 - DNA, 24 bp, Artificial Sequence
  Synthetic
cttctctgcgguttgaaagtacug

SEQ ID NO: 85749 - DNA, 27 bp, Artificial Sequence
  Synthetic
acaacttgcaaugagtatgcacattut

SEQ ID NO: 85750 - DNA, 24 bp, Artificial Sequence
  Synthetic
agacctcatucctctgtcttcuca

SEQ ID NO: 85751 - DNA, 20 bp, Artificial Sequence
  Synthetic
tccagguccagatccaccut

SEQ ID NO: 85752 - DNA, 21 bp, Artificial Sequence
  Synthetic
cagtggucagacctgctcaua

SEQ ID NO: 85753 - DNA, 25 bp, Artificial Sequence
  Synthetic
guaaagatggcuagagcccagaaag

SEQ ID NO: 85754 - DNA, 25 bp, Artificial Sequence
  Synthetic
tgtgtcaaggagutcgaagatucac

SEQ ID NO: 85755 - DNA, 24 bp, Artificial Sequence
  Synthetic
attgaaaatcutcctgcctuccct

SEQ ID NO: 85756 - DNA, 29 bp, Artificial Sequence
  Synthetic
ccaatctccctautttctcaagcattuct

SEQ ID NO: 85757 - DNA, 24 bp, Artificial Sequence
  Synthetic
ggagaagugactgatctgtugcat

SEQ ID NO: 85758 - DNA, 27 bp, Artificial Sequence
  Synthetic
ttcggaaatugaagaaatctgccuagt

SEQ ID NO: 85759 - DNA, 20 bp, Artificial Sequence
  Synthetic
gcggguccggatatgaauga

SEQ ID NO: 85760 - DNA, 26 bp, Artificial Sequence
  Synthetic
caagaagtggagaaugtcagtcugag

SEQ ID NO: 85761 - DNA, 23 bp, Artificial Sequence
  Synthetic
cagaccctcucactcatgtgaug

SEQ ID NO: 85762 - DNA, 24 bp, Artificial Sequence
  Synthetic
cagaagaggauaggcagaaacuca

SEQ ID NO: 85763 - DNA, 22 bp, Artificial Sequence
  Synthetic
agtgatgaugggactcagggut

SEQ ID NO: 85764 - DNA, 23 bp, Artificial Sequence
  Synthetic
ctgggauggagggaagauaaacc

SEQ ID NO: 85765 - DNA, 22 bp, Artificial Sequence
  Synthetic
gcctatcatguggcagctcuac

SEQ ID NO: 85766 - DNA, 26 bp, Artificial Sequence
  Synthetic
ctggtgtttuaggaccattctgttug

SEQ ID NO: 85767 - DNA, 24 bp, Artificial Sequence
  Synthetic
tcaatgattcugactccggcatut

SEQ ID NO: 85768 - DNA, 22 bp, Artificial Sequence
  Synthetic
agacgcagagucagttttuccc

SEQ ID NO: 85769 - DNA, 28 bp, Artificial Sequence
  Synthetic
aataccaacacaaacutgtacacccuat

SEQ ID NO: 85770 - DNA, 26 bp, Artificial Sequence
  Synthetic
gcctttttataugagccaacaacuca

SEQ ID NO: 85771 - DNA, 25 bp, Artificial Sequence
  Synthetic
gagacctaaaagautgcccactcut

SEQ ID NO: 85772 - DNA, 21 bp, Artificial Sequence
  Synthetic
gaactgaggugacatgggcut

SEQ ID NO: 85773 - DNA, 19 bp, Artificial Sequence
  Synthetic
ctgtgucgggacccctuac

SEQ ID NO: 85774 - DNA, 22 bp, Artificial Sequence
  Synthetic
agtgtugagcaaaagccgagua

SEQ ID NO: 85775 - DNA, 27 bp, Artificial Sequence
  Synthetic
tctcatcgagauattaagcgaaugcag

SEQ ID NO: 85776 - DNA, 21 bp, Artificial Sequence
  Synthetic
tgtactgagcaugaccccugt

SEQ ID NO: 85777 - DNA, 26 bp, Artificial Sequence
  Synthetic
agcaggagguttatctgacatttugg

SEQ ID NO: 85778 - DNA, 23 bp, Artificial Sequence
  Synthetic
gtgtgaagccautgtccagtcua

SEQ ID NO: 85779 - DNA, 21 bp, Artificial Sequence
  Synthetic
acctaccguaaactcggguca

SEQ ID NO: 85780 - DNA, 20 bp, Artificial Sequence
  Synthetic
gccagcaacuacctgcacut

SEQ ID NO: 85781 - DNA, 20 bp, Artificial Sequence
  Synthetic
gtctguccagccactauggg

SEQ ID NO: 85782 - DNA, 24 bp, Artificial Sequence
  Synthetic
ggttatctggaautcccacgguaa

SEQ ID NO: 85783 - DNA, 24 bp, Artificial Sequence
  Synthetic
caccaacaacuttcgucaacacag

SEQ ID NO: 85784 - DNA, 22 bp, Artificial Sequence
  Synthetic
accacacauggcaatcccauac

SEQ ID NO: 85785 - DNA, 23 bp, Artificial Sequence
  Synthetic
tttggattgtguccgttgagcua

SEQ ID NO: 85786 - DNA, 21 bp, Artificial Sequence
  Synthetic
atcaacaggaauggctgcuca

SEQ ID NO: 85787 - DNA, 26 bp, Artificial Sequence
  Synthetic
gtcagttctcucaagaggtcttucag

SEQ ID NO: 85788 - DNA, 27 bp, Artificial Sequence
  Synthetic
ggacatcagtuacatcttcccatugac

SEQ ID NO: 85789 - DNA, 28 bp, Artificial Sequence
  Synthetic
tgaaggcacuaacugagaaaaacaaaga

SEQ ID NO: 85790 - DNA, 21 bp, Artificial Sequence
  Synthetic
ggatcgguatcgtccaucagg

SEQ ID NO: 85791 - DNA, 25 bp, Artificial Sequence
  Synthetic
tgaaagtatgcccugtccttttcut

SEQ ID NO: 85792 - DNA, 23 bp, Artificial Sequence
  Synthetic
tgcgatccugagcaattucaagt

SEQ ID NO: 85793 - DNA, 26 bp, Artificial Sequence
  Synthetic
tggcagttgcauaaaaacactcatug

SEQ ID NO: 85794 - DNA, 28 bp, Artificial Sequence
  Synthetic
tcgcattacttaauttaggcagttcuga

SEQ ID NO: 85795 - DNA, 28 bp, Artificial Sequence
  Synthetic
caacactgcauaccttccaattuacaat

SEQ ID NO: 85796 - DNA, 23 bp, Artificial Sequence
  Synthetic
cacactgggacutgtgtttagug

SEQ ID NO: 85797 - DNA, 23 bp, Artificial Sequence
  Synthetic
cctcaccugctacttuaagccat

SEQ ID NO: 85798 - DNA, 21 bp, Artificial Sequence
  Synthetic
tgaccugccttggttuaacgg

SEQ ID NO: 85799 - DNA, 25 bp, Artificial Sequence
  Synthetic
ccatccaucccaagatccatctgua

SEQ ID NO: 85800 - DNA, 24 bp, Artificial Sequence
  Synthetic
ccagctcctcutcaaagactcauc

SEQ ID NO: 85801 - DNA, 24 bp, Artificial Sequence
  Synthetic
actatgagagcutctcctgtguct

SEQ ID NO: 85802 - DNA, 24 bp, Artificial Sequence
  Synthetic
ttgtttgtttccugtctggacuga

SEQ ID NO: 85803 - DNA, 21 bp, Artificial Sequence
  Synthetic
ctucacagcagaacagcugga

SEQ ID NO: 85804 - DNA, 17 bp, Artificial Sequence
  Synthetic
ccagccucacctugcca

SEQ ID NO: 85805 - DNA, 19 bp, Artificial Sequence
  Synthetic
gggtcacgugtgtctccut

SEQ ID NO: 85806 - DNA, 24 bp, Artificial Sequence
  Synthetic
ccagccucugagagaaacacaaat

SEQ ID NO: 85807 - DNA, 21 bp, Artificial Sequence
  Synthetic
tctgcatgcuattggcctguc

SEQ ID NO: 85808 - DNA, 21 bp, Artificial Sequence
  Synthetic
ggaaggcucaagccauccaat

SEQ ID NO: 85809 - DNA, 23 bp, Artificial Sequence
  Synthetic
gaatcccuaactcccuccaaacc

SEQ ID NO: 85810 - DNA, 23 bp, Artificial Sequence
  Synthetic
ccagcagtcugagcagttaguaa

SEQ ID NO: 85811 - DNA, 22 bp, Artificial Sequence
  Synthetic
cactuggaaacaggcttuggaa

SEQ ID NO: 85812 - DNA, 22 bp, Artificial Sequence
  Synthetic
gacttgucagaggccattgcua

SEQ ID NO: 85813 - DNA, 20 bp, Artificial Sequence
  Synthetic
gccuctggcuggaaaccaag

SEQ ID NO: 85814 - DNA, 20 bp, Artificial Sequence
  Synthetic
gctgauagctgtugccgact

SEQ ID NO: 85815 - DNA, 20 bp, Artificial Sequence
  Synthetic
gtgcgtaucgactcgaugct

SEQ ID NO: 85816 - DNA, 23 bp, Artificial Sequence
  Synthetic
cagggccagagaguagagagtua

SEQ ID NO: 85817 - DNA, 21 bp, Artificial Sequence
  Synthetic
ccaccccucaaaccctatcut

SEQ ID NO: 85818 - DNA, 22 bp, Artificial Sequence
  Synthetic
agagggcaagaggguttcacua

SEQ ID NO: 85819 - DNA, 26 bp, Artificial Sequence
  Synthetic
gtccaagagacuctgaagttacucac

SEQ ID NO: 85820 - DNA, 25 bp, Artificial Sequence
  Synthetic
aagaagtgagucaagcagtaugcaa

SEQ ID NO: 85821 - DNA, 27 bp, Artificial Sequence
  Synthetic
ggacaaaaatgaaugcctttcgaaucc

SEQ ID NO: 85822 - DNA, 32 bp, Artificial Sequence
  Synthetic
atatatatgaaguaccaatgacttcctttucc

SEQ ID NO: 85823 - DNA, 23 bp, Artificial Sequence
  Synthetic
tggtactcaccutgtccacgaua

SEQ ID NO: 85824 - DNA, 33 bp, Artificial Sequence
  Synthetic
tttaagcttagaactutagtcagtctagaatut

SEQ ID NO: 85825 - DNA, 28 bp, Artificial Sequence
  Synthetic
aggttaattcatcacugtgcctagatut

SEQ ID NO: 85826 - DNA, 31 bp, Artificial Sequence
  Synthetic
ttttacctauaggctgacaaagaugaacaaa

SEQ ID NO: 85827 - DNA, 28 bp, Artificial Sequence
  Synthetic
tgtccctgguctgattaatttctttuga

SEQ ID NO: 85828 - DNA, 21 bp, Artificial Sequence
  Synthetic
tctcaaaagcacgcuccagut

SEQ ID NO: 85829 - DNA, 26 bp, Artificial Sequence
  Synthetic
tgttttgttcutctgtgctttuagcc

SEQ ID NO: 85830 - DNA, 25 bp, Artificial Sequence
  Synthetic
gcccatttagaagutcagagaguga

SEQ ID NO: 85831 - DNA, 27 bp, Artificial Sequence
  Synthetic
caaccagtugacagtgaactcatuaaa

SEQ ID NO: 85832 - DNA, 21 bp, Artificial Sequence
  Synthetic
ccaaguggacacagggacuat

SEQ ID NO: 85833 - DNA, 21 bp, Artificial Sequence
  Synthetic
atgggccugttcgtccttuag

SEQ ID NO: 85834 - DNA, 28 bp, Artificial Sequence
  Synthetic
gtgatgaattaaccucactgttgggaua

SEQ ID NO: 85835 - DNA, 31 bp, Artificial Sequence
  Synthetic
tctattacatcuccaaatgttgcaactuact

SEQ ID NO: 85836 - DNA, 26 bp, Artificial Sequence
  Synthetic
ttcctgguagaacaataaggtccuct

SEQ ID NO: 85837 - DNA, 25 bp, Artificial Sequence
  Synthetic
tgaaaaagugaagtcctgcucagaa

SEQ ID NO: 85838 - DNA, 24 bp, Artificial Sequence
  Synthetic
aaattatacgugacctguggcgaa

SEQ ID NO: 85839 - DNA, 20 bp, Artificial Sequence
  Synthetic
ggguccagggaggtaaugct

SEQ ID NO: 85840 - DNA, 21 bp, Artificial Sequence
  Synthetic
gcccacutgguggaagaacag

SEQ ID NO: 85841 - DNA, 23 bp, Artificial Sequence
  Synthetic
caccgcucagauaaggaacagag

SEQ ID NO: 85842 - DNA, 24 bp, Artificial Sequence
  Synthetic
ctgtcctttcugactgcatccuat

SEQ ID NO: 85843 - DNA, 21 bp, Artificial Sequence
  Synthetic
gtacugccagctcactucact

SEQ ID NO: 85844 - DNA, 23 bp, Artificial Sequence
  Synthetic
acttgcaaccuttccttgaaguc

SEQ ID NO: 85845 - DNA, 22 bp, Artificial Sequence
  Synthetic
gagtactcggugtcaaacugct

SEQ ID NO: 85846 - DNA, 20 bp, Artificial Sequence
  Synthetic
gcacagaacgguguccagag

SEQ ID NO: 85847 - DNA, 21 bp, Artificial Sequence
  Synthetic
cagcttgcggaucttgtagug

SEQ ID NO: 85848 - DNA, 20 bp, Artificial Sequence
  Synthetic
ctgcagcgagguatggacuc

SEQ ID NO: 85849 - DNA, 19 bp, Artificial Sequence
  Synthetic
gtgacgccguagtcgagua

SEQ ID NO: 85850 - DNA, 20 bp, Artificial Sequence
  Synthetic
cccgtagcucgagaguacaa

SEQ ID NO: 85851 - DNA, 18 bp, Artificial Sequence
  Synthetic
caggcccuctgttgccua

SEQ ID NO: 85852 - DNA, 28 bp, Artificial Sequence
  Synthetic
aacttgaggutgctaactaugaaacact

SEQ ID NO: 85853 - DNA, 23 bp, Artificial Sequence
  Synthetic
ccttcagcacutctttugagcac

SEQ ID NO: 85854 - DNA, 19 bp, Artificial Sequence
  Synthetic
ccaagggccucaacgugaa

SEQ ID NO: 85855 - DNA, 19 bp, Artificial Sequence
  Synthetic
cccagaguctgcagcugag

SEQ ID NO: 85856 - DNA, 21 bp, Artificial Sequence
  Synthetic
cactgtcucagccagaggtug

SEQ ID NO: 85857 - DNA, 26 bp, Artificial Sequence
  Synthetic
acttctguggagacaccctacttuat

SEQ ID NO: 85858 - DNA, 22 bp, Artificial Sequence
  Synthetic
tgtgttgacugtggcatcugaa

SEQ ID NO: 85859 - DNA, 28 bp, Artificial Sequence
  Synthetic
ctcaatggaaaaagaaguaggtaacugt

SEQ ID NO: 85860 - DNA, 23 bp, Artificial Sequence
  Synthetic
ctcttcatgggugagggtaguct

SEQ ID NO: 85861 - DNA, 21 bp, Artificial Sequence
  Synthetic
agaagaggaucacccugggat

SEQ ID NO: 85862 - DNA, 21 bp, Artificial Sequence
  Synthetic
gccatcgugtcgtgtgttuac

SEQ ID NO: 85863 - DNA, 21 bp, Artificial Sequence
  Synthetic
gacgtccucctttccaggaut

SEQ ID NO: 85864 - DNA, 22 bp, Artificial Sequence
  Synthetic
gauggtatguaacagcgaccgt

SEQ ID NO: 85865 - DNA, 27 bp, Artificial Sequence
  Synthetic
gctactggaaaacautcaaaactggut

SEQ ID NO: 85866 - DNA, 26 bp, Artificial Sequence
  Synthetic
gggtcaggutttatcaactcauagca

SEQ ID NO: 85867 - DNA, 28 bp, Artificial Sequence
  Synthetic
gacttcagttguctttgtttctctucag

SEQ ID NO: 85868 - DNA, 21 bp, Artificial Sequence
  Synthetic
ctacccccagaacutcagguc

SEQ ID NO: 85869 - DNA, 26 bp, Artificial Sequence
  Synthetic
agcctggtcauttcacatatttucct

SEQ ID NO: 85870 - DNA, 24 bp, Artificial Sequence
  Synthetic
ggagggccuttaaaatgaggtuct

SEQ ID NO: 85871 - DNA, 28 bp, Artificial Sequence
  Synthetic
gctaagcattgucccatcattcaataug

SEQ ID NO: 85872 - DNA, 20 bp, Artificial Sequence
  Synthetic
ctccgaaacccacacuccug

SEQ ID NO: 85873 - DNA, 20 bp, Artificial Sequence
  Synthetic
cgtgactguggcgctcatua

SEQ ID NO: 85874 - DNA, 20 bp, Artificial Sequence
  Synthetic
gtaaagcgggcugggaugat

SEQ ID NO: 85875 - DNA, 22 bp, Artificial Sequence
  Synthetic
cagcaaaaatucctcctggugt

SEQ ID NO: 85876 - DNA, 22 bp, Artificial Sequence
  Synthetic
acaagttccuccattcuggcat

SEQ ID NO: 85877 - DNA, 28 bp, Artificial Sequence
  Synthetic
caccaagtccugtatttcactctaugac

SEQ ID NO: 85878 - DNA, 28 bp, Artificial Sequence
  Synthetic
agtggctaaaugaatatctctgcttugt

SEQ ID NO: 85879 - DNA, 28 bp, Artificial Sequence
  Synthetic
ggttttccaatutactgaaagcaugagg

SEQ ID NO: 85880 - DNA, 22 bp, Artificial Sequence
  Synthetic
cctccagccccucctatagaut

SEQ ID NO: 85881 - DNA, 28 bp, Artificial Sequence
  Synthetic
ctgtcgatgataugaattcccatgauga

SEQ ID NO: 85882 - DNA, 21 bp, Artificial Sequence
  Synthetic
agagagggugggtgacagaut

SEQ ID NO: 85883 - DNA, 23 bp, Artificial Sequence
  Synthetic
cactaacctuccttctcccctug

SEQ ID NO: 85884 - DNA, 21 bp, Artificial Sequence
  Synthetic
ctcaaagggcuccactggtut

SEQ ID NO: 85885 - DNA, 20 bp, Artificial Sequence
  Synthetic
tgatgcttucacggcuccat

SEQ ID NO: 85886 - DNA, 24 bp, Artificial Sequence
  Synthetic
gutggaagagtuaaaagcccgaac

SEQ ID NO: 85887 - DNA, 28 bp, Artificial Sequence
  Synthetic
tgcaattcaacucaggaaaagtauccat

SEQ ID NO: 85888 - DNA, 23 bp, Artificial Sequence
  Synthetic
tcaaagtccagacaugcaaccut

SEQ ID NO: 85889 - DNA, 29 bp, Artificial Sequence
  Synthetic
aatttctgctttcuagccatcaagaguat

SEQ ID NO: 85890 - DNA, 28 bp, Artificial Sequence
  Synthetic
tgagacaacagaagcautatactgctut

SEQ ID NO: 85891 - DNA, 25 bp, Artificial Sequence
  Synthetic
ctggagtgtguggaggaattacaut

SEQ ID NO: 85892 - DNA, 21 bp, Artificial Sequence
  Synthetic
ctacccuaggtgcucaggact

SEQ ID NO: 85893 - DNA, 26 bp, Artificial Sequence
  Synthetic
ccctttcuagggccatctgaatuaga

SEQ ID NO: 85894 - DNA, 24 bp, Artificial Sequence
  Synthetic
gtgatggatcuggctaagcatcut

SEQ ID NO: 85895 - DNA, 28 bp, Artificial Sequence
  Synthetic
tcaagcaaatttcuatgagtcagcctua

SEQ ID NO: 85896 - DNA, 19 bp, Artificial Sequence
  Synthetic
ggactgacuggcacctcut

SEQ ID NO: 85897 - DNA, 20 bp, Artificial Sequence
  Synthetic
gcctggaucaccttctgguc

SEQ ID NO: 85898 - DNA, 24 bp, Artificial Sequence
  Synthetic
gcttgttgutggctatacugaggt

SEQ ID NO: 85899 - DNA, 25 bp, Artificial Sequence
  Synthetic
ctgcttctgugttttcccttttuca

SEQ ID NO: 85900 - DNA, 18 bp, Artificial Sequence
  Synthetic
ggaccccagcaucugcac

SEQ ID NO: 85901 - DNA, 20 bp, Artificial Sequence
  Synthetic
atgtgccagaugcaccucaa

SEQ ID NO: 85902 - DNA, 20 bp, Artificial Sequence
  Synthetic
gttgcccugggtcctcttua

SEQ ID NO: 85903 - DNA, 27 bp, Artificial Sequence
  Synthetic
ctgcctcaugaaagcctttatctttut

SEQ ID NO: 85904 - DNA, 18 bp, Artificial Sequence
  Synthetic
ggtcugcgctttguccga

SEQ ID NO: 85905 - DNA, 21 bp, Artificial Sequence
  Synthetic
cugtcccuggaggagaaagac

SEQ ID NO: 85906 - DNA, 28 bp, Artificial Sequence
  Synthetic
tttaaactcagcautccatccctaugaa

SEQ ID NO: 85907 - DNA, 29 bp, Artificial Sequence
  Synthetic
agattgtctgtttugttgggttttgtuac

SEQ ID NO: 85908 - DNA, 21 bp, Artificial Sequence
  Synthetic
gcagccaaguacaagcucaac

SEQ ID NO: 85909 - DNA, 18 bp, Artificial Sequence
  Synthetic
gcguccaccatucacgct

SEQ ID NO: 85910 - DNA, 24 bp, Artificial Sequence
  Synthetic
cccctgccauttgtatatcgtuga

SEQ ID NO: 85911 - DNA, 26 bp, Artificial Sequence
  Synthetic
ccacutcaguaagaccagaaagaacc

SEQ ID NO: 85912 - DNA, 28 bp, Artificial Sequence
  Synthetic
gttatttgatgugaactttgtgcctgut

SEQ ID NO: 85913 - DNA, 24 bp, Artificial Sequence
  Synthetic
gacaggaaagagcaaucacuagca

SEQ ID NO: 85914 - DNA, 25 bp, Artificial Sequence
  Synthetic
tgtgctaaaacuttgagtcccaugt

SEQ ID NO: 85915 - DNA, 27 bp, Artificial Sequence
  Synthetic
agcatgtagcgugctaaaatagcaaua

SEQ ID NO: 85916 - DNA, 17 bp, Artificial Sequence
  Synthetic
gcucccgcgcgttatug

SEQ ID NO: 85917 - DNA, 23 bp, Artificial Sequence
  Synthetic
acacaagtagcuggatacccuct

SEQ ID NO: 85918 - DNA, 28 bp, Artificial Sequence
  Synthetic
gttaaaaagctucacagtttgtcctugt

SEQ ID NO: 85919 - DNA, 25 bp, Artificial Sequence
  Synthetic
ggcctcagtucagtctcaatgtuag

SEQ ID NO: 85920 - DNA, 26 bp, Artificial Sequence
  Synthetic
tcatccttttcuctgagatgcttugg

SEQ ID NO: 85921 - DNA, 21 bp, Artificial Sequence
  Synthetic
caagtguacaaccctgtgugg

SEQ ID NO: 85922 - DNA, 28 bp, Artificial Sequence
  Synthetic
tcactggatccautgtgtatagtuacga

SEQ ID NO: 85923 - DNA, 28 bp, Artificial Sequence
  Synthetic
cacacctcaccugtaaaactcagtauat

SEQ ID NO: 85924 - DNA, 26 bp, Artificial Sequence
  Synthetic
actgaggaggaugataattgggtcua

SEQ ID NO: 85925 - DNA, 28 bp, Artificial Sequence
  Synthetic
cccatgtttcaucttcaacgtgaatuaa

SEQ ID NO: 85926 - DNA, 29 bp, Artificial Sequence
  Synthetic
gggaguacaacagaaacaaatuagagaac

SEQ ID NO: 85927 - DNA, 28 bp, Artificial Sequence
  Synthetic
gttgtcttctacuccatcttcaaaucca

SEQ ID NO: 85928 - DNA, 29 bp, Artificial Sequence
  Synthetic
cutggaaataaaguggaacgaaaagaaga

SEQ ID NO: 85929 - DNA, 24 bp, Artificial Sequence
  Synthetic
tcctgagacugctgttccaaaaut

SEQ ID NO: 85930 - DNA, 29 bp, Artificial Sequence
  Synthetic
tctccaactccuactttagaacaacauct

SEQ ID NO: 85931 - DNA, 21 bp, Artificial Sequence
  Synthetic
cggaccugtggctacuaagaa

SEQ ID NO: 85932 - DNA, 27 bp, Artificial Sequence
  Synthetic
tttacatagguggaatgaatggcugaa

SEQ ID NO: 85933 - DNA, 28 bp, Artificial Sequence
  Synthetic
agcggtataaucaggagttttuaaaggt

SEQ ID NO: 85934 - DNA, 29 bp, Artificial Sequence
  Synthetic
ggaaagagcttguttgatgtcgttagaua

SEQ ID NO: 85935 - DNA, 28 bp, Artificial Sequence
  Synthetic
gtgcttcctcuttatttagtaccucagt

SEQ ID NO: 85936 - DNA, 23 bp, Artificial Sequence
  Synthetic
tccagaucugagagaaccaggaa

SEQ ID NO: 85937 - DNA, 22 bp, Artificial Sequence
  Synthetic
agagtucacttaccuccaggca

SEQ ID NO: 85938 - DNA, 23 bp, Artificial Sequence
  Synthetic
cctacctctuccacgttgtuact

SEQ ID NO: 85939 - DNA, 29 bp, Artificial Sequence
  Synthetic
tggtaaacacaaautcctttccuagaact

SEQ ID NO: 85940 - DNA, 23 bp, Artificial Sequence
  Synthetic
ttttgtgacggucttggaaguga

SEQ ID NO: 85941 - DNA, 23 bp, Artificial Sequence
  Synthetic
aggaagagaagaagcutggucct

SEQ ID NO: 85942 - DNA, 27 bp, Artificial Sequence
  Synthetic
actgaactguacatgctcttcaucaac

SEQ ID NO: 85943 - DNA, 28 bp, Artificial Sequence
  Synthetic
gcacggaacagagcautcgttaattaua

SEQ ID NO: 85944 - DNA, 27 bp, Artificial Sequence
  Synthetic
ggcaaaagaaggaggutaactgtaauc

SEQ ID NO: 85945 - DNA, 28 bp, Artificial Sequence
  Synthetic
acatgtatcgaagcacaucaaagaguaa

SEQ ID NO: 85946 - DNA, 28 bp, Artificial Sequence
  Synthetic
gacatcttctttcutcctgatcaaguga

SEQ ID NO: 85947 - DNA, 32 bp, Artificial Sequence
  Synthetic
agattagtgcttatutcttcttttaggtaugt

SEQ ID NO: 85948 - DNA, 22 bp, Artificial Sequence
  Synthetic
ctgcactugcattgtctucaca

SEQ ID NO: 85949 - DNA, 33 bp, Artificial Sequence
  Synthetic
tctgtgtacagugaaatagtatatugaagaaca

SEQ ID NO: 85950 - DNA, 21 bp, Artificial Sequence
  Synthetic
gagcttuggcccttggtgaua

SEQ ID NO: 85951 - DNA, 21 bp, Artificial Sequence
  Synthetic
gutctcatcugcagaccccaa

SEQ ID NO: 85952 - DNA, 21 bp, Artificial Sequence
  Synthetic
ggtgcaggcaacauggtctua

SEQ ID NO: 85953 - DNA, 23 bp, Artificial Sequence
  Synthetic
cagcacauccgtatacacucagg

SEQ ID NO: 85954 - DNA, 21 bp, Artificial Sequence
  Synthetic
ctgaagggucagccttctcut

SEQ ID NO: 85955 - DNA, 23 bp, Artificial Sequence
  Synthetic
ccttggtcagcutctggatttug

SEQ ID NO: 85956 - DNA, 21 bp, Artificial Sequence
  Synthetic
gcaggauacagacgtcccuca

SEQ ID NO: 85957 - DNA, 21 bp, Artificial Sequence
  Synthetic
agccgugaagtuggagaagac

SEQ ID NO: 85958 - DNA, 23 bp, Artificial Sequence
  Synthetic
gtctggacaugatggctcgauac

SEQ ID NO: 85959 - DNA, 22 bp, Artificial Sequence
  Synthetic
cuagaagacagggagcgugaaa

SEQ ID NO: 85960 - DNA, 22 bp, Artificial Sequence
  Synthetic
acaggccautttccatgtuggt

SEQ ID NO: 85961 - DNA, 28 bp, Artificial Sequence
  Synthetic
atgacgccatautcttttagagcauact

SEQ ID NO: 85962 - DNA, 26 bp, Artificial Sequence
  Synthetic
cacagaagtuacaactgtagggctua

SEQ ID NO: 85963 - DNA, 23 bp, Artificial Sequence
  Synthetic
gtgctcacugacattctacucca

SEQ ID NO: 85964 - DNA, 29 bp, Artificial Sequence
  Synthetic
aaccuacaactatttauggagaacaagca

SEQ ID NO: 85965 - DNA, 22 bp, Artificial Sequence
  Synthetic
ccctccccuttaggtactguga

SEQ ID NO: 85966 - DNA, 24 bp, Artificial Sequence
  Synthetic
ggaataucacagatccgucacagg

SEQ ID NO: 85967 - DNA, 21 bp, Artificial Sequence
  Synthetic
tguagaagagcgcacgucaag

SEQ ID NO: 85968 - DNA, 27 bp, Artificial Sequence
  Synthetic
gtaaatgtgtcaaauactggcctgaug

SEQ ID NO: 85969 - DNA, 27 bp, Artificial Sequence
  Synthetic
acagttcccaaaguctctagaauacga

SEQ ID NO: 85970 - DNA, 21 bp, Artificial Sequence
  Synthetic
cttgatgcgugttgaggctug

SEQ ID NO: 85971 - DNA, 21 bp, Artificial Sequence
  Synthetic
ctgaactugcggtggatgaug

SEQ ID NO: 85972 - DNA, 18 bp, Artificial Sequence
  Synthetic
gagcuggccatgctcuca

SEQ ID NO: 85973 - DNA, 17 bp, Artificial Sequence
  Synthetic
acgcgaaccccucaguc

SEQ ID NO: 85974 - DNA, 20 bp, Artificial Sequence
  Synthetic
ccatgctcucacctcaucca

SEQ ID NO: 85975 - DNA, 18 bp, Artificial Sequence
  Synthetic
gggctcacuacacgccut

SEQ ID NO: 85976 - DNA, 17 bp, Artificial Sequence
  Synthetic
guccccggaccgguaag

SEQ ID NO: 85977 - DNA, 21 bp, Artificial Sequence
  Synthetic
caggaaccguagctaggacug

SEQ ID NO: 85978 - DNA, 21 bp, Artificial Sequence
  Synthetic
agtggauctgcatcuccgact

SEQ ID NO: 85979 - DNA, 22 bp, Artificial Sequence
  Synthetic
aggtgggctuctcttggaagua

SEQ ID NO: 85980 - DNA, 22 bp, Artificial Sequence
  Synthetic
caaaggagautgagcggauggt

SEQ ID NO: 85981 - DNA, 21 bp, Artificial Sequence
  Synthetic
cagaucagggacucccagaga

SEQ ID NO: 85982 - DNA, 25 bp, Artificial Sequence
  Synthetic
gatgtattguttgcactctucagca

SEQ ID NO: 85983 - DNA, 28 bp, Artificial Sequence
  Synthetic
gctaacatuaaaagggacaagtcuaaga

SEQ ID NO: 85984 - DNA, 21 bp, Artificial Sequence
  Synthetic
gcaccacaagggcucaguaaa

SEQ ID NO: 85985 - DNA, 21 bp, Artificial Sequence
  Synthetic
ctgacaccacucaggtuggag

SEQ ID NO: 85986 - DNA, 25 bp, Artificial Sequence
  Synthetic
cttttcctcaaautcttcccugcaa

SEQ ID NO: 85987 - DNA, 27 bp, Artificial Sequence
  Synthetic
aaatatttcatcucctcctcugacact

SEQ ID NO: 85988 - DNA, 26 bp, Artificial Sequence
  Synthetic
acaacatgctuccactcttgauaact

SEQ ID NO: 85989 - DNA, 29 bp, Artificial Sequence
  Synthetic
gcatgaagaacugatgaagaaaacugaaa

SEQ ID NO: 85990 - DNA, 23 bp, Artificial Sequence
  Synthetic
acacactgugcacaatttcctug

SEQ ID NO: 85991 - DNA, 25 bp, Artificial Sequence
  Synthetic
ccaatgagggugacaacgactauat

SEQ ID NO: 85992 - DNA, 27 bp, Artificial Sequence
  Synthetic
atgatggugaaggatgaatatgugcat

SEQ ID NO: 85993 - DNA, 23 bp, Artificial Sequence
  Synthetic
gcagtgctgguagcattagacuc

SEQ ID NO: 85994 - DNA, 17 bp, Artificial Sequence
  Synthetic
gggcccucgucagcaac

SEQ ID NO: 85995 - DNA, 20 bp, Artificial Sequence
  Synthetic
gttccatggccuccgatcuc

SEQ ID NO: 85996 - DNA, 23 bp, Artificial Sequence
  Synthetic
gccaagctuccgttttccttgua

SEQ ID NO: 85997 - DNA, 26 bp, Artificial Sequence
  Synthetic
gtgtcagtgaguccttagcctaatut

SEQ ID NO: 85998 - DNA, 24 bp, Artificial Sequence
  Synthetic
atgcccctauggagaaaatcctug

SEQ ID NO: 85999 - DNA, 26 bp, Artificial Sequence
  Synthetic
ccaaactugagagactggacaguaag

SEQ ID NO: 86000 - DNA, 20 bp, Artificial Sequence
  Synthetic
tttcctggcuccgctucaat

SEQ ID NO: 86001 - DNA, 27 bp, Artificial Sequence
  Synthetic
ctatccatctutggtatttgctuccac

SEQ ID NO: 86002 - DNA, 26 bp, Artificial Sequence
  Synthetic
ccaggctcatuataagttttggcaut

SEQ ID NO: 86003 - DNA, 28 bp, Artificial Sequence
  Synthetic
tgatgaactcucattaaaaggaacugct

SEQ ID NO: 86004 - DNA, 23 bp, Artificial Sequence
  Synthetic
tgaaucgccgtatcugagaaaac

SEQ ID NO: 86005 - DNA, 23 bp, Artificial Sequence
  Synthetic
augcaacaagcucagaaacacac

SEQ ID NO: 86006 - DNA, 29 bp, Artificial Sequence
  Synthetic
agtctctccttcucttctcttagcattut

SEQ ID NO: 86007 - DNA, 27 bp, Artificial Sequence
  Synthetic
ctcataggaacagguagacttucaact

SEQ ID NO: 86008 - DNA, 21 bp, Artificial Sequence
  Synthetic
gcagtauagaggacggagcug

SEQ ID NO: 86009 - DNA, 21 bp, Artificial Sequence
  Synthetic
cagaaguaccagcagguggat

SEQ ID NO: 86010 - DNA, 21 bp, Artificial Sequence
  Synthetic
caggagttuggtctgccctut

SEQ ID NO: 86011 - DNA, 22 bp, Artificial Sequence
  Synthetic
gguacaacuggacaagcagaga

SEQ ID NO: 86012 - DNA, 22 bp, Artificial Sequence
  Synthetic
tgagcttgutgcattgugacct

SEQ ID NO: 86013 - DNA, 26 bp, Artificial Sequence
  Synthetic
actggtcatttugcactacctcttut

SEQ ID NO: 86014 - DNA, 20 bp, Artificial Sequence
  Synthetic
ggtttcgcgutggttgtgut

SEQ ID NO: 86015 - DNA, 20 bp, Artificial Sequence
  Synthetic
gcagtcagcucctctgucac

SEQ ID NO: 86016 - DNA, 23 bp, Artificial Sequence
  Synthetic
tugacaaaggcaucgagacagat

SEQ ID NO: 86017 - DNA, 21 bp, Artificial Sequence
  Synthetic
tggtggaaugctgagtgaugg

SEQ ID NO: 86018 - DNA, 25 bp, Artificial Sequence
  Synthetic
gtcatttgttuccttttgctcucca

SEQ ID NO: 86019 - DNA, 26 bp, Artificial Sequence
  Synthetic
agttaatatgaaucctcccccacuca

SEQ ID NO: 86020 - DNA, 19 bp, Artificial Sequence
  Synthetic
tgctggtggugtgtccauc

SEQ ID NO: 86021 - DNA, 22 bp, Artificial Sequence
  Synthetic
gcccgatacugtggctcattut

SEQ ID NO: 86022 - DNA, 26 bp, Artificial Sequence
  Synthetic
gagtggcuattgcttatgtugcaaaa

SEQ ID NO: 86023 - DNA, 26 bp, Artificial Sequence
  Synthetic
caaatgcagcutgttgattccauagt

SEQ ID NO: 86024 - DNA, 20 bp, Artificial Sequence
  Synthetic
cagctctgutagccccauct

SEQ ID NO: 86025 - DNA, 28 bp, Artificial Sequence
  Synthetic
caatgattaggaaaacucaacttgcuga

SEQ ID NO: 86026 - DNA, 18 bp, Artificial Sequence
  Synthetic
gccccugacacgcatugt

SEQ ID NO: 86027 - DNA, 19 bp, Artificial Sequence
  Synthetic
gcaagggacacuggagcug

SEQ ID NO: 86028 - DNA, 24 bp, Artificial Sequence
  Synthetic
ttttgtgttacuggcaggatcugt

SEQ ID NO: 86029 - DNA, 24 bp, Artificial Sequence
  Synthetic
agctcctggaucagaagtgacuat

SEQ ID NO: 86030 - DNA, 21 bp, Artificial Sequence
  Synthetic
cggtacauatcacgcugacga

SEQ ID NO: 86031 - DNA, 26 bp, Artificial Sequence
  Synthetic
cctgtgaatuaggccgactttttcua

SEQ ID NO: 86032 - DNA, 18 bp, Artificial Sequence
  Synthetic
gggactccugctcgctut

SEQ ID NO: 86033 - DNA, 18 bp, Artificial Sequence
  Synthetic
gggccaagucggacagua

SEQ ID NO: 86034 - DNA, 22 bp, Artificial Sequence
  Synthetic
gccctagaaauggaggctgtug

SEQ ID NO: 86035 - DNA, 29 bp, Artificial Sequence
  Synthetic
caaggtagaatauagccatggtgatgaut

SEQ ID NO: 86036 - DNA, 23 bp, Artificial Sequence
  Synthetic
gggctgttcautttgagtgcaua

SEQ ID NO: 86037 - DNA, 29 bp, Artificial Sequence
  Synthetic
ggacatgacccucagtagcaatataaaut

SEQ ID NO: 86038 - DNA, 19 bp, Artificial Sequence
  Synthetic
ggcgaacucacccacgtut

SEQ ID NO: 86039 - DNA, 18 bp, Artificial Sequence
  Synthetic
cgaaaaggcgcucacguc

SEQ ID NO: 86040 - DNA, 20 bp, Artificial Sequence
  Synthetic
gttggtcugggaaggtgugt

SEQ ID NO: 86041 - DNA, 23 bp, Artificial Sequence
  Synthetic
ctttaacccucagcctcagaguc

SEQ ID NO: 86042 - DNA, 23 bp, Artificial Sequence
  Synthetic
tgatctgccugttctttccacuc

SEQ ID NO: 86043 - DNA, 18 bp, Artificial Sequence
  Synthetic
agggcccaucctctggut

SEQ ID NO: 86044 - DNA, 17 bp, Artificial Sequence
  Synthetic
cccaggauggcgacgug

SEQ ID NO: 86045 - DNA, 19 bp, Artificial Sequence
  Synthetic
agcccuggcaccttcttug

SEQ ID NO: 86046 - DNA, 22 bp, Artificial Sequence
  Synthetic
gcttctcccaguctttgtgcug

SEQ ID NO: 86047 - DNA, 28 bp, Artificial Sequence
  Synthetic
taacagtgtatuaacttgggatctugct

SEQ ID NO: 86048 - DNA, 20 bp, Artificial Sequence
  Synthetic
ggctcaccggcucttgttua

SEQ ID NO: 86049 - DNA, 28 bp, Artificial Sequence
  Synthetic
tcaaggagaagcauaaaatttugcacag

SEQ ID NO: 86050 - DNA, 18 bp, Artificial Sequence
  Synthetic
gagccgccgaguactugt

SEQ ID NO: 86051 - DNA, 19 bp, Artificial Sequence
  Synthetic
cccccaacuacacccugga

SEQ ID NO: 86052 - DNA, 24 bp, Artificial Sequence
  Synthetic
ttttgagtccaagcutcccatcut

SEQ ID NO: 86053 - DNA, 24 bp, Artificial Sequence
  Synthetic
ccatagttauaccaacagcuccct

SEQ ID NO: 86054 - DNA, 19 bp, Artificial Sequence
  Synthetic
gtcatuccccgacguggat

SEQ ID NO: 86055 - DNA, 19 bp, Artificial Sequence
  Synthetic
cccgggcucggattactuc

SEQ ID NO: 86056 - DNA, 23 bp, Artificial Sequence
  Synthetic
catctggtacutaccctgcauct

SEQ ID NO: 86057 - DNA, 20 bp, Artificial Sequence
  Synthetic
gggagcutgtcctttuccga

SEQ ID NO: 86058 - DNA, 18 bp, Artificial Sequence
  Synthetic
gcttuggagccgctgcua

SEQ ID NO: 86059 - DNA, 23 bp, Artificial Sequence
  Synthetic
cgugacctucaacaagaagaacc

SEQ ID NO: 86060 - DNA, 20 bp, Artificial Sequence
  Synthetic
gagctcugcatggagtguca

SEQ ID NO: 86061 - DNA, 22 bp, Artificial Sequence
  Synthetic
gaaagcatucgttgcaguagcc

SEQ ID NO: 86062 - DNA, 18 bp, Artificial Sequence
  Synthetic
cagacugcccccgaacug

SEQ ID NO: 86063 - DNA, 17 bp, Artificial Sequence
  Synthetic
tctgcccgcugactgug

SEQ ID NO: 86064 - DNA, 19 bp, Artificial Sequence
  Synthetic
cctcuccgggcatccucat

SEQ ID NO: 86065 - DNA, 17 bp, Artificial Sequence
  Synthetic
gacctgcugccccguag

SEQ ID NO: 86066 - DNA, 17 bp, Artificial Sequence
  Synthetic
cgagccgcccauccuac

SEQ ID NO: 86067 - DNA, 17 bp, Artificial Sequence
  Synthetic
tuggcccagccgaacut

SEQ ID NO: 86068 - DNA, 21 bp, Artificial Sequence
  Synthetic
ctcagtttccucttgcccuct

SEQ ID NO: 86069 - DNA, 18 bp, Artificial Sequence
  Synthetic
tcgcugggctcctucaac

SEQ ID NO: 86070 - DNA, 23 bp, Artificial Sequence
  Synthetic
ccaggcucaccatcttctcuaca

SEQ ID NO: 86071 - DNA, 20 bp, Artificial Sequence
  Synthetic
ccaactgcuccaggtcctuc

SEQ ID NO: 86072 - DNA, 18 bp, Artificial Sequence
  Synthetic
gcctgcugctcgaaggug

SEQ ID NO: 86073 - DNA, 18 bp, Artificial Sequence
  Synthetic
cccaaccuggctcagcua

SEQ ID NO: 86074 - DNA, 23 bp, Artificial Sequence
  Synthetic
tctaccugagcaatatgccucca

SEQ ID NO: 86075 - DNA, 28 bp, Artificial Sequence
  Synthetic
gcatcatcttcatucgcttatgggatua

SEQ ID NO: 86076 - DNA, 22 bp, Artificial Sequence
  Synthetic
ccatttgttccuttgggccaut

SEQ ID NO: 86077 - DNA, 23 bp, Artificial Sequence
  Synthetic
gtgtgtgtgaugaatccggauct

SEQ ID NO: 86078 - DNA, 21 bp, Artificial Sequence
  Synthetic
gagtcctccugttgctcaguc

SEQ ID NO: 86079 - DNA, 24 bp, Artificial Sequence
  Synthetic
ttctgaccagcagugttgttgtua

SEQ ID NO: 86080 - DNA, 23 bp, Artificial Sequence
  Synthetic
cctgcactuaaaaccagcugaca

SEQ ID NO: 86081 - DNA, 29 bp, Artificial Sequence
  Synthetic
gctgctttgtttuatttaggttccaguat

SEQ ID NO: 86082 - DNA, 20 bp, Artificial Sequence
  Synthetic
ccccuccggagtgtttugaa

SEQ ID NO: 86083 - DNA, 23 bp, Artificial Sequence
  Synthetic
ccagttgagccauggtgatcauc

SEQ ID NO: 86084 - DNA, 24 bp, Artificial Sequence
  Synthetic
tgatcatttuggcaatgccaagug

SEQ ID NO: 86085 - DNA, 24 bp, Artificial Sequence
  Synthetic
tcagaggauagcaccatgaugact

SEQ ID NO: 86086 - DNA, 19 bp, Artificial Sequence
  Synthetic
gccttcgcgcucaaagtuc

SEQ ID NO: 86087 - DNA, 20 bp, Artificial Sequence
  Synthetic
aacgcggcccucatgatuaa

SEQ ID NO: 86088 - DNA, 17 bp, Artificial Sequence
  Synthetic
cgggcccauccacucaa

SEQ ID NO: 86089 - DNA, 21 bp, Artificial Sequence
  Synthetic
acattcggatucggagcctuc

SEQ ID NO: 86090 - DNA, 20 bp, Artificial Sequence
  Synthetic
tgagggccugaagtgcatug

SEQ ID NO: 86091 - DNA, 19 bp, Artificial Sequence
  Synthetic
caccaaggcaucgcaugag

SEQ ID NO: 86092 - DNA, 20 bp, Artificial Sequence
  Synthetic
cagctgcuccagttcacuga

SEQ ID NO: 86093 - DNA, 24 bp, Artificial Sequence
  Synthetic
gccccagutttaggaaauccacaa

SEQ ID NO: 86094 - DNA, 17 bp, Artificial Sequence
  Synthetic
atuccgcgacgccauct

SEQ ID NO: 86095 - DNA, 18 bp, Artificial Sequence
  Synthetic
gaccaccagucccugcaa

SEQ ID NO: 86096 - DNA, 18 bp, Artificial Sequence
  Synthetic
gtcctuggagctgggcut

SEQ ID NO: 86097 - DNA, 17 bp, Artificial Sequence
  Synthetic
cgguccaggcgugaact

SEQ ID NO: 86098 - DNA, 28 bp, Artificial Sequence
  Synthetic
tccagagacaaagutgcaaaacagauaa

SEQ ID NO: 86099 - DNA, 26 bp, Artificial Sequence
  Synthetic
cagaagcctcauatgaagatggcuat

SEQ ID NO: 86100 - DNA, 19 bp, Artificial Sequence
  Synthetic
ggctgggcuggaaaucagg

SEQ ID NO: 86101 - DNA, 17 bp, Artificial Sequence
  Synthetic
agccgggcuttccgtut

SEQ ID NO: 86102 - DNA, 18 bp, Artificial Sequence
  Synthetic
tcaugagggccgcgttut

SEQ ID NO: 86103 - DNA, 18 bp, Artificial Sequence
  Synthetic
gcccgacagcutccctuc

SEQ ID NO: 86104 - DNA, 21 bp, Artificial Sequence
  Synthetic
ttccccatcguttgtccaguc

SEQ ID NO: 86105 - DNA, 28 bp, Artificial Sequence
  Synthetic
gttcttttaaggugaagaggccatauca

SEQ ID NO: 86106 - DNA, 25 bp, Artificial Sequence
  Synthetic
acatcaggcacuggaactatctgua

SEQ ID NO: 86107 - DNA, 28 bp, Artificial Sequence
  Synthetic
gccttcaaatgaugaaaattatcctugt

SEQ ID NO: 86108 - DNA, 21 bp, Artificial Sequence
  Synthetic
gaacugctgtccugcaagagt

SEQ ID NO: 86109 - DNA, 21 bp, Artificial Sequence
  Synthetic
gccagctcuttgtcggauaca

SEQ ID NO: 86110 - DNA, 20 bp, Artificial Sequence
  Synthetic
gugcggcagaaaaucgagaa

SEQ ID NO: 86111 - DNA, 19 bp, Artificial Sequence
  Synthetic
ggagggcugtgaaaagcug

SEQ ID NO: 86112 - DNA, 18 bp, Artificial Sequence
  Synthetic
gttgcagggacugguggt

SEQ ID NO: 86113 - DNA, 20 bp, Artificial Sequence
  Synthetic
acaacggcgcuctggauaat

SEQ ID NO: 86114 - DNA, 17 bp, Artificial Sequence
  Synthetic
cuggguaggcggaaggg

SEQ ID NO: 86115 - DNA, 17 bp, Artificial Sequence
  Synthetic
cagcggcugcagcatut

SEQ ID NO: 86116 - DNA, 19 bp, Artificial Sequence
  Synthetic
gcgacccgcugcataauga

SEQ ID NO: 86117 - DNA, 20 bp, Artificial Sequence
  Synthetic
tccgatucccacagtcugga

SEQ ID NO: 86118 - DNA, 27 bp, Artificial Sequence
  Synthetic
ctctttctgaaacuctgtgagatugct

SEQ ID NO: 86119 - DNA, 23 bp, Artificial Sequence
  Synthetic
ggtcttccautacggagagaucc

SEQ ID NO: 86120 - DNA, 21 bp, Artificial Sequence
  Synthetic
tcccgcacaugtguaaccaat

SEQ ID NO: 86121 - DNA, 21 bp, Artificial Sequence
  Synthetic
ccttcgatgguaccccactug

SEQ ID NO: 86122 - DNA, 30 bp, Artificial Sequence
  Synthetic
gtgcuaagcagtacattuaaaaagaaagga

SEQ ID NO: 86123 - DNA, 27 bp, Artificial Sequence
  Synthetic
tctaggacaaaggaaautgaagccaut

SEQ ID NO: 86124 - DNA, 27 bp, Artificial Sequence
  Synthetic
cttacctctgauctcaagattgcauga

SEQ ID NO: 86125 - DNA, 29 bp, Artificial Sequence
  Synthetic
gcctactattcugtgtaaactcagugaaa

SEQ ID NO: 86126 - DNA, 21 bp, Artificial Sequence
  Synthetic
ggaagcgatutttgccgacut

SEQ ID NO: 86127 - DNA, 19 bp, Artificial Sequence
  Synthetic
ccagccugggcgttctuac

SEQ ID NO: 86128 - DNA, 23 bp, Artificial Sequence
  Synthetic
ccttcatccautctggactuggt

SEQ ID NO: 86129 - DNA, 28 bp, Artificial Sequence
  Synthetic
gggagaaauattcugaccacgaaagaag

SEQ ID NO: 86130 - DNA, 22 bp, Artificial Sequence
  Synthetic
gggcctgaggugttctgttuag

SEQ ID NO: 86131 - DNA, 20 bp, Artificial Sequence
  Synthetic
gctctggttuctcccacgut

SEQ ID NO: 86132 - DNA, 18 bp, Artificial Sequence
  Synthetic
gacggcuccttggtucgt

SEQ ID NO: 86133 - DNA, 21 bp, Artificial Sequence
  Synthetic
cggactuccacagttcaggug

SEQ ID NO: 86134 - DNA, 19 bp, Artificial Sequence
  Synthetic
ttcugcagcagcacaucct

SEQ ID NO: 86135 - DNA, 19 bp, Artificial Sequence
  Synthetic
ccctugcccctttccucac

SEQ ID NO: 86136 - DNA, 23 bp, Artificial Sequence
  Synthetic
catcgtcauggaaagcugaagga

SEQ ID NO: 86137 - DNA, 26 bp, Artificial Sequence
  Synthetic
aggtagaaaucagccatctuaaagcc

SEQ ID NO: 86138 - DNA, 18 bp, Artificial Sequence
  Synthetic
ctcggtuagggctcuggt

SEQ ID NO: 86139 - DNA, 19 bp, Artificial Sequence
  Synthetic
ctucgccgagggctaugag

SEQ ID NO: 86140 - DNA, 23 bp, Artificial Sequence
  Synthetic
ggaaaactgacugggtgggatuc

SEQ ID NO: 86141 - DNA, 23 bp, Artificial Sequence
  Synthetic
caaccactccucagggtaguaac

SEQ ID NO: 86142 - DNA, 22 bp, Artificial Sequence
  Synthetic
agaggaucctugggaggaagac

SEQ ID NO: 86143 - DNA, 21 bp, Artificial Sequence
  Synthetic
gcaaggcaguggatgaggtuc

SEQ ID NO: 86144 - DNA, 17 bp, Artificial Sequence
  Synthetic
ctggctcuccgccaugt

SEQ ID NO: 86145 - DNA, 20 bp, Artificial Sequence
  Synthetic
ggaagucatcauccccacca

SEQ ID NO: 86146 - DNA, 21 bp, Artificial Sequence
  Synthetic
gccattgcugagtcacccuaa

SEQ ID NO: 86147 - DNA, 22 bp, Artificial Sequence
  Synthetic
gaactctgccucttgagacugg

SEQ ID NO: 86148 - DNA, 24 bp, Artificial Sequence
  Synthetic
caagctacctguggagtctttgut

SEQ ID NO: 86149 - DNA, 20 bp, Artificial Sequence
  Synthetic
gcagagcagacugcaugaca

SEQ ID NO: 86150 - DNA, 22 bp, Artificial Sequence
  Synthetic
ggagtgcaauctgtctggctut

SEQ ID NO: 86151 - DNA, 27 bp, Artificial Sequence
  Synthetic
tcagttgauagaggaccatcatuggat

SEQ ID NO: 86152 - DNA, 23 bp, Artificial Sequence
  Synthetic
gcugagatttggugagacacaga

SEQ ID NO: 86153 - DNA, 28 bp, Artificial Sequence
  Synthetic
gtttgcatttctugactttcattgcaut

SEQ ID NO: 86154 - DNA, 30 bp, Artificial Sequence
  Synthetic
ggagcaaaagtaauacgtaaatggaaagut

SEQ ID NO: 86155 - DNA, 21 bp, Artificial Sequence
  Synthetic
tgctaacugcgcaaccttcut

SEQ ID NO: 86156 - DNA, 27 bp, Artificial Sequence
  Synthetic
attaaagatgcccugaagagttgugaa

SEQ ID NO: 86157 - DNA, 26 bp, Artificial Sequence
  Synthetic
cagttcttucagagagctguacaagt

SEQ ID NO: 86158 - DNA, 28 bp, Artificial Sequence
  Synthetic
gcagttagcagutataaatagccuggaa

SEQ ID NO: 86159 - DNA, 30 bp, Artificial Sequence; identical to SEQ ID NO: 62431
  Synthetic

SEQ ID NO: 86160 - DNA, 21 bp, Artificial Sequence
  Synthetic
caacttugggatcagcuccgt

SEQ ID NO: 86161 - DNA, 28 bp, Artificial Sequence
  Synthetic
aatggaatgtctucgtaatgtggaguag

SEQ ID NO: 86162 - DNA, 25 bp, Artificial Sequence
  Synthetic
tgtgtgtaatgutcaagcacgttut

SEQ ID NO: 86163 - DNA, 20 bp, Artificial Sequence
  Synthetic
ccucagggcagaaagacgut

SEQ ID NO: 86164 - DNA, 26 bp, Artificial Sequence
  Synthetic
gaaacaaauagacacagctcuccaga

SEQ ID NO: 86165 - DNA, 26 bp, Artificial Sequence
  Synthetic
gtttttgtggugggctttatgatgut

SEQ ID NO: 86166 - DNA, 22 bp, Artificial Sequence
  Synthetic
attcaccucctgtggguaggat

SEQ ID NO: 86167 - DNA, 23 bp, Artificial Sequence
  Synthetic
cttgacctugtctctttcugcct

SEQ ID NO: 86168 - DNA, 23 bp, Artificial Sequence
  Synthetic
aatcacacccaccauttctgugt

SEQ ID NO: 86169 - DNA, 28 bp, Artificial Sequence
  Synthetic
aggaaacacugatagctgagauagaaga

SEQ ID NO: 86170 - DNA, 27 bp, Artificial Sequence
  Synthetic
gtagcttctugattctgtctguccaat

SEQ ID NO: 86171 - DNA, 29 bp, Artificial Sequence
  Synthetic
gctacaagagacauaagtttggatucaga

SEQ ID NO: 86172 - DNA, 26 bp, Artificial Sequence
  Synthetic
cactactgttgacutctccagcatut

SEQ ID NO: 86173 - DNA, 28 bp, Artificial Sequence
  Synthetic
gagtccaattcuagtcctagtagtcuga

SEQ ID NO: 86174 - DNA, 28 bp, Artificial Sequence
  Synthetic
tgcctccaaatuaagtcttaagtcaugt

SEQ ID NO: 86175 - DNA, 26 bp, Artificial Sequence
  Synthetic
tggtgtctccaautgaaagtatgugt

SEQ ID NO: 86176 - DNA, 21 bp, Artificial Sequence
  Synthetic
ctttccauccccatctcugga

SEQ ID NO: 86177 - DNA, 22 bp, Artificial Sequence
  Synthetic
gctgaaccugcccaatcuacac

SEQ ID NO: 86178 - DNA, 27 bp, Artificial Sequence
  Synthetic
gatgaauggatatctguaaggaagcag

SEQ ID NO: 86179 - DNA, 21 bp, Artificial Sequence
  Synthetic
cgcggctaaucgaactcacua

SEQ ID NO: 86180 - DNA, 22 bp, Artificial Sequence
  Synthetic
gcaggcaagaaccutttgguaa

SEQ ID NO: 86181 - DNA, 25 bp, Artificial Sequence
  Synthetic
aatttccaaauggaaggctcacuct

SEQ ID NO: 86182 - DNA, 20 bp, Artificial Sequence
  Synthetic
gccaggacucaagggucaag

SEQ ID NO: 86183 - DNA, 20 bp, Artificial Sequence
  Synthetic
ggaccggaagugcaaagaug

SEQ ID NO: 86184 - DNA, 19 bp, Artificial Sequence
  Synthetic
ggcttugccgagccctaua

SEQ ID NO: 86185 - DNA, 26 bp, Artificial Sequence
  Synthetic
gaactucaggagaaggaucaaagagt

SEQ ID NO: 86186 - DNA, 21 bp, Artificial Sequence
  Synthetic
cagtgggtucagacgatguca

SEQ ID NO: 86187 - DNA, 26 bp, Artificial Sequence
  Synthetic
ccacuctgcttacauacaaaacaggt

SEQ ID NO: 86188 - DNA, 19 bp, Artificial Sequence
  Synthetic
gcctgaggugtcctgtcuc

SEQ ID NO: 86189 - DNA, 20 bp, Artificial Sequence
  Synthetic
tgagatgugcgtgagctuca

SEQ ID NO: 86190 - DNA, 28 bp, Artificial Sequence
  Synthetic
ctctgaaaatatcaaucgttgcctctut

SEQ ID NO: 86191 - DNA, 22 bp, Artificial Sequence
  Synthetic
cucccggcagaaggaauacaag

SEQ ID NO: 86192 - DNA, 21 bp, Artificial Sequence
  Synthetic
gacacagtcgaugtccagcut

SEQ ID NO: 86193 - DNA, 21 bp, Artificial Sequence
  Synthetic
gccaaatgcugacttgcucac

SEQ ID NO: 86194 - DNA, 21 bp, Artificial Sequence
  Synthetic
gccagaggccagcuagctaua

SEQ ID NO: 86195 - DNA, 25 bp, Artificial Sequence
  Synthetic
ccttaacagguctttgaaaccccut

SEQ ID NO: 86196 - DNA, 24 bp, Artificial Sequence
  Synthetic
ggagatgccugacatcatcaucaa

SEQ ID NO: 86197 - DNA, 20 bp, Artificial Sequence
  Synthetic
gtuacacagcccgaaccuct

SEQ ID NO: 86198 - DNA, 23 bp, Artificial Sequence
  Synthetic
catgtttgccugccattttcugt

SEQ ID NO: 86199 - DNA, 20 bp, Artificial Sequence
  Synthetic
ctcatctggcuggtctcguc

SEQ ID NO: 86200 - DNA, 25 bp, Artificial Sequence
  Synthetic
ttcttttggcutctcaggaauccat

SEQ ID NO: 86201 - DNA, 21 bp, Artificial Sequence
  Synthetic
ctgcataacagugggtgggua

SEQ ID NO: 86202 - DNA, 18 bp, Artificial Sequence
  Synthetic
cacagcaucgacggcauc

SEQ ID NO: 86203 - DNA, 21 bp, Artificial Sequence
  Synthetic
gagagtttcuccgctggagut

SEQ ID NO: 86204 - DNA, 21 bp, Artificial Sequence
  Synthetic
ccttcagggcutggtagaguc

SEQ ID NO: 86205 - DNA, 20 bp, Artificial Sequence
  Synthetic
gagtgacaucggtggaggut

SEQ ID NO: 86206 - DNA, 24 bp, Artificial Sequence
  Synthetic
ccaccagacaguctaguaacaagg

SEQ ID NO: 86207 - DNA, 26 bp, Artificial Sequence
  Synthetic
aagccaaauggacctaaagaaucagt

SEQ ID NO: 86208 - DNA, 21 bp, Artificial Sequence
  Synthetic
tccagcugcagtgattctgut

SEQ ID NO: 86209 - DNA, 20 bp, Artificial Sequence
  Synthetic
gcttctggccuggtgctuac

SEQ ID NO: 86210 - DNA, 24 bp, Artificial Sequence
  Synthetic
gcatctgtttcuggaggcattcut

SEQ ID NO: 86211 - DNA, 20 bp, Artificial Sequence
  Synthetic
gaggtcaaaggucaccccut

SEQ ID NO: 86212 - DNA, 24 bp, Artificial Sequence
  Synthetic
acgaatgacuctttttcagccuct

SEQ ID NO: 86213 - DNA, 20 bp, Artificial Sequence
  Synthetic
ggaaugcaaggcccaacuca

SEQ ID NO: 86214 - DNA, 24 bp, Artificial Sequence
  Synthetic
gggttgctaucatacggttctuac

SEQ ID NO: 86215 - DNA, 21 bp, Artificial Sequence
  Synthetic
cctggaacgcutagtgguaca

SEQ ID NO: 86216 - DNA, 26 bp, Artificial Sequence
  Synthetic
tttaccaugaagagtgtguccagaag

SEQ ID NO: 86217 - DNA, 29 bp, Artificial Sequence
  Synthetic
caattagactgguccacataagaaaucca

SEQ ID NO: 86218 - DNA, 18 bp, Artificial Sequence
  Synthetic
gcctgcauccctccucaa

SEQ ID NO: 86219 - DNA, 23 bp, Artificial Sequence
  Synthetic
gctcctcugaaaccacagcauac

SEQ ID NO: 86220 - DNA, 22 bp, Artificial Sequence
  Synthetic
tgtccaugcagtttguccaaga

SEQ ID NO: 86221 - DNA, 21 bp, Artificial Sequence
  Synthetic
ctgtggtuggagcccttctut

SEQ ID NO: 86222 - DNA, 23 bp, Artificial Sequence
  Synthetic
gtctatugggacagcttggucag

SEQ ID NO: 86223 - DNA, 24 bp, Artificial Sequence
  Synthetic
cttttcccctugaatgcagtccua

SEQ ID NO: 86224 - DNA, 24 bp, Artificial Sequence
  Synthetic
agggataacucacaggtgtctugt

SEQ ID NO: 86225 - DNA, 26 bp, Artificial Sequence
  Synthetic
ggtcttgatuataagcccauccagag

SEQ ID NO: 86226 - DNA, 24 bp, Artificial Sequence
  Synthetic
tgtgagatugccaactgauaacgg

SEQ ID NO: 86227 - DNA, 22 bp, Artificial Sequence
  Synthetic
ttcagtgcuattgcagcaucct

SEQ ID NO: 86228 - DNA, 17 bp, Artificial Sequence
  Synthetic
catgugccgccgtugag

SEQ ID NO: 86229 - DNA, 17 bp, Artificial Sequence
  Synthetic
cgagggcugggtgugag

SEQ ID NO: 86230 - DNA, 24 bp, Artificial Sequence
  Synthetic
ctaccaacaugggccaggaaaaua

SEQ ID NO: 86231 - DNA, 23 bp, Artificial Sequence
  Synthetic
ccttggctutagaccatcuccac

SEQ ID NO: 86232 - DNA, 24 bp, Artificial Sequence
  Synthetic
ctcctttaccccuccttccuagag

SEQ ID NO: 86233 - DNA, 21 bp, Artificial Sequence
  Synthetic
tguaaccuccaccccaagaga

SEQ ID NO: 86234 - DNA, 21 bp, Artificial Sequence
  Synthetic
gcatgagaagcuggtgcagut

SEQ ID NO: 86235 - DNA, 25 bp, Artificial Sequence
  Synthetic
tctagacaugagaggaaaugaggct

SEQ ID NO: 86236 - DNA, 18 bp, Artificial Sequence
  Synthetic
cgccgccgaugtguagaa

SEQ ID NO: 86237 - DNA, 18 bp, Artificial Sequence
  Synthetic
cgctgcuctacagccuca

SEQ ID NO: 86238 - DNA, 17 bp, Artificial Sequence
  Synthetic
ggctggcugaggctgua

SEQ ID NO: 86239 - DNA, 18 bp, Artificial Sequence
  Synthetic
ccaccgagcugugcagac

SEQ ID NO: 86240 - DNA, 17 bp, Artificial Sequence
  Synthetic
ggtcugcacagcucggt

SEQ ID NO: 86241 - DNA, 18 bp, Artificial Sequence
  Synthetic
gagcccccagucaucgaa

SEQ ID NO: 86242 - DNA, 21 bp, Artificial Sequence
  Synthetic
gctgtcccucagtcctgcaua

SEQ ID NO: 86243 - DNA, 20 bp, Artificial Sequence
  Synthetic
gttgacaucgcgttgtgucc

SEQ ID NO: 86244 - DNA, 24 bp, Artificial Sequence
  Synthetic
tgtttguggcatatcctucccaat

SEQ ID NO: 86245 - DNA, 28 bp, Artificial Sequence
  Synthetic
gaagttcctctucccaattcatctauga

SEQ ID NO: 86246 - DNA, 19 bp, Artificial Sequence
  Synthetic
cgcggcccuttaagtcuct

SEQ ID NO: 86247 - DNA, 17 bp, Artificial Sequence
  Synthetic
gcaccuggtcctgcuga

SEQ ID NO: 86248 - DNA, 19 bp, Artificial Sequence
  Synthetic
cgtucagcaggaccaggug

SEQ ID NO: 86249 - DNA, 21 bp, Artificial Sequence
  Synthetic
catccgctugtctgtctguct

SEQ ID NO: 86250 - DNA, 21 bp, Artificial Sequence
  Synthetic
tcugtagatgauccccaggct

SEQ ID NO: 86251 - DNA, 28 bp, Artificial Sequence
  Synthetic
gagttcttuaaaacacaccagccauaaa

SEQ ID NO: 86252 - DNA, 22 bp, Artificial Sequence
  Synthetic
auttcactggaaucggaagcct

SEQ ID NO: 86253 - DNA, 23 bp, Artificial Sequence
  Synthetic
gagacugagagaagugcaaagga

SEQ ID NO: 86254 - DNA, 21 bp, Artificial Sequence
  Synthetic
cuggtgaauagcacagagggt

SEQ ID NO: 86255 - DNA, 20 bp, Artificial Sequence
  Synthetic
ccctugaagaggcctuggaa

SEQ ID NO: 86256 - DNA, 27 bp, Artificial Sequence
  Synthetic
tcaggtcugcaaccaaagattcatuaa

SEQ ID NO: 86257 - DNA, 24 bp, Artificial Sequence
  Synthetic
gcaaacaugcaaaaagcaccaauc

SEQ ID NO: 86258 - DNA, 28 bp, Artificial Sequence
  Synthetic
tcctccacugagataatgacttctuacc

SEQ ID NO: 86259 - DNA, 28 bp, Artificial Sequence
  Synthetic
gctgtcactguattatttgtccauggaa

SEQ ID NO: 86260 - DNA, 21 bp, Artificial Sequence
  Synthetic
ccaggaacaggcgaucagaut

SEQ ID NO: 86261 - DNA, 27 bp, Artificial Sequence
  Synthetic
ccactgtagacugaaatgtagttugga

SEQ ID NO: 86262 - DNA, 28 bp, Artificial Sequence
  Synthetic
tgggctataucagaatacatugcaacaa

SEQ ID NO: 86263 - DNA, 23 bp, Artificial Sequence
  Synthetic
ggtgagtgcugtgacatguagat

SEQ ID NO: 86264 - DNA, 25 bp, Artificial Sequence
  Synthetic
gattaaagggacuctgaagggacut

SEQ ID NO: 86265 - DNA, 29 bp, Artificial Sequence
  Synthetic
aaacctgacaaaugtgcaatctuaaaaga

SEQ ID NO: 86266 - DNA, 21 bp, Artificial Sequence
  Synthetic
gggacacugccctggaaauat

SEQ ID NO: 86267 - DNA, 21 bp, Artificial Sequence
  Synthetic
cacutctcctccucagggaag

SEQ ID NO: 86268 - DNA, 28 bp, Artificial Sequence
  Synthetic
ttggccaatcagauaccaactgttaaua

SEQ ID NO: 86269 - DNA, 28 bp, Artificial Sequence
  Synthetic
ggtagtaagttucccattaccaagtuct

SEQ ID NO: 86270 - DNA, 22 bp, Artificial Sequence
  Synthetic
gggatuaaagctggctauggca

SEQ ID NO: 86271 - DNA, 21 bp, Artificial Sequence
  Synthetic
ccttgtugggacctcagaugt

SEQ ID NO: 86272 - DNA, 25 bp, Artificial Sequence
  Synthetic
gatctgacgaauttgcttcacagut

SEQ ID NO: 86273 - DNA, 25 bp, Artificial Sequence
  Synthetic
cccaaaaggaacacugaaaaacgua

SEQ ID NO: 86274 - DNA, 19 bp, Artificial Sequence
  Synthetic
ctctctgcucgacctgugt

SEQ ID NO: 86275 - DNA, 21 bp, Artificial Sequence
  Synthetic
gcttccctcugagaggcgaua

SEQ ID NO: 86276 - DNA, 20 bp, Artificial Sequence
  Synthetic
ccgctcgagutcctcttugg

SEQ ID NO: 86277 - DNA, 22 bp, Artificial Sequence
  Synthetic
gaagtcaccuctgggtcttgug

SEQ ID NO: 86278 - DNA, 26 bp, Artificial Sequence
  Synthetic
cacgattacgtutttcagtgttccut

SEQ ID NO: 86279 - DNA, 31 bp, Artificial Sequence
  Synthetic
tctgtgtttatauaggtagcttttgttugct

SEQ ID NO: 86280 - DNA, 25 bp, Artificial Sequence
  Synthetic
tgaacaacagucacacttuccaagt

SEQ ID NO: 86281 - DNA, 23 bp, Artificial Sequence
  Synthetic
actuagcaagcacaaagguaccc

SEQ ID NO: 86282 - DNA, 21 bp, Artificial Sequence
  Synthetic
gcagatucaggtctgccucat

SEQ ID NO: 86283 - DNA, 23 bp, Artificial Sequence
  Synthetic
acttcatguccacgtctcttugg

SEQ ID NO: 86284 - DNA, 17 bp, Artificial Sequence
  Synthetic
tggccccutgccttcuc

SEQ ID NO: 86285 - DNA, 17 bp, Artificial Sequence
  Synthetic
gggtcugcggtggcauc

SEQ ID NO: 86286 - DNA, 20 bp, Artificial Sequence
  Synthetic
gcaccccucagaagctgaut

SEQ ID NO: 86287 - DNA, 18 bp, Artificial Sequence
  Synthetic
ggtgaugcggctctgcut

SEQ ID NO: 86288 - DNA, 17 bp, Artificial Sequence
  Synthetic
cgugaugccaccgcaga

SEQ ID NO: 86289 - DNA, 18 bp, Artificial Sequence
  Synthetic
cccgcccucacctguact

SEQ ID NO: 86290 - DNA, 19 bp, Artificial Sequence
  Synthetic
gccucgaccctguggagat

SEQ ID NO: 86291 - DNA, 20 bp, Artificial Sequence
  Synthetic
gcacagggcacugtttgcua

SEQ ID NO: 86292 - DNA, 20 bp, Artificial Sequence
  Synthetic
agcuaacgggaagcctccua

SEQ ID NO: 86293 - DNA, 17 bp, Artificial Sequence
  Synthetic
cugtcccctucgggcat

SEQ ID NO: 86294 - DNA, 21 bp, Artificial Sequence
  Synthetic
gtagtacugggaggtccccut

SEQ ID NO: 86295 - DNA, 20 bp, Artificial Sequence
  Synthetic
gcttcggccuttgcagttut

SEQ ID NO: 86296 - DNA, 19 bp, Artificial Sequence
  Synthetic
tcugugagcccacgaggat

SEQ ID NO: 86297 - DNA, 18 bp, Artificial Sequence
  Synthetic
gccgccaccuacttugct

SEQ ID NO: 86298 - DNA, 19 bp, Artificial Sequence
  Synthetic
cugggcagcagctguaagt

SEQ ID NO: 86299 - DNA, 19 bp, Artificial Sequence
  Synthetic
tcauacacacggcctuggg

SEQ ID NO: 86300 - DNA, 19 bp, Artificial Sequence
  Synthetic
ggaggccagucacaaugga

SEQ ID NO: 86301 - DNA, 17 bp, Artificial Sequence
  Synthetic
gacagccggcggaucut

SEQ ID NO: 86302 - DNA, 25 bp, Artificial Sequence
  Synthetic
tgtaacttaugagcagctgugacaa

SEQ ID NO: 86303 - DNA, 26 bp, Artificial Sequence
  Synthetic
cacagggactucacaagttccaaaua

SEQ ID NO: 86304 - DNA, 19 bp, Artificial Sequence
  Synthetic
cgcagcugagcaccaaauc

SEQ ID NO: 86305 - DNA, 18 bp, Artificial Sequence
  Synthetic
caggcgutguccccacat

SEQ ID NO: 86306 - DNA, 19 bp, Artificial Sequence
  Synthetic
agagtgccccaguccctua

SEQ ID NO: 86307 - DNA, 24 bp, Artificial Sequence
  Synthetic
gcccaucattttgtcaucaggaag

SEQ ID NO: 86308 - DNA, 22 bp, Artificial Sequence
  Synthetic
actcccugggaactttgaguct

SEQ ID NO: 86309 - DNA, 28 bp, Artificial Sequence
  Synthetic
gagaaaatgugcaaatcccgaatuaact

SEQ ID NO: 86310 - DNA, 20 bp, Artificial Sequence
  Synthetic
caaggacagcccuttcggua

SEQ ID NO: 86311 - DNA, 24 bp, Artificial Sequence
  Synthetic
gatcauggaggccaaatcctguag

SEQ ID NO: 86312 - DNA, 22 bp, Artificial Sequence
  Synthetic
gctgccagcaaugagaagugaa

SEQ ID NO: 86313 - DNA, 29 bp, Artificial Sequence
  Synthetic
gagatccccttutccagtatcatttucaa

SEQ ID NO: 86314 - DNA, 28 bp, Artificial Sequence
  Synthetic
agaaaacctuccaaagacaaaguagaca

SEQ ID NO: 86315 - DNA, 22 bp, Artificial Sequence
  Synthetic
ggcaacagautttcacagcuca

SEQ ID NO: 86316 - DNA, 25 bp, Artificial Sequence
  Synthetic
ttttcttagtucatcttcggcugct

SEQ ID NO: 86317 - DNA, 27 bp, Artificial Sequence
  Synthetic
cccctggactuttctatgagttcttua

SEQ ID NO: 86318 - DNA, 24 bp, Artificial Sequence
  Synthetic
ggaaagtcuctgtacgugaagagg

SEQ ID NO: 86319 - DNA, 21 bp, Artificial Sequence
  Synthetic
ctgatacugcgcauccaggaa

SEQ ID NO: 86320 - DNA, 28 bp, Artificial Sequence
  Synthetic
tgacccatauaaacctcatcctcaugat

SEQ ID NO: 86321 - DNA, 26 bp, Artificial Sequence
  Synthetic
tgtcauggagaagaaacagaacaucc

SEQ ID NO: 86322 - DNA, 17 bp, Artificial Sequence
  Synthetic
gggagcuggccgcauac

SEQ ID NO: 86323 - DNA, 20 bp, Artificial Sequence
  Synthetic
ccagugacccuacggacaga

SEQ ID NO: 86324 - DNA, 21 bp, Artificial Sequence
  Synthetic
ctgagtccugaccttugcaca

SEQ ID NO: 86325 - DNA, 21 bp, Artificial Sequence
  Synthetic
gttggucccagggaucgaaag

SEQ ID NO: 86326 - DNA, 21 bp, Artificial Sequence
  Synthetic
cccttaggagcguccagguat

SEQ ID NO: 86327 - DNA, 19 bp, Artificial Sequence
  Synthetic
ctctuggccggttcguact

SEQ ID NO: 86328 - DNA, 20 bp, Artificial Sequence
  Synthetic
gcttctccucagggatgcut

SEQ ID NO: 86329 - DNA, 17 bp, Artificial Sequence
  Synthetic
tcuagcgcccgcucaac

SEQ ID NO: 86330 - DNA, 17 bp, Artificial Sequence
  Synthetic
gtgccccgagucctuct

SEQ ID NO: 86331 - DNA, 25 bp, Artificial Sequence
  Synthetic
gtatgctgtcutctagcactucagg

SEQ ID NO: 86332 - DNA, 28 bp, Artificial Sequence
  Synthetic
tctgtagacagaccucttttcaaguaca

SEQ ID NO: 86333 - DNA, 27 bp, Artificial Sequence
  Synthetic
tccctgtaacaugaaagtcacactuac

SEQ ID NO: 86334 - DNA, 24 bp, Artificial Sequence
  Synthetic
ctgtguaggagggacctcttcuat

SEQ ID NO: 86335 - DNA, 21 bp, Artificial Sequence
  Synthetic
gaagagacgcacutcctccug

SEQ ID NO: 86336 - DNA, 21 bp, Artificial Sequence
  Synthetic
tgtaccaccacuccttgugga

SEQ ID NO: 86337 - DNA, 28 bp, Artificial Sequence
  Synthetic
gccaacttggaagucagtctgtttatua

SEQ ID NO: 86338 - DNA, 21 bp, Artificial Sequence
  Synthetic
ccttugtcagagauggcacct

SEQ ID NO: 86339 - DNA, 24 bp, Artificial Sequence
  Synthetic
aaaagacgugtccattuccagact

SEQ ID NO: 86340 - DNA, 21 bp, Artificial Sequence
  Synthetic
tggctgccuttaaaccucgaa

SEQ ID NO: 86341 - DNA, 22 bp, Artificial Sequence
  Synthetic
tgtattcaucgccguacaccag

SEQ ID NO: 86342 - DNA, 19 bp, Artificial Sequence
  Synthetic
gctgaagaucaggcgggut

SEQ ID NO: 86343 - DNA, 27 bp, Artificial Sequence
  Synthetic
gctccagaaaaccaguataaagctuac

SEQ ID NO: 86344 - DNA, 24 bp, Artificial Sequence
  Synthetic
aaaacaautcgactgaucgaccct

SEQ ID NO: 86345 - DNA, 21 bp, Artificial Sequence
  Synthetic
gggaccacguctttactgaug

SEQ ID NO: 86346 - DNA, 25 bp, Artificial Sequence
  Synthetic
ttgctttcttuaacagctccucagt

SEQ ID NO: 86347 - DNA, 23 bp, Artificial Sequence
  Synthetic
accagtatctucactcccagucc

SEQ ID NO: 86348 - DNA, 26 bp, Artificial Sequence
  Synthetic
ctttgctgtgcutcatgatgtaacug

SEQ ID NO: 86349 - DNA, 21 bp, Artificial Sequence
  Synthetic
actcaggacaugtcagccuct

SEQ ID NO: 86350 - DNA, 22 bp, Artificial Sequence
  Synthetic
gcaccugaagtgcuagaagaca

SEQ ID NO: 86351 - DNA, 24 bp, Artificial Sequence
  Synthetic
ccccttcautaaggacuggagaag

SEQ ID NO: 86352 - DNA, 28 bp, Artificial Sequence
  Synthetic
gggcacaacuttcttattaatttucaca

SEQ ID NO: 86353 - DNA, 22 bp, Artificial Sequence
  Synthetic
cctcagccaacuaatcucgcaa

SEQ ID NO: 86354 - DNA, 21 bp, Artificial Sequence
  Synthetic
cctgggcaugctaactcctut

SEQ ID NO: 86355 - DNA, 19 bp, Artificial Sequence
  Synthetic
ggacacgcaggaggucauc

SEQ ID NO: 86356 - DNA, 22 bp, Artificial Sequence
  Synthetic
gatacgtgugccagttuccaga

SEQ ID NO: 86357 - DNA, 22 bp, Artificial Sequence
  Synthetic
ggtgacaggaggauggctctua

SEQ ID NO: 86358 - DNA, 21 bp, Artificial Sequence
  Synthetic
tcugcaccgaggugaaacaag

SEQ ID NO: 86359 - DNA, 22 bp, Artificial Sequence
  Synthetic
gagggugcatttucaggaggaa

SEQ ID NO: 86360 - DNA, 23 bp, Artificial Sequence
  Synthetic
cagtctggaaauggacacgtcut

SEQ ID NO: 86361 - DNA, 24 bp, Artificial Sequence
  Synthetic
tctcaccatutcaggataguccct

SEQ ID NO: 86362 - DNA, 22 bp, Artificial Sequence
  Synthetic
agaggctgacaugtcctgagua

SEQ ID NO: 86363 - DNA, 27 bp, Artificial Sequence
  Synthetic
accaggaagauaccggatgtaaattuc

SEQ ID NO: 86364 - DNA, 28 bp, Artificial Sequence
  Synthetic
ggtgtgagccuttttgttattattucct

SEQ ID NO: 86365 - DNA, 22 bp, Artificial Sequence
  Synthetic
tggctaacucctctttggctuc

SEQ ID NO: 86366 - DNA, 24 bp, Artificial Sequence
  Synthetic
cggtatggtutactctgcttugct

SEQ ID NO: 86367 - DNA, 27 bp, Artificial Sequence
  Synthetic
tcctatcaggacaauttgctcagatuc

SEQ ID NO: 86368 - DNA, 30 bp, Artificial Sequence; identical to SEQ ID NO: 61368
  Synthetic

SEQ ID NO: 86369 - DNA, 24 bp, Artificial Sequence
  Synthetic
ccaaataaactgugcctgcgauat

SEQ ID NO: 86370 - DNA, 19 bp, Artificial Sequence
  Synthetic
ctcagcgucttgccgauca

SEQ ID NO: 86371 - DNA, 27 bp, Artificial Sequence
  Synthetic
agaaacttcuaccaagaatcccucagt

SEQ ID NO: 86372 - DNA, 22 bp, Artificial Sequence
  Synthetic
gtatgttcccuccacccactuc

SEQ ID NO: 86373 - DNA, 29 bp, Artificial Sequence
  Synthetic
gttctgatgatcauttctgtgttgtugac

SEQ ID NO: 86374 - DNA, 18 bp, Artificial Sequence
  Synthetic
gggacucacagtguggca

SEQ ID NO: 86375 - DNA, 21 bp, Artificial Sequence
  Synthetic
ggagagccagcuggagacuaa

SEQ ID NO: 86376 - DNA, 23 bp, Artificial Sequence
  Synthetic
cttgttacautccacugcggaga

SEQ ID NO: 86377 - DNA, 22 bp, Artificial Sequence
  Synthetic
aggacucaaggaagugcaaaca

SEQ ID NO: 86378 - DNA, 20 bp, Artificial Sequence
  Synthetic
cctggcccautttgucacct

SEQ ID NO: 86379 - DNA, 17 bp, Artificial Sequence
  Synthetic
cgcaccuggcagtgugt

SEQ ID NO: 86380 - DNA, 20 bp, Artificial Sequence
  Synthetic
gcaacccutaccccagugag

SEQ ID NO: 86381 - DNA, 26 bp, Artificial Sequence
  Synthetic
tgtccaguaaagcaagacctcuaaga

SEQ ID NO: 86382 - DNA, 24 bp, Artificial Sequence
  Synthetic
agautagttggcugaggcaaaact

SEQ ID NO: 86383 - DNA, 19 bp, Artificial Sequence
  Synthetic
gtcacugcagcagcgagua

SEQ ID NO: 86384 - DNA, 20 bp, Artificial Sequence
  Synthetic
tcctccucccagtacgucac

SEQ ID NO: 86385 - DNA, 24 bp, Artificial Sequence
  Synthetic
agtttctccucagtttccctguct

SEQ ID NO: 86386 - DNA, 23 bp, Artificial Sequence
  Synthetic
tcgtcggagguggaatttuacaa

SEQ ID NO: 86387 - DNA, 23 bp, Artificial Sequence
  Synthetic
ctttacacucctcccuggacaag

SEQ ID NO: 86388 - DNA, 21 bp, Artificial Sequence
  Synthetic
cccaggccagauggataggua

SEQ ID NO: 86389 - DNA, 20 bp, Artificial Sequence
  Synthetic
caagggaugccacctgguat

SEQ ID NO: 86390 - DNA, 23 bp, Artificial Sequence
  Synthetic
tccauggaaaaatctcucgggaa

SEQ ID NO: 86391 - DNA, 25 bp, Artificial Sequence
  Synthetic
gccagucacaaggaagctgaatuat

SEQ ID NO: 86392 - DNA, 23 bp, Artificial Sequence
  Synthetic
agaaaagaaaacugcccccacua

SEQ ID NO: 86393 - DNA, 23 bp, Artificial Sequence
  Synthetic
accaggtgatuaagtacgtgcuc

SEQ ID NO: 86394 - DNA, 31 bp, Artificial Sequence
  Synthetic
aagcactttttauagtatttcctgguaagca

SEQ ID NO: 86395 - DNA, 23 bp, Artificial Sequence
  Synthetic
tgcccuguacacaaacaagaaca

SEQ ID NO: 86396 - DNA, 20 bp, Artificial Sequence
  Synthetic
gucacugcaaggaggcaact

SEQ ID NO: 86397 - DNA, 21 bp, Artificial Sequence
  Synthetic
gctgtcucggtcatccugaac

SEQ ID NO: 86398 - DNA, 26 bp, Artificial Sequence
  Synthetic
agatgatgauagagaacaccctugga

SEQ ID NO: 86399 - DNA, 23 bp, Artificial Sequence
  Synthetic
caauactcacagaugccaaagcc

SEQ ID NO: 86400 - DNA, 27 bp, Artificial Sequence
  Synthetic
tgttccaatagcugacagtctcuacat

SEQ ID NO: 86401 - DNA, 21 bp, Artificial Sequence
  Synthetic
gctacagaguctgtuggagca

SEQ ID NO: 86402 - DNA, 19 bp, Artificial Sequence
  Synthetic
acagggcgutgaccagaug

SEQ ID NO: 86403 - DNA, 27 bp, Artificial Sequence
  Synthetic
ctccttctttugcccctatagaattut

SEQ ID NO: 86404 - DNA, 21 bp, Artificial Sequence
  Synthetic
ggcttttucccgtcagcugat

SEQ ID NO: 86405 - DNA, 27 bp, Artificial Sequence
  Synthetic
aggatctttuaatgtggagugggaaac

SEQ ID NO: 86406 - DNA, 22 bp, Artificial Sequence
  Synthetic
cggttccugaggaatuggaagt

SEQ ID NO: 86407 - DNA, 20 bp, Artificial Sequence
  Synthetic
ctttcggaccuggtggtcut

SEQ ID NO: 86408 - DNA, 18 bp, Artificial Sequence
  Synthetic
tcgcacutgctgcuccaa

SEQ ID NO: 86409 - DNA, 17 bp, Artificial Sequence
  Synthetic
tgcggguccgtgacauc

SEQ ID NO: 86410 - DNA, 21 bp, Artificial Sequence
  Synthetic
cagctcctuaaaggcctcgut

SEQ ID NO: 86411 - DNA, 20 bp, Artificial Sequence
  Synthetic
acctcactguctccctcugg

SEQ ID NO: 86412 - DNA, 24 bp, Artificial Sequence
  Synthetic
gggctaaatuaggctaaggacuca

SEQ ID NO: 86413 - DNA, 19 bp, Artificial Sequence
  Synthetic
ctcctcgcutgcgttucag

SEQ ID NO: 86414 - DNA, 22 bp, Artificial Sequence
  Synthetic
autcaagagcucagacgccaat

SEQ ID NO: 86415 - DNA, 27 bp, Artificial Sequence
  Synthetic
gcagaaagccautcttgatagtcttug

SEQ ID NO: 86416 - DNA, 20 bp, Artificial Sequence
  Synthetic
gagcagccaaaugggaucct

SEQ ID NO: 86417 - DNA, 19 bp, Artificial Sequence
  Synthetic
gcctgacucccattgguct

SEQ ID NO: 86418 - DNA, 26 bp, Artificial Sequence
  Synthetic
gatcatggaagaucaacaccucagat

SEQ ID NO: 86419 - DNA, 22 bp, Artificial Sequence
  Synthetic
cctcaggcaucagtauggacac

SEQ ID NO: 86420 - DNA, 28 bp, Artificial Sequence
  Synthetic
actgacatguacctgtttttaacugcat

SEQ ID NO: 86421 - DNA, 24 bp, Artificial Sequence
  Synthetic
ctccacatuaccagtcttcuccag

SEQ ID NO: 86422 - DNA, 23 bp, Artificial Sequence
  Synthetic
ggccagcguggtagtttttctua

SEQ ID NO: 86423 - DNA, 21 bp, Artificial Sequence
  Synthetic
ggaaggacagguttgctgtug

SEQ ID NO: 86424 - DNA, 22 bp, Artificial Sequence
  Synthetic
tcagcaataguggcccttucaa

SEQ ID NO: 86425 - DNA, 26 bp, Artificial Sequence
  Synthetic
cattctgacauctccaacagattugg

SEQ ID NO: 86426 - DNA, 24 bp, Artificial Sequence
  Synthetic
gctccaggauctccttcaaguaag

SEQ ID NO: 86427 - DNA, 31 bp, Artificial Sequence
  Synthetic
aaaaagttgctgutttgaattagctcuacaa

SEQ ID NO: 86428 - DNA, 27 bp, Artificial Sequence
  Synthetic
ttggtactaatgugttcacagaaugct

SEQ ID NO: 86429 - DNA, 26 bp, Artificial Sequence
  Synthetic
catccccacaacuaaaacactcauct

SEQ ID NO: 86430 - DNA, 23 bp, Artificial Sequence
  Synthetic
acgttttcttugggacctguagt

SEQ ID NO: 86431 - DNA, 27 bp, Artificial Sequence
  Synthetic
agagactttgtauaaaggcagaacgug

SEQ ID NO: 86432 - DNA, 20 bp, Artificial Sequence
  Synthetic
aggcttgcuttggtgtguca

SEQ ID NO: 86433 - DNA, 21 bp, Artificial Sequence
  Synthetic
cctcgaggaggcuttgacuct

SEQ ID NO: 86434 - DNA, 20 bp, Artificial Sequence
  Synthetic
agtuagggcagccacgaaug

SEQ ID NO: 86435 - DNA, 19 bp, Artificial Sequence
  Synthetic
agtgcctguctgtccacug

SEQ ID NO: 86436 - DNA, 20 bp, Artificial Sequence
  Synthetic
ctcccacauccccgaggaua

SEQ ID NO: 86437 - DNA, 18 bp, Artificial Sequence
  Synthetic
cggguacaacggctcuca

SEQ ID NO: 86438 - DNA, 21 bp, Artificial Sequence
  Synthetic
ccugaggagaggacucgagat

SEQ ID NO: 86439 - DNA, 21 bp, Artificial Sequence
  Synthetic
cucatgcaauccacagggaca

SEQ ID NO: 86440 - DNA, 28 bp, Artificial Sequence
  Synthetic
cttactaggaaguttttccatggctuct

SEQ ID NO: 86441 - DNA, 27 bp, Artificial Sequence
  Synthetic
cctatttgccaaagugtgactacagut

SEQ ID NO: 86442 - DNA, 22 bp, Artificial Sequence
  Synthetic
gcctguaacagtgtttcugcaa

SEQ ID NO: 86443 - DNA, 22 bp, Artificial Sequence
  Synthetic
ctcttgggaccutcttcuagcc

SEQ ID NO: 86444 - DNA, 18 bp, Artificial Sequence
  Synthetic
gtcacccacgucgtcugt

SEQ ID NO: 86445 - DNA, 20 bp, Artificial Sequence
  Synthetic
gccacttuggcccccatuat

SEQ ID NO: 86446 - DNA, 21 bp, Artificial Sequence
  Synthetic
agctggtcugacttggacuct

SEQ ID NO: 86447 - DNA, 27 bp, Artificial Sequence
  Synthetic
cgagaacacaaugttcaucaacaagat

SEQ ID NO: 86448 - DNA, 22 bp, Artificial Sequence
  Synthetic
ggagacugtctcgguaaaaggg

SEQ ID NO: 86449 - DNA, 25 bp, Artificial Sequence
  Synthetic
ataccgacugccatttcttttgtut

SEQ ID NO: 86450 - DNA, 21 bp, Artificial Sequence
  Synthetic
ccttctcuggcaacagcugat

SEQ ID NO: 86451 - DNA, 22 bp, Artificial Sequence
  Synthetic
gaagtgcucatccttgauccct

SEQ ID NO: 86452 - DNA, 23 bp, Artificial Sequence
  Synthetic
ggugaaaucacaaaggagcgaga

SEQ ID NO: 86453 - DNA, 25 bp, Artificial Sequence
  Synthetic
cgagtagcgguacaaatggatttug

SEQ ID NO: 86454 - DNA, 23 bp, Artificial Sequence
  Synthetic
agccaatgaaggugagtcctcua

SEQ ID NO: 86455 - DNA, 20 bp, Artificial Sequence
  Synthetic
gaagaaucagcacgcaccuc

SEQ ID NO: 86456 - DNA, 22 bp, Artificial Sequence
  Synthetic
aaaacctgaggaugagcagcut

SEQ ID NO: 86457 - DNA, 21 bp, Artificial Sequence
  Synthetic
ggcaagtctugactggctcug

SEQ ID NO: 86458 - DNA, 23 bp, Artificial Sequence
  Synthetic
tcactatgacucctgctguccat

SEQ ID NO: 86459 - DNA, 23 bp, Artificial Sequence
  Synthetic
agtccaagtucaagtccaccauc

SEQ ID NO: 86460 - DNA, 20 bp, Artificial Sequence
  Synthetic
cagucccugaacccaagcat

SEQ ID NO: 86461 - DNA, 17 bp, Artificial Sequence
  Synthetic
cagcuggtuggcgaagg

SEQ ID NO: 86462 - DNA, 21 bp, Artificial Sequence
  Synthetic
ctcctccagcugtgcaatcut

SEQ ID NO: 86463 - DNA, 21 bp, Artificial Sequence
  Synthetic
cggcccagaagaaugagagug

SEQ ID NO: 86464 - DNA, 18 bp, Artificial Sequence
  Synthetic
gtctcgaguggccgtuct

SEQ ID NO: 86465 - DNA, 22 bp, Artificial Sequence
  Synthetic
ggaaaaggtgucaggtgtggut

SEQ ID NO: 86466 - DNA, 19 bp, Artificial Sequence
  Synthetic
cctcaccgaccuggtctut

SEQ ID NO: 86467 - DNA, 20 bp, Artificial Sequence
  Synthetic
agctcccuggaagagacucc

SEQ ID NO: 86468 - DNA, 20 bp, Artificial Sequence
  Synthetic
ctccggagcuccttgttcug

SEQ ID NO: 86469 - DNA, 20 bp, Artificial Sequence
  Synthetic
ggtctcagugcgctctctug

SEQ ID NO: 86470 - DNA, 24 bp, Artificial Sequence
  Synthetic
tccctggauctatagctctucacc

SEQ ID NO: 86471 - DNA, 24 bp, Artificial Sequence
  Synthetic
aaaggtauccctctttgugcaaca

SEQ ID NO: 86472 - DNA, 23 bp, Artificial Sequence
  Synthetic
ttcggcgaaaagucaggatgtua

SEQ ID NO: 86473 - DNA, 27 bp, Artificial Sequence
  Synthetic
gttttcagtttgutttgtacgtgaugg

SEQ ID NO: 86474 - DNA, 26 bp, Artificial Sequence
  Synthetic
ctcccuggagaacagctcaaauaaaa

SEQ ID NO: 86475 - DNA, 28 bp, Artificial Sequence
  Synthetic
ccacacaacacauttatctacaaaugct

SEQ ID NO: 86476 - DNA, 22 bp, Artificial Sequence
  Synthetic
tcctggaaauaacctgggucct

SEQ ID NO: 86477 - DNA, 28 bp, Artificial Sequence
  Synthetic
ttacccaggcugcaataagagatattut

SEQ ID NO: 86478 - DNA, 22 bp, Artificial Sequence
  Synthetic
gcatctgtaagugggacagcut

SEQ ID NO: 86479 - DNA, 25 bp, Artificial Sequence
  Synthetic
ttaaagcctcccutcctcttacuct

SEQ ID NO: 86480 - DNA, 27 bp, Artificial Sequence
  Synthetic
gctatatgctautcattaccgtgugct

SEQ ID NO: 86481 - DNA, 28 bp, Artificial Sequence
  Synthetic
aacggaaactguaaaacaagaaaaugct

SEQ ID NO: 86482 - DNA, 26 bp, Artificial Sequence
  Synthetic
gatgtctatgaagugttgtggtucct

SEQ ID NO: 86483 - DNA, 28 bp, Artificial Sequence
  Synthetic
acagccagauatcaactgtuacagaaat

SEQ ID NO: 86484 - DNA, 21 bp, Artificial Sequence
  Synthetic
agtgagaucccagcccagaut

SEQ ID NO: 86485 - DNA, 24 bp, Artificial Sequence
  Synthetic
cagcatgtgcugaattcttgacuc

SEQ ID NO: 86486 - DNA, 22 bp, Artificial Sequence
  Synthetic
gggtgaccccuatgtggtacua

SEQ ID NO: 86487 - DNA, 25 bp, Artificial Sequence
  Synthetic
tgaaacacttcuggcagtatcctuc

SEQ ID NO: 86488 - DNA, 22 bp, Artificial Sequence
  Synthetic
gcacagcccuttggauaacagt

SEQ ID NO: 86489 - DNA, 20 bp, Artificial Sequence
  Synthetic
ctucccacaggaaggctuga

SEQ ID NO: 86490 - DNA, 22 bp, Artificial Sequence
  Synthetic
gcaccaagaccccuttaacuca

SEQ ID NO: 86491 - DNA, 21 bp, Artificial Sequence
  Synthetic
gtagaaauacggcugcaccga

SEQ ID NO: 86492 - DNA, 20 bp, Artificial Sequence
  Synthetic
gccaagcucgtcucagagaa

SEQ ID NO: 86493 - DNA, 19 bp, Artificial Sequence
  Synthetic
gggtcgaugcactcugagg

SEQ ID NO: 86494 - DNA, 20 bp, Artificial Sequence
  Synthetic
ccagcutgtaccugcaggat

SEQ ID NO: 86495 - DNA, 19 bp, Artificial Sequence
  Synthetic
gaggacuccgucgaggaga

SEQ ID NO: 86496 - DNA, 20 bp, Artificial Sequence
  Synthetic
tctgaggucccccttctgut

SEQ ID NO: 86497 - DNA, 18 bp, Artificial Sequence
  Synthetic
ggagggugcagtgtuggg

SEQ ID NO: 86498 - DNA, 21 bp, Artificial Sequence
  Synthetic
ctctccgucctcggattcuct

SEQ ID NO: 86499 - DNA, 26 bp, Artificial Sequence
  Synthetic
gccaatgaaaaugggaaaggtaucca

SEQ ID NO: 86500 - DNA, 23 bp, Artificial Sequence
  Synthetic
aggaactaugacctcgacuacga

SEQ ID NO: 86501 - DNA, 21 bp, Artificial Sequence
  Synthetic
gcagcagcucgaatttctucc

SEQ ID NO: 86502 - DNA, 21 bp, Artificial Sequence
  Synthetic
accctuggaagcaccatgtut

SEQ ID NO: 86503 - DNA, 22 bp, Artificial Sequence
  Synthetic
cuccagcaaaaagcaucgaaca

SEQ ID NO: 86504 - DNA, 28 bp, Artificial Sequence
  Synthetic
cactattaaccacagautgctgattugg

SEQ ID NO: 86505 - DNA, 26 bp, Artificial Sequence
  Synthetic
ctttcagttguttcatgacgaucagg

SEQ ID NO: 86506 - DNA, 19 bp, Artificial Sequence
  Synthetic
ctgguaacaccgcccugat

SEQ ID NO: 86507 - DNA, 29 bp, Artificial Sequence
  Synthetic
gtaggaaacattuactaggacttgaacut

SEQ ID NO: 86508 - DNA, 23 bp, Artificial Sequence
  Synthetic
ggataaaugaccggtaugcccaa

SEQ ID NO: 86509 - DNA, 21 bp, Artificial Sequence
  Synthetic
ggcttcaguggtatggacugt

SEQ ID NO: 86510 - DNA, 18 bp, Artificial Sequence
  Synthetic
cgcccagcgaggauauct

SEQ ID NO: 86511 - DNA, 19 bp, Artificial Sequence
  Synthetic
gucgttgtcuccccgaagg

SEQ ID NO: 86512 - DNA, 19 bp, Artificial Sequence
  Synthetic
cctccuacgttgcggucac

SEQ ID NO: 86513 - DNA, 23 bp, Artificial Sequence
  Synthetic
tcgcagaugaaactctggtucac

SEQ ID NO: 86514 - DNA, 28 bp, Artificial Sequence
  Synthetic
ttttgtcctugaagaagccttattcuca

SEQ ID NO: 86515 - DNA, 19 bp, Artificial Sequence
  Synthetic
ggcauggacguacagcaag

SEQ ID NO: 86516 - DNA, 19 bp, Artificial Sequence
  Synthetic
agcugcugggaggagacat

SEQ ID NO: 86517 - DNA, 17 bp, Artificial Sequence
  Synthetic
gggcugccgctgtctut

SEQ ID NO: 86518 - DNA, 22 bp, Artificial Sequence
  Synthetic
ctgggagaagcugtatguggac

SEQ ID NO: 86519 - DNA, 20 bp, Artificial Sequence
  Synthetic
gtgtccucctggaugcagat

SEQ ID NO: 86520 - DNA, 20 bp, Artificial Sequence
  Synthetic
cggctgcaugagaacaacug

SEQ ID NO: 86521 - DNA, 20 bp, Artificial Sequence
  Synthetic
ctgtgauaagggcggctuga

SEQ ID NO: 86522 - DNA, 22 bp, Artificial Sequence
  Synthetic
ggcagtcaucaatgtcctccuc

SEQ ID NO: 86523 - DNA, 25 bp, Artificial Sequence
  Synthetic
gtcatttatuggccctgtgttccua

SEQ ID NO: 86524 - DNA, 18 bp, Artificial Sequence
  Synthetic
ggcucccacatgggugac

SEQ ID NO: 86525 - DNA, 23 bp, Artificial Sequence
  Synthetic
tgccctgatuaaaccctgctuac

SEQ ID NO: 86526 - DNA, 27 bp, Artificial Sequence
  Synthetic
cattgcattcaaauttggcatactugt

SEQ ID NO: 86527 - DNA, 20 bp, Artificial Sequence
  Synthetic
ccacaccaugaugagcacca

SEQ ID NO: 86528 - DNA, 21 bp, Artificial Sequence
  Synthetic
cactgtccaacugctgtgaug

SEQ ID NO: 86529 - DNA, 25 bp, Artificial Sequence
  Synthetic
acttttcatugagggtgcatctuct

SEQ ID NO: 86530 - DNA, 27 bp, Artificial Sequence
  Synthetic
ctctagtgagtutccacttcaaguagt

SEQ ID NO: 86531 - DNA, 21 bp, Artificial Sequence
  Synthetic
gaccaggcuggttcagguaag

SEQ ID NO: 86532 - DNA, 30 bp, Artificial Sequence; identical to SEQ ID NO: 20354
  Synthetic

SEQ ID NO: 86533 - DNA, 28 bp, Artificial Sequence
  Synthetic
ggtcctgctuatgtctgtaataucacaa

SEQ ID NO: 86534 - DNA, 21 bp, Artificial Sequence
  Synthetic
cgacagaagaugcacccucaa

SEQ ID NO: 86535 - DNA, 28 bp, Artificial Sequence
  Synthetic
tccacaatacucaaatcctattcuccca

SEQ ID NO: 86536 - DNA, 27 bp, Artificial Sequence
  Synthetic
ctttctggaagugaggtgctatttuct

SEQ ID NO: 86537 - DNA, 24 bp, Artificial Sequence
  Synthetic
ccatgutaaaacttcaugcagcca

SEQ ID NO: 86538 - DNA, 19 bp, Artificial Sequence
  Synthetic
caggaccutggctgcauga

SEQ ID NO: 86539 - DNA, 30 bp, Artificial Sequence
  Synthetic
cacttgctauaagcctatacatttttgugt

SEQ ID NO: 86540 - DNA, 22 bp, Artificial Sequence
  Synthetic
ctgacguccagtgtacagugaa

SEQ ID NO: 86541 - DNA, 26 bp, Artificial Sequence
  Synthetic
ggttattcagucagtagctgcugaag

SEQ ID NO: 86542 - DNA, 19 bp, Artificial Sequence
  Synthetic
ccagcagaagagccuccut

SEQ ID NO: 86543 - DNA, 27 bp, Artificial Sequence
  Synthetic
gaagaatggcugcagattgagatauca

SEQ ID NO: 86544 - DNA, 26 bp, Artificial Sequence
  Synthetic
caagtacttugcaaacacacauacct

SEQ ID NO: 86545 - DNA, 21 bp, Artificial Sequence
  Synthetic
tcccuaaagctggagucccaa

SEQ ID NO: 86546 - DNA, 20 bp, Artificial Sequence
  Synthetic
ggaccuagcgtggacucact

SEQ ID NO: 86547 - DNA, 19 bp, Artificial Sequence
  Synthetic
catctgaaucgggcugcga

SEQ ID NO: 86548 - DNA, 27 bp, Artificial Sequence
  Synthetic
ttctagtaattugggaatgcctggtut

SEQ ID NO: 86549 - DNA, 28 bp, Artificial Sequence
  Synthetic
cccgcctcugaatatttctttaatgtug

SEQ ID NO: 86550 - DNA, 19 bp, Artificial Sequence
  Synthetic
cctggcguagactguggac

SEQ ID NO: 86551 - DNA, 17 bp, Artificial Sequence
  Synthetic
gcutcugccgccacaac

SEQ ID NO: 86552 - DNA, 19 bp, Artificial Sequence
  Synthetic
tccuacgguggagccaaga

SEQ ID NO: 86553 - DNA, 18 bp, Artificial Sequence
  Synthetic
gttcuccagcagggcugt

SEQ ID NO: 86554 - DNA, 19 bp, Artificial Sequence
  Synthetic
caccgaugccguggaagat

SEQ ID NO: 86555 - DNA, 21 bp, Artificial Sequence
  Synthetic
gagcucagaggaagcctgaug

SEQ ID NO: 86556 - DNA, 23 bp, Artificial Sequence
  Synthetic
gutagtttctcuaggcacggcaa

SEQ ID NO: 86557 - DNA, 22 bp, Artificial Sequence
  Synthetic
agctgaaggcaaugatgcauga

SEQ ID NO: 86558 - DNA, 27 bp, Artificial Sequence
  Synthetic
gagggaggaaugataaaggttaaguga

SEQ ID NO: 86559 - DNA, 22 bp, Artificial Sequence
  Synthetic
ggucggccaagacacctauaag

SEQ ID NO: 86560 - DNA, 19 bp, Artificial Sequence
  Synthetic
gtgctacuctcggucccaa

SEQ ID NO: 86561 - DNA, 24 bp, Artificial Sequence
  Synthetic
gatggacaggacgauctcauagga

SEQ ID NO: 86562 - DNA, 23 bp, Artificial Sequence
  Synthetic
gagcugggaaacagaagaatgug

SEQ ID NO: 86563 - DNA, 24 bp, Artificial Sequence
  Synthetic
ctatctccaucagtgacccccuaa

SEQ ID NO: 86564 - DNA, 27 bp, Artificial Sequence
  Synthetic
tgaatccttttaccucctgttctcuca

SEQ ID NO: 86565 - DNA, 23 bp, Artificial Sequence
  Synthetic
gaaacgagacgauggttcuaggg

SEQ ID NO: 86566 - DNA, 23 bp, Artificial Sequence
  Synthetic
aattcagtccucatcagctguct

SEQ ID NO: 86567 - DNA, 22 bp, Artificial Sequence
  Synthetic
gaggtcctuccctttccactuc

SEQ ID NO: 86568 - DNA, 19 bp, Artificial Sequence
  Synthetic
catguccgaacgagguggt

SEQ ID NO: 86569 - DNA, 19 bp, Artificial Sequence
  Synthetic
gcugaaggagccgtucgat

SEQ ID NO: 86570 - DNA, 20 bp, Artificial Sequence
  Synthetic
attggcugcagagtucggat

SEQ ID NO: 86571 - DNA, 28 bp, Artificial Sequence
  Synthetic
cuactatcaatacucgaccagcagaaaa

SEQ ID NO: 86572 - DNA, 20 bp, Artificial Sequence
  Synthetic
gcccgtgutctctcctttug

SEQ ID NO: 86573 - DNA, 21 bp, Artificial Sequence
  Synthetic
ctcacctttuggccaccttug

SEQ ID NO: 86574 - DNA, 28 bp, Artificial Sequence
  Synthetic
cctctattttgacutcctgtctcugaac

SEQ ID NO: 86575 - DNA, 24 bp, Artificial Sequence
  Synthetic
tggaaauacugcggaacaaacaga

SEQ ID NO: 86576 - DNA, 21 bp, Artificial Sequence
  Synthetic
cccaagaguacctgccatgug

SEQ ID NO: 86577 - DNA, 25 bp, Artificial Sequence
  Synthetic
ctgctgatccuctttttctctcugt

SEQ ID NO: 86578 - DNA, 21 bp, Artificial Sequence
  Synthetic
gtcagccagcugctgtttcua

SEQ ID NO: 86579 - DNA, 23 bp, Artificial Sequence
  Synthetic
gttctgaggcutcatatcucggt

SEQ ID NO: 86580 - DNA, 22 bp, Artificial Sequence
  Synthetic
cgtgggacautctgcugaacat

SEQ ID NO: 86581 - DNA, 22 bp, Artificial Sequence
  Synthetic
cccaagguaccatcttcugagt

SEQ ID NO: 86582 - DNA, 21 bp, Artificial Sequence
  Synthetic
ctggacatggaugctgaccuc

SEQ ID NO: 86583 - DNA, 27 bp, Artificial Sequence
  Synthetic
gctgctgggaaguaaattagaggauac

SEQ ID NO: 86584 - DNA, 24 bp, Artificial Sequence
  Synthetic
gagaaaaatccaaugctggtgugt

SEQ ID NO: 86585 - DNA, 23 bp, Artificial Sequence
  Synthetic
ccctcttcaucccaagattcuca

SEQ ID NO: 86586 - DNA, 21 bp, Artificial Sequence
  Synthetic
ttgtgaacacagugtcugcct

SEQ ID NO: 86587 - DNA, 26 bp, Artificial Sequence
  Synthetic
agaagctcttggauaaaggacaagug

SEQ ID NO: 86588 - DNA, 25 bp, Artificial Sequence
  Synthetic
gctttcacaccuctcagtgacttuc

SEQ ID NO: 86589 - DNA, 28 bp, Artificial Sequence
  Synthetic
ggcagtttcaauaatgctgtatgtugac

SEQ ID NO: 86590 - DNA, 27 bp, Artificial Sequence
  Synthetic
tgtgtatggaggugattcttcagauga

SEQ ID NO: 86591 - DNA, 29 bp, Artificial Sequence
  Synthetic
ttccatttgaaaagugaatacatgccaut

SEQ ID NO: 86592 - DNA, 25 bp, Artificial Sequence
  Synthetic
ccaaagaggcauctatgtgauccag

SEQ ID NO: 86593 - DNA, 27 bp, Artificial Sequence
  Synthetic
tctgtgaagagcauaggttagaaguca

SEQ ID NO: 86594 - DNA, 18 bp, Artificial Sequence
  Synthetic
gggccacaacugctgcua

SEQ ID NO: 86595 - DNA, 19 bp, Artificial Sequence
  Synthetic
gcaggagcugcaggucaag

SEQ ID NO: 86596 - DNA, 18 bp, Artificial Sequence
  Synthetic
gcgctcuccctcgtugaa

SEQ ID NO: 86597 - DNA, 23 bp, Artificial Sequence
  Synthetic
aggugaaagcaaaccucgagaag

SEQ ID NO: 86598 - DNA, 23 bp, Artificial Sequence
  Synthetic
gctctaacucctctgctgtucct

SEQ ID NO: 86599 - DNA, 19 bp, Artificial Sequence
  Synthetic
ccacguagccgaaguccac

SEQ ID NO: 86600 - DNA, 20 bp, Artificial Sequence
  Synthetic
cugcaucacggaacgagaag

SEQ ID NO: 86601 - DNA, 20 bp, Artificial Sequence
  Synthetic
gtttccggcautggtugagt

SEQ ID NO: 86602 - DNA, 20 bp, Artificial Sequence
  Synthetic
catacugccagggtcctguc

SEQ ID NO: 86603 - DNA, 20 bp, Artificial Sequence
  Synthetic
tgctgtgtuggagcaagugt

SEQ ID NO: 86604 - DNA, 17 bp, Artificial Sequence
  Synthetic
ccuggcgugaccaccaa

SEQ ID NO: 86605 - DNA, 18 bp, Artificial Sequence
  Synthetic
cctgucccaccagcucac

SEQ ID NO: 86606 - DNA, 22 bp, Artificial Sequence
  Synthetic
ctcgttcuccagagtctgctut

SEQ ID NO: 86607 - DNA, 21 bp, Artificial Sequence
  Synthetic
gaagcagcgaugtctggauct

SEQ ID NO: 86608 - DNA, 20 bp, Artificial Sequence
  Synthetic
gcatucccaccgcatccuac

SEQ ID NO: 86609 - DNA, 24 bp, Artificial Sequence
  Synthetic
gtggaacuggaagcttagauggat

SEQ ID NO: 86610 - DNA, 24 bp, Artificial Sequence
  Synthetic
cctagcttagaugatgacgaugct

SEQ ID NO: 86611 - DNA, 22 bp, Artificial Sequence
  Synthetic
ccctcucaccacctttcttuca

SEQ ID NO: 86612 - DNA, 25 bp, Artificial Sequence
  Synthetic
gcttcgtucggttttgctguaaaaa

SEQ ID NO: 86613 - DNA, 27 bp, Artificial Sequence
  Synthetic
tctagatugcaacagaggcuacaaaag

SEQ ID NO: 86614 - DNA, 25 bp, Artificial Sequence
  Synthetic
tccccatuggtttgttatugcagat

SEQ ID NO: 86615 - DNA, 24 bp, Artificial Sequence
  Synthetic
agtttcaucgagttcuagcccaac

SEQ ID NO: 86616 - DNA, 20 bp, Artificial Sequence
  Synthetic
tgcgggcacacacutauagg

SEQ ID NO: 86617 - DNA, 19 bp, Artificial Sequence
  Synthetic
cacagcaaagcuggcacug

SEQ ID NO: 86618 - DNA, 28 bp, Artificial Sequence
  Synthetic
aactatcttgtutatttggagctuccca

SEQ ID NO: 86619 - DNA, 21 bp, Artificial Sequence
  Synthetic
gaaagcccacgacaugaucac

SEQ ID NO: 86620 - DNA, 18 bp, Artificial Sequence
  Synthetic
tguctcgggtucgagggt

SEQ ID NO: 86621 - DNA, 22 bp, Artificial Sequence
  Synthetic
cagggtugactgagtcttuggt

SEQ ID NO: 86622 - DNA, 23 bp, Artificial Sequence
  Synthetic
gggtgaaguggactgtactctua

SEQ ID NO: 86623 - DNA, 21 bp, Artificial Sequence
  Synthetic
gatgcagccucactagaggug

SEQ ID NO: 86624 - DNA, 22 bp, Artificial Sequence
  Synthetic
gcttggagacaaggaucctgut

SEQ ID NO: 86625 - DNA, 21 bp, Artificial Sequence
  Synthetic
gcccagagcugatgcaacaut

SEQ ID NO: 86626 - DNA, 19 bp, Artificial Sequence
  Synthetic
ccgtgguacgctucagagt

SEQ ID NO: 86627 - DNA, 21 bp, Artificial Sequence
  Synthetic
ccttuacaggacgacguggag

SEQ ID NO: 86628 - DNA, 20 bp, Artificial Sequence
  Synthetic
agagtgcgguattcccggua

SEQ ID NO: 86629 - DNA, 20 bp, Artificial Sequence
  Synthetic
ctgacgcgutcccttuacag

SEQ ID NO: 86630 - DNA, 28 bp, Artificial Sequence
  Synthetic
gtaagtcaucgaaagcatcatagtuact

SEQ ID NO: 86631 - DNA, 25 bp, Artificial Sequence
  Synthetic
ttctgccagtutctgctgaaattug

SEQ ID NO: 86632 - DNA, 24 bp, Artificial Sequence
  Synthetic
cagtaaacatcucccaggagaguc

SEQ ID NO: 86633 - DNA, 24 bp, Artificial Sequence
  Synthetic
gcataaacaaaccugccaacugaa

SEQ ID NO: 86634 - DNA, 20 bp, Artificial Sequence
  Synthetic
ccatctuggccctctctgut

SEQ ID NO: 86635 - DNA, 21 bp, Artificial Sequence
  Synthetic
cttgtctgguttggccugact

SEQ ID NO: 86636 - DNA, 27 bp, Artificial Sequence
  Synthetic
agaagacattacuaaccctggctcuaa

SEQ ID NO: 86637 - DNA, 20 bp, Artificial Sequence
  Synthetic
cctguccctgctucagcaag

SEQ ID NO: 86638 - DNA, 20 bp, Artificial Sequence
  Synthetic
cacugtgtgcguagacaggt

SEQ ID NO: 86639 - DNA, 23 bp, Artificial Sequence
  Synthetic
ggcaggaggaaagaguacaaugt

SEQ ID NO: 86640 - DNA, 28 bp, Artificial Sequence
  Synthetic
gcatatgagguagaactgaacggataut

SEQ ID NO: 86641 - DNA, 26 bp, Artificial Sequence
  Synthetic
gcagttaaaccuctacaacacuccat

SEQ ID NO: 86642 - DNA, 22 bp, Artificial Sequence
  Synthetic
cgtccccautttctuccaacag

SEQ ID NO: 86643 - DNA, 24 bp, Artificial Sequence
  Synthetic
gagcacagaaauctccagactuca

SEQ ID NO: 86644 - DNA, 22 bp, Artificial Sequence
  Synthetic
ggccagtutctctgctucagaa

SEQ ID NO: 86645 - DNA, 21 bp, Artificial Sequence
  Synthetic
tcauctgctcugaggcaaacc

SEQ ID NO: 86646 - DNA, 19 bp, Artificial Sequence
  Synthetic
tgacggcucccttctccut

SEQ ID NO: 86647 - DNA, 19 bp, Artificial Sequence
  Synthetic
gcagccagagacgguacuc

SEQ ID NO: 86648 - DNA, 25 bp, Artificial Sequence
  Synthetic
tgtgtttuaaaaaggctcctcuggt

SEQ ID NO: 86649 - DNA, 17 bp, Artificial Sequence
  Synthetic
cagaucgcccgcatucc

SEQ ID NO: 86650 - DNA, 18 bp, Artificial Sequence
  Synthetic
gcgcgccguttactugaa

SEQ ID NO: 86651 - DNA, 19 bp, Artificial Sequence
  Synthetic
ctgaccaguggtccagcuc

SEQ ID NO: 86652 - DNA, 20 bp, Artificial Sequence
  Synthetic
ccagucggagacgtuggaat

SEQ ID NO: 86653 - DNA, 18 bp, Artificial Sequence
  Synthetic
cccucgcagcacagcuac

SEQ ID NO: 86654 - DNA, 18 bp, Artificial Sequence
  Synthetic
gutguccacaggcgagga

SEQ ID NO: 86655 - DNA, 17 bp, Artificial Sequence
  Synthetic
cctggcggugcacacua

SEQ ID NO: 86656 - DNA, 20 bp, Artificial Sequence
  Synthetic
caaaggaccccguctgtcug

SEQ ID NO: 86657 - DNA, 24 bp, Artificial Sequence
  Synthetic
cttgagagaaagggugttguacct

SEQ ID NO: 86658 - DNA, 23 bp, Artificial Sequence
  Synthetic
caaaatactugcgagaacggugt

SEQ ID NO: 86659 - DNA, 25 bp, Artificial Sequence
  Synthetic
tgacattucacccgagauaggagaa

SEQ ID NO: 86660 - DNA, 19 bp, Artificial Sequence
  Synthetic
tgaaatucagggccccucc

SEQ ID NO: 86661 - DNA, 17 bp, Artificial Sequence
  Synthetic
gcaucgggcaccugaac

SEQ ID NO: 86662 - DNA, 19 bp, Artificial Sequence
  Synthetic
ggugggccagtcucaaagg

SEQ ID NO: 86663 - DNA, 17 bp, Artificial Sequence
  Synthetic
cagcaguctccguccgt

SEQ ID NO: 86664 - DNA, 18 bp, Artificial Sequence
  Synthetic
catcccaggcagguggut

SEQ ID NO: 86665 - DNA, 17 bp, Artificial Sequence
  Synthetic
agctccggcaugctcuc

SEQ ID NO: 86666 - DNA, 23 bp, Artificial Sequence
  Synthetic
attctcuccagctgttucccaag

SEQ ID NO: 86667 - DNA, 28 bp, Artificial Sequence
  Synthetic
tcttatgatagttcuctgaggtcaggut

SEQ ID NO: 86668 - DNA, 20 bp, Artificial Sequence
  Synthetic
cacgtcugacagguagccat

SEQ ID NO: 86669 - DNA, 18 bp, Artificial Sequence
  Synthetic
ggccuguggaagcaagga

SEQ ID NO: 86670 - DNA, 20 bp, Artificial Sequence
  Synthetic
ccgtccugggacttctucct

SEQ ID NO: 86671 - DNA, 17 bp, Artificial Sequence
  Synthetic
cgcccaacggcuaccug

SEQ ID NO: 86672 - DNA, 20 bp, Artificial Sequence
  Synthetic
cgagctcugcatggacugaa

SEQ ID NO: 86673 - DNA, 23 bp, Artificial Sequence
  Synthetic
accaguggatttcctugacccat

SEQ ID NO: 86674 - DNA, 18 bp, Artificial Sequence
  Synthetic
gggctugcggaccttcut

SEQ ID NO: 86675 - DNA, 19 bp, Artificial Sequence
  Synthetic
gcgcatgcaucacgacauc

SEQ ID NO: 86676 - DNA, 22 bp, Artificial Sequence
  Synthetic
ccacaaguatcuggagcccaac

SEQ ID NO: 86677 - DNA, 27 bp, Artificial Sequence
  Synthetic
gggaggtugaacgttacataaauacca

SEQ ID NO: 86678 - DNA, 28 bp, Artificial Sequence
  Synthetic
atctgtgguctaattagcucaaaagaaa

SEQ ID NO: 86679 - DNA, 28 bp, Artificial Sequence
  Synthetic
aggaagaaagugaaaatgatugggaaga

SEQ ID NO: 86680 - DNA, 18 bp, Artificial Sequence
  Synthetic
ctcgagcacuggcagugt

SEQ ID NO: 86681 - DNA, 17 bp, Artificial Sequence
  Synthetic
tggaccggccagaugug

SEQ ID NO: 86682 - DNA, 22 bp, Artificial Sequence
  Synthetic
accatgcugaggagactgttut

SEQ ID NO: 86683 - DNA, 25 bp, Artificial Sequence
  Synthetic
gcagtatctcutctgggaacugaga

SEQ ID NO: 86684 - DNA, 19 bp, Artificial Sequence
  Synthetic
cctgcacguagctcucgaa

SEQ ID NO: 86685 - DNA, 17 bp, Artificial Sequence
  Synthetic
caugugcagccgggaac

SEQ ID NO: 86686 - DNA, 26 bp, Artificial Sequence
  Synthetic
gtctatcgagtgugtgcatatgtgua

SEQ ID NO: 86687 - DNA, 23 bp, Artificial Sequence
  Synthetic
cttcctuacctgggatuggaaca

SEQ ID NO: 86688 - DNA, 20 bp, Artificial Sequence
  Synthetic
gcatgaaggcucgctguacc

SEQ ID NO: 86689 - DNA, 20 bp, Artificial Sequence
  Synthetic
acatggucccatcccacuga

SEQ ID NO: 86690 - DNA, 22 bp, Artificial Sequence
  Synthetic
agggccaaagaguccatcagua

SEQ ID NO: 86691 - DNA, 20 bp, Artificial Sequence
  Synthetic
gaauacacacgcacggtguc

SEQ ID NO: 86692 - DNA, 19 bp, Artificial Sequence
  Synthetic
gaacgagggugcgaacuct

SEQ ID NO: 86693 - DNA, 22 bp, Artificial Sequence
  Synthetic
gcaatgggccutcctcttctuc

SEQ ID NO: 86694 - DNA, 27 bp, Artificial Sequence
  Synthetic
gaaagtgaaatucttcctgaaauggca

SEQ ID NO: 86695 - DNA, 28 bp, Artificial Sequence
  Synthetic
aaagtcauccaaagatagcugaggaaat

SEQ ID NO: 86696 - DNA, 21 bp, Artificial Sequence
  Synthetic
gctcaccugaatgcctcugaa

SEQ ID NO: 86697 - DNA, 24 bp, Artificial Sequence
  Synthetic
tgagccttttucccttctttgugt

SEQ ID NO: 86698 - DNA, 25 bp, Artificial Sequence
  Synthetic
gtcaagatgauacaggtcagtgugg

SEQ ID NO: 86699 - DNA, 26 bp, Artificial Sequence
  Synthetic
caagttttcaaaucctgtggaauggt

SEQ ID NO: 86700 - DNA, 23 bp, Artificial Sequence
  Synthetic
tgutgatuagccagagaggagga

SEQ ID NO: 86701 - DNA, 26 bp, Artificial Sequence
  Synthetic
acttccttctgautttgtgctctuga

SEQ ID NO: 86702 - DNA, 27 bp, Artificial Sequence
  Synthetic
caacaccataccutagaatgagcacua

SEQ ID NO: 86703 - DNA, 28 bp, Artificial Sequence
  Synthetic
ggttattccagautctgttcaagaguct

SEQ ID NO: 86704 - DNA, 27 bp, Artificial Sequence
  Synthetic
ccattccacaggauttgaaaactugaa

SEQ ID NO: 86705 - DNA, 33 bp, Artificial Sequence
  Synthetic
tttctatgatttcuatattggtcaataaucccc

SEQ ID NO: 86706 - DNA, 31 bp, Artificial Sequence
  Synthetic
cacaaagaatuaggctatttacugacaggat

SEQ ID NO: 86707 - DNA, 24 bp, Artificial Sequence
  Synthetic
agtccaagtugcttctcagtctuc

SEQ ID NO: 86708 - DNA, 26 bp, Artificial Sequence
  Synthetic
acctttaccagutctctgugaagact

SEQ ID NO: 86709 - DNA, 26 bp, Artificial Sequence
  Synthetic
caaagagacaacuggauacagagaca

SEQ ID NO: 86710 - DNA, 21 bp, Artificial Sequence
  Synthetic
cccttcctucatctgccgtua

SEQ ID NO: 86711 - DNA, 20 bp, Artificial Sequence
  Synthetic
gcttuggaacagggctccuc

SEQ ID NO: 86712 - DNA, 27 bp, Artificial Sequence
  Synthetic
aagatgcatagauaggctcatctggua

SEQ ID NO: 86713 - DNA, 24 bp, Artificial Sequence
  Synthetic
caccctctautagtgcaccucaaa

SEQ ID NO: 86714 - DNA, 28 bp, Artificial Sequence
  Synthetic
gaagatttgtctcugtatccagttguct

SEQ ID NO: 86715 - DNA, 27 bp, Artificial Sequence
  Synthetic
ccgagcuccaaaggtctauaaaaagat

SEQ ID NO: 86716 - DNA, 29 bp, Artificial Sequence
  Synthetic
gcaaaattcaaugatcataatggaugaca

SEQ ID NO: 86717 - DNA, 26 bp, Artificial Sequence
  Synthetic
gggcaaaactuactgctaactaauct

SEQ ID NO: 86718 - DNA, 22 bp, Artificial Sequence
  Synthetic
agcagtaagtuttgccccctut

SEQ ID NO: 86719 - DNA, 26 bp, Artificial Sequence
  Synthetic
cacttgacaccaugtttttcagcaut

SEQ ID NO: 86720 - DNA, 18 bp, Artificial Sequence
  Synthetic
gtgtgcgucacgctugaa

SEQ ID NO: 86721 - DNA, 17 bp, Artificial Sequence
  Synthetic
ggacgggcuggactgug

SEQ ID NO: 86722 - DNA, 23 bp, Artificial Sequence
  Synthetic
cucagacagtuggcaagaaaacc

SEQ ID NO: 86723 - DNA, 22 bp, Artificial Sequence
  Synthetic
cagctgugcagtgagatttucc

SEQ ID NO: 86724 - DNA, 21 bp, Artificial Sequence
  Synthetic
gctgaagtgguccttgcagua

SEQ ID NO: 86725 - DNA, 22 bp, Artificial Sequence
  Synthetic
atgcagttcuaaggctctgcuc

SEQ ID NO: 86726 - DNA, 26 bp, Artificial Sequence
  Synthetic
cccattgtatgaaucagccacaatut

SEQ ID NO: 86727 - DNA, 28 bp, Artificial Sequence
  Synthetic
cagggatacttgutggctgaatttaaug

SEQ ID NO: 86728 - DNA, 28 bp, Artificial Sequence
  Synthetic
tgtgaataaaggguccttagtagctcut

SEQ ID NO: 86729 - DNA, 21 bp, Artificial Sequence
  Synthetic
ggtgugggaggcgagatttut

SEQ ID NO: 86730 - DNA, 25 bp, Artificial Sequence
  Synthetic
aaggcaccauatattgtgttuggga

SEQ ID NO: 86731 - DNA, 24 bp, Artificial Sequence
  Synthetic
tgccataagaguggacaggtttug

SEQ ID NO: 86732 - DNA, 26 bp, Artificial Sequence
  Synthetic
aggaagagaaacuggagtctcattug

SEQ ID NO: 86733 - DNA, 27 bp, Artificial Sequence
  Synthetic
aagttgttacaatugctgccaatgaut

SEQ ID NO: 86734 - DNA, 28 bp, Artificial Sequence
  Synthetic
tccgggaactuacgtagaatatatugga

SEQ ID NO: 86735 - DNA, 26 bp, Artificial Sequence
  Synthetic
aaagaaagggagucatuaagcaacca

SEQ ID NO: 86736 - DNA, 21 bp, Artificial Sequence
  Synthetic
ggtgtguggctactttugggt

SEQ ID NO: 86737 - DNA, 28 bp, Artificial Sequence
  Synthetic
ccagatugaccaaaaacaaacaaacuct

SEQ ID NO: 86738 - DNA, 25 bp, Artificial Sequence
  Synthetic
acttgtttugccctaaaccuacaca

SEQ ID NO: 86739 - DNA, 28 bp, Artificial Sequence
  Synthetic
cgaagaatgugggaaagaatttauggat

SEQ ID NO: 86740 - DNA, 27 bp, Artificial Sequence
  Synthetic
gcagttaucacaagttggcaaaucaaa

SEQ ID NO: 86741 - DNA, 28 bp, Artificial Sequence
  Synthetic
agttcattttccutttcttaggaccugt

SEQ ID NO: 86742 - DNA, 27 bp, Artificial Sequence
  Synthetic
tctttcccacautcttcgcatatuaca

SEQ ID NO: 86743 - DNA, 33 bp, Artificial Sequence
  Synthetic
ttgtcttttactuaaatgtatttatgucaggca

SEQ ID NO: 86744 - DNA, 22 bp, Artificial Sequence
  Synthetic
cctcttaucccctgtgauccct

SEQ ID NO: 86745 - DNA, 22 bp, Artificial Sequence
  Synthetic
catgacacugcagcttctgtuc

SEQ ID NO: 86746 - DNA, 18 bp, Artificial Sequence
  Synthetic
agctggagcugggtcuct

SEQ ID NO: 86747 - DNA, 20 bp, Artificial Sequence
  Synthetic
gctugaggaccaagggtgug

SEQ ID NO: 86748 - DNA, 21 bp, Artificial Sequence
  Synthetic
catggccuaccagagtugcat

SEQ ID NO: 86749 - DNA, 23 bp, Artificial Sequence
  Synthetic
ctaacacgugtgtgtuccaacag

SEQ ID NO: 86750 - DNA, 25 bp, Artificial Sequence
  Synthetic
tgcttccaaguggactgattctgua

SEQ ID NO: 86751 - DNA, 22 bp, Artificial Sequence
  Synthetic
actggauccaaggaccaugaac

SEQ ID NO: 86752 - DNA, 24 bp, Artificial Sequence
  Synthetic
tcatgaacagaaagcuttgguggt

SEQ ID NO: 86753 - DNA, 28 bp, Artificial Sequence
  Synthetic
aagctggtacatutccttagttgtagug

SEQ ID NO: 86754 - DNA, 21 bp, Artificial Sequence
  Synthetic
ggaaccctcugcactgttcut

SEQ ID NO: 86755 - DNA, 20 bp, Artificial Sequence
  Synthetic
ccttacaccaccucccucac

SEQ ID NO: 86756 - DNA, 26 bp, Artificial Sequence
  Synthetic
ctagtttctauaccttcgagggucca

SEQ ID NO: 86757 - DNA, 28 bp, Artificial Sequence
  Synthetic
gttccacaaacautcagccctttauaat

SEQ ID NO: 86758 - DNA, 19 bp, Artificial Sequence
  Synthetic
guactggccucaggccaaa

SEQ ID NO: 86759 - DNA, 19 bp, Artificial Sequence
  Synthetic
gccaugagggcgtuagaca

SEQ ID NO: 86760 - DNA, 19 bp, Artificial Sequence
  Synthetic
ctagctuccgcctctguct

SEQ ID NO: 86761 - DNA, 19 bp, Artificial Sequence
  Synthetic
gctgguccacacugcaagg

SEQ ID NO: 86762 - DNA, 24 bp, Artificial Sequence
  Synthetic
tttctccucggacaucaacaacat

SEQ ID NO: 86763 - DNA, 19 bp, Artificial Sequence
  Synthetic
ctcaccugtgtuggagcga

SEQ ID NO: 86764 - DNA, 21 bp, Artificial Sequence
  Synthetic
cagccctguacaagtcacugt

SEQ ID NO: 86765 - DNA, 17 bp, Artificial Sequence
  Synthetic
gccacautgccgucacc

SEQ ID NO: 86766 - DNA, 27 bp, Artificial Sequence
  Synthetic
tgcgctataaagugctcatctttacut

SEQ ID NO: 86767 - DNA, 20 bp, Artificial Sequence
  Synthetic
cagaggcucgcagtctttug

SEQ ID NO: 86768 - DNA, 26 bp, Artificial Sequence
  Synthetic
caagaagaaaacggcautttgagugt

SEQ ID NO: 86769 - DNA, 23 bp, Artificial Sequence
  Synthetic
cacctttcctugcctctttccua

SEQ ID NO: 86770 - DNA, 18 bp, Artificial Sequence
  Synthetic
ccaactcugcccccucac

SEQ ID NO: 86771 - DNA, 21 bp, Artificial Sequence
  Synthetic
gctgccttuaggtcacacuct

SEQ ID NO: 86772 - DNA, 28 bp, Artificial Sequence
  Synthetic
gaactatgaucacaatgacagtacugag

SEQ ID NO: 86773 - DNA, 18 bp, Artificial Sequence
  Synthetic
cccacuggctgtctugga

SEQ ID NO: 86774 - DNA, 22 bp, Artificial Sequence
  Synthetic
tcugtttuccaagacagccagt

SEQ ID NO: 86775 - DNA, 28 bp, Artificial Sequence
  Synthetic
gcaagcctuaatggaaagaaatucagaa

SEQ ID NO: 86776 - DNA, 27 bp, Artificial Sequence
  Synthetic
ggtaactucagcttgttggtuagagat

SEQ ID NO: 86777 - DNA, 24 bp, Artificial Sequence
  Synthetic
gtgatttccucttactaggcugct

SEQ ID NO: 86778 - DNA, 31 bp, Artificial Sequence
  Synthetic
gttttaattgcucttgaaaatctgaugacga

SEQ ID NO: 86779 - DNA, 28 bp, Artificial Sequence
  Synthetic
gcacatctgttuctgctgttttacuaag

SEQ ID NO: 86780 - DNA, 28 bp, Artificial Sequence
  Synthetic
gacttgttauggaccattacctaguaca

SEQ ID NO: 86781 - DNA, 28 bp, Artificial Sequence
  Synthetic
ttggaatggaaugactgaagtaucaaca

SEQ ID NO: 86782 - DNA, 19 bp, Artificial Sequence
  Synthetic
gaagacccgccuaacugct

SEQ ID NO: 86783 - DNA, 17 bp, Artificial Sequence
  Synthetic
cccuggcccagctugac

SEQ ID NO: 86784 - DNA, 27 bp, Artificial Sequence
  Synthetic
ctcagagcugaaagaatcaatgaagug

SEQ ID NO: 86785 - DNA, 27 bp, Artificial Sequence
  Synthetic
caagaacctgggacugaagatgaaaua

SEQ ID NO: 86786 - DNA, 27 bp, Artificial Sequence
  Synthetic
caccagataaguattggtgacttuggt

SEQ ID NO: 86787 - DNA, 28 bp, Artificial Sequence
  Synthetic
tctgagagttcucccatgatacatuact

SEQ ID NO: 86788 - DNA, 18 bp, Artificial Sequence
  Synthetic
gggagaucccucgggagt

SEQ ID NO: 86789 - DNA, 21 bp, Artificial Sequence
  Synthetic
cauccagcagaggcagcuaaa

SEQ ID NO: 86790 - DNA, 28 bp, Artificial Sequence
  Synthetic
cactaagaatgcauttcaggacattuca

SEQ ID NO: 86791 - DNA, 26 bp, Artificial Sequence
  Synthetic
ggtctttatugccattttctgacugg

SEQ ID NO: 86792 - DNA, 28 bp, Artificial Sequence
  Synthetic
ctgatttgagauaccttgtgtatucagt

SEQ ID NO: 86793 - DNA, 25 bp, Artificial Sequence
  Synthetic
gcctcctgcauctttcaaaagctua

SEQ ID NO: 86794 - DNA, 23 bp, Artificial Sequence
  Synthetic
caaaaacgcccauttgcctauca

SEQ ID NO: 86795 - DNA, 22 bp, Artificial Sequence
  Synthetic
tgactugcaggacagcaauact

SEQ ID NO: 86796 - DNA, 21 bp, Artificial Sequence
  Synthetic
caacggaaguctcuccagagt

SEQ ID NO: 86797 - DNA, 26 bp, Artificial Sequence
  Synthetic
ccatgaaaggaaaaaggutctcuggt

SEQ ID NO: 86798 - DNA, 27 bp, Artificial Sequence
  Synthetic
ttgttttacaccucctgaaaagcuaca

SEQ ID NO: 86799 - DNA, 27 bp, Artificial Sequence
  Synthetic
tgttgtttcttautagctgtgggucat

SEQ ID NO: 86800 - DNA, 20 bp, Artificial Sequence
  Synthetic
ccagcccccutctcatcuca

SEQ ID NO: 86801 - DNA, 19 bp, Artificial Sequence
  Synthetic
cuggccuaccgagagacac

SEQ ID NO: 86802 - DNA, 28 bp, Artificial Sequence
  Synthetic
aggttgtttgcautaatcactttccauc

SEQ ID NO: 86803 - DNA, 21 bp, Artificial Sequence
  Synthetic
gaattccccagcuctggtcut

SEQ ID NO: 86804 - DNA, 28 bp, Artificial Sequence
  Synthetic
cctttagttgccauatttaccattugct

SEQ ID NO: 86805 - DNA, 20 bp, Artificial Sequence
  Synthetic
gggctccugaaaactguggt

SEQ ID NO: 86806 - DNA, 23 bp, Artificial Sequence
  Synthetic
tcaactgutgcatgguagcagat

SEQ ID NO: 86807 - DNA, 23 bp, Artificial Sequence
  Synthetic
gcttcctguccatcactgaaucc

SEQ ID NO: 86808 - DNA, 21 bp, Artificial Sequence
  Synthetic
gcagtttguctggctgauggt

SEQ ID NO: 86809 - DNA, 28 bp, Artificial Sequence
  Synthetic
tgctacagtgugaaagcctttattacuc

SEQ ID NO: 86810 - DNA, 23 bp, Artificial Sequence
  Synthetic
gcagagaaacgacugaaggcuct

SEQ ID NO: 86811 - DNA, 22 bp, Artificial Sequence
  Synthetic
caactttguccgctgcatcauc

SEQ ID NO: 86812 - DNA, 20 bp, Artificial Sequence
  Synthetic
attcagtgtugcccccuacc

SEQ ID NO: 86813 - DNA, 24 bp, Artificial Sequence
  Synthetic
gctgctctucaattctgaggcuaa

SEQ ID NO: 86814 - DNA, 20 bp, Artificial Sequence
  Synthetic
cgcaccttcutctcgtggut

SEQ ID NO: 86815 - DNA, 18 bp, Artificial Sequence
  Synthetic
aagggcaugtuccgcact

SEQ ID NO: 86816 - DNA, 22 bp, Artificial Sequence
  Synthetic
gtaaaggcutctgcaaguccct

SEQ ID NO: 86817 - DNA, 21 bp, Artificial Sequence
  Synthetic
cagagcctcugtgagcatgua

SEQ ID NO: 86818 - DNA, 20 bp, Artificial Sequence
  Synthetic
gccagcugctccttguaaag

SEQ ID NO: 86819 - DNA, 20 bp, Artificial Sequence
  Synthetic
ggcacucacgtgttctcugt

SEQ ID NO: 86820 - DNA, 21 bp, Artificial Sequence
  Synthetic
aaguggattggugggaaggac

SEQ ID NO: 86821 - DNA, 25 bp, Artificial Sequence
  Synthetic
aggatcaatgagucccatgtgttut

SEQ ID NO: 86822 - DNA, 21 bp, Artificial Sequence
  Synthetic
ggccacucctcaggaaucaag

SEQ ID NO: 86823 - DNA, 26 bp, Artificial Sequence
  Synthetic
ctttggcuagagttaaagatgugcaa

SEQ ID NO: 86824 - DNA, 21 bp, Artificial Sequence
  Synthetic
ggccccagaacuaacaggtua

SEQ ID NO: 86825 - DNA, 21 bp, Artificial Sequence
  Synthetic
gggagauctctgccucaacca

SEQ ID NO: 86826 - DNA, 22 bp, Artificial Sequence
  Synthetic
cacctccugtcccaaatgugaa

SEQ ID NO: 86827 - DNA, 25 bp, Artificial Sequence
  Synthetic
ccatgaaggtgautcagaggaacug

SEQ ID NO: 86828 - DNA, 27 bp, Artificial Sequence
  Synthetic
ttattgtctctuaggagttggcatcug

SEQ ID NO: 86829 - DNA, 21 bp, Artificial Sequence
  Synthetic
ttgtcttugcccaagauggga

SEQ ID NO: 86830 - DNA, 21 bp, Artificial Sequence
  Synthetic
gctcctcccugtagacacuca

SEQ ID NO: 86831 - DNA, 23 bp, Artificial Sequence
  Synthetic
gttgtcauggaaatggcauccaa

SEQ ID NO: 86832 - DNA, 20 bp, Artificial Sequence
  Synthetic
aggaacaagccaaccugugg

SEQ ID NO: 86833 - DNA, 21 bp, Artificial Sequence
  Synthetic
aggcagucgaggaatgguact

SEQ ID NO: 86834 - DNA, 18 bp, Artificial Sequence
  Synthetic
gtgauagccgccggtuct

SEQ ID NO: 86835 - DNA, 22 bp, Artificial Sequence
  Synthetic
gcaggtacaacgucagggtuac

SEQ ID NO: 86836 - DNA, 17 bp, Artificial Sequence
  Synthetic
cgcccccugagctucac

SEQ ID NO: 86837 - DNA, 19 bp, Artificial Sequence
  Synthetic
gctcugggcagaatgggut

SEQ ID NO: 86838 - DNA, 20 bp, Artificial Sequence
  Synthetic
cagttccgcagcutgaggua

SEQ ID NO: 86839 - DNA, 20 bp, Artificial Sequence
  Synthetic
ctgtgcaggutcaggaugct

SEQ ID NO: 86840 - DNA, 17 bp, Artificial Sequence
  Synthetic
gcgtggacccuggtcuc

SEQ ID NO: 86841 - DNA, 23 bp, Artificial Sequence
  Synthetic
gagtctgcauccatgagttcugt

SEQ ID NO: 86842 - DNA, 21 bp, Artificial Sequence
  Synthetic
ccuattcacucccgcaccaac

SEQ ID NO: 86843 - DNA, 21 bp, Artificial Sequence
  Synthetic
ttctcuggaagacgggaucct

SEQ ID NO: 86844 - DNA, 22 bp, Artificial Sequence
  Synthetic
gcctcagtcaucatgggtcuct

SEQ ID NO: 86845 - DNA, 21 bp, Artificial Sequence
  Synthetic
caaacccagagcugagaucct

SEQ ID NO: 86846 - DNA, 19 bp, Artificial Sequence
  Synthetic
cauggcaagacggccaaug

SEQ ID NO: 86847 - DNA, 24 bp, Artificial Sequence
  Synthetic
catcatcaccutttgccttccuct

SEQ ID NO: 86848 - DNA, 17 bp, Artificial Sequence
  Synthetic
agcagcaacuggugggt

SEQ ID NO: 86849 - DNA, 25 bp, Artificial Sequence
  Synthetic
gccucaaaaccgagaagaugaagaa

SEQ ID NO: 86850 - DNA, 26 bp, Artificial Sequence
  Synthetic
ttctaatguagttgggatugcgaaca

SEQ ID NO: 86851 - DNA, 29 bp, Artificial Sequence
  Synthetic
gtaccattcagcaucttgtaaggacauat

SEQ ID NO: 86852 - DNA, 21 bp, Artificial Sequence
  Synthetic
cggcgacaaauggcacattua

SEQ ID NO: 86853 - DNA, 23 bp, Artificial Sequence
  Synthetic
gcaguaggctgtucaaacacaag

SEQ ID NO: 86854 - DNA, 20 bp, Artificial Sequence
  Synthetic
ccaccctucagcttctgcut

SEQ ID NO: 86855 - DNA, 18 bp, Artificial Sequence
  Synthetic
ccaccacugccacctguc

SEQ ID NO: 86856 - DNA, 26 bp, Artificial Sequence
  Synthetic
tgtagccaacaacgguatgaauaaca

SEQ ID NO: 86857 - DNA, 28 bp, Artificial Sequence
  Synthetic
gcaagctggugcttttctttctttuaat

SEQ ID NO: 86858 - DNA, 22 bp, Artificial Sequence
  Synthetic
gctgactgutgcttccattuca

SEQ ID NO: 86859 - DNA, 25 bp, Artificial Sequence
  Synthetic
tgtaccattcaugttccaggugaag

SEQ ID NO: 86860 - DNA, 28 bp, Artificial Sequence
  Synthetic
gcaacactatugcaaattagctctugaa

SEQ ID NO: 86861 - DNA, 27 bp, Artificial Sequence
  Synthetic
caagaacaagtuacagatttgcgauca

SEQ ID NO: 86862 - DNA, 28 bp, Artificial Sequence
  Synthetic
ggtattttgtgaucgcaaatctguaact

SEQ ID NO: 86863 - DNA, 28 bp, Artificial Sequence
  Synthetic
cacagtgttaccutctcataatcuccaa

SEQ ID NO: 86864 - DNA, 25 bp, Artificial Sequence
  Synthetic
cactgacctcutgtgatacagtuga

SEQ ID NO: 86865 - DNA, 27 bp, Artificial Sequence
  Synthetic
aggatgatagugagatgctuccaaaaa

SEQ ID NO: 86866 - DNA, 29 bp, Artificial Sequence
  Synthetic
ctcttgtgauacagttgaaataccuacct

SEQ ID NO: 86867 - DNA, 27 bp, Artificial Sequence
  Synthetic
caaacttcaggaugatagtgagaugct

SEQ ID NO: 86868 - DNA, 24 bp, Artificial Sequence
  Synthetic
ctgctgggucatgttttaggtcut

SEQ ID NO: 86869 - DNA, 20 bp, Artificial Sequence
  Synthetic
ccgccagaggauaguggaac

SEQ ID NO: 86870 - DNA, 22 bp, Artificial Sequence
  Synthetic
ggaccgtttcutgaggaggtua

SEQ ID NO: 86871 - DNA, 23 bp, Artificial Sequence
  Synthetic
aagtgaacuccagaaccacaucc

SEQ ID NO: 86872 - DNA, 22 bp, Artificial Sequence
  Synthetic
cauggagatcgaugggcagaag

SEQ ID NO: 86873 - DNA, 20 bp, Artificial Sequence
  Synthetic
ctgcgugtcagguccagaat

SEQ ID NO: 86874 - DNA, 21 bp, Artificial Sequence
  Synthetic
tcactagaguggtgcagccua

SEQ ID NO: 86875 - DNA, 28 bp, Artificial Sequence
  Synthetic
gaagcttaucagcaaaaccagtaucaag

SEQ ID NO: 86876 - DNA, 24 bp, Artificial Sequence
  Synthetic
tgtggagttttaugtggcgatcuc

SEQ ID NO: 86877 - DNA, 20 bp, Artificial Sequence
  Synthetic
ggcttccauacccgtgucaa

SEQ ID NO: 86878 - DNA, 22 bp, Artificial Sequence
  Synthetic
gagtgguaacgcaatcacgtut

SEQ ID NO: 86879 - DNA, 23 bp, Artificial Sequence
  Synthetic
gaggtttcctutcccaccttcuc

SEQ ID NO: 86880 - DNA, 17 bp, Artificial Sequence
  Synthetic
cagcggccautgugcag

SEQ ID NO: 86881 - DNA, 19 bp, Artificial Sequence
  Synthetic
ctggaggcagggutcgtut

SEQ ID NO: 86882 - DNA, 22 bp, Artificial Sequence
  Synthetic
cggccccagagcutagagaaua

SEQ ID NO: 86883 - DNA, 23 bp, Artificial Sequence
  Synthetic
tgagtcttcugtcctcctctucc

SEQ ID NO: 86884 - DNA, 23 bp, Artificial Sequence
  Synthetic
aggccauggaaacagaaagtuct

SEQ ID NO: 86885 - DNA, 25 bp, Artificial Sequence
  Synthetic
gtttaaagaugcagcucagaagcat

SEQ ID NO: 86886 - DNA, 28 bp, Artificial Sequence
  Synthetic
gaaactuggaaaattatgcucagcagat

SEQ ID NO: 86887 - DNA, 24 bp, Artificial Sequence
  Synthetic
ctttccacutatgtccuggaggag

SEQ ID NO: 86888 - DNA, 20 bp, Artificial Sequence
  Synthetic
gagctctcgguggatggtut

SEQ ID NO: 86889 - DNA, 23 bp, Artificial Sequence
  Synthetic
gggccagaaugagaatctgagug

SEQ ID NO: 86890 - DNA, 23 bp, Artificial Sequence
  Synthetic
cagagaugccaaggttccttcuc

SEQ ID NO: 86891 - DNA, 23 bp, Artificial Sequence
  Synthetic
gcagctcucaactatcccctuac

SEQ ID NO: 86892 - DNA, 21 bp, Artificial Sequence
  Synthetic
gccugacaccttgaugagcaa

SEQ ID NO: 86893 - DNA, 24 bp, Artificial Sequence
  Synthetic
actggttcuaactacccttuccct

SEQ ID NO: 86894 - DNA, 23 bp, Artificial Sequence
  Synthetic
ctcctaggaucactcctcaguca

SEQ ID NO: 86895 - DNA, 20 bp, Artificial Sequence
  Synthetic
atctctgtggutggcgtcuc

SEQ ID NO: 86896 - DNA, 30 bp, Artificial Sequence
  Synthetic
cttttagttgtgcugaaagacattaugaca

SEQ ID NO: 86897 - DNA, 28 bp, Artificial Sequence
  Synthetic
tctcactcgataauctggatgactcaut

SEQ ID NO: 86898 - DNA, 21 bp, Artificial Sequence
  Synthetic
ccttgcctutcccctcaaugg

SEQ ID NO: 86899 - DNA, 25 bp, Artificial Sequence
  Synthetic
ccaagcaagauctggtgaaactuga

SEQ ID NO: 86900 - DNA, 19 bp, Artificial Sequence
  Synthetic
tggacggcucaatgtgugg

SEQ ID NO: 86901 - DNA, 18 bp, Artificial Sequence
  Synthetic
cugcggcagcagctaaug

SEQ ID NO: 86902 - DNA, 17 bp, Artificial Sequence
  Synthetic
cctgtucccgacgcuca

SEQ ID NO: 86903 - DNA, 23 bp, Artificial Sequence
  Synthetic
ctacactctcugcatcgtctuct

SEQ ID NO: 86904 - DNA, 23 bp, Artificial Sequence
  Synthetic
cggcuaaacgacttgucacagaa

SEQ ID NO: 86905 - DNA, 23 bp, Artificial Sequence
  Synthetic
gcagatggaguggatgtugaaga

SEQ ID NO: 86906 - DNA, 21 bp, Artificial Sequence
  Synthetic
ccatttggguccctctcauct

SEQ ID NO: 86907 - DNA, 20 bp, Artificial Sequence
  Synthetic
gccuaggagcucagcagaca

SEQ ID NO: 86908 - DNA, 22 bp, Artificial Sequence
  Synthetic
gctgctgccuagtcatttcuga

SEQ ID NO: 86909 - DNA, 22 bp, Artificial Sequence
  Synthetic
ttgatggagaaggcguacacug

SEQ ID NO: 86910 - DNA, 23 bp, Artificial Sequence
  Synthetic
atgaagaagaugacgacauggca

SEQ ID NO: 86911 - DNA, 22 bp, Artificial Sequence
  Synthetic
agacccttuaggcttgggauga

SEQ ID NO: 86912 - DNA, 22 bp, Artificial Sequence
  Synthetic
ctatggcugtggtacagucagt

SEQ ID NO: 86913 - DNA, 22 bp, Artificial Sequence
  Synthetic
gctcactttccuggtggaacuc

SEQ ID NO: 86914 - DNA, 24 bp, Artificial Sequence
  Synthetic
gcccagcuccttcattgatttuct

SEQ ID NO: 86915 - DNA, 22 bp, Artificial Sequence
  Synthetic
ccagctgtuctcggagttcuac

SEQ ID NO: 86916 - DNA, 23 bp, Artificial Sequence
  Synthetic
gaccatauggcaggccattgaua

SEQ ID NO: 86917 - DNA, 23 bp, Artificial Sequence
  Synthetic
gacgutccacaugcaaaagacag

SEQ ID NO: 86918 - DNA, 20 bp, Artificial Sequence
  Synthetic
gcggaaagaagcccucaguc

SEQ ID NO: 86919 - DNA, 21 bp, Artificial Sequence
  Synthetic
gccgccgaaguagaagtcauc

SEQ ID NO: 86920 - DNA, 19 bp, Artificial Sequence
  Synthetic
cugcttcuacccggacgaa

SEQ ID NO: 86921 - DNA, 20 bp, Artificial Sequence
  Synthetic
ctcaagcagcauctccguga

SEQ ID NO: 86922 - DNA, 20 bp, Artificial Sequence
  Synthetic
gccaagagcaagucggauca

SEQ ID NO: 86923 - DNA, 21 bp, Artificial Sequence
  Synthetic
actctgcgugctggtugaaat

SEQ ID NO: 86924 - DNA, 24 bp, Artificial Sequence
  Synthetic
ggaggacatcuggaagaagttuga

SEQ ID NO: 86925 - DNA, 20 bp, Artificial Sequence
  Synthetic
ccacagcucgttcucaagca

SEQ ID NO: 86926 - DNA, 19 bp, Artificial Sequence
  Synthetic
gagctgggucacggagaug

SEQ ID NO: 86927 - DNA, 19 bp, Artificial Sequence
  Synthetic
tccacaugcagtccuggag

SEQ ID NO: 86928 - DNA, 20 bp, Artificial Sequence
  Synthetic
caaggcccacagcaucctua

SEQ ID NO: 86929 - DNA, 21 bp, Artificial Sequence
  Synthetic
ggtgtctuctcctcgauccct

SEQ ID NO: 86930 - DNA, 26 bp, Artificial Sequence
  Synthetic
gttctagatgcaugaaaaagccctut

SEQ ID NO: 86931 - DNA, 27 bp, Artificial Sequence
  Synthetic
cttattccttggutccagagaacacua

SEQ ID NO: 86932 - DNA, 21 bp, Artificial Sequence
  Synthetic
tctgaacugcagacccatucc

SEQ ID NO: 86933 - DNA, 26 bp, Artificial Sequence
  Synthetic
gaggagttuttagagcatugccaaat

SEQ ID NO: 86934 - DNA, 20 bp, Artificial Sequence
  Synthetic
cctgaucccaaguggccaac

SEQ ID NO: 86935 - DNA, 25 bp, Artificial Sequence
  Synthetic
gaaagacctuccatgcaagaugaac

SEQ ID NO: 86936 - DNA, 26 bp, Artificial Sequence
  Synthetic
tggagccutccaattaaatugcaaac

SEQ ID NO: 86937 - DNA, 28 bp, Artificial Sequence
  Synthetic
gctctcaaaaggutaagcaattgttcut

SEQ ID NO: 86938 - DNA, 27 bp, Artificial Sequence
  Synthetic
gtaaaactccccutatagtggcaacut

SEQ ID NO: 86939 - DNA, 23 bp, Artificial Sequence
  Synthetic
cattgtctuacctcccaacugga

SEQ ID NO: 86940 - DNA, 22 bp, Artificial Sequence
  Synthetic
ccttctggauctcgagctguct

SEQ ID NO: 86941 - DNA, 28 bp, Artificial Sequence
  Synthetic
agagatcactgaucaaaaatgtgtgugt

SEQ ID NO: 86942 - DNA, 28 bp, Artificial Sequence
  Synthetic
gacaaagactcuacaagtaactgtucca

SEQ ID NO: 86943 - DNA, 28 bp, Artificial Sequence
  Synthetic
gaggaaaaagcuatgtattctgcugaac

SEQ ID NO: 86944 - DNA, 28 bp, Artificial Sequence
  Synthetic
gctataagctgtutttgcttttcgagut

SEQ ID NO: 86945 - DNA, 28 bp, Artificial Sequence
  Synthetic
gagacatttgaacugttttcgttggaut

SEQ ID NO: 86946 - DNA, 26 bp, Artificial Sequence
  Synthetic
ctctgtccgugcctttatgaatauca

SEQ ID NO: 86947 - DNA, 28 bp, Artificial Sequence
  Synthetic
gcttagttctcgaacuctgctttctaut

SEQ ID NO: 86948 - DNA, 27 bp, Artificial Sequence
  Synthetic
tcccttgaaaaaugaaagagagauggt

SEQ ID NO: 86949 - DNA, 26 bp, Artificial Sequence
  Synthetic
acacagtcauggttgatttucagagt

SEQ ID NO: 86950 - DNA, 28 bp, Artificial Sequence
  Synthetic
ggtgatcugggtaatagtttcuccaaat

SEQ ID NO: 86951 - DNA, 28 bp, Artificial Sequence
  Synthetic
agaggatagcaacauacttcgagtttut

SEQ ID NO: 86952 - DNA, 27 bp, Artificial Sequence
  Synthetic
ccagaacaagtaautgctgaagcaauc

SEQ ID NO: 86953 - DNA, 26 bp, Artificial Sequence
  Synthetic
ggaaguattcatcacauccacacact

SEQ ID NO: 86954 - DNA, 23 bp, Artificial Sequence
  Synthetic
acgactcguataaatgctgcuga

SEQ ID NO: 86955 - DNA, 27 bp, Artificial Sequence
  Synthetic
agcaacttcucctccactaaaaauagg

SEQ ID NO: 86956 - DNA, 21 bp, Artificial Sequence
  Synthetic
cttgcgaagutcccactcuct

SEQ ID NO: 86957 - DNA, 19 bp, Artificial Sequence
  Synthetic
ggctgtgcuggcctctuac

SEQ ID NO: 86958 - DNA, 25 bp, Artificial Sequence
  Synthetic
atgcaaaugggaatcctctuacaca

SEQ ID NO: 86959 - DNA, 27 bp, Artificial Sequence
  Synthetic
tcactcaccatugtctgttattgtcuc

SEQ ID NO: 86960 - DNA, 23 bp, Artificial Sequence
  Synthetic
aggccttttuaagcccctuacag

SEQ ID NO: 86961 - DNA, 27 bp, Artificial Sequence
  Synthetic
tggataacuaggagattcacggtugaa

SEQ ID NO: 86962 - DNA, 20 bp, Artificial Sequence
  Synthetic
gagccgtguctcactgtcug

SEQ ID NO: 86963 - DNA, 25 bp, Artificial Sequence
  Synthetic
tctttcagttucaaggcctcgatut

SEQ ID NO: 86964 - DNA, 24 bp, Artificial Sequence
  Synthetic
gcaccauccccaaattcagaugat

SEQ ID NO: 86965 - DNA, 28 bp, Artificial Sequence
  Synthetic
cagtagtattuggcaattgtttgguagt

SEQ ID NO: 86966 - DNA, 25 bp, Artificial Sequence
  Synthetic
gttaagacagaccgaguttcuaggg

SEQ ID NO: 86967 - DNA, 26 bp, Artificial Sequence
  Synthetic
catgaagaaccaggutgcaagattua

SEQ ID NO: 86968 - DNA, 25 bp, Artificial Sequence
  Synthetic
gattgtgcuccatgctttctttuct

SEQ ID NO: 86969 - DNA, 26 bp, Artificial Sequence
  Synthetic
ggtacataccacagugcttccatuat

SEQ ID NO: 86970 - DNA, 28 bp, Artificial Sequence
  Synthetic
cttacttgtctucatctatcagccaugt

SEQ ID NO: 86971 - DNA, 24 bp, Artificial Sequence
  Synthetic
ttctccatttgcutctttcggcua

SEQ ID NO: 86972 - DNA, 28 bp, Artificial Sequence
  Synthetic
gacaatgaaatuaaagccttggauagcc

SEQ ID NO: 86973 - DNA, 26 bp, Artificial Sequence
  Synthetic
aatgtggauggcaaaatggatucaaa

SEQ ID NO: 86974 - DNA, 21 bp, Artificial Sequence
  Synthetic
cataaaccugggacgcacugt

SEQ ID NO: 86975 - DNA, 22 bp, Artificial Sequence
  Synthetic
ccaccauagaagagggagcuca

SEQ ID NO: 86976 - DNA, 23 bp, Artificial Sequence
  Synthetic
ccacagggacautcacaacauga

SEQ ID NO: 86977 - DNA, 33 bp, Artificial Sequence
  Synthetic
attaagattttucacagtaatagtcaucacagt

SEQ ID NO: 86978 - DNA, 21 bp, Artificial Sequence
  Synthetic
gggagcugaaagcaccatcug

SEQ ID NO: 86979 - DNA, 22 bp, Artificial Sequence
  Synthetic
acctcacauctttctccuccct

SEQ ID NO: 86980 - DNA, 21 bp, Artificial Sequence
  Synthetic
tgcuagucccaaagaggaggt

SEQ ID NO: 86981 - DNA, 22 bp, Artificial Sequence
  Synthetic
caccatgctuttgctcccttut

SEQ ID NO: 86982 - DNA, 19 bp, Artificial Sequence
  Synthetic
ctggcucaccctgcttuca

SEQ ID NO: 86983 - DNA, 20 bp, Artificial Sequence
  Synthetic
gccagatgcauggctgaguc

SEQ ID NO: 86984 - DNA, 31 bp, Artificial Sequence; identical to SEQ ID NO: 50936
  Synthetic

SEQ ID NO: 86985 - DNA, 27 bp, Artificial Sequence
  Synthetic
agcctgctauaatcgatcaaacuaacc

SEQ ID NO: 86986 - DNA, 23 bp, Artificial Sequence
  Synthetic
gcagcucaatgaacucaagacag

SEQ ID NO: 86987 - DNA, 28 bp, Artificial Sequence
  Synthetic
tccugatcagcaaaauacaagaaagaga

SEQ ID NO: 86988 - DNA, 18 bp, Artificial Sequence
  Synthetic
ctgctggaucggcaugga

SEQ ID NO: 86989 - DNA, 21 bp, Artificial Sequence
  Synthetic
ccccttagucaggtgagaugg

SEQ ID NO: 86990 - DNA, 21 bp, Artificial Sequence
  Synthetic
gaccgacaaaccugaggucat

SEQ ID NO: 86991 - DNA, 26 bp, Artificial Sequence
  Synthetic
gcatttgtcctutgactggtgttuag

SEQ ID NO: 86992 - DNA, 25 bp, Artificial Sequence
  Synthetic
ctatgtcagugtaaaccuacgcgat

SEQ ID NO: 86993 - DNA, 27 bp, Artificial Sequence
  Synthetic
caccccagttugtcgaatatatgtuga

SEQ ID NO: 86994 - DNA, 21 bp, Artificial Sequence
  Synthetic
gtatgtguctcaccagucgct

SEQ ID NO: 86995 - DNA, 26 bp, Artificial Sequence
  Synthetic
aagttacuacagcagcagaaugacat

SEQ ID NO: 86996 - DNA, 20 bp, Artificial Sequence
  Synthetic
tggugggcuaccaaaagcaa

SEQ ID NO: 86997 - DNA, 23 bp, Artificial Sequence
  Synthetic
aacgtgttcucttttctcugcct

SEQ ID NO: 86998 - DNA, 20 bp, Artificial Sequence
  Synthetic
cgucggaaacggaaacacut

SEQ ID NO: 86999 - DNA, 20 bp, Artificial Sequence
  Synthetic
cgggctgcutccgagaaaut

SEQ ID NO: 87000 - DNA, 22 bp, Artificial Sequence
  Synthetic
aggccccaauatgggagguaaa

SEQ ID NO: 87001 - DNA, 22 bp, Artificial Sequence
  Synthetic
gggcuaagatgcaguccacaat

SEQ ID NO: 87002 - DNA, 25 bp, Artificial Sequence
  Synthetic
ttggtctcacucaactatgccaaut

SEQ ID NO: 87003 - DNA, 21 bp, Artificial Sequence
  Synthetic
gctgcatuggattcagcauca

SEQ ID NO: 87004 - DNA, 33 bp, Artificial Sequence
  Synthetic
aaaaccaatgatgcutaatcaatattttcaugt

SEQ ID NO: 87005 - DNA, 22 bp, Artificial Sequence
  Synthetic
gcggctugagctagagaaacuc

SEQ ID NO: 87006 - DNA, 24 bp, Artificial Sequence
  Synthetic
gactgugggacaacctcttttcua

SEQ ID NO: 87007 - DNA, 28 bp, Artificial Sequence
  Synthetic
tcttatgtggagcacaautctaatacug

SEQ ID NO: 87008 - DNA, 28 bp, Artificial Sequence
  Synthetic
ctaactgttctguaagtcttgatgcuga

SEQ ID NO: 87009 - DNA, 25 bp, Artificial Sequence
  Synthetic
cagctgaaatguagaggttgacuct

SEQ ID NO: 87010 - DNA, 21 bp, Artificial Sequence
  Synthetic
gagtcaucagcggcactcuaa

SEQ ID NO: 87011 - DNA, 21 bp, Artificial Sequence
  Synthetic
ggaacaacaggccaguaugga

SEQ ID NO: 87012 - DNA, 29 bp, Artificial Sequence
  Synthetic
tttcagattgaguacttccaaagaaccut

SEQ ID NO: 87013 - DNA, 25 bp, Artificial Sequence
  Synthetic
gtcttgctcaucctcatgtgguaat

SEQ ID NO: 87014 - DNA, 28 bp, Artificial Sequence
  Synthetic
cccaatttgtgaagutcataacatgcut

SEQ ID NO: 87015 - DNA, 27 bp, Artificial Sequence
  Synthetic
catatggaattcuacagcgaagctcut

SEQ ID NO: 87016 - DNA, 22 bp, Artificial Sequence
  Synthetic
atgtgagucagcagaagtgucc

SEQ ID NO: 87017 - DNA, 24 bp, Artificial Sequence
  Synthetic
tcaagggacuaggagatgcactua

SEQ ID NO: 87018 - DNA, 17 bp, Artificial Sequence
  Synthetic
cagggcuctgtgugcca

SEQ ID NO: 87019 - DNA, 18 bp, Artificial Sequence
  Synthetic
gccctguccaggcaccua

SEQ ID NO: 87020 - DNA, 22 bp, Artificial Sequence
  Synthetic
gaaagaatgggutgggctggua

SEQ ID NO: 87021 - DNA, 22 bp, Artificial Sequence
  Synthetic
cgtccttgaucctgacagctuc

SEQ ID NO: 87022 - DNA, 21 bp, Artificial Sequence
  Synthetic
gccctcgugagcattatgugt

SEQ ID NO: 87023 - DNA, 21 bp, Artificial Sequence
  Synthetic
cttgtccttcucggagccauc

SEQ ID NO: 87024 - DNA, 19 bp, Artificial Sequence
  Synthetic
gagugctcuaccgccacat

SEQ ID NO: 87025 - DNA, 22 bp, Artificial Sequence
  Synthetic
agatcaugacccgatggucaga

SEQ ID NO: 87026 - DNA, 27 bp, Artificial Sequence
  Synthetic
caaagcagucataattgttcuggcaaa

SEQ ID NO: 87027 - DNA, 28 bp, Artificial Sequence
  Synthetic
tggaatggcugttacacttttgauaact

SEQ ID NO: 87028 - DNA, 24 bp, Artificial Sequence
  Synthetic
ttgataagggugaaaauggccact

SEQ ID NO: 87029 - DNA, 27 bp, Artificial Sequence
  Synthetic
acagttgatgautcagagaccuaggat

SEQ ID NO: 87030 - DNA, 21 bp, Artificial Sequence
  Synthetic
gggttggcutttgagctcgua

SEQ ID NO: 87031 - DNA, 23 bp, Artificial Sequence
  Synthetic
attcaatcacugaccaccacucc

SEQ ID NO: 87032 - DNA, 18 bp, Artificial Sequence
  Synthetic
cccggcccutcttcacut

SEQ ID NO: 87033 - DNA, 17 bp, Artificial Sequence
  Synthetic
ctccgcagcuccgaguc

SEQ ID NO: 87034 - DNA, 27 bp, Artificial Sequence
  Synthetic
atgagatctactuacctatggcctugt

SEQ ID NO: 87035 - DNA, 29 bp, Artificial Sequence
  Synthetic
ccttcatctcautttcaggatctgucaaa

SEQ ID NO: 87036 - DNA, 23 bp, Artificial Sequence
  Synthetic
tttattccucctctcccucccat

SEQ ID NO: 87037 - DNA, 28 bp, Artificial Sequence
  Synthetic
cccaacagttttauatccacaatgccua

SEQ ID NO: 87038 - DNA, 27 bp, Artificial Sequence
  Synthetic
tcacatcacuacattaacaacugcaca

SEQ ID NO: 87039 - DNA, 23 bp, Artificial Sequence
  Synthetic
accccctucccatccttttcaua

SEQ ID NO: 87040 - DNA, 25 bp, Artificial Sequence
  Synthetic
gagctgtuccacttgtuaacagaga

SEQ ID NO: 87041 - DNA, 22 bp, Artificial Sequence
  Synthetic
atgagatgagutgtgccauggt

SEQ ID NO: 87042 - DNA, 23 bp, Artificial Sequence
  Synthetic
ggtgatagaaauccccguccaag

SEQ ID NO: 87043 - DNA, 26 bp, Artificial Sequence
  Synthetic
caaatcactcuactgttgagctucag

SEQ ID NO: 87044 - DNA, 24 bp, Artificial Sequence
  Synthetic
aaaactggcucctcaagagugaaa

SEQ ID NO: 87045 - DNA, 25 bp, Artificial Sequence
  Synthetic
catctcatctugatcaggaagcuct

SEQ ID NO: 87046 - DNA, 27 bp, Artificial Sequence
  Synthetic
cattgaaauggaaaaggttggagauca

SEQ ID NO: 87047 - DNA, 27 bp, Artificial Sequence
  Synthetic
agagcttaaacutctcactggttucac

SEQ ID NO: 87048 - DNA, 20 bp, Artificial Sequence
  Synthetic
cccucgagucccagacagaa

SEQ ID NO: 87049 - DNA, 21 bp, Artificial Sequence
  Synthetic
tcaaaatgcggguctctgucc

SEQ ID NO: 87050 - DNA, 26 bp, Artificial Sequence
  Synthetic
gctacgaagaagutttctcuagacga

SEQ ID NO: 87051 - DNA, 19 bp, Artificial Sequence
  Synthetic
ggacggacgucucgagagt

SEQ ID NO: 87052 - DNA, 23 bp, Artificial Sequence
  Synthetic
caccctcatucctgtgtagcuaa

SEQ ID NO: 87053 - DNA, 25 bp, Artificial Sequence
  Synthetic
tgtgaaacacguctctccaaatugt

SEQ ID NO: 87054 - DNA, 21 bp, Artificial Sequence
  Synthetic
ggaagccugagaatggcaguc

SEQ ID NO: 87055 - DNA, 22 bp, Artificial Sequence
  Synthetic
gcacttcagautgcccaggtut

SEQ ID NO: 87056 - DNA, 21 bp, Artificial Sequence
  Synthetic
gactgggaggcucatcaucac

SEQ ID NO: 87057 - DNA, 21 bp, Artificial Sequence
  Synthetic
gtgaggcutggagaaguaccc

SEQ ID NO: 87058 - DNA, 24 bp, Artificial Sequence
  Synthetic
cgtgtutccatgtttuggaagagt

SEQ ID NO: 87059 - DNA, 28 bp, Artificial Sequence
  Synthetic
tcaggtgaggaaacuggagttagataut

SEQ ID NO: 87060 - DNA, 23 bp, Artificial Sequence
  Synthetic
agtggcautttcaacacuggact

SEQ ID NO: 87061 - DNA, 28 bp, Artificial Sequence
  Synthetic
ccctcatgactguattctagttcttguc

SEQ ID NO: 87062 - DNA, 23 bp, Artificial Sequence
  Synthetic
ttctgtgataucgctcagcgaut

SEQ ID NO: 87063 - DNA, 25 bp, Artificial Sequence
  Synthetic
actgaagauggagaggcactagaut

SEQ ID NO: 87064 - DNA, 28 bp, Artificial Sequence
  Synthetic
ctcactttagcaugagtctatcagaugg

SEQ ID NO: 87065 - DNA, 27 bp, Artificial Sequence
  Synthetic
aguaacatttgctcucagaaacacaca

SEQ ID NO: 87066 - DNA, 22 bp, Artificial Sequence
  Synthetic
tctggtctctucctctctgcug

SEQ ID NO: 87067 - DNA, 26 bp, Artificial Sequence
  Synthetic
atttaggaatgugctgaggagctuag

SEQ ID NO: 87068 - DNA, 21 bp, Artificial Sequence
  Synthetic
cagcccaaaggugtggagaut

SEQ ID NO: 87069 - DNA, 20 bp, Artificial Sequence
  Synthetic
gctcugcacacctcctcuac

SEQ ID NO: 87070 - DNA, 22 bp, Artificial Sequence
  Synthetic
ccccagcuccagttaccttgua

SEQ ID NO: 87071 - DNA, 22 bp, Artificial Sequence
  Synthetic
acctttgtgucctgtgttggut

SEQ ID NO: 87072 - DNA, 25 bp, Artificial Sequence
  Synthetic
cttggcaaagutgcactaatucagt

SEQ ID NO: 87073 - DNA, 27 bp, Artificial Sequence
  Synthetic
agaacggccagcuaataaaagaactua

SEQ ID NO: 87074 - DNA, 21 bp, Artificial Sequence
  Synthetic
cgtctuccggcctcttctuac

SEQ ID NO: 87075 - DNA, 28 bp, Artificial Sequence
  Synthetic
gtgtutctgtttttgguagcaagaagat

SEQ ID NO: 87076 - DNA, 26 bp, Artificial Sequence
  Synthetic
tcagcatttgcutcttgtaaggguaa

SEQ ID NO: 87077 - DNA, 28 bp, Artificial Sequence
  Synthetic
ttagttatcaagaguggaagcatgtugt

SEQ ID NO: 87078 - DNA, 21 bp, Artificial Sequence
  Synthetic
cggatcugagcccggaaaaug

SEQ ID NO: 87079 - DNA, 23 bp, Artificial Sequence
  Synthetic
ccccataggugtgcaaatccaua

SEQ ID NO: 87080 - DNA, 28 bp, Artificial Sequence
  Synthetic
gactctctactauggtgtcatctttucc

SEQ ID NO: 87081 - DNA, 24 bp, Artificial Sequence
  Synthetic
catacctgcacucaaagcaauacc

SEQ ID NO: 87082 - DNA, 20 bp, Artificial Sequence
  Synthetic
tctcttcccauggcgatguc

SEQ ID NO: 87083 - DNA, 25 bp, Artificial Sequence
  Synthetic
gttccctcuaaatcaagtgcugagt

SEQ ID NO: 87084 - DNA, 28 bp, Artificial Sequence
  Synthetic
tctgattacacaguatcctcgacatuga

SEQ ID NO: 87085 - DNA, 26 bp, Artificial Sequence
  Synthetic
caagttaccugtgatccaattucgac

SEQ ID NO: 87086 - DNA, 20 bp, Artificial Sequence
  Synthetic
actgccgcuccgtctttuag

SEQ ID NO: 87087 - DNA, 22 bp, Artificial Sequence
  Synthetic
aacugcagaacaagcacucaga

SEQ ID NO: 87088 - DNA, 18 bp, Artificial Sequence
  Synthetic
gctgugggacagggtugt

SEQ ID NO: 87089 - DNA, 28 bp, Artificial Sequence
  Synthetic
gcagcagggauatagtatctgacaguat

SEQ ID NO: 87090 - DNA, 27 bp, Artificial Sequence
  Synthetic
gaaacaagcaagcuaaatgtgaacuga

SEQ ID NO: 87091 - DNA, 21 bp, Artificial Sequence
  Synthetic
gtctcccutcccccaugaaag

SEQ ID NO: 87092 - DNA, 24 bp, Artificial Sequence
  Synthetic
gtagccagugaggtatgcaatuct

SEQ ID NO: 87093 - DNA, 25 bp, Artificial Sequence
  Synthetic
cccaaaguagtgatccuaagcaagg

SEQ ID NO: 87094 - DNA, 27 bp, Artificial Sequence
  Synthetic
gcattccaatauaatccatcccugcaa

SEQ ID NO: 87095 - DNA, 19 bp, Artificial Sequence
  Synthetic
agugagggcggaacaggua

SEQ ID NO: 87096 - DNA, 21 bp, Artificial Sequence
  Synthetic
ccaccagggcutgcaagtaut

SEQ ID NO: 87097 - DNA, 23 bp, Artificial Sequence
  Synthetic
tgaggaugugaccaagaggaaga

SEQ ID NO: 87098 - DNA, 25 bp, Artificial Sequence
  Synthetic
tctgtttgtcauctgctggaaaugt

SEQ ID NO: 87099 - DNA, 24 bp, Artificial Sequence
  Synthetic
acaggatcagguttatcgggauca

SEQ ID NO: 87100 - DNA, 18 bp, Artificial Sequence
  Synthetic
ccccaucccgagggacut

SEQ ID NO: 87101 - DNA, 19 bp, Artificial Sequence
  Synthetic
tgagcgugctuccaggaat

SEQ ID NO: 87102 - DNA, 21 bp, Artificial Sequence
  Synthetic
ccctggcauacctttgtggua

SEQ ID NO: 87103 - DNA, 28 bp, Artificial Sequence
  Synthetic
tcggatttttcacuttgctcatgtttut

SEQ ID NO: 87104 - DNA, 21 bp, Artificial Sequence
  Synthetic
tgtguccacccccttacucat

SEQ ID NO: 87105 - DNA, 20 bp, Artificial Sequence
  Synthetic
ccgtattuggcgtacuccac

SEQ ID NO: 87106 - DNA, 21 bp, Artificial Sequence
  Synthetic
gggtggtgucttttcctgcua

SEQ ID NO: 87107 - DNA, 22 bp, Artificial Sequence
  Synthetic
caatctccaggagcutctgcut

SEQ ID NO: 87108 - DNA, 17 bp, Artificial Sequence
  Synthetic
gcccgcucctcctcauc

SEQ ID NO: 87109 - DNA, 18 bp, Artificial Sequence
  Synthetic
gtccagggagcuggagut

SEQ ID NO: 87110 - DNA, 26 bp, Artificial Sequence
  Synthetic
tttctttcagctucttgccttcatug

SEQ ID NO: 87111 - DNA, 27 bp, Artificial Sequence
  Synthetic
aaattgcattcucgattttgtctuggt

SEQ ID NO: 87112 - DNA, 20 bp, Artificial Sequence
  Synthetic
gcgcuccaggaagttgugat

SEQ ID NO: 87113 - DNA, 25 bp, Artificial Sequence
  Synthetic
caagaagaggtuctggagagagaug

SEQ ID NO: 87114 - DNA, 17 bp, Artificial Sequence
  Synthetic
gctaccugggcagugga

SEQ ID NO: 87115 - DNA, 18 bp, Artificial Sequence
  Synthetic
gctgggugcagagccaua

SEQ ID NO: 87116 - DNA, 21 bp, Artificial Sequence
  Synthetic
gcagaucagcugaagcaggac

SEQ ID NO: 87117 - DNA, 25 bp, Artificial Sequence
  Synthetic
aggaaagagaacaucaccaggacua

SEQ ID NO: 87118 - DNA, 22 bp, Artificial Sequence
  Synthetic
cccgtttcugcttctcagctut

SEQ ID NO: 87119 - DNA, 21 bp, Artificial Sequence
  Synthetic
ctgatgttgcuggtcgcttug

SEQ ID NO: 87120 - DNA, 23 bp, Artificial Sequence
  Synthetic
agaaaagctucacttgggtcugg

SEQ ID NO: 87121 - DNA, 24 bp, Artificial Sequence
  Synthetic
caccaatgacuacctgtgtgttug

SEQ ID NO: 87122 - DNA, 22 bp, Artificial Sequence
  Synthetic
gcactggccccuttttcttcut

SEQ ID NO: 87123 - DNA, 28 bp, Artificial Sequence
  Synthetic
ctctctaguagctcaactggauaaacct

SEQ ID NO: 87124 - DNA, 27 bp, Artificial Sequence
  Synthetic
tctcttcatccucctcatcttccttut

SEQ ID NO: 87125 - DNA, 24 bp, Artificial Sequence
  Synthetic
gcatgaagcauttccacatcucca

SEQ ID NO: 87126 - DNA, 25 bp, Artificial Sequence
  Synthetic
gacccagtgaugtttgtctgtuaca

SEQ ID NO: 87127 - DNA, 19 bp, Artificial Sequence
  Synthetic
cuggccaggaacgcatuac

SEQ ID NO: 87128 - DNA, 23 bp, Artificial Sequence
  Synthetic
gcttctcaccaguaaaggcacua

SEQ ID NO: 87129 - DNA, 20 bp, Artificial Sequence
  Synthetic
gctacagtugtcgctgctug

SEQ ID NO: 87130 - DNA, 24 bp, Artificial Sequence
  Synthetic
ctgtcccaccauaaccaaaatgug

SEQ ID NO: 87131 - DNA, 23 bp, Artificial Sequence
  Synthetic
acagagaaaagacagcuccgaug

SEQ ID NO: 87132 - DNA, 17 bp, Artificial Sequence
  Synthetic
gggagacgggugcauca

SEQ ID NO: 87133 - DNA, 17 bp, Artificial Sequence
  Synthetic
gacaugcacacgcugct

SEQ ID NO: 87134 - DNA, 20 bp, Artificial Sequence
  Synthetic
gaugacccaaccgtcuccac

SEQ ID NO: 87135 - DNA, 21 bp, Artificial Sequence
  Synthetic
gcacgcgucatcctcatucaa

SEQ ID NO: 87136 - DNA, 22 bp, Artificial Sequence
  Synthetic
ctcgttgaugtctcccucacaa

SEQ ID NO: 87137 - DNA, 26 bp, Artificial Sequence
  Synthetic
attctgtaccucttctctttccucca

SEQ ID NO: 87138 - DNA, 24 bp, Artificial Sequence
  Synthetic
gtgcagttuagtaagtggguagca

SEQ ID NO: 87139 - DNA, 26 bp, Artificial Sequence
  Synthetic
tgaggaaaataucgacgattguccag

SEQ ID NO: 87140 - DNA, 18 bp, Artificial Sequence
  Synthetic
gggccggugaaaccugag

SEQ ID NO: 87141 - DNA, 18 bp, Artificial Sequence
  Synthetic
ccacccugcagcagagua

SEQ ID NO: 87142 - DNA, 22 bp, Artificial Sequence
  Synthetic
tcgtccagguggtcttctauct

SEQ ID NO: 87143 - DNA, 20 bp, Artificial Sequence
  Synthetic
cctggcauatgcagctucct

SEQ ID NO: 87144 - DNA, 19 bp, Artificial Sequence
  Synthetic
cccaggcaaucgacugcat

SEQ ID NO: 87145 - DNA, 19 bp, Artificial Sequence
  Synthetic
cgtgcacauccttgaugct

SEQ ID NO: 87146 - DNA, 27 bp, Artificial Sequence
  Synthetic
tccctucacccctaaaaauagagaagt

SEQ ID NO: 87147 - DNA, 24 bp, Artificial Sequence
  Synthetic
ctgatacagagcugagggcuaaag

SEQ ID NO: 87148 - DNA, 21 bp, Artificial Sequence
  Synthetic
ccccgttcutgcagttgttuc

SEQ ID NO: 87149 - DNA, 21 bp, Artificial Sequence
  Synthetic
cttgtguccagagcagtgugt

SEQ ID NO: 87150 - DNA, 21 bp, Artificial Sequence
  Synthetic
accagagguctacgccaucat

SEQ ID NO: 87151 - DNA, 22 bp, Artificial Sequence
  Synthetic
cagtattccggcuaaccacucc

SEQ ID NO: 87152 - DNA, 18 bp, Artificial Sequence
  Synthetic
gagcugcacgcgcaauat

SEQ ID NO: 87153 - DNA, 22 bp, Artificial Sequence
  Synthetic
cccccaacacacagugaaauga

SEQ ID NO: 87154 - DNA, 23 bp, Artificial Sequence
  Synthetic
gatgatgcagutccatcctcuct

SEQ ID NO: 87155 - DNA, 23 bp, Artificial Sequence
  Synthetic
agcttccctgucttgtctttguc

SEQ ID NO: 87156 - DNA, 23 bp, Artificial Sequence
  Synthetic
gtcgtggaagggaucctgtatut

SEQ ID NO: 87157 - DNA, 22 bp, Artificial Sequence
  Synthetic
cacutagtuggacagcaagcag

SEQ ID NO: 87158 - DNA, 20 bp, Artificial Sequence
  Synthetic
aggtgcugcactatcgcauc

SEQ ID NO: 87159 - DNA, 21 bp, Artificial Sequence
  Synthetic
tgcccugtactcuacccacaa

SEQ ID NO: 87160 - DNA, 19 bp, Artificial Sequence
  Synthetic
gcacacgcuctctggctua

SEQ ID NO: 87161 - DNA, 23 bp, Artificial Sequence
  Synthetic
catgtgtttctugccttcctgug

SEQ ID NO: 87162 - DNA, 18 bp, Artificial Sequence
  Synthetic
cctgcagcugccctctua

SEQ ID NO: 87163 - DNA, 20 bp, Artificial Sequence
  Synthetic
gcagggaagguttcctggug

SEQ ID NO: 87164 - DNA, 21 bp, Artificial Sequence
  Synthetic
ctcatugagaaggugcgcaaa

SEQ ID NO: 87165 - DNA, 21 bp, Artificial Sequence
  Synthetic
agagaucttgccuggcacaag

SEQ ID NO: 87166 - DNA, 23 bp, Artificial Sequence
  Synthetic
ttggtactaaggauggcgaccua

SEQ ID NO: 87167 - DNA, 22 bp, Artificial Sequence
  Synthetic
ctgaggacutgtccugacagac

SEQ ID NO: 87168 - DNA, 23 bp, Artificial Sequence
  Synthetic
gccttcuaggctagtgtcuaggt

SEQ ID NO: 87169 - DNA, 23 bp, Artificial Sequence
  Synthetic
cgtctgtgaugtggttcaugact

SEQ ID NO: 87170 - DNA, 20 bp, Artificial Sequence
  Synthetic
gtggcccauctctcttcugt

SEQ ID NO: 87171 - DNA, 22 bp, Artificial Sequence
  Synthetic
tggcctggucagtaactcuagg

SEQ ID NO: 87172 - DNA, 20 bp, Artificial Sequence
  Synthetic
cggcacugacagttugcaat

SEQ ID NO: 87173 - DNA, 20 bp, Artificial Sequence
  Synthetic
gcagagugggatgccugaac

SEQ ID NO: 87174 - DNA, 21 bp, Artificial Sequence
  Synthetic
autcaucgacagagacggcaa

SEQ ID NO: 87175 - DNA, 22 bp, Artificial Sequence
  Synthetic
gggaaagaaagccutccacuca

SEQ ID NO: 87176 - DNA, 21 bp, Artificial Sequence
  Synthetic
cgcatcuacaagccttgctut

SEQ ID NO: 87177 - DNA, 24 bp, Artificial Sequence
  Synthetic
cattgacctcaucaagctgtccut

SEQ ID NO: 87178 - DNA, 21 bp, Artificial Sequence
  Synthetic
cgtctctttuctccgtcccua

SEQ ID NO: 87179 - DNA, 28 bp, Artificial Sequence
  Synthetic
aggtgctcaaugaagttttccatauaca

SEQ ID NO: 87180 - DNA, 22 bp, Artificial Sequence
  Synthetic
cgcatugggcagaaaagaaaug

SEQ ID NO: 87181 - DNA, 25 bp, Artificial Sequence
  Synthetic
ccttcttgtutgctgatgguaacct

SEQ ID NO: 87182 - DNA, 22 bp, Artificial Sequence
  Synthetic
gcaggccugattcaatgacuct

SEQ ID NO: 87183 - DNA, 26 bp, Artificial Sequence
  Synthetic
ccacaaggatgugaataatgctguca

SEQ ID NO: 87184 - DNA, 21 bp, Artificial Sequence
  Synthetic
gcctcaugggagacuccagaa

SEQ ID NO: 87185 - DNA, 21 bp, Artificial Sequence
  Synthetic
aaactgcucgaactgggugaa

SEQ ID NO: 87186 - DNA, 19 bp, Artificial Sequence
  Synthetic
gcctgacgacucgtgcuat

SEQ ID NO: 87187 - DNA, 23 bp, Artificial Sequence
  Synthetic
tcauaaacatcucgggacaagcc

SEQ ID NO: 87188 - DNA, 28 bp, Artificial Sequence
  Synthetic
tcctttagcaaacutctgaaugacaaca

SEQ ID NO: 87189 - DNA, 19 bp, Artificial Sequence
  Synthetic
cucucccccgaccaaagaa

SEQ ID NO: 87190 - DNA, 25 bp, Artificial Sequence
  Synthetic
gcggaagaugaagatttcggattuc

SEQ ID NO: 87191 - DNA, 23 bp, Artificial Sequence
  Synthetic
ggtatcttucctaggctucccaa

SEQ ID NO: 87192 - DNA, 21 bp, Artificial Sequence
  Synthetic
ctgccacutcaagucacgaaa

SEQ ID NO: 87193 - DNA, 28 bp, Artificial Sequence
  Synthetic
gtgggaagaaugaggaagaaagttctua

SEQ ID NO: 87194 - DNA, 28 bp, Artificial Sequence
  Synthetic
tgatcattgucccttcattaucaacaca

SEQ ID NO: 87195 - DNA, 28 bp, Artificial Sequence
  Synthetic
ggtgtttactaccuccttcttcattuca

SEQ ID NO: 87196 - DNA, 21 bp, Artificial Sequence
  Synthetic
gcctgaccgugtctctctcua

SEQ ID NO: 87197 - DNA, 25 bp, Artificial Sequence
  Synthetic
ccttagggcuagcttgatactucca

SEQ ID NO: 87198 - DNA, 22 bp, Artificial Sequence
  Synthetic
acaccatcaaccugaacagcut

SEQ ID NO: 87199 - DNA, 20 bp, Artificial Sequence
  Synthetic
gctgguggcaagcctgauac

SEQ ID NO: 87200 - DNA, 23 bp, Artificial Sequence
  Synthetic
tcttttggttutgcaggcttugg

SEQ ID NO: 87201 - DNA, 26 bp, Artificial Sequence
  Synthetic
gtatgctguagacgctcgtattcaut

SEQ ID NO: 87202 - DNA, 17 bp, Artificial Sequence
  Synthetic
ccctcuccgggccagua

SEQ ID NO: 87203 - DNA, 17 bp, Artificial Sequence
  Synthetic
accgcagcaugguggag

SEQ ID NO: 87204 - DNA, 18 bp, Artificial Sequence
  Synthetic
cagcaccuccaccaugct

SEQ ID NO: 87205 - DNA, 18 bp, Artificial Sequence
  Synthetic
ccguagaugccagcacga

SEQ ID NO: 87206 - DNA, 23 bp, Artificial Sequence
  Synthetic
gctacctcugagtcacctggtua

SEQ ID NO: 87207 - DNA, 20 bp, Artificial Sequence
  Synthetic
cuccagagccgactucagac

SEQ ID NO: 87208 - DNA, 21 bp, Artificial Sequence
  Synthetic
cagagttuctccacugggaca

SEQ ID NO: 87209 - DNA, 19 bp, Artificial Sequence
  Synthetic
ccgctguagggccctctua

SEQ ID NO: 87210 - DNA, 19 bp, Artificial Sequence
  Synthetic
caacgccucgctcatctug

SEQ ID NO: 87211 - DNA, 21 bp, Artificial Sequence
  Synthetic
gagctgttugcagggtccuaa

SEQ ID NO: 87212 - DNA, 21 bp, Artificial Sequence
  Synthetic
cctcugggcaggagattggua

SEQ ID NO: 87213 - DNA, 23 bp, Artificial Sequence
  Synthetic
cctgaactgugttttcctgtugg

SEQ ID NO: 87214 - DNA, 23 bp, Artificial Sequence
  Synthetic
cacacuctguaagcaaaagccaa

SEQ ID NO: 87215 - DNA, 28 bp, Artificial Sequence
  Synthetic
gaagaagaauccacatcattcacaaugg

SEQ ID NO: 87216 - DNA, 27 bp, Artificial Sequence
  Synthetic
gtagagtttcataucaccccattguga

SEQ ID NO: 87217 - DNA, 28 bp, Artificial Sequence
  Synthetic
agagatgctgaugataaacacaagctua

SEQ ID NO: 87218 - DNA, 28 bp, Artificial Sequence
  Synthetic
gctacttaggtuacaatcaggaggaaut

SEQ ID NO: 87219 - DNA, 32 bp, Artificial Sequence; identical to SEQ ID NO: 21971
  Synthetic

SEQ ID NO: 87220 - DNA, 18 bp, Artificial Sequence
  Synthetic
ccctccugatcccucgca

SEQ ID NO: 87221 - DNA, 19 bp, Artificial Sequence
  Synthetic
ctaccucggagccgaucat

SEQ ID NO: 87222 - DNA, 29 bp, Artificial Sequence
  Synthetic
ctcatctgaagaaaagutacctagugcaa

SEQ ID NO: 87223 - DNA, 21 bp, Artificial Sequence
  Synthetic
ccgtacuaaggcggtgucaag

SEQ ID NO: 87224 - DNA, 21 bp, Artificial Sequence
  Synthetic
ctgatuacccacgtcagucct

SEQ ID NO: 87225 - DNA, 25 bp, Artificial Sequence
  Synthetic
actccccaccucttcttcttttcua

SEQ ID NO: 87226 - DNA, 29 bp, Artificial Sequence
  Synthetic
gatattcttgtttugcctctgttttggut

SEQ ID NO: 87227 - DNA, 20 bp, Artificial Sequence
  Synthetic
gctgtgtgugcccctaagut

SEQ ID NO: 87228 - DNA, 27 bp, Artificial Sequence
  Synthetic
tctttgcttaaugggtgtcgtatauca

SEQ ID NO: 87229 - DNA, 21 bp, Artificial Sequence
  Synthetic
ctgcatgacuggtccugaaag

SEQ ID NO: 87230 - DNA, 21 bp, Artificial Sequence
  Synthetic
tgctttaauccagcgcctcuc

SEQ ID NO: 87231 - DNA, 22 bp, Artificial Sequence
  Synthetic
gctgcaaucttcggtaguccat

SEQ ID NO: 87232 - DNA, 25 bp, Artificial Sequence
  Synthetic
ctgttctucctcagacatucaaacg

SEQ ID NO: 87233 - DNA, 26 bp, Artificial Sequence
  Synthetic
cctggtggaagcauactgcaaaauat

SEQ ID NO: 87234 - DNA, 22 bp, Artificial Sequence
  Synthetic
cctguccacagaactttugcga

SEQ ID NO: 87235 - DNA, 25 bp, Artificial Sequence
  Synthetic
ggtggauccagaagcagaauaagag

SEQ ID NO: 87236 - DNA, 23 bp, Artificial Sequence
  Synthetic
cggtcttcaugcagagacugaaa

SEQ ID NO: 87237 - DNA, 24 bp, Artificial Sequence
  Synthetic
gtgaggtatuggtgacaagguagg

SEQ ID NO: 87238 - DNA, 23 bp, Artificial Sequence
  Synthetic
tgacauaggccagcggtttaaut

SEQ ID NO: 87239 - DNA, 20 bp, Artificial Sequence
  Synthetic
gcaccaccucacctgtugac

SEQ ID NO: 87240 - DNA, 23 bp, Artificial Sequence
  Synthetic
attcaattctucccggtctgcut

SEQ ID NO: 87241 - DNA, 23 bp, Artificial Sequence
  Synthetic
tgctcttcccuattctcccctut

SEQ ID NO: 87242 - DNA, 28 bp, Artificial Sequence
  Synthetic
gtggctctaaagucaatctcttcttuct

SEQ ID NO: 87243 - DNA, 22 bp, Artificial Sequence
  Synthetic
agaauggcccaacaagcaaaug

SEQ ID NO: 87244 - DNA, 21 bp, Artificial Sequence
  Synthetic
ggaguccagcauggcaagaag

SEQ ID NO: 87245 - DNA, 22 bp, Artificial Sequence
  Synthetic
gggccattuagtgactgtucat

SEQ ID NO: 87246 - DNA, 24 bp, Artificial Sequence
  Synthetic
ggtctcctaugagtgagaacucct

SEQ ID NO: 87247 - DNA, 22 bp, Artificial Sequence
  Synthetic
ccccaaaggaccuaagtctcut

SEQ ID NO: 87248 - DNA, 20 bp, Artificial Sequence
  Synthetic
gactccttugcccctgtgut

SEQ ID NO: 87249 - DNA, 22 bp, Artificial Sequence
  Synthetic
ctgctgccaauagcttaguggt

SEQ ID NO: 87250 - DNA, 22 bp, Artificial Sequence
  Synthetic
acccucagacagagtctgucaa

SEQ ID NO: 87251 - DNA, 24 bp, Artificial Sequence
  Synthetic
cagcttgagaugaggtggaauaga

SEQ ID NO: 87252 - DNA, 32 bp, Artificial Sequence
  Synthetic
aacatgaataggauacagtcttctacttcuca

SEQ ID NO: 87253 - DNA, 28 bp, Artificial Sequence
  Synthetic
attcgttgatcaaacucatctgtgguat

SEQ ID NO: 87254 - DNA, 23 bp, Artificial Sequence
  Synthetic
gatgtucaaagccaaagcctuca

SEQ ID NO: 87255 - DNA, 29 bp, Artificial Sequence
  Synthetic
cttctttaccggugtacactactattuct

SEQ ID NO: 87256 - DNA, 23 bp, Artificial Sequence
  Synthetic
ttggcaggcuacactgguaaaat

SEQ ID NO: 87257 - DNA, 28 bp, Artificial Sequence
  Synthetic
gcacgaaggugaattaaaaucaaaagga

SEQ ID NO: 87258 - DNA, 21 bp, Artificial Sequence
  Synthetic
cacaucgagaagcagctcuga

SEQ ID NO: 87259 - DNA, 23 bp, Artificial Sequence
  Synthetic
tcattcctgucattccctugcag

SEQ ID NO: 87260 - DNA, 26 bp, Artificial Sequence
  Synthetic
ggucaaaaaggaaacgcaauaaggat

SEQ ID NO: 87261 - DNA, 27 bp, Artificial Sequence
  Synthetic
cagctctggaauaacaagctucaaaaa

SEQ ID NO: 87262 - DNA, 28 bp, Artificial Sequence
  Synthetic
gtgttattgacgucatagagtgacuaga

SEQ ID NO: 87263 - DNA, 21 bp, Artificial Sequence
  Synthetic
gcacugacctctatguccaca

SEQ ID NO: 87264 - DNA, 22 bp, Artificial Sequence
  Synthetic
acatugccaaccattccuacct

SEQ ID NO: 87265 - DNA, 25 bp, Artificial Sequence
  Synthetic
gtaggguagggaagtucacagagaa

SEQ ID NO: 87266 - DNA, 21 bp, Artificial Sequence
  Synthetic
gggcacucagctagtcctcut

SEQ ID NO: 87267 - DNA, 25 bp, Artificial Sequence
  Synthetic
ctgcagagugctatgaaauacaagg

SEQ ID NO: 87268 - DNA, 21 bp, Artificial Sequence
  Synthetic
gaagcaccagcccuaugaact

SEQ ID NO: 87269 - DNA, 28 bp, Artificial Sequence
  Synthetic
ccattgcattgauatgatggatatuggg

SEQ ID NO: 87270 - DNA, 20 bp, Artificial Sequence
  Synthetic
gtccgccutctctccuacct

SEQ ID NO: 87271 - DNA, 17 bp, Artificial Sequence
  Synthetic
ggatucccgccccucac

SEQ ID NO: 87272 - DNA, 22 bp, Artificial Sequence
  Synthetic
tgccuaccccaaaatgcttuct

SEQ ID NO: 87273 - DNA, 29 bp, Artificial Sequence
  Synthetic
agcatttataaguccagagaugaagcaaa

SEQ ID NO: 87274 - DNA, 20 bp, Artificial Sequence
  Synthetic
ccggccccuactcactttug

SEQ ID NO: 87275 - DNA, 24 bp, Artificial Sequence
  Synthetic
cucttttcccuccacaacaaagga

SEQ ID NO: 87276 - DNA, 22 bp, Artificial Sequence
  Synthetic
tgcttggaucatattggccugt

SEQ ID NO: 87277 - DNA, 23 bp, Artificial Sequence
  Synthetic
actttcagcutgtgggaatugga

SEQ ID NO: 87278 - DNA, 22 bp, Artificial Sequence
  Synthetic
gcggtgtcutgactctcugaag

SEQ ID NO: 87279 - DNA, 21 bp, Artificial Sequence
  Synthetic
atgccgtucaggttgttgtug

SEQ ID NO: 87280 - DNA, 28 bp, Artificial Sequence
  Synthetic
caaagctttcattuatgactccactgut

SEQ ID NO: 87281 - DNA, 24 bp, Artificial Sequence
  Synthetic
ggtggaattuaatgacccagugct

SEQ ID NO: 87282 - DNA, 22 bp, Artificial Sequence
  Synthetic
ggtctttggucgggttctugag

SEQ ID NO: 87283 - DNA, 28 bp, Artificial Sequence
  Synthetic
aggaaaactggcaauaactcagattcut

SEQ ID NO: 87284 - DNA, 21 bp, Artificial Sequence
  Synthetic
gatgactgacccuccctctug

SEQ ID NO: 87285 - DNA, 28 bp, Artificial Sequence
  Synthetic
ctgaagatgugagcatgttctttguaaa

SEQ ID NO: 87286 - DNA, 19 bp, Artificial Sequence
  Synthetic
agtggctggugtccctgua

SEQ ID NO: 87287 - DNA, 17 bp, Artificial Sequence
  Synthetic
tggcagcggguacucac

SEQ ID NO: 87288 - DNA, 27 bp, Artificial Sequence
  Synthetic
cttaccctgggcutttgaatcagaaua

SEQ ID NO: 87289 - DNA, 24 bp, Artificial Sequence
  Synthetic
tggtagacugagctuagacagagg

SEQ ID NO: 87290 - DNA, 25 bp, Artificial Sequence
  Synthetic
tttggagaacutgctcucacagaaa

SEQ ID NO: 87291 - DNA, 25 bp, Artificial Sequence
  Synthetic
cagaacuggacctatgaggugaaag

SEQ ID NO: 87292 - DNA, 22 bp, Artificial Sequence
  Synthetic
ctccuccagctgttctucaagg

SEQ ID NO: 87293 - DNA, 24 bp, Artificial Sequence
  Synthetic
ctacagagtuctgggcatctucag

SEQ ID NO: 87294 - DNA, 26 bp, Artificial Sequence
  Synthetic
gttaggtgaagugattatccaggugt

SEQ ID NO: 87295 - DNA, 28 bp, Artificial Sequence
  Synthetic
ggatcttcggaucagtaagtacttctuc

SEQ ID NO: 87296 - DNA, 20 bp, Artificial Sequence
  Synthetic
acgggcucctcgaacuacat

SEQ ID NO: 87297 - DNA, 22 bp, Artificial Sequence
  Synthetic
ggacgacaaccagaaugagugg

SEQ ID NO: 87298 - DNA, 23 bp, Artificial Sequence
  Synthetic
aggcagagaagagaagugaguga

SEQ ID NO: 87299 - DNA, 29 bp, Artificial Sequence
  Synthetic
tgcattcttagagcugtggaaattactut

SEQ ID NO: 87300 - DNA, 28 bp, Artificial Sequence
  Synthetic
agtgtctgaaucaaatgttctctuggat

SEQ ID NO: 87301 - DNA, 28 bp, Artificial Sequence
  Synthetic
ggcctccuaaaagtagactggaauaaaa

SEQ ID NO: 87302 - DNA, 21 bp, Artificial Sequence
  Synthetic
cgacucacccggaacttctug

SEQ ID NO: 87303 - DNA, 19 bp, Artificial Sequence
  Synthetic
tcctagggagcucgcucag

SEQ ID NO: 87304 - DNA, 21 bp, Artificial Sequence
  Synthetic
aaaaggtggcuccgagaagut

SEQ ID NO: 87305 - DNA, 22 bp, Artificial Sequence
  Synthetic
cgatcagucacatcccuaccca

SEQ ID NO: 87306 - DNA, 21 bp, Artificial Sequence
  Synthetic
caggagggucttgggtggaua

SEQ ID NO: 87307 - DNA, 22 bp, Artificial Sequence
  Synthetic
gagaatcctuggtttgccctug

SEQ ID NO: 87308 - DNA, 27 bp, Artificial Sequence
  Synthetic
gagattcatugacgggacttacauaga

SEQ ID NO: 87309 - DNA, 24 bp, Artificial Sequence
  Synthetic
ccacattcccaaaucagatgctut

SEQ ID NO: 87310 - DNA, 27 bp, Artificial Sequence
  Synthetic
gcagtcatcaaaguacaaagcatcuga

SEQ ID NO: 87311 - DNA, 33 bp, Artificial Sequence
  Synthetic
acatcaattattgaauatttagcttggcaaugg

SEQ ID NO: 87312 - DNA, 27 bp, Artificial Sequence
  Synthetic
gtgcagtaactugatttgctgttguat

SEQ ID NO: 87313 - DNA, 22 bp, Artificial Sequence
  Synthetic
aagaggcutccaaatugagggt

SEQ ID NO: 87314 - DNA, 26 bp, Artificial Sequence
  Synthetic
ttcttctauccttccttcuccacagt

SEQ ID NO: 87315 - DNA, 24 bp, Artificial Sequence
  Synthetic
accttcctcutctaggtggtucag

SEQ ID NO: 87316 - DNA, 26 bp, Artificial Sequence
  Synthetic
ccagtgcttacuccagaaatgaugaa

SEQ ID NO: 87317 - DNA, 22 bp, Artificial Sequence
  Synthetic
agaggaaatcugcagctctguc

SEQ ID NO: 87318 - DNA, 20 bp, Artificial Sequence
  Synthetic
ggccaauaactcccuagcca

SEQ ID NO: 87319 - DNA, 28 bp, Artificial Sequence
  Synthetic
ttgagtgtaacuaccttttccctttgut

SEQ ID NO: 87320 - DNA, 22 bp, Artificial Sequence
  Synthetic
cctcggutgaataccugcaaga

SEQ ID NO: 87321 - DNA, 27 bp, Artificial Sequence
  Synthetic
tcgaagaactaguttcccatactucct

SEQ ID NO: 87322 - DNA, 19 bp, Artificial Sequence
  Synthetic
cutctcacugccccaccag

SEQ ID NO: 87323 - DNA, 21 bp, Artificial Sequence
  Synthetic
ctgagccaccutgtctgucat

SEQ ID NO: 87324 - DNA, 21 bp, Artificial Sequence
  Synthetic
ccttgtugccaccacttcuca

SEQ ID NO: 87325 - DNA, 28 bp, Artificial Sequence
  Synthetic
gcagtgtacagtuttaaatagctgccua

SEQ ID NO: 87326 - DNA, 28 bp, Artificial Sequence
  Synthetic
gacttaccagatuagttacacacgacut

SEQ ID NO: 87327 - DNA, 28 bp, Artificial Sequence
  Synthetic
catctaaaaatcugccattggtgaagug

SEQ ID NO: 87328 - DNA, 17 bp, Artificial Sequence
  Synthetic
caggcgccccuggaaut

SEQ ID NO: 87329 - DNA, 17 bp, Artificial Sequence
  Synthetic
gggctgcutgccguagg

SEQ ID NO: 87330 - DNA, 21 bp, Artificial Sequence
  Synthetic
tggtgctcugggagatctuca

SEQ ID NO: 87331 - DNA, 22 bp, Artificial Sequence
  Synthetic
gaaccgagutcccugaaaaagg

SEQ ID NO: 87332 - DNA, 21 bp, Artificial Sequence
  Synthetic
aggcacugagagggacaguag

SEQ ID NO: 87333 - DNA, 21 bp, Artificial Sequence
  Synthetic
cgcaagutctcatcuggccat

SEQ ID NO: 87334 - DNA, 26 bp, Artificial Sequence
  Synthetic
tgcttttagacguggatgtacuaacc

SEQ ID NO: 87335 - DNA, 21 bp, Artificial Sequence
  Synthetic
ttgctatugccgtcccaucaa

SEQ ID NO: 87336 - DNA, 27 bp, Artificial Sequence
  Synthetic
cttuaacaggaagaggtacugcaacat

SEQ ID NO: 87337 - DNA, 28 bp, Artificial Sequence
  Synthetic
cgcacagcaacautttgagaataatcut

SEQ ID NO: 87338 - DNA, 28 bp, Artificial Sequence
  Synthetic
gcagttgttaaagaacutgctgagacua

SEQ ID NO: 87339 - DNA, 21 bp, Artificial Sequence
  Synthetic
gcaagagaagugccctcucaa

SEQ ID NO: 87340 - DNA, 22 bp, Artificial Sequence
  Synthetic
cttttcctgugcttgctucaca

SEQ ID NO: 87341 - DNA, 23 bp, Artificial Sequence
  Synthetic
acctuaggcagagaggaaugagg

SEQ ID NO: 87342 - DNA, 27 bp, Artificial Sequence
  Synthetic
tcacactgagcauttactacctgaaug

SEQ ID NO: 87343 - DNA, 21 bp, Artificial Sequence
  Synthetic
cagcttucaccgcttgggaua

SEQ ID NO: 87344 - DNA, 27 bp, Artificial Sequence
  Synthetic
tgcaagttaacacugattgaccaucat

SEQ ID NO: 87345 - DNA, 24 bp, Artificial Sequence
  Synthetic
aaagacagaacugggcaaagacut

SEQ ID NO: 87346 - DNA, 25 bp, Artificial Sequence
  Synthetic
agagcguacatctgaaatucaacca

SEQ ID NO: 87347 - DNA, 18 bp, Artificial Sequence
  Synthetic
ctgaagugcccccuggag

SEQ ID NO: 87348 - DNA, 22 bp, Artificial Sequence
  Synthetic
ctcatgacaautggcaugcact

SEQ ID NO: 87349 - DNA, 24 bp, Artificial Sequence
  Synthetic
caagtcattaagggugcagagcua

SEQ ID NO: 87350 - DNA, 24 bp, Artificial Sequence
  Synthetic
gggcuccaataatcaucaaaggga

SEQ ID NO: 87351 - DNA, 20 bp, Artificial Sequence
  Synthetic
ctcaagctcutgggccauct

SEQ ID NO: 87352 - DNA, 19 bp, Artificial Sequence
  Synthetic
gacuacacgggcagctuca

SEQ ID NO: 87353 - DNA, 19 bp, Artificial Sequence
  Synthetic
caagcgacucggguaagga

SEQ ID NO: 87354 - DNA, 22 bp, Artificial Sequence
  Synthetic
gcccatctcuctccctcctuat

SEQ ID NO: 87355 - DNA, 22 bp, Artificial Sequence
  Synthetic
ccctgggaacaacaucctagug

SEQ ID NO: 87356 - DNA, 17 bp, Artificial Sequence
  Synthetic
cgcccaccucacugacc

SEQ ID NO: 87357 - DNA, 19 bp, Artificial Sequence
  Synthetic
gggcttcuggctccttcuc

SEQ ID NO: 87358 - DNA, 18 bp, Artificial Sequence
  Synthetic
tgugaagcgccucaacga

SEQ ID NO: 87359 - DNA, 19 bp, Artificial Sequence
  Synthetic
gggacggaaaugactuggg

SEQ ID NO: 87360 - DNA, 20 bp, Artificial Sequence
  Synthetic
cgctacccacagugacacuc

SEQ ID NO: 87361 - DNA, 28 bp, Artificial Sequence
  Synthetic
ggaagtatagttuctttcagggcugaat

SEQ ID NO: 87362 - DNA, 32 bp, Artificial Sequence
  Synthetic
atgttacattggttuccttgacatttttctut

SEQ ID NO: 87363 - DNA, 26 bp, Artificial Sequence
  Synthetic
cacaacugcatcaugagaaaacaagt

SEQ ID NO: 87364 - DNA, 24 bp, Artificial Sequence
  Synthetic
tutttccucccacagaaccaaact

SEQ ID NO: 87365 - DNA, 21 bp, Artificial Sequence
  Synthetic
gtgccatugaggcatgatgug

SEQ ID NO: 87366 - DNA, 25 bp, Artificial Sequence
  Synthetic
ttgctgctuactcccaaatatugga

SEQ ID NO: 87367 - DNA, 21 bp, Artificial Sequence
  Synthetic
caggaggcaccuttctgacut

SEQ ID NO: 87368 - DNA, 21 bp, Artificial Sequence
  Synthetic
ggcccatcucaagtggatugt

SEQ ID NO: 87369 - DNA, 27 bp, Artificial Sequence
  Synthetic
ggataccttgcgaautagaaggaagug

SEQ ID NO: 87370 - DNA, 22 bp, Artificial Sequence
  Synthetic
gcagauccctugcaagcaaaaa

SEQ ID NO: 87371 - DNA, 27 bp, Artificial Sequence
  Synthetic
agcaaggtaauacggaacactugaaat

SEQ ID NO: 87372 - DNA, 21 bp, Artificial Sequence
  Synthetic
ccccagacccucagtuaccat

SEQ ID NO: 87373 - DNA, 28 bp, Artificial Sequence
  Synthetic
agaaaggttttccucactcaagacauac

SEQ ID NO: 87374 - DNA, 26 bp, Artificial Sequence
  Synthetic
caaggattugagcactttcauccaat

SEQ ID NO: 87375 - DNA, 23 bp, Artificial Sequence
  Synthetic
caacttcaucccaggatggucaa

SEQ ID NO: 87376 - DNA, 26 bp, Artificial Sequence
  Synthetic
cccacugagtagttttucaacaagga

SEQ ID NO: 87377 - DNA, 26 bp, Artificial Sequence
  Synthetic
ccatataaatcugctgatggcaugga

SEQ ID NO: 87378 - DNA, 27 bp, Artificial Sequence
  Synthetic
gtaagauaagagccagcaaaatcaugg

SEQ ID NO: 87379 - DNA, 22 bp, Artificial Sequence
  Synthetic
aaaggatctucgctgggatgut

SEQ ID NO: 87380 - DNA, 28 bp, Artificial Sequence
  Synthetic
caattacaatgacaucatctccttugcc

SEQ ID NO: 87381 - DNA, 22 bp, Artificial Sequence
  Synthetic
aagggagtuacccagggagaut

SEQ ID NO: 87382 - DNA, 28 bp, Artificial Sequence
  Synthetic
gtttcttcactgucttccataggtguat

SEQ ID NO: 87383 - DNA, 30 bp, Artificial Sequence
  Synthetic
gctgctagtccauaagtactcattattcut

SEQ ID NO: 87384 - DNA, 20 bp, Artificial Sequence
  Synthetic
ctcactgtcugggtgtgcuc

SEQ ID NO: 87385 - DNA, 20 bp, Artificial Sequence
  Synthetic
gccgtaccucttgggtcuct

SEQ ID NO: 87386 - DNA, 22 bp, Artificial Sequence
  Synthetic
gtagggttutccactgcuccaa

SEQ ID NO: 87387 - DNA, 22 bp, Artificial Sequence
  Synthetic
cccgcuccacttcataacugat

SEQ ID NO: 87388 - DNA, 25 bp, Artificial Sequence
  Synthetic
tgttcctttcuttacagcggaugag

SEQ ID NO: 87389 - DNA, 28 bp, Artificial Sequence
  Synthetic
acacagtucccttcattttauccaagat

SEQ ID NO: 87390 - DNA, 21 bp, Artificial Sequence
  Synthetic
gcccggaguactagtcucaac

SEQ ID NO: 87391 - DNA, 21 bp, Artificial Sequence
  Synthetic
cacaggacccauttccacuca

SEQ ID NO: 87392 - DNA, 22 bp, Artificial Sequence
  Synthetic
catagtcggaauggaagcguca

SEQ ID NO: 87393 - DNA, 26 bp, Artificial Sequence
  Synthetic
gggtttucaagattcatgcucagaag

SEQ ID NO: 87394 - DNA, 23 bp, Artificial Sequence
  Synthetic
acggaaggaautccaggacaauc

SEQ ID NO: 87395 - DNA, 19 bp, Artificial Sequence
  Synthetic
tgacgtccugtgcaccauc

SEQ ID NO: 87396 - DNA, 22 bp, Artificial Sequence
  Synthetic
cgaggtcacugaactgcatguc

SEQ ID NO: 87397 - DNA, 20 bp, Artificial Sequence
  Synthetic
tgacgatcugccgctgaauc

SEQ ID NO: 87398 - DNA, 21 bp, Artificial Sequence
  Synthetic
tgtgtgtaagucctggcctuc

SEQ ID NO: 87399 - DNA, 18 bp, Artificial Sequence
  Synthetic
aggccucgugcagaacac

SEQ ID NO: 87400 - DNA, 22 bp, Artificial Sequence
  Synthetic
ggaggtaguccatggtctuggt

SEQ ID NO: 87401 - DNA, 24 bp, Artificial Sequence
  Synthetic
gcaggtctaugatgatggcaagut

SEQ ID NO: 87402 - DNA, 21 bp, Artificial Sequence
  Synthetic
gcaggagutcgatcuggagaa

SEQ ID NO: 87403 - DNA, 22 bp, Artificial Sequence
  Synthetic
gcutgtucacaacagacacacc

SEQ ID NO: 87404 - DNA, 26 bp, Artificial Sequence
  Synthetic
gcatgggagagacugataauccaaga

SEQ ID NO: 87405 - DNA, 28 bp, Artificial Sequence
  Synthetic
caaatgcauctgattgugaaacaaaaac

SEQ ID NO: 87406 - DNA, 23 bp, Artificial Sequence
  Synthetic
tcagctccautaccagguacaca

SEQ ID NO: 87407 - DNA, 22 bp, Artificial Sequence
  Synthetic
cctctgactuccctctcctguc

SEQ ID NO: 87408 - DNA, 28 bp, Artificial Sequence
  Synthetic
tgtccctttuaagtaaacacaugacaca

SEQ ID NO: 87409 - DNA, 26 bp, Artificial Sequence
  Synthetic
aacctgttgtatugctcccattctua

SEQ ID NO: 87410 - DNA, 21 bp, Artificial Sequence
  Synthetic
actcccagaggcuggtuaaca

SEQ ID NO: 87411 - DNA, 21 bp, Artificial Sequence
  Synthetic
ccaagagggagautcgctucc

SEQ ID NO: 87412 - DNA, 20 bp, Artificial Sequence
  Synthetic
gctctggcaucccaagguaa

SEQ ID NO: 87413 - DNA, 20 bp, Artificial Sequence
  Synthetic
agcucaacagccagaaccuc

SEQ ID NO: 87414 - DNA, 23 bp, Artificial Sequence
  Synthetic
ggaggcaaccutctgtagctcua

SEQ ID NO: 87415 - DNA, 29 bp, Artificial Sequence
  Synthetic
tgcaaatcttuacaccttcttacuaacct

SEQ ID NO: 87416 - DNA, 21 bp, Artificial Sequence
  Synthetic
gccatcagcgutgatgcagua

SEQ ID NO: 87417 - DNA, 21 bp, Artificial Sequence
  Synthetic
gccatctucggttcagaggut

SEQ ID NO: 87418 - DNA, 21 bp, Artificial Sequence
  Synthetic
gggccaagacccuatcaccua

SEQ ID NO: 87419 - DNA, 20 bp, Artificial Sequence
  Synthetic
ggtggttcuctgccctcuct

SEQ ID NO: 87420 - DNA, 25 bp, Artificial Sequence
  Synthetic
acaaaacacaacuttgcagattgut

SEQ ID NO: 87421 - DNA, 27 bp, Artificial Sequence
  Synthetic
caacaggtgaugatggagatgaaguat

SEQ ID NO: 87422 - DNA, 20 bp, Artificial Sequence
  Synthetic
gccacacucctggcaaucat

SEQ ID NO: 87423 - DNA, 28 bp, Artificial Sequence
  Synthetic
ccautgagccttattugaagaagaagga

SEQ ID NO: 87424 - DNA, 22 bp, Artificial Sequence
  Synthetic
ccttcagautctgccuccacaa

SEQ ID NO: 87425 - DNA, 25 bp, Artificial Sequence
  Synthetic
ctgtatttacugagagcaccaccuc

SEQ ID NO: 87426 - DNA, 28 bp, Artificial Sequence
  Synthetic
aatcaaatcagtaucaatggctcctuca

SEQ ID NO: 87427 - DNA, 27 bp, Artificial Sequence
  Synthetic
gagtaugcacgaaacaaaaacauccat

SEQ ID NO: 87428 - DNA, 21 bp, Artificial Sequence
  Synthetic
ccccaactcugacccttcuga

SEQ ID NO: 87429 - DNA, 21 bp, Artificial Sequence
  Synthetic
tccaattccagaugcccacug

SEQ ID NO: 87430 - DNA, 26 bp, Artificial Sequence
  Synthetic
tugtgtcagtugaagaaacagaagga

SEQ ID NO: 87431 - DNA, 22 bp, Artificial Sequence
  Synthetic
ccatgtgcugtgtttgtuccag

SEQ ID NO: 87432 - DNA, 22 bp, Artificial Sequence
  Synthetic
ctgcttgccutcctgagatuca

SEQ ID NO: 87433 - DNA, 27 bp, Artificial Sequence
  Synthetic
aggtgatgatggaauctgatcctttuc

SEQ ID NO: 87434 - DNA, 20 bp, Artificial Sequence
  Synthetic
aggcatgtuccgaagcauca

SEQ ID NO: 87435 - DNA, 28 bp, Artificial Sequence
  Synthetic
ggcagataguaggttctgttttatuggt

SEQ ID NO: 87436 - DNA, 28 bp, Artificial Sequence
  Synthetic
catcattctucagggccatgaaatagua

SEQ ID NO: 87437 - DNA, 26 bp, Artificial Sequence
  Synthetic
tgctcctagguaggaagtgctattut

SEQ ID NO: 87438 - DNA, 17 bp, Artificial Sequence
  Synthetic
gccccugtctgctuggt

SEQ ID NO: 87439 - DNA, 18 bp, Artificial Sequence
  Synthetic
gggcaccaucaccaccuc

SEQ ID NO: 87440 - DNA, 19 bp, Artificial Sequence
  Synthetic
gggagaaguacgagcuggt

SEQ ID NO: 87441 - DNA, 20 bp, Artificial Sequence
  Synthetic
acctcctuccgcttgaacuc

SEQ ID NO: 87442 - DNA, 17 bp, Artificial Sequence
  Synthetic
ccctgcccugggtccua

SEQ ID NO: 87443 - DNA, 18 bp, Artificial Sequence
  Synthetic
cagccgagcuctggaguc

SEQ ID NO: 87444 - DNA, 18 bp, Artificial Sequence
  Synthetic
gtgctgcugcttccacug

SEQ ID NO: 87445 - DNA, 17 bp, Artificial Sequence
  Synthetic
acucggcccccacctua

SEQ ID NO: 87446 - DNA, 18 bp, Artificial Sequence
  Synthetic
actccagagcucggcuga

SEQ ID NO: 87447 - DNA, 18 bp, Artificial Sequence
  Synthetic
ccccagcagcaccuaucc

SEQ ID NO: 87448 - DNA, 20 bp, Artificial Sequence
  Synthetic
gtguacgacgaggacgacuc

SEQ ID NO: 87449 - DNA, 21 bp, Artificial Sequence
  Synthetic
ggtggcuacacggacacuaaa

SEQ ID NO: 87450 - DNA, 22 bp, Artificial Sequence
  Synthetic
caaacutgcacuggagggagat

SEQ ID NO: 87451 - DNA, 22 bp, Artificial Sequence
  Synthetic
gtagtgagguctgtgggcatut

SEQ ID NO: 87452 - DNA, 21 bp, Artificial Sequence
  Synthetic
gcatgugacaggagccuagaa

SEQ ID NO: 87453 - DNA, 21 bp, Artificial Sequence
  Synthetic
cugggtgacgugagagaaagt

SEQ ID NO: 87454 - DNA, 28 bp, Artificial Sequence
  Synthetic
tgacttggguactttttaacttgcucaa

SEQ ID NO: 87455 - DNA, 28 bp, Artificial Sequence
  Synthetic
ccagacaagcaaacucaaaauaaagaga

SEQ ID NO: 87456 - DNA, 27 bp, Artificial Sequence
  Synthetic
aaggcttcttuccatatacctugcaat

SEQ ID NO: 87457 - DNA, 28 bp, Artificial Sequence
  Synthetic
gcatctagtaagucaacagaaagaucca

SEQ ID NO: 87458 - DNA, 28 bp, Artificial Sequence
  Synthetic
gaaaggagctuccgatattcttctguat

SEQ ID NO: 87459 - DNA, 26 bp, Artificial Sequence
  Synthetic
tugattactttacaugcaggacacct

SEQ ID NO: 87460 - DNA, 23 bp, Artificial Sequence
  Synthetic
agaagagaucgagagaaggcugt

SEQ ID NO: 87461 - DNA, 21 bp, Artificial Sequence
  Synthetic
acutcctcctucccagcagaa

SEQ ID NO: 87462 - DNA, 23 bp, Artificial Sequence
  Synthetic
gagggagctucttcgtttcctut

SEQ ID NO: 87463 - DNA, 22 bp, Artificial Sequence
  Synthetic
gcaacugaacgaggaagggaug

SEQ ID NO: 87464 - DNA, 25 bp, Artificial Sequence
  Synthetic
aaaagcacacagutatgaccuagca

SEQ ID NO: 87465 - DNA, 28 bp, Artificial Sequence
  Synthetic
ttccatagaacuccactttgacaatuga

SEQ ID NO: 87466 - DNA, 29 bp, Artificial Sequence
  Synthetic
tgctatcgaguaggtaatttgcttttgut

SEQ ID NO: 87467 - DNA, 25 bp, Artificial Sequence
  Synthetic
ggacutagtgaucacagcagacaag

SEQ ID NO: 87468 - DNA, 27 bp, Artificial Sequence
  Synthetic
gcttcttgcaguttggaatgaaatuct

SEQ ID NO: 87469 - DNA, 28 bp, Artificial Sequence
  Synthetic
tggtttctgtcaguatgtttgcttgtua

SEQ ID NO: 87470 - DNA, 24 bp, Artificial Sequence
  Synthetic
gugtttgatctcugaagccaacag

SEQ ID NO: 87471 - DNA, 26 bp, Artificial Sequence
  Synthetic
cggaggaguccatagatacatttgut

SEQ ID NO: 87472 - DNA, 22 bp, Artificial Sequence
  Synthetic
atttgcggaaauttggcaucgt

SEQ ID NO: 87473 - DNA, 21 bp, Artificial Sequence
  Synthetic
ccttgccugagctgatgtucc

SEQ ID NO: 87474 - DNA, 24 bp, Artificial Sequence
  Synthetic
ctgatggaugacttttgguggact

SEQ ID NO: 87475 - DNA, 26 bp, Artificial Sequence
  Synthetic
agacatcatctuacctgatccacuga

SEQ ID NO: 87476 - DNA, 21 bp, Artificial Sequence
  Synthetic
gtgtcagguagggatgcucac

SEQ ID NO: 87477 - DNA, 22 bp, Artificial Sequence
  Synthetic
gcaggtagcucagaccattcuc

SEQ ID NO: 87478 - DNA, 21 bp, Artificial Sequence
  Synthetic
tcccugcccagcuaacaaaag

SEQ ID NO: 87479 - DNA, 21 bp, Artificial Sequence
  Synthetic
ccagcgaagguguggaagaag

SEQ ID NO: 87480 - DNA, 17 bp, Artificial Sequence
  Synthetic
ctucccccaccccacut

SEQ ID NO: 87481 - DNA, 17 bp, Artificial Sequence
  Synthetic
cucctuccgccagcact

SEQ ID NO: 87482 - DNA, 18 bp, Artificial Sequence
  Synthetic
cccugcacgacctcaugt

SEQ ID NO: 87483 - DNA, 17 bp, Artificial Sequence
  Synthetic
gccgagaagccggucug

SEQ ID NO: 87484 - DNA, 22 bp, Artificial Sequence
  Synthetic
ccttggcugtgacctgtuacac

SEQ ID NO: 87485 - DNA, 28 bp, Artificial Sequence
  Synthetic
agtcttgcugaagacaatctgaaactua

SEQ ID NO: 87486 - DNA, 24 bp, Artificial Sequence
  Synthetic
tgtactcacagcutgtctacucca

SEQ ID NO: 87487 - DNA, 20 bp, Artificial Sequence
  Synthetic
gcttggcagucctgcacaua

SEQ ID NO: 87488 - DNA, 28 bp, Artificial Sequence
  Synthetic
caccttttcttgacucagtaatgactuc

SEQ ID NO: 87489 - DNA, 27 bp, Artificial Sequence
  Synthetic
aaacacacaautgtatagatugccagc

SEQ ID NO: 87490 - DNA, 22 bp, Artificial Sequence
  Synthetic
ccatgatgugcagcttcuccaa

SEQ ID NO: 87491 - DNA, 25 bp, Artificial Sequence
  Synthetic
tcauctgatgaaugaggaacagcag

SEQ ID NO: 87492 - DNA, 21 bp, Artificial Sequence
  Synthetic
cactgccuggagacacaaugt

SEQ ID NO: 87493 - DNA, 21 bp, Artificial Sequence
  Synthetic
atgcccagcaugcactatcut

SEQ ID NO: 87494 - DNA, 21 bp, Artificial Sequence
  Synthetic
caccacctucccagagtccua

SEQ ID NO: 87495 - DNA, 27 bp, Artificial Sequence
  Synthetic
gttttctcagaacacaauggaacaguc

SEQ ID NO: 87496 - DNA, 21 bp, Artificial Sequence
  Synthetic
ccagtcttcugatgcccugat

SEQ ID NO: 87497 - DNA, 21 bp, Artificial Sequence
  Synthetic
catccaagacaaccugctgug

SEQ ID NO: 87498 - DNA, 23 bp, Artificial Sequence
  Synthetic
gaattcaacuagagggcagccut

SEQ ID NO: 87499 - DNA, 22 bp, Artificial Sequence
  Synthetic
cagaggttcugtctggcaaaug

SEQ ID NO: 87500 - DNA, 20 bp, Artificial Sequence
  Synthetic
ggcccuctgcacugagaaac

SEQ ID NO: 87501 - DNA, 21 bp, Artificial Sequence
  Synthetic
gtgggaccaacugtgacauca

SEQ ID NO: 87502 - DNA, 20 bp, Artificial Sequence
  Synthetic
gattcagcccucacgtcucc

SEQ ID NO: 87503 - DNA, 23 bp, Artificial Sequence
  Synthetic
aacctaccccauctgcttcttuc

SEQ ID NO: 87504 - DNA, 21 bp, Artificial Sequence
  Synthetic
gcugggaaaggatgauaggct

SEQ ID NO: 87505 - DNA, 21 bp, Artificial Sequence
  Synthetic
tgcccaccaugtaccagatuc

SEQ ID NO: 87506 - DNA, 25 bp, Artificial Sequence
  Synthetic
ggagaagagaggucattttgcauga

SEQ ID NO: 87507 - DNA, 26 bp, Artificial Sequence
  Synthetic
gcataugccaaagcactacacuacaa

SEQ ID NO: 87508 - DNA, 22 bp, Artificial Sequence
  Synthetic
gtctgccauggtaagaaaugcc

SEQ ID NO: 87509 - DNA, 27 bp, Artificial Sequence
  Synthetic
gaagtgtactacutgccttctttcuct

SEQ ID NO: 87510 - DNA, 24 bp, Artificial Sequence
  Synthetic
ggttggatucacactcattgtugt

SEQ ID NO: 87511 - DNA, 20 bp, Artificial Sequence
  Synthetic
cccauagggcatugcagacc

SEQ ID NO: 87512 - DNA, 19 bp, Artificial Sequence
  Synthetic
ggcaaacgggccauttcug

SEQ ID NO: 87513 - DNA, 23 bp, Artificial Sequence
  Synthetic
cccattgugactttccagcucat

SEQ ID NO: 87514 - DNA, 27 bp, Artificial Sequence
  Synthetic
agtattcaaaaucaagcgagtucgaga

SEQ ID NO: 87515 - DNA, 27 bp, Artificial Sequence
  Synthetic
cctgtattttgcaugcacttgattuca

SEQ ID NO: 87516 - DNA, 23 bp, Artificial Sequence
  Synthetic
gaagacttacuccctttgccugt

SEQ ID NO: 87517 - DNA, 28 bp, Artificial Sequence
  Synthetic
ggcttaccgtttucccattgtagtaaua

SEQ ID NO: 87518 - DNA, 22 bp, Artificial Sequence
  Synthetic
tgtctcctccugacacctgtut

SEQ ID NO: 87519 - DNA, 20 bp, Artificial Sequence
  Synthetic
tgtcctgtcgutccctccua

SEQ ID NO: 87520 - DNA, 23 bp, Artificial Sequence
  Synthetic
gtggguagaagactaggtuggaa

SEQ ID NO: 87521 - DNA, 27 bp, Artificial Sequence
  Synthetic
ccatttgaugaactccaaaggucagaa

SEQ ID NO: 87522 - DNA, 19 bp, Artificial Sequence
  Synthetic
gggaatgugggaggaggut

SEQ ID NO: 87523 - DNA, 19 bp, Artificial Sequence
  Synthetic
ctgaggcugcccacacuac

SEQ ID NO: 87524 - DNA, 22 bp, Artificial Sequence
  Synthetic
gtgcttaucctgtcccuggaat

SEQ ID NO: 87525 - DNA, 28 bp, Artificial Sequence
  Synthetic
aagcgagtaatguatactgctttcctut

SEQ ID NO: 87526 - DNA, 19 bp, Artificial Sequence
  Synthetic
ctctgagcuggacccgaug

SEQ ID NO: 87527 - DNA, 21 bp, Artificial Sequence
  Synthetic
acaguacctguccaccacact

SEQ ID NO: 87528 - DNA, 23 bp, Artificial Sequence
  Synthetic
cauagtcagaugcacaggccaat

SEQ ID NO: 87529 - DNA, 23 bp, Artificial Sequence
  Synthetic
tcaatgatgcucttttgcugcac

SEQ ID NO: 87530 - DNA, 18 bp, Artificial Sequence
  Synthetic
gccugggaagccagctug

SEQ ID NO: 87531 - DNA, 21 bp, Artificial Sequence
  Synthetic
caccccttugagtcctgtuct

SEQ ID NO: 87532 - DNA, 28 bp, Artificial Sequence
  Synthetic
cgtagaaatuccccttatagucagacca

SEQ ID NO: 87533 - DNA, 25 bp, Artificial Sequence
  Synthetic
gtgatgcaagtuttgggtcttgtut

SEQ ID NO: 87534 - DNA, 17 bp, Artificial Sequence
  Synthetic
gcggucucagggaggct

SEQ ID NO: 87535 - DNA, 19 bp, Artificial Sequence
  Synthetic
acgugagcaggaggugaac

SEQ ID NO: 87536 - DNA, 25 bp, Artificial Sequence
  Synthetic
aggctgcatutcatgaaggtuagaa

SEQ ID NO: 87537 - DNA, 22 bp, Artificial Sequence
  Synthetic
ctcacacguatgttuccgacac

SEQ ID NO: 87538 - DNA, 21 bp, Artificial Sequence
  Synthetic
tgtgtccuttggttgtugcct

SEQ ID NO: 87539 - DNA, 22 bp, Artificial Sequence
  Synthetic
gtatgcgauggtggugacaaac

SEQ ID NO: 87540 - DNA, 23 bp, Artificial Sequence
  Synthetic
cuctcattctctugccaaagcag

SEQ ID NO: 87541 - DNA, 28 bp, Artificial Sequence
  Synthetic
tttaaggcttacacuctgcaattctcut

SEQ ID NO: 87542 - DNA, 23 bp, Artificial Sequence
  Synthetic
tggttgggcaauactgccttuag

SEQ ID NO: 87543 - DNA, 26 bp, Artificial Sequence
  Synthetic
tgagacccaguacaatgagatgttug

SEQ ID NO: 87544 - DNA, 27 bp, Artificial Sequence
  Synthetic
gactaagtccautcctgataccaucac

SEQ ID NO: 87545 - DNA, 27 bp, Artificial Sequence
  Synthetic
gcttcccttcauacagggtattccaua

SEQ ID NO: 87546 - DNA, 23 bp, Artificial Sequence
  Synthetic
gttuccacaccaaccaugagagt

SEQ ID NO: 87547 - DNA, 19 bp, Artificial Sequence
  Synthetic
caacaugcaggcgcucaag

SEQ ID NO: 87548 - DNA, 22 bp, Artificial Sequence
  Synthetic
cctccagggucttctucaggat

SEQ ID NO: 87549 - DNA, 22 bp, Artificial Sequence
  Synthetic
ggtagaaaagcugcctggagug

SEQ ID NO: 87550 - DNA, 22 bp, Artificial Sequence
  Synthetic
tgaatgugaggcccagaaguca

SEQ ID NO: 87551 - DNA, 23 bp, Artificial Sequence
  Synthetic
cttcaggauagcgctcttctucc

SEQ ID NO: 87552 - DNA, 22 bp, Artificial Sequence
  Synthetic
gcctttcuggaactccagtuct

SEQ ID NO: 87553 - DNA, 22 bp, Artificial Sequence
  Synthetic
gctgtgaggutttgctcttcuc

SEQ ID NO: 87554 - DNA, 22 bp, Artificial Sequence
  Synthetic
ttttacuccagcttgcugacga

SEQ ID NO: 87555 - DNA, 26 bp, Artificial Sequence
  Synthetic
aagtaagucaagagaacctccctuct

SEQ ID NO: 87556 - DNA, 23 bp, Artificial Sequence
  Synthetic
gacauacagacugcagggacaat

SEQ ID NO: 87557 - DNA, 24 bp, Artificial Sequence
  Synthetic
gacccttcagaauctcttgctcut

SEQ ID NO: 87558 - DNA, 25 bp, Artificial Sequence
  Synthetic
ttgtcttagaugggacccacaatuc

SEQ ID NO: 87559 - DNA, 25 bp, Artificial Sequence
  Synthetic
accctagtcacgugttatagccuac

SEQ ID NO: 87560 - DNA, 26 bp, Artificial Sequence
  Synthetic
gggatgtaatcautggagaggatgug

SEQ ID NO: 87561 - DNA, 20 bp, Artificial Sequence
  Synthetic
tcccuaacctugccaaggag

SEQ ID NO: 87562 - DNA, 26 bp, Artificial Sequence
  Synthetic
gactacacaucctgaacttttugcag

SEQ ID NO: 87563 - DNA, 25 bp, Artificial Sequence
  Synthetic
tgacttctgcucctgttctugaaag

SEQ ID NO: 87564 - DNA, 22 bp, Artificial Sequence
  Synthetic
gcttggagaucccttucgaact

SEQ ID NO: 87565 - DNA, 21 bp, Artificial Sequence
  Synthetic
tccatgagcuggagaagucca

SEQ ID NO: 87566 - DNA, 20 bp, Artificial Sequence
  Synthetic
cctccacguacccctcucag

SEQ ID NO: 87567 - DNA, 20 bp, Artificial Sequence
  Synthetic
cgtccuggacgaugcagaag

SEQ ID NO: 87568 - DNA, 22 bp, Artificial Sequence
  Synthetic
tgtctgtccagacucccatcut

SEQ ID NO: 87569 - DNA, 21 bp, Artificial Sequence
  Synthetic
ggagtcccuggatttcacuga

SEQ ID NO: 87570 - DNA, 24 bp, Artificial Sequence
  Synthetic
ttgggttactgugtggcatatgut

SEQ ID NO: 87571 - DNA, 23 bp, Artificial Sequence
  Synthetic
ggautcaaauaagcagccggaag

SEQ ID NO: 87572 - DNA, 18 bp, Artificial Sequence
  Synthetic
acagagaacgccgugugt

SEQ ID NO: 87573 - DNA, 19 bp, Artificial Sequence
  Synthetic
gggaccaggguggaaaugg

SEQ ID NO: 87574 - DNA, 22 bp, Artificial Sequence
  Synthetic
accagagaaguttgcccugaag

SEQ ID NO: 87575 - DNA, 25 bp, Artificial Sequence
  Synthetic
ctcaaaacagttutgcagggagaug

SEQ ID NO: 87576 - DNA, 25 bp, Artificial Sequence
  Synthetic
atcccaaagcaagaucttctucaca

SEQ ID NO: 87577 - DNA, 25 bp, Artificial Sequence
  Synthetic
gcacaggaaaaacauttgcatggut

SEQ ID NO: 87578 - DNA, 24 bp, Artificial Sequence
  Synthetic
aatccaccugcaagctgtgauaat

SEQ ID NO: 87579 - DNA, 28 bp, Artificial Sequence
  Synthetic
ccctgacattucaacttttacttgctuc

SEQ ID NO: 87580 - DNA, 19 bp, Artificial Sequence
  Synthetic
agcuggagccaggaccaua

SEQ ID NO: 87581 - DNA, 22 bp, Artificial Sequence
  Synthetic
ctcagugagccagttgctaucc

SEQ ID NO: 87582 - DNA, 26 bp, Artificial Sequence
  Synthetic
atccagaaaaagutgctgaaaucaga

SEQ ID NO: 87583 - DNA, 22 bp, Artificial Sequence
  Synthetic
tgacagagucttcccgaugagt

SEQ ID NO: 87584 - DNA, 21 bp, Artificial Sequence
  Synthetic
agggacaggaaguctgacuga

SEQ ID NO: 87585 - DNA, 27 bp, Artificial Sequence
  Synthetic
cttgaggtgcuactgaattttcugaag

SEQ ID NO: 87586 - DNA, 22 bp, Artificial Sequence
  Synthetic
ctgcgtctucatctcctccauc

SEQ ID NO: 87587 - DNA, 23 bp, Artificial Sequence
  Synthetic
ggtgggttuctcaatcgtctuca

SEQ ID NO: 87588 - DNA, 22 bp, Artificial Sequence
  Synthetic
ctctacacuggaggtggacuct

SEQ ID NO: 87589 - DNA, 22 bp, Artificial Sequence
  Synthetic
tcaagttcaucaccccactcug

SEQ ID NO: 87590 - DNA, 25 bp, Artificial Sequence
  Synthetic
tcttattcccacagugtatcggcua

SEQ ID NO: 87591 - DNA, 25 bp, Artificial Sequence
  Synthetic
tgcctgtctcucatgagttcauact

SEQ ID NO: 87592 - DNA, 25 bp, Artificial Sequence
  Synthetic
ggctgtgcttugtcttttaaaggug

SEQ ID NO: 87593 - DNA, 22 bp, Artificial Sequence
  Synthetic
ccuggccaagaaucaagaacct

SEQ ID NO: 87594 - DNA, 24 bp, Artificial Sequence
  Synthetic
catcctcaacauagatgccauggt

SEQ ID NO: 87595 - DNA, 26 bp, Artificial Sequence
  Synthetic
cccctcctagutttgatcttcttugg

SEQ ID NO: 87596 - DNA, 22 bp, Artificial Sequence
  Synthetic
gccgctuaccaacctccttuaa

SEQ ID NO: 87597 - DNA, 23 bp, Artificial Sequence
  Synthetic
ggtagaugctagggugaaaaggg

SEQ ID NO: 87598 - DNA, 21 bp, Artificial Sequence
  Synthetic
ccccacagaccugacttcuct

SEQ ID NO: 87599 - DNA, 23 bp, Artificial Sequence
  Synthetic
gcuggaaaggaggtgtugaagaa

SEQ ID NO: 87600 - DNA, 21 bp, Artificial Sequence
  Synthetic
agtgttttgcucctgggtcug

SEQ ID NO: 87601 - DNA, 26 bp, Artificial Sequence
  Synthetic
cauaagacaagcucacagcaaacaaa

SEQ ID NO: 87602 - DNA, 27 bp, Artificial Sequence
  Synthetic
ttgggttttccutaactttaggtugga

SEQ ID NO: 87603 - DNA, 28 bp, Artificial Sequence
  Synthetic
ctgtcugcattatttcugaaaaccaaca

SEQ ID NO: 87604 - DNA, 22 bp, Artificial Sequence
  Synthetic
cttcttcacgcuccttcccuat

SEQ ID NO: 87605 - DNA, 20 bp, Artificial Sequence
  Synthetic
catgcugaaggacagcucct

SEQ ID NO: 87606 - DNA, 22 bp, Artificial Sequence
  Synthetic
gtgaatgauccgggaggcauag

SEQ ID NO: 87607 - DNA, 29 bp, Artificial Sequence
  Synthetic
cttccttggagautgtatgttagcagtua

SEQ ID NO: 87608 - DNA, 26 bp, Artificial Sequence
  Synthetic
ttgctcagcaaagguacttgauacat

SEQ ID NO: 87609 - DNA, 26 bp, Artificial Sequence
  Synthetic
cttctgtaagagaugccacctuagag

SEQ ID NO: 87610 - DNA, 26 bp, Artificial Sequence
  Synthetic
ccaagtggcacuctttcaaaagtuat

SEQ ID NO: 87611 - DNA, 21 bp, Artificial Sequence
  Synthetic
tgaucugaaggagcccagaga

SEQ ID NO: 87612 - DNA, 22 bp, Artificial Sequence
  Synthetic
gcttgtctccucgccttatucc

SEQ ID NO: 87613 - DNA, 26 bp, Artificial Sequence
  Synthetic
ctggtcctcaaugaagtcgtagauaa

SEQ ID NO: 87614 - DNA, 26 bp, Artificial Sequence
  Synthetic
gaacatatcatcuggaccctttucca

SEQ ID NO: 87615 - DNA, 28 bp, Artificial Sequence
  Synthetic
tcagutaacaagtaaguagggaggagag

SEQ ID NO: 87616 - DNA, 20 bp, Artificial Sequence
  Synthetic
tgtgcccgcguatacttcuc

SEQ ID NO: 87617 - DNA, 18 bp, Artificial Sequence
  Synthetic
caggcggaacugguggaa

SEQ ID NO: 87618 - DNA, 22 bp, Artificial Sequence
  Synthetic
tgccagcagutgaugagaaaca

SEQ ID NO: 87619 - DNA, 25 bp, Artificial Sequence
  Synthetic
gcagtgatgccucattacgtttuag

SEQ ID NO: 87620 - DNA, 22 bp, Artificial Sequence
  Synthetic
agatgatugccaaggccttcuc

SEQ ID NO: 87621 - DNA, 20 bp, Artificial Sequence
  Synthetic
gcugggagagacuagcacat

SEQ ID NO: 87622 - DNA, 23 bp, Artificial Sequence
  Synthetic
cctactacccutggcatccttug

SEQ ID NO: 87623 - DNA, 20 bp, Artificial Sequence
  Synthetic
aggcaccgugttgacttcug

SEQ ID NO: 87624 - DNA, 22 bp, Artificial Sequence
  Synthetic
ggtcacauctgaccagucagaa

SEQ ID NO: 87625 - DNA, 20 bp, Artificial Sequence
  Synthetic
aaaugctgcugagcgaacac

SEQ ID NO: 87626 - DNA, 19 bp, Artificial Sequence
  Synthetic
ccutccgcatucgggagaa

SEQ ID NO: 87627 - DNA, 19 bp, Artificial Sequence
  Synthetic
ccacaaggucggcacucac

SEQ ID NO: 87628 - DNA, 21 bp, Artificial Sequence
  Synthetic
tgtacccuggttctgcucagt

SEQ ID NO: 87629 - DNA, 23 bp, Artificial Sequence
  Synthetic
aatcgtgttcutgtgcctaucca

SEQ ID NO: 87630 - DNA, 27 bp, Artificial Sequence
  Synthetic
ccataaggcucttactctcaaaucaca

SEQ ID NO: 87631 - DNA, 23 bp, Artificial Sequence
  Synthetic
agctgttcttutggttggtguct

SEQ ID NO: 87632 - DNA, 23 bp, Artificial Sequence
  Synthetic
gaaggacacucaaaagcatgcug

SEQ ID NO: 87633 - DNA, 22 bp, Artificial Sequence
  Synthetic
cttgcatccaggutccacctua

SEQ ID NO: 87634 - DNA, 20 bp, Artificial Sequence
  Synthetic
cgacgccgagaccucuaaac

SEQ ID NO: 87635 - DNA, 20 bp, Artificial Sequence
  Synthetic
gctatgagcugcttgggcua

SEQ ID NO: 87636 - DNA, 25 bp, Artificial Sequence
  Synthetic
gagcagcaaacaacutctucagaaa

SEQ ID NO: 87637 - DNA, 24 bp, Artificial Sequence
  Synthetic
ggcactuacctacacatcugcaag

SEQ ID NO: 87638 - DNA, 28 bp, Artificial Sequence
  Synthetic
cctgtcaagacucaatatgattucccat

SEQ ID NO: 87639 - DNA, 27 bp, Artificial Sequence
  Synthetic
caaattgcugccagactcaagattuaa

SEQ ID NO: 87640 - DNA, 23 bp, Artificial Sequence
  Synthetic
gctaagtagcugcttctggtuga

SEQ ID NO: 87641 - DNA, 23 bp, Artificial Sequence
  Synthetic
tcttgttcaauggaagcctccug

SEQ ID NO: 87642 - DNA, 27 bp, Artificial Sequence
  Synthetic
tttucacaagcacatugacaaacaaga

SEQ ID NO: 87643 - DNA, 24 bp, Artificial Sequence
  Synthetic
cctgtgatugctcctgtgaucaaa

SEQ ID NO: 87644 - DNA, 23 bp, Artificial Sequence
  Synthetic
acgcacagtuagtgaaccttcuc

SEQ ID NO: 87645 - DNA, 27 bp, Artificial Sequence
  Synthetic
ttatcactcaaaucggagacattuggt

SEQ ID NO: 87646 - DNA, 27 bp, Artificial Sequence
  Synthetic
tctgttgagaugaactaaauggcaact

SEQ ID NO: 87647 - DNA, 23 bp, Artificial Sequence
  Synthetic
agaagagccauagagagcaugga

SEQ ID NO: 87648 - DNA, 27 bp, Artificial Sequence
  Synthetic
acggttaaccuatttacctgttgtucc

SEQ ID NO: 87649 - DNA, 28 bp, Artificial Sequence
  Synthetic
tgaagttcgttuaaaagagtcagcugaa

SEQ ID NO: 87650 - DNA, 26 bp, Artificial Sequence
  Synthetic
ttggatgctautcaaggttatuggct

SEQ ID NO: 87651 - DNA, 25 bp, Artificial Sequence
  Synthetic
accacattgaggucacaatctucaa

SEQ ID NO: 87652 - DNA, 21 bp, Artificial Sequence
  Synthetic
ttucaccaagcggaaucccat

SEQ ID NO: 87653 - DNA, 22 bp, Artificial Sequence
  Synthetic
gtgctccagcugtgttgtttuc

SEQ ID NO: 87654 - DNA, 28 bp, Artificial Sequence
  Synthetic
ggctcttctttuatcatcctgaagtuct

SEQ ID NO: 87655 - DNA, 22 bp, Artificial Sequence
  Synthetic
aaaggugacagaagaagugcgt

SEQ ID NO: 87656 - DNA, 20 bp, Artificial Sequence
  Synthetic
tctgccucccttctgacugt

SEQ ID NO: 87657 - DNA, 20 bp, Artificial Sequence
  Synthetic
gagaguccacccagcauagg

SEQ ID NO: 87658 - DNA, 26 bp, Artificial Sequence
  Synthetic
agtcccugaaaaacagctgaatgaua

SEQ ID NO: 87659 - DNA, 28 bp, Artificial Sequence
  Synthetic
agtacttacggtugtcataaattgggut

SEQ ID NO: 87660 - DNA, 20 bp, Artificial Sequence
  Synthetic
cctcccuacgccttcttcut

SEQ ID NO: 87661 - DNA, 18 bp, Artificial Sequence
  Synthetic
ccacccuccacaguccct

SEQ ID NO: 87662 - DNA, 20 bp, Artificial Sequence
  Synthetic
gcucggagaacacccttcug

SEQ ID NO: 87663 - DNA, 26 bp, Artificial Sequence
  Synthetic
acggtcctcautttctcgtatttugt

SEQ ID NO: 87664 - DNA, 20 bp, Artificial Sequence
  Synthetic
cauggagaagaaggcccuca

SEQ ID NO: 87665 - DNA, 23 bp, Artificial Sequence
  Synthetic
cttggcgaacuccacagtctuaa

SEQ ID NO: 87666 - DNA, 23 bp, Artificial Sequence
  Synthetic
gggctggatutggagctaaagua

SEQ ID NO: 87667 - DNA, 28 bp, Artificial Sequence
  Synthetic
gctgcaaataaaaguccagatacgttut

SEQ ID NO: 87668 - DNA, 20 bp, Artificial Sequence
  Synthetic
actcacuggctcctauggca

SEQ ID NO: 87669 - DNA, 27 bp, Artificial Sequence
  Synthetic
agtcacauagaagaatttgggttuggt

SEQ ID NO: 87670 - DNA, 20 bp, Artificial Sequence
  Synthetic
caggugccacctgataguga

SEQ ID NO: 87671 - DNA, 20 bp, Artificial Sequence
  Synthetic
cugagggagccccatatucc

SEQ ID NO: 87672 - DNA, 26 bp, Artificial Sequence
  Synthetic
acacccatttutacaatgacgugact

SEQ ID NO: 87673 - DNA, 22 bp, Artificial Sequence
  Synthetic
cagctacagugatgcccacuac

SEQ ID NO: 87674 - DNA, 22 bp, Artificial Sequence
  Synthetic
ctcccttaggutccctacucct

SEQ ID NO: 87675 - DNA, 21 bp, Artificial Sequence
  Synthetic
cagaggaaauggctccaggua

SEQ ID NO: 87676 - DNA, 20 bp, Artificial Sequence
  Synthetic
ctccuccaccgcttcttguc

SEQ ID NO: 87677 - DNA, 21 bp, Artificial Sequence
  Synthetic
ctacugggacggaacagctut

SEQ ID NO: 87678 - DNA, 22 bp, Artificial Sequence
  Synthetic
gaactcuccaccaagtgcauca

SEQ ID NO: 87679 - DNA, 21 bp, Artificial Sequence
  Synthetic
gacaucuacccaggacacagg

SEQ ID NO: 87680 - DNA, 27 bp, Artificial Sequence
  Synthetic
agtcaagcggacutaaaacttctuacc

SEQ ID NO: 87681 - DNA, 28 bp, Artificial Sequence
  Synthetic
gtctgctatacugattcctgacttgtut

SEQ ID NO: 87682 - DNA, 25 bp, Artificial Sequence
  Synthetic
ctaaccttccugtgattccactugt

SEQ ID NO: 87683 - DNA, 24 bp, Artificial Sequence
  Synthetic
gaaataagucaacacccagggcua

SEQ ID NO: 87684 - DNA, 21 bp, Artificial Sequence
  Synthetic
tgcgagagcagagugaggaua

SEQ ID NO: 87685 - DNA, 23 bp, Artificial Sequence
  Synthetic
ggaacaaccaautgtagcucgga

SEQ ID NO: 87686 - DNA, 28 bp, Artificial Sequence
  Synthetic
agaaggcaactugacaagagaaatgaua

SEQ ID NO: 87687 - DNA, 28 bp, Artificial Sequence
  Synthetic
aggtagatgtuaagaaacacctcucact

SEQ ID NO: 87688 - DNA, 24 bp, Artificial Sequence
  Synthetic
tgaaataccucagagcuagagcga

SEQ ID NO: 87689 - DNA, 23 bp, Artificial Sequence
  Synthetic
tguggacgtttucagcagaaaga

SEQ ID NO: 87690 - DNA, 29 bp, Artificial Sequence
  Synthetic
tgtttaaaugcagtctaactuggagaagt

SEQ ID NO: 87691 - DNA, 28 bp, Artificial Sequence
  Synthetic
cccaacatcugacagttctttctcttua

SEQ ID NO: 87692 - DNA, 22 bp, Artificial Sequence
  Synthetic
ggcttgatatuggctgttggug

SEQ ID NO: 87693 - DNA, 28 bp, Artificial Sequence
  Synthetic
attcaaaacagcuttaataaggctcuga

SEQ ID NO: 87694 - DNA, 20 bp, Artificial Sequence
  Synthetic
cucccaaggcaagctuacac

SEQ ID NO: 87695 - DNA, 23 bp, Artificial Sequence
  Synthetic
gtgaggguttttggaacuggaga

SEQ ID NO: 87696 - DNA, 21 bp, Artificial Sequence
  Synthetic
ggtccugaggtaagaccugct

SEQ ID NO: 87697 - DNA, 21 bp, Artificial Sequence
  Synthetic
gttgaaggtcugtgcgttcug

SEQ ID NO: 87698 - DNA, 27 bp, Artificial Sequence
  Synthetic
catctcattaucagctgtguagcaaac

SEQ ID NO: 87699 - DNA, 28 bp, Artificial Sequence
  Synthetic
ctcacctcauaactcttcttgguaacaa

SEQ ID NO: 87700 - DNA, 20 bp, Artificial Sequence
  Synthetic
gaaggacgucatgctccugt

SEQ ID NO: 87701 - DNA, 20 bp, Artificial Sequence
  Synthetic
cacagcuagcgggacttgut

SEQ ID NO: 87702 - DNA, 25 bp, Artificial Sequence
  Synthetic
gtggtctutctttctgauacagcca

SEQ ID NO: 87703 - DNA, 25 bp, Artificial Sequence
  Synthetic
cgatcaatgccutctctctctcuct

SEQ ID NO: 87704 - DNA, 25 bp, Artificial Sequence
  Synthetic
ggttctttcuctccaccttugaact

SEQ ID NO: 87705 - DNA, 23 bp, Artificial Sequence
  Synthetic
cagaaaggauaaaccagcaccug

SEQ ID NO: 87706 - DNA, 23 bp, Artificial Sequence
  Synthetic
gctgtgauttcacttucgcagaa

SEQ ID NO: 87707 - DNA, 22 bp, Artificial Sequence
  Synthetic
tttcctcctuggagacatgcug

SEQ ID NO: 87708 - DNA, 28 bp, Artificial Sequence
  Synthetic
gtccacacaacutgattttgatccauat

SEQ ID NO: 87709 - DNA, 27 bp, Artificial Sequence
  Synthetic
tgccagatatuaaatcgagacttugct

SEQ ID NO: 87710 - DNA, 28 bp, Artificial Sequence
  Synthetic
tgagctcagtauggaaagaaataacuct

SEQ ID NO: 87711 - DNA, 25 bp, Artificial Sequence
  Synthetic
tcactttgcauatgccatacaugga

SEQ ID NO: 87712 - DNA, 28 bp, Artificial Sequence
  Synthetic
catgtatggcauatgcaaagugaagaat

SEQ ID NO: 87713 - DNA, 33 bp, Artificial Sequence; identical to SEQ ID NO: 54143
  Synthetic

SEQ ID NO: 87714 - DNA, 21 bp, Artificial Sequence
  Synthetic
cagggcaugcatttcatugga

SEQ ID NO: 87715 - DNA, 23 bp, Artificial Sequence
  Synthetic
gcaggtattuctcgtactgguca

SEQ ID NO: 87716 - DNA, 23 bp, Artificial Sequence
  Synthetic
ggaggtccugttttcaagtucct

SEQ ID NO: 87717 - DNA, 17 bp, Artificial Sequence
  Synthetic
gtccacugcgacgccua

SEQ ID NO: 87718 - DNA, 20 bp, Artificial Sequence
  Synthetic
cccatggagugtccttcgug

SEQ ID NO: 87719 - DNA, 21 bp, Artificial Sequence
  Synthetic
tttccuggaagggaggugaga

SEQ ID NO: 87720 - DNA, 19 bp, Artificial Sequence
  Synthetic
acagttgugggtggctuca

SEQ ID NO: 87721 - DNA, 17 bp, Artificial Sequence
  Synthetic
gctccgccucgtgacuc

SEQ ID NO: 87722 - DNA, 24 bp, Artificial Sequence
  Synthetic
gcagcccaucatgaagttcaucaa

SEQ ID NO: 87723 - DNA, 18 bp, Artificial Sequence
  Synthetic
augaggacgccgacacug

SEQ ID NO: 87724 - DNA, 28 bp, Artificial Sequence
  Synthetic
tcctagataccutcattccttucccaaa

SEQ ID NO: 87725 - DNA, 20 bp, Artificial Sequence
  Synthetic
tgtgggcagcaucactctug

SEQ ID NO: 87726 - DNA, 17 bp, Artificial Sequence
  Synthetic
ccccagccugcagaguc

SEQ ID NO: 87727 - DNA, 22 bp, Artificial Sequence
  Synthetic
guggaggacgagaagaatucct

SEQ ID NO: 87728 - DNA, 23 bp, Artificial Sequence
  Synthetic
gtccatggutcatgcatctucct

SEQ ID NO: 87729 - DNA, 23 bp, Artificial Sequence
  Synthetic
caaaaaggacaaucaggcctgut

SEQ ID NO: 87730 - DNA, 20 bp, Artificial Sequence
  Synthetic
tgcttcuccaggttgtgcut

SEQ ID NO: 87731 - DNA, 19 bp, Artificial Sequence
  Synthetic
cctcucaacccgcgaguag

SEQ ID NO: 87732 - DNA, 21 bp, Artificial Sequence
  Synthetic
gtgccaccacautgcaguaac

SEQ ID NO: 87733 - DNA, 21 bp, Artificial Sequence
  Synthetic
gaggtuagccacgtactcguc

SEQ ID NO: 87734 - DNA, 20 bp, Artificial Sequence
  Synthetic
ccuacctctugcagcagaca

SEQ ID NO: 87735 - DNA, 18 bp, Artificial Sequence
  Synthetic
acgugaagacggctgcuc

SEQ ID NO: 87736 - DNA, 17 bp, Artificial Sequence
  Synthetic
gcugccaagcgtucgga

SEQ ID NO: 87737 - DNA, 24 bp, Artificial Sequence
  Synthetic
tcaagatgggcuactgaaaaugct

SEQ ID NO: 87738 - DNA, 22 bp, Artificial Sequence
  Synthetic
tctgctggagutcatcctgcua

SEQ ID NO: 87739 - DNA, 20 bp, Artificial Sequence
  Synthetic
gtcagaacugggatcugcga

SEQ ID NO: 87740 - DNA, 23 bp, Artificial Sequence
  Synthetic
actcactggucctttcactcuct

SEQ ID NO: 87741 - DNA, 20 bp, Artificial Sequence
  Synthetic
cagttgtcuggcctcuccat

SEQ ID NO: 87742 - DNA, 17 bp, Artificial Sequence
  Synthetic
ctccaccacgucgcuct

SEQ ID NO: 87743 - DNA, 17 bp, Artificial Sequence
  Synthetic
agcucgccctccuacca

SEQ ID NO: 87744 - DNA, 22 bp, Artificial Sequence
  Synthetic
guttgtgcauaaggaccaggga

SEQ ID NO: 87745 - DNA, 23 bp, Artificial Sequence
  Synthetic
cttcccaagaacagacugagugt

SEQ ID NO: 87746 - DNA, 20 bp, Artificial Sequence
  Synthetic
cccaccauggagaactggua

SEQ ID NO: 87747 - DNA, 18 bp, Artificial Sequence
  Synthetic
catcggcaucggcatguc

SEQ ID NO: 87748 - DNA, 18 bp, Artificial Sequence
  Synthetic
cggcagguaggtgtggua

SEQ ID NO: 87749 - DNA, 17 bp, Artificial Sequence
  Synthetic
ctgcccuccatcuccga

SEQ ID NO: 87750 - DNA, 26 bp, Artificial Sequence
  Synthetic
caaactttcucaccatggtttcagut

SEQ ID NO: 87751 - DNA, 26 bp, Artificial Sequence
  Synthetic
tccttttctttcugccttcttaggug

SEQ ID NO: 87752 - DNA, 19 bp, Artificial Sequence
  Synthetic
gtgaaggcgccuggauagt

SEQ ID NO: 87753 - DNA, 21 bp, Artificial Sequence
  Synthetic
ccgcaaccucctactcactuc

SEQ ID NO: 87754 - DNA, 33 bp, Artificial Sequence; identical to SEQ ID NO: 63628
  Synthetic

SEQ ID NO: 87755 - DNA, 28 bp, Artificial Sequence
  Synthetic
ggtacaagtuaaggcacacagaagatua

SEQ ID NO: 87756 - DNA, 28 bp, Artificial Sequence
  Synthetic
aacttcatttgtgutttctcctagguca

SEQ ID NO: 87757 - DNA, 25 bp, Artificial Sequence
  Synthetic
gtgttgtuggcagggatacauaaac

SEQ ID NO: 87758 - DNA, 27 bp, Artificial Sequence
  Synthetic
caccctacagaaautcagaactcugat

SEQ ID NO: 87759 - DNA, 24 bp, Artificial Sequence
  Synthetic
acuggagcgatcugaaacagaaac

SEQ ID NO: 87760 - DNA, 21 bp, Artificial Sequence
  Synthetic
gcggctcutcaaccttcugaa

SEQ ID NO: 87761 - DNA, 22 bp, Artificial Sequence
  Synthetic
ggagggaaugcacacagatguc

SEQ ID NO: 87762 - DNA, 27 bp, Artificial Sequence
  Synthetic
tctatctggcuactaagcctttgttug

SEQ ID NO: 87763 - DNA, 27 bp, Artificial Sequence
  Synthetic
ctgcttcatguagaaatgggttguaat

SEQ ID NO: 87764 - DNA, 18 bp, Artificial Sequence
  Synthetic
aggcccuaagccctcugt

SEQ ID NO: 87765 - DNA, 17 bp, Artificial Sequence
  Synthetic
ccggcaggaucagcuca

SEQ ID NO: 87766 - DNA, 23 bp, Artificial Sequence
  Synthetic
agccacaccucacgttagaatut

SEQ ID NO: 87767 - DNA, 31 bp, Artificial Sequence; identical to SEQ ID NO: 65237
  Synthetic

SEQ ID NO: 87768 - DNA, 22 bp, Artificial Sequence
  Synthetic
gttctuggagagcacatccuca

SEQ ID NO: 87769 - DNA, 17 bp, Artificial Sequence
  Synthetic
gtcgcccugggcctuac

SEQ ID NO: 87770 - DNA, 26 bp, Artificial Sequence
  Synthetic
tgagaaagccaautgagcactatcut

SEQ ID NO: 87771 - DNA, 20 bp, Artificial Sequence
  Synthetic
gccgagugctacaaccucag

SEQ ID NO: 87772 - DNA, 20 bp, Artificial Sequence
  Synthetic
gatgccagcucaccagauga

SEQ ID NO: 87773 - DNA, 28 bp, Artificial Sequence
  Synthetic
ctttcagtcacuctagtcaagcactuat

SEQ ID NO: 87774 - DNA, 25 bp, Artificial Sequence
  Synthetic
caaggagggagaucacattaguaca

SEQ ID NO: 87775 - DNA, 24 bp, Artificial Sequence
  Synthetic
gcaatggugtgttttaacuggcat

SEQ ID NO: 87776 - DNA, 28 bp, Artificial Sequence
  Synthetic
ccacatgctttugaagatgttcattuga

SEQ ID NO: 87777 - DNA, 26 bp, Artificial Sequence
  Synthetic
gggagttacutagcttttcctuagca

SEQ ID NO: 87778 - DNA, 28 bp, Artificial Sequence
  Synthetic
gaagcctcautcaactcaaauacaaacc

SEQ ID NO: 87779 - DNA, 23 bp, Artificial Sequence
  Synthetic
acgagcccuactacagcaacuat

SEQ ID NO: 87780 - DNA, 20 bp, Artificial Sequence
  Synthetic
tgccctuccaatggauccac

SEQ ID NO: 87781 - DNA, 22 bp, Artificial Sequence
  Synthetic
tcatgctggauccccactttuc

SEQ ID NO: 87782 - DNA, 22 bp, Artificial Sequence
  Synthetic
tccttcugcaggcctuaaacag

SEQ ID NO: 87783 - DNA, 21 bp, Artificial Sequence
  Synthetic
aagcautaaagccugcaggga

SEQ ID NO: 87784 - DNA, 17 bp, Artificial Sequence
  Synthetic
ccucgccgccacactut

SEQ ID NO: 87785 - DNA, 18 bp, Artificial Sequence
  Synthetic
aggcacucaggugagcag

SEQ ID NO: 87786 - DNA, 26 bp, Artificial Sequence
  Synthetic
agcttctgattucatctccctttucc

SEQ ID NO: 87787 - DNA, 23 bp, Artificial Sequence
  Synthetic
tgacccctugggaacatcauact

SEQ ID NO: 87788 - DNA, 20 bp, Artificial Sequence
  Synthetic
tcacutcgtguggagcacat

SEQ ID NO: 87789 - DNA, 28 bp, Artificial Sequence
  Synthetic
caagtcagacaguacaggtacatuaact

SEQ ID NO: 87790 - DNA, 17 bp, Artificial Sequence
  Synthetic
gccaguggcccgtctuc

SEQ ID NO: 87791 - DNA, 19 bp, Artificial Sequence
  Synthetic
cccuggccagcatcttgua

SEQ ID NO: 87792 - DNA, 28 bp, Artificial Sequence
  Synthetic
atttgtctgttccutaccttgacaauat

SEQ ID NO: 87793 - DNA, 23 bp, Artificial Sequence
  Synthetic
aggaaatuagcagagcgatuggt

SEQ ID NO: 87794 - DNA, 20 bp, Artificial Sequence
  Synthetic
gacctcgguttgcattugcc

SEQ ID NO: 87795 - DNA, 28 bp, Artificial Sequence
  Synthetic
gcgattctggcagaucaagtaatgauaa

SEQ ID NO: 87796 - DNA, 26 bp, Artificial Sequence
  Synthetic
gctttgaccuaaatctgttgcttugt

SEQ ID NO: 87797 - DNA, 24 bp, Artificial Sequence
  Synthetic
ccctatcuggccaagcaatactua

SEQ ID NO: 87798 - DNA, 27 bp, Artificial Sequence
  Synthetic
tcaattcaaacuatggaggaucaagcc

SEQ ID NO: 87799 - DNA, 25 bp, Artificial Sequence
  Synthetic
tcagtcttugccttccttucagaaa

SEQ ID NO: 87800 - DNA, 23 bp, Artificial Sequence
  Synthetic
tccaagtgugactcttgatgcug

SEQ ID NO: 87801 - DNA, 25 bp, Artificial Sequence
  Synthetic
cttgctaucgaaatgcacaucagaa

SEQ ID NO: 87802 - DNA, 23 bp, Artificial Sequence
  Synthetic
tgatgactgcucaaaacctgguc

SEQ ID NO: 87803 - DNA, 23 bp, Artificial Sequence
  Synthetic
ttctgagtgccauctccctttut

SEQ ID NO: 87804 - DNA, 24 bp, Artificial Sequence
  Synthetic
ctggagaacauggcttctgtttut

SEQ ID NO: 87805 - DNA, 28 bp, Artificial Sequence
  Synthetic
ccttctcagtccutcttacattgtctut

SEQ ID NO: 87806 - DNA, 26 bp, Artificial Sequence
  Synthetic
tgatgctcuctctccaaaatucaacc

SEQ ID NO: 87807 - DNA, 27 bp, Artificial Sequence
  Synthetic
tctgccataacuggattttctttgugt

SEQ ID NO: 87808 - DNA, 27 bp, Artificial Sequence
  Synthetic
acutataatgcaagtuggacaagggat

SEQ ID NO: 87809 - DNA, 25 bp, Artificial Sequence
  Synthetic
gaaactcacugccacaacucaaaag

SEQ ID NO: 87810 - DNA, 21 bp, Artificial Sequence
  Synthetic
ctgggccacggutaaatgtut

SEQ ID NO: 87811 - DNA, 28 bp, Artificial Sequence
  Synthetic
gacaatgtttaucagcactttcuccaat

SEQ ID NO: 87812 - DNA, 26 bp, Artificial Sequence
  Synthetic
ctagcttctcauttgctcctcucaaa

SEQ ID NO: 87813 - DNA, 28 bp, Artificial Sequence
  Synthetic
ccagttatgaaaugctgcaagataaugt

SEQ ID NO: 87814 - DNA, 28 bp, Artificial Sequence
  Synthetic
tttgtccagagaccuttctaacgtatuc

SEQ ID NO: 87815 - DNA, 25 bp, Artificial Sequence
  Synthetic
gcctctttuccacagaaacaacauc

SEQ ID NO: 87816 - DNA, 19 bp, Artificial Sequence
  Synthetic
ctcaggtcacucgggctua

SEQ ID NO: 87817 - DNA, 24 bp, Artificial Sequence
  Synthetic
gctcttagugtgcactttcugcat

SEQ ID NO: 87818 - DNA, 28 bp, Artificial Sequence
  Synthetic
ggaggaacaagaagaugaggaagaaauc

SEQ ID NO: 87819 - DNA, 22 bp, Artificial Sequence
  Synthetic
agttgtgcugatgtguggagac

SEQ ID NO: 87820 - DNA, 28 bp, Artificial Sequence
  Synthetic
tgcgattttctcucatacaaagatcuga

SEQ ID NO: 87821 - DNA, 22 bp, Artificial Sequence
  Synthetic
tggttcttugagcaacauggga

SEQ ID NO: 87822 - DNA, 25 bp, Artificial Sequence
  Synthetic
aacuctctattucccaaacaacgct

SEQ ID NO: 87823 - DNA, 26 bp, Artificial Sequence
  Synthetic
gaaccacaugcagacaaagatttcug

SEQ ID NO: 87824 - DNA, 21 bp, Artificial Sequence
  Synthetic
ccccctgcuaatgactccugt

SEQ ID NO: 87825 - DNA, 23 bp, Artificial Sequence
  Synthetic
cgccttcacagauccaaaccuaa

SEQ ID NO: 87826 - DNA, 21 bp, Artificial Sequence
  Synthetic
ttucgggacctcugaaccaac

SEQ ID NO: 87827 - DNA, 19 bp, Artificial Sequence
  Synthetic
gcgggacgaucgaguacat

SEQ ID NO: 87828 - DNA, 21 bp, Artificial Sequence
  Synthetic
cttgtctgccucagggaucag

SEQ ID NO: 87829 - DNA, 20 bp, Artificial Sequence
  Synthetic
cgugtacctguaggagccat

SEQ ID NO: 87830 - DNA, 17 bp, Artificial Sequence
  Synthetic
gggccucaaggcacuca

SEQ ID NO: 87831 - DNA, 18 bp, Artificial Sequence
  Synthetic
gtcaacggcuggacuggt

SEQ ID NO: 87832 - DNA, 18 bp, Artificial Sequence
  Synthetic
cauttccuccccggccaa

SEQ ID NO: 87833 - DNA, 21 bp, Artificial Sequence
  Synthetic
cttcgaaaucgcctgcuacaa

SEQ ID NO: 87834 - DNA, 20 bp, Artificial Sequence
  Synthetic
tcgccaucctgtccaaugag

SEQ ID NO: 87835 - DNA, 19 bp, Artificial Sequence
  Synthetic
ccucaccacacacguccag

SEQ ID NO: 87836 - DNA, 21 bp, Artificial Sequence
  Synthetic
gtttaccuggaccgaaagcug

SEQ ID NO: 87837 - DNA, 25 bp, Artificial Sequence
  Synthetic
catgtctagaaccugagctcatgug

SEQ ID NO: 87838 - DNA, 21 bp, Artificial Sequence
  Synthetic
tcacagagagcuttgccctut

SEQ ID NO: 87839 - DNA, 24 bp, Artificial Sequence
  Synthetic
gcatgaccuggaatcagaugaact

SEQ ID NO: 87840 - DNA, 19 bp, Artificial Sequence
  Synthetic
tgttctcgcugcagtccuc

SEQ ID NO: 87841 - DNA, 18 bp, Artificial Sequence
  Synthetic
ggccgacagcucctgtuc

SEQ ID NO: 87842 - DNA, 31 bp, Artificial Sequence; identical to SEQ ID NO: 64188
  Synthetic

SEQ ID NO: 87843 - DNA, 30 bp, Artificial Sequence; identical to SEQ ID NO: 64189
  Synthetic

SEQ ID NO: 87844 - DNA, 22 bp, Artificial Sequence
  Synthetic
aacugtatctucgggcaccaaa

SEQ ID NO: 87845 - DNA, 27 bp, Artificial Sequence
  Synthetic
atgccattutctctttaatuggaaagg

SEQ ID NO: 87846 - DNA, 18 bp, Artificial Sequence
  Synthetic
ccagccggacaaggugua

SEQ ID NO: 87847 - DNA, 20 bp, Artificial Sequence
  Synthetic
ggtagcaggacuggauggga

SEQ ID NO: 87848 - DNA, 27 bp, Artificial Sequence
  Synthetic
ggtattgaugaaagaggagguacaaca

SEQ ID NO: 87849 - DNA, 28 bp, Artificial Sequence
  Synthetic
cgtagtctgccaaautacagctttaauc

SEQ ID NO: 87850 - DNA, 20 bp, Artificial Sequence
  Synthetic
cccacuggtccucaagaggt

SEQ ID NO: 87851 - DNA, 22 bp, Artificial Sequence
  Synthetic
gctggtgcautttcggttgtug

SEQ ID NO: 87852 - DNA, 21 bp, Artificial Sequence
  Synthetic
cgagttgtcugcttcccuacc

SEQ ID NO: 87853 - DNA, 26 bp, Artificial Sequence
  Synthetic
tttacggtucactgtgttcttuacca

SEQ ID NO: 87854 - DNA, 25 bp, Artificial Sequence
  Synthetic
gtggttctaggguagaggtaaccut

SEQ ID NO: 87855 - DNA, 27 bp, Artificial Sequence
  Synthetic
aagaaaatacucaccccgaatgatuca

SEQ ID NO: 87856 - DNA, 21 bp, Artificial Sequence
  Synthetic
accccttuaaggtggctccua

SEQ ID NO: 87857 - DNA, 27 bp, Artificial Sequence
  Synthetic
ccattgctttugaagaaacagttgugt

SEQ ID NO: 87858 - DNA, 25 bp, Artificial Sequence
  Synthetic
gcagtaagccacutgtttttctugg

SEQ ID NO: 87859 - DNA, 28 bp, Artificial Sequence
  Synthetic
accgagaagggutaaactatatgguact

SEQ ID NO: 87860 - DNA, 33 bp, Artificial Sequence; identical to SEQ ID NO: 66630
  Synthetic

SEQ ID NO: 87861 - DNA, 28 bp, Artificial Sequence
  Synthetic
caactgctgcaauaaagatacagatucc

SEQ ID NO: 87862 - DNA, 28 bp, Artificial Sequence
  Synthetic
gctctgataauccaaaaaggactagugt

SEQ ID NO: 87863 - DNA, 28 bp, Artificial Sequence
  Synthetic
ggctatttgctaucctggaaagttcaut

SEQ ID NO: 87864 - DNA, 28 bp, Artificial Sequence
  Synthetic
catgcatatcagcuatttcctcatcuct

SEQ ID NO: 87865 - DNA, 25 bp, Artificial Sequence
  Synthetic
agaaggacatugcatcttgcaaaug

SEQ ID NO: 87866 - DNA, 22 bp, Artificial Sequence
  Synthetic
cgttuaaaccaaaggcgcacua

SEQ ID NO: 87867 - DNA, 25 bp, Artificial Sequence
  Synthetic
tcaagtatgctugctgaaggagtuc

SEQ ID NO: 87868 - DNA, 23 bp, Artificial Sequence
  Synthetic
tgtcagagucctgagacagauca

SEQ ID NO: 87869 - DNA, 22 bp, Artificial Sequence
  Synthetic
cgttttagcucgttcctccuct

SEQ ID NO: 87870 - DNA, 28 bp, Artificial Sequence
  Synthetic
cagaacacaaagaucatccttucagaga

SEQ ID NO: 87871 - DNA, 26 bp, Artificial Sequence
  Synthetic
catacuggatacagcuggacaagaag

SEQ ID NO: 87872 - DNA, 26 bp, Artificial Sequence
  Synthetic
ggttttccaauagttcggattuccca

SEQ ID NO: 87873 - DNA, 21 bp, Artificial Sequence
  Synthetic
cgccgctutcagtttccuagt

SEQ ID NO: 87874 - DNA, 20 bp, Artificial Sequence
  Synthetic
cgaacacacaacguctugga

SEQ ID NO: 87875 - DNA, 21 bp, Artificial Sequence
  Synthetic
cttttgcucctctgctuggac

SEQ ID NO: 87876 - DNA, 21 bp, Artificial Sequence
  Synthetic
ccttggccacautctguagca

SEQ ID NO: 87877 - DNA, 22 bp, Artificial Sequence
  Synthetic
tttcacaggugaagauggcgat

SEQ ID NO: 87878 - DNA, 17 bp, Artificial Sequence
  Synthetic
ggccuggaaggcugaca

SEQ ID NO: 87879 - DNA, 19 bp, Artificial Sequence
  Synthetic
aaauggccacauccccaca

SEQ ID NO: 87880 - DNA, 28 bp, Artificial Sequence
  Synthetic
ggttaaccaaacugaattatttgugcca

SEQ ID NO: 87881 - DNA, 28 bp, Artificial Sequence
  Synthetic
cctgtactuaccacaacaaccttatcut

SEQ ID NO: 87882 - DNA, 23 bp, Artificial Sequence
  Synthetic
gtcacttugttctgttugcaggt

SEQ ID NO: 87883 - DNA, 22 bp, Artificial Sequence
  Synthetic
tccaaccuccaatgacccatuc

SEQ ID NO: 87884 - DNA, 33 bp, Artificial Sequence
  Synthetic
tcttctattatcucaacagagcaaattatugaa

SEQ ID NO: 87885 - DNA, 25 bp, Artificial Sequence
  Synthetic
gtgcctttgcgutaattaccttuct

SEQ ID NO: 87886 - DNA, 21 bp, Artificial Sequence
  Synthetic
ccaagguacaguggaccaaca

SEQ ID NO: 87887 - DNA, 28 bp, Artificial Sequence
  Synthetic
ggacataagtttutcagtttgggaauct

SEQ ID NO: 87888 - DNA, 21 bp, Artificial Sequence
  Synthetic
cggacacugtcctccuagcat

SEQ ID NO: 87889 - DNA, 21 bp, Artificial Sequence
  Synthetic
aggcctucccagaaactugag

SEQ ID NO: 87890 - DNA, 22 bp, Artificial Sequence
  Synthetic
tggtctctcauggcactguact

SEQ ID NO: 87891 - DNA, 22 bp, Artificial Sequence
  Synthetic
gcattgcatuccctgtggttut

SEQ ID NO: 87892 - DNA, 26 bp, Artificial Sequence
  Synthetic
gtggcagcuattagagaaatcaugga

SEQ ID NO: 87893 - DNA, 28 bp, Artificial Sequence
  Synthetic
gcaaccctagaauagctaagcctacuaa

SEQ ID NO: 87894 - DNA, 21 bp, Artificial Sequence
  Synthetic
gtatgttggaguagggcuggt

SEQ ID NO: 87895 - DNA, 27 bp, Artificial Sequence
  Synthetic
gataaagcgttuctgtctctagctuca

SEQ ID NO: 87896 - DNA, 23 bp, Artificial Sequence
  Synthetic
tccacagugtctgaagcuagaga

SEQ ID NO: 87897 - DNA, 33 bp, Artificial Sequence
  Synthetic
agctttgatattattcutgttaaaaatctgcut

SEQ ID NO: 87898 - DNA, 24 bp, Artificial Sequence
  Synthetic
tgcagaacttutccagaatccuga

SEQ ID NO: 87899 - DNA, 21 bp, Artificial Sequence
  Synthetic
cattcccagaguggagtugga

SEQ ID NO: 87900 - DNA, 25 bp, Artificial Sequence
  Synthetic
aacatgtttuatccgagtugaagga

SEQ ID NO: 87901 - DNA, 28 bp, Artificial Sequence
  Synthetic
agcaatgtactgaauttgtagtctggut

SEQ ID NO: 87902 - DNA, 27 bp, Artificial Sequence
  Synthetic
ttgtagcctttaugtttcccatcacut

SEQ ID NO: 87903 - DNA, 27 bp, Artificial Sequence
  Synthetic
cggattccatcutcaaaatctgtcuga

SEQ ID NO: 87904 - DNA, 28 bp, Artificial Sequence
  Synthetic
acgaatacagccaaaugtaaaatccuca

SEQ ID NO: 87905 - DNA, 25 bp, Artificial Sequence
  Synthetic
ctaggacttccuacgttttgggtut

SEQ ID NO: 87906 - DNA, 26 bp, Artificial Sequence
  Synthetic
gaaataatggugcaagtctucaagca

SEQ ID NO: 87907 - DNA, 20 bp, Artificial Sequence
  Synthetic
ctccaccucagcatuaccgt

SEQ ID NO: 87908 - DNA, 25 bp, Artificial Sequence
  Synthetic
gtgtccagtatuctctccacagaug

SEQ ID NO: 87909 - DNA, 23 bp, Artificial Sequence
  Synthetic
cctggaaucaagctaggctuact

SEQ ID NO: 87910 - DNA, 18 bp, Artificial Sequence
  Synthetic
gaccugaagugcccccat

SEQ ID NO: 87911 - DNA, 23 bp, Artificial Sequence
  Synthetic
cagtctcctuactttgcctcgua

SEQ ID NO: 87912 - DNA, 23 bp, Artificial Sequence
  Synthetic
ccaatgaaguctacacgtugcac

SEQ ID NO: 87913 - DNA, 20 bp, Artificial Sequence
  Synthetic
gaaggaggtuccgctggtut

SEQ ID NO: 87914 - DNA, 28 bp, Artificial Sequence
  Synthetic
ttttgtggaugaagaaaaacaacctgut

SEQ ID NO: 87915 - DNA, 25 bp, Artificial Sequence
  Synthetic
gtcccttgaaugaaaggaagtcuca

SEQ ID NO: 87916 - DNA, 17 bp, Artificial Sequence
  Synthetic
cgucaugccgcccaaaa

SEQ ID NO: 87917 - DNA, 17 bp, Artificial Sequence
  Synthetic
cggctcugctcgcucac

SEQ ID NO: 87918 - DNA, 23 bp, Artificial Sequence
  Synthetic
ggctgtagcugaaaagaguacct

SEQ ID NO: 87919 - DNA, 23 bp, Artificial Sequence
  Synthetic
agtggaaaugcctctuccaaaga

SEQ ID NO: 87920 - DNA, 25 bp, Artificial Sequence
  Synthetic
aggaagtcacauatctggtcctuct

SEQ ID NO: 87921 - DNA, 21 bp, Artificial Sequence
  Synthetic
cctgcatcugacatgcttucc

SEQ ID NO: 87922 - DNA, 25 bp, Artificial Sequence
  Synthetic
aagcttgctgugagtaagacauaca

SEQ ID NO: 87923 - DNA, 24 bp, Artificial Sequence
  Synthetic
gguagcctauacagccaggaaaag

SEQ ID NO: 87924 - DNA, 21 bp, Artificial Sequence
  Synthetic
accaucagagagcctugagga

SEQ ID NO: 87925 - DNA, 24 bp, Artificial Sequence
  Synthetic
tggtataaacaguggcacacacut

SEQ ID NO: 87926 - DNA, 25 bp, Artificial Sequence
  Synthetic
cctacaggugtgacactttucaact

SEQ ID NO: 87927 - DNA, 22 bp, Artificial Sequence
  Synthetic
cagutcttcttugccaaagcgt

SEQ ID NO: 87928 - DNA, 28 bp, Artificial Sequence
  Synthetic
ttagctgttguttttcactgttuccaaa

SEQ ID NO: 87929 - DNA, 24 bp, Artificial Sequence
  Synthetic
accttgtcuatggcacaucaaact

SEQ ID NO: 87930 - DNA, 24 bp, Artificial Sequence
  Synthetic
gctatcctctucctcttcacgugt

SEQ ID NO: 87931 - DNA, 28 bp, Artificial Sequence
  Synthetic
ctgtgttcucctttagttaagugaccat

SEQ ID NO: 87932 - DNA, 24 bp, Artificial Sequence
  Synthetic
catcagttccucctcagaatuccc

SEQ ID NO: 87933 - DNA, 22 bp, Artificial Sequence
  Synthetic
acaccaucagcagctagaucct

SEQ ID NO: 87934 - DNA, 24 bp, Artificial Sequence
  Synthetic
caagaacgagaaacugaagtgugt

SEQ ID NO: 87935 - DNA, 23 bp, Artificial Sequence
  Synthetic
cccacttcccugctgggattaua

SEQ ID NO: 87936 - DNA, 22 bp, Artificial Sequence
  Synthetic
ccatuggagaggaaggtguagt

SEQ ID NO: 87937 - DNA, 23 bp, Artificial Sequence
  Synthetic
ccttgaccagauctcggtcucat

SEQ ID NO: 87938 - DNA, 22 bp, Artificial Sequence
  Synthetic
caaagaguacagctggccugaa

SEQ ID NO: 87939 - DNA, 24 bp, Artificial Sequence
  Synthetic
aactgttacacuggaagtcacugg

SEQ ID NO: 87940 - DNA, 18 bp, Artificial Sequence
  Synthetic
ccgtcuccctcuccacca

SEQ ID NO: 87941 - DNA, 23 bp, Artificial Sequence
  Synthetic
ctuccagagcagttucagaaacc

SEQ ID NO: 87942 - DNA, 27 bp, Artificial Sequence
  Synthetic
gcttgagttucaatttctctuaaagca

SEQ ID NO: 87943 - DNA, 23 bp, Artificial Sequence
  Synthetic
gcctctctuttctccccauacag

SEQ ID NO: 87944 - DNA, 22 bp, Artificial Sequence
  Synthetic
gggcaauggccatatcauccaa

SEQ ID NO: 87945 - DNA, 22 bp, Artificial Sequence
  Synthetic
cagagagccuttgcacucagaa

SEQ ID NO: 87946 - DNA, 29 bp, Artificial Sequence
  Synthetic
tggcacuagatttcatttucaacaaagag

SEQ ID NO: 87947 - DNA, 23 bp, Artificial Sequence
  Synthetic
actctgggauggttgtgtttgug

SEQ ID NO: 87948 - DNA, 21 bp, Artificial Sequence
  Synthetic
gcctgtcugagcattgugcat

SEQ ID NO: 87949 - DNA, 28 bp, Artificial Sequence
  Synthetic
gatgagctccauttgtagttatagcugt

SEQ ID NO: 87950 - DNA, 28 bp, Artificial Sequence
  Synthetic
aaaataccaaaaagutcatgggatugct

SEQ ID NO: 87951 - DNA, 18 bp, Artificial Sequence
  Synthetic
gccccaccucaggagtug

SEQ ID NO: 87952 - DNA, 28 bp, Artificial Sequence
  Synthetic
agtacttttaataccugaactggtgguc

SEQ ID NO: 87953 - DNA, 23 bp, Artificial Sequence
  Synthetic
acagccaucatcagcatcugaaa

SEQ ID NO: 87954 - DNA, 24 bp, Artificial Sequence
  Synthetic
cctaatcccutcctagtgguggat

SEQ ID NO: 87955 - DNA, 22 bp, Artificial Sequence
  Synthetic
ccccuacaacagcagacugaga

SEQ ID NO: 87956 - DNA, 21 bp, Artificial Sequence
  Synthetic
gcatgaauggtcagtctuggg

SEQ ID NO: 87957 - DNA, 24 bp, Artificial Sequence
  Synthetic
caggtgcugcagaatcttctttut

SEQ ID NO: 87958 - DNA, 28 bp, Artificial Sequence
  Synthetic
ctcaaataacggaguagaaattgcagut

SEQ ID NO: 87959 - DNA, 26 bp, Artificial Sequence
  Synthetic
ctgatgttccgutttctcttgcuaag

SEQ ID NO: 87960 - DNA, 25 bp, Artificial Sequence
  Synthetic
ctgttgttctcuagaaacctccuga

SEQ ID NO: 87961 - DNA, 24 bp, Artificial Sequence
  Synthetic
attcgtacggugaacattcctgut

SEQ ID NO: 87962 - DNA, 21 bp, Artificial Sequence
  Synthetic
ctgccagacuccttccttcuc

SEQ ID NO: 87963 - DNA, 21 bp, Artificial Sequence
  Synthetic
gaacaaccuctggcugagaca

SEQ ID NO: 87964 - DNA, 28 bp, Artificial Sequence
  Synthetic
tgattactatuaacacctccagccucat

SEQ ID NO: 87965 - DNA, 29 bp, Artificial Sequence
  Synthetic
gaaagtaguggccaagatatgttuagaga

SEQ ID NO: 87966 - DNA, 28 bp, Artificial Sequence
  Synthetic
ctgacttagtgcauctatttcgatguct

SEQ ID NO: 87967 - DNA, 23 bp, Artificial Sequence
  Synthetic
gatggauattgttgcugccaagg

SEQ ID NO: 87968 - DNA, 25 bp, Artificial Sequence
  Synthetic
tcttgcagttugataagagctgcut

SEQ ID NO: 87969 - DNA, 28 bp, Artificial Sequence
  Synthetic
ggcttatgctauggaaagagaaaaggua

SEQ ID NO: 87970 - DNA, 29 bp, Artificial Sequence
  Synthetic
catttttcctgtaucttgcatgtttcuca

SEQ ID NO: 87971 - DNA, 28 bp, Artificial Sequence
  Synthetic
agcagggaacaaucactaatacaacaut

SEQ ID NO: 87972 - DNA, 22 bp, Artificial Sequence
  Synthetic
agctcaucacactggttgtuga

SEQ ID NO: 87973 - DNA, 21 bp, Artificial Sequence
  Synthetic
gccaguattgugccgacaaag

SEQ ID NO: 87974 - DNA, 28 bp, Artificial Sequence
  Synthetic
ccttttgcaacauaagcctcauaaacag

SEQ ID NO: 87975 - DNA, 27 bp, Artificial Sequence
  Synthetic
tgatccttctctutgctgatcattgut

SEQ ID NO: 87976 - DNA, 26 bp, Artificial Sequence
  Synthetic
ggactgttgccuaagggatttauagt

SEQ ID NO: 87977 - DNA, 22 bp, Artificial Sequence
  Synthetic
tgauccaucaggcaaaagccat

SEQ ID NO: 87978 - DNA, 20 bp, Artificial Sequence
  Synthetic
ccuaucccacagcacagcat

SEQ ID NO: 87979 - DNA, 21 bp, Artificial Sequence
  Synthetic
gtggugacaagggugagacag

SEQ ID NO: 87980 - DNA, 21 bp, Artificial Sequence
  Synthetic
gcatggcagutcaaaggtugg

SEQ ID NO: 87981 - DNA, 25 bp, Artificial Sequence
  Synthetic
tgacauacacatcataugcgcagaa

SEQ ID NO: 87982 - DNA, 22 bp, Artificial Sequence
  Synthetic
ggtgaccctutatgcctctguc

SEQ ID NO: 87983 - DNA, 21 bp, Artificial Sequence
  Synthetic
gtgtcccccaugccttuagaa

SEQ ID NO: 87984 - DNA, 17 bp, Artificial Sequence
  Synthetic
ggctgucggcgcaguag

SEQ ID NO: 87985 - DNA, 19 bp, Artificial Sequence
  Synthetic
cacaggagcuggtgtucca

SEQ ID NO: 87986 - DNA, 19 bp, Artificial Sequence
  Synthetic
agccauggaacaccagcuc

SEQ ID NO: 87987 - DNA, 19 bp, Artificial Sequence
  Synthetic
ggaccuccttcugcacaca

SEQ ID NO: 87988 - DNA, 27 bp, Artificial Sequence
  Synthetic
gctttaggagagutgaaagatgccaut

SEQ ID NO: 87989 - DNA, 22 bp, Artificial Sequence
  Synthetic
ctugagggaacacatacucgct

SEQ ID NO: 87990 - DNA, 21 bp, Artificial Sequence
  Synthetic
ccctcggugtcctactucaaa

SEQ ID NO: 87991 - DNA, 25 bp, Artificial Sequence
  Synthetic
caagtugcagggaagtctuaagaga

SEQ ID NO: 87992 - DNA, 21 bp, Artificial Sequence
  Synthetic
ccaccacgacutgaccttcug

SEQ ID NO: 87993 - DNA, 22 bp, Artificial Sequence
  Synthetic
agcagggugaaagcaaaucagt

SEQ ID NO: 87994 - DNA, 24 bp, Artificial Sequence
  Synthetic
cgattatgugagcagttugaacca

SEQ ID NO: 87995 - DNA, 26 bp, Artificial Sequence
  Synthetic
ctttacctgtutccatctcagugagg

SEQ ID NO: 87996 - DNA, 31 bp, Artificial Sequence
  Synthetic
aaatacttaagaagaucgataactgccucac

SEQ ID NO: 87997 - DNA, 26 bp, Artificial Sequence
  Synthetic
tcgtggtaccaacautctctactgua

SEQ ID NO: 87998 - DNA, 25 bp, Artificial Sequence
  Synthetic
agctctacutcctgattugggagaa

SEQ ID NO: 87999 - DNA, 23 bp, Artificial Sequence
  Synthetic
cattaaugacaacccuccggagt

SEQ ID NO: 88000 - DNA, 21 bp, Artificial Sequence
  Synthetic
catgauaggtctcgugcagga

SEQ ID NO: 88001 - DNA, 22 bp, Artificial Sequence
  Synthetic
acattcaugccaccaagacgut

SEQ ID NO: 88002 - DNA, 23 bp, Artificial Sequence
  Synthetic
actctaggaaugaaggtgugggt

SEQ ID NO: 88003 - DNA, 23 bp, Artificial Sequence
  Synthetic
cttgtccucagacatucggaaca

SEQ ID NO: 88004 - DNA, 22 bp, Artificial Sequence
  Synthetic
gcgtuagagccaaggtttgcua

SEQ ID NO: 88005 - DNA, 17 bp, Artificial Sequence
  Synthetic
cgagtgcugtcccguct

SEQ ID NO: 88006 - DNA, 19 bp, Artificial Sequence
  Synthetic
gggcagutcttggtcucgt

SEQ ID NO: 88007 - DNA, 21 bp, Artificial Sequence
  Synthetic
ctacugacaacgcccctctuc

SEQ ID NO: 88008 - DNA, 26 bp, Artificial Sequence
  Synthetic
gaaagaaagccautgctuaacagact

SEQ ID NO: 88009 - DNA, 26 bp, Artificial Sequence
  Synthetic
gatcaagactugaccacttactugga

SEQ ID NO: 88010 - DNA, 22 bp, Artificial Sequence
  Synthetic
cactccaggcuctggaacttua

SEQ ID NO: 88011 - DNA, 26 bp, Artificial Sequence
  Synthetic
tgccacctacutaacctctttgttut

SEQ ID NO: 88012 - DNA, 21 bp, Artificial Sequence
  Synthetic
tgggctcuctcttctcgaucc

SEQ ID NO: 88013 - DNA, 28 bp, Artificial Sequence
  Synthetic
tgactctggtgaugggaacattaaauac

SEQ ID NO: 88014 - DNA, 21 bp, Artificial Sequence
  Synthetic
agctccutccccugagagaat

SEQ ID NO: 88015 - DNA, 23 bp, Artificial Sequence
  Synthetic
gtaagtgagttuccccactgcut

SEQ ID NO: 88016 - DNA, 21 bp, Artificial Sequence
  Synthetic
cgacataugcagctgctgtut

SEQ ID NO: 88017 - DNA, 28 bp, Artificial Sequence
  Synthetic
accagataaauaactgctcacattuccc

SEQ ID NO: 88018 - DNA, 26 bp, Artificial Sequence
  Synthetic
tgattaaccuttgttcttuccagcca

SEQ ID NO: 88019 - DNA, 22 bp, Artificial Sequence
  Synthetic
ggttgtuccaatggtgguccaa

SEQ ID NO: 88020 - DNA, 21 bp, Artificial Sequence
  Synthetic
cgaagccgaautcctggtcug

SEQ ID NO: 88021 - DNA, 20 bp, Artificial Sequence
  Synthetic
tccatcacucccacgtggua

SEQ ID NO: 88022 - DNA, 26 bp, Artificial Sequence
  Synthetic
gatatgcatgucagaggaaagucact

SEQ ID NO: 88023 - DNA, 25 bp, Artificial Sequence
  Synthetic
ttcttttaggccuctttttcgugga

SEQ ID NO: 88024 - DNA, 25 bp, Artificial Sequence
  Synthetic
ttgatcaacauctgaactuccacga

SEQ ID NO: 88025 - DNA, 28 bp, Artificial Sequence
  Synthetic
tttgcttcctgugaaacaatgataaugg

SEQ ID NO: 88026 - DNA, 22 bp, Artificial Sequence
  Synthetic
gttcagttugggttgcttguct

SEQ ID NO: 88027 - DNA, 19 bp, Artificial Sequence
  Synthetic
cctgcccaucatcgatgug

SEQ ID NO: 88028 - DNA, 21 bp, Artificial Sequence
  Synthetic
ccacctcccaauctcccagua

SEQ ID NO: 88029 - DNA, 21 bp, Artificial Sequence
  Synthetic
ctggagagcuctgacgttuga

SEQ ID NO: 88030 - DNA, 20 bp, Artificial Sequence
  Synthetic
cagcacucacaucgaagggt

SEQ ID NO: 88031 - DNA, 22 bp, Artificial Sequence
  Synthetic
ctcaccaacaccaccugatuct

SEQ ID NO: 88032 - DNA, 23 bp, Artificial Sequence
  Synthetic
cctaacttgguctcctgcttcut

SEQ ID NO: 88033 - DNA, 22 bp, Artificial Sequence
  Synthetic
gctgccagaguaaaatgctgut

SEQ ID NO: 88034 - DNA, 18 bp, Artificial Sequence
  Synthetic
ccccggaggucctgucat

SEQ ID NO: 88035 - DNA, 19 bp, Artificial Sequence
  Synthetic
agaatgguggctgcaggug

SEQ ID NO: 88036 - DNA, 21 bp, Artificial Sequence
  Synthetic
caagcctgguctacactgugg

SEQ ID NO: 88037 - DNA, 21 bp, Artificial Sequence
  Synthetic
actcactcugctctgggtuga

SEQ ID NO: 88038 - DNA, 21 bp, Artificial Sequence
  Synthetic
gcatcatugggtcctcaguca

SEQ ID NO: 88039 - DNA, 25 bp, Artificial Sequence
  Synthetic
ctgttcctaugttctctcctuccag

SEQ ID NO: 88040 - DNA, 23 bp, Artificial Sequence
  Synthetic
gggtcagauggtatcttctugct

SEQ ID NO: 88041 - DNA, 21 bp, Artificial Sequence
  Synthetic
ttcccttcaaucccagcctuc

SEQ ID NO: 88042 - DNA, 20 bp, Artificial Sequence
  Synthetic
cctgcacuccatggctcaua

SEQ ID NO: 88043 - DNA, 23 bp, Artificial Sequence
  Synthetic
gaaaaaugccagugacaagcgaa

SEQ ID NO: 88044 - DNA, 22 bp, Artificial Sequence
  Synthetic
cagatgcacuggaaacuaggca

SEQ ID NO: 88045 - DNA, 23 bp, Artificial Sequence
  Synthetic
gagcatguagaccaggaccuaag

SEQ ID NO: 88046 - DNA, 23 bp, Artificial Sequence
  Synthetic
ccgtgcucacttactttgtuggt

SEQ ID NO: 88047 - DNA, 27 bp, Artificial Sequence
  Synthetic
acatctcgttguttttctggtcauagt

SEQ ID NO: 88048 - DNA, 22 bp, Artificial Sequence
  Synthetic
gggtgcctugtccagatatguc

SEQ ID NO: 88049 - DNA, 28 bp, Artificial Sequence
  Synthetic
ggattgaaaagugagcatttactcuggt

SEQ ID NO: 88050 - DNA, 27 bp, Artificial Sequence
  Synthetic
gtaaggacaggacaaautttcctccua

SEQ ID NO: 88051 - DNA, 26 bp, Artificial Sequence
  Synthetic
aaaacgccgucctttgaataacaaut

SEQ ID NO: 88052 - DNA, 25 bp, Artificial Sequence
  Synthetic
ctgcttagugacagtgcaattucag

SEQ ID NO: 88053 - DNA, 28 bp, Artificial Sequence
  Synthetic
tgggtcctaaaaacucttacattgcaua

SEQ ID NO: 88054 - DNA, 18 bp, Artificial Sequence
  Synthetic
ctgtgcuccccaccgtut

SEQ ID NO: 88055 - DNA, 17 bp, Artificial Sequence
  Synthetic
gctgcuccgtgggagug

SEQ ID NO: 88056 - DNA, 25 bp, Artificial Sequence
  Synthetic
tccattgccacugtgatcttctaug

SEQ ID NO: 88057 - DNA, 27 bp, Artificial Sequence
  Synthetic
gagagctggtaauttggtcattgttut

SEQ ID NO: 88058 - DNA, 17 bp, Artificial Sequence
  Synthetic
ccccaggucccuccaca

SEQ ID NO: 88059 - DNA, 22 bp, Artificial Sequence
  Synthetic
ttuacccgggaggagauaacct

SEQ ID NO: 88060 - DNA, 21 bp, Artificial Sequence
  Synthetic
agggaggccutcaugcaaaat

SEQ ID NO: 88061 - DNA, 27 bp, Artificial Sequence
  Synthetic
gcatccaatttgguaaagaatcgtguc

SEQ ID NO: 88062 - DNA, 21 bp, Artificial Sequence
  Synthetic
gcagcggutggucaaaagaat

SEQ ID NO: 88063 - DNA, 28 bp, Artificial Sequence
  Synthetic
cacacctgatucatacaacttttctucc

SEQ ID NO: 88064 - DNA, 21 bp, Artificial Sequence
  Synthetic
ctcagtggcutcactggugat

SEQ ID NO: 88065 - DNA, 25 bp, Artificial Sequence
  Synthetic
acgaaggcaagcutaaaagaacuca

SEQ ID NO: 88066 - DNA, 22 bp, Artificial Sequence
  Synthetic
ctgauggactgacugaggagga

SEQ ID NO: 88067 - DNA, 20 bp, Artificial Sequence
  Synthetic
atgtccaucatggcctugct

SEQ ID NO: 88068 - DNA, 28 bp, Artificial Sequence
  Synthetic
ctcacctgcutatacttgtacaauagca

SEQ ID NO: 88069 - DNA, 21 bp, Artificial Sequence
  Synthetic
ctgctcacugctttgctucat

SEQ ID NO: 88070 - DNA, 19 bp, Artificial Sequence
  Synthetic
ccttcacgcccugcttcuc

SEQ ID NO: 88071 - DNA, 21 bp, Artificial Sequence
  Synthetic
cgtccttcaugagcccaauca

SEQ ID NO: 88072 - DNA, 21 bp, Artificial Sequence
  Synthetic
caacgugaagaagagctcugg

SEQ ID NO: 88073 - DNA, 23 bp, Artificial Sequence
  Synthetic
agcacttcuccaccatcttctug

SEQ ID NO: 88074 - DNA, 20 bp, Artificial Sequence
  Synthetic
ctcaugaaggacgcctucca

SEQ ID NO: 88075 - DNA, 17 bp, Artificial Sequence
  Synthetic
gcucagccggccttuca

SEQ ID NO: 88076 - DNA, 20 bp, Artificial Sequence
  Synthetic
gcacugcccccttaacucac

SEQ ID NO: 88077 - DNA, 24 bp, Artificial Sequence
  Synthetic
tcctgcttutccacatguaaccat

SEQ ID NO: 88078 - DNA, 21 bp, Artificial Sequence
  Synthetic
gggacugctgcaacucaaact

SEQ ID NO: 88079 - DNA, 19 bp, Artificial Sequence
  Synthetic
ctgccctutggccacauac

SEQ ID NO: 88080 - DNA, 18 bp, Artificial Sequence
  Synthetic
ggccaugctgaggguact

SEQ ID NO: 88081 - DNA, 22 bp, Artificial Sequence
  Synthetic
gcctgactcuttcttctcccut

SEQ ID NO: 88082 - DNA, 28 bp, Artificial Sequence
  Synthetic
gctgaatttgaaagaacutaggtccaut

SEQ ID NO: 88083 - DNA, 25 bp, Artificial Sequence
  Synthetic
gtgcacaaacuctcctactaugagt

SEQ ID NO: 88084 - DNA, 24 bp, Artificial Sequence
  Synthetic
aacttaccccacgutcaaagucat

SEQ ID NO: 88085 - DNA, 25 bp, Artificial Sequence
  Synthetic
acaggugaacuccagaaagaagaag

SEQ ID NO: 88086 - DNA, 22 bp, Artificial Sequence
  Synthetic
tcagtcttuggtggctgaaugg

SEQ ID NO: 88087 - DNA, 21 bp, Artificial Sequence
  Synthetic
ctgcugaacacatugcccaag

SEQ ID NO: 88088 - DNA, 19 bp, Artificial Sequence
  Synthetic
gugaggugccagagagcag

SEQ ID NO: 88089 - DNA, 20 bp, Artificial Sequence
  Synthetic
tggacgtccuggtgaagtug

SEQ ID NO: 88090 - DNA, 21 bp, Artificial Sequence
  Synthetic
tgaggccugtagagacguagg

SEQ ID NO: 88091 - DNA, 22 bp, Artificial Sequence
  Synthetic
actaggaccccugctauccaaa

SEQ ID NO: 88092 - DNA, 19 bp, Artificial Sequence
  Synthetic
ggaucctttcucgccagca

SEQ ID NO: 88093 - DNA, 21 bp, Artificial Sequence
  Synthetic
gagtcugacagcccctccuat

SEQ ID NO: 88094 - DNA, 20 bp, Artificial Sequence
  Synthetic
agggcuaagcagtgccttut

SEQ ID NO: 88095 - DNA, 22 bp, Artificial Sequence
  Synthetic
ggtcgatcutgagttcguccag

SEQ ID NO: 88096 - DNA, 19 bp, Artificial Sequence
  Synthetic
cctcgtcgugggttctgua

SEQ ID NO: 88097 - DNA, 23 bp, Artificial Sequence
  Synthetic
gcagtuacacgttttccuccaag

SEQ ID NO: 88098 - DNA, 19 bp, Artificial Sequence
  Synthetic
cgacuccgacagccagtut

SEQ ID NO: 88099 - DNA, 19 bp, Artificial Sequence
  Synthetic
ccatccggaaggugtccuc

SEQ ID NO: 88100 - DNA, 19 bp, Artificial Sequence
  Synthetic
caacgaccccgacauggut

SEQ ID NO: 88101 - DNA, 17 bp, Artificial Sequence
  Synthetic
tcacaagcucggccgut

SEQ ID NO: 88102 - DNA, 24 bp, Artificial Sequence
  Synthetic
ctgaacauagccctgtgtgtauga

SEQ ID NO: 88103 - DNA, 21 bp, Artificial Sequence
  Synthetic
ggacactcaugagggttggug

SEQ ID NO: 88104 - DNA, 23 bp, Artificial Sequence
  Synthetic
tgaagtgacucgtaacgacgtug

SEQ ID NO: 88105 - DNA, 24 bp, Artificial Sequence
  Synthetic
agcttagagaugagccatgcttug

SEQ ID NO: 88106 - DNA, 28 bp, Artificial Sequence
  Synthetic
atgaaagcaagaacaauatctctgugga

SEQ ID NO: 88107 - DNA, 24 bp, Artificial Sequence
  Synthetic
caagtucagcagcaaatcugacat

SEQ ID NO: 88108 - DNA, 27 bp, Artificial Sequence
  Synthetic
aaucttatccactuaccaaaagcccaa

SEQ ID NO: 88109 - DNA, 25 bp, Artificial Sequence
  Synthetic
tcctaatgcaacaagucctgaaucc

SEQ ID NO: 88110 - DNA, 20 bp, Artificial Sequence
  Synthetic
tcaacccgucaguacccaga

SEQ ID NO: 88111 - DNA, 22 bp, Artificial Sequence
  Synthetic
cgaagtagagcaucctggagut

SEQ ID NO: 88112 - DNA, 21 bp, Artificial Sequence
  Synthetic
acagacccutgggagagugat

SEQ ID NO: 88113 - DNA, 23 bp, Artificial Sequence
  Synthetic
ctgctcucagacagccaaaaaug

SEQ ID NO: 88114 - DNA, 21 bp, Artificial Sequence
  Synthetic
tggcgatccutcaccaatguc

SEQ ID NO: 88115 - DNA, 21 bp, Artificial Sequence
  Synthetic
aagcttcacugtcaccccauc

SEQ ID NO: 88116 - DNA, 23 bp, Artificial Sequence
  Synthetic
ctccaaaattuggcagcccauag

SEQ ID NO: 88117 - DNA, 26 bp, Artificial Sequence
  Synthetic
tgatctctctcutctttcctgcuaca

SEQ ID NO: 88118 - DNA, 23 bp, Artificial Sequence
  Synthetic
gagagagagagutcctccuggaa

SEQ ID NO: 88119 - DNA, 23 bp, Artificial Sequence
  Synthetic
actgccacautgtttcctucaca

SEQ ID NO: 88120 - DNA, 22 bp, Artificial Sequence
  Synthetic
caccgtttutgagctggugaat

SEQ ID NO: 88121 - DNA, 25 bp, Artificial Sequence
  Synthetic
ctgaatcctaacugctgaagtcugt

SEQ ID NO: 88122 - DNA, 20 bp, Artificial Sequence
  Synthetic
ggaccaugctgtggtgucaa

SEQ ID NO: 88123 - DNA, 19 bp, Artificial Sequence
  Synthetic
ccccugagggtgagacuga

SEQ ID NO: 88124 - DNA, 21 bp, Artificial Sequence
  Synthetic
gctgcaaaucccaagcaugag

SEQ ID NO: 88125 - DNA, 24 bp, Artificial Sequence
  Synthetic
gtcttcattacucactgccugaca

SEQ ID NO: 88126 - DNA, 24 bp, Artificial Sequence
  Synthetic
agggccagutactagagacaucag

SEQ ID NO: 88127 - DNA, 29 bp, Artificial Sequence
  Synthetic
ttgctaaauccagaaatacactctuccaa

SEQ ID NO: 88128 - DNA, 17 bp, Artificial Sequence
  Synthetic
ggctuggacccuggcaa

SEQ ID NO: 88129 - DNA, 20 bp, Artificial Sequence
  Synthetic
cgactugcaaacctgtuggt

SEQ ID NO: 88130 - DNA, 22 bp, Artificial Sequence
  Synthetic
ccacaagcaucttgtcctuggt

SEQ ID NO: 88131 - DNA, 22 bp, Artificial Sequence
  Synthetic
cctcctcttugtccccatccua

SEQ ID NO: 88132 - DNA, 28 bp, Artificial Sequence
  Synthetic
gataaattcaaguctctcttcctuccca

SEQ ID NO: 88133 - DNA, 23 bp, Artificial Sequence
  Synthetic
gggctgacautcatagcctucaa

SEQ ID NO: 88134 - DNA, 22 bp, Artificial Sequence
  Synthetic
cagaagcugacagtgucacaca

SEQ ID NO: 88135 - DNA, 21 bp, Artificial Sequence
  Synthetic
gcuagagagcaaggcugcaaa

SEQ ID NO: 88136 - DNA, 27 bp, Artificial Sequence
  Synthetic
tctgcttctagucagaatcacauacct

SEQ ID NO: 88137 - DNA, 20 bp, Artificial Sequence
  Synthetic
cgaccaggacuccgguaaga

SEQ ID NO: 88138 - DNA, 21 bp, Artificial Sequence
  Synthetic
ccagtgutggactugcagaac

SEQ ID NO: 88139 - DNA, 22 bp, Artificial Sequence
  Synthetic
gccagugattucaaacagccat

SEQ ID NO: 88140 - DNA, 20 bp, Artificial Sequence
  Synthetic
gugcuggacacgacaacaac

SEQ ID NO: 88141 - DNA, 22 bp, Artificial Sequence
  Synthetic
cccttatctcaugctcccacut

SEQ ID NO: 88142 - DNA, 22 bp, Artificial Sequence
  Synthetic
gaggcuccacacacaatucaga

SEQ ID NO: 88143 - DNA, 21 bp, Artificial Sequence
  Synthetic
ctcttgucggacaguaagcca

SEQ ID NO: 88144 - DNA, 28 bp, Artificial Sequence
  Synthetic
acttaacaagtgaagauggtgaccatut

SEQ ID NO: 88145 - DNA, 27 bp, Artificial Sequence
  Synthetic
ccattgagttcaucattctcactgtuc

SEQ ID NO: 88146 - DNA, 25 bp, Artificial Sequence
  Synthetic
gagtcagaacaugacctgttgctua

SEQ ID NO: 88147 - DNA, 27 bp, Artificial Sequence
  Synthetic
gcttcaaattgtaugtggcccttttuc

SEQ ID NO: 88148 - DNA, 20 bp, Artificial Sequence
  Synthetic
tcacguggcggctgaattua

SEQ ID NO: 88149 - DNA, 20 bp, Artificial Sequence
  Synthetic
cagccacacuctctggaguc

SEQ ID NO: 88150 - DNA, 25 bp, Artificial Sequence
  Synthetic
ttcaacccttcuccagtttgtcaut

SEQ ID NO: 88151 - DNA, 22 bp, Artificial Sequence
  Synthetic
gtcttctccugcctggatgaug

SEQ ID NO: 88152 - DNA, 21 bp, Artificial Sequence
  Synthetic
cccagagcuggactctguaat

SEQ ID NO: 88153 - DNA, 21 bp, Artificial Sequence
  Synthetic
tgttcatgcgcutacgaggut

SEQ ID NO: 88154 - DNA, 26 bp, Artificial Sequence
  Synthetic
cccaagtuccgaagtataaagugcaa

SEQ ID NO: 88155 - DNA, 25 bp, Artificial Sequence
  Synthetic
gttttagaccauccacttucccact

SEQ ID NO: 88156 - DNA, 21 bp, Artificial Sequence
  Synthetic
gagtctcguacaagcagugga

SEQ ID NO: 88157 - DNA, 20 bp, Artificial Sequence
  Synthetic
gcaucaaccacacgttucct

SEQ ID NO: 88158 - DNA, 22 bp, Artificial Sequence
  Synthetic
caagctacccuccagacucaag

SEQ ID NO: 88159 - DNA, 21 bp, Artificial Sequence
  Synthetic
tgctttuggagggctucaaca

SEQ ID NO: 88160 - DNA, 23 bp, Artificial Sequence
  Synthetic
ccucatcactuaacaggcccaat

SEQ ID NO: 88161 - DNA, 25 bp, Artificial Sequence
  Synthetic
tttccaagagtuctttgcagcaaug

SEQ ID NO: 88162 - DNA, 24 bp, Artificial Sequence
  Synthetic
tctccttuggccagcatttcuaaa

SEQ ID NO: 88163 - DNA, 26 bp, Artificial Sequence
  Synthetic
cctcaccuaaggatctguaagagagt

SEQ ID NO: 88164 - DNA, 21 bp, Artificial Sequence
  Synthetic
ccaagcaccugccccattaut

SEQ ID NO: 88165 - DNA, 22 bp, Artificial Sequence
  Synthetic
gcttctgagcugcctctgatug

SEQ ID NO: 88166 - DNA, 25 bp, Artificial Sequence
  Synthetic
ggatatatctgauacgcaggccuct

SEQ ID NO: 88167 - DNA, 25 bp, Artificial Sequence
  Synthetic
gcaagcccaauaaagagtcaccaut

SEQ ID NO: 88168 - DNA, 22 bp, Artificial Sequence
  Synthetic
cgggatgaguttccagagcaua

SEQ ID NO: 88169 - DNA, 24 bp, Artificial Sequence
  Synthetic
caatgcuggcactggatttaucac

SEQ ID NO: 88170 - DNA, 22 bp, Artificial Sequence
  Synthetic
cgagaugcttttucagcccaaa

SEQ ID NO: 88171 - DNA, 20 bp, Artificial Sequence
  Synthetic
ttctcggtcuccctgcagua

SEQ ID NO: 88172 - DNA, 27 bp, Artificial Sequence
  Synthetic
cattcctgaattauactgcgaggctua

SEQ ID NO: 88173 - DNA, 28 bp, Artificial Sequence
  Synthetic
ggatagaagagaaacugcaagaagttug

SEQ ID NO: 88174 - DNA, 20 bp, Artificial Sequence
  Synthetic
gtugcaggcctcaucacaga

SEQ ID NO: 88175 - DNA, 24 bp, Artificial Sequence
  Synthetic
ctccttattacucctgccagtgug

SEQ ID NO: 88176 - DNA, 18 bp, Artificial Sequence
  Synthetic
cggcuacccgagaauggt

SEQ ID NO: 88177 - DNA, 17 bp, Artificial Sequence
  Synthetic
tgcttcugccccagucc

SEQ ID NO: 88178 - DNA, 17 bp, Artificial Sequence
  Synthetic
ctgcaccccugcaccua

SEQ ID NO: 88179 - DNA, 20 bp, Artificial Sequence
  Synthetic
ctcacugccctgctctuacc

SEQ ID NO: 88180 - DNA, 20 bp, Artificial Sequence
  Synthetic
ctacuggcacagcctgacuc

SEQ ID NO: 88181 - DNA, 28 bp, Artificial Sequence
  Synthetic
gccatttttattucctcactgattucca

SEQ ID NO: 88182 - DNA, 21 bp, Artificial Sequence
  Synthetic
cgggtgauccccaaatctuca

SEQ ID NO: 88183 - DNA, 24 bp, Artificial Sequence
  Synthetic
gtgcaacataugcttctctcucag

SEQ ID NO: 88184 - DNA, 24 bp, Artificial Sequence
  Synthetic
gacagtgcauctacttctgtguca

SEQ ID NO: 88185 - DNA, 28 bp, Artificial Sequence
  Synthetic
gctcaggttuggagttgatcttaaauct

SEQ ID NO: 88186 - DNA, 21 bp, Artificial Sequence
  Synthetic
tgttctguaggcaactugcca

SEQ ID NO: 88187 - DNA, 28 bp, Artificial Sequence
  Synthetic
gaaggtcaaauaggctgaagtgaagaua

SEQ ID NO: 88188 - DNA, 29 bp, Artificial Sequence
  Synthetic
ataaacacaagaauttgcagcagaauaat

SEQ ID NO: 88189 - DNA, 26 bp, Artificial Sequence
  Synthetic
ggcaacatgtutgtgatttactcugt

SEQ ID NO: 88190 - DNA, 27 bp, Artificial Sequence
  Synthetic
catcagctccuacgctatctttuagat

SEQ ID NO: 88191 - DNA, 23 bp, Artificial Sequence
  Synthetic
gggttggguttgtattacaugga

SEQ ID NO: 88192 - DNA, 20 bp, Artificial Sequence
  Synthetic
atcccaagcccacgutagug

SEQ ID NO: 88193 - DNA, 26 bp, Artificial Sequence
  Synthetic
aattgaggaaaucctcaggcacauag

SEQ ID NO: 88194 - DNA, 26 bp, Artificial Sequence
  Synthetic
agattttgaagugacttgtgctguct

SEQ ID NO: 88195 - DNA, 22 bp, Artificial Sequence
  Synthetic
ggtcccccaagautttctccuc

SEQ ID NO: 88196 - DNA, 28 bp, Artificial Sequence
  Synthetic
tgaaaguggaaaagaaagaacagaugga

SEQ ID NO: 88197 - DNA, 22 bp, Artificial Sequence
  Synthetic
tctgugaagcaagcagtuaccc

SEQ ID NO: 88198 - DNA, 18 bp, Artificial Sequence
  Synthetic
ttuccttgccuggcaggt

SEQ ID NO: 88199 - DNA, 27 bp, Artificial Sequence
  Synthetic
ctcagaatctgauatgacccttcgtut

SEQ ID NO: 88200 - DNA, 24 bp, Artificial Sequence
  Synthetic
acacagtcagcacuacaagatcug

SEQ ID NO: 88201 - DNA, 27 bp, Artificial Sequence
  Synthetic
ctctctaguagggttccttcaguagaa

SEQ ID NO: 88202 - DNA, 27 bp, Artificial Sequence
  Synthetic
gctaatcucataaatgcugaagaacgg

SEQ ID NO: 88203 - DNA, 26 bp, Artificial Sequence
  Synthetic
cagcactacutatcaaagccugagaa

SEQ ID NO: 88204 - DNA, 24 bp, Artificial Sequence
  Synthetic
ccccgattutgatgcatcuacact

SEQ ID NO: 88205 - DNA, 24 bp, Artificial Sequence
  Synthetic
cactgacuccaataagagcaucca

SEQ ID NO: 88206 - DNA, 29 bp, Artificial Sequence
  Synthetic
gctctggaaggautcaaagtaatgtguaa

SEQ ID NO: 88207 - DNA, 20 bp, Artificial Sequence
  Synthetic
ggctgtaucccatcggtuca

SEQ ID NO: 88208 - DNA, 28 bp, Artificial Sequence
  Synthetic
caacttggagauttttctgaauggaaca

SEQ ID NO: 88209 - DNA, 27 bp, Artificial Sequence
  Synthetic
gtcttctatggcauctagacgatcaut

SEQ ID NO: 88210 - DNA, 22 bp, Artificial Sequence
  Synthetic
gcgaaguagccgccaaauaaaa

SEQ ID NO: 88211 - DNA, 21 bp, Artificial Sequence
  Synthetic
actctcactaucccccacucc

SEQ ID NO: 88212 - DNA, 26 bp, Artificial Sequence
  Synthetic
ccccactctguaaccattatgctaut

SEQ ID NO: 88213 - DNA, 25 bp, Artificial Sequence
  Synthetic
tgagtagccuctcaagatcuggaag

SEQ ID NO: 88214 - DNA, 27 bp, Artificial Sequence
  Synthetic
ctccgaagtugtagagcttcuaaagaa

SEQ ID NO: 88215 - DNA, 27 bp, Artificial Sequence
  Synthetic
tcttcatacattauagccctgctguct

SEQ ID NO: 88216 - DNA, 28 bp, Artificial Sequence
  Synthetic
ggtcgttttccugatttgactguagaat

SEQ ID NO: 88217 - DNA, 28 bp, Artificial Sequence
  Synthetic
ggaggctctgtucattttctcttatguc

SEQ ID NO: 88218 - DNA, 25 bp, Artificial Sequence
  Synthetic
gggaaatttuatgagctguaccaca

SEQ ID NO: 88219 - DNA, 21 bp, Artificial Sequence
  Synthetic
gtctgtuccactcgtgcuact

SEQ ID NO: 88220 - DNA, 21 bp, Artificial Sequence
  Synthetic
tccccugaagagucagaacca

SEQ ID NO: 88221 - DNA, 27 bp, Artificial Sequence
  Synthetic
tcagcaacttctuccatgatccctaua

SEQ ID NO: 88222 - DNA, 25 bp, Artificial Sequence
  Synthetic
aggaagcagugatgaaauaagcagt

SEQ ID NO: 88223 - DNA, 27 bp, Artificial Sequence
  Synthetic
cgtttccttccuagagcttttccttut

SEQ ID NO: 88224 - DNA, 22 bp, Artificial Sequence
  Synthetic
ggtgactggaaauggctctcut

SEQ ID NO: 88225 - DNA, 22 bp, Artificial Sequence
  Synthetic
cgactactgucatcaccaccuc

SEQ ID NO: 88226 - DNA, 28 bp, Artificial Sequence
  Synthetic
gggtgtaaaauaggtggaacucaaaagt

SEQ ID NO: 88227 - DNA, 23 bp, Artificial Sequence
  Synthetic
gccttcgtaautcattgcctcug

SEQ ID NO: 88228 - DNA, 25 bp, Artificial Sequence
  Synthetic
ctctgattaugaccaagctctugct

SEQ ID NO: 88229 - DNA, 22 bp, Artificial Sequence
  Synthetic
ggcaaatugcgagtggugaaat

SEQ ID NO: 88230 - DNA, 26 bp, Artificial Sequence
  Synthetic
aaaggatgagutgcacattgtugaag

SEQ ID NO: 88231 - DNA, 28 bp, Artificial Sequence
  Synthetic
ccttgacacaacauccaaagtatguaag

SEQ ID NO: 88232 - DNA, 20 bp, Artificial Sequence
  Synthetic
ggagaucgtggcucagcaag

SEQ ID NO: 88233 - DNA, 22 bp, Artificial Sequence
  Synthetic
cagctaccacuaccccattugt

SEQ ID NO: 88234 - DNA, 21 bp, Artificial Sequence
  Synthetic
cctggugcagaagggctauaa

SEQ ID NO: 88235 - DNA, 26 bp, Artificial Sequence
  Synthetic
gtgtaccctuggtaatgatccuacag

SEQ ID NO: 88236 - DNA, 22 bp, Artificial Sequence
  Synthetic
actgaaggcagcuctgaacauc

SEQ ID NO: 88237 - DNA, 22 bp, Artificial Sequence
  Synthetic
tgtgcaguaaagaauggccagt

SEQ ID NO: 88238 - DNA, 28 bp, Artificial Sequence
  Synthetic
tctattttguagcaaattccugagcact

SEQ ID NO: 88239 - DNA, 28 bp, Artificial Sequence
  Synthetic
cccaaaggaaguataagccaagtaauga

SEQ ID NO: 88240 - DNA, 24 bp, Artificial Sequence
  Synthetic
gttaccagcuggaaattccugaga

SEQ ID NO: 88241 - DNA, 24 bp, Artificial Sequence
  Synthetic
gcagtcctucaatgatacauccct

SEQ ID NO: 88242 - DNA, 24 bp, Artificial Sequence
  Synthetic
gaaaaaccuacagaccuggagaca

SEQ ID NO: 88243 - DNA, 22 bp, Artificial Sequence
  Synthetic
ggcgtttcagcuaaacccaaut

SEQ ID NO: 88244 - DNA, 23 bp, Artificial Sequence
  Synthetic
gauagagtggugaggagggagat

SEQ ID NO: 88245 - DNA, 20 bp, Artificial Sequence
  Synthetic
gcacacaccauaugcacgag

SEQ ID NO: 88246 - DNA, 23 bp, Artificial Sequence
  Synthetic
tgtctgtatgugtgtcccccuaa

SEQ ID NO: 88247 - DNA, 21 bp, Artificial Sequence
  Synthetic
cactgggugaggttgtctguc

SEQ ID NO: 88248 - DNA, 22 bp, Artificial Sequence
  Synthetic
tggttgcgcauttgtggaatut

SEQ ID NO: 88249 - DNA, 29 bp, Artificial Sequence
  Synthetic
aggatctcaacutaccagcttatuaacac

SEQ ID NO: 88250 - DNA, 19 bp, Artificial Sequence
  Synthetic
gcagccuggtagacacgua

SEQ ID NO: 88251 - DNA, 22 bp, Artificial Sequence
  Synthetic
gtctgagucatggtuagggcat

SEQ ID NO: 88252 - DNA, 28 bp, Artificial Sequence
  Synthetic
gtcttcaagttuaactcctcaaagctuc

SEQ ID NO: 88253 - DNA, 28 bp, Artificial Sequence
  Synthetic
gccaagtgagauaccattctatactuca

SEQ ID NO: 88254 - DNA, 19 bp, Artificial Sequence
  Synthetic
tcagagugaggtcggguca

SEQ ID NO: 88255 - DNA, 21 bp, Artificial Sequence
  Synthetic
acacacacacutggtgctcut

SEQ ID NO: 88256 - DNA, 25 bp, Artificial Sequence
  Synthetic
cagttucaaagcaacagguaaagca

SEQ ID NO: 88257 - DNA, 24 bp, Artificial Sequence
  Synthetic
aggaccaaguagtgtgtctgtuct

SEQ ID NO: 88258 - DNA, 24 bp, Artificial Sequence
  Synthetic
gcaucaaggagctatuaggagggt

SEQ ID NO: 88259 - DNA, 26 bp, Artificial Sequence
  Synthetic
agacagcttcuttttcgttgttucag

SEQ ID NO: 88260 - DNA, 26 bp, Artificial Sequence
  Synthetic
agtaactggcugttctctttttcucc

SEQ ID NO: 88261 - DNA, 25 bp, Artificial Sequence
  Synthetic
agcttcacacgaucttcttaaugct

SEQ ID NO: 88262 - DNA, 22 bp, Artificial Sequence
  Synthetic
cgctggcaguttcaaacguaat

SEQ ID NO: 88263 - DNA, 27 bp, Artificial Sequence
  Synthetic
gggttcattauaaaacaggaagugcag

SEQ ID NO: 88264 - DNA, 18 bp, Artificial Sequence
  Synthetic
gagccugcacuccacaga

SEQ ID NO: 88265 - DNA, 17 bp, Artificial Sequence
  Synthetic
cugaccacggccuggac

SEQ ID NO: 88266 - DNA, 17 bp, Artificial Sequence
  Synthetic
cacaggccgguggaaug

SEQ ID NO: 88267 - DNA, 20 bp, Artificial Sequence
  Synthetic
ctcctaccucccctcaccua

SEQ ID NO: 88268 - DNA, 22 bp, Artificial Sequence
  Synthetic
cactcatctucagccttgcugt

SEQ ID NO: 88269 - DNA, 21 bp, Artificial Sequence
  Synthetic
ggacagtgcuctggagacuct

SEQ ID NO: 88270 - DNA, 21 bp, Artificial Sequence
  Synthetic
ctggacacagaggaucgaugt

SEQ ID NO: 88271 - DNA, 20 bp, Artificial Sequence
  Synthetic
ctggaggugatgacugccaa

SEQ ID NO: 88272 - DNA, 21 bp, Artificial Sequence
  Synthetic
cctgggccutctcctcuaact

SEQ ID NO: 88273 - DNA, 18 bp, Artificial Sequence
  Synthetic
gcagaggugagcaagcug

SEQ ID NO: 88274 - DNA, 20 bp, Artificial Sequence
  Synthetic
ctgcttcuggcattgctgut

SEQ ID NO: 88275 - DNA, 22 bp, Artificial Sequence
  Synthetic
caaaccgugaagcaacugaagg

SEQ ID NO: 88276 - DNA, 21 bp, Artificial Sequence
  Synthetic
ttgacctuggcaccctcauac

SEQ ID NO: 88277 - DNA, 23 bp, Artificial Sequence
  Synthetic
agtttcuggaagtggagtuggac

SEQ ID NO: 88278 - DNA, 20 bp, Artificial Sequence
  Synthetic
cgctuctcctctucaaggct

SEQ ID NO: 88279 - DNA, 18 bp, Artificial Sequence
  Synthetic
gcccaggutgcagagcua

SEQ ID NO: 88280 - DNA, 21 bp, Artificial Sequence
  Synthetic
ggagctcagcuagttcgtuct

SEQ ID NO: 88281 - DNA, 22 bp, Artificial Sequence
  Synthetic
gtuccaggaacagctgaugact

SEQ ID NO: 88282 - DNA, 25 bp, Artificial Sequence
  Synthetic
tccttttctttcutagccagctgut

SEQ ID NO: 88283 - DNA, 20 bp, Artificial Sequence
  Synthetic
ggagtucgctacccugcaag

SEQ ID NO: 88284 - DNA, 23 bp, Artificial Sequence
  Synthetic
gctgccaacucttggacatacut

SEQ ID NO: 88285 - DNA, 20 bp, Artificial Sequence
  Synthetic
agagaaggccagcuaugcag

SEQ ID NO: 88286 - DNA, 20 bp, Artificial Sequence
  Synthetic
ctctgcauagctggcctuct

SEQ ID NO: 88287 - DNA, 17 bp, Artificial Sequence
  Synthetic
caccgugaggagcugga

SEQ ID NO: 88288 - DNA, 19 bp, Artificial Sequence
  Synthetic
ccutcugccgcagaggaat

SEQ ID NO: 88289 - DNA, 19 bp, Artificial Sequence
  Synthetic
cagcuaagcacctcugcca

SEQ ID NO: 88290 - DNA, 27 bp, Artificial Sequence
  Synthetic
gtaccttttggaucaaatgatgctugt

SEQ ID NO: 88291 - DNA, 25 bp, Artificial Sequence
  Synthetic
tggagaagucagaacgaagaucagt

SEQ ID NO: 88292 - DNA, 27 bp, Artificial Sequence
  Synthetic
tgtaacaaggguatacctgtatuggga

SEQ ID NO: 88293 - DNA, 22 bp, Artificial Sequence
  Synthetic
ggctgctcaacucttgtccaut

SEQ ID NO: 88294 - DNA, 17 bp, Artificial Sequence
  Synthetic
gaccgcagcugcaacuc

SEQ ID NO: 88295 - DNA, 19 bp, Artificial Sequence
  Synthetic
gcuaaugaagcccgggaca

SEQ ID NO: 88296 - DNA, 26 bp, Artificial Sequence
  Synthetic
tcttcgttctgacutctccaagttuc

SEQ ID NO: 88297 - DNA, 26 bp, Artificial Sequence
  Synthetic
tgtccacaaaggugctacaatuagat

SEQ ID NO: 88298 - DNA, 23 bp, Artificial Sequence
  Synthetic
gccttctcacautcctcctucaa

SEQ ID NO: 88299 - DNA, 23 bp, Artificial Sequence
  Synthetic
tgagcagcucgtcaaagaaguag

SEQ ID NO: 88300 - DNA, 18 bp, Artificial Sequence
  Synthetic
ctgggccugtgtcacuga

SEQ ID NO: 88301 - DNA, 20 bp, Artificial Sequence
  Synthetic
ggagcgagaggccucctuaa

SEQ ID NO: 88302 - DNA, 21 bp, Artificial Sequence
  Synthetic
ggctatccucataccgcucac

SEQ ID NO: 88303 - DNA, 21 bp, Artificial Sequence
  Synthetic
gaggctcgautacagcagcut

SEQ ID NO: 88304 - DNA, 18 bp, Artificial Sequence
  Synthetic
gcugctugagagccgcat

SEQ ID NO: 88305 - DNA, 19 bp, Artificial Sequence
  Synthetic
caccagguggagcagcuaa

SEQ ID NO: 88306 - DNA, 22 bp, Artificial Sequence
  Synthetic
aggacttcaguctcagccugat

SEQ ID NO: 88307 - DNA, 23 bp, Artificial Sequence
  Synthetic
gttgtatcuctgagcugaaggca

SEQ ID NO: 88308 - DNA, 21 bp, Artificial Sequence
  Synthetic
ctttcgtucccgcttatgcug

SEQ ID NO: 88309 - DNA, 24 bp, Artificial Sequence
  Synthetic
caaagaguccttgaaggucaccaa

SEQ ID NO: 88310 - DNA, 21 bp, Artificial Sequence
  Synthetic
gctaaagggcucagagugcag

SEQ ID NO: 88311 - DNA, 20 bp, Artificial Sequence
  Synthetic
tcctcacggugaacgtctug

SEQ ID NO: 88312 - DNA, 28 bp, Artificial Sequence
  Synthetic
ttcattgaccaucacatgctaatagugt

SEQ ID NO: 88313 - DNA, 27 bp, Artificial Sequence
  Synthetic
gcatcaucattatgctugcaaaaacga

SEQ ID NO: 88314 - DNA, 24 bp, Artificial Sequence
  Synthetic
gactccauggctgtcaaatcuagt

SEQ ID NO: 88315 - DNA, 22 bp, Artificial Sequence
  Synthetic
agcaaacucaataccugcccaa

SEQ ID NO: 88316 - DNA, 22 bp, Artificial Sequence
  Synthetic
gcagctggautttactgccaut

SEQ ID NO: 88317 - DNA, 19 bp, Artificial Sequence
  Synthetic
caggctgacugcctctuga

SEQ ID NO: 88318 - DNA, 27 bp, Artificial Sequence
  Synthetic
cctgctttttaauccaagtaagccaut

SEQ ID NO: 88319 - DNA, 25 bp, Artificial Sequence
  Synthetic
aaccaatgctcucaccttaaagugt

SEQ ID NO: 88320 - DNA, 24 bp, Artificial Sequence
  Synthetic
cguataagcccucacaacaaccaa

SEQ ID NO: 88321 - DNA, 31 bp, Artificial Sequence; identical to SEQ ID NO: 62433
  Synthetic

SEQ ID NO: 88322 - DNA, 25 bp, Artificial Sequence
  Synthetic
aagaaaaacaagucaggtgagguga

SEQ ID NO: 88323 - DNA, 21 bp, Artificial Sequence
  Synthetic
ctgcctccugtttggcttcua

SEQ ID NO: 88324 - DNA, 22 bp, Artificial Sequence
  Synthetic
aggcctguggatatagccucaa

SEQ ID NO: 88325 - DNA, 18 bp, Artificial Sequence
  Synthetic
gagtucccgtccgugacc

SEQ ID NO: 88326 - DNA, 21 bp, Artificial Sequence
  Synthetic
ccccgutttcctaauccacaa

SEQ ID NO: 88327 - DNA, 25 bp, Artificial Sequence
  Synthetic
cgcttcctuggcttgtcaaatauct

SEQ ID NO: 88328 - DNA, 20 bp, Artificial Sequence
  Synthetic
gcccaacgcugtagttccug

SEQ ID NO: 88329 - DNA, 26 bp, Artificial Sequence
  Synthetic
agtggcatgaguaacaagagagaaug

SEQ ID NO: 88330 - DNA, 26 bp, Artificial Sequence
  Synthetic
ctattttcctgucataggcacuacca

SEQ ID NO: 88331 - DNA, 28 bp, Artificial Sequence
  Synthetic
gaaggtgaaaagaucaggaactgaguaa

SEQ ID NO: 88332 - DNA, 17 bp, Artificial Sequence
  Synthetic
cgcugcccacggagaug

SEQ ID NO: 88333 - DNA, 18 bp, Artificial Sequence
  Synthetic
gccggucctggugaaaga

SEQ ID NO: 88334 - DNA, 17 bp, Artificial Sequence
  Synthetic
tggccuggcgcttcaut

SEQ ID NO: 88335 - DNA, 17 bp, Artificial Sequence
  Synthetic
cgggugctcttcucgca

SEQ ID NO: 88336 - DNA, 18 bp, Artificial Sequence
  Synthetic
gtcgcuccagctcguaca

SEQ ID NO: 88337 - DNA, 22 bp, Artificial Sequence
  Synthetic
cttacagtcucccgcttcaugg

SEQ ID NO: 88338 - DNA, 20 bp, Artificial Sequence
  Synthetic
cccaugccgctcatgtucat

SEQ ID NO: 88339 - DNA, 17 bp, Artificial Sequence
  Synthetic
ctaggcugcctggguca

SEQ ID NO: 88340 - DNA, 19 bp, Artificial Sequence
  Synthetic
ccuagcaaggcgaggctut

SEQ ID NO: 88341 - DNA, 21 bp, Artificial Sequence
  Synthetic
cctcccugttgactcaugcag

SEQ ID NO: 88342 - DNA, 29 bp, Artificial Sequence
  Synthetic
gatgctcatacugtcaatacaaaaucgaa

SEQ ID NO: 88343 - DNA, 28 bp, Artificial Sequence
  Synthetic
gccaaggauggatatagaaacaaaugac

SEQ ID NO: 88344 - DNA, 26 bp, Artificial Sequence
  Synthetic
ctactttctgguactgcttcaucact

SEQ ID NO: 88345 - DNA, 29 bp, Artificial Sequence
  Synthetic
gacacaaaaccagagutagaaattgaugt

SEQ ID NO: 88346 - DNA, 24 bp, Artificial Sequence
  Synthetic
ctagatgacaguacagggctagug

SEQ ID NO: 88347 - DNA, 21 bp, Artificial Sequence
  Synthetic
ttgactcugaggcctggagua

SEQ ID NO: 88348 - DNA, 28 bp, Artificial Sequence
  Synthetic
tgacatcttccucctgtttttgaactut

SEQ ID NO: 88349 - DNA, 28 bp, Artificial Sequence
  Synthetic
catgctgcagaaaagcuaagatcaaaua

SEQ ID NO: 88350 - DNA, 24 bp, Artificial Sequence
  Synthetic
tgggaauggcaagcagtaattuca

SEQ ID NO: 88351 - DNA, 23 bp, Artificial Sequence
  Synthetic
ccaatcatucgcattcaguccat

SEQ ID NO: 88352 - DNA, 23 bp, Artificial Sequence
  Synthetic
ggccacatcauccatttccctut

SEQ ID NO: 88353 - DNA, 28 bp, Artificial Sequence
  Synthetic
gtggaaaaauaaggagcagcatctauct

SEQ ID NO: 88354 - DNA, 23 bp, Artificial Sequence
  Synthetic
gtatgttgccutacctgtgtugg

SEQ ID NO: 88355 - DNA, 23 bp, Artificial Sequence
  Synthetic
agggcagtuacttgggaaactug

SEQ ID NO: 88356 - DNA, 24 bp, Artificial Sequence
  Synthetic
tgttctctugggagttggtaucct

SEQ ID NO: 88357 - DNA, 28 bp, Artificial Sequence
  Synthetic
caagacattcuaggttgtagtugaaggt

SEQ ID NO: 88358 - DNA, 22 bp, Artificial Sequence
  Synthetic
ttgtguccacaggctcattcuc

SEQ ID NO: 88359 - DNA, 28 bp, Artificial Sequence
  Synthetic
gtcttcatgcaaaucagcaagaauagaa

SEQ ID NO: 88360 - DNA, 24 bp, Artificial Sequence
  Synthetic
gtctcttaugcaggcactgaacut

SEQ ID NO: 88361 - DNA, 24 bp, Artificial Sequence
  Synthetic
aagcagaagtcuagaagggtggua

SEQ ID NO: 88362 - DNA, 27 bp, Artificial Sequence
  Synthetic
agcaggtugtgtttgttcuaaaagaga

SEQ ID NO: 88363 - DNA, 28 bp, Artificial Sequence
  Synthetic
gccaaactaaauggttacttagctgugt

SEQ ID NO: 88364 - DNA, 20 bp, Artificial Sequence
  Synthetic
tgactugcaaagacggugct

SEQ ID NO: 88365 - DNA, 28 bp, Artificial Sequence
  Synthetic
aggcagaacacuaaatcctttggtaaut

SEQ ID NO: 88366 - DNA, 21 bp, Artificial Sequence
  Synthetic
cccacacaucccacaaugact

SEQ ID NO: 88367 - DNA, 21 bp, Artificial Sequence
  Synthetic
tctagcaatgugagcgtccug

SEQ ID NO: 88368 - DNA, 23 bp, Artificial Sequence
  Synthetic
tttcctcatuccggctcttuagg

SEQ ID NO: 88369 - DNA, 24 bp, Artificial Sequence
  Synthetic
tctctcuaaagaaccucagggcaa

SEQ ID NO: 88370 - DNA, 23 bp, Artificial Sequence
  Synthetic
gtcatcttuaagcctcagugggt

SEQ ID NO: 88371 - DNA, 22 bp, Artificial Sequence
  Synthetic
acgtggccaucaagatgaucaa

SEQ ID NO: 88372 - DNA, 23 bp, Artificial Sequence
  Synthetic
catcttcagacauggagcctuct

SEQ ID NO: 88373 - DNA, 28 bp, Artificial Sequence
  Synthetic
ccaaagaaucacaccaagactttatugt

SEQ ID NO: 88374 - DNA, 20 bp, Artificial Sequence
  Synthetic
gctggcttugtaccggacut

SEQ ID NO: 88375 - DNA, 26 bp, Artificial Sequence
  Synthetic
acaacactcacuaccctagaaacuga

SEQ ID NO: 88376 - DNA, 19 bp, Artificial Sequence
  Synthetic
tcccuccagagccccttut

SEQ ID NO: 88377 - DNA, 20 bp, Artificial Sequence
  Synthetic
gcacacugggaaacgctuct

SEQ ID NO: 88378 - DNA, 19 bp, Artificial Sequence
  Synthetic
aggaaaugcuggacagcgt

SEQ ID NO: 88379 - DNA, 25 bp, Artificial Sequence
  Synthetic
aaaaacttgggccutcatgtcaaug

SEQ ID NO: 88380 - DNA, 24 bp, Artificial Sequence
  Synthetic
ggatgagccaaagaugaccaagut

SEQ ID NO: 88381 - DNA, 24 bp, Artificial Sequence
  Synthetic
tcccctttgcugatgtgaaaagut

SEQ ID NO: 88382 - DNA, 20 bp, Artificial Sequence
  Synthetic
caccttcugggcccaatcuc

SEQ ID NO: 88383 - DNA, 28 bp, Artificial Sequence
  Synthetic
tggcaatgcuaaccatctttaacatcua

SEQ ID NO: 88384 - DNA, 22 bp, Artificial Sequence
  Synthetic
agccagcacautgtcacagaua

SEQ ID NO: 88385 - DNA, 21 bp, Artificial Sequence
  Synthetic
tccacuctctcagugacagca

SEQ ID NO: 88386 - DNA, 23 bp, Artificial Sequence
  Synthetic
cctgttccatugggtctccatut

SEQ ID NO: 88387 - DNA, 23 bp, Artificial Sequence
  Synthetic
agatgctucaggatggacaugag

SEQ ID NO: 88388 - DNA, 28 bp, Artificial Sequence
  Synthetic
acaagaaagucattgtttucacaagcaa

SEQ ID NO: 88389 - DNA, 25 bp, Artificial Sequence
  Synthetic
cgttaaaggacuttgcaaucaagcc

SEQ ID NO: 88390 - DNA, 21 bp, Artificial Sequence
  Synthetic
gtggccugcagtcctactaug

SEQ ID NO: 88391 - DNA, 19 bp, Artificial Sequence
  Synthetic
caccaccugggaacaccug

SEQ ID NO: 88392 - DNA, 22 bp, Artificial Sequence
  Synthetic
gcccagugaggagtaaacugaa

SEQ ID NO: 88393 - DNA, 21 bp, Artificial Sequence
  Synthetic
tggcttaggucacggugaaac

SEQ ID NO: 88394 - DNA, 22 bp, Artificial Sequence
  Synthetic
cctgtcccagcauggaagtauc

SEQ ID NO: 88395 - DNA, 28 bp, Artificial Sequence
  Synthetic
gtaacttctttccugccttcttcttuct

SEQ ID NO: 88396 - DNA, 25 bp, Artificial Sequence
  Synthetic
gaagtaaatgatucgcttggctugt

SEQ ID NO: 88397 - DNA, 25 bp, Artificial Sequence
  Synthetic
tgaggtttcttutgttcctgtguca

SEQ ID NO: 88398 - DNA, 23 bp, Artificial Sequence
  Synthetic
gggaagaggcugtaaaaaucaca

SEQ ID NO: 88399 - DNA, 18 bp, Artificial Sequence
  Synthetic
cuggcccggaagacauct

SEQ ID NO: 88400 - DNA, 22 bp, Artificial Sequence
  Synthetic
accagcucagagctcagaucat

SEQ ID NO: 88401 - DNA, 17 bp, Artificial Sequence
  Synthetic
ccugtugcggacaccga

SEQ ID NO: 88402 - DNA, 19 bp, Artificial Sequence
  Synthetic
gcagaugccaacgcuacct

SEQ ID NO: 88403 - DNA, 20 bp, Artificial Sequence
  Synthetic
cagccautcgctcugagaca

SEQ ID NO: 88404 - DNA, 28 bp, Artificial Sequence
  Synthetic
tcactattccuctttaacttcucggact

SEQ ID NO: 88405 - DNA, 24 bp, Artificial Sequence
  Synthetic
gctgccaacaugtctgatgtauct

SEQ ID NO: 88406 - DNA, 24 bp, Artificial Sequence
  Synthetic
cggactaaccagutcatccaugat

SEQ ID NO: 88407 - DNA, 28 bp, Artificial Sequence
  Synthetic
ccagcaaatugtttatttctcugaagga

SEQ ID NO: 88408 - DNA, 21 bp, Artificial Sequence
  Synthetic
gccccaggucgtatgtttcut

SEQ ID NO: 88409 - DNA, 23 bp, Artificial Sequence
  Synthetic
agttctttgucttccagcgucag

SEQ ID NO: 88410 - DNA, 19 bp, Artificial Sequence
  Synthetic
cagccgacgaccutgttut

SEQ ID NO: 88411 - DNA, 17 bp, Artificial Sequence
  Synthetic
cgggucagccctggtuc

SEQ ID NO: 88412 - DNA, 17 bp, Artificial Sequence
  Synthetic
gtgtccucgccggtuca

SEQ ID NO: 88413 - DNA, 18 bp, Artificial Sequence
  Synthetic
tgaguguggacccccgaa

SEQ ID NO: 88414 - DNA, 28 bp, Artificial Sequence
  Synthetic
gttcccagggaggutatatucaaaagaa

SEQ ID NO: 88415 - DNA, 23 bp, Artificial Sequence
  Synthetic
cguttccttttauggcagaggct

SEQ ID NO: 88416 - DNA, 22 bp, Artificial Sequence
  Synthetic
cagtttcugcagatggctcugt

SEQ ID NO: 88417 - DNA, 22 bp, Artificial Sequence
  Synthetic
tggagaaccugagggtagaugg

SEQ ID NO: 88418 - DNA, 28 bp, Artificial Sequence
  Synthetic
acatcttgugaaaagacaaagaccacua

SEQ ID NO: 88419 - DNA, 23 bp, Artificial Sequence
  Synthetic
caaacctcacauggtatggcauc

SEQ ID NO: 88420 - DNA, 23 bp, Artificial Sequence
  Synthetic
tctcuggaaagaccacggtguat

SEQ ID NO: 88421 - DNA, 23 bp, Artificial Sequence
  Synthetic
aggatggagaccutcagcttcut

SEQ ID NO: 88422 - DNA, 17 bp, Artificial Sequence
  Synthetic
acugcgggaggguggat

SEQ ID NO: 88423 - DNA, 18 bp, Artificial Sequence
  Synthetic
gggactugaccgcugagg

SEQ ID NO: 88424 - DNA, 19 bp, Artificial Sequence
  Synthetic
ctgctccagugtgcatugt

SEQ ID NO: 88425 - DNA, 18 bp, Artificial Sequence
  Synthetic
gguggcacucaccacacc

SEQ ID NO: 88426 - DNA, 21 bp, Artificial Sequence
  Synthetic
ggguggccatuaacacacaat

SEQ ID NO: 88427 - DNA, 21 bp, Artificial Sequence
  Synthetic
ccacctugcatgggtacucac

SEQ ID NO: 88428 - DNA, 18 bp, Artificial Sequence
  Synthetic
cagcugctctgcucggat

SEQ ID NO: 88429 - DNA, 23 bp, Artificial Sequence
  Synthetic
caggcccggutctggttauaaaa

SEQ ID NO: 88430 - DNA, 20 bp, Artificial Sequence
  Synthetic
caaaagccgagcugtgcauc

SEQ ID NO: 88431 - DNA, 20 bp, Artificial Sequence
  Synthetic
attucccacagggacacgut

SEQ ID NO: 88432 - DNA, 20 bp, Artificial Sequence
  Synthetic
catggtcgcutgcttggaug

SEQ ID NO: 88433 - DNA, 22 bp, Artificial Sequence
  Synthetic
agtgactgaacugtgctggtut

SEQ ID NO: 88434 - DNA, 21 bp, Artificial Sequence
  Synthetic
cccaggugacaagctcactua

SEQ ID NO: 88435 - DNA, 24 bp, Artificial Sequence
  Synthetic
ggtcatcuagaccccaacactuac

SEQ ID NO: 88436 - DNA, 28 bp, Artificial Sequence
  Synthetic
gttuggtaaagaagcugaaggagaaaaa

SEQ ID NO: 88437 - DNA, 26 bp, Artificial Sequence
  Synthetic
aatctgccaccauagagggtauagaa

SEQ ID NO: 88438 - DNA, 21 bp, Artificial Sequence
  Synthetic
ccttactgtugcccaccctut

SEQ ID NO: 88439 - DNA, 25 bp, Artificial Sequence
  Synthetic
gggtgacagugcttauaaacgaaga

SEQ ID NO: 88440 - DNA, 20 bp, Artificial Sequence
  Synthetic
gcagcucagccaactcttug

SEQ ID NO: 88441 - DNA, 28 bp, Artificial Sequence
  Synthetic
cacttcaaaugcactgttaacattucct

SEQ ID NO: 88442 - DNA, 17 bp, Artificial Sequence
  Synthetic
gctgcgcuacaacgugt

SEQ ID NO: 88443 - DNA, 17 bp, Artificial Sequence
  Synthetic
gcuccgccgcactuacc

SEQ ID NO: 88444 - DNA, 17 bp, Artificial Sequence
  Synthetic
cggcaagcucgtgcuct

SEQ ID NO: 88445 - DNA, 17 bp, Artificial Sequence
  Synthetic
tccccgcccucuccaaa

SEQ ID NO: 88446 - DNA, 20 bp, Artificial Sequence
  Synthetic
ctccccuagacugagaccgt

SEQ ID NO: 88447 - DNA, 21 bp, Artificial Sequence
  Synthetic
cgggtcaccutgttgatgaug

SEQ ID NO: 88448 - DNA, 18 bp, Artificial Sequence
  Synthetic
ggagucagcagcagggut

SEQ ID NO: 88449 - DNA, 17 bp, Artificial Sequence
  Synthetic
ccggcugaggtgtucca

SEQ ID NO: 88450 - DNA, 19 bp, Artificial Sequence
  Synthetic
aggauccgcatgacugcac

SEQ ID NO: 88451 - DNA, 22 bp, Artificial Sequence
  Synthetic
gggtgacucaagtcatggugat

SEQ ID NO: 88452 - DNA, 23 bp, Artificial Sequence
  Synthetic
agcaagcucttctuggaaaacct

SEQ ID NO: 88453 - DNA, 22 bp, Artificial Sequence
  Synthetic
actctugagagaggtgccucat

SEQ ID NO: 88454 - DNA, 22 bp, Artificial Sequence
  Synthetic
cttcaacguacccaacccucat

SEQ ID NO: 88455 - DNA, 22 bp, Artificial Sequence
  Synthetic
ggtgagccgaaggutcactuac

SEQ ID NO: 88456 - DNA, 20 bp, Artificial Sequence
  Synthetic
tgucaccgggacaagaacug

SEQ ID NO: 88457 - DNA, 24 bp, Artificial Sequence
  Synthetic
cttggtcttuaggagcatcugaga

SEQ ID NO: 88458 - DNA, 17 bp, Artificial Sequence
  Synthetic
gcccccugccctgatug

SEQ ID NO: 88459 - DNA, 19 bp, Artificial Sequence
  Synthetic
cttgttcugcagcggtgug

SEQ ID NO: 88460 - DNA, 19 bp, Artificial Sequence
  Synthetic
gtacagccagugtguccga

SEQ ID NO: 88461 - DNA, 24 bp, Artificial Sequence
  Synthetic
gcaaaagtggucctctctgaauct

SEQ ID NO: 88462 - DNA, 21 bp, Artificial Sequence
  Synthetic
ctctgcuccggtttgggauat

SEQ ID NO: 88463 - DNA, 25 bp, Artificial Sequence
  Synthetic
ctctggagacauatagagtggtgug

SEQ ID NO: 88464 - DNA, 26 bp, Artificial Sequence
  Synthetic
ggaagggaaagaaugactgauggaat

SEQ ID NO: 88465 - DNA, 21 bp, Artificial Sequence
  Synthetic
ctgggaacccugatgacucac

SEQ ID NO: 88466 - DNA, 20 bp, Artificial Sequence
  Synthetic
gcucaacacgcactatgugg

SEQ ID NO: 88467 - DNA, 22 bp, Artificial Sequence
  Synthetic
cgtuaaaccactgcucgaaggt

SEQ ID NO: 88468 - DNA, 21 bp, Artificial Sequence
  Synthetic
gcugcccaccatctucaagag

SEQ ID NO: 88469 - DNA, 19 bp, Artificial Sequence
  Synthetic
agctggtgcucaacacgut

SEQ ID NO: 88470 - DNA, 24 bp, Artificial Sequence
  Synthetic
aaacaaatgcccugttggtagtua

SEQ ID NO: 88471 - DNA, 23 bp, Artificial Sequence
  Synthetic
gcagttucagacacacagucagg

SEQ ID NO: 88472 - DNA, 32 bp, Artificial Sequence; identical to SEQ ID NO: 59170
  Synthetic

SEQ ID NO: 88473 - DNA, 19 bp, Artificial Sequence
  Synthetic
ccgtgcacucctgttcuga

SEQ ID NO: 88474 - DNA, 23 bp, Artificial Sequence
  Synthetic
ccacaacaagcccauaactuacc

SEQ ID NO: 88475 - DNA, 27 bp, Artificial Sequence
  Synthetic
acaggaattucaggacagtatagcuct

SEQ ID NO: 88476 - DNA, 23 bp, Artificial Sequence
  Synthetic
gtcataggttuggaacccgtuct

SEQ ID NO: 88477 - DNA, 22 bp, Artificial Sequence
  Synthetic
agtaagagacccuagggcucac

SEQ ID NO: 88478 - DNA, 22 bp, Artificial Sequence
  Synthetic
tggtgcugacatccaucaaagg

SEQ ID NO: 88479 - DNA, 22 bp, Artificial Sequence
  Synthetic
ctgaccagcugaaagatgctug

SEQ ID NO: 88480 - DNA, 22 bp, Artificial Sequence
  Synthetic
cacataggccugcatgggauaa

SEQ ID NO: 88481 - DNA, 23 bp, Artificial Sequence
  Synthetic
ggaagttgttugagcaagaggug

SEQ ID NO: 88482 - DNA, 28 bp, Artificial Sequence
  Synthetic
caugaacagaccauaaagcagaaaagaa

SEQ ID NO: 88483 - DNA, 22 bp, Artificial Sequence
  Synthetic
ctgtcagtguacagcagcagua

SEQ ID NO: 88484 - DNA, 21 bp, Artificial Sequence
  Synthetic
ggaggcctugtcaccatccua

SEQ ID NO: 88485 - DNA, 24 bp, Artificial Sequence
  Synthetic
accttgtgtgutgactccactuac

SEQ ID NO: 88486 - DNA, 21 bp, Artificial Sequence
  Synthetic
gcaccccucccttctatgcua

SEQ ID NO: 88487 - DNA, 28 bp, Artificial Sequence
  Synthetic
gaacagagauagagggagacagattuct

SEQ ID NO: 88488 - DNA, 20 bp, Artificial Sequence
  Synthetic
gtttctgagccucccgtuga

SEQ ID NO: 88489 - DNA, 28 bp, Artificial Sequence
  Synthetic
tttgattgugtctatgattuagggagca

SEQ ID NO: 88490 - DNA, 21 bp, Artificial Sequence
  Synthetic
gcutgagactgugcaggagag

SEQ ID NO: 88491 - DNA, 20 bp, Artificial Sequence
  Synthetic
tggcccagagugatggtgua

SEQ ID NO: 88492 - DNA, 26 bp, Artificial Sequence
  Synthetic
cctcatcatcauacccttcaacaucc

SEQ ID NO: 88493 - DNA, 28 bp, Artificial Sequence
  Synthetic
gcctctgtattucaagatgagagcaaut

SEQ ID NO: 88494 - DNA, 21 bp, Artificial Sequence
  Synthetic
cattgugcgcaccacaucaat

SEQ ID NO: 88495 - DNA, 25 bp, Artificial Sequence
  Synthetic
cagaaggaugauaaagagccacagg

SEQ ID NO: 88496 - DNA, 21 bp, Artificial Sequence
  Synthetic
caacgctggagucttggtgua

SEQ ID NO: 88497 - DNA, 24 bp, Artificial Sequence
  Synthetic
tctcctgcuccttatgatcaugct

SEQ ID NO: 88498 - DNA, 21 bp, Artificial Sequence
  Synthetic
gctccucacagctcccauaac

SEQ ID NO: 88499 - DNA, 24 bp, Artificial Sequence
  Synthetic
tggaauaagacccaaacaacccut

SEQ ID NO: 88500 - DNA, 24 bp, Artificial Sequence
  Synthetic
gttcctgucactgtcttctucact

SEQ ID NO: 88501 - DNA, 21 bp, Artificial Sequence
  Synthetic
gccaugaagggcaagtgtcuc

SEQ ID NO: 88502 - DNA, 21 bp, Artificial Sequence
  Synthetic
tttgaatccauccctgugcgt

SEQ ID NO: 88503 - DNA, 27 bp, Artificial Sequence
  Synthetic
tttattuaccgccttttcuggaagagt

SEQ ID NO: 88504 - DNA, 25 bp, Artificial Sequence
  Synthetic
gcaguggaaatauccaagacagaca

SEQ ID NO: 88505 - DNA, 25 bp, Artificial Sequence
  Synthetic
gaattagaaagccuggacccaauga

SEQ ID NO: 88506 - DNA, 22 bp, Artificial Sequence
  Synthetic
ggttcugtagaatgucccacca

SEQ ID NO: 88507 - DNA, 22 bp, Artificial Sequence
  Synthetic
gcatcatcccuttgctggtuac

SEQ ID NO: 88508 - DNA, 23 bp, Artificial Sequence
  Synthetic
cacccagcauatcauaccacagt

SEQ ID NO: 88509 - DNA, 25 bp, Artificial Sequence
  Synthetic
gctgatgaugaaatcacgatgaugg

SEQ ID NO: 88510 - DNA, 25 bp, Artificial Sequence
  Synthetic
tctgaaugggaaggaaaggctttut

SEQ ID NO: 88511 - DNA, 24 bp, Artificial Sequence
  Synthetic
cctaacuccagaagggccaataug

SEQ ID NO: 88512 - DNA, 22 bp, Artificial Sequence
  Synthetic
catcctcagautctgcctgugt

SEQ ID NO: 88513 - DNA, 25 bp, Artificial Sequence
  Synthetic
gaccaagatgcuattacctgtgugt

SEQ ID NO: 88514 - DNA, 21 bp, Artificial Sequence
  Synthetic
gaatcctucaccacacccugt

SEQ ID NO: 88515 - DNA, 28 bp, Artificial Sequence
  Synthetic
cccagaagaagaaaaugaggaagattuc

SEQ ID NO: 88516 - DNA, 27 bp, Artificial Sequence
  Synthetic
ggtatcatacauatcaggaggcugaga

SEQ ID NO: 88517 - DNA, 25 bp, Artificial Sequence
  Synthetic
ttgugaacatctgtuaccagacaat

SEQ ID NO: 88518 - DNA, 22 bp, Artificial Sequence
  Synthetic
cacugatgtugccgaaaaggat

SEQ ID NO: 88519 - DNA, 27 bp, Artificial Sequence
  Synthetic
ctgttgttttauttccggtttaugcga

SEQ ID NO: 88520 - DNA, 28 bp, Artificial Sequence
  Synthetic
ggcggtaaauaaaaacctgtagaaaguc

SEQ ID NO: 88521 - DNA, 27 bp, Artificial Sequence
  Synthetic
acaagacagggutactatatucgggaa

SEQ ID NO: 88522 - DNA, 24 bp, Artificial Sequence
  Synthetic
gggaaaauttggacuccacaggaa

SEQ ID NO: 88523 - DNA, 21 bp, Artificial Sequence
  Synthetic
agcagauccaggagguggaat

SEQ ID NO: 88524 - DNA, 27 bp, Artificial Sequence
  Synthetic
gcaagatgatgucttctccacttucag

SEQ ID NO: 88525 - DNA, 28 bp, Artificial Sequence
  Synthetic
cctttaccacucggattatgaugaagat

SEQ ID NO: 88526 - DNA, 23 bp, Artificial Sequence
  Synthetic
tgttctccugaagcatgcugaag

SEQ ID NO: 88527 - DNA, 21 bp, Artificial Sequence
  Synthetic
augctgggagugacgaagaag

SEQ ID NO: 88528 - DNA, 21 bp, Artificial Sequence
  Synthetic
gctgtccgaguctgacaugat

SEQ ID NO: 88529 - DNA, 20 bp, Artificial Sequence
  Synthetic
cccccgccuttattcagcut

SEQ ID NO: 88530 - DNA, 26 bp, Artificial Sequence
  Synthetic
tggccaaccacaaaaauatccacuaa

SEQ ID NO: 88531 - DNA, 23 bp, Artificial Sequence
  Synthetic
ccaattacugcaggcactugaga

SEQ ID NO: 88532 - DNA, 28 bp, Artificial Sequence
  Synthetic
ctcaagttgagucaaatgctcatcauac

SEQ ID NO: 88533 - DNA, 27 bp, Artificial Sequence
  Synthetic
aagtatcagagucgggagagttttcua

SEQ ID NO: 88534 - DNA, 26 bp, Artificial Sequence
  Synthetic
cagcgtgaacutcatcatcaatctuc

SEQ ID NO: 88535 - DNA, 28 bp, Artificial Sequence
  Synthetic
tgtgcttattauagcatgatagcugcaa

SEQ ID NO: 88536 - DNA, 22 bp, Artificial Sequence
  Synthetic
acuggagcacgaaaaaggtugt

SEQ ID NO: 88537 - DNA, 27 bp, Artificial Sequence
  Synthetic
gcatggcaaccaagauaaagaactaut

SEQ ID NO: 88538 - DNA, 28 bp, Artificial Sequence
  Synthetic
actgttggcaagaauaaggtttacauca

SEQ ID NO: 88539 - DNA, 25 bp, Artificial Sequence
  Synthetic
agttccagatucttggccattucat

SEQ ID NO: 88540 - DNA, 20 bp, Artificial Sequence
  Synthetic
gccagcauccttcagtcgut

SEQ ID NO: 88541 - DNA, 21 bp, Artificial Sequence
  Synthetic
ctaaagctcugcgctgactuc

SEQ ID NO: 88542 - DNA, 25 bp, Artificial Sequence
  Synthetic
ctggctgacutctgattctacugag

SEQ ID NO: 88543 - DNA, 25 bp, Artificial Sequence
  Synthetic
cagaatttcgaccuggaaaagtgut

SEQ ID NO: 88544 - DNA, 24 bp, Artificial Sequence
  Synthetic
cagctggauagcagagaaaggaut

SEQ ID NO: 88545 - DNA, 26 bp, Artificial Sequence
  Synthetic
tgaagaggaaggaacuguacaacaac

SEQ ID NO: 88546 - DNA, 28 bp, Artificial Sequence
  Synthetic
caatgtcttcacaaucagcatcataguc

SEQ ID NO: 88547 - DNA, 26 bp, Artificial Sequence
  Synthetic
atgaaggguggattaggaguacagaa

SEQ ID NO: 88548 - DNA, 22 bp, Artificial Sequence
  Synthetic
cctcauacaggacactggctuc

SEQ ID NO: 88549 - DNA, 22 bp, Artificial Sequence
  Synthetic
gctgggugaggaagactcugat

SEQ ID NO: 88550 - DNA, 28 bp, Artificial Sequence
  Synthetic
tctatagctggaaaagucattcctcuca

SEQ ID NO: 88551 - DNA, 20 bp, Artificial Sequence
  Synthetic
ggtcgcggaucttcttcucc

SEQ ID NO: 88552 - DNA, 28 bp, Artificial Sequence
  Synthetic
ttggagatgttctuacgtatggtctcua

SEQ ID NO: 88553 - DNA, 23 bp, Artificial Sequence
  Synthetic
tcacccagaaaaugatggcagut

SEQ ID NO: 88554 - DNA, 22 bp, Artificial Sequence
  Synthetic
agactcugacagacgcugagat

SEQ ID NO: 88555 - DNA, 22 bp, Artificial Sequence
  Synthetic
ctgtcucagagaccaugggaga

SEQ ID NO: 88556 - DNA, 24 bp, Artificial Sequence
  Synthetic
gguccaaaaagatguaggaagcgt

SEQ ID NO: 88557 - DNA, 20 bp, Artificial Sequence
  Synthetic
agaugggaccucaggaagca

SEQ ID NO: 88558 - DNA, 25 bp, Artificial Sequence
  Synthetic
ggccccagacccautattttaauga

SEQ ID NO: 88559 - DNA, 25 bp, Artificial Sequence
  Synthetic
tccacuattcggugaaaaccaacaa

SEQ ID NO: 88560 - DNA, 23 bp, Artificial Sequence
  Synthetic
cactcaccugctgttttgtacuc

SEQ ID NO: 88561 - DNA, 26 bp, Artificial Sequence
  Synthetic
actattguggcagacaaatgtgugaa

SEQ ID NO: 88562 - DNA, 28 bp, Artificial Sequence
  Synthetic
ctcattgatguctgaatagtcuacagca

SEQ ID NO: 88563 - DNA, 26 bp, Artificial Sequence
  Synthetic
ttggatgatgagugtaagaagcacut

SEQ ID NO: 88564 - DNA, 24 bp, Artificial Sequence
  Synthetic
tgtactctugttggtttucaccga

SEQ ID NO: 88565 - DNA, 22 bp, Artificial Sequence
  Synthetic
acacacacaacuggagcagaug

SEQ ID NO: 88566 - DNA, 17 bp, Artificial Sequence
  Synthetic
accaacgcccucugcat

SEQ ID NO: 88567 - DNA, 17 bp, Artificial Sequence
  Synthetic
gguctcgtugggccagt

SEQ ID NO: 88568 - DNA, 21 bp, Artificial Sequence
  Synthetic
cagguggtgagaugccagaaa

SEQ ID NO: 88569 - DNA, 22 bp, Artificial Sequence
  Synthetic
tgacutcuacgacagacagcac

SEQ ID NO: 88570 - DNA, 28 bp, Artificial Sequence
  Synthetic
ccagttgtgtgugtctttctttatcuga

SEQ ID NO: 88571 - DNA, 31 bp, Artificial Sequence
  Synthetic
aggatgaaattuaattttctctccauccagt

SEQ ID NO: 88572 - DNA, 19 bp, Artificial Sequence
  Synthetic
cagaccutccggguggaac

SEQ ID NO: 88573 - DNA, 22 bp, Artificial Sequence
  Synthetic
tgaagagcgagcaccucattuc

SEQ ID NO: 88574 - DNA, 22 bp, Artificial Sequence
  Synthetic
ccgtgagutcagtgatuaggct

SEQ ID NO: 88575 - DNA, 21 bp, Artificial Sequence
  Synthetic
catctggagguggcccattua

SEQ ID NO: 88576 - DNA, 20 bp, Artificial Sequence
  Synthetic
cctacagcgaugcctgugaa

SEQ ID NO: 88577 - DNA, 24 bp, Artificial Sequence
  Synthetic
ctgatttccutttcggtgugagac

SEQ ID NO: 88578 - DNA, 33 bp, Artificial Sequence
  Synthetic
ttacttcatttcacautcaaaatgatagcuaca

SEQ ID NO: 88579 - DNA, 28 bp, Artificial Sequence
  Synthetic
cttggcugaatggaaauagagaagaaga

SEQ ID NO: 88580 - DNA, 21 bp, Artificial Sequence
  Synthetic
accctgtcccuctgatgtcut

SEQ ID NO: 88581 - DNA, 28 bp, Artificial Sequence
  Synthetic
gaatttcaauccagcaaggtgtttctut

SEQ ID NO: 88582 - DNA, 22 bp, Artificial Sequence
  Synthetic
ggtgtaaccautgggcggauac

SEQ ID NO: 88583 - DNA, 24 bp, Artificial Sequence
  Synthetic
tctataagugccagcacaucagac

SEQ ID NO: 88584 - DNA, 22 bp, Artificial Sequence
  Synthetic
tgcggagatuctcttcctcugt

SEQ ID NO: 88585 - DNA, 22 bp, Artificial Sequence
  Synthetic
aatgggacagguaggaccugat

SEQ ID NO: 88586 - DNA, 23 bp, Artificial Sequence
  Synthetic
cggatuacccaagacagagcauc

SEQ ID NO: 88587 - DNA, 21 bp, Artificial Sequence
  Synthetic
tuaagggccccaacgguaaaa

SEQ ID NO: 88588 - DNA, 26 bp, Artificial Sequence
  Synthetic
acagaagatagcucatgactcctgut

SEQ ID NO: 88589 - DNA, 24 bp, Artificial Sequence
  Synthetic
ggacttgctugattccaccctuac

SEQ ID NO: 88590 - DNA, 21 bp, Artificial Sequence
  Synthetic
gggatgugatgagagguggat

SEQ ID NO: 88591 - DNA, 23 bp, Artificial Sequence
  Synthetic
ccatcctcaccaucatcacacug

SEQ ID NO: 88592 - DNA, 28 bp, Artificial Sequence
  Synthetic
gtgaaataacagcutcgtaagtgcttua

SEQ ID NO: 88593 - DNA, 29 bp, Artificial Sequence
  Synthetic
gactggaagaacaaaugaatggctuaaaa

SEQ ID NO: 88594 - DNA, 20 bp, Artificial Sequence
  Synthetic
ggctccugacctggagtcut

SEQ ID NO: 88595 - DNA, 23 bp, Artificial Sequence
  Synthetic
ctcatctugggcctgtgttauct

SEQ ID NO: 88596 - DNA, 28 bp, Artificial Sequence
  Synthetic
aacgaaattgtguaaggatcatgtcuct

SEQ ID NO: 88597 - DNA, 24 bp, Artificial Sequence
  Synthetic
ccatccaactcugggtgtagatug

SEQ ID NO: 88598 - DNA, 18 bp, Artificial Sequence
  Synthetic
tctagguggctggucgga

SEQ ID NO: 88599 - DNA, 27 bp, Artificial Sequence
  Synthetic
aggtgatacaacucgttcgtagtgaua

SEQ ID NO: 88600 - DNA, 24 bp, Artificial Sequence
  Synthetic
ggtctgtttucagtgaccttggut

SEQ ID NO: 88601 - DNA, 20 bp, Artificial Sequence
  Synthetic
gcgagcuctctucaaacgga

SEQ ID NO: 88602 - DNA, 28 bp, Artificial Sequence
  Synthetic
aaaatgtgatagugtctgtgtgaaucca

SEQ ID NO: 88603 - DNA, 28 bp, Artificial Sequence
  Synthetic
tcgcgggctaucttccaaatttataaut

SEQ ID NO: 88604 - DNA, 20 bp, Artificial Sequence
  Synthetic
ggaatctuacccagccggut

SEQ ID NO: 88605 - DNA, 23 bp, Artificial Sequence
  Synthetic
ggccctcttuatagcttgtccut

SEQ ID NO: 88606 - DNA, 26 bp, Artificial Sequence
  Synthetic
aatctaacagaugccagcaauaacca

SEQ ID NO: 88607 - DNA, 20 bp, Artificial Sequence
  Synthetic
aggcaaacuggtggaagguc

SEQ ID NO: 88608 - DNA, 23 bp, Artificial Sequence
  Synthetic
ctgcagctgucctctgaaagaua

SEQ ID NO: 88609 - DNA, 25 bp, Artificial Sequence
  Synthetic
gaaagaccaccutctttuggaacag

SEQ ID NO: 88610 - DNA, 20 bp, Artificial Sequence
  Synthetic
ccaacgcacacuctctccuc

SEQ ID NO: 88611 - DNA, 21 bp, Artificial Sequence
  Synthetic
gctaaggccuatgccatcuca

SEQ ID NO: 88612 - DNA, 24 bp, Artificial Sequence
  Synthetic
agactggatgaugcaatccatgug

SEQ ID NO: 88613 - DNA, 21 bp, Artificial Sequence
  Synthetic
ctgaucgactgctugcaacaa

SEQ ID NO: 88614 - DNA, 25 bp, Artificial Sequence
  Synthetic
aaatttuggagaagggaagucggaa

SEQ ID NO: 88615 - DNA, 22 bp, Artificial Sequence
  Synthetic
ggtggaugaacgtgtccauacc

SEQ ID NO: 88616 - DNA, 18 bp, Artificial Sequence
  Synthetic
ggagggcgagcugatguc

SEQ ID NO: 88617 - DNA, 20 bp, Artificial Sequence
  Synthetic
gaguccagcacctcctucac

SEQ ID NO: 88618 - DNA, 27 bp, Artificial Sequence
  Synthetic
gcctggagttugacatcctctagauat

SEQ ID NO: 88619 - DNA, 22 bp, Artificial Sequence
  Synthetic
cgcctaucggaaagagcuagaa

SEQ ID NO: 88620 - DNA, 19 bp, Artificial Sequence
  Synthetic
gggaaggcuctuacggcaa

SEQ ID NO: 88621 - DNA, 21 bp, Artificial Sequence
  Synthetic
accccagcaagccauactuac

SEQ ID NO: 88622 - DNA, 20 bp, Artificial Sequence
  Synthetic
cuctuccacgaaagcgcaaa

SEQ ID NO: 88623 - DNA, 22 bp, Artificial Sequence
  Synthetic
gttgaccacutgtuccccaaga

SEQ ID NO: 88624 - DNA, 29 bp, Artificial Sequence
  Synthetic
gtcattgaaaggguattgaatcuaaacac

SEQ ID NO: 88625 - DNA, 23 bp, Artificial Sequence
  Synthetic
gccccaaaacauctctgtcacut

SEQ ID NO: 88626 - DNA, 27 bp, Artificial Sequence
  Synthetic
cagattttaaccccugtacctgttuca

SEQ ID NO: 88627 - DNA, 27 bp, Artificial Sequence
  Synthetic
tttagtucttggctagugaacaacact

SEQ ID NO: 88628 - DNA, 20 bp, Artificial Sequence
  Synthetic
caccggugtggctcttuaac

SEQ ID NO: 88629 - DNA, 22 bp, Artificial Sequence
  Synthetic
gctgtccgucaacatugagaga

SEQ ID NO: 88630 - DNA, 20 bp, Artificial Sequence
  Synthetic
gcagcaacutcacgagcaut

SEQ ID NO: 88631 - DNA, 28 bp, Artificial Sequence
  Synthetic
gatgggagtctguacagcttaaagatut

SEQ ID NO: 88632 - DNA, 25 bp, Artificial Sequence
  Synthetic
gtgctttcucaccatgtttcttugt

SEQ ID NO: 88633 - DNA, 27 bp, Artificial Sequence
  Synthetic
gcattttaacccagugctgagatgtua

SEQ ID NO: 88634 - DNA, 27 bp, Artificial Sequence
  Synthetic
catggcgtutatccagaatuagcaaat

SEQ ID NO: 88635 - DNA, 26 bp, Artificial Sequence
  Synthetic
cacaagcaucggtaactugacaaaaa

SEQ ID NO: 88636 - DNA, 24 bp, Artificial Sequence
  Synthetic
catccagaaugccatgcttuaact

SEQ ID NO: 88637 - DNA, 21 bp, Artificial Sequence
  Synthetic
gaaaggcgacguttttgtgug

SEQ ID NO: 88638 - DNA, 20 bp, Artificial Sequence
  Synthetic
cagaugagccucacgcacat

SEQ ID NO: 88639 - DNA, 23 bp, Artificial Sequence
  Synthetic
gggcaaguagagatggaacccua

SEQ ID NO: 88640 - DNA, 23 bp, Artificial Sequence
  Synthetic
gagatauccgtcccatucagcag

SEQ ID NO: 88641 - DNA, 24 bp, Artificial Sequence
  Synthetic
tgttgaggugcagatgtgattugt

SEQ ID NO: 88642 - DNA, 20 bp, Artificial Sequence
  Synthetic
ccgtggcauttagtcgugag

SEQ ID NO: 88643 - DNA, 21 bp, Artificial Sequence
  Synthetic
ccugaaaagacugcccccaaa

SEQ ID NO: 88644 - DNA, 21 bp, Artificial Sequence
  Synthetic
gagagcaggcacacuagtuga

SEQ ID NO: 88645 - DNA, 27 bp, Artificial Sequence
  Synthetic
cccctgtgttcutctcttccatttuag

SEQ ID NO: 88646 - DNA, 19 bp, Artificial Sequence
  Synthetic
cggcugaccccaaggtaug

SEQ ID NO: 88647 - DNA, 22 bp, Artificial Sequence
  Synthetic
caacttccttucctcccctgug

SEQ ID NO: 88648 - DNA, 22 bp, Artificial Sequence
  Synthetic
agacutttccucacccccaaag

SEQ ID NO: 88649 - DNA, 25 bp, Artificial Sequence
  Synthetic
tccagtcccauttggacattaugag

SEQ ID NO: 88650 - DNA, 28 bp, Artificial Sequence
  Synthetic
ggctattttcccuagtcttctcatucaa

SEQ ID NO: 88651 - DNA, 27 bp, Artificial Sequence
  Synthetic
agcagaaagattuggagatacaagcuc

SEQ ID NO: 88652 - DNA, 27 bp, Artificial Sequence
  Synthetic
cctgtctgaguagatctctgtgagtut

SEQ ID NO: 88653 - DNA, 28 bp, Artificial Sequence
  Synthetic
gtgaaggaataugcattaccaataggug

SEQ ID NO: 88654 - DNA, 22 bp, Artificial Sequence
  Synthetic
aggcaaggguctcctauacaca

SEQ ID NO: 88655 - DNA, 23 bp, Artificial Sequence
  Synthetic
gcctggaguccagttacaaugat

SEQ ID NO: 88656 - DNA, 18 bp, Artificial Sequence
  Synthetic
gcatgcgggutgttgugt

SEQ ID NO: 88657 - DNA, 19 bp, Artificial Sequence
  Synthetic
gggccaagcccuacaacug

SEQ ID NO: 88658 - DNA, 28 bp, Artificial Sequence
  Synthetic
tgggaagtugaagaaattctagcaugaa

SEQ ID NO: 88659 - DNA, 28 bp, Artificial Sequence
  Synthetic
gagcgagaacuggagattaaacttcuaa

SEQ ID NO: 88660 - DNA, 28 bp, Artificial Sequence
  Synthetic
ttcatctttggacaacugatcaatcugt

SEQ ID NO: 88661 - DNA, 28 bp, Artificial Sequence
  Synthetic
gcatgatutatctaaagcugaaacggaa

SEQ ID NO: 88662 - DNA, 20 bp, Artificial Sequence
  Synthetic
aggcctuctggcaguaggaa

SEQ ID NO: 88663 - DNA, 21 bp, Artificial Sequence
  Synthetic
ggcaggauccactccaagaug

SEQ ID NO: 88664 - DNA, 20 bp, Artificial Sequence
  Synthetic
ggcttgatgguctccgtgug

SEQ ID NO: 88665 - DNA, 22 bp, Artificial Sequence
  Synthetic
catccgucaagcaacgtcatut

SEQ ID NO: 88666 - DNA, 27 bp, Artificial Sequence
  Synthetic
auttaaagcacacauacacacacaaac

SEQ ID NO: 88667 - DNA, 26 bp, Artificial Sequence
  Synthetic
ggctattguagcagcaaagucaaaaa

SEQ ID NO: 88668 - DNA, 21 bp, Artificial Sequence
  Synthetic
gggcagauagctgagcattuc

SEQ ID NO: 88669 - DNA, 26 bp, Artificial Sequence
  Synthetic
cacattccccucccaaattcttcuaa

SEQ ID NO: 88670 - DNA, 17 bp, Artificial Sequence
  Synthetic
gcagccccguctgtguc

SEQ ID NO: 88671 - DNA, 18 bp, Artificial Sequence
  Synthetic
ggctcugagccacacuca

SEQ ID NO: 88672 - DNA, 21 bp, Artificial Sequence
  Synthetic
gcatgatcugggaagcgcaua

SEQ ID NO: 88673 - DNA, 28 bp, Artificial Sequence
  Synthetic
ctcaaattguagaaggagtgtgatucca

SEQ ID NO: 88674 - DNA, 21 bp, Artificial Sequence
  Synthetic
caggcataugctggtccctut

SEQ ID NO: 88675 - DNA, 22 bp, Artificial Sequence
  Synthetic
accaucatgaacugcacaagga

SEQ ID NO: 88676 - DNA, 20 bp, Artificial Sequence
  Synthetic
ccctacuctgggcuaacgct

SEQ ID NO: 88677 - DNA, 27 bp, Artificial Sequence
  Synthetic
aactctgtacctuttcctcttttcgut

SEQ ID NO: 88678 - DNA, 18 bp, Artificial Sequence
  Synthetic
gactcugcagcagcugga

SEQ ID NO: 88679 - DNA, 22 bp, Artificial Sequence
  Synthetic
ccatcuggagccccaagatuat

SEQ ID NO: 88680 - DNA, 18 bp, Artificial Sequence
  Synthetic
gccagggcaucucccaat

SEQ ID NO: 88681 - DNA, 18 bp, Artificial Sequence
  Synthetic
ccaaagggcugcaccuac

SEQ ID NO: 88682 - DNA, 28 bp, Artificial Sequence
  Synthetic
aacagatattuaccagctaagtgugcaa

SEQ ID NO: 88683 - DNA, 23 bp, Artificial Sequence
  Synthetic
ggaacagacugtgcaactucagt

SEQ ID NO: 88684 - DNA, 27 bp, Artificial Sequence
  Synthetic
cttgaagaacaaguggattggugaaat

SEQ ID NO: 88685 - DNA, 21 bp, Artificial Sequence
  Synthetic
gtagccctuggctctgacauc

SEQ ID NO: 88686 - DNA, 28 bp, Artificial Sequence
  Synthetic
cgctttgtgacutaactttttacaguga

SEQ ID NO: 88687 - DNA, 26 bp, Artificial Sequence
  Synthetic
cctcccctacuagaaaactctguacc

SEQ ID NO: 88688 - DNA, 28 bp, Artificial Sequence
  Synthetic
acctgaaaacaggaacugattttacugt

SEQ ID NO: 88689 - DNA, 25 bp, Artificial Sequence
  Synthetic
cttgtcttucaggagctgttuacct

SEQ ID NO: 88690 - DNA, 21 bp, Artificial Sequence
  Synthetic
cgtgaggagcauggttgttug

SEQ ID NO: 88691 - DNA, 24 bp, Artificial Sequence
  Synthetic
gccagatctcugtgcacaaaatug

SEQ ID NO: 88692 - DNA, 23 bp, Artificial Sequence
  Synthetic
acccatgguagctgtcactguat

SEQ ID NO: 88693 - DNA, 24 bp, Artificial Sequence
  Synthetic
gccaaaguacatctugaggcaagt

SEQ ID NO: 88694 - DNA, 23 bp, Artificial Sequence
  Synthetic
cctgacgaagucgtgaaagtuca

SEQ ID NO: 88695 - DNA, 32 bp, Artificial Sequence
  Synthetic
atattgaaatgattgaautccatggtgaauac

SEQ ID NO: 88696 - DNA, 27 bp, Artificial Sequence
  Synthetic
ccttaacagtcuggttaaacacctcut

SEQ ID NO: 88697 - DNA, 22 bp, Artificial Sequence
  Synthetic
acataagcaucagtggcugcat

SEQ ID NO: 88698 - DNA, 23 bp, Artificial Sequence
  Synthetic
tcaaugccauggaagggaagaaa

SEQ ID NO: 88699 - DNA, 22 bp, Artificial Sequence
  Synthetic
gaagagccuccttctgttucgt

SEQ ID NO: 88700 - DNA, 23 bp, Artificial Sequence
  Synthetic
tctcacugaggaccagaaacugt

SEQ ID NO: 88701 - DNA, 28 bp, Artificial Sequence
  Synthetic
aaatattttggtagaguttctgccacua

SEQ ID NO: 88702 - DNA, 22 bp, Artificial Sequence
  Synthetic
agcacccaaugaagagcaagut

SEQ ID NO: 88703 - DNA, 25 bp, Artificial Sequence
  Synthetic
caggttatttgccutttcccttgut

SEQ ID NO: 88704 - DNA, 22 bp, Artificial Sequence
  Synthetic
cctgtctacgutccctcacugt

SEQ ID NO: 88705 - DNA, 19 bp, Artificial Sequence
  Synthetic
cttgguccagacccaggug

SEQ ID NO: 88706 - DNA, 18 bp, Artificial Sequence
  Synthetic
cgtccgaacugccgucaa

SEQ ID NO: 88707 - DNA, 20 bp, Artificial Sequence
  Synthetic
caccaagcuttcctggctuc

SEQ ID NO: 88708 - DNA, 20 bp, Artificial Sequence
  Synthetic
cccacguacctuaggacagg

SEQ ID NO: 88709 - DNA, 24 bp, Artificial Sequence
  Synthetic
cagctaatcauccctggtttucca

SEQ ID NO: 88710 - DNA, 22 bp, Artificial Sequence
  Synthetic
ccacttgccaacutacccagua

SEQ ID NO: 88711 - DNA, 21 bp, Artificial Sequence
  Synthetic
ggtguacacagtguccaccaa

SEQ ID NO: 88712 - DNA, 18 bp, Artificial Sequence
  Synthetic
gtctgcagcucccgugaa

SEQ ID NO: 88713 - DNA, 17 bp, Artificial Sequence
  Synthetic
gggccccaucatgcugt

SEQ ID NO: 88714 - DNA, 19 bp, Artificial Sequence
  Synthetic
ggaactggcaucgccauga

SEQ ID NO: 88715 - DNA, 24 bp, Artificial Sequence
  Synthetic
ggacccgacaaaaccuaaagaugg

SEQ ID NO: 88716 - DNA, 17 bp, Artificial Sequence
  Synthetic
ccutccccuggagccat

SEQ ID NO: 88717 - DNA, 22 bp, Artificial Sequence
  Synthetic
ggatcccuaccttgtgcatcug

SEQ ID NO: 88718 - DNA, 20 bp, Artificial Sequence
  Synthetic
ggguacccucaggacaacat

SEQ ID NO: 88719 - DNA, 21 bp, Artificial Sequence
  Synthetic
acaccuccaacaagaaggcut

SEQ ID NO: 88720 - DNA, 23 bp, Artificial Sequence
  Synthetic
actguaggcaggatatuccagca

SEQ ID NO: 88721 - DNA, 22 bp, Artificial Sequence
  Synthetic
gacuttauacagccccgcagaa

SEQ ID NO: 88722 - DNA, 23 bp, Artificial Sequence
  Synthetic
ctgtttcucttgcaggugagact

SEQ ID NO: 88723 - DNA, 22 bp, Artificial Sequence
  Synthetic
cagaaacctggucaccctacuc

SEQ ID NO: 88724 - DNA, 19 bp, Artificial Sequence
  Synthetic
tgtgcacaccauaccucca

SEQ ID NO: 88725 - DNA, 21 bp, Artificial Sequence
  Synthetic
tgtguccagaccgtcctaugt

SEQ ID NO: 88726 - DNA, 23 bp, Artificial Sequence
  Synthetic
ggcaugaagtactuggaggagag

SEQ ID NO: 88727 - DNA, 28 bp, Artificial Sequence
  Synthetic
ctgctgctcugaatattagctaagtugt

SEQ ID NO: 88728 - DNA, 24 bp, Artificial Sequence
  Synthetic
gtctctcatcugactttaggcgut

SEQ ID NO: 88729 - DNA, 28 bp, Artificial Sequence
  Synthetic
gaaagcagtugcattgtacttugaagat

SEQ ID NO: 88730 - DNA, 26 bp, Artificial Sequence
  Synthetic
ctaggtatgtgugccatttacacugt

SEQ ID NO: 88731 - DNA, 25 bp, Artificial Sequence
  Synthetic
ctccctcagugatgtctttucaact

SEQ ID NO: 88732 - DNA, 17 bp, Artificial Sequence
  Synthetic
gagggccucagcacugg

SEQ ID NO: 88733 - DNA, 22 bp, Artificial Sequence
  Synthetic
ctcaccggagucattguagaca

SEQ ID NO: 88734 - DNA, 26 bp, Artificial Sequence
  Synthetic
ctgtcattcaagugaacagaggacut

SEQ ID NO: 88735 - DNA, 27 bp, Artificial Sequence
  Synthetic
aaacagctagugaaccaccatttauca

SEQ ID NO: 88736 - DNA, 24 bp, Artificial Sequence
  Synthetic
tcggaaaaugtactcagugaaggg

SEQ ID NO: 88737 - DNA, 24 bp, Artificial Sequence
  Synthetic
catcttctcugttgagccauccat

SEQ ID NO: 88738 - DNA, 20 bp, Artificial Sequence
  Synthetic
ggcaacgacuttgtguccat

SEQ ID NO: 88739 - DNA, 19 bp, Artificial Sequence
  Synthetic
ctcctcgugaccgaagcuc

SEQ ID NO: 88740 - DNA, 20 bp, Artificial Sequence
  Synthetic
caagcucttugcaccgacaa

SEQ ID NO: 88741 - DNA, 27 bp, Artificial Sequence
  Synthetic
ccccttcatucccagatttttcacuat

SEQ ID NO: 88742 - DNA, 24 bp, Artificial Sequence
  Synthetic
gattccccauggtttctactggut

SEQ ID NO: 88743 - DNA, 23 bp, Artificial Sequence
  Synthetic
gccutcagttgaauaggcacagg

SEQ ID NO: 88744 - DNA, 19 bp, Artificial Sequence
  Synthetic
ctcccgccgcugctaaaua

SEQ ID NO: 88745 - DNA, 24 bp, Artificial Sequence
  Synthetic
atgcttatucccccaggcauaaat

SEQ ID NO: 88746 - DNA, 20 bp, Artificial Sequence
  Synthetic
ccttcucaaggagcgtcugt

SEQ ID NO: 88747 - DNA, 18 bp, Artificial Sequence
  Synthetic
tcacguccccactcccut

SEQ ID NO: 88748 - DNA, 26 bp, Artificial Sequence
  Synthetic
ttggtgaaaaagauacgacactguca

SEQ ID NO: 88749 - DNA, 27 bp, Artificial Sequence
  Synthetic
gtaggaagacccagauttctttccaut

SEQ ID NO: 88750 - DNA, 21 bp, Artificial Sequence
  Synthetic
catctgggacucatgcctuca

SEQ ID NO: 88751 - DNA, 25 bp, Artificial Sequence
  Synthetic
gguggaatttagguggaacaaacct

SEQ ID NO: 88752 - DNA, 24 bp, Artificial Sequence
  Synthetic
guatatagcauccaaccgaaggca

SEQ ID NO: 88753 - DNA, 26 bp, Artificial Sequence
  Synthetic
ctacctgtcugcaaattgtgttgtut

SEQ ID NO: 88754 - DNA, 21 bp, Artificial Sequence
  Synthetic
cagaggcagcagcucttgaua

SEQ ID NO: 88755 - DNA, 23 bp, Artificial Sequence
  Synthetic
tgaactcactgugctctgtgtug

SEQ ID NO: 88756 - DNA, 28 bp, Artificial Sequence
  Synthetic
cggtagaaccaacucattctaaatgcut

SEQ ID NO: 88757 - DNA, 24 bp, Artificial Sequence
  Synthetic
tggtaggtaucacaggtgagucat

SEQ ID NO: 88758 - DNA, 28 bp, Artificial Sequence
  Synthetic
attttgttaacaccccautttcatgcut

SEQ ID NO: 88759 - DNA, 25 bp, Artificial Sequence
  Synthetic
ctctacctgugcctctactttucag

SEQ ID NO: 88760 - DNA, 24 bp, Artificial Sequence
  Synthetic
ggcctaaguttgtccctuaaggaa

SEQ ID NO: 88761 - DNA, 27 bp, Artificial Sequence
  Synthetic
cctgcggttauggtcattatcaaaauc

SEQ ID NO: 88762 - DNA, 21 bp, Artificial Sequence
  Synthetic
cacctgcuagagaccacugag

SEQ ID NO: 88763 - DNA, 24 bp, Artificial Sequence
  Synthetic
tccacagtgtcuttctccccatua

SEQ ID NO: 88764 - DNA, 21 bp, Artificial Sequence
  Synthetic
tcctcagacaucctcguccag

SEQ ID NO: 88765 - DNA, 26 bp, Artificial Sequence
  Synthetic
aaagaccatttugatgaggctguagt

SEQ ID NO: 88766 - DNA, 22 bp, Artificial Sequence
  Synthetic
ggagaggttucatgcctggaut

SEQ ID NO: 88767 - DNA, 29 bp, Artificial Sequence
  Synthetic
gttttgtccagguagttatgguaagagat

SEQ ID NO: 88768 - DNA, 21 bp, Artificial Sequence
  Synthetic
cggctgccuactcagatcuct

SEQ ID NO: 88769 - DNA, 22 bp, Artificial Sequence
  Synthetic
caccucatcuaacaccaccaca

SEQ ID NO: 88770 - DNA, 23 bp, Artificial Sequence
  Synthetic
actttgugccagggacttaagut

SEQ ID NO: 88771 - DNA, 24 bp, Artificial Sequence
  Synthetic
gacttggcgaaugtcagctttaut

SEQ ID NO: 88772 - DNA, 26 bp, Artificial Sequence
  Synthetic
ggaacaacugcagacatgatctacuc

SEQ ID NO: 88773 - DNA, 21 bp, Artificial Sequence
  Synthetic
gctggccauccaccataugat

SEQ ID NO: 88774 - DNA, 19 bp, Artificial Sequence
  Synthetic
ggaaggaccugcagcagua

SEQ ID NO: 88775 - DNA, 18 bp, Artificial Sequence
  Synthetic
ggcccagutggagaugcc

SEQ ID NO: 88776 - DNA, 24 bp, Artificial Sequence
  Synthetic
tcaatatacucacctgccucgact

SEQ ID NO: 88777 - DNA, 27 bp, Artificial Sequence
  Synthetic
gtgaccgguaggtagaattccaaauat

SEQ ID NO: 88778 - DNA, 21 bp, Artificial Sequence
  Synthetic
aattctucgggcttcgugact

SEQ ID NO: 88779 - DNA, 25 bp, Artificial Sequence
  Synthetic
ccagaaagaugtccaaagctuggat

SEQ ID NO: 88780 - DNA, 22 bp, Artificial Sequence
  Synthetic
gcauggaaacaggcaagauggt

SEQ ID NO: 88781 - DNA, 21 bp, Artificial Sequence
  Synthetic
tgacaaucaggcggaagtugg

SEQ ID NO: 88782 - DNA, 21 bp, Artificial Sequence
  Synthetic
gcaaagccutcacagaccuca

SEQ ID NO: 88783 - DNA, 24 bp, Artificial Sequence
  Synthetic
ccggatcacucaagcaataactuc

SEQ ID NO: 88784 - DNA, 22 bp, Artificial Sequence
  Synthetic
ggttccagugctgacagcatua

SEQ ID NO: 88785 - DNA, 28 bp, Artificial Sequence
  Synthetic
ggcagaaacucgtttatgagaaaaaugt

SEQ ID NO: 88786 - DNA, 19 bp, Artificial Sequence
  Synthetic
ggguagaagggcuggacga

SEQ ID NO: 88787 - DNA, 17 bp, Artificial Sequence
  Synthetic
gggaugcccucggcaaa

SEQ ID NO: 88788 - DNA, 28 bp, Artificial Sequence
  Synthetic
gutctctaaaaaccuaacccaggacaaa

SEQ ID NO: 88789 - DNA, 25 bp, Artificial Sequence
  Synthetic
caagtacaucacagactgttuccac

SEQ ID NO: 88790 - DNA, 24 bp, Artificial Sequence
  Synthetic
accatagctttuggaatgggcaut

SEQ ID NO: 88791 - DNA, 26 bp, Artificial Sequence
  Synthetic
gtgacaagaacuttgaagtccaucac

SEQ ID NO: 88792 - DNA, 20 bp, Artificial Sequence
  Synthetic
gggcttucctctgcttugga

SEQ ID NO: 88793 - DNA, 28 bp, Artificial Sequence
  Synthetic
cttataaagaggagagugggagtgauga

SEQ ID NO: 88794 - DNA, 24 bp, Artificial Sequence
  Synthetic
tcaauaacaggtacuggagcagga

SEQ ID NO: 88795 - DNA, 28 bp, Artificial Sequence
  Synthetic
gctgatttaugaaagccaacaaagcaut

SEQ ID NO: 88796 - DNA, 24 bp, Artificial Sequence
  Synthetic
ccacuggagagctcaaaaucagag

SEQ ID NO: 88797 - DNA, 20 bp, Artificial Sequence
  Synthetic
ccuccagcgaggaagaugag

SEQ ID NO: 88798 - DNA, 20 bp, Artificial Sequence
  Synthetic
cacaaaaaggucggctucgt

SEQ ID NO: 88799 - DNA, 21 bp, Artificial Sequence
  Synthetic
caaagtacccutggacucggt

SEQ ID NO: 88800 - DNA, 20 bp, Artificial Sequence
  Synthetic
ggugtccuagagcggagagt

SEQ ID NO: 88801 - DNA, 19 bp, Artificial Sequence
  Synthetic
tttccuaacgcgcccuacc

SEQ ID NO: 88802 - DNA, 21 bp, Artificial Sequence
  Synthetic
gttgccttcucctgcttguct

SEQ ID NO: 88803 - DNA, 21 bp, Artificial Sequence
  Synthetic
aaaccuttgcuaagggcacct

SEQ ID NO: 88804 - DNA, 22 bp, Artificial Sequence
  Synthetic
caggagattgguagagctgguc

SEQ ID NO: 88805 - DNA, 28 bp, Artificial Sequence
  Synthetic
ggatactggaaauagcctcaaacactut

SEQ ID NO: 88806 - DNA, 30 bp, Artificial Sequence
  Synthetic
gttatggcattauttagcatcacttugcat

SEQ ID NO: 88807 - DNA, 25 bp, Artificial Sequence
  Synthetic
cacaggaggaggcutcatttuagaa

SEQ ID NO: 88808 - DNA, 18 bp, Artificial Sequence
  Synthetic
gaatagcgggcuggcuct

SEQ ID NO: 88809 - DNA, 18 bp, Artificial Sequence
  Synthetic
cctgagcgccutcacugt

SEQ ID NO: 88810 - DNA, 28 bp, Artificial Sequence
  Synthetic
cctggttgaugaacaacttttccaatut

SEQ ID NO: 88811 - DNA, 27 bp, Artificial Sequence
  Synthetic
acaggcttaccuacttcaattgtugac

SEQ ID NO: 88812 - DNA, 22 bp, Artificial Sequence
  Synthetic
cagcctgtcuagtcagcaguaa

SEQ ID NO: 88813 - DNA, 24 bp, Artificial Sequence
  Synthetic
ggagaaagauggcctccugaaaaa

SEQ ID NO: 88814 - DNA, 20 bp, Artificial Sequence
  Synthetic
agugaacuggccggaaaagt

SEQ ID NO: 88815 - DNA, 18 bp, Artificial Sequence
  Synthetic
cggctuacgggtcgtugg

SEQ ID NO: 88816 - DNA, 23 bp, Artificial Sequence
  Synthetic
gctcctgttugatgaaggaguga

SEQ ID NO: 88817 - DNA, 17 bp, Artificial Sequence
  Synthetic
ctgtgcccugcctguga

SEQ ID NO: 88818 - DNA, 17 bp, Artificial Sequence
  Synthetic
gcacgucggagcccaut

SEQ ID NO: 88819 - DNA, 18 bp, Artificial Sequence
  Synthetic
gugccuacagcagccaga

SEQ ID NO: 88820 - DNA, 21 bp, Artificial Sequence
  Synthetic
gccacugacaaccaccctuaa

SEQ ID NO: 88821 - DNA, 26 bp, Artificial Sequence
  Synthetic
cgtgtggaguatttggaugacagaaa

SEQ ID NO: 88822 - DNA, 23 bp, Artificial Sequence
  Synthetic
ctcccttgtucctcttcccttug

SEQ ID NO: 88823 - DNA, 23 bp, Artificial Sequence
  Synthetic
ccaaggaaagautgacugcggat

SEQ ID NO: 88824 - DNA, 20 bp, Artificial Sequence
  Synthetic
gcgtcaaaugtcgggtucac

SEQ ID NO: 88825 - DNA, 21 bp, Artificial Sequence
  Synthetic
ccagcaccgugttgataucca

SEQ ID NO: 88826 - DNA, 22 bp, Artificial Sequence
  Synthetic
ggaacttcaguggcaaggauga

SEQ ID NO: 88827 - DNA, 23 bp, Artificial Sequence
  Synthetic
ccttcugagaaggcccaaagaug

SEQ ID NO: 88828 - DNA, 25 bp, Artificial Sequence
  Synthetic
agctgtaucaaagaagtcctgtgug

SEQ ID NO: 88829 - DNA, 25 bp, Artificial Sequence
  Synthetic
cgtctcctccauactaaccctguag

SEQ ID NO: 88830 - DNA, 22 bp, Artificial Sequence
  Synthetic
gaagtttcugaggagcctccug

SEQ ID NO: 88831 - DNA, 27 bp, Artificial Sequence
  Synthetic
ttctctagctggugacttaaccctaut

SEQ ID NO: 88832 - DNA, 24 bp, Artificial Sequence
  Synthetic
accaccacacuatgtcgaaaagug

SEQ ID NO: 88833 - DNA, 22 bp, Artificial Sequence
  Synthetic
aggcctcugattcctcacugat

SEQ ID NO: 88834 - DNA, 22 bp, Artificial Sequence
  Synthetic
ccagaguacacaggaaauccca

SEQ ID NO: 88835 - DNA, 25 bp, Artificial Sequence
  Synthetic
tctctgaaucaaggagtctcctgut

SEQ ID NO: 88836 - DNA, 22 bp, Artificial Sequence
  Synthetic
ccaugcagctgaucaaacagaa

SEQ ID NO: 88837 - DNA, 21 bp, Artificial Sequence
  Synthetic
aataatctccggcugctgguc

SEQ ID NO: 88838 - DNA, 24 bp, Artificial Sequence
  Synthetic
ccuataatatcagcugcacagcct

SEQ ID NO: 88839 - DNA, 27 bp, Artificial Sequence
  Synthetic
ttctggcaaacutacatccattguagt

SEQ ID NO: 88840 - DNA, 25 bp, Artificial Sequence
  Synthetic
tctctttuggttgttcauggagcat

SEQ ID NO: 88841 - DNA, 29 bp, Artificial Sequence
  Synthetic
gcgattatacaucaggaaguaaacaaacc

SEQ ID NO: 88842 - DNA, 23 bp, Artificial Sequence
  Synthetic
cttacgaaggaaggucttuggca

SEQ ID NO: 88843 - DNA, 25 bp, Artificial Sequence
  Synthetic
tttcagttcutctcggtguccaaat

SEQ ID NO: 88844 - DNA, 24 bp, Artificial Sequence
  Synthetic
ctgcatgcugttttctcugaaacc

SEQ ID NO: 88845 - DNA, 27 bp, Artificial Sequence
  Synthetic
aaagttactttggutcttttgctgcut

SEQ ID NO: 88846 - DNA, 26 bp, Artificial Sequence
  Synthetic
ctgcttcugctttttcttctucaagt

SEQ ID NO: 88847 - DNA, 28 bp, Artificial Sequence
  Synthetic
ctatattctggcuggtctgtatcttuca

SEQ ID NO: 88848 - DNA, 21 bp, Artificial Sequence
  Synthetic
ccgtttggagucagctggtut

SEQ ID NO: 88849 - DNA, 23 bp, Artificial Sequence
  Synthetic
tgtagagcttutcagcaacguca

SEQ ID NO: 88850 - DNA, 20 bp, Artificial Sequence
  Synthetic
ccggcuggagaagcactauc

SEQ ID NO: 88851 - DNA, 21 bp, Artificial Sequence
  Synthetic
cgagtgguagccgaugaagac

SEQ ID NO: 88852 - DNA, 21 bp, Artificial Sequence
  Synthetic
catggagcugacaggtgtcua

SEQ ID NO: 88853 - DNA, 21 bp, Artificial Sequence
  Synthetic
caggtugcactcgtaguccag

SEQ ID NO: 88854 - DNA, 23 bp, Artificial Sequence
  Synthetic
agatccugcagcagacattctuc

SEQ ID NO: 88855 - DNA, 22 bp, Artificial Sequence
  Synthetic
gutctgcaggtugagaagcaac

SEQ ID NO: 88856 - DNA, 19 bp, Artificial Sequence
  Synthetic
tgtccacgugatcgucacc

SEQ ID NO: 88857 - DNA, 17 bp, Artificial Sequence
  Synthetic
gcuctuggcgccacact

SEQ ID NO: 88858 - DNA, 23 bp, Artificial Sequence
  Synthetic
agctatgtgutatacccccucca

SEQ ID NO: 88859 - DNA, 21 bp, Artificial Sequence
  Synthetic
gggcaauccccaaagguacag

SEQ ID NO: 88860 - DNA, 20 bp, Artificial Sequence
  Synthetic
cctggacagucagcaccauc

SEQ ID NO: 88861 - DNA, 19 bp, Artificial Sequence
  Synthetic
aguatccgtuggccagcaa

SEQ ID NO: 88862 - DNA, 21 bp, Artificial Sequence
  Synthetic
ggtaacaagggucgttcuggt

SEQ ID NO: 88863 - DNA, 21 bp, Artificial Sequence
  Synthetic
agtgguccagaacgtccagua

SEQ ID NO: 88864 - DNA, 18 bp, Artificial Sequence
  Synthetic
ggtccacugccccctgua

SEQ ID NO: 88865 - DNA, 19 bp, Artificial Sequence
  Synthetic
ggcagtgguccagaacguc

SEQ ID NO: 88866 - DNA, 17 bp, Artificial Sequence
  Synthetic
gcccagcuccgggaaug

SEQ ID NO: 88867 - DNA, 19 bp, Artificial Sequence
  Synthetic
cctccaucctgcctgucct

SEQ ID NO: 88868 - DNA, 23 bp, Artificial Sequence
  Synthetic
agcuatcatgcugacccaaaaca

SEQ ID NO: 88869 - DNA, 28 bp, Artificial Sequence
  Synthetic
ccagttactcuatgagcgtttuaagagg

SEQ ID NO: 88870 - DNA, 20 bp, Artificial Sequence
  Synthetic
ggcacaaauacagccccuct

SEQ ID NO: 88871 - DNA, 22 bp, Artificial Sequence
  Synthetic
cagttcagcaggaucgattugg

SEQ ID NO: 88872 - DNA, 28 bp, Artificial Sequence
  Synthetic
tcccacaactcuttcatgtgtttaauct

SEQ ID NO: 88873 - DNA, 22 bp, Artificial Sequence
  Synthetic
caagcaagggaaaaugccaugt

SEQ ID NO: 88874 - DNA, 27 bp, Artificial Sequence
  Synthetic
agatcaaaguaacatggcatttuccct

SEQ ID NO: 88875 - DNA, 25 bp, Artificial Sequence
  Synthetic
gugagctucaggacagaaagaaagt

SEQ ID NO: 88876 - DNA, 22 bp, Artificial Sequence
  Synthetic
tgtgggacuttggacaacugag

SEQ ID NO: 88877 - DNA, 22 bp, Artificial Sequence
  Synthetic
ctgacaaagcugcactcatcut

SEQ ID NO: 88878 - DNA, 27 bp, Artificial Sequence
  Synthetic
tggttttgatuccaaatgcacatucat

SEQ ID NO: 88879 - DNA, 24 bp, Artificial Sequence
  Synthetic
gcugcaaaaccaaagatucagaca

SEQ ID NO: 88880 - DNA, 21 bp, Artificial Sequence
  Synthetic
gggacaggaaacucaggguct

SEQ ID NO: 88881 - DNA, 23 bp, Artificial Sequence
  Synthetic
gggtgacccauaactctctcugt

SEQ ID NO: 88882 - DNA, 22 bp, Artificial Sequence
  Synthetic
cttcaccagaaggugtcugagg

SEQ ID NO: 88883 - DNA, 25 bp, Artificial Sequence
  Synthetic
cctgaaggaaauctgcaaaggagut

SEQ ID NO: 88884 - DNA, 21 bp, Artificial Sequence
  Synthetic
cuttgatcacctugcggagga

SEQ ID NO: 88885 - DNA, 22 bp, Artificial Sequence
  Synthetic
cacccuccctctgcttuacaat

SEQ ID NO: 88886 - DNA, 19 bp, Artificial Sequence
  Synthetic
gacgtccuccaaggcuagg

SEQ ID NO: 88887 - DNA, 18 bp, Artificial Sequence
  Synthetic
agccgtgutcgtgctgut

SEQ ID NO: 88888 - DNA, 17 bp, Artificial Sequence
  Synthetic
cgcaccugagcagcuga

SEQ ID NO: 88889 - DNA, 18 bp, Artificial Sequence
  Synthetic
ccgggcgucatgtcucat

SEQ ID NO: 88890 - DNA, 18 bp, Artificial Sequence
  Synthetic
gccaucccgagctggtuc

SEQ ID NO: 88891 - DNA, 18 bp, Artificial Sequence
  Synthetic
gcgcagugctagcuccat

SEQ ID NO: 88892 - DNA, 20 bp, Artificial Sequence
  Synthetic
cuggagacccagcctttuct

SEQ ID NO: 88893 - DNA, 28 bp, Artificial Sequence
  Synthetic
cctttcaaaaccuatacccaagtcugat

SEQ ID NO: 88894 - DNA, 28 bp, Artificial Sequence
  Synthetic
gggttgctatcgutcaaagtacagtaua

SEQ ID NO: 88895 - DNA, 26 bp, Artificial Sequence
  Synthetic
tcaccacaccaagauaaactcatguc

SEQ ID NO: 88896 - DNA, 21 bp, Artificial Sequence
  Synthetic
gcagaggugttgctcagaugt

SEQ ID NO: 88897 - DNA, 28 bp, Artificial Sequence
  Synthetic
tcccaacagaaucttaaacttctcctuc

SEQ ID NO: 88898 - DNA, 28 bp, Artificial Sequence
  Synthetic
ctacctttugaacaaggtgtctguaaac

SEQ ID NO: 88899 - DNA, 26 bp, Artificial Sequence
  Synthetic
gacgagggucatcatattcuaagcat

SEQ ID NO: 88900 - DNA, 21 bp, Artificial Sequence
  Synthetic
ccctgctcuacctccactcua

SEQ ID NO: 88901 - DNA, 28 bp, Artificial Sequence
  Synthetic
ggacacttuagctgtgaaugaaaagaaa

SEQ ID NO: 88902 - DNA, 28 bp, Artificial Sequence
  Synthetic
gtagatttauaacgggaagcactacugt

SEQ ID NO: 88903 - DNA, 28 bp, Artificial Sequence
  Synthetic
acttagagauggaaagaagaggcaagua

SEQ ID NO: 88904 - DNA, 28 bp, Artificial Sequence
  Synthetic
ggaataatccacagucataactggcaua

SEQ ID NO: 88905 - DNA, 28 bp, Artificial Sequence
  Synthetic
gcatgctttcaucaaatggattucagaa

SEQ ID NO: 88906 - DNA, 21 bp, Artificial Sequence
  Synthetic
caaggccagcaaagguagtut

SEQ ID NO: 88907 - DNA, 23 bp, Artificial Sequence
  Synthetic
gcatgaccuctctctctgttuca

SEQ ID NO: 88908 - DNA, 28 bp, Artificial Sequence
  Synthetic
gggagaacaacaucttttaattgctuca

SEQ ID NO: 88909 - DNA, 27 bp, Artificial Sequence
  Synthetic
ttcctcttctuacagagaccuaaggac

SEQ ID NO: 88910 - DNA, 23 bp, Artificial Sequence
  Synthetic
cgcccatctutgtgagataccua

SEQ ID NO: 88911 - DNA, 23 bp, Artificial Sequence
  Synthetic
ccttcccccuatgagauggagat

SEQ ID NO: 88912 - DNA, 17 bp, Artificial Sequence
  Synthetic
ccctgcugcctctccut

SEQ ID NO: 88913 - DNA, 17 bp, Artificial Sequence
  Synthetic
cgctggcuggcatccut

SEQ ID NO: 88914 - DNA, 23 bp, Artificial Sequence
  Synthetic
ccaacaagcaaagautcaggcut

SEQ ID NO: 88915 - DNA, 23 bp, Artificial Sequence
  Synthetic
caaagacacagguagctcacuca

SEQ ID NO: 88916 - DNA, 26 bp, Artificial Sequence
  Synthetic
cactctctattucctgcctcctttut

SEQ ID NO: 88917 - DNA, 22 bp, Artificial Sequence
  Synthetic
gtgcaagcaccugaaauaagca

SEQ ID NO: 88918 - DNA, 28 bp, Artificial Sequence
  Synthetic
cacagctaaagugtccttaatggaatug

SEQ ID NO: 88919 - DNA, 27 bp, Artificial Sequence
  Synthetic
acaagtaccagautccctaacagauga

SEQ ID NO: 88920 - DNA, 20 bp, Artificial Sequence
  Synthetic
gggcagacucaccatcagua

SEQ ID NO: 88921 - DNA, 22 bp, Artificial Sequence
  Synthetic
ggatcttgtgauctgcccgtuc

SEQ ID NO: 88922 - DNA, 18 bp, Artificial Sequence
  Synthetic
acctcugccccctcctut

SEQ ID NO: 88923 - DNA, 18 bp, Artificial Sequence
  Synthetic
ggctguccgctcagagug

SEQ ID NO: 88924 - DNA, 28 bp, Artificial Sequence
  Synthetic
tccaagtcttttuctttgcacctacuaa

SEQ ID NO: 88925 - DNA, 20 bp, Artificial Sequence
  Synthetic
gggcagaauctgattuggca

SEQ ID NO: 88926 - DNA, 21 bp, Artificial Sequence
  Synthetic
tcagautcugccccaggagat

SEQ ID NO: 88927 - DNA, 29 bp, Artificial Sequence
  Synthetic
tccgaatttauaacacatgatagccauga

SEQ ID NO: 88928 - DNA, 28 bp, Artificial Sequence
  Synthetic
ctgccccaggagauccatttatattuaa

SEQ ID NO: 88929 - DNA, 30 bp, Artificial Sequence
  Synthetic
gctagatgaatugcctatttttaaguccga

SEQ ID NO: 88930 - DNA, 19 bp, Artificial Sequence
  Synthetic
agaacucagagggccugga

SEQ ID NO: 88931 - DNA, 19 bp, Artificial Sequence
  Synthetic
cgagggcugtgtccatgug

SEQ ID NO: 88932 - DNA, 20 bp, Artificial Sequence
  Synthetic
tgcccaatuccaccctugac

SEQ ID NO: 88933 - DNA, 25 bp, Artificial Sequence
  Synthetic
gcagaataggtutctcactgcacut

SEQ ID NO: 88934 - DNA, 25 bp, Artificial Sequence
  Synthetic
caccaccccutctaattgtgtuaca

SEQ ID NO: 88935 - DNA, 28 bp, Artificial Sequence
  Synthetic
agcaatgcaucaaccaataaccatttut

SEQ ID NO: 88936 - DNA, 29 bp, Artificial Sequence
  Synthetic
tcttggacttguaacatctaatggactuc

SEQ ID NO: 88937 - DNA, 24 bp, Artificial Sequence
  Synthetic
tggctagautcttctugggcaaaa

SEQ ID NO: 88938 - DNA, 28 bp, Artificial Sequence
  Synthetic
ggtctaaatacuagtgagttttcggugt

SEQ ID NO: 88939 - DNA, 20 bp, Artificial Sequence
  Synthetic
gaatggacggccutcctuca

SEQ ID NO: 88940 - DNA, 26 bp, Artificial Sequence
  Synthetic
agautgaataugaacacagagcacca

SEQ ID NO: 88941 - DNA, 20 bp, Artificial Sequence
  Synthetic
gctgtccucagcccaactua

SEQ ID NO: 88942 - DNA, 22 bp, Artificial Sequence
  Synthetic
cctgccaugctacctagauacc

SEQ ID NO: 88943 - DNA, 21 bp, Artificial Sequence
  Synthetic
gcactggccugaactgtugaa

SEQ ID NO: 88944 - DNA, 26 bp, Artificial Sequence
  Synthetic
gaaggtataguggagtaggguaagca

SEQ ID NO: 88945 - DNA, 27 bp, Artificial Sequence
  Synthetic
gaaataggucagaaaaccagtgtcuct

SEQ ID NO: 88946 - DNA, 26 bp, Artificial Sequence
  Synthetic
ggagtatcacuttgcttttcatugcc

SEQ ID NO: 88947 - DNA, 23 bp, Artificial Sequence
  Synthetic
gaccaatgtucaaaggtgtugct

SEQ ID NO: 88948 - DNA, 21 bp, Artificial Sequence
  Synthetic
caatcaugggagccgaaaugg

SEQ ID NO: 88949 - DNA, 29 bp, Artificial Sequence
  Synthetic
tgaaataggatuaggatcaggacugaaca

SEQ ID NO: 88950 - DNA, 23 bp, Artificial Sequence
  Synthetic
agcttcctugctttaagtugcct

SEQ ID NO: 88951 - DNA, 25 bp, Artificial Sequence
  Synthetic
catcttggaagcauaagctctcuca

SEQ ID NO: 88952 - DNA, 22 bp, Artificial Sequence
  Synthetic
gtgtaggaguctgcctgttuga

SEQ ID NO: 88953 - DNA, 29 bp, Artificial Sequence
  Synthetic
tctttggacacaautcttcattagctuga

SEQ ID NO: 88954 - DNA, 22 bp, Artificial Sequence
  Synthetic
gccagaccuaagagcaaucagt

SEQ ID NO: 88955 - DNA, 22 bp, Artificial Sequence
  Synthetic
ggccatcuacaagcagucacag

SEQ ID NO: 88956 - DNA, 25 bp, Artificial Sequence
  Synthetic
attctgtcagcautactctgtgucc

SEQ ID NO: 88957 - DNA, 27 bp, Artificial Sequence
  Synthetic
ggacucgccagagacatctauaaaaat

SEQ ID NO: 88958 - DNA, 24 bp, Artificial Sequence
  Synthetic
ccagaatgaggugcagaacaucaa

SEQ ID NO: 88959 - DNA, 21 bp, Artificial Sequence
  Synthetic
gatgtagctgugcatgtccug

SEQ ID NO: 88960 - DNA, 27 bp, Artificial Sequence
  Synthetic
ctgattaaatcuggctggtuccaaaac

SEQ ID NO: 88961 - DNA, 25 bp, Artificial Sequence
  Synthetic
tctgaaattucccagaatgcacuga

SEQ ID NO: 88962 - DNA, 20 bp, Artificial Sequence
  Synthetic
cccacauaccacacgtgcuc

SEQ ID NO: 88963 - DNA, 23 bp, Artificial Sequence
  Synthetic
gctacgagaucaaggaggacauc

SEQ ID NO: 88964 - DNA, 18 bp, Artificial Sequence
  Synthetic
ccagtguccccucggaga

SEQ ID NO: 88965 - DNA, 20 bp, Artificial Sequence
  Synthetic
tgcauggagcagaggugaac

SEQ ID NO: 88966 - DNA, 22 bp, Artificial Sequence
  Synthetic
gaggagaaggaggaugcagaug

SEQ ID NO: 88967 - DNA, 19 bp, Artificial Sequence
  Synthetic
ccagcacgagcguatggua

SEQ ID NO: 88968 - DNA, 26 bp, Artificial Sequence
  Synthetic
ttaguaaagaaggcaaaagaggugct

SEQ ID NO: 88969 - DNA, 27 bp, Artificial Sequence
  Synthetic
gactgccctugttcttttacatttuca

SEQ ID NO: 88970 - DNA, 23 bp, Artificial Sequence
  Synthetic
acagaatcucagagcctcaucct

SEQ ID NO: 88971 - DNA, 28 bp, Artificial Sequence
  Synthetic
acttgtgagaggccuataaactggtaua

SEQ ID NO: 88972 - DNA, 20 bp, Artificial Sequence
  Synthetic
cccugggauggaggacagat

SEQ ID NO: 88973 - DNA, 19 bp, Artificial Sequence
  Synthetic
ggagcgacutctcctccug

SEQ ID NO: 88974 - DNA, 24 bp, Artificial Sequence
  Synthetic
gccttugggcaaaaatcgacuaga

SEQ ID NO: 88975 - DNA, 28 bp, Artificial Sequence
  Synthetic
actgtgcaguccatttgaaagtaacuat

SEQ ID NO: 88976 - DNA, 24 bp, Artificial Sequence
  Synthetic
agaacagccgaccacuataguaca

SEQ ID NO: 88977 - DNA, 25 bp, Artificial Sequence
  Synthetic
accacuccagaaacacacactaaut

SEQ ID NO: 88978 - DNA, 20 bp, Artificial Sequence
  Synthetic
ctctucacagaggcugagca

SEQ ID NO: 88979 - DNA, 20 bp, Artificial Sequence
  Synthetic
cccttcccuctggctctcut

SEQ ID NO: 88980 - DNA, 23 bp, Artificial Sequence
  Synthetic
gactctttuctgttgcctugcag

SEQ ID NO: 88981 - DNA, 24 bp, Artificial Sequence
  Synthetic
tggacutttccttguacccaacaa

SEQ ID NO: 88982 - DNA, 24 bp, Artificial Sequence
  Synthetic
gtcctttctagucgtcctcaguct

SEQ ID NO: 88983 - DNA, 20 bp, Artificial Sequence
  Synthetic
agaggagcuggacttgcuca

SEQ ID NO: 88984 - DNA, 22 bp, Artificial Sequence
  Synthetic
cgtcatcguctgctgctgtuat

SEQ ID NO: 88985 - DNA, 26 bp, Artificial Sequence
  Synthetic
ttcagaattgcugacagagcauagaa

SEQ ID NO: 88986 - DNA, 21 bp, Artificial Sequence
  Synthetic
cctcacaaccuccgtcatgug

SEQ ID NO: 88987 - DNA, 25 bp, Artificial Sequence
  Synthetic
caactctgtcuccttcctcttccua

SEQ ID NO: 88988 - DNA, 20 bp, Artificial Sequence
  Synthetic
tctgtggaccuctcctucca

SEQ ID NO: 88989 - DNA, 18 bp, Artificial Sequence
  Synthetic
agcacttuccccguccag

SEQ ID NO: 88990 - DNA, 24 bp, Artificial Sequence
  Synthetic
caaagattacugggcagtcaggut

SEQ ID NO: 88991 - DNA, 22 bp, Artificial Sequence
  Synthetic
caggaggacacugauaaagcca

SEQ ID NO: 88992 - DNA, 18 bp, Artificial Sequence
  Synthetic
cccggucacagucaggga

SEQ ID NO: 88993 - DNA, 18 bp, Artificial Sequence
  Synthetic
tcttgccccugcgtgaug

SEQ ID NO: 88994 - DNA, 27 bp, Artificial Sequence
  Synthetic
ctctctcaaguacagatgattgctugt

SEQ ID NO: 88995 - DNA, 28 bp, Artificial Sequence
  Synthetic
tggtggtgttugagtattgtatgtctut

SEQ ID NO: 88996 - DNA, 22 bp, Artificial Sequence
  Synthetic
cgaggtuacaccatcuccgact

SEQ ID NO: 88997 - DNA, 17 bp, Artificial Sequence
  Synthetic
ccgcaggagagguguca

SEQ ID NO: 88998 - DNA, 21 bp, Artificial Sequence
  Synthetic
cgctugcacactgaguaggag

SEQ ID NO: 88999 - DNA, 21 bp, Artificial Sequence
  Synthetic
ccacattcugtgtgcgtguag

SEQ ID NO: 89000 - DNA, 28 bp, Artificial Sequence
  Synthetic
ggccttccccuctctttctatagtaauc

SEQ ID NO: 89001 - DNA, 22 bp, Artificial Sequence
  Synthetic
ggcagcuagaaattgccttgut

SEQ ID NO: 89002 - DNA, 22 bp, Artificial Sequence
  Synthetic
tcgagtgggaautcctggguaa

SEQ ID NO: 89003 - DNA, 22 bp, Artificial Sequence
  Synthetic
cagugactgatuccccagagag

SEQ ID NO: 89004 - DNA, 33 bp, Artificial Sequence
  Synthetic
tctatggctgttatucagatatttaagtagaug

SEQ ID NO: 89005 - DNA, 27 bp, Artificial Sequence
  Synthetic
tcaacagtatgugggttcaatuccaat

SEQ ID NO: 89006 - DNA, 24 bp, Artificial Sequence
  Synthetic
tggactgguatagtcttucacgga

SEQ ID NO: 89007 - DNA, 28 bp, Artificial Sequence
  Synthetic
acctactagggcuacttctttgattuct

SEQ ID NO: 89008 - DNA, 28 bp, Artificial Sequence
  Synthetic
ctctctgagguattgtaatgcttcauca

SEQ ID NO: 89009 - DNA, 26 bp, Artificial Sequence
  Synthetic
auactccaugaacagccaaaagagaa

SEQ ID NO: 89010 - DNA, 21 bp, Artificial Sequence
  Synthetic
ccagagacutgtggagctuca

SEQ ID NO: 89011 - DNA, 21 bp, Artificial Sequence
  Synthetic
acatguaagggagagctugga

SEQ ID NO: 89012 - DNA, 24 bp, Artificial Sequence
  Synthetic
gactacaguagatgtggtcauggg

SEQ ID NO: 89013 - DNA, 28 bp, Artificial Sequence
  Synthetic
actaaaatctcctutcacgtgatcagut

SEQ ID NO: 89014 - DNA, 22 bp, Artificial Sequence
  Synthetic
gaagagaauctgggugacagca

SEQ ID NO: 89015 - DNA, 26 bp, Artificial Sequence
  Synthetic
gtcaaaagctugtagagtctctucct

SEQ ID NO: 89016 - DNA, 26 bp, Artificial Sequence
  Synthetic
guggacacaaaacaagaaaucacagt

SEQ ID NO: 89017 - DNA, 29 bp, Artificial Sequence
  Synthetic
acatgtttaatgccauttcttacggttug

SEQ ID NO: 89018 - DNA, 21 bp, Artificial Sequence
  Synthetic
tcctctccaccuaaccagugt

SEQ ID NO: 89019 - DNA, 22 bp, Artificial Sequence
  Synthetic
cctgagagtuagtgctgacucc

SEQ ID NO: 89020 - DNA, 21 bp, Artificial Sequence
  Synthetic
ccaucaagagaucggcggaaa

SEQ ID NO: 89021 - DNA, 26 bp, Artificial Sequence
  Synthetic
atcatguggacaaaatugcccaaaat

SEQ ID NO: 89022 - DNA, 28 bp, Artificial Sequence
  Synthetic
ttcacactccaucataaatcatcaugct

SEQ ID NO: 89023 - DNA, 28 bp, Artificial Sequence
  Synthetic
cacttgctccaaugttaatctcctauct

SEQ ID NO: 89024 - DNA, 29 bp, Artificial Sequence
  Synthetic
aagaaacgaaccaaauctccaaaattgut

SEQ ID NO: 89025 - DNA, 28 bp, Artificial Sequence
  Synthetic
tccaatgtctugccgaattcttcaauat

SEQ ID NO: 89026 - DNA, 23 bp, Artificial Sequence
  Synthetic
gccagugagaaactatcctugct

SEQ ID NO: 89027 - DNA, 22 bp, Artificial Sequence
  Synthetic
aaagagcuggcaaccaaagtug

SEQ ID NO: 89028 - DNA, 22 bp, Artificial Sequence
  Synthetic
catatgcauggccccaatcuca

SEQ ID NO: 89029 - DNA, 25 bp, Artificial Sequence
  Synthetic
ggccttggugaaaatagcauagagg

SEQ ID NO: 89030 - DNA, 27 bp, Artificial Sequence
  Synthetic
gtacactguttaccagcugaaacaaat

SEQ ID NO: 89031 - DNA, 24 bp, Artificial Sequence
  Synthetic
ctccccttgagaugatcacaacuc

SEQ ID NO: 89032 - DNA, 27 bp, Artificial Sequence
  Synthetic
caagcatccacaaagucacatgaauat

SEQ ID NO: 89033 - DNA, 27 bp, Artificial Sequence
  Synthetic
cacttcattatttcutggtggcaacug

SEQ ID NO: 89034 - DNA, 28 bp, Artificial Sequence
  Synthetic
gttgttattucagaccaaaaccttgugt

SEQ ID NO: 89035 - DNA, 23 bp, Artificial Sequence
  Synthetic
gactaatcuggaaggcctugcat

SEQ ID NO: 89036 - DNA, 28 bp, Artificial Sequence
  Synthetic
tcttgacaatugttccaatgattugcat

SEQ ID NO: 89037 - DNA, 26 bp, Artificial Sequence
  Synthetic
caacatcttccucaatttgggtaugg

SEQ ID NO: 89038 - DNA, 26 bp, Artificial Sequence
  Synthetic
gctatgagctcugttgctactgauat

SEQ ID NO: 89039 - DNA, 27 bp, Artificial Sequence
  Synthetic
tggttgatcaccutcattgtgtauact

SEQ ID NO: 89040 - DNA, 22 bp, Artificial Sequence
  Synthetic
cccagaguccttaaccugcaat

SEQ ID NO: 89041 - DNA, 28 bp, Artificial Sequence
  Synthetic
atcacaatcaugttgcttttcuaaaccc

SEQ ID NO: 89042 - DNA, 22 bp, Artificial Sequence
  Synthetic
gaucattggtttuggccaggag

SEQ ID NO: 89043 - DNA, 28 bp, Artificial Sequence
  Synthetic
caattctcaggaacutgtagcccatuat

SEQ ID NO: 89044 - DNA, 29 bp, Artificial Sequence
  Synthetic
cgttcaaccaaguctcttatcgttaauga

SEQ ID NO: 89045 - DNA, 25 bp, Artificial Sequence
  Synthetic
agctattaagcaaacuggctgtuct

SEQ ID NO: 89046 - DNA, 27 bp, Artificial Sequence
  Synthetic
cagatgatctaucatgtcaggaugcaa

SEQ ID NO: 89047 - DNA, 24 bp, Artificial Sequence
  Synthetic
aggcttgtuggtgtacttucaact

SEQ ID NO: 89048 - DNA, 25 bp, Artificial Sequence
  Synthetic
gcgacatttggauagcatcgaaaut

SEQ ID NO: 89049 - DNA, 24 bp, Artificial Sequence
  Synthetic
ctgagtgaguggtggaaatacugt

SEQ ID NO: 89050 - DNA, 27 bp, Artificial Sequence
  Synthetic
cagttgacacaacutgcttcgataaut

SEQ ID NO: 89051 - DNA, 27 bp, Artificial Sequence
  Synthetic
acttgaaggtgguttctgttgtatugt

SEQ ID NO: 89052 - DNA, 26 bp, Artificial Sequence
  Synthetic
ggtatctctcaugaaacaccctuacc

SEQ ID NO: 89053 - DNA, 21 bp, Artificial Sequence
  Synthetic
tttctgtgcacugtccacugt

SEQ ID NO: 89054 - DNA, 24 bp, Artificial Sequence
  Synthetic
ccttcctgutcctccaaauccaat

SEQ ID NO: 89055 - DNA, 27 bp, Artificial Sequence
  Synthetic
ctgagtttgatgaugattgaggagugt

SEQ ID NO: 89056 - DNA, 21 bp, Artificial Sequence
  Synthetic
gggagtttugccaaggcctua

SEQ ID NO: 89057 - DNA, 22 bp, Artificial Sequence
  Synthetic
ccagtgttagugccatcagcuc

SEQ ID NO: 89058 - DNA, 22 bp, Artificial Sequence
  Synthetic
tgagtucaacccgtgugaagac

SEQ ID NO: 89059 - DNA, 23 bp, Artificial Sequence
  Synthetic
tgtagtggcuggtgaggagaaua

SEQ ID NO: 89060 - DNA, 28 bp, Artificial Sequence
  Synthetic
ccaaatccaaaaaggutccactttcuaa

SEQ ID NO: 89061 - DNA, 21 bp, Artificial Sequence
  Synthetic
aaggactugggtgtctugcat

SEQ ID NO: 89062 - DNA, 26 bp, Artificial Sequence
  Synthetic
cagcaaaaauacaaucaggagaaggg

SEQ ID NO: 89063 - DNA, 27 bp, Artificial Sequence
  Synthetic
ttgataacttacaacugtgggcttcut

SEQ ID NO: 89064 - DNA, 28 bp, Artificial Sequence
  Synthetic
ttttcctactcugtagctatgtcucgat

SEQ ID NO: 89065 - DNA, 24 bp, Artificial Sequence
  Synthetic
ttccagggcutaaagtcttgacug

SEQ ID NO: 89066 - DNA, 25 bp, Artificial Sequence
  Synthetic
gcactcagaaaaugattcggtucca

SEQ ID NO: 89067 - DNA, 26 bp, Artificial Sequence
  Synthetic
ccactgtggguagggatattgatcut

SEQ ID NO: 89068 - DNA, 23 bp, Artificial Sequence
  Synthetic
cgagguccattaugcaacccaaa

SEQ ID NO: 89069 - DNA, 24 bp, Artificial Sequence
  Synthetic
ttcccgtuggattccgtttuaaga

SEQ ID NO: 89070 - DNA, 24 bp, Artificial Sequence
  Synthetic
acttaactccugtgccaatccaut

SEQ ID NO: 89071 - DNA, 28 bp, Artificial Sequence
  Synthetic
gtgggtaacctuttgaacctgaatauca

SEQ ID NO: 89072 - DNA, 22 bp, Artificial Sequence
  Synthetic
cttgcaguccagggtgctauac

SEQ ID NO: 89073 - DNA, 23 bp, Artificial Sequence
  Synthetic
gtgttagcuggcaggaagctuat

SEQ ID NO: 89074 - DNA, 23 bp, Artificial Sequence
  Synthetic
gagccaacaaaaaugtggcauca

SEQ ID NO: 89075 - DNA, 21 bp, Artificial Sequence
  Synthetic
ctgcuccagctcttgucagaa

SEQ ID NO: 89076 - DNA, 25 bp, Artificial Sequence
  Synthetic
gttgggtucacgagtagaatctcut

SEQ ID NO: 89077 - DNA, 28 bp, Artificial Sequence
  Synthetic
tttattacagagguaggagacguagacc

SEQ ID NO: 89078 - DNA, 24 bp, Artificial Sequence
  Synthetic
agagaaggaugaggaaucagagca

SEQ ID NO: 89079 - DNA, 25 bp, Artificial Sequence
  Synthetic
cgtgttgcaugaactttgttttucc

SEQ ID NO: 89080 - DNA, 28 bp, Artificial Sequence
  Synthetic
gttcatccagttutggaacatcagaaut

SEQ ID NO: 89081 - DNA, 24 bp, Artificial Sequence
  Synthetic
agaacacaugcacacaagtacuca

SEQ ID NO: 89082 - DNA, 24 bp, Artificial Sequence
  Synthetic
ttggtcccaaagagutgaggatuc

SEQ ID NO: 89083 - DNA, 21 bp, Artificial Sequence
  Synthetic
cacacugtgtccugagcaaac

SEQ ID NO: 89084 - DNA, 19 bp, Artificial Sequence
  Synthetic
cuaaaccacccgugccagt

SEQ ID NO: 89085 - DNA, 22 bp, Artificial Sequence
  Synthetic
cttcguagcgccattguaaacc

SEQ ID NO: 89086 - DNA, 21 bp, Artificial Sequence
  Synthetic
agagtccugtaccacucacga

SEQ ID NO: 89087 - DNA, 24 bp, Artificial Sequence
  Synthetic
cccttgtgaguccattaccttuca

SEQ ID NO: 89088 - DNA, 21 bp, Artificial Sequence
  Synthetic
gggcaatguctttgtccugct

SEQ ID NO: 89089 - DNA, 24 bp, Artificial Sequence
  Synthetic
gcatggttguagtactcagaguga

SEQ ID NO: 89090 - DNA, 20 bp, Artificial Sequence
  Synthetic
cacttggcugccctguagag

SEQ ID NO: 89091 - DNA, 22 bp, Artificial Sequence
  Synthetic
ccaatcttcugagatgcuccgt

SEQ ID NO: 89092 - DNA, 20 bp, Artificial Sequence
  Synthetic
cagtgggaugggaccatgug

SEQ ID NO: 89093 - DNA, 28 bp, Artificial Sequence
  Synthetic
acctcgatuccattatcatttacugcaa

SEQ ID NO: 89094 - DNA, 27 bp, Artificial Sequence
  Synthetic
tctgagacaggaacugttaatgtccua

SEQ ID NO: 89095 - DNA, 26 bp, Artificial Sequence
  Synthetic
cauagaggacaacacaguaagaacca

SEQ ID NO: 89096 - DNA, 17 bp, Artificial Sequence
  Synthetic
gugcaggcaggtucgga

SEQ ID NO: 89097 - DNA, 19 bp, Artificial Sequence
  Synthetic
gctcctcaucaggcacugt

SEQ ID NO: 89098 - DNA, 21 bp, Artificial Sequence
  Synthetic
accaacugtggtgaaugcact

SEQ ID NO: 89099 - DNA, 21 bp, Artificial Sequence
  Synthetic
gcccctugactgtttgctuac

SEQ ID NO: 89100 - DNA, 24 bp, Artificial Sequence
  Synthetic
cacagatgugggaccuaggaaaag

SEQ ID NO: 89101 - DNA, 26 bp, Artificial Sequence
  Synthetic
tgacaaacagaaagaugggtgaaugt

SEQ ID NO: 89102 - DNA, 25 bp, Artificial Sequence
  Synthetic
aatgauaccagtggtuccccaaaaa

SEQ ID NO: 89103 - DNA, 27 bp, Artificial Sequence
  Synthetic
tgggatccagguaagaatcagauaact

SEQ ID NO: 89104 - DNA, 21 bp, Artificial Sequence
  Synthetic
ggutccuccaaagaacagcac

SEQ ID NO: 89105 - DNA, 23 bp, Artificial Sequence
  Synthetic
ttctgagattuggccttgctuct

SEQ ID NO: 89106 - DNA, 28 bp, Artificial Sequence
  Synthetic
caatgtagaaaaugagaagcaggtucat

SEQ ID NO: 89107 - DNA, 23 bp, Artificial Sequence
  Synthetic
ctctgtcugatttgcuaggacca

SEQ ID NO: 89108 - DNA, 21 bp, Artificial Sequence
  Synthetic
gaaactgctuggctcttggug

SEQ ID NO: 89109 - DNA, 22 bp, Artificial Sequence
  Synthetic
caaaggccugtccuaggaaaga

SEQ ID NO: 89110 - DNA, 28 bp, Artificial Sequence
  Synthetic
caccaaaacttaaucactgtccatctut

SEQ ID NO: 89111 - DNA, 23 bp, Artificial Sequence
  Synthetic
catgtgacttugtggatgctugg

SEQ ID NO: 89112 - DNA, 28 bp, Artificial Sequence
  Synthetic
ccaactcacataucaactcagctacuaa

SEQ ID NO: 89113 - DNA, 28 bp, Artificial Sequence
  Synthetic
tgagcaatacttutattggtgtcaauct

SEQ ID NO: 89114 - DNA, 20 bp, Artificial Sequence
  Synthetic
ctgtgtcaucgtgcctggua

SEQ ID NO: 89115 - DNA, 17 bp, Artificial Sequence
  Synthetic
gggtcucacaggccuct

SEQ ID NO: 89116 - DNA, 27 bp, Artificial Sequence
  Synthetic
accattggatucactcagcttattuca

SEQ ID NO: 89117 - DNA, 19 bp, Artificial Sequence
  Synthetic
tcgccugccatcacgtuag

SEQ ID NO: 89118 - DNA, 26 bp, Artificial Sequence
  Synthetic
gattgaaaacucccatcuaaccccaa

SEQ ID NO: 89119 - DNA, 28 bp, Artificial Sequence
  Synthetic
catgggatuggaatgcatatucaagaaa

SEQ ID NO: 89120 - DNA, 22 bp, Artificial Sequence
  Synthetic
tccttcaccaaguttgcauggt

SEQ ID NO: 89121 - DNA, 28 bp, Artificial Sequence
  Synthetic
gccaatcctaugcagtctcataacttua

SEQ ID NO: 89122 - DNA, 22 bp, Artificial Sequence
  Synthetic
agcaacggugtggtacttuagg

SEQ ID NO: 89123 - DNA, 28 bp, Artificial Sequence
  Synthetic
acccttcatctacuacactgatatggut

SEQ ID NO: 89124 - DNA, 28 bp, Artificial Sequence
  Synthetic
tctcatttgtatugttaccacggcuaaa

SEQ ID NO: 89125 - DNA, 27 bp, Artificial Sequence
  Synthetic
atgaaatagugaaagaaguggaagcca

SEQ ID NO: 89126 - DNA, 22 bp, Artificial Sequence
  Synthetic
ggtauagcccaactctcucagg

SEQ ID NO: 89127 - DNA, 25 bp, Artificial Sequence
  Synthetic
tcttctttuccaaagtcgguagcaa

SEQ ID NO: 89128 - DNA, 22 bp, Artificial Sequence
  Synthetic
tggcgttucaaaattggtgcut

SEQ ID NO: 89129 - DNA, 25 bp, Artificial Sequence
  Synthetic
acaaccctttguctactttcagcuc

SEQ ID NO: 89130 - DNA, 25 bp, Artificial Sequence
  Synthetic
gctactgcaaaucaacaggaagtut

SEQ ID NO: 89131 - DNA, 22 bp, Artificial Sequence
  Synthetic
agacctcuccttggacuggaat

SEQ ID NO: 89132 - DNA, 22 bp, Artificial Sequence
  Synthetic
gccctcucacccttcactguaa

SEQ ID NO: 89133 - DNA, 19 bp, Artificial Sequence
  Synthetic
ggtacttcuggcgguggaa

SEQ ID NO: 89134 - DNA, 19 bp, Artificial Sequence
  Synthetic
cctucacacgccugcagat

SEQ ID NO: 89135 - DNA, 22 bp, Artificial Sequence
  Synthetic
ggttcuggaaccaggtttugac

SEQ ID NO: 89136 - DNA, 23 bp, Artificial Sequence
  Synthetic
ccccagatcuaccagagatucct

SEQ ID NO: 89137 - DNA, 26 bp, Artificial Sequence
  Synthetic
atttggaaggagcautaaagguagca

SEQ ID NO: 89138 - DNA, 19 bp, Artificial Sequence
  Synthetic
gccaaggcgcucaaaauga

SEQ ID NO: 89139 - DNA, 20 bp, Artificial Sequence
  Synthetic
caaugaaccgagagcugcct

SEQ ID NO: 89140 - DNA, 26 bp, Artificial Sequence
  Synthetic
gtacctccucttcttcctauaccact

SEQ ID NO: 89141 - DNA, 25 bp, Artificial Sequence
  Synthetic
ggctgttcttuctgttcttgcagua

SEQ ID NO: 89142 - DNA, 21 bp, Artificial Sequence
  Synthetic
ccaaacggguctgaagcaugt

SEQ ID NO: 89143 - DNA, 28 bp, Artificial Sequence
  Synthetic
tccacaggauagattcagtttccuaagt

SEQ ID NO: 89144 - DNA, 27 bp, Artificial Sequence
  Synthetic
ctttaacattcuctctctttccuccca

SEQ ID NO: 89145 - DNA, 21 bp, Artificial Sequence
  Synthetic
ctgcatgcugctgatgtugaa

SEQ ID NO: 89146 - DNA, 27 bp, Artificial Sequence
  Synthetic
ttcaaggatauggaaagagtttgugct

SEQ ID NO: 89147 - DNA, 28 bp, Artificial Sequence
  Synthetic
aaagagggtgauattgtggcaatgauaa

SEQ ID NO: 89148 - DNA, 23 bp, Artificial Sequence
  Synthetic
ggtgtttgggauggaatggugat

SEQ ID NO: 89149 - DNA, 24 bp, Artificial Sequence
  Synthetic
guagagtttgucagccagagacag

SEQ ID NO: 89150 - DNA, 28 bp, Artificial Sequence
  Synthetic
gaaaaatgacacaacaagutacagguga

SEQ ID NO: 89151 - DNA, 23 bp, Artificial Sequence
  Synthetic
agcaacggagagcaaugatgaut

SEQ ID NO: 89152 - DNA, 21 bp, Artificial Sequence
  Synthetic
gctcctucgcagcttguagag

SEQ ID NO: 89153 - DNA, 27 bp, Artificial Sequence
  Synthetic
ccaatgtgtatcuttggacaagtgcua

SEQ ID NO: 89154 - DNA, 20 bp, Artificial Sequence
  Synthetic
gugacgggttuggacacact

SEQ ID NO: 89155 - DNA, 23 bp, Artificial Sequence
  Synthetic
gaatutgaccaagtucaccagca

SEQ ID NO: 89156 - DNA, 22 bp, Artificial Sequence
  Synthetic
catcctggtgugggaaggaauc

SEQ ID NO: 89157 - DNA, 21 bp, Artificial Sequence
  Synthetic
tutcctatcaguggccgcaaa

SEQ ID NO: 89158 - DNA, 25 bp, Artificial Sequence
  Synthetic
acctgtttttccutgttcagggaut

SEQ ID NO: 89159 - DNA, 25 bp, Artificial Sequence
  Synthetic
tttuaggtcagccuagcaacaaaga

SEQ ID NO: 89160 - DNA, 25 bp, Artificial Sequence
  Synthetic
gctgactcacaagaucatccacauc

SEQ ID NO: 89161 - DNA, 33 bp, Artificial Sequence
  Synthetic
tgtatttgaaccutaatgctaatttcauaagct

SEQ ID NO: 89162 - DNA, 22 bp, Artificial Sequence
  Synthetic
ttgtccucggaattccttcugg

SEQ ID NO: 89163 - DNA, 27 bp, Artificial Sequence
  Synthetic
aggaccattaucagaacaggatcucaa

SEQ ID NO: 89164 - DNA, 28 bp, Artificial Sequence
  Synthetic
cactgtctctaugcacataacatttguc

SEQ ID NO: 89165 - DNA, 28 bp, Artificial Sequence
  Synthetic
cactttaattgggutgcatttctgagut

SEQ ID NO: 89166 - DNA, 20 bp, Artificial Sequence
  Synthetic
ggagaaauagccccgagucc

SEQ ID NO: 89167 - DNA, 25 bp, Artificial Sequence
  Synthetic
gttgaatatccutgcaggtgacuct

SEQ ID NO: 89168 - DNA, 20 bp, Artificial Sequence
  Synthetic
gccaucaggaggaggactuc

SEQ ID NO: 89169 - DNA, 25 bp, Artificial Sequence
  Synthetic
gttattgagcugcttttgtgcacut

SEQ ID NO: 89170 - DNA, 23 bp, Artificial Sequence
  Synthetic
gtcaaugagccaaccaccctaut

SEQ ID NO: 89171 - DNA, 24 bp, Artificial Sequence
  Synthetic
gatcttcttctuccctgagcgtut

SEQ ID NO: 89172 - DNA, 21 bp, Artificial Sequence
  Synthetic
ggaccuagcccagctgauaag

SEQ ID NO: 89173 - DNA, 22 bp, Artificial Sequence
  Synthetic
tcagctguccacttgttcaugt

SEQ ID NO: 89174 - DNA, 28 bp, Artificial Sequence
  Synthetic
gagacttttacuaattcaggcctaugct

SEQ ID NO: 89175 - DNA, 28 bp, Artificial Sequence
  Synthetic
ttttcugatctagactuccaaagcacaa

SEQ ID NO: 89176 - DNA, 27 bp, Artificial Sequence
  Synthetic
gatcagagttatcugttccttgtgcut

SEQ ID NO: 89177 - DNA, 24 bp, Artificial Sequence
  Synthetic
cggaatctgugaaaatccccctut

SEQ ID NO: 89178 - DNA, 24 bp, Artificial Sequence
  Synthetic
ccaauacacacaaagcatcauggt

SEQ ID NO: 89179 - DNA, 28 bp, Artificial Sequence
  Synthetic
tgtacacaatguccacagaagttttuct

SEQ ID NO: 89180 - DNA, 21 bp, Artificial Sequence
  Synthetic
gcaccactuctcaccagucac

SEQ ID NO: 89181 - DNA, 26 bp, Artificial Sequence
  Synthetic
agttttcatggcuacccttgactuac

SEQ ID NO: 89182 - DNA, 18 bp, Artificial Sequence
  Synthetic
ccgtgutggcctucagag

SEQ ID NO: 89183 - DNA, 20 bp, Artificial Sequence
  Synthetic
atggcgaacacacuggcaua

SEQ ID NO: 89184 - DNA, 22 bp, Artificial Sequence
  Synthetic
attaccugcagctctgttugga

SEQ ID NO: 89185 - DNA, 29 bp, Artificial Sequence
  Synthetic
cggaaacaaaauaacccaagttcatcaut

SEQ ID NO: 89186 - DNA, 20 bp, Artificial Sequence
  Synthetic
ccgcaccuctacaggaacut

SEQ ID NO: 89187 - DNA, 18 bp, Artificial Sequence
  Synthetic
tttcugccgcaaggccua

SEQ ID NO: 89188 - DNA, 23 bp, Artificial Sequence
  Synthetic
gggactguagatgggugaaaaga

SEQ ID NO: 89189 - DNA, 22 bp, Artificial Sequence
  Synthetic
gggactgacuttctgctctugt

SEQ ID NO: 89190 - DNA, 26 bp, Artificial Sequence
  Synthetic
gtaatacccgtutgctttacctgaug

SEQ ID NO: 89191 - DNA, 21 bp, Artificial Sequence
  Synthetic
ttcagtuggaagatgcuggct

SEQ ID NO: 89192 - DNA, 29 bp, Artificial Sequence
  Synthetic
gattatctaaactacutgagccagcauct

SEQ ID NO: 89193 - DNA, 28 bp, Artificial Sequence
  Synthetic
ggctcagcttgauattggataatctgut

SEQ ID NO: 89194 - DNA, 22 bp, Artificial Sequence
  Synthetic
cccacaggauttcctctcccua

SEQ ID NO: 89195 - DNA, 27 bp, Artificial Sequence
  Synthetic
gagtgcaaugagaatgugaaacacaaa

SEQ ID NO: 89196 - DNA, 21 bp, Artificial Sequence
  Synthetic
tgcctggugctgcagtttaua

SEQ ID NO: 89197 - DNA, 25 bp, Artificial Sequence
  Synthetic
tggaaggutagtcugcagaaagaac

SEQ ID NO: 89198 - DNA, 22 bp, Artificial Sequence
  Synthetic
ggtagttgtuggcaaagccuct

SEQ ID NO: 89199 - DNA, 20 bp, Artificial Sequence
  Synthetic
gtagagcgaccugacgaugt

SEQ ID NO: 89200 - DNA, 25 bp, Artificial Sequence
  Synthetic
tcctggagcugattgtatctagcut

SEQ ID NO: 89201 - DNA, 28 bp, Artificial Sequence
  Synthetic
gttggaagacagcuaaaatgatgacaut

SEQ ID NO: 89202 - DNA, 28 bp, Artificial Sequence
  Synthetic
gcatgtacttcutaatgtactcctuggt

SEQ ID NO: 89203 - DNA, 28 bp, Artificial Sequence
  Synthetic
ccctcatataatutctgctctgatuggt

SEQ ID NO: 89204 - DNA, 23 bp, Artificial Sequence
  Synthetic
gcctgagaautacaggagacugg

SEQ ID NO: 89205 - DNA, 28 bp, Artificial Sequence
  Synthetic
caaaagctgagaugaaacagtgtaagut

SEQ ID NO: 89206 - DNA, 22 bp, Artificial Sequence
  Synthetic
aacagaaaugggctgagcacua

SEQ ID NO: 89207 - DNA, 29 bp, Artificial Sequence
  Synthetic
ggaagaautagaagcugagaaaagagact

SEQ ID NO: 89208 - DNA, 29 bp, Artificial Sequence
  Synthetic
gctacaagcacutcttcatacctgtuaag

SEQ ID NO: 89209 - DNA, 25 bp, Artificial Sequence
  Synthetic
tcgctttcctguattgctctactug

SEQ ID NO: 89210 - DNA, 25 bp, Artificial Sequence
  Synthetic
cacatggcugccattatcattagut

SEQ ID NO: 89211 - DNA, 28 bp, Artificial Sequence
  Synthetic
cagactacatuggaaaggagatttgcua

SEQ ID NO: 89212 - DNA, 22 bp, Artificial Sequence
  Synthetic
ggcatctctugcctcatgacua

SEQ ID NO: 89213 - DNA, 22 bp, Artificial Sequence
  Synthetic
acccgggaaggutttcaagtuc

SEQ ID NO: 89214 - DNA, 20 bp, Artificial Sequence
  Synthetic
gcaucgcacaccgaatucag

SEQ ID NO: 89215 - DNA, 21 bp, Artificial Sequence
  Synthetic
cagcagugttggugacaaagg

SEQ ID NO: 89216 - DNA, 25 bp, Artificial Sequence
  Synthetic
tcctcatcatcucgagcagaguaaa

SEQ ID NO: 89217 - DNA, 22 bp, Artificial Sequence
  Synthetic
acacaaggaaugcctgcttuct

SEQ ID NO: 89218 - DNA, 20 bp, Artificial Sequence
  Synthetic
gcuttgtcctcugagcacga

SEQ ID NO: 89219 - DNA, 21 bp, Artificial Sequence
  Synthetic
ccatccagutgggaagctuct

SEQ ID NO: 89220 - DNA, 31 bp, Artificial Sequence
  Synthetic
agtttatgcattaggaaucatctggtactug

SEQ ID NO: 89221 - DNA, 27 bp, Artificial Sequence
  Synthetic
ccattctagaggaugttaaacgtcuga

SEQ ID NO: 89222 - DNA, 22 bp, Artificial Sequence
  Synthetic
ggacaaacgcccuaataugcag

SEQ ID NO: 89223 - DNA, 28 bp, Artificial Sequence
  Synthetic
cgcttatcttggcugatgagattatuca

SEQ ID NO: 89224 - DNA, 21 bp, Artificial Sequence
  Synthetic
acutgcgtgugggagacaaat

SEQ ID NO: 89225 - DNA, 25 bp, Artificial Sequence
  Synthetic
gtctgtctccgucctagactcauag

SEQ ID NO: 89226 - DNA, 27 bp, Artificial Sequence
  Synthetic
gttcaccctttgutgtattgctttcut

SEQ ID NO: 89227 - DNA, 27 bp, Artificial Sequence
  Synthetic
cagctgtgcauactttgtatuaaaggt

SEQ ID NO: 89228 - DNA, 27 bp, Artificial Sequence
  Synthetic
tgtaaagccaucaacacagagtatcuc

SEQ ID NO: 89229 - DNA, 25 bp, Artificial Sequence
  Synthetic
accattuccaccctcactaauaacc

SEQ ID NO: 89230 - DNA, 19 bp, Artificial Sequence
  Synthetic
gggtggtuctgcttccuca

SEQ ID NO: 89231 - DNA, 23 bp, Artificial Sequence
  Synthetic
atgcttcgcaggucagtaatcut

SEQ ID NO: 89232 - DNA, 21 bp, Artificial Sequence
  Synthetic
cacctttguggccctctauga

SEQ ID NO: 89233 - DNA, 21 bp, Artificial Sequence
  Synthetic
ctgatgccagaucctgcauga

SEQ ID NO: 89234 - DNA, 24 bp, Artificial Sequence
  Synthetic
cacatgtuccccaagatgctaaug

SEQ ID NO: 89235 - DNA, 22 bp, Artificial Sequence
  Synthetic
tcguattgtccuggcacaaaga

SEQ ID NO: 89236 - DNA, 25 bp, Artificial Sequence
  Synthetic
catctagauaaaaccctucccacca

SEQ ID NO: 89237 - DNA, 26 bp, Artificial Sequence
  Synthetic
tcttttccugcagctccaaatctuag

SEQ ID NO: 89238 - DNA, 21 bp, Artificial Sequence
  Synthetic
ggaaaagtguggtccatugct

SEQ ID NO: 89239 - DNA, 22 bp, Artificial Sequence
  Synthetic
gagccacaguaagccagacaua

SEQ ID NO: 89240 - DNA, 26 bp, Artificial Sequence
  Synthetic
tgctacttcugaattgaaatggtuca

SEQ ID NO: 89241 - DNA, 27 bp, Artificial Sequence
  Synthetic
gattacctaccautactctgcagtgut

SEQ ID NO: 89242 - DNA, 26 bp, Artificial Sequence
  Synthetic
agatctcucaggattaacacugcaga

SEQ ID NO: 89243 - DNA, 17 bp, Artificial Sequence
  Synthetic
gccugccgcucacacaa

SEQ ID NO: 89244 - DNA, 28 bp, Artificial Sequence
  Synthetic
gctctcagucactatttgtctattucct

SEQ ID NO: 89245 - DNA, 22 bp, Artificial Sequence
  Synthetic
actccagtgucttgggaacuca

SEQ ID NO: 89246 - DNA, 25 bp, Artificial Sequence
  Synthetic
cttctccttuccttccttccatucc

SEQ ID NO: 89247 - DNA, 22 bp, Artificial Sequence
  Synthetic
actctcauacctggagtugcca

SEQ ID NO: 89248 - DNA, 22 bp, Artificial Sequence
  Synthetic
ctgccccaggauatttctguca

SEQ ID NO: 89249 - DNA, 21 bp, Artificial Sequence
  Synthetic
gccccacucttcagatccuct

SEQ ID NO: 89250 - DNA, 19 bp, Artificial Sequence
  Synthetic
aaacggautcgggcucaca

SEQ ID NO: 89251 - DNA, 22 bp, Artificial Sequence
  Synthetic
acacugaggaauccggagagaa

SEQ ID NO: 89252 - DNA, 17 bp, Artificial Sequence
  Synthetic
agcgcccgcauguacaa

SEQ ID NO: 89253 - DNA, 19 bp, Artificial Sequence
  Synthetic
gtccgggcugtttttcugg

SEQ ID NO: 89254 - DNA, 20 bp, Artificial Sequence
  Synthetic
gacagtuacgcgcacaugaa

SEQ ID NO: 89255 - DNA, 17 bp, Artificial Sequence
  Synthetic
gggcgcucacgtcguag

SEQ ID NO: 89256 - DNA, 22 bp, Artificial Sequence
  Synthetic
catgauggagacggagcugaag

SEQ ID NO: 89257 - DNA, 21 bp, Artificial Sequence
  Synthetic
ggaccacaccaugaaggcaut

SEQ ID NO: 89258 - DNA, 17 bp, Artificial Sequence
  Synthetic
cgucaagcggcccauga

SEQ ID NO: 89259 - DNA, 19 bp, Artificial Sequence
  Synthetic
gcttcuccgtcuccgacaa

SEQ ID NO: 89260 - DNA, 17 bp, Artificial Sequence
  Synthetic
gcacccgggccucaaug

SEQ ID NO: 89261 - DNA, 22 bp, Artificial Sequence
  Synthetic
cgagtaggacaugctgtaggug

SEQ ID NO: 89262 - DNA, 18 bp, Artificial Sequence
  Synthetic
ggcgccgaguggaaacut

SEQ ID NO: 89263 - DNA, 22 bp, Artificial Sequence
  Synthetic
gggcagcgugtacttatcctuc

SEQ ID NO: 89264 - DNA, 19 bp, Artificial Sequence
  Synthetic
ccagcucgcagaccuacat

SEQ ID NO: 89265 - DNA, 21 bp, Artificial Sequence
  Synthetic
agugggaggaagagguaacca

SEQ ID NO: 89266 - DNA, 22 bp, Artificial Sequence
  Synthetic
ggaaaaccaagacgcucaugaa

SEQ ID NO: 89267 - DNA, 18 bp, Artificial Sequence
  Synthetic
gtagcugccgttgcucca

SEQ ID NO: 89268 - DNA, 19 bp, Artificial Sequence
  Synthetic
gttcgguggtcaaguccga

SEQ ID NO: 89269 - DNA, 22 bp, Artificial Sequence
  Synthetic
gtagtgcugggacatgugaagt

SEQ ID NO: 89270 - DNA, 22 bp, Artificial Sequence
  Synthetic
ccgggacaugatcagcatguat

SEQ ID NO: 89271 - DNA, 17 bp, Artificial Sequence
  Synthetic
ccggcccucacatgugt

SEQ ID NO: 89272 - DNA, 19 bp, Artificial Sequence
  Synthetic
ggccatuaacggcacacug

SEQ ID NO: 89273 - DNA, 22 bp, Artificial Sequence
  Synthetic
tctttttgagcguaccgggtut

SEQ ID NO: 89274 - DNA, 19 bp, Artificial Sequence
  Synthetic
ttggucgagccaagctuga

SEQ ID NO: 89275 - DNA, 21 bp, Artificial Sequence
  Synthetic
ctcugaggaagcggacttgut

SEQ ID NO: 89276 - DNA, 25 bp, Artificial Sequence
  Synthetic
tcatcaatttccugacttcggtuct

SEQ ID NO: 89277 - DNA, 28 bp, Artificial Sequence
  Synthetic
tcagccttaacaugttctgagaattcut

SEQ ID NO: 89278 - DNA, 24 bp, Artificial Sequence
  Synthetic
cccaccaaggcacaautttaguag

SEQ ID NO: 89279 - DNA, 21 bp, Artificial Sequence
  Synthetic
cctctccucccctcuccaaag

SEQ ID NO: 89280 - DNA, 28 bp, Artificial Sequence
  Synthetic
agtgtctcuctttctgttuagagcaaaa

SEQ ID NO: 89281 - DNA, 18 bp, Artificial Sequence
  Synthetic
ccugaggccacgggttug

SEQ ID NO: 89282 - DNA, 22 bp, Artificial Sequence
  Synthetic
ccctgtcaccugactttgctut

SEQ ID NO: 89283 - DNA, 17 bp, Artificial Sequence
  Synthetic
gggctgucgccaaccuc

SEQ ID NO: 89284 - DNA, 21 bp, Artificial Sequence
  Synthetic
gctggugaaggccattcuagg

SEQ ID NO: 89285 - DNA, 21 bp, Artificial Sequence
  Synthetic
ccatctcucccggatgacuca

SEQ ID NO: 89286 - DNA, 17 bp, Artificial Sequence
  Synthetic
ggagggugacggccuct

SEQ ID NO: 89287 - DNA, 20 bp, Artificial Sequence
  Synthetic
tccgtgtggucctggaatug

SEQ ID NO: 89288 - DNA, 20 bp, Artificial Sequence
  Synthetic
ccacaggaagugaggcucag

SEQ ID NO: 89289 - DNA, 19 bp, Artificial Sequence
  Synthetic
ctccugggcagcatctuca

SEQ ID NO: 89290 - DNA, 20 bp, Artificial Sequence
  Synthetic
gauacggccaggcatugaag

SEQ ID NO: 89291 - DNA, 22 bp, Artificial Sequence
  Synthetic
tcatcttcugtccctucccaga

SEQ ID NO: 89292 - DNA, 24 bp, Artificial Sequence
  Synthetic
tttccttttggucttcaggtugga

SEQ ID NO: 89293 - DNA, 21 bp, Artificial Sequence
  Synthetic
cggaaggtuccatgggatuct

SEQ ID NO: 89294 - DNA, 22 bp, Artificial Sequence
  Synthetic
ttggagatccucaggctgguat

SEQ ID NO: 89295 - DNA, 24 bp, Artificial Sequence
  Synthetic
gtctccacaugccatttcuaggag

SEQ ID NO: 89296 - DNA, 20 bp, Artificial Sequence
  Synthetic
gtagctgcccuggtaggtut

SEQ ID NO: 89297 - DNA, 23 bp, Artificial Sequence
  Synthetic
aacaauggttcacugaagaccca

SEQ ID NO: 89298 - DNA, 26 bp, Artificial Sequence
  Synthetic
gaguacaagaaauggcaggaaaacag

SEQ ID NO: 89299 - DNA, 22 bp, Artificial Sequence
  Synthetic
gcataaaggcugggtgtucaca

SEQ ID NO: 89300 - DNA, 24 bp, Artificial Sequence
  Synthetic
cccggccaguttttcagatttuaa

SEQ ID NO: 89301 - DNA, 22 bp, Artificial Sequence
  Synthetic
ccutctccaatugaaccgagga

SEQ ID NO: 89302 - DNA, 27 bp, Artificial Sequence
  Synthetic
ttaattttccugagagaccaagaccug

SEQ ID NO: 89303 - DNA, 26 bp, Artificial Sequence
  Synthetic
ttgtgcaaaguactggtctttcugat

SEQ ID NO: 89304 - DNA, 22 bp, Artificial Sequence
  Synthetic
gctgttacagugcgaaguaccc

SEQ ID NO: 89305 - DNA, 21 bp, Artificial Sequence
  Synthetic
ggccctgaucatcatggtuca

SEQ ID NO: 89306 - DNA, 23 bp, Artificial Sequence
  Synthetic
cattcugggagcttcatcuggac

SEQ ID NO: 89307 - DNA, 22 bp, Artificial Sequence
  Synthetic
ggtcctcugactgctctttuca

SEQ ID NO: 89308 - DNA, 27 bp, Artificial Sequence
  Synthetic
gaggattaaaacugtaacaccuaccca

SEQ ID NO: 89309 - DNA, 23 bp, Artificial Sequence
  Synthetic
tcactggtcuctgtttgcacuac

SEQ ID NO: 89310 - DNA, 21 bp, Artificial Sequence
  Synthetic
acacugaatgugcagcacaac

SEQ ID NO: 89311 - DNA, 25 bp, Artificial Sequence
  Synthetic
tcctttugaagcaagtacugcagat

SEQ ID NO: 89312 - DNA, 21 bp, Artificial Sequence
  Synthetic
ccaacugccccttcttcaugt

SEQ ID NO: 89313 - DNA, 21 bp, Artificial Sequence
  Synthetic
ctcauaggcttcuccccgaga

SEQ ID NO: 89314 - DNA, 23 bp, Artificial Sequence
  Synthetic
aaactcccaaagcugaacuccaa

SEQ ID NO: 89315 - DNA, 23 bp, Artificial Sequence
  Synthetic
tgguctcacugaacagaaaaggg

SEQ ID NO: 89316 - DNA, 20 bp, Artificial Sequence
  Synthetic
ggaacccugaggaguccact

SEQ ID NO: 89317 - DNA, 22 bp, Artificial Sequence
  Synthetic
tgtggcaacgutcacaaaaucc

SEQ ID NO: 89318 - DNA, 26 bp, Artificial Sequence
  Synthetic
aggatgtuaccaggacatttaauggg

SEQ ID NO: 89319 - DNA, 22 bp, Artificial Sequence
  Synthetic
tttccagcuctguggcaagaat

SEQ ID NO: 89320 - DNA, 21 bp, Artificial Sequence
  Synthetic
gacagatucccgttgctucct

SEQ ID NO: 89321 - DNA, 22 bp, Artificial Sequence
  Synthetic
cctgagggacuaggauggacat

SEQ ID NO: 89322 - DNA, 21 bp, Artificial Sequence
  Synthetic
caccagcgutccaagucagat

SEQ ID NO: 89323 - DNA, 21 bp, Artificial Sequence
  Synthetic
gcttttcugcacttgctcguc

SEQ ID NO: 89324 - DNA, 19 bp, Artificial Sequence
  Synthetic
ctguctcaagcugcacgga

SEQ ID NO: 89325 - DNA, 20 bp, Artificial Sequence
  Synthetic
cagccgcugtgtuaggaagt

SEQ ID NO: 89326 - DNA, 23 bp, Artificial Sequence
  Synthetic
caaatctgcugttccccatcuca

SEQ ID NO: 89327 - DNA, 29 bp, Artificial Sequence
  Synthetic
ctccattttctucctcattctacttcuca

SEQ ID NO: 89328 - DNA, 27 bp, Artificial Sequence
  Synthetic
gcagccaagtuatctgtatagtctuct

SEQ ID NO: 89329 - DNA, 24 bp, Artificial Sequence
  Synthetic
caaaggtuaaagctgaaagugcca

SEQ ID NO: 89330 - DNA, 25 bp, Artificial Sequence
  Synthetic
gcttctacccaguatcacagggaut

SEQ ID NO: 89331 - DNA, 25 bp, Artificial Sequence
  Synthetic
gagctcautaactaccaucagcaca

SEQ ID NO: 89332 - DNA, 22 bp, Artificial Sequence
  Synthetic
ccatgtaccugccacguagaag

SEQ ID NO: 89333 - DNA, 18 bp, Artificial Sequence
  Synthetic
tgatcguggtcccuccgt

SEQ ID NO: 89334 - DNA, 21 bp, Artificial Sequence
  Synthetic
cctgguactcaccugcagagt

SEQ ID NO: 89335 - DNA, 28 bp, Artificial Sequence
  Synthetic
aagttactgacuaagcatccacttctuc

SEQ ID NO: 89336 - DNA, 23 bp, Artificial Sequence
  Synthetic
ctcttatcagagutcagccuggt

SEQ ID NO: 89337 - DNA, 20 bp, Artificial Sequence
  Synthetic
gcagaccucucgggagacaa

SEQ ID NO: 89338 - DNA, 17 bp, Artificial Sequence
  Synthetic
gcucaccuggcagggat

SEQ ID NO: 89339 - DNA, 21 bp, Artificial Sequence
  Synthetic
agcagcaccucatcgtaagug

SEQ ID NO: 89340 - DNA, 21 bp, Artificial Sequence
  Synthetic
aacctcatggutctgcctcuc

SEQ ID NO: 89341 - DNA, 20 bp, Artificial Sequence
  Synthetic
accagguccaagccaaaguc

SEQ ID NO: 89342 - DNA, 22 bp, Artificial Sequence
  Synthetic
gaagacuaccagctcgtcaugg

SEQ ID NO: 89343 - DNA, 20 bp, Artificial Sequence
  Synthetic
cggtagtgaccugccaggua

SEQ ID NO: 89344 - DNA, 21 bp, Artificial Sequence
  Synthetic
ctggcugtctacaugcaaacc

SEQ ID NO: 89345 - DNA, 21 bp, Artificial Sequence
  Synthetic
gtagcucagctgatcugcgaa

SEQ ID NO: 89346 - DNA, 18 bp, Artificial Sequence
  Synthetic
cccucgaggccauccaag

SEQ ID NO: 89347 - DNA, 18 bp, Artificial Sequence
  Synthetic
accctgccgcuctcctua

SEQ ID NO: 89348 - DNA, 19 bp, Artificial Sequence
  Synthetic
ggcacaaggucuacagcct

SEQ ID NO: 89349 - DNA, 19 bp, Artificial Sequence
  Synthetic
tcccaguccccaucacaga

SEQ ID NO: 89350 - DNA, 22 bp, Artificial Sequence
  Synthetic
atggucagaacagcaatcguga

SEQ ID NO: 89351 - DNA, 28 bp, Artificial Sequence
  Synthetic
ccagataauagatgccacucaaaaagga

SEQ ID NO: 89352 - DNA, 23 bp, Artificial Sequence
  Synthetic
ctaaggutttaccacugcagcct

SEQ ID NO: 89353 - DNA, 22 bp, Artificial Sequence
  Synthetic
ggagggaggagaccutctuact

SEQ ID NO: 89354 - DNA, 20 bp, Artificial Sequence
  Synthetic
agggtgtguccctccaaaug

SEQ ID NO: 89355 - DNA, 23 bp, Artificial Sequence
  Synthetic
aggtaaaagtgcuccattcgcut

SEQ ID NO: 89356 - DNA, 26 bp, Artificial Sequence
  Synthetic
ctgtgattcaugaaacgagagcaaut

SEQ ID NO: 89357 - DNA, 26 bp, Artificial Sequence
  Synthetic
gttaggttucgcagcacaatctttut

SEQ ID NO: 89358 - DNA, 20 bp, Artificial Sequence
  Synthetic
gcauccggagatgttuggct

SEQ ID NO: 89359 - DNA, 20 bp, Artificial Sequence
  Synthetic
caaacgucagcgggtucaaa

SEQ ID NO: 89360 - DNA, 22 bp, Artificial Sequence
  Synthetic
ccatccgggcuttacgcaaaua

SEQ ID NO: 89361 - DNA, 24 bp, Artificial Sequence
  Synthetic
atatcatccagccugtgtcttucc

SEQ ID NO: 89362 - DNA, 24 bp, Artificial Sequence
  Synthetic
ttgacagcuggaagagatttguga

SEQ ID NO: 89363 - DNA, 21 bp, Artificial Sequence
  Synthetic
ctcagggugcagttgctttug

SEQ ID NO: 89364 - DNA, 21 bp, Artificial Sequence
  Synthetic
cagctgtgugctcttgagtuc

SEQ ID NO: 89365 - DNA, 22 bp, Artificial Sequence
  Synthetic
gctgaggtcutgtgagtgtcut

SEQ ID NO: 89366 - DNA, 24 bp, Artificial Sequence
  Synthetic
agaaatcctcugtgacgatcugga

SEQ ID NO: 89367 - DNA, 20 bp, Artificial Sequence
  Synthetic
cagtgcugggtgagaaguca

SEQ ID NO: 89368 - DNA, 23 bp, Artificial Sequence
  Synthetic
gccctaacgaugctatcctucat

SEQ ID NO: 89369 - DNA, 23 bp, Artificial Sequence
  Synthetic
ccatgatgaucctcagcttgucc

SEQ ID NO: 89370 - DNA, 22 bp, Artificial Sequence
  Synthetic
gaucaaggaccgagucgaacag

SEQ ID NO: 89371 - DNA, 24 bp, Artificial Sequence
  Synthetic
ccacaguccccagcaaataactua

SEQ ID NO: 89372 - DNA, 21 bp, Artificial Sequence
  Synthetic
ggacttuggagtgctugcagt

SEQ ID NO: 89373 - DNA, 22 bp, Artificial Sequence
  Synthetic
tggctgtctcugagcaagtcua

SEQ ID NO: 89374 - DNA, 22 bp, Artificial Sequence
  Synthetic
gtccaagaaauggcugggaaga

SEQ ID NO: 89375 - DNA, 22 bp, Artificial Sequence
  Synthetic
agctcaaggaugtgcctttcug

SEQ ID NO: 89376 - DNA, 22 bp, Artificial Sequence
  Synthetic
cugagugagcccgaagaagaat

SEQ ID NO: 89377 - DNA, 27 bp, Artificial Sequence
  Synthetic
tcacaaagtccutgaagatgacaucaa

SEQ ID NO: 89378 - DNA, 28 bp, Artificial Sequence
  Synthetic
aggcttaaggautagaaaacttgtucca

SEQ ID NO: 89379 - DNA, 27 bp, Artificial Sequence
  Synthetic
ctagtagtagucaaccaaagccttuca

SEQ ID NO: 89380 - DNA, 27 bp, Artificial Sequence
  Synthetic
ctgaaaggcttuggttgactactacua

SEQ ID NO: 89381 - DNA, 33 bp, Artificial Sequence
  Synthetic
agaattgaaatcaaaugaacaagtctacatcut

SEQ ID NO: 89382 - DNA, 21 bp, Artificial Sequence
  Synthetic
cagagcaatuggaagcacgut

SEQ ID NO: 89383 - DNA, 26 bp, Artificial Sequence
  Synthetic
cacacatcgaauacccaaatttugga

SEQ ID NO: 89384 - DNA, 28 bp, Artificial Sequence
  Synthetic
acctgacagttautgacaaagatgcaut

SEQ ID NO: 89385 - DNA, 28 bp, Artificial Sequence
  Synthetic
tctccccttaaugtctccatttatucca

SEQ ID NO: 89386 - DNA, 20 bp, Artificial Sequence
  Synthetic
agaggucaccctugcagaga

SEQ ID NO: 89387 - DNA, 24 bp, Artificial Sequence
  Synthetic
gtgcaggtgauggtattcctugat

SEQ ID NO: 89388 - DNA, 27 bp, Artificial Sequence
  Synthetic
gtggttttcattuccatctttacgcut

SEQ ID NO: 89389 - DNA, 27 bp, Artificial Sequence
  Synthetic
ctctccttcuccctttctatcttcugt

SEQ ID NO: 89390 - DNA, 20 bp, Artificial Sequence
  Synthetic
ggtcacugggcgggaaauac

SEQ ID NO: 89391 - DNA, 22 bp, Artificial Sequence
  Synthetic
gcaattacguacggcucaacat

SEQ ID NO: 89392 - DNA, 21 bp, Artificial Sequence
  Synthetic
ccgacucaccagggaucagaa

SEQ ID NO: 89393 - DNA, 22 bp, Artificial Sequence
  Synthetic
ctccctagaucctggctggtua

SEQ ID NO: 89394 - DNA, 21 bp, Artificial Sequence
  Synthetic
accgauagagggaaccacugt

SEQ ID NO: 89395 - DNA, 26 bp, Artificial Sequence
  Synthetic
gccctgtctugctttccttgtatuaa

SEQ ID NO: 89396 - DNA, 21 bp, Artificial Sequence
  Synthetic
ctctgtccguccctctctuct

SEQ ID NO: 89397 - DNA, 19 bp, Artificial Sequence
  Synthetic
cctcccccgggutcactua

SEQ ID NO: 89398 - DNA, 29 bp, Artificial Sequence
  Synthetic
tttgctaattgtaugtgtgtgtgtttcug

SEQ ID NO: 89399 - DNA, 25 bp, Artificial Sequence
  Synthetic
accaaaggcuttatcaagucacact

SEQ ID NO: 89400 - DNA, 28 bp, Artificial Sequence
  Synthetic
ctaatgaagaugaggatttgaacccuga

SEQ ID NO: 89401 - DNA, 26 bp, Artificial Sequence
  Synthetic
gccaagctctutgaatgcttcatuaa

SEQ ID NO: 89402 - DNA, 17 bp, Artificial Sequence
  Synthetic
cggugccaagccucaca

SEQ ID NO: 89403 - DNA, 17 bp, Artificial Sequence
  Synthetic
ggguggcttgugggcaa

SEQ ID NO: 89404 - DNA, 21 bp, Artificial Sequence
  Synthetic
tctgggaccucactgugacat

SEQ ID NO: 89405 - DNA, 20 bp, Artificial Sequence
  Synthetic
ctgtccccuccttugcagaa

SEQ ID NO: 89406 - DNA, 19 bp, Artificial Sequence
  Synthetic
aggagcugggucggaaaac

SEQ ID NO: 89407 - DNA, 21 bp, Artificial Sequence
  Synthetic
caaguacggcaccacagucat

SEQ ID NO: 89408 - DNA, 20 bp, Artificial Sequence
  Synthetic
cgcacgtagugtttctgcut

SEQ ID NO: 89409 - DNA, 20 bp, Artificial Sequence
  Synthetic
caucgaaccccagguaccac

SEQ ID NO: 89410 - DNA, 18 bp, Artificial Sequence
  Synthetic
cctucccagccctagcut

SEQ ID NO: 89411 - DNA, 17 bp, Artificial Sequence
  Synthetic
gcuggacccccaucgga

SEQ ID NO: 89412 - DNA, 22 bp, Artificial Sequence
  Synthetic
gaagaaacaucctccggcugaa

SEQ ID NO: 89413 - DNA, 22 bp, Artificial Sequence
  Synthetic
accgtgaagucctgagtguaga

SEQ ID NO: 89414 - DNA, 21 bp, Artificial Sequence
  Synthetic
gcauccactgcuaccacaagt

SEQ ID NO: 89415 - DNA, 22 bp, Artificial Sequence
  Synthetic
tcaccaggaucttgaaggcauc

SEQ ID NO: 89416 - DNA, 22 bp, Artificial Sequence
  Synthetic
agggtctucctcaactgcuaca

SEQ ID NO: 89417 - DNA, 22 bp, Artificial Sequence
  Synthetic
gccttccaagaagucagcaucc

SEQ ID NO: 89418 - DNA, 17 bp, Artificial Sequence
  Synthetic
ccctcgcuggacuccat

SEQ ID NO: 89419 - DNA, 17 bp, Artificial Sequence
  Synthetic
ctcgtcugcccagcgut

SEQ ID NO: 89420 - DNA, 22 bp, Artificial Sequence
  Synthetic
gggtuccaggaattucccaacc

SEQ ID NO: 89421 - DNA, 25 bp, Artificial Sequence
  Synthetic
gagaagtugaaggcagaaagcauac

SEQ ID NO: 89422 - DNA, 22 bp, Artificial Sequence
  Synthetic
gtggaggcucatcactgactut

SEQ ID NO: 89423 - DNA, 22 bp, Artificial Sequence
  Synthetic
cctcctgcugttctgttgtucc

SEQ ID NO: 89424 - DNA, 21 bp, Artificial Sequence
  Synthetic
ctcgttccauctccgcttcuc

SEQ ID NO: 89425 - DNA, 25 bp, Artificial Sequence
  Synthetic
gatctaggcucagaggaaucacaac

SEQ ID NO: 89426 - DNA, 24 bp, Artificial Sequence
  Synthetic
agctagtgtguagacagacauggt

SEQ ID NO: 89427 - DNA, 28 bp, Artificial Sequence
  Synthetic
tggaagtccaaaaaccugaaaggaauat

SEQ ID NO: 89428 - DNA, 28 bp, Artificial Sequence
  Synthetic
ccaaaccctagautatttgcagctacua

SEQ ID NO: 89429 - DNA, 28 bp, Artificial Sequence
  Synthetic
acagaaccagaauttaaggtggaagaug

SEQ ID NO: 89430 - DNA, 18 bp, Artificial Sequence
  Synthetic
gcttacgcgugcgggaua

SEQ ID NO: 89431 - DNA, 28 bp, Artificial Sequence
  Synthetic
gttatacatcucggctgaacctactuac

SEQ ID NO: 89432 - DNA, 27 bp, Artificial Sequence
  Synthetic
aacactacugcaggatccattaaaugt

SEQ ID NO: 89433 - DNA, 28 bp, Artificial Sequence
  Synthetic
gcgttcagtcacuaagaagatctaugaa

SEQ ID NO: 89434 - DNA, 18 bp, Artificial Sequence
  Synthetic
gtgaguggcgccctctut

SEQ ID NO: 89435 - DNA, 19 bp, Artificial Sequence
  Synthetic
gaggccagcccaaguacuc

SEQ ID NO: 89436 - DNA, 26 bp, Artificial Sequence
  Synthetic
accacagaaaugaagcaguaagaaca

SEQ ID NO: 89437 - DNA, 23 bp, Artificial Sequence
  Synthetic
attaagugacaaggtcgtugcct

SEQ ID NO: 89438 - DNA, 24 bp, Artificial Sequence
  Synthetic
tttacaggtaucacgctcatugct

SEQ ID NO: 89439 - DNA, 24 bp, Artificial Sequence
  Synthetic
gacatcagacutggcaaagctuac

SEQ ID NO: 89440 - DNA, 23 bp, Artificial Sequence
  Synthetic
gaccttguacaccttcctucaca

SEQ ID NO: 89441 - DNA, 25 bp, Artificial Sequence
  Synthetic
attctgatagacucttggctugcag

SEQ ID NO: 89442 - DNA, 29 bp, Artificial Sequence
  Synthetic
caagttgaaaugaacaaaagatgctucct

SEQ ID NO: 89443 - DNA, 22 bp, Artificial Sequence
  Synthetic
tgaagaggagggugtgtcugat

SEQ ID NO: 89444 - DNA, 19 bp, Artificial Sequence
  Synthetic
agaucugcgaggaggacca

SEQ ID NO: 89445 - DNA, 19 bp, Artificial Sequence
  Synthetic
gggccucacctctctucac

SEQ ID NO: 89446 - DNA, 21 bp, Artificial Sequence
  Synthetic
cctgtgcgugggattctctuc

SEQ ID NO: 89447 - DNA, 19 bp, Artificial Sequence
  Synthetic
ggcucacccgacauggaac

SEQ ID NO: 89448 - DNA, 21 bp, Artificial Sequence
  Synthetic
gcaugugagacagaccaagga

SEQ ID NO: 89449 - DNA, 19 bp, Artificial Sequence
  Synthetic
cugaacacugggaccagca

SEQ ID NO: 89450 - DNA, 25 bp, Artificial Sequence
  Synthetic
aatactcaaacaaaucctgcccuga

SEQ ID NO: 89451 - DNA, 28 bp, Artificial Sequence
  Synthetic
caaaaatctacccucttccacacatgua

SEQ ID NO: 89452 - DNA, 23 bp, Artificial Sequence
  Synthetic
tgttcttggcucctttcactcuc

SEQ ID NO: 89453 - DNA, 27 bp, Artificial Sequence
  Synthetic
accaacauagaagctagtaagcuacct

SEQ ID NO: 89454 - DNA, 23 bp, Artificial Sequence
  Synthetic
gagcacgcgaugtattctcacua

SEQ ID NO: 89455 - DNA, 22 bp, Artificial Sequence
  Synthetic
agacttuggaacactugcccat

SEQ ID NO: 89456 - DNA, 19 bp, Artificial Sequence
  Synthetic
tgctggtucttggctgugt

SEQ ID NO: 89457 - DNA, 18 bp, Artificial Sequence
  Synthetic
ctggugctgccuacaggt

SEQ ID NO: 89458 - DNA, 20 bp, Artificial Sequence
  Synthetic
gctgguagcacagggactug

SEQ ID NO: 89459 - DNA, 20 bp, Artificial Sequence
  Synthetic
cagtcaugcggatcctguct

SEQ ID NO: 89460 - DNA, 19 bp, Artificial Sequence
  Synthetic
ctgtggctuaccccaggut

SEQ ID NO: 89461 - DNA, 18 bp, Artificial Sequence
  Synthetic
ggcctgugcccaaguacc

SEQ ID NO: 89462 - DNA, 25 bp, Artificial Sequence
  Synthetic
gacacagatgutgatcaccaugact

SEQ ID NO: 89463 - DNA, 21 bp, Artificial Sequence
  Synthetic
ggttcctucaccacaaccugt

SEQ ID NO: 89464 - DNA, 26 bp, Artificial Sequence
  Synthetic
tcatttgguaggcttgagttugaaga

SEQ ID NO: 89465 - DNA, 25 bp, Artificial Sequence
  Synthetic
tccacagaugaaactttcucccaag

SEQ ID NO: 89466 - DNA, 23 bp, Artificial Sequence
  Synthetic
caggcgccaautccaatacuact

SEQ ID NO: 89467 - DNA, 28 bp, Artificial Sequence
  Synthetic
catactgccaauacctgaatactgacua

SEQ ID NO: 89468 - DNA, 28 bp, Artificial Sequence
  Synthetic
tgagttugaagaaacagaagaaccugat

SEQ ID NO: 89469 - DNA, 28 bp, Artificial Sequence
  Synthetic
gaaaatcctuaccaatactccauccaca

SEQ ID NO: 89470 - DNA, 26 bp, Artificial Sequence
  Synthetic
tcutcattcattcatucccaccacaa

SEQ ID NO: 89471 - DNA, 28 bp, Artificial Sequence
  Synthetic
cttatcccggcuaatggttagaatugaa

SEQ ID NO: 89472 - DNA, 20 bp, Artificial Sequence
  Synthetic
cttggtggcuaagctgcuca

SEQ ID NO: 89473 - DNA, 20 bp, Artificial Sequence
  Synthetic
gctgugaagaggctgguaca

SEQ ID NO: 89474 - DNA, 25 bp, Artificial Sequence
  Synthetic
cacgggaacaagaucctttaucaca

SEQ ID NO: 89475 - DNA, 28 bp, Artificial Sequence
  Synthetic
ggatgtgttaaaugtgtgtctcttucag

SEQ ID NO: 89476 - DNA, 17 bp, Artificial Sequence
  Synthetic
gugcaggcugggaacac

SEQ ID NO: 89477 - DNA, 21 bp, Artificial Sequence
  Synthetic
caccccacccucatgaaagut

SEQ ID NO: 89478 - DNA, 21 bp, Artificial Sequence
  Synthetic
aggcacugctgaatcucagac

SEQ ID NO: 89479 - DNA, 26 bp, Artificial Sequence
  Synthetic
gaagagggtgtugattaaggtggaut

SEQ ID NO: 89480 - DNA, 18 bp, Artificial Sequence
  Synthetic
guagaguggcagcacggt

SEQ ID NO: 89481 - DNA, 20 bp, Artificial Sequence
  Synthetic
ttgtggccaguggttgtcut

SEQ ID NO: 89482 - DNA, 25 bp, Artificial Sequence
  Synthetic
gacagguaagtttctgcuccaaagt

SEQ ID NO: 89483 - DNA, 28 bp, Artificial Sequence
  Synthetic
ggtatttttattugctgtggtaggugga

SEQ ID NO: 89484 - DNA, 26 bp, Artificial Sequence
  Synthetic
ccaaacagucatggttttgtucaaga

SEQ ID NO: 89485 - DNA, 28 bp, Artificial Sequence
  Synthetic
tgctgcatcuatataggtggtaucaaga

SEQ ID NO: 89486 - DNA, 22 bp, Artificial Sequence
  Synthetic
cgtcagctuctggttcagaugt

SEQ ID NO: 89487 - DNA, 26 bp, Artificial Sequence
  Synthetic
ggatggcaaagaggaucttgaucaat

SEQ ID NO: 89488 - DNA, 17 bp, Artificial Sequence
  Synthetic
gcagagcggcutgggua

SEQ ID NO: 89489 - DNA, 18 bp, Artificial Sequence
  Synthetic
ctgaccgugcgtgaugga

SEQ ID NO: 89490 - DNA, 22 bp, Artificial Sequence
  Synthetic
aggttugggtcagtaucagcag

SEQ ID NO: 89491 - DNA, 27 bp, Artificial Sequence
  Synthetic
aatgaatagtatgcugtcccaggttut

SEQ ID NO: 89492 - DNA, 29 bp, Artificial Sequence
  Synthetic
acaagttttcttcucaatcaattgcctut

SEQ ID NO: 89493 - DNA, 22 bp, Artificial Sequence
  Synthetic
cctcagtgaugggctcctguat

SEQ ID NO: 89494 - DNA, 28 bp, Artificial Sequence
  Synthetic
gtgaatacautgactgtctugaaccaac

SEQ ID NO: 89495 - DNA, 27 bp, Artificial Sequence
  Synthetic
gacctgtucacaaagttatgctucaaa

SEQ ID NO: 89496 - DNA, 23 bp, Artificial Sequence
  Synthetic
ccagcacagcuatcttctucagg

SEQ ID NO: 89497 - DNA, 26 bp, Artificial Sequence
  Synthetic
atgggatttgtugtgtgatacacuca

SEQ ID NO: 89498 - DNA, 24 bp, Artificial Sequence
  Synthetic
caaattaacccaugtgggcctuaa

SEQ ID NO: 89499 - DNA, 27 bp, Artificial Sequence
  Synthetic
gccctuacaacaaaaacaagagctuac

SEQ ID NO: 89500 - DNA, 21 bp, Artificial Sequence
  Synthetic
cctgcagggutccaggttuaa

SEQ ID NO: 89501 - DNA, 26 bp, Artificial Sequence
  Synthetic
gctcggagttugggaagaattctauc

SEQ ID NO: 89502 - DNA, 22 bp, Artificial Sequence
  Synthetic
ggaugaggaacagcaacctuca

SEQ ID NO: 89503 - DNA, 18 bp, Artificial Sequence
  Synthetic
agggacaacguggauggg

SEQ ID NO: 89504 - DNA, 19 bp, Artificial Sequence
  Synthetic
autgcatguacgccccact

SEQ ID NO: 89505 - DNA, 21 bp, Artificial Sequence
  Synthetic
gccttcuagccctttggtgua

SEQ ID NO: 89506 - DNA, 19 bp, Artificial Sequence
  Synthetic
ccuccggacgaggaugact

SEQ ID NO: 89507 - DNA, 21 bp, Artificial Sequence
  Synthetic
ttcggatacugcttcctgcug

SEQ ID NO: 89508 - DNA, 18 bp, Artificial Sequence
  Synthetic
ccgccgcutcctcaucct

SEQ ID NO: 89509 - DNA, 17 bp, Artificial Sequence
  Synthetic
ggccgagugtagccgua

SEQ ID NO: 89510 - DNA, 27 bp, Artificial Sequence
  Synthetic
cctcttcctcuacagggacattttcua

SEQ ID NO: 89511 - DNA, 28 bp, Artificial Sequence
  Synthetic
caagaaactaaugtttcgcagacugaaa

SEQ ID NO: 89512 - DNA, 17 bp, Artificial Sequence
  Synthetic
cgaggcgggagcuguag

SEQ ID NO: 89513 - DNA, 24 bp, Artificial Sequence
  Synthetic
ccatttcgcutttgacacaagugg

SEQ ID NO: 89514 - DNA, 23 bp, Artificial Sequence
  Synthetic
aguattccccttucaagggaggt

SEQ ID NO: 89515 - DNA, 20 bp, Artificial Sequence
  Synthetic
ccagtgcuccggacttguag

SEQ ID NO: 89516 - DNA, 21 bp, Artificial Sequence
  Synthetic
ggguaagggaagtagguggaa

SEQ ID NO: 89517 - DNA, 17 bp, Artificial Sequence
  Synthetic
gcccgggutctggauca

SEQ ID NO: 89518 - DNA, 20 bp, Artificial Sequence
  Synthetic
cagagtgcccuatcccaguc

SEQ ID NO: 89519 - DNA, 21 bp, Artificial Sequence
  Synthetic
agguaggagccgctagauacc

SEQ ID NO: 89520 - DNA, 20 bp, Artificial Sequence
  Synthetic
agcagggugaggatggtuct

SEQ ID NO: 89521 - DNA, 19 bp, Artificial Sequence
  Synthetic
tcugggacgcaacctcuct

SEQ ID NO: 89522 - DNA, 21 bp, Artificial Sequence
  Synthetic
catgcaacucctucagcaaca

SEQ ID NO: 89523 - DNA, 21 bp, Artificial Sequence
  Synthetic
accgacacugcctuacacaac

SEQ ID NO: 89524 - DNA, 24 bp, Artificial Sequence
  Synthetic
gcctcggguaaatttgagcttcut

SEQ ID NO: 89525 - DNA, 21 bp, Artificial Sequence
  Synthetic
gcctcacuggctcatacucac

SEQ ID NO: 89526 - DNA, 19 bp, Artificial Sequence
  Synthetic
tgccgtcuaccctgtcuct

SEQ ID NO: 89527 - DNA, 17 bp, Artificial Sequence
  Synthetic
ccgtaguccagcgggut

SEQ ID NO: 89528 - DNA, 18 bp, Artificial Sequence
  Synthetic
gctcgcaucaagcuggag

SEQ ID NO: 89529 - DNA, 21 bp, Artificial Sequence
  Synthetic
cttcggcugtgaagagagugt

SEQ ID NO: 89530 - DNA, 21 bp, Artificial Sequence
  Synthetic
ctttcuccccaaaggccacut

SEQ ID NO: 89531 - DNA, 21 bp, Artificial Sequence
  Synthetic
cccacatutacaccttugcca

SEQ ID NO: 89532 - DNA, 22 bp, Artificial Sequence
  Synthetic
ccauttcugacaacgccaagga

SEQ ID NO: 89533 - DNA, 18 bp, Artificial Sequence
  Synthetic
gcggguggaacucccaaa

SEQ ID NO: 89534 - DNA, 28 bp, Artificial Sequence
  Synthetic
tgcactgtccaugctattttcacttaua

SEQ ID NO: 89535 - DNA, 25 bp, Artificial Sequence
  Synthetic
cgttgagugaaggagatgggtatuc

SEQ ID NO: 89536 - DNA, 27 bp, Artificial Sequence
  Synthetic
aaacagaggcucattttgcaattugat

SEQ ID NO: 89537 - DNA, 28 bp, Artificial Sequence
  Synthetic
actccaaauatacccaagugcagaaaaa

SEQ ID NO: 89538 - DNA, 19 bp, Artificial Sequence
  Synthetic
gagcgcgutccatcctcua

SEQ ID NO: 89539 - DNA, 17 bp, Artificial Sequence
  Synthetic
cctaccucggcctcguc

SEQ ID NO: 89540 - DNA, 21 bp, Artificial Sequence
  Synthetic
gaagaguacggcccugaagaa

SEQ ID NO: 89541 - DNA, 22 bp, Artificial Sequence
  Synthetic
gattgcagaagaugaccuggga

SEQ ID NO: 89542 - DNA, 21 bp, Artificial Sequence
  Synthetic
cccagcacugttgtcagguaa

SEQ ID NO: 89543 - DNA, 27 bp, Artificial Sequence
  Synthetic
ctgguagaagaacagatgtaaauccgt

SEQ ID NO: 89544 - DNA, 23 bp, Artificial Sequence
  Synthetic
cactgtctucaacagaccctuga

SEQ ID NO: 89545 - DNA, 19 bp, Artificial Sequence
  Synthetic
ccugucaccaacgggaagg

SEQ ID NO: 89546 - DNA, 17 bp, Artificial Sequence
  Synthetic
gctgcgcucggugaact

SEQ ID NO: 89547 - DNA, 21 bp, Artificial Sequence
  Synthetic
gtacctcgguagctgtggaug

SEQ ID NO: 89548 - DNA, 21 bp, Artificial Sequence
  Synthetic
cctaccugaacctccgaacug

SEQ ID NO: 89549 - DNA, 20 bp, Artificial Sequence
  Synthetic
ggttugaacccgggactgua

SEQ ID NO: 89550 - DNA, 29 bp, Artificial Sequence
  Synthetic
ggtttcattcatcuatgaagatgttgcut

SEQ ID NO: 89551 - DNA, 24 bp, Artificial Sequence
  Synthetic
gacttgtactaugtgtggccauga

SEQ ID NO: 89552 - DNA, 24 bp, Artificial Sequence
  Synthetic
ttcatatgucagttcauggccaca

SEQ ID NO: 89553 - DNA, 20 bp, Artificial Sequence
  Synthetic
gaatugcggcgagcaguaag

SEQ ID NO: 89554 - DNA, 21 bp, Artificial Sequence
  Synthetic
cccgtauggctcaactucgac

SEQ ID NO: 89555 - DNA, 19 bp, Artificial Sequence
  Synthetic
gggctucagaccgtgcuat

SEQ ID NO: 89556 - DNA, 25 bp, Artificial Sequence
  Synthetic
ccagctgggutaataagagguacag

SEQ ID NO: 89557 - DNA, 31 bp, Artificial Sequence
  Synthetic
cttctttgtgaaagauaggagactaaaucca

SEQ ID NO: 89558 - DNA, 25 bp, Artificial Sequence
  Synthetic
gatagcaggaaaaacaaugcctuca

SEQ ID NO: 89559 - DNA, 25 bp, Artificial Sequence
  Synthetic
cuaacagacagagaaugggcagaag

SEQ ID NO: 89560 - DNA, 25 bp, Artificial Sequence
  Synthetic
agcctttccuagaatgatccacuaa

SEQ ID NO: 89561 - DNA, 26 bp, Artificial Sequence
  Synthetic
cagctguagctaagatagugaaacct

SEQ ID NO: 89562 - DNA, 25 bp, Artificial Sequence
  Synthetic
gcaagctctucttcagacaataugg

SEQ ID NO: 89563 - DNA, 33 bp, Artificial Sequence
  Synthetic
tataatgtacagtacaugtcacttacctugaaa

SEQ ID NO: 89564 - DNA, 23 bp, Artificial Sequence
  Synthetic
ctgaacagccuatttccccauca

SEQ ID NO: 89565 - DNA, 23 bp, Artificial Sequence
  Synthetic
ggacaacugagggttgggtttut

SEQ ID NO: 89566 - DNA, 23 bp, Artificial Sequence
  Synthetic
acaatcguctccctttuccacac

SEQ ID NO: 89567 - DNA, 23 bp, Artificial Sequence
  Synthetic
atgtacatggcugaaagctugat

SEQ ID NO: 89568 - DNA, 29 bp, Artificial Sequence
  Synthetic
tgtgguttatcacattttuagccagaaga

SEQ ID NO: 89569 - DNA, 24 bp, Artificial Sequence
  Synthetic
tgttcccacuactccacuacaagt

SEQ ID NO: 89570 - DNA, 20 bp, Artificial Sequence
  Synthetic
gggctgcuacttgtagugga

SEQ ID NO: 89571 - DNA, 26 bp, Artificial Sequence
  Synthetic
ttctttcacauccctgacttgtugat

SEQ ID NO: 89572 - DNA, 27 bp, Artificial Sequence
  Synthetic
gtcttacatggucaagatgttuccact

SEQ ID NO: 89573 - DNA, 28 bp, Artificial Sequence
  Synthetic
gctttagggttatucagccttctctaut

SEQ ID NO: 89574 - DNA, 23 bp, Artificial Sequence
  Synthetic
ctgaaggaaccaguttggtggua

SEQ ID NO: 89575 - DNA, 28 bp, Artificial Sequence
  Synthetic
tgaugatctttatataugcgcacacaca

SEQ ID NO: 89576 - DNA, 21 bp, Artificial Sequence
  Synthetic
gtggaatagucccacgcugaa

SEQ ID NO: 89577 - DNA, 20 bp, Artificial Sequence
  Synthetic
aatagcagggaugcguagcc

SEQ ID NO: 89578 - DNA, 25 bp, Artificial Sequence
  Synthetic
agactctagtgugttcttagggcut

SEQ ID NO: 89579 - DNA, 27 bp, Artificial Sequence
  Synthetic
ccatatcatcacuggcttcttgtttug

SEQ ID NO: 89580 - DNA, 23 bp, Artificial Sequence
  Synthetic
gggagaaugacattgatguggac

SEQ ID NO: 89581 - DNA, 22 bp, Artificial Sequence
  Synthetic
agagcctuccacagcttttuca

SEQ ID NO: 89582 - DNA, 21 bp, Artificial Sequence
  Synthetic
gctcacatuccgtctctcugg

SEQ ID NO: 89583 - DNA, 23 bp, Artificial Sequence
  Synthetic
agaaaccgccutacctgguaaaa

SEQ ID NO: 89584 - DNA, 20 bp, Artificial Sequence
  Synthetic
tccaacaucccagcttgcut

SEQ ID NO: 89585 - DNA, 28 bp, Artificial Sequence
  Synthetic
acataaattacucacaacttccucagca

SEQ ID NO: 89586 - DNA, 24 bp, Artificial Sequence
  Synthetic
acatgttgggaaugaatgagcuct

SEQ ID NO: 89587 - DNA, 25 bp, Artificial Sequence
  Synthetic
ccagtacaggugatctgaggattuc

SEQ ID NO: 89588 - DNA, 21 bp, Artificial Sequence
  Synthetic
ccgacatcugtgttgccauca

SEQ ID NO: 89589 - DNA, 22 bp, Artificial Sequence
  Synthetic
ctggaaaggccuagaaaugcca

SEQ ID NO: 89590 - DNA, 22 bp, Artificial Sequence
  Synthetic
ctcagcctcugtcttgtgtuct

SEQ ID NO: 89591 - DNA, 21 bp, Artificial Sequence
  Synthetic
gagccaagugagtgaguagcc

SEQ ID NO: 89592 - DNA, 28 bp, Artificial Sequence
  Synthetic
gaagacattguacgttgcttaaatcuga

SEQ ID NO: 89593 - DNA, 24 bp, Artificial Sequence
  Synthetic
gttttgacaagaaauggcugcaga

SEQ ID NO: 89594 - DNA, 21 bp, Artificial Sequence
  Synthetic
ccttcaggauctgcagccaut

SEQ ID NO: 89595 - DNA, 29 bp, Artificial Sequence
  Synthetic
ccaaaactagguggaatttgaaatatgut

SEQ ID NO: 89596 - DNA, 24 bp, Artificial Sequence
  Synthetic
gacttcagugcattcaugaagcat

SEQ ID NO: 89597 - DNA, 21 bp, Artificial Sequence
  Synthetic
gccaccauttccacagucact

SEQ ID NO: 89598 - DNA, 22 bp, Artificial Sequence
  Synthetic
ccagtggtcutcctccttaucc

SEQ ID NO: 89599 - DNA, 24 bp, Artificial Sequence
  Synthetic
agaagcgaaagcaggutctuaact

SEQ ID NO: 89600 - DNA, 24 bp, Artificial Sequence
  Synthetic
gtgctugggtgtattugcaaagaa

SEQ ID NO: 89601 - DNA, 22 bp, Artificial Sequence
  Synthetic
tctgggcuttgaaatacuggct

SEQ ID NO: 89602 - DNA, 28 bp, Artificial Sequence
  Synthetic
cctaagcaaatgugattttacccagaug

SEQ ID NO: 89603 - DNA, 26 bp, Artificial Sequence
  Synthetic
cacaattccagaautctccagaggut

SEQ ID NO: 89604 - DNA, 21 bp, Artificial Sequence
  Synthetic
gaactgaccucacttgccuga

SEQ ID NO: 89605 - DNA, 21 bp, Artificial Sequence
  Synthetic
gtagttcauccgctccacgua

SEQ ID NO: 89606 - DNA, 17 bp, Artificial Sequence
  Synthetic
cgggcutgucgcgaaca

SEQ ID NO: 89607 - DNA, 19 bp, Artificial Sequence
  Synthetic
aacucccccaccaacaugg

SEQ ID NO: 89608 - DNA, 18 bp, Artificial Sequence
  Synthetic
agatcgccucaggcaugg

SEQ ID NO: 89609 - DNA, 17 bp, Artificial Sequence
  Synthetic
ccgcgccgugtacucat

SEQ ID NO: 89610 - DNA, 25 bp, Artificial Sequence
  Synthetic
catgccttugctaagctttctucaa

SEQ ID NO: 89611 - DNA, 25 bp, Artificial Sequence
  Synthetic
cuaagatguccacagcagacaaaag

SEQ ID NO: 89612 - DNA, 25 bp, Artificial Sequence
  Synthetic
ggactttgguccacaagcattuaag

SEQ ID NO: 89613 - DNA, 28 bp, Artificial Sequence
  Synthetic
actgcaaaccuctgaagaaaagtguaat

SEQ ID NO: 89614 - DNA, 28 bp, Artificial Sequence
  Synthetic
catgcagataacutgactttccttcuct

SEQ ID NO: 89615 - DNA, 27 bp, Artificial Sequence
  Synthetic
ggaatttaaagtugcgtgtgtctgtut

SEQ ID NO: 89616 - DNA, 21 bp, Artificial Sequence
  Synthetic
ggacaagggugctgtctuagg

SEQ ID NO: 89617 - DNA, 21 bp, Artificial Sequence
  Synthetic
ctgtgcttguagtggagcuga

SEQ ID NO: 89618 - DNA, 32 bp, Artificial Sequence
  Synthetic
agtattttctccutctaattcagtgtuccaag

SEQ ID NO: 89619 - DNA, 20 bp, Artificial Sequence
  Synthetic
ctgtcccugctgctaaugga

SEQ ID NO: 89620 - DNA, 28 bp, Artificial Sequence
  Synthetic
cctaaattgacuacattcttugcccaga

SEQ ID NO: 89621 - DNA, 28 bp, Artificial Sequence
  Synthetic
ctttaagattactutccagttgcgucat

SEQ ID NO: 89622 - DNA, 20 bp, Artificial Sequence
  Synthetic
gagaugctggucagccacat

SEQ ID NO: 89623 - DNA, 19 bp, Artificial Sequence
  Synthetic
tcugcagctuccaggaacc

SEQ ID NO: 89624 - DNA, 23 bp, Artificial Sequence
  Synthetic
ggatcacaccgugcttucaaaat

SEQ ID NO: 89625 - DNA, 28 bp, Artificial Sequence
  Synthetic
tgacactgtgggaauatatgtgctttut

SEQ ID NO: 89626 - DNA, 28 bp, Artificial Sequence
  Synthetic
caactactatgcaaugaaacagcaauct

SEQ ID NO: 89627 - DNA, 29 bp, Artificial Sequence
  Synthetic
aagcaaagugatactaugacagaaaagga

SEQ ID NO: 89628 - DNA, 27 bp, Artificial Sequence
  Synthetic
gagcatctcucagattttgctcuagaa

SEQ ID NO: 89629 - DNA, 20 bp, Artificial Sequence
  Synthetic
agacacugaggcgcatctug

SEQ ID NO: 89630 - DNA, 22 bp, Artificial Sequence
  Synthetic
tgatgcactcugggcaagaaut

SEQ ID NO: 89631 - DNA, 29 bp, Artificial Sequence
  Synthetic
gagaacaagaacagcuaaatguggaaaag

SEQ ID NO: 89632 - DNA, 24 bp, Artificial Sequence
  Synthetic
aaaggactttucccaccaagagut

SEQ ID NO: 89633 - DNA, 21 bp, Artificial Sequence
  Synthetic
gtauaagacggcggagcauca

SEQ ID NO: 89634 - DNA, 19 bp, Artificial Sequence
  Synthetic
ctgtucagcacgcucaagg

SEQ ID NO: 89635 - DNA, 28 bp, Artificial Sequence
  Synthetic
caccatggagcuctgttagtagataaut

SEQ ID NO: 89636 - DNA, 23 bp, Artificial Sequence
  Synthetic
tgacagugaggcagatgtcctua

SEQ ID NO: 89637 - DNA, 21 bp, Artificial Sequence
  Synthetic
caccaccacacutccagtcuc

SEQ ID NO: 89638 - DNA, 19 bp, Artificial Sequence
  Synthetic
ggautgctguccccaccac

SEQ ID NO: 89639 - DNA, 17 bp, Artificial Sequence
  Synthetic
ggccucccaggcaucac

SEQ ID NO: 89640 - DNA, 28 bp, Artificial Sequence
  Synthetic
cctgttttatagaaauactgtgcacugg

SEQ ID NO: 89641 - DNA, 28 bp, Artificial Sequence
  Synthetic
ttcatctaacutgtcatgtuccaacact

SEQ ID NO: 89642 - DNA, 21 bp, Artificial Sequence
  Synthetic
agcctctttcutgcgggtauc

SEQ ID NO: 89643 - DNA, 25 bp, Artificial Sequence
  Synthetic
ctccttgctucctttagtcacagua

SEQ ID NO: 89644 - DNA, 18 bp, Artificial Sequence
  Synthetic
cacagucaccgccgctua

SEQ ID NO: 89645 - DNA, 21 bp, Artificial Sequence
  Synthetic
ggaatcgttguggaggtgguc

SEQ ID NO: 89646 - DNA, 21 bp, Artificial Sequence
  Synthetic
aagaucaugcccaagaagcca

SEQ ID NO: 89647 - DNA, 27 bp, Artificial Sequence
  Synthetic
agagaagttgtucccaaatcattucct

SEQ ID NO: 89648 - DNA, 17 bp, Artificial Sequence
  Synthetic
cuccgggccgacaugag

SEQ ID NO: 89649 - DNA, 17 bp, Artificial Sequence
  Synthetic
ggcuccggcctgucaaa

SEQ ID NO: 89650 - DNA, 23 bp, Artificial Sequence
  Synthetic
ccctagccauccattcaccaaut

SEQ ID NO: 89651 - DNA, 19 bp, Artificial Sequence
  Synthetic
ccacaguggctcggaguag

SEQ ID NO: 89652 - DNA, 28 bp, Artificial Sequence
  Synthetic
gcugttgcuaaaacaaagaaaacagagt

SEQ ID NO: 89653 - DNA, 20 bp, Artificial Sequence
  Synthetic
gacccgaaggcaguctguag

SEQ ID NO: 89654 - DNA, 22 bp, Artificial Sequence
  Synthetic
ccaagaggguggagauccagat

SEQ ID NO: 89655 - DNA, 19 bp, Artificial Sequence
  Synthetic
gugtagccucagccacagg

SEQ ID NO: 89656 - DNA, 23 bp, Artificial Sequence
  Synthetic
agaccutggagaatucagagcct

SEQ ID NO: 89657 - DNA, 22 bp, Artificial Sequence
  Synthetic
cccatuaccacagcauccaaga

SEQ ID NO: 89658 - DNA, 21 bp, Artificial Sequence
  Synthetic
cccagcucagcugcaaagaat

SEQ ID NO: 89659 - DNA, 25 bp, Artificial Sequence
  Synthetic
cctacgatcagucctaccaauacct

SEQ ID NO: 89660 - DNA, 20 bp, Artificial Sequence
  Synthetic
agtcaacugaaggccacguc

SEQ ID NO: 89661 - DNA, 28 bp, Artificial Sequence
  Synthetic
gcagcgtaataagcugtatctgttgaua

SEQ ID NO: 89662 - DNA, 24 bp, Artificial Sequence
  Synthetic
cactggtaccutggaaagcuaagt

SEQ ID NO: 89663 - DNA, 25 bp, Artificial Sequence
  Synthetic
tggcaacaauaaagatgaugaccca

SEQ ID NO: 89664 - DNA, 20 bp, Artificial Sequence
  Synthetic
gucgagacacccaacuccac

SEQ ID NO: 89665 - DNA, 21 bp, Artificial Sequence
  Synthetic
gttggcutagggaguccacat

SEQ ID NO: 89666 - DNA, 19 bp, Artificial Sequence
  Synthetic
gcctcaccutccccuggat

SEQ ID NO: 89667 - DNA, 17 bp, Artificial Sequence
  Synthetic
aagagcugggcgaccug

SEQ ID NO: 89668 - DNA, 21 bp, Artificial Sequence
  Synthetic
ctgggcgugaagaacucagaa

SEQ ID NO: 89669 - DNA, 20 bp, Artificial Sequence
  Synthetic
cacctgctuggacgagaugt

SEQ ID NO: 89670 - DNA, 18 bp, Artificial Sequence
  Synthetic
tcagguagucgcggagga

SEQ ID NO: 89671 - DNA, 18 bp, Artificial Sequence
  Synthetic
cgagctgcuggagcacua

SEQ ID NO: 89672 - DNA, 18 bp, Artificial Sequence
  Synthetic
ggaugcgagccaggtuct

SEQ ID NO: 89673 - DNA, 18 bp, Artificial Sequence
  Synthetic
ccgcgagagcutcgacug

SEQ ID NO: 89674 - DNA, 18 bp, Artificial Sequence
  Synthetic
gcuccagcagcucgaaga

SEQ ID NO: 89675 - DNA, 17 bp, Artificial Sequence
  Synthetic
gtgggcaccutccuggt

SEQ ID NO: 89676 - DNA, 17 bp, Artificial Sequence
  Synthetic
ccagcauggagcaccug

SEQ ID NO: 89677 - DNA, 18 bp, Artificial Sequence
  Synthetic
agcagccaaggccguaut

SEQ ID NO: 89678 - DNA, 24 bp, Artificial Sequence
  Synthetic
gaaagaacccacacuccgtgaaua

SEQ ID NO: 89679 - DNA, 20 bp, Artificial Sequence
  Synthetic
ttgacccggcuggtattguc

SEQ ID NO: 89680 - DNA, 19 bp, Artificial Sequence
  Synthetic
cgcacugagctgtccatug

SEQ ID NO: 89681 - DNA, 17 bp, Artificial Sequence
  Synthetic
cggtgggcugactccug

SEQ ID NO: 89682 - DNA, 17 bp, Artificial Sequence
  Synthetic
gaccaggguggcugcat

SEQ ID NO: 89683 - DNA, 21 bp, Artificial Sequence
  Synthetic
ccgggaccuccagtaccauag

SEQ ID NO: 89684 - DNA, 21 bp, Artificial Sequence
  Synthetic
gcuaagggcgaaaaagcagut

SEQ ID NO: 89685 - DNA, 17 bp, Artificial Sequence
  Synthetic
cgtucgcacgccgatua

SEQ ID NO: 89686 - DNA, 20 bp, Artificial Sequence
  Synthetic
ctctgctgcugtggagacug

SEQ ID NO: 89687 - DNA, 21 bp, Artificial Sequence
  Synthetic
ccagctcaccuctttgtcuct

SEQ ID NO: 89688 - DNA, 17 bp, Artificial Sequence
  Synthetic
gcgtgaugcgccgguaa

SEQ ID NO: 89689 - DNA, 22 bp, Artificial Sequence
  Synthetic
cagaaccttccucctcttccuc

SEQ ID NO: 89690 - DNA, 22 bp, Artificial Sequence
  Synthetic
cggagaucaccatcgucaaacc

SEQ ID NO: 89691 - DNA, 18 bp, Artificial Sequence
  Synthetic
tcagcaggcutgggcauc

SEQ ID NO: 89692 - DNA, 19 bp, Artificial Sequence
  Synthetic
cggaggcgccuacactuac

SEQ ID NO: 89693 - DNA, 18 bp, Artificial Sequence
  Synthetic
gccugccaaggccatgut

SEQ ID NO: 89694 - DNA, 28 bp, Artificial Sequence
  Synthetic
gagagaatcatuaggaagctgaacauca

SEQ ID NO: 89695 - DNA, 26 bp, Artificial Sequence
  Synthetic
ccttcagaaacaccaucaatccttut

SEQ ID NO: 89696 - DNA, 20 bp, Artificial Sequence
  Synthetic
gaacggaaugtgcggaagug

SEQ ID NO: 89697 - DNA, 17 bp, Artificial Sequence
  Synthetic
gguggcagccgacaaug

SEQ ID NO: 89698 - DNA, 21 bp, Artificial Sequence
  Synthetic
gaaggagaggcaauggauccc

SEQ ID NO: 89699 - DNA, 28 bp, Artificial Sequence
  Synthetic
agggccacucatttcttatuaaaagaca

SEQ ID NO: 89700 - DNA, 25 bp, Artificial Sequence
  Synthetic
gagccattttucctctacagcucat

SEQ ID NO: 89701 - DNA, 27 bp, Artificial Sequence
  Synthetic
cccaactttcacaauaccaggtacaua

SEQ ID NO: 89702 - DNA, 22 bp, Artificial Sequence
  Synthetic
agacagcacaccagucttcaut

SEQ ID NO: 89703 - DNA, 28 bp, Artificial Sequence
  Synthetic
ccatgtgaaaatugaacctgcagataug

SEQ ID NO: 89704 - DNA, 21 bp, Artificial Sequence
  Synthetic
ccacatggtuccaggcaagua

SEQ ID NO: 89705 - DNA, 19 bp, Artificial Sequence
  Synthetic
cgagaaccuggctcgcauc

SEQ ID NO: 89706 - DNA, 24 bp, Artificial Sequence
  Synthetic
agaccaacuacggttgaaaacgua

SEQ ID NO: 89707 - DNA, 24 bp, Artificial Sequence
  Synthetic
agctccugcaaaccacagtattut

SEQ ID NO: 89708 - DNA, 28 bp, Artificial Sequence
  Synthetic
aatgcataggtcuactctgacttcatut

SEQ ID NO: 89709 - DNA, 21 bp, Artificial Sequence
  Synthetic
ttgugcaacccacucaacaga

SEQ ID NO: 89710 - DNA, 30 bp, Artificial Sequence
  Synthetic
aggaaaaatgtgguatctgaagctcuaaaa

SEQ ID NO: 89711 - DNA, 23 bp, Artificial Sequence
  Synthetic
gcatgtttcugcctagcttcuac

SEQ ID NO: 89712 - DNA, 26 bp, Artificial Sequence
  Synthetic
caataaaatggatgutcccccagcua

SEQ ID NO: 89713 - DNA, 28 bp, Artificial Sequence
  Synthetic
gacagtggaagcuatggtcatattauca

SEQ ID NO: 89714 - DNA, 27 bp, Artificial Sequence
  Synthetic
gtaatcatgtggauaggattgagccut

SEQ ID NO: 89715 - DNA, 24 bp, Artificial Sequence
  Synthetic
gtgatgccaggagutaagaggaut

SEQ ID NO: 89716 - DNA, 23 bp, Artificial Sequence
  Synthetic
cctgactgttugcagctttcaut

SEQ ID NO: 89717 - DNA, 28 bp, Artificial Sequence
  Synthetic
tttgtcatcgutttgttttagtugagca

SEQ ID NO: 89718 - DNA, 21 bp, Artificial Sequence
  Synthetic
gcaggcucaatctgaggauga

SEQ ID NO: 89719 - DNA, 24 bp, Artificial Sequence
  Synthetic
cagttttuggaagcacaaguggat

SEQ ID NO: 89720 - DNA, 26 bp, Artificial Sequence
  Synthetic
gggagtacaggauacattcaagctut

SEQ ID NO: 89721 - DNA, 26 bp, Artificial Sequence
  Synthetic
ggatgtugcaaaggacaaatatgugt

SEQ ID NO: 89722 - DNA, 20 bp, Artificial Sequence
  Synthetic
accucccaggccctaugaag

SEQ ID NO: 89723 - DNA, 21 bp, Artificial Sequence
  Synthetic
acagggcagcaaguaacucag

SEQ ID NO: 89724 - DNA, 26 bp, Artificial Sequence
  Synthetic
gacautaggactaguagaacgaacgg

SEQ ID NO: 89725 - DNA, 28 bp, Artificial Sequence
  Synthetic
tgacatgtaccacagaauaggaaggaua

SEQ ID NO: 89726 - DNA, 27 bp, Artificial Sequence
  Synthetic
cattttcactgaucacctttccagtuc

SEQ ID NO: 89727 - DNA, 24 bp, Artificial Sequence
  Synthetic
augttggcccugaaacaaaaacaa

SEQ ID NO: 89728 - DNA, 27 bp, Artificial Sequence
  Synthetic
ctcattctguagggcagtatttuccat

SEQ ID NO: 89729 - DNA, 28 bp, Artificial Sequence
  Synthetic
gcaagactggagagutaaatcagcttut

SEQ ID NO: 89730 - DNA, 22 bp, Artificial Sequence
  Synthetic
gaaagtcaccuaagggccucat

SEQ ID NO: 89731 - DNA, 23 bp, Artificial Sequence
  Synthetic
gctgtcauagccgagaacaaugg

SEQ ID NO: 89732 - DNA, 28 bp, Artificial Sequence
  Synthetic
cttctcctgcautgatttaactgcatut

SEQ ID NO: 89733 - DNA, 20 bp, Artificial Sequence
  Synthetic
tcgggaggcugccctattua

SEQ ID NO: 89734 - DNA, 22 bp, Artificial Sequence
  Synthetic
gcccaggaaugctacagauacc

SEQ ID NO: 89735 - DNA, 27 bp, Artificial Sequence
  Synthetic
aaaaccctgatguttcagtgtctagut

SEQ ID NO: 89736 - DNA, 28 bp, Artificial Sequence
  Synthetic
gacttcaguacaactcacuggaagaaat

SEQ ID NO: 89737 - DNA, 27 bp, Artificial Sequence
  Synthetic
gctgaaagcauttaagtacagauccgt

SEQ ID NO: 89738 - DNA, 21 bp, Artificial Sequence
  Synthetic
gggcutguggagaagagaagt

SEQ ID NO: 89739 - DNA, 28 bp, Artificial Sequence
  Synthetic
tctggattcuagccactctaacacttua

SEQ ID NO: 89740 - DNA, 25 bp, Artificial Sequence
  Synthetic
acttcacttgccuatttctgccaut

SEQ ID NO: 89741 - DNA, 20 bp, Artificial Sequence
  Synthetic
ctccacagaucaggcagguc

SEQ ID NO: 89742 - DNA, 28 bp, Artificial Sequence
  Synthetic
aaagtcactttuagagcccttaatgugt

SEQ ID NO: 89743 - DNA, 25 bp, Artificial Sequence
  Synthetic
ggacctgcucctagatgggtauaaa

SEQ ID NO: 89744 - DNA, 19 bp, Artificial Sequence
  Synthetic
gatggccaggcuctgtgut

SEQ ID NO: 89745 - DNA, 20 bp, Artificial Sequence
  Synthetic
gcagcaggautggcttgtut

SEQ ID NO: 89746 - DNA, 19 bp, Artificial Sequence
  Synthetic
cccutcttuggcgacgagt

SEQ ID NO: 89747 - DNA, 19 bp, Artificial Sequence
  Synthetic
gcugccacagggagctuag

SEQ ID NO: 89748 - DNA, 22 bp, Artificial Sequence
  Synthetic
cacctccttgucaaccctgtut

SEQ ID NO: 89749 - DNA, 22 bp, Artificial Sequence
  Synthetic
cagaaaggaucttgggcactug

SEQ ID NO: 89750 - DNA, 27 bp, Artificial Sequence
  Synthetic
cautgactattacttuccaccccagaa

SEQ ID NO: 89751 - DNA, 22 bp, Artificial Sequence
  Synthetic
gtgcatgugcaagacccttuac

SEQ ID NO: 89752 - DNA, 23 bp, Artificial Sequence
  Synthetic
cgaaagaagacaaaggugugcat

SEQ ID NO: 89753 - DNA, 22 bp, Artificial Sequence
  Synthetic
gugcaacaaggaatuccccaac

SEQ ID NO: 89754 - DNA, 27 bp, Artificial Sequence
  Synthetic
ctttcttctguacctaattctguccca

SEQ ID NO: 89755 - DNA, 28 bp, Artificial Sequence
  Synthetic
gcagtagaggaacuacacaaactttuga

SEQ ID NO: 89756 - DNA, 21 bp, Artificial Sequence
  Synthetic
atcgtgactgutgtgggacuc

SEQ ID NO: 89757 - DNA, 22 bp, Artificial Sequence
  Synthetic
gccttccaugcgatcatttugt

SEQ ID NO: 89758 - DNA, 25 bp, Artificial Sequence
  Synthetic
aaacacttacctucaccagcttcut

SEQ ID NO: 89759 - DNA, 28 bp, Artificial Sequence
  Synthetic
gttgcattgttgacugttaggtaactut

SEQ ID NO: 89760 - DNA, 23 bp, Artificial Sequence
  Synthetic
gtcagggaautcctcaagucagg

SEQ ID NO: 89761 - DNA, 27 bp, Artificial Sequence
  Synthetic
tccctcccutttaactcttacugaaca

SEQ ID NO: 89762 - DNA, 21 bp, Artificial Sequence
  Synthetic
catggttgagcugtccacuga

SEQ ID NO: 89763 - DNA, 26 bp, Artificial Sequence
  Synthetic
catttgtuctgagagttuccacacag

SEQ ID NO: 89764 - DNA, 22 bp, Artificial Sequence
  Synthetic
ccggaaatgauggcagagauca

SEQ ID NO: 89765 - DNA, 23 bp, Artificial Sequence
  Synthetic
tgcagaggaguagtgcagagtua

SEQ ID NO: 89766 - DNA, 28 bp, Artificial Sequence
  Synthetic
caatgaacctguctaatatgctctucca

SEQ ID NO: 89767 - DNA, 21 bp, Artificial Sequence
  Synthetic
ccgaagttgucaacgaccuca

SEQ ID NO: 89768 - DNA, 28 bp, Artificial Sequence
  Synthetic
cauataacccaatuagaagaggcaagca

SEQ ID NO: 89769 - DNA, 28 bp, Artificial Sequence
  Synthetic
atgtgcaacattuttcgtcttgtgauat

SEQ ID NO: 89770 - DNA, 28 bp, Artificial Sequence
  Synthetic
gtgcttctctuttgatttaacaagugct

SEQ ID NO: 89771 - DNA, 27 bp, Artificial Sequence
  Synthetic
cgttatcgacaaagggutgaactttua

SEQ ID NO: 89772 - DNA, 27 bp, Artificial Sequence
  Synthetic
cagcatttagacuatcttgcagtucct

SEQ ID NO: 89773 - DNA, 27 bp, Artificial Sequence
  Synthetic
acgacgagaaaaagaaautgcugaaac

SEQ ID NO: 89774 - DNA, 22 bp, Artificial Sequence
  Synthetic
cgauaacgcagactcucaacct

SEQ ID NO: 89775 - DNA, 33 bp, Artificial Sequence
  Synthetic
attaaagtcaatgauttttgtcatctuaccaaa

SEQ ID NO: 89776 - DNA, 25 bp, Artificial Sequence
  Synthetic
gtaacatgctucagcaaggattcut

SEQ ID NO: 89777 - DNA, 23 bp, Artificial Sequence
  Synthetic
tgcacgtcccacuggagaataua

SEQ ID NO: 89778 - DNA, 22 bp, Artificial Sequence
  Synthetic
cggatgtgtucctgaagagugt

SEQ ID NO: 89779 - DNA, 25 bp, Artificial Sequence
  Synthetic
catcttaagcaagugcatgaagcuc

SEQ ID NO: 89780 - DNA, 23 bp, Artificial Sequence
  Synthetic
catgtggcugtacagttccucaa

SEQ ID NO: 89781 - DNA, 21 bp, Artificial Sequence
  Synthetic
cagugtgtctacugccacgag

SEQ ID NO: 89782 - DNA, 33 bp, Artificial Sequence
  Synthetic
attcatcacctttucatatttttacagatcuga

SEQ ID NO: 89783 - DNA, 28 bp, Artificial Sequence
  Synthetic
cagcaatcuacaagttaccgaaaucaac

SEQ ID NO: 89784 - DNA, 25 bp, Artificial Sequence
  Synthetic
tttcggtaacutgtagattgcugct

SEQ ID NO: 89785 - DNA, 28 bp, Artificial Sequence
  Synthetic
cgtttttcataaugctgtgcacauaact

SEQ ID NO: 89786 - DNA, 27 bp, Artificial Sequence
  Synthetic
tcaagactcttacuatgcgtgacttug

SEQ ID NO: 89787 - DNA, 21 bp, Artificial Sequence
  Synthetic
ctctcgaaccutcttcuccga

SEQ ID NO: 89788 - DNA, 28 bp, Artificial Sequence
  Synthetic
cagtgtttttcucgcaagtgtttttcua

SEQ ID NO: 89789 - DNA, 26 bp, Artificial Sequence
  Synthetic
gaaaaccaagggaaagugcataagug

SEQ ID NO: 89790 - DNA, 22 bp, Artificial Sequence
  Synthetic
gaaacaaucagacctgggucct

SEQ ID NO: 89791 - DNA, 28 bp, Artificial Sequence
  Synthetic
gcagattcaccugaaaactatgcactua

SEQ ID NO: 89792 - DNA, 23 bp, Artificial Sequence
  Synthetic
tctcctgucccctatgcaatuct

SEQ ID NO: 89793 - DNA, 22 bp, Artificial Sequence
  Synthetic
acagggaagcguatttccucac

SEQ ID NO: 89794 - DNA, 21 bp, Artificial Sequence
  Synthetic
gggagguctcctcuacgaaga

SEQ ID NO: 89795 - DNA, 23 bp, Artificial Sequence
  Synthetic
aggacuggaagaugaaggacact

SEQ ID NO: 89796 - DNA, 28 bp, Artificial Sequence
  Synthetic
gtgtactuagcaccacattgatuacaga

SEQ ID NO: 89797 - DNA, 24 bp, Artificial Sequence
  Synthetic
aacattccctuggccctgaatuat

SEQ ID NO: 89798 - DNA, 23 bp, Artificial Sequence
  Synthetic
caaaggacucaccgcagaaaaug

SEQ ID NO: 89799 - DNA, 29 bp, Artificial Sequence
  Synthetic
agcacaguaacgaaaagaaagtctauagg

SEQ ID NO: 89800 - DNA, 24 bp, Artificial Sequence
  Synthetic
aatatgggccugttctggcttauc

SEQ ID NO: 89801 - DNA, 21 bp, Artificial Sequence
  Synthetic
acatgactgguccctcgagua

SEQ ID NO: 89802 - DNA, 24 bp, Artificial Sequence
  Synthetic
cctggattucttcccattguggat

SEQ ID NO: 89803 - DNA, 28 bp, Artificial Sequence
  Synthetic
ctcccaaagaaccaguagtagaagtcua

SEQ ID NO: 89804 - DNA, 22 bp, Artificial Sequence
  Synthetic
cctcacacugactgcacttcug

SEQ ID NO: 89805 - DNA, 21 bp, Artificial Sequence
  Synthetic
tcacacguccaacaagccaua

SEQ ID NO: 89806 - DNA, 22 bp, Artificial Sequence
  Synthetic
catatgtucccggaggccatut

SEQ ID NO: 89807 - DNA, 26 bp, Artificial Sequence
  Synthetic
ctatggaaactutgctgcagaaucac

SEQ ID NO: 89808 - DNA, 28 bp, Artificial Sequence
  Synthetic
tggcgaauttgtacaauaggaacaagaa

SEQ ID NO: 89809 - DNA, 22 bp, Artificial Sequence
  Synthetic
gggtttcucactgactctuccc

SEQ ID NO: 89810 - DNA, 26 bp, Artificial Sequence
  Synthetic
acagctgtagguaacttttgcttgut

SEQ ID NO: 89811 - DNA, 23 bp, Artificial Sequence
  Synthetic
gtacgacuccagattccaaccuc

SEQ ID NO: 89812 - DNA, 17 bp, Artificial Sequence
  Synthetic
cgggcucctccgtguag

SEQ ID NO: 89813 - DNA, 18 bp, Artificial Sequence
  Synthetic
acuggcaaggaccctgug

SEQ ID NO: 89814 - DNA, 21 bp, Artificial Sequence
  Synthetic
gtctugcaggaggtcatcugg

SEQ ID NO: 89815 - DNA, 21 bp, Artificial Sequence
  Synthetic
ccgccuggccatgaagtauat

SEQ ID NO: 89816 - DNA, 21 bp, Artificial Sequence
  Synthetic
cggaagucccagtugcaagat

SEQ ID NO: 89817 - DNA, 22 bp, Artificial Sequence
  Synthetic
cctucagaaacacctgcuggac

SEQ ID NO: 89818 - DNA, 21 bp, Artificial Sequence
  Synthetic
ctcctggtcautgagcagcut

SEQ ID NO: 89819 - DNA, 19 bp, Artificial Sequence
  Synthetic
ggcagcagaaugugaacgg

SEQ ID NO: 89820 - DNA, 25 bp, Artificial Sequence
  Synthetic
atctcattctugctgagcttctugt

SEQ ID NO: 89821 - DNA, 28 bp, Artificial Sequence
  Synthetic
ttctcctaactctugtcctcctaatcuc

SEQ ID NO: 89822 - DNA, 21 bp, Artificial Sequence
  Synthetic
gtctgatgutgtggtcucgga

SEQ ID NO: 89823 - DNA, 21 bp, Artificial Sequence
  Synthetic
gcagacuttgcugaccaacag

SEQ ID NO: 89824 - DNA, 28 bp, Artificial Sequence
  Synthetic
cacaaattaagugatgctaatggucagg

SEQ ID NO: 89825 - DNA, 25 bp, Artificial Sequence
  Synthetic
aatgagaatugacccatgagtugga

SEQ ID NO: 89826 - DNA, 27 bp, Artificial Sequence
  Synthetic
gauctgtataggtauccaagccaagac

SEQ ID NO: 89827 - DNA, 27 bp, Artificial Sequence
  Synthetic
atttggtctaauggtacaactgcugaa

SEQ ID NO: 89828 - DNA, 23 bp, Artificial Sequence
  Synthetic
gctttctggaucctgacatuggg

SEQ ID NO: 89829 - DNA, 23 bp, Artificial Sequence
  Synthetic
tggctcatucatgctcttaugct

SEQ ID NO: 89830 - DNA, 18 bp, Artificial Sequence
  Synthetic
gccctccuggctgaucct

SEQ ID NO: 89831 - DNA, 17 bp, Artificial Sequence
  Synthetic
cggcagcuccctggaug

SEQ ID NO: 89832 - DNA, 24 bp, Artificial Sequence
  Synthetic
aaccaaaataugcagggagauggt

SEQ ID NO: 89833 - DNA, 25 bp, Artificial Sequence
  Synthetic
ggattgctcagautgggtggtaauc

SEQ ID NO: 89834 - DNA, 23 bp, Artificial Sequence
  Synthetic
caggatcuccctcgtctttuacc

SEQ ID NO: 89835 - DNA, 24 bp, Artificial Sequence
  Synthetic
gggccatacutttcacactctucc

SEQ ID NO: 89836 - DNA, 21 bp, Artificial Sequence
  Synthetic
acttcaugggagccacctcua

SEQ ID NO: 89837 - DNA, 25 bp, Artificial Sequence
  Synthetic
agcatgtcatuctccttgtttugga

SEQ ID NO: 89838 - DNA, 23 bp, Artificial Sequence
  Synthetic
gcugaaaaagcccgugagaaaga

SEQ ID NO: 89839 - DNA, 23 bp, Artificial Sequence
  Synthetic
gtccttucggcaagagactugat

SEQ ID NO: 89840 - DNA, 21 bp, Artificial Sequence
  Synthetic
gctctcttcaugccctgcauc

SEQ ID NO: 89841 - DNA, 22 bp, Artificial Sequence
  Synthetic
actagtgccaauggctgcttut

SEQ ID NO: 89842 - DNA, 20 bp, Artificial Sequence
  Synthetic
agcccactuacctgcgttuc

SEQ ID NO: 89843 - DNA, 28 bp, Artificial Sequence
  Synthetic
gtctttucaagtgagguaaccaacaaaa

SEQ ID NO: 89844 - DNA, 21 bp, Artificial Sequence
  Synthetic
gggaaucttggctuccacacc

SEQ ID NO: 89845 - DNA, 22 bp, Artificial Sequence
  Synthetic
gggctcacutcccagtucaaaa

SEQ ID NO: 89846 - DNA, 26 bp, Artificial Sequence
  Synthetic
cgaaataactcucgagccttcauacc

SEQ ID NO: 89847 - DNA, 21 bp, Artificial Sequence
  Synthetic
gcgagcuttcuaccccagaga

SEQ ID NO: 89848 - DNA, 19 bp, Artificial Sequence
  Synthetic
cccaccgacugctgaaugg

SEQ ID NO: 89849 - DNA, 21 bp, Artificial Sequence
  Synthetic
ggcacaaugaagaggcatcug

SEQ ID NO: 89850 - DNA, 20 bp, Artificial Sequence
  Synthetic
tcttggtcucaccgttgugg

SEQ ID NO: 89851 - DNA, 25 bp, Artificial Sequence
  Synthetic
cagtgtgagugagtgtcagtguaat

SEQ ID NO: 89852 - DNA, 18 bp, Artificial Sequence
  Synthetic
ctgcuggcctuggagaca

SEQ ID NO: 89853 - DNA, 18 bp, Artificial Sequence
  Synthetic
cugggagacccctuccac

SEQ ID NO: 89854 - DNA, 22 bp, Artificial Sequence
  Synthetic
cctccaucagaatgtccuccag

SEQ ID NO: 89855 - DNA, 20 bp, Artificial Sequence
  Synthetic
cgcagcaacgutccatguag

SEQ ID NO: 89856 - DNA, 18 bp, Artificial Sequence
  Synthetic
ggagcautcugggcaggt

SEQ ID NO: 89857 - DNA, 19 bp, Artificial Sequence
  Synthetic
ctccagggcugctttccut

SEQ ID NO: 89858 - DNA, 20 bp, Artificial Sequence
  Synthetic
tgtcagaagccgaagucgug

SEQ ID NO: 89859 - DNA, 24 bp, Artificial Sequence
  Synthetic
ctgagggacuctgaaccctactua

SEQ ID NO: 89860 - DNA, 22 bp, Artificial Sequence
  Synthetic
tcatcctgacuggtcctcctut

SEQ ID NO: 89861 - DNA, 20 bp, Artificial Sequence
  Synthetic
ccctgctcucttcagtgucc

SEQ ID NO: 89862 - DNA, 24 bp, Artificial Sequence
  Synthetic
aagaaatccaggugaaagcaguca

SEQ ID NO: 89863 - DNA, 22 bp, Artificial Sequence
  Synthetic
tccccucctgctcatucagaat

SEQ ID NO: 89864 - DNA, 23 bp, Artificial Sequence
  Synthetic
tcctaggccaauccttcuaaggt

SEQ ID NO: 89865 - DNA, 21 bp, Artificial Sequence
  Synthetic
ctgagtacauggccaauggct

SEQ ID NO: 89866 - DNA, 22 bp, Artificial Sequence
  Synthetic
ggcctgaaaauccagagctuca

SEQ ID NO: 89867 - DNA, 22 bp, Artificial Sequence
  Synthetic
agttcaccaugtgtgtgtucca

SEQ ID NO: 89868 - DNA, 22 bp, Artificial Sequence
  Synthetic
tgctacagtutctgcctctucc

SEQ ID NO: 89869 - DNA, 26 bp, Artificial Sequence
  Synthetic
gacaactcattaguagcctgactgut

SEQ ID NO: 89870 - DNA, 26 bp, Artificial Sequence
  Synthetic
tgataatgccaguaaactagcugcaa

SEQ ID NO: 89871 - DNA, 25 bp, Artificial Sequence
  Synthetic
tggaaccugaacagaattctucacc

SEQ ID NO: 89872 - DNA, 22 bp, Artificial Sequence
  Synthetic
gcatctcccucaggtagtucag

SEQ ID NO: 89873 - DNA, 25 bp, Artificial Sequence
  Synthetic
gactagttcctugcctttcctguag

SEQ ID NO: 89874 - DNA, 28 bp, Artificial Sequence
  Synthetic
gaaaaccacatcucacataaatgccaut

SEQ ID NO: 89875 - DNA, 21 bp, Artificial Sequence
  Synthetic
tggaggcagcucagagtuaga

SEQ ID NO: 89876 - DNA, 21 bp, Artificial Sequence
  Synthetic
ggaaccacaaagcuagcguct

SEQ ID NO: 89877 - DNA, 25 bp, Artificial Sequence
  Synthetic
gtggcagaaaaggaauccttaguga

SEQ ID NO: 89878 - DNA, 22 bp, Artificial Sequence
  Synthetic
cctgacctgugtgtctgtguat

SEQ ID NO: 89879 - DNA, 23 bp, Artificial Sequence
  Synthetic
caccauguacaccagaaacacca

SEQ ID NO: 89880 - DNA, 21 bp, Artificial Sequence
  Synthetic
cagaucaatuccgcacagacc

SEQ ID NO: 89881 - DNA, 28 bp, Artificial Sequence
  Synthetic
ggtttcugaaaggaacaggtattuagca

SEQ ID NO: 89882 - DNA, 24 bp, Artificial Sequence
  Synthetic
cttactucaagcaaagctcagugt

SEQ ID NO: 89883 - DNA, 24 bp, Artificial Sequence
  Synthetic
caccattcagagugctttttccut

SEQ ID NO: 89884 - DNA, 22 bp, Artificial Sequence
  Synthetic
caggttccucagcttcctucag

SEQ ID NO: 89885 - DNA, 24 bp, Artificial Sequence
  Synthetic
ggctgcauacatgtgtagauggat

SEQ ID NO: 89886 - DNA, 22 bp, Artificial Sequence
  Synthetic
tccatgttugggtgctttguga

SEQ ID NO: 89887 - DNA, 24 bp, Artificial Sequence
  Synthetic
gcaaaccttugcacagtatcaucc

SEQ ID NO: 89888 - DNA, 27 bp, Artificial Sequence
  Synthetic
gagattttggaugatactgugcaaagg

SEQ ID NO: 89889 - DNA, 24 bp, Artificial Sequence
  Synthetic
caggacugctcagacatucaagaa

SEQ ID NO: 89890 - DNA, 23 bp, Artificial Sequence
  Synthetic
gccaaaautcacugacaaaggct

SEQ ID NO: 89891 - DNA, 22 bp, Artificial Sequence
  Synthetic
ggagcaucaagagagacaccut

SEQ ID NO: 89892 - DNA, 22 bp, Artificial Sequence
  Synthetic
cttgaggcucatctctctgcuc

SEQ ID NO: 89893 - DNA, 26 bp, Artificial Sequence
  Synthetic
gagccttagaucagcagaaagaugaa

SEQ ID NO: 89894 - DNA, 21 bp, Artificial Sequence
  Synthetic
ccagtcctcugccctcttcut

SEQ ID NO: 89895 - DNA, 21 bp, Artificial Sequence
  Synthetic
gucttctccugcacaggaacc

SEQ ID NO: 89896 - DNA, 20 bp, Artificial Sequence
  Synthetic
cgaaaccugagaaggccuca

SEQ ID NO: 89897 - DNA, 20 bp, Artificial Sequence
  Synthetic
ctgugggtgacuggcagaaa

SEQ ID NO: 89898 - DNA, 21 bp, Artificial Sequence
  Synthetic
cgcagtaaugcgaacauccaa

SEQ ID NO: 89899 - DNA, 26 bp, Artificial Sequence
  Synthetic
gtgccaattaagugcataaatgcugt

SEQ ID NO: 89900 - DNA, 25 bp, Artificial Sequence
  Synthetic
cgtgcaaagaguaaaacatgtuccc

SEQ ID NO: 89901 - DNA, 27 bp, Artificial Sequence
  Synthetic
aatcactgaagtutgttttccctcuct

SEQ ID NO: 89902 - DNA, 25 bp, Artificial Sequence
  Synthetic
cgaagaaagagacuctggaaacuca

SEQ ID NO: 89903 - DNA, 27 bp, Artificial Sequence
  Synthetic
cagagtcatcccugcttcataacatut

SEQ ID NO: 89904 - DNA, 21 bp, Artificial Sequence
  Synthetic
tgtccatcutgtcgtctucgg

SEQ ID NO: 89905 - DNA, 26 bp, Artificial Sequence
  Synthetic
cccutggaagcaucaaagaagaaaat

SEQ ID NO: 89906 - DNA, 28 bp, Artificial Sequence
  Synthetic
agccatgattuatgattcagttguacct

SEQ ID NO: 89907 - DNA, 25 bp, Artificial Sequence
  Synthetic
tgattttgguaagctacuggagcat

SEQ ID NO: 89908 - DNA, 23 bp, Artificial Sequence
  Synthetic
ctttcaccaucctcttccugaca

SEQ ID NO: 89909 - DNA, 20 bp, Artificial Sequence
  Synthetic
gtagucgcagacgcaguagg

SEQ ID NO: 89910 - DNA, 21 bp, Artificial Sequence
  Synthetic
cccaacaaggauggagtcgug

SEQ ID NO: 89911 - DNA, 21 bp, Artificial Sequence
  Synthetic
cctgggacaucccucagacat

SEQ ID NO: 89912 - DNA, 22 bp, Artificial Sequence
  Synthetic
agtactuggagggagagcaugt

SEQ ID NO: 89913 - DNA, 21 bp, Artificial Sequence
  Synthetic
catgguggagagcacgagaua

SEQ ID NO: 89914 - DNA, 21 bp, Artificial Sequence
  Synthetic
tggtgtggacucacccattut

SEQ ID NO: 89915 - DNA, 28 bp, Artificial Sequence
  Synthetic
gccctttatgatuacatgccaatgaaug

SEQ ID NO: 89916 - DNA, 23 bp, Artificial Sequence
  Synthetic
cttccgcagcugtagatcattug

SEQ ID NO: 89917 - DNA, 28 bp, Artificial Sequence
  Synthetic
ccctcctacctuttctcctaactacaua

SEQ ID NO: 89918 - DNA, 26 bp, Artificial Sequence
  Synthetic
cttttatugactcaaaguggcaggat

SEQ ID NO: 89919 - DNA, 23 bp, Artificial Sequence
  Synthetic
tcaactgttccuccagtctcuga

SEQ ID NO: 89920 - DNA, 26 bp, Artificial Sequence
  Synthetic
gtagtagagucaaagaagaaggcugt

SEQ ID NO: 89921 - DNA, 22 bp, Artificial Sequence
  Synthetic
ctcaaggagggcucaacactua

SEQ ID NO: 89922 - DNA, 22 bp, Artificial Sequence
  Synthetic
acaaatgcacagucccctucaa

SEQ ID NO: 89923 - DNA, 22 bp, Artificial Sequence
  Synthetic
gagugccactcaaugaaggaga

SEQ ID NO: 89924 - DNA, 21 bp, Artificial Sequence
  Synthetic
gcugtucaaaagcaagagcct

SEQ ID NO: 89925 - DNA, 28 bp, Artificial Sequence
  Synthetic
ggacautggcaaacuaaaaggagaaaat

SEQ ID NO: 89926 - DNA, 26 bp, Artificial Sequence
  Synthetic
tcctttccccugtatgtttccacuat

SEQ ID NO: 89927 - DNA, 28 bp, Artificial Sequence
  Synthetic
ccaaaagtgaucaactactttctuccaa

SEQ ID NO: 89928 - DNA, 27 bp, Artificial Sequence
  Synthetic
tcagacttactugctctaagacacuct

SEQ ID NO: 89929 - DNA, 22 bp, Artificial Sequence
  Synthetic
cacaagtucagcacagcatugg

SEQ ID NO: 89930 - DNA, 25 bp, Artificial Sequence
  Synthetic
gaagatccttgguattgcaaagcug

SEQ ID NO: 89931 - DNA, 28 bp, Artificial Sequence
  Synthetic
cacaggttttggutgacagtgataauaa

SEQ ID NO: 89932 - DNA, 28 bp, Artificial Sequence
  Synthetic
tgcctcaaaagtucgttttcatttacut

SEQ ID NO: 89933 - DNA, 26 bp, Artificial Sequence
  Synthetic
aacacgaacaaaccgautcagaaauc

SEQ ID NO: 89934 - DNA, 29 bp, Artificial Sequence
  Synthetic
agttctcgctcutttattcctttcacuaa

SEQ ID NO: 89935 - DNA, 26 bp, Artificial Sequence
  Synthetic
caaatcaaaacccagutgcaugaaga

SEQ ID NO: 89936 - DNA, 28 bp, Artificial Sequence
  Synthetic
cagagttatctguttgaatgtcctguct

SEQ ID NO: 89937 - DNA, 28 bp, Artificial Sequence
  Synthetic
gtttagataccagcaugagcaaaugaac

SEQ ID NO: 89938 - DNA, 26 bp, Artificial Sequence
  Synthetic
acatcttgtttcucctttagctgcut

SEQ ID NO: 89939 - DNA, 28 bp, Artificial Sequence
  Synthetic
tgcaacaautagaactcuccaggaaaat

SEQ ID NO: 89940 - DNA, 25 bp, Artificial Sequence
  Synthetic
cttctcuaaaaagagctgggtgugt

SEQ ID NO: 89941 - DNA, 28 bp, Artificial Sequence
  Synthetic
aagaucaaaaccagagtaagaugcaact

SEQ ID NO: 89942 - DNA, 25 bp, Artificial Sequence
  Synthetic
caatcgaaucagacaatctgtggut

SEQ ID NO: 89943 - DNA, 21 bp, Artificial Sequence
  Synthetic
tcattgctuactccccaguct

SEQ ID NO: 89944 - DNA, 29 bp, Artificial Sequence
  Synthetic
ggccagtataguccacttgtaattuagaa

SEQ ID NO: 89945 - DNA, 23 bp, Artificial Sequence
  Synthetic
gcaggtgaugaccacaguacaaa

SEQ ID NO: 89946 - DNA, 29 bp, Artificial Sequence
  Synthetic
catccatttcctucttttgctcttguaaa

SEQ ID NO: 89947 - DNA, 28 bp, Artificial Sequence
  Synthetic
agtgttactgaacuagcatctgagguat

SEQ ID NO: 89948 - DNA, 25 bp, Artificial Sequence
  Synthetic
tgttccttgaucgtgttcagtugag

SEQ ID NO: 89949 - DNA, 24 bp, Artificial Sequence
  Synthetic
caagaagaatuggaacgacucagg

SEQ ID NO: 89950 - DNA, 21 bp, Artificial Sequence
  Synthetic
gggctgacucgtgttgcauat

SEQ ID NO: 89951 - DNA, 26 bp, Artificial Sequence
  Synthetic
agttttacaaacauccagcactggua

SEQ ID NO: 89952 - DNA, 20 bp, Artificial Sequence
  Synthetic
gcggttcgacuctgctctuc

SEQ ID NO: 89953 - DNA, 28 bp, Artificial Sequence
  Synthetic
gctgcaggaggaautggataaatatuct

SEQ ID NO: 89954 - DNA, 28 bp, Artificial Sequence
  Synthetic
ggtctttttccuctatggtctgtctuaa

SEQ ID NO: 89955 - DNA, 27 bp, Artificial Sequence
  Synthetic
gucatctagttuagaagagcagaagca

SEQ ID NO: 89956 - DNA, 25 bp, Artificial Sequence
  Synthetic
atttatccaattccucctgcagcut

SEQ ID NO: 89957 - DNA, 27 bp, Artificial Sequence
  Synthetic
aactaaggacgutttgtcatctagtut

SEQ ID NO: 89958 - DNA, 22 bp, Artificial Sequence
  Synthetic
gtgtcaacugcttctgctctuc

SEQ ID NO: 89959 - DNA, 26 bp, Artificial Sequence
  Synthetic
ccttacagcuggaacatgagcattua

SEQ ID NO: 89960 - DNA, 28 bp, Artificial Sequence
  Synthetic
tgagttctgctauttccatgtctttcut

SEQ ID NO: 89961 - DNA, 21 bp, Artificial Sequence
  Synthetic
aggcagaatugtgttgggcua

SEQ ID NO: 89962 - DNA, 22 bp, Artificial Sequence
  Synthetic
tgcttctuccaacagcctctut

SEQ ID NO: 89963 - DNA, 27 bp, Artificial Sequence
  Synthetic
tgaggcatcagutagaagaatgtctug

SEQ ID NO: 89964 - DNA, 26 bp, Artificial Sequence
  Synthetic
tttccagagaaagcugattgtuacca

SEQ ID NO: 89965 - DNA, 30 bp, Artificial Sequence
  Synthetic
gcaaaatcttucagaattagaacagcucaa

SEQ ID NO: 89966 - DNA, 29 bp, Artificial Sequence
  Synthetic
gagctgttctaautctgaaagatttugct

SEQ ID NO: 89967 - DNA, 27 bp, Artificial Sequence
  Synthetic
ggagcauattagacaaaaugaggagga

SEQ ID NO: 89968 - DNA, 28 bp, Artificial Sequence
  Synthetic
tcattccttattcuagaaagctccucct

SEQ ID NO: 89969 - DNA, 28 bp, Artificial Sequence
  Synthetic
agcagaaactugaggacaaaguagaaaa

SEQ ID NO: 89970 - DNA, 28 bp, Artificial Sequence
  Synthetic
ctccttctggaugcttacattacttuct

SEQ ID NO: 89971 - DNA, 25 bp, Artificial Sequence
  Synthetic
gctaattcaaagugaagtggcccua

SEQ ID NO: 89972 - DNA, 28 bp, Artificial Sequence
  Synthetic
cagtttactgaugatgctatctcctuca

SEQ ID NO: 89973 - DNA, 33 bp, Artificial Sequence
  Synthetic
ttttctttgagtacuaaaatgagaacatgtugt

SEQ ID NO: 89974 - DNA, 27 bp, Artificial Sequence
  Synthetic
gacattcttcuaactgatgccucacat

SEQ ID NO: 89975 - DNA, 29 bp, Artificial Sequence
  Synthetic
gcaaaatcttucagaattagaacagcuca

SEQ ID NO: 89976 - DNA, 30 bp, Artificial Sequence
  Synthetic
tgtccattttatcaucttcaagttgaugaa

SEQ ID NO: 89977 - DNA, 27 bp, Artificial Sequence
  Synthetic
accatgcaaauttttcttucagcacat

SEQ ID NO: 89978 - DNA, 22 bp, Artificial Sequence
  Synthetic
gcagcgcucgttcagtttauct

SEQ ID NO: 89979 - DNA, 18 bp, Artificial Sequence
  Synthetic
gaggaugcggttcgctug

SEQ ID NO: 89980 - DNA, 18 bp, Artificial Sequence
  Synthetic
tggcagguaacggctugt

SEQ ID NO: 89981 - DNA, 19 bp, Artificial Sequence
  Synthetic
cgaagagcgacgagutgug

SEQ ID NO: 89982 - DNA, 17 bp, Artificial Sequence
  Synthetic
gctgacccuctgugcgt

SEQ ID NO: 89983 - DNA, 19 bp, Artificial Sequence
  Synthetic
ggucccacagggcagaaug

SEQ ID NO: 89984 - DNA, 21 bp, Artificial Sequence
  Synthetic
gcgtcucctgactgauggaag

SEQ ID NO: 89985 - DNA, 27 bp, Artificial Sequence
  Synthetic
ctggccagauatcaaacttuacaaagg

SEQ ID NO: 89986 - DNA, 20 bp, Artificial Sequence
  Synthetic
cgtgcccuccatcagcauat

SEQ ID NO: 89987 - DNA, 22 bp, Artificial Sequence
  Synthetic
gaccgggucgttctctaaacuc

SEQ ID NO: 89988 - DNA, 18 bp, Artificial Sequence
  Synthetic
cuggcagccaaggcctua

SEQ ID NO: 89989 - DNA, 19 bp, Artificial Sequence
  Synthetic
ggguccgagatgucacaca

SEQ ID NO: 89990 - DNA, 19 bp, Artificial Sequence
  Synthetic
gggtcuccacgattcgugt

SEQ ID NO: 89991 - DNA, 22 bp, Artificial Sequence
  Synthetic
cccgtgaaugagggtattguct

SEQ ID NO: 89992 - DNA, 21 bp, Artificial Sequence
  Synthetic
ggugaggccacagtcatugag

SEQ ID NO: 89993 - DNA, 21 bp, Artificial Sequence
  Synthetic
cagguggacagcctcttucag

SEQ ID NO: 89994 - DNA, 20 bp, Artificial Sequence
  Synthetic
tccagacugggtcgtaccuc

SEQ ID NO: 89995 - DNA, 23 bp, Artificial Sequence
  Synthetic
gutctgugagcaggaggaaaagt

SEQ ID NO: 89996 - DNA, 23 bp, Artificial Sequence
  Synthetic
cgtgcacacaguctacacauacc

SEQ ID NO: 89997 - DNA, 20 bp, Artificial Sequence
  Synthetic
guaaggacccaagctugcca

SEQ ID NO: 89998 - DNA, 26 bp, Artificial Sequence
  Synthetic
ttttactgcutgaagagctugaggat

SEQ ID NO: 89999 - DNA, 23 bp, Artificial Sequence
  Synthetic
ctctgatgaggautccgaaccug

SEQ ID NO: 90000 - DNA, 27 bp, Artificial Sequence
  Synthetic
gcagtgtttucacaaacaagtttgaug

SEQ ID NO: 90001 - DNA, 26 bp, Artificial Sequence
  Synthetic
cuagaaattgauagccagcaggaaga

SEQ ID NO: 90002 - DNA, 20 bp, Artificial Sequence
  Synthetic
cagatgctugaaccggcuct

SEQ ID NO: 90003 - DNA, 28 bp, Artificial Sequence
  Synthetic
agggagctcuggattacttaagtgauaa

SEQ ID NO: 90004 - DNA, 27 bp, Artificial Sequence
  Synthetic
aacagatttaaacuggacccacttcut

SEQ ID NO: 90005 - DNA, 27 bp, Artificial Sequence
  Synthetic
tttcaaaaucagaagggtgcaatugag

SEQ ID NO: 90006 - DNA, 26 bp, Artificial Sequence
  Synthetic
ttctcaagaagtutcgccagtagaut

SEQ ID NO: 90007 - DNA, 29 bp, Artificial Sequence
  Synthetic
gtttcaagattgacucatttagctgtuct

SEQ ID NO: 90008 - DNA, 26 bp, Artificial Sequence
  Synthetic
gggccaatcuctttttaccaatucaa

SEQ ID NO: 90009 - DNA, 24 bp, Artificial Sequence
  Synthetic
agaagaaagtaugggtggagguga

SEQ ID NO: 90010 - DNA, 27 bp, Artificial Sequence
  Synthetic
ccaacatattgugaaaactgtcaugct

SEQ ID NO: 90011 - DNA, 25 bp, Artificial Sequence
  Synthetic
tgggcagautagaaaatgcaugact

SEQ ID NO: 90012 - DNA, 24 bp, Artificial Sequence
  Synthetic
ccgaggaaaaacaaugatggtuga

SEQ ID NO: 90013 - DNA, 28 bp, Artificial Sequence
  Synthetic
gtgtcagatggutttctacaatgaaugg

SEQ ID NO: 90014 - DNA, 28 bp, Artificial Sequence
  Synthetic
ctgagaactatuccaagtcatgcattut

SEQ ID NO: 90015 - DNA, 31 bp, Artificial Sequence
  Synthetic
actgccattgauttatgcaagtataauacca

SEQ ID NO: 90016 - DNA, 24 bp, Artificial Sequence
  Synthetic
tgcaacaugaacctgaatauccca

SEQ ID NO: 90017 - DNA, 26 bp, Artificial Sequence
  Synthetic
gcaacatagguaagatcagcatcuca

SEQ ID NO: 90018 - DNA, 20 bp, Artificial Sequence
  Synthetic
cgcctaactuggcccagaug

SEQ ID NO: 90019 - DNA, 21 bp, Artificial Sequence
  Synthetic
gcgatccuggacttcctctug

SEQ ID NO: 90020 - DNA, 21 bp, Artificial Sequence
  Synthetic
ctccuctagggtugcgcaaat

SEQ ID NO: 90021 - DNA, 21 bp, Artificial Sequence
  Synthetic
gccctgtcutcactccttcug

SEQ ID NO: 90022 - DNA, 22 bp, Artificial Sequence
  Synthetic
aaggacggaaagagcaucucac

SEQ ID NO: 90023 - DNA, 21 bp, Artificial Sequence
  Synthetic
gcccaaguctguccagaacaa

SEQ ID NO: 90024 - DNA, 17 bp, Artificial Sequence
  Synthetic
tggatgucgccgtugct

SEQ ID NO: 90025 - DNA, 17 bp, Artificial Sequence
  Synthetic
cagccucgctccuggac

SEQ ID NO: 90026 - DNA, 19 bp, Artificial Sequence
  Synthetic
tgcaagcuctgcugacaca

SEQ ID NO: 90027 - DNA, 19 bp, Artificial Sequence
  Synthetic
ctcagugggcactggagut

SEQ ID NO: 90028 - DNA, 17 bp, Artificial Sequence
  Synthetic
cagguguccaggagcga

SEQ ID NO: 90029 - DNA, 17 bp, Artificial Sequence
  Synthetic
ggcccaggcugctucat

SEQ ID NO: 90030 - DNA, 28 bp, Artificial Sequence
  Synthetic
gaacagatacggaugcattatagugact

SEQ ID NO: 90031 - DNA, 28 bp, Artificial Sequence
  Synthetic
cagaaaagtaggaugggagaggattuaa

SEQ ID NO: 90032 - DNA, 26 bp, Artificial Sequence
  Synthetic
cagggattugcaataagtgucaaaaa

SEQ ID NO: 90033 - DNA, 26 bp, Artificial Sequence
  Synthetic
cacaccctuacagtaaagtcttuggt

SEQ ID NO: 90034 - DNA, 25 bp, Artificial Sequence
  Synthetic
ctgaucagcaaggaactttucaagt

SEQ ID NO: 90035 - DNA, 22 bp, Artificial Sequence
  Synthetic
gcctttctuctccgcttcuacc

SEQ ID NO: 90036 - DNA, 28 bp, Artificial Sequence
  Synthetic
tgtaactctaggcauacttgtcttugga

SEQ ID NO: 90037 - DNA, 25 bp, Artificial Sequence
  Synthetic
cttttcaagcccaucagaugagact

SEQ ID NO: 90038 - DNA, 22 bp, Artificial Sequence
  Synthetic
gctcactgccuctctgcattut

SEQ ID NO: 90039 - DNA, 25 bp, Artificial Sequence
  Synthetic
aaggaaacucaaggaaaguggaagt

SEQ ID NO: 90040 - DNA, 22 bp, Artificial Sequence
  Synthetic
cctggtattcuggcagcatuct

SEQ ID NO: 90041 - DNA, 28 bp, Artificial Sequence
  Synthetic
aatttctacttttugtagcctccucgat

SEQ ID NO: 90042 - DNA, 27 bp, Artificial Sequence
  Synthetic
ccaacctaagacauacataccagtugt

SEQ ID NO: 90043 - DNA, 28 bp, Artificial Sequence
  Synthetic
ccactgctgaugtactttattaactucc

SEQ ID NO: 90044 - DNA, 23 bp, Artificial Sequence
  Synthetic
ctcatcgccuctgtagacctcua

SEQ ID NO: 90045 - DNA, 21 bp, Artificial Sequence
  Synthetic
gcgaaggugatggcauaccag

SEQ ID NO: 90046 - DNA, 26 bp, Artificial Sequence
  Synthetic
gcaagaaacaccuggactctuaagaa

SEQ ID NO: 90047 - DNA, 24 bp, Artificial Sequence
  Synthetic
ccaaggtcutttgtcacttaugcc

SEQ ID NO: 90048 - DNA, 19 bp, Artificial Sequence
  Synthetic
tgacggucatcacccugga

SEQ ID NO: 90049 - DNA, 26 bp, Artificial Sequence
  Synthetic
cagatactgacuttggcatagcuact

SEQ ID NO: 90050 - DNA, 22 bp, Artificial Sequence
  Synthetic
cctgcttccuttggtgggaaua

SEQ ID NO: 90051 - DNA, 27 bp, Artificial Sequence
  Synthetic
atttcggactgugatgtagatctucac

SEQ ID NO: 90052 - DNA, 21 bp, Artificial Sequence
  Synthetic
cagaacaggcccucagtucaa

SEQ ID NO: 90053 - DNA, 23 bp, Artificial Sequence
  Synthetic
cttaugaccaggagccacucaag

SEQ ID NO: 90054 - DNA, 22 bp, Artificial Sequence
  Synthetic
cccattcugtcttcaucccaca

SEQ ID NO: 90055 - DNA, 22 bp, Artificial Sequence
  Synthetic
gagcttggugagctgguagaag

SEQ ID NO: 90056 - DNA, 22 bp, Artificial Sequence
  Synthetic
aatcccacaucctgcucaagac

SEQ ID NO: 90057 - DNA, 21 bp, Artificial Sequence
  Synthetic
ggaauggaagcaccucccaac

SEQ ID NO: 90058 - DNA, 26 bp, Artificial Sequence
  Synthetic
gcagaaataagcaaautccccaauga

SEQ ID NO: 90059 - DNA, 20 bp, Artificial Sequence
  Synthetic
aaaugggccagaagaucgca

SEQ ID NO: 90060 - DNA, 27 bp, Artificial Sequence
  Synthetic
ccttagggaaaggutagattcugaaca

SEQ ID NO: 90061 - DNA, 27 bp, Artificial Sequence
  Synthetic
gggactttuggagaatgataugggaac

SEQ ID NO: 90062 - DNA, 20 bp, Artificial Sequence
  Synthetic
gcctcagggcutgtacucat

SEQ ID NO: 90063 - DNA, 20 bp, Artificial Sequence
  Synthetic
gggcgcuaatcgtacugaaa

SEQ ID NO: 90064 - DNA, 28 bp, Artificial Sequence
  Synthetic
ttaatttcaacagaguaaggtgcgauct

SEQ ID NO: 90065 - DNA, 29 bp, Artificial Sequence
  Synthetic
gagtgactccucttacccatattuacaat

SEQ ID NO: 90066 - DNA, 19 bp, Artificial Sequence
  Synthetic
ccggaaggaguggcacauc

SEQ ID NO: 90067 - DNA, 20 bp, Artificial Sequence
  Synthetic
accctcugttctccuccaca

SEQ ID NO: 90068 - DNA, 19 bp, Artificial Sequence
  Synthetic
acaactguggcactccgut

SEQ ID NO: 90069 - DNA, 27 bp, Artificial Sequence
  Synthetic
cctggttgaauaacactccttgtttuc

SEQ ID NO: 90070 - DNA, 27 bp, Artificial Sequence
  Synthetic
ctatttctggaggutgttgaaagucct

SEQ ID NO: 90071 - DNA, 22 bp, Artificial Sequence
  Synthetic
gggatuggagacagacatcuga

SEQ ID NO: 90072 - DNA, 24 bp, Artificial Sequence
  Synthetic
gtgagatgtcuattcccagctgut

SEQ ID NO: 90073 - DNA, 20 bp, Artificial Sequence
  Synthetic
gcaacauccagggaccagug

SEQ ID NO: 90074 - DNA, 24 bp, Artificial Sequence
  Synthetic
ctgttctgauaccgtgugagagag

SEQ ID NO: 90075 - DNA, 22 bp, Artificial Sequence
  Synthetic
tgaagtacuccgggtucacaga

SEQ ID NO: 90076 - DNA, 27 bp, Artificial Sequence
  Synthetic
ttctcgttttcuaaaagacgtgacugt

SEQ ID NO: 90077 - DNA, 28 bp, Artificial Sequence
  Synthetic
ctttgcctcagagagaucatcaagatua

SEQ ID NO: 90078 - DNA, 23 bp, Artificial Sequence
  Synthetic
cccugtatggcucagaagagact

SEQ ID NO: 90079 - DNA, 23 bp, Artificial Sequence
  Synthetic
gcttctccccautcattgtcucc

SEQ ID NO: 90080 - DNA, 23 bp, Artificial Sequence
  Synthetic
ctcttcgucttctccaucagcat

SEQ ID NO: 90081 - DNA, 22 bp, Artificial Sequence
  Synthetic
ccagaaggtuccagcagaauct

SEQ ID NO: 90082 - DNA, 21 bp, Artificial Sequence
  Synthetic
gggaatggagugctgtaugcc

SEQ ID NO: 90083 - DNA, 27 bp, Artificial Sequence
  Synthetic
gtagctcaaaataaugcaaacctccut

SEQ ID NO: 90084 - DNA, 22 bp, Artificial Sequence
  Synthetic
tccauggccaccataaagtugt

SEQ ID NO: 90085 - DNA, 20 bp, Artificial Sequence
  Synthetic
ctcttttguaggcgggccut

SEQ ID NO: 90086 - DNA, 23 bp, Artificial Sequence
  Synthetic
ccagaaagttuccctcctccauc

SEQ ID NO: 90087 - DNA, 22 bp, Artificial Sequence
  Synthetic
tgcttctgcuggacacuaacac

SEQ ID NO: 90088 - DNA, 22 bp, Artificial Sequence
  Synthetic
gtctctcttccucctccaggua

SEQ ID NO: 90089 - DNA, 20 bp, Artificial Sequence
  Synthetic
acttgcagutgtccctgugg

SEQ ID NO: 90090 - DNA, 28 bp, Artificial Sequence
  Synthetic
tgatcaaaccugggatctaacaaaacut

SEQ ID NO: 90091 - DNA, 23 bp, Artificial Sequence
  Synthetic
agaaugggcaggaagaaaagugg

SEQ ID NO: 90092 - DNA, 24 bp, Artificial Sequence
  Synthetic
aacatacctucctccagcctuaga

SEQ ID NO: 90093 - DNA, 27 bp, Artificial Sequence
  Synthetic
ataaggatttccacuttctgtccucag

SEQ ID NO: 90094 - DNA, 28 bp, Artificial Sequence
  Synthetic
gacaaagtucagtaaaatctugcacagt

SEQ ID NO: 90095 - DNA, 24 bp, Artificial Sequence
  Synthetic
gcaaccagaacauagattgugcag

SEQ ID NO: 90096 - DNA, 18 bp, Artificial Sequence
  Synthetic
tctcugggcaagccgaug

SEQ ID NO: 90097 - DNA, 19 bp, Artificial Sequence
  Synthetic
caaggcgcaccagutccua

SEQ ID NO: 90098 - DNA, 23 bp, Artificial Sequence
  Synthetic
tgtgcagtaagutgaggatgcut

SEQ ID NO: 90099 - DNA, 22 bp, Artificial Sequence
  Synthetic
caacccagcuctctgtttucca

SEQ ID NO: 90100 - DNA, 25 bp, Artificial Sequence
  Synthetic
ctgcagtucttttcatcugaagcat

SEQ ID NO: 90101 - DNA, 28 bp, Artificial Sequence
  Synthetic
ccatctttgcauttgtttatgtaccugt

SEQ ID NO: 90102 - DNA, 25 bp, Artificial Sequence
  Synthetic
ccagactttucactgctttcucaca

SEQ ID NO: 90103 - DNA, 22 bp, Artificial Sequence
  Synthetic
gcttgcugcctttgguaagaac

SEQ ID NO: 90104 - DNA, 28 bp, Artificial Sequence
  Synthetic
ttaacataaacacugtagagcacauggt

SEQ ID NO: 90105 - DNA, 27 bp, Artificial Sequence
  Synthetic
actgtgaggauggattcgaaauaacag

SEQ ID NO: 90106 - DNA, 26 bp, Artificial Sequence
  Synthetic
cttacctttacagcutctcccatcut

SEQ ID NO: 90107 - DNA, 27 bp, Artificial Sequence
  Synthetic
tctctacagaacugttatccaatugcc

SEQ ID NO: 90108 - DNA, 22 bp, Artificial Sequence
  Synthetic
actgacaautcagctgtuggca

SEQ ID NO: 90109 - DNA, 28 bp, Artificial Sequence
  Synthetic
tctgggagaacaaucaagactatagugt

SEQ ID NO: 90110 - DNA, 21 bp, Artificial Sequence
  Synthetic
cctugggcaaagguaggacat

SEQ ID NO: 90111 - DNA, 20 bp, Artificial Sequence
  Synthetic
atccgaaggcaccucaacug

SEQ ID NO: 90112 - DNA, 23 bp, Artificial Sequence
  Synthetic
gcagtcacucaatcacacctgut

SEQ ID NO: 90113 - DNA, 22 bp, Artificial Sequence
  Synthetic
gugttgacaatcuccgcaaacc

SEQ ID NO: 90114 - DNA, 22 bp, Artificial Sequence
  Synthetic
ccatuggcagtctcucaaaggg

SEQ ID NO: 90115 - DNA, 25 bp, Artificial Sequence
  Synthetic
cccagccaaaggcaugtatttacua

SEQ ID NO: 90116 - DNA, 28 bp, Artificial Sequence
  Synthetic
tgaaaccacccuaatgcattttaugagt

SEQ ID NO: 90117 - DNA, 17 bp, Artificial Sequence
  Synthetic
ccgacccaauggcaguc

SEQ ID NO: 90118 - DNA, 17 bp, Artificial Sequence
  Synthetic
tgcgacugccatugggt

SEQ ID NO: 90119 - DNA, 28 bp, Artificial Sequence
  Synthetic
gaagacagtgatucctgtaaactccuaa

SEQ ID NO: 90120 - DNA, 20 bp, Artificial Sequence
  Synthetic
agctcatgcuggactgtugg

SEQ ID NO: 90121 - DNA, 27 bp, Artificial Sequence
  Synthetic
catgaaaccagccauatttagggauca

SEQ ID NO: 90122 - DNA, 24 bp, Artificial Sequence
  Synthetic
tctgcaatgcutgtctatgtuggt

SEQ ID NO: 90123 - DNA, 21 bp, Artificial Sequence
  Synthetic
accttgaccutgctcatcugg

SEQ ID NO: 90124 - DNA, 27 bp, Artificial Sequence
  Synthetic
ggtgugaaacagaaagauaaaaagcca

SEQ ID NO: 90125 - DNA, 28 bp, Artificial Sequence
  Synthetic
gaaaatgauaccatctacuggacagaca

SEQ ID NO: 90126 - DNA, 27 bp, Artificial Sequence
  Synthetic
ctctgctaatttuattgaagcccaugt

SEQ ID NO: 90127 - DNA, 28 bp, Artificial Sequence
  Synthetic
ctgttgcaatatgaucctaacaccgaua

SEQ ID NO: 90128 - DNA, 20 bp, Artificial Sequence
  Synthetic
gaaaatuccccggcaacucc

SEQ ID NO: 90129 - DNA, 23 bp, Artificial Sequence
  Synthetic
ggttactttccugtctgctcuct

SEQ ID NO: 90130 - DNA, 25 bp, Artificial Sequence
  Synthetic
tcttggttcucccaaacacattugt

SEQ ID NO: 90131 - DNA, 20 bp, Artificial Sequence
  Synthetic
tgaacuccagcgcacactua

SEQ ID NO: 90132 - DNA, 24 bp, Artificial Sequence
  Synthetic
attgttcaguccatcccttuccaa

SEQ ID NO: 90133 - DNA, 20 bp, Artificial Sequence
  Synthetic
cuccaugacgaagcgaagga

SEQ ID NO: 90134 - DNA, 19 bp, Artificial Sequence
  Synthetic
gggcutguccaacgagcaa

SEQ ID NO: 90135 - DNA, 28 bp, Artificial Sequence
  Synthetic
gtattugagaagagaacucagaagagca

SEQ ID NO: 90136 - DNA, 26 bp, Artificial Sequence
  Synthetic
gtagtttccucctatccctacaugct

SEQ ID NO: 90137 - DNA, 17 bp, Artificial Sequence
  Synthetic
gggccaauggaggcuca

SEQ ID NO: 90138 - DNA, 21 bp, Artificial Sequence
  Synthetic
gggccaccaucagctatatug

SEQ ID NO: 90139 - DNA, 27 bp, Artificial Sequence
  Synthetic
ccaaattcatccuggattctaggacut

SEQ ID NO: 90140 - DNA, 21 bp, Artificial Sequence
  Synthetic
ttgacugaaagggaccacguc

SEQ ID NO: 90141 - DNA, 28 bp, Artificial Sequence
  Synthetic
gctgtgtgtauagtcaccctctaauact

SEQ ID NO: 90142 - DNA, 27 bp, Artificial Sequence
  Synthetic
tgtcacaagaguacaaaaacagcauct

SEQ ID NO: 90143 - DNA, 21 bp, Artificial Sequence
  Synthetic
ggtcttggugcgataacuggt

SEQ ID NO: 90144 - DNA, 20 bp, Artificial Sequence
  Synthetic
gccccucctgtgtcugaaga

SEQ ID NO: 90145 - DNA, 28 bp, Artificial Sequence
  Synthetic
ctctatgactatuccaaagggcatctut

SEQ ID NO: 90146 - DNA, 21 bp, Artificial Sequence
  Synthetic
gccagggcautctctgcuaaa

SEQ ID NO: 90147 - DNA, 21 bp, Artificial Sequence
  Synthetic
caaacccccuacatcccucag

SEQ ID NO: 90148 - DNA, 21 bp, Artificial Sequence
  Synthetic
tggacacautgtggcauggaa

SEQ ID NO: 90149 - DNA, 23 bp, Artificial Sequence
  Synthetic
tguatacatucagccaggacaca

SEQ ID NO: 90150 - DNA, 22 bp, Artificial Sequence
  Synthetic
actgcaagauacatggcuccag

SEQ ID NO: 90151 - DNA, 22 bp, Artificial Sequence
  Synthetic
caatgatgcuggtccacaccua

SEQ ID NO: 90152 - DNA, 27 bp, Artificial Sequence
  Synthetic
agtttcccaagugtaatcctacaggua

SEQ ID NO: 90153 - DNA, 27 bp, Artificial Sequence
  Synthetic
ccaattttgttaugttggaagttugga

SEQ ID NO: 90154 - DNA, 20 bp, Artificial Sequence
  Synthetic
ctggcucacaagtccctcut

SEQ ID NO: 90155 - DNA, 20 bp, Artificial Sequence
  Synthetic
gacctgagcuggttccucac

SEQ ID NO: 90156 - DNA, 22 bp, Artificial Sequence
  Synthetic
ctcatctcacugggttggucaa

SEQ ID NO: 90157 - DNA, 23 bp, Artificial Sequence
  Synthetic
cccttcugcctcagcttauaacc

SEQ ID NO: 90158 - DNA, 21 bp, Artificial Sequence
  Synthetic
gctctgguggcagactttgua

SEQ ID NO: 90159 - DNA, 20 bp, Artificial Sequence
  Synthetic
ccgccagaucagagaaggug

SEQ ID NO: 90160 - DNA, 28 bp, Artificial Sequence
  Synthetic
cataagaaatgugcacttgguaaaaccc

SEQ ID NO: 90161 - DNA, 25 bp, Artificial Sequence
  Synthetic
ggtagtggttugaatctgacctuca

SEQ ID NO: 90162 - DNA, 21 bp, Artificial Sequence
  Synthetic
gcaaccccaaucaccccttua

SEQ ID NO: 90163 - DNA, 22 bp, Artificial Sequence
  Synthetic
ctttguttctgacgugccacag

SEQ ID NO: 90164 - DNA, 21 bp, Artificial Sequence
  Synthetic
cagagcaaugggcacgatuac

SEQ ID NO: 90165 - DNA, 27 bp, Artificial Sequence
  Synthetic
cctttgauaccacagacttcctctuac

SEQ ID NO: 90166 - DNA, 21 bp, Artificial Sequence
  Synthetic
gcctcccugtagaatcucgga

SEQ ID NO: 90167 - DNA, 19 bp, Artificial Sequence
  Synthetic
caccguggccgtgaaaaug

SEQ ID NO: 90168 - DNA, 22 bp, Artificial Sequence
  Synthetic
cagcuggagatgagtucgagac

SEQ ID NO: 90169 - DNA, 20 bp, Artificial Sequence
  Synthetic
gggcccccutgaaaaagtuc

SEQ ID NO: 90170 - DNA, 22 bp, Artificial Sequence
  Synthetic
ggcgtttaagucccctgacuat

SEQ ID NO: 90171 - DNA, 21 bp, Artificial Sequence
  Synthetic
ggacgtgauggagccactuac

SEQ ID NO: 90172 - DNA, 19 bp, Artificial Sequence
  Synthetic
ctucacccaggtcuccgat

SEQ ID NO: 90173 - DNA, 21 bp, Artificial Sequence
  Synthetic
ccatccacucctgcacttguc

SEQ ID NO: 90174 - DNA, 20 bp, Artificial Sequence
  Synthetic
gcugaccccacaccttucag

SEQ ID NO: 90175 - DNA, 18 bp, Artificial Sequence
  Synthetic
cacgcucaccccguacag

SEQ ID NO: 90176 - DNA, 27 bp, Artificial Sequence
  Synthetic
tgacatgtuaggacactttccaatgut

SEQ ID NO: 90177 - DNA, 18 bp, Artificial Sequence
  Synthetic
gggctuggcctaauggac

SEQ ID NO: 90178 - DNA, 27 bp, Artificial Sequence
  Synthetic
gcatgcaaagggaauttaattctgugt

SEQ ID NO: 90179 - DNA, 27 bp, Artificial Sequence
  Synthetic
ggacaactacgugtctctattugaagt

SEQ ID NO: 90180 - DNA, 25 bp, Artificial Sequence
  Synthetic
gtaaccccuagcaggaaagttugag

SEQ ID NO: 90181 - DNA, 22 bp, Artificial Sequence
  Synthetic
cagatcaaccutctccctcugg

SEQ ID NO: 90182 - DNA, 19 bp, Artificial Sequence
  Synthetic
gaccugccacuggagaagt

SEQ ID NO: 90183 - DNA, 27 bp, Artificial Sequence
  Synthetic
tgttacctugaaggaccttctttugaa

SEQ ID NO: 90184 - DNA, 26 bp, Artificial Sequence
  Synthetic
ccttttctcaaaguggtccacagtua

SEQ ID NO: 90185 - DNA, 25 bp, Artificial Sequence
  Synthetic
gaattcttttcuggacagacuggga

SEQ ID NO: 90186 - DNA, 23 bp, Artificial Sequence
  Synthetic
gtgucaacaaggagauggaacca

SEQ ID NO: 90187 - DNA, 21 bp, Artificial Sequence
  Synthetic
cuggagaccagcttugcagaa

SEQ ID NO: 90188 - DNA, 22 bp, Artificial Sequence
  Synthetic
cttctcctctugggacatggug

SEQ ID NO: 90189 - DNA, 26 bp, Artificial Sequence
  Synthetic
aagagcagttugggtttactcgtuaa

SEQ ID NO: 90190 - DNA, 22 bp, Artificial Sequence
  Synthetic
gugggcacaccacttuaacaag

SEQ ID NO: 90191 - DNA, 28 bp, Artificial Sequence
  Synthetic
tctgttctgtgtuatgtcgtctgattut

SEQ ID NO: 90192 - DNA, 20 bp, Artificial Sequence
  Synthetic
cacauagaacaggcccguct

SEQ ID NO: 90193 - DNA, 23 bp, Artificial Sequence
  Synthetic
cagttctgcuccatgctgtttut

SEQ ID NO: 90194 - DNA, 19 bp, Artificial Sequence
  Synthetic
agtgaccucgcctcctcuc

SEQ ID NO: 90195 - DNA, 18 bp, Artificial Sequence
  Synthetic
gctgccccugaaguggat

SEQ ID NO: 90196 - DNA, 24 bp, Artificial Sequence
  Synthetic
cccagtcguaaataccgacttcua

SEQ ID NO: 90197 - DNA, 28 bp, Artificial Sequence
  Synthetic
ggagcattgtcautcacatctaagacut

SEQ ID NO: 90198 - DNA, 23 bp, Artificial Sequence
  Synthetic
ccctctcccccucttctctatut

SEQ ID NO: 90199 - DNA, 28 bp, Artificial Sequence
  Synthetic
ccatatctgcatucggtaggaagttaut

SEQ ID NO: 90200 - DNA, 21 bp, Artificial Sequence
  Synthetic
ggtcuggtatggugagcgaaa

SEQ ID NO: 90201 - DNA, 21 bp, Artificial Sequence
  Synthetic
ggagactttuctgcggtccuc

SEQ ID NO: 90202 - DNA, 26 bp, Artificial Sequence
  Synthetic
cacagttccacaugtatattctugcc

SEQ ID NO: 90203 - DNA, 25 bp, Artificial Sequence
  Synthetic
ttcagtgaugaagcccagatcaaut

SEQ ID NO: 90204 - DNA, 28 bp, Artificial Sequence
  Synthetic
ccttctttagtacaautgatctgggcut

SEQ ID NO: 90205 - DNA, 28 bp, Artificial Sequence
  Synthetic
tgtgttcactcutgctttgataaucagt

SEQ ID NO: 90206 - DNA, 24 bp, Artificial Sequence
  Synthetic
ttggaagtgtucctgtcacaauca

SEQ ID NO: 90207 - DNA, 20 bp, Artificial Sequence
  Synthetic
ggtuaagcagagugcaccac

SEQ ID NO: 90208 - DNA, 26 bp, Artificial Sequence
  Synthetic
gctcaatttgcutcatttctcctgut

SEQ ID NO: 90209 - DNA, 24 bp, Artificial Sequence
  Synthetic
attttggcctgucccgagttauag

SEQ ID NO: 90210 - DNA, 22 bp, Artificial Sequence
  Synthetic
ggaggctggcuccaagatacua

SEQ ID NO: 90211 - DNA, 21 bp, Artificial Sequence
  Synthetic
gccttcucccaacaccttuca

SEQ ID NO: 90212 - DNA, 23 bp, Artificial Sequence
  Synthetic
guaaggaagaugcaaacccagga

SEQ ID NO: 90213 - DNA, 22 bp, Artificial Sequence
  Synthetic
cccacgccaguagagaaaagug

SEQ ID NO: 90214 - DNA, 17 bp, Artificial Sequence
  Synthetic
cccggccacugucacac

SEQ ID NO: 90215 - DNA, 18 bp, Artificial Sequence
  Synthetic
gctcacggcuccccttuc

SEQ ID NO: 90216 - DNA, 21 bp, Artificial Sequence
  Synthetic
gcatctgccacuggaacauct

SEQ ID NO: 90217 - DNA, 24 bp, Artificial Sequence
  Synthetic
atggttcagauttcactgccucat

SEQ ID NO: 90218 - DNA, 26 bp, Artificial Sequence
  Synthetic
tgtatagacagcutctggatcaucct

SEQ ID NO: 90219 - DNA, 28 bp, Artificial Sequence
  Synthetic
gctggaatgagauatttggctgataugg

SEQ ID NO: 90220 - DNA, 19 bp, Artificial Sequence
  Synthetic
gtgtgagcucgccgaugat

SEQ ID NO: 90221 - DNA, 23 bp, Artificial Sequence
  Synthetic
tgctcatguaaaccaacccctuc

SEQ ID NO: 90222 - DNA, 27 bp, Artificial Sequence
  Synthetic
aggattggtagugattttcatgaugct

SEQ ID NO: 90223 - DNA, 24 bp, Artificial Sequence
  Synthetic
aagagactuccaggacaugcaaaa

SEQ ID NO: 90224 - DNA, 27 bp, Artificial Sequence
  Synthetic
tcataatgcacugaaaggaatuccaga

SEQ ID NO: 90225 - DNA, 21 bp, Artificial Sequence
  Synthetic
acctgcaggauttgguaagca

SEQ ID NO: 90226 - DNA, 19 bp, Artificial Sequence
  Synthetic
caggctgugccagtccaua

SEQ ID NO: 90227 - DNA, 23 bp, Artificial Sequence
  Synthetic
tgacaggatuggagcaatgaugt

SEQ ID NO: 90228 - DNA, 24 bp, Artificial Sequence
  Synthetic
ccccttguactgagtatgcuaacc

SEQ ID NO: 90229 - DNA, 21 bp, Artificial Sequence
  Synthetic
acaccttcuacacctggcuga

SEQ ID NO: 90230 - DNA, 27 bp, Artificial Sequence
  Synthetic
ctaaactgacuccagctgtatccttuc

SEQ ID NO: 90231 - DNA, 23 bp, Artificial Sequence
  Synthetic
ggtgtttuggacaatggacuggt

SEQ ID NO: 90232 - DNA, 28 bp, Artificial Sequence
  Synthetic
tggtagctctatutagtaactgtccugt

SEQ ID NO: 90233 - DNA, 28 bp, Artificial Sequence
  Synthetic
ccccaagttcucatgattctcttcttut

SEQ ID NO: 90234 - DNA, 20 bp, Artificial Sequence
  Synthetic
ttcacagcugctuacagcga

SEQ ID NO: 90235 - DNA, 24 bp, Artificial Sequence
  Synthetic
gccattagcaugcaaagagacuga

SEQ ID NO: 90236 - DNA, 23 bp, Artificial Sequence
  Synthetic
gggtttttgcuagttcagctcut

SEQ ID NO: 90237 - DNA, 28 bp, Artificial Sequence
  Synthetic
ggcttctggcacauaaaacatataagut

SEQ ID NO: 90238 - DNA, 23 bp, Artificial Sequence
  Synthetic
tggcccagaaacauttguagcat

SEQ ID NO: 90239 - DNA, 20 bp, Artificial Sequence
  Synthetic
tgaccugcctccctaugacc

SEQ ID NO: 90240 - DNA, 23 bp, Artificial Sequence
  Synthetic
tgcaaggtcccugtgaacatauc

SEQ ID NO: 90241 - DNA, 28 bp, Artificial Sequence
  Synthetic
agttaactgggcutttatttttgtctuc

SEQ ID NO: 90242 - DNA, 20 bp, Artificial Sequence
  Synthetic
tgutcgagctguggcagaag

SEQ ID NO: 90243 - DNA, 26 bp, Artificial Sequence
  Synthetic
cactttgaacautgagtcaacctuga

SEQ ID NO: 90244 - DNA, 22 bp, Artificial Sequence
  Synthetic
tuacaccaagugagcacacagt

SEQ ID NO: 90245 - DNA, 23 bp, Artificial Sequence
  Synthetic
cctaggaugaggcgaaggtttut

SEQ ID NO: 90246 - DNA, 18 bp, Artificial Sequence
  Synthetic
caugaaagcccccgcuga

SEQ ID NO: 90247 - DNA, 18 bp, Artificial Sequence
  Synthetic
cagcgacagggucctcut

SEQ ID NO: 90248 - DNA, 18 bp, Artificial Sequence
  Synthetic
gtgccugggcacaugaac

SEQ ID NO: 90249 - DNA, 18 bp, Artificial Sequence
  Synthetic
ggauggagccgaucacca

SEQ ID NO: 90250 - DNA, 18 bp, Artificial Sequence
  Synthetic
gcccucggtctucgagaa

SEQ ID NO: 90251 - DNA, 17 bp, Artificial Sequence
  Synthetic
ccucgagccagctucgt

SEQ ID NO: 90252 - DNA, 21 bp, Artificial Sequence
  Synthetic
ctactctggaugccacacugt

SEQ ID NO: 90253 - DNA, 26 bp, Artificial Sequence
  Synthetic
cagtctcaatttuctcctttgtgcut

SEQ ID NO: 90254 - DNA, 29 bp, Artificial Sequence
  Synthetic
cctttaccttatugactggtttctacugt

SEQ ID NO: 90255 - DNA, 24 bp, Artificial Sequence
  Synthetic
gccagtggtucacctattcttcua

SEQ ID NO: 90256 - DNA, 21 bp, Artificial Sequence
  Synthetic
ccaagagcagggcuagtgtuc

SEQ ID NO: 90257 - DNA, 24 bp, Artificial Sequence
  Synthetic
gctgccaaaauttcatggagtgut

SEQ ID NO: 90258 - DNA, 21 bp, Artificial Sequence
  Synthetic
agctuccggaaagactcucct

SEQ ID NO: 90259 - DNA, 23 bp, Artificial Sequence
  Synthetic
ggtttggcugtggagttaauggt

SEQ ID NO: 90260 - DNA, 21 bp, Artificial Sequence
  Synthetic
ggacagcaccucgttcaaauc

SEQ ID NO: 90261 - DNA, 28 bp, Artificial Sequence
  Synthetic
gggtggtcttuatgctcatgatauaaat

SEQ ID NO: 90262 - DNA, 27 bp, Artificial Sequence
  Synthetic
tgtattctttcaagagugctgacctut

SEQ ID NO: 90263 - DNA, 20 bp, Artificial Sequence
  Synthetic
acatgcaaacggguctguca

SEQ ID NO: 90264 - DNA, 23 bp, Artificial Sequence
  Synthetic
ccttggtctccutgtccttccua

SEQ ID NO: 90265 - DNA, 25 bp, Artificial Sequence
  Synthetic
ctcagcaacacaguttcauaagcac

SEQ ID NO: 90266 - DNA, 21 bp, Artificial Sequence
  Synthetic
cctttgtgugcccagacauct

SEQ ID NO: 90267 - DNA, 23 bp, Artificial Sequence
  Synthetic
ctacagccacagcucagtactua

SEQ ID NO: 90268 - DNA, 21 bp, Artificial Sequence
  Synthetic
catcattcttguggcccctuc

SEQ ID NO: 90269 - DNA, 24 bp, Artificial Sequence
  Synthetic
tttctttcccutctgttgguccat

SEQ ID NO: 90270 - DNA, 18 bp, Artificial Sequence
  Synthetic
ggccucagaggctgugac

SEQ ID NO: 90271 - DNA, 22 bp, Artificial Sequence
  Synthetic
ttggcttugtagacgugaccat

SEQ ID NO: 90272 - DNA, 23 bp, Artificial Sequence
  Synthetic
ccaccuccagacagagtgtttuc

SEQ ID NO: 90273 - DNA, 22 bp, Artificial Sequence
  Synthetic
ccctcctctugcagacagguat

SEQ ID NO: 90274 - DNA, 26 bp, Artificial Sequence
  Synthetic
ccttacattttgutgctgttctgcut

SEQ ID NO: 90275 - DNA, 25 bp, Artificial Sequence
  Synthetic
ctgcttttctgugtagccaacttuc

SEQ ID NO: 90276 - DNA, 26 bp, Artificial Sequence
  Synthetic
agaaagaacacagcautcaugaacct

SEQ ID NO: 90277 - DNA, 27 bp, Artificial Sequence
  Synthetic
gaggacaagtutattgtgtgctugaac

SEQ ID NO: 90278 - DNA, 18 bp, Artificial Sequence
  Synthetic
aagtuggccgaggcacut

SEQ ID NO: 90279 - DNA, 17 bp, Artificial Sequence
  Synthetic
ctctcccuccgggcuac

SEQ ID NO: 90280 - DNA, 25 bp, Artificial Sequence
  Synthetic
tgaaaataaugccctcagatgucca

SEQ ID NO: 90281 - DNA, 24 bp, Artificial Sequence
  Synthetic
ggattgatgaaugcggtgacaaut

SEQ ID NO: 90282 - DNA, 20 bp, Artificial Sequence
  Synthetic
agctgtugggcctaaaccug

SEQ ID NO: 90283 - DNA, 26 bp, Artificial Sequence
  Synthetic
atgccattctugatagagttgcugat

SEQ ID NO: 90284 - DNA, 22 bp, Artificial Sequence
  Synthetic
tggttcuaaagcgctgcttuct

SEQ ID NO: 90285 - DNA, 23 bp, Artificial Sequence
  Synthetic
ccagagccacagacaugtacaut

SEQ ID NO: 90286 - DNA, 26 bp, Artificial Sequence
  Synthetic
gtacgaacucttctggtuacaacaga

SEQ ID NO: 90287 - DNA, 28 bp, Artificial Sequence
  Synthetic
tgaagttgatugattaagtcauggcgat

SEQ ID NO: 90288 - DNA, 21 bp, Artificial Sequence
  Synthetic
tcctggaaccccuccttctut

SEQ ID NO: 90289 - DNA, 21 bp, Artificial Sequence
  Synthetic
gtcatcacagcugcacactug

SEQ ID NO: 90290 - DNA, 19 bp, Artificial Sequence
  Synthetic
ggcacaaggacccuggtut

SEQ ID NO: 90291 - DNA, 21 bp, Artificial Sequence
  Synthetic
gaactcuccagcatccugacc

SEQ ID NO: 90292 - DNA, 21 bp, Artificial Sequence
  Synthetic
agcgaaguccccatgtgttut

SEQ ID NO: 90293 - DNA, 24 bp, Artificial Sequence
  Synthetic
aggtccctgcuatttcccatagut

SEQ ID NO: 90294 - DNA, 24 bp, Artificial Sequence
  Synthetic
gatttcaguggccatuaagaccct

SEQ ID NO: 90295 - DNA, 27 bp, Artificial Sequence
  Synthetic
cggaaacacaggucttatgactactut

SEQ ID NO: 90296 - DNA, 19 bp, Artificial Sequence
  Synthetic
gctggcugacgttguggat

SEQ ID NO: 90297 - DNA, 17 bp, Artificial Sequence
  Synthetic
ggaggugtgcctucggt

SEQ ID NO: 90298 - DNA, 20 bp, Artificial Sequence
  Synthetic
cttaggguggcccatucact

SEQ ID NO: 90299 - DNA, 26 bp, Artificial Sequence
  Synthetic
catctcaggtcuctgatgaaaaccut

SEQ ID NO: 90300 - DNA, 26 bp, Artificial Sequence
  Synthetic
tttaccaccacagugatcttcatcug

SEQ ID NO: 90301 - DNA, 26 bp, Artificial Sequence
  Synthetic
atgtactcgaaggagcutctttgtut

SEQ ID NO: 90302 - DNA, 28 bp, Artificial Sequence
  Synthetic
aggctattttctaucgtgaaagttgugt

SEQ ID NO: 90303 - DNA, 28 bp, Artificial Sequence
  Synthetic
tgctgaattggcautataggttgtgaua

SEQ ID NO: 90304 - DNA, 26 bp, Artificial Sequence
  Synthetic
catccaugatgtactcugagaacgac

SEQ ID NO: 90305 - DNA, 22 bp, Artificial Sequence
  Synthetic
gggauaccattccuggaacaga

SEQ ID NO: 90306 - DNA, 26 bp, Artificial Sequence
  Synthetic
acctattggguggtttacaacttcuc

SEQ ID NO: 90307 - DNA, 23 bp, Artificial Sequence
  Synthetic
aggaacuccgcggttcaataaut

SEQ ID NO: 90308 - DNA, 24 bp, Artificial Sequence
  Synthetic
tcttcccaauccttttggtgaucc

SEQ ID NO: 90309 - DNA, 20 bp, Artificial Sequence
  Synthetic
gaggautcucccagcagcaa

SEQ ID NO: 90310 - DNA, 20 bp, Artificial Sequence
  Synthetic
ggaatcccaccutggctgug

SEQ ID NO: 90311 - DNA, 21 bp, Artificial Sequence
  Synthetic
caaggagaccutcaccgtcut

SEQ ID NO: 90312 - DNA, 19 bp, Artificial Sequence
  Synthetic
cacaggcacacugaccauc

SEQ ID NO: 90313 - DNA, 20 bp, Artificial Sequence
  Synthetic
gggaaagcagccccutacuc

SEQ ID NO: 90314 - DNA, 27 bp, Artificial Sequence
  Synthetic
tgtcctacacaagaaugcagaaatuca

SEQ ID NO: 90315 - DNA, 22 bp, Artificial Sequence
  Synthetic
gtctttcauacagggcugcaca

SEQ ID NO: 90316 - DNA, 22 bp, Artificial Sequence
  Synthetic
tgtccgcaucgctctcatagua

SEQ ID NO: 90317 - DNA, 18 bp, Artificial Sequence
  Synthetic
gctucgcacaggtugggt

SEQ ID NO: 90318 - DNA, 26 bp, Artificial Sequence
  Synthetic
actaaccttuttcatgcaguccacat

SEQ ID NO: 90319 - DNA, 22 bp, Artificial Sequence
  Synthetic
gaggcagtcuggaggaactuag

SEQ ID NO: 90320 - DNA, 20 bp, Artificial Sequence
  Synthetic
gcagcaggautcacuccagt

SEQ ID NO: 90321 - DNA, 28 bp, Artificial Sequence
  Synthetic
agctgtctgatuatctgaaacacaaugt

SEQ ID NO: 90322 - DNA, 21 bp, Artificial Sequence
  Synthetic
cgaugagctgcuccagaacac

SEQ ID NO: 90323 - DNA, 27 bp, Artificial Sequence
  Synthetic
taagccataatucgtgcagtttctuat

SEQ ID NO: 90324 - DNA, 17 bp, Artificial Sequence
  Synthetic
cgtggcguacacgugga

SEQ ID NO: 90325 - DNA, 19 bp, Artificial Sequence
  Synthetic
cccttgcugacctcctuct

SEQ ID NO: 90326 - DNA, 24 bp, Artificial Sequence
  Synthetic
ggaaaccgucaaattgcttcgtut

SEQ ID NO: 90327 - DNA, 27 bp, Artificial Sequence
  Synthetic
gcaaccuaaaaacaagtaagacauggt

SEQ ID NO: 90328 - DNA, 23 bp, Artificial Sequence
  Synthetic
cctctacugaaggagttccucac

SEQ ID NO: 90329 - DNA, 26 bp, Artificial Sequence
  Synthetic
ttagctacagugtaggttgctcuaaa

SEQ ID NO: 90330 - DNA, 22 bp, Artificial Sequence
  Synthetic
ctccaagagagutgtagcccut

SEQ ID NO: 90331 - DNA, 23 bp, Artificial Sequence
  Synthetic
gggcagagucaatgtttccauca

SEQ ID NO: 90332 - DNA, 22 bp, Artificial Sequence
  Synthetic
ggaaugacgcugaaaacaggac

SEQ ID NO: 90333 - DNA, 28 bp, Artificial Sequence
  Synthetic
tccttcttctcguactaatgcttctuct

SEQ ID NO: 90334 - DNA, 28 bp, Artificial Sequence
  Synthetic
gcacaaaaccuatacatcctttctucct

SEQ ID NO: 90335 - DNA, 22 bp, Artificial Sequence
  Synthetic
gggataggcagcaugtggatug

SEQ ID NO: 90336 - DNA, 28 bp, Artificial Sequence
  Synthetic
cttctctggcagguaaaaggaaaauaac

SEQ ID NO: 90337 - DNA, 24 bp, Artificial Sequence
  Synthetic
gccgcagutcataggtauaggaat

SEQ ID NO: 90338 - DNA, 27 bp, Artificial Sequence
  Synthetic
aautttggaaaagtgucagaaggcaat

SEQ ID NO: 90339 - DNA, 24 bp, Artificial Sequence
  Synthetic
tggtgatggauctgatgaaccuga

SEQ ID NO: 90340 - DNA, 22 bp, Artificial Sequence
  Synthetic
gctttccaacagccaugagcua

SEQ ID NO: 90341 - DNA, 26 bp, Artificial Sequence
  Synthetic
guatccagauaacaaaagcaggagga

SEQ ID NO: 90342 - DNA, 23 bp, Artificial Sequence
  Synthetic
tgccagtatacucacgacaguca

SEQ ID NO: 90343 - DNA, 29 bp, Artificial Sequence
  Synthetic
tccattatataugcactgggttctucaac

SEQ ID NO: 90344 - DNA, 19 bp, Artificial Sequence
  Synthetic
ttacccccugactggguga

SEQ ID NO: 90345 - DNA, 24 bp, Artificial Sequence
  Synthetic
agtggattgggugtcacgtaatut

SEQ ID NO: 90346 - DNA, 22 bp, Artificial Sequence
  Synthetic
accugauaaagaggcccgagaa

SEQ ID NO: 90347 - DNA, 22 bp, Artificial Sequence
  Synthetic
cagacacaccuatgtgcagugt

SEQ ID NO: 90348 - DNA, 28 bp, Artificial Sequence
  Synthetic
gattgtccatucatctgttaatccucct

SEQ ID NO: 90349 - DNA, 28 bp, Artificial Sequence
  Synthetic
actctaagcucagtcaatggaaaugaaa

SEQ ID NO: 90350 - DNA, 27 bp, Artificial Sequence
  Synthetic
cagagtctgcugaatatgatgatguct

SEQ ID NO: 90351 - DNA, 28 bp, Artificial Sequence
  Synthetic
gtcgtacugaaccaattgtatcattugt

SEQ ID NO: 90352 - DNA, 22 bp, Artificial Sequence
  Synthetic
cctcatctccuttccagcgtuc

SEQ ID NO: 90353 - DNA, 23 bp, Artificial Sequence
  Synthetic
gcaacagtgcauggacaagatuc

SEQ ID NO: 90354 - DNA, 27 bp, Artificial Sequence
  Synthetic
cgtttcatcaaautctgagctaaucca

SEQ ID NO: 90355 - DNA, 27 bp, Artificial Sequence
  Synthetic
aaaataactactugcagagccaguaca

SEQ ID NO: 90356 - DNA, 28 bp, Artificial Sequence
  Synthetic
cctcctgctttugttatctggatacaut

SEQ ID NO: 90357 - DNA, 27 bp, Artificial Sequence
  Synthetic
tggaagtaaaauggcaactctaagcuc

SEQ ID NO: 90358 - DNA, 27 bp, Artificial Sequence
  Synthetic
tgagcttagagutgccattttactucc

SEQ ID NO: 90359 - DNA, 28 bp, Artificial Sequence
  Synthetic
agctttcaataacuagggcaaaactgua

SEQ ID NO: 90360 - DNA, 21 bp, Artificial Sequence
  Synthetic
ccugggaacccaaauccaact

SEQ ID NO: 90361 - DNA, 22 bp, Artificial Sequence
  Synthetic
tcaggtuccggccacttuaaaa

SEQ ID NO: 90362 - DNA, 28 bp, Artificial Sequence
  Synthetic
tgacacactcuaaaagataggctgaaug

SEQ ID NO: 90363 - DNA, 22 bp, Artificial Sequence
  Synthetic
cctaguccagccttcagaugga

SEQ ID NO: 90364 - DNA, 28 bp, Artificial Sequence
  Synthetic
tgaaacaaagucttcatttcuccacaga

SEQ ID NO: 90365 - DNA, 24 bp, Artificial Sequence
  Synthetic
ctctgggaacacaautccaccaua

SEQ ID NO: 90366 - DNA, 22 bp, Artificial Sequence
  Synthetic
ttagaggcuacagactcugcct

SEQ ID NO: 90367 - DNA, 22 bp, Artificial Sequence
  Synthetic
gcactagcugccattaaaugct

SEQ ID NO: 90368 - DNA, 21 bp, Artificial Sequence
  Synthetic
cagctuggtgagcaucacaac

SEQ ID NO: 90369 - DNA, 27 bp, Artificial Sequence
  Synthetic
gtgtgagcttutgcatgttctcuaaat

SEQ ID NO: 90370 - DNA, 23 bp, Artificial Sequence
  Synthetic
actttccccuaccctcaugaagt

SEQ ID NO: 90371 - DNA, 24 bp, Artificial Sequence
  Synthetic
tucttcttcaguacccaggacaga

SEQ ID NO: 90372 - DNA, 28 bp, Artificial Sequence
  Synthetic
cacaagtgtuagaatctgatctcugcat

SEQ ID NO: 90373 - DNA, 26 bp, Artificial Sequence
  Synthetic
gatgagaccaagaauaacugggaagt

SEQ ID NO: 90374 - DNA, 22 bp, Artificial Sequence
  Synthetic
cccgagaaagagcugacactuc

SEQ ID NO: 90375 - DNA, 33 bp, Artificial Sequence
  Synthetic
gtttctatttgacaauatagtttgttgcctcua

SEQ ID NO: 90376 - DNA, 22 bp, Artificial Sequence
  Synthetic
ccaaggccugaaaactccauct

SEQ ID NO: 90377 - DNA, 28 bp, Artificial Sequence
  Synthetic
catatgctgtcaauggatggaaguacat

SEQ ID NO: 90378 - DNA, 23 bp, Artificial Sequence
  Synthetic
actggaagcucatttcccactuc

SEQ ID NO: 90379 - DNA, 28 bp, Artificial Sequence
  Synthetic
ttgctaccauagggatatgtgtaaucct

SEQ ID NO: 90380 - DNA, 25 bp, Artificial Sequence
  Synthetic
tgatgactuggaggtatggtcucat

SEQ ID NO: 90381 - DNA, 27 bp, Artificial Sequence
  Synthetic
ccaatcaacuttctatcatcugcagga

SEQ ID NO: 90382 - DNA, 25 bp, Artificial Sequence
  Synthetic
gaaagguacattgctauggaggaca

SEQ ID NO: 90383 - DNA, 28 bp, Artificial Sequence
  Synthetic
atgatgctaccagaguctacctaatuct

SEQ ID NO: 90384 - DNA, 27 bp, Artificial Sequence
  Synthetic
aaaatctgcautaagctgcaugaaaca

SEQ ID NO: 90385 - DNA, 27 bp, Artificial Sequence
  Synthetic
cgctcagagaacaagutttacttucca

SEQ ID NO: 90386 - DNA, 22 bp, Artificial Sequence
  Synthetic
cctttctucagtgggtcucagt

SEQ ID NO: 90387 - DNA, 25 bp, Artificial Sequence
  Synthetic
catccatgtacucataacccagcuc

SEQ ID NO: 90388 - DNA, 24 bp, Artificial Sequence
  Synthetic
cctagggagaaugaccttaugcca

SEQ ID NO: 90389 - DNA, 26 bp, Artificial Sequence
  Synthetic
cggcatacagaauttccttcactuac

SEQ ID NO: 90390 - DNA, 21 bp, Artificial Sequence
  Synthetic
cgccauggcaactgtcaaauc

SEQ ID NO: 90391 - DNA, 27 bp, Artificial Sequence
  Synthetic
gttctttcctaauggtgactgttucct

SEQ ID NO: 90392 - DNA, 27 bp, Artificial Sequence
  Synthetic
gggccttatttaucatctgttctguct

SEQ ID NO: 90393 - DNA, 26 bp, Artificial Sequence
  Synthetic
tgatggtgtcuaacacaacctttgut

SEQ ID NO: 90394 - DNA, 24 bp, Artificial Sequence
  Synthetic
actgttccaaguggtgcatatucc

SEQ ID NO: 90395 - DNA, 28 bp, Artificial Sequence
  Synthetic
agctccaaaccaagugttagaatgttua

SEQ ID NO: 90396 - DNA, 23 bp, Artificial Sequence
  Synthetic
aatggccacacagutgaugagat

SEQ ID NO: 90397 - DNA, 29 bp, Artificial Sequence
  Synthetic
atgtgtccagtuttcttattttgcttuca

SEQ ID NO: 90398 - DNA, 21 bp, Artificial Sequence
  Synthetic
cctaggccaagutccctugag

SEQ ID NO: 90399 - DNA, 28 bp, Artificial Sequence
  Synthetic
ccatctcgtugccgattcatatatucat

SEQ ID NO: 90400 - DNA, 22 bp, Artificial Sequence
  Synthetic
cttctccccaacaugctctgut

SEQ ID NO: 90401 - DNA, 20 bp, Artificial Sequence
  Synthetic
gtcctgcacgaaugcaacuc

SEQ ID NO: 90402 - DNA, 21 bp, Artificial Sequence
  Synthetic
caaacagccgugcgtcauaaa

SEQ ID NO: 90403 - DNA, 24 bp, Artificial Sequence
  Synthetic
caaaacgggacuggctagtuaaac

SEQ ID NO: 90404 - DNA, 26 bp, Artificial Sequence
  Synthetic
ctgagttgcaggugaatttgtaaugt

SEQ ID NO: 90405 - DNA, 22 bp, Artificial Sequence
  Synthetic
gggtaaacccggucatcatcut

SEQ ID NO: 90406 - DNA, 21 bp, Artificial Sequence
  Synthetic
gtgaactgugacgctctcuca

SEQ ID NO: 90407 - DNA, 28 bp, Artificial Sequence
  Synthetic
ttcagatcctugaagctccatttgaaua

SEQ ID NO: 90408 - DNA, 24 bp, Artificial Sequence
  Synthetic
cctgaccctcugagtctttctcut

SEQ ID NO: 90409 - DNA, 22 bp, Artificial Sequence
  Synthetic
ctccattuctggccucagagac

SEQ ID NO: 90410 - DNA, 20 bp, Artificial Sequence
  Synthetic
ccguagaagcccacgatgua

SEQ ID NO: 90411 - DNA, 21 bp, Artificial Sequence
  Synthetic
cccaaatgccutcatcccgut

SEQ ID NO: 90412 - DNA, 22 bp, Artificial Sequence
  Synthetic
ggcacaacuccagaugaagact

SEQ ID NO: 90413 - DNA, 22 bp, Artificial Sequence
  Synthetic
gccccugaaaagctctcatcuc

SEQ ID NO: 90414 - DNA, 23 bp, Artificial Sequence
  Synthetic
gtatgccugccacagagatuacc

SEQ ID NO: 90415 - DNA, 22 bp, Artificial Sequence
  Synthetic
tcgatccccutcttccuaagca

SEQ ID NO: 90416 - DNA, 22 bp, Artificial Sequence
  Synthetic
accacucacctaggttugcaac

SEQ ID NO: 90417 - DNA, 27 bp, Artificial Sequence
  Synthetic
gacatgctcacutgtggtactatttuc

SEQ ID NO: 90418 - DNA, 23 bp, Artificial Sequence
  Synthetic
gggcgatcucaaaagttatcucc

SEQ ID NO: 90419 - DNA, 23 bp, Artificial Sequence
  Synthetic
agaaacacuggatgcuggaaagt

SEQ ID NO: 90420 - DNA, 21 bp, Artificial Sequence
  Synthetic
tgauccccacaccugacaaag

SEQ ID NO: 90421 - DNA, 23 bp, Artificial Sequence
  Synthetic
gtaagagaccuggaagccatgug

SEQ ID NO: 90422 - DNA, 23 bp, Artificial Sequence
  Synthetic
cagcatcugagcaagggtaugaa

SEQ ID NO: 90423 - DNA, 26 bp, Artificial Sequence
  Synthetic
gctatgccaguaatcagggttaucaa

SEQ ID NO: 90424 - DNA, 25 bp, Artificial Sequence
  Synthetic
cctagacctcaucctctttgagcut

SEQ ID NO: 90425 - DNA, 23 bp, Artificial Sequence
  Synthetic
tcaggtggaucaaagtgtctgug

SEQ ID NO: 90426 - DNA, 22 bp, Artificial Sequence
  Synthetic
ggcaaactuacccagcctctut

SEQ ID NO: 90427 - DNA, 27 bp, Artificial Sequence
  Synthetic
ggattgtgactcucatttcttttggug

SEQ ID NO: 90428 - DNA, 25 bp, Artificial Sequence
  Synthetic
gcuctgaaagtcuggaagagaaaga

SEQ ID NO: 90429 - DNA, 21 bp, Artificial Sequence
  Synthetic
tgacccttgugaacagctugg

SEQ ID NO: 90430 - DNA, 22 bp, Artificial Sequence
  Synthetic
ggcccagcacaugtaatttugt

SEQ ID NO: 90431 - DNA, 28 bp, Artificial Sequence
  Synthetic
cttggaaagtgaugcaaatacttcagut

SEQ ID NO: 90432 - DNA, 20 bp, Artificial Sequence
  Synthetic
caccgaguccuggacaagat

SEQ ID NO: 90433 - DNA, 25 bp, Artificial Sequence
  Synthetic
ctttatguctctcctguaggaagcc

SEQ ID NO: 90434 - DNA, 28 bp, Artificial Sequence
  Synthetic
caaaatgaccaaguaataagctgucagt

SEQ ID NO: 90435 - DNA, 26 bp, Artificial Sequence
  Synthetic
gacctttgctguaacatgctgtatut

SEQ ID NO: 90436 - DNA, 22 bp, Artificial Sequence
  Synthetic
cctcagccaugtttccucacat

SEQ ID NO: 90437 - DNA, 21 bp, Artificial Sequence
  Synthetic
cacggagaccutcctgacaut

SEQ ID NO: 90438 - DNA, 21 bp, Artificial Sequence
  Synthetic
cgacaagaccaaccuccaugt

SEQ ID NO: 90439 - DNA, 28 bp, Artificial Sequence
  Synthetic
ggtggctttgtucaaattaaaggttcut

SEQ ID NO: 90440 - DNA, 21 bp, Artificial Sequence
  Synthetic
ctgaggccagguggttuaagt

SEQ ID NO: 90441 - DNA, 23 bp, Artificial Sequence
  Synthetic
aatgctucacagcaaacctgtuc

SEQ ID NO: 90442 - DNA, 20 bp, Artificial Sequence
  Synthetic
atgaggcugctgtgctugat

SEQ ID NO: 90443 - DNA, 22 bp, Artificial Sequence
  Synthetic
agctcaugcacgactagttucc

SEQ ID NO: 90444 - DNA, 22 bp, Artificial Sequence
  Synthetic
caaugagccagactuggaagac

SEQ ID NO: 90445 - DNA, 23 bp, Artificial Sequence
  Synthetic
tgatgaatgtcugccaagcctut

SEQ ID NO: 90446 - DNA, 25 bp, Artificial Sequence
  Synthetic
gucttcaagtgttuagccacaaagg

SEQ ID NO: 90447 - DNA, 23 bp, Artificial Sequence
  Synthetic
gacctgcaugcttttctttcuca

SEQ ID NO: 90448 - DNA, 28 bp, Artificial Sequence
  Synthetic
caacagcctuagatgctcttaguaaaga

SEQ ID NO: 90449 - DNA, 27 bp, Artificial Sequence
  Synthetic
gccagcctaaautaattcactccatut

SEQ ID NO: 90450 - DNA, 28 bp, Artificial Sequence
  Synthetic
catcctttatautgccatttttguccca

SEQ ID NO: 90451 - DNA, 26 bp, Artificial Sequence
  Synthetic
gcacgatauaacaggccaagcattua

SEQ ID NO: 90452 - DNA, 26 bp, Artificial Sequence
  Synthetic
gatcccaatgcccuctatgtcttaut

SEQ ID NO: 90453 - DNA, 22 bp, Artificial Sequence
  Synthetic
tgcacaccaggutactgtugac

SEQ ID NO: 90454 - DNA, 28 bp, Artificial Sequence
  Synthetic
ccaagutttaggagatucagaaggcaaa

SEQ ID NO: 90455 - DNA, 22 bp, Artificial Sequence
  Synthetic
ctaacagaacutccgcctcugg

SEQ ID NO: 90456 - DNA, 29 bp, Artificial Sequence
  Synthetic
gttttctggaauggagtgagtatagucat

SEQ ID NO: 90457 - DNA, 28 bp, Artificial Sequence
  Synthetic
ctctttgccatuaacttggatttctuga

SEQ ID NO: 90458 - DNA, 18 bp, Artificial Sequence
  Synthetic
agaguccccgguccaaca

SEQ ID NO: 90459 - DNA, 20 bp, Artificial Sequence
  Synthetic
ccagggcagguggaagaauc

SEQ ID NO: 90460 - DNA, 25 bp, Artificial Sequence
  Synthetic
acaggattccugaaaaccaactgua

SEQ ID NO: 90461 - DNA, 20 bp, Artificial Sequence
  Synthetic
ctcgaucaccgtgcagtuct

SEQ ID NO: 90462 - DNA, 19 bp, Artificial Sequence
  Synthetic
gccacgguatgttccucgt

SEQ ID NO: 90463 - DNA, 25 bp, Artificial Sequence
  Synthetic
aaattcctgguccccgatctuaaaa

SEQ ID NO: 90464 - DNA, 27 bp, Artificial Sequence
  Synthetic
ggtcttcaccaguacatttcattcuca

SEQ ID NO: 90465 - DNA, 24 bp, Artificial Sequence
  Synthetic
cctccaccaguttctgtattucct

SEQ ID NO: 90466 - DNA, 26 bp, Artificial Sequence
  Synthetic
aagtcatgcuaacagagtgucaagag

SEQ ID NO: 90467 - DNA, 29 bp, Artificial Sequence
  Synthetic
ccgacagaaaauatgttacgcuaagagaa

SEQ ID NO: 90468 - DNA, 22 bp, Artificial Sequence
  Synthetic
caacgactaucagcagcugaag

SEQ ID NO: 90469 - DNA, 21 bp, Artificial Sequence
  Synthetic
cacucggaacagcagcaagua

SEQ ID NO: 90470 - DNA, 26 bp, Artificial Sequence
  Synthetic
gtatgttucactctatgucccccaaa

SEQ ID NO: 90471 - DNA, 22 bp, Artificial Sequence
  Synthetic
ttccttctugggttgctgtuga

SEQ ID NO: 90472 - DNA, 25 bp, Artificial Sequence
  Synthetic
tggtcaugagggaaaauaagaaccc

SEQ ID NO: 90473 - DNA, 28 bp, Artificial Sequence
  Synthetic
gcagaatgtuaaatgaacgaaucccaaa

SEQ ID NO: 90474 - DNA, 22 bp, Artificial Sequence
  Synthetic
cctggctgcuaggaacattcug

SEQ ID NO: 90475 - DNA, 26 bp, Artificial Sequence
  Synthetic
atgcttcuacttgagaaugccaagaa

SEQ ID NO: 90476 - DNA, 19 bp, Artificial Sequence
  Synthetic
catcaacucgcugcccaac

SEQ ID NO: 90477 - DNA, 19 bp, Artificial Sequence
  Synthetic
agacccggutctcgaccut

SEQ ID NO: 90478 - DNA, 28 bp, Artificial Sequence
  Synthetic
agatttacctcccaaaugtcagatgaug

SEQ ID NO: 90479 - DNA, 25 bp, Artificial Sequence
  Synthetic
ctgtgcugaaaacagtctctttgut

SEQ ID NO: 90480 - DNA, 24 bp, Artificial Sequence
  Synthetic
tggataaaagcggucaactuaccc

SEQ ID NO: 90481 - DNA, 26 bp, Artificial Sequence
  Synthetic
tgaaggagcugcataaagagucaaaa

SEQ ID NO: 90482 - DNA, 22 bp, Artificial Sequence
  Synthetic
ccctattuccctccucaaccaa

SEQ ID NO: 90483 - DNA, 24 bp, Artificial Sequence
  Synthetic
acaatgtagcugacagccaaauca

SEQ ID NO: 90484 - DNA, 21 bp, Artificial Sequence
  Synthetic
ctggatuggcacctgcuaact

SEQ ID NO: 90485 - DNA, 28 bp, Artificial Sequence
  Synthetic
gccgggaaaaucatgttcttttcttcua

SEQ ID NO: 90486 - DNA, 23 bp, Artificial Sequence
  Synthetic
gcagtccatuctgcctctgttut

SEQ ID NO: 90487 - DNA, 26 bp, Artificial Sequence
  Synthetic
agagttgcttuttgactgtctucaca

SEQ ID NO: 90488 - DNA, 21 bp, Artificial Sequence
  Synthetic
caagcucacggtcatuaccga

SEQ ID NO: 90489 - DNA, 21 bp, Artificial Sequence
  Synthetic
aagaugaccagggcgtagtug

SEQ ID NO: 90490 - DNA, 29 bp, Artificial Sequence
  Synthetic
tgtttaaagagaauacgaccaagccuaac

SEQ ID NO: 90491 - DNA, 21 bp, Artificial Sequence
  Synthetic
ggccagagacutgcagacaut

SEQ ID NO: 90492 - DNA, 21 bp, Artificial Sequence
  Synthetic
ccctgcagugattcugaggac

SEQ ID NO: 90493 - DNA, 23 bp, Artificial Sequence
  Synthetic
ggagcttgtgauggaggaaagut

SEQ ID NO: 90494 - DNA, 17 bp, Artificial Sequence
  Synthetic
gcagggagcggugagug

SEQ ID NO: 90495 - DNA, 17 bp, Artificial Sequence
  Synthetic
ccgccgucctcctucat

SEQ ID NO: 90496 - DNA, 19 bp, Artificial Sequence
  Synthetic
gguccacagggaugcgaag

SEQ ID NO: 90497 - DNA, 23 bp, Artificial Sequence
  Synthetic
ctccccaaccugtctcttttgua

SEQ ID NO: 90498 - DNA, 24 bp, Artificial Sequence
  Synthetic
cagttgcatugttccacaaaugga

SEQ ID NO: 90499 - DNA, 19 bp, Artificial Sequence
  Synthetic
tutcaggucccgaggaggt

SEQ ID NO: 90500 - DNA, 27 bp, Artificial Sequence
  Synthetic
aggagtggauacaggaaaucagaagat

SEQ ID NO: 90501 - DNA, 21 bp, Artificial Sequence
  Synthetic
gaacctgcautgtgactgcug

SEQ ID NO: 90502 - DNA, 19 bp, Artificial Sequence
  Synthetic
ccagccaaucgtctcuggt

SEQ ID NO: 90503 - DNA, 27 bp, Artificial Sequence
  Synthetic
ccaattagaaacutctgtcacttgugt

SEQ ID NO: 90504 - DNA, 21 bp, Artificial Sequence
  Synthetic
gaacgutcaucaggacaggga

SEQ ID NO: 90505 - DNA, 27 bp, Artificial Sequence
  Synthetic
tcctaagcaaggutctggtttgtttua

SEQ ID NO: 90506 - DNA, 20 bp, Artificial Sequence
  Synthetic
tcaaggctugccaggacuaa

SEQ ID NO: 90507 - DNA, 22 bp, Artificial Sequence
  Synthetic
gcgcagagagaucgaaauccag

SEQ ID NO: 90508 - DNA, 20 bp, Artificial Sequence
  Synthetic
cagtggcaguaaggctggut

SEQ ID NO: 90509 - DNA, 21 bp, Artificial Sequence
  Synthetic
tccaauagggagacccaccug

SEQ ID NO: 90510 - DNA, 20 bp, Artificial Sequence
  Synthetic
cgcggcuggaaactcttcua

SEQ ID NO: 90511 - DNA, 20 bp, Artificial Sequence
  Synthetic
ggaucagggaccaguccaca

SEQ ID NO: 90512 - DNA, 21 bp, Artificial Sequence
  Synthetic
catcaacccauactgcaggug

SEQ ID NO: 90513 - DNA, 22 bp, Artificial Sequence
  Synthetic
acutggcucgggagaagaaaag

SEQ ID NO: 90514 - DNA, 23 bp, Artificial Sequence
  Synthetic
gggcactaagutgccaataguag

SEQ ID NO: 90515 - DNA, 23 bp, Artificial Sequence
  Synthetic
cgaaugttgagtucgaccaccat

SEQ ID NO: 90516 - DNA, 24 bp, Artificial Sequence
  Synthetic
gggacaacuacctgtatgagaucc

SEQ ID NO: 90517 - DNA, 21 bp, Artificial Sequence
  Synthetic
tttgugggaagccacggatua

SEQ ID NO: 90518 - DNA, 27 bp, Artificial Sequence
  Synthetic
tgtttctguacctgctttaatuacggt

SEQ ID NO: 90519 - DNA, 20 bp, Artificial Sequence
  Synthetic
ggccactcuggtttcaggut

SEQ ID NO: 90520 - DNA, 24 bp, Artificial Sequence
  Synthetic
ccagagtucccacaacgaaattug

SEQ ID NO: 90521 - DNA, 23 bp, Artificial Sequence
  Synthetic
ctgaggaggaacuggcaucaaaa

SEQ ID NO: 90522 - DNA, 22 bp, Artificial Sequence
  Synthetic
ctgacctcugttacctcuccac

SEQ ID NO: 90523 - DNA, 26 bp, Artificial Sequence
  Synthetic
tgtactcattgtugatggtggtctuc

SEQ ID NO: 90524 - DNA, 20 bp, Artificial Sequence
  Synthetic
gttggtgggaaguccagcut

SEQ ID NO: 90525 - DNA, 21 bp, Artificial Sequence
  Synthetic
tctcccaccucagaagccaua

SEQ ID NO: 90526 - DNA, 21 bp, Artificial Sequence
  Synthetic
cttgagcgccacgaugaaaug

SEQ ID NO: 90527 - DNA, 27 bp, Artificial Sequence
  Synthetic
aacctcttaauaaccaaaaccggtuct

SEQ ID NO: 90528 - DNA, 26 bp, Artificial Sequence
  Synthetic
tgctattgugtttctcaauccaggaa

SEQ ID NO: 90529 - DNA, 28 bp, Artificial Sequence
  Synthetic
ccaagcatttcautaccagagttuacat

SEQ ID NO: 90530 - DNA, 23 bp, Artificial Sequence
  Synthetic
ccactgtgugcccctcttattuc

SEQ ID NO: 90531 - DNA, 23 bp, Artificial Sequence
  Synthetic
gccaagggautcaggtucagaat

SEQ ID NO: 90532 - DNA, 23 bp, Artificial Sequence
  Synthetic
caggttccutccactguaccaaa

SEQ ID NO: 90533 - DNA, 26 bp, Artificial Sequence
  Synthetic
ggattatgaatucagggttgttgcug

SEQ ID NO: 90534 - DNA, 22 bp, Artificial Sequence
  Synthetic
agacauggccaacaaugacaca

SEQ ID NO: 90535 - DNA, 29 bp, Artificial Sequence
  Synthetic
cgttttcctcctutcaactaacctaacut

SEQ ID NO: 90536 - DNA, 21 bp, Artificial Sequence
  Synthetic
ccaagcaagacaggugcttut

SEQ ID NO: 90537 - DNA, 20 bp, Artificial Sequence
  Synthetic
ggtaccggugccaggttaug

SEQ ID NO: 90538 - DNA, 24 bp, Artificial Sequence
  Synthetic
agaaatgaagcugttgctggaaug

SEQ ID NO: 90539 - DNA, 28 bp, Artificial Sequence
  Synthetic
gtgtgugaccagaatttucaagaaagaa

SEQ ID NO: 90540 - DNA, 26 bp, Artificial Sequence
  Synthetic
cttaccttctgcuatgcaggtgtuat

SEQ ID NO: 90541 - DNA, 28 bp, Artificial Sequence
  Synthetic
gggtatgatgaugctattttgagctcut

SEQ ID NO: 90542 - DNA, 20 bp, Artificial Sequence
  Synthetic
cccccgcccaaugttatuga

SEQ ID NO: 90543 - DNA, 28 bp, Artificial Sequence
  Synthetic
agcataaaccuaaaaactcugaggaact

SEQ ID NO: 90544 - DNA, 21 bp, Artificial Sequence
  Synthetic
ccaagggtguggtgaaagaug

SEQ ID NO: 90545 - DNA, 29 bp, Artificial Sequence
  Synthetic
cattttggctttucaggaactttctctua

SEQ ID NO: 90546 - DNA, 24 bp, Artificial Sequence
  Synthetic
gccaccccaucaatttctttguaa

SEQ ID NO: 90547 - DNA, 22 bp, Artificial Sequence
  Synthetic
atccaagccutacccaaaccuc

SEQ ID NO: 90548 - DNA, 22 bp, Artificial Sequence
  Synthetic
ccacgucgaagaatcgcaucat

SEQ ID NO: 90549 - DNA, 23 bp, Artificial Sequence
  Synthetic
caacagaauggcaucacccaaag

SEQ ID NO: 90550 - DNA, 26 bp, Artificial Sequence
  Synthetic
ctcacctgtgcutgaaagtatttcut

SEQ ID NO: 90551 - DNA, 22 bp, Artificial Sequence
  Synthetic
ttctccctccucttcggtctut

SEQ ID NO: 90552 - DNA, 23 bp, Artificial Sequence
  Synthetic
cacctgtgutttcagggauacga

SEQ ID NO: 90553 - DNA, 22 bp, Artificial Sequence
  Synthetic
caggcugttcttctuagagcgt

SEQ ID NO: 90554 - DNA, 20 bp, Artificial Sequence
  Synthetic
ccaagcccgcucatgaucaa

SEQ ID NO: 90555 - DNA, 25 bp, Artificial Sequence
  Synthetic
tgaagggtcuggtaggatcatacuc

SEQ ID NO: 90556 - DNA, 21 bp, Artificial Sequence
  Synthetic
agctgggagggacugagtuag

SEQ ID NO: 90557 - DNA, 18 bp, Artificial Sequence
  Synthetic
cccgacgcguacaggaug

SEQ ID NO: 90558 - DNA, 21 bp, Artificial Sequence
  Synthetic
cgaggccagguauacggacat

SEQ ID NO: 90559 - DNA, 18 bp, Artificial Sequence
  Synthetic
guacctgucgggccagag

SEQ ID NO: 90560 - DNA, 20 bp, Artificial Sequence
  Synthetic
gccactgugcagaagctcuc

SEQ ID NO: 90561 - DNA, 22 bp, Artificial Sequence
  Synthetic
gtaccagggaugagcttgacut

SEQ ID NO: 90562 - DNA, 22 bp, Artificial Sequence
  Synthetic
tgagcccccgauactctatucc

SEQ ID NO: 90563 - DNA, 20 bp, Artificial Sequence
  Synthetic
gctgcgcutcgcattctuac

SEQ ID NO: 90564 - DNA, 22 bp, Artificial Sequence
  Synthetic
tcaaccacagcaaugccatcua

SEQ ID NO: 90565 - DNA, 28 bp, Artificial Sequence
  Synthetic
gcaggagtatuaccatacaaggaaauct

SEQ ID NO: 90566 - DNA, 20 bp, Artificial Sequence
  Synthetic
gctcttgccucgatgtccua

SEQ ID NO: 90567 - DNA, 18 bp, Artificial Sequence
  Synthetic
tgctcucgcgccactuac

SEQ ID NO: 90568 - DNA, 17 bp, Artificial Sequence
  Synthetic
cccucagggcccaagut

SEQ ID NO: 90569 - DNA, 25 bp, Artificial Sequence
  Synthetic
ctccataacucatcactucccacat

SEQ ID NO: 90570 - DNA, 25 bp, Artificial Sequence
  Synthetic
tgaggacttugttaatgccaaugct

SEQ ID NO: 90571 - DNA, 29 bp, Artificial Sequence
  Synthetic
tgagattgtcacaaauttgctttctucaa

SEQ ID NO: 90572 - DNA, 24 bp, Artificial Sequence
  Synthetic
aaagccaaaaccccutcuaacaga

SEQ ID NO: 90573 - DNA, 19 bp, Artificial Sequence
  Synthetic
caccgttguggtccggaut

SEQ ID NO: 90574 - DNA, 27 bp, Artificial Sequence
  Synthetic
acaaaagagcugatgtttcaccauaca

SEQ ID NO: 90575 - DNA, 24 bp, Artificial Sequence
  Synthetic
cttgtgcatgucccactaactuct

SEQ ID NO: 90576 - DNA, 20 bp, Artificial Sequence
  Synthetic
gcctcuggaggaaccacuga

SEQ ID NO: 90577 - DNA, 19 bp, Artificial Sequence
  Synthetic
cttttgtugccggguggac

SEQ ID NO: 90578 - DNA, 23 bp, Artificial Sequence
  Synthetic
gcagcttcuccctctcattagug

SEQ ID NO: 90579 - DNA, 28 bp, Artificial Sequence
  Synthetic
agatttggagtgaugtcctcagttcuat

SEQ ID NO: 90580 - DNA, 31 bp, Artificial Sequence
  Synthetic
gcattgctaataugtaatcccttttucaact

SEQ ID NO: 90581 - DNA, 21 bp, Artificial Sequence
  Synthetic
cagaccggaauagcctgtuca

SEQ ID NO: 90582 - DNA, 22 bp, Artificial Sequence
  Synthetic
gcagagucgtggtaaacuccat

SEQ ID NO: 90583 - DNA, 25 bp, Artificial Sequence
  Synthetic
gaaagcattgccaugcatgacatua

SEQ ID NO: 90584 - DNA, 29 bp, Artificial Sequence
  Synthetic
acctacagtataugagaaatggagagcut

SEQ ID NO: 90585 - DNA, 22 bp, Artificial Sequence
  Synthetic
agautccucacacagccaacag

SEQ ID NO: 90586 - DNA, 28 bp, Artificial Sequence
  Synthetic
ccacctacaautaatgctggtttugaat

SEQ ID NO: 90587 - DNA, 27 bp, Artificial Sequence
  Synthetic
acttactagttatugctgtgccaaugt

SEQ ID NO: 90588 - DNA, 25 bp, Artificial Sequence
  Synthetic
caagtccuattatcagcugccagat

SEQ ID NO: 90589 - DNA, 29 bp, Artificial Sequence
  Synthetic
tcctgttttgttgutgttgtttctttcut

SEQ ID NO: 90590 - DNA, 24 bp, Artificial Sequence
  Synthetic
gatgtctggagcuttgggatacuc

SEQ ID NO: 90591 - DNA, 20 bp, Artificial Sequence
  Synthetic
tgutccaaccugggagggat

SEQ ID NO: 90592 - DNA, 20 bp, Artificial Sequence
  Synthetic
cctgaggcuggagctguact

SEQ ID NO: 90593 - DNA, 17 bp, Artificial Sequence
  Synthetic
cctccucccccagcauc

SEQ ID NO: 90594 - DNA, 25 bp, Artificial Sequence
  Synthetic
ggtgtcacuagaaacatcacaugct

SEQ ID NO: 90595 - DNA, 26 bp, Artificial Sequence
  Synthetic
ccattctgaugaagcaccttuaaacc

SEQ ID NO: 90596 - DNA, 22 bp, Artificial Sequence
  Synthetic
ccaaagcacutttctgctgcua

SEQ ID NO: 90597 - DNA, 28 bp, Artificial Sequence
  Synthetic
ttaaucttagtggagtugaaaggaagca

SEQ ID NO: 90598 - DNA, 17 bp, Artificial Sequence
  Synthetic
cggctgugacgcgagua

SEQ ID NO: 90599 - DNA, 21 bp, Artificial Sequence
  Synthetic
tggtgaauggtaggucaggga

SEQ ID NO: 90600 - DNA, 25 bp, Artificial Sequence
  Synthetic
ctgtaccugcacttttacacttugg

SEQ ID NO: 90601 - DNA, 25 bp, Artificial Sequence
  Synthetic
aggataucgacagtgtgguacagaa

SEQ ID NO: 90602 - DNA, 28 bp, Artificial Sequence
  Synthetic
ctcactgcccautatcttaagacauact

SEQ ID NO: 90603 - DNA, 30 bp, Artificial Sequence
  Synthetic
tcaatggaggaauaaatgtagaaatuggca

SEQ ID NO: 90604 - DNA, 17 bp, Artificial Sequence
  Synthetic
cgacccuccgggaguct

SEQ ID NO: 90605 - DNA, 22 bp, Artificial Sequence
  Synthetic
gacutttggcuacggagaagga

SEQ ID NO: 90606 - DNA, 18 bp, Artificial Sequence
  Synthetic
cctccccuccccctauct

SEQ ID NO: 90607 - DNA, 19 bp, Artificial Sequence
  Synthetic
ggcgacuggcaatgttugg

SEQ ID NO: 90608 - DNA, 27 bp, Artificial Sequence
  Synthetic
agtctataaactucacagggagaccut

SEQ ID NO: 90609 - DNA, 27 bp, Artificial Sequence
  Synthetic
tttacctcaaguttggctgcaauaaat

SEQ ID NO: 90610 - DNA, 19 bp, Artificial Sequence
  Synthetic
ccatuccccaacagctgug

SEQ ID NO: 90611 - DNA, 18 bp, Artificial Sequence
  Synthetic
caccgggaugccaggaua

SEQ ID NO: 90612 - DNA, 23 bp, Artificial Sequence
  Synthetic
cgcccaucagcacaactaaatuc

SEQ ID NO: 90613 - DNA, 26 bp, Artificial Sequence
  Synthetic
ggtgtagtguacattgaggagaugac

SEQ ID NO: 90614 - DNA, 24 bp, Artificial Sequence
  Synthetic
ggatcctgcuatgggagatctuca

SEQ ID NO: 90615 - DNA, 20 bp, Artificial Sequence
  Synthetic
ggaggaggacuggaaagugg

SEQ ID NO: 90616 - DNA, 28 bp, Artificial Sequence
  Synthetic
gcgacacaagaaaaugttgtaaaaacuc

SEQ ID NO: 90617 - DNA, 20 bp, Artificial Sequence
  Synthetic
gccaacctcutcccccaauc

SEQ ID NO: 90618 - DNA, 21 bp, Artificial Sequence
  Synthetic
gagcggagcauggtaactuct

SEQ ID NO: 90619 - DNA, 21 bp, Artificial Sequence
  Synthetic
aatcagtuccccgaagctguc

SEQ ID NO: 90620 - DNA, 23 bp, Artificial Sequence
  Synthetic
cgattaccgcguttctttugagg

SEQ ID NO: 90621 - DNA, 23 bp, Artificial Sequence
  Synthetic
cgcccuaaaaccgtgauaaagga

SEQ ID NO: 90622 - DNA, 22 bp, Artificial Sequence
  Synthetic
cccagaaacucaaugagcccaa

SEQ ID NO: 90623 - DNA, 22 bp, Artificial Sequence
  Synthetic
aacgtgtcugccatguacaagt

SEQ ID NO: 90624 - DNA, 20 bp, Artificial Sequence
  Synthetic
ccagguagaaagccgagugt

SEQ ID NO: 90625 - DNA, 19 bp, Artificial Sequence
  Synthetic
cctgctugacgctgtccuc

SEQ ID NO: 90626 - DNA, 20 bp, Artificial Sequence
  Synthetic
actcaguctcccctuggaca

SEQ ID NO: 90627 - DNA, 24 bp, Artificial Sequence
  Synthetic
guatctagggugaggagcagacaa

SEQ ID NO: 90628 - DNA, 17 bp, Artificial Sequence
  Synthetic
gccccagcuguggaagg

SEQ ID NO: 90629 - DNA, 18 bp, Artificial Sequence
  Synthetic
cgtugggcagggtauggt

SEQ ID NO: 90630 - DNA, 18 bp, Artificial Sequence
  Synthetic
gccaccgcuacctcgtut

SEQ ID NO: 90631 - DNA, 17 bp, Artificial Sequence
  Synthetic
aggucuacccccaggca

SEQ ID NO: 90632 - DNA, 22 bp, Artificial Sequence
  Synthetic
ccttctcagcugctctgttcuc

SEQ ID NO: 90633 - DNA, 21 bp, Artificial Sequence
  Synthetic
gctctatucggaggcacctuc

SEQ ID NO: 90634 - DNA, 25 bp, Artificial Sequence
  Synthetic
agaguctttaatgccugaaggagga

SEQ ID NO: 90635 - DNA, 26 bp, Artificial Sequence
  Synthetic
tgggcaatgguagagtagagaatuca

SEQ ID NO: 90636 - DNA, 21 bp, Artificial Sequence
  Synthetic
ccaccutgtuggagaccacac

SEQ ID NO: 90637 - DNA, 21 bp, Artificial Sequence
  Synthetic
gcgaccucctugcagaaagac

SEQ ID NO: 90638 - DNA, 26 bp, Artificial Sequence
  Synthetic
cacagctctacutcatttcctcugat

SEQ ID NO: 90639 - DNA, 21 bp, Artificial Sequence
  Synthetic
ggauccgaagacaagccctuc

SEQ ID NO: 90640 - DNA, 26 bp, Artificial Sequence
  Synthetic
gtactctacugaaccatggccaaaut

SEQ ID NO: 90641 - DNA, 31 bp, Artificial Sequence
  Synthetic
ctttcataacugcctttttaaaatuccaggt

SEQ ID NO: 90642 - DNA, 29 bp, Artificial Sequence
  Synthetic
aaattcctaucaagaaatggagaacugct

SEQ ID NO: 90643 - DNA, 24 bp, Artificial Sequence
  Synthetic
ttcctuccagacaaaagaccgtut

SEQ ID NO: 90644 - DNA, 23 bp, Artificial Sequence
  Synthetic
aaacggucttttgtcuggaagga

SEQ ID NO: 90645 - DNA, 32 bp, Artificial Sequence
  Synthetic
aacaattcttttcauctttcatgcttactaut

SEQ ID NO: 90646 - DNA, 17 bp, Artificial Sequence
  Synthetic
gcagcgcucccgctauc

SEQ ID NO: 90647 - DNA, 18 bp, Artificial Sequence
  Synthetic
aactgccuggagccgtut

SEQ ID NO: 90648 - DNA, 21 bp, Artificial Sequence
  Synthetic
ctatgtccucgtggccaugaa

SEQ ID NO: 90649 - DNA, 23 bp, Artificial Sequence
  Synthetic
cgtggcuggagttggtgttauag

SEQ ID NO: 90650 - DNA, 25 bp, Artificial Sequence
  Synthetic
ggctaagaugaagaggagacctuga

SEQ ID NO: 90651 - DNA, 22 bp, Artificial Sequence
  Synthetic
ggagaagtugtcctgguagcac

SEQ ID NO: 90652 - DNA, 24 bp, Artificial Sequence
  Synthetic
ctctaatggtgucctcctcctcut

SEQ ID NO: 90653 - DNA, 25 bp, Artificial Sequence
  Synthetic
acaacttctuaccatctccuaccca

SEQ ID NO: 90654 - DNA, 22 bp, Artificial Sequence
  Synthetic
cagcuggactggaauacaccat

SEQ ID NO: 90655 - DNA, 21 bp, Artificial Sequence
  Synthetic
ggaggcugctcttgucaaagg

SEQ ID NO: 90656 - DNA, 21 bp, Artificial Sequence
  Synthetic
ggcccttcuttgtctgccuac

SEQ ID NO: 90657 - DNA, 22 bp, Artificial Sequence
  Synthetic
aggaugacugggaagacagact

SEQ ID NO: 90658 - DNA, 21 bp, Artificial Sequence
  Synthetic
tgtgatcugagctctgcctug

SEQ ID NO: 90659 - DNA, 22 bp, Artificial Sequence
  Synthetic
cctcccagggacugacaattut

SEQ ID NO: 90660 - DNA, 21 bp, Artificial Sequence
  Synthetic
gctttcagccautggacugga

SEQ ID NO: 90661 - DNA, 22 bp, Artificial Sequence
  Synthetic
ttctccgagauccccaauacga

SEQ ID NO: 90662 - DNA, 27 bp, Artificial Sequence
  Synthetic
gataactgugagaagcaataccgucat

SEQ ID NO: 90663 - DNA, 26 bp, Artificial Sequence
  Synthetic
atgagttaaccaacuaggccactuac

SEQ ID NO: 90664 - DNA, 18 bp, Artificial Sequence
  Synthetic
aagcaccaugcgggauga

SEQ ID NO: 90665 - DNA, 29 bp, Artificial Sequence
  Synthetic
acttttggagaacucaacauaaacagact

SEQ ID NO: 90666 - DNA, 19 bp, Artificial Sequence
  Synthetic
gctcagtccuctcccccut

SEQ ID NO: 90667 - DNA, 20 bp, Artificial Sequence
  Synthetic
caaaggcacccucagagcua

SEQ ID NO: 90668 - DNA, 24 bp, Artificial Sequence
  Synthetic
gtttgccatcutcgtcatgtugaa

SEQ ID NO: 90669 - DNA, 21 bp, Artificial Sequence
  Synthetic
gtgagcagucttgggtcauca

SEQ ID NO: 90670 - DNA, 20 bp, Artificial Sequence
  Synthetic
ggacagagccuggagcuaat

SEQ ID NO: 90671 - DNA, 21 bp, Artificial Sequence
  Synthetic
gucaccaaaguccagcacaga

SEQ ID NO: 90672 - DNA, 23 bp, Artificial Sequence
  Synthetic
gtagtgtccacgugtgtgcttua

SEQ ID NO: 90673 - DNA, 27 bp, Artificial Sequence
  Synthetic
ttccttcaaggauacttctactgguca

SEQ ID NO: 90674 - DNA, 28 bp, Artificial Sequence
  Synthetic
aactgatugaggacagaagauacacaac

SEQ ID NO: 90675 - DNA, 29 bp, Artificial Sequence
  Synthetic
tgtttgtttcctagautcttcttgctcut

SEQ ID NO: 90676 - DNA, 18 bp, Artificial Sequence
  Synthetic
cgcagugctcacctucct

SEQ ID NO: 90677 - DNA, 20 bp, Artificial Sequence
  Synthetic
ggcuggaagcctttcucacc

SEQ ID NO: 90678 - DNA, 24 bp, Artificial Sequence
  Synthetic
cactgttttcugcatattgcugct

SEQ ID NO: 90679 - DNA, 28 bp, Artificial Sequence
  Synthetic
tcagtgtauaccagcaaaatggaaaugt

SEQ ID NO: 90680 - DNA, 20 bp, Artificial Sequence
  Synthetic
ctttgagtucgccgacctug

SEQ ID NO: 90681 - DNA, 22 bp, Artificial Sequence
  Synthetic
ccagatggaguctccctaggua

SEQ ID NO: 90682 - DNA, 28 bp, Artificial Sequence
  Synthetic
ctaccttgccacaaacuccttattctua

SEQ ID NO: 90683 - DNA, 27 bp, Artificial Sequence
  Synthetic
cactctguggaagaaatcactgauaac

SEQ ID NO: 90684 - DNA, 25 bp, Artificial Sequence
  Synthetic
catatttgcagucttcatggccauc

SEQ ID NO: 90685 - DNA, 28 bp, Artificial Sequence
  Synthetic
tgtcttttgagugtgtagaagtgttuct

SEQ ID NO: 90686 - DNA, 20 bp, Artificial Sequence
  Synthetic
ggtccaccucagaggtcugt

SEQ ID NO: 90687 - DNA, 21 bp, Artificial Sequence
  Synthetic
cccagccaauagccactcuaa

SEQ ID NO: 90688 - DNA, 28 bp, Artificial Sequence
  Synthetic
agcaacaagaaaaacuaagcaagtugac

SEQ ID NO: 90689 - DNA, 24 bp, Artificial Sequence
  Synthetic
agtttttgcugagtgcctaaguga

SEQ ID NO: 90690 - DNA, 23 bp, Artificial Sequence
  Synthetic
ggataaacaauagcctgcgggua

SEQ ID NO: 90691 - DNA, 27 bp, Artificial Sequence
  Synthetic
cagcattaagttucagctctctgttut

SEQ ID NO: 90692 - DNA, 18 bp, Artificial Sequence
  Synthetic
tgctgaccuctgcccuct

SEQ ID NO: 90693 - DNA, 19 bp, Artificial Sequence
  Synthetic
gactgcccuccttguacca

SEQ ID NO: 90694 - DNA, 22 bp, Artificial Sequence
  Synthetic
gctctgcacaaagautgcacua

SEQ ID NO: 90695 - DNA, 28 bp, Artificial Sequence
  Synthetic
tgcttccaaagucacactgaaataguaa

SEQ ID NO: 90696 - DNA, 17 bp, Artificial Sequence
  Synthetic
gcctgugcgtctgugct

SEQ ID NO: 90697 - DNA, 18 bp, Artificial Sequence
  Synthetic
ggccagcaucctcaggua

SEQ ID NO: 90698 - DNA, 27 bp, Artificial Sequence
  Synthetic
actaagaaatgtgutgcttgttgctut

SEQ ID NO: 90699 - DNA, 24 bp, Artificial Sequence
  Synthetic
cccaagcaauttgtttgugaccat

SEQ ID NO: 90700 - DNA, 20 bp, Artificial Sequence
  Synthetic
agacggcugatccaatggug

SEQ ID NO: 90701 - DNA, 27 bp, Artificial Sequence
  Synthetic
catgcttttgaugaatgctttctcuct

SEQ ID NO: 90702 - DNA, 22 bp, Artificial Sequence
  Synthetic
ttctttccutcagcccuaagcc

SEQ ID NO: 90703 - DNA, 22 bp, Artificial Sequence
  Synthetic
ggcaaagacugcaccagatgua

SEQ ID NO: 90704 - DNA, 21 bp, Artificial Sequence
  Synthetic
gccatcuccacagtcgtcauc

SEQ ID NO: 90705 - DNA, 28 bp, Artificial Sequence
  Synthetic
gggaagataacauatgtgctcatcuaac

SEQ ID NO: 90706 - DNA, 22 bp, Artificial Sequence
  Synthetic
cctgcagtucaggctgauaagg

SEQ ID NO: 90707 - DNA, 26 bp, Artificial Sequence
  Synthetic
agccttggagutctttgctatgaaut

SEQ ID NO: 90708 - DNA, 21 bp, Artificial Sequence
  Synthetic
gcctagagautgccagctucc

SEQ ID NO: 90709 - DNA, 24 bp, Artificial Sequence
  Synthetic
tcactcccugctagagtctctuac

SEQ ID NO: 90710 - DNA, 27 bp, Artificial Sequence
  Synthetic
agttaatgcauctcctttgtttugcag

SEQ ID NO: 90711 - DNA, 23 bp, Artificial Sequence
  Synthetic
atgtctgccagcaautcacctua

SEQ ID NO: 90712 - DNA, 33 bp, Artificial Sequence
  Synthetic
gaaaaagcaaauccaactattacuagaaaacat

SEQ ID NO: 90713 - DNA, 23 bp, Artificial Sequence
  Synthetic
gccaatgggaaucatagctgtug

SEQ ID NO: 90714 - DNA, 22 bp, Artificial Sequence
  Synthetic
acagctatuggtgtcatuggca

SEQ ID NO: 90715 - DNA, 28 bp, Artificial Sequence
  Synthetic
tcctcagtttggcugtttatgacaatua

SEQ ID NO: 90716 - DNA, 21 bp, Artificial Sequence
  Synthetic
agaatggccgugttcatgcua

SEQ ID NO: 90717 - DNA, 28 bp, Artificial Sequence
  Synthetic
gaatcatguagagttgctgaaucacaga

SEQ ID NO: 90718 - DNA, 33 bp, Artificial Sequence
  Synthetic
gaatgttactgaaagaugttaatgcatttaugg

SEQ ID NO: 90719 - DNA, 27 bp, Artificial Sequence
  Synthetic
cagacagactcucactgatttacucat

SEQ ID NO: 90720 - DNA, 23 bp, Artificial Sequence
  Synthetic
cacctggauatctgtgauggcat

SEQ ID NO: 90721 - DNA, 27 bp, Artificial Sequence
  Synthetic
ggtgattgcacuaacattgttugaaga

SEQ ID NO: 90722 - DNA, 22 bp, Artificial Sequence
  Synthetic
ccctccccucttcaacaacuct

SEQ ID NO: 90723 - DNA, 28 bp, Artificial Sequence
  Synthetic
ggccaactaacauttagcctttctttut

SEQ ID NO: 90724 - DNA, 21 bp, Artificial Sequence
  Synthetic
gaaggcaggcutggtacguaa

SEQ ID NO: 90725 - DNA, 26 bp, Artificial Sequence
  Synthetic
gggaaaatgguagaagaagtggaugg

SEQ ID NO: 90726 - DNA, 23 bp, Artificial Sequence
  Synthetic
ttccccaguccgaccagaataua

SEQ ID NO: 90727 - DNA, 28 bp, Artificial Sequence
  Synthetic
tgaagcaaaaauaggtgtggacgtauaa

SEQ ID NO: 90728 - DNA, 28 bp, Artificial Sequence
  Synthetic
agcattcagtaaucgatttcactugaca

SEQ ID NO: 90729 - DNA, 21 bp, Artificial Sequence
  Synthetic
accuggtttgagugcaggaaa

SEQ ID NO: 90730 - DNA, 25 bp, Artificial Sequence
  Synthetic
atttaatagtgccugcaagcttugg

SEQ ID NO: 90731 - DNA, 29 bp, Artificial Sequence
  Synthetic
aattccctgatacuctaataccaccugaa

SEQ ID NO: 90732 - DNA, 25 bp, Artificial Sequence
  Synthetic
gttgacaatuaacttctgtguggct

SEQ ID NO: 90733 - DNA, 27 bp, Artificial Sequence
  Synthetic
acattttccaaaagcuagtgcacatug

SEQ ID NO: 90734 - DNA, 27 bp, Artificial Sequence
  Synthetic
gttttcccatcaguccagtagatguag

SEQ ID NO: 90735 - DNA, 27 bp, Artificial Sequence
  Synthetic
tgtatctgucagcccatgtagtatuga

SEQ ID NO: 90736 - DNA, 23 bp, Artificial Sequence
  Synthetic
acauttaattgucccagcccagt

SEQ ID NO: 90737 - DNA, 25 bp, Artificial Sequence
  Synthetic
tgacatttugctgttttcucaagca

SEQ ID NO: 90738 - DNA, 33 bp, Artificial Sequence
  Synthetic
tcctcctatcatutcatgtaattaaattucact

SEQ ID NO: 90739 - DNA, 25 bp, Artificial Sequence
  Synthetic
tcgagtgcuggaaggattgtttauc

SEQ ID NO: 90740 - DNA, 21 bp, Artificial Sequence
  Synthetic
acaatcctuccagcacucgac

SEQ ID NO: 90741 - DNA, 28 bp, Artificial Sequence
  Synthetic
gtccctaaagaugaagtgttagcaaauc

SEQ ID NO: 90742 - DNA, 24 bp, Artificial Sequence
  Synthetic
gccggtgcuacttgttacaugaat

SEQ ID NO: 90743 - DNA, 26 bp, Artificial Sequence
  Synthetic
actcaaatttaccucattgtccugct

SEQ ID NO: 90744 - DNA, 24 bp, Artificial Sequence
  Synthetic
tcaaaaggaggcutcccaacuaaa

SEQ ID NO: 90745 - DNA, 22 bp, Artificial Sequence
  Synthetic
aacgagaagcacaucaaccuga

SEQ ID NO: 90746 - DNA, 24 bp, Artificial Sequence
  Synthetic
tttatgacucattgcagcucgact

SEQ ID NO: 90747 - DNA, 27 bp, Artificial Sequence
  Synthetic
tgggaguagtggactaucaaggaaaaa

SEQ ID NO: 90748 - DNA, 28 bp, Artificial Sequence
  Synthetic
gtctaaacacagcuctttttggaugaaa

SEQ ID NO: 90749 - DNA, 22 bp, Artificial Sequence
  Synthetic
tccagaatggaaugccgcauat

SEQ ID NO: 90750 - DNA, 21 bp, Artificial Sequence
  Synthetic
ccaagaugagccucagacact

SEQ ID NO: 90751 - DNA, 20 bp, Artificial Sequence
  Synthetic
ctacgaggcgcaugatgtuc

SEQ ID NO: 90752 - DNA, 27 bp, Artificial Sequence
  Synthetic
cctttaaacaaucacgugaaaccaaga

SEQ ID NO: 90753 - DNA, 29 bp, Artificial Sequence
  Synthetic
tggagcagtuttatggaatcaucagaaat

SEQ ID NO: 90754 - DNA, 21 bp, Artificial Sequence
  Synthetic
cggtctcauctccgtctcucc

SEQ ID NO: 90755 - DNA, 23 bp, Artificial Sequence
  Synthetic
acagacaccggcauagtaguagt

SEQ ID NO: 90756 - DNA, 21 bp, Artificial Sequence
  Synthetic
ctcccaggaaugcccttagug

SEQ ID NO: 90757 - DNA, 22 bp, Artificial Sequence
  Synthetic
ttcgttgggaucctcgtaagug

SEQ ID NO: 90758 - DNA, 28 bp, Artificial Sequence
  Synthetic
cggatagcaauagataactccttgtugt

SEQ ID NO: 90759 - DNA, 24 bp, Artificial Sequence
  Synthetic
gcaggttuctaatatgguggcgaa

SEQ ID NO: 90760 - DNA, 23 bp, Artificial Sequence
  Synthetic
auttctgcattttucgccaccat

SEQ ID NO: 90761 - DNA, 28 bp, Artificial Sequence
  Synthetic
agcaattgcgugtaactataacaguaca

SEQ ID NO: 90762 - DNA, 21 bp, Artificial Sequence
  Synthetic
gggaugagaagcaggacaaug

SEQ ID NO: 90763 - DNA, 21 bp, Artificial Sequence
  Synthetic
cggcccauccctaacttucaa

SEQ ID NO: 90764 - DNA, 24 bp, Artificial Sequence
  Synthetic
ccttgtcagtucaaatccctgtug

SEQ ID NO: 90765 - DNA, 23 bp, Artificial Sequence
  Synthetic
cacattcuagaaggtggaccuga

SEQ ID NO: 90766 - DNA, 19 bp, Artificial Sequence
  Synthetic
caacgacacggccugtgua

SEQ ID NO: 90767 - DNA, 21 bp, Artificial Sequence
  Synthetic
gatcacaaaccccucggaguc

SEQ ID NO: 90768 - DNA, 21 bp, Artificial Sequence
  Synthetic
attgtgcaucgcgacaucaag

SEQ ID NO: 90769 - DNA, 21 bp, Artificial Sequence
  Synthetic
ccaggtacucctcagucccat

SEQ ID NO: 90770 - DNA, 23 bp, Artificial Sequence
  Synthetic
gtaacatggutcctgcugggaat

SEQ ID NO: 90771 - DNA, 22 bp, Artificial Sequence
  Synthetic
tgatgtcutgcagagugaccag

SEQ ID NO: 90772 - DNA, 23 bp, Artificial Sequence
  Synthetic
tgatgagaagutcgtctcgguct

SEQ ID NO: 90773 - DNA, 23 bp, Artificial Sequence
  Synthetic
gagacauaactcctguggaagca

SEQ ID NO: 90774 - DNA, 21 bp, Artificial Sequence
  Synthetic
agcagtgaugactctcuggga

SEQ ID NO: 90775 - DNA, 21 bp, Artificial Sequence
  Synthetic
cctggagtuacgggattguga

SEQ ID NO: 90776 - DNA, 18 bp, Artificial Sequence
  Synthetic
tgguggaagcgcgagaug

SEQ ID NO: 90777 - DNA, 19 bp, Artificial Sequence
  Synthetic
cagagccccaagucacuga

SEQ ID NO: 90778 - DNA, 24 bp, Artificial Sequence
  Synthetic
ctgtgcagauaaagtgguaacaga

SEQ ID NO: 90779 - DNA, 25 bp, Artificial Sequence
  Synthetic
ctccctcctccuattcccatttcua

SEQ ID NO: 90780 - DNA, 19 bp, Artificial Sequence
  Synthetic
acttcugcgccaacaucct

SEQ ID NO: 90781 - DNA, 18 bp, Artificial Sequence
  Synthetic
ggcggguagugaccacac

SEQ ID NO: 90782 - DNA, 21 bp, Artificial Sequence
  Synthetic
gcaagggcutagcaggaucag

SEQ ID NO: 90783 - DNA, 21 bp, Artificial Sequence
  Synthetic
ctctcctggguctccgtgaua

SEQ ID NO: 90784 - DNA, 26 bp, Artificial Sequence
  Synthetic
cttacttgccacugaaaagttgtuga

SEQ ID NO: 90785 - DNA, 22 bp, Artificial Sequence
  Synthetic
catgcgtgcuttcctcatguag

SEQ ID NO: 90786 - DNA, 25 bp, Artificial Sequence
  Synthetic
ctgccttgaaugacagtgtgtcuat

SEQ ID NO: 90787 - DNA, 26 bp, Artificial Sequence
  Synthetic
atgggaugaaccgaacaaggataaut

SEQ ID NO: 90788 - DNA, 24 bp, Artificial Sequence
  Synthetic
ctttgtggattugaccctccauga

SEQ ID NO: 90789 - DNA, 22 bp, Artificial Sequence
  Synthetic
ctaagcuacagccaggtcacut

SEQ ID NO: 90790 - DNA, 21 bp, Artificial Sequence
  Synthetic
cctcuccagatgcucccaaaa

SEQ ID NO: 90791 - DNA, 22 bp, Artificial Sequence
  Synthetic
ggttactggaccuttggagcug

SEQ ID NO: 90792 - DNA, 25 bp, Artificial Sequence
  Synthetic
ggatgaagatcuacattgaccccut

SEQ ID NO: 90793 - DNA, 23 bp, Artificial Sequence
  Synthetic
agaugttuggacaccaggagaac

SEQ ID NO: 90794 - DNA, 22 bp, Artificial Sequence
  Synthetic
ccaaaugacatcaccucccaca

SEQ ID NO: 90795 - DNA, 25 bp, Artificial Sequence
  Synthetic
ccagctcaccutttctccttttuct

SEQ ID NO: 90796 - DNA, 22 bp, Artificial Sequence
  Synthetic
ctggctgcuctgtctttgaauc

SEQ ID NO: 90797 - DNA, 20 bp, Artificial Sequence
  Synthetic
tggctccaucaaacgtgcut

SEQ ID NO: 90798 - DNA, 21 bp, Artificial Sequence
  Synthetic
ccucatcaaacuccccaccaa

SEQ ID NO: 90799 - DNA, 20 bp, Artificial Sequence
  Synthetic
ttgaagguaggcctcuggga

SEQ ID NO: 90800 - DNA, 24 bp, Artificial Sequence
  Synthetic
caaatctagcuacaattgcgccut

SEQ ID NO: 90801 - DNA, 25 bp, Artificial Sequence
  Synthetic
aattcctuggcaaactcaugaacag

SEQ ID NO: 90802 - DNA, 26 bp, Artificial Sequence
  Synthetic
catttccagagacutcagaccaugat

SEQ ID NO: 90803 - DNA, 22 bp, Artificial Sequence
  Synthetic
ttgttcatgugatgtgctgcug

SEQ ID NO: 90804 - DNA, 18 bp, Artificial Sequence
  Synthetic
ggctgaugcgtgagugct

SEQ ID NO: 90805 - DNA, 17 bp, Artificial Sequence
  Synthetic
cgcggucaggccagaug

SEQ ID NO: 90806 - DNA, 20 bp, Artificial Sequence
  Synthetic
cagatgcucgcctccgtuaa

SEQ ID NO: 90807 - DNA, 27 bp, Artificial Sequence
  Synthetic
ctttccguattcatacttuaggaggga

SEQ ID NO: 90808 - DNA, 22 bp, Artificial Sequence
  Synthetic
tgcauggacagccatauacagg

SEQ ID NO: 90809 - DNA, 20 bp, Artificial Sequence
  Synthetic
cctgggugcacagtctugat

SEQ ID NO: 90810 - DNA, 24 bp, Artificial Sequence
  Synthetic
agctgcaataguggttctctctuc

SEQ ID NO: 90811 - DNA, 19 bp, Artificial Sequence
  Synthetic
agcagacagacuccuccgt

SEQ ID NO: 90812 - DNA, 21 bp, Artificial Sequence
  Synthetic
ggtgcagcautggtgaacaut

SEQ ID NO: 90813 - DNA, 26 bp, Artificial Sequence
  Synthetic
gcaaagcaagtutattctggctctua

SEQ ID NO: 90814 - DNA, 27 bp, Artificial Sequence
  Synthetic
tcagcttatuacagccaaactuacaca

SEQ ID NO: 90815 - DNA, 27 bp, Artificial Sequence
  Synthetic
tcaaaactgtauctactcaccacucca

SEQ ID NO: 90816 - DNA, 27 bp, Artificial Sequence
  Synthetic
ggttttctttgugagcacttgauaagt

SEQ ID NO: 90817 - DNA, 28 bp, Artificial Sequence
  Synthetic
tgaggatctucaccattcagctatttut

SEQ ID NO: 90818 - DNA, 24 bp, Artificial Sequence
  Synthetic
tcaacccccaaucaauacaaagca

SEQ ID NO: 90819 - DNA, 27 bp, Artificial Sequence
  Synthetic
gatcagttcagggaauggaaccauaaa

SEQ ID NO: 90820 - DNA, 24 bp, Artificial Sequence
  Synthetic
gcctattccugagatgcugaggat

SEQ ID NO: 90821 - DNA, 24 bp, Artificial Sequence
  Synthetic
gtttcacuaacacatgcccuacct

SEQ ID NO: 90822 - DNA, 23 bp, Artificial Sequence
  Synthetic
gccccgaacuttctctgaactua

SEQ ID NO: 90823 - DNA, 20 bp, Artificial Sequence
  Synthetic
cagggctucagcccatguag

SEQ ID NO: 90824 - DNA, 24 bp, Artificial Sequence
  Synthetic
gccctgauagctcttctgatucct

SEQ ID NO: 90825 - DNA, 28 bp, Artificial Sequence
  Synthetic
gttcaaaactgtauctactcaccacucc

SEQ ID NO: 90826 - DNA, 23 bp, Artificial Sequence
  Synthetic
cctgggttcugaaattgggaugt

SEQ ID NO: 90827 - DNA, 23 bp, Artificial Sequence
  Synthetic
ccagctggaaagutagcttgtug

SEQ ID NO: 90828 - DNA, 22 bp, Artificial Sequence
  Synthetic
ccagaacaaggaggcuguaagg

SEQ ID NO: 90829 - DNA, 24 bp, Artificial Sequence
  Synthetic
acgtaactuaaaacgaccgctuca

SEQ ID NO: 90830 - DNA, 27 bp, Artificial Sequence
  Synthetic
cacatacataugaagacccuacccaag

SEQ ID NO: 90831 - DNA, 27 bp, Artificial Sequence
  Synthetic
ctgagcaatcgugattcacatacagua

SEQ ID NO: 90832 - DNA, 27 bp, Artificial Sequence
  Synthetic
cagtgttttgatcutgtaaatcgccut

SEQ ID NO: 90833 - DNA, 28 bp, Artificial Sequence
  Synthetic
gaagttctaaaaguggaaaccagtctug

SEQ ID NO: 90834 - DNA, 27 bp, Artificial Sequence
  Synthetic
gactttaaaacugcataggccacaauc

SEQ ID NO: 90835 - DNA, 28 bp, Artificial Sequence
  Synthetic
catcagtggttuctacaaattgcttuct

SEQ ID NO: 90836 - DNA, 21 bp, Artificial Sequence
  Synthetic
ccaccauccaggttgcatcua

SEQ ID NO: 90837 - DNA, 28 bp, Artificial Sequence
  Synthetic
cagtggtgcuaggtggatattacaatut

SEQ ID NO: 90838 - DNA, 26 bp, Artificial Sequence
  Synthetic
ctgcaagaaagacucacctcgaaaua

SEQ ID NO: 90839 - DNA, 26 bp, Artificial Sequence
  Synthetic
tctcccugagaaacaagcagaattut

SEQ ID NO: 90840 - DNA, 28 bp, Artificial Sequence
  Synthetic
ttctccagcugagctttaaataacacut

SEQ ID NO: 90841 - DNA, 19 bp, Artificial Sequence
  Synthetic
ctaggaggcagugggctut

SEQ ID NO: 90842 - DNA, 18 bp, Artificial Sequence
  Synthetic
gtggagcccggcauctua

SEQ ID NO: 90843 - DNA, 26 bp, Artificial Sequence
  Synthetic
gtgcgaatguacaagatctcactcut

SEQ ID NO: 90844 - DNA, 26 bp, Artificial Sequence
  Synthetic
tgaaaatgaguacacccatggtucaa

SEQ ID NO: 90845 - DNA, 28 bp, Artificial Sequence
  Synthetic
gcttagttgtucgattatgtccctuaca

SEQ ID NO: 90846 - DNA, 21 bp, Artificial Sequence
  Synthetic
actcatcgtcuggtggagcua

SEQ ID NO: 90847 - DNA, 25 bp, Artificial Sequence
  Synthetic
caaagagttcaucttcaggcaacug

SEQ ID NO: 90848 - DNA, 21 bp, Artificial Sequence
  Synthetic
acuggatuacaggcaccagga

SEQ ID NO: 90849 - DNA, 28 bp, Artificial Sequence
  Synthetic
agcttctttctgcugctatgtctaatut

SEQ ID NO: 90850 - DNA, 21 bp, Artificial Sequence
  Synthetic
ctgtccacagccucttgtcua

SEQ ID NO: 90851 - DNA, 22 bp, Artificial Sequence
  Synthetic
tgttccttccccucagacacut

SEQ ID NO: 90852 - DNA, 23 bp, Artificial Sequence
  Synthetic
ggcgaccaauttcaaagtctucc

SEQ ID NO: 90853 - DNA, 28 bp, Artificial Sequence
  Synthetic
atgcatattgagugaagttggaauacga

SEQ ID NO: 90854 - DNA, 19 bp, Artificial Sequence
  Synthetic
ccaugguggagaacgacca

SEQ ID NO: 90855 - DNA, 23 bp, Artificial Sequence
  Synthetic
gctcactgcuaaccctacaauga

SEQ ID NO: 90856 - DNA, 22 bp, Artificial Sequence
  Synthetic
actgtccaugcatctcugcaat

SEQ ID NO: 90857 - DNA, 21 bp, Artificial Sequence
  Synthetic
ggaagctguccctgtacugga

SEQ ID NO: 90858 - DNA, 21 bp, Artificial Sequence
  Synthetic
ctggatgcucagcttctggut

SEQ ID NO: 90859 - DNA, 21 bp, Artificial Sequence
  Synthetic
guacaaagacgagaggcugct

SEQ ID NO: 90860 - DNA, 20 bp, Artificial Sequence
  Synthetic
ccuccagcuacaagcagcac

SEQ ID NO: 90861 - DNA, 28 bp, Artificial Sequence
  Synthetic
ggaggaggatcuacttgattctagagua

SEQ ID NO: 90862 - DNA, 26 bp, Artificial Sequence
  Synthetic
gtggagcatgutttatttggtagcut

SEQ ID NO: 90863 - DNA, 21 bp, Artificial Sequence
  Synthetic
acatgttccccugagttgucc

SEQ ID NO: 90864 - DNA, 26 bp, Artificial Sequence
  Synthetic
catgtgaatcaguttcctcaagtgut

SEQ ID NO: 90865 - DNA, 26 bp, Artificial Sequence
  Synthetic
cagatcacugaagattctgtgucaga

SEQ ID NO: 90866 - DNA, 28 bp, Artificial Sequence
  Synthetic
caatatctacctcutgtaacaaccccut

SEQ ID NO: 90867 - DNA, 26 bp, Artificial Sequence
  Synthetic
cagtagccauaaaaaccctgaaagut

SEQ ID NO: 90868 - DNA, 24 bp, Artificial Sequence
  Synthetic
catgaacaacccuctttcccacua

SEQ ID NO: 90869 - DNA, 22 bp, Artificial Sequence
  Synthetic
aggaggacucactggagaacug

SEQ ID NO: 90870 - DNA, 22 bp, Artificial Sequence
  Synthetic
ccctcccuaccagactttucct

SEQ ID NO: 90871 - DNA, 20 bp, Artificial Sequence
  Synthetic
cgcagaactugaccgaccuc

SEQ ID NO: 90872 - DNA, 24 bp, Artificial Sequence
  Synthetic
gcactcaccaucctttttcctuac

SEQ ID NO: 90873 - DNA, 21 bp, Artificial Sequence
  Synthetic
aatgaccugggctctgttucc

SEQ ID NO: 90874 - DNA, 23 bp, Artificial Sequence
  Synthetic
cttggaggaaacuggtaugccat

SEQ ID NO: 90875 - DNA, 26 bp, Artificial Sequence
  Synthetic
ggagacaagcagugaaaacagatuca

SEQ ID NO: 90876 - DNA, 22 bp, Artificial Sequence
  Synthetic
cctctcctugcctatccaggua

SEQ ID NO: 90877 - DNA, 22 bp, Artificial Sequence
  Synthetic
ggagcaacaucaccatggucaa

SEQ ID NO: 90878 - DNA, 19 bp, Artificial Sequence
  Synthetic
agtcgcucacgtucaccag

SEQ ID NO: 90879 - DNA, 21 bp, Artificial Sequence
  Synthetic
cacaaccccuaagtccagcut

SEQ ID NO: 90880 - DNA, 23 bp, Artificial Sequence
  Synthetic
ggttctcuccagcaguagaggaa

SEQ ID NO: 90881 - DNA, 25 bp, Artificial Sequence
  Synthetic
ccaaaaacguacattcttgctguga

SEQ ID NO: 90882 - DNA, 20 bp, Artificial Sequence
  Synthetic
ggcucagcgccatcaaaaug

SEQ ID NO: 90883 - DNA, 22 bp, Artificial Sequence
  Synthetic
accauctgcaauagcagggaag

SEQ ID NO: 90884 - DNA, 23 bp, Artificial Sequence
  Synthetic
ctcttcugcagctccttguagag

SEQ ID NO: 90885 - DNA, 27 bp, Artificial Sequence
  Synthetic
tcatcttttccagcucttttatgccut

SEQ ID NO: 90886 - DNA, 18 bp, Artificial Sequence
  Synthetic
ggugaaggtccugagcga

SEQ ID NO: 90887 - DNA, 28 bp, Artificial Sequence
  Synthetic
ggcttcgatcauatggaactacaugaat

SEQ ID NO: 90888 - DNA, 29 bp, Artificial Sequence
  Synthetic
aatactgaaaagaaauccaacagaccuca

SEQ ID NO: 90889 - DNA, 24 bp, Artificial Sequence
  Synthetic
gacaaaugccctgtatuggaaagg

SEQ ID NO: 90890 - DNA, 25 bp, Artificial Sequence
  Synthetic
tgatgcattgugtattctcctucgt

SEQ ID NO: 90891 - DNA, 19 bp, Artificial Sequence
  Synthetic
gcaaacgcaccccucacut

SEQ ID NO: 90892 - DNA, 28 bp, Artificial Sequence
  Synthetic
agtctctcctutgtttttctgtguaacc

SEQ ID NO: 90893 - DNA, 23 bp, Artificial Sequence
  Synthetic
tgcctgctugttctgttactuca

SEQ ID NO: 90894 - DNA, 22 bp, Artificial Sequence
  Synthetic
caaccttcuctgagccauccaa

SEQ ID NO: 90895 - DNA, 27 bp, Artificial Sequence
  Synthetic
gtaatgtctttutgcatagctcugcat

SEQ ID NO: 90896 - DNA, 25 bp, Artificial Sequence
  Synthetic
cttgtgcttttuggaggagtcttug

SEQ ID NO: 90897 - DNA, 23 bp, Artificial Sequence
  Synthetic
ctgggatcugctatttccuggag

SEQ ID NO: 90898 - DNA, 27 bp, Artificial Sequence
  Synthetic
ctattccagaaugtcaagaagtugcag

SEQ ID NO: 90899 - DNA, 28 bp, Artificial Sequence
  Synthetic
ccttttctagctutcttacgtagaguca

SEQ ID NO: 90900 - DNA, 19 bp, Artificial Sequence
  Synthetic
acgcutgctguccccaaaa

SEQ ID NO: 90901 - DNA, 20 bp, Artificial Sequence
  Synthetic
acctccccutcctgttguca

SEQ ID NO: 90902 - DNA, 22 bp, Artificial Sequence
  Synthetic
accatcgaccuccgatacauga

SEQ ID NO: 90903 - DNA, 22 bp, Artificial Sequence
  Synthetic
gtgccaaucagaggcttctuct

SEQ ID NO: 90904 - DNA, 23 bp, Artificial Sequence
  Synthetic
cgaataccttcuggagtgcccua

SEQ ID NO: 90905 - DNA, 28 bp, Artificial Sequence
  Synthetic
ctcatcattuagaaagaaagctgugcaa

SEQ ID NO: 90906 - DNA, 23 bp, Artificial Sequence
  Synthetic
actgggcuaatctggagugaagt

SEQ ID NO: 90907 - DNA, 29 bp, Artificial Sequence
  Synthetic
tgaacatagaauctaggaatgaugcacaa

SEQ ID NO: 90908 - DNA, 20 bp, Artificial Sequence
  Synthetic
ggaggtcugaggctggacut

SEQ ID NO: 90909 - DNA, 18 bp, Artificial Sequence
  Synthetic
gggccacacucaccttug

SEQ ID NO: 90910 - DNA, 22 bp, Artificial Sequence
  Synthetic
cacutccagcugaaggaaaacc

SEQ ID NO: 90911 - DNA, 28 bp, Artificial Sequence
  Synthetic
gattgtcctuatcattctcaucgacaca

SEQ ID NO: 90912 - DNA, 25 bp, Artificial Sequence
  Synthetic
tctagaagugcagaggagtcatuga

SEQ ID NO: 90913 - DNA, 20 bp, Artificial Sequence
  Synthetic
gcgggatucaaaggagccut

SEQ ID NO: 90914 - DNA, 18 bp, Artificial Sequence
  Synthetic
ctcugccacgcugagagt

SEQ ID NO: 90915 - DNA, 19 bp, Artificial Sequence
  Synthetic
cgacaggauctgctgcauc

SEQ ID NO: 90916 - DNA, 23 bp, Artificial Sequence
  Synthetic
tcactgtcucttccctuccacat

SEQ ID NO: 90917 - DNA, 22 bp, Artificial Sequence
  Synthetic
ccagtagugggaaagagggtug

SEQ ID NO: 90918 - DNA, 20 bp, Artificial Sequence
  Synthetic
cgutagggugcagagccaaa

SEQ ID NO: 90919 - DNA, 18 bp, Artificial Sequence
  Synthetic
ccucactgcuccgaggac

SEQ ID NO: 90920 - DNA, 19 bp, Artificial Sequence
  Synthetic
gacctgugggactcugcac

SEQ ID NO: 90921 - DNA, 19 bp, Artificial Sequence
  Synthetic
gcagtgccutgccctttut

SEQ ID NO: 90922 - DNA, 19 bp, Artificial Sequence
  Synthetic
agaugctuaccccgcaaca

SEQ ID NO: 90923 - DNA, 22 bp, Artificial Sequence
  Synthetic
gcccttggugaggtguaaacag

SEQ ID NO: 90924 - DNA, 21 bp, Artificial Sequence
  Synthetic
catcgggagggutacaggtut

SEQ ID NO: 90925 - DNA, 28 bp, Artificial Sequence
  Synthetic
gcttggaaaacagaauttcagctgauat

SEQ ID NO: 90926 - DNA, 19 bp, Artificial Sequence
  Synthetic
gaaaccugcgggagtucct

SEQ ID NO: 90927 - DNA, 21 bp, Artificial Sequence
  Synthetic
cttccgggacuccagatacug

SEQ ID NO: 90928 - DNA, 20 bp, Artificial Sequence
  Synthetic
tctcctucccagtcctgguc

SEQ ID NO: 90929 - DNA, 21 bp, Artificial Sequence
  Synthetic
agagggagaagucgggacaut

SEQ ID NO: 90930 - DNA, 22 bp, Artificial Sequence
  Synthetic
acaaacacaugcacacugcaaa

SEQ ID NO: 90931 - DNA, 28 bp, Artificial Sequence
  Synthetic
tgaaactactagguaaaggcactttugg

SEQ ID NO: 90932 - DNA, 24 bp, Artificial Sequence
  Synthetic
gagcaacauagtaaggcugaggaa

SEQ ID NO: 90933 - DNA, 25 bp, Artificial Sequence
  Synthetic
tttttatcaatggugcactggtugg

SEQ ID NO: 90934 - DNA, 27 bp, Artificial Sequence
  Synthetic
gccttctcucgaaccaaaataacttuc

SEQ ID NO: 90935 - DNA, 28 bp, Artificial Sequence
  Synthetic
ggttttgagtggauattgcaaacacaua

SEQ ID NO: 90936 - DNA, 29 bp, Artificial Sequence
  Synthetic
tttggttctatcaagutccatgttacugt

SEQ ID NO: 90937 - DNA, 22 bp, Artificial Sequence
  Synthetic
cacacgtaccuggtctgtaucc

SEQ ID NO: 90938 - DNA, 23 bp, Artificial Sequence
  Synthetic
tggtagcugggaauacagaccat

SEQ ID NO: 90939 - DNA, 23 bp, Artificial Sequence
  Synthetic
gggtaaaggautgtgctcacgua

SEQ ID NO: 90940 - DNA, 27 bp, Artificial Sequence
  Synthetic
gaagacaggcaaagutcttacatcuct

SEQ ID NO: 90941 - DNA, 26 bp, Artificial Sequence
  Synthetic
ggaaccattcuccatgtattctguga

SEQ ID NO: 90942 - DNA, 27 bp, Artificial Sequence
  Synthetic
ctaggtaagccagutatgattgucaca

SEQ ID NO: 90943 - DNA, 29 bp, Artificial Sequence
  Synthetic
agggtgtctctaaugttttcagcaattua

SEQ ID NO: 90944 - DNA, 20 bp, Artificial Sequence
  Synthetic
ccucaggccagctgttucat

SEQ ID NO: 90945 - DNA, 21 bp, Artificial Sequence
  Synthetic
tctagcaccccuccatctucc

SEQ ID NO: 90946 - DNA, 18 bp, Artificial Sequence
  Synthetic
cctcgcugtgctggugac

SEQ ID NO: 90947 - DNA, 19 bp, Artificial Sequence
  Synthetic
gggagucgctgtacaucct

SEQ ID NO: 90948 - DNA, 17 bp, Artificial Sequence
  Synthetic
acaggcgucctcuccct

SEQ ID NO: 90949 - DNA, 18 bp, Artificial Sequence
  Synthetic
cgtuccccgcaggatcuc

SEQ ID NO: 90950 - DNA, 20 bp, Artificial Sequence
  Synthetic
gtaugcccggacaccaugaa

SEQ ID NO: 90951 - DNA, 22 bp, Artificial Sequence
  Synthetic
caggtagguatggtcagauggg

SEQ ID NO: 90952 - DNA, 28 bp, Artificial Sequence
  Synthetic
gcaacacacacaaaauagttactuacca

SEQ ID NO: 90953 - DNA, 23 bp, Artificial Sequence
  Synthetic
gcaaucatctaaagugcagccaa

SEQ ID NO: 90954 - DNA, 24 bp, Artificial Sequence
  Synthetic
ggagaagautgcugagacgaagac

SEQ ID NO: 90955 - DNA, 19 bp, Artificial Sequence
  Synthetic
cctcctcugtcgccaacut

SEQ ID NO: 90956 - DNA, 23 bp, Artificial Sequence
  Synthetic
catcccucatgccauacagacat

SEQ ID NO: 90957 - DNA, 21 bp, Artificial Sequence
  Synthetic
ttccagaaacugggagcctug

SEQ ID NO: 90958 - DNA, 21 bp, Artificial Sequence
  Synthetic
ccugtcccatucagacaacga

SEQ ID NO: 90959 - DNA, 25 bp, Artificial Sequence
  Synthetic
acacccattgucaatgcaacauagt

SEQ ID NO: 90960 - DNA, 17 bp, Artificial Sequence
  Synthetic
ccccaaggcucccagut

SEQ ID NO: 90961 - DNA, 28 bp, Artificial Sequence
  Synthetic
actgttgcuggacttagaaagtuaaagt

SEQ ID NO: 90962 - DNA, 24 bp, Artificial Sequence
  Synthetic
tgacggattaucaagaatgcgugt

SEQ ID NO: 90963 - DNA, 27 bp, Artificial Sequence
  Synthetic
gcaccatctccauccacaatagtauat

SEQ ID NO: 90964 - DNA, 26 bp, Artificial Sequence
  Synthetic
cagaactaaaaatugccatcctgcut

SEQ ID NO: 90965 - DNA, 28 bp, Artificial Sequence
  Synthetic
cctcatgaautccagtguaaaaacaaca

SEQ ID NO: 90966 - DNA, 25 bp, Artificial Sequence
  Synthetic
tgatgatctctcugaggcaaagcua

SEQ ID NO: 90967 - DNA, 29 bp, Artificial Sequence
  Synthetic
cgtgtgaatauaaagattggcugacaaaa

SEQ ID NO: 90968 - DNA, 20 bp, Artificial Sequence
  Synthetic
cctgccccucttggacctua

SEQ ID NO: 90969 - DNA, 23 bp, Artificial Sequence
  Synthetic
caagtcctuggagacctacugac

SEQ ID NO: 90970 - DNA, 21 bp, Artificial Sequence
  Synthetic
gctgcaaagaauccctucacc

SEQ ID NO: 90971 - DNA, 21 bp, Artificial Sequence
  Synthetic
tcttcctcuccgcccttttuc

SEQ ID NO: 90972 - DNA, 25 bp, Artificial Sequence
  Synthetic
ctccaacaucatgttttccugacat

SEQ ID NO: 90973 - DNA, 26 bp, Artificial Sequence
  Synthetic
cttggtgatcuttgcctttgaaauca

SEQ ID NO: 90974 - DNA, 21 bp, Artificial Sequence
  Synthetic
gtgcttgugctgctcacauac

SEQ ID NO: 90975 - DNA, 21 bp, Artificial Sequence
  Synthetic
aggctguagcaaccactgtuc

SEQ ID NO: 90976 - DNA, 27 bp, Artificial Sequence
  Synthetic
cactataaaatcaggutgacctgggua

SEQ ID NO: 90977 - DNA, 24 bp, Artificial Sequence
  Synthetic
agacgauacagcagactcucaaga

SEQ ID NO: 90978 - DNA, 28 bp, Artificial Sequence
  Synthetic
caaaagaaaacuccaagacccaauacag

SEQ ID NO: 90979 - DNA, 20 bp, Artificial Sequence
  Synthetic
ggagagaugcggaaccagua

SEQ ID NO: 90980 - DNA, 25 bp, Artificial Sequence
  Synthetic
cataacgacuatatgtguccagcca

SEQ ID NO: 90981 - DNA, 21 bp, Artificial Sequence
  Synthetic
ccccugggagagatgtaccua

SEQ ID NO: 90982 - DNA, 25 bp, Artificial Sequence
  Synthetic
actgaguttcccattuaagcaccat

SEQ ID NO: 90983 - DNA, 29 bp, Artificial Sequence
  Synthetic
gcctcaaataatgugggagaaataagugt

SEQ ID NO: 90984 - DNA, 21 bp, Artificial Sequence
  Synthetic
gccagtgaucgggaauacagt

SEQ ID NO: 90985 - DNA, 25 bp, Artificial Sequence
  Synthetic
gttgtgagggaugtcttcauggaaa

SEQ ID NO: 90986 - DNA, 25 bp, Artificial Sequence
  Synthetic
gacaautcctctuccaggaacaaca

SEQ ID NO: 90987 - DNA, 28 bp, Artificial Sequence
  Synthetic
tgtagtatcctggcuaattgtaggctua

SEQ ID NO: 90988 - DNA, 28 bp, Artificial Sequence
  Synthetic
acttgatgttcauaatactgcagtgucc

SEQ ID NO: 90989 - DNA, 23 bp, Artificial Sequence
  Synthetic
tgtctgccuacgatacucacagt

SEQ ID NO: 90990 - DNA, 24 bp, Artificial Sequence
  Synthetic
tgaaggcaucaatgcagagaugaa

SEQ ID NO: 90991 - DNA, 24 bp, Artificial Sequence
  Synthetic
agcacccaugaaagtggttuagaa

SEQ ID NO: 90992 - DNA, 20 bp, Artificial Sequence
  Synthetic
ggctgcgccaugaatacugt

SEQ ID NO: 90993 - DNA, 26 bp, Artificial Sequence
  Synthetic
cagagtcgauatcttgaugcaggaat

SEQ ID NO: 90994 - DNA, 24 bp, Artificial Sequence
  Synthetic
ggtagctgcuggcaaatgtttuat

SEQ ID NO: 90995 - DNA, 24 bp, Artificial Sequence
  Synthetic
catctgtctacucagcagcagtua

SEQ ID NO: 90996 - DNA, 23 bp, Artificial Sequence
  Synthetic
gcaaaactgugagtctgguggat

SEQ ID NO: 90997 - DNA, 28 bp, Artificial Sequence
  Synthetic
cctgtgacagcuattgtttcctctaaua

SEQ ID NO: 90998 - DNA, 21 bp, Artificial Sequence
  Synthetic
cagcgacaaguccgagtttug

SEQ ID NO: 90999 - DNA, 26 bp, Artificial Sequence
  Synthetic
acttgaattucacgcatgctgtttut

SEQ ID NO: 91000 - DNA, 28 bp, Artificial Sequence
  Synthetic
aatttgttagutcatgcauccaagcaaa

SEQ ID NO: 91001 - DNA, 27 bp, Artificial Sequence
  Synthetic
cctcccaaccutcttattctcaaucag

SEQ ID NO: 91002 - DNA, 20 bp, Artificial Sequence
  Synthetic
accccugacagtctccaugt

SEQ ID NO: 91003 - DNA, 20 bp, Artificial Sequence
  Synthetic
acaactcgcugcaggatguc

SEQ ID NO: 91004 - DNA, 25 bp, Artificial Sequence
  Synthetic
actctauacaaccaggtagccucaa

SEQ ID NO: 91005 - DNA, 21 bp, Artificial Sequence
  Synthetic
ctcactgugtgttcugccaac

SEQ ID NO: 91006 - DNA, 24 bp, Artificial Sequence
  Synthetic
aaatgcaatgtuttgtggtcctut

SEQ ID NO: 91007 - DNA, 25 bp, Artificial Sequence
  Synthetic
gccaaattugttgagaagauccact

SEQ ID NO: 91008 - DNA, 22 bp, Artificial Sequence
  Synthetic
ggcaaagagccagucaaagcua

SEQ ID NO: 91009 - DNA, 26 bp, Artificial Sequence
  Synthetic
acaaattttcugctcgaaaugaccag

SEQ ID NO: 91010 - DNA, 20 bp, Artificial Sequence
  Synthetic
gaccagutcttugcggagac

SEQ ID NO: 91011 - DNA, 21 bp, Artificial Sequence
  Synthetic
gctgcttggguagagaaggut

SEQ ID NO: 91012 - DNA, 26 bp, Artificial Sequence
  Synthetic
tcattaattgugttacagggtuggct

SEQ ID NO: 91013 - DNA, 26 bp, Artificial Sequence
  Synthetic
tctacggtgcacuaaccattgattut

SEQ ID NO: 91014 - DNA, 22 bp, Artificial Sequence
  Synthetic
cattagacccgucgcataucca

SEQ ID NO: 91015 - DNA, 27 bp, Artificial Sequence
  Synthetic
ccttcttctagauaacacagacugcac

SEQ ID NO: 91016 - DNA, 24 bp, Artificial Sequence
  Synthetic
catgaccaaccutctcaguaacga

SEQ ID NO: 91017 - DNA, 22 bp, Artificial Sequence
  Synthetic
aagcuacagacauggaaggcaa

SEQ ID NO: 91018 - DNA, 27 bp, Artificial Sequence
  Synthetic
actccaagcutatagaaatgtgugcag

SEQ ID NO: 91019 - DNA, 26 bp, Artificial Sequence
  Synthetic
ccctgttgtgugggataattacguat

SEQ ID NO: 91020 - DNA, 25 bp, Artificial Sequence
  Synthetic
ccacaaauccccaaataaccacaut

SEQ ID NO: 91021 - DNA, 27 bp, Artificial Sequence
  Synthetic
gcautatggtggattuacaaacaagca

SEQ ID NO: 91022 - DNA, 20 bp, Artificial Sequence
  Synthetic
gtttacucagggccccucaa

SEQ ID NO: 91023 - DNA, 21 bp, Artificial Sequence
  Synthetic
gaccggccuctcagttctuag

SEQ ID NO: 91024 - DNA, 23 bp, Artificial Sequence
  Synthetic
gggtttggauaatctgggcucat

SEQ ID NO: 91025 - DNA, 24 bp, Artificial Sequence
  Synthetic
ggagccaugaaactaggttaccut

SEQ ID NO: 91026 - DNA, 29 bp, Artificial Sequence
  Synthetic
aattcctucaaaacacattctacugacct

SEQ ID NO: 91027 - DNA, 27 bp, Artificial Sequence
  Synthetic
tgctccaaucaaaactgaaaatgctut

SEQ ID NO: 91028 - DNA, 23 bp, Artificial Sequence
  Synthetic
tgttugaaaggccatatguggga

SEQ ID NO: 91029 - DNA, 28 bp, Artificial Sequence
  Synthetic
cttgcattauaaagagccgttuacagaa

SEQ ID NO: 91030 - DNA, 21 bp, Artificial Sequence
  Synthetic
gcaaccgguccaaggtattug

SEQ ID NO: 91031 - DNA, 24 bp, Artificial Sequence
  Synthetic
gcacattcttucccatttgccaut

SEQ ID NO: 91032 - DNA, 22 bp, Artificial Sequence
  Synthetic
ccaaaagaccugcaucacaagt

SEQ ID NO: 91033 - DNA, 24 bp, Artificial Sequence
  Synthetic
ggcaucttcacauccaagacagat

SEQ ID NO: 91034 - DNA, 28 bp, Artificial Sequence
  Synthetic
gaagacatatucttgaccacttuggagt

SEQ ID NO: 91035 - DNA, 24 bp, Artificial Sequence
  Synthetic
ggagauatcuaggaagcgcagaag

SEQ ID NO: 91036 - DNA, 23 bp, Artificial Sequence
  Synthetic
ccaagatggguattggaggaugg

SEQ ID NO: 91037 - DNA, 26 bp, Artificial Sequence
  Synthetic
cctgcttccucacctaaaacatctut

SEQ ID NO: 91038 - DNA, 25 bp, Artificial Sequence
  Synthetic
ctctatacuccgagggttgtcaaug

SEQ ID NO: 91039 - DNA, 23 bp, Artificial Sequence
  Synthetic
catacagcucccaagacccuaga

SEQ ID NO: 91040 - DNA, 21 bp, Artificial Sequence
  Synthetic
ggaagggugttaucaccagga

SEQ ID NO: 91041 - DNA, 25 bp, Artificial Sequence
  Synthetic
ccttggtggugaacaactcatcaut

SEQ ID NO: 91042 - DNA, 26 bp, Artificial Sequence
  Synthetic
attcaacttctcucccataacggaug

SEQ ID NO: 91043 - DNA, 26 bp, Artificial Sequence
  Synthetic
ttgggttgtucccagttctgaatuaa

SEQ ID NO: 91044 - DNA, 21 bp, Artificial Sequence
  Synthetic
tgcggtaauaactggcccuac

SEQ ID NO: 91045 - DNA, 22 bp, Artificial Sequence
  Synthetic
gactttgggauggcacgagaua

SEQ ID NO: 91046 - DNA, 25 bp, Artificial Sequence
  Synthetic
gagtttgctaautttcctccccuca

SEQ ID NO: 91047 - DNA, 26 bp, Artificial Sequence
  Synthetic
cctgttgcaatguctagtgctgtaua

SEQ ID NO: 91048 - DNA, 27 bp, Artificial Sequence
  Synthetic
aatggagtaagucactgtggaattuga

SEQ ID NO: 91049 - DNA, 27 bp, Artificial Sequence
  Synthetic
gctcagacuattacaauaacaccacct

SEQ ID NO: 91050 - DNA, 21 bp, Artificial Sequence
  Synthetic
cacagggcaucaggtactgut

SEQ ID NO: 91051 - DNA, 24 bp, Artificial Sequence
  Synthetic
gcgaagttgccaucgaagaagaua

SEQ ID NO: 91052 - DNA, 19 bp, Artificial Sequence
  Synthetic
cacccgucuccgaaaacga

SEQ ID NO: 91053 - DNA, 26 bp, Artificial Sequence
  Synthetic
agatggtcctucctatatgtctuccc

SEQ ID NO: 91054 - DNA, 24 bp, Artificial Sequence
  Synthetic
gggtactguctgccaaataugaca

SEQ ID NO: 91055 - DNA, 27 bp, Artificial Sequence
  Synthetic
tcactggcttgaugaaaaccttagaut

SEQ ID NO: 91056 - DNA, 25 bp, Artificial Sequence
  Synthetic
cataccccgutgatuaaaacaagcc

SEQ ID NO: 91057 - DNA, 28 bp, Artificial Sequence
  Synthetic
gtatgagtgaaguttttggagggaatut

SEQ ID NO: 91058 - DNA, 27 bp, Artificial Sequence
  Synthetic
caacccauacattaagaaacaugcact

SEQ ID NO: 91059 - DNA, 25 bp, Artificial Sequence
  Synthetic
caaattgcagtcugtacaggcttua

SEQ ID NO: 91060 - DNA, 26 bp, Artificial Sequence
  Synthetic
gtttctucccctagaatugagcacat

SEQ ID NO: 91061 - DNA, 28 bp, Artificial Sequence
  Synthetic
ctgctaaaggcutcaaaggtgaatuaaa

SEQ ID NO: 91062 - DNA, 28 bp, Artificial Sequence
  Synthetic
tctagtttguggcagttttaagcaaaug

SEQ ID NO: 91063 - DNA, 28 bp, Artificial Sequence
  Synthetic
tccacactuccacagatgttgatttuat

SEQ ID NO: 91064 - DNA, 26 bp, Artificial Sequence
  Synthetic
aagctgatgaacucctgaatttcugt

SEQ ID NO: 91065 - DNA, 28 bp, Artificial Sequence
  Synthetic
cacagcttgautgatttataacauggca

SEQ ID NO: 91066 - DNA, 28 bp, Artificial Sequence
  Synthetic
acctggauacatccaaauaaaagcacaa

SEQ ID NO: 91067 - DNA, 27 bp, Artificial Sequence
  Synthetic
agagtagtacaaaugcttggatctcua

SEQ ID NO: 91068 - DNA, 23 bp, Artificial Sequence
  Synthetic
ttgtccucctagagauccaagca

SEQ ID NO: 91069 - DNA, 22 bp, Artificial Sequence
  Synthetic
caagtggguggcaaagagttut

SEQ ID NO: 91070 - DNA, 24 bp, Artificial Sequence
  Synthetic
aacacaaccacauctauggaagca

SEQ ID NO: 91071 - DNA, 28 bp, Artificial Sequence
  Synthetic
gggtgaagttcaucctagtgagatgaua

SEQ ID NO: 91072 - DNA, 20 bp, Artificial Sequence
  Synthetic
acatgggcuttgcccgatua

SEQ ID NO: 91073 - DNA, 26 bp, Artificial Sequence
  Synthetic
caatagcttuggtataatgcctugct

SEQ ID NO: 91074 - DNA, 21 bp, Artificial Sequence
  Synthetic
ctccttgagutccacccucat

SEQ ID NO: 91075 - DNA, 25 bp, Artificial Sequence
  Synthetic
gaggttgtctgucaagaagaactug

SEQ ID NO: 91076 - DNA, 24 bp, Artificial Sequence
  Synthetic
gcggaacaggutttctgcattaut

SEQ ID NO: 91077 - DNA, 25 bp, Artificial Sequence
  Synthetic
gtagtttgaggccutcacttgtcua

SEQ ID NO: 91078 - DNA, 28 bp, Artificial Sequence
  Synthetic
gggaagctgtugataccaaaaataaugt

SEQ ID NO: 91079 - DNA, 27 bp, Artificial Sequence
  Synthetic
ttgccaatccaguaatttcaggtagut

SEQ ID NO: 91080 - DNA, 28 bp, Artificial Sequence
  Synthetic
tgagtttttcaagugtggtttctucaac

SEQ ID NO: 91081 - DNA, 25 bp, Artificial Sequence
  Synthetic
agagtgagaaacucatagcatugcc

SEQ ID NO: 91082 - DNA, 21 bp, Artificial Sequence
  Synthetic
tcagaccauttgggcaaugct

SEQ ID NO: 91083 - DNA, 28 bp, Artificial Sequence
  Synthetic
tcatttttggctucattctttgcttcut

SEQ ID NO: 91084 - DNA, 17 bp, Artificial Sequence
  Synthetic
ccgagcggutcuccagt

SEQ ID NO: 91085 - DNA, 17 bp, Artificial Sequence
  Synthetic
gggcgcutccuggaaca

SEQ ID NO: 91086 - DNA, 23 bp, Artificial Sequence
  Synthetic
gcatgcuctttctcuaggcagaa

SEQ ID NO: 91087 - DNA, 19 bp, Artificial Sequence
  Synthetic
ggccagggutgcttccuac

SEQ ID NO: 91088 - DNA, 25 bp, Artificial Sequence
  Synthetic
ggcaatgctaugagtttctcacuct

SEQ ID NO: 91089 - DNA, 27 bp, Artificial Sequence
  Synthetic
attgaaagagcaucatttttggctuca

SEQ ID NO: 91090 - DNA, 27 bp, Artificial Sequence
  Synthetic
aagccaaaaatgaugctctttcaauga

SEQ ID NO: 91091 - DNA, 31 bp, Artificial Sequence
  Synthetic
tcggcattaacaautatttcaagagguaagt

SEQ ID NO: 91092 - DNA, 26 bp, Artificial Sequence
  Synthetic
tttcatatgguaggcactcagttguc

SEQ ID NO: 91093 - DNA, 28 bp, Artificial Sequence
  Synthetic
gcacctgtugtaatgtcaacauagaaaa

SEQ ID NO: 91094 - DNA, 20 bp, Artificial Sequence
  Synthetic
guatccacucccggcaagat

SEQ ID NO: 91095 - DNA, 21 bp, Artificial Sequence
  Synthetic
ggctctgaaagucgcatcuca

SEQ ID NO: 91096 - DNA, 22 bp, Artificial Sequence
  Synthetic
gggctgagucctgctctaatuc

SEQ ID NO: 91097 - DNA, 22 bp, Artificial Sequence
  Synthetic
gcaccuagaatccttcugccat

SEQ ID NO: 91098 - DNA, 18 bp, Artificial Sequence
  Synthetic
gcguccagaccggaagut

SEQ ID NO: 91099 - DNA, 19 bp, Artificial Sequence
  Synthetic
cgtcggaagguaccccauc

SEQ ID NO: 91100 - DNA, 19 bp, Artificial Sequence
  Synthetic
cucccagagcctuccacag

SEQ ID NO: 91101 - DNA, 22 bp, Artificial Sequence
  Synthetic
cacgagaccauctgggaaugag

SEQ ID NO: 91102 - DNA, 22 bp, Artificial Sequence
  Synthetic
gctccucctcattcuccaaggt

SEQ ID NO: 91103 - DNA, 22 bp, Artificial Sequence
  Synthetic
gaacttgucactgcttcuccga

SEQ ID NO: 91104 - DNA, 20 bp, Artificial Sequence
  Synthetic
cccctgcgcugtaatgagut

SEQ ID NO: 91105 - DNA, 21 bp, Artificial Sequence
  Synthetic
caccugagaacaggcagaguc

SEQ ID NO: 91106 - DNA, 17 bp, Artificial Sequence
  Synthetic
ctgccuccctgcauggt

SEQ ID NO: 91107 - DNA, 22 bp, Artificial Sequence
  Synthetic
gagacaggcagaggaugaggua

SEQ ID NO: 91108 - DNA, 21 bp, Artificial Sequence
  Synthetic
aagatggccuccagctcttug

SEQ ID NO: 91109 - DNA, 19 bp, Artificial Sequence
  Synthetic
tctgggcuctttccuccct

SEQ ID NO: 91110 - DNA, 21 bp, Artificial Sequence
  Synthetic
gaagcagugacccuggaagat

SEQ ID NO: 91111 - DNA, 26 bp, Artificial Sequence
  Synthetic
ggagaccaacutactgtgctactuac

SEQ ID NO: 91112 - DNA, 20 bp, Artificial Sequence
  Synthetic
gcacguacccggaaaacgua

SEQ ID NO: 91113 - DNA, 18 bp, Artificial Sequence
  Synthetic
ggagagccagcucgtcug

SEQ ID NO: 91114 - DNA, 20 bp, Artificial Sequence
  Synthetic
ctctucaacggcucgagact

SEQ ID NO: 91115 - DNA, 17 bp, Artificial Sequence
  Synthetic
agcgugctttccucggt

SEQ ID NO: 91116 - DNA, 21 bp, Artificial Sequence
  Synthetic
ccacgttcccuctcctcaaug

SEQ ID NO: 91117 - DNA, 22 bp, Artificial Sequence
  Synthetic
ggaacautctgctgucggaaag

SEQ ID NO: 91118 - DNA, 23 bp, Artificial Sequence
  Synthetic
ccaaagucacagatctucaccac

SEQ ID NO: 91119 - DNA, 21 bp, Artificial Sequence
  Synthetic
ggagtttcgggugtgggtaut

SEQ ID NO: 91120 - DNA, 21 bp, Artificial Sequence
  Synthetic
gcccuactaccuggagaacga

SEQ ID NO: 91121 - DNA, 17 bp, Artificial Sequence
  Synthetic
gctcccgcagcucccua

SEQ ID NO: 91122 - DNA, 27 bp, Artificial Sequence
  Synthetic
tcatttgttuaaggaccgtgauacaca

SEQ ID NO: 91123 - DNA, 26 bp, Artificial Sequence
  Synthetic
gcgctucaccaaacaaactacaaaut

SEQ ID NO: 91124 - DNA, 25 bp, Artificial Sequence
  Synthetic
ttcccgcacugaaacaaatuagaga

SEQ ID NO: 91125 - DNA, 28 bp, Artificial Sequence
  Synthetic
ccagccaataugctgtttcttttcaaua

SEQ ID NO: 91126 - DNA, 21 bp, Artificial Sequence
  Synthetic
ggtttgaaugcgcccctttut

SEQ ID NO: 91127 - DNA, 27 bp, Artificial Sequence
  Synthetic
actggaaatgcaucatatcgctctuac

SEQ ID NO: 91128 - DNA, 27 bp, Artificial Sequence
  Synthetic
tgattagaucctatcctuccccaaaca

SEQ ID NO: 91129 - DNA, 26 bp, Artificial Sequence
  Synthetic
ctaaatgtaaaautccagcccuggac

SEQ ID NO: 91130 - DNA, 24 bp, Artificial Sequence
  Synthetic
tgcccaaaccacutattctgtuct

SEQ ID NO: 91131 - DNA, 24 bp, Artificial Sequence
  Synthetic
acttgtcaccgutgacatacauga

SEQ ID NO: 91132 - DNA, 19 bp, Artificial Sequence
  Synthetic
agaagguccagggcuggaa

SEQ ID NO: 91133 - DNA, 27 bp, Artificial Sequence
  Synthetic
gagaagtagttucaggtattgcugagt

SEQ ID NO: 91134 - DNA, 29 bp, Artificial Sequence
  Synthetic
ctttcctcatcaugtaaatttcctugcat

SEQ ID NO: 91135 - DNA, 21 bp, Artificial Sequence
  Synthetic
ctcagccucagagcctgtuac

SEQ ID NO: 91136 - DNA, 21 bp, Artificial Sequence
  Synthetic
cggcgaauggatcttugagca

SEQ ID NO: 91137 - DNA, 24 bp, Artificial Sequence
  Synthetic
acatctcatugctggtcugaacac

SEQ ID NO: 91138 - DNA, 21 bp, Artificial Sequence
  Synthetic
atgcctggcaucagagtcauc

SEQ ID NO: 91139 - DNA, 22 bp, Artificial Sequence
  Synthetic
gtaacaggagucagcagacugt

SEQ ID NO: 91140 - DNA, 26 bp, Artificial Sequence
  Synthetic
cactataagcaauggcaacagtgtuc

SEQ ID NO: 91141 - DNA, 24 bp, Artificial Sequence
  Synthetic
gatgtcattgcuatgctgctuacc

SEQ ID NO: 91142 - DNA, 27 bp, Artificial Sequence
  Synthetic
tgcttcacaaguactacctgttttuga

SEQ ID NO: 91143 - DNA, 27 bp, Artificial Sequence
  Synthetic
tctacagccaguatagacagugagaac

SEQ ID NO: 91144 - DNA, 28 bp, Artificial Sequence
  Synthetic
acctgataaaatggutcactccagatut

SEQ ID NO: 91145 - DNA, 24 bp, Artificial Sequence
  Synthetic
ccgagaaggauttttgggaactug

SEQ ID NO: 91146 - DNA, 21 bp, Artificial Sequence
  Synthetic
gagatagcgccuaccatuccc

SEQ ID NO: 91147 - DNA, 27 bp, Artificial Sequence
  Synthetic
gaaaaatugaggaaagcccuaggaaga

SEQ ID NO: 91148 - DNA, 18 bp, Artificial Sequence
  Synthetic
ggagcagccuggcagtua

SEQ ID NO: 91149 - DNA, 18 bp, Artificial Sequence
  Synthetic
gugaaggguggcgaggac

SEQ ID NO: 91150 - DNA, 24 bp, Artificial Sequence
  Synthetic
ggtggttguaacagtcaagggaug

SEQ ID NO: 91151 - DNA, 28 bp, Artificial Sequence
  Synthetic
cgtgttctcautggtattcttuccaact

SEQ ID NO: 91152 - DNA, 24 bp, Artificial Sequence
  Synthetic
gatcccautcatgaccuggaagag

SEQ ID NO: 91153 - DNA, 28 bp, Artificial Sequence
  Synthetic
ccctgagaugacattctgattttugaag

SEQ ID NO: 91154 - DNA, 28 bp, Artificial Sequence
  Synthetic
ggcacacauagagaaattagtagucagt

SEQ ID NO: 91155 - DNA, 24 bp, Artificial Sequence
  Synthetic
ctaatgctacagugtctgcctuca

SEQ ID NO: 91156 - DNA, 23 bp, Artificial Sequence
  Synthetic
gtggcatcuttactcaccaucca

SEQ ID NO: 91157 - DNA, 22 bp, Artificial Sequence
  Synthetic
gtgttuggagcgggattttcuc

SEQ ID NO: 91158 - DNA, 22 bp, Artificial Sequence
  Synthetic
gccugccttcaaucagaaacct

SEQ ID NO: 91159 - DNA, 22 bp, Artificial Sequence
  Synthetic
atgactucccacatgacgaucc

SEQ ID NO: 91160 - DNA, 21 bp, Artificial Sequence
  Synthetic
acacagcagcugagacatucc

SEQ ID NO: 91161 - DNA, 23 bp, Artificial Sequence
  Synthetic
gaagaaugggtagugaggaagca

SEQ ID NO: 91162 - DNA, 27 bp, Artificial Sequence
  Synthetic
gcctttctucagattcattctcaugac

SEQ ID NO: 91163 - DNA, 22 bp, Artificial Sequence
  Synthetic
gcaccgttgutgtcagtgacua

SEQ ID NO: 91164 - DNA, 28 bp, Artificial Sequence
  Synthetic
tctctctccucagttaataacgacauga

SEQ ID NO: 91165 - DNA, 22 bp, Artificial Sequence
  Synthetic
ctcacagauggaggtgatgcug

SEQ ID NO: 91166 - DNA, 20 bp, Artificial Sequence
  Synthetic
cagcgacguttggagctaug

SEQ ID NO: 91167 - DNA, 22 bp, Artificial Sequence
  Synthetic
tgcctttgggaucccttcaaug

SEQ ID NO: 91168 - DNA, 23 bp, Artificial Sequence
  Synthetic
cagaaatccugcatgagcaacug

SEQ ID NO: 91169 - DNA, 28 bp, Artificial Sequence
  Synthetic
agagatacacugactgtgtgtactauga

SEQ ID NO: 91170 - DNA, 22 bp, Artificial Sequence
  Synthetic
gggattgagugacgaagtggut

SEQ ID NO: 91171 - DNA, 21 bp, Artificial Sequence
  Synthetic
tgtttccgtcugactgccauc

SEQ ID NO: 91172 - DNA, 28 bp, Artificial Sequence
  Synthetic
ccacattcaucagtaattcacuaagcgt

SEQ ID NO: 91173 - DNA, 26 bp, Artificial Sequence
  Synthetic
accaggaccaugagaaacttttugaa

SEQ ID NO: 91174 - DNA, 29 bp, Artificial Sequence
  Synthetic
agatgttacuaggtgttataugccacaga

SEQ ID NO: 91175 - DNA, 28 bp, Artificial Sequence
  Synthetic
catggcaagttaugtgatggagaaaaug

SEQ ID NO: 91176 - DNA, 19 bp, Artificial Sequence
  Synthetic
gccagauggcatgccugaa

SEQ ID NO: 91177 - DNA, 19 bp, Artificial Sequence
  Synthetic
tctgcaggutgagcaggug

SEQ ID NO: 91178 - DNA, 21 bp, Artificial Sequence
  Synthetic
gctcctgcaaaugcaacagut

SEQ ID NO: 91179 - DNA, 18 bp, Artificial Sequence
  Synthetic
cguacaggcagggctgug

SEQ ID NO: 91180 - DNA, 24 bp, Artificial Sequence
  Synthetic
gggacacugtcacaaaagugaaaa

SEQ ID NO: 91181 - DNA, 24 bp, Artificial Sequence
  Synthetic
accaaugaaagaaacgggcctuat

SEQ ID NO: 91182 - DNA, 22 bp, Artificial Sequence
  Synthetic
cagagcagaautgggaagcugt

SEQ ID NO: 91183 - DNA, 24 bp, Artificial Sequence
  Synthetic
agcatcaccuagatcttccaucca

SEQ ID NO: 91184 - DNA, 27 bp, Artificial Sequence
  Synthetic
catctgaagagagugttcgaggaaaut

SEQ ID NO: 91185 - DNA, 24 bp, Artificial Sequence
  Synthetic
gaagauaatgactauggccgagca

SEQ ID NO: 91186 - DNA, 20 bp, Artificial Sequence
  Synthetic
ccuaggccccaccagtcuac

SEQ ID NO: 91187 - DNA, 28 bp, Artificial Sequence
  Synthetic
tctcagactaccuaggctttgaaagtua

SEQ ID NO: 91188 - DNA, 19 bp, Artificial Sequence
  Synthetic
aggcccagcagccutatut

SEQ ID NO: 91189 - DNA, 19 bp, Artificial Sequence
  Synthetic
ggtccugcctctuggaacc

SEQ ID NO: 91190 - DNA, 21 bp, Artificial Sequence
  Synthetic
catcagagutgtcuccgcagt

SEQ ID NO: 91191 - DNA, 28 bp, Artificial Sequence
  Synthetic
tgatctctggtugtgtgtttctacttut

SEQ ID NO: 91192 - DNA, 24 bp, Artificial Sequence
  Synthetic
ccccactgaaccuctcttacatut

SEQ ID NO: 91193 - DNA, 22 bp, Artificial Sequence
  Synthetic
gagggaaggcaggauctcuaac

SEQ ID NO: 91194 - DNA, 31 bp, Artificial Sequence
  Synthetic
tgattttgtcucagacattacagcuaaaagt

SEQ ID NO: 91195 - DNA, 22 bp, Artificial Sequence
  Synthetic
caaggccuggaucaaccaagat

SEQ ID NO: 91196 - DNA, 21 bp, Artificial Sequence
  Synthetic
ctttctctgggugcacagcua

SEQ ID NO: 91197 - DNA, 31 bp, Artificial Sequence
  Synthetic
cctaggtaacatauattggacagatcauggt

SEQ ID NO: 91198 - DNA, 22 bp, Artificial Sequence
  Synthetic
ccucaaggccaacaagcatuct

SEQ ID NO: 91199 - DNA, 22 bp, Artificial Sequence
  Synthetic
gaatcaguctctgtggugggat

SEQ ID NO: 91200 - DNA, 21 bp, Artificial Sequence
  Synthetic
tgcgtgtaccaugatgctgua

SEQ ID NO: 91201 - DNA, 24 bp, Artificial Sequence
  Synthetic
catttgtgcucggtacttugagag

SEQ ID NO: 91202 - DNA, 21 bp, Artificial Sequence
  Synthetic
caggaggugacactguagacc

SEQ ID NO: 91203 - DNA, 23 bp, Artificial Sequence
  Synthetic
ttccaacugggatttuccacaca

SEQ ID NO: 91204 - DNA, 29 bp, Artificial Sequence
  Synthetic
tcaagggucataacaaaucaaaacagagt

SEQ ID NO: 91205 - DNA, 28 bp, Artificial Sequence
  Synthetic
caggctttggugaataatatgtccttug

SEQ ID NO: 91206 - DNA, 28 bp, Artificial Sequence
  Synthetic
gcagcggcauacacttctttatatctua

SEQ ID NO: 91207 - DNA, 28 bp, Artificial Sequence
  Synthetic
ggctgucaatatgacaugagaaggaaaa

SEQ ID NO: 91208 - DNA, 28 bp, Artificial Sequence
  Synthetic
ggtacgaatgugaagaatctttuacgac

SEQ ID NO: 91209 - DNA, 27 bp, Artificial Sequence
  Synthetic
agcccgtaccuttttattgcattttuc

SEQ ID NO: 91210 - DNA, 28 bp, Artificial Sequence
  Synthetic
actagaaggugcaaatgcatatcatugt

SEQ ID NO: 91211 - DNA, 25 bp, Artificial Sequence
  Synthetic
ggtgacutgtgaggaugaaccaaaa

SEQ ID NO: 91212 - DNA, 26 bp, Artificial Sequence
  Synthetic
aaagattctaucctctgcctcuagca

SEQ ID NO: 91213 - DNA, 25 bp, Artificial Sequence
  Synthetic
gtgatggaatucatgactgtgugga

SEQ ID NO: 91214 - DNA, 29 bp, Artificial Sequence
  Synthetic
tgatgaacctaautgtacaacttguggat

SEQ ID NO: 91215 - DNA, 25 bp, Artificial Sequence
  Synthetic
catcaaaccccacaugaatcgtaug

SEQ ID NO: 91216 - DNA, 26 bp, Artificial Sequence
  Synthetic
gtttaggguttgaagaatugccaagt

SEQ ID NO: 91217 - DNA, 25 bp, Artificial Sequence
  Synthetic
accaaaugcagagaacagtggaaut

SEQ ID NO: 91218 - DNA, 22 bp, Artificial Sequence
  Synthetic
tctctgcugttattgggugcat

SEQ ID NO: 91219 - DNA, 28 bp, Artificial Sequence
  Synthetic
cgatatttgtggcuggtggtttatauga

SEQ ID NO: 91220 - DNA, 26 bp, Artificial Sequence
  Synthetic
aattgagcugtacaacttcugggaaa

SEQ ID NO: 91221 - DNA, 25 bp, Artificial Sequence
  Synthetic
caataaggagauccctucacaccac

SEQ ID NO: 91222 - DNA, 27 bp, Artificial Sequence
  Synthetic
gtagaaacaguaacaagaccctaccug

SEQ ID NO: 91223 - DNA, 21 bp, Artificial Sequence
  Synthetic
ctttgugcagccagtgguaat

SEQ ID NO: 91224 - DNA, 27 bp, Artificial Sequence
  Synthetic
gagatctctctuccttcagacttugag

SEQ ID NO: 91225 - DNA, 28 bp, Artificial Sequence
  Synthetic
acatggcaattcutgcttgaaaactaut

SEQ ID NO: 91226 - DNA, 21 bp, Artificial Sequence
  Synthetic
cttcctuagggactgctgcug

SEQ ID NO: 91227 - DNA, 22 bp, Artificial Sequence
  Synthetic
cttcgcccugctctctatgaug

SEQ ID NO: 91228 - DNA, 23 bp, Artificial Sequence
  Synthetic
cacagttcucttcatcacugcca

SEQ ID NO: 91229 - DNA, 26 bp, Artificial Sequence
  Synthetic
ctgcagtguccatttgtattugaaca

SEQ ID NO: 91230 - DNA, 29 bp, Artificial Sequence
  Synthetic
tccacagguaagaaatcttuaaaccaagt

SEQ ID NO: 91231 - DNA, 21 bp, Artificial Sequence
  Synthetic
gggctuccctaccatugacat

SEQ ID NO: 91232 - DNA, 24 bp, Artificial Sequence
  Synthetic
gcacauggagacagaaatgucaca

SEQ ID NO: 91233 - DNA, 20 bp, Artificial Sequence
  Synthetic
ctgatgaacaugggccugga

SEQ ID NO: 91234 - DNA, 23 bp, Artificial Sequence
  Synthetic
ctcagttcuacagggtctgtugg

SEQ ID NO: 91235 - DNA, 26 bp, Artificial Sequence
  Synthetic
aggtgcaattcuctgcttttctauct

SEQ ID NO: 91236 - DNA, 22 bp, Artificial Sequence
  Synthetic
gtacgcucaaccacctucaact

SEQ ID NO: 91237 - DNA, 26 bp, Artificial Sequence
  Synthetic
gttctcaacaagcacugagtaaggua

SEQ ID NO: 91238 - DNA, 26 bp, Artificial Sequence
  Synthetic
cctacaauaacaatagugcacaccgt

SEQ ID NO: 91239 - DNA, 22 bp, Artificial Sequence
  Synthetic
agcatacaacugcgccatauct

SEQ ID NO: 91240 - DNA, 26 bp, Artificial Sequence
  Synthetic
ctgcaaacaaaaccacucattauggt

SEQ ID NO: 91241 - DNA, 21 bp, Artificial Sequence
  Synthetic
ggaggcagugattccaagcug

SEQ ID NO: 91242 - DNA, 21 bp, Artificial Sequence
  Synthetic
augggaagagcuacgaggagt

SEQ ID NO: 91243 - DNA, 22 bp, Artificial Sequence
  Synthetic
cagtgtgaaucgagcctugaca

SEQ ID NO: 91244 - DNA, 24 bp, Artificial Sequence
  Synthetic
acctgtctgugctttgttguagaa

SEQ ID NO: 91245 - DNA, 19 bp, Artificial Sequence
  Synthetic
ggutaacgacuggcaccac

SEQ ID NO: 91246 - DNA, 25 bp, Artificial Sequence
  Synthetic
actcatugaagacacagcagaugac

SEQ ID NO: 91247 - DNA, 27 bp, Artificial Sequence
  Synthetic
tgattgccatgutgtgtgaattgatut

SEQ ID NO: 91248 - DNA, 25 bp, Artificial Sequence
  Synthetic
cctgttcacuctcttttctcuccaa

SEQ ID NO: 91249 - DNA, 20 bp, Artificial Sequence
  Synthetic
caagtgccugtgtggacuca

SEQ ID NO: 91250 - DNA, 20 bp, Artificial Sequence
  Synthetic
cctactccucccgtgctuag

SEQ ID NO: 91251 - DNA, 26 bp, Artificial Sequence
  Synthetic
cattcaacctaccugttctctcctua

SEQ ID NO: 91252 - DNA, 21 bp, Artificial Sequence
  Synthetic
ggcatccauctcagcgttcut

SEQ ID NO: 91253 - DNA, 23 bp, Artificial Sequence
  Synthetic
catgcacuggaaagccaactuac

SEQ ID NO: 91254 - DNA, 33 bp, Artificial Sequence
  Synthetic
actgaataacaaacacutttaaagttguaacat

SEQ ID NO: 91255 - DNA, 27 bp, Artificial Sequence
  Synthetic
cgatgcatcugaggaacgtttatacug

SEQ ID NO: 91256 - DNA, 28 bp, Artificial Sequence
  Synthetic
ccagttccgtuaataaaagctcgttuaa

SEQ ID NO: 91257 - DNA, 28 bp, Artificial Sequence
  Synthetic
gttctgaaaucagaggagtggatatuga

SEQ ID NO: 91258 - DNA, 23 bp, Artificial Sequence
  Synthetic
aaaaggcaucaagcacaaaccuc

SEQ ID NO: 91259 - DNA, 17 bp, Artificial Sequence
  Synthetic
ggccaucggcccatcuc

SEQ ID NO: 91260 - DNA, 27 bp, Artificial Sequence
  Synthetic
gccgtgatgaagutaaagtatggatug

SEQ ID NO: 91261 - DNA, 28 bp, Artificial Sequence
  Synthetic
gcutgccaacttcauaagagaaaagaat

SEQ ID NO: 91262 - DNA, 21 bp, Artificial Sequence
  Synthetic
ccctaacagccaugctttcuc

SEQ ID NO: 91263 - DNA, 23 bp, Artificial Sequence
  Synthetic
ccaggcaauggaaagggtacaua

SEQ ID NO: 91264 - DNA, 22 bp, Artificial Sequence
  Synthetic
ccatggccucattctggttcuc

SEQ ID NO: 91265 - DNA, 22 bp, Artificial Sequence
  Synthetic
gcatgguacaaggtcacuccaa

SEQ ID NO: 91266 - DNA, 24 bp, Artificial Sequence
  Synthetic
ggattcagagugcataggttcuca

SEQ ID NO: 91267 - DNA, 20 bp, Artificial Sequence
  Synthetic
cgaaccuctgccaucaggac

SEQ ID NO: 91268 - DNA, 21 bp, Artificial Sequence
  Synthetic
gcctcacugcttccaacagut

SEQ ID NO: 91269 - DNA, 28 bp, Artificial Sequence
  Synthetic
cctcctgtatuaaaattgagcgtgugat

SEQ ID NO: 91270 - DNA, 21 bp, Artificial Sequence
  Synthetic
tgactguggatctcuggagca

SEQ ID NO: 91271 - DNA, 17 bp, Artificial Sequence
  Synthetic
ccaguccgccccatucc

SEQ ID NO: 91272 - DNA, 23 bp, Artificial Sequence
  Synthetic
cccaccuggcaataatagggaut

SEQ ID NO: 91273 - DNA, 20 bp, Artificial Sequence
  Synthetic
tggagggugtgccgttatuc

SEQ ID NO: 91274 - DNA, 28 bp, Artificial Sequence
  Synthetic
tgaaagcaaatcuctctcttcaaagucc

SEQ ID NO: 91275 - DNA, 22 bp, Artificial Sequence
  Synthetic
gcuacctaaugcagccagacaa

SEQ ID NO: 91276 - DNA, 28 bp, Artificial Sequence
  Synthetic
cttaccaatttuagccttgcaagatcug

SEQ ID NO: 91277 - DNA, 28 bp, Artificial Sequence
  Synthetic
agataaagcugcttagaaatgaugccaa

SEQ ID NO: 91278 - DNA, 23 bp, Artificial Sequence
  Synthetic
cacctcaatugcagtggatcuct

SEQ ID NO: 91279 - DNA, 24 bp, Artificial Sequence
  Synthetic
ccaaagagcagcaaguctgaucat

SEQ ID NO: 91280 - DNA, 25 bp, Artificial Sequence
  Synthetic
ttgtgctgauatgatcagactugct

SEQ ID NO: 91281 - DNA, 27 bp, Artificial Sequence
  Synthetic
ggctttgttatucgctgatctgtttug

SEQ ID NO: 91282 - DNA, 23 bp, Artificial Sequence
  Synthetic
ctacaauagccttaccugcacca

SEQ ID NO: 91283 - DNA, 28 bp, Artificial Sequence
  Synthetic
tcatcacagtcaugctttcttacaucat

SEQ ID NO: 91284 - DNA, 22 bp, Artificial Sequence
  Synthetic
caagcaugtgcatuggcaagat

SEQ ID NO: 91285 - DNA, 28 bp, Artificial Sequence
  Synthetic
tgggagtatugcacaattatctcttguc

SEQ ID NO: 91286 - DNA, 24 bp, Artificial Sequence
  Synthetic
aaagguaatgggcauagcacaact

SEQ ID NO: 91287 - DNA, 28 bp, Artificial Sequence
  Synthetic
caagtattccaugactacccatagtuca

SEQ ID NO: 91288 - DNA, 26 bp, Artificial Sequence
  Synthetic
aacccatcgauttgaatcctttcuca

SEQ ID NO: 91289 - DNA, 28 bp, Artificial Sequence
  Synthetic
cccaauaggttcctauggaaagaaagaa

SEQ ID NO: 91290 - DNA, 28 bp, Artificial Sequence
  Synthetic
tctctggcttcuttcctaatttcaaugt

SEQ ID NO: 91291 - DNA, 29 bp, Artificial Sequence
  Synthetic
ttgccagautgctacuaaaacagaaaaag

SEQ ID NO: 91292 - DNA, 26 bp, Artificial Sequence
  Synthetic
tcttgttatagcuacttggtggguga

SEQ ID NO: 91293 - DNA, 28 bp, Artificial Sequence
  Synthetic
ggtcttctcagcuagaaatgctctatut

SEQ ID NO: 91294 - DNA, 25 bp, Artificial Sequence
  Synthetic
gtacagttgucaagtccacttucct

SEQ ID NO: 91295 - DNA, 21 bp, Artificial Sequence
  Synthetic
gacaucaacctccauggcaac

SEQ ID NO: 91296 - DNA, 28 bp, Artificial Sequence
  Synthetic
ccatgtcttacutgtttttaggtugcat

SEQ ID NO: 91297 - DNA, 27 bp, Artificial Sequence
  Synthetic
tgtttccagucacaaaaagagtaucca

SEQ ID NO: 91298 - DNA, 25 bp, Artificial Sequence
  Synthetic
ttttggtatgcguctcaacttcuct

SEQ ID NO: 91299 - DNA, 25 bp, Artificial Sequence
  Synthetic
gtgaagauggagaaacaagugacca

SEQ ID NO: 91300 - DNA, 23 bp, Artificial Sequence
  Synthetic
gcacaggaacaucacccaatcuc

SEQ ID NO: 91301 - DNA, 22 bp, Artificial Sequence
  Synthetic
gctccgctuctttccttcacuc

SEQ ID NO: 91302 - DNA, 27 bp, Artificial Sequence
  Synthetic
cctgtgtccauactttgattcaacugt

SEQ ID NO: 91303 - DNA, 25 bp, Artificial Sequence
  Synthetic
ggtagtgagautatgttgcagcugt

SEQ ID NO: 91304 - DNA, 29 bp, Artificial Sequence
  Synthetic
tatgaaaacagtuaaaattgtgccaccut

SEQ ID NO: 91305 - DNA, 20 bp, Artificial Sequence
  Synthetic
gtaagcacaguggccaccua

SEQ ID NO: 91306 - DNA, 19 bp, Artificial Sequence
  Synthetic
gacacacaggcagcucuct

SEQ ID NO: 91307 - DNA, 18 bp, Artificial Sequence
  Synthetic
ccagggutcagcaugcca

SEQ ID NO: 91308 - DNA, 19 bp, Artificial Sequence
  Synthetic
agctuccccctccucaaca

SEQ ID NO: 91309 - DNA, 17 bp, Artificial Sequence
  Synthetic
gtccgtgcugtgtgcuc

SEQ ID NO: 91310 - DNA, 25 bp, Artificial Sequence
  Synthetic
ctggtacaagaaugtgcaatgtuct

SEQ ID NO: 91311 - DNA, 25 bp, Artificial Sequence
  Synthetic
ttccagcaaccutatcatacauggg

SEQ ID NO: 91312 - DNA, 22 bp, Artificial Sequence
  Synthetic
acccagtctcucttctgcctut

SEQ ID NO: 91313 - DNA, 28 bp, Artificial Sequence
  Synthetic
tgtttcctagtacucaggaatgtctuct

SEQ ID NO: 91314 - DNA, 28 bp, Artificial Sequence
  Synthetic
gcacagcauagaacataagtaagcuaca

SEQ ID NO: 91315 - DNA, 22 bp, Artificial Sequence
  Synthetic
acccttatttugcccccaaucc

SEQ ID NO: 91316 - DNA, 29 bp, Artificial Sequence
  Synthetic
attttggtattauccactgaagacugcat

SEQ ID NO: 91317 - DNA, 20 bp, Artificial Sequence
  Synthetic
ggcagcgucatccacttcuc

SEQ ID NO: 91318 - DNA, 22 bp, Artificial Sequence
  Synthetic
agttcccaguctcttgcaggua

SEQ ID NO: 91319 - DNA, 21 bp, Artificial Sequence
  Synthetic
cccccaccagutgatgaaugg

SEQ ID NO: 91320 - DNA, 22 bp, Artificial Sequence
  Synthetic
gtctcuctgatccugccacaac

SEQ ID NO: 91321 - DNA, 20 bp, Artificial Sequence
  Synthetic
cagcuggccatggcauagat

SEQ ID NO: 91322 - DNA, 23 bp, Artificial Sequence
  Synthetic
acagaccgacuaaagagcaguct

SEQ ID NO: 91323 - DNA, 21 bp, Artificial Sequence
  Synthetic
cccacccauttcctctccuca

SEQ ID NO: 91324 - DNA, 25 bp, Artificial Sequence
  Synthetic
cccttcttctuggcgaatgatctua

SEQ ID NO: 91325 - DNA, 21 bp, Artificial Sequence
  Synthetic
gctgcagaaaaucaagugcca

SEQ ID NO: 91326 - DNA, 23 bp, Artificial Sequence
  Synthetic
ggctaacuttccttcuggacact

SEQ ID NO: 91327 - DNA, 29 bp, Artificial Sequence
  Synthetic
gtcagaaatgcuaagtatgcaaaatgugt

SEQ ID NO: 91328 - DNA, 28 bp, Artificial Sequence
  Synthetic
tgttgatcgtttcugagaacaagctaua

SEQ ID NO: 91329 - DNA, 22 bp, Artificial Sequence
  Synthetic
gatgtgccccagutatgguact

SEQ ID NO: 91330 - DNA, 22 bp, Artificial Sequence
  Synthetic
ggtgctgaautcccttggcuaa

SEQ ID NO: 91331 - DNA, 27 bp, Artificial Sequence
  Synthetic
atgcaagcautcttatttccugcaaaa

SEQ ID NO: 91332 - DNA, 23 bp, Artificial Sequence
  Synthetic
caaatgtggccuttctcttugct

SEQ ID NO: 91333 - DNA, 21 bp, Artificial Sequence
  Synthetic
cagctcugatcctgcuaagcc

SEQ ID NO: 91334 - DNA, 24 bp, Artificial Sequence
  Synthetic
gacagtataggccugaccctcuaa

SEQ ID NO: 91335 - DNA, 27 bp, Artificial Sequence
  Synthetic
ttgaatucagtaatgtgucagcaggat

SEQ ID NO: 91336 - DNA, 24 bp, Artificial Sequence
  Synthetic
gcttactcaauagtcatccuggct

SEQ ID NO: 91337 - DNA, 28 bp, Artificial Sequence
  Synthetic
acactcctgattucactaccttttgtuc

SEQ ID NO: 91338 - DNA, 26 bp, Artificial Sequence
  Synthetic
tggtgcagaguagatgatatgaucca

SEQ ID NO: 91339 - DNA, 23 bp, Artificial Sequence
  Synthetic
gggaagaggaaaguacctgauga

SEQ ID NO: 91340 - DNA, 28 bp, Artificial Sequence
  Synthetic
cttaatagctugtagccattcuccaact

SEQ ID NO: 91341 - DNA, 28 bp, Artificial Sequence
  Synthetic
tctttggtattucaggataatgtucgct

SEQ ID NO: 91342 - DNA, 21 bp, Artificial Sequence
  Synthetic
gagttggcuggaaccaggaut

SEQ ID NO: 91343 - DNA, 24 bp, Artificial Sequence
  Synthetic
tctgcttccaaguctaggtcuagg

SEQ ID NO: 91344 - DNA, 23 bp, Artificial Sequence
  Synthetic
tgtgattgtgtuttctccgccut

SEQ ID NO: 91345 - DNA, 23 bp, Artificial Sequence
  Synthetic
tcttatagcucaggccggattug

SEQ ID NO: 91346 - DNA, 20 bp, Artificial Sequence
  Synthetic
caaggatggguccccttguc

SEQ ID NO: 91347 - DNA, 22 bp, Artificial Sequence
  Synthetic
aagagagtgcaugtctgctugt

SEQ ID NO: 91348 - DNA, 21 bp, Artificial Sequence
  Synthetic
ctgagcacacagcagugtcua

SEQ ID NO: 91349 - DNA, 27 bp, Artificial Sequence
  Synthetic
gctttgagagaautcttcagcacaaut

SEQ ID NO: 91350 - DNA, 23 bp, Artificial Sequence
  Synthetic
gtagagcuggagccagaacuaga

SEQ ID NO: 91351 - DNA, 26 bp, Artificial Sequence
  Synthetic
ggtgcaaagugttgggtaatuagaag

SEQ ID NO: 91352 - DNA, 24 bp, Artificial Sequence
  Synthetic
caaaattgcaaagauctgcccugt

SEQ ID NO: 91353 - DNA, 27 bp, Artificial Sequence
  Synthetic
gccccactguagctttaactagtauct

SEQ ID NO: 91354 - DNA, 22 bp, Artificial Sequence
  Synthetic
ccttgcaagutcccagtacucc

SEQ ID NO: 91355 - DNA, 21 bp, Artificial Sequence
  Synthetic
acataccaggugtgccaaguc

SEQ ID NO: 91356 - DNA, 22 bp, Artificial Sequence
  Synthetic
ccaataggcccaugctcatcuc

SEQ ID NO: 91357 - DNA, 20 bp, Artificial Sequence
  Synthetic
gggcaagugaaccugacgaa

SEQ ID NO: 91358 - DNA, 24 bp, Artificial Sequence
  Synthetic
agtgggugatgaaugaagagcaat

SEQ ID NO: 91359 - DNA, 20 bp, Artificial Sequence
  Synthetic
agggcacuttguagcaccac

SEQ ID NO: 91360 - DNA, 22 bp, Artificial Sequence
  Synthetic
tctagcctcacuggaccttcut

SEQ ID NO: 91361 - DNA, 21 bp, Artificial Sequence
  Synthetic
ccggcacuttttgcagaugat

SEQ ID NO: 91362 - DNA, 24 bp, Artificial Sequence
  Synthetic
aaccaagtuacccatgaucaagca

SEQ ID NO: 91363 - DNA, 29 bp, Artificial Sequence
  Synthetic
gcctaggaaagutaaaattgugacagaag

SEQ ID NO: 91364 - DNA, 21 bp, Artificial Sequence
  Synthetic
gttgtttuggttgggcuccat

SEQ ID NO: 91365 - DNA, 28 bp, Artificial Sequence
  Synthetic
agtacttgcacuttcaaaagcaaaaugt

SEQ ID NO: 91366 - DNA, 21 bp, Artificial Sequence
  Synthetic
cacaucaatggcauccaccac

SEQ ID NO: 91367 - DNA, 20 bp, Artificial Sequence
  Synthetic
ggccttcuggaaagcgtgua

SEQ ID NO: 91368 - DNA, 22 bp, Artificial Sequence
  Synthetic
gcgggaugatgtgaccuacaac

SEQ ID NO: 91369 - DNA, 21 bp, Artificial Sequence
  Synthetic
ggcctggaugtcaaaggtgua

SEQ ID NO: 91370 - DNA, 24 bp, Artificial Sequence
  Synthetic
gggtcatccutcctgaacattuca

SEQ ID NO: 91371 - DNA, 27 bp, Artificial Sequence
  Synthetic
gcactcauaaagttcctctucaaagca

SEQ ID NO: 91372 - DNA, 21 bp, Artificial Sequence
  Synthetic
ccccugagcctgaaugaagaa

SEQ ID NO: 91373 - DNA, 26 bp, Artificial Sequence
  Synthetic
gagugaagagtcugaccaaggaaaat

SEQ ID NO: 91374 - DNA, 19 bp, Artificial Sequence
  Synthetic
gtctccaucagcagccugt

SEQ ID NO: 91375 - DNA, 20 bp, Artificial Sequence
  Synthetic
gcacagaagccuccagacut

SEQ ID NO: 91376 - DNA, 22 bp, Artificial Sequence
  Synthetic
tgaattgcgcutctgguacaga

SEQ ID NO: 91377 - DNA, 26 bp, Artificial Sequence
  Synthetic
ccattggaaaaugtatcugcaaagca

SEQ ID NO: 91378 - DNA, 29 bp, Artificial Sequence
  Synthetic
aggagttcaaaagutgtgtcaaagauaca

SEQ ID NO: 91379 - DNA, 20 bp, Artificial Sequence
  Synthetic
agcaaaagggccagutcuca

SEQ ID NO: 91380 - DNA, 21 bp, Artificial Sequence
  Synthetic
tgttgguggcaacacacucat

SEQ ID NO: 91381 - DNA, 28 bp, Artificial Sequence
  Synthetic
ctttgcagggcutttcatattgtuaaga

SEQ ID NO: 91382 - DNA, 27 bp, Artificial Sequence
  Synthetic
acttacccacaguactaatgcaatucc

SEQ ID NO: 91383 - DNA, 26 bp, Artificial Sequence
  Synthetic
agatagacaguttcccacaguacagt

SEQ ID NO: 91384 - DNA, 22 bp, Artificial Sequence
  Synthetic
tgtctcctutttgctgguagcc

SEQ ID NO: 91385 - DNA, 26 bp, Artificial Sequence
  Synthetic
agtgactggtucagaattttcctcut

SEQ ID NO: 91386 - DNA, 25 bp, Artificial Sequence
  Synthetic
gacctgagcuctgcagtaattuagt

SEQ ID NO: 91387 - DNA, 25 bp, Artificial Sequence
  Synthetic
ccacaagaggagugaaaggtuacag

SEQ ID NO: 91388 - DNA, 24 bp, Artificial Sequence
  Synthetic
tcctcaauagctctcugaccaaga

SEQ ID NO: 91389 - DNA, 27 bp, Artificial Sequence
  Synthetic
aactatgaacuggtctacaaagauggg

SEQ ID NO: 91390 - DNA, 21 bp, Artificial Sequence
  Synthetic
acacaccagcugcattttugg

SEQ ID NO: 91391 - DNA, 28 bp, Artificial Sequence
  Synthetic
cctctaactcacgguttgctgattatut

SEQ ID NO: 91392 - DNA, 21 bp, Artificial Sequence
  Synthetic
atgtcccucgaacctcgacua

SEQ ID NO: 91393 - DNA, 26 bp, Artificial Sequence
  Synthetic
cttgcatagcuttggtttctgucaaa

SEQ ID NO: 91394 - DNA, 21 bp, Artificial Sequence
  Synthetic
cactgactucaagggtgcuct

SEQ ID NO: 91395 - DNA, 23 bp, Artificial Sequence
  Synthetic
cctgacctcuctgattgcatguc

SEQ ID NO: 91396 - DNA, 28 bp, Artificial Sequence
  Synthetic
acttaagagaccuaacattttgccauca

SEQ ID NO: 91397 - DNA, 23 bp, Artificial Sequence
  Synthetic
ggacaugcacggagatgagauat

SEQ ID NO: 91398 - DNA, 22 bp, Artificial Sequence
  Synthetic
caugaattgccucccaggagat

SEQ ID NO: 91399 - DNA, 23 bp, Artificial Sequence
  Synthetic
cacccaaagaaguagtgtugcag

SEQ ID NO: 91400 - DNA, 24 bp, Artificial Sequence
  Synthetic
ggaccagcacutcttgtaguacac

SEQ ID NO: 91401 - DNA, 28 bp, Artificial Sequence
  Synthetic
ccttggugaaagaaagatgaagctuaac

SEQ ID NO: 91402 - DNA, 23 bp, Artificial Sequence
  Synthetic
agtcttaccucctctccatgcuc

SEQ ID NO: 91403 - DNA, 22 bp, Artificial Sequence
  Synthetic
ttcaatccatugcctccctgut

SEQ ID NO: 91404 - DNA, 22 bp, Artificial Sequence
  Synthetic
accatcatcuggtcagagcuca

SEQ ID NO: 91405 - DNA, 22 bp, Artificial Sequence
  Synthetic
ggcccugagtctgaatcugaag

SEQ ID NO: 91406 - DNA, 26 bp, Artificial Sequence
  Synthetic
tcattcttcacugttgccatugagat

SEQ ID NO: 91407 - DNA, 22 bp, Artificial Sequence
  Synthetic
gagctggccacauattgtgtuc

SEQ ID NO: 91408 - DNA, 31 bp, Artificial Sequence
  Synthetic
cttactttcaacaautacttgtctgtctucc

SEQ ID NO: 91409 - DNA, 25 bp, Artificial Sequence
  Synthetic
agaatgtcauagccttggctttuga

SEQ ID NO: 91410 - DNA, 23 bp, Artificial Sequence
  Synthetic
ggtccaatcuctctcaccucagt

SEQ ID NO: 91411 - DNA, 27 bp, Artificial Sequence
  Synthetic
ctggcaggaauataagagaaaaccuct

SEQ ID NO: 91412 - DNA, 21 bp, Artificial Sequence
  Synthetic
ccagttcugacttccccugaa

SEQ ID NO: 91413 - DNA, 23 bp, Artificial Sequence
  Synthetic
gtctcctaugggtggcagttuaa

SEQ ID NO: 91414 - DNA, 27 bp, Artificial Sequence
  Synthetic
ccaaagtgtgcaucactgtaaaagaut

SEQ ID NO: 91415 - DNA, 28 bp, Artificial Sequence
  Synthetic
atttaaattccccaauaaggccatauga

SEQ ID NO: 91416 - DNA, 26 bp, Artificial Sequence
  Synthetic
gcaaaccttguaaagtgcaaatgtuc

SEQ ID NO: 91417 - DNA, 24 bp, Artificial Sequence
  Synthetic
gccctgaatgugtcacttgttuct

SEQ ID NO: 91418 - DNA, 21 bp, Artificial Sequence
  Synthetic
ctggctugtgcagguagacat

SEQ ID NO: 91419 - DNA, 27 bp, Artificial Sequence
  Synthetic
aaactcggtacccutcatggattatut

SEQ ID NO: 91420 - DNA, 28 bp, Artificial Sequence
  Synthetic
ggctatgacatucttgaaataacgugga

SEQ ID NO: 91421 - DNA, 22 bp, Artificial Sequence
  Synthetic
gcccauggatattuggcagaag

SEQ ID NO: 91422 - DNA, 21 bp, Artificial Sequence
  Synthetic
gccucaggcaagtaacuccat

SEQ ID NO: 91423 - DNA, 20 bp, Artificial Sequence
  Synthetic
agggaccaaugtttgugcca

SEQ ID NO: 91424 - DNA, 27 bp, Artificial Sequence
  Synthetic
ctgcagcaauggtgtctattttuacat

SEQ ID NO: 91425 - DNA, 25 bp, Artificial Sequence
  Synthetic
cctgagggautgtaacagtctucct

SEQ ID NO: 91426 - DNA, 21 bp, Artificial Sequence
  Synthetic
ggagcagccagaugtagcaua

SEQ ID NO: 91427 - DNA, 28 bp, Artificial Sequence
  Synthetic
acaaacagcattuaaaaatccacgacuc

SEQ ID NO: 91428 - DNA, 23 bp, Artificial Sequence
  Synthetic
gatagtgacccuttcccttgcut

SEQ ID NO: 91429 - DNA, 20 bp, Artificial Sequence
  Synthetic
tgccacugaacttgccguag

SEQ ID NO: 91430 - DNA, 20 bp, Artificial Sequence
  Synthetic
ccguactcguccagggacat

SEQ ID NO: 91431 - DNA, 17 bp, Artificial Sequence
  Synthetic
ctcccugtcguccagca

SEQ ID NO: 91432 - DNA, 17 bp, Artificial Sequence
  Synthetic
cugcuggacgacaggga

SEQ ID NO: 91433 - DNA, 17 bp, Artificial Sequence
  Synthetic
cgcucgcacacccugag

SEQ ID NO: 91434 - DNA, 26 bp, Artificial Sequence
  Synthetic
agtaggaauccaaaccaaaggcauaa

SEQ ID NO: 91435 - DNA, 26 bp, Artificial Sequence
  Synthetic
gaaaccaggaacagugtatgtttucc

SEQ ID NO: 91436 - DNA, 21 bp, Artificial Sequence
  Synthetic
ccttttaccugcccctttgug

SEQ ID NO: 91437 - DNA, 24 bp, Artificial Sequence
  Synthetic
ccttacctaugacacccagctuct

SEQ ID NO: 91438 - DNA, 22 bp, Artificial Sequence
  Synthetic
ggtatatguggtacaggugcgt

SEQ ID NO: 91439 - DNA, 23 bp, Artificial Sequence
  Synthetic
catttttggcuagtgcagcauct

SEQ ID NO: 91440 - DNA, 28 bp, Artificial Sequence
  Synthetic
gtagctcatttguagtgcctctttuagt

SEQ ID NO: 91441 - DNA, 27 bp, Artificial Sequence
  Synthetic
cagcttcuaaaagcacttctaatuccc

SEQ ID NO: 91442 - DNA, 22 bp, Artificial Sequence
  Synthetic
gcagcaguaaaagcccgaauct

SEQ ID NO: 91443 - DNA, 26 bp, Artificial Sequence
  Synthetic
gtcaaattguctggttgcaaucacaa

SEQ ID NO: 91444 - DNA, 23 bp, Artificial Sequence
  Synthetic
tggtggtggutggttaaaaguca

SEQ ID NO: 91445 - DNA, 24 bp, Artificial Sequence
  Synthetic
gtggagtucttccatguagaggac

SEQ ID NO: 91446 - DNA, 22 bp, Artificial Sequence
  Synthetic
gtggutccagtttugccgaaag

SEQ ID NO: 91447 - DNA, 22 bp, Artificial Sequence
  Synthetic
ccacttcauccgctttugggat

SEQ ID NO: 91448 - DNA, 23 bp, Artificial Sequence
  Synthetic
cacattcctgaugccaccttcua

SEQ ID NO: 91449 - DNA, 29 bp, Artificial Sequence
  Synthetic
ccttctctcuggatagtagtgttguaaga

SEQ ID NO: 91450 - DNA, 20 bp, Artificial Sequence
  Synthetic
gtccugggactcgtucacac

SEQ ID NO: 91451 - DNA, 24 bp, Artificial Sequence
  Synthetic
gacaggcaaucatatctggaggut

SEQ ID NO: 91452 - DNA, 20 bp, Artificial Sequence
  Synthetic
ggcaggaacggagcucauaa

SEQ ID NO: 91453 - DNA, 25 bp, Artificial Sequence
  Synthetic
cgattttggccauttcttcatcugg

SEQ ID NO: 91454 - DNA, 18 bp, Artificial Sequence
  Synthetic
gggaagcuccagctcuca

SEQ ID NO: 91455 - DNA, 18 bp, Artificial Sequence
  Synthetic
ggtagcugcgtgguggat

SEQ ID NO: 91456 - DNA, 20 bp, Artificial Sequence
  Synthetic
ccatccucacggcaguagag

SEQ ID NO: 91457 - DNA, 24 bp, Artificial Sequence
  Synthetic
cccugcacctcttcuacaaaaagt

SEQ ID NO: 91458 - DNA, 23 bp, Artificial Sequence
  Synthetic
aatcgagucaggttcacagucag

SEQ ID NO: 91459 - DNA, 19 bp, Artificial Sequence
  Synthetic
ccaccgggaaggugaaugt

SEQ ID NO: 91460 - DNA, 25 bp, Artificial Sequence
  Synthetic
ggcttcaugttagttttugcaggat

SEQ ID NO: 91461 - DNA, 21 bp, Artificial Sequence
  Synthetic
acagcaugaaaccccatguga

SEQ ID NO: 91462 - DNA, 17 bp, Artificial Sequence
  Synthetic
cccagacgcagcgucut

SEQ ID NO: 91463 - DNA, 20 bp, Artificial Sequence
  Synthetic
ggugagcugggaagaacaca

SEQ ID NO: 91464 - DNA, 17 bp, Artificial Sequence
  Synthetic
tgaccccugcccacuca

SEQ ID NO: 91465 - DNA, 17 bp, Artificial Sequence
  Synthetic
cctaugggccccggcua

SEQ ID NO: 91466 - DNA, 27 bp, Artificial Sequence
  Synthetic
cccaagagggaacaaugttacaaucat

SEQ ID NO: 91467 - DNA, 21 bp, Artificial Sequence
  Synthetic
tgtcccaugcaacatctggug

SEQ ID NO: 91468 - DNA, 25 bp, Artificial Sequence
  Synthetic
gcacaggagcagutctttttaaugt

SEQ ID NO: 91469 - DNA, 28 bp, Artificial Sequence
  Synthetic
tgcaagcuaaaaccacaaatttcugaat

SEQ ID NO: 91470 - DNA, 24 bp, Artificial Sequence
  Synthetic
gtctgcttgcugtgcaaataacut

SEQ ID NO: 91471 - DNA, 26 bp, Artificial Sequence
  Synthetic
ctgtcttgggagautccagagaatua

SEQ ID NO: 91472 - DNA, 21 bp, Artificial Sequence
  Synthetic
ccccatucagacccattggut

SEQ ID NO: 91473 - DNA, 21 bp, Artificial Sequence
  Synthetic
caagcttcttutgggcctgug

SEQ ID NO: 91474 - DNA, 24 bp, Artificial Sequence
  Synthetic
aatcaggcatugctggttagacut

SEQ ID NO: 91475 - DNA, 21 bp, Artificial Sequence
  Synthetic
cctgttcuggcaggatgtcug

SEQ ID NO: 91476 - DNA, 21 bp, Artificial Sequence
  Synthetic
ttgaaaggcauggcggagtua

SEQ ID NO: 91477 - DNA, 28 bp, Artificial Sequence
  Synthetic
ggaaaggacaggucatctgtttuaagaa

SEQ ID NO: 91478 - DNA, 21 bp, Artificial Sequence
  Synthetic
cccaccccaaccuacaccuat

SEQ ID NO: 91479 - DNA, 19 bp, Artificial Sequence
  Synthetic
cuggaacugacccagcact

SEQ ID NO: 91480 - DNA, 27 bp, Artificial Sequence
  Synthetic
gtagtagaaaacagaagugaggcucat

SEQ ID NO: 91481 - DNA, 20 bp, Artificial Sequence
  Synthetic
aacatcttuccggcctccug

SEQ ID NO: 91482 - DNA, 19 bp, Artificial Sequence
  Synthetic
gcctgcagaugacctucct

SEQ ID NO: 91483 - DNA, 18 bp, Artificial Sequence
  Synthetic
cacccaggcuggacugac

SEQ ID NO: 91484 - DNA, 18 bp, Artificial Sequence
  Synthetic
ccagcgaguccaggtuga

SEQ ID NO: 91485 - DNA, 18 bp, Artificial Sequence
  Synthetic
ggctcugctggaauggca

SEQ ID NO: 91486 - DNA, 17 bp, Artificial Sequence
  Synthetic
gctccggcugccatucc

SEQ ID NO: 91487 - DNA, 22 bp, Artificial Sequence
  Synthetic
gcagcaugtcucgaaggaagat

SEQ ID NO: 91488 - DNA, 25 bp, Artificial Sequence
  Synthetic
ctgttagagatuggctttggtgcua

SEQ ID NO: 91489 - DNA, 21 bp, Artificial Sequence
  Synthetic
ggccggaaaautcacuggaac

SEQ ID NO: 91490 - DNA, 19 bp, Artificial Sequence
  Synthetic
gcugaaggacucggacgaa

SEQ ID NO: 91491 - DNA, 20 bp, Artificial Sequence
  Synthetic
gcttaacgutgtcgctugcc

SEQ ID NO: 91492 - DNA, 21 bp, Artificial Sequence
  Synthetic
cagaagugaggacaaccccut

SEQ ID NO: 91493 - DNA, 28 bp, Artificial Sequence
  Synthetic
tccatagatgtggutgtgtttttctcut

SEQ ID NO: 91494 - DNA, 24 bp, Artificial Sequence
  Synthetic
cctcagttatccuggactggagut

SEQ ID NO: 91495 - DNA, 21 bp, Artificial Sequence
  Synthetic
tgaguccaaactgucgaggga

SEQ ID NO: 91496 - DNA, 26 bp, Artificial Sequence
  Synthetic
tcagtttuccaggcaattgagtttug

SEQ ID NO: 91497 - DNA, 28 bp, Artificial Sequence
  Synthetic
ccgagaaucaccaaatgugaaaaacaat

SEQ ID NO: 91498 - DNA, 27 bp, Artificial Sequence
  Synthetic
gaatataaaacagugtgagccaugcag

SEQ ID NO: 91499 - DNA, 22 bp, Artificial Sequence
  Synthetic
ctcagctcugacaccccatuaa

SEQ ID NO: 91500 - DNA, 28 bp, Artificial Sequence
  Synthetic
cataccattgucagaagcaaggaaagua

SEQ ID NO: 91501 - DNA, 28 bp, Artificial Sequence
  Synthetic
ccaattggcuaaaaatagatcctgugaa

SEQ ID NO: 91502 - DNA, 26 bp, Artificial Sequence
  Synthetic
gataacagtcacauaagagccacuca

SEQ ID NO: 91503 - DNA, 29 bp, Artificial Sequence
  Synthetic
ggcttactctttcutatctctctctguca

SEQ ID NO: 91504 - DNA, 28 bp, Artificial Sequence
  Synthetic
cggtccaaaacagcaautgtagttatut

SEQ ID NO: 91505 - DNA, 24 bp, Artificial Sequence
  Synthetic
gccagtugcatttggaacuaaacc

SEQ ID NO: 91506 - DNA, 27 bp, Artificial Sequence
  Synthetic
actaactacaccuttgagattgaugcc

SEQ ID NO: 91507 - DNA, 23 bp, Artificial Sequence
  Synthetic
tttuccacccagagucaaaacca

SEQ ID NO: 91508 - DNA, 26 bp, Artificial Sequence
  Synthetic
catacatgggcacaaaauaaccacut

SEQ ID NO: 91509 - DNA, 23 bp, Artificial Sequence
  Synthetic
ctaauagcaggagccauggaaca

SEQ ID NO: 91510 - DNA, 24 bp, Artificial Sequence
  Synthetic
cccauatcttggguccaaagcaat

SEQ ID NO: 91511 - DNA, 22 bp, Artificial Sequence
  Synthetic
agucgactggauagcaggaaac

SEQ ID NO: 91512 - DNA, 23 bp, Artificial Sequence
  Synthetic
tccatuggcaggagtgaatucag

SEQ ID NO: 91513 - DNA, 24 bp, Artificial Sequence
  Synthetic
cccgaccuaatctaacatccuggt

SEQ ID NO: 91514 - DNA, 28 bp, Artificial Sequence
  Synthetic
tgggcttatttuaactggcttttctuct

SEQ ID NO: 91515 - DNA, 24 bp, Artificial Sequence
  Synthetic
gaccagauatcaacttucggacca

SEQ ID NO: 91516 - DNA, 27 bp, Artificial Sequence
  Synthetic
ccaactgctuacaatttattgccauca

SEQ ID NO: 91517 - DNA, 28 bp, Artificial Sequence
  Synthetic
tacatgtatatggcuggattatcacugg

SEQ ID NO: 91518 - DNA, 29 bp, Artificial Sequence
  Synthetic
aaagtttccaatcutccagtgataaucca

SEQ ID NO: 91519 - DNA, 25 bp, Artificial Sequence
  Synthetic
atgacctgcttugccatattgagua

SEQ ID NO: 91520 - DNA, 30 bp, Artificial Sequence
  Synthetic
tgaagcacauaaaattaacttttcaugcca

SEQ ID NO: 91521 - DNA, 28 bp, Artificial Sequence
  Synthetic
gcttttgatctucctttatctccaguga

SEQ ID NO: 91522 - DNA, 26 bp, Artificial Sequence
  Synthetic
tgagaatttcugcacacttacacgut

SEQ ID NO: 91523 - DNA, 27 bp, Artificial Sequence
  Synthetic
tgaagttucccagagacttgtcttuag

SEQ ID NO: 91524 - DNA, 24 bp, Artificial Sequence
  Synthetic
cccacaagaccaggaugttagaut

SEQ ID NO: 91525 - DNA, 20 bp, Artificial Sequence
  Synthetic
ggcatgaacucctgcctcuc

SEQ ID NO: 91526 - DNA, 26 bp, Artificial Sequence
  Synthetic
agcctcttctugttaatttccctgut

SEQ ID NO: 91527 - DNA, 22 bp, Artificial Sequence
  Synthetic
tggcaaacugcagcttgtttut

SEQ ID NO: 91528 - DNA, 28 bp, Artificial Sequence
  Synthetic
gtctgtggagaaacugaaatacagtuct

SEQ ID NO: 91529 - DNA, 24 bp, Artificial Sequence
  Synthetic
gaaaaucgcacagaggttgtugac

SEQ ID NO: 91530 - DNA, 26 bp, Artificial Sequence
  Synthetic
agttttuacaaacccagctugaggat

SEQ ID NO: 91531 - DNA, 23 bp, Artificial Sequence
  Synthetic
acttgctgucgattggatuggaa

SEQ ID NO: 91532 - DNA, 29 bp, Artificial Sequence
  Synthetic
ccgagtgatgguccaatttctcttaauag

SEQ ID NO: 91533 - DNA, 21 bp, Artificial Sequence
  Synthetic
tgacaatgccccucaagtgut

SEQ ID NO: 91534 - DNA, 28 bp, Artificial Sequence
  Synthetic
tgtcccuatagtctcugcaaaaacaaat

SEQ ID NO: 91535 - DNA, 22 bp, Artificial Sequence
  Synthetic
cacacguttctatggugcagaa

SEQ ID NO: 91536 - DNA, 26 bp, Artificial Sequence
  Synthetic
tguagataguccaaggcagagacaat

SEQ ID NO: 91537 - DNA, 27 bp, Artificial Sequence
  Synthetic
attattacaatccugtccctgctgtut

SEQ ID NO: 91538 - DNA, 23 bp, Artificial Sequence
  Synthetic
gaggtggtgacucgaaaagctua

SEQ ID NO: 91539 - DNA, 28 bp, Artificial Sequence
  Synthetic
gggaataaagtaccugacttctcttcug

SEQ ID NO: 91540 - DNA, 28 bp, Artificial Sequence
  Synthetic
ttttctgtgucagaccaatagaggttut

SEQ ID NO: 91541 - DNA, 27 bp, Artificial Sequence
  Synthetic
gcaattgcucacttcttatttuaggga

SEQ ID NO: 91542 - DNA, 28 bp, Artificial Sequence
  Synthetic
ggtccagattgcugtctatccagtauat

SEQ ID NO: 91543 - DNA, 28 bp, Artificial Sequence
  Synthetic
gcacatgttggutttccttcttttguag

SEQ ID NO: 91544 - DNA, 21 bp, Artificial Sequence
  Synthetic
caagtctcugcctctugaggt

SEQ ID NO: 91545 - DNA, 25 bp, Artificial Sequence
  Synthetic
ggagagaactgutcagcatcattug

SEQ ID NO: 91546 - DNA, 28 bp, Artificial Sequence
  Synthetic
gaaaaagcccuaagttactctcatucct

SEQ ID NO: 91547 - DNA, 28 bp, Artificial Sequence
  Synthetic
ggctttcattccuctgaaggattttuct

SEQ ID NO: 91548 - DNA, 20 bp, Artificial Sequence
  Synthetic
caagagcaccugaccucaca

SEQ ID NO: 91549 - DNA, 17 bp, Artificial Sequence
  Synthetic
ttgccuggccagccuac

SEQ ID NO: 91550 - DNA, 28 bp, Artificial Sequence
  Synthetic
cttgtcattcugcttcatatttuagcgt

SEQ ID NO: 91551 - DNA, 20 bp, Artificial Sequence
  Synthetic
ctctgacccgcuctctucag

SEQ ID NO: 91552 - DNA, 20 bp, Artificial Sequence
  Synthetic
cactctccuctgcctccuca

SEQ ID NO: 91553 - DNA, 19 bp, Artificial Sequence
  Synthetic
cctcuggtgggucggaact

SEQ ID NO: 91554 - DNA, 21 bp, Artificial Sequence
  Synthetic
cacctgcaccaaucacctcut

SEQ ID NO: 91555 - DNA, 23 bp, Artificial Sequence
  Synthetic
ccgagtccagugggagttaatuc

SEQ ID NO: 91556 - DNA, 19 bp, Artificial Sequence
  Synthetic
ccucctcuagcaggcggat

SEQ ID NO: 91557 - DNA, 23 bp, Artificial Sequence
  Synthetic
ctccttgugaagacatgguccaa

SEQ ID NO: 91558 - DNA, 24 bp, Artificial Sequence
  Synthetic
ctgagtaacuccttcccattugct

SEQ ID NO: 91559 - DNA, 24 bp, Artificial Sequence
  Synthetic
ccagaattccuatgggtcacucac

SEQ ID NO: 91560 - DNA, 19 bp, Artificial Sequence
  Synthetic
ctgccuggagggcttcuac

SEQ ID NO: 91561 - DNA, 26 bp, Artificial Sequence
  Synthetic
ggaaaaacaagucactccaaaugcaa

SEQ ID NO: 91562 - DNA, 27 bp, Artificial Sequence
  Synthetic
aatttcagtgaugtgtgtggaattugg

SEQ ID NO: 91563 - DNA, 24 bp, Artificial Sequence
  Synthetic
attattgaauggaggctgccauga

SEQ ID NO: 91564 - DNA, 26 bp, Artificial Sequence
  Synthetic
tcccaguatcactatuccagaaacca

SEQ ID NO: 91565 - DNA, 25 bp, Artificial Sequence
  Synthetic
gacttcaaaguggagttccugagaa

SEQ ID NO: 91566 - DNA, 27 bp, Artificial Sequence
  Synthetic
acattatgtttcugcacctagttgugt

SEQ ID NO: 91567 - DNA, 21 bp, Artificial Sequence
  Synthetic
ttccaggaagcautgccauca

SEQ ID NO: 91568 - DNA, 23 bp, Artificial Sequence
  Synthetic
ccautgggagtuaaaaggcacaa

SEQ ID NO: 91569 - DNA, 29 bp, Artificial Sequence
  Synthetic
agagattgaggcaguctaatagttuacga

SEQ ID NO: 91570 - DNA, 20 bp, Artificial Sequence
  Synthetic
accgggaauctccagcucat

SEQ ID NO: 91571 - DNA, 28 bp, Artificial Sequence
  Synthetic
ggttctaaactacugagaatgaagcuca

SEQ ID NO: 91572 - DNA, 21 bp, Artificial Sequence
  Synthetic
gggaagtgacugtagcctgug

SEQ ID NO: 91573 - DNA, 25 bp, Artificial Sequence
  Synthetic
aggctgaagcucttgccatttauag

SEQ ID NO: 91574 - DNA, 25 bp, Artificial Sequence
  Synthetic
ctaaggcuccaaacaataagugcaa

SEQ ID NO: 91575 - DNA, 22 bp, Artificial Sequence
  Synthetic
cagtgtaccucatcctgtcucc

SEQ ID NO: 91576 - DNA, 24 bp, Artificial Sequence
  Synthetic
gctcacgucacctcttcttttcua

SEQ ID NO: 91577 - DNA, 21 bp, Artificial Sequence
  Synthetic
agcagtgagguggtactcuga

SEQ ID NO: 91578 - DNA, 27 bp, Artificial Sequence
  Synthetic
aggagtcacuccaggaatauacaagaa

SEQ ID NO: 91579 - DNA, 28 bp, Artificial Sequence
  Synthetic
ctcttggcacuctcttaacttgttuact

SEQ ID NO: 91580 - DNA, 26 bp, Artificial Sequence
  Synthetic
catgttggtaaugtcgttgaagucac

SEQ ID NO: 91581 - DNA, 28 bp, Artificial Sequence
  Synthetic
tccaaagtccaaacuaaacatcagtcut

SEQ ID NO: 91582 - DNA, 21 bp, Artificial Sequence
  Synthetic
ggagaggagcagccutgaauc

SEQ ID NO: 91583 - DNA, 23 bp, Artificial Sequence
  Synthetic
ggaggtgtcuctctttctcccua

SEQ ID NO: 91584 - DNA, 21 bp, Artificial Sequence
  Synthetic
tcaccagcuacatggcctcua

SEQ ID NO: 91585 - DNA, 23 bp, Artificial Sequence
  Synthetic
ctgctcttuccagtaccuccaag

SEQ ID NO: 91586 - DNA, 28 bp, Artificial Sequence
  Synthetic
acaaggctcucattttacatugcaaaaa

SEQ ID NO: 91587 - DNA, 25 bp, Artificial Sequence
  Synthetic
ttcatggaaaauggagccctagaug

SEQ ID NO: 91588 - DNA, 25 bp, Artificial Sequence
  Synthetic
cttgctcttutgggtgttatucagt

SEQ ID NO: 91589 - DNA, 25 bp, Artificial Sequence
  Synthetic
ggtcttgtguccttcaaattctucc

SEQ ID NO: 91590 - DNA, 21 bp, Artificial Sequence
  Synthetic
tgaaugggaccaucaccaacc

SEQ ID NO: 91591 - DNA, 25 bp, Artificial Sequence
  Synthetic
gcggcatugctggtttaatttugaa

SEQ ID NO: 91592 - DNA, 28 bp, Artificial Sequence
  Synthetic
atcactttggtacutaccctgagaaaug

SEQ ID NO: 91593 - DNA, 21 bp, Artificial Sequence
  Synthetic
cctccagcucaggtuacgact

SEQ ID NO: 91594 - DNA, 28 bp, Artificial Sequence
  Synthetic
ttggagaaugacaggaucaagaaaaaga

SEQ ID NO: 91595 - DNA, 21 bp, Artificial Sequence
  Synthetic
aattcgagucgggaagucacc

SEQ ID NO: 91596 - DNA, 26 bp, Artificial Sequence
  Synthetic
cctatugaaagacagcagaucaagac

SEQ ID NO: 91597 - DNA, 24 bp, Artificial Sequence
  Synthetic
gaacagcuggaaaaatggacugaa

SEQ ID NO: 91598 - DNA, 22 bp, Artificial Sequence
  Synthetic
aagtggtugggctgacatugat

SEQ ID NO: 91599 - DNA, 24 bp, Artificial Sequence
  Synthetic
tgaggauaggaattcacucaggct

SEQ ID NO: 91600 - DNA, 21 bp, Artificial Sequence
  Synthetic
caggcatcucaccatgcucat

SEQ ID NO: 91601 - DNA, 22 bp, Artificial Sequence
  Synthetic
tcgatctcucaacacgttgucc

SEQ ID NO: 91602 - DNA, 23 bp, Artificial Sequence
  Synthetic
ttgcccttcacutcttccatgut

SEQ ID NO: 91603 - DNA, 21 bp, Artificial Sequence
  Synthetic
cugaggaaagctucccacaga

SEQ ID NO: 91604 - DNA, 20 bp, Artificial Sequence
  Synthetic
ggcuggaccgggagaatauc

SEQ ID NO: 91605 - DNA, 20 bp, Artificial Sequence
  Synthetic
gaacaaccgaugcgugaaca

SEQ ID NO: 91606 - DNA, 26 bp, Artificial Sequence
  Synthetic
tttttctggtguggtctctgaaugaa

SEQ ID NO: 91607 - DNA, 25 bp, Artificial Sequence
  Synthetic
ggaaacaccaaucatgugaaacagt

SEQ ID NO: 91608 - DNA, 21 bp, Artificial Sequence
  Synthetic
gcaaaaucctgugacacagca

SEQ ID NO: 91609 - DNA, 20 bp, Artificial Sequence
  Synthetic
accccagugacaggauggaa

SEQ ID NO: 91610 - DNA, 21 bp, Artificial Sequence
  Synthetic
aauggacacagggagtugacc

SEQ ID NO: 91611 - DNA, 28 bp, Artificial Sequence
  Synthetic
gcttgggagcacutcacatatacttuat

SEQ ID NO: 91612 - DNA, 21 bp, Artificial Sequence
  Synthetic
gtctgugccaagccatgatut

SEQ ID NO: 91613 - DNA, 24 bp, Artificial Sequence
  Synthetic
gaatacagcugacagtctcucagg

SEQ ID NO: 91614 - DNA, 23 bp, Artificial Sequence
  Synthetic
aagcutttgtgctugcaaaggaa

SEQ ID NO: 91615 - DNA, 24 bp, Artificial Sequence
  Synthetic
ctcttccattcuaggctacagcuc

SEQ ID NO: 91616 - DNA, 19 bp, Artificial Sequence
  Synthetic
ctccgaggcccagaugtug

SEQ ID NO: 91617 - DNA, 20 bp, Artificial Sequence
  Synthetic
agutcggatccuacccgagt

SEQ ID NO: 91618 - DNA, 26 bp, Artificial Sequence
  Synthetic
tgactttggagggaauttgacatcut

SEQ ID NO: 91619 - DNA, 23 bp, Artificial Sequence
  Synthetic
cacccctattugggcttcagaut

SEQ ID NO: 91620 - DNA, 24 bp, Artificial Sequence
  Synthetic
accttgttgcuttcgtggatcaua

SEQ ID NO: 91621 - DNA, 29 bp, Artificial Sequence
  Synthetic
tcatggaaattatgugttctggactgaut

SEQ ID NO: 91622 - DNA, 25 bp, Artificial Sequence
  Synthetic
tgatatcttcutcctgctctugcac

SEQ ID NO: 91623 - DNA, 24 bp, Artificial Sequence
  Synthetic
agcttcctatucctgagtctguga

SEQ ID NO: 91624 - DNA, 23 bp, Artificial Sequence
  Synthetic
agutcatgacgugaacgacaact

SEQ ID NO: 91625 - DNA, 22 bp, Artificial Sequence
  Synthetic
cagtgaaguggctgatgugaga

SEQ ID NO: 91626 - DNA, 25 bp, Artificial Sequence
  Synthetic
gctggcgaauacacttattactucc

SEQ ID NO: 91627 - DNA, 25 bp, Artificial Sequence
  Synthetic
aggaaaacgacaaacaaugguacct

SEQ ID NO: 91628 - DNA, 21 bp, Artificial Sequence
  Synthetic
cacgtttuggacctccaacug

SEQ ID NO: 91629 - DNA, 28 bp, Artificial Sequence
  Synthetic
ccttccatctcutatcagtgacatucat

SEQ ID NO: 91630 - DNA, 22 bp, Artificial Sequence
  Synthetic
tggaacuccagagcuccagaat

SEQ ID NO: 91631 - DNA, 27 bp, Artificial Sequence
  Synthetic
ggaaaagctgaguataatgcctctcut

SEQ ID NO: 91632 - DNA, 27 bp, Artificial Sequence
  Synthetic
tgcaagaagacagacucaattatgugt

SEQ ID NO: 91633 - DNA, 22 bp, Artificial Sequence
  Synthetic
tgaagatggugcatcctuggag

SEQ ID NO: 91634 - DNA, 20 bp, Artificial Sequence
  Synthetic
gctgtcacagugatccggua

SEQ ID NO: 91635 - DNA, 24 bp, Artificial Sequence
  Synthetic
ccaguggaaaaacagaatggcaut

SEQ ID NO: 91636 - DNA, 21 bp, Artificial Sequence
  Synthetic
cgcagggauttcacaaagugg

SEQ ID NO: 91637 - DNA, 26 bp, Artificial Sequence
  Synthetic
cactcaugtttctgacucaagggaaa

SEQ ID NO: 91638 - DNA, 28 bp, Artificial Sequence
  Synthetic
caatgtcaccucacttgttatcaaauct

SEQ ID NO: 91639 - DNA, 27 bp, Artificial Sequence
  Synthetic
ggtcagttcugatttttcacaatgugt

SEQ ID NO: 91640 - DNA, 21 bp, Artificial Sequence
  Synthetic
cccctgtgucgaaagcaugaa

SEQ ID NO: 91641 - DNA, 27 bp, Artificial Sequence
  Synthetic
acttggttgaaucttactgaccttugt

SEQ ID NO: 91642 - DNA, 28 bp, Artificial Sequence
  Synthetic
ccattgattcugttacttctgcucagat

SEQ ID NO: 91643 - DNA, 22 bp, Artificial Sequence
  Synthetic
cgggagcaugaaaagcaucaac

SEQ ID NO: 91644 - DNA, 25 bp, Artificial Sequence
  Synthetic
agaataaugaagagagggcttgcug

SEQ ID NO: 91645 - DNA, 23 bp, Artificial Sequence
  Synthetic
acagacaccucctcggctauaat

SEQ ID NO: 91646 - DNA, 28 bp, Artificial Sequence
  Synthetic
cagtgtacttgauggagtattcagugat

SEQ ID NO: 91647 - DNA, 28 bp, Artificial Sequence
  Synthetic
cctgtcctttcacutaaatcctccttua

SEQ ID NO: 91648 - DNA, 21 bp, Artificial Sequence
  Synthetic
gtcagtgcutgtcctgucgaa

SEQ ID NO: 91649 - DNA, 22 bp, Artificial Sequence
  Synthetic
caccugaacagttccatugcag

SEQ ID NO: 91650 - DNA, 28 bp, Artificial Sequence
  Synthetic
acaatgtaaugctttctatcugcagact

SEQ ID NO: 91651 - DNA, 21 bp, Artificial Sequence
  Synthetic
gaaccagagagugggcttuca

SEQ ID NO: 91652 - DNA, 28 bp, Artificial Sequence
  Synthetic
tgtgataccuctatctttaauccgcaga

SEQ ID NO: 91653 - DNA, 22 bp, Artificial Sequence
  Synthetic
atgguagagagggcauccagat

SEQ ID NO: 91654 - DNA, 22 bp, Artificial Sequence
  Synthetic
cagccucagggugaagagaaac

SEQ ID NO: 91655 - DNA, 22 bp, Artificial Sequence
  Synthetic
tcagaaacugtgccctttucct

SEQ ID NO: 91656 - DNA, 26 bp, Artificial Sequence
  Synthetic
accttgggaauggttaatttccugaa

SEQ ID NO: 91657 - DNA, 22 bp, Artificial Sequence
  Synthetic
agcgaggugtagttgaaaugct

SEQ ID NO: 91658 - DNA, 23 bp, Artificial Sequence
  Synthetic
aggcacttcacutgagtctctuc

SEQ ID NO: 91659 - DNA, 27 bp, Artificial Sequence
  Synthetic
acatgctttgtgutttctgtgtttgut

SEQ ID NO: 91660 - DNA, 27 bp, Artificial Sequence
  Synthetic
gaaagaaaaggauccaaaaagccucat

SEQ ID NO: 91661 - DNA, 21 bp, Artificial Sequence
  Synthetic
caccagguttggaaugggaca

SEQ ID NO: 91662 - DNA, 20 bp, Artificial Sequence
  Synthetic
ggacccguacttuggagcat

SEQ ID NO: 91663 - DNA, 22 bp, Artificial Sequence
  Synthetic
cccagaaggagaacuccuaccc

SEQ ID NO: 91664 - DNA, 18 bp, Artificial Sequence
  Synthetic
acgcacccgagugaauga

SEQ ID NO: 91665 - DNA, 19 bp, Artificial Sequence
  Synthetic
ggagcccaggaccucauct

SEQ ID NO: 91666 - DNA, 21 bp, Artificial Sequence
  Synthetic
aggctutgatcccucaggaac

SEQ ID NO: 91667 - DNA, 25 bp, Artificial Sequence
  Synthetic
gttgagggcacaugcagtagataut

SEQ ID NO: 91668 - DNA, 21 bp, Artificial Sequence
  Synthetic
gggttatgccugagcagttug

SEQ ID NO: 91669 - DNA, 27 bp, Artificial Sequence
  Synthetic
aaacagaatggguagtcaaggaagaug

SEQ ID NO: 91670 - DNA, 21 bp, Artificial Sequence
  Synthetic
gtacuccttgctuagcggaca

SEQ ID NO: 91671 - DNA, 22 bp, Artificial Sequence
  Synthetic
gtctagccutggctcacuaacc

SEQ ID NO: 91672 - DNA, 19 bp, Artificial Sequence
  Synthetic
gaagggccutaccgtcugt

SEQ ID NO: 91673 - DNA, 17 bp, Artificial Sequence
  Synthetic
cttccggcucgaucggt

SEQ ID NO: 91674 - DNA, 23 bp, Artificial Sequence
  Synthetic
gggttctccacutgatttccaut

SEQ ID NO: 91675 - DNA, 28 bp, Artificial Sequence
  Synthetic
gtttttcagcugtgagtttattctugct

SEQ ID NO: 91676 - DNA, 24 bp, Artificial Sequence
  Synthetic
tgttcccttcuccctctgttctua

SEQ ID NO: 91677 - DNA, 25 bp, Artificial Sequence
  Synthetic
gtccgatcuttcttaatcgucagga

SEQ ID NO: 91678 - DNA, 17 bp, Artificial Sequence
  Synthetic
cccgccuccaagtcuca

SEQ ID NO: 91679 - DNA, 18 bp, Artificial Sequence
  Synthetic
caggcccuacugcaaggt

SEQ ID NO: 91680 - DNA, 25 bp, Artificial Sequence
  Synthetic
agacaccucacttaggtagucacat

SEQ ID NO: 91681 - DNA, 26 bp, Artificial Sequence
  Synthetic
gctagcccacgcuaattatactttug

SEQ ID NO: 91682 - DNA, 23 bp, Artificial Sequence
  Synthetic
tttgttctcccuctgagcugaac

SEQ ID NO: 91683 - DNA, 24 bp, Artificial Sequence
  Synthetic
aggtagtgguaggaggaacaacuc

SEQ ID NO: 91684 - DNA, 17 bp, Artificial Sequence
  Synthetic
accucgugcagcagcaa

SEQ ID NO: 91685 - DNA, 19 bp, Artificial Sequence
  Synthetic
ccaccugaccactcctguc

SEQ ID NO: 91686 - DNA, 24 bp, Artificial Sequence
  Synthetic
gcacacaauacacacacatgcaut

SEQ ID NO: 91687 - DNA, 28 bp, Artificial Sequence
  Synthetic
atccctuagaaaaggaacaaaagctuct

SEQ ID NO: 91688 - DNA, 28 bp, Artificial Sequence
  Synthetic
ggagaatcagaagcutttgttcctttuc

SEQ ID NO: 91689 - DNA, 28 bp, Artificial Sequence
  Synthetic
gactcctccauatagtctactucacagt

SEQ ID NO: 91690 - DNA, 21 bp, Artificial Sequence
  Synthetic
gacccccgutgaagaaaguga

SEQ ID NO: 91691 - DNA, 28 bp, Artificial Sequence
  Synthetic
catatgtaaacacugacatgcagucaat

SEQ ID NO: 91692 - DNA, 23 bp, Artificial Sequence
  Synthetic
tgaatgctgugctgggaauaagt

SEQ ID NO: 91693 - DNA, 23 bp, Artificial Sequence
  Synthetic
gacagaagcuatccaggctguag

SEQ ID NO: 91694 - DNA, 20 bp, Artificial Sequence
  Synthetic
cttgcctcugcagtctguct

SEQ ID NO: 91695 - DNA, 25 bp, Artificial Sequence
  Synthetic
tgtgttgagtgugtttgatctcuga

SEQ ID NO: 91696 - DNA, 28 bp, Artificial Sequence
  Synthetic
ggtaaaccaaacaacutccacctcuaaa

SEQ ID NO: 91697 - DNA, 28 bp, Artificial Sequence
  Synthetic
ctgtcttactgucattcgaagagagtua

SEQ ID NO: 91698 - DNA, 28 bp, Artificial Sequence
  Synthetic
tcagaaactccauttacagcttcaacut

SEQ ID NO: 91699 - DNA, 25 bp, Artificial Sequence
  Synthetic
agaatattgtguaagcggtgcagut

SEQ ID NO: 91700 - DNA, 17 bp, Artificial Sequence
  Synthetic
cctuccccaggcucacc

SEQ ID NO: 91701 - DNA, 17 bp, Artificial Sequence
  Synthetic
agcgugcggttccugaa

SEQ ID NO: 91702 - DNA, 24 bp, Artificial Sequence
  Synthetic
ctctctttacagcuccatcaccug

SEQ ID NO: 91703 - DNA, 23 bp, Artificial Sequence
  Synthetic
acagcccaacccutaaacatugt

SEQ ID NO: 91704 - DNA, 20 bp, Artificial Sequence
  Synthetic
gcagcaaauccatgccacua

SEQ ID NO: 91705 - DNA, 21 bp, Artificial Sequence
  Synthetic
ccgaugacttcacauccaggt

SEQ ID NO: 91706 - DNA, 19 bp, Artificial Sequence
  Synthetic
ctcugcccggttttcugac

SEQ ID NO: 91707 - DNA, 20 bp, Artificial Sequence
  Synthetic
ttgcaaggcaggcuagugat

SEQ ID NO: 91708 - DNA, 28 bp, Artificial Sequence
  Synthetic
gatccaagaaguaagttctctggctuaa

SEQ ID NO: 91709 - DNA, 24 bp, Artificial Sequence
  Synthetic
tgtgttccttucggaagagatguc

SEQ ID NO: 91710 - DNA, 31 bp, Artificial Sequence
  Synthetic
ttttcctgtggautttaatagaacatcuggt

SEQ ID NO: 91711 - DNA, 28 bp, Artificial Sequence
  Synthetic
ccagtcatagucaaatcgctttagtugt

SEQ ID NO: 91712 - DNA, 21 bp, Artificial Sequence
  Synthetic
gataccguaaagcgcttgcug

SEQ ID NO: 91713 - DNA, 22 bp, Artificial Sequence
  Synthetic
acacctgcaacugtgtaaggut

SEQ ID NO: 91714 - DNA, 21 bp, Artificial Sequence
  Synthetic
ctgctctagccugccttctua

SEQ ID NO: 91715 - DNA, 21 bp, Artificial Sequence
  Synthetic
ccuccccacuccaaaccaaac

SEQ ID NO: 91716 - DNA, 20 bp, Artificial Sequence
  Synthetic
ccgtctucccctatggtcug

SEQ ID NO: 91717 - DNA, 20 bp, Artificial Sequence
  Synthetic
caggagacgagcuggugaag

SEQ ID NO: 91718 - DNA, 24 bp, Artificial Sequence
  Synthetic
caacacaacaaggcuctgugaaaa

SEQ ID NO: 91719 - DNA, 26 bp, Artificial Sequence
  Synthetic
tctggacttucacaccaacacatuat

SEQ ID NO: 91720 - DNA, 29 bp, Artificial Sequence
  Synthetic
acccaactuatatgttttatgugccagaa

SEQ ID NO: 91721 - DNA, 25 bp, Artificial Sequence
  Synthetic
agtaagttggaucaaggaggaguga

SEQ ID NO: 91722 - DNA, 28 bp, Artificial Sequence
  Synthetic
accttaaagagcagutcaggatuagaga

SEQ ID NO: 91723 - DNA, 33 bp, Artificial Sequence
  Synthetic
tattgatttttggaagauatttgattgccuaaa

SEQ ID NO: 91724 - DNA, 23 bp, Artificial Sequence
  Synthetic
gttacucccacagggaacacaut

SEQ ID NO: 91725 - DNA, 22 bp, Artificial Sequence
  Synthetic
catcugcaccacagaaccucat

SEQ ID NO: 91726 - DNA, 27 bp, Artificial Sequence
  Synthetic
cctaaccccaggauggtataattggua

SEQ ID NO: 91727 - DNA, 21 bp, Artificial Sequence
  Synthetic
gtgtgauggagaggacgacug

SEQ ID NO: 91728 - DNA, 21 bp, Artificial Sequence
  Synthetic
gggctgtuaccactggaacuc

SEQ ID NO: 91729 - DNA, 21 bp, Artificial Sequence
  Synthetic
gacgggtcagucctggattua

SEQ ID NO: 91730 - DNA, 27 bp, Artificial Sequence
  Synthetic
tuttgagcaacaucaacaacagacaat

SEQ ID NO: 91731 - DNA, 21 bp, Artificial Sequence
  Synthetic
gaacucaccccatgtgaugga

SEQ ID NO: 91732 - DNA, 22 bp, Artificial Sequence
  Synthetic
gtgaagucactggcatugaggt

SEQ ID NO: 91733 - DNA, 28 bp, Artificial Sequence
  Synthetic
gaggatgaaacuctgtaaggtggatuaa

SEQ ID NO: 91734 - DNA, 23 bp, Artificial Sequence
  Synthetic
gaatttccucgagagcuggacat

SEQ ID NO: 91735 - DNA, 24 bp, Artificial Sequence
  Synthetic
agtctgtattutgtgcttccugct

SEQ ID NO: 91736 - DNA, 24 bp, Artificial Sequence
  Synthetic
gatcguaataggcaucacaccagt

SEQ ID NO: 91737 - DNA, 22 bp, Artificial Sequence
  Synthetic
gattgagaaggccuggauggat

SEQ ID NO: 91738 - DNA, 21 bp, Artificial Sequence
  Synthetic
ggagctgggcuggatctctua

SEQ ID NO: 91739 - DNA, 27 bp, Artificial Sequence
  Synthetic
gtcaccagaaguacaagagttctctut

SEQ ID NO: 91740 - DNA, 27 bp, Artificial Sequence
  Synthetic
cttactgtgguttggttgatgtugaaa

SEQ ID NO: 91741 - DNA, 21 bp, Artificial Sequence
  Synthetic
gccccacacagaucctttugt

SEQ ID NO: 91742 - DNA, 25 bp, Artificial Sequence
  Synthetic
aggtatcagugatgtctgcattucc

SEQ ID NO: 91743 - DNA, 28 bp, Artificial Sequence
  Synthetic
acttgggaacatucaaacttggaaguaa

SEQ ID NO: 91744 - DNA, 22 bp, Artificial Sequence
  Synthetic
ggcttcaucagagttgtcucca

SEQ ID NO: 91745 - DNA, 28 bp, Artificial Sequence
  Synthetic
ggcactgattacuctgaatctctttgut

SEQ ID NO: 91746 - DNA, 26 bp, Artificial Sequence
  Synthetic
gatttctcttugggacaacagucaag

SEQ ID NO: 91747 - DNA, 28 bp, Artificial Sequence
  Synthetic
ccacagtataucctaagggaatucaagg

SEQ ID NO: 91748 - DNA, 27 bp, Artificial Sequence
  Synthetic
cattcgcgtauctattctttggttugt

SEQ ID NO: 91749 - DNA, 28 bp, Artificial Sequence
  Synthetic
ctggtggtttucagtattgattttgugt

SEQ ID NO: 91750 - DNA, 24 bp, Artificial Sequence
  Synthetic
agagtgagcaguctgaaagugaga

SEQ ID NO: 91751 - DNA, 27 bp, Artificial Sequence
  Synthetic
tcaccaucatcaaatttauaccagcga

SEQ ID NO: 91752 - DNA, 22 bp, Artificial Sequence
  Synthetic
tgcaatguccattggtguccaa

SEQ ID NO: 91753 - DNA, 24 bp, Artificial Sequence
  Synthetic
gaaggaccaaaaugtgaggtugac

SEQ ID NO: 91754 - DNA, 25 bp, Artificial Sequence
  Synthetic
tcacaaaaatcugccgattgaaucc

SEQ ID NO: 91755 - DNA, 28 bp, Artificial Sequence
  Synthetic
ggctggttgtaauaacatgtatgcatut

SEQ ID NO: 91756 - DNA, 24 bp, Artificial Sequence
  Synthetic
tcccattucagcatgctcaauaca

SEQ ID NO: 91757 - DNA, 22 bp, Artificial Sequence
  Synthetic
gtctgccugtaaacagctucac

SEQ ID NO: 91758 - DNA, 22 bp, Artificial Sequence
  Synthetic
caacttacccuggcatctguga

SEQ ID NO: 91759 - DNA, 20 bp, Artificial Sequence
  Synthetic
gucaccaatacuggccagca

SEQ ID NO: 91760 - DNA, 27 bp, Artificial Sequence
  Synthetic
tgtacaagtacagguttgtcacatuga

SEQ ID NO: 91761 - DNA, 28 bp, Artificial Sequence
  Synthetic
aattaagaaaactcuactggaccgaugg

SEQ ID NO: 91762 - DNA, 26 bp, Artificial Sequence
  Synthetic
aatatattaugcagaagcccagcuct

SEQ ID NO: 91763 - DNA, 28 bp, Artificial Sequence
  Synthetic
agctcacctaauttactgttttgucaca

SEQ ID NO: 91764 - DNA, 23 bp, Artificial Sequence
  Synthetic
ggaatgguggagatggugagaga

SEQ ID NO: 91765 - DNA, 20 bp, Artificial Sequence
  Synthetic
ccttttcuggcgcctgtaug

SEQ ID NO: 91766 - DNA, 22 bp, Artificial Sequence
  Synthetic
attgtgttuccatcgguccagt

SEQ ID NO: 91767 - DNA, 28 bp, Artificial Sequence
  Synthetic
ggacaatttuggagttttcugaaaagaa

SEQ ID NO: 91768 - DNA, 21 bp, Artificial Sequence
  Synthetic
cccatggcaccutacacacut

SEQ ID NO: 91769 - DNA, 27 bp, Artificial Sequence
  Synthetic
gccaccactautgtgtgaattcugaat

SEQ ID NO: 91770 - DNA, 25 bp, Artificial Sequence
  Synthetic
attcaacacutccatcauccccaat

SEQ ID NO: 91771 - DNA, 31 bp, Artificial Sequence
  Synthetic
aaatgaaagggucaccttaattatgacugaa

SEQ ID NO: 91772 - DNA, 19 bp, Artificial Sequence
  Synthetic
ggtggacgcccugaagaug

SEQ ID NO: 91773 - DNA, 21 bp, Artificial Sequence
  Synthetic
tctctatggcagguctgggut

SEQ ID NO: 91774 - DNA, 21 bp, Artificial Sequence
  Synthetic
tgctggacuggtgagctctua

SEQ ID NO: 91775 - DNA, 21 bp, Artificial Sequence
  Synthetic
tgcggatggugttcaggttut

SEQ ID NO: 91776 - DNA, 27 bp, Artificial Sequence
  Synthetic
tccacaacaacacutgtcatactucaa

SEQ ID NO: 91777 - DNA, 27 bp, Artificial Sequence
  Synthetic
tgtaattccaacggutctgtatgtguc

SEQ ID NO: 91778 - DNA, 22 bp, Artificial Sequence
  Synthetic
gaagcuccagatcaaucagggt

SEQ ID NO: 91779 - DNA, 28 bp, Artificial Sequence
  Synthetic
gcacctgtgatucaatgattttgtguat

SEQ ID NO: 91780 - DNA, 28 bp, Artificial Sequence
  Synthetic
cttaatgagccuttacctacatgtucca

SEQ ID NO: 91781 - DNA, 28 bp, Artificial Sequence
  Synthetic
tcatgtgggaagutatgtcttauggaga

SEQ ID NO: 91782 - DNA, 28 bp, Artificial Sequence
  Synthetic
ttgatttgacatgucccaataaggtcut

SEQ ID NO: 91783 - DNA, 22 bp, Artificial Sequence
  Synthetic
autccagtaagguggacagcac

SEQ ID NO: 91784 - DNA, 21 bp, Artificial Sequence
  Synthetic
gctaccuccccagctttucaa

SEQ ID NO: 91785 - DNA, 21 bp, Artificial Sequence
  Synthetic
ccatuacaggacccggatgug

SEQ ID NO: 91786 - DNA, 23 bp, Artificial Sequence
  Synthetic
ttcctgatcauccaatggcaugt

SEQ ID NO: 91787 - DNA, 24 bp, Artificial Sequence
  Synthetic
cauttcagttggucagaggaacca

SEQ ID NO: 91788 - DNA, 22 bp, Artificial Sequence
  Synthetic
ggaagaagucagtggcuacgat

SEQ ID NO: 91789 - DNA, 22 bp, Artificial Sequence
  Synthetic
gctgcaguctctcacagugaag

SEQ ID NO: 91790 - DNA, 22 bp, Artificial Sequence
  Synthetic
atttccggtacuggatggctuc

SEQ ID NO: 91791 - DNA, 22 bp, Artificial Sequence
  Synthetic
gtagaccugatgctgcugaact

SEQ ID NO: 91792 - DNA, 28 bp, Artificial Sequence
  Synthetic
atgagaagacagugaataccttagucct

SEQ ID NO: 91793 - DNA, 27 bp, Artificial Sequence
  Synthetic
ggttactcttgcutgactctatgtuct

SEQ ID NO: 91794 - DNA, 26 bp, Artificial Sequence
  Synthetic
gtgtatgtgaaccugttggtttccua

SEQ ID NO: 91795 - DNA, 21 bp, Artificial Sequence
  Synthetic
acaugauccagcagagaaccc

SEQ ID NO: 91796 - DNA, 26 bp, Artificial Sequence
  Synthetic
ctggcctaattuctttggttgaaguc

SEQ ID NO: 91797 - DNA, 26 bp, Artificial Sequence
  Synthetic
tgactatatctacutcccagccucac

SEQ ID NO: 91798 - DNA, 26 bp, Artificial Sequence
  Synthetic
accaugaagattaugacccacaaact

SEQ ID NO: 91799 - DNA, 27 bp, Artificial Sequence
  Synthetic
ccaacaaagaccaagcuatacagtcua

SEQ ID NO: 91800 - DNA, 29 bp, Artificial Sequence
  Synthetic
ctgatagcctgacucttaagttcattuca

SEQ ID NO: 91801 - DNA, 24 bp, Artificial Sequence
  Synthetic
gcgcacaatguagtaactcaggut

SEQ ID NO: 91802 - DNA, 28 bp, Artificial Sequence
  Synthetic
tcaactggctautttgaaattcctugat

SEQ ID NO: 91803 - DNA, 28 bp, Artificial Sequence
  Synthetic
cagtctaggaaaaautgaaaggtgugaa

SEQ ID NO: 91804 - DNA, 22 bp, Artificial Sequence
  Synthetic
cccaucgcatcuacacagagat

SEQ ID NO: 91805 - DNA, 21 bp, Artificial Sequence
  Synthetic
ccucagaccagaaggcugact

SEQ ID NO: 91806 - DNA, 25 bp, Artificial Sequence
  Synthetic
agctcttgggucagtccttatttuc

SEQ ID NO: 91807 - DNA, 24 bp, Artificial Sequence
  Synthetic
gcctgggcauagagtaccattcua

SEQ ID NO: 91808 - DNA, 23 bp, Artificial Sequence
  Synthetic
acatgtctcugggatccatcgua

SEQ ID NO: 91809 - DNA, 28 bp, Artificial Sequence
  Synthetic
tcatgagatcuactctgacugggaaaaa

SEQ ID NO: 91810 - DNA, 25 bp, Artificial Sequence
  Synthetic
agcttgtcacucaatatttgccuct

SEQ ID NO: 91811 - DNA, 23 bp, Artificial Sequence
  Synthetic
agaattccuccaggcttctcuca

SEQ ID NO: 91812 - DNA, 23 bp, Artificial Sequence
  Synthetic
cctaaagguaaaaggugcaccct

SEQ ID NO: 91813 - DNA, 22 bp, Artificial Sequence
  Synthetic
ggacctccaccuctgagctaut

SEQ ID NO: 91814 - DNA, 21 bp, Artificial Sequence
  Synthetic
gtacugaccaccactugagca

SEQ ID NO: 91815 - DNA, 27 bp, Artificial Sequence
  Synthetic
atagcttggtatugccatgtttctaut

SEQ ID NO: 91816 - DNA, 32 bp, Artificial Sequence
  Synthetic
gttttaaaagaagagaaucatgagaactuggg

SEQ ID NO: 91817 - DNA, 26 bp, Artificial Sequence
  Synthetic
tctttcaagttcauctccaagccaut

SEQ ID NO: 91818 - DNA, 20 bp, Artificial Sequence
  Synthetic
caggtgcgcuaacatcgaut

SEQ ID NO: 91819 - DNA, 28 bp, Artificial Sequence
  Synthetic
atgcggtaaattucggaaacacataaut

SEQ ID NO: 91820 - DNA, 27 bp, Artificial Sequence
  Synthetic
agcuattcccactauaagggagaaagg

SEQ ID NO: 91821 - DNA, 24 bp, Artificial Sequence
  Synthetic
agcttctacaacutggcagtctug

SEQ ID NO: 91822 - DNA, 21 bp, Artificial Sequence
  Synthetic
ccuaagaagcucacacccagt

SEQ ID NO: 91823 - DNA, 23 bp, Artificial Sequence
  Synthetic
gctcgcaacaucctagucaacag

SEQ ID NO: 91824 - DNA, 20 bp, Artificial Sequence
  Synthetic
caccccagacugcagacauc

SEQ ID NO: 91825 - DNA, 18 bp, Artificial Sequence
  Synthetic
gcatctccuggccctuca

SEQ ID NO: 91826 - DNA, 21 bp, Artificial Sequence
  Synthetic
gugccagttugacccagagat

SEQ ID NO: 91827 - DNA, 28 bp, Artificial Sequence
  Synthetic
agaagacatgaagacautgttcgagaut

SEQ ID NO: 91828 - DNA, 21 bp, Artificial Sequence
  Synthetic
tgaagtggaacccuccctcuc

SEQ ID NO: 91829 - DNA, 24 bp, Artificial Sequence
  Synthetic
gcacatuacaaccacaggaaugaa

SEQ ID NO: 91830 - DNA, 22 bp, Artificial Sequence
  Synthetic
gacuctgtcatugccaccaaga

SEQ ID NO: 91831 - DNA, 22 bp, Artificial Sequence
  Synthetic
autccgaguaagaggcccaaag

SEQ ID NO: 91832 - DNA, 27 bp, Artificial Sequence
  Synthetic
cagggcaauggagatctuaaaagaaag

SEQ ID NO: 91833 - DNA, 24 bp, Artificial Sequence
  Synthetic
accattggacguttcattgcttug

SEQ ID NO: 91834 - DNA, 21 bp, Artificial Sequence
  Synthetic
agacacttugcagacgaggut

SEQ ID NO: 91835 - DNA, 20 bp, Artificial Sequence
  Synthetic
ccacccuatctgctcuccag

SEQ ID NO: 91836 - DNA, 27 bp, Artificial Sequence
  Synthetic
aacacagagacaaaaccutttcaggua

SEQ ID NO: 91837 - DNA, 22 bp, Artificial Sequence
  Synthetic
gaggatccagacugtgcagaug

SEQ ID NO: 91838 - DNA, 28 bp, Artificial Sequence
  Synthetic
aatcctcaguacacttacaacaatuggt

SEQ ID NO: 91839 - DNA, 25 bp, Artificial Sequence
  Synthetic
ctcttccatutctatctgcugcaca

SEQ ID NO: 91840 - DNA, 24 bp, Artificial Sequence
  Synthetic
caactcaccugatttcatguccct

SEQ ID NO: 91841 - DNA, 24 bp, Artificial Sequence
  Synthetic
atagccaaccauccacctgatuac

SEQ ID NO: 91842 - DNA, 17 bp, Artificial Sequence
  Synthetic
tcccugaucggccacct

SEQ ID NO: 91843 - DNA, 24 bp, Artificial Sequence
  Synthetic
gggtgacaccuacttgataaacug

SEQ ID NO: 91844 - DNA, 26 bp, Artificial Sequence
  Synthetic
atgaagguaaacacagaagucaggag

SEQ ID NO: 91845 - DNA, 26 bp, Artificial Sequence
  Synthetic
tcatagtctcuggaaacacugcaaaa

SEQ ID NO: 91846 - DNA, 23 bp, Artificial Sequence
  Synthetic
agcagggaaaaugtactttgcut

SEQ ID NO: 91847 - DNA, 21 bp, Artificial Sequence
  Synthetic
acggtgtttuggatgctguca

SEQ ID NO: 91848 - DNA, 22 bp, Artificial Sequence
  Synthetic
ctgugagaccctgtgugaagac

SEQ ID NO: 91849 - DNA, 21 bp, Artificial Sequence
  Synthetic
agaacccuctggagugaggac

SEQ ID NO: 91850 - DNA, 25 bp, Artificial Sequence
  Synthetic
tgaactctguccagaggagguaaaa

SEQ ID NO: 91851 - DNA, 27 bp, Artificial Sequence
  Synthetic
ccagccgaauaaacattttucaaaacc

SEQ ID NO: 91852 - DNA, 20 bp, Artificial Sequence
  Synthetic
gcagttggccucgtctgaug

SEQ ID NO: 91853 - DNA, 28 bp, Artificial Sequence
  Synthetic
ctccaaagctacautttaatggcagtut

SEQ ID NO: 91854 - DNA, 28 bp, Artificial Sequence
  Synthetic
gactcaaagcaguctttcctactuaaca

SEQ ID NO: 91855 - DNA, 20 bp, Artificial Sequence
  Synthetic
gggttggtaucggaggcauc

SEQ ID NO: 91856 - DNA, 24 bp, Artificial Sequence
  Synthetic
tgctgugagaaaacaagugacagt

SEQ ID NO: 91857 - DNA, 27 bp, Artificial Sequence
  Synthetic
tgtataccctaaauttcagccacctug

SEQ ID NO: 91858 - DNA, 21 bp, Artificial Sequence
  Synthetic
gggcuactuagacccagagaa

SEQ ID NO: 91859 - DNA, 20 bp, Artificial Sequence
  Synthetic
ggcttggugaggagtgtguc

SEQ ID NO: 91860 - DNA, 28 bp, Artificial Sequence
  Synthetic
acatgtaaatgcauctcacctgtatcug

SEQ ID NO: 91861 - DNA, 28 bp, Artificial Sequence
  Synthetic
cccgcactacautgatgtactaattugt

SEQ ID NO: 91862 - DNA, 23 bp, Artificial Sequence
  Synthetic
gccagtgacautatcccaaggug

SEQ ID NO: 91863 - DNA, 28 bp, Artificial Sequence
  Synthetic
agattccatctaccutcattctcccuaa

SEQ ID NO: 91864 - DNA, 24 bp, Artificial Sequence
  Synthetic
atgagacacguttcaacacugact

SEQ ID NO: 91865 - DNA, 20 bp, Artificial Sequence
  Synthetic
gagacctuacgacgggtugg

SEQ ID NO: 91866 - DNA, 20 bp, Artificial Sequence
  Synthetic
cttacctuggaaggccguct

SEQ ID NO: 91867 - DNA, 22 bp, Artificial Sequence
  Synthetic
gcagtcgcuggagattatcuct

SEQ ID NO: 91868 - DNA, 23 bp, Artificial Sequence
  Synthetic
gcccaatacutcaagaaggugct

SEQ ID NO: 91869 - DNA, 20 bp, Artificial Sequence
  Synthetic
ggcaaggcacugagaagugt

SEQ ID NO: 91870 - DNA, 25 bp, Artificial Sequence
  Synthetic
tgaggcttaugatgagagugaggat

SEQ ID NO: 91871 - DNA, 26 bp, Artificial Sequence
  Synthetic
ctccaccctuggatttgtcatactua

SEQ ID NO: 91872 - DNA, 26 bp, Artificial Sequence
  Synthetic
ctttgtgagtucctttttgtgaccut

SEQ ID NO: 91873 - DNA, 27 bp, Artificial Sequence
  Synthetic
aatgtggatatgutttcagttgcaguc

SEQ ID NO: 91874 - DNA, 27 bp, Artificial Sequence
  Synthetic
acaatacattgacuccacactcttucc

SEQ ID NO: 91875 - DNA, 22 bp, Artificial Sequence
  Synthetic
agagggtggugtgacctcttua

SEQ ID NO: 91876 - DNA, 27 bp, Artificial Sequence
  Synthetic
tttatgttacuggaccaacctttgugt

SEQ ID NO: 91877 - DNA, 28 bp, Artificial Sequence
  Synthetic
ggaaccaaucagagtgttgtcauagaaa

SEQ ID NO: 91878 - DNA, 29 bp, Artificial Sequence
  Synthetic
acccggcctatuatttcatttcttacauc

SEQ ID NO: 91879 - DNA, 28 bp, Artificial Sequence
  Synthetic
acttgcatccagcuaaacctaaagatut

SEQ ID NO: 91880 - DNA, 23 bp, Artificial Sequence
  Synthetic
ccaccaggutaaugaaagccgaa

SEQ ID NO: 91881 - DNA, 28 bp, Artificial Sequence
  Synthetic
agtgattcgtgautgaatggtacaaugt

SEQ ID NO: 91882 - DNA, 21 bp, Artificial Sequence
  Synthetic
tgctucaccagcaguaccaaa

SEQ ID NO: 91883 - DNA, 28 bp, Artificial Sequence
  Synthetic
cgtguagaaagtaatcauggcaagaagt

SEQ ID NO: 91884 - DNA, 23 bp, Artificial Sequence
  Synthetic
gaccaguagatguaagccccaaa

SEQ ID NO: 91885 - DNA, 29 bp, Artificial Sequence
  Synthetic
aggaaaataaattguactggtgtgaugct

SEQ ID NO: 91886 - DNA, 23 bp, Artificial Sequence
  Synthetic
gttagctgucggtgaagttucca

SEQ ID NO: 91887 - DNA, 27 bp, Artificial Sequence
  Synthetic
tgatatugttagcccaucacggaaaaa

SEQ ID NO: 91888 - DNA, 18 bp, Artificial Sequence
  Synthetic
tgugcgagcaucacacca

SEQ ID NO: 91889 - DNA, 28 bp, Artificial Sequence
  Synthetic
actatgaggtcugttggatttctttuca

SEQ ID NO: 91890 - DNA, 20 bp, Artificial Sequence
  Synthetic
tctgggtgucagagccctua

SEQ ID NO: 91891 - DNA, 22 bp, Artificial Sequence
  Synthetic
cctgaucagcagcctttcctuc

SEQ ID NO: 91892 - DNA, 28 bp, Artificial Sequence
  Synthetic
gttagtgccauaggtctagaaatctugg

SEQ ID NO: 91893 - DNA, 28 bp, Artificial Sequence
  Synthetic
ctcccagagaauctgtaaacaaaaucag

SEQ ID NO: 91894 - DNA, 24 bp, Artificial Sequence
  Synthetic
gttaaaagugaagcatgucagcga

SEQ ID NO: 91895 - DNA, 28 bp, Artificial Sequence
  Synthetic
ctcacaggcaucactatgtaaatcugat

SEQ ID NO: 91896 - DNA, 28 bp, Artificial Sequence
  Synthetic
attaacacagagaaacutacttgggcut

SEQ ID NO: 91897 - DNA, 22 bp, Artificial Sequence
  Synthetic
gggtggcauatttaggctgcua

SEQ ID NO: 91898 - DNA, 21 bp, Artificial Sequence
  Synthetic
gtgagggccaagugaauggaa

SEQ ID NO: 91899 - DNA, 22 bp, Artificial Sequence
  Synthetic
actctggtucagtcagctucct

SEQ ID NO: 91900 - DNA, 24 bp, Artificial Sequence
  Synthetic
actcttttcucaatgtggctcucc

SEQ ID NO: 91901 - DNA, 21 bp, Artificial Sequence
  Synthetic
actgugcgccacattagugat

SEQ ID NO: 91902 - DNA, 23 bp, Artificial Sequence
  Synthetic
ctttggcaagutgcagactuagg

SEQ ID NO: 91903 - DNA, 28 bp, Artificial Sequence
  Synthetic
acggtccattuagaaacagaatttgcua

SEQ ID NO: 91904 - DNA, 25 bp, Artificial Sequence
  Synthetic
agacctggcacaaautcattagugt

SEQ ID NO: 91905 - DNA, 23 bp, Artificial Sequence
  Synthetic
gataagaaacugtggugggcaga

SEQ ID NO: 91906 - DNA, 25 bp, Artificial Sequence
  Synthetic
cacutcaacaccauacaaaagcaca

SEQ ID NO: 91907 - DNA, 28 bp, Artificial Sequence
  Synthetic
ccgatttaaugggactgatattcacuca

SEQ ID NO: 91908 - DNA, 28 bp, Artificial Sequence
  Synthetic
ggattccccaagcautctcaatttuaat

SEQ ID NO: 91909 - DNA, 29 bp, Artificial Sequence
  Synthetic
gttttgccctcuttataggttagacauct

SEQ ID NO: 91910 - DNA, 24 bp, Artificial Sequence
  Synthetic
aaatcagcccucatttggatguga

SEQ ID NO: 91911 - DNA, 23 bp, Artificial Sequence
  Synthetic
catcgagucatcactgcucaaca

SEQ ID NO: 91912 - DNA, 24 bp, Artificial Sequence
  Synthetic
gtggattttgaggauggacgtgua

SEQ ID NO: 91913 - DNA, 28 bp, Artificial Sequence
  Synthetic
cattattgagaagaacutcagcatuggg

SEQ ID NO: 91914 - DNA, 17 bp, Artificial Sequence
  Synthetic
agucccgcaccgguaga

SEQ ID NO: 91915 - DNA, 27 bp, Artificial Sequence
  Synthetic
caagaacttcuagattctggcagugat

SEQ ID NO: 91916 - DNA, 26 bp, Artificial Sequence
  Synthetic
auttccttctgtaauacacgagccat

SEQ ID NO: 91917 - DNA, 28 bp, Artificial Sequence
  Synthetic
caaatcaccaagaagaugggctactaua

SEQ ID NO: 91918 - DNA, 27 bp, Artificial Sequence
  Synthetic
tggcaccaatagautcattcagcaaua

SEQ ID NO: 91919 - DNA, 24 bp, Artificial Sequence
  Synthetic
aactcctcaagutttgcgctttut

SEQ ID NO: 91920 - DNA, 28 bp, Artificial Sequence
  Synthetic
cacgagccauggaaaacttgattaatut

SEQ ID NO: 91921 - DNA, 31 bp, Artificial Sequence
  Synthetic
cctttttgaagcuaaatgaatctaccttuga

SEQ ID NO: 91922 - DNA, 26 bp, Artificial Sequence
  Synthetic
gcccatcttcutggtgatttgaguat

SEQ ID NO: 91923 - DNA, 31 bp, Artificial Sequence
  Synthetic
gcatttttgactgutaaaattctgtctguct

SEQ ID NO: 91924 - DNA, 20 bp, Artificial Sequence
  Synthetic
gatgcacccutttcccguct

SEQ ID NO: 91925 - DNA, 19 bp, Artificial Sequence
  Synthetic
cacctggcuccactgtgua

SEQ ID NO: 91926 - DNA, 31 bp, Artificial Sequence
  Synthetic
gttttgcattcucacttttatatatgugcct

SEQ ID NO: 91927 - DNA, 27 bp, Artificial Sequence
  Synthetic
acaacacatccauggacttactugaat

SEQ ID NO: 91928 - DNA, 23 bp, Artificial Sequence
  Synthetic
gcccaggaacuaggaaagcaaug

SEQ ID NO: 91929 - DNA, 22 bp, Artificial Sequence
  Synthetic
tggugaaagggactguccagat

SEQ ID NO: 91930 - DNA, 25 bp, Artificial Sequence
  Synthetic
ggaattccagauctcagtgacugat

SEQ ID NO: 91931 - DNA, 21 bp, Artificial Sequence
  Synthetic
aatctgccaccugaaccugac

SEQ ID NO: 91932 - DNA, 21 bp, Artificial Sequence
  Synthetic
gcccacctutcgatctgacug

SEQ ID NO: 91933 - DNA, 21 bp, Artificial Sequence
  Synthetic
tcuaatccccugcacccaaga

SEQ ID NO: 91934 - DNA, 22 bp, Artificial Sequence
  Synthetic
tgggtcuaagggtacgtgugat

SEQ ID NO: 91935 - DNA, 20 bp, Artificial Sequence
  Synthetic
tggugtcctctuaccaggca

SEQ ID NO: 91936 - DNA, 26 bp, Artificial Sequence
  Synthetic
tcagaacattctcuagtaccccaguc

SEQ ID NO: 91937 - DNA, 23 bp, Artificial Sequence
  Synthetic
gaaautggtgatucgccaacagt

SEQ ID NO: 91938 - DNA, 21 bp, Artificial Sequence
  Synthetic
ctcgccagcccaucatgatua

SEQ ID NO: 91939 - DNA, 27 bp, Artificial Sequence
  Synthetic
tttaattcgcttuaggcattccatgug

SEQ ID NO: 91940 - DNA, 21 bp, Artificial Sequence
  Synthetic
gcctagauggaggtaccugga

SEQ ID NO: 91941 - DNA, 21 bp, Artificial Sequence
  Synthetic
caccggguctctgctttcuac

SEQ ID NO: 91942 - DNA, 28 bp, Artificial Sequence
  Synthetic
agttgctaatgggucagttttgtagaut

SEQ ID NO: 91943 - DNA, 24 bp, Artificial Sequence
  Synthetic
cgactcatgtucatctggagcauc

SEQ ID NO: 91944 - DNA, 21 bp, Artificial Sequence
  Synthetic
acacuacgagacccaggtuca

SEQ ID NO: 91945 - DNA, 23 bp, Artificial Sequence
  Synthetic
gcuggagatuaaaaacgccaaca

SEQ ID NO: 91946 - DNA, 23 bp, Artificial Sequence
  Synthetic
agtattgtttccutcgccctugt

SEQ ID NO: 91947 - DNA, 17 bp, Artificial Sequence
  Synthetic
ccuccuccggagccaga

SEQ ID NO: 91948 - DNA, 26 bp, Artificial Sequence
  Synthetic
ttcaaaatuaggagccagaugaccaa

SEQ ID NO: 91949 - DNA, 27 bp, Artificial Sequence
  Synthetic
gggataaaagcauaaactgactccugt

SEQ ID NO: 91950 - DNA, 27 bp, Artificial Sequence
  Synthetic
agagagagugtaagaaugaggaaacca

SEQ ID NO: 91951 - DNA, 20 bp, Artificial Sequence
  Synthetic
ctgggucctcttgauagcga

SEQ ID NO: 91952 - DNA, 28 bp, Artificial Sequence
  Synthetic
acacatugaacactcatuacagagacaa

SEQ ID NO: 91953 - DNA, 27 bp, Artificial Sequence
  Synthetic
ggagaacccuatgctattgcaguaaat

SEQ ID NO: 91954 - DNA, 28 bp, Artificial Sequence
  Synthetic
ctaagccatuaacctaccctctttuagg

SEQ ID NO: 91955 - DNA, 22 bp, Artificial Sequence
  Synthetic
ctcactggaccaguctgaggua

SEQ ID NO: 91956 - DNA, 28 bp, Artificial Sequence
  Synthetic
catcccaaauaaaaggaatgaagtcugg

SEQ ID NO: 91957 - DNA, 17 bp, Artificial Sequence
  Synthetic
cggcgggcacauacuca

SEQ ID NO: 91958 - DNA, 21 bp, Artificial Sequence
  Synthetic
tgtggaaagcucatcgctucc

SEQ ID NO: 91959 - DNA, 27 bp, Artificial Sequence
  Synthetic
tggacacagaguaatcttaatggcaut

SEQ ID NO: 91960 - DNA, 28 bp, Artificial Sequence
  Synthetic
gagaaagaaacaugagaaagtccuaggt

SEQ ID NO: 91961 - DNA, 22 bp, Artificial Sequence
  Synthetic
cgutcagtcctucccagaagag

SEQ ID NO: 91962 - DNA, 25 bp, Artificial Sequence
  Synthetic
ggaggtacttutgttccccaauaga

SEQ ID NO: 91963 - DNA, 28 bp, Artificial Sequence
  Synthetic
ggttttgttgatguctttagcagtguaa

SEQ ID NO: 91964 - DNA, 25 bp, Artificial Sequence
  Synthetic
ggatgaaatcatuccagtgctccut

SEQ ID NO: 91965 - DNA, 26 bp, Artificial Sequence
  Synthetic
cctactgtgacutgcactagtcatua

SEQ ID NO: 91966 - DNA, 20 bp, Artificial Sequence
  Synthetic
cgtgcuactcaagucaccca

SEQ ID NO: 91967 - DNA, 21 bp, Artificial Sequence
  Synthetic
tccctauccccatgctucact

SEQ ID NO: 91968 - DNA, 21 bp, Artificial Sequence
  Synthetic
cgcctccucagggcttattua

SEQ ID NO: 91969 - DNA, 22 bp, Artificial Sequence
  Synthetic
cgtccaagguttcctgactgug

SEQ ID NO: 91970 - DNA, 22 bp, Artificial Sequence
  Synthetic
cagctgcccuacgttgauagag

SEQ ID NO: 91971 - DNA, 26 bp, Artificial Sequence
  Synthetic
tggtgtgttgutttgtttccttguag

SEQ ID NO: 91972 - DNA, 28 bp, Artificial Sequence
  Synthetic
acctttaaatguagatccagctttgugt

SEQ ID NO: 91973 - DNA, 28 bp, Artificial Sequence
  Synthetic
aaatgtgtcctguttttcttttcctucc

SEQ ID NO: 91974 - DNA, 20 bp, Artificial Sequence
  Synthetic
ccgaugacgcagagggauaa

SEQ ID NO: 91975 - DNA, 18 bp, Artificial Sequence
  Synthetic
agcttcucgcaggtgucc

SEQ ID NO: 91976 - DNA, 21 bp, Artificial Sequence
  Synthetic
gaagaccucacgggacttuga

SEQ ID NO: 91977 - DNA, 21 bp, Artificial Sequence
  Synthetic
cctcuacccccttaacuccca

SEQ ID NO: 91978 - DNA, 20 bp, Artificial Sequence
  Synthetic
cuccatatcctugcggccaa

SEQ ID NO: 91979 - DNA, 23 bp, Artificial Sequence
  Synthetic
gtcttaccacuccatcccatgug

SEQ ID NO: 91980 - DNA, 23 bp, Artificial Sequence
  Synthetic
cctgtcactuctttccctaccuc

SEQ ID NO: 91981 - DNA, 23 bp, Artificial Sequence
  Synthetic
gcaatcttgaucacggccactua

SEQ ID NO: 91982 - DNA, 19 bp, Artificial Sequence
  Synthetic
cgatgtguagggccauggt

SEQ ID NO: 91983 - DNA, 19 bp, Artificial Sequence
  Synthetic
agtggcuggtggtttcugg

SEQ ID NO: 91984 - DNA, 21 bp, Artificial Sequence
  Synthetic
cactccctucaactggaccug

SEQ ID NO: 91985 - DNA, 26 bp, Artificial Sequence
  Synthetic
ctacatgcttuaggttctctggacut

SEQ ID NO: 91986 - DNA, 21 bp, Artificial Sequence
  Synthetic
cgcctgccugaggcttttuat

SEQ ID NO: 91987 - DNA, 22 bp, Artificial Sequence
  Synthetic
cggaggaugcggtcttattucc

SEQ ID NO: 91988 - DNA, 23 bp, Artificial Sequence
  Synthetic
gcctacgtugaccaactcttcua

SEQ ID NO: 91989 - DNA, 24 bp, Artificial Sequence
  Synthetic
gattggccaaaaccaaaucaggut

SEQ ID NO: 91990 - DNA, 21 bp, Artificial Sequence
  Synthetic
catggcaguaatggcctcuct

SEQ ID NO: 91991 - DNA, 19 bp, Artificial Sequence
  Synthetic
ggatgccgugaaccccauc

SEQ ID NO: 91992 - DNA, 25 bp, Artificial Sequence
  Synthetic
gaaguagagcagggaatatuggcat

SEQ ID NO: 91993 - DNA, 25 bp, Artificial Sequence
  Synthetic
gatgcaaggautcatcugcaaacag

SEQ ID NO: 91994 - DNA, 29 bp, Artificial Sequence
  Synthetic
tgaatcaatcaacugttccatgtagaugt

SEQ ID NO: 91995 - DNA, 24 bp, Artificial Sequence
  Synthetic
agaataattgcuactgccgcugaa

SEQ ID NO: 91996 - DNA, 20 bp, Artificial Sequence
  Synthetic
gccttucacaacacgcucat

SEQ ID NO: 91997 - DNA, 26 bp, Artificial Sequence
  Synthetic
tcccaatgaccucctcaatcttgaua

SEQ ID NO: 91998 - DNA, 21 bp, Artificial Sequence
  Synthetic
gtacgaccugactggccuaag

SEQ ID NO: 91999 - DNA, 24 bp, Artificial Sequence
  Synthetic
aaugaacagacgccaaucaagaga

SEQ ID NO: 92000 - DNA, 22 bp, Artificial Sequence
  Synthetic
ctccaaaggutatccgtguggt

SEQ ID NO: 92001 - DNA, 23 bp, Artificial Sequence
  Synthetic
gaattcccuccagtatgcucact

SEQ ID NO: 92002 - DNA, 21 bp, Artificial Sequence
  Synthetic
ccaaguggtcatgaucgccat

SEQ ID NO: 92003 - DNA, 22 bp, Artificial Sequence
  Synthetic
caaucaguggcagcaaacaaag

SEQ ID NO: 92004 - DNA, 28 bp, Artificial Sequence
  Synthetic
gtaccttattcttuccctccacaaacuc

SEQ ID NO: 92005 - DNA, 20 bp, Artificial Sequence
  Synthetic
tgtatcccugacctgcccut

SEQ ID NO: 92006 - DNA, 25 bp, Artificial Sequence
  Synthetic
caagaatuaggaccacttggucagt

SEQ ID NO: 92007 - DNA, 28 bp, Artificial Sequence
  Synthetic
gatggcaagagugatggattacaaauaa

SEQ ID NO: 92008 - DNA, 20 bp, Artificial Sequence
  Synthetic
ggccaggcauctcgtgaaua

SEQ ID NO: 92009 - DNA, 23 bp, Artificial Sequence
  Synthetic
cccattgaaauacgctcaggugt

SEQ ID NO: 92010 - DNA, 20 bp, Artificial Sequence
  Synthetic
cgggaagucgatcctgctua

SEQ ID NO: 92011 - DNA, 21 bp, Artificial Sequence
  Synthetic
tgtgtttggaugggactcugg

SEQ ID NO: 92012 - DNA, 20 bp, Artificial Sequence
  Synthetic
tgagccaggacugctccuaa

SEQ ID NO: 92013 - DNA, 22 bp, Artificial Sequence
  Synthetic
gagacctacauggactgaugcc

SEQ ID NO: 92014 - DNA, 25 bp, Artificial Sequence
  Synthetic
agaaagagguaatgctgaugccaaa

SEQ ID NO: 92015 - DNA, 27 bp, Artificial Sequence
  Synthetic
tgaaaggaaagaacugctuccaaagaa

SEQ ID NO: 92016 - DNA, 24 bp, Artificial Sequence
  Synthetic
gggaaaagccuaacaagactggut

SEQ ID NO: 92017 - DNA, 18 bp, Artificial Sequence
  Synthetic
tgtctgccaucgctggug

SEQ ID NO: 92018 - DNA, 29 bp, Artificial Sequence
  Synthetic
gccactgtctcucttataccaatttcuat

SEQ ID NO: 92019 - DNA, 28 bp, Artificial Sequence
  Synthetic
acaaattactccaauccggtataugcaa

SEQ ID NO: 92020 - DNA, 29 bp, Artificial Sequence
  Synthetic
tcgacagtttugcccatccatatataaut

SEQ ID NO: 92021 - DNA, 28 bp, Artificial Sequence
  Synthetic
cgattaggagauggacattcuaggaagt

SEQ ID NO: 92022 - DNA, 24 bp, Artificial Sequence
  Synthetic
tggaatggcugaaacatgttcuct

SEQ ID NO: 92023 - DNA, 20 bp, Artificial Sequence
  Synthetic
gatgtgtucctgccucgagt

SEQ ID NO: 92024 - DNA, 21 bp, Artificial Sequence
  Synthetic
gctgtgagcgcuaattctgug

SEQ ID NO: 92025 - DNA, 23 bp, Artificial Sequence
  Synthetic
acagtcacgucctcagaugagat

SEQ ID NO: 92026 - DNA, 23 bp, Artificial Sequence
  Synthetic
ccttctggaauacgtgaaugggt

SEQ ID NO: 92027 - DNA, 22 bp, Artificial Sequence
  Synthetic
acataaggcaacgcucagucaa

SEQ ID NO: 92028 - DNA, 27 bp, Artificial Sequence
  Synthetic
tcaatatctaugggaatccctgagugt

SEQ ID NO: 92029 - DNA, 25 bp, Artificial Sequence
  Synthetic
gaggtaactgaacuggcttcttgut

SEQ ID NO: 92030 - DNA, 22 bp, Artificial Sequence
  Synthetic
ccaggccacauagctcttcauc

SEQ ID NO: 92031 - DNA, 28 bp, Artificial Sequence
  Synthetic
agctggcatuagaaatgttttgattugt

SEQ ID NO: 92032 - DNA, 26 bp, Artificial Sequence
  Synthetic
tcaagttucacagagcttcuaaagca

SEQ ID NO: 92033 - DNA, 22 bp, Artificial Sequence
  Synthetic
aaauctctgugcaacacccagt

SEQ ID NO: 92034 - DNA, 23 bp, Artificial Sequence
  Synthetic
agaggtcaugagaagctggauga

SEQ ID NO: 92035 - DNA, 20 bp, Artificial Sequence
  Synthetic
ccugcccccatcuacagaca

SEQ ID NO: 92036 - DNA, 25 bp, Artificial Sequence
  Synthetic
gatggtattcacuacctgcatgcua

SEQ ID NO: 92037 - DNA, 28 bp, Artificial Sequence
  Synthetic
cactggtatcuacagacgacuagaaaag

SEQ ID NO: 92038 - DNA, 21 bp, Artificial Sequence
  Synthetic
gctgaaagaggcaaucgccut

SEQ ID NO: 92039 - DNA, 23 bp, Artificial Sequence
  Synthetic
ctgtacttggucatccggttcug

SEQ ID NO: 92040 - DNA, 22 bp, Artificial Sequence
  Synthetic
caccagaauaaggcaaggguga

SEQ ID NO: 92041 - DNA, 17 bp, Artificial Sequence
  Synthetic
cccagcccacccuctug

SEQ ID NO: 92042 - DNA, 28 bp, Artificial Sequence
  Synthetic
tgctgctttcutatttctcatctugact

SEQ ID NO: 92043 - DNA, 28 bp, Artificial Sequence
  Synthetic
gctttgatgccuatatcaggaactucat

SEQ ID NO: 92044 - DNA, 23 bp, Artificial Sequence
  Synthetic
auggaaatctatucccacggcaa

SEQ ID NO: 92045 - DNA, 22 bp, Artificial Sequence
  Synthetic
ttatctccggcccugcattuag

SEQ ID NO: 92046 - DNA, 21 bp, Artificial Sequence
  Synthetic
gggagtcacuaaaggcaacuc

SEQ ID NO: 92047 - DNA, 26 bp, Artificial Sequence
  Synthetic
tttcaggacaautatgccatctcucc

SEQ ID NO: 92048 - DNA, 23 bp, Artificial Sequence
  Synthetic
aagtcacttcuttgtctgcguga

SEQ ID NO: 92049 - DNA, 28 bp, Artificial Sequence
  Synthetic
accacaatcaucaccatctgaauaagag

SEQ ID NO: 92050 - DNA, 19 bp, Artificial Sequence
  Synthetic
ctgaauggcccccgaagua

SEQ ID NO: 92051 - DNA, 25 bp, Artificial Sequence
  Synthetic
aaaggcaacagaucccctaattugt

SEQ ID NO: 92052 - DNA, 25 bp, Artificial Sequence
  Synthetic
aaaacagacacugagaaaggccuaa

SEQ ID NO: 92053 - DNA, 24 bp, Artificial Sequence
  Synthetic
caccatcattucctttgcaggtuc

SEQ ID NO: 92054 - DNA, 25 bp, Artificial Sequence
  Synthetic
cctugagaacatcttucagccacaa

SEQ ID NO: 92055 - DNA, 29 bp, Artificial Sequence
  Synthetic
cagtgaaacaagutgaatgcgtaguaaaa

SEQ ID NO: 92056 - DNA, 22 bp, Artificial Sequence
  Synthetic
accaggguaaccggaatcauct

SEQ ID NO: 92057 - DNA, 28 bp, Artificial Sequence
  Synthetic
agccacaatguatagtgaattctguaaa

SEQ ID NO: 92058 - DNA, 23 bp, Artificial Sequence
  Synthetic
tgtttgtugaggacccagaugag

SEQ ID NO: 92059 - DNA, 20 bp, Artificial Sequence
  Synthetic
cccaagccucacgttugaca

SEQ ID NO: 92060 - DNA, 28 bp, Artificial Sequence
  Synthetic
ccaugaaagagaaaggaaacatucaact

SEQ ID NO: 92061 - DNA, 25 bp, Artificial Sequence
  Synthetic
gatatgaagaaugcaggacctcugg

SEQ ID NO: 92062 - DNA, 20 bp, Artificial Sequence
  Synthetic
gguaagggacggaccucagt

SEQ ID NO: 92063 - DNA, 21 bp, Artificial Sequence
  Synthetic
gcagaaggugcaggaacaguc

SEQ ID NO: 92064 - DNA, 28 bp, Artificial Sequence
  Synthetic
gtagacaaggtucaatgctaaaagcuac

SEQ ID NO: 92065 - DNA, 24 bp, Artificial Sequence
  Synthetic
gattgtcctgauggctctgaugaa

SEQ ID NO: 92066 - DNA, 27 bp, Artificial Sequence
  Synthetic
ctcatcagaaggacuttagccaatgua

SEQ ID NO: 92067 - DNA, 28 bp, Artificial Sequence
  Synthetic
ccaagtggaatgcuttactatctggtut

SEQ ID NO: 92068 - DNA, 24 bp, Artificial Sequence
  Synthetic
acatgcaauaccacagagauagcc

SEQ ID NO: 92069 - DNA, 27 bp, Artificial Sequence
  Synthetic
gattgcgaagaucagtcagaugaagat

SEQ ID NO: 92070 - DNA, 29 bp, Artificial Sequence
  Synthetic
aactgcagccutatcaagtatauggaaaa

SEQ ID NO: 92071 - DNA, 25 bp, Artificial Sequence
  Synthetic
actctgagugctagctaaguaacca

SEQ ID NO: 92072 - DNA, 28 bp, Artificial Sequence
  Synthetic
tctttttcttaugatcagcgttttugcc

SEQ ID NO: 92073 - DNA, 27 bp, Artificial Sequence
  Synthetic
gaaacaagaagcugctaacagtactut

SEQ ID NO: 92074 - DNA, 21 bp, Artificial Sequence
  Synthetic
tgttggagggcutcacatcug

SEQ ID NO: 92075 - DNA, 19 bp, Artificial Sequence
  Synthetic
tggcguaccuccgagagaa

SEQ ID NO: 92076 - DNA, 20 bp, Artificial Sequence
  Synthetic
gccttaccucggtgcaugat

SEQ ID NO: 92077 - DNA, 21 bp, Artificial Sequence
  Synthetic
ctctgacugctcagctcugac

SEQ ID NO: 92078 - DNA, 23 bp, Artificial Sequence
  Synthetic
augacaugagacacacagcacat

SEQ ID NO: 92079 - DNA, 24 bp, Artificial Sequence
  Synthetic
cgcaagugagtggagtaaugaagg

SEQ ID NO: 92080 - DNA, 28 bp, Artificial Sequence
  Synthetic
ctccagaataugcaagaatgcaaugaaa

SEQ ID NO: 92081 - DNA, 28 bp, Artificial Sequence
  Synthetic
gaatgtgcaccauaagaatgagtttugt

SEQ ID NO: 92082 - DNA, 22 bp, Artificial Sequence
  Synthetic
gtattctgcuccccacccttuc

SEQ ID NO: 92083 - DNA, 26 bp, Artificial Sequence
  Synthetic
agatctucaacaaccaggaattugct

SEQ ID NO: 92084 - DNA, 23 bp, Artificial Sequence
  Synthetic
agaagagcagcaaautcctggut

SEQ ID NO: 92085 - DNA, 28 bp, Artificial Sequence
  Synthetic
ggaatcagtagaugattgcatgctcaua

SEQ ID NO: 92086 - DNA, 21 bp, Artificial Sequence
  Synthetic
ccactccccuccctcatttut

SEQ ID NO: 92087 - DNA, 28 bp, Artificial Sequence
  Synthetic
caccatcatttagucttgtctgtctuga

SEQ ID NO: 92088 - DNA, 17 bp, Artificial Sequence
  Synthetic
tccugcggaugcacgaa

SEQ ID NO: 92089 - DNA, 21 bp, Artificial Sequence
  Synthetic
ggagtuctgcaaguacggcaa

SEQ ID NO: 92090 - DNA, 20 bp, Artificial Sequence
  Synthetic
gtggtgtgugctcaacucca

SEQ ID NO: 92091 - DNA, 26 bp, Artificial Sequence
  Synthetic
gcaatcttcaucacattgtccucagt

SEQ ID NO: 92092 - DNA, 24 bp, Artificial Sequence
  Synthetic
tccacacaagaaacugtcacaguc

SEQ ID NO: 92093 - DNA, 25 bp, Artificial Sequence
  Synthetic
actgaagacaauaatggccacucat

SEQ ID NO: 92094 - DNA, 27 bp, Artificial Sequence
  Synthetic
aagagatatguccccttccctauaacc

SEQ ID NO: 92095 - DNA, 20 bp, Artificial Sequence
  Synthetic
atgcctcaaagguccgaguc

SEQ ID NO: 92096 - DNA, 24 bp, Artificial Sequence
  Synthetic
caccuaaggacagcagaacaauga

SEQ ID NO: 92097 - DNA, 21 bp, Artificial Sequence
  Synthetic
tgtaggucctgtcctugcagt

SEQ ID NO: 92098 - DNA, 19 bp, Artificial Sequence
  Synthetic
agugtauccaccgggacct

SEQ ID NO: 92099 - DNA, 21 bp, Artificial Sequence
  Synthetic
catccagttcugccccatcuc

SEQ ID NO: 92100 - DNA, 20 bp, Artificial Sequence
  Synthetic
augacccaaggguaggaggt

SEQ ID NO: 92101 - DNA, 21 bp, Artificial Sequence
  Synthetic
gcccagcccucatgattacuc

SEQ ID NO: 92102 - DNA, 25 bp, Artificial Sequence
  Synthetic
ccutacttctcucacaaaagcccaa

SEQ ID NO: 92103 - DNA, 20 bp, Artificial Sequence
  Synthetic
ccaguggcagggcagauaag

SEQ ID NO: 92104 - DNA, 22 bp, Artificial Sequence
  Synthetic
cccaagacuggtacctcctuga

SEQ ID NO: 92105 - DNA, 21 bp, Artificial Sequence
  Synthetic
gutcctttcccuggagcagat

SEQ ID NO: 92106 - DNA, 23 bp, Artificial Sequence
  Synthetic
atgggaaccccuaccaaaggaua

SEQ ID NO: 92107 - DNA, 23 bp, Artificial Sequence
  Synthetic
ggttgaccauctcttccacguag

SEQ ID NO: 92108 - DNA, 20 bp, Artificial Sequence
  Synthetic
actccgcugcagtactcuct

SEQ ID NO: 92109 - DNA, 24 bp, Artificial Sequence
  Synthetic
accutaatgaaacuggcacagcat

SEQ ID NO: 92110 - DNA, 18 bp, Artificial Sequence
  Synthetic
gutcuggacgaccagcga

SEQ ID NO: 92111 - DNA, 23 bp, Artificial Sequence
  Synthetic
acagagaaguggagtcgaatgug

SEQ ID NO: 92112 - DNA, 25 bp, Artificial Sequence
  Synthetic
agtgtgaauaattacccuggaggga

SEQ ID NO: 92113 - DNA, 26 bp, Artificial Sequence
  Synthetic
cagtactacugctggattcuaaagca

SEQ ID NO: 92114 - DNA, 26 bp, Artificial Sequence
  Synthetic
ggaaatccacuccaactctgtttgut

SEQ ID NO: 92115 - DNA, 33 bp, Artificial Sequence
  Synthetic
tatgaaaagattcaccutaaaaatgtctacaug

SEQ ID NO: 92116 - DNA, 21 bp, Artificial Sequence
  Synthetic
gcagctguggttcccaucaaa

SEQ ID NO: 92117 - DNA, 23 bp, Artificial Sequence
  Synthetic
gccaaggagaauctgggaauagg

SEQ ID NO: 92118 - DNA, 24 bp, Artificial Sequence
  Synthetic
caattggtugcagacacacttugt

SEQ ID NO: 92119 - DNA, 19 bp, Artificial Sequence
  Synthetic
ctcctcagccugacgguag

SEQ ID NO: 92120 - DNA, 22 bp, Artificial Sequence
  Synthetic
tgtgtcagugtgaagtcaugct

SEQ ID NO: 92121 - DNA, 24 bp, Artificial Sequence
  Synthetic
ccattgattcugattggcgttucc

SEQ ID NO: 92122 - DNA, 22 bp, Artificial Sequence
  Synthetic
gtactucggaaacgccaaucag

SEQ ID NO: 92123 - DNA, 28 bp, Artificial Sequence
  Synthetic
ttcagctgcauatgaagttatgguacaa

SEQ ID NO: 92124 - DNA, 22 bp, Artificial Sequence
  Synthetic
ggatgggctutctagaggcaut

SEQ ID NO: 92125 - DNA, 23 bp, Artificial Sequence
  Synthetic
gctatgucaacactgggtgucat

SEQ ID NO: 92126 - DNA, 27 bp, Artificial Sequence
  Synthetic
gcaatgacaaugcagatgauaaagacc

SEQ ID NO: 92127 - DNA, 28 bp, Artificial Sequence
  Synthetic
gaaatagacuctgcttttccucagaaga

SEQ ID NO: 92128 - DNA, 21 bp, Artificial Sequence
  Synthetic
ccgggagaccutcacccttua

SEQ ID NO: 92129 - DNA, 20 bp, Artificial Sequence
  Synthetic
ggagggaaagcuctcgtcug

SEQ ID NO: 92130 - DNA, 22 bp, Artificial Sequence
  Synthetic
gagtaagggcuggttgcauaca

SEQ ID NO: 92131 - DNA, 28 bp, Artificial Sequence
  Synthetic
ctgttttgcuaatattgcaucacacact

SEQ ID NO: 92132 - DNA, 21 bp, Artificial Sequence
  Synthetic
tggaccaagguggacacaaut

SEQ ID NO: 92133 - DNA, 20 bp, Artificial Sequence
  Synthetic
ccaaagcuccgctcttugac

SEQ ID NO: 92134 - DNA, 25 bp, Artificial Sequence
  Synthetic
cacggtaagtuctgaaacaagctut

SEQ ID NO: 92135 - DNA, 24 bp, Artificial Sequence
  Synthetic
ccagaatcuccaaccccatcauac

SEQ ID NO: 92136 - DNA, 28 bp, Artificial Sequence
  Synthetic
cagtagcatgtucctgtcaggttataug

SEQ ID NO: 92137 - DNA, 21 bp, Artificial Sequence
  Synthetic
caccccuggaucacagcaaat

SEQ ID NO: 92138 - DNA, 23 bp, Artificial Sequence
  Synthetic
gaaagcuggttttacugcacaca

SEQ ID NO: 92139 - DNA, 25 bp, Artificial Sequence
  Synthetic
ggttctgctuaggtttactcuccaa

SEQ ID NO: 92140 - DNA, 22 bp, Artificial Sequence
  Synthetic
agagtucaagccgaatgccaut

SEQ ID NO: 92141 - DNA, 22 bp, Artificial Sequence
  Synthetic
ccatgacaaggugatgctccuc

SEQ ID NO: 92142 - DNA, 29 bp, Artificial Sequence
  Synthetic
cagctgacaaugttttgtataaaauccct

SEQ ID NO: 92143 - DNA, 25 bp, Artificial Sequence
  Synthetic
gattgtgaggauggacgtgaugaat

SEQ ID NO: 92144 - DNA, 23 bp, Artificial Sequence
  Synthetic
acagtggaautcatcacguccat

SEQ ID NO: 92145 - DNA, 27 bp, Artificial Sequence
  Synthetic
cacagtucaaaacaaacacaaatguga

SEQ ID NO: 92146 - DNA, 28 bp, Artificial Sequence
  Synthetic
aatgcatctuccactaggacaacuaaaa

SEQ ID NO: 92147 - DNA, 33 bp, Artificial Sequence
  Synthetic
agcttacttgttatutatctctttcagttuagg

SEQ ID NO: 92148 - DNA, 22 bp, Artificial Sequence
  Synthetic
cctgacccugtgtgactgttut

SEQ ID NO: 92149 - DNA, 24 bp, Artificial Sequence
  Synthetic
cggtatagcgggugtttctcauag

SEQ ID NO: 92150 - DNA, 21 bp, Artificial Sequence
  Synthetic
cttcgactucctgacggacug

SEQ ID NO: 92151 - DNA, 21 bp, Artificial Sequence
  Synthetic
cggagaacguctggattugga

SEQ ID NO: 92152 - DNA, 26 bp, Artificial Sequence
  Synthetic
aaaggttaaaguaaagccacgacuca

SEQ ID NO: 92153 - DNA, 24 bp, Artificial Sequence
  Synthetic
gccagctagaaacutgtatgccua

SEQ ID NO: 92154 - DNA, 24 bp, Artificial Sequence
  Synthetic
acagtgatcugtgctattgctuca

SEQ ID NO: 92155 - DNA, 25 bp, Artificial Sequence
  Synthetic
gtcaccaaugccttatgtaaagugg

SEQ ID NO: 92156 - DNA, 20 bp, Artificial Sequence
  Synthetic
gggauagcagtacccugcca

SEQ ID NO: 92157 - DNA, 19 bp, Artificial Sequence
  Synthetic
gccctgguacagcccctua

SEQ ID NO: 92158 - DNA, 28 bp, Artificial Sequence
  Synthetic
tgttttggcaatutgatggttttgauga

SEQ ID NO: 92159 - DNA, 28 bp, Artificial Sequence
  Synthetic
catttgttgtacuccaggttgaatucac

SEQ ID NO: 92160 - DNA, 21 bp, Artificial Sequence
  Synthetic
accgtggcauttcggtuaaca

SEQ ID NO: 92161 - DNA, 28 bp, Artificial Sequence
  Synthetic
ctgcattttggugttcgatagcatatua

SEQ ID NO: 92162 - DNA, 22 bp, Artificial Sequence
  Synthetic
gccttgtugacctcatcagcua

SEQ ID NO: 92163 - DNA, 24 bp, Artificial Sequence
  Synthetic
tggtaagattcugggtctctccug

SEQ ID NO: 92164 - DNA, 24 bp, Artificial Sequence
  Synthetic
ccctcugttacaaagucagggaat

SEQ ID NO: 92165 - DNA, 27 bp, Artificial Sequence
  Synthetic
tggaattcttuccttatcagccugaac

SEQ ID NO: 92166 - DNA, 26 bp, Artificial Sequence
  Synthetic
tgtagacucagcaaagaacaauggaa

SEQ ID NO: 92167 - DNA, 23 bp, Artificial Sequence
  Synthetic
cctccacagucaggttauaccag

SEQ ID NO: 92168 - DNA, 21 bp, Artificial Sequence
  Synthetic
cagaucttcugcccccaacat

SEQ ID NO: 92169 - DNA, 28 bp, Artificial Sequence
  Synthetic
gttatcatttcccutgtgttttgtucca

SEQ ID NO: 92170 - DNA, 26 bp, Artificial Sequence
  Synthetic
atggctaatttguttcatgagcaugg

SEQ ID NO: 92171 - DNA, 26 bp, Artificial Sequence
  Synthetic
cctgaagatgttuacagtgcagtcut

SEQ ID NO: 92172 - DNA, 28 bp, Artificial Sequence
  Synthetic
cgtttctatttgugtcagcttctgaaug

SEQ ID NO: 92173 - DNA, 26 bp, Artificial Sequence
  Synthetic
ccaugtaactttaaugagagcccaga

SEQ ID NO: 92174 - DNA, 24 bp, Artificial Sequence
  Synthetic
cacaatatggugagggtggaagua

SEQ ID NO: 92175 - DNA, 22 bp, Artificial Sequence
  Synthetic
gtggcacttugcaggactttut

SEQ ID NO: 92176 - DNA, 21 bp, Artificial Sequence
  Synthetic
gcaccaagucagtgccacuat

SEQ ID NO: 92177 - DNA, 23 bp, Artificial Sequence
  Synthetic
ctagcaaccauccauggaacagt

SEQ ID NO: 92178 - DNA, 28 bp, Artificial Sequence
  Synthetic
aaggtttcuccaaccctctgatttaaut

SEQ ID NO: 92179 - DNA, 23 bp, Artificial Sequence
  Synthetic
ttggcttgaautgttcacgcaut

SEQ ID NO: 92180 - DNA, 24 bp, Artificial Sequence
  Synthetic
cagggagacaccuagaaaccaauc

SEQ ID NO: 92181 - DNA, 29 bp, Artificial Sequence
  Synthetic
ggcttggataaucacttcgtagtattcut

SEQ ID NO: 92182 - DNA, 24 bp, Artificial Sequence
  Synthetic
agaacuggacagagaagtcuaccc

SEQ ID NO: 92183 - DNA, 27 bp, Artificial Sequence
  Synthetic
agutttggaagaaugagggaaaaggaa

SEQ ID NO: 92184 - DNA, 28 bp, Artificial Sequence
  Synthetic
tggtcttctgtutgaaccatatagtucc

SEQ ID NO: 92185 - DNA, 28 bp, Artificial Sequence
  Synthetic
ttgggcttttcutctctattttccucat

SEQ ID NO: 92186 - DNA, 23 bp, Artificial Sequence
  Synthetic
ccaacaaagcaucaaagccgtua

SEQ ID NO: 92187 - DNA, 27 bp, Artificial Sequence
  Synthetic
actaacatttgcutcccatttaccuct

SEQ ID NO: 92188 - DNA, 23 bp, Artificial Sequence
  Synthetic
gtccttcaugcacatcctucgat

SEQ ID NO: 92189 - DNA, 26 bp, Artificial Sequence
  Synthetic
aggtagcaatcautgcacacatttut

SEQ ID NO: 92190 - DNA, 23 bp, Artificial Sequence
  Synthetic
caugaacauggacagagaagcca

SEQ ID NO: 92191 - DNA, 23 bp, Artificial Sequence
  Synthetic
tgtgctctcutgggttagguact

SEQ ID NO: 92192 - DNA, 28 bp, Artificial Sequence
  Synthetic
gagagagagagagaaaauttgtgtcuga

SEQ ID NO: 92193 - DNA, 25 bp, Artificial Sequence
  Synthetic
ctgtgauggagagaatgattgugga

SEQ ID NO: 92194 - DNA, 25 bp, Artificial Sequence
  Synthetic
gggctauaaaccaaattgctucaga

SEQ ID NO: 92195 - DNA, 21 bp, Artificial Sequence
  Synthetic
cauccaaacgccgagaaucac

SEQ ID NO: 92196 - DNA, 26 bp, Artificial Sequence
  Synthetic
ccacagttgagutcatcagaattguc

SEQ ID NO: 92197 - DNA, 28 bp, Artificial Sequence
  Synthetic
accattccacaauatctatgctttcucc

SEQ ID NO: 92198 - DNA, 28 bp, Artificial Sequence
  Synthetic
cctacagagauctaaccattagcaugaa

SEQ ID NO: 92199 - DNA, 21 bp, Artificial Sequence
  Synthetic
cctgtgggaauccgacgaaug

SEQ ID NO: 92200 - DNA, 20 bp, Artificial Sequence
  Synthetic
gacgtggtgugtcactgcua

SEQ ID NO: 92201 - DNA, 23 bp, Artificial Sequence
  Synthetic
cucacttcaucaggacagacgac

SEQ ID NO: 92202 - DNA, 23 bp, Artificial Sequence
  Synthetic
gctttcagutagagtgtgugcca

SEQ ID NO: 92203 - DNA, 27 bp, Artificial Sequence
  Synthetic
ctgggcttaaccucttccaatttuaga

SEQ ID NO: 92204 - DNA, 20 bp, Artificial Sequence
  Synthetic
ggcgtggaugggtcttucat

SEQ ID NO: 92205 - DNA, 29 bp, Artificial Sequence
  Synthetic
gttgtaattttctauctttgtgcccauct

SEQ ID NO: 92206 - DNA, 23 bp, Artificial Sequence
  Synthetic
tcccaccacagugtcttctttut

SEQ ID NO: 92207 - DNA, 22 bp, Artificial Sequence
  Synthetic
tgctgatggucccactuacaac

SEQ ID NO: 92208 - DNA, 23 bp, Artificial Sequence
  Synthetic
tcuaagatucgacagagggcaga

SEQ ID NO: 92209 - DNA, 27 bp, Artificial Sequence
  Synthetic
ccatgcttccaugttcacatcaattut

SEQ ID NO: 92210 - DNA, 28 bp, Artificial Sequence
  Synthetic
caaacatatttugaacacactgggctua

SEQ ID NO: 92211 - DNA, 23 bp, Artificial Sequence
  Synthetic
gcctggauggataccugaagact

SEQ ID NO: 92212 - DNA, 23 bp, Artificial Sequence
  Synthetic
ctcaggattgcauccagccttua

SEQ ID NO: 92213 - DNA, 23 bp, Artificial Sequence
  Synthetic
agaaaaatauggctggcccugaa

SEQ ID NO: 92214 - DNA, 27 bp, Artificial Sequence
  Synthetic
cttctaaacatuacctgacaaggcuga

SEQ ID NO: 92215 - DNA, 26 bp, Artificial Sequence
  Synthetic
cctgaatgcuctagaagaatggucaa

SEQ ID NO: 92216 - DNA, 25 bp, Artificial Sequence
  Synthetic
gagacaccugcaagtgacatatgua

SEQ ID NO: 92217 - DNA, 21 bp, Artificial Sequence
  Synthetic
gagacagtguctgccttcuct

SEQ ID NO: 92218 - DNA, 26 bp, Artificial Sequence
  Synthetic
cttaaaagccacauttctctccucct

SEQ ID NO: 92219 - DNA, 22 bp, Artificial Sequence
  Synthetic
ggtactctguctccagctctuc

SEQ ID NO: 92220 - DNA, 29 bp, Artificial Sequence
  Synthetic
aggctgcattacaugtctgtcaatauaaa

SEQ ID NO: 92221 - DNA, 26 bp, Artificial Sequence
  Synthetic
tcctgcgttucagtttaacttgttug

SEQ ID NO: 92222 - DNA, 22 bp, Artificial Sequence
  Synthetic
tgtgttcgaaugggagacucct

SEQ ID NO: 92223 - DNA, 19 bp, Artificial Sequence
  Synthetic
cccagggugaacgcatuac

SEQ ID NO: 92224 - DNA, 17 bp, Artificial Sequence
  Synthetic
gagagcuggcuggcaga

SEQ ID NO: 92225 - DNA, 19 bp, Artificial Sequence
  Synthetic
ccauggccaactcctucgt

SEQ ID NO: 92226 - DNA, 23 bp, Artificial Sequence
  Synthetic
gggatgcugaaagttgactcuct

SEQ ID NO: 92227 - DNA, 28 bp, Artificial Sequence
  Synthetic
aaacgttccaagutttcttactttgugt

SEQ ID NO: 92228 - DNA, 21 bp, Artificial Sequence
  Synthetic
ccagggtggugtacagcatuc

SEQ ID NO: 92229 - DNA, 28 bp, Artificial Sequence
  Synthetic
gggtctgtcauagcagcagttataaaut

SEQ ID NO: 92230 - DNA, 19 bp, Artificial Sequence
  Synthetic
cgaaggagutggccaugga

SEQ ID NO: 92231 - DNA, 17 bp, Artificial Sequence
  Synthetic
cggcaggcaacugtugg

SEQ ID NO: 92232 - DNA, 21 bp, Artificial Sequence
  Synthetic
cgcagacaccuacaacaucac

SEQ ID NO: 92233 - DNA, 21 bp, Artificial Sequence
  Synthetic
gctgtggataucgatgcggua

SEQ ID NO: 92234 - DNA, 22 bp, Artificial Sequence
  Synthetic
cagctgctuacaactgagguct

SEQ ID NO: 92235 - DNA, 25 bp, Artificial Sequence
  Synthetic
gcatttcagtgutggcttcctttua

SEQ ID NO: 92236 - DNA, 26 bp, Artificial Sequence
  Synthetic
tgaatcattctgugcttagctacgut

SEQ ID NO: 92237 - DNA, 26 bp, Artificial Sequence
  Synthetic
ctcaagtagctuttcacgttgcttut

SEQ ID NO: 92238 - DNA, 22 bp, Artificial Sequence
  Synthetic
gtgaggctguttttcccatcug

SEQ ID NO: 92239 - DNA, 20 bp, Artificial Sequence
  Synthetic
cattccccacccucctccua

SEQ ID NO: 92240 - DNA, 20 bp, Artificial Sequence
  Synthetic
tgcagttcuccctggaguca

SEQ ID NO: 92241 - DNA, 21 bp, Artificial Sequence
  Synthetic
aactcccauagtgggucgaga

SEQ ID NO: 92242 - DNA, 26 bp, Artificial Sequence
  Synthetic
aggtttttagaccucttctcccucaa

SEQ ID NO: 92243 - DNA, 24 bp, Artificial Sequence
  Synthetic
gctgaagaaucccggttgttacua

SEQ ID NO: 92244 - DNA, 23 bp, Artificial Sequence
  Synthetic
ggcctcgugagtctagatcuacc

SEQ ID NO: 92245 - DNA, 21 bp, Artificial Sequence
  Synthetic
tggagaaaguccagccucaga

SEQ ID NO: 92246 - DNA, 24 bp, Artificial Sequence
  Synthetic
gautttaaaaccttuggcgcagac

SEQ ID NO: 92247 - DNA, 28 bp, Artificial Sequence
  Synthetic
gcatgtacatauccccttgtgtagtaut

SEQ ID NO: 92248 - DNA, 22 bp, Artificial Sequence
  Synthetic
gccagtuggacaaatgcgagua

SEQ ID NO: 92249 - DNA, 22 bp, Artificial Sequence
  Synthetic
atcactgugagccagatuccac

SEQ ID NO: 92250 - DNA, 23 bp, Artificial Sequence
  Synthetic
ctaacctucggcctttcacatug

SEQ ID NO: 92251 - DNA, 21 bp, Artificial Sequence
  Synthetic
ggccagcuggatcataccaua

SEQ ID NO: 92252 - DNA, 20 bp, Artificial Sequence
  Synthetic
gggccaaaggccauaguaga

SEQ ID NO: 92253 - DNA, 17 bp, Artificial Sequence
  Synthetic
gcagcccacgugaucct

SEQ ID NO: 92254 - DNA, 21 bp, Artificial Sequence
  Synthetic
ggctccuccactgaggaugaa

SEQ ID NO: 92255 - DNA, 21 bp, Artificial Sequence
  Synthetic
gcccggccacugatacttuac

SEQ ID NO: 92256 - DNA, 20 bp, Artificial Sequence
  Synthetic
ccucccaggaaaagggtcug

SEQ ID NO: 92257 - DNA, 24 bp, Artificial Sequence
  Synthetic
cctacacaaggugaaagctcctua

SEQ ID NO: 92258 - DNA, 23 bp, Artificial Sequence
  Synthetic
gtttgagccuatagcccaacuga

SEQ ID NO: 92259 - DNA, 29 bp, Artificial Sequence
  Synthetic
tggcatggtcuaaacaaatagctctuaat

SEQ ID NO: 92260 - DNA, 19 bp, Artificial Sequence
  Synthetic
ccaggccautgctgacuca

SEQ ID NO: 92261 - DNA, 20 bp, Artificial Sequence
  Synthetic
ctctctucctcaccugcaca

SEQ ID NO: 92262 - DNA, 27 bp, Artificial Sequence
  Synthetic
caaagcaagaauacttttctgggtcut

SEQ ID NO: 92263 - DNA, 26 bp, Artificial Sequence
  Synthetic
gctaggaacuactggattgggauaca

SEQ ID NO: 92264 - DNA, 17 bp, Artificial Sequence
  Synthetic
ccagcccccaagucuca

SEQ ID NO: 92265 - DNA, 17 bp, Artificial Sequence
  Synthetic
gccctggguggtggtuc

SEQ ID NO: 92266 - DNA, 21 bp, Artificial Sequence
  Synthetic
gacagcaaacaguctgccuct

SEQ ID NO: 92267 - DNA, 23 bp, Artificial Sequence
  Synthetic
cccacttttuggtgttggaacug

SEQ ID NO: 92268 - DNA, 26 bp, Artificial Sequence
  Synthetic
cctccagauagcacaacgauagaaaa

SEQ ID NO: 92269 - DNA, 27 bp, Artificial Sequence
  Synthetic
cctctgttagauatagcacttgugagg

SEQ ID NO: 92270 - DNA, 27 bp, Artificial Sequence
  Synthetic
agcctcacaagugctatatcuaacaga

SEQ ID NO: 92271 - DNA, 29 bp, Artificial Sequence
  Synthetic
acccaaatcatucaccttaccataugaaa

SEQ ID NO: 92272 - DNA, 26 bp, Artificial Sequence
  Synthetic
ttttgtgttagaucaggttctgccut

SEQ ID NO: 92273 - DNA, 24 bp, Artificial Sequence
  Synthetic
tctctagcagguctggtactucag

SEQ ID NO: 92274 - DNA, 20 bp, Artificial Sequence
  Synthetic
ccgctugaccatggtgaugt

SEQ ID NO: 92275 - DNA, 19 bp, Artificial Sequence
  Synthetic
tcatccagccuccgacuca

SEQ ID NO: 92276 - DNA, 26 bp, Artificial Sequence
  Synthetic
aaaggtataggugaagtcaggacgua

SEQ ID NO: 92277 - DNA, 18 bp, Artificial Sequence
  Synthetic
ggaguctgguggccgaga

SEQ ID NO: 92278 - DNA, 17 bp, Artificial Sequence
  Synthetic
tccucucggccaccaga

SEQ ID NO: 92279 - DNA, 18 bp, Artificial Sequence
  Synthetic
gctgctggugcctccaut

SEQ ID NO: 92280 - DNA, 23 bp, Artificial Sequence
  Synthetic
gcacacaaagugttgaacctuct

SEQ ID NO: 92281 - DNA, 25 bp, Artificial Sequence
  Synthetic
agtgagcaaagcaguacactctuac

SEQ ID NO: 92282 - DNA, 26 bp, Artificial Sequence
  Synthetic
gaagtctugggaatcttcauaaccca

SEQ ID NO: 92283 - DNA, 27 bp, Artificial Sequence
  Synthetic
gtgaatccatguggagatgatgcauat

SEQ ID NO: 92284 - DNA, 23 bp, Artificial Sequence
  Synthetic
tcgaaaaccucagcaacatucct

SEQ ID NO: 92285 - DNA, 29 bp, Artificial Sequence
  Synthetic
tttcagtgcaucagggtttaatcagaaua

SEQ ID NO: 92286 - DNA, 21 bp, Artificial Sequence
  Synthetic
aaauccaggctuacagcgaca

SEQ ID NO: 92287 - DNA, 27 bp, Artificial Sequence
  Synthetic
agttaactccccacutcaggaatuaga

SEQ ID NO: 92288 - DNA, 23 bp, Artificial Sequence
  Synthetic
ggaaggaccacuggttuagaaca

SEQ ID NO: 92289 - DNA, 26 bp, Artificial Sequence
  Synthetic
aattgagagguaaagttgggtuccaa

SEQ ID NO: 92290 - DNA, 23 bp, Artificial Sequence
  Synthetic
ccatcccaggutgtccttcatua

SEQ ID NO: 92291 - DNA, 24 bp, Artificial Sequence
  Synthetic
caacagtgtugtgatgccatugat

SEQ ID NO: 92292 - DNA, 23 bp, Artificial Sequence
  Synthetic
tcctgttcaguttcttcctugct

SEQ ID NO: 92293 - DNA, 22 bp, Artificial Sequence
  Synthetic
ttaacacaggcguattccgugt

SEQ ID NO: 92294 - DNA, 24 bp, Artificial Sequence
  Synthetic
gcttcttttcaaugatgcggcaua

SEQ ID NO: 92295 - DNA, 33 bp, Artificial Sequence
  Synthetic
aaaattaccttutcagttaaaaatuaggccaac

SEQ ID NO: 92296 - DNA, 24 bp, Artificial Sequence
  Synthetic
cctcatagcauggacgcattctua

SEQ ID NO: 92297 - DNA, 22 bp, Artificial Sequence
  Synthetic
gcauttttggcugcagaagagg

SEQ ID NO: 92298 - DNA, 25 bp, Artificial Sequence
  Synthetic
tgtccagaccccaauacagtuaaga

SEQ ID NO: 92299 - DNA, 24 bp, Artificial Sequence
  Synthetic
gtcatcatcaguggaacaggtgut

SEQ ID NO: 92300 - DNA, 21 bp, Artificial Sequence
  Synthetic
tgtgtgcugtacagucacagg

SEQ ID NO: 92301 - DNA, 20 bp, Artificial Sequence
  Synthetic
caccgtgugggctgagttua

SEQ ID NO: 92302 - DNA, 21 bp, Artificial Sequence
  Synthetic
cctatgcagggcuacgatugg

SEQ ID NO: 92303 - DNA, 20 bp, Artificial Sequence
  Synthetic
gttgggcucagcagguaact

SEQ ID NO: 92304 - DNA, 22 bp, Artificial Sequence
  Synthetic
ccagtcaaaggugacaccugag

SEQ ID NO: 92305 - DNA, 20 bp, Artificial Sequence
  Synthetic
tcactgugtgcgtgucaaca

SEQ ID NO: 92306 - DNA, 28 bp, Artificial Sequence
  Synthetic
tctgactatgugctctcaaaacatucat

SEQ ID NO: 92307 - DNA, 22 bp, Artificial Sequence
  Synthetic
gccttacccugacatcctccua

SEQ ID NO: 92308 - DNA, 21 bp, Artificial Sequence
  Synthetic
ccatgcccuctctacacugga

SEQ ID NO: 92309 - DNA, 26 bp, Artificial Sequence
  Synthetic
tcaagagacucgccacagaaaatuac

SEQ ID NO: 92310 - DNA, 22 bp, Artificial Sequence
  Synthetic
tgcacctacutcttcacauggg

SEQ ID NO: 92311 - DNA, 24 bp, Artificial Sequence
  Synthetic
tgttccaugagcatgtggacuaag

SEQ ID NO: 92312 - DNA, 22 bp, Artificial Sequence
  Synthetic
aggcagcuactgcuagaagaga

SEQ ID NO: 92313 - DNA, 19 bp, Artificial Sequence
  Synthetic
ccacgcucagcctgaguat

SEQ ID NO: 92314 - DNA, 24 bp, Artificial Sequence
  Synthetic
agctgcaaggacutaagttucaca

SEQ ID NO: 92315 - DNA, 23 bp, Artificial Sequence
  Synthetic
gtttctccucgccttactcacuc

SEQ ID NO: 92316 - DNA, 26 bp, Artificial Sequence
  Synthetic
agcagugcagccaaaatatauacaca

SEQ ID NO: 92317 - DNA, 24 bp, Artificial Sequence
  Synthetic
tttctgttctcauagccttggugg

SEQ ID NO: 92318 - DNA, 20 bp, Artificial Sequence
  Synthetic
gcactucgcacacatagugg

SEQ ID NO: 92319 - DNA, 19 bp, Artificial Sequence
  Synthetic
cgcttcugctcgacugcaa

SEQ ID NO: 92320 - DNA, 20 bp, Artificial Sequence
  Synthetic
tccatcgguttggcacctut

SEQ ID NO: 92321 - DNA, 22 bp, Artificial Sequence
  Synthetic
acttttccucgggctgcttuag

SEQ ID NO: 92322 - DNA, 19 bp, Artificial Sequence
  Synthetic
ggcgaacagaugcacgtuc

SEQ ID NO: 92323 - DNA, 21 bp, Artificial Sequence
  Synthetic
aagccauccgaggagctacua

SEQ ID NO: 92324 - DNA, 22 bp, Artificial Sequence
  Synthetic
gcaaucggcaataaucccgaga

SEQ ID NO: 92325 - DNA, 20 bp, Artificial Sequence
  Synthetic
tgtaaaugacgccgcucgat

SEQ ID NO: 92326 - DNA, 25 bp, Artificial Sequence
  Synthetic
acaactttgtgutctaccttcuccc

SEQ ID NO: 92327 - DNA, 22 bp, Artificial Sequence
  Synthetic
gctacagcugtctccagugaac

SEQ ID NO: 92328 - DNA, 20 bp, Artificial Sequence
  Synthetic
gtggtcagggutgactguct

SEQ ID NO: 92329 - DNA, 20 bp, Artificial Sequence
  Synthetic
tgtgctucagccactggaug

SEQ ID NO: 92330 - DNA, 21 bp, Artificial Sequence
  Synthetic
cgtacttguagctgtcggcut

SEQ ID NO: 92331 - DNA, 19 bp, Artificial Sequence
  Synthetic
agtgccacagggcutctuc

SEQ ID NO: 92332 - DNA, 20 bp, Artificial Sequence
  Synthetic
gtgcaaggugtacagcgaug

SEQ ID NO: 92333 - DNA, 22 bp, Artificial Sequence
  Synthetic
aacccaaggugggagaagaaug

SEQ ID NO: 92334 - DNA, 24 bp, Artificial Sequence
  Synthetic
gatcagcacuttctugagcaacac

SEQ ID NO: 92335 - DNA, 28 bp, Artificial Sequence
  Synthetic
aggtcctaauacacaaaaatgcuggaaa

SEQ ID NO: 92336 - DNA, 20 bp, Artificial Sequence
  Synthetic
cccactcgacucccacauct

SEQ ID NO: 92337 - DNA, 29 bp, Artificial Sequence
  Synthetic
ggttccttactaaaugagcactattgugt

SEQ ID NO: 92338 - DNA, 28 bp, Artificial Sequence
  Synthetic
caaccacagcaaugataataacaggaut

SEQ ID NO: 92339 - DNA, 33 bp, Artificial Sequence
  Synthetic
actctaattttattuaacctttcaagttctugc

SEQ ID NO: 92340 - DNA, 26 bp, Artificial Sequence
  Synthetic
gaagacaaaagcacutcacaaaccut

SEQ ID NO: 92341 - DNA, 25 bp, Artificial Sequence
  Synthetic
tgtcttgtgugtgttgatttugcag

SEQ ID NO: 92342 - DNA, 21 bp, Artificial Sequence
  Synthetic
ccagaagucccactcctcuca

SEQ ID NO: 92343 - DNA, 21 bp, Artificial Sequence
  Synthetic
actccctuccaacgtgtctuc

SEQ ID NO: 92344 - DNA, 26 bp, Artificial Sequence
  Synthetic
gacttgaaacgggauctcattuagga

SEQ ID NO: 92345 - DNA, 23 bp, Artificial Sequence
  Synthetic
gctcattcuaccagaaguccaca

SEQ ID NO: 92346 - DNA, 27 bp, Artificial Sequence
  Synthetic
gtctttaaccuctaactuccaagggaa

SEQ ID NO: 92347 - DNA, 26 bp, Artificial Sequence
  Synthetic
gtctccacagaauttccgtctctauc

SEQ ID NO: 92348 - DNA, 21 bp, Artificial Sequence
  Synthetic
acagctucgggtgttaauggt

SEQ ID NO: 92349 - DNA, 28 bp, Artificial Sequence
  Synthetic
gatcagtgcuaaacaggatcttttccua

SEQ ID NO: 92350 - DNA, 25 bp, Artificial Sequence
  Synthetic
ggatagtaccugagtgtgtctggua

SEQ ID NO: 92351 - DNA, 21 bp, Artificial Sequence
  Synthetic
ccttucaggcagccgacuaaa

SEQ ID NO: 92352 - DNA, 22 bp, Artificial Sequence
  Synthetic
gtgagtgaaugctgaccccaut

SEQ ID NO: 92353 - DNA, 23 bp, Artificial Sequence
  Synthetic
cgaggcugatgaactauacggat

SEQ ID NO: 92354 - DNA, 22 bp, Artificial Sequence
  Synthetic
ttctgaaaaccuggcaauccca

SEQ ID NO: 92355 - DNA, 21 bp, Artificial Sequence
  Synthetic
gcttgtcugacaggagtgcut

SEQ ID NO: 92356 - DNA, 28 bp, Artificial Sequence
  Synthetic
tcatttgttcaauaactgcttggcatut

SEQ ID NO: 92357 - DNA, 28 bp, Artificial Sequence
  Synthetic
gctggtttaucttcaaattgtugaggat

SEQ ID NO: 92358 - DNA, 21 bp, Artificial Sequence
  Synthetic
gacgtggacutccacauccaa

SEQ ID NO: 92359 - DNA, 24 bp, Artificial Sequence
  Synthetic
gaauagatggtugagcccacaaac

SEQ ID NO: 92360 - DNA, 24 bp, Artificial Sequence
  Synthetic
caatgttgaucccagggatgaugt

SEQ ID NO: 92361 - DNA, 23 bp, Artificial Sequence
  Synthetic
gggcacauagtattgcagucgag

SEQ ID NO: 92362 - DNA, 23 bp, Artificial Sequence
  Synthetic
cgctgccauttggactaaatugt

SEQ ID NO: 92363 - DNA, 26 bp, Artificial Sequence
  Synthetic
cagccaatuaccgtcaagattacuga

SEQ ID NO: 92364 - DNA, 26 bp, Artificial Sequence
  Synthetic
ccatattcuccacatctctcttuggt

SEQ ID NO: 92365 - DNA, 29 bp, Artificial Sequence
  Synthetic
accacuccaacaaagaagaaatugaagat

SEQ ID NO: 92366 - DNA, 22 bp, Artificial Sequence
  Synthetic
ggcatccutttgaacgtugaca

SEQ ID NO: 92367 - DNA, 22 bp, Artificial Sequence
  Synthetic
tgaaaugggcccaagtucagaa

SEQ ID NO: 92368 - DNA, 25 bp, Artificial Sequence
  Synthetic
gtcatctttggucatttagctgcut

SEQ ID NO: 92369 - DNA, 27 bp, Artificial Sequence
  Synthetic
agatgcctuccaacatgtctttuagag

SEQ ID NO: 92370 - DNA, 19 bp, Artificial Sequence
  Synthetic
gccccagcguttccgtauc

SEQ ID NO: 92371 - DNA, 24 bp, Artificial Sequence
  Synthetic
catttaaccucccctctcgttuca

SEQ ID NO: 92372 - DNA, 26 bp, Artificial Sequence
  Synthetic
gcagtacacugaagaattccugagac

SEQ ID NO: 92373 - DNA, 23 bp, Artificial Sequence
  Synthetic
tgcatucgcagatgcttucaaaa

SEQ ID NO: 92374 - DNA, 23 bp, Artificial Sequence
  Synthetic
cccaacaccacaaggugaatuag

SEQ ID NO: 92375 - DNA, 26 bp, Artificial Sequence
  Synthetic
cgggtcatttcuacttggcatttcut

SEQ ID NO: 92376 - DNA, 22 bp, Artificial Sequence
  Synthetic
acaggaaacaaaucaggcugct

SEQ ID NO: 92377 - DNA, 18 bp, Artificial Sequence
  Synthetic
gggacaggcccaguccua

SEQ ID NO: 92378 - DNA, 20 bp, Artificial Sequence
  Synthetic
agatggcaaagccugacucc

SEQ ID NO: 92379 - DNA, 22 bp, Artificial Sequence
  Synthetic
gacttggcaucccattgtcuga

SEQ ID NO: 92380 - DNA, 19 bp, Artificial Sequence
  Synthetic
ggaaggagggcccautcuc

SEQ ID NO: 92381 - DNA, 19 bp, Artificial Sequence
  Synthetic
cctcccuccaccagcucat

SEQ ID NO: 92382 - DNA, 23 bp, Artificial Sequence
  Synthetic
caatcctcaccuagagatgcgut

SEQ ID NO: 92383 - DNA, 20 bp, Artificial Sequence
  Synthetic
cucaggcaccuccacaaagt

SEQ ID NO: 92384 - DNA, 21 bp, Artificial Sequence
  Synthetic
gcagctgutggagagaucagt

SEQ ID NO: 92385 - DNA, 23 bp, Artificial Sequence
  Synthetic
cctggaacgcagugtacagaauc

SEQ ID NO: 92386 - DNA, 28 bp, Artificial Sequence
  Synthetic
cttagtgagaguaaagagatgcgaauga

SEQ ID NO: 92387 - DNA, 24 bp, Artificial Sequence
  Synthetic
gcattaagugctccatagcugagg

SEQ ID NO: 92388 - DNA, 21 bp, Artificial Sequence
  Synthetic
gggtucagaagttcucggagt

SEQ ID NO: 92389 - DNA, 25 bp, Artificial Sequence
  Synthetic
gcctgtcauactttgaaagugcaat

SEQ ID NO: 92390 - DNA, 22 bp, Artificial Sequence
  Synthetic
gtaagttggcuttccagugcat

SEQ ID NO: 92391 - DNA, 23 bp, Artificial Sequence
  Synthetic
cgtctcccutataaccauggcaa

SEQ ID NO: 92392 - DNA, 22 bp, Artificial Sequence
  Synthetic
ggtctttcugccaacaguccag

SEQ ID NO: 92393 - DNA, 21 bp, Artificial Sequence
  Synthetic
cctgggccugttagcatctut

SEQ ID NO: 92394 - DNA, 24 bp, Artificial Sequence
  Synthetic
accctggugaagaacatgatcuct

SEQ ID NO: 92395 - DNA, 25 bp, Artificial Sequence
  Synthetic
ggguctcttgtaugagaaagcaagg

SEQ ID NO: 92396 - DNA, 21 bp, Artificial Sequence
  Synthetic
cacttccuacccgtggtcauc

SEQ ID NO: 92397 - DNA, 22 bp, Artificial Sequence
  Synthetic
agtaagauggctaccacugcct

SEQ ID NO: 92398 - DNA, 24 bp, Artificial Sequence
  Synthetic
tgcatacccautaactggauccac

SEQ ID NO: 92399 - DNA, 24 bp, Artificial Sequence
  Synthetic
gaccaaugatggccauaggaaaac

SEQ ID NO: 92400 - DNA, 22 bp, Artificial Sequence
  Synthetic
cctgtgttugaacctggcttut

SEQ ID NO: 92401 - DNA, 26 bp, Artificial Sequence
  Synthetic
gaagggaagautccagcatauaagga

SEQ ID NO: 92402 - DNA, 27 bp, Artificial Sequence
  Synthetic
agaaattctguccggtttcagattaug

SEQ ID NO: 92403 - DNA, 22 bp, Artificial Sequence
  Synthetic
cgtgaactugcggtaggctaua

SEQ ID NO: 92404 - DNA, 23 bp, Artificial Sequence
  Synthetic
aaacaccaccacutatcacugct

SEQ ID NO: 92405 - DNA, 26 bp, Artificial Sequence
  Synthetic
ggauttattgacttcaucggccaagt

SEQ ID NO: 92406 - DNA, 28 bp, Artificial Sequence
  Synthetic
gatgagacauttcaccctcuaaaagagt

SEQ ID NO: 92407 - DNA, 24 bp, Artificial Sequence
  Synthetic
ctggataatguagagggcatugct

SEQ ID NO: 92408 - DNA, 23 bp, Artificial Sequence
  Synthetic
aatcagguggacaucaccagaag

SEQ ID NO: 92409 - DNA, 24 bp, Artificial Sequence
  Synthetic
tcctgattggacauctcccaguat

SEQ ID NO: 92410 - DNA, 23 bp, Artificial Sequence
  Synthetic
gagttcacctuctgcgaggauat

SEQ ID NO: 92411 - DNA, 22 bp, Artificial Sequence
  Synthetic
cttccacccacugtgtcttcuc

SEQ ID NO: 92412 - DNA, 26 bp, Artificial Sequence
  Synthetic
tgtcacaacaguacaaatgaguggaa

SEQ ID NO: 92413 - DNA, 24 bp, Artificial Sequence
  Synthetic
ccagatgugaatgtgaagaugggt

SEQ ID NO: 92414 - DNA, 20 bp, Artificial Sequence
  Synthetic
ccaguaggatcuccgccact

SEQ ID NO: 92415 - DNA, 25 bp, Artificial Sequence
  Synthetic
cctctgacugaggtttgtctttcuc

SEQ ID NO: 92416 - DNA, 19 bp, Artificial Sequence
  Synthetic
cctgccutgcctacugaca

SEQ ID NO: 92417 - DNA, 20 bp, Artificial Sequence
  Synthetic
ggacacagaggugacccuca

SEQ ID NO: 92418 - DNA, 26 bp, Artificial Sequence
  Synthetic
gcgggcaccutattctttatctuagg

SEQ ID NO: 92419 - DNA, 21 bp, Artificial Sequence
  Synthetic
catcgcugtcttcttcugggt

SEQ ID NO: 92420 - DNA, 21 bp, Artificial Sequence
  Synthetic
ccgacaccaggaguacctcut

SEQ ID NO: 92421 - DNA, 19 bp, Artificial Sequence
  Synthetic
cccagguggctctacucac

SEQ ID NO: 92422 - DNA, 19 bp, Artificial Sequence
  Synthetic
gctacagggccutgtgugt

SEQ ID NO: 92423 - DNA, 27 bp, Artificial Sequence
  Synthetic
ccutactctcttcaucaaagggaacag

SEQ ID NO: 92424 - DNA, 25 bp, Artificial Sequence
  Synthetic
augttacagaagaugaggaggagga

SEQ ID NO: 92425 - DNA, 19 bp, Artificial Sequence
  Synthetic
gcaggugcacgctctuaca

SEQ ID NO: 92426 - DNA, 25 bp, Artificial Sequence
  Synthetic
ggaagauaauggaacggaggaagaa

SEQ ID NO: 92427 - DNA, 26 bp, Artificial Sequence
  Synthetic
cuaaatactcttttugcacccaccag

SEQ ID NO: 92428 - DNA, 27 bp, Artificial Sequence
  Synthetic
tggccaaacugttcttttgttttaugg

SEQ ID NO: 92429 - DNA, 25 bp, Artificial Sequence
  Synthetic
cgggtatguggctttccttcuaaag

SEQ ID NO: 92430 - DNA, 23 bp, Artificial Sequence
  Synthetic
ctgtgtcaaguggatggtuccat

SEQ ID NO: 92431 - DNA, 25 bp, Artificial Sequence
  Synthetic
gaattuggccaagaaggacugaaag

SEQ ID NO: 92432 - DNA, 22 bp, Artificial Sequence
  Synthetic
accatcacugaccatctccugt

SEQ ID NO: 92433 - DNA, 25 bp, Artificial Sequence
  Synthetic
gcccagcugaactgattacttugat

SEQ ID NO: 92434 - DNA, 21 bp, Artificial Sequence
  Synthetic
ggtcagauggagccctguaat

SEQ ID NO: 92435 - DNA, 28 bp, Artificial Sequence
  Synthetic
gctctcatgtcucaatttttgctttcut

SEQ ID NO: 92436 - DNA, 25 bp, Artificial Sequence
  Synthetic
aggugatgtcttauggagagagacc

SEQ ID NO: 92437 - DNA, 24 bp, Artificial Sequence
  Synthetic
gccacccagutacattatgtucca

SEQ ID NO: 92438 - DNA, 26 bp, Artificial Sequence
  Synthetic
accatcaguatttgaaagtcugcact

SEQ ID NO: 92439 - DNA, 28 bp, Artificial Sequence
  Synthetic
cgatttgtaacaggcutcttggtattuc

SEQ ID NO: 92440 - DNA, 28 bp, Artificial Sequence
  Synthetic
ttcatcauaaaaggtgacuaaaccagca

SEQ ID NO: 92441 - DNA, 22 bp, Artificial Sequence
  Synthetic
ttccatccaggucagcaaucag

SEQ ID NO: 92442 - DNA, 21 bp, Artificial Sequence
  Synthetic
gctcctgcuacatgggactut

SEQ ID NO: 92443 - DNA, 22 bp, Artificial Sequence
  Synthetic
gaatccugatgtggucaccact

SEQ ID NO: 92444 - DNA, 21 bp, Artificial Sequence
  Synthetic
agtuacccagcaugccacaat

SEQ ID NO: 92445 - DNA, 18 bp, Artificial Sequence
  Synthetic
ggaaggtcguggtgcgut

SEQ ID NO: 92446 - DNA, 20 bp, Artificial Sequence
  Synthetic
tggtgcttcucccgtaggua

SEQ ID NO: 92447 - DNA, 21 bp, Artificial Sequence
  Synthetic
gcagaagacucccaagtugga

SEQ ID NO: 92448 - DNA, 22 bp, Artificial Sequence
  Synthetic
guagtacatggcuccacccaac

SEQ ID NO: 92449 - DNA, 24 bp, Artificial Sequence
  Synthetic
gcctggaagcugcatagtatugat

SEQ ID NO: 92450 - DNA, 24 bp, Artificial Sequence
  Synthetic
tctgcctcacuctctgtttctcut

SEQ ID NO: 92451 - DNA, 27 bp, Artificial Sequence
  Synthetic
acataaatcttcugagctgagttccug

SEQ ID NO: 92452 - DNA, 24 bp, Artificial Sequence
  Synthetic
atcaggtttgaguggttcactgut

SEQ ID NO: 92453 - DNA, 21 bp, Artificial Sequence
  Synthetic
tgtcaggcutgaggctacuga

SEQ ID NO: 92454 - DNA, 28 bp, Artificial Sequence
  Synthetic
aacttgagttcuggttaaagctagtcug

SEQ ID NO: 92455 - DNA, 21 bp, Artificial Sequence
  Synthetic
ccuaatuggccggcagaagat

SEQ ID NO: 92456 - DNA, 26 bp, Artificial Sequence
  Synthetic
aagtgcccatutacagtgaagaauct

SEQ ID NO: 92457 - DNA, 22 bp, Artificial Sequence
  Synthetic
ggaacactugccaatggguaca

SEQ ID NO: 92458 - DNA, 22 bp, Artificial Sequence
  Synthetic
gcaagaggcacaaaugtuacca

SEQ ID NO: 92459 - DNA, 27 bp, Artificial Sequence
  Synthetic
ccctcctcuagactgcattgaaauaat

SEQ ID NO: 92460 - DNA, 28 bp, Artificial Sequence
  Synthetic
aattgaagaugacagtgaaguagcagaa

SEQ ID NO: 92461 - DNA, 28 bp, Artificial Sequence
  Synthetic
attaaaauagatgtttccugcccacaga

SEQ ID NO: 92462 - DNA, 24 bp, Artificial Sequence
  Synthetic
ggaagaaccuctcccttucaaact

SEQ ID NO: 92463 - DNA, 28 bp, Artificial Sequence
  Synthetic
tctttgtctcaacuttataggcaccaut

SEQ ID NO: 92464 - DNA, 21 bp, Artificial Sequence
  Synthetic
caguacagaaggcgaauggct

SEQ ID NO: 92465 - DNA, 28 bp, Artificial Sequence
  Synthetic
tgagttgagacugagtgcatttcattua

SEQ ID NO: 92466 - DNA, 28 bp, Artificial Sequence
  Synthetic
gggttttctttugacttatcacctcuca

SEQ ID NO: 92467 - DNA, 22 bp, Artificial Sequence
  Synthetic
gaagctacutgccttttugcca

SEQ ID NO: 92468 - DNA, 20 bp, Artificial Sequence
  Synthetic
cctgucagccagacucagga

SEQ ID NO: 92469 - DNA, 28 bp, Artificial Sequence
  Synthetic
gcaatgacattaagugagaacacaccua

SEQ ID NO: 92470 - DNA, 29 bp, Artificial Sequence
  Synthetic
gaaatttaccauagcaggtcttcttguct

SEQ ID NO: 92471 - DNA, 22 bp, Artificial Sequence
  Synthetic
gtgcagcuaatgauggcaaagg

SEQ ID NO: 92472 - DNA, 26 bp, Artificial Sequence
  Synthetic
agaacaaaugagaatgcagcauacca

SEQ ID NO: 92473 - DNA, 27 bp, Artificial Sequence
  Synthetic
acaaccactgucaattatgtacgugat

SEQ ID NO: 92474 - DNA, 22 bp, Artificial Sequence
  Synthetic
ggtttctctcuctgtgccauct

SEQ ID NO: 92475 - DNA, 29 bp, Artificial Sequence
  Synthetic
gctgatgaauacatgatccccauagaaaa

SEQ ID NO: 92476 - DNA, 27 bp, Artificial Sequence
  Synthetic
tgattgatuagacacatgugagagcag

SEQ ID NO: 92477 - DNA, 24 bp, Artificial Sequence
  Synthetic
tgaataaccccugtcaaccucaga

SEQ ID NO: 92478 - DNA, 21 bp, Artificial Sequence
  Synthetic
ccagggacucctatccccaua

SEQ ID NO: 92479 - DNA, 22 bp, Artificial Sequence
  Synthetic
ggatgttcccautggtctgguc

SEQ ID NO: 92480 - DNA, 22 bp, Artificial Sequence
  Synthetic
aagtttgacaggcacuggctua

SEQ ID NO: 92481 - DNA, 22 bp, Artificial Sequence
  Synthetic
cggcatcatucccaggaaaauc

SEQ ID NO: 92482 - DNA, 21 bp, Artificial Sequence
  Synthetic
tgacctugagggccactguat

SEQ ID NO: 92483 - DNA, 27 bp, Artificial Sequence
  Synthetic
ctgaaagacgaauggtttgatacucac

SEQ ID NO: 92484 - DNA, 18 bp, Artificial Sequence
  Synthetic
gggcaucaggatgugggt

SEQ ID NO: 92485 - DNA, 28 bp, Artificial Sequence
  Synthetic
accacatgcacaautaagaaacattugt

SEQ ID NO: 92486 - DNA, 21 bp, Artificial Sequence
  Synthetic
gccacgagggutagacaaugt

SEQ ID NO: 92487 - DNA, 28 bp, Artificial Sequence
  Synthetic
aggaatgtatuggattcagaaugagcaa

SEQ ID NO: 92488 - DNA, 28 bp, Artificial Sequence
  Synthetic
agagaagcucacaaaaatttgtcttugg

SEQ ID NO: 92489 - DNA, 19 bp, Artificial Sequence
  Synthetic
agctgtcuggtgtgctgut

SEQ ID NO: 92490 - DNA, 26 bp, Artificial Sequence
  Synthetic
acttctgctuttgcttctttuaagcc

SEQ ID NO: 92491 - DNA, 23 bp, Artificial Sequence
  Synthetic
atttgctgtctugcctgtgacua

SEQ ID NO: 92492 - DNA, 23 bp, Artificial Sequence
  Synthetic
gcutctttuaagccaacagcaca

SEQ ID NO: 92493 - DNA, 19 bp, Artificial Sequence
  Synthetic
cccgccacaggagucaaut

SEQ ID NO: 92494 - DNA, 19 bp, Artificial Sequence
  Synthetic
caacagcaucacggtgucc

SEQ ID NO: 92495 - DNA, 21 bp, Artificial Sequence
  Synthetic
tgtgaggccuatgagctccua

SEQ ID NO: 92496 - DNA, 23 bp, Artificial Sequence
  Synthetic
cttgcaautgcttttguccggat

SEQ ID NO: 92497 - DNA, 28 bp, Artificial Sequence
  Synthetic
gtcattcttaccucagtttgtctttucc

SEQ ID NO: 92498 - DNA, 22 bp, Artificial Sequence
  Synthetic
attggcugagaacaaacugggt

SEQ ID NO: 92499 - DNA, 23 bp, Artificial Sequence
  Synthetic
gctctcgaaauttcaccccauga

SEQ ID NO: 92500 - DNA, 33 bp, Artificial Sequence
  Synthetic
atgatacttagguaagatacttacctctugaaa

SEQ ID NO: 92501 - DNA, 27 bp, Artificial Sequence
  Synthetic
cttcattcagugcattcatcttuccat

SEQ ID NO: 92502 - DNA, 27 bp, Artificial Sequence
  Synthetic
caatggaaagaugaatgcactgaauga

SEQ ID NO: 92503 - DNA, 22 bp, Artificial Sequence
  Synthetic
tgaaagacucactgccatucgt

SEQ ID NO: 92504 - DNA, 27 bp, Artificial Sequence
  Synthetic
ggaaagatgaaugcactgaatgaagut

SEQ ID NO: 92505 - DNA, 29 bp, Artificial Sequence
  Synthetic
tcctatgaagaagaacugaaagacucact

SEQ ID NO: 92506 - DNA, 23 bp, Artificial Sequence
  Synthetic
cuaaagcacgagggttuaccaga

SEQ ID NO: 92507 - DNA, 27 bp, Artificial Sequence
  Synthetic
gcagcatcagutgtttgtgtttguaat

SEQ ID NO: 92508 - DNA, 26 bp, Artificial Sequence
  Synthetic
acctggaatatguacggactctguat

SEQ ID NO: 92509 - DNA, 24 bp, Artificial Sequence
  Synthetic
caagcutttcgacauaagggacag

SEQ ID NO: 92510 - DNA, 27 bp, Artificial Sequence
  Synthetic
ggagucaaagtuaagacaagacagagt

SEQ ID NO: 92511 - DNA, 27 bp, Artificial Sequence
  Synthetic
ccaagaaccagaaaugtatcccaguaa

SEQ ID NO: 92512 - DNA, 21 bp, Artificial Sequence
  Synthetic
ctggttugcaggtgacatugg

SEQ ID NO: 92513 - DNA, 23 bp, Artificial Sequence
  Synthetic
gaccaggagaagcucagttugat

SEQ ID NO: 92514 - DNA, 24 bp, Artificial Sequence
  Synthetic
actccaagucaccttucaaaacca

SEQ ID NO: 92515 - DNA, 23 bp, Artificial Sequence
  Synthetic
agtccaguaaacaccaaaucgct

SEQ ID NO: 92516 - DNA, 32 bp, Artificial Sequence
  Synthetic
gaaatgattgcatucaatgtacatatcuaaca

SEQ ID NO: 92517 - DNA, 27 bp, Artificial Sequence
  Synthetic
ggagaatatgatugtgctgatggtuca

SEQ ID NO: 92518 - DNA, 28 bp, Artificial Sequence
  Synthetic
cagtcatctugcccattacatctuaagt

SEQ ID NO: 92519 - DNA, 28 bp, Artificial Sequence
  Synthetic
cacaaattttctcuctctctctcctuct

SEQ ID NO: 92520 - DNA, 20 bp, Artificial Sequence
  Synthetic
ccctctctgucccacccaua

SEQ ID NO: 92521 - DNA, 20 bp, Artificial Sequence
  Synthetic
caggaacucatccucaggca

SEQ ID NO: 92522 - DNA, 26 bp, Artificial Sequence
  Synthetic
acacagaattaucagctggtuggaat

SEQ ID NO: 92523 - DNA, 21 bp, Artificial Sequence
  Synthetic
actgcgguacagtgtaacugg

SEQ ID NO: 92524 - DNA, 21 bp, Artificial Sequence
  Synthetic
gagaagcuggcccagattuga

SEQ ID NO: 92525 - DNA, 22 bp, Artificial Sequence
  Synthetic
ctgagtcacggguatcgtcaut

SEQ ID NO: 92526 - DNA, 20 bp, Artificial Sequence
  Synthetic
agcccugagaatgccttugg

SEQ ID NO: 92527 - DNA, 24 bp, Artificial Sequence
  Synthetic
ggaatgatuagcaggagucagaca

SEQ ID NO: 92528 - DNA, 26 bp, Artificial Sequence
  Synthetic
gataatgaagauaccagtuggaggct

SEQ ID NO: 92529 - DNA, 21 bp, Artificial Sequence
  Synthetic
gaagtgtgaugtgccccauct

SEQ ID NO: 92530 - DNA, 19 bp, Artificial Sequence
  Synthetic
ggccgggutgggatgatuc

SEQ ID NO: 92531 - DNA, 21 bp, Artificial Sequence
  Synthetic
tgcagguagaggagttguggt

SEQ ID NO: 92532 - DNA, 28 bp, Artificial Sequence
  Synthetic
ttttctccagttcucctctacaaatgug

SEQ ID NO: 92533 - DNA, 28 bp, Artificial Sequence
  Synthetic
ccgttttgaagautgttgagaaatugga

SEQ ID NO: 92534 - DNA, 24 bp, Artificial Sequence
  Synthetic
ccagattccatucccttaggcaut

SEQ ID NO: 92535 - DNA, 18 bp, Artificial Sequence
  Synthetic
ccagcuggcctucaccag

SEQ ID NO: 92536 - DNA, 28 bp, Artificial Sequence
  Synthetic
cccaacagtcugtatttcaagtguaaga

SEQ ID NO: 92537 - DNA, 27 bp, Artificial Sequence
  Synthetic
gcagatgaagcauttttctctgugaat

SEQ ID NO: 92538 - DNA, 28 bp, Artificial Sequence
  Synthetic
gtaaatgatucagactttcacuggagga

SEQ ID NO: 92539 - DNA, 23 bp, Artificial Sequence
  Synthetic
aaaccggcacauacatctgtgua

SEQ ID NO: 92540 - DNA, 21 bp, Artificial Sequence
  Synthetic
aaaccggagccaacuttcuct

SEQ ID NO: 92541 - DNA, 19 bp, Artificial Sequence
  Synthetic
gtcccuccccagcatctuc

SEQ ID NO: 92542 - DNA, 21 bp, Artificial Sequence
  Synthetic
gcaacgccutttctggcauac

SEQ ID NO: 92543 - DNA, 22 bp, Artificial Sequence
  Synthetic
aacccgaggugaaaaugaacca

SEQ ID NO: 92544 - DNA, 26 bp, Artificial Sequence
  Synthetic
tccttttgccaacaauccaacatuag

SEQ ID NO: 92545 - DNA, 26 bp, Artificial Sequence
  Synthetic
cattttgccuaccaggaaatttggut

SEQ ID NO: 92546 - DNA, 24 bp, Artificial Sequence
  Synthetic
gcaaggctauaaagtcgctugaaa

SEQ ID NO: 92547 - DNA, 27 bp, Artificial Sequence
  Synthetic
gaccctgtugacagtacttuaagagat

SEQ ID NO: 92548 - DNA, 27 bp, Artificial Sequence
  Synthetic
cctgtactacauggagtctgatgauga

SEQ ID NO: 92549 - DNA, 27 bp, Artificial Sequence
  Synthetic
acaggacctacutctctaatctcagug

SEQ ID NO: 92550 - DNA, 22 bp, Artificial Sequence
  Synthetic
tcatgcauacgctcaaccucag

SEQ ID NO: 92551 - DNA, 23 bp, Artificial Sequence
  Synthetic
ctctaaugccaaggcagtctugt

SEQ ID NO: 92552 - DNA, 20 bp, Artificial Sequence
  Synthetic
cccagggcugtctgtagaug

SEQ ID NO: 92553 - DNA, 20 bp, Artificial Sequence
  Synthetic
ttctgggcgcugtacaugag

SEQ ID NO: 92554 - DNA, 24 bp, Artificial Sequence
  Synthetic
gtttgtatggcucttaccgtcuga

SEQ ID NO: 92555 - DNA, 23 bp, Artificial Sequence
  Synthetic
ggaggcutttctcaatuccgact

SEQ ID NO: 92556 - DNA, 17 bp, Artificial Sequence
  Synthetic
ggcugaccagctccgut

SEQ ID NO: 92557 - DNA, 20 bp, Artificial Sequence
  Synthetic
ggaaggagcuggaucccaat

SEQ ID NO: 92558 - DNA, 20 bp, Artificial Sequence
  Synthetic
gcagtttgcucagctguacc

SEQ ID NO: 92559 - DNA, 22 bp, Artificial Sequence
  Synthetic
acuggagaaauggcacccaaaa

SEQ ID NO: 92560 - DNA, 26 bp, Artificial Sequence
  Synthetic
ccagaaaagaguaccctgtgcttaug

SEQ ID NO: 92561 - DNA, 28 bp, Artificial Sequence
  Synthetic
aatcatccagugctctaattccaugaat

SEQ ID NO: 92562 - DNA, 21 bp, Artificial Sequence
  Synthetic
cgautctgtctucagccacga

SEQ ID NO: 92563 - DNA, 21 bp, Artificial Sequence
  Synthetic
gctatcaaggucgagcacugt

SEQ ID NO: 92564 - DNA, 24 bp, Artificial Sequence
  Synthetic
tuctcgaauacaccgaccacaaaa

SEQ ID NO: 92565 - DNA, 28 bp, Artificial Sequence
  Synthetic
caagggtattcagutgtcagtggttaua

SEQ ID NO: 92566 - DNA, 22 bp, Artificial Sequence
  Synthetic
gggaccguattctgaagcucaa

SEQ ID NO: 92567 - DNA, 21 bp, Artificial Sequence
  Synthetic
accgtguctggaaacauagcc

SEQ ID NO: 92568 - DNA, 22 bp, Artificial Sequence
  Synthetic
cucaagaatuggaagccagcaa

SEQ ID NO: 92569 - DNA, 21 bp, Artificial Sequence
  Synthetic
accagggcccuttttagcuac

SEQ ID NO: 92570 - DNA, 27 bp, Artificial Sequence
  Synthetic
ttcagcagaaaacaaaagugtugaagt

SEQ ID NO: 92571 - DNA, 28 bp, Artificial Sequence
  Synthetic
tutaccagtgagauaggaacaaagcaaa

SEQ ID NO: 92572 - DNA, 27 bp, Artificial Sequence
  Synthetic
cttctgctaataaugcactctgaguga

SEQ ID NO: 92573 - DNA, 28 bp, Artificial Sequence
  Synthetic
agtgttcattgatutggcctttttgaut

SEQ ID NO: 92574 - DNA, 24 bp, Artificial Sequence
  Synthetic
gautaactacucaaaggcccccat

SEQ ID NO: 92575 - DNA, 23 bp, Artificial Sequence
  Synthetic
agcctcucagcaacagaactuac

SEQ ID NO: 92576 - DNA, 23 bp, Artificial Sequence
  Synthetic
gcugaacatccuagaagccaaga

SEQ ID NO: 92577 - DNA, 21 bp, Artificial Sequence
  Synthetic
gtttgccagugtgacuccaac

SEQ ID NO: 92578 - DNA, 22 bp, Artificial Sequence
  Synthetic
ccacaatccugtccacatcugt

SEQ ID NO: 92579 - DNA, 27 bp, Artificial Sequence
  Synthetic
cttgaagctgguatctatgaagtuccc

SEQ ID NO: 92580 - DNA, 24 bp, Artificial Sequence
  Synthetic
agtccacagaugttuccaaacaca

SEQ ID NO: 92581 - DNA, 27 bp, Artificial Sequence
  Synthetic
tgctaacttcccucctttcttttucag

SEQ ID NO: 92582 - DNA, 29 bp, Artificial Sequence
  Synthetic
cctttagtttctuctgcttctagtctuca

SEQ ID NO: 92583 - DNA, 25 bp, Artificial Sequence
  Synthetic
gtgcttgugccgataatcaacttut

SEQ ID NO: 92584 - DNA, 24 bp, Artificial Sequence
  Synthetic
gtgcaagttgucccattttcaucc

SEQ ID NO: 92585 - DNA, 26 bp, Artificial Sequence
  Synthetic
tctgacacattugctttcttcctcut

SEQ ID NO: 92586 - DNA, 23 bp, Artificial Sequence
  Synthetic
ggacttgaauggctcagtgtuct

SEQ ID NO: 92587 - DNA, 21 bp, Artificial Sequence
  Synthetic
tgcttcaggaugcctcatgug

SEQ ID NO: 92588 - DNA, 21 bp, Artificial Sequence
  Synthetic
gacccgaaccaaaccutgtut

SEQ ID NO: 92589 - DNA, 24 bp, Artificial Sequence
  Synthetic
cagtagaagaagauggctguggag

SEQ ID NO: 92590 - DNA, 28 bp, Artificial Sequence
  Synthetic
actaaagtgactucttttctggctctut

SEQ ID NO: 92591 - DNA, 22 bp, Artificial Sequence
  Synthetic
tccuctcctuccccaagaaaca

SEQ ID NO: 92592 - DNA, 21 bp, Artificial Sequence
  Synthetic
ggauctcugaccagaggccaa

SEQ ID NO: 92593 - DNA, 22 bp, Artificial Sequence
  Synthetic
cgtagacaaggagaugcaggua

SEQ ID NO: 92594 - DNA, 22 bp, Artificial Sequence
  Synthetic
ccaucaccccagaagcactuag

SEQ ID NO: 92595 - DNA, 27 bp, Artificial Sequence
  Synthetic
tgctggataccaaugaacatgatuaca

SEQ ID NO: 92596 - DNA, 26 bp, Artificial Sequence
  Synthetic
gggacactugccataaggtttaucag

SEQ ID NO: 92597 - DNA, 24 bp, Artificial Sequence
  Synthetic
ctaatatgaucccagcagccugag

SEQ ID NO: 92598 - DNA, 25 bp, Artificial Sequence
  Synthetic
gcaggaacaucaaatgtcaagtuca

SEQ ID NO: 92599 - DNA, 28 bp, Artificial Sequence
  Synthetic
gggagcttguaggtaaatgaaacauagg

SEQ ID NO: 92600 - DNA, 26 bp, Artificial Sequence
  Synthetic
gucaagtttctttuggagaaggcaaa

SEQ ID NO: 92601 - DNA, 28 bp, Artificial Sequence
  Synthetic
gatgcttttuaagcccaataactgtuga

SEQ ID NO: 92602 - DNA, 19 bp, Artificial Sequence
  Synthetic
ctgcgauccgacucaccaa

SEQ ID NO: 92603 - DNA, 28 bp, Artificial Sequence
  Synthetic
catatcagagcuttgaacaggtagugaa

SEQ ID NO: 92604 - DNA, 21 bp, Artificial Sequence
  Synthetic
ccttgtctgacuctgctgcuc

SEQ ID NO: 92605 - DNA, 21 bp, Artificial Sequence
  Synthetic
gtagctgguggtgtccatcuc

SEQ ID NO: 92606 - DNA, 21 bp, Artificial Sequence
  Synthetic
gggacccagguttaagaugct

SEQ ID NO: 92607 - DNA, 21 bp, Artificial Sequence
  Synthetic
gggagtcacugccattttugg

SEQ ID NO: 92608 - DNA, 18 bp, Artificial Sequence
  Synthetic
gcagcuggtcaccuacga

SEQ ID NO: 92609 - DNA, 18 bp, Artificial Sequence
  Synthetic
cctcgguggcttcugcac

SEQ ID NO: 92610 - DNA, 19 bp, Artificial Sequence
  Synthetic
cccaucccggaagagtuca

SEQ ID NO: 92611 - DNA, 18 bp, Artificial Sequence
  Synthetic
ccgggaggugauccccat

SEQ ID NO: 92612 - DNA, 25 bp, Artificial Sequence
  Synthetic
gtagccugagaagggttctuaacaa

SEQ ID NO: 92613 - DNA, 24 bp, Artificial Sequence
  Synthetic
agtgattucttctgctucaggcaa

SEQ ID NO: 92614 - DNA, 18 bp, Artificial Sequence
  Synthetic
gcccggccutccctcuat

SEQ ID NO: 92615 - DNA, 18 bp, Artificial Sequence
  Synthetic
ggagcccucgtagccgua

SEQ ID NO: 92616 - DNA, 21 bp, Artificial Sequence
  Synthetic
gcaagatcaccugttgccuga

SEQ ID NO: 92617 - DNA, 27 bp, Artificial Sequence
  Synthetic
ggaatgaaaauccaaagcaatguacca

SEQ ID NO: 92618 - DNA, 27 bp, Artificial Sequence
  Synthetic
tccttactttcuccactttgctttuca

SEQ ID NO: 92619 - DNA, 23 bp, Artificial Sequence
  Synthetic
cttucaggagccgguaaaacaag

SEQ ID NO: 92620 - DNA, 17 bp, Artificial Sequence
  Synthetic
gctgaccuggcctucct

SEQ ID NO: 92621 - DNA, 18 bp, Artificial Sequence
  Synthetic
cagcagggucccacucac

SEQ ID NO: 92622 - DNA, 20 bp, Artificial Sequence
  Synthetic
gggagggcaacaucgauacc

SEQ ID NO: 92623 - DNA, 18 bp, Artificial Sequence
  Synthetic
cccacagccuggcttguc

SEQ ID NO: 92624 - DNA, 18 bp, Artificial Sequence
  Synthetic
ggcttgugcagcctcuct

SEQ ID NO: 92625 - DNA, 17 bp, Artificial Sequence
  Synthetic
caccacgcugacccugt

SEQ ID NO: 92626 - DNA, 19 bp, Artificial Sequence
  Synthetic
ccuacgacacgcugcacat

SEQ ID NO: 92627 - DNA, 17 bp, Artificial Sequence
  Synthetic
ggguccgagccguacag

SEQ ID NO: 92628 - DNA, 22 bp, Artificial Sequence
  Synthetic
cactgtctgucctggcttctua

SEQ ID NO: 92629 - DNA, 19 bp, Artificial Sequence
  Synthetic
acagcaugcccgtcaugat

SEQ ID NO: 92630 - DNA, 20 bp, Artificial Sequence
  Synthetic
ccctcagcgcutgcttuact

SEQ ID NO: 92631 - DNA, 22 bp, Artificial Sequence
  Synthetic
gactgaaucggagauggagacc

SEQ ID NO: 92632 - DNA, 23 bp, Artificial Sequence
  Synthetic
cgttctccaugaactctgugaga

SEQ ID NO: 92633 - DNA, 22 bp, Artificial Sequence
  Synthetic
tgtggcaaucaagacccugaag

SEQ ID NO: 92634 - DNA, 20 bp, Artificial Sequence
  Synthetic
ccaggaugggttgccatuga

SEQ ID NO: 92635 - DNA, 24 bp, Artificial Sequence
  Synthetic
ctttctctccuacaagcttuccca

SEQ ID NO: 92636 - DNA, 25 bp, Artificial Sequence
  Synthetic
aacuaattttuggcaacagcaacct

SEQ ID NO: 92637 - DNA, 28 bp, Artificial Sequence
  Synthetic
gtagatactgaucactggagtctucaga

SEQ ID NO: 92638 - DNA, 20 bp, Artificial Sequence
  Synthetic
ggcctcgcucagaaacucac

SEQ ID NO: 92639 - DNA, 21 bp, Artificial Sequence
  Synthetic
gatgacctcugcgtccttgut

SEQ ID NO: 92640 - DNA, 22 bp, Artificial Sequence
  Synthetic
ggccugaaatuccaggacaaca

SEQ ID NO: 92641 - DNA, 20 bp, Artificial Sequence
  Synthetic
gacgtccaggutatggcuca

SEQ ID NO: 92642 - DNA, 18 bp, Artificial Sequence
  Synthetic
ggugucccagccaggaga

SEQ ID NO: 92643 - DNA, 18 bp, Artificial Sequence
  Synthetic
ccucacccagcagctuga

SEQ ID NO: 92644 - DNA, 20 bp, Artificial Sequence
  Synthetic
tggttgugaaggaccuccct

SEQ ID NO: 92645 - DNA, 24 bp, Artificial Sequence
  Synthetic
ggagatcttcucactgggcuacat

SEQ ID NO: 92646 - DNA, 21 bp, Artificial Sequence
  Synthetic
gcctgaacacugcacatugaa

SEQ ID NO: 92647 - DNA, 22 bp, Artificial Sequence
  Synthetic
tcatagcgaaugctcucagcag

SEQ ID NO: 92648 - DNA, 22 bp, Artificial Sequence
  Synthetic
cctcgccaaacucacctucaaa

SEQ ID NO: 92649 - DNA, 24 bp, Artificial Sequence
  Synthetic
tcgatgtctccuacgtcaagatug

SEQ ID NO: 92650 - DNA, 20 bp, Artificial Sequence
  Synthetic
tgaccucgtaguccagcaca

SEQ ID NO: 92651 - DNA, 22 bp, Artificial Sequence
  Synthetic
ggacagagcuaccaugcacaag

SEQ ID NO: 92652 - DNA, 17 bp, Artificial Sequence
  Synthetic
ggcgauggccctggaut

SEQ ID NO: 92653 - DNA, 18 bp, Artificial Sequence
  Synthetic
gaugccugcaccgcaaag

SEQ ID NO: 92654 - DNA, 24 bp, Artificial Sequence
  Synthetic
gtcaccaatucaaaaagcggtuca

SEQ ID NO: 92655 - DNA, 25 bp, Artificial Sequence
  Synthetic
gucataggaaggaugaaaggagcaa

SEQ ID NO: 92656 - DNA, 18 bp, Artificial Sequence
  Synthetic
gttggugcgcccaggaua

SEQ ID NO: 92657 - DNA, 23 bp, Artificial Sequence
  Synthetic
cctgaggcuaatcctgtccttuc

SEQ ID NO: 92658 - DNA, 22 bp, Artificial Sequence
  Synthetic
tgtccucctcgattucagcaag

SEQ ID NO: 92659 - DNA, 24 bp, Artificial Sequence
  Synthetic
ccaacagaugagaacaacgtguca

SEQ ID NO: 92660 - DNA, 27 bp, Artificial Sequence
  Synthetic
atcagatucacacaaacaucaggaaga

SEQ ID NO: 92661 - DNA, 26 bp, Artificial Sequence
  Synthetic
tggctgacgaagugtttttaucaaac

SEQ ID NO: 92662 - DNA, 22 bp, Artificial Sequence
  Synthetic
gttcctgccgaugttagtguca

SEQ ID NO: 92663 - DNA, 23 bp, Artificial Sequence
  Synthetic
ccagacaccautaagccagucac

SEQ ID NO: 92664 - DNA, 22 bp, Artificial Sequence
  Synthetic
ctctcggucactacaggagtuc

SEQ ID NO: 92665 - DNA, 33 bp, Artificial Sequence
  Synthetic
aatcttcagtagauacataatcctgtcatttuc

SEQ ID NO: 92666 - DNA, 20 bp, Artificial Sequence
  Synthetic
ccctctccuccctcagttuc

SEQ ID NO: 92667 - DNA, 24 bp, Artificial Sequence
  Synthetic
gactctgtcuctctgtctgtcuca

SEQ ID NO: 92668 - DNA, 21 bp, Artificial Sequence
  Synthetic
aagucagcaaccccaggatuc

SEQ ID NO: 92669 - DNA, 23 bp, Artificial Sequence
  Synthetic
tgtccaggagugttagucacaca

SEQ ID NO: 92670 - DNA, 26 bp, Artificial Sequence
  Synthetic
acuttcctattaauggaaccgaagcc

SEQ ID NO: 92671 - DNA, 24 bp, Artificial Sequence
  Synthetic
gctggacaaagauggccacauaaa

SEQ ID NO: 92672 - DNA, 25 bp, Artificial Sequence
  Synthetic
ctattaauggaaccgaagccuacct

SEQ ID NO: 92673 - DNA, 25 bp, Artificial Sequence
  Synthetic
cacagttggagaauctaatgcugga

SEQ ID NO: 92674 - DNA, 28 bp, Artificial Sequence
  Synthetic
ccagaaaaggagaauaauagaacaggga

SEQ ID NO: 92675 - DNA, 25 bp, Artificial Sequence
  Synthetic
gctgtcagttaugtgatggctacug

SEQ ID NO: 92676 - DNA, 25 bp, Artificial Sequence
  Synthetic
tcctcttatgtgutcgctttcctug

SEQ ID NO: 92677 - DNA, 26 bp, Artificial Sequence
  Synthetic
agcuaaaacggugaagcaaaacaaaa

SEQ ID NO: 92678 - DNA, 21 bp, Artificial Sequence
  Synthetic
tcacuacctuccgcacaacag

SEQ ID NO: 92679 - DNA, 27 bp, Artificial Sequence
  Synthetic
gccaagaaagtucaaaagaatcctuca

SEQ ID NO: 92680 - DNA, 19 bp, Artificial Sequence
  Synthetic
tggccauctttguccagca

SEQ ID NO: 92681 - DNA, 28 bp, Artificial Sequence
  Synthetic
ttccaaaataccutactcagcatucagt

SEQ ID NO: 92682 - DNA, 21 bp, Artificial Sequence
  Synthetic
tggcatgugccaccattguaa

SEQ ID NO: 92683 - DNA, 27 bp, Artificial Sequence
  Synthetic
agctttcagcaauaatgttgccaauaa

SEQ ID NO: 92684 - DNA, 18 bp, Artificial Sequence
  Synthetic
ccactgugccccagagut

SEQ ID NO: 92685 - DNA, 20 bp, Artificial Sequence
  Synthetic
gtcttcctcugcctctgcug

SEQ ID NO: 92686 - DNA, 19 bp, Artificial Sequence
  Synthetic
ccaccaggugcaggugaag

SEQ ID NO: 92687 - DNA, 17 bp, Artificial Sequence
  Synthetic
cccugccggtcacuaca

SEQ ID NO: 92688 - DNA, 24 bp, Artificial Sequence
  Synthetic
agcaagcaaguaacguagaaacca

SEQ ID NO: 92689 - DNA, 22 bp, Artificial Sequence
  Synthetic
gttgccuctttcatcugccaag

SEQ ID NO: 92690 - DNA, 19 bp, Artificial Sequence
  Synthetic
ggccctuggactgccauat

SEQ ID NO: 92691 - DNA, 19 bp, Artificial Sequence
  Synthetic
gcctucacactcctugcac

SEQ ID NO: 92692 - DNA, 25 bp, Artificial Sequence
  Synthetic
aaautatccacguaaaccacaccga

SEQ ID NO: 92693 - DNA, 28 bp, Artificial Sequence
  Synthetic
tgatggcattccucactgtaaagauaaa

SEQ ID NO: 92694 - DNA, 21 bp, Artificial Sequence
  Synthetic
ggacctgcucttcaatgucgt

SEQ ID NO: 92695 - DNA, 22 bp, Artificial Sequence
  Synthetic
actaacacucggctctcaguca

SEQ ID NO: 92696 - DNA, 22 bp, Artificial Sequence
  Synthetic
tttaggtctugggtctcccgua

SEQ ID NO: 92697 - DNA, 23 bp, Artificial Sequence
  Synthetic
ggagagcagcgguagtaggauaa

SEQ ID NO: 92698 - DNA, 21 bp, Artificial Sequence
  Synthetic
gucctcctuaagcacccaact

SEQ ID NO: 92699 - DNA, 24 bp, Artificial Sequence
  Synthetic
ggaacttucagaagaggtgcugac

SEQ ID NO: 92700 - DNA, 20 bp, Artificial Sequence
  Synthetic
gcagggaugaggtccactuc

SEQ ID NO: 92701 - DNA, 20 bp, Artificial Sequence
  Synthetic
tgagcucagacaccccatua

SEQ ID NO: 92702 - DNA, 20 bp, Artificial Sequence
  Synthetic
gaggagaagccgaugtguga

SEQ ID NO: 92703 - DNA, 21 bp, Artificial Sequence
  Synthetic
cggaacucgtgcacucagaag

SEQ ID NO: 92704 - DNA, 26 bp, Artificial Sequence
  Synthetic
ccacaguagagcagtttttcatcuga

SEQ ID NO: 92705 - DNA, 26 bp, Artificial Sequence
  Synthetic
ttgccatugcacaaaagtattgacut

SEQ ID NO: 92706 - DNA, 21 bp, Artificial Sequence
  Synthetic
catcttagaggugcaggcugt

SEQ ID NO: 92707 - DNA, 22 bp, Artificial Sequence
  Synthetic
ccaggcuggagatcaggaguag

SEQ ID NO: 92708 - DNA, 22 bp, Artificial Sequence
  Synthetic
ctgaatcggucttccaucaggt

SEQ ID NO: 92709 - DNA, 27 bp, Artificial Sequence
  Synthetic
cgtttgcattugatttgtctgatugct

SEQ ID NO: 92710 - DNA, 22 bp, Artificial Sequence
  Synthetic
cagcaagcacugtgctaguaga

SEQ ID NO: 92711 - DNA, 23 bp, Artificial Sequence
  Synthetic
acggtucaagaaacttgcugaca

SEQ ID NO: 92712 - DNA, 17 bp, Artificial Sequence
  Synthetic
gcctgcucccgaaggua

SEQ ID NO: 92713 - DNA, 18 bp, Artificial Sequence
  Synthetic
ccgctgcuggagttgguc

SEQ ID NO: 92714 - DNA, 23 bp, Artificial Sequence
  Synthetic
acccgtccguactggtgttatua

SEQ ID NO: 92715 - DNA, 20 bp, Artificial Sequence
  Synthetic
cgcutgaggagauggaagcc

SEQ ID NO: 92716 - DNA, 23 bp, Artificial Sequence
  Synthetic
cctagaacugatgguacgcaagt

SEQ ID NO: 92717 - DNA, 26 bp, Artificial Sequence
  Synthetic
cttgtgaaaauggaggaagatgcaut

SEQ ID NO: 92718 - DNA, 23 bp, Artificial Sequence
  Synthetic
ccattcuggcagtagttgcuaca

SEQ ID NO: 92719 - DNA, 27 bp, Artificial Sequence
  Synthetic
agtuaacttgtgaaaauggaggaagat

SEQ ID NO: 92720 - DNA, 28 bp, Artificial Sequence
  Synthetic
tgcatcttccuccattttcacaagtuaa

SEQ ID NO: 92721 - DNA, 31 bp, Artificial Sequence
  Synthetic
gggttaattattttauggaaacacaagaucc

SEQ ID NO: 92722 - DNA, 19 bp, Artificial Sequence
  Synthetic
cctctucgggcgacaugat

SEQ ID NO: 92723 - DNA, 18 bp, Artificial Sequence
  Synthetic
cacccucacgccagacuc

SEQ ID NO: 92724 - DNA, 25 bp, Artificial Sequence
  Synthetic
tcagattgucacaaactgcctugat

SEQ ID NO: 92725 - DNA, 22 bp, Artificial Sequence
  Synthetic
ctgtauccaagctcgguggaaa

SEQ ID NO: 92726 - DNA, 23 bp, Artificial Sequence
  Synthetic
tcagtcaucacctccaccauaca

SEQ ID NO: 92727 - DNA, 25 bp, Artificial Sequence
  Synthetic
caccatatgacuccctgttagtgut

SEQ ID NO: 92728 - DNA, 23 bp, Artificial Sequence
  Synthetic
atgaaggucaggacttggaagug

SEQ ID NO: 92729 - DNA, 27 bp, Artificial Sequence
  Synthetic
cttggagatccuggtgctactagtaua

SEQ ID NO: 92730 - DNA, 20 bp, Artificial Sequence
  Synthetic
ggagagccuttctgctcuga

SEQ ID NO: 92731 - DNA, 21 bp, Artificial Sequence
  Synthetic
cctaccacaccacuggctuac

SEQ ID NO: 92732 - DNA, 22 bp, Artificial Sequence
  Synthetic
gggcagcuattgatacctugct

SEQ ID NO: 92733 - DNA, 22 bp, Artificial Sequence
  Synthetic
cccctucaggagtggttctuac

SEQ ID NO: 92734 - DNA, 24 bp, Artificial Sequence
  Synthetic
accttccttauctgtctccuagcc

SEQ ID NO: 92735 - DNA, 23 bp, Artificial Sequence
  Synthetic
tgccagttcuccatttgggttut

SEQ ID NO: 92736 - DNA, 20 bp, Artificial Sequence
  Synthetic
cagtcaucgtcgccaucaca

SEQ ID NO: 92737 - DNA, 29 bp, Artificial Sequence
  Synthetic
tggactgactguagctagcattattcaua

SEQ ID NO: 92738 - DNA, 20 bp, Artificial Sequence
  Synthetic
ccccucagacagggtcttug

SEQ ID NO: 92739 - DNA, 20 bp, Artificial Sequence
  Synthetic
acctccuacccttgggucat

SEQ ID NO: 92740 - DNA, 19 bp, Artificial Sequence
  Synthetic
gaggtggutgccgatguga

SEQ ID NO: 92741 - DNA, 19 bp, Artificial Sequence
  Synthetic
gtaacccucccccucccaa

SEQ ID NO: 92742 - DNA, 21 bp, Artificial Sequence
  Synthetic
gagccacugccttcataguca

SEQ ID NO: 92743 - DNA, 27 bp, Artificial Sequence
  Synthetic
tggttttgtaaagugtaaccctctcut

SEQ ID NO: 92744 - DNA, 27 bp, Artificial Sequence
  Synthetic
cccaaatauaagaccattagtgccuga

SEQ ID NO: 92745 - DNA, 28 bp, Artificial Sequence
  Synthetic
caatcggctutcaaaacatgguaaagaa

SEQ ID NO: 92746 - DNA, 22 bp, Artificial Sequence
  Synthetic
aaaggttguccttcctgugacc

SEQ ID NO: 92747 - DNA, 25 bp, Artificial Sequence
  Synthetic
gccctgtaaugtttatgcgatcuac

SEQ ID NO: 92748 - DNA, 28 bp, Artificial Sequence
  Synthetic
gcaaccuccatcaaatttuaaagacaca

SEQ ID NO: 92749 - DNA, 24 bp, Artificial Sequence
  Synthetic
gcaacacuggaagaagtgtgatuc

SEQ ID NO: 92750 - DNA, 20 bp, Artificial Sequence
  Synthetic
gggaaucttuggcccaccat

SEQ ID NO: 92751 - DNA, 26 bp, Artificial Sequence
  Synthetic
cttcacucacaacgaaattgtcucag

SEQ ID NO: 92752 - DNA, 25 bp, Artificial Sequence
  Synthetic
tgctacaatuaaatcagccatugcc

SEQ ID NO: 92753 - DNA, 28 bp, Artificial Sequence
  Synthetic
agacgaucaaaacaagactgaaugaagt

SEQ ID NO: 92754 - DNA, 23 bp, Artificial Sequence
  Synthetic
cagcccuaaagccatatucggat

SEQ ID NO: 92755 - DNA, 23 bp, Artificial Sequence
  Synthetic
ctgagcaugccaagttcctgaua

SEQ ID NO: 92756 - DNA, 28 bp, Artificial Sequence
  Synthetic
ctgatatttgtagguggtgatccaugaa

SEQ ID NO: 92757 - DNA, 21 bp, Artificial Sequence
  Synthetic
cgaaccatucgaacagctucc

SEQ ID NO: 92758 - DNA, 21 bp, Artificial Sequence
  Synthetic
agactccagucacaggtggua

SEQ ID NO: 92759 - DNA, 28 bp, Artificial Sequence
  Synthetic
aactgaaggactuatttggtgtccauag

SEQ ID NO: 92760 - DNA, 21 bp, Artificial Sequence
  Synthetic
ccccacccutcatgtgaagua

SEQ ID NO: 92761 - DNA, 23 bp, Artificial Sequence
  Synthetic
caccutctgatttcuccccacag

SEQ ID NO: 92762 - DNA, 27 bp, Artificial Sequence
  Synthetic
caaagacagugttaattgugcaagaca

SEQ ID NO: 92763 - DNA, 26 bp, Artificial Sequence
  Synthetic
gttattcacaaaccucgacauaggga

SEQ ID NO: 92764 - DNA, 22 bp, Artificial Sequence
  Synthetic
gggtctcttugtcttgggcaua

SEQ ID NO: 92765 - DNA, 28 bp, Artificial Sequence
  Synthetic
cttttacagugaagtttagcaacugcaa

SEQ ID NO: 92766 - DNA, 22 bp, Artificial Sequence
  Synthetic
ccaagccccuattcccaucaaa

SEQ ID NO: 92767 - DNA, 23 bp, Artificial Sequence
  Synthetic
ttttgttccttucccatcggcua

SEQ ID NO: 92768 - DNA, 22 bp, Artificial Sequence
  Synthetic
tggacacuggccaagatttuct

SEQ ID NO: 92769 - DNA, 25 bp, Artificial Sequence
  Synthetic
gcttttctgautggcttacaaucct

SEQ ID NO: 92770 - DNA, 18 bp, Artificial Sequence
  Synthetic
ccacucugccccggaaaa

SEQ ID NO: 92771 - DNA, 18 bp, Artificial Sequence
  Synthetic
gucactcuggcgggacac

SEQ ID NO: 92772 - DNA, 27 bp, Artificial Sequence
  Synthetic
gggcataatguagaagtgtcuggaaac

SEQ ID NO: 92773 - DNA, 28 bp, Artificial Sequence
  Synthetic
gatgatcaactuccttgcaatgtaacut

SEQ ID NO: 92774 - DNA, 21 bp, Artificial Sequence
  Synthetic
tggcttuggaccagtcctuac

SEQ ID NO: 92775 - DNA, 29 bp, Artificial Sequence
  Synthetic
gcctacttgattcaugtgctctgtattut

SEQ ID NO: 92776 - DNA, 23 bp, Artificial Sequence
  Synthetic
ccagaagugaaaggagcuaccaa

SEQ ID NO: 92777 - DNA, 19 bp, Artificial Sequence
  Synthetic
gggaguaccacgucagagg

SEQ ID NO: 92778 - DNA, 26 bp, Artificial Sequence
  Synthetic
agggcacatguaaatatcaaggctut

SEQ ID NO: 92779 - DNA, 25 bp, Artificial Sequence
  Synthetic
catatgaauccacaagggtaugcct

SEQ ID NO: 92780 - DNA, 24 bp, Artificial Sequence
  Synthetic
acacaacguggcttgcatuaaaaa

SEQ ID NO: 92781 - DNA, 21 bp, Artificial Sequence
  Synthetic
gccutguccacaaacaccagt

SEQ ID NO: 92782 - DNA, 28 bp, Artificial Sequence
  Synthetic
gtaatcagatcctuctactccacggaua

SEQ ID NO: 92783 - DNA, 22 bp, Artificial Sequence
  Synthetic
cctatucaacagcgtcuagcca

SEQ ID NO: 92784 - DNA, 24 bp, Artificial Sequence
  Synthetic
ccggccauggaatgtattctctut

SEQ ID NO: 92785 - DNA, 22 bp, Artificial Sequence
  Synthetic
gcacctccuactccctacucac

SEQ ID NO: 92786 - DNA, 26 bp, Artificial Sequence
  Synthetic
gaagattggcacugataaacctugag

SEQ ID NO: 92787 - DNA, 22 bp, Artificial Sequence
  Synthetic
gggtacacugcattcaaacugt

SEQ ID NO: 92788 - DNA, 22 bp, Artificial Sequence
  Synthetic
agtuaagaagcaacccccucac

SEQ ID NO: 92789 - DNA, 21 bp, Artificial Sequence
  Synthetic
agtctggaggcuggcatcuat

SEQ ID NO: 92790 - DNA, 20 bp, Artificial Sequence
  Synthetic
cgagguccccagctaggtua

SEQ ID NO: 92791 - DNA, 21 bp, Artificial Sequence
  Synthetic
gagcctcaugaagcagagguc

SEQ ID NO: 92792 - DNA, 22 bp, Artificial Sequence
  Synthetic
ccaccctcugatgcagtcauag

SEQ ID NO: 92793 - DNA, 25 bp, Artificial Sequence
  Synthetic
caggagcugcaaacattgacattut

SEQ ID NO: 92794 - DNA, 23 bp, Artificial Sequence
  Synthetic
ggttcagccugtctgtgatucat

SEQ ID NO: 92795 - DNA, 23 bp, Artificial Sequence
  Synthetic
ctctgccccugaatcagcttuaa

SEQ ID NO: 92796 - DNA, 23 bp, Artificial Sequence
  Synthetic
ctaaucagcacagtggucagaga

SEQ ID NO: 92797 - DNA, 21 bp, Artificial Sequence
  Synthetic
gtcacagucctggtcaauggg

SEQ ID NO: 92798 - DNA, 21 bp, Artificial Sequence
  Synthetic
cutgggcactuacgacaaggt

SEQ ID NO: 92799 - DNA, 22 bp, Artificial Sequence
  Synthetic
ggaacaccugcaggagtcttut

SEQ ID NO: 92800 - DNA, 24 bp, Artificial Sequence
  Synthetic
gctctgcugaccactgaatuagac

SEQ ID NO: 92801 - DNA, 21 bp, Artificial Sequence
  Synthetic
cccacccaugtaccagctcua

SEQ ID NO: 92802 - DNA, 24 bp, Artificial Sequence
  Synthetic
cccacacagggugacattcctaua

SEQ ID NO: 92803 - DNA, 26 bp, Artificial Sequence
  Synthetic
tggactttgguatcacataggaguca

SEQ ID NO: 92804 - DNA, 22 bp, Artificial Sequence
  Synthetic
catgttucagggagggaccaut

SEQ ID NO: 92805 - DNA, 26 bp, Artificial Sequence
  Synthetic
gaggtgaaaauaccactagcatccua

SEQ ID NO: 92806 - DNA, 20 bp, Artificial Sequence
  Synthetic
tgtugacacgcacacaguga

SEQ ID NO: 92807 - DNA, 18 bp, Artificial Sequence
  Synthetic
gcagugcgagaccaccug

SEQ ID NO: 92808 - DNA, 21 bp, Artificial Sequence
  Synthetic
ggtuggaaaggaagtccuggt

SEQ ID NO: 92809 - DNA, 20 bp, Artificial Sequence
  Synthetic
gcaatgatgguggccttguc

SEQ ID NO: 92810 - DNA, 20 bp, Artificial Sequence
  Synthetic
gcacaggaaacguccgctua

SEQ ID NO: 92811 - DNA, 21 bp, Artificial Sequence
  Synthetic
gctgaccucctggtctgttut

SEQ ID NO: 92812 - DNA, 20 bp, Artificial Sequence
  Synthetic
ccctgacacucgctggtuag

SEQ ID NO: 92813 - DNA, 24 bp, Artificial Sequence
  Synthetic
tgautttgagttugggagaccaca

SEQ ID NO: 92814 - DNA, 27 bp, Artificial Sequence
  Synthetic
tgaagagcaauatttccauccagaaca

SEQ ID NO: 92815 - DNA, 23 bp, Artificial Sequence
  Synthetic
gatctccagugtgatcgactuga

SEQ ID NO: 92816 - DNA, 27 bp, Artificial Sequence
  Synthetic
tctagggtgaauttcagtcattuagcc

SEQ ID NO: 92817 - DNA, 21 bp, Artificial Sequence
  Synthetic
tgggtccuctgaagccuagaa

SEQ ID NO: 92818 - DNA, 24 bp, Artificial Sequence
  Synthetic
gcccttgacutctttcacagugag

SEQ ID NO: 92819 - DNA, 25 bp, Artificial Sequence
  Synthetic
ccaatgccautgttatgctgtuaca

SEQ ID NO: 92820 - DNA, 23 bp, Artificial Sequence
  Synthetic
catctgctuctgacgtactugga

SEQ ID NO: 92821 - DNA, 22 bp, Artificial Sequence
  Synthetic
catgugggaggaagtaaccuct

SEQ ID NO: 92822 - DNA, 20 bp, Artificial Sequence
  Synthetic
ctgaaccauctccgcaguca

SEQ ID NO: 92823 - DNA, 28 bp, Artificial Sequence
  Synthetic
agagtgttttgatuctgtgaagcacuaa

SEQ ID NO: 92824 - DNA, 24 bp, Artificial Sequence
  Synthetic
ggguaaaggccttgttauaaccaa

SEQ ID NO: 92825 - DNA, 21 bp, Artificial Sequence
  Synthetic
ggacagaacaccacgucaguc

SEQ ID NO: 92826 - DNA, 21 bp, Artificial Sequence
  Synthetic
ggctaaccuggcagagaaugg

SEQ ID NO: 92827 - DNA, 23 bp, Artificial Sequence
  Synthetic
catgtggugggaccatactuact

SEQ ID NO: 92828 - DNA, 26 bp, Artificial Sequence
  Synthetic
ggacaccatagcaugatagtcccuaa

SEQ ID NO: 92829 - DNA, 26 bp, Artificial Sequence
  Synthetic
catgcttccucaactcttcaucaaac

SEQ ID NO: 92830 - DNA, 26 bp, Artificial Sequence
  Synthetic
gtgctatacagugagcatttgguact

SEQ ID NO: 92831 - DNA, 28 bp, Artificial Sequence
  Synthetic
cgaattatgtcaugcacagtcaauaaca

SEQ ID NO: 92832 - DNA, 23 bp, Artificial Sequence
  Synthetic
gaattaggugctttcctcuccca

SEQ ID NO: 92833 - DNA, 21 bp, Artificial Sequence
  Synthetic
cctctgaauggcgtggatguc

SEQ ID NO: 92834 - DNA, 19 bp, Artificial Sequence
  Synthetic
tggaagagguccgugcaga

SEQ ID NO: 92835 - DNA, 21 bp, Artificial Sequence
  Synthetic
tcactccttgugtgccctcua

SEQ ID NO: 92836 - DNA, 27 bp, Artificial Sequence
  Synthetic
agattcttgtgcautgtgatttcgtut

SEQ ID NO: 92837 - DNA, 27 bp, Artificial Sequence
  Synthetic
gatcaagttgtucaggagaaaaauccc

SEQ ID NO: 92838 - DNA, 19 bp, Artificial Sequence
  Synthetic
gctgacgguccctttgcut

SEQ ID NO: 92839 - DNA, 22 bp, Artificial Sequence
  Synthetic
gcagtgttuctgcggaaauagg

SEQ ID NO: 92840 - DNA, 22 bp, Artificial Sequence
  Synthetic
ggcaggtcugctggtcaataua

SEQ ID NO: 92841 - DNA, 27 bp, Artificial Sequence
  Synthetic
agaaatgggtaugcttgttctgguaat

SEQ ID NO: 92842 - DNA, 22 bp, Artificial Sequence
  Synthetic
tccccagaaggaugactgagut

SEQ ID NO: 92843 - DNA, 18 bp, Artificial Sequence
  Synthetic
ggttctucgcccgtgguc

SEQ ID NO: 92844 - DNA, 23 bp, Artificial Sequence
  Synthetic
ttggcatgggauttttctccuga

SEQ ID NO: 92845 - DNA, 28 bp, Artificial Sequence
  Synthetic
caccacagactguttaatgggatttcua

SEQ ID NO: 92846 - DNA, 21 bp, Artificial Sequence
  Synthetic
cttccaggugccatgctaugt

SEQ ID NO: 92847 - DNA, 22 bp, Artificial Sequence
  Synthetic
ccucagccccacaaagatucat

SEQ ID NO: 92848 - DNA, 27 bp, Artificial Sequence
  Synthetic
ccatgttaacugcaatgatacccaaut

SEQ ID NO: 92849 - DNA, 29 bp, Artificial Sequence
  Synthetic
gtcgacacaaauccattgaactctttuat

SEQ ID NO: 92850 - DNA, 19 bp, Artificial Sequence
  Synthetic
caucgacgacaccacugga

SEQ ID NO: 92851 - DNA, 28 bp, Artificial Sequence
  Synthetic
ggctcattgtcautgatgtcttgaatut

SEQ ID NO: 92852 - DNA, 24 bp, Artificial Sequence
  Synthetic
tgttgtttgtggucttgttgctut

SEQ ID NO: 92853 - DNA, 19 bp, Artificial Sequence
  Synthetic
gcatcgugttgtucacgca

SEQ ID NO: 92854 - DNA, 21 bp, Artificial Sequence
  Synthetic
ggtgagccugttaatcugcgt

SEQ ID NO: 92855 - DNA, 26 bp, Artificial Sequence
  Synthetic
cagcaaaggaaccucctaagacttua

SEQ ID NO: 92856 - DNA, 21 bp, Artificial Sequence
  Synthetic
tggcugccacacttccatuaa

SEQ ID NO: 92857 - DNA, 21 bp, Artificial Sequence
  Synthetic
cggtaauaaccgguccgacag

SEQ ID NO: 92858 - DNA, 21 bp, Artificial Sequence
  Synthetic
gcccataugcctctcuccaac

SEQ ID NO: 92859 - DNA, 25 bp, Artificial Sequence
  Synthetic
gccatttccuccataccctttacuc

SEQ ID NO: 92860 - DNA, 24 bp, Artificial Sequence
  Synthetic
cgtgaacaacacgaugcttuagaa

SEQ ID NO: 92861 - DNA, 21 bp, Artificial Sequence
  Synthetic
acutacctatgugggcagcct

SEQ ID NO: 92862 - DNA, 28 bp, Artificial Sequence
  Synthetic
gatctataactggutcaccaggatgtuc

SEQ ID NO: 92863 - DNA, 24 bp, Artificial Sequence
  Synthetic
gcaggacuaatggttuagggaact

SEQ ID NO: 92864 - DNA, 22 bp, Artificial Sequence
  Synthetic
cccgagucagagttcatcauca

SEQ ID NO: 92865 - DNA, 22 bp, Artificial Sequence
  Synthetic
aatcagcgagucaccacctuac

SEQ ID NO: 92866 - DNA, 24 bp, Artificial Sequence
  Synthetic
agcctgcuagaagctacctauacc

SEQ ID NO: 92867 - DNA, 20 bp, Artificial Sequence
  Synthetic
ctcaccgucacagccuacac

SEQ ID NO: 92868 - DNA, 20 bp, Artificial Sequence
  Synthetic
gugaagccttuccccaccaa

SEQ ID NO: 92869 - DNA, 22 bp, Artificial Sequence
  Synthetic
tcggtccugtgacattgugaac

SEQ ID NO: 92870 - DNA, 27 bp, Artificial Sequence
  Synthetic
catacctggcaauaaaggaacgaatut

SEQ ID NO: 92871 - DNA, 25 bp, Artificial Sequence
  Synthetic
agggactaaugacagtatgctguct

SEQ ID NO: 92872 - DNA, 26 bp, Artificial Sequence
  Synthetic
tgctgacataauggaacactagctut

SEQ ID NO: 92873 - DNA, 18 bp, Artificial Sequence
  Synthetic
cctcccucctggagcugt

SEQ ID NO: 92874 - DNA, 18 bp, Artificial Sequence
  Synthetic
ggcgtcucccatcugcac

SEQ ID NO: 92875 - DNA, 20 bp, Artificial Sequence
  Synthetic
tugcaccaucagggaaccaa

SEQ ID NO: 92876 - DNA, 20 bp, Artificial Sequence
  Synthetic
ctccccucgcttccaaugaa

SEQ ID NO: 92877 - DNA, 24 bp, Artificial Sequence
  Synthetic
ggagaagcagcaucttccagaaua

SEQ ID NO: 92878 - DNA, 24 bp, Artificial Sequence
  Synthetic
gcttcagagggucagacatacugt

SEQ ID NO: 92879 - DNA, 23 bp, Artificial Sequence
  Synthetic
ctgttggaaugcatcggatctug

SEQ ID NO: 92880 - DNA, 21 bp, Artificial Sequence
  Synthetic
cgagcaccauctcctttggut

SEQ ID NO: 92881 - DNA, 27 bp, Artificial Sequence
  Synthetic
ccagagcatuagtagcatgtttugaat

SEQ ID NO: 92882 - DNA, 23 bp, Artificial Sequence
  Synthetic
gcgtcatguaagcatcaaucacc

SEQ ID NO: 92883 - DNA, 23 bp, Artificial Sequence
  Synthetic
gcttcagtcaugctcatgggtut

SEQ ID NO: 92884 - DNA, 21 bp, Artificial Sequence
  Synthetic
caagctccccuaccatgacut

SEQ ID NO: 92885 - DNA, 26 bp, Artificial Sequence
  Synthetic
ccacaccctuaagagaagaaaacuca

SEQ ID NO: 92886 - DNA, 21 bp, Artificial Sequence
  Synthetic
accagagggucucaccaacat

SEQ ID NO: 92887 - DNA, 23 bp, Artificial Sequence
  Synthetic
gtttctctggugactcccagtuc

SEQ ID NO: 92888 - DNA, 23 bp, Artificial Sequence
  Synthetic
agtccaugtaggtcucagacaca

SEQ ID NO: 92889 - DNA, 24 bp, Artificial Sequence
  Synthetic
cctcattctgcuggaactgatguc

SEQ ID NO: 92890 - DNA, 28 bp, Artificial Sequence
  Synthetic
gagtttgaaacuagtccagactgtaugt

SEQ ID NO: 92891 - DNA, 28 bp, Artificial Sequence
  Synthetic
tgcaatgucccaagcaatatacctuaaa

SEQ ID NO: 92892 - DNA, 24 bp, Artificial Sequence
  Synthetic
cgttttgtucactgtaaccugcaa

SEQ ID NO: 92893 - DNA, 26 bp, Artificial Sequence
  Synthetic
ttgatgatagugagaggtctcucaaa

SEQ ID NO: 92894 - DNA, 28 bp, Artificial Sequence
  Synthetic
aggatccatatguataactgaggtugga

SEQ ID NO: 92895 - DNA, 24 bp, Artificial Sequence
  Synthetic
ccagcaaugcatcaatacauacgg

SEQ ID NO: 92896 - DNA, 22 bp, Artificial Sequence
  Synthetic
gaaactctucatgtccccucca

SEQ ID NO: 92897 - DNA, 22 bp, Artificial Sequence
  Synthetic
cctcctgguaacgggatatguc

SEQ ID NO: 92898 - DNA, 23 bp, Artificial Sequence
  Synthetic
gcaggttugcttattggugaagg

SEQ ID NO: 92899 - DNA, 24 bp, Artificial Sequence
  Synthetic
ctgggtgctuctactgcagaaaua

SEQ ID NO: 92900 - DNA, 24 bp, Artificial Sequence
  Synthetic
ccuatggtaatugaagcccaagga

SEQ ID NO: 92901 - DNA, 25 bp, Artificial Sequence
  Synthetic
gagaggagaagcccuattttgtuca

SEQ ID NO: 92902 - DNA, 23 bp, Artificial Sequence
  Synthetic
gcacctugttgtctgtugaccat

SEQ ID NO: 92903 - DNA, 20 bp, Artificial Sequence
  Synthetic
caatgucagcccagccauac

SEQ ID NO: 92904 - DNA, 23 bp, Artificial Sequence
  Synthetic
cgagcaaagaaagccaugttguc

SEQ ID NO: 92905 - DNA, 24 bp, Artificial Sequence
  Synthetic
caacugtctttgguggagaaggat

SEQ ID NO: 92906 - DNA, 23 bp, Artificial Sequence
  Synthetic
ctgtacagaggcacutgtaaguc

SEQ ID NO: 92907 - DNA, 25 bp, Artificial Sequence
  Synthetic
gctcattttucttttcccagugcaa

SEQ ID NO: 92908 - DNA, 23 bp, Artificial Sequence
  Synthetic
tcaagagucucaacacgggaaac

SEQ ID NO: 92909 - DNA, 28 bp, Artificial Sequence
  Synthetic
gttgcttcaagacutcaatcgttttcut

SEQ ID NO: 92910 - DNA, 22 bp, Artificial Sequence
  Synthetic
catttcccacugtccctuccaa

SEQ ID NO: 92911 - DNA, 21 bp, Artificial Sequence
  Synthetic
cauaaaagcaaccgcctuccc

SEQ ID NO: 92912 - DNA, 23 bp, Artificial Sequence
  Synthetic
cttgactgcauggttctagcuga

SEQ ID NO: 92913 - DNA, 26 bp, Artificial Sequence
  Synthetic
atgaccacatuctcttattgctucca

SEQ ID NO: 92914 - DNA, 28 bp, Artificial Sequence
  Synthetic
gtattacctgcauaaaactctgaaugcc

SEQ ID NO: 92915 - DNA, 24 bp, Artificial Sequence
  Synthetic
gaccagtcccugctgacatttaut

SEQ ID NO: 92916 - DNA, 24 bp, Artificial Sequence
  Synthetic
cgtcatccutcagttggaauccag

SEQ ID NO: 92917 - DNA, 24 bp, Artificial Sequence
  Synthetic
aaatgcugggagacagaaagacut

SEQ ID NO: 92918 - DNA, 24 bp, Artificial Sequence
  Synthetic
gggcattaacauatcccattgugt

SEQ ID NO: 92919 - DNA, 20 bp, Artificial Sequence
  Synthetic
ccagcutcctaugcccagag

SEQ ID NO: 92920 - DNA, 23 bp, Artificial Sequence
  Synthetic
gguggaaagaaagagaagguggt

SEQ ID NO: 92921 - DNA, 25 bp, Artificial Sequence
  Synthetic
gagggacccaauaatugcaaaacag

SEQ ID NO: 92922 - DNA, 28 bp, Artificial Sequence
  Synthetic
tttcaaaatuccagaaaacaagctgcua

SEQ ID NO: 92923 - DNA, 28 bp, Artificial Sequence
  Synthetic
gatgtgttugcaacagtttgtatttucc

SEQ ID NO: 92924 - DNA, 20 bp, Artificial Sequence
  Synthetic
tccccgugcatagctttguc

SEQ ID NO: 92925 - DNA, 27 bp, Artificial Sequence
  Synthetic
tcaaattggccutctgtagtuacaagt

SEQ ID NO: 92926 - DNA, 20 bp, Artificial Sequence
  Synthetic
ccuacacuccccagcaaaca

SEQ ID NO: 92927 - DNA, 22 bp, Artificial Sequence
  Synthetic
tggacgaauttgcacuccaact

SEQ ID NO: 92928 - DNA, 21 bp, Artificial Sequence
  Synthetic
tgtgggcaggaugaggatcua

SEQ ID NO: 92929 - DNA, 22 bp, Artificial Sequence
  Synthetic
tctcuaccaggcaggtgtaugt

SEQ ID NO: 92930 - DNA, 22 bp, Artificial Sequence
  Synthetic
gtgcaccagugttgagaactuc

SEQ ID NO: 92931 - DNA, 25 bp, Artificial Sequence
  Synthetic
agtggtuccaagtcacatuaaagca

SEQ ID NO: 92932 - DNA, 24 bp, Artificial Sequence
  Synthetic
tgaccttgggauctgattctucct

SEQ ID NO: 92933 - DNA, 24 bp, Artificial Sequence
  Synthetic
gccgacattcautctgaacatcug

SEQ ID NO: 92934 - DNA, 20 bp, Artificial Sequence
  Synthetic
cactggaguctcgtgaugga

SEQ ID NO: 92935 - DNA, 21 bp, Artificial Sequence
  Synthetic
aactgagcccaaaauggguca

SEQ ID NO: 92936 - DNA, 19 bp, Artificial Sequence
  Synthetic
cagctccugccactgctua

SEQ ID NO: 92937 - DNA, 19 bp, Artificial Sequence
  Synthetic
ctcacacccuctccuggac

SEQ ID NO: 92938 - DNA, 23 bp, Artificial Sequence
  Synthetic
aaaagttguctgcccuccaaaga

SEQ ID NO: 92939 - DNA, 22 bp, Artificial Sequence
  Synthetic
ctgaagtucacatgcugagggt

SEQ ID NO: 92940 - DNA, 21 bp, Artificial Sequence
  Synthetic
gggacucacaacagcgaugaa

SEQ ID NO: 92941 - DNA, 24 bp, Artificial Sequence
  Synthetic
agguggcagttaaaaugaagcagt

SEQ ID NO: 92942 - DNA, 23 bp, Artificial Sequence
  Synthetic
cggugcccagatugaacaaagat

SEQ ID NO: 92943 - DNA, 20 bp, Artificial Sequence
  Synthetic
catgccguctgcaatctcuc

SEQ ID NO: 92944 - DNA, 22 bp, Artificial Sequence
  Synthetic
ccaaaagcugagtagugaggct

SEQ ID NO: 92945 - DNA, 23 bp, Artificial Sequence
  Synthetic
agaagtgtccgutcattggtgut

SEQ ID NO: 92946 - DNA, 23 bp, Artificial Sequence
  Synthetic
caagggcccaauctacaaguacc

SEQ ID NO: 92947 - DNA, 23 bp, Artificial Sequence
  Synthetic
tgcttcccucactctagttcugt

SEQ ID NO: 92948 - DNA, 21 bp, Artificial Sequence
  Synthetic
acagccucctccugcaaaaag

SEQ ID NO: 92949 - DNA, 27 bp, Artificial Sequence
  Synthetic
ctcatccaaaacutcaatgtggactug

SEQ ID NO: 92950 - DNA, 25 bp, Artificial Sequence
  Synthetic
caagaggccaaaagutcatcttugt

SEQ ID NO: 92951 - DNA, 28 bp, Artificial Sequence
  Synthetic
caataaaggctacgugccaatttttgua

SEQ ID NO: 92952 - DNA, 29 bp, Artificial Sequence
  Synthetic
agaaagtaagcaagaugagagagauaggt

SEQ ID NO: 92953 - DNA, 28 bp, Artificial Sequence
  Synthetic
cctgagttaatgugtgtttctttgtgut

SEQ ID NO: 92954 - DNA, 22 bp, Artificial Sequence
  Synthetic
ggatttcccaguttgccaugga

SEQ ID NO: 92955 - DNA, 29 bp, Artificial Sequence
  Synthetic
tgtcttactttguccttgttttcccauaa

SEQ ID NO: 92956 - DNA, 24 bp, Artificial Sequence
  Synthetic
cccacaggaaaagaauccattgug

SEQ ID NO: 92957 - DNA, 20 bp, Artificial Sequence
  Synthetic
ccucccaccugaaccagact

SEQ ID NO: 92958 - DNA, 24 bp, Artificial Sequence
  Synthetic
gcctgagcaagaugattcagaugg

SEQ ID NO: 92959 - DNA, 21 bp, Artificial Sequence
  Synthetic
cccagaccuggaaagcuaagg

SEQ ID NO: 92960 - DNA, 26 bp, Artificial Sequence
  Synthetic
ctctcctgatauccctttctcctuct

SEQ ID NO: 92961 - DNA, 17 bp, Artificial Sequence
  Synthetic
cccccgucagcactguc

SEQ ID NO: 92962 - DNA, 27 bp, Artificial Sequence
  Synthetic
gtgaagtaaaugaaccagagguaaggt

SEQ ID NO: 92963 - DNA, 25 bp, Artificial Sequence
  Synthetic
gcaattccugccaactaaacaaugg

SEQ ID NO: 92964 - DNA, 21 bp, Artificial Sequence
  Synthetic
gggaaagucagagctgctcut

SEQ ID NO: 92965 - DNA, 20 bp, Artificial Sequence
  Synthetic
cgttcugacagccccttgug

SEQ ID NO: 92966 - DNA, 20 bp, Artificial Sequence
  Synthetic
gggaacugggcatcagugag

SEQ ID NO: 92967 - DNA, 24 bp, Artificial Sequence
  Synthetic
ccaagggcatutctctgttctgut

SEQ ID NO: 92968 - DNA, 25 bp, Artificial Sequence
  Synthetic
tggtaaacaaagutgagagcaucca

SEQ ID NO: 92969 - DNA, 29 bp, Artificial Sequence
  Synthetic
gaaacagctgcauttagaaatcaauagca

SEQ ID NO: 92970 - DNA, 20 bp, Artificial Sequence
  Synthetic
ggcttugacagcgagaaucc

SEQ ID NO: 92971 - DNA, 17 bp, Artificial Sequence
  Synthetic
cccugccacccgctuac

SEQ ID NO: 92972 - DNA, 29 bp, Artificial Sequence
  Synthetic
cactgtttctuacttttgacattcaucca

SEQ ID NO: 92973 - DNA, 22 bp, Artificial Sequence
  Synthetic
agctctaccaccucatccauca

SEQ ID NO: 92974 - DNA, 26 bp, Artificial Sequence
  Synthetic
ttccttacaagcaugtataacggcut

SEQ ID NO: 92975 - DNA, 21 bp, Artificial Sequence
  Synthetic
ccaccacacaccucagtctug

SEQ ID NO: 92976 - DNA, 21 bp, Artificial Sequence
  Synthetic
gtctgguccacagtgtgtcug

SEQ ID NO: 92977 - DNA, 28 bp, Artificial Sequence
  Synthetic
tttttctttttctucccccactagaugt

SEQ ID NO: 92978 - DNA, 21 bp, Artificial Sequence
  Synthetic
gcaagucctuccacagaaccc

SEQ ID NO: 92979 - DNA, 28 bp, Artificial Sequence
  Synthetic
gagattttguggagaaatggttgaugaa

SEQ ID NO: 92980 - DNA, 19 bp, Artificial Sequence
  Synthetic
ggctcgggutggctcuaaa

SEQ ID NO: 92981 - DNA, 19 bp, Artificial Sequence
  Synthetic
gctagugggcgcatguagg

SEQ ID NO: 92982 - DNA, 20 bp, Artificial Sequence
  Synthetic
cacgtgguctctgctgtuga

SEQ ID NO: 92983 - DNA, 20 bp, Artificial Sequence
  Synthetic
agctgagggcuttcacugac

SEQ ID NO: 92984 - DNA, 23 bp, Artificial Sequence
  Synthetic
cautgaggaggucacagagaacc

SEQ ID NO: 92985 - DNA, 24 bp, Artificial Sequence
  Synthetic
atggagttgugcaggaaattcuca

SEQ ID NO: 92986 - DNA, 25 bp, Artificial Sequence
  Synthetic
ccaaaugactgauaacaggagggaa

SEQ ID NO: 92987 - DNA, 25 bp, Artificial Sequence
  Synthetic
tgaugaagaagguggaggagaagaa

SEQ ID NO: 92988 - DNA, 22 bp, Artificial Sequence
  Synthetic
aggctgaauaccgcaaagtcut

SEQ ID NO: 92989 - DNA, 23 bp, Artificial Sequence
  Synthetic
gctgctgacutacacactaccug

SEQ ID NO: 92990 - DNA, 23 bp, Artificial Sequence
  Synthetic
gagaacggccauatuaccaccaa

SEQ ID NO: 92991 - DNA, 20 bp, Artificial Sequence
  Synthetic
cctgaagggcautgctcugt

SEQ ID NO: 92992 - DNA, 19 bp, Artificial Sequence
  Synthetic
aagcactgcucacctgguc

SEQ ID NO: 92993 - DNA, 24 bp, Artificial Sequence
  Synthetic
tgtgctgaugtttgtggtauggat

SEQ ID NO: 92994 - DNA, 20 bp, Artificial Sequence
  Synthetic
cctcgggcugtgctctttut

SEQ ID NO: 92995 - DNA, 22 bp, Artificial Sequence
  Synthetic
ccttggauctgatgcaguaggg

SEQ ID NO: 92996 - DNA, 22 bp, Artificial Sequence
  Synthetic
tctatgaccugctgcuggagat

SEQ ID NO: 92997 - DNA, 21 bp, Artificial Sequence
  Synthetic
tgcctcccccgugatgtaaua

SEQ ID NO: 92998 - DNA, 21 bp, Artificial Sequence
  Synthetic
acaccaaagcauctgggaugg

SEQ ID NO: 92999 - DNA, 20 bp, Artificial Sequence
  Synthetic
cttgctgcugtccagguaca

SEQ ID NO: 93000 - DNA, 18 bp, Artificial Sequence
  Synthetic
ccguccgcagcucaagat

SEQ ID NO: 93001 - DNA, 17 bp, Artificial Sequence
  Synthetic
cgtagaccugcgcgtug

SEQ ID NO: 93002 - DNA, 18 bp, Artificial Sequence
  Synthetic
cgccgccuacgagtucaa

SEQ ID NO: 93003 - DNA, 19 bp, Artificial Sequence
  Synthetic
gcgggugcagtagcaucag

SEQ ID NO: 93004 - DNA, 21 bp, Artificial Sequence
  Synthetic
cgttctttaucccggcgttuc

SEQ ID NO: 93005 - DNA, 28 bp, Artificial Sequence
  Synthetic
gcatttcaggccutcagttcatauaagt

SEQ ID NO: 93006 - DNA, 19 bp, Artificial Sequence
  Synthetic
ctcaacagcgugtcuccga

SEQ ID NO: 93007 - DNA, 17 bp, Artificial Sequence
  Synthetic
ccucgcgcaccgtguag

SEQ ID NO: 93008 - DNA, 24 bp, Artificial Sequence
  Synthetic
acttcaucgcattcctugcaaaag

SEQ ID NO: 93009 - DNA, 24 bp, Artificial Sequence
  Synthetic
catgaugagggtaaaaugcagcag

SEQ ID NO: 93010 - DNA, 20 bp, Artificial Sequence
  Synthetic
gcucccacccagugagaaac

SEQ ID NO: 93011 - DNA, 20 bp, Artificial Sequence
  Synthetic
gucgtcauggaaggacacca

SEQ ID NO: 93012 - DNA, 21 bp, Artificial Sequence
  Synthetic
aagacagugagcuccaccaag

SEQ ID NO: 93013 - DNA, 27 bp, Artificial Sequence
  Synthetic
atcatcgaguggaagtcttatttggut

SEQ ID NO: 93014 - DNA, 20 bp, Artificial Sequence
  Synthetic
cucagggacugcggaagaag

SEQ ID NO: 93015 - DNA, 20 bp, Artificial Sequence
  Synthetic
ctgacaaccuctgggcugat

SEQ ID NO: 93016 - DNA, 28 bp, Artificial Sequence
  Synthetic
caggtagttcuacagctctaacacauac

SEQ ID NO: 93017 - DNA, 28 bp, Artificial Sequence
  Synthetic
gtgttggtgttuagatgaagaaccttut

SEQ ID NO: 93018 - DNA, 22 bp, Artificial Sequence
  Synthetic
cctggcuacatcttcctugact

SEQ ID NO: 93019 - DNA, 22 bp, Artificial Sequence
  Synthetic
gagagugcaucacacaacgaga

SEQ ID NO: 93020 - DNA, 19 bp, Artificial Sequence
  Synthetic
ctcaccucctgcttugcca

SEQ ID NO: 93021 - DNA, 18 bp, Artificial Sequence
  Synthetic
cgaggcuccagggtcugt

SEQ ID NO: 93022 - DNA, 26 bp, Artificial Sequence
  Synthetic
gggtgtatgaaggauactccatctuc

SEQ ID NO: 93023 - DNA, 20 bp, Artificial Sequence
  Synthetic
gggattuccaccgggagaut

SEQ ID NO: 93024 - DNA, 22 bp, Artificial Sequence
  Synthetic
ggccagggucacagtatcttug

SEQ ID NO: 93025 - DNA, 24 bp, Artificial Sequence
  Synthetic
ctcgatgcaguactcaguaagcag

SEQ ID NO: 93026 - DNA, 29 bp, Artificial Sequence
  Synthetic
gccatcagtgcuaattttccttatcucat

SEQ ID NO: 93027 - DNA, 23 bp, Artificial Sequence
  Synthetic
accagaucagcactgcattugaa

SEQ ID NO: 93028 - DNA, 18 bp, Artificial Sequence
  Synthetic
tgacgaugcggcgauagg

SEQ ID NO: 93029 - DNA, 21 bp, Artificial Sequence
  Synthetic
ctgcccccagagaugatugag

SEQ ID NO: 93030 - DNA, 23 bp, Artificial Sequence
  Synthetic
caaaaatccacacuggtggucaa

SEQ ID NO: 93031 - DNA, 24 bp, Artificial Sequence
  Synthetic
caggccagaaaguttgatgatguc

SEQ ID NO: 93032 - DNA, 17 bp, Artificial Sequence
  Synthetic
cgugacgggcgucacat

SEQ ID NO: 93033 - DNA, 21 bp, Artificial Sequence
  Synthetic
gtguacacacgctgacugaac

SEQ ID NO: 93034 - DNA, 24 bp, Artificial Sequence
  Synthetic
tttcagaggacautgattgcccut

SEQ ID NO: 93035 - DNA, 28 bp, Artificial Sequence
  Synthetic
ccagagcatttacauatgtctcttccut

SEQ ID NO: 93036 - DNA, 20 bp, Artificial Sequence
  Synthetic
gggagugggacatgtgcuaa

SEQ ID NO: 93037 - DNA, 23 bp, Artificial Sequence
  Synthetic
caatgttctgguggttcagctuc

SEQ ID NO: 93038 - DNA, 28 bp, Artificial Sequence
  Synthetic
gcttatgtttctgcucagagtcacaaua

SEQ ID NO: 93039 - DNA, 23 bp, Artificial Sequence
  Synthetic
ggaaagauggacgcattgugaat

SEQ ID NO: 93040 - DNA, 25 bp, Artificial Sequence
  Synthetic
agaatagtccccuctgatcacaguc

SEQ ID NO: 93041 - DNA, 25 bp, Artificial Sequence
  Synthetic
tggagttctcutcccttaagucagt

SEQ ID NO: 93042 - DNA, 24 bp, Artificial Sequence
  Synthetic
cagatccaccutctcattgugcat

SEQ ID NO: 93043 - DNA, 24 bp, Artificial Sequence
  Synthetic
cagggaaaggagagutcctatguc

SEQ ID NO: 93044 - DNA, 25 bp, Artificial Sequence
  Synthetic
caacaatgtcugaaaagagcauggt

SEQ ID NO: 93045 - DNA, 26 bp, Artificial Sequence
  Synthetic
aggcaactutagaaagaacucaccag

SEQ ID NO: 93046 - DNA, 21 bp, Artificial Sequence
  Synthetic
cguacgcttgtaugcgggaaa

SEQ ID NO: 93047 - DNA, 22 bp, Artificial Sequence
  Synthetic
caggaaggaaggccucatctug

SEQ ID NO: 93048 - DNA, 22 bp, Artificial Sequence
  Synthetic
ggtttgaacugatgcgcatgug

SEQ ID NO: 93049 - DNA, 21 bp, Artificial Sequence
  Synthetic
cagcttgttcucctcgctgua

SEQ ID NO: 93050 - DNA, 21 bp, Artificial Sequence
  Synthetic
gtgagggaguttgaggtccug

SEQ ID NO: 93051 - DNA, 27 bp, Artificial Sequence
  Synthetic
aaatctctgttaucatgtggcctgaut

SEQ ID NO: 93052 - DNA, 21 bp, Artificial Sequence
  Synthetic
ttccgggagguctccttcuac

SEQ ID NO: 93053 - DNA, 19 bp, Artificial Sequence
  Synthetic
gttcucggccttgtgucct

SEQ ID NO: 93054 - DNA, 27 bp, Artificial Sequence
  Synthetic
ccactgtctuctttttctcttctucca

SEQ ID NO: 93055 - DNA, 26 bp, Artificial Sequence
  Synthetic
gctacatctcucagacatccctaucc

SEQ ID NO: 93056 - DNA, 18 bp, Artificial Sequence
  Synthetic
acugcccgacagacacuc

SEQ ID NO: 93057 - DNA, 17 bp, Artificial Sequence
  Synthetic
aaggcccgcucgttcut

SEQ ID NO: 93058 - DNA, 19 bp, Artificial Sequence
  Synthetic
ctuacgcccacaugaacgg

SEQ ID NO: 93059 - DNA, 23 bp, Artificial Sequence
  Synthetic
aggaggcttgugaatggattgut

SEQ ID NO: 93060 - DNA, 20 bp, Artificial Sequence
  Synthetic
gacatcucgggtggcaucat

SEQ ID NO: 93061 - DNA, 27 bp, Artificial Sequence
  Synthetic
tgatccatgtuccagaatcaaatucca

SEQ ID NO: 93062 - DNA, 26 bp, Artificial Sequence
  Synthetic
cacacauggagagcccaaaaauaaaa

SEQ ID NO: 93063 - DNA, 28 bp, Artificial Sequence
  Synthetic
tgtgaacctacuatgtgaagagtacuga

SEQ ID NO: 93064 - DNA, 27 bp, Artificial Sequence
  Synthetic
cactgtgaguatattgtgatguggaga

SEQ ID NO: 93065 - DNA, 28 bp, Artificial Sequence
  Synthetic
tcacccaacatguttacaatcaacaaug

SEQ ID NO: 93066 - DNA, 22 bp, Artificial Sequence
  Synthetic
gatacagautcagccugagcca

SEQ ID NO: 93067 - DNA, 28 bp, Artificial Sequence
  Synthetic
gagaaaaagactgugaagatggtaguga

SEQ ID NO: 93068 - DNA, 23 bp, Artificial Sequence
  Synthetic
cactgtgatgaugtcaccaguct

SEQ ID NO: 93069 - DNA, 24 bp, Artificial Sequence
  Synthetic
caattgatgcugacgatcccaaug

SEQ ID NO: 93070 - DNA, 24 bp, Artificial Sequence
  Synthetic
cttacaaucaagccactgttugct

SEQ ID NO: 93071 - DNA, 29 bp, Artificial Sequence
  Synthetic
tggcgatcaucaacaaatttctcatatug

SEQ ID NO: 93072 - DNA, 26 bp, Artificial Sequence
  Synthetic
gattctgtaccucaacatcccatuga

SEQ ID NO: 93073 - DNA, 21 bp, Artificial Sequence
  Synthetic
ggtcccuggaatgaaggguaa

SEQ ID NO: 93074 - DNA, 28 bp, Artificial Sequence
  Synthetic
gcctggattaaacugagtactccaaaua

SEQ ID NO: 93075 - DNA, 26 bp, Artificial Sequence
  Synthetic
gctaatgacacugatatcctgggtut

SEQ ID NO: 93076 - DNA, 27 bp, Artificial Sequence
  Synthetic
ctttctggguggttaatccataaguga

SEQ ID NO: 93077 - DNA, 23 bp, Artificial Sequence
  Synthetic
caataaguggacagggcagaaug

SEQ ID NO: 93078 - DNA, 23 bp, Artificial Sequence
  Synthetic
tggtaccatugcaaccttttuca

SEQ ID NO: 93079 - DNA, 28 bp, Artificial Sequence
  Synthetic
tctgcttctctcutcctcatttcaaaut

SEQ ID NO: 93080 - DNA, 22 bp, Artificial Sequence
  Synthetic
ctgaccaaaguatggctuccct

SEQ ID NO: 93081 - DNA, 24 bp, Artificial Sequence
  Synthetic
acacagauacacaaccgctttcuc

SEQ ID NO: 93082 - DNA, 19 bp, Artificial Sequence
  Synthetic
cttctgguggccacgacut

SEQ ID NO: 93083 - DNA, 19 bp, Artificial Sequence
  Synthetic
gaggaugcgggacgctauc

SEQ ID NO: 93084 - DNA, 17 bp, Artificial Sequence
  Synthetic
cgcuggcggaggagtug

SEQ ID NO: 93085 - DNA, 19 bp, Artificial Sequence
  Synthetic
acgaucccaaacccaggug

SEQ ID NO: 93086 - DNA, 25 bp, Artificial Sequence
  Synthetic
gcactggtttuctgaatcacacuga

SEQ ID NO: 93087 - DNA, 25 bp, Artificial Sequence
  Synthetic
gtcatgaataccuttcccatcccut

SEQ ID NO: 93088 - DNA, 21 bp, Artificial Sequence
  Synthetic
gggtgaaaccuccaacuagca

SEQ ID NO: 93089 - DNA, 21 bp, Artificial Sequence
  Synthetic
cccacacagacacaaugugac

SEQ ID NO: 93090 - DNA, 17 bp, Artificial Sequence
  Synthetic
acagcugcacgcctcuc

SEQ ID NO: 93091 - DNA, 22 bp, Artificial Sequence
  Synthetic
gggtctuggctgttttcuacct

SEQ ID NO: 93092 - DNA, 26 bp, Artificial Sequence
  Synthetic
agaaatactgggaacautctgcctut

SEQ ID NO: 93093 - DNA, 22 bp, Artificial Sequence
  Synthetic
tgagtaagcaaaguggcagcut

SEQ ID NO: 93094 - DNA, 21 bp, Artificial Sequence
  Synthetic
cgtcacatugtgtctgtgugg

SEQ ID NO: 93095 - DNA, 22 bp, Artificial Sequence
  Synthetic
ctttagacgccuccttcctcut

SEQ ID NO: 93096 - DNA, 24 bp, Artificial Sequence
  Synthetic
tcacucccatauagagacacagca

SEQ ID NO: 93097 - DNA, 28 bp, Artificial Sequence
  Synthetic
gtctctggacuagttgaatgagtttuga

SEQ ID NO: 93098 - DNA, 24 bp, Artificial Sequence
  Synthetic
tcuataagccucgacagccagaat

SEQ ID NO: 93099 - DNA, 23 bp, Artificial Sequence
  Synthetic
ccctttcagcutcttgtttgguc

SEQ ID NO: 93100 - DNA, 22 bp, Artificial Sequence
  Synthetic
cctggtgggugcaaaaagagua

SEQ ID NO: 93101 - DNA, 21 bp, Artificial Sequence
  Synthetic
ttggttuccgggaaggaugac

SEQ ID NO: 93102 - DNA, 23 bp, Artificial Sequence
  Synthetic
cctcagguctttgcugagagaaa

SEQ ID NO: 93103 - DNA, 21 bp, Artificial Sequence
  Synthetic
gctctcggugtgtgtcttuca

SEQ ID NO: 93104 - DNA, 23 bp, Artificial Sequence
  Synthetic
ggaggcuttcttctctugggaaa

SEQ ID NO: 93105 - DNA, 23 bp, Artificial Sequence
  Synthetic
caagagcagutgctcagauacca

SEQ ID NO: 93106 - DNA, 20 bp, Artificial Sequence
  Synthetic
ggcggcacacccuauaacaa

SEQ ID NO: 93107 - DNA, 22 bp, Artificial Sequence
  Synthetic
gcgcgaugaggaacaaacatuc

SEQ ID NO: 93108 - DNA, 22 bp, Artificial Sequence
  Synthetic
caacccgaccaaagcutgaaut

SEQ ID NO: 93109 - DNA, 25 bp, Artificial Sequence
  Synthetic
catttcctcaugcagcaatttugga

SEQ ID NO: 93110 - DNA, 19 bp, Artificial Sequence
  Synthetic
gugcttgcuaccgggacat

SEQ ID NO: 93111 - DNA, 22 bp, Artificial Sequence
  Synthetic
ccacaugggcaaaggatcguag

SEQ ID NO: 93112 - DNA, 22 bp, Artificial Sequence
  Synthetic
catagcagcagcagcugattut

SEQ ID NO: 93113 - DNA, 23 bp, Artificial Sequence
  Synthetic
cctggtactacuggcatcacauc

SEQ ID NO: 93114 - DNA, 27 bp, Artificial Sequence
  Synthetic
ctgcattcaugggaaattgacatguat

SEQ ID NO: 93115 - DNA, 21 bp, Artificial Sequence
  Synthetic
gatctguccacgacccatucc

SEQ ID NO: 93116 - DNA, 26 bp, Artificial Sequence
  Synthetic
tgaatgtgaacccuttcatgtctugt

SEQ ID NO: 93117 - DNA, 22 bp, Artificial Sequence
  Synthetic
ccagcagcaugtcgaagatcuc

SEQ ID NO: 93118 - DNA, 22 bp, Artificial Sequence
  Synthetic
agacagagacccauccaaguct

SEQ ID NO: 93119 - DNA, 28 bp, Artificial Sequence
  Synthetic
aatttagttgctauttgtgccattgugt

SEQ ID NO: 93120 - DNA, 20 bp, Artificial Sequence
  Synthetic
cagcgacuggattccuccaa

SEQ ID NO: 93121 - DNA, 25 bp, Artificial Sequence
  Synthetic
gcagattatggugtattccagucca

SEQ ID NO: 93122 - DNA, 23 bp, Artificial Sequence
  Synthetic
gaaaatgtguagagggcatggug

SEQ ID NO: 93123 - DNA, 27 bp, Artificial Sequence
  Synthetic
tcatccagcatugagttatcttgtgut

SEQ ID NO: 93124 - DNA, 22 bp, Artificial Sequence
  Synthetic
ccacccuctuacccaacaaagt

SEQ ID NO: 93125 - DNA, 28 bp, Artificial Sequence
  Synthetic
gccaagtguccaacataagtagatguaa

SEQ ID NO: 93126 - DNA, 32 bp, Artificial Sequence
  Synthetic
tgaattaacatutaggaatggauacagcagaa

SEQ ID NO: 93127 - DNA, 25 bp, Artificial Sequence
  Synthetic
gctgcccagauattatcaagaucct

SEQ ID NO: 93128 - DNA, 20 bp, Artificial Sequence
  Synthetic
cctgccaguaaggacacuct

SEQ ID NO: 93129 - DNA, 20 bp, Artificial Sequence
  Synthetic
gtucgcggcattcuacaagg

SEQ ID NO: 93130 - DNA, 23 bp, Artificial Sequence
  Synthetic
gattcaggccacauctctctcug

SEQ ID NO: 93131 - DNA, 27 bp, Artificial Sequence
  Synthetic
acagaaaauaagacagccaugaacact

SEQ ID NO: 93132 - DNA, 28 bp, Artificial Sequence
  Synthetic
gtcatcaaagaaaaagcuctgacctuac

SEQ ID NO: 93133 - DNA, 24 bp, Artificial Sequence
  Synthetic
tgcatccattucatgacagcuact

SEQ ID NO: 93134 - DNA, 17 bp, Artificial Sequence
  Synthetic
gaggugggcaccgucat

SEQ ID NO: 93135 - DNA, 19 bp, Artificial Sequence
  Synthetic
caggaagugggcgcactua

SEQ ID NO: 93136 - DNA, 28 bp, Artificial Sequence
  Synthetic
ggtactaaatgcaauagagcaggagtuc

SEQ ID NO: 93137 - DNA, 21 bp, Artificial Sequence
  Synthetic
ggtatctggcutgcggaucat

SEQ ID NO: 93138 - DNA, 22 bp, Artificial Sequence
  Synthetic
tguaacgcacacagaacacuga

SEQ ID NO: 93139 - DNA, 29 bp, Artificial Sequence
  Synthetic
gctttattgttttcutaggtgaggttucc

SEQ ID NO: 93140 - DNA, 21 bp, Artificial Sequence
  Synthetic
ctgguggctgcattugacaag

SEQ ID NO: 93141 - DNA, 27 bp, Artificial Sequence
  Synthetic
tctcctcagutttctttaggttugcat

SEQ ID NO: 93142 - DNA, 28 bp, Artificial Sequence
  Synthetic
tgtatgaaauggcactgcctagauaaaa

SEQ ID NO: 93143 - DNA, 22 bp, Artificial Sequence
  Synthetic
ctgtggccugtattcaccucag

SEQ ID NO: 93144 - DNA, 27 bp, Artificial Sequence
  Synthetic
gttgcagagaaaugctaactttgtcut

SEQ ID NO: 93145 - DNA, 24 bp, Artificial Sequence
  Synthetic
ctcgttttcauctgggtttugagg

SEQ ID NO: 93146 - DNA, 27 bp, Artificial Sequence
  Synthetic
ctaagtgacacutcctgaaaactucct

SEQ ID NO: 93147 - DNA, 23 bp, Artificial Sequence
  Synthetic
caaacttggguctgttgttccug

SEQ ID NO: 93148 - DNA, 21 bp, Artificial Sequence
  Synthetic
cctgaggccacugatttggut

SEQ ID NO: 93149 - DNA, 22 bp, Artificial Sequence
  Synthetic
ccaccagcucttcttttgacug

SEQ ID NO: 93150 - DNA, 23 bp, Artificial Sequence
  Synthetic
ccctttacgcacgucaaaatcut

SEQ ID NO: 93151 - DNA, 20 bp, Artificial Sequence
  Synthetic
gacttcggcaaugcagtgug

SEQ ID NO: 93152 - DNA, 20 bp, Artificial Sequence
  Synthetic
cuggactgcuggcagaaaga

SEQ ID NO: 93153 - DNA, 29 bp, Artificial Sequence
  Synthetic
agtgaatgccagauaacaaattgaatgug

SEQ ID NO: 93154 - DNA, 24 bp, Artificial Sequence
  Synthetic
tgccagtuccatgtaaatguagca

SEQ ID NO: 93155 - DNA, 29 bp, Artificial Sequence
  Synthetic
gacagtttagugccacatttattcttugt

SEQ ID NO: 93156 - DNA, 22 bp, Artificial Sequence
  Synthetic
cggcttcacuttgtcctgaaug

SEQ ID NO: 93157 - DNA, 26 bp, Artificial Sequence
  Synthetic
agcgtggagauagagaacattacuct

SEQ ID NO: 93158 - DNA, 27 bp, Artificial Sequence
  Synthetic
catcttcucagacatcaatcugaagca

SEQ ID NO: 93159 - DNA, 19 bp, Artificial Sequence
  Synthetic
ggtccucccagctgaugac

SEQ ID NO: 93160 - DNA, 18 bp, Artificial Sequence
  Synthetic
gaguaccugacgcggcat

SEQ ID NO: 93161 - DNA, 24 bp, Artificial Sequence
  Synthetic
gttaggtcgtucttcacgaggaua

SEQ ID NO: 93162 - DNA, 26 bp, Artificial Sequence
  Synthetic
tcctgacagtacutacctaccacauc

SEQ ID NO: 93163 - DNA, 26 bp, Artificial Sequence
  Synthetic
ggtagcaguagaagatgatgaugaca

SEQ ID NO: 93164 - DNA, 22 bp, Artificial Sequence
  Synthetic
gaaggacccaggacaucactug

SEQ ID NO: 93165 - DNA, 25 bp, Artificial Sequence
  Synthetic
agcautcagactaugagagcacaaa

SEQ ID NO: 93166 - DNA, 20 bp, Artificial Sequence
  Synthetic
agggaccucaagagcuccaa

SEQ ID NO: 93167 - DNA, 26 bp, Artificial Sequence
  Synthetic
gggatctagcacuagctctaactuac

SEQ ID NO: 93168 - DNA, 28 bp, Artificial Sequence
  Synthetic
tgccaaaagaccaauagtattgtcuacc

SEQ ID NO: 93169 - DNA, 28 bp, Artificial Sequence
  Synthetic
tcaagtcttcauggccttcatctctaua

SEQ ID NO: 93170 - DNA, 21 bp, Artificial Sequence
  Synthetic
accactgggagutgccatauc

SEQ ID NO: 93171 - DNA, 20 bp, Artificial Sequence
  Synthetic
gctgatgucagagcggucat

SEQ ID NO: 93172 - DNA, 26 bp, Artificial Sequence
  Synthetic
tgagcaaattgtucacctggtgauat

SEQ ID NO: 93173 - DNA, 26 bp, Artificial Sequence
  Synthetic
ctttgcacatcacugacctctttcua

SEQ ID NO: 93174 - DNA, 24 bp, Artificial Sequence
  Synthetic
ggtgattatgcugtacgtctucca

SEQ ID NO: 93175 - DNA, 28 bp, Artificial Sequence
  Synthetic
gaagaacatttgaugggaaaatcaggut

SEQ ID NO: 93176 - DNA, 21 bp, Artificial Sequence
  Synthetic
cactgugccatcatccuggaa

SEQ ID NO: 93177 - DNA, 25 bp, Artificial Sequence
  Synthetic
tctcaaactgcuctgaagtgttcug

SEQ ID NO: 93178 - DNA, 23 bp, Artificial Sequence
  Synthetic
gggcaccautgttctccatuaga

SEQ ID NO: 93179 - DNA, 21 bp, Artificial Sequence
  Synthetic
tgatggccacguagattuccc

SEQ ID NO: 93180 - DNA, 24 bp, Artificial Sequence
  Synthetic
tgaggtctauaaggccaagcugaa

SEQ ID NO: 93181 - DNA, 24 bp, Artificial Sequence
  Synthetic
gtcaggaacuggagtatgttcuca

SEQ ID NO: 93182 - DNA, 21 bp, Artificial Sequence
  Synthetic
guttgaaacugccaggcaaga

SEQ ID NO: 93183 - DNA, 22 bp, Artificial Sequence
  Synthetic
ccctccaggcgaaugatgtuag

SEQ ID NO: 93184 - DNA, 21 bp, Artificial Sequence
  Synthetic
ctcgcugcttttccugagaga

SEQ ID NO: 93185 - DNA, 19 bp, Artificial Sequence
  Synthetic
gccacagtuccgagaccut

SEQ ID NO: 93186 - DNA, 22 bp, Artificial Sequence
  Synthetic
cccaaaaagugggagcagugaa

SEQ ID NO: 93187 - DNA, 21 bp, Artificial Sequence
  Synthetic
cttgucccaccactugaagga

SEQ ID NO: 93188 - DNA, 18 bp, Artificial Sequence
  Synthetic
gcccggcutaggagacut

SEQ ID NO: 93189 - DNA, 17 bp, Artificial Sequence
  Synthetic
gcctcgucctccucgct

SEQ ID NO: 93190 - DNA, 17 bp, Artificial Sequence
  Synthetic
accgucgtgguggagga

SEQ ID NO: 93191 - DNA, 17 bp, Artificial Sequence
  Synthetic
acgucgggcgugaagag

SEQ ID NO: 93192 - DNA, 21 bp, Artificial Sequence
  Synthetic
ctcctcaccuttcacgauggt

SEQ ID NO: 93193 - DNA, 18 bp, Artificial Sequence
  Synthetic
gggtctcaucagcgcugt

SEQ ID NO: 93194 - DNA, 17 bp, Artificial Sequence
  Synthetic
gcugcuggcggacaaga

SEQ ID NO: 93195 - DNA, 18 bp, Artificial Sequence
  Synthetic
cacgaguacccacugcca

SEQ ID NO: 93196 - DNA, 18 bp, Artificial Sequence
  Synthetic
caccugctccaugaggct

SEQ ID NO: 93197 - DNA, 17 bp, Artificial Sequence
  Synthetic
cgccgccucatcgtugt

SEQ ID NO: 93198 - DNA, 17 bp, Artificial Sequence
  Synthetic
gcccacagcgcugauga

SEQ ID NO: 93199 - DNA, 24 bp, Artificial Sequence
  Synthetic
ggcttccagaauggtctcaacuac

SEQ ID NO: 93200 - DNA, 24 bp, Artificial Sequence
  Synthetic
cgccaaagucgatgttgatguact

SEQ ID NO: 93201 - DNA, 17 bp, Artificial Sequence
  Synthetic
gcccggagggcutctug

SEQ ID NO: 93202 - DNA, 17 bp, Artificial Sequence
  Synthetic
ccgguguccgaggacaa

SEQ ID NO: 93203 - DNA, 18 bp, Artificial Sequence
  Synthetic
aggcctccuccccgtauc

SEQ ID NO: 93204 - DNA, 19 bp, Artificial Sequence
  Synthetic
tgggtacucgtgcatgcug

SEQ ID NO: 93205 - DNA, 18 bp, Artificial Sequence
  Synthetic
agcccccucaccctguag

SEQ ID NO: 93206 - DNA, 17 bp, Artificial Sequence
  Synthetic
tggccugaggcuccaga

SEQ ID NO: 93207 - DNA, 19 bp, Artificial Sequence
  Synthetic
gctgctgcuacagctccut

SEQ ID NO: 93208 - DNA, 18 bp, Artificial Sequence
  Synthetic
cctcacgucgauggcgat

SEQ ID NO: 93209 - DNA, 18 bp, Artificial Sequence
  Synthetic
caccuccccacgacagut

SEQ ID NO: 93210 - DNA, 18 bp, Artificial Sequence
  Synthetic
gcacgtacuggtcgcugt

SEQ ID NO: 93211 - DNA, 18 bp, Artificial Sequence
  Synthetic
cccgcccgacutcttcuc

SEQ ID NO: 93212 - DNA, 19 bp, Artificial Sequence
  Synthetic
gcaaggagcuguagcagca

SEQ ID NO: 93213 - DNA, 20 bp, Artificial Sequence
  Synthetic
ccaagcugtccauggagcat

SEQ ID NO: 93214 - DNA, 19 bp, Artificial Sequence
  Synthetic
gggcugcggagaagaaguc

SEQ ID NO: 93215 - DNA, 19 bp, Artificial Sequence
  Synthetic
cccgaggacaguggguaca

SEQ ID NO: 93216 - DNA, 17 bp, Artificial Sequence
  Synthetic
ggcgagcuggccttgua

SEQ ID NO: 93217 - DNA, 19 bp, Artificial Sequence
  Synthetic
cgcccccaagcagauctug

SEQ ID NO: 93218 - DNA, 17 bp, Artificial Sequence
  Synthetic
tcgccgggaaugtccug

SEQ ID NO: 93219 - DNA, 21 bp, Artificial Sequence
  Synthetic
cgacgacuacatgcccaugag

SEQ ID NO: 93220 - DNA, 17 bp, Artificial Sequence
  Synthetic
ccggcugcaactgucgt

SEQ ID NO: 93221 - DNA, 17 bp, Artificial Sequence
  Synthetic
ccgucctucgcccacaa

SEQ ID NO: 93222 - DNA, 17 bp, Artificial Sequence
  Synthetic
cggcacgagcugcacut

SEQ ID NO: 93223 - DNA, 20 bp, Artificial Sequence
  Synthetic
cgcaguaagagccaatcguc

SEQ ID NO: 93224 - DNA, 19 bp, Artificial Sequence
  Synthetic
tgggcugcaagatctgcut

SEQ ID NO: 93225 - DNA, 18 bp, Artificial Sequence
  Synthetic
gagaucggcucccacagg

SEQ ID NO: 93226 - DNA, 19 bp, Artificial Sequence
  Synthetic
ggttgaccagguggtggug

SEQ ID NO: 93227 - DNA, 19 bp, Artificial Sequence
  Synthetic
ccatccuggaggccaugaa

SEQ ID NO: 93228 - DNA, 19 bp, Artificial Sequence
  Synthetic
atgggccagutcgaccauc

SEQ ID NO: 93229 - DNA, 23 bp, Artificial Sequence
  Synthetic
gcatccaagugcatcaucaaacc

SEQ ID NO: 93230 - DNA, 20 bp, Artificial Sequence
  Synthetic
cggaacucgaagagctccut

SEQ ID NO: 93231 - DNA, 18 bp, Artificial Sequence
  Synthetic
gccacucggacagctuct

SEQ ID NO: 93232 - DNA, 18 bp, Artificial Sequence
  Synthetic
cccaggutgctgcuggag

SEQ ID NO: 93233 - DNA, 18 bp, Artificial Sequence
  Synthetic
ctctgccucgctggauga

SEQ ID NO: 93234 - DNA, 17 bp, Artificial Sequence
  Synthetic
caccagcccguagcugt

SEQ ID NO: 93235 - DNA, 18 bp, Artificial Sequence
  Synthetic
ggagcaggagggcuggua

SEQ ID NO: 93236 - DNA, 18 bp, Artificial Sequence
  Synthetic
gctgaccaggucggugag

SEQ ID NO: 93237 - DNA, 22 bp, Artificial Sequence
  Synthetic
ctgcugcctgaacaucaacaag

SEQ ID NO: 93238 - DNA, 18 bp, Artificial Sequence
  Synthetic
gcccgcaucagggtguat

SEQ ID NO: 93239 - DNA, 17 bp, Artificial Sequence
  Synthetic
cactguggccgctccua

SEQ ID NO: 93240 - DNA, 21 bp, Artificial Sequence
  Synthetic
gagggcgaucaggtacttgug

SEQ ID NO: 93241 - DNA, 22 bp, Artificial Sequence
  Synthetic
tcgaguacuacgagagcgagaa

SEQ ID NO: 93242 - DNA, 18 bp, Artificial Sequence
  Synthetic
ggcccaccucgaugaaga

SEQ ID NO: 93243 - DNA, 20 bp, Artificial Sequence
  Synthetic
gtaccgtcugtgcctgtcug

SEQ ID NO: 93244 - DNA, 22 bp, Artificial Sequence
  Synthetic
ggtcagggaguaggtcctctug

SEQ ID NO: 93245 - DNA, 17 bp, Artificial Sequence
  Synthetic
cgaguccaucgcggaga

SEQ ID NO: 93246 - DNA, 18 bp, Artificial Sequence
  Synthetic
gccttgcuccgccactut

SEQ ID NO: 93247 - DNA, 17 bp, Artificial Sequence
  Synthetic
cgcaagugcggcuacct

SEQ ID NO: 93248 - DNA, 23 bp, Artificial Sequence
  Synthetic
tggtcatguacccgtagaacuca

SEQ ID NO: 93249 - DNA, 18 bp, Artificial Sequence
  Synthetic
cgaccccggcutcatguc

SEQ ID NO: 93250 - DNA, 20 bp, Artificial Sequence
  Synthetic
tcgcagutgagctucacgaa

SEQ ID NO: 93251 - DNA, 17 bp, Artificial Sequence
  Synthetic
gacagcuacgggcuggt

SEQ ID NO: 93252 - DNA, 26 bp, Artificial Sequence
  Synthetic
gtgcaagtttugaaaatggagggaut

SEQ ID NO: 93253 - DNA, 22 bp, Artificial Sequence
  Synthetic
aggagcaaugcgaatacctguc

SEQ ID NO: 93254 - DNA, 19 bp, Artificial Sequence
  Synthetic
ccactggcuggcatcguag

SEQ ID NO: 93255 - DNA, 22 bp, Artificial Sequence
  Synthetic
acagtgguatggccaaaucagt

SEQ ID NO: 93256 - DNA, 26 bp, Artificial Sequence
  Synthetic
ggataguaaacagtccauagggacca

SEQ ID NO: 93257 - DNA, 21 bp, Artificial Sequence
  Synthetic
tggacctcuacagtggtugga

SEQ ID NO: 93258 - DNA, 22 bp, Artificial Sequence
  Synthetic
atgaagggagaugggcagacua

SEQ ID NO: 93259 - DNA, 24 bp, Artificial Sequence
  Synthetic
accggaagtugtaggtggagtuat

SEQ ID NO: 93260 - DNA, 24 bp, Artificial Sequence
  Synthetic
ccacaaaacugaaatgcgtauggt

SEQ ID NO: 93261 - DNA, 27 bp, Artificial Sequence
  Synthetic
atgcattggaatuatctcaaagcccua

SEQ ID NO: 93262 - DNA, 24 bp, Artificial Sequence
  Synthetic
cctccctcttucctctgtgctaut

SEQ ID NO: 93263 - DNA, 29 bp, Artificial Sequence
  Synthetic
ctcatcctagacutcttgaactgtttgua

SEQ ID NO: 93264 - DNA, 26 bp, Artificial Sequence
  Synthetic
acaactaaucgatgggaguaagagga

SEQ ID NO: 93265 - DNA, 26 bp, Artificial Sequence
  Synthetic
ggcaactgtaugagccactagttaug

SEQ ID NO: 93266 - DNA, 23 bp, Artificial Sequence
  Synthetic
gttcccaacagugcctacacuaa

SEQ ID NO: 93267 - DNA, 23 bp, Artificial Sequence
  Synthetic
gtgacgaccgugtttatcagaug

SEQ ID NO: 93268 - DNA, 26 bp, Artificial Sequence
  Synthetic
gggatcccauctgagttaatacttug

SEQ ID NO: 93269 - DNA, 27 bp, Artificial Sequence
  Synthetic
cctgcctguggacttgaatttcauaat

SEQ ID NO: 93270 - DNA, 25 bp, Artificial Sequence
  Synthetic
tgctgttuggacaagatgaactuca

SEQ ID NO: 93271 - DNA, 23 bp, Artificial Sequence
  Synthetic
gguagcaccagugaaaaggaaga

SEQ ID NO: 93272 - DNA, 27 bp, Artificial Sequence
  Synthetic
cttgttgttagugaaccagtgaaucag

SEQ ID NO: 93273 - DNA, 24 bp, Artificial Sequence
  Synthetic
atggaacccuttacagcguaacat

SEQ ID NO: 93274 - DNA, 21 bp, Artificial Sequence
  Synthetic
ctgccguggatuaggaagagg

SEQ ID NO: 93275 - DNA, 22 bp, Artificial Sequence
  Synthetic
cauctguaccaggccaaaaaca

SEQ ID NO: 93276 - DNA, 21 bp, Artificial Sequence
  Synthetic
aacagacuggaggaagctugg

SEQ ID NO: 93277 - DNA, 28 bp, Artificial Sequence
  Synthetic
tgcaaggttauaaacgcaaaagatgtug

SEQ ID NO: 93278 - DNA, 28 bp, Artificial Sequence
  Synthetic
cagattgccttuccggataaaaatuaca

SEQ ID NO: 93279 - DNA, 26 bp, Artificial Sequence
  Synthetic
cttaaaacaggcutcacgaucacaaa

SEQ ID NO: 93280 - DNA, 25 bp, Artificial Sequence
  Synthetic
tgaatgagcucaacgtacaugaagt

SEQ ID NO: 93281 - DNA, 28 bp, Artificial Sequence
  Synthetic
tcacatggctuaacatgacacctuaaat

SEQ ID NO: 93282 - DNA, 28 bp, Artificial Sequence
  Synthetic
gaaatgcttagcugagaatgcagttuac

SEQ ID NO: 93283 - DNA, 25 bp, Artificial Sequence
  Synthetic
agaaggatcaagcugaagcacatua

SEQ ID NO: 93284 - DNA, 28 bp, Artificial Sequence
  Synthetic
gggatgaaccagacutagatcctgauat

SEQ ID NO: 93285 - DNA, 28 bp, Artificial Sequence
  Synthetic
tgctactagtttuccttctcgacaatuc

SEQ ID NO: 93286 - DNA, 27 bp, Artificial Sequence
  Synthetic
tgtttgatcacaugatgaagcgtaugt

SEQ ID NO: 93287 - DNA, 27 bp, Artificial Sequence
  Synthetic
tggctgatggcauaataatctgaugag

SEQ ID NO: 93288 - DNA, 27 bp, Artificial Sequence
  Synthetic
ggaatgaagtgtuttgagcgattctuc

SEQ ID NO: 93289 - DNA, 28 bp, Artificial Sequence
  Synthetic
acatcagacaccauttacagagttccua

SEQ ID NO: 93290 - DNA, 28 bp, Artificial Sequence
  Synthetic
catcgtgcaaautgtgctaatugaaaat

SEQ ID NO: 93291 - DNA, 28 bp, Artificial Sequence
  Synthetic
cattctttgatugcgtttctagagctut

SEQ ID NO: 93292 - DNA, 21 bp, Artificial Sequence
  Synthetic
agcutgctaucaccaccagac

SEQ ID NO: 93293 - DNA, 27 bp, Artificial Sequence
  Synthetic
ggagggttuaagtaaacgccatuacat

SEQ ID NO: 93294 - DNA, 27 bp, Artificial Sequence
  Synthetic
ccacagaagaagaucatcagtagcaut

SEQ ID NO: 93295 - DNA, 26 bp, Artificial Sequence
  Synthetic
ccagaattautgtctgtcugcaggat

SEQ ID NO: 93296 - DNA, 28 bp, Artificial Sequence
  Synthetic
ccgaatgcaguacagtatggagtattut

SEQ ID NO: 93297 - DNA, 26 bp, Artificial Sequence
  Synthetic
tgaacttaaacaugttgacgccuact

SEQ ID NO: 93298 - DNA, 22 bp, Artificial Sequence
  Synthetic
gaagucugcagagagggaagag

SEQ ID NO: 93299 - DNA, 24 bp, Artificial Sequence
  Synthetic
cgugactttctucacagacaacag

SEQ ID NO: 93300 - DNA, 23 bp, Artificial Sequence
  Synthetic
tcttgtccgaugctgcttaguag

SEQ ID NO: 93301 - DNA, 21 bp, Artificial Sequence
  Synthetic
gaggaggccaggugtttuaca

SEQ ID NO: 93302 - DNA, 23 bp, Artificial Sequence
  Synthetic
agtctttccauttggtccaugct

SEQ ID NO: 93303 - DNA, 29 bp, Artificial Sequence
  Synthetic
gccttcaatgtcugactaaagtacttcug

SEQ ID NO: 93304 - DNA, 19 bp, Artificial Sequence
  Synthetic
agctccccauactcgcugt

SEQ ID NO: 93305 - DNA, 23 bp, Artificial Sequence
  Synthetic
ctaacaccaccutccctgtctug

SEQ ID NO: 93306 - DNA, 20 bp, Artificial Sequence
  Synthetic
tgcctcaguccttacccuca

SEQ ID NO: 93307 - DNA, 22 bp, Artificial Sequence
  Synthetic
ccaggaacugaguccagagaag

SEQ ID NO: 93308 - DNA, 21 bp, Artificial Sequence
  Synthetic
cacaccagcaauguagcaaca

SEQ ID NO: 93309 - DNA, 25 bp, Artificial Sequence
  Synthetic
ccactattcttucatggacaggcut

SEQ ID NO: 93310 - DNA, 21 bp, Artificial Sequence
  Synthetic
gtgucccagcattgugcaaaa

SEQ ID NO: 93311 - DNA, 22 bp, Artificial Sequence
  Synthetic
ccaauaggcaccatccatuccc

SEQ ID NO: 93312 - DNA, 23 bp, Artificial Sequence
  Synthetic
ctttggatcuctttcccgcuaca

SEQ ID NO: 93313 - DNA, 21 bp, Artificial Sequence
  Synthetic
aggaaucttctccuccgagca

SEQ ID NO: 93314 - DNA, 26 bp, Artificial Sequence
  Synthetic
ccttgttgcugtaaaacaggtaaugt

SEQ ID NO: 93315 - DNA, 27 bp, Artificial Sequence
  Synthetic
tacaaacaggtugaaatactgctguaa

SEQ ID NO: 93316 - DNA, 22 bp, Artificial Sequence
  Synthetic
gcccaucaaactctacugcaac

SEQ ID NO: 93317 - DNA, 22 bp, Artificial Sequence
  Synthetic
gaagcagaggcuccaaagctua

SEQ ID NO: 93318 - DNA, 27 bp, Artificial Sequence
  Synthetic
gttatattaacaguggtcacucaccca

SEQ ID NO: 93319 - DNA, 22 bp, Artificial Sequence
  Synthetic
ggatcttacucgtgtgccauca

SEQ ID NO: 93320 - DNA, 25 bp, Artificial Sequence
  Synthetic
gcatcaatccutactgttggagugg

SEQ ID NO: 93321 - DNA, 23 bp, Artificial Sequence
  Synthetic
ctcttgtagguctttcgccctua

SEQ ID NO: 93322 - DNA, 21 bp, Artificial Sequence
  Synthetic
ttcagtgagcuggagcatcug

SEQ ID NO: 93323 - DNA, 22 bp, Artificial Sequence
  Synthetic
ctgcctcugttctttggugaga

SEQ ID NO: 93324 - DNA, 22 bp, Artificial Sequence
  Synthetic
gagggaagcucttggtcactut

SEQ ID NO: 93325 - DNA, 27 bp, Artificial Sequence
  Synthetic
gcttaacctacauttccacttttgugt

SEQ ID NO: 93326 - DNA, 18 bp, Artificial Sequence
  Synthetic
gggcuaagccagtgctuc

SEQ ID NO: 93327 - DNA, 21 bp, Artificial Sequence
  Synthetic
gcttaccucgcttttggctut

SEQ ID NO: 93328 - DNA, 23 bp, Artificial Sequence
  Synthetic
gcttgaautgcttguagcgacat

SEQ ID NO: 93329 - DNA, 28 bp, Artificial Sequence
  Synthetic
ggtgatcccatutgaatatgctgtttut

SEQ ID NO: 93330 - DNA, 21 bp, Artificial Sequence
  Synthetic
ggcagaugggctgagaattug

SEQ ID NO: 93331 - DNA, 23 bp, Artificial Sequence
  Synthetic
cgtagagctugtacagtgtcugg

SEQ ID NO: 93332 - DNA, 28 bp, Artificial Sequence
  Synthetic
cttttatcatttugaaaccaggtcguga

SEQ ID NO: 93333 - DNA, 28 bp, Artificial Sequence
  Synthetic
gggccgaaagaautatatatggaagtut

SEQ ID NO: 93334 - DNA, 21 bp, Artificial Sequence
  Synthetic
cctgacuggaggcttctcuca

SEQ ID NO: 93335 - DNA, 19 bp, Artificial Sequence
  Synthetic
ggtgaaacaucgggcucac

SEQ ID NO: 93336 - DNA, 27 bp, Artificial Sequence
  Synthetic
gtgaatttctuacctttcctcuggagt

SEQ ID NO: 93337 - DNA, 27 bp, Artificial Sequence
  Synthetic
gaaugccagttaaugaaaacagaacga

SEQ ID NO: 93338 - DNA, 28 bp, Artificial Sequence
  Synthetic
gattataaatgtguttggctttggucgt

SEQ ID NO: 93339 - DNA, 24 bp, Artificial Sequence
  Synthetic
gagttcgcacugggttttgttuaa

SEQ ID NO: 93340 - DNA, 17 bp, Artificial Sequence
  Synthetic
tgggagggucggaugct

SEQ ID NO: 93341 - DNA, 21 bp, Artificial Sequence
  Synthetic
acagcttgcuccctctccaua

SEQ ID NO: 93342 - DNA, 21 bp, Artificial Sequence
  Synthetic
cggcgatgcugagaaccaaua

SEQ ID NO: 93343 - DNA, 25 bp, Artificial Sequence
  Synthetic
gaauaaagaggagcaggtugaggaa

SEQ ID NO: 93344 - DNA, 23 bp, Artificial Sequence
  Synthetic
aagcaaccugcttgatgauacca

SEQ ID NO: 93345 - DNA, 23 bp, Artificial Sequence
  Synthetic
ccttagacutccctguggacaga

SEQ ID NO: 93346 - DNA, 21 bp, Artificial Sequence
  Synthetic
ggccccuggagaggtttuaat

SEQ ID NO: 93347 - DNA, 24 bp, Artificial Sequence
  Synthetic
cagaaaatctgcucttagggcuca

SEQ ID NO: 93348 - DNA, 19 bp, Artificial Sequence
  Synthetic
ctctcccguccctgaccua

SEQ ID NO: 93349 - DNA, 22 bp, Artificial Sequence
  Synthetic
acaaggauggaaaggcactguc

SEQ ID NO: 93350 - DNA, 18 bp, Artificial Sequence
  Synthetic
ccgtcugctgccctuaca

SEQ ID NO: 93351 - DNA, 17 bp, Artificial Sequence
  Synthetic
ccuaacggcccgugcag

SEQ ID NO: 93352 - DNA, 24 bp, Artificial Sequence
  Synthetic
caactatggcuggcaattgaauca

SEQ ID NO: 93353 - DNA, 25 bp, Artificial Sequence
  Synthetic
cctgtgacguctttcctgttttcut

SEQ ID NO: 93354 - DNA, 22 bp, Artificial Sequence
  Synthetic
tgtguctcctcttuccccagat

SEQ ID NO: 93355 - DNA, 17 bp, Artificial Sequence
  Synthetic
cagcaggcugtgggugt

SEQ ID NO: 93356 - DNA, 20 bp, Artificial Sequence
  Synthetic
ctctgucacctcctugagca

SEQ ID NO: 93357 - DNA, 22 bp, Artificial Sequence
  Synthetic
cctccctccucccaactgtaut

SEQ ID NO: 93358 - DNA, 21 bp, Artificial Sequence
  Synthetic
gtgggaacacacggucatuct

SEQ ID NO: 93359 - DNA, 20 bp, Artificial Sequence
  Synthetic
ccaucctuaagccagcggat

SEQ ID NO: 93360 - DNA, 21 bp, Artificial Sequence
  Synthetic
cagcaatcutcagctcuccct

SEQ ID NO: 93361 - DNA, 23 bp, Artificial Sequence
  Synthetic
tggaggtccauccttgtctgaut

SEQ ID NO: 93362 - DNA, 19 bp, Artificial Sequence
  Synthetic
cgtcaagutccgctgucca

SEQ ID NO: 93363 - DNA, 22 bp, Artificial Sequence
  Synthetic
ggtctuggaacccagagacuca

SEQ ID NO: 93364 - DNA, 18 bp, Artificial Sequence
  Synthetic
gcuaacccugcccaacgg

SEQ ID NO: 93365 - DNA, 19 bp, Artificial Sequence
  Synthetic
ccagctgcugatggctuct

SEQ ID NO: 93366 - DNA, 21 bp, Artificial Sequence
  Synthetic
tgccacacucagaacatugct

SEQ ID NO: 93367 - DNA, 27 bp, Artificial Sequence
  Synthetic
gagaaccccagaauaaacacgtaatuc

SEQ ID NO: 93368 - DNA, 27 bp, Artificial Sequence
  Synthetic
gccagtttttcuaacagcattgaucat

SEQ ID NO: 93369 - DNA, 24 bp, Artificial Sequence
  Synthetic
gttttaacaccutcagugggcaag

SEQ ID NO: 93370 - DNA, 22 bp, Artificial Sequence
  Synthetic
ggccguaagcagacaaatccua

SEQ ID NO: 93371 - DNA, 23 bp, Artificial Sequence
  Synthetic
cttatugttccagcugacaccac

SEQ ID NO: 93372 - DNA, 21 bp, Artificial Sequence
  Synthetic
catgucaccacaggcaaaucc

SEQ ID NO: 93373 - DNA, 26 bp, Artificial Sequence
  Synthetic
gcctgagatttcuttcccttgtgtua

SEQ ID NO: 93374 - DNA, 25 bp, Artificial Sequence
  Synthetic
attcaagaaccacugctaucaaggt

SEQ ID NO: 93375 - DNA, 29 bp, Artificial Sequence
  Synthetic
ggaaaatatttgautaatggcaccugcaa

SEQ ID NO: 93376 - DNA, 18 bp, Artificial Sequence
  Synthetic
gggcucggtctaugacga

SEQ ID NO: 93377 - DNA, 21 bp, Artificial Sequence
  Synthetic
ccacucacccgacttcugaac

SEQ ID NO: 93378 - DNA, 18 bp, Artificial Sequence
  Synthetic
gcguaucgccagcacgat

SEQ ID NO: 93379 - DNA, 17 bp, Artificial Sequence
  Synthetic
cgggcccgacugucaag

SEQ ID NO: 93380 - DNA, 25 bp, Artificial Sequence
  Synthetic
aaagcctcccugtaaataactgugt

SEQ ID NO: 93381 - DNA, 22 bp, Artificial Sequence
  Synthetic
gaagagataugctgtgcccuca

SEQ ID NO: 93382 - DNA, 21 bp, Artificial Sequence
  Synthetic
ccaccuaacaggctgtcauca

SEQ ID NO: 93383 - DNA, 25 bp, Artificial Sequence
  Synthetic
cttttgttucaccagtacccaaucc

SEQ ID NO: 93384 - DNA, 23 bp, Artificial Sequence
  Synthetic
gttgacctgucccagattcaguc

SEQ ID NO: 93385 - DNA, 24 bp, Artificial Sequence
  Synthetic
gcctctaugcctctaauccaaggt

SEQ ID NO: 93386 - DNA, 22 bp, Artificial Sequence
  Synthetic
attcatgaagcccutgccauct

SEQ ID NO: 93387 - DNA, 29 bp, Artificial Sequence
  Synthetic
ggaccttcatcuaaagacacaagcauaaa

SEQ ID NO: 93388 - DNA, 20 bp, Artificial Sequence
  Synthetic
ccugagggcacagcatauct

SEQ ID NO: 93389 - DNA, 28 bp, Artificial Sequence
  Synthetic
gcaattcgtccucaggtaggattaauat

SEQ ID NO: 93390 - DNA, 27 bp, Artificial Sequence
  Synthetic
acactaaaatuttcctgggucacaaga

SEQ ID NO: 93391 - DNA, 26 bp, Artificial Sequence
  Synthetic
acccttaccacuatcagagagtugag

SEQ ID NO: 93392 - DNA, 26 bp, Artificial Sequence
  Synthetic
aaacttgcaatautcctacctggugt

SEQ ID NO: 93393 - DNA, 22 bp, Artificial Sequence
  Synthetic
ggcctgatcutcacagtcauca

SEQ ID NO: 93394 - DNA, 19 bp, Artificial Sequence
  Synthetic
cuccagaacgacucgggaa

SEQ ID NO: 93395 - DNA, 18 bp, Artificial Sequence
  Synthetic
ggcugcaggagacctugt

SEQ ID NO: 93396 - DNA, 20 bp, Artificial Sequence
  Synthetic
gcctcugagctcctctucac

SEQ ID NO: 93397 - DNA, 20 bp, Artificial Sequence
  Synthetic
tccagctcuggacccacaua

SEQ ID NO: 93398 - DNA, 21 bp, Artificial Sequence
  Synthetic
ctgaagccutttgtcgtugcc

SEQ ID NO: 93399 - DNA, 25 bp, Artificial Sequence
  Synthetic
agccaggaaautctggtcacuaaac

SEQ ID NO: 93400 - DNA, 20 bp, Artificial Sequence
  Synthetic
ctgcacacacuaacgcgtut

SEQ ID NO: 93401 - DNA, 29 bp, Artificial Sequence
  Synthetic
tgaagccagatugaagtttcctagatuac

SEQ ID NO: 93402 - DNA, 26 bp, Artificial Sequence
  Synthetic
ctggttttaagccagugagtgtcaua

SEQ ID NO: 93403 - DNA, 20 bp, Artificial Sequence
  Synthetic
cactucaacctccguccagt

SEQ ID NO: 93404 - DNA, 27 bp, Artificial Sequence
  Synthetic
cttctgaaatugagtgtacctgcuact

SEQ ID NO: 93405 - DNA, 27 bp, Artificial Sequence
  Synthetic
accattgatugaagactgcattctuga

SEQ ID NO: 93406 - DNA, 23 bp, Artificial Sequence
  Synthetic
atccgaatggcaugagaacctut

SEQ ID NO: 93407 - DNA, 24 bp, Artificial Sequence
  Synthetic
gtgatccuggtgaatttcttugcc

SEQ ID NO: 93408 - DNA, 27 bp, Artificial Sequence
  Synthetic
aaaatgtcaggauaaagtggatcugct

SEQ ID NO: 93409 - DNA, 23 bp, Artificial Sequence
  Synthetic
agccatactucccttgtcatugg

SEQ ID NO: 93410 - DNA, 28 bp, Artificial Sequence
  Synthetic
ctctttaccuccctttcataagcuagac

SEQ ID NO: 93411 - DNA, 26 bp, Artificial Sequence
  Synthetic
tcagaagttugaaaggccagtaacuc

SEQ ID NO: 93412 - DNA, 25 bp, Artificial Sequence
  Synthetic
gcagttttcaautgccttgagtuca

SEQ ID NO: 93413 - DNA, 21 bp, Artificial Sequence
  Synthetic
cttttccccutgctucccaac

SEQ ID NO: 93414 - DNA, 20 bp, Artificial Sequence
  Synthetic
gccaccutggagugacaaag

SEQ ID NO: 93415 - DNA, 29 bp, Artificial Sequence
  Synthetic
tgauatgtagctuacaaccaagaacacag

SEQ ID NO: 93416 - DNA, 21 bp, Artificial Sequence
  Synthetic
ggacagguggttgccaagaua

SEQ ID NO: 93417 - DNA, 22 bp, Artificial Sequence
  Synthetic
gagcatcauacgtctucaggct

SEQ ID NO: 93418 - DNA, 22 bp, Artificial Sequence
  Synthetic
gagacacaagucacgtgaucgt

SEQ ID NO: 93419 - DNA, 27 bp, Artificial Sequence
  Synthetic
catttcatgtttguactgctcgttcug

SEQ ID NO: 93420 - DNA, 29 bp, Artificial Sequence
  Synthetic
ctcctctggauaccgttctataatcugaa

SEQ ID NO: 93421 - DNA, 27 bp, Artificial Sequence
  Synthetic
tgctttcttcttuggtgtccttgauag

SEQ ID NO: 93422 - DNA, 24 bp, Artificial Sequence
  Synthetic
cutcgtggtgtaugaggaagacat

SEQ ID NO: 93423 - DNA, 19 bp, Artificial Sequence
  Synthetic
cacccugccagcaagatug

SEQ ID NO: 93424 - DNA, 28 bp, Artificial Sequence
  Synthetic
cagaggtacauaatttcagaggctuacc

SEQ ID NO: 93425 - DNA, 22 bp, Artificial Sequence
  Synthetic
gttaaagtcucatggcgcucac

SEQ ID NO: 93426 - DNA, 22 bp, Artificial Sequence
  Synthetic
ggcagagaaagautggccagua

SEQ ID NO: 93427 - DNA, 25 bp, Artificial Sequence
  Synthetic
acaggaccagacuccataatgguag

SEQ ID NO: 93428 - DNA, 33 bp, Artificial Sequence
  Synthetic
ttcaaaatatatcttaautcaaaagggctgcut

SEQ ID NO: 93429 - DNA, 25 bp, Artificial Sequence
  Synthetic
ctggagagaggcutggctaatttua

SEQ ID NO: 93430 - DNA, 20 bp, Artificial Sequence
  Synthetic
gggcuggactgcaacugaac

SEQ ID NO: 93431 - DNA, 20 bp, Artificial Sequence
  Synthetic
ccugcgtctcuggaaaggaa

SEQ ID NO: 93432 - DNA, 23 bp, Artificial Sequence
  Synthetic
tccttcctttugcagcatccaut

SEQ ID NO: 93433 - DNA, 27 bp, Artificial Sequence
  Synthetic
tctttccugcagcagagttttattuca

SEQ ID NO: 93434 - DNA, 18 bp, Artificial Sequence
  Synthetic
ccgtgcuccgatccttug

SEQ ID NO: 93435 - DNA, 17 bp, Artificial Sequence
  Synthetic
cacttgcccuccccgut

SEQ ID NO: 93436 - DNA, 23 bp, Artificial Sequence
  Synthetic
gtgtgcaaugactatgctucagg

SEQ ID NO: 93437 - DNA, 24 bp, Artificial Sequence
  Synthetic
tggctctuaggatctgctcauagg

SEQ ID NO: 93438 - DNA, 21 bp, Artificial Sequence
  Synthetic
gagccagaggaggauggagua

SEQ ID NO: 93439 - DNA, 19 bp, Artificial Sequence
  Synthetic
gcaagugcaagacgagugg

SEQ ID NO: 93440 - DNA, 25 bp, Artificial Sequence
  Synthetic
tcgacactcuccattcaattcgtut

SEQ ID NO: 93441 - DNA, 25 bp, Artificial Sequence
  Synthetic
ggatgttcucaagactgucaagacc

SEQ ID NO: 93442 - DNA, 23 bp, Artificial Sequence
  Synthetic
agtttgatgctutccccacagua

SEQ ID NO: 93443 - DNA, 28 bp, Artificial Sequence
  Synthetic
tccagacugtcaaaatgtuaagaacaca

SEQ ID NO: 93444 - DNA, 27 bp, Artificial Sequence
  Synthetic
gagtaccuaccttataacugaccggaa

SEQ ID NO: 93445 - DNA, 25 bp, Artificial Sequence
  Synthetic
aggtcttugcgacaataaggaugac

SEQ ID NO: 93446 - DNA, 25 bp, Artificial Sequence
  Synthetic
cttatctggccaugctgtttatugg

SEQ ID NO: 93447 - DNA, 21 bp, Artificial Sequence
  Synthetic
gctcugatagggugggacaag

SEQ ID NO: 93448 - DNA, 21 bp, Artificial Sequence
  Synthetic
cccacttugtttctggcugag

SEQ ID NO: 93449 - DNA, 24 bp, Artificial Sequence
  Synthetic
ctcttcagggcuaccgtcuaaaat

SEQ ID NO: 93450 - DNA, 21 bp, Artificial Sequence
  Synthetic
ctcauctgaaccaucgccaca

SEQ ID NO: 93451 - DNA, 23 bp, Artificial Sequence
  Synthetic
ggcatgcccuttatgttccatut

SEQ ID NO: 93452 - DNA, 23 bp, Artificial Sequence
  Synthetic
tatttgtcccaugcacacggaua

SEQ ID NO: 93453 - DNA, 23 bp, Artificial Sequence
  Synthetic
aagagaaacagaugggagcucac

SEQ ID NO: 93454 - DNA, 22 bp, Artificial Sequence
  Synthetic
tgtctgtaccauagctggucgt

SEQ ID NO: 93455 - DNA, 21 bp, Artificial Sequence
  Synthetic
acccaguaacatcgccttugt

SEQ ID NO: 93456 - DNA, 28 bp, Artificial Sequence
  Synthetic
ctgattgagaaagaacuttatgcccuct

SEQ ID NO: 93457 - DNA, 26 bp, Artificial Sequence
  Synthetic
ccaatcctgaaaugttgacaccauct

SEQ ID NO: 93458 - DNA, 25 bp, Artificial Sequence
  Synthetic
tcggtaaacacacuctccttttugt

SEQ ID NO: 93459 - DNA, 18 bp, Artificial Sequence
  Synthetic
gatgucgaaggccucggt

SEQ ID NO: 93460 - DNA, 23 bp, Artificial Sequence
  Synthetic
acatccagggaccaguaatctuc

SEQ ID NO: 93461 - DNA, 26 bp, Artificial Sequence
  Synthetic
gcttctggcuctgaaaauaaagacaa

SEQ ID NO: 93462 - DNA, 20 bp, Artificial Sequence
  Synthetic
gagaacaucgtccgcuacga

SEQ ID NO: 93463 - DNA, 18 bp, Artificial Sequence
  Synthetic
gcacgtcugaggcacgua

SEQ ID NO: 93464 - DNA, 18 bp, Artificial Sequence
  Synthetic
gcugcccgagaucgagag

SEQ ID NO: 93465 - DNA, 17 bp, Artificial Sequence
  Synthetic
ccgucccccucgaacat

SEQ ID NO: 93466 - DNA, 23 bp, Artificial Sequence
  Synthetic
gtgggacugcagatatagaugcc

SEQ ID NO: 93467 - DNA, 23 bp, Artificial Sequence
  Synthetic
gtggatccccuggatttgtugaa

SEQ ID NO: 93468 - DNA, 21 bp, Artificial Sequence
  Synthetic
ttcgactcccuccagacguat

SEQ ID NO: 93469 - DNA, 19 bp, Artificial Sequence
  Synthetic
gtagagcucggccagctuc

SEQ ID NO: 93470 - DNA, 23 bp, Artificial Sequence
  Synthetic
ggtagagtggauggtcagtguct

SEQ ID NO: 93471 - DNA, 24 bp, Artificial Sequence
  Synthetic
ctgcaggatacutttgtggaacuc

SEQ ID NO: 93472 - DNA, 26 bp, Artificial Sequence
  Synthetic
ggaaagaaccacuttatttugcacct

SEQ ID NO: 93473 - DNA, 28 bp, Artificial Sequence
  Synthetic
acagtgaaatatuggttctgacgtuagt

SEQ ID NO: 93474 - DNA, 27 bp, Artificial Sequence
  Synthetic
gggctauagggtgtatattugcagaac

SEQ ID NO: 93475 - DNA, 22 bp, Artificial Sequence
  Synthetic
atgtgtaccugcaggaaauccc

SEQ ID NO: 93476 - DNA, 25 bp, Artificial Sequence
  Synthetic
ccatctcaaguccatagcactuacc

SEQ ID NO: 93477 - DNA, 23 bp, Artificial Sequence
  Synthetic
tgacacucacaaagtgcucaagt

SEQ ID NO: 93478 - DNA, 21 bp, Artificial Sequence
  Synthetic
gccacctuaaagtgggacgug

SEQ ID NO: 93479 - DNA, 28 bp, Artificial Sequence
  Synthetic
ctcatagatauctcgcgtcauaccaaaa

SEQ ID NO: 93480 - DNA, 28 bp, Artificial Sequence
  Synthetic
accagcuggacagaatattcaatguaat

SEQ ID NO: 93481 - DNA, 29 bp, Artificial Sequence
  Synthetic
aacaaagactcaaguaaaagtagctucca

SEQ ID NO: 93482 - DNA, 27 bp, Artificial Sequence
  Synthetic
gctattcatuaggatccctttcucgga

SEQ ID NO: 93483 - DNA, 28 bp, Artificial Sequence
  Synthetic
ccagcagaactauctcctactactctut

SEQ ID NO: 93484 - DNA, 27 bp, Artificial Sequence
  Synthetic
gcaactuacccaagctatgatuaacag

SEQ ID NO: 93485 - DNA, 33 bp, Artificial Sequence
  Synthetic
taaagctagtttuatgattacttgaucagaagt

SEQ ID NO: 93486 - DNA, 20 bp, Artificial Sequence
  Synthetic
gctgctgcautgttcccaua

SEQ ID NO: 93487 - DNA, 25 bp, Artificial Sequence
  Synthetic
gtttttcacaucaccaaggccauag

SEQ ID NO: 93488 - DNA, 22 bp, Artificial Sequence
  Synthetic
acagttgggauttctgggtguc

SEQ ID NO: 93489 - DNA, 28 bp, Artificial Sequence
  Synthetic
ggactgtugacccgaaatatacaaatuc

SEQ ID NO: 93490 - DNA, 24 bp, Artificial Sequence
  Synthetic
cagguaagatgagugggaaaagca

SEQ ID NO: 93491 - DNA, 21 bp, Artificial Sequence
  Synthetic
gtgcatgaugatgtgcuggag

SEQ ID NO: 93492 - DNA, 27 bp, Artificial Sequence
  Synthetic
agatcaacttcuaagacaccacucact

SEQ ID NO: 93493 - DNA, 28 bp, Artificial Sequence
  Synthetic
gctgatatcacaaaguaccatttcucca

SEQ ID NO: 93494 - DNA, 25 bp, Artificial Sequence
  Synthetic
gatacaatcucgaagcagtccucaa

SEQ ID NO: 93495 - DNA, 23 bp, Artificial Sequence
  Synthetic
cggaccucagaattagcaucaac

SEQ ID NO: 93496 - DNA, 28 bp, Artificial Sequence
  Synthetic
tcatttgctuctgtaaattctuggagga

SEQ ID NO: 93497 - DNA, 24 bp, Artificial Sequence
  Synthetic
ccatccaaugccttguagaaacct

SEQ ID NO: 93498 - DNA, 25 bp, Artificial Sequence
  Synthetic
cattttgttugtagcttgucgacca

SEQ ID NO: 93499 - DNA, 28 bp, Artificial Sequence
  Synthetic
aagtaattattcucacacctgcagtuca

SEQ ID NO: 93500 - DNA, 23 bp, Artificial Sequence
  Synthetic
tgcacactguttcgttgacugat

SEQ ID NO: 93501 - DNA, 19 bp, Artificial Sequence
  Synthetic
tggcgtugagaatcgcuct

SEQ ID NO: 93502 - DNA, 22 bp, Artificial Sequence
  Synthetic
cccctacaugatacgucaggct

SEQ ID NO: 93503 - DNA, 28 bp, Artificial Sequence
  Synthetic
ccagctagtgauttttgaaacaggttut

SEQ ID NO: 93504 - DNA, 21 bp, Artificial Sequence
  Synthetic
cgccctcucttccctuacaga

SEQ ID NO: 93505 - DNA, 25 bp, Artificial Sequence
  Synthetic
ggcaatgcaguaaaggttctcauac

SEQ ID NO: 93506 - DNA, 22 bp, Artificial Sequence
  Synthetic
gattgagcucgtccatcuccag

SEQ ID NO: 93507 - DNA, 24 bp, Artificial Sequence
  Synthetic
tuatatgctgtugccccagaaaga

SEQ ID NO: 93508 - DNA, 27 bp, Artificial Sequence
  Synthetic
gcaaacttttuagaccgtaaggagcua

SEQ ID NO: 93509 - DNA, 25 bp, Artificial Sequence
  Synthetic
tggaagaagaugguggaagaaacag

SEQ ID NO: 93510 - DNA, 26 bp, Artificial Sequence
  Synthetic
cagttctacucaggaagatggtucaa

SEQ ID NO: 93511 - DNA, 22 bp, Artificial Sequence
  Synthetic
aaaacaaacauggaggcauggg

SEQ ID NO: 93512 - DNA, 23 bp, Artificial Sequence
  Synthetic
agtaaaaggccugaagacaggug

SEQ ID NO: 93513 - DNA, 22 bp, Artificial Sequence
  Synthetic
tccaggtccucactgtagtugt

SEQ ID NO: 93514 - DNA, 22 bp, Artificial Sequence
  Synthetic
aagggaaggcucuacagaaggt

SEQ ID NO: 93515 - DNA, 28 bp, Artificial Sequence
  Synthetic
caaatgagaagcuatgctctgatgttuc

SEQ ID NO: 93516 - DNA, 25 bp, Artificial Sequence
  Synthetic
gccatatctuctgcctctttuacct

SEQ ID NO: 93517 - DNA, 24 bp, Artificial Sequence
  Synthetic
tgaccagacagaugaaatggcauc

SEQ ID NO: 93518 - DNA, 23 bp, Artificial Sequence
  Synthetic
gugcggaaaggauaagaccaagt

SEQ ID NO: 93519 - DNA, 24 bp, Artificial Sequence
  Synthetic
ctaagctuccggatgtcatacuca

SEQ ID NO: 93520 - DNA, 18 bp, Artificial Sequence
  Synthetic
ggcctgacuctgcctgut

SEQ ID NO: 93521 - DNA, 17 bp, Artificial Sequence
  Synthetic
cagugccacaccccuca

SEQ ID NO: 93522 - DNA, 23 bp, Artificial Sequence
  Synthetic
cttctcuccccacccatctctua

SEQ ID NO: 93523 - DNA, 27 bp, Artificial Sequence
  Synthetic
cagaaacccaagcucttactgaattut

SEQ ID NO: 93524 - DNA, 24 bp, Artificial Sequence
  Synthetic
gatacagagcagugccttugaaga

SEQ ID NO: 93525 - DNA, 25 bp, Artificial Sequence
  Synthetic
caatgactccuctgcacttcuagag

SEQ ID NO: 93526 - DNA, 23 bp, Artificial Sequence
  Synthetic
ccttcttgcugctgctttcttua

SEQ ID NO: 93527 - DNA, 25 bp, Artificial Sequence
  Synthetic
cactcaaagtagugcacacattcug

SEQ ID NO: 93528 - DNA, 26 bp, Artificial Sequence
  Synthetic
catgtctcacucacaactuaccacaa

SEQ ID NO: 93529 - DNA, 24 bp, Artificial Sequence
  Synthetic
tgatcatcauagccagaacaugcc

SEQ ID NO: 93530 - DNA, 26 bp, Artificial Sequence
  Synthetic
gggaactccugaatttgtaacugcaa

SEQ ID NO: 93531 - DNA, 29 bp, Artificial Sequence
  Synthetic
ttccccagagtauacttcataagcatgua

SEQ ID NO: 93532 - DNA, 28 bp, Artificial Sequence
  Synthetic
tgacaaggtggaauttgtagaactacug

SEQ ID NO: 93533 - DNA, 25 bp, Artificial Sequence
  Synthetic
atgcaagttguggcttttggtatut

SEQ ID NO: 93534 - DNA, 22 bp, Artificial Sequence
  Synthetic
acagctacaautgcctgggtut

SEQ ID NO: 93535 - DNA, 23 bp, Artificial Sequence
  Synthetic
ctgaagguactctcatgcuccac

SEQ ID NO: 93536 - DNA, 27 bp, Artificial Sequence
  Synthetic
gaggagatutacgtgtatauccaagca

SEQ ID NO: 93537 - DNA, 20 bp, Artificial Sequence
  Synthetic
ccctcccucccagtcaauca

SEQ ID NO: 93538 - DNA, 27 bp, Artificial Sequence
  Synthetic
cttgagtgctuaggactaaagtgtgua

SEQ ID NO: 93539 - DNA, 22 bp, Artificial Sequence
  Synthetic
catccccacuagctgaaugaca

SEQ ID NO: 93540 - DNA, 28 bp, Artificial Sequence
  Synthetic
gcatttaaactgaucatcaggacagcua

SEQ ID NO: 93541 - DNA, 27 bp, Artificial Sequence
  Synthetic
ggcaatgaaugacagactctaugacat

SEQ ID NO: 93542 - DNA, 23 bp, Artificial Sequence
  Synthetic
cagaaacacgaugcccagttuac

SEQ ID NO: 93543 - DNA, 19 bp, Artificial Sequence
  Synthetic
aagaugtuccgagcagcga

SEQ ID NO: 93544 - DNA, 23 bp, Artificial Sequence
  Synthetic
gggaggattcuaatgcctcttuc

SEQ ID NO: 93545 - DNA, 22 bp, Artificial Sequence
  Synthetic
gcaagtgagaguggaggaccua

SEQ ID NO: 93546 - DNA, 23 bp, Artificial Sequence
  Synthetic
agtacctgucagacatgggcuat

SEQ ID NO: 93547 - DNA, 25 bp, Artificial Sequence
  Synthetic
ttgtataagcagcutctgggtcauc

SEQ ID NO: 93548 - DNA, 27 bp, Artificial Sequence
  Synthetic
gtgtaaggtttcugatttcggacttuc

SEQ ID NO: 93549 - DNA, 23 bp, Artificial Sequence
  Synthetic
gacaacacgutttgggtcaugat

SEQ ID NO: 93550 - DNA, 26 bp, Artificial Sequence
  Synthetic
gttcccttaguagtctctcctcucat

SEQ ID NO: 93551 - DNA, 27 bp, Artificial Sequence
  Synthetic
cagagctgccuattggcacttatauag

SEQ ID NO: 93552 - DNA, 23 bp, Artificial Sequence
  Synthetic
gcagatcacagcaaucactccut

SEQ ID NO: 93553 - DNA, 22 bp, Artificial Sequence
  Synthetic
ctcgacaccutgtccttacucc

SEQ ID NO: 93554 - DNA, 21 bp, Artificial Sequence
  Synthetic
gctgttgtcugctgtgcagua

SEQ ID NO: 93555 - DNA, 20 bp, Artificial Sequence
  Synthetic
gauggacgaaggcaaagcug

SEQ ID NO: 93556 - DNA, 20 bp, Artificial Sequence
  Synthetic
cagggagugagtggctgtua

SEQ ID NO: 93557 - DNA, 23 bp, Artificial Sequence
  Synthetic
ggaaatagactutgcccccguag

SEQ ID NO: 93558 - DNA, 18 bp, Artificial Sequence
  Synthetic
ggctgcugccatgcagua

SEQ ID NO: 93559 - DNA, 18 bp, Artificial Sequence
  Synthetic
ctgtguccccaaggcugt

SEQ ID NO: 93560 - DNA, 23 bp, Artificial Sequence
  Synthetic
aaggaaattagugctgggcguat

SEQ ID NO: 93561 - DNA, 21 bp, Artificial Sequence
  Synthetic
ctagcagacccuttcccucac

SEQ ID NO: 93562 - DNA, 22 bp, Artificial Sequence
  Synthetic
ctggccacauctatggttucca

SEQ ID NO: 93563 - DNA, 20 bp, Artificial Sequence
  Synthetic
cctgggccuctcctcacuac

SEQ ID NO: 93564 - DNA, 22 bp, Artificial Sequence
  Synthetic
tgatctagccgauagccctuct

SEQ ID NO: 93565 - DNA, 27 bp, Artificial Sequence
  Synthetic
gcctgcctttcuattttatctgaacug

SEQ ID NO: 93566 - DNA, 31 bp, Artificial Sequence
  Synthetic
aaaggacagtcaugagttggtaatattaauc

SEQ ID NO: 93567 - DNA, 22 bp, Artificial Sequence
  Synthetic
tggaaggccgagagaucattuc

SEQ ID NO: 93568 - DNA, 28 bp, Artificial Sequence
  Synthetic
gccttccactcuagcatagtaatctuca

SEQ ID NO: 93569 - DNA, 33 bp, Artificial Sequence
  Synthetic
ttcttatgtatguttaattctgtacaugagcat

SEQ ID NO: 93570 - DNA, 23 bp, Artificial Sequence
  Synthetic
tgcatcaacacutgagtctugga

SEQ ID NO: 93571 - DNA, 21 bp, Artificial Sequence
  Synthetic
gcccttgutgcaagtcugaca

SEQ ID NO: 93572 - DNA, 20 bp, Artificial Sequence
  Synthetic
cugaagcttcugagccccaa

SEQ ID NO: 93573 - DNA, 20 bp, Artificial Sequence
  Synthetic
cactgccccuctgctcauag

SEQ ID NO: 93574 - DNA, 21 bp, Artificial Sequence
  Synthetic
cctctgatuccctctgcctuc

SEQ ID NO: 93575 - DNA, 20 bp, Artificial Sequence
  Synthetic
accaggugcgaguacaggat

SEQ ID NO: 93576 - DNA, 21 bp, Artificial Sequence
  Synthetic
ccucaacaagaaggaccugct

SEQ ID NO: 93577 - DNA, 23 bp, Artificial Sequence
  Synthetic
tgtatgagccccuctcccatauc

SEQ ID NO: 93578 - DNA, 23 bp, Artificial Sequence
  Synthetic
ggutttcucaagaaggaggagca

SEQ ID NO: 93579 - DNA, 25 bp, Artificial Sequence
  Synthetic
ctgtactctcuctttgggacatuct

SEQ ID NO: 93580 - DNA, 27 bp, Artificial Sequence
  Synthetic
aaaacccttauacacaaagagguacgg

SEQ ID NO: 93581 - DNA, 23 bp, Artificial Sequence
  Synthetic
tgggtttcucctggcattuacag

SEQ ID NO: 93582 - DNA, 25 bp, Artificial Sequence
  Synthetic
gtttgtgacauaagcagaacgctut

SEQ ID NO: 93583 - DNA, 25 bp, Artificial Sequence
  Synthetic
cttcagaatcucttgcgtttccuac

SEQ ID NO: 93584 - DNA, 29 bp, Artificial Sequence
  Synthetic
gcatttgcuaaaaacattcaaauacacaa

SEQ ID NO: 93585 - DNA, 24 bp, Artificial Sequence
  Synthetic
cacuactgcacagucaaggaagaa

SEQ ID NO: 93586 - DNA, 28 bp, Artificial Sequence
  Synthetic
tcatcattaaattcutcagcccactuct

SEQ ID NO: 93587 - DNA, 28 bp, Artificial Sequence
  Synthetic
tgttcttaccaguaagcagagcgataua

SEQ ID NO: 93588 - DNA, 27 bp, Artificial Sequence
  Synthetic
tcaacttgcttcuttatgtcactguct

SEQ ID NO: 93589 - DNA, 25 bp, Artificial Sequence
  Synthetic
ggcaagaagauggtggtgttaugat

SEQ ID NO: 93590 - DNA, 21 bp, Artificial Sequence
  Synthetic
gctcagggaagguctctccuc

SEQ ID NO: 93591 - DNA, 21 bp, Artificial Sequence
  Synthetic
tgctcaucctccuaccccaat

SEQ ID NO: 93592 - DNA, 28 bp, Artificial Sequence
  Synthetic
acattccttcctugagcaagatttcuat

SEQ ID NO: 93593 - DNA, 28 bp, Artificial Sequence
  Synthetic
ccacaaaaggttuctgaattagcaacug

SEQ ID NO: 93594 - DNA, 22 bp, Artificial Sequence
  Synthetic
cttctctccugaggacgttuca

SEQ ID NO: 93595 - DNA, 27 bp, Artificial Sequence
  Synthetic
ccagtgatgcauatttcagtgggaaua

SEQ ID NO: 93596 - DNA, 25 bp, Artificial Sequence
  Synthetic
cctgacaaucagcacctttaatugg

SEQ ID NO: 93597 - DNA, 23 bp, Artificial Sequence
  Synthetic
agcaguggaacugaacaagaagt

SEQ ID NO: 93598 - DNA, 21 bp, Artificial Sequence
  Synthetic
aguggagaacggccttucaaa

SEQ ID NO: 93599 - DNA, 27 bp, Artificial Sequence
  Synthetic
gtcagaaggtcuacccagaaaatacug

SEQ ID NO: 93600 - DNA, 26 bp, Artificial Sequence
  Synthetic
gatgaactcuccacttcttgtucagt

SEQ ID NO: 93601 - DNA, 24 bp, Artificial Sequence
  Synthetic
acctgccaacacutctgaagatut

SEQ ID NO: 93602 - DNA, 26 bp, Artificial Sequence
  Synthetic
aaaccaaagtgguatgagaaagcuct

SEQ ID NO: 93603 - DNA, 22 bp, Artificial Sequence
  Synthetic
aagactccugctgtgtgaugac

SEQ ID NO: 93604 - DNA, 28 bp, Artificial Sequence
  Synthetic
cctttgagtcaautagtcaggtaaguga

SEQ ID NO: 93605 - DNA, 26 bp, Artificial Sequence
  Synthetic
tgtggaugaaacaggaaacaatccut

SEQ ID NO: 93606 - DNA, 27 bp, Artificial Sequence
  Synthetic
attcutaacatccaguagggcaaaaca

SEQ ID NO: 93607 - DNA, 21 bp, Artificial Sequence
  Synthetic
ctgguccccagacattucaga

SEQ ID NO: 93608 - DNA, 23 bp, Artificial Sequence
  Synthetic
cccttgtcauctgttccagaaug

SEQ ID NO: 93609 - DNA, 28 bp, Artificial Sequence
  Synthetic
tcgaacaagcttuacaccttcttcatua

SEQ ID NO: 93610 - DNA, 25 bp, Artificial Sequence
  Synthetic
actgagaaaaaugaactcugcccaa

SEQ ID NO: 93611 - DNA, 22 bp, Artificial Sequence
  Synthetic
ggctcccacgucttctaaaguc

SEQ ID NO: 93612 - DNA, 28 bp, Artificial Sequence
  Synthetic
aggcaacattcautagactcactttcut

SEQ ID NO: 93613 - DNA, 28 bp, Artificial Sequence
  Synthetic
aaaaagatagtagcucaagtggaagugg

SEQ ID NO: 93614 - DNA, 24 bp, Artificial Sequence
  Synthetic
acttcaacaucattgtcacugcca

SEQ ID NO: 93615 - DNA, 28 bp, Artificial Sequence
  Synthetic
tgctgattgaccucttataattgacgut

SEQ ID NO: 93616 - DNA, 21 bp, Artificial Sequence
  Synthetic
ccaactuggcctgttccauct

SEQ ID NO: 93617 - DNA, 23 bp, Artificial Sequence
  Synthetic
tttggttatgcugtcaccagugt

SEQ ID NO: 93618 - DNA, 29 bp, Artificial Sequence
  Synthetic
tcacgatgttcuaaaatgaaggaagagut

SEQ ID NO: 93619 - DNA, 28 bp, Artificial Sequence
  Synthetic
gagtgttaaaaucgctttccttcttgut

SEQ ID NO: 93620 - DNA, 18 bp, Artificial Sequence
  Synthetic
ccccctccuggtggctut

SEQ ID NO: 93621 - DNA, 18 bp, Artificial Sequence
  Synthetic
ggcagguagcccaaggug

SEQ ID NO: 93622 - DNA, 23 bp, Artificial Sequence
  Synthetic
cuggaacugaggaaggaacagac

SEQ ID NO: 93623 - DNA, 25 bp, Artificial Sequence
  Synthetic
gcaucagaatgtuccaacagaggaa

SEQ ID NO: 93624 - DNA, 21 bp, Artificial Sequence
  Synthetic
caagccucaccccaggtaaua

SEQ ID NO: 93625 - DNA, 25 bp, Artificial Sequence
  Synthetic
tgtcacagaaugttgactttuccca

SEQ ID NO: 93626 - DNA, 27 bp, Artificial Sequence
  Synthetic
acggcataaatguagtcttttcccaut

SEQ ID NO: 93627 - DNA, 27 bp, Artificial Sequence
  Synthetic
atagctattgtugcagaaacatgtuca

SEQ ID NO: 93628 - DNA, 17 bp, Artificial Sequence
  Synthetic
ccgacgtugaccgcauc

SEQ ID NO: 93629 - DNA, 20 bp, Artificial Sequence
  Synthetic
gggcaaaugagcctcucagt

SEQ ID NO: 93630 - DNA, 21 bp, Artificial Sequence
  Synthetic
ggcagggaguactguaaaggg

SEQ ID NO: 93631 - DNA, 25 bp, Artificial Sequence
  Synthetic
acagcttgtugacccatttgtttut

SEQ ID NO: 93632 - DNA, 28 bp, Artificial Sequence
  Synthetic
caccaccgguacttttatttgttcttug

SEQ ID NO: 93633 - DNA, 28 bp, Artificial Sequence
  Synthetic
accttgtgcttuggaaaagaaggataut

SEQ ID NO: 93634 - DNA, 24 bp, Artificial Sequence
  Synthetic
ctcacaucagaaaaggaccucgat

SEQ ID NO: 93635 - DNA, 20 bp, Artificial Sequence
  Synthetic
gggagcgagugatgtacgug

SEQ ID NO: 93636 - DNA, 27 bp, Artificial Sequence
  Synthetic
gtaagcacauccgattttccaataugg

SEQ ID NO: 93637 - DNA, 28 bp, Artificial Sequence
  Synthetic
cagtgctgaaugaagacaaagatgatut

SEQ ID NO: 93638 - DNA, 21 bp, Artificial Sequence
  Synthetic
ccctaactuggcgcatgacut

SEQ ID NO: 93639 - DNA, 28 bp, Artificial Sequence
  Synthetic
tgccttacctcucttcagagttauagag

SEQ ID NO: 93640 - DNA, 29 bp, Artificial Sequence
  Synthetic
ctgttttctugaaagtttagcttcugact

SEQ ID NO: 93641 - DNA, 25 bp, Artificial Sequence
  Synthetic
cgauggatgctguaaacaaagagaa

SEQ ID NO: 93642 - DNA, 22 bp, Artificial Sequence
  Synthetic
gtcttcuaggttcccuccccat

SEQ ID NO: 93643 - DNA, 25 bp, Artificial Sequence
  Synthetic
gaaggugagaaaaacagcaacacut

SEQ ID NO: 93644 - DNA, 26 bp, Artificial Sequence
  Synthetic
ttctgcttctaaautcaggcccttua

SEQ ID NO: 93645 - DNA, 28 bp, Artificial Sequence
  Synthetic
ggctttatcugaactgaagtcttguact

SEQ ID NO: 93646 - DNA, 19 bp, Artificial Sequence
  Synthetic
ccuacgggaucgagagacc

SEQ ID NO: 93647 - DNA, 19 bp, Artificial Sequence
  Synthetic
agtcccggugctctugaga

SEQ ID NO: 93648 - DNA, 28 bp, Artificial Sequence
  Synthetic
cgtgcttttgttucaaacttagcatcua

SEQ ID NO: 93649 - DNA, 23 bp, Artificial Sequence
  Synthetic
gcttttaagtcugtgttggcuga

SEQ ID NO: 93650 - DNA, 23 bp, Artificial Sequence
  Synthetic
cccagcuggcacttaacattuaa

SEQ ID NO: 93651 - DNA, 26 bp, Artificial Sequence
  Synthetic
gctgcagcucagagtttttaucaaac

SEQ ID NO: 93652 - DNA, 28 bp, Artificial Sequence
  Synthetic
tcacaacagaaaagauatgcuggagaat

SEQ ID NO: 93653 - DNA, 26 bp, Artificial Sequence
  Synthetic
actatcatgagugctgtcagtctgua

SEQ ID NO: 93654 - DNA, 19 bp, Artificial Sequence
  Synthetic
ggaatacggugtccccugt

SEQ ID NO: 93655 - DNA, 20 bp, Artificial Sequence
  Synthetic
gggtagugagcgttguacga

SEQ ID NO: 93656 - DNA, 24 bp, Artificial Sequence
  Synthetic
atgtttgctgugctgtttttcugt

SEQ ID NO: 93657 - DNA, 26 bp, Artificial Sequence
  Synthetic
ggaagatggaautgcaccaauaggaa

SEQ ID NO: 93658 - DNA, 24 bp, Artificial Sequence
  Synthetic
agtgtcatgucacaaactcugcat

SEQ ID NO: 93659 - DNA, 24 bp, Artificial Sequence
  Synthetic
tgactggauccactgaauggagaa

SEQ ID NO: 93660 - DNA, 21 bp, Artificial Sequence
  Synthetic
guaccaccaggcaauccaaag

SEQ ID NO: 93661 - DNA, 27 bp, Artificial Sequence
  Synthetic
attcaaaacugcggacatatatccugt

SEQ ID NO: 93662 - DNA, 22 bp, Artificial Sequence
  Synthetic
cacctucaccagctguacaagt

SEQ ID NO: 93663 - DNA, 24 bp, Artificial Sequence
  Synthetic
tuttacaagacugccacagacaca

SEQ ID NO: 93664 - DNA, 26 bp, Artificial Sequence
  Synthetic
aatgagaaaaccuggacagaactuca

SEQ ID NO: 93665 - DNA, 32 bp, Artificial Sequence
  Synthetic
aaaattttcaugcaactatagaugacagaaac

SEQ ID NO: 93666 - DNA, 21 bp, Artificial Sequence
  Synthetic
tcagtcaguccccaccactua

SEQ ID NO: 93667 - DNA, 22 bp, Artificial Sequence
  Synthetic
caacucggagtggttugagaac

SEQ ID NO: 93668 - DNA, 21 bp, Artificial Sequence
  Synthetic
acagcggugacagagagagua

SEQ ID NO: 93669 - DNA, 22 bp, Artificial Sequence
  Synthetic
gctgtcugaccaatgcctgtut

SEQ ID NO: 93670 - DNA, 28 bp, Artificial Sequence
  Synthetic
tgaaaattcctaggaugccatcttctut

SEQ ID NO: 93671 - DNA, 28 bp, Artificial Sequence
  Synthetic
cttatccactucaggttttagggcttua

SEQ ID NO: 93672 - DNA, 17 bp, Artificial Sequence
  Synthetic
cgacucagacggugcct

SEQ ID NO: 93673 - DNA, 25 bp, Artificial Sequence
  Synthetic
actccagugcatttctatcguaacc

SEQ ID NO: 93674 - DNA, 28 bp, Artificial Sequence
  Synthetic
gcaatgaacaagacutaggaatccagua

SEQ ID NO: 93675 - DNA, 29 bp, Artificial Sequence
  Synthetic
ggtacttucagaaaacacacagaaugagt

SEQ ID NO: 93676 - DNA, 28 bp, Artificial Sequence
  Synthetic
gatgtagutttgttgttttuccaagcct

SEQ ID NO: 93677 - DNA, 27 bp, Artificial Sequence
  Synthetic
cagtcttctcuttccattcttcuccaa

SEQ ID NO: 93678 - DNA, 29 bp, Artificial Sequence
  Synthetic
agctttaggatccutttccactgtattug

SEQ ID NO: 93679 - DNA, 26 bp, Artificial Sequence
  Synthetic
tctattgttggcutagctgcatguaa

SEQ ID NO: 93680 - DNA, 21 bp, Artificial Sequence
  Synthetic
cgtcctgggautgcagatugg

SEQ ID NO: 93681 - DNA, 22 bp, Artificial Sequence
  Synthetic
tcacgttcucaaagcaguggat

SEQ ID NO: 93682 - DNA, 18 bp, Artificial Sequence
  Synthetic
gucggagcggaggaagug

SEQ ID NO: 93683 - DNA, 17 bp, Artificial Sequence
  Synthetic
cccaggcutggcaggug

SEQ ID NO: 93684 - DNA, 21 bp, Artificial Sequence
  Synthetic
gacagttuccagccuccaaca

SEQ ID NO: 93685 - DNA, 26 bp, Artificial Sequence
  Synthetic
tccagatatugcagatgaagaauccc

SEQ ID NO: 93686 - DNA, 27 bp, Artificial Sequence
  Synthetic
gcaataccatuggttgttttcauccat

SEQ ID NO: 93687 - DNA, 19 bp, Artificial Sequence
  Synthetic
tttcagguggtgugcggaa

SEQ ID NO: 93688 - DNA, 21 bp, Artificial Sequence
  Synthetic
tcacctggugtatcggcttug

SEQ ID NO: 93689 - DNA, 22 bp, Artificial Sequence
  Synthetic
cctgttcugggcatcagatgua

SEQ ID NO: 93690 - DNA, 22 bp, Artificial Sequence
  Synthetic
ggcgctttuaaaacaccgauct

SEQ ID NO: 93691 - DNA, 17 bp, Artificial Sequence
  Synthetic
ccccggutctgctcuca

SEQ ID NO: 93692 - DNA, 22 bp, Artificial Sequence
  Synthetic
ccutgttcgtctaucccccaga

SEQ ID NO: 93693 - DNA, 23 bp, Artificial Sequence
  Synthetic
cttctgcaaccuctgcctttcua

SEQ ID NO: 93694 - DNA, 28 bp, Artificial Sequence
  Synthetic
cacaaatggcuataggctatcatuaggt

SEQ ID NO: 93695 - DNA, 25 bp, Artificial Sequence
  Synthetic
gcactttcauccagattacctguct

SEQ ID NO: 93696 - DNA, 20 bp, Artificial Sequence
  Synthetic
agaccagggacutgcguaga

SEQ ID NO: 93697 - DNA, 28 bp, Artificial Sequence
  Synthetic
tgtgaaaatccaucctttctctcaauaa

SEQ ID NO: 93698 - DNA, 21 bp, Artificial Sequence
  Synthetic
cctatuccccagccuacacct

SEQ ID NO: 93699 - DNA, 24 bp, Artificial Sequence
  Synthetic
tggacatttggguttctctgtgut

SEQ ID NO: 93700 - DNA, 23 bp, Artificial Sequence
  Synthetic
tcacucaacattucacccacaca

SEQ ID NO: 93701 - DNA, 21 bp, Artificial Sequence
  Synthetic
ctggacgaggugauacaccag

SEQ ID NO: 93702 - DNA, 26 bp, Artificial Sequence
  Synthetic
aaugcataugaggccaaacaaaaaca

SEQ ID NO: 93703 - DNA, 22 bp, Artificial Sequence
  Synthetic
cttagttcaucctcggcuccaa

SEQ ID NO: 93704 - DNA, 27 bp, Artificial Sequence
  Synthetic
tctacataccgugagttccagatttug

SEQ ID NO: 93705 - DNA, 23 bp, Artificial Sequence
  Synthetic
gtcagaagauggagctcagctut

SEQ ID NO: 93706 - DNA, 25 bp, Artificial Sequence
  Synthetic
gaaggauccaagaaacctgtgtuca

SEQ ID NO: 93707 - DNA, 28 bp, Artificial Sequence
  Synthetic
tgtgcttatcttcauctaggaagcttuc

SEQ ID NO: 93708 - DNA, 28 bp, Artificial Sequence
  Synthetic
tgagctccatctuctgacagattatcua

SEQ ID NO: 93709 - DNA, 25 bp, Artificial Sequence
  Synthetic
tctgcttcctugtcaaaaaccauga

SEQ ID NO: 93710 - DNA, 27 bp, Artificial Sequence
  Synthetic
tcttctctctcauacttacagctcugg

SEQ ID NO: 93711 - DNA, 21 bp, Artificial Sequence
  Synthetic
ttttccgguggtccactgtut

SEQ ID NO: 93712 - DNA, 20 bp, Artificial Sequence
  Synthetic
ccacccacuagaggacugct

SEQ ID NO: 93713 - DNA, 21 bp, Artificial Sequence
  Synthetic
agaccaagcacuaggcccuaa

SEQ ID NO: 93714 - DNA, 25 bp, Artificial Sequence
  Synthetic
tctgttttuacgagcactggaagut

SEQ ID NO: 93715 - DNA, 23 bp, Artificial Sequence
  Synthetic
gcaaccccaggcucaaaaataug

SEQ ID NO: 93716 - DNA, 27 bp, Artificial Sequence
  Synthetic
gaagctgtaagauggtagagcaaauga

SEQ ID NO: 93717 - DNA, 27 bp, Artificial Sequence
  Synthetic
ttaccaacagcaggauaacttatgucc

SEQ ID NO: 93718 - DNA, 26 bp, Artificial Sequence
  Synthetic
ctggagccaautcgaauaaaacaaga

SEQ ID NO: 93719 - DNA, 28 bp, Artificial Sequence
  Synthetic
cataggaatagcautgcaagcattcaua

SEQ ID NO: 93720 - DNA, 21 bp, Artificial Sequence
  Synthetic
gtgtguggctaggtguaggat

SEQ ID NO: 93721 - DNA, 29 bp, Artificial Sequence
  Synthetic
tttctaattatttcugtgtgggtgtguga

SEQ ID NO: 93722 - DNA, 25 bp, Artificial Sequence
  Synthetic
ctggaugataacactucccacagaa

SEQ ID NO: 93723 - DNA, 28 bp, Artificial Sequence
  Synthetic
aattgcagaataugtatagagtguggca

SEQ ID NO: 93724 - DNA, 22 bp, Artificial Sequence
  Synthetic
gtggtgccacugagaacuagac

SEQ ID NO: 93725 - DNA, 33 bp, Artificial Sequence
  Synthetic
aaaagcttaatgtauaatccacaaatgatucat

SEQ ID NO: 93726 - DNA, 19 bp, Artificial Sequence
  Synthetic
gggagcucaccctcatcuc

SEQ ID NO: 93727 - DNA, 28 bp, Artificial Sequence
  Synthetic
ctcaagaatugccaagaagatgctttua

SEQ ID NO: 93728 - DNA, 22 bp, Artificial Sequence
  Synthetic
ccatgctuccccaacactcaut

SEQ ID NO: 93729 - DNA, 21 bp, Artificial Sequence
  Synthetic
catgtgggagagguctctguc

SEQ ID NO: 93730 - DNA, 27 bp, Artificial Sequence
  Synthetic
tcatcatctgaagauccatcctcauca

SEQ ID NO: 93731 - DNA, 28 bp, Artificial Sequence
  Synthetic
tggtgtattucacccccagatatauagt

SEQ ID NO: 93732 - DNA, 29 bp, Artificial Sequence
  Synthetic
ttcaactaaacutctaagatguggcaaga

SEQ ID NO: 93733 - DNA, 25 bp, Artificial Sequence
  Synthetic
tctuaaaagctgtgugcaaaagcaa

SEQ ID NO: 93734 - DNA, 19 bp, Artificial Sequence
  Synthetic
cccactguccccattugct

SEQ ID NO: 93735 - DNA, 18 bp, Artificial Sequence
  Synthetic
ctcuggccccaggagtuc

SEQ ID NO: 93736 - DNA, 20 bp, Artificial Sequence
  Synthetic
agcttgatcugggcgaucac

SEQ ID NO: 93737 - DNA, 20 bp, Artificial Sequence
  Synthetic
ggaaggccuggatgggagua

SEQ ID NO: 93738 - DNA, 27 bp, Artificial Sequence
  Synthetic
caatcttaataccagugtgtctcgcut

SEQ ID NO: 93739 - DNA, 26 bp, Artificial Sequence
  Synthetic
ggatgaguatgtccguaacacaacag

SEQ ID NO: 93740 - DNA, 21 bp, Artificial Sequence
  Synthetic
gcctgggacucccagaacuaa

SEQ ID NO: 93741 - DNA, 22 bp, Artificial Sequence
  Synthetic
cgtctggugagtggactttgug

SEQ ID NO: 93742 - DNA, 24 bp, Artificial Sequence
  Synthetic
aaaagcaaatucagaagcaugcca

SEQ ID NO: 93743 - DNA, 20 bp, Artificial Sequence
  Synthetic
cccagagcgucttgatccut

SEQ ID NO: 93744 - DNA, 20 bp, Artificial Sequence
  Synthetic
tcagggaagaggutgugggt

SEQ ID NO: 93745 - DNA, 25 bp, Artificial Sequence
  Synthetic
tgattctgcccucttctctttucag

SEQ ID NO: 93746 - DNA, 25 bp, Artificial Sequence
  Synthetic
agtgggaaagaautaccatcugcaa

SEQ ID NO: 93747 - DNA, 22 bp, Artificial Sequence
  Synthetic
gauccatttgcugagcacagac

SEQ ID NO: 93748 - DNA, 23 bp, Artificial Sequence
  Synthetic
aggcuacaacagcaaaagctcua

SEQ ID NO: 93749 - DNA, 26 bp, Artificial Sequence
  Synthetic
accaactcatgacugtcctttcttug

SEQ ID NO: 93750 - DNA, 20 bp, Artificial Sequence
  Synthetic
cccggtcugcaatcttugga

SEQ ID NO: 93751 - DNA, 29 bp, Artificial Sequence
  Synthetic
acatttgtgctttauggtgttctgattut

SEQ ID NO: 93752 - DNA, 25 bp, Artificial Sequence
  Synthetic
tgtacaacatgugttcaccagugat

SEQ ID NO: 93753 - DNA, 25 bp, Artificial Sequence
  Synthetic
tggaacttgggugttcaatgagtut

SEQ ID NO: 93754 - DNA, 20 bp, Artificial Sequence
  Synthetic
gcatcgcccauttgccatuc

SEQ ID NO: 93755 - DNA, 25 bp, Artificial Sequence
  Synthetic
ggtaaggcacacutttgtcagtuac

SEQ ID NO: 93756 - DNA, 28 bp, Artificial Sequence
  Synthetic
gcatattccauaaaacacagcaucaaca

SEQ ID NO: 93757 - DNA, 27 bp, Artificial Sequence
  Synthetic
gtatgcgaactguaaaaagggaaacut

SEQ ID NO: 93758 - DNA, 21 bp, Artificial Sequence
  Synthetic
cctcccgtuggcaactctuaa

SEQ ID NO: 93759 - DNA, 22 bp, Artificial Sequence
  Synthetic
gcacacctugcattggtauggt

SEQ ID NO: 93760 - DNA, 23 bp, Artificial Sequence
  Synthetic
ggtacaacaaucttccccgcuaa

SEQ ID NO: 93761 - DNA, 20 bp, Artificial Sequence
  Synthetic
cagaagccccuagctccuct

SEQ ID NO: 93762 - DNA, 24 bp, Artificial Sequence
  Synthetic
ggcucacccaaccagatatuaact

SEQ ID NO: 93763 - DNA, 28 bp, Artificial Sequence
  Synthetic
aatggaattgcauctaatgtacaccuga

SEQ ID NO: 93764 - DNA, 20 bp, Artificial Sequence
  Synthetic
ctgatgcacuagctgcggua

SEQ ID NO: 93765 - DNA, 26 bp, Artificial Sequence
  Synthetic
acactcguaaccacacugaaaaagaa

SEQ ID NO: 93766 - DNA, 23 bp, Artificial Sequence
  Synthetic
cccagctctguttccctcttcua

SEQ ID NO: 93767 - DNA, 27 bp, Artificial Sequence
  Synthetic
gacctagauatgctgtttucccaaaag

SEQ ID NO: 93768 - DNA, 23 bp, Artificial Sequence
  Synthetic
cttgacggtguctttctctgtuc

SEQ ID NO: 93769 - DNA, 22 bp, Artificial Sequence
  Synthetic
gtaagtguggaggtgggttucc

SEQ ID NO: 93770 - DNA, 21 bp, Artificial Sequence
  Synthetic
ccgaactacugcttcctcugg

SEQ ID NO: 93771 - DNA, 20 bp, Artificial Sequence
  Synthetic
accgcuaacagcatcaucgt

SEQ ID NO: 93772 - DNA, 28 bp, Artificial Sequence
  Synthetic
tuctcaccttgaauaaagaagggaacag

SEQ ID NO: 93773 - DNA, 20 bp, Artificial Sequence
  Synthetic
caucaaggcagccccacuaa

SEQ ID NO: 93774 - DNA, 23 bp, Artificial Sequence
  Synthetic
tgtttccaaggutgcatguacaa

SEQ ID NO: 93775 - DNA, 27 bp, Artificial Sequence
  Synthetic
tttagcatgugcaatgaattcucacag

SEQ ID NO: 93776 - DNA, 23 bp, Artificial Sequence
  Synthetic
atgtatggugtgtacttgugcaa

SEQ ID NO: 93777 - DNA, 27 bp, Artificial Sequence
  Synthetic
acaaacttgaugacttagttcguccat

SEQ ID NO: 93778 - DNA, 25 bp, Artificial Sequence
  Synthetic
gctgcttcaucttcgtcatcaucat

SEQ ID NO: 93779 - DNA, 22 bp, Artificial Sequence
  Synthetic
aatgtgtgaggugaagggaugg

SEQ ID NO: 93780 - DNA, 24 bp, Artificial Sequence
  Synthetic
tcacgtacagcaaugaacactuca

SEQ ID NO: 93781 - DNA, 20 bp, Artificial Sequence
  Synthetic
ctgtggaggccucaaaggut

SEQ ID NO: 93782 - DNA, 23 bp, Artificial Sequence
  Synthetic
tccactgcauacaggaactccua

SEQ ID NO: 93783 - DNA, 28 bp, Artificial Sequence
  Synthetic
accttcacacauatattgctcttuccaa

SEQ ID NO: 93784 - DNA, 20 bp, Artificial Sequence
  Synthetic
aggataggguccacgcugat

SEQ ID NO: 93785 - DNA, 18 bp, Artificial Sequence
  Synthetic
ccgcagugcctcauccag

SEQ ID NO: 93786 - DNA, 27 bp, Artificial Sequence
  Synthetic
ggagaacaaaccutatgcacataugga

SEQ ID NO: 93787 - DNA, 27 bp, Artificial Sequence
  Synthetic
ggagctggtccuttgtttaatcagaut

SEQ ID NO: 93788 - DNA, 20 bp, Artificial Sequence
  Synthetic
ggagcgtcuggaaagcauca

SEQ ID NO: 93789 - DNA, 29 bp, Artificial Sequence
  Synthetic
cttacttcaaagaaaagcugtcaaacuca

SEQ ID NO: 93790 - DNA, 21 bp, Artificial Sequence
  Synthetic
gcgacuccattcuggagagaa

SEQ ID NO: 93791 - DNA, 22 bp, Artificial Sequence
  Synthetic
caggtgaaccutgaggcuacag

SEQ ID NO: 93792 - DNA, 22 bp, Artificial Sequence
  Synthetic
cgtggagguaaagtgccugaat

SEQ ID NO: 93793 - DNA, 27 bp, Artificial Sequence
  Synthetic
ttttgcaggtuagactcttttcuccaa

SEQ ID NO: 93794 - DNA, 28 bp, Artificial Sequence
  Synthetic
tggaaagagcaauatatgtgtgaaggut

SEQ ID NO: 93795 - DNA, 24 bp, Artificial Sequence
  Synthetic
ttttcagguagcccaaaagugaca

SEQ ID NO: 93796 - DNA, 23 bp, Artificial Sequence
  Synthetic
tguaggagacaucagcagaggaa

SEQ ID NO: 93797 - DNA, 27 bp, Artificial Sequence
  Synthetic
aaagaaaccacaccuattactctgcuc

SEQ ID NO: 93798 - DNA, 28 bp, Artificial Sequence
  Synthetic
cactgaaataugcatcactggtuaaaaa

SEQ ID NO: 93799 - DNA, 26 bp, Artificial Sequence
  Synthetic
tggatgaaugaatttgagaaguggca

SEQ ID NO: 93800 - DNA, 27 bp, Artificial Sequence
  Synthetic
catcttttaatcccucttgccactuct

SEQ ID NO: 93801 - DNA, 28 bp, Artificial Sequence
  Synthetic
ggtgacaatcugttttcttatagguggt

SEQ ID NO: 93802 - DNA, 21 bp, Artificial Sequence
  Synthetic
gggagacagugcacauccaaa

SEQ ID NO: 93803 - DNA, 28 bp, Artificial Sequence
  Synthetic
ttctttgtcauggtttctttatgtugcc

SEQ ID NO: 93804 - DNA, 21 bp, Artificial Sequence
  Synthetic
gagccttacuctgttccccut

SEQ ID NO: 93805 - DNA, 23 bp, Artificial Sequence
  Synthetic
gctcctttucatgtcccugaaga

SEQ ID NO: 93806 - DNA, 28 bp, Artificial Sequence
  Synthetic
tgaaauccagtttgucacacaaaagaac

SEQ ID NO: 93807 - DNA, 26 bp, Artificial Sequence
  Synthetic
tggaaattcuggccgtttattgttua

SEQ ID NO: 93808 - DNA, 25 bp, Artificial Sequence
  Synthetic
ctttttgucccttcaacaucaacca

SEQ ID NO: 93809 - DNA, 28 bp, Artificial Sequence
  Synthetic
gatgccgttucgagaattttattcacut

SEQ ID NO: 93810 - DNA, 22 bp, Artificial Sequence
  Synthetic
tctggtugccagtgtugaagag

SEQ ID NO: 93811 - DNA, 28 bp, Artificial Sequence
  Synthetic
ccattaattaccacaaaucccagtgaut

SEQ ID NO: 93812 - DNA, 28 bp, Artificial Sequence
  Synthetic
actcaggtctttuagaaagcctagaugt

SEQ ID NO: 93813 - DNA, 25 bp, Artificial Sequence
  Synthetic
aatgucaatcagagtucacgaccat

SEQ ID NO: 93814 - DNA, 26 bp, Artificial Sequence
  Synthetic
atgactatccauccctccataguagg

SEQ ID NO: 93815 - DNA, 27 bp, Artificial Sequence
  Synthetic
acgaagagaagcaauctacaatgaugt

SEQ ID NO: 93816 - DNA, 29 bp, Artificial Sequence
  Synthetic
cagttgagttcugttaagtcattgatucc

SEQ ID NO: 93817 - DNA, 21 bp, Artificial Sequence
  Synthetic
gtaugcagccaccaccatuac

SEQ ID NO: 93818 - DNA, 28 bp, Artificial Sequence
  Synthetic
acgtcagaattcutaccatctgttgtut

SEQ ID NO: 93819 - DNA, 26 bp, Artificial Sequence
  Synthetic
agtggaaggagaacaugaatctcuca

SEQ ID NO: 93820 - DNA, 24 bp, Artificial Sequence
  Synthetic
gtgccacaagaacuacatccauct

SEQ ID NO: 93821 - DNA, 28 bp, Artificial Sequence
  Synthetic
actgatgtcaaacutctcgatttctuca

SEQ ID NO: 93822 - DNA, 26 bp, Artificial Sequence
  Synthetic
ctgtagcugagatttcacauccaact

SEQ ID NO: 93823 - DNA, 24 bp, Artificial Sequence
  Synthetic
aaaggccucgcagtggtaatauac

SEQ ID NO: 93824 - DNA, 27 bp, Artificial Sequence
  Synthetic
cattttgtcuagttcaggacugaggat

SEQ ID NO: 93825 - DNA, 29 bp, Artificial Sequence
  Synthetic
ccttactcttguagatattggtcctguca

SEQ ID NO: 93826 - DNA, 18 bp, Artificial Sequence
  Synthetic
ctctguaggccgacugct

SEQ ID NO: 93827 - DNA, 20 bp, Artificial Sequence
  Synthetic
tccaugggagacaggaugct

SEQ ID NO: 93828 - DNA, 18 bp, Artificial Sequence
  Synthetic
cgagctcucgacgtcucc

SEQ ID NO: 93829 - DNA, 18 bp, Artificial Sequence
  Synthetic
gcctgcggucgtagcaut

SEQ ID NO: 93830 - DNA, 22 bp, Artificial Sequence
  Synthetic
cagtacgucagtgccaucaaga

SEQ ID NO: 93831 - DNA, 18 bp, Artificial Sequence
  Synthetic
cctucccgaaggguccca

SEQ ID NO: 93832 - DNA, 23 bp, Artificial Sequence
  Synthetic
agacttcacugtcagcacucaag

SEQ ID NO: 93833 - DNA, 25 bp, Artificial Sequence
  Synthetic
ctgcccuagagagaggtaaacttug

SEQ ID NO: 93834 - DNA, 22 bp, Artificial Sequence
  Synthetic
gcaugaactcagauggagggaa

SEQ ID NO: 93835 - DNA, 24 bp, Artificial Sequence
  Synthetic
tctctgatccugtccgtcttguag

SEQ ID NO: 93836 - DNA, 26 bp, Artificial Sequence
  Synthetic
ctgtacagcauactaactggttugga

SEQ ID NO: 93837 - DNA, 22 bp, Artificial Sequence
  Synthetic
agaagatggugaatggcgucac

SEQ ID NO: 93838 - DNA, 17 bp, Artificial Sequence
  Synthetic
cattugccgccagugga

SEQ ID NO: 93839 - DNA, 19 bp, Artificial Sequence
  Synthetic
gtcucagggctcugcaact

SEQ ID NO: 93840 - DNA, 24 bp, Artificial Sequence
  Synthetic
cttggaagauctgacccgaaucaa

SEQ ID NO: 93841 - DNA, 23 bp, Artificial Sequence
  Synthetic
acacttucaggccagtttctuct

SEQ ID NO: 93842 - DNA, 20 bp, Artificial Sequence
  Synthetic
gcucccccagctctucagat

SEQ ID NO: 93843 - DNA, 21 bp, Artificial Sequence
  Synthetic
tctccctaugccatctugcac

SEQ ID NO: 93844 - DNA, 20 bp, Artificial Sequence
  Synthetic
cccaccugctggttguagag

SEQ ID NO: 93845 - DNA, 21 bp, Artificial Sequence
  Synthetic
gggaaucagcctcacagucat

SEQ ID NO: 93846 - DNA, 23 bp, Artificial Sequence
  Synthetic
ccctcttccucctcctcttgtua

SEQ ID NO: 93847 - DNA, 22 bp, Artificial Sequence
  Synthetic
gagcaggcauggtctcttcuac

SEQ ID NO: 93848 - DNA, 29 bp, Artificial Sequence
  Synthetic
acaggataccttcauattcttcagctcut

SEQ ID NO: 93849 - DNA, 25 bp, Artificial Sequence
  Synthetic
ggtgttcaguttatgtgggatugct

SEQ ID NO: 93850 - DNA, 18 bp, Artificial Sequence
  Synthetic
gagctgaugccggagguc

SEQ ID NO: 93851 - DNA, 20 bp, Artificial Sequence
  Synthetic
aggaagcccuggatccugaa

SEQ ID NO: 93852 - DNA, 22 bp, Artificial Sequence
  Synthetic
tucacagacucacagcagcaat

SEQ ID NO: 93853 - DNA, 33 bp, Artificial Sequence
  Synthetic
ttttaatgctgtttcutagaagttttggttaug

SEQ ID NO: 93854 - DNA, 21 bp, Artificial Sequence
  Synthetic
ggccguggucagaaaagagaa

SEQ ID NO: 93855 - DNA, 22 bp, Artificial Sequence
  Synthetic
aggtaccagagguagtgggtug

SEQ ID NO: 93856 - DNA, 17 bp, Artificial Sequence
  Synthetic
ggucccggcugacaagt

SEQ ID NO: 93857 - DNA, 25 bp, Artificial Sequence
  Synthetic
gaatccgccuaaagtagtgactcug

SEQ ID NO: 93858 - DNA, 23 bp, Artificial Sequence
  Synthetic
ttcactgcugcattccctuacat

SEQ ID NO: 93859 - DNA, 25 bp, Artificial Sequence
  Synthetic
ccctgagguagtttctttucgagaa

SEQ ID NO: 93860 - DNA, 21 bp, Artificial Sequence
  Synthetic
gggaaggagcuggatctucac

SEQ ID NO: 93861 - DNA, 22 bp, Artificial Sequence
  Synthetic
gggucaaaggagacttttugga

SEQ ID NO: 93862 - DNA, 23 bp, Artificial Sequence
  Synthetic
gaguaagtagcacugcacagcat

SEQ ID NO: 93863 - DNA, 21 bp, Artificial Sequence
  Synthetic
agcactcgcuatgccaauagg

SEQ ID NO: 93864 - DNA, 29 bp, Artificial Sequence
  Synthetic
acaattatgtccaaugagacagttcuacc

SEQ ID NO: 93865 - DNA, 24 bp, Artificial Sequence
  Synthetic
ggaugaaacaccagctagucagat

SEQ ID NO: 93866 - DNA, 21 bp, Artificial Sequence
  Synthetic
cttggcugcccttuagacaga

SEQ ID NO: 93867 - DNA, 28 bp, Artificial Sequence
  Synthetic
ggtaagctacaucgtgcattaaaactut

SEQ ID NO: 93868 - DNA, 21 bp, Artificial Sequence
  Synthetic
ttgugccaggaccagaaaugt

SEQ ID NO: 93869 - DNA, 21 bp, Artificial Sequence
  Synthetic
tcuttctuggcaccaacaggt

SEQ ID NO: 93870 - DNA, 22 bp, Artificial Sequence
  Synthetic
tgtgccaautggtgtcttucca

SEQ ID NO: 93871 - DNA, 26 bp, Artificial Sequence
  Synthetic
agattctattggugaaacaccgacuc

SEQ ID NO: 93872 - DNA, 26 bp, Artificial Sequence
  Synthetic
catcccaccgugattttcttttacug

SEQ ID NO: 93873 - DNA, 27 bp, Artificial Sequence
  Synthetic
tctttttaaagauactcctgggcaugg

SEQ ID NO: 93874 - DNA, 21 bp, Artificial Sequence
  Synthetic
gagacgccuccatugaaggaa

SEQ ID NO: 93875 - DNA, 20 bp, Artificial Sequence
  Synthetic
aagcttugcccctggauacc

SEQ ID NO: 93876 - DNA, 27 bp, Artificial Sequence
  Synthetic
tgtttaccuggaaatgaccaucaaagt

SEQ ID NO: 93877 - DNA, 25 bp, Artificial Sequence
  Synthetic
aaatgcatgacaugctccaattgut

SEQ ID NO: 93878 - DNA, 22 bp, Artificial Sequence
  Synthetic
ggaggcaagcutggttatguca

SEQ ID NO: 93879 - DNA, 21 bp, Artificial Sequence
  Synthetic
atgttcugggctcugaacgag

SEQ ID NO: 93880 - DNA, 31 bp, Artificial Sequence
  Synthetic
ttautcaaatgcaaaacugaaaaagaacaac

SEQ ID NO: 93881 - DNA, 28 bp, Artificial Sequence
  Synthetic
tcagtgcaagcuctatcagtactactua

SEQ ID NO: 93882 - DNA, 27 bp, Artificial Sequence
  Synthetic
tcattctcacagcuaacacatatucgt

SEQ ID NO: 93883 - DNA, 28 bp, Artificial Sequence
  Synthetic
aagcaatgagaacutgtagttcatucct

SEQ ID NO: 93884 - DNA, 27 bp, Artificial Sequence
  Synthetic
acatcacactugcaaaagaagtatgua

SEQ ID NO: 93885 - DNA, 28 bp, Artificial Sequence
  Synthetic
cactacuaggccaacaaaauagaaaaca

SEQ ID NO: 93886 - DNA, 21 bp, Artificial Sequence
  Synthetic
aggaagtggcuggactctcua

SEQ ID NO: 93887 - DNA, 28 bp, Artificial Sequence
  Synthetic
gctccattgttutactgtgcattttuac

SEQ ID NO: 93888 - DNA, 27 bp, Artificial Sequence
  Synthetic
gttacagcugttccagaauaacagagt

SEQ ID NO: 93889 - DNA, 23 bp, Artificial Sequence
  Synthetic
catccttatcucccttgctugga

SEQ ID NO: 93890 - DNA, 21 bp, Artificial Sequence
  Synthetic
agagccaccuccauccaaaac

SEQ ID NO: 93891 - DNA, 19 bp, Artificial Sequence
  Synthetic
gccccatuctggcacugac

SEQ ID NO: 93892 - DNA, 18 bp, Artificial Sequence
  Synthetic
gtuccccaggcucagaca

SEQ ID NO: 93893 - DNA, 20 bp, Artificial Sequence
  Synthetic
cugaaaagcccccugaggag

SEQ ID NO: 93894 - DNA, 21 bp, Artificial Sequence
  Synthetic
ggaaatguccgtcuccacaga

SEQ ID NO: 93895 - DNA, 24 bp, Artificial Sequence
  Synthetic
ccaucgttactgucagaagaaccc

SEQ ID NO: 93896 - DNA, 18 bp, Artificial Sequence
  Synthetic
tcaggugcagggcatugg

SEQ ID NO: 93897 - DNA, 20 bp, Artificial Sequence
  Synthetic
ccccaaccugaggaaucaca

SEQ ID NO: 93898 - DNA, 22 bp, Artificial Sequence
  Synthetic
gacaggtgugattcctcaggut

SEQ ID NO: 93899 - DNA, 19 bp, Artificial Sequence
  Synthetic
gcugagggaccacatcugt

SEQ ID NO: 93900 - DNA, 22 bp, Artificial Sequence
  Synthetic
tctcctcaauggagcacaggua

SEQ ID NO: 93901 - DNA, 21 bp, Artificial Sequence
  Synthetic
caattggucagctgctuccac

SEQ ID NO: 93902 - DNA, 20 bp, Artificial Sequence
  Synthetic
caggugcaattccucaggct

SEQ ID NO: 93903 - DNA, 21 bp, Artificial Sequence
  Synthetic
ccugaggagccacacctauct

SEQ ID NO: 93904 - DNA, 25 bp, Artificial Sequence
  Synthetic
ggagaatgtucccttgacataccug

SEQ ID NO: 93905 - DNA, 23 bp, Artificial Sequence
  Synthetic
acgaugaggagagtgaugaggaa

SEQ ID NO: 93906 - DNA, 21 bp, Artificial Sequence
  Synthetic
ttccacaacccagaugctgut

SEQ ID NO: 93907 - DNA, 22 bp, Artificial Sequence
  Synthetic
ctgaactucccagtcttccuca

SEQ ID NO: 93908 - DNA, 21 bp, Artificial Sequence
  Synthetic
acatacctgcugctgcttcut

SEQ ID NO: 93909 - DNA, 22 bp, Artificial Sequence
  Synthetic
cugagacagaugacgaagacga

SEQ ID NO: 93910 - DNA, 22 bp, Artificial Sequence
  Synthetic
gggtaatcccaauccctctucc

SEQ ID NO: 93911 - DNA, 22 bp, Artificial Sequence
  Synthetic
acccttuagcagcctctcucat

SEQ ID NO: 93912 - DNA, 28 bp, Artificial Sequence
  Synthetic
tggcgtagtguaaagggaaataauaagg

SEQ ID NO: 93913 - DNA, 23 bp, Artificial Sequence
  Synthetic
agtgagcagguatccagatcugt

SEQ ID NO: 93914 - DNA, 24 bp, Artificial Sequence
  Synthetic
gacagaggagacucttcaaauggt

SEQ ID NO: 93915 - DNA, 20 bp, Artificial Sequence
  Synthetic
caccugaggaatugcccact

SEQ ID NO: 93916 - DNA, 21 bp, Artificial Sequence
  Synthetic
gtggagacaugggtgactcut

SEQ ID NO: 93917 - DNA, 24 bp, Artificial Sequence
  Synthetic
ctgtccccaccauttgaagaauct

SEQ ID NO: 93918 - DNA, 17 bp, Artificial Sequence
  Synthetic
ggcagcaguggcatcuc

SEQ ID NO: 93919 - DNA, 18 bp, Artificial Sequence
  Synthetic
tgugcatugccccagacc

SEQ ID NO: 93920 - DNA, 21 bp, Artificial Sequence
  Synthetic
gggaagugggcaattccucag

SEQ ID NO: 93921 - DNA, 19 bp, Artificial Sequence
  Synthetic
ccutgtcuccaccggaaga

SEQ ID NO: 93922 - DNA, 22 bp, Artificial Sequence
  Synthetic
gaatggaaugcttgcatcugct

SEQ ID NO: 93923 - DNA, 22 bp, Artificial Sequence
  Synthetic
ttgcagtctucaggagggtcua

SEQ ID NO: 93924 - DNA, 20 bp, Artificial Sequence
  Synthetic
gggauagaggcgtcucaagt

SEQ ID NO: 93925 - DNA, 18 bp, Artificial Sequence
  Synthetic
ggaaucgcccctctcucc

SEQ ID NO: 93926 - DNA, 26 bp, Artificial Sequence
  Synthetic
gttctccattgcuttcagcatctaug

SEQ ID NO: 93927 - DNA, 21 bp, Artificial Sequence
  Synthetic
aagagccccaugtcctcacua

SEQ ID NO: 93928 - DNA, 23 bp, Artificial Sequence
  Synthetic
ttcctcatcacuctcctcaucgt

SEQ ID NO: 93929 - DNA, 25 bp, Artificial Sequence
  Synthetic
ggcaagggatuccttagagaaacut

SEQ ID NO: 93930 - DNA, 26 bp, Artificial Sequence
  Synthetic
ccagtggagaaaaaggugatgatuca

SEQ ID NO: 93931 - DNA, 18 bp, Artificial Sequence
  Synthetic
aggaatugcccgcauccc

SEQ ID NO: 93932 - DNA, 21 bp, Artificial Sequence
  Synthetic
gaggctccuccttgaccaaug

SEQ ID NO: 93933 - DNA, 28 bp, Artificial Sequence
  Synthetic
gcagactttgaugtgtgtgtttatgtut

SEQ ID NO: 93934 - DNA, 20 bp, Artificial Sequence
  Synthetic
ggtgcaaugccucaggaagt

SEQ ID NO: 93935 - DNA, 20 bp, Artificial Sequence
  Synthetic
ccccuaaacgaggagaugcc

SEQ ID NO: 93936 - DNA, 20 bp, Artificial Sequence
  Synthetic
gcaccucatcacgcugaaca

SEQ ID NO: 93937 - DNA, 28 bp, Artificial Sequence
  Synthetic
atttcgatgcaccaacauttatcactuc

SEQ ID NO: 93938 - DNA, 26 bp, Artificial Sequence
  Synthetic
tccaggttcttutcattggagatcug

SEQ ID NO: 93939 - DNA, 26 bp, Artificial Sequence
  Synthetic
cctagtgtccuctcagcagtatttut

SEQ ID NO: 93940 - DNA, 21 bp, Artificial Sequence
  Synthetic
cccaguggcauaagacacaag

SEQ ID NO: 93941 - DNA, 25 bp, Artificial Sequence
  Synthetic
cacttatcttcugtgctttggugga

SEQ ID NO: 93942 - DNA, 24 bp, Artificial Sequence
  Synthetic
agaaagccuccttcctcatucaac

SEQ ID NO: 93943 - DNA, 24 bp, Artificial Sequence
  Synthetic
ctctgaggugactacgtgaaugac

SEQ ID NO: 93944 - DNA, 25 bp, Artificial Sequence
  Synthetic
ttcctgatgcaaaagucccaaagua

SEQ ID NO: 93945 - DNA, 29 bp, Artificial Sequence
  Synthetic
atctctagactttuaggatcccactugaa

SEQ ID NO: 93946 - DNA, 23 bp, Artificial Sequence
  Synthetic
tgaatgtatgguttcccccucct

SEQ ID NO: 93947 - DNA, 28 bp, Artificial Sequence
  Synthetic
catgttgaacacuggcaaaagaaatcua

SEQ ID NO: 93948 - DNA, 22 bp, Artificial Sequence
  Synthetic
autgtgctttaauggcgcaagt

SEQ ID NO: 93949 - DNA, 21 bp, Artificial Sequence
  Synthetic
tgguccacggaggtctaugag

SEQ ID NO: 93950 - DNA, 18 bp, Artificial Sequence
  Synthetic
ccucaggcacagcgcaua

SEQ ID NO: 93951 - DNA, 18 bp, Artificial Sequence
  Synthetic
tgaggagccgcaacucug

SEQ ID NO: 93952 - DNA, 23 bp, Artificial Sequence
  Synthetic
ctgtccaugcaggcaacauaaac

SEQ ID NO: 93953 - DNA, 27 bp, Artificial Sequence
  Synthetic
gcctgtgcuatagaaccatgtuacaat

SEQ ID NO: 93954 - DNA, 19 bp, Artificial Sequence
  Synthetic
agccugcggagataggugt

SEQ ID NO: 93955 - DNA, 18 bp, Artificial Sequence
  Synthetic
accggaggacucgcucat

SEQ ID NO: 93956 - DNA, 19 bp, Artificial Sequence
  Synthetic
cgcacagcuggtgcaatuc

SEQ ID NO: 93957 - DNA, 22 bp, Artificial Sequence
  Synthetic
gagcacuggaaagggagagtuc

SEQ ID NO: 93958 - DNA, 18 bp, Artificial Sequence
  Synthetic
gggaagcaggugagucct

SEQ ID NO: 93959 - DNA, 17 bp, Artificial Sequence
  Synthetic
ccctgccugtggtguca

SEQ ID NO: 93960 - DNA, 18 bp, Artificial Sequence
  Synthetic
gggauaggcgcgauacct

SEQ ID NO: 93961 - DNA, 20 bp, Artificial Sequence
  Synthetic
cacctgaggaguctccccut

SEQ ID NO: 93962 - DNA, 20 bp, Artificial Sequence
  Synthetic
acauaggcgagtccucaggt

SEQ ID NO: 93963 - DNA, 20 bp, Artificial Sequence
  Synthetic
cggaggcauctcgtctgtuc

SEQ ID NO: 93964 - DNA, 24 bp, Artificial Sequence
  Synthetic
aaaatgccatguttggtcgttugt

SEQ ID NO: 93965 - DNA, 28 bp, Artificial Sequence
  Synthetic
aaatgatattacuatgcagagctugcca

SEQ ID NO: 93966 - DNA, 28 bp, Artificial Sequence
  Synthetic
agtaaaatttcctuagtccacgttggut

SEQ ID NO: 93967 - DNA, 27 bp, Artificial Sequence
  Synthetic
gtggagcgucattttactatgaaugag

SEQ ID NO: 93968 - DNA, 24 bp, Artificial Sequence
  Synthetic
caagtggucacactgaaucaggaa

SEQ ID NO: 93969 - DNA, 22 bp, Artificial Sequence
  Synthetic
cctguggcatgtgugagaaaaa

SEQ ID NO: 93970 - DNA, 22 bp, Artificial Sequence
  Synthetic
tggatccaauagttgcccucct

SEQ ID NO: 93971 - DNA, 28 bp, Artificial Sequence
  Synthetic
tggagaagtgaugccatttattgaugaa

SEQ ID NO: 93972 - DNA, 26 bp, Artificial Sequence
  Synthetic
agaacacgtcutgttaaatcccauga

SEQ ID NO: 93973 - DNA, 21 bp, Artificial Sequence
  Synthetic
gggtacaugattggugcacaa

SEQ ID NO: 93974 - DNA, 28 bp, Artificial Sequence
  Synthetic
agacgcatctucatttacagtttcauca

SEQ ID NO: 93975 - DNA, 27 bp, Artificial Sequence
  Synthetic
gggtattgutccagttgucagaaacat

SEQ ID NO: 93976 - DNA, 23 bp, Artificial Sequence
  Synthetic
tgagcataugggtcagtguagga

SEQ ID NO: 93977 - DNA, 21 bp, Artificial Sequence
  Synthetic
cauctcagguagagccccaga

SEQ ID NO: 93978 - DNA, 28 bp, Artificial Sequence
  Synthetic
ggtcatctaauaagtctggcucaaaagt

SEQ ID NO: 93979 - DNA, 28 bp, Artificial Sequence
  Synthetic
tcttttuacaaagggaaccauggaagat

SEQ ID NO: 93980 - DNA, 28 bp, Artificial Sequence
  Synthetic
tgcttagttactugccgatcataaauct

SEQ ID NO: 93981 - DNA, 33 bp, Artificial Sequence
  Synthetic
accataaagtttuaccatttcatatuaaccagt

SEQ ID NO: 93982 - DNA, 28 bp, Artificial Sequence
  Synthetic
tcaagtgttctugtactgtttgatcugt

SEQ ID NO: 93983 - DNA, 26 bp, Artificial Sequence
  Synthetic
ttgtgtgtggutttccttatuagggt

SEQ ID NO: 93984 - DNA, 29 bp, Artificial Sequence
  Synthetic
ttgaggctgaagaucacaaataatagugt

SEQ ID NO: 93985 - DNA, 27 bp, Artificial Sequence
  Synthetic
ccaggatatggcutgtgatacttucat

SEQ ID NO: 93986 - DNA, 22 bp, Artificial Sequence
  Synthetic
cctgaaccugaacgaaaugcct

SEQ ID NO: 93987 - DNA, 23 bp, Artificial Sequence
  Synthetic
ccaugatggaguccaggacaaaa

SEQ ID NO: 93988 - DNA, 21 bp, Artificial Sequence
  Synthetic
tuggaggagaaggugccaaag

SEQ ID NO: 93989 - DNA, 20 bp, Artificial Sequence
  Synthetic
ctggguggcctggagtuaaa

SEQ ID NO: 93990 - DNA, 21 bp, Artificial Sequence
  Synthetic
gggcttugaagacatcaggug

SEQ ID NO: 93991 - DNA, 25 bp, Artificial Sequence
  Synthetic
cctagaggugaagaaggaagagcut

SEQ ID NO: 93992 - DNA, 28 bp, Artificial Sequence
  Synthetic
caatattgcaacautctacatgguccaa

SEQ ID NO: 93993 - DNA, 25 bp, Artificial Sequence
  Synthetic
gatttggttgugaagattcgcugaa

SEQ ID NO: 93994 - DNA, 23 bp, Artificial Sequence
  Synthetic
gggaaaagcuggagcattucaga

SEQ ID NO: 93995 - DNA, 28 bp, Artificial Sequence
  Synthetic
cttgtgagtggutattcttcatttugct

SEQ ID NO: 93996 - DNA, 22 bp, Artificial Sequence
  Synthetic
tgagucaacaaagcccaggtut

SEQ ID NO: 93997 - DNA, 22 bp, Artificial Sequence
  Synthetic
gataactuggctgtgccugaga

SEQ ID NO: 93998 - DNA, 19 bp, Artificial Sequence
  Synthetic
tuccgggacuccccaaaag

SEQ ID NO: 93999 - DNA, 18 bp, Artificial Sequence
  Synthetic
acacuaccccaccuggca

SEQ ID NO: 94000 - DNA, 28 bp, Artificial Sequence
  Synthetic
tttcaagaatuaaggctatccugcagaa

SEQ ID NO: 94001 - DNA, 28 bp, Artificial Sequence
  Synthetic
gggacatauaacagctgaaataccucaa

SEQ ID NO: 94002 - DNA, 18 bp, Artificial Sequence
  Synthetic
tgtggagggcuggtguct

SEQ ID NO: 94003 - DNA, 17 bp, Artificial Sequence
  Synthetic
gcaccgcccaccuaucc

SEQ ID NO: 94004 - DNA, 21 bp, Artificial Sequence
  Synthetic
ccccguaggactaggauaggg

SEQ ID NO: 94005 - DNA, 21 bp, Artificial Sequence
  Synthetic
cctggugagctcttccucaag

SEQ ID NO: 94006 - DNA, 22 bp, Artificial Sequence
  Synthetic
cccacauccagagtagcacaua

SEQ ID NO: 94007 - DNA, 21 bp, Artificial Sequence
  Synthetic
catccccugagagcatctugg

SEQ ID NO: 94008 - DNA, 28 bp, Artificial Sequence
  Synthetic
caatgtgcatucaaaaacagcaucaaat

SEQ ID NO: 94009 - DNA, 21 bp, Artificial Sequence
  Synthetic
cccctctgutggatgcagtuc

SEQ ID NO: 94010 - DNA, 22 bp, Artificial Sequence
  Synthetic
aacatcagcuctggaucagcaa

SEQ ID NO: 94011 - DNA, 22 bp, Artificial Sequence
  Synthetic
gatctgguggcagagcagttua

SEQ ID NO: 94012 - DNA, 25 bp, Artificial Sequence
  Synthetic
gggccatacauagttcaacaaguga

SEQ ID NO: 94013 - DNA, 24 bp, Artificial Sequence
  Synthetic
tttttcccutccgttguagagacc

SEQ ID NO: 94014 - DNA, 23 bp, Artificial Sequence
  Synthetic
actgccttatguttttccccgut

SEQ ID NO: 94015 - DNA, 23 bp, Artificial Sequence
  Synthetic
ctatcccaugggcagtcactuac

SEQ ID NO: 94016 - DNA, 19 bp, Artificial Sequence
  Synthetic
gccaugtuagcggccaaga

SEQ ID NO: 94017 - DNA, 18 bp, Artificial Sequence
  Synthetic
gcggaggcacutacggut

SEQ ID NO: 94018 - DNA, 21 bp, Artificial Sequence
  Synthetic
gaagcccucuagaacaaccca

SEQ ID NO: 94019 - DNA, 22 bp, Artificial Sequence
  Synthetic
ctcctgctgcugcttcaagaua

SEQ ID NO: 94020 - DNA, 28 bp, Artificial Sequence
  Synthetic
gctgggacattuctctgataatcaauga

SEQ ID NO: 94021 - DNA, 28 bp, Artificial Sequence
  Synthetic
tgctacatcucatagacaggaauaacct

SEQ ID NO: 94022 - DNA, 22 bp, Artificial Sequence
  Synthetic
gggtggaggguacaaatuggag

SEQ ID NO: 94023 - DNA, 28 bp, Artificial Sequence
  Synthetic
tcaaggaagagaaaaagutguagaagca

SEQ ID NO: 94024 - DNA, 21 bp, Artificial Sequence
  Synthetic
cugagcccagaugagggaaac

SEQ ID NO: 94025 - DNA, 20 bp, Artificial Sequence
  Synthetic
tgcagggcuguagcaacaaa

SEQ ID NO: 94026 - DNA, 22 bp, Artificial Sequence
  Synthetic
ctagccguctgtctgtguacaa

SEQ ID NO: 94027 - DNA, 29 bp, Artificial Sequence
  Synthetic
ccggtgaatauttcctgtaaaacuaagac

SEQ ID NO: 94028 - DNA, 20 bp, Artificial Sequence
  Synthetic
gctcaccgcauccatcagug

SEQ ID NO: 94029 - DNA, 24 bp, Artificial Sequence
  Synthetic
cagttccaucattacagcctucct

SEQ ID NO: 94030 - DNA, 22 bp, Artificial Sequence
  Synthetic
ctttagggaaggcuccccuact

SEQ ID NO: 94031 - DNA, 19 bp, Artificial Sequence
  Synthetic
catgccaaggucccaagug

SEQ ID NO: 94032 - DNA, 22 bp, Artificial Sequence
  Synthetic
tcactgctgucacactgttugt

SEQ ID NO: 94033 - DNA, 28 bp, Artificial Sequence
  Synthetic
ggcaaatggaaggautccctatacttua

SEQ ID NO: 94034 - DNA, 24 bp, Artificial Sequence
  Synthetic
aaccugagaacagaugaagccaaa

SEQ ID NO: 94035 - DNA, 22 bp, Artificial Sequence
  Synthetic
ccactgucacccagtucaacag

SEQ ID NO: 94036 - DNA, 18 bp, Artificial Sequence
  Synthetic
acaaaugcacccguccca

SEQ ID NO: 94037 - DNA, 21 bp, Artificial Sequence
  Synthetic
gcccccugaagttgccttuaa

SEQ ID NO: 94038 - DNA, 24 bp, Artificial Sequence
  Synthetic
cacagaggaggautgccaaaagua

SEQ ID NO: 94039 - DNA, 23 bp, Artificial Sequence
  Synthetic
catgggaacaguattggacccut

SEQ ID NO: 94040 - DNA, 20 bp, Artificial Sequence
  Synthetic
cagcgaagugtgggcuagag

SEQ ID NO: 94041 - DNA, 21 bp, Artificial Sequence
  Synthetic
ctttttgcccaucacccgtua

SEQ ID NO: 94042 - DNA, 21 bp, Artificial Sequence
  Synthetic
tctcugcaaccacaggugaag

SEQ ID NO: 94043 - DNA, 20 bp, Artificial Sequence
  Synthetic
agccagcugtgggacuagaa

SEQ ID NO: 94044 - DNA, 24 bp, Artificial Sequence
  Synthetic
ccactgtcuggtccaatatgtuct

SEQ ID NO: 94045 - DNA, 20 bp, Artificial Sequence
  Synthetic
tgcggcacaaautgactgug

SEQ ID NO: 94046 - DNA, 20 bp, Artificial Sequence
  Synthetic
tgaugacacagtuggccaca

SEQ ID NO: 94047 - DNA, 22 bp, Artificial Sequence
  Synthetic
ggcaggaccaggugacattuag

SEQ ID NO: 94048 - DNA, 23 bp, Artificial Sequence
  Synthetic
tcttctccagautctccgucact

SEQ ID NO: 94049 - DNA, 28 bp, Artificial Sequence
  Synthetic
ggcattttaaaggcugaagaaggtttua

SEQ ID NO: 94050 - DNA, 22 bp, Artificial Sequence
  Synthetic
ggacccuttacaggugggaaga

SEQ ID NO: 94051 - DNA, 20 bp, Artificial Sequence
  Synthetic
ggtttcccugagggcctuac

SEQ ID NO: 94052 - DNA, 21 bp, Artificial Sequence
  Synthetic
gtgagggugggcgagaauaag

SEQ ID NO: 94053 - DNA, 19 bp, Artificial Sequence
  Synthetic
cgacccttuctcccgagug

SEQ ID NO: 94054 - DNA, 20 bp, Artificial Sequence
  Synthetic
tggactgggacugaggacug

SEQ ID NO: 94055 - DNA, 23 bp, Artificial Sequence
  Synthetic
ctccaagucacccagacatctut

SEQ ID NO: 94056 - DNA, 22 bp, Artificial Sequence
  Synthetic
cauccaccuggagaacagagac

SEQ ID NO: 94057 - DNA, 23 bp, Artificial Sequence
  Synthetic
gccctatctgucatgctcctuac

SEQ ID NO: 94058 - DNA, 22 bp, Artificial Sequence
  Synthetic
tcuacugaaagagcgggaaaga

SEQ ID NO: 94059 - DNA, 25 bp, Artificial Sequence
  Synthetic
cgtgctcacautctctatgagaugt

SEQ ID NO: 94060 - DNA, 28 bp, Artificial Sequence
  Synthetic
catatttgtaccugaacacatccagcua

SEQ ID NO: 94061 - DNA, 26 bp, Artificial Sequence
  Synthetic
acttggatccautaaggagtucagga

SEQ ID NO: 94062 - DNA, 26 bp, Artificial Sequence
  Synthetic
tcctgaacuccttaatggauccaagt

SEQ ID NO: 94063 - DNA, 26 bp, Artificial Sequence
  Synthetic
tgcatgtgttttugacatgagcatut

SEQ ID NO: 94064 - DNA, 31 bp, Artificial Sequence
  Synthetic
aaaaggcacttutaagagttattaguaggca

SEQ ID NO: 94065 - DNA, 26 bp, Artificial Sequence
  Synthetic
tcagtttgtttcuctgcacctttcut

SEQ ID NO: 94066 - DNA, 29 bp, Artificial Sequence
  Synthetic
acctccataagaguttccctgagattuaa

SEQ ID NO: 94067 - DNA, 28 bp, Artificial Sequence
  Synthetic
cgtactcaaauggaaaagatgaugaaca

SEQ ID NO: 94068 - DNA, 19 bp, Artificial Sequence
  Synthetic
tuctcctaggugggcaggt

SEQ ID NO: 94069 - DNA, 17 bp, Artificial Sequence
  Synthetic
ggagcuacggcgcttug

SEQ ID NO: 94070 - DNA, 28 bp, Artificial Sequence
  Synthetic
gtgcagagaaacaaacugagatttugaa

SEQ ID NO: 94071 - DNA, 24 bp, Artificial Sequence
  Synthetic
aatgcgaactgaucgtccctttua

SEQ ID NO: 94072 - DNA, 24 bp, Artificial Sequence
  Synthetic
ccatttcacaauacacaacuggca

SEQ ID NO: 94073 - DNA, 22 bp, Artificial Sequence
  Synthetic
ggccaauggtttugcaacaact

SEQ ID NO: 94074 - DNA, 26 bp, Artificial Sequence
  Synthetic
atgttcagtggaauctcatgtgatut

SEQ ID NO: 94075 - DNA, 27 bp, Artificial Sequence
  Synthetic
ctctcttcttatuagagggcccttuac

SEQ ID NO: 94076 - DNA, 23 bp, Artificial Sequence
  Synthetic
acaccaataguaaagggcccuct

SEQ ID NO: 94077 - DNA, 23 bp, Artificial Sequence
  Synthetic
ccacaagcucctcctugagaaac

SEQ ID NO: 94078 - DNA, 20 bp, Artificial Sequence
  Synthetic
gggccaaucaaauggcaact

SEQ ID NO: 94079 - DNA, 22 bp, Artificial Sequence
  Synthetic
gtggtactgaugcttgtgtguc

SEQ ID NO: 94080 - DNA, 20 bp, Artificial Sequence
  Synthetic
aggctucgaagagcaaggut

SEQ ID NO: 94081 - DNA, 18 bp, Artificial Sequence
  Synthetic
cggaggucttcgccugac

SEQ ID NO: 94082 - DNA, 27 bp, Artificial Sequence
  Synthetic
gcactggattaguaggtcctcttcuac

SEQ ID NO: 94083 - DNA, 23 bp, Artificial Sequence
  Synthetic
gctctgtttucctgctcctauca

SEQ ID NO: 94084 - DNA, 28 bp, Artificial Sequence
  Synthetic
caactttgttuccctctctgtaauacac

SEQ ID NO: 94085 - DNA, 22 bp, Artificial Sequence
  Synthetic
tcgcttuggacaaacuaagcct

SEQ ID NO: 94086 - DNA, 26 bp, Artificial Sequence
  Synthetic
aggcttagttugtccaaagcgauaaa

SEQ ID NO: 94087 - DNA, 30 bp, Artificial Sequence
  Synthetic
ctaaagcaggatcuctaggaattaatcugg

SEQ ID NO: 94088 - DNA, 22 bp, Artificial Sequence
  Synthetic
atggatuccaagaagcgucgaa

SEQ ID NO: 94089 - DNA, 33 bp, Artificial Sequence
  Synthetic
gcatttattcuatattttcatttucagaggacg

SEQ ID NO: 94090 - DNA, 20 bp, Artificial Sequence
  Synthetic
gctgtccagguagtgccaua

SEQ ID NO: 94091 - DNA, 18 bp, Artificial Sequence
  Synthetic
cactcagcugtgcuggct

SEQ ID NO: 94092 - DNA, 19 bp, Artificial Sequence
  Synthetic
gactcugggaagggcugag

SEQ ID NO: 94093 - DNA, 20 bp, Artificial Sequence
  Synthetic
tctccgacccucccatgtua

SEQ ID NO: 94094 - DNA, 27 bp, Artificial Sequence
  Synthetic
cataaaagtggucacatctaccccuaa

SEQ ID NO: 94095 - DNA, 25 bp, Artificial Sequence
  Synthetic
tcattgtgttutgatttgcagugct

SEQ ID NO: 94096 - DNA, 17 bp, Artificial Sequence
  Synthetic
gcccggcucaacctgut

SEQ ID NO: 94097 - DNA, 18 bp, Artificial Sequence
  Synthetic
gcgggcagcaugagguag

SEQ ID NO: 94098 - DNA, 19 bp, Artificial Sequence
  Synthetic
gcctgcacuctttcugcca

SEQ ID NO: 94099 - DNA, 17 bp, Artificial Sequence
  Synthetic
cggccggutctcaccut

SEQ ID NO: 94100 - DNA, 27 bp, Artificial Sequence
  Synthetic
acaagcaacugagaatttctuggagaa

SEQ ID NO: 94101 - DNA, 21 bp, Artificial Sequence
  Synthetic
aggcctgccuctctttaccua

SEQ ID NO: 94102 - DNA, 33 bp, Artificial Sequence
  Synthetic
ttaaaagtagctuttaacttgcaaaaucagaat

SEQ ID NO: 94103 - DNA, 28 bp, Artificial Sequence
  Synthetic
tggctggccaugatctatattagtauct

SEQ ID NO: 94104 - DNA, 21 bp, Artificial Sequence
  Synthetic
gccagacagcaggguttguaa

SEQ ID NO: 94105 - DNA, 24 bp, Artificial Sequence
  Synthetic
cccgttcugaacctaaaatgagug

SEQ ID NO: 94106 - DNA, 22 bp, Artificial Sequence
  Synthetic
cggctttuccagcaagttctuc

SEQ ID NO: 94107 - DNA, 26 bp, Artificial Sequence
  Synthetic
tcattgcatatucgctcagtagcaua

SEQ ID NO: 94108 - DNA, 28 bp, Artificial Sequence
  Synthetic
gactgttcaaguactattatgcuggaca

SEQ ID NO: 94109 - DNA, 22 bp, Artificial Sequence
  Synthetic
aagaagcccacuttaccugcaa

SEQ ID NO: 94110 - DNA, 28 bp, Artificial Sequence
  Synthetic
gggaagaaguaagaatttgaugcaaaag

SEQ ID NO: 94111 - DNA, 25 bp, Artificial Sequence
  Synthetic
caaaccatactugcctcagatcugt

SEQ ID NO: 94112 - DNA, 21 bp, Artificial Sequence
  Synthetic
agctgccucacacccaaauat

SEQ ID NO: 94113 - DNA, 29 bp, Artificial Sequence
  Synthetic
agatgaagaugaagaaaccaaagaaccut

SEQ ID NO: 94114 - DNA, 24 bp, Artificial Sequence
  Synthetic
acctgcacuaaaggttctttggut

SEQ ID NO: 94115 - DNA, 28 bp, Artificial Sequence
  Synthetic
ccattgcttgaaugatttctttgagcut

SEQ ID NO: 94116 - DNA, 21 bp, Artificial Sequence
  Synthetic
cccautttcuccacgggaact

SEQ ID NO: 94117 - DNA, 24 bp, Artificial Sequence
  Synthetic
cgatcagagccuaaaatccucaca

SEQ ID NO: 94118 - DNA, 26 bp, Artificial Sequence
  Synthetic
ggctatttatcutggttgcaauccga

SEQ ID NO: 94119 - DNA, 25 bp, Artificial Sequence
  Synthetic
ccagtuccagattggctugaaaaat

SEQ ID NO: 94120 - DNA, 23 bp, Artificial Sequence
  Synthetic
gggaacuatucacaaagaagcct

SEQ ID NO: 94121 - DNA, 27 bp, Artificial Sequence
  Synthetic
aactggaggaugagaatacctaucaca

SEQ ID NO: 94122 - DNA, 25 bp, Artificial Sequence
  Synthetic
cttaacacaaaccucttgacauggg

SEQ ID NO: 94123 - DNA, 25 bp, Artificial Sequence
  Synthetic
ttgtgtctgcuttgcttctttucag

SEQ ID NO: 94124 - DNA, 23 bp, Artificial Sequence
  Synthetic
gacaatgtcuctctgaaggcugt

SEQ ID NO: 94125 - DNA, 27 bp, Artificial Sequence
  Synthetic
ggatgaggucatctccaaataugcaat

SEQ ID NO: 94126 - DNA, 28 bp, Artificial Sequence
  Synthetic
tgttattuaaacgccacaaaactguacc

SEQ ID NO: 94127 - DNA, 28 bp, Artificial Sequence
  Synthetic
gtatttcaacugtgcagtcauaaaccaa

SEQ ID NO: 94128 - DNA, 26 bp, Artificial Sequence
  Synthetic
gcacagagaaaagcaaugagaacaut

SEQ ID NO: 94129 - DNA, 28 bp, Artificial Sequence
  Synthetic
agtcttttcttgauggttgacaaaucca

SEQ ID NO: 94130 - DNA, 27 bp, Artificial Sequence
  Synthetic
ctgtttttgtatatutactgggcgcut

SEQ ID NO: 94131 - DNA, 26 bp, Artificial Sequence
  Synthetic
gatcacagtgaaautggatggtgtug

SEQ ID NO: 94132 - DNA, 26 bp, Artificial Sequence
  Synthetic
tccaatggauttgtcaaccaucaaga

SEQ ID NO: 94133 - DNA, 23 bp, Artificial Sequence
  Synthetic
ttttcacacugctgttcctucct

SEQ ID NO: 94134 - DNA, 27 bp, Artificial Sequence
  Synthetic
acatacagcaaucgcaaaaatgtctut

SEQ ID NO: 94135 - DNA, 26 bp, Artificial Sequence
  Synthetic
tccctcagaaagucttgacacagaua

SEQ ID NO: 94136 - DNA, 28 bp, Artificial Sequence
  Synthetic
acatactgcutaccagcaauaagaagac

SEQ ID NO: 94137 - DNA, 28 bp, Artificial Sequence
  Synthetic
gagggaacagugttacagaaatttugac

SEQ ID NO: 94138 - DNA, 30 bp, Artificial Sequence
  Synthetic
ccacaataaacgcaacauacaataatauca

SEQ ID NO: 94139 - DNA, 24 bp, Artificial Sequence
  Synthetic
gcaattgcacaaucctcttaucct

SEQ ID NO: 94140 - DNA, 27 bp, Artificial Sequence
  Synthetic
atagaaaauaaggcttgtaccuggcat

SEQ ID NO: 94141 - DNA, 24 bp, Artificial Sequence
  Synthetic
gcctctcaugaatggccttatugg

SEQ ID NO: 94142 - DNA, 22 bp, Artificial Sequence
  Synthetic
cacaagcucaccgtttgtagug

SEQ ID NO: 94143 - DNA, 25 bp, Artificial Sequence
  Synthetic
caggctaaggugagtatgaactgug

SEQ ID NO: 94144 - DNA, 20 bp, Artificial Sequence
  Synthetic
gatgcauccccagugaccaa

SEQ ID NO: 94145 - DNA, 28 bp, Artificial Sequence
  Synthetic
ttttacagacaaaugccactgagaaaug

SEQ ID NO: 94146 - DNA, 21 bp, Artificial Sequence
  Synthetic
ggttttuggccaggactccut

SEQ ID NO: 94147 - DNA, 18 bp, Artificial Sequence
  Synthetic
caugcuagagcggcccat

SEQ ID NO: 94148 - DNA, 20 bp, Artificial Sequence
  Synthetic
ggcuccagggcuagaaaagt

SEQ ID NO: 94149 - DNA, 22 bp, Artificial Sequence
  Synthetic
cagcagaugggcctttuaaacc

SEQ ID NO: 94150 - DNA, 25 bp, Artificial Sequence
  Synthetic
atgacagattucattctgcctucca

SEQ ID NO: 94151 - DNA, 25 bp, Artificial Sequence
  Synthetic
ggtcattgaguacatcgggactauc

SEQ ID NO: 94152 - DNA, 18 bp, Artificial Sequence
  Synthetic
gaagcgccaucttugcga

SEQ ID NO: 94153 - DNA, 24 bp, Artificial Sequence
  Synthetic
tccatgtgtctutcctggtgacua

SEQ ID NO: 94154 - DNA, 23 bp, Artificial Sequence
  Synthetic
cctccucacttttgtctugcaac

SEQ ID NO: 94155 - DNA, 26 bp, Artificial Sequence
  Synthetic
gctgagtgctcugactttatgtctuc

SEQ ID NO: 94156 - DNA, 22 bp, Artificial Sequence
  Synthetic
ctgcugaagctgctguaaagag

SEQ ID NO: 94157 - DNA, 20 bp, Artificial Sequence
  Synthetic
cttaugggacacaggcuggt

SEQ ID NO: 94158 - DNA, 24 bp, Artificial Sequence
  Synthetic
gtgacaucagactctgcugaagat

SEQ ID NO: 94159 - DNA, 21 bp, Artificial Sequence
  Synthetic
caggtgctuatgacccagucc

SEQ ID NO: 94160 - DNA, 25 bp, Artificial Sequence
  Synthetic
gaggttguggccctgtattatttug

SEQ ID NO: 94161 - DNA, 23 bp, Artificial Sequence
  Synthetic
ctaggcaguggatcatcttcuga

SEQ ID NO: 94162 - DNA, 24 bp, Artificial Sequence
  Synthetic
cctgttggcuacttcgttucgaat

SEQ ID NO: 94163 - DNA, 24 bp, Artificial Sequence
  Synthetic
ccgagggugaaacctttgtaugaa

SEQ ID NO: 94164 - DNA, 20 bp, Artificial Sequence
  Synthetic
tgaccagccugtgtcccaua

SEQ ID NO: 94165 - DNA, 18 bp, Artificial Sequence
  Synthetic
gcagcacccuggagctut

SEQ ID NO: 94166 - DNA, 22 bp, Artificial Sequence
  Synthetic
atgtgggagaugaggacuggat

SEQ ID NO: 94167 - DNA, 29 bp, Artificial Sequence
  Synthetic
gctttacttcaacuccttgttacttguga

SEQ ID NO: 94168 - DNA, 26 bp, Artificial Sequence
  Synthetic
caaatgcuacatgcagtguacaaaca

SEQ ID NO: 94169 - DNA, 20 bp, Artificial Sequence
  Synthetic
gggaaaacugcaguggaaga

SEQ ID NO: 94170 - DNA, 22 bp, Artificial Sequence
  Synthetic
gcugatccccuaaggaaacaga

SEQ ID NO: 94171 - DNA, 20 bp, Artificial Sequence
  Synthetic
cugaggctuccaggacaaca

SEQ ID NO: 94172 - DNA, 21 bp, Artificial Sequence
  Synthetic
ccatccaugctgtcctcauct

SEQ ID NO: 94173 - DNA, 30 bp, Artificial Sequence
  Synthetic
tgtataccttcaaautgtgccttatgtuga

SEQ ID NO: 94174 - DNA, 21 bp, Artificial Sequence
  Synthetic
ctgggtcauaagcacctguct

SEQ ID NO: 94175 - DNA, 18 bp, Artificial Sequence
  Synthetic
agggccutatgccuccca

SEQ ID NO: 94176 - DNA, 18 bp, Artificial Sequence
  Synthetic
cuggaccaggaggcctug

SEQ ID NO: 94177 - DNA, 21 bp, Artificial Sequence
  Synthetic
ccttcuaggacagguggcaat

SEQ ID NO: 94178 - DNA, 21 bp, Artificial Sequence
  Synthetic
ctgtguggagcaggctaacut

SEQ ID NO: 94179 - DNA, 22 bp, Artificial Sequence
  Synthetic
gaggtaaagcccucactctcug

SEQ ID NO: 94180 - DNA, 24 bp, Artificial Sequence
  Synthetic
tctagaagcugtgttcaggaucca

SEQ ID NO: 94181 - DNA, 23 bp, Artificial Sequence
  Synthetic
aggagatcaacaucagcttcguc

SEQ ID NO: 94182 - DNA, 23 bp, Artificial Sequence
  Synthetic
gagcttgguttgtctgtacucca

SEQ ID NO: 94183 - DNA, 26 bp, Artificial Sequence
  Synthetic
ctgautcaaggctttuacaggaaagg

SEQ ID NO: 94184 - DNA, 22 bp, Artificial Sequence
  Synthetic
caccttctttucctggccauca

SEQ ID NO: 94185 - DNA, 20 bp, Artificial Sequence
  Synthetic
ccaagtccugtgaccagcuc

SEQ ID NO: 94186 - DNA, 21 bp, Artificial Sequence
  Synthetic
ggacaagcaggagutgugagt

SEQ ID NO: 94187 - DNA, 20 bp, Artificial Sequence
  Synthetic
cguagacccagccgtttcut

SEQ ID NO: 94188 - DNA, 17 bp, Artificial Sequence
  Synthetic
tccccgcugctgaggua

SEQ ID NO: 94189 - DNA, 19 bp, Artificial Sequence
  Synthetic
gggttgggaugtgtcctug

SEQ ID NO: 94190 - DNA, 23 bp, Artificial Sequence
  Synthetic
cttctgcagcuccttcttcucat

SEQ ID NO: 94191 - DNA, 21 bp, Artificial Sequence
  Synthetic
ggatccuccctgcuggaaaag

SEQ ID NO: 94192 - DNA, 28 bp, Artificial Sequence
  Synthetic
cattacuatttcatgtcugccacagagt

SEQ ID NO: 94193 - DNA, 27 bp, Artificial Sequence
  Synthetic
ctggctatagcaugagaatgagtaguc

SEQ ID NO: 94194 - DNA, 18 bp, Artificial Sequence
  Synthetic
gggccagcugcatacgut

SEQ ID NO: 94195 - DNA, 22 bp, Artificial Sequence
  Synthetic
cagcaacagcaacautctggug

SEQ ID NO: 94196 - DNA, 24 bp, Artificial Sequence
  Synthetic
cctcgacuatcatccattucacca

SEQ ID NO: 94197 - DNA, 28 bp, Artificial Sequence
  Synthetic
agaagaaaacggucaaaaccaaaatuga

SEQ ID NO: 94198 - DNA, 19 bp, Artificial Sequence
  Synthetic
cggcccuccctgatgtgua

SEQ ID NO: 94199 - DNA, 20 bp, Artificial Sequence
  Synthetic
gccagcaaagccuctucaac

SEQ ID NO: 94200 - DNA, 19 bp, Artificial Sequence
  Synthetic
ccccacuctcgagcucaaa

SEQ ID NO: 94201 - DNA, 21 bp, Artificial Sequence
  Synthetic
tuttctagcagugggcacaca

SEQ ID NO: 94202 - DNA, 24 bp, Artificial Sequence
  Synthetic
cccacccttguttcaagtctctua

SEQ ID NO: 94203 - DNA, 22 bp, Artificial Sequence
  Synthetic
tcacacauggccttggaugaag

SEQ ID NO: 94204 - DNA, 24 bp, Artificial Sequence
  Synthetic
ccatttcaccaucccttgaaugct

SEQ ID NO: 94205 - DNA, 23 bp, Artificial Sequence
  Synthetic
ggtgtgtguttgactgaaucagg

SEQ ID NO: 94206 - DNA, 21 bp, Artificial Sequence
  Synthetic
ggcaggcacucctggttttua

SEQ ID NO: 94207 - DNA, 25 bp, Artificial Sequence
  Synthetic
gccttatctaaaucagtgcctguca

SEQ ID NO: 94208 - DNA, 19 bp, Artificial Sequence
  Synthetic
cccaaaggaggccutcuca

SEQ ID NO: 94209 - DNA, 19 bp, Artificial Sequence
  Synthetic
acctgcugccaattcccut

SEQ ID NO: 94210 - DNA, 29 bp, Artificial Sequence
  Synthetic
tgactatgcaugaacactttucaaaacag

SEQ ID NO: 94211 - DNA, 24 bp, Artificial Sequence
  Synthetic
ccagcattggcuacttctgaauca

SEQ ID NO: 94212 - DNA, 22 bp, Artificial Sequence
  Synthetic
ctccacagccugatucagaagt

SEQ ID NO: 94213 - DNA, 23 bp, Artificial Sequence
  Synthetic
gggctguacaaagtcatcatcug

SEQ ID NO: 94214 - DNA, 23 bp, Artificial Sequence
  Synthetic
atcatgctcugtcctggcttuag

SEQ ID NO: 94215 - DNA, 20 bp, Artificial Sequence
  Synthetic
tctgtgcuccctgaggugaa

SEQ ID NO: 94216 - DNA, 25 bp, Artificial Sequence
  Synthetic
tcccatgtcaagutctggatctgua

SEQ ID NO: 94217 - DNA, 27 bp, Artificial Sequence
  Synthetic
atggcaaggtagutgaattggatacut

SEQ ID NO: 94218 - DNA, 24 bp, Artificial Sequence
  Synthetic
tgtcgtcatcaucatcatccacug

SEQ ID NO: 94219 - DNA, 26 bp, Artificial Sequence
  Synthetic
ccagagttuagaccccacttagttug

SEQ ID NO: 94220 - DNA, 24 bp, Artificial Sequence
  Synthetic
gacttggaagaugcagaacuggat

SEQ ID NO: 94221 - DNA, 24 bp, Artificial Sequence
  Synthetic
accatuaaaaccaccatcccucac

SEQ ID NO: 94222 - DNA, 18 bp, Artificial Sequence
  Synthetic
tccacccucctccaccut

SEQ ID NO: 94223 - DNA, 20 bp, Artificial Sequence
  Synthetic
cctgaggcuggtagaaucgg

SEQ ID NO: 94224 - DNA, 28 bp, Artificial Sequence
  Synthetic
caaaccagaautcaggaatgaaucagaa

SEQ ID NO: 94225 - DNA, 20 bp, Artificial Sequence
  Synthetic
acaagcuagtggtgcugcat

SEQ ID NO: 94226 - DNA, 25 bp, Artificial Sequence
  Synthetic
gcctctgucacatactcaacaucat

SEQ ID NO: 94227 - DNA, 27 bp, Artificial Sequence
  Synthetic
gctgctctgugatgactgtgatatuag

SEQ ID NO: 94228 - DNA, 28 bp, Artificial Sequence
  Synthetic
ccaggttgggaucattagtttccaaaut

SEQ ID NO: 94229 - DNA, 25 bp, Artificial Sequence
  Synthetic
cttgattctgaugacccttctguga

SEQ ID NO: 94230 - DNA, 17 bp, Artificial Sequence
  Synthetic
gccgccacuccacctug

SEQ ID NO: 94231 - DNA, 24 bp, Artificial Sequence
  Synthetic
ctctttccttcuttgcccttcuga

SEQ ID NO: 94232 - DNA, 22 bp, Artificial Sequence
  Synthetic
gtccaggcaguatgtgtgguag

SEQ ID NO: 94233 - DNA, 22 bp, Artificial Sequence
  Synthetic
caccctgagaagutcccatcut

SEQ ID NO: 94234 - DNA, 23 bp, Artificial Sequence
  Synthetic
ctcccgtucagccttctcatuag

SEQ ID NO: 94235 - DNA, 20 bp, Artificial Sequence
  Synthetic
ccaaugacccccactuggat

SEQ ID NO: 94236 - DNA, 26 bp, Artificial Sequence
  Synthetic
ctcaaggtctutaacatccagtucct

SEQ ID NO: 94237 - DNA, 24 bp, Artificial Sequence
  Synthetic
agaagctccuttgtcaacatcugt

SEQ ID NO: 94238 - DNA, 30 bp, Artificial Sequence
  Synthetic
agcaaaauattacttgtaaauaggcaggga

SEQ ID NO: 94239 - DNA, 28 bp, Artificial Sequence
  Synthetic
gtgagcagtuaccagatactttagtuga

SEQ ID NO: 94240 - DNA, 26 bp, Artificial Sequence
  Synthetic
gcagggaaaguttcttcaagcttaut

SEQ ID NO: 94241 - DNA, 28 bp, Artificial Sequence
  Synthetic
tttataaatgugactgttgttucaggct

SEQ ID NO: 94242 - DNA, 28 bp, Artificial Sequence
  Synthetic
ccaacatttaaagucgaaactgctuact

SEQ ID NO: 94243 - DNA, 25 bp, Artificial Sequence
  Synthetic
gaataacgccuggatttatctugcc

SEQ ID NO: 94244 - DNA, 21 bp, Artificial Sequence
  Synthetic
acaaugttcagtgugccaggt

SEQ ID NO: 94245 - DNA, 25 bp, Artificial Sequence
  Synthetic
ctttccataacuctctgcccaucag

SEQ ID NO: 94246 - DNA, 20 bp, Artificial Sequence
  Synthetic
ctcguctccatugagcaggt

SEQ ID NO: 94247 - DNA, 19 bp, Artificial Sequence
  Synthetic
aggaucccgagctggauga

SEQ ID NO: 94248 - DNA, 25 bp, Artificial Sequence
  Synthetic
attatcagacgutgttucagacggt

SEQ ID NO: 94249 - DNA, 21 bp, Artificial Sequence
  Synthetic
cctgugcacccagattuggaa

SEQ ID NO: 94250 - DNA, 28 bp, Artificial Sequence
  Synthetic
cttcttgtuagaaggttggtttcuccat

SEQ ID NO: 94251 - DNA, 28 bp, Artificial Sequence
  Synthetic
agctacttttcuccttctctgactuaca

SEQ ID NO: 94252 - DNA, 20 bp, Artificial Sequence
  Synthetic
ccuttttcucccccagacct

SEQ ID NO: 94253 - DNA, 22 bp, Artificial Sequence
  Synthetic
ggctctgauccactcctttcug

SEQ ID NO: 94254 - DNA, 25 bp, Artificial Sequence
  Synthetic
cccgatggccuaatgtctgaatuat

SEQ ID NO: 94255 - DNA, 26 bp, Artificial Sequence
  Synthetic
gaaaagaaccaaucgagaaactgcug

SEQ ID NO: 94256 - DNA, 21 bp, Artificial Sequence
  Synthetic
agggcagaaucaggguacact

SEQ ID NO: 94257 - DNA, 25 bp, Artificial Sequence
  Synthetic
gagaggacacugtaatgttccaugt

SEQ ID NO: 94258 - DNA, 20 bp, Artificial Sequence
  Synthetic
ggcctugtgggcaucaaaat

SEQ ID NO: 94259 - DNA, 21 bp, Artificial Sequence
  Synthetic
tcutcauccaacaccccacac

SEQ ID NO: 94260 - DNA, 24 bp, Artificial Sequence
  Synthetic
gagtggatgccugaatgacattug

SEQ ID NO: 94261 - DNA, 25 bp, Artificial Sequence
  Synthetic
ctgctcacucagacctaaatgaugg

SEQ ID NO: 94262 - DNA, 27 bp, Artificial Sequence
  Synthetic
gatttcatgaaugtctagaugcccagt

SEQ ID NO: 94263 - DNA, 27 bp, Artificial Sequence
  Synthetic
ccaaaatgguggcccttaaaggtauaa

SEQ ID NO: 94264 - DNA, 26 bp, Artificial Sequence
  Synthetic
ccagattgtttugtgccatcacttua

SEQ ID NO: 94265 - DNA, 33 bp, Artificial Sequence
  Synthetic
atatttgaattactucttagtgtacgtugaact

SEQ ID NO: 94266 - DNA, 21 bp, Artificial Sequence
  Synthetic
cctctgcucgcttctctctug

SEQ ID NO: 94267 - DNA, 24 bp, Artificial Sequence
  Synthetic
agcacagcgaauctggaaaacuat

SEQ ID NO: 94268 - DNA, 19 bp, Artificial Sequence
  Synthetic
ccagtuggcaggguaggac

SEQ ID NO: 94269 - DNA, 23 bp, Artificial Sequence
  Synthetic
agagaccccguttttaccctgua

SEQ ID NO: 94270 - DNA, 24 bp, Artificial Sequence
  Synthetic
aactgcattautcagaccaugcct

SEQ ID NO: 94271 - DNA, 22 bp, Artificial Sequence
  Synthetic
gccacagucaacacatttggut

SEQ ID NO: 94272 - DNA, 22 bp, Artificial Sequence
  Synthetic
cttgttgagauggtggcactug

SEQ ID NO: 94273 - DNA, 24 bp, Artificial Sequence
  Synthetic
cagcgttguagaggcatcttcuaa

SEQ ID NO: 94274 - DNA, 27 bp, Artificial Sequence
  Synthetic
tcacaaggaugcaaagaagtctttuct

SEQ ID NO: 94275 - DNA, 28 bp, Artificial Sequence
  Synthetic
ggtggaauccaaatgtgaaacugaaaaa

SEQ ID NO: 94276 - DNA, 19 bp, Artificial Sequence
  Synthetic
ctgtctcccutgcccucat

SEQ ID NO: 94277 - DNA, 18 bp, Artificial Sequence
  Synthetic
gggcgacggacuctccua

SEQ ID NO: 94278 - DNA, 22 bp, Artificial Sequence
  Synthetic
cctaugaggaggcagagttgug

SEQ ID NO: 94279 - DNA, 20 bp, Artificial Sequence
  Synthetic
gatguggagccuggcaaaga

SEQ ID NO: 94280 - DNA, 28 bp, Artificial Sequence
  Synthetic
tgagcaaggagugtcaacattatcttua

SEQ ID NO: 94281 - DNA, 28 bp, Artificial Sequence
  Synthetic
ggttctcuctgataaacatucaccacag

SEQ ID NO: 94282 - DNA, 20 bp, Artificial Sequence
  Synthetic
gctgaagacuccgctggtua

SEQ ID NO: 94283 - DNA, 20 bp, Artificial Sequence
  Synthetic
gcutcttuagcccggaaccc

SEQ ID NO: 94284 - DNA, 17 bp, Artificial Sequence
  Synthetic
gagtccgucgcccucac

SEQ ID NO: 94285 - DNA, 17 bp, Artificial Sequence
  Synthetic
gcgcccugtgactcuct

SEQ ID NO: 94286 - DNA, 26 bp, Artificial Sequence
  Synthetic
agtacttccguttttacctcatuggt

SEQ ID NO: 94287 - DNA, 27 bp, Artificial Sequence
  Synthetic
gaggaactagaccutccaattgaugat

SEQ ID NO: 94288 - DNA, 28 bp, Artificial Sequence
  Synthetic
gaaccagagtttugttttcttgttccut

SEQ ID NO: 94289 - DNA, 28 bp, Artificial Sequence
  Synthetic
ggtcaggagaguttgatatcattgcaua

SEQ ID NO: 94290 - DNA, 22 bp, Artificial Sequence
  Synthetic
cacccaauggcctttgcaauat

SEQ ID NO: 94291 - DNA, 24 bp, Artificial Sequence
  Synthetic
gggagcugaatatgtatcugcaag

SEQ ID NO: 94292 - DNA, 25 bp, Artificial Sequence
  Synthetic
ctcaaagcaaaucctcatccacuct

SEQ ID NO: 94293 - DNA, 33 bp, Artificial Sequence
  Synthetic
tgagttaatcatguttttagaactgaattugca

SEQ ID NO: 94294 - DNA, 25 bp, Artificial Sequence
  Synthetic
cgatatggttuacgcttgcgtttut

SEQ ID NO: 94295 - DNA, 27 bp, Artificial Sequence
  Synthetic
acaaggtuaaaagggcctatagttcug

SEQ ID NO: 94296 - DNA, 23 bp, Artificial Sequence
  Synthetic
ctgcataggcaauctcagagguc

SEQ ID NO: 94297 - DNA, 28 bp, Artificial Sequence
  Synthetic
tgactcaaaatgacautagcacctguaa

SEQ ID NO: 94298 - DNA, 25 bp, Artificial Sequence
  Synthetic
cctaaatcctugcctttcactucct

SEQ ID NO: 94299 - DNA, 30 bp, Artificial Sequence
  Synthetic
aaagaatgttcaaaugtcatacgtgttuaa

SEQ ID NO: 94300 - DNA, 28 bp, Artificial Sequence
  Synthetic
tttaaagctgugttctgtatucaaggga

SEQ ID NO: 94301 - DNA, 28 bp, Artificial Sequence
  Synthetic
tccagataacagugaaagcaccaattua

SEQ ID NO: 94302 - DNA, 28 bp, Artificial Sequence
  Synthetic
ccatggactttaautcgccaaatgatua

SEQ ID NO: 94303 - DNA, 25 bp, Artificial Sequence
  Synthetic
gacgtgctugctttcatttgauagg

SEQ ID NO: 94304 - DNA, 27 bp, Artificial Sequence
  Synthetic
ggactttgctautaacgtatgcacuct

SEQ ID NO: 94305 - DNA, 29 bp, Artificial Sequence
  Synthetic
attcagcttaaaacutactgtcgucaaac

SEQ ID NO: 94306 - DNA, 24 bp, Artificial Sequence
  Synthetic
gctactgaaugctcaccacaauct

SEQ ID NO: 94307 - DNA, 28 bp, Artificial Sequence
  Synthetic
ccacacaaucaccctctttattagtuga

SEQ ID NO: 94308 - DNA, 23 bp, Artificial Sequence
  Synthetic
ctgctctaaaugactcacccuca

SEQ ID NO: 94309 - DNA, 26 bp, Artificial Sequence
  Synthetic
agauggaggaagugaaaccaagaaac

SEQ ID NO: 94310 - DNA, 25 bp, Artificial Sequence
  Synthetic
agttaggauagagcatgtggtguga

SEQ ID NO: 94311 - DNA, 21 bp, Artificial Sequence
  Synthetic
ttgggccaguttactctgugg

SEQ ID NO: 94312 - DNA, 24 bp, Artificial Sequence
  Synthetic
ggautaaagaugccagggacagac

SEQ ID NO: 94313 - DNA, 28 bp, Artificial Sequence
  Synthetic
gcaagttgaagtutattgcgttgacaut

SEQ ID NO: 94314 - DNA, 22 bp, Artificial Sequence
  Synthetic
ctgaacaacauggcagaugcaa

SEQ ID NO: 94315 - DNA, 22 bp, Artificial Sequence
  Synthetic
acagttttcugacatgguggct

SEQ ID NO: 94316 - DNA, 19 bp, Artificial Sequence
  Synthetic
tgagtccguttgctucgct

SEQ ID NO: 94317 - DNA, 28 bp, Artificial Sequence
  Synthetic
gcactgcatgaacuaaaaaccaaataug

SEQ ID NO: 94318 - DNA, 28 bp, Artificial Sequence
  Synthetic
agagatttaccaugcatgaatucgaaca

SEQ ID NO: 94319 - DNA, 27 bp, Artificial Sequence
  Synthetic
aggautatgugaacagaaaagaggcaa

SEQ ID NO: 94320 - DNA, 28 bp, Artificial Sequence
  Synthetic
ctttgcctcttutctgttcacataaucc

SEQ ID NO: 94321 - DNA, 28 bp, Artificial Sequence
  Synthetic
ggacgaaaaacgauttcttgttactgut

SEQ ID NO: 94322 - DNA, 20 bp, Artificial Sequence
  Synthetic
ccctcctcautcaccctcug

SEQ ID NO: 94323 - DNA, 20 bp, Artificial Sequence
  Synthetic
cggacttuccctgccucaag

SEQ ID NO: 94324 - DNA, 24 bp, Artificial Sequence
  Synthetic
tgaccctttaucctcagtgaucct

SEQ ID NO: 94325 - DNA, 28 bp, Artificial Sequence
  Synthetic
cccagatcaggucttatatctguagcaa

SEQ ID NO: 94326 - DNA, 21 bp, Artificial Sequence
  Synthetic
gcacuggcttuagcagcaaaa

SEQ ID NO: 94327 - DNA, 28 bp, Artificial Sequence
  Synthetic
ccaagaagtcaucaatggaagtaatguc

SEQ ID NO: 94328 - DNA, 19 bp, Artificial Sequence
  Synthetic
gcatgtugagctgcacgua

SEQ ID NO: 94329 - DNA, 19 bp, Artificial Sequence
  Synthetic
caggcctcugactctgcug

SEQ ID NO: 94330 - DNA, 26 bp, Artificial Sequence
  Synthetic
tccattgttctugcttttgctttgut

SEQ ID NO: 94331 - DNA, 26 bp, Artificial Sequence
  Synthetic
gagatgttcatuttccccaaacucac

SEQ ID NO: 94332 - DNA, 23 bp, Artificial Sequence
  Synthetic
gtgttcucacagatgctgucgat

SEQ ID NO: 94333 - DNA, 28 bp, Artificial Sequence
  Synthetic
cagtgtttgcccautaatacaactuaga

SEQ ID NO: 94334 - DNA, 27 bp, Artificial Sequence
  Synthetic
acctagcctgugtgtgactatttcuaa

SEQ ID NO: 94335 - DNA, 27 bp, Artificial Sequence
  Synthetic
ccatgagacttguttctgtcagaaaug

SEQ ID NO: 94336 - DNA, 27 bp, Artificial Sequence
  Synthetic
cgttgatgauaatgaagttcgugacct

SEQ ID NO: 94337 - DNA, 28 bp, Artificial Sequence
  Synthetic
tccattctccugatgtaccttcuacaat

SEQ ID NO: 94338 - DNA, 25 bp, Artificial Sequence
  Synthetic
accttcccaagaacutcactatucc

SEQ ID NO: 94339 - DNA, 22 bp, Artificial Sequence
  Synthetic
attttagcctcuttgcccccut

SEQ ID NO: 94340 - DNA, 22 bp, Artificial Sequence
  Synthetic
gcagctguaggatgcagaguaa

SEQ ID NO: 94341 - DNA, 29 bp, Artificial Sequence
  Synthetic
gttcagaaucaagaaggaatgacaucaaa

SEQ ID NO: 94342 - DNA, 25 bp, Artificial Sequence
  Synthetic
caaaatataaagugcctggcucagt

SEQ ID NO: 94343 - DNA, 29 bp, Artificial Sequence
  Synthetic
ccctttacacuacgccaatttactaaugt

SEQ ID NO: 94344 - DNA, 24 bp, Artificial Sequence
  Synthetic
aacccaacaacuctgttacacugt

SEQ ID NO: 94345 - DNA, 28 bp, Artificial Sequence
  Synthetic
gatttcagccaaaaacuggataucaact

SEQ ID NO: 94346 - DNA, 19 bp, Artificial Sequence
  Synthetic
cautgacugggcagccact

SEQ ID NO: 94347 - DNA, 19 bp, Artificial Sequence
  Synthetic
gugcaagacagcgaugcaa

SEQ ID NO: 94348 - DNA, 22 bp, Artificial Sequence
  Synthetic
aaggccttucctttctctucca

SEQ ID NO: 94349 - DNA, 25 bp, Artificial Sequence
  Synthetic
tggtcgtucacaatgtatguacact

SEQ ID NO: 94350 - DNA, 28 bp, Artificial Sequence
  Synthetic
tccatggtauaagcaattcaccacatua

SEQ ID NO: 94351 - DNA, 24 bp, Artificial Sequence
  Synthetic
accaaaacttgauaggcagctuca

SEQ ID NO: 94352 - DNA, 23 bp, Artificial Sequence
  Synthetic
gacagaggcugagttugaagaga

SEQ ID NO: 94353 - DNA, 28 bp, Artificial Sequence
  Synthetic
tcttcttgtcaauaaaccagaggctuac

SEQ ID NO: 94354 - DNA, 24 bp, Artificial Sequence
  Synthetic
gtatcatguacgcatagcucgaga

SEQ ID NO: 94355 - DNA, 23 bp, Artificial Sequence
  Synthetic
ccctctgaugagctctgauacac

SEQ ID NO: 94356 - DNA, 20 bp, Artificial Sequence
  Synthetic
ccttcccauggagctcugac

SEQ ID NO: 94357 - DNA, 21 bp, Artificial Sequence
  Synthetic
ttccagtugccggatcatcuc

SEQ ID NO: 94358 - DNA, 29 bp, Artificial Sequence
  Synthetic
acaatgaatgaauggaacagagagguaac

SEQ ID NO: 94359 - DNA, 27 bp, Artificial Sequence
  Synthetic
ggaagaaaaucagcggagctauaaaca

SEQ ID NO: 94360 - DNA, 28 bp, Artificial Sequence
  Synthetic
aaccttaatacgucgccttttcttttuc

SEQ ID NO: 94361 - DNA, 28 bp, Artificial Sequence
  Synthetic
ggaatgcauacagaggtagaacagttut

SEQ ID NO: 94362 - DNA, 24 bp, Artificial Sequence
  Synthetic
gaagcaggtutgacaagtgguaag

SEQ ID NO: 94363 - DNA, 20 bp, Artificial Sequence
  Synthetic
ccttccucagactgctguga

SEQ ID NO: 94364 - DNA, 28 bp, Artificial Sequence
  Synthetic
gtttgacutaaggcaguagaagagaagt

SEQ ID NO: 94365 - DNA, 28 bp, Artificial Sequence
  Synthetic
gcttaatgtauacaagtgcctcagugaa

SEQ ID NO: 94366 - DNA, 31 bp, Artificial Sequence
  Synthetic
ggtattcattgtgutaatgggttcaataucc

SEQ ID NO: 94367 - DNA, 22 bp, Artificial Sequence
  Synthetic
actattccuggagguggagcaa

SEQ ID NO: 94368 - DNA, 26 bp, Artificial Sequence
  Synthetic
ttctttagctuccagagcagttguag

SEQ ID NO: 94369 - DNA, 24 bp, Artificial Sequence
  Synthetic
ctttgcuttactccucccaaggat

SEQ ID NO: 94370 - DNA, 29 bp, Artificial Sequence
  Synthetic
tctaattcataccuatcccttgcauacct

SEQ ID NO: 94371 - DNA, 25 bp, Artificial Sequence
  Synthetic
gacagagaagcutcacaatcaagug

SEQ ID NO: 94372 - DNA, 20 bp, Artificial Sequence
  Synthetic
gcgacauccagtttgugcag

SEQ ID NO: 94373 - DNA, 25 bp, Artificial Sequence
  Synthetic
cttctagccaaccucttttcgauga

SEQ ID NO: 94374 - DNA, 27 bp, Artificial Sequence
  Synthetic
atttttccatgaccacuctgtaccaut

SEQ ID NO: 94375 - DNA, 28 bp, Artificial Sequence
  Synthetic
tgctcattattugcatttgaaaccaugt

SEQ ID NO: 94376 - DNA, 21 bp, Artificial Sequence
  Synthetic
ttgccauccacaccaaagcua

SEQ ID NO: 94377 - DNA, 24 bp, Artificial Sequence
  Synthetic
cactccaaaaautggcatggguaa

SEQ ID NO: 94378 - DNA, 30 bp, Artificial Sequence
  Synthetic
tcaagcacatauaaactgtgagataaucaa

SEQ ID NO: 94379 - DNA, 20 bp, Artificial Sequence
  Synthetic
cacutcuggcagcacaggat

SEQ ID NO: 94380 - DNA, 28 bp, Artificial Sequence
  Synthetic
cttacctgtcgguaatttcttctaucca

SEQ ID NO: 94381 - DNA, 25 bp, Artificial Sequence
  Synthetic
ggtaaaacagugttgugggacagat

SEQ ID NO: 94382 - DNA, 24 bp, Artificial Sequence
  Synthetic
ctgtgcugccagaagtgttuaaaa

SEQ ID NO: 94383 - DNA, 29 bp, Artificial Sequence
  Synthetic
tcacgtaatcagcaaugagtattctctuc

SEQ ID NO: 94384 - DNA, 27 bp, Artificial Sequence
  Synthetic
aataccacatauggtgctctttctugt

SEQ ID NO: 94385 - DNA, 27 bp, Artificial Sequence
  Synthetic
attagcatggcuctgagaaagtgtuat

SEQ ID NO: 94386 - DNA, 28 bp, Artificial Sequence
  Synthetic
tcuttcacaaccatuaaaacaggagaca

SEQ ID NO: 94387 - DNA, 28 bp, Artificial Sequence
  Synthetic
gtactctttttccugttgctgttcttut

SEQ ID NO: 94388 - DNA, 23 bp, Artificial Sequence
  Synthetic
aatagctgguttacccaugccaa

SEQ ID NO: 94389 - DNA, 20 bp, Artificial Sequence
  Synthetic
cagactugccttcgcaugac

SEQ ID NO: 94390 - DNA, 28 bp, Artificial Sequence
  Synthetic
ccattagcttggauagctgcagaaauat

SEQ ID NO: 94391 - DNA, 23 bp, Artificial Sequence
  Synthetic
tcaagcagcutggtagcatttug

SEQ ID NO: 94392 - DNA, 22 bp, Artificial Sequence
  Synthetic
gtgttgaauggctcugcaagac

SEQ ID NO: 94393 - DNA, 28 bp, Artificial Sequence
  Synthetic
tcaaaacaagucaauacaggaaggaaga

SEQ ID NO: 94394 - DNA, 25 bp, Artificial Sequence
  Synthetic
tgccaattttuggagtgacugagat

SEQ ID NO: 94395 - DNA, 27 bp, Artificial Sequence
  Synthetic
agtcaucattttcatcaucagcagaca

SEQ ID NO: 94396 - DNA, 25 bp, Artificial Sequence
  Synthetic
ctttgcaggcuctcacatttgttut

SEQ ID NO: 94397 - DNA, 27 bp, Artificial Sequence
  Synthetic
cccagccguggataattcttataugat

SEQ ID NO: 94398 - DNA, 25 bp, Artificial Sequence
  Synthetic
ctgtgtctgguctattgctagugag

SEQ ID NO: 94399 - DNA, 21 bp, Artificial Sequence
  Synthetic
cccugggaatagctucaggaa

SEQ ID NO: 94400 - DNA, 33 bp, Artificial Sequence
  Synthetic
agcaatttaacatatuactgatcatagttccut

SEQ ID NO: 94401 - DNA, 28 bp, Artificial Sequence
  Synthetic
ctagtggacagauaacccaagtcaaauc

SEQ ID NO: 94402 - DNA, 28 bp, Artificial Sequence
  Synthetic
tgcttagatttgacutgggttatctguc

SEQ ID NO: 94403 - DNA, 26 bp, Artificial Sequence
  Synthetic
agatacugaaacaagaauggcccaaa

SEQ ID NO: 94404 - DNA, 27 bp, Artificial Sequence
  Synthetic
cctacttgcuccaacaatatcacugat

SEQ ID NO: 94405 - DNA, 29 bp, Artificial Sequence
  Synthetic
gtgatttatcctuactcctgcctttaucc

SEQ ID NO: 94406 - DNA, 27 bp, Artificial Sequence
  Synthetic
tcttctctttgtcucccattgtttcug

SEQ ID NO: 94407 - DNA, 24 bp, Artificial Sequence
  Synthetic
tctcgacaugtcagtttgucacat

SEQ ID NO: 94408 - DNA, 25 bp, Artificial Sequence
  Synthetic
tgcctccttgguatgaaacatctut

SEQ ID NO: 94409 - DNA, 23 bp, Artificial Sequence
  Synthetic
gtgtccccacaugaggaaaguat

SEQ ID NO: 94410 - DNA, 22 bp, Artificial Sequence
  Synthetic
agctgaagcugtactgugagac

SEQ ID NO: 94411 - DNA, 23 bp, Artificial Sequence
  Synthetic
gcagcagtccuttagtcctcuaa

SEQ ID NO: 94412 - DNA, 18 bp, Artificial Sequence
  Synthetic
gtgcaguggagggcucat

SEQ ID NO: 94413 - DNA, 17 bp, Artificial Sequence
  Synthetic
tggugccagcctuccag

SEQ ID NO: 94414 - DNA, 20 bp, Artificial Sequence
  Synthetic
gcgtttgcaucgctgtctug

SEQ ID NO: 94415 - DNA, 21 bp, Artificial Sequence
  Synthetic
tuggtgagcucccgaaagaag

SEQ ID NO: 94416 - DNA, 25 bp, Artificial Sequence
  Synthetic
gctaacaaaaaccucccaactccua

SEQ ID NO: 94417 - DNA, 22 bp, Artificial Sequence
  Synthetic
cctgaagtatugggcagcatuc

SEQ ID NO: 94418 - DNA, 31 bp, Artificial Sequence
  Synthetic
gtctaagtttattcugcttccaatagaugct

SEQ ID NO: 94419 - DNA, 24 bp, Artificial Sequence
  Synthetic
caggtgcaaagcutttccaagaut

SEQ ID NO: 94420 - DNA, 24 bp, Artificial Sequence
  Synthetic
tguagtctagcugcaaacaccaag

SEQ ID NO: 94421 - DNA, 23 bp, Artificial Sequence
  Synthetic
tcttttgaucaggtgugggcaat

SEQ ID NO: 94422 - DNA, 20 bp, Artificial Sequence
  Synthetic
aatggccutcagtgcuccaa

SEQ ID NO: 94423 - DNA, 28 bp, Artificial Sequence
  Synthetic
gcatcaaatucttacttctuccccaaat

SEQ ID NO: 94424 - DNA, 21 bp, Artificial Sequence
  Synthetic
gaagtgatgggutcctgggut

SEQ ID NO: 94425 - DNA, 28 bp, Artificial Sequence
  Synthetic
cagcttgcaacagguaatgttttgaaua

SEQ ID NO: 94426 - DNA, 23 bp, Artificial Sequence
  Synthetic
ctgtutcagctgttucagcaagg

SEQ ID NO: 94427 - DNA, 24 bp, Artificial Sequence
  Synthetic
ccttcaatgggcutatttggctua

SEQ ID NO: 94428 - DNA, 26 bp, Artificial Sequence
  Synthetic
ccaactgttccucaggacataaugaa

SEQ ID NO: 94429 - DNA, 22 bp, Artificial Sequence
  Synthetic
ccagaucactgugcagcaagaa

SEQ ID NO: 94430 - DNA, 22 bp, Artificial Sequence
  Synthetic
acaggaagauggtgacguagga

SEQ ID NO: 94431 - DNA, 21 bp, Artificial Sequence
  Synthetic
ctgactgtcugtccctccuct

SEQ ID NO: 94432 - DNA, 26 bp, Artificial Sequence
  Synthetic
gaacgagactuttctcagatgtugga

SEQ ID NO: 94433 - DNA, 26 bp, Artificial Sequence
  Synthetic
gtttctacugcgacatuagccaaaaa

SEQ ID NO: 94434 - DNA, 26 bp, Artificial Sequence
  Synthetic
cctctgccautcacttcatctaucaa

SEQ ID NO: 94435 - DNA, 25 bp, Artificial Sequence
  Synthetic
ttgccaacacaacacutttuaagca

SEQ ID NO: 94436 - DNA, 24 bp, Artificial Sequence
  Synthetic
cccatagcacugaaagaggagaut

SEQ ID NO: 94437 - DNA, 22 bp, Artificial Sequence
  Synthetic
agagcuggtatuggaggcaaag

SEQ ID NO: 94438 - DNA, 28 bp, Artificial Sequence
  Synthetic
ttgagagctttuacactacagcaaucat

SEQ ID NO: 94439 - DNA, 22 bp, Artificial Sequence
  Synthetic
gtgaacguggacaaagctgtug

SEQ ID NO: 94440 - DNA, 23 bp, Artificial Sequence
  Synthetic
acttacttcugtgctcccugaga

SEQ ID NO: 94441 - DNA, 27 bp, Artificial Sequence
  Synthetic
tgctcatttgcuccttttcattttucc

SEQ ID NO: 94442 - DNA, 22 bp, Artificial Sequence
  Synthetic
cgccctcuggtcttctgactua

SEQ ID NO: 94443 - DNA, 22 bp, Artificial Sequence
  Synthetic
cttttcccugatggtccauccc

SEQ ID NO: 94444 - DNA, 27 bp, Artificial Sequence
  Synthetic
tgagtcatacuggttcatacauaagca

SEQ ID NO: 94445 - DNA, 25 bp, Artificial Sequence
  Synthetic
ggaatcctccacuctcttcactgua

SEQ ID NO: 94446 - DNA, 22 bp, Artificial Sequence
  Synthetic
tccatccctucctcagtcauct

SEQ ID NO: 94447 - DNA, 25 bp, Artificial Sequence
  Synthetic
tttgactcttugtctctcactuccc

SEQ ID NO: 94448 - DNA, 28 bp, Artificial Sequence
  Synthetic
tgtacttuacagaacggtcttuccaaat

SEQ ID NO: 94449 - DNA, 25 bp, Artificial Sequence
  Synthetic
catctgaaugggaagtggtauagcc

SEQ ID NO: 94450 - DNA, 23 bp, Artificial Sequence
  Synthetic
agctctttgugcttctgaucaca

SEQ ID NO: 94451 - DNA, 21 bp, Artificial Sequence
  Synthetic
tgatgtcatugccactgucgt

SEQ ID NO: 94452 - DNA, 21 bp, Artificial Sequence
  Synthetic
ctactaccccuccaccucaga

SEQ ID NO: 94453 - DNA, 23 bp, Artificial Sequence
  Synthetic
ggacacagcagaugtcttugagt

SEQ ID NO: 94454 - DNA, 25 bp, Artificial Sequence
  Synthetic
tttaaggtgugaagtagctgugcat

SEQ ID NO: 94455 - DNA, 27 bp, Artificial Sequence
  Synthetic
tttacaactccauctacattggtuccc

SEQ ID NO: 94456 - DNA, 23 bp, Artificial Sequence
  Synthetic
gctggaugctgaagtguccaaat

SEQ ID NO: 94457 - DNA, 20 bp, Artificial Sequence
  Synthetic
gggaagaaaguagccccugt

SEQ ID NO: 94458 - DNA, 28 bp, Artificial Sequence
  Synthetic
catattcatguggtaggaguaaaacgga

SEQ ID NO: 94459 - DNA, 22 bp, Artificial Sequence
  Synthetic
gcaggugaaggagcaggagaua

SEQ ID NO: 94460 - DNA, 27 bp, Artificial Sequence
  Synthetic
acatacatgtguccagaagcaatcuaa

SEQ ID NO: 94461 - DNA, 29 bp, Artificial Sequence
  Synthetic
gtggttctggaaguaactctgatatgaug

SEQ ID NO: 94462 - DNA, 20 bp, Artificial Sequence
  Synthetic
ggcucagctccuacgaaaga

SEQ ID NO: 94463 - DNA, 22 bp, Artificial Sequence
  Synthetic
gtctgtgugttcgaguggacaa

SEQ ID NO: 94464 - DNA, 25 bp, Artificial Sequence
  Synthetic
tccttacctctuccttgctgtttuc

SEQ ID NO: 94465 - DNA, 29 bp, Artificial Sequence
  Synthetic
gggtttgtggagutataggtattgatgut

SEQ ID NO: 94466 - DNA, 25 bp, Artificial Sequence
  Synthetic
gttcgtgttgautctgttcctgaug

SEQ ID NO: 94467 - DNA, 29 bp, Artificial Sequence
  Synthetic
agaaaatgctacuggagacacaaaagtua

SEQ ID NO: 94468 - DNA, 24 bp, Artificial Sequence
  Synthetic
ctgtgcccauttcgaactuacaaa

SEQ ID NO: 94469 - DNA, 21 bp, Artificial Sequence
  Synthetic
ctggagcaaugagctgagtug

SEQ ID NO: 94470 - DNA, 25 bp, Artificial Sequence
  Synthetic
aaagcaauaagctccatuagagcaa

SEQ ID NO: 94471 - DNA, 20 bp, Artificial Sequence
  Synthetic
ctuccaaggaaccagugcga

SEQ ID NO: 94472 - DNA, 24 bp, Artificial Sequence
  Synthetic
gtacttcaacttugcccccttcua

SEQ ID NO: 94473 - DNA, 23 bp, Artificial Sequence
  Synthetic
caaaggaggcaacgutgaagtut

SEQ ID NO: 94474 - DNA, 20 bp, Artificial Sequence
  Synthetic
cggaccuaacaugggagggt

SEQ ID NO: 94475 - DNA, 22 bp, Artificial Sequence
  Synthetic
agctgatgcugagaagcucaag

SEQ ID NO: 94476 - DNA, 26 bp, Artificial Sequence
  Synthetic
tctttattttccuaccttcgcacugg

SEQ ID NO: 94477 - DNA, 26 bp, Artificial Sequence
  Synthetic
ctgtccatttgugaatcctgagagut

SEQ ID NO: 94478 - DNA, 22 bp, Artificial Sequence
  Synthetic
ccgaccaggaacautctacgut

SEQ ID NO: 94479 - DNA, 26 bp, Artificial Sequence
  Synthetic
aatcctggaaauccagtuaacaacca

SEQ ID NO: 94480 - DNA, 21 bp, Artificial Sequence
  Synthetic
cagctgctautccacaccuga

SEQ ID NO: 94481 - DNA, 28 bp, Artificial Sequence
  Synthetic
ccatgagggtagugttgacaaagatuaa

SEQ ID NO: 94482 - DNA, 24 bp, Artificial Sequence
  Synthetic
tgctctggauttgtttttcaguct

SEQ ID NO: 94483 - DNA, 24 bp, Artificial Sequence
  Synthetic
ggaggtcgguaccacaaagtaaug

SEQ ID NO: 94484 - DNA, 24 bp, Artificial Sequence
  Synthetic
agagatgtgtcugacctgtgauct

SEQ ID NO: 94485 - DNA, 19 bp, Artificial Sequence
  Synthetic
ccacggagcgcutcctuac

SEQ ID NO: 94486 - DNA, 22 bp, Artificial Sequence
  Synthetic
tcttgctcugctgctctguaac

SEQ ID NO: 94487 - DNA, 20 bp, Artificial Sequence
  Synthetic
acccagcagcuccuacagat

SEQ ID NO: 94488 - DNA, 22 bp, Artificial Sequence
  Synthetic
tccaaggcacauttggtctcuc

SEQ ID NO: 94489 - DNA, 21 bp, Artificial Sequence
  Synthetic
atgtccacggcuttaccacut

SEQ ID NO: 94490 - DNA, 17 bp, Artificial Sequence
  Synthetic
cccacuggtgcccucac

SEQ ID NO: 94491 - DNA, 22 bp, Artificial Sequence
  Synthetic
tccacaactcugcctcctcaua

SEQ ID NO: 94492 - DNA, 22 bp, Artificial Sequence
  Synthetic
gcaactgtgagucagggaaaug

SEQ ID NO: 94493 - DNA, 24 bp, Artificial Sequence
  Synthetic
gggagtagcaguagtacatgauga

SEQ ID NO: 94494 - DNA, 23 bp, Artificial Sequence
  Synthetic
agucgccctuacacaaacaaagt

SEQ ID NO: 94495 - DNA, 29 bp, Artificial Sequence
  Synthetic
acagagaaaacaaaguacaagucaacagt

SEQ ID NO: 94496 - DNA, 24 bp, Artificial Sequence
  Synthetic
cctaacctgugttgtgccuaagac

SEQ ID NO: 94497 - DNA, 23 bp, Artificial Sequence
  Synthetic
gtgtgaccugttcttctguacca

SEQ ID NO: 94498 - DNA, 22 bp, Artificial Sequence
  Synthetic
gggtuaggccaaagttcucagt

SEQ ID NO: 94499 - DNA, 20 bp, Artificial Sequence
  Synthetic
tgacatgcugcgactctucc

SEQ ID NO: 94500 - DNA, 21 bp, Artificial Sequence
  Synthetic
tctgctccuctagcacctuca

SEQ ID NO: 94501 - DNA, 22 bp, Artificial Sequence
  Synthetic
gggagtgguttgggtcataugg

SEQ ID NO: 94502 - DNA, 32 bp, Artificial Sequence
  Synthetic
agtttatttctgcuagtatcacttaccaauag

SEQ ID NO: 94503 - DNA, 28 bp, Artificial Sequence
  Synthetic
catgcaaacugaagatcgaactaugaaa

SEQ ID NO: 94504 - DNA, 25 bp, Artificial Sequence
  Synthetic
atttccagauggctggtcatuaaca

SEQ ID NO: 94505 - DNA, 22 bp, Artificial Sequence
  Synthetic
acttcctccuccagctggtuat

SEQ ID NO: 94506 - DNA, 26 bp, Artificial Sequence
  Synthetic
cagugttttcatggauaggaaggaac

SEQ ID NO: 94507 - DNA, 21 bp, Artificial Sequence
  Synthetic
ggctgacacugaggctcttut

SEQ ID NO: 94508 - DNA, 22 bp, Artificial Sequence
  Synthetic
cgagcuggagttcgaauaggaa

SEQ ID NO: 94509 - DNA, 27 bp, Artificial Sequence
  Synthetic
gatgttgtcuccaagcaaauaaaaacc

SEQ ID NO: 94510 - DNA, 21 bp, Artificial Sequence
  Synthetic
tcctcgcccutcagatacuca

SEQ ID NO: 94511 - DNA, 21 bp, Artificial Sequence
  Synthetic
tggaggucagugagcagaagt

SEQ ID NO: 94512 - DNA, 21 bp, Artificial Sequence
  Synthetic
caagcauctcctgcuggacaa

SEQ ID NO: 94513 - DNA, 19 bp, Artificial Sequence
  Synthetic
ggtgtttguggctccucgt

SEQ ID NO: 94514 - DNA, 24 bp, Artificial Sequence
  Synthetic
tctaccuccttcaaacucagggaa

SEQ ID NO: 94515 - DNA, 28 bp, Artificial Sequence
  Synthetic
cattaactagcggutttctcaaaucact

SEQ ID NO: 94516 - DNA, 21 bp, Artificial Sequence
  Synthetic
ccgugatagtgaugcccacag

SEQ ID NO: 94517 - DNA, 23 bp, Artificial Sequence
  Synthetic
tggagtgccugttttgtguacag

SEQ ID NO: 94518 - DNA, 28 bp, Artificial Sequence
  Synthetic
gatgagaggtgagutttcactgaaguat

SEQ ID NO: 94519 - DNA, 28 bp, Artificial Sequence
  Synthetic
gtaggaatccugatccacatatucacaa

SEQ ID NO: 94520 - DNA, 28 bp, Artificial Sequence
  Synthetic
agaacucagaacaaatagacaugcaaga

SEQ ID NO: 94521 - DNA, 28 bp, Artificial Sequence
  Synthetic
tcaccatttccuacatgattggaagtut

SEQ ID NO: 94522 - DNA, 28 bp, Artificial Sequence
  Synthetic
tttgcaaagcagaagauaatggtgttut

SEQ ID NO: 94523 - DNA, 27 bp, Artificial Sequence
  Synthetic
gtatagcaccucgagtgttgagatuac

SEQ ID NO: 94524 - DNA, 24 bp, Artificial Sequence
  Synthetic
tggtgtctcuctctgatgtuggaa

SEQ ID NO: 94525 - DNA, 25 bp, Artificial Sequence
  Synthetic
agtggtgttgucattgtaaaguggt

SEQ ID NO: 94526 - DNA, 28 bp, Artificial Sequence
  Synthetic
ggagauggttctcattuaagcaaaaaca

SEQ ID NO: 94527 - DNA, 27 bp, Artificial Sequence
  Synthetic
ctttctagttgaucacctttggcagua

SEQ ID NO: 94528 - DNA, 24 bp, Artificial Sequence
  Synthetic
tctccugaagattccttugaagca

SEQ ID NO: 94529 - DNA, 24 bp, Artificial Sequence
  Synthetic
gctattuaagagcagggaggugag

SEQ ID NO: 94530 - DNA, 25 bp, Artificial Sequence
  Synthetic
tcatctcacttuacctgatgtgcug

SEQ ID NO: 94531 - DNA, 28 bp, Artificial Sequence
  Synthetic
tccagtcttaccuatgctcttttcuact

SEQ ID NO: 94532 - DNA, 20 bp, Artificial Sequence
  Synthetic
agtcauggagaacccgucct

SEQ ID NO: 94533 - DNA, 28 bp, Artificial Sequence
  Synthetic
tgagcactgatuagtctcactttgaaut

SEQ ID NO: 94534 - DNA, 21 bp, Artificial Sequence
  Synthetic
tgggagaugttgctugcacaa

SEQ ID NO: 94535 - DNA, 32 bp, Artificial Sequence
  Synthetic
ataaattgagggtttugtacagtaccatatua

SEQ ID NO: 94536 - DNA, 31 bp, Artificial Sequence
  Synthetic
tccaatagaaataucaagaccaaagggtuac

SEQ ID NO: 94537 - DNA, 27 bp, Artificial Sequence
  Synthetic
tgatcagaaaagautcctcaggctcua

SEQ ID NO: 94538 - DNA, 22 bp, Artificial Sequence
  Synthetic
caaggctgcucttgtccuagaa

SEQ ID NO: 94539 - DNA, 20 bp, Artificial Sequence
  Synthetic
tgccttugagcagctgaguc

SEQ ID NO: 94540 - DNA, 21 bp, Artificial Sequence
  Synthetic
ccccatguactctcccacugt

SEQ ID NO: 94541 - DNA, 19 bp, Artificial Sequence
  Synthetic
ggtagatgugacgcccuca

SEQ ID NO: 94542 - DNA, 22 bp, Artificial Sequence
  Synthetic
tgcaagguaactgcucggaaat

SEQ ID NO: 94543 - DNA, 29 bp, Artificial Sequence
  Synthetic
gtgtactgtggaaaugtagggagaaatua

SEQ ID NO: 94544 - DNA, 25 bp, Artificial Sequence
  Synthetic
attctcagggaaagugtaggtacut

SEQ ID NO: 94545 - DNA, 28 bp, Artificial Sequence
  Synthetic
tttagggtgtugaaatacctaccatugt

SEQ ID NO: 94546 - DNA, 27 bp, Artificial Sequence
  Synthetic
agggacttuagatatcacucagcaaga

SEQ ID NO: 94547 - DNA, 21 bp, Artificial Sequence
  Synthetic
ccgcattugaagcctcctgua

SEQ ID NO: 94548 - DNA, 21 bp, Artificial Sequence
  Synthetic
ccuacctgtgucccagcaaag

SEQ ID NO: 94549 - DNA, 20 bp, Artificial Sequence
  Synthetic
tgatucggcagcagauccag

SEQ ID NO: 94550 - DNA, 23 bp, Artificial Sequence
  Synthetic
ctgttcccaucccctaatggaut

SEQ ID NO: 94551 - DNA, 19 bp, Artificial Sequence
  Synthetic
tgccaggcgauagtgggua

SEQ ID NO: 94552 - DNA, 22 bp, Artificial Sequence
  Synthetic
ccgcacaccacutccaagaaua

SEQ ID NO: 94553 - DNA, 28 bp, Artificial Sequence
  Synthetic
caccttgtgtcaucagtcagttttaaut

SEQ ID NO: 94554 - DNA, 21 bp, Artificial Sequence
  Synthetic
tgcagctgtutccttctccug

SEQ ID NO: 94555 - DNA, 21 bp, Artificial Sequence
  Synthetic
ccccctataucgctcctguct

SEQ ID NO: 94556 - DNA, 21 bp, Artificial Sequence
  Synthetic
agtuggaccacgaccttgtut

SEQ ID NO: 94557 - DNA, 29 bp, Artificial Sequence
  Synthetic
cctttgctcucatttccttcatauacaac

SEQ ID NO: 94558 - DNA, 24 bp, Artificial Sequence
  Synthetic
caccctccagauatatccccguat

SEQ ID NO: 94559 - DNA, 27 bp, Artificial Sequence
  Synthetic
caugcccatguaagaaacaaaaaggaa

SEQ ID NO: 94560 - DNA, 27 bp, Artificial Sequence
  Synthetic
ctacaggccaautatccaagaagcaua

SEQ ID NO: 94561 - DNA, 25 bp, Artificial Sequence
  Synthetic
ggatccaaccautcagacttuccat

SEQ ID NO: 94562 - DNA, 27 bp, Artificial Sequence
  Synthetic
tgaggaagaagagaaagugatacugga

SEQ ID NO: 94563 - DNA, 20 bp, Artificial Sequence
  Synthetic
cagccacgccutcctctaug

SEQ ID NO: 94564 - DNA, 22 bp, Artificial Sequence
  Synthetic
ggtggttcauctgtgagcagua

SEQ ID NO: 94565 - DNA, 21 bp, Artificial Sequence
  Synthetic
gacaactacacutgggcgtug

SEQ ID NO: 94566 - DNA, 20 bp, Artificial Sequence
  Synthetic
cctcaccggcugttcacauc

SEQ ID NO: 94567 - DNA, 27 bp, Artificial Sequence
  Synthetic
ccaccttcatcuaccttgtctcttcua

SEQ ID NO: 94568 - DNA, 31 bp, Artificial Sequence
  Synthetic
gctgctctcugaataaaataaatggtuacct

SEQ ID NO: 94569 - DNA, 21 bp, Artificial Sequence
  Synthetic
tctccuccacgacttgcaaug

SEQ ID NO: 94570 - DNA, 19 bp, Artificial Sequence
  Synthetic
acacgcccuccccttctua

SEQ ID NO: 94571 - DNA, 19 bp, Artificial Sequence
  Synthetic
cttcccccutggcttccut

SEQ ID NO: 94572 - DNA, 25 bp, Artificial Sequence
  Synthetic
agattcttcugatgagtgugcaagg

SEQ ID NO: 94573 - DNA, 28 bp, Artificial Sequence
  Synthetic
tggctatattttcaguttgctagagcut

SEQ ID NO: 94574 - DNA, 24 bp, Artificial Sequence
  Synthetic
ggautcagaccucaaaaccacagt

SEQ ID NO: 94575 - DNA, 24 bp, Artificial Sequence
  Synthetic
cgttgctttcuggaagtcaacaut

SEQ ID NO: 94576 - DNA, 24 bp, Artificial Sequence
  Synthetic
gactucaccaggacaattccucaa

SEQ ID NO: 94577 - DNA, 21 bp, Artificial Sequence
  Synthetic
ggagttccccuccgtttugac

SEQ ID NO: 94578 - DNA, 27 bp, Artificial Sequence
  Synthetic
aagccccacauaaagaaacctctuaat

SEQ ID NO: 94579 - DNA, 20 bp, Artificial Sequence
  Synthetic
cctgagaagggcgucaccua

SEQ ID NO: 94580 - DNA, 20 bp, Artificial Sequence
  Synthetic
gtcaggttccucgctgtcuc

SEQ ID NO: 94581 - DNA, 25 bp, Artificial Sequence
  Synthetic
ggtcgacatugatgacttacugact

SEQ ID NO: 94582 - DNA, 21 bp, Artificial Sequence
  Synthetic
cgtggaggaaucagcaacugg

SEQ ID NO: 94583 - DNA, 22 bp, Artificial Sequence
  Synthetic
tcccgtaccccuccacatatut

SEQ ID NO: 94584 - DNA, 27 bp, Artificial Sequence
  Synthetic
ccttttcguaaccaggcattatgauct

SEQ ID NO: 94585 - DNA, 21 bp, Artificial Sequence
  Synthetic
gggagaggaagguctgugagt

SEQ ID NO: 94586 - DNA, 26 bp, Artificial Sequence
  Synthetic
cauattatccattucaagggcccact

SEQ ID NO: 94587 - DNA, 20 bp, Artificial Sequence
  Synthetic
caatcgtcgcugctgctauc

SEQ ID NO: 94588 - DNA, 26 bp, Artificial Sequence
  Synthetic
agcttgttgauagcctttgttctuct

SEQ ID NO: 94589 - DNA, 25 bp, Artificial Sequence
  Synthetic
ctttccatcataucctgctgcacua

SEQ ID NO: 94590 - DNA, 22 bp, Artificial Sequence
  Synthetic
tgtctccugggaggaacaucaa

SEQ ID NO: 94591 - DNA, 28 bp, Artificial Sequence
  Synthetic
gcccttcattataugttgttggtatcug

SEQ ID NO: 94592 - DNA, 22 bp, Artificial Sequence
  Synthetic
aatgaggacuggtgtgcagtut

SEQ ID NO: 94593 - DNA, 27 bp, Artificial Sequence
  Synthetic
aagaatgugggaagggaagtactauct

SEQ ID NO: 94594 - DNA, 21 bp, Artificial Sequence
  Synthetic
ggaacagaggacacgucacut

SEQ ID NO: 94595 - DNA, 27 bp, Artificial Sequence
  Synthetic
gaaagacagatucctccaaaaacucac

SEQ ID NO: 94596 - DNA, 29 bp, Artificial Sequence
  Synthetic
gccaaatgautccagtatucaagacaaat

SEQ ID NO: 94597 - DNA, 26 bp, Artificial Sequence
  Synthetic
ccttaaggugtaacaagugaaaagca

SEQ ID NO: 94598 - DNA, 23 bp, Artificial Sequence
  Synthetic
catccagguaaactgggcatuct

SEQ ID NO: 94599 - DNA, 21 bp, Artificial Sequence
  Synthetic
cctaattccaggugccacucc

SEQ ID NO: 94600 - DNA, 23 bp, Artificial Sequence
  Synthetic
gcccgttgutctcaccaauagaa

SEQ ID NO: 94601 - DNA, 18 bp, Artificial Sequence
  Synthetic
gtuccacgccaucggaca

SEQ ID NO: 94602 - DNA, 27 bp, Artificial Sequence
  Synthetic
gttacctctcucaatttttctcgcuca

SEQ ID NO: 94603 - DNA, 28 bp, Artificial Sequence
  Synthetic
aaaggcagaaagaaaautcggaagatuc

SEQ ID NO: 94604 - DNA, 20 bp, Artificial Sequence
  Synthetic
cctuccagccccacgatuac

SEQ ID NO: 94605 - DNA, 28 bp, Artificial Sequence
  Synthetic
ccaacagtttucaacagaggctagtaua

SEQ ID NO: 94606 - DNA, 23 bp, Artificial Sequence
  Synthetic
gctccctcucagcaatacgttut

SEQ ID NO: 94607 - DNA, 22 bp, Artificial Sequence
  Synthetic
caaguctccuggaaaaggcaga

SEQ ID NO: 94608 - DNA, 20 bp, Artificial Sequence
  Synthetic
caccaugggaaaggtgggut

SEQ ID NO: 94609 - DNA, 28 bp, Artificial Sequence
  Synthetic
gattcguaaacaacagaaagaacaugct

SEQ ID NO: 94610 - DNA, 24 bp, Artificial Sequence
  Synthetic
ctatgaaagucagccatctgguga

SEQ ID NO: 94611 - DNA, 22 bp, Artificial Sequence
  Synthetic
agctgagcucttttgctgtcut

SEQ ID NO: 94612 - DNA, 25 bp, Artificial Sequence
  Synthetic
gaagttcgugacctcatttcugaca

SEQ ID NO: 94613 - DNA, 26 bp, Artificial Sequence
  Synthetic
gaggtggaugaaataaagacucccaa

SEQ ID NO: 94614 - DNA, 28 bp, Artificial Sequence
  Synthetic
tgctgtttgauccgataatcttcaauca

SEQ ID NO: 94615 - DNA, 20 bp, Artificial Sequence
  Synthetic
gccaaacugccctctgtgua

SEQ ID NO: 94616 - DNA, 27 bp, Artificial Sequence
  Synthetic
tgtagaagguacatcaggagaauggat

SEQ ID NO: 94617 - DNA, 25 bp, Artificial Sequence
  Synthetic
gtacgattagcugccaagagctuaa

SEQ ID NO: 94618 - DNA, 19 bp, Artificial Sequence
  Synthetic
cctcgucccgctcaatgua

SEQ ID NO: 94619 - DNA, 19 bp, Artificial Sequence
  Synthetic
catgcgtugccccaatguc

SEQ ID NO: 94620 - DNA, 26 bp, Artificial Sequence
  Synthetic
tgagauaaagcagaaatgugcaagga

SEQ ID NO: 94621 - DNA, 28 bp, Artificial Sequence
  Synthetic
aggatgaugaagaaaactctaugcacaa

SEQ ID NO: 94622 - DNA, 26 bp, Artificial Sequence
  Synthetic
gggcttcacauacaataatccttgut

SEQ ID NO: 94623 - DNA, 22 bp, Artificial Sequence
  Synthetic
acctggcaaguctgtcactuac

SEQ ID NO: 94624 - DNA, 22 bp, Artificial Sequence
  Synthetic
caugagtttgcugggaaacaga

SEQ ID NO: 94625 - DNA, 27 bp, Artificial Sequence
  Synthetic
ttgatacttgugtaccctgtttugaca

SEQ ID NO: 94626 - DNA, 21 bp, Artificial Sequence
  Synthetic
cggauggcacaagcaaaaugg

SEQ ID NO: 94627 - DNA, 20 bp, Artificial Sequence
  Synthetic
gguccacggaggtgtaugag

SEQ ID NO: 94628 - DNA, 23 bp, Artificial Sequence
  Synthetic
tctttccttugaggagggcaaug

SEQ ID NO: 94629 - DNA, 28 bp, Artificial Sequence
  Synthetic
aactagtttaagguacagtcacatgcut

SEQ ID NO: 94630 - DNA, 28 bp, Artificial Sequence
  Synthetic
tgatctgtggcagagutctatttttcug

SEQ ID NO: 94631 - DNA, 22 bp, Artificial Sequence
  Synthetic
agaactgguccattgggttugg

SEQ ID NO: 94632 - DNA, 22 bp, Artificial Sequence
  Synthetic
cctgcugaccagggtatcuact

SEQ ID NO: 94633 - DNA, 21 bp, Artificial Sequence
  Synthetic
aggcgggaagcaucgauaaac

SEQ ID NO: 94634 - DNA, 28 bp, Artificial Sequence
  Synthetic
ccacgtttgauaaactttcagaaucaca

SEQ ID NO: 94635 - DNA, 22 bp, Artificial Sequence
  Synthetic
tgtugagccaagaaagccauct

SEQ ID NO: 94636 - DNA, 18 bp, Artificial Sequence
  Synthetic
cucagccaagggtucggt

SEQ ID NO: 94637 - DNA, 23 bp, Artificial Sequence
  Synthetic
cactcagcacagcuataccuaca

SEQ ID NO: 94638 - DNA, 22 bp, Artificial Sequence
  Synthetic
gcaauaaagccaaacccccuac

SEQ ID NO: 94639 - DNA, 28 bp, Artificial Sequence
  Synthetic
tcttggctcttuataacctgttgctuaa

SEQ ID NO: 94640 - DNA, 21 bp, Artificial Sequence
  Synthetic
ccagcccauggatgagaauga

SEQ ID NO: 94641 - DNA, 28 bp, Artificial Sequence
  Synthetic
gaaagaagctgtuaagacgtctgaaaug

SEQ ID NO: 94642 - DNA, 22 bp, Artificial Sequence
  Synthetic
agtctgacacuttgggaccuct

SEQ ID NO: 94643 - DNA, 26 bp, Artificial Sequence
  Synthetic
aggctcattucatggcaguaaagaaa

SEQ ID NO: 94644 - DNA, 26 bp, Artificial Sequence
  Synthetic
cttagaagtgugagcgcctactttua

SEQ ID NO: 94645 - DNA, 27 bp, Artificial Sequence
  Synthetic
cagaaaagcautccactgtguaaacat

SEQ ID NO: 94646 - DNA, 22 bp, Artificial Sequence
  Synthetic
cgcacauccagatuggagacat

SEQ ID NO: 94647 - DNA, 24 bp, Artificial Sequence
  Synthetic
ggagggagcuagttagaugaggag

SEQ ID NO: 94648 - DNA, 21 bp, Artificial Sequence
  Synthetic
gttggcaggguggtcatagut

SEQ ID NO: 94649 - DNA, 24 bp, Artificial Sequence
  Synthetic
tgggatgatucacaatggccttut

SEQ ID NO: 94650 - DNA, 25 bp, Artificial Sequence
  Synthetic
cacagaagtcacucgttacacatug

SEQ ID NO: 94651 - DNA, 25 bp, Artificial Sequence
  Synthetic
agaggguagagaaggacattgtcut

SEQ ID NO: 94652 - DNA, 26 bp, Artificial Sequence
  Synthetic
tccttccacucccttagtttcaucat

SEQ ID NO: 94653 - DNA, 27 bp, Artificial Sequence
  Synthetic
caacaaccctacuttttattccccaut

SEQ ID NO: 94654 - DNA, 29 bp, Artificial Sequence
  Synthetic
cgcttgtgcagutgatgaataaagaauaa

SEQ ID NO: 94655 - DNA, 24 bp, Artificial Sequence
  Synthetic
ttgacutgttgagatucccacaca

SEQ ID NO: 94656 - DNA, 23 bp, Artificial Sequence
  Synthetic
ggtgttaagccugctctctctuc

SEQ ID NO: 94657 - DNA, 25 bp, Artificial Sequence
  Synthetic
cuaatgctuaccccagagacaacaa

SEQ ID NO: 94658 - DNA, 26 bp, Artificial Sequence
  Synthetic
aggtattgcacaugtgaaaatgtugg

SEQ ID NO: 94659 - DNA, 22 bp, Artificial Sequence
  Synthetic
tctgggtgaaauggcaactgut

SEQ ID NO: 94660 - DNA, 22 bp, Artificial Sequence
  Synthetic
acaagcucaactccuagagcac

SEQ ID NO: 94661 - DNA, 24 bp, Artificial Sequence
  Synthetic
agataagggttucaaggcatgcut

SEQ ID NO: 94662 - DNA, 28 bp, Artificial Sequence
  Synthetic
gcttaccagggaautcttcctttaagut

SEQ ID NO: 94663 - DNA, 28 bp, Artificial Sequence
  Synthetic
gaaggagaaaaugacacaatgtcgaaug

SEQ ID NO: 94664 - DNA, 24 bp, Artificial Sequence
  Synthetic
caactcuggaagaagcatagcuca

SEQ ID NO: 94665 - DNA, 26 bp, Artificial Sequence
  Synthetic
cttcagtgaaaacucacctctcauct

SEQ ID NO: 94666 - DNA, 21 bp, Artificial Sequence
  Synthetic
ctcccactuaagcgtgctuct

SEQ ID NO: 94667 - DNA, 25 bp, Artificial Sequence
  Synthetic
ttcccagggauaaaaattcagccut

SEQ ID NO: 94668 - DNA, 22 bp, Artificial Sequence
  Synthetic
gaacatcugcagcaaggucaag

SEQ ID NO: 94669 - DNA, 22 bp, Artificial Sequence
  Synthetic
gcaggtguttatgcggauagga

SEQ ID NO: 94670 - DNA, 27 bp, Artificial Sequence
  Synthetic
tgttaggatcacutgccattggatuaa

SEQ ID NO: 94671 - DNA, 33 bp, Artificial Sequence
  Synthetic
ggcttttgctataaauatgttacttttaacugt

SEQ ID NO: 94672 - DNA, 24 bp, Artificial Sequence
  Synthetic
cgacagcggutttcttttatuacc

SEQ ID NO: 94673 - DNA, 22 bp, Artificial Sequence
  Synthetic
ctgcaaguagggcatccttuga

SEQ ID NO: 94674 - DNA, 22 bp, Artificial Sequence
  Synthetic
gugaaaaagtccugggagggat

SEQ ID NO: 94675 - DNA, 21 bp, Artificial Sequence
  Synthetic
atcggugaggagctgaucaac

SEQ ID NO: 94676 - DNA, 31 bp, Artificial Sequence
  Synthetic
atgaccaaauaaatcacatcttuaggaagga

SEQ ID NO: 94677 - DNA, 23 bp, Artificial Sequence
  Synthetic
cttcgaauggcagaggaaatugg

SEQ ID NO: 94678 - DNA, 26 bp, Artificial Sequence
  Synthetic
gcacttacacuttatccccaattucc

SEQ ID NO: 94679 - DNA, 27 bp, Artificial Sequence
  Synthetic
gctccagacuggtacaaagattttgut

SEQ ID NO: 94680 - DNA, 24 bp, Artificial Sequence
  Synthetic
gcagggagauggagtagatgacuc

SEQ ID NO: 94681 - DNA, 22 bp, Artificial Sequence
  Synthetic
agtctgugccctatcugggaaa

SEQ ID NO: 94682 - DNA, 31 bp, Artificial Sequence
  Synthetic
aaaattctgtuagaaccatgaaacataucca

SEQ ID NO: 94683 - DNA, 28 bp, Artificial Sequence
  Synthetic
ggatgcagaataugccaactactauact

SEQ ID NO: 94684 - DNA, 24 bp, Artificial Sequence
  Synthetic
tcctcaucaggagactggaatuct

SEQ ID NO: 94685 - DNA, 21 bp, Artificial Sequence
  Synthetic
agggtttggcugctttctuga

SEQ ID NO: 94686 - DNA, 22 bp, Artificial Sequence
  Synthetic
aaacctcagcaucagcatcugt

SEQ ID NO: 94687 - DNA, 28 bp, Artificial Sequence
  Synthetic
tctcttgctcuctttccatttctttuct

SEQ ID NO: 94688 - DNA, 26 bp, Artificial Sequence
  Synthetic
gcttccagaatuaagaggcagtcaut

SEQ ID NO: 94689 - DNA, 25 bp, Artificial Sequence
  Synthetic
agatgatcaagcuggtaaactgugg

SEQ ID NO: 94690 - DNA, 27 bp, Artificial Sequence
  Synthetic
ctcttccucaaaaaggataagcacugt

SEQ ID NO: 94691 - DNA, 28 bp, Artificial Sequence
  Synthetic
cgtttcattttcutgtgttttgccuagt

SEQ ID NO: 94692 - DNA, 22 bp, Artificial Sequence
  Synthetic
gcccaaccagacugagttcauc

SEQ ID NO: 94693 - DNA, 28 bp, Artificial Sequence
  Synthetic
ttttctgcttgttutcactttcacagut

SEQ ID NO: 94694 - DNA, 18 bp, Artificial Sequence
  Synthetic
ccaggcuctggctgugaa

SEQ ID NO: 94695 - DNA, 19 bp, Artificial Sequence
  Synthetic
caccagucctctccctucc

SEQ ID NO: 94696 - DNA, 21 bp, Artificial Sequence
  Synthetic
acctcugacagtgggcuaact

SEQ ID NO: 94697 - DNA, 22 bp, Artificial Sequence
  Synthetic
tcacugccagagactgaugact

SEQ ID NO: 94698 - DNA, 21 bp, Artificial Sequence
  Synthetic
gggtcagugcagttagctuct

SEQ ID NO: 94699 - DNA, 22 bp, Artificial Sequence
  Synthetic
ctccactcucacccatcaucac

SEQ ID NO: 94700 - DNA, 21 bp, Artificial Sequence
  Synthetic
ggguactctaacucccccaaa

SEQ ID NO: 94701 - DNA, 27 bp, Artificial Sequence
  Synthetic
gggatgttaguactctgttattcugga

SEQ ID NO: 94702 - DNA, 19 bp, Artificial Sequence
  Synthetic
gcaggaaaggucccccaut

SEQ ID NO: 94703 - DNA, 20 bp, Artificial Sequence
  Synthetic
cctccccgutgagtcccaua

SEQ ID NO: 94704 - DNA, 20 bp, Artificial Sequence
  Synthetic
tgtcccagcaucgcacaaua

SEQ ID NO: 94705 - DNA, 20 bp, Artificial Sequence
  Synthetic
gctccctguccatggagtug

SEQ ID NO: 94706 - DNA, 29 bp, Artificial Sequence
  Synthetic
ctaccgtaagcutcattagatttaagugt

SEQ ID NO: 94707 - DNA, 25 bp, Artificial Sequence
  Synthetic
aaagaatcugaaacgtggtccauga

SEQ ID NO: 94708 - DNA, 27 bp, Artificial Sequence
  Synthetic
aatttaatcattagcuccgcaaagcug

SEQ ID NO: 94709 - DNA, 27 bp, Artificial Sequence
  Synthetic
cttgggcatacuccttaacttcttuct

SEQ ID NO: 94710 - DNA, 21 bp, Artificial Sequence
  Synthetic
atctgagacccccacuaccut

SEQ ID NO: 94711 - DNA, 20 bp, Artificial Sequence
  Synthetic
gcttcucccatcctgaugga

SEQ ID NO: 94712 - DNA, 25 bp, Artificial Sequence
  Synthetic
gcacgttttaauggagtaaccgcua

SEQ ID NO: 94713 - DNA, 22 bp, Artificial Sequence
  Synthetic
agcgaaggaagaugcaaacugt

SEQ ID NO: 94714 - DNA, 21 bp, Artificial Sequence
  Synthetic
aaccagggaaugcugaaggag

SEQ ID NO: 94715 - DNA, 21 bp, Artificial Sequence
  Synthetic
ccatccuggagacacccauca

SEQ ID NO: 94716 - DNA, 23 bp, Artificial Sequence
  Synthetic
ctggacuaacatccguagagacc

SEQ ID NO: 94717 - DNA, 24 bp, Artificial Sequence
  Synthetic
actctcatcaaauccgacatcgut

SEQ ID NO: 94718 - DNA, 27 bp, Artificial Sequence
  Synthetic
tgattgaagcugcaaagaatggaaaug

SEQ ID NO: 94719 - DNA, 27 bp, Artificial Sequence
  Synthetic
caagttgccuacaagtcaatgaaacug

SEQ ID NO: 94720 - DNA, 20 bp, Artificial Sequence
  Synthetic
cctguaccccacccttgtuc

SEQ ID NO: 94721 - DNA, 24 bp, Artificial Sequence
  Synthetic
caccctcaccugacttttcttcuc

SEQ ID NO: 94722 - DNA, 25 bp, Artificial Sequence
  Synthetic
cctggctcagautagagatctcgut

SEQ ID NO: 94723 - DNA, 22 bp, Artificial Sequence
  Synthetic
tgtgaccccuatggaggtcuac

SEQ ID NO: 94724 - DNA, 19 bp, Artificial Sequence
  Synthetic
gctgtcugcttgcatucgg

SEQ ID NO: 94725 - DNA, 21 bp, Artificial Sequence
  Synthetic
cccctctggaugggattgaug

SEQ ID NO: 94726 - DNA, 27 bp, Artificial Sequence
  Synthetic
gcccatataaagagugctccaattuct

SEQ ID NO: 94727 - DNA, 22 bp, Artificial Sequence
  Synthetic
ccttataggcugcgacaucagg

SEQ ID NO: 94728 - DNA, 27 bp, Artificial Sequence
  Synthetic
ggatttctaugggaactcagacatuca

SEQ ID NO: 94729 - DNA, 24 bp, Artificial Sequence
  Synthetic
cttggucagaagaagccaggauat

SEQ ID NO: 94730 - DNA, 22 bp, Artificial Sequence
  Synthetic
tgggttgcuttcatgtgagugt

SEQ ID NO: 94731 - DNA, 21 bp, Artificial Sequence
  Synthetic
cguatgatgtggugggaccat

SEQ ID NO: 94732 - DNA, 25 bp, Artificial Sequence
  Synthetic
aaagatcaccugttctgttgacugt

SEQ ID NO: 94733 - DNA, 22 bp, Artificial Sequence
  Synthetic
ggttttcautgcaggaugacga

SEQ ID NO: 94734 - DNA, 26 bp, Artificial Sequence
  Synthetic
agaagaacgtuccgatcctctauact

SEQ ID NO: 94735 - DNA, 20 bp, Artificial Sequence
  Synthetic
cctgggcugcattggaaaug

SEQ ID NO: 94736 - DNA, 27 bp, Artificial Sequence
  Synthetic
caaataagaactugcaatgaagggugt

SEQ ID NO: 94737 - DNA, 28 bp, Artificial Sequence
  Synthetic
atgtgtgaataauagccactcctttcuc

SEQ ID NO: 94738 - DNA, 32 bp, Artificial Sequence
  Synthetic
atgtactttaguaatttagatttatgucgcct

SEQ ID NO: 94739 - DNA, 28 bp, Artificial Sequence
  Synthetic
gcaactccttauggtatcgaatctttug

SEQ ID NO: 94740 - DNA, 33 bp, Artificial Sequence
  Synthetic
aactacaagtacauttcctaaaatgtattucca

SEQ ID NO: 94741 - DNA, 28 bp, Artificial Sequence
  Synthetic
gagaagttgugagagaattcaugaagga

SEQ ID NO: 94742 - DNA, 21 bp, Artificial Sequence
  Synthetic
gccctucacctatgcaauccc

SEQ ID NO: 94743 - DNA, 26 bp, Artificial Sequence
  Synthetic
ttctctttaccucttcccacctguaa

SEQ ID NO: 94744 - DNA, 27 bp, Artificial Sequence
  Synthetic
caaagucactaaugaacaacacaccaa

SEQ ID NO: 94745 - DNA, 20 bp, Artificial Sequence
  Synthetic
caagaaagcugggcgugaat

SEQ ID NO: 94746 - DNA, 28 bp, Artificial Sequence
  Synthetic
cccttccauaaaggcttuaacacagaat

SEQ ID NO: 94747 - DNA, 26 bp, Artificial Sequence
  Synthetic
ggcatagtuaaaacctgtgtttggut

SEQ ID NO: 94748 - DNA, 24 bp, Artificial Sequence
  Synthetic
caacagggaccugatauacaagca

SEQ ID NO: 94749 - DNA, 26 bp, Artificial Sequence
  Synthetic
gaaattuccacccaagcataactuac

SEQ ID NO: 94750 - DNA, 21 bp, Artificial Sequence
  Synthetic
cttgacctucactccctuggt

SEQ ID NO: 94751 - DNA, 20 bp, Artificial Sequence
  Synthetic
catccctgaucacccctcug

SEQ ID NO: 94752 - DNA, 24 bp, Artificial Sequence
  Synthetic
gttgttctgcaucttcctcuggaa

SEQ ID NO: 94753 - DNA, 23 bp, Artificial Sequence
  Synthetic
cgtaagcaguatgaagaguggct

SEQ ID NO: 94754 - DNA, 27 bp, Artificial Sequence
  Synthetic
tcagtttgaugaaatgaacagctucct

SEQ ID NO: 94755 - DNA, 23 bp, Artificial Sequence
  Synthetic
gttctctggugtctcccaactuc

SEQ ID NO: 94756 - DNA, 22 bp, Artificial Sequence
  Synthetic
gatttggcaugaggactgguct

SEQ ID NO: 94757 - DNA, 23 bp, Artificial Sequence
  Synthetic
catatgcucatcctccuggaaca

SEQ ID NO: 94758 - DNA, 21 bp, Artificial Sequence
  Synthetic
cattugaagcagctgtugggt

SEQ ID NO: 94759 - DNA, 27 bp, Artificial Sequence
  Synthetic
attatgtggtcauggtgaaactactuc

SEQ ID NO: 94760 - DNA, 21 bp, Artificial Sequence
  Synthetic
gcaggccuttcataaggguca

SEQ ID NO: 94761 - DNA, 22 bp, Artificial Sequence
  Synthetic
gactcataugcacgaccctugt

SEQ ID NO: 94762 - DNA, 22 bp, Artificial Sequence
  Synthetic
ttacucctgaagtuggcacagg

SEQ ID NO: 94763 - DNA, 26 bp, Artificial Sequence
  Synthetic
ctcagtcugactctttuggaacaagt

SEQ ID NO: 94764 - DNA, 31 bp, Artificial Sequence
  Synthetic
cattgttagttgtautactacttgacagucc

SEQ ID NO: 94765 - DNA, 28 bp, Artificial Sequence
  Synthetic
gtgccctttgguatgtattctttacuca

SEQ ID NO: 94766 - DNA, 27 bp, Artificial Sequence
  Synthetic
cctgtttaggutattggagtgaugagt

SEQ ID NO: 94767 - DNA, 28 bp, Artificial Sequence
  Synthetic
ccaaaaatatttccugttggcgttctua

SEQ ID NO: 94768 - DNA, 21 bp, Artificial Sequence
  Synthetic
gggcttgaacuggtgtaccua

SEQ ID NO: 94769 - DNA, 28 bp, Artificial Sequence
  Synthetic
aggatggcagtauaacacatcagattuc

SEQ ID NO: 94770 - DNA, 22 bp, Artificial Sequence
  Synthetic
ccactctgguccataagtgcut

SEQ ID NO: 94771 - DNA, 20 bp, Artificial Sequence
  Synthetic
gtccucaagaagcggaccut

SEQ ID NO: 94772 - DNA, 27 bp, Artificial Sequence
  Synthetic
aataatgcaaagaccucccttcucaaa

SEQ ID NO: 94773 - DNA, 28 bp, Artificial Sequence
  Synthetic
gctctcgtattgautcggagcttttuaa

SEQ ID NO: 94774 - DNA, 27 bp, Artificial Sequence
  Synthetic
tgaaatctacaccaaugacacagtucc

SEQ ID NO: 94775 - DNA, 21 bp, Artificial Sequence
  Synthetic
gtgagccacccagcuctttua

SEQ ID NO: 94776 - DNA, 21 bp, Artificial Sequence
  Synthetic
ggucgtgagtuagaggaccca

SEQ ID NO: 94777 - DNA, 25 bp, Artificial Sequence
  Synthetic
agtaccccuacgtctacatctucag

SEQ ID NO: 94778 - DNA, 24 bp, Artificial Sequence
  Synthetic
ccagatuaaaccagatggcugcaa

SEQ ID NO: 94779 - DNA, 24 bp, Artificial Sequence
  Synthetic
agatttgctggauacgtgacauca

SEQ ID NO: 94780 - DNA, 29 bp, Artificial Sequence
  Synthetic
ctgttcatgttcugattctctttgcttua

SEQ ID NO: 94781 - DNA, 22 bp, Artificial Sequence
  Synthetic
gccagagauaacagagctgcut

SEQ ID NO: 94782 - DNA, 24 bp, Artificial Sequence
  Synthetic
aagggacagaaautccaggtctug

SEQ ID NO: 94783 - DNA, 19 bp, Artificial Sequence
  Synthetic
ccccggccuactactgtug

SEQ ID NO: 94784 - DNA, 25 bp, Artificial Sequence
  Synthetic
catctucaagttcagtugcagcaat

SEQ ID NO: 94785 - DNA, 26 bp, Artificial Sequence
  Synthetic
cacagautcgagaaatucaaggcaag

SEQ ID NO: 94786 - DNA, 24 bp, Artificial Sequence
  Synthetic
tttcagtttcugacccatgucaca

SEQ ID NO: 94787 - DNA, 21 bp, Artificial Sequence
  Synthetic
gcagtggccauttcatcugga

SEQ ID NO: 94788 - DNA, 24 bp, Artificial Sequence
  Synthetic
cagctccuaagccagaagaaagut

SEQ ID NO: 94789 - DNA, 22 bp, Artificial Sequence
  Synthetic
gtaaggcccuttttgcagtugg

SEQ ID NO: 94790 - DNA, 21 bp, Artificial Sequence
  Synthetic
agcaacatcaugggcagttug

SEQ ID NO: 94791 - DNA, 25 bp, Artificial Sequence
  Synthetic
cctgatacatgtucccagacaccua

SEQ ID NO: 94792 - DNA, 22 bp, Artificial Sequence
  Synthetic
ctatcaagaggugcaggtguca

SEQ ID NO: 94793 - DNA, 23 bp, Artificial Sequence
  Synthetic
agaacaaacugcaaaaggcccua

SEQ ID NO: 94794 - DNA, 21 bp, Artificial Sequence
  Synthetic
agcttcaucaagagctgccut

SEQ ID NO: 94795 - DNA, 26 bp, Artificial Sequence
  Synthetic
aaagaaatgcatugtgttgggagtuc

SEQ ID NO: 94796 - DNA, 20 bp, Artificial Sequence
  Synthetic
gggctgcugactataugggt

SEQ ID NO: 94797 - DNA, 27 bp, Artificial Sequence
  Synthetic
ctccacgaccugttgtagattcttaut

SEQ ID NO: 94798 - DNA, 22 bp, Artificial Sequence
  Synthetic
catcatacaccuctcgcucaca

SEQ ID NO: 94799 - DNA, 19 bp, Artificial Sequence
  Synthetic
aggtccugctgaugaccca

SEQ ID NO: 94800 - DNA, 29 bp, Artificial Sequence
  Synthetic
acttcagaaataucagctaatgggtcauc

SEQ ID NO: 94801 - DNA, 23 bp, Artificial Sequence
  Synthetic
tgcctcacucagtatctgctgua

SEQ ID NO: 94802 - DNA, 22 bp, Artificial Sequence
  Synthetic
cctccatcucccttggctttug

SEQ ID NO: 94803 - DNA, 23 bp, Artificial Sequence
  Synthetic
gcagggcaugaagaaaactgtut

SEQ ID NO: 94804 - DNA, 25 bp, Artificial Sequence
  Synthetic
acttttgtttccuctcgccagtauc

SEQ ID NO: 94805 - DNA, 25 bp, Artificial Sequence
  Synthetic
ccatcatctcugggaggttactuac

SEQ ID NO: 94806 - DNA, 25 bp, Artificial Sequence
  Synthetic
gcttgtggcuttacaaacacaucat

SEQ ID NO: 94807 - DNA, 22 bp, Artificial Sequence
  Synthetic
ggatacagaguccctugacacc

SEQ ID NO: 94808 - DNA, 24 bp, Artificial Sequence
  Synthetic
cggcuaaatgtgtcugaaagacca

SEQ ID NO: 94809 - DNA, 26 bp, Artificial Sequence
  Synthetic
agggttttacuaggtcctcaaugaca

SEQ ID NO: 94810 - DNA, 21 bp, Artificial Sequence
  Synthetic
ctgctctccugtgaccaaucc

SEQ ID NO: 94811 - DNA, 26 bp, Artificial Sequence
  Synthetic
agaaaagcacacaauggttaucgagt

SEQ ID NO: 94812 - DNA, 23 bp, Artificial Sequence
  Synthetic
cctagctgutcctgaagatuggg

SEQ ID NO: 94813 - DNA, 22 bp, Artificial Sequence
  Synthetic
cccacauccagcagtgaaugaa

SEQ ID NO: 94814 - DNA, 20 bp, Artificial Sequence
  Synthetic
ctacccagcagcuggtacuc

SEQ ID NO: 94815 - DNA, 26 bp, Artificial Sequence
  Synthetic
gcttatttccuccagtctctgttcuc

SEQ ID NO: 94816 - DNA, 21 bp, Artificial Sequence
  Synthetic
gatcactggutccagctgcua

SEQ ID NO: 94817 - DNA, 26 bp, Artificial Sequence
  Synthetic
ttccacgacaaauaatgacccctaug

SEQ ID NO: 94818 - DNA, 23 bp, Artificial Sequence
  Synthetic
acatatttccautgccaggcuga

SEQ ID NO: 94819 - DNA, 26 bp, Artificial Sequence
  Synthetic
agcuaaaatugaagccacacagaaac

SEQ ID NO: 94820 - DNA, 21 bp, Artificial Sequence
  Synthetic
tccgaatgauggtgccaaugt

SEQ ID NO: 94821 - DNA, 21 bp, Artificial Sequence
  Synthetic
cccuacagcaagcagtttgug

SEQ ID NO: 94822 - DNA, 22 bp, Artificial Sequence
  Synthetic
cccutgaaggaugggcaaaaga

SEQ ID NO: 94823 - DNA, 21 bp, Artificial Sequence
  Synthetic
ggcaucaaggcgattgtcugt

SEQ ID NO: 94824 - DNA, 20 bp, Artificial Sequence
  Synthetic
ggtctagcugcgtgaagcug

SEQ ID NO: 94825 - DNA, 17 bp, Artificial Sequence
  Synthetic
atggugcagcgcatgug

SEQ ID NO: 94826 - DNA, 18 bp, Artificial Sequence
  Synthetic
tgaagcugugcagcacca

SEQ ID NO: 94827 - DNA, 17 bp, Artificial Sequence
  Synthetic
cgcugcgagcctuccat

SEQ ID NO: 94828 - DNA, 25 bp, Artificial Sequence
  Synthetic
tcatttgaaggcauggtcatucaga

SEQ ID NO: 94829 - DNA, 27 bp, Artificial Sequence
  Synthetic
tcaggaaucaggagttagugaagaagt

SEQ ID NO: 94830 - DNA, 24 bp, Artificial Sequence
  Synthetic
cgctgttcatcutcggattcacua

SEQ ID NO: 94831 - DNA, 28 bp, Artificial Sequence
  Synthetic
tctgttttaatgucgagtcagtgguaaa

SEQ ID NO: 94832 - DNA, 29 bp, Artificial Sequence
  Synthetic
tgcattcuagaaaaatttgctugacaact

SEQ ID NO: 94833 - DNA, 28 bp, Artificial Sequence
  Synthetic
ggagcagcagauattgatcataaactug

SEQ ID NO: 94834 - DNA, 24 bp, Artificial Sequence
  Synthetic
gctgctcatutttcacctgtucaa

SEQ ID NO: 94835 - DNA, 28 bp, Artificial Sequence
  Synthetic
ccatgatgguagttttcttcctuaacct

SEQ ID NO: 94836 - DNA, 28 bp, Artificial Sequence
  Synthetic
ctctgtagtctgutcttggaaagcauaa

SEQ ID NO: 94837 - DNA, 25 bp, Artificial Sequence
  Synthetic
ccaggattguggatgatcugaaaga

SEQ ID NO: 94838 - DNA, 23 bp, Artificial Sequence
  Synthetic
cctaggtgtguctggaggtttug

SEQ ID NO: 94839 - DNA, 23 bp, Artificial Sequence
  Synthetic
agaagaaautctgcugcaccagt

SEQ ID NO: 94840 - DNA, 25 bp, Artificial Sequence
  Synthetic
catttttctguactgttcggctuca

SEQ ID NO: 94841 - DNA, 27 bp, Artificial Sequence
  Synthetic
ccttggaaaagcaguctaaaaggttut

SEQ ID NO: 94842 - DNA, 21 bp, Artificial Sequence
  Synthetic
gcccagacacucttcucacat

SEQ ID NO: 94843 - DNA, 29 bp, Artificial Sequence
  Synthetic
cttcctctaaccugatgattgtcactuac

SEQ ID NO: 94844 - DNA, 23 bp, Artificial Sequence
  Synthetic
ccggtacugagatgactuggagt

SEQ ID NO: 94845 - DNA, 21 bp, Artificial Sequence
  Synthetic
tgagggagagcugtcttguca

SEQ ID NO: 94846 - DNA, 28 bp, Artificial Sequence
  Synthetic
cctatctcatcgucttatattggctuca

SEQ ID NO: 94847 - DNA, 21 bp, Artificial Sequence
  Synthetic
tctctgggutggagtggaugt

SEQ ID NO: 94848 - DNA, 27 bp, Artificial Sequence
  Synthetic
accgatgauaaaggtgtacagtttucc

SEQ ID NO: 94849 - DNA, 21 bp, Artificial Sequence
  Synthetic
cctcaccgcaagugtttucac

SEQ ID NO: 94850 - DNA, 19 bp, Artificial Sequence
  Synthetic
cctcccgccagcuttcauc

SEQ ID NO: 94851 - DNA, 21 bp, Artificial Sequence
  Synthetic
gaggccaaagutgttgaugcc

SEQ ID NO: 94852 - DNA, 19 bp, Artificial Sequence
  Synthetic
cgctgugagcagcaugaat

SEQ ID NO: 94853 - DNA, 18 bp, Artificial Sequence
  Synthetic
cctccgggcuccatcuga

SEQ ID NO: 94854 - DNA, 21 bp, Artificial Sequence
  Synthetic
catgcucaaccccacttcuct

SEQ ID NO: 94855 - DNA, 21 bp, Artificial Sequence
  Synthetic
gctacaggccutgtcctucat

SEQ ID NO: 94856 - DNA, 20 bp, Artificial Sequence
  Synthetic
caaagcuaccucagcagcga

SEQ ID NO: 94857 - DNA, 23 bp, Artificial Sequence
  Synthetic
tcgtacttgaucttgccgttcug

SEQ ID NO: 94858 - DNA, 21 bp, Artificial Sequence
  Synthetic
ctcaaauggcacagctgctua

SEQ ID NO: 94859 - DNA, 23 bp, Artificial Sequence
  Synthetic
gcttcctucaaagactcctcugg

SEQ ID NO: 94860 - DNA, 22 bp, Artificial Sequence
  Synthetic
ccacagugccttctccttuacc

SEQ ID NO: 94861 - DNA, 20 bp, Artificial Sequence
  Synthetic
agattcauggcttcgucgct

SEQ ID NO: 94862 - DNA, 20 bp, Artificial Sequence
  Synthetic
cuactucccagcagcaggac

SEQ ID NO: 94863 - DNA, 24 bp, Artificial Sequence
  Synthetic
gggttttcaucagctgacucaaga

SEQ ID NO: 94864 - DNA, 21 bp, Artificial Sequence
  Synthetic
cttcccuacccgcugaagaag

SEQ ID NO: 94865 - DNA, 28 bp, Artificial Sequence
  Synthetic
aaagcaagcuaaauacaaacacaagcat

SEQ ID NO: 94866 - DNA, 20 bp, Artificial Sequence
  Synthetic
gggttgaagacugggctugt

SEQ ID NO: 94867 - DNA, 22 bp, Artificial Sequence
  Synthetic
cagacagugatgaaccucagga

SEQ ID NO: 94868 - DNA, 27 bp, Artificial Sequence
  Synthetic
ctgacatgcagaauatattggcagtuc

SEQ ID NO: 94869 - DNA, 25 bp, Artificial Sequence
  Synthetic
tgagattcaugaccggtctgttuac

SEQ ID NO: 94870 - DNA, 23 bp, Artificial Sequence
  Synthetic
aaugaagaaagagtuccccagca

SEQ ID NO: 94871 - DNA, 24 bp, Artificial Sequence
  Synthetic
gtacauggacaggcagacagauac

SEQ ID NO: 94872 - DNA, 25 bp, Artificial Sequence
  Synthetic
aaagctgauggtgatgatguacaga

SEQ ID NO: 94873 - DNA, 28 bp, Artificial Sequence
  Synthetic
tcaaccagtuatgaaatcaguaccaacc

SEQ ID NO: 94874 - DNA, 21 bp, Artificial Sequence
  Synthetic
cctctcagutcccacgcuaat

SEQ ID NO: 94875 - DNA, 25 bp, Artificial Sequence
  Synthetic
agtcttctctgacucactctctcug

SEQ ID NO: 94876 - DNA, 23 bp, Artificial Sequence
  Synthetic
ggcagucaaggagaaacagttut

SEQ ID NO: 94877 - DNA, 21 bp, Artificial Sequence
  Synthetic
gagcagagcutagcugaaggg

SEQ ID NO: 94878 - DNA, 30 bp, Artificial Sequence
  Synthetic
tcaattaggttatuttgaagtggtgtucct

SEQ ID NO: 94879 - DNA, 28 bp, Artificial Sequence
  Synthetic
tgttgtttgtgaugaaggccatattcua

SEQ ID NO: 94880 - DNA, 28 bp, Artificial Sequence
  Synthetic
gctttagaaacagcagaugcttcattut

SEQ ID NO: 94881 - DNA, 28 bp, Artificial Sequence
  Synthetic
cctgtaagaucagcactttaaagggaut

SEQ ID NO: 94882 - DNA, 23 bp, Artificial Sequence
  Synthetic
accctttgucacacgtaucacac

SEQ ID NO: 94883 - DNA, 21 bp, Artificial Sequence
  Synthetic
gtgcagtucccaggactgaut

SEQ ID NO: 94884 - DNA, 25 bp, Artificial Sequence
  Synthetic
ggatatgcugaactaagtugccaca

SEQ ID NO: 94885 - DNA, 21 bp, Artificial Sequence
  Synthetic
ccagagcagggutgagctuac

SEQ ID NO: 94886 - DNA, 23 bp, Artificial Sequence
  Synthetic
cgctgttgcutcttcttctcauc

SEQ ID NO: 94887 - DNA, 22 bp, Artificial Sequence
  Synthetic
acaaagtgucaccctgcaagut

SEQ ID NO: 94888 - DNA, 21 bp, Artificial Sequence
  Synthetic
gtgcttctuaccacccctguc

SEQ ID NO: 94889 - DNA, 23 bp, Artificial Sequence
  Synthetic
tggtatttgguagaggcgacgua

SEQ ID NO: 94890 - DNA, 26 bp, Artificial Sequence
  Synthetic
gtacaactgaugattccactuggaaa

SEQ ID NO: 94891 - DNA, 23 bp, Artificial Sequence
  Synthetic
cagttgcugcatgguagaaaacc

SEQ ID NO: 94892 - DNA, 21 bp, Artificial Sequence
  Synthetic
gtggttucagacacccucaca

SEQ ID NO: 94893 - DNA, 27 bp, Artificial Sequence
  Synthetic
gtgtaccugcaagtgggtaauaaaaga

SEQ ID NO: 94894 - DNA, 24 bp, Artificial Sequence
  Synthetic
caagaacttgaugaatgctguggt

SEQ ID NO: 94895 - DNA, 25 bp, Artificial Sequence
  Synthetic
tctcttcaccaauggctttttcuct

SEQ ID NO: 94896 - DNA, 21 bp, Artificial Sequence
  Synthetic
ctgtgaccutggagacugaca

SEQ ID NO: 94897 - DNA, 23 bp, Artificial Sequence
  Synthetic
tcauaaaggcattuggcaagggt

SEQ ID NO: 94898 - DNA, 25 bp, Artificial Sequence
  Synthetic
aaagaaattaccuctgcctgauccc

SEQ ID NO: 94899 - DNA, 27 bp, Artificial Sequence
  Synthetic
gcagaaaaagcuaaagctggagaacua

SEQ ID NO: 94900 - DNA, 26 bp, Artificial Sequence
  Synthetic
agtgctagccautagtaacauggaag

SEQ ID NO: 94901 - DNA, 26 bp, Artificial Sequence
  Synthetic
cagtatgtgaaaugtggctgacttug

SEQ ID NO: 94902 - DNA, 20 bp, Artificial Sequence
  Synthetic
ctttucagcgacagcggtut

SEQ ID NO: 94903 - DNA, 27 bp, Artificial Sequence
  Synthetic
cutatccttttugaggaagaggaagca

SEQ ID NO: 94904 - DNA, 21 bp, Artificial Sequence
  Synthetic
tgctgctccautgacgactut

SEQ ID NO: 94905 - DNA, 28 bp, Artificial Sequence
  Synthetic
gtgattgcgcuaatggtagaaaaauaca

SEQ ID NO: 94906 - DNA, 32 bp, Artificial Sequence
  Synthetic
ctaagtagtaacccuaaatttgattagctuca

SEQ ID NO: 94907 - DNA, 27 bp, Artificial Sequence
  Synthetic
tgtcttcacauactggatttugccaat

SEQ ID NO: 94908 - DNA, 23 bp, Artificial Sequence
  Synthetic
ttgcataccugaagatuggcaaa

SEQ ID NO: 94909 - DNA, 28 bp, Artificial Sequence
  Synthetic
ctgacattacaucctcatcttcttcuga

SEQ ID NO: 94910 - DNA, 28 bp, Artificial Sequence
  Synthetic
agtatcagatgaugaacaatcttgtcuc

SEQ ID NO: 94911 - DNA, 26 bp, Artificial Sequence
  Synthetic
agggaaaggagauagttgtgactcut

SEQ ID NO: 94912 - DNA, 28 bp, Artificial Sequence
  Synthetic
attggcaggcaaaugaauaaaagaacat

SEQ ID NO: 94913 - DNA, 26 bp, Artificial Sequence
  Synthetic
caattctcattguttcccagcatucc

SEQ ID NO: 94914 - DNA, 27 bp, Artificial Sequence
  Synthetic
gaagtaaaacuctgctcttucccagaa

SEQ ID NO: 94915 - DNA, 28 bp, Artificial Sequence
  Synthetic
tgaugatgcugaaagaaaacaagagaga

SEQ ID NO: 94916 - DNA, 28 bp, Artificial Sequence
  Synthetic
ttcttctctcuaccatatgctccatuct

SEQ ID NO: 94917 - DNA, 28 bp, Artificial Sequence
  Synthetic
tggaacaacugauggagaaaagaaaagt

SEQ ID NO: 94918 - DNA, 23 bp, Artificial Sequence
  Synthetic
cctgctgtgucatggaagaugaa

SEQ ID NO: 94919 - DNA, 23 bp, Artificial Sequence
  Synthetic
ggcagactuagatgctgtccaua

SEQ ID NO: 94920 - DNA, 28 bp, Artificial Sequence
  Synthetic
cctgttgacttcucagcataatcagaua

SEQ ID NO: 94921 - DNA, 27 bp, Artificial Sequence
  Synthetic
cttcatctgauggcactgaaaagtuac

SEQ ID NO: 94922 - DNA, 27 bp, Artificial Sequence
  Synthetic
ggaaaatgacaaauttcttctcgcuca

SEQ ID NO: 94923 - DNA, 26 bp, Artificial Sequence
  Synthetic
agagcgaugaaacttctgaagaugat

SEQ ID NO: 94924 - DNA, 28 bp, Artificial Sequence
  Synthetic
cgcctgagtcuttaaatcatacaaaguc

SEQ ID NO: 94925 - DNA, 27 bp, Artificial Sequence
  Synthetic
agattctgaugaaatgctagcaaucct

SEQ ID NO: 94926 - DNA, 27 bp, Artificial Sequence
  Synthetic
ctcttaattccaugatggtcgtgtcut

SEQ ID NO: 94927 - DNA, 26 bp, Artificial Sequence
  Synthetic
cucttctgaagaugagaaacacagca

SEQ ID NO: 94928 - DNA, 22 bp, Artificial Sequence
  Synthetic
gactcatccugctcacctctut

SEQ ID NO: 94929 - DNA, 27 bp, Artificial Sequence
  Synthetic
aggataagcgtaautcttctgacagug

SEQ ID NO: 94930 - DNA, 27 bp, Artificial Sequence
  Synthetic
gtttaaactgugtaggtggaauagcaa

SEQ ID NO: 94931 - DNA, 27 bp, Artificial Sequence
  Synthetic
tcuagcacaacaaagacacugaaacat

SEQ ID NO: 94932 - DNA, 27 bp, Artificial Sequence
  Synthetic
ctatagcacugtcagaagaatuacgct

SEQ ID NO: 94933 - DNA, 24 bp, Artificial Sequence
  Synthetic
agatccccacgugtaaagacuaca

SEQ ID NO: 94934 - DNA, 25 bp, Artificial Sequence
  Synthetic
cagttccctttutgctctgctttut

SEQ ID NO: 94935 - DNA, 27 bp, Artificial Sequence
  Synthetic
gcaagcatcucaaaaccaaaacatgua

SEQ ID NO: 94936 - DNA, 29 bp, Artificial Sequence
  Synthetic
gcttccctcaccuatagaattctgaucat

SEQ ID NO: 94937 - DNA, 24 bp, Artificial Sequence
  Synthetic
aaagaaggcagucattgucaagga

SEQ ID NO: 94938 - DNA, 19 bp, Artificial Sequence
  Synthetic
ttctgtcggucgccucaag

SEQ ID NO: 94939 - DNA, 21 bp, Artificial Sequence
  Synthetic
ttgtggtcugaaccccaagut

SEQ ID NO: 94940 - DNA, 19 bp, Artificial Sequence
  Synthetic
gcccucagcgagtucaaag

SEQ ID NO: 94941 - DNA, 21 bp, Artificial Sequence
  Synthetic
actggttcaguctgcccatut

SEQ ID NO: 94942 - DNA, 28 bp, Artificial Sequence
  Synthetic
gcttgttctuagggagtttctcttttuc

SEQ ID NO: 94943 - DNA, 27 bp, Artificial Sequence
  Synthetic
aaggaaatacaaaguggctcatcauca

SEQ ID NO: 94944 - DNA, 22 bp, Artificial Sequence
  Synthetic
agctcttagcugatttgcccut

SEQ ID NO: 94945 - DNA, 28 bp, Artificial Sequence
  Synthetic
gatgagtcacagutcttcttcagauact

SEQ ID NO: 94946 - DNA, 28 bp, Artificial Sequence
  Synthetic
gcaatatcagauaagccatcctgtacut

SEQ ID NO: 94947 - DNA, 22 bp, Artificial Sequence
  Synthetic
gcttccacugatggtgtcgaua

SEQ ID NO: 94948 - DNA, 27 bp, Artificial Sequence
  Synthetic
gatgatgaugagccactttgtattucc

SEQ ID NO: 94949 - DNA, 28 bp, Artificial Sequence
  Synthetic
ggaagagacaagautgttcatcatcuga

SEQ ID NO: 94950 - DNA, 23 bp, Artificial Sequence
  Synthetic
cctgtccaaguccacatttcuct

SEQ ID NO: 94951 - DNA, 26 bp, Artificial Sequence
  Synthetic
tcactcctgtutccctttctaatucc

SEQ ID NO: 94952 - DNA, 28 bp, Artificial Sequence
  Synthetic
atgatgagccacuttgtatttcctuagt

SEQ ID NO: 94953 - DNA, 26 bp, Artificial Sequence
  Synthetic
cutggaaagagtucaaggaagagaca

SEQ ID NO: 94954 - DNA, 28 bp, Artificial Sequence
  Synthetic
ttccaatgcaagaugagccttcttaaua

SEQ ID NO: 94955 - DNA, 24 bp, Artificial Sequence
  Synthetic
agccaacaugaactccagttaugt

SEQ ID NO: 94956 - DNA, 28 bp, Artificial Sequence
  Synthetic
caaatttgagaacugtagggtcattgug

SEQ ID NO: 94957 - DNA, 23 bp, Artificial Sequence
  Synthetic
tgtgcaccgcutactaggatcua

SEQ ID NO: 94958 - DNA, 19 bp, Artificial Sequence
  Synthetic
ctcgaccucgccgattcut

SEQ ID NO: 94959 - DNA, 20 bp, Artificial Sequence
  Synthetic
gggcgtacucaccttctucc

SEQ ID NO: 94960 - DNA, 27 bp, Artificial Sequence
  Synthetic
gatttctgaattauctgttgcctgcut

SEQ ID NO: 94961 - DNA, 28 bp, Artificial Sequence
  Synthetic
gaaattagatgatucctgttctggcuct

SEQ ID NO: 94962 - DNA, 26 bp, Artificial Sequence
  Synthetic
agtgcggaauaagagtaggtuacaga

SEQ ID NO: 94963 - DNA, 29 bp, Artificial Sequence
  Synthetic
cagttgutgcagcaaaauaagaagaagat

SEQ ID NO: 94964 - DNA, 28 bp, Artificial Sequence
  Synthetic
gagccagaacaggaaucatctaattuct

SEQ ID NO: 94965 - DNA, 28 bp, Artificial Sequence
  Synthetic
gagaattuagaacagttgtugcagcaaa

SEQ ID NO: 94966 - DNA, 28 bp, Artificial Sequence
  Synthetic
tcttcttcttatttugctgcaacaacug

SEQ ID NO: 94967 - DNA, 24 bp, Artificial Sequence
  Synthetic
ggtcgaaaggagutgtccacaaua

SEQ ID NO: 94968 - DNA, 22 bp, Artificial Sequence
  Synthetic
gactauacgccagcatgtuacc

SEQ ID NO: 94969 - DNA, 24 bp, Artificial Sequence
  Synthetic
gctgaagcagccuaatgtaccaut

SEQ ID NO: 94970 - DNA, 19 bp, Artificial Sequence
  Synthetic
cggcaggguctggguaaga

SEQ ID NO: 94971 - DNA, 20 bp, Artificial Sequence
  Synthetic
cgcttgtccucctccgagua

SEQ ID NO: 94972 - DNA, 28 bp, Artificial Sequence
  Synthetic
atggtgttuaaaagaagtaaccctucca

SEQ ID NO: 94973 - DNA, 23 bp, Artificial Sequence
  Synthetic
ggaaagaucgcctucaaccagag

SEQ ID NO: 94974 - DNA, 22 bp, Artificial Sequence
  Synthetic
agagcacgutcaucaagcagat

SEQ ID NO: 94975 - DNA, 21 bp, Artificial Sequence
  Synthetic
gctcacctugttctgctcgua

SEQ ID NO: 94976 - DNA, 29 bp, Artificial Sequence
  Synthetic
tggcttatcttugatacgtcgttcuaaaa

SEQ ID NO: 94977 - DNA, 28 bp, Artificial Sequence
  Synthetic
tgtgagtguaagccaataugaagaacaa

SEQ ID NO: 94978 - DNA, 18 bp, Artificial Sequence
  Synthetic
cgccaugcaggccaugat

SEQ ID NO: 94979 - DNA, 19 bp, Artificial Sequence
  Synthetic
caccaugcucaccaccaag

SEQ ID NO: 94980 - DNA, 26 bp, Artificial Sequence
  Synthetic
tgctttagtugcatcattgucagagt

SEQ ID NO: 94981 - DNA, 27 bp, Artificial Sequence
  Synthetic
tcaggccaautaattttatggtuccct

SEQ ID NO: 94982 - DNA, 21 bp, Artificial Sequence
  Synthetic
tcaccautgcttgtuggagga

SEQ ID NO: 94983 - DNA, 22 bp, Artificial Sequence
  Synthetic
cagatgtcccauccatgggtut

SEQ ID NO: 94984 - DNA, 24 bp, Artificial Sequence
  Synthetic
ccucacattctuccaccagagaag

SEQ ID NO: 94985 - DNA, 23 bp, Artificial Sequence
  Synthetic
cugggataaaagtugcagcaagg

SEQ ID NO: 94986 - DNA, 21 bp, Artificial Sequence
  Synthetic
gcaaccatucctgaaggcuga

SEQ ID NO: 94987 - DNA, 20 bp, Artificial Sequence
  Synthetic
ggcccccgauagagtttucc

SEQ ID NO: 94988 - DNA, 28 bp, Artificial Sequence
  Synthetic
tggccaaattugaaaattgatactgcut

SEQ ID NO: 94989 - DNA, 25 bp, Artificial Sequence
  Synthetic
cccccatctuaaagaacagacauga

SEQ ID NO: 94990 - DNA, 19 bp, Artificial Sequence
  Synthetic
gagtugaacccagccguga

SEQ ID NO: 94991 - DNA, 22 bp, Artificial Sequence
  Synthetic
tgtttcaggcccaucagtgtut

SEQ ID NO: 94992 - DNA, 28 bp, Artificial Sequence
  Synthetic
gcaauacgaccaacaagatcaauacaat

SEQ ID NO: 94993 - DNA, 28 bp, Artificial Sequence
  Synthetic
aggaaagugaacaaaagttgcaatucaa

SEQ ID NO: 94994 - DNA, 21 bp, Artificial Sequence
  Synthetic
ccattccagcccugagtctua

SEQ ID NO: 94995 - DNA, 21 bp, Artificial Sequence
  Synthetic
acttggttcucccctcuccag

SEQ ID NO: 94996 - DNA, 25 bp, Artificial Sequence
  Synthetic
gatttatuggaccacatgcugacac

SEQ ID NO: 94997 - DNA, 20 bp, Artificial Sequence
  Synthetic
tcgucuaaggcccagggaaa

SEQ ID NO: 94998 - DNA, 24 bp, Artificial Sequence
  Synthetic
tcttcacagcauttgataguggct

SEQ ID NO: 94999 - DNA, 27 bp, Artificial Sequence
  Synthetic
gcaggttcaauttgttttacttgugat

SEQ ID NO: 95000 - DNA, 19 bp, Artificial Sequence
  Synthetic
ggagcuccuacagaggcat

SEQ ID NO: 95001 - DNA, 21 bp, Artificial Sequence
  Synthetic
gtgccggaucctcaagaacut

SEQ ID NO: 95002 - DNA, 26 bp, Artificial Sequence
  Synthetic
tgatagagttgugagactgggtagut

SEQ ID NO: 95003 - DNA, 29 bp, Artificial Sequence
  Synthetic
tgaautagctaguagggagaagacagaag

SEQ ID NO: 95004 - DNA, 22 bp, Artificial Sequence
  Synthetic
gaggauggcatacagugacgag

SEQ ID NO: 95005 - DNA, 23 bp, Artificial Sequence
  Synthetic
cctgggtguctgtctcatuagga

SEQ ID NO: 95006 - DNA, 21 bp, Artificial Sequence
  Synthetic
ccccguccaaacaggactuat

SEQ ID NO: 95007 - DNA, 21 bp, Artificial Sequence
  Synthetic
gtaacugctggacuccccaag

SEQ ID NO: 95008 - DNA, 24 bp, Artificial Sequence
  Synthetic
gctttgtcacucagtcaggauact

SEQ ID NO: 95009 - DNA, 21 bp, Artificial Sequence
  Synthetic
gcctgacauccctgactcugt

SEQ ID NO: 95010 - DNA, 23 bp, Artificial Sequence
  Synthetic
ggttgattcugtggctacugacc

SEQ ID NO: 95011 - DNA, 27 bp, Artificial Sequence
  Synthetic
tctgggtgaauaatacagcattugcat

SEQ ID NO: 95012 - DNA, 23 bp, Artificial Sequence
  Synthetic
gcccaacucagtcttctgctuat

SEQ ID NO: 95013 - DNA, 27 bp, Artificial Sequence
  Synthetic
gaaaggaatcuttcaggacacugaagt

SEQ ID NO: 95014 - DNA, 29 bp, Artificial Sequence
  Synthetic
cgacacagaaatauttgtagctcacctut

SEQ ID NO: 95015 - DNA, 22 bp, Artificial Sequence
  Synthetic
ttgtttucagccagtcccucat

SEQ ID NO: 95016 - DNA, 21 bp, Artificial Sequence
  Synthetic
ggaccttcucaggctctcuga

SEQ ID NO: 95017 - DNA, 22 bp, Artificial Sequence
  Synthetic
gtaccacagaautgctgctucc

SEQ ID NO: 95018 - DNA, 25 bp, Artificial Sequence
  Synthetic
gtcctggattuttgcttctcatugg

SEQ ID NO: 95019 - DNA, 27 bp, Artificial Sequence
  Synthetic
cccccaaattugatcatgaatcctuct

SEQ ID NO: 95020 - DNA, 28 bp, Artificial Sequence
  Synthetic
ttcttagautgttcacgtucagacaact

SEQ ID NO: 95021 - DNA, 28 bp, Artificial Sequence
  Synthetic
caccgcaaguaatactgtttuaaagcaa

SEQ ID NO: 95022 - DNA, 22 bp, Artificial Sequence
  Synthetic
agaagttgutctaacgcugcct

SEQ ID NO: 95023 - DNA, 23 bp, Artificial Sequence
  Synthetic
gaactgtttggugtgcaaggtut

SEQ ID NO: 95024 - DNA, 27 bp, Artificial Sequence
  Synthetic
tcctctcatatcaauctgctggtagut

SEQ ID NO: 95025 - DNA, 22 bp, Artificial Sequence
  Synthetic
gctccagcagcaguacaaucag

SEQ ID NO: 95026 - DNA, 26 bp, Artificial Sequence
  Synthetic
tgataagtcattugttgctgttgcug

SEQ ID NO: 95027 - DNA, 25 bp, Artificial Sequence
  Synthetic
ttttgagacaggucatgcacttgua

SEQ ID NO: 95028 - DNA, 17 bp, Artificial Sequence
  Synthetic
gcggcgcutcucggaaa

SEQ ID NO: 95029 - DNA, 20 bp, Artificial Sequence
  Synthetic
gggaggauguggaggagacc

SEQ ID NO: 95030 - DNA, 17 bp, Artificial Sequence
  Synthetic
cgcugaggcuccaggac

SEQ ID NO: 95031 - DNA, 20 bp, Artificial Sequence
  Synthetic
tguccgcacgtucaagaaca

SEQ ID NO: 95032 - DNA, 20 bp, Artificial Sequence
  Synthetic
gctgcuctcaacaugcgagt

SEQ ID NO: 95033 - DNA, 20 bp, Artificial Sequence
  Synthetic
tccgcttgugtctccagtug

SEQ ID NO: 95034 - DNA, 22 bp, Artificial Sequence
  Synthetic
tctaccccucatgaagtugcct

SEQ ID NO: 95035 - DNA, 26 bp, Artificial Sequence
  Synthetic
ggattatguacaagccacttccuaca

SEQ ID NO: 95036 - DNA, 27 bp, Artificial Sequence
  Synthetic
ggagatggacuttgagtactuggagat

SEQ ID NO: 95037 - DNA, 20 bp, Artificial Sequence
  Synthetic
cccagctuggtaagcagcuc

SEQ ID NO: 95038 - DNA, 23 bp, Artificial Sequence
  Synthetic
ctttctcatcugtaccccacguc

SEQ ID NO: 95039 - DNA, 27 bp, Artificial Sequence
  Synthetic
gactccaatccuaacgaaaatgaucca

SEQ ID NO: 95040 - DNA, 24 bp, Artificial Sequence
  Synthetic
atttatuaaggcaccagccugagt

SEQ ID NO: 95041 - DNA, 27 bp, Artificial Sequence
  Synthetic
ggaaatgtugcttttgtcaugaagaag

SEQ ID NO: 95042 - DNA, 25 bp, Artificial Sequence
  Synthetic
cttauccagacaaatuccagggact

SEQ ID NO: 95043 - DNA, 21 bp, Artificial Sequence
  Synthetic
tgcctgucacaactugggaaa

SEQ ID NO: 95044 - DNA, 28 bp, Artificial Sequence
  Synthetic
gaaaagaatatatguggctatccgguga

SEQ ID NO: 95045 - DNA, 24 bp, Artificial Sequence
  Synthetic
cttgtacaugcaacctuggaaaca

SEQ ID NO: 95046 - DNA, 26 bp, Artificial Sequence
  Synthetic
ggaatccagutcagaaatcugagcaa

SEQ ID NO: 95047 - DNA, 27 bp, Artificial Sequence
  Synthetic
actgtgtcagtutgtaatggtaagugt

SEQ ID NO: 95048 - DNA, 23 bp, Artificial Sequence
  Synthetic
tggtccatcugtcaatccaucac

SEQ ID NO: 95049 - DNA, 28 bp, Artificial Sequence
  Synthetic
gaagtggagcautcatattgtaauccct

SEQ ID NO: 95050 - DNA, 21 bp, Artificial Sequence
  Synthetic
tgacaccucacttccttugcc

SEQ ID NO: 95051 - DNA, 22 bp, Artificial Sequence
  Synthetic
gcggccaagugttacacaaaut

SEQ ID NO: 95052 - DNA, 24 bp, Artificial Sequence
  Synthetic
acaaggtggtutaaatgtccccut

SEQ ID NO: 95053 - DNA, 22 bp, Artificial Sequence
  Synthetic
cagatgagcugaaggugacagt

SEQ ID NO: 95054 - DNA, 18 bp, Artificial Sequence
  Synthetic
gtccugcgaaggcactug

SEQ ID NO: 95055 - DNA, 21 bp, Artificial Sequence
  Synthetic
ttttcatuggcagccccacua

SEQ ID NO: 95056 - DNA, 22 bp, Artificial Sequence
  Synthetic
cttagcuccagggtgtcaacut

SEQ ID NO: 95057 - DNA, 22 bp, Artificial Sequence
  Synthetic
cucctgucgaaaagcgagaaga

SEQ ID NO: 95058 - DNA, 19 bp, Artificial Sequence
  Synthetic
cguccgcagagguagacaa

SEQ ID NO: 95059 - DNA, 19 bp, Artificial Sequence
  Synthetic
agcccguaagacugaccga

SEQ ID NO: 95060 - DNA, 20 bp, Artificial Sequence
  Synthetic
gggaaugcggagatguaggg

SEQ ID NO: 95061 - DNA, 20 bp, Artificial Sequence
  Synthetic
ctagtggguggcctctctug

SEQ ID NO: 95062 - DNA, 21 bp, Artificial Sequence
  Synthetic
tcgccaaagagcuacccatuc

SEQ ID NO: 95063 - DNA, 19 bp, Artificial Sequence
  Synthetic
gggagagcuatgggctguc

SEQ ID NO: 95064 - DNA, 28 bp, Artificial Sequence
  Synthetic
tttggcttttctucctccttcattttuc

SEQ ID NO: 95065 - DNA, 22 bp, Artificial Sequence
  Synthetic
aggagtttucggagctcttcuc

SEQ ID NO: 95066 - DNA, 20 bp, Artificial Sequence
  Synthetic
cttagccgaggcutcagcut

SEQ ID NO: 95067 - DNA, 24 bp, Artificial Sequence
  Synthetic
tcaguacagcaacaacatcuccac

SEQ ID NO: 95068 - DNA, 21 bp, Artificial Sequence
  Synthetic
acctctgugggacatccctua

SEQ ID NO: 95069 - DNA, 25 bp, Artificial Sequence
  Synthetic
cttgtatguagcgaacgcactttut

SEQ ID NO: 95070 - DNA, 17 bp, Artificial Sequence
  Synthetic
cgacggagggcguagug

SEQ ID NO: 95071 - DNA, 19 bp, Artificial Sequence
  Synthetic
cctugggcaagccucaaag

SEQ ID NO: 95072 - DNA, 25 bp, Artificial Sequence
  Synthetic
cgaacugatttcctucaaagacgag

SEQ ID NO: 95073 - DNA, 23 bp, Artificial Sequence
  Synthetic
cggaggagcugttttgattcgut

SEQ ID NO: 95074 - DNA, 27 bp, Artificial Sequence
  Synthetic
acttcccttguctgtggttagauaagt

SEQ ID NO: 95075 - DNA, 26 bp, Artificial Sequence
  Synthetic
aaccatgccaaaagutgtaccuagaa

SEQ ID NO: 95076 - DNA, 29 bp, Artificial Sequence
  Synthetic
gtcaaatcgtcuctagtcaatgaaucaga

SEQ ID NO: 95077 - DNA, 24 bp, Artificial Sequence
  Synthetic
cgattuctccccttucagcaacat

SEQ ID NO: 95078 - DNA, 23 bp, Artificial Sequence
  Synthetic
cctgtggcuactgtgtagttugt

SEQ ID NO: 95079 - DNA, 22 bp, Artificial Sequence
  Synthetic
ccatgcgttucactttcccuca

SEQ ID NO: 95080 - DNA, 26 bp, Artificial Sequence
  Synthetic
gataactctcucccctgtttcuagga

SEQ ID NO: 95081 - DNA, 22 bp, Artificial Sequence
  Synthetic
gtctgctcaguctgtgactugg

SEQ ID NO: 95082 - DNA, 18 bp, Artificial Sequence
  Synthetic
cccuccccgaacctgcua

SEQ ID NO: 95083 - DNA, 17 bp, Artificial Sequence
  Synthetic
ccttgugggtggccuca

SEQ ID NO: 95084 - DNA, 17 bp, Artificial Sequence
  Synthetic
gctgucgctcgucacca

SEQ ID NO: 95085 - DNA, 27 bp, Artificial Sequence
  Synthetic
aatgtagccacauggcacaaaatuaag

SEQ ID NO: 95086 - DNA, 27 bp, Artificial Sequence
  Synthetic
caattctagguacaacttttggcaugg

SEQ ID NO: 95087 - DNA, 23 bp, Artificial Sequence
  Synthetic
tgacucaggtctgtuagggaact

SEQ ID NO: 95088 - DNA, 18 bp, Artificial Sequence
  Synthetic
aggcaccguggcuagaga

SEQ ID NO: 95089 - DNA, 19 bp, Artificial Sequence
  Synthetic
cctgtccuctacccuggca

SEQ ID NO: 95090 - DNA, 19 bp, Artificial Sequence
  Synthetic
ggttggccccugaggttug

SEQ ID NO: 95091 - DNA, 24 bp, Artificial Sequence
  Synthetic
ccttatcuacaggaccagtcctug

SEQ ID NO: 95092 - DNA, 23 bp, Artificial Sequence
  Synthetic
ctctacctgcuccactctacuca

SEQ ID NO: 95093 - DNA, 20 bp, Artificial Sequence
  Synthetic
agaagcuacuccgggcaaag

SEQ ID NO: 95094 - DNA, 19 bp, Artificial Sequence
  Synthetic
gatgguggaggtgugggat

SEQ ID NO: 95095 - DNA, 18 bp, Artificial Sequence
  Synthetic
gggcugccaaccucaact

SEQ ID NO: 95096 - DNA, 28 bp, Artificial Sequence
  Synthetic
ggacatugaaaaagaacaaagucacagt

SEQ ID NO: 95097 - DNA, 21 bp, Artificial Sequence
  Synthetic
ctgcacautcttggcugcaaa

SEQ ID NO: 95098 - DNA, 23 bp, Artificial Sequence
  Synthetic
tttcccagtuggagtcattcgut

SEQ ID NO: 95099 - DNA, 22 bp, Artificial Sequence
  Synthetic
ggcaggcaaaaggutcaagaug

SEQ ID NO: 95100 - DNA, 20 bp, Artificial Sequence
  Synthetic
cugtctgtgguccagggaag

SEQ ID NO: 95101 - DNA, 20 bp, Artificial Sequence
  Synthetic
cagcuacaggcactccucat

SEQ ID NO: 95102 - DNA, 33 bp, Artificial Sequence
  Synthetic
caaatgctaatacuaaaaatgagatacctucct

SEQ ID NO: 95103 - DNA, 26 bp, Artificial Sequence
  Synthetic
gacaagagucgacacaatttuggaat

SEQ ID NO: 95104 - DNA, 28 bp, Artificial Sequence
  Synthetic
cagatttuaaaaccaccacttgctuact

SEQ ID NO: 95105 - DNA, 25 bp, Artificial Sequence
  Synthetic
gcaaagaatggcucaagaagtacug

SEQ ID NO: 95106 - DNA, 18 bp, Artificial Sequence
  Synthetic
ggcgtacugcctgacuct

SEQ ID NO: 95107 - DNA, 18 bp, Artificial Sequence
  Synthetic
tgggucagctucgagcac

SEQ ID NO: 95108 - DNA, 18 bp, Artificial Sequence
  Synthetic
gcccagcuctccccaaua

SEQ ID NO: 95109 - DNA, 19 bp, Artificial Sequence
  Synthetic
gugggagugggaaggaagg

SEQ ID NO: 95110 - DNA, 20 bp, Artificial Sequence
  Synthetic
cccagugctgagtugcacat

SEQ ID NO: 95111 - DNA, 20 bp, Artificial Sequence
  Synthetic
gagcccagucagugaagagg

SEQ ID NO: 95112 - DNA, 26 bp, Artificial Sequence
  Synthetic
gcatcaggaugctcctttaaatgugt

SEQ ID NO: 95113 - DNA, 26 bp, Artificial Sequence
  Synthetic
gaatttgtgccutgctcagtagttut

SEQ ID NO: 95114 - DNA, 27 bp, Artificial Sequence
  Synthetic
acccttttcttcutcattgctcttuca

SEQ ID NO: 95115 - DNA, 28 bp, Artificial Sequence
  Synthetic
gaacaugattctctttuggaccacaaag

SEQ ID NO: 95116 - DNA, 22 bp, Artificial Sequence
  Synthetic
gcaacaccucttttcccaucct

SEQ ID NO: 95117 - DNA, 28 bp, Artificial Sequence
  Synthetic
gatcagggatggaucgaactttaatcuc

SEQ ID NO: 95118 - DNA, 20 bp, Artificial Sequence
  Synthetic
cccctatuggctccccatug

SEQ ID NO: 95119 - DNA, 21 bp, Artificial Sequence
  Synthetic
ctggaccaggugaauggacag

SEQ ID NO: 95120 - DNA, 26 bp, Artificial Sequence
  Synthetic
gctgcttttcuttcttcttcagucaa

SEQ ID NO: 95121 - DNA, 29 bp, Artificial Sequence
  Synthetic
ttgtctcttattucaacccctcuaaacag

SEQ ID NO: 95122 - DNA, 28 bp, Artificial Sequence
  Synthetic
ggagaatgugatatttctgcauagggaa

SEQ ID NO: 95123 - DNA, 21 bp, Artificial Sequence
  Synthetic
gagccctgucagcaatgagua

SEQ ID NO: 95124 - DNA, 21 bp, Artificial Sequence
  Synthetic
gaggttccugcttgatgcuga

SEQ ID NO: 95125 - DNA, 20 bp, Artificial Sequence
  Synthetic
gggaucccccagacaaccua

SEQ ID NO: 95126 - DNA, 22 bp, Artificial Sequence
  Synthetic
caactcaccuccagctgtugat

SEQ ID NO: 95127 - DNA, 21 bp, Artificial Sequence
  Synthetic
gggacugaccatgcgttucaa

SEQ ID NO: 95128 - DNA, 24 bp, Artificial Sequence
  Synthetic
aagcatatcgcaugccactcuaat

SEQ ID NO: 95129 - DNA, 26 bp, Artificial Sequence
  Synthetic
gcctctacttcuacaggatctttugg

SEQ ID NO: 95130 - DNA, 20 bp, Artificial Sequence
  Synthetic
ctgctctggcutctgggtut

SEQ ID NO: 95131 - DNA, 18 bp, Artificial Sequence
  Synthetic
tcccucccacccauccag

SEQ ID NO: 95132 - DNA, 25 bp, Artificial Sequence
  Synthetic
gggtaaattggucccagttggtaug

SEQ ID NO: 95133 - DNA, 27 bp, Artificial Sequence
  Synthetic
cctggatctgagaaugtggattcttut

SEQ ID NO: 95134 - DNA, 25 bp, Artificial Sequence
  Synthetic
gggaatgaaguttccatgtcucaga

SEQ ID NO: 95135 - DNA, 25 bp, Artificial Sequence
  Synthetic
actgggccaagcauatattgaacug

SEQ ID NO: 95136 - DNA, 18 bp, Artificial Sequence
  Synthetic
ctucaggagccagucggt

SEQ ID NO: 95137 - DNA, 20 bp, Artificial Sequence
  Synthetic
ctggtccugcccagttcaut

SEQ ID NO: 95138 - DNA, 26 bp, Artificial Sequence
  Synthetic
ttcttggcaautttgaagttcugcaa

SEQ ID NO: 95139 - DNA, 23 bp, Artificial Sequence
  Synthetic
aattctgtuccacgacaggatuc

SEQ ID NO: 95140 - DNA, 20 bp, Artificial Sequence
  Synthetic
actcugccgctcccuaagat

SEQ ID NO: 95141 - DNA, 21 bp, Artificial Sequence
  Synthetic
gcaggatuggagggttcugag

SEQ ID NO: 95142 - DNA, 20 bp, Artificial Sequence
  Synthetic
agccagccacaaaugccuaa

SEQ ID NO: 95143 - DNA, 22 bp, Artificial Sequence
  Synthetic
agccattaccugttgctgcaua

SEQ ID NO: 95144 - DNA, 20 bp, Artificial Sequence
  Synthetic
tccaaccggcagcaauguat

SEQ ID NO: 95145 - DNA, 28 bp, Artificial Sequence
  Synthetic
gaacaaaaactcuaccaccattcctuac

SEQ ID NO: 95146 - DNA, 24 bp, Artificial Sequence
  Synthetic
tcccagtccuttctgtacattgug

SEQ ID NO: 95147 - DNA, 21 bp, Artificial Sequence
  Synthetic
ccatgucagctcgcttuccat

SEQ ID NO: 95148 - DNA, 23 bp, Artificial Sequence
  Synthetic
caccctgaguaacttggctaugt

SEQ ID NO: 95149 - DNA, 22 bp, Artificial Sequence
  Synthetic
cagugctaucacagaagcccat

SEQ ID NO: 95150 - DNA, 20 bp, Artificial Sequence
  Synthetic
ccgucaggagccctatguct

SEQ ID NO: 95151 - DNA, 28 bp, Artificial Sequence
  Synthetic
tccacagcuaagaagatcagtatctgua

SEQ ID NO: 95152 - DNA, 21 bp, Artificial Sequence
  Synthetic
ccaagttcagguccaggagut

SEQ ID NO: 95153 - DNA, 21 bp, Artificial Sequence
  Synthetic
gtaggaggcucccaagcttuc

SEQ ID NO: 95154 - DNA, 23 bp, Artificial Sequence
  Synthetic
ctgctgttcutgcctttctugat

SEQ ID NO: 95155 - DNA, 22 bp, Artificial Sequence
  Synthetic
ggccucaaacaagtcagtcugg

SEQ ID NO: 95156 - DNA, 21 bp, Artificial Sequence
  Synthetic
ccutcttgtcaucagggccaa

SEQ ID NO: 95157 - DNA, 21 bp, Artificial Sequence
  Synthetic
gtgtgtggcugacagaaacug

SEQ ID NO: 95158 - DNA, 21 bp, Artificial Sequence
  Synthetic
tgactcaccuggctcttucac

SEQ ID NO: 95159 - DNA, 22 bp, Artificial Sequence
  Synthetic
tggtaaagccugtgggtgagua

SEQ ID NO: 95160 - DNA, 19 bp, Artificial Sequence
  Synthetic
acatggaagguggcauggt

SEQ ID NO: 95161 - DNA, 18 bp, Artificial Sequence
  Synthetic
ccagcucatgcccuccag

SEQ ID NO: 95162 - DNA, 20 bp, Artificial Sequence
  Synthetic
tggucaggtuacgcagcaag

SEQ ID NO: 95163 - DNA, 25 bp, Artificial Sequence
  Synthetic
tgtctcagcuaaggacataggtuga

SEQ ID NO: 95164 - DNA, 22 bp, Artificial Sequence
  Synthetic
gggtccagacaugctactggua

SEQ ID NO: 95165 - DNA, 28 bp, Artificial Sequence
  Synthetic
cagtagtctcuagggtaaaccatgttut

SEQ ID NO: 95166 - DNA, 29 bp, Artificial Sequence
  Synthetic
tgtgagttattuaaaggcctaggcatauc

SEQ ID NO: 95167 - DNA, 26 bp, Artificial Sequence
  Synthetic
gatttggattuccaggaggtagucat

SEQ ID NO: 95168 - DNA, 20 bp, Artificial Sequence
  Synthetic
gctcttgacucggcatggua

SEQ ID NO: 95169 - DNA, 28 bp, Artificial Sequence
  Synthetic
atttggcaacatuttgtatgtacagtut

SEQ ID NO: 95170 - DNA, 17 bp, Artificial Sequence
  Synthetic
ggauggagccaggcgut

SEQ ID NO: 95171 - DNA, 17 bp, Artificial Sequence
  Synthetic
ccugcccaggccatguc

SEQ ID NO: 95172 - DNA, 29 bp, Artificial Sequence
  Synthetic
tttgagttcattcutgctgagtttgttut

SEQ ID NO: 95173 - DNA, 23 bp, Artificial Sequence
  Synthetic
caaaaucagcaaccggguaacag

SEQ ID NO: 95174 - DNA, 20 bp, Artificial Sequence
  Synthetic
aagagcccucatguggcaaa

SEQ ID NO: 95175 - DNA, 22 bp, Artificial Sequence
  Synthetic
gctcatugaggacctgtuggag

SEQ ID NO: 95176 - DNA, 21 bp, Artificial Sequence
  Synthetic
aggatagggugctcgctgaua

SEQ ID NO: 95177 - DNA, 24 bp, Artificial Sequence
  Synthetic
tctatccttccucactgcccuaag

SEQ ID NO: 95178 - DNA, 18 bp, Artificial Sequence
  Synthetic
cgaggcaacauggtucgg

SEQ ID NO: 95179 - DNA, 24 bp, Artificial Sequence
  Synthetic
actaaggaaggccaguagcaauct

SEQ ID NO: 95180 - DNA, 22 bp, Artificial Sequence
  Synthetic
gtttaccugcacacccugagaa

SEQ ID NO: 95181 - DNA, 23 bp, Artificial Sequence
  Synthetic
tccccauccaatcatgtgucaag

SEQ ID NO: 95182 - DNA, 21 bp, Artificial Sequence
  Synthetic
catccgccucataccugacat

SEQ ID NO: 95183 - DNA, 20 bp, Artificial Sequence
  Synthetic
aggatgccutccgagatgug

SEQ ID NO: 95184 - DNA, 22 bp, Artificial Sequence
  Synthetic
agattgctagacuccacccugt

SEQ ID NO: 95185 - DNA, 28 bp, Artificial Sequence
  Synthetic
tgaacgcaccutatagtaaacagttugt

SEQ ID NO: 95186 - DNA, 23 bp, Artificial Sequence
  Synthetic
gagacugagaggcagtgtttuca

SEQ ID NO: 95187 - DNA, 27 bp, Artificial Sequence
  Synthetic
gccaagctcuatgtctacatcaaugag

SEQ ID NO: 95188 - DNA, 22 bp, Artificial Sequence
  Synthetic
cggugctaugaaaggaggcaaa

SEQ ID NO: 95189 - DNA, 28 bp, Artificial Sequence
  Synthetic
ctccagttctcucaagtttacttgcuaa

SEQ ID NO: 95190 - DNA, 25 bp, Artificial Sequence
  Synthetic
ggcaaaacttgcutgtgtgtgtaua

SEQ ID NO: 95191 - DNA, 21 bp, Artificial Sequence
  Synthetic
cagctguacttagtccugcga

SEQ ID NO: 95192 - DNA, 20 bp, Artificial Sequence
  Synthetic
cgctccugtaacctgaugcc

SEQ ID NO: 95193 - DNA, 20 bp, Artificial Sequence
  Synthetic
gcatugagcggctcaucaac

SEQ ID NO: 95194 - DNA, 20 bp, Artificial Sequence
  Synthetic
ggcctugagaacagugcaga

SEQ ID NO: 95195 - DNA, 21 bp, Artificial Sequence
  Synthetic
gtgcccacuctctgttttugg

SEQ ID NO: 95196 - DNA, 21 bp, Artificial Sequence
  Synthetic
gcaatggagutggctgagugt

SEQ ID NO: 95197 - DNA, 29 bp, Artificial Sequence
  Synthetic
caggaccctacuagtcttttaatcttgut

SEQ ID NO: 95198 - DNA, 22 bp, Artificial Sequence
  Synthetic
gtactgcgaugacttggaguga

SEQ ID NO: 95199 - DNA, 29 bp, Artificial Sequence
  Synthetic
actcagaggtatcutcagttttccttgua

SEQ ID NO: 95200 - DNA, 23 bp, Artificial Sequence
  Synthetic
cccuagagaggatgtugcagaac

SEQ ID NO: 95201 - DNA, 23 bp, Artificial Sequence
  Synthetic
ttccccugaaccttctagtucct

SEQ ID NO: 95202 - DNA, 24 bp, Artificial Sequence
  Synthetic
ccccatagucagggaaggtaucag

SEQ ID NO: 95203 - DNA, 22 bp, Artificial Sequence
  Synthetic
cctcttugggcgactatgugag

SEQ ID NO: 95204 - DNA, 25 bp, Artificial Sequence
  Synthetic
tgctgtctgcaucttacaaagtuca

SEQ ID NO: 95205 - DNA, 20 bp, Artificial Sequence
  Synthetic
gatggcugactggttcucct

SEQ ID NO: 95206 - DNA, 26 bp, Artificial Sequence
  Synthetic
gataccactgtutcaggttcctcuaa

SEQ ID NO: 95207 - DNA, 28 bp, Artificial Sequence
  Synthetic
agacctgaaaaugtcttctgaagugaag

SEQ ID NO: 95208 - DNA, 23 bp, Artificial Sequence
  Synthetic
ggtcagugaagagcagtcttuca

SEQ ID NO: 95209 - DNA, 22 bp, Artificial Sequence
  Synthetic
gcugcaggaaaaggagtuggat

SEQ ID NO: 95210 - DNA, 28 bp, Artificial Sequence
  Synthetic
gcccggcctucattttcttaaataacua

SEQ ID NO: 95211 - DNA, 21 bp, Artificial Sequence
  Synthetic
tcaaacutguccacacagcgt

SEQ ID NO: 95212 - DNA, 26 bp, Artificial Sequence
  Synthetic
gutgtcctcgttauggagaaagaaga

SEQ ID NO: 95213 - DNA, 27 bp, Artificial Sequence
  Synthetic
tgtggcaatattuacctgtgtcttugt

SEQ ID NO: 95214 - DNA, 29 bp, Artificial Sequence
  Synthetic
atgctattccuaaagacattaugccacat

SEQ ID NO: 95215 - DNA, 18 bp, Artificial Sequence
  Synthetic
cagccucccucccaacac

SEQ ID NO: 95216 - DNA, 26 bp, Artificial Sequence
  Synthetic
cttcctgattgtuatgaggtggtgut

SEQ ID NO: 95217 - DNA, 27 bp, Artificial Sequence
  Synthetic
gcttttccagutaccaaaactcuagga

SEQ ID NO: 95218 - DNA, 28 bp, Artificial Sequence
  Synthetic
cacattcagatugttagaaaagcauagg

SEQ ID NO: 95219 - DNA, 24 bp, Artificial Sequence
  Synthetic
cctcagattcugatgaaaccucca

SEQ ID NO: 95220 - DNA, 27 bp, Artificial Sequence
  Synthetic
attttatgctcucccaataagcuccaa

SEQ ID NO: 95221 - DNA, 25 bp, Artificial Sequence
  Synthetic
gcatgcuacaaaagagcucaacaat

SEQ ID NO: 95222 - DNA, 26 bp, Artificial Sequence
  Synthetic
agcttaaactcauggaggtttcauca

SEQ ID NO: 95223 - DNA, 26 bp, Artificial Sequence
  Synthetic
ctcagctcgugccaattaacttatuc

SEQ ID NO: 95224 - DNA, 22 bp, Artificial Sequence
  Synthetic
agggcagcugaaatggttuagg

SEQ ID NO: 95225 - DNA, 26 bp, Artificial Sequence
  Synthetic
ccagttgugtattgtgaaauggcaat

SEQ ID NO: 95226 - DNA, 24 bp, Artificial Sequence
  Synthetic
gtctgggucatccaattcugagag

SEQ ID NO: 95227 - DNA, 21 bp, Artificial Sequence
  Synthetic
tctcctuggaccccacaaaug

SEQ ID NO: 95228 - DNA, 27 bp, Artificial Sequence
  Synthetic
gctcttctggacuaagtgttgatucat

SEQ ID NO: 95229 - DNA, 33 bp, Artificial Sequence
  Synthetic
tgataaactatuggtaagtgatacuagcagaaa

SEQ ID NO: 95230 - DNA, 28 bp, Artificial Sequence
  Synthetic
actgtagtccautcatttaaaacuggct

SEQ ID NO: 95231 - DNA, 23 bp, Artificial Sequence
  Synthetic
gaagccugacaggtgagatacug

SEQ ID NO: 95232 - DNA, 21 bp, Artificial Sequence
  Synthetic
caccagaaucactccccucaa

SEQ ID NO: 95233 - DNA, 22 bp, Artificial Sequence
  Synthetic
gagcatgaagauccccaacucc

SEQ ID NO: 95234 - DNA, 24 bp, Artificial Sequence
  Synthetic
cgacaaauacccacatgctgttut

SEQ ID NO: 95235 - DNA, 29 bp, Artificial Sequence
  Synthetic
gctgaugaagagaaacataaacgucaaat

SEQ ID NO: 95236 - DNA, 21 bp, Artificial Sequence
  Synthetic
ccagtucacgcagtcgtcaut

SEQ ID NO: 95237 - DNA, 25 bp, Artificial Sequence
  Synthetic
caaaaatacaggugaaccctuggac

SEQ ID NO: 95238 - DNA, 21 bp, Artificial Sequence
  Synthetic
attugggcaaagccaaugcaa

SEQ ID NO: 95239 - DNA, 25 bp, Artificial Sequence
  Synthetic
gcccactttcugatgaggaatuaga

SEQ ID NO: 95240 - DNA, 27 bp, Artificial Sequence
  Synthetic
accttatatccutctgggaacauagca

SEQ ID NO: 95241 - DNA, 28 bp, Artificial Sequence
  Synthetic
gcttttcttgguaggtcacataaugagt

SEQ ID NO: 95242 - DNA, 19 bp, Artificial Sequence
  Synthetic
gccaagccugaagctgtuc

SEQ ID NO: 95243 - DNA, 33 bp, Artificial Sequence
  Synthetic
agcaaataataggatugatcttaactgtcttut

SEQ ID NO: 95244 - DNA, 23 bp, Artificial Sequence
  Synthetic
ccaatccagcugcattcattcuc

SEQ ID NO: 95245 - DNA, 27 bp, Artificial Sequence
  Synthetic
gcagaaaucaaagaacaatcugcagaa

SEQ ID NO: 95246 - DNA, 22 bp, Artificial Sequence
  Synthetic
tctcugggaacagcacctcaua

SEQ ID NO: 95247 - DNA, 26 bp, Artificial Sequence
  Synthetic
acttggctgauatgtttcttccaucc

SEQ ID NO: 95248 - DNA, 17 bp, Artificial Sequence
  Synthetic
ggcccacgaguccctug

SEQ ID NO: 95249 - DNA, 18 bp, Artificial Sequence
  Synthetic
cgguggcacacgugaagt

SEQ ID NO: 95250 - DNA, 24 bp, Artificial Sequence
  Synthetic
gacagcgacaagaucatctacuca

SEQ ID NO: 95251 - DNA, 18 bp, Artificial Sequence
  Synthetic
cgtgtcuccatcccguct

SEQ ID NO: 95252 - DNA, 23 bp, Artificial Sequence
  Synthetic
gcagcaaagauggauggaaagga

SEQ ID NO: 95253 - DNA, 26 bp, Artificial Sequence
  Synthetic
gggcagattttuccaattttacacut

SEQ ID NO: 95254 - DNA, 23 bp, Artificial Sequence
  Synthetic
ggatgaattucagggacccucaa

SEQ ID NO: 95255 - DNA, 19 bp, Artificial Sequence
  Synthetic
cgauacccccacugacgag

SEQ ID NO: 95256 - DNA, 29 bp, Artificial Sequence
  Synthetic
ttcctacttgggautttcagtcattucat

SEQ ID NO: 95257 - DNA, 27 bp, Artificial Sequence
  Synthetic
caccttguacaggaaaagacatttgug

SEQ ID NO: 95258 - DNA, 27 bp, Artificial Sequence
  Synthetic
caggtttggaguctaaaaagtuaccca

SEQ ID NO: 95259 - DNA, 26 bp, Artificial Sequence
  Synthetic
tttaacaagatgcutctcggagtuct

SEQ ID NO: 95260 - DNA, 21 bp, Artificial Sequence
  Synthetic
cttggcaugcaacguacagag

SEQ ID NO: 95261 - DNA, 24 bp, Artificial Sequence
  Synthetic
ccagtgtgcuctctaggatttgut

SEQ ID NO: 95262 - DNA, 26 bp, Artificial Sequence
  Synthetic
tggtgatacaauggcacaacatuaca

SEQ ID NO: 95263 - DNA, 28 bp, Artificial Sequence
  Synthetic
ctcagcucaaagaagagtatatcugcat

SEQ ID NO: 95264 - DNA, 28 bp, Artificial Sequence
  Synthetic
cttcagauacagggaaagtaaagtugga

SEQ ID NO: 95265 - DNA, 27 bp, Artificial Sequence
  Synthetic
tgatgtttctguctcctttggaguaac

SEQ ID NO: 95266 - DNA, 26 bp, Artificial Sequence
  Synthetic
caagtttgaatucagatgtgccucag

SEQ ID NO: 95267 - DNA, 25 bp, Artificial Sequence
  Synthetic
catttguagaccgaacgtcagauga

SEQ ID NO: 95268 - DNA, 22 bp, Artificial Sequence
  Synthetic
gctggucagacagttcagcuaa

SEQ ID NO: 95269 - DNA, 22 bp, Artificial Sequence
  Synthetic
tgactgacaguaggaggtgguc

SEQ ID NO: 95270 - DNA, 26 bp, Artificial Sequence
  Synthetic
caaccaatctucaaatctgacugcaa

SEQ ID NO: 95271 - DNA, 26 bp, Artificial Sequence
  Synthetic
acttcacaaggaautggagcttuact

SEQ ID NO: 95272 - DNA, 24 bp, Artificial Sequence
  Synthetic
tcagctcccaggugtttacaauac

SEQ ID NO: 95273 - DNA, 28 bp, Artificial Sequence
  Synthetic
tcagcaatgcctuctctttacctagaua

SEQ ID NO: 95274 - DNA, 27 bp, Artificial Sequence
  Synthetic
gaacataccagcaugtacttcuacagt

SEQ ID NO: 95275 - DNA, 28 bp, Artificial Sequence
  Synthetic
tgagacaatattggaugcagaagttgut

SEQ ID NO: 95276 - DNA, 22 bp, Artificial Sequence
  Synthetic
gtctuccagagcaagggcauat

SEQ ID NO: 95277 - DNA, 26 bp, Artificial Sequence
  Synthetic
gattttgattucacgaatggctguga

SEQ ID NO: 95278 - DNA, 23 bp, Artificial Sequence
  Synthetic
aagtatcccatuctcctgcccua

SEQ ID NO: 95279 - DNA, 28 bp, Artificial Sequence
  Synthetic
gggtcactgatugtaacaattctaacuc

SEQ ID NO: 95280 - DNA, 22 bp, Artificial Sequence
  Synthetic
tcctcuacccctcaaucacagg

SEQ ID NO: 95281 - DNA, 22 bp, Artificial Sequence
  Synthetic
tgcattcgacugttgaggtuga

SEQ ID NO: 95282 - DNA, 24 bp, Artificial Sequence
  Synthetic
aatgctccagugactgtcatucaa

SEQ ID NO: 95283 - DNA, 22 bp, Artificial Sequence
  Synthetic
caggttguggccctgtactaug

SEQ ID NO: 95284 - DNA, 23 bp, Artificial Sequence
  Synthetic
caaugagaaagagggctucccaa

SEQ ID NO: 95285 - DNA, 28 bp, Artificial Sequence
  Synthetic
ccagtctacccugtaaaaatgtgatuct

SEQ ID NO: 95286 - DNA, 27 bp, Artificial Sequence
  Synthetic
cagtcgcaggaautccaaataaaguag

SEQ ID NO: 95287 - DNA, 22 bp, Artificial Sequence
  Synthetic
gttggtggaugctgttgcttut

SEQ ID NO: 95288 - DNA, 20 bp, Artificial Sequence
  Synthetic
gctcaautacggcuccagca

SEQ ID NO: 95289 - DNA, 23 bp, Artificial Sequence
  Synthetic
ggacaggccugcttccaaattua

SEQ ID NO: 95290 - DNA, 28 bp, Artificial Sequence
  Synthetic
gctaaagtagcaauagaaagtgctgtuc

SEQ ID NO: 95291 - DNA, 25 bp, Artificial Sequence
  Synthetic
agatgagacauggaaaacagugcat

SEQ ID NO: 95292 - DNA, 22 bp, Artificial Sequence
  Synthetic
tcauagcacccccacagtaugt

SEQ ID NO: 95293 - DNA, 20 bp, Artificial Sequence
  Synthetic
ccctacccutgaggcttgug

SEQ ID NO: 95294 - DNA, 23 bp, Artificial Sequence
  Synthetic
ccccaacaaguacagaugcaagt

SEQ ID NO: 95295 - DNA, 22 bp, Artificial Sequence
  Synthetic
gcttaccaccuggtgtugaagg

SEQ ID NO: 95296 - DNA, 26 bp, Artificial Sequence
  Synthetic
ggaaagggaaauagugaagagaggaa

SEQ ID NO: 95297 - DNA, 26 bp, Artificial Sequence
  Synthetic
ctgggagcaucacaatcatatucaac

SEQ ID NO: 95298 - DNA, 25 bp, Artificial Sequence
  Synthetic
ctgccgagacutatcuaaaccagaa

SEQ ID NO: 95299 - DNA, 28 bp, Artificial Sequence
  Synthetic
ggtaccacaguacaatattgcacuacaa

SEQ ID NO: 95300 - DNA, 26 bp, Artificial Sequence
  Synthetic
ctccacagagutctgttgtucagaat

SEQ ID NO: 95301 - DNA, 24 bp, Artificial Sequence
  Synthetic
gtcctgguaccactgtgtgtaaug

SEQ ID NO: 95302 - DNA, 20 bp, Artificial Sequence
  Synthetic
ttctgctuccgaaacguggt

SEQ ID NO: 95303 - DNA, 22 bp, Artificial Sequence
  Synthetic
aatagctgcugagctggagtut

SEQ ID NO: 95304 - DNA, 24 bp, Artificial Sequence
  Synthetic
ttactattgcuggtgtcccaaguc

SEQ ID NO: 95305 - DNA, 20 bp, Artificial Sequence
  Synthetic
tgttgagcuggctggctuac

SEQ ID NO: 95306 - DNA, 25 bp, Artificial Sequence
  Synthetic
ccatctgtaatuccacagcagtcuc

SEQ ID NO: 95307 - DNA, 25 bp, Artificial Sequence
  Synthetic
ggtgattaacugttgaccctgugaa

SEQ ID NO: 95308 - DNA, 20 bp, Artificial Sequence
  Synthetic
aguaaccaagccgcaggtut

SEQ ID NO: 95309 - DNA, 23 bp, Artificial Sequence
  Synthetic
tgagatcaguggacctggcaaua

SEQ ID NO: 95310 - DNA, 23 bp, Artificial Sequence
  Synthetic
caacccaacaaagcguagtgaut

SEQ ID NO: 95311 - DNA, 28 bp, Artificial Sequence
  Synthetic
gaagatggagutatgttaggttguccag

SEQ ID NO: 95312 - DNA, 26 bp, Artificial Sequence
  Synthetic
cagttgctgguactaatctgctguaa

SEQ ID NO: 95313 - DNA, 28 bp, Artificial Sequence
  Synthetic
ggcagtatttgtucagaagatgactgua

SEQ ID NO: 95314 - DNA, 29 bp, Artificial Sequence
  Synthetic
ctgggttctgcutctcaactagtttatua

SEQ ID NO: 95315 - DNA, 20 bp, Artificial Sequence
  Synthetic
ctgcugccaaaggagacuca

SEQ ID NO: 95316 - DNA, 21 bp, Artificial Sequence
  Synthetic
gctgccauattgggaguggat

SEQ ID NO: 95317 - DNA, 22 bp, Artificial Sequence
  Synthetic
tcagauataacugccccaccga

SEQ ID NO: 95318 - DNA, 27 bp, Artificial Sequence
  Synthetic
caacaagtgttucagaagttcatuccc

SEQ ID NO: 95319 - DNA, 25 bp, Artificial Sequence
  Synthetic
gcctaaatuggaggaacagaauggt

SEQ ID NO: 95320 - DNA, 23 bp, Artificial Sequence
  Synthetic
ggtagtttcugagatgccuggag

SEQ ID NO: 95321 - DNA, 28 bp, Artificial Sequence
  Synthetic
ccaatcgctcautcagttgtattcugat

SEQ ID NO: 95322 - DNA, 25 bp, Artificial Sequence
  Synthetic
ctacagcgttuccttctacctuact

SEQ ID NO: 95323 - DNA, 28 bp, Artificial Sequence
  Synthetic
caaatcaacagacguatgcaaatucaga

SEQ ID NO: 95324 - DNA, 24 bp, Artificial Sequence
  Synthetic
tggtggattcugcatcatcatcuc

SEQ ID NO: 95325 - DNA, 25 bp, Artificial Sequence
  Synthetic
agtagctaauagcagtctcccaugt

SEQ ID NO: 95326 - DNA, 23 bp, Artificial Sequence
  Synthetic
ccttcgctcautagtctgcauga

SEQ ID NO: 95327 - DNA, 25 bp, Artificial Sequence
  Synthetic
ccttctacagtuccgacttacctug

SEQ ID NO: 95328 - DNA, 28 bp, Artificial Sequence
  Synthetic
gtgtccatgggutatagtagaatctugg

SEQ ID NO: 95329 - DNA, 24 bp, Artificial Sequence
  Synthetic
tuttcttctgugaagcagggacat

SEQ ID NO: 95330 - DNA, 27 bp, Artificial Sequence
  Synthetic
acccttatctguaaaagtctgagucct

SEQ ID NO: 95331 - DNA, 24 bp, Artificial Sequence
  Synthetic
cauattactcaccugcgaccacat

SEQ ID NO: 95332 - DNA, 24 bp, Artificial Sequence
  Synthetic
gtttccauggagagcttgtcuact

SEQ ID NO: 95333 - DNA, 21 bp, Artificial Sequence
  Synthetic
caagagtcgguggaaccaguc

SEQ ID NO: 95334 - DNA, 22 bp, Artificial Sequence
  Synthetic
cattgccuccacatggcttuag

SEQ ID NO: 95335 - DNA, 27 bp, Artificial Sequence
  Synthetic
gctaatttacugcaagtcgagagguat

SEQ ID NO: 95336 - DNA, 27 bp, Artificial Sequence
  Synthetic
tgtttcucgagcagaaatgtattcuga

SEQ ID NO: 95337 - DNA, 28 bp, Artificial Sequence
  Synthetic
aagagatgttguaagtgacgtaaaugga

SEQ ID NO: 95338 - DNA, 24 bp, Artificial Sequence
  Synthetic
agtgactgcaucttggctttuact

SEQ ID NO: 95339 - DNA, 22 bp, Artificial Sequence
  Synthetic
gtattcucagagcaggcagcua

SEQ ID NO: 95340 - DNA, 25 bp, Artificial Sequence
  Synthetic
gggtccuagaggttgcataaaauca

SEQ ID NO: 95341 - DNA, 26 bp, Artificial Sequence
  Synthetic
aggtagauagacaaagagcttugcag

SEQ ID NO: 95342 - DNA, 22 bp, Artificial Sequence
  Synthetic
agctggucccagaaagattucc

SEQ ID NO: 95343 - DNA, 26 bp, Artificial Sequence
  Synthetic
aattaattcacccuccacccaaacut

SEQ ID NO: 95344 - DNA, 25 bp, Artificial Sequence
  Synthetic
catctttattagcugcctgctcuga

SEQ ID NO: 95345 - DNA, 28 bp, Artificial Sequence
  Synthetic
gtgatgattugcccttactcauacaaaa

SEQ ID NO: 95346 - DNA, 22 bp, Artificial Sequence
  Synthetic
gctgctccauttccatcctcug

SEQ ID NO: 95347 - DNA, 21 bp, Artificial Sequence
  Synthetic
accaccaccucgggtagaaut

SEQ ID NO: 95348 - DNA, 24 bp, Artificial Sequence
  Synthetic
gtaccggcugtgtttattcugaga

SEQ ID NO: 95349 - DNA, 21 bp, Artificial Sequence
  Synthetic
ggagagtgugctggatucaca

SEQ ID NO: 95350 - DNA, 26 bp, Artificial Sequence
  Synthetic
gacttgaggcautgttattucagcat

SEQ ID NO: 95351 - DNA, 25 bp, Artificial Sequence
  Synthetic
cagaaaagugcaccaaaccagatuc

SEQ ID NO: 95352 - DNA, 22 bp, Artificial Sequence
  Synthetic
ggaugggaggaauaggaggcat

SEQ ID NO: 95353 - DNA, 24 bp, Artificial Sequence
  Synthetic
gtcattgtccccutctttcacuca

SEQ ID NO: 95354 - DNA, 24 bp, Artificial Sequence
  Synthetic
gaccatgactuaatgggactgcua

SEQ ID NO: 95355 - DNA, 25 bp, Artificial Sequence
  Synthetic
ccgatgcaggaaautctttttguga

SEQ ID NO: 95356 - DNA, 24 bp, Artificial Sequence
  Synthetic
gtcccatgucccatgaatcuaagg

SEQ ID NO: 95357 - DNA, 20 bp, Artificial Sequence
  Synthetic
actttcugacggccatuggg

SEQ ID NO: 95358 - DNA, 27 bp, Artificial Sequence
  Synthetic
acagctaauggaaggattggaatacug

SEQ ID NO: 95359 - DNA, 27 bp, Artificial Sequence
  Synthetic
acuaaaaaggucagaggagaagaggaa

SEQ ID NO: 95360 - DNA, 22 bp, Artificial Sequence
  Synthetic
agaaaagcaacuggatgcgcua

SEQ ID NO: 95361 - DNA, 21 bp, Artificial Sequence
  Synthetic
tgcaaagucccgacaauacca

SEQ ID NO: 95362 - DNA, 20 bp, Artificial Sequence
  Synthetic
gggttgcuttttggagugct

SEQ ID NO: 95363 - DNA, 21 bp, Artificial Sequence
  Synthetic
gtgacgcuctctgctgtuaga

SEQ ID NO: 95364 - DNA, 21 bp, Artificial Sequence
  Synthetic
agggcaaccuccacattcauc

SEQ ID NO: 95365 - DNA, 23 bp, Artificial Sequence
  Synthetic
gtttctgtcaugaggagggugac

SEQ ID NO: 95366 - DNA, 28 bp, Artificial Sequence
  Synthetic
actttcacuaaagggattgttgtcauca

SEQ ID NO: 95367 - DNA, 23 bp, Artificial Sequence
  Synthetic
ctcctagaatucagcccccaaut

SEQ ID NO: 95368 - DNA, 22 bp, Artificial Sequence
  Synthetic
tggaggagcutctggaacttug

SEQ ID NO: 95369 - DNA, 21 bp, Artificial Sequence
  Synthetic
ggtcaccaaccccaugtctut

SEQ ID NO: 95370 - DNA, 21 bp, Artificial Sequence
  Synthetic
ggtcaguccccctuacaagga

SEQ ID NO: 95371 - DNA, 19 bp, Artificial Sequence
  Synthetic
cgaucgcccgctguaagag

SEQ ID NO: 95372 - DNA, 20 bp, Artificial Sequence
  Synthetic
cagguccaggtucagcagac

SEQ ID NO: 95373 - DNA, 22 bp, Artificial Sequence
  Synthetic
ggcagagttuatggagcagcut

SEQ ID NO: 95374 - DNA, 28 bp, Artificial Sequence
  Synthetic
gctggtguacaagtttttattgguaact

SEQ ID NO: 95375 - DNA, 21 bp, Artificial Sequence
  Synthetic
tctggccauactagccctgut

SEQ ID NO: 95376 - DNA, 21 bp, Artificial Sequence
  Synthetic
gccaaccaggaacutcttgug

SEQ ID NO: 95377 - DNA, 25 bp, Artificial Sequence
  Synthetic
cagaaccgacautactggcatttut

SEQ ID NO: 95378 - DNA, 19 bp, Artificial Sequence
  Synthetic
gtctcgcgguaccttguca

SEQ ID NO: 95379 - DNA, 21 bp, Artificial Sequence
  Synthetic
gtgaagatucccgtcctccuc

SEQ ID NO: 95380 - DNA, 20 bp, Artificial Sequence
  Synthetic
ccgcugagcuagcaaggaat

SEQ ID NO: 95381 - DNA, 23 bp, Artificial Sequence
  Synthetic
ctttcttacccugtgtcttugcc

SEQ ID NO: 95382 - DNA, 24 bp, Artificial Sequence
  Synthetic
cccattcttacutccctgggauca

SEQ ID NO: 95383 - DNA, 28 bp, Artificial Sequence
  Synthetic
gagactaggaacuctagacttcccttut

SEQ ID NO: 95384 - DNA, 26 bp, Artificial Sequence
  Synthetic
ccgggacutactaaaagcuaaacaga

SEQ ID NO: 95385 - DNA, 20 bp, Artificial Sequence
  Synthetic
ttgctgcugcttttggcuac

SEQ ID NO: 95386 - DNA, 22 bp, Artificial Sequence
  Synthetic
cgtccagcuacgaaagaagugg

SEQ ID NO: 95387 - DNA, 28 bp, Artificial Sequence
  Synthetic
cctaaaugaggaaggactgtuagacaaa

SEQ ID NO: 95388 - DNA, 21 bp, Artificial Sequence
  Synthetic
cggcataaguccaaacacucc

SEQ ID NO: 95389 - DNA, 21 bp, Artificial Sequence
  Synthetic
tcgttctcccutcggtcuagt

SEQ ID NO: 95390 - DNA, 23 bp, Artificial Sequence
  Synthetic
gtgtctctcuggtgccatctuaa

SEQ ID NO: 95391 - DNA, 28 bp, Artificial Sequence
  Synthetic
attcttctagttgcugaggaaacgtauc

SEQ ID NO: 95392 - DNA, 23 bp, Artificial Sequence
  Synthetic
gcactccuttccatttctugagg

SEQ ID NO: 95393 - DNA, 23 bp, Artificial Sequence
  Synthetic
ctactgagcccutggttgaacut

SEQ ID NO: 95394 - DNA, 20 bp, Artificial Sequence
  Synthetic
ctccgaugacatggcctuca

SEQ ID NO: 95395 - DNA, 22 bp, Artificial Sequence
  Synthetic
tgctggagacutcttggcttut

SEQ ID NO: 95396 - DNA, 24 bp, Artificial Sequence
  Synthetic
aggagacugatgactaugggaagg

SEQ ID NO: 95397 - DNA, 26 bp, Artificial Sequence
  Synthetic
ccactgttttguaacttttgggtgut

SEQ ID NO: 95398 - DNA, 25 bp, Artificial Sequence
  Synthetic
agatgaaguggaaggttttcugcaa

SEQ ID NO: 95399 - DNA, 22 bp, Artificial Sequence
  Synthetic
aggcatgugagggatgaatcuc

SEQ ID NO: 95400 - DNA, 26 bp, Artificial Sequence
  Synthetic
cggaguaaaagtcaucgaaaaaggga

SEQ ID NO: 95401 - DNA, 25 bp, Artificial Sequence
  Synthetic
agatcgtgagggacuaaggtcauaa

SEQ ID NO: 95402 - DNA, 21 bp, Artificial Sequence
  Synthetic
gggagcutcttauggccaaga

SEQ ID NO: 95403 - DNA, 19 bp, Artificial Sequence
  Synthetic
cuggactgguaggccgaag

SEQ ID NO: 95404 - DNA, 24 bp, Artificial Sequence
  Synthetic
tcatcacuccagaaagcttuggaa

SEQ ID NO: 95405 - DNA, 20 bp, Artificial Sequence
  Synthetic
ccaaggcuaagcaggagguc

SEQ ID NO: 95406 - DNA, 21 bp, Artificial Sequence
  Synthetic
aatgggccucatgtguaccag

SEQ ID NO: 95407 - DNA, 28 bp, Artificial Sequence
  Synthetic
acatggtgacataugcttcttcttgaut

SEQ ID NO: 95408 - DNA, 23 bp, Artificial Sequence
  Synthetic
gggagagaaaagugagugaaagg

SEQ ID NO: 95409 - DNA, 27 bp, Artificial Sequence
  Synthetic
ctgactacttcuttcttcctctuccag

SEQ ID NO: 95410 - DNA, 23 bp, Artificial Sequence
  Synthetic
gaaatgtgttgguggctgttgut

SEQ ID NO: 95411 - DNA, 20 bp, Artificial Sequence
  Synthetic
actgcacaaggccugctaug

SEQ ID NO: 95412 - DNA, 24 bp, Artificial Sequence
  Synthetic
ctcttgctctuagctcctccuact

SEQ ID NO: 95413 - DNA, 24 bp, Artificial Sequence
  Synthetic
gtgcgtuactcacctgugaaaaat

SEQ ID NO: 95414 - DNA, 27 bp, Artificial Sequence
  Synthetic
cccaaagauaaaaagacaauggcaaca

SEQ ID NO: 95415 - DNA, 21 bp, Artificial Sequence
  Synthetic
ggcauaaggtucgggaagagg

SEQ ID NO: 95416 - DNA, 24 bp, Artificial Sequence
  Synthetic
tgacaactcugcaacatcttccuc

SEQ ID NO: 95417 - DNA, 25 bp, Artificial Sequence
  Synthetic
gagtctuccttcttgtucgaaacca

SEQ ID NO: 95418 - DNA, 20 bp, Artificial Sequence
  Synthetic
agagtugcccacgguaacaa

SEQ ID NO: 95419 - DNA, 25 bp, Artificial Sequence
  Synthetic
gctttggaugtaccgataatugcag

SEQ ID NO: 95420 - DNA, 28 bp, Artificial Sequence
  Synthetic
gacctaaagtcuccaatcatttctguga

SEQ ID NO: 95421 - DNA, 22 bp, Artificial Sequence
  Synthetic
gucagggagaaaauggccagat

SEQ ID NO: 95422 - DNA, 21 bp, Artificial Sequence
  Synthetic
ccaagacatgugcagctcauc

SEQ ID NO: 95423 - DNA, 21 bp, Artificial Sequence
  Synthetic
acgtcccagutcacctacugt

SEQ ID NO: 95424 - DNA, 21 bp, Artificial Sequence
  Synthetic
tuctgctttcuccagcccaaa

SEQ ID NO: 95425 - DNA, 26 bp, Artificial Sequence
  Synthetic
gacaacagtctuctcatcctcatuca

SEQ ID NO: 95426 - DNA, 22 bp, Artificial Sequence
  Synthetic
gtggaagagguggtgagctuaa

SEQ ID NO: 95427 - DNA, 20 bp, Artificial Sequence
  Synthetic
cagugcacagagguggaaag

SEQ ID NO: 95428 - DNA, 21 bp, Artificial Sequence
  Synthetic
cctcccgaaggutcatgcaut

SEQ ID NO: 95429 - DNA, 30 bp, Artificial Sequence
  Synthetic
cagaauggaagcatttttcuaaaagcaaag

SEQ ID NO: 95430 - DNA, 22 bp, Artificial Sequence
  Synthetic
gaagggaagcccccuagtauct

SEQ ID NO: 95431 - DNA, 21 bp, Artificial Sequence
  Synthetic
cagccaagcagcacuattuga

SEQ ID NO: 95432 - DNA, 21 bp, Artificial Sequence
  Synthetic
caggcaaguatcgagagugct

SEQ ID NO: 95433 - DNA, 23 bp, Artificial Sequence
  Synthetic
ccaagccaugctctcttcatuca

SEQ ID NO: 95434 - DNA, 25 bp, Artificial Sequence
  Synthetic
ggtatggtgtauacttgccctcuga

SEQ ID NO: 95435 - DNA, 24 bp, Artificial Sequence
  Synthetic
agagctttgtgucagctttgacut

SEQ ID NO: 95436 - DNA, 20 bp, Artificial Sequence
  Synthetic
gcagguccgcagtcagaauc

SEQ ID NO: 95437 - DNA, 22 bp, Artificial Sequence
  Synthetic
ggaccaagtugatgacaccuca

SEQ ID NO: 95438 - DNA, 24 bp, Artificial Sequence
  Synthetic
ttcaagtgacucctgcttcatuca

SEQ ID NO: 95439 - DNA, 21 bp, Artificial Sequence
  Synthetic
ttttcggucgtggatggugat

SEQ ID NO: 95440 - DNA, 21 bp, Artificial Sequence
  Synthetic
tcugcuccagcgaacaacaat

SEQ ID NO: 95441 - DNA, 28 bp, Artificial Sequence
  Synthetic
caggtacatgtgugctacatagtgtuaa

SEQ ID NO: 95442 - DNA, 23 bp, Artificial Sequence
  Synthetic
ggaatctgcuccttgggucagaa

SEQ ID NO: 95443 - DNA, 21 bp, Artificial Sequence
  Synthetic
gtcaccuggaggacaactugt

SEQ ID NO: 95444 - DNA, 21 bp, Artificial Sequence
  Synthetic
cgaattcgtugctcctctugt

SEQ ID NO: 95445 - DNA, 23 bp, Artificial Sequence
  Synthetic
ccttcttcucaggaggaaaucgg

SEQ ID NO: 95446 - DNA, 22 bp, Artificial Sequence
  Synthetic
cctgctcatcuggaaactccuc

SEQ ID NO: 95447 - DNA, 23 bp, Artificial Sequence
  Synthetic
gctgcttccacutaagagtcuca

SEQ ID NO: 95448 - DNA, 22 bp, Artificial Sequence
  Synthetic
cgaaauggaagccgtcaucagt

SEQ ID NO: 95449 - DNA, 20 bp, Artificial Sequence
  Synthetic
agctctgcaucgtctccuct

SEQ ID NO: 95450 - DNA, 22 bp, Artificial Sequence
  Synthetic
gaagaggaugtcauccggcaaa

SEQ ID NO: 95451 - DNA, 21 bp, Artificial Sequence
  Synthetic
tggctttcuccctcttcccua

SEQ ID NO: 95452 - DNA, 23 bp, Artificial Sequence
  Synthetic
gttggcucaaaagcugggaaaaa

SEQ ID NO: 95453 - DNA, 28 bp, Artificial Sequence
  Synthetic
atctcacattuccaagtacattcucagg

SEQ ID NO: 95454 - DNA, 21 bp, Artificial Sequence
  Synthetic
tgggatacucacaggtcucca

SEQ ID NO: 95455 - DNA, 20 bp, Artificial Sequence
  Synthetic
gctcaaguggtcctgucgaa

SEQ ID NO: 95456 - DNA, 21 bp, Artificial Sequence
  Synthetic
ccctgttcuccctgatuggaa

SEQ ID NO: 95457 - DNA, 20 bp, Artificial Sequence
  Synthetic
cugagaccgucaccaagacc

SEQ ID NO: 95458 - DNA, 23 bp, Artificial Sequence
  Synthetic
ggccgagaugcagatgattctua

SEQ ID NO: 95459 - DNA, 22 bp, Artificial Sequence
  Synthetic
ccgaugtucaggacaacagcat

SEQ ID NO: 95460 - DNA, 27 bp, Artificial Sequence
  Synthetic
ctgattgcauacaagtcaatggcatut

SEQ ID NO: 95461 - DNA, 26 bp, Artificial Sequence
  Synthetic
ggcactgacuacaagatctacctgua

SEQ ID NO: 95462 - DNA, 22 bp, Artificial Sequence
  Synthetic
ccgagcatugtcattcaaggug

SEQ ID NO: 95463 - DNA, 25 bp, Artificial Sequence
  Synthetic
agaaaaatugcaggctagctugaga

SEQ ID NO: 95464 - DNA, 21 bp, Artificial Sequence
  Synthetic
gaaggcagccacutgacacua

SEQ ID NO: 95465 - DNA, 24 bp, Artificial Sequence
  Synthetic
cttgtccaaucttgtcuccaagga

SEQ ID NO: 95466 - DNA, 26 bp, Artificial Sequence
  Synthetic
gtcccaactguatccaaatctgctua

SEQ ID NO: 95467 - DNA, 26 bp, Artificial Sequence
  Synthetic
tggagtaagacagguccatcaaguag

SEQ ID NO: 95468 - DNA, 24 bp, Artificial Sequence
  Synthetic
ggaggattacccugtggacatcua

SEQ ID NO: 95469 - DNA, 22 bp, Artificial Sequence
  Synthetic
gacacaggcutgtccacaaaug

SEQ ID NO: 95470 - DNA, 20 bp, Artificial Sequence
  Synthetic
agtaaccugcggattggcut

SEQ ID NO: 95471 - DNA, 26 bp, Artificial Sequence
  Synthetic
gagctagaaauaggaaccaggactug

SEQ ID NO: 95472 - DNA, 24 bp, Artificial Sequence
  Synthetic
gtattcuggagccactagaccuct

SEQ ID NO: 95473 - DNA, 27 bp, Artificial Sequence
  Synthetic
cctggacccacacuttgaatatatuga

SEQ ID NO: 95474 - DNA, 21 bp, Artificial Sequence
  Synthetic
acaacccacaagggcutcauc

SEQ ID NO: 95475 - DNA, 26 bp, Artificial Sequence
  Synthetic
aaccacaattacacugattgcactuc

SEQ ID NO: 95476 - DNA, 21 bp, Artificial Sequence
  Synthetic
gtgucacgaaggcgtttucag

SEQ ID NO: 95477 - DNA, 20 bp, Artificial Sequence
  Synthetic
cggaagcgacuaaacgucca

SEQ ID NO: 95478 - DNA, 22 bp, Artificial Sequence
  Synthetic
catgttgtcucttctgcccuca

SEQ ID NO: 95479 - DNA, 28 bp, Artificial Sequence
  Synthetic
cggtaatctttuccttctttgttgtgua

SEQ ID NO: 95480 - DNA, 22 bp, Artificial Sequence
  Synthetic
ttgtgaugccaaagactcugct

SEQ ID NO: 95481 - DNA, 28 bp, Artificial Sequence
  Synthetic
gccccactaguttctcttctgtaatuat

SEQ ID NO: 95482 - DNA, 21 bp, Artificial Sequence
  Synthetic
cttuccaacctggugccaaac

SEQ ID NO: 95483 - DNA, 25 bp, Artificial Sequence
  Synthetic
gtcaagtgacuatgacagctctucc

SEQ ID NO: 95484 - DNA, 23 bp, Artificial Sequence
  Synthetic
tcctcactcuttttgccttugct

SEQ ID NO: 95485 - DNA, 25 bp, Artificial Sequence
  Synthetic
gtacctctccuttctccttccttuc

SEQ ID NO: 95486 - DNA, 21 bp, Artificial Sequence
  Synthetic
gcagtgaauggctgaggctut

SEQ ID NO: 95487 - DNA, 28 bp, Artificial Sequence
  Synthetic
aaatcagtttcugaatctcttgctcugt

SEQ ID NO: 95488 - DNA, 21 bp, Artificial Sequence
  Synthetic
gggcttgtugtcacttaccut

SEQ ID NO: 95489 - DNA, 22 bp, Artificial Sequence
  Synthetic
agccggtugttatgacaaugga

SEQ ID NO: 95490 - DNA, 25 bp, Artificial Sequence
  Synthetic
agaagccacagutctccagatcaua

SEQ ID NO: 95491 - DNA, 24 bp, Artificial Sequence
  Synthetic
gagaaactutcagctcaugaggga

SEQ ID NO: 95492 - DNA, 25 bp, Artificial Sequence
  Synthetic
cataccctcugttctttggtcuagg

SEQ ID NO: 95493 - DNA, 27 bp, Artificial Sequence
  Synthetic
actttaaaaggagcugtaaggcctaug

SEQ ID NO: 95494 - DNA, 27 bp, Artificial Sequence
  Synthetic
gaaaatggaagaaaaccugactagcug

SEQ ID NO: 95495 - DNA, 28 bp, Artificial Sequence
  Synthetic
ccacagtgtguacccaataactuaaaga

SEQ ID NO: 95496 - DNA, 23 bp, Artificial Sequence
  Synthetic
actgctagcautgggaaucaagg

SEQ ID NO: 95497 - DNA, 27 bp, Artificial Sequence
  Synthetic
caattggcugagcaagattttctauct

SEQ ID NO: 95498 - DNA, 22 bp, Artificial Sequence
  Synthetic
ctcccctgugccattctcauaa

SEQ ID NO: 95499 - DNA, 24 bp, Artificial Sequence
  Synthetic
tctacaccauccaagtccugagag

SEQ ID NO: 95500 - DNA, 28 bp, Artificial Sequence
  Synthetic
acaccaatttcaagguttttggttgtut

SEQ ID NO: 95501 - DNA, 26 bp, Artificial Sequence
  Synthetic
ccaagaaagugatgtagtagcugcat

SEQ ID NO: 95502 - DNA, 28 bp, Artificial Sequence
  Synthetic
gaaacgtguaaaaggatgcaaatcuagt

SEQ ID NO: 95503 - DNA, 26 bp, Artificial Sequence
  Synthetic
aaggaaccaaagucattctcactuag

SEQ ID NO: 95504 - DNA, 21 bp, Artificial Sequence
  Synthetic
gcgcatcuctttcctguccat

SEQ ID NO: 95505 - DNA, 27 bp, Artificial Sequence
  Synthetic
ggtgtttacttugcattccttcctcua

SEQ ID NO: 95506 - DNA, 21 bp, Artificial Sequence
  Synthetic
ggagaccaccagcutccttug

SEQ ID NO: 95507 - DNA, 24 bp, Artificial Sequence
  Synthetic
gactatucccagcacaagacacut

SEQ ID NO: 95508 - DNA, 24 bp, Artificial Sequence
  Synthetic
aggtgtggccautgtaaaaacuca

SEQ ID NO: 95509 - DNA, 25 bp, Artificial Sequence
  Synthetic
tgacaactgaucgaaggaacguaac

SEQ ID NO: 95510 - DNA, 27 bp, Artificial Sequence
  Synthetic
ctatatcccaauggatgatgactucca

SEQ ID NO: 95511 - DNA, 22 bp, Artificial Sequence
  Synthetic
ggtagtgguggcattagcagua

SEQ ID NO: 95512 - DNA, 21 bp, Artificial Sequence
  Synthetic
gtgccccucctggaagaauat

SEQ ID NO: 95513 - DNA, 20 bp, Artificial Sequence
  Synthetic
aguacggccaccaagaagug

SEQ ID NO: 95514 - DNA, 17 bp, Artificial Sequence
  Synthetic
caccucaccugccgaca

SEQ ID NO: 95515 - DNA, 21 bp, Artificial Sequence
  Synthetic
aggttctuccccagtgugagt

SEQ ID NO: 95516 - DNA, 19 bp, Artificial Sequence
  Synthetic
agaugccgcacuccaagaa

SEQ ID NO: 95517 - DNA, 18 bp, Artificial Sequence
  Synthetic
gugaaggucacggccaca

SEQ ID NO: 95518 - DNA, 21 bp, Artificial Sequence
  Synthetic
gacaaacgacugctccuggat

SEQ ID NO: 95519 - DNA, 17 bp, Artificial Sequence
  Synthetic
tccuccccacgcugaac

SEQ ID NO: 95520 - DNA, 25 bp, Artificial Sequence
  Synthetic
tccagcagacucaaauacaagaacc

SEQ ID NO: 95521 - DNA, 28 bp, Artificial Sequence
  Synthetic
gtgatgatguggcactagtagtttctut

SEQ ID NO: 95522 - DNA, 21 bp, Artificial Sequence
  Synthetic
gguggtgaagucaaagcgagt

SEQ ID NO: 95523 - DNA, 21 bp, Artificial Sequence
  Synthetic
ccgtuggaaggaagcuaccat

SEQ ID NO: 95524 - DNA, 27 bp, Artificial Sequence
  Synthetic
ttgactgtugacttcacttuaagcaga

SEQ ID NO: 95525 - DNA, 22 bp, Artificial Sequence
  Synthetic
gtaaccaguggagtggctugag

SEQ ID NO: 95526 - DNA, 17 bp, Artificial Sequence
  Synthetic
gcaggucacgctgccut

SEQ ID NO: 95527 - DNA, 17 bp, Artificial Sequence
  Synthetic
agccaccugcggtctuc

SEQ ID NO: 95528 - DNA, 22 bp, Artificial Sequence
  Synthetic
gtaggagttuaagtggccuggt

SEQ ID NO: 95529 - DNA, 26 bp, Artificial Sequence
  Synthetic
tgcctaagtccugcttaagtcattut

SEQ ID NO: 95530 - DNA, 25 bp, Artificial Sequence
  Synthetic
atctccatcucctacccacauacat

SEQ ID NO: 95531 - DNA, 26 bp, Artificial Sequence
  Synthetic
actcaaagcgacagauaacacgtuag

SEQ ID NO: 95532 - DNA, 19 bp, Artificial Sequence
  Synthetic
cgugacgucagagcaggaa

SEQ ID NO: 95533 - DNA, 17 bp, Artificial Sequence
  Synthetic
tcaccugucggcaggga

SEQ ID NO: 95534 - DNA, 26 bp, Artificial Sequence
  Synthetic
gacagaaaaauctcauccaagaagcc

SEQ ID NO: 95535 - DNA, 28 bp, Artificial Sequence
  Synthetic
gcgttagggcauatatatcagaaagtut

SEQ ID NO: 95536 - DNA, 27 bp, Artificial Sequence
  Synthetic
tgtgactgcaccuaacaagattcauat

SEQ ID NO: 95537 - DNA, 22 bp, Artificial Sequence
  Synthetic
gtattcgtguaatgccgctgug

SEQ ID NO: 95538 - DNA, 22 bp, Artificial Sequence
  Synthetic
ctacttgccagauttggctugg

SEQ ID NO: 95539 - DNA, 23 bp, Artificial Sequence
  Synthetic
caggtggcautgaaggauagaga

SEQ ID NO: 95540 - DNA, 21 bp, Artificial Sequence
  Synthetic
cgtgaccuccctgaagagtug

SEQ ID NO: 95541 - DNA, 22 bp, Artificial Sequence
  Synthetic
ccacagaugcuccaggacaaag

SEQ ID NO: 95542 - DNA, 28 bp, Artificial Sequence
  Synthetic
gtggttattcttugacaattgcttgugt

SEQ ID NO: 95543 - DNA, 19 bp, Artificial Sequence
  Synthetic
cagccggutgcaatctucc

SEQ ID NO: 95544 - DNA, 22 bp, Artificial Sequence
  Synthetic
tcactaucccccagccatctua

SEQ ID NO: 95545 - DNA, 20 bp, Artificial Sequence
  Synthetic
agcugaacgaacugcaaggt

SEQ ID NO: 95546 - DNA, 20 bp, Artificial Sequence
  Synthetic
cacagcauccagacccugaa

SEQ ID NO: 95547 - DNA, 23 bp, Artificial Sequence
  Synthetic
tgttgctcauaacggttgctuct

SEQ ID NO: 95548 - DNA, 20 bp, Artificial Sequence
  Synthetic
cctgtguggcaggactucag

SEQ ID NO: 95549 - DNA, 27 bp, Artificial Sequence
  Synthetic
tcttgtccaggcuaagaactttcaaut

SEQ ID NO: 95550 - DNA, 25 bp, Artificial Sequence
  Synthetic
ggcacttaattutcagcttacgugt

SEQ ID NO: 95551 - DNA, 21 bp, Artificial Sequence
  Synthetic
acaatgtggguccctctguct

SEQ ID NO: 95552 - DNA, 23 bp, Artificial Sequence
  Synthetic
cagattccucagtgggtactugg

SEQ ID NO: 95553 - DNA, 27 bp, Artificial Sequence
  Synthetic
ccactaaccuccagtttgtcaaugaaa

SEQ ID NO: 95554 - DNA, 25 bp, Artificial Sequence
  Synthetic
catcucaccaggacagtagaaucag

SEQ ID NO: 95555 - DNA, 28 bp, Artificial Sequence
  Synthetic
caacctugaggagagaaaactuagacat

SEQ ID NO: 95556 - DNA, 21 bp, Artificial Sequence
  Synthetic
agaggtugagggacggagaut

SEQ ID NO: 95557 - DNA, 27 bp, Artificial Sequence
  Synthetic
cttcaggttttgaguttcctagaccut

SEQ ID NO: 95558 - DNA, 27 bp, Artificial Sequence
  Synthetic
ccaatgtcggaguttggaaaacaaaut

SEQ ID NO: 95559 - DNA, 25 bp, Artificial Sequence
  Synthetic
agttcagccccuataacuaggaaca

SEQ ID NO: 95560 - DNA, 21 bp, Artificial Sequence
  Synthetic
cacctgguggtgcaatuaacc

SEQ ID NO: 95561 - DNA, 21 bp, Artificial Sequence
  Synthetic
gagctatuccctgcaccugat

SEQ ID NO: 95562 - DNA, 22 bp, Artificial Sequence
  Synthetic
gctctgcagugtcttctucacc

SEQ ID NO: 95563 - DNA, 25 bp, Artificial Sequence
  Synthetic
gcattcactgaugtggatgtcgaut

SEQ ID NO: 95564 - DNA, 20 bp, Artificial Sequence
  Synthetic
cctgacggccutgtctucac

SEQ ID NO: 95565 - DNA, 20 bp, Artificial Sequence
  Synthetic
acacucacaagcccctgtut

SEQ ID NO: 95566 - DNA, 22 bp, Artificial Sequence
  Synthetic
caagtgaggguggagaattugg

SEQ ID NO: 95567 - DNA, 21 bp, Artificial Sequence
  Synthetic
ccaucagcaggaacaccttug

SEQ ID NO: 95568 - DNA, 24 bp, Artificial Sequence
  Synthetic
ggcttucccaagcaattttgaugg

SEQ ID NO: 95569 - DNA, 28 bp, Artificial Sequence
  Synthetic
atgcttattucacaacttgctttucaca

SEQ ID NO: 95570 - DNA, 18 bp, Artificial Sequence
  Synthetic
acagcccggugacttcug

SEQ ID NO: 95571 - DNA, 21 bp, Artificial Sequence
  Synthetic
gacctgcaguttgtggaagug

SEQ ID NO: 95572 - DNA, 21 bp, Artificial Sequence
  Synthetic
gatggtgaccutcacgtcugt

SEQ ID NO: 95573 - DNA, 26 bp, Artificial Sequence
  Synthetic
gcctaacatauccaagaaactggcut

SEQ ID NO: 95574 - DNA, 19 bp, Artificial Sequence
  Synthetic
cacctacatucggcgggua

SEQ ID NO: 95575 - DNA, 23 bp, Artificial Sequence
  Synthetic
ctgggtaugacactggaaauggt

SEQ ID NO: 95576 - DNA, 21 bp, Artificial Sequence
  Synthetic
gggtctgcuctcatcggttut

SEQ ID NO: 95577 - DNA, 21 bp, Artificial Sequence
  Synthetic
tcctcctuggcagtacuccat

SEQ ID NO: 95578 - DNA, 19 bp, Artificial Sequence
  Synthetic
gaactuggcgcccaaugac

SEQ ID NO: 95579 - DNA, 25 bp, Artificial Sequence
  Synthetic
gcttcctgaugatgacagaagugaa

SEQ ID NO: 95580 - DNA, 22 bp, Artificial Sequence
  Synthetic
cagaagugccaggaagcugaat

SEQ ID NO: 95581 - DNA, 21 bp, Artificial Sequence
  Synthetic
ggctctaaccuctctcggcua

SEQ ID NO: 95582 - DNA, 20 bp, Artificial Sequence
  Synthetic
ctggcctuggcataccacua

SEQ ID NO: 95583 - DNA, 20 bp, Artificial Sequence
  Synthetic
tggtcagutagcgucagcac

SEQ ID NO: 95584 - DNA, 22 bp, Artificial Sequence
  Synthetic
gcacagggtutcctgtcacaua

SEQ ID NO: 95585 - DNA, 27 bp, Artificial Sequence
  Synthetic
cgacacagtcaucctcattcttauagg

SEQ ID NO: 95586 - DNA, 24 bp, Artificial Sequence
  Synthetic
tgaatcttuggccaattgcugact

SEQ ID NO: 95587 - DNA, 21 bp, Artificial Sequence
  Synthetic
gagagtgccccuactacacug

SEQ ID NO: 95588 - DNA, 22 bp, Artificial Sequence
  Synthetic
cttgcccaugtttggcuacaaa

SEQ ID NO: 95589 - DNA, 22 bp, Artificial Sequence
  Synthetic
gcactccaagucctccaaacuc

SEQ ID NO: 95590 - DNA, 23 bp, Artificial Sequence
  Synthetic
tggcaaggaugcagtgaattgua

SEQ ID NO: 95591 - DNA, 22 bp, Artificial Sequence
  Synthetic
cctaacatggutctccctcucc

SEQ ID NO: 95592 - DNA, 22 bp, Artificial Sequence
  Synthetic
caggagguagagagtcgccaua

SEQ ID NO: 95593 - DNA, 21 bp, Artificial Sequence
  Synthetic
ctagtacucgggcctcacuca

SEQ ID NO: 95594 - DNA, 25 bp, Artificial Sequence
  Synthetic
ttcaaaatucacccgtttgttgugt

SEQ ID NO: 95595 - DNA, 28 bp, Artificial Sequence
  Synthetic
caggagaagguatccctattttugaaga

SEQ ID NO: 95596 - DNA, 21 bp, Artificial Sequence
  Synthetic
gccccagaauccatcgagtuc

SEQ ID NO: 95597 - DNA, 20 bp, Artificial Sequence
  Synthetic
gtctcuccccgcaaagaguc

SEQ ID NO: 95598 - DNA, 27 bp, Artificial Sequence
  Synthetic
tagtatccuactgaggaguccacaaaa

SEQ ID NO: 95599 - DNA, 28 bp, Artificial Sequence
  Synthetic
aactcactgaccuaagctttgttgauat

SEQ ID NO: 95600 - DNA, 24 bp, Artificial Sequence
  Synthetic
ctttagtgaagaacuggtggcuga

SEQ ID NO: 95601 - DNA, 27 bp, Artificial Sequence
  Synthetic
ttgccauagaaagaaaggacauggaat

SEQ ID NO: 95602 - DNA, 23 bp, Artificial Sequence
  Synthetic
catgcggcauttatctttugcag

SEQ ID NO: 95603 - DNA, 27 bp, Artificial Sequence
  Synthetic
ccgatggaugattctgttttcaugaag

SEQ ID NO: 95604 - DNA, 22 bp, Artificial Sequence
  Synthetic
ctcagcctcugcgcttagauac

SEQ ID NO: 95605 - DNA, 21 bp, Artificial Sequence
  Synthetic
gcagagtgugctcctttccuc

SEQ ID NO: 95606 - DNA, 28 bp, Artificial Sequence
  Synthetic
gtattttcttuaaaagcgctcacuggat

SEQ ID NO: 95607 - DNA, 25 bp, Artificial Sequence
  Synthetic
ctctgagcatuctgcaaagctagua

SEQ ID NO: 95608 - DNA, 28 bp, Artificial Sequence
  Synthetic
gttccugaggaagaactaaauccaaaga

SEQ ID NO: 95609 - DNA, 28 bp, Artificial Sequence
  Synthetic
cacattagcuagaaaagcaaaaccuact

SEQ ID NO: 95610 - DNA, 18 bp, Artificial Sequence
  Synthetic
ccccacccaauggaugct

SEQ ID NO: 95611 - DNA, 20 bp, Artificial Sequence
  Synthetic
aacugagcaggacctccuct

SEQ ID NO: 95612 - DNA, 23 bp, Artificial Sequence
  Synthetic
tgtcactcucaggatagcagcut

SEQ ID NO: 95613 - DNA, 21 bp, Artificial Sequence
  Synthetic
ctgatcagagcucctgcacut

SEQ ID NO: 95614 - DNA, 21 bp, Artificial Sequence
  Synthetic
ccacctcuggacttgccttuc

SEQ ID NO: 95615 - DNA, 19 bp, Artificial Sequence
  Synthetic
gccgagggaaugggctuac

SEQ ID NO: 95616 - DNA, 20 bp, Artificial Sequence
  Synthetic
gccgggacucaggttaucaa

SEQ ID NO: 95617 - DNA, 26 bp, Artificial Sequence
  Synthetic
cctctgtgcaauaacttccctttuct

SEQ ID NO: 95618 - DNA, 23 bp, Artificial Sequence
  Synthetic
acagcccaagcaagauaagtuct

SEQ ID NO: 95619 - DNA, 28 bp, Artificial Sequence
  Synthetic
cagtcactgcaaagaucaaattgatgut

SEQ ID NO: 95620 - DNA, 26 bp, Artificial Sequence
  Synthetic
tgatgacugagaagctaucccagaaa

SEQ ID NO: 95621 - DNA, 22 bp, Artificial Sequence
  Synthetic
guatccaatgcuagcacaggct

SEQ ID NO: 95622 - DNA, 25 bp, Artificial Sequence
  Synthetic
gctcaaaggucagagtcatgaucaa

SEQ ID NO: 95623 - DNA, 25 bp, Artificial Sequence
  Synthetic
cccctgauggtttctctttucacag

SEQ ID NO: 95624 - DNA, 22 bp, Artificial Sequence
  Synthetic
gccccaugagaagugaagagaa

SEQ ID NO: 95625 - DNA, 22 bp, Artificial Sequence
  Synthetic
gcctcuacaggacaagaagcuc

SEQ ID NO: 95626 - DNA, 21 bp, Artificial Sequence
  Synthetic
gggaaagcugtggaacttcut

SEQ ID NO: 95627 - DNA, 29 bp, Artificial Sequence
  Synthetic
gagtctcataggugattttactgttguca

SEQ ID NO: 95628 - DNA, 20 bp, Artificial Sequence
  Synthetic
ccgcacctutggaactccut

SEQ ID NO: 95629 - DNA, 23 bp, Artificial Sequence
  Synthetic
gacactagccutacctggaacuc

SEQ ID NO: 95630 - DNA, 27 bp, Artificial Sequence
  Synthetic
catctttctatgaauctgctccgugat

SEQ ID NO: 95631 - DNA, 21 bp, Artificial Sequence
  Synthetic
tcgcagagautgtgggttcuc

SEQ ID NO: 95632 - DNA, 27 bp, Artificial Sequence
  Synthetic
tcttgaaatgutcctgtccauaaagca

SEQ ID NO: 95633 - DNA, 25 bp, Artificial Sequence
  Synthetic
acacautctgtttgtugaagggaga

SEQ ID NO: 95634 - DNA, 28 bp, Artificial Sequence
  Synthetic
agtggtattatucagcacgacttgatut

SEQ ID NO: 95635 - DNA, 23 bp, Artificial Sequence
  Synthetic
ccagcaaagutaaagcaucaggt

SEQ ID NO: 95636 - DNA, 22 bp, Artificial Sequence
  Synthetic
gcaggacutcttgccttucaca

SEQ ID NO: 95637 - DNA, 21 bp, Artificial Sequence
  Synthetic
gacagcuccactggaauccat

SEQ ID NO: 95638 - DNA, 28 bp, Artificial Sequence
  Synthetic
cattggacatggaucttgtttttctcut

SEQ ID NO: 95639 - DNA, 28 bp, Artificial Sequence
  Synthetic
gccttgtcccacauattataacggatua

SEQ ID NO: 95640 - DNA, 24 bp, Artificial Sequence
  Synthetic
accaactggguaggaaagtctuct

SEQ ID NO: 95641 - DNA, 23 bp, Artificial Sequence
  Synthetic
ggaattccaucacccucaccaac

SEQ ID NO: 95642 - DNA, 28 bp, Artificial Sequence
  Synthetic
gtagcctcuttgacaaactuaagaagga

SEQ ID NO: 95643 - DNA, 26 bp, Artificial Sequence
  Synthetic
gcttguagcaacagacacaattuagg

SEQ ID NO: 95644 - DNA, 22 bp, Artificial Sequence
  Synthetic
acatactctgugcctggaguga

SEQ ID NO: 95645 - DNA, 24 bp, Artificial Sequence
  Synthetic
tcttttactgugcactggatugct

SEQ ID NO: 95646 - DNA, 22 bp, Artificial Sequence
  Synthetic
gatcctguagccagtgatggug

SEQ ID NO: 95647 - DNA, 23 bp, Artificial Sequence
  Synthetic
cacttcctaaacuggtggtguct

SEQ ID NO: 95648 - DNA, 22 bp, Artificial Sequence
  Synthetic
acautcaggguagggaaggact

SEQ ID NO: 95649 - DNA, 26 bp, Artificial Sequence
  Synthetic
aggctgataaugatctgaggaugact

SEQ ID NO: 95650 - DNA, 24 bp, Artificial Sequence
  Synthetic
ctggauagtcatacugccaacacc

SEQ ID NO: 95651 - DNA, 28 bp, Artificial Sequence
  Synthetic
gtttctcatgctuttgagcagagtttua

SEQ ID NO: 95652 - DNA, 21 bp, Artificial Sequence
  Synthetic
tgcatcaaaccuccacgauga

SEQ ID NO: 95653 - DNA, 23 bp, Artificial Sequence
  Synthetic
gctactucactgccauccagaac

SEQ ID NO: 95654 - DNA, 22 bp, Artificial Sequence
  Synthetic
ggcaaacagucaggaagtgcua

SEQ ID NO: 95655 - DNA, 27 bp, Artificial Sequence
  Synthetic
cctggccgaaaauacattgtaaatguc

SEQ ID NO: 95656 - DNA, 23 bp, Artificial Sequence
  Synthetic
acaaaacaacccucctucaggaa

SEQ ID NO: 95657 - DNA, 29 bp, Artificial Sequence
  Synthetic
agaaaatcaagaaaguacacctgttguca

SEQ ID NO: 95658 - DNA, 22 bp, Artificial Sequence
  Synthetic
gggctcacucacttttccucaa

SEQ ID NO: 95659 - DNA, 24 bp, Artificial Sequence
  Synthetic
cagaaagauctgctgtucaaggac

SEQ ID NO: 95660 - DNA, 23 bp, Artificial Sequence
  Synthetic
ctctgctccccaucctcagauat

SEQ ID NO: 95661 - DNA, 25 bp, Artificial Sequence
  Synthetic
agctgtagagucatttgagggacua

SEQ ID NO: 95662 - DNA, 22 bp, Artificial Sequence
  Synthetic
gtgccaguggtttcttgtugaa

SEQ ID NO: 95663 - DNA, 21 bp, Artificial Sequence
  Synthetic
cagcacagaacucaacctucc

SEQ ID NO: 95664 - DNA, 21 bp, Artificial Sequence
  Synthetic
ccucgaaaacccaauggcaga

SEQ ID NO: 95665 - DNA, 28 bp, Artificial Sequence
  Synthetic
cctccctattuaccattgacaccauaat

SEQ ID NO: 95666 - DNA, 21 bp, Artificial Sequence
  Synthetic
gtgacggaguttgcagttuca

SEQ ID NO: 95667 - DNA, 28 bp, Artificial Sequence
  Synthetic
tgtctcaaagaaaacagugcatctuact

SEQ ID NO: 95668 - DNA, 23 bp, Artificial Sequence
  Synthetic
gaactatgcuaccctccctcuct

SEQ ID NO: 95669 - DNA, 21 bp, Artificial Sequence
  Synthetic
catctcccaguccttccucca

SEQ ID NO: 95670 - DNA, 28 bp, Artificial Sequence
  Synthetic
gtgtcugcgagaaaactttguaaaaaca

SEQ ID NO: 95671 - DNA, 26 bp, Artificial Sequence
  Synthetic
ccataacaaaaccauccaaggcttuc

SEQ ID NO: 95672 - DNA, 25 bp, Artificial Sequence
  Synthetic
gacaugaaagcacagatgaatugct

SEQ ID NO: 95673 - DNA, 28 bp, Artificial Sequence
  Synthetic
agagctcttaauatgtgtgcatttuacc

SEQ ID NO: 95674 - DNA, 18 bp, Artificial Sequence
  Synthetic
ccaggaccccucagtgug

SEQ ID NO: 95675 - DNA, 18 bp, Artificial Sequence
  Synthetic
cagcccagaggugacugt

SEQ ID NO: 95676 - DNA, 20 bp, Artificial Sequence
  Synthetic
gacautgatcugcacgccat

SEQ ID NO: 95677 - DNA, 21 bp, Artificial Sequence
  Synthetic
ccccaagaguaaccgctcuct

SEQ ID NO: 95678 - DNA, 28 bp, Artificial Sequence
  Synthetic
gtagtaagaaggaaaaugacagcaugga

SEQ ID NO: 95679 - DNA, 23 bp, Artificial Sequence
  Synthetic
aattccttgcuggtatcauggca

SEQ ID NO: 95680 - DNA, 24 bp, Artificial Sequence
  Synthetic
ttgatgatguagccggtaatccug

SEQ ID NO: 95681 - DNA, 22 bp, Artificial Sequence
  Synthetic
tcgggagaaaagugtgggagua

SEQ ID NO: 95682 - DNA, 24 bp, Artificial Sequence
  Synthetic
ccctttctguaccttttgccauct

SEQ ID NO: 95683 - DNA, 22 bp, Artificial Sequence
  Synthetic
tcagtgggauaagcagcaugac

SEQ ID NO: 95684 - DNA, 21 bp, Artificial Sequence
  Synthetic
gcaccucatcatgugacccat

SEQ ID NO: 95685 - DNA, 28 bp, Artificial Sequence
  Synthetic
ctggtgatcatutatcaagtgcattuct

SEQ ID NO: 95686 - DNA, 20 bp, Artificial Sequence
  Synthetic
gtgcccuctaggaugaagcc

SEQ ID NO: 95687 - DNA, 20 bp, Artificial Sequence
  Synthetic
gtgccgaagcuccagtaguc

SEQ ID NO: 95688 - DNA, 21 bp, Artificial Sequence
  Synthetic
gcagaaguacacagugaccgt

SEQ ID NO: 95689 - DNA, 24 bp, Artificial Sequence
  Synthetic
aaacaggguacgugaagagaaagg

SEQ ID NO: 95690 - DNA, 22 bp, Artificial Sequence
  Synthetic
ccactcgutgaatgguccagaa

SEQ ID NO: 95691 - DNA, 20 bp, Artificial Sequence
  Synthetic
cccggcaagcugatauacgg

SEQ ID NO: 95692 - DNA, 21 bp, Artificial Sequence
  Synthetic
gatggtgucacactcgcagua

SEQ ID NO: 95693 - DNA, 20 bp, Artificial Sequence
  Synthetic
caggagcuggaaggaagcug

SEQ ID NO: 95694 - DNA, 24 bp, Artificial Sequence
  Synthetic
tgagcagatgauggagttgttguc

SEQ ID NO: 95695 - DNA, 20 bp, Artificial Sequence
  Synthetic
tgtccctugtcccacaucac

SEQ ID NO: 95696 - DNA, 23 bp, Artificial Sequence
  Synthetic
cctugggagaacatugcaaaaca

SEQ ID NO: 95697 - DNA, 27 bp, Artificial Sequence
  Synthetic
gccttaaaccuggagttgattauacca

SEQ ID NO: 95698 - DNA, 27 bp, Artificial Sequence
  Synthetic
attatcatggcagugaaggaucaaact

SEQ ID NO: 95699 - DNA, 19 bp, Artificial Sequence
  Synthetic
cggccgugagatgagtguc

SEQ ID NO: 95700 - DNA, 22 bp, Artificial Sequence
  Synthetic
ccagtgacagcauacacaguga

SEQ ID NO: 95701 - DNA, 26 bp, Artificial Sequence
  Synthetic
cctcacactcugaactaaccctttut

SEQ ID NO: 95702 - DNA, 26 bp, Artificial Sequence
  Synthetic
catgctgagacutaattgaacgggua

SEQ ID NO: 95703 - DNA, 22 bp, Artificial Sequence
  Synthetic
agcttcgcugtgtgttttgtuc

SEQ ID NO: 95704 - DNA, 20 bp, Artificial Sequence
  Synthetic
ctgggcccaacugtgtcuaa

SEQ ID NO: 95705 - DNA, 20 bp, Artificial Sequence
  Synthetic
ggcaggcacagucacaauca

SEQ ID NO: 95706 - DNA, 27 bp, Artificial Sequence
  Synthetic
tcattaggcctugtgaaaaaggguaaa

SEQ ID NO: 95707 - DNA, 27 bp, Artificial Sequence
  Synthetic
cttaccttccaugttgcagactttaug

SEQ ID NO: 95708 - DNA, 27 bp, Artificial Sequence
  Synthetic
cctaacuagccgaggaagaactaugaa

SEQ ID NO: 95709 - DNA, 25 bp, Artificial Sequence
  Synthetic
ggaactguaaaccttcccucacaat

SEQ ID NO: 95710 - DNA, 20 bp, Artificial Sequence
  Synthetic
ctgatcguccaggtcaccut

SEQ ID NO: 95711 - DNA, 20 bp, Artificial Sequence
  Synthetic
ggaagggcgauagtccucct

SEQ ID NO: 95712 - DNA, 26 bp, Artificial Sequence
  Synthetic
acatggcatctuctaatccttctgug

SEQ ID NO: 95713 - DNA, 21 bp, Artificial Sequence
  Synthetic
ctggctgcauctcgagactut

SEQ ID NO: 95714 - DNA, 21 bp, Artificial Sequence
  Synthetic
gatcccagugtgagtgcucag

SEQ ID NO: 95715 - DNA, 21 bp, Artificial Sequence
  Synthetic
tcgtcacacucgcagtactug

SEQ ID NO: 95716 - DNA, 28 bp, Artificial Sequence
  Synthetic
gtaggataagutctgaacgucgaaaaga

SEQ ID NO: 95717 - DNA, 25 bp, Artificial Sequence
  Synthetic
aatagctgauggtaagcctcaucac

SEQ ID NO: 95718 - DNA, 21 bp, Artificial Sequence
  Synthetic
cacagcagugacttuggcaag

SEQ ID NO: 95719 - DNA, 24 bp, Artificial Sequence
  Synthetic
ccttcacctaugtttccagtggut

SEQ ID NO: 95720 - DNA, 23 bp, Artificial Sequence
  Synthetic
gttcgcatcutgataaggccuct

SEQ ID NO: 95721 - DNA, 27 bp, Artificial Sequence
  Synthetic
aaaacatugcgaccaccttcuaaaaat

SEQ ID NO: 95722 - DNA, 21 bp, Artificial Sequence
  Synthetic
cctgagcuagggtggtgacut

SEQ ID NO: 95723 - DNA, 21 bp, Artificial Sequence
  Synthetic
caccaucccgaacuggaagag

SEQ ID NO: 95724 - DNA, 24 bp, Artificial Sequence
  Synthetic
tuctcaacaucaaccccaacaaga

SEQ ID NO: 95725 - DNA, 24 bp, Artificial Sequence
  Synthetic
acaaaaagaugtgguggagacaca

SEQ ID NO: 95726 - DNA, 19 bp, Artificial Sequence
  Synthetic
ggtccccacugtgctgtut

SEQ ID NO: 95727 - DNA, 19 bp, Artificial Sequence
  Synthetic
ctccagcuttccctugggt

SEQ ID NO: 95728 - DNA, 19 bp, Artificial Sequence
  Synthetic
ggtgcagaggugctcacug

SEQ ID NO: 95729 - DNA, 19 bp, Artificial Sequence
  Synthetic
cctcacccugtggcaagua

SEQ ID NO: 95730 - DNA, 18 bp, Artificial Sequence
  Synthetic
ctccgccugcacucacat

SEQ ID NO: 95731 - DNA, 19 bp, Artificial Sequence
  Synthetic
gugcgagaggaccacugag

SEQ ID NO: 95732 - DNA, 20 bp, Artificial Sequence
  Synthetic
gccacgaccacuacacucaa

SEQ ID NO: 95733 - DNA, 18 bp, Artificial Sequence
  Synthetic
aggagctuagccgtgcug

SEQ ID NO: 95734 - DNA, 25 bp, Artificial Sequence
  Synthetic
gataatgcauacctgtctctuggca

SEQ ID NO: 95735 - DNA, 19 bp, Artificial Sequence
  Synthetic
tcctcccuatggccacugt

SEQ ID NO: 95736 - DNA, 22 bp, Artificial Sequence
  Synthetic
agaguagaccacaccactguct

SEQ ID NO: 95737 - DNA, 28 bp, Artificial Sequence
  Synthetic
gcagaaagtagugaattgtcttctcuca

SEQ ID NO: 95738 - DNA, 25 bp, Artificial Sequence
  Synthetic
gggucagaagaggaauaaacagaca

SEQ ID NO: 95739 - DNA, 23 bp, Artificial Sequence
  Synthetic
gcatctcacguaccccuacaaag

SEQ ID NO: 95740 - DNA, 23 bp, Artificial Sequence
  Synthetic
cacaaaactucagccccaactut

SEQ ID NO: 95741 - DNA, 20 bp, Artificial Sequence
  Synthetic
caggcucagcaaatggtuca

SEQ ID NO: 95742 - DNA, 20 bp, Artificial Sequence
  Synthetic
cutgctttgacugacagcca

SEQ ID NO: 95743 - DNA, 18 bp, Artificial Sequence
  Synthetic
tcucccccaccgtcucaa

SEQ ID NO: 95744 - DNA, 22 bp, Artificial Sequence
  Synthetic
tgatctgtccuggagacctcug

SEQ ID NO: 95745 - DNA, 23 bp, Artificial Sequence
  Synthetic
acagaaaggcauccuggaaaagg

SEQ ID NO: 95746 - DNA, 25 bp, Artificial Sequence
  Synthetic
aggtgggacuggcttaatauaagga

SEQ ID NO: 95747 - DNA, 28 bp, Artificial Sequence
  Synthetic
ggctagacttttcucctaaagccttaut

SEQ ID NO: 95748 - DNA, 23 bp, Artificial Sequence
  Synthetic
cccactggccuttgttttgtauc

SEQ ID NO: 95749 - DNA, 21 bp, Artificial Sequence
  Synthetic
aactacagcucccccatugac

SEQ ID NO: 95750 - DNA, 19 bp, Artificial Sequence
  Synthetic
gcatgcgccuaccacauca

SEQ ID NO: 95751 - DNA, 18 bp, Artificial Sequence
  Synthetic
cccccagccaguacucac

SEQ ID NO: 95752 - DNA, 21 bp, Artificial Sequence
  Synthetic
gggatgcuagctagggtcuac

SEQ ID NO: 95753 - DNA, 27 bp, Artificial Sequence
  Synthetic
gtctgaaaccaaaaaccutctgtucaa

SEQ ID NO: 95754 - DNA, 24 bp, Artificial Sequence
  Synthetic
gagggtguaaacttctgccaugat

SEQ ID NO: 95755 - DNA, 25 bp, Artificial Sequence
  Synthetic
atttaatgtcugagtgguggaagca

SEQ ID NO: 95756 - DNA, 21 bp, Artificial Sequence
  Synthetic
gccagacacucagtgttguca

SEQ ID NO: 95757 - DNA, 22 bp, Artificial Sequence
  Synthetic
gctactcacugtctgcccttut

SEQ ID NO: 95758 - DNA, 23 bp, Artificial Sequence
  Synthetic
cccaaacagaucccaacacagut

SEQ ID NO: 95759 - DNA, 21 bp, Artificial Sequence
  Synthetic
gaagccuatggcaagugcaag

SEQ ID NO: 95760 - DNA, 26 bp, Artificial Sequence
  Synthetic
ccuatcagttaactugggaggagaaa

SEQ ID NO: 95761 - DNA, 27 bp, Artificial Sequence
  Synthetic
tcataaatugagcggcctaaaagtuct

SEQ ID NO: 95762 - DNA, 24 bp, Artificial Sequence
  Synthetic
cgaatugatgggataugagccaga

SEQ ID NO: 95763 - DNA, 28 bp, Artificial Sequence
  Synthetic
tgtacagaggtugcaacagttaaguaat

SEQ ID NO: 95764 - DNA, 22 bp, Artificial Sequence
  Synthetic
gcaccttgucgtcaccaaatuc

SEQ ID NO: 95765 - DNA, 22 bp, Artificial Sequence
  Synthetic
ccaggcctcugtctctgttgua

SEQ ID NO: 95766 - DNA, 26 bp, Artificial Sequence
  Synthetic
cctatctttcuccttgttaccugcaa

SEQ ID NO: 95767 - DNA, 28 bp, Artificial Sequence
  Synthetic
gcccattgacauaatgtgatggttcuat

SEQ ID NO: 95768 - DNA, 28 bp, Artificial Sequence
  Synthetic
gtattaccctuctctctaggaauccaga

SEQ ID NO: 95769 - DNA, 21 bp, Artificial Sequence
  Synthetic
ctaccaaggcuggatgauggt

SEQ ID NO: 95770 - DNA, 23 bp, Artificial Sequence
  Synthetic
cttcucccaggcaagtacaauct

SEQ ID NO: 95771 - DNA, 28 bp, Artificial Sequence
  Synthetic
ggagcttgcacaautcaaaataacctut

SEQ ID NO: 95772 - DNA, 20 bp, Artificial Sequence
  Synthetic
gagttgtuggtcctcugggt

SEQ ID NO: 95773 - DNA, 21 bp, Artificial Sequence
  Synthetic
ggagugcacgaagtucaaggt

SEQ ID NO: 95774 - DNA, 22 bp, Artificial Sequence
  Synthetic
acacactaugctcctcuccaca

SEQ ID NO: 95775 - DNA, 21 bp, Artificial Sequence
  Synthetic
gctaactuggctccacacuca

SEQ ID NO: 95776 - DNA, 19 bp, Artificial Sequence
  Synthetic
gccccgacucgatgcatuc

SEQ ID NO: 95777 - DNA, 22 bp, Artificial Sequence
  Synthetic
tcctctgaccutcctgctcuac

SEQ ID NO: 95778 - DNA, 22 bp, Artificial Sequence
  Synthetic
ggcttgctccutctttgcctua

SEQ ID NO: 95779 - DNA, 27 bp, Artificial Sequence
  Synthetic
tgcaactctaagaugtgctgaactuac

SEQ ID NO: 95780 - DNA, 19 bp, Artificial Sequence
  Synthetic
cagcaggaggucgcauagt

SEQ ID NO: 95781 - DNA, 21 bp, Artificial Sequence
  Synthetic
ggaaggctcugatccaccuga

SEQ ID NO: 95782 - DNA, 22 bp, Artificial Sequence
  Synthetic
ccttcucaaagcgcctgtacuc

SEQ ID NO: 95783 - DNA, 20 bp, Artificial Sequence
  Synthetic
ggtgtgcugcttcttcccua

SEQ ID NO: 95784 - DNA, 22 bp, Artificial Sequence
  Synthetic
ctcccaugacccagagggaaua

SEQ ID NO: 95785 - DNA, 23 bp, Artificial Sequence
  Synthetic
gctggagatcugctctgtcttug

SEQ ID NO: 95786 - DNA, 22 bp, Artificial Sequence
  Synthetic
tctccgtctuccctggaatuga

SEQ ID NO: 95787 - DNA, 21 bp, Artificial Sequence
  Synthetic
aagtgcccuggtgtttccuac

SEQ ID NO: 95788 - DNA, 24 bp, Artificial Sequence
  Synthetic
tttttacagtucctgccactucct

SEQ ID NO: 95789 - DNA, 28 bp, Artificial Sequence
  Synthetic
tgatgtctggcutgtctttattcttuca

SEQ ID NO: 95790 - DNA, 26 bp, Artificial Sequence
  Synthetic
gccatattugacctcaagtcuagaca

SEQ ID NO: 95791 - DNA, 28 bp, Artificial Sequence
  Synthetic
ccauaaatgagauaaggagaagcccaag

SEQ ID NO: 95792 - DNA, 23 bp, Artificial Sequence
  Synthetic
tccaaugaacaacggtcatguct

SEQ ID NO: 95793 - DNA, 21 bp, Artificial Sequence
  Synthetic
accacccaaugttcagcucac

SEQ ID NO: 95794 - DNA, 19 bp, Artificial Sequence
  Synthetic
catgggucccagctgagug

SEQ ID NO: 95795 - DNA, 21 bp, Artificial Sequence
  Synthetic
cgtgccatguctggtcttcut

SEQ ID NO: 95796 - DNA, 19 bp, Artificial Sequence
  Synthetic
cacccgcacucgataucca

SEQ ID NO: 95797 - DNA, 26 bp, Artificial Sequence
  Synthetic
cctctaaccaaugacaatcucgacag

SEQ ID NO: 95798 - DNA, 20 bp, Artificial Sequence
  Synthetic
acutggccacugacgagaag

SEQ ID NO: 95799 - DNA, 23 bp, Artificial Sequence
  Synthetic
ataaaggacagutccccaaccug

SEQ ID NO: 95800 - DNA, 22 bp, Artificial Sequence
  Synthetic
gcacatttgutttcccctgucc

SEQ ID NO: 95801 - DNA, 22 bp, Artificial Sequence
  Synthetic
tcacactctguggtccactuct

SEQ ID NO: 95802 - DNA, 23 bp, Artificial Sequence
  Synthetic
tctctaccagugacatggcugaa

SEQ ID NO: 95803 - DNA, 22 bp, Artificial Sequence
  Synthetic
tggcaucagtgguaaacaccag

SEQ ID NO: 95804 - DNA, 22 bp, Artificial Sequence
  Synthetic
ctgaaccugtctugagcgacat

SEQ ID NO: 95805 - DNA, 22 bp, Artificial Sequence
  Synthetic
ggccactuctgaatctgugacc

SEQ ID NO: 95806 - DNA, 26 bp, Artificial Sequence
  Synthetic
aaatatttctugacctgctuccccat

SEQ ID NO: 95807 - DNA, 23 bp, Artificial Sequence
  Synthetic
agacaccuggagcaagaaggaua

SEQ ID NO: 95808 - DNA, 23 bp, Artificial Sequence
  Synthetic
ggaggaatgaugcatcccactug

SEQ ID NO: 95809 - DNA, 21 bp, Artificial Sequence
  Synthetic
accauaggtggugccagagat

SEQ ID NO: 95810 - DNA, 20 bp, Artificial Sequence
  Synthetic
ctggagcagguttccucgat

SEQ ID NO: 95811 - DNA, 25 bp, Artificial Sequence
  Synthetic
ctcgacctgaugtatgtatgtgcut

SEQ ID NO: 95812 - DNA, 24 bp, Artificial Sequence
  Synthetic
cacaaagctacuggctgtgattuc

SEQ ID NO: 95813 - DNA, 22 bp, Artificial Sequence
  Synthetic
atgacugaaggctgacttuccc

SEQ ID NO: 95814 - DNA, 24 bp, Artificial Sequence
  Synthetic
gacctaggcaaauagatgggcaut

SEQ ID NO: 95815 - DNA, 21 bp, Artificial Sequence
  Synthetic
tcctgttggautctggcctuc

SEQ ID NO: 95816 - DNA, 25 bp, Artificial Sequence
  Synthetic
gaatcctcguagaaggacattgugt

SEQ ID NO: 95817 - DNA, 20 bp, Artificial Sequence
  Synthetic
caggcaaggcccacutctua

SEQ ID NO: 95818 - DNA, 22 bp, Artificial Sequence
  Synthetic
aggatgagaguctgcagagcut

SEQ ID NO: 95819 - DNA, 20 bp, Artificial Sequence
  Synthetic
ggauggtgtguacgaagcca

SEQ ID NO: 95820 - DNA, 25 bp, Artificial Sequence
  Synthetic
ttttatcaaagcutactggccaugt

SEQ ID NO: 95821 - DNA, 25 bp, Artificial Sequence
  Synthetic
actgaggttggutactgttggtauc

SEQ ID NO: 95822 - DNA, 28 bp, Artificial Sequence
  Synthetic
ctttcaggttauccacaacagaatcuga

SEQ ID NO: 95823 - DNA, 20 bp, Artificial Sequence
  Synthetic
cgagggaccuggaagttgut

SEQ ID NO: 95824 - DNA, 23 bp, Artificial Sequence
  Synthetic
gcacaggccacautcacgtauat

SEQ ID NO: 95825 - DNA, 22 bp, Artificial Sequence
  Synthetic
tcatauccaggctgtgucgact

SEQ ID NO: 95826 - DNA, 28 bp, Artificial Sequence
  Synthetic
tcctttagauagcaagactttccucagt

SEQ ID NO: 95827 - DNA, 26 bp, Artificial Sequence
  Synthetic
cgctgaatcttugctatggtgaauat

SEQ ID NO: 95828 - DNA, 26 bp, Artificial Sequence
  Synthetic
gttttcactggaautcaggtctauga

SEQ ID NO: 95829 - DNA, 24 bp, Artificial Sequence
  Synthetic
gagtgtgtgugtcttggtaaugga

SEQ ID NO: 95830 - DNA, 24 bp, Artificial Sequence
  Synthetic
cctgugcaaactcatcuagggaaa

SEQ ID NO: 95831 - DNA, 26 bp, Artificial Sequence
  Synthetic
gacatcacutacaatgugaacgacac

SEQ ID NO: 95832 - DNA, 22 bp, Artificial Sequence
  Synthetic
atgggctgguaagagacatgug

SEQ ID NO: 95833 - DNA, 23 bp, Artificial Sequence
  Synthetic
ctgaattccgggacugggattua

SEQ ID NO: 95834 - DNA, 23 bp, Artificial Sequence
  Synthetic
cctcttcaugacgcttguggaat

SEQ ID NO: 95835 - DNA, 28 bp, Artificial Sequence
  Synthetic
agtggaaguagttgtatgcttugagaag

SEQ ID NO: 95836 - DNA, 22 bp, Artificial Sequence
  Synthetic
gcttgcagguccattctcctut

SEQ ID NO: 95837 - DNA, 29 bp, Artificial Sequence
  Synthetic
ccctctcctaacautttcgttgtatctuc

SEQ ID NO: 95838 - DNA, 17 bp, Artificial Sequence
  Synthetic
gcggcgaccugcaucat

SEQ ID NO: 95839 - DNA, 18 bp, Artificial Sequence
  Synthetic
ttcaggcacgugcugaag

SEQ ID NO: 95840 - DNA, 31 bp, Artificial Sequence
  Synthetic
ttctcttagugaaaagttaacatttgugact

SEQ ID NO: 95841 - DNA, 21 bp, Artificial Sequence
  Synthetic
ggttuggcccgagaaauacga

SEQ ID NO: 95842 - DNA, 23 bp, Artificial Sequence
  Synthetic
tttgaucgtatttcucgggccaa

SEQ ID NO: 95843 - DNA, 28 bp, Artificial Sequence
  Synthetic
tttggatttcttcucctctactgtcuct

SEQ ID NO: 95844 - DNA, 23 bp, Artificial Sequence
  Synthetic
tgaaactggutggagttgtuggt

SEQ ID NO: 95845 - DNA, 19 bp, Artificial Sequence
  Synthetic
ccutcguggacaagaccgt

SEQ ID NO: 95846 - DNA, 18 bp, Artificial Sequence
  Synthetic
gugcgtgtucacgaacgg

SEQ ID NO: 95847 - DNA, 22 bp, Artificial Sequence
  Synthetic
cccugcuaggagagaggaaaca

SEQ ID NO: 95848 - DNA, 26 bp, Artificial Sequence
  Synthetic
tgaaccccacugatttaccattctut

SEQ ID NO: 95849 - DNA, 25 bp, Artificial Sequence
  Synthetic
gctctuaaggacacttugacaagca

SEQ ID NO: 95850 - DNA, 20 bp, Artificial Sequence
  Synthetic
ggcaggcaaguacctucact

SEQ ID NO: 95851 - DNA, 24 bp, Artificial Sequence
  Synthetic
caaggtctgguatctgctcctuac

SEQ ID NO: 95852 - DNA, 22 bp, Artificial Sequence
  Synthetic
gttcccccagucttaauccaca

SEQ ID NO: 95853 - DNA, 21 bp, Artificial Sequence
  Synthetic
ctgtgacccutgatggtggut

SEQ ID NO: 95854 - DNA, 20 bp, Artificial Sequence
  Synthetic
gacaactcccugagctgguc

SEQ ID NO: 95855 - DNA, 24 bp, Artificial Sequence
  Synthetic
gctgtagtgaaacuccttgggtut

SEQ ID NO: 95856 - DNA, 20 bp, Artificial Sequence
  Synthetic
caggccugcctcgtatauga

SEQ ID NO: 95857 - DNA, 23 bp, Artificial Sequence
  Synthetic
ctttttgaggucctgaaguccca

SEQ ID NO: 95858 - DNA, 24 bp, Artificial Sequence
  Synthetic
cccatgagauggttgtcugagaga

SEQ ID NO: 95859 - DNA, 22 bp, Artificial Sequence
  Synthetic
cauaaggcauaggccaagacca

SEQ ID NO: 95860 - DNA, 29 bp, Artificial Sequence
  Synthetic
caagactgtggaauctataactgacauca

SEQ ID NO: 95861 - DNA, 18 bp, Artificial Sequence
  Synthetic
ccaagggucagcgtccua

SEQ ID NO: 95862 - DNA, 24 bp, Artificial Sequence
  Synthetic
gtaggtgaagcugagggttatgug

SEQ ID NO: 95863 - DNA, 21 bp, Artificial Sequence
  Synthetic
gttcatcauggtgguggcaat

SEQ ID NO: 95864 - DNA, 22 bp, Artificial Sequence
  Synthetic
ggcagguagcatgtgaugaaca

SEQ ID NO: 95865 - DNA, 21 bp, Artificial Sequence
  Synthetic
ccagcuggagttctttaugcc

SEQ ID NO: 95866 - DNA, 21 bp, Artificial Sequence
  Synthetic
ccccaaaagcccagugtcuac

SEQ ID NO: 95867 - DNA, 21 bp, Artificial Sequence
  Synthetic
gcttccacaugaagaccugga

SEQ ID NO: 95868 - DNA, 25 bp, Artificial Sequence
  Synthetic
cggccaaautgaaaagguaaacagt

SEQ ID NO: 95869 - DNA, 19 bp, Artificial Sequence
  Synthetic
atguacaacgggtcgugct

SEQ ID NO: 95870 - DNA, 19 bp, Artificial Sequence
  Synthetic
agatggtgucccccucgat

SEQ ID NO: 95871 - DNA, 20 bp, Artificial Sequence
  Synthetic
ggtgagugctaacgcucaga

SEQ ID NO: 95872 - DNA, 27 bp, Artificial Sequence
  Synthetic
cttgaaggagcaaaauaagatgaugcc

SEQ ID NO: 95873 - DNA, 24 bp, Artificial Sequence
  Synthetic
ggtcatccugggaacagtgtauct

SEQ ID NO: 95874 - DNA, 22 bp, Artificial Sequence
  Synthetic
gcagagauggttcuccagcaaa

SEQ ID NO: 95875 - DNA, 20 bp, Artificial Sequence
  Synthetic
tcgtgttccutacggtggug

SEQ ID NO: 95876 - DNA, 20 bp, Artificial Sequence
  Synthetic
cgacccctuagcacgagtua

SEQ ID NO: 95877 - DNA, 19 bp, Artificial Sequence
  Synthetic
atttcgaaccucggucgca

SEQ ID NO: 95878 - DNA, 24 bp, Artificial Sequence
  Synthetic
ggtggaccacuttgaaataccugt

SEQ ID NO: 95879 - DNA, 27 bp, Artificial Sequence
  Synthetic
ccttttcggacagacuattaccucaga

SEQ ID NO: 95880 - DNA, 24 bp, Artificial Sequence
  Synthetic
ctatttgccacacugatgcaacuc

SEQ ID NO: 95881 - DNA, 27 bp, Artificial Sequence
  Synthetic
gtattattttucaagcccctccttucc

SEQ ID NO: 95882 - DNA, 28 bp, Artificial Sequence
  Synthetic
ctgcagatttugagcttgttgtagaaut

SEQ ID NO: 95883 - DNA, 25 bp, Artificial Sequence
  Synthetic
ctagactcuatttcctcuggacggt

SEQ ID NO: 95884 - DNA, 29 bp, Artificial Sequence
  Synthetic
tgatgaccaaacugtacctctctttaaug

SEQ ID NO: 95885 - DNA, 23 bp, Artificial Sequence
  Synthetic
agaagctcaaccaugccaatgua

SEQ ID NO: 95886 - DNA, 28 bp, Artificial Sequence
  Synthetic
ctgtacctctcuttaatgagctgguaaa

SEQ ID NO: 95887 - DNA, 28 bp, Artificial Sequence
  Synthetic
tgttttgttttgugtttattcctugcct

SEQ ID NO: 95888 - DNA, 28 bp, Artificial Sequence
  Synthetic
atggataacagaaaaugacagtgauggt

SEQ ID NO: 95889 - DNA, 25 bp, Artificial Sequence
  Synthetic
cacttatgagcgucctaaagacucc

SEQ ID NO: 95890 - DNA, 22 bp, Artificial Sequence
  Synthetic
tgcagguacagtcccagaucat

SEQ ID NO: 95891 - DNA, 23 bp, Artificial Sequence
  Synthetic
ggctcacauggactttcctttuc

SEQ ID NO: 95892 - DNA, 28 bp, Artificial Sequence
  Synthetic
ttgcttatttcugtttcagttttguggt

SEQ ID NO: 95893 - DNA, 24 bp, Artificial Sequence
  Synthetic
ccgaaacccaaaaugagtctccua

SEQ ID NO: 95894 - DNA, 22 bp, Artificial Sequence
  Synthetic
acaacacuggaggtgagaucct

SEQ ID NO: 95895 - DNA, 21 bp, Artificial Sequence
  Synthetic
ggatggaccgcuacctcauct

SEQ ID NO: 95896 - DNA, 20 bp, Artificial Sequence
  Synthetic
acctcggcuctcauccacat

SEQ ID NO: 95897 - DNA, 19 bp, Artificial Sequence
  Synthetic
cugcagctgucgaacaacc

SEQ ID NO: 95898 - DNA, 18 bp, Artificial Sequence
  Synthetic
gcaggucctgccctucac

SEQ ID NO: 95899 - DNA, 17 bp, Artificial Sequence
  Synthetic
tggcaccgaugcucaca

SEQ ID NO: 95900 - DNA, 24 bp, Artificial Sequence
  Synthetic
ccacagacacagaaacugaugacc

SEQ ID NO: 95901 - DNA, 21 bp, Artificial Sequence
  Synthetic
gtttcagcggugggtaaugga

SEQ ID NO: 95902 - DNA, 21 bp, Artificial Sequence
  Synthetic
gccagccagutgtctccuaag

SEQ ID NO: 95903 - DNA, 21 bp, Artificial Sequence
  Synthetic
ctggctaagucgagaggcaut

SEQ ID NO: 95904 - DNA, 26 bp, Artificial Sequence
  Synthetic
ccucacccaacgaaaaatuacagaat

SEQ ID NO: 95905 - DNA, 25 bp, Artificial Sequence
  Synthetic
ccagtgactcuggatttggttcuaa

SEQ ID NO: 95906 - DNA, 28 bp, Artificial Sequence
  Synthetic
tgcactcaaucaagaagttgcatuaaaa

SEQ ID NO: 95907 - DNA, 24 bp, Artificial Sequence
  Synthetic
acctaccucaggtgaactttguct

SEQ ID NO: 95908 - DNA, 20 bp, Artificial Sequence
  Synthetic
gtcaguggaagcccggauag

SEQ ID NO: 95909 - DNA, 21 bp, Artificial Sequence
  Synthetic
tgcccttgauggtcacactug

SEQ ID NO: 95910 - DNA, 28 bp, Artificial Sequence
  Synthetic
agattcagtcugtttacaaatgugagca

SEQ ID NO: 95911 - DNA, 28 bp, Artificial Sequence
  Synthetic
gtcttatttccaggucaacaaaggatuc

SEQ ID NO: 95912 - DNA, 17 bp, Artificial Sequence
  Synthetic
ctcugggcgactgugct

SEQ ID NO: 95913 - DNA, 19 bp, Artificial Sequence
  Synthetic
ggctccaaguccgcaacut

SEQ ID NO: 95914 - DNA, 23 bp, Artificial Sequence
  Synthetic
catccaagucagcccaatcauct

SEQ ID NO: 95915 - DNA, 27 bp, Artificial Sequence
  Synthetic
ttctgttaaugccaagtattgcttucc

SEQ ID NO: 95916 - DNA, 27 bp, Artificial Sequence
  Synthetic
gggattaacucaggtaaaaugcacaca

SEQ ID NO: 95917 - DNA, 25 bp, Artificial Sequence
  Synthetic
ctcatttccucatggtcacauggat

SEQ ID NO: 95918 - DNA, 23 bp, Artificial Sequence
  Synthetic
gtaugagggaacacacttgugct

SEQ ID NO: 95919 - DNA, 24 bp, Artificial Sequence
  Synthetic
tgacttcatgccuctactctcuca

SEQ ID NO: 95920 - DNA, 27 bp, Artificial Sequence
  Synthetic
ctggacacagugtgtttgattttacuc

SEQ ID NO: 95921 - DNA, 28 bp, Artificial Sequence
  Synthetic
gccttgggtaaguacaatagcaaagtut

SEQ ID NO: 95922 - DNA, 24 bp, Artificial Sequence
  Synthetic
ctggcaaauaaaactagggcauga

SEQ ID NO: 95923 - DNA, 21 bp, Artificial Sequence
  Synthetic
cuactccugcaccacagaagg

SEQ ID NO: 95924 - DNA, 20 bp, Artificial Sequence
  Synthetic
gggaaggguctggaauaggt

SEQ ID NO: 95925 - DNA, 23 bp, Artificial Sequence
  Synthetic
gtgtcctggguacatgtcttugt

SEQ ID NO: 95926 - DNA, 27 bp, Artificial Sequence
  Synthetic
gaaagaaagaagaacuctaagcugggt

SEQ ID NO: 95927 - DNA, 27 bp, Artificial Sequence
  Synthetic
caattgagtgctucatgcctttagaug

SEQ ID NO: 95928 - DNA, 21 bp, Artificial Sequence
  Synthetic
caccaaagaugtccgtccugt

SEQ ID NO: 95929 - DNA, 27 bp, Artificial Sequence
  Synthetic
gcatctctgttuactgacactctttug

SEQ ID NO: 95930 - DNA, 24 bp, Artificial Sequence
  Synthetic
gggaatcttcuctgtcagcctgua

SEQ ID NO: 95931 - DNA, 27 bp, Artificial Sequence
  Synthetic
cctatctataagcagcugtcatgaguc

SEQ ID NO: 95932 - DNA, 21 bp, Artificial Sequence
  Synthetic
tcaccuaacaugagcccacac

SEQ ID NO: 95933 - DNA, 20 bp, Artificial Sequence
  Synthetic
gcaaacggaagccugugact

SEQ ID NO: 95934 - DNA, 21 bp, Artificial Sequence
  Synthetic
caagauggcagcttcuagcct

SEQ ID NO: 95935 - DNA, 21 bp, Artificial Sequence
  Synthetic
cgtggatgaugccaccttcut

SEQ ID NO: 95936 - DNA, 19 bp, Artificial Sequence
  Synthetic
acccggacacaugcctuct

SEQ ID NO: 95937 - DNA, 18 bp, Artificial Sequence
  Synthetic
gaagcagcuguccccaca

SEQ ID NO: 95938 - DNA, 21 bp, Artificial Sequence
  Synthetic
cgcagguaaagcgtcacttut

SEQ ID NO: 95939 - DNA, 20 bp, Artificial Sequence
  Synthetic
ggatccugactccatucgct

SEQ ID NO: 95940 - DNA, 17 bp, Artificial Sequence
  Synthetic
augtcgucagccgcaca

SEQ ID NO: 95941 - DNA, 19 bp, Artificial Sequence
  Synthetic
agtcctccauggccaguca

SEQ ID NO: 95942 - DNA, 21 bp, Artificial Sequence
  Synthetic
cttcctgggcugtgtgtttuc

SEQ ID NO: 95943 - DNA, 21 bp, Artificial Sequence
  Synthetic
acagctgccacautcacacut

SEQ ID NO: 95944 - DNA, 21 bp, Artificial Sequence
  Synthetic
gtactgacaccugcatgucca

SEQ ID NO: 95945 - DNA, 22 bp, Artificial Sequence
  Synthetic
ctctctccagacuccacacuca

SEQ ID NO: 95946 - DNA, 26 bp, Artificial Sequence
  Synthetic
ctttttccattuctctctccctucca

SEQ ID NO: 95947 - DNA, 24 bp, Artificial Sequence
  Synthetic
aaaaugcttccaauggcaaaggaa

SEQ ID NO: 95948 - DNA, 21 bp, Artificial Sequence
  Synthetic
gggccacgcacutttctcaua

SEQ ID NO: 95949 - DNA, 25 bp, Artificial Sequence
  Synthetic
tcagtggttgaauccttactcctug

SEQ ID NO: 95950 - DNA, 22 bp, Artificial Sequence
  Synthetic
gggatguggaagaaactgtgut

SEQ ID NO: 95951 - DNA, 25 bp, Artificial Sequence
  Synthetic
gcattctcccuttcactcactttuc

SEQ ID NO: 95952 - DNA, 22 bp, Artificial Sequence
  Synthetic
acaggtcacauctggctcctua

SEQ ID NO: 95953 - DNA, 21 bp, Artificial Sequence
  Synthetic
gagaauaagtgcgugcccaac

SEQ ID NO: 95954 - DNA, 20 bp, Artificial Sequence
  Synthetic
ctgagugcgaggagttgugt

SEQ ID NO: 95955 - DNA, 23 bp, Artificial Sequence
  Synthetic
gcttgatgaccucaggaatguca

SEQ ID NO: 95956 - DNA, 19 bp, Artificial Sequence
  Synthetic
aggtcgccaccuagctuct

SEQ ID NO: 95957 - DNA, 22 bp, Artificial Sequence
  Synthetic
tgtggctccutttgttctgucc

SEQ ID NO: 95958 - DNA, 21 bp, Artificial Sequence
  Synthetic
gccgtaguatctctcgtugct

SEQ ID NO: 95959 - DNA, 23 bp, Artificial Sequence
  Synthetic
gactcagguttgaagagcugact

SEQ ID NO: 95960 - DNA, 20 bp, Artificial Sequence
  Synthetic
gcctggcacauccagtctua

SEQ ID NO: 95961 - DNA, 25 bp, Artificial Sequence
  Synthetic
gcgtgcatcugtcttgtgtctauat

SEQ ID NO: 95962 - DNA, 23 bp, Artificial Sequence
  Synthetic
augcatggaactugaggagacaa

SEQ ID NO: 95963 - DNA, 22 bp, Artificial Sequence
  Synthetic
cagtttcccautatgccgtugg

SEQ ID NO: 95964 - DNA, 21 bp, Artificial Sequence
  Synthetic
aacatgaccuttgaccugcca

SEQ ID NO: 95965 - DNA, 27 bp, Artificial Sequence
  Synthetic
ctcgtgaaatugagagtgagtgtaugt

SEQ ID NO: 95966 - DNA, 23 bp, Artificial Sequence
  Synthetic
cagacattcgutcccactcauct

SEQ ID NO: 95967 - DNA, 29 bp, Artificial Sequence
  Synthetic
agtcattcgatuttcttcttatgguccaa

SEQ ID NO: 95968 - DNA, 23 bp, Artificial Sequence
  Synthetic
ctcgugattgctttuggaagagg

SEQ ID NO: 95969 - DNA, 26 bp, Artificial Sequence
  Synthetic
tcataatcggcccautttggttctua

SEQ ID NO: 95970 - DNA, 23 bp, Artificial Sequence
  Synthetic
agtcagcugagggaaagtaucct

SEQ ID NO: 95971 - DNA, 21 bp, Artificial Sequence
  Synthetic
cattctuccacacccagccua

SEQ ID NO: 95972 - DNA, 22 bp, Artificial Sequence
  Synthetic
ggtaucaacccaggagtgctuc

SEQ ID NO: 95973 - DNA, 23 bp, Artificial Sequence
  Synthetic
gcttacatuggccccataucagt

SEQ ID NO: 95974 - DNA, 28 bp, Artificial Sequence
  Synthetic
gcaaagtatauggaagcttctucaggaa

SEQ ID NO: 95975 - DNA, 24 bp, Artificial Sequence
  Synthetic
gcutctgtgtctucagcaaaaagt

SEQ ID NO: 95976 - DNA, 27 bp, Artificial Sequence
  Synthetic
ctttttacagccuaatagtcccaguga

SEQ ID NO: 95977 - DNA, 27 bp, Artificial Sequence
  Synthetic
cctgagtagaaaaugggttctttgcut

SEQ ID NO: 95978 - DNA, 28 bp, Artificial Sequence
  Synthetic
ggtagaaaaacuttttgcugaagacaca

SEQ ID NO: 95979 - DNA, 24 bp, Artificial Sequence
  Synthetic
gagtttttacaauggccacaccut

SEQ ID NO: 95980 - DNA, 23 bp, Artificial Sequence
  Synthetic
aagcccgttuacattgtggguat

SEQ ID NO: 95981 - DNA, 22 bp, Artificial Sequence
  Synthetic
gactgagacgaucactggctuc

SEQ ID NO: 95982 - DNA, 26 bp, Artificial Sequence
  Synthetic
agagcattaataaucactgccctgut

SEQ ID NO: 95983 - DNA, 24 bp, Artificial Sequence
  Synthetic
gagaagtatgugcatggtgucaga

SEQ ID NO: 95984 - DNA, 21 bp, Artificial Sequence
  Synthetic
gccatagcaguagcactggua

SEQ ID NO: 95985 - DNA, 26 bp, Artificial Sequence
  Synthetic
aggctgtttaucttttccttccaugt

SEQ ID NO: 95986 - DNA, 20 bp, Artificial Sequence
  Synthetic
gctggaacggcaucaactug

SEQ ID NO: 95987 - DNA, 24 bp, Artificial Sequence
  Synthetic
caggcactaauctctagctaugct

SEQ ID NO: 95988 - DNA, 28 bp, Artificial Sequence
  Synthetic
tcaagacataaacuaaccaacaagtuca

SEQ ID NO: 95989 - DNA, 23 bp, Artificial Sequence
  Synthetic
ctctggtucagactgcaguaacc

SEQ ID NO: 95990 - DNA, 23 bp, Artificial Sequence
  Synthetic
aaaccaagcaguggttacguact

SEQ ID NO: 95991 - DNA, 24 bp, Artificial Sequence
  Synthetic
gtggatgtugcatttgctttucac

SEQ ID NO: 95992 - DNA, 28 bp, Artificial Sequence
  Synthetic
tttccaaaacaaugatgaacatucagca

SEQ ID NO: 95993 - DNA, 21 bp, Artificial Sequence
  Synthetic
acctctttuggcaagcaucct

SEQ ID NO: 95994 - DNA, 22 bp, Artificial Sequence
  Synthetic
gacaagucaccacaggacagua

SEQ ID NO: 95995 - DNA, 28 bp, Artificial Sequence
  Synthetic
ttacttaccucacaacgtaatucacaca

SEQ ID NO: 95996 - DNA, 24 bp, Artificial Sequence
  Synthetic
tctcaaccacagugcattgtaugt

SEQ ID NO: 95997 - DNA, 33 bp, Artificial Sequence
  Synthetic
ttggtagcgatguaaaagaattaaaatttagut

SEQ ID NO: 95998 - DNA, 23 bp, Artificial Sequence
  Synthetic
gggcaatcaauggatgaaagugg

SEQ ID NO: 95999 - DNA, 28 bp, Artificial Sequence
  Synthetic
cagttaacttgauccaaagctctgagua

SEQ ID NO: 96000 - DNA, 24 bp, Artificial Sequence
  Synthetic
gaaacctacugcagggugaagaat

SEQ ID NO: 96001 - DNA, 26 bp, Artificial Sequence
  Synthetic
gcagtattguagccaggcttcuaaaa

SEQ ID NO: 96002 - DNA, 28 bp, Artificial Sequence
  Synthetic
cttactgtaacugctgatggttaugaga

SEQ ID NO: 96003 - DNA, 23 bp, Artificial Sequence
  Synthetic
tcacgutgtacttguccacagag

SEQ ID NO: 96004 - DNA, 17 bp, Artificial Sequence
  Synthetic
ccucacccgugcccaag

SEQ ID NO: 96005 - DNA, 17 bp, Artificial Sequence
  Synthetic
cccagcccuaccgtgut

SEQ ID NO: 96006 - DNA, 23 bp, Artificial Sequence
  Synthetic
accucacctaugagaggaaggac

SEQ ID NO: 96007 - DNA, 22 bp, Artificial Sequence
  Synthetic
ttaacagcaugacgugcagaga

SEQ ID NO: 96008 - DNA, 21 bp, Artificial Sequence
  Synthetic
ctgacaccauccgtctgtcut

SEQ ID NO: 96009 - DNA, 21 bp, Artificial Sequence
  Synthetic
agatagtcuggtagccugcgt

SEQ ID NO: 96010 - DNA, 22 bp, Artificial Sequence
  Synthetic
tctccauccctttgagcuccat

SEQ ID NO: 96011 - DNA, 22 bp, Artificial Sequence
  Synthetic
acatttccaaauccccctgucc

SEQ ID NO: 96012 - DNA, 21 bp, Artificial Sequence
  Synthetic
cctcatcgucctcatcgccua

SEQ ID NO: 96013 - DNA, 20 bp, Artificial Sequence
  Synthetic
cccctucgacaggacccuaa

SEQ ID NO: 96014 - DNA, 22 bp, Artificial Sequence
  Synthetic
ccttcctgcauccagggaatut

SEQ ID NO: 96015 - DNA, 23 bp, Artificial Sequence
  Synthetic
ctctcgaauccaggcaaggaaut

SEQ ID NO: 96016 - DNA, 21 bp, Artificial Sequence
  Synthetic
gggaaaugaaagagcgcctug

SEQ ID NO: 96017 - DNA, 22 bp, Artificial Sequence
  Synthetic
cccagcaggaucagagaaagug

SEQ ID NO: 96018 - DNA, 28 bp, Artificial Sequence
  Synthetic
agaactagaccauggattaggtggaaua

SEQ ID NO: 96019 - DNA, 29 bp, Artificial Sequence
  Synthetic
agagtttttgacaaautgagttctgcaut

SEQ ID NO: 96020 - DNA, 21 bp, Artificial Sequence
  Synthetic
gtgacctuctcgtcacuggaa

SEQ ID NO: 96021 - DNA, 24 bp, Artificial Sequence
  Synthetic
gatcggaagutgctttgtttugct

SEQ ID NO: 96022 - DNA, 22 bp, Artificial Sequence
  Synthetic
gcucagggctgtaucacagaga

SEQ ID NO: 96023 - DNA, 23 bp, Artificial Sequence
  Synthetic
ctgggagcuctattccacctuac

SEQ ID NO: 96024 - DNA, 21 bp, Artificial Sequence
  Synthetic
ggaggaccgugggtgaagaua

SEQ ID NO: 96025 - DNA, 22 bp, Artificial Sequence
  Synthetic
ttactcugcccagacaacacuc

SEQ ID NO: 96026 - DNA, 20 bp, Artificial Sequence
  Synthetic
gtctcagucacctcggtgut

SEQ ID NO: 96027 - DNA, 26 bp, Artificial Sequence
  Synthetic
gcttggttaaacugaggttctccaua

SEQ ID NO: 96028 - DNA, 25 bp, Artificial Sequence
  Synthetic
ccagcccauctttcttctattcuga

SEQ ID NO: 96029 - DNA, 22 bp, Artificial Sequence
  Synthetic
ttgtcaccagguctcctaugga

SEQ ID NO: 96030 - DNA, 23 bp, Artificial Sequence
  Synthetic
ctttgaacttguccactggctuc

SEQ ID NO: 96031 - DNA, 23 bp, Artificial Sequence
  Synthetic
gggaactauagctcgaggtuact

SEQ ID NO: 96032 - DNA, 22 bp, Artificial Sequence
  Synthetic
ggttgucacagccaatcatcuc

SEQ ID NO: 96033 - DNA, 24 bp, Artificial Sequence
  Synthetic
gacactttcucttcctctuggcat

SEQ ID NO: 96034 - DNA, 26 bp, Artificial Sequence
  Synthetic
gggttttgttautgtacaggaaaugg

SEQ ID NO: 96035 - DNA, 24 bp, Artificial Sequence
  Synthetic
acatggaagccauggaattctuca

SEQ ID NO: 96036 - DNA, 29 bp, Artificial Sequence
  Synthetic
acttgataacaacauttcactgctctuca

SEQ ID NO: 96037 - DNA, 26 bp, Artificial Sequence
  Synthetic
aactttgttttccuctgcctcauaca

SEQ ID NO: 96038 - DNA, 21 bp, Artificial Sequence
  Synthetic
acaacagcugcctcuccaaaa

SEQ ID NO: 96039 - DNA, 22 bp, Artificial Sequence
  Synthetic
ctcattgcaaagugcacacuca

SEQ ID NO: 96040 - DNA, 22 bp, Artificial Sequence
  Synthetic
gggttcatctucaagggtggut

SEQ ID NO: 96041 - DNA, 22 bp, Artificial Sequence
  Synthetic
gcttctctgcugagtcccatuc

SEQ ID NO: 96042 - DNA, 27 bp, Artificial Sequence
  Synthetic
agatgaggutctagtattucccgaaca

SEQ ID NO: 96043 - DNA, 28 bp, Artificial Sequence
  Synthetic
gcttcactguggacttacaaatguaaaa

SEQ ID NO: 96044 - DNA, 23 bp, Artificial Sequence
  Synthetic
ctgtgtgaccauctcgtgtgaut

SEQ ID NO: 96045 - DNA, 19 bp, Artificial Sequence
  Synthetic
tgccuagccgaagctgaug

SEQ ID NO: 96046 - DNA, 18 bp, Artificial Sequence
  Synthetic
cccucaccucgcaagcat

SEQ ID NO: 96047 - DNA, 20 bp, Artificial Sequence
  Synthetic
tcccuccccaacccttctua

SEQ ID NO: 96048 - DNA, 21 bp, Artificial Sequence
  Synthetic
ccagtgcucagtaacgtgcuc

SEQ ID NO: 96049 - DNA, 23 bp, Artificial Sequence
  Synthetic
agtgcccaugatatgcaggaauc

SEQ ID NO: 96050 - DNA, 27 bp, Artificial Sequence
  Synthetic
caggtatgucaaggaagatacagtugt

SEQ ID NO: 96051 - DNA, 28 bp, Artificial Sequence
  Synthetic
gaccgtcatggugaaaatattctcttug

SEQ ID NO: 96052 - DNA, 32 bp, Artificial Sequence
  Synthetic
tcacaaataagatucacgtagattttgugaaa

SEQ ID NO: 96053 - DNA, 26 bp, Artificial Sequence
  Synthetic
ggcctatatugcagggtttgatgaua

SEQ ID NO: 96054 - DNA, 33 bp, Artificial Sequence
  Synthetic
agtcatataaaacugaagtttaccatatcauca

SEQ ID NO: 96055 - DNA, 28 bp, Artificial Sequence
  Synthetic
gaaatcctcatucctctacaatcaguca

SEQ ID NO: 96056 - DNA, 25 bp, Artificial Sequence
  Synthetic
tgtacgcautcaccagucaaagaat

SEQ ID NO: 96057 - DNA, 27 bp, Artificial Sequence
  Synthetic
aggcattgtguttcttttagguacagt

SEQ ID NO: 96058 - DNA, 22 bp, Artificial Sequence
  Synthetic
ggaacggcaguaagctgatcua

SEQ ID NO: 96059 - DNA, 32 bp, Artificial Sequence
  Synthetic
ccaagaatataatacgutgttatggttgaaug

SEQ ID NO: 96060 - DNA, 26 bp, Artificial Sequence
  Synthetic
ggtacccagaautgatggaagtguag

SEQ ID NO: 96061 - DNA, 28 bp, Artificial Sequence
  Synthetic
tccacattaagcaugagcactcatttua

SEQ ID NO: 96062 - DNA, 28 bp, Artificial Sequence
  Synthetic
gcttcttcuaccagctttttaagcatut

SEQ ID NO: 96063 - DNA, 25 bp, Artificial Sequence
  Synthetic
acagactgcugaacctttgtaauca

SEQ ID NO: 96064 - DNA, 21 bp, Artificial Sequence
  Synthetic
aacaaaaacugctgtggcgut

SEQ ID NO: 96065 - DNA, 26 bp, Artificial Sequence
  Synthetic
ctgcatctggguaattctttcaccua

SEQ ID NO: 96066 - DNA, 27 bp, Artificial Sequence
  Synthetic
agtagtgugagaaaccttttgtugagg

SEQ ID NO: 96067 - DNA, 22 bp, Artificial Sequence
  Synthetic
cagcattcuccaggtgacagut

SEQ ID NO: 96068 - DNA, 28 bp, Artificial Sequence
  Synthetic
agctacccagtutagagaatcttctuga

SEQ ID NO: 96069 - DNA, 32 bp, Artificial Sequence
  Synthetic
aacattttaacauaggctctatctatctucag

SEQ ID NO: 96070 - DNA, 22 bp, Artificial Sequence
  Synthetic
gccaggttaucagctggatgug

SEQ ID NO: 96071 - DNA, 25 bp, Artificial Sequence
  Synthetic
tcccatttctuagtgtgcacagaug

SEQ ID NO: 96072 - DNA, 26 bp, Artificial Sequence
  Synthetic
cttacctctgcauctacctcaatucc

SEQ ID NO: 96073 - DNA, 25 bp, Artificial Sequence
  Synthetic
gctaaaagcagcuttgtgccattua

SEQ ID NO: 96074 - DNA, 24 bp, Artificial Sequence
  Synthetic
ccagcuggcacaaattuaaggaaa

SEQ ID NO: 96075 - DNA, 28 bp, Artificial Sequence
  Synthetic
atttaaatatgcugctggaaaaactcug

SEQ ID NO: 96076 - DNA, 22 bp, Artificial Sequence
  Synthetic
cacaccgucttcaaacaugaca

SEQ ID NO: 96077 - DNA, 29 bp, Artificial Sequence
  Synthetic
ccttgtagaaauggatactgaccaatuga

SEQ ID NO: 96078 - DNA, 26 bp, Artificial Sequence
  Synthetic
catattggacauggaaatcucgggaa

SEQ ID NO: 96079 - DNA, 24 bp, Artificial Sequence
  Synthetic
catgactacuggtctcccaatuca

SEQ ID NO: 96080 - DNA, 28 bp, Artificial Sequence
  Synthetic
cagctttgataauggctcttcauagagt

SEQ ID NO: 96081 - DNA, 26 bp, Artificial Sequence
  Synthetic
cagaacttttucagcttggaggacua

SEQ ID NO: 96082 - DNA, 20 bp, Artificial Sequence
  Synthetic
aagtgcuagctggttgugct

SEQ ID NO: 96083 - DNA, 27 bp, Artificial Sequence
  Synthetic
tcttactttggcagauaggttgtgtuc

SEQ ID NO: 96084 - DNA, 28 bp, Artificial Sequence
  Synthetic
cttccccctuctaaatgttcataugact

SEQ ID NO: 96085 - DNA, 27 bp, Artificial Sequence
  Synthetic
gctatttgcauacagataccagctugt

SEQ ID NO: 96086 - DNA, 26 bp, Artificial Sequence
  Synthetic
actcccacccaacuataggaaauaca

SEQ ID NO: 96087 - DNA, 23 bp, Artificial Sequence
  Synthetic
ctacacatgugcacgtaacucac

SEQ ID NO: 96088 - DNA, 21 bp, Artificial Sequence
  Synthetic
cccatgaaccugggtatuggt

SEQ ID NO: 96089 - DNA, 21 bp, Artificial Sequence
  Synthetic
atttcccuggcgcagataguc

SEQ ID NO: 96090 - DNA, 27 bp, Artificial Sequence
  Synthetic
ggtagatgacugacattgaccaugaaa

SEQ ID NO: 96091 - DNA, 20 bp, Artificial Sequence
  Synthetic
acttctucgcccgttcctuc

SEQ ID NO: 96092 - DNA, 23 bp, Artificial Sequence
  Synthetic
gcguggagaacagcgagattuat

SEQ ID NO: 96093 - DNA, 24 bp, Artificial Sequence
  Synthetic
gggtttggaaugaattctgggtug

SEQ ID NO: 96094 - DNA, 22 bp, Artificial Sequence
  Synthetic
agtgauaacagggcagcaaugt

SEQ ID NO: 96095 - DNA, 29 bp, Artificial Sequence
  Synthetic
gaggaataugacccttaaccaaugacaat

SEQ ID NO: 96096 - DNA, 26 bp, Artificial Sequence
  Synthetic
ggttcctaagcuaactcttcccauct

SEQ ID NO: 96097 - DNA, 21 bp, Artificial Sequence
  Synthetic
atcccgaagccaaugtaccuc

SEQ ID NO: 96098 - DNA, 20 bp, Artificial Sequence
  Synthetic
gtgtcagcuccaggtucagg

SEQ ID NO: 96099 - DNA, 25 bp, Artificial Sequence
  Synthetic
accactatccagucatcctgtucat

SEQ ID NO: 96100 - DNA, 20 bp, Artificial Sequence
  Synthetic
cttcgggauggacagaucct

SEQ ID NO: 96101 - DNA, 21 bp, Artificial Sequence
  Synthetic
gctttcugccctctgtgugac

SEQ ID NO: 96102 - DNA, 26 bp, Artificial Sequence
  Synthetic
aauccaagttcatuacaggaaaccca

SEQ ID NO: 96103 - DNA, 28 bp, Artificial Sequence
  Synthetic
gaatacagtggccuaaagaatcctgtua

SEQ ID NO: 96104 - DNA, 28 bp, Artificial Sequence
  Synthetic
acaacagcaatuccttctaacatcucaa

SEQ ID NO: 96105 - DNA, 30 bp, Artificial Sequence
  Synthetic
gaattaaacaugtggacaugaaccaaaaga

SEQ ID NO: 96106 - DNA, 22 bp, Artificial Sequence
  Synthetic
agtcaugcaggagggaagagua

SEQ ID NO: 96107 - DNA, 25 bp, Artificial Sequence
  Synthetic
gcaacaaacucagaatgacctugat

SEQ ID NO: 96108 - DNA, 21 bp, Artificial Sequence
  Synthetic
atggtgggaagggugaacauc

SEQ ID NO: 96109 - DNA, 28 bp, Artificial Sequence
  Synthetic
gcugataaactuggaaggaaaagaggac

SEQ ID NO: 96110 - DNA, 21 bp, Artificial Sequence
  Synthetic
gctgagauggtgcttgcucaa

SEQ ID NO: 96111 - DNA, 22 bp, Artificial Sequence
  Synthetic
ccagttcaccuctttccacugt

SEQ ID NO: 96112 - DNA, 22 bp, Artificial Sequence
  Synthetic
ccccagagaagugttugaacca

SEQ ID NO: 96113 - DNA, 25 bp, Artificial Sequence
  Synthetic
gccagattcuctacagccttuagat

SEQ ID NO: 96114 - DNA, 27 bp, Artificial Sequence
  Synthetic
tcccacaccuagaaagtcttatucaga

SEQ ID NO: 96115 - DNA, 23 bp, Artificial Sequence
  Synthetic
ccatcgactucggcctatagtut

SEQ ID NO: 96116 - DNA, 21 bp, Artificial Sequence
  Synthetic
gcaccacagggcautctugat

SEQ ID NO: 96117 - DNA, 28 bp, Artificial Sequence
  Synthetic
ccctggctaaagutaatgacattttcut

SEQ ID NO: 96118 - DNA, 27 bp, Artificial Sequence
  Synthetic
cctaaagutgctatctugggaaacagt

SEQ ID NO: 96119 - DNA, 27 bp, Artificial Sequence
  Synthetic
ggttctgtctttutcccaattagcaut

SEQ ID NO: 96120 - DNA, 27 bp, Artificial Sequence
  Synthetic
gtagatcagaaacucaggagtgtctut

SEQ ID NO: 96121 - DNA, 28 bp, Artificial Sequence
  Synthetic
accttgttucactatttcaauggaacca

SEQ ID NO: 96122 - DNA, 27 bp, Artificial Sequence
  Synthetic
gcattgttttgcuacctggaagaauat

SEQ ID NO: 96123 - DNA, 24 bp, Artificial Sequence
  Synthetic
atgcactgauctttccccttucaa

SEQ ID NO: 96124 - DNA, 28 bp, Artificial Sequence
  Synthetic
gtgaaatctcuagcaaccattttgtuga

SEQ ID NO: 96125 - DNA, 28 bp, Artificial Sequence
  Synthetic
accgctttatuaccaactgttctcauaa

SEQ ID NO: 96126 - DNA, 22 bp, Artificial Sequence
  Synthetic
caagaaccaugtcgccattgug

SEQ ID NO: 96127 - DNA, 27 bp, Artificial Sequence
  Synthetic
acgagaaccauttttcttcugaacaga

SEQ ID NO: 96128 - DNA, 28 bp, Artificial Sequence
  Synthetic
agttggtaauaaagcggtctcaagttua

SEQ ID NO: 96129 - DNA, 24 bp, Artificial Sequence
  Synthetic
ggaacggtucttgagacauacaga

SEQ ID NO: 96130 - DNA, 28 bp, Artificial Sequence
  Synthetic
aactcaataaagauggcttactgauccc

SEQ ID NO: 96131 - DNA, 22 bp, Artificial Sequence
  Synthetic
gcacacagccacuttcctagut

SEQ ID NO: 96132 - DNA, 25 bp, Artificial Sequence
  Synthetic
gggtcaatagagutaatgcagguga

SEQ ID NO: 96133 - DNA, 28 bp, Artificial Sequence
  Synthetic
ggaaacgtauggtgtagatactugcaat

SEQ ID NO: 96134 - DNA, 25 bp, Artificial Sequence
  Synthetic
gcttagataauagcttggcugcaca

SEQ ID NO: 96135 - DNA, 25 bp, Artificial Sequence
  Synthetic
gcatgaacuaccatcagccaatuga

SEQ ID NO: 96136 - DNA, 28 bp, Artificial Sequence
  Synthetic
ggaggatttuatagaacagauggcaagt

SEQ ID NO: 96137 - DNA, 23 bp, Artificial Sequence
  Synthetic
ctccgtgaugttgcttgattuca

SEQ ID NO: 96138 - DNA, 24 bp, Artificial Sequence
  Synthetic
gggaggattucatgatatgcugga

SEQ ID NO: 96139 - DNA, 27 bp, Artificial Sequence
  Synthetic
ccacaguctggtttctuaacaaaagga

SEQ ID NO: 96140 - DNA, 24 bp, Artificial Sequence
  Synthetic
gtgtgtgcuaggcattcagauaga

SEQ ID NO: 96141 - DNA, 26 bp, Artificial Sequence
  Synthetic
ttggtctggaguaaagaagccaatut

SEQ ID NO: 96142 - DNA, 26 bp, Artificial Sequence
  Synthetic
gggtgtgatguatagctacgtaaugt

SEQ ID NO: 96143 - DNA, 28 bp, Artificial Sequence
  Synthetic
tgcaatgaaucaaacacagcaaaaagua

SEQ ID NO: 96144 - DNA, 20 bp, Artificial Sequence
  Synthetic
cacccacutccugggaacag

SEQ ID NO: 96145 - DNA, 20 bp, Artificial Sequence
  Synthetic
cucttgccaaugcacgaagg

SEQ ID NO: 96146 - DNA, 26 bp, Artificial Sequence
  Synthetic
gggatgagagcuatcttgttctttut

SEQ ID NO: 96147 - DNA, 26 bp, Artificial Sequence
  Synthetic
caggcatugaagcaaagcatactuac

SEQ ID NO: 96148 - DNA, 28 bp, Artificial Sequence
  Synthetic
tttgattttactgcuctgcttttgtugt

SEQ ID NO: 96149 - DNA, 24 bp, Artificial Sequence
  Synthetic
gtgtgcatgaccutgttcttgtuc

SEQ ID NO: 96150 - DNA, 23 bp, Artificial Sequence
  Synthetic
gaacattagtgcuacgcggaaug

SEQ ID NO: 96151 - DNA, 20 bp, Artificial Sequence
  Synthetic
ccaagccacuccacuccaat

SEQ ID NO: 96152 - DNA, 27 bp, Artificial Sequence
  Synthetic
accattctgcaaagutactacccaaut

SEQ ID NO: 96153 - DNA, 27 bp, Artificial Sequence
  Synthetic
agtcaactgaaggagutgctgtaatut

SEQ ID NO: 96154 - DNA, 22 bp, Artificial Sequence
  Synthetic
tutacatgtggucgaggccaaa

SEQ ID NO: 96155 - DNA, 26 bp, Artificial Sequence
  Synthetic
cataaccaaaugcagaataggcucac

SEQ ID NO: 96156 - DNA, 28 bp, Artificial Sequence
  Synthetic
tgacagataaacgcuccatattgttuca

SEQ ID NO: 96157 - DNA, 25 bp, Artificial Sequence
  Synthetic
agcaaggaaauaccatuccaaccat

SEQ ID NO: 96158 - DNA, 28 bp, Artificial Sequence
  Synthetic
aacctcaauaggacagagaactctttug

SEQ ID NO: 96159 - DNA, 20 bp, Artificial Sequence
  Synthetic
tcaagctcggutgctctgug

SEQ ID NO: 96160 - DNA, 23 bp, Artificial Sequence
  Synthetic
gcccccaatucccctaaacatuc

SEQ ID NO: 96161 - DNA, 25 bp, Artificial Sequence
  Synthetic
gcaacagacagugaaacaguagaac

SEQ ID NO: 96162 - DNA, 23 bp, Artificial Sequence
  Synthetic
ccttucaaaagcactgucaccaa

SEQ ID NO: 96163 - DNA, 26 bp, Artificial Sequence
  Synthetic
aagcttcctagcucaggaaaacauac

SEQ ID NO: 96164 - DNA, 22 bp, Artificial Sequence
  Synthetic
cccgagagugaaggctuaacag

SEQ ID NO: 96165 - DNA, 23 bp, Artificial Sequence
  Synthetic
cacacugtcagatuggacacaga

SEQ ID NO: 96166 - DNA, 22 bp, Artificial Sequence
  Synthetic
catagggcuaaggcaagaggug

SEQ ID NO: 96167 - DNA, 21 bp, Artificial Sequence
  Synthetic
ttgggcauggctttggactua

SEQ ID NO: 96168 - DNA, 26 bp, Artificial Sequence
  Synthetic
gaattucaggcattctgugcaaagat

SEQ ID NO: 96169 - DNA, 28 bp, Artificial Sequence
  Synthetic
ggtaccataugtgatccttuacaaagct

SEQ ID NO: 96170 - DNA, 27 bp, Artificial Sequence
  Synthetic
gcagctttguaaaggatcacatauggt

SEQ ID NO: 96171 - DNA, 30 bp, Artificial Sequence
  Synthetic
gccaattctgcautcttttctaagtaauaa

SEQ ID NO: 96172 - DNA, 20 bp, Artificial Sequence
  Synthetic
ggaaucagcggaggaggaug

SEQ ID NO: 96173 - DNA, 17 bp, Artificial Sequence
  Synthetic
cgtuggcgtggtugact

SEQ ID NO: 96174 - DNA, 23 bp, Artificial Sequence
  Synthetic
ccugaaagggaaacucacaacct

SEQ ID NO: 96175 - DNA, 25 bp, Artificial Sequence
  Synthetic
cacagutcatuccaagagaccacat

SEQ ID NO: 96176 - DNA, 28 bp, Artificial Sequence
  Synthetic
ggttcactatcagacuttcttaaggcua

SEQ ID NO: 96177 - DNA, 19 bp, Artificial Sequence
  Synthetic
ggcaggtutgtggccauct

SEQ ID NO: 96178 - DNA, 27 bp, Artificial Sequence
  Synthetic
acatgaggatauacctggccuaaaaga

SEQ ID NO: 96179 - DNA, 28 bp, Artificial Sequence
  Synthetic
ctgtcttguaaagcatgattgcauaaca

SEQ ID NO: 96180 - DNA, 29 bp, Artificial Sequence
  Synthetic
tggcagtttucgaacaaaataaaggaaut

SEQ ID NO: 96181 - DNA, 27 bp, Artificial Sequence
  Synthetic
cttcagaacttccuggatcacgataug

SEQ ID NO: 96182 - DNA, 20 bp, Artificial Sequence
  Synthetic
ccaaacgcaagcucacacug

SEQ ID NO: 96183 - DNA, 27 bp, Artificial Sequence
  Synthetic
aatcatactggaaugcatccatgtgua

SEQ ID NO: 96184 - DNA, 28 bp, Artificial Sequence
  Synthetic
aggctataattuactcaccctcttucct

SEQ ID NO: 96185 - DNA, 26 bp, Artificial Sequence
  Synthetic
tctcatttgguctgttcttgtuccaa

SEQ ID NO: 96186 - DNA, 28 bp, Artificial Sequence
  Synthetic
ttcagataaugaagggcacgttctaaut

SEQ ID NO: 96187 - DNA, 20 bp, Artificial Sequence
  Synthetic
cugatcttgcugccaaagca

SEQ ID NO: 96188 - DNA, 27 bp, Artificial Sequence
  Synthetic
ttccuaaagttcgaaugagagcagaag

SEQ ID NO: 96189 - DNA, 26 bp, Artificial Sequence
  Synthetic
tcacccagacaaaugtacttttuggt

SEQ ID NO: 96190 - DNA, 19 bp, Artificial Sequence
  Synthetic
caggagugacagggcuacc

SEQ ID NO: 96191 - DNA, 24 bp, Artificial Sequence
  Synthetic
tgaatgatuaaacgcccctuacca

SEQ ID NO: 96192 - DNA, 26 bp, Artificial Sequence
  Synthetic
gtgttgatggaauaatttgccccuac

SEQ ID NO: 96193 - DNA, 23 bp, Artificial Sequence
  Synthetic
ggtggcttaggugtaactggaut

SEQ ID NO: 96194 - DNA, 21 bp, Artificial Sequence
  Synthetic
ccctttuccacagccactuca

SEQ ID NO: 96195 - DNA, 22 bp, Artificial Sequence
  Synthetic
ccatcttgugatgcctguacac

SEQ ID NO: 96196 - DNA, 24 bp, Artificial Sequence
  Synthetic
gggattgtcauttgtgcatttugg

SEQ ID NO: 96197 - DNA, 28 bp, Artificial Sequence
  Synthetic
tgggttucaccacagtaatatttcucaa

SEQ ID NO: 96198 - DNA, 26 bp, Artificial Sequence
  Synthetic
tgttggaaugcataagaacataugct

SEQ ID NO: 96199 - DNA, 26 bp, Artificial Sequence
  Synthetic
ggaactgaaacucatgacatctgugt

SEQ ID NO: 96200 - DNA, 26 bp, Artificial Sequence
  Synthetic
gtttacttaccauacactggcctuga

SEQ ID NO: 96201 - DNA, 28 bp, Artificial Sequence
  Synthetic
gcacaaaggaucgttgtaaactctatug

SEQ ID NO: 96202 - DNA, 26 bp, Artificial Sequence
  Synthetic
agaaataattggutccagcaaccuga

SEQ ID NO: 96203 - DNA, 28 bp, Artificial Sequence
  Synthetic
tggcagtaagtaaautatgctggttcut

SEQ ID NO: 96204 - DNA, 31 bp, Artificial Sequence
  Synthetic
aagattatgataguaccggtttatugcacaa

SEQ ID NO: 96205 - DNA, 26 bp, Artificial Sequence
  Synthetic
tgaacagaugcaaggaaatccucaat

SEQ ID NO: 96206 - DNA, 29 bp, Artificial Sequence
  Synthetic
tgcacaattcuagaagcttatctgtuagg

SEQ ID NO: 96207 - DNA, 23 bp, Artificial Sequence
  Synthetic
tcatcttaucccatgcgtgugaa

SEQ ID NO: 96208 - DNA, 22 bp, Artificial Sequence
  Synthetic
cctagtggugagtcaggcauct

SEQ ID NO: 96209 - DNA, 18 bp, Artificial Sequence
  Synthetic
gtagguccacgggctcug

SEQ ID NO: 96210 - DNA, 20 bp, Artificial Sequence
  Synthetic
caacacccccutcaaccuga

SEQ ID NO: 96211 - DNA, 21 bp, Artificial Sequence
  Synthetic
cuattcggagcugacccacat

SEQ ID NO: 96212 - DNA, 24 bp, Artificial Sequence
  Synthetic
tggtgtgtgucatgttctgctuat

SEQ ID NO: 96213 - DNA, 25 bp, Artificial Sequence
  Synthetic
acatattcgtuaagcaactgggcut

SEQ ID NO: 96214 - DNA, 23 bp, Artificial Sequence
  Synthetic
gggaagattuggttgtgtcugga

SEQ ID NO: 96215 - DNA, 28 bp, Artificial Sequence
  Synthetic
ggcttctgttutgagactatttcugagt

SEQ ID NO: 96216 - DNA, 23 bp, Artificial Sequence
  Synthetic
acgatccttugtgccaactguaa

SEQ ID NO: 96217 - DNA, 24 bp, Artificial Sequence
  Synthetic
aatgtgagguggcttccaagauac

SEQ ID NO: 96218 - DNA, 27 bp, Artificial Sequence
  Synthetic
aaccagcauaatttacttacugccact

SEQ ID NO: 96219 - DNA, 24 bp, Artificial Sequence
  Synthetic
gautcatguccaaaaggcacacaa

SEQ ID NO: 96220 - DNA, 22 bp, Artificial Sequence
  Synthetic
agcactgctuctctcgaaaguc

SEQ ID NO: 96221 - DNA, 28 bp, Artificial Sequence
  Synthetic
gcacaaataatgtugtactgatgtgcut

SEQ ID NO: 96222 - DNA, 20 bp, Artificial Sequence
  Synthetic
ccttgccgcaugaaaggcua

SEQ ID NO: 96223 - DNA, 20 bp, Artificial Sequence
  Synthetic
cagctgugcgaggtucaaag

SEQ ID NO: 96224 - DNA, 24 bp, Artificial Sequence
  Synthetic
ccaggaacauatgcagaattugcc

SEQ ID NO: 96225 - DNA, 27 bp, Artificial Sequence
  Synthetic
ggctcacctcuaaagaactcattgaua

SEQ ID NO: 96226 - DNA, 28 bp, Artificial Sequence
  Synthetic
ctatcaagaagugaaactggaucaacga

SEQ ID NO: 96227 - DNA, 22 bp, Artificial Sequence
  Synthetic
cccacaccagugtcacaucaat

SEQ ID NO: 96228 - DNA, 17 bp, Artificial Sequence
  Synthetic
ccccacutagccgcuga

SEQ ID NO: 96229 - DNA, 17 bp, Artificial Sequence
  Synthetic
ggguccccaggguggaa

SEQ ID NO: 96230 - DNA, 28 bp, Artificial Sequence
  Synthetic
tggctaaatacaaacugaatgaagguca

SEQ ID NO: 96231 - DNA, 28 bp, Artificial Sequence
  Synthetic
gaaaaccucagcagtaatagtgauggaa

SEQ ID NO: 96232 - DNA, 20 bp, Artificial Sequence
  Synthetic
acgacgccutttgggtgaua

SEQ ID NO: 96233 - DNA, 21 bp, Artificial Sequence
  Synthetic
agtacttgtugggcccactut

SEQ ID NO: 96234 - DNA, 27 bp, Artificial Sequence
  Synthetic
ccatactttccautttcaaagcugcat

SEQ ID NO: 96235 - DNA, 28 bp, Artificial Sequence
  Synthetic
cctaacatctaauacattcttgcugcct

SEQ ID NO: 96236 - DNA, 27 bp, Artificial Sequence
  Synthetic
cagagatuaacaatccccugaagaaca

SEQ ID NO: 96237 - DNA, 24 bp, Artificial Sequence
  Synthetic
gucaaaacccaacagaaugaagcc

SEQ ID NO: 96238 - DNA, 28 bp, Artificial Sequence
  Synthetic
caagttagtgcuactggaaaaugcaaaa

SEQ ID NO: 96239 - DNA, 24 bp, Artificial Sequence
  Synthetic
ggtgaagatgaugaccacacugag

SEQ ID NO: 96240 - DNA, 26 bp, Artificial Sequence
  Synthetic
actgcattttugcactttttctucct

SEQ ID NO: 96241 - DNA, 28 bp, Artificial Sequence
  Synthetic
tcattttgagaagagcaugaaacgguat

SEQ ID NO: 96242 - DNA, 22 bp, Artificial Sequence
  Synthetic
atccttgaaucgaaggccagut

SEQ ID NO: 96243 - DNA, 28 bp, Artificial Sequence
  Synthetic
gctttactcugaagcactacttaacuct

SEQ ID NO: 96244 - DNA, 28 bp, Artificial Sequence
  Synthetic
gcaactctgaaauaaaagcaatctggut

SEQ ID NO: 96245 - DNA, 26 bp, Artificial Sequence
  Synthetic
atcatgatgtguaagccaaaagauga

SEQ ID NO: 96246 - DNA, 28 bp, Artificial Sequence
  Synthetic
tccattagtcuacaatcctttcucaggt

SEQ ID NO: 96247 - DNA, 28 bp, Artificial Sequence
  Synthetic
tttaggtggaaautcttgcttctctuca

SEQ ID NO: 96248 - DNA, 28 bp, Artificial Sequence
  Synthetic
gtctacaatccttuctcaggtcatctut

SEQ ID NO: 96249 - DNA, 29 bp, Artificial Sequence
  Synthetic
catcatcttttagguggaaattcttgcut

SEQ ID NO: 96250 - DNA, 22 bp, Artificial Sequence
  Synthetic
ccacaggaagcugaacacugat

SEQ ID NO: 96251 - DNA, 22 bp, Artificial Sequence
  Synthetic
ttttaccccutgtggagagugg

SEQ ID NO: 96252 - DNA, 24 bp, Artificial Sequence
  Synthetic
gaatactuacgggtgaccaauccc

SEQ ID NO: 96253 - DNA, 21 bp, Artificial Sequence
  Synthetic
agaggtacucaagcccgcuat

SEQ ID NO: 96254 - DNA, 23 bp, Artificial Sequence
  Synthetic
tcaagagcaucacgacagctuac

SEQ ID NO: 96255 - DNA, 28 bp, Artificial Sequence
  Synthetic
gtgaguaacagctatguaaaagggacat

SEQ ID NO: 96256 - DNA, 26 bp, Artificial Sequence
  Synthetic
gccctgaaguatatttttgttgcugt

SEQ ID NO: 96257 - DNA, 28 bp, Artificial Sequence
  Synthetic
caatctacagtugagcaaacctacguat

SEQ ID NO: 96258 - DNA, 28 bp, Artificial Sequence
  Synthetic
acagcaagcaaauaaaaatggagaaugg

SEQ ID NO: 96259 - DNA, 28 bp, Artificial Sequence
  Synthetic
agcatatacacaugcccaaataucaaga

SEQ ID NO: 96260 - DNA, 27 bp, Artificial Sequence
  Synthetic
ccctgttgtaagaaucaaggtatccut

SEQ ID NO: 96261 - DNA, 28 bp, Artificial Sequence
  Synthetic
catttgagtttacgucaacctagctcua

SEQ ID NO: 96262 - DNA, 20 bp, Artificial Sequence
  Synthetic
cagggtcaauctctcccgut

SEQ ID NO: 96263 - DNA, 25 bp, Artificial Sequence
  Synthetic
aaatgaaccaaguttgggagtcuca

SEQ ID NO: 96264 - DNA, 24 bp, Artificial Sequence
  Synthetic
aaaccaagccaaautccatugcat

SEQ ID NO: 96265 - DNA, 26 bp, Artificial Sequence
  Synthetic
tgaatctctgaguccatgtgaactuc

SEQ ID NO: 96266 - DNA, 24 bp, Artificial Sequence
  Synthetic
ctactugccaggaagcacatguat

SEQ ID NO: 96267 - DNA, 27 bp, Artificial Sequence
  Synthetic
gutacatgtgguaaaggaacaaagcag

SEQ ID NO: 96268 - DNA, 23 bp, Artificial Sequence
  Synthetic
acattcagcugacaccataccug

SEQ ID NO: 96269 - DNA, 26 bp, Artificial Sequence
  Synthetic
attgcatcagtutaaggcatttgugt

SEQ ID NO: 96270 - DNA, 26 bp, Artificial Sequence
  Synthetic
cactttgtttugtggagtgugaaact

SEQ ID NO: 96271 - DNA, 28 bp, Artificial Sequence
  Synthetic
gtttgtccagugacttatgttuaaacca

SEQ ID NO: 96272 - DNA, 25 bp, Artificial Sequence
  Synthetic
acctgagaccautctgaataaugcc

SEQ ID NO: 96273 - DNA, 25 bp, Artificial Sequence
  Synthetic
tccattcaugaaggacagactgtuc

SEQ ID NO: 96274 - DNA, 28 bp, Artificial Sequence
  Synthetic
cataacatttctttugagcacctggtut

SEQ ID NO: 96275 - DNA, 24 bp, Artificial Sequence
  Synthetic
tcttttcacagugctcagtgacut

SEQ ID NO: 96276 - DNA, 28 bp, Artificial Sequence
  Synthetic
acttgtctctucattatcccaatuccac

SEQ ID NO: 96277 - DNA, 28 bp, Artificial Sequence
  Synthetic
tccagaaauacctggtcuaagaaaagga

SEQ ID NO: 96278 - DNA, 23 bp, Artificial Sequence
  Synthetic
caccacaguagtggtcaucaact

SEQ ID NO: 96279 - DNA, 23 bp, Artificial Sequence
  Synthetic
caagguggcatgttatuggcaaa

SEQ ID NO: 96280 - DNA, 24 bp, Artificial Sequence
  Synthetic
accacatugggatgaacatucact

SEQ ID NO: 96281 - DNA, 29 bp, Artificial Sequence
  Synthetic
tggtggtttgtcuatcaacttttaggaut

SEQ ID NO: 96282 - DNA, 28 bp, Artificial Sequence
  Synthetic
tgacatgtuaacagacaagagtgctauc

SEQ ID NO: 96283 - DNA, 28 bp, Artificial Sequence
  Synthetic
gtaatatgucaatttcccaauggccaaa

SEQ ID NO: 96284 - DNA, 22 bp, Artificial Sequence
  Synthetic
agggttcuccaagtacatguct

SEQ ID NO: 96285 - DNA, 29 bp, Artificial Sequence
  Synthetic
cacattagaaaggauggtgactatuacct

SEQ ID NO: 96286 - DNA, 24 bp, Artificial Sequence
  Synthetic
ttctccaaguacatgtcugcacaa

SEQ ID NO: 96287 - DNA, 27 bp, Artificial Sequence
  Synthetic
aaaaccacatuagaaaggatggugact

SEQ ID NO: 96288 - DNA, 28 bp, Artificial Sequence
  Synthetic
agtcaccatccuttctaatgtggtttut

SEQ ID NO: 96289 - DNA, 28 bp, Artificial Sequence
  Synthetic
caaagtgtcagauattcagagtguagca

SEQ ID NO: 96290 - DNA, 26 bp, Artificial Sequence
  Synthetic
gtggcttgttuacaatttcacagtug

SEQ ID NO: 96291 - DNA, 32 bp, Artificial Sequence
  Synthetic
aaaccacagttttgaautttcctattcttgut

SEQ ID NO: 96292 - DNA, 24 bp, Artificial Sequence
  Synthetic
cagatgaaugccatcagttugcac

SEQ ID NO: 96293 - DNA, 28 bp, Artificial Sequence
  Synthetic
gatgagatgauagacaggcagaagtuaa

SEQ ID NO: 96294 - DNA, 26 bp, Artificial Sequence
  Synthetic
acttttctctcuctggctagguacat

SEQ ID NO: 96295 - DNA, 27 bp, Artificial Sequence
  Synthetic
accttattatgugtctgagtctgucca

SEQ ID NO: 96296 - DNA, 26 bp, Artificial Sequence
  Synthetic
caatatccucatactggtuggacaga

SEQ ID NO: 96297 - DNA, 31 bp, Artificial Sequence
  Synthetic
tgtcagaagttcuccattttagaatgaaugt

SEQ ID NO: 96298 - DNA, 32 bp, Artificial Sequence
  Synthetic
atacccatautatataacttaguacccacact

SEQ ID NO: 96299 - DNA, 26 bp, Artificial Sequence
  Synthetic
tgggattautgaatgggugaacaaca

SEQ ID NO: 96300 - DNA, 26 bp, Artificial Sequence
  Synthetic
gtttggucagaataggtcucaaacca

SEQ ID NO: 96301 - DNA, 27 bp, Artificial Sequence
  Synthetic
gaaaagaugcagagtctcguagaagag

SEQ ID NO: 96302 - DNA, 23 bp, Artificial Sequence
  Synthetic
gtctcaaaccagcagugttgtuc

SEQ ID NO: 96303 - DNA, 26 bp, Artificial Sequence
  Synthetic
acagtgcutaagaaaagaugcagagt

SEQ ID NO: 96304 - DNA, 25 bp, Artificial Sequence
  Synthetic
agttctcttcuacgagactcugcat

SEQ ID NO: 96305 - DNA, 28 bp, Artificial Sequence
  Synthetic
gccttcaatgacautctttggttaugaa

SEQ ID NO: 96306 - DNA, 26 bp, Artificial Sequence
  Synthetic
acactactgacautcaagtcccttug

SEQ ID NO: 96307 - DNA, 22 bp, Artificial Sequence
  Synthetic
ttgggtgggucatcctactgua

SEQ ID NO: 96308 - DNA, 23 bp, Artificial Sequence
  Synthetic
gcuagcagccagaaaaugaccaa

SEQ ID NO: 96309 - DNA, 22 bp, Artificial Sequence
  Synthetic
ccataucagggcccgagagaua

SEQ ID NO: 96310 - DNA, 27 bp, Artificial Sequence
  Synthetic
tccttaccatcagutcaggtgatauga

SEQ ID NO: 96311 - DNA, 24 bp, Artificial Sequence
  Synthetic
agcctgtugagacaagattuccaa

SEQ ID NO: 96312 - DNA, 27 bp, Artificial Sequence
  Synthetic
acgcagcaauaattcattatgcaaucc

SEQ ID NO: 96313 - DNA, 27 bp, Artificial Sequence
  Synthetic
gagctcctgaugtactaatagcatgut

SEQ ID NO: 96314 - DNA, 28 bp, Artificial Sequence
  Synthetic
gttgtttgtaucacacgttagtggtcua

SEQ ID NO: 96315 - DNA, 28 bp, Artificial Sequence
  Synthetic
gutgattttgatgttuaccaggacaaca

SEQ ID NO: 96316 - DNA, 27 bp, Artificial Sequence
  Synthetic
gaaggaggacuactctatgcttttgug

SEQ ID NO: 96317 - DNA, 30 bp, Artificial Sequence
  Synthetic
ttgccactctaatugaaagaaagtagtcut

SEQ ID NO: 96318 - DNA, 25 bp, Artificial Sequence
  Synthetic
attttccaaucctgtcaggugacat

SEQ ID NO: 96319 - DNA, 28 bp, Artificial Sequence
  Synthetic
ctgaaactagugagagcagaacaaatug

SEQ ID NO: 96320 - DNA, 22 bp, Artificial Sequence
  Synthetic
aagcttgcagcugaaagaggua

SEQ ID NO: 96321 - DNA, 28 bp, Artificial Sequence
  Synthetic
cgtgacatttctugactcttcatttgut

SEQ ID NO: 96322 - DNA, 28 bp, Artificial Sequence
  Synthetic
gaactgauaaagggaagagctaatuggt

SEQ ID NO: 96323 - DNA, 23 bp, Artificial Sequence
  Synthetic
tcaggcacugaaagcugagaaat

SEQ ID NO: 96324 - DNA, 25 bp, Artificial Sequence
  Synthetic
tttctgtttgauttgctgtguggac

SEQ ID NO: 96325 - DNA, 28 bp, Artificial Sequence
  Synthetic
gatcagcauaccataaauacccaagaca

SEQ ID NO: 96326 - DNA, 24 bp, Artificial Sequence
  Synthetic
tgagtugacacagatcagaugcaa

SEQ ID NO: 96327 - DNA, 28 bp, Artificial Sequence
  Synthetic
tgccttagaatggutagctttagatguc

SEQ ID NO: 96328 - DNA, 27 bp, Artificial Sequence
  Synthetic
atagcucagaagtattucaaacaggct

SEQ ID NO: 96329 - DNA, 28 bp, Artificial Sequence
  Synthetic
attaatttgucaggaactgggaugaaga

SEQ ID NO: 96330 - DNA, 22 bp, Artificial Sequence
  Synthetic
gcacutaggctucaggcaaaaa

SEQ ID NO: 96331 - DNA, 22 bp, Artificial Sequence
  Synthetic
ctgttcagaaacuggaccugga

SEQ ID NO: 96332 - DNA, 21 bp, Artificial Sequence
  Synthetic
gccactttgcugtgctggaua

SEQ ID NO: 96333 - DNA, 27 bp, Artificial Sequence
  Synthetic
cccttgcaatugagaagacttattugt

SEQ ID NO: 96334 - DNA, 22 bp, Artificial Sequence
  Synthetic
caccaccutatcaatggtugcc

SEQ ID NO: 96335 - DNA, 28 bp, Artificial Sequence
  Synthetic
aaggactgucaacataaauccaagaaga

SEQ ID NO: 96336 - DNA, 27 bp, Artificial Sequence
  Synthetic
agtcaacagagutaactgaaacugcat

SEQ ID NO: 96337 - DNA, 27 bp, Artificial Sequence
  Synthetic
gagggtaagaacaugttaatccauggt

SEQ ID NO: 96338 - DNA, 26 bp, Artificial Sequence
  Synthetic
cataaatcggcccacuagtagcauag

SEQ ID NO: 96339 - DNA, 24 bp, Artificial Sequence
  Synthetic
tgatgtucaccaggcactaatugt

SEQ ID NO: 96340 - DNA, 28 bp, Artificial Sequence
  Synthetic
gacatccaagttaucactacagaaggut

SEQ ID NO: 96341 - DNA, 28 bp, Artificial Sequence
  Synthetic
cgtactcacaauttcttttggcttuact

SEQ ID NO: 96342 - DNA, 33 bp, Artificial Sequence
  Synthetic
atatttgataatgtuaagcacttaaccaguagt

SEQ ID NO: 96343 - DNA, 28 bp, Artificial Sequence
  Synthetic
gaatacagtggaucaaataacgcagtug

SEQ ID NO: 96344 - DNA, 28 bp, Artificial Sequence
  Synthetic
actgatgacugagaatttaccugcaaaa

SEQ ID NO: 96345 - DNA, 26 bp, Artificial Sequence
  Synthetic
aatcaatgugcaaggaacaagaacug

SEQ ID NO: 96346 - DNA, 28 bp, Artificial Sequence
  Synthetic
caactgcgttatutgatccactgtatuc

SEQ ID NO: 96347 - DNA, 27 bp, Artificial Sequence
  Synthetic
attatctgacgcugaagggaatttuct

SEQ ID NO: 96348 - DNA, 22 bp, Artificial Sequence
  Synthetic
gccagaaugcacagtcagtcut

SEQ ID NO: 96349 - DNA, 28 bp, Artificial Sequence
  Synthetic
gtgtgggtaattuatacaaccctgaugt

SEQ ID NO: 96350 - DNA, 26 bp, Artificial Sequence
  Synthetic
actcctctctuccaaagggatatuga

SEQ ID NO: 96351 - DNA, 33 bp, Artificial Sequence
  Synthetic
aaactactggtuaagtgcttaacattaucaaat

SEQ ID NO: 96352 - DNA, 21 bp, Artificial Sequence
  Synthetic
gcataccaucatctgcccuca

SEQ ID NO: 96353 - DNA, 26 bp, Artificial Sequence
  Synthetic
cctccttgcaautacattgtgguaac

SEQ ID NO: 96354 - DNA, 23 bp, Artificial Sequence
  Synthetic
accttaccugtgatgagtcugct

SEQ ID NO: 96355 - DNA, 28 bp, Artificial Sequence
  Synthetic
gagagaaaagatucacatcaacgaaugg

SEQ ID NO: 96356 - DNA, 25 bp, Artificial Sequence
  Synthetic
tgtctgattuggttatctgugcact

SEQ ID NO: 96357 - DNA, 28 bp, Artificial Sequence
  Synthetic
ggctgaatgugagtatcgacatguaaat

SEQ ID NO: 96358 - DNA, 20 bp, Artificial Sequence
  Synthetic
cuaggctugcacagagggat

SEQ ID NO: 96359 - DNA, 24 bp, Artificial Sequence
  Synthetic
tcccggtgtaugaatctcttggua

SEQ ID NO: 96360 - DNA, 22 bp, Artificial Sequence
  Synthetic
ccagtggcauggagtatcugag

SEQ ID NO: 96361 - DNA, 22 bp, Artificial Sequence
  Synthetic
tctagcccugcttccatccuaa

SEQ ID NO: 96362 - DNA, 26 bp, Artificial Sequence
  Synthetic
ccggtcaatgaautgacacagaatut

SEQ ID NO: 96363 - DNA, 28 bp, Artificial Sequence
  Synthetic
aacattgacacugaacacatttgaugag

SEQ ID NO: 96364 - DNA, 21 bp, Artificial Sequence
  Synthetic
cagacuggacaccctcttucc

SEQ ID NO: 96365 - DNA, 22 bp, Artificial Sequence
  Synthetic
gguctgatgucccagaaacacc

SEQ ID NO: 96366 - DNA, 21 bp, Artificial Sequence
  Synthetic
cacgggacaguaccagtgtut

SEQ ID NO: 96367 - DNA, 20 bp, Artificial Sequence
  Synthetic
ctaugagcgccacatgucct

SEQ ID NO: 96368 - DNA, 21 bp, Artificial Sequence
  Synthetic
ctgctccaugactctguccac

SEQ ID NO: 96369 - DNA, 26 bp, Artificial Sequence
  Synthetic
gaagttcagaaggaugtgtgtaugct

SEQ ID NO: 96370 - DNA, 28 bp, Artificial Sequence
  Synthetic
tgaacagauacaaccacagattcauacc

SEQ ID NO: 96371 - DNA, 28 bp, Artificial Sequence
  Synthetic
gcattaccttauacaggaagctacugat

SEQ ID NO: 96372 - DNA, 28 bp, Artificial Sequence
  Synthetic
caaccaagatacauctggcataguaagt

SEQ ID NO: 96373 - DNA, 24 bp, Artificial Sequence
  Synthetic
ttcttttuaggccaagacccaugt

SEQ ID NO: 96374 - DNA, 23 bp, Artificial Sequence
  Synthetic
gtagtcgcugctcaatgucaaga

SEQ ID NO: 96375 - DNA, 29 bp, Artificial Sequence
  Synthetic
gggtattggucagtaaaatggtatuaaca

SEQ ID NO: 96376 - DNA, 29 bp, Artificial Sequence
  Synthetic
aaaatactgaatugcaaacctcaagugaa

SEQ ID NO: 96377 - DNA, 28 bp, Artificial Sequence
  Synthetic
ctcaccagagagaaauggctttaaauac

SEQ ID NO: 96378 - DNA, 25 bp, Artificial Sequence
  Synthetic
gaaaacgutggcaattucagacaac

SEQ ID NO: 96379 - DNA, 27 bp, Artificial Sequence
  Synthetic
gctctagttttuggtagaatccctuca

SEQ ID NO: 96380 - DNA, 27 bp, Artificial Sequence
  Synthetic
ctgttacaccutctttacagacuccat

SEQ ID NO: 96381 - DNA, 27 bp, Artificial Sequence
  Synthetic
ggacaactctucatgcaagacaauaac

SEQ ID NO: 96382 - DNA, 27 bp, Artificial Sequence
  Synthetic
ccataaugagaactgtugaagacacct

SEQ ID NO: 96383 - DNA, 20 bp, Artificial Sequence
  Synthetic
tgtctugaaggcagctggut

SEQ ID NO: 96384 - DNA, 27 bp, Artificial Sequence
  Synthetic
aaatattacctgutagcatgcacucca

SEQ ID NO: 96385 - DNA, 28 bp, Artificial Sequence
  Synthetic
ggtccccaagcuattattgaagtgauaa

SEQ ID NO: 96386 - DNA, 20 bp, Artificial Sequence
  Synthetic
gagacgcccuggaacttgua

SEQ ID NO: 96387 - DNA, 28 bp, Artificial Sequence
  Synthetic
gccaaagtattuctagcctatccucaac

SEQ ID NO: 96388 - DNA, 27 bp, Artificial Sequence
  Synthetic
tgtgagaaatgtcuacacacaagctut

SEQ ID NO: 96389 - DNA, 21 bp, Artificial Sequence
  Synthetic
cttgttccugagggaccctut

SEQ ID NO: 96390 - DNA, 23 bp, Artificial Sequence
  Synthetic
gcgaccucgatctgttcaugaaa

SEQ ID NO: 96391 - DNA, 28 bp, Artificial Sequence
  Synthetic
gcaaaagattaugaaaacatgcaguggt

SEQ ID NO: 96392 - DNA, 23 bp, Artificial Sequence
  Synthetic
agctgtcatcauccacattgcut

SEQ ID NO: 96393 - DNA, 28 bp, Artificial Sequence
  Synthetic
ctgcttttucacaattgatctcucgaat

SEQ ID NO: 96394 - DNA, 28 bp, Artificial Sequence
  Synthetic
caacaaaaactucatcgtgagaaugaca

SEQ ID NO: 96395 - DNA, 17 bp, Artificial Sequence
  Synthetic
gccgcuccgatcgtgua

SEQ ID NO: 96396 - DNA, 25 bp, Artificial Sequence
  Synthetic
tcattcctcauttgtacacgaucgg

SEQ ID NO: 96397 - DNA, 27 bp, Artificial Sequence
  Synthetic
cttgggcaugggaataacatacttuaa

SEQ ID NO: 96398 - DNA, 29 bp, Artificial Sequence
  Synthetic
aaaaagctaaacagaaautgaaccaccut

SEQ ID NO: 96399 - DNA, 27 bp, Artificial Sequence
  Synthetic
ctgctttaagtttucacatgagtccut

SEQ ID NO: 96400 - DNA, 27 bp, Artificial Sequence
  Synthetic
gctccaaggacucatgtgaaaactuaa

SEQ ID NO: 96401 - DNA, 33 bp, Artificial Sequence
  Synthetic
aggatctattactaauatcgtaagcatctttug

SEQ ID NO: 96402 - DNA, 28 bp, Artificial Sequence
  Synthetic
ccctggctacaacauataccaacataut

SEQ ID NO: 96403 - DNA, 24 bp, Artificial Sequence
  Synthetic
actgtgaaugtgacaauggacact

SEQ ID NO: 96404 - DNA, 25 bp, Artificial Sequence
  Synthetic
ctgaaaacagtguatccagcagcua

SEQ ID NO: 96405 - DNA, 28 bp, Artificial Sequence
  Synthetic
ggcctcgtaacugcatctaatacuaaaa

SEQ ID NO: 96406 - DNA, 27 bp, Artificial Sequence
  Synthetic
aacaaaacaauaaacttgtacugccaa

SEQ ID NO: 96407 - DNA, 28 bp, Artificial Sequence
  Synthetic
ggcaatgtctacauccttttcaaaguct

SEQ ID NO: 96408 - DNA, 26 bp, Artificial Sequence
  Synthetic
ctaggaaautagactguccagccaaa

SEQ ID NO: 96409 - DNA, 27 bp, Artificial Sequence
  Synthetic
cagttcatauatcagtcaaugccacga

SEQ ID NO: 96410 - DNA, 26 bp, Artificial Sequence
  Synthetic
gccatagagtuaacattcgtggcaut

SEQ ID NO: 96411 - DNA, 28 bp, Artificial Sequence
  Synthetic
tgaaaacggtaugtggtagtttgaauct

SEQ ID NO: 96412 - DNA, 28 bp, Artificial Sequence
  Synthetic
cgtattuaaaagctaactugaagcagca

SEQ ID NO: 96413 - DNA, 23 bp, Artificial Sequence
  Synthetic
aaactacuccacactuggcacat

SEQ ID NO: 96414 - DNA, 21 bp, Artificial Sequence
  Synthetic
tcatagcgguttgacgcucaa

SEQ ID NO: 96415 - DNA, 28 bp, Artificial Sequence
  Synthetic
gcattttcucacatgcactguaaaagat

SEQ ID NO: 96416 - DNA, 22 bp, Artificial Sequence
  Synthetic
cagggaccugattccctucaat

SEQ ID NO: 96417 - DNA, 25 bp, Artificial Sequence
  Synthetic
tcaaaatccaccaautgcagctuac

SEQ ID NO: 96418 - DNA, 19 bp, Artificial Sequence
  Synthetic
gcugggagcccaacaacut

SEQ ID NO: 96419 - DNA, 18 bp, Artificial Sequence
  Synthetic
aggagcccccaucacuca

SEQ ID NO: 96420 - DNA, 28 bp, Artificial Sequence
  Synthetic
tcttgcatgtcauaatgtcagtttggua

SEQ ID NO: 96421 - DNA, 22 bp, Artificial Sequence
  Synthetic
cgaccctugaccacaaguaacc

SEQ ID NO: 96422 - DNA, 23 bp, Artificial Sequence
  Synthetic
cctgttccuttccccaauccaaa

SEQ ID NO: 96423 - DNA, 24 bp, Artificial Sequence
  Synthetic
agactctcaauggcaatccactug

SEQ ID NO: 96424 - DNA, 20 bp, Artificial Sequence
  Synthetic
gtcccaguggagcacatgut

SEQ ID NO: 96425 - DNA, 22 bp, Artificial Sequence
  Synthetic
atccacagutgtagttgcugct

SEQ ID NO: 96426 - DNA, 27 bp, Artificial Sequence
  Synthetic
tgtacaggaatuacagtagacgacuct

SEQ ID NO: 96427 - DNA, 22 bp, Artificial Sequence
  Synthetic
agttttacauccctggguggac

SEQ ID NO: 96428 - DNA, 20 bp, Artificial Sequence
  Synthetic
cgtaucgccaagaugccagt

SEQ ID NO: 96429 - DNA, 21 bp, Artificial Sequence
  Synthetic
ccaggcauagtgtgtgauggt

SEQ ID NO: 96430 - DNA, 21 bp, Artificial Sequence
  Synthetic
gaacgagtcuttgggaacgug

SEQ ID NO: 96431 - DNA, 25 bp, Artificial Sequence
  Synthetic
agccgtgtttuccctttgttactua

SEQ ID NO: 96432 - DNA, 22 bp, Artificial Sequence
  Synthetic
aaggcttcauccatgacctgut

SEQ ID NO: 96433 - DNA, 19 bp, Artificial Sequence
  Synthetic
tcttucgccgguggacaag

SEQ ID NO: 96434 - DNA, 24 bp, Artificial Sequence
  Synthetic
acatacacgugtttaaggcauaca

SEQ ID NO: 96435 - DNA, 24 bp, Artificial Sequence
  Synthetic
acacagaatgccaugaagctaguc

SEQ ID NO: 96436 - DNA, 27 bp, Artificial Sequence
  Synthetic
tgattctttttaccugtctgtcacugg

SEQ ID NO: 96437 - DNA, 24 bp, Artificial Sequence
  Synthetic
tcutctttcagugcacaaccacat

SEQ ID NO: 96438 - DNA, 23 bp, Artificial Sequence
  Synthetic
gtgtcctcaucttggctctctuc

SEQ ID NO: 96439 - DNA, 28 bp, Artificial Sequence
  Synthetic
attctgattctuagtcatcactccucct

SEQ ID NO: 96440 - DNA, 27 bp, Artificial Sequence
  Synthetic
caacataaacauaaaagacuggccaca

SEQ ID NO: 96441 - DNA, 28 bp, Artificial Sequence
  Synthetic
cgagctgtaaugcactttgaatcattua

SEQ ID NO: 96442 - DNA, 28 bp, Artificial Sequence
  Synthetic
acctgtaaaaauccaagatgttccugaa

SEQ ID NO: 96443 - DNA, 26 bp, Artificial Sequence
  Synthetic
gactatcagagugtaacccgtttuct

SEQ ID NO: 96444 - DNA, 33 bp, Artificial Sequence
  Synthetic
agtgaaatcagattautgaacagtataagaugc

SEQ ID NO: 96445 - DNA, 17 bp, Artificial Sequence
  Synthetic
gtgguccagggcctugt

SEQ ID NO: 96446 - DNA, 26 bp, Artificial Sequence
  Synthetic
ttacttctccccaauttccgtagtuc

SEQ ID NO: 96447 - DNA, 22 bp, Artificial Sequence
  Synthetic
tgtggtcugccaggaugaaaat

SEQ ID NO: 96448 - DNA, 27 bp, Artificial Sequence
  Synthetic
agctaggttgacguaaactcaaatgut

SEQ ID NO: 96449 - DNA, 28 bp, Artificial Sequence
  Synthetic
tggaagauccagacaaagatgtuagagt

SEQ ID NO: 96450 - DNA, 28 bp, Artificial Sequence
  Synthetic
gcttgatattuccactaaaagccacuct

SEQ ID NO: 96451 - DNA, 28 bp, Artificial Sequence
  Synthetic
ggtattgtatactcutgtccttcagcut

SEQ ID NO: 96452 - DNA, 23 bp, Artificial Sequence
  Synthetic
tcgcagtaacuagcactttgucc

SEQ ID NO: 96453 - DNA, 25 bp, Artificial Sequence
  Synthetic
ggaatccgcaguttgtgcatattut

SEQ ID NO: 96454 - DNA, 31 bp, Artificial Sequence
  Synthetic
tgugaaggaaatatgtauaaaacaagcagga

SEQ ID NO: 96455 - DNA, 26 bp, Artificial Sequence
  Synthetic
cctcaaagucaaggtctgaataucgt

SEQ ID NO: 96456 - DNA, 30 bp, Artificial Sequence
  Synthetic
gagaagaaaatcacgauattcagacctuga

SEQ ID NO: 96457 - DNA, 24 bp, Artificial Sequence
  Synthetic
acccttacauggctgcatagagua

SEQ ID NO: 96458 - DNA, 26 bp, Artificial Sequence
  Synthetic
atgactctcttuccctctcttcucaa

SEQ ID NO: 96459 - DNA, 21 bp, Artificial Sequence
  Synthetic
gacacttcucccactctgcug

SEQ ID NO: 96460 - DNA, 23 bp, Artificial Sequence
  Synthetic
cggactgaccuccagtttuagaa

SEQ ID NO: 96461 - DNA, 26 bp, Artificial Sequence
  Synthetic
catgggaaccutacagttcttgtuca

SEQ ID NO: 96462 - DNA, 21 bp, Artificial Sequence
  Synthetic
gattccgccuccacatgtuct

SEQ ID NO: 96463 - DNA, 28 bp, Artificial Sequence
  Synthetic
gagacacacatcauttctttttgtgcut

SEQ ID NO: 96464 - DNA, 22 bp, Artificial Sequence
  Synthetic
gcaaaggaugctttggaacuga

SEQ ID NO: 96465 - DNA, 23 bp, Artificial Sequence
  Synthetic
aaatgtcaggcutcccaagtcut

SEQ ID NO: 96466 - DNA, 27 bp, Artificial Sequence
  Synthetic
actgcaagauttaccttgaucaacact

SEQ ID NO: 96467 - DNA, 22 bp, Artificial Sequence
  Synthetic
cccttccgucctttcatuggaa

SEQ ID NO: 96468 - DNA, 25 bp, Artificial Sequence
  Synthetic
gcctctgtuctaacagacaucaact

SEQ ID NO: 96469 - DNA, 22 bp, Artificial Sequence
  Synthetic
ccttttgaugacaccggaguga

SEQ ID NO: 96470 - DNA, 30 bp, Artificial Sequence
  Synthetic
ttcuttctttttgactcuaggacaaacagt

SEQ ID NO: 96471 - DNA, 21 bp, Artificial Sequence
  Synthetic
tcaacactggugcctcgttut

SEQ ID NO: 96472 - DNA, 28 bp, Artificial Sequence
  Synthetic
tgaagcaugagaacatattacagtucat

SEQ ID NO: 96473 - DNA, 25 bp, Artificial Sequence
  Synthetic
ctctgagggauttatagccagcaut

SEQ ID NO: 96474 - DNA, 33 bp, Artificial Sequence
  Synthetic
taattacattggagaaaguaagtttcacatgut

SEQ ID NO: 96475 - DNA, 28 bp, Artificial Sequence
  Synthetic
caaagtgaccauctatcttctuccacat

SEQ ID NO: 96476 - DNA, 25 bp, Artificial Sequence
  Synthetic
cttctctcugttctttgugacacac

SEQ ID NO: 96477 - DNA, 24 bp, Artificial Sequence
  Synthetic
gtactaaagcuggctttgcaccua

SEQ ID NO: 96478 - DNA, 25 bp, Artificial Sequence
  Synthetic
caacccaguaagacauacaccagaa

SEQ ID NO: 96479 - DNA, 27 bp, Artificial Sequence
  Synthetic
tgtgaaagtgugttactgtcuacacat

SEQ ID NO: 96480 - DNA, 21 bp, Artificial Sequence
  Synthetic
tcaucagccaccaacucgaaa

SEQ ID NO: 96481 - DNA, 24 bp, Artificial Sequence
  Synthetic
caggtcaacucacaggaggatuac

SEQ ID NO: 96482 - DNA, 25 bp, Artificial Sequence
  Synthetic
ttccagagttccuattcagggcuat

SEQ ID NO: 96483 - DNA, 21 bp, Artificial Sequence
  Synthetic
catgaaagccutggcttgcug

SEQ ID NO: 96484 - DNA, 20 bp, Artificial Sequence
  Synthetic
cataagcugacgacggccut

SEQ ID NO: 96485 - DNA, 19 bp, Artificial Sequence
  Synthetic
ccgccgaugcatccttuct

SEQ ID NO: 96486 - DNA, 19 bp, Artificial Sequence
  Synthetic
ccaagtgcaccucggtgua

SEQ ID NO: 96487 - DNA, 21 bp, Artificial Sequence
  Synthetic
agaagugttcccucagagcca

SEQ ID NO: 96488 - DNA, 21 bp, Artificial Sequence
  Synthetic
ataacaagcaguggcauccct

SEQ ID NO: 96489 - DNA, 28 bp, Artificial Sequence
  Synthetic
caaagaaattgtaugctgctatgcauga

SEQ ID NO: 96490 - DNA, 23 bp, Artificial Sequence
  Synthetic
ctccatcaggutcatgcauagca

SEQ ID NO: 96491 - DNA, 31 bp, Artificial Sequence
  Synthetic
aattgctgtttcaauataaacaggtggttut

SEQ ID NO: 96492 - DNA, 19 bp, Artificial Sequence
  Synthetic
cgtttcugccggcugaagt

SEQ ID NO: 96493 - DNA, 28 bp, Artificial Sequence
  Synthetic
tggaagaagttuagagttggacaaugag

SEQ ID NO: 96494 - DNA, 28 bp, Artificial Sequence
  Synthetic
accacaagauaagaaatcttccattcug

SEQ ID NO: 96495 - DNA, 26 bp, Artificial Sequence
  Synthetic
atctgtcactuacgttttggagucat

SEQ ID NO: 96496 - DNA, 29 bp, Artificial Sequence
  Synthetic
gggtactttgaauccctattgtgtatugt

SEQ ID NO: 96497 - DNA, 23 bp, Artificial Sequence
  Synthetic
ctgttaacuagcaggcagcugaa

SEQ ID NO: 96498 - DNA, 25 bp, Artificial Sequence
  Synthetic
ccctggtaauagaccacatttggut

SEQ ID NO: 96499 - DNA, 23 bp, Artificial Sequence
  Synthetic
ccctcuaatacctcuggagccat

SEQ ID NO: 96500 - DNA, 19 bp, Artificial Sequence
  Synthetic
aggttgguacccggaggua

SEQ ID NO: 96501 - DNA, 21 bp, Artificial Sequence
  Synthetic
gcgagaagccagutcccauag

SEQ ID NO: 96502 - DNA, 28 bp, Artificial Sequence
  Synthetic
cacatgatgtugaacactagaaaugcaa

SEQ ID NO: 96503 - DNA, 20 bp, Artificial Sequence
  Synthetic
cacccgaccutgttcucaga

SEQ ID NO: 96504 - DNA, 29 bp, Artificial Sequence
  Synthetic
aggatagatatguatgccatgggatuagt

SEQ ID NO: 96505 - DNA, 25 bp, Artificial Sequence
  Synthetic
ccttggagtguatcatccctttuca

SEQ ID NO: 96506 - DNA, 22 bp, Artificial Sequence
  Synthetic
acacagtccugactccaacauc

SEQ ID NO: 96507 - DNA, 28 bp, Artificial Sequence
  Synthetic
gctaattgttcaaaucaactggacucct

SEQ ID NO: 96508 - DNA, 26 bp, Artificial Sequence
  Synthetic
aagtatcactcugagggctagaagut

SEQ ID NO: 96509 - DNA, 28 bp, Artificial Sequence
  Synthetic
gatttattgugcagacatgtactuggag

SEQ ID NO: 96510 - DNA, 27 bp, Artificial Sequence
  Synthetic
atcatataccucattccagctatuggc

SEQ ID NO: 96511 - DNA, 25 bp, Artificial Sequence
  Synthetic
aagtgttttgcautgaccaatucca

SEQ ID NO: 96512 - DNA, 25 bp, Artificial Sequence
  Synthetic
tgtgagttggagguttctgtactug

SEQ ID NO: 96513 - DNA, 26 bp, Artificial Sequence
  Synthetic
tcttttctagtgcucagcttcttgug

SEQ ID NO: 96514 - DNA, 27 bp, Artificial Sequence
  Synthetic
ttttgagtgauaggttagctttgcuga

SEQ ID NO: 96515 - DNA, 25 bp, Artificial Sequence
  Synthetic
accactgccuactattaggguaact

SEQ ID NO: 96516 - DNA, 21 bp, Artificial Sequence
  Synthetic
ggaatcctcuggcacacctuc

SEQ ID NO: 96517 - DNA, 28 bp, Artificial Sequence
  Synthetic
actaagcattgcauttcaggtctaucaa

SEQ ID NO: 96518 - DNA, 26 bp, Artificial Sequence
  Synthetic
aagtgacagttuccacattaccauca

SEQ ID NO: 96519 - DNA, 27 bp, Artificial Sequence
  Synthetic
acctcttauacacatccagccuaaaga

SEQ ID NO: 96520 - DNA, 23 bp, Artificial Sequence
  Synthetic
ggtagtggaagauagctgcagut

SEQ ID NO: 96521 - DNA, 21 bp, Artificial Sequence
  Synthetic
cacatagagcutgggacugct

SEQ ID NO: 96522 - DNA, 29 bp, Artificial Sequence
  Synthetic
ttgctagggauttaatttttggacuacca

SEQ ID NO: 96523 - DNA, 24 bp, Artificial Sequence
  Synthetic
agctccttugcagttgatgaguat

SEQ ID NO: 96524 - DNA, 22 bp, Artificial Sequence
  Synthetic
tgatgacattuccctggccaut

SEQ ID NO: 96525 - DNA, 21 bp, Artificial Sequence
  Synthetic
gcuagaaaggctggucaccac

SEQ ID NO: 96526 - DNA, 28 bp, Artificial Sequence
  Synthetic
gccaaagtaagagutcttgccttcuaaa

SEQ ID NO: 96527 - DNA, 27 bp, Artificial Sequence
  Synthetic
tggtcaugagccgatttttaagucaat

SEQ ID NO: 96528 - DNA, 28 bp, Artificial Sequence
  Synthetic
ggagctgattguaaatatcccatgtgut

SEQ ID NO: 96529 - DNA, 28 bp, Artificial Sequence
  Synthetic
actttttgaagacutggtttaccuccat

SEQ ID NO: 96530 - DNA, 24 bp, Artificial Sequence
  Synthetic
agcatgacccaucacatttctuct

SEQ ID NO: 96531 - DNA, 28 bp, Artificial Sequence
  Synthetic
acacaagaaaatcugtgaagtcatcugt

SEQ ID NO: 96532 - DNA, 25 bp, Artificial Sequence
  Synthetic
gtaccccaaaaauagcaggactcut

SEQ ID NO: 96533 - DNA, 24 bp, Artificial Sequence
  Synthetic
tcataacgagacutctgcggatug

SEQ ID NO: 96534 - DNA, 22 bp, Artificial Sequence
  Synthetic
ggagagcatugtaggctgtcug

SEQ ID NO: 96535 - DNA, 26 bp, Artificial Sequence
  Synthetic
ctctcaccaaugtgttgttactucct

SEQ ID NO: 96536 - DNA, 25 bp, Artificial Sequence
  Synthetic
tgtaacaaaugacaggagggagtug

SEQ ID NO: 96537 - DNA, 28 bp, Artificial Sequence
  Synthetic
agtcaatcgucaaggatttagcaaauga

SEQ ID NO: 96538 - DNA, 25 bp, Artificial Sequence
  Synthetic
gcaaautcgatccaugagcagaaac

SEQ ID NO: 96539 - DNA, 29 bp, Artificial Sequence
  Synthetic
tgaaagaaagagtuttaggacacacauca

SEQ ID NO: 96540 - DNA, 28 bp, Artificial Sequence
  Synthetic
gcatcagctguaaccataatttcaaugt

SEQ ID NO: 96541 - DNA, 26 bp, Artificial Sequence
  Synthetic
cagtttacccuttcataccuacagca

SEQ ID NO: 96542 - DNA, 26 bp, Artificial Sequence
  Synthetic
tatctttgccuaaggaagtacuggaa

SEQ ID NO: 96543 - DNA, 24 bp, Artificial Sequence
  Synthetic
agtttttguataggacugcgccaa

SEQ ID NO: 96544 - DNA, 23 bp, Artificial Sequence
  Synthetic
tcugtatttgttctuggcgcagt

SEQ ID NO: 96545 - DNA, 27 bp, Artificial Sequence
  Synthetic
cccttcatatuaccacagcttgttuga

SEQ ID NO: 96546 - DNA, 25 bp, Artificial Sequence
  Synthetic
gtgtacatatucccccttttcugct

SEQ ID NO: 96547 - DNA, 21 bp, Artificial Sequence
  Synthetic
gccaacccaaagucagcaaug

SEQ ID NO: 96548 - DNA, 25 bp, Artificial Sequence
  Synthetic
ctgttgaaaaacaaccugacagcut

SEQ ID NO: 96549 - DNA, 25 bp, Artificial Sequence
  Synthetic
actaattcagtccugacatgccaut

SEQ ID NO: 96550 - DNA, 21 bp, Artificial Sequence
  Synthetic
ctcctccucacgacctttcuc

SEQ ID NO: 96551 - DNA, 22 bp, Artificial Sequence
  Synthetic
ggcttguagaccccttgaauct

SEQ ID NO: 96552 - DNA, 27 bp, Artificial Sequence
  Synthetic
gcagatgatgaguaataattgcatguc

SEQ ID NO: 96553 - DNA, 26 bp, Artificial Sequence
  Synthetic
tgccacttccaucatttgttacucaa

SEQ ID NO: 96554 - DNA, 27 bp, Artificial Sequence
  Synthetic
ccttagtucacagtctgtatugcaact

SEQ ID NO: 96555 - DNA, 23 bp, Artificial Sequence
  Synthetic
tcatttgacttuggccaagguct

SEQ ID NO: 96556 - DNA, 27 bp, Artificial Sequence
  Synthetic
tgtatgcaagtuatgtttcttcgcuga

SEQ ID NO: 96557 - DNA, 28 bp, Artificial Sequence
  Synthetic
ctggctccttuaagctattagcagaaut

SEQ ID NO: 96558 - DNA, 26 bp, Artificial Sequence
  Synthetic
gctaaatatgaaugcgtgacatugct

SEQ ID NO: 96559 - DNA, 28 bp, Artificial Sequence
  Synthetic
ccaaccaagacuctttgatgatttgtua

SEQ ID NO: 96560 - DNA, 29 bp, Artificial Sequence
  Synthetic
tctttgaatgtutgtagctagaugcagaa

SEQ ID NO: 96561 - DNA, 24 bp, Artificial Sequence
  Synthetic
catgcagttacugagctctagugt

SEQ ID NO: 96562 - DNA, 25 bp, Artificial Sequence
  Synthetic
tgcaaacaugcagttctcatacuca

SEQ ID NO: 96563 - DNA, 28 bp, Artificial Sequence
  Synthetic
gcatttttacctugccaagtactaugac

SEQ ID NO: 96564 - DNA, 23 bp, Artificial Sequence
  Synthetic
tctgtgaccaugggcatcaatut

SEQ ID NO: 96565 - DNA, 28 bp, Artificial Sequence
  Synthetic
gggatttcctuaggtaggtatcctaugt

SEQ ID NO: 96566 - DNA, 25 bp, Artificial Sequence
  Synthetic
gtagagatgaggacuacagcccaua

SEQ ID NO: 96567 - DNA, 26 bp, Artificial Sequence
  Synthetic
tctacatgatccucttgtggaaugga

SEQ ID NO: 96568 - DNA, 24 bp, Artificial Sequence
  Synthetic
ggaatgcccuttcactggttuact

SEQ ID NO: 96569 - DNA, 30 bp, Artificial Sequence
  Synthetic
gtattaccattagcutctcatccttcacut

SEQ ID NO: 96570 - DNA, 24 bp, Artificial Sequence
  Synthetic
ccacatacuggctgttgttuacga

SEQ ID NO: 96571 - DNA, 28 bp, Artificial Sequence
  Synthetic
gccatctgcuttttgtgaaattuaacat

SEQ ID NO: 96572 - DNA, 27 bp, Artificial Sequence
  Synthetic
catcccaaaaugtattgagcaguagga

SEQ ID NO: 96573 - DNA, 25 bp, Artificial Sequence
  Synthetic
gttgttttgggutcaggccttatug

SEQ ID NO: 96574 - DNA, 28 bp, Artificial Sequence
  Synthetic
gtcattaattccaaaaucatcgtgguca

SEQ ID NO: 96575 - DNA, 28 bp, Artificial Sequence
  Synthetic
tggtgttatcagutgaaagaatgacugt

SEQ ID NO: 96576 - DNA, 29 bp, Artificial Sequence
  Synthetic
cgagtatttccaacuaatttcccaggaut

SEQ ID NO: 96577 - DNA, 27 bp, Artificial Sequence
  Synthetic
cacatgattctgutctcccattttcug

SEQ ID NO: 96578 - DNA, 26 bp, Artificial Sequence
  Synthetic
agctggctguaatattgaaaggagut

SEQ ID NO: 96579 - DNA, 29 bp, Artificial Sequence
  Synthetic
caaacauaaccaggagatagguggaaaat

SEQ ID NO: 96580 - DNA, 25 bp, Artificial Sequence
  Synthetic
acttggtuggagagctgctuaaaat

SEQ ID NO: 96581 - DNA, 21 bp, Artificial Sequence
  Synthetic
ccctctguctgctcatucagg

SEQ ID NO: 96582 - DNA, 27 bp, Artificial Sequence
  Synthetic
ggctgttcguaacctgctgatttauat

SEQ ID NO: 96583 - DNA, 28 bp, Artificial Sequence
  Synthetic
ccaagtgcaguttgtaaagttttuagga

SEQ ID NO: 96584 - DNA, 29 bp, Artificial Sequence
  Synthetic
agggagtcatttauggatcgtattctgua

SEQ ID NO: 96585 - DNA, 26 bp, Artificial Sequence
  Synthetic
aaactgauaagccaggagugaaaagt

SEQ ID NO: 96586 - DNA, 24 bp, Artificial Sequence
  Synthetic
ccaaaaaggaccutagctgctcua

SEQ ID NO: 96587 - DNA, 28 bp, Artificial Sequence
  Synthetic
cattcttggaatugcagagttgcatuat

SEQ ID NO: 96588 - DNA, 28 bp, Artificial Sequence
  Synthetic
cgctgattttgtuaaataacgtggtgut

SEQ ID NO: 96589 - DNA, 22 bp, Artificial Sequence
  Synthetic
cttcccctcuctttggcactua

SEQ ID NO: 96590 - DNA, 28 bp, Artificial Sequence
  Synthetic
actcctggcttaucagtttgatcattut

SEQ ID NO: 96591 - DNA, 28 bp, Artificial Sequence
  Synthetic
gggaaattagtuggaaatactcgacgua

SEQ ID NO: 96592 - DNA, 27 bp, Artificial Sequence
  Synthetic
ccaagaatgcuttcgtttttcuacagt

SEQ ID NO: 96593 - DNA, 27 bp, Artificial Sequence
  Synthetic
gctgaccttgtucaataccaaaaacuc

SEQ ID NO: 96594 - DNA, 27 bp, Artificial Sequence
  Synthetic
tgtattggaactugggaacaattcugt

SEQ ID NO: 96595 - DNA, 27 bp, Artificial Sequence
  Synthetic
caactaactatuagggatgctgugcaa

SEQ ID NO: 96596 - DNA, 27 bp, Artificial Sequence
  Synthetic
tgaagattctgaugtttgctctgtuct

SEQ ID NO: 96597 - DNA, 27 bp, Artificial Sequence
  Synthetic
cagaagatcgccugcatagaaatttut

SEQ ID NO: 96598 - DNA, 24 bp, Artificial Sequence
  Synthetic
cgcacccaucctaaaactgctuat

SEQ ID NO: 96599 - DNA, 28 bp, Artificial Sequence
  Synthetic
cagatgaatuaaacacgtacagagugga

SEQ ID NO: 96600 - DNA, 24 bp, Artificial Sequence
  Synthetic
caccaaatcccacugtgacaatut

SEQ ID NO: 96601 - DNA, 28 bp, Artificial Sequence
  Synthetic
ccaatgaaaaatcuctgaatgtcaccut

SEQ ID NO: 96602 - DNA, 29 bp, Artificial Sequence
  Synthetic
auctttaatgtttaguagaaagcgagaca

SEQ ID NO: 96603 - DNA, 20 bp, Artificial Sequence
  Synthetic
ctgcucggcaaggaccaaua

SEQ ID NO: 96604 - DNA, 17 bp, Artificial Sequence
  Synthetic
tggucctugccgagcag

SEQ ID NO: 96605 - DNA, 27 bp, Artificial Sequence
  Synthetic
ctggatgatgacuttggaaatgacaut

SEQ ID NO: 96606 - DNA, 28 bp, Artificial Sequence
  Synthetic
caagacactgutggatttaacucagaga

SEQ ID NO: 96607 - DNA, 24 bp, Artificial Sequence
  Synthetic
ccttcacgaacutgtctccctuac

SEQ ID NO: 96608 - DNA, 25 bp, Artificial Sequence
  Synthetic
gctaagctatucaacattgccugga

SEQ ID NO: 96609 - DNA, 27 bp, Artificial Sequence
  Synthetic
cccctctcaaautatcatccgtacaua

SEQ ID NO: 96610 - DNA, 32 bp, Artificial Sequence
  Synthetic
acttatgtttctugcaatattctggtuaaaaa

SEQ ID NO: 96611 - DNA, 24 bp, Artificial Sequence
  Synthetic
ggagattgcuacagtgcttucaga

SEQ ID NO: 96612 - DNA, 27 bp, Artificial Sequence
  Synthetic
acaaatatgaaauacctgtgggcauct

SEQ ID NO: 96613 - DNA, 27 bp, Artificial Sequence
  Synthetic
tgcattattguctccatgcuaaagagt

SEQ ID NO: 96614 - DNA, 23 bp, Artificial Sequence
  Synthetic
tgaatugcggagaactgtguact

SEQ ID NO: 96615 - DNA, 28 bp, Artificial Sequence
  Synthetic
tcattgaaggcuggttattuacagaact

SEQ ID NO: 96616 - DNA, 27 bp, Artificial Sequence
  Synthetic
gaaagtgacuatattgtgaugcccaga

SEQ ID NO: 96617 - DNA, 28 bp, Artificial Sequence
  Synthetic
tgaattcaggguttactttgtagugcaa

SEQ ID NO: 96618 - DNA, 26 bp, Artificial Sequence
  Synthetic
actcttaaaaaguactgctgtugcct

SEQ ID NO: 96619 - DNA, 23 bp, Artificial Sequence
  Synthetic
catctgtctcuggagcagcauac

SEQ ID NO: 96620 - DNA, 24 bp, Artificial Sequence
  Synthetic
gctgcaaccagagcuctaattuct

SEQ ID NO: 96621 - DNA, 26 bp, Artificial Sequence
  Synthetic
tgutgtttttaatttuagggccgcaa

SEQ ID NO: 96622 - DNA, 25 bp, Artificial Sequence
  Synthetic
agtgcaaatgguaccaaatctccut

SEQ ID NO: 96623 - DNA, 27 bp, Artificial Sequence
  Synthetic
ccgtttgtttcugggatattggagaua

SEQ ID NO: 96624 - DNA, 23 bp, Artificial Sequence
  Synthetic
cacacacattcutgtgagcacut

SEQ ID NO: 96625 - DNA, 26 bp, Artificial Sequence
  Synthetic
gctctcactuccatggatttatuccc

SEQ ID NO: 96626 - DNA, 28 bp, Artificial Sequence
  Synthetic
gtcaacttuaaacagccatcaucagaat

SEQ ID NO: 96627 - DNA, 33 bp, Artificial Sequence
  Synthetic
ttaatgacttatttugtgcttctgtaguaaaca

SEQ ID NO: 96628 - DNA, 25 bp, Artificial Sequence
  Synthetic
tgtaccuaaaagaaacacaaugcct

SEQ ID NO: 96629 - DNA, 28 bp, Artificial Sequence
  Synthetic
tcctcctattttucatgagtggtttcug

SEQ ID NO: 96630 - DNA, 26 bp, Artificial Sequence
  Synthetic
catgatgtaggaucagggaatgtuct

SEQ ID NO: 96631 - DNA, 23 bp, Artificial Sequence
  Synthetic
gccagtgtaugctaccaaaguca

SEQ ID NO: 96632 - DNA, 20 bp, Artificial Sequence
  Synthetic
gaugccugggcaggagaaat

SEQ ID NO: 96633 - DNA, 24 bp, Artificial Sequence
  Synthetic
gatatcacucttcctugcaggagt

SEQ ID NO: 96634 - DNA, 33 bp, Artificial Sequence
  Synthetic
aaagtcttagatuacaaagctttacuaacacaa

SEQ ID NO: 96635 - DNA, 26 bp, Artificial Sequence
  Synthetic
agtgacgagagagaautgcaaugaat

SEQ ID NO: 96636 - DNA, 27 bp, Artificial Sequence
  Synthetic
gtttaatgtaccucgctccattcacua

SEQ ID NO: 96637 - DNA, 27 bp, Artificial Sequence
  Synthetic
gtatgaataacttuggccatcgtctug

SEQ ID NO: 96638 - DNA, 25 bp, Artificial Sequence
  Synthetic
cccaacugggacaggaaaattcaut

SEQ ID NO: 96639 - DNA, 22 bp, Artificial Sequence
  Synthetic
cagtgtuccaggagttguggag

SEQ ID NO: 96640 - DNA, 20 bp, Artificial Sequence
  Synthetic
accttucccctccuccacaa

SEQ ID NO: 96641 - DNA, 29 bp, Artificial Sequence
  Synthetic
aagttgcccctutctttctaattacguat

SEQ ID NO: 96642 - DNA, 27 bp, Artificial Sequence
  Synthetic
tcttcatacaagacucaccctucaaga

SEQ ID NO: 96643 - DNA, 22 bp, Artificial Sequence
  Synthetic
cttgccugccttttgttacuca

SEQ ID NO: 96644 - DNA, 20 bp, Artificial Sequence
  Synthetic
cccctcattutgctgcccua

SEQ ID NO: 96645 - DNA, 21 bp, Artificial Sequence
  Synthetic
ccacccucatccatgtugaca

SEQ ID NO: 96646 - DNA, 22 bp, Artificial Sequence
  Synthetic
aggagccugacgaaatcctcua

SEQ ID NO: 96647 - DNA, 20 bp, Artificial Sequence
  Synthetic
acatagcguccagcaggaug

SEQ ID NO: 96648 - DNA, 24 bp, Artificial Sequence
  Synthetic
cgtagtcaacccaaaugggtgtua

SEQ ID NO: 96649 - DNA, 28 bp, Artificial Sequence
  Synthetic
gttctgaaataacccuaaccttaccugt

SEQ ID NO: 96650 - DNA, 21 bp, Artificial Sequence
  Synthetic
gattcctguagctgccucact

SEQ ID NO: 96651 - DNA, 22 bp, Artificial Sequence
  Synthetic
ttggatccugagagggaguacc

SEQ ID NO: 96652 - DNA, 28 bp, Artificial Sequence
  Synthetic
catagcatguaaacagttgggaauaggt

SEQ ID NO: 96653 - DNA, 22 bp, Artificial Sequence
  Synthetic
agagatggaugctggccaatut

SEQ ID NO: 96654 - DNA, 29 bp, Artificial Sequence
  Synthetic
gagttctattucacagtttaccugacaca

SEQ ID NO: 96655 - DNA, 28 bp, Artificial Sequence
  Synthetic
gaaggcagaugggaatgaataugaagat

SEQ ID NO: 96656 - DNA, 28 bp, Artificial Sequence
  Synthetic
tgtatataagatguggcttgttgugacc

SEQ ID NO: 96657 - DNA, 25 bp, Artificial Sequence
  Synthetic
ttttcttctuggcgactgtuaggaa

SEQ ID NO: 96658 - DNA, 27 bp, Artificial Sequence
  Synthetic
gatgaatacaugttgccattugaggag

SEQ ID NO: 96659 - DNA, 28 bp, Artificial Sequence
  Synthetic
aagctaactggauaacttacagcatgut

SEQ ID NO: 96660 - DNA, 27 bp, Artificial Sequence
  Synthetic
ggcctgttutaagagattatuggcaga

SEQ ID NO: 96661 - DNA, 27 bp, Artificial Sequence
  Synthetic
atcacctuccagaaaatactugcagaa

SEQ ID NO: 96662 - DNA, 29 bp, Artificial Sequence
  Synthetic
catgtaactucctgtaattttucaaggct

SEQ ID NO: 96663 - DNA, 25 bp, Artificial Sequence
  Synthetic
gcaagccatuccttttcctacugaa

SEQ ID NO: 96664 - DNA, 28 bp, Artificial Sequence
  Synthetic
ctcaccaagtttuactggactaggtaut

SEQ ID NO: 96665 - DNA, 21 bp, Artificial Sequence
  Synthetic
ctcugaacacggacatgugga

SEQ ID NO: 96666 - DNA, 25 bp, Artificial Sequence
  Synthetic
ggcuttcaagttccuacagaagagg

SEQ ID NO: 96667 - DNA, 28 bp, Artificial Sequence
  Synthetic
ccccagagauaaagtcaaagatgatuct

SEQ ID NO: 96668 - DNA, 28 bp, Artificial Sequence
  Synthetic
cagacaagtugaccaagtauagaagcaa

SEQ ID NO: 96669 - DNA, 27 bp, Artificial Sequence
  Synthetic
ggctttgtttuaccagtacttttgucc

SEQ ID NO: 96670 - DNA, 27 bp, Artificial Sequence
  Synthetic
actatatccacucttacctgaauggca

SEQ ID NO: 96671 - DNA, 27 bp, Artificial Sequence
  Synthetic
gtagaagatucaagctttgcctaugga

SEQ ID NO: 96672 - DNA, 28 bp, Artificial Sequence
  Synthetic
ggtaagctcttgutagctccatcaauaa

SEQ ID NO: 96673 - DNA, 28 bp, Artificial Sequence
  Synthetic
catggaaaaagcaguacaccuaagaaaa

SEQ ID NO: 96674 - DNA, 28 bp, Artificial Sequence
  Synthetic
atcaggaaauccaggaaaatgtcttuct

SEQ ID NO: 96675 - DNA, 26 bp, Artificial Sequence
  Synthetic
gccgacacccuttacagtcaaatuaa

SEQ ID NO: 96676 - DNA, 23 bp, Artificial Sequence
  Synthetic
cccagtatgutttggtgcuggat

SEQ ID NO: 96677 - DNA, 22 bp, Artificial Sequence
  Synthetic
actgtgauggttcgtgtuggag

SEQ ID NO: 96678 - DNA, 24 bp, Artificial Sequence
  Synthetic
cggttgatttuacaccaggaggut

SEQ ID NO: 96679 - DNA, 23 bp, Artificial Sequence
  Synthetic
gcaccuaccugaagaacaggaga

SEQ ID NO: 96680 - DNA, 27 bp, Artificial Sequence
  Synthetic
gggccaataautatattcgaggtuact

SEQ ID NO: 96681 - DNA, 26 bp, Artificial Sequence
  Synthetic
gtcttttucgaagagcatgtgaagut

SEQ ID NO: 96682 - DNA, 26 bp, Artificial Sequence
  Synthetic
aatgggccauaccaaattattcucct

SEQ ID NO: 96683 - DNA, 28 bp, Artificial Sequence
  Synthetic
ccagagagaauagaaagcagctcaaaua

SEQ ID NO: 96684 - DNA, 20 bp, Artificial Sequence
  Synthetic
tcacgcaucagcctcatugt

SEQ ID NO: 96685 - DNA, 28 bp, Artificial Sequence
  Synthetic
agaaacctttgaagutccagaaattgug

SEQ ID NO: 96686 - DNA, 22 bp, Artificial Sequence
  Synthetic
tcatcaagugccatccauccac

SEQ ID NO: 96687 - DNA, 27 bp, Artificial Sequence
  Synthetic
gcaaattgcacaucatcctgtagttua

SEQ ID NO: 96688 - DNA, 26 bp, Artificial Sequence
  Synthetic
accatattatgagucaggcgaaaugg

SEQ ID NO: 96689 - DNA, 28 bp, Artificial Sequence
  Synthetic
tgctaaaagaatcuggacatgaagtuct

SEQ ID NO: 96690 - DNA, 25 bp, Artificial Sequence
  Synthetic
ggccaugaaaaucaaaaccacaact

SEQ ID NO: 96691 - DNA, 26 bp, Artificial Sequence
  Synthetic
tcttagcaatuggtttggattccugt

SEQ ID NO: 96692 - DNA, 22 bp, Artificial Sequence
  Synthetic
gauccatcacuccgaaaagcca

SEQ ID NO: 96693 - DNA, 28 bp, Artificial Sequence
  Synthetic
ccuctatatctatgauggaccagacagt

SEQ ID NO: 96694 - DNA, 21 bp, Artificial Sequence
  Synthetic
tggcgttugccgtctttctua

SEQ ID NO: 96695 - DNA, 20 bp, Artificial Sequence
  Synthetic
ggactcuccgacucaacacc

SEQ ID NO: 96696 - DNA, 26 bp, Artificial Sequence
  Synthetic
gggctattactguctggtccatcaua

SEQ ID NO: 96697 - DNA, 33 bp, Artificial Sequence
  Synthetic
tggttaacagccuaataataattatcctactuc

SEQ ID NO: 96698 - DNA, 23 bp, Artificial Sequence
  Synthetic
gaguttgtggtucaggacaggaa

SEQ ID NO: 96699 - DNA, 32 bp, Artificial Sequence
  Synthetic
gtttgatgagacacugatattcaatttuagca

SEQ ID NO: 96700 - DNA, 23 bp, Artificial Sequence
  Synthetic
cagcacgcuttttgacatctuct

SEQ ID NO: 96701 - DNA, 22 bp, Artificial Sequence
  Synthetic
agaugaacaaaacugggccaca

SEQ ID NO: 96702 - DNA, 27 bp, Artificial Sequence
  Synthetic
ggatactaaccugttgtcaatcugcac

SEQ ID NO: 96703 - DNA, 23 bp, Artificial Sequence
  Synthetic
gttgcagaaagcuaaagccauca

SEQ ID NO: 96704 - DNA, 24 bp, Artificial Sequence
  Synthetic
ctgctttttcuttgtgccagucaa

SEQ ID NO: 96705 - DNA, 25 bp, Artificial Sequence
  Synthetic
tgaaaagagacagguattccaugcc

SEQ ID NO: 96706 - DNA, 22 bp, Artificial Sequence
  Synthetic
cccagggcucaattccaguaac

SEQ ID NO: 96707 - DNA, 26 bp, Artificial Sequence
  Synthetic
gaccctgagauactgaaaagctgtut

SEQ ID NO: 96708 - DNA, 28 bp, Artificial Sequence
  Synthetic
gatctgaattcaccutttcctctacgut

SEQ ID NO: 96709 - DNA, 21 bp, Artificial Sequence
  Synthetic
tgtgacagggugaacttgcug

SEQ ID NO: 96710 - DNA, 24 bp, Artificial Sequence
  Synthetic
ctcctgatccugaaagttctugct

SEQ ID NO: 96711 - DNA, 21 bp, Artificial Sequence
  Synthetic
ccatgctguaggcatcctcuc

SEQ ID NO: 96712 - DNA, 27 bp, Artificial Sequence
  Synthetic
ggcttgtaautttcaacttcucagcaa

SEQ ID NO: 96713 - DNA, 26 bp, Artificial Sequence
  Synthetic
gcagagcagcuacttctagaaaauca

SEQ ID NO: 96714 - DNA, 22 bp, Artificial Sequence
  Synthetic
ctcaatagtuaaccgggcugga

SEQ ID NO: 96715 - DNA, 28 bp, Artificial Sequence
  Synthetic
tgcatactagggutgcattttaggttua

SEQ ID NO: 96716 - DNA, 19 bp, Artificial Sequence
  Synthetic
cggagcucctgaccuacac

SEQ ID NO: 96717 - DNA, 26 bp, Artificial Sequence
  Synthetic
ggcattttcucatgtcaatguacaca

SEQ ID NO: 96718 - DNA, 22 bp, Artificial Sequence
  Synthetic
cauccaucacaggaccacagag

SEQ ID NO: 96719 - DNA, 22 bp, Artificial Sequence
  Synthetic
ttttggcaucagtgctctcuca

SEQ ID NO: 96720 - DNA, 31 bp, Artificial Sequence
  Synthetic
caataacaatagucctgacttaccauacagt

SEQ ID NO: 96721 - DNA, 28 bp, Artificial Sequence
  Synthetic
ccatttattctccugggtatcctgauga

SEQ ID NO: 96722 - DNA, 28 bp, Artificial Sequence
  Synthetic
ggtactctuacaagccaaaaacaatcut

SEQ ID NO: 96723 - DNA, 23 bp, Artificial Sequence
  Synthetic
tgcctttttcuccacagtcagut

SEQ ID NO: 96724 - DNA, 30 bp, Artificial Sequence
  Synthetic
agagttccataauctctacgtattgucact

SEQ ID NO: 96725 - DNA, 26 bp, Artificial Sequence
  Synthetic
aggttgcaacaauctacaaagaucca

SEQ ID NO: 96726 - DNA, 29 bp, Artificial Sequence
  Synthetic
gtgacttcatttgcugttaactgtatcuc

SEQ ID NO: 96727 - DNA, 24 bp, Artificial Sequence
  Synthetic
gaaatggccucttccagaaaacuc

SEQ ID NO: 96728 - DNA, 26 bp, Artificial Sequence
  Synthetic
aaaaguagggcaaacagaaugaggaa

SEQ ID NO: 96729 - DNA, 25 bp, Artificial Sequence
  Synthetic
tgccccaguttctatttaguagcag

SEQ ID NO: 96730 - DNA, 24 bp, Artificial Sequence
  Synthetic
tgaaggaagcccugattgatctug

SEQ ID NO: 96731 - DNA, 21 bp, Artificial Sequence
  Synthetic
ccgagaagcuctgctagtcug

SEQ ID NO: 96732 - DNA, 28 bp, Artificial Sequence
  Synthetic
ggaacgactgutgtctgttgtaaauaga

SEQ ID NO: 96733 - DNA, 29 bp, Artificial Sequence
  Synthetic
tcagactgaacugaattatgatgttcugg

SEQ ID NO: 96734 - DNA, 25 bp, Artificial Sequence
  Synthetic
agaagattuggcccatcatgaacut

SEQ ID NO: 96735 - DNA, 32 bp, Artificial Sequence
  Synthetic
gcagtccaaagcautatttccatatatagugt

SEQ ID NO: 96736 - DNA, 24 bp, Artificial Sequence
  Synthetic
cgtgtuacagcagcattttuggaa

SEQ ID NO: 96737 - DNA, 25 bp, Artificial Sequence
  Synthetic
acgtcctcguataaggctttttguc

SEQ ID NO: 96738 - DNA, 25 bp, Artificial Sequence
  Synthetic
catgttttgaagugtcgcctttcua

SEQ ID NO: 96739 - DNA, 21 bp, Artificial Sequence
  Synthetic
aatcctugcggaaaggagcut

SEQ ID NO: 96740 - DNA, 28 bp, Artificial Sequence
  Synthetic
aggacagagaaagaauaagtagcacuct

SEQ ID NO: 96741 - DNA, 23 bp, Artificial Sequence
  Synthetic
gagtgcaguttcagaaugaagca

SEQ ID NO: 96742 - DNA, 29 bp, Artificial Sequence
  Synthetic
gttctcacautcaagtatauacccagcaa

SEQ ID NO: 96743 - DNA, 21 bp, Artificial Sequence
  Synthetic
cccaaguaggcttctgtucca

SEQ ID NO: 96744 - DNA, 29 bp, Artificial Sequence
  Synthetic
aaacaagggaaccaauatacatgaucact

SEQ ID NO: 96745 - DNA, 23 bp, Artificial Sequence
  Synthetic
atttcaggcugaccactcaaugt

SEQ ID NO: 96746 - DNA, 23 bp, Artificial Sequence
  Synthetic
agtgatgtuaaagccacgtccug

SEQ ID NO: 96747 - DNA, 26 bp, Artificial Sequence
  Synthetic
tcccagtttgauttccttgctgtuaa

SEQ ID NO: 96748 - DNA, 24 bp, Artificial Sequence
  Synthetic
tgctucaacaacatcaaugcaagg

SEQ ID NO: 96749 - DNA, 24 bp, Artificial Sequence
  Synthetic
ctgattgcacutggaccattguag

SEQ ID NO: 96750 - DNA, 23 bp, Artificial Sequence
  Synthetic
gggattcuggagagtcaccauct

SEQ ID NO: 96751 - DNA, 24 bp, Artificial Sequence
  Synthetic
tcctgatuacccagaagggtaugg

SEQ ID NO: 96752 - DNA, 21 bp, Artificial Sequence
  Synthetic
gaaattgtguccccaggcuct

SEQ ID NO: 96753 - DNA, 24 bp, Artificial Sequence
  Synthetic
aagatgcttguggaggaacaauga

SEQ ID NO: 96754 - DNA, 23 bp, Artificial Sequence
  Synthetic
tggatatgaugccactggaucct

SEQ ID NO: 96755 - DNA, 26 bp, Artificial Sequence
  Synthetic
gcacttggtaucacatttgaactgut

SEQ ID NO: 96756 - DNA, 20 bp, Artificial Sequence
  Synthetic
gtcutccataggugcaccca

SEQ ID NO: 96757 - DNA, 24 bp, Artificial Sequence
  Synthetic
tgcaatgaugcagtggtuacagaa

SEQ ID NO: 96758 - DNA, 28 bp, Artificial Sequence
  Synthetic
atcagagattatcguccagatgcaatut

SEQ ID NO: 96759 - DNA, 31 bp, Artificial Sequence
  Synthetic
tgtatttcataatctucctgtttcaccagut

SEQ ID NO: 96760 - DNA, 27 bp, Artificial Sequence
  Synthetic
agaactgttggtutgatatgtcagcut

SEQ ID NO: 96761 - DNA, 26 bp, Artificial Sequence
  Synthetic
caaaatgacagautgagccaccauac

SEQ ID NO: 96762 - DNA, 26 bp, Artificial Sequence
  Synthetic
gccattttgtugcagttttgttcaut

SEQ ID NO: 96763 - DNA, 23 bp, Artificial Sequence
  Synthetic
tcttggccucttacucaaggaca

SEQ ID NO: 96764 - DNA, 26 bp, Artificial Sequence
  Synthetic
ccagaacacgguattctaaaaugcct

SEQ ID NO: 96765 - DNA, 24 bp, Artificial Sequence
  Synthetic
ccccagcccutgaatatgaaacuc

SEQ ID NO: 96766 - DNA, 30 bp, Artificial Sequence
  Synthetic
tgtagtgaaaaauaaagcatgtctggauga

SEQ ID NO: 96767 - DNA, 28 bp, Artificial Sequence
  Synthetic
gcactgttcuatcaccaaactauccaaa

SEQ ID NO: 96768 - DNA, 28 bp, Artificial Sequence
  Synthetic
gagtcgaatctuacttaccaaactccut

SEQ ID NO: 96769 - DNA, 18 bp, Artificial Sequence
  Synthetic
tttccuagcgccctgugg

SEQ ID NO: 96770 - DNA, 26 bp, Artificial Sequence
  Synthetic
gtactgatcugtttttgctcaugcaa

SEQ ID NO: 96771 - DNA, 23 bp, Artificial Sequence
  Synthetic
ggactgttgaugtaacccaugga

SEQ ID NO: 96772 - DNA, 24 bp, Artificial Sequence
  Synthetic
gaggcaaatuaccttttccauggg

SEQ ID NO: 96773 - DNA, 26 bp, Artificial Sequence
  Synthetic
tgctgatcacauggatctgtttctut

SEQ ID NO: 96774 - DNA, 21 bp, Artificial Sequence
  Synthetic
gttcttccugctgctgcctua

SEQ ID NO: 96775 - DNA, 28 bp, Artificial Sequence
  Synthetic
ggttaaccaatuctgggaaacataugaa

SEQ ID NO: 96776 - DNA, 27 bp, Artificial Sequence
  Synthetic
agagtttagtgtucagttccgctatut

SEQ ID NO: 96777 - DNA, 28 bp, Artificial Sequence
  Synthetic
tccaaatgtccugaaaatgtgtcaguat

SEQ ID NO: 96778 - DNA, 25 bp, Artificial Sequence
  Synthetic
gactccuggaaaacaatggagauca

SEQ ID NO: 96779 - DNA, 25 bp, Artificial Sequence
  Synthetic
gacaaggcagguagctaagtguaaa

SEQ ID NO: 96780 - DNA, 24 bp, Artificial Sequence
  Synthetic
ctcaactugaaatcgcttugcaca

SEQ ID NO: 96781 - DNA, 28 bp, Artificial Sequence
  Synthetic
cgatatcaugcacaattcauacaaccat

SEQ ID NO: 96782 - DNA, 20 bp, Artificial Sequence
  Synthetic
tgtcagccauggccaaagut

SEQ ID NO: 96783 - DNA, 27 bp, Artificial Sequence
  Synthetic
cctgaccagtuaaacatttcatcctut

SEQ ID NO: 96784 - DNA, 30 bp, Artificial Sequence
  Synthetic
acgctcctcauggttaaaatagaatataug

SEQ ID NO: 96785 - DNA, 23 bp, Artificial Sequence
  Synthetic
agccuggaggagagaatcaucaa

SEQ ID NO: 96786 - DNA, 28 bp, Artificial Sequence
  Synthetic
agtcttggtattuacctgtctgttgaug

SEQ ID NO: 96787 - DNA, 28 bp, Artificial Sequence
  Synthetic
caagcagagctuttgctaaagaaaguaa

SEQ ID NO: 96788 - DNA, 27 bp, Artificial Sequence
  Synthetic
cattaatgggtcutgaacagtgtgtut

SEQ ID NO: 96789 - DNA, 27 bp, Artificial Sequence
  Synthetic
agcaatttaaguctgaggcctaucaac

SEQ ID NO: 96790 - DNA, 29 bp, Artificial Sequence
  Synthetic
tgcttgatgatucagtctttccatttcua

SEQ ID NO: 96791 - DNA, 23 bp, Artificial Sequence
  Synthetic
gtcaccucccctcagtaaguagt

SEQ ID NO: 96792 - DNA, 28 bp, Artificial Sequence
  Synthetic
ctaattaggcautgaaggaagctuaaca

SEQ ID NO: 96793 - DNA, 21 bp, Artificial Sequence
  Synthetic
gggaatgguacctggaguggt

SEQ ID NO: 96794 - DNA, 21 bp, Artificial Sequence
  Synthetic
acgtaagcacugcggtactuc

SEQ ID NO: 96795 - DNA, 24 bp, Artificial Sequence
  Synthetic
ggaaggcuggaaggaacaaattuc

SEQ ID NO: 96796 - DNA, 22 bp, Artificial Sequence
  Synthetic
ccagtctugtcctctcugagca

SEQ ID NO: 96797 - DNA, 23 bp, Artificial Sequence
  Synthetic
tgcaatgaguatgcatggugaca

SEQ ID NO: 96798 - DNA, 27 bp, Artificial Sequence
  Synthetic
gatgtagctaatacuaaagccccaguc

SEQ ID NO: 96799 - DNA, 25 bp, Artificial Sequence
  Synthetic
gctcaggatauttcaacagctgugt

SEQ ID NO: 96800 - DNA, 27 bp, Artificial Sequence
  Synthetic
ccacaaataugattcatggucaccaca

SEQ ID NO: 96801 - DNA, 22 bp, Artificial Sequence
  Synthetic
ggagcatgaccuggatgatguc

SEQ ID NO: 96802 - DNA, 21 bp, Artificial Sequence
  Synthetic
gagagtctuccaccgtgcaut

SEQ ID NO: 96803 - DNA, 27 bp, Artificial Sequence
  Synthetic
ttgcaagguaaacagcaagatguaaac

SEQ ID NO: 96804 - DNA, 24 bp, Artificial Sequence
  Synthetic
ctgaataaggccutgaccuaacca

SEQ ID NO: 96805 - DNA, 27 bp, Artificial Sequence
  Synthetic
acaacctgatgccuaaagaaatgctua

SEQ ID NO: 96806 - DNA, 25 bp, Artificial Sequence
  Synthetic
cagctcagtucacctatgtctctug

SEQ ID NO: 96807 - DNA, 24 bp, Artificial Sequence
  Synthetic
cctgcugagaaaggcatgaaguag

SEQ ID NO: 96808 - DNA, 29 bp, Artificial Sequence
  Synthetic
gtgactgactuagcatcttacatctttug

SEQ ID NO: 96809 - DNA, 26 bp, Artificial Sequence
  Synthetic
tcaggcctcucattgaataaggagua

SEQ ID NO: 96810 - DNA, 28 bp, Artificial Sequence
  Synthetic
tcactttctggaugaaggtggaaattut

SEQ ID NO: 96811 - DNA, 24 bp, Artificial Sequence
  Synthetic
agaaggcacaugtaagtuccaact

SEQ ID NO: 96812 - DNA, 23 bp, Artificial Sequence
  Synthetic
ggcatgtttcucaggagtgtgua

SEQ ID NO: 96813 - DNA, 25 bp, Artificial Sequence
  Synthetic
cattgtggcaccaauattgacucac

SEQ ID NO: 96814 - DNA, 28 bp, Artificial Sequence
  Synthetic
acactctcttttuactagacaggtggua

SEQ ID NO: 96815 - DNA, 28 bp, Artificial Sequence
  Synthetic
aatggagtagugaacatttagccaacut

SEQ ID NO: 96816 - DNA, 24 bp, Artificial Sequence
  Synthetic
gcaaatagttcugccagcagtaug

SEQ ID NO: 96817 - DNA, 28 bp, Artificial Sequence
  Synthetic
ctgcacagaaaaggaauaaacacttugt

SEQ ID NO: 96818 - DNA, 21 bp, Artificial Sequence
  Synthetic
ggtctcugcggccctaattuc

SEQ ID NO: 96819 - DNA, 25 bp, Artificial Sequence
  Synthetic
ggtgtgguaagaaactgggtctuaa

SEQ ID NO: 96820 - DNA, 19 bp, Artificial Sequence
  Synthetic
gcagcagaaggutgccuac

SEQ ID NO: 96821 - DNA, 18 bp, Artificial Sequence
  Synthetic
gcacccacuccugacact

SEQ ID NO: 96822 - DNA, 21 bp, Artificial Sequence
  Synthetic
ccucagagctgatugccaaga

SEQ ID NO: 96823 - DNA, 25 bp, Artificial Sequence
  Synthetic
gatttgagcaugcccatuaggaaac

SEQ ID NO: 96824 - DNA, 25 bp, Artificial Sequence
  Synthetic
ccatcaatgcagautcttcgagtuc

SEQ ID NO: 96825 - DNA, 29 bp, Artificial Sequence
  Synthetic
actgaagccaaagucaatcaaaaugaaaa

SEQ ID NO: 96826 - DNA, 25 bp, Artificial Sequence
  Synthetic
ttcacatccaaugacaaggcctuat

SEQ ID NO: 96827 - DNA, 24 bp, Artificial Sequence
  Synthetic
gggagagaaaguggagatgctuac

SEQ ID NO: 96828 - DNA, 27 bp, Artificial Sequence
  Synthetic
tccatgctatttuggtcttgaatgcua

SEQ ID NO: 96829 - DNA, 23 bp, Artificial Sequence
  Synthetic
acgcuggcaaaatgtttuggaaa

SEQ ID NO: 96830 - DNA, 26 bp, Artificial Sequence
  Synthetic
caacaauaaacacaaccctgcauaca

SEQ ID NO: 96831 - DNA, 26 bp, Artificial Sequence
  Synthetic
cgggctagttgugttagtggatttut

SEQ ID NO: 96832 - DNA, 23 bp, Artificial Sequence
  Synthetic
ctgctgctucctttgttctgtut

SEQ ID NO: 96833 - DNA, 25 bp, Artificial Sequence
  Synthetic
gatgtatuagcccatcaguccacag

SEQ ID NO: 96834 - DNA, 24 bp, Artificial Sequence
  Synthetic
ttcctgcttuattaacggctucca

SEQ ID NO: 96835 - DNA, 28 bp, Artificial Sequence
  Synthetic
ttugaggatgtttcauaaccagaaagga

SEQ ID NO: 96836 - DNA, 24 bp, Artificial Sequence
  Synthetic
tctgatatuggacccttcccucat

SEQ ID NO: 96837 - DNA, 20 bp, Artificial Sequence
  Synthetic
ccaccucccaactctgucac

SEQ ID NO: 96838 - DNA, 28 bp, Artificial Sequence
  Synthetic
acaagaattctgcugctgcaataagaua

SEQ ID NO: 96839 - DNA, 20 bp, Artificial Sequence
  Synthetic
ccacaggcacaaucacgaug

SEQ ID NO: 96840 - DNA, 28 bp, Artificial Sequence
  Synthetic
tgtcatcttttcuttaagcctccaauct

SEQ ID NO: 96841 - DNA, 26 bp, Artificial Sequence
  Synthetic
gccattcaacaugaaaatgtcgaugt

SEQ ID NO: 96842 - DNA, 27 bp, Artificial Sequence
  Synthetic
ttcaagcttguaagagcatgaauacga

SEQ ID NO: 96843 - DNA, 28 bp, Artificial Sequence
  Synthetic
ggcctttggaaauggttgttaaaauagt

SEQ ID NO: 96844 - DNA, 29 bp, Artificial Sequence
  Synthetic
caaaataggcaauctcctttcuaagcaaa

SEQ ID NO: 96845 - DNA, 22 bp, Artificial Sequence
  Synthetic
tcacaaggucctgttggtaugg

SEQ ID NO: 96846 - DNA, 24 bp, Artificial Sequence
  Synthetic
ctcctgagtaguaagggaggcaua

SEQ ID NO: 96847 - DNA, 28 bp, Artificial Sequence
  Synthetic
gaggagcuaaaaaccaaagtagaacugt

SEQ ID NO: 96848 - DNA, 25 bp, Artificial Sequence
  Synthetic
agctgctgatuaattgtctccgtut

SEQ ID NO: 96849 - DNA, 20 bp, Artificial Sequence
  Synthetic
gutacuggaccgagcccaag

SEQ ID NO: 96850 - DNA, 24 bp, Artificial Sequence
  Synthetic
ggagcttttcugagaggttcucaa

SEQ ID NO: 96851 - DNA, 24 bp, Artificial Sequence
  Synthetic
cacugcaagccaaaaugaaagact

SEQ ID NO: 96852 - DNA, 22 bp, Artificial Sequence
  Synthetic
ccttcaaccugctcttctcugg

SEQ ID NO: 96853 - DNA, 27 bp, Artificial Sequence
  Synthetic
caatgccaauaaaacctgcaagaugat

SEQ ID NO: 96854 - DNA, 22 bp, Artificial Sequence
  Synthetic
gcutcugaaaaccgagcagaca

SEQ ID NO: 96855 - DNA, 24 bp, Artificial Sequence
  Synthetic
tgttggaacaggauattgcagguc

SEQ ID NO: 96856 - DNA, 25 bp, Artificial Sequence
  Synthetic
gcuctactcagaaauaaggccaagt

SEQ ID NO: 96857 - DNA, 25 bp, Artificial Sequence
  Synthetic
gaaagaaaaaugggaatcgguggaa

SEQ ID NO: 96858 - DNA, 28 bp, Artificial Sequence
  Synthetic
ttcattcatggcauttatactgctcuga

SEQ ID NO: 96859 - DNA, 22 bp, Artificial Sequence
  Synthetic
cacaggttgugcaagcttaugt

SEQ ID NO: 96860 - DNA, 28 bp, Artificial Sequence
  Synthetic
cacatactttccuttcattgagttuggt

SEQ ID NO: 96861 - DNA, 28 bp, Artificial Sequence
  Synthetic
ctgcctttgaagcuaaagaagaaacaua

SEQ ID NO: 96862 - DNA, 24 bp, Artificial Sequence
  Synthetic
ggagaggttucttctgtggcuaac

SEQ ID NO: 96863 - DNA, 24 bp, Artificial Sequence
  Synthetic
gatgatgaacuggatagcauggct

SEQ ID NO: 96864 - DNA, 24 bp, Artificial Sequence
  Synthetic
cccccaaaacuagctcaacattut

SEQ ID NO: 96865 - DNA, 26 bp, Artificial Sequence
  Synthetic
gaaggtcattagucctactgggaaug

SEQ ID NO: 96866 - DNA, 23 bp, Artificial Sequence
  Synthetic
ggcctttcugcatcagactctua

SEQ ID NO: 96867 - DNA, 26 bp, Artificial Sequence
  Synthetic
gcttgggacugatgaccuagaaaaat

SEQ ID NO: 96868 - DNA, 21 bp, Artificial Sequence
  Synthetic
acacagaugggaccauagcct

SEQ ID NO: 96869 - DNA, 28 bp, Artificial Sequence
  Synthetic
gtgacctcatugagttattctgctctut

SEQ ID NO: 96870 - DNA, 21 bp, Artificial Sequence
  Synthetic
tttctgcatcuctccccacug

SEQ ID NO: 96871 - DNA, 26 bp, Artificial Sequence
  Synthetic
actaagucagcaggttgaugaaaagt

SEQ ID NO: 96872 - DNA, 27 bp, Artificial Sequence
  Synthetic
gggtagatttatugtccatgtgcaauc

SEQ ID NO: 96873 - DNA, 26 bp, Artificial Sequence
  Synthetic
ggatttctgtuattttgcagcucagt

SEQ ID NO: 96874 - DNA, 22 bp, Artificial Sequence
  Synthetic
gaaguctgacauagcaccacca

SEQ ID NO: 96875 - DNA, 23 bp, Artificial Sequence
  Synthetic
actcagagccutgaaaacgugaa

SEQ ID NO: 96876 - DNA, 21 bp, Artificial Sequence
  Synthetic
gtgcauccagctcactgugat

SEQ ID NO: 96877 - DNA, 22 bp, Artificial Sequence
  Synthetic
attaggtgtgugagcaggugac

SEQ ID NO: 96878 - DNA, 24 bp, Artificial Sequence
  Synthetic
gcctggacaugacagatacttuga

SEQ ID NO: 96879 - DNA, 24 bp, Artificial Sequence
  Synthetic
gagttctctguggctgccaataua

SEQ ID NO: 96880 - DNA, 24 bp, Artificial Sequence
  Synthetic
gcataugaaccaaagacgcatuct

SEQ ID NO: 96881 - DNA, 22 bp, Artificial Sequence
  Synthetic
cctcttgugaaaacccaggugt

SEQ ID NO: 96882 - DNA, 28 bp, Artificial Sequence
  Synthetic
aaatccgaatguattgttctgagaucca

SEQ ID NO: 96883 - DNA, 24 bp, Artificial Sequence
  Synthetic
gaucctttguaccaaaccccagat

SEQ ID NO: 96884 - DNA, 21 bp, Artificial Sequence
  Synthetic
gggtgucccagcaaagtucat

SEQ ID NO: 96885 - DNA, 18 bp, Artificial Sequence
  Synthetic
ggugaccaccucgaccac

SEQ ID NO: 96886 - DNA, 23 bp, Artificial Sequence
  Synthetic
ggaugtaggatcaugagcaggag

SEQ ID NO: 96887 - DNA, 20 bp, Artificial Sequence
  Synthetic
ccccgttcugtcccgaguat

SEQ ID NO: 96888 - DNA, 22 bp, Artificial Sequence
  Synthetic
tgccttugaacctcacaaucgt

SEQ ID NO: 96889 - DNA, 21 bp, Artificial Sequence
  Synthetic
ggacaaacgagaccgugctua

SEQ ID NO: 96890 - DNA, 26 bp, Artificial Sequence
  Synthetic
ggtggtgccaauatgtagacaucaat

SEQ ID NO: 96891 - DNA, 28 bp, Artificial Sequence
  Synthetic
cagcatgggatuctctaaataaagctug

SEQ ID NO: 96892 - DNA, 24 bp, Artificial Sequence
  Synthetic
caagtttgtcaauccggtcttucc

SEQ ID NO: 96893 - DNA, 27 bp, Artificial Sequence
  Synthetic
actggcttactuatcagaatggcttut

SEQ ID NO: 96894 - DNA, 27 bp, Artificial Sequence
  Synthetic
aagggaaccuagttgatactaugaaga

SEQ ID NO: 96895 - DNA, 21 bp, Artificial Sequence
  Synthetic
actgggcacuttctagcgtug

SEQ ID NO: 96896 - DNA, 24 bp, Artificial Sequence
  Synthetic
ctttttctttugcagctgtcguga

SEQ ID NO: 96897 - DNA, 21 bp, Artificial Sequence
  Synthetic
actucttcctgcuccgaaacc

SEQ ID NO: 96898 - DNA, 20 bp, Artificial Sequence
  Synthetic
caacacuctcaguggaccga

SEQ ID NO: 96899 - DNA, 28 bp, Artificial Sequence
  Synthetic
ctaagggataaggucagaatgcaacaua

SEQ ID NO: 96900 - DNA, 26 bp, Artificial Sequence
  Synthetic
gccattctgauaagtaagccagtugt

SEQ ID NO: 96901 - DNA, 29 bp, Artificial Sequence
  Synthetic
acaggaggagcuggatatagttatuaacc

SEQ ID NO: 96902 - DNA, 21 bp, Artificial Sequence
  Synthetic
acatgccgcaaugagtucaga

SEQ ID NO: 96903 - DNA, 28 bp, Artificial Sequence
  Synthetic
gtggttttgctuaaaattctaaggcugt

SEQ ID NO: 96904 - DNA, 21 bp, Artificial Sequence
  Synthetic
tctttcagcggcutccttcuc

SEQ ID NO: 96905 - DNA, 24 bp, Artificial Sequence
  Synthetic
gtagaggaagaacutccgaagguc

SEQ ID NO: 96906 - DNA, 28 bp, Artificial Sequence
  Synthetic
gagttggaacuaccacattgctttatug

SEQ ID NO: 96907 - DNA, 22 bp, Artificial Sequence
  Synthetic
atggtgtcuttgctttccuggt

SEQ ID NO: 96908 - DNA, 22 bp, Artificial Sequence
  Synthetic
attcattttcugcagccuccct

SEQ ID NO: 96909 - DNA, 27 bp, Artificial Sequence
  Synthetic
acagtgctugagaatagcaaactuaca

SEQ ID NO: 96910 - DNA, 28 bp, Artificial Sequence
  Synthetic
gcgattatugtgctttattuggaagact

SEQ ID NO: 96911 - DNA, 20 bp, Artificial Sequence
  Synthetic
gggcuccccaatgactucac

SEQ ID NO: 96912 - DNA, 29 bp, Artificial Sequence
  Synthetic
accattctttccaacucacttatcttucc

SEQ ID NO: 96913 - DNA, 23 bp, Artificial Sequence
  Synthetic
acagaacaggcutgacacttuca

SEQ ID NO: 96914 - DNA, 24 bp, Artificial Sequence
  Synthetic
aaacttgttgcugttgtcttuccc

SEQ ID NO: 96915 - DNA, 28 bp, Artificial Sequence
  Synthetic
gtttctttatctugcataagtccaugct

SEQ ID NO: 96916 - DNA, 22 bp, Artificial Sequence
  Synthetic
ggagacacagugctacucaagt

SEQ ID NO: 96917 - DNA, 21 bp, Artificial Sequence
  Synthetic
aaattccaatgucccccggut

SEQ ID NO: 96918 - DNA, 21 bp, Artificial Sequence
  Synthetic
cctctggagcautgcagauca

SEQ ID NO: 96919 - DNA, 24 bp, Artificial Sequence
  Synthetic
aggcaacaaagagcautgcaauac

SEQ ID NO: 96920 - DNA, 22 bp, Artificial Sequence
  Synthetic
tgtcaugttcttgcuggagacc

SEQ ID NO: 96921 - DNA, 27 bp, Artificial Sequence
  Synthetic
agguagcagagaaacagtugaaagaaa

SEQ ID NO: 96922 - DNA, 21 bp, Artificial Sequence
  Synthetic
ggacugagtttccugggcaat

SEQ ID NO: 96923 - DNA, 20 bp, Artificial Sequence
  Synthetic
tcaccaccugctgctgaaug

SEQ ID NO: 96924 - DNA, 27 bp, Artificial Sequence
  Synthetic
ttcttgctuccaattcaattttcugct

SEQ ID NO: 96925 - DNA, 28 bp, Artificial Sequence
  Synthetic
agaaagagagacaaugaggaagaacuct

SEQ ID NO: 96926 - DNA, 21 bp, Artificial Sequence
  Synthetic
ccagguggtucagcagaaact

SEQ ID NO: 96927 - DNA, 21 bp, Artificial Sequence
  Synthetic
ggtgtcuttagccugacagca

SEQ ID NO: 96928 - DNA, 27 bp, Artificial Sequence
  Synthetic
gtctttttccatcugctttatcagcut

SEQ ID NO: 96929 - DNA, 24 bp, Artificial Sequence
  Synthetic
caatcagtuggaggaaaacaccut

SEQ ID NO: 96930 - DNA, 21 bp, Artificial Sequence
  Synthetic
gcccaagutacagaugagggt

SEQ ID NO: 96931 - DNA, 21 bp, Artificial Sequence
  Synthetic
tgctgaauctcttgcgugaca

SEQ ID NO: 96932 - DNA, 24 bp, Artificial Sequence
  Synthetic
tgatcttccagugttcgtctggua

SEQ ID NO: 96933 - DNA, 24 bp, Artificial Sequence
  Synthetic
agggaactugaaaccattgugaga

SEQ ID NO: 96934 - DNA, 25 bp, Artificial Sequence
  Synthetic
gagcttgttguagctgaactttcug

SEQ ID NO: 96935 - DNA, 24 bp, Artificial Sequence
  Synthetic
cctggcgaaaagucaaaattuggt

SEQ ID NO: 96936 - DNA, 27 bp, Artificial Sequence
  Synthetic
acattggtcucagtaagtcaaatugct

SEQ ID NO: 96937 - DNA, 28 bp, Artificial Sequence
  Synthetic
tgtggaaaaagaacutatggtcagtgut

SEQ ID NO: 96938 - DNA, 28 bp, Artificial Sequence
  Synthetic
tgaaacgcaauacaaaagcatgacuaac

SEQ ID NO: 96939 - DNA, 20 bp, Artificial Sequence
  Synthetic
actgugggaggtuccaggat

SEQ ID NO: 96940 - DNA, 24 bp, Artificial Sequence
  Synthetic
gctgcctttgugtgtttagcauat

SEQ ID NO: 96941 - DNA, 27 bp, Artificial Sequence
  Synthetic
acaacaaaaacuggaagaatccuccaa

SEQ ID NO: 96942 - DNA, 28 bp, Artificial Sequence
  Synthetic
ggaactgggtuagattattggaggatuc

SEQ ID NO: 96943 - DNA, 31 bp, Artificial Sequence
  Synthetic
atcataccatacagucctcatagacataguc

SEQ ID NO: 96944 - DNA, 22 bp, Artificial Sequence
  Synthetic
tcatggccuctcctcttgttuc

SEQ ID NO: 96945 - DNA, 22 bp, Artificial Sequence
  Synthetic
gactucaccaccccaagtaucc

SEQ ID NO: 96946 - DNA, 28 bp, Artificial Sequence
  Synthetic
gttggtcacacutttgcttaaatucact

SEQ ID NO: 96947 - DNA, 23 bp, Artificial Sequence
  Synthetic
gcactgaaaautcaggcagaugg

SEQ ID NO: 96948 - DNA, 20 bp, Artificial Sequence
  Synthetic
ctcctcagugtccaccaucc

SEQ ID NO: 96949 - DNA, 28 bp, Artificial Sequence
  Synthetic
gtgctcagautgcattattttgugaaac

SEQ ID NO: 96950 - DNA, 24 bp, Artificial Sequence
  Synthetic
gagcaaaggaaagcaauagugcaa

SEQ ID NO: 96951 - DNA, 22 bp, Artificial Sequence
  Synthetic
cctggcttcutcttagcaggug

SEQ ID NO: 96952 - DNA, 24 bp, Artificial Sequence
  Synthetic
gtgctgcguagctgatcttuaaaa

SEQ ID NO: 96953 - DNA, 29 bp, Artificial Sequence
  Synthetic
agcttacuaggcagaataaugaaaccaaa

SEQ ID NO: 96954 - DNA, 22 bp, Artificial Sequence
  Synthetic
cccuagggaggaagcaactuac

SEQ ID NO: 96955 - DNA, 22 bp, Artificial Sequence
  Synthetic
ccaaagcaaggutcccattguc

SEQ ID NO: 96956 - DNA, 27 bp, Artificial Sequence
  Synthetic
tcggatctacacacuctatgttctgut

SEQ ID NO: 96957 - DNA, 29 bp, Artificial Sequence
  Synthetic
ctcttttcttaatauagcccacagctgua

SEQ ID NO: 96958 - DNA, 27 bp, Artificial Sequence
  Synthetic
attctgcctgaautctctgcatcatua

SEQ ID NO: 96959 - DNA, 24 bp, Artificial Sequence
  Synthetic
ccaaaggcucaatgaagaatugga

SEQ ID NO: 96960 - DNA, 26 bp, Artificial Sequence
  Synthetic
agcatctcugcacactcattacttut

SEQ ID NO: 96961 - DNA, 28 bp, Artificial Sequence
  Synthetic
acaaatcugccagagaaaatcagaucat

SEQ ID NO: 96962 - DNA, 28 bp, Artificial Sequence
  Synthetic
gatgtctgggauaataacagaagtucgt

SEQ ID NO: 96963 - DNA, 28 bp, Artificial Sequence
  Synthetic
gcctgatggagcuacttatgtattucaa

SEQ ID NO: 96964 - DNA, 29 bp, Artificial Sequence
  Synthetic
gctcatggctttuctcaaattgttcttut

SEQ ID NO: 96965 - DNA, 27 bp, Artificial Sequence
  Synthetic
acaaagagaaguagacagaaucacaag

SEQ ID NO: 96966 - DNA, 28 bp, Artificial Sequence
  Synthetic
ccaaattgtccauaatctttgcctugaa

SEQ ID NO: 96967 - DNA, 25 bp, Artificial Sequence
  Synthetic
ctgggaaaauatagctauggccagt

SEQ ID NO: 96968 - DNA, 28 bp, Artificial Sequence
  Synthetic
tcattatgacugagtagattgcgugaag

SEQ ID NO: 96969 - DNA, 25 bp, Artificial Sequence
  Synthetic
tcttcugaaagggattcaugccaag

SEQ ID NO: 96970 - DNA, 25 bp, Artificial Sequence
  Synthetic
gctgtctcacugtctatactucagg

SEQ ID NO: 96971 - DNA, 28 bp, Artificial Sequence
  Synthetic
cactgaacttagaugacactggaaugaa

SEQ ID NO: 96972 - DNA, 20 bp, Artificial Sequence
  Synthetic
ccttctcagccuggcttcug

SEQ ID NO: 96973 - DNA, 17 bp, Artificial Sequence
  Synthetic
tgggcaaccugcugcat

SEQ ID NO: 96974 - DNA, 20 bp, Artificial Sequence
  Synthetic
tggaaguccacaugcagcag

SEQ ID NO: 96975 - DNA, 23 bp, Artificial Sequence
  Synthetic
atttggtagugaggcaggtaugg

SEQ ID NO: 96976 - DNA, 17 bp, Artificial Sequence
  Synthetic
tggtggguagcgugcag

SEQ ID NO: 96977 - DNA, 22 bp, Artificial Sequence
  Synthetic
ccatttggtagugaggcaggua

SEQ ID NO: 96978 - DNA, 24 bp, Artificial Sequence
  Synthetic
acatagattuccagagccaugcaa

SEQ ID NO: 96979 - DNA, 28 bp, Artificial Sequence
  Synthetic
agtgaatctcugaaacagcuacaagaat

SEQ ID NO: 96980 - DNA, 27 bp, Artificial Sequence
  Synthetic
ctacctttacatcucctgaggtttgug

SEQ ID NO: 96981 - DNA, 25 bp, Artificial Sequence
  Synthetic
cttgaggacgacutgcattagtcut

SEQ ID NO: 96982 - DNA, 32 bp, Artificial Sequence
  Synthetic
tcgatataaagugttagttctaugaggacaga

SEQ ID NO: 96983 - DNA, 24 bp, Artificial Sequence
  Synthetic
ggactatcctcugccttcctguat

SEQ ID NO: 96984 - DNA, 23 bp, Artificial Sequence
  Synthetic
ccuaccaauacaggaaggcagag

SEQ ID NO: 96985 - DNA, 21 bp, Artificial Sequence
  Synthetic
ccacuttgctgguagcaccat

SEQ ID NO: 96986 - DNA, 28 bp, Artificial Sequence
  Synthetic
gcctaatacagccugtgataaaaguaca

SEQ ID NO: 96987 - DNA, 23 bp, Artificial Sequence
  Synthetic
gatgggaaaaaguggtucaacgg

SEQ ID NO: 96988 - DNA, 22 bp, Artificial Sequence
  Synthetic
agacagggauccccatgcttua

SEQ ID NO: 96989 - DNA, 24 bp, Artificial Sequence
  Synthetic
gaagatagccaggaaucccaaguc

SEQ ID NO: 96990 - DNA, 24 bp, Artificial Sequence
  Synthetic
gtgtagccuggattgcatccauaa

SEQ ID NO: 96991 - DNA, 24 bp, Artificial Sequence
  Synthetic
tttgtcccaggutttgaactcuca

SEQ ID NO: 96992 - DNA, 22 bp, Artificial Sequence
  Synthetic
ggaaugccaggatctucacagt

SEQ ID NO: 96993 - DNA, 29 bp, Artificial Sequence
  Synthetic
atggtaagggcaauatgactaagaauaag

SEQ ID NO: 96994 - DNA, 28 bp, Artificial Sequence
  Synthetic
ccagttgtgtuatatctgagccugaaaa

SEQ ID NO: 96995 - DNA, 28 bp, Artificial Sequence
  Synthetic
aatgaattacaugggtctttggtctuct

SEQ ID NO: 96996 - DNA, 27 bp, Artificial Sequence
  Synthetic
atccaaagatcutcctctctcuaccaa

SEQ ID NO: 96997 - DNA, 28 bp, Artificial Sequence
  Synthetic
aatgaagtaaautctcatcgugagcaga

SEQ ID NO: 96998 - DNA, 26 bp, Artificial Sequence
  Synthetic
ggttccagtttugtccagctctatua

SEQ ID NO: 96999 - DNA, 27 bp, Artificial Sequence
  Synthetic
caggtttaugacaccagaagcatttut

SEQ ID NO: 97000 - DNA, 26 bp, Artificial Sequence
  Synthetic
tgccatgcattuaactcattgtgaug

SEQ ID NO: 97001 - DNA, 20 bp, Artificial Sequence
  Synthetic
agagatcugggaccgaggug

SEQ ID NO: 97002 - DNA, 29 bp, Artificial Sequence
  Synthetic
cccagttgattatuatcctttgcttgaug

SEQ ID NO: 97003 - DNA, 20 bp, Artificial Sequence
  Synthetic
cgcaccucagacgtctttug

SEQ ID NO: 97004 - DNA, 28 bp, Artificial Sequence
  Synthetic
agccctatgcutattctcaagtttucaa

SEQ ID NO: 97005 - DNA, 28 bp, Artificial Sequence
  Synthetic
tgtcaaagaaautcaaggaaauggagga

SEQ ID NO: 97006 - DNA, 24 bp, Artificial Sequence
  Synthetic
ggaccaaagccutatcacttggua

SEQ ID NO: 97007 - DNA, 26 bp, Artificial Sequence
  Synthetic
gaatgccauttgaagatcuagcaaca

SEQ ID NO: 97008 - DNA, 27 bp, Artificial Sequence
  Synthetic
agaaatuggaagcctttcaguaagact

SEQ ID NO: 97009 - DNA, 22 bp, Artificial Sequence
  Synthetic
atgtggactucttgctggacuc

SEQ ID NO: 97010 - DNA, 23 bp, Artificial Sequence
  Synthetic
gcagacaacuctgtcccuaagaa

SEQ ID NO: 97011 - DNA, 28 bp, Artificial Sequence
  Synthetic
tccaggagagguttaaaacaatgtgtua

SEQ ID NO: 97012 - DNA, 22 bp, Artificial Sequence
  Synthetic
gataagtgttugctcgctgugg

SEQ ID NO: 97013 - DNA, 28 bp, Artificial Sequence
  Synthetic
atctcctaccccutttctcttttgatug

SEQ ID NO: 97014 - DNA, 24 bp, Artificial Sequence
  Synthetic
cagaacgtcugtaattcccaucct

SEQ ID NO: 97015 - DNA, 20 bp, Artificial Sequence
  Synthetic
caagcgtggugagcctttut

SEQ ID NO: 97016 - DNA, 23 bp, Artificial Sequence
  Synthetic
gcttgcugtctgagaaugaggat

SEQ ID NO: 97017 - DNA, 21 bp, Artificial Sequence
  Synthetic
gcctgagaagcuggaaatgug

SEQ ID NO: 97018 - DNA, 22 bp, Artificial Sequence
  Synthetic
cccuggaaaaaccaucacacct

SEQ ID NO: 97019 - DNA, 21 bp, Artificial Sequence
  Synthetic
gccctggauctgtggaactug

SEQ ID NO: 97020 - DNA, 19 bp, Artificial Sequence
  Synthetic
agacgacgacgaccucuca

SEQ ID NO: 97021 - DNA, 19 bp, Artificial Sequence
  Synthetic
agacgcacacgutcauggt

SEQ ID NO: 97022 - DNA, 29 bp, Artificial Sequence
  Synthetic
ggaactgatucaaacaattcgauaaccaa

SEQ ID NO: 97023 - DNA, 25 bp, Artificial Sequence
  Synthetic
gcctccatcgaaugtcttcctaaug

SEQ ID NO: 97024 - DNA, 27 bp, Artificial Sequence
  Synthetic
ggtctttcatttcuccaactccaagua

SEQ ID NO: 97025 - DNA, 23 bp, Artificial Sequence
  Synthetic
ggaacatggaagauggcgaatug

SEQ ID NO: 97026 - DNA, 30 bp, Artificial Sequence
  Synthetic
atgataaacattccuatggtttccaugaca

SEQ ID NO: 97027 - DNA, 28 bp, Artificial Sequence
  Synthetic
tggtattctatgacugcaatcctggaua

SEQ ID NO: 97028 - DNA, 28 bp, Artificial Sequence
  Synthetic
gttttgtattcauaatgggagccatuca

SEQ ID NO: 97029 - DNA, 27 bp, Artificial Sequence
  Synthetic
ggtcaguggagatgtaaagaauggaat

SEQ ID NO: 97030 - DNA, 26 bp, Artificial Sequence
  Synthetic
acattctgguaaaggtttgtcccaut

SEQ ID NO: 97031 - DNA, 27 bp, Artificial Sequence
  Synthetic
aacatggaaatttuacttacggcacug

SEQ ID NO: 97032 - DNA, 25 bp, Artificial Sequence
  Synthetic
ccaggatugcagtcatagaauacca

SEQ ID NO: 97033 - DNA, 29 bp, Artificial Sequence
  Synthetic
tttgtcatttgttuagtggtcaactgtuc

SEQ ID NO: 97034 - DNA, 24 bp, Artificial Sequence
  Synthetic
ggaattccaggaucagaacagtug

SEQ ID NO: 97035 - DNA, 32 bp, Artificial Sequence
  Synthetic
attggaatctggtugtttgaataaatttacut

SEQ ID NO: 97036 - DNA, 28 bp, Artificial Sequence
  Synthetic
ttcaaatacacuggctgataacaacuct

SEQ ID NO: 97037 - DNA, 22 bp, Artificial Sequence
  Synthetic
gatccgcuacagctgtguaact

SEQ ID NO: 97038 - DNA, 21 bp, Artificial Sequence
  Synthetic
gggtggccaucaaggatguat

SEQ ID NO: 97039 - DNA, 24 bp, Artificial Sequence
  Synthetic
aattgcagaguagctcttguggaa

SEQ ID NO: 97040 - DNA, 21 bp, Artificial Sequence
  Synthetic
cuttggguggaacaccaggat

SEQ ID NO: 97041 - DNA, 27 bp, Artificial Sequence
  Synthetic
cctttcagugactcttcuccaaagaaa

SEQ ID NO: 97042 - DNA, 24 bp, Artificial Sequence
  Synthetic
tgacauagcaatagugcaccacat

SEQ ID NO: 97043 - DNA, 29 bp, Artificial Sequence
  Synthetic
gaagauaaggctttgatugaacagaaact

SEQ ID NO: 97044 - DNA, 24 bp, Artificial Sequence
  Synthetic
acccttggutaccatcauacacct

SEQ ID NO: 97045 - DNA, 28 bp, Artificial Sequence
  Synthetic
gatatcctgacagutacccaaatctuca

SEQ ID NO: 97046 - DNA, 28 bp, Artificial Sequence
  Synthetic
agctgttcacacuttatcttagctucat

SEQ ID NO: 97047 - DNA, 20 bp, Artificial Sequence
  Synthetic
caaggaagugcacaggcaut

SEQ ID NO: 97048 - DNA, 25 bp, Artificial Sequence
  Synthetic
tctgtgttuttcactactucagcca

SEQ ID NO: 97049 - DNA, 27 bp, Artificial Sequence
  Synthetic
actctctctgtacucactctgtcttut

SEQ ID NO: 97050 - DNA, 23 bp, Artificial Sequence
  Synthetic
ctgaaatgcuccatgcacacaut

SEQ ID NO: 97051 - DNA, 27 bp, Artificial Sequence
  Synthetic
tgaggctcuaaaagactggcattatut

SEQ ID NO: 97052 - DNA, 21 bp, Artificial Sequence
  Synthetic
ggatgaugaggcgctctugat

SEQ ID NO: 97053 - DNA, 28 bp, Artificial Sequence
  Synthetic
gaggtaatggaagutcaagaacatcuct

SEQ ID NO: 97054 - DNA, 25 bp, Artificial Sequence
  Synthetic
tgacagtccuggtaggataatgugt

SEQ ID NO: 97055 - DNA, 25 bp, Artificial Sequence
  Synthetic
ggatggaaaaguaatgtggagugga

SEQ ID NO: 97056 - DNA, 27 bp, Artificial Sequence
  Synthetic
acacttaccuccacattttggaaucag

SEQ ID NO: 97057 - DNA, 20 bp, Artificial Sequence
  Synthetic
caatcaaugcacggcggtut

SEQ ID NO: 97058 - DNA, 33 bp, Artificial Sequence
  Synthetic
tgagcacaatcttuccttaaagattatatuaca

SEQ ID NO: 97059 - DNA, 21 bp, Artificial Sequence
  Synthetic
ttgctgcutggagtgaucaca

SEQ ID NO: 97060 - DNA, 25 bp, Artificial Sequence
  Synthetic
tgtaattgtttcugttccctgggut

SEQ ID NO: 97061 - DNA, 23 bp, Artificial Sequence
  Synthetic
gaatgcccugatcctggaauacc

SEQ ID NO: 97062 - DNA, 23 bp, Artificial Sequence
  Synthetic
acuccaagcagcaaaaactucag

SEQ ID NO: 97063 - DNA, 28 bp, Artificial Sequence
  Synthetic
ccagcagaagugaagcctagttattaug

SEQ ID NO: 97064 - DNA, 25 bp, Artificial Sequence
  Synthetic
ccuaattgaaagttguccccaaacc

SEQ ID NO: 97065 - DNA, 26 bp, Artificial Sequence
  Synthetic
agaaggatctcuctctggctaatgut

SEQ ID NO: 97066 - DNA, 31 bp, Artificial Sequence
  Synthetic
tgaacaatatacaaguatgtctgagtucacc

SEQ ID NO: 97067 - DNA, 28 bp, Artificial Sequence
  Synthetic
tccactcaacuatgaaaacaaccaugaa

SEQ ID NO: 97068 - DNA, 28 bp, Artificial Sequence
  Synthetic
gggtgctgattutatcacagatgatuct

SEQ ID NO: 97069 - DNA, 22 bp, Artificial Sequence
  Synthetic
ggcatucaacaccagtgacuga

SEQ ID NO: 97070 - DNA, 27 bp, Artificial Sequence
  Synthetic
tctggctgaaauattgattcccttucc

SEQ ID NO: 97071 - DNA, 28 bp, Artificial Sequence
  Synthetic
gcatctgcaacgaauaatgaaggaatut

SEQ ID NO: 97072 - DNA, 28 bp, Artificial Sequence
  Synthetic
tcatggttgttutcatagttgaguggat

SEQ ID NO: 97073 - DNA, 29 bp, Artificial Sequence
  Synthetic
tgcataacactuccatacatgatatugct

SEQ ID NO: 97074 - DNA, 21 bp, Artificial Sequence
  Synthetic
gtcccacggaaauctgtcuct

SEQ ID NO: 97075 - DNA, 18 bp, Artificial Sequence
  Synthetic
ccggtggucgtgcucaat

SEQ ID NO: 97076 - DNA, 19 bp, Artificial Sequence
  Synthetic
auctgggtgaugggcacag

SEQ ID NO: 97077 - DNA, 19 bp, Artificial Sequence
  Synthetic
tgacccuccctctgcagut

SEQ ID NO: 97078 - DNA, 20 bp, Artificial Sequence
  Synthetic
gggttggutaggcactucag

SEQ ID NO: 97079 - DNA, 26 bp, Artificial Sequence
  Synthetic
cctggctauccttttccataugacaa

SEQ ID NO: 97080 - DNA, 28 bp, Artificial Sequence
  Synthetic
tgtcacttucactttgtatttcugaggt

SEQ ID NO: 97081 - DNA, 20 bp, Artificial Sequence
  Synthetic
ccaccccugcaaaggcaaua

SEQ ID NO: 97082 - DNA, 28 bp, Artificial Sequence
  Synthetic
actgttgtttacuttctgaatctcuggt

SEQ ID NO: 97083 - DNA, 28 bp, Artificial Sequence
  Synthetic
ccctcacaaaucagggtctacaattaut

SEQ ID NO: 97084 - DNA, 20 bp, Artificial Sequence
  Synthetic
tccacaugcaacgcaggtua

SEQ ID NO: 97085 - DNA, 28 bp, Artificial Sequence
  Synthetic
tgaaaagattggcautaaattgtggcut

SEQ ID NO: 97086 - DNA, 27 bp, Artificial Sequence
  Synthetic
catacctctacaagutggcattacucc

SEQ ID NO: 97087 - DNA, 27 bp, Artificial Sequence
  Synthetic
tggagatgautatgtggtuggacaaaa

SEQ ID NO: 97088 - DNA, 20 bp, Artificial Sequence
  Synthetic
cccgaaggugttggcugaaa

SEQ ID NO: 97089 - DNA, 23 bp, Artificial Sequence
  Synthetic
aagagccactuaccggttactug

SEQ ID NO: 97090 - DNA, 22 bp, Artificial Sequence
  Synthetic
tcttcggagcutccttgtucag

SEQ ID NO: 97091 - DNA, 21 bp, Artificial Sequence
  Synthetic
caagcgccaaauctcttgcua

SEQ ID NO: 97092 - DNA, 22 bp, Artificial Sequence
  Synthetic
tggcuggcacatguaagaaaca

SEQ ID NO: 97093 - DNA, 28 bp, Artificial Sequence
  Synthetic
ccatctgctcutctaatccaatacugac

SEQ ID NO: 97094 - DNA, 23 bp, Artificial Sequence
  Synthetic
gcatucaaagcacagcaatugac

SEQ ID NO: 97095 - DNA, 22 bp, Artificial Sequence
  Synthetic
ggtgatugaagctgaaccugga

SEQ ID NO: 97096 - DNA, 24 bp, Artificial Sequence
  Synthetic
tgatagagtguccaggttcagcut

SEQ ID NO: 97097 - DNA, 26 bp, Artificial Sequence
  Synthetic
atttaattttucagccccatgtggug

SEQ ID NO: 97098 - DNA, 21 bp, Artificial Sequence
  Synthetic
ggccatccuggtgagagaauc

SEQ ID NO: 97099 - DNA, 32 bp, Artificial Sequence
  Synthetic
aactatttaataaggauatgcagagacttgut

SEQ ID NO: 97100 - DNA, 27 bp, Artificial Sequence
  Synthetic
gaaaaagatucctgcaagtuagccaaa

SEQ ID NO: 97101 - DNA, 22 bp, Artificial Sequence
  Synthetic
atcttacagcuctgccagtgug

SEQ ID NO: 97102 - DNA, 19 bp, Artificial Sequence
  Synthetic
tggtgttcugccgtgcuac

SEQ ID NO: 97103 - DNA, 22 bp, Artificial Sequence
  Synthetic
tcaagggaggaguccaacucat

SEQ ID NO: 97104 - DNA, 23 bp, Artificial Sequence
  Synthetic
gttctccttuatgtgctgcucca

SEQ ID NO: 97105 - DNA, 25 bp, Artificial Sequence
  Synthetic
gccttatttcuccccagtcagtuat

SEQ ID NO: 97106 - DNA, 25 bp, Artificial Sequence
  Synthetic
tctgcagaattutaaactcgccuct

SEQ ID NO: 97107 - DNA, 21 bp, Artificial Sequence
  Synthetic
aggaaaucaccugccagcaaa

SEQ ID NO: 97108 - DNA, 26 bp, Artificial Sequence
  Synthetic
cactatctctutgaggacttguccaa

SEQ ID NO: 97109 - DNA, 25 bp, Artificial Sequence
  Synthetic
ttgacattucagaaatccaguccgt

SEQ ID NO: 97110 - DNA, 22 bp, Artificial Sequence
  Synthetic
gacagttuccacatcugagcac

SEQ ID NO: 97111 - DNA, 24 bp, Artificial Sequence
  Synthetic
tgagctgtcuctaccttcttucct

SEQ ID NO: 97112 - DNA, 22 bp, Artificial Sequence
  Synthetic
gccccagacuaactgcatcauc

SEQ ID NO: 97113 - DNA, 28 bp, Artificial Sequence
  Synthetic
atcacagatacucacctaacctcucaat

SEQ ID NO: 97114 - DNA, 24 bp, Artificial Sequence
  Synthetic
gacagcaagcagcgauattatucc

SEQ ID NO: 97115 - DNA, 25 bp, Artificial Sequence
  Synthetic
gaaaccatcauaccagggaacagut

SEQ ID NO: 97116 - DNA, 25 bp, Artificial Sequence
  Synthetic
ctgaatttctcuggactctcccaut

SEQ ID NO: 97117 - DNA, 19 bp, Artificial Sequence
  Synthetic
tgacucccggugaggagac

SEQ ID NO: 97118 - DNA, 17 bp, Artificial Sequence
  Synthetic
gaagccuccggtggugt

SEQ ID NO: 97119 - DNA, 20 bp, Artificial Sequence
  Synthetic
cctgugaaaccaggcucaag

SEQ ID NO: 97120 - DNA, 22 bp, Artificial Sequence
  Synthetic
gtgcactgutttgtgtgucgat

SEQ ID NO: 97121 - DNA, 27 bp, Artificial Sequence
  Synthetic
cttttgaaaaucccatgtaugacacca

SEQ ID NO: 97122 - DNA, 22 bp, Artificial Sequence
  Synthetic
ccaatuggacggtgaguaaacc

SEQ ID NO: 97123 - DNA, 27 bp, Artificial Sequence
  Synthetic
agccgttguatgaaactctuaaacaga

SEQ ID NO: 97124 - DNA, 27 bp, Artificial Sequence
  Synthetic
tctctttttgugcacatactccttuga

SEQ ID NO: 97125 - DNA, 24 bp, Artificial Sequence
  Synthetic
ttccactttguctatgcgtccuac

SEQ ID NO: 97126 - DNA, 20 bp, Artificial Sequence
  Synthetic
ccctuccactgacttugcgt

SEQ ID NO: 97127 - DNA, 25 bp, Artificial Sequence
  Synthetic
ctgtagtcugctgtttcuggaagaa

SEQ ID NO: 97128 - DNA, 26 bp, Artificial Sequence
  Synthetic
ccagatctagcaaucatttcctcucc

SEQ ID NO: 97129 - DNA, 23 bp, Artificial Sequence
  Synthetic
tctgcagaggutgagaagaucaa

SEQ ID NO: 97130 - DNA, 27 bp, Artificial Sequence
  Synthetic
gcttttccatguctactgacacatuct

SEQ ID NO: 97131 - DNA, 23 bp, Artificial Sequence
  Synthetic
ttgttttgccccuagttccauga

SEQ ID NO: 97132 - DNA, 26 bp, Artificial Sequence
  Synthetic
caggctcucaaggatctgatctauct

SEQ ID NO: 97133 - DNA, 33 bp, Artificial Sequence
  Synthetic
taaagaggctaagauttattcttaattcugaca

SEQ ID NO: 97134 - DNA, 27 bp, Artificial Sequence
  Synthetic
ttcataggcautcatctaaguaacgca

SEQ ID NO: 97135 - DNA, 24 bp, Artificial Sequence
  Synthetic
gttagtcgttugaggcagaacuga

SEQ ID NO: 97136 - DNA, 28 bp, Artificial Sequence
  Synthetic
aactcctgtacuttgtttacattcugct

SEQ ID NO: 97137 - DNA, 28 bp, Artificial Sequence
  Synthetic
acccaccacaacauttaacagtagatut

SEQ ID NO: 97138 - DNA, 22 bp, Artificial Sequence
  Synthetic
agtacccgauaggcuaaggcaa

SEQ ID NO: 97139 - DNA, 25 bp, Artificial Sequence
  Synthetic
aggtgcatgttuctgtttactgcua

SEQ ID NO: 97140 - DNA, 29 bp, Artificial Sequence
  Synthetic
gccaaauatagauaagggaaacagaaggt

SEQ ID NO: 97141 - DNA, 25 bp, Artificial Sequence
  Synthetic
cagattcctgacuggagtgtcttut

SEQ ID NO: 97142 - DNA, 29 bp, Artificial Sequence
  Synthetic
tttgctttuaagggaattcatagguaaga

SEQ ID NO: 97143 - DNA, 22 bp, Artificial Sequence
  Synthetic
ccaggaugaaagtgggaucaca

SEQ ID NO: 97144 - DNA, 28 bp, Artificial Sequence
  Synthetic
caatgtgatcugctccattatttuccag

SEQ ID NO: 97145 - DNA, 25 bp, Artificial Sequence
  Synthetic
tguaagtggtttcucaggaagcaaa

SEQ ID NO: 97146 - DNA, 27 bp, Artificial Sequence
  Synthetic
tgaggagtaacutctccctatgttugt

SEQ ID NO: 97147 - DNA, 24 bp, Artificial Sequence
  Synthetic
gcaaatccatugacaacaggagut

SEQ ID NO: 97148 - DNA, 23 bp, Artificial Sequence
  Synthetic
gatugacccaaaggacctugaca

SEQ ID NO: 97149 - DNA, 28 bp, Artificial Sequence
  Synthetic
atcacagauagtgaaattuggaccagag

SEQ ID NO: 97150 - DNA, 28 bp, Artificial Sequence
  Synthetic
ctgutttatttcatagtugcaggcagaa

SEQ ID NO: 97151 - DNA, 21 bp, Artificial Sequence
  Synthetic
cuaatggcagtuggaccggaa

SEQ ID NO: 97152 - DNA, 24 bp, Artificial Sequence
  Synthetic
tgcttgagatuacctttgcacuct

SEQ ID NO: 97153 - DNA, 27 bp, Artificial Sequence
  Synthetic
gctcuagacaggaaagcaattucagaa

SEQ ID NO: 97154 - DNA, 28 bp, Artificial Sequence
  Synthetic
aggatgtaaccaguatcacaagcauaac

SEQ ID NO: 97155 - DNA, 28 bp, Artificial Sequence
  Synthetic
gaattggttaacutgaactgtacugcat

SEQ ID NO: 97156 - DNA, 23 bp, Artificial Sequence
  Synthetic
gtaaaaucaccaatugcccccaa

SEQ ID NO: 97157 - DNA, 27 bp, Artificial Sequence
  Synthetic
ccttcctcatuacaatcccatatucca

SEQ ID NO: 97158 - DNA, 22 bp, Artificial Sequence
  Synthetic
ctgctcgucccttauccaagac

SEQ ID NO: 97159 - DNA, 29 bp, Artificial Sequence
  Synthetic
tcatttctttcatutcagaccttcaugga

SEQ ID NO: 97160 - DNA, 25 bp, Artificial Sequence
  Synthetic
gctgttttcuggtcatttccuccat

SEQ ID NO: 97161 - DNA, 30 bp, Artificial Sequence
  Synthetic
acatggttctttuatccttctgctttuagt

SEQ ID NO: 97162 - DNA, 26 bp, Artificial Sequence
  Synthetic
tgtcagucaaaaccacttgcuaaact

SEQ ID NO: 97163 - DNA, 28 bp, Artificial Sequence
  Synthetic
ccttatgacaacaauctgaattgtgugt

SEQ ID NO: 97164 - DNA, 23 bp, Artificial Sequence
  Synthetic
tgcattgcuagtacgacactugt

SEQ ID NO: 97165 - DNA, 23 bp, Artificial Sequence
  Synthetic
agatgauggaagacctggaugga

SEQ ID NO: 97166 - DNA, 21 bp, Artificial Sequence
  Synthetic
cctctggcacugtgatctucc

SEQ ID NO: 97167 - DNA, 24 bp, Artificial Sequence
  Synthetic
actccctctcutggactgcttuat

SEQ ID NO: 97168 - DNA, 23 bp, Artificial Sequence
  Synthetic
atgacaactuggcaaggctcuat

SEQ ID NO: 97169 - DNA, 29 bp, Artificial Sequence
  Synthetic
ggcaccagactuggaatggattataaaut

SEQ ID NO: 97170 - DNA, 28 bp, Artificial Sequence
  Synthetic
tgaagaacauaaccagcatcacaguaat

SEQ ID NO: 97171 - DNA, 24 bp, Artificial Sequence
  Synthetic
gtttuacagcaaaacugcgagagt

SEQ ID NO: 97172 - DNA, 25 bp, Artificial Sequence
  Synthetic
tutatccaucaaagaggcacacaca

SEQ ID NO: 97173 - DNA, 27 bp, Artificial Sequence
  Synthetic
atugaaaggagaagcaaacaugagaga

SEQ ID NO: 97174 - DNA, 22 bp, Artificial Sequence
  Synthetic
ccttttgtgguccttgtgcuct

SEQ ID NO: 97175 - DNA, 28 bp, Artificial Sequence
  Synthetic
acttacattggutaaggatttgcugaca

SEQ ID NO: 97176 - DNA, 28 bp, Artificial Sequence
  Synthetic
tcccagtgautggaaatatccuacagat

SEQ ID NO: 97177 - DNA, 28 bp, Artificial Sequence
  Synthetic
atctcttgtaacautgtacctcuaggga

SEQ ID NO: 97178 - DNA, 24 bp, Artificial Sequence
  Synthetic
gttcaccucactactctugcacat

SEQ ID NO: 97179 - DNA, 23 bp, Artificial Sequence
  Synthetic
cgaaaggtguacatggcttcugg

SEQ ID NO: 97180 - DNA, 25 bp, Artificial Sequence
  Synthetic
gaggaaaagtcutcatcctgaguct

SEQ ID NO: 97181 - DNA, 19 bp, Artificial Sequence
  Synthetic
gggtauggctgcttuccga

SEQ ID NO: 97182 - DNA, 24 bp, Artificial Sequence
  Synthetic
actuggagaagagacugaccacat

SEQ ID NO: 97183 - DNA, 20 bp, Artificial Sequence
  Synthetic
cagcatagguggttgtuggg

SEQ ID NO: 97184 - DNA, 22 bp, Artificial Sequence
  Synthetic
gctcactgugggaaaccugaag

SEQ ID NO: 97185 - DNA, 22 bp, Artificial Sequence
  Synthetic
ggcccgtuccttttcatacuca

SEQ ID NO: 97186 - DNA, 20 bp, Artificial Sequence
  Synthetic
tgatgauggccgggatctuc

SEQ ID NO: 97187 - DNA, 21 bp, Artificial Sequence
  Synthetic
aacgatugagcgcctcttcut

SEQ ID NO: 97188 - DNA, 22 bp, Artificial Sequence
  Synthetic
gcagtgagugaaggaccaacua

SEQ ID NO: 97189 - DNA, 23 bp, Artificial Sequence
  Synthetic
actcattgguggagguagcaaag

SEQ ID NO: 97190 - DNA, 28 bp, Artificial Sequence
  Synthetic
caggtguttaagtatttcucaggaagga

SEQ ID NO: 97191 - DNA, 21 bp, Artificial Sequence
  Synthetic
gtgtccucccagatgaugagg

SEQ ID NO: 97192 - DNA, 29 bp, Artificial Sequence
  Synthetic
tgcatgtcaaaugagttattaccaucaca

SEQ ID NO: 97193 - DNA, 28 bp, Artificial Sequence
  Synthetic
tccattggctcuactgtttcatttagut

SEQ ID NO: 97194 - DNA, 27 bp, Artificial Sequence
  Synthetic
tcacacttacgtutgggttacttctut

SEQ ID NO: 97195 - DNA, 26 bp, Artificial Sequence
  Synthetic
gggtcgtcttuctgtgtcgaatttua

SEQ ID NO: 97196 - DNA, 22 bp, Artificial Sequence
  Synthetic
tcaaugagaguccggagagcat

SEQ ID NO: 97197 - DNA, 24 bp, Artificial Sequence
  Synthetic
ggtgtgtgtgugtgtgaactctua

SEQ ID NO: 97198 - DNA, 26 bp, Artificial Sequence
  Synthetic
catgactcaaccugtatcctgaauca

SEQ ID NO: 97199 - DNA, 28 bp, Artificial Sequence
  Synthetic
ccaccaagctuactctttattttctucc

SEQ ID NO: 97200 - DNA, 21 bp, Artificial Sequence
  Synthetic
cactccgcagcuttgctaauc

SEQ ID NO: 97201 - DNA, 28 bp, Artificial Sequence
  Synthetic
tcatgcacttaaauagaggcaccaauaa

SEQ ID NO: 97202 - DNA, 28 bp, Artificial Sequence
  Synthetic
gaacacaaaatggauttattaccggcua

SEQ ID NO: 97203 - DNA, 25 bp, Artificial Sequence
  Synthetic
caagactacaccaugtgaacacuga

SEQ ID NO: 97204 - DNA, 27 bp, Artificial Sequence
  Synthetic
actggtctguttctaggagtuacaagt

SEQ ID NO: 97205 - DNA, 26 bp, Artificial Sequence
  Synthetic
agaagaacutctgcaguacaaaagca

SEQ ID NO: 97206 - DNA, 21 bp, Artificial Sequence
  Synthetic
cgtggaaucgcatggtgtuag

SEQ ID NO: 97207 - DNA, 24 bp, Artificial Sequence
  Synthetic
ccagcatcauccatgggagaauaa

SEQ ID NO: 97208 - DNA, 22 bp, Artificial Sequence
  Synthetic
ccauccaggagctgttugaagt

SEQ ID NO: 97209 - DNA, 28 bp, Artificial Sequence
  Synthetic
aactcttcagccagautcaatgtatuct

SEQ ID NO: 97210 - DNA, 29 bp, Artificial Sequence
  Synthetic
aatggtttacatutcctgtacacucagaa

SEQ ID NO: 97211 - DNA, 21 bp, Artificial Sequence
  Synthetic
ccagccugttcauggagacat

SEQ ID NO: 97212 - DNA, 28 bp, Artificial Sequence
  Synthetic
tcgatcagattcaucaccaaatcaaugt

SEQ ID NO: 97213 - DNA, 24 bp, Artificial Sequence
  Synthetic
tggaggaagcccugttattttcug

SEQ ID NO: 97214 - DNA, 17 bp, Artificial Sequence
  Synthetic
ggcugggcugccagaag

SEQ ID NO: 97215 - DNA, 18 bp, Artificial Sequence
  Synthetic
tctgtugccactgcgugt

SEQ ID NO: 97216 - DNA, 24 bp, Artificial Sequence
  Synthetic
cctgtagggcauctgtgaattguc

SEQ ID NO: 97217 - DNA, 22 bp, Artificial Sequence
  Synthetic
gctctuccccttgaguaccact

SEQ ID NO: 97218 - DNA, 21 bp, Artificial Sequence
  Synthetic
ccccattucgagtcccatuca

SEQ ID NO: 97219 - DNA, 33 bp, Artificial Sequence
  Synthetic
acacagggatataugaaattgattttggtagut

SEQ ID NO: 97220 - DNA, 26 bp, Artificial Sequence
  Synthetic
aagcaaaaccaacaguctgaatucac

SEQ ID NO: 97221 - DNA, 24 bp, Artificial Sequence
  Synthetic
tctgtgatcauacctgtgaccuct

SEQ ID NO: 97222 - DNA, 24 bp, Artificial Sequence
  Synthetic
aaccctgagauatgctctcctuct

SEQ ID NO: 97223 - DNA, 20 bp, Artificial Sequence
  Synthetic
gcugcgggcacagaaattua

SEQ ID NO: 97224 - DNA, 27 bp, Artificial Sequence
  Synthetic
acaagcacautttatagagtuggagca

SEQ ID NO: 97225 - DNA, 21 bp, Artificial Sequence
  Synthetic
ggtgacaucaggctugagcaa

SEQ ID NO: 97226 - DNA, 21 bp, Artificial Sequence
  Synthetic
gaagcugagcagaagtcuggt

SEQ ID NO: 97227 - DNA, 23 bp, Artificial Sequence
  Synthetic
cgggaacgugctgacctaatuat

SEQ ID NO: 97228 - DNA, 26 bp, Artificial Sequence
  Synthetic
cacctctgtttugctgaaagctttua

SEQ ID NO: 97229 - DNA, 28 bp, Artificial Sequence
  Synthetic
tgaggaaauaucaaccaagaaggaacaa

SEQ ID NO: 97230 - DNA, 28 bp, Artificial Sequence
  Synthetic
gctgtatagttugaagtgcttccgauaa

SEQ ID NO: 97231 - DNA, 28 bp, Artificial Sequence
  Synthetic
acttgggtctugactaaagcttgatuaa

SEQ ID NO: 97232 - DNA, 27 bp, Artificial Sequence
  Synthetic
tcatctttgtucaggtaaaagcuccaa

SEQ ID NO: 97233 - DNA, 22 bp, Artificial Sequence
  Synthetic
cuaccgattagugagcgacacc

SEQ ID NO: 97234 - DNA, 21 bp, Artificial Sequence
  Synthetic
cccacuaccaguccacagaca

SEQ ID NO: 97235 - DNA, 29 bp, Artificial Sequence
  Synthetic
ccatggagatttugagacacaaggataut

SEQ ID NO: 97236 - DNA, 23 bp, Artificial Sequence
  Synthetic
atctccuccaccttctgagugat

SEQ ID NO: 97237 - DNA, 21 bp, Artificial Sequence
  Synthetic
gaagtgagcagugctttgcug

SEQ ID NO: 97238 - DNA, 26 bp, Artificial Sequence
  Synthetic
tgcccagatutaacaaggtcaucaat

SEQ ID NO: 97239 - DNA, 28 bp, Artificial Sequence
  Synthetic
gacccctctagugtaacgtgatatttut

SEQ ID NO: 97240 - DNA, 20 bp, Artificial Sequence
  Synthetic
gccctccauggtaccagtuc

SEQ ID NO: 97241 - DNA, 28 bp, Artificial Sequence
  Synthetic
gaaaagtctgtugaagctcttaagtgut

SEQ ID NO: 97242 - DNA, 20 bp, Artificial Sequence
  Synthetic
cctugggaacgaactgugct

SEQ ID NO: 97243 - DNA, 23 bp, Artificial Sequence
  Synthetic
agctgcttcuactccttcucaca

SEQ ID NO: 97244 - DNA, 25 bp, Artificial Sequence
  Synthetic
cccagagcagugttttaaacucagt

SEQ ID NO: 97245 - DNA, 25 bp, Artificial Sequence
  Synthetic
ggcatacaggutggaaggatgatut

SEQ ID NO: 97246 - DNA, 23 bp, Artificial Sequence
  Synthetic
agtaactgaugcatggcagtuct

SEQ ID NO: 97247 - DNA, 20 bp, Artificial Sequence
  Synthetic
gcttctccgggutcctgtug

SEQ ID NO: 97248 - DNA, 25 bp, Artificial Sequence
  Synthetic
tttttaccugcatctcaucaaccca

SEQ ID NO: 97249 - DNA, 26 bp, Artificial Sequence
  Synthetic
gaguagagccaaattcatugcaaact

SEQ ID NO: 97250 - DNA, 28 bp, Artificial Sequence
  Synthetic
ttaccaaccuggaaatagaatugaacga

SEQ ID NO: 97251 - DNA, 22 bp, Artificial Sequence
  Synthetic
gtgatggcaagucagcaatugg

SEQ ID NO: 97252 - DNA, 20 bp, Artificial Sequence
  Synthetic
gcagtuccgccatggtttut

SEQ ID NO: 97253 - DNA, 24 bp, Artificial Sequence
  Synthetic
tcactaggaaugaccacatcucca

SEQ ID NO: 97254 - DNA, 28 bp, Artificial Sequence
  Synthetic
caggttaccatuaacttcatcctctuct

SEQ ID NO: 97255 - DNA, 26 bp, Artificial Sequence
  Synthetic
ccttttggacuggttgtcaaatgtug

SEQ ID NO: 97256 - DNA, 23 bp, Artificial Sequence
  Synthetic
gggtttucggatctgcaucaact

SEQ ID NO: 97257 - DNA, 21 bp, Artificial Sequence
  Synthetic
gcctgacuccatctgtcacuc

SEQ ID NO: 97258 - DNA, 22 bp, Artificial Sequence
  Synthetic
cctgccctutctgagtcttugt

SEQ ID NO: 97259 - DNA, 25 bp, Artificial Sequence
  Synthetic
gaattcctccugtgaactttcccut

SEQ ID NO: 97260 - DNA, 25 bp, Artificial Sequence
  Synthetic
tcctgaugggaaaccaggtgtauaa

SEQ ID NO: 97261 - DNA, 25 bp, Artificial Sequence
  Synthetic
gtttaaacucaggattugcacagac

SEQ ID NO: 97262 - DNA, 25 bp, Artificial Sequence
  Synthetic
ggaagtgccautgaatagaggtuct

SEQ ID NO: 97263 - DNA, 28 bp, Artificial Sequence
  Synthetic
agtgccagauggcttttcaatattttuc

SEQ ID NO: 97264 - DNA, 25 bp, Artificial Sequence
  Synthetic
gatggaaaacagacuagcagagcut

SEQ ID NO: 97265 - DNA, 20 bp, Artificial Sequence
  Synthetic
gagaaacgccggauctccut

SEQ ID NO: 97266 - DNA, 21 bp, Artificial Sequence
  Synthetic
cugggtgttuggaagcagaac

SEQ ID NO: 97267 - DNA, 25 bp, Artificial Sequence
  Synthetic
gcctatcaccacugattgttuccat

SEQ ID NO: 97268 - DNA, 27 bp, Artificial Sequence
  Synthetic
gaatcgutttcagcaauggaaagagat

SEQ ID NO: 97269 - DNA, 22 bp, Artificial Sequence
  Synthetic
gtatgtucacccacccttggut

SEQ ID NO: 97270 - DNA, 24 bp, Artificial Sequence
  Synthetic
cctgaggucagactagggtguaag

SEQ ID NO: 97271 - DNA, 19 bp, Artificial Sequence
  Synthetic
cagggtugcaaaacugcgt

SEQ ID NO: 97272 - DNA, 28 bp, Artificial Sequence
  Synthetic
tttggatccaucatgaagaaauggagat

SEQ ID NO: 97273 - DNA, 21 bp, Artificial Sequence
  Synthetic
gcttcccagutgggtttcuga

SEQ ID NO: 97274 - DNA, 27 bp, Artificial Sequence
  Synthetic
aagaacatcccaautgatgactggaut

SEQ ID NO: 97275 - DNA, 25 bp, Artificial Sequence
  Synthetic
tgaagaggauaggatcagagagugg

SEQ ID NO: 97276 - DNA, 22 bp, Artificial Sequence
  Synthetic
caaagtugccaagaccucacac

SEQ ID NO: 97277 - DNA, 28 bp, Artificial Sequence
  Synthetic
gggaagacattuccataaaaggagugaa

SEQ ID NO: 97278 - DNA, 24 bp, Artificial Sequence
  Synthetic
aagcacgaaautcaaaaggagugg

SEQ ID NO: 97279 - DNA, 24 bp, Artificial Sequence
  Synthetic
tgcagccaugttgctaauagagat

SEQ ID NO: 97280 - DNA, 22 bp, Artificial Sequence
  Synthetic
gccttguggaggagtugagaaa

SEQ ID NO: 97281 - DNA, 28 bp, Artificial Sequence
  Synthetic
acaaccaggacuccaaataaaagatcug

SEQ ID NO: 97282 - DNA, 26 bp, Artificial Sequence
  Synthetic
aacattgtgcuaggtaaactgtguca

SEQ ID NO: 97283 - DNA, 23 bp, Artificial Sequence
  Synthetic
aaagaugcagagaaggcuggaaa

SEQ ID NO: 97284 - DNA, 23 bp, Artificial Sequence
  Synthetic
ccutttgctuagagaagggaggt

SEQ ID NO: 97285 - DNA, 23 bp, Artificial Sequence
  Synthetic
tttcttaccgcucacaactguca

SEQ ID NO: 97286 - DNA, 21 bp, Artificial Sequence
  Synthetic
cctcagatucccacccaguga

SEQ ID NO: 97287 - DNA, 22 bp, Artificial Sequence
  Synthetic
gcatagatcuggctcguacgga

SEQ ID NO: 97288 - DNA, 23 bp, Artificial Sequence
  Synthetic
gcagaguaaaaacaaccgtccuc

SEQ ID NO: 97289 - DNA, 28 bp, Artificial Sequence
  Synthetic
gaacataaaaugagcacucaggaaacat

SEQ ID NO: 97290 - DNA, 23 bp, Artificial Sequence
  Synthetic
ggtctcatttucccatggccaua

SEQ ID NO: 97291 - DNA, 25 bp, Artificial Sequence
  Synthetic
cgactccaucactaccatuaagcac

SEQ ID NO: 97292 - DNA, 25 bp, Artificial Sequence
  Synthetic
tgtgtttcuagactacagggucact

SEQ ID NO: 97293 - DNA, 28 bp, Artificial Sequence
  Synthetic
tgttttgttgaguaggagaatcactucc

SEQ ID NO: 97294 - DNA, 24 bp, Artificial Sequence
  Synthetic
cctgaactcaguggaagtgatuct

SEQ ID NO: 97295 - DNA, 32 bp, Artificial Sequence
  Synthetic
gaacatagattgacautttcaaatgacagugt

SEQ ID NO: 97296 - DNA, 21 bp, Artificial Sequence
  Synthetic
cgcccggaugattgttaucca

SEQ ID NO: 97297 - DNA, 26 bp, Artificial Sequence
  Synthetic
gccaatgccaacagutaattgaaguc

SEQ ID NO: 97298 - DNA, 20 bp, Artificial Sequence
  Synthetic
gcatcaccccutgcacagut

SEQ ID NO: 97299 - DNA, 26 bp, Artificial Sequence
  Synthetic
cccucagacaaaaagaaagtugacat

SEQ ID NO: 97300 - DNA, 30 bp, Artificial Sequence
  Synthetic
gataacaatgatucaccttagtgtctucca

SEQ ID NO: 97301 - DNA, 24 bp, Artificial Sequence
  Synthetic
gtcaagaacagutggatgcttucc

SEQ ID NO: 97302 - DNA, 33 bp, Artificial Sequence
  Synthetic
acagaatgaaacttuaaaatctgatgaagctua

SEQ ID NO: 97303 - DNA, 24 bp, Artificial Sequence
  Synthetic
acatgtaugccaggacctguaaga

SEQ ID NO: 97304 - DNA, 24 bp, Artificial Sequence
  Synthetic
catcttcttacaggucctggcaua

SEQ ID NO: 97305 - DNA, 31 bp, Artificial Sequence
  Synthetic
aaaataaagccatguacttaagcttgtttut

SEQ ID NO: 97306 - DNA, 26 bp, Artificial Sequence
  Synthetic
ttucctaaatcctcugcaccaaaaga

SEQ ID NO: 97307 - DNA, 27 bp, Artificial Sequence
  Synthetic
aagctguaacttcttgucaagaacagt

SEQ ID NO: 97308 - DNA, 28 bp, Artificial Sequence
  Synthetic
gatttaacaagaacutggaaagcaucca

SEQ ID NO: 97309 - DNA, 28 bp, Artificial Sequence
  Synthetic
tggtttcttaacautgtgtgacaugaga

SEQ ID NO: 97310 - DNA, 28 bp, Artificial Sequence
  Synthetic
tgtgtggaaaucaaaatcagcttttuct

SEQ ID NO: 97311 - DNA, 28 bp, Artificial Sequence
  Synthetic
caatagaagaggcuctccaagtagguat

SEQ ID NO: 97312 - DNA, 26 bp, Artificial Sequence
  Synthetic
agttttgtggcaaugaggacatcuat

SEQ ID NO: 97313 - DNA, 27 bp, Artificial Sequence
  Synthetic
tggtggaagcugtgaatgcaaatatua

SEQ ID NO: 97314 - DNA, 26 bp, Artificial Sequence
  Synthetic
agttactgctcauctctagctcctut

SEQ ID NO: 97315 - DNA, 25 bp, Artificial Sequence
  Synthetic
agttcatggaccuaaggactcgaua

SEQ ID NO: 97316 - DNA, 20 bp, Artificial Sequence
  Synthetic
tgagagugaccagggcagua

SEQ ID NO: 97317 - DNA, 28 bp, Artificial Sequence
  Synthetic
gctgtctgaaggccuagttaatgtaaut

SEQ ID NO: 97318 - DNA, 27 bp, Artificial Sequence
  Synthetic
caaacatcggatucccatttccttaut

SEQ ID NO: 97319 - DNA, 20 bp, Artificial Sequence
  Synthetic
gccgaagcuttgcauagagg

SEQ ID NO: 97320 - DNA, 20 bp, Artificial Sequence
  Synthetic
tgggcaaaccccucaucaac

SEQ ID NO: 97321 - DNA, 25 bp, Artificial Sequence
  Synthetic
tctgtacuaaaagcctcccguagaa

SEQ ID NO: 97322 - DNA, 27 bp, Artificial Sequence
  Synthetic
cagggucttcatguaaaaagcaaaaca

SEQ ID NO: 97323 - DNA, 28 bp, Artificial Sequence
  Synthetic
ccaagtgtugaaagccatttagaaaauc

SEQ ID NO: 97324 - DNA, 26 bp, Artificial Sequence
  Synthetic
gaacatatttcccugtgctctctugt

SEQ ID NO: 97325 - DNA, 25 bp, Artificial Sequence
  Synthetic
ccatctttctuccacttgatcacug

SEQ ID NO: 97326 - DNA, 28 bp, Artificial Sequence
  Synthetic
cctcactgautttagcttcttugagact

SEQ ID NO: 97327 - DNA, 20 bp, Artificial Sequence
  Synthetic
gtacaacuggaccgcacuga

SEQ ID NO: 97328 - DNA, 25 bp, Artificial Sequence
  Synthetic
gctttcaacacutggcaaatcugag

SEQ ID NO: 97329 - DNA, 28 bp, Artificial Sequence
  Synthetic
tgttcaggatcutttgaattgggtugat

SEQ ID NO: 97330 - DNA, 26 bp, Artificial Sequence
  Synthetic
gtccagttguaccttcagacaguaaa

SEQ ID NO: 97331 - DNA, 30 bp, Artificial Sequence
  Synthetic
atgaaatttgtucaggatcttttgaatugg

SEQ ID NO: 97332 - DNA, 33 bp, Artificial Sequence
  Synthetic
ttcatcttgccuaacaaaaactagaattatucc

SEQ ID NO: 97333 - DNA, 27 bp, Artificial Sequence
  Synthetic
tcttcagugaggatatgucaacaggat

SEQ ID NO: 97334 - DNA, 21 bp, Artificial Sequence
  Synthetic
gagcugaccagaccaattgug

SEQ ID NO: 97335 - DNA, 21 bp, Artificial Sequence
  Synthetic
tcagcgggucattgtggaaut

SEQ ID NO: 97336 - DNA, 19 bp, Artificial Sequence
  Synthetic
gaguccgaccgaggagtuc

SEQ ID NO: 97337 - DNA, 27 bp, Artificial Sequence
  Synthetic
tggtgtctggaaugaagtatgtttugt

SEQ ID NO: 97338 - DNA, 25 bp, Artificial Sequence
  Synthetic
cttgaccatucacaatcagttcugg

SEQ ID NO: 97339 - DNA, 27 bp, Artificial Sequence
  Synthetic
ctttaaaggtutgctcatgtuccacat

SEQ ID NO: 97340 - DNA, 18 bp, Artificial Sequence
  Synthetic
actccucggtctcucgct

SEQ ID NO: 97341 - DNA, 18 bp, Artificial Sequence
  Synthetic
ccccaacgguctctugga

SEQ ID NO: 97342 - DNA, 25 bp, Artificial Sequence
  Synthetic
aactttcaaaugggtctctgcugat

SEQ ID NO: 97343 - DNA, 23 bp, Artificial Sequence
  Synthetic
ggaagaauccacctacctgcuac

SEQ ID NO: 97344 - DNA, 28 bp, Artificial Sequence
  Synthetic
agtaagtgttcttucttttatgccccut

SEQ ID NO: 97345 - DNA, 22 bp, Artificial Sequence
  Synthetic
gggccauggtagatucacaaca

SEQ ID NO: 97346 - DNA, 22 bp, Artificial Sequence
  Synthetic
tcggcgttucactggagattut

SEQ ID NO: 97347 - DNA, 29 bp, Artificial Sequence
  Synthetic
tgaaactctaguactttgcttcaatucat

SEQ ID NO: 97348 - DNA, 25 bp, Artificial Sequence
  Synthetic
cctggattatuggcaacatctugga

SEQ ID NO: 97349 - DNA, 28 bp, Artificial Sequence
  Synthetic
actggtuaaagaagagtactugaaagca

SEQ ID NO: 97350 - DNA, 24 bp, Artificial Sequence
  Synthetic
gatgcttgcuaataggttggcuct

SEQ ID NO: 97351 - DNA, 20 bp, Artificial Sequence
  Synthetic
cggacaaaucggcuggaaac

SEQ ID NO: 97352 - DNA, 28 bp, Artificial Sequence
  Synthetic
ccacactcatatucagtaaatgtctcut

SEQ ID NO: 97353 - DNA, 26 bp, Artificial Sequence
  Synthetic
gcctttaaacuctactgctctucagg

SEQ ID NO: 97354 - DNA, 26 bp, Artificial Sequence
  Synthetic
ctgaagagcaguagagttuaaaggca

SEQ ID NO: 97355 - DNA, 28 bp, Artificial Sequence
  Synthetic
tgtccaagtcugttaatgaacgaaauga

SEQ ID NO: 97356 - DNA, 23 bp, Artificial Sequence
  Synthetic
tgaaatcctgugaacttggcgut

SEQ ID NO: 97357 - DNA, 22 bp, Artificial Sequence
  Synthetic
ggtctcaagcucaggtgctuac

SEQ ID NO: 97358 - DNA, 26 bp, Artificial Sequence
  Synthetic
gatgccttctagutgcctactaagut

SEQ ID NO: 97359 - DNA, 25 bp, Artificial Sequence
  Synthetic
gctaugaaccaacagtuggaaacag

SEQ ID NO: 97360 - DNA, 21 bp, Artificial Sequence
  Synthetic
acaggtggcugtgtgaatguc

SEQ ID NO: 97361 - DNA, 20 bp, Artificial Sequence
  Synthetic
ggcatgcucgtcccaguaac

SEQ ID NO: 97362 - DNA, 24 bp, Artificial Sequence
  Synthetic
cgggtcaaggutatctggagttut

SEQ ID NO: 97363 - DNA, 28 bp, Artificial Sequence
  Synthetic
ccttcatgtgtutttgaaaagggauagg

SEQ ID NO: 97364 - DNA, 22 bp, Artificial Sequence
  Synthetic
cagagatgtgguccctgtctug

SEQ ID NO: 97365 - DNA, 27 bp, Artificial Sequence
  Synthetic
agctgaatttuattggtagcaucacct

SEQ ID NO: 97366 - DNA, 20 bp, Artificial Sequence
  Synthetic
gccucttcaugcagcaagac

SEQ ID NO: 97367 - DNA, 22 bp, Artificial Sequence
  Synthetic
gctgctgaaguggagattucct

SEQ ID NO: 97368 - DNA, 26 bp, Artificial Sequence
  Synthetic
cctgctgtatcucctgcttcatttut

SEQ ID NO: 97369 - DNA, 24 bp, Artificial Sequence
  Synthetic
tgaccaagccautgtuaaaagcac

SEQ ID NO: 97370 - DNA, 21 bp, Artificial Sequence
  Synthetic
agauaccgcggaaactcaugg

SEQ ID NO: 97371 - DNA, 23 bp, Artificial Sequence
  Synthetic
agcctttctttucaccacgcaua

SEQ ID NO: 97372 - DNA, 24 bp, Artificial Sequence
  Synthetic
cttctcagcaggcuttgatacugt

SEQ ID NO: 97373 - DNA, 24 bp, Artificial Sequence
  Synthetic
aagacccttcuttacgtgggatug

SEQ ID NO: 97374 - DNA, 20 bp, Artificial Sequence
  Synthetic
agctgccagutgctcttuca

SEQ ID NO: 97375 - DNA, 26 bp, Artificial Sequence
  Synthetic
gcgtttgttuacccttgttacctuag

SEQ ID NO: 97376 - DNA, 22 bp, Artificial Sequence
  Synthetic
gggagacagcaugggaaagaut

SEQ ID NO: 97377 - DNA, 28 bp, Artificial Sequence
  Synthetic
cctgttgaacuaattgtgtctttctucc

SEQ ID NO: 97378 - DNA, 28 bp, Artificial Sequence
  Synthetic
gacgagctgucattcttttatttgtuca

SEQ ID NO: 97379 - DNA, 27 bp, Artificial Sequence
  Synthetic
ccaatatgccautgagattcttccugt

SEQ ID NO: 97380 - DNA, 25 bp, Artificial Sequence
  Synthetic
ttaaaacugcaagggagtctucgat

SEQ ID NO: 97381 - DNA, 21 bp, Artificial Sequence
  Synthetic
gtgggcgaaugtgtcttucag

SEQ ID NO: 97382 - DNA, 20 bp, Artificial Sequence
  Synthetic
ggactggcuggccaaactut

SEQ ID NO: 97383 - DNA, 27 bp, Artificial Sequence
  Synthetic
tggcctatagguaagtcctagcaaaua

SEQ ID NO: 97384 - DNA, 28 bp, Artificial Sequence
  Synthetic
ccaacacatautgtccaatttuccaagt

SEQ ID NO: 97385 - DNA, 23 bp, Artificial Sequence
  Synthetic
agtcctgtcuggcgagaagtaua

SEQ ID NO: 97386 - DNA, 27 bp, Artificial Sequence
  Synthetic
tgttacaatttugctgaagctttugga

SEQ ID NO: 97387 - DNA, 23 bp, Artificial Sequence
  Synthetic
gtaccattgacugtcatggcuga

SEQ ID NO: 97388 - DNA, 28 bp, Artificial Sequence
  Synthetic
caggaauagtgaacaguagacccaaaag

SEQ ID NO: 97389 - DNA, 25 bp, Artificial Sequence
  Synthetic
tgctggtauaggttgttcgauagga

SEQ ID NO: 97390 - DNA, 24 bp, Artificial Sequence
  Synthetic
ggaagtcaguacagtttccaggug

SEQ ID NO: 97391 - DNA, 28 bp, Artificial Sequence
  Synthetic
acctttugaagctgagauaacaagaaga

SEQ ID NO: 97392 - DNA, 24 bp, Artificial Sequence
  Synthetic
aaaagccuggtgtcugaaaagaga

SEQ ID NO: 97393 - DNA, 25 bp, Artificial Sequence
  Synthetic
caggcugaacagaccctaaatguag

SEQ ID NO: 97394 - DNA, 23 bp, Artificial Sequence
  Synthetic
ctcacctcacacuagactggcua

SEQ ID NO: 97395 - DNA, 28 bp, Artificial Sequence
  Synthetic
catgaaagugtgttcagaaucacagaac

SEQ ID NO: 97396 - DNA, 28 bp, Artificial Sequence
  Synthetic
cccaacatatttauagctctcaccucct

SEQ ID NO: 97397 - DNA, 28 bp, Artificial Sequence
  Synthetic
tcgaaacatuagacttcggtuagagaac

SEQ ID NO: 97398 - DNA, 22 bp, Artificial Sequence
  Synthetic
aagaugagactuggccgagaag

SEQ ID NO: 97399 - DNA, 28 bp, Artificial Sequence
  Synthetic
aggccctuaaacatcacatacuaaacaa

SEQ ID NO: 97400 - DNA, 24 bp, Artificial Sequence
  Synthetic
ctgtctaaucagccgatctucaca

SEQ ID NO: 97401 - DNA, 28 bp, Artificial Sequence
  Synthetic
gaagcutctaagagauagaaaacaaggt

SEQ ID NO: 97402 - DNA, 22 bp, Artificial Sequence
  Synthetic
ctggtggugacaaaacatgcut

SEQ ID NO: 97403 - DNA, 19 bp, Artificial Sequence
  Synthetic
gcagcugctggaaguacgg

SEQ ID NO: 97404 - DNA, 23 bp, Artificial Sequence
  Synthetic
cacagaaugaggatctugaggca

SEQ ID NO: 97405 - DNA, 17 bp, Artificial Sequence
  Synthetic
cccccaacugccgcaua

SEQ ID NO: 97406 - DNA, 27 bp, Artificial Sequence
  Synthetic
aaaagggactutaatcctcagaugacc

SEQ ID NO: 97407 - DNA, 25 bp, Artificial Sequence
  Synthetic
gcaagcttcgacutccaggatatut

SEQ ID NO: 97408 - DNA, 18 bp, Artificial Sequence
  Synthetic
gctttgggcugggtgtuc

SEQ ID NO: 97409 - DNA, 27 bp, Artificial Sequence
  Synthetic
agaataaaauggacagtgcaucacact

SEQ ID NO: 97410 - DNA, 28 bp, Artificial Sequence
  Synthetic
tgttagattacatuaagggcagtggtut

SEQ ID NO: 97411 - DNA, 23 bp, Artificial Sequence
  Synthetic
ggttaacaggautccatcugcca

SEQ ID NO: 97412 - DNA, 21 bp, Artificial Sequence
  Synthetic
gagtggaagccuttcccugat

SEQ ID NO: 97413 - DNA, 26 bp, Artificial Sequence
  Synthetic
gtcagtggaauatcatgguacaggag

SEQ ID NO: 97414 - DNA, 31 bp, Artificial Sequence
  Synthetic
aatgtatagcattguttccagttaaacatut

SEQ ID NO: 97415 - DNA, 21 bp, Artificial Sequence
  Synthetic
gaacgacugcagatggaugga

SEQ ID NO: 97416 - DNA, 26 bp, Artificial Sequence
  Synthetic
accattgaauaccttgacaaacugga

SEQ ID NO: 97417 - DNA, 26 bp, Artificial Sequence
  Synthetic
gttgcttataugaaacctcccctcut

SEQ ID NO: 97418 - DNA, 25 bp, Artificial Sequence
  Synthetic
gtagattcuaggtaaagcccugcaa

SEQ ID NO: 97419 - DNA, 20 bp, Artificial Sequence
  Synthetic
gggctuaggcacactgugac

SEQ ID NO: 97420 - DNA, 27 bp, Artificial Sequence
  Synthetic
gtaaaagaacaccaagaaucgauggac

SEQ ID NO: 97421 - DNA, 26 bp, Artificial Sequence
  Synthetic
gtcaaugaatcacaaauacgcaagca

SEQ ID NO: 97422 - DNA, 22 bp, Artificial Sequence
  Synthetic
ccagaagcutagctuccaccaa

SEQ ID NO: 97423 - DNA, 23 bp, Artificial Sequence
  Synthetic
gcatcuggtggacucaagaaagg

SEQ ID NO: 97424 - DNA, 27 bp, Artificial Sequence
  Synthetic
ctggttcuaagcccttctuaaggaaat

SEQ ID NO: 97425 - DNA, 27 bp, Artificial Sequence
  Synthetic
cctgutacagatagcuaagaacaagca

SEQ ID NO: 97426 - DNA, 22 bp, Artificial Sequence
  Synthetic
ccattcutcagcacugggaact

SEQ ID NO: 97427 - DNA, 29 bp, Artificial Sequence
  Synthetic
tgtttggatugagaatggataaagugaca

SEQ ID NO: 97428 - DNA, 31 bp, Artificial Sequence
  Synthetic
gtacagcaattcaucgaaatcatcauaaaca

SEQ ID NO: 97429 - DNA, 20 bp, Artificial Sequence
  Synthetic
ggctauggaagcagcaguct

SEQ ID NO: 97430 - DNA, 23 bp, Artificial Sequence
  Synthetic
aatacccgaagutcagactgcug

SEQ ID NO: 97431 - DNA, 27 bp, Artificial Sequence
  Synthetic
agcaggccttaugtaatgctaagatut

SEQ ID NO: 97432 - DNA, 20 bp, Artificial Sequence
  Synthetic
agctgccacacutgggaauc

SEQ ID NO: 97433 - DNA, 17 bp, Artificial Sequence
  Synthetic
gcaagcuggcagcgtuc

SEQ ID NO: 97434 - DNA, 22 bp, Artificial Sequence
  Synthetic
cagagucagcagcagtaugacc

SEQ ID NO: 97435 - DNA, 20 bp, Artificial Sequence
  Synthetic
tgtctgggccuctaccacut

SEQ ID NO: 97436 - DNA, 18 bp, Artificial Sequence
  Synthetic
tcctcugcgctgcagtut

SEQ ID NO: 97437 - DNA, 18 bp, Artificial Sequence
  Synthetic
caggtgugggaacgugga

SEQ ID NO: 97438 - DNA, 25 bp, Artificial Sequence
  Synthetic
atcagtucaacttcatctuccccaa

SEQ ID NO: 97439 - DNA, 23 bp, Artificial Sequence
  Synthetic
ttgagcuccagggaggauaaaga

SEQ ID NO: 97440 - DNA, 18 bp, Artificial Sequence
  Synthetic
agcagccaacuccccauc

SEQ ID NO: 97441 - DNA, 21 bp, Artificial Sequence
  Synthetic
acacagguagccagcaaaucc

SEQ ID NO: 97442 - DNA, 28 bp, Artificial Sequence
  Synthetic
gagagaaguctaatttactcugcaccat

SEQ ID NO: 97443 - DNA, 25 bp, Artificial Sequence
  Synthetic
gcttaggccutagaagatgacauca

SEQ ID NO: 97444 - DNA, 28 bp, Artificial Sequence
  Synthetic
gcctggtgtaaaugtttattgtgatuga

SEQ ID NO: 97445 - DNA, 30 bp, Artificial Sequence
  Synthetic
gcaaactaaatccauttaacatgtcaugct

SEQ ID NO: 97446 - DNA, 25 bp, Artificial Sequence
  Synthetic
gacacataugaaaaggcaugcacat

SEQ ID NO: 97447 - DNA, 26 bp, Artificial Sequence
  Synthetic
tggcatgaguctcacataaacaugaa

SEQ ID NO: 97448 - DNA, 28 bp, Artificial Sequence
  Synthetic
gatgagataaugccaggatactacacuc

SEQ ID NO: 97449 - DNA, 26 bp, Artificial Sequence
  Synthetic
gcagtgtgttutcagagggaguaaaa

SEQ ID NO: 97450 - DNA, 22 bp, Artificial Sequence
  Synthetic
acaggtucacactggaccuaca

SEQ ID NO: 97451 - DNA, 28 bp, Artificial Sequence
  Synthetic
ggaaatcgcaaaugatccagacaaaaua

SEQ ID NO: 97452 - DNA, 26 bp, Artificial Sequence
  Synthetic
accttatgttgugcaagttgtgttut

SEQ ID NO: 97453 - DNA, 27 bp, Artificial Sequence
  Synthetic
ctagttccaugaagcttggaguaaact

SEQ ID NO: 97454 - DNA, 26 bp, Artificial Sequence
  Synthetic
tttctgactcttcuagccactccaua

SEQ ID NO: 97455 - DNA, 29 bp, Artificial Sequence
  Synthetic
ctgtcttaaaacugtgctagatcucaagt

SEQ ID NO: 97456 - DNA, 29 bp, Artificial Sequence
  Synthetic
autatttaatatacaugcagcaccccagt

SEQ ID NO: 97457 - DNA, 28 bp, Artificial Sequence
  Synthetic
cggactgacacutagtagtactucaaat

SEQ ID NO: 97458 - DNA, 19 bp, Artificial Sequence
  Synthetic
ctgtgggcgcucaggtaut

SEQ ID NO: 97459 - DNA, 21 bp, Artificial Sequence
  Synthetic
agggacgagguagaagaggug

SEQ ID NO: 97460 - DNA, 24 bp, Artificial Sequence
  Synthetic
agccttcatcugtcccttcaguat

SEQ ID NO: 97461 - DNA, 28 bp, Artificial Sequence
  Synthetic
agataaaacgacucatctactaggugct

SEQ ID NO: 97462 - DNA, 27 bp, Artificial Sequence
  Synthetic
agtaaaagcaccuagtagatgagucgt

SEQ ID NO: 97463 - DNA, 27 bp, Artificial Sequence
  Synthetic
gccctttggaaaugtactgatctgaut

SEQ ID NO: 97464 - DNA, 23 bp, Artificial Sequence
  Synthetic
cctctgctguttgggagtagaut

SEQ ID NO: 97465 - DNA, 22 bp, Artificial Sequence
  Synthetic
gtgtttggttugaggcctgtug

SEQ ID NO: 97466 - DNA, 24 bp, Artificial Sequence
  Synthetic
ccttacagauggtagcaucgacaa

SEQ ID NO: 97467 - DNA, 21 bp, Artificial Sequence
  Synthetic
gccttatuggtggcugaggaa

SEQ ID NO: 97468 - DNA, 29 bp, Artificial Sequence
  Synthetic
cagaagacacaacauctctaagtuacaca

SEQ ID NO: 97469 - DNA, 25 bp, Artificial Sequence
  Synthetic
ggtccaaaguagacatttccucaca

SEQ ID NO: 97470 - DNA, 23 bp, Artificial Sequence
  Synthetic
tctcctttccuggacaagcuaca

SEQ ID NO: 97471 - DNA, 17 bp, Artificial Sequence
  Synthetic
gccaggaagcucgccua

SEQ ID NO: 97472 - DNA, 21 bp, Artificial Sequence
  Synthetic
tgcgtaacatuaggcgagcut

SEQ ID NO: 97473 - DNA, 27 bp, Artificial Sequence
  Synthetic
ccttgacttgcccutgttttatttcut

SEQ ID NO: 97474 - DNA, 28 bp, Artificial Sequence
  Synthetic
acaggaagcaaggacaugaatatctuac

SEQ ID NO: 97475 - DNA, 26 bp, Artificial Sequence
  Synthetic
caggttgcugtagagaaacugaagaa

SEQ ID NO: 97476 - DNA, 25 bp, Artificial Sequence
  Synthetic
ctcgatccuctccagtaaauagacc

SEQ ID NO: 97477 - DNA, 27 bp, Artificial Sequence
  Synthetic
gagttatttgtuctgtcagcgtaucct

SEQ ID NO: 97478 - DNA, 27 bp, Artificial Sequence
  Synthetic
aagtaaagaucccctggcatcuaaaag

SEQ ID NO: 97479 - DNA, 27 bp, Artificial Sequence
  Synthetic
cctgctgagtauaattgaaaagcgtut

SEQ ID NO: 97480 - DNA, 28 bp, Artificial Sequence
  Synthetic
acttgttctuaacctttttgaauggcac

SEQ ID NO: 97481 - DNA, 28 bp, Artificial Sequence
  Synthetic
aggaacaacaauaccccatctttugaat

SEQ ID NO: 97482 - DNA, 23 bp, Artificial Sequence
  Synthetic
gcagcagaaacacugatgtcuga

SEQ ID NO: 97483 - DNA, 28 bp, Artificial Sequence
  Synthetic
acttattatgtggucattgtcttgccut

SEQ ID NO: 97484 - DNA, 21 bp, Artificial Sequence
  Synthetic
cctcgucccaagacagttcuc

SEQ ID NO: 97485 - DNA, 28 bp, Artificial Sequence
  Synthetic
cgccatcacautcttgacaatuaaaact

SEQ ID NO: 97486 - DNA, 22 bp, Artificial Sequence
  Synthetic
gtgcaugatatcguggcagaac

SEQ ID NO: 97487 - DNA, 28 bp, Artificial Sequence
  Synthetic
agagatggcgauggatatattgacuact

SEQ ID NO: 97488 - DNA, 24 bp, Artificial Sequence
  Synthetic
ggcugtaactaaaugggcacaagt

SEQ ID NO: 97489 - DNA, 25 bp, Artificial Sequence
  Synthetic
cagcagauacacaaaguaccaggag

SEQ ID NO: 97490 - DNA, 26 bp, Artificial Sequence
  Synthetic
ctatctgttcagcaugtcttggtcut

SEQ ID NO: 97491 - DNA, 21 bp, Artificial Sequence
  Synthetic
ccagtgtuacagctgucacca

SEQ ID NO: 97492 - DNA, 24 bp, Artificial Sequence
  Synthetic
ggtgaagggcugctacaaatucat

SEQ ID NO: 97493 - DNA, 28 bp, Artificial Sequence
  Synthetic
tgcaatugagaatgtctugagaaagaac

SEQ ID NO: 97494 - DNA, 23 bp, Artificial Sequence
  Synthetic
ctgttccucggaaagtctaugga

SEQ ID NO: 97495 - DNA, 22 bp, Artificial Sequence
  Synthetic
tctagtgcuactgtgucccaca

SEQ ID NO: 97496 - DNA, 33 bp, Artificial Sequence
  Synthetic
ttcaatataactactguttgcctctaagattut

SEQ ID NO: 97497 - DNA, 25 bp, Artificial Sequence
  Synthetic
ggaacagccacaaauacugaggaat

SEQ ID NO: 97498 - DNA, 23 bp, Artificial Sequence
  Synthetic
cctcagtatutgtggctgtucct

SEQ ID NO: 97499 - DNA, 28 bp, Artificial Sequence
  Synthetic
gggtttgatttaaugccatctactgtua

SEQ ID NO: 97500 - DNA, 28 bp, Artificial Sequence
  Synthetic
aagatgatagugagatctgtccugaagt

SEQ ID NO: 97501 - DNA, 23 bp, Artificial Sequence
  Synthetic
tccagtgctuatttccctcagug

SEQ ID NO: 97502 - DNA, 25 bp, Artificial Sequence
  Synthetic
gatgaataauccccacugagggaaa

SEQ ID NO: 97503 - DNA, 28 bp, Artificial Sequence
  Synthetic
gattggtggugaagcaatttaaccauat

SEQ ID NO: 97504 - DNA, 28 bp, Artificial Sequence
  Synthetic
acaaaaccacacaauaaaaacugaacct

SEQ ID NO: 97505 - DNA, 25 bp, Artificial Sequence
  Synthetic
gaaaagaggcuggtgaattgugaac

SEQ ID NO: 97506 - DNA, 26 bp, Artificial Sequence
  Synthetic
aagtttagatgcutgggttcctaugg

SEQ ID NO: 97507 - DNA, 25 bp, Artificial Sequence
  Synthetic
tccctaaatgaccutttggcacaut

SEQ ID NO: 97508 - DNA, 26 bp, Artificial Sequence
  Synthetic
aagtcatgaagguatatttcgcugct

SEQ ID NO: 97509 - DNA, 28 bp, Artificial Sequence
  Synthetic
cccatgacctuaacagttactagttuca

SEQ ID NO: 97510 - DNA, 21 bp, Artificial Sequence
  Synthetic
gcgttaacuctcccaguggaa

SEQ ID NO: 97511 - DNA, 25 bp, Artificial Sequence
  Synthetic
cacagttccugatgatgtattugcc

SEQ ID NO: 97512 - DNA, 22 bp, Artificial Sequence
  Synthetic
cccttctuaccgtggttcucct

SEQ ID NO: 97513 - DNA, 20 bp, Artificial Sequence
  Synthetic
cacugagaacucggcaggaa

SEQ ID NO: 97514 - DNA, 22 bp, Artificial Sequence
  Synthetic
acctgaugaagctguacgaagg

SEQ ID NO: 97515 - DNA, 24 bp, Artificial Sequence
  Synthetic
tctttgtaagtacuccggcttcug

SEQ ID NO: 97516 - DNA, 24 bp, Artificial Sequence
  Synthetic
gaggaaugagggcaaatgacaaug

SEQ ID NO: 97517 - DNA, 28 bp, Artificial Sequence
  Synthetic
acagacacaaautgaaaccaaaaaucct

SEQ ID NO: 97518 - DNA, 25 bp, Artificial Sequence
  Synthetic
aatgtagcaugtgttcugcaaaact

SEQ ID NO: 97519 - DNA, 23 bp, Artificial Sequence
  Synthetic
tcaaacggacgaaagugtuggat

SEQ ID NO: 97520 - DNA, 28 bp, Artificial Sequence
  Synthetic
cctutgtagttaacctugaaaccaacag

SEQ ID NO: 97521 - DNA, 28 bp, Artificial Sequence
  Synthetic
ctctcccttcttugtccatctcttttua

SEQ ID NO: 97522 - DNA, 29 bp, Artificial Sequence
  Synthetic
tttgttactaactcutggctctcattcuc

SEQ ID NO: 97523 - DNA, 28 bp, Artificial Sequence
  Synthetic
ggaaaattcaccucatccatucagaaat

SEQ ID NO: 97524 - DNA, 25 bp, Artificial Sequence
  Synthetic
atttgcucaccagtaagttuaccct

SEQ ID NO: 97525 - DNA, 23 bp, Artificial Sequence
  Synthetic
gaaacugccatccuaaccgaagt

SEQ ID NO: 97526 - DNA, 28 bp, Artificial Sequence
  Synthetic
cctaaaatcaaugccaatctcctggaua

SEQ ID NO: 97527 - DNA, 22 bp, Artificial Sequence
  Synthetic
gaucttgctttuccagccaacc

SEQ ID NO: 97528 - DNA, 22 bp, Artificial Sequence
  Synthetic
catgtgaaaacagccuccctug

SEQ ID NO: 97529 - DNA, 28 bp, Artificial Sequence
  Synthetic
tctgtcccttgaugaagcatgaatttua

SEQ ID NO: 97530 - DNA, 28 bp, Artificial Sequence
  Synthetic
tcatgccaccaaaugggaatatactuag

SEQ ID NO: 97531 - DNA, 28 bp, Artificial Sequence
  Synthetic
tggtaacattctcaugcaatattgggua

SEQ ID NO: 97532 - DNA, 22 bp, Artificial Sequence
  Synthetic
ctttgtuggcccttgcauaaga

SEQ ID NO: 97533 - DNA, 23 bp, Artificial Sequence
  Synthetic
tttctgtgttuccttccctgucc

SEQ ID NO: 97534 - DNA, 25 bp, Artificial Sequence
  Synthetic
aagcccagaacautaggaacttugt

SEQ ID NO: 97535 - DNA, 22 bp, Artificial Sequence
  Synthetic
tgatcacaagcaggutgctgut

SEQ ID NO: 97536 - DNA, 24 bp, Artificial Sequence
  Synthetic
agtttaccacuctctcttuccaga

SEQ ID NO: 97537 - DNA, 23 bp, Artificial Sequence
  Synthetic
ggttcctttgcuggaaacctgua

SEQ ID NO: 97538 - DNA, 27 bp, Artificial Sequence
  Synthetic
tccatttctctccutttccatcagtuc

SEQ ID NO: 97539 - DNA, 22 bp, Artificial Sequence
  Synthetic
gggatgaggucgatgtatcuct

SEQ ID NO: 97540 - DNA, 19 bp, Artificial Sequence
  Synthetic
gcaagtuccagggccagua

SEQ ID NO: 97541 - DNA, 21 bp, Artificial Sequence
  Synthetic
agtgtgguccattcctucacc

SEQ ID NO: 97542 - DNA, 20 bp, Artificial Sequence
  Synthetic
gaggctguctgtcggucaag

SEQ ID NO: 97543 - DNA, 24 bp, Artificial Sequence
  Synthetic
catcutccagatcauccgggaaag

SEQ ID NO: 97544 - DNA, 21 bp, Artificial Sequence
  Synthetic
cttctcaguggccctcactuc

SEQ ID NO: 97545 - DNA, 23 bp, Artificial Sequence
  Synthetic
gcagcttugaactgatccaugat

SEQ ID NO: 97546 - DNA, 20 bp, Artificial Sequence
  Synthetic
gccacaugcccuacacagat

SEQ ID NO: 97547 - DNA, 27 bp, Artificial Sequence
  Synthetic
gaggaauaaaagaacatggagtugcag

SEQ ID NO: 97548 - DNA, 21 bp, Artificial Sequence
  Synthetic
ggcagtgucactccucagaag

SEQ ID NO: 97549 - DNA, 23 bp, Artificial Sequence
  Synthetic
tcttgggaaccagcugttaccua

SEQ ID NO: 97550 - DNA, 23 bp, Artificial Sequence
  Synthetic
tggttctcaucgactcgctttuc

SEQ ID NO: 97551 - DNA, 21 bp, Artificial Sequence
  Synthetic
acttgaaagcutagcgccuca

SEQ ID NO: 97552 - DNA, 23 bp, Artificial Sequence
  Synthetic
cacccagcuctcatttacauggt

SEQ ID NO: 97553 - DNA, 22 bp, Artificial Sequence
  Synthetic
cagcccgagaacucauagaagg

SEQ ID NO: 97554 - DNA, 20 bp, Artificial Sequence
  Synthetic
aggaggagucatcccgacug

SEQ ID NO: 97555 - DNA, 28 bp, Artificial Sequence
  Synthetic
agtatgtgttgcugttttggttttguaa

SEQ ID NO: 97556 - DNA, 22 bp, Artificial Sequence
  Synthetic
caccaucccccatgtatcauct

SEQ ID NO: 97557 - DNA, 20 bp, Artificial Sequence
  Synthetic
gcaaagtcugtggccaucca

SEQ ID NO: 97558 - DNA, 22 bp, Artificial Sequence
  Synthetic
ggactatctgcuggaggagaug

SEQ ID NO: 97559 - DNA, 21 bp, Artificial Sequence
  Synthetic
ccaccacutacaccacugcaa

SEQ ID NO: 97560 - DNA, 28 bp, Artificial Sequence
  Synthetic
tgcttccgaauatttccattcucagaaa

SEQ ID NO: 97561 - DNA, 22 bp, Artificial Sequence
  Synthetic
gtgctgtgugcagaaagtctuc

SEQ ID NO: 97562 - DNA, 24 bp, Artificial Sequence
  Synthetic
gcatcccaugcatgatacccauag

SEQ ID NO: 97563 - DNA, 25 bp, Artificial Sequence
  Synthetic
ccagaatccccaccucatggataua

SEQ ID NO: 97564 - DNA, 21 bp, Artificial Sequence
  Synthetic
gcccaccugtctgactgauaa

SEQ ID NO: 97565 - DNA, 23 bp, Artificial Sequence
  Synthetic
agcactagucgctgtataggugt

SEQ ID NO: 97566 - DNA, 27 bp, Artificial Sequence
  Synthetic
tgttttgaggaaaaugtttgcctugag

SEQ ID NO: 97567 - DNA, 24 bp, Artificial Sequence
  Synthetic
ctccttcuccggcattgtuaaaag

SEQ ID NO: 97568 - DNA, 28 bp, Artificial Sequence
  Synthetic
ctccagagtcaagutcccattatguaat

SEQ ID NO: 97569 - DNA, 31 bp, Artificial Sequence
  Synthetic
actttgtcagaggaagautaacaattucact

SEQ ID NO: 97570 - DNA, 26 bp, Artificial Sequence
  Synthetic
ttcttgtaauggccttcagtgaucaa

SEQ ID NO: 97571 - DNA, 17 bp, Artificial Sequence
  Synthetic
ctagccgugccgacgua

SEQ ID NO: 97572 - DNA, 20 bp, Artificial Sequence
  Synthetic
agccactcucaccttcucca

SEQ ID NO: 97573 - DNA, 22 bp, Artificial Sequence
  Synthetic
aaggtccuacgctuccaaaagg

SEQ ID NO: 97574 - DNA, 19 bp, Artificial Sequence
  Synthetic
cctggaccaaugggcauct

SEQ ID NO: 97575 - DNA, 18 bp, Artificial Sequence
  Synthetic
agagaacguggcgauggg

SEQ ID NO: 97576 - DNA, 21 bp, Artificial Sequence
  Synthetic
gctcagtuagcagctcaucca

SEQ ID NO: 97577 - DNA, 19 bp, Artificial Sequence
  Synthetic
gccugagacttguccaggt

SEQ ID NO: 97578 - DNA, 17 bp, Artificial Sequence
  Synthetic
gcctcugctgcuccaca

SEQ ID NO: 97579 - DNA, 21 bp, Artificial Sequence
  Synthetic
cgcgagaagaaagugccauga

SEQ ID NO: 97580 - DNA, 28 bp, Artificial Sequence
  Synthetic
tgttttgagaaguacagcagugaaagaa

SEQ ID NO: 97581 - DNA, 24 bp, Artificial Sequence
  Synthetic
gauaaagaagtcaucccccaggag

SEQ ID NO: 97582 - DNA, 24 bp, Artificial Sequence
  Synthetic
aatgagtgcuttcacctctucgat

SEQ ID NO: 97583 - DNA, 20 bp, Artificial Sequence
  Synthetic
ccugggcaaagcaacaucag

SEQ ID NO: 97584 - DNA, 22 bp, Artificial Sequence
  Synthetic
gccagagcacutgctaatcuct

SEQ ID NO: 97585 - DNA, 24 bp, Artificial Sequence
  Synthetic
cagaagcattaugggtctagcuca

SEQ ID NO: 97586 - DNA, 26 bp, Artificial Sequence
  Synthetic
acctaaaaugcaaccctagtaugcaa

SEQ ID NO: 97587 - DNA, 28 bp, Artificial Sequence
  Synthetic
gtgcgactaaugaacttatttggtugaa

SEQ ID NO: 97588 - DNA, 25 bp, Artificial Sequence
  Synthetic
ctctcactccagucataagcaacut

SEQ ID NO: 97589 - DNA, 26 bp, Artificial Sequence
  Synthetic
agaatacauccaggaaucaagaacgg

SEQ ID NO: 97590 - DNA, 22 bp, Artificial Sequence
  Synthetic
ctgctgtctuggtttcccatuc

SEQ ID NO: 97591 - DNA, 24 bp, Artificial Sequence
  Synthetic
agccctggagaugacaaagauagt

SEQ ID NO: 97592 - DNA, 28 bp, Artificial Sequence
  Synthetic
gcacgactuacaaaattatggagtguat

SEQ ID NO: 97593 - DNA, 28 bp, Artificial Sequence
  Synthetic
agtcagtatgcaaaacucttggtaagut

SEQ ID NO: 97594 - DNA, 31 bp, Artificial Sequence
  Synthetic
actaccaagtaagagutgtagatagctctut

SEQ ID NO: 97595 - DNA, 28 bp, Artificial Sequence
  Synthetic
gctttgctacagaacauaattgggatuc

SEQ ID NO: 97596 - DNA, 24 bp, Artificial Sequence
  Synthetic
tctcccccaucataaaaguccaga

SEQ ID NO: 97597 - DNA, 28 bp, Artificial Sequence
  Synthetic
gggattggtggacuatagttatgtguat

SEQ ID NO: 97598 - DNA, 30 bp, Artificial Sequence
  Synthetic
ccttggtatacaauatgaaacccttgttug

SEQ ID NO: 97599 - DNA, 22 bp, Artificial Sequence
  Synthetic
actgttatuggccggcttagug

SEQ ID NO: 97600 - DNA, 28 bp, Artificial Sequence
  Synthetic
ggtgctgaauaaggaagatggtattuga

SEQ ID NO: 97601 - DNA, 28 bp, Artificial Sequence
  Synthetic
cttcaggtgtacauctccagtttguaaa

SEQ ID NO: 97602 - DNA, 27 bp, Artificial Sequence
  Synthetic
gaggatccactucgtacttccaaauaa

SEQ ID NO: 97603 - DNA, 27 bp, Artificial Sequence
  Synthetic
agtacattgatgugattgtgtgtgugt

SEQ ID NO: 97604 - DNA, 20 bp, Artificial Sequence
  Synthetic
ctaagaggccucgcctugaa

SEQ ID NO: 97605 - DNA, 20 bp, Artificial Sequence
  Synthetic
ggtttcuggaaccgcagugt

SEQ ID NO: 97606 - DNA, 28 bp, Artificial Sequence
  Synthetic
gaattagtgggaaauatcaagagugcca

SEQ ID NO: 97607 - DNA, 24 bp, Artificial Sequence
  Synthetic
agatcaagcagcautcacaagcua

SEQ ID NO: 97608 - DNA, 26 bp, Artificial Sequence
  Synthetic
accattgattccugaacaaggtctuc

SEQ ID NO: 97609 - DNA, 29 bp, Artificial Sequence
  Synthetic
actttaacttccagguttcatctttccut

SEQ ID NO: 97610 - DNA, 28 bp, Artificial Sequence
  Synthetic
tcttgtcagctauaactgcttcttctuc

SEQ ID NO: 97611 - DNA, 28 bp, Artificial Sequence
  Synthetic
aacatttaaccauaggtggctattgtut

SEQ ID NO: 97612 - DNA, 23 bp, Artificial Sequence
  Synthetic
gagatgccucttttcaaggguga

SEQ ID NO: 97613 - DNA, 21 bp, Artificial Sequence
  Synthetic
gggctctgcugtaagggaaug

SEQ ID NO: 97614 - DNA, 23 bp, Artificial Sequence
  Synthetic
cacuccaaagaccugaggaaagg

SEQ ID NO: 97615 - DNA, 28 bp, Artificial Sequence
  Synthetic
acacctccaaauggaaataagatuggaa

SEQ ID NO: 97616 - DNA, 25 bp, Artificial Sequence
  Synthetic
gctgttgagccauatgaagttugag

SEQ ID NO: 97617 - DNA, 25 bp, Artificial Sequence
  Synthetic
cagttttgtuacaagtgcagctuga

SEQ ID NO: 97618 - DNA, 28 bp, Artificial Sequence
  Synthetic
gctgtgttgtucagtaattctaccauac

SEQ ID NO: 97619 - DNA, 24 bp, Artificial Sequence
  Synthetic
gtagagactcuctggccatggaua

SEQ ID NO: 97620 - DNA, 23 bp, Artificial Sequence
  Synthetic
tccaggttgutttggcatttguc

SEQ ID NO: 97621 - DNA, 29 bp, Artificial Sequence
  Synthetic
gcagccttacagutacagcttaauacaat

SEQ ID NO: 97622 - DNA, 18 bp, Artificial Sequence
  Synthetic
cuccggagauggcacaga

SEQ ID NO: 97623 - DNA, 28 bp, Artificial Sequence
  Synthetic
gggcataatgttucttcttgaaagcuaa

SEQ ID NO: 97624 - DNA, 26 bp, Artificial Sequence
  Synthetic
agtgtcttttcagugctgttaagugt

SEQ ID NO: 97625 - DNA, 17 bp, Artificial Sequence
  Synthetic
caggcccuggacctcug

SEQ ID NO: 97626 - DNA, 29 bp, Artificial Sequence
  Synthetic
tcttctctccagcuatttttcactgttut

SEQ ID NO: 97627 - DNA, 23 bp, Artificial Sequence
  Synthetic
gggctcaatugcgtttcattuca

SEQ ID NO: 97628 - DNA, 21 bp, Artificial Sequence
  Synthetic
tgaaacgcaautgagcccuga

SEQ ID NO: 97629 - DNA, 27 bp, Artificial Sequence
  Synthetic
tggaagaccaucatgactacttacuga

SEQ ID NO: 97630 - DNA, 20 bp, Artificial Sequence
  Synthetic
cccagaacguccagcaucag

SEQ ID NO: 97631 - DNA, 28 bp, Artificial Sequence
  Synthetic
ctcctattcaucagctgctgtattugat

SEQ ID NO: 97632 - DNA, 27 bp, Artificial Sequence
  Synthetic
cctgaagcutggtttcuaagaaagaac

SEQ ID NO: 97633 - DNA, 24 bp, Artificial Sequence
  Synthetic
gctaaaagactugcacaggaccut

SEQ ID NO: 97634 - DNA, 18 bp, Artificial Sequence
  Synthetic
caccccaguctcccagut

SEQ ID NO: 97635 - DNA, 21 bp, Artificial Sequence
  Synthetic
cagtgtgauctgctggttucc

SEQ ID NO: 97636 - DNA, 29 bp, Artificial Sequence
  Synthetic
acctgcttatuaaatgtatcccaatuggt

SEQ ID NO: 97637 - DNA, 26 bp, Artificial Sequence
  Synthetic
ctttgaccgcucagtctcatatguat

SEQ ID NO: 97638 - DNA, 24 bp, Artificial Sequence
  Synthetic
gggtaaaacugccattctctguga

SEQ ID NO: 97639 - DNA, 29 bp, Artificial Sequence
  Synthetic
actctctgtgtttuactgatctacctgua

SEQ ID NO: 97640 - DNA, 27 bp, Artificial Sequence
  Synthetic
acactttcaagggaacaugatggatut

SEQ ID NO: 97641 - DNA, 28 bp, Artificial Sequence
  Synthetic
cttacctcgtcautgataacctcagaut

SEQ ID NO: 97642 - DNA, 20 bp, Artificial Sequence
  Synthetic
cgtgaacaucacccugcaga

SEQ ID NO: 97643 - DNA, 21 bp, Artificial Sequence
  Synthetic
gggacgugacctgaatgtaug

SEQ ID NO: 97644 - DNA, 27 bp, Artificial Sequence
  Synthetic
agattttcacctuctgcaatggtttut

SEQ ID NO: 97645 - DNA, 25 bp, Artificial Sequence
  Synthetic
ggcuggauacaaagaaagaagagca

SEQ ID NO: 97646 - DNA, 23 bp, Artificial Sequence
  Synthetic
gatgaggtccuctgtttgcctut

SEQ ID NO: 97647 - DNA, 20 bp, Artificial Sequence
  Synthetic
acagaagugaccgcucgaac

SEQ ID NO: 97648 - DNA, 28 bp, Artificial Sequence
  Synthetic
gtttggcagatautggatgagatttgut

SEQ ID NO: 97649 - DNA, 24 bp, Artificial Sequence
  Synthetic
tcuagagaatcatguccagcacct

SEQ ID NO: 97650 - DNA, 18 bp, Artificial Sequence
  Synthetic
tugcacaggccgacugaa

SEQ ID NO: 97651 - DNA, 23 bp, Artificial Sequence
  Synthetic
agtcaatgcuaaaagccctugct

SEQ ID NO: 97652 - DNA, 19 bp, Artificial Sequence
  Synthetic
cauggcaacgacucagggt

SEQ ID NO: 97653 - DNA, 20 bp, Artificial Sequence
  Synthetic
gcagacguguggcagagaaa

SEQ ID NO: 97654 - DNA, 21 bp, Artificial Sequence
  Synthetic
tgagtcugaggcctcuaccac

SEQ ID NO: 97655 - DNA, 21 bp, Artificial Sequence
  Synthetic
tgugcaaaggagcagcuagat

SEQ ID NO: 97656 - DNA, 21 bp, Artificial Sequence
  Synthetic
ggaucccagcgaatcauggat

SEQ ID NO: 97657 - DNA, 21 bp, Artificial Sequence
  Synthetic
ggtggacauggtcacugaaca

SEQ ID NO: 97658 - DNA, 25 bp, Artificial Sequence
  Synthetic
guaacacaagttuaccagacccaca

SEQ ID NO: 97659 - DNA, 28 bp, Artificial Sequence
  Synthetic
gagaattgauaaagaccaggaugggaaa

SEQ ID NO: 97660 - DNA, 27 bp, Artificial Sequence
  Synthetic
cccaggaaatatuttctctccagtcut

SEQ ID NO: 97661 - DNA, 28 bp, Artificial Sequence
  Synthetic
cacaugggtaataauagcagaagaacga

SEQ ID NO: 97662 - DNA, 25 bp, Artificial Sequence
  Synthetic
catcaataaatucctgccgcgtuat

SEQ ID NO: 97663 - DNA, 24 bp, Artificial Sequence
  Synthetic
tccttttagcugagggaattugct

SEQ ID NO: 97664 - DNA, 26 bp, Artificial Sequence
  Synthetic
gtttgtaggaugaggatgtccaucat

SEQ ID NO: 97665 - DNA, 25 bp, Artificial Sequence
  Synthetic
cactauagaaagccctggtttucca

SEQ ID NO: 97666 - DNA, 22 bp, Artificial Sequence
  Synthetic
ccatgtgcaguttgcaccatut

SEQ ID NO: 97667 - DNA, 28 bp, Artificial Sequence
  Synthetic
gtctgtttautgtcttttgtugcaggat

SEQ ID NO: 97668 - DNA, 27 bp, Artificial Sequence
  Synthetic
ggctttctatagugccattaagtccut

SEQ ID NO: 97669 - DNA, 30 bp, Artificial Sequence
  Synthetic
ttgttaactttggucttggaaatgcaauag

SEQ ID NO: 97670 - DNA, 28 bp, Artificial Sequence
  Synthetic
ttttgcgccagauatcaaaatcaaagut

SEQ ID NO: 97671 - DNA, 28 bp, Artificial Sequence
  Synthetic
tgaaatgggaaggauatgtgtacuacct

SEQ ID NO: 97672 - DNA, 19 bp, Artificial Sequence
  Synthetic
gtaucgccagggcccauat

SEQ ID NO: 97673 - DNA, 21 bp, Artificial Sequence
  Synthetic
catctaaaccgcugggaggut

SEQ ID NO: 97674 - DNA, 28 bp, Artificial Sequence
  Synthetic
ctccagacagaauttcttactgugaagt

SEQ ID NO: 97675 - DNA, 25 bp, Artificial Sequence
  Synthetic
cagaaggaaauggaccaacacttug

SEQ ID NO: 97676 - DNA, 20 bp, Artificial Sequence
  Synthetic
ctccttggcugtttccggua

SEQ ID NO: 97677 - DNA, 28 bp, Artificial Sequence
  Synthetic
cccaacttaaaacugcctattactucag

SEQ ID NO: 97678 - DNA, 31 bp, Artificial Sequence
  Synthetic
tcaaatgttggutagtggattgtauaaggaa

SEQ ID NO: 97679 - DNA, 28 bp, Artificial Sequence
  Synthetic
actgtttctctccutttcttgctcaaua

SEQ ID NO: 97680 - DNA, 26 bp, Artificial Sequence
  Synthetic
agtgtcttaatutgagctttggugga

SEQ ID NO: 97681 - DNA, 27 bp, Artificial Sequence
  Synthetic
catcatctgucacattggagauaagca

SEQ ID NO: 97682 - DNA, 28 bp, Artificial Sequence
  Synthetic
aagtautctttattggguggaagcaact

SEQ ID NO: 97683 - DNA, 29 bp, Artificial Sequence
  Synthetic
caatataaactcauctccagccacuaact

SEQ ID NO: 97684 - DNA, 27 bp, Artificial Sequence
  Synthetic
atgctgaccacaugatgatttgattug

SEQ ID NO: 97685 - DNA, 27 bp, Artificial Sequence
  Synthetic
cccacataaaaauggtacctgtgttut

SEQ ID NO: 97686 - DNA, 21 bp, Artificial Sequence
  Synthetic
gggutggugaagacaggaact

SEQ ID NO: 97687 - DNA, 28 bp, Artificial Sequence
  Synthetic
cgctcgttgacuaaataaatctgaucca

SEQ ID NO: 97688 - DNA, 26 bp, Artificial Sequence
  Synthetic
gaggaaaagaccagacuctugaaaga

SEQ ID NO: 97689 - DNA, 21 bp, Artificial Sequence
  Synthetic
cactgtacccutccatggcua

SEQ ID NO: 97690 - DNA, 24 bp, Artificial Sequence
  Synthetic
ggcagagacutgctaaggattugt

SEQ ID NO: 97691 - DNA, 20 bp, Artificial Sequence
  Synthetic
gcagagacucuccacaccga

SEQ ID NO: 97692 - DNA, 22 bp, Artificial Sequence
  Synthetic
gtgagctgaugttgacgcttug

SEQ ID NO: 97693 - DNA, 24 bp, Artificial Sequence
  Synthetic
agaagccgaugggagtaagatgua

SEQ ID NO: 97694 - DNA, 28 bp, Artificial Sequence
  Synthetic
attaggtagcugataaggtcucagaaca

SEQ ID NO: 97695 - DNA, 24 bp, Artificial Sequence
  Synthetic
agaagauaagagaccaagcccuga

SEQ ID NO: 97696 - DNA, 28 bp, Artificial Sequence
  Synthetic
ctgaatattcttcucagctacagcaugt

SEQ ID NO: 97697 - DNA, 26 bp, Artificial Sequence
  Synthetic
tgaatcaaaccacagguaaagcugaa

SEQ ID NO: 97698 - DNA, 22 bp, Artificial Sequence
  Synthetic
aggttttcaaccucacgctuct

SEQ ID NO: 97699 - DNA, 28 bp, Artificial Sequence
  Synthetic
ccaagaaaaugctaagctttgugaaaca

SEQ ID NO: 97700 - DNA, 26 bp, Artificial Sequence
  Synthetic
agaggtcuacagagtaaccaaacugt

SEQ ID NO: 97701 - DNA, 22 bp, Artificial Sequence
  Synthetic
gactggacgutctcugaaggag

SEQ ID NO: 97702 - DNA, 28 bp, Artificial Sequence
  Synthetic
tgatacctaacagguggtctagaatugt

SEQ ID NO: 97703 - DNA, 21 bp, Artificial Sequence
  Synthetic
gggcuccacucgagaaagaga

SEQ ID NO: 97704 - DNA, 23 bp, Artificial Sequence
  Synthetic
atcactagctucttgcatggcut

SEQ ID NO: 97705 - DNA, 23 bp, Artificial Sequence
  Synthetic
ccttaagutggagcuggaaagga

SEQ ID NO: 97706 - DNA, 21 bp, Artificial Sequence
  Synthetic
gtcaucagccagggaggttut

SEQ ID NO: 97707 - DNA, 27 bp, Artificial Sequence
  Synthetic
cctcttaccugtttattagucccaaga

SEQ ID NO: 97708 - DNA, 27 bp, Artificial Sequence
  Synthetic
ctgttgaagctguctttcaagttctut

SEQ ID NO: 97709 - DNA, 27 bp, Artificial Sequence
  Synthetic
atggaguccaaagtcatcacugaaaat

SEQ ID NO: 97710 - DNA, 28 bp, Artificial Sequence
  Synthetic
acaaagtcaagccuaatgcctgaaauat

SEQ ID NO: 97711 - DNA, 22 bp, Artificial Sequence
  Synthetic
ccauagaggagcagaugaccca

SEQ ID NO: 97712 - DNA, 23 bp, Artificial Sequence
  Synthetic
ctcagagtaacacugctggctut

SEQ ID NO: 97713 - DNA, 22 bp, Artificial Sequence
  Synthetic
atccccuctgttgagauggact

SEQ ID NO: 97714 - DNA, 22 bp, Artificial Sequence
  Synthetic
gaataccctutctccgccugat

SEQ ID NO: 97715 - DNA, 24 bp, Artificial Sequence
  Synthetic
tgaacaagacaugagagagcugac

SEQ ID NO: 97716 - DNA, 28 bp, Artificial Sequence
  Synthetic
attcttccugaaacagaaccatcttuct

SEQ ID NO: 97717 - DNA, 21 bp, Artificial Sequence
  Synthetic
gcggaacugaatgctuccaaa

SEQ ID NO: 97718 - DNA, 22 bp, Artificial Sequence
  Synthetic
tcttccaauggctgtggttcut

SEQ ID NO: 97719 - DNA, 22 bp, Artificial Sequence
  Synthetic
cacagccaaagacugtacctuc

SEQ ID NO: 97720 - DNA, 26 bp, Artificial Sequence
  Synthetic
caagctggagggcautaagttcauat

SEQ ID NO: 97721 - DNA, 23 bp, Artificial Sequence
  Synthetic
gctacatcaugcagggcaguaac

SEQ ID NO: 97722 - DNA, 24 bp, Artificial Sequence
  Synthetic
gcggtgtcaaautactgtccctut

SEQ ID NO: 97723 - DNA, 22 bp, Artificial Sequence
  Synthetic
gctccaggaagguattgugcag

SEQ ID NO: 97724 - DNA, 28 bp, Artificial Sequence
  Synthetic
ccttcactgtcauctcaaaatctggtut

SEQ ID NO: 97725 - DNA, 24 bp, Artificial Sequence
  Synthetic
aaacttgaggaugagctgauagcc

SEQ ID NO: 97726 - DNA, 22 bp, Artificial Sequence
  Synthetic
caacgtcugcttctgaucgact

SEQ ID NO: 97727 - DNA, 24 bp, Artificial Sequence
  Synthetic
ccctgtgtaaccutatgaccacut

SEQ ID NO: 97728 - DNA, 17 bp, Artificial Sequence
  Synthetic
cacccaccggaguggut

SEQ ID NO: 97729 - DNA, 17 bp, Artificial Sequence
  Synthetic
tgttccuggcgcgcuat

SEQ ID NO: 97730 - DNA, 18 bp, Artificial Sequence
  Synthetic
caagtugcgcaaggugga

SEQ ID NO: 97731 - DNA, 19 bp, Artificial Sequence
  Synthetic
gttggagugggtgguggat

SEQ ID NO: 97732 - DNA, 26 bp, Artificial Sequence
  Synthetic
tgaagagagccaggautactaccaua

SEQ ID NO: 97733 - DNA, 26 bp, Artificial Sequence
  Synthetic
tctttccaaaaaugctgctguaacac

SEQ ID NO: 97734 - DNA, 24 bp, Artificial Sequence
  Synthetic
cactgagtgaaaugacttgcaugg

SEQ ID NO: 97735 - DNA, 28 bp, Artificial Sequence
  Synthetic
tguccgaaatagaaaugaaacagagcaa

SEQ ID NO: 97736 - DNA, 26 bp, Artificial Sequence
  Synthetic
ctgcatattttugacactcgtccaut

SEQ ID NO: 97737 - DNA, 28 bp, Artificial Sequence
  Synthetic
gctgtactgugaagtgatgtagataugt

SEQ ID NO: 97738 - DNA, 26 bp, Artificial Sequence
  Synthetic
catatattuagggagtggugcaacga

SEQ ID NO: 97739 - DNA, 23 bp, Artificial Sequence
  Synthetic
gucaactccttguaaagcagcag

SEQ ID NO: 97740 - DNA, 22 bp, Artificial Sequence
  Synthetic
cagcttccugtgagtuccacat

SEQ ID NO: 97741 - DNA, 21 bp, Artificial Sequence
  Synthetic
ggatgggaguggcttcauaca

SEQ ID NO: 97742 - DNA, 20 bp, Artificial Sequence
  Synthetic
cgactcggucatgtgtcuca

SEQ ID NO: 97743 - DNA, 20 bp, Artificial Sequence
  Synthetic
tggctgacaugcagggatuc

SEQ ID NO: 97744 - DNA, 20 bp, Artificial Sequence
  Synthetic
cacgggaaagucugagcact

SEQ ID NO: 97745 - DNA, 28 bp, Artificial Sequence
  Synthetic
ccttttcatttgauttgccattgtucca

SEQ ID NO: 97746 - DNA, 24 bp, Artificial Sequence
  Synthetic
acacaaucccacaccaatgatuca

SEQ ID NO: 97747 - DNA, 28 bp, Artificial Sequence
  Synthetic
cgtagcagtgautctgtgtttaguaaca

SEQ ID NO: 97748 - DNA, 21 bp, Artificial Sequence
  Synthetic
gactggtucgagtgctgguag

SEQ ID NO: 97749 - DNA, 26 bp, Artificial Sequence
  Synthetic
caccgttagaaguagagcttttucca

SEQ ID NO: 97750 - DNA, 33 bp, Artificial Sequence
  Synthetic
atcacagatcauacaaatttatatacucaccaa

SEQ ID NO: 97751 - DNA, 20 bp, Artificial Sequence
  Synthetic
gcagtcggutcatcggtuct

SEQ ID NO: 97752 - DNA, 27 bp, Artificial Sequence
  Synthetic
actgtttcacaccuaattgctauggat

SEQ ID NO: 97753 - DNA, 26 bp, Artificial Sequence
  Synthetic
acagctgttccuagaacaagttcuac

SEQ ID NO: 97754 - DNA, 21 bp, Artificial Sequence
  Synthetic
tcaggcacagaacugcatugt

SEQ ID NO: 97755 - DNA, 33 bp, Artificial Sequence
  Synthetic
attcaagttctgauaaaaagtgatgatttcuca

SEQ ID NO: 97756 - DNA, 24 bp, Artificial Sequence
  Synthetic
cgtcttgggtaugccttgcttcua

SEQ ID NO: 97757 - DNA, 29 bp, Artificial Sequence
  Synthetic
tggcacagtugagttaaagaaataucagt

SEQ ID NO: 97758 - DNA, 27 bp, Artificial Sequence
  Synthetic
gaaaaccaaattcuacctcttgctugg

SEQ ID NO: 97759 - DNA, 28 bp, Artificial Sequence
  Synthetic
agggatatgugatcttctuacccaaact

SEQ ID NO: 97760 - DNA, 22 bp, Artificial Sequence
  Synthetic
cctagaaaauctgctccugcct

SEQ ID NO: 97761 - DNA, 21 bp, Artificial Sequence
  Synthetic
caaggatgcucaggacgtuga

SEQ ID NO: 97762 - DNA, 22 bp, Artificial Sequence
  Synthetic
ggtgaccaautaggcggtttuc

SEQ ID NO: 97763 - DNA, 27 bp, Artificial Sequence
  Synthetic
gcgattttgugaccaccatacattuaa

SEQ ID NO: 97764 - DNA, 20 bp, Artificial Sequence
  Synthetic
ctugaagagcgggcacttug

SEQ ID NO: 97765 - DNA, 23 bp, Artificial Sequence
  Synthetic
tctccagugccttcaggatuaga

SEQ ID NO: 97766 - DNA, 20 bp, Artificial Sequence
  Synthetic
ctggagtauccgtccgcauc

SEQ ID NO: 97767 - DNA, 23 bp, Artificial Sequence
  Synthetic
gctggtugagaacccattuccaa

SEQ ID NO: 97768 - DNA, 29 bp, Artificial Sequence
  Synthetic
atcaaaagaggcaaagguattccauaagt

SEQ ID NO: 97769 - DNA, 25 bp, Artificial Sequence
  Synthetic
ccaccaccaautaucagcaacaaaa

SEQ ID NO: 97770 - DNA, 22 bp, Artificial Sequence
  Synthetic
acaaaaugcagtcugagccagt

SEQ ID NO: 97771 - DNA, 28 bp, Artificial Sequence
  Synthetic
caattttgugaaaacgtttactgcugaa

SEQ ID NO: 97772 - DNA, 30 bp, Artificial Sequence
  Synthetic
tgtaagtggaagacauagaatagactuggt

SEQ ID NO: 97773 - DNA, 28 bp, Artificial Sequence
  Synthetic
gaacgactuaaagatgattugggaacaa

SEQ ID NO: 97774 - DNA, 28 bp, Artificial Sequence
  Synthetic
gcttgactgaaaaacucctcacactuat

SEQ ID NO: 97775 - DNA, 22 bp, Artificial Sequence
  Synthetic
atcacaggugatggcctgauac

SEQ ID NO: 97776 - DNA, 25 bp, Artificial Sequence
  Synthetic
agtgatgaaautccctugacacaca

SEQ ID NO: 97777 - DNA, 28 bp, Artificial Sequence
  Synthetic
gaacgcgagtuacctatttttgtaauga

SEQ ID NO: 97778 - DNA, 21 bp, Artificial Sequence
  Synthetic
caagtggugttgcctcucagt

SEQ ID NO: 97779 - DNA, 28 bp, Artificial Sequence
  Synthetic
tgaaugtttaataagguagcaacagcct

SEQ ID NO: 97780 - DNA, 27 bp, Artificial Sequence
  Synthetic
ctgtagtgagtuctttggatgacaauc

SEQ ID NO: 97781 - DNA, 28 bp, Artificial Sequence
  Synthetic
acgattttgctugtgtgtatgttttuct

SEQ ID NO: 97782 - DNA, 28 bp, Artificial Sequence
  Synthetic
aggtttcccaacautttccaagaauact

SEQ ID NO: 97783 - DNA, 22 bp, Artificial Sequence
  Synthetic
gtcauaaaacacgacggtgucc

SEQ ID NO: 97784 - DNA, 27 bp, Artificial Sequence
  Synthetic
acagttactgugcataatcagccttua

SEQ ID NO: 97785 - DNA, 28 bp, Artificial Sequence
  Synthetic
ggcaaaagcuttatataccagucagagg

SEQ ID NO: 97786 - DNA, 25 bp, Artificial Sequence
  Synthetic
ccgtaccacagguataaaccttgua

SEQ ID NO: 97787 - DNA, 25 bp, Artificial Sequence
  Synthetic
gtctttgcatcucctgatcctaucc

SEQ ID NO: 97788 - DNA, 27 bp, Artificial Sequence
  Synthetic
tgaaaggaaaautgcagctgaaugaaa

SEQ ID NO: 97789 - DNA, 29 bp, Artificial Sequence
  Synthetic
ccaaactgtgtacuctgctgtatacuaaa

SEQ ID NO: 97790 - DNA, 27 bp, Artificial Sequence
  Synthetic
gtggagaguattacgaagaaucaacca

SEQ ID NO: 97791 - DNA, 26 bp, Artificial Sequence
  Synthetic
agtgtcatctgugaagacaaacugat

SEQ ID NO: 97792 - DNA, 23 bp, Artificial Sequence
  Synthetic
acugaagagcattuccagcaaga

SEQ ID NO: 97793 - DNA, 24 bp, Artificial Sequence
  Synthetic
tggtgagcuctttgactucaaagg

SEQ ID NO: 97794 - DNA, 24 bp, Artificial Sequence
  Synthetic
ctatcuggaagcaaagcattuggt

SEQ ID NO: 97795 - DNA, 28 bp, Artificial Sequence
  Synthetic
gcgatggatttuctaatcgtgatgttut

SEQ ID NO: 97796 - DNA, 22 bp, Artificial Sequence
  Synthetic
cccaaacuggcattcaaaccut

SEQ ID NO: 97797 - DNA, 23 bp, Artificial Sequence
  Synthetic
ggtatcataugcctgcaacccut

SEQ ID NO: 97798 - DNA, 29 bp, Artificial Sequence
  Synthetic
ccaagaaatctgaugacactagaaaugga

SEQ ID NO: 97799 - DNA, 24 bp, Artificial Sequence
  Synthetic
ctaagugagcagaaacctgtugga

SEQ ID NO: 97800 - DNA, 25 bp, Artificial Sequence
  Synthetic
ttgtactgacautgtgacatgcuct

SEQ ID NO: 97801 - DNA, 28 bp, Artificial Sequence
  Synthetic
ccccagacacucttgaattaaccattua

SEQ ID NO: 97802 - DNA, 25 bp, Artificial Sequence
  Synthetic
caatttcaatggcuttagggtcucc

SEQ ID NO: 97803 - DNA, 23 bp, Artificial Sequence
  Synthetic
gcataaacuggagggtgctcuat

SEQ ID NO: 97804 - DNA, 21 bp, Artificial Sequence
  Synthetic
gttggaacugacccaaggcua

SEQ ID NO: 97805 - DNA, 24 bp, Artificial Sequence
  Synthetic
ggcttcacuggatacgtttaugga

SEQ ID NO: 97806 - DNA, 26 bp, Artificial Sequence
  Synthetic
cagtttgatgccacuaagacttcauc

SEQ ID NO: 97807 - DNA, 24 bp, Artificial Sequence
  Synthetic
gcttccaattuatgcccagaucca

SEQ ID NO: 97808 - DNA, 25 bp, Artificial Sequence
  Synthetic
ctgggcataaautggaagctgttut

SEQ ID NO: 97809 - DNA, 30 bp, Artificial Sequence
  Synthetic
aatgcttaaaugacagtgattatagugaca

SEQ ID NO: 97810 - DNA, 24 bp, Artificial Sequence
  Synthetic
gcaugctatuggaagaggaagaca

SEQ ID NO: 97811 - DNA, 26 bp, Artificial Sequence
  Synthetic
ggagtcagtcguaattggaatcaucc

SEQ ID NO: 97812 - DNA, 23 bp, Artificial Sequence
  Synthetic
gcataccutcacacctuggaagt

SEQ ID NO: 97813 - DNA, 19 bp, Artificial Sequence
  Synthetic
ccacgcccguttcgaaaug

SEQ ID NO: 97814 - DNA, 27 bp, Artificial Sequence
  Synthetic
tcatatgatacugtgttttccccucat

SEQ ID NO: 97815 - DNA, 25 bp, Artificial Sequence
  Synthetic
gauagccagaaacacaacatuccag

SEQ ID NO: 97816 - DNA, 27 bp, Artificial Sequence
  Synthetic
caaagaccatccaaugtagtagccaut

SEQ ID NO: 97817 - DNA, 28 bp, Artificial Sequence
  Synthetic
aatgtgaaataccugagttggatgacut

SEQ ID NO: 97818 - DNA, 28 bp, Artificial Sequence
  Synthetic
gtttgacccacaguaaaatcatuaccaa

SEQ ID NO: 97819 - DNA, 25 bp, Artificial Sequence
  Synthetic
agttgcaaaautgctgtaguaccct

SEQ ID NO: 97820 - DNA, 28 bp, Artificial Sequence
  Synthetic
tgatttgtggcutataacatgacacuga

SEQ ID NO: 97821 - DNA, 24 bp, Artificial Sequence
  Synthetic
catgagaugtggaacucacaggaa

SEQ ID NO: 97822 - DNA, 20 bp, Artificial Sequence
  Synthetic
tggagtgtguggctgtgaug

SEQ ID NO: 97823 - DNA, 18 bp, Artificial Sequence
  Synthetic
cgccugagacacggtcug

SEQ ID NO: 97824 - DNA, 17 bp, Artificial Sequence
  Synthetic
cctggcccugtggugat

SEQ ID NO: 97825 - DNA, 25 bp, Artificial Sequence
  Synthetic
acucgccttagauggaagagaaaga

SEQ ID NO: 97826 - DNA, 29 bp, Artificial Sequence
  Synthetic
cagtagcaaaugaaataggaactcucaga

SEQ ID NO: 97827 - DNA, 22 bp, Artificial Sequence
  Synthetic
tcacctcagaucggtcagtuca

SEQ ID NO: 97828 - DNA, 24 bp, Artificial Sequence
  Synthetic
agaacctcuaacagcttugcacaa

SEQ ID NO: 97829 - DNA, 18 bp, Artificial Sequence
  Synthetic
gcagttucgcaggauggg

SEQ ID NO: 97830 - DNA, 17 bp, Artificial Sequence
  Synthetic
cuccagcacagccgcua

SEQ ID NO: 97831 - DNA, 17 bp, Artificial Sequence
  Synthetic
ggagcaccagccucuga

SEQ ID NO: 97832 - DNA, 18 bp, Artificial Sequence
  Synthetic
gcccatccugcgaaacug

SEQ ID NO: 97833 - DNA, 21 bp, Artificial Sequence
  Synthetic
ggaaaggugaggccactuact

SEQ ID NO: 97834 - DNA, 18 bp, Artificial Sequence
  Synthetic
cctcagaggcuggtgcuc

SEQ ID NO: 97835 - DNA, 20 bp, Artificial Sequence
  Synthetic
ggacagcaaggcucctccua

SEQ ID NO: 97836 - DNA, 26 bp, Artificial Sequence
  Synthetic
ctgtagactgatuccaaagcggtaut

SEQ ID NO: 97837 - DNA, 28 bp, Artificial Sequence
  Synthetic
cggttcaaaacuacttccacaatcaauc

SEQ ID NO: 97838 - DNA, 22 bp, Artificial Sequence
  Synthetic
gctcatuagaaggctggagugt

SEQ ID NO: 97839 - DNA, 29 bp, Artificial Sequence
  Synthetic
gccttccagttuataagatagtccaucaa

SEQ ID NO: 97840 - DNA, 27 bp, Artificial Sequence
  Synthetic
acagttttggugttttatgtcuccaga

SEQ ID NO: 97841 - DNA, 24 bp, Artificial Sequence
  Synthetic
ccgtcagaaagugtaaccactgut

SEQ ID NO: 97842 - DNA, 23 bp, Artificial Sequence
  Synthetic
ccgggcguctctactgatgauat

SEQ ID NO: 97843 - DNA, 26 bp, Artificial Sequence
  Synthetic
ttagtcaggaagccutgaaaauggaa

SEQ ID NO: 97844 - DNA, 28 bp, Artificial Sequence
  Synthetic
ttcatgttctttugcagtttctctttut

SEQ ID NO: 97845 - DNA, 26 bp, Artificial Sequence
  Synthetic
ccccgttacugcttgaagattaugat

SEQ ID NO: 97846 - DNA, 28 bp, Artificial Sequence
  Synthetic
tttttccagcaugacatagaguacaaca

SEQ ID NO: 97847 - DNA, 23 bp, Artificial Sequence
  Synthetic
gtctgctcugctcttccttctuc

SEQ ID NO: 97848 - DNA, 25 bp, Artificial Sequence
  Synthetic
gtttctugcctcttgtuccaaaact

SEQ ID NO: 97849 - DNA, 23 bp, Artificial Sequence
  Synthetic
cggtggcaaggutgatacttcug

SEQ ID NO: 97850 - DNA, 26 bp, Artificial Sequence
  Synthetic
caggtgtcugctttggtatttaaugg

SEQ ID NO: 97851 - DNA, 22 bp, Artificial Sequence
  Synthetic
tctgcagtutctgcttcugcat

SEQ ID NO: 97852 - DNA, 22 bp, Artificial Sequence
  Synthetic
agaagcagcuccgugaagaaag

SEQ ID NO: 97853 - DNA, 23 bp, Artificial Sequence
  Synthetic
cagctccgacagacugattctua

SEQ ID NO: 97854 - DNA, 20 bp, Artificial Sequence
  Synthetic
ctgcacttcuctgtgggtug

SEQ ID NO: 97855 - DNA, 26 bp, Artificial Sequence
  Synthetic
accaaatugaagaggcagaagagtut

SEQ ID NO: 97856 - DNA, 28 bp, Artificial Sequence
  Synthetic
tgcttgtatttuaggaacacctcaucaa

SEQ ID NO: 97857 - DNA, 18 bp, Artificial Sequence
  Synthetic
cgtgaccgucgtgagcug

SEQ ID NO: 97858 - DNA, 20 bp, Artificial Sequence
  Synthetic
caacagcccaagugcaagug

SEQ ID NO: 97859 - DNA, 25 bp, Artificial Sequence
  Synthetic
augctgctttuggaaaacaaacaga

SEQ ID NO: 97860 - DNA, 23 bp, Artificial Sequence
  Synthetic
cagutttguagacagaggccact

SEQ ID NO: 97861 - DNA, 25 bp, Artificial Sequence
  Synthetic
agcccgcagauaaagtgaagattut

SEQ ID NO: 97862 - DNA, 27 bp, Artificial Sequence
  Synthetic
acctttgtgagaaauaacgtcttcuga

SEQ ID NO: 97863 - DNA, 28 bp, Artificial Sequence
  Synthetic
gcaggaagaautagaaaagtttgaugct

SEQ ID NO: 97864 - DNA, 25 bp, Artificial Sequence
  Synthetic
gctatccaagagacugagctgttuc

SEQ ID NO: 97865 - DNA, 26 bp, Artificial Sequence
  Synthetic
gttttgtcucaagcttcuccagagat

SEQ ID NO: 97866 - DNA, 24 bp, Artificial Sequence
  Synthetic
ccgtagatuttcggtcauccaaca

SEQ ID NO: 97867 - DNA, 28 bp, Artificial Sequence
  Synthetic
tcagatcctttcauatgtgcatacauac

SEQ ID NO: 97868 - DNA, 23 bp, Artificial Sequence
  Synthetic
ccagtgcucaaactcggtauagt

SEQ ID NO: 97869 - DNA, 24 bp, Artificial Sequence
  Synthetic
agggtcaguatctctctccugaag

SEQ ID NO: 97870 - DNA, 28 bp, Artificial Sequence
  Synthetic
acatcacctucctattttgcatugaaga

SEQ ID NO: 97871 - DNA, 28 bp, Artificial Sequence
  Synthetic
ctgaaggaattcauagcaccctcaauat

SEQ ID NO: 97872 - DNA, 23 bp, Artificial Sequence
  Synthetic
ccgtgtcaaacuggatggtuact

SEQ ID NO: 97873 - DNA, 26 bp, Artificial Sequence
  Synthetic
catcacatgatauactccgagtcugg

SEQ ID NO: 97874 - DNA, 28 bp, Artificial Sequence
  Synthetic
ggtgctatgaautccttcaggaauaaga

SEQ ID NO: 97875 - DNA, 20 bp, Artificial Sequence
  Synthetic
ttctcccacagcutgcagut

SEQ ID NO: 97876 - DNA, 28 bp, Artificial Sequence
  Synthetic
gtacaaatgcuaaagcaaaatggccuaa

SEQ ID NO: 97877 - DNA, 22 bp, Artificial Sequence
  Synthetic
tgtgactggacuatcaccguca

SEQ ID NO: 97878 - DNA, 29 bp, Artificial Sequence
  Synthetic
cagattauaaagaacgaagggtguaacca

SEQ ID NO: 97879 - DNA, 24 bp, Artificial Sequence
  Synthetic
gggttatcgacuggaaggaacauc

SEQ ID NO: 97880 - DNA, 25 bp, Artificial Sequence
  Synthetic
gccaaggagauaacatagtcugcat

SEQ ID NO: 97881 - DNA, 26 bp, Artificial Sequence
  Synthetic
tgtggaggcaauttaacaggatctuc

SEQ ID NO: 97882 - DNA, 26 bp, Artificial Sequence
  Synthetic
ggaagttuggtgaaagaauaaagcct

SEQ ID NO: 97883 - DNA, 26 bp, Artificial Sequence
  Synthetic
gtctgtacaaagccucataagctcut

SEQ ID NO: 97884 - DNA, 23 bp, Artificial Sequence
  Synthetic
caccaccaagacagaugatcuct

SEQ ID NO: 97885 - DNA, 23 bp, Artificial Sequence
  Synthetic
accttgtgaagaucctggcatuc

SEQ ID NO: 97886 - DNA, 25 bp, Artificial Sequence
  Synthetic
gaacccgatucgactaccatatuga

SEQ ID NO: 97887 - DNA, 29 bp, Artificial Sequence
  Synthetic
aaccactatcatuttctttgtccttucct

SEQ ID NO: 97888 - DNA, 23 bp, Artificial Sequence
  Synthetic
aggcaggaaccautaaaacauca

SEQ ID NO: 97889 - DNA, 24 bp, Artificial Sequence
  Synthetic
gttcacgaucacatttccacucac

SEQ ID NO: 97890 - DNA, 20 bp, Artificial Sequence
  Synthetic
ccatttctccuggcgctgut

SEQ ID NO: 97891 - DNA, 19 bp, Artificial Sequence
  Synthetic
ccaggugaagcgcaacuca

SEQ ID NO: 97892 - DNA, 25 bp, Artificial Sequence
  Synthetic
gattacctttauggagagtggguga

SEQ ID NO: 97893 - DNA, 23 bp, Artificial Sequence
  Synthetic
ggcatccucctccagatacucaa

SEQ ID NO: 97894 - DNA, 21 bp, Artificial Sequence
  Synthetic
gccagccuctctccatcuaca

SEQ ID NO: 97895 - DNA, 21 bp, Artificial Sequence
  Synthetic
ccgccuagacttcatccugat

SEQ ID NO: 97896 - DNA, 31 bp, Artificial Sequence
  Synthetic
atgcatataaattctuacccatgatagcaut

SEQ ID NO: 97897 - DNA, 28 bp, Artificial Sequence
  Synthetic
tgctatagguaggaagtgttgtacagut

SEQ ID NO: 97898 - DNA, 22 bp, Artificial Sequence
  Synthetic
tttcctcaggcccucaagagua

SEQ ID NO: 97899 - DNA, 21 bp, Artificial Sequence
  Synthetic
cccaaaccugctccaugaagt

SEQ ID NO: 97900 - DNA, 23 bp, Artificial Sequence
  Synthetic
cccttggagaaggugtcctttut

SEQ ID NO: 97901 - DNA, 28 bp, Artificial Sequence
  Synthetic
tcttccaacttuaccatacggaattuca

SEQ ID NO: 97902 - DNA, 28 bp, Artificial Sequence
  Synthetic
gaggttccaaaacguaaatccactttua

SEQ ID NO: 97903 - DNA, 21 bp, Artificial Sequence
  Synthetic
caggaatuaggagcucgcgaa

SEQ ID NO: 97904 - DNA, 24 bp, Artificial Sequence
  Synthetic
catcccaatuagaggagctagcug

SEQ ID NO: 97905 - DNA, 28 bp, Artificial Sequence
  Synthetic
caagttcctuatacaatccacuaaccaa

SEQ ID NO: 97906 - DNA, 25 bp, Artificial Sequence
  Synthetic
ctggtttacuctcttgcugaagact

SEQ ID NO: 97907 - DNA, 25 bp, Artificial Sequence
  Synthetic
gaatattcttcutctgctcctugcc

SEQ ID NO: 97908 - DNA, 25 bp, Artificial Sequence
  Synthetic
gcaacaccaggacutctgaaaatuc

SEQ ID NO: 97909 - DNA, 21 bp, Artificial Sequence
  Synthetic
agtccucactgaugagccact

SEQ ID NO: 97910 - DNA, 27 bp, Artificial Sequence
  Synthetic
gaaaggcaguacaaacagtuaaaacct

SEQ ID NO: 97911 - DNA, 20 bp, Artificial Sequence
  Synthetic
cagugcacagccaauggaac

SEQ ID NO: 97912 - DNA, 21 bp, Artificial Sequence
  Synthetic
gcugagcctggucaagacaac

SEQ ID NO: 97913 - DNA, 22 bp, Artificial Sequence
  Synthetic
gucttccctctugccaaagact

SEQ ID NO: 97914 - DNA, 28 bp, Artificial Sequence
  Synthetic
tgtacagutaggtaaagtuccagaccat

SEQ ID NO: 97915 - DNA, 28 bp, Artificial Sequence
  Synthetic
cgaattgauggcacaacattttctagut

SEQ ID NO: 97916 - DNA, 24 bp, Artificial Sequence
  Synthetic
tccagaaaggaugtatcccuccat

SEQ ID NO: 97917 - DNA, 27 bp, Artificial Sequence
  Synthetic
aacactttgttttauagctgtgcagug

SEQ ID NO: 97918 - DNA, 24 bp, Artificial Sequence
  Synthetic
attggaaaugttcctcuccccaaa

SEQ ID NO: 97919 - DNA, 24 bp, Artificial Sequence
  Synthetic
gtttttacaugagccauccagcaa

SEQ ID NO: 97920 - DNA, 24 bp, Artificial Sequence
  Synthetic
gggcaguaatccgaucaaccaaat

SEQ ID NO: 97921 - DNA, 27 bp, Artificial Sequence
  Synthetic
catcacactuacagaacttgctgatuc

SEQ ID NO: 97922 - DNA, 28 bp, Artificial Sequence
  Synthetic
gcttgttattgggautagggaaaacuct

SEQ ID NO: 97923 - DNA, 27 bp, Artificial Sequence
  Synthetic
gtaaacatatctuggaagcccagatug

SEQ ID NO: 97924 - DNA, 25 bp, Artificial Sequence
  Synthetic
gggaatatugcgccaaaatccuact

SEQ ID NO: 97925 - DNA, 21 bp, Artificial Sequence
  Synthetic
agcaatgcacaaugtgtcugg

SEQ ID NO: 97926 - DNA, 24 bp, Artificial Sequence
  Synthetic
ttctgtagaggugagtcagtugga

SEQ ID NO: 97927 - DNA, 19 bp, Artificial Sequence
  Synthetic
gcctgcugcttcagctuca

SEQ ID NO: 97928 - DNA, 18 bp, Artificial Sequence
  Synthetic
gcaggacagaccguggug

SEQ ID NO: 97929 - DNA, 22 bp, Artificial Sequence
  Synthetic
cttggcauagacccagaaguga

SEQ ID NO: 97930 - DNA, 28 bp, Artificial Sequence
  Synthetic
ccttatttgtatucactgctgtgaugac

SEQ ID NO: 97931 - DNA, 26 bp, Artificial Sequence
  Synthetic
tcttttagtgaaaacgugtggctcua

SEQ ID NO: 97932 - DNA, 28 bp, Artificial Sequence
  Synthetic
ctaatccaaaaugcagaaatcagagcut

SEQ ID NO: 97933 - DNA, 20 bp, Artificial Sequence
  Synthetic
cugcacuccacacacgaaga

SEQ ID NO: 97934 - DNA, 22 bp, Artificial Sequence
  Synthetic
cctcucacagggtcaaugacac

SEQ ID NO: 97935 - DNA, 24 bp, Artificial Sequence
  Synthetic
gaautaggcttctugaggcagaga

SEQ ID NO: 97936 - DNA, 20 bp, Artificial Sequence
  Synthetic
ggacuaaccggcucagcaaa

SEQ ID NO: 97937 - DNA, 28 bp, Artificial Sequence
  Synthetic
gcattcttctcauatgctgactgauact

SEQ ID NO: 97938 - DNA, 21 bp, Artificial Sequence
  Synthetic
actttguccagccagguacac

SEQ ID NO: 97939 - DNA, 26 bp, Artificial Sequence
  Synthetic
gaagccatuaaagcaagguacaaaga

SEQ ID NO: 97940 - DNA, 26 bp, Artificial Sequence
  Synthetic
ccacatcagugctcagtttagtaaug

SEQ ID NO: 97941 - DNA, 28 bp, Artificial Sequence
  Synthetic
ccataatatcugaagaaaccctcuccct

SEQ ID NO: 97942 - DNA, 25 bp, Artificial Sequence
  Synthetic
gaataagaataucccacagcugcct

SEQ ID NO: 97943 - DNA, 22 bp, Artificial Sequence
  Synthetic
acaaaatgguggctttggcaut

SEQ ID NO: 97944 - DNA, 28 bp, Artificial Sequence
  Synthetic
tgttccctgctcuatagcctcattaaua

SEQ ID NO: 97945 - DNA, 27 bp, Artificial Sequence
  Synthetic
gcttuccagagaaacctgatugagaaa

SEQ ID NO: 97946 - DNA, 22 bp, Artificial Sequence
  Synthetic
tgttgcagccugagcttcuaaa

SEQ ID NO: 97947 - DNA, 22 bp, Artificial Sequence
  Synthetic
tttcugacgaaagccaccucaa

SEQ ID NO: 97948 - DNA, 28 bp, Artificial Sequence
  Synthetic
gctgcccugaaagttcaagatatauact

SEQ ID NO: 97949 - DNA, 23 bp, Artificial Sequence
  Synthetic
agtcccaaugctttctgttucca

SEQ ID NO: 97950 - DNA, 26 bp, Artificial Sequence
  Synthetic
acttgtctgtcutaaaacttgccugt

SEQ ID NO: 97951 - DNA, 24 bp, Artificial Sequence
  Synthetic
cacautttcccacucaagcagaag

SEQ ID NO: 97952 - DNA, 26 bp, Artificial Sequence
  Synthetic
acauaggaaaggaagaugaggagcat

SEQ ID NO: 97953 - DNA, 29 bp, Artificial Sequence
  Synthetic
gcaggttgaaacuactcagagaaagatuc

SEQ ID NO: 97954 - DNA, 22 bp, Artificial Sequence
  Synthetic
aagccctguacttcgatgucac

SEQ ID NO: 97955 - DNA, 19 bp, Artificial Sequence
  Synthetic
gccguguccaacaggagat

SEQ ID NO: 97956 - DNA, 21 bp, Artificial Sequence
  Synthetic
atgaatcacggcaguggtgua

SEQ ID NO: 97957 - DNA, 21 bp, Artificial Sequence
  Synthetic
ggaggcaagaaggagugucag

SEQ ID NO: 97958 - DNA, 29 bp, Artificial Sequence
  Synthetic
ggttttactatttucaggctgatttucct

SEQ ID NO: 97959 - DNA, 21 bp, Artificial Sequence
  Synthetic
cgctggacaccgugactatuc

SEQ ID NO: 97960 - DNA, 27 bp, Artificial Sequence
  Synthetic
cctaacattuacccaaggaatcuggat

SEQ ID NO: 97961 - DNA, 28 bp, Artificial Sequence
  Synthetic
gaagatcctggaautgatccttcaguag

SEQ ID NO: 97962 - DNA, 26 bp, Artificial Sequence
  Synthetic
gtccucaaggtgatttugaaagacag

SEQ ID NO: 97963 - DNA, 22 bp, Artificial Sequence
  Synthetic
catcaaugaccaggcactucca

SEQ ID NO: 97964 - DNA, 24 bp, Artificial Sequence
  Synthetic
ctgctgcttcutgctgttgtttua

SEQ ID NO: 97965 - DNA, 23 bp, Artificial Sequence
  Synthetic
gggaagccaaacuactggatgug

SEQ ID NO: 97966 - DNA, 23 bp, Artificial Sequence
  Synthetic
cacgtccuacactcagttctucc

SEQ ID NO: 97967 - DNA, 22 bp, Artificial Sequence
  Synthetic
acactcaaugacaagcgcguaa

SEQ ID NO: 97968 - DNA, 24 bp, Artificial Sequence
  Synthetic
ccagaacttutctgctagcuccat

SEQ ID NO: 97969 - DNA, 28 bp, Artificial Sequence
  Synthetic
gccttgtggauattgttttgcttcauag

SEQ ID NO: 97970 - DNA, 21 bp, Artificial Sequence
  Synthetic
gcctgcttuggtcagtacugt

SEQ ID NO: 97971 - DNA, 25 bp, Artificial Sequence
  Synthetic
agtccaaagaacutctgcatctuct

SEQ ID NO: 97972 - DNA, 24 bp, Artificial Sequence
  Synthetic
tgtttgtgcugaaggacacacuaa

SEQ ID NO: 97973 - DNA, 23 bp, Artificial Sequence
  Synthetic
tgatctggttcutgtcccactug

SEQ ID NO: 97974 - DNA, 23 bp, Artificial Sequence
  Synthetic
aactacaacutcttcccucgcaa

SEQ ID NO: 97975 - DNA, 23 bp, Artificial Sequence
  Synthetic
agcctucacaaaagacaccucat

SEQ ID NO: 97976 - DNA, 23 bp, Artificial Sequence
  Synthetic
gagaaggcagauttgtggucact

SEQ ID NO: 97977 - DNA, 27 bp, Artificial Sequence
  Synthetic
gtgtgacatctaauctcccccataaut

SEQ ID NO: 97978 - DNA, 28 bp, Artificial Sequence
  Synthetic
acagtttggttagugatgagttgtaucc

SEQ ID NO: 97979 - DNA, 20 bp, Artificial Sequence
  Synthetic
ccagtucaggcccctguaac

SEQ ID NO: 97980 - DNA, 20 bp, Artificial Sequence
  Synthetic
aggaaggccugaccctgtua

SEQ ID NO: 97981 - DNA, 21 bp, Artificial Sequence
  Synthetic
ggctttcutttgctccuccag

SEQ ID NO: 97982 - DNA, 26 bp, Artificial Sequence
  Synthetic
tgtcatgguagaagtttgcucaacaa

SEQ ID NO: 97983 - DNA, 20 bp, Artificial Sequence
  Synthetic
accttgaggugtcggttcug

SEQ ID NO: 97984 - DNA, 28 bp, Artificial Sequence
  Synthetic
caggaagtauagacggcttttatgtuga

SEQ ID NO: 97985 - DNA, 24 bp, Artificial Sequence
  Synthetic
ctgatatgauctggtgtugaccca

SEQ ID NO: 97986 - DNA, 28 bp, Artificial Sequence
  Synthetic
ctggcaaggaagaagautgaaauacaag

SEQ ID NO: 97987 - DNA, 21 bp, Artificial Sequence
  Synthetic
cccgugguagaaaccacaaca

SEQ ID NO: 97988 - DNA, 21 bp, Artificial Sequence
  Synthetic
attttcccugtgttgcuccct

SEQ ID NO: 97989 - DNA, 27 bp, Artificial Sequence
  Synthetic
ccacatataaugcaacagctagctuac

SEQ ID NO: 97990 - DNA, 22 bp, Artificial Sequence
  Synthetic
gactgagaagacgcugtaccug

SEQ ID NO: 97991 - DNA, 23 bp, Artificial Sequence
  Synthetic
cgacacgagguagtcaaacacut

SEQ ID NO: 97992 - DNA, 22 bp, Artificial Sequence
  Synthetic
aaaccgaaacagcucctctugt

SEQ ID NO: 97993 - DNA, 26 bp, Artificial Sequence
  Synthetic
agatcagaagagagaguccatuaccc

SEQ ID NO: 97994 - DNA, 23 bp, Artificial Sequence
  Synthetic
gcaggagaagugtttgacuacct

SEQ ID NO: 97995 - DNA, 19 bp, Artificial Sequence
  Synthetic
ccaugcccagctcucagac

SEQ ID NO: 97996 - DNA, 19 bp, Artificial Sequence
  Synthetic
cgtggtgaugccagctcua

SEQ ID NO: 97997 - DNA, 17 bp, Artificial Sequence
  Synthetic
agcccucgacucccact

SEQ ID NO: 97998 - DNA, 17 bp, Artificial Sequence
  Synthetic
ccuccagccccatgguc

SEQ ID NO: 97999 - DNA, 18 bp, Artificial Sequence
  Synthetic
gcagggccugaggaaugt

SEQ ID NO: 98000 - DNA, 21 bp, Artificial Sequence
  Synthetic
agcgctucgggtgaattcaua

SEQ ID NO: 98001 - DNA, 23 bp, Artificial Sequence
  Synthetic
ctccttaacaagcutccccucag

SEQ ID NO: 98002 - DNA, 27 bp, Artificial Sequence
  Synthetic
gatcgctgactuaaggtatcactguaa

SEQ ID NO: 98003 - DNA, 28 bp, Artificial Sequence
  Synthetic
gggtctttatuccagatgagatctucac

SEQ ID NO: 98004 - DNA, 23 bp, Artificial Sequence
  Synthetic
ccataaggaacutctgcagcuct

SEQ ID NO: 98005 - DNA, 28 bp, Artificial Sequence
  Synthetic
catgaaggtcuactaactgtaggugagt

SEQ ID NO: 98006 - DNA, 22 bp, Artificial Sequence
  Synthetic
aagcagacagugtaagggcaut

SEQ ID NO: 98007 - DNA, 20 bp, Artificial Sequence
  Synthetic
gaacagaugccguccaagga

SEQ ID NO: 98008 - DNA, 22 bp, Artificial Sequence
  Synthetic
catgaagtgcucaatggcaucc

SEQ ID NO: 98009 - DNA, 24 bp, Artificial Sequence
  Synthetic
acatgtgtatcugacaccctccut

SEQ ID NO: 98010 - DNA, 26 bp, Artificial Sequence
  Synthetic
tcagttttgtcuctaatgggcttuca

SEQ ID NO: 98011 - DNA, 26 bp, Artificial Sequence
  Synthetic
aatgcccaaaguatagttgcacagua

SEQ ID NO: 98012 - DNA, 19 bp, Artificial Sequence
  Synthetic
ccagcccacccutgtctut

SEQ ID NO: 98013 - DNA, 19 bp, Artificial Sequence
  Synthetic
gatuccaaggcagcctgug

SEQ ID NO: 98014 - DNA, 27 bp, Artificial Sequence
  Synthetic
ggacacactcucagaaataaagacgut

SEQ ID NO: 98015 - DNA, 28 bp, Artificial Sequence
  Synthetic
gggaaaaacatgcucaaaaggacaatua

SEQ ID NO: 98016 - DNA, 25 bp, Artificial Sequence
  Synthetic
cattaaggucagcgtcatgtcatug

SEQ ID NO: 98017 - DNA, 20 bp, Artificial Sequence
  Synthetic
cgctggugcagctctcauat

SEQ ID NO: 98018 - DNA, 21 bp, Artificial Sequence
  Synthetic
cctggacucacatgggtucac

SEQ ID NO: 98019 - DNA, 27 bp, Artificial Sequence
  Synthetic
ccccacttatcuttgtatatccctgut

SEQ ID NO: 98020 - DNA, 22 bp, Artificial Sequence
  Synthetic
tctggagcugcagagagtcuaa

SEQ ID NO: 98021 - DNA, 25 bp, Artificial Sequence
  Synthetic
gatgccatcaaauacaatgtccugt

SEQ ID NO: 98022 - DNA, 22 bp, Artificial Sequence
  Synthetic
ctgtcacucctgagatcugcaa

SEQ ID NO: 98023 - DNA, 27 bp, Artificial Sequence
  Synthetic
cgaagagugagggaaaagaataauggt

SEQ ID NO: 98024 - DNA, 29 bp, Artificial Sequence
  Synthetic
gttctgatugaccacacataatguagagt

SEQ ID NO: 98025 - DNA, 28 bp, Artificial Sequence
  Synthetic
gggacagcacutcttaccatgttuaaat

SEQ ID NO: 98026 - DNA, 22 bp, Artificial Sequence
  Synthetic
ccutcactttccugggcaacaa

SEQ ID NO: 98027 - DNA, 21 bp, Artificial Sequence
  Synthetic
tgtccaggguctctguccaat

SEQ ID NO: 98028 - DNA, 28 bp, Artificial Sequence
  Synthetic
gactctctgautctaatagggucaaagg

SEQ ID NO: 98029 - DNA, 20 bp, Artificial Sequence
  Synthetic
ctcaggcagccaugcuaact

SEQ ID NO: 98030 - DNA, 22 bp, Artificial Sequence
  Synthetic
gagtgcagugtttgugcaaact

SEQ ID NO: 98031 - DNA, 27 bp, Artificial Sequence
  Synthetic
agagtgctgttguttaagtcactacug

SEQ ID NO: 98032 - DNA, 21 bp, Artificial Sequence
  Synthetic
gggcttccauctcagatucct

SEQ ID NO: 98033 - DNA, 23 bp, Artificial Sequence
  Synthetic
ggatgaaagggcaaaucaaccut

SEQ ID NO: 98034 - DNA, 23 bp, Artificial Sequence
  Synthetic
agtggaaactugtgtcagagguc

SEQ ID NO: 98035 - DNA, 20 bp, Artificial Sequence
  Synthetic
agaacccgugtgttgctuca

SEQ ID NO: 98036 - DNA, 28 bp, Artificial Sequence
  Synthetic
aatgtgaagcuctgcattattacuccat

SEQ ID NO: 98037 - DNA, 26 bp, Artificial Sequence
  Synthetic
cccattgcaaaaguaggtgtattcug

SEQ ID NO: 98038 - DNA, 23 bp, Artificial Sequence
  Synthetic
gggttctcuaggtctcggtgaut

SEQ ID NO: 98039 - DNA, 25 bp, Artificial Sequence
  Synthetic
agtaaacagagaacacugccctuac

SEQ ID NO: 98040 - DNA, 25 bp, Artificial Sequence
  Synthetic
gtggttugggaaagatacctgauct

SEQ ID NO: 98041 - DNA, 25 bp, Artificial Sequence
  Synthetic
ccataggccugaacaaaatgactug

SEQ ID NO: 98042 - DNA, 28 bp, Artificial Sequence
  Synthetic
ctaatagctcuacccacaaattgtguca

SEQ ID NO: 98043 - DNA, 20 bp, Artificial Sequence
  Synthetic
gctataatcggcugccccut

SEQ ID NO: 98044 - DNA, 23 bp, Artificial Sequence
  Synthetic
gctacaggagcugtgcaguaaac

SEQ ID NO: 98045 - DNA, 22 bp, Artificial Sequence
  Synthetic
ggtgcttgugaaagcgacuact

SEQ ID NO: 98046 - DNA, 21 bp, Artificial Sequence
  Synthetic
gggaggguctggaagatgtua

SEQ ID NO: 98047 - DNA, 23 bp, Artificial Sequence
  Synthetic
ccagcccaagcagauatguaagg

SEQ ID NO: 98048 - DNA, 21 bp, Artificial Sequence
  Synthetic
agttggccutgtctttcuggt

SEQ ID NO: 98049 - DNA, 25 bp, Artificial Sequence
  Synthetic
tgtggaggagcugttttcttttuga

SEQ ID NO: 98050 - DNA, 21 bp, Artificial Sequence
  Synthetic
tgccccaacccaaauggaaua

SEQ ID NO: 98051 - DNA, 23 bp, Artificial Sequence
  Synthetic
gctgucaaacagaggtggaugag

SEQ ID NO: 98052 - DNA, 28 bp, Artificial Sequence
  Synthetic
taccatactgggcutctaaatttgauac

SEQ ID NO: 98053 - DNA, 28 bp, Artificial Sequence
  Synthetic
tcatatcaccaucaaggagaaggtttuc

SEQ ID NO: 98054 - DNA, 26 bp, Artificial Sequence
  Synthetic
tttcctcttaggcugaaaaccttcuc

SEQ ID NO: 98055 - DNA, 25 bp, Artificial Sequence
  Synthetic
acttcaggcccaucatacttcttuc

SEQ ID NO: 98056 - DNA, 20 bp, Artificial Sequence
  Synthetic
tgcucccgagctttuccaag

SEQ ID NO: 98057 - DNA, 28 bp, Artificial Sequence
  Synthetic
tgatacctttaaautctggccaucgaaa

SEQ ID NO: 98058 - DNA, 27 bp, Artificial Sequence
  Synthetic
ctctatacattagucagtggctcctug

SEQ ID NO: 98059 - DNA, 22 bp, Artificial Sequence
  Synthetic
cgtaaaactcgcuctcgcagut

SEQ ID NO: 98060 - DNA, 27 bp, Artificial Sequence
  Synthetic
ggccaaauaaaactaggtaugagagca

SEQ ID NO: 98061 - DNA, 27 bp, Artificial Sequence
  Synthetic
tgagaatgaagguggatgattgcuaag

SEQ ID NO: 98062 - DNA, 27 bp, Artificial Sequence
  Synthetic
actgtgttttcautccagtgtctuaca

SEQ ID NO: 98063 - DNA, 28 bp, Artificial Sequence
  Synthetic
cttcagttgttutcttgagatttcugct

SEQ ID NO: 98064 - DNA, 20 bp, Artificial Sequence
  Synthetic
cagcgucagcatugacaacc

SEQ ID NO: 98065 - DNA, 24 bp, Artificial Sequence
  Synthetic
acatcaaagaaaggcutccaguca

SEQ ID NO: 98066 - DNA, 21 bp, Artificial Sequence
  Synthetic
caacacacccuttgctuccac

SEQ ID NO: 98067 - DNA, 27 bp, Artificial Sequence
  Synthetic
gtctccagcaaagaugtatgtcttcut

SEQ ID NO: 98068 - DNA, 23 bp, Artificial Sequence
  Synthetic
ccgccuttaacuggagcaaaaac

SEQ ID NO: 98069 - DNA, 19 bp, Artificial Sequence
  Synthetic
agcccaccaaccucugaac

SEQ ID NO: 98070 - DNA, 21 bp, Artificial Sequence
  Synthetic
gcagaagcuggtggacuacat

SEQ ID NO: 98071 - DNA, 26 bp, Artificial Sequence
  Synthetic
agaaaggaaggacutactgcacuaac

SEQ ID NO: 98072 - DNA, 20 bp, Artificial Sequence
  Synthetic
tcagcacgccugactucaat

SEQ ID NO: 98073 - DNA, 24 bp, Artificial Sequence
  Synthetic
ctatcatgcccugtctctgtctug

SEQ ID NO: 98074 - DNA, 21 bp, Artificial Sequence
  Synthetic
catctgaggguggtcugcaaa

SEQ ID NO: 98075 - DNA, 25 bp, Artificial Sequence
  Synthetic
tctctttctttuggttcccctgaug

SEQ ID NO: 98076 - DNA, 28 bp, Artificial Sequence
  Synthetic
ccctacagctuaaactatgtaacacgua

SEQ ID NO: 98077 - DNA, 25 bp, Artificial Sequence
  Synthetic
ttatcttcaagcugcagtcttugga

SEQ ID NO: 98078 - DNA, 24 bp, Artificial Sequence
  Synthetic
ctttgccctcutgttccagaagua

SEQ ID NO: 98079 - DNA, 28 bp, Artificial Sequence
  Synthetic
cagttatttgcauctaacactttucgga

SEQ ID NO: 98080 - DNA, 25 bp, Artificial Sequence
  Synthetic
cagtgattcugaggtacaaagccua

SEQ ID NO: 98081 - DNA, 21 bp, Artificial Sequence
  Synthetic
gagccacacuctcaccaucag

SEQ ID NO: 98082 - DNA, 27 bp, Artificial Sequence
  Synthetic
tggacccuaatgacatgaugagagaaa

SEQ ID NO: 98083 - DNA, 23 bp, Artificial Sequence
  Synthetic
ccattaagugacagtcguggcaa

SEQ ID NO: 98084 - DNA, 21 bp, Artificial Sequence
  Synthetic
tgggagauggaagtcugcaag

SEQ ID NO: 98085 - DNA, 28 bp, Artificial Sequence
  Synthetic
tgtatcttcccugaacctgtaaattugg

SEQ ID NO: 98086 - DNA, 17 bp, Artificial Sequence
  Synthetic
ccggagagccccuguga

SEQ ID NO: 98087 - DNA, 18 bp, Artificial Sequence
  Synthetic
ggaggguccacgttguga

SEQ ID NO: 98088 - DNA, 21 bp, Artificial Sequence
  Synthetic
catucgaacagccccuaggag

SEQ ID NO: 98089 - DNA, 21 bp, Artificial Sequence
  Synthetic
ccatgccugtgaacgtgaugt

SEQ ID NO: 98090 - DNA, 23 bp, Artificial Sequence
  Synthetic
gccagguttttcucccaacagat

SEQ ID NO: 98091 - DNA, 21 bp, Artificial Sequence
  Synthetic
agctggtctucaagagcgaug

SEQ ID NO: 98092 - DNA, 19 bp, Artificial Sequence
  Synthetic
ggtccuggaagcactcgut

SEQ ID NO: 98093 - DNA, 21 bp, Artificial Sequence
  Synthetic
ccagctucgggacttctgtuc

SEQ ID NO: 98094 - DNA, 22 bp, Artificial Sequence
  Synthetic
tccatuaacacatgggtuggct

SEQ ID NO: 98095 - DNA, 21 bp, Artificial Sequence
  Synthetic
agagugagcactggguaacct

SEQ ID NO: 98096 - DNA, 22 bp, Artificial Sequence
  Synthetic
gacgtccccagugcagtaauag

SEQ ID NO: 98097 - DNA, 21 bp, Artificial Sequence
  Synthetic
gcatttgcccuctgacatgut

SEQ ID NO: 98098 - DNA, 24 bp, Artificial Sequence
  Synthetic
gacagacacuaagttgtgcugagt

SEQ ID NO: 98099 - DNA, 25 bp, Artificial Sequence
  Synthetic
gcattactuaccatgcttcauccca

SEQ ID NO: 98100 - DNA, 26 bp, Artificial Sequence
  Synthetic
tggaattccuccctaccatgtatuct

SEQ ID NO: 98101 - DNA, 18 bp, Artificial Sequence
  Synthetic
tgggagcutgcggttcug

SEQ ID NO: 98102 - DNA, 19 bp, Artificial Sequence
  Synthetic
gcgggaucggaatgtugga

SEQ ID NO: 98103 - DNA, 21 bp, Artificial Sequence
  Synthetic
ccguaggttttcugcaggcat

SEQ ID NO: 98104 - DNA, 24 bp, Artificial Sequence
  Synthetic
cactccgtaucttcctcgcatuat

SEQ ID NO: 98105 - DNA, 20 bp, Artificial Sequence
  Synthetic
cttgguccgtagactuggct

SEQ ID NO: 98106 - DNA, 21 bp, Artificial Sequence
  Synthetic
ggctccggcaaugagaauagg

SEQ ID NO: 98107 - DNA, 17 bp, Artificial Sequence
  Synthetic
gcacggacggugucagt

SEQ ID NO: 98108 - DNA, 25 bp, Artificial Sequence
  Synthetic
cacaagcatacccuccttagttcut

SEQ ID NO: 98109 - DNA, 21 bp, Artificial Sequence
  Synthetic
ctagcccuggaggctacuact

SEQ ID NO: 98110 - DNA, 25 bp, Artificial Sequence
  Synthetic
cagtgagtgaaaugtgctctaaugt

SEQ ID NO: 98111 - DNA, 28 bp, Artificial Sequence
  Synthetic
cacactctgattuttgtgtctgtttcug

SEQ ID NO: 98112 - DNA, 24 bp, Artificial Sequence
  Synthetic
tcttttgcucttttcccuaggcaa

SEQ ID NO: 98113 - DNA, 25 bp, Artificial Sequence
  Synthetic
catacaagttgugttcctccatucc

SEQ ID NO: 98114 - DNA, 23 bp, Artificial Sequence
  Synthetic
acacagtagucagtgctggttug

SEQ ID NO: 98115 - DNA, 20 bp, Artificial Sequence
  Synthetic
cccccaccugtttcctucag

SEQ ID NO: 98116 - DNA, 26 bp, Artificial Sequence
  Synthetic
accctaataucctaaccatugggact

SEQ ID NO: 98117 - DNA, 24 bp, Artificial Sequence
  Synthetic
gggacaaattugagccatgactug

SEQ ID NO: 98118 - DNA, 28 bp, Artificial Sequence
  Synthetic
tgtttcatttggauccttctttgacuca

SEQ ID NO: 98119 - DNA, 29 bp, Artificial Sequence
  Synthetic
gcautttactaagacugaaagcagaacaa

SEQ ID NO: 98120 - DNA, 19 bp, Artificial Sequence
  Synthetic
actccugcaaggcacacuc

SEQ ID NO: 98121 - DNA, 18 bp, Artificial Sequence
  Synthetic
gcacccagggcutccaut

SEQ ID NO: 98122 - DNA, 24 bp, Artificial Sequence
  Synthetic
tgtcaaggtgucagaacactgaug

SEQ ID NO: 98123 - DNA, 21 bp, Artificial Sequence
  Synthetic
attggcaugcctcttugcaag

SEQ ID NO: 98124 - DNA, 25 bp, Artificial Sequence
  Synthetic
cctctttcuagagaaggctaugcag

SEQ ID NO: 98125 - DNA, 25 bp, Artificial Sequence
  Synthetic
ccaggacaaccuatcaugcaaaagt

SEQ ID NO: 98126 - DNA, 29 bp, Artificial Sequence
  Synthetic
tcttgcctaggutttctttcatactuacc

SEQ ID NO: 98127 - DNA, 23 bp, Artificial Sequence
  Synthetic
gttccuggacccaccattaugat

SEQ ID NO: 98128 - DNA, 23 bp, Artificial Sequence
  Synthetic
cttaccagaugacccctcaaucc

SEQ ID NO: 98129 - DNA, 26 bp, Artificial Sequence
  Synthetic
acggttacucaggaatacatttuccc

SEQ ID NO: 98130 - DNA, 26 bp, Artificial Sequence
  Synthetic
cttcgttcagaguttaaagcaugcaa

SEQ ID NO: 98131 - DNA, 25 bp, Artificial Sequence
  Synthetic
ctgttagccugaggtcttttgguat

SEQ ID NO: 98132 - DNA, 20 bp, Artificial Sequence
  Synthetic
gtggcacagcuagacgcuaa

SEQ ID NO: 98133 - DNA, 22 bp, Artificial Sequence
  Synthetic
ctcccaagguccatagctcauc

SEQ ID NO: 98134 - DNA, 24 bp, Artificial Sequence
  Synthetic
tttccatggtcutctcaactgcut

SEQ ID NO: 98135 - DNA, 27 bp, Artificial Sequence
  Synthetic
gcagtgtgacuttaataggaugaccag

SEQ ID NO: 98136 - DNA, 24 bp, Artificial Sequence
  Synthetic
catccattccucctgctgtaucat

SEQ ID NO: 98137 - DNA, 22 bp, Artificial Sequence
  Synthetic
tttcctcuctggcccuacaaga

SEQ ID NO: 98138 - DNA, 22 bp, Artificial Sequence
  Synthetic
gggagacucccattttgaugac

SEQ ID NO: 98139 - DNA, 22 bp, Artificial Sequence
  Synthetic
tcacccagaugtgtgacttucc

SEQ ID NO: 98140 - DNA, 22 bp, Artificial Sequence
  Synthetic
caccagaaguccatgtccacut

SEQ ID NO: 98141 - DNA, 28 bp, Artificial Sequence
  Synthetic
gtgatggtgacuatcatgtatttucaca

SEQ ID NO: 98142 - DNA, 23 bp, Artificial Sequence
  Synthetic
acuagcagaaaattgugggccaa

SEQ ID NO: 98143 - DNA, 28 bp, Artificial Sequence
  Synthetic
tcttccaugggcaactaagtaaucaaat

SEQ ID NO: 98144 - DNA, 26 bp, Artificial Sequence
  Synthetic
ctgctttacctutctgattcagguga

SEQ ID NO: 98145 - DNA, 28 bp, Artificial Sequence
  Synthetic
gtacatcgcuacaattaucagcaaaaca

SEQ ID NO: 98146 - DNA, 22 bp, Artificial Sequence
  Synthetic
ctgtcccttugcttggactcua

SEQ ID NO: 98147 - DNA, 21 bp, Artificial Sequence
  Synthetic
agatgttgucgtgcuccacag

SEQ ID NO: 98148 - DNA, 21 bp, Artificial Sequence
  Synthetic
aatgcucaggagcagaagucc

SEQ ID NO: 98149 - DNA, 24 bp, Artificial Sequence
  Synthetic
gcagctacugacttccttcttuga

SEQ ID NO: 98150 - DNA, 20 bp, Artificial Sequence
  Synthetic
cctguggagagcacgtctuc

SEQ ID NO: 98151 - DNA, 19 bp, Artificial Sequence
  Synthetic
ggaaucgccccagggatua

SEQ ID NO: 98152 - DNA, 28 bp, Artificial Sequence
  Synthetic
aaaaatgttcagccacutagagatcuca

SEQ ID NO: 98153 - DNA, 24 bp, Artificial Sequence
  Synthetic
ctgatgttccuataatccggccut

SEQ ID NO: 98154 - DNA, 19 bp, Artificial Sequence
  Synthetic
ggacggcugcaaggtaguc

SEQ ID NO: 98155 - DNA, 25 bp, Artificial Sequence
  Synthetic
tctcaaatcgcutttacacccugat

SEQ ID NO: 98156 - DNA, 26 bp, Artificial Sequence
  Synthetic
gggcacaagaaacuctaaagctcaua

SEQ ID NO: 98157 - DNA, 28 bp, Artificial Sequence
  Synthetic
catcttagacacauggaacaatggaaut

SEQ ID NO: 98158 - DNA, 20 bp, Artificial Sequence
  Synthetic
ggutccguggacaacaacct

SEQ ID NO: 98159 - DNA, 21 bp, Artificial Sequence
  Synthetic
gcagagccugttgaagttgug

SEQ ID NO: 98160 - DNA, 22 bp, Artificial Sequence
  Synthetic
ggcttctucatcccaaagucgt

SEQ ID NO: 98161 - DNA, 21 bp, Artificial Sequence
  Synthetic
ctgctcccucagtcttgcaut

SEQ ID NO: 98162 - DNA, 19 bp, Artificial Sequence
  Synthetic
agccccugacttccctcut

SEQ ID NO: 98163 - DNA, 23 bp, Artificial Sequence
  Synthetic
guaaaggaagccaacauccgagt

SEQ ID NO: 98164 - DNA, 21 bp, Artificial Sequence
  Synthetic
aactccugaaggctcttggug

SEQ ID NO: 98165 - DNA, 27 bp, Artificial Sequence
  Synthetic
aattugaacagaggagguggaaaagat

SEQ ID NO: 98166 - DNA, 29 bp, Artificial Sequence
  Synthetic
gcttcctttactucctccatcttcttaut

SEQ ID NO: 98167 - DNA, 23 bp, Artificial Sequence
  Synthetic
gaagcaaaggagagcugtgaaug

SEQ ID NO: 98168 - DNA, 23 bp, Artificial Sequence
  Synthetic
cctcactctccuctgtcttccut

SEQ ID NO: 98169 - DNA, 22 bp, Artificial Sequence
  Synthetic
tttgcaagtgutccagttggug

SEQ ID NO: 98170 - DNA, 20 bp, Artificial Sequence
  Synthetic
cacggaaggugggatuggat

SEQ ID NO: 98171 - DNA, 20 bp, Artificial Sequence
  Synthetic
gacaggaggcgauggagtuc

SEQ ID NO: 98172 - DNA, 17 bp, Artificial Sequence
  Synthetic
ctcactgggugcccgut

SEQ ID NO: 98173 - DNA, 18 bp, Artificial Sequence
  Synthetic
ccacccugtgcccauact

SEQ ID NO: 98174 - DNA, 21 bp, Artificial Sequence
  Synthetic
tccattgccugttgcuagcat

SEQ ID NO: 98175 - DNA, 21 bp, Artificial Sequence
  Synthetic
ggcttctacuccgcttcctug

SEQ ID NO: 98176 - DNA, 17 bp, Artificial Sequence
  Synthetic
ccacugcagccaucgca

SEQ ID NO: 98177 - DNA, 23 bp, Artificial Sequence
  Synthetic
gggaccaauacagaggtctcuga

SEQ ID NO: 98178 - DNA, 21 bp, Artificial Sequence
  Synthetic
cccacgtccaugaaaggctut

SEQ ID NO: 98179 - DNA, 21 bp, Artificial Sequence
  Synthetic
cagaacgugtccagctucgat

SEQ ID NO: 98180 - DNA, 28 bp, Artificial Sequence
  Synthetic
ctgaattacttugaacttcggatgctut

SEQ ID NO: 98181 - DNA, 26 bp, Artificial Sequence
  Synthetic
gacaagtuggaaagacctccactuat

SEQ ID NO: 98182 - DNA, 21 bp, Artificial Sequence
  Synthetic
ctttggctucagcaacgagut

SEQ ID NO: 98183 - DNA, 19 bp, Artificial Sequence
  Synthetic
gcugacgagggtguacagg

SEQ ID NO: 98184 - DNA, 22 bp, Artificial Sequence
  Synthetic
ggaaacautaccuggagccaga

SEQ ID NO: 98185 - DNA, 26 bp, Artificial Sequence
  Synthetic
gcagggctaagagutcttctaccaua

SEQ ID NO: 98186 - DNA, 19 bp, Artificial Sequence
  Synthetic
tctggagccugggagucat

SEQ ID NO: 98187 - DNA, 18 bp, Artificial Sequence
  Synthetic
ccagucccaccacugagg

SEQ ID NO: 98188 - DNA, 25 bp, Artificial Sequence
  Synthetic
ctttcgauggccagaattuaaaggt

SEQ ID NO: 98189 - DNA, 27 bp, Artificial Sequence
  Synthetic
acagtcugtggacatauagaagggaat

SEQ ID NO: 98190 - DNA, 23 bp, Artificial Sequence
  Synthetic
gagtttuacgagggaaguaccgt

SEQ ID NO: 98191 - DNA, 26 bp, Artificial Sequence
  Synthetic
aatgctcttcggutcctggaatatut

SEQ ID NO: 98192 - DNA, 26 bp, Artificial Sequence
  Synthetic
gtgtgggtatugttgcattgtttcut

SEQ ID NO: 98193 - DNA, 28 bp, Artificial Sequence
  Synthetic
tgctgtguagcatataguaacagaaacc

SEQ ID NO: 98194 - DNA, 25 bp, Artificial Sequence
  Synthetic
gttacatgccutgaagtgaugagga

SEQ ID NO: 98195 - DNA, 27 bp, Artificial Sequence
  Synthetic
ggtaaaatccacugtaacggctcuaac

SEQ ID NO: 98196 - DNA, 26 bp, Artificial Sequence
  Synthetic
ttctgctgaacaaaugagtcactuct

SEQ ID NO: 98197 - DNA, 23 bp, Artificial Sequence
  Synthetic
cacacacaaugcgtatgactugg

SEQ ID NO: 98198 - DNA, 28 bp, Artificial Sequence
  Synthetic
gaagaagggattcutacatcgatgacut

SEQ ID NO: 98199 - DNA, 24 bp, Artificial Sequence
  Synthetic
tcctgggtcucttttgtgctaauc

SEQ ID NO: 98200 - DNA, 21 bp, Artificial Sequence
  Synthetic
gggtgttauggttggcacaut

SEQ ID NO: 98201 - DNA, 21 bp, Artificial Sequence
  Synthetic
agcactugcgtactccaucac

SEQ ID NO: 98202 - DNA, 21 bp, Artificial Sequence
  Synthetic
gtcccctucggagctttcuat

SEQ ID NO: 98203 - DNA, 18 bp, Artificial Sequence
  Synthetic
cggaauccgggaaccgua

SEQ ID NO: 98204 - DNA, 21 bp, Artificial Sequence
  Synthetic
ctggugatggaguacgcaagt

SEQ ID NO: 98205 - DNA, 21 bp, Artificial Sequence
  Synthetic
gagcttccutctccttcaugc
